United States Patent 7,374,927 (METHODS OF ANALYSIS OF DEGRADED NUCLEIC ACID SAMPLES) - sequence listing, part 8

SEQ ID NO: 280469 - DNA, 25 bp, Homo sapien
cttcgtagactctggaatggagctg

SEQ ID NO: 280470 - DNA, 25 bp, Homo sapien
aagctgtcatcctcagcacactaac

SEQ ID NO: 280471 - DNA, 25 bp, Homo sapien
gtcatcctcagcacactaacgcagg

SEQ ID NO: 280472 - DNA, 25 bp, Homo sapien
gggagaactttccagccatgttgga

SEQ ID NO: 280473 - DNA, 25 bp, Homo sapien
cagccatgttggaactacatttgga

SEQ ID NO: 280474 - DNA, 25 bp, Homo sapien
ttaaacatttcccagcacacacctg

SEQ ID NO: 280475 - DNA, 25 bp, Homo sapien
acacacctggatctgcatctgctgt

SEQ ID NO: 280476 - DNA, 25 bp, Homo sapien
atctgcatctgctgtgtcaattgaa

SEQ ID NO: 280477 - DNA, 25 bp, Homo sapien
gagcctggtgggaagtatttggatc

SEQ ID NO: 280478 - DNA, 25 bp, Homo sapien
ggatcatgagagaggatccttcatg

SEQ ID NO: 280479 - DNA, 25 bp, Homo sapien
gatccttcatgaatggctcagcacc

SEQ ID NO: 280480 - DNA, 25 bp, Homo sapien
tcaattcacatagatatggttgttt

SEQ ID NO: 280481 - DNA, 25 bp, Homo sapien
tcccctctttctcgccatgtgatat

SEQ ID NO: 280482 - DNA, 25 bp, Homo sapien
tctttctcgccatgtgatatgcctg

SEQ ID NO: 280483 - DNA, 25 bp, Homo sapien
ttcaccttccgcctttactgtaagc

SEQ ID NO: 280484 - DNA, 25 bp, Homo sapien
ccgcctttactgtaagcttcctgag

SEQ ID NO: 280485 - DNA, 25 bp, Homo sapien
gagcaaatgttggtgccatgccagt

SEQ ID NO: 280486 - DNA, 25 bp, Homo sapien
gcaaatgttggtgccatgccagtac

SEQ ID NO: 280487 - DNA, 25 bp, Homo sapien
aatgttggtgccatgccagtacagc

SEQ ID NO: 280488 - DNA, 25 bp, Homo sapien
acgattagggaaaatatgctgctgt

SEQ ID NO: 280489 - DNA, 25 bp, Homo sapien
atatgctgctgtgggttaacaactc

SEQ ID NO: 280490 - DNA, 25 bp, Homo sapien
tgtgggttaacaactcagaaagtcc

SEQ ID NO: 280491 - DNA, 25 bp, Homo sapien
agaaagtccctgatccacatttggc

SEQ ID NO: 280492 - DNA, 25 bp, Homo sapien
tgatccacatttggctgtttactaa

SEQ ID NO: 280493 - DNA, 25 bp, Homo sapien
ggctgtttactaaagcttgtgatta

SEQ ID NO: 280494 - DNA, 25 bp, Homo sapien
gcttgtgattaactttttggcagtg

SEQ ID NO: 280495 - DNA, 25 bp, Homo sapien
ttggcagtgtgtactatgctctatt

SEQ ID NO: 280496 - DNA, 25 bp, Homo sapien
gtgtgtactatgctctattgctata

SEQ ID NO: 280497 - DNA, 25 bp, Homo sapien
gctctattgctatatatgctatcta

SEQ ID NO: 280498 - DNA, 25 bp, Homo sapien
tctatagttttgaagtttggttaag

SEQ ID NO: 280499 - DNA, 25 bp, Homo sapien
tgctggagctcttaagttagacctg

SEQ ID NO: 280500 - DNA, 25 bp, Homo sapien
gctggagctcttaagttagacctgg

SEQ ID NO: 280501 - DNA, 25 bp, Homo sapien
ctggagctcttaagttagacctggg

SEQ ID NO: 280502 - DNA, 25 bp, Homo sapien
tggagctcttaagttagacctggga

SEQ ID NO: 280503 - DNA, 25 bp, Homo sapien
ggagctcttaagttagacctgggac

SEQ ID NO: 280504 - DNA, 25 bp, Homo sapien
gagctcttaagttagacctgggact

SEQ ID NO: 280505 - DNA, 25 bp, Homo sapien
agctcttaagttagacctgggactt

SEQ ID NO: 280506 - DNA, 25 bp, Homo sapien
tagacctgggacttttctctactaa

SEQ ID NO: 280507 - DNA, 25 bp, Homo sapien
tactacaattgctaaatatgcacag

SEQ ID NO: 280508 - DNA, 25 bp, Homo sapien
attgctaaatatgcacagtaccagg

SEQ ID NO: 280509 - DNA, 25 bp, Homo sapien
ttgctaaatatgcacagtaccaggc

SEQ ID NO: 280510 - DNA, 25 bp, Homo sapien
tcctgaacaagggagacttctaaga

SEQ ID NO: 280511 - DNA, 25 bp, Homo sapien
acttctaagaaggtaggagttgagc

SEQ ID NO: 280512 - DNA, 25 bp, Homo sapien
ctcctgagcatcacaaccatctggg

SEQ ID NO: 280513 - DNA, 25 bp, Homo sapien
aaatgaagttgctcagccgttgaga

SEQ ID NO: 280514 - DNA, 25 bp, Homo sapien
agttgctcagccgttgagaactgct

SEQ ID NO: 280515 - DNA, 25 bp, Homo sapien
gccgttgagaactgctggaaagccc

SEQ ID NO: 280516 - DNA, 25 bp, Homo sapien
gagaactgctggaaagcccagctta

SEQ ID NO: 280517 - DNA, 25 bp, Homo sapien
gaaagcccagcttaacaagttgttt

SEQ ID NO: 280518 - DNA, 25 bp, Homo sapien
gcccagcttaacaagttgtttgctt

SEQ ID NO: 280519 - DNA, 25 bp, Homo sapien
agttgtttgcttgggtggactctgc

SEQ ID NO: 280520 - DNA, 25 bp, Homo sapien
ttccagtcctggtgtgttgctggga

SEQ ID NO: 280521 - DNA, 25 bp, Homo sapien
gccacacttgcgctgcgcttgtgtg

SEQ ID NO: 280522 - DNA, 25 bp, Homo sapien
gggagatatgacaaggcctgcctgc

SEQ ID NO: 280523 - DNA, 25 bp, Homo sapien
tgcacttttgcacccaaactctgga

SEQ ID NO: 280524 - DNA, 25 bp, Homo sapien
tttgcacccaaactctggacgtcag

SEQ ID NO: 280525 - DNA, 25 bp, Homo sapien
aactctggacgtcagcagtaattca

SEQ ID NO: 280526 - DNA, 25 bp, Homo sapien
tcagcagtaattcaaggacggcaga

SEQ ID NO: 280527 - DNA, 25 bp, Homo sapien
agtcaaggaccaacaaagcaagcag

SEQ ID NO: 280528 - DNA, 25 bp, Homo sapien
aagcaagcaggctttagacctccac

SEQ ID NO: 280529 - DNA, 25 bp, Homo sapien
atggactgtccaactacagaggaag

SEQ ID NO: 280530 - DNA, 25 bp, Homo sapien
gtccaactacagaggaagcttccgg

SEQ ID NO: 280531 - DNA, 25 bp, Homo sapien
agggaatctgcagctctcacatcgg

SEQ ID NO: 280532 - DNA, 25 bp, Homo sapien
agggagaccaacttatttagagcga

SEQ ID NO: 280533 - DNA, 25 bp, Homo sapien
gagaccaacttatttagagcgaatt

SEQ ID NO: 280534 - DNA, 25 bp, Homo sapien
atttagagcgaattggacatggata

SEQ ID NO: 280535 - DNA, 25 bp, Homo sapien
gacatggataaaaaccccagtggga

SEQ ID NO: 280536 - DNA, 25 bp, Homo sapien
gagtgacctctgataaattactgct

SEQ ID NO: 280537 - DNA, 25 bp, Homo sapien
gtgacctctgataaattactgctag

SEQ ID NO: 280538 - DNA, 25 bp, Homo sapien
attactgctagaatgaacttgtcaa

SEQ ID NO: 280539 - DNA, 25 bp, Homo sapien
tgtcaatgatggatggtaaattttc

SEQ ID NO: 280540 - DNA, 25 bp, Homo sapien
ttgcttttacccctgtcagtagccc

SEQ ID NO: 280541 - DNA, 25 bp, Homo sapien
tacccctccttctaactttattgct

SEQ ID NO: 280542 - DNA, 25 bp, Homo sapien
ctcttcactctatatttctctctat

SEQ ID NO: 280543 - DNA, 25 bp, Homo sapien
tgccaggctgcctttagggtccctg

SEQ ID NO: 280544 - DNA, 25 bp, Homo sapien
ttagggtccctgtagacccaggaga

SEQ ID NO: 280545 - DNA, 25 bp, Homo sapien
tccctgtagacccaggagagttgag

SEQ ID NO: 280546 - DNA, 25 bp, Homo sapien
tggaggaatgctggctttgagccct

SEQ ID NO: 280547 - DNA, 25 bp, Homo sapien
gaatgctggctttgagccctctaca

SEQ ID NO: 280548 - DNA, 25 bp, Homo sapien
tgagccctctacactgctggttgta

SEQ ID NO: 280549 - DNA, 25 bp, Homo sapien
gccctctacactgctggttgtatga

SEQ ID NO: 280550 - DNA, 25 bp, Homo sapien
tacactgctggttgtatgaccttgg

SEQ ID NO: 280551 - DNA, 25 bp, Homo sapien
ctgctggttgtatgaccttggacaa

SEQ ID NO: 280552 - DNA, 25 bp, Homo sapien
ggatctctgaaaccttcctacccta

SEQ ID NO: 280553 - DNA, 25 bp, Homo sapien
ttggatgtggaagtaaaagtgctgc

SEQ ID NO: 280554 - DNA, 25 bp, Homo sapien
ttgagattagaatagaacaggctct

SEQ ID NO: 280555 - DNA, 25 bp, Homo sapien
agaacaggctctattcatgcaaact

SEQ ID NO: 280556 - DNA, 25 bp, Homo sapien
gaacaggctctattcatgcaaacta

SEQ ID NO: 280557 - DNA, 25 bp, Homo sapien
acaggctctattcatgcaaactata

SEQ ID NO: 280558 - DNA, 25 bp, Homo sapien
tcttcattaattggagcttctgggc

SEQ ID NO: 280559 - DNA, 25 bp, Homo sapien
cttcattaattggagcttctgggca

SEQ ID NO: 280560 - DNA, 25 bp, Homo sapien
cattaattggagcttctgggcaaca

SEQ ID NO: 280561 - DNA, 25 bp, Homo sapien
ttaattggagcttctgggcaacatc

SEQ ID NO: 280562 - DNA, 25 bp, Homo sapien
cacatgttgtgttcagctttctgtt

SEQ ID NO: 280563 - DNA, 25 bp, Homo sapien
atgttgtgttcagctttctgtttta

SEQ ID NO: 280564 - DNA, 25 bp, Homo sapien
atattatttgccattgagattagaa

SEQ ID NO: 280565 - DNA, 25 bp, Homo sapien
acttgtctagtttcacaggttcatg

SEQ ID NO: 280566 - DNA, 25 bp, Homo sapien
gtctagtttcacaggttcatgctgg

SEQ ID NO: 280567 - DNA, 25 bp, Homo sapien
ctagtttcacaggttcatgctggag

SEQ ID NO: 280568 - DNA, 25 bp, Homo sapien
tttgcctcagggtgaaaccttgagt

SEQ ID NO: 280569 - DNA, 25 bp, Homo sapien
gggtgaaaccttgagtatgcctgta

SEQ ID NO: 280570 - DNA, 25 bp, Homo sapien
gaaaccttgagtatgcctgtacctg

SEQ ID NO: 280571 - DNA, 25 bp, Homo sapien
aaccttgagtatgcctgtacctgat

SEQ ID NO: 280572 - DNA, 25 bp, Homo sapien
tgagtatgcctgtacctgatctaaa

SEQ ID NO: 280573 - DNA, 25 bp, Homo sapien
gtatgcctgtacctgatctaaatga

SEQ ID NO: 280574 - DNA, 25 bp, Homo sapien
atgcctgtacctgatctaaatgata

SEQ ID NO: 280575 - DNA, 25 bp, Homo sapien
gcctgtacctgatctaaatgatatt

SEQ ID NO: 280576 - DNA, 25 bp, Homo sapien
ctgtgcccagccagacttccattaa

SEQ ID NO: 280577 - DNA, 25 bp, Homo sapien
ccagccagacttccattaatctttt

SEQ ID NO: 280578 - DNA, 25 bp, Homo sapien
gccagacttccattaatcttttaaa

SEQ ID NO: 280579 - DNA, 25 bp, Homo sapien
attaagctataatactcattaagaa

SEQ ID NO: 280580 - DNA, 25 bp, Homo sapien
tgtacatatcataatttcacaccta

SEQ ID NO: 280581 - DNA, 25 bp, Homo sapien
atttcacacctagatgagtttttca

SEQ ID NO: 280582 - DNA, 25 bp, Homo sapien
tcacacctagatgagtttttcaaat

SEQ ID NO: 280583 - DNA, 25 bp, Homo sapien
cacctagatgagtttttcaaatttt

SEQ ID NO: 280584 - DNA, 25 bp, Homo sapien
aaacatctgtataactaagatcaag

SEQ ID NO: 280585 - DNA, 25 bp, Homo sapien
aagatcaagtacagcatcaagaata

SEQ ID NO: 280586 - DNA, 25 bp, Homo sapien
gtacagcatcaagaataagaaacag

SEQ ID NO: 280587 - DNA, 25 bp, Homo sapien
ggatttcaggaagtcgtcatatttg

SEQ ID NO: 280588 - DNA, 25 bp, Homo sapien
tatttgagcacttggcgagggatcc

SEQ ID NO: 280589 - DNA, 25 bp, Homo sapien
aagggcagcacccatccatgttgta

SEQ ID NO: 280590 - DNA, 25 bp, Homo sapien
atccatgttgtacttctgctgcact

SEQ ID NO: 280591 - DNA, 25 bp, Homo sapien
ggaccacttgggtgttggccgacct

SEQ ID NO: 280592 - DNA, 25 bp, Homo sapien
gacctccggaagatgccctcggtgg

SEQ ID NO: 280593 - DNA, 25 bp, Homo sapien
taggcaacagtctccctgagtacaa

SEQ ID NO: 280594 - DNA, 25 bp, Homo sapien
ggaatgggctcctgctctggattct

SEQ ID NO: 280595 - DNA, 25 bp, Homo sapien
ctgctctggattcttctcctggagg

SEQ ID NO: 280596 - DNA, 25 bp, Homo sapien
aggtgctgcagcgagactccaaact

SEQ ID NO: 280597 - DNA, 25 bp, Homo sapien
gagactccaaactgctggttgggca

SEQ ID NO: 280598 - DNA, 25 bp, Homo sapien
gtgtcttgtcagtccaagaagtgac

SEQ ID NO: 280599 - DNA, 25 bp, Homo sapien
gaagtgacaccgagatgttaatttt

SEQ ID NO: 280600 - DNA, 25 bp, Homo sapien
gtgccttgtttcctagcccacaaga

SEQ ID NO: 280601 - DNA, 25 bp, Homo sapien
gtttcctagcccacaagaatgcaaa

SEQ ID NO: 280602 - DNA, 25 bp, Homo sapien
actaacaaagaacgagcacttcctt

SEQ ID NO: 280603 - DNA, 25 bp, Homo sapien
atcaaacagatactcgctagcctca

SEQ ID NO: 280604 - DNA, 25 bp, Homo sapien
agatactcgctagcctcatttaaat

SEQ ID NO: 280605 - DNA, 25 bp, Homo sapien
aggaggagtgcatctttggccgaca

SEQ ID NO: 280606 - DNA, 25 bp, Homo sapien
atctttggccgacagtggtgtaact

SEQ ID NO: 280607 - DNA, 25 bp, Homo sapien
gcacttcctttcagagtttctgaga

SEQ ID NO: 280608 - DNA, 25 bp, Homo sapien
ataatgtacgtggaacagtctgggt

SEQ ID NO: 280609 - DNA, 25 bp, Homo sapien
gaatgcagagcctctccgcatgtgt

SEQ ID NO: 280610 - DNA, 25 bp, Homo sapien
gcgcgtggccgtgtctgtgtatttc

SEQ ID NO: 280611 - DNA, 25 bp, Homo sapien
gtctgtgtatttctacgtgtgtcgc

SEQ ID NO: 280612 - DNA, 25 bp, Homo sapien
ttctacgtgtgtcgctcttcagaag

SEQ ID NO: 280613 - DNA, 25 bp, Homo sapien
acacgcaaggtcatggccccagcgg

SEQ ID NO: 280614 - DNA, 25 bp, Homo sapien
ggtgcctggcggacagaacttcaga

SEQ ID NO: 280615 - DNA, 25 bp, Homo sapien
agaacttcagagaccacgcagcctt

SEQ ID NO: 280616 - DNA, 25 bp, Homo sapien
agaccacgcagccttccttcgaaga

SEQ ID NO: 280617 - DNA, 25 bp, Homo sapien
ggaggaccaccctggcggagacatt

SEQ ID NO: 280618 - DNA, 25 bp, Homo sapien
tggcggagacattgctgatccctgg

SEQ ID NO: 280619 - DNA, 25 bp, Homo sapien
tgatccctggcttggagctccttgg

SEQ ID NO: 280620 - DNA, 25 bp, Homo sapien
tgtgtttttgtaataccagtggagc

SEQ ID NO: 280621 - DNA, 25 bp, Homo sapien
gtgtttttgtaataccagtggagcc

SEQ ID NO: 280622 - DNA, 25 bp, Homo sapien
tgtttttgtaataccagtggagcct

SEQ ID NO: 280623 - DNA, 25 bp, Homo sapien
gtttttgtaataccagtggagcctt

SEQ ID NO: 280624 - DNA, 25 bp, Homo sapien
tttttgtaataccagtggagccttt

SEQ ID NO: 280625 - DNA, 25 bp, Homo sapien
ttttgtaataccagtggagcctttt

SEQ ID NO: 280626 - DNA, 25 bp, Homo sapien
tttgtaataccagtggagccttttc

SEQ ID NO: 280627 - DNA, 25 bp, Homo sapien
ttgtaataccagtggagccttttct

SEQ ID NO: 280628 - DNA, 25 bp, Homo sapien
gaaactaggcaaacctaagacaatt

SEQ ID NO: 280629 - DNA, 25 bp, Homo sapien
aacctaagacaattatgcttaagga

SEQ ID NO: 280630 - DNA, 25 bp, Homo sapien
gaaacggatcaaatggaatggctca

SEQ ID NO: 280631 - DNA, 25 bp, Homo sapien
cgtagtagctgttcaactcctagta

SEQ ID NO: 280632 - DNA, 25 bp, Homo sapien
agctgttcaactcctagtacttaga

SEQ ID NO: 280633 - DNA, 25 bp, Homo sapien
actcctagtacttagaaatacacgt

SEQ ID NO: 280634 - DNA, 25 bp, Homo sapien
tacacgtatggttaatgttcagtcc

SEQ ID NO: 280635 - DNA, 25 bp, Homo sapien
gtatggttaatgttcagtccaacaa

SEQ ID NO: 280636 - DNA, 25 bp, Homo sapien
ccaacaaaccacacacagtaaatgt

SEQ ID NO: 280637 - DNA, 25 bp, Homo sapien
tgtttattaatagtcatggttcgta

SEQ ID NO: 280638 - DNA, 25 bp, Homo sapien
catggttcgtattttaggtgactga

SEQ ID NO: 280639 - DNA, 25 bp, Homo sapien
attttaggtgactgaaattgcaaca

SEQ ID NO: 280640 - DNA, 25 bp, Homo sapien
attgcaacagtgatcataatgaggt

SEQ ID NO: 280641 - DNA, 25 bp, Homo sapien
gtcatataaacgtcctgtttctgtt

SEQ ID NO: 280642 - DNA, 25 bp, Homo sapien
agctggtcccgggagatgtccgagg

SEQ ID NO: 280643 - DNA, 25 bp, Homo sapien
gtcccgggagatgtccgaggacctc

SEQ ID NO: 280644 - DNA, 25 bp, Homo sapien
tcccgggagatgtccgaggacctcg

SEQ ID NO: 280645 - DNA, 25 bp, Homo sapien
agatgtccgaggacctcggcgcgcc

SEQ ID NO: 280646 - DNA, 25 bp, Homo sapien
aagagggctggtggacgggatgtcc

SEQ ID NO: 280647 - DNA, 25 bp, Homo sapien
ctggtggacgggatgtccccgggag

SEQ ID NO: 280648 - DNA, 25 bp, Homo sapien
gaggcccctcacctcttgcagggcg

SEQ ID NO: 280649 - DNA, 25 bp, Homo sapien
caacaccgatgggatttgggaagga

SEQ ID NO: 280650 - DNA, 25 bp, Homo sapien
accgatgggatttgggaaggagctc

SEQ ID NO: 280651 - DNA, 25 bp, Homo sapien
tgggatttgggaaggagctcggaat

SEQ ID NO: 280652 - DNA, 25 bp, Homo sapien
ggaaggagctcggaatggagccgct

SEQ ID NO: 280653 - DNA, 25 bp, Homo sapien
gaagttttctcttactggtgtatat

SEQ ID NO: 280654 - DNA, 25 bp, Homo sapien
agtgcctctcactgttctagtatca

SEQ ID NO: 280655 - DNA, 25 bp, Homo sapien
actgttctagtatcactctgcaaaa

SEQ ID NO: 280656 - DNA, 25 bp, Homo sapien
ttagacatgcctcatcagcagttgg

SEQ ID NO: 280657 - DNA, 25 bp, Homo sapien
cttactggtgtatatttggtcattt

SEQ ID NO: 280658 - DNA, 25 bp, Homo sapien
ggattcttttccttcccataactct

SEQ ID NO: 280659 - DNA, 25 bp, Homo sapien
tccttcccataactctggctagtag

SEQ ID NO: 280660 - DNA, 25 bp, Homo sapien
aactctggctagtagttaacagcta

SEQ ID NO: 280661 - DNA, 25 bp, Homo sapien
ataatctcctaaaggcttgctcgct

SEQ ID NO: 280662 - DNA, 25 bp, Homo sapien
aaggcttgctcgctgtgacatctaa

SEQ ID NO: 280663 - DNA, 25 bp, Homo sapien
gtgacatctaatacttgcagttgta

SEQ ID NO: 280664 - DNA, 25 bp, Homo sapien
agaagggaacttgccatcaagattc

SEQ ID NO: 280665 - DNA, 25 bp, Homo sapien
aagggaacttgccatcaagattcct

SEQ ID NO: 280666 - DNA, 25 bp, Homo sapien
gggaacttgccatcaagattcctgt

SEQ ID NO: 280667 - DNA, 25 bp, Homo sapien
gggtgcagccggagaccccgccgag

SEQ ID NO: 280668 - DNA, 25 bp, Homo sapien
catccccgcatgcttctagggagcg

SEQ ID NO: 280669 - DNA, 25 bp, Homo sapien
atccccgcatgcttctagggagcgc

SEQ ID NO: 280670 - DNA, 25 bp, Homo sapien
cgcatgcttctagggagcgcctctt

SEQ ID NO: 280671 - DNA, 25 bp, Homo sapien
atgcttctagggagcgcctcttttc

SEQ ID NO: 280672 - DNA, 25 bp, Homo sapien
tagggagcgcctcttttccgttctt

SEQ ID NO: 280673 - DNA, 25 bp, Homo sapien
gcctcttttccgttcttgaggaatt

SEQ ID NO: 280674 - DNA, 25 bp, Homo sapien
tttccgttcttgaggaatttctgtt

SEQ ID NO: 280675 - DNA, 25 bp, Homo sapien
cctagccttcttttcacatgtctaa

SEQ ID NO: 280676 - DNA, 25 bp, Homo sapien
ttcacatgtctaatcttttcctttc

SEQ ID NO: 280677 - DNA, 25 bp, Homo sapien
tcttttcctttctcatggtgccctc

SEQ ID NO: 280678 - DNA, 25 bp, Homo sapien
catggtgccctccatggaagtcaca

SEQ ID NO: 280679 - DNA, 25 bp, Homo sapien
ggaagtcacagtcaacactgaataa

SEQ ID NO: 280680 - DNA, 25 bp, Homo sapien
gtgtgttcatctgtctgcatgtgga

SEQ ID NO: 280681 - DNA, 25 bp, Homo sapien
gttcatctgtctgcatgtggatcaa

SEQ ID NO: 280682 - DNA, 25 bp, Homo sapien
tgtctgcatgtggatcaatttcttt

SEQ ID NO: 280683 - DNA, 25 bp, Homo sapien
tttggagttatattctgattacagt

SEQ ID NO: 280684 - DNA, 25 bp, Homo sapien
tgattacagtgctccctctcccaaa

SEQ ID NO: 280685 - DNA, 25 bp, Homo sapien
taaaatgtataatctggtctcaggt

SEQ ID NO: 280686 - DNA, 25 bp, Homo sapien
aagtgggtgggcaccacttttcaca

SEQ ID NO: 280687 - DNA, 25 bp, Homo sapien
ggtgggcaccacttttcacacccaa

SEQ ID NO: 280688 - DNA, 25 bp, Homo sapien
tctttccatgcccaaaacaccgtgg

SEQ ID NO: 280689 - DNA, 25 bp, Homo sapien
gtgtgctgggctgcactgacatgca

SEQ ID NO: 280690 - DNA, 25 bp, Homo sapien
tgggctgcactgacatgcattccgg

SEQ ID NO: 280691 - DNA, 25 bp, Homo sapien
atgcattccggctcagagttggctt

SEQ ID NO: 280692 - DNA, 25 bp, Homo sapien
ctcagagttggcttcacccttaaca

SEQ ID NO: 280693 - DNA, 25 bp, Homo sapien
ttcacccttaacagcgggtactggg

SEQ ID NO: 280694 - DNA, 25 bp, Homo sapien
gggactctgtggacacatggacaac

SEQ ID NO: 280695 - DNA, 25 bp, Homo sapien
gtggacacatggacaactttactta

SEQ ID NO: 280696 - DNA, 25 bp, Homo sapien
catggacaactttacttaactctaa

SEQ ID NO: 280697 - DNA, 25 bp, Homo sapien
atgagggtagcaggtaagatattta

SEQ ID NO: 280698 - DNA, 25 bp, Homo sapien
taattgtactttttgtgtaacctgt

SEQ ID NO: 280699 - DNA, 25 bp, Homo sapien
ttgtactttttgtgtaacctgtttg

SEQ ID NO: 280700 - DNA, 25 bp, Homo sapien
ggaggaatttctgctctagagctaa

SEQ ID NO: 280701 - DNA, 25 bp, Homo sapien
gaaataaactaaatcattcagccct

SEQ ID NO: 280702 - DNA, 25 bp, Homo sapien
tgtttttaggtagttggcaaatcac

SEQ ID NO: 280703 - DNA, 25 bp, Homo sapien
ggaatttctgctctagagctaatga

SEQ ID NO: 280704 - DNA, 25 bp, Homo sapien
gttggcaaatcacaaattggacatt

SEQ ID NO: 280705 - DNA, 25 bp, Homo sapien
cacaaattggacatttagtcagtat

SEQ ID NO: 280706 - DNA, 25 bp, Homo sapien
ctgctctagagctaatgatatttgc

SEQ ID NO: 280707 - DNA, 25 bp, Homo sapien
tctagagctaatgatatttgctttt

SEQ ID NO: 280708 - DNA, 25 bp, Homo sapien
aaactgcactactcctttattgatc

SEQ ID NO: 280709 - DNA, 25 bp, Homo sapien
tattgatccttagcaccttgtacac

SEQ ID NO: 280710 - DNA, 25 bp, Homo sapien
aaagtgtctatgtctcatacatctt

SEQ ID NO: 280711 - DNA, 25 bp, Homo sapien
gtctcatacatctttttattaccat

SEQ ID NO: 280712 - DNA, 25 bp, Homo sapien
gaatttgcacatctgacataatagg

SEQ ID NO: 280713 - DNA, 25 bp, Homo sapien
gcacatctgacataataggaactta

SEQ ID NO: 280714 - DNA, 25 bp, Homo sapien
gtatgggtgaacaatcaaggactct

SEQ ID NO: 280715 - DNA, 25 bp, Homo sapien
ggtgaacaatcaaggactctagaat

SEQ ID NO: 280716 - DNA, 25 bp, Homo sapien
ggactctagaatgtcttagtgcttt

SEQ ID NO: 280717 - DNA, 25 bp, Homo sapien
ctagaatgtcttagtgctttcaaaa

SEQ ID NO: 280718 - DNA, 25 bp, Homo sapien
tttcaaaacttagtgcttatggact

SEQ ID NO: 280719 - DNA, 25 bp, Homo sapien
ctaaagctctctgagaagatctcat

SEQ ID NO: 280720 - DNA, 25 bp, Homo sapien
gaagatctcatactgtgtctcctac

SEQ ID NO: 280721 - DNA, 25 bp, Homo sapien
aatgggcactgattgagggtcttcc

SEQ ID NO: 280722 - DNA, 25 bp, Homo sapien
gtctcctacatttcatcttctataa

SEQ ID NO: 280723 - DNA, 25 bp, Homo sapien
actgattgagggtcttcctggtgtg

SEQ ID NO: 280724 - DNA, 25 bp, Homo sapien
tcatttctttctctggatttggaaa

SEQ ID NO: 280725 - DNA, 25 bp, Homo sapien
gctgttagtttacacttgcattgtt

SEQ ID NO: 280726 - DNA, 25 bp, Homo sapien
tggtgtggcatcatcaaatccctgt

SEQ ID NO: 280727 - DNA, 25 bp, Homo sapien
atcatcaaatccctgttgctcaaac

SEQ ID NO: 280728 - DNA, 25 bp, Homo sapien
cctgttgctcaaacccactaattag

SEQ ID NO: 280729 - DNA, 25 bp, Homo sapien
acccactaattagctcattcttatc

SEQ ID NO: 280730 - DNA, 25 bp, Homo sapien
gcgtggtgcttaggtcctgtccgca

SEQ ID NO: 280731 - DNA, 25 bp, Homo sapien
gtgcttaggtcctgtccgcaaggga

SEQ ID NO: 280732 - DNA, 25 bp, Homo sapien
gcttaggtcctgtccgcaagggatc

SEQ ID NO: 280733 - DNA, 25 bp, Homo sapien
gtcagagtggacaaagcctacgaca

SEQ ID NO: 280734 - DNA, 25 bp, Homo sapien
aagcctacgacaatggccagtacca

SEQ ID NO: 280735 - DNA, 25 bp, Homo sapien
gacaatggccagtaccagctattag

SEQ ID NO: 280736 - DNA, 25 bp, Homo sapien
atggccagtaccagctattaggcat

SEQ ID NO: 280737 - DNA, 25 bp, Homo sapien
gccagtaccagctattaggcattcc

SEQ ID NO: 280738 - DNA, 25 bp, Homo sapien
ttggtggtactggagcttccctacc

SEQ ID NO: 280739 - DNA, 25 bp, Homo sapien
ggtggtactggagcttccctaccca

SEQ ID NO: 280740 - DNA, 25 bp, Homo sapien
tacccaggatttcagtggattccaa

SEQ ID NO: 280741 - DNA, 25 bp, Homo sapien
agtgacttcagataacaccttcatc

SEQ ID NO: 280742 - DNA, 25 bp, Homo sapien
agataacaccttcatcatatactga

SEQ ID NO: 280743 - DNA, 25 bp, Homo sapien
tcatatactgattttccttatggac

SEQ ID NO: 280744 - DNA, 25 bp, Homo sapien
tcttctcttccactagtctttctgt

SEQ ID NO: 280745 - DNA, 25 bp, Homo sapien
actagtctttctgtttattcatgtg

SEQ ID NO: 280746 - DNA, 25 bp, Homo sapien
attcatgtgtcaatatttcagtttt

SEQ ID NO: 280747 - DNA, 25 bp, Homo sapien
tcttttactagaatatcaggtgttc

SEQ ID NO: 280748 - DNA, 25 bp, Homo sapien
atcaggtgttctagctattcttccg

SEQ ID NO: 280749 - DNA, 25 bp, Homo sapien
gttctagctattcttccgtgtttat

SEQ ID NO: 280750 - DNA, 25 bp, Homo sapien
gtatcaatttgtctaactccataaa

SEQ ID NO: 280751 - DNA, 25 bp, Homo sapien
aactccataaagagcttactagtat

SEQ ID NO: 280752 - DNA, 25 bp, Homo sapien
acaatgcaaatgctacagaattttt

SEQ ID NO: 280753 - DNA, 25 bp, Homo sapien
gaatcctaacaactattaggcagtg

SEQ ID NO: 280754 - DNA, 25 bp, Homo sapien
taggcagtgataagaaaaatccatt

SEQ ID NO: 280755 - DNA, 25 bp, Homo sapien
aataagtgcctagtattgcagatgc

SEQ ID NO: 280756 - DNA, 25 bp, Homo sapien
attgcagatgcagtttatggtgaac

SEQ ID NO: 280757 - DNA, 25 bp, Homo sapien
agggggcttcattgagatattcaca

SEQ ID NO: 280758 - DNA, 25 bp, Homo sapien
ttcacatgccataaactctcccatt

SEQ ID NO: 280759 - DNA, 25 bp, Homo sapien
catgccataaactctcccatttaaa

SEQ ID NO: 280760 - DNA, 25 bp, Homo sapien
gccataaactctcccatttaaagta

SEQ ID NO: 280761 - DNA, 25 bp, Homo sapien
atatccacagagttgggcaagccat

SEQ ID NO: 280762 - DNA, 25 bp, Homo sapien
agttgggcaagccattaccacaatc

SEQ ID NO: 280763 - DNA, 25 bp, Homo sapien
tagagctttgcgaatgggatcaggt

SEQ ID NO: 280764 - DNA, 25 bp, Homo sapien
atgggatcaggtgcccttatgaaaa

SEQ ID NO: 280765 - DNA, 25 bp, Homo sapien
gatcaggtgcccttatgaaaaggct

SEQ ID NO: 280766 - DNA, 25 bp, Homo sapien
ggtgcccttatgaaaaggcttgata

SEQ ID NO: 280767 - DNA, 25 bp, Homo sapien
ttctgctctgtgaggacacaatgct

SEQ ID NO: 280768 - DNA, 25 bp, Homo sapien
gacatgagccctcaacagacaactg

SEQ ID NO: 280769 - DNA, 25 bp, Homo sapien
atgagccctcaacagacaactgcac

SEQ ID NO: 280770 - DNA, 25 bp, Homo sapien
aacagacaactgcacctactgatgt

SEQ ID NO: 280771 - DNA, 25 bp, Homo sapien
gacaactgcacctactgatgttttg

SEQ ID NO: 280772 - DNA, 25 bp, Homo sapien
actgcacctactgatgttttgatgt

SEQ ID NO: 280773 - DNA, 25 bp, Homo sapien
tgttttgatgttgaacttcccagcc

SEQ ID NO: 280774 - DNA, 25 bp, Homo sapien
gggttcgtgcctcctagcctaggaa

SEQ ID NO: 280775 - DNA, 25 bp, Homo sapien
gtgcctcctagcctaggaaacttaa

SEQ ID NO: 280776 - DNA, 25 bp, Homo sapien
taatgatacattacgcctttgcagt

SEQ ID NO: 280777 - DNA, 25 bp, Homo sapien
acattacgcctttgcagtgagctaa

SEQ ID NO: 280778 - DNA, 25 bp, Homo sapien
acgcctttgcagtgagctaataata

SEQ ID NO: 280779 - DNA, 25 bp, Homo sapien
aataagctaacctttgtgcacaaat

SEQ ID NO: 280780 - DNA, 25 bp, Homo sapien
attatatatctattctgcataggta

SEQ ID NO: 280781 - DNA, 25 bp, Homo sapien
taggtattttgactttgtgcaggac

SEQ ID NO: 280782 - DNA, 25 bp, Homo sapien
aagttgtgtaggtatgactgttcta

SEQ ID NO: 280783 - DNA, 25 bp, Homo sapien
gactgttctacttttcagttttctt

SEQ ID NO: 280784 - DNA, 25 bp, Homo sapien
ttttctctagaaattactcaaacaa

SEQ ID NO: 280785 - DNA, 25 bp, Homo sapien
ccctagtcattggaggtgacatcga

SEQ ID NO: 280786 - DNA, 25 bp, Homo sapien
gtgacatcgatgtcctccccattgg

SEQ ID NO: 280787 - DNA, 25 bp, Homo sapien
tggcaatgcgccaccggttgatgtg

SEQ ID NO: 280788 - DNA, 25 bp, Homo sapien
ccggttgatgtgatgggagcccttc

SEQ ID NO: 280789 - DNA, 25 bp, Homo sapien
tgatgggagcccttcttcttctgct

SEQ ID NO: 280790 - DNA, 25 bp, Homo sapien
cagcttctgccgtttgtactttgtc

SEQ ID NO: 280791 - DNA, 25 bp, Homo sapien
tgtactttgtcctccggttctggaa

SEQ ID NO: 280792 - DNA, 25 bp, Homo sapien
tttgtcctccggttctggaaccaca

SEQ ID NO: 280793 - DNA, 25 bp, Homo sapien
ttcacctgcgtctcggagaggctga

SEQ ID NO: 280794 - DNA, 25 bp, Homo sapien
caccacgtagtggttcttctcgaag

SEQ ID NO: 280795 - DNA, 25 bp, Homo sapien
agtggttcttctcgaaggcgcgctc

SEQ ID NO: 280796 - DNA, 25 bp, Homo sapien
ggtgatagtgttctttctgtaagta

SEQ ID NO: 280797 - DNA, 25 bp, Homo sapien
aaaacatagtttgcttaccaggtgg

SEQ ID NO: 280798 - DNA, 25 bp, Homo sapien
ttaccaggtggagacaagattcaag

SEQ ID NO: 280799 - DNA, 25 bp, Homo sapien
atattttccacttaaatgaggctgt

SEQ ID NO: 280800 - DNA, 25 bp, Homo sapien
tgaggctgtttttgacgttctctgc

SEQ ID NO: 280801 - DNA, 25 bp, Homo sapien
ttgacgttctctgccaaggatttag

SEQ ID NO: 280802 - DNA, 25 bp, Homo sapien
aggatttagagctttcgttgaacta

SEQ ID NO: 280803 - DNA, 25 bp, Homo sapien
tagagatgttccgtgtgtgccgccc

SEQ ID NO: 280804 - DNA, 25 bp, Homo sapien
tgaactgcgtttccacctgctgtgg

SEQ ID NO: 280805 - DNA, 25 bp, Homo sapien
acctgctgtggtgcttgtgcagcct

SEQ ID NO: 280806 - DNA, 25 bp, Homo sapien
gcctggcagttcattgtcatcttta

SEQ ID NO: 280807 - DNA, 25 bp, Homo sapien
gttggaattgtgattatgtctgttt

SEQ ID NO: 280808 - DNA, 25 bp, Homo sapien
gattatgtctgttttagttgtttaa

SEQ ID NO: 280809 - DNA, 25 bp, Homo sapien
ttttcctattatatggtatccaagg

SEQ ID NO: 280810 - DNA, 25 bp, Homo sapien
ggtatccaaggatgtagacacatta

SEQ ID NO: 280811 - DNA, 25 bp, Homo sapien
gaggagcaaatcatgaagagcggat

SEQ ID NO: 280812 - DNA, 25 bp, Homo sapien
agagcggattggtctttgttcaaca

SEQ ID NO: 280813 - DNA, 25 bp, Homo sapien
agcggattggtctttgttcaacaag

SEQ ID NO: 280814 - DNA, 25 bp, Homo sapien
gattggtctttgttcaacaagagct

SEQ ID NO: 280815 - DNA, 25 bp, Homo sapien
ttcaacaagagctggcagagtagtt

SEQ ID NO: 280816 - DNA, 25 bp, Homo sapien
aagagctggcagagtagttaagaca

SEQ ID NO: 280817 - DNA, 25 bp, Homo sapien
gagtagttaagacaaggagttcaaa

SEQ ID NO: 280818 - DNA, 25 bp, Homo sapien
caaaaggagctcctcccacaagtac

SEQ ID NO: 280819 - DNA, 25 bp, Homo sapien
tcctcccacaagtaccttaatagtc

SEQ ID NO: 280820 - DNA, 25 bp, Homo sapien
aagtaccttaatagtcccactccat

SEQ ID NO: 280821 - DNA, 25 bp, Homo sapien
taatagtcccactccatttgattct

SEQ ID NO: 280822 - DNA, 25 bp, Homo sapien
agtcccactccatttgattctcaca

SEQ ID NO: 280823 - DNA, 25 bp, Homo sapien
gattctcacagtcctgaaggggcag

SEQ ID NO: 280824 - DNA, 25 bp, Homo sapien
tcctgttgccattgtagagatgaaa

SEQ ID NO: 280825 - DNA, 25 bp, Homo sapien
aagaaaattgccttcctcaacgtca

SEQ ID NO: 280826 - DNA, 25 bp, Homo sapien
ttcctcaacgtcatacagcttgtca

SEQ ID NO: 280827 - DNA, 25 bp, Homo sapien
atgggacgccaggagttgcttgact

SEQ ID NO: 280828 - DNA, 25 bp, Homo sapien
gccaggagttgcttgactccaggag

SEQ ID NO: 280829 - DNA, 25 bp, Homo sapien
ttgtcttccgggtcctaaagagcac

SEQ ID NO: 280830 - DNA, 25 bp, Homo sapien
gaaaatggaggtccccagtctaggt

SEQ ID NO: 280831 - DNA, 25 bp, Homo sapien
gtccccagtctaggtaggaagctga

SEQ ID NO: 280832 - DNA, 25 bp, Homo sapien
gctgattggatgaggacttcttttt

SEQ ID NO: 280833 - DNA, 25 bp, Homo sapien
ttgggctccacacaccagatgcttt

SEQ ID NO: 280834 - DNA, 25 bp, Homo sapien
acacaccagatgctttggttttcta

SEQ ID NO: 280835 - DNA, 25 bp, Homo sapien
ggttttctacaactgttgctatgtg

SEQ ID NO: 280836 - DNA, 25 bp, Homo sapien
tgttgctatgtgtagagggtgctca

SEQ ID NO: 280837 - DNA, 25 bp, Homo sapien
cgtggcatgagagcaaggagaccat

SEQ ID NO: 280838 - DNA, 25 bp, Homo sapien
ggagaccatggctactctttgaaat

SEQ ID NO: 280839 - DNA, 25 bp, Homo sapien
aatttaatcacgagattgcgccact

SEQ ID NO: 280840 - DNA, 25 bp, Homo sapien
actctctcaacatttccccttaaat

SEQ ID NO: 280841 - DNA, 25 bp, Homo sapien
ttaaatgtccccttgtcatctccaa

SEQ ID NO: 280842 - DNA, 25 bp, Homo sapien
gtcatctccaaccagtgtgtctaaa

SEQ ID NO: 280843 - DNA, 25 bp, Homo sapien
gtgtctaaaaccagcataaattccg

SEQ ID NO: 280844 - DNA, 25 bp, Homo sapien
taaccattagtcacccaggtttgaa

SEQ ID NO: 280845 - DNA, 25 bp, Homo sapien
aattaattgtcttcaacttcctctg

SEQ ID NO: 280846 - DNA, 25 bp, Homo sapien
aacttcctctgtaagtggcacactg

SEQ ID NO: 280847 - DNA, 25 bp, Homo sapien
gtggcacactgagctcatcacgcat

SEQ ID NO: 280848 - DNA, 25 bp, Homo sapien
tactccctgtcatcaagttctgtgg

SEQ ID NO: 280849 - DNA, 25 bp, Homo sapien
caagttctgtggatgttttcctcta

SEQ ID NO: 280850 - DNA, 25 bp, Homo sapien
taaatctctcattacttttctgcca

SEQ ID NO: 280851 - DNA, 25 bp, Homo sapien
ttttgtctcaaattccttaaataat

SEQ ID NO: 280852 - DNA, 25 bp, Homo sapien
gtatgtattttccattacaaatata

SEQ ID NO: 280853 - DNA, 25 bp, Homo sapien
atacatactcatacaaaactttgga

SEQ ID NO: 280854 - DNA, 25 bp, Homo sapien
aaaattcacacatattcccaacacc

SEQ ID NO: 280855 - DNA, 25 bp, Homo sapien
atattcccaacacccaacaacaatt

SEQ ID NO: 280856 - DNA, 25 bp, Homo sapien
taactgttaacatcttgatctgtgc

SEQ ID NO: 280857 - DNA, 25 bp, Homo sapien
gttaacatcttgatctgtgcactag

SEQ ID NO: 280858 - DNA, 25 bp, Homo sapien
catcttgatctgtgcactagtctgt

SEQ ID NO: 280859 - DNA, 25 bp, Homo sapien
cttgatctgtgcactagtctgtgat

SEQ ID NO: 280860 - DNA, 25 bp, Homo sapien
tgcactagtctgtgattattagggt

SEQ ID NO: 280861 - DNA, 25 bp, Homo sapien
ctgtgattattagggtgttagtgat

SEQ ID NO: 280862 - DNA, 25 bp, Homo sapien
gcatctgaggccctatgatggcact

SEQ ID NO: 280863 - DNA, 25 bp, Homo sapien
tgatggcactacattgagctgtctg

SEQ ID NO: 280864 - DNA, 25 bp, Homo sapien
attgagctgtctgcccttccggaaa

SEQ ID NO: 280865 - DNA, 25 bp, Homo sapien
ggaaacccaacctgcaatcaactgc

SEQ ID NO: 280866 - DNA, 25 bp, Homo sapien
atcaaattcttcacattccagctac

SEQ ID NO: 280867 - DNA, 25 bp, Homo sapien
acattccagctacagtctttctttc

SEQ ID NO: 280868 - DNA, 25 bp, Homo sapien
tttccccattgaatctcagtccctg

SEQ ID NO: 280869 - DNA, 25 bp, Homo sapien
tcagtccctggccatgtggtcaagg

SEQ ID NO: 280870 - DNA, 25 bp, Homo sapien
atgtggtcaaggtggctttctgtta

SEQ ID NO: 280871 - DNA, 25 bp, Homo sapien
ttctgttaagctaccctaatttcgg

SEQ ID NO: 280872 - DNA, 25 bp, Homo sapien
ggccattacaactctgccttcaaga

SEQ ID NO: 280873 - DNA, 25 bp, Homo sapien
aaatgggattactatagtcctgcag

SEQ ID NO: 280874 - DNA, 25 bp, Homo sapien
gggattactatagtcctgcagtggt

SEQ ID NO: 280875 - DNA, 25 bp, Homo sapien
gattactatagtcctgcagtggttt

SEQ ID NO: 280876 - DNA, 25 bp, Homo sapien
ttactatagtcctgcagtggtttaa

SEQ ID NO: 280877 - DNA, 25 bp, Homo sapien
ataaataacatctctgcaacttcct

SEQ ID NO: 280878 - DNA, 25 bp, Homo sapien
ataacatctctgcaacttccttttt

SEQ ID NO: 280879 - DNA, 25 bp, Homo sapien
aacatctctgcaacttcctttttct

SEQ ID NO: 280880 - DNA, 25 bp, Homo sapien
ttcctttttctcctgatcagtcctg

SEQ ID NO: 280881 - DNA, 25 bp, Homo sapien
tttttctcctgatcagtcctgtgag

SEQ ID NO: 280882 - DNA, 25 bp, Homo sapien
ttctcctgatcagtcctgtgagtga

SEQ ID NO: 280883 - DNA, 25 bp, Homo sapien
tcctgatcagtcctgtgagtgaccc

SEQ ID NO: 280884 - DNA, 25 bp, Homo sapien
ggcagaataatgctagaacagctaa

SEQ ID NO: 280885 - DNA, 25 bp, Homo sapien
gaacagctaaggtttacatgtacca

SEQ ID NO: 280886 - DNA, 25 bp, Homo sapien
taacatgtttcagctcattccatcc

SEQ ID NO: 280887 - DNA, 25 bp, Homo sapien
gtttcagctcattccatcctcacaa

SEQ ID NO: 280888 - DNA, 25 bp, Homo sapien
ccctgaaagtgggtactatcattag

SEQ ID NO: 280889 - DNA, 25 bp, Homo sapien
gggtactatcattagtcccatgtta

SEQ ID NO: 280890 - DNA, 25 bp, Homo sapien
gtcccatgttatagaaactgcagca

SEQ ID NO: 280891 - DNA, 25 bp, Homo sapien
attgcctccaaattaccggaagagt

SEQ ID NO: 280892 - DNA, 25 bp, Homo sapien
gatgtattcacgtaacatgcttgaa

SEQ ID NO: 280893 - DNA, 25 bp, Homo sapien
catgcttgaaactgcctggcatata

SEQ ID NO: 280894 - DNA, 25 bp, Homo sapien
ctggcatatactaaacgctaaataa

SEQ ID NO: 280895 - DNA, 25 bp, Homo sapien
tccccaagtgtcacacaggcacttt

SEQ ID NO: 280896 - DNA, 25 bp, Homo sapien
cccaagtgtcacacaggcactttgt

SEQ ID NO: 280897 - DNA, 25 bp, Homo sapien
aagtgtcacacaggcactttgtaca

SEQ ID NO: 280898 - DNA, 25 bp, Homo sapien
gtgtcacacaggcactttgtacaca

SEQ ID NO: 280899 - DNA, 25 bp, Homo sapien
tgtcacacaggcactttgtacacat

SEQ ID NO: 280900 - DNA, 25 bp, Homo sapien
gtcacacaggcactttgtacacatc

SEQ ID NO: 280901 - DNA, 25 bp, Homo sapien
tcacacaggcactttgtacacatcc

SEQ ID NO: 280902 - DNA, 25 bp, Homo sapien
cacacaggcactttgtacacatcct

SEQ ID NO: 280903 - DNA, 25 bp, Homo sapien
acacaggcactttgtacacatcctg

SEQ ID NO: 280904 - DNA, 25 bp, Homo sapien
acaggcactttgtacacatcctggt

SEQ ID NO: 280905 - DNA, 25 bp, Homo sapien
aggcactttgtacacatcctggttt

SEQ ID NO: 280906 - DNA, 25 bp, Homo sapien
tgatcattacaccttgcataattgt

SEQ ID NO: 280907 - DNA, 25 bp, Homo sapien
attacaccttgcataattgtctcaa

SEQ ID NO: 280908 - DNA, 25 bp, Homo sapien
acaccttgcataattgtctcaaaat

SEQ ID NO: 280909 - DNA, 25 bp, Homo sapien
taccccataaatgcatataattgtt

SEQ ID NO: 280910 - DNA, 25 bp, Homo sapien
gactggatgtgggtgatgaataaat

SEQ ID NO: 280911 - DNA, 25 bp, Homo sapien
aatgaggatttggtatactattttc

SEQ ID NO: 280912 - DNA, 25 bp, Homo sapien
attttctctacttcttatgttcaaa

SEQ ID NO: 280913 - DNA, 25 bp, Homo sapien
ttctctacttcttatgttcaaaata

SEQ ID NO: 280914 - DNA, 25 bp, Homo sapien
aactactatattttgtacattcata

SEQ ID NO: 280915 - DNA, 25 bp, Homo sapien
tacattcatattacaggcacacttt

SEQ ID NO: 280916 - DNA, 25 bp, Homo sapien
aggcacactttattgtacttcgctt

SEQ ID NO: 280917 - DNA, 25 bp, Homo sapien
aaggtagtcctttctatagctataa

SEQ ID NO: 280918 - DNA, 25 bp, Homo sapien
gaatcccacagaccctaaggatgct

SEQ ID NO: 280919 - DNA, 25 bp, Homo sapien
gttttaagtgtatctttccctctag

SEQ ID NO: 280920 - DNA, 25 bp, Homo sapien
aagtgtatctttccctctagttatt

SEQ ID NO: 280921 - DNA, 25 bp, Homo sapien
tccctctagttatttgtatggctca

SEQ ID NO: 280922 - DNA, 25 bp, Homo sapien
gtatggctcaatcctgtatatctag

SEQ ID NO: 280923 - DNA, 25 bp, Homo sapien
aatcctgtatatctagtgcctctct

SEQ ID NO: 280924 - DNA, 25 bp, Homo sapien
tatatctagtgcctctctcaggata

SEQ ID NO: 280925 - DNA, 25 bp, Homo sapien
agaccctaaggatgctcctgcacaa

SEQ ID NO: 280926 - DNA, 25 bp, Homo sapien
gtgcctctctcaggatatatgataa

SEQ ID NO: 280927 - DNA, 25 bp, Homo sapien
gctcctgcacaaaaaacccaactga

SEQ ID NO: 280928 - DNA, 25 bp, Homo sapien
ctgccacatcccgtgtaacataagt

SEQ ID NO: 280929 - DNA, 25 bp, Homo sapien
tcccgtgtaacataagtggtgccca

SEQ ID NO: 280930 - DNA, 25 bp, Homo sapien
aagtggtgcccaccatgtttgcact

SEQ ID NO: 280931 - DNA, 25 bp, Homo sapien
gcccaccatgtttgcacttttaata

SEQ ID NO: 280932 - DNA, 25 bp, Homo sapien
gcacttttaataactcttacttgcg

SEQ ID NO: 280933 - DNA, 25 bp, Homo sapien
ctcttacttgcgtgttttgtttttg

SEQ ID NO: 280934 - DNA, 25 bp, Homo sapien
accaatatctaataccacagtggga

SEQ ID NO: 280935 - DNA, 25 bp, Homo sapien
ggaagaaagactttattctctctct

SEQ ID NO: 280936 - DNA, 25 bp, Homo sapien
ctttattctctctcttattgtaagt

SEQ ID NO: 280937 - DNA, 25 bp, Homo sapien
gtttttggatctgctactgacaact

SEQ ID NO: 280938 - DNA, 25 bp, Homo sapien
gctactgacaacttttagagggttt

SEQ ID NO: 280939 - DNA, 25 bp, Homo sapien
ccagaagagggcactaccacaggac

SEQ ID NO: 280940 - DNA, 25 bp, Homo sapien
gaagagggcactaccacaggaccct

SEQ ID NO: 280941 - DNA, 25 bp, Homo sapien
acaggaccctctcaagcttctcagg

SEQ ID NO: 280942 - DNA, 25 bp, Homo sapien
aggaccctctcaagcttctcaggca

SEQ ID NO: 280943 - DNA, 25 bp, Homo sapien
ttctcaggcaacagcttgaggtccc

SEQ ID NO: 280944 - DNA, 25 bp, Homo sapien
aggcaacagcttgaggtccctgagg

SEQ ID NO: 280945 - DNA, 25 bp, Homo sapien
agtggcaagccctaatgcaactcac

SEQ ID NO: 280946 - DNA, 25 bp, Homo sapien
tcaccctcatcctggtgcttaggtg

SEQ ID NO: 280947 - DNA, 25 bp, Homo sapien
tcatcctggtgcttaggtggcagag

SEQ ID NO: 280948 - DNA, 25 bp, Homo sapien
gggatggcaaaaccaccaactgccc

SEQ ID NO: 280949 - DNA, 25 bp, Homo sapien
gtggagatgggatgcgtgccaacct

SEQ ID NO: 280950 - DNA, 25 bp, Homo sapien
ttggtaagtggttctcctttgccca

SEQ ID NO: 280951 - DNA, 25 bp, Homo sapien
tgcccacaccttaccaggacaaaag

SEQ ID NO: 280952 - DNA, 25 bp, Homo sapien
aaaaggagcttactctacccaggca

SEQ ID NO: 280953 - DNA, 25 bp, Homo sapien
acccaggcaattaagcaatctccca

SEQ ID NO: 280954 - DNA, 25 bp, Homo sapien
accaccaccaagctcaaatgttttc

SEQ ID NO: 280955 - DNA, 25 bp, Homo sapien
tgttttcatcatagactagggttca

SEQ ID NO: 280956 - DNA, 25 bp, Homo sapien
gtaattctttcagcgtaaacattgt

SEQ ID NO: 280957 - DNA, 25 bp, Homo sapien
agcgtaaacattgttgaggttcaac

SEQ ID NO: 280958 - DNA, 25 bp, Homo sapien
gaggttcaacagtccttattgctga

SEQ ID NO: 280959 - DNA, 25 bp, Homo sapien
tccttattgctgagtaggactcgat

SEQ ID NO: 280960 - DNA, 25 bp, Homo sapien
gagtaggactcgattgtatgaatat

SEQ ID NO: 280961 - DNA, 25 bp, Homo sapien
gggtgtgtcccacaaacgctgctat

SEQ ID NO: 280962 - DNA, 25 bp, Homo sapien
gtgtgtcccacaaacgctgctatgg

SEQ ID NO: 280963 - DNA, 25 bp, Homo sapien
tgtgtcccacaaacgctgctatggg

SEQ ID NO: 280964 - DNA, 25 bp, Homo sapien
gtgtttgactttcttttcaagtggg

SEQ ID NO: 280965 - DNA, 25 bp, Homo sapien
gactgagagtgaggcaagttctccc

SEQ ID NO: 280966 - DNA, 25 bp, Homo sapien
gagagtgaggcaagttctccccagc

SEQ ID NO: 280967 - DNA, 25 bp, Homo sapien
gagtgaggcaagttctccccagccc

SEQ ID NO: 280968 - DNA, 25 bp, Homo sapien
ggtaggatcataagtcattcccctc

SEQ ID NO: 280969 - DNA, 25 bp, Homo sapien
gtaggatcataagtcattcccctcc

SEQ ID NO: 280970 - DNA, 25 bp, Homo sapien
taggatcataagtcattcccctccc

SEQ ID NO: 280971 - DNA, 25 bp, Homo sapien
caggcctcctgctatatttggggga

SEQ ID NO: 280972 - DNA, 25 bp, Homo sapien
acacctgcagaaaccttgcaccgat

SEQ ID NO: 280973 - DNA, 25 bp, Homo sapien
aaccttgcaccgatggatagtctcc

SEQ ID NO: 280974 - DNA, 25 bp, Homo sapien
tgcaccgatggatagtctccctcag

SEQ ID NO: 280975 - DNA, 25 bp, Homo sapien
gatggatagtctccctcagctccgt

SEQ ID NO: 280976 - DNA, 25 bp, Homo sapien
agctccgtgccatcgctgcagaggc

SEQ ID NO: 280977 - DNA, 25 bp, Homo sapien
tgcagaggctgttatggacatcact

SEQ ID NO: 280978 - DNA, 25 bp, Homo sapien
gctgttatggacatcactgcagccc

SEQ ID NO: 280979 - DNA, 25 bp, Homo sapien
ctggtctccaccatatgagttggct

SEQ ID NO: 280980 - DNA, 25 bp, Homo sapien
gtctccaccatatgagttggcttct

SEQ ID NO: 280981 - DNA, 25 bp, Homo sapien
ccaccatatgagttggcttctgttt

SEQ ID NO: 280982 - DNA, 25 bp, Homo sapien
tctcctgttttactttgcctttagc

SEQ ID NO: 280983 - DNA, 25 bp, Homo sapien
aaactgatttcatgtcctatgcaag

SEQ ID NO: 280984 - DNA, 25 bp, Homo sapien
catgtcctatgcaagtgttttctac

SEQ ID NO: 280985 - DNA, 25 bp, Homo sapien
gtgttttctacaacctgcataacca

SEQ ID NO: 280986 - DNA, 25 bp, Homo sapien
aacttgtttacgcttcaattgtaca

SEQ ID NO: 280987 - DNA, 25 bp, Homo sapien
ggtacctccaaacttgaattcgtct

SEQ ID NO: 280988 - DNA, 25 bp, Homo sapien
gaattcgtctgtgtgaagcattgta

SEQ ID NO: 280989 - DNA, 25 bp, Homo sapien
gatacatttctcttttgagtaccat

SEQ ID NO: 280990 - DNA, 25 bp, Homo sapien
gtacagaggttttcactgcttctat

SEQ ID NO: 280991 - DNA, 25 bp, Homo sapien
tcactgcttctatttttctactgtt

SEQ ID NO: 280992 - DNA, 25 bp, Homo sapien
tttctactgttactgataagcatgt

SEQ ID NO: 280993 - DNA, 25 bp, Homo sapien
ttatcctacatatagttggcatttc

SEQ ID NO: 280994 - DNA, 25 bp, Homo sapien
aactggactttctgtaggctagccc

SEQ ID NO: 280995 - DNA, 25 bp, Homo sapien
ggactttctgtaggctagcccggaa

SEQ ID NO: 280996 - DNA, 25 bp, Homo sapien
gctagcccggaagacagacgactga

SEQ ID NO: 280997 - DNA, 25 bp, Homo sapien
cggaagacagacgactgatctccga

SEQ ID NO: 280998 - DNA, 25 bp, Homo sapien
cctgccacaggttcctggaaagact

SEQ ID NO: 280999 - DNA, 25 bp, Homo sapien
cacaggttcctggaaagactctcca

SEQ ID NO: 281000 - DNA, 25 bp, Homo sapien
ttgtgctttggcagactcctccatg

SEQ ID NO: 281001 - DNA, 25 bp, Homo sapien
ttggcagactcctccatgttttgtt

SEQ ID NO: 281002 - DNA, 25 bp, Homo sapien
agactcctccatgttttgttccctt

SEQ ID NO: 281003 - DNA, 25 bp, Homo sapien
tatgcatgtgcctgttcagagtctc

SEQ ID NO: 281004 - DNA, 25 bp, Homo sapien
tgcatgtgcctgttcagagtctcca

SEQ ID NO: 281005 - DNA, 25 bp, Homo sapien
tttgaaacaatctcacacctacaga

SEQ ID NO: 281006 - DNA, 25 bp, Homo sapien
ccctctcctgaactgtttgatagta

SEQ ID NO: 281007 - DNA, 25 bp, Homo sapien
gttgccaaactgatatacccacgat

SEQ ID NO: 281008 - DNA, 25 bp, Homo sapien
atatacccacgatccccaaatgctt

SEQ ID NO: 281009 - DNA, 25 bp, Homo sapien
caaatgcttcagtgtatttcctccc

SEQ ID NO: 281010 - DNA, 25 bp, Homo sapien
ccagcaaggacattctcctgcataa

SEQ ID NO: 281011 - DNA, 25 bp, Homo sapien
tcctgcataaccacaatacaaccat

SEQ ID NO: 281012 - DNA, 25 bp, Homo sapien
aagtcaggagattaacaccagttca

SEQ ID NO: 281013 - DNA, 25 bp, Homo sapien
acaccagttcattttgaccatctga

SEQ ID NO: 281014 - DNA, 25 bp, Homo sapien
cattttgaccatctgaaattcaggt

SEQ ID NO: 281015 - DNA, 25 bp, Homo sapien
gaaattcaggtgtcattcatgtttt

SEQ ID NO: 281016 - DNA, 25 bp, Homo sapien
gttgtctaaaattcacttactccct

SEQ ID NO: 281017 - DNA, 25 bp, Homo sapien
gtctaaaattcacttactccctact

SEQ ID NO: 281018 - DNA, 25 bp, Homo sapien
agaagacattatcccctgaaattta

SEQ ID NO: 281019 - DNA, 25 bp, Homo sapien
gacattatcccctgaaatttactta

SEQ ID NO: 281020 - DNA, 25 bp, Homo sapien
tatcccctgaaatttacttaaacat

SEQ ID NO: 281021 - DNA, 25 bp, Homo sapien
tatattgcaatgctgtataaaccat

SEQ ID NO: 281022 - DNA, 25 bp, Homo sapien
aaaccatttcttagtccatttgagc

SEQ ID NO: 281023 - DNA, 25 bp, Homo sapien
cttagtccatttgagctactgttaa

SEQ ID NO: 281024 - DNA, 25 bp, Homo sapien
aaaaatatcataaactaggtggctt

SEQ ID NO: 281025 - DNA, 25 bp, Homo sapien
ttccaaacatcaatccagaagacaa

SEQ ID NO: 281026 - DNA, 25 bp, Homo sapien
ccagaagacaaatctaaacgaacct

SEQ ID NO: 281027 - DNA, 25 bp, Homo sapien
ccatcttgccacactaacacttaat

SEQ ID NO: 281028 - DNA, 25 bp, Homo sapien
taatgcttctgctaatccagtatgg

SEQ ID NO: 281029 - DNA, 25 bp, Homo sapien
tgcttctgctaatccagtatggaca

SEQ ID NO: 281030 - DNA, 25 bp, Homo sapien
tgctaatccagtatggacagaggaa

SEQ ID NO: 281031 - DNA, 25 bp, Homo sapien
gcagaacaaatatgtggatgcttat

SEQ ID NO: 281032 - DNA, 25 bp, Homo sapien
ggtttgtggcatatatagatttgga

SEQ ID NO: 281033 - DNA, 25 bp, Homo sapien
aagttaatggactgtgcagagacct

SEQ ID NO: 281034 - DNA, 25 bp, Homo sapien
gtgcagagacctagaaatcaatttt

SEQ ID NO: 281035 - DNA, 25 bp, Homo sapien
atcaattttcagtcacataatagtt

SEQ ID NO: 281036 - DNA, 25 bp, Homo sapien
atagtttagattaccagttttgaag

SEQ ID NO: 281037 - DNA, 25 bp, Homo sapien
gagaccccaaggtgggcgccactgc

SEQ ID NO: 281038 - DNA, 25 bp, Homo sapien
taggcctgaagtctttttggcactt

SEQ ID NO: 281039 - DNA, 25 bp, Homo sapien
aagcttatcctttatcaatttctat

SEQ ID NO: 281040 - DNA, 25 bp, Homo sapien
tatcagttaaccactcagatgagga

SEQ ID NO: 281041 - DNA, 25 bp, Homo sapien
gagagaggttccacaaagagataaa

SEQ ID NO: 281042 - DNA, 25 bp, Homo sapien
atgagtggccataaggagtccttga

SEQ ID NO: 281043 - DNA, 25 bp, Homo sapien
agtccttgaaaacacacctctctag

SEQ ID NO: 281044 - DNA, 25 bp, Homo sapien
gcccatcaaaaaatgcagcacctta

SEQ ID NO: 281045 - DNA, 25 bp, Homo sapien
gcagcaccttaaactcaagtccatc

SEQ ID NO: 281046 - DNA, 25 bp, Homo sapien
tcaagtccatcttactagcctttag

SEQ ID NO: 281047 - DNA, 25 bp, Homo sapien
cttactagcctttagcagtacccca

SEQ ID NO: 281048 - DNA, 25 bp, Homo sapien
caccactctcaaaatttccagcatt

SEQ ID NO: 281049 - DNA, 25 bp, Homo sapien
cttcctcttcaccttaaagctgaga

SEQ ID NO: 281050 - DNA, 25 bp, Homo sapien
gagactcagctaaactggaaaccac

SEQ ID NO: 281051 - DNA, 25 bp, Homo sapien
atcccaccatccttcaagattgcag

SEQ ID NO: 281052 - DNA, 25 bp, Homo sapien
tctgcatgcttcttagtttttaatg

SEQ ID NO: 281053 - DNA, 25 bp, Homo sapien
tcacatggaggtcttgttaaaacaa

SEQ ID NO: 281054 - DNA, 25 bp, Homo sapien
acaaagattgctgggcaacatcccc

SEQ ID NO: 281055 - DNA, 25 bp, Homo sapien
gggcaacatccccagagtgtaagat

SEQ ID NO: 281056 - DNA, 25 bp, Homo sapien
atccccagagtgtaagattcagtag

SEQ ID NO: 281057 - DNA, 25 bp, Homo sapien
atttgtacctctaataagtttccag

SEQ ID NO: 281058 - DNA, 25 bp, Homo sapien
atagtgattttgctggtcgggaacc

SEQ ID NO: 281059 - DNA, 25 bp, Homo sapien
ggtcgggaaccacactgcaaaaatt

SEQ ID NO: 281060 - DNA, 25 bp, Homo sapien
gaagttgcagcgagctcagatcgtc

SEQ ID NO: 281061 - DNA, 25 bp, Homo sapien
aagttgcagcgagctcagatcgtcc

SEQ ID NO: 281062 - DNA, 25 bp, Homo sapien
agttgcagcgagctcagatcgtccc

SEQ ID NO: 281063 - DNA, 25 bp, Homo sapien
gttgcagcgagctcagatcgtccca

SEQ ID NO: 281064 - DNA, 25 bp, Homo sapien
ttgcagcgagctcagatcgtcccac

SEQ ID NO: 281065 - DNA, 25 bp, Homo sapien
tgcagcgagctcagatcgtcccact

SEQ ID NO: 281066 - DNA, 25 bp, Homo sapien
gcagcgagctcagatcgtcccactg

SEQ ID NO: 281067 - DNA, 25 bp, Homo sapien
cagcgagctcagatcgtcccactgc

SEQ ID NO: 281068 - DNA, 25 bp, Homo sapien
agcgagctcagatcgtcccactgca

SEQ ID NO: 281069 - DNA, 25 bp, Homo sapien
gcgagctcagatcgtcccactgcac

SEQ ID NO: 281070 - DNA, 25 bp, Homo sapien
cgagctcagatcgtcccactgcact

SEQ ID NO: 281071 - DNA, 25 bp, Homo sapien
gaaaactagccccagtccctgtcta

SEQ ID NO: 281072 - DNA, 25 bp, Homo sapien
agccccagtccctgtctaaattgtt

SEQ ID NO: 281073 - DNA, 25 bp, Homo sapien
ccccagtccctgtctaaattgttat

SEQ ID NO: 281074 - DNA, 25 bp, Homo sapien
cccagtccctgtctaaattgttata

SEQ ID NO: 281075 - DNA, 25 bp, Homo sapien
cagtccctgtctaaattgttatagt

SEQ ID NO: 281076 - DNA, 25 bp, Homo sapien
gtccctgtctaaattgttatagttt

SEQ ID NO: 281077 - DNA, 25 bp, Homo sapien
gtctaaattgttatagtttttgact

SEQ ID NO: 281078 - DNA, 25 bp, Homo sapien
attatctgaattagtcttatccaaa

SEQ ID NO: 281079 - DNA, 25 bp, Homo sapien
gaattagtcttatccaaatttcata

SEQ ID NO: 281080 - DNA, 25 bp, Homo sapien
agtcttatccaaatttcatatgcag

SEQ ID NO: 281081 - DNA, 25 bp, Homo sapien
gtcttatccaaatttcatatgcaga

SEQ ID NO: 281082 - DNA, 25 bp, Homo sapien
ggatcatcagttataacagaggtac

SEQ ID NO: 281083 - DNA, 25 bp, Homo sapien
atcagttataacagaggtaccctct

SEQ ID NO: 281084 - DNA, 25 bp, Homo sapien
acagaggtaccctctggtggtggca

SEQ ID NO: 281085 - DNA, 25 bp, Homo sapien
ggaatatgggaaatctgctcagtgt

SEQ ID NO: 281086 - DNA, 25 bp, Homo sapien
tgggaaatctgctcagtgttgctgt

SEQ ID NO: 281087 - DNA, 25 bp, Homo sapien
aaatctgctcagtgttgctgtgaac

SEQ ID NO: 281088 - DNA, 25 bp, Homo sapien
aaaaatatgctcacagctcagttgt

SEQ ID NO: 281089 - DNA, 25 bp, Homo sapien
acagctcagttgtgatactagtaat

SEQ ID NO: 281090 - DNA, 25 bp, Homo sapien
gctcagttgtgatactagtaatgca

SEQ ID NO: 281091 - DNA, 25 bp, Homo sapien
gtgatactagtaatgcaatttttat

SEQ ID NO: 281092 - DNA, 25 bp, Homo sapien
tatgcttttgaagaaatcagaattc

SEQ ID NO: 281093 - DNA, 25 bp, Homo sapien
ttgaaacaaaattcccttttgcaat

SEQ ID NO: 281094 - DNA, 25 bp, Homo sapien
tgaaacaaaattcccttttgcaatt

SEQ ID NO: 281095 - DNA, 25 bp, Homo sapien
gaaacaaaattcccttttgcaattg

SEQ ID NO: 281096 - DNA, 25 bp, Homo sapien
aaagtccttaacgatggtctattca

SEQ ID NO: 281097 - DNA, 25 bp, Homo sapien
aagtccttaacgatggtctattcaa

SEQ ID NO: 281098 - DNA, 25 bp, Homo sapien
agtccttaacgatggtctattcaaa

SEQ ID NO: 281099 - DNA, 25 bp, Homo sapien
gtccttaacgatggtctattcaaaa

SEQ ID NO: 281100 - DNA, 25 bp, Homo sapien
tccttaacgatggtctattcaaaaa

SEQ ID NO: 281101 - DNA, 25 bp, Homo sapien
cttaacgatggtctattcaaaaaat

SEQ ID NO: 281102 - DNA, 25 bp, Homo sapien
ttgaaacaaaattcccttttgcaat

SEQ ID NO: 281103 - DNA, 25 bp, Homo sapien
tgaaacaaaattcccttttgcaatt

SEQ ID NO: 281104 - DNA, 25 bp, Homo sapien
gaaacaaaattcccttttgcaattg

SEQ ID NO: 281105 - DNA, 25 bp, Homo sapien
aaagtccttaacgatggtctattca

SEQ ID NO: 281106 - DNA, 25 bp, Homo sapien
aagtccttaacgatggtctattcaa

SEQ ID NO: 281107 - DNA, 25 bp, Homo sapien
agtccttaacgatggtctattcaaa

SEQ ID NO: 281108 - DNA, 25 bp, Homo sapien
gtccttaacgatggtctattcaaaa

SEQ ID NO: 281109 - DNA, 25 bp, Homo sapien
tccttaacgatggtctattcaaaaa

SEQ ID NO: 281110 - DNA, 25 bp, Homo sapien
cttaacgatggtctattcaaaaaat

SEQ ID NO: 281111 - DNA, 25 bp, Homo sapien
ttaacgatggtctattcaaaaaatt

SEQ ID NO: 281112 - DNA, 25 bp, Homo sapien
taacgatggtctattcaaaaaattt

SEQ ID NO: 281113 - DNA, 25 bp, Homo sapien
ttcacagtggaattggctttggatc

SEQ ID NO: 281114 - DNA, 25 bp, Homo sapien
ggctttggatctggcctatagatta

SEQ ID NO: 281115 - DNA, 25 bp, Homo sapien
tttcccctgttctttttgtgttatg

SEQ ID NO: 281116 - DNA, 25 bp, Homo sapien
gctggagtgctgcttaacaagtatc

SEQ ID NO: 281117 - DNA, 25 bp, Homo sapien
ttaacaagtatctctcctactctca

SEQ ID NO: 281118 - DNA, 25 bp, Homo sapien
tcctactctcagtggtcagaggctg

SEQ ID NO: 281119 - DNA, 25 bp, Homo sapien
tcagaggctgtgttggacccatagt

SEQ ID NO: 281120 - DNA, 25 bp, Homo sapien
aggtcacagacccaagcttccatgg

SEQ ID NO: 281121 - DNA, 25 bp, Homo sapien
aagcttccatgggttgttactgtgc

SEQ ID NO: 281122 - DNA, 25 bp, Homo sapien
ccacttggtgggtctgattctgaac

SEQ ID NO: 281123 - DNA, 25 bp, Homo sapien
ctgattctgaacctgatgtgtgtgt

SEQ ID NO: 281124 - DNA, 25 bp, Homo sapien
attagcccaccataccaagtaacaa

SEQ ID NO: 281125 - DNA, 25 bp, Homo sapien
aagtaacaagttaggcaggaatcgt

SEQ ID NO: 281126 - DNA, 25 bp, Homo sapien
tcgtgggaatttattgagtcagctt

SEQ ID NO: 281127 - DNA, 25 bp, Homo sapien
gagtcagctttgagtgtttgagaga

SEQ ID NO: 281128 - DNA, 25 bp, Homo sapien
gattggctcgaattgtaaacgtttg

SEQ ID NO: 281129 - DNA, 25 bp, Homo sapien
aacgtttgtactttggatgagttca

SEQ ID NO: 281130 - DNA, 25 bp, Homo sapien
gagttcatggttctttaggtcacct

SEQ ID NO: 281131 - DNA, 25 bp, Homo sapien
gtcaccttaataccagctatctttg

SEQ ID NO: 281132 - DNA, 25 bp, Homo sapien
gctatctttggtagaagctacagca

SEQ ID NO: 281133 - DNA, 25 bp, Homo sapien
agctacagcattcagtttctctgga

SEQ ID NO: 281134 - DNA, 25 bp, Homo sapien
gtttctctggaaactgtatcacatt

SEQ ID NO: 281135 - DNA, 25 bp, Homo sapien
atattttaaagtactggaggtgcct

SEQ ID NO: 281136 - DNA, 25 bp, Homo sapien
tactggaggtgccttttacctgttt

SEQ ID NO: 281137 - DNA, 25 bp, Homo sapien
gtgccttttacctgtttattagatt

SEQ ID NO: 281138 - DNA, 25 bp, Homo sapien
aattatttcatgagcaatcttttaa

SEQ ID NO: 281139 - DNA, 25 bp, Homo sapien
agctttttaacaaggctgccattta

SEQ ID NO: 281140 - DNA, 25 bp, Homo sapien
aacaaggctgccatttaacttaaat

SEQ ID NO: 281141 - DNA, 25 bp, Homo sapien
tcatcttagctttcacttgtataaa

SEQ ID NO: 281142 - DNA, 25 bp, Homo sapien
tgaactgcagcaataaaaccctcag

SEQ ID NO: 281143 - DNA, 25 bp, Homo sapien
aaaaccctcagctcctaagaagtct

SEQ ID NO: 281144 - DNA, 25 bp, Homo sapien
gaagtcttaagagggtattctatat

SEQ ID NO: 281145 - DNA, 25 bp, Homo sapien
gggtattctatatattctgctttgt

SEQ ID NO: 281146 - DNA, 25 bp, Homo sapien
ttaatcatacaatagcttacctggc

SEQ ID NO: 281147 - DNA, 25 bp, Homo sapien
cctggctaaaactttgcgtataaag

SEQ ID NO: 281148 - DNA, 25 bp, Homo sapien
gggaaaacttgctttaatctgtggg

SEQ ID NO: 281149 - DNA, 25 bp, Homo sapien
aatctgtgggattgcggaccgatgc

SEQ ID NO: 281150 - DNA, 25 bp, Homo sapien
ttgcggaccgatgcgacttgcagaa

SEQ ID NO: 281151 - DNA, 25 bp, Homo sapien
gacttgcagaaggtaaacaggcgtg

SEQ ID NO: 281152 - DNA, 25 bp, Homo sapien
ttttgtgtgcgttaggttaggtgtt

SEQ ID NO: 281153 - DNA, 25 bp, Homo sapien
gtggacttttaatgtatcttgtgaa

SEQ ID NO: 281154 - DNA, 25 bp, Homo sapien
gttactagggtaggttcaagagcta

SEQ ID NO: 281155 - DNA, 25 bp, Homo sapien
ctggcttttgaacccatctattaaa

SEQ ID NO: 281156 - DNA, 25 bp, Homo sapien
gtgaagtctgagtaaggttgctctc

SEQ ID NO: 281157 - DNA, 25 bp, Homo sapien
taacagtgaacctatatagatgtat

SEQ ID NO: 281158 - DNA, 25 bp, Homo sapien
tatagatgtattttgctgtccttac

SEQ ID NO: 281159 - DNA, 25 bp, Homo sapien
agatgtattttgctgtccttacaga

SEQ ID NO: 281160 - DNA, 25 bp, Homo sapien
gctgtccttacagaacatgcagtgt

SEQ ID NO: 281161 - DNA, 25 bp, Homo sapien
gaacatgcagtgtaagaagtacctt

SEQ ID NO: 281162 - DNA, 25 bp, Homo sapien
caacctacacacttctttcccgaag

SEQ ID NO: 281163 - DNA, 25 bp, Homo sapien
caaatgcttaatgtctttagtgttt

SEQ ID NO: 281164 - DNA, 25 bp, Homo sapien
tcacatgcggatccattagtcctcg

SEQ ID NO: 281165 - DNA, 25 bp, Homo sapien
atgcggatccattagtcctcgagaa

SEQ ID NO: 281166 - DNA, 25 bp, Homo sapien
ggatccattagtcctcgagaattta

SEQ ID NO: 281167 - DNA, 25 bp, Homo sapien
gtcctcgagaatttaacagtgaacc

SEQ ID NO: 281168 - DNA, 25 bp, Homo sapien
taaggatactagctcctgggcacct

SEQ ID NO: 281169 - DNA, 25 bp, Homo sapien
atactagctcctgggcacctagggt

SEQ ID NO: 281170 - DNA, 25 bp, Homo sapien
gcacctagggtgcaaactgacttgt

SEQ ID NO: 281171 - DNA, 25 bp, Homo sapien
aacaaaacaaattaaggctgctggg

SEQ ID NO: 281172 - DNA, 25 bp, Homo sapien
gtgcaaactgacttgtggcagcata

SEQ ID NO: 281173 - DNA, 25 bp, Homo sapien
cagcataagctgatgctgcacaggg

SEQ ID NO: 281174 - DNA, 25 bp, Homo sapien
gggacccaagccatgttgctacttg

SEQ ID NO: 281175 - DNA, 25 bp, Homo sapien
agccatgttgctacttgtcacttaa

SEQ ID NO: 281176 - DNA, 25 bp, Homo sapien
gtcacttaaggcaggaagcgcacaa

SEQ ID NO: 281177 - DNA, 25 bp, Homo sapien
gggaacctgagtccatgttaagctt

SEQ ID NO: 281178 - DNA, 25 bp, Homo sapien
catgttaagcttgggttgactgtaa

SEQ ID NO: 281179 - DNA, 25 bp, Homo sapien
gaagctctcagggaaatgtctgtga

SEQ ID NO: 281180 - DNA, 25 bp, Homo sapien
aatcatttaaagatgctctctggtg

SEQ ID NO: 281181 - DNA, 25 bp, Homo sapien
tctggtggatagagaaaccgcagtc

SEQ ID NO: 281182 - DNA, 25 bp, Homo sapien
gagaaaccgcagtccaaaaacagat

SEQ ID NO: 281183 - DNA, 25 bp, Homo sapien
agggcatgtatcatactcgcatcta

SEQ ID NO: 281184 - DNA, 25 bp, Homo sapien
ctcgcatctaaaacagtgtccacat

SEQ ID NO: 281185 - DNA, 25 bp, Homo sapien
ttttttattacctcgtggccagcac

SEQ ID NO: 281186 - DNA, 25 bp, Homo sapien
aaatgggcttccacgatggtgaatc

SEQ ID NO: 281187 - DNA, 25 bp, Homo sapien
ttccacgatggtgaatcagcatgct

SEQ ID NO: 281188 - DNA, 25 bp, Homo sapien
atcagcatgctgatttctcttggca

SEQ ID NO: 281189 - DNA, 25 bp, Homo sapien
gcatgctgatttctcttggcaggaa

SEQ ID NO: 281190 - DNA, 25 bp, Homo sapien
atcctcacaacacccattgtacaga

SEQ ID NO: 281191 - DNA, 25 bp, Homo sapien
ttaagtgacttctccgaggttacac

SEQ ID NO: 281192 - DNA, 25 bp, Homo sapien
acttctccgaggttacacagctagg

SEQ ID NO: 281193 - DNA, 25 bp, Homo sapien
gtcaggcagcgctgagcagtaatgt

SEQ ID NO: 281194 - DNA, 25 bp, Homo sapien
gcaacagtaagagcccacgaagagc

SEQ ID NO: 281195 - DNA, 25 bp, Homo sapien
aagagctgcggttggtagttcattc

SEQ ID NO: 281196 - DNA, 25 bp, Homo sapien
ttggtagttcattctggacagccct

SEQ ID NO: 281197 - DNA, 25 bp, Homo sapien
aaccgtccctgtactggcacttgtt

SEQ ID NO: 281198 - DNA, 25 bp, Homo sapien
agacctcttctaagaactttacctg

SEQ ID NO: 281199 - DNA, 25 bp, Homo sapien
agaactttacctgtttcagctcact

SEQ ID NO: 281200 - DNA, 25 bp, Homo sapien
tacctgtttcagctcactgaatcct

SEQ ID NO: 281201 - DNA, 25 bp, Homo sapien
aaataaagtgtctatgtctcataca

SEQ ID NO: 281202 - DNA, 25 bp, Homo sapien
agtgtctatgtctcatacatctttt

SEQ ID NO: 281203 - DNA, 25 bp, Homo sapien
gtctcatacatctttttattaccat

SEQ ID NO: 281204 - DNA, 25 bp, Homo sapien
gaatttgcacatctgacataatagg

SEQ ID NO: 281205 - DNA, 25 bp, Homo sapien
gcacatctgacataataggaactta

SEQ ID NO: 281206 - DNA, 25 bp, Homo sapien
gtatgggtgaacaatcaaggactct

SEQ ID NO: 281207 - DNA, 25 bp, Homo sapien
ggtgaacaatcaaggactctagaat

SEQ ID NO: 281208 - DNA, 25 bp, Homo sapien
ggactctagaatgtcttagtgcttt

SEQ ID NO: 281209 - DNA, 25 bp, Homo sapien
ctagaatgtcttagtgctttcaaaa

SEQ ID NO: 281210 - DNA, 25 bp, Homo sapien
ctttcaaaacttagtgcttatggac

SEQ ID NO: 281211 - DNA, 25 bp, Homo sapien
acttagtgcttatggactaatacat

SEQ ID NO: 281212 - DNA, 25 bp, Homo sapien
tggttcttcatcagtcccttggtct

SEQ ID NO: 281213 - DNA, 25 bp, Homo sapien
ttggtctctagcctcggccagggct

SEQ ID NO: 281214 - DNA, 25 bp, Homo sapien
tctccgccctcctttgtgtatcaag

SEQ ID NO: 281215 - DNA, 25 bp, Homo sapien
gtgtatcaagtgtcgctcacagccc

SEQ ID NO: 281216 - DNA, 25 bp, Homo sapien
ggagcctttcggatctatttggtct

SEQ ID NO: 281217 - DNA, 25 bp, Homo sapien
tttcggatctatttggtctttctca

SEQ ID NO: 281218 - DNA, 25 bp, Homo sapien
agcgggtgcttgtactgtgtgaatc

SEQ ID NO: 281219 - DNA, 25 bp, Homo sapien
acacttaatgacttccttggcacca

SEQ ID NO: 281220 - DNA, 25 bp, Homo sapien
ggcaccaatcatgtatttcaccgtt

SEQ ID NO: 281221 - DNA, 25 bp, Homo sapien
tgtatttcaccgtttgcactttttg

SEQ ID NO: 281222 - DNA, 25 bp, Homo sapien
caccgtttgcactttttgtatttca

SEQ ID NO: 281223 - DNA, 25 bp, Homo sapien
aaaagaatagactgaatttgccaaa

SEQ ID NO: 281224 - DNA, 25 bp, Homo sapien
gactgaatttgccaaaagagtgctt

SEQ ID NO: 281225 - DNA, 25 bp, Homo sapien
aaagagtgcttaaatggagacctaa

SEQ ID NO: 281226 - DNA, 25 bp, Homo sapien
gtgcttaaatggagacctaagtctt

SEQ ID NO: 281227 - DNA, 25 bp, Homo sapien
aatggagacctaagtcttcaaagct

SEQ ID NO: 281228 - DNA, 25 bp, Homo sapien
gagacctaagtcttcaaagctaagg

SEQ ID NO: 281229 - DNA, 25 bp, Homo sapien
aagtcttcaaagctaaggtgatgag

SEQ ID NO: 281230 - DNA, 25 bp, Homo sapien
aggtgatgagaaaagaacaggtctt

SEQ ID NO: 281231 - DNA, 25 bp, Homo sapien
gaacaggtcttaaatttcttcagag

SEQ ID NO: 281232 - DNA, 25 bp, Homo sapien
aacaggtcttaaatttcttcagagc

SEQ ID NO: 281233 - DNA, 25 bp, Homo sapien
tcagagcttcaagaggcaaagcttg

SEQ ID NO: 281234 - DNA, 25 bp, Homo sapien
agaaatgaggcaaagcccttccctg

SEQ ID NO: 281235 - DNA, 25 bp, Homo sapien
gcaagaccccttgtggatgtttttg

SEQ ID NO: 281236 - DNA, 25 bp, Homo sapien
ggatgtttttgcatctacctgattt

SEQ ID NO: 281237 - DNA, 25 bp, Homo sapien
tacctgatttttagccccacccagg

SEQ ID NO: 281238 - DNA, 25 bp, Homo sapien
ggagactttataccccatgatcctg

SEQ ID NO: 281239 - DNA, 25 bp, Homo sapien
accgttgctgttgtctgccagctgg

SEQ ID NO: 281240 - DNA, 25 bp, Homo sapien
tgccagctgggtctagcatcacagg

SEQ ID NO: 281241 - DNA, 25 bp, Homo sapien
gaaagactactgatcctaccggaaa

SEQ ID NO: 281242 - DNA, 25 bp, Homo sapien
gaaaccaacctgtttactgtactgt

SEQ ID NO: 281243 - DNA, 25 bp, Homo sapien
aatatcatgccctttatatcctgta

SEQ ID NO: 281244 - DNA, 25 bp, Homo sapien
atatcctgtatattggcttctttta

SEQ ID NO: 281245 - DNA, 25 bp, Homo sapien
gagcctggtgggaagtatttggatc

SEQ ID NO: 281246 - DNA, 25 bp, Homo sapien
ggatcatgagagaggatccttcatg

SEQ ID NO: 281247 - DNA, 25 bp, Homo sapien
gatccttcatgaatggctcagcacc

SEQ ID NO: 281248 - DNA, 25 bp, Homo sapien
tcaattcacatagatatggttgttt

SEQ ID NO: 281249 - DNA, 25 bp, Homo sapien
taaaagagtctgagacctctcccct

SEQ ID NO: 281250 - DNA, 25 bp, Homo sapien
tctttctcgccatgtgatatgcctg

SEQ ID NO: 281251 - DNA, 25 bp, Homo sapien
ttcaccttccgcctttactgtaagc

SEQ ID NO: 281252 - DNA, 25 bp, Homo sapien
ccgcctttactgtaagcttcctgag

SEQ ID NO: 281253 - DNA, 25 bp, Homo sapien
gagcaaatgttggtgccatgccagt

SEQ ID NO: 281254 - DNA, 25 bp, Homo sapien
aatgttggtgccatgccagtacagc

SEQ ID NO: 281255 - DNA, 25 bp, Homo sapien
gccagtacagcctgcagaattgtga

SEQ ID NO: 281256 - DNA, 25 bp, Homo sapien
gcgcctggccccgtattcatttttt

SEQ ID NO: 281257 - DNA, 25 bp, Homo sapien
ttcattttttatactggaaaacatt

SEQ ID NO: 281258 - DNA, 25 bp, Homo sapien
agcataaaaatgaatactccaaaga

SEQ ID NO: 281259 - DNA, 25 bp, Homo sapien
tatggcaaattaaaagggacacggt

SEQ ID NO: 281260 - DNA, 25 bp, Homo sapien
ttaaaagggacacggtactatgatt

SEQ ID NO: 281261 - DNA, 25 bp, Homo sapien
aagggacacggtactatgatttaat

SEQ ID NO: 281262 - DNA, 25 bp, Homo sapien
gggacacggtactatgatttaatta

SEQ ID NO: 281263 - DNA, 25 bp, Homo sapien
gacacggtactatgatttaattact

SEQ ID NO: 281264 - DNA, 25 bp, Homo sapien
cggtactatgatttaattactgtct

SEQ ID NO: 281265 - DNA, 25 bp, Homo sapien
actatgatttaattactgtcttgtc

SEQ ID NO: 281266 - DNA, 25 bp, Homo sapien
tatgatttaattactgtcttgtctt

SEQ ID NO: 281267 - DNA, 25 bp, Homo sapien
tgattcctgtttttcatttaagcag

SEQ ID NO: 281268 - DNA, 25 bp, Homo sapien
atttaagcagcacattgaaggtcat

SEQ ID NO: 281269 - DNA, 25 bp, Homo sapien
ctgagcaggcctggattgcagccac

SEQ ID NO: 281270 - DNA, 25 bp, Homo sapien
tggattgcagccacctaggcaccat

SEQ ID NO: 281271 - DNA, 25 bp, Homo sapien
cagccacctaggcaccatagtgaag

SEQ ID NO: 281272 - DNA, 25 bp, Homo sapien
ggttataagataagcccatgcaagg

SEQ ID NO: 281273 - DNA, 25 bp, Homo sapien
gcccatgcaaggcactagagcaagc

SEQ ID NO: 281274 - DNA, 25 bp, Homo sapien
gccagggctggaaagaatgtgctct

SEQ ID NO: 281275 - DNA, 25 bp, Homo sapien
tagagcaagcctaggtaacagccat

SEQ ID NO: 281276 - DNA, 25 bp, Homo sapien
agagtcatatgtaagtctgagttat

SEQ ID NO: 281277 - DNA, 25 bp, Homo sapien
gtctgagttataaacctgtcatagt

SEQ ID NO: 281278 - DNA, 25 bp, Homo sapien
atatcatctcagatacctttaggtg

SEQ ID NO: 281279 - DNA, 25 bp, Homo sapien
gatacctttaggtgacaatgcaaaa

SEQ ID NO: 281280 - DNA, 25 bp, Homo sapien
aggtttatgatgaggatccctttgc

SEQ ID NO: 281281 - DNA, 25 bp, Homo sapien
gaggatccctttgcatattcagagc

SEQ ID NO: 281282 - DNA, 25 bp, Homo sapien
ccctttgcatattcagagccactat

SEQ ID NO: 281283 - DNA, 25 bp, Homo sapien
gagccactatagacctgcccatatt

SEQ ID NO: 281284 - DNA, 25 bp, Homo sapien
tcctcccaccattgattcagttact

SEQ ID NO: 281285 - DNA, 25 bp, Homo sapien
tatagacctgcccatattcttcacg

SEQ ID NO: 281286 - DNA, 25 bp, Homo sapien
atattcttcacgtgctcttaacttg

SEQ ID NO: 281287 - DNA, 25 bp, Homo sapien
tgctgcttacaaatcatctcctgag

SEQ ID NO: 281288 - DNA, 25 bp, Homo sapien
ttcagttactgagacattgtattca

SEQ ID NO: 281289 - DNA, 25 bp, Homo sapien
gtcccgggagatgtccgaggacctc

SEQ ID NO: 281290 - DNA, 25 bp, Homo sapien
tcccgggagatgtccgaggacctcg

SEQ ID NO: 281291 - DNA, 25 bp, Homo sapien
agatgtccgaggacctcggcgcgcc

SEQ ID NO: 281292 - DNA, 25 bp, Homo sapien
aagagggctggtggacgggatgtcc

SEQ ID NO: 281293 - DNA, 25 bp, Homo sapien
tggacgggatgtccccgggagagct

SEQ ID NO: 281294 - DNA, 25 bp, Homo sapien
ggagagctggacttgcgccgcccga

SEQ ID NO: 281295 - DNA, 25 bp, Homo sapien
gaggcccctcacctcttgcagggcg

SEQ ID NO: 281296 - DNA, 25 bp, Homo sapien
caacaccgatgggatttgggaagga

SEQ ID NO: 281297 - DNA, 25 bp, Homo sapien
accgatgggatttgggaaggagctc

SEQ ID NO: 281298 - DNA, 25 bp, Homo sapien
ggaaggagctcggaatggagccgct

SEQ ID NO: 281299 - DNA, 25 bp, Homo sapien
agctcggaatggagccgctggaaga

SEQ ID NO: 281300 - DNA, 25 bp, Homo sapien
ctgaggatttcctcagctgggagaa

SEQ ID NO: 281301 - DNA, 25 bp, Homo sapien
tcagctgggagaaagcacaaagcgt

SEQ ID NO: 281302 - DNA, 25 bp, Homo sapien
agaaagcacaaagcgttttccacct

SEQ ID NO: 281303 - DNA, 25 bp, Homo sapien
tgcagccacaccatcttctaggaca

SEQ ID NO: 281304 - DNA, 25 bp, Homo sapien
agccacaccatcttctaggacaagt

SEQ ID NO: 281305 - DNA, 25 bp, Homo sapien
gccacaccatcttctaggacaagtc

SEQ ID NO: 281306 - DNA, 25 bp, Homo sapien
ggaacacggacatgaagagggccct

SEQ ID NO: 281307 - DNA, 25 bp, Homo sapien
aacacggacatgaagagggccctgg

SEQ ID NO: 281308 - DNA, 25 bp, Homo sapien
ggagactcctcagtagggcaacatt

SEQ ID NO: 281309 - DNA, 25 bp, Homo sapien
gagactcctcagtagggcaacattt

SEQ ID NO: 281310 - DNA, 25 bp, Homo sapien
gactcctcagtagggcaacattttt

SEQ ID NO: 281311 - DNA, 25 bp, Homo sapien
atgaagctcatatccttttgaaggt

SEQ ID NO: 281312 - DNA, 25 bp, Homo sapien
aaggtagttgcaaagagacatttca

SEQ ID NO: 281313 - DNA, 25 bp, Homo sapien
agacatttcaaaactgccctaggcc

SEQ ID NO: 281314 - DNA, 25 bp, Homo sapien
aaaactgccctaggccattgcagca

SEQ ID NO: 281315 - DNA, 25 bp, Homo sapien
taggccattgcagcatccttagatg

SEQ ID NO: 281316 - DNA, 25 bp, Homo sapien
gcagcatccttagatgggacgcata

SEQ ID NO: 281317 - DNA, 25 bp, Homo sapien
gatgggacgcataatcattacctta

SEQ ID NO: 281318 - DNA, 25 bp, Homo sapien
attaccttaaagcatcaccactcat

SEQ ID NO: 281319 - DNA, 25 bp, Homo sapien
gcatcaccactcattttgaccatat

SEQ ID NO: 281320 - DNA, 25 bp, Homo sapien
gtttaaaaggtcaatcagcctcatg

SEQ ID NO: 281321 - DNA, 25 bp, Homo sapien
atcagcctcatgactttatagttat

SEQ ID NO: 281322 - DNA, 25 bp, Homo sapien
gtttttctatagtaacagattctgt

SEQ ID NO: 281323 - DNA, 25 bp, Homo sapien
ggagactgtagtgtgctgccatcat

SEQ ID NO: 281324 - DNA, 25 bp, Homo sapien
actgtagtgtgctgccatcatgcct

SEQ ID NO: 281325 - DNA, 25 bp, Homo sapien
tgccatcatgcctgtgtatagcttc

SEQ ID NO: 281326 - DNA, 25 bp, Homo sapien
atcatgcctgtgtatagcttctgcg

SEQ ID NO: 281327 - DNA, 25 bp, Homo sapien
atgcctgtgtatagcttctgcgcta

SEQ ID NO: 281328 - DNA, 25 bp, Homo sapien
tgtatagcttctgcgctacagccta

SEQ ID NO: 281329 - DNA, 25 bp, Homo sapien
agcttctgcgctacagcctaggcaa

SEQ ID NO: 281330 - DNA, 25 bp, Homo sapien
ttctgcgctacagcctaggcaacgt

SEQ ID NO: 281331 - DNA, 25 bp, Homo sapien
atctattcctcataatttccttaaa

SEQ ID NO: 281332 - DNA, 25 bp, Homo sapien
ctcataatttccttaaaacttgtgg

SEQ ID NO: 281333 - DNA, 25 bp, Homo sapien
attctgtattactgctttggccatg

SEQ ID NO: 281334 - DNA, 25 bp, Homo sapien
ttggccatgtggctctcatgacttt

SEQ ID NO: 281335 - DNA, 25 bp, Homo sapien
gtggctctcatgactttcattgtac

SEQ ID NO: 281336 - DNA, 25 bp, Homo sapien
gactttcattgtaccagattctcag

SEQ ID NO: 281337 - DNA, 25 bp, Homo sapien
ttcattgtaccagattctcagctcc

SEQ ID NO: 281338 - DNA, 25 bp, Homo sapien
agattctcagctccctgaaacatgg

SEQ ID NO: 281339 - DNA, 25 bp, Homo sapien
gcaagatttttgttccatgagcgca

SEQ ID NO: 281340 - DNA, 25 bp, Homo sapien
ttttgttccatgagcgcaatactgt

SEQ ID NO: 281341 - DNA, 25 bp, Homo sapien
gagcgcaatactgtatcattaacat

SEQ ID NO: 281342 - DNA, 25 bp, Homo sapien
gtatggattttatagcatctgtgta

SEQ ID NO: 281343 - DNA, 25 bp, Homo sapien
aaaatgagcgtttttcatcttaaat

SEQ ID NO: 281344 - DNA, 25 bp, Homo sapien
ggattattcccaaactatgtacaat

SEQ ID NO: 281345 - DNA, 25 bp, Homo sapien
atgtacaattaatgggttgccttgc

SEQ ID NO: 281346 - DNA, 25 bp, Homo sapien
ggttgccttgcagagttggatcaat

SEQ ID NO: 281347 - DNA, 25 bp, Homo sapien
ggatcaataatacctgacacacttg

SEQ ID NO: 281348 - DNA, 25 bp, Homo sapien
gacacacttgtatagcaagcataca

SEQ ID NO: 281349 - DNA, 25 bp, Homo sapien
tacactttacatagttcctcgcatc

SEQ ID NO: 281350 - DNA, 25 bp, Homo sapien
agttcctcgcatctattctttgaaa

SEQ ID NO: 281351 - DNA, 25 bp, Homo sapien
ttctttgaaacccagacacattcta

SEQ ID NO: 281352 - DNA, 25 bp, Homo sapien
cagacacattctagtattgggcact

SEQ ID NO: 281353 - DNA, 25 bp, Homo sapien
attgggcactagaaactggtgataa

SEQ ID NO: 281354 - DNA, 25 bp, Homo sapien
taacaattacatatatttcctgaag

SEQ ID NO: 281355 - DNA, 25 bp, Homo sapien
gaagttcctcaacaaacctcggtca

SEQ ID NO: 281356 - DNA, 25 bp, Homo sapien
aacctcggtcaggtactgtggagct

SEQ ID NO: 281357 - DNA, 25 bp, Homo sapien
aggtactgtggagctcccaaagcca

SEQ ID NO: 281358 - DNA, 25 bp, Homo sapien
cacccagaaacagggagggtcctcg

SEQ ID NO: 281359 - DNA, 25 bp, Homo sapien
gagggtcctcgaggaggacacacca

SEQ ID NO: 281360 - DNA, 25 bp, Homo sapien
gaggacacaccagggtctcagcctt

SEQ ID NO: 281361 - DNA, 25 bp, Homo sapien
tgaggcatctgatctattcgctacc

SEQ ID NO: 281362 - DNA, 25 bp, Homo sapien
atctgatctattcgctaccgggact

SEQ ID NO: 281363 - DNA, 25 bp, Homo sapien
tcccgagaggagtcgggacccttcg

SEQ ID NO: 281364 - DNA, 25 bp, Homo sapien
gccttgtcacatttgtctgcattag

SEQ ID NO: 281365 - DNA, 25 bp, Homo sapien
ttgtctgcattagaaactactgaag

SEQ ID NO: 281366 - DNA, 25 bp, Homo sapien
ggatagattccattctaacataaag

SEQ ID NO: 281367 - DNA, 25 bp, Homo sapien
tatagatgagttgactggtagattt

SEQ ID NO: 281368 - DNA, 25 bp, Homo sapien
tagatttggtggtagttgctttctc

SEQ ID NO: 281369 - DNA, 25 bp, Homo sapien
gtggtagttgctttctcgggatata

SEQ ID NO: 281370 - DNA, 25 bp, Homo sapien
gtagttgctttctcgggatataaga

SEQ ID NO: 281371 - DNA, 25 bp, Homo sapien
gtttcaccagatcagatgatgtctg

SEQ ID NO: 281372 - DNA, 25 bp, Homo sapien
agatgatgtctggttattctgtaaa

SEQ ID NO: 281373 - DNA, 25 bp, Homo sapien
tgtaaattatagttcttatcccaga

SEQ ID NO: 281374 - DNA, 25 bp, Homo sapien
tagttcttatcccagaaattactgc

SEQ ID NO: 281375 - DNA, 25 bp, Homo sapien
tccaccatccctaatatcttctaat

SEQ ID NO: 281376 - DNA, 25 bp, Homo sapien
cctaatatcttctaattggtatcat

SEQ ID NO: 281377 - DNA, 25 bp, Homo sapien
gctcccctgaacagttgttataaag

SEQ ID NO: 281378 - DNA, 25 bp, Homo sapien
ctcccctgaacagttgttataaaga

SEQ ID NO: 281379 - DNA, 25 bp, Homo sapien
cccctgaacagttgttataaagact

SEQ ID NO: 281380 - DNA, 25 bp, Homo sapien
tataaagactgtatagtggccgggc

SEQ ID NO: 281381 - DNA, 25 bp, Homo sapien
ataaagactgtatagtggccgggcg

SEQ ID NO: 281382 - DNA, 25 bp, Homo sapien
taaagactgtatagtggccgggcgt

SEQ ID NO: 281383 - DNA, 25 bp, Homo sapien
gaacccagaggcaagtcaagaatgt

SEQ ID NO: 281384 - DNA, 25 bp, Homo sapien
aacccagaggcaagtcaagaatgtg

SEQ ID NO: 281385 - DNA, 25 bp, Homo sapien
cccagaggcaagtcaagaatgtgtc

SEQ ID NO: 281386 - DNA, 25 bp, Homo sapien
cagaggcaagtcaagaatgtgtcac

SEQ ID NO: 281387 - DNA, 25 bp, Homo sapien
agaggcaagtcaagaatgtgtcact

SEQ ID NO: 281388 - DNA, 25 bp, Homo sapien
gttggaaacttgattcccattgcaa

SEQ ID NO: 281389 - DNA, 25 bp, Homo sapien
aacttgattcccattgcaacagtgt

SEQ ID NO: 281390 - DNA, 25 bp, Homo sapien
ggattaatgcagttatctcaagagt

SEQ ID NO: 281391 - DNA, 25 bp, Homo sapien
tctctcttgcccatgtgattccttc

SEQ ID NO: 281392 - DNA, 25 bp, Homo sapien
atgtgattccttccaccatgtttat

SEQ ID NO: 281393 - DNA, 25 bp, Homo sapien
gattccttccaccatgtttatgatg

SEQ ID NO: 281394 - DNA, 25 bp, Homo sapien
ttatgatgcaacaagaaggtcctca

SEQ ID NO: 281395 - DNA, 25 bp, Homo sapien
cagatgctggttccttgatcttgta

SEQ ID NO: 281396 - DNA, 25 bp, Homo sapien
gctggttccttgatcttgtattttg

SEQ ID NO: 281397 - DNA, 25 bp, Homo sapien
tccttgatcttgtattttgcagcct

SEQ ID NO: 281398 - DNA, 25 bp, Homo sapien
tttgcagcctccaaaatcgtgagcc

SEQ ID NO: 281399 - DNA, 25 bp, Homo sapien
attgtgtcctccacccaattatcct

SEQ ID NO: 281400 - DNA, 25 bp, Homo sapien
aattatccttagcattagtttgcta

SEQ ID NO: 281401 - DNA, 25 bp, Homo sapien
gacttattctgcacggacactgcac

SEQ ID NO: 281402 - DNA, 25 bp, Homo sapien
attctgcacggacactgcacacact

SEQ ID NO: 281403 - DNA, 25 bp, Homo sapien
tggagctggctcctgacctatttac

SEQ ID NO: 281404 - DNA, 25 bp, Homo sapien
tgacctatttacacaccgaggaggg

SEQ ID NO: 281405 - DNA, 25 bp, Homo sapien
tacacaccgaggagggatgtggaaa

SEQ ID NO: 281406 - DNA, 25 bp, Homo sapien
gagtcccagggctccaatgcaaaga

SEQ ID NO: 281407 - DNA, 25 bp, Homo sapien
ctccaatgcaaagaggagcctcttc

SEQ ID NO: 281408 - DNA, 25 bp, Homo sapien
tctgccgtggccgtgcaagggacag

SEQ ID NO: 281409 - DNA, 25 bp, Homo sapien
agggacagcgccttgtgggattgtg

SEQ ID NO: 281410 - DNA, 25 bp, Homo sapien
gagtgtaagcagttgtgaatcatta

SEQ ID NO: 281411 - DNA, 25 bp, Homo sapien
gtgaatcattacaagcagtctggga

SEQ ID NO: 281412 - DNA, 25 bp, Homo sapien
gcagtctgggataactaactcctag

SEQ ID NO: 281413 - DNA, 25 bp, Homo sapien
taactaactcctagggataaccatt

SEQ ID NO: 281414 - DNA, 25 bp, Homo sapien
gataaccatttctatcctgttccaa

SEQ ID NO: 281415 - DNA, 25 bp, Homo sapien
ctatcctgttccaaagtcttatttt

SEQ ID NO: 281416 - DNA, 25 bp, Homo sapien
gtttgaaaagcactttgcacacagt

SEQ ID NO: 281417 - DNA, 25 bp, Homo sapien
gcactttgcacacagttcttgtata

SEQ ID NO: 281418 - DNA, 25 bp, Homo sapien
gatatagtgttcctgctttgtttaa

SEQ ID NO: 281419 - DNA, 25 bp, Homo sapien
gctttgtttaataagaacctcattt

SEQ ID NO: 281420 - DNA, 25 bp, Homo sapien
acctcatttaaacttgacagctatg

SEQ ID NO: 281421 - DNA, 25 bp, Homo sapien
gaaaaactcatctaggtgtgaaatt

SEQ ID NO: 281422 - DNA, 25 bp, Homo sapien
gtgaaattatgatatgtacactttt

SEQ ID NO: 281423 - DNA, 25 bp, Homo sapien
gtacactttttcttaatgagtatta

SEQ ID NO: 281424 - DNA, 25 bp, Homo sapien
aaaagattaatggaagtctggctgg

SEQ ID NO: 281425 - DNA, 25 bp, Homo sapien
atgaagggaacatctggactacaga

SEQ ID NO: 281426 - DNA, 25 bp, Homo sapien
tctggactacagataatactgtttc

SEQ ID NO: 281427 - DNA, 25 bp, Homo sapien
atactgtttcttattcttgatgctg

SEQ ID NO: 281428 - DNA, 25 bp, Homo sapien
ttcttattcttgatgctgtacttga

SEQ ID NO: 281429 - DNA, 25 bp, Homo sapien
attcttgatgctgtacttgatctta

SEQ ID NO: 281430 - DNA, 25 bp, Homo sapien
ttgatgctgtacttgatcttagtta

SEQ ID NO: 281431 - DNA, 25 bp, Homo sapien
gtacttgatcttagttatacagatg

SEQ ID NO: 281432 - DNA, 25 bp, Homo sapien
atgtggtttcttttgtacacattac

SEQ ID NO: 281433 - DNA, 25 bp, Homo sapien
tgtggtttcttttgtacacattact

SEQ ID NO: 281434 - DNA, 25 bp, Homo sapien
gtggtttcttttgtacacattactt

SEQ ID NO: 281435 - DNA, 25 bp, Homo sapien
tggtttcttttgtacacattactta

SEQ ID NO: 281436 - DNA, 25 bp, Homo sapien
atatattgtggatttattttcactg

SEQ ID NO: 281437 - DNA, 25 bp, Homo sapien
attgtggatttattttcactgttat

SEQ ID NO: 281438 - DNA, 25 bp, Homo sapien
tgtggatttattttcactgttatat

SEQ ID NO: 281439 - DNA, 25 bp, Homo sapien
ggatttattttcactgttatattta

SEQ ID NO: 281440 - DNA, 25 bp, Homo sapien
attttcactgttatatttaactata

SEQ ID NO: 281441 - DNA, 25 bp, Homo sapien
atgcaaaaagcaaggttgagatgac

SEQ ID NO: 281442 - DNA, 25 bp, Homo sapien
aaagcaaggttgagatgacaatgtt

SEQ ID NO: 281443 - DNA, 25 bp, Homo sapien
tcctggccctggtgcggtccgcagg

SEQ ID NO: 281444 - DNA, 25 bp, Homo sapien
ttgaccctctccttggcactctgag

SEQ ID NO: 281445 - DNA, 25 bp, Homo sapien
tgaggtccccgctcgccgttaagct

SEQ ID NO: 281446 - DNA, 25 bp, Homo sapien
cgctcgccgttaagctggtggtgct

SEQ ID NO: 281447 - DNA, 25 bp, Homo sapien
gcacctgcaggacggtcactctcgg

SEQ ID NO: 281448 - DNA, 25 bp, Homo sapien
tgcaggacggtcactctcgggcact

SEQ ID NO: 281449 - DNA, 25 bp, Homo sapien
ggacggtcactctcgggcacttcag

SEQ ID NO: 281450 - DNA, 25 bp, Homo sapien
ttcagagccctctgacacatcatct

SEQ ID NO: 281451 - DNA, 25 bp, Homo sapien
agtctggcccggtggcaacagaagc

SEQ ID NO: 281452 - DNA, 25 bp, Homo sapien
gtctggcccggtggcaacagaagct

SEQ ID NO: 281453 - DNA, 25 bp, Homo sapien
cttccttgttcatggctgccatgga

SEQ ID NO: 281454 - DNA, 25 bp, Homo sapien
gatgccagtagctcacatatcacca

SEQ ID NO: 281455 - DNA, 25 bp, Homo sapien
atgccagtagctcacatatcaccac

SEQ ID NO: 281456 - DNA, 25 bp, Homo sapien
atatcaccacctcctctgcagtttg

SEQ ID NO: 281457 - DNA, 25 bp, Homo sapien
acctcctctgcagtttggtcatcaa

SEQ ID NO: 281458 - DNA, 25 bp, Homo sapien
cctcctctgcagtttggtcatcaaa

SEQ ID NO: 281459 - DNA, 25 bp, Homo sapien
tcctctgcagtttggtcatcaaaaa

SEQ ID NO: 281460 - DNA, 25 bp, Homo sapien
ctctgcagtttggtcatcaaaaata

SEQ ID NO: 281461 - DNA, 25 bp, Homo sapien
ttggtcatcaaaaatatatgcagat

SEQ ID NO: 281462 - DNA, 25 bp, Homo sapien
atatgcagatatggccatatgtccc

SEQ ID NO: 281463 - DNA, 25 bp, Homo sapien
tatggccatatgtcccctgggggaa

SEQ ID NO: 281464 - DNA, 25 bp, Homo sapien
agttgaataccaactgtcctaaagc

SEQ ID NO: 281465 - DNA, 25 bp, Homo sapien
caagtagaagcctggattagtttgc

SEQ ID NO: 281466 - DNA, 25 bp, Homo sapien
ctggattagtttgcagcaactcaat

SEQ ID NO: 281467 - DNA, 25 bp, Homo sapien
gattagtttgcagcaactcaatccc

SEQ ID NO: 281468 - DNA, 25 bp, Homo sapien
ttagtttgcagcaactcaatcccaa

SEQ ID NO: 281469 - DNA, 25 bp, Homo sapien
gtttgcagcaactcaatcccaaagg

SEQ ID NO: 281470 - DNA, 25 bp, Homo sapien
tgcagcaactcaatcccaaaggaac

SEQ ID NO: 281471 - DNA, 25 bp, Homo sapien
caatcccaaaggaaccaaaggctct

SEQ ID NO: 281472 - DNA, 25 bp, Homo sapien
ttcagagccacctacaattttgtgg

SEQ ID NO: 281473 - DNA, 25 bp, Homo sapien
tcagagccacctacaattttgtgga

SEQ ID NO: 281474 - DNA, 25 bp, Homo sapien
tacaattttgtggaagaactgagca

SEQ ID NO: 281475 - DNA, 25 bp, Homo sapien
tggaagaactgagcactatgtttaa

SEQ ID NO: 281476 - DNA, 25 bp, Homo sapien
tgggttggtttttgtcttcgacgct

SEQ ID NO: 281477 - DNA, 25 bp, Homo sapien
gttggtttttgtcttcgacgctcag

SEQ ID NO: 281478 - DNA, 25 bp, Homo sapien
gtttttgtcttcgacgctcagggtc

SEQ ID NO: 281479 - DNA, 25 bp, Homo sapien
tgtcttcgacgctcagggtctgggc

SEQ ID NO: 281480 - DNA, 25 bp, Homo sapien
acgctcagggtctgggcgcctcgca

SEQ ID NO: 281481 - DNA, 25 bp, Homo sapien
tgggcgcctcgcatttgcagtctgt

SEQ ID NO: 281482 - DNA, 25 bp, Homo sapien
gcctcgcatttgcagtctgttgtga

SEQ ID NO: 281483 - DNA, 25 bp, Homo sapien
ctcgcatttgcagtctgttgtgaca

SEQ ID NO: 281484 - DNA, 25 bp, Homo sapien
cgcatttgcagtctgttgtgacaga

SEQ ID NO: 281485 - DNA, 25 bp, Homo sapien
cggcgaggccccttcagtcttgttc

SEQ ID NO: 281486 - DNA, 25 bp, Homo sapien
ctgagcgctgtatccctgaatatag

SEQ ID NO: 281487 - DNA, 25 bp, Homo sapien
ataaggtaccatccacgattctagg

SEQ ID NO: 281488 - DNA, 25 bp, Homo sapien
ggtaccatccacgattctaggatta

SEQ ID NO: 281489 - DNA, 25 bp, Homo sapien
tccacgattctaggattaggaggaa

SEQ ID NO: 281490 - DNA, 25 bp, Homo sapien
aggaggaaggcttaccttttgcagg

SEQ ID NO: 281491 - DNA, 25 bp, Homo sapien
tctacccctacatcttacctaagaa

SEQ ID NO: 281492 - DNA, 25 bp, Homo sapien
aagctttgcctcttgaagctctgaa

SEQ ID NO: 281493 - DNA, 25 bp, Homo sapien
ttgcctcttgaagctctgaagaaat

SEQ ID NO: 281494 - DNA, 25 bp, Homo sapien
tccatgtcttctcttctgtcatata

SEQ ID NO: 281495 - DNA, 25 bp, Homo sapien
atgtcttctcttctgtcatatatga

SEQ ID NO: 281496 - DNA, 25 bp, Homo sapien
gaatacatgtcattgactttacagt

SEQ ID NO: 281497 - DNA, 25 bp, Homo sapien
gactttacagtccaccagataatcc

SEQ ID NO: 281498 - DNA, 25 bp, Homo sapien
gagaattcccgcaatgaaggccagg

SEQ ID NO: 281499 - DNA, 25 bp, Homo sapien
agtattacagtatcccaatctccag

SEQ ID NO: 281500 - DNA, 25 bp, Homo sapien
gggtccaagtattcaatcctggctc

SEQ ID NO: 281501 - DNA, 25 bp, Homo sapien
atcctggctcagttgcaggctgaca

SEQ ID NO: 281502 - DNA, 25 bp, Homo sapien
gaagagaagcatcgtcctacgctcg

SEQ ID NO: 281503 - DNA, 25 bp, Homo sapien
cgtcctacgctcgtacacaatggag

SEQ ID NO: 281504 - DNA, 25 bp, Homo sapien
atgataacatctgtcacactcttcc

SEQ ID NO: 281505 - DNA, 25 bp, Homo sapien
actcttccatattgtctgcactgaa

SEQ ID NO: 281506 - DNA, 25 bp, Homo sapien
ggcagaaccattaggcaggtcttta

SEQ ID NO: 281507 - DNA, 25 bp, Homo sapien
aatccagatgtgcagacagctgagg

SEQ ID NO: 281508 - DNA, 25 bp, Homo sapien
ggtggcaaagagaattcccgcaatg

SEQ ID NO: 281509 - DNA, 25 bp, Homo sapien
aaaagtcttcagtctcttgcttctg

SEQ ID NO: 281510 - DNA, 25 bp, Homo sapien
ttgcttctgcctgcaaagcaaggca

SEQ ID NO: 281511 - DNA, 25 bp, Homo sapien
aaggcagagtcagcaacatgggcag

SEQ ID NO: 281512 - DNA, 25 bp, Homo sapien
agtctccccactggagaacgctgag

SEQ ID NO: 281513 - DNA, 25 bp, Homo sapien
tgagtcatgcatgggcttctccaag

SEQ ID NO: 281514 - DNA, 25 bp, Homo sapien
gcttctccaagtttccatcagatgg

SEQ ID NO: 281515 - DNA, 25 bp, Homo sapien
tgggatccagtgttgaatccagtgc

SEQ ID NO: 281516 - DNA, 25 bp, Homo sapien
gcaggactggagtctagctggcaaa

SEQ ID NO: 281517 - DNA, 25 bp, Homo sapien
ggagagaccacttttggctaggttt

SEQ ID NO: 281518 - DNA, 25 bp, Homo sapien
ggctaggtttattgtactacttgat

SEQ ID NO: 281519 - DNA, 25 bp, Homo sapien
gtaattgggcttatttattctagag

SEQ ID NO: 281520 - DNA, 25 bp, Homo sapien
gcacgtagaaggtaggagtaagaaa

SEQ ID NO: 281521 - DNA, 25 bp, Homo sapien
gaagagccaaaaagacccagaaata

SEQ ID NO: 281522 - DNA, 25 bp, Homo sapien
gatacaggtaagattggaactcatg

SEQ ID NO: 281523 - DNA, 25 bp, Homo sapien
ggtaagattggaactcatgaagaca

SEQ ID NO: 281524 - DNA, 25 bp, Homo sapien
aagacaaaagataagacagtggcat

SEQ ID NO: 281525 - DNA, 25 bp, Homo sapien
agataagacagtggcatagagttaa

SEQ ID NO: 281526 - DNA, 25 bp, Homo sapien
gacagtggcatagagttaatattta

SEQ ID NO: 281527 - DNA, 25 bp, Homo sapien
aactttatcttgaaagggtctatct

SEQ ID NO: 281528 - DNA, 25 bp, Homo sapien
ctttatcttgaaagggtctatcttg

SEQ ID NO: 281529 - DNA, 25 bp, Homo sapien
aagggtctatcttgttacttagaat

SEQ ID NO: 281530 - DNA, 25 bp, Homo sapien
agggtctatcttgttacttagaata

SEQ ID NO: 281531 - DNA, 25 bp, Homo sapien
caagtagaagcctggattagtttgc

SEQ ID NO: 281532 - DNA, 25 bp, Homo sapien
ctggattagtttgcagcaactcaat

SEQ ID NO: 281533 - DNA, 25 bp, Homo sapien
tggattagtttgcagcaactcaatc

SEQ ID NO: 281534 - DNA, 25 bp, Homo sapien
gattagtttgcagcaactcaatccc

SEQ ID NO: 281535 - DNA, 25 bp, Homo sapien
attagtttgcagcaactcaatccca

SEQ ID NO: 281536 - DNA, 25 bp, Homo sapien
ttagtttgcagcaactcaatcccaa

SEQ ID NO: 281537 - DNA, 25 bp, Homo sapien
caactcaatcccaaaggaaccaaag

SEQ ID NO: 281538 - DNA, 25 bp, Homo sapien
ctcaatcccaaaggaaccaaaggct

SEQ ID NO: 281539 - DNA, 25 bp, Homo sapien
caatcccaaaggaaccaaaggctct

SEQ ID NO: 281540 - DNA, 25 bp, Homo sapien
ttcagagccacctacaattttgtgg

SEQ ID NO: 281541 - DNA, 25 bp, Homo sapien
tcagagccacctacaattttgtgga

SEQ ID NO: 281542 - DNA, 25 bp, Homo sapien
tggcttcaccttaatattgcctctc

SEQ ID NO: 281543 - DNA, 25 bp, Homo sapien
taatattgcctctcctgtgtacttt

SEQ ID NO: 281544 - DNA, 25 bp, Homo sapien
tgtgtactttcctcactgcagaaga

SEQ ID NO: 281545 - DNA, 25 bp, Homo sapien
tttcctcactgcagaagaaccaaca

SEQ ID NO: 281546 - DNA, 25 bp, Homo sapien
gtaatttctggccttctgtaagctt

SEQ ID NO: 281547 - DNA, 25 bp, Homo sapien
ggccttctgtaagcttttatgtcaa

SEQ ID NO: 281548 - DNA, 25 bp, Homo sapien
aaatcttttctttgtgagggcagta

SEQ ID NO: 281549 - DNA, 25 bp, Homo sapien
tattctcttgaagtcctttgctttt

SEQ ID NO: 281550 - DNA, 25 bp, Homo sapien
gttgaaacatttagtctcgcctttg

SEQ ID NO: 281551 - DNA, 25 bp, Homo sapien
agtctcgcctttgttcacatatgaa

SEQ ID NO: 281552 - DNA, 25 bp, Homo sapien
ttagcacgtcttcatttggcttcac

SEQ ID NO: 281553 - DNA, 25 bp, Homo sapien
catgggccttggttgaagcctctaa

SEQ ID NO: 281554 - DNA, 25 bp, Homo sapien
gcctctaatcctgtaagggctgctt

SEQ ID NO: 281555 - DNA, 25 bp, Homo sapien
agaaacccggtgtaagcctcaatcg

SEQ ID NO: 281556 - DNA, 25 bp, Homo sapien
gtgtaagcctcaatcggtagccggt

SEQ ID NO: 281557 - DNA, 25 bp, Homo sapien
aatcggtagccggtctggcctcttt

SEQ ID NO: 281558 - DNA, 25 bp, Homo sapien
tctttctcacacttaaccgacacag

SEQ ID NO: 281559 - DNA, 25 bp, Homo sapien
taaccgacacagctcttgctctgat

SEQ ID NO: 281560 - DNA, 25 bp, Homo sapien
ttgctctgatctcatcccaagtcat

SEQ ID NO: 281561 - DNA, 25 bp, Homo sapien
catcccaagtcatctcgctggagga

SEQ ID NO: 281562 - DNA, 25 bp, Homo sapien
gctggaggacaattaactcggcttc

SEQ ID NO: 281563 - DNA, 25 bp, Homo sapien
aactcggcttcaaaatggccctcag

SEQ ID NO: 281564 - DNA, 25 bp, Homo sapien
catggctgccatggagaacacctgg

SEQ ID NO: 281565 - DNA, 25 bp, Homo sapien
ttcatcctggccctggtgcggtccg

SEQ ID NO: 281566 - DNA, 25 bp, Homo sapien
ttgaccctctccttggcactctgag

SEQ ID NO: 281567 - DNA, 25 bp, Homo sapien
tgaggtccccgctcgccgttaagct

SEQ ID NO: 281568 - DNA, 25 bp, Homo sapien
cgctcgccgttaagctggtggtgct

SEQ ID NO: 281569 - DNA, 25 bp, Homo sapien
gcacctgcaggacggtcactctcgg

SEQ ID NO: 281570 - DNA, 25 bp, Homo sapien
ggacggtcactctcgggcacttcag

SEQ ID NO: 281571 - DNA, 25 bp, Homo sapien
ttcagagccctctgacacatcatct

SEQ ID NO: 281572 - DNA, 25 bp, Homo sapien
agtctggcccggtggcaacagaagc

SEQ ID NO: 281573 - DNA, 25 bp, Homo sapien
ggcccggtggcaacagaagctgttc

SEQ ID NO: 281574 - DNA, 25 bp, Homo sapien
cttccttgttcatggctgccatgga

SEQ ID NO: 281575 - DNA, 25 bp, Homo sapien
gaggaaagattctgggtgctcatga

SEQ ID NO: 281576 - DNA, 25 bp, Homo sapien
aaacttgggagcctcttgagagtgt

SEQ ID NO: 281577 - DNA, 25 bp, Homo sapien
tgagagtgtacagcatcagcccttg

SEQ ID NO: 281578 - DNA, 25 bp, Homo sapien
agcccttgccaactcttgtttatat

SEQ ID NO: 281579 - DNA, 25 bp, Homo sapien
gccaactcttgtttatatgcattta

SEQ ID NO: 281580 - DNA, 25 bp, Homo sapien
taactttcagttaaccatgggaata

SEQ ID NO: 281581 - DNA, 25 bp, Homo sapien
caatctacaaacaaaggccatccta

SEQ ID NO: 281582 - DNA, 25 bp, Homo sapien
aaggccatcctaacgttcatgttat

SEQ ID NO: 281583 - DNA, 25 bp, Homo sapien
taacgttcatgttattcttttccct

SEQ ID NO: 281584 - DNA, 25 bp, Homo sapien
cttttccctaagaatctttcacaag

SEQ ID NO: 281585 - DNA, 25 bp, Homo sapien
atctttcacaagagctataatcaag

SEQ ID NO: 281586 - DNA, 25 bp, Homo sapien
tctttcttcagcctattttcctatc

SEQ ID NO: 281587 - DNA, 25 bp, Homo sapien
tttcttcagcctattttcctatctc

SEQ ID NO: 281588 - DNA, 25 bp, Homo sapien
tcttcagcctattttcctatctcct

SEQ ID NO: 281589 - DNA, 25 bp, Homo sapien
ttcagcctattttcctatctcctct

SEQ ID NO: 281590 - DNA, 25 bp, Homo sapien
tattttcctatctcctctcgcacca

SEQ ID NO: 281591 - DNA, 25 bp, Homo sapien
tctcgcaccatactaggcacacaat

SEQ ID NO: 281592 - DNA, 25 bp, Homo sapien
tcgcaccatactaggcacacaatct

SEQ ID NO: 281593 - DNA, 25 bp, Homo sapien
taggcacacaatctctgtacctgtg

SEQ ID NO: 281594 - DNA, 25 bp, Homo sapien
ggcacacaatctctgtacctgtgct

SEQ ID NO: 281595 - DNA, 25 bp, Homo sapien
acacaatctctgtacctgtgctgtc

SEQ ID NO: 281596 - DNA, 25 bp, Homo sapien
acaatctctgtacctgtgctgtctt

SEQ ID NO: 281597 - DNA, 25 bp, Homo sapien
aatctggatccagtgagaggaaaga

SEQ ID NO: 281598 - DNA, 25 bp, Homo sapien
gaggaaagattctgggtgctcatga

SEQ ID NO: 281599 - DNA, 25 bp, Homo sapien
aacaaaacttgggagcctcttgaga

SEQ ID NO: 281600 - DNA, 25 bp, Homo sapien
aaacttgggagcctcttgagagtgt

SEQ ID NO: 281601 - DNA, 25 bp, Homo sapien
ggagcctcttgagagtgtacagcat

SEQ ID NO: 281602 - DNA, 25 bp, Homo sapien
ttgagagtgtacagcatcagccctt

SEQ ID NO: 281603 - DNA, 25 bp, Homo sapien
gagagtgtacagcatcagcccttgc

SEQ ID NO: 281604 - DNA, 25 bp, Homo sapien
gcccttgccaactcttgtttatatg

SEQ ID NO: 281605 - DNA, 25 bp, Homo sapien
gccaactcttgtttatatgcattta

SEQ ID NO: 281606 - DNA, 25 bp, Homo sapien
gtttatatgcatttaactttcagtt

SEQ ID NO: 281607 - DNA, 25 bp, Homo sapien
taactttcagttaaccatgggaata

SEQ ID NO: 281608 - DNA, 25 bp, Homo sapien
tctaaatatttttctgggcatgctc

SEQ ID NO: 281609 - DNA, 25 bp, Homo sapien
aaatatttttctgggcatgctcatg

SEQ ID NO: 281610 - DNA, 25 bp, Homo sapien
atttttctgggcatgctcatgtatg

SEQ ID NO: 281611 - DNA, 25 bp, Homo sapien
tctgggcatgctcatgtatgtacat

SEQ ID NO: 281612 - DNA, 25 bp, Homo sapien
ggcatgctcatgtatgtacatcagt

SEQ ID NO: 281613 - DNA, 25 bp, Homo sapien
tgctcatgtatgtacatcagttgtt

SEQ ID NO: 281614 - DNA, 25 bp, Homo sapien
gtggtttcttttgtacacattactt

SEQ ID NO: 281615 - DNA, 25 bp, Homo sapien
gtaattttaatgtctgcttagcacc

SEQ ID NO: 281616 - DNA, 25 bp, Homo sapien
taatgtctgcttagcaccccactga

SEQ ID NO: 281617 - DNA, 25 bp, Homo sapien
accccactgataaccaaatcacagt

SEQ ID NO: 281618 - DNA, 25 bp, Homo sapien
actgataaccaaatcacagtttatt

SEQ ID NO: 281619 - DNA, 25 bp, Homo sapien
agagccgccagcaacatcatcttct

SEQ ID NO: 281620 - DNA, 25 bp, Homo sapien
gattcggaggaacctgagtgcctca

SEQ ID NO: 281621 - DNA, 25 bp, Homo sapien
gaggaacctgagtgcctcagtcatc

SEQ ID NO: 281622 - DNA, 25 bp, Homo sapien
tgagtgcctcagtcatcgccgtcac

SEQ ID NO: 281623 - DNA, 25 bp, Homo sapien
acccagaagatcctgcttccgtggt

SEQ ID NO: 281624 - DNA, 25 bp, Homo sapien
aagatcctgcttccgtggttgaggc

SEQ ID NO: 281625 - DNA, 25 bp, Homo sapien
atcctgcttccgtggttgaggcgcg

SEQ ID NO: 281626 - DNA, 25 bp, Homo sapien
ttgaggcgcggaagctggaggccac

SEQ ID NO: 281627 - DNA, 25 bp, Homo sapien
tggaggccaccatcatcggcgagtg

SEQ ID NO: 281628 - DNA, 25 bp, Homo sapien
catcatcggcgagtgggtaaaggca

SEQ ID NO: 281629 - DNA, 25 bp, Homo sapien
taaaggcagccaggcgtgagcagca

SEQ ID NO: 281630 - DNA, 25 bp, Homo sapien
aagctccgcgccttactcagtcaat

SEQ ID NO: 281631 - DNA, 25 bp, Homo sapien
acacccttactctgtgtcagcggtg

SEQ ID NO: 281632 - DNA, 25 bp, Homo sapien
ggaggagtccaataccttcctctga

SEQ ID NO: 281633 - DNA, 25 bp, Homo sapien
agtccaataccttcctctgaaagag

SEQ ID NO: 281634 - DNA, 25 bp, Homo sapien
aaagagctggaattctagccctgca

SEQ ID NO: 281635 - DNA, 25 bp, Homo sapien
agctggaattctagccctgcattgt

SEQ ID NO: 281636 - DNA, 25 bp, Homo sapien
ggaattctagccctgcattgtccaa

SEQ ID NO: 281637 - DNA, 25 bp, Homo sapien
tctagccctgcattgtccaacataa

SEQ ID NO: 281638 - DNA, 25 bp, Homo sapien
gccctgcattgtccaacataacttt

SEQ ID NO: 281639 - DNA, 25 bp, Homo sapien
cataatctttcttccctcactctgt

SEQ ID NO: 281640 - DNA, 25 bp, Homo sapien
gaagatagatcatcgtcaccgctgc

SEQ ID NO: 281641 - DNA, 25 bp, Homo sapien
tagagctttgcgaatgggatcaggt

SEQ ID NO: 281642 - DNA, 25 bp, Homo sapien
atgggatcaggtgcccttatgaaaa

SEQ ID NO: 281643 - DNA, 25 bp, Homo sapien
gatcaggtgcccttatgaaaaggct

SEQ ID NO: 281644 - DNA, 25 bp, Homo sapien
ggtgcccttatgaaaaggcttgata

SEQ ID NO: 281645 - DNA, 25 bp, Homo sapien
gacatgagccctcaacagacaactg

SEQ ID NO: 281646 - DNA, 25 bp, Homo sapien
atgagccctcaacagacaactgcac

SEQ ID NO: 281647 - DNA, 25 bp, Homo sapien
aacagacaactgcacctactgatgt

SEQ ID NO: 281648 - DNA, 25 bp, Homo sapien
cagacaactgcacctactgatgttt

SEQ ID NO: 281649 - DNA, 25 bp, Homo sapien
gacaactgcacctactgatgttttg

SEQ ID NO: 281650 - DNA, 25 bp, Homo sapien
caactgcacctactgatgttttgat

SEQ ID NO: 281651 - DNA, 25 bp, Homo sapien
actgcacctactgatgttttgatgt

SEQ ID NO: 281652 - DNA, 25 bp, Homo sapien
gtgtgataactctttgccaacctac

SEQ ID NO: 281653 - DNA, 25 bp, Homo sapien
caacctacgaaacccatatctggaa

SEQ ID NO: 281654 - DNA, 25 bp, Homo sapien
tggaagaatcaccagctcccgtgag

SEQ ID NO: 281655 - DNA, 25 bp, Homo sapien
gctcccgtgagcagcttcatgtaaa

SEQ ID NO: 281656 - DNA, 25 bp, Homo sapien
aatagatgcactccaagcagattgc

SEQ ID NO: 281657 - DNA, 25 bp, Homo sapien
agcagattgcatgcctcaggtgttt

SEQ ID NO: 281658 - DNA, 25 bp, Homo sapien
gcctcaggtgtttgtcttctagtaa

SEQ ID NO: 281659 - DNA, 25 bp, Homo sapien
ggagtgtgcaacacccagagtaaca

SEQ ID NO: 281660 - DNA, 25 bp, Homo sapien
ggctaaaaacccttaatgctgcatt

SEQ ID NO: 281661 - DNA, 25 bp, Homo sapien
tgctgccagttgtaaagagatgcct

SEQ ID NO: 281662 - DNA, 25 bp, Homo sapien
ctgccctgtgggtgaaactgatgat

SEQ ID NO: 281663 - DNA, 25 bp, Homo sapien
gcgagaagaggagtccatttctccg

SEQ ID NO: 281664 - DNA, 25 bp, Homo sapien
ggatgcaggcccctgattcagtacg

SEQ ID NO: 281665 - DNA, 25 bp, Homo sapien
gcccctgattcagtacgttctgtga

SEQ ID NO: 281666 - DNA, 25 bp, Homo sapien
tacgttctgtgaaagtggagcgaga

SEQ ID NO: 281667 - DNA, 25 bp, Homo sapien
gccactaccagcctaactttaggaa

SEQ ID NO: 281668 - DNA, 25 bp, Homo sapien
aactttaggaactgtcgtccacctg

SEQ ID NO: 281669 - DNA, 25 bp, Homo sapien
gaactgtcgtccacctggcttttat

SEQ ID NO: 281670 - DNA, 25 bp, Homo sapien
ctggcttttattatactgccttaaa

SEQ ID NO: 281671 - DNA, 25 bp, Homo sapien
actgccttaaacatattcacttttt

SEQ ID NO: 281672 - DNA, 25 bp, Homo sapien
gagactctagaaatttcacaagttt

SEQ ID NO: 281673 - DNA, 25 bp, Homo sapien
gcacactgggctttgggtgtgtttc

SEQ ID NO: 281674 - DNA, 25 bp, Homo sapien
attcctttgctatagtatattgcat

SEQ ID NO: 281675 - DNA, 25 bp, Homo sapien
tattgcataatgtggagtcaactat

SEQ ID NO: 281676 - DNA, 25 bp, Homo sapien
ggagtcaactattttttacaatatg

SEQ ID NO: 281677 - DNA, 25 bp, Homo sapien
tacaatatgtacgtgttgatctgaa

SEQ ID NO: 281678 - DNA, 25 bp, Homo sapien
gtacgtgttgatctgaaagttccta

SEQ ID NO: 281679 - DNA, 25 bp, Homo sapien
gatctgaaagttcctattgagttaa

SEQ ID NO: 281680 - DNA, 25 bp, Homo sapien
ataatttggtggaccatgaatttta

SEQ ID NO: 281681 - DNA, 25 bp, Homo sapien
attcttcatttaaccttgttgcttt

SEQ ID NO: 281682 - DNA, 25 bp, Homo sapien
tcatttaaccttgttgctttgagta

SEQ ID NO: 281683 - DNA, 25 bp, Homo sapien
gttgctttgagtactcctaaagctt

SEQ ID NO: 281684 - DNA, 25 bp, Homo sapien
gagtactcctaaagcttgtaataat

SEQ ID NO: 281685 - DNA, 25 bp, Homo sapien
tctctgcagtcctgtggagcagttg

SEQ ID NO: 281686 - DNA, 25 bp, Homo sapien
agcagttggactgctctctctgctc

SEQ ID NO: 281687 - DNA, 25 bp, Homo sapien
tctctgctctcaggatgatactgtg

SEQ ID NO: 281688 - DNA, 25 bp, Homo sapien
atatgctaagcacatgtcaggaaac

SEQ ID NO: 281689 - DNA, 25 bp, Homo sapien
aagcacatgtcaggaaacagttttg

SEQ ID NO: 281690 - DNA, 25 bp, Homo sapien
ttgtggtctttggacactcgctgta

SEQ ID NO: 281691 - DNA, 25 bp, Homo sapien
ttggacactcgctgtagccattccg

SEQ ID NO: 281692 - DNA, 25 bp, Homo sapien
agccattccgttccatttcaggtga

SEQ ID NO: 281693 - DNA, 25 bp, Homo sapien
tccgttccatttcaggtgattttat

SEQ ID NO: 281694 - DNA, 25 bp, Homo sapien
tatacaccactaaagcctcccatta

SEQ ID NO: 281695 - DNA, 25 bp, Homo sapien
taaagcctcccattaaacccataga

SEQ ID NO: 281696 - DNA, 25 bp, Homo sapien
tggtgcacagcaggttgtacatgat

SEQ ID NO: 281697 - DNA, 25 bp, Homo sapien
agcaggttgtacatgatttcatgtt

SEQ ID NO: 281698 - DNA, 25 bp, Homo sapien
ttcatgtttatgtagcaaaatgcat

SEQ ID NO: 281699 - DNA, 25 bp, Homo sapien
cattgaaatgtattagtgttgaaac

SEQ ID NO: 281700 - DNA, 25 bp, Homo sapien
attgttatattttccttgtgtgtca

SEQ ID NO: 281701 - DNA, 25 bp, Homo sapien
ttatattttccttgtgtgtcattta

SEQ ID NO: 281702 - DNA, 25 bp, Homo sapien
attcagcctaactgaataaggctaa

SEQ ID NO: 281703 - DNA, 25 bp, Homo sapien
aaggctaaatgaatactgtaattga

SEQ ID NO: 281704 - DNA, 25 bp, Homo sapien
tttaaatctttgtcatgagtttttt

SEQ ID NO: 281705 - DNA, 25 bp, Homo sapien
attgtatcattcctgattacacaga

SEQ ID NO: 281706 - DNA, 25 bp, Homo sapien
attacacagaactttgtgggtggtt

SEQ ID NO: 281707 - DNA, 25 bp, Homo sapien
ctagaagttccatgtttgctttaga

SEQ ID NO: 281708 - DNA, 25 bp, Homo sapien
tagaagttccatgtttgctttagaa

SEQ ID NO: 281709 - DNA, 25 bp, Homo sapien
gtttgctttagaagccttagtttag

SEQ ID NO: 281710 - DNA, 25 bp, Homo sapien
tgctttagaagccttagtttagacc

SEQ ID NO: 281711 - DNA, 25 bp, Homo sapien
gctttagaagccttagtttagacca

SEQ ID NO: 281712 - DNA, 25 bp, Homo sapien
ctttagaagccttagtttagaccag

SEQ ID NO: 281713 - DNA, 25 bp, Homo sapien
ttagaagccttagtttagaccaggt

SEQ ID NO: 281714 - DNA, 25 bp, Homo sapien
tagaagccttagtttagaccaggtg

SEQ ID NO: 281715 - DNA, 25 bp, Homo sapien
agaagccttagtttagaccaggtgc

SEQ ID NO: 281716 - DNA, 25 bp, Homo sapien
gaagccttagtttagaccaggtgca

SEQ ID NO: 281717 - DNA, 25 bp, Homo sapien
gccttagtttagaccaggtgcagtg

SEQ ID NO: 281718 - DNA, 25 bp, Homo sapien
atcatgactcacacgtattaattgg

SEQ ID NO: 281719 - DNA, 25 bp, Homo sapien
tgttgtgtacactggttagataaaa

SEQ ID NO: 281720 - DNA, 25 bp, Homo sapien
ggatgttggcaaaccagtgcatgca

SEQ ID NO: 281721 - DNA, 25 bp, Homo sapien
aaccagtgcatgcacctggttggaa

SEQ ID NO: 281722 - DNA, 25 bp, Homo sapien
ggttggaagatgctcagcctcacaa

SEQ ID NO: 281723 - DNA, 25 bp, Homo sapien
tcacaaaagctccaagccctttggg

SEQ ID NO: 281724 - DNA, 25 bp, Homo sapien
tttgggagccaaagtgtctgagagt

SEQ ID NO: 281725 - DNA, 25 bp, Homo sapien
gccaaagtgtctgagagtgtgaccc

SEQ ID NO: 281726 - DNA, 25 bp, Homo sapien
agtgtgaccctctcctgtaaagtat

SEQ ID NO: 281727 - DNA, 25 bp, Homo sapien
tgtaaagtatttatcccacccatta

SEQ ID NO: 281728 - DNA, 25 bp, Homo sapien
atcccacccattaatataatttctg

SEQ ID NO: 281729 - DNA, 25 bp, Homo sapien
aaagcacccgtgaacccacaaggat

SEQ ID NO: 281730 - DNA, 25 bp, Homo sapien
agcacccgtgaacccacaaggataa

SEQ ID NO: 281731 - DNA, 25 bp, Homo sapien
taaaataatgtgtttgtccctgccc

SEQ ID NO: 281732 - DNA, 25 bp, Homo sapien
tgaggctggttgatggtacattgtt

SEQ ID NO: 281733 - DNA, 25 bp, Homo sapien
ggctggttgatggtacattgttgta

SEQ ID NO: 281734 - DNA, 25 bp, Homo sapien
acattgttgtagaataattgcggaa

SEQ ID NO: 281735 - DNA, 25 bp, Homo sapien
taattgcggaattttatttacctgg

SEQ ID NO: 281736 - DNA, 25 bp, Homo sapien
ttatttacctggaagtttgctgaga

SEQ ID NO: 281737 - DNA, 25 bp, Homo sapien
gtttgctgagaaaacaatgtctgag

SEQ ID NO: 281738 - DNA, 25 bp, Homo sapien
gagaaaacaatgtctgaggtggtgt

SEQ ID NO: 281739 - DNA, 25 bp, Homo sapien
aaacatttgacagagttctcataat

SEQ ID NO: 281740 - DNA, 25 bp, Homo sapien
aaagaggcactacatagagtggtta

SEQ ID NO: 281741 - DNA, 25 bp, Homo sapien
gataaacagaatcaggtctccagtt

SEQ ID NO: 281742 - DNA, 25 bp, Homo sapien
acagaatcaggtctccagttttttg

SEQ ID NO: 281743 - DNA, 25 bp, Homo sapien
gaaaagggcttagcatctagacaca

SEQ ID NO: 281744 - DNA, 25 bp, Homo sapien
gggcttagcatctagacacaacaaa

SEQ ID NO: 281745 - DNA, 25 bp, Homo sapien
tctagacacaacaaagaagtgctgg

SEQ ID NO: 281746 - DNA, 25 bp, Homo sapien
gaagtgctggaaattcagtgatcaa

SEQ ID NO: 281747 - DNA, 25 bp, Homo sapien
ttcagtgatcaaagatacttcatgt

SEQ ID NO: 281748 - DNA, 25 bp, Homo sapien
gatacttcatgtaacgactctggtg

SEQ ID NO: 281749 - DNA, 25 bp, Homo sapien
ttggcaagaatatggtaacatgatg

SEQ ID NO: 281750 - DNA, 25 bp, Homo sapien
gtaacatgatggtaattagcaggga

SEQ ID NO: 281751 - DNA, 25 bp, Homo sapien
ggtgacggcatgactccatctccaa

SEQ ID NO: 281752 - DNA, 25 bp, Homo sapien
gattttggagtagattcatcattaa

SEQ ID NO: 281753 - DNA, 25 bp, Homo sapien
gtagattcatcattaataagtaaca

SEQ ID NO: 281754 - DNA, 25 bp, Homo sapien
atggctaataaaatgaacacaatgt

SEQ ID NO: 281755 - DNA, 25 bp, Homo sapien
aatctataaattgatcatctgttta

SEQ ID NO: 281756 - DNA, 25 bp, Homo sapien
attgatcatctgtttataaattggc

SEQ ID NO: 281757 - DNA, 25 bp, Homo sapien
gatcatctgtttataaattggcaga

SEQ ID NO: 281758 - DNA, 25 bp, Homo sapien
tataaattggcagatggttgtgtac

SEQ ID NO: 281759 - DNA, 25 bp, Homo sapien
tggcagatggttgtgtaccatcttt

SEQ ID NO: 281760 - DNA, 25 bp, Homo sapien
ggcagatggttgtgtaccatctttt

SEQ ID NO: 281761 - DNA, 25 bp, Homo sapien
gcagatggttgtgtaccatctttta

SEQ ID NO: 281762 - DNA, 25 bp, Homo sapien
ggacatcgtttcataaaattaaggt

SEQ ID NO: 281763 - DNA, 25 bp, Homo sapien
ggtttaacagactgaatcccaacat

SEQ ID NO: 281764 - DNA, 25 bp, Homo sapien
gactgaatcccaacattagtagtat

SEQ ID NO: 281765 - DNA, 25 bp, Homo sapien
gtataactaaattctctcaggagct

SEQ ID NO: 281766 - DNA, 25 bp, Homo sapien
ggagctttttatgaatgccttagta

SEQ ID NO: 281767 - DNA, 25 bp, Homo sapien
atgccttagtagtactttggcttct

SEQ ID NO: 281768 - DNA, 25 bp, Homo sapien
tagtagtactttggcttcttgaaga

SEQ ID NO: 281769 - DNA, 25 bp, Homo sapien
ggagctaatgccataacccttttta

SEQ ID NO: 281770 - DNA, 25 bp, Homo sapien
taaccctttttaaatcatccatctg

SEQ ID NO: 281771 - DNA, 25 bp, Homo sapien
taaatcatccatctgcagctgggca

SEQ ID NO: 281772 - DNA, 25 bp, Homo sapien
tcatccatctgcagctgggcatggt

SEQ ID NO: 281773 - DNA, 25 bp, Homo sapien
ctactccttacagtctctagaatta

SEQ ID NO: 281774 - DNA, 25 bp, Homo sapien
gtctctagaattaaatgtactcatt

SEQ ID NO: 281775 - DNA, 25 bp, Homo sapien
aatgcatattttagccactttagag

SEQ ID NO: 281776 - DNA, 25 bp, Homo sapien
tttagccactttagagaaacctcat

SEQ ID NO: 281777 - DNA, 25 bp, Homo sapien
aacctcataggcacagagtttccaa

SEQ ID NO: 281778 - DNA, 25 bp, Homo sapien
cagagtttccaagattaattttaag

SEQ ID NO: 281779 - DNA, 25 bp, Homo sapien
gaatatcttcacgaacttgaccctc

SEQ ID NO: 281780 - DNA, 25 bp, Homo sapien
tactccacattgcaacatttccatc

SEQ ID NO: 281781 - DNA, 25 bp, Homo sapien
gcaacatttccatcagacagcattt

SEQ ID NO: 281782 - DNA, 25 bp, Homo sapien
gacagcatttcaattccagtattat

SEQ ID NO: 281783 - DNA, 25 bp, Homo sapien
tccagtattatgtatattgcaaatt

SEQ ID NO: 281784 - DNA, 25 bp, Homo sapien
ttctctggtagcccgggtttggact

SEQ ID NO: 281785 - DNA, 25 bp, Homo sapien
tttggactcttcctcctggcatcag

SEQ ID NO: 281786 - DNA, 25 bp, Homo sapien
ggagagagatgttggagccacccat

SEQ ID NO: 281787 - DNA, 25 bp, Homo sapien
atgttggagccacccatcaggcatg

SEQ ID NO: 281788 - DNA, 25 bp, Homo sapien
tggcggcctcgctgttaccagaaga

SEQ ID NO: 281789 - DNA, 25 bp, Homo sapien
gcctcgctgttaccagaagacgttt

SEQ ID NO: 281790 - DNA, 25 bp, Homo sapien
agaagacgtttttctctgccttaca

SEQ ID NO: 281791 - DNA, 25 bp, Homo sapien
gtttttctctgccttacacttctca

SEQ ID NO: 281792 - DNA, 25 bp, Homo sapien
tggacaccgggcttttgctgggctc

SEQ ID NO: 281793 - DNA, 25 bp, Homo sapien
cgggcttttgctgggctctccagag

SEQ ID NO: 281794 - DNA, 25 bp, Homo sapien
agagctgggcttggctcttccagct

SEQ ID NO: 281795 - DNA, 25 bp, Homo sapien
actgccatgtgcctataactatagg

SEQ ID NO: 281796 - DNA, 25 bp, Homo sapien
tataactataggttattctctttcc

SEQ ID NO: 281797 - DNA, 25 bp, Homo sapien
gtatttgttctctacaataaatgtg

SEQ ID NO: 281798 - DNA, 25 bp, Homo sapien
aaacatattggactactattacata

SEQ ID NO: 281799 - DNA, 25 bp, Homo sapien
tattttttcacttaccgttccactg

SEQ ID NO: 281800 - DNA, 25 bp, Homo sapien
tttcacttaccgttccactgagcag

SEQ ID NO: 281801 - DNA, 25 bp, Homo sapien
gttccactgagcagcaaccgggact

SEQ ID NO: 281802 - DNA, 25 bp, Homo sapien
gcagcaaccgggactggtcaataga

SEQ ID NO: 281803 - DNA, 25 bp, Homo sapien
ccgggactggtcaatagatggaaat

SEQ ID NO: 281804 - DNA, 25 bp, Homo sapien
ggaaatcaatcccaatttagagaca

SEQ ID NO: 281805 - DNA, 25 bp, Homo sapien
atcccaatttagagacaatacctgg

SEQ ID NO: 281806 - DNA, 25 bp, Homo sapien
cagtaggattgtgtaatgtattctc

SEQ ID NO: 281807 - DNA, 25 bp, Homo sapien
tattctctcttgtagcctattcttc

SEQ ID NO: 281808 - DNA, 25 bp, Homo sapien
gtagcctattcttcaaagcgtatct

SEQ ID NO: 281809 - DNA, 25 bp, Homo sapien
aaagcgtatcttcactttccatgtt

SEQ ID NO: 281810 - DNA, 25 bp, Homo sapien
ttatgattgtctaggattccatgga

SEQ ID NO: 281811 - DNA, 25 bp, Homo sapien
aattgagtcatctggtagagcgcat

SEQ ID NO: 281812 - DNA, 25 bp, Homo sapien
tggtagagcgcatataggacaggac

SEQ ID NO: 281813 - DNA, 25 bp, Homo sapien
aggacaggacgctaggttgtttatc

SEQ ID NO: 281814 - DNA, 25 bp, Homo sapien
gacgctaggttgtttatcttttgtt

SEQ ID NO: 281815 - DNA, 25 bp, Homo sapien
ctatgtgggatgcatttggtgatct

SEQ ID NO: 281816 - DNA, 25 bp, Homo sapien
aaatttcttgagtaattcctggatt

SEQ ID NO: 281817 - DNA, 25 bp, Homo sapien
ggtcgcagagccactgtccaaataa

SEQ ID NO: 281818 - DNA, 25 bp, Homo sapien
aaggcatttcgagagccacgaggat

SEQ ID NO: 281819 - DNA, 25 bp, Homo sapien
atgacataaagcagactccgcgttt

SEQ ID NO: 281820 - DNA, 25 bp, Homo sapien
agactccgcgtttcttcatttttcg

SEQ ID NO: 281821 - DNA, 25 bp, Homo sapien
gcgtttcttcatttttcgttaagtg

SEQ ID NO: 281822 - DNA, 25 bp, Homo sapien
gttaagtgacacgatttccctcaca

SEQ ID NO: 281823 - DNA, 25 bp, Homo sapien
tgtcatccattaccacgacccgtgt

SEQ ID NO: 281824 - DNA, 25 bp, Homo sapien
gacccgtgtgacagaagcggctctt

SEQ ID NO: 281825 - DNA, 25 bp, Homo sapien
tcaggaatccgccatcggaacggag

SEQ ID NO: 281826 - DNA, 25 bp, Homo sapien
catcggaacggaggccctaactggt

SEQ ID NO: 281827 - DNA, 25 bp, Homo sapien
ggccctaactggtccggtcgcagag

SEQ ID NO: 281828 - DNA, 25 bp, Homo sapien
ttatctcctcgggtctgacatgggg

SEQ ID NO: 281829 - DNA, 25 bp, Homo sapien
tcctctctcctgtcttcaagctgag

SEQ ID NO: 281830 - DNA, 25 bp, Homo sapien
tcaccttctctgcttatgcattctg

SEQ ID NO: 281831 - DNA, 25 bp, Homo sapien
ttctctgcttatgcattctgtccct

SEQ ID NO: 281832 - DNA, 25 bp, Homo sapien
ttatgcattctgtccctgcgacagg

SEQ ID NO: 281833 - DNA, 25 bp, Homo sapien
tccctgcgacaggagtggctgagca

SEQ ID NO: 281834 - DNA, 25 bp, Homo sapien
ggctgagcagtttgccatcgcggaa

SEQ ID NO: 281835 - DNA, 25 bp, Homo sapien
gcagtttgccatcgcggaagccaag

SEQ ID NO: 281836 - DNA, 25 bp, Homo sapien
ggaagccaagctccgagcatggtct

SEQ ID NO: 281837 - DNA, 25 bp, Homo sapien
agctccgagcatggtcttcggtgga

SEQ ID NO: 281838 - DNA, 25 bp, Homo sapien
tcttcggtggatggcgaggactcca

SEQ ID NO: 281839 - DNA, 25 bp, Homo sapien
gaggctgctgtcaccactgtgcgtc

SEQ ID NO: 281840 - DNA, 25 bp, Homo sapien
accactgtgcgtccaaggccatgct

SEQ ID NO: 281841 - DNA, 25 bp, Homo sapien
aaggccatgctctctgcgggtcagt

SEQ ID NO: 281842 - DNA, 25 bp, Homo sapien
tctgcgggtcagtgcctgagtctcg

SEQ ID NO: 281843 - DNA, 25 bp, Homo sapien
ctgcctgtcacgtcggcatttgtga

SEQ ID NO: 281844 - DNA, 25 bp, Homo sapien
gcatttgtgagacctaccctgtaac

SEQ ID NO: 281845 - DNA, 25 bp, Homo sapien
tttctcccttgctgtagacaggctg

SEQ ID NO: 281846 - DNA, 25 bp, Homo sapien
ttgctgtagacaggctggattccag

SEQ ID NO: 281847 - DNA, 25 bp, Homo sapien
ggattccagtgttgggacagccatc

SEQ ID NO: 281848 - DNA, 25 bp, Homo sapien
tgttgggacagccatctccagaaac

SEQ ID NO: 281849 - DNA, 25 bp, Homo sapien
gccatctccagaaacctgacttaag

SEQ ID NO: 281850 - DNA, 25 bp, Homo sapien
agcctgagatagagccacctgggtg

SEQ ID NO: 281851 - DNA, 25 bp, Homo sapien
ggtgccatagtgatggccatggaat

SEQ ID NO: 281852 - DNA, 25 bp, Homo sapien
ggaataagccatgctaagcactagg

SEQ ID NO: 281853 - DNA, 25 bp, Homo sapien
catgctaagcactagggcaaaccta

SEQ ID NO: 281854 - DNA, 25 bp, Homo sapien
gcaaacctacataatggccatctga

SEQ ID NO: 281855 - DNA, 25 bp, Homo sapien
atggccatctgagttgcacagcaac

SEQ ID NO: 281856 - DNA, 25 bp, Homo sapien
aatcctgagttatgagcctgttata

SEQ ID NO: 281857 - DNA, 25 bp, Homo sapien
tatgagcctgttataatttgattaa

SEQ ID NO: 281858 - DNA, 25 bp, Homo sapien
gtttatagattcctgctctctacac

SEQ ID NO: 281859 - DNA, 25 bp, Homo sapien
gctctctacacctagtgacttcaaa

SEQ ID NO: 281860 - DNA, 25 bp, Homo sapien
acacctagtgacttcaaatattctg

SEQ ID NO: 281861 - DNA, 25 bp, Homo sapien
tttccattaattgccaagcgaggtc

SEQ ID NO: 281862 - DNA, 25 bp, Homo sapien
agcgaggtcaactcgtttttcccat

SEQ ID NO: 281863 - DNA, 25 bp, Homo sapien
tcgtttttcccatggcgcattaaag

SEQ ID NO: 281864 - DNA, 25 bp, Homo sapien
ggcgcattaaagtaactccacagtt

SEQ ID NO: 281865 - DNA, 25 bp, Homo sapien
aagtaactccacagttcttctccaa

SEQ ID NO: 281866 - DNA, 25 bp, Homo sapien
agttcttctccaacataatttacag

SEQ ID NO: 281867 - DNA, 25 bp, Homo sapien
caacataatttacagccaccattct

SEQ ID NO: 281868 - DNA, 25 bp, Homo sapien
ccattcttccacaagctccaagata

SEQ ID NO: 281869 - DNA, 25 bp, Homo sapien
agatactttgcaaatggccaacctt

SEQ ID NO: 281870 - DNA, 25 bp, Homo sapien
atggccaaccttcatcagacggaaa

SEQ ID NO: 281871 - DNA, 25 bp, Homo sapien
ggaaaactctgtagcaccagcggct

SEQ ID NO: 281872 - DNA, 25 bp, Homo sapien
gagtggctgagcagtttgccatcgc

SEQ ID NO: 281873 - DNA, 25 bp, Homo sapien
ggctgagcagtttgccatcgcggaa

SEQ ID NO: 281874 - DNA, 25 bp, Homo sapien
tgagcagtttgccatcgcggaagcc

SEQ ID NO: 281875 - DNA, 25 bp, Homo sapien
gcagtttgccatcgcggaagccaag

SEQ ID NO: 281876 - DNA, 25 bp, Homo sapien
ttgccatcgcggaagccaagctccg

SEQ ID NO: 281877 - DNA, 25 bp, Homo sapien
atcgcggaagccaagctccgagcat

SEQ ID NO: 281878 - DNA, 25 bp, Homo sapien
ggaagccaagctccgagcatggtct

SEQ ID NO: 281879 - DNA, 25 bp, Homo sapien
aagctccgagcatggtcttcggtgg

SEQ ID NO: 281880 - DNA, 25 bp, Homo sapien
ctccgagcatggtcttcggtggatg

SEQ ID NO: 281881 - DNA, 25 bp, Homo sapien
tcttcggtggatggcgaggactcca

SEQ ID NO: 281882 - DNA, 25 bp, Homo sapien
gtggatggcgaggactccactgatg

SEQ ID NO: 281883 - DNA, 25 bp, Homo sapien
agagaggacttgtccatgactttgg

SEQ ID NO: 281884 - DNA, 25 bp, Homo sapien
cccagggacaagtggcgactttgga

SEQ ID NO: 281885 - DNA, 25 bp, Homo sapien
tggcgactttggaaactccattcct

SEQ ID NO: 281886 - DNA, 25 bp, Homo sapien
tcacagtgagtgaaggaacatggct

SEQ ID NO: 281887 - DNA, 25 bp, Homo sapien
ggaaactccattcctctgcaaaatg

SEQ ID NO: 281888 - DNA, 25 bp, Homo sapien
tctgcaaaatgacatcacgaggaga

SEQ ID NO: 281889 - DNA, 25 bp, Homo sapien
actctgctatgaggaagcgctggat

SEQ ID NO: 281890 - DNA, 25 bp, Homo sapien
gaacatggctctgaatcatgcctgt

SEQ ID NO: 281891 - DNA, 25 bp, Homo sapien
gctctgaatcatgcctgtctgtctc

SEQ ID NO: 281892 - DNA, 25 bp, Homo sapien
tgtctccccaggtctgtgcttaaaa

SEQ ID NO: 281893 - DNA, 25 bp, Homo sapien
ggtctgtgcttaaaaccacgaagtt

SEQ ID NO: 281894 - DNA, 25 bp, Homo sapien
caaatggtttatggctatgaatgaa

SEQ ID NO: 281895 - DNA, 25 bp, Homo sapien
gaagtatttgttgtagatagtaccc

SEQ ID NO: 281896 - DNA, 25 bp, Homo sapien
aaaaccaaacaccatatctgatgtg

SEQ ID NO: 281897 - DNA, 25 bp, Homo sapien
gaaaacctcttgtgtatattcttaa

SEQ ID NO: 281898 - DNA, 25 bp, Homo sapien
tctgtttagacaataggtttatcac

SEQ ID NO: 281899 - DNA, 25 bp, Homo sapien
tccttttgaaatgatcactagccat

SEQ ID NO: 281900 - DNA, 25 bp, Homo sapien
gatcactagccatgttacgtgccaa

SEQ ID NO: 281901 - DNA, 25 bp, Homo sapien
tagccatgttacgtgccaatatagc

SEQ ID NO: 281902 - DNA, 25 bp, Homo sapien
gttacgtgccaatatagcactggga

SEQ ID NO: 281903 - DNA, 25 bp, Homo sapien
agcactgggataaggttccattttc

SEQ ID NO: 281904 - DNA, 25 bp, Homo sapien
aggttccattttcaaacttctatca

SEQ ID NO: 281905 - DNA, 25 bp, Homo sapien
tacaagaccactgttaaaagcccgg

SEQ ID NO: 281906 - DNA, 25 bp, Homo sapien
gttaaaagcccggaagaatcctgca

SEQ ID NO: 281907 - DNA, 25 bp, Homo sapien
aaaagcccggaagaatcctgcagct

SEQ ID NO: 281908 - DNA, 25 bp, Homo sapien
aagcccggaagaatcctgcagctcg

SEQ ID NO: 281909 - DNA, 25 bp, Homo sapien
cggaagaatcctgcagctcgctgtg

SEQ ID NO: 281910 - DNA, 25 bp, Homo sapien
gctgttttgcgtgtgctagagtcta

SEQ ID NO: 281911 - DNA, 25 bp, Homo sapien
gttttgcgtgtgctagagtctattc

SEQ ID NO: 281912 - DNA, 25 bp, Homo sapien
ttgcgtgtgctagagtctattcagc

SEQ ID NO: 281913 - DNA, 25 bp, Homo sapien
gagtctattcagcatttcagacaga

SEQ ID NO: 281914 - DNA, 25 bp, Homo sapien
tttcagacagaaaagcctcagcatt

SEQ ID NO: 281915 - DNA, 25 bp, Homo sapien
tcagacagaaaagcctcagcattcc

SEQ ID NO: 281916 - DNA, 25 bp, Homo sapien
cattgctgcatattacagtgtccca

SEQ ID NO: 281917 - DNA, 25 bp, Homo sapien
gctgcatattacagtgtcccattat

SEQ ID NO: 281918 - DNA, 25 bp, Homo sapien
gtgtcccattataacaatatgtgac

SEQ ID NO: 281919 - DNA, 25 bp, Homo sapien
gacaatatgtttagccattctattg

SEQ ID NO: 281920 - DNA, 25 bp, Homo sapien
aatgctaatgtgaacattcttcata

SEQ ID NO: 281921 - DNA, 25 bp, Homo sapien
tgtattccatcacatctacgtcagt

SEQ ID NO: 281922 - DNA, 25 bp, Homo sapien
attccatcacatctacgtcagtttc

SEQ ID NO: 281923 - DNA, 25 bp, Homo sapien
gtataacatatacctgggagtgtaa

SEQ ID NO: 281924 - DNA, 25 bp, Homo sapien
acctgggagtgtaatatgtatcata

SEQ ID NO: 281925 - DNA, 25 bp, Homo sapien
gttcttttctagagggttacacagt

SEQ ID NO: 281926 - DNA, 25 bp, Homo sapien
ctagagggttacacagtcacaaaaa

SEQ ID NO: 281927 - DNA, 25 bp, Homo sapien
tacctctctccgtgtggtcaagaaa

SEQ ID NO: 281928 - DNA, 25 bp, Homo sapien
ttttgaggcctcacctgtatgtagt

SEQ ID NO: 281929 - DNA, 25 bp, Homo sapien
tatgagatttgcctccagtgttttc

SEQ ID NO: 281930 - DNA, 25 bp, Homo sapien
ccagtgttttcctgttctcaaatat

SEQ ID NO: 281931 - DNA, 25 bp, Homo sapien
aaatatcacagtcctgttctgcctg

SEQ ID NO: 281932 - DNA, 25 bp, Homo sapien
ttctgcctgtgttccaatctctgaa

SEQ ID NO: 281933 - DNA, 25 bp, Homo sapien
caaatattctatccagtttcagttt

SEQ ID NO: 281934 - DNA, 25 bp, Homo sapien
cagtaccttattctataaactccca

SEQ ID NO: 281935 - DNA, 25 bp, Homo sapien
taaactcccaacatgttagcactgt

SEQ ID NO: 281936 - DNA, 25 bp, Homo sapien
gttagcactgtaagactctcagctt

SEQ ID NO: 281937 - DNA, 25 bp, Homo sapien
gactctcagcttagtgacagtgaca

SEQ ID NO: 281938 - DNA, 25 bp, Homo sapien
aacttttacagctagtacattaaat

SEQ ID NO: 281939 - DNA, 25 bp, Homo sapien
acttttacagctagtacattaaatt

SEQ ID NO: 281940 - DNA, 25 bp, Homo sapien
cttttacagctagtacattaaattt

SEQ ID NO: 281941 - DNA, 25 bp, Homo sapien
ctcaaagattcttttattgtgaact

SEQ ID NO: 281942 - DNA, 25 bp, Homo sapien
tcaaagattcttttattgtgaactt

SEQ ID NO: 281943 - DNA, 25 bp, Homo sapien
caaagattcttttattgtgaacttt

SEQ ID NO: 281944 - DNA, 25 bp, Homo sapien
attcttttattgtgaactttctaag

SEQ ID NO: 281945 - DNA, 25 bp, Homo sapien
gaaagaattgtaaggccggtgcggt

SEQ ID NO: 281946 - DNA, 25 bp, Homo sapien
aaagaattgtaaggccggtgcggtg

SEQ ID NO: 281947 - DNA, 25 bp, Homo sapien
tttccatccaaatatcccacttcag

SEQ ID NO: 281948 - DNA, 25 bp, Homo sapien
ttccatccaaatatcccacttcagg

SEQ ID NO: 281949 - DNA, 25 bp, Homo sapien
ggtttgtaacccatgacatctgtgg

SEQ ID NO: 281950 - DNA, 25 bp, Homo sapien
taacccatgacatctgtgggcgaga

SEQ ID NO: 281951 - DNA, 25 bp, Homo sapien
agcaggacacttggagggtcacccc

SEQ ID NO: 281952 - DNA, 25 bp, Homo sapien
gacacttggagggtcaccccacggg

SEQ ID NO: 281953 - DNA, 25 bp, Homo sapien
ggtggcacctgcactctgagtgccc

SEQ ID NO: 281954 - DNA, 25 bp, Homo sapien
agctgcctcttaccgtggacacagt

SEQ ID NO: 281955 - DNA, 25 bp, Homo sapien
taccgtggacacagttttggttttg

SEQ ID NO: 281956 - DNA, 25 bp, Homo sapien
cactcctggtggtaccgtttggact

SEQ ID NO: 281957 - DNA, 25 bp, Homo sapien
tggtggtaccgtttggacttactag

SEQ ID NO: 281958 - DNA, 25 bp, Homo sapien
taccgtttggacttactagggcagt

SEQ ID NO: 281959 - DNA, 25 bp, Homo sapien
acttactagggcagtgggacatata

SEQ ID NO: 281960 - DNA, 25 bp, Homo sapien
tccacacaggagaatctcggcgatt

SEQ ID NO: 281961 - DNA, 25 bp, Homo sapien
cacaggagaatctcggcgatttaca

SEQ ID NO: 281962 - DNA, 25 bp, Homo sapien
gatttacacccccaggctacgcaga

SEQ ID NO: 281963 - DNA, 25 bp, Homo sapien
caggctacgcagaaaaagcggcttc

SEQ ID NO: 281964 - DNA, 25 bp, Homo sapien
gaaaaagcggcttcggaatccgccg

SEQ ID NO: 281965 - DNA, 25 bp, Homo sapien
agcggcttcggaatccgccgcaagt

SEQ ID NO: 281966 - DNA, 25 bp, Homo sapien
gaagtctggcctcccgcgtctgggt

SEQ ID NO: 281967 - DNA, 25 bp, Homo sapien
ggctccgcgactgcgctcagattaa

SEQ ID NO: 281968 - DNA, 25 bp, Homo sapien
ccgcgactgcgctcagattaacgga

SEQ ID NO: 281969 - DNA, 25 bp, Homo sapien
aaagacacccctctagagtccggca

SEQ ID NO: 281970 - DNA, 25 bp, Homo sapien
aagacacccctctagagtccggcag

SEQ ID NO: 281971 - DNA, 25 bp, Homo sapien
gtctccctctatcagaatgaaagct

SEQ ID NO: 281972 - DNA, 25 bp, Homo sapien
gcttcatgaagcgagagacttaatt

SEQ ID NO: 281973 - DNA, 25 bp, Homo sapien
tttttatctgttatatccctagtgc

SEQ ID NO: 281974 - DNA, 25 bp, Homo sapien
tatccctagtgcctggtgcagggta

SEQ ID NO: 281975 - DNA, 25 bp, Homo sapien
gcctggtgcagggtaagtactcaaa

SEQ ID NO: 281976 - DNA, 25 bp, Homo sapien
gggactggtttgtatctggttatat

SEQ ID NO: 281977 - DNA, 25 bp, Homo sapien
gtatctggttatatctcttgtcctt

SEQ ID NO: 281978 - DNA, 25 bp, Homo sapien
gttatatctcttgtccttagcacag

SEQ ID NO: 281979 - DNA, 25 bp, Homo sapien
atctcttgtccttagcacagtacct

SEQ ID NO: 281980 - DNA, 25 bp, Homo sapien
gagttggttatatgattgtctttga

SEQ ID NO: 281981 - DNA, 25 bp, Homo sapien
gattgtctttgaattctatgactgt

SEQ ID NO: 281982 - DNA, 25 bp, Homo sapien
ttcattccttctgccttcggaaggc

SEQ ID NO: 281983 - DNA, 25 bp, Homo sapien
ggcagctacagctggaggctgcacc

SEQ ID NO: 281984 - DNA, 25 bp, Homo sapien
agctacagctggaggctgcacccca

SEQ ID NO: 281985 - DNA, 25 bp, Homo sapien
ttctcccagttcatcctacctggaa

SEQ ID NO: 281986 - DNA, 25 bp, Homo sapien
agttcatcctacctggaatctgacc

SEQ ID NO: 281987 - DNA, 25 bp, Homo sapien
atcctacctggaatctgacccacta

SEQ ID NO: 281988 - DNA, 25 bp, Homo sapien
tacccacctgcaacaagtcttccag

SEQ ID NO: 281989 - DNA, 25 bp, Homo sapien
aggcaggaagataggccctgccctg

SEQ ID NO: 281990 - DNA, 25 bp, Homo sapien
gatgggtttataactggaacctcca

SEQ ID NO: 281991 - DNA, 25 bp, Homo sapien
ggaacctccaatgaccagatgtata

SEQ ID NO: 281992 - DNA, 25 bp, Homo sapien
acctccaatgaccagatgtatatag

SEQ ID NO: 281993 - DNA, 25 bp, Homo sapien
aggcagcagagactcggccattgca

SEQ ID NO: 281994 - DNA, 25 bp, Homo sapien
cctctgggtgccttgtccgggcagt

SEQ ID NO: 281995 - DNA, 25 bp, Homo sapien
ggcagtggtgaagtagccgcccctc

SEQ ID NO: 281996 - DNA, 25 bp, Homo sapien
tgggcagcttccactttctgccgga

SEQ ID NO: 281997 - DNA, 25 bp, Homo sapien
actttctgccggacactctgaggag

SEQ ID NO: 281998 - DNA, 25 bp, Homo sapien
tttctgccggacactctgaggagag

SEQ ID NO: 281999 - DNA, 25 bp, Homo sapien
agctccaggcctcagcgttctcttt

SEQ ID NO: 282000 - DNA, 25 bp, Homo sapien
aggcctcagcgttctcttttttcct

SEQ ID NO: 282001 - DNA, 25 bp, Homo sapien
tctcccacccgggaaatgaaactgt

SEQ ID NO: 282002 - DNA, 25 bp, Homo sapien
aaatgaaactgttgggctgggcgac

SEQ ID NO: 282003 - DNA, 25 bp, Homo sapien
aactgttgggctgggcgacggaggc

SEQ ID NO: 282004 - DNA, 25 bp, Homo sapien
acgggtctcggaccgagcggagctc

SEQ ID NO: 282005 - DNA, 25 bp, Homo sapien
accgagcggagctcgcagcctcggt

SEQ ID NO: 282006 - DNA, 25 bp, Homo sapien
ggagctcgcagcctcggtcccggag

SEQ ID NO: 282007 - DNA, 25 bp, Homo sapien
tgatggaggcggccaccacactgca

SEQ ID NO: 282008 - DNA, 25 bp, Homo sapien
ggcccgctgggcgagttcctgcctc

SEQ ID NO: 282009 - DNA, 25 bp, Homo sapien
gagtgcccggtcttcgaacccagct

SEQ ID NO: 282010 - DNA, 25 bp, Homo sapien
gcccggtcttcgaacccagctggga

SEQ ID NO: 282011 - DNA, 25 bp, Homo sapien
aacccagctgggaagagttcgcgga

SEQ ID NO: 282012 - DNA, 25 bp, Homo sapien
cccagctgggaagagttcgcggacc

SEQ ID NO: 282013 - DNA, 25 bp, Homo sapien
gctgggaagagttcgcggacccctt

SEQ ID NO: 282014 - DNA, 25 bp, Homo sapien
gaagagttcgcggaccccttcgctt

SEQ ID NO: 282015 - DNA, 25 bp, Homo sapien
caagccttcagggttggaatggcat

SEQ ID NO: 282016 - DNA, 25 bp, Homo sapien
gaatggcatttccaaatatagactc

SEQ ID NO: 282017 - DNA, 25 bp, Homo sapien
aaatcctcagatgtttgattctaga

SEQ ID NO: 282018 - DNA, 25 bp, Homo sapien
atagagctgggaattctgtcctgca

SEQ ID NO: 282019 - DNA, 25 bp, Homo sapien
tgggaattctgtcctgcaaatgcct

SEQ ID NO: 282020 - DNA, 25 bp, Homo sapien
tgtcctgcaaatgccttctgcagca

SEQ ID NO: 282021 - DNA, 25 bp, Homo sapien
gcagcatgggagcaaacccactctt

SEQ ID NO: 282022 - DNA, 25 bp, Homo sapien
gttgcttcaaactctctattttctg

SEQ ID NO: 282023 - DNA, 25 bp, Homo sapien
aagatgtgggtctacattttgaaat

SEQ ID NO: 282024 - DNA, 25 bp, Homo sapien
agatggtgctgctgccatattttcc

SEQ ID NO: 282025 - DNA, 25 bp, Homo sapien
tgctgctgccatattttcctggcac

SEQ ID NO: 282026 - DNA, 25 bp, Homo sapien
acaaagagatgaaatgctaagcccc

SEQ ID NO: 282027 - DNA, 25 bp, Homo sapien
ctaagcccccaatgtgttctgaaaa

SEQ ID NO: 282028 - DNA, 25 bp, Homo sapien
aagttaaataaccatcttacatcag

SEQ ID NO: 282029 - DNA, 25 bp, Homo sapien
ccatcttacatcagttggtacgttt

SEQ ID NO: 282030 - DNA, 25 bp, Homo sapien
gtacgtttttgtaagagtccaggat

SEQ ID NO: 282031 - DNA, 25 bp, Homo sapien
aagagtccaggatgtaaaagtgata

SEQ ID NO: 282032 - DNA, 25 bp, Homo sapien
aaatcaacaaaagacatggcaggaa

SEQ ID NO: 282033 - DNA, 25 bp, Homo sapien
aaagagaagcaagggatgcattcta

SEQ ID NO: 282034 - DNA, 25 bp, Homo sapien
aaatgctgaagattgtttggagtca

SEQ ID NO: 282035 - DNA, 25 bp, Homo sapien
gtttggagtcagaagtgattgttca

SEQ ID NO: 282036 - DNA, 25 bp, Homo sapien
gaatctgtcttaatgacaagtcaga

SEQ ID NO: 282037 - DNA, 25 bp, Homo sapien
aaggagggtctgatcattggatgtc

SEQ ID NO: 282038 - DNA, 25 bp, Homo sapien
attggatgtcaagttttgtcacaca

SEQ ID NO: 282039 - DNA, 25 bp, Homo sapien
ttgtcacacatgcatttctgagaag

SEQ ID NO: 282040 - DNA, 25 bp, Homo sapien
gactagttgtgtttatcagattctt

SEQ ID NO: 282041 - DNA, 25 bp, Homo sapien
agtgtaaaggacagagcagcctgct

SEQ ID NO: 282042 - DNA, 25 bp, Homo sapien
agtaaagcatcagtcacttcccaat

SEQ ID NO: 282043 - DNA, 25 bp, Homo sapien
acttcccaatgtcctgcatatggtg

SEQ ID NO: 282044 - DNA, 25 bp, Homo sapien
atgtcctgcatatggtggagcccct

SEQ ID NO: 282045 - DNA, 25 bp, Homo sapien
gagcagcctgctcaatgggaaagca

SEQ ID NO: 282046 - DNA, 25 bp, Homo sapien
gggaaagcaagcttcaggacttgaa

SEQ ID NO: 282047 - DNA, 25 bp, Homo sapien
aggtgtctgtaatccaaggagggtc

SEQ ID NO: 282048 - DNA, 25 bp, Homo sapien
tttggaggccttccatctgtcggta

SEQ ID NO: 282049 - DNA, 25 bp, Homo sapien
ctgtcggtaggccatctgcattttc

SEQ ID NO: 282050 - DNA, 25 bp, Homo sapien
ttcttactgttgatgtttcctgccc

SEQ ID NO: 282051 - DNA, 25 bp, Homo sapien
gttgatgtttcctgcccaaaggaca

SEQ ID NO: 282052 - DNA, 25 bp, Homo sapien
aaggacacatttgggcagtgccacc

SEQ ID NO: 282053 - DNA, 25 bp, Homo sapien
ttgggcccctaggatgacccaacta

SEQ ID NO: 282054 - DNA, 25 bp, Homo sapien
ataactttctgcttcccacaggttt

SEQ ID NO: 282055 - DNA, 25 bp, Homo sapien
ttcccacaggttttcagcattctat

SEQ ID NO: 282056 - DNA, 25 bp, Homo sapien
attctatcgtcctgttgtgctcagc

SEQ ID NO: 282057 - DNA, 25 bp, Homo sapien
agctcatcatcagtcgctgtctctt

SEQ ID NO: 282058 - DNA, 25 bp, Homo sapien
ctgtctcttttctgtgatttctgta

SEQ ID NO: 282059 - DNA, 25 bp, Homo sapien
gtggtgcttaggtcctgtccgcaag

SEQ ID NO: 282060 - DNA, 25 bp, Homo sapien
gcttaggtcctgtccgcaagggatc

SEQ ID NO: 282061 - DNA, 25 bp, Homo sapien
cagcgagtcctgtcctcgtctggag

SEQ ID NO: 282062 - DNA, 25 bp, Homo sapien
agtccccatcttcagtttgtcagag

SEQ ID NO: 282063 - DNA, 25 bp, Homo sapien
gtcagagtggacaaagcctacgaca

SEQ ID NO: 282064 - DNA, 25 bp, Homo sapien
aagcctacgacaatggccagtacca

SEQ ID NO: 282065 - DNA, 25 bp, Homo sapien
gacaatggccagtaccagctattag

SEQ ID NO: 282066 - DNA, 25 bp, Homo sapien
ggccagtaccagctattaggcattc

SEQ ID NO: 282067 - DNA, 25 bp, Homo sapien
ttggtggtactggagcttccctacc

SEQ ID NO: 282068 - DNA, 25 bp, Homo sapien
ggtggtactggagcttccctaccca

SEQ ID NO: 282069 - DNA, 25 bp, Homo sapien
tacccaggatttcagtggattccaa

SEQ ID NO: 282070 - DNA, 25 bp, Homo sapien
gtgagaccagccgtcagcactttgg

SEQ ID NO: 282071 - DNA, 25 bp, Homo sapien
agcactttggctcatggaacacacg

SEQ ID NO: 282072 - DNA, 25 bp, Homo sapien
atggaacacacgtctgtccgagcag

SEQ ID NO: 282073 - DNA, 25 bp, Homo sapien
tgtccgagcagtgcagacctggctt

SEQ ID NO: 282074 - DNA, 25 bp, Homo sapien
agacctggcttgtgtgaactgggct

SEQ ID NO: 282075 - DNA, 25 bp, Homo sapien
cttgtgtgaactgggctctgtgtgc

SEQ ID NO: 282076 - DNA, 25 bp, Homo sapien
tgccgaggccacatctagaaattct

SEQ ID NO: 282077 - DNA, 25 bp, Homo sapien
tgagagccgtgtgcagagctgcccc

SEQ ID NO: 282078 - DNA, 25 bp, Homo sapien
tgggactaggccaagttcaagtgca

SEQ ID NO: 282079 - DNA, 25 bp, Homo sapien
ttcaagtgcaggagcacactggccc

SEQ ID NO: 282080 - DNA, 25 bp, Homo sapien
atttggcttgtgagaccagccgtca

SEQ ID NO: 282081 - DNA, 25 bp, Homo sapien
agaatcccctgacattcccagggtc

SEQ ID NO: 282082 - DNA, 25 bp, Homo sapien
agggtcagccaggacctgttacagc

SEQ ID NO: 282083 - DNA, 25 bp, Homo sapien
ctgttacagccctggtcacttggaa

SEQ ID NO: 282084 - DNA, 25 bp, Homo sapien
ggtcacttggaactgacagctgtgt

SEQ ID NO: 282085 - DNA, 25 bp, Homo sapien
tgtgtgaggcctgcacttctcagac

SEQ ID NO: 282086 - DNA, 25 bp, Homo sapien
gcacttctcagacccagacttagaa

SEQ ID NO: 282087 - DNA, 25 bp, Homo sapien
gagtgaggactcaaggctacaatga

SEQ ID NO: 282088 - DNA, 25 bp, Homo sapien
atgaggttccagtacttgttacaag

SEQ ID NO: 282089 - DNA, 25 bp, Homo sapien
ccctacctgggcctttaggtgaatg

SEQ ID NO: 282090 - DNA, 25 bp, Homo sapien
aggtgaatgtgggatccactcccgc

SEQ ID NO: 282091 - DNA, 25 bp, Homo sapien
atccactcccgcttttaacatgaaa

SEQ ID NO: 282092 - DNA, 25 bp, Homo sapien
tgaattttggagtgctttttctctt

SEQ ID NO: 282093 - DNA, 25 bp, Homo sapien
ttacaatgtgtgttccaactctttg

SEQ ID NO: 282094 - DNA, 25 bp, Homo sapien
gtgtgttccaactctttgtgttaaa

SEQ ID NO: 282095 - DNA, 25 bp, Homo sapien
tgttttttacctgtatcacttccct

SEQ ID NO: 282096 - DNA, 25 bp, Homo sapien
cctgtatcacttccctgtgtattat

SEQ ID NO: 282097 - DNA, 25 bp, Homo sapien
ttttactggaagcaaaactgtgcca

SEQ ID NO: 282098 - DNA, 25 bp, Homo sapien
tgtgccagggacagagatatacaat

SEQ ID NO: 282099 - DNA, 25 bp, Homo sapien
ttttctctttttggcaactgcactt

SEQ ID NO: 282100 - DNA, 25 bp, Homo sapien
actgcacttgcttaaaatgtactga

SEQ ID NO: 282101 - DNA, 25 bp, Homo sapien
gaatgtcagctggatttcacagcat

SEQ ID NO: 282102 - DNA, 25 bp, Homo sapien
acagcatatcagatttacagtcttt

SEQ ID NO: 282103 - DNA, 25 bp, Homo sapien
gttcatgtccaaactattaatgcca

SEQ ID NO: 282104 - DNA, 25 bp, Homo sapien
ttaatgccaagtagtcatcaacttt

SEQ ID NO: 282105 - DNA, 25 bp, Homo sapien
gtgtagtcatatgaagtctatttct

SEQ ID NO: 282106 - DNA, 25 bp, Homo sapien
agtctatttctagttgactgtaaca

SEQ ID NO: 282107 - DNA, 25 bp, Homo sapien
catgggtattaatagtctttgctgc

SEQ ID NO: 282108 - DNA, 25 bp, Homo sapien
gtctttgctgctggtaatactgaaa

SEQ ID NO: 282109 - DNA, 25 bp, Homo sapien
acctgctttatattggagtatcaag

SEQ ID NO: 282110 - DNA, 25 bp, Homo sapien
ttggagtatcaagatctcaggttca

SEQ ID NO: 282111 - DNA, 25 bp, Homo sapien
tctcaggttcattaagaccaaactg

SEQ ID NO: 282112 - DNA, 25 bp, Homo sapien
cattaagaccaaactgacttttcct

SEQ ID NO: 282113 - DNA, 25 bp, Homo sapien
tatatttttattctacctttcagta

SEQ ID NO: 282114 - DNA, 25 bp, Homo sapien
tacacccagggttgctatatcgaat

SEQ ID NO: 282115 - DNA, 25 bp, Homo sapien
gggttgctatatcgaattcatgttt

SEQ ID NO: 282116 - DNA, 25 bp, Homo sapien
attcatgtttctagaggtcagttca

SEQ ID NO: 282117 - DNA, 25 bp, Homo sapien
ttctagaggtcagttcaacacaatg

SEQ ID NO: 282118 - DNA, 25 bp, Homo sapien
cagagctctgtcctatccagagagg

SEQ ID NO: 282119 - DNA, 25 bp, Homo sapien
aggaccactcagttactctgttgcc

SEQ ID NO: 282120 - DNA, 25 bp, Homo sapien
ccagtagccatgtgggtccaatgtt

SEQ ID NO: 282121 - DNA, 25 bp, Homo sapien
gggtccaatgttgtcacatgacttt

SEQ ID NO: 282122 - DNA, 25 bp, Homo sapien
tatccagagaggctaaaccaacttg

SEQ ID NO: 282123 - DNA, 25 bp, Homo sapien
aaccaacttggatggctcaagacaa

SEQ ID NO: 282124 - DNA, 25 bp, Homo sapien
atatgggatctagagtacacccagg

SEQ ID NO: 282125 - DNA, 25 bp, Homo sapien
gtggtgactcccgtggcagcaagtc

SEQ ID NO: 282126 - DNA, 25 bp, Homo sapien
ctcccgtggcagcaagtccgaatgg

SEQ ID NO: 282127 - DNA, 25 bp, Homo sapien
ggccaacctgcctgcaaacatggag

SEQ ID NO: 282128 - DNA, 25 bp, Homo sapien
catggagggcatttggccacagata

SEQ ID NO: 282129 - DNA, 25 bp, Homo sapien
gaggagctcagttgtcggacagcta

SEQ ID NO: 282130 - DNA, 25 bp, Homo sapien
ttgtcggacagctatgcagtccctg

SEQ ID NO: 282131 - DNA, 25 bp, Homo sapien
atgcagtccctgtccggtggtgctg

SEQ ID NO: 282132 - DNA, 25 bp, Homo sapien
ggtgctggaggctccactctcctta

SEQ ID NO: 282133 - DNA, 25 bp, Homo sapien
actctccttaggttcatagtctctc

SEQ ID NO: 282134 - DNA, 25 bp, Homo sapien
aggttcatagtctctccccttcttt

SEQ ID NO: 282135 - DNA, 25 bp, Homo sapien
tttcccttccacttctagagcaggg

SEQ ID NO: 282136 - DNA, 25 bp, Homo sapien
tcttgggcatttgggtagttctcac

SEQ ID NO: 282137 - DNA, 25 bp, Homo sapien
taaacattcaggtcttttggtaagc

SEQ ID NO: 282138 - DNA, 25 bp, Homo sapien
tttggtaagcatatacctggctttc

SEQ ID NO: 282139 - DNA, 25 bp, Homo sapien
acctggctttctgttggctatttat

SEQ ID NO: 282140 - DNA, 25 bp, Homo sapien
agagttgctggcttataaggtatgc

SEQ ID NO: 282141 - DNA, 25 bp, Homo sapien
ttgcagtttgtaccaattcacccac

SEQ ID NO: 282142 - DNA, 25 bp, Homo sapien
acccacccaccaatgtgaatatcta

SEQ ID NO: 282143 - DNA, 25 bp, Homo sapien
aatatctaatattgcctgcctgtct

SEQ ID NO: 282144 - DNA, 25 bp, Homo sapien
tgcctgtctgtacgtgtgtactggt

SEQ ID NO: 282145 - DNA, 25 bp, Homo sapien
gtgtactggtatagcattgtggttt

SEQ ID NO: 282146 - DNA, 25 bp, Homo sapien
ttgcattttccagtgcctaatgaaa

SEQ ID NO: 282147 - DNA, 25 bp, Homo sapien
acctcttgacttctaaagacgcaaa

SEQ ID NO: 282148 - DNA, 25 bp, Homo sapien
cctcttgacttctaaagacgcaaaa

SEQ ID NO: 282149 - DNA, 25 bp, Homo sapien
tcttgacttctaaagacgcaaaagt

SEQ ID NO: 282150 - DNA, 25 bp, Homo sapien
gacttctaaagacgcaaaagtggcc

SEQ ID NO: 282151 - DNA, 25 bp, Homo sapien
cttctaaagacgcaaaagtggccaa

SEQ ID NO: 282152 - DNA, 25 bp, Homo sapien
ttctaaagacgcaaaagtggccaaa

SEQ ID NO: 282153 - DNA, 25 bp, Homo sapien
aaaagtggccaaaagtgcaatacag

SEQ ID NO: 282154 - DNA, 25 bp, Homo sapien
aaatacaaagtgattcgtgactcat

SEQ ID NO: 282155 - DNA, 25 bp, Homo sapien
atacaaagtgattcgtgactcattg

SEQ ID NO: 282156 - DNA, 25 bp, Homo sapien
caaagtgattcgtgactcattgtct

SEQ ID NO: 282157 - DNA, 25 bp, Homo sapien
aaagtgattcgtgactcattgtctc

SEQ ID NO: 282158 - DNA, 25 bp, Homo sapien
tgcccggctcaaccaaatgtagttt

SEQ ID NO: 282159 - DNA, 25 bp, Homo sapien
tagtttgttaccttggtggccatct

SEQ ID NO: 282160 - DNA, 25 bp, Homo sapien
ctgccacactgctaaaccagaggat

SEQ ID NO: 282161 - DNA, 25 bp, Homo sapien
tggctgaagagcactggaaagacaa

SEQ ID NO: 282162 - DNA, 25 bp, Homo sapien
gaaagacaaactcctgcggtgcaag

SEQ ID NO: 282163 - DNA, 25 bp, Homo sapien
tcctgcggtgcaagagtcctggacc

SEQ ID NO: 282164 - DNA, 25 bp, Homo sapien
cgagcacagagacgccgcaaccgga

SEQ ID NO: 282165 - DNA, 25 bp, Homo sapien
ccgcaaccggagcaggagccctaaa

SEQ ID NO: 282166 - DNA, 25 bp, Homo sapien
gcaggagccctaaacctgtcagggt

SEQ ID NO: 282167 - DNA, 25 bp, Homo sapien
aaacctgtcagggtgggtcagccct

SEQ ID NO: 282168 - DNA, 25 bp, Homo sapien
ggtcagccctggagtaatcctggag

SEQ ID NO: 282169 - DNA, 25 bp, Homo sapien
caagaaggatctgtgctttgtagca

SEQ ID NO: 282170 - DNA, 25 bp, Homo sapien
tagcacaaatgtagcacctctgaag

SEQ ID NO: 282171 - DNA, 25 bp, Homo sapien
tgaagtatgtgtctgcttgggctca

SEQ ID NO: 282172 - DNA, 25 bp, Homo sapien
agggcagcttttcagtatgacttct

SEQ ID NO: 282173 - DNA, 25 bp, Homo sapien
ttctgaatcattgcctagtccatcc

SEQ ID NO: 282174 - DNA, 25 bp, Homo sapien
aataccagggagatgggtctgtcag

SEQ ID NO: 282175 - DNA, 25 bp, Homo sapien
gtctgtcagggatgttttcagctgc

SEQ ID NO: 282176 - DNA, 25 bp, Homo sapien
ttttcagctgcagtagtggatgctt

SEQ ID NO: 282177 - DNA, 25 bp, Homo sapien
gtggatgcttattgttcttgcaaca

SEQ ID NO: 282178 - DNA, 25 bp, Homo sapien
gcaacaagagttccggccaggcatg

SEQ ID NO: 282179 - DNA, 25 bp, Homo sapien
ggtggctcactttaggagactgaag

SEQ ID NO: 282180 - DNA, 25 bp, Homo sapien
ttatattcattaataaatgctgttg

SEQ ID NO: 282181 - DNA, 25 bp, Homo sapien
taataaatgctgttgtgcttggaga

SEQ ID NO: 282182 - DNA, 25 bp, Homo sapien
aataaatgctgttgtgcttggagat

SEQ ID NO: 282183 - DNA, 25 bp, Homo sapien
ataaatgctgttgtgcttggagatg

SEQ ID NO: 282184 - DNA, 25 bp, Homo sapien
taaatgctgttgtgcttggagatga

SEQ ID NO: 282185 - DNA, 25 bp, Homo sapien
aaatgctgttgtgcttggagatgat

SEQ ID NO: 282186 - DNA, 25 bp, Homo sapien
aatgctgttgtgcttggagatgatc

SEQ ID NO: 282187 - DNA, 25 bp, Homo sapien
atgctgttgtgcttggagatgatca

SEQ ID NO: 282188 - DNA, 25 bp, Homo sapien
tagccaacattagataccctcagtc

SEQ ID NO: 282189 - DNA, 25 bp, Homo sapien
caacattagataccctcagtctcat

SEQ ID NO: 282190 - DNA, 25 bp, Homo sapien
attagataccctcagtctcatactt

SEQ ID NO: 282191 - DNA, 25 bp, Homo sapien
gataccctcagtctcatacttaagt

SEQ ID NO: 282192 - DNA, 25 bp, Homo sapien
accctcagtctcatacttaagtatt

SEQ ID NO: 282193 - DNA, 25 bp, Homo sapien
ggtattttagccatccttatttctt

SEQ ID NO: 282194 - DNA, 25 bp, Homo sapien
tttagccatccttatttcttctttt

SEQ ID NO: 282195 - DNA, 25 bp, Homo sapien
tcctgttgtatatccattttgatat

SEQ ID NO: 282196 - DNA, 25 bp, Homo sapien
gatatcttaatgatttataaccctt

SEQ ID NO: 282197 - DNA, 25 bp, Homo sapien
gaatgagtgctaatcctttgttatg

SEQ ID NO: 282198 - DNA, 25 bp, Homo sapien
atgagtgctaatcctttgttatgtg

SEQ ID NO: 282199 - DNA, 25 bp, Homo sapien
tggttcattatagccttctcttaag

SEQ ID NO: 282200 - DNA, 25 bp, Homo sapien
cattatagccttctcttaagtactg

SEQ ID NO: 282201 - DNA, 25 bp, Homo sapien
acatcatcagtaagtctttagggac

SEQ ID NO: 282202 - DNA, 25 bp, Homo sapien
tagtcaggtcttctaaaaaggaaat

SEQ ID NO: 282203 - DNA, 25 bp, Homo sapien
taagtctttagggacacagggaata

SEQ ID NO: 282204 - DNA, 25 bp, Homo sapien
gcctggctgcggaacatgttgaagt

SEQ ID NO: 282205 - DNA, 25 bp, Homo sapien
aaattgagggtccaaaagctgaagg

SEQ ID NO: 282206 - DNA, 25 bp, Homo sapien
agctgaaggactttgtaaaggtcct

SEQ ID NO: 282207 - DNA, 25 bp, Homo sapien
tccttttctgatggtccatcagctg

SEQ ID NO: 282208 - DNA, 25 bp, Homo sapien
tggtccatcagctgctggttcatta

SEQ ID NO: 282209 - DNA, 25 bp, Homo sapien
agctgctggttcattatagccttct

SEQ ID NO: 282210 - DNA, 25 bp, Homo sapien
gtgtgctggtacacgtatgtagtcc

SEQ ID NO: 282211 - DNA, 25 bp, Homo sapien
gtgctggtacacgtatgtagtccca

SEQ ID NO: 282212 - DNA, 25 bp, Homo sapien
tgctggtacacgtatgtagtcccag

SEQ ID NO: 282213 - DNA, 25 bp, Homo sapien
gtcccagctacctgcctgtagtcct

SEQ ID NO: 282214 - DNA, 25 bp, Homo sapien
acacacaaacatcctcactgaaatt

SEQ ID NO: 282215 - DNA, 25 bp, Homo sapien
acatcctcactgaaattccttactg

SEQ ID NO: 282216 - DNA, 25 bp, Homo sapien
tcctcactgaaattccttactgtat

SEQ ID NO: 282217 - DNA, 25 bp, Homo sapien
cactgaaattccttactgtatttga

SEQ ID NO: 282218 - DNA, 25 bp, Homo sapien
ctgaaattccttactgtatttgaca

SEQ ID NO: 282219 - DNA, 25 bp, Homo sapien
tttaactcgaaaccatcctcagcca

SEQ ID NO: 282220 - DNA, 25 bp, Homo sapien
taactcgaaaccatcctcagccagg

SEQ ID NO: 282221 - DNA, 25 bp, Homo sapien
taaagctatccaggcagaattgctg

SEQ ID NO: 282222 - DNA, 25 bp, Homo sapien
agctatccaggcagaattgctgaaa

SEQ ID NO: 282223 - DNA, 25 bp, Homo sapien
gaattgctgaaagtcaaacaaaaga

SEQ ID NO: 282224 - DNA, 25 bp, Homo sapien
cagttttgcttattgtgtgttgatt

SEQ ID NO: 282225 - DNA, 25 bp, Homo sapien
tttgcttattgtgtgttgattgtat

SEQ ID NO: 282226 - DNA, 25 bp, Homo sapien
tgaatatgatccctaatgtgtttct

SEQ ID NO: 282227 - DNA, 25 bp, Homo sapien
tgtttcttttgacaccttagttcct

SEQ ID NO: 282228 - DNA, 25 bp, Homo sapien
cttttgacaccttagttccttactg

SEQ ID NO: 282229 - DNA, 25 bp, Homo sapien
ttgacaccttagttccttactgttt

SEQ ID NO: 282230 - DNA, 25 bp, Homo sapien
caccttagttccttactgtttacag

SEQ ID NO: 282231 - DNA, 25 bp, Homo sapien
ctgtttacagtttaggagtactgat

SEQ ID NO: 282232 - DNA, 25 bp, Homo sapien
gaggaggcagggatatcattgacaa

SEQ ID NO: 282233 - DNA, 25 bp, Homo sapien
cacctttgccagtttctttgtattc

SEQ ID NO: 282234 - DNA, 25 bp, Homo sapien
ttgccagtttctttgtattcgtgat

SEQ ID NO: 282235 - DNA, 25 bp, Homo sapien
gtattcgtgattttttgtgctatta

SEQ ID NO: 282236 - DNA, 25 bp, Homo sapien
ttcggcacgacgcagttatatgttt

SEQ ID NO: 282237 - DNA, 25 bp, Homo sapien
ggcacgacgcagttatatgtttggg

SEQ ID NO: 282238 - DNA, 25 bp, Homo sapien
aagaaaagcccacctgggctagtga

SEQ ID NO: 282239 - DNA, 25 bp, Homo sapien
gcccacctgggctagtgaaaggaga

SEQ ID NO: 282240 - DNA, 25 bp, Homo sapien
gagccgtcgctccaaaagtagagaa

SEQ ID NO: 282241 - DNA, 25 bp, Homo sapien
gctgtaagataagcaaccaacgcag

SEQ ID NO: 282242 - DNA, 25 bp, Homo sapien
aatgtagcccattacatatatgggt

SEQ ID NO: 282243 - DNA, 25 bp, Homo sapien
ttcataccaatgtgctcaaactttg

SEQ ID NO: 282244 - DNA, 25 bp, Homo sapien
ctcaaactttgagctaggtcttgtg

SEQ ID NO: 282245 - DNA, 25 bp, Homo sapien
aggtcttgtgagtttgcctagcact

SEQ ID NO: 282246 - DNA, 25 bp, Homo sapien
tgcctagcactcagacctgtttaag

SEQ ID NO: 282247 - DNA, 25 bp, Homo sapien
aagtcaaccgaagctttgtggtgca

SEQ ID NO: 282248 - DNA, 25 bp, Homo sapien
aaactctcccagcagggtcctcggt

SEQ ID NO: 282249 - DNA, 25 bp, Homo sapien
agggtcctcggtttcctcatttgtg

SEQ ID NO: 282250 - DNA, 25 bp, Homo sapien
tgagtgggccacgacgttaataagc

SEQ ID NO: 282251 - DNA, 25 bp, Homo sapien
ataagcccaagagaactgtgaaggt

SEQ ID NO: 282252 - DNA, 25 bp, Homo sapien
tgaaggtggtagtcccttgccctaa

SEQ ID NO: 282253 - DNA, 25 bp, Homo sapien
ccttgccctaattggtgctcaataa

SEQ ID NO: 282254 - DNA, 25 bp, Homo sapien
gggaagctgcccgtttcaatcctca

SEQ ID NO: 282255 - DNA, 25 bp, Homo sapien
ccaccacgtcgctcataaagcttat

SEQ ID NO: 282256 - DNA, 25 bp, Homo sapien
tcataaagcttatccctctgtcgtt

SEQ ID NO: 282257 - DNA, 25 bp, Homo sapien
ttatccctctgtcgttcctggattt

SEQ ID NO: 282258 - DNA, 25 bp, Homo sapien
tggatttctttcatctcatccgcat

SEQ ID NO: 282259 - DNA, 25 bp, Homo sapien
atctcatccgcataccggcaaaagg

SEQ ID NO: 282260 - DNA, 25 bp, Homo sapien
ggcaaaaggcgcctccgaacttgcc

SEQ ID NO: 282261 - DNA, 25 bp, Homo sapien
atggcattgcggtaggacggcttca

SEQ ID NO: 282262 - DNA, 25 bp, Homo sapien
attgcggtaggacggcttcacctcg

SEQ ID NO: 282263 - DNA, 25 bp, Homo sapien
actcgcagaaacaccccgtatttgt

SEQ ID NO: 282264 - DNA, 25 bp, Homo sapien
ggaaagggaattctctagccaaggg

SEQ ID NO: 282265 - DNA, 25 bp, Homo sapien
ggttatggcacaacacatgcagtcc

SEQ ID NO: 282266 - DNA, 25 bp, Homo sapien
atgcagtcccatgcaccttataaat

SEQ ID NO: 282267 - DNA, 25 bp, Homo sapien
ggcctcatgaagatgtccgtgctga

SEQ ID NO: 282268 - DNA, 25 bp, Homo sapien
gaatgtagatttgttggccttacta

SEQ ID NO: 282269 - DNA, 25 bp, Homo sapien
ggccttactaaccttggagctactt

SEQ ID NO: 282270 - DNA, 25 bp, Homo sapien
ggagctacttgttacttagcttcta

SEQ ID NO: 282271 - DNA, 25 bp, Homo sapien
ttagcttctactattcagcaacttt

SEQ ID NO: 282272 - DNA, 25 bp, Homo sapien
gcaactttatatgatacctgaggca

SEQ ID NO: 282273 - DNA, 25 bp, Homo sapien
ggctgtcttcactgccaaggtagaa

SEQ ID NO: 282274 - DNA, 25 bp, Homo sapien
tgccgcttacgatttgttagtagag

SEQ ID NO: 282275 - DNA, 25 bp, Homo sapien
acaggctaatacacaactgggttat

SEQ ID NO: 282276 - DNA, 25 bp, Homo sapien
tgttgggagtcaatggcatcagaac

SEQ ID NO: 282277 - DNA, 25 bp, Homo sapien
tttttagcccaggtatgtggaagac

SEQ ID NO: 282278 - DNA, 25 bp, Homo sapien
cccaggtatgtggaagacacttctt

SEQ ID NO: 282279 - DNA, 25 bp, Homo sapien
gtgtgataaagaccaacccttccca

SEQ ID NO: 282280 - DNA, 25 bp, Homo sapien
gataaagaccaacccttcccattag

SEQ ID NO: 282281 - DNA, 25 bp, Homo sapien
cttccaggcccacatgtaagaattc

SEQ ID NO: 282282 - DNA, 25 bp, Homo sapien
aaacatttgctcatgtcttagttct

SEQ ID NO: 282283 - DNA, 25 bp, Homo sapien
gctcatgtcttagttctacagctga

SEQ ID NO: 282284 - DNA, 25 bp, Homo sapien
tagttctacagctgaccttctttca

SEQ ID NO: 282285 - DNA, 25 bp, Homo sapien
gctgaccttctttcactgttttcaa

SEQ ID NO: 282286 - DNA, 25 bp, Homo sapien
tttcaaggtcaataactgtgtgttc

SEQ ID NO: 282287 - DNA, 25 bp, Homo sapien
acttttgcaatgtgacccatgttgg

SEQ ID NO: 282288 - DNA, 25 bp, Homo sapien
caatgtgacccatgttgggcatttt

SEQ ID NO: 282289 - DNA, 25 bp, Homo sapien
ataacgagcaaaactggttagattt

SEQ ID NO: 282290 - DNA, 25 bp, Homo sapien
gtttagttttgaatttctgacagag

SEQ ID NO: 282291 - DNA, 25 bp, Homo sapien
gtagtttaaaatctctcgtacactg

SEQ ID NO: 282292 - DNA, 25 bp, Homo sapien
aaatctctcgtacactgataactca

SEQ ID NO: 282293 - DNA, 25 bp, Homo sapien
tctcgtacactgataactcaagctt

SEQ ID NO: 282294 - DNA, 25 bp, Homo sapien
acactgataactcaagcttttcatt

SEQ ID NO: 282295 - DNA, 25 bp, Homo sapien
cttttcattttctcatacagttgta

SEQ ID NO: 282296 - DNA, 25 bp, Homo sapien
ttcattttctcatacagttgtacag

SEQ ID NO: 282297 - DNA, 25 bp, Homo sapien
agttgtacagatttaactgggacca

SEQ ID NO: 282298 - DNA, 25 bp, Homo sapien
ggaagcattttatgagattacttat

SEQ ID NO: 282299 - DNA, 25 bp, Homo sapien
gcattttatgagattacttatgtta

SEQ ID NO: 282300 - DNA, 25 bp, Homo sapien
tagcacttttggaggtagggtggca

SEQ ID NO: 282301 - DNA, 25 bp, Homo sapien
tggcagggagcagattgcatcgcat

SEQ ID NO: 282302 - DNA, 25 bp, Homo sapien
gcagggagcagattgcatcgcatga

SEQ ID NO: 282303 - DNA, 25 bp, Homo sapien
gagcagattgcatcgcatgaggcca

SEQ ID NO: 282304 - DNA, 25 bp, Homo sapien
agcagattgcatcgcatgaggccag

SEQ ID NO: 282305 - DNA, 25 bp, Homo sapien
agattgcatcgcatgaggccagcct

SEQ ID NO: 282306 - DNA, 25 bp, Homo sapien
gattgcatcgcatgaggccagcctg

SEQ ID NO: 282307 - DNA, 25 bp, Homo sapien
attgcatcgcatgaggccagcctgg

SEQ ID NO: 282308 - DNA, 25 bp, Homo sapien
ttgcatcgcatgaggccagcctggg

SEQ ID NO: 282309 - DNA, 25 bp, Homo sapien
ttttctacccaaattactaatctat

SEQ ID NO: 282310 - DNA, 25 bp, Homo sapien
ttctacccaaattactaatctatgc

SEQ ID NO: 282311 - DNA, 25 bp, Homo sapien
tacccaaattactaatctatgccat

SEQ ID NO: 282312 - DNA, 25 bp, Homo sapien
cccaaattactaatctatgccatta

SEQ ID NO: 282313 - DNA, 25 bp, Homo sapien
aaattactaatctatgccattaagg

SEQ ID NO: 282314 - DNA, 25 bp, Homo sapien
aattactaatctatgccattaagga

SEQ ID NO: 282315 - DNA, 25 bp, Homo sapien
attactaatctatgccattaaggaa

SEQ ID NO: 282316 - DNA, 25 bp, Homo sapien
ttactaatctatgccattaaggaaa

SEQ ID NO: 282317 - DNA, 25 bp, Homo sapien
actaatctatgccattaaggaaagg

SEQ ID NO: 282318 - DNA, 25 bp, Homo sapien
aatctatgccattaaggaaaggaat

SEQ ID NO: 282319 - DNA, 25 bp, Homo sapien
tctatgccattaaggaaaggaataa

SEQ ID NO: 282320 - DNA, 25 bp, Homo sapien
agctaacctgtggtttgtgctgaaa

SEQ ID NO: 282321 - DNA, 25 bp, Homo sapien
aaacctgctttcttcctgggagtct

SEQ ID NO: 282322 - DNA, 25 bp, Homo sapien
gtagaaggtacctacgtgaccagcc

SEQ ID NO: 282323 - DNA, 25 bp, Homo sapien
accctgggcactgtatctctaacaa

SEQ ID NO: 282324 - DNA, 25 bp, Homo sapien
gtatctctaacaagtttccctggta

SEQ ID NO: 282325 - DNA, 25 bp, Homo sapien
tttccctggtaaacaacatttctca

SEQ ID NO: 282326 - DNA, 25 bp, Homo sapien
ttgtcacaattcagttgctggtgga

SEQ ID NO: 282327 - DNA, 25 bp, Homo sapien
atgtgtgactccactgttagaggac

SEQ ID NO: 282328 - DNA, 25 bp, Homo sapien
ggactctggaagcttatacctggtt

SEQ ID NO: 282329 - DNA, 25 bp, Homo sapien
ccagactttgcctctgtaccttttc

SEQ ID NO: 282330 - DNA, 25 bp, Homo sapien
tttctctttgctgttttgcttcata

SEQ ID NO: 282331 - DNA, 25 bp, Homo sapien
gccacagtaccatgaggttaacagg

SEQ ID NO: 282332 - DNA, 25 bp, Homo sapien
atgaggttaacaggtcctccctcca

SEQ ID NO: 282333 - DNA, 25 bp, Homo sapien
atggtggcagcctaacctgcattgc

SEQ ID NO: 282334 - DNA, 25 bp, Homo sapien
aacctgcattgcagccgttcaccgg

SEQ ID NO: 282335 - DNA, 25 bp, Homo sapien
tgggaggagtaaacaacccagccca

SEQ ID NO: 282336 - DNA, 25 bp, Homo sapien
aacaacccagcccagttaagaggag

SEQ ID NO: 282337 - DNA, 25 bp, Homo sapien
gcccagttaagaggagatgccgaat

SEQ ID NO: 282338 - DNA, 25 bp, Homo sapien
acctgtcttccactgtatctactgt

SEQ ID NO: 282339 - DNA, 25 bp, Homo sapien
gtcttccactgtatctactgtacga

SEQ ID NO: 282340 - DNA, 25 bp, Homo sapien
gtatctactgtacgaacttctccag

SEQ ID NO: 282341 - DNA, 25 bp, Homo sapien
tactgtacgaacttctccagctctg

SEQ ID NO: 282342 - DNA, 25 bp, Homo sapien
tgtccgtaaactggaacctctgttc

SEQ ID NO: 282343 - DNA, 25 bp, Homo sapien
gtaaactggaacctctgttcactca

SEQ ID NO: 282344 - DNA, 25 bp, Homo sapien
aactggaacctctgttcactcaagg

SEQ ID NO: 282345 - DNA, 25 bp, Homo sapien
tggaacctctgttcactcaagggac

SEQ ID NO: 282346 - DNA, 25 bp, Homo sapien
gaacctctgttcactcaagggacga

SEQ ID NO: 282347 - DNA, 25 bp, Homo sapien
tctgttcactcaagggacgaggtct

SEQ ID NO: 282348 - DNA, 25 bp, Homo sapien
tcactcaagggacgaggtctcactg

SEQ ID NO: 282349 - DNA, 25 bp, Homo sapien
ctggcctcaaaactccttagcttgg

SEQ ID NO: 282350 - DNA, 25 bp, Homo sapien
ctcaaaactccttagcttggccagg

SEQ ID NO: 282351 - DNA, 25 bp, Homo sapien
agcctgccaacacattgaaacttcg

SEQ ID NO: 282352 - DNA, 25 bp, Homo sapien
tgccaacacattgaaacttcgtctc

SEQ ID NO: 282353 - DNA, 25 bp, Homo sapien
gagcttttgttgtgagttattgtga

SEQ ID NO: 282354 - DNA, 25 bp, Homo sapien
cagacaaataggtccagggagctca

SEQ ID NO: 282355 - DNA, 25 bp, Homo sapien
atatatgtgagctgtcttctctccc

SEQ ID NO: 282356 - DNA, 25 bp, Homo sapien
gctgtcttctctcccgtttcttaaa

SEQ ID NO: 282357 - DNA, 25 bp, Homo sapien
atatttatccatacatatctgggta

SEQ ID NO: 282358 - DNA, 25 bp, Homo sapien
atctgggtaatcattcaataattta

SEQ ID NO: 282359 - DNA, 25 bp, Homo sapien
agggagctcaaaatccatttccacc

SEQ ID NO: 282360 - DNA, 25 bp, Homo sapien
gctcaaaatccatttccaccattta

SEQ ID NO: 282361 - DNA, 25 bp, Homo sapien
ttattatcaataactctgggacttt

SEQ ID NO: 282362 - DNA, 25 bp, Homo sapien
taactctgggactttttgttctggt

SEQ ID NO: 282363 - DNA, 25 bp, Homo sapien
ctggttacttattctctgtgagctt

SEQ ID NO: 282364 - DNA, 25 bp, Homo sapien
tgaaaattctttgttgttctacttt

SEQ ID NO: 282365 - DNA, 25 bp, Homo sapien
caattgtaaagttgcagtgatgact

SEQ ID NO: 282366 - DNA, 25 bp, Homo sapien
tgaatagaacttaaggaaataactc

SEQ ID NO: 282367 - DNA, 25 bp, Homo sapien
gaaataactccaaaacaatgtaatt

SEQ ID NO: 282368 - DNA, 25 bp, Homo sapien
gaaggttcataaaaatcctgtaagg

SEQ ID NO: 282369 - DNA, 25 bp, Homo sapien
agttgcagtgatgacttttgtgaaa

SEQ ID NO: 282370 - DNA, 25 bp, Homo sapien
gttgcagtgatgacttttgtgaaac

SEQ ID NO: 282371 - DNA, 25 bp, Homo sapien
tgctgtaactttttctccctaaaga

SEQ ID NO: 282372 - DNA, 25 bp, Homo sapien
gcagtgatgacttttgtgaaacaaa

SEQ ID NO: 282373 - DNA, 25 bp, Homo sapien
atgtatcattttagtgatactctta

SEQ ID NO: 282374 - DNA, 25 bp, Homo sapien
ttgttttttggcagtaaatgtgaaa

SEQ ID NO: 282375 - DNA, 25 bp, Homo sapien
ggcacacgcatcacctttgagaagg

SEQ ID NO: 282376 - DNA, 25 bp, Homo sapien
tcccagcagacatcattttcatcgt

SEQ ID NO: 282377 - DNA, 25 bp, Homo sapien
taaaggagaagctacaccctcgctt

SEQ ID NO: 282378 - DNA, 25 bp, Homo sapien
acaccctcgcttccgcagggagaat

SEQ ID NO: 282379 - DNA, 25 bp, Homo sapien
gaatgacaacctcttcttcgtgaac

SEQ ID NO: 282380 - DNA, 25 bp, Homo sapien
ggctctcacctgctgcactgtggag

SEQ ID NO: 282381 - DNA, 25 bp, Homo sapien
ctgcactgtggaggtgaggacccta

SEQ ID NO: 282382 - DNA, 25 bp, Homo sapien
gtgaggaccctagatgaccgtctgc

SEQ ID NO: 282383 - DNA, 25 bp, Homo sapien
tagatgaccgtctgctcaacatccc

SEQ ID NO: 282384 - DNA, 25 bp, Homo sapien
catccaccccaaatacttcaagaag

SEQ ID NO: 282385 - DNA, 25 bp, Homo sapien
tgaccattgatgtgaagcccggttg

SEQ ID NO: 282386 - DNA, 25 bp, Homo sapien
gcagttattccaattcagggttgtg

SEQ ID NO: 282387 - DNA, 25 bp, Homo sapien
ttccaattcagggttgtgggtggct

SEQ ID NO: 282388 - DNA, 25 bp, Homo sapien
gggtggctgaaatctatcccatcag

SEQ ID NO: 282389 - DNA, 25 bp, Homo sapien
gggaccaaccctgacaggttgctat

SEQ ID NO: 282390 - DNA, 25 bp, Homo sapien
acaggttgctattccattgcagggt

SEQ ID NO: 282391 - DNA, 25 bp, Homo sapien
tccattgcagggtgcattgcaacca

SEQ ID NO: 282392 - DNA, 25 bp, Homo sapien
agggtgcattgcaaccacacacaca

SEQ ID NO: 282393 - DNA, 25 bp, Homo sapien
acacacccatagtcgttcagactga

SEQ ID NO: 282394 - DNA, 25 bp, Homo sapien
gttcagactgagatcatttagacaa

SEQ ID NO: 282395 - DNA, 25 bp, Homo sapien
gagtaagttgagttcctaaagcata

SEQ ID NO: 282396 - DNA, 25 bp, Homo sapien
gttcctaaagcatatctctgatcac

SEQ ID NO: 282397 - DNA, 25 bp, Homo sapien
ggataatattctgcccaactccatc

SEQ ID NO: 282398 - DNA, 25 bp, Homo sapien
catcctctgttactagatcccttac

SEQ ID NO: 282399 - DNA, 25 bp, Homo sapien
tagatcccttaccagtcacatttgt

SEQ ID NO: 282400 - DNA, 25 bp, Homo sapien
tcacatttgtggactggtggccagt

SEQ ID NO: 282401 - DNA, 25 bp, Homo sapien
cagtcgtataccatccctggaagga

SEQ ID NO: 282402 - DNA, 25 bp, Homo sapien
tgggacaatattccagggattcatt

SEQ ID NO: 282403 - DNA, 25 bp, Homo sapien
gattcattgacttcttggctccttt

SEQ ID NO: 282404 - DNA, 25 bp, Homo sapien
gaccatgcttaagtgcatcctatca

SEQ ID NO: 282405 - DNA, 25 bp, Homo sapien
gtccccatggccattggatcatgag

SEQ ID NO: 282406 - DNA, 25 bp, Homo sapien
ggatcatgagacactctgaagtcag

SEQ ID NO: 282407 - DNA, 25 bp, Homo sapien
gggcagatcacttcaagcaagcccc

SEQ ID NO: 282408 - DNA, 25 bp, Homo sapien
ccctgaagcagggagtcctggatgt

SEQ ID NO: 282409 - DNA, 25 bp, Homo sapien
acctgtgccttcaccccagatggga

SEQ ID NO: 282410 - DNA, 25 bp, Homo sapien
accccagatgggaaaatcttagtgt

SEQ ID NO: 282411 - DNA, 25 bp, Homo sapien
tggagctgccgatcagactagacgt

SEQ ID NO: 282412 - DNA, 25 bp, Homo sapien
ttctctcccgacgagctgtggctgg

SEQ ID NO: 282413 - DNA, 25 bp, Homo sapien
gactagacgtcaaatatcccgcacg

SEQ ID NO: 282414 - DNA, 25 bp, Homo sapien
tcaaatatcccgcacgtccaaatca

SEQ ID NO: 282415 - DNA, 25 bp, Homo sapien
ctaacaccaaccacctcagatggtg

SEQ ID NO: 282416 - DNA, 25 bp, Homo sapien
ggctattcccgcatggtcaaagtct

SEQ ID NO: 282417 - DNA, 25 bp, Homo sapien
aaagtctgggactgcaacacaggaa

SEQ ID NO: 282418 - DNA, 25 bp, Homo sapien
ggaaagtgccttgagaccctgaagc

SEQ ID NO: 282419 - DNA, 25 bp, Homo sapien
aagctcatttcccacttcaatgcaa

SEQ ID NO: 282420 - DNA, 25 bp, Homo sapien
atttcccacttcaatgcaatactga

SEQ ID NO: 282421 - DNA, 25 bp, Homo sapien
aatgcaatactgaaaactggctaaa

SEQ ID NO: 282422 - DNA, 25 bp, Homo sapien
atcaatatactgctaatggtacttt

SEQ ID NO: 282423 - DNA, 25 bp, Homo sapien
agagtatgcaaaactggaaggccag

SEQ ID NO: 282424 - DNA, 25 bp, Homo sapien
ggaggcaaataatatgtctttccga

SEQ ID NO: 282425 - DNA, 25 bp, Homo sapien
taatatgtctttccgatggtgtctc

SEQ ID NO: 282426 - DNA, 25 bp, Homo sapien
ggtgtctcccaagtgttggtgcttt

SEQ ID NO: 282427 - DNA, 25 bp, Homo sapien
tgttggtgctttgggtttttataag

SEQ ID NO: 282428 - DNA, 25 bp, Homo sapien
gaagatgcacatttcttcattctcc

SEQ ID NO: 282429 - DNA, 25 bp, Homo sapien
ttcttcattctccatggtgtgcatg

SEQ ID NO: 282430 - DNA, 25 bp, Homo sapien
gcgctagctccttctctcgcccggg

SEQ ID NO: 282431 - DNA, 25 bp, Homo sapien
ggttcctgccggtagctctccgggt

SEQ ID NO: 282432 - DNA, 25 bp, Homo sapien
tcctgccggtagctctccgggtctt

SEQ ID NO: 282433 - DNA, 25 bp, Homo sapien
tgccggtagctctccgggtcttggc

SEQ ID NO: 282434 - DNA, 25 bp, Homo sapien
agctctccgggtcttggcgcggcgg

SEQ ID NO: 282435 - DNA, 25 bp, Homo sapien
cgggcggtatgtggcgcctggtgcc

SEQ ID NO: 282436 - DNA, 25 bp, Homo sapien
gtatgtggcgcctggtgcccccgaa

SEQ ID NO: 282437 - DNA, 25 bp, Homo sapien
tgtggcgcctggtgcccccgaagct

SEQ ID NO: 282438 - DNA, 25 bp, Homo sapien
tgtcccgctcgctgaagctggcggc

SEQ ID NO: 282439 - DNA, 25 bp, Homo sapien
gctcgctgaagctggcggcgctggg

SEQ ID NO: 282440 - DNA, 25 bp, Homo sapien
cgctgggcagcctgttggtgctgat

SEQ ID NO: 282441 - DNA, 25 bp, Homo sapien
gcacccttacaaatgcttaatgagc

SEQ ID NO: 282442 - DNA, 25 bp, Homo sapien
gcttaatgagcctatgggtttgttt

SEQ ID NO: 282443 - DNA, 25 bp, Homo sapien
tgggtttgtttggtactgtaatgac

SEQ ID NO: 282444 - DNA, 25 bp, Homo sapien
ggtactgtaatgacaagccatcgca

SEQ ID NO: 282445 - DNA, 25 bp, Homo sapien
aagccatcgcaagtgacctctatat

SEQ ID NO: 282446 - DNA, 25 bp, Homo sapien
acctctatatacagggtcactcaga

SEQ ID NO: 282447 - DNA, 25 bp, Homo sapien
ttgcattagaggtatgtctcctttt

SEQ ID NO: 282448 - DNA, 25 bp, Homo sapien
gtctccttttgtatttagtacacca

SEQ ID NO: 282449 - DNA, 25 bp, Homo sapien
aatatttcagaatgcttattccttc

SEQ ID NO: 282450 - DNA, 25 bp, Homo sapien
attccttcaatgatttcctaagtgt

SEQ ID NO: 282451 - DNA, 25 bp, Homo sapien
atttcctaagtgtatcagttgagat

SEQ ID NO: 282452 - DNA, 25 bp, Homo sapien
actggaaagatactctctaaatgta

SEQ ID NO: 282453 - DNA, 25 bp, Homo sapien
tggaaagatactctctaaatgtatg

SEQ ID NO: 282454 - DNA, 25 bp, Homo sapien
aaacattcagtactttaatttcaga

SEQ ID NO: 282455 - DNA, 25 bp, Homo sapien
gaaacttgaaagaactcactttgga

SEQ ID NO: 282456 - DNA, 25 bp, Homo sapien
aagaactcactttggagatagaccc

SEQ ID NO: 282457 - DNA, 25 bp, Homo sapien
agaactcactttggagatagaccct

SEQ ID NO: 282458 - DNA, 25 bp, Homo sapien
gaactcactttggagatagacccta

SEQ ID NO: 282459 - DNA, 25 bp, Homo sapien
aactcactttggagatagaccctat

SEQ ID NO: 282460 - DNA, 25 bp, Homo sapien
actcactttggagatagaccctatg

SEQ ID NO: 282461 - DNA, 25 bp, Homo sapien
ctcactttggagatagaccctatga

SEQ ID NO: 282462 - DNA, 25 bp, Homo sapien
gtaaacatgggataaagccttaagt

SEQ ID NO: 282463 - DNA, 25 bp, Homo sapien
aaaaacatgtccaggtatggtggta

SEQ ID NO: 282464 - DNA, 25 bp, Homo sapien
gtggtatatgcctgcggttccaagc

SEQ ID NO: 282465 - DNA, 25 bp, Homo sapien
tggtatatgcctgcggttccaagcc

SEQ ID NO: 282466 - DNA, 25 bp, Homo sapien
atatgcctgcggttccaagccacct

SEQ ID NO: 282467 - DNA, 25 bp, Homo sapien
ctgcggttccaagccacctgggagg

SEQ ID NO: 282468 - DNA, 25 bp, Homo sapien
cggttccaagccacctgggaggccg

SEQ ID NO: 282469 - DNA, 25 bp, Homo sapien
actgctcgagcccacaaggtcaatg

SEQ ID NO: 282470 - DNA, 25 bp, Homo sapien
gctcgagcccacaaggtcaatgctg

SEQ ID NO: 282471 - DNA, 25 bp, Homo sapien
gagcccacaaggtcaatgctgcaga

SEQ ID NO: 282472 - DNA, 25 bp, Homo sapien
gcccacaaggtcaatgctgcagaaa

SEQ ID NO: 282473 - DNA, 25 bp, Homo sapien
caaggtcaatgctgcagaaagctgt

SEQ ID NO: 282474 - DNA, 25 bp, Homo sapien
tattcccaaggaagtattgcattat

SEQ ID NO: 282475 - DNA, 25 bp, Homo sapien
tgaaacgagttctccctaactgaat

SEQ ID NO: 282476 - DNA, 25 bp, Homo sapien
atgtgctagaacgttaactaactga

SEQ ID NO: 282477 - DNA, 25 bp, Homo sapien
attgaattaattctattcctcctca

SEQ ID NO: 282478 - DNA, 25 bp, Homo sapien
gggaaggaaccaatcatttgctctt

SEQ ID NO: 282479 - DNA, 25 bp, Homo sapien
ggaaccaatcatttgctctttacaa

SEQ ID NO: 282480 - DNA, 25 bp, Homo sapien
acatttctacaaaaccaacagcatg

SEQ ID NO: 282481 - DNA, 25 bp, Homo sapien
acagcatgggaaattcttcaaataa

SEQ ID NO: 282482 - DNA, 25 bp, Homo sapien
tttttccttctgcataacaagttag

SEQ ID NO: 282483 - DNA, 25 bp, Homo sapien
gttagtgtcttgtcttatacagtat

SEQ ID NO: 282484 - DNA, 25 bp, Homo sapien
tacagtattacttcctattcccaag

SEQ ID NO: 282485 - DNA, 25 bp, Homo sapien
agcacttttgatatcaagcaagtgg

SEQ ID NO: 282486 - DNA, 25 bp, Homo sapien
acttttgatatcaagcaagtggctt

SEQ ID NO: 282487 - DNA, 25 bp, Homo sapien
cttttgatatcaagcaagtggcttc

SEQ ID NO: 282488 - DNA, 25 bp, Homo sapien
ttttgatatcaagcaagtggcttcc

SEQ ID NO: 282489 - DNA, 25 bp, Homo sapien
tttgatatcaagcaagtggcttcct

SEQ ID NO: 282490 - DNA, 25 bp, Homo sapien
ttgatatcaagcaagtggcttcctt

SEQ ID NO: 282491 - DNA, 25 bp, Homo sapien
tgatatcaagcaagtggcttccttt

SEQ ID NO: 282492 - DNA, 25 bp, Homo sapien
gatatcaagcaagtggcttcctttt

SEQ ID NO: 282493 - DNA, 25 bp, Homo sapien
atatcaagcaagtggcttccttttt

SEQ ID NO: 282494 - DNA, 25 bp, Homo sapien
tatcaagcaagtggcttcctttttg

SEQ ID NO: 282495 - DNA, 25 bp, Homo sapien
atcaagcaagtggcttcctttttga

SEQ ID NO: 282496 - DNA, 25 bp, Homo sapien
gtaatgcattaatggttgaatggct

SEQ ID NO: 282497 - DNA, 25 bp, Homo sapien
atgcattaatggttgaatggctggc

SEQ ID NO: 282498 - DNA, 25 bp, Homo sapien
tgcattaatggttgaatggctggcc

SEQ ID NO: 282499 - DNA, 25 bp, Homo sapien
gcattaatggttgaatggctggcca

SEQ ID NO: 282500 - DNA, 25 bp, Homo sapien
cattaatggttgaatggctggccac

SEQ ID NO: 282501 - DNA, 25 bp, Homo sapien
attaatggttgaatggctggccacc

SEQ ID NO: 282502 - DNA, 25 bp, Homo sapien
ttaatggttgaatggctggccaccg

SEQ ID NO: 282503 - DNA, 25 bp, Homo sapien
taatggttgaatggctggccaccgt

SEQ ID NO: 282504 - DNA, 25 bp, Homo sapien
tggttgaatggctggccaccgtgcc

SEQ ID NO: 282505 - DNA, 25 bp, Homo sapien
ggttgaatggctggccaccgtgcct

SEQ ID NO: 282506 - DNA, 25 bp, Homo sapien
gttgaatggctggccaccgtgcctc

SEQ ID NO: 282507 - DNA, 25 bp, Homo sapien
atgttagcactttactgctgaattc

SEQ ID NO: 282508 - DNA, 25 bp, Homo sapien
gcactttactgctgaattctcaatt

SEQ ID NO: 282509 - DNA, 25 bp, Homo sapien
tttactgctgaattctcaattttct

SEQ ID NO: 282510 - DNA, 25 bp, Homo sapien
aattttcttaacattgagacaataa

SEQ ID NO: 282511 - DNA, 25 bp, Homo sapien
aataaatgtgtagttagtcttgtat

SEQ ID NO: 282512 - DNA, 25 bp, Homo sapien
agttagtcttgtatatggcataaag

SEQ ID NO: 282513 - DNA, 25 bp, Homo sapien
aagtcagtacttgggttgtgtaatc

SEQ ID NO: 282514 - DNA, 25 bp, Homo sapien
cttgggttgtgtaatctgctagtcc

SEQ ID NO: 282515 - DNA, 25 bp, Homo sapien
ggttgtgtaatctgctagtccaagc

SEQ ID NO: 282516 - DNA, 25 bp, Homo sapien
gtgtaatctgctagtccaagcgaac

SEQ ID NO: 282517 - DNA, 25 bp, Homo sapien
aatctgctagtccaagcgaacagca

SEQ ID NO: 282518 - DNA, 25 bp, Homo sapien
tgatttctagattctcattgaagac

SEQ ID NO: 282519 - DNA, 25 bp, Homo sapien
gggtctttgattttacatagctttg

SEQ ID NO: 282520 - DNA, 25 bp, Homo sapien
gaaaatggatgcaccctggattcag

SEQ ID NO: 282521 - DNA, 25 bp, Homo sapien
tgcaccctggattcagagcaagcac

SEQ ID NO: 282522 - DNA, 25 bp, Homo sapien
gcctcagttcttctcggatctgatg

SEQ ID NO: 282523 - DNA, 25 bp, Homo sapien
gttcttctcggatctgatgtttaat

SEQ ID NO: 282524 - DNA, 25 bp, Homo sapien
gtgagatggaagctttccctcgcca

SEQ ID NO: 282525 - DNA, 25 bp, Homo sapien
gaagctttccctcgccactgaaagg

SEQ ID NO: 282526 - DNA, 25 bp, Homo sapien
ctcatccagggcctgcaaggatgct

SEQ ID NO: 282527 - DNA, 25 bp, Homo sapien
agctttgagaggagctacagcttta

SEQ ID NO: 282528 - DNA, 25 bp, Homo sapien
caaaatttaatagctgcctgcccta

SEQ ID NO: 282529 - DNA, 25 bp, Homo sapien
tttagagcaggtccttgatgtgcct

SEQ ID NO: 282530 - DNA, 25 bp, Homo sapien
tgatgtgcctggcatctaagtccca

SEQ ID NO: 282531 - DNA, 25 bp, Homo sapien
tggcatctaagtcccaccctgaagg

SEQ ID NO: 282532 - DNA, 25 bp, Homo sapien
gagacagacatgtgttcaacagcga

SEQ ID NO: 282533 - DNA, 25 bp, Homo sapien
gttcaacagcgacaaacagtgcagt

SEQ ID NO: 282534 - DNA, 25 bp, Homo sapien
cagtgcagtgaatatgtaggagcct

SEQ ID NO: 282535 - DNA, 25 bp, Homo sapien
actatggctttgctgtgagatcctg

SEQ ID NO: 282536 - DNA, 25 bp, Homo sapien
gatcctggacaagccatgtaacttc

SEQ ID NO: 282537 - DNA, 25 bp, Homo sapien
caagccatgtaacttctgagcctca

SEQ ID NO: 282538 - DNA, 25 bp, Homo sapien
atgccacctcacagggttagcgtga

SEQ ID NO: 282539 - DNA, 25 bp, Homo sapien
cttccagccatgtccagtaaacaat

SEQ ID NO: 282540 - DNA, 25 bp, Homo sapien
gaacctgacgttcttgacgatcttt

SEQ ID NO: 282541 - DNA, 25 bp, Homo sapien
acctgacgttcttgacgatctttat

SEQ ID NO: 282542 - DNA, 25 bp, Homo sapien
tgacgttcttgacgatctttatgga

SEQ ID NO: 282543 - DNA, 25 bp, Homo sapien
gcatggtacctcaagcctaagttgt

SEQ ID NO: 282544 - DNA, 25 bp, Homo sapien
attcaacgtgcaatgatattttaca

SEQ ID NO: 282545 - DNA, 25 bp, Homo sapien
acgtgcaatgatattttacaagtac

SEQ ID NO: 282546 - DNA, 25 bp, Homo sapien
aaagaaatcgtagaggcatcggaag

SEQ ID NO: 282547 - DNA, 25 bp, Homo sapien
aatcgtagaggcatcggaagaagat

SEQ ID NO: 282548 - DNA, 25 bp, Homo sapien
ggaagaagattaggcagttttcaat

SEQ ID NO: 282549 - DNA, 25 bp, Homo sapien
gattgaccccaagctcttacttaaa

SEQ ID NO: 282550 - DNA, 25 bp, Homo sapien
ctgatgaacctgacgttcttgacga

SEQ ID NO: 282551 - DNA, 25 bp, Homo sapien
aacctcatcttaattacttcggcaa

SEQ ID NO: 282552 - DNA, 25 bp, Homo sapien
taattacttcggcaaagaccctgtt

SEQ ID NO: 282553 - DNA, 25 bp, Homo sapien
taaggccatatttcacagataccag

SEQ ID NO: 282554 - DNA, 25 bp, Homo sapien
gccatatttcacagataccagggta

SEQ ID NO: 282555 - DNA, 25 bp, Homo sapien
gataccagggtataggacttcatat

SEQ ID NO: 282556 - DNA, 25 bp, Homo sapien
gggtataggacttcatatcgttttg

SEQ ID NO: 282557 - DNA, 25 bp, Homo sapien
gacttcatatcgttttgagggacac

SEQ ID NO: 282558 - DNA, 25 bp, Homo sapien
tgagggacacaattcaacacataac

SEQ ID NO: 282559 - DNA, 25 bp, Homo sapien
aacattagttaagcgtctcatggag

SEQ ID NO: 282560 - DNA, 25 bp, Homo sapien
ttaagcgtctcatggagttcggact

SEQ ID NO: 282561 - DNA, 25 bp, Homo sapien
gcgtctcatggagttcggactggtt

SEQ ID NO: 282562 - DNA, 25 bp, Homo sapien
ctcctctgtggcggcaggacctttg

SEQ ID NO: 282563 - DNA, 25 bp, Homo sapien
tcctctgtggcggcaggacctttgt

SEQ ID NO: 282564 - DNA, 25 bp, Homo sapien
cctctgtggcggcaggacctttgtg

SEQ ID NO: 282565 - DNA, 25 bp, Homo sapien
ctctgtggcggcaggacctttgtgg

SEQ ID NO: 282566 - DNA, 25 bp, Homo sapien
tctgtggcggcaggacctttgtggg

SEQ ID NO: 282567 - DNA, 25 bp, Homo sapien
ctgtggcggcaggacctttgtgggg

SEQ ID NO: 282568 - DNA, 25 bp, Homo sapien
ggacctttgtggggcttcgtgccct

SEQ ID NO: 282569 - DNA, 25 bp, Homo sapien
gacctcaatacaataaatgtgatcc

SEQ ID NO: 282570 - DNA, 25 bp, Homo sapien
acttcagatagtacgccatcagcgg

SEQ ID NO: 282571 - DNA, 25 bp, Homo sapien
agatagtacgccatcagcggctgct

SEQ ID NO: 282572 - DNA, 25 bp, Homo sapien
atagtacgccatcagcggctgcttt

SEQ ID NO: 282573 - DNA, 25 bp, Homo sapien
tcagcggctgctttgagttcctgct

SEQ ID NO: 282574 - DNA, 25 bp, Homo sapien
agcggtcaatctcctgctcgcgttc

SEQ ID NO: 282575 - DNA, 25 bp, Homo sapien
cgcccacataggcagcctgggtcaa

SEQ ID NO: 282576 - DNA, 25 bp, Homo sapien
acataggcagcctgggtcaacggct

SEQ ID NO: 282577 - DNA, 25 bp, Homo sapien
taggcagcctgggtcaacggctgta

SEQ ID NO: 282578 - DNA, 25 bp, Homo sapien
gtcaacggctgtagccgctcggcca

SEQ ID NO: 282579 - DNA, 25 bp, Homo sapien
ggctgtagccgctcggccagttccg

SEQ ID NO: 282580 - DNA, 25 bp, Homo sapien
agcggcgcggtctgggagtacagca

SEQ ID NO: 282581 - DNA, 25 bp, Homo sapien
tatgtgggtccatatgtgtttacac

SEQ ID NO: 282582 - DNA, 25 bp, Homo sapien
gtgtttacacatatccccatgtaca

SEQ ID NO: 282583 - DNA, 25 bp, Homo sapien
atatccccatgtacacgtatggatt

SEQ ID NO: 282584 - DNA, 25 bp, Homo sapien
attgcttgcactttcatttatacac

SEQ ID NO: 282585 - DNA, 25 bp, Homo sapien
actttcatttatacacactgcaggc

SEQ ID NO: 282586 - DNA, 25 bp, Homo sapien
cacactgcaggccacatgtagagaa

SEQ ID NO: 282587 - DNA, 25 bp, Homo sapien
tttcaaggaaactctgtgcttcctg

SEQ ID NO: 282588 - DNA, 25 bp, Homo sapien
tgtgcttcctgatactcctttccta

SEQ ID NO: 282589 - DNA, 25 bp, Homo sapien
ttccctttgattgaagccttcctta

SEQ ID NO: 282590 - DNA, 25 bp, Homo sapien
agccttccttactgttatcttgaca

SEQ ID NO: 282591 - DNA, 25 bp, Homo sapien
gaatatcagctgtggaacttataga

SEQ ID NO: 282592 - DNA, 25 bp, Homo sapien
ttttcccgttattagtggtaatgca

SEQ ID NO: 282593 - DNA, 25 bp, Homo sapien
gtggtaatgcatctgaaaattttga

SEQ ID NO: 282594 - DNA, 25 bp, Homo sapien
taatcaatgcccaactgaatggaga

SEQ ID NO: 282595 - DNA, 25 bp, Homo sapien
ggagaaaacctacactttttgcatt

SEQ ID NO: 282596 - DNA, 25 bp, Homo sapien
acactttttgcattgttaagcacag

SEQ ID NO: 282597 - DNA, 25 bp, Homo sapien
aattttggctctttggcattgttct

SEQ ID NO: 282598 - DNA, 25 bp, Homo sapien
ggctctttggcattgttctagaatt

SEQ ID NO: 282599 - DNA, 25 bp, Homo sapien
attttaattctagggatattgctct

SEQ ID NO: 282600 - DNA, 25 bp, Homo sapien
gggatattgctctaaatgtgcttct

SEQ ID NO: 282601 - DNA, 25 bp, Homo sapien
atgtgcttcttatcacttttgactc

SEQ ID NO: 282602 - DNA, 25 bp, Homo sapien
atatatacacttgtgaactgttgtt

SEQ ID NO: 282603 - DNA, 25 bp, Homo sapien
accatggtgcgaatcctgacccaag

SEQ ID NO: 282604 - DNA, 25 bp, Homo sapien
tggtgcgaatcctgacccaaggcct

SEQ ID NO: 282605 - DNA, 25 bp, Homo sapien
ggcctcctgtctcccttcaaaggga

SEQ ID NO: 282606 - DNA, 25 bp, Homo sapien
ttgggggatgagtttgccagactcc

SEQ ID NO: 282607 - DNA, 25 bp, Homo sapien
tccccgtgctggtttctttgttact

SEQ ID NO: 282608 - DNA, 25 bp, Homo sapien
ccgtgctggtttctttgttactatt

SEQ ID NO: 282609 - DNA, 25 bp, Homo sapien
gctggtttctttgttactatttgtt

SEQ ID NO: 282610 - DNA, 25 bp, Homo sapien
tgtgaacttgaatgaacactgctca

SEQ ID NO: 282611 - DNA, 25 bp, Homo sapien
gaatgaacactgctcaaactttctg

SEQ ID NO: 282612 - DNA, 25 bp, Homo sapien
gaacactgctcaaactttctgctat

SEQ ID NO: 282613 - DNA, 25 bp, Homo sapien
acactgctcaaactttctgctattg

SEQ ID NO: 282614 - DNA, 25 bp, Homo sapien
acctcttgacttctaaagacgcaaa

SEQ ID NO: 282615 - DNA, 25 bp, Homo sapien
tcttgacttctaaagacgcaaaagt

SEQ ID NO: 282616 - DNA, 25 bp, Homo sapien
cttctaaagacgcaaaagtggccaa

SEQ ID NO: 282617 - DNA, 25 bp, Homo sapien
aaaagtggccaaaagtgcaatacag

SEQ ID NO: 282618 - DNA, 25 bp, Homo sapien
gtggccaaaagtgcaatacagtatt

SEQ ID NO: 282619 - DNA, 25 bp, Homo sapien
acagtattgtgtttatttacatcta

SEQ ID NO: 282620 - DNA, 25 bp, Homo sapien
taaatgcatgtgtatctgtaaatac

SEQ ID NO: 282621 - DNA, 25 bp, Homo sapien
aaatacaaagtgattcgtgactcat

SEQ ID NO: 282622 - DNA, 25 bp, Homo sapien
atacaaagtgattcgtgactcattg

SEQ ID NO: 282623 - DNA, 25 bp, Homo sapien
caaagtgattcgtgactcattgtct

SEQ ID NO: 282624 - DNA, 25 bp, Homo sapien
aaagtgattcgtgactcattgtctc

SEQ ID NO: 282625 - DNA, 25 bp, Homo sapien
aagtcaaactgtcattaaaaataat

SEQ ID NO: 282626 - DNA, 25 bp, Homo sapien
agtcaaactgtcattaaaaataatt

SEQ ID NO: 282627 - DNA, 25 bp, Homo sapien
ttaaaaataattctggctgagcacg

SEQ ID NO: 282628 - DNA, 25 bp, Homo sapien
aaaaataattctggctgagcacggt

SEQ ID NO: 282629 - DNA, 25 bp, Homo sapien
aaaataattctggctgagcacggtg

SEQ ID NO: 282630 - DNA, 25 bp, Homo sapien
aaataattctggctgagcacggtgg

SEQ ID NO: 282631 - DNA, 25 bp, Homo sapien
aataattctggctgagcacggtggc

SEQ ID NO: 282632 - DNA, 25 bp, Homo sapien
tcagcaatttgggaagtggaggtgg

SEQ ID NO: 282633 - DNA, 25 bp, Homo sapien
gcaatttgggaagtggaggtgggcg

SEQ ID NO: 282634 - DNA, 25 bp, Homo sapien
tgagccgagatcaagatcacgccac

SEQ ID NO: 282635 - DNA, 25 bp, Homo sapien
gagccgagatcaagatcacgccact

SEQ ID NO: 282636 - DNA, 25 bp, Homo sapien
ttgagatgggccgtgagtgactaaa

SEQ ID NO: 282637 - DNA, 25 bp, Homo sapien
tgagatgggccgtgagtgactaaag

SEQ ID NO: 282638 - DNA, 25 bp, Homo sapien
gagatgggccgtgagtgactaaagt

SEQ ID NO: 282639 - DNA, 25 bp, Homo sapien
gatgggccgtgagtgactaaagtaa

SEQ ID NO: 282640 - DNA, 25 bp, Homo sapien
gggccgtgagtgactaaagtaatgc

SEQ ID NO: 282641 - DNA, 25 bp, Homo sapien
gccgtgagtgactaaagtaatgcat

SEQ ID NO: 282642 - DNA, 25 bp, Homo sapien
cgtgagtgactaaagtaatgcatta

SEQ ID NO: 282643 - DNA, 25 bp, Homo sapien
attaatggttgaatggctggccacc

SEQ ID NO: 282644 - DNA, 25 bp, Homo sapien
taatggttgaatggctggccaccgt

SEQ ID NO: 282645 - DNA, 25 bp, Homo sapien
ggttgaatggctggccaccgtgcct

SEQ ID NO: 282646 - DNA, 25 bp, Homo sapien
tgaatggctggccaccgtgcctcat

SEQ ID NO: 282647 - DNA, 25 bp, Homo sapien
aagtttcaggtactcttgacactcc

SEQ ID NO: 282648 - DNA, 25 bp, Homo sapien
ggtactcttgacactcctgagaaga

SEQ ID NO: 282649 - DNA, 25 bp, Homo sapien
acaccagtttgtacaccaacatttt

SEQ ID NO: 282650 - DNA, 25 bp, Homo sapien
caacatttttggagaggcgaaaatc

SEQ ID NO: 282651 - DNA, 25 bp, Homo sapien
ggcgaaaatctcaagtggctgaact

SEQ ID NO: 282652 - DNA, 25 bp, Homo sapien
tcaagtggctgaactgaatgatgat

SEQ ID NO: 282653 - DNA, 25 bp, Homo sapien
tagttttcaaacagcccatatcctg

SEQ ID NO: 282654 - DNA, 25 bp, Homo sapien
agcccatatcctgtgtaaaagaaga

SEQ ID NO: 282655 - DNA, 25 bp, Homo sapien
agagactcaaacacctacacattca

SEQ ID NO: 282656 - DNA, 25 bp, Homo sapien
ctcaaacacctacacattcacggaa

SEQ ID NO: 282657 - DNA, 25 bp, Homo sapien
agacgaagaagcagcaatcagtgat

SEQ ID NO: 282658 - DNA, 25 bp, Homo sapien
agatgacccgtctctgaccaccaag

SEQ ID NO: 282659 - DNA, 25 bp, Homo sapien
tgaccaccaagcacctagaaggcac

SEQ ID NO: 282660 - DNA, 25 bp, Homo sapien
aagcacctagaaggcactttcgcag

SEQ ID NO: 282661 - DNA, 25 bp, Homo sapien
tagaaggcactttcgcaggagcaag

SEQ ID NO: 282662 - DNA, 25 bp, Homo sapien
aggcactttcgcaggagcaaggcag

SEQ ID NO: 282663 - DNA, 25 bp, Homo sapien
gttcccgccgagcatggtgataatg

SEQ ID NO: 282664 - DNA, 25 bp, Homo sapien
tgccccttgtgatctggacagaccc

SEQ ID NO: 282665 - DNA, 25 bp, Homo sapien
acagaccctggcaggcctcgagttc

SEQ ID NO: 282666 - DNA, 25 bp, Homo sapien
gcaggcctcgagttccctggaggtt

SEQ ID NO: 282667 - DNA, 25 bp, Homo sapien
ttccctggaggttgcgccttagcga

SEQ ID NO: 282668 - DNA, 25 bp, Homo sapien
tagcgacagatgacccgtctctgac

SEQ ID NO: 282669 - DNA, 25 bp, Homo sapien
ggaccagggactacaaactcacctt

SEQ ID NO: 282670 - DNA, 25 bp, Homo sapien
aagatgcagctcagctccagtggcc

SEQ ID NO: 282671 - DNA, 25 bp, Homo sapien
cagtggccacaccaagacggtttaa

SEQ ID NO: 282672 - DNA, 25 bp, Homo sapien
ggactacaaactcaccttcagggct

SEQ ID NO: 282673 - DNA, 25 bp, Homo sapien
gtttgagttccttgaacagcagaag

SEQ ID NO: 282674 - DNA, 25 bp, Homo sapien
cttgaacagcagaaggtgcttggat

SEQ ID NO: 282675 - DNA, 25 bp, Homo sapien
gtgcttggatttagggaggctctaa

SEQ ID NO: 282676 - DNA, 25 bp, Homo sapien
gggaggctctaattgcctggacgaa

SEQ ID NO: 282677 - DNA, 25 bp, Homo sapien
tctaattgcctggacgaagaacccc

SEQ ID NO: 282678 - DNA, 25 bp, Homo sapien
ttcagggctcctaagctgctgcgga

SEQ ID NO: 282679 - DNA, 25 bp, Homo sapien
ggaggagactagaatattctgagac

SEQ ID NO: 282680 - DNA, 25 bp, Homo sapien
agaccaccaatcttgtttgtccatc

SEQ ID NO: 282681 - DNA, 25 bp, Homo sapien
gtttgtccatctacatggtttgtcg

SEQ ID NO: 282682 - DNA, 25 bp, Homo sapien
gggacatttaactcatggaggtgct

SEQ ID NO: 282683 - DNA, 25 bp, Homo sapien
actcatggaggtgctttagatttca

SEQ ID NO: 282684 - DNA, 25 bp, Homo sapien
ggtgctttagatttcaacatcagat

SEQ ID NO: 282685 - DNA, 25 bp, Homo sapien
gatggttgaagctggaagtttaatt

SEQ ID NO: 282686 - DNA, 25 bp, Homo sapien
tgagaaggcagttccagttttagca

SEQ ID NO: 282687 - DNA, 25 bp, Homo sapien
tccagttttagcacagatttgttta

SEQ ID NO: 282688 - DNA, 25 bp, Homo sapien
aaatgactcatttttaccaataatg

SEQ ID NO: 282689 - DNA, 25 bp, Homo sapien
aaattagttttggttgtgctagcat

SEQ ID NO: 282690 - DNA, 25 bp, Homo sapien
gctagcatgaattaataaccaccat

SEQ ID NO: 282691 - DNA, 25 bp, Homo sapien
cctcccttaggtggcaacaaagtcg

SEQ ID NO: 282692 - DNA, 25 bp, Homo sapien
tcccttaggtggcaacaaagtcgtg

SEQ ID NO: 282693 - DNA, 25 bp, Homo sapien
ccttaggtggcaacaaagtcgtgca

SEQ ID NO: 282694 - DNA, 25 bp, Homo sapien
ttaggtggcaacaaagtcgtgcagt

SEQ ID NO: 282695 - DNA, 25 bp, Homo sapien
caacaaagtcgtgcagtgggagccg

SEQ ID NO: 282696 - DNA, 25 bp, Homo sapien
gggagtggccagggcgggactccaa

SEQ ID NO: 282697 - DNA, 25 bp, Homo sapien
ggactccaagaactgcccgggggca

SEQ ID NO: 282698 - DNA, 25 bp, Homo sapien
tgtgccgtccccaaaaccagccgag

SEQ ID NO: 282699 - DNA, 25 bp, Homo sapien
agggcagccggctctgaagtatgcg

SEQ ID NO: 282700 - DNA, 25 bp, Homo sapien
aaaaccagccgagacagctggcccc

SEQ ID NO: 282701 - DNA, 25 bp, Homo sapien
cttccacccattgggcaggccgcac

SEQ ID NO: 282702 - DNA, 25 bp, Homo sapien
ggccagggagagaatgatatggttt

SEQ ID NO: 282703 - DNA, 25 bp, Homo sapien
aaatatcaccttaaattgtagctcc

SEQ ID NO: 282704 - DNA, 25 bp, Homo sapien
atatcaccttaaattgtagctccca

SEQ ID NO: 282705 - DNA, 25 bp, Homo sapien
tatcaccttaaattgtagctcccat

SEQ ID NO: 282706 - DNA, 25 bp, Homo sapien
tagctcccataattgtgggagggac

SEQ ID NO: 282707 - DNA, 25 bp, Homo sapien
agctcccataattgtgggagggacc

SEQ ID NO: 282708 - DNA, 25 bp, Homo sapien
gctcccataattgtgggagggacct

SEQ ID NO: 282709 - DNA, 25 bp, Homo sapien
gtttctcccatactgttctggtggt

SEQ ID NO: 282710 - DNA, 25 bp, Homo sapien
tttctcccatactgttctggtggta

SEQ ID NO: 282711 - DNA, 25 bp, Homo sapien
ttctcccatactgttctggtggtag

SEQ ID NO: 282712 - DNA, 25 bp, Homo sapien
gtttccccttttgcttggctctcat

SEQ ID NO: 282713 - DNA, 25 bp, Homo sapien
aatattactttgtcactggtgtcag

SEQ ID NO: 282714 - DNA, 25 bp, Homo sapien
gagaaacctctgtcatcagcagatg

SEQ ID NO: 282715 - DNA, 25 bp, Homo sapien
catcagcagatgtcctaagagtata

SEQ ID NO: 282716 - DNA, 25 bp, Homo sapien
ccaaaatttgttctgctctgatatc

SEQ ID NO: 282717 - DNA, 25 bp, Homo sapien
tgattccacaattagattaggtctg

SEQ ID NO: 282718 - DNA, 25 bp, Homo sapien
aggtctgttgaagataacttattct

SEQ ID NO: 282719 - DNA, 25 bp, Homo sapien
agtttgagagttgttactccctgcc

SEQ ID NO: 282720 - DNA, 25 bp, Homo sapien
tgagagttgttactccctgcctcaa

SEQ ID NO: 282721 - DNA, 25 bp, Homo sapien
cctcaactccatggtattccaaaat

SEQ ID NO: 282722 - DNA, 25 bp, Homo sapien
ttccaaaatgtttttgtgggcactt

SEQ ID NO: 282723 - DNA, 25 bp, Homo sapien
gtgggcactttaatacttgtagttt

SEQ ID NO: 282724 - DNA, 25 bp, Homo sapien
aacatacaccccaccaggagtactg

SEQ ID NO: 282725 - DNA, 25 bp, Homo sapien
atacaccccaccaggagtactgatc

SEQ ID NO: 282726 - DNA, 25 bp, Homo sapien
aggagtactgatcctgcctcccttc

SEQ ID NO: 282727 - DNA, 25 bp, Homo sapien
ggaagcattcgcctttgagcacttg

SEQ ID NO: 282728 - DNA, 25 bp, Homo sapien
agcattcgcctttgagcacttgttt

SEQ ID NO: 282729 - DNA, 25 bp, Homo sapien
ttcgcctttgagcacttgtttgcaa

SEQ ID NO: 282730 - DNA, 25 bp, Homo sapien
gcctttgagcacttgtttgcaaatc

SEQ ID NO: 282731 - DNA, 25 bp, Homo sapien
ttgagcacttgtttgcaaatctggg

SEQ ID NO: 282732 - DNA, 25 bp, Homo sapien
ttctttccctgcagtctattcactc

SEQ ID NO: 282733 - DNA, 25 bp, Homo sapien
agtgcttccagtggcccaaaaatgc

SEQ ID NO: 282734 - DNA, 25 bp, Homo sapien
tccagtggcccaaaaatgctttttg

SEQ ID NO: 282735 - DNA, 25 bp, Homo sapien
gagccaggtgccgagaactaggacc

SEQ ID NO: 282736 - DNA, 25 bp, Homo sapien
gagaactaggacctcgtccccttct

SEQ ID NO: 282737 - DNA, 25 bp, Homo sapien
tgatccatctcgtctctgttctcct

SEQ ID NO: 282738 - DNA, 25 bp, Homo sapien
gtacccacggaaaaagtcgaagctg

SEQ ID NO: 282739 - DNA, 25 bp, Homo sapien
aaagtcgaagctgtccccggagagt

SEQ ID NO: 282740 - DNA, 25 bp, Homo sapien
aggccttcacgaagcggtggcggaa

SEQ ID NO: 282741 - DNA, 25 bp, Homo sapien
aggagccgaagttctctgatcggag

SEQ ID NO: 282742 - DNA, 25 bp, Homo sapien
gttctctgatcggaggcgtgagcaa

SEQ ID NO: 282743 - DNA, 25 bp, Homo sapien
gagcaagtggcatctccggaaagag

SEQ ID NO: 282744 - DNA, 25 bp, Homo sapien
aagagccgaaacacggactcgagct

SEQ ID NO: 282745 - DNA, 25 bp, Homo sapien
acggactcgagcttaatcccaggag

SEQ ID NO: 282746 - DNA, 25 bp, Homo sapien
ggagctttggtctattagtttgtga

SEQ ID NO: 282747 - DNA, 25 bp, Homo sapien
tattcaaaggccaaaacactactca

SEQ ID NO: 282748 - DNA, 25 bp, Homo sapien
actactcagacactttcctgggaag

SEQ ID NO: 282749 - DNA, 25 bp, Homo sapien
tcctgggaagagcaactaaaaatgt

SEQ ID NO: 282750 - DNA, 25 bp, Homo sapien
gaaaagtatgtatctcacattgaac

SEQ ID NO: 282751 - DNA, 25 bp, Homo sapien
attgaactaaaatccactgtctcat

SEQ ID NO: 282752 - DNA, 25 bp, Homo sapien
ccactgtctcataagttcatggaat

SEQ ID NO: 282753 - DNA, 25 bp, Homo sapien
atggaatgaaatggctttctgcctc

SEQ ID NO: 282754 - DNA, 25 bp, Homo sapien
gctttctgcctccattttaatcatg

SEQ ID NO: 282755 - DNA, 25 bp, Homo sapien
tagatggctttgagtggattttcac

SEQ ID NO: 282756 - DNA, 25 bp, Homo sapien
ggattttcacaatggctcaagacta

SEQ ID NO: 282757 - DNA, 25 bp, Homo sapien
tacttcaccatccatgacagcgagt

SEQ ID NO: 282758 - DNA, 25 bp, Homo sapien
tcaccatccatgacagcgagttcaa

SEQ ID NO: 282759 - DNA, 25 bp, Homo sapien
gagttcaaggagttcaccacacgca

SEQ ID NO: 282760 - DNA, 25 bp, Homo sapien
aaggagttcaccacacgcacgcagg

SEQ ID NO: 282761 - DNA, 25 bp, Homo sapien
accaaacgtggtcctgggagtcaca

SEQ ID NO: 282762 - DNA, 25 bp, Homo sapien
caaacgtggtcctgggagtcacaaa

SEQ ID NO: 282763 - DNA, 25 bp, Homo sapien
tgggagtcacaaaccctttctttat

SEQ ID NO: 282764 - DNA, 25 bp, Homo sapien
gagtcacaaaccctttctttatcaa

SEQ ID NO: 282765 - DNA, 25 bp, Homo sapien
ctttatcaaaacactccagcactgg

SEQ ID NO: 282766 - DNA, 25 bp, Homo sapien
ttatcaaaacactccagcactggcc

SEQ ID NO: 282767 - DNA, 25 bp, Homo sapien
aagccaggcctctacaccgcttaca

SEQ ID NO: 282768 - DNA, 25 bp, Homo sapien
gccgggccggttgctggcatcttaa

SEQ ID NO: 282769 - DNA, 25 bp, Homo sapien
cgggccggttgctggcatcttaatg

SEQ ID NO: 282770 - DNA, 25 bp, Homo sapien
gccggttgctggcatcttaatgttc

SEQ ID NO: 282771 - DNA, 25 bp, Homo sapien
ccggttgctggcatcttaatgttct

SEQ ID NO: 282772 - DNA, 25 bp, Homo sapien
ggttgctggcatcttaatgttctgt

SEQ ID NO: 282773 - DNA, 25 bp, Homo sapien
gttgctggcatcttaatgttctgta

SEQ ID NO: 282774 - DNA, 25 bp, Homo sapien
ttgctggcatcttaatgttctgtag

SEQ ID NO: 282775 - DNA, 25 bp, Homo sapien
gctggcatcttaatgttctgtaggt

SEQ ID NO: 282776 - DNA, 25 bp, Homo sapien
ggcatcttaatgttctgtaggtgga

SEQ ID NO: 282777 - DNA, 25 bp, Homo sapien
catcttaatgttctgtaggtggaat

SEQ ID NO: 282778 - DNA, 25 bp, Homo sapien
cttaatgttctgtaggtggaatatt

SEQ ID NO: 282779 - DNA, 25 bp, Homo sapien
cgagcccctccgggacgaggacgat

SEQ ID NO: 282780 - DNA, 25 bp, Homo sapien
gagcccctccgggacgaggacgatg

SEQ ID NO: 282781 - DNA, 25 bp, Homo sapien
gacgaggacgatgacctcctgcagt

SEQ ID NO: 282782 - DNA, 25 bp, Homo sapien
agcctgcttgaagcgggcactgagg

SEQ ID NO: 282783 - DNA, 25 bp, Homo sapien
gcctgcttgaagcgggcactgaggc

SEQ ID NO: 282784 - DNA, 25 bp, Homo sapien
cctgcttgaagcgggcactgaggcg

SEQ ID NO: 282785 - DNA, 25 bp, Homo sapien
ctgcttgaagcgggcactgaggcgg

SEQ ID NO: 282786 - DNA, 25 bp, Homo sapien
tgcttgaagcgggcactgaggcgga

SEQ ID NO: 282787 - DNA, 25 bp, Homo sapien
gccctgaccaacacccggcccggtg

SEQ ID NO: 282788 - DNA, 25 bp, Homo sapien
ggaatgctgaggcttttctgtctga

SEQ ID NO: 282789 - DNA, 25 bp, Homo sapien
aatgctgaggcttttctgtctgaaa

SEQ ID NO: 282790 - DNA, 25 bp, Homo sapien
ctgtctgaaatgctgaatagactct

SEQ ID NO: 282791 - DNA, 25 bp, Homo sapien
gctgaatagactctagcacacgcaa

SEQ ID NO: 282792 - DNA, 25 bp, Homo sapien
gaatagactctagcacacgcaaaac

SEQ ID NO: 282793 - DNA, 25 bp, Homo sapien
agactctagcacacgcaaaacagcc

SEQ ID NO: 282794 - DNA, 25 bp, Homo sapien
cagcgagctgcaggattcttccggg

SEQ ID NO: 282795 - DNA, 25 bp, Homo sapien
gagctgcaggattcttccgggcttt

SEQ ID NO: 282796 - DNA, 25 bp, Homo sapien
gctgcaggattcttccgggctttta

SEQ ID NO: 282797 - DNA, 25 bp, Homo sapien
tcttccgggcttttaacagtggtct

SEQ ID NO: 282798 - DNA, 25 bp, Homo sapien
tccgggcttttaacagtggtcttgt

SEQ ID NO: 282799 - DNA, 25 bp, Homo sapien
aaaggcaacaccagtgtgctgccct

SEQ ID NO: 282800 - DNA, 25 bp, Homo sapien
catgtttccctatcatttttgtcaa

SEQ ID NO: 282801 - DNA, 25 bp, Homo sapien
gtggtccgggcaataaggcctctga

SEQ ID NO: 282802 - DNA, 25 bp, Homo sapien
aataaggcctctgaccatatttgcc

SEQ ID NO: 282803 - DNA, 25 bp, Homo sapien
ttctccttcaagctatggctgtgaa

SEQ ID NO: 282804 - DNA, 25 bp, Homo sapien
ataatctcctgtattcacttgtgcc

SEQ ID NO: 282805 - DNA, 25 bp, Homo sapien
gtattcacttgtgcccattactggt

SEQ ID NO: 282806 - DNA, 25 bp, Homo sapien
gcccattactggttttcatcaagat

SEQ ID NO: 282807 - DNA, 25 bp, Homo sapien
caagatacttgggtgtaattcctgg

SEQ ID NO: 282808 - DNA, 25 bp, Homo sapien
gtgatatctcttccctaataagcta

SEQ ID NO: 282809 - DNA, 25 bp, Homo sapien
atcttactatggttcaaaggcaaca

SEQ ID NO: 282810 - DNA, 25 bp, Homo sapien
gctgcgacttccgtccctacttcac

SEQ ID NO: 282811 - DNA, 25 bp, Homo sapien
ctacttcaccatccatgacagcgag

SEQ ID NO: 282812 - DNA, 25 bp, Homo sapien
tacttcaccatccatgacagcgagt

SEQ ID NO: 282813 - DNA, 25 bp, Homo sapien
acttcaccatccatgacagcgagtt

SEQ ID NO: 282814 - DNA, 25 bp, Homo sapien
cttcaccatccatgacagcgagttc

SEQ ID NO: 282815 - DNA, 25 bp, Homo sapien
ttcaccatccatgacagcgagttca

SEQ ID NO: 282816 - DNA, 25 bp, Homo sapien
tcaccatccatgacagcgagttcaa

SEQ ID NO: 282817 - DNA, 25 bp, Homo sapien
gagttcaaggagttcaccacacgca

SEQ ID NO: 282818 - DNA, 25 bp, Homo sapien
aagccaggcctctacaccgcttaca

SEQ ID NO: 282819 - DNA, 25 bp, Homo sapien
caggcctctacaccgcttacacggc

SEQ ID NO: 282820 - DNA, 25 bp, Homo sapien
acctccaccgcgacaaggcgctgct

SEQ ID NO: 282821 - DNA, 25 bp, Homo sapien
aaatactaaagatcctcaggtccag

SEQ ID NO: 282822 - DNA, 25 bp, Homo sapien
atcctcaggtccagaattccagcat

SEQ ID NO: 282823 - DNA, 25 bp, Homo sapien
gatccattgtatcagtacctcacaa

SEQ ID NO: 282824 - DNA, 25 bp, Homo sapien
gtacctcacaatcagagttggcaaa

SEQ ID NO: 282825 - DNA, 25 bp, Homo sapien
gagtgattcaagcagtgcacccggt

SEQ ID NO: 282826 - DNA, 25 bp, Homo sapien
gcagtgcacccggtggaagctgaaa

SEQ ID NO: 282827 - DNA, 25 bp, Homo sapien
ggaagctgaaatccatctgtgaatg

SEQ ID NO: 282828 - DNA, 25 bp, Homo sapien
aatatgctgactatatcctggaagc

SEQ ID NO: 282829 - DNA, 25 bp, Homo sapien
gaagcatttttataccatcttgaaa

SEQ ID NO: 282830 - DNA, 25 bp, Homo sapien
ggcttttgccagttaatccagctgt

SEQ ID NO: 282831 - DNA, 25 bp, Homo sapien
gttaatccagctgtctttcaagaat

SEQ ID NO: 282832 - DNA, 25 bp, Homo sapien
tctctctgggatttaccagcttaag

SEQ ID NO: 282833 - DNA, 25 bp, Homo sapien
tttaccagcttaagagtccaactca

SEQ ID NO: 282834 - DNA, 25 bp, Homo sapien
aactcacttccagtgcccaaaaggg

SEQ ID NO: 282835 - DNA, 25 bp, Homo sapien
aaagggcacccaccagaaattccag

SEQ ID NO: 282836 - DNA, 25 bp, Homo sapien
gaaattccagtaaatcctcatttga

SEQ ID NO: 282837 - DNA, 25 bp, Homo sapien
ttgaggaagctctcccttgtttact

SEQ ID NO: 282838 - DNA, 25 bp, Homo sapien
ttgtttactctgttaccacattggg

SEQ ID NO: 282839 - DNA, 25 bp, Homo sapien
ttttcttcttcctggtagactaggt

SEQ ID NO: 282840 - DNA, 25 bp, Homo sapien
gtagactaggtttatttatctgagc

SEQ ID NO: 282841 - DNA, 25 bp, Homo sapien
atctgagcaataacttctatgttgg

SEQ ID NO: 282842 - DNA, 25 bp, Homo sapien
acttctatgttggtttcagtggctg

SEQ ID NO: 282843 - DNA, 25 bp, Homo sapien
ctgacccccaggagggtggtattag

SEQ ID NO: 282844 - DNA, 25 bp, Homo sapien
tgactaggcttaggtgagatcgtga

SEQ ID NO: 282845 - DNA, 25 bp, Homo sapien
gggctcgccgatgagatcgagtcct

SEQ ID NO: 282846 - DNA, 25 bp, Homo sapien
gctcgccgatgagatcgagtcctta

SEQ ID NO: 282847 - DNA, 25 bp, Homo sapien
tcgccgatgagatcgagtccttata

SEQ ID NO: 282848 - DNA, 25 bp, Homo sapien
gccgatgagatcgagtccttataag

SEQ ID NO: 282849 - DNA, 25 bp, Homo sapien
aggaaggaactagagcgaggtcact

SEQ ID NO: 282850 - DNA, 25 bp, Homo sapien
aggaactagagcgaggtcactttgt

SEQ ID NO: 282851 - DNA, 25 bp, Homo sapien
actagagcgaggtcactttgtgctg

SEQ ID NO: 282852 - DNA, 25 bp, Homo sapien
actttgtgctgtgtgagcatacaag

SEQ ID NO: 282853 - DNA, 25 bp, Homo sapien
gtgtgagcatacaagaaaactgcca

SEQ ID NO: 282854 - DNA, 25 bp, Homo sapien
gacagaacaaataactctggagaac

SEQ ID NO: 282855 - DNA, 25 bp, Homo sapien
aaataactctggagaaccaggtgca

SEQ ID NO: 282856 - DNA, 25 bp, Homo sapien
accaaaccacagagtcctgctcaga

SEQ ID NO: 282857 - DNA, 25 bp, Homo sapien
agtcctgctcagaatgccacctcgt

SEQ ID NO: 282858 - DNA, 25 bp, Homo sapien
ccaagacagttctcaggatacgctg

SEQ ID NO: 282859 - DNA, 25 bp, Homo sapien
aagacagttctcaggatacgctgac

SEQ ID NO: 282860 - DNA, 25 bp, Homo sapien
gacagttctcaggatacgctgacag

SEQ ID NO: 282861 - DNA, 25 bp, Homo sapien
acagttctcaggatacgctgacaga

SEQ ID NO: 282862 - DNA, 25 bp, Homo sapien
cagttctcaggatacgctgacagaa

SEQ ID NO: 282863 - DNA, 25 bp, Homo sapien
gttctcaggatacgctgacagaaca

SEQ ID NO: 282864 - DNA, 25 bp, Homo sapien
ctcaggatacgctgacagaacaaat

SEQ ID NO: 282865 - DNA, 25 bp, Homo sapien
tgatcatcctctgtcttgtatgtct

SEQ ID NO: 282866 - DNA, 25 bp, Homo sapien
tcctctgtcttgtatgtcttgtttg

SEQ ID NO: 282867 - DNA, 25 bp, Homo sapien
ctgtcttgtatgtcttgtttggaaa

SEQ ID NO: 282868 - DNA, 25 bp, Homo sapien
ggaaagggttggaaactcttgacat

SEQ ID NO: 282869 - DNA, 25 bp, Homo sapien
gttggaaactcttgacatgaggaat

SEQ ID NO: 282870 - DNA, 25 bp, Homo sapien
ctcttgacatgaggaatggttgtta

SEQ ID NO: 282871 - DNA, 25 bp, Homo sapien
gcaggttttgaggaaaaccttctag

SEQ ID NO: 282872 - DNA, 25 bp, Homo sapien
gaaaaccttctagaagagtcccagt

SEQ ID NO: 282873 - DNA, 25 bp, Homo sapien
aaaccttctagaagagtcccagtat

SEQ ID NO: 282874 - DNA, 25 bp, Homo sapien
ggagcaagatgccactgactaccgc

SEQ ID NO: 282875 - DNA, 25 bp, Homo sapien
gaagcctgcggaaactcctggctca

SEQ ID NO: 282876 - DNA, 25 bp, Homo sapien
aggcacttaagcaagttataagcta

SEQ ID NO: 282877 - DNA, 25 bp, Homo sapien
ataagctactttcctaactacacaa

SEQ ID NO: 282878 - DNA, 25 bp, Homo sapien
taagctactttcctaactacacaag

SEQ ID NO: 282879 - DNA, 25 bp, Homo sapien
aagctactttcctaactacacaagt

SEQ ID NO: 282880 - DNA, 25 bp, Homo sapien
gctactttcctaactacacaagtgg

SEQ ID NO: 282881 - DNA, 25 bp, Homo sapien
tactttcctaactacacaagtggaa

SEQ ID NO: 282882 - DNA, 25 bp, Homo sapien
tacacaagtggaatcttaagctgag

SEQ ID NO: 282883 - DNA, 25 bp, Homo sapien
caagtggaatcttaagctgaggttc

SEQ ID NO: 282884 - DNA, 25 bp, Homo sapien
gtggaatcttaagctgaggttccca

SEQ ID NO: 282885 - DNA, 25 bp, Homo sapien
ttcccaggagttgactggagccaga

SEQ ID NO: 282886 - DNA, 25 bp, Homo sapien
ccaggagttgactggagccagagaa

SEQ ID NO: 282887 - DNA, 25 bp, Homo sapien
atttcctccccaagtgaacatcttc

SEQ ID NO: 282888 - DNA, 25 bp, Homo sapien
gtgaacatcttctaatgctgcatca

SEQ ID NO: 282889 - DNA, 25 bp, Homo sapien
taatgctgcatcaaagctgccctga

SEQ ID NO: 282890 - DNA, 25 bp, Homo sapien
tgccctgaagctgcactgaacttct

SEQ ID NO: 282891 - DNA, 25 bp, Homo sapien
gcactgaacttctcttgttctcttt

SEQ ID NO: 282892 - DNA, 25 bp, Homo sapien
tctttatctgtgttgagctttttaa

SEQ ID NO: 282893 - DNA, 25 bp, Homo sapien
tattgaggcatataacgtctcttat

SEQ ID NO: 282894 - DNA, 25 bp, Homo sapien
gaaatgtagcatagtgtggaatctt

SEQ ID NO: 282895 - DNA, 25 bp, Homo sapien
gtggaatcttaatttctctccagtt

SEQ ID NO: 282896 - DNA, 25 bp, Homo sapien
ttctctccagtttcaaacactccag

SEQ ID NO: 282897 - DNA, 25 bp, Homo sapien
aacactccagaggaatgcaatagat

SEQ ID NO: 282898 - DNA, 25 bp, Homo sapien
attcttacccgaaggctgccgagct

SEQ ID NO: 282899 - DNA, 25 bp, Homo sapien
tacccgaaggctgccgagctacagg

SEQ ID NO: 282900 - DNA, 25 bp, Homo sapien
gtcggtccgggcgtctgctgtaatc

SEQ ID NO: 282901 - DNA, 25 bp, Homo sapien
ccgggcgtctgctgtaatccactag

SEQ ID NO: 282902 - DNA, 25 bp, Homo sapien
ggctgcgctcactctcggacgcaga

SEQ ID NO: 282903 - DNA, 25 bp, Homo sapien
tcggacgcagagacccgctcatgtt

SEQ ID NO: 282904 - DNA, 25 bp, Homo sapien
gcagagacccgctcatgttggtgaa

SEQ ID NO: 282905 - DNA, 25 bp, Homo sapien
gagacccgctcatgttggtgaagaa

SEQ ID NO: 282906 - DNA, 25 bp, Homo sapien
tgttggtgaagaagccgcgccagaa

SEQ ID NO: 282907 - DNA, 25 bp, Homo sapien
gcagtcacctcgagcaggccggctg

SEQ ID NO: 282908 - DNA, 25 bp, Homo sapien
caccagctccggaggtggcggcgat

SEQ ID NO: 282909 - DNA, 25 bp, Homo sapien
gaaagatagagactccagggccagc

SEQ ID NO: 282910 - DNA, 25 bp, Homo sapien
agcctggtgggtgctgaacctgccc

SEQ ID NO: 282911 - DNA, 25 bp, Homo sapien
ggcccctccaggtaggagcctggtt

SEQ ID NO: 282912 - DNA, 25 bp, Homo sapien
ggagcctggttggaaaagacagacc

SEQ ID NO: 282913 - DNA, 25 bp, Homo sapien
aagacagaccgacttcttctgggtt

SEQ ID NO: 282914 - DNA, 25 bp, Homo sapien
accgacttcttctgggttggctgga

SEQ ID NO: 282915 - DNA, 25 bp, Homo sapien
atgacatactcaaagccttgtcctt

SEQ ID NO: 282916 - DNA, 25 bp, Homo sapien
aaagccttgtccttccacttggatg

SEQ ID NO: 282917 - DNA, 25 bp, Homo sapien
ttccacttggatgcacctggtgaag

SEQ ID NO: 282918 - DNA, 25 bp, Homo sapien
gtgaagatgcgacagtcacctttgt

SEQ ID NO: 282919 - DNA, 25 bp, Homo sapien
gatgcgacagtcacctttgtctggg

SEQ ID NO: 282920 - DNA, 25 bp, Homo sapien
agcagttcacaaaactttacacatg

SEQ ID NO: 282921 - DNA, 25 bp, Homo sapien
gttcacaaaactttacacatgcaga

SEQ ID NO: 282922 - DNA, 25 bp, Homo sapien
acaaaactttacacatgcagacatc

SEQ ID NO: 282923 - DNA, 25 bp, Homo sapien
tttacacatgcagacatcaagccct

SEQ ID NO: 282924 - DNA, 25 bp, Homo sapien
gtgttcaggcgaaactgtgatctgc

SEQ ID NO: 282925 - DNA, 25 bp, Homo sapien
ttcaggcgaaactgtgatctgcggc

SEQ ID NO: 282926 - DNA, 25 bp, Homo sapien
gcgaaactgtgatctgcggcggcac

SEQ ID NO: 282927 - DNA, 25 bp, Homo sapien
aaactgtgatctgcggcggcacagc

SEQ ID NO: 282928 - DNA, 25 bp, Homo sapien
acaccccgcggcaggacttctagag

SEQ ID NO: 282929 - DNA, 25 bp, Homo sapien
gaagcccaggatctgtcccgtgccg

SEQ ID NO: 282930 - DNA, 25 bp, Homo sapien
agggggtcgcatccctagcccttca

SEQ ID NO: 282931 - DNA, 25 bp, Homo sapien
atgaaagctattctggccagccttg

SEQ ID NO: 282932 - DNA, 25 bp, Homo sapien
tctggccagccttgaatccatttaa

SEQ ID NO: 282933 - DNA, 25 bp, Homo sapien
gaatccatttaattttgcccacgag

SEQ ID NO: 282934 - DNA, 25 bp, Homo sapien
ttgcccacgagaacctttcatgaca

SEQ ID NO: 282935 - DNA, 25 bp, Homo sapien
caagacactagtttccccataaaag

SEQ ID NO: 282936 - DNA, 25 bp, Homo sapien
aatactcctgtattggcaagtggac

SEQ ID NO: 282937 - DNA, 25 bp, Homo sapien
tatcggatagcagccaccatgtgtg

SEQ ID NO: 282938 - DNA, 25 bp, Homo sapien
atgtgtgctgaccactcacgattca

SEQ ID NO: 282939 - DNA, 25 bp, Homo sapien
ggactggaccaacagacacaggcct

SEQ ID NO: 282940 - DNA, 25 bp, Homo sapien
cagccactgtcgctagggactgaag

SEQ ID NO: 282941 - DNA, 25 bp, Homo sapien
aggagagttcatggattcttacccc

SEQ ID NO: 282942 - DNA, 25 bp, Homo sapien
aatccacattctccatcgcttctca

SEQ ID NO: 282943 - DNA, 25 bp, Homo sapien
aaaaaccaggctctgccaggcgcag

SEQ ID NO: 282944 - DNA, 25 bp, Homo sapien
aaattagctgcgtgtagtagcatat

SEQ ID NO: 282945 - DNA, 25 bp, Homo sapien
agctgcgtgtagtagcatatgcctt

SEQ ID NO: 282946 - DNA, 25 bp, Homo sapien
ctgcgtgtagtagcatatgcctttc

SEQ ID NO: 282947 - DNA, 25 bp, Homo sapien
gcgtgtagtagcatatgcctttcaa

SEQ ID NO: 282948 - DNA, 25 bp, Homo sapien
tgtagtagcatatgcctttcaacgt

SEQ ID NO: 282949 - DNA, 25 bp, Homo sapien
agtagcatatgcctttcaacgtagc

SEQ ID NO: 282950 - DNA, 25 bp, Homo sapien
gcatatgcctttcaacgtagctact

SEQ ID NO: 282951 - DNA, 25 bp, Homo sapien
tatgcctttcaacgtagctactcag

SEQ ID NO: 282952 - DNA, 25 bp, Homo sapien
tgcctttcaacgtagctactcagga

SEQ ID NO: 282953 - DNA, 25 bp, Homo sapien
tctctttttacctttaacagacttg

SEQ ID NO: 282954 - DNA, 25 bp, Homo sapien
gacttgtttaatcttctcgatgtag

SEQ ID NO: 282955 - DNA, 25 bp, Homo sapien
gtttatgtaggtacttcacattgca

SEQ ID NO: 282956 - DNA, 25 bp, Homo sapien
cattgcaaacgccttttattctatt

SEQ ID NO: 282957 - DNA, 25 bp, Homo sapien
ttacaagctcagatgtctctgctct

SEQ ID NO: 282958 - DNA, 25 bp, Homo sapien
tctgctctcctgaatcttgggcatg

SEQ ID NO: 282959 - DNA, 25 bp, Homo sapien
gaatcttgggcatgcctttctgtaa

SEQ ID NO: 282960 - DNA, 25 bp, Homo sapien
gtaaccaaaaatccctgtaggcgtg

SEQ ID NO: 282961 - DNA, 25 bp, Homo sapien
tgtaggcgtgctagcaattccaggg

SEQ ID NO: 282962 - DNA, 25 bp, Homo sapien
tggtccgggtttggcagatttgatt

SEQ ID NO: 282963 - DNA, 25 bp, Homo sapien
aatgttattatgtcaaccagtgagg

SEQ ID NO: 282964 - DNA, 25 bp, Homo sapien
aaactgagctggatatggtagcaca

SEQ ID NO: 282965 - DNA, 25 bp, Homo sapien
ggaaggacaggcacttaagcaagtt

SEQ ID NO: 282966 - DNA, 25 bp, Homo sapien
aggcacttaagcaagttataagcta

SEQ ID NO: 282967 - DNA, 25 bp, Homo sapien
ataagctactttcctaactacacaa

SEQ ID NO: 282968 - DNA, 25 bp, Homo sapien
gctactttcctaactacacaagtgg

SEQ ID NO: 282969 - DNA, 25 bp, Homo sapien
tactttcctaactacacaagtggaa

SEQ ID NO: 282970 - DNA, 25 bp, Homo sapien
tacacaagtggaatcttaagctgag

SEQ ID NO: 282971 - DNA, 25 bp, Homo sapien
caagtggaatcttaagctgaggttc

SEQ ID NO: 282972 - DNA, 25 bp, Homo sapien
gtggaatcttaagctgaggttccca

SEQ ID NO: 282973 - DNA, 25 bp, Homo sapien
ttcccaggagttgactggagccaga

SEQ ID NO: 282974 - DNA, 25 bp, Homo sapien
ccaggagttgactggagccagagaa

SEQ ID NO: 282975 - DNA, 25 bp, Homo sapien
ttatttgtcctgaccttttcagtcc

SEQ ID NO: 282976 - DNA, 25 bp, Homo sapien
ttttcagtcctacagagacgcatct

SEQ ID NO: 282977 - DNA, 25 bp, Homo sapien
gagacgcatctgtggttcttttgta

SEQ ID NO: 282978 - DNA, 25 bp, Homo sapien
gtggttcttttgtacttgccataga

SEQ ID NO: 282979 - DNA, 25 bp, Homo sapien
gtacttgccatagatgtaacctaaa

SEQ ID NO: 282980 - DNA, 25 bp, Homo sapien
aaagttttggcatatttaggtcagc

SEQ ID NO: 282981 - DNA, 25 bp, Homo sapien
taggtcagcctagcggaactttttt

SEQ ID NO: 282982 - DNA, 25 bp, Homo sapien
gtgtctgcaaaattcctgagatcat

SEQ ID NO: 282983 - DNA, 25 bp, Homo sapien
aagctgttccttgtttctgatacat

SEQ ID NO: 282984 - DNA, 25 bp, Homo sapien
tactgccagttgtgagtggcttttt

SEQ ID NO: 282985 - DNA, 25 bp, Homo sapien
ttaacttgtctttcattgcacttca

SEQ ID NO: 282986 - DNA, 25 bp, Homo sapien
gagaatgtctttactttggtttaat

SEQ ID NO: 282987 - DNA, 25 bp, Homo sapien
gtagacttgtggatactgcccactt

SEQ ID NO: 282988 - DNA, 25 bp, Homo sapien
ggatactgcccacttttgtaagtga

SEQ ID NO: 282989 - DNA, 25 bp, Homo sapien
gtaagtgatctgaacagcaagcttt

SEQ ID NO: 282990 - DNA, 25 bp, Homo sapien
aagagctgatagactggcatttcct

SEQ ID NO: 282991 - DNA, 25 bp, Homo sapien
gatagactggcatttcctcaaaagg

SEQ ID NO: 282992 - DNA, 25 bp, Homo sapien
ggcatttcctcaaaaggatctctac

SEQ ID NO: 282993 - DNA, 25 bp, Homo sapien
aaggatctctacatacagtgtgaaa

SEQ ID NO: 282994 - DNA, 25 bp, Homo sapien
agaatttcttcaccctttcacatgg

SEQ ID NO: 282995 - DNA, 25 bp, Homo sapien
ttcacatggccccaaatggaatatt

SEQ ID NO: 282996 - DNA, 25 bp, Homo sapien
ttttcttatccagagatgtccagat

SEQ ID NO: 282997 - DNA, 25 bp, Homo sapien
ccaaagtctgggattgcagacaagt

SEQ ID NO: 282998 - DNA, 25 bp, Homo sapien
caaagtctgggattgcagacaagtc

SEQ ID NO: 282999 - DNA, 25 bp, Homo sapien
attgcagacaagtcatcgtacccgg

SEQ ID NO: 283000 - DNA, 25 bp, Homo sapien
ttgcagacaagtcatcgtacccggc

SEQ ID NO: 283001 - DNA, 25 bp, Homo sapien
tgcagacaagtcatcgtacccggcc

SEQ ID NO: 283002 - DNA, 25 bp, Homo sapien
gcagacaagtcatcgtacccggcct

SEQ ID NO: 283003 - DNA, 25 bp, Homo sapien
cagacaagtcatcgtacccggcctt

SEQ ID NO: 283004 - DNA, 25 bp, Homo sapien
agacaagtcatcgtacccggccttc

SEQ ID NO: 283005 - DNA, 25 bp, Homo sapien
gacaagtcatcgtacccggccttct

SEQ ID NO: 283006 - DNA, 25 bp, Homo sapien
acaagtcatcgtacccggccttctt

SEQ ID NO: 283007 - DNA, 25 bp, Homo sapien
tttgcccttaaaagtaagggatgtg

SEQ ID NO: 283008 - DNA, 25 bp, Homo sapien
actggaaagatactctctaaatgta

SEQ ID NO: 283009 - DNA, 25 bp, Homo sapien
ctggaaagatactctctaaatgtat

SEQ ID NO: 283010 - DNA, 25 bp, Homo sapien
tggaaagatactctctaaatgtatg

SEQ ID NO: 283011 - DNA, 25 bp, Homo sapien
aagaactcactttggagatagaccc

SEQ ID NO: 283012 - DNA, 25 bp, Homo sapien
agaactcactttggagatagaccct

SEQ ID NO: 283013 - DNA, 25 bp, Homo sapien
gaactcactttggagatagacccta

SEQ ID NO: 283014 - DNA, 25 bp, Homo sapien
aactcactttggagatagaccctat

SEQ ID NO: 283015 - DNA, 25 bp, Homo sapien
actcactttggagatagaccctatg

SEQ ID NO: 283016 - DNA, 25 bp, Homo sapien
ctcactttggagatagaccctatga

SEQ ID NO: 283017 - DNA, 25 bp, Homo sapien
tatgaatgtaaacatgggataaagc

SEQ ID NO: 283018 - DNA, 25 bp, Homo sapien
gtgctagtctatattcctcagtacc

SEQ ID NO: 283019 - DNA, 25 bp, Homo sapien
gccatttctactcatccattgtttt

SEQ ID NO: 283020 - DNA, 25 bp, Homo sapien
aggcttctctattaccaaattctgt

SEQ ID NO: 283021 - DNA, 25 bp, Homo sapien
attaccaaattctgttcctgcatca

SEQ ID NO: 283022 - DNA, 25 bp, Homo sapien
agaataccttcattctacactgcac

SEQ ID NO: 283023 - DNA, 25 bp, Homo sapien
ctgcactgaggccatgaggatttaa

SEQ ID NO: 283024 - DNA, 25 bp, Homo sapien
gttgttgaacttatccagtatgctg

SEQ ID NO: 283025 - DNA, 25 bp, Homo sapien
gtatgctggagtgattttctgccca

SEQ ID NO: 283026 - DNA, 25 bp, Homo sapien
tgcccagtccttagttcttgagtct

SEQ ID NO: 283027 - DNA, 25 bp, Homo sapien
taggaatcagagttggcttctagct

SEQ ID NO: 283028 - DNA, 25 bp, Homo sapien
ggcttctagctgacatatccttgga

SEQ ID NO: 283029 - DNA, 25 bp, Homo sapien
ccaacgggtacagcgtgctgggcat

SEQ ID NO: 283030 - DNA, 25 bp, Homo sapien
gcgtgctgggcatggagcgcaacga

SEQ ID NO: 283031 - DNA, 25 bp, Homo sapien
agcccctccgggacgaggacgatga

SEQ ID NO: 283032 - DNA, 25 bp, Homo sapien
gacgaggacgatgacctcctgcagt

SEQ ID NO: 283033 - DNA, 25 bp, Homo sapien
tgcagttcgccatccagcagagcct

SEQ ID NO: 283034 - DNA, 25 bp, Homo sapien
agcagagcctgcttgaagcgggcac

SEQ ID NO: 283035 - DNA, 25 bp, Homo sapien
agagcctgcttgaagcgggcactga

SEQ ID NO: 283036 - DNA, 25 bp, Homo sapien
agcctgcttgaagcgggcactgagg

SEQ ID NO: 283037 - DNA, 25 bp, Homo sapien
ggccacggtttatgaggaacagctt

SEQ ID NO: 283038 - DNA, 25 bp, Homo sapien
aacagcttcagctggagcgggccct

SEQ ID NO: 283039 - DNA, 25 bp, Homo sapien
aggaaagcctgcagctgtccacaga

SEQ ID NO: 283040 - DNA, 25 bp, Homo sapien
aacccctcctaggatgtgcgggcag

SEQ ID NO: 283041 - DNA, 25 bp, Homo sapien
ccctcctaggatgtgcgggcagtgt

SEQ ID NO: 283042 - DNA, 25 bp, Homo sapien
gatggctctggttgccacagagctg

SEQ ID NO: 283043 - DNA, 25 bp, Homo sapien
tgttcttctagagagggccacaaga

SEQ ID NO: 283044 - DNA, 25 bp, Homo sapien
ttgtcagctgatgcctgctgagagg

SEQ ID NO: 283045 - DNA, 25 bp, Homo sapien
tgatgcctgctgagaggcaggaatt

SEQ ID NO: 283046 - DNA, 25 bp, Homo sapien
gaattgtgccagtgagtgacagtca

SEQ ID NO: 283047 - DNA, 25 bp, Homo sapien
ttgtgccagtgagtgacagtcatga

SEQ ID NO: 283048 - DNA, 25 bp, Homo sapien
acagtcatgagggagtgtctcttct

SEQ ID NO: 283049 - DNA, 25 bp, Homo sapien
tcatgagggagtgtctcttcttggg

SEQ ID NO: 283050 - DNA, 25 bp, Homo sapien
aaggtagagcctttctgtctgaatg

SEQ ID NO: 283051 - DNA, 25 bp, Homo sapien
ctctgatggcgccactggtacactc

SEQ ID NO: 283052 - DNA, 25 bp, Homo sapien
ggcaacagacagaaacgagcacttc

SEQ ID NO: 283053 - DNA, 25 bp, Homo sapien
gaaacgagcacttctgcagctatct

SEQ ID NO: 283054 - DNA, 25 bp, Homo sapien
acttctgcagctatctcacaaaact

SEQ ID NO: 283055 - DNA, 25 bp, Homo sapien
gcagctatctcacaaaactagtttg

SEQ ID NO: 283056 - DNA, 25 bp, Homo sapien
gtaagcagttttgaattctgaacta

SEQ ID NO: 283057 - DNA, 25 bp, Homo sapien
tttggcaccaaaactagttaaagtg

SEQ ID NO: 283058 - DNA, 25 bp, Homo sapien
agttaaagtgacctggtgtccgcct

SEQ ID NO: 283059 - DNA, 25 bp, Homo sapien
ttaaagtgacctggtgtccgcctca

SEQ ID NO: 283060 - DNA, 25 bp, Homo sapien
gttttgaattctgaactatgtggac

SEQ ID NO: 283061 - DNA, 25 bp, Homo sapien
gaactatgtggacagaacaccaaat

SEQ ID NO: 283062 - DNA, 25 bp, Homo sapien
gctcatcagctattttaggtttctt

SEQ ID NO: 283063 - DNA, 25 bp, Homo sapien
gctttgaaaagctttctgtggctct

SEQ ID NO: 283064 - DNA, 25 bp, Homo sapien
aaagctttctgtggctctttatagc

SEQ ID NO: 283065 - DNA, 25 bp, Homo sapien
agctgttttacccaatcagttcctt

SEQ ID NO: 283066 - DNA, 25 bp, Homo sapien
ataatctcaagatgggctgcagtct

SEQ ID NO: 283067 - DNA, 25 bp, Homo sapien
gcagtctgtgcagacacacaggctg

SEQ ID NO: 283068 - DNA, 25 bp, Homo sapien
gtgctgagctgcctagcagatccct

SEQ ID NO: 283069 - DNA, 25 bp, Homo sapien
gatccctgggacttagggtaagcct

SEQ ID NO: 283070 - DNA, 25 bp, Homo sapien
tagctaacactcacttattcattca

SEQ ID NO: 283071 - DNA, 25 bp, Homo sapien
attcattcaagggagggcttctggc

SEQ ID NO: 283072 - DNA, 25 bp, Homo sapien
ttctggctcatcagctattttaggt

SEQ ID NO: 283073 - DNA, 25 bp, Homo sapien
actcggtccagaggccagctaggag

SEQ ID NO: 283074 - DNA, 25 bp, Homo sapien
gctaggagggaaaccgcagcttcct

SEQ ID NO: 283075 - DNA, 25 bp, Homo sapien
ggcttgtgtgtgaagattcctgact

SEQ ID NO: 283076 - DNA, 25 bp, Homo sapien
gactcatcgagacaacatgcccagt

SEQ ID NO: 283077 - DNA, 25 bp, Homo sapien
atgcccagttatcagggagtcctgt

SEQ ID NO: 283078 - DNA, 25 bp, Homo sapien
gtcctgtgtcacaaggtctgtctct

SEQ ID NO: 283079 - DNA, 25 bp, Homo sapien
aggtctgtctctgccattgtaagca

SEQ ID NO: 283080 - DNA, 25 bp, Homo sapien
ttgtaagcaagtgccttgggcgagc

SEQ ID NO: 283081 - DNA, 25 bp, Homo sapien
acagtctcatctgtacaccgacagg

SEQ ID NO: 283082 - DNA, 25 bp, Homo sapien
tgtacaccgacagggttgatgcctc

SEQ ID NO: 283083 - DNA, 25 bp, Homo sapien
gatgcctccctcacagggttgagaa

SEQ ID NO: 283084 - DNA, 25 bp, Homo sapien
tcatagcctcggaggagaaggtctt

SEQ ID NO: 283085 - DNA, 25 bp, Homo sapien
gaaggtcttggtggccgacaagtct

SEQ ID NO: 283086 - DNA, 25 bp, Homo sapien
gacaagtctggagacgtctactcct

SEQ ID NO: 283087 - DNA, 25 bp, Homo sapien
agacgtctactccttttcggtgctg

SEQ ID NO: 283088 - DNA, 25 bp, Homo sapien
ttttcggtgctggagccacacgggt

SEQ ID NO: 283089 - DNA, 25 bp, Homo sapien
gatgtggctgtgagtcctgatgacc

SEQ ID NO: 283090 - DNA, 25 bp, Homo sapien
ctgtgagtcctgatgaccgcttcat

SEQ ID NO: 283091 - DNA, 25 bp, Homo sapien
agaagatccgagtcagctgggccgc

SEQ ID NO: 283092 - DNA, 25 bp, Homo sapien
atagcatcgagtccttctgcttggg

SEQ ID NO: 283093 - DNA, 25 bp, Homo sapien
acagagtttgtgagccgtatctccg

SEQ ID NO: 283094 - DNA, 25 bp, Homo sapien
gtgagccgtatctccgtggtgccaa

SEQ ID NO: 283095 - DNA, 25 bp, Homo sapien
gggtcctggccggatctgtaaacac

SEQ ID NO: 283096 - DNA, 25 bp, Homo sapien
ggccggatctgtaaacactcgactg

SEQ ID NO: 283097 - DNA, 25 bp, Homo sapien
acactcgactgacacttgttcattc

SEQ ID NO: 283098 - DNA, 25 bp, Homo sapien
ttgttcattcctccgggcggaaggc

SEQ ID NO: 283099 - DNA, 25 bp, Homo sapien
gcggaaggcctgtcccaaggtcggg

SEQ ID NO: 283100 - DNA, 25 bp, Homo sapien
tcaccatgggttccaggttcactcg

SEQ ID NO: 283101 - DNA, 25 bp, Homo sapien
atgggttccaggttcactcgcagga

SEQ ID NO: 283102 - DNA, 25 bp, Homo sapien
aggttcactcgcaggacctggcgcg

SEQ ID NO: 283103 - DNA, 25 bp, Homo sapien
gggacagggacaaccatccggcaac

SEQ ID NO: 283104 - DNA, 25 bp, Homo sapien
atccggcaacttcttcgcgcgtaaa

SEQ ID NO: 283105 - DNA, 25 bp, Homo sapien
ttcttcgcgcgtaaagtgcattggg

SEQ ID NO: 283106 - DNA, 25 bp, Homo sapien
ttaagaaaacccacagtggctgggc

SEQ ID NO: 283107 - DNA, 25 bp, Homo sapien
taagaaaacccacagtggctgggca

SEQ ID NO: 283108 - DNA, 25 bp, Homo sapien
aagaaaacccacagtggctgggcat

SEQ ID NO: 283109 - DNA, 25 bp, Homo sapien
agaaaacccacagtggctgggcatg

SEQ ID NO: 283110 - DNA, 25 bp, Homo sapien
gaaaacccacagtggctgggcatgg

SEQ ID NO: 283111 - DNA, 25 bp, Homo sapien
aaaacccacagtggctgggcatggt

SEQ ID NO: 283112 - DNA, 25 bp, Homo sapien
aaacccacagtggctgggcatggtg

SEQ ID NO: 283113 - DNA, 25 bp, Homo sapien
aacccacagtggctgggcatggtgg

SEQ ID NO: 283114 - DNA, 25 bp, Homo sapien
acccacagtggctgggcatggtggc

SEQ ID NO: 283115 - DNA, 25 bp, Homo sapien
aggcaggagaatcacctgagccctg

SEQ ID NO: 283116 - DNA, 25 bp, Homo sapien
tcacctgagccctggaggcagaggt

SEQ ID NO: 283117 - DNA, 25 bp, Homo sapien
ggctcagcctccttctactgaggag

SEQ ID NO: 283118 - DNA, 25 bp, Homo sapien
ggaaggcctgatcttctgtgatgcc

SEQ ID NO: 283119 - DNA, 25 bp, Homo sapien
cagtgcctaaataatctgctctagc

SEQ ID NO: 283120 - DNA, 25 bp, Homo sapien
ataatctgctctagcaacactccct

SEQ ID NO: 283121 - DNA, 25 bp, Homo sapien
tgtgccactcctacaaatgctccaa

SEQ ID NO: 283122 - DNA, 25 bp, Homo sapien
aaatgctccaaactctgtcctcaaa

SEQ ID NO: 283123 - DNA, 25 bp, Homo sapien
tgtcctcaaatgacttgtgccactc

SEQ ID NO: 283124 - DNA, 25 bp, Homo sapien
gacttgtgccactcaaccaggaaat

SEQ ID NO: 283125 - DNA, 25 bp, Homo sapien
gaaatctatcccaggtctaactcac

SEQ ID NO: 283126 - DNA, 25 bp, Homo sapien
gtccaactgtcaccaaagatcatgt

SEQ ID NO: 283127 - DNA, 25 bp, Homo sapien
gacaacagaggaccctgaggctcag

SEQ ID NO: 283128 - DNA, 25 bp, Homo sapien
cccctccggatgaatataaaccatg

SEQ ID NO: 283129 - DNA, 25 bp, Homo sapien
aaccatgccagaagatttaccccag

SEQ ID NO: 283130 - DNA, 25 bp, Homo sapien
gccagaagatttaccccagcaagat

SEQ ID NO: 283131 - DNA, 25 bp, Homo sapien
agcaagatccccagaagccgtacac

SEQ ID NO: 283132 - DNA, 25 bp, Homo sapien
tggtccctggctccaagcggaagca

SEQ ID NO: 283133 - DNA, 25 bp, Homo sapien
ctccaagcggaagcagtcgggcaga

SEQ ID NO: 283134 - DNA, 25 bp, Homo sapien
gtcgggcagagctctgatgacatca

SEQ ID NO: 283135 - DNA, 25 bp, Homo sapien
gttatctctaaagactcttcggtga

SEQ ID NO: 283136 - DNA, 25 bp, Homo sapien
tgcagaacaacatgtcagaccccac

SEQ ID NO: 283137 - DNA, 25 bp, Homo sapien
gctcaagctgtaattcagttggcat

SEQ ID NO: 283138 - DNA, 25 bp, Homo sapien
ttcagttggcatacaggcttggaat

SEQ ID NO: 283139 - DNA, 25 bp, Homo sapien
gtgtgcacttgtggccgcgtgtaca

SEQ ID NO: 283140 - DNA, 25 bp, Homo sapien
cgaggcacaggcatggctcttggtt

SEQ ID NO: 283141 - DNA, 25 bp, Homo sapien
atggctcttggtttatgagatatcc

SEQ ID NO: 283142 - DNA, 25 bp, Homo sapien
gagatatccacgcactcaggacagt

SEQ ID NO: 283143 - DNA, 25 bp, Homo sapien
aggacagtgacccagattgcaggcc

SEQ ID NO: 283144 - DNA, 25 bp, Homo sapien
attgcaggcccgtgccaggtgagaa

SEQ ID NO: 283145 - DNA, 25 bp, Homo sapien
gcacaacaaatcacattctagcaga

SEQ ID NO: 283146 - DNA, 25 bp, Homo sapien
ttcctgaccactgagtgctgtgttg

SEQ ID NO: 283147 - DNA, 25 bp, Homo sapien
gagtgctgtgttggctccagagctc

SEQ ID NO: 283148 - DNA, 25 bp, Homo sapien
aagacatccctaagccacaaaactg

SEQ ID NO: 283149 - DNA, 25 bp, Homo sapien
aaaactggattagccgtgtgcactt

SEQ ID NO: 283150 - DNA, 25 bp, Homo sapien
tgatgcctcctctgggtcacattgc

SEQ ID NO: 283151 - DNA, 25 bp, Homo sapien
gtcacattgcttcttatcctgaaca

SEQ ID NO: 283152 - DNA, 25 bp, Homo sapien
tatcctgaacacttgacaccttgag

SEQ ID NO: 283153 - DNA, 25 bp, Homo sapien
caccttgagggtagaatttagcgtt

SEQ ID NO: 283154 - DNA, 25 bp, Homo sapien
gcgtttggtttttacctcctagcat

SEQ ID NO: 283155 - DNA, 25 bp, Homo sapien
gtttttacctcctagcatatgctgt

SEQ ID NO: 283156 - DNA, 25 bp, Homo sapien
atgctgtttggtatgtgagggtttc

SEQ ID NO: 283157 - DNA, 25 bp, Homo sapien
gggtttcagtacaaatgctgctgtc

SEQ ID NO: 283158 - DNA, 25 bp, Homo sapien
ctgctgtctatttctgtgcacttaa

SEQ ID NO: 283159 - DNA, 25 bp, Homo sapien
gtgcacttaacaatggaacccaaac

SEQ ID NO: 283160 - DNA, 25 bp, Homo sapien
gtgtccatttggaccaaacgttgtt

SEQ ID NO: 283161 - DNA, 25 bp, Homo sapien
catgaaatctctccgaatgccctgc

SEQ ID NO: 283162 - DNA, 25 bp, Homo sapien
atgggctgcaccaatgaggccacgc

SEQ ID NO: 283163 - DNA, 25 bp, Homo sapien
aaacgttactggacaccagctcggc

SEQ ID NO: 283164 - DNA, 25 bp, Homo sapien
gagctgtccagcaagagaacggctt

SEQ ID NO: 283165 - DNA, 25 bp, Homo sapien
gcaagagaacggctttgctgtcttc

SEQ ID NO: 283166 - DNA, 25 bp, Homo sapien
tgtcttccggcaaacctatggttct

SEQ ID NO: 283167 - DNA, 25 bp, Homo sapien
ctatggttctgaagtgctctctcac

SEQ ID NO: 283168 - DNA, 25 bp, Homo sapien
gctctctcaccgagggcacaaagat

SEQ ID NO: 283169 - DNA, 25 bp, Homo sapien
aaaatctccttgtccacccaggcat

SEQ ID NO: 283170 - DNA, 25 bp, Homo sapien
tcccctgggccttataggcgacggg

SEQ ID NO: 283171 - DNA, 25 bp, Homo sapien
ggtgctggatgcctttgaaagccct

SEQ ID NO: 283172 - DNA, 25 bp, Homo sapien
aagttctatgtacaggtccttcatc

SEQ ID NO: 283173 - DNA, 25 bp, Homo sapien
tgtacaggtccttcatcttatgaat

SEQ ID NO: 283174 - DNA, 25 bp, Homo sapien
gcccacaccttttggaccaattact

SEQ ID NO: 283175 - DNA, 25 bp, Homo sapien
ttttggaccaattactgcgcgacct

SEQ ID NO: 283176 - DNA, 25 bp, Homo sapien
tgcgcgacctcccatgtatgaagac

SEQ ID NO: 283177 - DNA, 25 bp, Homo sapien
gtatgaagactatatgccattgcat

SEQ ID NO: 283178 - DNA, 25 bp, Homo sapien
tatatgccattgcatgcacctcttc

SEQ ID NO: 283179 - DNA, 25 bp, Homo sapien
agcactgatgatgaggaccgacaga

SEQ ID NO: 283180 - DNA, 25 bp, Homo sapien
ggaccgacagagaatgaacaaatta

SEQ ID NO: 283181 - DNA, 25 bp, Homo sapien
ggaactagcaaatcttcagcccaaa

SEQ ID NO: 283182 - DNA, 25 bp, Homo sapien
acctaaaacaataaagcagcgccat

SEQ ID NO: 283183 - DNA, 25 bp, Homo sapien
gtaggccagccttgaagccatcgca

SEQ ID NO: 283184 - DNA, 25 bp, Homo sapien
gaagccatcgcacagtctagaaact

SEQ ID NO: 283185 - DNA, 25 bp, Homo sapien
tgtgtagctgagtgtgcagctcacc

SEQ ID NO: 283186 - DNA, 25 bp, Homo sapien
gagtgtgcagctcacctttaagggt

SEQ ID NO: 283187 - DNA, 25 bp, Homo sapien
gcagctcacctttaagggtgaagtt

SEQ ID NO: 283188 - DNA, 25 bp, Homo sapien
ggtaaaagcaattagcagaggcgtt

SEQ ID NO: 283189 - DNA, 25 bp, Homo sapien
gcagaggcgttatctatgtgattat

SEQ ID NO: 283190 - DNA, 25 bp, Homo sapien
ttttatagccctttcaatgaaataa

SEQ ID NO: 283191 - DNA, 25 bp, Homo sapien
taaagagtcacccttactactgttg

SEQ ID NO: 283192 - DNA, 25 bp, Homo sapien
gagtcacccttactactgttgaatt

SEQ ID NO: 283193 - DNA, 25 bp, Homo sapien
tcacccttactactgttgaatttca

SEQ ID NO: 283194 - DNA, 25 bp, Homo sapien
gtcccaaggtacaaacttgcaccag

SEQ ID NO: 283195 - DNA, 25 bp, Homo sapien
aggtacaaacttgcaccagcagcaa

SEQ ID NO: 283196 - DNA, 25 bp, Homo sapien
accagcagcaagatagcagaggcag

SEQ ID NO: 283197 - DNA, 25 bp, Homo sapien
ctgaagatcaagagggaggtcgccc

SEQ ID NO: 283198 - DNA, 25 bp, Homo sapien
gaggtcgccctggtactacatagca

SEQ ID NO: 283199 - DNA, 25 bp, Homo sapien
cctggtactacatagcagtcacgtt

SEQ ID NO: 283200 - DNA, 25 bp, Homo sapien
atagcagtcacgttaggctgggaca

SEQ ID NO: 283201 - DNA, 25 bp, Homo sapien
gtcacgttaggctgggacaattcct

SEQ ID NO: 283202 - DNA, 25 bp, Homo sapien
ttaggctgggacaattcctgtttac

SEQ ID NO: 283203 - DNA, 25 bp, Homo sapien
ttaggcctcagcctgtctgcatgca

SEQ ID NO: 283204 - DNA, 25 bp, Homo sapien
cctgtctgcatgcaggcgctcatta

SEQ ID NO: 283205 - DNA, 25 bp, Homo sapien
ccggtagatcccttgcaactatatg

SEQ ID NO: 283206 - DNA, 25 bp, Homo sapien
cccttgcaactatatgattcctctg

SEQ ID NO: 283207 - DNA, 25 bp, Homo sapien
gattcctctgttatcagttggtgat

SEQ ID NO: 283208 - DNA, 25 bp, Homo sapien
gagagggcagaattgtttcagaatt

SEQ ID NO: 283209 - DNA, 25 bp, Homo sapien
gatcaagacccttattcagtagatg

SEQ ID NO: 283210 - DNA, 25 bp, Homo sapien
tagagaaacagtgtgcccgacccag

SEQ ID NO: 283211 - DNA, 25 bp, Homo sapien
tggaggatcctgacggtacctgact

SEQ ID NO: 283212 - DNA, 25 bp, Homo sapien
ccgacccaggtctggcttactgaaa

SEQ ID NO: 283213 - DNA, 25 bp, Homo sapien
gatgcagcagcccaaactctgactc

SEQ ID NO: 283214 - DNA, 25 bp, Homo sapien
tctgaccctacttctgtatcttaag

SEQ ID NO: 283215 - DNA, 25 bp, Homo sapien
ttctgtatcttaagcccggtagatc

SEQ ID NO: 283216 - DNA, 25 bp, Homo sapien
tccttcctgagcttgtcccaggtgt

SEQ ID NO: 283217 - DNA, 25 bp, Homo sapien
acgaggccgcgtcggaggacagcga

SEQ ID NO: 283218 - DNA, 25 bp, Homo sapien
ggcgctcggacgctggcgtgaggac

SEQ ID NO: 283219 - DNA, 25 bp, Homo sapien
cgtgaggacgccatcgactggcagc

SEQ ID NO: 283220 - DNA, 25 bp, Homo sapien
ccatcgactggcagcgcacgttcag

SEQ ID NO: 283221 - DNA, 25 bp, Homo sapien
gcacgttcagcgtgggcgccgtgga

SEQ ID NO: 283222 - DNA, 25 bp, Homo sapien
tgggcgccgtggacttcgagctgct

SEQ ID NO: 283223 - DNA, 25 bp, Homo sapien
aggcgcgcacgctgggacctgcggc

SEQ ID NO: 283224 - DNA, 25 bp, Homo sapien
tgcggcgcccacagtggactcaaac

SEQ ID NO: 283225 - DNA, 25 bp, Homo sapien
agtggactcaaacttgtcctccgaa

SEQ ID NO: 283226 - DNA, 25 bp, Homo sapien
tcaaacttgtcctccgaagcgcggc

SEQ ID NO: 283227 - DNA, 25 bp, Homo sapien
cttcatttctcagtaatcattgtaa

SEQ ID NO: 283228 - DNA, 25 bp, Homo sapien
tttttcttctccactctaacaaaag

SEQ ID NO: 283229 - DNA, 25 bp, Homo sapien
aggtcttggactccactacttgtta

SEQ ID NO: 283230 - DNA, 25 bp, Homo sapien
ggactccactacttgttagttatgt

SEQ ID NO: 283231 - DNA, 25 bp, Homo sapien
gttatgttggcctggacagatggca

SEQ ID NO: 283232 - DNA, 25 bp, Homo sapien
agatggcaggtctgtcggcagttcc

SEQ ID NO: 283233 - DNA, 25 bp, Homo sapien
gtcggcagttcctcagtctgtaaaa

SEQ ID NO: 283234 - DNA, 25 bp, Homo sapien
tgcctctccctttgtcacagtgttg

SEQ ID NO: 283235 - DNA, 25 bp, Homo sapien
cacagtgttgtcgtgaagatcagat

SEQ ID NO: 283236 - DNA, 25 bp, Homo sapien
aagtgttaactatcgttgcccaccg

SEQ ID NO: 283237 - DNA, 25 bp, Homo sapien
ttaactatcgttgcccaccgaattt

SEQ ID NO: 283238 - DNA, 25 bp, Homo sapien
ttctctgactagacacttgtactga

SEQ ID NO: 283239 - DNA, 25 bp, Homo sapien
acttgtactgagtcaattggcgagt

SEQ ID NO: 283240 - DNA, 25 bp, Homo sapien
ggcgagtgtgtctgtctaaaagcac

SEQ ID NO: 283241 - DNA, 25 bp, Homo sapien
ggaagtctggaagtttctacccatg

SEQ ID NO: 283242 - DNA, 25 bp, Homo sapien
taaagcatctttacatagtgtgttt

SEQ ID NO: 283243 - DNA, 25 bp, Homo sapien
gttattcagcagaaaggtaattcca

SEQ ID NO: 283244 - DNA, 25 bp, Homo sapien
aggtaattccaattggtctgcatat

SEQ ID NO: 283245 - DNA, 25 bp, Homo sapien
tggaagtttctacccatgccaagaa

SEQ ID NO: 283246 - DNA, 25 bp, Homo sapien
ctgcatatttatcagcacttggtat

SEQ ID NO: 283247 - DNA, 25 bp, Homo sapien
gcacttggtattgtctgtttcttat

SEQ ID NO: 283248 - DNA, 25 bp, Homo sapien
ttttttccctatattctctgactag

SEQ ID NO: 283249 - DNA, 25 bp, Homo sapien
aaaacccagtgattttgccagtatc

SEQ ID NO: 283250 - DNA, 25 bp, Homo sapien
gattttgccagtatccctgcaggga

SEQ ID NO: 283251 - DNA, 25 bp, Homo sapien
atccctgcagggacctgcggtacag

SEQ ID NO: 283252 - DNA, 25 bp, Homo sapien
tgcggtacaggcaggttgaagatct

SEQ ID NO: 283253 - DNA, 25 bp, Homo sapien
agatctgagactcaggaaccttggc

SEQ ID NO: 283254 - DNA, 25 bp, Homo sapien
gcccctttgtcacttacaactgtgt

SEQ ID NO: 283255 - DNA, 25 bp, Homo sapien
aacagtttggactgagagcactgaa

SEQ ID NO: 283256 - DNA, 25 bp, Homo sapien
aagctgctgtgtgttgtgcatataa

SEQ ID NO: 283257 - DNA, 25 bp, Homo sapien
aatgctgtgtgttgtggcttgcact

SEQ ID NO: 283258 - DNA, 25 bp, Homo sapien
aagcttatgtaagggccggctggtc

SEQ ID NO: 283259 - DNA, 25 bp, Homo sapien
tggtcagctccctagaaccacgggc

SEQ ID NO: 283260 - DNA, 25 bp, Homo sapien
agcatccttaagtaagccctgcctg

SEQ ID NO: 283261 - DNA, 25 bp, Homo sapien
agccctgcctgaccctgtagattgg

SEQ ID NO: 283262 - DNA, 25 bp, Homo sapien
gtagattgggccagggacccttatt

SEQ ID NO: 283263 - DNA, 25 bp, Homo sapien
gccagggacccttattctagggcat

SEQ ID NO: 283264 - DNA, 25 bp, Homo sapien
tattctagggcattctttccttttc

SEQ ID NO: 283265 - DNA, 25 bp, Homo sapien
ttttctaaaggcactgatcgcagtt

SEQ ID NO: 283266 - DNA, 25 bp, Homo sapien
gatcgcagtttgtagttatatcttt

SEQ ID NO: 283267 - DNA, 25 bp, Homo sapien
ggtagggacatggtctgctttcatt

SEQ ID NO: 283268 - DNA, 25 bp, Homo sapien
gtctgctttcattcaccactgtatt

SEQ ID NO: 283269 - DNA, 25 bp, Homo sapien
tcaccactgtattcctgcaggcctg

SEQ ID NO: 283270 - DNA, 25 bp, Homo sapien
tgtattcctgcaggcctgccacagt

SEQ ID NO: 283271 - DNA, 25 bp, Homo sapien
gagagatagctcttctttaggtaaa

SEQ ID NO: 283272 - DNA, 25 bp, Homo sapien
gctcttctttaggtaaatgtcattt

SEQ ID NO: 283273 - DNA, 25 bp, Homo sapien
gaatactaaaggttgagcgttgtca

SEQ ID NO: 283274 - DNA, 25 bp, Homo sapien
gcgttgtcatgttggctcttaatgc

SEQ ID NO: 283275 - DNA, 25 bp, Homo sapien
gttggctcttaatgccccaaatttt

SEQ ID NO: 283276 - DNA, 25 bp, Homo sapien
ttttgtcagtcatcttggaatattg

SEQ ID NO: 283277 - DNA, 25 bp, Homo sapien
cttcaaggtaaactcatttcaaggg

SEQ ID NO: 283278 - DNA, 25 bp, Homo sapien
atttcaagggatacatttaagggtg

SEQ ID NO: 283279 - DNA, 25 bp, Homo sapien
gggacataatccatttcttgccaac

SEQ ID NO: 283280 - DNA, 25 bp, Homo sapien
ccatttcttgccaacaggacacaaa

SEQ ID NO: 283281 - DNA, 25 bp, Homo sapien
cacaaaaatgtctactggagggctt

SEQ ID NO: 283282 - DNA, 25 bp, Homo sapien
gcacagaactgtggatgtttgtcac

SEQ ID NO: 283283 - DNA, 25 bp, Homo sapien
ggatgtttgtcacagaactttccaa

SEQ ID NO: 283284 - DNA, 25 bp, Homo sapien
tcatttccataatctttaaggtgtg

SEQ ID NO: 283285 - DNA, 25 bp, Homo sapien
gggatacgtaatctggacttctcaa

SEQ ID NO: 283286 - DNA, 25 bp, Homo sapien
acgtaatctggacttctcaaatgga

SEQ ID NO: 283287 - DNA, 25 bp, Homo sapien
aatctggacttctcaaatggatgat

SEQ ID NO: 283288 - DNA, 25 bp, Homo sapien
ggacttctcaaatggatgatttcta

SEQ ID NO: 283289 - DNA, 25 bp, Homo sapien
ggatgatttctaaatacgcgtcaga

SEQ ID NO: 283290 - DNA, 25 bp, Homo sapien
ctaaatacgcgtcagatgaagtgat

SEQ ID NO: 283291 - DNA, 25 bp, Homo sapien
tgaagtgattctaactttctctgta

SEQ ID NO: 283292 - DNA, 25 bp, Homo sapien
ctttctctgtagtaatatcttattt

SEQ ID NO: 283293 - DNA, 25 bp, Homo sapien
aaggcggtccttgggcaccagcaaa

SEQ ID NO: 283294 - DNA, 25 bp, Homo sapien
ggcaccagcaaaggcaaggcccatt

SEQ ID NO: 283295 - DNA, 25 bp, Homo sapien
gtggccagtcgcaacttgcttgcta

SEQ ID NO: 283296 - DNA, 25 bp, Homo sapien
gggcacatgtataaatattcctact

SEQ ID NO: 283297 - DNA, 25 bp, Homo sapien
atttcaagtggcaacccgtcacatc

SEQ ID NO: 283298 - DNA, 25 bp, Homo sapien
ccagcaagtctccttttataacatg

SEQ ID NO: 283299 - DNA, 25 bp, Homo sapien
ttataacatggcctcccgggatcta

SEQ ID NO: 283300 - DNA, 25 bp, Homo sapien
aacttgcttgctaggcagagggaca

SEQ ID NO: 283301 - DNA, 25 bp, Homo sapien
gggatctacaggaccgagcatggac

SEQ ID NO: 283302 - DNA, 25 bp, Homo sapien
gccagcgccgtcactgcagtggaag

SEQ ID NO: 283303 - DNA, 25 bp, Homo sapien
gtcactgcagtggaaggcggtcctt

SEQ ID NO: 283304 - DNA, 25 bp, Homo sapien
cctcccttaggtggcaacaaagtcg

SEQ ID NO: 283305 - DNA, 25 bp, Homo sapien
tcccttaggtggcaacaaagtcgtg

SEQ ID NO: 283306 - DNA, 25 bp, Homo sapien
ttaggtggcaacaaagtcgtgcagt

SEQ ID NO: 283307 - DNA, 25 bp, Homo sapien
caacaaagtcgtgcagtgggagccg

SEQ ID NO: 283308 - DNA, 25 bp, Homo sapien
acaaagtcgtgcagtgggagccgcc

SEQ ID NO: 283309 - DNA, 25 bp, Homo sapien
tggccagggcgggactccaagaact

SEQ ID NO: 283310 - DNA, 25 bp, Homo sapien
ccagggcgggactccaagaactgcc

SEQ ID NO: 283311 - DNA, 25 bp, Homo sapien
tgtgccgtccccaaaaccagccgag

SEQ ID NO: 283312 - DNA, 25 bp, Homo sapien
agggcagccggctctgaagtatgcg

SEQ ID NO: 283313 - DNA, 25 bp, Homo sapien
aaaaccagccgagacagctggcccc

SEQ ID NO: 283314 - DNA, 25 bp, Homo sapien
cttccacccattgggcaggccgcac

SEQ ID NO: 283315 - DNA, 25 bp, Homo sapien
cttcaacaaggacagcaggagctca

SEQ ID NO: 283316 - DNA, 25 bp, Homo sapien
aggagctcaccatgtccacgacatt

SEQ ID NO: 283317 - DNA, 25 bp, Homo sapien
accatgtccacgacatttgccatca

SEQ ID NO: 283318 - DNA, 25 bp, Homo sapien
gggtccggtcaatccaagttgagaa

SEQ ID NO: 283319 - DNA, 25 bp, Homo sapien
agttgagaaggccacaagcttctta

SEQ ID NO: 283320 - DNA, 25 bp, Homo sapien
gccacaagcttcttaggaaaggcct

SEQ ID NO: 283321 - DNA, 25 bp, Homo sapien
atgagcctttgccagtcctttctcc

SEQ ID NO: 283322 - DNA, 25 bp, Homo sapien
tctcctgcgacgtgactgacagcaa

SEQ ID NO: 283323 - DNA, 25 bp, Homo sapien
gacagcaactcaggctggtcccgta

SEQ ID NO: 283324 - DNA, 25 bp, Homo sapien
tggtcccgtattccagtcccaggag

SEQ ID NO: 283325 - DNA, 25 bp, Homo sapien
caggagcctcaaaacggactctgcc

SEQ ID NO: 283326 - DNA, 25 bp, Homo sapien
gaacctgacgttcttgacgatcttt

SEQ ID NO: 283327 - DNA, 25 bp, Homo sapien
aacctgacgttcttgacgatcttta

SEQ ID NO: 283328 - DNA, 25 bp, Homo sapien
cctgacgttcttgacgatctttatg

SEQ ID NO: 283329 - DNA, 25 bp, Homo sapien
tgacgttcttgacgatctttatgga

SEQ ID NO: 283330 - DNA, 25 bp, Homo sapien
attcaacgtgcaatgatattttaca

SEQ ID NO: 283331 - DNA, 25 bp, Homo sapien
acgtgcaatgatattttacaagtac

SEQ ID NO: 283332 - DNA, 25 bp, Homo sapien
aaagaaatcgtagaggcatcggaag

SEQ ID NO: 283333 - DNA, 25 bp, Homo sapien
aatcgtagaggcatcggaagaagat

SEQ ID NO: 283334 - DNA, 25 bp, Homo sapien
ggaagaagattaggcagttttcaat

SEQ ID NO: 283335 - DNA, 25 bp, Homo sapien
ctgatgaacctgacgttcttgacga

SEQ ID NO: 283336 - DNA, 25 bp, Homo sapien
gatgaacctgacgttcttgacgatc

SEQ ID NO: 283337 - DNA, 25 bp, Homo sapien
gaaaggtcttgaataagtacacaga

SEQ ID NO: 283338 - DNA, 25 bp, Homo sapien
ggaaattggaatacagggagacagt

SEQ ID NO: 283339 - DNA, 25 bp, Homo sapien
ccaggaatctgcctatgtggtagac

SEQ ID NO: 283340 - DNA, 25 bp, Homo sapien
gtggtagacccaaccattactactt

SEQ ID NO: 283341 - DNA, 25 bp, Homo sapien
gaaaagcttttccagcattccataa

SEQ ID NO: 283342 - DNA, 25 bp, Homo sapien
cattccataactcaggttcctcatt

SEQ ID NO: 283343 - DNA, 25 bp, Homo sapien
tccataactcaggttcctcatttat

SEQ ID NO: 283344 - DNA, 25 bp, Homo sapien
gtgggaaactcataattgtcctacc

SEQ ID NO: 283345 - DNA, 25 bp, Homo sapien
aaactcataattgtcctacctacct

SEQ ID NO: 283346 - DNA, 25 bp, Homo sapien
tcataattgtcctacctacctcaca

SEQ ID NO: 283347 - DNA, 25 bp, Homo sapien
gaacagatgaatgtatgagcacttt

SEQ ID NO: 283348 - DNA, 25 bp, Homo sapien
tttcttcctgaccaccgattgagac

SEQ ID NO: 283349 - DNA, 25 bp, Homo sapien
gattgagacgtctccaggaccttag

SEQ ID NO: 283350 - DNA, 25 bp, Homo sapien
gcagatccgttttctcactgttgga

SEQ ID NO: 283351 - DNA, 25 bp, Homo sapien
gttttctcactgttggactctacct

SEQ ID NO: 283352 - DNA, 25 bp, Homo sapien
ggactctacctcactggtctggaag

SEQ ID NO: 283353 - DNA, 25 bp, Homo sapien
ggtctggaagtcctccgaagacatt

SEQ ID NO: 283354 - DNA, 25 bp, Homo sapien
gaatttggtttcgtgcttgtgtaat

SEQ ID NO: 283355 - DNA, 25 bp, Homo sapien
gccagaatttacttgttctttatct

SEQ ID NO: 283356 - DNA, 25 bp, Homo sapien
gtcacccctctttgtggacagaagt

SEQ ID NO: 283357 - DNA, 25 bp, Homo sapien
agttcgaacatgtggtgttgcacta

SEQ ID NO: 283358 - DNA, 25 bp, Homo sapien
cactagtttgtgctcagggtattct

SEQ ID NO: 283359 - DNA, 25 bp, Homo sapien
agcgaatttccggtttgatttatga

SEQ ID NO: 283360 - DNA, 25 bp, Homo sapien
cggtttgatttatgaggagactcgt

SEQ ID NO: 283361 - DNA, 25 bp, Homo sapien
ttacgcgctcaagcgtcaaggacgc

SEQ ID NO: 283362 - DNA, 25 bp, Homo sapien
ctctgtacggcttcggcggttaatc

SEQ ID NO: 283363 - DNA, 25 bp, Homo sapien
gcttcggcggttaatcttttcgtca

SEQ ID NO: 283364 - DNA, 25 bp, Homo sapien
tcggcggttaatcttttcgtcagtt

SEQ ID NO: 283365 - DNA, 25 bp, Homo sapien
taatcttttcgtcagttttcttcca

SEQ ID NO: 283366 - DNA, 25 bp, Homo sapien
gcccactccctctcagaaagagctg

SEQ ID NO: 283367 - DNA, 25 bp, Homo sapien
gagctgtgattgtattctttcggat

SEQ ID NO: 283368 - DNA, 25 bp, Homo sapien
gattgtattctttcggatggtaaca

SEQ ID NO: 283369 - DNA, 25 bp, Homo sapien
tcggatggtaacatctcaatggctt

SEQ ID NO: 283370 - DNA, 25 bp, Homo sapien
gtggctgactgaattaagtaccagt

SEQ ID NO: 283371 - DNA, 25 bp, Homo sapien
taagtaccagtgacatgcagtaact

SEQ ID NO: 283372 - DNA, 25 bp, Homo sapien
gatgagccatctgtatgctctgaca

SEQ ID NO: 283373 - DNA, 25 bp, Homo sapien
gtatgctctgacagttacagactga

SEQ ID NO: 283374 - DNA, 25 bp, Homo sapien
gactgaataagttggagacttccct

SEQ ID NO: 283375 - DNA, 25 bp, Homo sapien
ggagacttccctaaagggtggcatt

SEQ ID NO: 283376 - DNA, 25 bp, Homo sapien
tccctaaagggtggcatttccccag

SEQ ID NO: 283377 - DNA, 25 bp, Homo sapien
tgcagaggctggagaaaggataaca

SEQ ID NO: 283378 - DNA, 25 bp, Homo sapien
gagagagtatacaggcatgccttga

SEQ ID NO: 283379 - DNA, 25 bp, Homo sapien
ggcatgccttgatttattgcacttc

SEQ ID NO: 283380 - DNA, 25 bp, Homo sapien
tgcacttcacaggtagcagaatttt

SEQ ID NO: 283381 - DNA, 25 bp, Homo sapien
cagtggatcacacaccctggtgaaa

SEQ ID NO: 283382 - DNA, 25 bp, Homo sapien
tgttgcaagtcccaagcctctcggg

SEQ ID NO: 283383 - DNA, 25 bp, Homo sapien
gagacagcatgacttcagaccagca

SEQ ID NO: 283384 - DNA, 25 bp, Homo sapien
accagcaaagaaaagtcaccaccct

SEQ ID NO: 283385 - DNA, 25 bp, Homo sapien
tggaaactaatgctctaccctaaac

SEQ ID NO: 283386 - DNA, 25 bp, Homo sapien
gaaactacacactgctttttgccaa

SEQ ID NO: 283387 - DNA, 25 bp, Homo sapien
acactgctttttgccaaagaggcta

SEQ ID NO: 283388 - DNA, 25 bp, Homo sapien
gggcctacaggcaaaccctgactgc

SEQ ID NO: 283389 - DNA, 25 bp, Homo sapien
tgactgcccatgaagcagccgcagg

SEQ ID NO: 283390 - DNA, 25 bp, Homo sapien
gaagcagccgcaggtgccaaaggac

SEQ ID NO: 283391 - DNA, 25 bp, Homo sapien
ggtgccaaaggacccactgccaaca

SEQ ID NO: 283392 - DNA, 25 bp, Homo sapien
tgaaggtgtgtgttgtcgagacaat

SEQ ID NO: 283393 - DNA, 25 bp, Homo sapien
gttgtcgagacaatacagcagtgaa

SEQ ID NO: 283394 - DNA, 25 bp, Homo sapien
gcatgcaaagctgtcttgttggagt

SEQ ID NO: 283395 - DNA, 25 bp, Homo sapien
gctgtcttgttggagtctggctaaa

SEQ ID NO: 283396 - DNA, 25 bp, Homo sapien
tggagtctggctaaagagcaccaaa

SEQ ID NO: 283397 - DNA, 25 bp, Homo sapien
aagcagcctgttgtgggatgtcctc

SEQ ID NO: 283398 - DNA, 25 bp, Homo sapien
gccacctggacttgctatgttaaca

SEQ ID NO: 283399 - DNA, 25 bp, Homo sapien
tatgttaacatggagggactaggca

SEQ ID NO: 283400 - DNA, 25 bp, Homo sapien
caggaggcagcagcaacaatgagag

SEQ ID NO: 283401 - DNA, 25 bp, Homo sapien
agattggttatccatatgacttgga

SEQ ID NO: 283402 - DNA, 25 bp, Homo sapien
tccatatgacttggatctgtgtccc

SEQ ID NO: 283403 - DNA, 25 bp, Homo sapien
gaaatgagcttcatgctgaggtagt

SEQ ID NO: 283404 - DNA, 25 bp, Homo sapien
ttcatgctgaggtagtggttgcctt

SEQ ID NO: 283405 - DNA, 25 bp, Homo sapien
gtggttgccttagagctgttattta

SEQ ID NO: 283406 - DNA, 25 bp, Homo sapien
agagctgttatttatgctgtagaaa

SEQ ID NO: 283407 - DNA, 25 bp, Homo sapien
atggttttgctacctgataagcttc

SEQ ID NO: 283408 - DNA, 25 bp, Homo sapien
agcttcagattagatatagccctaa

SEQ ID NO: 283409 - DNA, 25 bp, Homo sapien
atcctgtacctgcattaaattttca

SEQ ID NO: 283410 - DNA, 25 bp, Homo sapien
gagaatcttggttttggtaattcat

SEQ ID NO: 283411 - DNA, 25 bp, Homo sapien
tcattatgtgcaaaacaccaagttt

SEQ ID NO: 283412 - DNA, 25 bp, Homo sapien
aatggccttagttttcaatgtctga

SEQ ID NO: 283413 - DNA, 25 bp, Homo sapien
tttgtgagttgtgttatctgtaata

SEQ ID NO: 283414 - DNA, 25 bp, Homo sapien
aggctccactcgctggtatttccag

SEQ ID NO: 283415 - DNA, 25 bp, Homo sapien
ggtatttccaggcttgctaagtact

SEQ ID NO: 283416 - DNA, 25 bp, Homo sapien
tgctaagtactaaccaactcatccc

SEQ ID NO: 283417 - DNA, 25 bp, Homo sapien
actcatccccagtaacactgcatgt

SEQ ID NO: 283418 - DNA, 25 bp, Homo sapien
aacactgcatgttcatatcctgaat

SEQ ID NO: 283419 - DNA, 25 bp, Homo sapien
gagcaaacacgtgcataagcaaatg

SEQ ID NO: 283420 - DNA, 25 bp, Homo sapien
agatgtgcagccagtgcaggtaccc

SEQ ID NO: 283421 - DNA, 25 bp, Homo sapien
caggtaccccgggagtgttgcaagt

SEQ ID NO: 283422 - DNA, 25 bp, Homo sapien
gtttagtatttaattgctcctcatg

SEQ ID NO: 283423 - DNA, 25 bp, Homo sapien
gctcctcatgtaacattactctgct

SEQ ID NO: 283424 - DNA, 25 bp, Homo sapien
atgtaacattactctgcttcagaaa

SEQ ID NO: 283425 - DNA, 25 bp, Homo sapien
aagcgctttgtggtctgaggcagcc

SEQ ID NO: 283426 - DNA, 25 bp, Homo sapien
tgaggcagcccctctgtcatgtggt

SEQ ID NO: 283427 - DNA, 25 bp, Homo sapien
tgtcatgtggtgctccctattcctc

SEQ ID NO: 283428 - DNA, 25 bp, Homo sapien
gcagcaccctcgctactcaggagtt

SEQ ID NO: 283429 - DNA, 25 bp, Homo sapien
tcaggagttctgtccatcctcgttt

SEQ ID NO: 283430 - DNA, 25 bp, Homo sapien
atcctcgttttgtgtggctgactca

SEQ ID NO: 283431 - DNA, 25 bp, Homo sapien
tttgtgtggctgactcagttctcga

SEQ ID NO: 283432 - DNA, 25 bp, Homo sapien
tgtggctgactcagttctcgagccc

SEQ ID NO: 283433 - DNA, 25 bp, Homo sapien
tttcccgcctgcgagggagacctgg

SEQ ID NO: 283434 - DNA, 25 bp, Homo sapien
ggagacctggcgtctgcccgctgct

SEQ ID NO: 283435 - DNA, 25 bp, Homo sapien
gctgctcgcagagtcacgttgccgg

SEQ ID NO: 283436 - DNA, 25 bp, Homo sapien
gagaaggatgacagtcctccacaga

SEQ ID NO: 283437 - DNA, 25 bp, Homo sapien
gaaggatgacagtcctccacagaaa

SEQ ID NO: 283438 - DNA, 25 bp, Homo sapien
ggatgacagtcctccacagaaatgg

SEQ ID NO: 283439 - DNA, 25 bp, Homo sapien
atgacagtcctccacagaaatggcc

SEQ ID NO: 283440 - DNA, 25 bp, Homo sapien
agaaatggcctgagctcagccacgg

SEQ ID NO: 283441 - DNA, 25 bp, Homo sapien
aaatggcctgagctcagccacggtc

SEQ ID NO: 283442 - DNA, 25 bp, Homo sapien
atggcctgagctcagccacggtctt

SEQ ID NO: 283443 - DNA, 25 bp, Homo sapien
tgagctcagccacggtcttcacctg

SEQ ID NO: 283444 - DNA, 25 bp, Homo sapien
gtccccttcattcacagtgctgctg

SEQ ID NO: 283445 - DNA, 25 bp, Homo sapien
ccccttcattcacagtgctgctgag

SEQ ID NO: 283446 - DNA, 25 bp, Homo sapien
tgccccgcatggacctgccactggc

SEQ ID NO: 283447 - DNA, 25 bp, Homo sapien
ttggcccgaggtcgttcaccgcgaa

SEQ ID NO: 283448 - DNA, 25 bp, Homo sapien
gtcgttcaccgcgaaaatggattag

SEQ ID NO: 283449 - DNA, 25 bp, Homo sapien
gattagagaaacttcttccccgatt

SEQ ID NO: 283450 - DNA, 25 bp, Homo sapien
gaattcgccctagagctgtatcatg

SEQ ID NO: 283451 - DNA, 25 bp, Homo sapien
gggaaagattcctgcggccagcgct

SEQ ID NO: 283452 - DNA, 25 bp, Homo sapien
gaaagtgccccgaccgcagaggcga

SEQ ID NO: 283453 - DNA, 25 bp, Homo sapien
aagctgctcacggtagtcggcgttg

SEQ ID NO: 283454 - DNA, 25 bp, Homo sapien
gcagcggtggccttcctcatctggg

SEQ ID NO: 283455 - DNA, 25 bp, Homo sapien
gagctgtatcatgtattttctttca

SEQ ID NO: 283456 - DNA, 25 bp, Homo sapien
ctcatctgggcgatgtgggctccga

SEQ ID NO: 283457 - DNA, 25 bp, Homo sapien
gcaacaaaagcaaacttggcccgag

SEQ ID NO: 283458 - DNA, 25 bp, Homo sapien
gtatgcagactttctctctgagtag

SEQ ID NO: 283459 - DNA, 25 bp, Homo sapien
caatttgggtgaataaaggcctgaa

SEQ ID NO: 283460 - DNA, 25 bp, Homo sapien
ctgaagagttattttaccctccttg

SEQ ID NO: 283461 - DNA, 25 bp, Homo sapien
accctccttgcctgatgtaggacag

SEQ ID NO: 283462 - DNA, 25 bp, Homo sapien
ggacagtggaattgtacagccttta

SEQ ID NO: 283463 - DNA, 25 bp, Homo sapien
ttgtacagcctttatgaacctgccc

SEQ ID NO: 283464 - DNA, 25 bp, Homo sapien
ccctttatgtgtggcggatctgatt

SEQ ID NO: 283465 - DNA, 25 bp, Homo sapien
ggatctgattcctaactgaccaaag

SEQ ID NO: 283466 - DNA, 25 bp, Homo sapien
gaacaaaagccacttttcttacatt

SEQ ID NO: 283467 - DNA, 25 bp, Homo sapien
aatattcatatctaccacgaacatg

SEQ ID NO: 283468 - DNA, 25 bp, Homo sapien
atctaccacgaacatgatcatcaaa

SEQ ID NO: 283469 - DNA, 25 bp, Homo sapien
gtccaattggcgcatgccctgaggc

SEQ ID NO: 283470 - DNA, 25 bp, Homo sapien
cctgaggctctcattatacaaattg

SEQ ID NO: 283471 - DNA, 25 bp, Homo sapien
catcctgcctcaaaggagaagtggt

SEQ ID NO: 283472 - DNA, 25 bp, Homo sapien
gaatttgcataaggtccccaacagg

SEQ ID NO: 283473 - DNA, 25 bp, Homo sapien
ggtccccaacaggtgaaggcaggcc

SEQ ID NO: 283474 - DNA, 25 bp, Homo sapien
tctagatttcgtttttctgaccccg

SEQ ID NO: 283475 - DNA, 25 bp, Homo sapien
gggcttcacccaacactgggcgcag

SEQ ID NO: 283476 - DNA, 25 bp, Homo sapien
tttactgttttctccacctttagag

SEQ ID NO: 283477 - DNA, 25 bp, Homo sapien
gttttctccacctttagagggaatg

SEQ ID NO: 283478 - DNA, 25 bp, Homo sapien
tagagggaatgagggtccctgctcc

SEQ ID NO: 283479 - DNA, 25 bp, Homo sapien
ttactctactccactgtccaattgg

SEQ ID NO: 283480 - DNA, 25 bp, Homo sapien
tgggcctcccagaggacccttgctt

SEQ ID NO: 283481 - DNA, 25 bp, Homo sapien
gcctcccagaggacccttgcttggg

SEQ ID NO: 283482 - DNA, 25 bp, Homo sapien
atccccaagcctaggatctggcctt

SEQ ID NO: 283483 - DNA, 25 bp, Homo sapien
aagcctaggatctggccttggaacc

SEQ ID NO: 283484 - DNA, 25 bp, Homo sapien
agcctaggatctggccttggaaccg

SEQ ID NO: 283485 - DNA, 25 bp, Homo sapien
ctaggatctggccttggaaccgagc

SEQ ID NO: 283486 - DNA, 25 bp, Homo sapien
aggatctggccttggaaccgagcct

SEQ ID NO: 283487 - DNA, 25 bp, Homo sapien
gatctggccttggaaccgagcctct

SEQ ID NO: 283488 - DNA, 25 bp, Homo sapien
tctggccttggaaccgagcctctgc

SEQ ID NO: 283489 - DNA, 25 bp, Homo sapien
agccacagaccaaagaggcggcggc

SEQ ID NO: 283490 - DNA, 25 bp, Homo sapien
agaggcggcggccccaatccctgat

SEQ ID NO: 283491 - DNA, 25 bp, Homo sapien
aataggtcgatattcctgttgcagg

SEQ ID NO: 283492 - DNA, 25 bp, Homo sapien
ctgttgcaggaccatttgaagtctg

SEQ ID NO: 283493 - DNA, 25 bp, Homo sapien
gaagtctgagagtttctaggtgaga

SEQ ID NO: 283494 - DNA, 25 bp, Homo sapien
gtgagaggaaacgaacctggttact

SEQ ID NO: 283495 - DNA, 25 bp, Homo sapien
gaattggaaccaagtggcaccccaa

SEQ ID NO: 283496 - DNA, 25 bp, Homo sapien
gtggcaccccaagagaactagcttt

SEQ ID NO: 283497 - DNA, 25 bp, Homo sapien
aactagctttcagtggcatgtttct

SEQ ID NO: 283498 - DNA, 25 bp, Homo sapien
ttctcccagaaggttgaacttgcat

SEQ ID NO: 283499 - DNA, 25 bp, Homo sapien
gaacttgcattgtccagaggcaaat

SEQ ID NO: 283500 - DNA, 25 bp, Homo sapien
atgtgtatcggacatggctgtgcat

SEQ ID NO: 283501 - DNA, 25 bp, Homo sapien
acatggctgtgcatattgggcggaa

SEQ ID NO: 283502 - DNA, 25 bp, Homo sapien
gaaaaacacatcaagtcttcaccaa

SEQ ID NO: 283503 - DNA, 25 bp, Homo sapien
tgaattttctactctgtgcacctga

SEQ ID NO: 283504 - DNA, 25 bp, Homo sapien
gcactggaggcaatgaagacacggc

SEQ ID NO: 283505 - DNA, 25 bp, Homo sapien
gaagacacggcggagtcccagctcg

SEQ ID NO: 283506 - DNA, 25 bp, Homo sapien
agctcgcagggagctcaggttctga

SEQ ID NO: 283507 - DNA, 25 bp, Homo sapien
gagctcaggttctgacggcgtcaga

SEQ ID NO: 283508 - DNA, 25 bp, Homo sapien
acggcgtcagaggacaacacgctct

SEQ ID NO: 283509 - DNA, 25 bp, Homo sapien
gaggacaacacgctctggaccagcg

SEQ ID NO: 283510 - DNA, 25 bp, Homo sapien
ctggaccagcgcagcgcccaagggt

SEQ ID NO: 283511 - DNA, 25 bp, Homo sapien
tcttcgggaggcatgaaaggcagac

SEQ ID NO: 283512 - DNA, 25 bp, Homo sapien
aaggcagacgtgttccgaaacgtga

SEQ ID NO: 283513 - DNA, 25 bp, Homo sapien
gactggctttagatatcatgactca

SEQ ID NO: 283514 - DNA, 25 bp, Homo sapien
ggagatgtataaggcaaccacaaat

SEQ ID NO: 283515 - DNA, 25 bp, Homo sapien
gtattagtaatattctcccatgtat

SEQ ID NO: 283516 - DNA, 25 bp, Homo sapien
aatattctcccatgtattaactaga

SEQ ID NO: 283517 - DNA, 25 bp, Homo sapien
catttcttctagtgtgccttagcaa

SEQ ID NO: 283518 - DNA, 25 bp, Homo sapien
gtgtgccttagcaaatctgctggaa

SEQ ID NO: 283519 - DNA, 25 bp, Homo sapien
tctgctggaaagagtctagttgttt

SEQ ID NO: 283520 - DNA, 25 bp, Homo sapien
aaaatgtgtctctcaatttgtcaat

SEQ ID NO: 283521 - DNA, 25 bp, Homo sapien
caatttgtcaattctaagcctgtaa

SEQ ID NO: 283522 - DNA, 25 bp, Homo sapien
gtaaaggcagaaactatccacagta

SEQ ID NO: 283523 - DNA, 25 bp, Homo sapien
gcagaaactatccacagtaatgagt

SEQ ID NO: 283524 - DNA, 25 bp, Homo sapien
aacaaacatcttttgcctctggcag

SEQ ID NO: 283525 - DNA, 25 bp, Homo sapien
aacatcttttgcctctggcagtact

SEQ ID NO: 283526 - DNA, 25 bp, Homo sapien
ttttgcctctggcagtactcaaggg

SEQ ID NO: 283527 - DNA, 25 bp, Homo sapien
attaaaatgtcaagtgccacaggga

SEQ ID NO: 283528 - DNA, 25 bp, Homo sapien
gtcaagtgccacagggaagagaaat

SEQ ID NO: 283529 - DNA, 25 bp, Homo sapien
gaaatttgtatttctagctagtact

SEQ ID NO: 283530 - DNA, 25 bp, Homo sapien
atttctagctagtactatttaacac

SEQ ID NO: 283531 - DNA, 25 bp, Homo sapien
atttaacacaacttcacaatactaa

SEQ ID NO: 283532 - DNA, 25 bp, Homo sapien
atctcaaaaaggaagccacttgctt

SEQ ID NO: 283533 - DNA, 25 bp, Homo sapien
ggaagccacttgcttgatatcaaaa

SEQ ID NO: 283534 - DNA, 25 bp, Homo sapien
cttgcttgatatcaaaagtgctgtg

SEQ ID NO: 283535 - DNA, 25 bp, Homo sapien
gacagagtcattagaaaacccttca

SEQ ID NO: 283536 - DNA, 25 bp, Homo sapien
aaacccttcatgactgtggcgtgga

SEQ ID NO: 283537 - DNA, 25 bp, Homo sapien
aggtcaccaaagacactgcccttgt

SEQ ID NO: 283538 - DNA, 25 bp, Homo sapien
aaagggctggcaaggatcacaaaca

SEQ ID NO: 283539 - DNA, 25 bp, Homo sapien
cagctttcctgggtttggtcttaca

SEQ ID NO: 283540 - DNA, 25 bp, Homo sapien
gtttggtcttacagcatggacttct

SEQ ID NO: 283541 - DNA, 25 bp, Homo sapien
tcttcaccctcatctacacgtaaaa

SEQ ID NO: 283542 - DNA, 25 bp, Homo sapien
aagacactgcccttgtacctggaag

SEQ ID NO: 283543 - DNA, 25 bp, Homo sapien
ggagatcagggttgcctctaccttg

SEQ ID NO: 283544 - DNA, 25 bp, Homo sapien
ttgcattcctatgtagccatgaatt

SEQ ID NO: 283545 - DNA, 25 bp, Homo sapien
tgtagccatgaattaattcccaaat

SEQ ID NO: 283546 - DNA, 25 bp, Homo sapien
gcaacaaagtgagattgttcctaca

SEQ ID NO: 283547 - DNA, 25 bp, Homo sapien
caacaaagtgagattgttcctacaa

SEQ ID NO: 283548 - DNA, 25 bp, Homo sapien
aacaaagtgagattgttcctacaaa

SEQ ID NO: 283549 - DNA, 25 bp, Homo sapien
acaaagtgagattgttcctacaaaa

SEQ ID NO: 283550 - DNA, 25 bp, Homo sapien
caaagtgagattgttcctacaaaaa

SEQ ID NO: 283551 - DNA, 25 bp, Homo sapien
agtgagattgttcctacaaaaaaat

SEQ ID NO: 283552 - DNA, 25 bp, Homo sapien
gtgagattgttcctacaaaaaaata

SEQ ID NO: 283553 - DNA, 25 bp, Homo sapien
tgagattgttcctacaaaaaaatat

SEQ ID NO: 283554 - DNA, 25 bp, Homo sapien
gagattgttcctacaaaaaaatata

SEQ ID NO: 283555 - DNA, 25 bp, Homo sapien
agattgttcctacaaaaaaatatat

SEQ ID NO: 283556 - DNA, 25 bp, Homo sapien
gagtagccgtgattacaggcgtgtg

SEQ ID NO: 283557 - DNA, 25 bp, Homo sapien
tgtcaattactcatactaccaccat

SEQ ID NO: 283558 - DNA, 25 bp, Homo sapien
aattactcatactaccaccatccag

SEQ ID NO: 283559 - DNA, 25 bp, Homo sapien
accaccatccagaaatatcactctg

SEQ ID NO: 283560 - DNA, 25 bp, Homo sapien
atatcactctgaacatgttggcaca

SEQ ID NO: 283561 - DNA, 25 bp, Homo sapien
tgaacatgttggcacacatccttcc

SEQ ID NO: 283562 - DNA, 25 bp, Homo sapien
ggcacacatccttcctaacattttt

SEQ ID NO: 283563 - DNA, 25 bp, Homo sapien
cctaacatttttctctacacataac

SEQ ID NO: 283564 - DNA, 25 bp, Homo sapien
cacataacacgtgtgtaagactttt

SEQ ID NO: 283565 - DNA, 25 bp, Homo sapien
tcctgaacacgcatgcttccttata

SEQ ID NO: 283566 - DNA, 25 bp, Homo sapien
gaacacgcatgcttccttataaaag

SEQ ID NO: 283567 - DNA, 25 bp, Homo sapien
gcatgcttccttataaaaggtgtgt

SEQ ID NO: 283568 - DNA, 25 bp, Homo sapien
agtttttgaagtacatcttctggcc

SEQ ID NO: 283569 - DNA, 25 bp, Homo sapien
gccccttgagtactgccagaggcaa

SEQ ID NO: 283570 - DNA, 25 bp, Homo sapien
attccacttttgtctcctgggatcc

SEQ ID NO: 283571 - DNA, 25 bp, Homo sapien
atcccttctgtagcctaaagtatgg

SEQ ID NO: 283572 - DNA, 25 bp, Homo sapien
cctaaagtatggctgggaaatggac

SEQ ID NO: 283573 - DNA, 25 bp, Homo sapien
aatggacttgagaagattggcttga

SEQ ID NO: 283574 - DNA, 25 bp, Homo sapien
tcataatcatgtgtgatcccatcat

SEQ ID NO: 283575 - DNA, 25 bp, Homo sapien
gtgatcccatcatgaattcattgga

SEQ ID NO: 283576 - DNA, 25 bp, Homo sapien
ttggaatttgtgttgcatgtaaggc

SEQ ID NO: 283577 - DNA, 25 bp, Homo sapien
tgcatgtaaggcaatctttcctgtt

SEQ ID NO: 283578 - DNA, 25 bp, Homo sapien
tctttcctgttgtaaatcttccttt

SEQ ID NO: 283579 - DNA, 25 bp, Homo sapien
aatagtaaacagacttgctgcccac

SEQ ID NO: 283580 - DNA, 25 bp, Homo sapien
tagtaaacagacttgctgcccacct

SEQ ID NO: 283581 - DNA, 25 bp, Homo sapien
taaacagacttgctgcccaccttgg

SEQ ID NO: 283582 - DNA, 25 bp, Homo sapien
gacttgctgcccaccttggctggga

SEQ ID NO: 283583 - DNA, 25 bp, Homo sapien
ttggctgggaaaccaagtcccgtga

SEQ ID NO: 283584 - DNA, 25 bp, Homo sapien
gctgggaaaccaagtcccgtgagta

SEQ ID NO: 283585 - DNA, 25 bp, Homo sapien
accaagtcccgtgagtaactagtct

SEQ ID NO: 283586 - DNA, 25 bp, Homo sapien
aagtcccgtgagtaactagtctaag

SEQ ID NO: 283587 - DNA, 25 bp, Homo sapien
cgtgagtaactagtctaaggccact

SEQ ID NO: 283588 - DNA, 25 bp, Homo sapien
agtaactagtctaaggccactcagg

SEQ ID NO: 283589 - DNA, 25 bp, Homo sapien
taactagtctaaggccactcaggcc

SEQ ID NO: 283590 - DNA, 25 bp, Homo sapien
cccaggtgcatttattgtgccagaa

SEQ ID NO: 283591 - DNA, 25 bp, Homo sapien
ggtgcatttattgtgccagaaacag

SEQ ID NO: 283592 - DNA, 25 bp, Homo sapien
ttacaattcaatggtagtgcttaat

SEQ ID NO: 283593 - DNA, 25 bp, Homo sapien
ttcaatggtagtgcttaatgttact

SEQ ID NO: 283594 - DNA, 25 bp, Homo sapien
gttactgtctgaaatccactgttta

SEQ ID NO: 283595 - DNA, 25 bp, Homo sapien
tgtctgaaatccactgtttaaccag

SEQ ID NO: 283596 - DNA, 25 bp, Homo sapien
tgaaatccactgtttaaccagatgg

SEQ ID NO: 283597 - DNA, 25 bp, Homo sapien
ccactgtttaaccagatggaagact

SEQ ID NO: 283598 - DNA, 25 bp, Homo sapien
gactggggccattcaaaacattatt

SEQ ID NO: 283599 - DNA, 25 bp, Homo sapien
agttcacaagtgtttgctgttaaaa

SEQ ID NO: 283600 - DNA, 25 bp, Homo sapien
ctgtacttgggcaggtcccagcagc

SEQ ID NO: 283601 - DNA, 25 bp, Homo sapien
taaatcgagtttttaggcttcaaat

SEQ ID NO: 283602 - DNA, 25 bp, Homo sapien
ttaggcttcaaatcgaggcattgtc

SEQ ID NO: 283603 - DNA, 25 bp, Homo sapien
aaatcgaggcattgtcaagacataa

SEQ ID NO: 283604 - DNA, 25 bp, Homo sapien
ggttcaacatatcaaggctaggcct

SEQ ID NO: 283605 - DNA, 25 bp, Homo sapien
aaggctaggcctggtggaccaaatg

SEQ ID NO: 283606 - DNA, 25 bp, Homo sapien
ggaccaaatgatagggtttctccca

SEQ ID NO: 283607 - DNA, 25 bp, Homo sapien
gggtttctcccatagtaaagacaag

SEQ ID NO: 283608 - DNA, 25 bp, Homo sapien
acaaggtatcttagtccagtatgaa

SEQ ID NO: 283609 - DNA, 25 bp, Homo sapien
agtccagtatgaaggatttagtcag

SEQ ID NO: 283610 - DNA, 25 bp, Homo sapien
gaaaatcctattctctttggcttgg

SEQ ID NO: 283611 - DNA, 25 bp, Homo sapien
ctctttggcttggagaattacggga

SEQ ID NO: 283612 - DNA, 25 bp, Homo sapien
cattttgactggtcttcatgatgag

SEQ ID NO: 283613 - DNA, 25 bp, Homo sapien
ttgactggtcttcatgatgagtttc

SEQ ID NO: 283614 - DNA, 25 bp, Homo sapien
atcagagatttgaaagttgaacact

SEQ ID NO: 283615 - DNA, 25 bp, Homo sapien
cttaagaagaagtgtatgggctaaa

SEQ ID NO: 283616 - DNA, 25 bp, Homo sapien
gtatgggctaaagaaagctatggaa

SEQ ID NO: 283617 - DNA, 25 bp, Homo sapien
ataagcagaattttacagggcaagt

SEQ ID NO: 283618 - DNA, 25 bp, Homo sapien
tacagggcaagtagattcttgcttg

SEQ ID NO: 283619 - DNA, 25 bp, Homo sapien
gtagattcttgcttgggcaagctct

SEQ ID NO: 283620 - DNA, 25 bp, Homo sapien
gcttgggcaagctctggaaataaaa

SEQ ID NO: 283621 - DNA, 25 bp, Homo sapien
ttgggcaagctctggaaataaaact

SEQ ID NO: 283622 - DNA, 25 bp, Homo sapien
aggaacagtaattgcaaagtagatt

SEQ ID NO: 283623 - DNA, 25 bp, Homo sapien
gaaggtgatgtattcagactcagtc

SEQ ID NO: 283624 - DNA, 25 bp, Homo sapien
tcagactcagtcaaggcaaggacct

SEQ ID NO: 283625 - DNA, 25 bp, Homo sapien
ggacctgatctatcttgtcatagct

SEQ ID NO: 283626 - DNA, 25 bp, Homo sapien
ttgtcatagctttatgtcccactcc

SEQ ID NO: 283627 - DNA, 25 bp, Homo sapien
ggaacacagcccactacatagcagg

SEQ ID NO: 283628 - DNA, 25 bp, Homo sapien
gcaggcacccaacaaatacattaca

SEQ ID NO: 283629 - DNA, 25 bp, Homo sapien
aacattgagtcaactagttaactag

SEQ ID NO: 283630 - DNA, 25 bp, Homo sapien
aatcacttttactgggttattgttg

SEQ ID NO: 283631 - DNA, 25 bp, Homo sapien
tactgggttattgttgtggccaaat

SEQ ID NO: 283632 - DNA, 25 bp, Homo sapien
taggatgaatccctatctgagtggg

SEQ ID NO: 283633 - DNA, 25 bp, Homo sapien
aggtatttgattgtcttagaagcag

SEQ ID NO: 283634 - DNA, 25 bp, Homo sapien
ctataagaacatgaaatcggtgctg

SEQ ID NO: 283635 - DNA, 25 bp, Homo sapien
atcggtgctgtaccaaagccttata

SEQ ID NO: 283636 - DNA, 25 bp, Homo sapien
atatgaacatattctacactctgta

SEQ ID NO: 283637 - DNA, 25 bp, Homo sapien
tctacactctgtataacctgtctgt

SEQ ID NO: 283638 - DNA, 25 bp, Homo sapien
ataacctgtctgtgaggagctccct

SEQ ID NO: 283639 - DNA, 25 bp, Homo sapien
gtctgtgaggagctccctgctctat

SEQ ID NO: 283640 - DNA, 25 bp, Homo sapien
ctgggaatgccagcgcgtgccaagc

SEQ ID NO: 283641 - DNA, 25 bp, Homo sapien
aatgccagcgcgtgccaagcctggg

SEQ ID NO: 283642 - DNA, 25 bp, Homo sapien
acaagggcacctgggaagtaaagat

SEQ ID NO: 283643 - DNA, 25 bp, Homo sapien
ggacaccctttcctggctggcctga

SEQ ID NO: 283644 - DNA, 25 bp, Homo sapien
agcagacctgcaaggaaacccagat

SEQ ID NO: 283645 - DNA, 25 bp, Homo sapien
gctgctttcttgtacattgttctcg

SEQ ID NO: 283646 - DNA, 25 bp, Homo sapien
attgttctcgttttctaaactcctg

SEQ ID NO: 283647 - DNA, 25 bp, Homo sapien
taaactcctggccacttaattgtac

SEQ ID NO: 283648 - DNA, 25 bp, Homo sapien
ttaattgtaccctgcttaacccatc

SEQ ID NO: 283649 - DNA, 25 bp, Homo sapien
atcctcttgttttctggctcaacgc

SEQ ID NO: 283650 - DNA, 25 bp, Homo sapien
ggctcaacgctctttcatgtggtgg

SEQ ID NO: 283651 - DNA, 25 bp, Homo sapien
ggtggcctgcattttaggtcttaac

SEQ ID NO: 283652 - DNA, 25 bp, Homo sapien
aggtcttaactgcataggctttcaa

SEQ ID NO: 283653 - DNA, 25 bp, Homo sapien
ggctttcaacgccttggttttgcct

SEQ ID NO: 283654 - DNA, 25 bp, Homo sapien
ggttttgcctttccttgatgtttat

SEQ ID NO: 283655 - DNA, 25 bp, Homo sapien
tgatgtttatttgaccttgcccgag

SEQ ID NO: 283656 - DNA, 25 bp, Homo sapien
aagggcttctgagcagactgcttct

SEQ ID NO: 283657 - DNA, 25 bp, Homo sapien
gggaggagatagctgccctctccat

SEQ ID NO: 283658 - DNA, 25 bp, Homo sapien
ccactcttcatcatgggcatcttga

SEQ ID NO: 283659 - DNA, 25 bp, Homo sapien
catcttgaatctgccctactattgg

SEQ ID NO: 283660 - DNA, 25 bp, Homo sapien
ctactattggccacatttgttagag

SEQ ID NO: 283661 - DNA, 25 bp, Homo sapien
ttgttagaggaacacctgcccatcg

SEQ ID NO: 283662 - DNA, 25 bp, Homo sapien
tcgccccaggcacacataaataaaa

SEQ ID NO: 283663 - DNA, 25 bp, Homo sapien
aaaattcccaaagagcaagcttaga

SEQ ID NO: 283664 - DNA, 25 bp, Homo sapien
tagaggtaatctagtcagccccagg

SEQ ID NO: 283665 - DNA, 25 bp, Homo sapien
aatgctgccatgtctagcgtgggat

SEQ ID NO: 283666 - DNA, 25 bp, Homo sapien
tctagcgtgggatgcatgaaaaatt

SEQ ID NO: 283667 - DNA, 25 bp, Homo sapien
aaaaaaaccagcatacatatgcaaa

SEQ ID NO: 283668 - DNA, 25 bp, Homo sapien
aaaaaaccagcatacatatgcaaaa

SEQ ID NO: 283669 - DNA, 25 bp, Homo sapien
aaaaaccagcatacatatgcaaaac

SEQ ID NO: 283670 - DNA, 25 bp, Homo sapien
aaaaccagcatacatatgcaaaact

SEQ ID NO: 283671 - DNA, 25 bp, Homo sapien
aaaccagcatacatatgcaaaacta

SEQ ID NO: 283672 - DNA, 25 bp, Homo sapien
aaccagcatacatatgcaaaactat

SEQ ID NO: 283673 - DNA, 25 bp, Homo sapien
accagcatacatatgcaaaactata

SEQ ID NO: 283674 - DNA, 25 bp, Homo sapien
ccagcatacatatgcaaaactatat

SEQ ID NO: 283675 - DNA, 25 bp, Homo sapien
cagcatacatatgcaaaactatata

SEQ ID NO: 283676 - DNA, 25 bp, Homo sapien
agcatacatatgcaaaactatatat

SEQ ID NO: 283677 - DNA, 25 bp, Homo sapien
tatagcatactttggatgcctaggg

SEQ ID NO: 283678 - DNA, 25 bp, Homo sapien
gagctctggagtttgtggaagcacc

SEQ ID NO: 283679 - DNA, 25 bp, Homo sapien
gtttgtggaagcaccagagaaacca

SEQ ID NO: 283680 - DNA, 25 bp, Homo sapien
agagaaaccacagtaccacagatag

SEQ ID NO: 283681 - DNA, 25 bp, Homo sapien
aaggaccaaacatacatctctaatt

SEQ ID NO: 283682 - DNA, 25 bp, Homo sapien
gaaatttatatgcacaattccagag

SEQ ID NO: 283683 - DNA, 25 bp, Homo sapien
gggaacacacatccaatgttctggc

SEQ ID NO: 283684 - DNA, 25 bp, Homo sapien
atccaatgttctggcttttcatggg

SEQ ID NO: 283685 - DNA, 25 bp, Homo sapien
ggctgcctgaggaattggtttctgt

SEQ ID NO: 283686 - DNA, 25 bp, Homo sapien
aattggtttctgtctcacctgactc

SEQ ID NO: 283687 - DNA, 25 bp, Homo sapien
gtctcacctgactcagagcagtgat

SEQ ID NO: 283688 - DNA, 25 bp, Homo sapien
agggggacaagttgccttctctctc

SEQ ID NO: 283689 - DNA, 25 bp, Homo sapien
gtctgttcgtccgtcttttttgttg

SEQ ID NO: 283690 - DNA, 25 bp, Homo sapien
tgttcgtccgtcttttttgttgttg

SEQ ID NO: 283691 - DNA, 25 bp, Homo sapien
gtttttatatattgaagcgcctggc

SEQ ID NO: 283692 - DNA, 25 bp, Homo sapien
ttatatattgaagcgcctggcccag

SEQ ID NO: 283693 - DNA, 25 bp, Homo sapien
ccccgcactgcggttaatttatgtg

SEQ ID NO: 283694 - DNA, 25 bp, Homo sapien
ctgcggttaatttatgtgttgttta

SEQ ID NO: 283695 - DNA, 25 bp, Homo sapien
gtgttgtttaaaatgcggctgctct

SEQ ID NO: 283696 - DNA, 25 bp, Homo sapien
gttgtttaaaatgcggctgctctgc

SEQ ID NO: 283697 - DNA, 25 bp, Homo sapien
tctgcttctgccgtatccctaataa

SEQ ID NO: 283698 - DNA, 25 bp, Homo sapien
gcttctgccgtatccctaataaaat

SEQ ID NO: 283699 - DNA, 25 bp, Homo sapien
ccccacacggagactgactctaaaa

SEQ ID NO: 283700 - DNA, 25 bp, Homo sapien
acacggagactgactctaaaaccct

SEQ ID NO: 283701 - DNA, 25 bp, Homo sapien
cggagactgactctaaaacccttca

SEQ ID NO: 283702 - DNA, 25 bp, Homo sapien
ggagactgactctaaaacccttcat

SEQ ID NO: 283703 - DNA, 25 bp, Homo sapien
gagactgactctaaaacccttcatc

SEQ ID NO: 283704 - DNA, 25 bp, Homo sapien
gactgactctaaaacccttcatcca

SEQ ID NO: 283705 - DNA, 25 bp, Homo sapien
gactctaaaacccttcatccaatgg

SEQ ID NO: 283706 - DNA, 25 bp, Homo sapien
ctctaaaacccttcatccaatggtg

SEQ ID NO: 283707 - DNA, 25 bp, Homo sapien
cagagaagcacagaccccgccaggg

SEQ ID NO: 283708 - DNA, 25 bp, Homo sapien
ggcctgtctgggactggccttcccg

SEQ ID NO: 283709 - DNA, 25 bp, Homo sapien
ggcaccagactgattctgaggcaca

SEQ ID NO: 283710 - DNA, 25 bp, Homo sapien
agatgtgagctaccactcacggccc

SEQ ID NO: 283711 - DNA, 25 bp, Homo sapien
tcacggcccaaatcttcttgatcat

SEQ ID NO: 283712 - DNA, 25 bp, Homo sapien
ggcccaaatcttcttgatcatatgt

SEQ ID NO: 283713 - DNA, 25 bp, Homo sapien
agcatgagttgtcacttcttgtttg

SEQ ID NO: 283714 - DNA, 25 bp, Homo sapien
atgagttgtcacttcttgtttgcct

SEQ ID NO: 283715 - DNA, 25 bp, Homo sapien
ttgtcacttcttgtttgcctttttt

SEQ ID NO: 283716 - DNA, 25 bp, Homo sapien
gttggagagttacatcattgctaat

SEQ ID NO: 283717 - DNA, 25 bp, Homo sapien
gagttacatcattgctaatgtagaa

SEQ ID NO: 283718 - DNA, 25 bp, Homo sapien
ctagattctacatttatttgtgggt

SEQ ID NO: 283719 - DNA, 25 bp, Homo sapien
ctttctttccacagcacttttgata

SEQ ID NO: 283720 - DNA, 25 bp, Homo sapien
ttctttccacagcacttttgatatc

SEQ ID NO: 283721 - DNA, 25 bp, Homo sapien
ttcctaaaacatataaccagtacat

SEQ ID NO: 283722 - DNA, 25 bp, Homo sapien
gtacatcaatactaaggttatagcc

SEQ ID NO: 283723 - DNA, 25 bp, Homo sapien
ggttatagccacattcaacttgaat

SEQ ID NO: 283724 - DNA, 25 bp, Homo sapien
atttaccatgaatactgtgtcttac

SEQ ID NO: 283725 - DNA, 25 bp, Homo sapien
ctgtgtcttacaatgctgagctctc

SEQ ID NO: 283726 - DNA, 25 bp, Homo sapien
aatgctgagctctcgactagactaa

SEQ ID NO: 283727 - DNA, 25 bp, Homo sapien
gagctctcgactagactaaccagaa

SEQ ID NO: 283728 - DNA, 25 bp, Homo sapien
ctaaccagaataggaacacagtctc

SEQ ID NO: 283729 - DNA, 25 bp, Homo sapien
cacagtctcaaaggataccataaga

SEQ ID NO: 283730 - DNA, 25 bp, Homo sapien
acgtgaaaaactactatattcttga

SEQ ID NO: 283731 - DNA, 25 bp, Homo sapien
tgggagtagaatgtaagctctttga

SEQ ID NO: 283732 - DNA, 25 bp, Homo sapien
tgaaaattctttgttgttctacttt

SEQ ID NO: 283733 - DNA, 25 bp, Homo sapien
caattgtaaagttgcagtgatgact

SEQ ID NO: 283734 - DNA, 25 bp, Homo sapien
gaaataactccaaaacaatgtaatt

SEQ ID NO: 283735 - DNA, 25 bp, Homo sapien
gaaggttcataaaaatcctgtaagg

SEQ ID NO: 283736 - DNA, 25 bp, Homo sapien
gttgcagtgatgacttttgtgaaac

SEQ ID NO: 283737 - DNA, 25 bp, Homo sapien
tgctgtaactttttctccctaaaga

SEQ ID NO: 283738 - DNA, 25 bp, Homo sapien
gcagtgatgacttttgtgaaacaaa

SEQ ID NO: 283739 - DNA, 25 bp, Homo sapien
gaaacaaggtccaactaatccaatg

SEQ ID NO: 283740 - DNA, 25 bp, Homo sapien
atccaatgctgtttcatcttgttcg

SEQ ID NO: 283741 - DNA, 25 bp, Homo sapien
gtttcatcttgttcgagacgtcaaa

SEQ ID NO: 283742 - DNA, 25 bp, Homo sapien
ttgttttttggcagtaaatgtgaaa

SEQ ID NO: 283743 - DNA, 25 bp, Homo sapien
gcgctagctccttctctcgcccggg

SEQ ID NO: 283744 - DNA, 25 bp, Homo sapien
ggttcctgccggtagctctccgggt

SEQ ID NO: 283745 - DNA, 25 bp, Homo sapien
tcctgccggtagctctccgggtctt

SEQ ID NO: 283746 - DNA, 25 bp, Homo sapien
tgccggtagctctccgggtcttggc

SEQ ID NO: 283747 - DNA, 25 bp, Homo sapien
gtagctctccgggtcttggcgcggc

SEQ ID NO: 283748 - DNA, 25 bp, Homo sapien
gctctccgggtcttggcgcggcggg

SEQ ID NO: 283749 - DNA, 25 bp, Homo sapien
cgggcggtatgtggcgcctggtgcc

SEQ ID NO: 283750 - DNA, 25 bp, Homo sapien
gtatgtggcgcctggtgcccccgaa

SEQ ID NO: 283751 - DNA, 25 bp, Homo sapien
tgtggcgcctggtgcccccgaagct

SEQ ID NO: 283752 - DNA, 25 bp, Homo sapien
tgtcccgctcgctgaagctggcggc

SEQ ID NO: 283753 - DNA, 25 bp, Homo sapien
gctcgctgaagctggcggcgctggg

SEQ ID NO: 283754 - DNA, 25 bp, Homo sapien
ccccacacggagactgactctaaaa

SEQ ID NO: 283755 - DNA, 25 bp, Homo sapien
acacggagactgactctaaaaccct

SEQ ID NO: 283756 - DNA, 25 bp, Homo sapien
cggagactgactctaaaacccttca

SEQ ID NO: 283757 - DNA, 25 bp, Homo sapien
ggagactgactctaaaacccttcat

SEQ ID NO: 283758 - DNA, 25 bp, Homo sapien
gagactgactctaaaacccttcatc

SEQ ID NO: 283759 - DNA, 25 bp, Homo sapien
gactgactctaaaacccttcatcca

SEQ ID NO: 283760 - DNA, 25 bp, Homo sapien
ctgactctaaaacccttcatccaat

SEQ ID NO: 283761 - DNA, 25 bp, Homo sapien
gactctaaaacccttcatccaatgg

SEQ ID NO: 283762 - DNA, 25 bp, Homo sapien
ctctaaaacccttcatccaatggtg

SEQ ID NO: 283763 - DNA, 25 bp, Homo sapien
cagaagggacacaaagagggatgga

SEQ ID NO: 283764 - DNA, 25 bp, Homo sapien
caggggcaccagactgattctgagg

SEQ ID NO: 283765 - DNA, 25 bp, Homo sapien
gatgtccgagatccaagtgaggcct

SEQ ID NO: 283766 - DNA, 25 bp, Homo sapien
gtccgagatccaagtgaggcctgtt

SEQ ID NO: 283767 - DNA, 25 bp, Homo sapien
gagatccaagtgaggcctgttcagt

SEQ ID NO: 283768 - DNA, 25 bp, Homo sapien
ccaagtgaggcctgttcagtgtgaa

SEQ ID NO: 283769 - DNA, 25 bp, Homo sapien
aggcctgttcagtgtgaaatgtcta

SEQ ID NO: 283770 - DNA, 25 bp, Homo sapien
tcagtgtgaaatgtctagggtagaa

SEQ ID NO: 283771 - DNA, 25 bp, Homo sapien
agaagaaagaccatcctccattatg

SEQ ID NO: 283772 - DNA, 25 bp, Homo sapien
aaagaccatcctccattatggctgg

SEQ ID NO: 283773 - DNA, 25 bp, Homo sapien
cctccattatggctggcatgtggca

SEQ ID NO: 283774 - DNA, 25 bp, Homo sapien
atggctggcatgtggcagtcatcct

SEQ ID NO: 283775 - DNA, 25 bp, Homo sapien
ggcagtcatccttaagattattttt

SEQ ID NO: 283776 - DNA, 25 bp, Homo sapien
tcttcaatacatgaccgagaaatta

SEQ ID NO: 283777 - DNA, 25 bp, Homo sapien
acatgaccgagaaattaggttcaac

SEQ ID NO: 283778 - DNA, 25 bp, Homo sapien
tgtgattttgatttaagaccatgtc

SEQ ID NO: 283779 - DNA, 25 bp, Homo sapien
taagaccatgtcatgaaacaacagt

SEQ ID NO: 283780 - DNA, 25 bp, Homo sapien
acaacagtagacatttttcataaga

SEQ ID NO: 283781 - DNA, 25 bp, Homo sapien
gacatttttcataagaagcatacaa

SEQ ID NO: 283782 - DNA, 25 bp, Homo sapien
aatatatgatgggtggtagcctaat

SEQ ID NO: 283783 - DNA, 25 bp, Homo sapien
tgatgggtggtagcctaatttgtat

SEQ ID NO: 283784 - DNA, 25 bp, Homo sapien
ggtggtagcctaatttgtattatgt

SEQ ID NO: 283785 - DNA, 25 bp, Homo sapien
ttgtattatgtctactttaagtgaa

SEQ ID NO: 283786 - DNA, 25 bp, Homo sapien
tctactttaagtgaatattggattt

SEQ ID NO: 283787 - DNA, 25 bp, Homo sapien
agccgtttgccaaagcaaggcctgt

SEQ ID NO: 283788 - DNA, 25 bp, Homo sapien
tttgccaaagcaaggcctgtgaggt

SEQ ID NO: 283789 - DNA, 25 bp, Homo sapien
cctgtgaggtgttgattcgggaaca

SEQ ID NO: 283790 - DNA, 25 bp, Homo sapien
tttgtgaaggttttgagctgggaaa

SEQ ID NO: 283791 - DNA, 25 bp, Homo sapien
tgctgttatccccaagggtaaacaa

SEQ ID NO: 283792 - DNA, 25 bp, Homo sapien
aaaatcagggcgaagctaaagctct

SEQ ID NO: 283793 - DNA, 25 bp, Homo sapien
tcagggcgaagctaaagctctagtt

SEQ ID NO: 283794 - DNA, 25 bp, Homo sapien
aagctctagttagggcatctctctg

SEQ ID NO: 283795 - DNA, 25 bp, Homo sapien
cccatcctgggagtgcactgagaca

SEQ ID NO: 283796 - DNA, 25 bp, Homo sapien
agctgggatcaggagccgtttgcca

SEQ ID NO: 283797 - DNA, 25 bp, Homo sapien
gatcaggagccgtttgccaaagcaa

SEQ ID NO: 283798 - DNA, 25 bp, Homo sapien
caaaacagattatggccctctgctg

SEQ ID NO: 283799 - DNA, 25 bp, Homo sapien
tgcacactctggctgaattcggatg

SEQ ID NO: 283800 - DNA, 25 bp, Homo sapien
ggctgaattcggatggcttctgaca

SEQ ID NO: 283801 - DNA, 25 bp, Homo sapien
atggcttctgacaagcgtgttgccc

SEQ ID NO: 283802 - DNA, 25 bp, Homo sapien
ttgcccacacctgtattgagacatg

SEQ ID NO: 283803 - DNA, 25 bp, Homo sapien
agcagatcgtattccttcagaggcc

SEQ ID NO: 283804 - DNA, 25 bp, Homo sapien
gaggccagttatgtggaattcagct

SEQ ID NO: 283805 - DNA, 25 bp, Homo sapien
gaattcagctgctcaaacaccagat

SEQ ID NO: 283806 - DNA, 25 bp, Homo sapien
gataagaaagccagccgccacataa

SEQ ID NO: 283807 - DNA, 25 bp, Homo sapien
agccactagtagaagcatcggatta

SEQ ID NO: 283808 - DNA, 25 bp, Homo sapien
ggattagacacaacctcgtcacaac

SEQ ID NO: 283809 - DNA, 25 bp, Homo sapien
gatcttggccaaataatttacaatt

SEQ ID NO: 283810 - DNA, 25 bp, Homo sapien
cattgcagacaaaactaccagtagt

SEQ ID NO: 283811 - DNA, 25 bp, Homo sapien
aactaccagtagtccatattgttta

SEQ ID NO: 283812 - DNA, 25 bp, Homo sapien
ctaccagtagtccatattgtttaat

SEQ ID NO: 283813 - DNA, 25 bp, Homo sapien
accagtagtccatattgtttaatat

SEQ ID NO: 283814 - DNA, 25 bp, Homo sapien
atttcagtcagagcctaaatcacat

SEQ ID NO: 283815 - DNA, 25 bp, Homo sapien
tcagtcagagcctaaatcacatttt

SEQ ID NO: 283816 - DNA, 25 bp, Homo sapien
agtcagagcctaaatcacattttga

SEQ ID NO: 283817 - DNA, 25 bp, Homo sapien
atcacattttgattgtctgaatttt

SEQ ID NO: 283818 - DNA, 25 bp, Homo sapien
gattgtctgaatttttgatactatt

SEQ ID NO: 283819 - DNA, 25 bp, Homo sapien
gtctgaatttttgatactattttta

SEQ ID NO: 283820 - DNA, 25 bp, Homo sapien
agtcggctcagcttgccacgaggga

SEQ ID NO: 283821 - DNA, 25 bp, Homo sapien
ggctcagcttgccacgagggaacct

SEQ ID NO: 283822 - DNA, 25 bp, Homo sapien
ttgccacgagggaacctcgggttag

SEQ ID NO: 283823 - DNA, 25 bp, Homo sapien
tgctccaagtctcctgtcctggtta

SEQ ID NO: 283824 - DNA, 25 bp, Homo sapien
tctcctgtcctggttatcccaagtt

SEQ ID NO: 283825 - DNA, 25 bp, Homo sapien
ttatcccaagttcagggcccacctg

SEQ ID NO: 283826 - DNA, 25 bp, Homo sapien
gggaactacttgtcttaaggctgta

SEQ ID NO: 283827 - DNA, 25 bp, Homo sapien
actacttgtcttaaggctgtaaaca

SEQ ID NO: 283828 - DNA, 25 bp, Homo sapien
gtcttaaggctgtaaacaatagttg

SEQ ID NO: 283829 - DNA, 25 bp, Homo sapien
agaggagttgctagcttttgagaac

SEQ ID NO: 283830 - DNA, 25 bp, Homo sapien
tgcctcgggcatcagcccacgagtg

SEQ ID NO: 283831 - DNA, 25 bp, Homo sapien
agctcacctgcatcctcaagggcga

SEQ ID NO: 283832 - DNA, 25 bp, Homo sapien
atcctcaagggcgactggctgggtc

SEQ ID NO: 283833 - DNA, 25 bp, Homo sapien
actggctgggtctctacaggcggtt

SEQ ID NO: 283834 - DNA, 25 bp, Homo sapien
tgggtctctacaggcggtttttcaa

SEQ ID NO: 283835 - DNA, 25 bp, Homo sapien
tctctacaggcggtttttcaagtcc

SEQ ID NO: 283836 - DNA, 25 bp, Homo sapien
ccattttgatggctggtaccggcag

SEQ ID NO: 283837 - DNA, 25 bp, Homo sapien
gcacaaggagatggccctgaagctg

SEQ ID NO: 283838 - DNA, 25 bp, Homo sapien
ggaggctatctgtgaggcgaacatc

SEQ ID NO: 283839 - DNA, 25 bp, Homo sapien
ggcgaacatcgagacctggatgaaa

SEQ ID NO: 283840 - DNA, 25 bp, Homo sapien
aggtcgtggacctggtcctgaaact

SEQ ID NO: 283841 - DNA, 25 bp, Homo sapien
gacctggtcctgaaacttcgtgaga

SEQ ID NO: 283842 - DNA, 25 bp, Homo sapien
gattgatcctgtcacgggaatggtt

SEQ ID NO: 283843 - DNA, 25 bp, Homo sapien
gtttcaaatctgaccaacctcatgg

SEQ ID NO: 283844 - DNA, 25 bp, Homo sapien
ctgaccaacctcatggcatacattg

SEQ ID NO: 283845 - DNA, 25 bp, Homo sapien
taaaacggccaagggagggctccat

SEQ ID NO: 283846 - DNA, 25 bp, Homo sapien
attgtgaaaccccttgattctttgg

SEQ ID NO: 283847 - DNA, 25 bp, Homo sapien
gattctttggatctggacatgctgt

SEQ ID NO: 283848 - DNA, 25 bp, Homo sapien
tctggacatgctgtactgtgacaat

SEQ ID NO: 283849 - DNA, 25 bp, Homo sapien
aaatgtagctgtgtctaccgggaaa

SEQ ID NO: 283850 - DNA, 25 bp, Homo sapien
atggcacgacctctgagtaacccag

SEQ ID NO: 283851 - DNA, 25 bp, Homo sapien
cccaggacactcctgtttgggaaat

SEQ ID NO: 283852 - DNA, 25 bp, Homo sapien
aatgcaaaccatccatacggcaggg

SEQ ID NO: 283853 - DNA, 25 bp, Homo sapien
aaaagacctctccttggacctattg

SEQ ID NO: 283854 - DNA, 25 bp, Homo sapien
ggacctattgcttaccagaaagaaa

SEQ ID NO: 283855 - DNA, 25 bp, Homo sapien
agaaaaggtcccaaggcctccactg

SEQ ID NO: 283856 - DNA, 25 bp, Homo sapien
cactggtctcactggcaaggactga

SEQ ID NO: 283857 - DNA, 25 bp, Homo sapien
ggactgaatcacatgtccatcagga

SEQ ID NO: 283858 - DNA, 25 bp, Homo sapien
cagagaccatctggagtcatcccta

SEQ ID NO: 283859 - DNA, 25 bp, Homo sapien
ccgtcccttggacagaattggagtt

SEQ ID NO: 283860 - DNA, 25 bp, Homo sapien
tggagtcatccctacgttgtggagg

SEQ ID NO: 283861 - DNA, 25 bp, Homo sapien
agcccattagagagtttgtcacttc

SEQ ID NO: 283862 - DNA, 25 bp, Homo sapien
agagagtttgtcacttcacggctgc

SEQ ID NO: 283863 - DNA, 25 bp, Homo sapien
ttcacggctgcctggctgccatggc

SEQ ID NO: 283864 - DNA, 25 bp, Homo sapien
caatgagtgctttttaattcttaca

SEQ ID NO: 283865 - DNA, 25 bp, Homo sapien
gtatttttccaattcccattttatg

SEQ ID NO: 283866 - DNA, 25 bp, Homo sapien
attcccattttatgcttcggtagcc

SEQ ID NO: 283867 - DNA, 25 bp, Homo sapien
tatgcttcggtagccctttgtattt

SEQ ID NO: 283868 - DNA, 25 bp, Homo sapien
ttatacttcaaaacacttggctctc

SEQ ID NO: 283869 - DNA, 25 bp, Homo sapien
acaagacagacctggttatgattcc

SEQ ID NO: 283870 - DNA, 25 bp, Homo sapien
ggttatgattcctggctctgaaagc

SEQ ID NO: 283871 - DNA, 25 bp, Homo sapien
gctctgaaagctgtacaccctgtga

SEQ ID NO: 283872 - DNA, 25 bp, Homo sapien
gtacaccctgtgaccctagacaggt

SEQ ID NO: 283873 - DNA, 25 bp, Homo sapien
acaggtgttttaatgcctcgctgcc

SEQ ID NO: 283874 - DNA, 25 bp, Homo sapien
gctgcctctgtttcttgctctgtaa

SEQ ID NO: 283875 - DNA, 25 bp, Homo sapien
ttctacaagatgcttaaggtcaatt

SEQ ID NO: 283876 - DNA, 25 bp, Homo sapien
caagatgcttaaggtcaattataca

SEQ ID NO: 283877 - DNA, 25 bp, Homo sapien
gaatgtttgattataggatccagag

SEQ ID NO: 283878 - DNA, 25 bp, Homo sapien
tttgattataggatccagagtacta

SEQ ID NO: 283879 - DNA, 25 bp, Homo sapien
ggtagtagggacactgaactcagtt

SEQ ID NO: 283880 - DNA, 25 bp, Homo sapien
gaactcagttttaatggtcaggaaa

SEQ ID NO: 283881 - DNA, 25 bp, Homo sapien
aaagtttgctggacaaaaggcaagt

SEQ ID NO: 283882 - DNA, 25 bp, Homo sapien
gaacataaacagaagtcacctcagg

SEQ ID NO: 283883 - DNA, 25 bp, Homo sapien
gttccttcgtgagtgaaagacatgc

SEQ ID NO: 283884 - DNA, 25 bp, Homo sapien
cttcgtgagtgaaagacatgcaggg

SEQ ID NO: 283885 - DNA, 25 bp, Homo sapien
gggtaggacatctaaagagtggtta

SEQ ID NO: 283886 - DNA, 25 bp, Homo sapien
gggtttgtgcccaccatggtgcgaa

SEQ ID NO: 283887 - DNA, 25 bp, Homo sapien
accatggtgcgaatcctgacccaag

SEQ ID NO: 283888 - DNA, 25 bp, Homo sapien
tggtgcgaatcctgacccaaggcct

SEQ ID NO: 283889 - DNA, 25 bp, Homo sapien
ggcctcctgtctcccttcaaaggga

SEQ ID NO: 283890 - DNA, 25 bp, Homo sapien
ggatgagtttgccagactccccgtg

SEQ ID NO: 283891 - DNA, 25 bp, Homo sapien
tccccgtgctggtttctttgttact

SEQ ID NO: 283892 - DNA, 25 bp, Homo sapien
ccgtgctggtttctttgttactatt

SEQ ID NO: 283893 - DNA, 25 bp, Homo sapien
gctggtttctttgttactatttgtt

SEQ ID NO: 283894 - DNA, 25 bp, Homo sapien
tgtgaacttgaatgaacactgctca

SEQ ID NO: 283895 - DNA, 25 bp, Homo sapien
gaacactgctcaaactttctgctat

SEQ ID NO: 283896 - DNA, 25 bp, Homo sapien
acactgctcaaactttctgctattg

SEQ ID NO: 283897 - DNA, 25 bp, Homo sapien
gaaaaccagagagctggacgacaag

SEQ ID NO: 283898 - DNA, 25 bp, Homo sapien
ggacgacaaggacacagtaacagca

SEQ ID NO: 283899 - DNA, 25 bp, Homo sapien
ggattcatctaaagggcattccgat

SEQ ID NO: 283900 - DNA, 25 bp, Homo sapien
aaagggcattccgatggagcaggca

SEQ ID NO: 283901 - DNA, 25 bp, Homo sapien
cattccgatggagcaggcaggctgc

SEQ ID NO: 283902 - DNA, 25 bp, Homo sapien
acaggcgagcgtgcactgcctgaaa

SEQ ID NO: 283903 - DNA, 25 bp, Homo sapien
aaagttttcatgatggctccagcct

SEQ ID NO: 283904 - DNA, 25 bp, Homo sapien
ttcatgatggctccagcctaatttc

SEQ ID NO: 283905 - DNA, 25 bp, Homo sapien
aaatcagcgaaagccaggatattaa

SEQ ID NO: 283906 - DNA, 25 bp, Homo sapien
atggttaaggacaagcaggcgaatt

SEQ ID NO: 283907 - DNA, 25 bp, Homo sapien
ggcgaattaagactctggaaaccga

SEQ ID NO: 283908 - DNA, 25 bp, Homo sapien
tcgtgtttacttttcgctctagatt

SEQ ID NO: 283909 - DNA, 25 bp, Homo sapien
aaatgtgattgtgcccttgactgta

SEQ ID NO: 283910 - DNA, 25 bp, Homo sapien
ttgtgcccttgactgtaccaaagtg

SEQ ID NO: 283911 - DNA, 25 bp, Homo sapien
gtaccaaagtgctgttgctataaca

SEQ ID NO: 283912 - DNA, 25 bp, Homo sapien
tgtagtttcaaatgcagtacccata

SEQ ID NO: 283913 - DNA, 25 bp, Homo sapien
tgcagtacccatatgaccttgatca

SEQ ID NO: 283914 - DNA, 25 bp, Homo sapien
gaccttgatcatattttagctattt

SEQ ID NO: 283915 - DNA, 25 bp, Homo sapien
ggattttggcagaagtagtcacatg

SEQ ID NO: 283916 - DNA, 25 bp, Homo sapien
gtagtcacatgcatgattgctctga

SEQ ID NO: 283917 - DNA, 25 bp, Homo sapien
ctctgatagattggttggcgtgtgc

SEQ ID NO: 283918 - DNA, 25 bp, Homo sapien
tttaactctcccacaggatggatgt

SEQ ID NO: 283919 - DNA, 25 bp, Homo sapien
cttctgtgttatagacatcatcatg

SEQ ID NO: 283920 - DNA, 25 bp, Homo sapien
tagacatcatcatggcacagtgccg

SEQ ID NO: 283921 - DNA, 25 bp, Homo sapien
atttactagaactttgcaatttcat

SEQ ID NO: 283922 - DNA, 25 bp, Homo sapien
atttagggcccttgagatggtgcaa

SEQ ID NO: 283923 - DNA, 25 bp, Homo sapien
gggcccttgagatggtgcaagaaaa

SEQ ID NO: 283924 - DNA, 25 bp, Homo sapien
tttttaagctatttgttctttctgt

SEQ ID NO: 283925 - DNA, 25 bp, Homo sapien
gttctttctgtgcaaattacataac

SEQ ID NO: 283926 - DNA, 25 bp, Homo sapien
cataacttccaattatttccaacgt

SEQ ID NO: 283927 - DNA, 25 bp, Homo sapien
gaaatagtccctctgaatcctttat

SEQ ID NO: 283928 - DNA, 25 bp, Homo sapien
atagtccctctgaatcctttatgat

SEQ ID NO: 283929 - DNA, 25 bp, Homo sapien
gtccctctgaatcctttatgattta

SEQ ID NO: 283930 - DNA, 25 bp, Homo sapien
aaccagaaaacctcatactcagtcc

SEQ ID NO: 283931 - DNA, 25 bp, Homo sapien
cctcatactcagtcctcagtgaaag

SEQ ID NO: 283932 - DNA, 25 bp, Homo sapien
taaggactttagacagaagagcatt

SEQ ID NO: 283933 - DNA, 25 bp, Homo sapien
cagaagagcattgtgtaacttgact

SEQ ID NO: 283934 - DNA, 25 bp, Homo sapien
gtaacttgactgaagatcatccatt

SEQ ID NO: 283935 - DNA, 25 bp, Homo sapien
gaagatcatccattaatagttatta

SEQ ID NO: 283936 - DNA, 25 bp, Homo sapien
tgtcaaaaacagtcaatagggctac

SEQ ID NO: 283937 - DNA, 25 bp, Homo sapien
tcaatagggctactgctggcccaaa

SEQ ID NO: 283938 - DNA, 25 bp, Homo sapien
tggcccaaagaccatttaggtccac

SEQ ID NO: 283939 - DNA, 25 bp, Homo sapien
agaccatttaggtccacctcctctt

SEQ ID NO: 283940 - DNA, 25 bp, Homo sapien
tgtgacagtttcactgtgtcgccca

SEQ ID NO: 283941 - DNA, 25 bp, Homo sapien
aagagctttattaggatacaattca

SEQ ID NO: 283942 - DNA, 25 bp, Homo sapien
cactcttttaacaactgaatggctt

SEQ ID NO: 283943 - DNA, 25 bp, Homo sapien
actgaatggctttagtacatccaca

SEQ ID NO: 283944 - DNA, 25 bp, Homo sapien
gtacatccacagagttgtgcaagca

SEQ ID NO: 283945 - DNA, 25 bp, Homo sapien
gttgtgcaagcattgccactaattt

SEQ ID NO: 283946 - DNA, 25 bp, Homo sapien
gaaaccgtatacctgttaacatcac

SEQ ID NO: 283947 - DNA, 25 bp, Homo sapien
tgttaacatcactcctcactattcc

SEQ ID NO: 283948 - DNA, 25 bp, Homo sapien
agtccctggcactcactcttctagt

SEQ ID NO: 283949 - DNA, 25 bp, Homo sapien
actcttctagtctctgtctctatag

SEQ ID NO: 283950 - DNA, 25 bp, Homo sapien
gtctctgtctctataggtttgcttt

SEQ ID NO: 283951 - DNA, 25 bp, Homo sapien
ctataggtttgctttttcaggacat

SEQ ID NO: 283952 - DNA, 25 bp, Homo sapien
tgatcatcctctgtcttgtatgtct

SEQ ID NO: 283953 - DNA, 25 bp, Homo sapien
ggaaagggttggaaactcttgacat

SEQ ID NO: 283954 - DNA, 25 bp, Homo sapien
aaagggttggaaactcttgacatga

SEQ ID NO: 283955 - DNA, 25 bp, Homo sapien
agggttggaaactcttgacatgagg

SEQ ID NO: 283956 - DNA, 25 bp, Homo sapien
ggttggaaactcttgacatgaggaa

SEQ ID NO: 283957 - DNA, 25 bp, Homo sapien
gttggaaactcttgacatgaggaat

SEQ ID NO: 283958 - DNA, 25 bp, Homo sapien
gaaactcttgacatgaggaatggtt

SEQ ID NO: 283959 - DNA, 25 bp, Homo sapien
ctcttgacatgaggaatggttgtta

SEQ ID NO: 283960 - DNA, 25 bp, Homo sapien
gcaggttttgaggaaaaccttctag

SEQ ID NO: 283961 - DNA, 25 bp, Homo sapien
gaaaaccttctagaagagtcccagt

SEQ ID NO: 283962 - DNA, 25 bp, Homo sapien
aaaccttctagaagagtcccagtat

SEQ ID NO: 283963 - DNA, 25 bp, Homo sapien
tgtgatcatgccatcacaccgctgc

SEQ ID NO: 283964 - DNA, 25 bp, Homo sapien
acaccgctgccttgtgagagattga

SEQ ID NO: 283965 - DNA, 25 bp, Homo sapien
gatgggaaatttccctgccagacct

SEQ ID NO: 283966 - DNA, 25 bp, Homo sapien
tgtttactagaaatcaggtggccaa

SEQ ID NO: 283967 - DNA, 25 bp, Homo sapien
ggtggccaaaacatgactctcagag

SEQ ID NO: 283968 - DNA, 25 bp, Homo sapien
gggcttcatgaccatgtgcatcaga

SEQ ID NO: 283969 - DNA, 25 bp, Homo sapien
catgaccatgtgcatcagaattgcc

SEQ ID NO: 283970 - DNA, 25 bp, Homo sapien
cagaattgcctggagtgtgcactga

SEQ ID NO: 283971 - DNA, 25 bp, Homo sapien
gtgtgcactgaaactgtgtattacc

SEQ ID NO: 283972 - DNA, 25 bp, Homo sapien
gtgtattaccaagctcactctagcc

SEQ ID NO: 283973 - DNA, 25 bp, Homo sapien
aagctcactctagccaactaaataa

SEQ ID NO: 283974 - DNA, 25 bp, Homo sapien
ggaaagataagaggaccaaacatat

SEQ ID NO: 283975 - DNA, 25 bp, Homo sapien
ccaaacatataaggtgaaattcaga

SEQ ID NO: 283976 - DNA, 25 bp, Homo sapien
tcagaattccgtttccttctaacta

SEQ ID NO: 283977 - DNA, 25 bp, Homo sapien
gaattccgtttccttctaactaatg

SEQ ID NO: 283978 - DNA, 25 bp, Homo sapien
ttatactttccttgctaaggtccca

SEQ ID NO: 283979 - DNA, 25 bp, Homo sapien
tactttccttgctaaggtcccatat

SEQ ID NO: 283980 - DNA, 25 bp, Homo sapien
tccttgctaaggtcccatatattga

SEQ ID NO: 283981 - DNA, 25 bp, Homo sapien
tgctaaggtcccatatattgatttg

SEQ ID NO: 283982 - DNA, 25 bp, Homo sapien
tttgtacagatccacttagtcattt

SEQ ID NO: 283983 - DNA, 25 bp, Homo sapien
agatccacttagtcattttctcctt

SEQ ID NO: 283984 - DNA, 25 bp, Homo sapien
atccacttagtcattttctcctttt

SEQ ID NO: 283985 - DNA, 25 bp, Homo sapien
tttgcttctggaactttgaaacaca

SEQ ID NO: 283986 - DNA, 25 bp, Homo sapien
aaaacacaagttggcacttacaatt

SEQ ID NO: 283987 - DNA, 25 bp, Homo sapien
acaattttaaagatgcagccagctc

SEQ ID NO: 283988 - DNA, 25 bp, Homo sapien
aagatgcagccagctctaaacaaca

SEQ ID NO: 283989 - DNA, 25 bp, Homo sapien
gcagccagctctaaacaacacacag

SEQ ID NO: 283990 - DNA, 25 bp, Homo sapien
taaacaacacacagagcacaaatat

SEQ ID NO: 283991 - DNA, 25 bp, Homo sapien
gcacaaatatgctcctgacggactc

SEQ ID NO: 283992 - DNA, 25 bp, Homo sapien
aatatgctcctgacggactcaggaa

SEQ ID NO: 283993 - DNA, 25 bp, Homo sapien
tgctcctgacggactcaggaaaatg

SEQ ID NO: 283994 - DNA, 25 bp, Homo sapien
aaaatgccaacagcagagcaccctg

SEQ ID NO: 283995 - DNA, 25 bp, Homo sapien
agcagagcaccctggtgccaaggcc

SEQ ID NO: 283996 - DNA, 25 bp, Homo sapien
aacttttacagctagtacattaaat

SEQ ID NO: 283997 - DNA, 25 bp, Homo sapien
acttttacagctagtacattaaatt

SEQ ID NO: 283998 - DNA, 25 bp, Homo sapien
cttttacagctagtacattaaattt

SEQ ID NO: 283999 - DNA, 25 bp, Homo sapien
ctcaaagattcttttattgtgaact

SEQ ID NO: 284000 - DNA, 25 bp, Homo sapien
tcaaagattcttttattgtgaactt

SEQ ID NO: 284001 - DNA, 25 bp, Homo sapien
caaagattcttttattgtgaacttt

SEQ ID NO: 284002 - DNA, 25 bp, Homo sapien
gaaagaattgtaaggccggtgcggt

SEQ ID NO: 284003 - DNA, 25 bp, Homo sapien
aaagaattgtaaggccggtgcggtg

SEQ ID NO: 284004 - DNA, 25 bp, Homo sapien
aagaattgtaaggccggtgcggtgg

SEQ ID NO: 284005 - DNA, 25 bp, Homo sapien
tttccatccaaatatcccacttcag

SEQ ID NO: 284006 - DNA, 25 bp, Homo sapien
ttccatccaaatatcccacttcagg

SEQ ID NO: 284007 - DNA, 25 bp, Homo sapien
aatgaggaacagcacccaaaatcac

SEQ ID NO: 284008 - DNA, 25 bp, Homo sapien
cactgcagtgacagagacggcacca

SEQ ID NO: 284009 - DNA, 25 bp, Homo sapien
cacaaaaaccaatctgcagctaatt

SEQ ID NO: 284010 - DNA, 25 bp, Homo sapien
caccagcgccggtgcaggactggat

SEQ ID NO: 284011 - DNA, 25 bp, Homo sapien
cgccggtgcaggactggatgctcat

SEQ ID NO: 284012 - DNA, 25 bp, Homo sapien
gcaggactggatgctcatgcacatc

SEQ ID NO: 284013 - DNA, 25 bp, Homo sapien
gactggatgctcatgcacatctcag

SEQ ID NO: 284014 - DNA, 25 bp, Homo sapien
ggatgctcatgcacatctcaggcct

SEQ ID NO: 284015 - DNA, 25 bp, Homo sapien
accaatctgcagctaattgaatcag

SEQ ID NO: 284016 - DNA, 25 bp, Homo sapien
ttcagcctcttccataaccacacta

SEQ ID NO: 284017 - DNA, 25 bp, Homo sapien
gactgagaggcttcataatgaggaa

SEQ ID NO: 284018 - DNA, 25 bp, Homo sapien
aaaagacatcagaaagcctgcttgc

SEQ ID NO: 284019 - DNA, 25 bp, Homo sapien
gatgcaggaagaagccagctgtcta

SEQ ID NO: 284020 - DNA, 25 bp, Homo sapien
ggaagaagccagctgtctacagaac

SEQ ID NO: 284021 - DNA, 25 bp, Homo sapien
gaagccagctgtctacagaacagga

SEQ ID NO: 284022 - DNA, 25 bp, Homo sapien
gccagctgtctacagaacaggaaga

SEQ ID NO: 284023 - DNA, 25 bp, Homo sapien
gaacaggaagagaaccctacgagaa

SEQ ID NO: 284024 - DNA, 25 bp, Homo sapien
gagaaccctacgagaacctaaccat

SEQ ID NO: 284025 - DNA, 25 bp, Homo sapien
gaaccctacgagaacctaaccatgc

SEQ ID NO: 284026 - DNA, 25 bp, Homo sapien
acctaaccatgctggcgacctgttc

SEQ ID NO: 284027 - DNA, 25 bp, Homo sapien
atgctggcgacctgttctcagactt

SEQ ID NO: 284028 - DNA, 25 bp, Homo sapien
ggcgacctgttctcagacttccaga

SEQ ID NO: 284029 - DNA, 25 bp, Homo sapien
gctcttgttggagcacaggccccag

SEQ ID NO: 284030 - DNA, 25 bp, Homo sapien
ttgttggagcacaggccccaggctt

SEQ ID NO: 284031 - DNA, 25 bp, Homo sapien
cactcactccttccagcaataagaa

SEQ ID NO: 284032 - DNA, 25 bp, Homo sapien
gcaataagaaccgtccttggtcgtg

SEQ ID NO: 284033 - DNA, 25 bp, Homo sapien
taagaaccgtccttggtcgtggaga

SEQ ID NO: 284034 - DNA, 25 bp, Homo sapien
gaaccgtccttggtcgtggagagta

SEQ ID NO: 284035 - DNA, 25 bp, Homo sapien
ccttggtcgtggagagtactgtgaa

SEQ ID NO: 284036 - DNA, 25 bp, Homo sapien
ggagagtactgtgaaacaaaccaat

SEQ ID NO: 284037 - DNA, 25 bp, Homo sapien
acaaaccaatgcacttaccaggagg

SEQ ID NO: 284038 - DNA, 25 bp, Homo sapien
aatgcacttaccaggaggcacaaga

SEQ ID NO: 284039 - DNA, 25 bp, Homo sapien
taccaggaggcacaagactcttgaa

SEQ ID NO: 284040 - DNA, 25 bp, Homo sapien
attcagacaaaaaatggctcaccct

SEQ ID NO: 284041 - DNA, 25 bp, Homo sapien
gaggtttctgtaatatttagctttt

SEQ ID NO: 284042 - DNA, 25 bp, Homo sapien
gaagcgatagcgtatggcatttttt

SEQ ID NO: 284043 - DNA, 25 bp, Homo sapien
atgctgtttggtttatattgtctac

SEQ ID NO: 284044 - DNA, 25 bp, Homo sapien
ttatattgtctactgcaggcttctt

SEQ ID NO: 284045 - DNA, 25 bp, Homo sapien
gtctactgcaggcttctttgtataa

SEQ ID NO: 284046 - DNA, 25 bp, Homo sapien
ccctctcctggacactgttttaaag

SEQ ID NO: 284047 - DNA, 25 bp, Homo sapien
gttttaaagtgtcaccgctgtccat

SEQ ID NO: 284048 - DNA, 25 bp, Homo sapien
tgtccatgctgccagaggctctgat

SEQ ID NO: 284049 - DNA, 25 bp, Homo sapien
tgccagaggctctgatgtgaagctg

SEQ ID NO: 284050 - DNA, 25 bp, Homo sapien
atgtgaagctgtactctcaagatcc

SEQ ID NO: 284051 - DNA, 25 bp, Homo sapien
attgctagtttttatcagatttcag

SEQ ID NO: 284052 - DNA, 25 bp, Homo sapien
gaagggcatactatgattgctgtgt

SEQ ID NO: 284053 - DNA, 25 bp, Homo sapien
attgctgtgttcctcaggtacattc

SEQ ID NO: 284054 - DNA, 25 bp, Homo sapien
gtacattcctgtgtttctctgacct

SEQ ID NO: 284055 - DNA, 25 bp, Homo sapien
atcccctaacctaactgacttggtg

SEQ ID NO: 284056 - DNA, 25 bp, Homo sapien
gagatggacacccttctctaggagg

SEQ ID NO: 284057 - DNA, 25 bp, Homo sapien
ggagggctggcaaaaatacaccaat

SEQ ID NO: 284058 - DNA, 25 bp, Homo sapien
tatccccaggattacttgttctttt

SEQ ID NO: 284059 - DNA, 25 bp, Homo sapien
gattacttgttcttttatgactgct

SEQ ID NO: 284060 - DNA, 25 bp, Homo sapien
tatgactgcttttctccttcaaagc

SEQ ID NO: 284061 - DNA, 25 bp, Homo sapien
ttttctccttcaaagcttctcattg

SEQ ID NO: 284062 - DNA, 25 bp, Homo sapien
gcaccagttggatcagatacaccag

SEQ ID NO: 284063 - DNA, 25 bp, Homo sapien
cacagcagcaagtgagccctgcaga

SEQ ID NO: 284064 - DNA, 25 bp, Homo sapien
gccctgcagacagagacattctaga

SEQ ID NO: 284065 - DNA, 25 bp, Homo sapien
agacattctagaacccaggcctggg

SEQ ID NO: 284066 - DNA, 25 bp, Homo sapien
ctgggaccagtgctcaggagccata

SEQ ID NO: 284067 - DNA, 25 bp, Homo sapien
tcaggagccatactctcagctagat

SEQ ID NO: 284068 - DNA, 25 bp, Homo sapien
atactctcagctagattgccttcag

SEQ ID NO: 284069 - DNA, 25 bp, Homo sapien
agggatgtgatctgcccgattgtgc

SEQ ID NO: 284070 - DNA, 25 bp, Homo sapien
ttgtgcagaattcagagcccagctg

SEQ ID NO: 284071 - DNA, 25 bp, Homo sapien
gaattcagagcccagctggaacctg

SEQ ID NO: 284072 - DNA, 25 bp, Homo sapien
agctggaacctgaatgtcctgaccc

SEQ ID NO: 284073 - DNA, 25 bp, Homo sapien
aagatctcaagaaactgagcttgga

SEQ ID NO: 284074 - DNA, 25 bp, Homo sapien
aggctgagagggtctcccgccgcct

SEQ ID NO: 284075 - DNA, 25 bp, Homo sapien
tgcgttctctgcagctatggcccca

SEQ ID NO: 284076 - DNA, 25 bp, Homo sapien
ttggctgctgaaagggtgatgctct

SEQ ID NO: 284077 - DNA, 25 bp, Homo sapien
agggtgatgctcttatgcctgagtc

SEQ ID NO: 284078 - DNA, 25 bp, Homo sapien
atgctcttatgcctgagtcttggct

SEQ ID NO: 284079 - DNA, 25 bp, Homo sapien
atgcctgagtcttggctcctgtggt

SEQ ID NO: 284080 - DNA, 25 bp, Homo sapien
ttggctcctgtggtcctgcagagac

SEQ ID NO: 284081 - DNA, 25 bp, Homo sapien
gtcacctgcactcatcttgggtttt

SEQ ID NO: 284082 - DNA, 25 bp, Homo sapien
tgcactcatcttgggttttccttcc

SEQ ID NO: 284083 - DNA, 25 bp, Homo sapien
cttttccaccctaagctgaaggtat

SEQ ID NO: 284084 - DNA, 25 bp, Homo sapien
atagccctgactcaggcagaatgcc

SEQ ID NO: 284085 - DNA, 25 bp, Homo sapien
cttagtcatgactgattttccttag

SEQ ID NO: 284086 - DNA, 25 bp, Homo sapien
tagtcatgactgattttccttagcc

SEQ ID NO: 284087 - DNA, 25 bp, Homo sapien
agtcatgactgattttccttagcca

SEQ ID NO: 284088 - DNA, 25 bp, Homo sapien
gtcatgactgattttccttagccag

SEQ ID NO: 284089 - DNA, 25 bp, Homo sapien
tcatgactgattttccttagccagt

SEQ ID NO: 284090 - DNA, 25 bp, Homo sapien
catgactgattttccttagccagtt

SEQ ID NO: 284091 - DNA, 25 bp, Homo sapien
atgactgattttccttagccagttt

SEQ ID NO: 284092 - DNA, 25 bp, Homo sapien
tgactgattttccttagccagtttg

SEQ ID NO: 284093 - DNA, 25 bp, Homo sapien
gactgattttccttagccagtttgt

SEQ ID NO: 284094 - DNA, 25 bp, Homo sapien
ctgattttccttagccagtttgtaa

SEQ ID NO: 284095 - DNA, 25 bp, Homo sapien
gagggctgtgcttttccaggtcagt

SEQ ID NO: 284096 - DNA, 25 bp, Homo sapien
aggtcagtgccagcttggctgtccc

SEQ ID NO: 284097 - DNA, 25 bp, Homo sapien
ttggctgtcccaggccgtgcacagt

SEQ ID NO: 284098 - DNA, 25 bp, Homo sapien
tgcacagtgcccattgctatagctg

SEQ ID NO: 284099 - DNA, 25 bp, Homo sapien
ggttgtcacggcagcacagtgcaca

SEQ ID NO: 284100 - DNA, 25 bp, Homo sapien
gcacatgcagagaggaccaggccat

SEQ ID NO: 284101 - DNA, 25 bp, Homo sapien
aggaccaggccatgtttttcctgtg

SEQ ID NO: 284102 - DNA, 25 bp, Homo sapien
tttcctgtgctgagaaactcttggg

SEQ ID NO: 284103 - DNA, 25 bp, Homo sapien
ccgcttgatgtctaagtgttggtgg

SEQ ID NO: 284104 - DNA, 25 bp, Homo sapien
ctgttgctttgctgttccatgaaag

SEQ ID NO: 284105 - DNA, 25 bp, Homo sapien
tgttccatgaaagcgctccctggct

SEQ ID NO: 284106 - DNA, 25 bp, Homo sapien
tcaagagttagagcaggtggctgca

SEQ ID NO: 284107 - DNA, 25 bp, Homo sapien
gggaaggccactgccggccacttgg

SEQ ID NO: 284108 - DNA, 25 bp, Homo sapien
gggcagacacagacacctcaaggat

SEQ ID NO: 284109 - DNA, 25 bp, Homo sapien
acacctcaaggatctgtcacggaag

SEQ ID NO: 284110 - DNA, 25 bp, Homo sapien
tcaaggatctgtcacggaaggcgtc

SEQ ID NO: 284111 - DNA, 25 bp, Homo sapien
gatctgtcacggaaggcgtcctttt

SEQ ID NO: 284112 - DNA, 25 bp, Homo sapien
gaaggcgtcctttttccttgtagct

SEQ ID NO: 284113 - DNA, 25 bp, Homo sapien
gcgtcctttttccttgtagctaacg

SEQ ID NO: 284114 - DNA, 25 bp, Homo sapien
ttccttgtagctaacgttaggcctg

SEQ ID NO: 284115 - DNA, 25 bp, Homo sapien
taacgttaggcctgagtagctcccc

SEQ ID NO: 284116 - DNA, 25 bp, Homo sapien
ttaggcctgagtagctcccctccat

SEQ ID NO: 284117 - DNA, 25 bp, Homo sapien
actcggccgcctccagagggagcga

SEQ ID NO: 284118 - DNA, 25 bp, Homo sapien
tccagagggagcgagggaagcggct

SEQ ID NO: 284119 - DNA, 25 bp, Homo sapien
cgagggaagcggctagaggatcggg

SEQ ID NO: 284120 - DNA, 25 bp, Homo sapien
agaagccggcggagggcgggatcgc

SEQ ID NO: 284121 - DNA, 25 bp, Homo sapien
gggatcgcgcctcctgacatgttgg

SEQ ID NO: 284122 - DNA, 25 bp, Homo sapien
ggatcgcgcctcctgacatgttggg

SEQ ID NO: 284123 - DNA, 25 bp, Homo sapien
atcgcgcctcctgacatgttggggg

SEQ ID NO: 284124 - DNA, 25 bp, Homo sapien
gcgcctcctgacatgttgggggtat

SEQ ID NO: 284125 - DNA, 25 bp, Homo sapien
gcctcctgacatgttgggggtatcc

SEQ ID NO: 284126 - DNA, 25 bp, Homo sapien
ctcctgacatgttgggggtatccct

SEQ ID NO: 284127 - DNA, 25 bp, Homo sapien
acatgttgggggtatccctggccgg

SEQ ID NO: 284128 - DNA, 25 bp, Homo sapien
tccgagggctggagtgacgcccact

SEQ ID NO: 284129 - DNA, 25 bp, Homo sapien
tgacgcccacttggatcctaatgag

SEQ ID NO: 284130 - DNA, 25 bp, Homo sapien
acttggatcctaatgagctgccctt

SEQ ID NO: 284131 - DNA, 25 bp, Homo sapien
ggatcctaatgagctgcccttcatc

SEQ ID NO: 284132 - DNA, 25 bp, Homo sapien
gatgccactgatgccaatggccatg

SEQ ID NO: 284133 - DNA, 25 bp, Homo sapien
gatgccaatggccatgctgatccca

SEQ ID NO: 284134 - DNA, 25 bp, Homo sapien
aatggccatgctgatcccactcatg

SEQ ID NO: 284135 - DNA, 25 bp, Homo sapien
ccactgagattgtcaccatatctga

SEQ ID NO: 284136 - DNA, 25 bp, Homo sapien
gattgtcaccatatctgagaatgaa

SEQ ID NO: 284137 - DNA, 25 bp, Homo sapien
caccaatccagaggaccgcagtgat

SEQ ID NO: 284138 - DNA, 25 bp, Homo sapien
gaccgcagtgatagctccgagggct

SEQ ID NO: 284139 - DNA, 25 bp, Homo sapien
tggtgggcgctttcctactcacttt

SEQ ID NO: 284140 - DNA, 25 bp, Homo sapien
actttctgggaccacgcacctgtaa

SEQ ID NO: 284141 - DNA, 25 bp, Homo sapien
tgggaccacgcacctgtaagcttag

SEQ ID NO: 284142 - DNA, 25 bp, Homo sapien
gcacctgtaagcttaggtctgggaa

SEQ ID NO: 284143 - DNA, 25 bp, Homo sapien
ggtctgggaataaaaacccgagcag

SEQ ID NO: 284144 - DNA, 25 bp, Homo sapien
tgaggcgctgtgatcggaggaaacc

SEQ ID NO: 284145 - DNA, 25 bp, Homo sapien
ggacaactctatactacgtaccgtg

SEQ ID NO: 284146 - DNA, 25 bp, Homo sapien
tctatactacgtaccgtgaccgtcc

SEQ ID NO: 284147 - DNA, 25 bp, Homo sapien
gtgaccgtcctcctatactgggaaa

SEQ ID NO: 284148 - DNA, 25 bp, Homo sapien
tatactgggaaaccgagcacagaaa

SEQ ID NO: 284149 - DNA, 25 bp, Homo sapien
agcacagaaagcttaagcgcctggc

SEQ ID NO: 284150 - DNA, 25 bp, Homo sapien
atcctgagggtgaccctgtagggca

SEQ ID NO: 284151 - DNA, 25 bp, Homo sapien
acatctatttctgggagatccaccc

SEQ ID NO: 284152 - DNA, 25 bp, Homo sapien
gagatccacccatgagtcaggacat

SEQ ID NO: 284153 - DNA, 25 bp, Homo sapien
tcaggacatggcttcagagggcgtc

SEQ ID NO: 284154 - DNA, 25 bp, Homo sapien
ttcagagggcgtcttcttggcacat

SEQ ID NO: 284155 - DNA, 25 bp, Homo sapien
gtcttcttggcacatgtgggactac

SEQ ID NO: 284156 - DNA, 25 bp, Homo sapien
gtgggactaccaggctgtgacccgt

SEQ ID NO: 284157 - DNA, 25 bp, Homo sapien
tgacccgtgcggtacgctattacag

SEQ ID NO: 284158 - DNA, 25 bp, Homo sapien
gctattacagttaaaccatgtggga

SEQ ID NO: 284159 - DNA, 25 bp, Homo sapien
tctacccagaggaatccaggtcctg

SEQ ID NO: 284160 - DNA, 25 bp, Homo sapien
gctcctcattcatcgtccgggactt

SEQ ID NO: 284161 - DNA, 25 bp, Homo sapien
gaagaaataagaccagtttccaaat

SEQ ID NO: 284162 - DNA, 25 bp, Homo sapien
gacaaagagcttggtattcctgcag

SEQ ID NO: 284163 - DNA, 25 bp, Homo sapien
agagcttggtattcctgcaggcatc

SEQ ID NO: 284164 - DNA, 25 bp, Homo sapien
ggtattcctgcaggcatcagaatca

SEQ ID NO: 284165 - DNA, 25 bp, Homo sapien
ggtggtggcccagagaccacacatt

SEQ ID NO: 284166 - DNA, 25 bp, Homo sapien
ggcccagagaccacacattgagaac

SEQ ID NO: 284167 - DNA, 25 bp, Homo sapien
aaaccatttgtctttgctgatggag

SEQ ID NO: 284168 - DNA, 25 bp, Homo sapien
gaaacctggctctaatagaagggct

SEQ ID NO: 284169 - DNA, 25 bp, Homo sapien
tagaagggcttgtatgtgtccagga

SEQ ID NO: 284170 - DNA, 25 bp, Homo sapien
gcagcgcctccggttataagttgaa

SEQ ID NO: 284171 - DNA, 25 bp, Homo sapien
gcgcctccggttataagttgaagaa

SEQ ID NO: 284172 - DNA, 25 bp, Homo sapien
tcagtctgtcgatatatgtatgcta

SEQ ID NO: 284173 - DNA, 25 bp, Homo sapien
gcggcttgggtgacagcagaactct

SEQ ID NO: 284174 - DNA, 25 bp, Homo sapien
tttccccactctcaagtcagactat

SEQ ID NO: 284175 - DNA, 25 bp, Homo sapien
tctcaagtcagactatgttgttttc

SEQ ID NO: 284176 - DNA, 25 bp, Homo sapien
gttgttttcatagttagtagctagc

SEQ ID NO: 284177 - DNA, 25 bp, Homo sapien
agttagtagctagcagtctacccca

SEQ ID NO: 284178 - DNA, 25 bp, Homo sapien
gctagcagtctaccccactagatta

SEQ ID NO: 284179 - DNA, 25 bp, Homo sapien
agatgtggaattcttttctgcaaat

SEQ ID NO: 284180 - DNA, 25 bp, Homo sapien
attcttttctgcaaatgttctctaa

SEQ ID NO: 284181 - DNA, 25 bp, Homo sapien
tgttctctaatagtataccttcttc

SEQ ID NO: 284182 - DNA, 25 bp, Homo sapien
agtataccttcttcagtctgtcgat

SEQ ID NO: 284183 - DNA, 25 bp, Homo sapien
ttaccattcccaatgcctgaacttc

SEQ ID NO: 284184 - DNA, 25 bp, Homo sapien
ctgaacttcctcctgctattaagat

SEQ ID NO: 284185 - DNA, 25 bp, Homo sapien
cctgctattaagattgctagagaat

SEQ ID NO: 284186 - DNA, 25 bp, Homo sapien
gattgctagagaattgtgtcttaaa

SEQ ID NO: 284187 - DNA, 25 bp, Homo sapien
gtgtcttaaacagttcatgaaccca

SEQ ID NO: 284188 - DNA, 25 bp, Homo sapien
gttcatgaacccagaagaatgcaat

SEQ ID NO: 284189 - DNA, 25 bp, Homo sapien
tgtatttagtacacacacagtatgt

SEQ ID NO: 284190 - DNA, 25 bp, Homo sapien
gtatgtatataaacacaactcacag

SEQ ID NO: 284191 - DNA, 25 bp, Homo sapien
cagaatatattttccatacattggg

SEQ ID NO: 284192 - DNA, 25 bp, Homo sapien
tacattgggtaggtatgcactttgt

SEQ ID NO: 284193 - DNA, 25 bp, Homo sapien
agcagatggagattaccattcccaa

SEQ ID NO: 284194 - DNA, 25 bp, Homo sapien
tttttgtgcttctagaacaagaatg

SEQ ID NO: 284195 - DNA, 25 bp, Homo sapien
tgtggcttggtcacttcgtggctaa

SEQ ID NO: 284196 - DNA, 25 bp, Homo sapien
tcgtggctaaggtaagaacgtgctt

SEQ ID NO: 284197 - DNA, 25 bp, Homo sapien
gtaagaacgtgcttgtggaagacaa

SEQ ID NO: 284198 - DNA, 25 bp, Homo sapien
gtgagtctgtgtggccagcagcctc

SEQ ID NO: 284199 - DNA, 25 bp, Homo sapien
agcagcctctgatctgtgcagggta

SEQ ID NO: 284200 - DNA, 25 bp, Homo sapien
agggctgagtgttctgggatttctc

SEQ ID NO: 284201 - DNA, 25 bp, Homo sapien
tgttctgggatttctctagaggctg

SEQ ID NO: 284202 - DNA, 25 bp, Homo sapien
tttgtcttgcgggtctgtcagggtt

SEQ ID NO: 284203 - DNA, 25 bp, Homo sapien
tgagtccccaaacctctttcttcta

SEQ ID NO: 284204 - DNA, 25 bp, Homo sapien
aattcatctgaggattttttgtgct

SEQ ID NO: 284205 - DNA, 25 bp, Homo sapien
ccccagagcgcaagtactcggtgtg

SEQ ID NO: 284206 - DNA, 25 bp, Homo sapien
gagtacgacgagtcgggcccctcca

SEQ ID NO: 284207 - DNA, 25 bp, Homo sapien
gcaaatgcttctaaacggactcagc

SEQ ID NO: 284208 - DNA, 25 bp, Homo sapien
acggactcagcagatgcgtagcatt

SEQ ID NO: 284209 - DNA, 25 bp, Homo sapien
agcagatgcgtagcatttgctgcat

SEQ ID NO: 284210 - DNA, 25 bp, Homo sapien
gatgcgtagcatttgctgcatgggt

SEQ ID NO: 284211 - DNA, 25 bp, Homo sapien
gcgtagcatttgctgcatgggttaa

SEQ ID NO: 284212 - DNA, 25 bp, Homo sapien
ttgctgcatgggttaattgagaata

SEQ ID NO: 284213 - DNA, 25 bp, Homo sapien
ttgagaatagaaatttgcccctggc

SEQ ID NO: 284214 - DNA, 25 bp, Homo sapien
catgctagcctcacgaaactggaat

SEQ ID NO: 284215 - DNA, 25 bp, Homo sapien
gaataagccttcgaaaagaaattgt

SEQ ID NO: 284216 - DNA, 25 bp, Homo sapien
cttaccagtcatactttagataatt

SEQ ID NO: 284217 - DNA, 25 bp, Homo sapien
aatattttaacaagcaagcgtaact

SEQ ID NO: 284218 - DNA, 25 bp, Homo sapien
tgcagtgccacatcgtgcctgtcag

SEQ ID NO: 284219 - DNA, 25 bp, Homo sapien
agtgccacatcgtgcctgtcagtag

SEQ ID NO: 284220 - DNA, 25 bp, Homo sapien
acatcgtgcctgtcagtagccactt

SEQ ID NO: 284221 - DNA, 25 bp, Homo sapien
atcgtgcctgtcagtagccacttca

SEQ ID NO: 284222 - DNA, 25 bp, Homo sapien
gtgcctgtcagtagccacttcagcc

SEQ ID NO: 284223 - DNA, 25 bp, Homo sapien
caaattttagacttatgtgggatta

SEQ ID NO: 284224 - DNA, 25 bp, Homo sapien
ttagacttatgtgggattaaaggta

SEQ ID NO: 284225 - DNA, 25 bp, Homo sapien
gtaaaaatcttaccagtcatacttt

SEQ ID NO: 284226 - DNA, 25 bp, Homo sapien
aaaatcttaccagtcatactttaga

SEQ ID NO: 284227 - DNA, 25 bp, Homo sapien
aagggtcccatttcttaactcagca

SEQ ID NO: 284228 - DNA, 25 bp, Homo sapien
gtcccatttcttaactcagcatttc

SEQ ID NO: 284229 - DNA, 25 bp, Homo sapien
taactcagcatttcatataccaaga

SEQ ID NO: 284230 - DNA, 25 bp, Homo sapien
gaacacttgcaaagatttcttcata

SEQ ID NO: 284231 - DNA, 25 bp, Homo sapien
atttttcagttccagaagcatttcc

SEQ ID NO: 284232 - DNA, 25 bp, Homo sapien
aacttgaagctttgatttgcactga

SEQ ID NO: 284233 - DNA, 25 bp, Homo sapien
gatttgcactgaattaacttggata

SEQ ID NO: 284234 - DNA, 25 bp, Homo sapien
aaaattttagtttctctcttcagct

SEQ ID NO: 284235 - DNA, 25 bp, Homo sapien
tagtttctctcttcagctaacagat

SEQ ID NO: 284236 - DNA, 25 bp, Homo sapien
ctctcttcagctaacagatttggaa

SEQ ID NO: 284237 - DNA, 25 bp, Homo sapien
gcccacattgcaaatagtcttcata

SEQ ID NO: 284238 - DNA, 25 bp, Homo sapien
caacgctcccatggtttgggataca

SEQ ID NO: 284239 - DNA, 25 bp, Homo sapien
tgggatacacctcaagttttaactt

SEQ ID NO: 284240 - DNA, 25 bp, Homo sapien
gtacttcaagtttcttttattcaat

SEQ ID NO: 284241 - DNA, 25 bp, Homo sapien
ttgcccatttcctagccagggtttg

SEQ ID NO: 284242 - DNA, 25 bp, Homo sapien
acaaaccgtctgacttttggcttct

SEQ ID NO: 284243 - DNA, 25 bp, Homo sapien
agaatcttgatgaactctgaaatga

SEQ ID NO: 284244 - DNA, 25 bp, Homo sapien
agccagggtttgtggtccaggcaac

SEQ ID NO: 284245 - DNA, 25 bp, Homo sapien
aggcaacctgtcacatcagtgtgtt

SEQ ID NO: 284246 - DNA, 25 bp, Homo sapien
tcagtgtgttccaaacatggcaccc

SEQ ID NO: 284247 - DNA, 25 bp, Homo sapien
ggcacccagatctcaaaagcttctt

SEQ ID NO: 284248 - DNA, 25 bp, Homo sapien
aaaagcttcttcaacgctcccatgg

SEQ ID NO: 284249 - DNA, 25 bp, Homo sapien
atcatcgcacccccagagcgcaagt

SEQ ID NO: 284250 - DNA, 25 bp, Homo sapien
acggactcagcagatgcgtagcatt

SEQ ID NO: 284251 - DNA, 25 bp, Homo sapien
cggactcagcagatgcgtagcattt

SEQ ID NO: 284252 - DNA, 25 bp, Homo sapien
ggactcagcagatgcgtagcatttg

SEQ ID NO: 284253 - DNA, 25 bp, Homo sapien
gactcagcagatgcgtagcatttgc

SEQ ID NO: 284254 - DNA, 25 bp, Homo sapien
ctcagcagatgcgtagcatttgctg

SEQ ID NO: 284255 - DNA, 25 bp, Homo sapien
tcagcagatgcgtagcatttgctgc

SEQ ID NO: 284256 - DNA, 25 bp, Homo sapien
cagcagatgcgtagcatttgctgca

SEQ ID NO: 284257 - DNA, 25 bp, Homo sapien
agcagatgcgtagcatttgctgcat

SEQ ID NO: 284258 - DNA, 25 bp, Homo sapien
gcagatgcgtagcatttgctgcatg

SEQ ID NO: 284259 - DNA, 25 bp, Homo sapien
cagatgcgtagcatttgctgcatgg

SEQ ID NO: 284260 - DNA, 25 bp, Homo sapien
agggtttcatggtccacctgggagc

SEQ ID NO: 284261 - DNA, 25 bp, Homo sapien
ggtttcatggtccacctgggagccc

SEQ ID NO: 284262 - DNA, 25 bp, Homo sapien
accctggagtgagatctaggctccc

SEQ ID NO: 284263 - DNA, 25 bp, Homo sapien
aggcaggagaagtgccttccaaaag

SEQ ID NO: 284264 - DNA, 25 bp, Homo sapien
tattccttcagccagtacccaggtc

SEQ ID NO: 284265 - DNA, 25 bp, Homo sapien
tacccaggtccccttggtcatggct

SEQ ID NO: 284266 - DNA, 25 bp, Homo sapien
agactacctggggtcgctgacgagc

SEQ ID NO: 284267 - DNA, 25 bp, Homo sapien
agcaccgagccgtcctgcaggcgcg

SEQ ID NO: 284268 - DNA, 25 bp, Homo sapien
tcgcgcaccgtctggtggtcgtcca

SEQ ID NO: 284269 - DNA, 25 bp, Homo sapien
cagccgccgcgcgttgtagtagaag

SEQ ID NO: 284270 - DNA, 25 bp, Homo sapien
gttgtagtagaaggcgcgcttccag

SEQ ID NO: 284271 - DNA, 25 bp, Homo sapien
agggcagctggagccggtgcacctg

SEQ ID NO: 284272 - DNA, 25 bp, Homo sapien
aggctctgcgggtagccgaagacct

SEQ ID NO: 284273 - DNA, 25 bp, Homo sapien
gggtagccgaagaccttgccgcaga

SEQ ID NO: 284274 - DNA, 25 bp, Homo sapien
ttgccgcagagctcgcacttgtagg

SEQ ID NO: 284275 - DNA, 25 bp, Homo sapien
cgcagtccgagcaggcgtagctcag

SEQ ID NO: 284276 - DNA, 25 bp, Homo sapien
agagctcgcacttgtagggccgctc

SEQ ID NO: 284277 - DNA, 25 bp, Homo sapien
gctcgcgcgtgtgcaccacgtgatg

SEQ ID NO: 284278 - DNA, 25 bp, Homo sapien
tgcaccacgtgatgcttgctcaagt

SEQ ID NO: 284279 - DNA, 25 bp, Homo sapien
tgcttgctcaagtggaaggattcgc

SEQ ID NO: 284280 - DNA, 25 bp, Homo sapien
gaaggattcgcggaagcgcttccca

SEQ ID NO: 284281 - DNA, 25 bp, Homo sapien
caggcgtagctcagcccatcggtgg

SEQ ID NO: 284282 - DNA, 25 bp, Homo sapien
aaacccagcctaacatgcagcaagc

SEQ ID NO: 284283 - DNA, 25 bp, Homo sapien
gaatctccaaaatttggaccctggt

SEQ ID NO: 284284 - DNA, 25 bp, Homo sapien
tgggtccttgcctcacaggctgcct

SEQ ID NO: 284285 - DNA, 25 bp, Homo sapien
gtccccttgcaattccattctattt

SEQ ID NO: 284286 - DNA, 25 bp, Homo sapien
ttctatttctgccacatgccaagtg

SEQ ID NO: 284287 - DNA, 25 bp, Homo sapien
atgccaagtgctatgacaggtacaa

SEQ ID NO: 284288 - DNA, 25 bp, Homo sapien
tgctatgacaggtacaaggcaaata

SEQ ID NO: 284289 - DNA, 25 bp, Homo sapien
ttggaccctggttctaagctaatat

SEQ ID NO: 284290 - DNA, 25 bp, Homo sapien
acttccctgttctaaagacaccaca

SEQ ID NO: 284291 - DNA, 25 bp, Homo sapien
gaggaaatgattcctgcgtttcttg

SEQ ID NO: 284292 - DNA, 25 bp, Homo sapien
ggaacccagaatacaaacccagcct

SEQ ID NO: 284293 - DNA, 25 bp, Homo sapien
agagtacaggaacccaatccagctt

SEQ ID NO: 284294 - DNA, 25 bp, Homo sapien
gaacccaatccagcttggagttggg

SEQ ID NO: 284295 - DNA, 25 bp, Homo sapien
gaagaccccctaaaagaggtggcat

SEQ ID NO: 284296 - DNA, 25 bp, Homo sapien
gtggcatctgagttcatcctttaaa

SEQ ID NO: 284297 - DNA, 25 bp, Homo sapien
gcatctgagttcatcctttaaagaa

SEQ ID NO: 284298 - DNA, 25 bp, Homo sapien
agctgagtacaggtgctcctggcca

SEQ ID NO: 284299 - DNA, 25 bp, Homo sapien
ctcctggccaaatgtgcaaaggcag

SEQ ID NO: 284300 - DNA, 25 bp, Homo sapien
gagagcaggcccaggtgagtcacct

SEQ ID NO: 284301 - DNA, 25 bp, Homo sapien
gtgagtcacctgtaggtagttgtga

SEQ ID NO: 284302 - DNA, 25 bp, Homo sapien
ggcacatagtaatcactacgtatgt

SEQ ID NO: 284303 - DNA, 25 bp, Homo sapien
gtaatcactacgtatgtgtttgtta

SEQ ID NO: 284304 - DNA, 25 bp, Homo sapien
gtgtacctgcaagagactgggaact

SEQ ID NO: 284305 - DNA, 25 bp, Homo sapien
aaggagggccaagagcagttgctca

SEQ ID NO: 284306 - DNA, 25 bp, Homo sapien
gagcagttgctcagataccagctgg

SEQ ID NO: 284307 - DNA, 25 bp, Homo sapien
tcagataccagctggcaggccaaaa

SEQ ID NO: 284308 - DNA, 25 bp, Homo sapien
aggccaaaatcagctgctgctgcta

SEQ ID NO: 284309 - DNA, 25 bp, Homo sapien
tgctatgcccagacttcagacaaga

SEQ ID NO: 284310 - DNA, 25 bp, Homo sapien
ttgccagggcaaagtcggctgagta

SEQ ID NO: 284311 - DNA, 25 bp, Homo sapien
aggcattctgccttcattcagtaca

SEQ ID NO: 284312 - DNA, 25 bp, Homo sapien
tcagtacacccggaaactattcagg

SEQ ID NO: 284313 - DNA, 25 bp, Homo sapien
actattcaggagcaactgtgatcag

SEQ ID NO: 284314 - DNA, 25 bp, Homo sapien
gggcatttggcctgaaaggcagaat

SEQ ID NO: 284315 - DNA, 25 bp, Homo sapien
aatagcaaatgttttacacctcttg

SEQ ID NO: 284316 - DNA, 25 bp, Homo sapien
atgttttacacctcttgaaatttgc

SEQ ID NO: 284317 - DNA, 25 bp, Homo sapien
cttgaaatttgcaacattttctttc

SEQ ID NO: 284318 - DNA, 25 bp, Homo sapien
ccacagaaagattcgggaacacaaa

SEQ ID NO: 284319 - DNA, 25 bp, Homo sapien
tgtgtgtccctcatgtcttctaatg

SEQ ID NO: 284320 - DNA, 25 bp, Homo sapien
tgtgtccctcatgtcttctaatgga

SEQ ID NO: 284321 - DNA, 25 bp, Homo sapien
gtgtccctcatgtcttctaatggaa

SEQ ID NO: 284322 - DNA, 25 bp, Homo sapien
gtccctcatgtcttctaatggaaaa

SEQ ID NO: 284323 - DNA, 25 bp, Homo sapien
ccctcatgtcttctaatggaaaaga

SEQ ID NO: 284324 - DNA, 25 bp, Homo sapien
ttttctttatccagtatatatatgt

SEQ ID NO: 284325 - DNA, 25 bp, Homo sapien
ggaacacaaattttacaaacacaca

SEQ ID NO: 284326 - DNA, 25 bp, Homo sapien
atggaagggtcacctcaaccacttt

SEQ ID NO: 284327 - DNA, 25 bp, Homo sapien
tttctgctggttcccttgcagacat

SEQ ID NO: 284328 - DNA, 25 bp, Homo sapien
gcagacatttcaaactttgtcacct

SEQ ID NO: 284329 - DNA, 25 bp, Homo sapien
tgtcacctattcaaagatggctttc

SEQ ID NO: 284330 - DNA, 25 bp, Homo sapien
gatggctttctacggactccatgag

SEQ ID NO: 284331 - DNA, 25 bp, Homo sapien
tggcaacagcttccatgtcatacag

SEQ ID NO: 284332 - DNA, 25 bp, Homo sapien
gagcaaccaacaagctaacccattg

SEQ ID NO: 284333 - DNA, 25 bp, Homo sapien
acatgaagcaacagccacataggag

SEQ ID NO: 284334 - DNA, 25 bp, Homo sapien
acggaggctcggaactgccaaagct

SEQ ID NO: 284335 - DNA, 25 bp, Homo sapien
gaactgccaaagctccacacggata

SEQ ID NO: 284336 - DNA, 25 bp, Homo sapien
atacacccttgtagagagactcccc

SEQ ID NO: 284337 - DNA, 25 bp, Homo sapien
ttagccactggccatgtctggattc

SEQ ID NO: 284338 - DNA, 25 bp, Homo sapien
gtctggattcatggtcgaattcact

SEQ ID NO: 284339 - DNA, 25 bp, Homo sapien
cgaattcactagacttcctggacac

SEQ ID NO: 284340 - DNA, 25 bp, Homo sapien
ggacacatacaagcccttctattag

SEQ ID NO: 284341 - DNA, 25 bp, Homo sapien
aagcccttctattagagccaggttt

SEQ ID NO: 284342 - DNA, 25 bp, Homo sapien
agagccaggtttctccatcagcaaa

SEQ ID NO: 284343 - DNA, 25 bp, Homo sapien
agcatctcctcctccaggtgattct

SEQ ID NO: 284344 - DNA, 25 bp, Homo sapien
gatgcctgcaggaataccaagctct

SEQ ID NO: 284345 - DNA, 25 bp, Homo sapien
ggaataccaagctctttgtcattta

SEQ ID NO: 284346 - DNA, 25 bp, Homo sapien
aagctctttgtcatttatttggaaa

SEQ ID NO: 284347 - DNA, 25 bp, Homo sapien
aacttataaccggaggcgctgcagg

SEQ ID NO: 284348 - DNA, 25 bp, Homo sapien
gagcccatgcttgatgtggtcagca

SEQ ID NO: 284349 - DNA, 25 bp, Homo sapien
tgatgtggtcagcattgcctccctg

SEQ ID NO: 284350 - DNA, 25 bp, Homo sapien
agggcccggctcagggagtccttct

SEQ ID NO: 284351 - DNA, 25 bp, Homo sapien
gtgtgcgtgtgcgagaatccaccct

SEQ ID NO: 284352 - DNA, 25 bp, Homo sapien
ctctgtcttccctatggtctattaa

SEQ ID NO: 284353 - DNA, 25 bp, Homo sapien
ctatggtctattaatctccccatgc

SEQ ID NO: 284354 - DNA, 25 bp, Homo sapien
tcaaatcgactgtaggctgtgctcc

SEQ ID NO: 284355 - DNA, 25 bp, Homo sapien
tgtgcgctctcacgagcactaacac

SEQ ID NO: 284356 - DNA, 25 bp, Homo sapien
agcatgattctccaggactgcggct

SEQ ID NO: 284357 - DNA, 25 bp, Homo sapien
aatccacccttcatgatttaattga

SEQ ID NO: 284358 - DNA, 25 bp, Homo sapien
atcagcagcagcgaagatgaccctc

SEQ ID NO: 284359 - DNA, 25 bp, Homo sapien
tcaccggctctatgaccctggaaga

SEQ ID NO: 284360 - DNA, 25 bp, Homo sapien
accggctctatgaccctggaagaat

SEQ ID NO: 284361 - DNA, 25 bp, Homo sapien
gggcagaaactgtcactgtcacggt

SEQ ID NO: 284362 - DNA, 25 bp, Homo sapien
gcagaaactgtcactgtcacggtcc

SEQ ID NO: 284363 - DNA, 25 bp, Homo sapien
agaaactgtcactgtcacggtcctg

SEQ ID NO: 284364 - DNA, 25 bp, Homo sapien
aaactgtcactgtcacggtcctgtt

SEQ ID NO: 284365 - DNA, 25 bp, Homo sapien
actgtcactgtcacggtcctgttta

SEQ ID NO: 284366 - DNA, 25 bp, Homo sapien
cacggtcctgtttagagaggaaggt

SEQ ID NO: 284367 - DNA, 25 bp, Homo sapien
ttagagaggaaggtcggagaaacca

SEQ ID NO: 284368 - DNA, 25 bp, Homo sapien
gaaaccagtgccgtggaaggctctg

SEQ ID NO: 284369 - DNA, 25 bp, Homo sapien
aaaccagtgccgtggaaggctctgg

SEQ ID NO: 284370 - DNA, 25 bp, Homo sapien
ccagctgaaagtgatggcgagcgac

SEQ ID NO: 284371 - DNA, 25 bp, Homo sapien
aagtgatggcgagcgaccaccgaga

SEQ ID NO: 284372 - DNA, 25 bp, Homo sapien
accgagaggcgctgctggacaggga

SEQ ID NO: 284373 - DNA, 25 bp, Homo sapien
acagggagagcgagaacgcgtctct

SEQ ID NO: 284374 - DNA, 25 bp, Homo sapien
cgagaacgcgtctctccgggagaag

SEQ ID NO: 284375 - DNA, 25 bp, Homo sapien
cgtctctccgggagaagctgcggct

SEQ ID NO: 284376 - DNA, 25 bp, Homo sapien
agatcgcccgcatccgggacgagga

SEQ ID NO: 284377 - DNA, 25 bp, Homo sapien
agagggcgagcttcctgcagaacgc

SEQ ID NO: 284378 - DNA, 25 bp, Homo sapien
tgcagaacgccgtcctggcttacgt

SEQ ID NO: 284379 - DNA, 25 bp, Homo sapien
gccgtcctggcttacgtgcaggcgt

SEQ ID NO: 284380 - DNA, 25 bp, Homo sapien
tacgtgcaggcgtcccccgtgagga

SEQ ID NO: 284381 - DNA, 25 bp, Homo sapien
gagaagacgtgaacctgccaaccag

SEQ ID NO: 284382 - DNA, 25 bp, Homo sapien
tcaggaaggtctccgttaaacacta

SEQ ID NO: 284383 - DNA, 25 bp, Homo sapien
gtgaacctgccaaccagcctgtgtt

SEQ ID NO: 284384 - DNA, 25 bp, Homo sapien
gtctccgttaaacactaagaaactg

SEQ ID NO: 284385 - DNA, 25 bp, Homo sapien
aacaccccaggagttggcagattgg

SEQ ID NO: 284386 - DNA, 25 bp, Homo sapien
tggcagattgggaccctactccgtg

SEQ ID NO: 284387 - DNA, 25 bp, Homo sapien
aagggaacgctcagtgactgctgcc

SEQ ID NO: 284388 - DNA, 25 bp, Homo sapien
ggcgtccacccgtaatctctcagtt

SEQ ID NO: 284389 - DNA, 25 bp, Homo sapien
aaactgagatgcaatcagctggcct

SEQ ID NO: 284390 - DNA, 25 bp, Homo sapien
cctggaattcaggaaagtgctggtt

SEQ ID NO: 284391 - DNA, 25 bp, Homo sapien
agtgctggttctgaaattgaggaca

SEQ ID NO: 284392 - DNA, 25 bp, Homo sapien
tataaattccaccagtcatcttttt

SEQ ID NO: 284393 - DNA, 25 bp, Homo sapien
agtcatcttttttatggcagatttc

SEQ ID NO: 284394 - DNA, 25 bp, Homo sapien
gatttcagatttgtcgtctcagcgt

SEQ ID NO: 284395 - DNA, 25 bp, Homo sapien
gtctcagcgtagttatgctccataa

SEQ ID NO: 284396 - DNA, 25 bp, Homo sapien
gttcaaatcttgctacgttatgtgt

SEQ ID NO: 284397 - DNA, 25 bp, Homo sapien
gctacgttatgtgtcttttaggcaa

SEQ ID NO: 284398 - DNA, 25 bp, Homo sapien
gcaagttaatgcctcagcctcagtt

SEQ ID NO: 284399 - DNA, 25 bp, Homo sapien
tactttaccacaagtccatcttctg

SEQ ID NO: 284400 - DNA, 25 bp, Homo sapien
aagtccatcttctgtgttcaggtaa

SEQ ID NO: 284401 - DNA, 25 bp, Homo sapien
tttgttgtctagctgtttgttgtct

SEQ ID NO: 284402 - DNA, 25 bp, Homo sapien
tagctgtttgttgtctattctgttc

SEQ ID NO: 284403 - DNA, 25 bp, Homo sapien
gggagctgataatgttctgattctt

SEQ ID NO: 284404 - DNA, 25 bp, Homo sapien
gttctgattcttgaagtagttaacc

SEQ ID NO: 284405 - DNA, 25 bp, Homo sapien
gtagttaaccagattacacaggtgt

SEQ ID NO: 284406 - DNA, 25 bp, Homo sapien
acacaggtgtgttcgttttttgata

SEQ ID NO: 284407 - DNA, 25 bp, Homo sapien
aattctttgaactgtatgtgtactg

SEQ ID NO: 284408 - DNA, 25 bp, Homo sapien
gattgataagtaacacatgcttgtg

SEQ ID NO: 284409 - DNA, 25 bp, Homo sapien
cttaaggtttggctatcatggtgag

SEQ ID NO: 284410 - DNA, 25 bp, Homo sapien
ttggctatcatggtgagaactccta

SEQ ID NO: 284411 - DNA, 25 bp, Homo sapien
tggtgagaactcctatgtaccctgc

SEQ ID NO: 284412 - DNA, 25 bp, Homo sapien
atgtaccctgctcaggtcctggtaa

SEQ ID NO: 284413 - DNA, 25 bp, Homo sapien
gctcaggtcctggtaaacagtatca

SEQ ID NO: 284414 - DNA, 25 bp, Homo sapien
gagaatagcacaggaaacacccgcc

SEQ ID NO: 284415 - DNA, 25 bp, Homo sapien
ttcaattacctcctcctaagtccct

SEQ ID NO: 284416 - DNA, 25 bp, Homo sapien
ggcacggccaaactatatcagaaag

SEQ ID NO: 284417 - DNA, 25 bp, Homo sapien
gatgaagtgacagcatatcctgatg

SEQ ID NO: 284418 - DNA, 25 bp, Homo sapien
gacagcatatcctgatgtgtgtgat

SEQ ID NO: 284419 - DNA, 25 bp, Homo sapien
tatcctgatgtgtgtgatggtttca

SEQ ID NO: 284420 - DNA, 25 bp, Homo sapien
cctgatgtgtgtgatggtttcatga

SEQ ID NO: 284421 - DNA, 25 bp, Homo sapien
gaagccaaagcagaaccccctgaga

SEQ ID NO: 284422 - DNA, 25 bp, Homo sapien
gaaccccctgagaaacccatcagtt

SEQ ID NO: 284423 - DNA, 25 bp, Homo sapien
aacccatcagttagtgagacttact

SEQ ID NO: 284424 - DNA, 25 bp, Homo sapien
cccatcagttagtgagacttactcg

SEQ ID NO: 284425 - DNA, 25 bp, Homo sapien
attattattaattccaacagagtat

SEQ ID NO: 284426 - DNA, 25 bp, Homo sapien
atatattatcagagtgcatttgtta

SEQ ID NO: 284427 - DNA, 25 bp, Homo sapien
tagaatggaccaattttagctcaac

SEQ ID NO: 284428 - DNA, 25 bp, Homo sapien
gaatggaccaattttagctcaactt

SEQ ID NO: 284429 - DNA, 25 bp, Homo sapien
ggaccaattttagctcaacttttag

SEQ ID NO: 284430 - DNA, 25 bp, Homo sapien
ttagctcaacttttagtttgttaga

SEQ ID NO: 284431 - DNA, 25 bp, Homo sapien
agaagcaagtgtaggaactctagca

SEQ ID NO: 284432 - DNA, 25 bp, Homo sapien
gtgtaggaactctagcactgtagtt

SEQ ID NO: 284433 - DNA, 25 bp, Homo sapien
gtaggaactctagcactgtagtttt

SEQ ID NO: 284434 - DNA, 25 bp, Homo sapien
gaactctagcactgtagtttttaat

SEQ ID NO: 284435 - DNA, 25 bp, Homo sapien
ttaattattgcttgtatctattatt

SEQ ID NO: 284436 - DNA, 25 bp, Homo sapien
gcaaattggaatggctggcttgaag

SEQ ID NO: 284437 - DNA, 25 bp, Homo sapien
ggaatggctggcttgaagtttccat

SEQ ID NO: 284438 - DNA, 25 bp, Homo sapien
tggctggcttgaagtttccattatt

SEQ ID NO: 284439 - DNA, 25 bp, Homo sapien
ttcttgaagagaggtgatgctttaa

SEQ ID NO: 284440 - DNA, 25 bp, Homo sapien
agaggtgatgctttaaattactttt

SEQ ID NO: 284441 - DNA, 25 bp, Homo sapien
aaattactttttggattgtagccag

SEQ ID NO: 284442 - DNA, 25 bp, Homo sapien
tttttggattgtagccagttcagct

SEQ ID NO: 284443 - DNA, 25 bp, Homo sapien
gattgtagccagttcagctaggcaa

SEQ ID NO: 284444 - DNA, 25 bp, Homo sapien
gccagttcagctaggcaaaagccat

SEQ ID NO: 284445 - DNA, 25 bp, Homo sapien
gttcagctaggcaaaagccatactt

SEQ ID NO: 284446 - DNA, 25 bp, Homo sapien
ggcaaaagccatacttttcacaatt

SEQ ID NO: 284447 - DNA, 25 bp, Homo sapien
ccatccgttgcacactggtaaactg

SEQ ID NO: 284448 - DNA, 25 bp, Homo sapien
aagattaacctgaggacttgtgatc

SEQ ID NO: 284449 - DNA, 25 bp, Homo sapien
gtggcacatgaaaccctgaaatcgt

SEQ ID NO: 284450 - DNA, 25 bp, Homo sapien
aaaccctgaaatcgtgtctccaatg

SEQ ID NO: 284451 - DNA, 25 bp, Homo sapien
acgactacggctgaaccagggttca

SEQ ID NO: 284452 - DNA, 25 bp, Homo sapien
gtctccaatgacttctgctcagagg

SEQ ID NO: 284453 - DNA, 25 bp, Homo sapien
gtgaaacacagcattctttccggct

SEQ ID NO: 284454 - DNA, 25 bp, Homo sapien
attctttccggctgccttatactgt

SEQ ID NO: 284455 - DNA, 25 bp, Homo sapien
ccttatactgtgcagtgtcctgggt

SEQ ID NO: 284456 - DNA, 25 bp, Homo sapien
ggcaaaacgctgatactaacctctt

SEQ ID NO: 284457 - DNA, 25 bp, Homo sapien
gaatgtcccaacaggccatccgttg

SEQ ID NO: 284458 - DNA, 25 bp, Homo sapien
gaaagttcagcttgatgtactggat

SEQ ID NO: 284459 - DNA, 25 bp, Homo sapien
gtactggatggtccaaacctggctt

SEQ ID NO: 284460 - DNA, 25 bp, Homo sapien
aaacctggcttctaggctgtggagc

SEQ ID NO: 284461 - DNA, 25 bp, Homo sapien
gagacacctcaactatgttctcctt

SEQ ID NO: 284462 - DNA, 25 bp, Homo sapien
gtgggagaaggaagctattcagcat

SEQ ID NO: 284463 - DNA, 25 bp, Homo sapien
gagagatctccatactcagcatttc

SEQ ID NO: 284464 - DNA, 25 bp, Homo sapien
atttcactgccttcttacttgaggt

SEQ ID NO: 284465 - DNA, 25 bp, Homo sapien
tacttgaggtccagtttttgcattt

SEQ ID NO: 284466 - DNA, 25 bp, Homo sapien
tgcattttcagttgcctacccagcc

SEQ ID NO: 284467 - DNA, 25 bp, Homo sapien
agtctgttgccggtgcttgcctttg

SEQ ID NO: 284468 - DNA, 25 bp, Homo sapien
gcctttggctgagctctactgaaaa

SEQ ID NO: 284469 - DNA, 25 bp, Homo sapien
ggtaggtgatgctcagagatgttca

SEQ ID NO: 284470 - DNA, 25 bp, Homo sapien
gagatgttcagtaacttgtccaagt

SEQ ID NO: 284471 - DNA, 25 bp, Homo sapien
gtccaagtgacccagctgttaattg

SEQ ID NO: 284472 - DNA, 25 bp, Homo sapien
cttgctccagagtccatctttttaa

SEQ ID NO: 284473 - DNA, 25 bp, Homo sapien
taattggctagagaataaccccttc

SEQ ID NO: 284474 - DNA, 25 bp, Homo sapien
aatactgcaccaaactgcctttgtg

SEQ ID NO: 284475 - DNA, 25 bp, Homo sapien
gcaccaaactgcctttgtgatggta

SEQ ID NO: 284476 - DNA, 25 bp, Homo sapien
gcctggaaggagtttatgatctccc

SEQ ID NO: 284477 - DNA, 25 bp, Homo sapien
cccttccttagcacattgttctaag

SEQ ID NO: 284478 - DNA, 25 bp, Homo sapien
attgttctaagcacctcgtttggtc

SEQ ID NO: 284479 - DNA, 25 bp, Homo sapien
tcgtttggtcctacaatcctataag

SEQ ID NO: 284480 - DNA, 25 bp, Homo sapien
agcagtgtatgtttgaaacagccaa

SEQ ID NO: 284481 - DNA, 25 bp, Homo sapien
aacagccaaagatggcgatgaacca

SEQ ID NO: 284482 - DNA, 25 bp, Homo sapien
agatggcgatgaaccaagtgtaaat

SEQ ID NO: 284483 - DNA, 25 bp, Homo sapien
gtgttgaatcaacaaacagtgtatt

SEQ ID NO: 284484 - DNA, 25 bp, Homo sapien
acaaacagtgtattgttgaagtgaa

SEQ ID NO: 284485 - DNA, 25 bp, Homo sapien
gtagagtaataatggctcctgggat

SEQ ID NO: 284486 - DNA, 25 bp, Homo sapien
agtaataatggctcctgggatggag

SEQ ID NO: 284487 - DNA, 25 bp, Homo sapien
gaacctggaacattctattatggtg

SEQ ID NO: 284488 - DNA, 25 bp, Homo sapien
ggaacattctattatggtgccacaa

SEQ ID NO: 284489 - DNA, 25 bp, Homo sapien
gaacattctattatggtgccacaaa

SEQ ID NO: 284490 - DNA, 25 bp, Homo sapien
attctattatggtgccacaaaggaa

SEQ ID NO: 284491 - DNA, 25 bp, Homo sapien
aaatgccctaattgaggtatatttc

SEQ ID NO: 284492 - DNA, 25 bp, Homo sapien
gccctaattgaggtatatttctgaa

SEQ ID NO: 284493 - DNA, 25 bp, Homo sapien
gtatatttctgaatagtttcagcag

SEQ ID NO: 284494 - DNA, 25 bp, Homo sapien
gaatagtttcagcaggttatttttt

SEQ ID NO: 284495 - DNA, 25 bp, Homo sapien
ttattttatactcagcagaagacag

SEQ ID NO: 284496 - DNA, 25 bp, Homo sapien
tttatactcagcagaagacagggaa

SEQ ID NO: 284497 - DNA, 25 bp, Homo sapien
atactcagcagaagacagggaaatt

SEQ ID NO: 284498 - DNA, 25 bp, Homo sapien
aataatttctatttctaccaagctt

SEQ ID NO: 284499 - DNA, 25 bp, Homo sapien
aatttctatttctaccaagcttaat

SEQ ID NO: 284500 - DNA, 25 bp, Homo sapien
tctatttctaccaagcttaattatg

SEQ ID NO: 284501 - DNA, 25 bp, Homo sapien
atttctaccaagcttaattatggta

SEQ ID NO: 284502 - DNA, 25 bp, Homo sapien
tattttctatctgtggttggattca

SEQ ID NO: 284503 - DNA, 25 bp, Homo sapien
attttctatctgtggttggattcag

SEQ ID NO: 284504 - DNA, 25 bp, Homo sapien
ttctatctgtggttggattcagacc

SEQ ID NO: 284505 - DNA, 25 bp, Homo sapien
tctatctgtggttggattcagacca

SEQ ID NO: 284506 - DNA, 25 bp, Homo sapien
atctgtggttggattcagaccacat

SEQ ID NO: 284507 - DNA, 25 bp, Homo sapien
tggttggattcagaccacatgaaca

SEQ ID NO: 284508 - DNA, 25 bp, Homo sapien
gattcagaccacatgaacactgagg

SEQ ID NO: 284509 - DNA, 25 bp, Homo sapien
agaccacatgaacactgagggctga

SEQ ID NO: 284510 - DNA, 25 bp, Homo sapien
gaccacatgaacactgagggctgac

SEQ ID NO: 284511 - DNA, 25 bp, Homo sapien
accacatgaacactgagggctgact

SEQ ID NO: 284512 - DNA, 25 bp, Homo sapien
ccacatgaacactgagggctgactg

SEQ ID NO: 284513 - DNA, 25 bp, Homo sapien
ttttgtcaccaatatccatcatcag

SEQ ID NO: 284514 - DNA, 25 bp, Homo sapien
accaatatccatcatcagaacattt

SEQ ID NO: 284515 - DNA, 25 bp, Homo sapien
ctatatccatagatgtcccagaaat

SEQ ID NO: 284516 - DNA, 25 bp, Homo sapien
tatccatagatgtcccagaaataat

SEQ ID NO: 284517 - DNA, 25 bp, Homo sapien
aatatctgactatacagagcagcat

SEQ ID NO: 284518 - DNA, 25 bp, Homo sapien
agagcagcattaccaagccaccaag

SEQ ID NO: 284519 - DNA, 25 bp, Homo sapien
gcattaccaagccaccaagaagtct

SEQ ID NO: 284520 - DNA, 25 bp, Homo sapien
caagccaccaagaagtctgcctagt

SEQ ID NO: 284521 - DNA, 25 bp, Homo sapien
ggtcacatctcccaagaagcagtaa

SEQ ID NO: 284522 - DNA, 25 bp, Homo sapien
tcacatctcccaagaagcagtaatg

SEQ ID NO: 284523 - DNA, 25 bp, Homo sapien
gagccttatatgaattacatcaatt

SEQ ID NO: 284524 - DNA, 25 bp, Homo sapien
ctatgcttttgaggttatttacatt

SEQ ID NO: 284525 - DNA, 25 bp, Homo sapien
aaatggtggagatagggtcagcttc

SEQ ID NO: 284526 - DNA, 25 bp, Homo sapien
atagggtcagcttctgcacatcttt

SEQ ID NO: 284527 - DNA, 25 bp, Homo sapien
tcagcttctgcacatcttttcccga

SEQ ID NO: 284528 - DNA, 25 bp, Homo sapien
tgatgtcaccttgatagctcaccaa

SEQ ID NO: 284529 - DNA, 25 bp, Homo sapien
gtcaccttgatagctcaccaatggt

SEQ ID NO: 284530 - DNA, 25 bp, Homo sapien
caccaatggtgaaagtatttactcc

SEQ ID NO: 284531 - DNA, 25 bp, Homo sapien
gtatttactccatggaaagctgcaa

SEQ ID NO: 284532 - DNA, 25 bp, Homo sapien
tactccatggaaagctgcaaaatgc

SEQ ID NO: 284533 - DNA, 25 bp, Homo sapien
aatgctatgaatcagggctttttcc

SEQ ID NO: 284534 - DNA, 25 bp, Homo sapien
aacactaaaaacacatcgcttcata

SEQ ID NO: 284535 - DNA, 25 bp, Homo sapien
cattgtgctaggaactggatgtaga

SEQ ID NO: 284536 - DNA, 25 bp, Homo sapien
gaactggatgtagactatagcaaga

SEQ ID NO: 284537 - DNA, 25 bp, Homo sapien
atagcaagatacttatgtccacatt

SEQ ID NO: 284538 - DNA, 25 bp, Homo sapien
cttatgtccacattatttaataggg

SEQ ID NO: 284539 - DNA, 25 bp, Homo sapien
ggaactgttgcagtacagagagaga

SEQ ID NO: 284540 - DNA, 25 bp, Homo sapien
gagaggtgcataactcaggctgaaa

SEQ ID NO: 284541 - DNA, 25 bp, Homo sapien
cagagggacagagaaatttcgttag

SEQ ID NO: 284542 - DNA, 25 bp, Homo sapien
ggattccaaacagtgaaaactcaga

SEQ ID NO: 284543 - DNA, 25 bp, Homo sapien
aactcagaaatacttggtagcctgt

SEQ ID NO: 284544 - DNA, 25 bp, Homo sapien
gaaatacttggtagcctgtatgcat

SEQ ID NO: 284545 - DNA, 25 bp, Homo sapien
gcattaaaggatgggttttgcttgg

SEQ ID NO: 284546 - DNA, 25 bp, Homo sapien
gtgtagccgcagaagatatcaacag

SEQ ID NO: 284547 - DNA, 25 bp, Homo sapien
atatcaacagggtctccgaggtcga

SEQ ID NO: 284548 - DNA, 25 bp, Homo sapien
ctccgaggtcgaactgccagcagtg

SEQ ID NO: 284549 - DNA, 25 bp, Homo sapien
agcagtgcagccatcaatcctgcca

SEQ ID NO: 284550 - DNA, 25 bp, Homo sapien
caccagggccatgggtatcaacaac

SEQ ID NO: 284551 - DNA, 25 bp, Homo sapien
ggtatcaacaacacccacactgaca

SEQ ID NO: 284552 - DNA, 25 bp, Homo sapien
accaccatagtgtggatcttcccac

SEQ ID NO: 284553 - DNA, 25 bp, Homo sapien
gatcttcccacctcaagttctcaga

SEQ ID NO: 284554 - DNA, 25 bp, Homo sapien
aagttctcagacatctcaggcaacc

SEQ ID NO: 284555 - DNA, 25 bp, Homo sapien
ttttctgatcctctagaagtgccca

SEQ ID NO: 284556 - DNA, 25 bp, Homo sapien
aggccccgatttcccaggatgttca

SEQ ID NO: 284557 - DNA, 25 bp, Homo sapien
gtatttctgaagaattgttaagaac

SEQ ID NO: 284558 - DNA, 25 bp, Homo sapien
gaacattggaaattcttgagatata

SEQ ID NO: 284559 - DNA, 25 bp, Homo sapien
gtatgatctcaatatgtcctgatga

SEQ ID NO: 284560 - DNA, 25 bp, Homo sapien
tatgatctcaatatgtcctgatgaa

SEQ ID NO: 284561 - DNA, 25 bp, Homo sapien
atgatctcaatatgtcctgatgaat

SEQ ID NO: 284562 - DNA, 25 bp, Homo sapien
gatctcaatatgtcctgatgaataa

SEQ ID NO: 284563 - DNA, 25 bp, Homo sapien
tctcaatatgtcctgatgaataaaa

SEQ ID NO: 284564 - DNA, 25 bp, Homo sapien
ataatacagaggacattattctgag

SEQ ID NO: 284565 - DNA, 25 bp, Homo sapien
atacagaggacattattctgagata

SEQ ID NO: 284566 - DNA, 25 bp, Homo sapien
agaggacattattctgagataaaat

SEQ ID NO: 284567 - DNA, 25 bp, Homo sapien
gataaaatacatcaaaatctttcca

SEQ ID NO: 284568 - DNA, 25 bp, Homo sapien
ctgcagggaggcgtgggtgcgctta

SEQ ID NO: 284569 - DNA, 25 bp, Homo sapien
tgcgcttaagcggagctcgtccatg

SEQ ID NO: 284570 - DNA, 25 bp, Homo sapien
taagcggagctcgtccatgttcatc

SEQ ID NO: 284571 - DNA, 25 bp, Homo sapien
ggagctcgtccatgttcatcccgca

SEQ ID NO: 284572 - DNA, 25 bp, Homo sapien
tgttcatcccgcagctcttgaccag

SEQ ID NO: 284573 - DNA, 25 bp, Homo sapien
acgtgcagctcctccgtgcagatct

SEQ ID NO: 284574 - DNA, 25 bp, Homo sapien
agatctccctgcagcgcaaggccac

SEQ ID NO: 284575 - DNA, 25 bp, Homo sapien
gacatcctagaccaggagagagaag

SEQ ID NO: 284576 - DNA, 25 bp, Homo sapien
gagagaagacgacttcttcatggca

SEQ ID NO: 284577 - DNA, 25 bp, Homo sapien
agaagacgacttcttcatggcattc

SEQ ID NO: 284578 - DNA, 25 bp, Homo sapien
ttccacaccctaccgcggagaagca

SEQ ID NO: 284579 - DNA, 25 bp, Homo sapien
aggtcgatgagtcccctgtcaacga

SEQ ID NO: 284580 - DNA, 25 bp, Homo sapien
tcgatgagtcccctgtcaacgacag

SEQ ID NO: 284581 - DNA, 25 bp, Homo sapien
cgatgagtcccctgtcaacgacagc

SEQ ID NO: 284582 - DNA, 25 bp, Homo sapien
atgagtcccctgtcaacgacagcca

SEQ ID NO: 284583 - DNA, 25 bp, Homo sapien
tgagtcccctgtcaacgacagccat

SEQ ID NO: 284584 - DNA, 25 bp, Homo sapien
gtcaacggcgcgctggtggtcacgg

SEQ ID NO: 284585 - DNA, 25 bp, Homo sapien
agtcccctgtcaacgacagccatgg

SEQ ID NO: 284586 - DNA, 25 bp, Homo sapien
gccatggccgggctcccgaggaggg

SEQ ID NO: 284587 - DNA, 25 bp, Homo sapien
aacggcgcgctggtggtcacggtga

SEQ ID NO: 284588 - DNA, 25 bp, Homo sapien
gcgcgctggtggtcacggtgagctg

SEQ ID NO: 284589 - DNA, 25 bp, Homo sapien
ctggtggtcacggtgagctgcggcg

SEQ ID NO: 284590 - DNA, 25 bp, Homo sapien
tctaatgcctctcagttcaaggagg

SEQ ID NO: 284591 - DNA, 25 bp, Homo sapien
cctctcagttcaaggaggccactga

SEQ ID NO: 284592 - DNA, 25 bp, Homo sapien
gttcaaggaggccactgagtgaaac

SEQ ID NO: 284593 - DNA, 25 bp, Homo sapien
cactgagtgaaactgaaggctggtt

SEQ ID NO: 284594 - DNA, 25 bp, Homo sapien
gagtgaaactgaaggctggttttcc

SEQ ID NO: 284595 - DNA, 25 bp, Homo sapien
gttttccttggaagccagcggccca

SEQ ID NO: 284596 - DNA, 25 bp, Homo sapien
agcctccgctcaaacactgtcgtgg

SEQ ID NO: 284597 - DNA, 25 bp, Homo sapien
gctcaaacactgtcgtggcttggca

SEQ ID NO: 284598 - DNA, 25 bp, Homo sapien
aaacactgtcgtggcttggcagcac

SEQ ID NO: 284599 - DNA, 25 bp, Homo sapien
acactgtcgtggcttggcagcacta

SEQ ID NO: 284600 - DNA, 25 bp, Homo sapien
ctgtcgtggcttggcagcactacaa

SEQ ID NO: 284601 - DNA, 25 bp, Homo sapien
agtcatttggctacacactgaggag

SEQ ID NO: 284602 - DNA, 25 bp, Homo sapien
gagtagtagcctcctcaaataatgt

SEQ ID NO: 284603 - DNA, 25 bp, Homo sapien
aaataatgttccctacctatctgtc

SEQ ID NO: 284604 - DNA, 25 bp, Homo sapien
tatctgtcaataccttccatcttag

SEQ ID NO: 284605 - DNA, 25 bp, Homo sapien
tgcaggctggtagtgtctgttccac

SEQ ID NO: 284606 - DNA, 25 bp, Homo sapien
ttaatgaggctgtgttttcttggct

SEQ ID NO: 284607 - DNA, 25 bp, Homo sapien
tttcttggctgtgcttcttgatgtt

SEQ ID NO: 284608 - DNA, 25 bp, Homo sapien
caaatctgtattcttttctcctaag

SEQ ID NO: 284609 - DNA, 25 bp, Homo sapien
gtctgttccacctggattaggttaa

SEQ ID NO: 284610 - DNA, 25 bp, Homo sapien
ggtaattcctatctgtttatacaca

SEQ ID NO: 284611 - DNA, 25 bp, Homo sapien
gatgctttagcgcttgctgtacaaa

SEQ ID NO: 284612 - DNA, 25 bp, Homo sapien
gaaaagatactagcgccagtctggc

SEQ ID NO: 284613 - DNA, 25 bp, Homo sapien
gggccttttctagtctcaagcacgc

SEQ ID NO: 284614 - DNA, 25 bp, Homo sapien
tcaagcacgctgagcagtcctacac

SEQ ID NO: 284615 - DNA, 25 bp, Homo sapien
tttgccataggcttttctgtactgt

SEQ ID NO: 284616 - DNA, 25 bp, Homo sapien
gagaagaggacagtcctcagcctcc

SEQ ID NO: 284617 - DNA, 25 bp, Homo sapien
taggcttttctgtactgtttgcatt

SEQ ID NO: 284618 - DNA, 25 bp, Homo sapien
gggtgccttagtgaggacatcatct

SEQ ID NO: 284619 - DNA, 25 bp, Homo sapien
ggacatcatctgcaactcccagatg

SEQ ID NO: 284620 - DNA, 25 bp, Homo sapien
actcccagatggatagacgaggcca

SEQ ID NO: 284621 - DNA, 25 bp, Homo sapien
gtttgcttgaattacctctttggga

SEQ ID NO: 284622 - DNA, 25 bp, Homo sapien
gaggaatttacactaaaacacctgt

SEQ ID NO: 284623 - DNA, 25 bp, Homo sapien
tccacctgaacgcaagcagagcttt

SEQ ID NO: 284624 - DNA, 25 bp, Homo sapien
acctgaacgcaagcagagctttctg

SEQ ID NO: 284625 - DNA, 25 bp, Homo sapien
aacgcaagcagagctttctgtggga

SEQ ID NO: 284626 - DNA, 25 bp, Homo sapien
agctttctgtgggagggcagcgcac

SEQ ID NO: 284627 - DNA, 25 bp, Homo sapien
tgtgggagggcagcgcactgactgg

SEQ ID NO: 284628 - DNA, 25 bp, Homo sapien
aaaagggccgtgtggccttgctcct

SEQ ID NO: 284629 - DNA, 25 bp, Homo sapien
ctgcccagggccttatgcaggagcc

SEQ ID NO: 284630 - DNA, 25 bp, Homo sapien
tgcaggagcccgtgccgcctctggt

SEQ ID NO: 284631 - DNA, 25 bp, Homo sapien
gtggccttgctcctctctaaggaag

SEQ ID NO: 284632 - DNA, 25 bp, Homo sapien
gaattgtttagccgcccaccacttc

SEQ ID NO: 284633 - DNA, 25 bp, Homo sapien
cacttcctgccagcaggattttaaa

SEQ ID NO: 284634 - DNA, 25 bp, Homo sapien
gctgtttacatgtctctgagtgtgt

SEQ ID NO: 284635 - DNA, 25 bp, Homo sapien
catgtctctgagtgtgtttctaggc

SEQ ID NO: 284636 - DNA, 25 bp, Homo sapien
agtgtgtttctaggctctcttcaag

SEQ ID NO: 284637 - DNA, 25 bp, Homo sapien
tctaggctctcttcaagtctactaa

SEQ ID NO: 284638 - DNA, 25 bp, Homo sapien
ggctctcttcaagtctactaaacaa

SEQ ID NO: 284639 - DNA, 25 bp, Homo sapien
tagttagacagtatcttttcagtaa

SEQ ID NO: 284640 - DNA, 25 bp, Homo sapien
tgttgggagaactgggaagccacct

SEQ ID NO: 284641 - DNA, 25 bp, Homo sapien
ggagaactgggaagccacctgaaaa

SEQ ID NO: 284642 - DNA, 25 bp, Homo sapien
gatagattcgtattcatacaccagg

SEQ ID NO: 284643 - DNA, 25 bp, Homo sapien
caagtggaacagtcatgagctccaa

SEQ ID NO: 284644 - DNA, 25 bp, Homo sapien
agtcatgagctccaaaccactcaag

SEQ ID NO: 284645 - DNA, 25 bp, Homo sapien
tcacaagagaggtgggcaagccccc

SEQ ID NO: 284646 - DNA, 25 bp, Homo sapien
ggaagtaagcaggatcctccctgtc

SEQ ID NO: 284647 - DNA, 25 bp, Homo sapien
aagcaggatcctccctgtcctgttt

SEQ ID NO: 284648 - DNA, 25 bp, Homo sapien
ttcccagaaccagagcaaggaatgg

SEQ ID NO: 284649 - DNA, 25 bp, Homo sapien
gaatcctaagggtttctgtggcatc

SEQ ID NO: 284650 - DNA, 25 bp, Homo sapien
ctgccaccctttttcagggaggtga

SEQ ID NO: 284651 - DNA, 25 bp, Homo sapien
tttcagggaggtgagtacctgccat

SEQ ID NO: 284652 - DNA, 25 bp, Homo sapien
gaggtgagtacctgccatggtcact

SEQ ID NO: 284653 - DNA, 25 bp, Homo sapien
tgagtacctgccatggtcactgtta

SEQ ID NO: 284654 - DNA, 25 bp, Homo sapien
gggctctgagctaggtgcattgctc

SEQ ID NO: 284655 - DNA, 25 bp, Homo sapien
gagctaggtgcattgctctgttacc

SEQ ID NO: 284656 - DNA, 25 bp, Homo sapien
gttcccatcagctggtgtgagatgc

SEQ ID NO: 284657 - DNA, 25 bp, Homo sapien
gtgagatgcagtgccctaagaccca

SEQ ID NO: 284658 - DNA, 25 bp, Homo sapien
agtacaacccgaattcttgcagacc

SEQ ID NO: 284659 - DNA, 25 bp, Homo sapien
cttgcagacctaagaagccactttt

SEQ ID NO: 284660 - DNA, 25 bp, Homo sapien
gaagccactttttaccctatggaag

SEQ ID NO: 284661 - DNA, 25 bp, Homo sapien
agctgttcctgagtataacaccaag

SEQ ID NO: 284662 - DNA, 25 bp, Homo sapien
gatgctgctgtctttattcaaacac

SEQ ID NO: 284663 - DNA, 25 bp, Homo sapien
tattcaaacacctggcgtcggccaa

SEQ ID NO: 284664 - DNA, 25 bp, Homo sapien
aaaatcttccagtttacgctgtaga

SEQ ID NO: 284665 - DNA, 25 bp, Homo sapien
ggaacatgtttctgtgaacctatca

SEQ ID NO: 284666 - DNA, 25 bp, Homo sapien
cagtggatttcattctcttgagtaa

SEQ ID NO: 284667 - DNA, 25 bp, Homo sapien
agggaacagccaatgcagaggccgt

SEQ ID NO: 284668 - DNA, 25 bp, Homo sapien
acagccaatgcagaggccgtgaggt

SEQ ID NO: 284669 - DNA, 25 bp, Homo sapien
gaggtggccagtgccactgagcagt

SEQ ID NO: 284670 - DNA, 25 bp, Homo sapien
agtgtggatggtggtattccctcac

SEQ ID NO: 284671 - DNA, 25 bp, Homo sapien
gcggggtcagacaaacaatatgctt

SEQ ID NO: 284672 - DNA, 25 bp, Homo sapien
tgcctcaagcctgagctgaagctga

SEQ ID NO: 284673 - DNA, 25 bp, Homo sapien
gagctgaagctgaaaattggcactt

SEQ ID NO: 284674 - DNA, 25 bp, Homo sapien
aaattggcacttcaaagcaggagga

SEQ ID NO: 284675 - DNA, 25 bp, Homo sapien
gtggtattccctcaccaagaggtga

SEQ ID NO: 284676 - DNA, 25 bp, Homo sapien
ttccctcaccaagaggtgacatgtg

SEQ ID NO: 284677 - DNA, 25 bp, Homo sapien
agggtgtgacccgtgtggaaatcag

SEQ ID NO: 284678 - DNA, 25 bp, Homo sapien
gaataagccttcgaaaagaaattgt

SEQ ID NO: 284679 - DNA, 25 bp, Homo sapien
gaaaagaaattgtccttgaagcttg

SEQ ID NO: 284680 - DNA, 25 bp, Homo sapien
gtatctgatatcagcactggattgt

SEQ ID NO: 284681 - DNA, 25 bp, Homo sapien
acttgttgctgattttgaccttgta

SEQ ID NO: 284682 - DNA, 25 bp, Homo sapien
gaccttgtattgaagttaactgttc

SEQ ID NO: 284683 - DNA, 25 bp, Homo sapien
agggctgagtgttctgggatttctc

SEQ ID NO: 284684 - DNA, 25 bp, Homo sapien
ggctgagtgttctgggatttctcta

SEQ ID NO: 284685 - DNA, 25 bp, Homo sapien
agtgttctgggatttctctagaggc

SEQ ID NO: 284686 - DNA, 25 bp, Homo sapien
tgttctgggatttctctagaggctg

SEQ ID NO: 284687 - DNA, 25 bp, Homo sapien
tctagaggctggcaagaaccagttg

SEQ ID NO: 284688 - DNA, 25 bp, Homo sapien
tttgtcttgcgggtctgtcagggtt

SEQ ID NO: 284689 - DNA, 25 bp, Homo sapien
gagcccctggctcctggaacgaaca

SEQ ID NO: 284690 - DNA, 25 bp, Homo sapien
gcttttcacacagaaagggcttcta

SEQ ID NO: 284691 - DNA, 25 bp, Homo sapien
ggaacgaacacacagccatggcaga

SEQ ID NO: 284692 - DNA, 25 bp, Homo sapien
ggcttgaataggttccatgacttgt

SEQ ID NO: 284693 - DNA, 25 bp, Homo sapien
ataggttccatgacttgtacaagac

SEQ ID NO: 284694 - DNA, 25 bp, Homo sapien
atgacttgtacaagaccacagctgg

SEQ ID NO: 284695 - DNA, 25 bp, Homo sapien
gaccacagctggtacatgatgaagc

SEQ ID NO: 284696 - DNA, 25 bp, Homo sapien
aagcaaggacaagacacgggcatct

SEQ ID NO: 284697 - DNA, 25 bp, Homo sapien
aagacacgggcatctgacctcaaga

SEQ ID NO: 284698 - DNA, 25 bp, Homo sapien
ctgtgcctgaccttaagacaggaaa

SEQ ID NO: 284699 - DNA, 25 bp, Homo sapien
gagctaaggaagctacctacaccgc

SEQ ID NO: 284700 - DNA, 25 bp, Homo sapien
ccccagagcgcaagtactcggtgtg

SEQ ID NO: 284701 - DNA, 25 bp, Homo sapien
gagtacgacgagtcgggcccctcca

SEQ ID NO: 284702 - DNA, 25 bp, Homo sapien
acggactcagcagatgcgtagcatt

SEQ ID NO: 284703 - DNA, 25 bp, Homo sapien
gactcagcagatgcgtagcatttgc

SEQ ID NO: 284704 - DNA, 25 bp, Homo sapien
agcagatgcgtagcatttgctgcat

SEQ ID NO: 284705 - DNA, 25 bp, Homo sapien
gatgcgtagcatttgctgcatgggt

SEQ ID NO: 284706 - DNA, 25 bp, Homo sapien
gcgtagcatttgctgcatgggttaa

SEQ ID NO: 284707 - DNA, 25 bp, Homo sapien
gcatttgctgcatgggttaattgag

SEQ ID NO: 284708 - DNA, 25 bp, Homo sapien
ttgctgcatgggttaattgagaata

SEQ ID NO: 284709 - DNA, 25 bp, Homo sapien
ttgagaatagaaatttgcccctggc

SEQ ID NO: 284710 - DNA, 25 bp, Homo sapien
agcttgtatctgatatcagcactgg

SEQ ID NO: 284711 - DNA, 25 bp, Homo sapien
gccagcaatatcttctatcttttcc

SEQ ID NO: 284712 - DNA, 25 bp, Homo sapien
atcttttccaacattattcacctct

SEQ ID NO: 284713 - DNA, 25 bp, Homo sapien
caatggtgggctggacagagcattc

SEQ ID NO: 284714 - DNA, 25 bp, Homo sapien
gacagagcattcaatgaccgagaat

SEQ ID NO: 284715 - DNA, 25 bp, Homo sapien
gaccgagaatctaccataagctact

SEQ ID NO: 284716 - DNA, 25 bp, Homo sapien
cataagctactagggccacatcttc

SEQ ID NO: 284717 - DNA, 25 bp, Homo sapien
ccaggtttgtcccatttgtactgac

SEQ ID NO: 284718 - DNA, 25 bp, Homo sapien
ttgtcccatttgtactgactctgac

SEQ ID NO: 284719 - DNA, 25 bp, Homo sapien
gttcttacttttccataaggattga

SEQ ID NO: 284720 - DNA, 25 bp, Homo sapien
attgagtctcaaaatgtctggtagc

SEQ ID NO: 284721 - DNA, 25 bp, Homo sapien
tctggtagcatccactgcattttgt

SEQ ID NO: 284722 - DNA, 25 bp, Homo sapien
tgctcagttcacacgccagtggtaa

SEQ ID NO: 284723 - DNA, 25 bp, Homo sapien
acacgccagtggtaactgaacacta

SEQ ID NO: 284724 - DNA, 25 bp, Homo sapien
gaatgactggttcatctcagcttct

SEQ ID NO: 284725 - DNA, 25 bp, Homo sapien
atctcagcttcttcactgaattttt

SEQ ID NO: 284726 - DNA, 25 bp, Homo sapien
gaattttttatctgcttgatgaaga

SEQ ID NO: 284727 - DNA, 25 bp, Homo sapien
aaaacagtcccttacctctgagaag

SEQ ID NO: 284728 - DNA, 25 bp, Homo sapien
ggaagcaggacagcacagtgttgaa

SEQ ID NO: 284729 - DNA, 25 bp, Homo sapien
aaggacatgggttttggagccagac

SEQ ID NO: 284730 - DNA, 25 bp, Homo sapien
tctgagaagcgtctcctggcagatg

SEQ ID NO: 284731 - DNA, 25 bp, Homo sapien
ctggcagatgaaaccctcaatcact

SEQ ID NO: 284732 - DNA, 25 bp, Homo sapien
tcaatcactctgtcgctaacaggac

SEQ ID NO: 284733 - DNA, 25 bp, Homo sapien
acggactcagcagatgcgtagcatt

SEQ ID NO: 284734 - DNA, 25 bp, Homo sapien
cggactcagcagatgcgtagcattt

SEQ ID NO: 284735 - DNA, 25 bp, Homo sapien
ggactcagcagatgcgtagcatttg

SEQ ID NO: 284736 - DNA, 25 bp, Homo sapien
gactcagcagatgcgtagcatttgc

SEQ ID NO: 284737 - DNA, 25 bp, Homo sapien
actcagcagatgcgtagcatttgct

SEQ ID NO: 284738 - DNA, 25 bp, Homo sapien
ctcagcagatgcgtagcatttgctg

SEQ ID NO: 284739 - DNA, 25 bp, Homo sapien
tcagcagatgcgtagcatttgctgc

SEQ ID NO: 284740 - DNA, 25 bp, Homo sapien
cagcagatgcgtagcatttgctgca

SEQ ID NO: 284741 - DNA, 25 bp, Homo sapien
agcagatgcgtagcatttgctgcat

SEQ ID NO: 284742 - DNA, 25 bp, Homo sapien
gcagatgcgtagcatttgctgcatg

SEQ ID NO: 284743 - DNA, 25 bp, Homo sapien
cagatgcgtagcatttgctgcatgg

SEQ ID NO: 284744 - DNA, 25 bp, Homo sapien
gtaatcctattgaatgttcctctga

SEQ ID NO: 284745 - DNA, 25 bp, Homo sapien
gaatgttcctctgagcatagcttta

SEQ ID NO: 284746 - DNA, 25 bp, Homo sapien
gttcctctgagcatagctttagcta

SEQ ID NO: 284747 - DNA, 25 bp, Homo sapien
atagctttagctatattacttaaat

SEQ ID NO: 284748 - DNA, 25 bp, Homo sapien
ttcaacaagtatttaagcacctgct

SEQ ID NO: 284749 - DNA, 25 bp, Homo sapien
agtatttaagcacctgctccatcta

SEQ ID NO: 284750 - DNA, 25 bp, Homo sapien
taagcacctgctccatctagacatt

SEQ ID NO: 284751 - DNA, 25 bp, Homo sapien
tgctccatctagacattctgccaag

SEQ ID NO: 284752 - DNA, 25 bp, Homo sapien
gacattctgccaagtgctgaggaca

SEQ ID NO: 284753 - DNA, 25 bp, Homo sapien
gaggacacaactatgtacaagacaa

SEQ ID NO: 284754 - DNA, 25 bp, Homo sapien
caagacaaggtctcttgccttcatc

SEQ ID NO: 284755 - DNA, 25 bp, Homo sapien
ggaaggtgttccacgtggccatagc

SEQ ID NO: 284756 - DNA, 25 bp, Homo sapien
tggccatagcgtttgcgtcacaatg

SEQ ID NO: 284757 - DNA, 25 bp, Homo sapien
ttgcgtcacaatgacctggcggaca

SEQ ID NO: 284758 - DNA, 25 bp, Homo sapien
ggagccacagcgtacaccccaggat

SEQ ID NO: 284759 - DNA, 25 bp, Homo sapien
tctgtgctgtgcgtagtgcctactg

SEQ ID NO: 284760 - DNA, 25 bp, Homo sapien
gcctactgcttgcttccaggttaaa

SEQ ID NO: 284761 - DNA, 25 bp, Homo sapien
ccaggttaaatttctgtagctttag

SEQ ID NO: 284762 - DNA, 25 bp, Homo sapien
aggacaggagacttcatgacttcac

SEQ ID NO: 284763 - DNA, 25 bp, Homo sapien
ttcatgacttcactgccaagaaaag

SEQ ID NO: 284764 - DNA, 25 bp, Homo sapien
tacagaggcctgctgtacctggaaa

SEQ ID NO: 284765 - DNA, 25 bp, Homo sapien
atcaagtttgagcttcgagaataaa

SEQ ID NO: 284766 - DNA, 25 bp, Homo sapien
aagtgcttggacctgccttactaca

SEQ ID NO: 284767 - DNA, 25 bp, Homo sapien
ggacctgccttactacatttataac

SEQ ID NO: 284768 - DNA, 25 bp, Homo sapien
ataacaaatgcgacgagctccgcgt

SEQ ID NO: 284769 - DNA, 25 bp, Homo sapien
cgcgccggccggtatacaaaagtgg

SEQ ID NO: 284770 - DNA, 25 bp, Homo sapien
gtatacaaaagtgggcttcgcctct

SEQ ID NO: 284771 - DNA, 25 bp, Homo sapien
tctcgcctcgttttgacttttttgt

SEQ ID NO: 284772 - DNA, 25 bp, Homo sapien
ttgtcccctcgagcaaagaaaacgc

SEQ ID NO: 284773 - DNA, 25 bp, Homo sapien
gcaaagaaaacgctttccgcttcct

SEQ ID NO: 284774 - DNA, 25 bp, Homo sapien
tccgcttcctccgtaggtgataaat

SEQ ID NO: 284775 - DNA, 25 bp, Homo sapien
gaagttcagtctaaaacccaagtct

SEQ ID NO: 284776 - DNA, 25 bp, Homo sapien
ctaaaacccaagtctggtgtcagcg

SEQ ID NO: 284777 - DNA, 25 bp, Homo sapien
attgttggtgtctcatcattaccaa

SEQ ID NO: 284778 - DNA, 25 bp, Homo sapien
acattagattgttgctcactgagaa

SEQ ID NO: 284779 - DNA, 25 bp, Homo sapien
gtgtctcatcattaccaaaccaagg

SEQ ID NO: 284780 - DNA, 25 bp, Homo sapien
attgacttacaaatcaatccttgat

SEQ ID NO: 284781 - DNA, 25 bp, Homo sapien
gctaagtggcagttgaaaggaacat

SEQ ID NO: 284782 - DNA, 25 bp, Homo sapien
aacattatagacctctgttgccctg

SEQ ID NO: 284783 - DNA, 25 bp, Homo sapien
tatagacctctgttgccctgtttta

SEQ ID NO: 284784 - DNA, 25 bp, Homo sapien
tgccctgttttataacttaagctgg

SEQ ID NO: 284785 - DNA, 25 bp, Homo sapien
aacttaagctgggtagctgtgcaga

SEQ ID NO: 284786 - DNA, 25 bp, Homo sapien
tgaatagctgagaatcacacacagt

SEQ ID NO: 284787 - DNA, 25 bp, Homo sapien
atcacacacagtggtgaatcttgta

SEQ ID NO: 284788 - DNA, 25 bp, Homo sapien
gatcccttgggcttggctcactcct

SEQ ID NO: 284789 - DNA, 25 bp, Homo sapien
atctctttggcatgaccaacaactg

SEQ ID NO: 284790 - DNA, 25 bp, Homo sapien
ttggcatgaccaacaactggctggc

SEQ ID NO: 284791 - DNA, 25 bp, Homo sapien
atgaccaacaactggctggcgagcc

SEQ ID NO: 284792 - DNA, 25 bp, Homo sapien
caactggctggcgagccagagatcg

SEQ ID NO: 284793 - DNA, 25 bp, Homo sapien
aagaagggccctgagcatgagtgca

SEQ ID NO: 284794 - DNA, 25 bp, Homo sapien
agcatgagtgcacctcactgcatgg

SEQ ID NO: 284795 - DNA, 25 bp, Homo sapien
actgcatggccctggtcaggtccct

SEQ ID NO: 284796 - DNA, 25 bp, Homo sapien
cagcagcctgtgcacatttagcgct

SEQ ID NO: 284797 - DNA, 25 bp, Homo sapien
tgtgcacatttagcgctggatccct

SEQ ID NO: 284798 - DNA, 25 bp, Homo sapien
tggatccctgatcccttgggcttgg

SEQ ID NO: 284799 - DNA, 25 bp, Homo sapien
gaattcaatccagttcattttgtga

SEQ ID NO: 284800 - DNA, 25 bp, Homo sapien
aacttttaaaatcctcaagcaggtg

SEQ ID NO: 284801 - DNA, 25 bp, Homo sapien
gcaggtgagttttaaactgcttcta

SEQ ID NO: 284802 - DNA, 25 bp, Homo sapien
aaactgcttctatcaagggtcagat

SEQ ID NO: 284803 - DNA, 25 bp, Homo sapien
tcaagggtcagatcaggtagggctt

SEQ ID NO: 284804 - DNA, 25 bp, Homo sapien
gcttgggtcttttttgggtaatgag

SEQ ID NO: 284805 - DNA, 25 bp, Homo sapien
gctgcaaataccttttatcaccaca

SEQ ID NO: 284806 - DNA, 25 bp, Homo sapien
aggttacagaaggacagtggcattg

SEQ ID NO: 284807 - DNA, 25 bp, Homo sapien
gtggcattgtcagatcggatcactc

SEQ ID NO: 284808 - DNA, 25 bp, Homo sapien
ttatcaccacagaaagacaactatt

SEQ ID NO: 284809 - DNA, 25 bp, Homo sapien
ctagaattgcaatgagtgtttcaaa

SEQ ID NO: 284810 - DNA, 25 bp, Homo sapien
tagtgtaatgataccatgacagtgg

SEQ ID NO: 284811 - DNA, 25 bp, Homo sapien
agtggtggtatgaaagcatctgaaa

SEQ ID NO: 284812 - DNA, 25 bp, Homo sapien
aaagaggcatataacccatactggg

SEQ ID NO: 284813 - DNA, 25 bp, Homo sapien
cacagagggcttcccagggaatatc

SEQ ID NO: 284814 - DNA, 25 bp, Homo sapien
ggcttcccagggaatatcattccag

SEQ ID NO: 284815 - DNA, 25 bp, Homo sapien
gggaatatcattccagaactgagtc

SEQ ID NO: 284816 - DNA, 25 bp, Homo sapien
gaagataaccaccaaatgaaatgca

SEQ ID NO: 284817 - DNA, 25 bp, Homo sapien
atgaaatgcatgatccttggtttga

SEQ ID NO: 284818 - DNA, 25 bp, Homo sapien
tactatgagccagacagtagggcct

SEQ ID NO: 284819 - DNA, 25 bp, Homo sapien
gggcctggagagtaaaaagtcttca

SEQ ID NO: 284820 - DNA, 25 bp, Homo sapien
gagattactgtttattgtgagagac

SEQ ID NO: 284821 - DNA, 25 bp, Homo sapien
gagggaggtgatactgacttgagat

SEQ ID NO: 284822 - DNA, 25 bp, Homo sapien
tctcctctgtgtcccaaacgagttt

SEQ ID NO: 284823 - DNA, 25 bp, Homo sapien
acggccttagatcacactctggatg

SEQ ID NO: 284824 - DNA, 25 bp, Homo sapien
gccttagatcacactctggatggat

SEQ ID NO: 284825 - DNA, 25 bp, Homo sapien
gatcacactctggatggataggaca

SEQ ID NO: 284826 - DNA, 25 bp, Homo sapien
ggataggacagtcgtcctcaatact

SEQ ID NO: 284827 - DNA, 25 bp, Homo sapien
gtcccaaacgagtttgtgcctcact

SEQ ID NO: 284828 - DNA, 25 bp, Homo sapien
tgtgcctcactttgtcgggttttgg

SEQ ID NO: 284829 - DNA, 25 bp, Homo sapien
cactttgtcgggttttggctgtgac

SEQ ID NO: 284830 - DNA, 25 bp, Homo sapien
ggctgtgacttggagcctcaccaag

SEQ ID NO: 284831 - DNA, 25 bp, Homo sapien
ttggagcctcaccaagctccctttt

SEQ ID NO: 284832 - DNA, 25 bp, Homo sapien
acagaaagcatagacgtctcaggtt

SEQ ID NO: 284833 - DNA, 25 bp, Homo sapien
gcatagacgtctcaggttattcgtt

SEQ ID NO: 284834 - DNA, 25 bp, Homo sapien
gttactctaaggtaaaaccatctag

SEQ ID NO: 284835 - DNA, 25 bp, Homo sapien
tctaggatgattttcccccttgcag

SEQ ID NO: 284836 - DNA, 25 bp, Homo sapien
ccccttgcagttatgttatcattct

SEQ ID NO: 284837 - DNA, 25 bp, Homo sapien
tttcttacgcttgctatcatggcag

SEQ ID NO: 284838 - DNA, 25 bp, Homo sapien
gcttgctatcatggcagcatgcgat

SEQ ID NO: 284839 - DNA, 25 bp, Homo sapien
ggcagcatgcgatgtcatattttcc

SEQ ID NO: 284840 - DNA, 25 bp, Homo sapien
tcctttatgtgatgtaactactttc

SEQ ID NO: 284841 - DNA, 25 bp, Homo sapien
gatgtaactactttctgttatctag

SEQ ID NO: 284842 - DNA, 25 bp, Homo sapien
aacacttctactgttcaatttcaga

SEQ ID NO: 284843 - DNA, 25 bp, Homo sapien
tcaaactgtgatgccggaccgtttc

SEQ ID NO: 284844 - DNA, 25 bp, Homo sapien
atgccggaccgtttctccaactggt

SEQ ID NO: 284845 - DNA, 25 bp, Homo sapien
aactggtcccgtatcgcaggtgcct

SEQ ID NO: 284846 - DNA, 25 bp, Homo sapien
gggtccttcgaaaattcagcttgcc

SEQ ID NO: 284847 - DNA, 25 bp, Homo sapien
aaaattcagcttgccgggctgcctg

SEQ ID NO: 284848 - DNA, 25 bp, Homo sapien
gttctgtaggtctcgggtgggcccg

SEQ ID NO: 284849 - DNA, 25 bp, Homo sapien
agacgttggcgcagctggtccagaa

SEQ ID NO: 284850 - DNA, 25 bp, Homo sapien
gctggtccagaacctgactttgaga

SEQ ID NO: 284851 - DNA, 25 bp, Homo sapien
ggctgacaactgtgaccctaggggt

SEQ ID NO: 284852 - DNA, 25 bp, Homo sapien
gggtcctagagaccatcagacccca

SEQ ID NO: 284853 - DNA, 25 bp, Homo sapien
gagaccatcagaccccacatctggg

SEQ ID NO: 284854 - DNA, 25 bp, Homo sapien
gtagcagagatgcaatgtggcttct

SEQ ID NO: 284855 - DNA, 25 bp, Homo sapien
cagagatgcaatgtggcttctcccc

SEQ ID NO: 284856 - DNA, 25 bp, Homo sapien
aaagacctgattttacctcactgcc

SEQ ID NO: 284857 - DNA, 25 bp, Homo sapien
cctgattttacctcactgccagaaa

SEQ ID NO: 284858 - DNA, 25 bp, Homo sapien
actgccagaaaagagaatggtgctc

SEQ ID NO: 284859 - DNA, 25 bp, Homo sapien
tttgtacatagtgttcactgggcag

SEQ ID NO: 284860 - DNA, 25 bp, Homo sapien
atctacctggataagggctccgagc

SEQ ID NO: 284861 - DNA, 25 bp, Homo sapien
gggctccgagctacagggaccctga

SEQ ID NO: 284862 - DNA, 25 bp, Homo sapien
cagggaccctgacattgggatgtat

SEQ ID NO: 284863 - DNA, 25 bp, Homo sapien
ggaacagttgtaccgaatcttgaag

SEQ ID NO: 284864 - DNA, 25 bp, Homo sapien
agttgtaccgaatcttgaagtgaag

SEQ ID NO: 284865 - DNA, 25 bp, Homo sapien
tgaagggcgaaaggacgcgtcttct

SEQ ID NO: 284866 - DNA, 25 bp, Homo sapien
tttcctggaagcttcatccaagggc

SEQ ID NO: 284867 - DNA, 25 bp, Homo sapien
agcttcatccaagggcttctacata

SEQ ID NO: 284868 - DNA, 25 bp, Homo sapien
aagggcttctacatacctctctgtg

SEQ ID NO: 284869 - DNA, 25 bp, Homo sapien
tacatacctctctgtgaccattctg

SEQ ID NO: 284870 - DNA, 25 bp, Homo sapien
tctgtgaccattctgtctgcaagag

SEQ ID NO: 284871 - DNA, 25 bp, Homo sapien
ttatctgaggaatttgctgcccaga

SEQ ID NO: 284872 - DNA, 25 bp, Homo sapien
ctgcccagatggaatcagggttatt

SEQ ID NO: 284873 - DNA, 25 bp, Homo sapien
gcagaatcgcttgttgggcaggcaa

SEQ ID NO: 284874 - DNA, 25 bp, Homo sapien
tgttgggcaggcaacctgctgtctg

SEQ ID NO: 284875 - DNA, 25 bp, Homo sapien
tgctgtctgtcctacaggtctcaac

SEQ ID NO: 284876 - DNA, 25 bp, Homo sapien
atatgccacagagaggatccagaga

SEQ ID NO: 284877 - DNA, 25 bp, Homo sapien
agagagcccatctccggtcagttat

SEQ ID NO: 284878 - DNA, 25 bp, Homo sapien
atctccggtcagttatctgtatttg

SEQ ID NO: 284879 - DNA, 25 bp, Homo sapien
gtatttgtatgtcaactacagcatc

SEQ ID NO: 284880 - DNA, 25 bp, Homo sapien
gtacaccaacgccagtccaaaggac

SEQ ID NO: 284881 - DNA, 25 bp, Homo sapien
gtcactgtgaactggaaattcatct

SEQ ID NO: 284882 - DNA, 25 bp, Homo sapien
ctacctactttatgctttatctcta

SEQ ID NO: 284883 - DNA, 25 bp, Homo sapien
atgaacagtgtcctgtaaccctcag

SEQ ID NO: 284884 - DNA, 25 bp, Homo sapien
tgtcctgtaaccctcagagtgagac

SEQ ID NO: 284885 - DNA, 25 bp, Homo sapien
gagactagagtcagaatgcaggctt

SEQ ID NO: 284886 - DNA, 25 bp, Homo sapien
gaatgcaggcttttctcatttgaaa

SEQ ID NO: 284887 - DNA, 25 bp, Homo sapien
gacgggctgctgagtcgcgcgctgc

SEQ ID NO: 284888 - DNA, 25 bp, Homo sapien
gggctgctgagtcgcgcgctgcggg

SEQ ID NO: 284889 - DNA, 25 bp, Homo sapien
gcgctgcgggctggaaggagtcgcc

SEQ ID NO: 284890 - DNA, 25 bp, Homo sapien
gggctggaaggagtcgccgcctggc

SEQ ID NO: 284891 - DNA, 25 bp, Homo sapien
gctggaaggagtcgccgcctggccc

SEQ ID NO: 284892 - DNA, 25 bp, Homo sapien
gctccgtctccagcgggaacgagga

SEQ ID NO: 284893 - DNA, 25 bp, Homo sapien
gtctccagcgggaacgaggacgagg

SEQ ID NO: 284894 - DNA, 25 bp, Homo sapien
tccagcgggaacgaggacgaggagc

SEQ ID NO: 284895 - DNA, 25 bp, Homo sapien
agcgccgcgcgggatccgagtcccc

SEQ ID NO: 284896 - DNA, 25 bp, Homo sapien
tcctcgagcccgctgtcatccaggg

SEQ ID NO: 284897 - DNA, 25 bp, Homo sapien
gtcatccagggccccgcttcctgag

SEQ ID NO: 284898 - DNA, 25 bp, Homo sapien
aacaggtgacttggctgggagcact

SEQ ID NO: 284899 - DNA, 25 bp, Homo sapien
tcctgggaactggtaggtgctcaat

SEQ ID NO: 284900 - DNA, 25 bp, Homo sapien
ttggctgggagcactcagtcattta

SEQ ID NO: 284901 - DNA, 25 bp, Homo sapien
tcagtcatttagtggcagtaggcaa

SEQ ID NO: 284902 - DNA, 25 bp, Homo sapien
tttcactagcacatgctgcctggta

SEQ ID NO: 284903 - DNA, 25 bp, Homo sapien
acatgctgcctggtagagtatgaac

SEQ ID NO: 284904 - DNA, 25 bp, Homo sapien
gatagttaccaaatgctctacacag

SEQ ID NO: 284905 - DNA, 25 bp, Homo sapien
ccccagtcttaacaagtgccggtga

SEQ ID NO: 284906 - DNA, 25 bp, Homo sapien
aacaagtgccggtgattcatgagat

SEQ ID NO: 284907 - DNA, 25 bp, Homo sapien
gatacatcatgtggctcagatccct

SEQ ID NO: 284908 - DNA, 25 bp, Homo sapien
tcagatcccttgttttgcaggtgag

SEQ ID NO: 284909 - DNA, 25 bp, Homo sapien
ttgttactcgaagaaaactgatagt

SEQ ID NO: 284910 - DNA, 25 bp, Homo sapien
tgatagtaagttttcacatgggaaa

SEQ ID NO: 284911 - DNA, 25 bp, Homo sapien
aatgttgtcttaccagcaatccaaa

SEQ ID NO: 284912 - DNA, 25 bp, Homo sapien
gagaattaaggcaacttgaacacaa

SEQ ID NO: 284913 - DNA, 25 bp, Homo sapien
ggaaatgtgacaagtatgcctaata

SEQ ID NO: 284914 - DNA, 25 bp, Homo sapien
gcaatactgtgcatagagacgttta

SEQ ID NO: 284915 - DNA, 25 bp, Homo sapien
gtgcatagagacgtttaaacattac

SEQ ID NO: 284916 - DNA, 25 bp, Homo sapien
taaacattactggttgctaggcata

SEQ ID NO: 284917 - DNA, 25 bp, Homo sapien
attactggttgctaggcatatcaag

SEQ ID NO: 284918 - DNA, 25 bp, Homo sapien
atcacttctctatgttctaagatgg

SEQ ID NO: 284919 - DNA, 25 bp, Homo sapien
gatggtaacagtgagactacaagta

SEQ ID NO: 284920 - DNA, 25 bp, Homo sapien
gatattgtattgttcgtcattataa

SEQ ID NO: 284921 - DNA, 25 bp, Homo sapien
gtcattataatatgctaccacatgt

SEQ ID NO: 284922 - DNA, 25 bp, Homo sapien
ctaccacatgtagcaataattacaa

SEQ ID NO: 284923 - DNA, 25 bp, Homo sapien
ttctctgtactgtctacctttatgt

SEQ ID NO: 284924 - DNA, 25 bp, Homo sapien
gtactgtctacctttatgtgaagaa

SEQ ID NO: 284925 - DNA, 25 bp, Homo sapien
aattaattatatgccattgccaggt

SEQ ID NO: 284926 - DNA, 25 bp, Homo sapien
atatgccattgccaggtagaagttt

SEQ ID NO: 284927 - DNA, 25 bp, Homo sapien
gccattgccaggtagaagtttggaa

SEQ ID NO: 284928 - DNA, 25 bp, Homo sapien
ggaataattgtttagtctctcctat

SEQ ID NO: 284929 - DNA, 25 bp, Homo sapien
gtttagtctctcctattagatgtgg

SEQ ID NO: 284930 - DNA, 25 bp, Homo sapien
gtctctcctattagatgtggacatt

SEQ ID NO: 284931 - DNA, 25 bp, Homo sapien
tacagcagcggaaacatcgggaagt

SEQ ID NO: 284932 - DNA, 25 bp, Homo sapien
catcgggaagtttctatctaactgt

SEQ ID NO: 284933 - DNA, 25 bp, Homo sapien
aagtcagctatgctggaagcttcct

SEQ ID NO: 284934 - DNA, 25 bp, Homo sapien
tggaagcttcctcaaccaaagtgaa

SEQ ID NO: 284935 - DNA, 25 bp, Homo sapien
aaggcacattccagattgtgggcac

SEQ ID NO: 284936 - DNA, 25 bp, Homo sapien
ttgtgggcacgctgtccaagcctga

SEQ ID NO: 284937 - DNA, 25 bp, Homo sapien
acagcccgcggcctgactttgcggt

SEQ ID NO: 284938 - DNA, 25 bp, Homo sapien
ctgctgctctcacggagaaggttat

SEQ ID NO: 284939 - DNA, 25 bp, Homo sapien
cggagaaggttatccggacccagag

SEQ ID NO: 284940 - DNA, 25 bp, Homo sapien
gacccagagggtgtttataaacctg

SEQ ID NO: 284941 - DNA, 25 bp, Homo sapien
aaacctgttggattcctacagcagc

SEQ ID NO: 284942 - DNA, 25 bp, Homo sapien
gctcggcaaggaatccacgacatgc

SEQ ID NO: 284943 - DNA, 25 bp, Homo sapien
aatccacgacatgctggaacacggt

SEQ ID NO: 284944 - DNA, 25 bp, Homo sapien
cgacatgctggaacacggtgggaac

SEQ ID NO: 284945 - DNA, 25 bp, Homo sapien
ctggaacacggtgggaacaagatcc

SEQ ID NO: 284946 - DNA, 25 bp, Homo sapien
aagaatatgaatgacctccctggtt

SEQ ID NO: 284947 - DNA, 25 bp, Homo sapien
aatatgaatgacctccctggttgcg

SEQ ID NO: 284948 - DNA, 25 bp, Homo sapien
tgaatgacctccctggttgcgcctg

SEQ ID NO: 284949 - DNA, 25 bp, Homo sapien
cgcctgcccggagggaaggattatt

SEQ ID NO: 284950 - DNA, 25 bp, Homo sapien
cccggagggaaggattattctgagt

SEQ ID NO: 284951 - DNA, 25 bp, Homo sapien
tattctgagttgtctgtaacctggt

SEQ ID NO: 284952 - DNA, 25 bp, Homo sapien
tgagttgtctgtaacctggtagggc

SEQ ID NO: 284953 - DNA, 25 bp, Homo sapien
agtttatagaatttgttccttatca

SEQ ID NO: 284954 - DNA, 25 bp, Homo sapien
tacttgatcaacattcttagacttt

SEQ ID NO: 284955 - DNA, 25 bp, Homo sapien
aaagcactcctatatcttaaatgtc

SEQ ID NO: 284956 - DNA, 25 bp, Homo sapien
gcactcctatatcttaaatgtcctt

SEQ ID NO: 284957 - DNA, 25 bp, Homo sapien
ctcctatatcttaaatgtccttctt

SEQ ID NO: 284958 - DNA, 25 bp, Homo sapien
ctatatcttaaatgtccttcttttt

SEQ ID NO: 284959 - DNA, 25 bp, Homo sapien
gaaatttatgcccacagatttttct

SEQ ID NO: 284960 - DNA, 25 bp, Homo sapien
aatgtgaagatactgtttacagctt

SEQ ID NO: 284961 - DNA, 25 bp, Homo sapien
gtttacagcttttgttaattgcact

SEQ ID NO: 284962 - DNA, 25 bp, Homo sapien
acagcttttgttaattgcacttttc

SEQ ID NO: 284963 - DNA, 25 bp, Homo sapien
gcttttgttaattgcacttttcatc

SEQ ID NO: 284964 - DNA, 25 bp, Homo sapien
aggagtgctggcttatagagttaga

SEQ ID NO: 284965 - DNA, 25 bp, Homo sapien
gaagtcagtatttcttctaatctga

SEQ ID NO: 284966 - DNA, 25 bp, Homo sapien
tttcttctaatctgaggctatgatc

SEQ ID NO: 284967 - DNA, 25 bp, Homo sapien
gaggctatgatcagtcccagctgta

SEQ ID NO: 284968 - DNA, 25 bp, Homo sapien
gatttttgtgggacaactctagccc

SEQ ID NO: 284969 - DNA, 25 bp, Homo sapien
tctagcccacaaactgactggctgg

SEQ ID NO: 284970 - DNA, 25 bp, Homo sapien
ctgactggctggtgagtcttgactc

SEQ ID NO: 284971 - DNA, 25 bp, Homo sapien
tcttgactcccttccaacacagatg

SEQ ID NO: 284972 - DNA, 25 bp, Homo sapien
tccagatcattcacttcgcacgtgg

SEQ ID NO: 284973 - DNA, 25 bp, Homo sapien
tcacttcgcacgtgggccttgtgaa

SEQ ID NO: 284974 - DNA, 25 bp, Homo sapien
gatttgtgaatatccaggaagaact

SEQ ID NO: 284975 - DNA, 25 bp, Homo sapien
ttgattgggtgtgtgttccccagtt

SEQ ID NO: 284976 - DNA, 25 bp, Homo sapien
cagtttgccacagcctactggactt

SEQ ID NO: 284977 - DNA, 25 bp, Homo sapien
tggacttccctcttatatcagacaa

SEQ ID NO: 284978 - DNA, 25 bp, Homo sapien
aacttctctactttgtagttcctgc

SEQ ID NO: 284979 - DNA, 25 bp, Homo sapien
tgtagttcctgctcagccctgaaga

SEQ ID NO: 284980 - DNA, 25 bp, Homo sapien
tcagccctgaagacctctaagtttg

SEQ ID NO: 284981 - DNA, 25 bp, Homo sapien
gaagacctctaagtttgagacccct

SEQ ID NO: 284982 - DNA, 25 bp, Homo sapien
gacccctgatttagatctgtaatta

SEQ ID NO: 284983 - DNA, 25 bp, Homo sapien
gttctgaatttcatgatttgctaat

SEQ ID NO: 284984 - DNA, 25 bp, Homo sapien
ggtagttcacataggccagtttgac

SEQ ID NO: 284985 - DNA, 25 bp, Homo sapien
gccagtttgacccacagttatttta

SEQ ID NO: 284986 - DNA, 25 bp, Homo sapien
ggaaatcagctcttcccataccatg

SEQ ID NO: 284987 - DNA, 25 bp, Homo sapien
tagccccacagaaatccactagtct

SEQ ID NO: 284988 - DNA, 25 bp, Homo sapien
gaaatccactagtctgggctttctc

SEQ ID NO: 284989 - DNA, 25 bp, Homo sapien
ctgggctttctctgcgattggctga

SEQ ID NO: 284990 - DNA, 25 bp, Homo sapien
ctctgcgattggctgaggcagcaac

SEQ ID NO: 284991 - DNA, 25 bp, Homo sapien
atcagatggtggatgtggcctgccc

SEQ ID NO: 284992 - DNA, 25 bp, Homo sapien
atgtggcctgcccaaggtgcataca

SEQ ID NO: 284993 - DNA, 25 bp, Homo sapien
aaggtgcatacagtcccttccttag

SEQ ID NO: 284994 - DNA, 25 bp, Homo sapien
tacagtcccttccttagtgtgggta

SEQ ID NO: 284995 - DNA, 25 bp, Homo sapien
tggtggttttggacttcacctctgt

SEQ ID NO: 284996 - DNA, 25 bp, Homo sapien
tttggacttcacctctgtcctcaag

SEQ ID NO: 284997 - DNA, 25 bp, Homo sapien
tggctcttgtttgtttaggcccagg

SEQ ID NO: 284998 - DNA, 25 bp, Homo sapien
gggccagagctaggttttagagatc

SEQ ID NO: 284999 - DNA, 25 bp, Homo sapien
taggttttagagatcctacaggatc

SEQ ID NO: 285000 - DNA, 25 bp, Homo sapien
gatcctacaggatcccacatgggac

SEQ ID NO: 285001 - DNA, 25 bp, Homo sapien
tacaggatcccacatgggacggcta

SEQ ID NO: 285002 - DNA, 25 bp, Homo sapien
tcccacatgggacggctacctaggt

SEQ ID NO: 285003 - DNA, 25 bp, Homo sapien
gcacggcccctacccgagaacagga

SEQ ID NO: 285004 - DNA, 25 bp, Homo sapien
catgatcagggatatgagcagggcc

SEQ ID NO: 285005 - DNA, 25 bp, Homo sapien
atcagggatatgagcagggcctgcc

SEQ ID NO: 285006 - DNA, 25 bp, Homo sapien
cagagcctgggcacctttgggagag

SEQ ID NO: 285007 - DNA, 25 bp, Homo sapien
gtgaggtgggacttggaaaggcttt

SEQ ID NO: 285008 - DNA, 25 bp, Homo sapien
agctcctctgttactttgcttttat

SEQ ID NO: 285009 - DNA, 25 bp, Homo sapien
tcttcatgagcatctttgagggctt

SEQ ID NO: 285010 - DNA, 25 bp, Homo sapien
tcaaattctgtcaaagcctgctgct

SEQ ID NO: 285011 - DNA, 25 bp, Homo sapien
ctttgagggcttgaattgcagattc

SEQ ID NO: 285012 - DNA, 25 bp, Homo sapien
gcagattcatgctcatcatttttag

SEQ ID NO: 285013 - DNA, 25 bp, Homo sapien
cttgctcattttcaggtgcatctcc

SEQ ID NO: 285014 - DNA, 25 bp, Homo sapien
aggtgcatctcctggctgtagtcca

SEQ ID NO: 285015 - DNA, 25 bp, Homo sapien
caaagcctgctgcttcatttttatg

SEQ ID NO: 285016 - DNA, 25 bp, Homo sapien
atgtgatcttctaatgatgattcta

SEQ ID NO: 285017 - DNA, 25 bp, Homo sapien
gaatctttcttctaaggtctagctc

SEQ ID NO: 285018 - DNA, 25 bp, Homo sapien
taaggtctagctcctctgttacttt

SEQ ID NO: 285019 - DNA, 25 bp, Homo sapien
agcttctttcaaatgggctaaacta

SEQ ID NO: 285020 - DNA, 25 bp, Homo sapien
ggctaaactaccttattccagaaag

SEQ ID NO: 285021 - DNA, 25 bp, Homo sapien
gaaagtgtcagcaggtggcactctt

SEQ ID NO: 285022 - DNA, 25 bp, Homo sapien
gtggcactctttccaccaaattgga

SEQ ID NO: 285023 - DNA, 25 bp, Homo sapien
ttgttttaccacgtttatgggtgat

SEQ ID NO: 285024 - DNA, 25 bp, Homo sapien
cgtttatgggtgattatgttgtctt

SEQ ID NO: 285025 - DNA, 25 bp, Homo sapien
gttgtcttgaagatcatctgttttt

SEQ ID NO: 285026 - DNA, 25 bp, Homo sapien
atctgtttttgatctgtccatcacc

SEQ ID NO: 285027 - DNA, 25 bp, Homo sapien
cacccctcagaacttgctcatttta

SEQ ID NO: 285028 - DNA, 25 bp, Homo sapien
ttttatttcatctcccatagagttt

SEQ ID NO: 285029 - DNA, 25 bp, Homo sapien
aacatttctttttgcaatctacttg

SEQ ID NO: 285030 - DNA, 25 bp, Homo sapien
tagaacacttatgacattttggtta

SEQ ID NO: 285031 - DNA, 25 bp, Homo sapien
atccttcctataggccaaacttggg

SEQ ID NO: 285032 - DNA, 25 bp, Homo sapien
gccagacagtgtgctgaaacagaga

SEQ ID NO: 285033 - DNA, 25 bp, Homo sapien
aacagagactcgagtcttgaacaag

SEQ ID NO: 285034 - DNA, 25 bp, Homo sapien
agtcttcttactagtcttgtgctta

SEQ ID NO: 285035 - DNA, 25 bp, Homo sapien
tagtcttgtgcttattttcctccct

SEQ ID NO: 285036 - DNA, 25 bp, Homo sapien
ggtaataattcccagtcacacaaac

SEQ ID NO: 285037 - DNA, 25 bp, Homo sapien
taattcccagtcacacaaacccata

SEQ ID NO: 285038 - DNA, 25 bp, Homo sapien
gccatggactcttgttctccaatga

SEQ ID NO: 285039 - DNA, 25 bp, Homo sapien
ctcttgttctccaatgattccagac

SEQ ID NO: 285040 - DNA, 25 bp, Homo sapien
gattccagactattagaacacttat

SEQ ID NO: 285041 - DNA, 25 bp, Homo sapien
gcctggttgcccattctttatggtc

SEQ ID NO: 285042 - DNA, 25 bp, Homo sapien
tggttgcccattctttatggtcgtt

SEQ ID NO: 285043 - DNA, 25 bp, Homo sapien
ggttgcccattctttatggtcgttt

SEQ ID NO: 285044 - DNA, 25 bp, Homo sapien
ttgcccattctttatggtcgtttct

SEQ ID NO: 285045 - DNA, 25 bp, Homo sapien
gcccattctttatggtcgtttcttg

SEQ ID NO: 285046 - DNA, 25 bp, Homo sapien
attctttatggtcgtttcttgatga

SEQ ID NO: 285047 - DNA, 25 bp, Homo sapien
atatgctaaccaaggagtggattaa

SEQ ID NO: 285048 - DNA, 25 bp, Homo sapien
ccaaggagtggattaatcatgcctc

SEQ ID NO: 285049 - DNA, 25 bp, Homo sapien
ttttggaccacatagggtctaaact

SEQ ID NO: 285050 - DNA, 25 bp, Homo sapien
accacatagggtctaaactgtcatg

SEQ ID NO: 285051 - DNA, 25 bp, Homo sapien
ccacatagggtctaaactgtcatgg

SEQ ID NO: 285052 - DNA, 25 bp, Homo sapien
agatggcctcagatactagcgactt

SEQ ID NO: 285053 - DNA, 25 bp, Homo sapien
gcctcagatactagcgacttctttg

SEQ ID NO: 285054 - DNA, 25 bp, Homo sapien
tactagcgacttctttgggagcacg

SEQ ID NO: 285055 - DNA, 25 bp, Homo sapien
agcgacttctttgggagcacgctta

SEQ ID NO: 285056 - DNA, 25 bp, Homo sapien
gagcacgcttactcctcgagaaagg

SEQ ID NO: 285057 - DNA, 25 bp, Homo sapien
agaccgaacctacagactcagcaga

SEQ ID NO: 285058 - DNA, 25 bp, Homo sapien
agactcagcagaggcgacctgtgtg

SEQ ID NO: 285059 - DNA, 25 bp, Homo sapien
tcagcagaggcgacctgtgtgcccc

SEQ ID NO: 285060 - DNA, 25 bp, Homo sapien
aggcgcagtccagtctctgcgagtc

SEQ ID NO: 285061 - DNA, 25 bp, Homo sapien
gagcccgactttgagccctcggtta

SEQ ID NO: 285062 - DNA, 25 bp, Homo sapien
tgagccctcggttaccatgccactg

SEQ ID NO: 285063 - DNA, 25 bp, Homo sapien
tgaaaagaacaattgctgtccttct

SEQ ID NO: 285064 - DNA, 25 bp, Homo sapien
tccttctggatgacattttgcaacg

SEQ ID NO: 285065 - DNA, 25 bp, Homo sapien
caacgattggtgaagctggagaaca

SEQ ID NO: 285066 - DNA, 25 bp, Homo sapien
tattgttgtgaatggctcagcagcc

SEQ ID NO: 285067 - DNA, 25 bp, Homo sapien
agccaacaccaccaatggtactagt

SEQ ID NO: 285068 - DNA, 25 bp, Homo sapien
ggaatttggtgccagtaaccacaaa

SEQ ID NO: 285069 - DNA, 25 bp, Homo sapien
atgtctcgggcagtatcagatagca

SEQ ID NO: 285070 - DNA, 25 bp, Homo sapien
tgaaaatcaccttgtgctgctccat

SEQ ID NO: 285071 - DNA, 25 bp, Homo sapien
tgtgctgctccatccactgtggatt

SEQ ID NO: 285072 - DNA, 25 bp, Homo sapien
gattatatcctatggcagaaaagct

SEQ ID NO: 285073 - DNA, 25 bp, Homo sapien
gctggcttaggacagagcaatactt

SEQ ID NO: 285074 - DNA, 25 bp, Homo sapien
aatgtgtgccactggtacttggtcc

SEQ ID NO: 285075 - DNA, 25 bp, Homo sapien
ggtacttggtcctctggagcatgga

SEQ ID NO: 285076 - DNA, 25 bp, Homo sapien
cctctggagcatggactgggaattc

SEQ ID NO: 285077 - DNA, 25 bp, Homo sapien
ggactgggaattcattcccctctgt

SEQ ID NO: 285078 - DNA, 25 bp, Homo sapien
gatgaacatgttctctcctaacact

SEQ ID NO: 285079 - DNA, 25 bp, Homo sapien
gttctctcctaacactgcatggtga

SEQ ID NO: 285080 - DNA, 25 bp, Homo sapien
aacactgcatggtgaatctggacct

SEQ ID NO: 285081 - DNA, 25 bp, Homo sapien
aatctggacctgagctggttggcac

SEQ ID NO: 285082 - DNA, 25 bp, Homo sapien
ctgtcccacccaatcaagaggaatg

SEQ ID NO: 285083 - DNA, 25 bp, Homo sapien
agaggaatggtaggagccccaccca

SEQ ID NO: 285084 - DNA, 25 bp, Homo sapien
aagtcactcttcctccaaggtaggg

SEQ ID NO: 285085 - DNA, 25 bp, Homo sapien
gccaccgcgtggtcctttgcaagag

SEQ ID NO: 285086 - DNA, 25 bp, Homo sapien
accgcgtggtcctttgcaagagcgc

SEQ ID NO: 285087 - DNA, 25 bp, Homo sapien
cgtggtcctttgcaagagcgcagac

SEQ ID NO: 285088 - DNA, 25 bp, Homo sapien
gtcctttgcaagagcgcagaccacc

SEQ ID NO: 285089 - DNA, 25 bp, Homo sapien
tttgcaagagcgcagaccaccgcgc

SEQ ID NO: 285090 - DNA, 25 bp, Homo sapien
accggccaccatgcgctgcaacttg

SEQ ID NO: 285091 - DNA, 25 bp, Homo sapien
atgcgctgcaacttgcgccgctgcc

SEQ ID NO: 285092 - DNA, 25 bp, Homo sapien
tgagtgctctgcacagtgcggcgtc

SEQ ID NO: 285093 - DNA, 25 bp, Homo sapien
tcggtgcgctgcaccagccacacgg

SEQ ID NO: 285094 - DNA, 25 bp, Homo sapien
acgggccaggcgtcgcacgagtgca

SEQ ID NO: 285095 - DNA, 25 bp, Homo sapien
aggcgtcgcacgagtgcacggaggc

SEQ ID NO: 285096 - DNA, 25 bp, Homo sapien
acgagatgaatctcatttcaccaaa

SEQ ID NO: 285097 - DNA, 25 bp, Homo sapien
cgagatgaatctcatttcaccaaaa

SEQ ID NO: 285098 - DNA, 25 bp, Homo sapien
gagatgaatctcatttcaccaaaat

SEQ ID NO: 285099 - DNA, 25 bp, Homo sapien
agatgaatctcatttcaccaaaatt

SEQ ID NO: 285100 - DNA, 25 bp, Homo sapien
gatgaatctcatttcaccaaaatta

SEQ ID NO: 285101 - DNA, 25 bp, Homo sapien
atgaatctcatttcaccaaaattaa

SEQ ID NO: 285102 - DNA, 25 bp, Homo sapien
tgaatctcatttcaccaaaattaaa

SEQ ID NO: 285103 - DNA, 25 bp, Homo sapien
gaatctcatttcaccaaaattaaat

SEQ ID NO: 285104 - DNA, 25 bp, Homo sapien
aatctcatttcaccaaaattaaatt

SEQ ID NO: 285105 - DNA, 25 bp, Homo sapien
atctcatttcaccaaaattaaatta

SEQ ID NO: 285106 - DNA, 25 bp, Homo sapien
aaaaaaggctctgctttgacctgaa

SEQ ID NO: 285107 - DNA, 25 bp, Homo sapien
ggctctgctttgacctgaagtattt

SEQ ID NO: 285108 - DNA, 25 bp, Homo sapien
gacctgaagtattttatctatcctc

SEQ ID NO: 285109 - DNA, 25 bp, Homo sapien
gtattttatctatcctcagtctcag

SEQ ID NO: 285110 - DNA, 25 bp, Homo sapien
tatcctcagtctcaggacactgttg

SEQ ID NO: 285111 - DNA, 25 bp, Homo sapien
ctcaggacactgttgatggaattaa

SEQ ID NO: 285112 - DNA, 25 bp, Homo sapien
ggaattaaggccaagcacatctgca

SEQ ID NO: 285113 - DNA, 25 bp, Homo sapien
aaggccaagcacatctgcaaaaaag

SEQ ID NO: 285114 - DNA, 25 bp, Homo sapien
ctccagtcctgggaaaagcagtggt

SEQ ID NO: 285115 - DNA, 25 bp, Homo sapien
cattttgaaaatgccattccactgt

SEQ ID NO: 285116 - DNA, 25 bp, Homo sapien
attccactgttttctggcctttatg

SEQ ID NO: 285117 - DNA, 25 bp, Homo sapien
gcctggcataattcctaaatacaag

SEQ ID NO: 285118 - DNA, 25 bp, Homo sapien
ggagatagggttacactgttttcta

SEQ ID NO: 285119 - DNA, 25 bp, Homo sapien
aatcccttaatcttgaggtaaactg

SEQ ID NO: 285120 - DNA, 25 bp, Homo sapien
aactgcatgcatttagtcaaacaag

SEQ ID NO: 285121 - DNA, 25 bp, Homo sapien
ttgtttcctcactgtttgggcttaa

SEQ ID NO: 285122 - DNA, 25 bp, Homo sapien
tgggcttaacctcctgatagcctgt

SEQ ID NO: 285123 - DNA, 25 bp, Homo sapien
cctcctgatagcctgttttactgaa

SEQ ID NO: 285124 - DNA, 25 bp, Homo sapien
attggcaggcacagaatcattttta

SEQ ID NO: 285125 - DNA, 25 bp, Homo sapien
ttaagaaccaaatacccagtcctgc

SEQ ID NO: 285126 - DNA, 25 bp, Homo sapien
agtcctgccttaaaggccacatcta

SEQ ID NO: 285127 - DNA, 25 bp, Homo sapien
aggccacatctatgatcatcagctc

SEQ ID NO: 285128 - DNA, 25 bp, Homo sapien
gggataagataacattctctcactt

SEQ ID NO: 285129 - DNA, 25 bp, Homo sapien
ttacctaacccaatggtttgctggc

SEQ ID NO: 285130 - DNA, 25 bp, Homo sapien
cattctctcacttacctaaatttta

SEQ ID NO: 285131 - DNA, 25 bp, Homo sapien
taatgtgtcctgttacataggttaa

SEQ ID NO: 285132 - DNA, 25 bp, Homo sapien
acataggttaatttgtgcttggaaa

SEQ ID NO: 285133 - DNA, 25 bp, Homo sapien
aacccaatggtttgctggcatttag

SEQ ID NO: 285134 - DNA, 25 bp, Homo sapien
aaatacctgttgtttgctttctgac

SEQ ID NO: 285135 - DNA, 25 bp, Homo sapien
gtttgctttctgacattatagtaat

SEQ ID NO: 285136 - DNA, 25 bp, Homo sapien
tgctggcatttaggttagtgtcttt

SEQ ID NO: 285137 - DNA, 25 bp, Homo sapien
aagagctagctctcattgggagagt

SEQ ID NO: 285138 - DNA, 25 bp, Homo sapien
gagccagagcaaccatagtaaacat

SEQ ID NO: 285139 - DNA, 25 bp, Homo sapien
tttgtcttgcgggtctgtcagggtt

SEQ ID NO: 285140 - DNA, 25 bp, Homo sapien
gtctttggccagaacaccgtgggct

SEQ ID NO: 285141 - DNA, 25 bp, Homo sapien
ttggccagaacaccgtgggctgtta

SEQ ID NO: 285142 - DNA, 25 bp, Homo sapien
ggccagaacaccgtgggctgttact

SEQ ID NO: 285143 - DNA, 25 bp, Homo sapien
acttgttgctgattttgaccttgta

SEQ ID NO: 285144 - DNA, 25 bp, Homo sapien
ccagaacaccgtgggctgttacttg

SEQ ID NO: 285145 - DNA, 25 bp, Homo sapien
ttgttgctgattttgaccttgtatt

SEQ ID NO: 285146 - DNA, 25 bp, Homo sapien
gagttggaagcggtttgcatttacg

SEQ ID NO: 285147 - DNA, 25 bp, Homo sapien
cggtttgcatttacgcctgtaaatg

SEQ ID NO: 285148 - DNA, 25 bp, Homo sapien
gcatttacgcctgtaaatgtattca

SEQ ID NO: 285149 - DNA, 25 bp, Homo sapien
gttccccttggtattaacatgtcag

SEQ ID NO: 285150 - DNA, 25 bp, Homo sapien
gtgcaagttttcctgagtttaaacg

SEQ ID NO: 285151 - DNA, 25 bp, Homo sapien
caatttaccaaaaactgtgagtggc

SEQ ID NO: 285152 - DNA, 25 bp, Homo sapien
gtgagtggcttcttttgtccttgag

SEQ ID NO: 285153 - DNA, 25 bp, Homo sapien
tgagtggcttcttttgtccttgaga

SEQ ID NO: 285154 - DNA, 25 bp, Homo sapien
ttgagaagcccttgacctgtttcag

SEQ ID NO: 285155 - DNA, 25 bp, Homo sapien
tgagaagcccttgacctgtttcagt

SEQ ID NO: 285156 - DNA, 25 bp, Homo sapien
agaagcccttgacctgtttcagttg

SEQ ID NO: 285157 - DNA, 25 bp, Homo sapien
aagcccttgacctgtttcagttgaa

SEQ ID NO: 285158 - DNA, 25 bp, Homo sapien
gcccttgacctgtttcagttgaaaa

SEQ ID NO: 285159 - DNA, 25 bp, Homo sapien
cccttgacctgtttcagttgaaaat

SEQ ID NO: 285160 - DNA, 25 bp, Homo sapien
gacctgtttcagttgaaaattacaa

SEQ ID NO: 285161 - DNA, 25 bp, Homo sapien
tttgtcttgcgggtctgtcagggtt

SEQ ID NO: 285162 - DNA, 25 bp, Homo sapien
cggtttgcatttacgcctgtaaatg

SEQ ID NO: 285163 - DNA, 25 bp, Homo sapien
ggtttgcatttacgcctgtaaatgt

SEQ ID NO: 285164 - DNA, 25 bp, Homo sapien
gtttgcatttacgcctgtaaatgta

SEQ ID NO: 285165 - DNA, 25 bp, Homo sapien
tttgcatttacgcctgtaaatgtat

SEQ ID NO: 285166 - DNA, 25 bp, Homo sapien
ttgcatttacgcctgtaaatgtatt

SEQ ID NO: 285167 - DNA, 25 bp, Homo sapien
tgcatttacgcctgtaaatgtattc

SEQ ID NO: 285168 - DNA, 25 bp, Homo sapien
gcatttacgcctgtaaatgtattca

SEQ ID NO: 285169 - DNA, 25 bp, Homo sapien
aacgggcgtgcggtcgatcgagcga

SEQ ID NO: 285170 - DNA, 25 bp, Homo sapien
atcgagcgatcggttggcggctctt

SEQ ID NO: 285171 - DNA, 25 bp, Homo sapien
gagcgatcggttggcggctctttct

SEQ ID NO: 285172 - DNA, 25 bp, Homo sapien
gccgggacggtagctgcggtgcgga

SEQ ID NO: 285173 - DNA, 25 bp, Homo sapien
cgcgtctttcttctcgtacgcagaa

SEQ ID NO: 285174 - DNA, 25 bp, Homo sapien
tttcttctcgtacgcagaactcggg

SEQ ID NO: 285175 - DNA, 25 bp, Homo sapien
ttctcgtacgcagaactcgggcggc

SEQ ID NO: 285176 - DNA, 25 bp, Homo sapien
aactcgggcggcggcctatgcgttt

SEQ ID NO: 285177 - DNA, 25 bp, Homo sapien
atcttgtctcgtcgccggggagtca

SEQ ID NO: 285178 - DNA, 25 bp, Homo sapien
ggagtcaggcccctaaatcgaagaa

SEQ ID NO: 285179 - DNA, 25 bp, Homo sapien
ctaaatcgaagaagccctggcgcgc

SEQ ID NO: 285180 - DNA, 25 bp, Homo sapien
aaactgcatcagttcaaagtgaaac

SEQ ID NO: 285181 - DNA, 25 bp, Homo sapien
tgaaacctacacattgctccttacc

SEQ ID NO: 285182 - DNA, 25 bp, Homo sapien
ctgctccacaatccatagtgctgag

SEQ ID NO: 285183 - DNA, 25 bp, Homo sapien
atccatagtgctgagttgtctgaat

SEQ ID NO: 285184 - DNA, 25 bp, Homo sapien
agttaattgcaagttcaacctgttt

SEQ ID NO: 285185 - DNA, 25 bp, Homo sapien
aataaatcaccagggccaagattga

SEQ ID NO: 285186 - DNA, 25 bp, Homo sapien
gaaaatcgcaaggtatcatactata

SEQ ID NO: 285187 - DNA, 25 bp, Homo sapien
ttcaggttctagaagcaatcggctt

SEQ ID NO: 285188 - DNA, 25 bp, Homo sapien
gaagcaatcggctttttcttttgtt

SEQ ID NO: 285189 - DNA, 25 bp, Homo sapien
attgagtgaatcttgggtccatagc

SEQ ID NO: 285190 - DNA, 25 bp, Homo sapien
gcaaacccctcattaggctataatt

SEQ ID NO: 285191 - DNA, 25 bp, Homo sapien
tccagagggagcgagggaagcggct

SEQ ID NO: 285192 - DNA, 25 bp, Homo sapien
ccagagggagcgagggaagcggcta

SEQ ID NO: 285193 - DNA, 25 bp, Homo sapien
ggagcgagggaagcggctagaggat

SEQ ID NO: 285194 - DNA, 25 bp, Homo sapien
cgagggaagcggctagaggatcggg

SEQ ID NO: 285195 - DNA, 25 bp, Homo sapien
gggatcgcgcctcctgacatgttgg

SEQ ID NO: 285196 - DNA, 25 bp, Homo sapien
ggatcgcgcctcctgacatgttggg

SEQ ID NO: 285197 - DNA, 25 bp, Homo sapien
atcgcgcctcctgacatgttggggg

SEQ ID NO: 285198 - DNA, 25 bp, Homo sapien
gcgcctcctgacatgttgggggtat

SEQ ID NO: 285199 - DNA, 25 bp, Homo sapien
gcctcctgacatgttgggggtatcc

SEQ ID NO: 285200 - DNA, 25 bp, Homo sapien
ctcctgacatgttgggggtatccct

SEQ ID NO: 285201 - DNA, 25 bp, Homo sapien
acatgttgggggtatccctggccgg

SEQ ID NO: 285202 - DNA, 25 bp, Homo sapien
attctgctgacccttatgtggctaa

SEQ ID NO: 285203 - DNA, 25 bp, Homo sapien
acccttatgtggctaaattggcaaa

SEQ ID NO: 285204 - DNA, 25 bp, Homo sapien
gatgataagattttccacccaccaa

SEQ ID NO: 285205 - DNA, 25 bp, Homo sapien
tggaccaaaaagcagaccagttgaa

SEQ ID NO: 285206 - DNA, 25 bp, Homo sapien
ctttgaatgtcagaagggcactaaa

SEQ ID NO: 285207 - DNA, 25 bp, Homo sapien
aagacttcttcagtaccatcctatt

SEQ ID NO: 285208 - DNA, 25 bp, Homo sapien
gtaccatcctattagcaactggaag

SEQ ID NO: 285209 - DNA, 25 bp, Homo sapien
ggaagacaagtagctttctagatct

SEQ ID NO: 285210 - DNA, 25 bp, Homo sapien
gtcttctcctggtaaaaagcctggt

SEQ ID NO: 285211 - DNA, 25 bp, Homo sapien
ggaacatttgatccttacccatcac

SEQ ID NO: 285212 - DNA, 25 bp, Homo sapien
atccttacccatcacattctgctga

SEQ ID NO: 285213 - DNA, 25 bp, Homo sapien
tgcgccggtggctcagtaggttgga

SEQ ID NO: 285214 - DNA, 25 bp, Homo sapien
actgggcgcacgcatgaggcttctc

SEQ ID NO: 285215 - DNA, 25 bp, Homo sapien
gcacgcatgaggcttctcgcccgtg

SEQ ID NO: 285216 - DNA, 25 bp, Homo sapien
ggtgctccgccaggtaggagcccat

SEQ ID NO: 285217 - DNA, 25 bp, Homo sapien
cgccaggtaggagcccatgacgaaa

SEQ ID NO: 285218 - DNA, 25 bp, Homo sapien
ggagcccatgacgaaagcctggccg

SEQ ID NO: 285219 - DNA, 25 bp, Homo sapien
atgacgaaagcctggccgcactcgg

SEQ ID NO: 285220 - DNA, 25 bp, Homo sapien
tcgaagggccgctcaccagtgtgcg

SEQ ID NO: 285221 - DNA, 25 bp, Homo sapien
cgctcaccagtgtgcgtgcgctggt

SEQ ID NO: 285222 - DNA, 25 bp, Homo sapien
cggtggtgcgccaggccggaactgc

SEQ ID NO: 285223 - DNA, 25 bp, Homo sapien
gcagtcggcgcaggcgaagggcttg

SEQ ID NO: 285224 - DNA, 25 bp, Homo sapien
tgtgcacacagttcaggcctgccca

SEQ ID NO: 285225 - DNA, 25 bp, Homo sapien
ggcctgcccagcttcttatgggcaa

SEQ ID NO: 285226 - DNA, 25 bp, Homo sapien
tctcgtctccctgagctgtctggtt

SEQ ID NO: 285227 - DNA, 25 bp, Homo sapien
tgagctgtctggttctgcggaccca

SEQ ID NO: 285228 - DNA, 25 bp, Homo sapien
ctgtctggttctgcggacccaggaa

SEQ ID NO: 285229 - DNA, 25 bp, Homo sapien
gggccctgcttgtgtttatcctcgg

SEQ ID NO: 285230 - DNA, 25 bp, Homo sapien
tgtgtttatcctcggctgctgtctt

SEQ ID NO: 285231 - DNA, 25 bp, Homo sapien
caggcaaggaggcttcccactgctg

SEQ ID NO: 285232 - DNA, 25 bp, Homo sapien
acaccaactctcacggatgcacaga

SEQ ID NO: 285233 - DNA, 25 bp, Homo sapien
ggatgcacagatccctgtggtccgc

SEQ ID NO: 285234 - DNA, 25 bp, Homo sapien
gccgacacacacacacgtcgtaatg

SEQ ID NO: 285235 - DNA, 25 bp, Homo sapien
ggcagagcagtaggacaaatagcta

SEQ ID NO: 285236 - DNA, 25 bp, Homo sapien
gtttatctatatagcacctacatgt

SEQ ID NO: 285237 - DNA, 25 bp, Homo sapien
atctatatagcacctacatgttctg

SEQ ID NO: 285238 - DNA, 25 bp, Homo sapien
atagcacctacatgttctgcacttg

SEQ ID NO: 285239 - DNA, 25 bp, Homo sapien
gcacctacatgttctgcacttgtat

SEQ ID NO: 285240 - DNA, 25 bp, Homo sapien
acatgttctgcacttgtatcctgga

SEQ ID NO: 285241 - DNA, 25 bp, Homo sapien
aagccaacatggcattcattactgc

SEQ ID NO: 285242 - DNA, 25 bp, Homo sapien
gccctgcctgcatgtggctattgag

SEQ ID NO: 285243 - DNA, 25 bp, Homo sapien
gtgctgtatgatacacaccggactt

SEQ ID NO: 285244 - DNA, 25 bp, Homo sapien
caccggactttgaagactcagtgtg

SEQ ID NO: 285245 - DNA, 25 bp, Homo sapien
cggactttgaagactcagtgtgaaa

SEQ ID NO: 285246 - DNA, 25 bp, Homo sapien
ccctcgccggagagagtgctggtaa

SEQ ID NO: 285247 - DNA, 25 bp, Homo sapien
caatgattctggactgagacgcgct

SEQ ID NO: 285248 - DNA, 25 bp, Homo sapien
ttctggactgagacgcgcttgggca

SEQ ID NO: 285249 - DNA, 25 bp, Homo sapien
acgcgcttgggcagaggctatgtaa

SEQ ID NO: 285250 - DNA, 25 bp, Homo sapien
gaggctatgtaatcgtgtctgtgtt

SEQ ID NO: 285251 - DNA, 25 bp, Homo sapien
tctgtgttgaggacttcgcttcgag

SEQ ID NO: 285252 - DNA, 25 bp, Homo sapien
agtgctggtaactccttccccagag

SEQ ID NO: 285253 - DNA, 25 bp, Homo sapien
ttccccagagtctgattacctgctc

SEQ ID NO: 285254 - DNA, 25 bp, Homo sapien
tgattacctgctccgcgaggccgcg

SEQ ID NO: 285255 - DNA, 25 bp, Homo sapien
gacacgtgcggagagccgactgaca

SEQ ID NO: 285256 - DNA, 25 bp, Homo sapien
cggagagccgactgacactcgcagc

SEQ ID NO: 285257 - DNA, 25 bp, Homo sapien
acttgtactactacgatggcctggc

SEQ ID NO: 285258 - DNA, 25 bp, Homo sapien
ttgtactactacgatggcctggcca

SEQ ID NO: 285259 - DNA, 25 bp, Homo sapien
gtactactacgatggcctggccaac

SEQ ID NO: 285260 - DNA, 25 bp, Homo sapien
actacgatggcctggccaaccagca

SEQ ID NO: 285261 - DNA, 25 bp, Homo sapien
ctcgagctctgcatcagaaccaagt

SEQ ID NO: 285262 - DNA, 25 bp, Homo sapien
gctctgcatcagaaccaagtggaag

SEQ ID NO: 285263 - DNA, 25 bp, Homo sapien
agaccccatcctgtgaccgttggat

SEQ ID NO: 285264 - DNA, 25 bp, Homo sapien
tgaccgttggatgtgggtaaaccct

SEQ ID NO: 285265 - DNA, 25 bp, Homo sapien
gatgtgggtaaaccctgtggtccac

SEQ ID NO: 285266 - DNA, 25 bp, Homo sapien
tgtgggtaaaccctgtggtccacca

SEQ ID NO: 285267 - DNA, 25 bp, Homo sapien
cactcatcacctcatcaccgaggat

SEQ ID NO: 285268 - DNA, 25 bp, Homo sapien
tccagacaaatcaaatcggcccttt

SEQ ID NO: 285269 - DNA, 25 bp, Homo sapien
aaatcggccctttccagcaaggagt

SEQ ID NO: 285270 - DNA, 25 bp, Homo sapien
tccagcaaggagtggaacagcccaa

SEQ ID NO: 285271 - DNA, 25 bp, Homo sapien
aacagcccaagggtggctagatcac

SEQ ID NO: 285272 - DNA, 25 bp, Homo sapien
gtggctagatcacatcttctgctca

SEQ ID NO: 285273 - DNA, 25 bp, Homo sapien
gcataggtcatgccctgtgcaagag

SEQ ID NO: 285274 - DNA, 25 bp, Homo sapien
gagctgaagtcctgcccaggctcca

SEQ ID NO: 285275 - DNA, 25 bp, Homo sapien
aggctccattcaccaagcagagctt

SEQ ID NO: 285276 - DNA, 25 bp, Homo sapien
agcagagcttatgttgttgtgtgtc

SEQ ID NO: 285277 - DNA, 25 bp, Homo sapien
ctgtgtctacccagaggatgtgggt

SEQ ID NO: 285278 - DNA, 25 bp, Homo sapien
aaaatgtgcaccaatgcatcttgta

SEQ ID NO: 285279 - DNA, 25 bp, Homo sapien
gtgaatgctgttactaatcctgtta

SEQ ID NO: 285280 - DNA, 25 bp, Homo sapien
tgctgttactaatcctgttacgaga

SEQ ID NO: 285281 - DNA, 25 bp, Homo sapien
ctaatcctgttacgagatgaatctc

SEQ ID NO: 285282 - DNA, 25 bp, Homo sapien
gagatgaatctcatttcaccaaaat

SEQ ID NO: 285283 - DNA, 25 bp, Homo sapien
tacaagttgaagacacatcactctg

SEQ ID NO: 285284 - DNA, 25 bp, Homo sapien
agacacatcactctgaaattggaag

SEQ ID NO: 285285 - DNA, 25 bp, Homo sapien
ttggaagacctcaccacttaaggct

SEQ ID NO: 285286 - DNA, 25 bp, Homo sapien
accacttaaggctccacagtggctt

SEQ ID NO: 285287 - DNA, 25 bp, Homo sapien
ttttaaaatgttgggagatggccat

SEQ ID NO: 285288 - DNA, 25 bp, Homo sapien
gagatggccattctaactactgttg

SEQ ID NO: 285289 - DNA, 25 bp, Homo sapien
gaatgtctctgttttgggaaggtat

SEQ ID NO: 285290 - DNA, 25 bp, Homo sapien
aagacataattacaacattctgtgg

SEQ ID NO: 285291 - DNA, 25 bp, Homo sapien
gggactcagttcttagagaagtctt

SEQ ID NO: 285292 - DNA, 25 bp, Homo sapien
gagaagtcttttggtcttagagttc

SEQ ID NO: 285293 - DNA, 25 bp, Homo sapien
aagtcttttggtcttagagttcatc

SEQ ID NO: 285294 - DNA, 25 bp, Homo sapien
gtcttttggtcttagagttcatcaa

SEQ ID NO: 285295 - DNA, 25 bp, Homo sapien
tttggtcttagagttcatcaagcag

SEQ ID NO: 285296 - DNA, 25 bp, Homo sapien
ggtcttagagttcatcaagcagaga

SEQ ID NO: 285297 - DNA, 25 bp, Homo sapien
cttagagttcatcaagcagagaagg

SEQ ID NO: 285298 - DNA, 25 bp, Homo sapien
gggaaggacatggtccaggaaaata

SEQ ID NO: 285299 - DNA, 25 bp, Homo sapien
atggtccaggaaaataaatcagcac

SEQ ID NO: 285300 - DNA, 25 bp, Homo sapien
ggaaaataaatcagcacacaaagag

SEQ ID NO: 285301 - DNA, 25 bp, Homo sapien
tgaatagttccttcataaccaggac

SEQ ID NO: 285302 - DNA, 25 bp, Homo sapien
cttcataaccaggacagctagtgtg

SEQ ID NO: 285303 - DNA, 25 bp, Homo sapien
ctagtgtgtgcttgagaatgtctcc

SEQ ID NO: 285304 - DNA, 25 bp, Homo sapien
gcttgagaatgtctccctcaactat

SEQ ID NO: 285305 - DNA, 25 bp, Homo sapien
atatgatctgggatattctgcatta

SEQ ID NO: 285306 - DNA, 25 bp, Homo sapien
ggcattatactggttcatcttttac

SEQ ID NO: 285307 - DNA, 25 bp, Homo sapien
acatttttactctgactccttcatt

SEQ ID NO: 285308 - DNA, 25 bp, Homo sapien
actccttcatttatcttcccacata

SEQ ID NO: 285309 - DNA, 25 bp, Homo sapien
atcttttacctaatgcatgaccagt

SEQ ID NO: 285310 - DNA, 25 bp, Homo sapien
atgcatgaccagtatactagaggaa

SEQ ID NO: 285311 - DNA, 25 bp, Homo sapien
gatggaccagagtctttttgttttg

SEQ ID NO: 285312 - DNA, 25 bp, Homo sapien
ctgcaacacgtttcctcatttattt

SEQ ID NO: 285313 - DNA, 25 bp, Homo sapien
gggagaggtccctgcaaggtccctt

SEQ ID NO: 285314 - DNA, 25 bp, Homo sapien
gagggatggaaatgccgtcacagta

SEQ ID NO: 285315 - DNA, 25 bp, Homo sapien
aaatgccgtcacagtagtagggact

SEQ ID NO: 285316 - DNA, 25 bp, Homo sapien
gtagtagggactggagcgtctacaa

SEQ ID NO: 285317 - DNA, 25 bp, Homo sapien
gggagctactcaggcctaacgttag

SEQ ID NO: 285318 - DNA, 25 bp, Homo sapien
caggcctaacgttagctacaaggaa

SEQ ID NO: 285319 - DNA, 25 bp, Homo sapien
aaaaaggacgccttccgtgacagat

SEQ ID NO: 285320 - DNA, 25 bp, Homo sapien
gccttccgtgacagatccttgaggt

SEQ ID NO: 285321 - DNA, 25 bp, Homo sapien
acagatccttgaggtgtctgtgtct

SEQ ID NO: 285322 - DNA, 25 bp, Homo sapien
agccacctgctctaactcttgagtg

SEQ ID NO: 285323 - DNA, 25 bp, Homo sapien
ggacacttctccagatatttggctt

SEQ ID NO: 285324 - DNA, 25 bp, Homo sapien
tatttggcttcaaaggagtaccttt

SEQ ID NO: 285325 - DNA, 25 bp, Homo sapien
gagtacctttacttacatgtgcttt

SEQ ID NO: 285326 - DNA, 25 bp, Homo sapien
ttttactacaaagcacaattcattt

SEQ ID NO: 285327 - DNA, 25 bp, Homo sapien
tttgtaatgcatatccatcttggat

SEQ ID NO: 285328 - DNA, 25 bp, Homo sapien
tggattcaatccaaggtgctttagc

SEQ ID NO: 285329 - DNA, 25 bp, Homo sapien
gtgctttagctatcagtagtaccaa

SEQ ID NO: 285330 - DNA, 25 bp, Homo sapien
atcagtagtaccaaaggatcttttt

SEQ ID NO: 285331 - DNA, 25 bp, Homo sapien
gatctttttacaaggcttcctgtgg

SEQ ID NO: 285332 - DNA, 25 bp, Homo sapien
ttcctgtggtattgactctgagaat

SEQ ID NO: 285333 - DNA, 25 bp, Homo sapien
gactctgagaataacacatagtgaa

SEQ ID NO: 285334 - DNA, 25 bp, Homo sapien
gtcgtgggccatgtatatttcatca

SEQ ID NO: 285335 - DNA, 25 bp, Homo sapien
atcaaacggactttgggtgcgtcgc

SEQ ID NO: 285336 - DNA, 25 bp, Homo sapien
tgggtgcgtcgcgtctcactgccat

SEQ ID NO: 285337 - DNA, 25 bp, Homo sapien
gccatcagtgctatgtgcagtgaca

SEQ ID NO: 285338 - DNA, 25 bp, Homo sapien
gtgcagtgacatttctgacttgagt

SEQ ID NO: 285339 - DNA, 25 bp, Homo sapien
ttagaggatcttcttggcgccaatg

SEQ ID NO: 285340 - DNA, 25 bp, Homo sapien
ttggcgccaatgctaattgtcctga

SEQ ID NO: 285341 - DNA, 25 bp, Homo sapien
taattgtcctgatttatgccccttc

SEQ ID NO: 285342 - DNA, 25 bp, Homo sapien
ttctgactaagctcaacgtcttcat

SEQ ID NO: 285343 - DNA, 25 bp, Homo sapien
tccgggagccgcaatccagaagcgt

SEQ ID NO: 285344 - DNA, 25 bp, Homo sapien
aatccagaagcgtcgtgggccatgt

SEQ ID NO: 285345 - DNA, 25 bp, Homo sapien
ttcaattacctcctcctaagtccct

SEQ ID NO: 285346 - DNA, 25 bp, Homo sapien
gatgaagtgacagcatatcctgatg

SEQ ID NO: 285347 - DNA, 25 bp, Homo sapien
gaagtgacagcatatcctgatgtgt

SEQ ID NO: 285348 - DNA, 25 bp, Homo sapien
gacagcatatcctgatgtgtgtgat

SEQ ID NO: 285349 - DNA, 25 bp, Homo sapien
gcatatcctgatgtgtgtgatggtt

SEQ ID NO: 285350 - DNA, 25 bp, Homo sapien
tatcctgatgtgtgtgatggtttca

SEQ ID NO: 285351 - DNA, 25 bp, Homo sapien
cctgatgtgtgtgatggtttcatga

SEQ ID NO: 285352 - DNA, 25 bp, Homo sapien
gaagccaaagcagaaccccctgaga

SEQ ID NO: 285353 - DNA, 25 bp, Homo sapien
gaaccccctgagaaacccatcagtt

SEQ ID NO: 285354 - DNA, 25 bp, Homo sapien
aacccatcagttagtgagacttact

SEQ ID NO: 285355 - DNA, 25 bp, Homo sapien
cccatcagttagtgagacttactcg

SEQ ID NO: 285356 - DNA, 25 bp, Homo sapien
ccagctgaaagtgatggcgagcgac

SEQ ID NO: 285357 - DNA, 25 bp, Homo sapien
aagtgatggcgagcgaccaccgaga

SEQ ID NO: 285358 - DNA, 25 bp, Homo sapien
accgagaggcgctgctggacaggga

SEQ ID NO: 285359 - DNA, 25 bp, Homo sapien
acagggagagcgagaacgcgtctct

SEQ ID NO: 285360 - DNA, 25 bp, Homo sapien
cgagaacgcgtctctccgggagaag

SEQ ID NO: 285361 - DNA, 25 bp, Homo sapien
cgtctctccgggagaagctgcggct

SEQ ID NO: 285362 - DNA, 25 bp, Homo sapien
ggagatcgcccgcatccgggacgag

SEQ ID NO: 285363 - DNA, 25 bp, Homo sapien
tgcagaacgccgtcctggcttacgt

SEQ ID NO: 285364 - DNA, 25 bp, Homo sapien
gaacgccgtcctggcttacgtgcag

SEQ ID NO: 285365 - DNA, 25 bp, Homo sapien
cgtcctggcttacgtgcaggcgtcc

SEQ ID NO: 285366 - DNA, 25 bp, Homo sapien
aggcgtcccccgtgaggaccctgag

SEQ ID NO: 285367 - DNA, 25 bp, Homo sapien
attgccagttgctcaaattcgtgcc

SEQ ID NO: 285368 - DNA, 25 bp, Homo sapien
gttgctcaaattcgtgccaatactt

SEQ ID NO: 285369 - DNA, 25 bp, Homo sapien
aattcgtgccaatacttggtatttt

SEQ ID NO: 285370 - DNA, 25 bp, Homo sapien
ttagacattctggagagtgtgtagt

SEQ ID NO: 285371 - DNA, 25 bp, Homo sapien
gagtgtgtagtaatttttcatcttg

SEQ ID NO: 285372 - DNA, 25 bp, Homo sapien
ttcaagtgattgtagcagtttgctg

SEQ ID NO: 285373 - DNA, 25 bp, Homo sapien
cattaaattagtatccatttctcta

SEQ ID NO: 285374 - DNA, 25 bp, Homo sapien
tttgaagtgcttattgtccatttta

SEQ ID NO: 285375 - DNA, 25 bp, Homo sapien
acagcagcagattgtagcagattac

SEQ ID NO: 285376 - DNA, 25 bp, Homo sapien
tctacagcagcagcatgtgagattg

SEQ ID NO: 285377 - DNA, 25 bp, Homo sapien
gcagcagcatgtgagattgccagtt

SEQ ID NO: 285378 - DNA, 25 bp, Homo sapien
aaactggtccagtgtacaacatcca

SEQ ID NO: 285379 - DNA, 25 bp, Homo sapien
cagtgtacaacatccagtgaagagt

SEQ ID NO: 285380 - DNA, 25 bp, Homo sapien
ggatggcatagacttaccaactcaa

SEQ ID NO: 285381 - DNA, 25 bp, Homo sapien
ggattctagaaacattatagtccaa

SEQ ID NO: 285382 - DNA, 25 bp, Homo sapien
aacctcctcaattcatcgttgatac

SEQ ID NO: 285383 - DNA, 25 bp, Homo sapien
atcgttgatacacaaaggcccacta

SEQ ID NO: 285384 - DNA, 25 bp, Homo sapien
acacaaaggcccactaagctgtgtg

SEQ ID NO: 285385 - DNA, 25 bp, Homo sapien
aagctgtgtggttcactcagcatca

SEQ ID NO: 285386 - DNA, 25 bp, Homo sapien
cactcagcatcacgtggctaatatg

SEQ ID NO: 285387 - DNA, 25 bp, Homo sapien
gggttccatacactcttaccaggca

SEQ ID NO: 285388 - DNA, 25 bp, Homo sapien
tcttaccaggcactgagagtcatgg

SEQ ID NO: 285389 - DNA, 25 bp, Homo sapien
ggcggcggctcaaagaggccgggct

SEQ ID NO: 285390 - DNA, 25 bp, Homo sapien
ggtccccgcagtacggaggctccgg

SEQ ID NO: 285391 - DNA, 25 bp, Homo sapien
aacacgtcgagaggctcggcggcaa

SEQ ID NO: 285392 - DNA, 25 bp, Homo sapien
gccgggagaaattcgcagcggcggg

SEQ ID NO: 285393 - DNA, 25 bp, Homo sapien
aggctcggcggcaagcaagactgcc

SEQ ID NO: 285394 - DNA, 25 bp, Homo sapien
ggcaagcaagactgccgcctccgtg

SEQ ID NO: 285395 - DNA, 25 bp, Homo sapien
gggctcaagggctcgttcaaggtca

SEQ ID NO: 285396 - DNA, 25 bp, Homo sapien
ggctcaagggctcgttcaaggtcaa

SEQ ID NO: 285397 - DNA, 25 bp, Homo sapien
gctcaagggctcgttcaaggtcaag

SEQ ID NO: 285398 - DNA, 25 bp, Homo sapien
aagggctcgttcaaggtcaagccgc

SEQ ID NO: 285399 - DNA, 25 bp, Homo sapien
tcgttcaaggtcaagccgccgcggg

SEQ ID NO: 285400 - DNA, 25 bp, Homo sapien
gagtctgtgaactacctggtattct

SEQ ID NO: 285401 - DNA, 25 bp, Homo sapien
agcaacctaaggattcctccacctg

SEQ ID NO: 285402 - DNA, 25 bp, Homo sapien
gtcagagtcaaatactttggttctc

SEQ ID NO: 285403 - DNA, 25 bp, Homo sapien
caaagagagctagccaatgcagaaa

SEQ ID NO: 285404 - DNA, 25 bp, Homo sapien
atggatgtccagtgagacagatcaa

SEQ ID NO: 285405 - DNA, 25 bp, Homo sapien
tcctaatcctattttgtgctgtgaa

SEQ ID NO: 285406 - DNA, 25 bp, Homo sapien
ccacctgtcactgagatccattgag

SEQ ID NO: 285407 - DNA, 25 bp, Homo sapien
ctgagatccattgagatgattcctg

SEQ ID NO: 285408 - DNA, 25 bp, Homo sapien
attcctgctttctcacatcttggtt

SEQ ID NO: 285409 - DNA, 25 bp, Homo sapien
cacatcttggttttgagttaaattc

SEQ ID NO: 285410 - DNA, 25 bp, Homo sapien
tgagttaaattctttgagtctgtga

SEQ ID NO: 285411 - DNA, 25 bp, Homo sapien
gataggctgggattaaaatttgtta

SEQ ID NO: 285412 - DNA, 25 bp, Homo sapien
ggattaaaatttgttatggcagtaa

SEQ ID NO: 285413 - DNA, 25 bp, Homo sapien
tggcagtaataagagcaacagagct

SEQ ID NO: 285414 - DNA, 25 bp, Homo sapien
cataggattataggattagagcaga

SEQ ID NO: 285415 - DNA, 25 bp, Homo sapien
gacattgaaagggataaacagtttt

SEQ ID NO: 285416 - DNA, 25 bp, Homo sapien
agttttttggttattagtgagcagt

SEQ ID NO: 285417 - DNA, 25 bp, Homo sapien
ggttattagtgagcagttttctctc

SEQ ID NO: 285418 - DNA, 25 bp, Homo sapien
attagtgagcagttttctctcaggc

SEQ ID NO: 285419 - DNA, 25 bp, Homo sapien
gtgagcagttttctctcaggccata

SEQ ID NO: 285420 - DNA, 25 bp, Homo sapien
agcagttttctctcaggccatagtg

SEQ ID NO: 285421 - DNA, 25 bp, Homo sapien
agttttctctcaggccatagtgtag

SEQ ID NO: 285422 - DNA, 25 bp, Homo sapien
tttaacctcccgagactctgtgcct

SEQ ID NO: 285423 - DNA, 25 bp, Homo sapien
cacatgtatagattccctgtttgta

SEQ ID NO: 285424 - DNA, 25 bp, Homo sapien
ttccctgtttgtagacagcagtgct

SEQ ID NO: 285425 - DNA, 25 bp, Homo sapien
gggacctctgaaggctatctgaatg

SEQ ID NO: 285426 - DNA, 25 bp, Homo sapien
ggctatctgaatgtgcctgcattta

SEQ ID NO: 285427 - DNA, 25 bp, Homo sapien
atgtgcctgcatttagcaagtcaag

SEQ ID NO: 285428 - DNA, 25 bp, Homo sapien
gcaagtcaaggccagaccctccaga

SEQ ID NO: 285429 - DNA, 25 bp, Homo sapien
agaccctccagatgcactggactgt

SEQ ID NO: 285430 - DNA, 25 bp, Homo sapien
gagtggttttgcatggcatccatgt

SEQ ID NO: 285431 - DNA, 25 bp, Homo sapien
atggcatccatgtaggaattgacta

SEQ ID NO: 285432 - DNA, 25 bp, Homo sapien
cattttctgagagtccggctgtgtg

SEQ ID NO: 285433 - DNA, 25 bp, Homo sapien
ttctgctataggtcaatgtatacac

SEQ ID NO: 285434 - DNA, 25 bp, Homo sapien
aatgtatacactttctgttgcgtag

SEQ ID NO: 285435 - DNA, 25 bp, Homo sapien
acactttctgttgcgtagttttcct

SEQ ID NO: 285436 - DNA, 25 bp, Homo sapien
ctgttgcgtagttttcctgctgaaa

SEQ ID NO: 285437 - DNA, 25 bp, Homo sapien
tttcctgctgaaaaccttgttctga

SEQ ID NO: 285438 - DNA, 25 bp, Homo sapien
ctgctgaaaaccttgttctgactcc

SEQ ID NO: 285439 - DNA, 25 bp, Homo sapien
gtcttcacccgcgatgtggattctt

SEQ ID NO: 285440 - DNA, 25 bp, Homo sapien
cgcgatgtggattcttgcccagggc

SEQ ID NO: 285441 - DNA, 25 bp, Homo sapien
atgtggattcttgcccagggcgcct

SEQ ID NO: 285442 - DNA, 25 bp, Homo sapien
gaggccgagtcctctgccaggtcct

SEQ ID NO: 285443 - DNA, 25 bp, Homo sapien
tgcagaccccatcctggtcctaagg

SEQ ID NO: 285444 - DNA, 25 bp, Homo sapien
acccttcacatcagagcatgtcggt

SEQ ID NO: 285445 - DNA, 25 bp, Homo sapien
gggagtctcaccaagggacacgttc

SEQ ID NO: 285446 - DNA, 25 bp, Homo sapien
tgccctgggttgtaaggatgctctt

SEQ ID NO: 285447 - DNA, 25 bp, Homo sapien
gaggttgctaacataagttccatac

SEQ ID NO: 285448 - DNA, 25 bp, Homo sapien
gttccatacaatgcaaccaggcctg

SEQ ID NO: 285449 - DNA, 25 bp, Homo sapien
acaatgcaaccaggcctgttcagtg

SEQ ID NO: 285450 - DNA, 25 bp, Homo sapien
caggtttagttgctccccaatattt

SEQ ID NO: 285451 - DNA, 25 bp, Homo sapien
gttgctccccaatatttaacagcag

SEQ ID NO: 285452 - DNA, 25 bp, Homo sapien
cagcagaggtggtgtcaaggctcca

SEQ ID NO: 285453 - DNA, 25 bp, Homo sapien
gtcaaggctccactgagacagggat

SEQ ID NO: 285454 - DNA, 25 bp, Homo sapien
gacagggatgctgaacctcagttcg

SEQ ID NO: 285455 - DNA, 25 bp, Homo sapien
gttttttttgtacgcaattctcgat

SEQ ID NO: 285456 - DNA, 25 bp, Homo sapien
tttgtacgcaattctcgattctttg

SEQ ID NO: 285457 - DNA, 25 bp, Homo sapien
ttgtacgcaattctcgattctttga

SEQ ID NO: 285458 - DNA, 25 bp, Homo sapien
tgtacgcaattctcgattctttgaa

SEQ ID NO: 285459 - DNA, 25 bp, Homo sapien
gtacgcaattctcgattctttgaag

SEQ ID NO: 285460 - DNA, 25 bp, Homo sapien
tacgcaattctcgattctttgaaga

SEQ ID NO: 285461 - DNA, 25 bp, Homo sapien
acgcaattctcgattctttgaagag

SEQ ID NO: 285462 - DNA, 25 bp, Homo sapien
cgcaattctcgattctttgaagaga

SEQ ID NO: 285463 - DNA, 25 bp, Homo sapien
atcacctcgatgacgttcctgctgg

SEQ ID NO: 285464 - DNA, 25 bp, Homo sapien
ccaggtgcgctgagtacatgaagtc

SEQ ID NO: 285465 - DNA, 25 bp, Homo sapien
tcgatgatggccttgaagccctggg

SEQ ID NO: 285466 - DNA, 25 bp, Homo sapien
gacttgatgctgatgtccagcgccg

SEQ ID NO: 285467 - DNA, 25 bp, Homo sapien
aagccctgggccgtgacgatgtcca

SEQ ID NO: 285468 - DNA, 25 bp, Homo sapien
tgacgatgtccaggtgcgtgaccgt

SEQ ID NO: 285469 - DNA, 25 bp, Homo sapien
gcacctggcagtagagcgtcttgaa

SEQ ID NO: 285470 - DNA, 25 bp, Homo sapien
aggacgttcttgtgcgccttgaaga

SEQ ID NO: 285471 - DNA, 25 bp, Homo sapien
cagcgccgccttgatgaagtcgtgg

SEQ ID NO: 285472 - DNA, 25 bp, Homo sapien
gcacgatgtccgtcatctgcaggaa

SEQ ID NO: 285473 - DNA, 25 bp, Homo sapien
aagctggcggctgacatcacctcga

SEQ ID NO: 285474 - DNA, 25 bp, Homo sapien
gcaaacttcttactttcttacagct

SEQ ID NO: 285475 - DNA, 25 bp, Homo sapien
actttcttacagctaaacttggtag

SEQ ID NO: 285476 - DNA, 25 bp, Homo sapien
gcttagtgaagtacagctgcttgta

SEQ ID NO: 285477 - DNA, 25 bp, Homo sapien
gtacagctgcttgtatggaggagct

SEQ ID NO: 285478 - DNA, 25 bp, Homo sapien
tttacatctcagtcttgctagcaag

SEQ ID NO: 285479 - DNA, 25 bp, Homo sapien
gctagcaagcactacttggcttaga

SEQ ID NO: 285480 - DNA, 25 bp, Homo sapien
ggcttagaatctgtcatatccataa

SEQ ID NO: 285481 - DNA, 25 bp, Homo sapien
aaggaggagctcatgtctctagtcc

SEQ ID NO: 285482 - DNA, 25 bp, Homo sapien
tagtcctggcccttcaactcagaag

SEQ ID NO: 285483 - DNA, 25 bp, Homo sapien
aggttcttctatactttccttctct

SEQ ID NO: 285484 - DNA, 25 bp, Homo sapien
tcaggactcttatagcccagacttt

SEQ ID NO: 285485 - DNA, 25 bp, Homo sapien
tgccctgcaggccagatagagcctt

SEQ ID NO: 285486 - DNA, 25 bp, Homo sapien
agatagagccttgccaaaccagtgg

SEQ ID NO: 285487 - DNA, 25 bp, Homo sapien
gccagtttcccatgtggagccgaaa

SEQ ID NO: 285488 - DNA, 25 bp, Homo sapien
gagccgaaacagtcgtgcttttatc

SEQ ID NO: 285489 - DNA, 25 bp, Homo sapien
aaacagtcgtgcttttatctctcca

SEQ ID NO: 285490 - DNA, 25 bp, Homo sapien
ttgctcagtcaccagatgcaggcca

SEQ ID NO: 285491 - DNA, 25 bp, Homo sapien
ggtgcaagaagctaactagggatca

SEQ ID NO: 285492 - DNA, 25 bp, Homo sapien
caggccacgcccagaagggtatgtt

SEQ ID NO: 285493 - DNA, 25 bp, Homo sapien
aagggtatgtttttctctgcagctc

SEQ ID NO: 285494 - DNA, 25 bp, Homo sapien
tctctgcagctcagactgatgttga

SEQ ID NO: 285495 - DNA, 25 bp, Homo sapien
atgaagaggttgaactgccctgcag

SEQ ID NO: 285496 - DNA, 25 bp, Homo sapien
cgggctggactacccctgagattta

SEQ ID NO: 285497 - DNA, 25 bp, Homo sapien
gctggactacccctgagatttaatg

SEQ ID NO: 285498 - DNA, 25 bp, Homo sapien
ctggactacccctgagatttaatga

SEQ ID NO: 285499 - DNA, 25 bp, Homo sapien
tggactacccctgagatttaatgac

SEQ ID NO: 285500 - DNA, 25 bp, Homo sapien
ggactacccctgagatttaatgacc

SEQ ID NO: 285501 - DNA, 25 bp, Homo sapien
gactacccctgagatttaatgacca

SEQ ID NO: 285502 - DNA, 25 bp, Homo sapien
actacccctgagatttaatgaccag

SEQ ID NO: 285503 - DNA, 25 bp, Homo sapien
tacccctgagatttaatgaccagag

SEQ ID NO: 285504 - DNA, 25 bp, Homo sapien
gagatttaatgaccagagctgagac

SEQ ID NO: 285505 - DNA, 25 bp, Homo sapien
atttaatgaccagagctgagacccc

SEQ ID NO: 285506 - DNA, 25 bp, Homo sapien
ttaatgaccagagctgagaccccca

SEQ ID NO: 285507 - DNA, 25 bp, Homo sapien
gtaaattgtaacatcctttgttgtc

SEQ ID NO: 285508 - DNA, 25 bp, Homo sapien
aataaattatcaagccatccatgag

SEQ ID NO: 285509 - DNA, 25 bp, Homo sapien
tatttgtcccacatgtcccgggtct

SEQ ID NO: 285510 - DNA, 25 bp, Homo sapien
acatgtcccgggtctaagagaagta

SEQ ID NO: 285511 - DNA, 25 bp, Homo sapien
gaatgaatatgccttgtctttcgtg

SEQ ID NO: 285512 - DNA, 25 bp, Homo sapien
atatgccttgtctttcgtgatcgat

SEQ ID NO: 285513 - DNA, 25 bp, Homo sapien
cgtgatcgatctttgttgttgtggg

SEQ ID NO: 285514 - DNA, 25 bp, Homo sapien
gtagaagtctactttcacaagcatg

SEQ ID NO: 285515 - DNA, 25 bp, Homo sapien
gtctactttcacaagcatgctttag

SEQ ID NO: 285516 - DNA, 25 bp, Homo sapien
acaagcatgctttagtatagttatt

SEQ ID NO: 285517 - DNA, 25 bp, Homo sapien
gtatagttattacagccaaacatgt

SEQ ID NO: 285518 - DNA, 25 bp, Homo sapien
gatcagactaaaggcctgtcaagag

SEQ ID NO: 285519 - DNA, 25 bp, Homo sapien
gatctaagaagactctgatctttaa

SEQ ID NO: 285520 - DNA, 25 bp, Homo sapien
tgtcaaaatgaccacagcccagctt

SEQ ID NO: 285521 - DNA, 25 bp, Homo sapien
acagcccagcttttaccttggaatc

SEQ ID NO: 285522 - DNA, 25 bp, Homo sapien
gcttttaccttggaatctctgctag

SEQ ID NO: 285523 - DNA, 25 bp, Homo sapien
gaatctctgctagttcctgtgtcat

SEQ ID NO: 285524 - DNA, 25 bp, Homo sapien
tgctagttcctgtgtcattctcatt

SEQ ID NO: 285525 - DNA, 25 bp, Homo sapien
tgtgtcattctcattcccgtaactc

SEQ ID NO: 285526 - DNA, 25 bp, Homo sapien
tatctagctcttttctttacatgta

SEQ ID NO: 285527 - DNA, 25 bp, Homo sapien
ggatgacacttaaacctatgaacag

SEQ ID NO: 285528 - DNA, 25 bp, Homo sapien
gaacagtcatctctgttctctttcc

SEQ ID NO: 285529 - DNA, 25 bp, Homo sapien
gatgatgctttcgaagcggatgacg

SEQ ID NO: 285530 - DNA, 25 bp, Homo sapien
ctttcgaagcggatgacggcgaaga

SEQ ID NO: 285531 - DNA, 25 bp, Homo sapien
cgtgccggctgtttcccagggccat

SEQ ID NO: 285532 - DNA, 25 bp, Homo sapien
tgaggccactccacggggacgagtt

SEQ ID NO: 285533 - DNA, 25 bp, Homo sapien
acgagttgagggacgacttgtgctt

SEQ ID NO: 285534 - DNA, 25 bp, Homo sapien
agttgagggacgacttgtgcttgct

SEQ ID NO: 285535 - DNA, 25 bp, Homo sapien
tgagggacgacttgtgcttgctctc

SEQ ID NO: 285536 - DNA, 25 bp, Homo sapien
gggacgacttgtgcttgctctccgg

SEQ ID NO: 285537 - DNA, 25 bp, Homo sapien
atgacggcgaagaggcgcgagctga

SEQ ID NO: 285538 - DNA, 25 bp, Homo sapien
aagaggcgcgagctgaagccggcaa

SEQ ID NO: 285539 - DNA, 25 bp, Homo sapien
aaggagagaagcgactgccacccag

SEQ ID NO: 285540 - DNA, 25 bp, Homo sapien
aaccagtgattttaagtaccactat

SEQ ID NO: 285541 - DNA, 25 bp, Homo sapien
gtgattttaagtaccactatactaa

SEQ ID NO: 285542 - DNA, 25 bp, Homo sapien
aagtgcacctctaaagtgcctagtt

SEQ ID NO: 285543 - DNA, 25 bp, Homo sapien
agtgcctagtttctgtgtccatgta

SEQ ID NO: 285544 - DNA, 25 bp, Homo sapien
gcctagtttctgtgtccatgtaaaa

SEQ ID NO: 285545 - DNA, 25 bp, Homo sapien
gtttctgtgtccatgtaaaaccagt

SEQ ID NO: 285546 - DNA, 25 bp, Homo sapien
aaccagtaatatgaggagcaatttc

SEQ ID NO: 285547 - DNA, 25 bp, Homo sapien
gagcaatttcaacatatgggagttt

SEQ ID NO: 285548 - DNA, 25 bp, Homo sapien
atgggagtttgattaaacctctatg

SEQ ID NO: 285549 - DNA, 25 bp, Homo sapien
aaaatgcaacttttcagcttatttg

SEQ ID NO: 285550 - DNA, 25 bp, Homo sapien
ttcagcttatttgtacattagtaga

SEQ ID NO: 285551 - DNA, 25 bp, Homo sapien
agtgtttctccatgataaggtcaca

SEQ ID NO: 285552 - DNA, 25 bp, Homo sapien
acctctatatccaacgcttgtatgt

SEQ ID NO: 285553 - DNA, 25 bp, Homo sapien
aacgcttgtatgtcccacatgtgtt

SEQ ID NO: 285554 - DNA, 25 bp, Homo sapien
catgtgtttccaaattcctcatcgg

SEQ ID NO: 285555 - DNA, 25 bp, Homo sapien
ttcctcatcggccttagagacacaa

SEQ ID NO: 285556 - DNA, 25 bp, Homo sapien
acacaaagagtttctggcttccctg

SEQ ID NO: 285557 - DNA, 25 bp, Homo sapien
gcacctcagcgccaagtttctgtaa

SEQ ID NO: 285558 - DNA, 25 bp, Homo sapien
gtttctgtaagccacttccatgtaa

SEQ ID NO: 285559 - DNA, 25 bp, Homo sapien
ggcttaacagaagtgtcatttccta

SEQ ID NO: 285560 - DNA, 25 bp, Homo sapien
gtcatttcctatctcaagctttgga

SEQ ID NO: 285561 - DNA, 25 bp, Homo sapien
agctttggaagctctgagtttgcag

SEQ ID NO: 285562 - DNA, 25 bp, Homo sapien
gaatttttcacacctatgtctgcat

SEQ ID NO: 285563 - DNA, 25 bp, Homo sapien
tgtctgcattaaaggctgttttact

SEQ ID NO: 285564 - DNA, 25 bp, Homo sapien
acatagacttcctgcagtcagctgc

SEQ ID NO: 285565 - DNA, 25 bp, Homo sapien
tgctgtgccccagtgccttactggt

SEQ ID NO: 285566 - DNA, 25 bp, Homo sapien
agtgccttactggtcctttgtagat

SEQ ID NO: 285567 - DNA, 25 bp, Homo sapien
ttactggtcctttgtagatttgcct

SEQ ID NO: 285568 - DNA, 25 bp, Homo sapien
ctgtgtcctggtgaaccttaatgaa

SEQ ID NO: 285569 - DNA, 25 bp, Homo sapien
ggccgtcttaggcacagtgcaaaac

SEQ ID NO: 285570 - DNA, 25 bp, Homo sapien
caagcatttgtcctgtactgttaga

SEQ ID NO: 285571 - DNA, 25 bp, Homo sapien
tgtcctgtactgttagagccaaaat

SEQ ID NO: 285572 - DNA, 25 bp, Homo sapien
gatgagcaatactgataattgtcca

SEQ ID NO: 285573 - DNA, 25 bp, Homo sapien
agagtacaggaacccaatccagctt

SEQ ID NO: 285574 - DNA, 25 bp, Homo sapien
gaacccaatccagcttggagttggg

SEQ ID NO: 285575 - DNA, 25 bp, Homo sapien
gaagaccccctaaaagaggtggcat

SEQ ID NO: 285576 - DNA, 25 bp, Homo sapien
gtggcatctgagttcatcctttaaa

SEQ ID NO: 285577 - DNA, 25 bp, Homo sapien
gcatctgagttcatcctttaaagaa

SEQ ID NO: 285578 - DNA, 25 bp, Homo sapien
ctcctggccaaatgtgcaaaggcag

SEQ ID NO: 285579 - DNA, 25 bp, Homo sapien
agcaggcccaggtgagtcacctgta

SEQ ID NO: 285580 - DNA, 25 bp, Homo sapien
gtgagtcacctgtaggtagttgtga

SEQ ID NO: 285581 - DNA, 25 bp, Homo sapien
acctgtaggtagttgtgaagttgga

SEQ ID NO: 285582 - DNA, 25 bp, Homo sapien
ggcacatagtaatcactacgtatgt

SEQ ID NO: 285583 - DNA, 25 bp, Homo sapien
gtaatcactacgtatgtgtttgtta

SEQ ID NO: 285584 - DNA, 25 bp, Homo sapien
gtttttcaggaatactaatatggca

SEQ ID NO: 285585 - DNA, 25 bp, Homo sapien
actagcaaatgtggagagaacggat

SEQ ID NO: 285586 - DNA, 25 bp, Homo sapien
aatggaagcagtgtgaacctagtga

SEQ ID NO: 285587 - DNA, 25 bp, Homo sapien
gaacctagtgaatacttgccaagct

SEQ ID NO: 285588 - DNA, 25 bp, Homo sapien
gaatacttgccaagctgtatctccc

SEQ ID NO: 285589 - DNA, 25 bp, Homo sapien
ctgtatctcccctgaatttgtcaaa

SEQ ID NO: 285590 - DNA, 25 bp, Homo sapien
agcatctgagctagaccaaccctca

SEQ ID NO: 285591 - DNA, 25 bp, Homo sapien
tagaccaaccctcagtgctaacatt

SEQ ID NO: 285592 - DNA, 25 bp, Homo sapien
aaccctcagtgctaacattgatgtg

SEQ ID NO: 285593 - DNA, 25 bp, Homo sapien
gattaaagagtctgaactgggagca

SEQ ID NO: 285594 - DNA, 25 bp, Homo sapien
ctgggagcagaattccttcaggtat

SEQ ID NO: 285595 - DNA, 25 bp, Homo sapien
gtatctgatatcagcactggattgt

SEQ ID NO: 285596 - DNA, 25 bp, Homo sapien
acttgttgctgattttgaccttgta

SEQ ID NO: 285597 - DNA, 25 bp, Homo sapien
gtacatatctttgagttcaaccttt

SEQ ID NO: 285598 - DNA, 25 bp, Homo sapien
gttcaacctttagtacgtgtggctt

SEQ ID NO: 285599 - DNA, 25 bp, Homo sapien
tcgtggctaaggtaagaacgtgctt

SEQ ID NO: 285600 - DNA, 25 bp, Homo sapien
gtaagaacgtgcttgtggaagacaa

SEQ ID NO: 285601 - DNA, 25 bp, Homo sapien
gtgagtctgtgtggccagcagcctc

SEQ ID NO: 285602 - DNA, 25 bp, Homo sapien
agcagcctctgatctgtgcagggta

SEQ ID NO: 285603 - DNA, 25 bp, Homo sapien
agggctgagtgttctgggatttctc

SEQ ID NO: 285604 - DNA, 25 bp, Homo sapien
gtgttctgggatttctctagaggct

SEQ ID NO: 285605 - DNA, 25 bp, Homo sapien
tctagaggctggcaagaaccagttg

SEQ ID NO: 285606 - DNA, 25 bp, Homo sapien
taagaaattcttgcattggtcgatt

SEQ ID NO: 285607 - DNA, 25 bp, Homo sapien
attcttgcattggtcgatttcaatt

SEQ ID NO: 285608 - DNA, 25 bp, Homo sapien
catgttctaggaaactatgattctg

SEQ ID NO: 285609 - DNA, 25 bp, Homo sapien
aactatgattctggttgttcaggat

SEQ ID NO: 285610 - DNA, 25 bp, Homo sapien
ctggttgttcaggattgttattatt

SEQ ID NO: 285611 - DNA, 25 bp, Homo sapien
gcgggaaatgcactaattgtgctct

SEQ ID NO: 285612 - DNA, 25 bp, Homo sapien
tgcactaattgtgctcttccttata

SEQ ID NO: 285613 - DNA, 25 bp, Homo sapien
tgcactcattttttagctgtattag

SEQ ID NO: 285614 - DNA, 25 bp, Homo sapien
ttttagctgtattaggaatgtcaat

SEQ ID NO: 285615 - DNA, 25 bp, Homo sapien
gaatgtcaataatcctgtagcaaat

SEQ ID NO: 285616 - DNA, 25 bp, Homo sapien
aatcctgtagcaaattttcacagag

SEQ ID NO: 285617 - DNA, 25 bp, Homo sapien
gtgaggtaaaagcagtccccgcagc

SEQ ID NO: 285618 - DNA, 25 bp, Homo sapien
agtccccgcagctctcagtgttcga

SEQ ID NO: 285619 - DNA, 25 bp, Homo sapien
cagtgttcgaccctccagtgagtgt

SEQ ID NO: 285620 - DNA, 25 bp, Homo sapien
tccagtgagtgtccacgcacagggt

SEQ ID NO: 285621 - DNA, 25 bp, Homo sapien
tggtgggtctactagactgcacctg

SEQ ID NO: 285622 - DNA, 25 bp, Homo sapien
tgggtctactagactgcacctgccc

SEQ ID NO: 285623 - DNA, 25 bp, Homo sapien
ttacatctgcaaacatcgggccctc

SEQ ID NO: 285624 - DNA, 25 bp, Homo sapien
gggccacagtagatactgacaggtg

SEQ ID NO: 285625 - DNA, 25 bp, Homo sapien
tactgacaggtggacagcccggatt

SEQ ID NO: 285626 - DNA, 25 bp, Homo sapien
gacaggtggacagcccggattccta

SEQ ID NO: 285627 - DNA, 25 bp, Homo sapien
tggacagcccggattcctattcctt

SEQ ID NO: 285628 - DNA, 25 bp, Homo sapien
ttcctgggtagctctgcctgaagca

SEQ ID NO: 285629 - DNA, 25 bp, Homo sapien
gggtagctctgcctgaagcattcca

SEQ ID NO: 285630 - DNA, 25 bp, Homo sapien
gaagcattccactaagatcatctat

SEQ ID NO: 285631 - DNA, 25 bp, Homo sapien
taagatcatctattccaaggtcatg

SEQ ID NO: 285632 - DNA, 25 bp, Homo sapien
attccaaggtcatggacaggctact

SEQ ID NO: 285633 - DNA, 25 bp, Homo sapien
catggacaggctactggtgaccaaa

SEQ ID NO: 285634 - DNA, 25 bp, Homo sapien
tactggtgaccaaagttggttcctt

SEQ ID NO: 285635 - DNA, 25 bp, Homo sapien
tttctttcctccttgaagcctggct

SEQ ID NO: 285636 - DNA, 25 bp, Homo sapien
tgaagcctggctcccttggtcgcag

SEQ ID NO: 285637 - DNA, 25 bp, Homo sapien
attgcccattccctcgttcgttcat

SEQ ID NO: 285638 - DNA, 25 bp, Homo sapien
gttcgttcattcagcacaggccttg

SEQ ID NO: 285639 - DNA, 25 bp, Homo sapien
actacaagtatttcaggggctgcca

SEQ ID NO: 285640 - DNA, 25 bp, Homo sapien
gggctgattgcatcccatgatgtgc

SEQ ID NO: 285641 - DNA, 25 bp, Homo sapien
gattgcatcccatgatgtgcccagg

SEQ ID NO: 285642 - DNA, 25 bp, Homo sapien
atcccatgatgtgcccaggttttga

SEQ ID NO: 285643 - DNA, 25 bp, Homo sapien
atgtgcccaggttttgagatgctcc

SEQ ID NO: 285644 - DNA, 25 bp, Homo sapien
ccaggttttgagatgctcctcgtga

SEQ ID NO: 285645 - DNA, 25 bp, Homo sapien
ggttttgagatgctcctcgtgaatg

SEQ ID NO: 285646 - DNA, 25 bp, Homo sapien
gagatgctcctcgtgaatgaaaata

SEQ ID NO: 285647 - DNA, 25 bp, Homo sapien
aaaataggactgtctggttcctcca

SEQ ID NO: 285648 - DNA, 25 bp, Homo sapien
tggttcctccatccatagcaaggga

SEQ ID NO: 285649 - DNA, 25 bp, Homo sapien
tcctccatccatagcaagggagcct

SEQ ID NO: 285650 - DNA, 25 bp, Homo sapien
cttcgtggctaaggtaagaacgtgc

SEQ ID NO: 285651 - DNA, 25 bp, Homo sapien
tcgtggctaaggtaagaacgtgctt

SEQ ID NO: 285652 - DNA, 25 bp, Homo sapien
gtggctaaggtaagaacgtgcttgt

SEQ ID NO: 285653 - DNA, 25 bp, Homo sapien
gctaaggtaagaacgtgcttgtgga

SEQ ID NO: 285654 - DNA, 25 bp, Homo sapien
ctaaggtaagaacgtgcttgtggaa

SEQ ID NO: 285655 - DNA, 25 bp, Homo sapien
aggtaagaacgtgcttgtggaagac

SEQ ID NO: 285656 - DNA, 25 bp, Homo sapien
gtaagaacgtgcttgtggaagacaa

SEQ ID NO: 285657 - DNA, 25 bp, Homo sapien
gaacgtgcttgtggaagacaagtct

SEQ ID NO: 285658 - DNA, 25 bp, Homo sapien
cgtgcttgtggaagacaagtctgtg

SEQ ID NO: 285659 - DNA, 25 bp, Homo sapien
gcagcctctgatctgtgcagggtat

SEQ ID NO: 285660 - DNA, 25 bp, Homo sapien
cagcctctgatctgtgcagggtatt

SEQ ID NO: 285661 - DNA, 25 bp, Homo sapien
tgggaagacttctgagaccacatct

SEQ ID NO: 285662 - DNA, 25 bp, Homo sapien
ttctgagaccacatctgggctctgc

SEQ ID NO: 285663 - DNA, 25 bp, Homo sapien
cctttctgggtctacctgtgatcaa

SEQ ID NO: 285664 - DNA, 25 bp, Homo sapien
atcaacccgggtgtgctgtggacat

SEQ ID NO: 285665 - DNA, 25 bp, Homo sapien
tgtgctgtggacatcagactgagga

SEQ ID NO: 285666 - DNA, 25 bp, Homo sapien
ggagtgctacatttgctgatacctt

SEQ ID NO: 285667 - DNA, 25 bp, Homo sapien
gctgataccttagtatgcagtattg

SEQ ID NO: 285668 - DNA, 25 bp, Homo sapien
gaagcttagatcctctggaatggca

SEQ ID NO: 285669 - DNA, 25 bp, Homo sapien
gaatggcagaaattcccagatttat

SEQ ID NO: 285670 - DNA, 25 bp, Homo sapien
gagtatcttcgaaccaggaatatct

SEQ ID NO: 285671 - DNA, 25 bp, Homo sapien
gctgtctagggcactttgctgggaa

SEQ ID NO: 285672 - DNA, 25 bp, Homo sapien
agatgccaacccacagagccatgag

SEQ ID NO: 285673 - DNA, 25 bp, Homo sapien
gagccatgagctaaatgaatgtctc

SEQ ID NO: 285674 - DNA, 25 bp, Homo sapien
gaatgtctcagtgttgtgagccgct

SEQ ID NO: 285675 - DNA, 25 bp, Homo sapien
gggtagttaatgacacagcaagagc

SEQ ID NO: 285676 - DNA, 25 bp, Homo sapien
ttaatgacacagcaagagctactgc

SEQ ID NO: 285677 - DNA, 25 bp, Homo sapien
aggtggctcacgctgccttccattg

SEQ ID NO: 285678 - DNA, 25 bp, Homo sapien
gctgcatcgggagccctgtgtgttt

SEQ ID NO: 285679 - DNA, 25 bp, Homo sapien
gtgtttggagggaattcctgcccct

SEQ ID NO: 285680 - DNA, 25 bp, Homo sapien
tttggagggaattcctgcccctgca

SEQ ID NO: 285681 - DNA, 25 bp, Homo sapien
gttggtgcgggtgtaacctgtttca

SEQ ID NO: 285682 - DNA, 25 bp, Homo sapien
gcgggtgtaacctgtttcatggaag

SEQ ID NO: 285683 - DNA, 25 bp, Homo sapien
ccgctgttgtggcaagggctttcat

SEQ ID NO: 285684 - DNA, 25 bp, Homo sapien
aagggctttcatgacgccttcgatc

SEQ ID NO: 285685 - DNA, 25 bp, Homo sapien
atgacgccttcgatctcaagcgcca

SEQ ID NO: 285686 - DNA, 25 bp, Homo sapien
aagcgccacatgaggactcacactg

SEQ ID NO: 285687 - DNA, 25 bp, Homo sapien
ttccgctgcagtgcttgcgggaaag

SEQ ID NO: 285688 - DNA, 25 bp, Homo sapien
gggaaagcgtttacgcagcgctgct

SEQ ID NO: 285689 - DNA, 25 bp, Homo sapien
ggaagctcaccttgctaaggtgcat

SEQ ID NO: 285690 - DNA, 25 bp, Homo sapien
ctaaggtgcatggacagccggccag

SEQ ID NO: 285691 - DNA, 25 bp, Homo sapien
tacgcttaccgtgagcgccgcgaga

SEQ ID NO: 285692 - DNA, 25 bp, Homo sapien
gtgtgcgaggactgcggcttcacca

SEQ ID NO: 285693 - DNA, 25 bp, Homo sapien
agcctgatacggtgtgccagcgtcc

SEQ ID NO: 285694 - DNA, 25 bp, Homo sapien
tacactgagggcatgtatcctagca

SEQ ID NO: 285695 - DNA, 25 bp, Homo sapien
gagggcatgtatcctagcatctgtg

SEQ ID NO: 285696 - DNA, 25 bp, Homo sapien
tgtatcctagcatctgtgtggaagc

SEQ ID NO: 285697 - DNA, 25 bp, Homo sapien
gagagcctgggagactacctaagaa

SEQ ID NO: 285698 - DNA, 25 bp, Homo sapien
ggaagttaagtcatcagaggcccat

SEQ ID NO: 285699 - DNA, 25 bp, Homo sapien
gttaagtcatcagaggcccatgaaa

SEQ ID NO: 285700 - DNA, 25 bp, Homo sapien
gaaaaaacactagacagaaggcact

SEQ ID NO: 285701 - DNA, 25 bp, Homo sapien
gagcaatttttattacttccagaga

SEQ ID NO: 285702 - DNA, 25 bp, Homo sapien
tacttccagagatcctcttctttca

SEQ ID NO: 285703 - DNA, 25 bp, Homo sapien
tcttctttcactggaattacttgat

SEQ ID NO: 285704 - DNA, 25 bp, Homo sapien
ggaattacttgatcaactgtttttt

SEQ ID NO: 285705 - DNA, 25 bp, Homo sapien
ttagtcttcagtacctttccttcca

SEQ ID NO: 285706 - DNA, 25 bp, Homo sapien
agtacctttccttccagtattatct

SEQ ID NO: 285707 - DNA, 25 bp, Homo sapien
tattatctgcattatctgtgcccgc

SEQ ID NO: 285708 - DNA, 25 bp, Homo sapien
gcccgcttgctgtgatgtcttgaaa

SEQ ID NO: 285709 - DNA, 25 bp, Homo sapien
gaaaagcccataaattggttcttat

SEQ ID NO: 285710 - DNA, 25 bp, Homo sapien
tttggcaaatggtctcctgcttttc

SEQ ID NO: 285711 - DNA, 25 bp, Homo sapien
atttgcctttggctaagcgcagtta

SEQ ID NO: 285712 - DNA, 25 bp, Homo sapien
ggctaagcgcagttacatgaaccaa

SEQ ID NO: 285713 - DNA, 25 bp, Homo sapien
agcaacaggctgagtcacattgtat

SEQ ID NO: 285714 - DNA, 25 bp, Homo sapien
tctctgtgttccttctaggcctgag

SEQ ID NO: 285715 - DNA, 25 bp, Homo sapien
ctaggcctgaggacgcatcaacaca

SEQ ID NO: 285716 - DNA, 25 bp, Homo sapien
tttgtcttgcgggtctgtcagggtt

SEQ ID NO: 285717 - DNA, 25 bp, Homo sapien
cggtttgcatttacgcctgtaaatg

SEQ ID NO: 285718 - DNA, 25 bp, Homo sapien
ggtttgcatttacgcctgtaaatgt

SEQ ID NO: 285719 - DNA, 25 bp, Homo sapien
gtttgcatttacgcctgtaaatgta

SEQ ID NO: 285720 - DNA, 25 bp, Homo sapien
tttgcatttacgcctgtaaatgtat

SEQ ID NO: 285721 - DNA, 25 bp, Homo sapien
ttgcatttacgcctgtaaatgtatt

SEQ ID NO: 285722 - DNA, 25 bp, Homo sapien
tgcatttacgcctgtaaatgtattc

SEQ ID NO: 285723 - DNA, 25 bp, Homo sapien
gcatttacgcctgtaaatgtattca

SEQ ID NO: 285724 - DNA, 25 bp, Homo sapien
caaaccacaggaggacggagtcgga

SEQ ID NO: 285725 - DNA, 25 bp, Homo sapien
tcggagactggagcaccgcggcctt

SEQ ID NO: 285726 - DNA, 25 bp, Homo sapien
ggctgaggctggaccggattctctc

SEQ ID NO: 285727 - DNA, 25 bp, Homo sapien
tctctccgagttcccagaaggagcc

SEQ ID NO: 285728 - DNA, 25 bp, Homo sapien
agaaggagccagtcctgccgacgcc

SEQ ID NO: 285729 - DNA, 25 bp, Homo sapien
tgccgacgccttgatgctggactct

SEQ ID NO: 285730 - DNA, 25 bp, Homo sapien
aaggctcttgagacgaggtcatcct

SEQ ID NO: 285731 - DNA, 25 bp, Homo sapien
acgaggtcatcctgggttatgcaga

SEQ ID NO: 285732 - DNA, 25 bp, Homo sapien
gttatgcagatggaccctgaatccg

SEQ ID NO: 285733 - DNA, 25 bp, Homo sapien
agatggaccctgaatccgacactag

SEQ ID NO: 285734 - DNA, 25 bp, Homo sapien
atccgacactagcacccgtgtggaa

SEQ ID NO: 285735 - DNA, 25 bp, Homo sapien
tggtgtcttacttttgagtggattt

SEQ ID NO: 285736 - DNA, 25 bp, Homo sapien
gagtggatttatgaggcatcctaga

SEQ ID NO: 285737 - DNA, 25 bp, Homo sapien
aatgtattgggaagtctctgacacc

SEQ ID NO: 285738 - DNA, 25 bp, Homo sapien
ttgggaagtctctgacaccgatcag

SEQ ID NO: 285739 - DNA, 25 bp, Homo sapien
gacaccgatcagaacctggttagag

SEQ ID NO: 285740 - DNA, 25 bp, Homo sapien
cagaacctggttagagatgcaatca

SEQ ID NO: 285741 - DNA, 25 bp, Homo sapien
gaattgattttctcaaacctgcact

SEQ ID NO: 285742 - DNA, 25 bp, Homo sapien
gcactttgcagataatggccaccta

SEQ ID NO: 285743 - DNA, 25 bp, Homo sapien
taatggccacctagatcaaaaagat

SEQ ID NO: 285744 - DNA, 25 bp, Homo sapien
agtttacaaagttgagacctctcat

SEQ ID NO: 285745 - DNA, 25 bp, Homo sapien
taaaaatttcctcttgtatgctccc

SEQ ID NO: 285746 - DNA, 25 bp, Homo sapien
tgggcactctgtactttgcaaccta

SEQ ID NO: 285747 - DNA, 25 bp, Homo sapien
gcaacctaccaagtatcatcacaag

SEQ ID NO: 285748 - DNA, 25 bp, Homo sapien
ctccggctggataccaggctgtaga

SEQ ID NO: 285749 - DNA, 25 bp, Homo sapien
agtcagcatcctctctcttggtgta

SEQ ID NO: 285750 - DNA, 25 bp, Homo sapien
tcctctctcttggtgtacaatggta

SEQ ID NO: 285751 - DNA, 25 bp, Homo sapien
gataccaggctgtagaaccaccaga

SEQ ID NO: 285752 - DNA, 25 bp, Homo sapien
ggtagggacagctactgtgtcatct

SEQ ID NO: 285753 - DNA, 25 bp, Homo sapien
agctactgtgtcatctggagcatga

SEQ ID NO: 285754 - DNA, 25 bp, Homo sapien
tgtagaaccaccagatgcttcagat

SEQ ID NO: 285755 - DNA, 25 bp, Homo sapien
aaggttggatctgtttcacagggaa

SEQ ID NO: 285756 - DNA, 25 bp, Homo sapien
gctaaactgtttcaagaggcgacca

SEQ ID NO: 285757 - DNA, 25 bp, Homo sapien
tccacctgaacgcaagcagagcttt

SEQ ID NO: 285758 - DNA, 25 bp, Homo sapien
aacgcaagcagagctttctgtggga

SEQ ID NO: 285759 - DNA, 25 bp, Homo sapien
agctttctgtgggagggcagcgcac

SEQ ID NO: 285760 - DNA, 25 bp, Homo sapien
tgtgggagggcagcgcactgactgg

SEQ ID NO: 285761 - DNA, 25 bp, Homo sapien
tgggccatggaggacttctacacgg

SEQ ID NO: 285762 - DNA, 25 bp, Homo sapien
aaaagggccgtgtggccttgctcct

SEQ ID NO: 285763 - DNA, 25 bp, Homo sapien
ctgcccagggccttatgcaggagcc

SEQ ID NO: 285764 - DNA, 25 bp, Homo sapien
tgcaggagcccgtgccgcctctggt

SEQ ID NO: 285765 - DNA, 25 bp, Homo sapien
gtggccttgctcctctctaaggaag

SEQ ID NO: 285766 - DNA, 25 bp, Homo sapien
aagtgaattgtttagccgcccacca

SEQ ID NO: 285767 - DNA, 25 bp, Homo sapien
cacttcctgccagcaggattttaaa

SEQ ID NO: 285768 - DNA, 25 bp, Homo sapien
gatctcagggcaagtgcaggcacag

SEQ ID NO: 285769 - DNA, 25 bp, Homo sapien
gatgcctcctatgtagagagacccc

SEQ ID NO: 285770 - DNA, 25 bp, Homo sapien
atgagctggctacatttctcttaaa

SEQ ID NO: 285771 - DNA, 25 bp, Homo sapien
atcaccaatttcattgttgcccagc

SEQ ID NO: 285772 - DNA, 25 bp, Homo sapien
aatttcattgttgcccagcatgcca

SEQ ID NO: 285773 - DNA, 25 bp, Homo sapien
cagcatgccatcagcctatagagtc

SEQ ID NO: 285774 - DNA, 25 bp, Homo sapien
ctatagagtcaggtgccccagatat

SEQ ID NO: 285775 - DNA, 25 bp, Homo sapien
gccccagatattaaatccctgttaa

SEQ ID NO: 285776 - DNA, 25 bp, Homo sapien
gagggtcaagttataagttcattca

SEQ ID NO: 285777 - DNA, 25 bp, Homo sapien
ccacctcatggtggttctgatggca

SEQ ID NO: 285778 - DNA, 25 bp, Homo sapien
gcaaatgtagtggtgatctcagggc

SEQ ID NO: 285779 - DNA, 25 bp, Homo sapien
gcagacagtataaggcttcagccaa

SEQ ID NO: 285780 - DNA, 25 bp, Homo sapien
acagtataaggcttcagccaagagc

SEQ ID NO: 285781 - DNA, 25 bp, Homo sapien
gccaagagcttcttttagatatgat

SEQ ID NO: 285782 - DNA, 25 bp, Homo sapien
gaatttataatgctttacttgggat

SEQ ID NO: 285783 - DNA, 25 bp, Homo sapien
cgttacattttcctgtagtggttat

SEQ ID NO: 285784 - DNA, 25 bp, Homo sapien
agtggttatgatgttgtgtcctgaa

SEQ ID NO: 285785 - DNA, 25 bp, Homo sapien
ttgtgtcctgaacccatttggtact

SEQ ID NO: 285786 - DNA, 25 bp, Homo sapien
gtcctgaacccatttggtactgaaa

SEQ ID NO: 285787 - DNA, 25 bp, Homo sapien
acccatttggtactgaaacattctg

SEQ ID NO: 285788 - DNA, 25 bp, Homo sapien
ttggtactgaaacattctgcagaat

SEQ ID NO: 285789 - DNA, 25 bp, Homo sapien
aaagaaagtaacatgctgcagacag

SEQ ID NO: 285790 - DNA, 25 bp, Homo sapien
gatggtttgtttgagcagccccaga

SEQ ID NO: 285791 - DNA, 25 bp, Homo sapien
tgagcagccccagataacaaacatt

SEQ ID NO: 285792 - DNA, 25 bp, Homo sapien
aaacattccttgaggtcacacgcta

SEQ ID NO: 285793 - DNA, 25 bp, Homo sapien
tgaggtcacacgctaaccaagctgt

SEQ ID NO: 285794 - DNA, 25 bp, Homo sapien
acacgctaaccaagctgtgattcga

SEQ ID NO: 285795 - DNA, 25 bp, Homo sapien
aagctgtgattcgaacactgcctct

SEQ ID NO: 285796 - DNA, 25 bp, Homo sapien
tgattcgaacactgcctctcaaatt

SEQ ID NO: 285797 - DNA, 25 bp, Homo sapien
tgcctctcaaattcacgagcaaaag

SEQ ID NO: 285798 - DNA, 25 bp, Homo sapien
aaatgccaaaaagaactctttcttg

SEQ ID NO: 285799 - DNA, 25 bp, Homo sapien
gggcaatccatttaatgctactaag

SEQ ID NO: 285800 - DNA, 25 bp, Homo sapien
gctactaagttgtgggatggtttgt

SEQ ID NO: 285801 - DNA, 25 bp, Homo sapien
agcagtggatctaggaatggagccc

SEQ ID NO: 285802 - DNA, 25 bp, Homo sapien
tctaggaatggagcccgagcagtct

SEQ ID NO: 285803 - DNA, 25 bp, Homo sapien
agcccgagcagtctcgctctcaggg

SEQ ID NO: 285804 - DNA, 25 bp, Homo sapien
actgtgctgtcccagctctggagac

SEQ ID NO: 285805 - DNA, 25 bp, Homo sapien
gtcccagctctggagacgcagaatt

SEQ ID NO: 285806 - DNA, 25 bp, Homo sapien
gggatgacgctgcttcacccagact

SEQ ID NO: 285807 - DNA, 25 bp, Homo sapien
cgctgcttcacccagacttggagga

SEQ ID NO: 285808 - DNA, 25 bp, Homo sapien
aggagcgtggtgaattgcccgtgcc

SEQ ID NO: 285809 - DNA, 25 bp, Homo sapien
catgctctgatgtgcctctctggcc

SEQ ID NO: 285810 - DNA, 25 bp, Homo sapien
taaacactgccctaaatcagcaggg

SEQ ID NO: 285811 - DNA, 25 bp, Homo sapien
gtcacttctgctttatgcacctttt

SEQ ID NO: 285812 - DNA, 25 bp, Homo sapien
ctcttcctgacctgaggagaggccc

SEQ ID NO: 285813 - DNA, 25 bp, Homo sapien
accctcacccagtctttgtgcaggg

SEQ ID NO: 285814 - DNA, 25 bp, Homo sapien
acccagtctttgtgcagggcgccgg

SEQ ID NO: 285815 - DNA, 25 bp, Homo sapien
ccaactgccacgttctgggcctttg

SEQ ID NO: 285816 - DNA, 25 bp, Homo sapien
attcagagcaaaccagcggcatttg

SEQ ID NO: 285817 - DNA, 25 bp, Homo sapien
cagagcaaaccagcggcatttgttg

SEQ ID NO: 285818 - DNA, 25 bp, Homo sapien
ggtctccggccttcaacatcacaga

SEQ ID NO: 285819 - DNA, 25 bp, Homo sapien
gggcgccagaaagccactttgggcc

SEQ ID NO: 285820 - DNA, 25 bp, Homo sapien
cgccagaaagccactttgggcctgt

SEQ ID NO: 285821 - DNA, 25 bp, Homo sapien
gcctgtccccaggaaaacgtggtct

SEQ ID NO: 285822 - DNA, 25 bp, Homo sapien
caggaaaacgtggtctcagctgtgg

SEQ ID NO: 285823 - DNA, 25 bp, Homo sapien
atggcatattgcctatgttcgccgc

SEQ ID NO: 285824 - DNA, 25 bp, Homo sapien
ccccagttcactagtgtatcagaat

SEQ ID NO: 285825 - DNA, 25 bp, Homo sapien
tcactagtgtatcagaatgcatctt

SEQ ID NO: 285826 - DNA, 25 bp, Homo sapien
tgcatcttcagaattacacactgaa

SEQ ID NO: 285827 - DNA, 25 bp, Homo sapien
tgaagatacaaaaggtccagttggt

SEQ ID NO: 285828 - DNA, 25 bp, Homo sapien
ggtccagttggtaagctcatcagta

SEQ ID NO: 285829 - DNA, 25 bp, Homo sapien
gctcatcagtaaataacaaggcttt

SEQ ID NO: 285830 - DNA, 25 bp, Homo sapien
ggctttgaaatctgacaaattagct

SEQ ID NO: 285831 - DNA, 25 bp, Homo sapien
gagtattctttatcctttctgttgt

SEQ ID NO: 285832 - DNA, 25 bp, Homo sapien
tatcctttctgttgtctcacatgac

SEQ ID NO: 285833 - DNA, 25 bp, Homo sapien
gttgtctcacatgacaagcatggga

SEQ ID NO: 285834 - DNA, 25 bp, Homo sapien
agcaaccccagctatctggatctga

SEQ ID NO: 285835 - DNA, 25 bp, Homo sapien
ccagctatctggatctgaagtggat

SEQ ID NO: 285836 - DNA, 25 bp, Homo sapien
tgaagtggatatgctcagagacatc

SEQ ID NO: 285837 - DNA, 25 bp, Homo sapien
tggcccaccccaaagaagatgctgc

SEQ ID NO: 285838 - DNA, 25 bp, Homo sapien
gctgcactcagaagacgccagagct

SEQ ID NO: 285839 - DNA, 25 bp, Homo sapien
tctggaagctctgcaaggacccagc

SEQ ID NO: 285840 - DNA, 25 bp, Homo sapien
agctctgcaaggacccagcaaggca

SEQ ID NO: 285841 - DNA, 25 bp, Homo sapien
agcaaggcagcctgctcagcgaagg

SEQ ID NO: 285842 - DNA, 25 bp, Homo sapien
gctcagcgaaggctttgtctcctgt

SEQ ID NO: 285843 - DNA, 25 bp, Homo sapien
gcgaaggctttgtctcctgtggcag

SEQ ID NO: 285844 - DNA, 25 bp, Homo sapien
gcaacattaagaacaagaaccccgg

SEQ ID NO: 285845 - DNA, 25 bp, Homo sapien
tgctaggctcctcttctgtgctctt

SEQ ID NO: 285846 - DNA, 25 bp, Homo sapien
cactgggagagctatcctagggtag

SEQ ID NO: 285847 - DNA, 25 bp, Homo sapien
gagagctatcctagggtagcctcca

SEQ ID NO: 285848 - DNA, 25 bp, Homo sapien
agctatcctagggtagcctccagct

SEQ ID NO: 285849 - DNA, 25 bp, Homo sapien
agggtgcccgtcaatagcctggcta

SEQ ID NO: 285850 - DNA, 25 bp, Homo sapien
ggtgcccgtcaatagcctggctaat

SEQ ID NO: 285851 - DNA, 25 bp, Homo sapien
tagcctggctaatttaatagatgca

SEQ ID NO: 285852 - DNA, 25 bp, Homo sapien
aggagcaaacagaggctcaggcaat

SEQ ID NO: 285853 - DNA, 25 bp, Homo sapien
gaggctcaggcaatgaggcccctaa

SEQ ID NO: 285854 - DNA, 25 bp, Homo sapien
gcaatgaggcccctaacctggacta

SEQ ID NO: 285855 - DNA, 25 bp, Homo sapien
ggtggtccctgctcctaaccactga

SEQ ID NO: 285856 - DNA, 25 bp, Homo sapien
gcatacagagaggaaacagcttaaa

SEQ ID NO: 285857 - DNA, 25 bp, Homo sapien
aactggataacccagacagtcccca

SEQ ID NO: 285858 - DNA, 25 bp, Homo sapien
cagacagtccccacagaatttcttt

SEQ ID NO: 285859 - DNA, 25 bp, Homo sapien
acagaatttctttcaggtcacagat

SEQ ID NO: 285860 - DNA, 25 bp, Homo sapien
tctttcaggtcacagatttcttaaa

SEQ ID NO: 285861 - DNA, 25 bp, Homo sapien
aaaatgtgcctgcttggttgtttga

SEQ ID NO: 285862 - DNA, 25 bp, Homo sapien
gcctgcttggttgtttgaatcttgc

SEQ ID NO: 285863 - DNA, 25 bp, Homo sapien
gcataattaatgtcacaggcgcaag

SEQ ID NO: 285864 - DNA, 25 bp, Homo sapien
aggcgcaagccgctgaacttagttg

SEQ ID NO: 285865 - DNA, 25 bp, Homo sapien
agccgctgaacttagttgagatgca

SEQ ID NO: 285866 - DNA, 25 bp, Homo sapien
aaatgcaatgacatatctgagaagc

SEQ ID NO: 285867 - DNA, 25 bp, Homo sapien
ggatatgaatgcttcctagagttct

SEQ ID NO: 285868 - DNA, 25 bp, Homo sapien
tgtggagccctcttagaaggagaca

SEQ ID NO: 285869 - DNA, 25 bp, Homo sapien
ggagccctcttagaaggagacaggc

SEQ ID NO: 285870 - DNA, 25 bp, Homo sapien
ggacatggagtctttctcaaggaca

SEQ ID NO: 285871 - DNA, 25 bp, Homo sapien
atggagtctttctcaaggacacaaa

SEQ ID NO: 285872 - DNA, 25 bp, Homo sapien
ggagcccttcccaggacatggagaa

SEQ ID NO: 285873 - DNA, 25 bp, Homo sapien
tggagtccccctgcatcatggagtc

SEQ ID NO: 285874 - DNA, 25 bp, Homo sapien
gactggagcctatgcaggcacagag

SEQ ID NO: 285875 - DNA, 25 bp, Homo sapien
agcctatgcaggcacagagtccctc

SEQ ID NO: 285876 - DNA, 25 bp, Homo sapien
agagtccctcaggaccaaggagtcc

SEQ ID NO: 285877 - DNA, 25 bp, Homo sapien
gagtccctcctgcaggtgtggagcc

SEQ ID NO: 285878 - DNA, 25 bp, Homo sapien
gccaccgcgtggtcctttgcaagag

SEQ ID NO: 285879 - DNA, 25 bp, Homo sapien
accgcgtggtcctttgcaagagcgc

SEQ ID NO: 285880 - DNA, 25 bp, Homo sapien
cgtggtcctttgcaagagcgcagac

SEQ ID NO: 285881 - DNA, 25 bp, Homo sapien
gtcctttgcaagagcgcagaccacc

SEQ ID NO: 285882 - DNA, 25 bp, Homo sapien
tttgcaagagcgcagaccaccgcgc

SEQ ID NO: 285883 - DNA, 25 bp, Homo sapien
accggccaccatgcgctgcaacttg

SEQ ID NO: 285884 - DNA, 25 bp, Homo sapien
tgagtgctctgcacagtgcggcgtc

SEQ ID NO: 285885 - DNA, 25 bp, Homo sapien
tcggtgcgctgcaccagccacacgg

SEQ ID NO: 285886 - DNA, 25 bp, Homo sapien
acgggccaggcgtcgcacgagtgca

SEQ ID NO: 285887 - DNA, 25 bp, Homo sapien
tcgcacgagtgcacggaggccctgc

SEQ ID NO: 285888 - DNA, 25 bp, Homo sapien
accacgcagcagtgtgaggccaagt

SEQ ID NO: 285889 - DNA, 25 bp, Homo sapien
atgccagattccgacaccgggttgc

SEQ ID NO: 285890 - DNA, 25 bp, Homo sapien
tcgcccatgccaagggccatgttgg

SEQ ID NO: 285891 - DNA, 25 bp, Homo sapien
gggatctgtcgtatgagtgagtcaa

SEQ ID NO: 285892 - DNA, 25 bp, Homo sapien
gagtgagtcaaagcctgattttttc

SEQ ID NO: 285893 - DNA, 25 bp, Homo sapien
tatggcatcttgaatagcaacacat

SEQ ID NO: 285894 - DNA, 25 bp, Homo sapien
tagcaacacattttagctcaaggaa

SEQ ID NO: 285895 - DNA, 25 bp, Homo sapien
accgggttgcatctggttgcccaag

SEQ ID NO: 285896 - DNA, 25 bp, Homo sapien
tctggttgcccaaggtttaagtagc

SEQ ID NO: 285897 - DNA, 25 bp, Homo sapien
taagtagccccggtctcttgtcaca

SEQ ID NO: 285898 - DNA, 25 bp, Homo sapien
ttgtcacaacatagaagctcgggaa

SEQ ID NO: 285899 - DNA, 25 bp, Homo sapien
ggaaacgaatggaagcagggctcta

SEQ ID NO: 285900 - DNA, 25 bp, Homo sapien
gcagggctccccagtacacgtttgg

SEQ ID NO: 285901 - DNA, 25 bp, Homo sapien
ccagtacacgtttggctaccggcgc

SEQ ID NO: 285902 - DNA, 25 bp, Homo sapien
taccggcgcccatacagagtgatgg

SEQ ID NO: 285903 - DNA, 25 bp, Homo sapien
agagtgatggacctcaacccggctc

SEQ ID NO: 285904 - DNA, 25 bp, Homo sapien
cgagctgctccctgctacagtctgg

SEQ ID NO: 285905 - DNA, 25 bp, Homo sapien
agaactggttctacaaggaggatgt

SEQ ID NO: 285906 - DNA, 25 bp, Homo sapien
gacctgagccatccatctatcagaa

SEQ ID NO: 285907 - DNA, 25 bp, Homo sapien
agccatccatctatcagaaccgcag

SEQ ID NO: 285908 - DNA, 25 bp, Homo sapien
tatcagaaccgcagccctacttaca

SEQ ID NO: 285909 - DNA, 25 bp, Homo sapien
gcagccctacttacagcatggccaa

SEQ ID NO: 285910 - DNA, 25 bp, Homo sapien
acagcatggccaagcgcttcgccta

SEQ ID NO: 285911 - DNA, 25 bp, Homo sapien
ggcagagcagtaggacaaatagcta

SEQ ID NO: 285912 - DNA, 25 bp, Homo sapien
gtttatctatatagcacctacatgt

SEQ ID NO: 285913 - DNA, 25 bp, Homo sapien
atctatatagcacctacatgttctg

SEQ ID NO: 285914 - DNA, 25 bp, Homo sapien
atatagcacctacatgttctgcact

SEQ ID NO: 285915 - DNA, 25 bp, Homo sapien
atagcacctacatgttctgcacttg

SEQ ID NO: 285916 - DNA, 25 bp, Homo sapien
gcacctacatgttctgcacttgtat

SEQ ID NO: 285917 - DNA, 25 bp, Homo sapien
aagccaacatggcattcattactgc

SEQ ID NO: 285918 - DNA, 25 bp, Homo sapien
gtgctgtatgatacacaccggactt

SEQ ID NO: 285919 - DNA, 25 bp, Homo sapien
caccggactttgaagactcagtgtg

SEQ ID NO: 285920 - DNA, 25 bp, Homo sapien
ccggactttgaagactcagtgtgaa

SEQ ID NO: 285921 - DNA, 25 bp, Homo sapien
gactttgaagactcagtgtgaaaaa

SEQ ID NO: 285922 - DNA, 25 bp, Homo sapien
aatagattagttgggttttcacatg

SEQ ID NO: 285923 - DNA, 25 bp, Homo sapien
aacattatggtgattatggtgagga

SEQ ID NO: 285924 - DNA, 25 bp, Homo sapien
gaaatagtgttgttacctgccaagc

SEQ ID NO: 285925 - DNA, 25 bp, Homo sapien
atagtgttgttacctgccaagccat

SEQ ID NO: 285926 - DNA, 25 bp, Homo sapien
gttacctgccaagccatcctgtata

SEQ ID NO: 285927 - DNA, 25 bp, Homo sapien
caagccatcctgtatacaccaatga

SEQ ID NO: 285928 - DNA, 25 bp, Homo sapien
gccatcctgtatacaccaatgattt

SEQ ID NO: 285929 - DNA, 25 bp, Homo sapien
cctccttctgccattactatggcaa

SEQ ID NO: 285930 - DNA, 25 bp, Homo sapien
tactatggcaacttaagtgtatctg

SEQ ID NO: 285931 - DNA, 25 bp, Homo sapien
aacttaagtgtatctgcagctctac

SEQ ID NO: 285932 - DNA, 25 bp, Homo sapien
ctgcagctctacattaaaaaggaga

SEQ ID NO: 285933 - DNA, 25 bp, Homo sapien
gacctgggtactggctgaaggaata

SEQ ID NO: 285934 - DNA, 25 bp, Homo sapien
ccgggagcctagatctcactccagg

SEQ ID NO: 285935 - DNA, 25 bp, Homo sapien
tgatgcacactgcttcagacactcc

SEQ ID NO: 285936 - DNA, 25 bp, Homo sapien
actgcttcagacactcctgctggag

SEQ ID NO: 285937 - DNA, 25 bp, Homo sapien
tggagccccagtccctgacaaggac

SEQ ID NO: 285938 - DNA, 25 bp, Homo sapien
tccctgacaaggacctaggacattt

SEQ ID NO: 285939 - DNA, 25 bp, Homo sapien
ggacctaggacatttttgctcctgc

SEQ ID NO: 285940 - DNA, 25 bp, Homo sapien
tcctgcccagcctatcgggagggag

SEQ ID NO: 285941 - DNA, 25 bp, Homo sapien
tatcgggagggagccttgagccttt

SEQ ID NO: 285942 - DNA, 25 bp, Homo sapien
ggagggagccttgagcctttcagct

SEQ ID NO: 285943 - DNA, 25 bp, Homo sapien
gccttgagcctttcagctctgctgt

SEQ ID NO: 285944 - DNA, 25 bp, Homo sapien
aagctgaaagcctttgccggcacag

SEQ ID NO: 285945 - DNA, 25 bp, Homo sapien
gggacttcacccgattccagagaaa

SEQ ID NO: 285946 - DNA, 25 bp, Homo sapien
ccgattccagagaaagccgctcaaa

SEQ ID NO: 285947 - DNA, 25 bp, Homo sapien
gaaagccgctcaaaggagagatctt

SEQ ID NO: 285948 - DNA, 25 bp, Homo sapien
aggagagatcttgctgagccctgct

SEQ ID NO: 285949 - DNA, 25 bp, Homo sapien
gacaccagctgtgttcacgaagaaa

SEQ ID NO: 285950 - DNA, 25 bp, Homo sapien
cacggaggtagaatgaatgactgct

SEQ ID NO: 285951 - DNA, 25 bp, Homo sapien
gaatgactgcttatttgggaaacaa

SEQ ID NO: 285952 - DNA, 25 bp, Homo sapien
tttgccggcacagaggcagcaactg

SEQ ID NO: 285953 - DNA, 25 bp, Homo sapien
gtttgggtacactgagtcagccctg

SEQ ID NO: 285954 - DNA, 25 bp, Homo sapien
gtacactgagtcagccctgagcagt

SEQ ID NO: 285955 - DNA, 25 bp, Homo sapien
aggcatcccttaatatgaaacctgc

SEQ ID NO: 285956 - DNA, 25 bp, Homo sapien
atattacccgtttacctgtctgtct

SEQ ID NO: 285957 - DNA, 25 bp, Homo sapien
tccatgttcactcaatttctgctca

SEQ ID NO: 285958 - DNA, 25 bp, Homo sapien
ccccacatagacaggactgagtttt

SEQ ID NO: 285959 - DNA, 25 bp, Homo sapien
gactgagttttactcaccgtcacat

SEQ ID NO: 285960 - DNA, 25 bp, Homo sapien
agcatattctccagtctcgaaactt

SEQ ID NO: 285961 - DNA, 25 bp, Homo sapien
actcaatttctgctcatcctttaag

SEQ ID NO: 285962 - DNA, 25 bp, Homo sapien
aagataagatctgttccccataagg

SEQ ID NO: 285963 - DNA, 25 bp, Homo sapien
catcctttaagcttggttcagtggt

SEQ ID NO: 285964 - DNA, 25 bp, Homo sapien
gttcagtggtcaccttctctaggac

SEQ ID NO: 285965 - DNA, 25 bp, Homo sapien
gggtcctttcaaggcatcccttaat

SEQ ID NO: 285966 - DNA, 25 bp, Homo sapien
ccacagaaagattcgggaacacaaa

SEQ ID NO: 285967 - DNA, 25 bp, Homo sapien
tgtgtgtccctcatgtcttctaatg

SEQ ID NO: 285968 - DNA, 25 bp, Homo sapien
gtgtgtccctcatgtcttctaatgg

SEQ ID NO: 285969 - DNA, 25 bp, Homo sapien
tgtgtccctcatgtcttctaatgga

SEQ ID NO: 285970 - DNA, 25 bp, Homo sapien
gtgtccctcatgtcttctaatggaa

SEQ ID NO: 285971 - DNA, 25 bp, Homo sapien
tgtccctcatgtcttctaatggaaa

SEQ ID NO: 285972 - DNA, 25 bp, Homo sapien
gtccctcatgtcttctaatggaaaa

SEQ ID NO: 285973 - DNA, 25 bp, Homo sapien
tccctcatgtcttctaatggaaaag

SEQ ID NO: 285974 - DNA, 25 bp, Homo sapien
cctcatgtcttctaatggaaaagaa

SEQ ID NO: 285975 - DNA, 25 bp, Homo sapien
ggaacacaaattttacaaacacaca

SEQ ID NO: 285976 - DNA, 25 bp, Homo sapien
acacaaattttacaaacacacaaag

SEQ ID NO: 285977 - DNA, 25 bp, Homo sapien
atttacaatccactagtctaatcta

SEQ ID NO: 285978 - DNA, 25 bp, Homo sapien
aatctagtttagatccagcggcaat

SEQ ID NO: 285979 - DNA, 25 bp, Homo sapien
agtttagatccagcggcaatttttg

SEQ ID NO: 285980 - DNA, 25 bp, Homo sapien
cctctataaacctgccgttttctgt

SEQ ID NO: 285981 - DNA, 25 bp, Homo sapien
acaggcaacgtgaccccaagcgaca

SEQ ID NO: 285982 - DNA, 25 bp, Homo sapien
aagcgacagccagctgatgcttgct

SEQ ID NO: 285983 - DNA, 25 bp, Homo sapien
gacagccagctgatgcttgcttctc

SEQ ID NO: 285984 - DNA, 25 bp, Homo sapien
tgccgttttctgtctcccaagtcat

SEQ ID NO: 285985 - DNA, 25 bp, Homo sapien
tctcccaagtcatcccagtttagaa

SEQ ID NO: 285986 - DNA, 25 bp, Homo sapien
cagtttagaactgctccaggaaata

SEQ ID NO: 285987 - DNA, 25 bp, Homo sapien
aacagagagagcctagtttgtttat

SEQ ID NO: 285988 - DNA, 25 bp, Homo sapien
tgaagtctcctgtcctctaaagcta

SEQ ID NO: 285989 - DNA, 25 bp, Homo sapien
acctggaagcaagcagtaggcacta

SEQ ID NO: 285990 - DNA, 25 bp, Homo sapien
gtaggcactacgcacagcacagagg

SEQ ID NO: 285991 - DNA, 25 bp, Homo sapien
gtccgccaggtcattgtgacgcaaa

SEQ ID NO: 285992 - DNA, 25 bp, Homo sapien
gtgacgcaaacgctatggccacgtg

SEQ ID NO: 285993 - DNA, 25 bp, Homo sapien
acgctatggccacgtggaacacctt

SEQ ID NO: 285994 - DNA, 25 bp, Homo sapien
aacatgacctttattctcgaagctc

SEQ ID NO: 285995 - DNA, 25 bp, Homo sapien
gctcaaacttgatttccaggtacag

SEQ ID NO: 285996 - DNA, 25 bp, Homo sapien
ggtacagcaggcctctgtaactttt

SEQ ID NO: 285997 - DNA, 25 bp, Homo sapien
aggcctctgtaacttttcttggcag

SEQ ID NO: 285998 - DNA, 25 bp, Homo sapien
tggcagtgaagtcatgaagtctcct

SEQ ID NO: 285999 - DNA, 25 bp, Homo sapien
gacgggctgctgagtcgcgcgctgc

SEQ ID NO: 286000 - DNA, 25 bp, Homo sapien
gggctgctgagtcgcgcgctgcggg

SEQ ID NO: 286001 - DNA, 25 bp, Homo sapien
gcgctgcgggctggaaggagtcgcc

SEQ ID NO: 286002 - DNA, 25 bp, Homo sapien
gggctggaaggagtcgccgcctggc

SEQ ID NO: 286003 - DNA, 25 bp, Homo sapien
gctggaaggagtcgccgcctggccc

SEQ ID NO: 286004 - DNA, 25 bp, Homo sapien
gctccgtctccagcgggaacgagga

SEQ ID NO: 286005 - DNA, 25 bp, Homo sapien
tccgtctccagcgggaacgaggacg

SEQ ID NO: 286006 - DNA, 25 bp, Homo sapien
tctccagcgggaacgaggacgagga

SEQ ID NO: 286007 - DNA, 25 bp, Homo sapien
gaacgaggacgaggagcgccgcgcg

SEQ ID NO: 286008 - DNA, 25 bp, Homo sapien
agcgccgcgcgggatccgagtcccc

SEQ ID NO: 286009 - DNA, 25 bp, Homo sapien
tcctcgagcccgctgtcatccaggg

SEQ ID NO: 286010 - DNA, 25 bp, Homo sapien
cagggagtcccagagcagtatgcgt

SEQ ID NO: 286011 - DNA, 25 bp, Homo sapien
agcagtatgcgttctcagcagccat

SEQ ID NO: 286012 - DNA, 25 bp, Homo sapien
cagcagccattttcagtggagcatt

SEQ ID NO: 286013 - DNA, 25 bp, Homo sapien
tggagcatttgactgtgcctcttat

SEQ ID NO: 286014 - DNA, 25 bp, Homo sapien
ttatccctgactgtgaactccaaat

SEQ ID NO: 286015 - DNA, 25 bp, Homo sapien
atcatccttagtggaagtcagattg

SEQ ID NO: 286016 - DNA, 25 bp, Homo sapien
gtcagattgaagctaagccagtttt

SEQ ID NO: 286017 - DNA, 25 bp, Homo sapien
ttctttttacactaccttcctatct

SEQ ID NO: 286018 - DNA, 25 bp, Homo sapien
accttcctatctgcatgtaatttac

SEQ ID NO: 286019 - DNA, 25 bp, Homo sapien
aggaactataccaagccgccttcct

SEQ ID NO: 286020 - DNA, 25 bp, Homo sapien
gccgccttccttataatgctgcaga

SEQ ID NO: 286021 - DNA, 25 bp, Homo sapien
aggtcgatgagtcccctgtcaacga

SEQ ID NO: 286022 - DNA, 25 bp, Homo sapien
tcgatgagtcccctgtcaacgacag

SEQ ID NO: 286023 - DNA, 25 bp, Homo sapien
cgatgagtcccctgtcaacgacagc

SEQ ID NO: 286024 - DNA, 25 bp, Homo sapien
atgagtcccctgtcaacgacagcca

SEQ ID NO: 286025 - DNA, 25 bp, Homo sapien
gtcaacggcgcgctggtggtcacgg

SEQ ID NO: 286026 - DNA, 25 bp, Homo sapien
agtcccctgtcaacgacagccatgg

SEQ ID NO: 286027 - DNA, 25 bp, Homo sapien
cctgtcaacgacagccatggccggg

SEQ ID NO: 286028 - DNA, 25 bp, Homo sapien
gtcaacgacagccatggccgggctc

SEQ ID NO: 286029 - DNA, 25 bp, Homo sapien
aacggcgcgctggtggtcacggtga

SEQ ID NO: 286030 - DNA, 25 bp, Homo sapien
gcgcgctggtggtcacggtgagctg

SEQ ID NO: 286031 - DNA, 25 bp, Homo sapien
ctggtggtcacggtgagctgcggcg

SEQ ID NO: 286032 - DNA, 25 bp, Homo sapien
tgcaaagcccaggactctgatactt

SEQ ID NO: 286033 - DNA, 25 bp, Homo sapien
cccaggactctgatactttgtgtgt

SEQ ID NO: 286034 - DNA, 25 bp, Homo sapien
ggactctgatactttgtgtgttgga

SEQ ID NO: 286035 - DNA, 25 bp, Homo sapien
tgttggagggtttattagaggtcta

SEQ ID NO: 286036 - DNA, 25 bp, Homo sapien
tagaggtctagtagcccagatctgc

SEQ ID NO: 286037 - DNA, 25 bp, Homo sapien
agtagcccagatctgccgcagtgga

SEQ ID NO: 286038 - DNA, 25 bp, Homo sapien
tgccgcagtggactactccaaggat

SEQ ID NO: 286039 - DNA, 25 bp, Homo sapien
ggactactccaaggatatgaggaca

SEQ ID NO: 286040 - DNA, 25 bp, Homo sapien
atgaggacaagctaagggatccagc

SEQ ID NO: 286041 - DNA, 25 bp, Homo sapien
taagggatccagcagtccaaagcct

SEQ ID NO: 286042 - DNA, 25 bp, Homo sapien
cagtccaaagcctcttacagcctgg

SEQ ID NO: 286043 - DNA, 25 bp, Homo sapien
tataatcatagcatgccttaagcac

SEQ ID NO: 286044 - DNA, 25 bp, Homo sapien
atcatagcatgccttaagcacataa

SEQ ID NO: 286045 - DNA, 25 bp, Homo sapien
agcatgccttaagcacataaagtgc

SEQ ID NO: 286046 - DNA, 25 bp, Homo sapien
agcacataaagtgcatagtatatgc

SEQ ID NO: 286047 - DNA, 25 bp, Homo sapien
tgtgtttcgccttaaaacaaatcct

SEQ ID NO: 286048 - DNA, 25 bp, Homo sapien
aaatcctttcaaacatactccatgt

SEQ ID NO: 286049 - DNA, 25 bp, Homo sapien
atactccatgtatgcatgactacaa

SEQ ID NO: 286050 - DNA, 25 bp, Homo sapien
gtatgcatgactacaataatcagga

SEQ ID NO: 286051 - DNA, 25 bp, Homo sapien
ataatcaggacactacccatttttg

SEQ ID NO: 286052 - DNA, 25 bp, Homo sapien
actacccatttttgtgagtttgtat

SEQ ID NO: 286053 - DNA, 25 bp, Homo sapien
taagccaccatacttggccaaaatt

SEQ ID NO: 286054 - DNA, 25 bp, Homo sapien
gaaattaactgcatgtgtctcaatc

SEQ ID NO: 286055 - DNA, 25 bp, Homo sapien
atgtgtctcaatctgcgagtgcagc

SEQ ID NO: 286056 - DNA, 25 bp, Homo sapien
cttctagatggtggcaccttccaga

SEQ ID NO: 286057 - DNA, 25 bp, Homo sapien
ttccagagcttggttcgccctgtgt

SEQ ID NO: 286058 - DNA, 25 bp, Homo sapien
gccctgtgtctacccaacaagtaca

SEQ ID NO: 286059 - DNA, 25 bp, Homo sapien
aagtacagatgccatcccggtgctg

SEQ ID NO: 286060 - DNA, 25 bp, Homo sapien
atgccatcccggtgctgtgatcttc

SEQ ID NO: 286061 - DNA, 25 bp, Homo sapien
tgtgatcttccagccatttctccat

SEQ ID NO: 286062 - DNA, 25 bp, Homo sapien
atttctccatttctgtcacagccca

SEQ ID NO: 286063 - DNA, 25 bp, Homo sapien
acagcccagaaagtgacgccgcaag

SEQ ID NO: 286064 - DNA, 25 bp, Homo sapien
gtgacgccgcaaggccttagagcaa

SEQ ID NO: 286065 - DNA, 25 bp, Homo sapien
gagagaccgcttaatcagcagcttg

SEQ ID NO: 286066 - DNA, 25 bp, Homo sapien
tcagcagcttgacaaagaagacctc

SEQ ID NO: 286067 - DNA, 25 bp, Homo sapien
acctcaagtcttgggaagaaacagt

SEQ ID NO: 286068 - DNA, 25 bp, Homo sapien
aacagtttaatcactcccaagtcct

SEQ ID NO: 286069 - DNA, 25 bp, Homo sapien
ttaatcactcccaagtcctgggcaa

SEQ ID NO: 286070 - DNA, 25 bp, Homo sapien
ctgggcaacagatgaccttcaagtc

SEQ ID NO: 286071 - DNA, 25 bp, Homo sapien
agatgggaaggctctcctctcggtc

SEQ ID NO: 286072 - DNA, 25 bp, Homo sapien
tcggtcccaaagtcctcctgttctt

SEQ ID NO: 286073 - DNA, 25 bp, Homo sapien
cagagttttttacttcctcacgcga

SEQ ID NO: 286074 - DNA, 25 bp, Homo sapien
tttacttcctcacgcgattgtaggt

SEQ ID NO: 286075 - DNA, 25 bp, Homo sapien
tcacgcgattgtaggttcctctcct

SEQ ID NO: 286076 - DNA, 25 bp, Homo sapien
taatgctacttcctggcatagcagg

SEQ ID NO: 286077 - DNA, 25 bp, Homo sapien
ggaagaaacatcaatctaaccacga

SEQ ID NO: 286078 - DNA, 25 bp, Homo sapien
tctaaccacgaattttatttccttg

SEQ ID NO: 286079 - DNA, 25 bp, Homo sapien
acaagctccttgattgtggatgtgc

SEQ ID NO: 286080 - DNA, 25 bp, Homo sapien
cagagctgcctgttgagtctgagga

SEQ ID NO: 286081 - DNA, 25 bp, Homo sapien
ctgttgagtctgaggagtctggcat

SEQ ID NO: 286082 - DNA, 25 bp, Homo sapien
aggagtctggcatgtgacacactgc

SEQ ID NO: 286083 - DNA, 25 bp, Homo sapien
atgtgacacactgcagacctgagac

SEQ ID NO: 286084 - DNA, 25 bp, Homo sapien
tgcagacctgagacaagaagccttg

SEQ ID NO: 286085 - DNA, 25 bp, Homo sapien
agccttgttgctatgggtgactttt

SEQ ID NO: 286086 - DNA, 25 bp, Homo sapien
ctatgggtgacttttagtgacctat

SEQ ID NO: 286087 - DNA, 25 bp, Homo sapien
ttcaatttcttgtcttttggattac

SEQ ID NO: 286088 - DNA, 25 bp, Homo sapien
ggcacgagattctttctaggtccct

SEQ ID NO: 286089 - DNA, 25 bp, Homo sapien
ctattcaggacaaccaatctctcaa

SEQ ID NO: 286090 - DNA, 25 bp, Homo sapien
aatctctcaagaaagggtcaagtac

SEQ ID NO: 286091 - DNA, 25 bp, Homo sapien
gggtcaagtacctatcctagctgtg

SEQ ID NO: 286092 - DNA, 25 bp, Homo sapien
tacctatcctagctgtggaacctac

SEQ ID NO: 286093 - DNA, 25 bp, Homo sapien
ggaacctacagaaccttacttcaga

SEQ ID NO: 286094 - DNA, 25 bp, Homo sapien
cttacttcagaagcccaatatgagt

SEQ ID NO: 286095 - DNA, 25 bp, Homo sapien
gggaatattctctggttgacaatgg

SEQ ID NO: 286096 - DNA, 25 bp, Homo sapien
ggttgacaatggtgtggctgtcact

SEQ ID NO: 286097 - DNA, 25 bp, Homo sapien
ggacctggaacagtgatctggcctc

SEQ ID NO: 286098 - DNA, 25 bp, Homo sapien
tcctcctcaaaacttccatttctat

SEQ ID NO: 286099 - DNA, 25 bp, Homo sapien
agcagtgtatgtttgaaacagccaa

SEQ ID NO: 286100 - DNA, 25 bp, Homo sapien
aacagccaaagatggcgatgaacca

SEQ ID NO: 286101 - DNA, 25 bp, Homo sapien
agatggcgatgaaccaagtgtaaat

SEQ ID NO: 286102 - DNA, 25 bp, Homo sapien
gtgttgaatcaacaaacagtgtatt

SEQ ID NO: 286103 - DNA, 25 bp, Homo sapien
ctgaaatgacttgttagaccagttt

SEQ ID NO: 286104 - DNA, 25 bp, Homo sapien
gtagagtaataatggctcctgggat

SEQ ID NO: 286105 - DNA, 25 bp, Homo sapien
gagaaatatgagatgaacctggaac

SEQ ID NO: 286106 - DNA, 25 bp, Homo sapien
gaacctggaacattctattatggtg

SEQ ID NO: 286107 - DNA, 25 bp, Homo sapien
ggaacattctattatggtgccacaa

SEQ ID NO: 286108 - DNA, 25 bp, Homo sapien
cattctattatggtgccacaaagga

SEQ ID NO: 286109 - DNA, 25 bp, Homo sapien
gagaggcttcactacatcatgcttc

SEQ ID NO: 286110 - DNA, 25 bp, Homo sapien
tacatcatgcttcctgacatctctc

SEQ ID NO: 286111 - DNA, 25 bp, Homo sapien
gatacttggatgcttttcctctgac

SEQ ID NO: 286112 - DNA, 25 bp, Homo sapien
gcagtcagactcctgctttgctctt

SEQ ID NO: 286113 - DNA, 25 bp, Homo sapien
gatgcttttcctctgactgatgaag

SEQ ID NO: 286114 - DNA, 25 bp, Homo sapien
ctctctgaaagaatccgggctgcca

SEQ ID NO: 286115 - DNA, 25 bp, Homo sapien
cagtttcatttggtttgggtgtcag

SEQ ID NO: 286116 - DNA, 25 bp, Homo sapien
gaataccaaagagggccgctgacag

SEQ ID NO: 286117 - DNA, 25 bp, Homo sapien
cgctgacaggtctaggagtacactt

SEQ ID NO: 286118 - DNA, 25 bp, Homo sapien
ggtctaggagtacacttctagcacc

SEQ ID NO: 286119 - DNA, 25 bp, Homo sapien
ttctagcacctagcagagagaggct

SEQ ID NO: 286120 - DNA, 25 bp, Homo sapien
ttatttgagcttgtcacctcgtggt

SEQ ID NO: 286121 - DNA, 25 bp, Homo sapien
ttgtcacctcgtggtcccaaaatgg

SEQ ID NO: 286122 - DNA, 25 bp, Homo sapien
caaaatggccgctgctttctcagtc

SEQ ID NO: 286123 - DNA, 25 bp, Homo sapien
atcacatcctcataatgtctcatcc

SEQ ID NO: 286124 - DNA, 25 bp, Homo sapien
tgtctcatccacaagcatacgaggg

SEQ ID NO: 286125 - DNA, 25 bp, Homo sapien
tacgagggagtctcataggagtaca

SEQ ID NO: 286126 - DNA, 25 bp, Homo sapien
ggaagagcaatgttactagtgtttt

SEQ ID NO: 286127 - DNA, 25 bp, Homo sapien
tttaaacaggtggtcctccctgagt

SEQ ID NO: 286128 - DNA, 25 bp, Homo sapien
ggtcctccctgagtttgtttaacag

SEQ ID NO: 286129 - DNA, 25 bp, Homo sapien
gtttaacagctcagttgtgtcatca

SEQ ID NO: 286130 - DNA, 25 bp, Homo sapien
gttgtgtcatcaagaactcaggctt

SEQ ID NO: 286131 - DNA, 25 bp, Homo sapien
gatgatgctttcgaagcggatgacg

SEQ ID NO: 286132 - DNA, 25 bp, Homo sapien
ctttcgaagcggatgacggcgaaga

SEQ ID NO: 286133 - DNA, 25 bp, Homo sapien
cgtgccggctgtttcccagggccat

SEQ ID NO: 286134 - DNA, 25 bp, Homo sapien
gtttcccagggccatgaggccactc

SEQ ID NO: 286135 - DNA, 25 bp, Homo sapien
acgagttgagggacgacttgtgctt

SEQ ID NO: 286136 - DNA, 25 bp, Homo sapien
agttgagggacgacttgtgcttgct

SEQ ID NO: 286137 - DNA, 25 bp, Homo sapien
tgagggacgacttgtgcttgctctc

SEQ ID NO: 286138 - DNA, 25 bp, Homo sapien
gggacgacttgtgcttgctctccgg

SEQ ID NO: 286139 - DNA, 25 bp, Homo sapien
aagaggcgcgagctgaagccggcaa

SEQ ID NO: 286140 - DNA, 25 bp, Homo sapien
tgaagccggcaagccaggccaggaa

SEQ ID NO: 286141 - DNA, 25 bp, Homo sapien
aaggagagaagcgactgccacccag

SEQ ID NO: 286142 - DNA, 25 bp, Homo sapien
cttccccattatttaacagccttag

SEQ ID NO: 286143 - DNA, 25 bp, Homo sapien
gcaaaggtgactcgtgcctcctgcg

SEQ ID NO: 286144 - DNA, 25 bp, Homo sapien
ttttgctttgtcttctaccttacta

SEQ ID NO: 286145 - DNA, 25 bp, Homo sapien
actaggtgccgctttgtttacattt

SEQ ID NO: 286146 - DNA, 25 bp, Homo sapien
agatggcacatttttccacgtgtct

SEQ ID NO: 286147 - DNA, 25 bp, Homo sapien
ttccacgtgtctatttactactcta

SEQ ID NO: 286148 - DNA, 25 bp, Homo sapien
tttactactctaatttcctcgggtg

SEQ ID NO: 286149 - DNA, 25 bp, Homo sapien
tcctcgggtgtgagtgttcttgtca

SEQ ID NO: 286150 - DNA, 25 bp, Homo sapien
ttcagcacacagaatcccgcagatt

SEQ ID NO: 286151 - DNA, 25 bp, Homo sapien
caccgaactcttgccttagaggttt

SEQ ID NO: 286152 - DNA, 25 bp, Homo sapien
catttgcccttgttttctaaggcgc

SEQ ID NO: 286153 - DNA, 25 bp, Homo sapien
tgcctcataaattagccttcgaaag

SEQ ID NO: 286154 - DNA, 25 bp, Homo sapien
gccttcgaaagaaaagtgcacgctc

SEQ ID NO: 286155 - DNA, 25 bp, Homo sapien
agtgcacgctcagacagtgtgtgga

SEQ ID NO: 286156 - DNA, 25 bp, Homo sapien
gtgagcttcctacctgacatgttgg

SEQ ID NO: 286157 - DNA, 25 bp, Homo sapien
tcctacctgacatgttggcagaagt

SEQ ID NO: 286158 - DNA, 25 bp, Homo sapien
gcagaagtagaatattaggatcctc

SEQ ID NO: 286159 - DNA, 25 bp, Homo sapien
attaggatcctcaagcatctctacc

SEQ ID NO: 286160 - DNA, 25 bp, Homo sapien
gcatctctaccgtaagtccaaagaa

SEQ ID NO: 286161 - DNA, 25 bp, Homo sapien
gtccaaagaatttaggtccctattg

SEQ ID NO: 286162 - DNA, 25 bp, Homo sapien
tttaggtccctattgtcactttgtt

SEQ ID NO: 286163 - DNA, 25 bp, Homo sapien
aatgcaattaaatacctcactatta

SEQ ID NO: 286164 - DNA, 25 bp, Homo sapien
gtttacaaatacacccttggctgag

SEQ ID NO: 286165 - DNA, 25 bp, Homo sapien
gtcctgttccctatcattacatgtt

SEQ ID NO: 286166 - DNA, 25 bp, Homo sapien
tatcattacatgttccagggacaca

SEQ ID NO: 286167 - DNA, 25 bp, Homo sapien
acatgttccagggacacacaggcct

SEQ ID NO: 286168 - DNA, 25 bp, Homo sapien
gaagaccttcctaaacagtgacgat

SEQ ID NO: 286169 - DNA, 25 bp, Homo sapien
gtgacgatatcacctcaggcgggac

SEQ ID NO: 286170 - DNA, 25 bp, Homo sapien
acctcaggcgggacccagcagaagc

SEQ ID NO: 286171 - DNA, 25 bp, Homo sapien
atacatgggactatttctgccctcg

SEQ ID NO: 286172 - DNA, 25 bp, Homo sapien
gccctcggaagcgtctgcgcagata

SEQ ID NO: 286173 - DNA, 25 bp, Homo sapien
gcgtctgcgcagatagcatggttag

SEQ ID NO: 286174 - DNA, 25 bp, Homo sapien
agcatggttagcaagtggcaggaac

SEQ ID NO: 286175 - DNA, 25 bp, Homo sapien
gcaccagaagcgggcaccgttgagc

SEQ ID NO: 286176 - DNA, 25 bp, Homo sapien
tttcatgcccgtgggacggacaaga

SEQ ID NO: 286177 - DNA, 25 bp, Homo sapien
atgaaagcacctttacagaagaggc

SEQ ID NO: 286178 - DNA, 25 bp, Homo sapien
ggcaatgcaagttgtattcatcaca

SEQ ID NO: 286179 - DNA, 25 bp, Homo sapien
ttgtattcatcacatgtgtagaatg

SEQ ID NO: 286180 - DNA, 25 bp, Homo sapien
aagatttatgccagttgcaaagaag

SEQ ID NO: 286181 - DNA, 25 bp, Homo sapien
aagaatattggctcactatttttcc

SEQ ID NO: 286182 - DNA, 25 bp, Homo sapien
gggacggacaagaactttatcttca

SEQ ID NO: 286183 - DNA, 25 bp, Homo sapien
aagaactttatcttcagctgaacta

SEQ ID NO: 286184 - DNA, 25 bp, Homo sapien
agtcctgcaacatttttggcgcgca

SEQ ID NO: 286185 - DNA, 25 bp, Homo sapien
tgcaacatttttggcgcgcaatgtg

SEQ ID NO: 286186 - DNA, 25 bp, Homo sapien
gaaattgcagcatgaggataaactc

SEQ ID NO: 286187 - DNA, 25 bp, Homo sapien
tgaggataaactcacctctttgttc

SEQ ID NO: 286188 - DNA, 25 bp, Homo sapien
tcacctctttgttctgaaaatagaa

SEQ ID NO: 286189 - DNA, 25 bp, Homo sapien
tttatcactatgctttccggtggtt

SEQ ID NO: 286190 - DNA, 25 bp, Homo sapien
tcactatgctttccggtggttttcc

SEQ ID NO: 286191 - DNA, 25 bp, Homo sapien
tacaatcgaaatcttgtgcctccca

SEQ ID NO: 286192 - DNA, 25 bp, Homo sapien
cttgtgcctcccaagtgcattggaa

SEQ ID NO: 286193 - DNA, 25 bp, Homo sapien
ttcaaatcttagctcaactctcacc

SEQ ID NO: 286194 - DNA, 25 bp, Homo sapien
gctcaactctcaccaagtgaaaatt

SEQ ID NO: 286195 - DNA, 25 bp, Homo sapien
gtgaaaattggctacttgggagaaa

SEQ ID NO: 286196 - DNA, 25 bp, Homo sapien
agttaactttctatggtgggatggt

SEQ ID NO: 286197 - DNA, 25 bp, Homo sapien
atatatacatggctatatgctgtat

SEQ ID NO: 286198 - DNA, 25 bp, Homo sapien
tatacatggctatatgctgtatatg

SEQ ID NO: 286199 - DNA, 25 bp, Homo sapien
tgctgtatatgtaataaggtttatt

SEQ ID NO: 286200 - DNA, 25 bp, Homo sapien
gtttatttctgtgagttttgtatga

SEQ ID NO: 286201 - DNA, 25 bp, Homo sapien
atttatagttgaatttttgcacaaa

SEQ ID NO: 286202 - DNA, 25 bp, Homo sapien
ttttatggcaatacaactgtgaaat

SEQ ID NO: 286203 - DNA, 25 bp, Homo sapien
actgtgaaataataaggccgatttt

SEQ ID NO: 286204 - DNA, 25 bp, Homo sapien
ataataaggccgattttcatataaa

SEQ ID NO: 286205 - DNA, 25 bp, Homo sapien
atcttgtttttggttacatgatacc

SEQ ID NO: 286206 - DNA, 25 bp, Homo sapien
gtttttggttacatgataccatgga

SEQ ID NO: 286207 - DNA, 25 bp, Homo sapien
ttggttacatgataccatggaaata

SEQ ID NO: 286208 - DNA, 25 bp, Homo sapien
cataaaatctgtacattagggtcaa

SEQ ID NO: 286209 - DNA, 25 bp, Homo sapien
gtaaaagtaacaaattctgccatat

SEQ ID NO: 286210 - DNA, 25 bp, Homo sapien
catattgtaaatttccagtgcaggc

SEQ ID NO: 286211 - DNA, 25 bp, Homo sapien
atattactgcatgggtatgttctag

SEQ ID NO: 286212 - DNA, 25 bp, Homo sapien
gggtatgttctagttcagtttataa

SEQ ID NO: 286213 - DNA, 25 bp, Homo sapien
taaaggcttatttgaggcatacctc

SEQ ID NO: 286214 - DNA, 25 bp, Homo sapien
gaggcatacctcactgttacgcaca

SEQ ID NO: 286215 - DNA, 25 bp, Homo sapien
tcactgttacgcacactggtaattt

SEQ ID NO: 286216 - DNA, 25 bp, Homo sapien
gtaatttaaccatgcccctaagtat

SEQ ID NO: 286217 - DNA, 25 bp, Homo sapien
ttaaccatgcccctaagtattcctt

SEQ ID NO: 286218 - DNA, 25 bp, Homo sapien
tgatgcagcccaacaaagcttttgt

SEQ ID NO: 286219 - DNA, 25 bp, Homo sapien
ataaaacttgcccttcattacatgt

SEQ ID NO: 286220 - DNA, 25 bp, Homo sapien
aacttgcccttcattacatgtttca

SEQ ID NO: 286221 - DNA, 25 bp, Homo sapien
tgcccttcattacatgtttcaaagt

SEQ ID NO: 286222 - DNA, 25 bp, Homo sapien
attacatgtttcaaagtggtgtggt

SEQ ID NO: 286223 - DNA, 25 bp, Homo sapien
ggaactgactgataaagctgtacaa

SEQ ID NO: 286224 - DNA, 25 bp, Homo sapien
gctgtacaaataagcagtgtgccta

SEQ ID NO: 286225 - DNA, 25 bp, Homo sapien
taagcagtgtgcctaacaagcaaca

SEQ ID NO: 286226 - DNA, 25 bp, Homo sapien
gcaacacagtaatgttgacatgctt

SEQ ID NO: 286227 - DNA, 25 bp, Homo sapien
tgttttgctaaaatacactttgaaa

SEQ ID NO: 286228 - DNA, 25 bp, Homo sapien
ctgtattccaagagctgagatctta

SEQ ID NO: 286229 - DNA, 25 bp, Homo sapien
ccaagagctgagatcttagatttta

SEQ ID NO: 286230 - DNA, 25 bp, Homo sapien
agcagctctgtgattagctactgac

SEQ ID NO: 286231 - DNA, 25 bp, Homo sapien
tgattagctactgaccaagaccctc

SEQ ID NO: 286232 - DNA, 25 bp, Homo sapien
gaccctcctatcactggtgtctaat

SEQ ID NO: 286233 - DNA, 25 bp, Homo sapien
ggtgtctaatccctatgttacagat

SEQ ID NO: 286234 - DNA, 25 bp, Homo sapien
cacaggtttagtactttgcccatat

SEQ ID NO: 286235 - DNA, 25 bp, Homo sapien
gataggccataagcccacatttgtc

SEQ ID NO: 286236 - DNA, 25 bp, Homo sapien
tgtcttcagtcaaagctttcactcc

SEQ ID NO: 286237 - DNA, 25 bp, Homo sapien
tgttccactcctgtatacctgaggt

SEQ ID NO: 286238 - DNA, 25 bp, Homo sapien
ctgaggtccccaacataaactttag

SEQ ID NO: 286239 - DNA, 25 bp, Homo sapien
gatcaggcttagtggtcagcattcc

SEQ ID NO: 286240 - DNA, 25 bp, Homo sapien
agtggtcagcattcctagtacttgg

SEQ ID NO: 286241 - DNA, 25 bp, Homo sapien
agggcccttcagtggggagcctcct

SEQ ID NO: 286242 - DNA, 25 bp, Homo sapien
gggcccttcagtggggagcctcctt

SEQ ID NO: 286243 - DNA, 25 bp, Homo sapien
tcagtggggagcctccttcttcttg

SEQ ID NO: 286244 - DNA, 25 bp, Homo sapien
cagtggggagcctccttcttcttgc

SEQ ID NO: 286245 - DNA, 25 bp, Homo sapien
tcttcttgcccttctccttcttgcc

SEQ ID NO: 286246 - DNA, 25 bp, Homo sapien
aggaaggtttaatgagccctgtcca

SEQ ID NO: 286247 - DNA, 25 bp, Homo sapien
ggaaggtttaatgagccctgtccag

SEQ ID NO: 286248 - DNA, 25 bp, Homo sapien
gaaggtttaatgagccctgtccagg

SEQ ID NO: 286249 - DNA, 25 bp, Homo sapien
aaggtttaatgagccctgtccaggg

SEQ ID NO: 286250 - DNA, 25 bp, Homo sapien
aggtttaatgagccctgtccagggc

SEQ ID NO: 286251 - DNA, 25 bp, Homo sapien
ggtttaatgagccctgtccagggcc

SEQ ID NO: 286252 - DNA, 25 bp, Homo sapien
ggaattagcagcattcccgctgaga

SEQ ID NO: 286253 - DNA, 25 bp, Homo sapien
gcattcccgctgagactggatttga

SEQ ID NO: 286254 - DNA, 25 bp, Homo sapien
gttacagttccttagagccactaca

SEQ ID NO: 286255 - DNA, 25 bp, Homo sapien
agccactacagatttctttcctcaa

SEQ ID NO: 286256 - DNA, 25 bp, Homo sapien
gatttctttcctcaatggatacctt

SEQ ID NO: 286257 - DNA, 25 bp, Homo sapien
atacctttagcttaggataaccact

SEQ ID NO: 286258 - DNA, 25 bp, Homo sapien
gactcttgaccatttgggataccca

SEQ ID NO: 286259 - DNA, 25 bp, Homo sapien
gggatacccatttgtcatcttttct

SEQ ID NO: 286260 - DNA, 25 bp, Homo sapien
acccatttgtcatcttttctactaa

SEQ ID NO: 286261 - DNA, 25 bp, Homo sapien
ggaaactaaaatattgctctctcaa

SEQ ID NO: 286262 - DNA, 25 bp, Homo sapien
ttgctctctcaaatactgggtattg

SEQ ID NO: 286263 - DNA, 25 bp, Homo sapien
ccctgagggtcttaagctattctga

SEQ ID NO: 286264 - DNA, 25 bp, Homo sapien
cctgagggtcttaagctattctgag

SEQ ID NO: 286265 - DNA, 25 bp, Homo sapien
tgagggtcttaagctattctgagtc

SEQ ID NO: 286266 - DNA, 25 bp, Homo sapien
gagggtcttaagctattctgagtca

SEQ ID NO: 286267 - DNA, 25 bp, Homo sapien
agggtcttaagctattctgagtcag

SEQ ID NO: 286268 - DNA, 25 bp, Homo sapien
gggtcttaagctattctgagtcaga

SEQ ID NO: 286269 - DNA, 25 bp, Homo sapien
ggtcttaagctattctgagtcagaa

SEQ ID NO: 286270 - DNA, 25 bp, Homo sapien
gtcttaagctattctgagtcagaat

SEQ ID NO: 286271 - DNA, 25 bp, Homo sapien
tctgagtcagaatacagttgaccct

SEQ ID NO: 286272 - DNA, 25 bp, Homo sapien
aaccccttctcatcctcagcctatt

SEQ ID NO: 286273 - DNA, 25 bp, Homo sapien
tctcttccttataatcttaacaaac

SEQ ID NO: 286274 - DNA, 25 bp, Homo sapien
ctcagctgcgcgtcgtcgcgggaca

SEQ ID NO: 286275 - DNA, 25 bp, Homo sapien
ggacacgccgtagcgccggttgttc

SEQ ID NO: 286276 - DNA, 25 bp, Homo sapien
cgtagcgccggttgttctggtagaa

SEQ ID NO: 286277 - DNA, 25 bp, Homo sapien
agcgccggttgttctggtagaagtt

SEQ ID NO: 286278 - DNA, 25 bp, Homo sapien
ggtagaagttggtcagctcgtagta

SEQ ID NO: 286279 - DNA, 25 bp, Homo sapien
ggtcagctcgtagtagaggtacact

SEQ ID NO: 286280 - DNA, 25 bp, Homo sapien
tagtagaggtacactgggccctgga

SEQ ID NO: 286281 - DNA, 25 bp, Homo sapien
aagagctcgggcagcgagaagtacc

SEQ ID NO: 286282 - DNA, 25 bp, Homo sapien
cgagaagtaccaggcgcacgagcag

SEQ ID NO: 286283 - DNA, 25 bp, Homo sapien
cggcgcacaccgagcagttgccggt

SEQ ID NO: 286284 - DNA, 25 bp, Homo sapien
gcactcgttgacagggtggcgcagc

SEQ ID NO: 286285 - DNA, 25 bp, Homo sapien
gaatgggacgctaaaattgcttgca

SEQ ID NO: 286286 - DNA, 25 bp, Homo sapien
aaaattgcttgcagtctccgactgc

SEQ ID NO: 286287 - DNA, 25 bp, Homo sapien
cagtctccgactgcttaaagctggg

SEQ ID NO: 286288 - DNA, 25 bp, Homo sapien
tgggaaggtcgttaccactggttca

SEQ ID NO: 286289 - DNA, 25 bp, Homo sapien
ggttcaaacctattttacagatcag

SEQ ID NO: 286290 - DNA, 25 bp, Homo sapien
agtgattagtgaggcgaccttccca

SEQ ID NO: 286291 - DNA, 25 bp, Homo sapien
ttcccacgatggcacagctcagtag

SEQ ID NO: 286292 - DNA, 25 bp, Homo sapien
gactaggtcgaggttttgtggcttt

SEQ ID NO: 286293 - DNA, 25 bp, Homo sapien
tgttctgcggctgaagttgtgcctt

SEQ ID NO: 286294 - DNA, 25 bp, Homo sapien
aagttgtgccttcgctgcctttcat

SEQ ID NO: 286295 - DNA, 25 bp, Homo sapien
gcctttcatttatccagcatactac

SEQ ID NO: 286296 - DNA, 25 bp, Homo sapien
gatcctaggcccaacaggttaaaag

SEQ ID NO: 286297 - DNA, 25 bp, Homo sapien
ggcccaacaggttaaaaggctggag

SEQ ID NO: 286298 - DNA, 25 bp, Homo sapien
gagggccaacgaggctggaaactca

SEQ ID NO: 286299 - DNA, 25 bp, Homo sapien
aggctggaaactcagaggcggccgg

SEQ ID NO: 286300 - DNA, 25 bp, Homo sapien
gcaaaaaagtgagacatcgaccccc

SEQ ID NO: 286301 - DNA, 25 bp, Homo sapien
gtttgtcgaacgaacgaattcactt

SEQ ID NO: 286302 - DNA, 25 bp, Homo sapien
tgtcgaacgaacgaattcacttctt

SEQ ID NO: 286303 - DNA, 25 bp, Homo sapien
gaacgaacgaattcacttcttagtt

SEQ ID NO: 286304 - DNA, 25 bp, Homo sapien
acgaattcacttcttagttccccat

SEQ ID NO: 286305 - DNA, 25 bp, Homo sapien
cgaattcacttcttagttccccatt

SEQ ID NO: 286306 - DNA, 25 bp, Homo sapien
tttcctgatcctaggcccaacaggt

SEQ ID NO: 286307 - DNA, 25 bp, Homo sapien
aagtccagcgtctaggccagcaggc

SEQ ID NO: 286308 - DNA, 25 bp, Homo sapien
tgcgccgcgtgctggaccagcagca

SEQ ID NO: 286309 - DNA, 25 bp, Homo sapien
gggccgggcggctggtggtactgct

SEQ ID NO: 286310 - DNA, 25 bp, Homo sapien
gggcggctggtggtactgctcaggc

SEQ ID NO: 286311 - DNA, 25 bp, Homo sapien
cctggcctctggcaggatgtccctt

SEQ ID NO: 286312 - DNA, 25 bp, Homo sapien
tggaccagcagcacatcctgcaggt

SEQ ID NO: 286313 - DNA, 25 bp, Homo sapien
tattttgaggaacccccaggccctg

SEQ ID NO: 286314 - DNA, 25 bp, Homo sapien
tgcaggagcgcatgatgagtctgct

SEQ ID NO: 286315 - DNA, 25 bp, Homo sapien
ggagcgcatgatgagtctgctggag

SEQ ID NO: 286316 - DNA, 25 bp, Homo sapien
gagaggatcatcaccaagtccagcg

SEQ ID NO: 286317 - DNA, 25 bp, Homo sapien
atcaccaagtccagcgtctaggcca

SEQ ID NO: 286318 - DNA, 25 bp, Homo sapien
tgctgtcccctttggacagactggc

SEQ ID NO: 286319 - DNA, 25 bp, Homo sapien
tttggacagactggcccatccctga

SEQ ID NO: 286320 - DNA, 25 bp, Homo sapien
atgccatagtctcttttgggcacac

SEQ ID NO: 286321 - DNA, 25 bp, Homo sapien
cctgtcttcaattcctgatggcaac

SEQ ID NO: 286322 - DNA, 25 bp, Homo sapien
attcctgatggcaacaagagagatt

SEQ ID NO: 286323 - DNA, 25 bp, Homo sapien
atagtctcttttgggcacacattat

SEQ ID NO: 286324 - DNA, 25 bp, Homo sapien
caagagagattctctgactgtttcc

SEQ ID NO: 286325 - DNA, 25 bp, Homo sapien
ctctgactgtttccaaggatgtcat

SEQ ID NO: 286326 - DNA, 25 bp, Homo sapien
aaggatgtcattctcagcctcacct

SEQ ID NO: 286327 - DNA, 25 bp, Homo sapien
cagcctcacctccaagtttgatttt

SEQ ID NO: 286328 - DNA, 25 bp, Homo sapien
gtttgattttatagaacaaccaata

SEQ ID NO: 286329 - DNA, 25 bp, Homo sapien
gtatttattgcttctccatgacatg

SEQ ID NO: 286330 - DNA, 25 bp, Homo sapien
gacatggttcttttctcattagttc

SEQ ID NO: 286331 - DNA, 25 bp, Homo sapien
tctcattagttcatgggcaagtcaa

SEQ ID NO: 286332 - DNA, 25 bp, Homo sapien
aagagacctaggtagcagctgagtc

SEQ ID NO: 286333 - DNA, 25 bp, Homo sapien
tagcagctgagtctgtagcctacag

SEQ ID NO: 286334 - DNA, 25 bp, Homo sapien
tctgtagcctacagatggcctgggc

SEQ ID NO: 286335 - DNA, 25 bp, Homo sapien
ttggctcagtcacttcccttagtca

SEQ ID NO: 286336 - DNA, 25 bp, Homo sapien
gtcacttccacacattccagaaatt

SEQ ID NO: 286337 - DNA, 25 bp, Homo sapien
tggcttgtcttaggctctgcaaaca

SEQ ID NO: 286338 - DNA, 25 bp, Homo sapien
ggctctgcaaacatagcacagtgac

SEQ ID NO: 286339 - DNA, 25 bp, Homo sapien
cagttgttgaagtgtagcagcagct

SEQ ID NO: 286340 - DNA, 25 bp, Homo sapien
aaacatccgctgaggaagacacagg

SEQ ID NO: 286341 - DNA, 25 bp, Homo sapien
gaagacacagggagttggaaatgat

SEQ ID NO: 286342 - DNA, 25 bp, Homo sapien
ggaaatgatggacccccttgtatga

SEQ ID NO: 286343 - DNA, 25 bp, Homo sapien
aacagttactggctctactaaaatt

SEQ ID NO: 286344 - DNA, 25 bp, Homo sapien
aaatgttgagttgagcaagctatac

SEQ ID NO: 286345 - DNA, 25 bp, Homo sapien
gagcaagctatacactacttaagga

SEQ ID NO: 286346 - DNA, 25 bp, Homo sapien
tagaagaagagggagttacagcaaa

SEQ ID NO: 286347 - DNA, 25 bp, Homo sapien
aaccgtcaagaaaaagcctcatcca

SEQ ID NO: 286348 - DNA, 25 bp, Homo sapien
agcctcatccacattacttattagc

SEQ ID NO: 286349 - DNA, 25 bp, Homo sapien
tacttattagctttgttccttagaa

SEQ ID NO: 286350 - DNA, 25 bp, Homo sapien
tattagctttgttccttagaacttg

SEQ ID NO: 286351 - DNA, 25 bp, Homo sapien
tgtgcatccccatctgttacatgca

SEQ ID NO: 286352 - DNA, 25 bp, Homo sapien
atctgttacatgcacagccaacaaa

SEQ ID NO: 286353 - DNA, 25 bp, Homo sapien
attttgaagctgtgtgtgggagaca

SEQ ID NO: 286354 - DNA, 25 bp, Homo sapien
ctgtgtgtgggagacagtcacagat

SEQ ID NO: 286355 - DNA, 25 bp, Homo sapien
agtacagtttcctcacttaatgctt

SEQ ID NO: 286356 - DNA, 25 bp, Homo sapien
tacagtttcctcacttaatgcttct

SEQ ID NO: 286357 - DNA, 25 bp, Homo sapien
acttaatgcttctgttccagcataa

SEQ ID NO: 286358 - DNA, 25 bp, Homo sapien
ggatgaatttcctggctggatacta

SEQ ID NO: 286359 - DNA, 25 bp, Homo sapien
atttcctggctggatactatcctag

SEQ ID NO: 286360 - DNA, 25 bp, Homo sapien
ggatactatcctagaattttccgta

SEQ ID NO: 286361 - DNA, 25 bp, Homo sapien
gggtattttgagttctgtgcatccc

SEQ ID NO: 286362 - DNA, 25 bp, Homo sapien
tctgtttctttcatgctctcctgtt

SEQ ID NO: 286363 - DNA, 25 bp, Homo sapien
ctgtttctttcatgctctcctgttt

SEQ ID NO: 286364 - DNA, 25 bp, Homo sapien
tgtttctttcatgctctcctgtttg

SEQ ID NO: 286365 - DNA, 25 bp, Homo sapien
gtttctttcatgctctcctgtttgc

SEQ ID NO: 286366 - DNA, 25 bp, Homo sapien
tttctttcatgctctcctgtttgct

SEQ ID NO: 286367 - DNA, 25 bp, Homo sapien
ttctttcatgctctcctgtttgctc

SEQ ID NO: 286368 - DNA, 25 bp, Homo sapien
tctttcatgctctcctgtttgctct

SEQ ID NO: 286369 - DNA, 25 bp, Homo sapien
ctttcatgctctcctgtttgctctg

SEQ ID NO: 286370 - DNA, 25 bp, Homo sapien
tttcatgctctcctgtttgctctgc

SEQ ID NO: 286371 - DNA, 25 bp, Homo sapien
ttcatgctctcctgtttgctctgcc

SEQ ID NO: 286372 - DNA, 25 bp, Homo sapien
tctcctgtttgctctgcctccaaaa

SEQ ID NO: 286373 - DNA, 25 bp, Homo sapien
aaacctttagctcactaactttatg

SEQ ID NO: 286374 - DNA, 25 bp, Homo sapien
acctttagctcactaactttatggg

SEQ ID NO: 286375 - DNA, 25 bp, Homo sapien
ttagctcactaactttatgggtttc

SEQ ID NO: 286376 - DNA, 25 bp, Homo sapien
agctcactaactttatgggtttctg

SEQ ID NO: 286377 - DNA, 25 bp, Homo sapien
gctcactaactttatgggtttctga

SEQ ID NO: 286378 - DNA, 25 bp, Homo sapien
tcactaactttatgggtttctgaag

SEQ ID NO: 286379 - DNA, 25 bp, Homo sapien
ctaactttatgggtttctgaagtga

SEQ ID NO: 286380 - DNA, 25 bp, Homo sapien
ctttatgggtttctgaagtgatgga

SEQ ID NO: 286381 - DNA, 25 bp, Homo sapien
gggtttctgaagtgatggaaatttt

SEQ ID NO: 286382 - DNA, 25 bp, Homo sapien
gcataaacttactaataattacttc

SEQ ID NO: 286383 - DNA, 25 bp, Homo sapien
gtactgaagcatatagggatgttaa

SEQ ID NO: 286384 - DNA, 25 bp, Homo sapien
agggaccacctcaccgggcaaatgg

SEQ ID NO: 286385 - DNA, 25 bp, Homo sapien
aggcaccacctggacactttcttgt

SEQ ID NO: 286386 - DNA, 25 bp, Homo sapien
gcaccacctggacactttcttgttg

SEQ ID NO: 286387 - DNA, 25 bp, Homo sapien
acactttcttgttgaatcctcccaa

SEQ ID NO: 286388 - DNA, 25 bp, Homo sapien
tttcttgttgaatcctcccaacacc

SEQ ID NO: 286389 - DNA, 25 bp, Homo sapien
gtcatccccactccttgtgtgcaca

SEQ ID NO: 286390 - DNA, 25 bp, Homo sapien
catgcagaggtgagacccgcaggct

SEQ ID NO: 286391 - DNA, 25 bp, Homo sapien
ggtgagacccgcaggctcccaggac

SEQ ID NO: 286392 - DNA, 25 bp, Homo sapien
ggcagggctggagccgggtcctcag

SEQ ID NO: 286393 - DNA, 25 bp, Homo sapien
ctggacccgcgtgcgttacgtcagg

SEQ ID NO: 286394 - DNA, 25 bp, Homo sapien
cgcgtgcgttacgtcaggcccagat

SEQ ID NO: 286395 - DNA, 25 bp, Homo sapien
gccccacctatgtctggacctttaa

SEQ ID NO: 286396 - DNA, 25 bp, Homo sapien
cctatgtctggacctttaacttgaa

SEQ ID NO: 286397 - DNA, 25 bp, Homo sapien
agaccaaagagaaggcagcgaagtg

SEQ ID NO: 286398 - DNA, 25 bp, Homo sapien
ggcagcgaagtggatcctggcagcc

SEQ ID NO: 286399 - DNA, 25 bp, Homo sapien
gcgctgctcctacaggtttagctcg

SEQ ID NO: 286400 - DNA, 25 bp, Homo sapien
acaggtttagctcgctcctgcctca

SEQ ID NO: 286401 - DNA, 25 bp, Homo sapien
ttcacctgtgcacctgtgacttatt

SEQ ID NO: 286402 - DNA, 25 bp, Homo sapien
tgtgcacctgtgacttattctttac

SEQ ID NO: 286403 - DNA, 25 bp, Homo sapien
gacttattctttacaggaactggtg

SEQ ID NO: 286404 - DNA, 25 bp, Homo sapien
atcaggtgctttgtaaccaagcaca

SEQ ID NO: 286405 - DNA, 25 bp, Homo sapien
gtaaccaagcacatcggaaccagag

SEQ ID NO: 286406 - DNA, 25 bp, Homo sapien
caaacagcccactgtgagccatggt

SEQ ID NO: 286407 - DNA, 25 bp, Homo sapien
aacagcccactgtgagccatggtga

SEQ ID NO: 286408 - DNA, 25 bp, Homo sapien
acagcccactgtgagccatggtgac

SEQ ID NO: 286409 - DNA, 25 bp, Homo sapien
actgtgagccatggtgaccccaaat

SEQ ID NO: 286410 - DNA, 25 bp, Homo sapien
tgtgagccatggtgaccccaaatct

SEQ ID NO: 286411 - DNA, 25 bp, Homo sapien
gagccatggtgaccccaaatctcca

SEQ ID NO: 286412 - DNA, 25 bp, Homo sapien
ggccggctcagtgcaggtattctcg

SEQ ID NO: 286413 - DNA, 25 bp, Homo sapien
ggctcagtgcaggtattctcgcaca

SEQ ID NO: 286414 - DNA, 25 bp, Homo sapien
ctcagtgcaggtattctcgcacagt

SEQ ID NO: 286415 - DNA, 25 bp, Homo sapien
tgcaggtattctcgcacagtgagct

SEQ ID NO: 286416 - DNA, 25 bp, Homo sapien
caggtattctcgcacagtgagctcc

SEQ ID NO: 286417 - DNA, 25 bp, Homo sapien
actttcaaaatcctgacaatcctca

SEQ ID NO: 286418 - DNA, 25 bp, Homo sapien
ctctctggatcaagctcggaacaac

SEQ ID NO: 286419 - DNA, 25 bp, Homo sapien
acaatcctcaggtatgatgccaatt

SEQ ID NO: 286420 - DNA, 25 bp, Homo sapien
gatgccaattattaatgtttccttt

SEQ ID NO: 286421 - DNA, 25 bp, Homo sapien
ttccttttttcacaggcacgtacaa

SEQ ID NO: 286422 - DNA, 25 bp, Homo sapien
ggcacgtacaattcagaggactttc

SEQ ID NO: 286423 - DNA, 25 bp, Homo sapien
cagaggactttcgaaattatctaaa

SEQ ID NO: 286424 - DNA, 25 bp, Homo sapien
actgccagccttgtctgtgagaaaa

SEQ ID NO: 286425 - DNA, 25 bp, Homo sapien
aagtacatatctatgtctgcacaga

SEQ ID NO: 286426 - DNA, 25 bp, Homo sapien
acaacaaacagctcttgaactcgcc

SEQ ID NO: 286427 - DNA, 25 bp, Homo sapien
gcctcccagcctaaaaagactgcag

SEQ ID NO: 286428 - DNA, 25 bp, Homo sapien
tctctttccatgtttcaattctcct

SEQ ID NO: 286429 - DNA, 25 bp, Homo sapien
tctccttttctctgtatagtggtaa

SEQ ID NO: 286430 - DNA, 25 bp, Homo sapien
gtggtaaagctaggctgacattctt

SEQ ID NO: 286431 - DNA, 25 bp, Homo sapien
ctgacattcttatagctagcagcta

SEQ ID NO: 286432 - DNA, 25 bp, Homo sapien
gctagcagctaaagagcatcctctc

SEQ ID NO: 286433 - DNA, 25 bp, Homo sapien
agcccgtatttatcccttcttatca

SEQ ID NO: 286434 - DNA, 25 bp, Homo sapien
tatcccttcttatcaagcatttttg

SEQ ID NO: 286435 - DNA, 25 bp, Homo sapien
aagcatttttgatcttcccctcttc

SEQ ID NO: 286436 - DNA, 25 bp, Homo sapien
gatttattggcccatgtaactggga

SEQ ID NO: 286437 - DNA, 25 bp, Homo sapien
gaaagccaaattgtgacactggttt

SEQ ID NO: 286438 - DNA, 25 bp, Homo sapien
cactggttttaggaatggctggatc

SEQ ID NO: 286439 - DNA, 25 bp, Homo sapien
ctcctctgcctgagaagggctcaga

SEQ ID NO: 286440 - DNA, 25 bp, Homo sapien
tcctctgcctgagaagggctcagaa

SEQ ID NO: 286441 - DNA, 25 bp, Homo sapien
cctctgcctgagaagggctcagaac

SEQ ID NO: 286442 - DNA, 25 bp, Homo sapien
tctgcctgagaagggctcagaacaa

SEQ ID NO: 286443 - DNA, 25 bp, Homo sapien
gagaagggctcagaacaaagtaaaa

SEQ ID NO: 286444 - DNA, 25 bp, Homo sapien
caccttcttcccaaaggcacgtgta

SEQ ID NO: 286445 - DNA, 25 bp, Homo sapien
tcttcccaaaggcacgtgtacctgc

SEQ ID NO: 286446 - DNA, 25 bp, Homo sapien
ttcccaaaggcacgtgtacctgcct

SEQ ID NO: 286447 - DNA, 25 bp, Homo sapien
cccaaaggcacgtgtacctgcctga

SEQ ID NO: 286448 - DNA, 25 bp, Homo sapien
aaaggcacgtgtacctgcctgacct

SEQ ID NO: 286449 - DNA, 25 bp, Homo sapien
aaggcacgtgtacctgcctgacctc

SEQ ID NO: 286450 - DNA, 25 bp, Homo sapien
ggagctccctcaagtgttcacatgt

SEQ ID NO: 286451 - DNA, 25 bp, Homo sapien
gaatgaggaacacccatctccttgg

SEQ ID NO: 286452 - DNA, 25 bp, Homo sapien
tccaccctgaagagttagttattaa

SEQ ID NO: 286453 - DNA, 25 bp, Homo sapien
attaaaataattggcaagctcttgc

SEQ ID NO: 286454 - DNA, 25 bp, Homo sapien
tcagtcatccattgttcagaatgga

SEQ ID NO: 286455 - DNA, 25 bp, Homo sapien
tagcaataatacatccctggctgcc

SEQ ID NO: 286456 - DNA, 25 bp, Homo sapien
tgggcttggccaggattactcactg

SEQ ID NO: 286457 - DNA, 25 bp, Homo sapien
gattactcactgaaggcctcagggt

SEQ ID NO: 286458 - DNA, 25 bp, Homo sapien
gaaggcctcagggttactggcacac

SEQ ID NO: 286459 - DNA, 25 bp, Homo sapien
agggttactggcacacactttcttt

SEQ ID NO: 286460 - DNA, 25 bp, Homo sapien
ctggcacacactttcttttcctaat

SEQ ID NO: 286461 - DNA, 25 bp, Homo sapien
gtacatttttggcagcatcagcacc

SEQ ID NO: 286462 - DNA, 25 bp, Homo sapien
tatgtggccagtgggatcaccgtcg

SEQ ID NO: 286463 - DNA, 25 bp, Homo sapien
ggatcaccgtcgactgggcctatga

SEQ ID NO: 286464 - DNA, 25 bp, Homo sapien
gactgggcctatgacagtggcatca

SEQ ID NO: 286465 - DNA, 25 bp, Homo sapien
atgacagtggcatcaagtacgcctt

SEQ ID NO: 286466 - DNA, 25 bp, Homo sapien
aagtacgccttcagctttgagctcc

SEQ ID NO: 286467 - DNA, 25 bp, Homo sapien
gccttcagctttgagctccgggaca

SEQ ID NO: 286468 - DNA, 25 bp, Homo sapien
tttcaccccgccaatgatcatcttg

SEQ ID NO: 286469 - DNA, 25 bp, Homo sapien
caggagacgtggatggcgcttcgga

SEQ ID NO: 286470 - DNA, 25 bp, Homo sapien
atcatcttgcagtacgatcttgcca

SEQ ID NO: 286471 - DNA, 25 bp, Homo sapien
acgatcttgccaaggatgcggtgga

SEQ ID NO: 286472 - DNA, 25 bp, Homo sapien
gggaaatcccttttcctgcctgcct

SEQ ID NO: 286473 - DNA, 25 bp, Homo sapien
gcctgtgacctgtgtacgtattaca

SEQ ID NO: 286474 - DNA, 25 bp, Homo sapien
gtacgtattacaggctttaggacca

SEQ ID NO: 286475 - DNA, 25 bp, Homo sapien
acaggctttaggaccagctgattgt

SEQ ID NO: 286476 - DNA, 25 bp, Homo sapien
ggaccagctgattgttatgcttgca

SEQ ID NO: 286477 - DNA, 25 bp, Homo sapien
tatgcttgcaggatggttttgaaac

SEQ ID NO: 286478 - DNA, 25 bp, Homo sapien
aatacttgtttactgtaggaatcct

SEQ ID NO: 286479 - DNA, 25 bp, Homo sapien
aatgctgtgaaaagatttattcctt

SEQ ID NO: 286480 - DNA, 25 bp, Homo sapien
aggcatatatgcttctaggttagga

SEQ ID NO: 286481 - DNA, 25 bp, Homo sapien
taggttaggattgtcctgactcact

SEQ ID NO: 286482 - DNA, 25 bp, Homo sapien
ggattgtcctgactcactaaagatg

SEQ ID NO: 286483 - DNA, 25 bp, Homo sapien
aaaatttaaacatcgtatgcgcata

SEQ ID NO: 286484 - DNA, 25 bp, Homo sapien
atttaaacatcgtatgcgcataaag

SEQ ID NO: 286485 - DNA, 25 bp, Homo sapien
taaacatcgtatgcgcataaagaaa

SEQ ID NO: 286486 - DNA, 25 bp, Homo sapien
acatcgtatgcgcataaagaaaaag

SEQ ID NO: 286487 - DNA, 25 bp, Homo sapien
tcctgtgtctatgtatctatatctg

SEQ ID NO: 286488 - DNA, 25 bp, Homo sapien
tggttccaaaccagatttcctgtga

SEQ ID NO: 286489 - DNA, 25 bp, Homo sapien
agatttcctgtgattctatactaat

SEQ ID NO: 286490 - DNA, 25 bp, Homo sapien
tttttgatataaccctttgcttctt

SEQ ID NO: 286491 - DNA, 25 bp, Homo sapien
ctttgcttcttataatgagtgcgat

SEQ ID NO: 286492 - DNA, 25 bp, Homo sapien
atatatgttgtcgaggctgttcttc

SEQ ID NO: 286493 - DNA, 25 bp, Homo sapien
ttgtcgaggctgttcttcaagaatt

SEQ ID NO: 286494 - DNA, 25 bp, Homo sapien
tgacacacacgtctgctcactgctt

SEQ ID NO: 286495 - DNA, 25 bp, Homo sapien
gacacacacgtctgctcactgcttg

SEQ ID NO: 286496 - DNA, 25 bp, Homo sapien
acacgtctgctcactgcttgctctt

SEQ ID NO: 286497 - DNA, 25 bp, Homo sapien
acgtctgctcactgcttgctctttg

SEQ ID NO: 286498 - DNA, 25 bp, Homo sapien
gtctgctcactgcttgctctttgca

SEQ ID NO: 286499 - DNA, 25 bp, Homo sapien
tgctcactgcttgctctttgcacag

SEQ ID NO: 286500 - DNA, 25 bp, Homo sapien
gctcactgcttgctctttgcacagg

SEQ ID NO: 286501 - DNA, 25 bp, Homo sapien
ctcactgcttgctctttgcacaggc

SEQ ID NO: 286502 - DNA, 25 bp, Homo sapien
tcactgcttgctctttgcacaggcc

SEQ ID NO: 286503 - DNA, 25 bp, Homo sapien
ttgctctttgcacaggcccctggat

SEQ ID NO: 286504 - DNA, 25 bp, Homo sapien
tgctctttgcacaggcccctggatc

SEQ ID NO: 286505 - DNA, 25 bp, Homo sapien
aaaatatttagctttgcagttcctg

SEQ ID NO: 286506 - DNA, 25 bp, Homo sapien
agctttgcagttcctgaccccttaa

SEQ ID NO: 286507 - DNA, 25 bp, Homo sapien
ttggttcattacaggtaagttgtac

SEQ ID NO: 286508 - DNA, 25 bp, Homo sapien
ggtaagttgtacagttctttgccta

SEQ ID NO: 286509 - DNA, 25 bp, Homo sapien
taagttgtacagttctttgcctact

SEQ ID NO: 286510 - DNA, 25 bp, Homo sapien
agttgtacagttctttgcctactga

SEQ ID NO: 286511 - DNA, 25 bp, Homo sapien
acagttctttgcctactgatgaaat

SEQ ID NO: 286512 - DNA, 25 bp, Homo sapien
ataataagtttgtaatgtcagaggg

SEQ ID NO: 286513 - DNA, 25 bp, Homo sapien
gggctaacacaaggaattaatattt

SEQ ID NO: 286514 - DNA, 25 bp, Homo sapien
gagggaatgccaagagcaaagacat

SEQ ID NO: 286515 - DNA, 25 bp, Homo sapien
gagcaaagacatagagagttaatta

SEQ ID NO: 286516 - DNA, 25 bp, Homo sapien
agcaccatcgtctcctgggtcttgt

SEQ ID NO: 286517 - DNA, 25 bp, Homo sapien
tcttccttggttgcggtgttgtcag

SEQ ID NO: 286518 - DNA, 25 bp, Homo sapien
tgtcagggccagaattgggcaattc

SEQ ID NO: 286519 - DNA, 25 bp, Homo sapien
gggcaattccgggtgacatccaggt

SEQ ID NO: 286520 - DNA, 25 bp, Homo sapien
acatccaggtgtggctgctgacacg

SEQ ID NO: 286521 - DNA, 25 bp, Homo sapien
acacggagcacaggtgaggttcact

SEQ ID NO: 286522 - DNA, 25 bp, Homo sapien
atggccttgggcttctagttcagag

SEQ ID NO: 286523 - DNA, 25 bp, Homo sapien
gggcttctagttcagagcacaccat

SEQ ID NO: 286524 - DNA, 25 bp, Homo sapien
gcacaccatccactcagcatgtgaa

SEQ ID NO: 286525 - DNA, 25 bp, Homo sapien
agctcccaaagcgtatgtgtgcatg

SEQ ID NO: 286526 - DNA, 25 bp, Homo sapien
gtacctgtgcacattgcgcatgtct

SEQ ID NO: 286527 - DNA, 25 bp, Homo sapien
ttagtgaacaggcagttacagcaaa

SEQ ID NO: 286528 - DNA, 25 bp, Homo sapien
ataaaaattgaatagctggctctgg

SEQ ID NO: 286529 - DNA, 25 bp, Homo sapien
gactttagagtcaaactggcctgga

SEQ ID NO: 286530 - DNA, 25 bp, Homo sapien
tggatttgaatcctgatcctcattg

SEQ ID NO: 286531 - DNA, 25 bp, Homo sapien
ctgatcctcattgcttgtagctgta

SEQ ID NO: 286532 - DNA, 25 bp, Homo sapien
ttgcttgtagctgtatgatctggac

SEQ ID NO: 286533 - DNA, 25 bp, Homo sapien
gacagtaactgtttctaaccttgat

SEQ ID NO: 286534 - DNA, 25 bp, Homo sapien
gatgccaattgtaactcctaaggat

SEQ ID NO: 286535 - DNA, 25 bp, Homo sapien
taaaatgcgtgtacagttcctgacc

SEQ ID NO: 286536 - DNA, 25 bp, Homo sapien
gtacagttcctgaccagtggtttgt

SEQ ID NO: 286537 - DNA, 25 bp, Homo sapien
tgaccagtggtttgtgcctaataac

SEQ ID NO: 286538 - DNA, 25 bp, Homo sapien
aacaagcgggagtcacagatacatt

SEQ ID NO: 286539 - DNA, 25 bp, Homo sapien
cttagtagctttgtgagtcctgttg

SEQ ID NO: 286540 - DNA, 25 bp, Homo sapien
agtcctgttgtaatgctttcagaca

SEQ ID NO: 286541 - DNA, 25 bp, Homo sapien
acattttttaccgattagattcctg

SEQ ID NO: 286542 - DNA, 25 bp, Homo sapien
accgattagattcctgatcatttag

SEQ ID NO: 286543 - DNA, 25 bp, Homo sapien
gaacacttgcaactgtgaggtgaat

SEQ ID NO: 286544 - DNA, 25 bp, Homo sapien
gaataaagtctgtactggctcccgg

SEQ ID NO: 286545 - DNA, 25 bp, Homo sapien
tggctcccggttgcaacatatagta

SEQ ID NO: 286546 - DNA, 25 bp, Homo sapien
aacgcagtgtgctactttatattga

SEQ ID NO: 286547 - DNA, 25 bp, Homo sapien
gagatgtcttggactcacccagtaa

SEQ ID NO: 286548 - DNA, 25 bp, Homo sapien
tcacccagtaactcagggctgtgga

SEQ ID NO: 286549 - DNA, 25 bp, Homo sapien
ccagtctttctacagtgacaggcca

SEQ ID NO: 286550 - DNA, 25 bp, Homo sapien
gtgacaggccacactgcatgaatgg

SEQ ID NO: 286551 - DNA, 25 bp, Homo sapien
tgaatccattgtcctctgcctattt

SEQ ID NO: 286552 - DNA, 25 bp, Homo sapien
attgtcctctgcctattttcctgtg

SEQ ID NO: 286553 - DNA, 25 bp, Homo sapien
attttcctgtgcacagtcacattcc

SEQ ID NO: 286554 - DNA, 25 bp, Homo sapien
gtcacattccctccttaggaatctt

SEQ ID NO: 286555 - DNA, 25 bp, Homo sapien
acaagggaacactgaatctttcaag

SEQ ID NO: 286556 - DNA, 25 bp, Homo sapien
atctttcaagggaattacacgtttg

SEQ ID NO: 286557 - DNA, 25 bp, Homo sapien
cacgtttgggttaatgtttcagtat

SEQ ID NO: 286558 - DNA, 25 bp, Homo sapien
gagagatttactgctatcccaggat

SEQ ID NO: 286559 - DNA, 25 bp, Homo sapien
gctatcccaggatgttcggacttgg

SEQ ID NO: 286560 - DNA, 25 bp, Homo sapien
tattacataaggaagggcctactgc

SEQ ID NO: 286561 - DNA, 25 bp, Homo sapien
taaggaagggcctactgcagagcag

SEQ ID NO: 286562 - DNA, 25 bp, Homo sapien
tggtcactaaggaatgacacacatc

SEQ ID NO: 286563 - DNA, 25 bp, Homo sapien
gggttaaggagcaaggaattcagta

SEQ ID NO: 286564 - DNA, 25 bp, Homo sapien
agcaaggaattcagtaggaggcagc

SEQ ID NO: 286565 - DNA, 25 bp, Homo sapien
ggcagcagcagactagctcttaaag

SEQ ID NO: 286566 - DNA, 25 bp, Homo sapien
gactagctcttaaagcttttgaggg

SEQ ID NO: 286567 - DNA, 25 bp, Homo sapien
gcttttgagggaatggctaattaaa

SEQ ID NO: 286568 - DNA, 25 bp, Homo sapien
aacaggaaggtaagacagcattgct

SEQ ID NO: 286569 - DNA, 25 bp, Homo sapien
gcattgctgggccaaaagtcataag

SEQ ID NO: 286570 - DNA, 25 bp, Homo sapien
gctgggccaaaagtcataagagagt

SEQ ID NO: 286571 - DNA, 25 bp, Homo sapien
agatcttaatgctggcgacatgcct

SEQ ID NO: 286572 - DNA, 25 bp, Homo sapien
taatgctggcgacatgcctccatca

SEQ ID NO: 286573 - DNA, 25 bp, Homo sapien
cacttcctgcctgaggtgtggaggc

SEQ ID NO: 286574 - DNA, 25 bp, Homo sapien
gatggataagagttgggtcccataa

SEQ ID NO: 286575 - DNA, 25 bp, Homo sapien
aggtggcactgagaagactgagtta

SEQ ID NO: 286576 - DNA, 25 bp, Homo sapien
ctcccccagcaagggtatcttgaat

SEQ ID NO: 286577 - DNA, 25 bp, Homo sapien
gcagggagaaaccaggaagccacta

SEQ ID NO: 286578 - DNA, 25 bp, Homo sapien
gagaaaccaggaagccactaataat

SEQ ID NO: 286579 - DNA, 25 bp, Homo sapien
ccactaataatatcaagaggccggg

SEQ ID NO: 286580 - DNA, 25 bp, Homo sapien
gcgtgcatctgtgctggagatctta

SEQ ID NO: 286581 - DNA, 25 bp, Homo sapien
gctggagatcttaatgctggcgaca

SEQ ID NO: 286582 - DNA, 25 bp, Homo sapien
gctgatggaggttccctgcctaggt

SEQ ID NO: 286583 - DNA, 25 bp, Homo sapien
tggaggttccctgcctaggttctgc

SEQ ID NO: 286584 - DNA, 25 bp, Homo sapien
taggttctgcctgcatctgttttct

SEQ ID NO: 286585 - DNA, 25 bp, Homo sapien
aaatatgaggccagagttaggtgtg

SEQ ID NO: 286586 - DNA, 25 bp, Homo sapien
gctgtagtgcactaggatcacgcct

SEQ ID NO: 286587 - DNA, 25 bp, Homo sapien
gcactaggatcacgcctatgaacag

SEQ ID NO: 286588 - DNA, 25 bp, Homo sapien
agatgggatctagggtccaagcttc

SEQ ID NO: 286589 - DNA, 25 bp, Homo sapien
gatctagggtccaagcttcaacagc

SEQ ID NO: 286590 - DNA, 25 bp, Homo sapien
ttcaacagcagcagggacaatttgt

SEQ ID NO: 286591 - DNA, 25 bp, Homo sapien
tttgtgcataacaagaaccaggcgc

SEQ ID NO: 286592 - DNA, 25 bp, Homo sapien
aaccaggcgcacatacaggtaggca

SEQ ID NO: 286593 - DNA, 25 bp, Homo sapien
acagacaaaccatgtcaccgcctaa

SEQ ID NO: 286594 - DNA, 25 bp, Homo sapien
agacaaaccatgtcaccgcctaaaa

SEQ ID NO: 286595 - DNA, 25 bp, Homo sapien
gacaaaccatgtcaccgcctaaaac

SEQ ID NO: 286596 - DNA, 25 bp, Homo sapien
atgtcaccgcctaaaaccaactcaa

SEQ ID NO: 286597 - DNA, 25 bp, Homo sapien
tgtcaccgcctaaaaccaactcaat

SEQ ID NO: 286598 - DNA, 25 bp, Homo sapien
aaaccaactcaatagtctaaggaat

SEQ ID NO: 286599 - DNA, 25 bp, Homo sapien
ccaactcaatagtctaaggaatttg

SEQ ID NO: 286600 - DNA, 25 bp, Homo sapien
gggagaatctggagaggatttaatt

SEQ ID NO: 286601 - DNA, 25 bp, Homo sapien
gagaggatttaattaatttggcaaa

SEQ ID NO: 286602 - DNA, 25 bp, Homo sapien
tttggcaaaaggattagcaattgaa

SEQ ID NO: 286603 - DNA, 25 bp, Homo sapien
gagaaaagagaattcttggaggaaa

SEQ ID NO: 286604 - DNA, 25 bp, Homo sapien
acaggcggacctgagaggcaactca

SEQ ID NO: 286605 - DNA, 25 bp, Homo sapien
ggacctgagaggcaactcaccgact

SEQ ID NO: 286606 - DNA, 25 bp, Homo sapien
tgagaggcaactcaccgactcctgc

SEQ ID NO: 286607 - DNA, 25 bp, Homo sapien
tgggagcctcggaacctagggctca

SEQ ID NO: 286608 - DNA, 25 bp, Homo sapien
gcctcggaacctagggctcaggaga

SEQ ID NO: 286609 - DNA, 25 bp, Homo sapien
gggctcaggagatgaaccaggactt

SEQ ID NO: 286610 - DNA, 25 bp, Homo sapien
tgaaccaggacttatccgaaggtac

SEQ ID NO: 286611 - DNA, 25 bp, Homo sapien
ttatccgaaggtaccaagtgaactt

SEQ ID NO: 286612 - DNA, 25 bp, Homo sapien
cacgctctgggtcagagttccttta

SEQ ID NO: 286613 - DNA, 25 bp, Homo sapien
tctgggtcagagttcctttacaggc

SEQ ID NO: 286614 - DNA, 25 bp, Homo sapien
tcagagttcctttacaggcggacct

SEQ ID NO: 286615 - DNA, 25 bp, Homo sapien
accgatgtccatctatatcacctgg

SEQ ID NO: 286616 - DNA, 25 bp, Homo sapien
gatgtccatctatatcacctggatc

SEQ ID NO: 286617 - DNA, 25 bp, Homo sapien
atctatatcacctggatcaccaacc

SEQ ID NO: 286618 - DNA, 25 bp, Homo sapien
acatctcccactgcttgaaggaggc

SEQ ID NO: 286619 - DNA, 25 bp, Homo sapien
atctcccactgcttgaaggaggcag

SEQ ID NO: 286620 - DNA, 25 bp, Homo sapien
gcgggacatcctggatctccaaggg

SEQ ID NO: 286621 - DNA, 25 bp, Homo sapien
tcctggatctccaagggcagcatca

SEQ ID NO: 286622 - DNA, 25 bp, Homo sapien
ctccaagggcagcatcacaagatga

SEQ ID NO: 286623 - DNA, 25 bp, Homo sapien
caagatgagccattaagtccagccc

SEQ ID NO: 286624 - DNA, 25 bp, Homo sapien
ggagaggaagtaagcatcacctcag

SEQ ID NO: 286625 - DNA, 25 bp, Homo sapien
atcacctcaggcacagaagaacaga

SEQ ID NO: 286626 - DNA, 25 bp, Homo sapien
acgtgcgagctctgctagcgcaggc

SEQ ID NO: 286627 - DNA, 25 bp, Homo sapien
tgcgagctctgctagcgcaggccag

SEQ ID NO: 286628 - DNA, 25 bp, Homo sapien
tctgctagcgcaggccagggtcatg

SEQ ID NO: 286629 - DNA, 25 bp, Homo sapien
caggccagggtcatggatgcctctg

SEQ ID NO: 286630 - DNA, 25 bp, Homo sapien
ctgcctttgagatcttcagcacatt

SEQ ID NO: 286631 - DNA, 25 bp, Homo sapien
gcctttgagatcttcagcacattcc

SEQ ID NO: 286632 - DNA, 25 bp, Homo sapien
tttgagatcttcagcacattcccgc

SEQ ID NO: 286633 - DNA, 25 bp, Homo sapien
tctaccaggacgatacactcacgct

SEQ ID NO: 286634 - DNA, 25 bp, Homo sapien
taccaggacgatacactcacgctgc

SEQ ID NO: 286635 - DNA, 25 bp, Homo sapien
aggacgatacactcacgctgcaggc

SEQ ID NO: 286636 - DNA, 25 bp, Homo sapien
ggacgatacactcacgctgcaggct

SEQ ID NO: 286637 - DNA, 25 bp, Homo sapien
gatttcacaaagtcggcagagttct

SEQ ID NO: 286638 - DNA, 25 bp, Homo sapien
gagttctgcgggaaatcccctggaa

SEQ ID NO: 286639 - DNA, 25 bp, Homo sapien
aagagagtgcagatcccgtcactgg

SEQ ID NO: 286640 - DNA, 25 bp, Homo sapien
gatcccgtcactggaagttcggaaa

SEQ ID NO: 286641 - DNA, 25 bp, Homo sapien
gaaaatgcagtgtcatcttcagaac

SEQ ID NO: 286642 - DNA, 25 bp, Homo sapien
tcttcagaactgatgtcccagactc

SEQ ID NO: 286643 - DNA, 25 bp, Homo sapien
gtgaagttctgggtaccaacgagaa

SEQ ID NO: 286644 - DNA, 25 bp, Homo sapien
gagccctacaagtaatacctcatat

SEQ ID NO: 286645 - DNA, 25 bp, Homo sapien
tggcccctcctagcatggagtactg

SEQ ID NO: 286646 - DNA, 25 bp, Homo sapien
agtactgcgttttactcttctgctg

SEQ ID NO: 286647 - DNA, 25 bp, Homo sapien
ggctattaacgacgcgatttcacaa

SEQ ID NO: 286648 - DNA, 25 bp, Homo sapien
gtagttatttagaaccattgtgtat

SEQ ID NO: 286649 - DNA, 25 bp, Homo sapien
attgtgtatgtttaaagcacggtac

SEQ ID NO: 286650 - DNA, 25 bp, Homo sapien
gtgtatgtttaaagcacggtacaaa

SEQ ID NO: 286651 - DNA, 25 bp, Homo sapien
ctcagactgtggagctttcacgctc

SEQ ID NO: 286652 - DNA, 25 bp, Homo sapien
tcagactgtggagctttcacgctcg

SEQ ID NO: 286653 - DNA, 25 bp, Homo sapien
agactgtggagctttcacgctcgca

SEQ ID NO: 286654 - DNA, 25 bp, Homo sapien
gactgtggagctttcacgctcgcac

SEQ ID NO: 286655 - DNA, 25 bp, Homo sapien
tttcacgctcgcacaacctcacaga

SEQ ID NO: 286656 - DNA, 25 bp, Homo sapien
caacctcacagactgtgcctgattt

SEQ ID NO: 286657 - DNA, 25 bp, Homo sapien
acctcacagactgtgcctgatttat

SEQ ID NO: 286658 - DNA, 25 bp, Homo sapien
cacagactgtgcctgatttatggat

SEQ ID NO: 286659 - DNA, 25 bp, Homo sapien
aaactcctggcccggagcagtcatc

SEQ ID NO: 286660 - DNA, 25 bp, Homo sapien
tgtgcctggtcaggtgtctttgaga

SEQ ID NO: 286661 - DNA, 25 bp, Homo sapien
tgcctggtcaggtgtctttgagagt

SEQ ID NO: 286662 - DNA, 25 bp, Homo sapien
gtgtctttgagagtggtgctatccc

SEQ ID NO: 286663 - DNA, 25 bp, Homo sapien
tgtctttgagagtggtgctatccca

SEQ ID NO: 286664 - DNA, 25 bp, Homo sapien
tctttgagagtggtgctatcccact

SEQ ID NO: 286665 - DNA, 25 bp, Homo sapien
ttgagagtggtgctatcccactgaa

SEQ ID NO: 286666 - DNA, 25 bp, Homo sapien
tgcagtggtataagcatggcacatt

SEQ ID NO: 286667 - DNA, 25 bp, Homo sapien
gtataagcatggcacattgtaacct

SEQ ID NO: 286668 - DNA, 25 bp, Homo sapien
ataagcatggcacattgtaacctcc

SEQ ID NO: 286669 - DNA, 25 bp, Homo sapien
taagcatggcacattgtaacctcca

SEQ ID NO: 286670 - DNA, 25 bp, Homo sapien
gaatgtcgtcacatgattgcatcat

SEQ ID NO: 286671 - DNA, 25 bp, Homo sapien
tgattgcatcatgttcttcaaaatg

SEQ ID NO: 286672 - DNA, 25 bp, Homo sapien
gaaatagtccagtgaaactaagcaa

SEQ ID NO: 286673 - DNA, 25 bp, Homo sapien
gatatattaaagactatgctcatgg

SEQ ID NO: 286674 - DNA, 25 bp, Homo sapien
gcaaagggaactttataccgtgagg

SEQ ID NO: 286675 - DNA, 25 bp, Homo sapien
caatggattgtaacagaaccctgca

SEQ ID NO: 286676 - DNA, 25 bp, Homo sapien
gaaccctgcaagaagagacatagct

SEQ ID NO: 286677 - DNA, 25 bp, Homo sapien
gacatagctttcaagttccagagac

SEQ ID NO: 286678 - DNA, 25 bp, Homo sapien
tctttcctgtcctttagggcagtat

SEQ ID NO: 286679 - DNA, 25 bp, Homo sapien
agggcagtattcaggccacacggtt

SEQ ID NO: 286680 - DNA, 25 bp, Homo sapien
caggccacacggttcaataacggga

SEQ ID NO: 286681 - DNA, 25 bp, Homo sapien
tatttctgtaaactttgagctttgt

SEQ ID NO: 286682 - DNA, 25 bp, Homo sapien
tctgtaaactttgagctttgttaat

SEQ ID NO: 286683 - DNA, 25 bp, Homo sapien
ttcctcttgtcttccttgaagagca

SEQ ID NO: 286684 - DNA, 25 bp, Homo sapien
cctcttgtcttccttgaagagcatt

SEQ ID NO: 286685 - DNA, 25 bp, Homo sapien
gaataatgctttgatttgttactgt

SEQ ID NO: 286686 - DNA, 25 bp, Homo sapien
aatgctttgatttgttactgtaaaa

SEQ ID NO: 286687 - DNA, 25 bp, Homo sapien
gtaacaaagccaaaacagaccctgt

SEQ ID NO: 286688 - DNA, 25 bp, Homo sapien
aaacagaccctgtaggaactcacag

SEQ ID NO: 286689 - DNA, 25 bp, Homo sapien
gaccctgtaggaactcacagatcaa

SEQ ID NO: 286690 - DNA, 25 bp, Homo sapien
gtaggaactcacagatcaagacttt

SEQ ID NO: 286691 - DNA, 25 bp, Homo sapien
gaactcacagatcaagactttttta

SEQ ID NO: 286692 - DNA, 25 bp, Homo sapien
gatctctctatcagagaaatgtcag

SEQ ID NO: 286693 - DNA, 25 bp, Homo sapien
tctctatcagagaaatgtcagattt

SEQ ID NO: 286694 - DNA, 25 bp, Homo sapien
cagagaaatgtcagatttctagcct

SEQ ID NO: 286695 - DNA, 25 bp, Homo sapien
atttttctggacattcaatagttcc

SEQ ID NO: 286696 - DNA, 25 bp, Homo sapien
ttttctggacattcaatagttcctc

SEQ ID NO: 286697 - DNA, 25 bp, Homo sapien
ttctggacattcaatagttcctctt

SEQ ID NO: 286698 - DNA, 25 bp, Homo sapien
tctggacattcaatagttcctcttt

SEQ ID NO: 286699 - DNA, 25 bp, Homo sapien
ctggacattcaatagttcctctttc

SEQ ID NO: 286700 - DNA, 25 bp, Homo sapien
tggacattcaatagttcctctttct

SEQ ID NO: 286701 - DNA, 25 bp, Homo sapien
gatgccagaaacacttggtatttgt

SEQ ID NO: 286702 - DNA, 25 bp, Homo sapien
gccagaaacacttggtatttgtttt

SEQ ID NO: 286703 - DNA, 25 bp, Homo sapien
tacctactgtgttcttaacactgag

SEQ ID NO: 286704 - DNA, 25 bp, Homo sapien
ggaactgcagtgagcctatctaagt

SEQ ID NO: 286705 - DNA, 25 bp, Homo sapien
tgcagtgagcctatctaagtttttt

SEQ ID NO: 286706 - DNA, 25 bp, Homo sapien
aaagctgatgcttgatcttgcacaa

SEQ ID NO: 286707 - DNA, 25 bp, Homo sapien
gtctagtatgtatgcttgagtgaat

SEQ ID NO: 286708 - DNA, 25 bp, Homo sapien
gcttgagtgaatgtgcgagtatgaa

SEQ ID NO: 286709 - DNA, 25 bp, Homo sapien
gagtcagtgtactttatagtgtgaa

SEQ ID NO: 286710 - DNA, 25 bp, Homo sapien
tagtgtgaatcctgtgagctaatac

SEQ ID NO: 286711 - DNA, 25 bp, Homo sapien
gtgagctaatacagtctatacttat

SEQ ID NO: 286712 - DNA, 25 bp, Homo sapien
tatacttatttcttccctacctgtt

SEQ ID NO: 286713 - DNA, 25 bp, Homo sapien
cctacctgtttcacatccgtaagat

SEQ ID NO: 286714 - DNA, 25 bp, Homo sapien
catagctgggaaacgtgggttcaat

SEQ ID NO: 286715 - DNA, 25 bp, Homo sapien
tattcacatcatttgggataccaga

SEQ ID NO: 286716 - DNA, 25 bp, Homo sapien
ataccagatagctcaatactctctg

SEQ ID NO: 286717 - DNA, 25 bp, Homo sapien
tactctctgagtacattgtgccctt

SEQ ID NO: 286718 - DNA, 25 bp, Homo sapien
tgagtacattgtgcccttgattttt

SEQ ID NO: 286719 - DNA, 25 bp, Homo sapien
ttgtgcccttgatttttatctccaa

SEQ ID NO: 286720 - DNA, 25 bp, Homo sapien
tttatctccaagtggcagtttttaa

SEQ ID NO: 286721 - DNA, 25 bp, Homo sapien
attggccttttacctggatataaat

SEQ ID NO: 286722 - DNA, 25 bp, Homo sapien
tgtcaccctaacttcgtattttttg

SEQ ID NO: 286723 - DNA, 25 bp, Homo sapien
aggatgacctcagggctatgtggat

SEQ ID NO: 286724 - DNA, 25 bp, Homo sapien
atgtattaatatctccatagctggg

SEQ ID NO: 286725 - DNA, 25 bp, Homo sapien
aaaaattatgcacatacacatgcac

SEQ ID NO: 286726 - DNA, 25 bp, Homo sapien
gttcatcagccagctacacatgagg

SEQ ID NO: 286727 - DNA, 25 bp, Homo sapien
ttcatcagccagctacacatgagga

SEQ ID NO: 286728 - DNA, 25 bp, Homo sapien
tcatcagccagctacacatgaggac

SEQ ID NO: 286729 - DNA, 25 bp, Homo sapien
agccagctacacatgaggaccaaaa

SEQ ID NO: 286730 - DNA, 25 bp, Homo sapien
gccagctacacatgaggaccaaaat

SEQ ID NO: 286731 - DNA, 25 bp, Homo sapien
ccagctacacatgaggaccaaaatg

SEQ ID NO: 286732 - DNA, 25 bp, Homo sapien
gctacacatgaggaccaaaatgctt

SEQ ID NO: 286733 - DNA, 25 bp, Homo sapien
ctacacatgaggaccaaaatgcttc

SEQ ID NO: 286734 - DNA, 25 bp, Homo sapien
acacatgaggaccaaaatgcttcag

SEQ ID NO: 286735 - DNA, 25 bp, Homo sapien
tcagtctaaaatggaagatacacat

SEQ ID NO: 286736 - DNA, 25 bp, Homo sapien
atggaataatgagcccttctgtcgt

SEQ ID NO: 286737 - DNA, 25 bp, Homo sapien
tttactttgttctgagcccttctca

SEQ ID NO: 286738 - DNA, 25 bp, Homo sapien
tgagcccttctcaggcagaggaggt

SEQ ID NO: 286739 - DNA, 25 bp, Homo sapien
gagcccttctcaggcagaggaggtc

SEQ ID NO: 286740 - DNA, 25 bp, Homo sapien
cccttctcaggcagaggaggtcagg

SEQ ID NO: 286741 - DNA, 25 bp, Homo sapien
cttctcaggcagaggaggtcaggca

SEQ ID NO: 286742 - DNA, 25 bp, Homo sapien
gaggtcaggcaggtacacgtgcctt

SEQ ID NO: 286743 - DNA, 25 bp, Homo sapien
aggtcaggcaggtacacgtgccttt

SEQ ID NO: 286744 - DNA, 25 bp, Homo sapien
tcaggcaggtacacgtgcctttggg

SEQ ID NO: 286745 - DNA, 25 bp, Homo sapien
gcaggtacacgtgcctttgggaaga

SEQ ID NO: 286746 - DNA, 25 bp, Homo sapien
gtacacgtgcctttgggaagaaggt

SEQ ID NO: 286747 - DNA, 25 bp, Homo sapien
attggctgatatctgcttggcttta

SEQ ID NO: 286748 - DNA, 25 bp, Homo sapien
atatctgcttggctttacttccagt

SEQ ID NO: 286749 - DNA, 25 bp, Homo sapien
ttacttccagtgctttctctaattg

SEQ ID NO: 286750 - DNA, 25 bp, Homo sapien
ttccagtgctttctctaattgcaga

SEQ ID NO: 286751 - DNA, 25 bp, Homo sapien
gaggcatgtgaaggccgtaatcttt

SEQ ID NO: 286752 - DNA, 25 bp, Homo sapien
ggccgtaatctttagaagagccttc

SEQ ID NO: 286753 - DNA, 25 bp, Homo sapien
agccttcaaagccttgcatggtctg

SEQ ID NO: 286754 - DNA, 25 bp, Homo sapien
aaagccttgcatggtctggccctgc

SEQ ID NO: 286755 - DNA, 25 bp, Homo sapien
atgagacgtttcattcacctccata

SEQ ID NO: 286756 - DNA, 25 bp, Homo sapien
acctccatatctttactgctcagac

SEQ ID NO: 286757 - DNA, 25 bp, Homo sapien
ctgctcagacacattggctgatatc

SEQ ID NO: 286758 - DNA, 25 bp, Homo sapien
atttgtaccgtgctttaaacataca

SEQ ID NO: 286759 - DNA, 25 bp, Homo sapien
tgtaccgtgctttaaacatacacaa

SEQ ID NO: 286760 - DNA, 25 bp, Homo sapien
ttaaacatacacaatggttctaaat

SEQ ID NO: 286761 - DNA, 25 bp, Homo sapien
acacaatggttctaaataactactt

SEQ ID NO: 286762 - DNA, 25 bp, Homo sapien
cagtctgtgaggttgtgcgagcgtg

SEQ ID NO: 286763 - DNA, 25 bp, Homo sapien
gtgcgagcgtgaaagctccacagtc

SEQ ID NO: 286764 - DNA, 25 bp, Homo sapien
gcgagcgtgaaagctccacagtctg

SEQ ID NO: 286765 - DNA, 25 bp, Homo sapien
agcgtgaaagctccacagtctgagg

SEQ ID NO: 286766 - DNA, 25 bp, Homo sapien
tgaaagctccacagtctgaggcctg

SEQ ID NO: 286767 - DNA, 25 bp, Homo sapien
gctgctattttttcctgcaatgcac

SEQ ID NO: 286768 - DNA, 25 bp, Homo sapien
aatgcactgttctttggtttgggaa

SEQ ID NO: 286769 - DNA, 25 bp, Homo sapien
ttactttcttgcttagaacctttca

SEQ ID NO: 286770 - DNA, 25 bp, Homo sapien
gcttagaacctttcaatggctttcc

SEQ ID NO: 286771 - DNA, 25 bp, Homo sapien
tcaatggctttccattccatgcaga

SEQ ID NO: 286772 - DNA, 25 bp, Homo sapien
ttttcttggactaaagccttatacg

SEQ ID NO: 286773 - DNA, 25 bp, Homo sapien
aaagccttatacgatctggccctgc

SEQ ID NO: 286774 - DNA, 25 bp, Homo sapien
tgccttttctgaccttgtcttttac

SEQ ID NO: 286775 - DNA, 25 bp, Homo sapien
tctgaccttgtcttttaccaccctt

SEQ ID NO: 286776 - DNA, 25 bp, Homo sapien
cttcccatctcaccaggtttctggt

SEQ ID NO: 286777 - DNA, 25 bp, Homo sapien
tcaccaggtttctggtccctaagaa

SEQ ID NO: 286778 - DNA, 25 bp, Homo sapien
gtccctaagaactcacaatctgtaa

SEQ ID NO: 286779 - DNA, 25 bp, Homo sapien
tgtagtagcataagccatgggctga

SEQ ID NO: 286780 - DNA, 25 bp, Homo sapien
aggagaaaccgtctgtgtccagcct

SEQ ID NO: 286781 - DNA, 25 bp, Homo sapien
gtgtccagcctgttagaggtgttac

SEQ ID NO: 286782 - DNA, 25 bp, Homo sapien
gaggtgttacatttgccctaggtgg

SEQ ID NO: 286783 - DNA, 25 bp, Homo sapien
agaaggctgttctgctcgggagcaa

SEQ ID NO: 286784 - DNA, 25 bp, Homo sapien
tcgggagcaacagtgtccacacgtc

SEQ ID NO: 286785 - DNA, 25 bp, Homo sapien
agtgtccacacgtcagtttccagag

SEQ ID NO: 286786 - DNA, 25 bp, Homo sapien
ccaggatccggctcagagtgtgagt

SEQ ID NO: 286787 - DNA, 25 bp, Homo sapien
tgtgtgctgagcacccctgggtgcc

SEQ ID NO: 286788 - DNA, 25 bp, Homo sapien
caccatcaaggctgtatcaccgagt

SEQ ID NO: 286789 - DNA, 25 bp, Homo sapien
atcaccgagtatctgctcattctga

SEQ ID NO: 286790 - DNA, 25 bp, Homo sapien
gctcattctgaaagtgtccatcctt

SEQ ID NO: 286791 - DNA, 25 bp, Homo sapien
aatacatcttatagggctgctgggt

SEQ ID NO: 286792 - DNA, 25 bp, Homo sapien
tcttatagggctgctgggtacagtt

SEQ ID NO: 286793 - DNA, 25 bp, Homo sapien
tgcacaagggcaccttgtccaagga

SEQ ID NO: 286794 - DNA, 25 bp, Homo sapien
accttgtccaaggagacaccacttt

SEQ ID NO: 286795 - DNA, 25 bp, Homo sapien
caaggagacaccactttcacccaaa

SEQ ID NO: 286796 - DNA, 25 bp, Homo sapien
gggcgtcattttcctgttcgcacaa

SEQ ID NO: 286797 - DNA, 25 bp, Homo sapien
cattttcctgttcgcacaaaggcac

SEQ ID NO: 286798 - DNA, 25 bp, Homo sapien
acagtgggcctgcaatcttagatcc

SEQ ID NO: 286799 - DNA, 25 bp, Homo sapien
gcaatcttagatcccatccttgcct

SEQ ID NO: 286800 - DNA, 25 bp, Homo sapien
atccttgccttcttcgagggatctc

SEQ ID NO: 286801 - DNA, 25 bp, Homo sapien
ttcttcgagggatctcttgggaccc

SEQ ID NO: 286802 - DNA, 25 bp, Homo sapien
agggaccacctcaccgggcaaatgg

SEQ ID NO: 286803 - DNA, 25 bp, Homo sapien
aggcaccacctggacactttcttgt

SEQ ID NO: 286804 - DNA, 25 bp, Homo sapien
gcaccacctggacactttcttgttg

SEQ ID NO: 286805 - DNA, 25 bp, Homo sapien
acactttcttgttgaatcctcccaa

SEQ ID NO: 286806 - DNA, 25 bp, Homo sapien
tttcttgttgaatcctcccaacacc

SEQ ID NO: 286807 - DNA, 25 bp, Homo sapien
cactccttgtgtgcacacatgcaga

SEQ ID NO: 286808 - DNA, 25 bp, Homo sapien
catgcagaggtgagacccgcaggct

SEQ ID NO: 286809 - DNA, 25 bp, Homo sapien
ggtgagacccgcaggctcccaggac

SEQ ID NO: 286810 - DNA, 25 bp, Homo sapien
gctggagccgggtcctcagctgtct

SEQ ID NO: 286811 - DNA, 25 bp, Homo sapien
ctggacccgcgtgcgttacgtcagg

SEQ ID NO: 286812 - DNA, 25 bp, Homo sapien
cgcgtgcgttacgtcaggcccagat

SEQ ID NO: 286813 - DNA, 25 bp, Homo sapien
tgggcttgcttcaggaatatcttac

SEQ ID NO: 286814 - DNA, 25 bp, Homo sapien
gcttgcttcaggaatatcttacaaa

SEQ ID NO: 286815 - DNA, 25 bp, Homo sapien
ggagtcatgtttacatctagttcta

SEQ ID NO: 286816 - DNA, 25 bp, Homo sapien
gtttacatctagttctactgatccg

SEQ ID NO: 286817 - DNA, 25 bp, Homo sapien
atctagttctactgatccgttcaca

SEQ ID NO: 286818 - DNA, 25 bp, Homo sapien
tagttctactgatccgttcacatct

SEQ ID NO: 286819 - DNA, 25 bp, Homo sapien
tctactgatccgttcacatctggag

SEQ ID NO: 286820 - DNA, 25 bp, Homo sapien
ctgatccgttcacatctggagagtt

SEQ ID NO: 286821 - DNA, 25 bp, Homo sapien
ggagagtttatttataactccctct

SEQ ID NO: 286822 - DNA, 25 bp, Homo sapien
ataactccctctataactctctgtt

SEQ ID NO: 286823 - DNA, 25 bp, Homo sapien
tacctaaatgtgctgtggttgtatt

SEQ ID NO: 286824 - DNA, 25 bp, Homo sapien
tctaaagctctctgtagttcctatt

SEQ ID NO: 286825 - DNA, 25 bp, Homo sapien
aaagctctctgtagttcctattttc

SEQ ID NO: 286826 - DNA, 25 bp, Homo sapien
gcaatattagctatattggatcttc

SEQ ID NO: 286827 - DNA, 25 bp, Homo sapien
gcagtgccatcctggaatagatttt

SEQ ID NO: 286828 - DNA, 25 bp, Homo sapien
gccatcctggaatagattttattca

SEQ ID NO: 286829 - DNA, 25 bp, Homo sapien
tatgtgcagcatgatttaggagaaa

SEQ ID NO: 286830 - DNA, 25 bp, Homo sapien
tagttacataagctacagtctttta

SEQ ID NO: 286831 - DNA, 25 bp, Homo sapien
gtatttccatcttgatgcttcagga

SEQ ID NO: 286832 - DNA, 25 bp, Homo sapien
ttccatcttgatgcttcaggataaa

SEQ ID NO: 286833 - DNA, 25 bp, Homo sapien
atgcttcaggataaaaattgcgtta

SEQ ID NO: 286834 - DNA, 25 bp, Homo sapien
aaattgcgttaaacaatacttgaat

SEQ ID NO: 286835 - DNA, 25 bp, Homo sapien
agtgggtctaaatcaacgtctggtt

SEQ ID NO: 286836 - DNA, 25 bp, Homo sapien
caacgtctggttatgaagggcctag

SEQ ID NO: 286837 - DNA, 25 bp, Homo sapien
gcctagagccagataggagcttctt

SEQ ID NO: 286838 - DNA, 25 bp, Homo sapien
cacttcttcaggagggaggttcgcc

SEQ ID NO: 286839 - DNA, 25 bp, Homo sapien
cttttggcagtttctggtggaggcc

SEQ ID NO: 286840 - DNA, 25 bp, Homo sapien
ggtggaggccagctctccttgtcat

SEQ ID NO: 286841 - DNA, 25 bp, Homo sapien
ttgtcatctaccttggcctgagaag

SEQ ID NO: 286842 - DNA, 25 bp, Homo sapien
aagcctgttcccctctgcagaggat

SEQ ID NO: 286843 - DNA, 25 bp, Homo sapien
tttctgctgggatcgatgccgtgga

SEQ ID NO: 286844 - DNA, 25 bp, Homo sapien
cgatgccgtggagactgaatacatt

SEQ ID NO: 286845 - DNA, 25 bp, Homo sapien
tgaatacattgaggtctccaggtga

SEQ ID NO: 286846 - DNA, 25 bp, Homo sapien
ttcgtcctgttgctggtctccgtcc

SEQ ID NO: 286847 - DNA, 25 bp, Homo sapien
tgttgctggtctccgtccggtcgcc

SEQ ID NO: 286848 - DNA, 25 bp, Homo sapien
ggtcgccggccgtctaggtctccgg

SEQ ID NO: 286849 - DNA, 25 bp, Homo sapien
tgcggccaccgcttctgtcgggcgt

SEQ ID NO: 286850 - DNA, 25 bp, Homo sapien
ccaccgcttctgtcgggcgtgcgtg

SEQ ID NO: 286851 - DNA, 25 bp, Homo sapien
tgtcgggcgtgcgtggtgcgcttct

SEQ ID NO: 286852 - DNA, 25 bp, Homo sapien
tggtgcgcttctgggccgaggagga

SEQ ID NO: 286853 - DNA, 25 bp, Homo sapien
ttctgggccgaggaggacgggccct

SEQ ID NO: 286854 - DNA, 25 bp, Homo sapien
ccgagtgcgccgacgactgctggca

SEQ ID NO: 286855 - DNA, 25 bp, Homo sapien
acgactgctggcagcgcgccgtgga

SEQ ID NO: 286856 - DNA, 25 bp, Homo sapien
ggcagcgcgccgtggagcccggcag

SEQ ID NO: 286857 - DNA, 25 bp, Homo sapien
cgcttctctggactgttccaggacc

SEQ ID NO: 286858 - DNA, 25 bp, Homo sapien
tggactgttccaggaccctgactag

SEQ ID NO: 286859 - DNA, 25 bp, Homo sapien
tccaggaccctgactagtgcatgca

SEQ ID NO: 286860 - DNA, 25 bp, Homo sapien
aggaccctgactagtgcatgcactc

SEQ ID NO: 286861 - DNA, 25 bp, Homo sapien
agtgcatgcactctgtaaggtgctt

SEQ ID NO: 286862 - DNA, 25 bp, Homo sapien
actctgtaaggtgcttgtgctggtc

SEQ ID NO: 286863 - DNA, 25 bp, Homo sapien
taaggtgcttgtgctggtccctcct

SEQ ID NO: 286864 - DNA, 25 bp, Homo sapien
ttgtgctggtccctcctcctgatag

SEQ ID NO: 286865 - DNA, 25 bp, Homo sapien
ttttggcatttaacaatcagatccc

SEQ ID NO: 286866 - DNA, 25 bp, Homo sapien
atcagatcccaaaatgtctttcctg

SEQ ID NO: 286867 - DNA, 25 bp, Homo sapien
cagatcccaaaatgtctttcctgac

SEQ ID NO: 286868 - DNA, 25 bp, Homo sapien
gaaaacattatcaggagggaattca

SEQ ID NO: 286869 - DNA, 25 bp, Homo sapien
ctgctactgacttgttgaactggca

SEQ ID NO: 286870 - DNA, 25 bp, Homo sapien
ctgacttgttgaactggcagtcggg

SEQ ID NO: 286871 - DNA, 25 bp, Homo sapien
aacttgggaagacagctgtgaccat

SEQ ID NO: 286872 - DNA, 25 bp, Homo sapien
gacagctgtgaccataaatattaaa

SEQ ID NO: 286873 - DNA, 25 bp, Homo sapien
aaaaggattctttgtgacactgaga

SEQ ID NO: 286874 - DNA, 25 bp, Homo sapien
ctttgtgacactgagaccttctgca

SEQ ID NO: 286875 - DNA, 25 bp, Homo sapien
gacactgagaccttctgcagtacca

SEQ ID NO: 286876 - DNA, 25 bp, Homo sapien
gtaccacagtggaggaaatgccagt

SEQ ID NO: 286877 - DNA, 25 bp, Homo sapien
ggaggaaatgccagtgtacacaact

SEQ ID NO: 286878 - DNA, 25 bp, Homo sapien
gtgtacacaactggcctcatttaat

SEQ ID NO: 286879 - DNA, 25 bp, Homo sapien
gtgttttagttagaagcgtgataga

SEQ ID NO: 286880 - DNA, 25 bp, Homo sapien
gcgtgatagatacagtcaacccttg

SEQ ID NO: 286881 - DNA, 25 bp, Homo sapien
agatacagtcaacccttggaaaact

SEQ ID NO: 286882 - DNA, 25 bp, Homo sapien
gatgttcgtaaaaacaagccttcta

SEQ ID NO: 286883 - DNA, 25 bp, Homo sapien
caagccttctataaagatatctttc

SEQ ID NO: 286884 - DNA, 25 bp, Homo sapien
ggttgatagatatgtcatctctcag

SEQ ID NO: 286885 - DNA, 25 bp, Homo sapien
agatatgtcatctctcaggtattta

SEQ ID NO: 286886 - DNA, 25 bp, Homo sapien
tctcaggtatttatccccaaactgc

SEQ ID NO: 286887 - DNA, 25 bp, Homo sapien
ggtatttatccccaaactgcaaatt

SEQ ID NO: 286888 - DNA, 25 bp, Homo sapien
actgcaaatttctgtatgtccgagg

SEQ ID NO: 286889 - DNA, 25 bp, Homo sapien
aatttctgtatgtccgaggaaagga

SEQ ID NO: 286890 - DNA, 25 bp, Homo sapien
ttatacaacaactgacctcttccaa

SEQ ID NO: 286891 - DNA, 25 bp, Homo sapien
gacctcttccaaactctaacactta

SEQ ID NO: 286892 - DNA, 25 bp, Homo sapien
taacacttaacctctgctattctgc

SEQ ID NO: 286893 - DNA, 25 bp, Homo sapien
tctgctattctgcataaattctgag

SEQ ID NO: 286894 - DNA, 25 bp, Homo sapien
aagccaaattttctgtcggtctaag

SEQ ID NO: 286895 - DNA, 25 bp, Homo sapien
gtctaagaagacatagcctacaccc

SEQ ID NO: 286896 - DNA, 25 bp, Homo sapien
tagcctacacccaactggagataat

SEQ ID NO: 286897 - DNA, 25 bp, Homo sapien
agagattctccttcacctaatttag

SEQ ID NO: 286898 - DNA, 25 bp, Homo sapien
ttgtgaattggcttgactttttgaa

SEQ ID NO: 286899 - DNA, 25 bp, Homo sapien
ttaagccttgaacatgtccaacttt

SEQ ID NO: 286900 - DNA, 25 bp, Homo sapien
gaacatgtccaactttaagaacttt

SEQ ID NO: 286901 - DNA, 25 bp, Homo sapien
tccgccctgggcttggcaatgagaa

SEQ ID NO: 286902 - DNA, 25 bp, Homo sapien
cgccctgggcttggcaatgagaagc

SEQ ID NO: 286903 - DNA, 25 bp, Homo sapien
gcttggcaatgagaagcagccccgc

SEQ ID NO: 286904 - DNA, 25 bp, Homo sapien
tcctggaagcgtccctggtttccct

SEQ ID NO: 286905 - DNA, 25 bp, Homo sapien
tggaagcgtccctggtttcccttcg

SEQ ID NO: 286906 - DNA, 25 bp, Homo sapien
agcctgggctggaccggagggcact

SEQ ID NO: 286907 - DNA, 25 bp, Homo sapien
accggagggcactggcgggttgcct

SEQ ID NO: 286908 - DNA, 25 bp, Homo sapien
ttgcctcgccccaagagcctcagtt

SEQ ID NO: 286909 - DNA, 25 bp, Homo sapien
gagtcgcagtctcaggtggccaggg

SEQ ID NO: 286910 - DNA, 25 bp, Homo sapien
cgcagtctcaggtggccagggcagg

SEQ ID NO: 286911 - DNA, 25 bp, Homo sapien
cagggcaggccttctccctatgggt

SEQ ID NO: 286912 - DNA, 25 bp, Homo sapien
agcccaaagtctactgctttcagct

SEQ ID NO: 286913 - DNA, 25 bp, Homo sapien
agtctactgctttcagctttgtgta

SEQ ID NO: 286914 - DNA, 25 bp, Homo sapien
aaggtggtatcttttagggctccag

SEQ ID NO: 286915 - DNA, 25 bp, Homo sapien
tggtatcttttagggctccagagac

SEQ ID NO: 286916 - DNA, 25 bp, Homo sapien
agggctccagagacactaaccagtg

SEQ ID NO: 286917 - DNA, 25 bp, Homo sapien
aaccagtgtaatttttgcaggcaac

SEQ ID NO: 286918 - DNA, 25 bp, Homo sapien
aacaatcctaagacccatctatttg

SEQ ID NO: 286919 - DNA, 25 bp, Homo sapien
agacccatctatttgcaattaggca

SEQ ID NO: 286920 - DNA, 25 bp, Homo sapien
cggtgacaaaagaaactactggact

SEQ ID NO: 286921 - DNA, 25 bp, Homo sapien
gaaactactggactgcagcccaaag

SEQ ID NO: 286922 - DNA, 25 bp, Homo sapien
tggactgcagcccaaagtctactgc

SEQ ID NO: 286923 - DNA, 25 bp, Homo sapien
gggacagtcagacccagaggtcctt

SEQ ID NO: 286924 - DNA, 25 bp, Homo sapien
agacccagaggtcctttacgtgtgg

SEQ ID NO: 286925 - DNA, 25 bp, Homo sapien
cccagaggtcctttacgtgtggatg

SEQ ID NO: 286926 - DNA, 25 bp, Homo sapien
gtcctttacgtgtggatggagttca

SEQ ID NO: 286927 - DNA, 25 bp, Homo sapien
tggatggagttcacaggcgaataga

SEQ ID NO: 286928 - DNA, 25 bp, Homo sapien
cacaggcgaatagaggagaggacca

SEQ ID NO: 286929 - DNA, 25 bp, Homo sapien
gtttgctgaagtgttcataagataa

SEQ ID NO: 286930 - DNA, 25 bp, Homo sapien
gataacaataggcttgaatctccaa

SEQ ID NO: 286931 - DNA, 25 bp, Homo sapien
taggcttgaatctccaattcaaatg

SEQ ID NO: 286932 - DNA, 25 bp, Homo sapien
aagcacatatctttaatatgctgaa

SEQ ID NO: 286933 - DNA, 25 bp, Homo sapien
tccattaaaacagtatattgatctc

SEQ ID NO: 286934 - DNA, 25 bp, Homo sapien
tatatgggttataattatcaatact

SEQ ID NO: 286935 - DNA, 25 bp, Homo sapien
ctgagaagagtagcattttacattt

SEQ ID NO: 286936 - DNA, 25 bp, Homo sapien
ttttacatttttacagatattcaac

SEQ ID NO: 286937 - DNA, 25 bp, Homo sapien
tacagatattcaacatgtgtcttaa

SEQ ID NO: 286938 - DNA, 25 bp, Homo sapien
tgtgtcttaaggcaattttacttaa

SEQ ID NO: 286939 - DNA, 25 bp, Homo sapien
gcaattttacttaaacacatttgat

SEQ ID NO: 286940 - DNA, 25 bp, Homo sapien
gacattgatgtaaaactctgacagg

SEQ ID NO: 286941 - DNA, 25 bp, Homo sapien
ttgatgtaaaactctgacaggaata

SEQ ID NO: 286942 - DNA, 25 bp, Homo sapien
ttattgatatcattggttctcaaac

SEQ ID NO: 286943 - DNA, 25 bp, Homo sapien
tttttggtctcagggcctctttata

SEQ ID NO: 286944 - DNA, 25 bp, Homo sapien
gtctcagggcctctttatactctaa

SEQ ID NO: 286945 - DNA, 25 bp, Homo sapien
atatgcttgaagtacgtgaacctcc

SEQ ID NO: 286946 - DNA, 25 bp, Homo sapien
gggagaatcctactctttgacagcc

SEQ ID NO: 286947 - DNA, 25 bp, Homo sapien
agaatcctactctttgacagcctta

SEQ ID NO: 286948 - DNA, 25 bp, Homo sapien
aatcctactctttgacagccttatg

SEQ ID NO: 286949 - DNA, 25 bp, Homo sapien
cctactctttgacagccttatgcca

SEQ ID NO: 286950 - DNA, 25 bp, Homo sapien
gacagaagggcagccgagttcaccc

SEQ ID NO: 286951 - DNA, 25 bp, Homo sapien
gaagggcagccgagttcacccaaag

SEQ ID NO: 286952 - DNA, 25 bp, Homo sapien
gcagccgagttcacccaaaggcaga

SEQ ID NO: 286953 - DNA, 25 bp, Homo sapien
gagttcacccaaaggcagaactact

SEQ ID NO: 286954 - DNA, 25 bp, Homo sapien
ggcagaactactttgatgaatctaa

SEQ ID NO: 286955 - DNA, 25 bp, Homo sapien
ttgtgggaaaagtggacacctaagt

SEQ ID NO: 286956 - DNA, 25 bp, Homo sapien
gtacttattttcctaatctctctct

SEQ ID NO: 286957 - DNA, 25 bp, Homo sapien
tatctgctatactccctccttttct

SEQ ID NO: 286958 - DNA, 25 bp, Homo sapien
ttcctctctgtaagacagctactac

SEQ ID NO: 286959 - DNA, 25 bp, Homo sapien
gtaagacagctactactgagcacta

SEQ ID NO: 286960 - DNA, 25 bp, Homo sapien
acagctactactgagcactaattag

SEQ ID NO: 286961 - DNA, 25 bp, Homo sapien
gtagaaagtcagagtggaggttatc

SEQ ID NO: 286962 - DNA, 25 bp, Homo sapien
gaggttatctgtgcatgtctttctg

SEQ ID NO: 286963 - DNA, 25 bp, Homo sapien
gcaaacattactgttgaggccatct

SEQ ID NO: 286964 - DNA, 25 bp, Homo sapien
actccttcagaagtattgtcatgct

SEQ ID NO: 286965 - DNA, 25 bp, Homo sapien
aagtattgtcatgctactgctgtac

SEQ ID NO: 286966 - DNA, 25 bp, Homo sapien
gctactgctgtacttattttcctaa

SEQ ID NO: 286967 - DNA, 25 bp, Homo sapien
tcatcattaggagagaatttatttt

SEQ ID NO: 286968 - DNA, 25 bp, Homo sapien
aaaagtgtcatcttaaactgcaagg

SEQ ID NO: 286969 - DNA, 25 bp, Homo sapien
aagtgtcatcttaaactgcaaggat

SEQ ID NO: 286970 - DNA, 25 bp, Homo sapien
atcttaaactgcaaggatgtctgtc

SEQ ID NO: 286971 - DNA, 25 bp, Homo sapien
taaactgcaaggatgtctgtcaaat

SEQ ID NO: 286972 - DNA, 25 bp, Homo sapien
actgcaaggatgtctgtcaaatatc

SEQ ID NO: 286973 - DNA, 25 bp, Homo sapien
gtcaaatatcacaattaaacatgcc

SEQ ID NO: 286974 - DNA, 25 bp, Homo sapien
aaaggagaagccatgttgtcaaaat

SEQ ID NO: 286975 - DNA, 25 bp, Homo sapien
gaagccatgttgtcaaaatgcccac

SEQ ID NO: 286976 - DNA, 25 bp, Homo sapien
gccatgttgtcaaaatgcccactta

SEQ ID NO: 286977 - DNA, 25 bp, Homo sapien
tgttgtcaaaatgcccacttaaccc

SEQ ID NO: 286978 - DNA, 25 bp, Homo sapien
aaaggacactctgctcttgaaggtg

SEQ ID NO: 286979 - DNA, 25 bp, Homo sapien
acatcaggttttcaaaccagccctg

SEQ ID NO: 286980 - DNA, 25 bp, Homo sapien
aaaccagccctggtgtagcagacac

SEQ ID NO: 286981 - DNA, 25 bp, Homo sapien
agacactgcaacagatgcctcctag

SEQ ID NO: 286982 - DNA, 25 bp, Homo sapien
acatccctggactcagttgcttatt

SEQ ID NO: 286983 - DNA, 25 bp, Homo sapien
ggactcagttgcttatttgtgtaat

SEQ ID NO: 286984 - DNA, 25 bp, Homo sapien
aatggatgtggtcctctaaagcccc

SEQ ID NO: 286985 - DNA, 25 bp, Homo sapien
aagcccctcattgtttttgattgcc

SEQ ID NO: 286986 - DNA, 25 bp, Homo sapien
attgccttctataggtgatgtggac

SEQ ID NO: 286987 - DNA, 25 bp, Homo sapien
atgtggacactgtgcatcaatgtgc

SEQ ID NO: 286988 - DNA, 25 bp, Homo sapien
atcaatgtgcagtgtcttttcagaa

SEQ ID NO: 286989 - DNA, 25 bp, Homo sapien
aggttcgactggtgtcattattgtc

SEQ ID NO: 286990 - DNA, 25 bp, Homo sapien
gactggtgtcattattgtcaatcca

SEQ ID NO: 286991 - DNA, 25 bp, Homo sapien
gtcaatccaaactgtagatctccta

SEQ ID NO: 286992 - DNA, 25 bp, Homo sapien
agatctcctagcaacaagtctgccc

SEQ ID NO: 286993 - DNA, 25 bp, Homo sapien
tccgggagaccaccactgtactaca

SEQ ID NO: 286994 - DNA, 25 bp, Homo sapien
tgtactacagcagtctcttaaccca

SEQ ID NO: 286995 - DNA, 25 bp, Homo sapien
gcagtctcttaacccaagtaaactt

SEQ ID NO: 286996 - DNA, 25 bp, Homo sapien
gtaaacttccagaaactgccactga

SEQ ID NO: 286997 - DNA, 25 bp, Homo sapien
aactgccactgacttatctgtgcat

SEQ ID NO: 286998 - DNA, 25 bp, Homo sapien
atctgtgcatagttctgatgaaaac

SEQ ID NO: 286999 - DNA, 25 bp, Homo sapien
aaatagcagtgtgcccatgcttttt

SEQ ID NO: 287000 - DNA, 25 bp, Homo sapien
ggttcgtggacctgcctttccccat

SEQ ID NO: 287001 - DNA, 25 bp, Homo sapien
tcagagcctctactcggtctcggcg

SEQ ID NO: 287002 - DNA, 25 bp, Homo sapien
ctctactcggtctcggcgcagtggc

SEQ ID NO: 287003 - DNA, 25 bp, Homo sapien
gtctgacccggcgagcggcatttgg

SEQ ID NO: 287004 - DNA, 25 bp, Homo sapien
cggaggaggcggaaactgcccctga

SEQ ID NO: 287005 - DNA, 25 bp, Homo sapien
gcccggttctgggagttttcaatgt

SEQ ID NO: 287006 - DNA, 25 bp, Homo sapien
gttctgggagttttcaatgtcggtc

SEQ ID NO: 287007 - DNA, 25 bp, Homo sapien
tctgggagttttcaatgtcggtcac

SEQ ID NO: 287008 - DNA, 25 bp, Homo sapien
gggagttttcaatgtcggtcacgag

SEQ ID NO: 287009 - DNA, 25 bp, Homo sapien
gagttttcaatgtcggtcacgaggt

SEQ ID NO: 287010 - DNA, 25 bp, Homo sapien
ttcaatgtcggtcacgaggtgctta

SEQ ID NO: 287011 - DNA, 25 bp, Homo sapien
tggagccagagcagtcgactcgagt

SEQ ID NO: 287012 - DNA, 25 bp, Homo sapien
cacctgttactgctgggagtcaagt

SEQ ID NO: 287013 - DNA, 25 bp, Homo sapien
agcaggacattttctcaaacagcaa

SEQ ID NO: 287014 - DNA, 25 bp, Homo sapien
gggcccatggaactgaatctttact

SEQ ID NO: 287015 - DNA, 25 bp, Homo sapien
actgaatctttactccttggtgcac

SEQ ID NO: 287016 - DNA, 25 bp, Homo sapien
ttggtgcaccgcttctgtcgtgcgt

SEQ ID NO: 287017 - DNA, 25 bp, Homo sapien
tcgtgcgttgccttgctccgttttt

SEQ ID NO: 287018 - DNA, 25 bp, Homo sapien
ttttcccaaaaagcactggcttcat

SEQ ID NO: 287019 - DNA, 25 bp, Homo sapien
tggcttcatcaaggccaccgacgat

SEQ ID NO: 287020 - DNA, 25 bp, Homo sapien
gacgatctcctgagtgcactgggaa

SEQ ID NO: 287021 - DNA, 25 bp, Homo sapien
tggcagccttgatcccaggagagta

SEQ ID NO: 287022 - DNA, 25 bp, Homo sapien
gggatcaagcttcgtggctttttat

SEQ ID NO: 287023 - DNA, 25 bp, Homo sapien
caagcttcgtggctttttatgaaga

SEQ ID NO: 287024 - DNA, 25 bp, Homo sapien
tttatgaagaatcccgaaccctgcc

SEQ ID NO: 287025 - DNA, 25 bp, Homo sapien
atgaagaatcccgaaccctgcctag

SEQ ID NO: 287026 - DNA, 25 bp, Homo sapien
aagaatcccgaaccctgcctaggag

SEQ ID NO: 287027 - DNA, 25 bp, Homo sapien
cagggaccacagtggctggaccaac

SEQ ID NO: 287028 - DNA, 25 bp, Homo sapien
ggaccacagtggctggaccaaccca

SEQ ID NO: 287029 - DNA, 25 bp, Homo sapien
gtggctggaccaacccaggaccagg

SEQ ID NO: 287030 - DNA, 25 bp, Homo sapien
tgtggctgttcccacatccccttga

SEQ ID NO: 287031 - DNA, 25 bp, Homo sapien
acatccccttgaatatcccaggaaa

SEQ ID NO: 287032 - DNA, 25 bp, Homo sapien
catccccttgaatatcccaggaaaa

SEQ ID NO: 287033 - DNA, 25 bp, Homo sapien
tgacccactgcccatcatttggctg

SEQ ID NO: 287034 - DNA, 25 bp, Homo sapien
gggagagcgcaatgtttctgcatca

SEQ ID NO: 287035 - DNA, 25 bp, Homo sapien
agcgcaatgtttctgcatcaggaca

SEQ ID NO: 287036 - DNA, 25 bp, Homo sapien
acatctatgtgtgtccagtctacaa

SEQ ID NO: 287037 - DNA, 25 bp, Homo sapien
cagtctacaaaacaagtgcccgcag

SEQ ID NO: 287038 - DNA, 25 bp, Homo sapien
acaagtgcccgcagaggaaccctct

SEQ ID NO: 287039 - DNA, 25 bp, Homo sapien
taccaactatgtcctctccattgag

SEQ ID NO: 287040 - DNA, 25 bp, Homo sapien
tctccattgagcttccaacagacat

SEQ ID NO: 287041 - DNA, 25 bp, Homo sapien
agacatgccccagaagcactggata

SEQ ID NO: 287042 - DNA, 25 bp, Homo sapien
gtggcctcactgtgccagctggata

SEQ ID NO: 287043 - DNA, 25 bp, Homo sapien
cactgtgccagctggataactgatg

SEQ ID NO: 287044 - DNA, 25 bp, Homo sapien
agctcgctgcaacctgggactgcag

SEQ ID NO: 287045 - DNA, 25 bp, Homo sapien
catgcccagccggttaataattctt

SEQ ID NO: 287046 - DNA, 25 bp, Homo sapien
gcccagccggttaataattcttaat

SEQ ID NO: 287047 - DNA, 25 bp, Homo sapien
gccggttaataattcttaatcagta

SEQ ID NO: 287048 - DNA, 25 bp, Homo sapien
gtaaatcattattcaaagacatagt

SEQ ID NO: 287049 - DNA, 25 bp, Homo sapien
gacatagttaatatcttcatgactt

SEQ ID NO: 287050 - DNA, 25 bp, Homo sapien
gttaatatcttcatgacttcttaag

SEQ ID NO: 287051 - DNA, 25 bp, Homo sapien
tcttcatgacttcttaaggatgctc

SEQ ID NO: 287052 - DNA, 25 bp, Homo sapien
tcatgacttcttaaggatgctcaaa

SEQ ID NO: 287053 - DNA, 25 bp, Homo sapien
gacttcttaaggatgctcaaaagct

SEQ ID NO: 287054 - DNA, 25 bp, Homo sapien
tcttaaggatgctcaaaagctggtc

SEQ ID NO: 287055 - DNA, 25 bp, Homo sapien
gaatccttctaaaatttagccatgc

SEQ ID NO: 287056 - DNA, 25 bp, Homo sapien
atgcccataggctgggagggacact

SEQ ID NO: 287057 - DNA, 25 bp, Homo sapien
gagggacactgctccattcagaggc

SEQ ID NO: 287058 - DNA, 25 bp, Homo sapien
acactgctccattcagaggcagcaa

SEQ ID NO: 287059 - DNA, 25 bp, Homo sapien
gcaaagcacattactgtatctccta

SEQ ID NO: 287060 - DNA, 25 bp, Homo sapien
gtatctcctatagagctttgagcag

SEQ ID NO: 287061 - DNA, 25 bp, Homo sapien
gagctttgagcagtccagtgtacat

SEQ ID NO: 287062 - DNA, 25 bp, Homo sapien
gggtaagtcttacatttgtcatcta

SEQ ID NO: 287063 - DNA, 25 bp, Homo sapien
gtcttacatttgtcatctaggtgat

SEQ ID NO: 287064 - DNA, 25 bp, Homo sapien
aagtatctgtttcaagaggattaca

SEQ ID NO: 287065 - DNA, 25 bp, Homo sapien
ggattacaatctaactgtactccaa

SEQ ID NO: 287066 - DNA, 25 bp, Homo sapien
acactggttagtgtctctggagccc

SEQ ID NO: 287067 - DNA, 25 bp, Homo sapien
ggttagtgtctctggagccctaaaa

SEQ ID NO: 287068 - DNA, 25 bp, Homo sapien
agtgtctctggagccctaaaagata

SEQ ID NO: 287069 - DNA, 25 bp, Homo sapien
tggagccctaaaagataccaccttt

SEQ ID NO: 287070 - DNA, 25 bp, Homo sapien
gcagtagactttgggctgcagtcca

SEQ ID NO: 287071 - DNA, 25 bp, Homo sapien
agtccagtagtttcttttgtcaccg

SEQ ID NO: 287072 - DNA, 25 bp, Homo sapien
tagtttcttttgtcaccgttttctg

SEQ ID NO: 287073 - DNA, 25 bp, Homo sapien
gcctaattgcaaatagatgggtctt

SEQ ID NO: 287074 - DNA, 25 bp, Homo sapien
caaatagatgggtcttaggattgtt

SEQ ID NO: 287075 - DNA, 25 bp, Homo sapien
tttgttttaatgttgcctgcaaaaa

SEQ ID NO: 287076 - DNA, 25 bp, Homo sapien
gttgcctgcaaaaattacactggtt

SEQ ID NO: 287077 - DNA, 25 bp, Homo sapien
gtgatttccaccgtccgtgaaagaa

SEQ ID NO: 287078 - DNA, 25 bp, Homo sapien
cgtccgtgaaagaaaggcagccctc

SEQ ID NO: 287079 - DNA, 25 bp, Homo sapien
agccctcatcaaccacaaatgcaga

SEQ ID NO: 287080 - DNA, 25 bp, Homo sapien
caaatgcagagttatcttgagggta

SEQ ID NO: 287081 - DNA, 25 bp, Homo sapien
aggacttgacatggcggctgctgcc

SEQ ID NO: 287082 - DNA, 25 bp, Homo sapien
tgcccctccagaggttatgaggccg

SEQ ID NO: 287083 - DNA, 25 bp, Homo sapien
gggctcaccacagactgcaggtagc

SEQ ID NO: 287084 - DNA, 25 bp, Homo sapien
accacagactgcaggtagctggtat

SEQ ID NO: 287085 - DNA, 25 bp, Homo sapien
agctggtatttatccccataggctc

SEQ ID NO: 287086 - DNA, 25 bp, Homo sapien
ccacagtggccccatggaaggtgat

SEQ ID NO: 287087 - DNA, 25 bp, Homo sapien
gggttggttgatgccagtgaaaaca

SEQ ID NO: 287088 - DNA, 25 bp, Homo sapien
tacagagaggagtaccttctccgct

SEQ ID NO: 287089 - DNA, 25 bp, Homo sapien
agaggagtaccttctccgctgaaag

SEQ ID NO: 287090 - DNA, 25 bp, Homo sapien
taccttctccgctgaaagctacaga

SEQ ID NO: 287091 - DNA, 25 bp, Homo sapien
gaaagctacagagaccacctgccag

SEQ ID NO: 287092 - DNA, 25 bp, Homo sapien
gctacactctgctgcgagcttcaga

SEQ ID NO: 287093 - DNA, 25 bp, Homo sapien
gacctgcagagacattggaatgact

SEQ ID NO: 287094 - DNA, 25 bp, Homo sapien
gacattggaatgacttgcctgcgga

SEQ ID NO: 287095 - DNA, 25 bp, Homo sapien
attggaatgacttgcctgcggagag

SEQ ID NO: 287096 - DNA, 25 bp, Homo sapien
gctgaatgattgagctcatgggaca

SEQ ID NO: 287097 - DNA, 25 bp, Homo sapien
gagctcatgggacaatctgtctcca

SEQ ID NO: 287098 - DNA, 25 bp, Homo sapien
ctcatgggacaatctgtctccagag

SEQ ID NO: 287099 - DNA, 25 bp, Homo sapien
gaagaacataacttgctataaagca

SEQ ID NO: 287100 - DNA, 25 bp, Homo sapien
gctgacatgtcataagcagttctct

SEQ ID NO: 287101 - DNA, 25 bp, Homo sapien
aagcaagggctagctgcctgttttg

SEQ ID NO: 287102 - DNA, 25 bp, Homo sapien
ctggaacacagccatacccattcat

SEQ ID NO: 287103 - DNA, 25 bp, Homo sapien
gccatacccattcatctacatatta

SEQ ID NO: 287104 - DNA, 25 bp, Homo sapien
ctacatattatcgatggctgctttc

SEQ ID NO: 287105 - DNA, 25 bp, Homo sapien
atcgatggctgctttcagggtacac

SEQ ID NO: 287106 - DNA, 25 bp, Homo sapien
tggctgctttcagggtacactggca

SEQ ID NO: 287107 - DNA, 25 bp, Homo sapien
tcagggtacactggcagagttggat

SEQ ID NO: 287108 - DNA, 25 bp, Homo sapien
gagaccaaaccataaagcctaaaat

SEQ ID NO: 287109 - DNA, 25 bp, Homo sapien
gaagtcaactcatatacagcagaac

SEQ ID NO: 287110 - DNA, 25 bp, Homo sapien
gcgttcccaagtttccaggccaatt

SEQ ID NO: 287111 - DNA, 25 bp, Homo sapien
aattacctacctgccttagagcaat

SEQ ID NO: 287112 - DNA, 25 bp, Homo sapien
agagcaattacgcacttctctctgg

SEQ ID NO: 287113 - DNA, 25 bp, Homo sapien
ttctctctggtagtccctgaaatgt

SEQ ID NO: 287114 - DNA, 25 bp, Homo sapien
atgttctaatcatcagatcgcccca

SEQ ID NO: 287115 - DNA, 25 bp, Homo sapien
ttgcttacggctcagttcagacagt

SEQ ID NO: 287116 - DNA, 25 bp, Homo sapien
agacagtatttgttccgggacgctc

SEQ ID NO: 287117 - DNA, 25 bp, Homo sapien
gaggcggtttttaccggctcactcg

SEQ ID NO: 287118 - DNA, 25 bp, Homo sapien
tggtctcttcttcacagggtcttcc

SEQ ID NO: 287119 - DNA, 25 bp, Homo sapien
agggtcttccacaatcgctcttttt

SEQ ID NO: 287120 - DNA, 25 bp, Homo sapien
aatcgctctttttcctgggcacggt

SEQ ID NO: 287121 - DNA, 25 bp, Homo sapien
gaaatgcgtcattaggcggttttat

SEQ ID NO: 287122 - DNA, 25 bp, Homo sapien
gtcattaggcggttttattgtacaa

SEQ ID NO: 287123 - DNA, 25 bp, Homo sapien
ggcggttttattgtacaaacattgt

SEQ ID NO: 287124 - DNA, 25 bp, Homo sapien
gtggatttcataacaagtgtactta

SEQ ID NO: 287125 - DNA, 25 bp, Homo sapien
tcaccacttggccattagttcatgt

SEQ ID NO: 287126 - DNA, 25 bp, Homo sapien
ctaaatgtagaaaaggtgcagtcaa

SEQ ID NO: 287127 - DNA, 25 bp, Homo sapien
aaggtgcagtcaaatatggttttat

SEQ ID NO: 287128 - DNA, 25 bp, Homo sapien
gtgttttttaagtcagatattctta

SEQ ID NO: 287129 - DNA, 25 bp, Homo sapien
attcttatgcagtcatgcattgatt

SEQ ID NO: 287130 - DNA, 25 bp, Homo sapien
gcagtcatgcattgattaacaacag

SEQ ID NO: 287131 - DNA, 25 bp, Homo sapien
catgcattgattaacaacagggata

SEQ ID NO: 287132 - DNA, 25 bp, Homo sapien
ctcaattcctttttgtaaggtgcta

SEQ ID NO: 287133 - DNA, 25 bp, Homo sapien
tgtaaggtgctatttctgtatttaa

SEQ ID NO: 287134 - DNA, 25 bp, Homo sapien
tcttttaacgtaaagctgctttctg

SEQ ID NO: 287135 - DNA, 25 bp, Homo sapien
gctttctgcttatcttattgcactg

SEQ ID NO: 287136 - DNA, 25 bp, Homo sapien
attgcactgctagttgtatgtaggt

SEQ ID NO: 287137 - DNA, 25 bp, Homo sapien
aggtattaattttattgctgcttac

SEQ ID NO: 287138 - DNA, 25 bp, Homo sapien
attatttagctctgctctttttcct

SEQ ID NO: 287139 - DNA, 25 bp, Homo sapien
tctgctctttttcctaatggctata

SEQ ID NO: 287140 - DNA, 25 bp, Homo sapien
atctatagctatttacttgtaactg

SEQ ID NO: 287141 - DNA, 25 bp, Homo sapien
gtaactgtactacatgtaaactgat

SEQ ID NO: 287142 - DNA, 25 bp, Homo sapien
atgtaaactgattttttgttctgat

SEQ ID NO: 287143 - DNA, 25 bp, Homo sapien
agaggcattggcgtgcttatttaag

SEQ ID NO: 287144 - DNA, 25 bp, Homo sapien
gcattggcgtgcttatttaagaaga

SEQ ID NO: 287145 - DNA, 25 bp, Homo sapien
atcatcaactcttataatccaatct

SEQ ID NO: 287146 - DNA, 25 bp, Homo sapien
taatccaatctatgttcagaaaatg

SEQ ID NO: 287147 - DNA, 25 bp, Homo sapien
ggaagcaacgtaaaatgcaatcaca

SEQ ID NO: 287148 - DNA, 25 bp, Homo sapien
tgcaatcacaagtaaaagctacagt

SEQ ID NO: 287149 - DNA, 25 bp, Homo sapien
aagagcttttagagaatggcattta

SEQ ID NO: 287150 - DNA, 25 bp, Homo sapien
gaagaaaattctgctattatcatac

SEQ ID NO: 287151 - DNA, 25 bp, Homo sapien
attctgctattatcatacaatcatg

SEQ ID NO: 287152 - DNA, 25 bp, Homo sapien
tacaatcatggtatagaatgcataa

SEQ ID NO: 287153 - DNA, 25 bp, Homo sapien
atattagatcttgtgttgttatcat

SEQ ID NO: 287154 - DNA, 25 bp, Homo sapien
caatttagctataactttggaaact

SEQ ID NO: 287155 - DNA, 25 bp, Homo sapien
ttttaagtttttgctctggaaggag

SEQ ID NO: 287156 - DNA, 25 bp, Homo sapien
ctctggaaggagcagtatcgtttct

SEQ ID NO: 287157 - DNA, 25 bp, Homo sapien
gagcagtatcgtttctttccagaaa

SEQ ID NO: 287158 - DNA, 25 bp, Homo sapien
tatcgtttctttccagaaattctgg

SEQ ID NO: 287159 - DNA, 25 bp, Homo sapien
aaattctggtgggtaacttgataat

SEQ ID NO: 287160 - DNA, 25 bp, Homo sapien
gggtaacttgataatttgacactag

SEQ ID NO: 287161 - DNA, 25 bp, Homo sapien
cctggtttgacagagaggcccattt

SEQ ID NO: 287162 - DNA, 25 bp, Homo sapien
gtttgacagagaggcccattttaac

SEQ ID NO: 287163 - DNA, 25 bp, Homo sapien
tggtattcactagggtttctcacat

SEQ ID NO: 287164 - DNA, 25 bp, Homo sapien
tacttttatgttacatggcatttta

SEQ ID NO: 287165 - DNA, 25 bp, Homo sapien
tagatatttcccctagagattagaa

SEQ ID NO: 287166 - DNA, 25 bp, Homo sapien
gattagaaacctcctttcatcctgt

SEQ ID NO: 287167 - DNA, 25 bp, Homo sapien
atcctgtccactttttgttagcata

SEQ ID NO: 287168 - DNA, 25 bp, Homo sapien
gttagcatactttcattggatttac

SEQ ID NO: 287169 - DNA, 25 bp, Homo sapien
cattggatttactggtacatgtttt

SEQ ID NO: 287170 - DNA, 25 bp, Homo sapien
catgataatgtgatcttgttttggt

SEQ ID NO: 287171 - DNA, 25 bp, Homo sapien
tactccgtctctatgccatgacagc

SEQ ID NO: 287172 - DNA, 25 bp, Homo sapien
aagcctggaagattactctttggtc

SEQ ID NO: 287173 - DNA, 25 bp, Homo sapien
attactctttggtcaagggcataca

SEQ ID NO: 287174 - DNA, 25 bp, Homo sapien
ggtgttgaaatagaacctcatacat

SEQ ID NO: 287175 - DNA, 25 bp, Homo sapien
atttattacagttctacttatacag

SEQ ID NO: 287176 - DNA, 25 bp, Homo sapien
cactgaaaaaccagcctgggtggcc

SEQ ID NO: 287177 - DNA, 25 bp, Homo sapien
cctgagagggcagaccgaaagcctt

SEQ ID NO: 287178 - DNA, 25 bp, Homo sapien
gagggcagaccgaaagccttggcac

SEQ ID NO: 287179 - DNA, 25 bp, Homo sapien
gggcagaccgaaagccttggcacct

SEQ ID NO: 287180 - DNA, 25 bp, Homo sapien
tgtcctttaacctcagagccccagg

SEQ ID NO: 287181 - DNA, 25 bp, Homo sapien
accatccctctgaaggagagctggg

SEQ ID NO: 287182 - DNA, 25 bp, Homo sapien
ctcggctttggcctccaggacctgg

SEQ ID NO: 287183 - DNA, 25 bp, Homo sapien
ccaggacctggcactggataggtgc

SEQ ID NO: 287184 - DNA, 25 bp, Homo sapien
ctggataggtgccaaatgtttgctg

SEQ ID NO: 287185 - DNA, 25 bp, Homo sapien
caaatgtttgctggctacatgaggc

SEQ ID NO: 287186 - DNA, 25 bp, Homo sapien
tgtccctcaggaacttcctgggaga

SEQ ID NO: 287187 - DNA, 25 bp, Homo sapien
ccagacacagcgtgcgctcgggcag

SEQ ID NO: 287188 - DNA, 25 bp, Homo sapien
aaggccgggcggcagaggcagcact

SEQ ID NO: 287189 - DNA, 25 bp, Homo sapien
tgcttaccccatcctggagctgggc

SEQ ID NO: 287190 - DNA, 25 bp, Homo sapien
gggcttcagaccttcacgtggccac

SEQ ID NO: 287191 - DNA, 25 bp, Homo sapien
ggccaccggagctgctgtctcagga

SEQ ID NO: 287192 - DNA, 25 bp, Homo sapien
ggagctgctgtctcaggacccctct

SEQ ID NO: 287193 - DNA, 25 bp, Homo sapien
ggcaggagacttttcaggtggctaa

SEQ ID NO: 287194 - DNA, 25 bp, Homo sapien
gagacttttcaggtggctaattcca

SEQ ID NO: 287195 - DNA, 25 bp, Homo sapien
tttcaggtggctaattccacaggaa

SEQ ID NO: 287196 - DNA, 25 bp, Homo sapien
attccacaggaagatagtgtcaggt

SEQ ID NO: 287197 - DNA, 25 bp, Homo sapien
aagatagtgtcaggtataggtgccg

SEQ ID NO: 287198 - DNA, 25 bp, Homo sapien
tgggaccgcctgcagctcggccatt

SEQ ID NO: 287199 - DNA, 25 bp, Homo sapien
agaggcgctctgatctgccctcctg

SEQ ID NO: 287200 - DNA, 25 bp, Homo sapien
gttcttgttagcagagagccacact

SEQ ID NO: 287201 - DNA, 25 bp, Homo sapien
ggagctgtgtagacccagggcctca

SEQ ID NO: 287202 - DNA, 25 bp, Homo sapien
cttgccagccaagcgggtcagtttg

SEQ ID NO: 287203 - DNA, 25 bp, Homo sapien
gcgggtcagtttggtgagcacttca

SEQ ID NO: 287204 - DNA, 25 bp, Homo sapien
aatgagacgccttgatttgtttccc

SEQ ID NO: 287205 - DNA, 25 bp, Homo sapien
gatttgtttccctattccaagagtt

SEQ ID NO: 287206 - DNA, 25 bp, Homo sapien
gagtttaccatctggatttagccat

SEQ ID NO: 287207 - DNA, 25 bp, Homo sapien
ggatttagccatgcccttgtaatga

SEQ ID NO: 287208 - DNA, 25 bp, Homo sapien
ttgtaatgaccccaccaatttcatg

SEQ ID NO: 287209 - DNA, 25 bp, Homo sapien
gtaagttttaatcttggatgccatt

SEQ ID NO: 287210 - DNA, 25 bp, Homo sapien
gccatttgggctgttgtagaccact

SEQ ID NO: 287211 - DNA, 25 bp, Homo sapien
aagtgccacaaccaaacataatcag

SEQ ID NO: 287212 - DNA, 25 bp, Homo sapien
tagaccactgaatgtctggttatgc

SEQ ID NO: 287213 - DNA, 25 bp, Homo sapien
ggcttggtagtgattcccctggtct

SEQ ID NO: 287214 - DNA, 25 bp, Homo sapien
tgattcccctggtctccaggtggag

SEQ ID NO: 287215 - DNA, 25 bp, Homo sapien
caaacataatcaggtgcccgaaaat

SEQ ID NO: 287216 - DNA, 25 bp, Homo sapien
ggtggaatagccttctttgcattta

SEQ ID NO: 287217 - DNA, 25 bp, Homo sapien
cttctttgcatttaggcgtccatca

SEQ ID NO: 287218 - DNA, 25 bp, Homo sapien
ggcgtccatcattactagatccttc

SEQ ID NO: 287219 - DNA, 25 bp, Homo sapien
ggttgggttgagaatcacaacatgt

SEQ ID NO: 287220 - DNA, 25 bp, Homo sapien
gaacttggagaaaaagtaatctcat

SEQ ID NO: 287221 - DNA, 25 bp, Homo sapien
aacttggagaaaaagtaatctcatg

SEQ ID NO: 287222 - DNA, 25 bp, Homo sapien
acttggagaaaaagtaatctcatgg

SEQ ID NO: 287223 - DNA, 25 bp, Homo sapien
aatgtgactggagggtagagaactt

SEQ ID NO: 287224 - DNA, 25 bp, Homo sapien
tgtgactggagggtagagaacttgg

SEQ ID NO: 287225 - DNA, 25 bp, Homo sapien
gtgactggagggtagagaacttgga

SEQ ID NO: 287226 - DNA, 25 bp, Homo sapien
tgactggagggtagagaacttggag

SEQ ID NO: 287227 - DNA, 25 bp, Homo sapien
gactggagggtagagaacttggaga

SEQ ID NO: 287228 - DNA, 25 bp, Homo sapien
actggagggtagagaacttggagaa

SEQ ID NO: 287229 - DNA, 25 bp, Homo sapien
ctggagggtagagaacttggagaaa

SEQ ID NO: 287230 - DNA, 25 bp, Homo sapien
tggagggtagagaacttggagaaaa

SEQ ID NO: 287231 - DNA, 25 bp, Homo sapien
aggctcttttcttgggagatttttg

SEQ ID NO: 287232 - DNA, 25 bp, Homo sapien
gtaaaattttcatcgcagtgccctg

SEQ ID NO: 287233 - DNA, 25 bp, Homo sapien
ttttcatcgcagtgccctggcacat

SEQ ID NO: 287234 - DNA, 25 bp, Homo sapien
ctggcacatagacgacatccaataa

SEQ ID NO: 287235 - DNA, 25 bp, Homo sapien
gatacattcattccgatactttaca

SEQ ID NO: 287236 - DNA, 25 bp, Homo sapien
acaaagacgtactgaggcctgctat

SEQ ID NO: 287237 - DNA, 25 bp, Homo sapien
acgtactgaggcctgctatgtatca

SEQ ID NO: 287238 - DNA, 25 bp, Homo sapien
ctgctatgtatcaggcacctttcta

SEQ ID NO: 287239 - DNA, 25 bp, Homo sapien
tatcaggcacctttctaggcacttt

SEQ ID NO: 287240 - DNA, 25 bp, Homo sapien
aaatgagatccaaatccctgacctt

SEQ ID NO: 287241 - DNA, 25 bp, Homo sapien
ggcagtcagtaggaaataagcatat

SEQ ID NO: 287242 - DNA, 25 bp, Homo sapien
tttggagacactgtggctctattga

SEQ ID NO: 287243 - DNA, 25 bp, Homo sapien
tggagacactgtggctctattgaca

SEQ ID NO: 287244 - DNA, 25 bp, Homo sapien
gagacactgtggctctattgacaga

SEQ ID NO: 287245 - DNA, 25 bp, Homo sapien
gacactgtggctctattgacagact

SEQ ID NO: 287246 - DNA, 25 bp, Homo sapien
cactgtggctctattgacagactga

SEQ ID NO: 287247 - DNA, 25 bp, Homo sapien
ggctctattgacagactgatatcta

SEQ ID NO: 287248 - DNA, 25 bp, Homo sapien
tctattgacagactgatatctagga

SEQ ID NO: 287249 - DNA, 25 bp, Homo sapien
ataactatttccattgtatttgtgc

SEQ ID NO: 287250 - DNA, 25 bp, Homo sapien
aactatttccattgtatttgtgcat

SEQ ID NO: 287251 - DNA, 25 bp, Homo sapien
ctatttccattgtatttgtgcatat

SEQ ID NO: 287252 - DNA, 25 bp, Homo sapien
gtgcatatacagtagttataggagc

SEQ ID NO: 287253 - DNA, 25 bp, Homo sapien
gagactcactctattcatcagggat

SEQ ID NO: 287254 - DNA, 25 bp, Homo sapien
gttttaatcaggaattggcaggcat

SEQ ID NO: 287255 - DNA, 25 bp, Homo sapien
aagagcacgctgtccagggtcggca

SEQ ID NO: 287256 - DNA, 25 bp, Homo sapien
gtcggcaaggcctggaaatgtcaga

SEQ ID NO: 287257 - DNA, 25 bp, Homo sapien
agacatggtcagtactcatacatag

SEQ ID NO: 287258 - DNA, 25 bp, Homo sapien
tcatacatagacatgacacacacat

SEQ ID NO: 287259 - DNA, 25 bp, Homo sapien
atatgcagactcacacatgtcaaca

SEQ ID NO: 287260 - DNA, 25 bp, Homo sapien
gactcacacatgtcaacagctgaat

SEQ ID NO: 287261 - DNA, 25 bp, Homo sapien
gagcacacataagggactctgtgaa

SEQ ID NO: 287262 - DNA, 25 bp, Homo sapien
atttgttgtgtgcatgcccgcagaa

SEQ ID NO: 287263 - DNA, 25 bp, Homo sapien
gtgcatgcccgcagaatgggataca

SEQ ID NO: 287264 - DNA, 25 bp, Homo sapien
agcagccagcgccttgttttgctgt

SEQ ID NO: 287265 - DNA, 25 bp, Homo sapien
agcgccttgttttgctgttccagga

SEQ ID NO: 287266 - DNA, 25 bp, Homo sapien
cttgttttgctgttccaggaagcga

SEQ ID NO: 287267 - DNA, 25 bp, Homo sapien
gttccaggaagcgaaccttctcgat

SEQ ID NO: 287268 - DNA, 25 bp, Homo sapien
gaagcgaaccttctcgatgtagctg

SEQ ID NO: 287269 - DNA, 25 bp, Homo sapien
gaaccttctcgatgtagctggcaaa

SEQ ID NO: 287270 - DNA, 25 bp, Homo sapien
aaccttctcgatgtagctggcaaag

SEQ ID NO: 287271 - DNA, 25 bp, Homo sapien
gggtctccttgaagccagcattgag

SEQ ID NO: 287272 - DNA, 25 bp, Homo sapien
ttgaagccagcattgagtgccccag

SEQ ID NO: 287273 - DNA, 25 bp, Homo sapien
agtgccccagccagggagaaatcca

SEQ ID NO: 287274 - DNA, 25 bp, Homo sapien
atctcccctgaggagacgtaggagc

SEQ ID NO: 287275 - DNA, 25 bp, Homo sapien
acttgatgcattaagccagttcttt

SEQ ID NO: 287276 - DNA, 25 bp, Homo sapien
aagccagttctttgcaactgaaaat

SEQ ID NO: 287277 - DNA, 25 bp, Homo sapien
ttccctttcacactccatgtatata

SEQ ID NO: 287278 - DNA, 25 bp, Homo sapien
gacaaaacactagtccgttatcaac

SEQ ID NO: 287279 - DNA, 25 bp, Homo sapien
catgtatatatgatcagcctctcca

SEQ ID NO: 287280 - DNA, 25 bp, Homo sapien
gatcagcctctccattaaaaagaag

SEQ ID NO: 287281 - DNA, 25 bp, Homo sapien
acactagtccgttatcaacttcttc

SEQ ID NO: 287282 - DNA, 25 bp, Homo sapien
gtccgttatcaacttcttcacagag

SEQ ID NO: 287283 - DNA, 25 bp, Homo sapien
gttatcaacttcttcacagagaaag

SEQ ID NO: 287284 - DNA, 25 bp, Homo sapien
gagaaagtagctatactatacccta

SEQ ID NO: 287285 - DNA, 25 bp, Homo sapien
gtagctatactataccctacatatt

SEQ ID NO: 287286 - DNA, 25 bp, Homo sapien
tatttcccaaattttgatgcatcac

SEQ ID NO: 287287 - DNA, 25 bp, Homo sapien
ttttgatgcatcactaagacatttc

SEQ ID NO: 287288 - DNA, 25 bp, Homo sapien
gatgcatcactaagacatttcattt

SEQ ID NO: 287289 - DNA, 25 bp, Homo sapien
atgtttttatgtgttcagagtcacc

SEQ ID NO: 287290 - DNA, 25 bp, Homo sapien
tcagagtcaccttttagggtttccg

SEQ ID NO: 287291 - DNA, 25 bp, Homo sapien
ttttgaaaacctacccagacattat

SEQ ID NO: 287292 - DNA, 25 bp, Homo sapien
gaaaacctacccagacattataata

SEQ ID NO: 287293 - DNA, 25 bp, Homo sapien
aaacctacccagacattataatatg

SEQ ID NO: 287294 - DNA, 25 bp, Homo sapien
tacccagacattataatatgaacag

SEQ ID NO: 287295 - DNA, 25 bp, Homo sapien
atcacctcattcaggtacagctttc

SEQ ID NO: 287296 - DNA, 25 bp, Homo sapien
acctcattcaggtacagctttcatt

SEQ ID NO: 287297 - DNA, 25 bp, Homo sapien
gaaatggcatcgaaaagcaagtcaa

SEQ ID NO: 287298 - DNA, 25 bp, Homo sapien
aagcaagtcaaaaccgtgagatttc

SEQ ID NO: 287299 - DNA, 25 bp, Homo sapien
caagtcaaaaccgtgagatttcaga

SEQ ID NO: 287300 - DNA, 25 bp, Homo sapien
agatttcagaattacagccctcctc

SEQ ID NO: 287301 - DNA, 25 bp, Homo sapien
acctccggaaagcctgaacagccag

SEQ ID NO: 287302 - DNA, 25 bp, Homo sapien
ccagcctgaagcagcgtccttgggc

SEQ ID NO: 287303 - DNA, 25 bp, Homo sapien
gaagcagcgtccttgggcccagaga

SEQ ID NO: 287304 - DNA, 25 bp, Homo sapien
ttgggcccagagatgaccgtcctat

SEQ ID NO: 287305 - DNA, 25 bp, Homo sapien
ggcccagagatgaccgtcctatttg

SEQ ID NO: 287306 - DNA, 25 bp, Homo sapien
agagatgaccgtcctatttgcccac

SEQ ID NO: 287307 - DNA, 25 bp, Homo sapien
tatttgcccaccgaagtggctgcca

SEQ ID NO: 287308 - DNA, 25 bp, Homo sapien
agtgtgtcatttcctcacctaaaac

SEQ ID NO: 287309 - DNA, 25 bp, Homo sapien
aagcttctagaatgtcaggcacgtg

SEQ ID NO: 287310 - DNA, 25 bp, Homo sapien
gcatatgagggcatacctggttcat

SEQ ID NO: 287311 - DNA, 25 bp, Homo sapien
gggcatacctggttcatcttaggca

SEQ ID NO: 287312 - DNA, 25 bp, Homo sapien
acctggttcatcttaggcactaaat

SEQ ID NO: 287313 - DNA, 25 bp, Homo sapien
gtaactagtgtgcatatcaattcat

SEQ ID NO: 287314 - DNA, 25 bp, Homo sapien
gtgcatatcaattcattccgagtct

SEQ ID NO: 287315 - DNA, 25 bp, Homo sapien
aattcattccgagtctgttgagcct

SEQ ID NO: 287316 - DNA, 25 bp, Homo sapien
attccgagtctgttgagcctgtgta

SEQ ID NO: 287317 - DNA, 25 bp, Homo sapien
ccgagtctgttgagcctgtgtatga

SEQ ID NO: 287318 - DNA, 25 bp, Homo sapien
ctgttgagcctgtgtatgaatttta

SEQ ID NO: 287319 - DNA, 25 bp, Homo sapien
cagaggaggaaaggcttcgcctaga

SEQ ID NO: 287320 - DNA, 25 bp, Homo sapien
aggaggaaaggcttcgcctagaaga

SEQ ID NO: 287321 - DNA, 25 bp, Homo sapien
aaaggcttcgcctagaagaggaagc

SEQ ID NO: 287322 - DNA, 25 bp, Homo sapien
cttcgcctagaagaggaagcccgaa

SEQ ID NO: 287323 - DNA, 25 bp, Homo sapien
ttcgcctagaagaggaagcccgaaa

SEQ ID NO: 287324 - DNA, 25 bp, Homo sapien
tcgcctagaagaggaagcccgaaag

SEQ ID NO: 287325 - DNA, 25 bp, Homo sapien
gcctagaagaggaagcccgaaagca

SEQ ID NO: 287326 - DNA, 25 bp, Homo sapien
cctagaagaggaagcccgaaagcag

SEQ ID NO: 287327 - DNA, 25 bp, Homo sapien
ctagaagaggaagcccgaaagcagg

SEQ ID NO: 287328 - DNA, 25 bp, Homo sapien
aagaggaagcccgaaagcaggaaga

SEQ ID NO: 287329 - DNA, 25 bp, Homo sapien
gaggaagcccgaaagcaggaagaag

SEQ ID NO: 287330 - DNA, 25 bp, Homo sapien
aatcagtaagtgttccatggaccca

SEQ ID NO: 287331 - DNA, 25 bp, Homo sapien
tggacccacagcgaagcccatttgt

SEQ ID NO: 287332 - DNA, 25 bp, Homo sapien
ctttccaggtgtctccagtgtagaa

SEQ ID NO: 287333 - DNA, 25 bp, Homo sapien
gtagaagcacaccacagaaaacatg

SEQ ID NO: 287334 - DNA, 25 bp, Homo sapien
gggtaacgcagagcatggagtttct

SEQ ID NO: 287335 - DNA, 25 bp, Homo sapien
ggagtttctgttagcagtgtcctca

SEQ ID NO: 287336 - DNA, 25 bp, Homo sapien
ggattctggaaacctctttgcctag

SEQ ID NO: 287337 - DNA, 25 bp, Homo sapien
ttgcctagccacacttagacttttt

SEQ ID NO: 287338 - DNA, 25 bp, Homo sapien
tagacttttttcagctaatccttta

SEQ ID NO: 287339 - DNA, 25 bp, Homo sapien
ggattcccatttaaacaactcagta

SEQ ID NO: 287340 - DNA, 25 bp, Homo sapien
aactcagtattcttttaagtgtgtc

SEQ ID NO: 287341 - DNA, 25 bp, Homo sapien
acagacaaaccatgtcaccgcctaa

SEQ ID NO: 287342 - DNA, 25 bp, Homo sapien
agacaaaccatgtcaccgcctaaaa

SEQ ID NO: 287343 - DNA, 25 bp, Homo sapien
gacaaaccatgtcaccgcctaaaac

SEQ ID NO: 287344 - DNA, 25 bp, Homo sapien
atgtcaccgcctaaaaccaactcaa

SEQ ID NO: 287345 - DNA, 25 bp, Homo sapien
tgtcaccgcctaaaaccaactcaat

SEQ ID NO: 287346 - DNA, 25 bp, Homo sapien
aaaccaactcaatagtctaaggaat

SEQ ID NO: 287347 - DNA, 25 bp, Homo sapien
ccaactcaatagtctaaggaatttg

SEQ ID NO: 287348 - DNA, 25 bp, Homo sapien
gggagaatctggagaggatttaatt

SEQ ID NO: 287349 - DNA, 25 bp, Homo sapien
gagaggatttaattaatttggcaaa

SEQ ID NO: 287350 - DNA, 25 bp, Homo sapien
tttggcaaaaggattagcaattgaa

SEQ ID NO: 287351 - DNA, 25 bp, Homo sapien
aaagatgtttagttacactgagaaa

SEQ ID NO: 287352 - DNA, 25 bp, Homo sapien
gctggctgtacatgaggatggttta

SEQ ID NO: 287353 - DNA, 25 bp, Homo sapien
aggatggtttaagcctcttagaata

SEQ ID NO: 287354 - DNA, 25 bp, Homo sapien
tcttagaatacaactccatgaggtt

SEQ ID NO: 287355 - DNA, 25 bp, Homo sapien
actccatgaggttaatagtcagcta

SEQ ID NO: 287356 - DNA, 25 bp, Homo sapien
tcagctatgtgtacaagagtctaat

SEQ ID NO: 287357 - DNA, 25 bp, Homo sapien
gtctaatgacctttggaggctatca

SEQ ID NO: 287358 - DNA, 25 bp, Homo sapien
gccatggcaaaacccaagattcttg

SEQ ID NO: 287359 - DNA, 25 bp, Homo sapien
gaaatcactcttttgatcgccagtt

SEQ ID NO: 287360 - DNA, 25 bp, Homo sapien
tcttttgatcgccagttacataaac

SEQ ID NO: 287361 - DNA, 25 bp, Homo sapien
gttacataaacaacttccatcagca

SEQ ID NO: 287362 - DNA, 25 bp, Homo sapien
ttccatcagcaaaaggcagcatttc

SEQ ID NO: 287363 - DNA, 25 bp, Homo sapien
aagtgtcactgagaccctcactatg

SEQ ID NO: 287364 - DNA, 25 bp, Homo sapien
gaccctcactatgcaaatggagcaa

SEQ ID NO: 287365 - DNA, 25 bp, Homo sapien
agggaactggtgactttcaatcaag

SEQ ID NO: 287366 - DNA, 25 bp, Homo sapien
tttcaatcaaggtcgcacatctgga

SEQ ID NO: 287367 - DNA, 25 bp, Homo sapien
tcaaggtcgcacatctggaaaggag

SEQ ID NO: 287368 - DNA, 25 bp, Homo sapien
ccgttctcaggtttgtaatactaat

SEQ ID NO: 287369 - DNA, 25 bp, Homo sapien
gagagtgtttattaggtgcggttca

SEQ ID NO: 287370 - DNA, 25 bp, Homo sapien
ccaaaatgttatgcttctcccaact

SEQ ID NO: 287371 - DNA, 25 bp, Homo sapien
ttctcccaactcaccgaaatgtggc

SEQ ID NO: 287372 - DNA, 25 bp, Homo sapien
aactcaccgaaatgtggccctactc

SEQ ID NO: 287373 - DNA, 25 bp, Homo sapien
gaatggctcttcatatcaacactta

SEQ ID NO: 287374 - DNA, 25 bp, Homo sapien
agatgattctgatcgttcctttgca

SEQ ID NO: 287375 - DNA, 25 bp, Homo sapien
tttgcagactgcagcaatgccacct

SEQ ID NO: 287376 - DNA, 25 bp, Homo sapien
catctccagttcacttctgagtcta

SEQ ID NO: 287377 - DNA, 25 bp, Homo sapien
tgagtctatcattctgctccagggc

SEQ ID NO: 287378 - DNA, 25 bp, Homo sapien
tccagggctgcttttgtggctgtca

SEQ ID NO: 287379 - DNA, 25 bp, Homo sapien
gtatctcatcccacttactgagtat

SEQ ID NO: 287380 - DNA, 25 bp, Homo sapien
ttgtggctgtcacgagcatcctcag

SEQ ID NO: 287381 - DNA, 25 bp, Homo sapien
cccagcgccttgagttgagccagaa

SEQ ID NO: 287382 - DNA, 25 bp, Homo sapien
ttgagccagaagagcctcgtactgt

SEQ ID NO: 287383 - DNA, 25 bp, Homo sapien
actgagtatttcacacctcttcttt

SEQ ID NO: 287384 - DNA, 25 bp, Homo sapien
aagagtaagtcggttttcatcaatt

SEQ ID NO: 287385 - DNA, 25 bp, Homo sapien
tgagtctaaccgctgcactattgaa

SEQ ID NO: 287386 - DNA, 25 bp, Homo sapien
gctgcactattgaagggtcaactgt

SEQ ID NO: 287387 - DNA, 25 bp, Homo sapien
aaaaagtcacttgtagcaggaagaa

SEQ ID NO: 287388 - DNA, 25 bp, Homo sapien
gggaaaagattcaagaccacatagt

SEQ ID NO: 287389 - DNA, 25 bp, Homo sapien
accacatagttaagtctcagatttc

SEQ ID NO: 287390 - DNA, 25 bp, Homo sapien
gtctcagatttctagctggtgcata

SEQ ID NO: 287391 - DNA, 25 bp, Homo sapien
agctggtgcatacatcaactgcctc

SEQ ID NO: 287392 - DNA, 25 bp, Homo sapien
atcaactgcctcttctcaacataca

SEQ ID NO: 287393 - DNA, 25 bp, Homo sapien
acatacaccctgcaaatcctttatt

SEQ ID NO: 287394 - DNA, 25 bp, Homo sapien
cctttattccagatcctttttgtga

SEQ ID NO: 287395 - DNA, 25 bp, Homo sapien
tactctatactaacaattccatttt

SEQ ID NO: 287396 - DNA, 25 bp, Homo sapien
ccagcggagactcctggtggcccat

SEQ ID NO: 287397 - DNA, 25 bp, Homo sapien
ggctcccgtggctttccacgtgttc

SEQ ID NO: 287398 - DNA, 25 bp, Homo sapien
ggacgccagccgagtgagccctgca

SEQ ID NO: 287399 - DNA, 25 bp, Homo sapien
caaaggtcgacggagcagccgcagc

SEQ ID NO: 287400 - DNA, 25 bp, Homo sapien
gggacccaatcactggcgagaacac

SEQ ID NO: 287401 - DNA, 25 bp, Homo sapien
tttccacgtgttcgcgccagctgag

SEQ ID NO: 287402 - DNA, 25 bp, Homo sapien
ataggcgcgaaattcccgtgatccg

SEQ ID NO: 287403 - DNA, 25 bp, Homo sapien
acgtgttcgcgccagctgagccctt

SEQ ID NO: 287404 - DNA, 25 bp, Homo sapien
gagccctttacataacctctttaca

SEQ ID NO: 287405 - DNA, 25 bp, Homo sapien
gccctttacataacctctttacata

SEQ ID NO: 287406 - DNA, 25 bp, Homo sapien
aacctctttacataagctgcacctc

SEQ ID NO: 287407 - DNA, 25 bp, Homo sapien
ccaatgtctggcagtgggcacatgg

SEQ ID NO: 287408 - DNA, 25 bp, Homo sapien
tgtaggtgccaagcgccatggctta

SEQ ID NO: 287409 - DNA, 25 bp, Homo sapien
agcgccatggcttagacccgagatt

SEQ ID NO: 287410 - DNA, 25 bp, Homo sapien
taggcgccaccatgtcgggagacaa

SEQ ID NO: 287411 - DNA, 25 bp, Homo sapien
atgtcgggagacaaacttctgagcg

SEQ ID NO: 287412 - DNA, 25 bp, Homo sapien
aacttctgagcgaactcggttataa

SEQ ID NO: 287413 - DNA, 25 bp, Homo sapien
tcggttataagctgggccgcacaat

SEQ ID NO: 287414 - DNA, 25 bp, Homo sapien
gccgcacaattggagagggcagcta

SEQ ID NO: 287415 - DNA, 25 bp, Homo sapien
taaggcggagtgacgcccgcagtca

SEQ ID NO: 287416 - DNA, 25 bp, Homo sapien
ccgcagtcacttcacaaggcaaaaa

SEQ ID NO: 287417 - DNA, 25 bp, Homo sapien
aaaggcacaacagcggccaatgtct

SEQ ID NO: 287418 - DNA, 25 bp, Homo sapien
tgcaggagcccctttgctggcttta

SEQ ID NO: 287419 - DNA, 25 bp, Homo sapien
tttgctggctttatctgctcccttg

SEQ ID NO: 287420 - DNA, 25 bp, Homo sapien
ctgctcccttgttctggacacagag

SEQ ID NO: 287421 - DNA, 25 bp, Homo sapien
ttgttctggacacagagccctggga

SEQ ID NO: 287422 - DNA, 25 bp, Homo sapien
tctggacacagagccctgggaaaaa

SEQ ID NO: 287423 - DNA, 25 bp, Homo sapien
caaggaaggtggaatgttctgtttt

SEQ ID NO: 287424 - DNA, 25 bp, Homo sapien
ttctgttttggccaccaggaaatgg

SEQ ID NO: 287425 - DNA, 25 bp, Homo sapien
atacacagagaggacccctctctta

SEQ ID NO: 287426 - DNA, 25 bp, Homo sapien
agaggacccctctcttaatacagct

SEQ ID NO: 287427 - DNA, 25 bp, Homo sapien
ccctctcttaatacagctgcttttc

SEQ ID NO: 287428 - DNA, 25 bp, Homo sapien
acagctgcttttctcggtgccaacc

SEQ ID NO: 287429 - DNA, 25 bp, Homo sapien
gtttataactttcctatcaagcaag

SEQ ID NO: 287430 - DNA, 25 bp, Homo sapien
gcaagtcctttaattagccattccc

SEQ ID NO: 287431 - DNA, 25 bp, Homo sapien
tagccattccctcaaaagctttaag

SEQ ID NO: 287432 - DNA, 25 bp, Homo sapien
tttaagagctagtctgctgctgcct

SEQ ID NO: 287433 - DNA, 25 bp, Homo sapien
tcctactgaattccttgctccttaa

SEQ ID NO: 287434 - DNA, 25 bp, Homo sapien
ttctaaatctttattccacacctgc

SEQ ID NO: 287435 - DNA, 25 bp, Homo sapien
gcagtaggcccttccttatgtaata

SEQ ID NO: 287436 - DNA, 25 bp, Homo sapien
tttcctttgcttccagtctcttatt

SEQ ID NO: 287437 - DNA, 25 bp, Homo sapien
gtctcttatttcatactctcttatg

SEQ ID NO: 287438 - DNA, 25 bp, Homo sapien
cttatgacttttggcccagcaatgc

SEQ ID NO: 287439 - DNA, 25 bp, Homo sapien
agcaatgctgtcttaccttcctgtt

SEQ ID NO: 287440 - DNA, 25 bp, Homo sapien
tcagatcatcaaagttcccattcca

SEQ ID NO: 287441 - DNA, 25 bp, Homo sapien
atgaccagtgatctctctatcagag

SEQ ID NO: 287442 - DNA, 25 bp, Homo sapien
gatctctctatcagagaaatgtcag

SEQ ID NO: 287443 - DNA, 25 bp, Homo sapien
cagagaaatgtcagatttctagcct

SEQ ID NO: 287444 - DNA, 25 bp, Homo sapien
ttttctggacattcaatagttcctc

SEQ ID NO: 287445 - DNA, 25 bp, Homo sapien
ttctggacattcaatagttcctctt

SEQ ID NO: 287446 - DNA, 25 bp, Homo sapien
tggacattcaatagttcctctttct

SEQ ID NO: 287447 - DNA, 25 bp, Homo sapien
acattcaatagttcctctttctcag

SEQ ID NO: 287448 - DNA, 25 bp, Homo sapien
attcaatagttcctctttctcagat

SEQ ID NO: 287449 - DNA, 25 bp, Homo sapien
gatgccagaaacacttggtatttgt

SEQ ID NO: 287450 - DNA, 25 bp, Homo sapien
gccagaaacacttggtatttgtttt

SEQ ID NO: 287451 - DNA, 25 bp, Homo sapien
catggtggctgttcataggcgtgat

SEQ ID NO: 287452 - DNA, 25 bp, Homo sapien
ataggcgtgatcctagtgcactaca

SEQ ID NO: 287453 - DNA, 25 bp, Homo sapien
tagtgcactacagcttaaaactccc

SEQ ID NO: 287454 - DNA, 25 bp, Homo sapien
ggctcagatgatccgtctgcttcag

SEQ ID NO: 287455 - DNA, 25 bp, Homo sapien
ctaactctggcctcatatttcattg

SEQ ID NO: 287456 - DNA, 25 bp, Homo sapien
aacagatgcaggcagaacctaggca

SEQ ID NO: 287457 - DNA, 25 bp, Homo sapien
agaacctaggcagggaacctccatc

SEQ ID NO: 287458 - DNA, 25 bp, Homo sapien
agggaacctccatcagcctcagtca

SEQ ID NO: 287459 - DNA, 25 bp, Homo sapien
acatccatctgcctacctgtatgtg

SEQ ID NO: 287460 - DNA, 25 bp, Homo sapien
tgcctacctgtatgtgcgcctggtt

SEQ ID NO: 287461 - DNA, 25 bp, Homo sapien
gcgcctggttcttgttatgcacaaa

SEQ ID NO: 287462 - DNA, 25 bp, Homo sapien
ttctgtggtctgcatgtccatgttt

SEQ ID NO: 287463 - DNA, 25 bp, Homo sapien
gcccaggctgtgatttgccatctac

SEQ ID NO: 287464 - DNA, 25 bp, Homo sapien
cccaggctgtgatttgccatctact

SEQ ID NO: 287465 - DNA, 25 bp, Homo sapien
ccaggctgtgatttgccatctactg

SEQ ID NO: 287466 - DNA, 25 bp, Homo sapien
ctgcaggctatggatggtattcaga

SEQ ID NO: 287467 - DNA, 25 bp, Homo sapien
tgcaggctatggatggtattcagaa

SEQ ID NO: 287468 - DNA, 25 bp, Homo sapien
gcaggctatggatggtattcagaag

SEQ ID NO: 287469 - DNA, 25 bp, Homo sapien
caggctatggatggtattcagaagg

SEQ ID NO: 287470 - DNA, 25 bp, Homo sapien
gctatggatggtattcagaagggag

SEQ ID NO: 287471 - DNA, 25 bp, Homo sapien
ggagatgctgtgtgcgtgttctgaa

SEQ ID NO: 287472 - DNA, 25 bp, Homo sapien
gatgctgtgtgcgtgttctgaaggg

SEQ ID NO: 287473 - DNA, 25 bp, Homo sapien
tttattgtaccttctggcaacctac

SEQ ID NO: 287474 - DNA, 25 bp, Homo sapien
gtaccttctggcaacctacatttgg

SEQ ID NO: 287475 - DNA, 25 bp, Homo sapien
ctacatttggtttctcttcctcatt

SEQ ID NO: 287476 - DNA, 25 bp, Homo sapien
gctgttttagggaattcttactgac

SEQ ID NO: 287477 - DNA, 25 bp, Homo sapien
cttactgacatgtgttgttttttcc

SEQ ID NO: 287478 - DNA, 25 bp, Homo sapien
tgttttttccacttggcctagttag

SEQ ID NO: 287479 - DNA, 25 bp, Homo sapien
ggcctagttagatttggtctactaa

SEQ ID NO: 287480 - DNA, 25 bp, Homo sapien
ggagattgtctctatcttagggact

SEQ ID NO: 287481 - DNA, 25 bp, Homo sapien
tagtcaagctcacttccagcctttc

SEQ ID NO: 287482 - DNA, 25 bp, Homo sapien
ttttcctccctgtatataatccctg

SEQ ID NO: 287483 - DNA, 25 bp, Homo sapien
agatttgtatgttttagctctgttc

SEQ ID NO: 287484 - DNA, 25 bp, Homo sapien
atagtgactgctaccccaagtgagc

SEQ ID NO: 287485 - DNA, 25 bp, Homo sapien
atgagagccatctggaacccggcag

SEQ ID NO: 287486 - DNA, 25 bp, Homo sapien
tgtggccacaggactacattctggc

SEQ ID NO: 287487 - DNA, 25 bp, Homo sapien
attctggccaacacatatgaggaga

SEQ ID NO: 287488 - DNA, 25 bp, Homo sapien
gaaatgatttgagcaacccctggat

SEQ ID NO: 287489 - DNA, 25 bp, Homo sapien
gagcaacccctggatacatccttaa

SEQ ID NO: 287490 - DNA, 25 bp, Homo sapien
aaaagcagggcgcttgccctccatt

SEQ ID NO: 287491 - DNA, 25 bp, Homo sapien
ctctttctctacctggtgactggaa

SEQ ID NO: 287492 - DNA, 25 bp, Homo sapien
gaaacatggtgacaactggagcagt

SEQ ID NO: 287493 - DNA, 25 bp, Homo sapien
aactggagcagtcgcttggacacag

SEQ ID NO: 287494 - DNA, 25 bp, Homo sapien
gatggataacagagccacccaccag

SEQ ID NO: 287495 - DNA, 25 bp, Homo sapien
gatttggcacataaaatccttttat

SEQ ID NO: 287496 - DNA, 25 bp, Homo sapien
gaactagctattttagttacatagt

SEQ ID NO: 287497 - DNA, 25 bp, Homo sapien
gtaatgtaactaatggagagattta

SEQ ID NO: 287498 - DNA, 25 bp, Homo sapien
ttgctgtcatatatgtccattttgg

SEQ ID NO: 287499 - DNA, 25 bp, Homo sapien
tgctgtcatatatgtccattttgga

SEQ ID NO: 287500 - DNA, 25 bp, Homo sapien
gtccattttggagacagatatgata

SEQ ID NO: 287501 - DNA, 25 bp, Homo sapien
ggagacagatatgatagaactagaa

SEQ ID NO: 287502 - DNA, 25 bp, Homo sapien
taaggcagttgaccccaccttccaa

SEQ ID NO: 287503 - DNA, 25 bp, Homo sapien
ttgaccccaccttccaacatgtttt

SEQ ID NO: 287504 - DNA, 25 bp, Homo sapien
ccaccttccaacatgttttcacttt

SEQ ID NO: 287505 - DNA, 25 bp, Homo sapien
ccttccaacatgttttcactttatt

SEQ ID NO: 287506 - DNA, 25 bp, Homo sapien
tcatcattaggagagaatttatttt

SEQ ID NO: 287507 - DNA, 25 bp, Homo sapien
aaaagtgtcatcttaaactgcaagg

SEQ ID NO: 287508 - DNA, 25 bp, Homo sapien
taaactgcaaggatgtctgtcaaat

SEQ ID NO: 287509 - DNA, 25 bp, Homo sapien
actgcaaggatgtctgtcaaatatc

SEQ ID NO: 287510 - DNA, 25 bp, Homo sapien
gtcaaatatcacaattaaacatgcc

SEQ ID NO: 287511 - DNA, 25 bp, Homo sapien
aaaggagaagccatgttgtcaaaat

SEQ ID NO: 287512 - DNA, 25 bp, Homo sapien
gaagccatgttgtcaaaatgcccac

SEQ ID NO: 287513 - DNA, 25 bp, Homo sapien
gccatgttgtcaaaatgcccactta

SEQ ID NO: 287514 - DNA, 25 bp, Homo sapien
tgttgtcaaaatgcccacttaaccc

SEQ ID NO: 287515 - DNA, 25 bp, Homo sapien
gctgaccttctataaccccattttt

SEQ ID NO: 287516 - DNA, 25 bp, Homo sapien
acagtgtactctctgagcccaatat

SEQ ID NO: 287517 - DNA, 25 bp, Homo sapien
tagtgaaagctcgaacctgcctggg

SEQ ID NO: 287518 - DNA, 25 bp, Homo sapien
tgggttcccaccttgtctctgctac

SEQ ID NO: 287519 - DNA, 25 bp, Homo sapien
gaactcagagccaactactaagcct

SEQ ID NO: 287520 - DNA, 25 bp, Homo sapien
tactaagcctgtagcagcctcccaa

SEQ ID NO: 287521 - DNA, 25 bp, Homo sapien
aaactgcccagtcttgttcagatgc

SEQ ID NO: 287522 - DNA, 25 bp, Homo sapien
ttcagatgcacctccagaaacacag

SEQ ID NO: 287523 - DNA, 25 bp, Homo sapien
cccagacaccctgaggagtagaaca

SEQ ID NO: 287524 - DNA, 25 bp, Homo sapien
gtagaacagtgccagcaggctccag

SEQ ID NO: 287525 - DNA, 25 bp, Homo sapien
gacagggactgagtctgcctgattc

SEQ ID NO: 287526 - DNA, 25 bp, Homo sapien
tgattcatctctgcattcctagcac

SEQ ID NO: 287527 - DNA, 25 bp, Homo sapien
ttcctagcacttaccttggtgctta

SEQ ID NO: 287528 - DNA, 25 bp, Homo sapien
gtttatactaacttatgtccagtga

SEQ ID NO: 287529 - DNA, 25 bp, Homo sapien
tactaacttatgtccagtgagatag

SEQ ID NO: 287530 - DNA, 25 bp, Homo sapien
gaaacacatttcttctttatagctc

SEQ ID NO: 287531 - DNA, 25 bp, Homo sapien
tctttatagctctaggtcctcttca

SEQ ID NO: 287532 - DNA, 25 bp, Homo sapien
aggtcctcttcacttgtttttgtgc

SEQ ID NO: 287533 - DNA, 25 bp, Homo sapien
ttattgttatacttactacctctgt

SEQ ID NO: 287534 - DNA, 25 bp, Homo sapien
actacctctgtatatgttacaagcc

SEQ ID NO: 287535 - DNA, 25 bp, Homo sapien
atgttacaagcccaagaatactatt

SEQ ID NO: 287536 - DNA, 25 bp, Homo sapien
tgttttttaaagaacctgagactgg

SEQ ID NO: 287537 - DNA, 25 bp, Homo sapien
cacctcctttagtggataccctgag

SEQ ID NO: 287538 - DNA, 25 bp, Homo sapien
tcctttagtggataccctgagctta

SEQ ID NO: 287539 - DNA, 25 bp, Homo sapien
gcaggcaccgaggtccgagtggcaa

SEQ ID NO: 287540 - DNA, 25 bp, Homo sapien
ccgaggtccgagtggcaaggagaca

SEQ ID NO: 287541 - DNA, 25 bp, Homo sapien
tgatcggcctggaatgtcaggctgt

SEQ ID NO: 287542 - DNA, 25 bp, Homo sapien
cctggaatgtcaggctgtgagctca

SEQ ID NO: 287543 - DNA, 25 bp, Homo sapien
tctcggcctgcgtgtcgggctgtca

SEQ ID NO: 287544 - DNA, 25 bp, Homo sapien
cctctgggccatggacaggcctaaa

SEQ ID NO: 287545 - DNA, 25 bp, Homo sapien
tctgggccatggacaggcctaaatt

SEQ ID NO: 287546 - DNA, 25 bp, Homo sapien
ccatggacaggcctaaatttagcta

SEQ ID NO: 287547 - DNA, 25 bp, Homo sapien
agctagtagacaaggggctggcccc

SEQ ID NO: 287548 - DNA, 25 bp, Homo sapien
agggacagtcggccttataaagcgg

SEQ ID NO: 287549 - DNA, 25 bp, Homo sapien
gcagtcggagcctggcacgctcgcc

SEQ ID NO: 287550 - DNA, 25 bp, Homo sapien
gttccacattaccttgaatgtcccc

SEQ ID NO: 287551 - DNA, 25 bp, Homo sapien
gaatgtcccctttcataactcatca

SEQ ID NO: 287552 - DNA, 25 bp, Homo sapien
tcatcacacctgagattacctattt

SEQ ID NO: 287553 - DNA, 25 bp, Homo sapien
gattacctatttgttgtcaactgtg

SEQ ID NO: 287554 - DNA, 25 bp, Homo sapien
gaactccacaaagattccacttcta

SEQ ID NO: 287555 - DNA, 25 bp, Homo sapien
agattccacttctagcttactcagt

SEQ ID NO: 287556 - DNA, 25 bp, Homo sapien
tatatccccgaacctcagaagagta

SEQ ID NO: 287557 - DNA, 25 bp, Homo sapien
gctacagcagtactccttatctgtg

SEQ ID NO: 287558 - DNA, 25 bp, Homo sapien
ttatctgtggtttcagtcagctgtg

SEQ ID NO: 287559 - DNA, 25 bp, Homo sapien
gctgtggcacagtacaataacatat

SEQ ID NO: 287560 - DNA, 25 bp, Homo sapien
attcatataacctttaccacagtat

SEQ ID NO: 287561 - DNA, 25 bp, Homo sapien
gacaggtatatttcatagatacttc

SEQ ID NO: 287562 - DNA, 25 bp, Homo sapien
ataattcagctttcaaatctgttgc

SEQ ID NO: 287563 - DNA, 25 bp, Homo sapien
agctttcaaatctgttgctgctttt

SEQ ID NO: 287564 - DNA, 25 bp, Homo sapien
ttgctgcttttccttaatccgtggt

SEQ ID NO: 287565 - DNA, 25 bp, Homo sapien
cttttccttaatccgtggtgttcat

SEQ ID NO: 287566 - DNA, 25 bp, Homo sapien
taatccgtggtgttcatgtgaaaat

SEQ ID NO: 287567 - DNA, 25 bp, Homo sapien
ttctgcatcagaacaatgtgaggtc

SEQ ID NO: 287568 - DNA, 25 bp, Homo sapien
gaacaatgtgaggtcattctacgtt

SEQ ID NO: 287569 - DNA, 25 bp, Homo sapien
gaggtcattctacgttaatatcatt

SEQ ID NO: 287570 - DNA, 25 bp, Homo sapien
tcagcatttttcatggaagtttaat

SEQ ID NO: 287571 - DNA, 25 bp, Homo sapien
aaatatgctctttgtgtttgaataa

SEQ ID NO: 287572 - DNA, 25 bp, Homo sapien
gcatatgagggcatacctggttcat

SEQ ID NO: 287573 - DNA, 25 bp, Homo sapien
gggcatacctggttcatcttaggca

SEQ ID NO: 287574 - DNA, 25 bp, Homo sapien
atacctggttcatcttaggcactaa

SEQ ID NO: 287575 - DNA, 25 bp, Homo sapien
cctggttcatcttaggcactaaatt

SEQ ID NO: 287576 - DNA, 25 bp, Homo sapien
gtaactagtgtgcatatcaattcat

SEQ ID NO: 287577 - DNA, 25 bp, Homo sapien
gtgtgcatatcaattcattccgagt

SEQ ID NO: 287578 - DNA, 25 bp, Homo sapien
gcatatcaattcattccgagtctgt

SEQ ID NO: 287579 - DNA, 25 bp, Homo sapien
aattcattccgagtctgttgagcct

SEQ ID NO: 287580 - DNA, 25 bp, Homo sapien
attccgagtctgttgagcctgtgta

SEQ ID NO: 287581 - DNA, 25 bp, Homo sapien
ccgagtctgttgagcctgtgtatga

SEQ ID NO: 287582 - DNA, 25 bp, Homo sapien
ctgttgagcctgtgtatgaatttta

SEQ ID NO: 287583 - DNA, 25 bp, Homo sapien
aaaaattatgcacatacacatgcac

SEQ ID NO: 287584 - DNA, 25 bp, Homo sapien
gtgtgtgtgtagttcatcagccagc

SEQ ID NO: 287585 - DNA, 25 bp, Homo sapien
gtgtgtgtagttcatcagccagcta

SEQ ID NO: 287586 - DNA, 25 bp, Homo sapien
gttcatcagccagctacacatgagg

SEQ ID NO: 287587 - DNA, 25 bp, Homo sapien
tcatcagccagctacacatgaggac

SEQ ID NO: 287588 - DNA, 25 bp, Homo sapien
agccagctacacatgaggaccaaaa

SEQ ID NO: 287589 - DNA, 25 bp, Homo sapien
gccagctacacatgaggaccaaaat

SEQ ID NO: 287590 - DNA, 25 bp, Homo sapien
gctacacatgaggaccaaaatgctt

SEQ ID NO: 287591 - DNA, 25 bp, Homo sapien
acacatgaggaccaaaatgcttcag

SEQ ID NO: 287592 - DNA, 25 bp, Homo sapien
ccaaaatgcttcagtctaaaatgga

SEQ ID NO: 287593 - DNA, 25 bp, Homo sapien
tcagtctaaaatggaagatacacat

SEQ ID NO: 287594 - DNA, 25 bp, Homo sapien
agggaccggcaccactatgtcagct

SEQ ID NO: 287595 - DNA, 25 bp, Homo sapien
gagccaccagcgcagacaggtacag

SEQ ID NO: 287596 - DNA, 25 bp, Homo sapien
agcgcagacaggtacaggatgttcc

SEQ ID NO: 287597 - DNA, 25 bp, Homo sapien
acaggatgttcctgcgtttccagaa

SEQ ID NO: 287598 - DNA, 25 bp, Homo sapien
ggatgttcctgcgtttccagaagga

SEQ ID NO: 287599 - DNA, 25 bp, Homo sapien
ttccagaaggaagtgctcgccaagc

SEQ ID NO: 287600 - DNA, 25 bp, Homo sapien
ccagaaaatttgcacgtgcagcccc

SEQ ID NO: 287601 - DNA, 25 bp, Homo sapien
agttcaacagactgcacgtctttgg

SEQ ID NO: 287602 - DNA, 25 bp, Homo sapien
gcacgtctttggaaaagtctttgaa

SEQ ID NO: 287603 - DNA, 25 bp, Homo sapien
agatatttgtaacagttctttgata

SEQ ID NO: 287604 - DNA, 25 bp, Homo sapien
gttctttgatatttggtgatctctt

SEQ ID NO: 287605 - DNA, 25 bp, Homo sapien
gaaccatggcactgtgtcttattta

SEQ ID NO: 287606 - DNA, 25 bp, Homo sapien
tatttaaccgttgggctgtctcata

SEQ ID NO: 287607 - DNA, 25 bp, Homo sapien
aaccgttgggctgtctcatactaaa

SEQ ID NO: 287608 - DNA, 25 bp, Homo sapien
gggctgtctcatactaaacttgcaa

SEQ ID NO: 287609 - DNA, 25 bp, Homo sapien
aaagatatttgcctatgaactgaac

SEQ ID NO: 287610 - DNA, 25 bp, Homo sapien
gcctatgaactgaacaagacttcca

SEQ ID NO: 287611 - DNA, 25 bp, Homo sapien
caggagttgaagtctggttcacaag

SEQ ID NO: 287612 - DNA, 25 bp, Homo sapien
gtctggttcacaagggtaccccttg

SEQ ID NO: 287613 - DNA, 25 bp, Homo sapien
aggccccaactcagttgtggagatg

SEQ ID NO: 287614 - DNA, 25 bp, Homo sapien
gttaatatgacgaaccccagctcaa

SEQ ID NO: 287615 - DNA, 25 bp, Homo sapien
gtaactgatgtgaactgctgggaat

SEQ ID NO: 287616 - DNA, 25 bp, Homo sapien
tctgtggtctgcatgtccatgtttg

SEQ ID NO: 287617 - DNA, 25 bp, Homo sapien
ggcccaggctgtgatttgccatcta

SEQ ID NO: 287618 - DNA, 25 bp, Homo sapien
gtgatttgccatctactgcaggcta

SEQ ID NO: 287619 - DNA, 25 bp, Homo sapien
tactgcaggctatggatggtattca

SEQ ID NO: 287620 - DNA, 25 bp, Homo sapien
tgacacacacgtctgctcactgctt

SEQ ID NO: 287621 - DNA, 25 bp, Homo sapien
acgtctgctcactgcttgctctttg

SEQ ID NO: 287622 - DNA, 25 bp, Homo sapien
gtctgctcactgcttgctctttgca

SEQ ID NO: 287623 - DNA, 25 bp, Homo sapien
tgctcactgcttgctctttgcacag

SEQ ID NO: 287624 - DNA, 25 bp, Homo sapien
tcactgcttgctctttgcacaggcc

SEQ ID NO: 287625 - DNA, 25 bp, Homo sapien
ttgctctttgcacaggcccctggat

SEQ ID NO: 287626 - DNA, 25 bp, Homo sapien
tgctctttgcacaggcccctggatc

SEQ ID NO: 287627 - DNA, 25 bp, Homo sapien
gagagaggagattgccactgtttct

SEQ ID NO: 287628 - DNA, 25 bp, Homo sapien
aggagattgccactgtttctaggac

SEQ ID NO: 287629 - DNA, 25 bp, Homo sapien
agattgccactgtttctaggacttt

SEQ ID NO: 287630 - DNA, 25 bp, Homo sapien
tctaggactttaaagttgctgattc

SEQ ID NO: 287631 - DNA, 25 bp, Homo sapien
agttgctgattcaacggagcttcag

SEQ ID NO: 287632 - DNA, 25 bp, Homo sapien
gattcaacggagcttcaggtttaaa

SEQ ID NO: 287633 - DNA, 25 bp, Homo sapien
gtcttcaggtttgatagactatatc

SEQ ID NO: 287634 - DNA, 25 bp, Homo sapien
gactatatcagttctatcaaactag

SEQ ID NO: 287635 - DNA, 25 bp, Homo sapien
aaactagtttttgtgatattccagt

SEQ ID NO: 287636 - DNA, 25 bp, Homo sapien
aaactatgtcaatctctgaattagc

SEQ ID NO: 287637 - DNA, 25 bp, Homo sapien
gtcaatctctgaattagcataaaat

SEQ ID NO: 287638 - DNA, 25 bp, Homo sapien
tttactctaggcaaaaaccctgtga

SEQ ID NO: 287639 - DNA, 25 bp, Homo sapien
atctacctcctgaatatgatactca

SEQ ID NO: 287640 - DNA, 25 bp, Homo sapien
aatcatcagtaatctaaatcctgca

SEQ ID NO: 287641 - DNA, 25 bp, Homo sapien
aatcctgcaagaaagagacttagtg

SEQ ID NO: 287642 - DNA, 25 bp, Homo sapien
ggatatgggaaatcactcctgagta

SEQ ID NO: 287643 - DNA, 25 bp, Homo sapien
atcactcctgagtactaaacaagag

SEQ ID NO: 287644 - DNA, 25 bp, Homo sapien
aaacaagagactactcatcctgaag

SEQ ID NO: 287645 - DNA, 25 bp, Homo sapien
ctactcatcctgaagtcaaatccca

SEQ ID NO: 287646 - DNA, 25 bp, Homo sapien
aaatcccataatcaaagtgccagag

SEQ ID NO: 287647 - DNA, 25 bp, Homo sapien
agtgccagagctttcagtcataatg

SEQ ID NO: 287648 - DNA, 25 bp, Homo sapien
gaagttcttatgcagtatcagaaaa

SEQ ID NO: 287649 - DNA, 25 bp, Homo sapien
attgacgaattctggaatctccaat

SEQ ID NO: 287650 - DNA, 25 bp, Homo sapien
aaatccactttaactgatgcagtct

SEQ ID NO: 287651 - DNA, 25 bp, Homo sapien
gtttatctacaaggcagttctttgc

SEQ ID NO: 287652 - DNA, 25 bp, Homo sapien
agttctttgcttcactgattttgta

SEQ ID NO: 287653 - DNA, 25 bp, Homo sapien
ttatgcatcatacaactgtgaggtt

SEQ ID NO: 287654 - DNA, 25 bp, Homo sapien
tgaggttgccaaactttctctccaa

SEQ ID NO: 287655 - DNA, 25 bp, Homo sapien
gaaatctgccacttgagagaaggta

SEQ ID NO: 287656 - DNA, 25 bp, Homo sapien
ggtattcacacgaatcattgcctcg

SEQ ID NO: 287657 - DNA, 25 bp, Homo sapien
acgaatcattgcctcggtagcggcg

SEQ ID NO: 287658 - DNA, 25 bp, Homo sapien
gatgcagtcttgtcttcaaaaggaa

SEQ ID NO: 287659 - DNA, 25 bp, Homo sapien
tgttttcatgcttatttccttcttc

SEQ ID NO: 287660 - DNA, 25 bp, Homo sapien
gggacttaagtgttgtctctgaaga

SEQ ID NO: 287661 - DNA, 25 bp, Homo sapien
agcatggacattagtctggagggtc

SEQ ID NO: 287662 - DNA, 25 bp, Homo sapien
ggagtgcaggtcttaccgtccgaga

SEQ ID NO: 287663 - DNA, 25 bp, Homo sapien
catcaaatggcgcttaggtctagga

SEQ ID NO: 287664 - DNA, 25 bp, Homo sapien
gccttagggcgaggcgcagacacac

SEQ ID NO: 287665 - DNA, 25 bp, Homo sapien
agacacaccccgaagtggttggatt

SEQ ID NO: 287666 - DNA, 25 bp, Homo sapien
aagtggttggattgtataccgcaag

SEQ ID NO: 287667 - DNA, 25 bp, Homo sapien
agatcgtccgcaactgggcgagctg

SEQ ID NO: 287668 - DNA, 25 bp, Homo sapien
cgagctgtgcaataaagcgtggcta

SEQ ID NO: 287669 - DNA, 25 bp, Homo sapien
gctaaggccgtggtttggttacgat

SEQ ID NO: 287670 - DNA, 25 bp, Homo sapien
gttacgattggccagcgggacttaa

SEQ ID NO: 287671 - DNA, 25 bp, Homo sapien
agaccaacatctgagtctcttcagc

SEQ ID NO: 287672 - DNA, 25 bp, Homo sapien
tgagtctcttcagcacacaagtttg

SEQ ID NO: 287673 - DNA, 25 bp, Homo sapien
aagtcctagcaacttcaagctcaga

SEQ ID NO: 287674 - DNA, 25 bp, Homo sapien
tcaagctcagaactacgggtggcag

SEQ ID NO: 287675 - DNA, 25 bp, Homo sapien
agcagctccctcttgacgtcgaagc

SEQ ID NO: 287676 - DNA, 25 bp, Homo sapien
acgtcgaagcctcccattccagaga

SEQ ID NO: 287677 - DNA, 25 bp, Homo sapien
ggcctggatcaaacaaagcccacaa

SEQ ID NO: 287678 - DNA, 25 bp, Homo sapien
cacaagcaccgatgactgagctgct

SEQ ID NO: 287679 - DNA, 25 bp, Homo sapien
ttttcatgggccgatctgctgaatt

SEQ ID NO: 287680 - DNA, 25 bp, Homo sapien
gggccgatctgctgaattcagccta

SEQ ID NO: 287681 - DNA, 25 bp, Homo sapien
agcctaggagctgagaccaacatct

SEQ ID NO: 287682 - DNA, 25 bp, Homo sapien
aagccctgatggagtagcaaggcat

SEQ ID NO: 287683 - DNA, 25 bp, Homo sapien
aaggcatctgaccaggactttctga

SEQ ID NO: 287684 - DNA, 25 bp, Homo sapien
gataatcctttatttactcgttcaa

SEQ ID NO: 287685 - DNA, 25 bp, Homo sapien
tactcgttcaaatgccatagttcca

SEQ ID NO: 287686 - DNA, 25 bp, Homo sapien
aaatgccatagttccactgtcctct

SEQ ID NO: 287687 - DNA, 25 bp, Homo sapien
tccccatattccacagtaggaagaa

SEQ ID NO: 287688 - DNA, 25 bp, Homo sapien
tctttctgatccttatacttccaac

SEQ ID NO: 287689 - DNA, 25 bp, Homo sapien
atgcttattcagtaactatgggtta

SEQ ID NO: 287690 - DNA, 25 bp, Homo sapien
tatacttccaacacaccttagccat

SEQ ID NO: 287691 - DNA, 25 bp, Homo sapien
tagccatgcctacattgtgtttctc

SEQ ID NO: 287692 - DNA, 25 bp, Homo sapien
gcctacattgtgtttctctgaaaat

SEQ ID NO: 287693 - DNA, 25 bp, Homo sapien
agatgccctgtccacttaccctagg

SEQ ID NO: 287694 - DNA, 25 bp, Homo sapien
tgccctgtccacttaccctaggtag

SEQ ID NO: 287695 - DNA, 25 bp, Homo sapien
atcagtgccgagtccttgtccctac

SEQ ID NO: 287696 - DNA, 25 bp, Homo sapien
tccagcctcaaaccgcctctggatc

SEQ ID NO: 287697 - DNA, 25 bp, Homo sapien
tgtccttctccgagtggcacgcctg

SEQ ID NO: 287698 - DNA, 25 bp, Homo sapien
tgcctcagcgggtcaggccttcaga

SEQ ID NO: 287699 - DNA, 25 bp, Homo sapien
ctcagcgggtcaggccttcagaaca

SEQ ID NO: 287700 - DNA, 25 bp, Homo sapien
agcgggtcaggccttcagaacactg

SEQ ID NO: 287701 - DNA, 25 bp, Homo sapien
gggtcaggccttcagaacactgcca

SEQ ID NO: 287702 - DNA, 25 bp, Homo sapien
ggtcaggccttcagaacactgccac

SEQ ID NO: 287703 - DNA, 25 bp, Homo sapien
ccagttttataatcccgctccctct

SEQ ID NO: 287704 - DNA, 25 bp, Homo sapien
gggataaataccagctacctgcagt

SEQ ID NO: 287705 - DNA, 25 bp, Homo sapien
aaataccagctacctgcagtctgtg

SEQ ID NO: 287706 - DNA, 25 bp, Homo sapien
agctacctgcagtctgtggtgagcc

SEQ ID NO: 287707 - DNA, 25 bp, Homo sapien
acctgcagtctgtggtgagcccctg

SEQ ID NO: 287708 - DNA, 25 bp, Homo sapien
atgtcaagtcctcctcaatactaca

SEQ ID NO: 287709 - DNA, 25 bp, Homo sapien
tcaagataactctgcatttgtggtt

SEQ ID NO: 287710 - DNA, 25 bp, Homo sapien
tctgcatttgtggttgatgagggct

SEQ ID NO: 287711 - DNA, 25 bp, Homo sapien
tcctgatgttgaccagctagaagag

SEQ ID NO: 287712 - DNA, 25 bp, Homo sapien
tctcctcccccttatgaagaaatat

SEQ ID NO: 287713 - DNA, 25 bp, Homo sapien
gaagaaatatactctctccctcgct

SEQ ID NO: 287714 - DNA, 25 bp, Homo sapien
tactctctccctcgctagaggctat

SEQ ID NO: 287715 - DNA, 25 bp, Homo sapien
gcatacaacttaggattcataacta

SEQ ID NO: 287716 - DNA, 25 bp, Homo sapien
ggattcataactacatatatacgga

SEQ ID NO: 287717 - DNA, 25 bp, Homo sapien
atatacggatagaagtgcatgaaca

SEQ ID NO: 287718 - DNA, 25 bp, Homo sapien
gaacagaaaatctgcccttctggaa

SEQ ID NO: 287719 - DNA, 25 bp, Homo sapien
ctgcccttctggaataccaaatgca

SEQ ID NO: 287720 - DNA, 25 bp, Homo sapien
aagtgactacaagcagaatttggag

SEQ ID NO: 287721 - DNA, 25 bp, Homo sapien
tggtttaagcgtggcagtttcccct

SEQ ID NO: 287722 - DNA, 25 bp, Homo sapien
tggcagtttcccctgagctctcctt

SEQ ID NO: 287723 - DNA, 25 bp, Homo sapien
tctccttcctgctggtatgtaaggc

SEQ ID NO: 287724 - DNA, 25 bp, Homo sapien
ggtatgtaaggcgtgctttgcttcc

SEQ ID NO: 287725 - DNA, 25 bp, Homo sapien
atgtaaggcgtgctttgcttcctct

SEQ ID NO: 287726 - DNA, 25 bp, Homo sapien
agggcgctgtatgcaaacatctctt

SEQ ID NO: 287727 - DNA, 25 bp, Homo sapien
gtatgcaaacatctcttgaactctg

SEQ ID NO: 287728 - DNA, 25 bp, Homo sapien
ttgaactctggagtctgctcacctt

SEQ ID NO: 287729 - DNA, 25 bp, Homo sapien
aagctcctaggtgagagacgtagca

SEQ ID NO: 287730 - DNA, 25 bp, Homo sapien
agagacgtagcagctgacagcactt

SEQ ID NO: 287731 - DNA, 25 bp, Homo sapien
acttgatttgggtggactccagcct

SEQ ID NO: 287732 - DNA, 25 bp, Homo sapien
cagcctccccagcaacaataagaga

SEQ ID NO: 287733 - DNA, 25 bp, Homo sapien
agcttgctgaaacgctgagtgcccg

SEQ ID NO: 287734 - DNA, 25 bp, Homo sapien
actctcaggtcaggtgggaccggca

SEQ ID NO: 287735 - DNA, 25 bp, Homo sapien
gagttcctgaacacttggttctcaa

SEQ ID NO: 287736 - DNA, 25 bp, Homo sapien
tggttctcaatactggccacagcca

SEQ ID NO: 287737 - DNA, 25 bp, Homo sapien
ggagctgcagcttagcctgccctcg

SEQ ID NO: 287738 - DNA, 25 bp, Homo sapien
gattgttgccctgtgtcggtaaggc

SEQ ID NO: 287739 - DNA, 25 bp, Homo sapien
tgttgccctgtgtcggtaaggcaat

SEQ ID NO: 287740 - DNA, 25 bp, Homo sapien
gccctgtgtcggtaaggcaatgttt

SEQ ID NO: 287741 - DNA, 25 bp, Homo sapien
ctgtgtcggtaaggcaatgtttgag

SEQ ID NO: 287742 - DNA, 25 bp, Homo sapien
tgtcggtaaggcaatgtttgaggca

SEQ ID NO: 287743 - DNA, 25 bp, Homo sapien
aatggacaatgaacgatttgggtga

SEQ ID NO: 287744 - DNA, 25 bp, Homo sapien
gacaatgaacgatttgggtgataaa

SEQ ID NO: 287745 - DNA, 25 bp, Homo sapien
aatcctcaaacattacgggagggag

SEQ ID NO: 287746 - DNA, 25 bp, Homo sapien
agggagtgcggtcgaggctagagtc

SEQ ID NO: 287747 - DNA, 25 bp, Homo sapien
tgctttagttgtttccgggccaccg

SEQ ID NO: 287748 - DNA, 25 bp, Homo sapien
ttgtggttgcactaatgtatactca

SEQ ID NO: 287749 - DNA, 25 bp, Homo sapien
gcactaatgtatactcactgccatt

SEQ ID NO: 287750 - DNA, 25 bp, Homo sapien
tatactcactgccattttaagaggg

SEQ ID NO: 287751 - DNA, 25 bp, Homo sapien
tgaatgtcatgtactgatatgcagt

SEQ ID NO: 287752 - DNA, 25 bp, Homo sapien
gatatgcagtagcttattgtttttc

SEQ ID NO: 287753 - DNA, 25 bp, Homo sapien
attgtttttctagttgcagagaatg

SEQ ID NO: 287754 - DNA, 25 bp, Homo sapien
gaaaggccttggagccagccaaaca

SEQ ID NO: 287755 - DNA, 25 bp, Homo sapien
ttagatggtctactttttcattgaa

SEQ ID NO: 287756 - DNA, 25 bp, Homo sapien
gagccagccaaacagaatttgttct

SEQ ID NO: 287757 - DNA, 25 bp, Homo sapien
acagaatttgttctaatggacatgg

SEQ ID NO: 287758 - DNA, 25 bp, Homo sapien
aagtttacaagtgctttgtggttgc

SEQ ID NO: 287759 - DNA, 25 bp, Homo sapien
ttggttcattacaggtaagttgtac

SEQ ID NO: 287760 - DNA, 25 bp, Homo sapien
caggtaagttgtacagttctttgcc

SEQ ID NO: 287761 - DNA, 25 bp, Homo sapien
ggtaagttgtacagttctttgccta

SEQ ID NO: 287762 - DNA, 25 bp, Homo sapien
gtaagttgtacagttctttgcctac

SEQ ID NO: 287763 - DNA, 25 bp, Homo sapien
taagttgtacagttctttgcctact

SEQ ID NO: 287764 - DNA, 25 bp, Homo sapien
agttgtacagttctttgcctactga

SEQ ID NO: 287765 - DNA, 25 bp, Homo sapien
ataataagtttgtaatgtcagaggg

SEQ ID NO: 287766 - DNA, 25 bp, Homo sapien
gggctaacacaaggaattaatattt

SEQ ID NO: 287767 - DNA, 25 bp, Homo sapien
tagagggaatgccaagagcaaagac

SEQ ID NO: 287768 - DNA, 25 bp, Homo sapien
agggaatgccaagagcaaagacata

SEQ ID NO: 287769 - DNA, 25 bp, Homo sapien
gagcaaagacatagagagttaatta

SEQ ID NO: 287770 - DNA, 25 bp, Homo sapien
gctcatgtaggctcacctttcgagt

SEQ ID NO: 287771 - DNA, 25 bp, Homo sapien
taggctcacctttcgagtgcggagg

SEQ ID NO: 287772 - DNA, 25 bp, Homo sapien
tcacctttcgagtgcggagggtgac

SEQ ID NO: 287773 - DNA, 25 bp, Homo sapien
gagtgcggagggtgacggacgcccc

SEQ ID NO: 287774 - DNA, 25 bp, Homo sapien
attcggcaccaggagagcagaagtg

SEQ ID NO: 287775 - DNA, 25 bp, Homo sapien
tggccacctgggtcgtccactgcgg

SEQ ID NO: 287776 - DNA, 25 bp, Homo sapien
actgcggccccgtggtccagcagga

SEQ ID NO: 287777 - DNA, 25 bp, Homo sapien
aagcggacaatttctgcagaccagg

SEQ ID NO: 287778 - DNA, 25 bp, Homo sapien
caatttctgcagaccaggagacgta

SEQ ID NO: 287779 - DNA, 25 bp, Homo sapien
gcagaccaggagacgtaagcccagc

SEQ ID NO: 287780 - DNA, 25 bp, Homo sapien
gccccagccgaggaagagccgggaa

SEQ ID NO: 287781 - DNA, 25 bp, Homo sapien
attgagaacctactacgcctcctgt

SEQ ID NO: 287782 - DNA, 25 bp, Homo sapien
tactacgcctcctgttatgttcctg

SEQ ID NO: 287783 - DNA, 25 bp, Homo sapien
tcctgttatgttcctgtgccaggca

SEQ ID NO: 287784 - DNA, 25 bp, Homo sapien
gtgccaggcacataacaggaaaaat

SEQ ID NO: 287785 - DNA, 25 bp, Homo sapien
aaatctctgccctggtagacattgc

SEQ ID NO: 287786 - DNA, 25 bp, Homo sapien
gccctggtagacattgcattataat

SEQ ID NO: 287787 - DNA, 25 bp, Homo sapien
gtattttatgcattctgcttttttc

SEQ ID NO: 287788 - DNA, 25 bp, Homo sapien
ccatttttactttgtcctcataaat

SEQ ID NO: 287789 - DNA, 25 bp, Homo sapien
aatactttaaatggctgtgtagcat

SEQ ID NO: 287790 - DNA, 25 bp, Homo sapien
gtgtagcatgccatcttgtttttga

SEQ ID NO: 287791 - DNA, 25 bp, Homo sapien
actgtaatttgcttaagctttctgc

SEQ ID NO: 287792 - DNA, 25 bp, Homo sapien
ggccactttaagatttgttattcca

SEQ ID NO: 287793 - DNA, 25 bp, Homo sapien
ctacaaacctttcgccaagtacaag

SEQ ID NO: 287794 - DNA, 25 bp, Homo sapien
ccattgcttattctgtaggaagatt

SEQ ID NO: 287795 - DNA, 25 bp, Homo sapien
aatataggctattcagatgttctgt

SEQ ID NO: 287796 - DNA, 25 bp, Homo sapien
tgtccgttttggtaatttgagtaat

SEQ ID NO: 287797 - DNA, 25 bp, Homo sapien
tttgcctactttatctttgtcttcc

SEQ ID NO: 287798 - DNA, 25 bp, Homo sapien
gattgtttcatctcataatggtaaa

SEQ ID NO: 287799 - DNA, 25 bp, Homo sapien
gtacaagaacatgacctgcttcctg

SEQ ID NO: 287800 - DNA, 25 bp, Homo sapien
tcctgcatctgttgatgtgtttctt

SEQ ID NO: 287801 - DNA, 25 bp, Homo sapien
tttctttcctttcccattcctatgc

SEQ ID NO: 287802 - DNA, 25 bp, Homo sapien
tatgctgcctcccttgcatacatgg

SEQ ID NO: 287803 - DNA, 25 bp, Homo sapien
gtaaagccaagcagatatcagccaa

SEQ ID NO: 287804 - DNA, 25 bp, Homo sapien
gccaagcagatatcagccaatgtgt

SEQ ID NO: 287805 - DNA, 25 bp, Homo sapien
gatatcagccaatgtgtctgagcag

SEQ ID NO: 287806 - DNA, 25 bp, Homo sapien
gtgtctgagcagtaaagatatggag

SEQ ID NO: 287807 - DNA, 25 bp, Homo sapien
tatggaggtgaatgaaacgtctcat

SEQ ID NO: 287808 - DNA, 25 bp, Homo sapien
gcagggccagaccatgcaaggcttt

SEQ ID NO: 287809 - DNA, 25 bp, Homo sapien
accatgcaaggctttgaaggctctt

SEQ ID NO: 287810 - DNA, 25 bp, Homo sapien
gaaggctcttctaaagattacggcc

SEQ ID NO: 287811 - DNA, 25 bp, Homo sapien
gctcttctaaagattacggccttca

SEQ ID NO: 287812 - DNA, 25 bp, Homo sapien
aaagattacggccttcacatgcctc

SEQ ID NO: 287813 - DNA, 25 bp, Homo sapien
ttcacatgcctctgcaattagagaa

SEQ ID NO: 287814 - DNA, 25 bp, Homo sapien
gaattttagtagagccagtaactgt

SEQ ID NO: 287815 - DNA, 25 bp, Homo sapien
gagccagtaactgttttcatacaag

SEQ ID NO: 287816 - DNA, 25 bp, Homo sapien
ccctgtgtcttcctcagcggatgtt

SEQ ID NO: 287817 - DNA, 25 bp, Homo sapien
ggatgaggctttttcttgacggttt

SEQ ID NO: 287818 - DNA, 25 bp, Homo sapien
tcttgacggttttgttttgctgtaa

SEQ ID NO: 287819 - DNA, 25 bp, Homo sapien
tttgttttgctgtaactccctcttc

SEQ ID NO: 287820 - DNA, 25 bp, Homo sapien
tgtaactccctcttcttctatactc

SEQ ID NO: 287821 - DNA, 25 bp, Homo sapien
gcataaccagggtaaattctgactt

SEQ ID NO: 287822 - DNA, 25 bp, Homo sapien
ttctgacttctaaggtttcttcctt

SEQ ID NO: 287823 - DNA, 25 bp, Homo sapien
ggtttcttccttaagtagtgtatag

SEQ ID NO: 287824 - DNA, 25 bp, Homo sapien
agtagtgtatagcttgctcaactca

SEQ ID NO: 287825 - DNA, 25 bp, Homo sapien
agttcttttagatcttatcataggg

SEQ ID NO: 287826 - DNA, 25 bp, Homo sapien
ggcagttgatgtatgcaccagctag

SEQ ID NO: 287827 - DNA, 25 bp, Homo sapien
ttgatgtatgcaccagctagaaatc

SEQ ID NO: 287828 - DNA, 25 bp, Homo sapien
gaaatctgagacttaactatgtggt

SEQ ID NO: 287829 - DNA, 25 bp, Homo sapien
actatgtggtcttgaatcttttccc

SEQ ID NO: 287830 - DNA, 25 bp, Homo sapien
gtcttgaatcttttcccatgctatt

SEQ ID NO: 287831 - DNA, 25 bp, Homo sapien
catgctattcttcctgctacaagtg

SEQ ID NO: 287832 - DNA, 25 bp, Homo sapien
attcttcctgctacaagtgactttt

SEQ ID NO: 287833 - DNA, 25 bp, Homo sapien
ttttttttactaactcagagatgct

SEQ ID NO: 287834 - DNA, 25 bp, Homo sapien
gtatagagtaacatctgtcagttct

SEQ ID NO: 287835 - DNA, 25 bp, Homo sapien
gagtaacatctgtcagttcttttag

SEQ ID NO: 287836 - DNA, 25 bp, Homo sapien
aggtcggataatagtttgaagcaac

SEQ ID NO: 287837 - DNA, 25 bp, Homo sapien
gtttgaagcaaccttgaactgattg

SEQ ID NO: 287838 - DNA, 25 bp, Homo sapien
gaactgattgctgcatgtgcaaagg

SEQ ID NO: 287839 - DNA, 25 bp, Homo sapien
gtaaggtatcaatctccaaaacaac

SEQ ID NO: 287840 - DNA, 25 bp, Homo sapien
tgccaagggaggagcgagcctttta

SEQ ID NO: 287841 - DNA, 25 bp, Homo sapien
ggagcgagccttttattagagttat

SEQ ID NO: 287842 - DNA, 25 bp, Homo sapien
tattattggcgttctcttcccttgc

SEQ ID NO: 287843 - DNA, 25 bp, Homo sapien
tcttcccttgcattcccatgtaaag

SEQ ID NO: 287844 - DNA, 25 bp, Homo sapien
gcattcccatgtaaagcccgagtag

SEQ ID NO: 287845 - DNA, 25 bp, Homo sapien
cccaatttttcaatgacggtgtcgc

SEQ ID NO: 287846 - DNA, 25 bp, Homo sapien
ctccgttcaccttgcagagctgaaa

SEQ ID NO: 287847 - DNA, 25 bp, Homo sapien
gaacttggagaaaaagtaatctcat

SEQ ID NO: 287848 - DNA, 25 bp, Homo sapien
aacttggagaaaaagtaatctcatg

SEQ ID NO: 287849 - DNA, 25 bp, Homo sapien
acttggagaaaaagtaatctcatgg

SEQ ID NO: 287850 - DNA, 25 bp, Homo sapien
atgtgactggagggtagagaacttg

SEQ ID NO: 287851 - DNA, 25 bp, Homo sapien
tgtgactggagggtagagaacttgg

SEQ ID NO: 287852 - DNA, 25 bp, Homo sapien
gtgactggagggtagagaacttgga

SEQ ID NO: 287853 - DNA, 25 bp, Homo sapien
tgactggagggtagagaacttggag

SEQ ID NO: 287854 - DNA, 25 bp, Homo sapien
gactggagggtagagaacttggaga

SEQ ID NO: 287855 - DNA, 25 bp, Homo sapien
actggagggtagagaacttggagaa

SEQ ID NO: 287856 - DNA, 25 bp, Homo sapien
atctagtttatgcagtatgatccct

SEQ ID NO: 287857 - DNA, 25 bp, Homo sapien
agtatgatccctggtatttggcaag

SEQ ID NO: 287858 - DNA, 25 bp, Homo sapien
ggtatttggcaagggctattccaga

SEQ ID NO: 287859 - DNA, 25 bp, Homo sapien
atcactgaacttgagtctcatactt

SEQ ID NO: 287860 - DNA, 25 bp, Homo sapien
ttgaccttaaagactatgaccttaa

SEQ ID NO: 287861 - DNA, 25 bp, Homo sapien
atgtccagttagattgtccttccac

SEQ ID NO: 287862 - DNA, 25 bp, Homo sapien
agttagattgtccttccactttaga

SEQ ID NO: 287863 - DNA, 25 bp, Homo sapien
gtccttccactttagacaagtttat

SEQ ID NO: 287864 - DNA, 25 bp, Homo sapien
gtttatcaagttcaattcttctgga

SEQ ID NO: 287865 - DNA, 25 bp, Homo sapien
gaatctcagcagatctccttaaaga

SEQ ID NO: 287866 - DNA, 25 bp, Homo sapien
tctccttaaagaaaagccaatgctt

SEQ ID NO: 287867 - DNA, 25 bp, Homo sapien
ccctgagggtcttaagctattctga

SEQ ID NO: 287868 - DNA, 25 bp, Homo sapien
cctgagggtcttaagctattctgag

SEQ ID NO: 287869 - DNA, 25 bp, Homo sapien
tgagggtcttaagctattctgagtc

SEQ ID NO: 287870 - DNA, 25 bp, Homo sapien
gagggtcttaagctattctgagtca

SEQ ID NO: 287871 - DNA, 25 bp, Homo sapien
agggtcttaagctattctgagtcag

SEQ ID NO: 287872 - DNA, 25 bp, Homo sapien
ggtcttaagctattctgagtcagaa

SEQ ID NO: 287873 - DNA, 25 bp, Homo sapien
tctgagtcagaatacagttgaccct

SEQ ID NO: 287874 - DNA, 25 bp, Homo sapien
acctctgccacccaagatagcaaga

SEQ ID NO: 287875 - DNA, 25 bp, Homo sapien
catcctcagcctattcaacatgaag

SEQ ID NO: 287876 - DNA, 25 bp, Homo sapien
tctcttccttataatcttaacaaac

SEQ ID NO: 287877 - DNA, 25 bp, Homo sapien
ttaacaaacattttctcttctctag

SEQ ID NO: 287878 - DNA, 25 bp, Homo sapien
tttactttgttctgagcccttctca

SEQ ID NO: 287879 - DNA, 25 bp, Homo sapien
tgagcccttctcaggcagaggaggt

SEQ ID NO: 287880 - DNA, 25 bp, Homo sapien
gagcccttctcaggcagaggaggtc

SEQ ID NO: 287881 - DNA, 25 bp, Homo sapien
cccttctcaggcagaggaggtcagg

SEQ ID NO: 287882 - DNA, 25 bp, Homo sapien
cttctcaggcagaggaggtcaggca

SEQ ID NO: 287883 - DNA, 25 bp, Homo sapien
gaggtcaggcaggtacacgtgcctt

SEQ ID NO: 287884 - DNA, 25 bp, Homo sapien
aggtcaggcaggtacacgtgccttt

SEQ ID NO: 287885 - DNA, 25 bp, Homo sapien
ggtcaggcaggtacacgtgcctttg

SEQ ID NO: 287886 - DNA, 25 bp, Homo sapien
tcaggcaggtacacgtgcctttggg

SEQ ID NO: 287887 - DNA, 25 bp, Homo sapien
aggcaggtacacgtgcctttgggaa

SEQ ID NO: 287888 - DNA, 25 bp, Homo sapien
gcaggtacacgtgcctttgggaaga

SEQ ID NO: 287889 - DNA, 25 bp, Homo sapien
gatgatttaaaatccaaccgattat

SEQ ID NO: 287890 - DNA, 25 bp, Homo sapien
aagccagtgtgattgatcatcttga

SEQ ID NO: 287891 - DNA, 25 bp, Homo sapien
tttaacattcttacatcccttctag

SEQ ID NO: 287892 - DNA, 25 bp, Homo sapien
cttctagccgtcaaactctgatcga

SEQ ID NO: 287893 - DNA, 25 bp, Homo sapien
aaactctgatcgacttacacttaag

SEQ ID NO: 287894 - DNA, 25 bp, Homo sapien
aagactgtgtctttggtagcctacc

SEQ ID NO: 287895 - DNA, 25 bp, Homo sapien
gtgtctttggtagcctaccctattc

SEQ ID NO: 287896 - DNA, 25 bp, Homo sapien
acttttattacaaaggcagctctta

SEQ ID NO: 287897 - DNA, 25 bp, Homo sapien
ataaatccatctcttcaggctcgaa

SEQ ID NO: 287898 - DNA, 25 bp, Homo sapien
aggctcgaactgcaaaacacacgtc

SEQ ID NO: 287899 - DNA, 25 bp, Homo sapien
aacacacgtcgagaggtgacaatgt

SEQ ID NO: 287900 - DNA, 25 bp, Homo sapien
atgcactagtcagggtcctggaaca

SEQ ID NO: 287901 - DNA, 25 bp, Homo sapien
cagtccagagaagcggtgggagcca

SEQ ID NO: 287902 - DNA, 25 bp, Homo sapien
gaagcggtgggagccagtcaggaaa

SEQ ID NO: 287903 - DNA, 25 bp, Homo sapien
aagacattttgggatctgattgtta

SEQ ID NO: 287904 - DNA, 25 bp, Homo sapien
gggatctgattgttaaatgccaaaa

SEQ ID NO: 287905 - DNA, 25 bp, Homo sapien
ctatcaggaggagggaccagcacaa

SEQ ID NO: 287906 - DNA, 25 bp, Homo sapien
aggagggaccagcacaagcacctta

SEQ ID NO: 287907 - DNA, 25 bp, Homo sapien
gaccagcacaagcaccttacagagt

SEQ ID NO: 287908 - DNA, 25 bp, Homo sapien
aagcaccttacagagtgcatgcact

SEQ ID NO: 287909 - DNA, 25 bp, Homo sapien
gagtgcatgcactagtcagggtcct

SEQ ID NO: 287910 - DNA, 25 bp, Homo sapien
tgcatgcactagtcagggtcctgga

SEQ ID NO: 287911 - DNA, 25 bp, Homo sapien
tcatagagtgtcctcggcttacctt

SEQ ID NO: 287912 - DNA, 25 bp, Homo sapien
tacctttctgtctggagggtgtcta

SEQ ID NO: 287913 - DNA, 25 bp, Homo sapien
gggtgtctactcaattcaagcgtaa

SEQ ID NO: 287914 - DNA, 25 bp, Homo sapien
gacccaattttcctattttgccatt

SEQ ID NO: 287915 - DNA, 25 bp, Homo sapien
cattccagtggtttttggcaagcca

SEQ ID NO: 287916 - DNA, 25 bp, Homo sapien
ttttggcaagccaggacacccgttc

SEQ ID NO: 287917 - DNA, 25 bp, Homo sapien
ccgttcatcctttcggaaactgatc

SEQ ID NO: 287918 - DNA, 25 bp, Homo sapien
actgatctagctgtcatgtttgcct

SEQ ID NO: 287919 - DNA, 25 bp, Homo sapien
atgtttgccttagctgagccaggaa

SEQ ID NO: 287920 - DNA, 25 bp, Homo sapien
cacacagactctttgttgggccagt

SEQ ID NO: 287921 - DNA, 25 bp, Homo sapien
ggccagtcaaatctctgctcattta

SEQ ID NO: 287922 - DNA, 25 bp, Homo sapien
tttttagaactactcaactgtgtgg

SEQ ID NO: 287923 - DNA, 25 bp, Homo sapien
agaactactcaactgtgtggtaaca

SEQ ID NO: 287924 - DNA, 25 bp, Homo sapien
ttcttaccaatttccccaactatgt

SEQ ID NO: 287925 - DNA, 25 bp, Homo sapien
tttccccaactatgttgcacatcag

SEQ ID NO: 287926 - DNA, 25 bp, Homo sapien
cccctttattggaatgcatgttttc

SEQ ID NO: 287927 - DNA, 25 bp, Homo sapien
ggaatgcatgttttcattgccttct

SEQ ID NO: 287928 - DNA, 25 bp, Homo sapien
tctcctttcaaagtgtacgtttgtg

SEQ ID NO: 287929 - DNA, 25 bp, Homo sapien
gtacgtttgtgtgttcatcacctta

SEQ ID NO: 287930 - DNA, 25 bp, Homo sapien
gtgttcatcaccttaaattatctta

SEQ ID NO: 287931 - DNA, 25 bp, Homo sapien
atactaatttaaactctggagccca

SEQ ID NO: 287932 - DNA, 25 bp, Homo sapien
tctggagcccataatatctacataa

SEQ ID NO: 287933 - DNA, 25 bp, Homo sapien
atttgtaccgtgctttaaacataca

SEQ ID NO: 287934 - DNA, 25 bp, Homo sapien
tttgtaccgtgctttaaacatacac

SEQ ID NO: 287935 - DNA, 25 bp, Homo sapien
tgtaccgtgctttaaacatacacaa

SEQ ID NO: 287936 - DNA, 25 bp, Homo sapien
ttaaacatacacaatggttctaaat

SEQ ID NO: 287937 - DNA, 25 bp, Homo sapien
acacaatggttctaaataactactt

SEQ ID NO: 287938 - DNA, 25 bp, Homo sapien
cagtctgtgaggttgtgcgagcgtg

SEQ ID NO: 287939 - DNA, 25 bp, Homo sapien
gtgcgagcgtgaaagctccacagtc

SEQ ID NO: 287940 - DNA, 25 bp, Homo sapien
tgcgagcgtgaaagctccacagtct

SEQ ID NO: 287941 - DNA, 25 bp, Homo sapien
gcgagcgtgaaagctccacagtctg

SEQ ID NO: 287942 - DNA, 25 bp, Homo sapien
gagcgtgaaagctccacagtctgag

SEQ ID NO: 287943 - DNA, 25 bp, Homo sapien
agcgtgaaagctccacagtctgagg

SEQ ID NO: 287944 - DNA, 25 bp, Homo sapien
aggaccaaggctcacgaaatctaag

SEQ ID NO: 287945 - DNA, 25 bp, Homo sapien
aatctaaggtgacaagcctgtggtc

SEQ ID NO: 287946 - DNA, 25 bp, Homo sapien
acaagcctgtggtcaaatagcaagt

SEQ ID NO: 287947 - DNA, 25 bp, Homo sapien
tagcaagtggtagtcaagccaggat

SEQ ID NO: 287948 - DNA, 25 bp, Homo sapien
agccaggataagaattccagtctcc

SEQ ID NO: 287949 - DNA, 25 bp, Homo sapien
tatttattactgttgctctgcttgt

SEQ ID NO: 287950 - DNA, 25 bp, Homo sapien
gagctcagaagtattttagacattt

SEQ ID NO: 287951 - DNA, 25 bp, Homo sapien
aagtaacccctctgaaattctgctg

SEQ ID NO: 287952 - DNA, 25 bp, Homo sapien
aattctgctgtatttcagtccaggc

SEQ ID NO: 287953 - DNA, 25 bp, Homo sapien
gtatttcagtccaggctttgttctg

SEQ ID NO: 287954 - DNA, 25 bp, Homo sapien
aggctttgttctggccatatgtaca

SEQ ID NO: 287955 - DNA, 25 bp, Homo sapien
tgcctccgcagaaggaagcctcttt

SEQ ID NO: 287956 - DNA, 25 bp, Homo sapien
gctggcaggtggctaaccccattta

SEQ ID NO: 287957 - DNA, 25 bp, Homo sapien
gcaggtggctaaccccatttagcat

SEQ ID NO: 287958 - DNA, 25 bp, Homo sapien
ggtggctaaccccatttagcatctc

SEQ ID NO: 287959 - DNA, 25 bp, Homo sapien
gctaaccccatttagcatctccagg

SEQ ID NO: 287960 - DNA, 25 bp, Homo sapien
aggccctgccatggtgtctcatctt

SEQ ID NO: 287961 - DNA, 25 bp, Homo sapien
ccatggtgtctcatcttgctgttat

SEQ ID NO: 287962 - DNA, 25 bp, Homo sapien
ttgctgttatctctagctctttccc

SEQ ID NO: 287963 - DNA, 25 bp, Homo sapien
tggattgcaccttgatgcctcctga

SEQ ID NO: 287964 - DNA, 25 bp, Homo sapien
attgcaccttgatgcctcctgagga

SEQ ID NO: 287965 - DNA, 25 bp, Homo sapien
agccttatccaagtcgctctgtcca

SEQ ID NO: 287966 - DNA, 25 bp, Homo sapien
agcaatacataggacattggccaat

SEQ ID NO: 287967 - DNA, 25 bp, Homo sapien
gacattggccaattaagaattttga

SEQ ID NO: 287968 - DNA, 25 bp, Homo sapien
gataaatattcctctcataaagtga

SEQ ID NO: 287969 - DNA, 25 bp, Homo sapien
aagagactgcttgctgggtgttcgt

SEQ ID NO: 287970 - DNA, 25 bp, Homo sapien
ctgcttgctgggtgttcgtcaaaat

SEQ ID NO: 287971 - DNA, 25 bp, Homo sapien
ctgggtgttcgtcaaaatggagtta

SEQ ID NO: 287972 - DNA, 25 bp, Homo sapien
gttagatggtctgtcccagactccc

SEQ ID NO: 287973 - DNA, 25 bp, Homo sapien
gactcccctgttgttagttctgaga

SEQ ID NO: 287974 - DNA, 25 bp, Homo sapien
taatggtgcttcttcaggactggct

SEQ ID NO: 287975 - DNA, 25 bp, Homo sapien
gcttcttcaggactggctcatagaa

SEQ ID NO: 287976 - DNA, 25 bp, Homo sapien
gctcatagaaacctgccgtgttcag

SEQ ID NO: 287977 - DNA, 25 bp, Homo sapien
aaaaaccctactagctgtgcagcgg

SEQ ID NO: 287978 - DNA, 25 bp, Homo sapien
aaccctactagctgtgcagcggagt

SEQ ID NO: 287979 - DNA, 25 bp, Homo sapien
tgtgcagcggagtggtgcgcacctg

SEQ ID NO: 287980 - DNA, 25 bp, Homo sapien
acctgtggtccctaactacaagcta

SEQ ID NO: 287981 - DNA, 25 bp, Homo sapien
gtccctaactacaagctactcagaa

SEQ ID NO: 287982 - DNA, 25 bp, Homo sapien
actcagaaggcaaggtaggagcatc

SEQ ID NO: 287983 - DNA, 25 bp, Homo sapien
gtcaaggctgcactgttcataccat

SEQ ID NO: 287984 - DNA, 25 bp, Homo sapien
aaggctgcactgttcataccattgc

SEQ ID NO: 287985 - DNA, 25 bp, Homo sapien
gctgcactgttcataccattgcact

SEQ ID NO: 287986 - DNA, 25 bp, Homo sapien
aacaatctcagtaataatgaacact

SEQ ID NO: 287987 - DNA, 25 bp, Homo sapien
aatgaacactgtggctgggtttggt

SEQ ID NO: 287988 - DNA, 25 bp, Homo sapien
agatccaatgttttttctaaagatg

SEQ ID NO: 287989 - DNA, 25 bp, Homo sapien
aacccacaactcctaaataatacag

SEQ ID NO: 287990 - DNA, 25 bp, Homo sapien
gaaagttttgtgtttgactgtatac

SEQ ID NO: 287991 - DNA, 25 bp, Homo sapien
gtgtttgttcaagctaagtggttca

SEQ ID NO: 287992 - DNA, 25 bp, Homo sapien
aagtggttcatcatggtgacagcat

SEQ ID NO: 287993 - DNA, 25 bp, Homo sapien
gtgaaggtgggagcaccttgaccca

SEQ ID NO: 287994 - DNA, 25 bp, Homo sapien
cccagggatgtgatggtttattgag

SEQ ID NO: 287995 - DNA, 25 bp, Homo sapien
gatatagcagggaatgttactagaa

SEQ ID NO: 287996 - DNA, 25 bp, Homo sapien
aactgatgatatcctatcctctcca

SEQ ID NO: 287997 - DNA, 25 bp, Homo sapien
gatgatatcctatcctctccaagct

SEQ ID NO: 287998 - DNA, 25 bp, Homo sapien
tctccaagctcctattccaggaaaa

SEQ ID NO: 287999 - DNA, 25 bp, Homo sapien
gtgtgtattcctttaatcctgtcat

SEQ ID NO: 288000 - DNA, 25 bp, Homo sapien
gtattcctttaatcctgtcatcagc

SEQ ID NO: 288001 - DNA, 25 bp, Homo sapien
tcctttaatcctgtcatcagctcta

SEQ ID NO: 288002 - DNA, 25 bp, Homo sapien
agtataagttatcatctccagttta

SEQ ID NO: 288003 - DNA, 25 bp, Homo sapien
ctccagtttatagttgaggcacaaa

SEQ ID NO: 288004 - DNA, 25 bp, Homo sapien
gttaaatgagtagcccaaatcaaaa

SEQ ID NO: 288005 - DNA, 25 bp, Homo sapien
aaaaaagactatagccaggattcaa

SEQ ID NO: 288006 - DNA, 25 bp, Homo sapien
agagccccagcccaaagcttgtact

SEQ ID NO: 288007 - DNA, 25 bp, Homo sapien
ccagcccaaagcttgtactcttggc

SEQ ID NO: 288008 - DNA, 25 bp, Homo sapien
gtactcttggccactcttgtatata

SEQ ID NO: 288009 - DNA, 25 bp, Homo sapien
tcttggccactcttgtatatacttc

SEQ ID NO: 288010 - DNA, 25 bp, Homo sapien
gcagcaatatgccatgttcatggtg

SEQ ID NO: 288011 - DNA, 25 bp, Homo sapien
aatcagttgtggatctcaggtggga

SEQ ID NO: 288012 - DNA, 25 bp, Homo sapien
aggctcccaactttgacttctctac

SEQ ID NO: 288013 - DNA, 25 bp, Homo sapien
tctactctcaccaggccatgttaac

SEQ ID NO: 288014 - DNA, 25 bp, Homo sapien
ggccatgttaacactgtaaaaccaa

SEQ ID NO: 288015 - DNA, 25 bp, Homo sapien
aaccaaactctttgctaagaacaat

SEQ ID NO: 288016 - DNA, 25 bp, Homo sapien
cagggcagtagtttagtctgctgat

SEQ ID NO: 288017 - DNA, 25 bp, Homo sapien
gtctgctgatgaaaccttgtgcttc

SEQ ID NO: 288018 - DNA, 25 bp, Homo sapien
tgatgaaaccttgtgcttccaagaa

SEQ ID NO: 288019 - DNA, 25 bp, Homo sapien
aagattccaaagtgcttttacagag

SEQ ID NO: 288020 - DNA, 25 bp, Homo sapien
aatatattcctaaagggcagcaata

SEQ ID NO: 288021 - DNA, 25 bp, Homo sapien
gataccaagcaagcagtgttccaat

SEQ ID NO: 288022 - DNA, 25 bp, Homo sapien
gttccaataatcacaagtctatgct

SEQ ID NO: 288023 - DNA, 25 bp, Homo sapien
ctatgctgtttcttaaagtctccat

SEQ ID NO: 288024 - DNA, 25 bp, Homo sapien
aaagtctccatatcgatgaagtaga

SEQ ID NO: 288025 - DNA, 25 bp, Homo sapien
aaagctgcaccactcattattgaat

SEQ ID NO: 288026 - DNA, 25 bp, Homo sapien
gaatatttcactctgactaaccaaa

SEQ ID NO: 288027 - DNA, 25 bp, Homo sapien
agttattcatgtacaggtctggacc

SEQ ID NO: 288028 - DNA, 25 bp, Homo sapien
agcatgcttgcaccggttgtatatt

SEQ ID NO: 288029 - DNA, 25 bp, Homo sapien
gcaccggttgtatattgtcgtacta

SEQ ID NO: 288030 - DNA, 25 bp, Homo sapien
tgtcgtactaacatccagaggcagt

SEQ ID NO: 288031 - DNA, 25 bp, Homo sapien
atccagaggcagtatgaagacaata

SEQ ID NO: 288032 - DNA, 25 bp, Homo sapien
gattttccttgaactccaggaggtg

SEQ ID NO: 288033 - DNA, 25 bp, Homo sapien
gaactccaggaggtgctaagaaagc

SEQ ID NO: 288034 - DNA, 25 bp, Homo sapien
aagaaagcttcgtgactgtggcaga

SEQ ID NO: 288035 - DNA, 25 bp, Homo sapien
cttcgtgactgtggcagatgcggct

SEQ ID NO: 288036 - DNA, 25 bp, Homo sapien
gcccgcgccagttgggaaagtgact

SEQ ID NO: 288037 - DNA, 25 bp, Homo sapien
gctccccgccagttgggaaagtgac

SEQ ID NO: 288038 - DNA, 25 bp, Homo sapien
aagtgactccttcctgtgggcagaa

SEQ ID NO: 288039 - DNA, 25 bp, Homo sapien
gagccctcgggctctgagagtcacg

SEQ ID NO: 288040 - DNA, 25 bp, Homo sapien
gaagccgcaccctcttcgtgggtgc

SEQ ID NO: 288041 - DNA, 25 bp, Homo sapien
tgggtgcgatgctgtgaacgtcttc

SEQ ID NO: 288042 - DNA, 25 bp, Homo sapien
gctgtgaacgtcttccttcaaggaa

SEQ ID NO: 288043 - DNA, 25 bp, Homo sapien
tgaaaaaggccagaaactagcagat

SEQ ID NO: 288044 - DNA, 25 bp, Homo sapien
gatagaaatggaacccgttgactta

SEQ ID NO: 288045 - DNA, 25 bp, Homo sapien
tagttcccttataagaagttcttgc

SEQ ID NO: 288046 - DNA, 25 bp, Homo sapien
gttcttgcaaacaactctgtgacgt

SEQ ID NO: 288047 - DNA, 25 bp, Homo sapien
gtgacgttttcattcaagtggatat

SEQ ID NO: 288048 - DNA, 25 bp, Homo sapien
cattcaagtggatatgttggacaaa

SEQ ID NO: 288049 - DNA, 25 bp, Homo sapien
cagttttagtttacgcgaacagtat

SEQ ID NO: 288050 - DNA, 25 bp, Homo sapien
tggtggacgccatttttttagaagt

SEQ ID NO: 288051 - DNA, 25 bp, Homo sapien
agcctgacccaagttgcctattttt

SEQ ID NO: 288052 - DNA, 25 bp, Homo sapien
acccaagttgcctatttttaatgtg

SEQ ID NO: 288053 - DNA, 25 bp, Homo sapien
ttttaatgtgttactgcatcttatt

SEQ ID NO: 288054 - DNA, 25 bp, Homo sapien
tggaggttcacgtacttcaagcata

SEQ ID NO: 288055 - DNA, 25 bp, Homo sapien
gtacttcaagcatatttttcggaca

SEQ ID NO: 288056 - DNA, 25 bp, Homo sapien
gcatatttttcggacaggcgtaact

SEQ ID NO: 288057 - DNA, 25 bp, Homo sapien
caggcgtaacttaggtgtccacttt

SEQ ID NO: 288058 - DNA, 25 bp, Homo sapien
gtgtccacttttcccacaaacataa

SEQ ID NO: 288059 - DNA, 25 bp, Homo sapien
agattcatcaaagtagttctgcctt

SEQ ID NO: 288060 - DNA, 25 bp, Homo sapien
agttctgcctttgggtgaactcggc

SEQ ID NO: 288061 - DNA, 25 bp, Homo sapien
tttgggtgaactcggctgcccttct

SEQ ID NO: 288062 - DNA, 25 bp, Homo sapien
gcataaggctgtcaaagagtaggat

SEQ ID NO: 288063 - DNA, 25 bp, Homo sapien
agagtaggattctccccttaatctt

SEQ ID NO: 288064 - DNA, 25 bp, Homo sapien
ttctccccttaatcttctctgtctt

SEQ ID NO: 288065 - DNA, 25 bp, Homo sapien
gagccctgcgccatgtgcgccatgg

SEQ ID NO: 288066 - DNA, 25 bp, Homo sapien
ggtgcacgcacgcatcctgcgcgtc

SEQ ID NO: 288067 - DNA, 25 bp, Homo sapien
gcatcctgcgcgtcttctacggtgc

SEQ ID NO: 288068 - DNA, 25 bp, Homo sapien
atcctgcgcgtcttctacggtgcgc

SEQ ID NO: 288069 - DNA, 25 bp, Homo sapien
gcgcgtcttctacggtgcgccctcg

SEQ ID NO: 288070 - DNA, 25 bp, Homo sapien
ccgctggctggaccccgacacgtag

SEQ ID NO: 288071 - DNA, 25 bp, Homo sapien
tggaccccgacacgtaggcgccgcc

SEQ ID NO: 288072 - DNA, 25 bp, Homo sapien
ggctacgacctgtacgtgacccgcg

SEQ ID NO: 288073 - DNA, 25 bp, Homo sapien
gctacgacctgtacgtgacccgcga

SEQ ID NO: 288074 - DNA, 25 bp, Homo sapien
ctacgacctgtacgtgacccgcgag

SEQ ID NO: 288075 - DNA, 25 bp, Homo sapien
acctgtacgtgacccgcgagccctg

SEQ ID NO: 288076 - DNA, 25 bp, Homo sapien
aattgtagacaatttagatggctaa

SEQ ID NO: 288077 - DNA, 25 bp, Homo sapien
ggctaaatgttagacgattttacta

SEQ ID NO: 288078 - DNA, 25 bp, Homo sapien
gagaaaaaacacttatccctttcat

SEQ ID NO: 288079 - DNA, 25 bp, Homo sapien
tttgctgaggatttactaagttgct

SEQ ID NO: 288080 - DNA, 25 bp, Homo sapien
gaggatttactaagttgctaggtac

SEQ ID NO: 288081 - DNA, 25 bp, Homo sapien
tactaagttgctaggtacagagtta

SEQ ID NO: 288082 - DNA, 25 bp, Homo sapien
agttgctaggtacagagttaaatga

SEQ ID NO: 288083 - DNA, 25 bp, Homo sapien
agataatgacagttgaaagtaggct

SEQ ID NO: 288084 - DNA, 25 bp, Homo sapien
gggaattatgttttaccacagcttt

SEQ ID NO: 288085 - DNA, 25 bp, Homo sapien
attatgttttaccacagctttatct

SEQ ID NO: 288086 - DNA, 25 bp, Homo sapien
taagcataggttggaattgtagaca

SEQ ID NO: 288087 - DNA, 25 bp, Homo sapien
ccaagtccagcgtctaggccagcag

SEQ ID NO: 288088 - DNA, 25 bp, Homo sapien
caagtccagcgtctaggccagcagg

SEQ ID NO: 288089 - DNA, 25 bp, Homo sapien
aagtccagcgtctaggccagcaggc

SEQ ID NO: 288090 - DNA, 25 bp, Homo sapien
tgcgccgcgtgctggaccagcagca

SEQ ID NO: 288091 - DNA, 25 bp, Homo sapien
gggccgggcggctggtggtactgct

SEQ ID NO: 288092 - DNA, 25 bp, Homo sapien
gccgggcggctggtggtactgctca

SEQ ID NO: 288093 - DNA, 25 bp, Homo sapien
gggcggctggtggtactgctcaggc

SEQ ID NO: 288094 - DNA, 25 bp, Homo sapien
ctgcaggagcgcatgatgagtctgc

SEQ ID NO: 288095 - DNA, 25 bp, Homo sapien
tgcaggagcgcatgatgagtctgct

SEQ ID NO: 288096 - DNA, 25 bp, Homo sapien
ggagcgcatgatgagtctgctggag

SEQ ID NO: 288097 - DNA, 25 bp, Homo sapien
atcaccaagtccagcgtctaggcca

SEQ ID NO: 288098 - DNA, 25 bp, Homo sapien
agcagtcatagatttcatgtggctg

SEQ ID NO: 288099 - DNA, 25 bp, Homo sapien
catgtggctgtttcttatactgacc

SEQ ID NO: 288100 - DNA, 25 bp, Homo sapien
tgctgtccaaatatagacttctcat

SEQ ID NO: 288101 - DNA, 25 bp, Homo sapien
atatagacttctcatggtaaaacat

SEQ ID NO: 288102 - DNA, 25 bp, Homo sapien
atggtaaaacatgatctaaggagag

SEQ ID NO: 288103 - DNA, 25 bp, Homo sapien
aatttagaggttttagactggcatc

SEQ ID NO: 288104 - DNA, 25 bp, Homo sapien
gaggttttagactggcatctgcttc

SEQ ID NO: 288105 - DNA, 25 bp, Homo sapien
actggcatctgcttctaaattctgt

SEQ ID NO: 288106 - DNA, 25 bp, Homo sapien
ggcatctgcttctaaattctgtttt

SEQ ID NO: 288107 - DNA, 25 bp, Homo sapien
agtcttcactgggagctttatagga

SEQ ID NO: 288108 - DNA, 25 bp, Homo sapien
cactgggagctttataggagtactg

SEQ ID NO: 288109 - DNA, 25 bp, Homo sapien
gcacctgccatagtgatggactgag

SEQ ID NO: 288110 - DNA, 25 bp, Homo sapien
tagtgagtactgagtgctgagtgct

SEQ ID NO: 288111 - DNA, 25 bp, Homo sapien
gctgagtgctgatactgagcacaga

SEQ ID NO: 288112 - DNA, 25 bp, Homo sapien
gtattgagcaccgagtactgagcat

SEQ ID NO: 288113 - DNA, 25 bp, Homo sapien
agcaccgagtactgagcatgggcca

SEQ ID NO: 288114 - DNA, 25 bp, Homo sapien
cagctgggttttgggcccatttcac

SEQ ID NO: 288115 - DNA, 25 bp, Homo sapien
gggtgcccctaactgggatccctgc

SEQ ID NO: 288116 - DNA, 25 bp, Homo sapien
taactgggatccctgccatgcacat

SEQ ID NO: 288117 - DNA, 25 bp, Homo sapien
ctgcccaagtggtttttcctcaagc

SEQ ID NO: 288118 - DNA, 25 bp, Homo sapien
gtttttcctcaagcccattgggtgg

SEQ ID NO: 288119 - DNA, 25 bp, Homo sapien
gctgaagtttctctaagaagggaac

SEQ ID NO: 288120 - DNA, 25 bp, Homo sapien
tccagtcacctccttcattgagaag

SEQ ID NO: 288121 - DNA, 25 bp, Homo sapien
gggcatattaggcatccatctggat

SEQ ID NO: 288122 - DNA, 25 bp, Homo sapien
atccatctggataaatgacccctga

SEQ ID NO: 288123 - DNA, 25 bp, Homo sapien
ctggataaatgacccctgagcaagg

SEQ ID NO: 288124 - DNA, 25 bp, Homo sapien
tgagcaaggtgttagcccacctacc

SEQ ID NO: 288125 - DNA, 25 bp, Homo sapien
cacattctactctgaacctggcata

SEQ ID NO: 288126 - DNA, 25 bp, Homo sapien
tactctgaacctggcataaactgaa

SEQ ID NO: 288127 - DNA, 25 bp, Homo sapien
gggtcagtgggcctattcctgttcc

SEQ ID NO: 288128 - DNA, 25 bp, Homo sapien
ttttccattggataagactcgcata

SEQ ID NO: 288129 - DNA, 25 bp, Homo sapien
gataagactcgcatacagttgggtt

SEQ ID NO: 288130 - DNA, 25 bp, Homo sapien
actcgcatacagttgggtttggtga

SEQ ID NO: 288131 - DNA, 25 bp, Homo sapien
gagactcgtcaaagcaaattataac

SEQ ID NO: 288132 - DNA, 25 bp, Homo sapien
gcaaattataacgaccagtactatt

SEQ ID NO: 288133 - DNA, 25 bp, Homo sapien
cagtgagatcaaaggctggtttcta

SEQ ID NO: 288134 - DNA, 25 bp, Homo sapien
ggaattcctaaattctagctttcaa

SEQ ID NO: 288135 - DNA, 25 bp, Homo sapien
agctttcaaatactactgtttccaa

SEQ ID NO: 288136 - DNA, 25 bp, Homo sapien
ctgtttccaacagtgaatccttgac

SEQ ID NO: 288137 - DNA, 25 bp, Homo sapien
agtgaatccttgacagagactgaat

SEQ ID NO: 288138 - DNA, 25 bp, Homo sapien
gactgaatgcagatggaattttgaa

SEQ ID NO: 288139 - DNA, 25 bp, Homo sapien
aaacattttcagtagctacctcctc

SEQ ID NO: 288140 - DNA, 25 bp, Homo sapien
ctcctctcctgaaattcctataagt

SEQ ID NO: 288141 - DNA, 25 bp, Homo sapien
aaatcctttaatataacatgtccat

SEQ ID NO: 288142 - DNA, 25 bp, Homo sapien
atttgtgtttcccttcaactctaga

SEQ ID NO: 288143 - DNA, 25 bp, Homo sapien
gtgtttcccttcaactctagaatgt

SEQ ID NO: 288144 - DNA, 25 bp, Homo sapien
tcccttcaactctagaatgtaagca

SEQ ID NO: 288145 - DNA, 25 bp, Homo sapien
tttgcctaacagcattaacatctaa

SEQ ID NO: 288146 - DNA, 25 bp, Homo sapien
gcctaacagcattaacatctaactt

SEQ ID NO: 288147 - DNA, 25 bp, Homo sapien
aacatctaacttaatgacaaggagg

SEQ ID NO: 288148 - DNA, 25 bp, Homo sapien
gaaggagattcttagaggcagtaga

SEQ ID NO: 288149 - DNA, 25 bp, Homo sapien
gcagtagaaaatggtcaagtgttca

SEQ ID NO: 288150 - DNA, 25 bp, Homo sapien
gatggcctttcattatatatcttta

SEQ ID NO: 288151 - DNA, 25 bp, Homo sapien
gcctttcattatatatctttagttc

SEQ ID NO: 288152 - DNA, 25 bp, Homo sapien
tctttagttctttctggcagatttg

SEQ ID NO: 288153 - DNA, 25 bp, Homo sapien
agtgttactctttctcagcttaacg

SEQ ID NO: 288154 - DNA, 25 bp, Homo sapien
tactctttctcagcttaacgttttt

SEQ ID NO: 288155 - DNA, 25 bp, Homo sapien
aggcaggatgtatcaatgcatgtca

SEQ ID NO: 288156 - DNA, 25 bp, Homo sapien
tttacatttcttgggattcgaagag

SEQ ID NO: 288157 - DNA, 25 bp, Homo sapien
gagttgaacttcaggttgccgtggt

SEQ ID NO: 288158 - DNA, 25 bp, Homo sapien
caggttgccgtggttacagtgtaca

SEQ ID NO: 288159 - DNA, 25 bp, Homo sapien
gtatatattatcagtctgtaccagt

SEQ ID NO: 288160 - DNA, 25 bp, Homo sapien
gtctgtaccagtagaccagtaccct

SEQ ID NO: 288161 - DNA, 25 bp, Homo sapien
agtagaccagtaccctaactactga

SEQ ID NO: 288162 - DNA, 25 bp, Homo sapien
gggcaggttatcacaacctaagagt

SEQ ID NO: 288163 - DNA, 25 bp, Homo sapien
aacatgggaatgaattctagagacc

SEQ ID NO: 288164 - DNA, 25 bp, Homo sapien
aaagccttgcttcctggagagcttt

SEQ ID NO: 288165 - DNA, 25 bp, Homo sapien
gcttcctggagagctttgagattct

SEQ ID NO: 288166 - DNA, 25 bp, Homo sapien
ggagagctttgagattctggtacaa

SEQ ID NO: 288167 - DNA, 25 bp, Homo sapien
ttgcattttaaaagtgcccggactt

SEQ ID NO: 288168 - DNA, 25 bp, Homo sapien
gagattctggtacaaaaggcatttt

SEQ ID NO: 288169 - DNA, 25 bp, Homo sapien
aagcacaaagtggaaaagcatcatt

SEQ ID NO: 288170 - DNA, 25 bp, Homo sapien
attcatattcatttgctgctgcggc

SEQ ID NO: 288171 - DNA, 25 bp, Homo sapien
attcatttgctgctgcggcatttct

SEQ ID NO: 288172 - DNA, 25 bp, Homo sapien
tgcggcatttctccctggaatcttc

SEQ ID NO: 288173 - DNA, 25 bp, Homo sapien
ccccgagtgaaagtcccattcaaag

SEQ ID NO: 288174 - DNA, 25 bp, Homo sapien
gaaagtcccattcaaagccttgctt

SEQ ID NO: 288175 - DNA, 25 bp, Homo sapien
agaagcctatctatgttctctggcg

SEQ ID NO: 288176 - DNA, 25 bp, Homo sapien
atgttctctggcgaccttcctataa

SEQ ID NO: 288177 - DNA, 25 bp, Homo sapien
gaccttcctataagcaggccacttt

SEQ ID NO: 288178 - DNA, 25 bp, Homo sapien
ataagcaggccactttctgaataaa

SEQ ID NO: 288179 - DNA, 25 bp, Homo sapien
taatgcatgcataagacagaaccat

SEQ ID NO: 288180 - DNA, 25 bp, Homo sapien
accaatttcaaggagccagagcaat

SEQ ID NO: 288181 - DNA, 25 bp, Homo sapien
caaggagccagagcaattttgcata

SEQ ID NO: 288182 - DNA, 25 bp, Homo sapien
gaccctgtactttcctagaatgttg

SEQ ID NO: 288183 - DNA, 25 bp, Homo sapien
gtactttcctagaatgttgtgcgca

SEQ ID NO: 288184 - DNA, 25 bp, Homo sapien
tgttgtgcgcaagatggtgagcatt

SEQ ID NO: 288185 - DNA, 25 bp, Homo sapien
ggtgagcattgaatactggcatgtt

SEQ ID NO: 288186 - DNA, 25 bp, Homo sapien
acttcctcattcattgagcttttta

SEQ ID NO: 288187 - DNA, 25 bp, Homo sapien
ttaaaagatcacaacctcaagatgg

SEQ ID NO: 288188 - DNA, 25 bp, Homo sapien
ggttaaaatccattgacatttgcac

SEQ ID NO: 288189 - DNA, 25 bp, Homo sapien
gacatttgcactttcaaacatgaca

SEQ ID NO: 288190 - DNA, 25 bp, Homo sapien
acatgacaagtctcggagctgctga

SEQ ID NO: 288191 - DNA, 25 bp, Homo sapien
tggcctttccacttatgcctccttt

SEQ ID NO: 288192 - DNA, 25 bp, Homo sapien
gcccaggtctggagttactttcata

SEQ ID NO: 288193 - DNA, 25 bp, Homo sapien
actttcatagcatttttcactcttg

SEQ ID NO: 288194 - DNA, 25 bp, Homo sapien
catttttcactcttggcttcttttc

SEQ ID NO: 288195 - DNA, 25 bp, Homo sapien
tctcccttgatggtcaagtctctta

SEQ ID NO: 288196 - DNA, 25 bp, Homo sapien
tgatggtcaagtctcttatgtttca

SEQ ID NO: 288197 - DNA, 25 bp, Homo sapien
tgccttattatgtgcttaagataca

SEQ ID NO: 288198 - DNA, 25 bp, Homo sapien
tgtgcttaagatacaataggttaga

SEQ ID NO: 288199 - DNA, 25 bp, Homo sapien
gagtttaatctaaatatcttgaaag

SEQ ID NO: 288200 - DNA, 25 bp, Homo sapien
atcttgaaagctatattgtgggctt

SEQ ID NO: 288201 - DNA, 25 bp, Homo sapien
ttgtgggcttggtaagcattttgtt

SEQ ID NO: 288202 - DNA, 25 bp, Homo sapien
ttttcattgcaattttaagtggttt

SEQ ID NO: 288203 - DNA, 25 bp, Homo sapien
ttatcaaatttttggtgcttggtgc

SEQ ID NO: 288204 - DNA, 25 bp, Homo sapien
gtgcttggtgcagagacggtgtggg

SEQ ID NO: 288205 - DNA, 25 bp, Homo sapien
gggaataattcagtgcacacctgta

SEQ ID NO: 288206 - DNA, 25 bp, Homo sapien
cacctgtaggcctctttacattgtg

SEQ ID NO: 288207 - DNA, 25 bp, Homo sapien
tgtaggcctctttacattgtgactg

SEQ ID NO: 288208 - DNA, 25 bp, Homo sapien
acgtgcgagctctgctagcgcaggc

SEQ ID NO: 288209 - DNA, 25 bp, Homo sapien
tctgctagcgcaggccagggtcatg

SEQ ID NO: 288210 - DNA, 25 bp, Homo sapien
caggccagggtcatggatgcctctg

SEQ ID NO: 288211 - DNA, 25 bp, Homo sapien
catggatgcctctgcctttgagatc

SEQ ID NO: 288212 - DNA, 25 bp, Homo sapien
ctgcctttgagatcttcagcacatt

SEQ ID NO: 288213 - DNA, 25 bp, Homo sapien
gcctttgagatcttcagcacattcc

SEQ ID NO: 288214 - DNA, 25 bp, Homo sapien
tttgagatcttcagcacattcccgc

SEQ ID NO: 288215 - DNA, 25 bp, Homo sapien
tctaccaggacgatacactcacgct

SEQ ID NO: 288216 - DNA, 25 bp, Homo sapien
ggacgatacactcacgctgcaggct

SEQ ID NO: 288217 - DNA, 25 bp, Homo sapien
aggctgcaggccttgtgcccaaagc

SEQ ID NO: 288218 - DNA, 25 bp, Homo sapien
gaaattcagtcctggtccctgtccc

SEQ ID NO: 288219 - DNA, 25 bp, Homo sapien
ggactctgtgcccatgccggtagtt

SEQ ID NO: 288220 - DNA, 25 bp, Homo sapien
cccatgccggtagttggcatcttgg

SEQ ID NO: 288221 - DNA, 25 bp, Homo sapien
ggagcctcgatgtctattcaaccca

SEQ ID NO: 288222 - DNA, 25 bp, Homo sapien
atgtctattcaacccacatacgctt

SEQ ID NO: 288223 - DNA, 25 bp, Homo sapien
ttgggagatatccttccttgatgga

SEQ ID NO: 288224 - DNA, 25 bp, Homo sapien
ttcaggatacactggacttggtcat

SEQ ID NO: 288225 - DNA, 25 bp, Homo sapien
cttggtcatgaaaacactgtcctct

SEQ ID NO: 288226 - DNA, 25 bp, Homo sapien
cctctcatacatcatgccctaagta

SEQ ID NO: 288227 - DNA, 25 bp, Homo sapien
tcaagtagacgtcagattcccagcc

SEQ ID NO: 288228 - DNA, 25 bp, Homo sapien
gattcccagccgagatgcaaaagca

SEQ ID NO: 288229 - DNA, 25 bp, Homo sapien
gatgcaaaagcatgtgggaactctg

SEQ ID NO: 288230 - DNA, 25 bp, Homo sapien
cgccgaagggcgtgatgttggcctt

SEQ ID NO: 288231 - DNA, 25 bp, Homo sapien
tggccttgacggtggccacgcccag

SEQ ID NO: 288232 - DNA, 25 bp, Homo sapien
acgacaggatcgctcccaggttaat

SEQ ID NO: 288233 - DNA, 25 bp, Homo sapien
ggaccaggcgccgtgcagttgagca

SEQ ID NO: 288234 - DNA, 25 bp, Homo sapien
gtgcagttgagcaggcgcgcggaac

SEQ ID NO: 288235 - DNA, 25 bp, Homo sapien
gctcccaggttaatgctccaataaa

SEQ ID NO: 288236 - DNA, 25 bp, Homo sapien
agcatgcccagcaggtagagcgcca

SEQ ID NO: 288237 - DNA, 25 bp, Homo sapien
taaaaaatctcctagtggcttccgg

SEQ ID NO: 288238 - DNA, 25 bp, Homo sapien
gtggcttccggacctcgatctttaa

SEQ ID NO: 288239 - DNA, 25 bp, Homo sapien
ggacctcgatctttaacctggtcgg

SEQ ID NO: 288240 - DNA, 25 bp, Homo sapien
atctttaacctggtcggcgccgaag

SEQ ID NO: 288241 - DNA, 25 bp, Homo sapien
atagctttgatcgttccccaaattc

SEQ ID NO: 288242 - DNA, 25 bp, Homo sapien
aaattcttgcagctctcatactgcc

SEQ ID NO: 288243 - DNA, 25 bp, Homo sapien
atactgccccgcaatgtggatgtag

SEQ ID NO: 288244 - DNA, 25 bp, Homo sapien
aatgtggatgtagcccactgcatgg

SEQ ID NO: 288245 - DNA, 25 bp, Homo sapien
actgcatggtactccacccggaaat

SEQ ID NO: 288246 - DNA, 25 bp, Homo sapien
tccagtgcctcttcttacttttacg

SEQ ID NO: 288247 - DNA, 25 bp, Homo sapien
tacttttacgccagacttcctgttc

SEQ ID NO: 288248 - DNA, 25 bp, Homo sapien
agacttcctgttcctgagtagatca

SEQ ID NO: 288249 - DNA, 25 bp, Homo sapien
taggtgaggttaggctctgctcttt

SEQ ID NO: 288250 - DNA, 25 bp, Homo sapien
acaagtacactgactctgagccatc

SEQ ID NO: 288251 - DNA, 25 bp, Homo sapien
tgagccatcgccagacagagacatt

SEQ ID NO: 288252 - DNA, 25 bp, Homo sapien
gatggtgacggcagcactggttata

SEQ ID NO: 288253 - DNA, 25 bp, Homo sapien
acggcagcactggttataagaaaag

SEQ ID NO: 288254 - DNA, 25 bp, Homo sapien
gacgaaggaagggacactgtatagt

SEQ ID NO: 288255 - DNA, 25 bp, Homo sapien
acactgtatagtgagcaggtttaca

SEQ ID NO: 288256 - DNA, 25 bp, Homo sapien
ttacaagatgcttccgggataagca

SEQ ID NO: 288257 - DNA, 25 bp, Homo sapien
acataaccacagctgcggccaaatc

SEQ ID NO: 288258 - DNA, 25 bp, Homo sapien
cacagctgcggccaaatcctcagaa

SEQ ID NO: 288259 - DNA, 25 bp, Homo sapien
tactgacagcggcaaacactgtcct

SEQ ID NO: 288260 - DNA, 25 bp, Homo sapien
agcggcaaacactgtcctagggaag

SEQ ID NO: 288261 - DNA, 25 bp, Homo sapien
ctgtcctagggaagtcacgtgacat

SEQ ID NO: 288262 - DNA, 25 bp, Homo sapien
aagtcacgtgacatgagggcaaaga

SEQ ID NO: 288263 - DNA, 25 bp, Homo sapien
ggaatattcatggagcccctgacca

SEQ ID NO: 288264 - DNA, 25 bp, Homo sapien
tcttcctcagttcagggttcttgga

SEQ ID NO: 288265 - DNA, 25 bp, Homo sapien
cagttcagggttcttggatttgctc

SEQ ID NO: 288266 - DNA, 25 bp, Homo sapien
ttggatttgctcaagtccacccaaa

SEQ ID NO: 288267 - DNA, 25 bp, Homo sapien
tccacccaaatatccctttacgatt

SEQ ID NO: 288268 - DNA, 25 bp, Homo sapien
ctttacgattctcagggtcccactc

SEQ ID NO: 288269 - DNA, 25 bp, Homo sapien
gatccaatgccctaaactttacata

SEQ ID NO: 288270 - DNA, 25 bp, Homo sapien
taagagttccggcaaggctgtgact

SEQ ID NO: 288271 - DNA, 25 bp, Homo sapien
aaggctgtgacttcaacttgtgttg

SEQ ID NO: 288272 - DNA, 25 bp, Homo sapien
caacttgtgttgtaactgcaacctg

SEQ ID NO: 288273 - DNA, 25 bp, Homo sapien
tcagttgtatcagtcttacggctac

SEQ ID NO: 288274 - DNA, 25 bp, Homo sapien
tgcctgacctcctctgcctgagaag

SEQ ID NO: 288275 - DNA, 25 bp, Homo sapien
ctcctctgcctgagaagggctcaga

SEQ ID NO: 288276 - DNA, 25 bp, Homo sapien
ctctgcctgagaagggctcagaaca

SEQ ID NO: 288277 - DNA, 25 bp, Homo sapien
gagaagggctcagaacaaagtaaaa

SEQ ID NO: 288278 - DNA, 25 bp, Homo sapien
gaagggctcattattccatattttt

SEQ ID NO: 288279 - DNA, 25 bp, Homo sapien
attccatatttttccaccaccttct

SEQ ID NO: 288280 - DNA, 25 bp, Homo sapien
caccttcttcccaaaggcacgtgta

SEQ ID NO: 288281 - DNA, 25 bp, Homo sapien
tcttcccaaaggcacgtgtacctgc

SEQ ID NO: 288282 - DNA, 25 bp, Homo sapien
ttcccaaaggcacgtgtacctgcct

SEQ ID NO: 288283 - DNA, 25 bp, Homo sapien
aaaggcacgtgtacctgcctgacct

SEQ ID NO: 288284 - DNA, 25 bp, Homo sapien
aaggcacgtgtacctgcctgacctc

SEQ ID NO: 288285 - DNA, 25 bp, Homo sapien
cataagccgtaaaccagttgcaata

SEQ ID NO: 288286 - DNA, 25 bp, Homo sapien
agccgtaaaccagttgcaatactag

SEQ ID NO: 288287 - DNA, 25 bp, Homo sapien
gtaaaccagttgcaatactagctat

SEQ ID NO: 288288 - DNA, 25 bp, Homo sapien
aaccagttgcaatactagctatttg

SEQ ID NO: 288289 - DNA, 25 bp, Homo sapien
gttgcaatactagctatttgttgaa

SEQ ID NO: 288290 - DNA, 25 bp, Homo sapien
gcaatactagctatttgttgaatat

SEQ ID NO: 288291 - DNA, 25 bp, Homo sapien
tcttatttcaagattttgcagaata

SEQ ID NO: 288292 - DNA, 25 bp, Homo sapien
gcagaatatgaattgtttcggtaat

SEQ ID NO: 288293 - DNA, 25 bp, Homo sapien
gtaattcccccaatgtaataagtat

SEQ ID NO: 288294 - DNA, 25 bp, Homo sapien
aataagtattagatgcaggtttgtt

SEQ ID NO: 288295 - DNA, 25 bp, Homo sapien
gatgcaggtttgttattgtttaaaa

SEQ ID NO: 288296 - DNA, 25 bp, Homo sapien
ttgtagtatggtgtgtgtctctgca

SEQ ID NO: 288297 - DNA, 25 bp, Homo sapien
gtgtctctgcatatggaactctaaa

SEQ ID NO: 288298 - DNA, 25 bp, Homo sapien
tgctggcctgggttttatttcatct

SEQ ID NO: 288299 - DNA, 25 bp, Homo sapien
gaaatttgcacatgaaatccctgat

SEQ ID NO: 288300 - DNA, 25 bp, Homo sapien
aaatccctgatttccaacttctctg

SEQ ID NO: 288301 - DNA, 25 bp, Homo sapien
acttctctgggaagatctggcaacc

SEQ ID NO: 288302 - DNA, 25 bp, Homo sapien
aagatctggcaaccctgggcttgaa

SEQ ID NO: 288303 - DNA, 25 bp, Homo sapien
ctgggcttgaattttctcctgttaa

SEQ ID NO: 288304 - DNA, 25 bp, Homo sapien
gatattattggcacattccctccaa

SEQ ID NO: 288305 - DNA, 25 bp, Homo sapien
acattccctccaaatgacagacatc

SEQ ID NO: 288306 - DNA, 25 bp, Homo sapien
gacagacatcatctcttctcctgaa

SEQ ID NO: 288307 - DNA, 25 bp, Homo sapien
ggatccccagagagcttttgtttat

SEQ ID NO: 288308 - DNA, 25 bp, Homo sapien
ctgagaagagtagcattttacattt

SEQ ID NO: 288309 - DNA, 25 bp, Homo sapien
ttttacatttttacagatattcaac

SEQ ID NO: 288310 - DNA, 25 bp, Homo sapien
tacagatattcaacatgtgtcttaa

SEQ ID NO: 288311 - DNA, 25 bp, Homo sapien
tgtgtcttaaggcaattttacttaa

SEQ ID NO: 288312 - DNA, 25 bp, Homo sapien
gcaattttacttaaacacatttgat

SEQ ID NO: 288313 - DNA, 25 bp, Homo sapien
gacattgatgtaaaactctgacagg

SEQ ID NO: 288314 - DNA, 25 bp, Homo sapien
ttgatgtaaaactctgacaggaata

SEQ ID NO: 288315 - DNA, 25 bp, Homo sapien
ttattgatatcattggttctcaaac

SEQ ID NO: 288316 - DNA, 25 bp, Homo sapien
tttttggtctcagggcctctttata

SEQ ID NO: 288317 - DNA, 25 bp, Homo sapien
gtctcagggcctctttatactctaa

SEQ ID NO: 288318 - DNA, 25 bp, Homo sapien
ggagatgaggatccatcctcctgcc

SEQ ID NO: 288319 - DNA, 25 bp, Homo sapien
tgcagcagtgacctgaaccgctcag

SEQ ID NO: 288320 - DNA, 25 bp, Homo sapien
gcagtgacctgaaccgctcagtggg

SEQ ID NO: 288321 - DNA, 25 bp, Homo sapien
aagaaggcccgcagcttcttgtagt

SEQ ID NO: 288322 - DNA, 25 bp, Homo sapien
cgcagcttcttgtagtcggtcagtg

SEQ ID NO: 288323 - DNA, 25 bp, Homo sapien
agcttcttgtagtcggtcagtgcct

SEQ ID NO: 288324 - DNA, 25 bp, Homo sapien
gtagtcggtcagtgccttcttccta

SEQ ID NO: 288325 - DNA, 25 bp, Homo sapien
ttcttcctacggtccatcacgtgtc

SEQ ID NO: 288326 - DNA, 25 bp, Homo sapien
agcagcatgctgaggcccaggttgc

SEQ ID NO: 288327 - DNA, 25 bp, Homo sapien
tgaggcccaggttgcgatgcttctt

SEQ ID NO: 288328 - DNA, 25 bp, Homo sapien
aggttgcgatgcttcttctccagct

SEQ ID NO: 288329 - DNA, 25 bp, Homo sapien
ccagacacagcgtgcgctcgggcag

SEQ ID NO: 288330 - DNA, 25 bp, Homo sapien
gtgcgctcgggcagcaaggccgggc

SEQ ID NO: 288331 - DNA, 25 bp, Homo sapien
ctgggcacgcttggggcttcagacc

SEQ ID NO: 288332 - DNA, 25 bp, Homo sapien
ggccaccggagctgctgtctcagga

SEQ ID NO: 288333 - DNA, 25 bp, Homo sapien
ggagctgctgtctcaggacccctct

SEQ ID NO: 288334 - DNA, 25 bp, Homo sapien
ggcaggagacttttcaggtggctaa

SEQ ID NO: 288335 - DNA, 25 bp, Homo sapien
gagacttttcaggtggctaattcca

SEQ ID NO: 288336 - DNA, 25 bp, Homo sapien
ttttcaggtggctaattccacagga

SEQ ID NO: 288337 - DNA, 25 bp, Homo sapien
caggtggctaattccacaggaagat

SEQ ID NO: 288338 - DNA, 25 bp, Homo sapien
attccacaggaagatagtgtcaggt

SEQ ID NO: 288339 - DNA, 25 bp, Homo sapien
aagatagtgtcaggtataggtgccg

SEQ ID NO: 288340 - DNA, 25 bp, Homo sapien
tcccggtacctaaggaccaatagca

SEQ ID NO: 288341 - DNA, 25 bp, Homo sapien
ggtacctaaggaccaatagcaagac

SEQ ID NO: 288342 - DNA, 25 bp, Homo sapien
aatagcaagaccgaggtcaccgtgt

SEQ ID NO: 288343 - DNA, 25 bp, Homo sapien
aagaccgaggtcaccgtgtgaagcg

SEQ ID NO: 288344 - DNA, 25 bp, Homo sapien
gcggtgccctcgaggcatgggctgg

SEQ ID NO: 288345 - DNA, 25 bp, Homo sapien
ggagcctcaggccacagggagagga

SEQ ID NO: 288346 - DNA, 25 bp, Homo sapien
acagggagaggagcgcctgccgtaa

SEQ ID NO: 288347 - DNA, 25 bp, Homo sapien
agcgcctgccgtaaggccagctctt

SEQ ID NO: 288348 - DNA, 25 bp, Homo sapien
tcttctgtctgcctcaacggcagtg

SEQ ID NO: 288349 - DNA, 25 bp, Homo sapien
gcctcaacggcagtggtgtcttgga

SEQ ID NO: 288350 - DNA, 25 bp, Homo sapien
caacggcagtggtgtcttggagcct

SEQ ID NO: 288351 - DNA, 25 bp, Homo sapien
aactggtacatgctcccaggtggga

SEQ ID NO: 288352 - DNA, 25 bp, Homo sapien
aagccaggactcttggtaggatctt

SEQ ID NO: 288353 - DNA, 25 bp, Homo sapien
actcttggtaggatcttgaggacaa

SEQ ID NO: 288354 - DNA, 25 bp, Homo sapien
ggaactggctatccatccatgatgg

SEQ ID NO: 288355 - DNA, 25 bp, Homo sapien
ccatgatggatcctgtgtggactga

SEQ ID NO: 288356 - DNA, 25 bp, Homo sapien
tgggtggcttggcatcatcctttag

SEQ ID NO: 288357 - DNA, 25 bp, Homo sapien
ttggcatcatcctttagtagacttc

SEQ ID NO: 288358 - DNA, 25 bp, Homo sapien
cttcatgtggttgaataattggcca

SEQ ID NO: 288359 - DNA, 25 bp, Homo sapien
ataattggccaatggaaggaatttc

SEQ ID NO: 288360 - DNA, 25 bp, Homo sapien
tcttttttggtaacagactctgtgt

SEQ ID NO: 288361 - DNA, 25 bp, Homo sapien
ctgtgtgtacagttatgggtcttaa

SEQ ID NO: 288362 - DNA, 25 bp, Homo sapien
cactgaaaaaccagcctgggtggcc

SEQ ID NO: 288363 - DNA, 25 bp, Homo sapien
cctgagagggcagaccgaaagcctt

SEQ ID NO: 288364 - DNA, 25 bp, Homo sapien
gagggcagaccgaaagccttggcac

SEQ ID NO: 288365 - DNA, 25 bp, Homo sapien
gggcagaccgaaagccttggcacct

SEQ ID NO: 288366 - DNA, 25 bp, Homo sapien
tgtcctttaacctcagagccccagg

SEQ ID NO: 288367 - DNA, 25 bp, Homo sapien
ctcggctttggcctccaggacctgg

SEQ ID NO: 288368 - DNA, 25 bp, Homo sapien
cctccaggacctggcactggatagg

SEQ ID NO: 288369 - DNA, 25 bp, Homo sapien
ccaggacctggcactggataggtgc

SEQ ID NO: 288370 - DNA, 25 bp, Homo sapien
gacctggcactggataggtgccaaa

SEQ ID NO: 288371 - DNA, 25 bp, Homo sapien
cactggataggtgccaaatgtttgc

SEQ ID NO: 288372 - DNA, 25 bp, Homo sapien
ctggataggtgccaaatgtttgctg

SEQ ID NO: 288373 - DNA, 25 bp, Homo sapien
cagttttttcctctagaccacttcg

SEQ ID NO: 288374 - DNA, 25 bp, Homo sapien
tttttcctctagaccacttcggcgg

SEQ ID NO: 288375 - DNA, 25 bp, Homo sapien
ttttgcttctcctatgccagcgggt

SEQ ID NO: 288376 - DNA, 25 bp, Homo sapien
atgccagcgggtctccgcgccttta

SEQ ID NO: 288377 - DNA, 25 bp, Homo sapien
gccacatcctcgtaactgatgtaca

SEQ ID NO: 288378 - DNA, 25 bp, Homo sapien
ctgatgtacagtccgtcagttcggc

SEQ ID NO: 288379 - DNA, 25 bp, Homo sapien
gtacagtccgtcagttcggcttcag

SEQ ID NO: 288380 - DNA, 25 bp, Homo sapien
tcagttcggcttcagttcttttgac

SEQ ID NO: 288381 - DNA, 25 bp, Homo sapien
tcggcttcagttcttttgacggatg

SEQ ID NO: 288382 - DNA, 25 bp, Homo sapien
gtcaaggcctaattcctgcaactcg

SEQ ID NO: 288383 - DNA, 25 bp, Homo sapien
aggcctaattcctgcaactcgccgg

SEQ ID NO: 288384 - DNA, 25 bp, Homo sapien
ttatcatgttttacccaccttgtcc

SEQ ID NO: 288385 - DNA, 25 bp, Homo sapien
acgaggaccctggatgggttctagt

SEQ ID NO: 288386 - DNA, 25 bp, Homo sapien
accctggatgggttctagttcactt

SEQ ID NO: 288387 - DNA, 25 bp, Homo sapien
gttctagttcacttgggaccgtggg

SEQ ID NO: 288388 - DNA, 25 bp, Homo sapien
gctgcgtactgagtgggtgccccac

SEQ ID NO: 288389 - DNA, 25 bp, Homo sapien
gagaaaggcggcttctggaaccttc

SEQ ID NO: 288390 - DNA, 25 bp, Homo sapien
gcggcttctggaaccttccgtggga

SEQ ID NO: 288391 - DNA, 25 bp, Homo sapien
tccgtgggacccgtaagtggctgtc

SEQ ID NO: 288392 - DNA, 25 bp, Homo sapien
ggacccgtaagtggctgtccagaaa

SEQ ID NO: 288393 - DNA, 25 bp, Homo sapien
ttaagggtcacgcatctgtacagtt

SEQ ID NO: 288394 - DNA, 25 bp, Homo sapien
acgcatctgtacagttgaatttcct

SEQ ID NO: 288395 - DNA, 25 bp, Homo sapien
gatgtcaactggaagatcatgccac

SEQ ID NO: 288396 - DNA, 25 bp, Homo sapien
atcatgccactcctgacaatgagaa

SEQ ID NO: 288397 - DNA, 25 bp, Homo sapien
tgagaagaggagttccctgtgcaag

SEQ ID NO: 288398 - DNA, 25 bp, Homo sapien
ttccctgtgcaagggaagcacatgg

SEQ ID NO: 288399 - DNA, 25 bp, Homo sapien
gcacatggtagggttaatgctacac

SEQ ID NO: 288400 - DNA, 25 bp, Homo sapien
aatgctacacggaacatgaactctg

SEQ ID NO: 288401 - DNA, 25 bp, Homo sapien
atgaactctgaagaccctcattttg

SEQ ID NO: 288402 - DNA, 25 bp, Homo sapien
ttttggtttccatgaaggtggtgaa

SEQ ID NO: 288403 - DNA, 25 bp, Homo sapien
ataaaagcatttccaataagggtga

SEQ ID NO: 288404 - DNA, 25 bp, Homo sapien
agagtagagagcagtgatgtttcca

SEQ ID NO: 288405 - DNA, 25 bp, Homo sapien
gagcagtgatgtttccaaaaagttt

SEQ ID NO: 288406 - DNA, 25 bp, Homo sapien
ttcactgattcttgtgaacaagtta

SEQ ID NO: 288407 - DNA, 25 bp, Homo sapien
aacaagttagacaggggtggcccat

SEQ ID NO: 288408 - DNA, 25 bp, Homo sapien
gtgaaatacacgaacactaacagta

SEQ ID NO: 288409 - DNA, 25 bp, Homo sapien
acgaacactaacagtagctgatgat

SEQ ID NO: 288410 - DNA, 25 bp, Homo sapien
aaataatctcatactgttttaataa

SEQ ID NO: 288411 - DNA, 25 bp, Homo sapien
caggttgggcaagcttgagttcgaa

SEQ ID NO: 288412 - DNA, 25 bp, Homo sapien
ggttgggcaagcttgagttcgaatc

SEQ ID NO: 288413 - DNA, 25 bp, Homo sapien
ttgggcaagcttgagttcgaatctt

SEQ ID NO: 288414 - DNA, 25 bp, Homo sapien
gggcaagcttgagttcgaatcttaa

SEQ ID NO: 288415 - DNA, 25 bp, Homo sapien
gcaagcttgagttcgaatcttaata

SEQ ID NO: 288416 - DNA, 25 bp, Homo sapien
gcttgagttcgaatcttaatattaa

SEQ ID NO: 288417 - DNA, 25 bp, Homo sapien
ccaagcacttactctagcacttagt

SEQ ID NO: 288418 - DNA, 25 bp, Homo sapien
ctctagcacttagtaagcattcagt

SEQ ID NO: 288419 - DNA, 25 bp, Homo sapien
cagtgaatatttgttgatacatcaa

SEQ ID NO: 288420 - DNA, 25 bp, Homo sapien
cttatggcatagatttgataacact

SEQ ID NO: 288421 - DNA, 25 bp, Homo sapien
ggtaaaattgcattgcacgtgaaaa

SEQ ID NO: 288422 - DNA, 25 bp, Homo sapien
gaagcagttttcttaccaaaacata

SEQ ID NO: 288423 - DNA, 25 bp, Homo sapien
aaaacataatctccatgcagtcaaa

SEQ ID NO: 288424 - DNA, 25 bp, Homo sapien
tgcagtcaaatacattgtctggatt

SEQ ID NO: 288425 - DNA, 25 bp, Homo sapien
cattgtctggattacttttgtcttc

SEQ ID NO: 288426 - DNA, 25 bp, Homo sapien
tacttttgtcttcctagtgccaagc

SEQ ID NO: 288427 - DNA, 25 bp, Homo sapien
tttgtcttcctagtgccaagcactt

SEQ ID NO: 288428 - DNA, 25 bp, Homo sapien
cagggcactgtgctgctgctgtgga

SEQ ID NO: 288429 - DNA, 25 bp, Homo sapien
ctgctgctgtggagcggcgccgacc

SEQ ID NO: 288430 - DNA, 25 bp, Homo sapien
gcgacgtgatcgtggacctgtggga

SEQ ID NO: 288431 - DNA, 25 bp, Homo sapien
acgtgatcgtggacctgtgggaggg

SEQ ID NO: 288432 - DNA, 25 bp, Homo sapien
tgctgctgctcgcttacttcagtcg

SEQ ID NO: 288433 - DNA, 25 bp, Homo sapien
tgctgctcgcttacttcagtcgcct

SEQ ID NO: 288434 - DNA, 25 bp, Homo sapien
tgctcgcttacttcagtcgcctctg

SEQ ID NO: 288435 - DNA, 25 bp, Homo sapien
tacttcagtcgcctctgcgccaagg

SEQ ID NO: 288436 - DNA, 25 bp, Homo sapien
ttcagtcgcctctgcgccaagggcg

SEQ ID NO: 288437 - DNA, 25 bp, Homo sapien
tcgcctctgcgccaagggcgacatc

SEQ ID NO: 288438 - DNA, 25 bp, Homo sapien
gcgtagcgcgggagcagggcactgt

SEQ ID NO: 288439 - DNA, 25 bp, Homo sapien
ttcctcatcagtgggcgctgggcaa

SEQ ID NO: 288440 - DNA, 25 bp, Homo sapien
ggccttgctccgaaacttgctgcag

SEQ ID NO: 288441 - DNA, 25 bp, Homo sapien
ccttgctccgaaacttgctgcaggg

SEQ ID NO: 288442 - DNA, 25 bp, Homo sapien
agagaaattctctagacccaagccc

SEQ ID NO: 288443 - DNA, 25 bp, Homo sapien
taaacagggactgagaggacccaga

SEQ ID NO: 288444 - DNA, 25 bp, Homo sapien
tgagaggacccagagaaccctccat

SEQ ID NO: 288445 - DNA, 25 bp, Homo sapien
agaaccctccataccagtcactgag

SEQ ID NO: 288446 - DNA, 25 bp, Homo sapien
accagtcactgaggcctaaaatctt

SEQ ID NO: 288447 - DNA, 25 bp, Homo sapien
gaggcctaaaatcttggcgcccttt

SEQ ID NO: 288448 - DNA, 25 bp, Homo sapien
acccagtgaccctttcttcttattg

SEQ ID NO: 288449 - DNA, 25 bp, Homo sapien
ccagtgaccctttcttcttattgct

SEQ ID NO: 288450 - DNA, 25 bp, Homo sapien
tttttcttagctaatgtaactttat

SEQ ID NO: 288451 - DNA, 25 bp, Homo sapien
gctaatgtaactttattcttcactt

SEQ ID NO: 288452 - DNA, 25 bp, Homo sapien
ttttagccctagacttcctagattt

SEQ ID NO: 288453 - DNA, 25 bp, Homo sapien
ttagccctagacttcctagattttc

SEQ ID NO: 288454 - DNA, 25 bp, Homo sapien
gccctagacttcctagattttctgt

SEQ ID NO: 288455 - DNA, 25 bp, Homo sapien
ctgtggcattctgtaggacattgta

SEQ ID NO: 288456 - DNA, 25 bp, Homo sapien
cattctgtaggacattgtattgctt

SEQ ID NO: 288457 - DNA, 25 bp, Homo sapien
gtaggacattgtattgcttggaaaa

SEQ ID NO: 288458 - DNA, 25 bp, Homo sapien
tctggggcaaatgctctattatcct

SEQ ID NO: 288459 - DNA, 25 bp, Homo sapien
tatccttatttatgacaagagaata

SEQ ID NO: 288460 - DNA, 25 bp, Homo sapien
tattgctataaatgtacttgagtca

SEQ ID NO: 288461 - DNA, 25 bp, Homo sapien
agagattgagactgtgaacctgaac

SEQ ID NO: 288462 - DNA, 25 bp, Homo sapien
agactgtgaacctgaactcccttga

SEQ ID NO: 288463 - DNA, 25 bp, Homo sapien
tgtgaacctgaactcccttgatctc

SEQ ID NO: 288464 - DNA, 25 bp, Homo sapien
aaccgggctcactgagaaggtgcag

SEQ ID NO: 288465 - DNA, 25 bp, Homo sapien
agaaggtgcaggaagcccccaacga

SEQ ID NO: 288466 - DNA, 25 bp, Homo sapien
catactgggccaggacgctgcagtg

SEQ ID NO: 288467 - DNA, 25 bp, Homo sapien
aggacgctgcagtggccgagccgct

SEQ ID NO: 288468 - DNA, 25 bp, Homo sapien
tggccgagccgctgggtgtctgcaa

SEQ ID NO: 288469 - DNA, 25 bp, Homo sapien
taaacggaatcggtttcacacgctt

SEQ ID NO: 288470 - DNA, 25 bp, Homo sapien
ggaatcggtttcacacgctttccct

SEQ ID NO: 288471 - DNA, 25 bp, Homo sapien
acgctttccctcttgatctaagaac

SEQ ID NO: 288472 - DNA, 25 bp, Homo sapien
attggctatgcactatcattaacag

SEQ ID NO: 288473 - DNA, 25 bp, Homo sapien
taacagaagctatcacggctccttt

SEQ ID NO: 288474 - DNA, 25 bp, Homo sapien
gctatcacggctcctttgtaatctt

SEQ ID NO: 288475 - DNA, 25 bp, Homo sapien
agcagctattccatgatcttttctc

SEQ ID NO: 288476 - DNA, 25 bp, Homo sapien
gatcttttctctcgcaatgatgaac

SEQ ID NO: 288477 - DNA, 25 bp, Homo sapien
aatgatgaaccgaacttttgataaa

SEQ ID NO: 288478 - DNA, 25 bp, Homo sapien
aaatatttgatctccttttagccaa

SEQ ID NO: 288479 - DNA, 25 bp, Homo sapien
gccaaaactcttctttataagccca

SEQ ID NO: 288480 - DNA, 25 bp, Homo sapien
tataagcccatttaatattccagaa

SEQ ID NO: 288481 - DNA, 25 bp, Homo sapien
cagaaggattttctttcgtttgaag

SEQ ID NO: 288482 - DNA, 25 bp, Homo sapien
gaaaaccaatggtgagaactcttat

SEQ ID NO: 288483 - DNA, 25 bp, Homo sapien
cagttgggtaggaaccagaaggcca

SEQ ID NO: 288484 - DNA, 25 bp, Homo sapien
ggtaggaaccagaaggccaatagga

SEQ ID NO: 288485 - DNA, 25 bp, Homo sapien
ccaataggaaggaggacaaaagtgc

SEQ ID NO: 288486 - DNA, 25 bp, Homo sapien
cagtgagtatggtatgcctagaata

SEQ ID NO: 288487 - DNA, 25 bp, Homo sapien
gattagaattgggtgacagtgatta

SEQ ID NO: 288488 - DNA, 25 bp, Homo sapien
ttgggtgacagtgattagtagtttc

SEQ ID NO: 288489 - DNA, 25 bp, Homo sapien
gacagtgattagtagtttcagaagt

SEQ ID NO: 288490 - DNA, 25 bp, Homo sapien
gtttcagaagtatctcttcccaatt

SEQ ID NO: 288491 - DNA, 25 bp, Homo sapien
agtatctcttcccaattcaaaagtc

SEQ ID NO: 288492 - DNA, 25 bp, Homo sapien
ttcaaaagtctcactttgggctgaa

SEQ ID NO: 288493 - DNA, 25 bp, Homo sapien
gtacagaggaagaaggtagactttt

SEQ ID NO: 288494 - DNA, 25 bp, Homo sapien
ctttaaatagcattcccgtaggagg

SEQ ID NO: 288495 - DNA, 25 bp, Homo sapien
attcccgtaggaggcagatcacatc

SEQ ID NO: 288496 - DNA, 25 bp, Homo sapien
ggaggcagatcacatccatccgtca

SEQ ID NO: 288497 - DNA, 25 bp, Homo sapien
atccgtcacctactgcaaagcatca

SEQ ID NO: 288498 - DNA, 25 bp, Homo sapien
cctactgcaaagcatcattttggtt

SEQ ID NO: 288499 - DNA, 25 bp, Homo sapien
ggtttctatcaaactcaaagcttgt

SEQ ID NO: 288500 - DNA, 25 bp, Homo sapien
gaatagttgtcttttgagcctcaga

SEQ ID NO: 288501 - DNA, 25 bp, Homo sapien
gtcttttgagcctcagagtggaaca

SEQ ID NO: 288502 - DNA, 25 bp, Homo sapien
gagtggaacaagtatacccaattct

SEQ ID NO: 288503 - DNA, 25 bp, Homo sapien
gtatacccaattcttatctgtttag

SEQ ID NO: 288504 - DNA, 25 bp, Homo sapien
attcttatctgtttagagacgcagc

SEQ ID NO: 288505 - DNA, 25 bp, Homo sapien
tgttcaacctggctctggttgatga

SEQ ID NO: 288506 - DNA, 25 bp, Homo sapien
acctggctctggttgatgagttctt

SEQ ID NO: 288507 - DNA, 25 bp, Homo sapien
tctggttgatgagttcttcacgctc

SEQ ID NO: 288508 - DNA, 25 bp, Homo sapien
ttgatgagttcttcacgctcacgct

SEQ ID NO: 288509 - DNA, 25 bp, Homo sapien
gcttcatcgtggtgcccgcggccta

SEQ ID NO: 288510 - DNA, 25 bp, Homo sapien
tgcagctgtggctcacctactacct

SEQ ID NO: 288511 - DNA, 25 bp, Homo sapien
tactacgtgtccacctatgcggcgg

SEQ ID NO: 288512 - DNA, 25 bp, Homo sapien
acctatgcggcggtggtcttcgccg

SEQ ID NO: 288513 - DNA, 25 bp, Homo sapien
tcttcgccgcgctcatcagcgtgtg

SEQ ID NO: 288514 - DNA, 25 bp, Homo sapien
cggccctggcaatgttcatccgcag

SEQ ID NO: 288515 - DNA, 25 bp, Homo sapien
tggcaatgttcatccgcagcggcgg

SEQ ID NO: 288516 - DNA, 25 bp, Homo sapien
gatatccctgttacttagggaattc

SEQ ID NO: 288517 - DNA, 25 bp, Homo sapien
aattattttgagtctgcctcctagg

SEQ ID NO: 288518 - DNA, 25 bp, Homo sapien
ctgcctcctaggaaccagagacaaa

SEQ ID NO: 288519 - DNA, 25 bp, Homo sapien
aagccagtcaaattctttactataa

SEQ ID NO: 288520 - DNA, 25 bp, Homo sapien
atgtgaaaacatactgtgcacgcta

SEQ ID NO: 288521 - DNA, 25 bp, Homo sapien
tactgtgcacgctatgtcacacaac

SEQ ID NO: 288522 - DNA, 25 bp, Homo sapien
gtctattgaacttgccaatggtgga

SEQ ID NO: 288523 - DNA, 25 bp, Homo sapien
aggtctgagggcatcattctttgca

SEQ ID NO: 288524 - DNA, 25 bp, Homo sapien
ctttgcaaagtgtattctttctgta

SEQ ID NO: 288525 - DNA, 25 bp, Homo sapien
tctgtaccattttcttgaccaattt

SEQ ID NO: 288526 - DNA, 25 bp, Homo sapien
tcttgaccaattttcaccttttctg

SEQ ID NO: 288527 - DNA, 25 bp, Homo sapien
ggtcatacatatgctattggagagt

SEQ ID NO: 288528 - DNA, 25 bp, Homo sapien
attggagagttcacagctagcccct

SEQ ID NO: 288529 - DNA, 25 bp, Homo sapien
tagcccctcactactcaaattgtgg

SEQ ID NO: 288530 - DNA, 25 bp, Homo sapien
caaattgtgggtgttattgccagac

SEQ ID NO: 288531 - DNA, 25 bp, Homo sapien
tattgccagactgcggagatgcaca

SEQ ID NO: 288532 - DNA, 25 bp, Homo sapien
agattattcatgttcctgcacactc

SEQ ID NO: 288533 - DNA, 25 bp, Homo sapien
ttcatgttcctgcacactctgttat

SEQ ID NO: 288534 - DNA, 25 bp, Homo sapien
acactctgttatctctgggagctct

SEQ ID NO: 288535 - DNA, 25 bp, Homo sapien
tgggagctcttaatcaatgcagggt

SEQ ID NO: 288536 - DNA, 25 bp, Homo sapien
atcaatgcagggtgagagccagtta

SEQ ID NO: 288537 - DNA, 25 bp, Homo sapien
agggtgagagccagttagcatgact

SEQ ID NO: 288538 - DNA, 25 bp, Homo sapien
tgagttactgaagggcaatgaaacc

SEQ ID NO: 288539 - DNA, 25 bp, Homo sapien
ggcaatgaaaccatagcccgcttgc

SEQ ID NO: 288540 - DNA, 25 bp, Homo sapien
aatgaaaccatagcccgcttgcagg

SEQ ID NO: 288541 - DNA, 25 bp, Homo sapien
aaccatagcccgcttgcaggctctg

SEQ ID NO: 288542 - DNA, 25 bp, Homo sapien
atagcccgcttgcaggctctggcca

SEQ ID NO: 288543 - DNA, 25 bp, Homo sapien
cttgcaggctctggccaagcgtact

SEQ ID NO: 288544 - DNA, 25 bp, Homo sapien
aggctctggccaagcgtactggtgt

SEQ ID NO: 288545 - DNA, 25 bp, Homo sapien
tctggccaagcgtactggtgtggct

SEQ ID NO: 288546 - DNA, 25 bp, Homo sapien
ggccaagcgtactggtgtggctgtg

SEQ ID NO: 288547 - DNA, 25 bp, Homo sapien
gtggaaaaaatggacctctctgctt

SEQ ID NO: 288548 - DNA, 25 bp, Homo sapien
ctctgcttctctgggtgaaaaagac

SEQ ID NO: 288549 - DNA, 25 bp, Homo sapien
cccagcttggccactcctagatgag

SEQ ID NO: 288550 - DNA, 25 bp, Homo sapien
gctaggagtggagacccagcaatga

SEQ ID NO: 288551 - DNA, 25 bp, Homo sapien
gggtgtttgtccttgacagctccgg

SEQ ID NO: 288552 - DNA, 25 bp, Homo sapien
gacagctccggtcaattgcagagaa

SEQ ID NO: 288553 - DNA, 25 bp, Homo sapien
tgagtgatccagttccacaggtagc

SEQ ID NO: 288554 - DNA, 25 bp, Homo sapien
tagagggtcctctagaatcctggac

SEQ ID NO: 288555 - DNA, 25 bp, Homo sapien
aatcctggacgtttgtccctggata

SEQ ID NO: 288556 - DNA, 25 bp, Homo sapien
gtccctggatacttttggaaatcct

SEQ ID NO: 288557 - DNA, 25 bp, Homo sapien
actgtccaagaccaccaatgatgat

SEQ ID NO: 288558 - DNA, 25 bp, Homo sapien
tgatgatgtcacaatgtcccactgt

SEQ ID NO: 288559 - DNA, 25 bp, Homo sapien
atgtcccactgtcccagagtgtcta

SEQ ID NO: 288560 - DNA, 25 bp, Homo sapien
gtagttgttggtgcagccatgttgt

SEQ ID NO: 288561 - DNA, 25 bp, Homo sapien
ttggtgcagccatgttgtgctgagt

SEQ ID NO: 288562 - DNA, 25 bp, Homo sapien
cagccatgttgtgctgagtgaacat

SEQ ID NO: 288563 - DNA, 25 bp, Homo sapien
ctgagtgaacatatattaagatctt

SEQ ID NO: 288564 - DNA, 25 bp, Homo sapien
taagatctttggaacctttaggaga

SEQ ID NO: 288565 - DNA, 25 bp, Homo sapien
ggaacctttaggagactgaaaatag

SEQ ID NO: 288566 - DNA, 25 bp, Homo sapien
gaatggtattcagagaacttcgtac

SEQ ID NO: 288567 - DNA, 25 bp, Homo sapien
cagagaacttcgtaccatttttata

SEQ ID NO: 288568 - DNA, 25 bp, Homo sapien
ggtaacctaattagaacagcttggc

SEQ ID NO: 288569 - DNA, 25 bp, Homo sapien
gaacagcttggcacttgtcagtaca

SEQ ID NO: 288570 - DNA, 25 bp, Homo sapien
aatgtgaaacaggtggctgggaccc

SEQ ID NO: 288571 - DNA, 25 bp, Homo sapien
actgttgtggtctgtttgattcctc

SEQ ID NO: 288572 - DNA, 25 bp, Homo sapien
tttgattcctcgtcgcttaccgtgg

SEQ ID NO: 288573 - DNA, 25 bp, Homo sapien
ttaccgtggctctccaaagcatggt

SEQ ID NO: 288574 - DNA, 25 bp, Homo sapien
aagcatggtctttgagttccaccca

SEQ ID NO: 288575 - DNA, 25 bp, Homo sapien
cagtccagacgggaggcatctgctc

SEQ ID NO: 288576 - DNA, 25 bp, Homo sapien
tccgcctgctactaggacgcaaggg

SEQ ID NO: 288577 - DNA, 25 bp, Homo sapien
aaagccatgaggttactgtcgtgtc

SEQ ID NO: 288578 - DNA, 25 bp, Homo sapien
aaagctgtcatttgtgcccgttatt

SEQ ID NO: 288579 - DNA, 25 bp, Homo sapien
taggagaacatggtctcttggtgcc

SEQ ID NO: 288580 - DNA, 25 bp, Homo sapien
gatttagtcctaagcagactcgttg

SEQ ID NO: 288581 - DNA, 25 bp, Homo sapien
gactcgttgcagtcttgtgaacact

SEQ ID NO: 288582 - DNA, 25 bp, Homo sapien
cttcctcctggcacatgacaaaatc

SEQ ID NO: 288583 - DNA, 25 bp, Homo sapien
acatgacaaaatcctagtgccttaa

SEQ ID NO: 288584 - DNA, 25 bp, Homo sapien
aaatcctagtgccttaaggtctgca

SEQ ID NO: 288585 - DNA, 25 bp, Homo sapien
agagagtttatatagtgttttccag

SEQ ID NO: 288586 - DNA, 25 bp, Homo sapien
gttcaagttccttatcatataatca

SEQ ID NO: 288587 - DNA, 25 bp, Homo sapien
aatatcctcaagacattgactcttt

SEQ ID NO: 288588 - DNA, 25 bp, Homo sapien
atctcctttgttacactgtgcacat

SEQ ID NO: 288589 - DNA, 25 bp, Homo sapien
gacattgactcttttcacagtgaag

SEQ ID NO: 288590 - DNA, 25 bp, Homo sapien
gctgaggttggagctttggcctcat

SEQ ID NO: 288591 - DNA, 25 bp, Homo sapien
ttggcctcatctcctataggttcat

SEQ ID NO: 288592 - DNA, 25 bp, Homo sapien
atctcctataggttcatgctgcatc

SEQ ID NO: 288593 - DNA, 25 bp, Homo sapien
tgtctctctgattattttgcttgtt

SEQ ID NO: 288594 - DNA, 25 bp, Homo sapien
tttgcttgttgattggccagttgtt

SEQ ID NO: 288595 - DNA, 25 bp, Homo sapien
ggccagttgttaattctgtctttgt

SEQ ID NO: 288596 - DNA, 25 bp, Homo sapien
ctgtctttgtgagttgtctttttct

SEQ ID NO: 288597 - DNA, 25 bp, Homo sapien
tgtctttttctcagtacttggccta

SEQ ID NO: 288598 - DNA, 25 bp, Homo sapien
gtacttggcctatttgtctttgatt

SEQ ID NO: 288599 - DNA, 25 bp, Homo sapien
gttgtagtcattttaattcctgtca

SEQ ID NO: 288600 - DNA, 25 bp, Homo sapien
cgccactgagtgctgttgtattgtt

SEQ ID NO: 288601 - DNA, 25 bp, Homo sapien
tttcgagttcataatttttcaatct

SEQ ID NO: 288602 - DNA, 25 bp, Homo sapien
agtgctgttgtattgttaatcttga

SEQ ID NO: 288603 - DNA, 25 bp, Homo sapien
gtctgtgtctctctgattattttgc

SEQ ID NO: 288604 - DNA, 25 bp, Homo sapien
gttaggcttataatcaagatgctga

SEQ ID NO: 288605 - DNA, 25 bp, Homo sapien
tcaagatgctgattttcaaccttag

SEQ ID NO: 288606 - DNA, 25 bp, Homo sapien
gctgattttcaaccttagcatcggg

SEQ ID NO: 288607 - DNA, 25 bp, Homo sapien
aggtaatgatagtttagttggcaaa

SEQ ID NO: 288608 - DNA, 25 bp, Homo sapien
gttggcaaagactttttgcagcaaa

SEQ ID NO: 288609 - DNA, 25 bp, Homo sapien
tgcagcaaactgtatttgagacagc

SEQ ID NO: 288610 - DNA, 25 bp, Homo sapien
ttgagacagcagaatccaaggatat

SEQ ID NO: 288611 - DNA, 25 bp, Homo sapien
gattcacttatactacattcttttt

SEQ ID NO: 288612 - DNA, 25 bp, Homo sapien
gtatatatttttggaacaccacagg

SEQ ID NO: 288613 - DNA, 25 bp, Homo sapien
tggaacaccacaggtttagttggga

SEQ ID NO: 288614 - DNA, 25 bp, Homo sapien
tattttgcagctgagttagaaactt

SEQ ID NO: 288615 - DNA, 25 bp, Homo sapien
gggcgcttgctgaccctagagtctt

SEQ ID NO: 288616 - DNA, 25 bp, Homo sapien
cttgctgaccctagagtcttggaca

SEQ ID NO: 288617 - DNA, 25 bp, Homo sapien
tgaccctagagtcttggacagtggc

SEQ ID NO: 288618 - DNA, 25 bp, Homo sapien
gacagtggcgttgggagtccccagc

SEQ ID NO: 288619 - DNA, 25 bp, Homo sapien
gtccccagcggcctgggaaccagat

SEQ ID NO: 288620 - DNA, 25 bp, Homo sapien
aagtggctgagcgaccagaccgttg

SEQ ID NO: 288621 - DNA, 25 bp, Homo sapien
ctgagcgaccagaccgttgctgtgt

SEQ ID NO: 288622 - DNA, 25 bp, Homo sapien
agaggcggtcgagcgctcgttttcc

SEQ ID NO: 288623 - DNA, 25 bp, Homo sapien
gagcgctcgttttccgggcgacttg

SEQ ID NO: 288624 - DNA, 25 bp, Homo sapien
tcttccccatgtctgcagtcggagg

SEQ ID NO: 288625 - DNA, 25 bp, Homo sapien
gatggtcccttggagagaacagcca

SEQ ID NO: 288626 - DNA, 25 bp, Homo sapien
agttcatctgcccactgtaagcgtg

SEQ ID NO: 288627 - DNA, 25 bp, Homo sapien
tgcccactgtaagcgtgacctcagg

SEQ ID NO: 288628 - DNA, 25 bp, Homo sapien
gacctcaggcaaatgtctgcagctt

SEQ ID NO: 288629 - DNA, 25 bp, Homo sapien
aaatgtctgcagctttctgagcggc

SEQ ID NO: 288630 - DNA, 25 bp, Homo sapien
tgagcggcgttccttgtcggtaaaa

SEQ ID NO: 288631 - DNA, 25 bp, Homo sapien
gcagatgtgtattttcgcgtcgcaa

SEQ ID NO: 288632 - DNA, 25 bp, Homo sapien
ttttcgcgtcgcaaggtggtcctgg

SEQ ID NO: 288633 - DNA, 25 bp, Homo sapien
tgggacgacaaagaactcgaccctc

SEQ ID NO: 288634 - DNA, 25 bp, Homo sapien
cttgcttccaagtctttgatgagat

SEQ ID NO: 288635 - DNA, 25 bp, Homo sapien
gtctttgatgagattccacagtaaa

SEQ ID NO: 288636 - DNA, 25 bp, Homo sapien
gtaagtaggcttctgtctgccagta

SEQ ID NO: 288637 - DNA, 25 bp, Homo sapien
aaccacaattggaatggttcttctt

SEQ ID NO: 288638 - DNA, 25 bp, Homo sapien
caaaaccaagagttccttatcctcg

SEQ ID NO: 288639 - DNA, 25 bp, Homo sapien
aagagttccttatcctcgtttctct

SEQ ID NO: 288640 - DNA, 25 bp, Homo sapien
tcgtttctctcgtttctcacagaga

SEQ ID NO: 288641 - DNA, 25 bp, Homo sapien
tctcgtttctcacagagagagcaga

SEQ ID NO: 288642 - DNA, 25 bp, Homo sapien
ggagttatgtggacttgttggttaa

SEQ ID NO: 288643 - DNA, 25 bp, Homo sapien
gttaaatacgcaaagattcctgcaa

SEQ ID NO: 288644 - DNA, 25 bp, Homo sapien
gattcctgcaaattccaaagctgtt

SEQ ID NO: 288645 - DNA, 25 bp, Homo sapien
aatgactacttgcagtacttggata

SEQ ID NO: 288646 - DNA, 25 bp, Homo sapien
actgagttcctaaagtttttgcaga

SEQ ID NO: 288647 - DNA, 25 bp, Homo sapien
agaaatgtgcgcaggattataatat

SEQ ID NO: 288648 - DNA, 25 bp, Homo sapien
aatgtttaaccactttgctgctgac

SEQ ID NO: 288649 - DNA, 25 bp, Homo sapien
gctgctgacttgagttatttatcca

SEQ ID NO: 288650 - DNA, 25 bp, Homo sapien
taactatagacttttaccaatgggt

SEQ ID NO: 288651 - DNA, 25 bp, Homo sapien
gacttttaccaatgggtagctataa

SEQ ID NO: 288652 - DNA, 25 bp, Homo sapien
aaatctttttactgagagatcatta

SEQ ID NO: 288653 - DNA, 25 bp, Homo sapien
aagttggttaggatcatatcttcac

SEQ ID NO: 288654 - DNA, 25 bp, Homo sapien
atatcttcacatatggccctttctg

SEQ ID NO: 288655 - DNA, 25 bp, Homo sapien
cacatatggccctttctgaatcaaa

SEQ ID NO: 288656 - DNA, 25 bp, Homo sapien
tggccctttctgaatcaaagtgcgg

SEQ ID NO: 288657 - DNA, 25 bp, Homo sapien
ttctgaatcaaagtgcggcaaagta

SEQ ID NO: 288658 - DNA, 25 bp, Homo sapien
gtgcggcaaagtaaatattgtctaa

SEQ ID NO: 288659 - DNA, 25 bp, Homo sapien
ttaatgggttctctgcagctagcta

SEQ ID NO: 288660 - DNA, 25 bp, Homo sapien
ctgcagctagctatacattttaaga

SEQ ID NO: 288661 - DNA, 25 bp, Homo sapien
tttaagaactctcaacctagaaagg

SEQ ID NO: 288662 - DNA, 25 bp, Homo sapien
tggagtggtccttgaaaatgagcat

SEQ ID NO: 288663 - DNA, 25 bp, Homo sapien
gggctctcttgtgagcaggatctat

SEQ ID NO: 288664 - DNA, 25 bp, Homo sapien
tgagcaggatctatcactgacattt

SEQ ID NO: 288665 - DNA, 25 bp, Homo sapien
actgacatttgaagccaaatcccac

SEQ ID NO: 288666 - DNA, 25 bp, Homo sapien
acctgctacacaattcacccagatg

SEQ ID NO: 288667 - DNA, 25 bp, Homo sapien
aattcacccagatgcctggaccaat

SEQ ID NO: 288668 - DNA, 25 bp, Homo sapien
aagagctttaaacgcattcacccca

SEQ ID NO: 288669 - DNA, 25 bp, Homo sapien
taaacgcattcaccccaataaatat

SEQ ID NO: 288670 - DNA, 25 bp, Homo sapien
atgaagtgcctcctacagctacttt

SEQ ID NO: 288671 - DNA, 25 bp, Homo sapien
agtatcttagaacttgattatttaa

SEQ ID NO: 288672 - DNA, 25 bp, Homo sapien
ttactttggctcgagaccctcagtc

SEQ ID NO: 288673 - DNA, 25 bp, Homo sapien
tgattttaatatccctttcttacaa

SEQ ID NO: 288674 - DNA, 25 bp, Homo sapien
atccctttcttacaatatatgttcc

SEQ ID NO: 288675 - DNA, 25 bp, Homo sapien
tgttcaggaggcagagcagttcttt

SEQ ID NO: 288676 - DNA, 25 bp, Homo sapien
gaggcagagcagttctttaccatca

SEQ ID NO: 288677 - DNA, 25 bp, Homo sapien
agagcagttctttaccatcaattgt

SEQ ID NO: 288678 - DNA, 25 bp, Homo sapien
gcagttctttaccatcaattgtgat

SEQ ID NO: 288679 - DNA, 25 bp, Homo sapien
taccatcaattgtgataggcacggg

SEQ ID NO: 288680 - DNA, 25 bp, Homo sapien
gaaccaggctgagagaatgaagtgc

SEQ ID NO: 288681 - DNA, 25 bp, Homo sapien
aatagctttgtttgtgttagacttc

SEQ ID NO: 288682 - DNA, 25 bp, Homo sapien
gtttgtgttagacttcacttctact

SEQ ID NO: 288683 - DNA, 25 bp, Homo sapien
gtgttagacttcacttctacttgta

SEQ ID NO: 288684 - DNA, 25 bp, Homo sapien
tagacttcacttctacttgtatttt

SEQ ID NO: 288685 - DNA, 25 bp, Homo sapien
ttctttcttgttaaaagtctagaca

SEQ ID NO: 288686 - DNA, 25 bp, Homo sapien
gtctagacaactgagatttacttac

SEQ ID NO: 288687 - DNA, 25 bp, Homo sapien
tttgaacttgttccaatccaaaagt

SEQ ID NO: 288688 - DNA, 25 bp, Homo sapien
tgttccaatccaaaagtaagcacta

SEQ ID NO: 288689 - DNA, 25 bp, Homo sapien
gtaagcactaagtctcattttatga

SEQ ID NO: 288690 - DNA, 25 bp, Homo sapien
tttatgagaccaccatttcttaata

SEQ ID NO: 288691 - DNA, 25 bp, Homo sapien
gagaccaccatttcttaatatcaca

SEQ ID NO: 288692 - DNA, 25 bp, Homo sapien
ggattttatccaagaactctctgag

SEQ ID NO: 288693 - DNA, 25 bp, Homo sapien
ttatccaagaactctctgaggttct

SEQ ID NO: 288694 - DNA, 25 bp, Homo sapien
gaggttcttgttcaatttgggatcc

SEQ ID NO: 288695 - DNA, 25 bp, Homo sapien
tcttgttcaatttgggatccctcct

SEQ ID NO: 288696 - DNA, 25 bp, Homo sapien
aatttgggatccctcctgagggcag

SEQ ID NO: 288697 - DNA, 25 bp, Homo sapien
cagcctacattgcagtgagagtacc

SEQ ID NO: 288698 - DNA, 25 bp, Homo sapien
gtgagagtaccagcaaactgaagaa

SEQ ID NO: 288699 - DNA, 25 bp, Homo sapien
atatggttctgaaagacttggtcaa

SEQ ID NO: 288700 - DNA, 25 bp, Homo sapien
gaacggcaatgtctgtactaataac

SEQ ID NO: 288701 - DNA, 25 bp, Homo sapien
gtctgtactaataacatcagcatgt

SEQ ID NO: 288702 - DNA, 25 bp, Homo sapien
ataacatcagcatgtatgagttact

SEQ ID NO: 288703 - DNA, 25 bp, Homo sapien
attctgactgtatcactgaaaggct

SEQ ID NO: 288704 - DNA, 25 bp, Homo sapien
aggctgtgtagctgtgtgaccgtaa

SEQ ID NO: 288705 - DNA, 25 bp, Homo sapien
gcaagtcacttaactccagattctc

SEQ ID NO: 288706 - DNA, 25 bp, Homo sapien
ccagattctcagtgctgtcatctat

SEQ ID NO: 288707 - DNA, 25 bp, Homo sapien
agtgctgtcatctataaacagggat

SEQ ID NO: 288708 - DNA, 25 bp, Homo sapien
gaatgaatatacacctcagagttgt

SEQ ID NO: 288709 - DNA, 25 bp, Homo sapien
acacctcagagttgttaagaatcca

SEQ ID NO: 288710 - DNA, 25 bp, Homo sapien
caatgagaaaatcacgggtaaccct

SEQ ID NO: 288711 - DNA, 25 bp, Homo sapien
gatacaagcatccttggcctttgca

SEQ ID NO: 288712 - DNA, 25 bp, Homo sapien
acatttttcctacaatccaaccaca

SEQ ID NO: 288713 - DNA, 25 bp, Homo sapien
tcctacaatccaaccacatcaagaa

SEQ ID NO: 288714 - DNA, 25 bp, Homo sapien
ttttttctttcttagcagtctgtaa

SEQ ID NO: 288715 - DNA, 25 bp, Homo sapien
gatagtgtctttaattcagtgcaat

SEQ ID NO: 288716 - DNA, 25 bp, Homo sapien
attcagtgcaataatgaccaatcat

SEQ ID NO: 288717 - DNA, 25 bp, Homo sapien
atcatatgacatagctgcgtaagaa

SEQ ID NO: 288718 - DNA, 25 bp, Homo sapien
ctgcgtaagaacaggaactttgtct

SEQ ID NO: 288719 - DNA, 25 bp, Homo sapien
caggaactttgtctatagccaaatc

SEQ ID NO: 288720 - DNA, 25 bp, Homo sapien
tagccaaatcatgaaatctgtgtat

SEQ ID NO: 288721 - DNA, 25 bp, Homo sapien
aatctgtgtatcatttttacccaaa

SEQ ID NO: 288722 - DNA, 25 bp, Homo sapien
taaggtatctagttatccatagcag

SEQ ID NO: 288723 - DNA, 25 bp, Homo sapien
tagttatccatagcagttttctgta

SEQ ID NO: 288724 - DNA, 25 bp, Homo sapien
agcagttttctgtaatctatcatac

SEQ ID NO: 288725 - DNA, 25 bp, Homo sapien
tcaacataggagttttgggaggaca

SEQ ID NO: 288726 - DNA, 25 bp, Homo sapien
gtccataacaccaagtacagtccac

SEQ ID NO: 288727 - DNA, 25 bp, Homo sapien
agtacagtccacaaggagcacaact

SEQ ID NO: 288728 - DNA, 25 bp, Homo sapien
gagttcttggtgaacatcctcttcc

SEQ ID NO: 288729 - DNA, 25 bp, Homo sapien
aaggagcacaactgcccttgggata

SEQ ID NO: 288730 - DNA, 25 bp, Homo sapien
ctgcccttgggataagaataatagt

SEQ ID NO: 288731 - DNA, 25 bp, Homo sapien
aacatcctcttcctggtctacagag

SEQ ID NO: 288732 - DNA, 25 bp, Homo sapien
cttcctggtctacagagtactgtgt

SEQ ID NO: 288733 - DNA, 25 bp, Homo sapien
gagtactgtgtacttaagtggaaaa

SEQ ID NO: 288734 - DNA, 25 bp, Homo sapien
agtagggtaagctggttctctggcc

SEQ ID NO: 288735 - DNA, 25 bp, Homo sapien
tagggtaagctggttctctggcctc

SEQ ID NO: 288736 - DNA, 25 bp, Homo sapien
caaagaaaccgcttggaaccaatgg

SEQ ID NO: 288737 - DNA, 25 bp, Homo sapien
atggataccatatttgttaagcaag

SEQ ID NO: 288738 - DNA, 25 bp, Homo sapien
ttaaagaaggaggacctgcttttga

SEQ ID NO: 288739 - DNA, 25 bp, Homo sapien
cttttgaagctggattatgtacagg

SEQ ID NO: 288740 - DNA, 25 bp, Homo sapien
ttatgtacaggtgaccgaattataa

SEQ ID NO: 288741 - DNA, 25 bp, Homo sapien
ggcaaaacctattcccaagtaattg

SEQ ID NO: 288742 - DNA, 25 bp, Homo sapien
cctattcccaagtaattgctttaat

SEQ ID NO: 288743 - DNA, 25 bp, Homo sapien
aattgctttaattcaaaacagtgat

SEQ ID NO: 288744 - DNA, 25 bp, Homo sapien
aaacagtgatacaacattggaactt

SEQ ID NO: 288745 - DNA, 25 bp, Homo sapien
aacattggaacttagtgttatgcca

SEQ ID NO: 288746 - DNA, 25 bp, Homo sapien
tagtgttatgccaaaagatgaagac

SEQ ID NO: 288747 - DNA, 25 bp, Homo sapien
gaattcatggtgagaagtctacaat

SEQ ID NO: 288748 - DNA, 25 bp, Homo sapien
ggtgagaagtctacaatttaaatga

SEQ ID NO: 288749 - DNA, 25 bp, Homo sapien
gaagagtagattcccataaaaaaca

SEQ ID NO: 288750 - DNA, 25 bp, Homo sapien
aacaaccaatgccaatcatgttctg

SEQ ID NO: 288751 - DNA, 25 bp, Homo sapien
aaccaatgccaatcatgttctggaa

SEQ ID NO: 288752 - DNA, 25 bp, Homo sapien
aatgccaatcatgttctggaagtga

SEQ ID NO: 288753 - DNA, 25 bp, Homo sapien
gccaatcatgttctggaagtgataa

SEQ ID NO: 288754 - DNA, 25 bp, Homo sapien
gtgaaaactacatttgccattcctg

SEQ ID NO: 288755 - DNA, 25 bp, Homo sapien
aaaactacatttgccattcctgact

SEQ ID NO: 288756 - DNA, 25 bp, Homo sapien
aactacatttgccattcctgacttt

SEQ ID NO: 288757 - DNA, 25 bp, Homo sapien
actacatttgccattcctgactttt

SEQ ID NO: 288758 - DNA, 25 bp, Homo sapien
ggcgatttctccgacgcgacgagac

SEQ ID NO: 288759 - DNA, 25 bp, Homo sapien
tttctccgacgcgacgagacaagtc

SEQ ID NO: 288760 - DNA, 25 bp, Homo sapien
gcgacgagacaagtccgggagccaa

SEQ ID NO: 288761 - DNA, 25 bp, Homo sapien
gacaagtccgggagccaagactcgc

SEQ ID NO: 288762 - DNA, 25 bp, Homo sapien
gtccgggagccaagactcgcagctg

SEQ ID NO: 288763 - DNA, 25 bp, Homo sapien
gcggccaactccctgcacaaagtgg

SEQ ID NO: 288764 - DNA, 25 bp, Homo sapien
aactccctgcacaaagtgggctttg

SEQ ID NO: 288765 - DNA, 25 bp, Homo sapien
aagtgggctttgtctgggtcccctg

SEQ ID NO: 288766 - DNA, 25 bp, Homo sapien
acagcggcggagtccccagaaaggg

SEQ ID NO: 288767 - DNA, 25 bp, Homo sapien
gccccaaggaagaccgaggcgactc

SEQ ID NO: 288768 - DNA, 25 bp, Homo sapien
ggccgcgcgagctcggaaccaagac

SEQ ID NO: 288769 - DNA, 25 bp, Homo sapien
gattttattgaaacctaaaggcatt

SEQ ID NO: 288770 - DNA, 25 bp, Homo sapien
ggcattttgaatgacattgttacca

SEQ ID NO: 288771 - DNA, 25 bp, Homo sapien
tgacattgttaccaaccattaattg

SEQ ID NO: 288772 - DNA, 25 bp, Homo sapien
accattaattggctcaggacctttg

SEQ ID NO: 288773 - DNA, 25 bp, Homo sapien
ggctcaggacctttgtaatttttat

SEQ ID NO: 288774 - DNA, 25 bp, Homo sapien
ttttttacgctgcttttttcaatgc

SEQ ID NO: 288775 - DNA, 25 bp, Homo sapien
gcttttttcaatgcatttcttaata

SEQ ID NO: 288776 - DNA, 25 bp, Homo sapien
agtttcatgaatgcatgctcagttt

SEQ ID NO: 288777 - DNA, 25 bp, Homo sapien
tatgttgattcagtgttttgtaaat

SEQ ID NO: 288778 - DNA, 25 bp, Homo sapien
cagagtatttttgtatgtactgtaa

SEQ ID NO: 288779 - DNA, 25 bp, Homo sapien
gtactgtaagataccatcttttcaa

SEQ ID NO: 288780 - DNA, 25 bp, Homo sapien
acacattggcctacatttgcctaca

SEQ ID NO: 288781 - DNA, 25 bp, Homo sapien
atttgcctacacagaatatcacgaa

SEQ ID NO: 288782 - DNA, 25 bp, Homo sapien
atatcacgaaatgtcctataatgga

SEQ ID NO: 288783 - DNA, 25 bp, Homo sapien
ataatggaggcttaacccctggcat

SEQ ID NO: 288784 - DNA, 25 bp, Homo sapien
aaggcttctactagcttttagcaga

SEQ ID NO: 288785 - DNA, 25 bp, Homo sapien
agaaatagtcagaaaagtgcctttt

SEQ ID NO: 288786 - DNA, 25 bp, Homo sapien
aatggctgccgcgtatttaggaaaa

SEQ ID NO: 288787 - DNA, 25 bp, Homo sapien
acatcagatttcaatcattggaatc

SEQ ID NO: 288788 - DNA, 25 bp, Homo sapien
tcaaatttgaccttttcatcagcaa

SEQ ID NO: 288789 - DNA, 25 bp, Homo sapien
caaatttaagtttgcttccagatgc

SEQ ID NO: 288790 - DNA, 25 bp, Homo sapien
tgcttccagatgcagaacaattcat

SEQ ID NO: 288791 - DNA, 25 bp, Homo sapien
agggcgcccccatcttacaggtggg

SEQ ID NO: 288792 - DNA, 25 bp, Homo sapien
cacttgaggaccactggctggtaac

SEQ ID NO: 288793 - DNA, 25 bp, Homo sapien
gaccactggctggtaactgactaaa

SEQ ID NO: 288794 - DNA, 25 bp, Homo sapien
tggtaactgactaaacaggcacctt

SEQ ID NO: 288795 - DNA, 25 bp, Homo sapien
gcacctttggattcagggagtgttt

SEQ ID NO: 288796 - DNA, 25 bp, Homo sapien
gattcagggagtgtttcccagccaa

SEQ ID NO: 288797 - DNA, 25 bp, Homo sapien
gtgtttcccagccaatacggagtgc

SEQ ID NO: 288798 - DNA, 25 bp, Homo sapien
ccaatacggagtgctggcagacacg

SEQ ID NO: 288799 - DNA, 25 bp, Homo sapien
gggtgtctgggtgcggttcagctac

SEQ ID NO: 288800 - DNA, 25 bp, Homo sapien
ttcgttcctgcctgtgccacactag

SEQ ID NO: 288801 - DNA, 25 bp, Homo sapien
gtgccacactagctgtgggatctga

SEQ ID NO: 288802 - DNA, 25 bp, Homo sapien
tttggtgctggagctctccaaatta

SEQ ID NO: 288803 - DNA, 25 bp, Homo sapien
tggagctctccaaattaagaatggg

SEQ ID NO: 288804 - DNA, 25 bp, Homo sapien
gaatgggtagtgacaaactttgaac

SEQ ID NO: 288805 - DNA, 25 bp, Homo sapien
acagtcaatttctaaatgggagtct

SEQ ID NO: 288806 - DNA, 25 bp, Homo sapien
atgggagtctatcatgtctcccctt

SEQ ID NO: 288807 - DNA, 25 bp, Homo sapien
atgtctcccctttgcaatactggct

SEQ ID NO: 288808 - DNA, 25 bp, Homo sapien
ctttgcaatactggcttcccaacag

SEQ ID NO: 288809 - DNA, 25 bp, Homo sapien
ggaattctatacttgtccagtccac

SEQ ID NO: 288810 - DNA, 25 bp, Homo sapien
ttgtccagtccaccataatgggtat

SEQ ID NO: 288811 - DNA, 25 bp, Homo sapien
ccaccataatgggtattctcattga

SEQ ID NO: 288812 - DNA, 25 bp, Homo sapien
tacttatatacagcagacaccatca

SEQ ID NO: 288813 - DNA, 25 bp, Homo sapien
tgccagtctcttaactcagacagaa

SEQ ID NO: 288814 - DNA, 25 bp, Homo sapien
agtactaaaacagctgtcaatctag

SEQ ID NO: 288815 - DNA, 25 bp, Homo sapien
tgtcaatctagaaatctctgccccg

SEQ ID NO: 288816 - DNA, 25 bp, Homo sapien
tctgccccgcaaaaactgtcataaa

SEQ ID NO: 288817 - DNA, 25 bp, Homo sapien
aatactgcaagacccatgttcagat

SEQ ID NO: 288818 - DNA, 25 bp, Homo sapien
gagggaggactctttgttttctcca

SEQ ID NO: 288819 - DNA, 25 bp, Homo sapien
accagtttggctcctgaggtttctt

SEQ ID NO: 288820 - DNA, 25 bp, Homo sapien
gaggtttcttcagcgttaggtttct

SEQ ID NO: 288821 - DNA, 25 bp, Homo sapien
gcgttaggtttctgtagggcccagc

SEQ ID NO: 288822 - DNA, 25 bp, Homo sapien
cagctttctccagtgtttggctact

SEQ ID NO: 288823 - DNA, 25 bp, Homo sapien
aactctgtgttctgccagtctctta

SEQ ID NO: 288824 - DNA, 25 bp, Homo sapien
ggatccaagtcctaaccttaagcaa

SEQ ID NO: 288825 - DNA, 25 bp, Homo sapien
agtcctaaccttaagcaagtggctt

SEQ ID NO: 288826 - DNA, 25 bp, Homo sapien
ctaaccttaagcaagtggcttggct

SEQ ID NO: 288827 - DNA, 25 bp, Homo sapien
gtggcttggctgttaaattcttggt

SEQ ID NO: 288828 - DNA, 25 bp, Homo sapien
taaattcttggtgtcctcatcttaa

SEQ ID NO: 288829 - DNA, 25 bp, Homo sapien
cttggtgtcctcatcttaaatggaa

SEQ ID NO: 288830 - DNA, 25 bp, Homo sapien
ataatagtacctgctgcacaggtta

SEQ ID NO: 288831 - DNA, 25 bp, Homo sapien
ctgctgcacaggttattaatgagta

SEQ ID NO: 288832 - DNA, 25 bp, Homo sapien
tgaggactctccctgcacctagttt

SEQ ID NO: 288833 - DNA, 25 bp, Homo sapien
tctccctgcacctagtttttgtgat

SEQ ID NO: 288834 - DNA, 25 bp, Homo sapien
aatgggtgtcatgctgacatgtccc

SEQ ID NO: 288835 - DNA, 25 bp, Homo sapien
ctgtctccatatttaggtagtgtca

SEQ ID NO: 288836 - DNA, 25 bp, Homo sapien
tctccatatttaggtagtgtcagtg

SEQ ID NO: 288837 - DNA, 25 bp, Homo sapien
gtgtcagtggctgagtatcaccgca

SEQ ID NO: 288838 - DNA, 25 bp, Homo sapien
tatcaccgcaggatcgatgctctaa

SEQ ID NO: 288839 - DNA, 25 bp, Homo sapien
aggatcgatgctctaaatactgaag

SEQ ID NO: 288840 - DNA, 25 bp, Homo sapien
aaatactgaagaactgcgcacactc

SEQ ID NO: 288841 - DNA, 25 bp, Homo sapien
ctgtttttctcaactgtcagtggaa

SEQ ID NO: 288842 - DNA, 25 bp, Homo sapien
aactgtcagtggaattattgtcttc

SEQ ID NO: 288843 - DNA, 25 bp, Homo sapien
cagtggaattattgtcttcctgtct

SEQ ID NO: 288844 - DNA, 25 bp, Homo sapien
tgtcttcctgtctccatatttaggt

SEQ ID NO: 288845 - DNA, 25 bp, Homo sapien
cttcctgtctccatatttaggtagt

SEQ ID NO: 288846 - DNA, 25 bp, Homo sapien
tttatggcagcttcggcgccgtggc

SEQ ID NO: 288847 - DNA, 25 bp, Homo sapien
ccagcggtgcctttattcaattgaa

SEQ ID NO: 288848 - DNA, 25 bp, Homo sapien
ggaatggacaagtgatgcaagagcc

SEQ ID NO: 288849 - DNA, 25 bp, Homo sapien
aattgaaacagcgtgattttgcggc

SEQ ID NO: 288850 - DNA, 25 bp, Homo sapien
attttgcggctaaatccacatcctt

SEQ ID NO: 288851 - DNA, 25 bp, Homo sapien
ggctaaatccacatcctttcatgta

SEQ ID NO: 288852 - DNA, 25 bp, Homo sapien
atccacatcctttcatgtattgttt

SEQ ID NO: 288853 - DNA, 25 bp, Homo sapien
tttttatatcagaacgcgtaagagt

SEQ ID NO: 288854 - DNA, 25 bp, Homo sapien
gcaagagccagttgagttaccaaat

SEQ ID NO: 288855 - DNA, 25 bp, Homo sapien
gatctgaaaaagctcggtccgggtt

SEQ ID NO: 288856 - DNA, 25 bp, Homo sapien
ggtccgggttcctagctctatattc

SEQ ID NO: 288857 - DNA, 25 bp, Homo sapien
ggacaaacaatctcagctgcttcaa

SEQ ID NO: 288858 - DNA, 25 bp, Homo sapien
tgcttcaatcagactcacttccttt

SEQ ID NO: 288859 - DNA, 25 bp, Homo sapien
gactcacttcctttcattcagatgg

SEQ ID NO: 288860 - DNA, 25 bp, Homo sapien
gactttggaatattgtatgggctcg

SEQ ID NO: 288861 - DNA, 25 bp, Homo sapien
atgggctcgtaatcagcgtactgaa

SEQ ID NO: 288862 - DNA, 25 bp, Homo sapien
gcgtactgaatttcaagccattcct

SEQ ID NO: 288863 - DNA, 25 bp, Homo sapien
aagccattccttggccactcaatgg

SEQ ID NO: 288864 - DNA, 25 bp, Homo sapien
cactcaatggccactactaaatcac

SEQ ID NO: 288865 - DNA, 25 bp, Homo sapien
acacaacccacccaactggagaatt

SEQ ID NO: 288866 - DNA, 25 bp, Homo sapien
gaatccgagtgatcgctaaggcaat

SEQ ID NO: 288867 - DNA, 25 bp, Homo sapien
tcatatattttacccaccttaggat

SEQ ID NO: 288868 - DNA, 25 bp, Homo sapien
tagagcatcgatcctgcggtgatac

SEQ ID NO: 288869 - DNA, 25 bp, Homo sapien
atcgatcctgcggtgatactcagcc

SEQ ID NO: 288870 - DNA, 25 bp, Homo sapien
ctgcggtgatactcagccactgaca

SEQ ID NO: 288871 - DNA, 25 bp, Homo sapien
tcagccactgacactacctaaatat

SEQ ID NO: 288872 - DNA, 25 bp, Homo sapien
tgacactacctaaatatggagacag

SEQ ID NO: 288873 - DNA, 25 bp, Homo sapien
gaagacaataattccactgacagtt

SEQ ID NO: 288874 - DNA, 25 bp, Homo sapien
ttccactgacagttgagaaaaacag

SEQ ID NO: 288875 - DNA, 25 bp, Homo sapien
gcgtctgcagagtgtgcgcagttct

SEQ ID NO: 288876 - DNA, 25 bp, Homo sapien
cagagtgtgcgcagttcttcagtat

SEQ ID NO: 288877 - DNA, 25 bp, Homo sapien
gagtgtgcgcagttcttcagtattt

SEQ ID NO: 288878 - DNA, 25 bp, Homo sapien
cttcagtatttagagcatcgatcct

SEQ ID NO: 288879 - DNA, 25 bp, Homo sapien
gtaaagtcttcagtcggtcttcaca

SEQ ID NO: 288880 - DNA, 25 bp, Homo sapien
aaagtcttcagtcggtcttcacaac

SEQ ID NO: 288881 - DNA, 25 bp, Homo sapien
ttcagtcggtcttcacaactacagt

SEQ ID NO: 288882 - DNA, 25 bp, Homo sapien
ggtcttcacaactacagtctcatca

SEQ ID NO: 288883 - DNA, 25 bp, Homo sapien
tcacaactacagtctcatcagcgag

SEQ ID NO: 288884 - DNA, 25 bp, Homo sapien
actacagtctcatcagcgagttcac

SEQ ID NO: 288885 - DNA, 25 bp, Homo sapien
gcttcagttggcgatcaaatcttac

SEQ ID NO: 288886 - DNA, 25 bp, Homo sapien
gttggcgatcaaatcttacagttca

SEQ ID NO: 288887 - DNA, 25 bp, Homo sapien
gatcaaatcttacagttcatcacag

SEQ ID NO: 288888 - DNA, 25 bp, Homo sapien
atcttacagttcatcacagaatcca

SEQ ID NO: 288889 - DNA, 25 bp, Homo sapien
aatccatgttggtgataaatcctat

SEQ ID NO: 288890 - DNA, 25 bp, Homo sapien
cacacaccattgtggcattattagt

SEQ ID NO: 288891 - DNA, 25 bp, Homo sapien
tttgagcagaagtcacttgagaaac

SEQ ID NO: 288892 - DNA, 25 bp, Homo sapien
acggcagttgcaggaagggttccct

SEQ ID NO: 288893 - DNA, 25 bp, Homo sapien
gttgcaggaagggttccctgacctg

SEQ ID NO: 288894 - DNA, 25 bp, Homo sapien
ggaagggttccctgacctgctgtct

SEQ ID NO: 288895 - DNA, 25 bp, Homo sapien
tgctgtctccctaaaagcaggtaat

SEQ ID NO: 288896 - DNA, 25 bp, Homo sapien
agcaggtaatacaatttcccatgag

SEQ ID NO: 288897 - DNA, 25 bp, Homo sapien
ggtaatacaatttcccatgagaaag

SEQ ID NO: 288898 - DNA, 25 bp, Homo sapien
gaagagaagaacatccttactggag

SEQ ID NO: 288899 - DNA, 25 bp, Homo sapien
gatgacgaaatggatctgtacaaac

SEQ ID NO: 288900 - DNA, 25 bp, Homo sapien
aatggatctgtacaaacaaatctac

SEQ ID NO: 288901 - DNA, 25 bp, Homo sapien
gagaaaagccattgttttaagagaa

SEQ ID NO: 288902 - DNA, 25 bp, Homo sapien
gaaaaagtttgtacaggtctgtaat

SEQ ID NO: 288903 - DNA, 25 bp, Homo sapien
actgcggtgccctctgagtgttttg

SEQ ID NO: 288904 - DNA, 25 bp, Homo sapien
caggtctgtaattttatagtgaaca

SEQ ID NO: 288905 - DNA, 25 bp, Homo sapien
caaaaatttcttacgttcttgcagt

SEQ ID NO: 288906 - DNA, 25 bp, Homo sapien
gcggtgccctctgagtgttttgaaa

SEQ ID NO: 288907 - DNA, 25 bp, Homo sapien
atttcttacgttcttgcagtttgag

SEQ ID NO: 288908 - DNA, 25 bp, Homo sapien
acgttcttgcagtttgagaggtact

SEQ ID NO: 288909 - DNA, 25 bp, Homo sapien
ggtgccctctgagtgttttgaaatg

SEQ ID NO: 288910 - DNA, 25 bp, Homo sapien
ctgtgtaccaggcaatgtttttcaa

SEQ ID NO: 288911 - DNA, 25 bp, Homo sapien
aggaaaaagtagctgtgcttttgca

SEQ ID NO: 288912 - DNA, 25 bp, Homo sapien
gctctgctccactgctggaaggaac

SEQ ID NO: 288913 - DNA, 25 bp, Homo sapien
ggtgaaccgaaacttacagagctca

SEQ ID NO: 288914 - DNA, 25 bp, Homo sapien
gaagcagcactgaacaaaggccatt

SEQ ID NO: 288915 - DNA, 25 bp, Homo sapien
aagcgacaccagaaacctaaggcgg

SEQ ID NO: 288916 - DNA, 25 bp, Homo sapien
cccggctcaacaaggatctcatgtt

SEQ ID NO: 288917 - DNA, 25 bp, Homo sapien
ggtcagagattcttgtgtcgtgtct

SEQ ID NO: 288918 - DNA, 25 bp, Homo sapien
tgtcgtgtctgggtgaggtcaaaaa

SEQ ID NO: 288919 - DNA, 25 bp, Homo sapien
aaaccatgcagagactttcacttcc

SEQ ID NO: 288920 - DNA, 25 bp, Homo sapien
agagctcaagtcacttgaccaggct

SEQ ID NO: 288921 - DNA, 25 bp, Homo sapien
caggctccatccctacaagaggcag

SEQ ID NO: 288922 - DNA, 25 bp, Homo sapien
aggcggccttttccaaagcttgtgc

SEQ ID NO: 288923 - DNA, 25 bp, Homo sapien
acttcatgtgtttgtgtagcctgga

SEQ ID NO: 288924 - DNA, 25 bp, Homo sapien
tggaatctattctaccttcacaggt

SEQ ID NO: 288925 - DNA, 25 bp, Homo sapien
caggttagaacatcttgatttcctc

SEQ ID NO: 288926 - DNA, 25 bp, Homo sapien
acgaaacattccctaacggtgtatg

SEQ ID NO: 288927 - DNA, 25 bp, Homo sapien
gtagtcatgagggaaccaccattca

SEQ ID NO: 288928 - DNA, 25 bp, Homo sapien
gcatttccacactgcaaacattttt

SEQ ID NO: 288929 - DNA, 25 bp, Homo sapien
accattcaagatgccctgctcagga

SEQ ID NO: 288930 - DNA, 25 bp, Homo sapien
acttggcatgagcactatggtcagc

SEQ ID NO: 288931 - DNA, 25 bp, Homo sapien
aaacattttttagggctatcttctg

SEQ ID NO: 288932 - DNA, 25 bp, Homo sapien
ttggaagcagtcttggcagcaacct

SEQ ID NO: 288933 - DNA, 25 bp, Homo sapien
ggcagcaacctctttagtaatcaat

SEQ ID NO: 288934 - DNA, 25 bp, Homo sapien
gggagccaacaaaggccgagatttg

SEQ ID NO: 288935 - DNA, 25 bp, Homo sapien
aaaggccgagatttgaggtcaccag

SEQ ID NO: 288936 - DNA, 25 bp, Homo sapien
agatttgaggtcaccagctctaggc

SEQ ID NO: 288937 - DNA, 25 bp, Homo sapien
tgaggtcaccagctctaggcccagg

SEQ ID NO: 288938 - DNA, 25 bp, Homo sapien
ggcccaggctgagcctaatgttgtt

SEQ ID NO: 288939 - DNA, 25 bp, Homo sapien
aatgttgtttagagtcacagactac

SEQ ID NO: 288940 - DNA, 25 bp, Homo sapien
gagtcacagactacgcagaagaaaa

SEQ ID NO: 288941 - DNA, 25 bp, Homo sapien
ttgttgagccaactcctctgaaaag

SEQ ID NO: 288942 - DNA, 25 bp, Homo sapien
gagccaactcctctgaaaaggtggg

SEQ ID NO: 288943 - DNA, 25 bp, Homo sapien
gggtgaagcgcagcctacagtccta

SEQ ID NO: 288944 - DNA, 25 bp, Homo sapien
tgaagcgcagcctacagtcctaggg

SEQ ID NO: 288945 - DNA, 25 bp, Homo sapien
atttccagaatcaatggtggtgcta

SEQ ID NO: 288946 - DNA, 25 bp, Homo sapien
ggtggtgctaaactatctccatgtt

SEQ ID NO: 288947 - DNA, 25 bp, Homo sapien
actatctccatgtttctagcatttt

SEQ ID NO: 288948 - DNA, 25 bp, Homo sapien
tcatcacaaaaatgcagtgcccttg

SEQ ID NO: 288949 - DNA, 25 bp, Homo sapien
actttccaggtgtcctttatcactt

SEQ ID NO: 288950 - DNA, 25 bp, Homo sapien
cctttatcactttgacgggactctt

SEQ ID NO: 288951 - DNA, 25 bp, Homo sapien
ttgacgggactctttggtctgcaga

SEQ ID NO: 288952 - DNA, 25 bp, Homo sapien
aaatgctctgtcttggcatgcttct

SEQ ID NO: 288953 - DNA, 25 bp, Homo sapien
tcttggcatgcttctagactgtaag

SEQ ID NO: 288954 - DNA, 25 bp, Homo sapien
ctagactgtaagatttgggttttgt

SEQ ID NO: 288955 - DNA, 25 bp, Homo sapien
gtttacatgcatcttatatttccct

SEQ ID NO: 288956 - DNA, 25 bp, Homo sapien
gatcatacatcttcaagctgtctga

SEQ ID NO: 288957 - DNA, 25 bp, Homo sapien
taggtaggaggtagaccctttagct

SEQ ID NO: 288958 - DNA, 25 bp, Homo sapien
tttagctcccttccaattaaaggag

SEQ ID NO: 288959 - DNA, 25 bp, Homo sapien
taaaggagtccccaattctggcacc

SEQ ID NO: 288960 - DNA, 25 bp, Homo sapien
aattctggcacctgagagtcccctg

SEQ ID NO: 288961 - DNA, 25 bp, Homo sapien
agtcccctgggtctaacagctatga

SEQ ID NO: 288962 - DNA, 25 bp, Homo sapien
gtagtgtgttgcttacctaaatgaa

SEQ ID NO: 288963 - DNA, 25 bp, Homo sapien
atacaatttccttccagacacgtga

SEQ ID NO: 288964 - DNA, 25 bp, Homo sapien
tggttaaggagttcagtctgtcgtc

SEQ ID NO: 288965 - DNA, 25 bp, Homo sapien
agtctgtcgtcaggcacacaccaga

SEQ ID NO: 288966 - DNA, 25 bp, Homo sapien
cacagaccccatcagagcaaaacag

SEQ ID NO: 288967 - DNA, 25 bp, Homo sapien
ttattatcagctcagtaagtccttg

SEQ ID NO: 288968 - DNA, 25 bp, Homo sapien
cattttgtaagccacatctttgtgt

SEQ ID NO: 288969 - DNA, 25 bp, Homo sapien
taagtccttgacctcatagggagat

SEQ ID NO: 288970 - DNA, 25 bp, Homo sapien
tgttgatatccactgctttactgcc

SEQ ID NO: 288971 - DNA, 25 bp, Homo sapien
atccactgctttactgcctaataag

SEQ ID NO: 288972 - DNA, 25 bp, Homo sapien
cagcacctgtccagaaggtagaatt

SEQ ID NO: 288973 - DNA, 25 bp, Homo sapien
ggtagaattccaggattccagatga

SEQ ID NO: 288974 - DNA, 25 bp, Homo sapien
atctttgtgtttgcagaactcccta

SEQ ID NO: 288975 - DNA, 25 bp, Homo sapien
gtttgcagaactccctaaaaatgtg

SEQ ID NO: 288976 - DNA, 25 bp, Homo sapien
gaaaaagttcatgcatcccagcagg

SEQ ID NO: 288977 - DNA, 25 bp, Homo sapien
tcatgcatcccagcaggtgagaagt

SEQ ID NO: 288978 - DNA, 25 bp, Homo sapien
cagtactttttcttgtgtgattctt

SEQ ID NO: 288979 - DNA, 25 bp, Homo sapien
gtattatctcagtggattatccgga

SEQ ID NO: 288980 - DNA, 25 bp, Homo sapien
ggattatccggaataacatctgaaa

SEQ ID NO: 288981 - DNA, 25 bp, Homo sapien
aaactattgtttctcctatcccaag

SEQ ID NO: 288982 - DNA, 25 bp, Homo sapien
ctatcccaagttcgctttgcatcta

SEQ ID NO: 288983 - DNA, 25 bp, Homo sapien
gttcgctttgcatctatcagtaaat

SEQ ID NO: 288984 - DNA, 25 bp, Homo sapien
tcttcagctgccttattaggagtgc

SEQ ID NO: 288985 - DNA, 25 bp, Homo sapien
gtgctatgagggtaacacctgttct

SEQ ID NO: 288986 - DNA, 25 bp, Homo sapien
taacacctgttctgcttttcatctt

SEQ ID NO: 288987 - DNA, 25 bp, Homo sapien
gcttttcatcttgtatttagttgac

SEQ ID NO: 288988 - DNA, 25 bp, Homo sapien
ttgactgtattatttgatttcggat

SEQ ID NO: 288989 - DNA, 25 bp, Homo sapien
taaacatcatctttgattctctgtt

SEQ ID NO: 288990 - DNA, 25 bp, Homo sapien
acatcatctttgattctctgtttct

SEQ ID NO: 288991 - DNA, 25 bp, Homo sapien
tctgtttctttcatgctctcctgtt

SEQ ID NO: 288992 - DNA, 25 bp, Homo sapien
ctgtttctttcatgctctcctgttt

SEQ ID NO: 288993 - DNA, 25 bp, Homo sapien
tgtttctttcatgctctcctgtttg

SEQ ID NO: 288994 - DNA, 25 bp, Homo sapien
gtttctttcatgctctcctgtttgc

SEQ ID NO: 288995 - DNA, 25 bp, Homo sapien
tttctttcatgctctcctgtttgct

SEQ ID NO: 288996 - DNA, 25 bp, Homo sapien
tctttcatgctctcctgtttgctct

SEQ ID NO: 288997 - DNA, 25 bp, Homo sapien
tttcatgctctcctgtttgctctgc

SEQ ID NO: 288998 - DNA, 25 bp, Homo sapien
ttcatgctctcctgtttgctctgcc

SEQ ID NO: 288999 - DNA, 25 bp, Homo sapien
tctcctgtttgctctgcctccaaaa

SEQ ID NO: 289000 - DNA, 25 bp, Homo sapien
tgttttctgggtttcagttaattca

SEQ ID NO: 289001 - DNA, 25 bp, Homo sapien
actagatgctgtgaggttttgtgtc

SEQ ID NO: 289002 - DNA, 25 bp, Homo sapien
gaggttttgtgtcagcatgcaacag

SEQ ID NO: 289003 - DNA, 25 bp, Homo sapien
gtgtcagcatgcaacagtgtcacaa

SEQ ID NO: 289004 - DNA, 25 bp, Homo sapien
gcaacagtgtcacaacagtgtcatc

SEQ ID NO: 289005 - DNA, 25 bp, Homo sapien
acgtttggttctgtgttgtggatgt

SEQ ID NO: 289006 - DNA, 25 bp, Homo sapien
tattttgccccacatacatagaaag

SEQ ID NO: 289007 - DNA, 25 bp, Homo sapien
tgttgtggtaaattgctttctctcc

SEQ ID NO: 289008 - DNA, 25 bp, Homo sapien
gctttctctccatttgaaatcccat

SEQ ID NO: 289009 - DNA, 25 bp, Homo sapien
ttgaaatcccattgagttgaagaga

SEQ ID NO: 289010 - DNA, 25 bp, Homo sapien
gcatagtgagtatacgtcccaagga

SEQ ID NO: 289011 - DNA, 25 bp, Homo sapien
agctttctctgaccttgtaatgtgc

SEQ ID NO: 289012 - DNA, 25 bp, Homo sapien
taatgtgcctattttacaacagagt

SEQ ID NO: 289013 - DNA, 25 bp, Homo sapien
aacagagtgcctgactcagtctcta

SEQ ID NO: 289014 - DNA, 25 bp, Homo sapien
gactcagtctctattgctctcttga

SEQ ID NO: 289015 - DNA, 25 bp, Homo sapien
ctcttgagcctcattcactaagtga

SEQ ID NO: 289016 - DNA, 25 bp, Homo sapien
caactaatcttaggcttggaggata

SEQ ID NO: 289017 - DNA, 25 bp, Homo sapien
atagctgtgctgacattctacctgg

SEQ ID NO: 289018 - DNA, 25 bp, Homo sapien
ctacctggtgatctctctagtgatt

SEQ ID NO: 289019 - DNA, 25 bp, Homo sapien
gagagcactcttaattagcatagga

SEQ ID NO: 289020 - DNA, 25 bp, Homo sapien
acctgtataaaatgctggaatcccc

SEQ ID NO: 289021 - DNA, 25 bp, Homo sapien
tgaggcccttccaatcacacatatt

SEQ ID NO: 289022 - DNA, 25 bp, Homo sapien
attttcatctaatcgttatgtggtt

SEQ ID NO: 289023 - DNA, 25 bp, Homo sapien
aatcgttatgtggttgggatgatca

SEQ ID NO: 289024 - DNA, 25 bp, Homo sapien
gatcatggtgaaatactaggaagac

SEQ ID NO: 289025 - DNA, 25 bp, Homo sapien
ggaagacatactctgttgatggact

SEQ ID NO: 289026 - DNA, 25 bp, Homo sapien
gttgatggactttttctctccaaat

SEQ ID NO: 289027 - DNA, 25 bp, Homo sapien
atggtttatatctttctcgtcacaa

SEQ ID NO: 289028 - DNA, 25 bp, Homo sapien
aaatgttcctttgatttctagcaca

SEQ ID NO: 289029 - DNA, 25 bp, Homo sapien
ttctagcacaaggtacagcaggatg

SEQ ID NO: 289030 - DNA, 25 bp, Homo sapien
agcaggatgcaaatgattctcagat

SEQ ID NO: 289031 - DNA, 25 bp, Homo sapien
atgatgttgacagtatttccttaac

SEQ ID NO: 289032 - DNA, 25 bp, Homo sapien
gcataattttcattctaacttttga

SEQ ID NO: 289033 - DNA, 25 bp, Homo sapien
tcccagcagactgaagcttcagctt

SEQ ID NO: 289034 - DNA, 25 bp, Homo sapien
aagcttcagctttagctgcagctgc

SEQ ID NO: 289035 - DNA, 25 bp, Homo sapien
agccacttgcaacacaatgtttcca

SEQ ID NO: 289036 - DNA, 25 bp, Homo sapien
gcaacacaatgtttccaactctcta

SEQ ID NO: 289037 - DNA, 25 bp, Homo sapien
gtttccaactctctaacatgtttaa

SEQ ID NO: 289038 - DNA, 25 bp, Homo sapien
actctctaacatgtttaaccctcaa

SEQ ID NO: 289039 - DNA, 25 bp, Homo sapien
acatgtttaaccctcaaacagaaga

SEQ ID NO: 289040 - DNA, 25 bp, Homo sapien
gaagttggatgggataccgagatta

SEQ ID NO: 289041 - DNA, 25 bp, Homo sapien
aacatggaggagttattcatattta

SEQ ID NO: 289042 - DNA, 25 bp, Homo sapien
atgttgacaaaaattcagctcaggg

SEQ ID NO: 289043 - DNA, 25 bp, Homo sapien
gtgtatgtgaagtgcccatcaattg

SEQ ID NO: 289044 - DNA, 25 bp, Homo sapien
aagtccaaacttagagatgttgcag

SEQ ID NO: 289045 - DNA, 25 bp, Homo sapien
gagatgttgcagtaagacttcaaaa

SEQ ID NO: 289046 - DNA, 25 bp, Homo sapien
gtaagacttcaaaaggtccaggata

SEQ ID NO: 289047 - DNA, 25 bp, Homo sapien
gacttcaaaaggtccaggatacaga

SEQ ID NO: 289048 - DNA, 25 bp, Homo sapien
aatcttaagcttgcagagagaaaag

SEQ ID NO: 289049 - DNA, 25 bp, Homo sapien
gagagaaaagacagattacccacaa

SEQ ID NO: 289050 - DNA, 25 bp, Homo sapien
gggatacaatatttgaacagatcat

SEQ ID NO: 289051 - DNA, 25 bp, Homo sapien
tgaacagatcatggctaagttttcc

SEQ ID NO: 289052 - DNA, 25 bp, Homo sapien
agacatgagcactagaaacagtcac

SEQ ID NO: 289053 - DNA, 25 bp, Homo sapien
tgagcactagaaacagtcacaagaa

SEQ ID NO: 289054 - DNA, 25 bp, Homo sapien
acagtcacaagaagtaccaaaaaag

SEQ ID NO: 289055 - DNA, 25 bp, Homo sapien
gagtctgacccttgcaggtctaaaa

SEQ ID NO: 289056 - DNA, 25 bp, Homo sapien
ggtctaaaattatttgtctctggtc

SEQ ID NO: 289057 - DNA, 25 bp, Homo sapien
gtctctggtcataaacatatctcga

SEQ ID NO: 289058 - DNA, 25 bp, Homo sapien
aacatatctcgaacttcagactcat

SEQ ID NO: 289059 - DNA, 25 bp, Homo sapien
acttcagactcatttttggttctta

SEQ ID NO: 289060 - DNA, 25 bp, Homo sapien
aatcaccaagttctgttggtccttc

SEQ ID NO: 289061 - DNA, 25 bp, Homo sapien
ttctgttggtccttccttctaggaa

SEQ ID NO: 289062 - DNA, 25 bp, Homo sapien
attgtttttgaatctccctgttctg

SEQ ID NO: 289063 - DNA, 25 bp, Homo sapien
tttgaatctccctgttctgtctatt

SEQ ID NO: 289064 - DNA, 25 bp, Homo sapien
acatctcctgatagccctggcctgg

SEQ ID NO: 289065 - DNA, 25 bp, Homo sapien
tgctgctgactctgttgagaattag

SEQ ID NO: 289066 - DNA, 25 bp, Homo sapien
aaaatttaccaactgatgccttaag

SEQ ID NO: 289067 - DNA, 25 bp, Homo sapien
gatgccttaagtctcaaagtataca

SEQ ID NO: 289068 - DNA, 25 bp, Homo sapien
aagtatacaatccttgtttcaagtt

SEQ ID NO: 289069 - DNA, 25 bp, Homo sapien
cttgtttcaagttgaaggtcttcct

SEQ ID NO: 289070 - DNA, 25 bp, Homo sapien
aaggtcttccttagttctgcatcat

SEQ ID NO: 289071 - DNA, 25 bp, Homo sapien
tccttagttctgcatcatcctttag

SEQ ID NO: 289072 - DNA, 25 bp, Homo sapien
gttctgcatcatcctttagtcattc

SEQ ID NO: 289073 - DNA, 25 bp, Homo sapien
atcatcctttagtcattctccaggc

SEQ ID NO: 289074 - DNA, 25 bp, Homo sapien
ctttagtcattctccaggcccttct

SEQ ID NO: 289075 - DNA, 25 bp, Homo sapien
atatgcgacagtactatgtggtccc

SEQ ID NO: 289076 - DNA, 25 bp, Homo sapien
gacagtactatgtggtcccataaaa

SEQ ID NO: 289077 - DNA, 25 bp, Homo sapien
aatcaacaagaccagcaccagatcc

SEQ ID NO: 289078 - DNA, 25 bp, Homo sapien
gcaccagatccaggttctagaacaa

SEQ ID NO: 289079 - DNA, 25 bp, Homo sapien
tagaacaaagtatcctcaggcttga

SEQ ID NO: 289080 - DNA, 25 bp, Homo sapien
aaagctgaactgcaaatctcaacga

SEQ ID NO: 289081 - DNA, 25 bp, Homo sapien
aatctcaacgaaggaagaggccatt

SEQ ID NO: 289082 - DNA, 25 bp, Homo sapien
aactaaagtcaattgagcggacaac

SEQ ID NO: 289083 - DNA, 25 bp, Homo sapien
gagcggacaacagaagacattataa

SEQ ID NO: 289084 - DNA, 25 bp, Homo sapien
gagtcaattgaggacatctatgcta

SEQ ID NO: 289085 - DNA, 25 bp, Homo sapien
catctatgctaatatccctgacctt

SEQ ID NO: 289086 - DNA, 25 bp, Homo sapien
atgctaatatccctgaccttccaaa

SEQ ID NO: 289087 - DNA, 25 bp, Homo sapien
gaccttccaaagtcctacatacctt

SEQ ID NO: 289088 - DNA, 25 bp, Homo sapien
accagcaccagatccaggttctaga

SEQ ID NO: 289089 - DNA, 25 bp, Homo sapien
agcaccagatccaggttctagaaca

SEQ ID NO: 289090 - DNA, 25 bp, Homo sapien
caccagatccaggttctagaacaaa

SEQ ID NO: 289091 - DNA, 25 bp, Homo sapien
ggttctagaacaaagtatcctcagg

SEQ ID NO: 289092 - DNA, 25 bp, Homo sapien
tagaacaaagtatcctcaggcttga

SEQ ID NO: 289093 - DNA, 25 bp, Homo sapien
gaacaaagtatcctcaggcttgaga

SEQ ID NO: 289094 - DNA, 25 bp, Homo sapien
caaagtatcctcaggcttgagaaag

SEQ ID NO: 289095 - DNA, 25 bp, Homo sapien
aaagctgaactgcaaatctcaacga

SEQ ID NO: 289096 - DNA, 25 bp, Homo sapien
gctgaactgcaaatctcaacgaagg

SEQ ID NO: 289097 - DNA, 25 bp, Homo sapien
gaactgcaaatctcaacgaaggaag

SEQ ID NO: 289098 - DNA, 25 bp, Homo sapien
aatctcaacgaaggaagaggccatt

SEQ ID NO: 289099 - DNA, 25 bp, Homo sapien
aggaaagttcgtgctgctaggcaga

SEQ ID NO: 289100 - DNA, 25 bp, Homo sapien
ggaatcaagacctgctcattctttc

SEQ ID NO: 289101 - DNA, 25 bp, Homo sapien
gggatccatccagcaatgacatcat

SEQ ID NO: 289102 - DNA, 25 bp, Homo sapien
atgacatcatctcatgctgccacaa

SEQ ID NO: 289103 - DNA, 25 bp, Homo sapien
aaggaccccaagtctgggctgctgg

SEQ ID NO: 289104 - DNA, 25 bp, Homo sapien
tgctcattccttcatcctagagaca

SEQ ID NO: 289105 - DNA, 25 bp, Homo sapien
atcctagagacattctgactctcct

SEQ ID NO: 289106 - DNA, 25 bp, Homo sapien
gaactgcagcttgttggcaggtgaa

SEQ ID NO: 289107 - DNA, 25 bp, Homo sapien
aagggagcctgtttagctgtgtcca

SEQ ID NO: 289108 - DNA, 25 bp, Homo sapien
gtttagctgtgtccagcaacaactt

SEQ ID NO: 289109 - DNA, 25 bp, Homo sapien
gcaacaacttacgtggtcctgcttg

SEQ ID NO: 289110 - DNA, 25 bp, Homo sapien
aaggcctcctactgccgggaagagg

SEQ ID NO: 289111 - DNA, 25 bp, Homo sapien
tcctactgccgggaagaggccagcg

SEQ ID NO: 289112 - DNA, 25 bp, Homo sapien
gcgcgctcgctggtcaggaacctgt

SEQ ID NO: 289113 - DNA, 25 bp, Homo sapien
tcgctggtcaggaacctgtcggcag

SEQ ID NO: 289114 - DNA, 25 bp, Homo sapien
tggtcaggaacctgtcggcagcccc

SEQ ID NO: 289115 - DNA, 25 bp, Homo sapien
ctagactcggtgagcccaggctgat

SEQ ID NO: 289116 - DNA, 25 bp, Homo sapien
tgagcccaggctgatggaccgtgca

SEQ ID NO: 289117 - DNA, 25 bp, Homo sapien
gctgatggaccgtgcagtccagttt

SEQ ID NO: 289118 - DNA, 25 bp, Homo sapien
gaccgtgcagtccagtttgagccag

SEQ ID NO: 289119 - DNA, 25 bp, Homo sapien
tgcagtccagtttgagccagcccag

SEQ ID NO: 289120 - DNA, 25 bp, Homo sapien
cagcagccctcaatcgggcgggcag

SEQ ID NO: 289121 - DNA, 25 bp, Homo sapien
ggatattaacctattttctaattga

SEQ ID NO: 289122 - DNA, 25 bp, Homo sapien
aggtatcataaaatcctggagtatc

SEQ ID NO: 289123 - DNA, 25 bp, Homo sapien
taaaatcctggagtatcatcttttt

SEQ ID NO: 289124 - DNA, 25 bp, Homo sapien
agtatcatctttttcaacctcctca

SEQ ID NO: 289125 - DNA, 25 bp, Homo sapien
atctttttcaacctcctcatggtat

SEQ ID NO: 289126 - DNA, 25 bp, Homo sapien
ttcaacctcctcatggtatagatga

SEQ ID NO: 289127 - DNA, 25 bp, Homo sapien
tcttagagaacttcaggatatttct

SEQ ID NO: 289128 - DNA, 25 bp, Homo sapien
gatatttctcttgacgttccaggac

SEQ ID NO: 289129 - DNA, 25 bp, Homo sapien
atttctcttgacgttccaggacttt

SEQ ID NO: 289130 - DNA, 25 bp, Homo sapien
tctcttgacgttccaggactttgta

SEQ ID NO: 289131 - DNA, 25 bp, Homo sapien
ttgacgttccaggactttgtagtaa

SEQ ID NO: 289132 - DNA, 25 bp, Homo sapien
gggtaccagcacttagcttctctct

SEQ ID NO: 289133 - DNA, 25 bp, Homo sapien
gtaccagcacttagcttctctctga

SEQ ID NO: 289134 - DNA, 25 bp, Homo sapien
ttctctctgagtgctggctcccaag

SEQ ID NO: 289135 - DNA, 25 bp, Homo sapien
tctctgagtgctggctcccaaggaa

SEQ ID NO: 289136 - DNA, 25 bp, Homo sapien
gtgctggctcccaaggaagggacct

SEQ ID NO: 289137 - DNA, 25 bp, Homo sapien
tgctggctcccaaggaagggacctg

SEQ ID NO: 289138 - DNA, 25 bp, Homo sapien
tcccaaggaagggacctgggacctg

SEQ ID NO: 289139 - DNA, 25 bp, Homo sapien
gggcttgcccttacctcttcagaag

SEQ ID NO: 289140 - DNA, 25 bp, Homo sapien
ctcttcagaaggaagcatcttccac

SEQ ID NO: 289141 - DNA, 25 bp, Homo sapien
cttcagaaggaagcatcttccacag

SEQ ID NO: 289142 - DNA, 25 bp, Homo sapien
cacccaactttcttaggagtgatct

SEQ ID NO: 289143 - DNA, 25 bp, Homo sapien
cgaggaccccaggtgagaggccgga

SEQ ID NO: 289144 - DNA, 25 bp, Homo sapien
gtgagaggccggagggtcctggagg

SEQ ID NO: 289145 - DNA, 25 bp, Homo sapien
ttcggcccgggctccacgacgggct

SEQ ID NO: 289146 - DNA, 25 bp, Homo sapien
tggcccgggctcagggcgtgtccgt

SEQ ID NO: 289147 - DNA, 25 bp, Homo sapien
agggcgtgtccgtcgccgccgggcg

SEQ ID NO: 289148 - DNA, 25 bp, Homo sapien
cgggcggctcgctcgacactgttcg

SEQ ID NO: 289149 - DNA, 25 bp, Homo sapien
gctcgacactgttcgctcctaccgg

SEQ ID NO: 289150 - DNA, 25 bp, Homo sapien
gatcggcgggaggaaggctgtcgga

SEQ ID NO: 289151 - DNA, 25 bp, Homo sapien
gaaggctgtcggagccaatcaagcc

SEQ ID NO: 289152 - DNA, 25 bp, Homo sapien
gctgtcggagccaatcaagccgcct

SEQ ID NO: 289153 - DNA, 25 bp, Homo sapien
tgggctgcgcgctccgactgcgcct

SEQ ID NO: 289154 - DNA, 25 bp, Homo sapien
ctcacgtggtgagcactcagggcag

SEQ ID NO: 289155 - DNA, 25 bp, Homo sapien
tcagggcagcgggtcgattttccga

SEQ ID NO: 289156 - DNA, 25 bp, Homo sapien
gcgggtcgattttccgaggtcccat

SEQ ID NO: 289157 - DNA, 25 bp, Homo sapien
gattttccgaggtcccatacctggg

SEQ ID NO: 289158 - DNA, 25 bp, Homo sapien
ccgaggtcccatacctgggtttgag

SEQ ID NO: 289159 - DNA, 25 bp, Homo sapien
gaggccgacacctggaggacgcctc

SEQ ID NO: 289160 - DNA, 25 bp, Homo sapien
tgcgcgccagggatccgggataaga

SEQ ID NO: 289161 - DNA, 25 bp, Homo sapien
gaggctccagttctcatctgctcag

SEQ ID NO: 289162 - DNA, 25 bp, Homo sapien
tccagttctcatctgctcaggtgtc

SEQ ID NO: 289163 - DNA, 25 bp, Homo sapien
gttctcatctgctcaggtgtccccg

SEQ ID NO: 289164 - DNA, 25 bp, Homo sapien
actccagttcctcacgtggtgagca

SEQ ID NO: 289165 - DNA, 25 bp, Homo sapien
ttggagctggtagggaagccccaca

SEQ ID NO: 289166 - DNA, 25 bp, Homo sapien
tccactcagggatcaagagcagtgc

SEQ ID NO: 289167 - DNA, 25 bp, Homo sapien
atcatgcatggtaaagacagccctt

SEQ ID NO: 289168 - DNA, 25 bp, Homo sapien
aagacagcccttactcaagacagaa

SEQ ID NO: 289169 - DNA, 25 bp, Homo sapien
gacagaaaaagcctgatgccacatg

SEQ ID NO: 289170 - DNA, 25 bp, Homo sapien
aaaaagcctgatgccacatgagaag

SEQ ID NO: 289171 - DNA, 25 bp, Homo sapien
gaagggaagactgccagtttcattt

SEQ ID NO: 289172 - DNA, 25 bp, Homo sapien
gaagactgccagtttcatttagcat

SEQ ID NO: 289173 - DNA, 25 bp, Homo sapien
gccagtttcatttagcattgttgcc

SEQ ID NO: 289174 - DNA, 25 bp, Homo sapien
tcatttagcattgttgcctagcggg

SEQ ID NO: 289175 - DNA, 25 bp, Homo sapien
tccttttgactggcacttcatcctg

SEQ ID NO: 289176 - DNA, 25 bp, Homo sapien
gagcatctttctatcttttaaagta

SEQ ID NO: 289177 - DNA, 25 bp, Homo sapien
ttttaaagtacctgggaagatcact

SEQ ID NO: 289178 - DNA, 25 bp, Homo sapien
gcaatacttgtagggaatcacggca

SEQ ID NO: 289179 - DNA, 25 bp, Homo sapien
agggaatcacggcaccttaattgtc

SEQ ID NO: 289180 - DNA, 25 bp, Homo sapien
gaatcacggcaccttaattgtccaa

SEQ ID NO: 289181 - DNA, 25 bp, Homo sapien
tcacggcaccttaattgtccaattt

SEQ ID NO: 289182 - DNA, 25 bp, Homo sapien
atttgggttgtattgtctcttggtc

SEQ ID NO: 289183 - DNA, 25 bp, Homo sapien
gttgtattgtctcttggtctgtcac

SEQ ID NO: 289184 - DNA, 25 bp, Homo sapien
attgtctcttggtctgtcactagga

SEQ ID NO: 289185 - DNA, 25 bp, Homo sapien
gtctcttggtctgtcactaggatga

SEQ ID NO: 289186 - DNA, 25 bp, Homo sapien
gtctgtcactaggatgagcatcttt

SEQ ID NO: 289187 - DNA, 25 bp, Homo sapien
acatcacagcaatagttgctatacg

SEQ ID NO: 289188 - DNA, 25 bp, Homo sapien
gttgctatacgtaagaacatgctaa

SEQ ID NO: 289189 - DNA, 25 bp, Homo sapien
ctatacgtaagaacatgctaagcaa

SEQ ID NO: 289190 - DNA, 25 bp, Homo sapien
ggtctaatttaattgcttttaatat

SEQ ID NO: 289191 - DNA, 25 bp, Homo sapien
aaaagactggtttgatttgcctatg

SEQ ID NO: 289192 - DNA, 25 bp, Homo sapien
gactggtttgatttgcctatggtgt

SEQ ID NO: 289193 - DNA, 25 bp, Homo sapien
tttgcctatggtgtgaaatcctttg

SEQ ID NO: 289194 - DNA, 25 bp, Homo sapien
gcctatggtgtgaaatcctttgtta

SEQ ID NO: 289195 - DNA, 25 bp, Homo sapien
gtgtgaaatcctttgttatttttct

SEQ ID NO: 289196 - DNA, 25 bp, Homo sapien
aacaagaagctatttacccaaagtg

SEQ ID NO: 289197 - DNA, 25 bp, Homo sapien
gctatttacccaaagtgagctttca

SEQ ID NO: 289198 - DNA, 25 bp, Homo sapien
atattctcagtgcttgtgcccacct

SEQ ID NO: 289199 - DNA, 25 bp, Homo sapien
accttggaactctgttcttgctctt

SEQ ID NO: 289200 - DNA, 25 bp, Homo sapien
ttgattcagaagctctttccctacc

SEQ ID NO: 289201 - DNA, 25 bp, Homo sapien
ttcttgctcttcattccgcatgtga

SEQ ID NO: 289202 - DNA, 25 bp, Homo sapien
ccgcatgtgatactctggtccaaga

SEQ ID NO: 289203 - DNA, 25 bp, Homo sapien
aaatatcgtctcagaggtgcttccc

SEQ ID NO: 289204 - DNA, 25 bp, Homo sapien
aggtgcttcccttgaaaactcggtg

SEQ ID NO: 289205 - DNA, 25 bp, Homo sapien
cggtgctgtttccatagttactcta

SEQ ID NO: 289206 - DNA, 25 bp, Homo sapien
agttactctatttgatcactctaag

SEQ ID NO: 289207 - DNA, 25 bp, Homo sapien
tctaagtttggttgtcttcatagca

SEQ ID NO: 289208 - DNA, 25 bp, Homo sapien
caagactacactttcttgccttctt

SEQ ID NO: 289209 - DNA, 25 bp, Homo sapien
tgggccatacacgtgttcaagaact

SEQ ID NO: 289210 - DNA, 25 bp, Homo sapien
ggtagcaagtgagtgcagacccacc

SEQ ID NO: 289211 - DNA, 25 bp, Homo sapien
actcataggcctcagatacacgatc

SEQ ID NO: 289212 - DNA, 25 bp, Homo sapien
gatacacgatcacctgtcatatcag

SEQ ID NO: 289213 - DNA, 25 bp, Homo sapien
atatcaggtgagcactggcctgctt

SEQ ID NO: 289214 - DNA, 25 bp, Homo sapien
gcccctccaggtgtaggaacagcaa

SEQ ID NO: 289215 - DNA, 25 bp, Homo sapien
agcaacactcctggctgacaactaa

SEQ ID NO: 289216 - DNA, 25 bp, Homo sapien
aatatggccctaggtcattcttgct

SEQ ID NO: 289217 - DNA, 25 bp, Homo sapien
attcttgcttccaatatgcttgcca

SEQ ID NO: 289218 - DNA, 25 bp, Homo sapien
atatgcttgccactccttaaatgtc

SEQ ID NO: 289219 - DNA, 25 bp, Homo sapien
ggagatcgtgttctgctttttacat

SEQ ID NO: 289220 - DNA, 25 bp, Homo sapien
gtgaaattcacataagcatgcccat

SEQ ID NO: 289221 - DNA, 25 bp, Homo sapien
ataagcatgcccattactaaagaca

SEQ ID NO: 289222 - DNA, 25 bp, Homo sapien
aggaacctacagcttcaactgactt

SEQ ID NO: 289223 - DNA, 25 bp, Homo sapien
agcttcaactgacttacgtgcagat

SEQ ID NO: 289224 - DNA, 25 bp, Homo sapien
acgtgcagatatgtaccaggagaac

SEQ ID NO: 289225 - DNA, 25 bp, Homo sapien
agaacatcattttagcttgggcgtc

SEQ ID NO: 289226 - DNA, 25 bp, Homo sapien
tttagcttgggcgtctttacttggg

SEQ ID NO: 289227 - DNA, 25 bp, Homo sapien
aggatccaggaacctcactgtatgc

SEQ ID NO: 289228 - DNA, 25 bp, Homo sapien
ggaacctcactgtatgcaaagtctt

SEQ ID NO: 289229 - DNA, 25 bp, Homo sapien
cagccttttgggacagatagtgagt

SEQ ID NO: 289230 - DNA, 25 bp, Homo sapien
gattcttaggaacttgacattgcca

SEQ ID NO: 289231 - DNA, 25 bp, Homo sapien
atttagctgtttgatattgttggaa

SEQ ID NO: 289232 - DNA, 25 bp, Homo sapien
cacatacagtcacatgagatgaaaa

SEQ ID NO: 289233 - DNA, 25 bp, Homo sapien
tatctatctgattttgtaactacaa

SEQ ID NO: 289234 - DNA, 25 bp, Homo sapien
gtaactacaaagatgaattgccagt

SEQ ID NO: 289235 - DNA, 25 bp, Homo sapien
gaattgccagtatatgttgcaagtg

SEQ ID NO: 289236 - DNA, 25 bp, Homo sapien
tgttgcaagtgggttagatgccttt

SEQ ID NO: 289237 - DNA, 25 bp, Homo sapien
gaaaactgttccaaatgtattttat

SEQ ID NO: 289238 - DNA, 25 bp, Homo sapien
atcacagaatctactgaaggtatgc

SEQ ID NO: 289239 - DNA, 25 bp, Homo sapien
gaaggtatgctattattcctcgagt

SEQ ID NO: 289240 - DNA, 25 bp, Homo sapien
ggtatgctattattcctcgagtatt

SEQ ID NO: 289241 - DNA, 25 bp, Homo sapien
atgctattattcctcgagtatttat

SEQ ID NO: 289242 - DNA, 25 bp, Homo sapien
atgctctgggcagctgttccaagac

SEQ ID NO: 289243 - DNA, 25 bp, Homo sapien
gacccttccattaccaatggcctgt

SEQ ID NO: 289244 - DNA, 25 bp, Homo sapien
atctttccacctgaaatggctaaca

SEQ ID NO: 289245 - DNA, 25 bp, Homo sapien
atggctaacaggtattaaatccttg

SEQ ID NO: 289246 - DNA, 25 bp, Homo sapien
caggtattaaatccttggttggtgt

SEQ ID NO: 289247 - DNA, 25 bp, Homo sapien
taaagccaacccaagaacagggtgt

SEQ ID NO: 289248 - DNA, 25 bp, Homo sapien
cccaagaacagggtgttaggtactg

SEQ ID NO: 289249 - DNA, 25 bp, Homo sapien
gtgttaggtactgttttaagcacct

SEQ ID NO: 289250 - DNA, 25 bp, Homo sapien
tactgttttaagcacctagataggt

SEQ ID NO: 289251 - DNA, 25 bp, Homo sapien
gggactgcaaatggtgttccgcaaa

SEQ ID NO: 289252 - DNA, 25 bp, Homo sapien
atggtgttccgcaaagcaaatcctg

SEQ ID NO: 289253 - DNA, 25 bp, Homo sapien
gcagatgtatgttttgccctcactc

SEQ ID NO: 289254 - DNA, 25 bp, Homo sapien
gggaaagaatctatggttctccaat

SEQ ID NO: 289255 - DNA, 25 bp, Homo sapien
atctatggttctccaattatgctga

SEQ ID NO: 289256 - DNA, 25 bp, Homo sapien
gtgaaggtgcgttcatttaaaacat

SEQ ID NO: 289257 - DNA, 25 bp, Homo sapien
tttcagtgactgttaacatctgtct

SEQ ID NO: 289258 - DNA, 25 bp, Homo sapien
gtgactgttaacatctgtctttctg

SEQ ID NO: 289259 - DNA, 25 bp, Homo sapien
gtttgatctacaaggtctgccatct

SEQ ID NO: 289260 - DNA, 25 bp, Homo sapien
gatctacaaggtctgccatcttaat

SEQ ID NO: 289261 - DNA, 25 bp, Homo sapien
gtctgccatcttaatgatcctcatg

SEQ ID NO: 289262 - DNA, 25 bp, Homo sapien
ttaatgatcctcatgctaagaacac

SEQ ID NO: 289263 - DNA, 25 bp, Homo sapien
catgctaagaacactgcagatgtat

SEQ ID NO: 289264 - DNA, 25 bp, Homo sapien
aggccagcccttgagtatgtttgga

SEQ ID NO: 289265 - DNA, 25 bp, Homo sapien
agcaggttaatggagctgtttgtaa

SEQ ID NO: 289266 - DNA, 25 bp, Homo sapien
aaattagcagcctgttctttttctc

SEQ ID NO: 289267 - DNA, 25 bp, Homo sapien
tttttctctttgcagcttgtatgtt

SEQ ID NO: 289268 - DNA, 25 bp, Homo sapien
gcagcttgtatgttaggacagcatt

SEQ ID NO: 289269 - DNA, 25 bp, Homo sapien
agcattagggtctgggttaggaaca

SEQ ID NO: 289270 - DNA, 25 bp, Homo sapien
gaagagcagcttgtcagatggccag

SEQ ID NO: 289271 - DNA, 25 bp, Homo sapien
gaaaccgctgagtacttgtatcgta

SEQ ID NO: 289272 - DNA, 25 bp, Homo sapien
gaggctttgcttttacgtggaggtc

SEQ ID NO: 289273 - DNA, 25 bp, Homo sapien
acgtggaggtcagctgtcagtgttc

SEQ ID NO: 289274 - DNA, 25 bp, Homo sapien
agtgttcacgtctcacctgtaggac

SEQ ID NO: 289275 - DNA, 25 bp, Homo sapien
gagacccagggcagtgctccacgtg

SEQ ID NO: 289276 - DNA, 25 bp, Homo sapien
gagcccaagctaggactgtgactgt

SEQ ID NO: 289277 - DNA, 25 bp, Homo sapien
tgggctgtgggcatctgaccatctc

SEQ ID NO: 289278 - DNA, 25 bp, Homo sapien
gtgggcatctgaccatctccagtgt

SEQ ID NO: 289279 - DNA, 25 bp, Homo sapien
catctccagtgtccccgtctttgat

SEQ ID NO: 289280 - DNA, 25 bp, Homo sapien
cgtctttgatttccctggcgatggt

SEQ ID NO: 289281 - DNA, 25 bp, Homo sapien
ttccctggcgatggtgctagcttag

SEQ ID NO: 289282 - DNA, 25 bp, Homo sapien
gctagcttagtttgtgcgcatcggc

SEQ ID NO: 289283 - DNA, 25 bp, Homo sapien
tgcgcatcggcatttgtgggagaaa

SEQ ID NO: 289284 - DNA, 25 bp, Homo sapien
ttgttttatgtcagactctctcagt

SEQ ID NO: 289285 - DNA, 25 bp, Homo sapien
aaagggtctgtctggctatgggcca

SEQ ID NO: 289286 - DNA, 25 bp, Homo sapien
aatacttccataattgcaggttgtg

SEQ ID NO: 289287 - DNA, 25 bp, Homo sapien
ttccataattgcaggttgtgttcat

SEQ ID NO: 289288 - DNA, 25 bp, Homo sapien
tgcattgaaatcaaattgggctgaa

SEQ ID NO: 289289 - DNA, 25 bp, Homo sapien
gatttgcacagatctccaattgaat

SEQ ID NO: 289290 - DNA, 25 bp, Homo sapien
cacagatctccaattgaatttgcaa

SEQ ID NO: 289291 - DNA, 25 bp, Homo sapien
gatctccaattgaatttgcaatgaa

SEQ ID NO: 289292 - DNA, 25 bp, Homo sapien
aagtatacagctgtaagtaaccctg

SEQ ID NO: 289293 - DNA, 25 bp, Homo sapien
agctgtaagtaaccctgtcaccatg

SEQ ID NO: 289294 - DNA, 25 bp, Homo sapien
gtaagtaaccctgtcaccatggatg

SEQ ID NO: 289295 - DNA, 25 bp, Homo sapien
catggatgatccttttctctaggaa

SEQ ID NO: 289296 - DNA, 25 bp, Homo sapien
tacattttgtggacaatgtcacttt

SEQ ID NO: 289297 - DNA, 25 bp, Homo sapien
gaggagagaacctggcatcctttcc

SEQ ID NO: 289298 - DNA, 25 bp, Homo sapien
atcctttccttaccttgatttcagg

SEQ ID NO: 289299 - DNA, 25 bp, Homo sapien
tagcaaatgtgtcttcctcccaggg

SEQ ID NO: 289300 - DNA, 25 bp, Homo sapien
tggctgcgtttctcagccacttgct

SEQ ID NO: 289301 - DNA, 25 bp, Homo sapien
ctctcaccctttctttcaactggta

SEQ ID NO: 289302 - DNA, 25 bp, Homo sapien
actggtagccagaaaatacgggttg

SEQ ID NO: 289303 - DNA, 25 bp, Homo sapien
atacgggttgagcatcagggattct

SEQ ID NO: 289304 - DNA, 25 bp, Homo sapien
gagcatcagggattctcaaccgtgt

SEQ ID NO: 289305 - DNA, 25 bp, Homo sapien
agccctgcctgttgtgacagacgtt

SEQ ID NO: 289306 - DNA, 25 bp, Homo sapien
gacgtttcctgatgcctgttgctct

SEQ ID NO: 289307 - DNA, 25 bp, Homo sapien
cccagagcgccatttggaggagaga

SEQ ID NO: 289308 - DNA, 25 bp, Homo sapien
aagaatcagactggcttgggactct

SEQ ID NO: 289309 - DNA, 25 bp, Homo sapien
tcagactggcttgggactctgctgt

SEQ ID NO: 289310 - DNA, 25 bp, Homo sapien
gtgacctcccaaaagcgtgtgttag

SEQ ID NO: 289311 - DNA, 25 bp, Homo sapien
gcgtgtgttagagactgacctgcct

SEQ ID NO: 289312 - DNA, 25 bp, Homo sapien
ttagagactgacctgcctagtgcgt

SEQ ID NO: 289313 - DNA, 25 bp, Homo sapien
tgacctgcctagtgcgtcagtggag

SEQ ID NO: 289314 - DNA, 25 bp, Homo sapien
tgaggccccgccctcgtgaatggct

SEQ ID NO: 289315 - DNA, 25 bp, Homo sapien
ctcgtgaatggctcagtgccttgtg

SEQ ID NO: 289316 - DNA, 25 bp, Homo sapien
ggctcagtgccttgtgaaagggctt

SEQ ID NO: 289317 - DNA, 25 bp, Homo sapien
cagtgccttgtgaaagggcttgatg

SEQ ID NO: 289318 - DNA, 25 bp, Homo sapien
tgatggagggagtttggtccctttt

SEQ ID NO: 289319 - DNA, 25 bp, Homo sapien
ttatcagagatgcattacgtgtaac

SEQ ID NO: 289320 - DNA, 25 bp, Homo sapien
cagtagtttcacttcagcgtgatga

SEQ ID NO: 289321 - DNA, 25 bp, Homo sapien
ttcagcgtgatgaataaatgcccat

SEQ ID NO: 289322 - DNA, 25 bp, Homo sapien
ataaatgcccatctatctctctttg

SEQ ID NO: 289323 - DNA, 25 bp, Homo sapien
atgcccatctatctctctttgtaga

SEQ ID NO: 289324 - DNA, 25 bp, Homo sapien
cccatctatctctctttgtagactt

SEQ ID NO: 289325 - DNA, 25 bp, Homo sapien
cagtgtgaactgtcaatcataaggt

SEQ ID NO: 289326 - DNA, 25 bp, Homo sapien
gaactgtcaatcataaggtagtaat

SEQ ID NO: 289327 - DNA, 25 bp, Homo sapien
aattgagtgacttatcgctgtaccg

SEQ ID NO: 289328 - DNA, 25 bp, Homo sapien
agtgacttatcgctgtaccgtggtc

SEQ ID NO: 289329 - DNA, 25 bp, Homo sapien
gacttatcgctgtaccgtggtcccc

SEQ ID NO: 289330 - DNA, 25 bp, Homo sapien
ttgttcaaatatacatctaggttgt

SEQ ID NO: 289331 - DNA, 25 bp, Homo sapien
acatctaggttgtaaaggagactca

SEQ ID NO: 289332 - DNA, 25 bp, Homo sapien
gagactcaacggtaagttatagtga

SEQ ID NO: 289333 - DNA, 25 bp, Homo sapien
gtaagttatagtgaccattgaaaaa

SEQ ID NO: 289334 - DNA, 25 bp, Homo sapien
gataacttttagactgtaatcagag

SEQ ID NO: 289335 - DNA, 25 bp, Homo sapien
tggctgcaaataggtggaagagacc

SEQ ID NO: 289336 - DNA, 25 bp, Homo sapien
gtaatcagaggtagatgctatcaat

SEQ ID NO: 289337 - DNA, 25 bp, Homo sapien
gatgctatcaatttgttagtgagga

SEQ ID NO: 289338 - DNA, 25 bp, Homo sapien
gaggagttttcaatgccacttagtt

SEQ ID NO: 289339 - DNA, 25 bp, Homo sapien
ggagttttcaatgccacttagttta

SEQ ID NO: 289340 - DNA, 25 bp, Homo sapien
aatgccacttagtttacaatgtcta

SEQ ID NO: 289341 - DNA, 25 bp, Homo sapien
acgtaaccctgccaaagttctgatg

SEQ ID NO: 289342 - DNA, 25 bp, Homo sapien
tgatggccaccacagatttgctgtt

SEQ ID NO: 289343 - DNA, 25 bp, Homo sapien
gaattatgtatgctgtgcctttctg

SEQ ID NO: 289344 - DNA, 25 bp, Homo sapien
tgctgtgcctttctgaggaggctaa

SEQ ID NO: 289345 - DNA, 25 bp, Homo sapien
gttgactgatggttctgctcctaaa

SEQ ID NO: 289346 - DNA, 25 bp, Homo sapien
gctgtggccttaatagtaactcgga

SEQ ID NO: 289347 - DNA, 25 bp, Homo sapien
ctttcctaagattcctcctttcaag

SEQ ID NO: 289348 - DNA, 25 bp, Homo sapien
gattcctcctttcaaggcaagtctg

SEQ ID NO: 289349 - DNA, 25 bp, Homo sapien
gcaagtctgcgcatcatcgtgtcat

SEQ ID NO: 289350 - DNA, 25 bp, Homo sapien
gtgtcatgctgcagttccctcagta

SEQ ID NO: 289351 - DNA, 25 bp, Homo sapien
ttccctcagtagctggctgggtcaa

SEQ ID NO: 289352 - DNA, 25 bp, Homo sapien
tacatgaaatggctggaggagactc

SEQ ID NO: 289353 - DNA, 25 bp, Homo sapien
ggaggagactcaagcattatgcatg

SEQ ID NO: 289354 - DNA, 25 bp, Homo sapien
tatgcatgacatttagtgaacgtaa

SEQ ID NO: 289355 - DNA, 25 bp, Homo sapien
gtaaaagacggagtctagacaactt

SEQ ID NO: 289356 - DNA, 25 bp, Homo sapien
aatattaacaaaggacaatcctctc

SEQ ID NO: 289357 - DNA, 25 bp, Homo sapien
tcctctcttaaaattcctggggtca

SEQ ID NO: 289358 - DNA, 25 bp, Homo sapien
tgaacaagccctccaaaagacactg

SEQ ID NO: 289359 - DNA, 25 bp, Homo sapien
agccctccaaaagacactgatgcat

SEQ ID NO: 289360 - DNA, 25 bp, Homo sapien
caaaagacactgatgcatgctgaag

SEQ ID NO: 289361 - DNA, 25 bp, Homo sapien
tgcatgctgaagttagctgctgctt

SEQ ID NO: 289362 - DNA, 25 bp, Homo sapien
tgctgctttagagaaactgttaatg

SEQ ID NO: 289363 - DNA, 25 bp, Homo sapien
aaggccaagtattcggcacaggagg

SEQ ID NO: 289364 - DNA, 25 bp, Homo sapien
ttcggcacaggaggattgctccgca

SEQ ID NO: 289365 - DNA, 25 bp, Homo sapien
aggattgctccgcacgtttttacac

SEQ ID NO: 289366 - DNA, 25 bp, Homo sapien
gtttttacacgctgaactctccagt

SEQ ID NO: 289367 - DNA, 25 bp, Homo sapien
tcttgggaaactactcctgtaaaat

SEQ ID NO: 289368 - DNA, 25 bp, Homo sapien
atcagattaattctctgggttgcaa

SEQ ID NO: 289369 - DNA, 25 bp, Homo sapien
aattctctgggttgcaaagaggcta

SEQ ID NO: 289370 - DNA, 25 bp, Homo sapien
aaagaggctattctgcaagcccctt

SEQ ID NO: 289371 - DNA, 25 bp, Homo sapien
gcaagccccttacagtggccctgaa

SEQ ID NO: 289372 - DNA, 25 bp, Homo sapien
gtttcacaaaggaactagctatgac

SEQ ID NO: 289373 - DNA, 25 bp, Homo sapien
gaactagctatgacaggattaggaa

SEQ ID NO: 289374 - DNA, 25 bp, Homo sapien
aagctctattgttcatatatgtagt

SEQ ID NO: 289375 - DNA, 25 bp, Homo sapien
tatatgtagttccaacttgtttttt

SEQ ID NO: 289376 - DNA, 25 bp, Homo sapien
taaccactgcttaatatttcataat

SEQ ID NO: 289377 - DNA, 25 bp, Homo sapien
tacactattacttgagtaaaccctt

SEQ ID NO: 289378 - DNA, 25 bp, Homo sapien
gtacatttctcctttggtacatgtc

SEQ ID NO: 289379 - DNA, 25 bp, Homo sapien
atttctcctttggtacatgtcttgc

SEQ ID NO: 289380 - DNA, 25 bp, Homo sapien
tctcctttggtacatgtcttgcttc

SEQ ID NO: 289381 - DNA, 25 bp, Homo sapien
ttggtacatgtcttgcttctctttc

SEQ ID NO: 289382 - DNA, 25 bp, Homo sapien
tatcataatttatgcatcatgttat

SEQ ID NO: 289383 - DNA, 25 bp, Homo sapien
tgatacaaaaatgacttgaagctct

SEQ ID NO: 289384 - DNA, 25 bp, Homo sapien
gacttgaagctctattgttcatata

SEQ ID NO: 289385 - DNA, 25 bp, Homo sapien
tgactctgtgatcctgtccagctgt

SEQ ID NO: 289386 - DNA, 25 bp, Homo sapien
agggagttccagagctctcccaaag

SEQ ID NO: 289387 - DNA, 25 bp, Homo sapien
ttccagagctctcccaaagtgcatg

SEQ ID NO: 289388 - DNA, 25 bp, Homo sapien
catgaggaactgcacaagtaggact

SEQ ID NO: 289389 - DNA, 25 bp, Homo sapien
gaagctatttgtctcctagaacctg

SEQ ID NO: 289390 - DNA, 25 bp, Homo sapien
tatttgtctcctagaacctggcacc

SEQ ID NO: 289391 - DNA, 25 bp, Homo sapien
aagacaatcagttgttcccctttct

SEQ ID NO: 289392 - DNA, 25 bp, Homo sapien
tacaggagacccacatcactcagtt

SEQ ID NO: 289393 - DNA, 25 bp, Homo sapien
tcccctttctggtgtcagaggcaaa

SEQ ID NO: 289394 - DNA, 25 bp, Homo sapien
gctggctctgggtttattgactctg

SEQ ID NO: 289395 - DNA, 25 bp, Homo sapien
gggtttattgactctgtgatcctgt

SEQ ID NO: 289396 - DNA, 25 bp, Homo sapien
taccactcggcgtcggcagagtccg

SEQ ID NO: 289397 - DNA, 25 bp, Homo sapien
tcggcagagtccgtggacgagattc

SEQ ID NO: 289398 - DNA, 25 bp, Homo sapien
cagagtccgtggacgagattccagt

SEQ ID NO: 289399 - DNA, 25 bp, Homo sapien
tccgtggacgagattccagtggcgc

SEQ ID NO: 289400 - DNA, 25 bp, Homo sapien
gacgagattccagtggcgcagacgc

SEQ ID NO: 289401 - DNA, 25 bp, Homo sapien
cgagattccagtggcgcagacgcgc

SEQ ID NO: 289402 - DNA, 25 bp, Homo sapien
gccgttttcgtgagcccgagcagcg

SEQ ID NO: 289403 - DNA, 25 bp, Homo sapien
aggctggtctggcttagctgggccg

SEQ ID NO: 289404 - DNA, 25 bp, Homo sapien
gtctggcttagctgggccgagaggc

SEQ ID NO: 289405 - DNA, 25 bp, Homo sapien
tccagctcgtcgacggattccgcgg

SEQ ID NO: 289406 - DNA, 25 bp, Homo sapien
tcgtcgacggattccgcggacgcca

SEQ ID NO: 289407 - DNA, 25 bp, Homo sapien
acaggttacctgttaacttcactga

SEQ ID NO: 289408 - DNA, 25 bp, Homo sapien
gttacctgttaacttcactgaaaca

SEQ ID NO: 289409 - DNA, 25 bp, Homo sapien
ctgaaacagacaacatgcagtattt

SEQ ID NO: 289410 - DNA, 25 bp, Homo sapien
gacaacatgcagtattttatcacaa

SEQ ID NO: 289411 - DNA, 25 bp, Homo sapien
ttatcacaattaaatcatctcagta

SEQ ID NO: 289412 - DNA, 25 bp, Homo sapien
tcagttattcttcacatgtgtgagt

SEQ ID NO: 289413 - DNA, 25 bp, Homo sapien
caccaggtcacgtgtgcctccaagg

SEQ ID NO: 289414 - DNA, 25 bp, Homo sapien
tggatctctgcagtaatggctgcgt

SEQ ID NO: 289415 - DNA, 25 bp, Homo sapien
aatggctgcgtgtaaggctgactcc

SEQ ID NO: 289416 - DNA, 25 bp, Homo sapien
ggctgcgtgtaaggctgactccaac

SEQ ID NO: 289417 - DNA, 25 bp, Homo sapien
gtgtaaggctgactccaaccctcca

SEQ ID NO: 289418 - DNA, 25 bp, Homo sapien
agagcacctctgaactcaacaggat

SEQ ID NO: 289419 - DNA, 25 bp, Homo sapien
tctgaactcaacaggatcctacact

SEQ ID NO: 289420 - DNA, 25 bp, Homo sapien
ggatcctacacttcttataggcctg

SEQ ID NO: 289421 - DNA, 25 bp, Homo sapien
tacacttcttataggcctggcttga

SEQ ID NO: 289422 - DNA, 25 bp, Homo sapien
tataggcctggcttgatgctgacat

SEQ ID NO: 289423 - DNA, 25 bp, Homo sapien
tgatgctgacatccttcagccccag

SEQ ID NO: 289424 - DNA, 25 bp, Homo sapien
gccccagggaagacctaaagatctc

SEQ ID NO: 289425 - DNA, 25 bp, Homo sapien
aaagatctccaggtcttgaggcacc

SEQ ID NO: 289426 - DNA, 25 bp, Homo sapien
tccaggtcttgaggcacctggaaca

SEQ ID NO: 289427 - DNA, 25 bp, Homo sapien
acctgagaccactttaacatgattt

SEQ ID NO: 289428 - DNA, 25 bp, Homo sapien
cactttaacatgatttctctgcttg

SEQ ID NO: 289429 - DNA, 25 bp, Homo sapien
aagtgatggactaaggatagatttt

SEQ ID NO: 289430 - DNA, 25 bp, Homo sapien
gtgatggactaaggatagattttgg

SEQ ID NO: 289431 - DNA, 25 bp, Homo sapien
ggactaaggatagattttggaggca

SEQ ID NO: 289432 - DNA, 25 bp, Homo sapien
gactaaggatagattttggaggcag

SEQ ID NO: 289433 - DNA, 25 bp, Homo sapien
actaaggatagattttggaggcaga

SEQ ID NO: 289434 - DNA, 25 bp, Homo sapien
gagcaaacaggagagcatgaaagaa

SEQ ID NO: 289435 - DNA, 25 bp, Homo sapien
agcaaacaggagagcatgaaagaaa

SEQ ID NO: 289436 - DNA, 25 bp, Homo sapien
gcaaacaggagagcatgaaagaaac

SEQ ID NO: 289437 - DNA, 25 bp, Homo sapien
caaacaggagagcatgaaagaaaca

SEQ ID NO: 289438 - DNA, 25 bp, Homo sapien
caaagatgatgtttaggccaggggc

SEQ ID NO: 289439 - DNA, 25 bp, Homo sapien
aagatgatgtttaggccaggggcgg

SEQ ID NO: 289440 - DNA, 25 bp, Homo sapien
cgacccaatttctcctacaaatagg

SEQ ID NO: 289441 - DNA, 25 bp, Homo sapien
caaataggtgccaacttctctgaaa

SEQ ID NO: 289442 - DNA, 25 bp, Homo sapien
gaaaattgagactccgagctcggct

SEQ ID NO: 289443 - DNA, 25 bp, Homo sapien
gagctcggctttactttgggcaaaa

SEQ ID NO: 289444 - DNA, 25 bp, Homo sapien
gagactttaatccaaaccttccagg

SEQ ID NO: 289445 - DNA, 25 bp, Homo sapien
accttccagggaaagacatcagatt

SEQ ID NO: 289446 - DNA, 25 bp, Homo sapien
tcccacactcagaatttttcttgcc

SEQ ID NO: 289447 - DNA, 25 bp, Homo sapien
agaatttttcttgcctgacagttat

SEQ ID NO: 289448 - DNA, 25 bp, Homo sapien
atccatgagcaaaaggagggctgct

SEQ ID NO: 289449 - DNA, 25 bp, Homo sapien
gagggctgctccaagtaaaatagga

SEQ ID NO: 289450 - DNA, 25 bp, Homo sapien
ttgggtcgacccaatttctcctaca

SEQ ID NO: 289451 - DNA, 25 bp, Homo sapien
aacacttctgctagcaaggtgggac

SEQ ID NO: 289452 - DNA, 25 bp, Homo sapien
gtgggactactgtgtccgacagttt

SEQ ID NO: 289453 - DNA, 25 bp, Homo sapien
gtgtccgacagtttcatagacctga

SEQ ID NO: 289454 - DNA, 25 bp, Homo sapien
tgaagtgttaaactctccggccagt

SEQ ID NO: 289455 - DNA, 25 bp, Homo sapien
ctccggccagttgactatttgcaaa

SEQ ID NO: 289456 - DNA, 25 bp, Homo sapien
aaaatctgcccaaagtgaactcgga

SEQ ID NO: 289457 - DNA, 25 bp, Homo sapien
tgaactcggaagtctgctcctagtg

SEQ ID NO: 289458 - DNA, 25 bp, Homo sapien
agtggccgactgactgtcctggaca

SEQ ID NO: 289459 - DNA, 25 bp, Homo sapien
ctggacacctccttgttgttgaaca

SEQ ID NO: 289460 - DNA, 25 bp, Homo sapien
taagtacactgagcgcttctttaca

SEQ ID NO: 289461 - DNA, 25 bp, Homo sapien
actggtcattgggtgttacgcttcc

SEQ ID NO: 289462 - DNA, 25 bp, Homo sapien
tgttagccatgaccctataagaaat

SEQ ID NO: 289463 - DNA, 25 bp, Homo sapien
gaccctataagaaataaactgcact

SEQ ID NO: 289464 - DNA, 25 bp, Homo sapien
atgatatcaatcattacatgggaag

SEQ ID NO: 289465 - DNA, 25 bp, Homo sapien
taataccttaggttaaggccacata

SEQ ID NO: 289466 - DNA, 25 bp, Homo sapien
aggtgccttttctgcggaggactct

SEQ ID NO: 289467 - DNA, 25 bp, Homo sapien
gccttttctgcggaggactctgaag

SEQ ID NO: 289468 - DNA, 25 bp, Homo sapien
tttctgcggaggactctgaagggat

SEQ ID NO: 289469 - DNA, 25 bp, Homo sapien
tgcggaggactctgaagggatacta

SEQ ID NO: 289470 - DNA, 25 bp, Homo sapien
ggaggactctgaagggatactaaac

SEQ ID NO: 289471 - DNA, 25 bp, Homo sapien
atgtttcttgttagccatgacccta

SEQ ID NO: 289472 - DNA, 25 bp, Homo sapien
ttcttgttagccatgaccctataag

SEQ ID NO: 289473 - DNA, 25 bp, Homo sapien
aatcaacagagctttttagattctc

SEQ ID NO: 289474 - DNA, 25 bp, Homo sapien
caacagagctttttagattctcttt

SEQ ID NO: 289475 - DNA, 25 bp, Homo sapien
cagagctttttagattctctttttt

SEQ ID NO: 289476 - DNA, 25 bp, Homo sapien
gaaatatctcatcatagttctcctg

SEQ ID NO: 289477 - DNA, 25 bp, Homo sapien
atgagtggaatttgttttctagtgc

SEQ ID NO: 289478 - DNA, 25 bp, Homo sapien
ttctagtgctttactgataaggtta

SEQ ID NO: 289479 - DNA, 25 bp, Homo sapien
agtgctttactgataaggttaacca

SEQ ID NO: 289480 - DNA, 25 bp, Homo sapien
gctttactgataaggttaaccagat

SEQ ID NO: 289481 - DNA, 25 bp, Homo sapien
actgataaggttaaccagatggtga

SEQ ID NO: 289482 - DNA, 25 bp, Homo sapien
cagatggtgaaatgtaatagcttgg

SEQ ID NO: 289483 - DNA, 25 bp, Homo sapien
cgatgtagttttgatatacagtaca

SEQ ID NO: 289484 - DNA, 25 bp, Homo sapien
taagagtggatagcaaggcacctgg

SEQ ID NO: 289485 - DNA, 25 bp, Homo sapien
acctgggagagtgtctaggcagata

SEQ ID NO: 289486 - DNA, 25 bp, Homo sapien
gtgtctaggcagatatacagtaggt

SEQ ID NO: 289487 - DNA, 25 bp, Homo sapien
tatacagtaggtacaaagacccagc

SEQ ID NO: 289488 - DNA, 25 bp, Homo sapien
tacaaagacccagcggcagaaagga

SEQ ID NO: 289489 - DNA, 25 bp, Homo sapien
aaggagtttggctcttccaggaaca

SEQ ID NO: 289490 - DNA, 25 bp, Homo sapien
gtttggctcttccaggaacagagaa

SEQ ID NO: 289491 - DNA, 25 bp, Homo sapien
cagagaagggacattgtgactagag

SEQ ID NO: 289492 - DNA, 25 bp, Homo sapien
caaggtgttacagcattgagtgact

SEQ ID NO: 289493 - DNA, 25 bp, Homo sapien
cagcattgagtgactgttctgacaa

SEQ ID NO: 289494 - DNA, 25 bp, Homo sapien
gactgttctgacaagtgctgaagca

SEQ ID NO: 289495 - DNA, 25 bp, Homo sapien
tcctcaagaggttcctggtggtctg

SEQ ID NO: 289496 - DNA, 25 bp, Homo sapien
aaagcccgaaaagcctggcgagcat

SEQ ID NO: 289497 - DNA, 25 bp, Homo sapien
aaaagcctggcgagcatggccgagc

SEQ ID NO: 289498 - DNA, 25 bp, Homo sapien
ggaactccacgtccctcgagagcag

SEQ ID NO: 289499 - DNA, 25 bp, Homo sapien
tccctcgagagcaggagcctcttaa

SEQ ID NO: 289500 - DNA, 25 bp, Homo sapien
gttcctggtggtctggcctaagccc

SEQ ID NO: 289501 - DNA, 25 bp, Homo sapien
ttaagggctggcactggtctcagcc

SEQ ID NO: 289502 - DNA, 25 bp, Homo sapien
ggcactggtctcagcctaatggctg

SEQ ID NO: 289503 - DNA, 25 bp, Homo sapien
gctgaggcggtaccctggcttcata

SEQ ID NO: 289504 - DNA, 25 bp, Homo sapien
atccacccgttgttctgaaggcaga

SEQ ID NO: 289505 - DNA, 25 bp, Homo sapien
tctgaaggcagagcccattctgtgg

SEQ ID NO: 289506 - DNA, 25 bp, Homo sapien
gctgatttacactggatcttgcctt

SEQ ID NO: 289507 - DNA, 25 bp, Homo sapien
tacactggatcttgccttagaaacc

SEQ ID NO: 289508 - DNA, 25 bp, Homo sapien
tagaaaccattgtctgcctgcctaa

SEQ ID NO: 289509 - DNA, 25 bp, Homo sapien
tgcctaaccagcctttcataaaatt

SEQ ID NO: 289510 - DNA, 25 bp, Homo sapien
aacaaaactctttctacgtagtgat

SEQ ID NO: 289511 - DNA, 25 bp, Homo sapien
tagtgatcctcaagcaatatttttg

SEQ ID NO: 289512 - DNA, 25 bp, Homo sapien
aagtgtcaaacttgctatagcataa

SEQ ID NO: 289513 - DNA, 25 bp, Homo sapien
gggctcctgatttccaggtttctaa

SEQ ID NO: 289514 - DNA, 25 bp, Homo sapien
gaggtaaaacagatgcctgaccgtt

SEQ ID NO: 289515 - DNA, 25 bp, Homo sapien
gatgcctgaccgttttaaaggatct

SEQ ID NO: 289516 - DNA, 25 bp, Homo sapien
tttaatgttttatgactgcctgtct

SEQ ID NO: 289517 - DNA, 25 bp, Homo sapien
agctcagagattagcgaatgcgtct

SEQ ID NO: 289518 - DNA, 25 bp, Homo sapien
gaatgcgtctcagctgtcctagaaa

SEQ ID NO: 289519 - DNA, 25 bp, Homo sapien
tgtcctagaaaagtgctgtcagcaa

SEQ ID NO: 289520 - DNA, 25 bp, Homo sapien
agagtttcccagaagccctgaaagg

SEQ ID NO: 289521 - DNA, 25 bp, Homo sapien
ggacgcaatagcatcatttagcaga

SEQ ID NO: 289522 - DNA, 25 bp, Homo sapien
acagccctggattaatgttcttttg

SEQ ID NO: 289523 - DNA, 25 bp, Homo sapien
gttcttttgggattcatcttctggc

SEQ ID NO: 289524 - DNA, 25 bp, Homo sapien
cttctggctttgtgattttgggcaa

SEQ ID NO: 289525 - DNA, 25 bp, Homo sapien
agactctcaggagctaggtttgata

SEQ ID NO: 289526 - DNA, 25 bp, Homo sapien
ggcacaatctcaaggcatcgctaag

SEQ ID NO: 289527 - DNA, 25 bp, Homo sapien
gttcttccagcaggtctgtaaacca

SEQ ID NO: 289528 - DNA, 25 bp, Homo sapien
tcttcctcctcaagacagctggtgc

SEQ ID NO: 289529 - DNA, 25 bp, Homo sapien
ggtgccttaagaattggcccagcct

SEQ ID NO: 289530 - DNA, 25 bp, Homo sapien
tagcaaccagctaatatttacccag

SEQ ID NO: 289531 - DNA, 25 bp, Homo sapien
ttacccagaggtactgcaatagagt

SEQ ID NO: 289532 - DNA, 25 bp, Homo sapien
atggaatcaggatctggtgggcctc

SEQ ID NO: 289533 - DNA, 25 bp, Homo sapien
tggtgggcctcagaaattgtctctt

SEQ ID NO: 289534 - DNA, 25 bp, Homo sapien
agaaattgtctcttttctgagtttc

SEQ ID NO: 289535 - DNA, 25 bp, Homo sapien
gagtttcagtttggttctcctggat

SEQ ID NO: 289536 - DNA, 25 bp, Homo sapien
tttggttctcctggatgttttgctc

SEQ ID NO: 289537 - DNA, 25 bp, Homo sapien
ttgggaaagccctttgaccccagct

SEQ ID NO: 289538 - DNA, 25 bp, Homo sapien
gaccccagcttgctagttgcataat

SEQ ID NO: 289539 - DNA, 25 bp, Homo sapien
attgcattctatcttgggcaacaaa

SEQ ID NO: 289540 - DNA, 25 bp, Homo sapien
aaaaaattcctgacatcgctatgta

SEQ ID NO: 289541 - DNA, 25 bp, Homo sapien
gacatcgctatgtattcccaacttt

SEQ ID NO: 289542 - DNA, 25 bp, Homo sapien
tatgtattcccaactttatcatttg

SEQ ID NO: 289543 - DNA, 25 bp, Homo sapien
catttgtctgcctgtttagttttga

SEQ ID NO: 289544 - DNA, 25 bp, Homo sapien
gtctgcctgtttagttttgacttat

SEQ ID NO: 289545 - DNA, 25 bp, Homo sapien
ctgtggacatgtagttgacggaaat

SEQ ID NO: 289546 - DNA, 25 bp, Homo sapien
aatttcccaaaactaatcatgcctt

SEQ ID NO: 289547 - DNA, 25 bp, Homo sapien
aatcatgccttatgtgactaatctt

SEQ ID NO: 289548 - DNA, 25 bp, Homo sapien
catctactgatatattttcttgagg

SEQ ID NO: 289549 - DNA, 25 bp, Homo sapien
tattttcttgaggtgtgtaattttc

SEQ ID NO: 289550 - DNA, 25 bp, Homo sapien
aattttctgtggcagcattgacacg

SEQ ID NO: 289551 - DNA, 25 bp, Homo sapien
ggcagcattgacacgtatctcctaa

SEQ ID NO: 289552 - DNA, 25 bp, Homo sapien
gcattgacacgtatctcctaaaaat

SEQ ID NO: 289553 - DNA, 25 bp, Homo sapien
taaagttccccacgtttacaagcag

SEQ ID NO: 289554 - DNA, 25 bp, Homo sapien
tccccacgtttacaagcagcatgat

SEQ ID NO: 289555 - DNA, 25 bp, Homo sapien
acaagcagcatgataggttcaggaa

SEQ ID NO: 289556 - DNA, 25 bp, Homo sapien
gatgagaggtaacatcttattattt

SEQ ID NO: 289557 - DNA, 25 bp, Homo sapien
tatgggctccataagtttatttttt

SEQ ID NO: 289558 - DNA, 25 bp, Homo sapien
attttttaagcaccatatatgtgtg

SEQ ID NO: 289559 - DNA, 25 bp, Homo sapien
gtgactagtaagtactgctgtgtct

SEQ ID NO: 289560 - DNA, 25 bp, Homo sapien
gtaagtactgctgtgtcttactagc

SEQ ID NO: 289561 - DNA, 25 bp, Homo sapien
gccgggagaaatgcctgctggataa

SEQ ID NO: 289562 - DNA, 25 bp, Homo sapien
gcgttctgcgcaaagatcaacacgg

SEQ ID NO: 289563 - DNA, 25 bp, Homo sapien
caagtccaaagaaccttgtagagga

SEQ ID NO: 289564 - DNA, 25 bp, Homo sapien
aggaggtggaatttcagctgaactt

SEQ ID NO: 289565 - DNA, 25 bp, Homo sapien
tattctgttttttggtccttatctt

SEQ ID NO: 289566 - DNA, 25 bp, Homo sapien
gatcaacacggcatgtctactataa

SEQ ID NO: 289567 - DNA, 25 bp, Homo sapien
aagcatggattgaaatgattcttac

SEQ ID NO: 289568 - DNA, 25 bp, Homo sapien
acacggcatgtctactataaggcag

SEQ ID NO: 289569 - DNA, 25 bp, Homo sapien
taaggcagacaacatgcgagtcaga

SEQ ID NO: 289570 - DNA, 25 bp, Homo sapien
agggccaccgcagcaagatctcatg

SEQ ID NO: 289571 - DNA, 25 bp, Homo sapien
cagcaagatctcatggccgggagaa

SEQ ID NO: 289572 - DNA, 25 bp, Homo sapien
tctttcctggatatagttctgttgg

SEQ ID NO: 289573 - DNA, 25 bp, Homo sapien
atggacttaacttttagagtgttca

SEQ ID NO: 289574 - DNA, 25 bp, Homo sapien
agctaggatctctgtatttgttttt

SEQ ID NO: 289575 - DNA, 25 bp, Homo sapien
tatcttttattacctgttctcttag

SEQ ID NO: 289576 - DNA, 25 bp, Homo sapien
acctgttctcttagattgttttttg

SEQ ID NO: 289577 - DNA, 25 bp, Homo sapien
ttgctagtaacccttactcagcttc

SEQ ID NO: 289578 - DNA, 25 bp, Homo sapien
taacccttactcagcttctgccttt

SEQ ID NO: 289579 - DNA, 25 bp, Homo sapien
gacgacaaagttaattgcaacaagt

SEQ ID NO: 289580 - DNA, 25 bp, Homo sapien
gaaaacttgggtgctaacacaggat

SEQ ID NO: 289581 - DNA, 25 bp, Homo sapien
gctaacacaggataacttctgctct

SEQ ID NO: 289582 - DNA, 25 bp, Homo sapien
acaggataacttctgctctttttct

SEQ ID NO: 289583 - DNA, 25 bp, Homo sapien
gatggaagctgccagaagcctctta

SEQ ID NO: 289584 - DNA, 25 bp, Homo sapien
tggaagctgccagaagcctcttagg

SEQ ID NO: 289585 - DNA, 25 bp, Homo sapien
gaagctgccagaagcctcttaggcc

SEQ ID NO: 289586 - DNA, 25 bp, Homo sapien
gcagctcattctgtttattcaggtg

SEQ ID NO: 289587 - DNA, 25 bp, Homo sapien
tccaggagcagctttaggaagccag

SEQ ID NO: 289588 - DNA, 25 bp, Homo sapien
cttgcatgggcccagcctttaggat

SEQ ID NO: 289589 - DNA, 25 bp, Homo sapien
tgcatgggcccagcctttaggatgg

SEQ ID NO: 289590 - DNA, 25 bp, Homo sapien
tgggcccagcctttaggatgggttt

SEQ ID NO: 289591 - DNA, 25 bp, Homo sapien
cagcctttaggatgggttttttctg

SEQ ID NO: 289592 - DNA, 25 bp, Homo sapien
taggatgggttttttctgccccaag

SEQ ID NO: 289593 - DNA, 25 bp, Homo sapien
gatgggttttttctgccccaagtag

SEQ ID NO: 289594 - DNA, 25 bp, Homo sapien
gggaaggtcttcaggcaggcctcaa

SEQ ID NO: 289595 - DNA, 25 bp, Homo sapien
gaagagtttcggtcggagtgcacat

SEQ ID NO: 289596 - DNA, 25 bp, Homo sapien
tttcggtcggagtgcacatcttcaa

SEQ ID NO: 289597 - DNA, 25 bp, Homo sapien
cggtcggagtgcacatcttcaagcc

SEQ ID NO: 289598 - DNA, 25 bp, Homo sapien
caagcccatcaaaaagtccacactg

SEQ ID NO: 289599 - DNA, 25 bp, Homo sapien
gaagggcttcaagtggagcttgaac

SEQ ID NO: 289600 - DNA, 25 bp, Homo sapien
gtggagcttgaaccttgacatgcat

SEQ ID NO: 289601 - DNA, 25 bp, Homo sapien
ggagcttgaaccttgacatgcatca

SEQ ID NO: 289602 - DNA, 25 bp, Homo sapien
agcttgaaccttgacatgcatcaga

SEQ ID NO: 289603 - DNA, 25 bp, Homo sapien
gaaccttgacatgcatcagagggtg

SEQ ID NO: 289604 - DNA, 25 bp, Homo sapien
ccttgacatgcatcagagggtgcac

SEQ ID NO: 289605 - DNA, 25 bp, Homo sapien
gaagttaaaccgcagctcaccgagg

SEQ ID NO: 289606 - DNA, 25 bp, Homo sapien
agttaaaccgcagctcaccgaggag

SEQ ID NO: 289607 - DNA, 25 bp, Homo sapien
ttaaaccgcagctcaccgaggagta

SEQ ID NO: 289608 - DNA, 25 bp, Homo sapien
aaaccgcagctcaccgaggagtagg

SEQ ID NO: 289609 - DNA, 25 bp, Homo sapien
gctcaccgaggagtagggtgtctac

SEQ ID NO: 289610 - DNA, 25 bp, Homo sapien
gggcgggcccgtgtagaccagctgt

SEQ ID NO: 289611 - DNA, 25 bp, Homo sapien
aaacccgccgtacatgccaggccta

SEQ ID NO: 289612 - DNA, 25 bp, Homo sapien
ctttttagaaggaaccgcactgaga

SEQ ID NO: 289613 - DNA, 25 bp, Homo sapien
ggaaccgcactgagaaagggtattt

SEQ ID NO: 289614 - DNA, 25 bp, Homo sapien
ggagtggtcaggtgactgatttcat

SEQ ID NO: 289615 - DNA, 25 bp, Homo sapien
agtggtcaggtgactgatttcatgt

SEQ ID NO: 289616 - DNA, 25 bp, Homo sapien
gaaatcttgtagacttcttgtgctt

SEQ ID NO: 289617 - DNA, 25 bp, Homo sapien
tagacttcttgtgcttctgtgtttt

SEQ ID NO: 289618 - DNA, 25 bp, Homo sapien
tttgctttcctatcaggccatgtag

SEQ ID NO: 289619 - DNA, 25 bp, Homo sapien
aggccatgtaggaaactgtgttctt

SEQ ID NO: 289620 - DNA, 25 bp, Homo sapien
ggccctcactgaaatccaagcttgg

SEQ ID NO: 289621 - DNA, 25 bp, Homo sapien
tccaagcttggaaggatgtcctgtg

SEQ ID NO: 289622 - DNA, 25 bp, Homo sapien
cagattctcttgtttggttttgaag

SEQ ID NO: 289623 - DNA, 25 bp, Homo sapien
tttctctaacactgacttctattcc

SEQ ID NO: 289624 - DNA, 25 bp, Homo sapien
gacttctattccatgagctttttca

SEQ ID NO: 289625 - DNA, 25 bp, Homo sapien
gagctttttcaaggcgcttatttta

SEQ ID NO: 289626 - DNA, 25 bp, Homo sapien
ggcagcgtattaaacttctttgata

SEQ ID NO: 289627 - DNA, 25 bp, Homo sapien
agcaaccagaccactccaatggaac

SEQ ID NO: 289628 - DNA, 25 bp, Homo sapien
aagtcatgctgactgtgtgatgaag

SEQ ID NO: 289629 - DNA, 25 bp, Homo sapien
tatccaggatgactgtgttgctgca

SEQ ID NO: 289630 - DNA, 25 bp, Homo sapien
tggtaacagtgacaggccctgcagt

SEQ ID NO: 289631 - DNA, 25 bp, Homo sapien
ccctgcagtcagcagctgtggattt

SEQ ID NO: 289632 - DNA, 25 bp, Homo sapien
tgtggattttatgtgcagggcagac

SEQ ID NO: 289633 - DNA, 25 bp, Homo sapien
tgcagggcagactgatctggaaaat

SEQ ID NO: 289634 - DNA, 25 bp, Homo sapien
gtgttgctgcagtctttgagtggtt

SEQ ID NO: 289635 - DNA, 25 bp, Homo sapien
tctttgagtggttggagcgctgtaa

SEQ ID NO: 289636 - DNA, 25 bp, Homo sapien
ggagcgctgtaatgtctatgttaat

SEQ ID NO: 289637 - DNA, 25 bp, Homo sapien
ggaaatcgcagtagcagcaaccaga

SEQ ID NO: 289638 - DNA, 25 bp, Homo sapien
gaagggcttcaagtggagcttgaac

SEQ ID NO: 289639 - DNA, 25 bp, Homo sapien
gggcttcaagtggagcttgaacctt

SEQ ID NO: 289640 - DNA, 25 bp, Homo sapien
aagtggagcttgaaccttgacatgc

SEQ ID NO: 289641 - DNA, 25 bp, Homo sapien
gtggagcttgaaccttgacatgcat

SEQ ID NO: 289642 - DNA, 25 bp, Homo sapien
tggagcttgaaccttgacatgcatc

SEQ ID NO: 289643 - DNA, 25 bp, Homo sapien
ggagcttgaaccttgacatgcatca

SEQ ID NO: 289644 - DNA, 25 bp, Homo sapien
gagcttgaaccttgacatgcatcag

SEQ ID NO: 289645 - DNA, 25 bp, Homo sapien
agcttgaaccttgacatgcatcaga

SEQ ID NO: 289646 - DNA, 25 bp, Homo sapien
gaaccttgacatgcatcagagggtg

SEQ ID NO: 289647 - DNA, 25 bp, Homo sapien
aaccttgacatgcatcagagggtgc

SEQ ID NO: 289648 - DNA, 25 bp, Homo sapien
ccttgacatgcatcagagggtgcac

SEQ ID NO: 289649 - DNA, 25 bp, Homo sapien
ttatcagagatgcattacgtgtaac

SEQ ID NO: 289650 - DNA, 25 bp, Homo sapien
cagtagtttcacttcagcgtgatga

SEQ ID NO: 289651 - DNA, 25 bp, Homo sapien
ttcagcgtgatgaataaatgcccat

SEQ ID NO: 289652 - DNA, 25 bp, Homo sapien
ataaatgcccatctatctctctttg

SEQ ID NO: 289653 - DNA, 25 bp, Homo sapien
cccatctatctctctttgtagactt

SEQ ID NO: 289654 - DNA, 25 bp, Homo sapien
agacttgcctaacgatatctcacct

SEQ ID NO: 289655 - DNA, 25 bp, Homo sapien
tctactcccatgaattcacctttga

SEQ ID NO: 289656 - DNA, 25 bp, Homo sapien
gaattcacctttgattccagtgtga

SEQ ID NO: 289657 - DNA, 25 bp, Homo sapien
cagtgtgaactgtcaatcataaggt

SEQ ID NO: 289658 - DNA, 25 bp, Homo sapien
aattgagtgacttatcgctgtaccg

SEQ ID NO: 289659 - DNA, 25 bp, Homo sapien
agtgacttatcgctgtaccgtggtc

SEQ ID NO: 289660 - DNA, 25 bp, Homo sapien
gaaacaagtatctgagttccctgga

SEQ ID NO: 289661 - DNA, 25 bp, Homo sapien
tgagttccctggagatcaacgggat

SEQ ID NO: 289662 - DNA, 25 bp, Homo sapien
aacgggatgaggtgttacagctgcc

SEQ ID NO: 289663 - DNA, 25 bp, Homo sapien
gatgaggtgttacagctgcctccct

SEQ ID NO: 289664 - DNA, 25 bp, Homo sapien
tccctcttcatgcaatctggtgagc

SEQ ID NO: 289665 - DNA, 25 bp, Homo sapien
catgcaatctggtgagcagtggtgc

SEQ ID NO: 289666 - DNA, 25 bp, Homo sapien
agaaacttgccagttatataacttc

SEQ ID NO: 289667 - DNA, 25 bp, Homo sapien
aatactgaactgtaagggttagtgg

SEQ ID NO: 289668 - DNA, 25 bp, Homo sapien
gtacatgacacagtagttgcttgat

SEQ ID NO: 289669 - DNA, 25 bp, Homo sapien
agtagtattcttactaagacccaat

SEQ ID NO: 289670 - DNA, 25 bp, Homo sapien
taagacccaatacaaatggattatt

SEQ ID NO: 289671 - DNA, 25 bp, Homo sapien
ttagacacaagagaacaggttccct

SEQ ID NO: 289672 - DNA, 25 bp, Homo sapien
tgcccttcggtcttcaggtgaggct

SEQ ID NO: 289673 - DNA, 25 bp, Homo sapien
gagaatctcttgtctactatttgca

SEQ ID NO: 289674 - DNA, 25 bp, Homo sapien
agtgatgccctgcagtgcttttgta

SEQ ID NO: 289675 - DNA, 25 bp, Homo sapien
cctgcagtgcttttgtagggttgga

SEQ ID NO: 289676 - DNA, 25 bp, Homo sapien
gctgggaaagaaggaacccttgcgt

SEQ ID NO: 289677 - DNA, 25 bp, Homo sapien
ctactatttgcaagaattgctgcgt

SEQ ID NO: 289678 - DNA, 25 bp, Homo sapien
aattgctgcgtattttctaggaaga

SEQ ID NO: 289679 - DNA, 25 bp, Homo sapien
gaagaagtccactgctttagtccta

SEQ ID NO: 289680 - DNA, 25 bp, Homo sapien
tccactgctttagtcctattctgaa

SEQ ID NO: 289681 - DNA, 25 bp, Homo sapien
ctgaaaggcatttggtgttagacac

SEQ ID NO: 289682 - DNA, 25 bp, Homo sapien
gccggtgctccacccatggaagaaa

SEQ ID NO: 289683 - DNA, 25 bp, Homo sapien
aaaggctggctgtccttgggcccaa

SEQ ID NO: 289684 - DNA, 25 bp, Homo sapien
ttgggcccaagaaagtcaagcatta

SEQ ID NO: 289685 - DNA, 25 bp, Homo sapien
agtcaagcattatccacgtccaaag

SEQ ID NO: 289686 - DNA, 25 bp, Homo sapien
gcattatccacgtccaaaggtgaca

SEQ ID NO: 289687 - DNA, 25 bp, Homo sapien
gactcaaaggagacttcaagaacag

SEQ ID NO: 289688 - DNA, 25 bp, Homo sapien
aaacactggaagaggtcacctagga

SEQ ID NO: 289689 - DNA, 25 bp, Homo sapien
aagaggtcacctaggaaaagcatga

SEQ ID NO: 289690 - DNA, 25 bp, Homo sapien
tgaactgctcagttaccatgggaga

SEQ ID NO: 289691 - DNA, 25 bp, Homo sapien
ttaccatgggagaaggaccaagatc

SEQ ID NO: 289692 - DNA, 25 bp, Homo sapien
aagatcaaaggccttcaggacccca

SEQ ID NO: 289693 - DNA, 25 bp, Homo sapien
agacttgcctaacgatatctcacct

SEQ ID NO: 289694 - DNA, 25 bp, Homo sapien
acttgcctaacgatatctcacctct

SEQ ID NO: 289695 - DNA, 25 bp, Homo sapien
ttgcctaacgatatctcacctctac

SEQ ID NO: 289696 - DNA, 25 bp, Homo sapien
tgcctaacgatatctcacctctact

SEQ ID NO: 289697 - DNA, 25 bp, Homo sapien
atatctcacctctactcccatgaat

SEQ ID NO: 289698 - DNA, 25 bp, Homo sapien
tctactcccatgaattcacctttga

SEQ ID NO: 289699 - DNA, 25 bp, Homo sapien
tactcccatgaattcacctttgatt

SEQ ID NO: 289700 - DNA, 25 bp, Homo sapien
ctcccatgaattcacctttgattcc

SEQ ID NO: 289701 - DNA, 25 bp, Homo sapien
atgaattcacctttgattccagtgt

SEQ ID NO: 289702 - DNA, 25 bp, Homo sapien
gaattcacctttgattccagtgtga

SEQ ID NO: 289703 - DNA, 25 bp, Homo sapien
ttcacctttgattccagtgtgaact

SEQ ID NO: 289704 - DNA, 25 bp, Homo sapien
gtgtgaatctgagtgccttattaac

SEQ ID NO: 289705 - DNA, 25 bp, Homo sapien
atctgagtgccttattaaccttccc

SEQ ID NO: 289706 - DNA, 25 bp, Homo sapien
gagtgccttattaaccttccctggt

SEQ ID NO: 289707 - DNA, 25 bp, Homo sapien
ctggtcccagtttcgtatctgtaaa

SEQ ID NO: 289708 - DNA, 25 bp, Homo sapien
cccagtttcgtatctgtaaagttag

SEQ ID NO: 289709 - DNA, 25 bp, Homo sapien
aaagttagaatagcaatcctgttta

SEQ ID NO: 289710 - DNA, 25 bp, Homo sapien
atttgcttctctcaccagggatcag

SEQ ID NO: 289711 - DNA, 25 bp, Homo sapien
tctcaccagggatcagaaggccaaa

SEQ ID NO: 289712 - DNA, 25 bp, Homo sapien
cagggatcagaaggccaaatgagat

SEQ ID NO: 289713 - DNA, 25 bp, Homo sapien
agtcctccacagatggcacttgcca

SEQ ID NO: 289714 - DNA, 25 bp, Homo sapien
ccccaccttcttaatagtgtgtgaa

SEQ ID NO: 289715 - DNA, 25 bp, Homo sapien
gttttttctaacttcacatctggaa

SEQ ID NO: 289716 - DNA, 25 bp, Homo sapien
tggaatcaaaccatggtccgccctt

SEQ ID NO: 289717 - DNA, 25 bp, Homo sapien
tccgcccttgctttctgtttaaaat

SEQ ID NO: 289718 - DNA, 25 bp, Homo sapien
acttctgcatgcacggccagtggtc

SEQ ID NO: 289719 - DNA, 25 bp, Homo sapien
gcaaccacctcaggaagtcgacatt

SEQ ID NO: 289720 - DNA, 25 bp, Homo sapien
aagtcgacatttgaggtattccacc

SEQ ID NO: 289721 - DNA, 25 bp, Homo sapien
gtattccaccaggaacctgtgtcag

SEQ ID NO: 289722 - DNA, 25 bp, Homo sapien
gagagcttagctgtcaagagtacca

SEQ ID NO: 289723 - DNA, 25 bp, Homo sapien
agtggtcagccacgcctttcaggat

SEQ ID NO: 289724 - DNA, 25 bp, Homo sapien
ggcctccctggaaccaaaaactgct

SEQ ID NO: 289725 - DNA, 25 bp, Homo sapien
aaaaactgctccctgaaatgctgga

SEQ ID NO: 289726 - DNA, 25 bp, Homo sapien
agagtgcaccgtatcctgtcacttc

SEQ ID NO: 289727 - DNA, 25 bp, Homo sapien
gtatcctgtcacttctggatgtgag

SEQ ID NO: 289728 - DNA, 25 bp, Homo sapien
ggctagtccctctgagacgagcgag

SEQ ID NO: 289729 - DNA, 25 bp, Homo sapien
tcattcccctccgtggatcagagga

SEQ ID NO: 289730 - DNA, 25 bp, Homo sapien
cgtggatcagaggacttggactaga

SEQ ID NO: 289731 - DNA, 25 bp, Homo sapien
tagaagcatgtggtgtctcctacga

SEQ ID NO: 289732 - DNA, 25 bp, Homo sapien
catgtggtgtctcctacgaggcctg

SEQ ID NO: 289733 - DNA, 25 bp, Homo sapien
agacgagcgagcaggcagccattca

SEQ ID NO: 289734 - DNA, 25 bp, Homo sapien
gcagccattcactaacatgcgttca

SEQ ID NO: 289735 - DNA, 25 bp, Homo sapien
caaagagtgtgtaggccagccccgg

SEQ ID NO: 289736 - DNA, 25 bp, Homo sapien
agccccggtcacagagtgcaccgta

SEQ ID NO: 289737 - DNA, 25 bp, Homo sapien
gaaactgaaggactgccaggcagca

SEQ ID NO: 289738 - DNA, 25 bp, Homo sapien
cagagttccggagggctcccaggac

SEQ ID NO: 289739 - DNA, 25 bp, Homo sapien
tcccaggaccttcaaccagaaagag

SEQ ID NO: 289740 - DNA, 25 bp, Homo sapien
agagcatatgcgcatatccctgcaa

SEQ ID NO: 289741 - DNA, 25 bp, Homo sapien
gcaaggaatgtactatagagccaat

SEQ ID NO: 289742 - DNA, 25 bp, Homo sapien
gagccaattttaccggcaaaggaat

SEQ ID NO: 289743 - DNA, 25 bp, Homo sapien
atctgaaaggctaggcgatcccaca

SEQ ID NO: 289744 - DNA, 25 bp, Homo sapien
taggcgatcccacaagcatcgagga

SEQ ID NO: 289745 - DNA, 25 bp, Homo sapien
gctggaatttgaaccaatcggcatg

SEQ ID NO: 289746 - DNA, 25 bp, Homo sapien
aatcggcatgattcccaagctcaag

SEQ ID NO: 289747 - DNA, 25 bp, Homo sapien
aagctcaagcttttggccacccctg

SEQ ID NO: 289748 - DNA, 25 bp, Homo sapien
cgcctcccggcctcgcccgagggtg

SEQ ID NO: 289749 - DNA, 25 bp, Homo sapien
gcctcccggcctcgcccgagggtgc

SEQ ID NO: 289750 - DNA, 25 bp, Homo sapien
ctcccggcctcgcccgagggtgcct

SEQ ID NO: 289751 - DNA, 25 bp, Homo sapien
tcccggcctcgcccgagggtgcctg

SEQ ID NO: 289752 - DNA, 25 bp, Homo sapien
ccggcctcgcccgagggtgcctggg

SEQ ID NO: 289753 - DNA, 25 bp, Homo sapien
cggcctcgcccgagggtgcctgggc

SEQ ID NO: 289754 - DNA, 25 bp, Homo sapien
ggcctcgcccgagggtgcctgggca

SEQ ID NO: 289755 - DNA, 25 bp, Homo sapien
gcctcgcccgagggtgcctgggcag

SEQ ID NO: 289756 - DNA, 25 bp, Homo sapien
cctcgcccgagggtgcctgggcagg

SEQ ID NO: 289757 - DNA, 25 bp, Homo sapien
ctcgcccgagggtgcctgggcaggc

SEQ ID NO: 289758 - DNA, 25 bp, Homo sapien
tcgcccgagggtgcctgggcaggcg

SEQ ID NO: 289759 - DNA, 25 bp, Homo sapien
atgggtcttgtctggctccaggctt

SEQ ID NO: 289760 - DNA, 25 bp, Homo sapien
cttgtctggctccaggctttttgtt

SEQ ID NO: 289761 - DNA, 25 bp, Homo sapien
gctttttgtttctaatgttgtttct

SEQ ID NO: 289762 - DNA, 25 bp, Homo sapien
gaagccacagacagttgttccagct

SEQ ID NO: 289763 - DNA, 25 bp, Homo sapien
agacagttgttccagctttccggat

SEQ ID NO: 289764 - DNA, 25 bp, Homo sapien
tgttccagctttccggatcagagag

SEQ ID NO: 289765 - DNA, 25 bp, Homo sapien
gctttccggatcagagagcactggt

SEQ ID NO: 289766 - DNA, 25 bp, Homo sapien
ttccggatcagagagcactggttgg

SEQ ID NO: 289767 - DNA, 25 bp, Homo sapien
atgggatcgctcctcaggtcatgga

SEQ ID NO: 289768 - DNA, 25 bp, Homo sapien
ggatcgctcctcaggtcatggagcc

SEQ ID NO: 289769 - DNA, 25 bp, Homo sapien
acatcagtgtggagggttcgctcca

SEQ ID NO: 289770 - DNA, 25 bp, Homo sapien
ctgctgctgtggagcggcgccgacc

SEQ ID NO: 289771 - DNA, 25 bp, Homo sapien
gcgacgtgatcgtggacctgtggga

SEQ ID NO: 289772 - DNA, 25 bp, Homo sapien
acgtgatcgtggacctgtgggaggg

SEQ ID NO: 289773 - DNA, 25 bp, Homo sapien
tgctgctgctcgcttacttcagtcg

SEQ ID NO: 289774 - DNA, 25 bp, Homo sapien
tgctgctcgcttacttcagtcgcct

SEQ ID NO: 289775 - DNA, 25 bp, Homo sapien
tgctcgcttacttcagtcgcctctg

SEQ ID NO: 289776 - DNA, 25 bp, Homo sapien
tacttcagtcgcctctgcgccaagg

SEQ ID NO: 289777 - DNA, 25 bp, Homo sapien
ttcagtcgcctctgcgccaagggcg

SEQ ID NO: 289778 - DNA, 25 bp, Homo sapien
tcgcctctgcgccaagggcgacatc

SEQ ID NO: 289779 - DNA, 25 bp, Homo sapien
gaggcacgtggcgcgcgtgggcccg

SEQ ID NO: 289780 - DNA, 25 bp, Homo sapien
gcgtagcgcgggagcagggcactgt

SEQ ID NO: 289781 - DNA, 25 bp, Homo sapien
gcggctcgaggactccgcttccttc

SEQ ID NO: 289782 - DNA, 25 bp, Homo sapien
tgaggcgagggctgcctcttgttct

SEQ ID NO: 289783 - DNA, 25 bp, Homo sapien
gaggcgagggctgcctcttgttctc

SEQ ID NO: 289784 - DNA, 25 bp, Homo sapien
ggcgagggctgcctcttgttctccc

SEQ ID NO: 289785 - DNA, 25 bp, Homo sapien
gcgagggctgcctcttgttctcccg

SEQ ID NO: 289786 - DNA, 25 bp, Homo sapien
gctgccgccgtctcctggtcgggtg

SEQ ID NO: 289787 - DNA, 25 bp, Homo sapien
cgcggcgcgggaggcacgttcctta

SEQ ID NO: 289788 - DNA, 25 bp, Homo sapien
gcgggaggcacgttccttagctccg

SEQ ID NO: 289789 - DNA, 25 bp, Homo sapien
cgggaggcacgttccttagctccgc

SEQ ID NO: 289790 - DNA, 25 bp, Homo sapien
gggaggcacgttccttagctccgcc

SEQ ID NO: 289791 - DNA, 25 bp, Homo sapien
ggaggcacgttccttagctccgccg

SEQ ID NO: 289792 - DNA, 25 bp, Homo sapien
tcacagggctgattgttctccttct

SEQ ID NO: 289793 - DNA, 25 bp, Homo sapien
aaaatctccatcagagcaaggcagc

SEQ ID NO: 289794 - DNA, 25 bp, Homo sapien
gattgggaagtgtccacttctccaa

SEQ ID NO: 289795 - DNA, 25 bp, Homo sapien
ggctcatcaaacacactcctttgtc

SEQ ID NO: 289796 - DNA, 25 bp, Homo sapien
acactcctttgtctatgaatggcac

SEQ ID NO: 289797 - DNA, 25 bp, Homo sapien
cctttgtctatgaatggcacatgta

SEQ ID NO: 289798 - DNA, 25 bp, Homo sapien
ttatatcatatgcttcaccattctg

SEQ ID NO: 289799 - DNA, 25 bp, Homo sapien
gcttcaccattctgtaaagggcctc

SEQ ID NO: 289800 - DNA, 25 bp, Homo sapien
gtaaagggcctctgcattgttgctc

SEQ ID NO: 289801 - DNA, 25 bp, Homo sapien
gcctctgcattgttgctcccatcag

SEQ ID NO: 289802 - DNA, 25 bp, Homo sapien
caagtggaaataaaccctcgtggat

SEQ ID NO: 289803 - DNA, 25 bp, Homo sapien
ggatccaagtcctaaccttaagcaa

SEQ ID NO: 289804 - DNA, 25 bp, Homo sapien
agtcctaaccttaagcaagtggctt

SEQ ID NO: 289805 - DNA, 25 bp, Homo sapien
ctaaccttaagcaagtggcttggct

SEQ ID NO: 289806 - DNA, 25 bp, Homo sapien
taaattcttggtgtcctcatcttaa

SEQ ID NO: 289807 - DNA, 25 bp, Homo sapien
attcttggtgtcctcatcttaaatg

SEQ ID NO: 289808 - DNA, 25 bp, Homo sapien
cttggtgtcctcatcttaaatggaa

SEQ ID NO: 289809 - DNA, 25 bp, Homo sapien
ataatagtacctgctgcacaggtta

SEQ ID NO: 289810 - DNA, 25 bp, Homo sapien
ctgctgcacaggttattaatgagta

SEQ ID NO: 289811 - DNA, 25 bp, Homo sapien
tgaggactctccctgcacctagttt

SEQ ID NO: 289812 - DNA, 25 bp, Homo sapien
tctccctgcacctagtttttgtgat

SEQ ID NO: 289813 - DNA, 25 bp, Homo sapien
ttgtgatgataatgggtgtcatgct

SEQ ID NO: 289814 - DNA, 25 bp, Homo sapien
atttttgcatttcaccaacagtgat

SEQ ID NO: 289815 - DNA, 25 bp, Homo sapien
aagcaaagtatcaacagtcccttaa

SEQ ID NO: 289816 - DNA, 25 bp, Homo sapien
agtcccttaaatgagaatccttatc

SEQ ID NO: 289817 - DNA, 25 bp, Homo sapien
gaatccttatctttgatctttattt

SEQ ID NO: 289818 - DNA, 25 bp, Homo sapien
tttctgtgttaggtgttagggtcct

SEQ ID NO: 289819 - DNA, 25 bp, Homo sapien
tcctggtgcagctcataatgctaat

SEQ ID NO: 289820 - DNA, 25 bp, Homo sapien
gtgcagctcataatgctaattcttc

SEQ ID NO: 289821 - DNA, 25 bp, Homo sapien
acctagtcactattgtctttgttca

SEQ ID NO: 289822 - DNA, 25 bp, Homo sapien
ttgtctttgttcattgtttgatcct

SEQ ID NO: 289823 - DNA, 25 bp, Homo sapien
cattgtttgatcctgagtggttgat

SEQ ID NO: 289824 - DNA, 25 bp, Homo sapien
agtggttgattgatatagctttgaa

SEQ ID NO: 289825 - DNA, 25 bp, Homo sapien
gagaatttgcttggtcagtaggtca

SEQ ID NO: 289826 - DNA, 25 bp, Homo sapien
ggtcagtaggtcagcattcaagagt

SEQ ID NO: 289827 - DNA, 25 bp, Homo sapien
attcaagagtatgggctggatgcag

SEQ ID NO: 289828 - DNA, 25 bp, Homo sapien
ggctggatgcagagtaaacgacctg

SEQ ID NO: 289829 - DNA, 25 bp, Homo sapien
aaacgacctgctgagagtaatggcc

SEQ ID NO: 289830 - DNA, 25 bp, Homo sapien
tcaaaatcctgaacaagctcctctt

SEQ ID NO: 289831 - DNA, 25 bp, Homo sapien
tggaaccatgcagattaggaagaga

SEQ ID NO: 289832 - DNA, 25 bp, Homo sapien
gaaagattttagcttggtcaagttg

SEQ ID NO: 289833 - DNA, 25 bp, Homo sapien
ggtcaagttgataacgggatgattc

SEQ ID NO: 289834 - DNA, 25 bp, Homo sapien
aacccttatcaactaggtatatctc

SEQ ID NO: 289835 - DNA, 25 bp, Homo sapien
ggtatatctcttttttcctacattt

SEQ ID NO: 289836 - DNA, 25 bp, Homo sapien
ctctgcttctctgggtgaaaaagac

SEQ ID NO: 289837 - DNA, 25 bp, Homo sapien
aagggactaccagctcaatgtacag

SEQ ID NO: 289838 - DNA, 25 bp, Homo sapien
gtacagctccgagaggtctttgcta

SEQ ID NO: 289839 - DNA, 25 bp, Homo sapien
ggtctttgctaaccgttttacacag

SEQ ID NO: 289840 - DNA, 25 bp, Homo sapien
aaccgttttacacagatgtttgcag

SEQ ID NO: 289841 - DNA, 25 bp, Homo sapien
acgaagcatttgtcattcagactgc

SEQ ID NO: 289842 - DNA, 25 bp, Homo sapien
aatcctggctgaccaaccgggaaca

SEQ ID NO: 289843 - DNA, 25 bp, Homo sapien
aaccgggaacagatgcagaactttg

SEQ ID NO: 289844 - DNA, 25 bp, Homo sapien
aatgaaaccatagcccgcttgcagg

SEQ ID NO: 289845 - DNA, 25 bp, Homo sapien
aggctctggccaagcgtactggtgt

SEQ ID NO: 289846 - DNA, 25 bp, Homo sapien
gtggaaaaaatggacctctctgctt

SEQ ID NO: 289847 - DNA, 25 bp, Homo sapien
atctgtgctcacaagcacacatgtt

SEQ ID NO: 289848 - DNA, 25 bp, Homo sapien
gtgctcacaagcacacatgttccct

SEQ ID NO: 289849 - DNA, 25 bp, Homo sapien
atgttccctctctcaacaaatgcat

SEQ ID NO: 289850 - DNA, 25 bp, Homo sapien
gttccctctctcaacaaatgcatgg

SEQ ID NO: 289851 - DNA, 25 bp, Homo sapien
tccctctctcaacaaatgcatggag

SEQ ID NO: 289852 - DNA, 25 bp, Homo sapien
ttaaactccccatttatttgctcag

SEQ ID NO: 289853 - DNA, 25 bp, Homo sapien
aggctgccccaggtctaaaggagca

SEQ ID NO: 289854 - DNA, 25 bp, Homo sapien
gctgccccaggtctaaaggagcaaa

SEQ ID NO: 289855 - DNA, 25 bp, Homo sapien
gccccaggtctaaaggagcaaaagg

SEQ ID NO: 289856 - DNA, 25 bp, Homo sapien
aacttaaggtttgctcaactgttct

SEQ ID NO: 289857 - DNA, 25 bp, Homo sapien
cttaaggtttgctcaactgttctga

SEQ ID NO: 289858 - DNA, 25 bp, Homo sapien
attctatgcaagtgtcctggccttt

SEQ ID NO: 289859 - DNA, 25 bp, Homo sapien
ggcagtgatggcagttgtctcttgc

SEQ ID NO: 289860 - DNA, 25 bp, Homo sapien
tcttctgcttccatgattccaccaa

SEQ ID NO: 289861 - DNA, 25 bp, Homo sapien
tgatggcagttgtctcttgcacgct

SEQ ID NO: 289862 - DNA, 25 bp, Homo sapien
catgccagtgagtgcactgcgttct

SEQ ID NO: 289863 - DNA, 25 bp, Homo sapien
gagtgcactgcgttctcagttaatt

SEQ ID NO: 289864 - DNA, 25 bp, Homo sapien
gcgttctcagttaattcatccgaaa

SEQ ID NO: 289865 - DNA, 25 bp, Homo sapien
ttgcacgctgcgtacagttctgtca

SEQ ID NO: 289866 - DNA, 25 bp, Homo sapien
acagttctgtcactgactcttacac

SEQ ID NO: 289867 - DNA, 25 bp, Homo sapien
actgactcttacacacagccctgga

SEQ ID NO: 289868 - DNA, 25 bp, Homo sapien
agagtgccgggagcattctatgcaa

SEQ ID NO: 289869 - DNA, 25 bp, Homo sapien
gggccttcccctactcataagctga

SEQ ID NO: 289870 - DNA, 25 bp, Homo sapien
gtctgaggaagaactgctgacccag

SEQ ID NO: 289871 - DNA, 25 bp, Homo sapien
aaagtggtatctcaagcatctctgg

SEQ ID NO: 289872 - DNA, 25 bp, Homo sapien
gaagttattccattgctctcagcat

SEQ ID NO: 289873 - DNA, 25 bp, Homo sapien
attgctctcagcataagactatgtg

SEQ ID NO: 289874 - DNA, 25 bp, Homo sapien
gggaaagtaccgctgtaagctctgt

SEQ ID NO: 289875 - DNA, 25 bp, Homo sapien
accgctgtaagctctgtatgaaaca

SEQ ID NO: 289876 - DNA, 25 bp, Homo sapien
aacaaatccctatcaggcaaacgct

SEQ ID NO: 289877 - DNA, 25 bp, Homo sapien
agggctaacctttctgagtcaaaat

SEQ ID NO: 289878 - DNA, 25 bp, Homo sapien
gagtcaaaatgtgccctgagaacca

SEQ ID NO: 289879 - DNA, 25 bp, Homo sapien
tgagaaccaggtcctttccctggtg

SEQ ID NO: 289880 - DNA, 25 bp, Homo sapien
taaggcatcagttggtaaatttttt

SEQ ID NO: 289881 - DNA, 25 bp, Homo sapien
ttttaggttttatgggaccacatag

SEQ ID NO: 289882 - DNA, 25 bp, Homo sapien
gggaccacatagtactgtcgcatat

SEQ ID NO: 289883 - DNA, 25 bp, Homo sapien
cacatagtactgtcgcatatttttt

SEQ ID NO: 289884 - DNA, 25 bp, Homo sapien
aagggcctggagaatgactaaagga

SEQ ID NO: 289885 - DNA, 25 bp, Homo sapien
atgatgcagaactaaggaagacctt

SEQ ID NO: 289886 - DNA, 25 bp, Homo sapien
agaactaaggaagaccttcaacttg

SEQ ID NO: 289887 - DNA, 25 bp, Homo sapien
gaccttcaacttgaaacaaggattg

SEQ ID NO: 289888 - DNA, 25 bp, Homo sapien
acaaggattgtatactttgagactt

SEQ ID NO: 289889 - DNA, 25 bp, Homo sapien
gtatactttgagacttaaggcatca

SEQ ID NO: 289890 - DNA, 25 bp, Homo sapien
gagacttaaggcatcagttggtaaa

SEQ ID NO: 289891 - DNA, 25 bp, Homo sapien
gtggtttagtatagagttaacactt

SEQ ID NO: 289892 - DNA, 25 bp, Homo sapien
tattcttatgtactgtaaggaccat

SEQ ID NO: 289893 - DNA, 25 bp, Homo sapien
ctgtaaggaccatatttgagttttt

SEQ ID NO: 289894 - DNA, 25 bp, Homo sapien
gagtttttggtctattcctaccatt

SEQ ID NO: 289895 - DNA, 25 bp, Homo sapien
gtctattcctaccattgtttctttg

SEQ ID NO: 289896 - DNA, 25 bp, Homo sapien
attcctaccattgtttctttgtggg

SEQ ID NO: 289897 - DNA, 25 bp, Homo sapien
aacatctgtaatccagttttctgta

SEQ ID NO: 289898 - DNA, 25 bp, Homo sapien
tctgtaatccagttttctgtaaatg

SEQ ID NO: 289899 - DNA, 25 bp, Homo sapien
ttctgtaaatgttgctgttgttcta

SEQ ID NO: 289900 - DNA, 25 bp, Homo sapien
gttgctgttgttctaagctctgtta

SEQ ID NO: 289901 - DNA, 25 bp, Homo sapien
agctctgttaatgttaagcattctt

SEQ ID NO: 289902 - DNA, 25 bp, Homo sapien
agcccgctcccgaaatgagtactcg

SEQ ID NO: 289903 - DNA, 25 bp, Homo sapien
aaatgagtactcgtggtttccgcgt

SEQ ID NO: 289904 - DNA, 25 bp, Homo sapien
tttccgcgtgggaaccaacctcgag

SEQ ID NO: 289905 - DNA, 25 bp, Homo sapien
tgggaaccaacctcgagcgccagtg

SEQ ID NO: 289906 - DNA, 25 bp, Homo sapien
gctttctaccttcccaggttagccg

SEQ ID NO: 289907 - DNA, 25 bp, Homo sapien
aggttagccgcggtcaacttctgcc

SEQ ID NO: 289908 - DNA, 25 bp, Homo sapien
caacttctgccaggcggagcgagaa

SEQ ID NO: 289909 - DNA, 25 bp, Homo sapien
agcgagaaatcgcattttgtcaggg

SEQ ID NO: 289910 - DNA, 25 bp, Homo sapien
acgggtgccgatttcatgtgtgtgt

SEQ ID NO: 289911 - DNA, 25 bp, Homo sapien
atttcatgtgtgtgttcccgagtgc

SEQ ID NO: 289912 - DNA, 25 bp, Homo sapien
gtgtgtgttcccgagtgcctgagcc

SEQ ID NO: 289913 - DNA, 25 bp, Homo sapien
agtatctacttcactgtcagttcaa

SEQ ID NO: 289914 - DNA, 25 bp, Homo sapien
gtatgtgttagcatttgagcactta

SEQ ID NO: 289915 - DNA, 25 bp, Homo sapien
gagcacttatttaatgagccatatc

SEQ ID NO: 289916 - DNA, 25 bp, Homo sapien
aagttagaaatcatgccttatggca

SEQ ID NO: 289917 - DNA, 25 bp, Homo sapien
tgccttatggcacctagtcagttgt

SEQ ID NO: 289918 - DNA, 25 bp, Homo sapien
cacctagtcagttgtgcagatggtt

SEQ ID NO: 289919 - DNA, 25 bp, Homo sapien
gcagatggttagtttgcttctaata

SEQ ID NO: 289920 - DNA, 25 bp, Homo sapien
gtaatttctagatgttgtgcactca

SEQ ID NO: 289921 - DNA, 25 bp, Homo sapien
gatgttgtgcactcaaacttggtat

SEQ ID NO: 289922 - DNA, 25 bp, Homo sapien
cagtaaacagtgtaaccaaggtctt

SEQ ID NO: 289923 - DNA, 25 bp, Homo sapien
aatcttaattatggctcagtcttta

SEQ ID NO: 289924 - DNA, 25 bp, Homo sapien
ttacagacctgtacaaactttttct

SEQ ID NO: 289925 - DNA, 25 bp, Homo sapien
acagaagggagcaagtatttgaaaa

SEQ ID NO: 289926 - DNA, 25 bp, Homo sapien
tcttaaaacaatggcttttctcttt

SEQ ID NO: 289927 - DNA, 25 bp, Homo sapien
aaagcacagctactttttcctggca

SEQ ID NO: 289928 - DNA, 25 bp, Homo sapien
aagcacagctactttttcctggcaa

SEQ ID NO: 289929 - DNA, 25 bp, Homo sapien
gcacagctactttttcctggcaaaa

SEQ ID NO: 289930 - DNA, 25 bp, Homo sapien
atttgaaaaacattgcctggtacac

SEQ ID NO: 289931 - DNA, 25 bp, Homo sapien
ttgaaaaacattgcctggtacacag

SEQ ID NO: 289932 - DNA, 25 bp, Homo sapien
agtacctctcaaactgcaagaacgt

SEQ ID NO: 289933 - DNA, 25 bp, Homo sapien
acctctcaaactgcaagaacgtaag

SEQ ID NO: 289934 - DNA, 25 bp, Homo sapien
caaactgcaagaacgtaagaaattt

SEQ ID NO: 289935 - DNA, 25 bp, Homo sapien
ttggtttccttctatccaccaaata

SEQ ID NO: 289936 - DNA, 25 bp, Homo sapien
gctaatgtaactttattcttcactt

SEQ ID NO: 289937 - DNA, 25 bp, Homo sapien
ttttagccctagacttcctagattt

SEQ ID NO: 289938 - DNA, 25 bp, Homo sapien
gccctagacttcctagattttctgt

SEQ ID NO: 289939 - DNA, 25 bp, Homo sapien
gacttcctagattttctgtggcatt

SEQ ID NO: 289940 - DNA, 25 bp, Homo sapien
ctgtggcattctgtaggacattgta

SEQ ID NO: 289941 - DNA, 25 bp, Homo sapien
cattctgtaggacattgtattgctt

SEQ ID NO: 289942 - DNA, 25 bp, Homo sapien
gtaggacattgtattgcttggaaaa

SEQ ID NO: 289943 - DNA, 25 bp, Homo sapien
gggcaaatgctctattatccttatt

SEQ ID NO: 289944 - DNA, 25 bp, Homo sapien
tatccttatttatgacaagagaata

SEQ ID NO: 289945 - DNA, 25 bp, Homo sapien
tattgctataaatgtacttgagtca

SEQ ID NO: 289946 - DNA, 25 bp, Homo sapien
gggccgccactcacctaggagagga

SEQ ID NO: 289947 - DNA, 25 bp, Homo sapien
ctggaggccggagcgccttttgatt

SEQ ID NO: 289948 - DNA, 25 bp, Homo sapien
tggagtccgatgacctggactgaga

SEQ ID NO: 289949 - DNA, 25 bp, Homo sapien
ctggactgagaggaaacgcgagact

SEQ ID NO: 289950 - DNA, 25 bp, Homo sapien
aaacgcgagactgagtctaccaggt

SEQ ID NO: 289951 - DNA, 25 bp, Homo sapien
gactgagtctaccaggtgaggtaaa

SEQ ID NO: 289952 - DNA, 25 bp, Homo sapien
gaggtaaaaaacacccacctgctca

SEQ ID NO: 289953 - DNA, 25 bp, Homo sapien
ggagcgccttttgatttcgggagac

SEQ ID NO: 289954 - DNA, 25 bp, Homo sapien
gcgccttttgatttcgggagactgg

SEQ ID NO: 289955 - DNA, 25 bp, Homo sapien
atttcgggagactggcccaggaact

SEQ ID NO: 289956 - DNA, 25 bp, Homo sapien
gagccaggtaggagccactcagagg

SEQ ID NO: 289957 - DNA, 25 bp, Homo sapien
ctgtctccatatttaggtagtgtca

SEQ ID NO: 289958 - DNA, 25 bp, Homo sapien
gtctccatatttaggtagtgtcagt

SEQ ID NO: 289959 - DNA, 25 bp, Homo sapien
ctccatatttaggtagtgtcagtgg

SEQ ID NO: 289960 - DNA, 25 bp, Homo sapien
ctgtttttctcaactgtcagtggaa

SEQ ID NO: 289961 - DNA, 25 bp, Homo sapien
gtttttctcaactgtcagtggaatt

SEQ ID NO: 289962 - DNA, 25 bp, Homo sapien
aactgtcagtggaattattgtcttc

SEQ ID NO: 289963 - DNA, 25 bp, Homo sapien
gtcagtggaattattgtcttcctgt

SEQ ID NO: 289964 - DNA, 25 bp, Homo sapien
cagtggaattattgtcttcctgtct

SEQ ID NO: 289965 - DNA, 25 bp, Homo sapien
tgtcttcctgtctccatatttaggt

SEQ ID NO: 289966 - DNA, 25 bp, Homo sapien
gtcttcctgtctccatatttaggta

SEQ ID NO: 289967 - DNA, 25 bp, Homo sapien
cttcctgtctccatatttaggtagt

SEQ ID NO: 289968 - DNA, 25 bp, Homo sapien
gaaatgtttaaatctctggtataag

SEQ ID NO: 289969 - DNA, 25 bp, Homo sapien
gtataagtttactccataccagagt

SEQ ID NO: 289970 - DNA, 25 bp, Homo sapien
attactctatataagcagtcttgca

SEQ ID NO: 289971 - DNA, 25 bp, Homo sapien
gcagtcttgcaataactaatcacca

SEQ ID NO: 289972 - DNA, 25 bp, Homo sapien
aactaatcaccaccatagaagaaag

SEQ ID NO: 289973 - DNA, 25 bp, Homo sapien
gaaacagactgcaaggaacagagtt

SEQ ID NO: 289974 - DNA, 25 bp, Homo sapien
gagtgtctggagtcatcaaaggcat

SEQ ID NO: 289975 - DNA, 25 bp, Homo sapien
gtctggagtcatcaaaggcattaaa

SEQ ID NO: 289976 - DNA, 25 bp, Homo sapien
gggccgtagcaaaaatcatgaaaaa

SEQ ID NO: 289977 - DNA, 25 bp, Homo sapien
gccaattttcacatcttccacaaac

SEQ ID NO: 289978 - DNA, 25 bp, Homo sapien
catcttccacaaactccatttaggg

SEQ ID NO: 289979 - DNA, 25 bp, Homo sapien
aaatgatggttatgccctggccagt

SEQ ID NO: 289980 - DNA, 25 bp, Homo sapien
gacagagtcaaagcactgcctggtt

SEQ ID NO: 289981 - DNA, 25 bp, Homo sapien
tcaaagcactgcctggttcaagccc

SEQ ID NO: 289982 - DNA, 25 bp, Homo sapien
ccagctctgtcacttactagttgta

SEQ ID NO: 289983 - DNA, 25 bp, Homo sapien
ctagttgtatgagcttgagtgagtt

SEQ ID NO: 289984 - DNA, 25 bp, Homo sapien
tgagtgagttattaagcctggcttt

SEQ ID NO: 289985 - DNA, 25 bp, Homo sapien
taagcctggctttgggaaattgata

SEQ ID NO: 289986 - DNA, 25 bp, Homo sapien
aattgatagtccctctctaggtgtc

SEQ ID NO: 289987 - DNA, 25 bp, Homo sapien
gatagtccctctctaggtgtcaata

SEQ ID NO: 289988 - DNA, 25 bp, Homo sapien
cctctctaggtgtcaatattttcat

SEQ ID NO: 289989 - DNA, 25 bp, Homo sapien
gaaatgggtttaatagtactctaag

SEQ ID NO: 289990 - DNA, 25 bp, Homo sapien
cagttgggtaggaaccagaaggcca

SEQ ID NO: 289991 - DNA, 25 bp, Homo sapien
ttgggtaggaaccagaaggccaata

SEQ ID NO: 289992 - DNA, 25 bp, Homo sapien
ggtaggaaccagaaggccaatagga

SEQ ID NO: 289993 - DNA, 25 bp, Homo sapien
ccaataggaaggaggacaaaagtgc

SEQ ID NO: 289994 - DNA, 25 bp, Homo sapien
gattagaattgggtgacagtgatta

SEQ ID NO: 289995 - DNA, 25 bp, Homo sapien
ttgggtgacagtgattagtagtttc

SEQ ID NO: 289996 - DNA, 25 bp, Homo sapien
ggtgacagtgattagtagtttcaga

SEQ ID NO: 289997 - DNA, 25 bp, Homo sapien
gacagtgattagtagtttcagaagt

SEQ ID NO: 289998 - DNA, 25 bp, Homo sapien
acagtgattagtagtttcagaagta

SEQ ID NO: 289999 - DNA, 25 bp, Homo sapien
gtacagaggaagaaggtagactttt

SEQ ID NO: 290000 - DNA, 25 bp, Homo sapien
gacttttaagaagtctgaataagcc

SEQ ID NO: 290001 - DNA, 25 bp, Homo sapien
tccccagtgcttcttttgatgtggt

SEQ ID NO: 290002 - DNA, 25 bp, Homo sapien
agaagggcacgctggatgccctgct

SEQ ID NO: 290003 - DNA, 25 bp, Homo sapien
ggaacgagatccctggaccgtgtcc

SEQ ID NO: 290004 - DNA, 25 bp, Homo sapien
tgtcctctgaaggtgtccacactgt

SEQ ID NO: 290005 - DNA, 25 bp, Homo sapien
tccacactgtggaccaggtgttgag

SEQ ID NO: 290006 - DNA, 25 bp, Homo sapien
cctggaggccggtttatctcaatga

SEQ ID NO: 290007 - DNA, 25 bp, Homo sapien
gtttatctcaatgacttctgctgcc

SEQ ID NO: 290008 - DNA, 25 bp, Homo sapien
agacactatgcccaagcctattatg

SEQ ID NO: 290009 - DNA, 25 bp, Homo sapien
attatggctggtccctgaggcatgc

SEQ ID NO: 290010 - DNA, 25 bp, Homo sapien
aggcatgctacctatggcagcggtt

SEQ ID NO: 290011 - DNA, 25 bp, Homo sapien
atctctacctcatgcacaagggcgg

SEQ ID NO: 290012 - DNA, 25 bp, Homo sapien
gcaggcgaacggtgcctgctaccca

SEQ ID NO: 290013 - DNA, 25 bp, Homo sapien
tgctacccagctggaagccacaagg

SEQ ID NO: 290014 - DNA, 25 bp, Homo sapien
tacccagctggaagccacaaggtgg

SEQ ID NO: 290015 - DNA, 25 bp, Homo sapien
ttggaagttgagtgaagccctcccc

SEQ ID NO: 290016 - DNA, 25 bp, Homo sapien
tgtcctcagcgtgcagccctagagg

SEQ ID NO: 290017 - DNA, 25 bp, Homo sapien
gcgtgcagccctagaggaccccagg

SEQ ID NO: 290018 - DNA, 25 bp, Homo sapien
gcagtggatcctgcgggagtctccc

SEQ ID NO: 290019 - DNA, 25 bp, Homo sapien
acgcgcggtcaaagtgcaatgattt

SEQ ID NO: 290020 - DNA, 25 bp, Homo sapien
gcggtcaaagtgcaatgatttttca

SEQ ID NO: 290021 - DNA, 25 bp, Homo sapien
aagtgcaatgatttttcagttcggt

SEQ ID NO: 290022 - DNA, 25 bp, Homo sapien
caatgatttttcagttcggttggct

SEQ ID NO: 290023 - DNA, 25 bp, Homo sapien
gggcaccatggcgttagtgttcaac

SEQ ID NO: 290024 - DNA, 25 bp, Homo sapien
tagtgttcaactggagagtgggaaa

SEQ ID NO: 290025 - DNA, 25 bp, Homo sapien
gggaaagagatttgcatgtgccacc

SEQ ID NO: 290026 - DNA, 25 bp, Homo sapien
gaacacactgattctcaacattgca

SEQ ID NO: 290027 - DNA, 25 bp, Homo sapien
agacacctgctgtctttgtccctat

SEQ ID NO: 290028 - DNA, 25 bp, Homo sapien
tgtctttgtccctatgtaggtttcc

SEQ ID NO: 290029 - DNA, 25 bp, Homo sapien
tcaggtcagataaaggccttcctct

SEQ ID NO: 290030 - DNA, 25 bp, Homo sapien
agcccctgaaatctgacatgctcag

SEQ ID NO: 290031 - DNA, 25 bp, Homo sapien
aatctgacatgctcagggtcagagc

SEQ ID NO: 290032 - DNA, 25 bp, Homo sapien
gtcagagccatgaaccactgtcttg

SEQ ID NO: 290033 - DNA, 25 bp, Homo sapien
tgtcttgacaaaccccatgtacatg

SEQ ID NO: 290034 - DNA, 25 bp, Homo sapien
gaaactggtccaactgggaagccat

SEQ ID NO: 290035 - DNA, 25 bp, Homo sapien
tgggaagccatgcaaatgctatcaa

SEQ ID NO: 290036 - DNA, 25 bp, Homo sapien
agagcttcattctggaggtttcaga

SEQ ID NO: 290037 - DNA, 25 bp, Homo sapien
aatgccacctttaagggttcatgac

SEQ ID NO: 290038 - DNA, 25 bp, Homo sapien
gggttcatgacaggagattctctat

SEQ ID NO: 290039 - DNA, 25 bp, Homo sapien
gattctctatcagatctaagagctt

SEQ ID NO: 290040 - DNA, 25 bp, Homo sapien
gagcttcatttatcttgtacctatg

SEQ ID NO: 290041 - DNA, 25 bp, Homo sapien
gtacctatgttaattcaccctattt

SEQ ID NO: 290042 - DNA, 25 bp, Homo sapien
ttttctgttaactcaggtctctctc

SEQ ID NO: 290043 - DNA, 25 bp, Homo sapien
tctctctccgtcatttacatagcat

SEQ ID NO: 290044 - DNA, 25 bp, Homo sapien
caccaccattaccttaattttgagt

SEQ ID NO: 290045 - DNA, 25 bp, Homo sapien
aattacatgcccttagaatgtgcat

SEQ ID NO: 290046 - DNA, 25 bp, Homo sapien
catgcccttagaatgtgcatttttt

SEQ ID NO: 290047 - DNA, 25 bp, Homo sapien
taacctattaaatttgccaatcttg

SEQ ID NO: 290048 - DNA, 25 bp, Homo sapien
attcagaaaaagttagcaagccaag

SEQ ID NO: 290049 - DNA, 25 bp, Homo sapien
gcaagccaagatgacattctctgta

SEQ ID NO: 290050 - DNA, 25 bp, Homo sapien
aagatgacattctctgtagcactat

SEQ ID NO: 290051 - DNA, 25 bp, Homo sapien
gacattctctgtagcactattttaa

SEQ ID NO: 290052 - DNA, 25 bp, Homo sapien
aatgaatgatcacataaaactcttt

SEQ ID NO: 290053 - DNA, 25 bp, Homo sapien
gtaattattactctacttcatttgt

SEQ ID NO: 290054 - DNA, 25 bp, Homo sapien
tctaaatcagtgatcattgatgttt

SEQ ID NO: 290055 - DNA, 25 bp, Homo sapien
tgatgtttgaactttttggcttaaa

SEQ ID NO: 290056 - DNA, 25 bp, Homo sapien
agaattcctgttgggaagccagtat

SEQ ID NO: 290057 - DNA, 25 bp, Homo sapien
tcctgttgggaagccagtattgcaa

SEQ ID NO: 290058 - DNA, 25 bp, Homo sapien
gagacatgatagactcccatttaga

SEQ ID NO: 290059 - DNA, 25 bp, Homo sapien
gatagactcccatttagaaattgac

SEQ ID NO: 290060 - DNA, 25 bp, Homo sapien
agaaattgactgtttaatcctaaat

SEQ ID NO: 290061 - DNA, 25 bp, Homo sapien
ttgttacctgttcaaagtttgtcac

SEQ ID NO: 290062 - DNA, 25 bp, Homo sapien
agtttgtcactacccattcttaatt

SEQ ID NO: 290063 - DNA, 25 bp, Homo sapien
cccattcttaatttggagagctcca

SEQ ID NO: 290064 - DNA, 25 bp, Homo sapien
agagctccagcaccaaataaccctt

SEQ ID NO: 290065 - DNA, 25 bp, Homo sapien
atacccattatggtggactggacaa

SEQ ID NO: 290066 - DNA, 25 bp, Homo sapien
gactggacaagtatagaattcctgt

SEQ ID NO: 290067 - DNA, 25 bp, Homo sapien
gaagtgatggcaactctatccgaac

SEQ ID NO: 290068 - DNA, 25 bp, Homo sapien
ctatccgaactcaaatctgccagac

SEQ ID NO: 290069 - DNA, 25 bp, Homo sapien
aaatctgccagacctataccagtag

SEQ ID NO: 290070 - DNA, 25 bp, Homo sapien
tataccagtaggtgcctgtgtgcag

SEQ ID NO: 290071 - DNA, 25 bp, Homo sapien
gggaagccattaggtgtgctccgct

SEQ ID NO: 290072 - DNA, 25 bp, Homo sapien
gccagtgctggcatgagctagctgt

SEQ ID NO: 290073 - DNA, 25 bp, Homo sapien
gagctagctgtcttgaactgaaaac

SEQ ID NO: 290074 - DNA, 25 bp, Homo sapien
gaggtggcagaatggtcaaagctat

SEQ ID NO: 290075 - DNA, 25 bp, Homo sapien
aagctatgaagccaacagctgctgc

SEQ ID NO: 290076 - DNA, 25 bp, Homo sapien
gggctctaatggcatattaacgcgt

SEQ ID NO: 290077 - DNA, 25 bp, Homo sapien
tattaacgcgtgcagctccagacag

SEQ ID NO: 290078 - DNA, 25 bp, Homo sapien
tctgcaggagcctcttgcctccagg

SEQ ID NO: 290079 - DNA, 25 bp, Homo sapien
gacgtcctccaggaagtagtagata

SEQ ID NO: 290080 - DNA, 25 bp, Homo sapien
gaagtagtagatatggcccaccgca

SEQ ID NO: 290081 - DNA, 25 bp, Homo sapien
aatccccagcaggtccacgaggatg

SEQ ID NO: 290082 - DNA, 25 bp, Homo sapien
tccacgaggatggagttgcccagca

SEQ ID NO: 290083 - DNA, 25 bp, Homo sapien
agcgagaagcccatgagcgcccaag

SEQ ID NO: 290084 - DNA, 25 bp, Homo sapien
catgagcgcccaaggcaggaacggt

SEQ ID NO: 290085 - DNA, 25 bp, Homo sapien
agcaggccgaagaagttgaccctca

SEQ ID NO: 290086 - DNA, 25 bp, Homo sapien
cgaagaagttgaccctcacccgagg

SEQ ID NO: 290087 - DNA, 25 bp, Homo sapien
acacgtacaccagcatggccatgag

SEQ ID NO: 290088 - DNA, 25 bp, Homo sapien
gtacaccagcatggccatgagggcc

SEQ ID NO: 290089 - DNA, 25 bp, Homo sapien
gaagttccctgtgagcaatctgtgt

SEQ ID NO: 290090 - DNA, 25 bp, Homo sapien
ccctgtgagcaatctgtgtgtcttc

SEQ ID NO: 290091 - DNA, 25 bp, Homo sapien
ctgtgtgtcttcagcgagcttgaac

SEQ ID NO: 290092 - DNA, 25 bp, Homo sapien
agcgagcttgaaccaaagtcttcat

SEQ ID NO: 290093 - DNA, 25 bp, Homo sapien
aaagtcttcatatcctgacccactg

SEQ ID NO: 290094 - DNA, 25 bp, Homo sapien
atcctgacccactgaattataagca

SEQ ID NO: 290095 - DNA, 25 bp, Homo sapien
aagcaattgctacttgcccatcttg

SEQ ID NO: 290096 - DNA, 25 bp, Homo sapien
gcccatcttgccaaagtagtccaaa

SEQ ID NO: 290097 - DNA, 25 bp, Homo sapien
gtagtccaaacacacttcaatgagg

SEQ ID NO: 290098 - DNA, 25 bp, Homo sapien
aacacacttcaatgaggacagttat

SEQ ID NO: 290099 - DNA, 25 bp, Homo sapien
gacagttatatttagcaggtcctca

SEQ ID NO: 290100 - DNA, 25 bp, Homo sapien
ctaagttcagtgtacaagggtgcat

SEQ ID NO: 290101 - DNA, 25 bp, Homo sapien
gtacaagggtgcatggactcttcct

SEQ ID NO: 290102 - DNA, 25 bp, Homo sapien
aagggtgcatggactcttcctgaaa

SEQ ID NO: 290103 - DNA, 25 bp, Homo sapien
gggtgcatggactcttcctgaaaga

SEQ ID NO: 290104 - DNA, 25 bp, Homo sapien
gtgcatggactcttcctgaaagaaa

SEQ ID NO: 290105 - DNA, 25 bp, Homo sapien
ggactcttcctgaaagaaattacta

SEQ ID NO: 290106 - DNA, 25 bp, Homo sapien
gagattaatctactgaagatcttaa

SEQ ID NO: 290107 - DNA, 25 bp, Homo sapien
gcttaaatatcaaagggcaaatgga

SEQ ID NO: 290108 - DNA, 25 bp, Homo sapien
aatggaacatttttacgatcaccta

SEQ ID NO: 290109 - DNA, 25 bp, Homo sapien
tggaacatttttacgatcacctaaa

SEQ ID NO: 290110 - DNA, 25 bp, Homo sapien
tttacgatcacctaaaattcttgaa

SEQ ID NO: 290111 - DNA, 25 bp, Homo sapien
gcggctcgaggactccgcttccttc

SEQ ID NO: 290112 - DNA, 25 bp, Homo sapien
tgcctgccagctagccggagccgcg

SEQ ID NO: 290113 - DNA, 25 bp, Homo sapien
tgaggcgagggctgcctcttgttct

SEQ ID NO: 290114 - DNA, 25 bp, Homo sapien
gaggcgagggctgcctcttgttctc

SEQ ID NO: 290115 - DNA, 25 bp, Homo sapien
ggcgagggctgcctcttgttctccc

SEQ ID NO: 290116 - DNA, 25 bp, Homo sapien
gcgagggctgcctcttgttctcccg

SEQ ID NO: 290117 - DNA, 25 bp, Homo sapien
gctgccgccgtctcctggtcgggtg

SEQ ID NO: 290118 - DNA, 25 bp, Homo sapien
gcgggaggcacgttccttagctccg

SEQ ID NO: 290119 - DNA, 25 bp, Homo sapien
cgggaggcacgttccttagctccgc

SEQ ID NO: 290120 - DNA, 25 bp, Homo sapien
gggaggcacgttccttagctccgcc

SEQ ID NO: 290121 - DNA, 25 bp, Homo sapien
ggaggcacgttccttagctccgccg

SEQ ID NO: 290122 - DNA, 25 bp, Homo sapien
tcaccttactttggctcgagaccct

SEQ ID NO: 290123 - DNA, 25 bp, Homo sapien
agtatcttagaacttgattatttaa

SEQ ID NO: 290124 - DNA, 25 bp, Homo sapien
taatatccctttcttacaatatatg

SEQ ID NO: 290125 - DNA, 25 bp, Homo sapien
ccctttcttacaatatatgttccaa

SEQ ID NO: 290126 - DNA, 25 bp, Homo sapien
tgttcaggaggcagagcagttcttt

SEQ ID NO: 290127 - DNA, 25 bp, Homo sapien
ggaggcagagcagttctttaccatc

SEQ ID NO: 290128 - DNA, 25 bp, Homo sapien
ggcagagcagttctttaccatcaat

SEQ ID NO: 290129 - DNA, 25 bp, Homo sapien
gagcagttctttaccatcaattgtg

SEQ ID NO: 290130 - DNA, 25 bp, Homo sapien
gcagttctttaccatcaattgtgat

SEQ ID NO: 290131 - DNA, 25 bp, Homo sapien
taccatcaattgtgataggcacggg

SEQ ID NO: 290132 - DNA, 25 bp, Homo sapien
gaaccaggctgagagaatgaagtgc

SEQ ID NO: 290133 - DNA, 25 bp, Homo sapien
atggcttttgattagccttaggata

SEQ ID NO: 290134 - DNA, 25 bp, Homo sapien
taggataaaaatcccgtcctgccgc

SEQ ID NO: 290135 - DNA, 25 bp, Homo sapien
gacttgtccatcttgtgggtagcca

SEQ ID NO: 290136 - DNA, 25 bp, Homo sapien
atcacctcccattaggaccactatg

SEQ ID NO: 290137 - DNA, 25 bp, Homo sapien
ctcagtgtccttcccagacatgctg

SEQ ID NO: 290138 - DNA, 25 bp, Homo sapien
tcagatccccgttttgcttagttac

SEQ ID NO: 290139 - DNA, 25 bp, Homo sapien
ttttgcttagttacttcctcctcat

SEQ ID NO: 290140 - DNA, 25 bp, Homo sapien
ggtctcaaagtagttgtcccttcac

SEQ ID NO: 290141 - DNA, 25 bp, Homo sapien
cattaggaccactatgcccttttaa

SEQ ID NO: 290142 - DNA, 25 bp, Homo sapien
attatgacacccttctgcatacaac

SEQ ID NO: 290143 - DNA, 25 bp, Homo sapien
gcatacaactattcaatggcttttg

SEQ ID NO: 290144 - DNA, 25 bp, Homo sapien
gtttgcacatatccacattgaccag

SEQ ID NO: 290145 - DNA, 25 bp, Homo sapien
gtcacactgcgattatctgggtcat

SEQ ID NO: 290146 - DNA, 25 bp, Homo sapien
aataggtcattagcagtacttgtag

SEQ ID NO: 290147 - DNA, 25 bp, Homo sapien
gtacttgtagtatcgcgtctgtcta

SEQ ID NO: 290148 - DNA, 25 bp, Homo sapien
tcgcgtctgtctaaaaatcctccaa

SEQ ID NO: 290149 - DNA, 25 bp, Homo sapien
aatcctccaacaccgagtgactttt

SEQ ID NO: 290150 - DNA, 25 bp, Homo sapien
taaccccagggacgcttattagaca

SEQ ID NO: 290151 - DNA, 25 bp, Homo sapien
gcttattagacatgcagactccggg

SEQ ID NO: 290152 - DNA, 25 bp, Homo sapien
aaaggagtcctacttgaattctcaa

SEQ ID NO: 290153 - DNA, 25 bp, Homo sapien
aatgacaaagttgcttcctctctac

SEQ ID NO: 290154 - DNA, 25 bp, Homo sapien
tctacccaagatcaggagcttccct

SEQ ID NO: 290155 - DNA, 25 bp, Homo sapien
gccagctcactgcttacagcatgaa

SEQ ID NO: 290156 - DNA, 25 bp, Homo sapien
tactgttgagtttgtcatgcctatg

SEQ ID NO: 290157 - DNA, 25 bp, Homo sapien
gtcatgcctatgttcctacatagtg

SEQ ID NO: 290158 - DNA, 25 bp, Homo sapien
gtgtttgatgaccaggttgtctgta

SEQ ID NO: 290159 - DNA, 25 bp, Homo sapien
gtctgtagagtcaccataaaacctt

SEQ ID NO: 290160 - DNA, 25 bp, Homo sapien
gttactcagttttctcataggtaga

SEQ ID NO: 290161 - DNA, 25 bp, Homo sapien
gaatgcatcatttacttgttaagtg

SEQ ID NO: 290162 - DNA, 25 bp, Homo sapien
tacttgttaagtgaacccctgttct

SEQ ID NO: 290163 - DNA, 25 bp, Homo sapien
agtgaacccctgttctgatctcatt

SEQ ID NO: 290164 - DNA, 25 bp, Homo sapien
gatctcattagcctcctaacaatta

SEQ ID NO: 290165 - DNA, 25 bp, Homo sapien
atgtatttttgccaaagccagctca

SEQ ID NO: 290166 - DNA, 25 bp, Homo sapien
agcagtcagcttcctaagtgtttta

SEQ ID NO: 290167 - DNA, 25 bp, Homo sapien
tcttacgtgggagacttttccactt

SEQ ID NO: 290168 - DNA, 25 bp, Homo sapien
atattttccgtcatataactagagg

SEQ ID NO: 290169 - DNA, 25 bp, Homo sapien
gataagtgccgaattcaaacccttc

SEQ ID NO: 290170 - DNA, 25 bp, Homo sapien
gccgaattcaaacccttcattttat

SEQ ID NO: 290171 - DNA, 25 bp, Homo sapien
gtttaagctcctgaatctgcattcc

SEQ ID NO: 290172 - DNA, 25 bp, Homo sapien
gaatctgcattccacttgggttgtt

SEQ ID NO: 290173 - DNA, 25 bp, Homo sapien
tgcattccacttgggttgtttttaa

SEQ ID NO: 290174 - DNA, 25 bp, Homo sapien
ataagttagatttcacagaatcagt

SEQ ID NO: 290175 - DNA, 25 bp, Homo sapien
gaatgtgtgcttattctcagaaggt

SEQ ID NO: 290176 - DNA, 25 bp, Homo sapien
cttattctcagaaggttcattaact

SEQ ID NO: 290177 - DNA, 25 bp, Homo sapien
ctcctgtgttgcagggaccacataa

SEQ ID NO: 290178 - DNA, 25 bp, Homo sapien
gttgcagggaccacataactgtcac

SEQ ID NO: 290179 - DNA, 25 bp, Homo sapien
ataactgtcaccatgtccggctagt

SEQ ID NO: 290180 - DNA, 25 bp, Homo sapien
accatgtccggctagttttttgatt

SEQ ID NO: 290181 - DNA, 25 bp, Homo sapien
aggtgtaggactgtttgttagttca

SEQ ID NO: 290182 - DNA, 25 bp, Homo sapien
gactgtttgttagttcattctccta

SEQ ID NO: 290183 - DNA, 25 bp, Homo sapien
gttagttcattctcctattgaagga

SEQ ID NO: 290184 - DNA, 25 bp, Homo sapien
gttcattctcctattgaaggacatg

SEQ ID NO: 290185 - DNA, 25 bp, Homo sapien
gaaggacatgtaattggttttgggt

SEQ ID NO: 290186 - DNA, 25 bp, Homo sapien
cacccaggctgtatacagtgacctg

SEQ ID NO: 290187 - DNA, 25 bp, Homo sapien
tacagtgacctgatgttggctcact

SEQ ID NO: 290188 - DNA, 25 bp, Homo sapien
taactatagacttttaccaatgggt

SEQ ID NO: 290189 - DNA, 25 bp, Homo sapien
gacttttaccaatgggtagctataa

SEQ ID NO: 290190 - DNA, 25 bp, Homo sapien
aaatctttttactgagagatcatta

SEQ ID NO: 290191 - DNA, 25 bp, Homo sapien
aagttggttaggatcatatcttcac

SEQ ID NO: 290192 - DNA, 25 bp, Homo sapien
atatcttcacatatggccctttctg

SEQ ID NO: 290193 - DNA, 25 bp, Homo sapien
atcttcacatatggccctttctgaa

SEQ ID NO: 290194 - DNA, 25 bp, Homo sapien
cacatatggccctttctgaatcaaa

SEQ ID NO: 290195 - DNA, 25 bp, Homo sapien
tatggccctttctgaatcaaagtgc

SEQ ID NO: 290196 - DNA, 25 bp, Homo sapien
gccctttctgaatcaaagtgcggca

SEQ ID NO: 290197 - DNA, 25 bp, Homo sapien
ttctgaatcaaagtgcggcaaagta

SEQ ID NO: 290198 - DNA, 25 bp, Homo sapien
gtgcggcaaagtaaatattgtctaa

SEQ ID NO: 290199 - DNA, 25 bp, Homo sapien
gtaaggatcccaaacaataaaagct

SEQ ID NO: 290200 - DNA, 25 bp, Homo sapien
taaaagctggacttgcctgttgcca

SEQ ID NO: 290201 - DNA, 25 bp, Homo sapien
ttgcctgttgccactagtccattat

SEQ ID NO: 290202 - DNA, 25 bp, Homo sapien
actagtccattatcccaaaccgtgg

SEQ ID NO: 290203 - DNA, 25 bp, Homo sapien
aaaccgtgggtaggccgcttgtcat

SEQ ID NO: 290204 - DNA, 25 bp, Homo sapien
tgggtaggccgcttgtcatctgcct

SEQ ID NO: 290205 - DNA, 25 bp, Homo sapien
gtcatctgcctctctatgacagaaa

SEQ ID NO: 290206 - DNA, 25 bp, Homo sapien
tgtatgtgccacttcagctttttaa

SEQ ID NO: 290207 - DNA, 25 bp, Homo sapien
aacagtgtaggtacttatgatacta

SEQ ID NO: 290208 - DNA, 25 bp, Homo sapien
tatgacagtagaggaagcctgctgc

SEQ ID NO: 290209 - DNA, 25 bp, Homo sapien
tgctgcttctcagtaaggatcccaa

SEQ ID NO: 290210 - DNA, 25 bp, Homo sapien
ggctcacattctcacctagcaacaa

SEQ ID NO: 290211 - DNA, 25 bp, Homo sapien
tcacattctcacctagcaacaactg

SEQ ID NO: 290212 - DNA, 25 bp, Homo sapien
cacattctcacctagcaacaactgg

SEQ ID NO: 290213 - DNA, 25 bp, Homo sapien
acattctcacctagcaacaactggc

SEQ ID NO: 290214 - DNA, 25 bp, Homo sapien
attctcacctagcaacaactggctg

SEQ ID NO: 290215 - DNA, 25 bp, Homo sapien
ttctcacctagcaacaactggctgg

SEQ ID NO: 290216 - DNA, 25 bp, Homo sapien
tctcacctagcaacaactggctgga

SEQ ID NO: 290217 - DNA, 25 bp, Homo sapien
tcacctagcaacaactggctggagc

SEQ ID NO: 290218 - DNA, 25 bp, Homo sapien
agctctgcctttagaaggggtgtcc

SEQ ID NO: 290219 - DNA, 25 bp, Homo sapien
gggtgtccacttcaccaggtcacca

SEQ ID NO: 290220 - DNA, 25 bp, Homo sapien
tgtccacttcaccaggtcaccacag

SEQ ID NO: 290221 - DNA, 25 bp, Homo sapien
gatcagttcaagaaggtaatccaag

SEQ ID NO: 290222 - DNA, 25 bp, Homo sapien
taatccaagggcctgatgactcttt

SEQ ID NO: 290223 - DNA, 25 bp, Homo sapien
gggcctgatgactcttttggtaacc

SEQ ID NO: 290224 - DNA, 25 bp, Homo sapien
tttggtaaccagacaccaatcaaat

SEQ ID NO: 290225 - DNA, 25 bp, Homo sapien
tgtgcctttaggaactgcccagaag

SEQ ID NO: 290226 - DNA, 25 bp, Homo sapien
caaggctttagccaggagcggaaac

SEQ ID NO: 290227 - DNA, 25 bp, Homo sapien
gagcggaaactgactaccatgtaat

SEQ ID NO: 290228 - DNA, 25 bp, Homo sapien
aaaattgggcattccatgctatttt

SEQ ID NO: 290229 - DNA, 25 bp, Homo sapien
gggcattccatgctatttttaatac

SEQ ID NO: 290230 - DNA, 25 bp, Homo sapien
tttttaatacctggattgctgattt

SEQ ID NO: 290231 - DNA, 25 bp, Homo sapien
gtcttgacttgcgatctagaagatc

SEQ ID NO: 290232 - DNA, 25 bp, Homo sapien
aaagatgctcatcctagtgacagac

SEQ ID NO: 290233 - DNA, 25 bp, Homo sapien
gatgctcatcctagtgacagaccaa

SEQ ID NO: 290234 - DNA, 25 bp, Homo sapien
atcctagtgacagaccaagagacaa

SEQ ID NO: 290235 - DNA, 25 bp, Homo sapien
agaccaagagacaatacaacccaaa

SEQ ID NO: 290236 - DNA, 25 bp, Homo sapien
agagacaatacaacccaaattggac

SEQ ID NO: 290237 - DNA, 25 bp, Homo sapien
aaattggacaattaaggtgccgtga

SEQ ID NO: 290238 - DNA, 25 bp, Homo sapien
aattaaggtgccgtgattccctaca

SEQ ID NO: 290239 - DNA, 25 bp, Homo sapien
aaggtgccgtgattccctacaagta

SEQ ID NO: 290240 - DNA, 25 bp, Homo sapien
tgccgtgattccctacaagtattgc

SEQ ID NO: 290241 - DNA, 25 bp, Homo sapien
gtgattccctacaagtattgcttta

SEQ ID NO: 290242 - DNA, 25 bp, Homo sapien
caagtattgctttattcccttctgt

SEQ ID NO: 290243 - DNA, 25 bp, Homo sapien
ttacctttagaaccctcaaacatag

SEQ ID NO: 290244 - DNA, 25 bp, Homo sapien
gaaccctcaaacatagcttggtatt

SEQ ID NO: 290245 - DNA, 25 bp, Homo sapien
aacatagcttggtattgctgttttt

SEQ ID NO: 290246 - DNA, 25 bp, Homo sapien
ttctggagcatttaggattcactta

SEQ ID NO: 290247 - DNA, 25 bp, Homo sapien
ttcacttagaaacaagcctttaggg

SEQ ID NO: 290248 - DNA, 25 bp, Homo sapien
ttttttgcactgactacttctattt

SEQ ID NO: 290249 - DNA, 25 bp, Homo sapien
ttgcactgactacttctatttttcc

SEQ ID NO: 290250 - DNA, 25 bp, Homo sapien
ctttcatttccctagacttttcaat

SEQ ID NO: 290251 - DNA, 25 bp, Homo sapien
tccctagacttttcaatgctttttt

SEQ ID NO: 290252 - DNA, 25 bp, Homo sapien
gagggagtacatgtctttgtccttt

SEQ ID NO: 290253 - DNA, 25 bp, Homo sapien
acatgtctttgtcctttacctttag

SEQ ID NO: 290254 - DNA, 25 bp, Homo sapien
tttgtatatgtttgattgctatctt

SEQ ID NO: 290255 - DNA, 25 bp, Homo sapien
atatgtttgattgctatctttaaag

SEQ ID NO: 290256 - DNA, 25 bp, Homo sapien
aagttgtgtacataataattctaaa

SEQ ID NO: 290257 - DNA, 25 bp, Homo sapien
gacagtgttctattttgcatcctgt

SEQ ID NO: 290258 - DNA, 25 bp, Homo sapien
agtgttctattttgcatcctgtatc

SEQ ID NO: 290259 - DNA, 25 bp, Homo sapien
gttctattttgcatcctgtatctta

SEQ ID NO: 290260 - DNA, 25 bp, Homo sapien
tctattttgcatcctgtatcttatg

SEQ ID NO: 290261 - DNA, 25 bp, Homo sapien
gtcaacgattaagccaactaattct

SEQ ID NO: 290262 - DNA, 25 bp, Homo sapien
taagccaactaattctctaccatat

SEQ ID NO: 290263 - DNA, 25 bp, Homo sapien
gccaactaattctctaccatatata

SEQ ID NO: 290264 - DNA, 25 bp, Homo sapien
actaattctctaccatatataactt

SEQ ID NO: 290265 - DNA, 25 bp, Homo sapien
gcagcactaacaccagaataacact

SEQ ID NO: 290266 - DNA, 25 bp, Homo sapien
cagaataacactgatgttgccatca

SEQ ID NO: 290267 - DNA, 25 bp, Homo sapien
gatgttgccatcagcagtcacacga

SEQ ID NO: 290268 - DNA, 25 bp, Homo sapien
tgccatcagcagtcacacgactgaa

SEQ ID NO: 290269 - DNA, 25 bp, Homo sapien
cgactgaaacatgaggactgccctg

SEQ ID NO: 290270 - DNA, 25 bp, Homo sapien
gcagcctgctgatctaacggccgcg

SEQ ID NO: 290271 - DNA, 25 bp, Homo sapien
gcgcccgcgtctgttgcttgagtca

SEQ ID NO: 290272 - DNA, 25 bp, Homo sapien
gtctgttgcttgagtcaccacggct

SEQ ID NO: 290273 - DNA, 25 bp, Homo sapien
gcttgagtcaccacggctgttacat

SEQ ID NO: 290274 - DNA, 25 bp, Homo sapien
agtcaccacggctgttacatcccgt

SEQ ID NO: 290275 - DNA, 25 bp, Homo sapien
atcaactcagctggcagcactaaca

SEQ ID NO: 290276 - DNA, 25 bp, Homo sapien
caactgtaacaggagaccatttatt

SEQ ID NO: 290277 - DNA, 25 bp, Homo sapien
gaccatttattataagcgtacctgt

SEQ ID NO: 290278 - DNA, 25 bp, Homo sapien
aagcgtacctgtttgtgaacttaat

SEQ ID NO: 290279 - DNA, 25 bp, Homo sapien
gctgtttttgcttaggtgatccact

SEQ ID NO: 290280 - DNA, 25 bp, Homo sapien
gtgatccactgccatgtgatccata

SEQ ID NO: 290281 - DNA, 25 bp, Homo sapien
gtgatccataatttttctacataaa

SEQ ID NO: 290282 - DNA, 25 bp, Homo sapien
atacagttatgcattcatttcaaca

SEQ ID NO: 290283 - DNA, 25 bp, Homo sapien
ctacttgttaatatattcggcccat

SEQ ID NO: 290284 - DNA, 25 bp, Homo sapien
attcggcccatattttgtgtgtttg

SEQ ID NO: 290285 - DNA, 25 bp, Homo sapien
tgtgtttggacaagtacatctccct

SEQ ID NO: 290286 - DNA, 25 bp, Homo sapien
tctcccttttgcctaatgaactttt

SEQ ID NO: 290287 - DNA, 25 bp, Homo sapien
agccagcagtcacactgcccagatt

SEQ ID NO: 290288 - DNA, 25 bp, Homo sapien
agtcacactgcccagatttctttct

SEQ ID NO: 290289 - DNA, 25 bp, Homo sapien
ggccagctgcccgatactgagttgg

SEQ ID NO: 290290 - DNA, 25 bp, Homo sapien
ctgagttgggctacacagagcagct

SEQ ID NO: 290291 - DNA, 25 bp, Homo sapien
acagagcagctgttccagttcctgc

SEQ ID NO: 290292 - DNA, 25 bp, Homo sapien
ggatcttcgagtgtgcggacccaaa

SEQ ID NO: 290293 - DNA, 25 bp, Homo sapien
agtgtgcggacccaaagctcgccat

SEQ ID NO: 290294 - DNA, 25 bp, Homo sapien
aaagctcgccatcagtgctgtctgg

SEQ ID NO: 290295 - DNA, 25 bp, Homo sapien
atcagtgctgtctggaccttcagag

SEQ ID NO: 290296 - DNA, 25 bp, Homo sapien
tgtctggaccttcagagacctaggg

SEQ ID NO: 290297 - DNA, 25 bp, Homo sapien
gttctgcagcagacgccgagccctg

SEQ ID NO: 290298 - DNA, 25 bp, Homo sapien
gtaatccaagctaaatgggcaacca

SEQ ID NO: 290299 - DNA, 25 bp, Homo sapien
gggcaaccagaagtaatatctgcta

SEQ ID NO: 290300 - DNA, 25 bp, Homo sapien
atatctgctagggtgcaatccatca

SEQ ID NO: 290301 - DNA, 25 bp, Homo sapien
ctgctagggtgcaatccatcagcat

SEQ ID NO: 290302 - DNA, 25 bp, Homo sapien
ggttcagtgcatatacataagtaaa

SEQ ID NO: 290303 - DNA, 25 bp, Homo sapien
gctagttaaagattaccattttagg

SEQ ID NO: 290304 - DNA, 25 bp, Homo sapien
ttttaaacttttcagtgcaagaatg

SEQ ID NO: 290305 - DNA, 25 bp, Homo sapien
gtttgaaagccttgttaagctcata

SEQ ID NO: 290306 - DNA, 25 bp, Homo sapien
gccttgttaagctcataaaagtttc

SEQ ID NO: 290307 - DNA, 25 bp, Homo sapien
aaagtttcatttaaacactgtagag

SEQ ID NO: 290308 - DNA, 25 bp, Homo sapien
taaacactgtagagtttcctacctt

SEQ ID NO: 290309 - DNA, 25 bp, Homo sapien
tgaagtcttactgcaacatctctaa

SEQ ID NO: 290310 - DNA, 25 bp, Homo sapien
acatctctaagtttggacttttctt

SEQ ID NO: 290311 - DNA, 25 bp, Homo sapien
ttggtacttcttgtgactgtttcta

SEQ ID NO: 290312 - DNA, 25 bp, Homo sapien
actgtttctagtgctcatgtctttt

SEQ ID NO: 290313 - DNA, 25 bp, Homo sapien
gtgctcatgtcttttattaattctg

SEQ ID NO: 290314 - DNA, 25 bp, Homo sapien
aaacttagccatgatctgttcaaat

SEQ ID NO: 290315 - DNA, 25 bp, Homo sapien
ttgtgggtaatctgtcttttctctc

SEQ ID NO: 290316 - DNA, 25 bp, Homo sapien
tgtcttttctctctgcaagcttaag

SEQ ID NO: 290317 - DNA, 25 bp, Homo sapien
ctgcaagcttaagatttttctctgt

SEQ ID NO: 290318 - DNA, 25 bp, Homo sapien
tttctctgtatcctggaccttttga

SEQ ID NO: 290319 - DNA, 25 bp, Homo sapien
ggaccttttgaagtcttactgcaac

SEQ ID NO: 290320 - DNA, 25 bp, Homo sapien
cacagtgtggctgagcgtcaagagt

SEQ ID NO: 290321 - DNA, 25 bp, Homo sapien
tggctgagcgtcaagagtccccaca

SEQ ID NO: 290322 - DNA, 25 bp, Homo sapien
agagtccccacactcaaaggaggca

SEQ ID NO: 290323 - DNA, 25 bp, Homo sapien
ggcagcagatacagggctgcacact

SEQ ID NO: 290324 - DNA, 25 bp, Homo sapien
gtgattccacacatgtgacattctg

SEQ ID NO: 290325 - DNA, 25 bp, Homo sapien
tgacattctggacacggacatgctg

SEQ ID NO: 290326 - DNA, 25 bp, Homo sapien
ttctggacacggacatgctggatgg

SEQ ID NO: 290327 - DNA, 25 bp, Homo sapien
atggcaaaacgagcatcgggctgag

SEQ ID NO: 290328 - DNA, 25 bp, Homo sapien
catcgggctgagaggactgctgaga

SEQ ID NO: 290329 - DNA, 25 bp, Homo sapien
gctgctgggatgtgggttgattgta

SEQ ID NO: 290330 - DNA, 25 bp, Homo sapien
gcagtagctcatggagatgtgacct

SEQ ID NO: 290331 - DNA, 25 bp, Homo sapien
ttagattatatttatgtttactcat

SEQ ID NO: 290332 - DNA, 25 bp, Homo sapien
ataatctttacatagtgaactttgg

SEQ ID NO: 290333 - DNA, 25 bp, Homo sapien
tacatagtgaactttggtggcgtta

SEQ ID NO: 290334 - DNA, 25 bp, Homo sapien
gtgaactttggtggcgttagtgata

SEQ ID NO: 290335 - DNA, 25 bp, Homo sapien
ctttggtggcgttagtgatatgttt

SEQ ID NO: 290336 - DNA, 25 bp, Homo sapien
ggcgttagtgatatgtttatgccta

SEQ ID NO: 290337 - DNA, 25 bp, Homo sapien
gtgatatgtttatgcctatttcttt

SEQ ID NO: 290338 - DNA, 25 bp, Homo sapien
gggatttaattattcagagcttaaa

SEQ ID NO: 290339 - DNA, 25 bp, Homo sapien
gtttatacactgtaaagctatctgt

SEQ ID NO: 290340 - DNA, 25 bp, Homo sapien
tacactgtaaagctatctgttttat

SEQ ID NO: 290341 - DNA, 25 bp, Homo sapien
tgtaaagctatctgttttatgcatt

SEQ ID NO: 290342 - DNA, 25 bp, Homo sapien
gggtaccagcacttagcttctctct

SEQ ID NO: 290343 - DNA, 25 bp, Homo sapien
ggtaccagcacttagcttctctctg

SEQ ID NO: 290344 - DNA, 25 bp, Homo sapien
gtaccagcacttagcttctctctga

SEQ ID NO: 290345 - DNA, 25 bp, Homo sapien
ttctctctgagtgctggctcccaag

SEQ ID NO: 290346 - DNA, 25 bp, Homo sapien
tctctctgagtgctggctcccaagg

SEQ ID NO: 290347 - DNA, 25 bp, Homo sapien
ctctctgagtgctggctcccaagga

SEQ ID NO: 290348 - DNA, 25 bp, Homo sapien
tctctgagtgctggctcccaaggaa

SEQ ID NO: 290349 - DNA, 25 bp, Homo sapien
gtgctggctcccaaggaagggacct

SEQ ID NO: 290350 - DNA, 25 bp, Homo sapien
tgctggctcccaaggaagggacctg

SEQ ID NO: 290351 - DNA, 25 bp, Homo sapien
ctcttcagaaggaagcatcttccac

SEQ ID NO: 290352 - DNA, 25 bp, Homo sapien
cttcagaaggaagcatcttccacag

SEQ ID NO: 290353 - DNA, 25 bp, Homo sapien
taacctgatggctcccggaggaggt

SEQ ID NO: 290354 - DNA, 25 bp, Homo sapien
gctcccggaggaggtggtattaatc

SEQ ID NO: 290355 - DNA, 25 bp, Homo sapien
tactgtatcctacacgaggctactt

SEQ ID NO: 290356 - DNA, 25 bp, Homo sapien
tggtattaatccttagcatcagggc

SEQ ID NO: 290357 - DNA, 25 bp, Homo sapien
gactctttccctagggtacatagct

SEQ ID NO: 290358 - DNA, 25 bp, Homo sapien
agggtacatagctcacaggatagat

SEQ ID NO: 290359 - DNA, 25 bp, Homo sapien
tacacgaggctactttggtgctgta

SEQ ID NO: 290360 - DNA, 25 bp, Homo sapien
cgaggctactttggtgctgtaggtt

SEQ ID NO: 290361 - DNA, 25 bp, Homo sapien
ttgggaacagttgcagagggctttt

SEQ ID NO: 290362 - DNA, 25 bp, Homo sapien
gagggcttttaatacctaacagcat

SEQ ID NO: 290363 - DNA, 25 bp, Homo sapien
taatacctaacagcatgcaagtgtc

SEQ ID NO: 290364 - DNA, 25 bp, Homo sapien
tcattttaaaccagtgaacccaagg

SEQ ID NO: 290365 - DNA, 25 bp, Homo sapien
gaacccaaggctgagtgtttcatca

SEQ ID NO: 290366 - DNA, 25 bp, Homo sapien
ggctgagtgtttcatcaatttacag

SEQ ID NO: 290367 - DNA, 25 bp, Homo sapien
tgacagctatcccagtgtatgactt

SEQ ID NO: 290368 - DNA, 25 bp, Homo sapien
ccagtgtatgacttaccatggagat

SEQ ID NO: 290369 - DNA, 25 bp, Homo sapien
ggagatcttcaaatagaatcacttt

SEQ ID NO: 290370 - DNA, 25 bp, Homo sapien
gaatcactttggtttgggtctcatt

SEQ ID NO: 290371 - DNA, 25 bp, Homo sapien
ggtttgggtctcattttcatattat

SEQ ID NO: 290372 - DNA, 25 bp, Homo sapien
catatttgataggaactgctgggaa

SEQ ID NO: 290373 - DNA, 25 bp, Homo sapien
gaattcttgcagttatatcctcaaa

SEQ ID NO: 290374 - DNA, 25 bp, Homo sapien
gcagttatatcctcaaaagacaaaa

SEQ ID NO: 290375 - DNA, 25 bp, Homo sapien
agcagtgggctcatgcccatctgca

SEQ ID NO: 290376 - DNA, 25 bp, Homo sapien
tgggctcatgcccatctgcacaagg

SEQ ID NO: 290377 - DNA, 25 bp, Homo sapien
gaacacaaatgcctcacacatcagc

SEQ ID NO: 290378 - DNA, 25 bp, Homo sapien
gcacatgcaggctaacaagggcact

SEQ ID NO: 290379 - DNA, 25 bp, Homo sapien
gctaacaagggcactgactctggaa

SEQ ID NO: 290380 - DNA, 25 bp, Homo sapien
tttacttaagactcccagcgtgatt

SEQ ID NO: 290381 - DNA, 25 bp, Homo sapien
cttaagactcccagcgtgattatga

SEQ ID NO: 290382 - DNA, 25 bp, Homo sapien
gcgtgattatgagaactggccttat

SEQ ID NO: 290383 - DNA, 25 bp, Homo sapien
gagaactggccttattttcacacag

SEQ ID NO: 290384 - DNA, 25 bp, Homo sapien
tggccttattttcacacaggttgaa

SEQ ID NO: 290385 - DNA, 25 bp, Homo sapien
tcacacaggttgaaaatgaagcagt

SEQ ID NO: 290386 - DNA, 25 bp, Homo sapien
cccctttccaggattctgaatgtac

SEQ ID NO: 290387 - DNA, 25 bp, Homo sapien
gaaatttacattcaagagtgtacta

SEQ ID NO: 290388 - DNA, 25 bp, Homo sapien
gagtgtactatacttgttcttctat

SEQ ID NO: 290389 - DNA, 25 bp, Homo sapien
atacttgttcttctataacatcaga

SEQ ID NO: 290390 - DNA, 25 bp, Homo sapien
ataggtttttactcagatgtcttca

SEQ ID NO: 290391 - DNA, 25 bp, Homo sapien
tactcagatgtcttcatgtcggtaa

SEQ ID NO: 290392 - DNA, 25 bp, Homo sapien
gatgtcttcatgtcggtaattatag

SEQ ID NO: 290393 - DNA, 25 bp, Homo sapien
atgtagatttaacaggttcctcatt

SEQ ID NO: 290394 - DNA, 25 bp, Homo sapien
aacaggttcctcattgataaaacaa

SEQ ID NO: 290395 - DNA, 25 bp, Homo sapien
gaataacgtttctatggacatctgt

SEQ ID NO: 290396 - DNA, 25 bp, Homo sapien
ggacatctgtaaacatgtatgaggg

SEQ ID NO: 290397 - DNA, 25 bp, Homo sapien
cagaccttctcacacccacacaaat

SEQ ID NO: 290398 - DNA, 25 bp, Homo sapien
agccaccgcttaggggaagccactg

SEQ ID NO: 290399 - DNA, 25 bp, Homo sapien
cagccagggcgctcttccaggcagg

SEQ ID NO: 290400 - DNA, 25 bp, Homo sapien
gcaggcgaggataacttgagagttt

SEQ ID NO: 290401 - DNA, 25 bp, Homo sapien
taacttgagagtttcctagggcacc

SEQ ID NO: 290402 - DNA, 25 bp, Homo sapien
acttgagagtttcctagggcaccag

SEQ ID NO: 290403 - DNA, 25 bp, Homo sapien
ttgagagtttcctagggcaccaggg

SEQ ID NO: 290404 - DNA, 25 bp, Homo sapien
gagagtttcctagggcaccagggac

SEQ ID NO: 290405 - DNA, 25 bp, Homo sapien
agtttcctagggcaccagggacaga

SEQ ID NO: 290406 - DNA, 25 bp, Homo sapien
aggtgtgtgtaggaggcggaggccc

SEQ ID NO: 290407 - DNA, 25 bp, Homo sapien
gcggaggcccgcagagcacagagca

SEQ ID NO: 290408 - DNA, 25 bp, Homo sapien
tatattctgaggatagtgggcgaga

SEQ ID NO: 290409 - DNA, 25 bp, Homo sapien
gtgggcgagaactttggatttgaat

SEQ ID NO: 290410 - DNA, 25 bp, Homo sapien
ggactctggtcaaaattttcgcccg

SEQ ID NO: 290411 - DNA, 25 bp, Homo sapien
tggtcaaaattttcgcccgccagct

SEQ ID NO: 290412 - DNA, 25 bp, Homo sapien
gtcgatcccgcacagcacgaagtag

SEQ ID NO: 290413 - DNA, 25 bp, Homo sapien
ctttattgtccgtttgtgtcctgaa

SEQ ID NO: 290414 - DNA, 25 bp, Homo sapien
gtttgtgtcctgaaagatagccctt

SEQ ID NO: 290415 - DNA, 25 bp, Homo sapien
tcctgaaagatagccctttaggcat

SEQ ID NO: 290416 - DNA, 25 bp, Homo sapien
acatgttcaccgcatcttgatcaaa

SEQ ID NO: 290417 - DNA, 25 bp, Homo sapien
gcatcttgatcaaaagggttccatt

SEQ ID NO: 290418 - DNA, 25 bp, Homo sapien
tcaaaagggttccattctatattct

SEQ ID NO: 290419 - DNA, 25 bp, Homo sapien
tgctgggcaactccatcctcgtgga

SEQ ID NO: 290420 - DNA, 25 bp, Homo sapien
actccatcctcgtggacctgctggg

SEQ ID NO: 290421 - DNA, 25 bp, Homo sapien
gtgggccatatctactacttcctgg

SEQ ID NO: 290422 - DNA, 25 bp, Homo sapien
catatctactacttcctggaggacg

SEQ ID NO: 290423 - DNA, 25 bp, Homo sapien
tactacttcctggaggacgtcttcc

SEQ ID NO: 290424 - DNA, 25 bp, Homo sapien
caaccagcctggaggcaagaggctc

SEQ ID NO: 290425 - DNA, 25 bp, Homo sapien
aagaggctcctgcagacccctggct

SEQ ID NO: 290426 - DNA, 25 bp, Homo sapien
gcagtagcctgaccatctggacaca

SEQ ID NO: 290427 - DNA, 25 bp, Homo sapien
cccagggacggcaggagagctcgcg

SEQ ID NO: 290428 - DNA, 25 bp, Homo sapien
agagctcgcggcaccttcctgaggc

SEQ ID NO: 290429 - DNA, 25 bp, Homo sapien
gggttagggctgttcctgaaaggca

SEQ ID NO: 290430 - DNA, 25 bp, Homo sapien
agatggtgactgtcttgcttgcagc

SEQ ID NO: 290431 - DNA, 25 bp, Homo sapien
tgcttgcagcagctgaggacaccga

SEQ ID NO: 290432 - DNA, 25 bp, Homo sapien
accgactgtgtttagcgagtgtcct

SEQ ID NO: 290433 - DNA, 25 bp, Homo sapien
gagtgtcctgcttttcatgtacaca

SEQ ID NO: 290434 - DNA, 25 bp, Homo sapien
tcatgtacacatctggcttaataag

SEQ ID NO: 290435 - DNA, 25 bp, Homo sapien
acgatgcagacgtggccttggctca

SEQ ID NO: 290436 - DNA, 25 bp, Homo sapien
ctctgtgctggacacaaatgacttt

SEQ ID NO: 290437 - DNA, 25 bp, Homo sapien
actcaagtccttggagtgtcacaaa

SEQ ID NO: 290438 - DNA, 25 bp, Homo sapien
cacaaaggactaacaacgctggctg

SEQ ID NO: 290439 - DNA, 25 bp, Homo sapien
ggagaattgactgcgtgaaccccac

SEQ ID NO: 290440 - DNA, 25 bp, Homo sapien
gtgaaccccacagggccgttagtgg

SEQ ID NO: 290441 - DNA, 25 bp, Homo sapien
ataagtacctacactgtttcctcaa

SEQ ID NO: 290442 - DNA, 25 bp, Homo sapien
gtttcctcaaccctttgcttatatg

SEQ ID NO: 290443 - DNA, 25 bp, Homo sapien
ccctttgcttatatggtttccttca

SEQ ID NO: 290444 - DNA, 25 bp, Homo sapien
aagctgaagtggcacatacatcccc

SEQ ID NO: 290445 - DNA, 25 bp, Homo sapien
cccctttctgtcatagagaggcaga

SEQ ID NO: 290446 - DNA, 25 bp, Homo sapien
aggcagatgacaagcggcctaccca

SEQ ID NO: 290447 - DNA, 25 bp, Homo sapien
ggcctacccacggtttgggataatg

SEQ ID NO: 290448 - DNA, 25 bp, Homo sapien
gataatggactagtggcaacaggca

SEQ ID NO: 290449 - DNA, 25 bp, Homo sapien
ggcaacaggcaagtccagcttttat

SEQ ID NO: 290450 - DNA, 25 bp, Homo sapien
caggcaagtccagcttttattgttt

SEQ ID NO: 290451 - DNA, 25 bp, Homo sapien
ttgtttgggatccttactgagaagc

SEQ ID NO: 290452 - DNA, 25 bp, Homo sapien
tactacttcctggaggacgtcttcc

SEQ ID NO: 290453 - DNA, 25 bp, Homo sapien
caaccagcctggaggcaagaggctc

SEQ ID NO: 290454 - DNA, 25 bp, Homo sapien
aagaggctcctgcagacccctggct

SEQ ID NO: 290455 - DNA, 25 bp, Homo sapien
tggcttcctaaagctgctcctggat

SEQ ID NO: 290456 - DNA, 25 bp, Homo sapien
ggcttcctaaagctgctcctggatg

SEQ ID NO: 290457 - DNA, 25 bp, Homo sapien
ttcctaaagctgctcctggatgccc

SEQ ID NO: 290458 - DNA, 25 bp, Homo sapien
tgcagaagaccccaattacctgccc

SEQ ID NO: 290459 - DNA, 25 bp, Homo sapien
ccaggcctaagaggcttctggcagc

SEQ ID NO: 290460 - DNA, 25 bp, Homo sapien
aacccatcctaaaggctgggcccat

SEQ ID NO: 290461 - DNA, 25 bp, Homo sapien
atcctaaaggctgggcccatgcaag

SEQ ID NO: 290462 - DNA, 25 bp, Homo sapien
tgggcccatgcaagggcccacctga

SEQ ID NO: 290463 - DNA, 25 bp, Homo sapien
acctgcctgctcctgtaggtatgtc

SEQ ID NO: 290464 - DNA, 25 bp, Homo sapien
gctcctgtaggtatgtctgctttta

SEQ ID NO: 290465 - DNA, 25 bp, Homo sapien
tctgcttttagccttgatgtgtaca

SEQ ID NO: 290466 - DNA, 25 bp, Homo sapien
aagctgacagaagggcctcgggtct

SEQ ID NO: 290467 - DNA, 25 bp, Homo sapien
aagggcctcgggtcttaatcacaga

SEQ ID NO: 290468 - DNA, 25 bp, Homo sapien
tctgtttcctcctggcatttatcag

SEQ ID NO: 290469 - DNA, 25 bp, Homo sapien
taatcacagacttagggaaatcata

SEQ ID NO: 290470 - DNA, 25 bp, Homo sapien
ttcctcctggcatttatcagctgga

SEQ ID NO: 290471 - DNA, 25 bp, Homo sapien
gaactcccaggagtcaatatcccta

SEQ ID NO: 290472 - DNA, 25 bp, Homo sapien
gagtcaatatccctatttccctgac

SEQ ID NO: 290473 - DNA, 25 bp, Homo sapien
ttcctcattcatctgtgctgtcacc

SEQ ID NO: 290474 - DNA, 25 bp, Homo sapien
cttgatatctggctgctatgtcttg

SEQ ID NO: 290475 - DNA, 25 bp, Homo sapien
atctggctgctatgtcttgtagttt

SEQ ID NO: 290476 - DNA, 25 bp, Homo sapien
ctgctatgtcttgtagtttggtgat

SEQ ID NO: 290477 - DNA, 25 bp, Homo sapien
gattatcttcatggtaaaaacacaa

SEQ ID NO: 290478 - DNA, 25 bp, Homo sapien
gagactttatgcatagtgtttccta

SEQ ID NO: 290479 - DNA, 25 bp, Homo sapien
agtgtttcctatagcaacgataagc

SEQ ID NO: 290480 - DNA, 25 bp, Homo sapien
gcaacgataagctttattcctcttt

SEQ ID NO: 290481 - DNA, 25 bp, Homo sapien
cctctttctctaagatagtaggtaa

SEQ ID NO: 290482 - DNA, 25 bp, Homo sapien
taatttaaagcaagcccctctttca

SEQ ID NO: 290483 - DNA, 25 bp, Homo sapien
caagcccctctttcagtaattttat

SEQ ID NO: 290484 - DNA, 25 bp, Homo sapien
actggtctgatcagtagtggaatca

SEQ ID NO: 290485 - DNA, 25 bp, Homo sapien
ctctacggaggcctggcactgctga

SEQ ID NO: 290486 - DNA, 25 bp, Homo sapien
acggaggcctggcactgctgaccac

SEQ ID NO: 290487 - DNA, 25 bp, Homo sapien
tggcactgctgaccaccggagcctt

SEQ ID NO: 290488 - DNA, 25 bp, Homo sapien
gccttctgggtcacgctggcaaccg

SEQ ID NO: 290489 - DNA, 25 bp, Homo sapien
tctgggtcacgctggcaaccggcgt

SEQ ID NO: 290490 - DNA, 25 bp, Homo sapien
tggcaaccggcgtcctgtgcctctt

SEQ ID NO: 290491 - DNA, 25 bp, Homo sapien
cgtcctgtgcctcttcctcggaggg

SEQ ID NO: 290492 - DNA, 25 bp, Homo sapien
tgagtctccagtatgttcggcccag

SEQ ID NO: 290493 - DNA, 25 bp, Homo sapien
agtctccagtatgttcggcccagcg

SEQ ID NO: 290494 - DNA, 25 bp, Homo sapien
tatgttcggcccagcgctcttcgca

SEQ ID NO: 290495 - DNA, 25 bp, Homo sapien
ttcgcacccttctggaccaaagcgc

SEQ ID NO: 290496 - DNA, 25 bp, Homo sapien
tgccgtcctttatgcttatcatgtg

SEQ ID NO: 290497 - DNA, 25 bp, Homo sapien
ggctttctaagcttgggtctgcatg

SEQ ID NO: 290498 - DNA, 25 bp, Homo sapien
tgctcctcggtgttttcccaggaat

SEQ ID NO: 290499 - DNA, 25 bp, Homo sapien
ttcccaggaatttcagtgacgcttt

SEQ ID NO: 290500 - DNA, 25 bp, Homo sapien
agtgacgctttttatgttacctaat

SEQ ID NO: 290501 - DNA, 25 bp, Homo sapien
gacgttgtcaaccatttaactgtgt

SEQ ID NO: 290502 - DNA, 25 bp, Homo sapien
catttaactgtgtagcgcgtgtgct

SEQ ID NO: 290503 - DNA, 25 bp, Homo sapien
agcgcgtgtgctttaacattccact

SEQ ID NO: 290504 - DNA, 25 bp, Homo sapien
cattccacttatgtttatacctggg

SEQ ID NO: 290505 - DNA, 25 bp, Homo sapien
tagcacttggtatctgtattttaaa

SEQ ID NO: 290506 - DNA, 25 bp, Homo sapien
aaatgtgactgttcagctgccgtcc

SEQ ID NO: 290507 - DNA, 25 bp, Homo sapien
tgctgctgggcaactccatcctcgt

SEQ ID NO: 290508 - DNA, 25 bp, Homo sapien
tgctgggcaactccatcctcgtgga

SEQ ID NO: 290509 - DNA, 25 bp, Homo sapien
gggcaactccatcctcgtggacctg

SEQ ID NO: 290510 - DNA, 25 bp, Homo sapien
actccatcctcgtggacctgctggg

SEQ ID NO: 290511 - DNA, 25 bp, Homo sapien
tcctcgtggacctgctggggattgc

SEQ ID NO: 290512 - DNA, 25 bp, Homo sapien
gtgggccatatctactacttcctgg

SEQ ID NO: 290513 - DNA, 25 bp, Homo sapien
tgggccatatctactacttcctgga

SEQ ID NO: 290514 - DNA, 25 bp, Homo sapien
gggccatatctactacttcctggag

SEQ ID NO: 290515 - DNA, 25 bp, Homo sapien
tcctggaggacgtcttccccaacca

SEQ ID NO: 290516 - DNA, 25 bp, Homo sapien
tccccaaccagcctggaggcaagag

SEQ ID NO: 290517 - DNA, 25 bp, Homo sapien
caaccagcctggaggcaagaggctc

SEQ ID NO: 290518 - DNA, 25 bp, Homo sapien
gtaagcatggcagtgagtatggtat

SEQ ID NO: 290519 - DNA, 25 bp, Homo sapien
catggcagtgagtatggtatgccta

SEQ ID NO: 290520 - DNA, 25 bp, Homo sapien
gcagtgagtatggtatgcctagaat

SEQ ID NO: 290521 - DNA, 25 bp, Homo sapien
cagtgagtatggtatgcctagaata

SEQ ID NO: 290522 - DNA, 25 bp, Homo sapien
agtgagtatggtatgcctagaataa

SEQ ID NO: 290523 - DNA, 25 bp, Homo sapien
gtgagtatggtatgcctagaataaa

SEQ ID NO: 290524 - DNA, 25 bp, Homo sapien
tcaaaagtctcactttgggctgaaa

SEQ ID NO: 290525 - DNA, 25 bp, Homo sapien
caaaagtctcactttgggctgaaag

SEQ ID NO: 290526 - DNA, 25 bp, Homo sapien
aaaagtctcactttgggctgaaagt

SEQ ID NO: 290527 - DNA, 25 bp, Homo sapien
aaagtctcactttgggctgaaagta

SEQ ID NO: 290528 - DNA, 25 bp, Homo sapien
aagtctcactttgggctgaaagtac

SEQ ID NO: 290529 - DNA, 25 bp, Homo sapien
gtcttttctattttacacctgcatg

SEQ ID NO: 290530 - DNA, 25 bp, Homo sapien
gcaagagttgaagttcccgacccct

SEQ ID NO: 290531 - DNA, 25 bp, Homo sapien
attttacacctgcatgtcctttgca

SEQ ID NO: 290532 - DNA, 25 bp, Homo sapien
cacctgcatgtcctttgcatttcag

SEQ ID NO: 290533 - DNA, 25 bp, Homo sapien
gattctttagattggatgcatggtc

SEQ ID NO: 290534 - DNA, 25 bp, Homo sapien
attggatgcatggtcacgctgggac

SEQ ID NO: 290535 - DNA, 25 bp, Homo sapien
gctgggaccgagaagagccactcga

SEQ ID NO: 290536 - DNA, 25 bp, Homo sapien
aagagccactcgacagtgtattccc

SEQ ID NO: 290537 - DNA, 25 bp, Homo sapien
cagtgtattccccttttagcaataa

SEQ ID NO: 290538 - DNA, 25 bp, Homo sapien
aaagtaacaccatttccttctcaca

SEQ ID NO: 290539 - DNA, 25 bp, Homo sapien
aggaccctaggcttggagctggagc

SEQ ID NO: 290540 - DNA, 25 bp, Homo sapien
tggcatcggtcacaggaaatcgata

SEQ ID NO: 290541 - DNA, 25 bp, Homo sapien
ggaaatcgatagtggctggctgcta

SEQ ID NO: 290542 - DNA, 25 bp, Homo sapien
tcgatagtggctggctgctagcatg

SEQ ID NO: 290543 - DNA, 25 bp, Homo sapien
gaaatagagccatggtactgaccaa

SEQ ID NO: 290544 - DNA, 25 bp, Homo sapien
gagccatggtactgaccaaagggac

SEQ ID NO: 290545 - DNA, 25 bp, Homo sapien
tgaccaaagggaccatagcacatgg

SEQ ID NO: 290546 - DNA, 25 bp, Homo sapien
acaggacttcatgttttatggaaat

SEQ ID NO: 290547 - DNA, 25 bp, Homo sapien
atatttaaccacttcaacattgtaa

SEQ ID NO: 290548 - DNA, 25 bp, Homo sapien
cttcaacattgtaaatctggataac

SEQ ID NO: 290549 - DNA, 25 bp, Homo sapien
gtatcttgatgacttaaatgtaagc

SEQ ID NO: 290550 - DNA, 25 bp, Homo sapien
caaagtggttaaacacatacccatc

SEQ ID NO: 290551 - DNA, 25 bp, Homo sapien
gactacaggttctctggatttcctc

SEQ ID NO: 290552 - DNA, 25 bp, Homo sapien
gttctctggatttcctcttcacatg

SEQ ID NO: 290553 - DNA, 25 bp, Homo sapien
cttattctgaagtgaagcctttaat

SEQ ID NO: 290554 - DNA, 25 bp, Homo sapien
gaagcctttaattgacgctgtgtat

SEQ ID NO: 290555 - DNA, 25 bp, Homo sapien
gacgctgtgtatagtactggagtac

SEQ ID NO: 290556 - DNA, 25 bp, Homo sapien
cataatattgatgttcctaatgttg

SEQ ID NO: 290557 - DNA, 25 bp, Homo sapien
atttgctttagctgtatacatacac

SEQ ID NO: 290558 - DNA, 25 bp, Homo sapien
atacatacacccataccccaaaaat

SEQ ID NO: 290559 - DNA, 25 bp, Homo sapien
aaatgttttgtctgtttggatctat

SEQ ID NO: 290560 - DNA, 25 bp, Homo sapien
tttggatctatgttgcctctcttat

SEQ ID NO: 290561 - DNA, 25 bp, Homo sapien
tgcctctcttatacgcaacaggtaa

SEQ ID NO: 290562 - DNA, 25 bp, Homo sapien
agctgaaaagaacgctagaccaaat

SEQ ID NO: 290563 - DNA, 25 bp, Homo sapien
agaccaaataggttctctgccttgc

SEQ ID NO: 290564 - DNA, 25 bp, Homo sapien
ccaaataggttctctgccttgcctt

SEQ ID NO: 290565 - DNA, 25 bp, Homo sapien
gttttgttttagctattatcaggga

SEQ ID NO: 290566 - DNA, 25 bp, Homo sapien
ttttagctattatcagggaaccaaa

SEQ ID NO: 290567 - DNA, 25 bp, Homo sapien
aactttaaggagctagtactggtct

SEQ ID NO: 290568 - DNA, 25 bp, Homo sapien
gagctagtactggtcttaattttta

SEQ ID NO: 290569 - DNA, 25 bp, Homo sapien
tcaaagtgagagaacagctgcattt

SEQ ID NO: 290570 - DNA, 25 bp, Homo sapien
gagagaacagctgcatttgtctttc

SEQ ID NO: 290571 - DNA, 25 bp, Homo sapien
aacagctgcatttgtctttctgacc

SEQ ID NO: 290572 - DNA, 25 bp, Homo sapien
cagctgcatttgtctttctgacctc

SEQ ID NO: 290573 - DNA, 25 bp, Homo sapien
aagtgatggactaaggatagatttt

SEQ ID NO: 290574 - DNA, 25 bp, Homo sapien
gactaaggatagattttggaggcag

SEQ ID NO: 290575 - DNA, 25 bp, Homo sapien
actaaggatagattttggaggcaga

SEQ ID NO: 290576 - DNA, 25 bp, Homo sapien
attttggaggcagagcaaacaggag

SEQ ID NO: 290577 - DNA, 25 bp, Homo sapien
gagcaaacaggagagcatgaaagaa

SEQ ID NO: 290578 - DNA, 25 bp, Homo sapien
agcaaacaggagagcatgaaagaaa

SEQ ID NO: 290579 - DNA, 25 bp, Homo sapien
gcaaacaggagagcatgaaagaaac

SEQ ID NO: 290580 - DNA, 25 bp, Homo sapien
caaacaggagagcatgaaagaaaca

SEQ ID NO: 290581 - DNA, 25 bp, Homo sapien
gagagcatgaaagaaacagagaatc

SEQ ID NO: 290582 - DNA, 25 bp, Homo sapien
caaagatgatgtttaggccaggggc

SEQ ID NO: 290583 - DNA, 25 bp, Homo sapien
aagatgatgtttaggccaggggcgg

SEQ ID NO: 290584 - DNA, 25 bp, Homo sapien
tggcatcggtcacaggaaatcgata

SEQ ID NO: 290585 - DNA, 25 bp, Homo sapien
aggaaatcgatagtggctggctgct

SEQ ID NO: 290586 - DNA, 25 bp, Homo sapien
ggaaatcgatagtggctggctgcta

SEQ ID NO: 290587 - DNA, 25 bp, Homo sapien
gaaatcgatagtggctggctgctag

SEQ ID NO: 290588 - DNA, 25 bp, Homo sapien
aatcgatagtggctggctgctagca

SEQ ID NO: 290589 - DNA, 25 bp, Homo sapien
atcgatagtggctggctgctagcat

SEQ ID NO: 290590 - DNA, 25 bp, Homo sapien
tcgatagtggctggctgctagcatg

SEQ ID NO: 290591 - DNA, 25 bp, Homo sapien
tgctagcatggccacttggggctta

SEQ ID NO: 290592 - DNA, 25 bp, Homo sapien
tgaccaaagggaccatagcacatgg

SEQ ID NO: 290593 - DNA, 25 bp, Homo sapien
aataaaactcaaaacaggacttcat

SEQ ID NO: 290594 - DNA, 25 bp, Homo sapien
caaaacaggacttcatgttttatgg

SEQ ID NO: 290595 - DNA, 25 bp, Homo sapien
tttgtgtctgtacataatctggaga

SEQ ID NO: 290596 - DNA, 25 bp, Homo sapien
tttactgaatagcacatgtatcccc

SEQ ID NO: 290597 - DNA, 25 bp, Homo sapien
catcctcgccatataccaaataatc

SEQ ID NO: 290598 - DNA, 25 bp, Homo sapien
gtctattttggtcaatttctgaact

SEQ ID NO: 290599 - DNA, 25 bp, Homo sapien
ttctgaactgtttattctattcctt

SEQ ID NO: 290600 - DNA, 25 bp, Homo sapien
tctattcctttatctagttacctat

SEQ ID NO: 290601 - DNA, 25 bp, Homo sapien
gaaactcacttggtgagacctcctc

SEQ ID NO: 290602 - DNA, 25 bp, Homo sapien
gtgagacctcctctatattttccta

SEQ ID NO: 290603 - DNA, 25 bp, Homo sapien
ctcctctatattttcctactgtttc

SEQ ID NO: 290604 - DNA, 25 bp, Homo sapien
ctactgtttcagaatttttcaaggg

SEQ ID NO: 290605 - DNA, 25 bp, Homo sapien
gtttctttcctatgcatactctaga

SEQ ID NO: 290606 - DNA, 25 bp, Homo sapien
ggaggacacataacagacatgctat

SEQ ID NO: 290607 - DNA, 25 bp, Homo sapien
gacatgctatccaccatttatttgt

SEQ ID NO: 290608 - DNA, 25 bp, Homo sapien
ttgtgattttgtaagagggttctct

SEQ ID NO: 290609 - DNA, 25 bp, Homo sapien
ctcttctttgtcttgttcagatatt

SEQ ID NO: 290610 - DNA, 25 bp, Homo sapien
gttcagatattttcatgtgtgtgtt

SEQ ID NO: 290611 - DNA, 25 bp, Homo sapien
aagtctgatgttttgataacttgaa

SEQ ID NO: 290612 - DNA, 25 bp, Homo sapien
agactcttgagttcatcttgtccaa

SEQ ID NO: 290613 - DNA, 25 bp, Homo sapien
catcttgtccaaatcttctagcatt

SEQ ID NO: 290614 - DNA, 25 bp, Homo sapien
aatcttctagcattttcaaggatga

SEQ ID NO: 290615 - DNA, 25 bp, Homo sapien
aggatgaagcctctgtgggatcttt

SEQ ID NO: 290616 - DNA, 25 bp, Homo sapien
agcctctgtgggatctttgggcttg

SEQ ID NO: 290617 - DNA, 25 bp, Homo sapien
agcggttcgcgggaggtggcctcgg

SEQ ID NO: 290618 - DNA, 25 bp, Homo sapien
tggcctcgggggtcgtagctactca

SEQ ID NO: 290619 - DNA, 25 bp, Homo sapien
tcgtagctactcaccggcggggcgc

SEQ ID NO: 290620 - DNA, 25 bp, Homo sapien
ggcgcggtccgcctgaggcctgaga

SEQ ID NO: 290621 - DNA, 25 bp, Homo sapien
acggcgcggtcagtgttcggctcct

SEQ ID NO: 290622 - DNA, 25 bp, Homo sapien
gcggtcagtgttcggctcctccgca

SEQ ID NO: 290623 - DNA, 25 bp, Homo sapien
gtctgggcgcgctgaagaccccttc

SEQ ID NO: 290624 - DNA, 25 bp, Homo sapien
tgggcgcgctgaagaccccttcggc

SEQ ID NO: 290625 - DNA, 25 bp, Homo sapien
gctgaagaccccttcggctgctggg

SEQ ID NO: 290626 - DNA, 25 bp, Homo sapien
ctgaagaccccttcggctgctgggc

SEQ ID NO: 290627 - DNA, 25 bp, Homo sapien
actcctgccgccgagcggttcgcgg

SEQ ID NO: 290628 - DNA, 25 bp, Homo sapien
ggtacgcaccatgggaaagcacaat

SEQ ID NO: 290629 - DNA, 25 bp, Homo sapien
gtaaagaagagtgcccatactggga

SEQ ID NO: 290630 - DNA, 25 bp, Homo sapien
atactgggatctgatcctgctgact

SEQ ID NO: 290631 - DNA, 25 bp, Homo sapien
atcctgctgactccctaatcgtgga

SEQ ID NO: 290632 - DNA, 25 bp, Homo sapien
taatcgtggacttccggtctccaga

SEQ ID NO: 290633 - DNA, 25 bp, Homo sapien
tccggtctccagaactattgtttaa

SEQ ID NO: 290634 - DNA, 25 bp, Homo sapien
acccagtctctaatattgtgttatg

SEQ ID NO: 290635 - DNA, 25 bp, Homo sapien
aagagcccagatatcatcctctagc

SEQ ID NO: 290636 - DNA, 25 bp, Homo sapien
gggtcctgaccccataggattaatg

SEQ ID NO: 290637 - DNA, 25 bp, Homo sapien
gacaccagagatggttgtctctctc

SEQ ID NO: 290638 - DNA, 25 bp, Homo sapien
agatggttgtctctctccccaggta

SEQ ID NO: 290639 - DNA, 25 bp, Homo sapien
tcttccgagtagttgctgcctttct

SEQ ID NO: 290640 - DNA, 25 bp, Homo sapien
tgctgcctttcttcagatcaggtta

SEQ ID NO: 290641 - DNA, 25 bp, Homo sapien
ctttcttcagatcaggttaccacaa

SEQ ID NO: 290642 - DNA, 25 bp, Homo sapien
agatcaggttaccacaatgcctccc

SEQ ID NO: 290643 - DNA, 25 bp, Homo sapien
tcagaacccactttgccggtgctaa

SEQ ID NO: 290644 - DNA, 25 bp, Homo sapien
actttgccggtgctaaaacacaaga

SEQ ID NO: 290645 - DNA, 25 bp, Homo sapien
gccagtaatggccagaaaccaacca

SEQ ID NO: 290646 - DNA, 25 bp, Homo sapien
gaaaccaaccaccagaggccaggct

SEQ ID NO: 290647 - DNA, 25 bp, Homo sapien
aggccaggctgaaagacaagctccg

SEQ ID NO: 290648 - DNA, 25 bp, Homo sapien
tgaaagacaagctccgggtgtccag

SEQ ID NO: 290649 - DNA, 25 bp, Homo sapien
gacgggccaaccatgtggcaggtcc

SEQ ID NO: 290650 - DNA, 25 bp, Homo sapien
tgaactcaggcttctgacactccaa

SEQ ID NO: 290651 - DNA, 25 bp, Homo sapien
aactcaggcttctgacactccaaag

SEQ ID NO: 290652 - DNA, 25 bp, Homo sapien
tcttaactcttcagtgtactgtgaa

SEQ ID NO: 290653 - DNA, 25 bp, Homo sapien
gtgtactgtgaaccttactgcaaca

SEQ ID NO: 290654 - DNA, 25 bp, Homo sapien
tactgtgaaccttactgcaacagac

SEQ ID NO: 290655 - DNA, 25 bp, Homo sapien
gatgagaatctcagcatggtagcta

SEQ ID NO: 290656 - DNA, 25 bp, Homo sapien
gagaatctcagcatggtagctaatt

SEQ ID NO: 290657 - DNA, 25 bp, Homo sapien
gcatggtagctaattagttgtgctt

SEQ ID NO: 290658 - DNA, 25 bp, Homo sapien
gctaattagttgtgcttggagaagc

SEQ ID NO: 290659 - DNA, 25 bp, Homo sapien
ggaggccagagacagcaagcaattt

SEQ ID NO: 290660 - DNA, 25 bp, Homo sapien
gcaatttgcccaagacgacacagct

SEQ ID NO: 290661 - DNA, 25 bp, Homo sapien
aaagatagtcgtgaagggtgaagct

SEQ ID NO: 290662 - DNA, 25 bp, Homo sapien
gtcgtgaagggtgaagctaatttgt

SEQ ID NO: 290663 - DNA, 25 bp, Homo sapien
gctaatttgtaaaactaatgcctga

SEQ ID NO: 290664 - DNA, 25 bp, Homo sapien
aaacataagcatgaagtccatggag

SEQ ID NO: 290665 - DNA, 25 bp, Homo sapien
gagagggaattgagagctgacactt

SEQ ID NO: 290666 - DNA, 25 bp, Homo sapien
gggaattgagagctgacacttcata

SEQ ID NO: 290667 - DNA, 25 bp, Homo sapien
ttgagagctgacacttcataactgg

SEQ ID NO: 290668 - DNA, 25 bp, Homo sapien
gagagctgacacttcataactggag

SEQ ID NO: 290669 - DNA, 25 bp, Homo sapien
gagctgacacttcataactggagaa

SEQ ID NO: 290670 - DNA, 25 bp, Homo sapien
gacacttcataactggagaaactgg

SEQ ID NO: 290671 - DNA, 25 bp, Homo sapien
cttcataactggagaaactggaaat

SEQ ID NO: 290672 - DNA, 25 bp, Homo sapien
aaagtacttcttttattgcacattc

SEQ ID NO: 290673 - DNA, 25 bp, Homo sapien
acttcttttattgcacattcagaga

SEQ ID NO: 290674 - DNA, 25 bp, Homo sapien
tcttgtgtgcgtgtccttaaacttc

SEQ ID NO: 290675 - DNA, 25 bp, Homo sapien
gtgtgcgtgtccttaaacttccaat

SEQ ID NO: 290676 - DNA, 25 bp, Homo sapien
gcgtgtccttaaacttccaatctta

SEQ ID NO: 290677 - DNA, 25 bp, Homo sapien
ggagattgttgaacgcagcttgtct

SEQ ID NO: 290678 - DNA, 25 bp, Homo sapien
attgttgaacgcagcttgtctagga

SEQ ID NO: 290679 - DNA, 25 bp, Homo sapien
ttgaacgcagcttgtctaggaaggg

SEQ ID NO: 290680 - DNA, 25 bp, Homo sapien
aaatttatttgggaccatgggaatg

SEQ ID NO: 290681 - DNA, 25 bp, Homo sapien
atttgggaccatgggaatgatagtt

SEQ ID NO: 290682 - DNA, 25 bp, Homo sapien
cacacgacagatttctagatacttt

SEQ ID NO: 290683 - DNA, 25 bp, Homo sapien
agttctccgaattctggcagagcgt

SEQ ID NO: 290684 - DNA, 25 bp, Homo sapien
tctgggaaggcgatcagtgcttctt

SEQ ID NO: 290685 - DNA, 25 bp, Homo sapien
agtgcttctttccatggcgcaaggc

SEQ ID NO: 290686 - DNA, 25 bp, Homo sapien
tccatggcgcaaggcctgggttctg

SEQ ID NO: 290687 - DNA, 25 bp, Homo sapien
ttctgggtgtgcttgaagaaagcca

SEQ ID NO: 290688 - DNA, 25 bp, Homo sapien
gggtgacatcgccatggctgagaag

SEQ ID NO: 290689 - DNA, 25 bp, Homo sapien
gaaggagccaggaccggaactgcaa

SEQ ID NO: 290690 - DNA, 25 bp, Homo sapien
accggaactgcaagggcgttgctgc

SEQ ID NO: 290691 - DNA, 25 bp, Homo sapien
aactgcaagggcgttgctgcccagg

SEQ ID NO: 290692 - DNA, 25 bp, Homo sapien
gcacccaagcgagcactgtctgaag

SEQ ID NO: 290693 - DNA, 25 bp, Homo sapien
gaaaaactagctccagttctccgaa

SEQ ID NO: 290694 - DNA, 25 bp, Homo sapien
gggcctcacagagaaatattagtga

SEQ ID NO: 290695 - DNA, 25 bp, Homo sapien
gtgactttaaccaggtttcagaatc

SEQ ID NO: 290696 - DNA, 25 bp, Homo sapien
tcatcagccttgaggtgattactga

SEQ ID NO: 290697 - DNA, 25 bp, Homo sapien
cagaatctgggccttacctttacag

SEQ ID NO: 290698 - DNA, 25 bp, Homo sapien
tctgggccttacctttacaggttca

SEQ ID NO: 290699 - DNA, 25 bp, Homo sapien
atggcatcaatagaggcagaagtat

SEQ ID NO: 290700 - DNA, 25 bp, Homo sapien
cacaaaacattttagcattatagct

SEQ ID NO: 290701 - DNA, 25 bp, Homo sapien
gcattatagctgtctgaatccttca

SEQ ID NO: 290702 - DNA, 25 bp, Homo sapien
agctgtctgaatccttcaataagaa

SEQ ID NO: 290703 - DNA, 25 bp, Homo sapien
ggtgattactgatgatttgggctta

SEQ ID NO: 290704 - DNA, 25 bp, Homo sapien
caataagaaggagaggcacacacaa

SEQ ID NO: 290705 - DNA, 25 bp, Homo sapien
ctactgttatcacatccctttgtat

SEQ ID NO: 290706 - DNA, 25 bp, Homo sapien
atcacatccctttgtataagtttta

SEQ ID NO: 290707 - DNA, 25 bp, Homo sapien
tcttcatttctttgaggagatcagt

SEQ ID NO: 290708 - DNA, 25 bp, Homo sapien
ggagatcagtattgtaacgtatgtg

SEQ ID NO: 290709 - DNA, 25 bp, Homo sapien
taaaagtcccacatgagagtcctga

SEQ ID NO: 290710 - DNA, 25 bp, Homo sapien
atgagagtcctgacgccctctccat

SEQ ID NO: 290711 - DNA, 25 bp, Homo sapien
tccatgccccacagtaatgtggctt

SEQ ID NO: 290712 - DNA, 25 bp, Homo sapien
gtaatgtggcttctttcatgggttt

SEQ ID NO: 290713 - DNA, 25 bp, Homo sapien
ttctttttagctgatctcatcctaa

SEQ ID NO: 290714 - DNA, 25 bp, Homo sapien
tgatctcatcctaagcatgctttat

SEQ ID NO: 290715 - DNA, 25 bp, Homo sapien
aagctaggtatttatcaactgcaga

SEQ ID NO: 290716 - DNA, 25 bp, Homo sapien
tctttgctgtttgcaatcacacgtg

SEQ ID NO: 290717 - DNA, 25 bp, Homo sapien
tgctgtttgcaatcacacgtggtga

SEQ ID NO: 290718 - DNA, 25 bp, Homo sapien
gtttgcaatcacacgtggtgacctc

SEQ ID NO: 290719 - DNA, 25 bp, Homo sapien
tgcaatcacacgtggtgacctcaca

SEQ ID NO: 290720 - DNA, 25 bp, Homo sapien
aatcacacgtggtgacctcacacac

SEQ ID NO: 290721 - DNA, 25 bp, Homo sapien
tctgggcggtccagaaggagcaggc

SEQ ID NO: 290722 - DNA, 25 bp, Homo sapien
tgggcctccacctctgtgcagggca

SEQ ID NO: 290723 - DNA, 25 bp, Homo sapien
tgtctccctcctgattctaaaatgt

SEQ ID NO: 290724 - DNA, 25 bp, Homo sapien
tctccctcctgattctaaaatgtct

SEQ ID NO: 290725 - DNA, 25 bp, Homo sapien
taaaatgtctcaagtgcaatgcccc

SEQ ID NO: 290726 - DNA, 25 bp, Homo sapien
tttaccgaggacagcctgcctctgc

SEQ ID NO: 290727 - DNA, 25 bp, Homo sapien
gtgattctttgtacataggtgtcta

SEQ ID NO: 290728 - DNA, 25 bp, Homo sapien
ataggtgtctaggttctgtttgttt

SEQ ID NO: 290729 - DNA, 25 bp, Homo sapien
ttttccctgatgttgggtagatgag

SEQ ID NO: 290730 - DNA, 25 bp, Homo sapien
gatgagtgcatatacatgctagtga

SEQ ID NO: 290731 - DNA, 25 bp, Homo sapien
agatacttttgctgtagggttgtat

SEQ ID NO: 290732 - DNA, 25 bp, Homo sapien
agggttgtattgttgtagtctaaat

SEQ ID NO: 290733 - DNA, 25 bp, Homo sapien
tggtggtaatttccttttgaagtct

SEQ ID NO: 290734 - DNA, 25 bp, Homo sapien
aataactaggagacatcttatgtgt

SEQ ID NO: 290735 - DNA, 25 bp, Homo sapien
attgtactagtacctctttaagagt

SEQ ID NO: 290736 - DNA, 25 bp, Homo sapien
ggacatgataagttaatggcctgat

SEQ ID NO: 290737 - DNA, 25 bp, Homo sapien
ggcctgattgttgagattttgttgt

SEQ ID NO: 290738 - DNA, 25 bp, Homo sapien
agctgcaaaccctcatctgaagagg

SEQ ID NO: 290739 - DNA, 25 bp, Homo sapien
accctcatctgaagaggacgaatga

SEQ ID NO: 290740 - DNA, 25 bp, Homo sapien
aagaggacgaatgaggaggaccact

SEQ ID NO: 290741 - DNA, 25 bp, Homo sapien
agatatgtccactgatccgcatctt

SEQ ID NO: 290742 - DNA, 25 bp, Homo sapien
aggaccactgtggtgcatgctgatt

SEQ ID NO: 290743 - DNA, 25 bp, Homo sapien
tatgtccactgatccgcatcttcat

SEQ ID NO: 290744 - DNA, 25 bp, Homo sapien
ctaaccagggtgaaagcctgagtcc

SEQ ID NO: 290745 - DNA, 25 bp, Homo sapien
ataccccttttcctcacagtcagaa

SEQ ID NO: 290746 - DNA, 25 bp, Homo sapien
agaacagcagcctctacacatgttg

SEQ ID NO: 290747 - DNA, 25 bp, Homo sapien
atcttcatccactccctggatgtga

SEQ ID NO: 290748 - DNA, 25 bp, Homo sapien
gataatcctcagcacaaaacccagc

SEQ ID NO: 290749 - DNA, 25 bp, Homo sapien
gcgcacccggccaagaacattattt

SEQ ID NO: 290750 - DNA, 25 bp, Homo sapien
gaagtgttaactttgaggacatatc

SEQ ID NO: 290751 - DNA, 25 bp, Homo sapien
tgaggacatatctgttccctggaga

SEQ ID NO: 290752 - DNA, 25 bp, Homo sapien
ttgggcttgaatcaggagtttgtcc

SEQ ID NO: 290753 - DNA, 25 bp, Homo sapien
aggagtttgtcctacaggtgtcgcc

SEQ ID NO: 290754 - DNA, 25 bp, Homo sapien
acaggtgtcgcccttgatctcagga

SEQ ID NO: 290755 - DNA, 25 bp, Homo sapien
gtcgcccttgatctcaggatgctac

SEQ ID NO: 290756 - DNA, 25 bp, Homo sapien
aggatgctaccagggctttgttctc

SEQ ID NO: 290757 - DNA, 25 bp, Homo sapien
ctaccagggctttgttctcgggatc

SEQ ID NO: 290758 - DNA, 25 bp, Homo sapien
agggctttgttctcgggatcctcgc

SEQ ID NO: 290759 - DNA, 25 bp, Homo sapien
gatcctcgcacctggagagtgaaga

SEQ ID NO: 290760 - DNA, 25 bp, Homo sapien
gcccatagaacacagagggccctct

SEQ ID NO: 290761 - DNA, 25 bp, Homo sapien
taggccaggcatgggtatttattct

SEQ ID NO: 290762 - DNA, 25 bp, Homo sapien
tgtaatcagcatcttgagccgggcc

SEQ ID NO: 290763 - DNA, 25 bp, Homo sapien
ttgagccgggcctccctttgtgagg

SEQ ID NO: 290764 - DNA, 25 bp, Homo sapien
ccctttgtgaggcttctgtaactat

SEQ ID NO: 290765 - DNA, 25 bp, Homo sapien
gaggcttctgtaactatggaagtgt

SEQ ID NO: 290766 - DNA, 25 bp, Homo sapien
gaagtgtgatttacgcagatttgtc

SEQ ID NO: 290767 - DNA, 25 bp, Homo sapien
ggtcagagacgtctttccctgagca

SEQ ID NO: 290768 - DNA, 25 bp, Homo sapien
taaactgtctaatttctctagggaa

SEQ ID NO: 290769 - DNA, 25 bp, Homo sapien
aagtaacatcgaaagcctaaaacag

SEQ ID NO: 290770 - DNA, 25 bp, Homo sapien
aaacagacgccaaaaggcccataga

SEQ ID NO: 290771 - DNA, 25 bp, Homo sapien
gtatagtaaatttatgtacctacca

SEQ ID NO: 290772 - DNA, 25 bp, Homo sapien
cattcaaaatttccaataccgtatt

SEQ ID NO: 290773 - DNA, 25 bp, Homo sapien
gtacctaccatacagtcctttgtta

SEQ ID NO: 290774 - DNA, 25 bp, Homo sapien
accatacagtcctttgttacaaatc

SEQ ID NO: 290775 - DNA, 25 bp, Homo sapien
gttacaaatcagttactgtgttttg

SEQ ID NO: 290776 - DNA, 25 bp, Homo sapien
gtcataaagggccaatgttcatttt

SEQ ID NO: 290777 - DNA, 25 bp, Homo sapien
tccaataccgtatttttagtgatat

SEQ ID NO: 290778 - DNA, 25 bp, Homo sapien
tttacttgggaaaaactgatgtgag

SEQ ID NO: 290779 - DNA, 25 bp, Homo sapien
agtgatatttgtagttttcaggata

SEQ ID NO: 290780 - DNA, 25 bp, Homo sapien
tagttattatgcttagaggctcctg

SEQ ID NO: 290781 - DNA, 25 bp, Homo sapien
gaggctcctgttttgttaattttgt

SEQ ID NO: 290782 - DNA, 25 bp, Homo sapien
cagatcctaattccccaccgcatta

SEQ ID NO: 290783 - DNA, 25 bp, Homo sapien
cgcattaccccgccctggatttggg

SEQ ID NO: 290784 - DNA, 25 bp, Homo sapien
gaaaaaatacgtatatcttgagaga

SEQ ID NO: 290785 - DNA, 25 bp, Homo sapien
agagcgcccttgagccttacgcaga

SEQ ID NO: 290786 - DNA, 25 bp, Homo sapien
ccttgagccttacgcagaggtcttg

SEQ ID NO: 290787 - DNA, 25 bp, Homo sapien
gagccttacgcagaggtcttgtgtg

SEQ ID NO: 290788 - DNA, 25 bp, Homo sapien
tacgcagaggtcttgtgtgttccta

SEQ ID NO: 290789 - DNA, 25 bp, Homo sapien
gaggtcttgtgtgttcctagttaag

SEQ ID NO: 290790 - DNA, 25 bp, Homo sapien
gtcttgtgtgttcctagttaagccc

SEQ ID NO: 290791 - DNA, 25 bp, Homo sapien
ttgtgtgttcctagttaagccctcc

SEQ ID NO: 290792 - DNA, 25 bp, Homo sapien
gtgttcctagttaagccctcccacg

SEQ ID NO: 290793 - DNA, 25 bp, Homo sapien
tgtgtggctaataaggtttgttttc

SEQ ID NO: 290794 - DNA, 25 bp, Homo sapien
aattggaaaggtgtggagaagctct

SEQ ID NO: 290795 - DNA, 25 bp, Homo sapien
aatcagaaggttaatggaatcacgg

SEQ ID NO: 290796 - DNA, 25 bp, Homo sapien
aaggtttcacatttgacattgacag

SEQ ID NO: 290797 - DNA, 25 bp, Homo sapien
aatgaatagaactccccgtctgttt

SEQ ID NO: 290798 - DNA, 25 bp, Homo sapien
tcccttttccattactacgtcattt

SEQ ID NO: 290799 - DNA, 25 bp, Homo sapien
tacgtcatttactttcctagccttg

SEQ ID NO: 290800 - DNA, 25 bp, Homo sapien
cctagccttgctaggacggatgcca

SEQ ID NO: 290801 - DNA, 25 bp, Homo sapien
gacattgacagtccattaactgtgt

SEQ ID NO: 290802 - DNA, 25 bp, Homo sapien
acagcagtaattgctttagagcagt

SEQ ID NO: 290803 - DNA, 25 bp, Homo sapien
ggaagatgtttatgtgtggctaata

SEQ ID NO: 290804 - DNA, 25 bp, Homo sapien
agggaactcaagacaatcactttag

SEQ ID NO: 290805 - DNA, 25 bp, Homo sapien
aatgtgtctcacttcgttcataaag

SEQ ID NO: 290806 - DNA, 25 bp, Homo sapien
gaaggcctttgacaacgtggccaaa

SEQ ID NO: 290807 - DNA, 25 bp, Homo sapien
ggcagagcctaagggacagactctt

SEQ ID NO: 290808 - DNA, 25 bp, Homo sapien
gacagactcttagaaagatgccctt

SEQ ID NO: 290809 - DNA, 25 bp, Homo sapien
aagatgcccttggaacagggtcccg

SEQ ID NO: 290810 - DNA, 25 bp, Homo sapien
ggtcccgcagagtgttcctctcaaa

SEQ ID NO: 290811 - DNA, 25 bp, Homo sapien
gatttcacattttcatgggatatgg

SEQ ID NO: 290812 - DNA, 25 bp, Homo sapien
gattgggatgagtcttcagtctcct

SEQ ID NO: 290813 - DNA, 25 bp, Homo sapien
cagtctcctggtttgtttctggaat

SEQ ID NO: 290814 - DNA, 25 bp, Homo sapien
ttctggaatagagtgggccacacct

SEQ ID NO: 290815 - DNA, 25 bp, Homo sapien
ctcactcacagtgcaaaaccaaaaa

SEQ ID NO: 290816 - DNA, 25 bp, Homo sapien
tccctggaacttctgtgctactaag

SEQ ID NO: 290817 - DNA, 25 bp, Homo sapien
ggaacttctgtgctactaagtcttt

SEQ ID NO: 290818 - DNA, 25 bp, Homo sapien
ctgtgctactaagtcttttgttgta

SEQ ID NO: 290819 - DNA, 25 bp, Homo sapien
gttgtaggctaagattattttcctt

SEQ ID NO: 290820 - DNA, 25 bp, Homo sapien
atgtggcaggctgcctagtccctag

SEQ ID NO: 290821 - DNA, 25 bp, Homo sapien
atttctgccttaattattgactgtt

SEQ ID NO: 290822 - DNA, 25 bp, Homo sapien
attgactgttgtgaaatctctcttc

SEQ ID NO: 290823 - DNA, 25 bp, Homo sapien
aaatctctcttctgagacattccca

SEQ ID NO: 290824 - DNA, 25 bp, Homo sapien
ctctcttctgagacattcccaaatt

SEQ ID NO: 290825 - DNA, 25 bp, Homo sapien
ctgagacattcccaaattttattta

SEQ ID NO: 290826 - DNA, 25 bp, Homo sapien
actgtaatgtgcagcttttattaaa

SEQ ID NO: 290827 - DNA, 25 bp, Homo sapien
gaaattggttgaactgctaggttga

SEQ ID NO: 290828 - DNA, 25 bp, Homo sapien
gctaggttgaatgagagacttcatc

SEQ ID NO: 290829 - DNA, 25 bp, Homo sapien
gagacttcatctattggactatttt

SEQ ID NO: 290830 - DNA, 25 bp, Homo sapien
tttaatccaggcatatggtctttag

SEQ ID NO: 290831 - DNA, 25 bp, Homo sapien
tatggtctttagtaatggcttgtaa

SEQ ID NO: 290832 - DNA, 25 bp, Homo sapien
gtaatggcttgtaatttgtgaaaac

SEQ ID NO: 290833 - DNA, 25 bp, Homo sapien
gttttccctgttttcagttgtccat

SEQ ID NO: 290834 - DNA, 25 bp, Homo sapien
gttttcagttgtccatgtacacata

SEQ ID NO: 290835 - DNA, 25 bp, Homo sapien
gttgtccatgtacacatagtcatta

SEQ ID NO: 290836 - DNA, 25 bp, Homo sapien
gaaagctgttcaacaaacttgttta

SEQ ID NO: 290837 - DNA, 25 bp, Homo sapien
agccaggaccacatacactcttggg

SEQ ID NO: 290838 - DNA, 25 bp, Homo sapien
gggccctgctgagactgcaagagtc

SEQ ID NO: 290839 - DNA, 25 bp, Homo sapien
gtcatgaattctaacgttccacagg

SEQ ID NO: 290840 - DNA, 25 bp, Homo sapien
gttccacaggtgaaagattccaaga

SEQ ID NO: 290841 - DNA, 25 bp, Homo sapien
gattctaggattgcaaaaccccatc

SEQ ID NO: 290842 - DNA, 25 bp, Homo sapien
aaaccccatcattctaagattccaa

SEQ ID NO: 290843 - DNA, 25 bp, Homo sapien
atgattccatgtttctaagattcca

SEQ ID NO: 290844 - DNA, 25 bp, Homo sapien
cacactatgattctatgctgctaat

SEQ ID NO: 290845 - DNA, 25 bp, Homo sapien
gctgctaattcttgaaatttcgagt

SEQ ID NO: 290846 - DNA, 25 bp, Homo sapien
atttcgagtctcattgttcgttgct

SEQ ID NO: 290847 - DNA, 25 bp, Homo sapien
tcattgttcgttgctgttccccaga

SEQ ID NO: 290848 - DNA, 25 bp, Homo sapien
aaagcaaagtgatgcagcggtgtga

SEQ ID NO: 290849 - DNA, 25 bp, Homo sapien
gtgatgcagcggtgtgagcacactc

SEQ ID NO: 290850 - DNA, 25 bp, Homo sapien
gtgagcacactctgagggcctgtca

SEQ ID NO: 290851 - DNA, 25 bp, Homo sapien
tactccctagagaagatgtggcaag

SEQ ID NO: 290852 - DNA, 25 bp, Homo sapien
tagctggttaatggccaagtggtca

SEQ ID NO: 290853 - DNA, 25 bp, Homo sapien
agtggtcagttcactggaagccttc

SEQ ID NO: 290854 - DNA, 25 bp, Homo sapien
tggaagccttcttttcctgcctgtg

SEQ ID NO: 290855 - DNA, 25 bp, Homo sapien
tcttttcctgcctgtggctacaaga

SEQ ID NO: 290856 - DNA, 25 bp, Homo sapien
acccagaggaaggtctaatgaggag

SEQ ID NO: 290857 - DNA, 25 bp, Homo sapien
aagatgtggcaagcctcaggaggtc

SEQ ID NO: 290858 - DNA, 25 bp, Homo sapien
aagcctcaggaggtctggccactct

SEQ ID NO: 290859 - DNA, 25 bp, Homo sapien
aaatcactagcaagtggctcagaaa

SEQ ID NO: 290860 - DNA, 25 bp, Homo sapien
gggaaaaggtacacttctgcaatca

SEQ ID NO: 290861 - DNA, 25 bp, Homo sapien
tgcaatcagctgaggagttcacacc

SEQ ID NO: 290862 - DNA, 25 bp, Homo sapien
acatcatatttgctgttcagaggca

SEQ ID NO: 290863 - DNA, 25 bp, Homo sapien
agctgcaaattcagctcacctcaac

SEQ ID NO: 290864 - DNA, 25 bp, Homo sapien
aatttcaaacgttagaggctggtct

SEQ ID NO: 290865 - DNA, 25 bp, Homo sapien
gaggctggtctctgtggtttcctac

SEQ ID NO: 290866 - DNA, 25 bp, Homo sapien
gtggtttcctactggttcctgtggg

SEQ ID NO: 290867 - DNA, 25 bp, Homo sapien
tcccgctttctttctccatagagct

SEQ ID NO: 290868 - DNA, 25 bp, Homo sapien
agggtatttctcatatgccccattg

SEQ ID NO: 290869 - DNA, 25 bp, Homo sapien
atatgccccattggctacctagtgt

SEQ ID NO: 290870 - DNA, 25 bp, Homo sapien
attgcactggccatctcagctatag

SEQ ID NO: 290871 - DNA, 25 bp, Homo sapien
atctcagctatagccgtcttcctgg

SEQ ID NO: 290872 - DNA, 25 bp, Homo sapien
atagccgtcttcctggtcttggtgt

SEQ ID NO: 290873 - DNA, 25 bp, Homo sapien
tggtcttggtgtctgcctgtatcct

SEQ ID NO: 290874 - DNA, 25 bp, Homo sapien
gtcttggtgtctgcctgtatccttc

SEQ ID NO: 290875 - DNA, 25 bp, Homo sapien
acctacacaatgctgaaacctcttc

SEQ ID NO: 290876 - DNA, 25 bp, Homo sapien
aatgctgaaacctcttcttgggtga

SEQ ID NO: 290877 - DNA, 25 bp, Homo sapien
gctgaaacctcttcttgggtgaatt

SEQ ID NO: 290878 - DNA, 25 bp, Homo sapien
gaaacctcttcttgggtgaatttgg

SEQ ID NO: 290879 - DNA, 25 bp, Homo sapien
ctcttcttgggtgaatttggtattg

SEQ ID NO: 290880 - DNA, 25 bp, Homo sapien
atttggtattgtggtgtgtggtctt

SEQ ID NO: 290881 - DNA, 25 bp, Homo sapien
cagcctgagctatgcagaccggagc

SEQ ID NO: 290882 - DNA, 25 bp, Homo sapien
agaccggagctctcaaccagggtat

SEQ ID NO: 290883 - DNA, 25 bp, Homo sapien
ggctgtctggcagggtttcccagaa

SEQ ID NO: 290884 - DNA, 25 bp, Homo sapien
accctgtttcctgtggtcataaata

SEQ ID NO: 290885 - DNA, 25 bp, Homo sapien
gttttcctgacaatgttgggaggtc

SEQ ID NO: 290886 - DNA, 25 bp, Homo sapien
ttccaaccgccgtgggtcagacctg

SEQ ID NO: 290887 - DNA, 25 bp, Homo sapien
ggaccccactgctgtgaccaaggaa

SEQ ID NO: 290888 - DNA, 25 bp, Homo sapien
gaccaaggaaatctcaccagctgtg

SEQ ID NO: 290889 - DNA, 25 bp, Homo sapien
agctgtgtccaagatcaaccctgac

SEQ ID NO: 290890 - DNA, 25 bp, Homo sapien
tccaatgcctttgtaggagtatttt

SEQ ID NO: 290891 - DNA, 25 bp, Homo sapien
taggagtatttttagcagaaccgtt

SEQ ID NO: 290892 - DNA, 25 bp, Homo sapien
actgaggcacacagcggttaaggga

SEQ ID NO: 290893 - DNA, 25 bp, Homo sapien
ggcacacagcggttaagggacttac

SEQ ID NO: 290894 - DNA, 25 bp, Homo sapien
cacacagcggttaagggacttacgc

SEQ ID NO: 290895 - DNA, 25 bp, Homo sapien
cgcgaggcatgttctcagtgtgtgt

SEQ ID NO: 290896 - DNA, 25 bp, Homo sapien
tcacacagcagtagagctgggctgg

SEQ ID NO: 290897 - DNA, 25 bp, Homo sapien
gaggcatgttctcagtgtgtgtctt

SEQ ID NO: 290898 - DNA, 25 bp, Homo sapien
gggctggcaagggagggactgcaaa

SEQ ID NO: 290899 - DNA, 25 bp, Homo sapien
agggactgcaaagggcctcacaggg

SEQ ID NO: 290900 - DNA, 25 bp, Homo sapien
agggccctgggcaccagtgattatg

SEQ ID NO: 290901 - DNA, 25 bp, Homo sapien
gtgtgtcttgtgtcatttctgtgat

SEQ ID NO: 290902 - DNA, 25 bp, Homo sapien
ttctgtgatgcttgcacatcgtcag

SEQ ID NO: 290903 - DNA, 25 bp, Homo sapien
gagaaacctgtatacctagggtcat

SEQ ID NO: 290904 - DNA, 25 bp, Homo sapien
gtcattatttgaccccatagtataa

SEQ ID NO: 290905 - DNA, 25 bp, Homo sapien
gaccccatagtataaccagattcat

SEQ ID NO: 290906 - DNA, 25 bp, Homo sapien
gattcatggtctaacaagctctcag

SEQ ID NO: 290907 - DNA, 25 bp, Homo sapien
aacaagctctcagtgtggcttttct

SEQ ID NO: 290908 - DNA, 25 bp, Homo sapien
agtgtggcttttctctgaatgcttg

SEQ ID NO: 290909 - DNA, 25 bp, Homo sapien
tgccttgcatttcacagttgtactc

SEQ ID NO: 290910 - DNA, 25 bp, Homo sapien
atttcacagttgtactccatggtca

SEQ ID NO: 290911 - DNA, 25 bp, Homo sapien
actccatggtcaaccggtgcttttt

SEQ ID NO: 290912 - DNA, 25 bp, Homo sapien
tttttcacatcgtggtacttgtcaa

SEQ ID NO: 290913 - DNA, 25 bp, Homo sapien
tcgtggtacttgtcaaaacattttg

SEQ ID NO: 290914 - DNA, 25 bp, Homo sapien
tgcaaaggtttctctgcaacccttc

SEQ ID NO: 290915 - DNA, 25 bp, Homo sapien
gcaacccttccctaagcatgatttt

SEQ ID NO: 290916 - DNA, 25 bp, Homo sapien
acccttccctaagcatgattttgca

SEQ ID NO: 290917 - DNA, 25 bp, Homo sapien
agcatgattttgcacagccaaccct

SEQ ID NO: 290918 - DNA, 25 bp, Homo sapien
ttgcacagccaaccctgggtctagg

SEQ ID NO: 290919 - DNA, 25 bp, Homo sapien
aaccctgggtctaggcgagccacag

SEQ ID NO: 290920 - DNA, 25 bp, Homo sapien
taggcgagccacagggtgaggtcaa

SEQ ID NO: 290921 - DNA, 25 bp, Homo sapien
gtcaaggtgagcattctgggaacaa

SEQ ID NO: 290922 - DNA, 25 bp, Homo sapien
attctgggaacaatatttgggctca

SEQ ID NO: 290923 - DNA, 25 bp, Homo sapien
ccccgccagacctggtgaagaggat

SEQ ID NO: 290924 - DNA, 25 bp, Homo sapien
gactggtaggttcccctccaagcca

SEQ ID NO: 290925 - DNA, 25 bp, Homo sapien
ctgtttttagtgcagtcacataata

SEQ ID NO: 290926 - DNA, 25 bp, Homo sapien
taagtgtgggatacccttctgcagc

SEQ ID NO: 290927 - DNA, 25 bp, Homo sapien
gtgtgggatacccttctgcagcttc

SEQ ID NO: 290928 - DNA, 25 bp, Homo sapien
cttcagtgagacaaatcacttttta

SEQ ID NO: 290929 - DNA, 25 bp, Homo sapien
ccattttattggcatcactagatgt

SEQ ID NO: 290930 - DNA, 25 bp, Homo sapien
gcatcactagatgtttttaggaccc

SEQ ID NO: 290931 - DNA, 25 bp, Homo sapien
gttattgaaaacagcatcttccttc

SEQ ID NO: 290932 - DNA, 25 bp, Homo sapien
gaaaacagcatcttccttcttgcaa

SEQ ID NO: 290933 - DNA, 25 bp, Homo sapien
aacagcatcttccttcttgcaatgg

SEQ ID NO: 290934 - DNA, 25 bp, Homo sapien
ttccttcttgcaatggccactaata

SEQ ID NO: 290935 - DNA, 25 bp, Homo sapien
gcaatggccactaatagcacacaat

SEQ ID NO: 290936 - DNA, 25 bp, Homo sapien
gaaatgggccacagctcagcggaag

SEQ ID NO: 290937 - DNA, 25 bp, Homo sapien
acagctcagcggaagggaggccggt

SEQ ID NO: 290938 - DNA, 25 bp, Homo sapien
caggtgtggcccaccaggagctgcc

SEQ ID NO: 290939 - DNA, 25 bp, Homo sapien
gctgccttccccacttttttgggag

SEQ ID NO: 290940 - DNA, 25 bp, Homo sapien
ttctgggagcagagcagccttggca

SEQ ID NO: 290941 - DNA, 25 bp, Homo sapien
actgtaaggttatctgtgtgttgtt

SEQ ID NO: 290942 - DNA, 25 bp, Homo sapien
aggttatctgtgtgttgttggattc

SEQ ID NO: 290943 - DNA, 25 bp, Homo sapien
gagcagagcagccttggcatgccat

SEQ ID NO: 290944 - DNA, 25 bp, Homo sapien
agcagagcagccttggcatgccatg

SEQ ID NO: 290945 - DNA, 25 bp, Homo sapien
attgtgtgtttatagaaaagtctgg

SEQ ID NO: 290946 - DNA, 25 bp, Homo sapien
aagtctgggacgtaagcgaggaaat

SEQ ID NO: 290947 - DNA, 25 bp, Homo sapien
aactccagtgctcgcattccaaaat

SEQ ID NO: 290948 - DNA, 25 bp, Homo sapien
gctcgcattccaaaatgcccctgga

SEQ ID NO: 290949 - DNA, 25 bp, Homo sapien
ggaaaccagcatcgagggcaccatt

SEQ ID NO: 290950 - DNA, 25 bp, Homo sapien
tcgagggcaccattcccttcagcaa

SEQ ID NO: 290951 - DNA, 25 bp, Homo sapien
ttcccttcagcaagcctgtaaaagt

SEQ ID NO: 290952 - DNA, 25 bp, Homo sapien
atataatgcccaaacctgcacggcg

SEQ ID NO: 290953 - DNA, 25 bp, Homo sapien
ggcaaaaacagtcttcccaaccgtg

SEQ ID NO: 290954 - DNA, 25 bp, Homo sapien
tagagggcccttcttaggtgtcaga

SEQ ID NO: 290955 - DNA, 25 bp, Homo sapien
gggcccttcttaggtgtcagaatga

SEQ ID NO: 290956 - DNA, 25 bp, Homo sapien
ttaggtgtcagaatgagccaagcct

SEQ ID NO: 290957 - DNA, 25 bp, Homo sapien
agaatgagccaagcctgaagcactt

SEQ ID NO: 290958 - DNA, 25 bp, Homo sapien
tggaaactgagttcacaagaagata

SEQ ID NO: 290959 - DNA, 25 bp, Homo sapien
atatgtaagaattagcacagtcaag

SEQ ID NO: 290960 - DNA, 25 bp, Homo sapien
ggagaaagactatattataccttac

SEQ ID NO: 290961 - DNA, 25 bp, Homo sapien
attataccttacatctatttttgtg

SEQ ID NO: 290962 - DNA, 25 bp, Homo sapien
gcacagtcaagtggtagggagcccc

SEQ ID NO: 290963 - DNA, 25 bp, Homo sapien
tatttttgtgttcaaccacatttgt

SEQ ID NO: 290964 - DNA, 25 bp, Homo sapien
ccatcatgccttttctgcaaactgg

SEQ ID NO: 290965 - DNA, 25 bp, Homo sapien
gccttttctgcaaactggtggcaca

SEQ ID NO: 290966 - DNA, 25 bp, Homo sapien
ttctgcaaactggtggcacatgttt

SEQ ID NO: 290967 - DNA, 25 bp, Homo sapien
actggtggcacatgtttatagaaag

SEQ ID NO: 290968 - DNA, 25 bp, Homo sapien
gggagatgctgatgaaatcctaagt

SEQ ID NO: 290969 - DNA, 25 bp, Homo sapien
acatgtactattttctctgtccaag

SEQ ID NO: 290970 - DNA, 25 bp, Homo sapien
tctgtccaagatctctgtctccagt

SEQ ID NO: 290971 - DNA, 25 bp, Homo sapien
tgatctttaccacccatttatctgt

SEQ ID NO: 290972 - DNA, 25 bp, Homo sapien
gtctcatcggttacatgctagctga

SEQ ID NO: 290973 - DNA, 25 bp, Homo sapien
tcagggagccttacttttctttcta

SEQ ID NO: 290974 - DNA, 25 bp, Homo sapien
ttctacttcctctgttgcagtgcag

SEQ ID NO: 290975 - DNA, 25 bp, Homo sapien
gtgcagaccattccagctcaatgtg

SEQ ID NO: 290976 - DNA, 25 bp, Homo sapien
ttatgttgcagccatactgcctacc

SEQ ID NO: 290977 - DNA, 25 bp, Homo sapien
tgaactctctcaactggctgtgcca

SEQ ID NO: 290978 - DNA, 25 bp, Homo sapien
gctgtgccatgctgatcatacattt

SEQ ID NO: 290979 - DNA, 25 bp, Homo sapien
gatcatacatttgtgcctttacatg

SEQ ID NO: 290980 - DNA, 25 bp, Homo sapien
gggccacagctcagcggaagggagg

SEQ ID NO: 290981 - DNA, 25 bp, Homo sapien
ttctgggagcagagcagccttggca

SEQ ID NO: 290982 - DNA, 25 bp, Homo sapien
tctgggagcagagcagccttggcat

SEQ ID NO: 290983 - DNA, 25 bp, Homo sapien
actgtaaggttatctgtgtgttgtt

SEQ ID NO: 290984 - DNA, 25 bp, Homo sapien
aggttatctgtgtgttgttggattc

SEQ ID NO: 290985 - DNA, 25 bp, Homo sapien
gagcagagcagccttggcatgccat

SEQ ID NO: 290986 - DNA, 25 bp, Homo sapien
agcagagcagccttggcatgccatg

SEQ ID NO: 290987 - DNA, 25 bp, Homo sapien
ccatggggtggattgtgtgtttata

SEQ ID NO: 290988 - DNA, 25 bp, Homo sapien
attgtgtgtttatagaaaagtctgg

SEQ ID NO: 290989 - DNA, 25 bp, Homo sapien
aagtctgggacgtaagcgaggaaat

SEQ ID NO: 290990 - DNA, 25 bp, Homo sapien
ggacgtaagcgaggaaatgggccac

SEQ ID NO: 290991 - DNA, 25 bp, Homo sapien
atttcaatccatacaatgagagtca

SEQ ID NO: 290992 - DNA, 25 bp, Homo sapien
aatgagagtcatgttcagtttttca

SEQ ID NO: 290993 - DNA, 25 bp, Homo sapien
tgacttcatgctgggtaatgttcac

SEQ ID NO: 290994 - DNA, 25 bp, Homo sapien
gttagatgtaagacagatggagcat

SEQ ID NO: 290995 - DNA, 25 bp, Homo sapien
tgctgggtaatgttcactctgcatt

SEQ ID NO: 290996 - DNA, 25 bp, Homo sapien
gatggagcatcatgggttggattat

SEQ ID NO: 290997 - DNA, 25 bp, Homo sapien
gcatcatgggttggattattactga

SEQ ID NO: 290998 - DNA, 25 bp, Homo sapien
tactgagttcaataatctggtgggt

SEQ ID NO: 290999 - DNA, 25 bp, Homo sapien
gttcaataatctggtgggttttgcc

SEQ ID NO: 291000 - DNA, 25 bp, Homo sapien
ggtgggttttgccagctagaaacat

SEQ ID NO: 291001 - DNA, 25 bp, Homo sapien
gggttttgccagctagaaacataat

SEQ ID NO: 291002 - DNA, 25 bp, Homo sapien
gagaatgtgaaggtatgcaaaagcc

SEQ ID NO: 291003 - DNA, 25 bp, Homo sapien
agaatgtgaaggtatgcaaaagcct

SEQ ID NO: 291004 - DNA, 25 bp, Homo sapien
gaatgtgaaggtatgcaaaagccta

SEQ ID NO: 291005 - DNA, 25 bp, Homo sapien
aatgtgaaggtatgcaaaagcctac

SEQ ID NO: 291006 - DNA, 25 bp, Homo sapien
atgtgaaggtatgcaaaagcctact

SEQ ID NO: 291007 - DNA, 25 bp, Homo sapien
tgtgaaggtatgcaaaagcctactt

SEQ ID NO: 291008 - DNA, 25 bp, Homo sapien
gtgaaggtatgcaaaagcctacttt

SEQ ID NO: 291009 - DNA, 25 bp, Homo sapien
tgaaggtatgcaaaagcctactttt

SEQ ID NO: 291010 - DNA, 25 bp, Homo sapien
gaaggtatgcaaaagcctacttttt

SEQ ID NO: 291011 - DNA, 25 bp, Homo sapien
ggagcgctcgaagttcccggttcgt

SEQ ID NO: 291012 - DNA, 25 bp, Homo sapien
tcccggttcgtctcaggtactggta

SEQ ID NO: 291013 - DNA, 25 bp, Homo sapien
gttcgtctcaggtactggtaccggg

SEQ ID NO: 291014 - DNA, 25 bp, Homo sapien
acgtccatatcctcgctctcgaaat

SEQ ID NO: 291015 - DNA, 25 bp, Homo sapien
tcgctctcgaaatccaccaggacga

SEQ ID NO: 291016 - DNA, 25 bp, Homo sapien
gaaatccaccaggacgacgctgaaa

SEQ ID NO: 291017 - DNA, 25 bp, Homo sapien
acgacgctgaaacgcgagtccccgg

SEQ ID NO: 291018 - DNA, 25 bp, Homo sapien
gcagcgcagccatgtccgccaggaa

SEQ ID NO: 291019 - DNA, 25 bp, Homo sapien
gccatgtccgccaggaactgtgcca

SEQ ID NO: 291020 - DNA, 25 bp, Homo sapien
tgtgcaggtcgcagaggaacacgat

SEQ ID NO: 291021 - DNA, 25 bp, Homo sapien
gaggaacacgatgctgctggcgtcc

SEQ ID NO: 291022 - DNA, 25 bp, Homo sapien
gagctgagcaaagtgatcattgttg

SEQ ID NO: 291023 - DNA, 25 bp, Homo sapien
gatcattgttgacaattcccctgcc

SEQ ID NO: 291024 - DNA, 25 bp, Homo sapien
tcatacatcttccatcctgagaatg

SEQ ID NO: 291025 - DNA, 25 bp, Homo sapien
cagtcctggttcgatgacatgacgg

SEQ ID NO: 291026 - DNA, 25 bp, Homo sapien
atgacatgacggacacggagctgct

SEQ ID NO: 291027 - DNA, 25 bp, Homo sapien
catccccttctttgagggcctgagc

SEQ ID NO: 291028 - DNA, 25 bp, Homo sapien
ccaagtatgcagaccctgtggctga

SEQ ID NO: 291029 - DNA, 25 bp, Homo sapien
tgtggctgacctcctagaccgctgg

SEQ ID NO: 291030 - DNA, 25 bp, Homo sapien
cccggctcttcagagaatcatgtgt

SEQ ID NO: 291031 - DNA, 25 bp, Homo sapien
atcatgtgtttttcatcgtgggaac

SEQ ID NO: 291032 - DNA, 25 bp, Homo sapien
ttttcatcgtgggaactacgtgaag

SEQ ID NO: 291033 - DNA, 25 bp, Homo sapien
gaagggtagggccttttattcacat

SEQ ID NO: 291034 - DNA, 25 bp, Homo sapien
gagcatgctctcaaaatgtgttata

SEQ ID NO: 291035 - DNA, 25 bp, Homo sapien
gccttctccaccaactgatgtgata

SEQ ID NO: 291036 - DNA, 25 bp, Homo sapien
tatccttttatattcgtgactccag

SEQ ID NO: 291037 - DNA, 25 bp, Homo sapien
atattcgtgactccagtgaacccac

SEQ ID NO: 291038 - DNA, 25 bp, Homo sapien
gcctctgaggatttacacccttgta

SEQ ID NO: 291039 - DNA, 25 bp, Homo sapien
acccttgtatttgtactcctcttga

SEQ ID NO: 291040 - DNA, 25 bp, Homo sapien
actcctcttgagtctgggctggcct

SEQ ID NO: 291041 - DNA, 25 bp, Homo sapien
ggctggcctgtgactttaatcagtg

SEQ ID NO: 291042 - DNA, 25 bp, Homo sapien
acagttgttaagaccatgatgctag

SEQ ID NO: 291043 - DNA, 25 bp, Homo sapien
atgctagaggcaagatcgtgagatc

SEQ ID NO: 291044 - DNA, 25 bp, Homo sapien
tcaggtactgtgctgagtccttcat

SEQ ID NO: 291045 - DNA, 25 bp, Homo sapien
agtccttcatgggtatcatttcgtt

SEQ ID NO: 291046 - DNA, 25 bp, Homo sapien
gtatcatttcgtttggtccttgcaa

SEQ ID NO: 291047 - DNA, 25 bp, Homo sapien
gcaataaccctatagggcaggtcct

SEQ ID NO: 291048 - DNA, 25 bp, Homo sapien
gggcaggtcctattattagatgcat

SEQ ID NO: 291049 - DNA, 25 bp, Homo sapien
agatgcattttttagctggaggtga

SEQ ID NO: 291050 - DNA, 25 bp, Homo sapien
gctggaggtgatcacactgctgaaa

SEQ ID NO: 291051 - DNA, 25 bp, Homo sapien
tgcagagtttctgactactgtgata

SEQ ID NO: 291052 - DNA, 25 bp, Homo sapien
ctgtgatatagggtcccggatggca

SEQ ID NO: 291053 - DNA, 25 bp, Homo sapien
gagcattgtttgtgcaggtaggatc

SEQ ID NO: 291054 - DNA, 25 bp, Homo sapien
aattgtggccactgttagctggtca

SEQ ID NO: 291055 - DNA, 25 bp, Homo sapien
cagacatcaagcattggtagtgcag

SEQ ID NO: 291056 - DNA, 25 bp, Homo sapien
gtgcagaatctttaatttcactgga

SEQ ID NO: 291057 - DNA, 25 bp, Homo sapien
tgaggacttcaccagttcgaaatta

SEQ ID NO: 291058 - DNA, 25 bp, Homo sapien
ttcaccagttcgaaattacagtttt

SEQ ID NO: 291059 - DNA, 25 bp, Homo sapien
acagttttcaccatcaactacctta

SEQ ID NO: 291060 - DNA, 25 bp, Homo sapien
accatcaactaccttatcctttttg

SEQ ID NO: 291061 - DNA, 25 bp, Homo sapien
atggctgatagtggcttagataaaa

SEQ ID NO: 291062 - DNA, 25 bp, Homo sapien
aaaatgccccgactgttcatctgct

SEQ ID NO: 291063 - DNA, 25 bp, Homo sapien
actttgtgtatgttccagcaaaaca

SEQ ID NO: 291064 - DNA, 25 bp, Homo sapien
ccagcaaaacaagggttcctccagt

SEQ ID NO: 291065 - DNA, 25 bp, Homo sapien
tggtggtggaaatgtcacagacatc

SEQ ID NO: 291066 - DNA, 25 bp, Homo sapien
gcaaagaggatggtacttggtcctt

SEQ ID NO: 291067 - DNA, 25 bp, Homo sapien
gatggtacttggtccttgattaagg

SEQ ID NO: 291068 - DNA, 25 bp, Homo sapien
ggtccttgattaaggttttgccatt

SEQ ID NO: 291069 - DNA, 25 bp, Homo sapien
aggttttgccattgaatccttcaac

SEQ ID NO: 291070 - DNA, 25 bp, Homo sapien
tgccattgaatccttcaacctccta

SEQ ID NO: 291071 - DNA, 25 bp, Homo sapien
ctaccactgcttctagctgtcagtt

SEQ ID NO: 291072 - DNA, 25 bp, Homo sapien
tgcttctagctgtcagttccagaat

SEQ ID NO: 291073 - DNA, 25 bp, Homo sapien
gcattgcgtctaaaggaagctaact

SEQ ID NO: 291074 - DNA, 25 bp, Homo sapien
tcagttccagaatttgaaacgcggt

SEQ ID NO: 291075 - DNA, 25 bp, Homo sapien
atttgaaacgcggtggaagaggcta

SEQ ID NO: 291076 - DNA, 25 bp, Homo sapien
gaggctagtgggtgtacagaaaaac

SEQ ID NO: 291077 - DNA, 25 bp, Homo sapien
agcctaccctcgcagcaacaggtgt

SEQ ID NO: 291078 - DNA, 25 bp, Homo sapien
cctcgcagcaacaggtgtgcacctt

SEQ ID NO: 291079 - DNA, 25 bp, Homo sapien
cttccaagcttgcaacagaccacat

SEQ ID NO: 291080 - DNA, 25 bp, Homo sapien
agcttgcaacagaccacattcagaa

SEQ ID NO: 291081 - DNA, 25 bp, Homo sapien
cagaccacattcagaagcttgattt

SEQ ID NO: 291082 - DNA, 25 bp, Homo sapien
gcttgatttcttgttgttctgggaa

SEQ ID NO: 291083 - DNA, 25 bp, Homo sapien
ggatcagagatttctccaagccact

SEQ ID NO: 291084 - DNA, 25 bp, Homo sapien
gtctgggcgtggttttacccagctc

SEQ ID NO: 291085 - DNA, 25 bp, Homo sapien
ttttacccagctcctttgcgaagct

SEQ ID NO: 291086 - DNA, 25 bp, Homo sapien
tgctgtcctttcctcaacgttacca

SEQ ID NO: 291087 - DNA, 25 bp, Homo sapien
tcaacgttaccacccggctgggcag

SEQ ID NO: 291088 - DNA, 25 bp, Homo sapien
tattggaatcattagggaggacctg

SEQ ID NO: 291089 - DNA, 25 bp, Homo sapien
aatgacaagctgaccaaataggcct

SEQ ID NO: 291090 - DNA, 25 bp, Homo sapien
gtgcctgggcagttacaaggaccta

SEQ ID NO: 291091 - DNA, 25 bp, Homo sapien
gcagttacaaggacctaggtagcag

SEQ ID NO: 291092 - DNA, 25 bp, Homo sapien
agtcattttctttacttgatttaag

SEQ ID NO: 291093 - DNA, 25 bp, Homo sapien
gcacttatttagtttgcataccgta

SEQ ID NO: 291094 - DNA, 25 bp, Homo sapien
tttgcataccgtactcaactcttag

SEQ ID NO: 291095 - DNA, 25 bp, Homo sapien
gtactcaactcttagctagcatagg

SEQ ID NO: 291096 - DNA, 25 bp, Homo sapien
ttagctagcatagggcaggttcctt

SEQ ID NO: 291097 - DNA, 25 bp, Homo sapien
catagggcaggttccttagttgaaa

SEQ ID NO: 291098 - DNA, 25 bp, Homo sapien
gaaagatcagttcccccaaagaata

SEQ ID NO: 291099 - DNA, 25 bp, Homo sapien
ttatctccaaagcagcataagctgc

SEQ ID NO: 291100 - DNA, 25 bp, Homo sapien
gcattaaaggacagccaccagtagg

SEQ ID NO: 291101 - DNA, 25 bp, Homo sapien
ggacagccaccagtaggcttggcag

SEQ ID NO: 291102 - DNA, 25 bp, Homo sapien
gggctgcagtggaaatcaactcaag

SEQ ID NO: 291103 - DNA, 25 bp, Homo sapien
actcaagatgtacacgaaggttttt

SEQ ID NO: 291104 - DNA, 25 bp, Homo sapien
gggcagataccttcaatttaaggct

SEQ ID NO: 291105 - DNA, 25 bp, Homo sapien
ttcaatttaaggctgtgggcacact

SEQ ID NO: 291106 - DNA, 25 bp, Homo sapien
aaggctgtgggcacacttgctcatt

SEQ ID NO: 291107 - DNA, 25 bp, Homo sapien
ggcacacttgctcatttttacttca

SEQ ID NO: 291108 - DNA, 25 bp, Homo sapien
tgtttaggcacagctatttataggg

SEQ ID NO: 291109 - DNA, 25 bp, Homo sapien
gtgcactttgcactagaagactttg

SEQ ID NO: 291110 - DNA, 25 bp, Homo sapien
ggctaaaataaacaatgtctggcaa

SEQ ID NO: 291111 - DNA, 25 bp, Homo sapien
aataaacaatgtctggcaattttca

SEQ ID NO: 291112 - DNA, 25 bp, Homo sapien
taaggttatggagcaactggaatca

SEQ ID NO: 291113 - DNA, 25 bp, Homo sapien
tatggagcaactggaatcagatcag

SEQ ID NO: 291114 - DNA, 25 bp, Homo sapien
actggaatcagatcagtgctattgt

SEQ ID NO: 291115 - DNA, 25 bp, Homo sapien
tgtgaaatgagtttcaatttctgtt

SEQ ID NO: 291116 - DNA, 25 bp, Homo sapien
catgttaaattctattcaaagtgat

SEQ ID NO: 291117 - DNA, 25 bp, Homo sapien
ggaaaatgttattcatccatgcaat

SEQ ID NO: 291118 - DNA, 25 bp, Homo sapien
attcatccatgcaattacccaacaa

SEQ ID NO: 291119 - DNA, 25 bp, Homo sapien
atccatgcaattacccaacaattat

SEQ ID NO: 291120 - DNA, 25 bp, Homo sapien
gcaattacccaacaattatgtattt

SEQ ID NO: 291121 - DNA, 25 bp, Homo sapien
tcttgaccagcgtattttgtagtgt

SEQ ID NO: 291122 - DNA, 25 bp, Homo sapien
tgtagtgttagattcatccatggac

SEQ ID NO: 291123 - DNA, 25 bp, Homo sapien
tcaaaggcaaataccttgggaggtt

SEQ ID NO: 291124 - DNA, 25 bp, Homo sapien
ctttctccctgtttggtgttagaag

SEQ ID NO: 291125 - DNA, 25 bp, Homo sapien
gggtgcaggaccgtttgattccctt

SEQ ID NO: 291126 - DNA, 25 bp, Homo sapien
acgcacttggtgttcagttccagtt

SEQ ID NO: 291127 - DNA, 25 bp, Homo sapien
ttcagttccagttctcgtcggttca

SEQ ID NO: 291128 - DNA, 25 bp, Homo sapien
agttctcgtcggttcatgggccgga

SEQ ID NO: 291129 - DNA, 25 bp, Homo sapien
ttcatgggccggacccggacggcaa

SEQ ID NO: 291130 - DNA, 25 bp, Homo sapien
gcaacttttaccttggtatccgaca

SEQ ID NO: 291131 - DNA, 25 bp, Homo sapien
ggtatccgacatgttggctgcgctc

SEQ ID NO: 291132 - DNA, 25 bp, Homo sapien
ttgttgtcgcgggccgcattgcccg

SEQ ID NO: 291133 - DNA, 25 bp, Homo sapien
gcactgccgccaggtacactggcgc

SEQ ID NO: 291134 - DNA, 25 bp, Homo sapien
ggcgccaacgcgctcggcgtagtgg

SEQ ID NO: 291135 - DNA, 25 bp, Homo sapien
agcagccggtgtacacggcccactg

SEQ ID NO: 291136 - DNA, 25 bp, Homo sapien
cagccggtgtacacggcccactggg

SEQ ID NO: 291137 - DNA, 25 bp, Homo sapien
gtagaccggtgaagcacgacggctc

SEQ ID NO: 291138 - DNA, 25 bp, Homo sapien
agaccggtgaagcacgacggctcaa

SEQ ID NO: 291139 - DNA, 25 bp, Homo sapien
gaccggtgaagcacgacggctcaaa

SEQ ID NO: 291140 - DNA, 25 bp, Homo sapien
accggtgaagcacgacggctcaaac

SEQ ID NO: 291141 - DNA, 25 bp, Homo sapien
ggtgaagcacgacggctcaaacact

SEQ ID NO: 291142 - DNA, 25 bp, Homo sapien
tgaagcacgacggctcaaacactag

SEQ ID NO: 291143 - DNA, 25 bp, Homo sapien
gggccaattcaagtttagctttttg

SEQ ID NO: 291144 - DNA, 25 bp, Homo sapien
gtggaatttttgcaccctgaatatt

SEQ ID NO: 291145 - DNA, 25 bp, Homo sapien
gcaccctgaatattttcaacctgtg

SEQ ID NO: 291146 - DNA, 25 bp, Homo sapien
agggctgactgtactaacactgctg

SEQ ID NO: 291147 - DNA, 25 bp, Homo sapien
ctaacactgctgaaagactgaacca

SEQ ID NO: 291148 - DNA, 25 bp, Homo sapien
gactgaaccagtacaacaccatttg

SEQ ID NO: 291149 - DNA, 25 bp, Homo sapien
gagcaatagattttaagaccagatt

SEQ ID NO: 291150 - DNA, 25 bp, Homo sapien
ccagatttctttgtgctatttttag

SEQ ID NO: 291151 - DNA, 25 bp, Homo sapien
taggttactcagaatagctattata

SEQ ID NO: 291152 - DNA, 25 bp, Homo sapien
attataataccacacatcacctcat

SEQ ID NO: 291153 - DNA, 25 bp, Homo sapien
ataccacacatcacctcatttgtgt

SEQ ID NO: 291154 - DNA, 25 bp, Homo sapien
attggcatgcccacagggtcttctg

SEQ ID NO: 291155 - DNA, 25 bp, Homo sapien
gggtcttctgacctctgattagatc

SEQ ID NO: 291156 - DNA, 25 bp, Homo sapien
gatattgaatcatcagtttctgtac

SEQ ID NO: 291157 - DNA, 25 bp, Homo sapien
gtttctgtacaactatctgaataag

SEQ ID NO: 291158 - DNA, 25 bp, Homo sapien
tttttctatgcttactcctgattgg

SEQ ID NO: 291159 - DNA, 25 bp, Homo sapien
tacaaggccatttgtaattttcctc

SEQ ID NO: 291160 - DNA, 25 bp, Homo sapien
ggtcacccatgagctgcagaaaaaa

SEQ ID NO: 291161 - DNA, 25 bp, Homo sapien
aaggctatttgcagaaggagctcac

SEQ ID NO: 291162 - DNA, 25 bp, Homo sapien
gaaggagctcacagatcacattgaa

SEQ ID NO: 291163 - DNA, 25 bp, Homo sapien
gcattgcatattcaaacatcttggt

SEQ ID NO: 291164 - DNA, 25 bp, Homo sapien
atcttggtcttctttattggcatgc

SEQ ID NO: 291165 - DNA, 25 bp, Homo sapien
caattgctgaatctagatagaacat

SEQ ID NO: 291166 - DNA, 25 bp, Homo sapien
aggagcagcctttgattcttagatg

SEQ ID NO: 291167 - DNA, 25 bp, Homo sapien
gaacataactgttcattattctttt

SEQ ID NO: 291168 - DNA, 25 bp, Homo sapien
ttttccaaatggatagtggctgttt

SEQ ID NO: 291169 - DNA, 25 bp, Homo sapien
gtttttaatttatcattgtgggcag

SEQ ID NO: 291170 - DNA, 25 bp, Homo sapien
tgtgggcagaaaaagcgactgacat

SEQ ID NO: 291171 - DNA, 25 bp, Homo sapien
gcgactgacatacctgctttttggg

SEQ ID NO: 291172 - DNA, 25 bp, Homo sapien
gacatacctgctttttgggttataa

SEQ ID NO: 291173 - DNA, 25 bp, Homo sapien
gattcttagatgtgatgtgcttata

SEQ ID NO: 291174 - DNA, 25 bp, Homo sapien
aagcattacagctatccctgagtct

SEQ ID NO: 291175 - DNA, 25 bp, Homo sapien
agctatccctgagtcttcaaaactt

SEQ ID NO: 291176 - DNA, 25 bp, Homo sapien
tagaggaactaacccaacttatatg

SEQ ID NO: 291177 - DNA, 25 bp, Homo sapien
gtcgtgtagttatggcactgtctta

SEQ ID NO: 291178 - DNA, 25 bp, Homo sapien
tatggcactgtcttatttggaacat

SEQ ID NO: 291179 - DNA, 25 bp, Homo sapien
gtcttatttggaacatttgcaacta

SEQ ID NO: 291180 - DNA, 25 bp, Homo sapien
atttgacaacctactactaatcaca

SEQ ID NO: 291181 - DNA, 25 bp, Homo sapien
ggtttttgcactccatagttgtctt

SEQ ID NO: 291182 - DNA, 25 bp, Homo sapien
gttgtcttagcccaatctttctata

SEQ ID NO: 291183 - DNA, 25 bp, Homo sapien
gcccaatctttctatactcttacga

SEQ ID NO: 291184 - DNA, 25 bp, Homo sapien
tatactcttacgattacttgggtta

SEQ ID NO: 291185 - DNA, 25 bp, Homo sapien
aggaccttctggctcttgagatacc

SEQ ID NO: 291186 - DNA, 25 bp, Homo sapien
ctggctcttgagataccctaaatat

SEQ ID NO: 291187 - DNA, 25 bp, Homo sapien
atactaaaagcttaaatagggccag

SEQ ID NO: 291188 - DNA, 25 bp, Homo sapien
tactaaaagcttaaatagggccagg

SEQ ID NO: 291189 - DNA, 25 bp, Homo sapien
ctaaaagcttaaatagggccaggtg

SEQ ID NO: 291190 - DNA, 25 bp, Homo sapien
ttgaacctgcaagacggaggttatg

SEQ ID NO: 291191 - DNA, 25 bp, Homo sapien
tgaacctgcaagacggaggttatgt

SEQ ID NO: 291192 - DNA, 25 bp, Homo sapien
acctgcaagacggaggttatgtgag

SEQ ID NO: 291193 - DNA, 25 bp, Homo sapien
cctgcaagacggaggttatgtgagt

SEQ ID NO: 291194 - DNA, 25 bp, Homo sapien
ctgcaagacggaggttatgtgagtg

SEQ ID NO: 291195 - DNA, 25 bp, Homo sapien
gcaagacggaggttatgtgagtgga

SEQ ID NO: 291196 - DNA, 25 bp, Homo sapien
gttatgtgagtggagattgagccac

SEQ ID NO: 291197 - DNA, 25 bp, Homo sapien
ttatgtgagtggagattgagccact

SEQ ID NO: 291198 - DNA, 25 bp, Homo sapien
gaacattgccatcatcgaatggact

SEQ ID NO: 291199 - DNA, 25 bp, Homo sapien
catcgaatggacttctgggattctt

SEQ ID NO: 291200 - DNA, 25 bp, Homo sapien
atctgaagtttatccaaaatctgaa

SEQ ID NO: 291201 - DNA, 25 bp, Homo sapien
tgttttgaactcttgtggtcagtat

SEQ ID NO: 291202 - DNA, 25 bp, Homo sapien
gaactcttgtggtcagtatactaca

SEQ ID NO: 291203 - DNA, 25 bp, Homo sapien
gtatactacatttaccatcctaaag

SEQ ID NO: 291204 - DNA, 25 bp, Homo sapien
gatgattttcacttgtggtgcacag

SEQ ID NO: 291205 - DNA, 25 bp, Homo sapien
ttcacttgtggtgcacagaaaagca

SEQ ID NO: 291206 - DNA, 25 bp, Homo sapien
tttattcttttttcacaactctatc

SEQ ID NO: 291207 - DNA, 25 bp, Homo sapien
ttttcacaactctatcttctttatt

SEQ ID NO: 291208 - DNA, 25 bp, Homo sapien
tcttctttattgatgatctttctta

SEQ ID NO: 291209 - DNA, 25 bp, Homo sapien
gttgttttcagcttactctaagttt

SEQ ID NO: 291210 - DNA, 25 bp, Homo sapien
gggtgattcgttatataactgtatt

SEQ ID NO: 291211 - DNA, 25 bp, Homo sapien
gtattaaccacaacatcatgttcca

SEQ ID NO: 291212 - DNA, 25 bp, Homo sapien
ccatttttaccttcgctgtcaggaa

SEQ ID NO: 291213 - DNA, 25 bp, Homo sapien
tcgctgtcaggaaactcaaggtcaa

SEQ ID NO: 291214 - DNA, 25 bp, Homo sapien
tattccttaaatacagcaactgcaa

SEQ ID NO: 291215 - DNA, 25 bp, Homo sapien
gcaactgcaatagccttaagtgtta

SEQ ID NO: 291216 - DNA, 25 bp, Homo sapien
caatagccttaagtgttagaacaac

SEQ ID NO: 291217 - DNA, 25 bp, Homo sapien
ataacactgagcatatatttctatt

SEQ ID NO: 291218 - DNA, 25 bp, Homo sapien
gttatctctgctatgctcatgagcg

SEQ ID NO: 291219 - DNA, 25 bp, Homo sapien
gctcatgagcgtaagaagtggttgt

SEQ ID NO: 291220 - DNA, 25 bp, Homo sapien
gcaaaggtctgttgaacccctccct

SEQ ID NO: 291221 - DNA, 25 bp, Homo sapien
tccctccattcccagttatctgggt

SEQ ID NO: 291222 - DNA, 25 bp, Homo sapien
ttatctgggtcctctggattcttct

SEQ ID NO: 291223 - DNA, 25 bp, Homo sapien
gtttcttgaatcaggctctgctttc

SEQ ID NO: 291224 - DNA, 25 bp, Homo sapien
aggcagcctctgacagtgccgcttt

SEQ ID NO: 291225 - DNA, 25 bp, Homo sapien
tgacagtgccgctttacttgcattc

SEQ ID NO: 291226 - DNA, 25 bp, Homo sapien
ccgctttacttgcattctgcagcaa

SEQ ID NO: 291227 - DNA, 25 bp, Homo sapien
ttctgcagcaattacatgtgtcctt

SEQ ID NO: 291228 - DNA, 25 bp, Homo sapien
tgtgtccttttgatccttgcccaac

SEQ ID NO: 291229 - DNA, 25 bp, Homo sapien
gcccagggcccctcttgctgttttt

SEQ ID NO: 291230 - DNA, 25 bp, Homo sapien
tgtcccaggccacagcaaaggtctg

SEQ ID NO: 291231 - DNA, 25 bp, Homo sapien
cccaggctaggctatgggctaggtt

SEQ ID NO: 291232 - DNA, 25 bp, Homo sapien
tctcgactccgggaaacaaaactat

SEQ ID NO: 291233 - DNA, 25 bp, Homo sapien
ccaggctaggctatgggctaggtta

SEQ ID NO: 291234 - DNA, 25 bp, Homo sapien
aagggcctgggctagaaagagagga

SEQ ID NO: 291235 - DNA, 25 bp, Homo sapien
gaaacaaaactatctcatcgttttt

SEQ ID NO: 291236 - DNA, 25 bp, Homo sapien
ctatctcatcgtttttattttgtgg

SEQ ID NO: 291237 - DNA, 25 bp, Homo sapien
atctcatcgtttttattttgtggtc

SEQ ID NO: 291238 - DNA, 25 bp, Homo sapien
gtacagagcctgtgtccgtgtgtct

SEQ ID NO: 291239 - DNA, 25 bp, Homo sapien
acagagcctgtgtccgtgtgtctgt

SEQ ID NO: 291240 - DNA, 25 bp, Homo sapien
gagcctgtgtccgtgtgtctgtgta

SEQ ID NO: 291241 - DNA, 25 bp, Homo sapien
agcctgtgtccgtgtgtctgtgtat

SEQ ID NO: 291242 - DNA, 25 bp, Homo sapien
ttatggctgctacttcgtcccagca

SEQ ID NO: 291243 - DNA, 25 bp, Homo sapien
tttggatgccatgaatcgagactgt

SEQ ID NO: 291244 - DNA, 25 bp, Homo sapien
tgaatcgagactgtggaattccact

SEQ ID NO: 291245 - DNA, 25 bp, Homo sapien
gaattccactcagtcatttgcaggt

SEQ ID NO: 291246 - DNA, 25 bp, Homo sapien
tggaggaatgaccagcaacaaaatt

SEQ ID NO: 291247 - DNA, 25 bp, Homo sapien
caacaaaattcttatgcagctacaa

SEQ ID NO: 291248 - DNA, 25 bp, Homo sapien
gcagctacaagcagacattctgtat

SEQ ID NO: 291249 - DNA, 25 bp, Homo sapien
gcagacattctgtatataccagtag

SEQ ID NO: 291250 - DNA, 25 bp, Homo sapien
tatataccagtagtgaagccctcaa

SEQ ID NO: 291251 - DNA, 25 bp, Homo sapien
agtagtgaagccctcaatgcccgaa

SEQ ID NO: 291252 - DNA, 25 bp, Homo sapien
tagtgaagccctcaatgcccgaaac

SEQ ID NO: 291253 - DNA, 25 bp, Homo sapien
tagagttttatcaaaccacagccat

SEQ ID NO: 291254 - DNA, 25 bp, Homo sapien
acagccatgcttacttgtttagcta

SEQ ID NO: 291255 - DNA, 25 bp, Homo sapien
gtttagctattgactatggctgctt

SEQ ID NO: 291256 - DNA, 25 bp, Homo sapien
atggctgctttagacaactgtgaca

SEQ ID NO: 291257 - DNA, 25 bp, Homo sapien
aactgtgacagactatatggctcgc

SEQ ID NO: 291258 - DNA, 25 bp, Homo sapien
atatggctcgcaaaactgcaaatat

SEQ ID NO: 291259 - DNA, 25 bp, Homo sapien
atatttcctatcctttaacagaaag

SEQ ID NO: 291260 - DNA, 25 bp, Homo sapien
tttaacagaaagtttgccaacctct

SEQ ID NO: 291261 - DNA, 25 bp, Homo sapien
tgccaacctctgctctagagtagag

SEQ ID NO: 291262 - DNA, 25 bp, Homo sapien
gagggcaatacaactgtcacatcag

SEQ ID NO: 291263 - DNA, 25 bp, Homo sapien
gaactcatttatcaatagaggtgaa

SEQ ID NO: 291264 - DNA, 25 bp, Homo sapien
tatggcgtactcaactgtggacagc

SEQ ID NO: 291265 - DNA, 25 bp, Homo sapien
ctgtggacagctgaaagtctggcat

SEQ ID NO: 291266 - DNA, 25 bp, Homo sapien
aaagtctggcatagcgtgccctcat

SEQ ID NO: 291267 - DNA, 25 bp, Homo sapien
cctcatcatcacaaatgggctcgca

SEQ ID NO: 291268 - DNA, 25 bp, Homo sapien
tgggctcgcattacaagctacactt

SEQ ID NO: 291269 - DNA, 25 bp, Homo sapien
aagctacacttatttgacaactatc

SEQ ID NO: 291270 - DNA, 25 bp, Homo sapien
tatcagcatttgtcaaccggcactc

SEQ ID NO: 291271 - DNA, 25 bp, Homo sapien
ttgtcaaccggcactcagatttgaa

SEQ ID NO: 291272 - DNA, 25 bp, Homo sapien
agttctcttcatgcagagcagctga

SEQ ID NO: 291273 - DNA, 25 bp, Homo sapien
gagcagctgacacaaatcttcaact

SEQ ID NO: 291274 - DNA, 25 bp, Homo sapien
gatggcatctgactgttccaggtat

SEQ ID NO: 291275 - DNA, 25 bp, Homo sapien
gctggctttcagaggctgtcgttaa

SEQ ID NO: 291276 - DNA, 25 bp, Homo sapien
tttcagaggctgtcgttaacttact

SEQ ID NO: 291277 - DNA, 25 bp, Homo sapien
cagagcctcgtagttttcttcccct

SEQ ID NO: 291278 - DNA, 25 bp, Homo sapien
gacacctttacaaaggttactaatg

SEQ ID NO: 291279 - DNA, 25 bp, Homo sapien
tttacaaaggttactaatgtcccag

SEQ ID NO: 291280 - DNA, 25 bp, Homo sapien
ttacaaaggttactaatgtcccagc

SEQ ID NO: 291281 - DNA, 25 bp, Homo sapien
tacaaaggttactaatgtcccagcc

SEQ ID NO: 291282 - DNA, 25 bp, Homo sapien
ttcatcccctactatgtgctggcag

SEQ ID NO: 291283 - DNA, 25 bp, Homo sapien
atcccctactatgtgctggcagctt

SEQ ID NO: 291284 - DNA, 25 bp, Homo sapien
ctactatgtgctggcagctttacct

SEQ ID NO: 291285 - DNA, 25 bp, Homo sapien
tgtcatttcatcctcatggccaccc

SEQ ID NO: 291286 - DNA, 25 bp, Homo sapien
gaatcaacagcctctgctttttcca

SEQ ID NO: 291287 - DNA, 25 bp, Homo sapien
agagaactgaaaatcctggattaac

SEQ ID NO: 291288 - DNA, 25 bp, Homo sapien
tcctggattaactaagtgacagtat

SEQ ID NO: 291289 - DNA, 25 bp, Homo sapien
ttttttgcacttactacacacctcc

SEQ ID NO: 291290 - DNA, 25 bp, Homo sapien
ttactacacacctccactgtataga

SEQ ID NO: 291291 - DNA, 25 bp, Homo sapien
acctccactgtatagaaacctctac

SEQ ID NO: 291292 - DNA, 25 bp, Homo sapien
gaaacctctacagattccaacagac

SEQ ID NO: 291293 - DNA, 25 bp, Homo sapien
actgtagaatctggagtcaatgctc

SEQ ID NO: 291294 - DNA, 25 bp, Homo sapien
gtcaatgctctaatctgttttttat

SEQ ID NO: 291295 - DNA, 25 bp, Homo sapien
gtatctatagtatgtctggagacag

SEQ ID NO: 291296 - DNA, 25 bp, Homo sapien
gacagacaaggctgcacactaaaat

SEQ ID NO: 291297 - DNA, 25 bp, Homo sapien
tattgatgctcctgccacggacaaa

SEQ ID NO: 291298 - DNA, 25 bp, Homo sapien
tcctgccacggacaaaaccctgtta

SEQ ID NO: 291299 - DNA, 25 bp, Homo sapien
accctgttaggtgttgggagagtca

SEQ ID NO: 291300 - DNA, 25 bp, Homo sapien
agggagagacaaacatcagggcagc

SEQ ID NO: 291301 - DNA, 25 bp, Homo sapien
tcagggcagcttttatttggatgta

SEQ ID NO: 291302 - DNA, 25 bp, Homo sapien
ttatttggatgtagaggtgccttgg

SEQ ID NO: 291303 - DNA, 25 bp, Homo sapien
ataggctgctgtttgggtcctgtcc

SEQ ID NO: 291304 - DNA, 25 bp, Homo sapien
gtccctgcatgtagttggccagtaa

SEQ ID NO: 291305 - DNA, 25 bp, Homo sapien
tgaacaggctggcacaggcagaaaa

SEQ ID NO: 291306 - DNA, 25 bp, Homo sapien
ggcacaggcagaaaagcgtttatat

SEQ ID NO: 291307 - DNA, 25 bp, Homo sapien
ttatatgtattgatgctcctgccac

SEQ ID NO: 291308 - DNA, 25 bp, Homo sapien
accaatattccaagcccagatccta

SEQ ID NO: 291309 - DNA, 25 bp, Homo sapien
cgcattaccccgccctggatttggg

SEQ ID NO: 291310 - DNA, 25 bp, Homo sapien
gaaaaaatacgtatatcttgagaga

SEQ ID NO: 291311 - DNA, 25 bp, Homo sapien
gaaaacaaaagccttgcggagtaga

SEQ ID NO: 291312 - DNA, 25 bp, Homo sapien
agagcgcccttgagccttacgcaga

SEQ ID NO: 291313 - DNA, 25 bp, Homo sapien
ccttgagccttacgcagaggtcttg

SEQ ID NO: 291314 - DNA, 25 bp, Homo sapien
gagccttacgcagaggtcttgtgtg

SEQ ID NO: 291315 - DNA, 25 bp, Homo sapien
tacgcagaggtcttgtgtgttccta

SEQ ID NO: 291316 - DNA, 25 bp, Homo sapien
gaggtcttgtgtgttcctagttaag

SEQ ID NO: 291317 - DNA, 25 bp, Homo sapien
ttgtgtgttcctagttaagccctcc

SEQ ID NO: 291318 - DNA, 25 bp, Homo sapien
gtgttcctagttaagccctcccacg

SEQ ID NO: 291319 - DNA, 25 bp, Homo sapien
caatgagtgctgaatgggaaaacat

SEQ ID NO: 291320 - DNA, 25 bp, Homo sapien
tatatcttactataaaaggttctgt

SEQ ID NO: 291321 - DNA, 25 bp, Homo sapien
aatggtagctttattgactgttctg

SEQ ID NO: 291322 - DNA, 25 bp, Homo sapien
ttgactgttctgattgtgctgtttc

SEQ ID NO: 291323 - DNA, 25 bp, Homo sapien
gttctgattgtgctgtttctaattt

SEQ ID NO: 291324 - DNA, 25 bp, Homo sapien
tattgaatctgctaggttttattga

SEQ ID NO: 291325 - DNA, 25 bp, Homo sapien
ggttttattgatgcagccaccactt

SEQ ID NO: 291326 - DNA, 25 bp, Homo sapien
ttgatgcagccaccacttaagtgac

SEQ ID NO: 291327 - DNA, 25 bp, Homo sapien
gcagccaccacttaagtgacataaa

SEQ ID NO: 291328 - DNA, 25 bp, Homo sapien
actgtgaaatgatcactttgtggca

SEQ ID NO: 291329 - DNA, 25 bp, Homo sapien
caaaagtaggttgagttcattgtaa

SEQ ID NO: 291330 - DNA, 25 bp, Homo sapien
aaaagctaggagaagtggcatctga

SEQ ID NO: 291331 - DNA, 25 bp, Homo sapien
gaagtggcatctgaacatttttgct

SEQ ID NO: 291332 - DNA, 25 bp, Homo sapien
atctgaacatttttgctttgctgcc

SEQ ID NO: 291333 - DNA, 25 bp, Homo sapien
ctgaacatttttgctttgctgccag

SEQ ID NO: 291334 - DNA, 25 bp, Homo sapien
gctgccagagtaaccctgactaata

SEQ ID NO: 291335 - DNA, 25 bp, Homo sapien
gccagagtaaccctgactaataata

SEQ ID NO: 291336 - DNA, 25 bp, Homo sapien
tttcctactggcttgaagtttttct

SEQ ID NO: 291337 - DNA, 25 bp, Homo sapien
gactaggtctaaagaatgaacacat

SEQ ID NO: 291338 - DNA, 25 bp, Homo sapien
gaacacattgtaaacagttgccaca

SEQ ID NO: 291339 - DNA, 25 bp, Homo sapien
acagttgccacagtagtttctaata

SEQ ID NO: 291340 - DNA, 25 bp, Homo sapien
gatcataaaagcagctatccttttt

SEQ ID NO: 291341 - DNA, 25 bp, Homo sapien
atcagagaaggcagtctttatataa

SEQ ID NO: 291342 - DNA, 25 bp, Homo sapien
gataaacatcttgataggaatggta

SEQ ID NO: 291343 - DNA, 25 bp, Homo sapien
ggaatggtagttatggtcactttaa

SEQ ID NO: 291344 - DNA, 25 bp, Homo sapien
tggtagttatggtcactttaacaaa

SEQ ID NO: 291345 - DNA, 25 bp, Homo sapien
tacattatttgtgagtattaactga

SEQ ID NO: 291346 - DNA, 25 bp, Homo sapien
aactggcaagtaaagagttaggcta

SEQ ID NO: 291347 - DNA, 25 bp, Homo sapien
tgatctagtctaaaccatgagttta

SEQ ID NO: 291348 - DNA, 25 bp, Homo sapien
tttccttttcactatttcatgcata

SEQ ID NO: 291349 - DNA, 25 bp, Homo sapien
ctatttcatgcatagtttgaactag

SEQ ID NO: 291350 - DNA, 25 bp, Homo sapien
gtttgaactaggatcacttaccaag

SEQ ID NO: 291351 - DNA, 25 bp, Homo sapien
ctaggatcacttaccaagttaatat

SEQ ID NO: 291352 - DNA, 25 bp, Homo sapien
ttttaggtgcacaggcaggaaggta

SEQ ID NO: 291353 - DNA, 25 bp, Homo sapien
gaaggtagctaagccagggattcag

SEQ ID NO: 291354 - DNA, 25 bp, Homo sapien
tctgaagtccagagaacaggagcct

SEQ ID NO: 291355 - DNA, 25 bp, Homo sapien
acaggagcctggaaccaatatttcc

SEQ ID NO: 291356 - DNA, 25 bp, Homo sapien
caatatttccaggtgccccaatgtg

SEQ ID NO: 291357 - DNA, 25 bp, Homo sapien
aggtgccccaatgtgcttgtgtgct

SEQ ID NO: 291358 - DNA, 25 bp, Homo sapien
caatgtgcttgtgtgctggagaaaa

SEQ ID NO: 291359 - DNA, 25 bp, Homo sapien
agagatagccagctagaccctactc

SEQ ID NO: 291360 - DNA, 25 bp, Homo sapien
tgaggctttggtcttcctcacagca

SEQ ID NO: 291361 - DNA, 25 bp, Homo sapien
ttggtcttcctcacagcacaagggc

SEQ ID NO: 291362 - DNA, 25 bp, Homo sapien
acaagggcccacttatttgggagat

SEQ ID NO: 291363 - DNA, 25 bp, Homo sapien
gtcttcttgttgtcgcgggccgcat

SEQ ID NO: 291364 - DNA, 25 bp, Homo sapien
agctccaggatctcagcggtgaggt

SEQ ID NO: 291365 - DNA, 25 bp, Homo sapien
tcagcggtgaggtactccagcactg

SEQ ID NO: 291366 - DNA, 25 bp, Homo sapien
ggcgccaacgcgctcggcgtagtgg

SEQ ID NO: 291367 - DNA, 25 bp, Homo sapien
agcagccggtgtacacggcccactg

SEQ ID NO: 291368 - DNA, 25 bp, Homo sapien
cagccggtgtacacggcccactggg

SEQ ID NO: 291369 - DNA, 25 bp, Homo sapien
cgacatgctagcgaggtagaccggt

SEQ ID NO: 291370 - DNA, 25 bp, Homo sapien
gtagaccggtgaagcacgacggctc

SEQ ID NO: 291371 - DNA, 25 bp, Homo sapien
agaccggtgaagcacgacggctcaa

SEQ ID NO: 291372 - DNA, 25 bp, Homo sapien
accggtgaagcacgacggctcaaac

SEQ ID NO: 291373 - DNA, 25 bp, Homo sapien
ggtgaagcacgacggctcaaacact

SEQ ID NO: 291374 - DNA, 25 bp, Homo sapien
gaaaactgaagaccgccgggtcgca

SEQ ID NO: 291375 - DNA, 25 bp, Homo sapien
gactccgatatattgcccttcttcc

SEQ ID NO: 291376 - DNA, 25 bp, Homo sapien
gcagaaaccctcttctttcctgaag

SEQ ID NO: 291377 - DNA, 25 bp, Homo sapien
agattcgcaaaacttcagacatttt

SEQ ID NO: 291378 - DNA, 25 bp, Homo sapien
tcagacattttcatccaggaagtag

SEQ ID NO: 291379 - DNA, 25 bp, Homo sapien
caggaagtaggaggccgcattaaaa

SEQ ID NO: 291380 - DNA, 25 bp, Homo sapien
aggaggccgcattaaaagaagtatt

SEQ ID NO: 291381 - DNA, 25 bp, Homo sapien
atttgtggaagatttcgcagcctca

SEQ ID NO: 291382 - DNA, 25 bp, Homo sapien
ggaagatttcgcagcctcaagtgct

SEQ ID NO: 291383 - DNA, 25 bp, Homo sapien
gcagcctcaagtgctgagtgtgata

SEQ ID NO: 291384 - DNA, 25 bp, Homo sapien
gtgatattatttgtaggcacataga

SEQ ID NO: 291385 - DNA, 25 bp, Homo sapien
attgaggttctaagctagggcctta

SEQ ID NO: 291386 - DNA, 25 bp, Homo sapien
ggttctaagctagggccttaaatag

SEQ ID NO: 291387 - DNA, 25 bp, Homo sapien
ttaaatagttcagctgtgtcagctc

SEQ ID NO: 291388 - DNA, 25 bp, Homo sapien
agctgtgtcagctctgagaaggagc

SEQ ID NO: 291389 - DNA, 25 bp, Homo sapien
ctctgagaaggagctcggaaacgga

SEQ ID NO: 291390 - DNA, 25 bp, Homo sapien
agctcggaaacggagagcagcctcc

SEQ ID NO: 291391 - DNA, 25 bp, Homo sapien
ggcccacatcagcatggctggtttc

SEQ ID NO: 291392 - DNA, 25 bp, Homo sapien
atggctggtttctacccacgaaggc

SEQ ID NO: 291393 - DNA, 25 bp, Homo sapien
ctgttcctgtgatgtagtaagtcag

SEQ ID NO: 291394 - DNA, 25 bp, Homo sapien
aagctctagggctggttggttcagc

SEQ ID NO: 291395 - DNA, 25 bp, Homo sapien
ttggttcagcaaactgcgtgtctag

SEQ ID NO: 291396 - DNA, 25 bp, Homo sapien
aaccctcgtgggaagatctgtctca

SEQ ID NO: 291397 - DNA, 25 bp, Homo sapien
ccctcgtgggaagatctgtctcaaa

SEQ ID NO: 291398 - DNA, 25 bp, Homo sapien
gtaacaaagaactaaccataacaat

SEQ ID NO: 291399 - DNA, 25 bp, Homo sapien
caaaggtgaaaggtcaattatatca

SEQ ID NO: 291400 - DNA, 25 bp, Homo sapien
ttgtcacaaccaggctggattgttc

SEQ ID NO: 291401 - DNA, 25 bp, Homo sapien
gtcacaaccaggctggattgttcca

SEQ ID NO: 291402 - DNA, 25 bp, Homo sapien
caaccaggctggattgttccaaaaa

SEQ ID NO: 291403 - DNA, 25 bp, Homo sapien
atctagaaggtcaaattcatcatgc

SEQ ID NO: 291404 - DNA, 25 bp, Homo sapien
ctagaaggtcaaattcatcatgcag

SEQ ID NO: 291405 - DNA, 25 bp, Homo sapien
tcatcatgcaggaaggagggtaaga

SEQ ID NO: 291406 - DNA, 25 bp, Homo sapien
gaaatacaacagcaactcactgtaa

SEQ ID NO: 291407 - DNA, 25 bp, Homo sapien
agatgtttatattcaccacgagaag

SEQ ID NO: 291408 - DNA, 25 bp, Homo sapien
attcaccacgagaagccagtcataa

SEQ ID NO: 291409 - DNA, 25 bp, Homo sapien
gtgtgatcaagtgttccgcaagcta

SEQ ID NO: 291410 - DNA, 25 bp, Homo sapien
tgttccgcaagctattccaacttta

SEQ ID NO: 291411 - DNA, 25 bp, Homo sapien
gcaagctattccaactttacaagag

SEQ ID NO: 291412 - DNA, 25 bp, Homo sapien
aattgtgattatgttcttttcacct

SEQ ID NO: 291413 - DNA, 25 bp, Homo sapien
tttcacctgtgggttataaaaaatg

SEQ ID NO: 291414 - DNA, 25 bp, Homo sapien
gttgtattctgaagacccacaaaat

SEQ ID NO: 291415 - DNA, 25 bp, Homo sapien
gacattctgtagtttatacaccgtg

SEQ ID NO: 291416 - DNA, 25 bp, Homo sapien
ttatacaccgtgttgcaaagtgttt

SEQ ID NO: 291417 - DNA, 25 bp, Homo sapien
aagtgtttactgtactatttcaaag

SEQ ID NO: 291418 - DNA, 25 bp, Homo sapien
aaaggacaaattgccgcagtcttct

SEQ ID NO: 291419 - DNA, 25 bp, Homo sapien
aattgccgcagtcttctaattgatg

SEQ ID NO: 291420 - DNA, 25 bp, Homo sapien
tctaattgatgcttccaaactcagg

SEQ ID NO: 291421 - DNA, 25 bp, Homo sapien
tcaggaagggcttatccagtgtaaa

SEQ ID NO: 291422 - DNA, 25 bp, Homo sapien
tccagtgtaaaatagccccaagccc

SEQ ID NO: 291423 - DNA, 25 bp, Homo sapien
agcaaccttctagagggctctggct

SEQ ID NO: 291424 - DNA, 25 bp, Homo sapien
ctctggctgggcagatagcttttgt

SEQ ID NO: 291425 - DNA, 25 bp, Homo sapien
cagccctcagtcaaggaaaatatac

SEQ ID NO: 291426 - DNA, 25 bp, Homo sapien
aaatataccatagctgctttcttgt

SEQ ID NO: 291427 - DNA, 25 bp, Homo sapien
tttcttgtcagtggcctttgagaga

SEQ ID NO: 291428 - DNA, 25 bp, Homo sapien
aattctgttcatctgatagaccggg

SEQ ID NO: 291429 - DNA, 25 bp, Homo sapien
aaacactcagtaaatattagctatt

SEQ ID NO: 291430 - DNA, 25 bp, Homo sapien
gcatagatttatttacctggtttgg

SEQ ID NO: 291431 - DNA, 25 bp, Homo sapien
gtttggaattttgaggatccacctc

SEQ ID NO: 291432 - DNA, 25 bp, Homo sapien
ttgaggatccacctcaaaagctgat

SEQ ID NO: 291433 - DNA, 25 bp, Homo sapien
gaagcagggctcagaacagcccact

SEQ ID NO: 291434 - DNA, 25 bp, Homo sapien
gaacagcccacttgataagagacag

SEQ ID NO: 291435 - DNA, 25 bp, Homo sapien
gacagagtatgtgagtcttatcaaa

SEQ ID NO: 291436 - DNA, 25 bp, Homo sapien
atcaaaggagtgaacccagctggtc

SEQ ID NO: 291437 - DNA, 25 bp, Homo sapien
gaggataatagtacctacatcataa

SEQ ID NO: 291438 - DNA, 25 bp, Homo sapien
acatcataaggtggttctgagtatt

SEQ ID NO: 291439 - DNA, 25 bp, Homo sapien
gagtattaagtaagatgatccatgt

SEQ ID NO: 291440 - DNA, 25 bp, Homo sapien
cacagcagctattatttattggtaa

SEQ ID NO: 291441 - DNA, 25 bp, Homo sapien
aactgtaaacagctcccatatccat

SEQ ID NO: 291442 - DNA, 25 bp, Homo sapien
gtaaacagctcccatatccatcaag

SEQ ID NO: 291443 - DNA, 25 bp, Homo sapien
gaacagttgatactctcaacaacct

SEQ ID NO: 291444 - DNA, 25 bp, Homo sapien
actctcaacaacctagatggacctc

SEQ ID NO: 291445 - DNA, 25 bp, Homo sapien
gatggacctcaaaataattcggttt

SEQ ID NO: 291446 - DNA, 25 bp, Homo sapien
gccaaacttaagaagagtacattgt

SEQ ID NO: 291447 - DNA, 25 bp, Homo sapien
cttggagaactaacttcttgcaata

SEQ ID NO: 291448 - DNA, 25 bp, Homo sapien
aacttcttgcaatagatttttaagc

SEQ ID NO: 291449 - DNA, 25 bp, Homo sapien
aagcactattaggagcatatgactt

SEQ ID NO: 291450 - DNA, 25 bp, Homo sapien
ggagcatatgacttaaacagttttt

SEQ ID NO: 291451 - DNA, 25 bp, Homo sapien
taccgcgctgccaccaaatggaatt

SEQ ID NO: 291452 - DNA, 25 bp, Homo sapien
aatggaattgaccagcggctgttac

SEQ ID NO: 291453 - DNA, 25 bp, Homo sapien
ggctgttacactgttctttgccact

SEQ ID NO: 291454 - DNA, 25 bp, Homo sapien
tgccactgtgcctatgctcagaata

SEQ ID NO: 291455 - DNA, 25 bp, Homo sapien
gaatatgctcactgctaagctacaa

SEQ ID NO: 291456 - DNA, 25 bp, Homo sapien
taagctacaaactcggacagggtca

SEQ ID NO: 291457 - DNA, 25 bp, Homo sapien
gggtcagaaacagaggtgtcccatc

SEQ ID NO: 291458 - DNA, 25 bp, Homo sapien
tggcattggccactgaagggtacaa

SEQ ID NO: 291459 - DNA, 25 bp, Homo sapien
aaaggaccacagcaccacttaggtg

SEQ ID NO: 291460 - DNA, 25 bp, Homo sapien
aactgcagtcagtatcagatcctgt

SEQ ID NO: 291461 - DNA, 25 bp, Homo sapien
taaataagctgactgttctctcttg

SEQ ID NO: 291462 - DNA, 25 bp, Homo sapien
catctcagctatagccgtcttcctg

SEQ ID NO: 291463 - DNA, 25 bp, Homo sapien
atctcagctatagccgtcttcctgg

SEQ ID NO: 291464 - DNA, 25 bp, Homo sapien
ctcagctatagccgtcttcctggtc

SEQ ID NO: 291465 - DNA, 25 bp, Homo sapien
aatgctgaaacctcttcttgggtga

SEQ ID NO: 291466 - DNA, 25 bp, Homo sapien
ctcttcttgggtgaatttggtattg

SEQ ID NO: 291467 - DNA, 25 bp, Homo sapien
tcttcttgggtgaatttggtattgt

SEQ ID NO: 291468 - DNA, 25 bp, Homo sapien
cttcttgggtgaatttggtattgtg

SEQ ID NO: 291469 - DNA, 25 bp, Homo sapien
tcttgggtgaatttggtattgtggt

SEQ ID NO: 291470 - DNA, 25 bp, Homo sapien
aatttggtattgtggtgtgtggtct

SEQ ID NO: 291471 - DNA, 25 bp, Homo sapien
atttggtattgtggtgtgtggtctt

SEQ ID NO: 291472 - DNA, 25 bp, Homo sapien
tttggtattgtggtgtgtggtcttg

SEQ ID NO: 291473 - DNA, 25 bp, Homo sapien
cttccgtttctatttgtgaagggag

SEQ ID NO: 291474 - DNA, 25 bp, Homo sapien
ttccgtttctatttgtgaagggagg

SEQ ID NO: 291475 - DNA, 25 bp, Homo sapien
ccgtttctatttgtgaagggaggag

SEQ ID NO: 291476 - DNA, 25 bp, Homo sapien
tttctatttgtgaagggaggaggaa

SEQ ID NO: 291477 - DNA, 25 bp, Homo sapien
tggccggggactggaatttcatctg

SEQ ID NO: 291478 - DNA, 25 bp, Homo sapien
gccggggactggaatttcatctgaa

SEQ ID NO: 291479 - DNA, 25 bp, Homo sapien
atttcatctgaatgactgcccctgc

SEQ ID NO: 291480 - DNA, 25 bp, Homo sapien
tttcatctgaatgactgcccctgcg

SEQ ID NO: 291481 - DNA, 25 bp, Homo sapien
ttcatctgaatgactgcccctgcgc

SEQ ID NO: 291482 - DNA, 25 bp, Homo sapien
tcatctgaatgactgcccctgcgcg

SEQ ID NO: 291483 - DNA, 25 bp, Homo sapien
aatgactgcccctgcgcgcacgcag

SEQ ID NO: 291484 - DNA, 25 bp, Homo sapien
gaatcgctcagatctttccttggat

SEQ ID NO: 291485 - DNA, 25 bp, Homo sapien
tctttccttggatgaacagcagtgg

SEQ ID NO: 291486 - DNA, 25 bp, Homo sapien
gtgttgactgtgaacaggctgactt

SEQ ID NO: 291487 - DNA, 25 bp, Homo sapien
ggctgacttagctgttgatgtatac

SEQ ID NO: 291488 - DNA, 25 bp, Homo sapien
gatgtatactcagaacctccatctc

SEQ ID NO: 291489 - DNA, 25 bp, Homo sapien
ttttccttctctgcagtctgattct

SEQ ID NO: 291490 - DNA, 25 bp, Homo sapien
ctgattctctaatgactgtcactgg

SEQ ID NO: 291491 - DNA, 25 bp, Homo sapien
gactgtcactggacaaaccccagtt

SEQ ID NO: 291492 - DNA, 25 bp, Homo sapien
accccagttttatgctcgcttagta

SEQ ID NO: 291493 - DNA, 25 bp, Homo sapien
gtggttgacagaactttgtccccaa

SEQ ID NO: 291494 - DNA, 25 bp, Homo sapien
ttgtccccaaacatgcggattcaat

SEQ ID NO: 291495 - DNA, 25 bp, Homo sapien
acgcgacgcagctgctgagccacgg

SEQ ID NO: 291496 - DNA, 25 bp, Homo sapien
ggtgcagcacgtggacaacctgcgc

SEQ ID NO: 291497 - DNA, 25 bp, Homo sapien
tcgtgctgcgcgtggacccagccaa

SEQ ID NO: 291498 - DNA, 25 bp, Homo sapien
aactttccgctgctaatccagtgtt

SEQ ID NO: 291499 - DNA, 25 bp, Homo sapien
aatccagtgtttccacgtcgtgctg

SEQ ID NO: 291500 - DNA, 25 bp, Homo sapien
ccacctgcaggacgagttcaccgtg

SEQ ID NO: 291501 - DNA, 25 bp, Homo sapien
ttcaccgtgcaaatgcaagcggcgt

SEQ ID NO: 291502 - DNA, 25 bp, Homo sapien
aagcggcgtgggacaagttcctgac

SEQ ID NO: 291503 - DNA, 25 bp, Homo sapien
caagttcctgactggtgtggccgtg

SEQ ID NO: 291504 - DNA, 25 bp, Homo sapien
tgtggccgtggtgctgaccgaaaaa

SEQ ID NO: 291505 - DNA, 25 bp, Homo sapien
gaaaaataccgctgagccctgtgct

SEQ ID NO: 291506 - DNA, 25 bp, Homo sapien
ttttgtagctgttcagttgccacta

SEQ ID NO: 291507 - DNA, 25 bp, Homo sapien
gttgccactaagagattgcacagtc

SEQ ID NO: 291508 - DNA, 25 bp, Homo sapien
acgactctaaacacactagtttgga

SEQ ID NO: 291509 - DNA, 25 bp, Homo sapien
aagaatcttctcgtttgaaactttg

SEQ ID NO: 291510 - DNA, 25 bp, Homo sapien
aacacatttactccacatatttttt

SEQ ID NO: 291511 - DNA, 25 bp, Homo sapien
agaaaacgtcacatcaggaaactct

SEQ ID NO: 291512 - DNA, 25 bp, Homo sapien
tctgattttgtggtagctgacatag

SEQ ID NO: 291513 - DNA, 25 bp, Homo sapien
gacatagtgttttcttgtacgtgaa

SEQ ID NO: 291514 - DNA, 25 bp, Homo sapien
tagaatcctgacatgtagtgcacat

SEQ ID NO: 291515 - DNA, 25 bp, Homo sapien
gatgtatagctttaactgaccctgg

SEQ ID NO: 291516 - DNA, 25 bp, Homo sapien
aactgaccctgggttttgcagacca

SEQ ID NO: 291517 - DNA, 25 bp, Homo sapien
ggttatggtggccatccagacataa

SEQ ID NO: 291518 - DNA, 25 bp, Homo sapien
tgaacgttaaacctgtgtggcttag

SEQ ID NO: 291519 - DNA, 25 bp, Homo sapien
agaacgttcattcatctgcagatgc

SEQ ID NO: 291520 - DNA, 25 bp, Homo sapien
agatgctcacacattcctacaggat

SEQ ID NO: 291521 - DNA, 25 bp, Homo sapien
acaggatgactgaaacccacagcaa

SEQ ID NO: 291522 - DNA, 25 bp, Homo sapien
aacccacagcaaacaatcctcatgg

SEQ ID NO: 291523 - DNA, 25 bp, Homo sapien
atcctcatggaatacagctcagctc

SEQ ID NO: 291524 - DNA, 25 bp, Homo sapien
gaggtcagcctcacgggaaattcga

SEQ ID NO: 291525 - DNA, 25 bp, Homo sapien
aaattcgatatctccacatgcagct

SEQ ID NO: 291526 - DNA, 25 bp, Homo sapien
gaaacgagtctaacctcgtctgagc

SEQ ID NO: 291527 - DNA, 25 bp, Homo sapien
agcctcagtttgttcacctaaaaga

SEQ ID NO: 291528 - DNA, 25 bp, Homo sapien
gaaattcctttgaatccaattttgg

SEQ ID NO: 291529 - DNA, 25 bp, Homo sapien
gaatccaattttggcctttgatgat

SEQ ID NO: 291530 - DNA, 25 bp, Homo sapien
tgatgaagggacacttgggcccctg

SEQ ID NO: 291531 - DNA, 25 bp, Homo sapien
acttgggcccctgcctcaggtagat

SEQ ID NO: 291532 - DNA, 25 bp, Homo sapien
cctcaggtagatggtgttcagacac

SEQ ID NO: 291533 - DNA, 25 bp, Homo sapien
gtgttcagacacagcagactgcaga

SEQ ID NO: 291534 - DNA, 25 bp, Homo sapien
acagcagactgcagaagttatatga

SEQ ID NO: 291535 - DNA, 25 bp, Homo sapien
gttatatgagtgtttcttctgaaga

SEQ ID NO: 291536 - DNA, 25 bp, Homo sapien
tctgaagaaccaaagctgaaattta

SEQ ID NO: 291537 - DNA, 25 bp, Homo sapien
ggaattcctttcctgctataaagga

SEQ ID NO: 291538 - DNA, 25 bp, Homo sapien
ctgctataaaggagcatcccctcca

SEQ ID NO: 291539 - DNA, 25 bp, Homo sapien
gagatagagaaccagaaggcagaac

SEQ ID NO: 291540 - DNA, 25 bp, Homo sapien
gaaggcagaacaaggaaaaactcaa

SEQ ID NO: 291541 - DNA, 25 bp, Homo sapien
ggaaacgtaacaggacatgttgcct

SEQ ID NO: 291542 - DNA, 25 bp, Homo sapien
gacatgttgcctcagtgagtcacca

SEQ ID NO: 291543 - DNA, 25 bp, Homo sapien
tcaccaagggctttggagttcttta

SEQ ID NO: 291544 - DNA, 25 bp, Homo sapien
gctttggagttctttagcccaaaat

SEQ ID NO: 291545 - DNA, 25 bp, Homo sapien
tggagttctttagcccaaaatgtgg

SEQ ID NO: 291546 - DNA, 25 bp, Homo sapien
gttctttagcccaaaatgtggttct

SEQ ID NO: 291547 - DNA, 25 bp, Homo sapien
ctttagcccaaaatgtggttctgtg

SEQ ID NO: 291548 - DNA, 25 bp, Homo sapien
tagcccaaaatgtggttctgtggag

SEQ ID NO: 291549 - DNA, 25 bp, Homo sapien
ccaaaatgtggttctgtggaggctg

SEQ ID NO: 291550 - DNA, 25 bp, Homo sapien
ggttctagaacacaacagttcccta

SEQ ID NO: 291551 - DNA, 25 bp, Homo sapien
tagaacacaacagttccctattctc

SEQ ID NO: 291552 - DNA, 25 bp, Homo sapien
agaccacccaagttggtgataagga

SEQ ID NO: 291553 - DNA, 25 bp, Homo sapien
cattgaaaaaatggtgttcctatcc

SEQ ID NO: 291554 - DNA, 25 bp, Homo sapien
aaggaaatggagacctcctactatt

SEQ ID NO: 291555 - DNA, 25 bp, Homo sapien
atggagacctcctactattcactga

SEQ ID NO: 291556 - DNA, 25 bp, Homo sapien
ctactattcactgacctctcagaag

SEQ ID NO: 291557 - DNA, 25 bp, Homo sapien
tgacctctcagaagaataacctcag

SEQ ID NO: 291558 - DNA, 25 bp, Homo sapien
gaagaataacctcagcaaatgccgc

SEQ ID NO: 291559 - DNA, 25 bp, Homo sapien
gaataacctcagcaaatgccgcctc

SEQ ID NO: 291560 - DNA, 25 bp, Homo sapien
ggtgttcctatccaaaattactgaa

SEQ ID NO: 291561 - DNA, 25 bp, Homo sapien
ggtgaacacatgtagcatcgacttt

SEQ ID NO: 291562 - DNA, 25 bp, Homo sapien
gtagcatcgactttttcctctttaa

SEQ ID NO: 291563 - DNA, 25 bp, Homo sapien
gttcgtagcacatccaatcataaac

SEQ ID NO: 291564 - DNA, 25 bp, Homo sapien
aaggacttcttttgtggcttgaata

SEQ ID NO: 291565 - DNA, 25 bp, Homo sapien
tgtggcttgaatagatcgtggatat

SEQ ID NO: 291566 - DNA, 25 bp, Homo sapien
gtagcacatccaatcataaacatca

SEQ ID NO: 291567 - DNA, 25 bp, Homo sapien
tttaatcagtttggctggtttctta

SEQ ID NO: 291568 - DNA, 25 bp, Homo sapien
ttgttggagtccctttccgtatgac

SEQ ID NO: 291569 - DNA, 25 bp, Homo sapien
gtccctttccgtatgacttactaga

SEQ ID NO: 291570 - DNA, 25 bp, Homo sapien
tccgtatgacttactagagaattct

SEQ ID NO: 291571 - DNA, 25 bp, Homo sapien
cttccttctcttttgtgtggtggag

SEQ ID NO: 291572 - DNA, 25 bp, Homo sapien
gatctgaggtgtgcctataccagtt

SEQ ID NO: 291573 - DNA, 25 bp, Homo sapien
ataccagttgttgggtccttcattg

SEQ ID NO: 291574 - DNA, 25 bp, Homo sapien
tcattgggaggacagttctcagaag

SEQ ID NO: 291575 - DNA, 25 bp, Homo sapien
gaagaagctagctcagggccaagaa

SEQ ID NO: 291576 - DNA, 25 bp, Homo sapien
accagtcagggaattccagggtcct

SEQ ID NO: 291577 - DNA, 25 bp, Homo sapien
gggacatagtgggtacccaggcttt

SEQ ID NO: 291578 - DNA, 25 bp, Homo sapien
tgggtgctggcctggagatttttca

SEQ ID NO: 291579 - DNA, 25 bp, Homo sapien
ggagatttttcaccccataagaaga

SEQ ID NO: 291580 - DNA, 25 bp, Homo sapien
tgtacctgtgtgtgaacaccgcagc

SEQ ID NO: 291581 - DNA, 25 bp, Homo sapien
aaccaagttctgttcacactttcta

SEQ ID NO: 291582 - DNA, 25 bp, Homo sapien
tctgtctgcgtctggatctgaggtg

SEQ ID NO: 291583 - DNA, 25 bp, Homo sapien
aaaggaggtgtcagaaggcaaaaag

SEQ ID NO: 291584 - DNA, 25 bp, Homo sapien
agagtactttgaggctcttcggaga

SEQ ID NO: 291585 - DNA, 25 bp, Homo sapien
tactgccattaaatggagccaccat

SEQ ID NO: 291586 - DNA, 25 bp, Homo sapien
ggagccaccatgagttttataaata

SEQ ID NO: 291587 - DNA, 25 bp, Homo sapien
tataaatattacgaagctccaggaa

SEQ ID NO: 291588 - DNA, 25 bp, Homo sapien
tattacgaagctccaggaaatatga

SEQ ID NO: 291589 - DNA, 25 bp, Homo sapien
gagcaggatctcaaatatattcaac

SEQ ID NO: 291590 - DNA, 25 bp, Homo sapien
aaagctgcacagaataaaccaagat

SEQ ID NO: 291591 - DNA, 25 bp, Homo sapien
gattctgagtcttgaaagtttattt

SEQ ID NO: 291592 - DNA, 25 bp, Homo sapien
agacaatgcctgtgccacatatttg

SEQ ID NO: 291593 - DNA, 25 bp, Homo sapien
gccacatatttgacttggttttaat

SEQ ID NO: 291594 - DNA, 25 bp, Homo sapien
gacaagccatccagcggtgaggaat

SEQ ID NO: 291595 - DNA, 25 bp, Homo sapien
atccagcggtgaggaatctctgcca

SEQ ID NO: 291596 - DNA, 25 bp, Homo sapien
tgaggaatctctgccatgttctctt

SEQ ID NO: 291597 - DNA, 25 bp, Homo sapien
tgctgcccacaaacgttacggagac

SEQ ID NO: 291598 - DNA, 25 bp, Homo sapien
aggactcgggcccatagatgcagac

SEQ ID NO: 291599 - DNA, 25 bp, Homo sapien
aatctagcaatagttctcacccttc

SEQ ID NO: 291600 - DNA, 25 bp, Homo sapien
agcaatagttctcacccttccaaag

SEQ ID NO: 291601 - DNA, 25 bp, Homo sapien
cttccaaagctcgagtgccattttg

SEQ ID NO: 291602 - DNA, 25 bp, Homo sapien
gatgacctaccaatgacatgcagta

SEQ ID NO: 291603 - DNA, 25 bp, Homo sapien
aggacataacctcacagccttttta

SEQ ID NO: 291604 - DNA, 25 bp, Homo sapien
taacctcacagcctttttagaagca

SEQ ID NO: 291605 - DNA, 25 bp, Homo sapien
tcctcctgtcaaactccaaataagc

SEQ ID NO: 291606 - DNA, 25 bp, Homo sapien
gaagcacatttgtcccaccaatgca

SEQ ID NO: 291607 - DNA, 25 bp, Homo sapien
caatgcagcagactggtcccctaaa

SEQ ID NO: 291608 - DNA, 25 bp, Homo sapien
ggtcccctaaacacccagatattgg

SEQ ID NO: 291609 - DNA, 25 bp, Homo sapien
agatattggcacaccttccaaggcc

SEQ ID NO: 291610 - DNA, 25 bp, Homo sapien
gccccagctttcacgctatgagaga

SEQ ID NO: 291611 - DNA, 25 bp, Homo sapien
ttttcattaggccatagatctcaga

SEQ ID NO: 291612 - DNA, 25 bp, Homo sapien
gatctcagaagaactccggacattt

SEQ ID NO: 291613 - DNA, 25 bp, Homo sapien
ttcgcagagttgtttatcccattcc

SEQ ID NO: 291614 - DNA, 25 bp, Homo sapien
gttgaaaagcatagtcctacttgca

SEQ ID NO: 291615 - DNA, 25 bp, Homo sapien
acatctgtacagtggacacctccat

SEQ ID NO: 291616 - DNA, 25 bp, Homo sapien
gcgaacacagcccatcctggacttt

SEQ ID NO: 291617 - DNA, 25 bp, Homo sapien
catcctggactttcgaacatttggt

SEQ ID NO: 291618 - DNA, 25 bp, Homo sapien
gaacatttggtctatcaagtggaag

SEQ ID NO: 291619 - DNA, 25 bp, Homo sapien
agtggaagtcagtgagtctctctca

SEQ ID NO: 291620 - DNA, 25 bp, Homo sapien
agcgtgcagcctcgcctcttaggta

SEQ ID NO: 291621 - DNA, 25 bp, Homo sapien
ctcttaggtactcgctggaacccag

SEQ ID NO: 291622 - DNA, 25 bp, Homo sapien
tacacgggctggatttatttgcggc

SEQ ID NO: 291623 - DNA, 25 bp, Homo sapien
tatttgcggcgacagtttgactatg

SEQ ID NO: 291624 - DNA, 25 bp, Homo sapien
acagtttgactatgaatccacccaa

SEQ ID NO: 291625 - DNA, 25 bp, Homo sapien
gtgtttgcttggatccccgaggacg

SEQ ID NO: 291626 - DNA, 25 bp, Homo sapien
ccccgaggacggattcttgcaaaat

SEQ ID NO: 291627 - DNA, 25 bp, Homo sapien
atcttctcttctccatttaccgtct

SEQ ID NO: 291628 - DNA, 25 bp, Homo sapien
ttgactaaaaatctctttataatcc

SEQ ID NO: 291629 - DNA, 25 bp, Homo sapien
tataatccttaatggtatcaaaatt

SEQ ID NO: 291630 - DNA, 25 bp, Homo sapien
tcaaaattaacattagttttcacaa

SEQ ID NO: 291631 - DNA, 25 bp, Homo sapien
taacctttccttgctctaaaaatca

SEQ ID NO: 291632 - DNA, 25 bp, Homo sapien
aacctttccttgctctaaaaatcag

SEQ ID NO: 291633 - DNA, 25 bp, Homo sapien
ctttccttgctctaaaaatcagaga

SEQ ID NO: 291634 - DNA, 25 bp, Homo sapien
aaaatcagagaactaagaaggcttt

SEQ ID NO: 291635 - DNA, 25 bp, Homo sapien
ttagaacagaatacttagagggtga

SEQ ID NO: 291636 - DNA, 25 bp, Homo sapien
acagaatacttagagggtgagaact

SEQ ID NO: 291637 - DNA, 25 bp, Homo sapien
gggtgagaactaatatcatttggat

SEQ ID NO: 291638 - DNA, 25 bp, Homo sapien
ctactactaatcacagaccacaagg

SEQ ID NO: 291639 - DNA, 25 bp, Homo sapien
tactactaatcacagaccacaaggg

SEQ ID NO: 291640 - DNA, 25 bp, Homo sapien
actactaatcacagaccacaagggt

SEQ ID NO: 291641 - DNA, 25 bp, Homo sapien
ctactaatcacagaccacaagggta

SEQ ID NO: 291642 - DNA, 25 bp, Homo sapien
actaatcacagaccacaagggtaat

SEQ ID NO: 291643 - DNA, 25 bp, Homo sapien
taatcacagaccacaagggtaatga

SEQ ID NO: 291644 - DNA, 25 bp, Homo sapien
atcacagaccacaagggtaatgacc

SEQ ID NO: 291645 - DNA, 25 bp, Homo sapien
cagaccacaagggtaatgaccaaat

SEQ ID NO: 291646 - DNA, 25 bp, Homo sapien
gaccacaagggtaatgaccaaattt

SEQ ID NO: 291647 - DNA, 25 bp, Homo sapien
caagggtaatgaccaaatttatgtg

SEQ ID NO: 291648 - DNA, 25 bp, Homo sapien
gggtaatgaccaaatttatgtggtt

SEQ ID NO: 291649 - DNA, 25 bp, Homo sapien
cagatgcgcactggacgctgtcact

SEQ ID NO: 291650 - DNA, 25 bp, Homo sapien
caacggtcaacaccctagcgatgga

SEQ ID NO: 291651 - DNA, 25 bp, Homo sapien
ctagcgatggagaccctccagccag

SEQ ID NO: 291652 - DNA, 25 bp, Homo sapien
agccaggtggcttgggaacgcttca

SEQ ID NO: 291653 - DNA, 25 bp, Homo sapien
gcttgggaacgcttcacgaggtgac

SEQ ID NO: 291654 - DNA, 25 bp, Homo sapien
gaacgcttcacgaggtgacctccag

SEQ ID NO: 291655 - DNA, 25 bp, Homo sapien
acagtgtgctcctccctgcacaggt

SEQ ID NO: 291656 - DNA, 25 bp, Homo sapien
caggtggtcagtctggcctcccgtc

SEQ ID NO: 291657 - DNA, 25 bp, Homo sapien
gccactttgaagagggtaccaggaa

SEQ ID NO: 291658 - DNA, 25 bp, Homo sapien
taccaggaaggtcctggcggtccct

SEQ ID NO: 291659 - DNA, 25 bp, Homo sapien
acctgtcgcggtccttgaacccgag

SEQ ID NO: 291660 - DNA, 25 bp, Homo sapien
ctttggcagaaagtctctaagctac

SEQ ID NO: 291661 - DNA, 25 bp, Homo sapien
gaaagtctctaagctacattcaaag

SEQ ID NO: 291662 - DNA, 25 bp, Homo sapien
gctacattcaaagataactcttcta

SEQ ID NO: 291663 - DNA, 25 bp, Homo sapien
gagcaacaaactctaggtagattga

SEQ ID NO: 291664 - DNA, 25 bp, Homo sapien
aactctaggtagattgaagtctttg

SEQ ID NO: 291665 - DNA, 25 bp, Homo sapien
ctcttataaggcagctaaagcagga

SEQ ID NO: 291666 - DNA, 25 bp, Homo sapien
ggaaaactggctatctgaagaaaac

SEQ ID NO: 291667 - DNA, 25 bp, Homo sapien
aacgtcaagattatagaaaaccatt

SEQ ID NO: 291668 - DNA, 25 bp, Homo sapien
agactatgggacagaagttttacaa

SEQ ID NO: 291669 - DNA, 25 bp, Homo sapien
ttacaaatcgaacattcttactgca

SEQ ID NO: 291670 - DNA, 25 bp, Homo sapien
cattcttactgcagacaagatataa

SEQ ID NO: 291671 - DNA, 25 bp, Homo sapien
gaggcaccataatccctccctaaaa

SEQ ID NO: 291672 - DNA, 25 bp, Homo sapien
gactaacctgatactcttttgaccc

SEQ ID NO: 291673 - DNA, 25 bp, Homo sapien
atactcttttgacccaactgcatca

SEQ ID NO: 291674 - DNA, 25 bp, Homo sapien
atcaacactaaacagctgcagaccc

SEQ ID NO: 291675 - DNA, 25 bp, Homo sapien
ccctgaatctttcacacatgccaag

SEQ ID NO: 291676 - DNA, 25 bp, Homo sapien
acatgccaagtgaacattcttgatg

SEQ ID NO: 291677 - DNA, 25 bp, Homo sapien
tgatgatttctctttgtgaccgcaa

SEQ ID NO: 291678 - DNA, 25 bp, Homo sapien
gatttctctttgtgaccgcaaccac

SEQ ID NO: 291679 - DNA, 25 bp, Homo sapien
acctgcaaaccagaacgactctaga

SEQ ID NO: 291680 - DNA, 25 bp, Homo sapien
cagaacgactctagaatttccttcc

SEQ ID NO: 291681 - DNA, 25 bp, Homo sapien
gtttagtttctaatctcttgtttat

SEQ ID NO: 291682 - DNA, 25 bp, Homo sapien
tttttggagactctttgctttgcca

SEQ ID NO: 291683 - DNA, 25 bp, Homo sapien
tctttggcagttcttttgactccag

SEQ ID NO: 291684 - DNA, 25 bp, Homo sapien
tggcagttcttttgactccagagga

SEQ ID NO: 291685 - DNA, 25 bp, Homo sapien
ttagcaataacttcccatctgatag

SEQ ID NO: 291686 - DNA, 25 bp, Homo sapien
gcaataacttcccatctgataggat

SEQ ID NO: 291687 - DNA, 25 bp, Homo sapien
cttcccatctgataggatatattat

SEQ ID NO: 291688 - DNA, 25 bp, Homo sapien
acagatcatcatttaatctttcatt

SEQ ID NO: 291689 - DNA, 25 bp, Homo sapien
aaaccattagatttttactgcagaa

SEQ ID NO: 291690 - DNA, 25 bp, Homo sapien
gatttttactgcagaaaggttatag

SEQ ID NO: 291691 - DNA, 25 bp, Homo sapien
gtaacaaatggacttctcaaaactc

SEQ ID NO: 291692 - DNA, 25 bp, Homo sapien
ggacttctcaaaactcaccaagttt

SEQ ID NO: 291693 - DNA, 25 bp, Homo sapien
tgaaaagcaggtaccagtgcccctt

SEQ ID NO: 291694 - DNA, 25 bp, Homo sapien
gtgccccttttcagacagtttttga

SEQ ID NO: 291695 - DNA, 25 bp, Homo sapien
gccccttttcagacagtttttgatt

SEQ ID NO: 291696 - DNA, 25 bp, Homo sapien
agacagtttttgattcgctctagac

SEQ ID NO: 291697 - DNA, 25 bp, Homo sapien
tttctacatgcacttaagactaaaa

SEQ ID NO: 291698 - DNA, 25 bp, Homo sapien
gcacttaagactaaaacacaggttt

SEQ ID NO: 291699 - DNA, 25 bp, Homo sapien
tttttccgcttttcttcccgcagag

SEQ ID NO: 291700 - DNA, 25 bp, Homo sapien
ttttcttcccgcagagcctgatggg

SEQ ID NO: 291701 - DNA, 25 bp, Homo sapien
ccacattttttgtaggtgataactc

SEQ ID NO: 291702 - DNA, 25 bp, Homo sapien
tgataactcaatgaaaattggtgct

SEQ ID NO: 291703 - DNA, 25 bp, Homo sapien
ctcttgtggctctcttgtggtgcta

SEQ ID NO: 291704 - DNA, 25 bp, Homo sapien
aatctcgtcctgagcccttattatg

SEQ ID NO: 291705 - DNA, 25 bp, Homo sapien
tcctgagcccttattatgcctgtgg

SEQ ID NO: 291706 - DNA, 25 bp, Homo sapien
attatgcctgtggtagagcaatgca

SEQ ID NO: 291707 - DNA, 25 bp, Homo sapien
tgcctgtggtagagcaatgcaagac

SEQ ID NO: 291708 - DNA, 25 bp, Homo sapien
atgcaagactgaaaaggttgccagt

SEQ ID NO: 291709 - DNA, 25 bp, Homo sapien
aaggttgccagtattttcaggctta

SEQ ID NO: 291710 - DNA, 25 bp, Homo sapien
ttttcaggcttatttgactaagaat

SEQ ID NO: 291711 - DNA, 25 bp, Homo sapien
ctaagaattagtgccaagaactgga

SEQ ID NO: 291712 - DNA, 25 bp, Homo sapien
attagtgccaagaactggaaagtct

SEQ ID NO: 291713 - DNA, 25 bp, Homo sapien
gtatagatgttatttcacccttaag

SEQ ID NO: 291714 - DNA, 25 bp, Homo sapien
agatgttatttcacccttaaggcac

SEQ ID NO: 291715 - DNA, 25 bp, Homo sapien
aaatgtgagctatgcctgcctgaat

SEQ ID NO: 291716 - DNA, 25 bp, Homo sapien
acacagtccccagtagacagtggtg

SEQ ID NO: 291717 - DNA, 25 bp, Homo sapien
cagtggtgccacagttgaactcaga

SEQ ID NO: 291718 - DNA, 25 bp, Homo sapien
gaactggctgattccaaagcccagt

SEQ ID NO: 291719 - DNA, 25 bp, Homo sapien
cgctggatttcctgagcagtctgga

SEQ ID NO: 291720 - DNA, 25 bp, Homo sapien
ctgagcagtctggaaggtttacaaa

SEQ ID NO: 291721 - DNA, 25 bp, Homo sapien
acaaatgggcacagagggaggctcc

SEQ ID NO: 291722 - DNA, 25 bp, Homo sapien
ggaggctcccagaagctgggacaat

SEQ ID NO: 291723 - DNA, 25 bp, Homo sapien
agacacttgcccaagtttgtctcct

SEQ ID NO: 291724 - DNA, 25 bp, Homo sapien
aagtttgtctcctcgtgagcagcaa

SEQ ID NO: 291725 - DNA, 25 bp, Homo sapien
tctcctcgtgagcagcaaggctgaa

SEQ ID NO: 291726 - DNA, 25 bp, Homo sapien
ggaaaggcgatctcttcactgtgaa

SEQ ID NO: 291727 - DNA, 25 bp, Homo sapien
cttcactgtgaaaagttgcccgggt

SEQ ID NO: 291728 - DNA, 25 bp, Homo sapien
aaagttgcccgggtgcagcgccttt

SEQ ID NO: 291729 - DNA, 25 bp, Homo sapien
gccttttccttctaccatgggaaat

SEQ ID NO: 291730 - DNA, 25 bp, Homo sapien
catgggaaatgcaggctgggccctt

SEQ ID NO: 291731 - DNA, 25 bp, Homo sapien
accaccagaatgcagttccagctta

SEQ ID NO: 291732 - DNA, 25 bp, Homo sapien
gcagttccagcttaggaagccacaa

SEQ ID NO: 291733 - DNA, 25 bp, Homo sapien
aggaggaacaaaacaccgccagcgt

SEQ ID NO: 291734 - DNA, 25 bp, Homo sapien
accgccagcgtggattttccaaatt

SEQ ID NO: 291735 - DNA, 25 bp, Homo sapien
tccctggaaagtaagtctcgctctt

SEQ ID NO: 291736 - DNA, 25 bp, Homo sapien
gtaagtctcgctcttgccaaagaaa

SEQ ID NO: 291737 - DNA, 25 bp, Homo sapien
tgtggagtcagggacagccttcagt

SEQ ID NO: 291738 - DNA, 25 bp, Homo sapien
ggacagccttcagtgacattaatct

SEQ ID NO: 291739 - DNA, 25 bp, Homo sapien
gaaggactggactgactatgatgaa

SEQ ID NO: 291740 - DNA, 25 bp, Homo sapien
ggaatctatgaggtcacccaccagt

SEQ ID NO: 291741 - DNA, 25 bp, Homo sapien
gaggtcacccaccagtttgtgaagt

SEQ ID NO: 291742 - DNA, 25 bp, Homo sapien
tttgtgaagtgctgatccctcttcc

SEQ ID NO: 291743 - DNA, 25 bp, Homo sapien
ttcccagttgcccttaagaactgag

SEQ ID NO: 291744 - DNA, 25 bp, Homo sapien
gtactctaagcagcagagcccacag

SEQ ID NO: 291745 - DNA, 25 bp, Homo sapien
agaggctcgttcctttgacccttgt

SEQ ID NO: 291746 - DNA, 25 bp, Homo sapien
ttgtctcctggtggctatacgaaac

SEQ ID NO: 291747 - DNA, 25 bp, Homo sapien
ggactttattacagcttcccaagcc

SEQ ID NO: 291748 - DNA, 25 bp, Homo sapien
agttccactccacatagtatgcaca

SEQ ID NO: 291749 - DNA, 25 bp, Homo sapien
acatagtatgcacagataggccaga

SEQ ID NO: 291750 - DNA, 25 bp, Homo sapien
gtatgcacagataggccagaatgct

SEQ ID NO: 291751 - DNA, 25 bp, Homo sapien
agataggccagaatgctaatatact

SEQ ID NO: 291752 - DNA, 25 bp, Homo sapien
tgaacagtttgagcttagaagtaga

SEQ ID NO: 291753 - DNA, 25 bp, Homo sapien
gagagtaccctaaattcttggagag

SEQ ID NO: 291754 - DNA, 25 bp, Homo sapien
gagtaccctaaattcttggagagga

SEQ ID NO: 291755 - DNA, 25 bp, Homo sapien
aaagggcttattgtggaggactcat

SEQ ID NO: 291756 - DNA, 25 bp, Homo sapien
aaatctctagaccttgagttatgtg

SEQ ID NO: 291757 - DNA, 25 bp, Homo sapien
gaccttgagttatgtgtaagtcttc

SEQ ID NO: 291758 - DNA, 25 bp, Homo sapien
gagttatgtgtaagtcttcagaggc

SEQ ID NO: 291759 - DNA, 25 bp, Homo sapien
aagaaaaccatctctgcacactacc

SEQ ID NO: 291760 - DNA, 25 bp, Homo sapien
gaaaaccatctctgcacactaccaa

SEQ ID NO: 291761 - DNA, 25 bp, Homo sapien
actaccaaacagacagtgcgtgaac

SEQ ID NO: 291762 - DNA, 25 bp, Homo sapien
agtgcgtgaacgaagcagaccctcc

SEQ ID NO: 291763 - DNA, 25 bp, Homo sapien
gcgtgaacgaagcagaccctcctga

SEQ ID NO: 291764 - DNA, 25 bp, Homo sapien
gagcttggtgaaactggtgctcaag

SEQ ID NO: 291765 - DNA, 25 bp, Homo sapien
ggtgctcaaggtagaaattccctgc

SEQ ID NO: 291766 - DNA, 25 bp, Homo sapien
aaggtagaaattccctgcgattgct

SEQ ID NO: 291767 - DNA, 25 bp, Homo sapien
tagaaattccctgcgattgctactg

SEQ ID NO: 291768 - DNA, 25 bp, Homo sapien
aaattccctgcgattgctactgcaa

SEQ ID NO: 291769 - DNA, 25 bp, Homo sapien
tccctgcgattgctactgcaactta

SEQ ID NO: 291770 - DNA, 25 bp, Homo sapien
actgaatatttctgtggtctttttg

SEQ ID NO: 291771 - DNA, 25 bp, Homo sapien
gatttgattcagactcgcaattatg

SEQ ID NO: 291772 - DNA, 25 bp, Homo sapien
gactcgcaattatgtttcagcaatg

SEQ ID NO: 291773 - DNA, 25 bp, Homo sapien
taaagctctttacccctaatatgcc

SEQ ID NO: 291774 - DNA, 25 bp, Homo sapien
ttacccctaatatgcctaatcactg

SEQ ID NO: 291775 - DNA, 25 bp, Homo sapien
gcctaatcactgtattgtgcataga

SEQ ID NO: 291776 - DNA, 25 bp, Homo sapien
atgtactctcaattacctaaaaatg

SEQ ID NO: 291777 - DNA, 25 bp, Homo sapien
aatgcttctggattagtattgttct

SEQ ID NO: 291778 - DNA, 25 bp, Homo sapien
tagtattgttctggactgtcatagg

SEQ ID NO: 291779 - DNA, 25 bp, Homo sapien
gttctggactgtcataggtatgagt

SEQ ID NO: 291780 - DNA, 25 bp, Homo sapien
tgagtggaacattgcaaaaccttat

SEQ ID NO: 291781 - DNA, 25 bp, Homo sapien
tgaactcaggcttctgacactccaa

SEQ ID NO: 291782 - DNA, 25 bp, Homo sapien
aactcaggcttctgacactccaaag

SEQ ID NO: 291783 - DNA, 25 bp, Homo sapien
tcttaactcttcagtgtactgtgaa

SEQ ID NO: 291784 - DNA, 25 bp, Homo sapien
gtgtactgtgaaccttactgcaaca

SEQ ID NO: 291785 - DNA, 25 bp, Homo sapien
ttactgcaacagactccagatgaga

SEQ ID NO: 291786 - DNA, 25 bp, Homo sapien
gatgagaatctcagcatggtagcta

SEQ ID NO: 291787 - DNA, 25 bp, Homo sapien
gcatggtagctaattagttgtgctt

SEQ ID NO: 291788 - DNA, 25 bp, Homo sapien
gctaattagttgtgcttggagaagc

SEQ ID NO: 291789 - DNA, 25 bp, Homo sapien
agaagcatgaggagtctcccctgct

SEQ ID NO: 291790 - DNA, 25 bp, Homo sapien
ggaggccagagacagcaagcaattt

SEQ ID NO: 291791 - DNA, 25 bp, Homo sapien
gcaatttgcccaagacgacacagct

SEQ ID NO: 291792 - DNA, 25 bp, Homo sapien
gaattttgtttttgaagtaatgctt

SEQ ID NO: 291793 - DNA, 25 bp, Homo sapien
gaaagttgaaggttacacaaattgt

SEQ ID NO: 291794 - DNA, 25 bp, Homo sapien
caaattgttttaggtatgagcagaa

SEQ ID NO: 291795 - DNA, 25 bp, Homo sapien
gcagaagaggttaaggtatttctaa

SEQ ID NO: 291796 - DNA, 25 bp, Homo sapien
caagagtttcctcaaaatagttatt

SEQ ID NO: 291797 - DNA, 25 bp, Homo sapien
gaatcagaatgtctgtgtatttctt

SEQ ID NO: 291798 - DNA, 25 bp, Homo sapien
gtctgtttctatgttgtcttatagc

SEQ ID NO: 291799 - DNA, 25 bp, Homo sapien
ctatgttgtcttatagctctgacta

SEQ ID NO: 291800 - DNA, 25 bp, Homo sapien
gttgtcttatagctctgactaaatg

SEQ ID NO: 291801 - DNA, 25 bp, Homo sapien
gctctgactaaatgtgtttacctat

SEQ ID NO: 291802 - DNA, 25 bp, Homo sapien
aaatgtgtttacctatgcaaaagat

SEQ ID NO: 291803 - DNA, 25 bp, Homo sapien
gcatttggactcacagaatctgcct

SEQ ID NO: 291804 - DNA, 25 bp, Homo sapien
cagaatctgccttccaatctcagtg

SEQ ID NO: 291805 - DNA, 25 bp, Homo sapien
aatctcagtgctgcttctactcctt

SEQ ID NO: 291806 - DNA, 25 bp, Homo sapien
tactcctttgctaccttaggtcttt

SEQ ID NO: 291807 - DNA, 25 bp, Homo sapien
agacaggtccataccttgggtgttt

SEQ ID NO: 291808 - DNA, 25 bp, Homo sapien
gggtgtttgtatttggacaaccaca

SEQ ID NO: 291809 - DNA, 25 bp, Homo sapien
gtatctgttctacttgcacaccttc

SEQ ID NO: 291810 - DNA, 25 bp, Homo sapien
tcaccacctggatgctgcttgagga

SEQ ID NO: 291811 - DNA, 25 bp, Homo sapien
ggacacagatctggtccatcagatt

SEQ ID NO: 291812 - DNA, 25 bp, Homo sapien
aagtccttcagtacagcctgggagc

SEQ ID NO: 291813 - DNA, 25 bp, Homo sapien
ggaagctgttaggagttgccatgat

SEQ ID NO: 291814 - DNA, 25 bp, Homo sapien
tctgccctcgtgtatttactatgct

SEQ ID NO: 291815 - DNA, 25 bp, Homo sapien
tatttactatgctgcctccctgatt

SEQ ID NO: 291816 - DNA, 25 bp, Homo sapien
cctgatttctgaccggttcctggag

SEQ ID NO: 291817 - DNA, 25 bp, Homo sapien
gaccggttcctggagcacttaaagt

SEQ ID NO: 291818 - DNA, 25 bp, Homo sapien
tggagcaactacttcacactcagca

SEQ ID NO: 291819 - DNA, 25 bp, Homo sapien
catgtgctgttttattgctacgaac

SEQ ID NO: 291820 - DNA, 25 bp, Homo sapien
acatctttttaggttcaggccctgt

SEQ ID NO: 291821 - DNA, 25 bp, Homo sapien
gattttatatcagcttgcctcacta

SEQ ID NO: 291822 - DNA, 25 bp, Homo sapien
agcttgcctcactaggacttagcac

SEQ ID NO: 291823 - DNA, 25 bp, Homo sapien
ggacttagcacaatgctctcaaata

SEQ ID NO: 291824 - DNA, 25 bp, Homo sapien
gagcctagttaactgctcctttatt

SEQ ID NO: 291825 - DNA, 25 bp, Homo sapien
gagtactaagagggcccgcgccgcg

SEQ ID NO: 291826 - DNA, 25 bp, Homo sapien
cctcatggaaagagctgagccgctt

SEQ ID NO: 291827 - DNA, 25 bp, Homo sapien
tcatggaaagagctgagccgcttca

SEQ ID NO: 291828 - DNA, 25 bp, Homo sapien
atggaaagagctgagccgcttcaga

SEQ ID NO: 291829 - DNA, 25 bp, Homo sapien
tggaaagagctgagccgcttcagac

SEQ ID NO: 291830 - DNA, 25 bp, Homo sapien
ggaaagagctgagccgcttcagact

SEQ ID NO: 291831 - DNA, 25 bp, Homo sapien
aaagagctgagccgcttcagactgc

SEQ ID NO: 291832 - DNA, 25 bp, Homo sapien
gagctgagccgcttcagactgcggg

SEQ ID NO: 291833 - DNA, 25 bp, Homo sapien
tagggttcgggccttccggatgcgg

SEQ ID NO: 291834 - DNA, 25 bp, Homo sapien
ggttcgggccttccggatgcggctt

SEQ ID NO: 291835 - DNA, 25 bp, Homo sapien
gggccttccggatgcggcttgggcg

SEQ ID NO: 291836 - DNA, 25 bp, Homo sapien
acaaaaccaaaatctggaacatgtt

SEQ ID NO: 291837 - DNA, 25 bp, Homo sapien
tacatgtgaacatcaaggctccaag

SEQ ID NO: 291838 - DNA, 25 bp, Homo sapien
gaacatcaaggctccaaggtaaagt

SEQ ID NO: 291839 - DNA, 25 bp, Homo sapien
caaggctccaaggtaaagttacatt

SEQ ID NO: 291840 - DNA, 25 bp, Homo sapien
taaggctaaattttattcagttctt

SEQ ID NO: 291841 - DNA, 25 bp, Homo sapien
tttattcagttctttattctcttaa

SEQ ID NO: 291842 - DNA, 25 bp, Homo sapien
attctcttaaagtcctacagcctac

SEQ ID NO: 291843 - DNA, 25 bp, Homo sapien
taaagtcctacagcctacaagcatg

SEQ ID NO: 291844 - DNA, 25 bp, Homo sapien
agtcctacagcctacaagcatgaag

SEQ ID NO: 291845 - DNA, 25 bp, Homo sapien
caagcatgaagccaacaggatgtaa

SEQ ID NO: 291846 - DNA, 25 bp, Homo sapien
gaagccaacaggatgtaaaacaacc

SEQ ID NO: 291847 - DNA, 25 bp, Homo sapien
taacttgctcaggattgcacggctg

SEQ ID NO: 291848 - DNA, 25 bp, Homo sapien
ttgcacggctggtgagcagcagtca

SEQ ID NO: 291849 - DNA, 25 bp, Homo sapien
tgataccaggccaggttcctttact

SEQ ID NO: 291850 - DNA, 25 bp, Homo sapien
ggttcctttactccagagttctcaa

SEQ ID NO: 291851 - DNA, 25 bp, Homo sapien
gtctcacgtcttctttagtctttag

SEQ ID NO: 291852 - DNA, 25 bp, Homo sapien
gagagacattttcaactgactcctt

SEQ ID NO: 291853 - DNA, 25 bp, Homo sapien
ttcaactgactccttagtggctaag

SEQ ID NO: 291854 - DNA, 25 bp, Homo sapien
ggacaaacagacaaaccctggccgc

SEQ ID NO: 291855 - DNA, 25 bp, Homo sapien
ggctaccatgctagcgggccgctga

SEQ ID NO: 291856 - DNA, 25 bp, Homo sapien
ctagcgggccgctgagtcggaatcc

SEQ ID NO: 291857 - DNA, 25 bp, Homo sapien
gtggctgtgttaggataacttgctc

SEQ ID NO: 291858 - DNA, 25 bp, Homo sapien
ttcaacaccctcttcttgaactggt

SEQ ID NO: 291859 - DNA, 25 bp, Homo sapien
tcaacaccctcttcttgaactggtg

SEQ ID NO: 291860 - DNA, 25 bp, Homo sapien
ttcttgaactggtgctgtctgggct

SEQ ID NO: 291861 - DNA, 25 bp, Homo sapien
tcttgaactggtgctgtctgggctt

SEQ ID NO: 291862 - DNA, 25 bp, Homo sapien
cttgaactggtgctgtctgggcttc

SEQ ID NO: 291863 - DNA, 25 bp, Homo sapien
ttgaactggtgctgtctgggcttca

SEQ ID NO: 291864 - DNA, 25 bp, Homo sapien
tgaactggtgctgtctgggcttcat

SEQ ID NO: 291865 - DNA, 25 bp, Homo sapien
gaactggtgctgtctgggcttcata

SEQ ID NO: 291866 - DNA, 25 bp, Homo sapien
aactggtgctgtctgggcttcatag

SEQ ID NO: 291867 - DNA, 25 bp, Homo sapien
actggtgctgtctgggcttcatagc

SEQ ID NO: 291868 - DNA, 25 bp, Homo sapien
ctggtgctgtctgggcttcatagca

SEQ ID NO: 291869 - DNA, 25 bp, Homo sapien
gagagttgctattttctgttgggca

SEQ ID NO: 291870 - DNA, 25 bp, Homo sapien
gagtaagccttgagagcatcttgaa

SEQ ID NO: 291871 - DNA, 25 bp, Homo sapien
gcatcttgaagaagtgttcactctt

SEQ ID NO: 291872 - DNA, 25 bp, Homo sapien
aagtgttcactcttctactgttcaa

SEQ ID NO: 291873 - DNA, 25 bp, Homo sapien
tcttctactgttcaactagttgtgt

SEQ ID NO: 291874 - DNA, 25 bp, Homo sapien
tagttgtgtaaaccactagtggtcc

SEQ ID NO: 291875 - DNA, 25 bp, Homo sapien
tagtggtcctctagtatccattgtc

SEQ ID NO: 291876 - DNA, 25 bp, Homo sapien
tagtatccattgtctcctttcttta

SEQ ID NO: 291877 - DNA, 25 bp, Homo sapien
ccattgtctcctttctttatgtaaa

SEQ ID NO: 291878 - DNA, 25 bp, Homo sapien
gaacctctaaattttctgttggcat

SEQ ID NO: 291879 - DNA, 25 bp, Homo sapien
ttctgttggcatatgaccactgaaa

SEQ ID NO: 291880 - DNA, 25 bp, Homo sapien
aaagagacagacgaggaggaaccca

SEQ ID NO: 291881 - DNA, 25 bp, Homo sapien
gacgaggaggaacccaattactagg

SEQ ID NO: 291882 - DNA, 25 bp, Homo sapien
aattgtcaacaggtatgcacgtagc

SEQ ID NO: 291883 - DNA, 25 bp, Homo sapien
ggtatgcacgtagcatctgcgattc

SEQ ID NO: 291884 - DNA, 25 bp, Homo sapien
gcacgtagcatctgcgattccggga

SEQ ID NO: 291885 - DNA, 25 bp, Homo sapien
tagcatctgcgattccgggagagct

SEQ ID NO: 291886 - DNA, 25 bp, Homo sapien
cgattccgggagagctgacaggcta

SEQ ID NO: 291887 - DNA, 25 bp, Homo sapien
gacaggctaggagccagctgtagct

SEQ ID NO: 291888 - DNA, 25 bp, Homo sapien
ggctaggagccagctgtagcttaca

SEQ ID NO: 291889 - DNA, 25 bp, Homo sapien
ggagccagctgtagcttacacttga

SEQ ID NO: 291890 - DNA, 25 bp, Homo sapien
gccagctgtagcttacacttgaaaa

SEQ ID NO: 291891 - DNA, 25 bp, Homo sapien
caattgtgtggtcagtggctctttt

SEQ ID NO: 291892 - DNA, 25 bp, Homo sapien
gtcagtggctcttttacccaataag

SEQ ID NO: 291893 - DNA, 25 bp, Homo sapien
cacagtcacatgcttgatggtttat

SEQ ID NO: 291894 - DNA, 25 bp, Homo sapien
aaaatctctctctgttgtgttcgtt

SEQ ID NO: 291895 - DNA, 25 bp, Homo sapien
taaagtcttgctgtggtctctttgt

SEQ ID NO: 291896 - DNA, 25 bp, Homo sapien
gtctctttgtggcagaagtgtttca

SEQ ID NO: 291897 - DNA, 25 bp, Homo sapien
gtgtttcatgcatggcagcaggcct

SEQ ID NO: 291898 - DNA, 25 bp, Homo sapien
tggcagcaggcctgttgctttttta

SEQ ID NO: 291899 - DNA, 25 bp, Homo sapien
aaaggattgcaagggccagatctgt

SEQ ID NO: 291900 - DNA, 25 bp, Homo sapien
ggccagatctgttaagtggtttcat

SEQ ID NO: 291901 - DNA, 25 bp, Homo sapien
ggtttcataggagacacatccagca

SEQ ID NO: 291902 - DNA, 25 bp, Homo sapien
taagtgatttatcagcaccactaga

SEQ ID NO: 291903 - DNA, 25 bp, Homo sapien
gaaatgcaggacaagcctcgtagga

SEQ ID NO: 291904 - DNA, 25 bp, Homo sapien
gcctcgtaggaagcaaggtcccagt

SEQ ID NO: 291905 - DNA, 25 bp, Homo sapien
gtcccagtggatgagatgctgtcct

SEQ ID NO: 291906 - DNA, 25 bp, Homo sapien
ttccaccactagtattcaccatatc

SEQ ID NO: 291907 - DNA, 25 bp, Homo sapien
tgtgtgcatgtgagtcggcctcccc

SEQ ID NO: 291908 - DNA, 25 bp, Homo sapien
ggcctcccctctatgatgtgagtag

SEQ ID NO: 291909 - DNA, 25 bp, Homo sapien
gtgagtagggacctatttttgctca

SEQ ID NO: 291910 - DNA, 25 bp, Homo sapien
tttttgctcatctctgtatcctcta

SEQ ID NO: 291911 - DNA, 25 bp, Homo sapien
tgtatcctctacacacgatgcttgg

SEQ ID NO: 291912 - DNA, 25 bp, Homo sapien
acgatgcttggcacacagcaagtat

SEQ ID NO: 291913 - DNA, 25 bp, Homo sapien
tggtagttgaacatagaacttgggt

SEQ ID NO: 291914 - DNA, 25 bp, Homo sapien
gaacttgggtattatagatcacttt

SEQ ID NO: 291915 - DNA, 25 bp, Homo sapien
ttatagatcacttttcactttttgg

SEQ ID NO: 291916 - DNA, 25 bp, Homo sapien
cactttttggaatgttttgtattga

SEQ ID NO: 291917 - DNA, 25 bp, Homo sapien
taggatatagagtttgtaccaaata

SEQ ID NO: 291918 - DNA, 25 bp, Homo sapien
tattgttcaaagcaaggagtatgtt

SEQ ID NO: 291919 - DNA, 25 bp, Homo sapien
aaatgaccagacacctgtttgataa

SEQ ID NO: 291920 - DNA, 25 bp, Homo sapien
gataaatagtttactgaactagcag

SEQ ID NO: 291921 - DNA, 25 bp, Homo sapien
ctgaactagcagacgtgtggaaaaa

SEQ ID NO: 291922 - DNA, 25 bp, Homo sapien
aatcagatcttgattcttctgggtt

SEQ ID NO: 291923 - DNA, 25 bp, Homo sapien
tcttctgggtttatactggttgtaa

SEQ ID NO: 291924 - DNA, 25 bp, Homo sapien
agccgcagtttggatgctctatcat

SEQ ID NO: 291925 - DNA, 25 bp, Homo sapien
ggatgctctatcataagggcacgtt

SEQ ID NO: 291926 - DNA, 25 bp, Homo sapien
agggcacgttttcttccagcaggga

SEQ ID NO: 291927 - DNA, 25 bp, Homo sapien
ggaggcgggacctatctgtccttca

SEQ ID NO: 291928 - DNA, 25 bp, Homo sapien
ctgtccttcacggtagattcattgt

SEQ ID NO: 291929 - DNA, 25 bp, Homo sapien
tgtattatttctgacgcaccgaggc

SEQ ID NO: 291930 - DNA, 25 bp, Homo sapien
gacgcaccgaggctgttgtgttcac

SEQ ID NO: 291931 - DNA, 25 bp, Homo sapien
gaggctgttgtgttcactggttttt

SEQ ID NO: 291932 - DNA, 25 bp, Homo sapien
gtgttcactggtttttggaagccaa

SEQ ID NO: 291933 - DNA, 25 bp, Homo sapien
ttggaagccaagatgtcaaacactt

SEQ ID NO: 291934 - DNA, 25 bp, Homo sapien
gatgtcaaacacttccgaagtatga

SEQ ID NO: 291935 - DNA, 25 bp, Homo sapien
cccaaactgcatttataattttgtg

SEQ ID NO: 291936 - DNA, 25 bp, Homo sapien
ccaaactgcatttataattttgtga

SEQ ID NO: 291937 - DNA, 25 bp, Homo sapien
caaactgcatttataattttgtgac

SEQ ID NO: 291938 - DNA, 25 bp, Homo sapien
aaactgcatttataattttgtgact

SEQ ID NO: 291939 - DNA, 25 bp, Homo sapien
aactgcatttataattttgtgactg

SEQ ID NO: 291940 - DNA, 25 bp, Homo sapien
actgcatttataattttgtgactga

SEQ ID NO: 291941 - DNA, 25 bp, Homo sapien
ctgcatttataattttgtgactgag

SEQ ID NO: 291942 - DNA, 25 bp, Homo sapien
tgcatttataattttgtgactgagg

SEQ ID NO: 291943 - DNA, 25 bp, Homo sapien
gcatttataattttgtgactgagga

SEQ ID NO: 291944 - DNA, 25 bp, Homo sapien
catttataattttgtgactgaggat

SEQ ID NO: 291945 - DNA, 25 bp, Homo sapien
atttataattttgtgactgaggatc

SEQ ID NO: 291946 - DNA, 25 bp, Homo sapien
tggtagttgaacatagaacttgggt

SEQ ID NO: 291947 - DNA, 25 bp, Homo sapien
gttgaacatagaacttgggtattat

SEQ ID NO: 291948 - DNA, 25 bp, Homo sapien
gaacatagaacttgggtattataga

SEQ ID NO: 291949 - DNA, 25 bp, Homo sapien
atagaacttgggtattatagatcac

SEQ ID NO: 291950 - DNA, 25 bp, Homo sapien
agaacttgggtattatagatcactt

SEQ ID NO: 291951 - DNA, 25 bp, Homo sapien
gaacttgggtattatagatcacttt

SEQ ID NO: 291952 - DNA, 25 bp, Homo sapien
acttgggtattatagatcacttttc

SEQ ID NO: 291953 - DNA, 25 bp, Homo sapien
cttgggtattatagatcacttttca

SEQ ID NO: 291954 - DNA, 25 bp, Homo sapien
ttgggtattatagatcacttttcac

SEQ ID NO: 291955 - DNA, 25 bp, Homo sapien
ttcttctgggtttatactggttgta

SEQ ID NO: 291956 - DNA, 25 bp, Homo sapien
tcttctgggtttatactggttgtaa

SEQ ID NO: 291957 - DNA, 25 bp, Homo sapien
gcatgtctatgcttgaggaactttt

SEQ ID NO: 291958 - DNA, 25 bp, Homo sapien
ttgaggaacttttccaaatgtgtgt

SEQ ID NO: 291959 - DNA, 25 bp, Homo sapien
gtacatagaagtcatagatgcagaa

SEQ ID NO: 291960 - DNA, 25 bp, Homo sapien
agaagtggttctgctggtacgattt

SEQ ID NO: 291961 - DNA, 25 bp, Homo sapien
gttctgctggtacgatttgattcct

SEQ ID NO: 291962 - DNA, 25 bp, Homo sapien
tggtacgatttgattcctgttggaa

SEQ ID NO: 291963 - DNA, 25 bp, Homo sapien
ttacactaagtgtactactttatat

SEQ ID NO: 291964 - DNA, 25 bp, Homo sapien
caatgaaattgctagacatgtttta

SEQ ID NO: 291965 - DNA, 25 bp, Homo sapien
ggacttttctaggaaagacttatgt

SEQ ID NO: 291966 - DNA, 25 bp, Homo sapien
gcagtgctttactttaaactaaggg

SEQ ID NO: 291967 - DNA, 25 bp, Homo sapien
ctttgcggaggtgaaaacctttgct

SEQ ID NO: 291968 - DNA, 25 bp, Homo sapien
tgcagacgcctgatgtatttacaag

SEQ ID NO: 291969 - DNA, 25 bp, Homo sapien
tatttacaagcatctgccctgggcg

SEQ ID NO: 291970 - DNA, 25 bp, Homo sapien
gcagccatggagtgagcctcttgga

SEQ ID NO: 291971 - DNA, 25 bp, Homo sapien
gagtgagcctcttggagaatcccaa

SEQ ID NO: 291972 - DNA, 25 bp, Homo sapien
caggcaaatgccagtatttgaacca

SEQ ID NO: 291973 - DNA, 25 bp, Homo sapien
ttgaggaaaggtcccatctggcttc

SEQ ID NO: 291974 - DNA, 25 bp, Homo sapien
cccagtctagctcagctggagagac

SEQ ID NO: 291975 - DNA, 25 bp, Homo sapien
agataatgctcttacctggtacacc

SEQ ID NO: 291976 - DNA, 25 bp, Homo sapien
cctggtacaccatatttcagagttg

SEQ ID NO: 291977 - DNA, 25 bp, Homo sapien
ttcagagttgggatctccaaagcag

SEQ ID NO: 291978 - DNA, 25 bp, Homo sapien
aaagcagatctgaggatggcaccgg

SEQ ID NO: 291979 - DNA, 25 bp, Homo sapien
taagtacttcctaccaccaaactgc

SEQ ID NO: 291980 - DNA, 25 bp, Homo sapien
cagccctgtgggaaccagctataaa

SEQ ID NO: 291981 - DNA, 25 bp, Homo sapien
agctataaacgcacacatggagaca

SEQ ID NO: 291982 - DNA, 25 bp, Homo sapien
tggaagaacttcacggccagtttat

SEQ ID NO: 291983 - DNA, 25 bp, Homo sapien
gccagtttatttgtaaccagagcca

SEQ ID NO: 291984 - DNA, 25 bp, Homo sapien
tatttgtaaccagagccaaagcctt

SEQ ID NO: 291985 - DNA, 25 bp, Homo sapien
cggtcaccggtcagctgcagtcggc

SEQ ID NO: 291986 - DNA, 25 bp, Homo sapien
ggagctgtggccaccacgtcatgga

SEQ ID NO: 291987 - DNA, 25 bp, Homo sapien
caaactgccgggatgccagcaaaag

SEQ ID NO: 291988 - DNA, 25 bp, Homo sapien
agcaaaaggctccatatcgtcccca

SEQ ID NO: 291989 - DNA, 25 bp, Homo sapien
cgcgtcagccgtgagattggaagaa

SEQ ID NO: 291990 - DNA, 25 bp, Homo sapien
ccaatctcgtgttccgatgggtaaa

SEQ ID NO: 291991 - DNA, 25 bp, Homo sapien
aagtggtggcacgtggcaactcctg

SEQ ID NO: 291992 - DNA, 25 bp, Homo sapien
gcaactcctggaggcttggaaatgg

SEQ ID NO: 291993 - DNA, 25 bp, Homo sapien
gggtcctagaatattaatccaaagt

SEQ ID NO: 291994 - DNA, 25 bp, Homo sapien
tattaatccaaagtggctgcagggt

SEQ ID NO: 291995 - DNA, 25 bp, Homo sapien
tgcagggtgcgccaagtccagccat

SEQ ID NO: 291996 - DNA, 25 bp, Homo sapien
agtccagccatcacacttaacggag

SEQ ID NO: 291997 - DNA, 25 bp, Homo sapien
cacttaacggaggagaggccctgga

SEQ ID NO: 291998 - DNA, 25 bp, Homo sapien
ccctggagagattgaatggcctgta

SEQ ID NO: 291999 - DNA, 25 bp, Homo sapien
aatggcctgtaagctgtgatgttga

SEQ ID NO: 292000 - DNA, 25 bp, Homo sapien
gctgtgatgttgaagggagaccctc

SEQ ID NO: 292001 - DNA, 25 bp, Homo sapien
aagtgatcctcttgcttcaatcccc

SEQ ID NO: 292002 - DNA, 25 bp, Homo sapien
tgcttcaatcccctgagaagctggg

SEQ ID NO: 292003 - DNA, 25 bp, Homo sapien
gcatggaccaccacccctgattgat

SEQ ID NO: 292004 - DNA, 25 bp, Homo sapien
agtacactgtttccacaaacttggg

SEQ ID NO: 292005 - DNA, 25 bp, Homo sapien
ctgtttccacaaacttgggaaggct

SEQ ID NO: 292006 - DNA, 25 bp, Homo sapien
gggcgtggaaatcactaaacaacaa

SEQ ID NO: 292007 - DNA, 25 bp, Homo sapien
aatctgatgaattggacagcataaa

SEQ ID NO: 292008 - DNA, 25 bp, Homo sapien
ccaggctggattgcttattcacaga

SEQ ID NO: 292009 - DNA, 25 bp, Homo sapien
gcttattcacagatgcagttacagt

SEQ ID NO: 292010 - DNA, 25 bp, Homo sapien
atgcagttacagtgccctatagcct

SEQ ID NO: 292011 - DNA, 25 bp, Homo sapien
ttacagtgccctatagcctcgaact

SEQ ID NO: 292012 - DNA, 25 bp, Homo sapien
tttttcgttttgcattagcttaaat

SEQ ID NO: 292013 - DNA, 25 bp, Homo sapien
gcttaaattggtttacctctcctga

SEQ ID NO: 292014 - DNA, 25 bp, Homo sapien
ttggtttacctctcctgatagtctc

SEQ ID NO: 292015 - DNA, 25 bp, Homo sapien
gttttctttattaactggaccagat

SEQ ID NO: 292016 - DNA, 25 bp, Homo sapien
gggagtaaagtatcctccatcctcc

SEQ ID NO: 292017 - DNA, 25 bp, Homo sapien
tgtcctcatttgctgtaaaccggtg

SEQ ID NO: 292018 - DNA, 25 bp, Homo sapien
tgctgtaaaccggtgtaaattctta

SEQ ID NO: 292019 - DNA, 25 bp, Homo sapien
actggaccagattaatcttcattaa

SEQ ID NO: 292020 - DNA, 25 bp, Homo sapien
gtaaattcttacttgtgcatctaca

SEQ ID NO: 292021 - DNA, 25 bp, Homo sapien
gcatctacaatctgtattattgggt

SEQ ID NO: 292022 - DNA, 25 bp, Homo sapien
aactgactgaactagtaatctttta

SEQ ID NO: 292023 - DNA, 25 bp, Homo sapien
gacattgagtctaagagtctcgtgc

SEQ ID NO: 292024 - DNA, 25 bp, Homo sapien
agtctcgtgctgaaaggctgttcca

SEQ ID NO: 292025 - DNA, 25 bp, Homo sapien
gtgctgaaaggctgttccaacgtca

SEQ ID NO: 292026 - DNA, 25 bp, Homo sapien
aaggctgttccaacgtcagtaacgc

SEQ ID NO: 292027 - DNA, 25 bp, Homo sapien
tgttccaacgtcagtaacgccacct

SEQ ID NO: 292028 - DNA, 25 bp, Homo sapien
agtaacgccacctgtcagttcctgt

SEQ ID NO: 292029 - DNA, 25 bp, Homo sapien
ccacctgtcagttcctgtctggtga

SEQ ID NO: 292030 - DNA, 25 bp, Homo sapien
gtctggtgaaaacaagactcttgga

SEQ ID NO: 292031 - DNA, 25 bp, Homo sapien
ttggaggagtcatctttcgaaagtt

SEQ ID NO: 292032 - DNA, 25 bp, Homo sapien
atctttcgaaagtttgagtgtgcaa

SEQ ID NO: 292033 - DNA, 25 bp, Homo sapien
gtgcaaatgtaaacagcttaacccc

SEQ ID NO: 292034 - DNA, 25 bp, Homo sapien
ctttctggacccaagggtatttatg

SEQ ID NO: 292035 - DNA, 25 bp, Homo sapien
aattttatcccaacaaatgcatttt

SEQ ID NO: 292036 - DNA, 25 bp, Homo sapien
tttcccccctagaatgtgttcgctg

SEQ ID NO: 292037 - DNA, 25 bp, Homo sapien
gacccaagggtatttatggaaggca

SEQ ID NO: 292038 - DNA, 25 bp, Homo sapien
ttccaggaagagtgttgaggtttta

SEQ ID NO: 292039 - DNA, 25 bp, Homo sapien
caagggtatttatggaaggcagaga

SEQ ID NO: 292040 - DNA, 25 bp, Homo sapien
agagtgttgaggttttagctgtaga

SEQ ID NO: 292041 - DNA, 25 bp, Homo sapien
gaggttttagctgtagaactgctat

SEQ ID NO: 292042 - DNA, 25 bp, Homo sapien
gctgtagaactgctattgatttttt

SEQ ID NO: 292043 - DNA, 25 bp, Homo sapien
agaatgagcagtggccttttatata

SEQ ID NO: 292044 - DNA, 25 bp, Homo sapien
gagcagtggccttttatataattca

SEQ ID NO: 292045 - DNA, 25 bp, Homo sapien
tgtggctcagatgggaccatctgtg

SEQ ID NO: 292046 - DNA, 25 bp, Homo sapien
tgaggtccaggcctagctgatccac

SEQ ID NO: 292047 - DNA, 25 bp, Homo sapien
agtatactccatccatcctagacat

SEQ ID NO: 292048 - DNA, 25 bp, Homo sapien
tactccatccatcctagacattttt

SEQ ID NO: 292049 - DNA, 25 bp, Homo sapien
catccatcctagacatttttctctt

SEQ ID NO: 292050 - DNA, 25 bp, Homo sapien
tctctttttaagaaaggtactcaat

SEQ ID NO: 292051 - DNA, 25 bp, Homo sapien
ggtactcaattttaaatctcttggc

SEQ ID NO: 292052 - DNA, 25 bp, Homo sapien
tcaattttaaatctcttggcatggg

SEQ ID NO: 292053 - DNA, 25 bp, Homo sapien
aaaaaacacctgtcccaatcatagt

SEQ ID NO: 292054 - DNA, 25 bp, Homo sapien
acctgtcccaatcatagtttctgtg

SEQ ID NO: 292055 - DNA, 25 bp, Homo sapien
tcccaatcatagtttctgtggctca

SEQ ID NO: 292056 - DNA, 25 bp, Homo sapien
ggacaggatgaacttggcccacatt

SEQ ID NO: 292057 - DNA, 25 bp, Homo sapien
ttggcccacattttgtagaatctgc

SEQ ID NO: 292058 - DNA, 25 bp, Homo sapien
tagaatctgcaaaagccccgggttc

SEQ ID NO: 292059 - DNA, 25 bp, Homo sapien
gtcacagtggtaacttggagcccct

SEQ ID NO: 292060 - DNA, 25 bp, Homo sapien
gggtttccccataattggcctgaat

SEQ ID NO: 292061 - DNA, 25 bp, Homo sapien
taattggcctgaatggtgcccttcc

SEQ ID NO: 292062 - DNA, 25 bp, Homo sapien
ctcccataactcctcaaagttcagg

SEQ ID NO: 292063 - DNA, 25 bp, Homo sapien
caaagttcaggatacaccaggcgct

SEQ ID NO: 292064 - DNA, 25 bp, Homo sapien
agaaagagcgcagccagagacggaa

SEQ ID NO: 292065 - DNA, 25 bp, Homo sapien
ccagagacggaaaggcagccaggct

SEQ ID NO: 292066 - DNA, 25 bp, Homo sapien
aagggccctgctgcacacttggaca

SEQ ID NO: 292067 - DNA, 25 bp, Homo sapien
cctaaaggccacttcctatctgatt

SEQ ID NO: 292068 - DNA, 25 bp, Homo sapien
taaaggccacttcctatctgatttt

SEQ ID NO: 292069 - DNA, 25 bp, Homo sapien
aaggccacttcctatctgatttttc

SEQ ID NO: 292070 - DNA, 25 bp, Homo sapien
aggccacttcctatctgatttttcc

SEQ ID NO: 292071 - DNA, 25 bp, Homo sapien
ccacttcctatctgatttttcccag

SEQ ID NO: 292072 - DNA, 25 bp, Homo sapien
tcttccacaaaacatctagccatct

SEQ ID NO: 292073 - DNA, 25 bp, Homo sapien
tccacaaaacatctagccatctaaa

SEQ ID NO: 292074 - DNA, 25 bp, Homo sapien
aaacatctagccatctaaaatggag

SEQ ID NO: 292075 - DNA, 25 bp, Homo sapien
tggagagatgaatcattctacctat

SEQ ID NO: 292076 - DNA, 25 bp, Homo sapien
gatgaatcattctacctatacaaac

SEQ ID NO: 292077 - DNA, 25 bp, Homo sapien
gaatcattctacctatacaaacaag

SEQ ID NO: 292078 - DNA, 25 bp, Homo sapien
taaagtttaaatccctgtggagtga

SEQ ID NO: 292079 - DNA, 25 bp, Homo sapien
ataatttccatgcatgtgtcttttt

SEQ ID NO: 292080 - DNA, 25 bp, Homo sapien
gcatgtgtctttttccagtaggtat

SEQ ID NO: 292081 - DNA, 25 bp, Homo sapien
aatttattgctaatcccatccctta

SEQ ID NO: 292082 - DNA, 25 bp, Homo sapien
tcccatcccttacgatctagagtat

SEQ ID NO: 292083 - DNA, 25 bp, Homo sapien
gatctagagtataagctgcgcaagg

SEQ ID NO: 292084 - DNA, 25 bp, Homo sapien
tgcgcaagggcagaagtttttatct

SEQ ID NO: 292085 - DNA, 25 bp, Homo sapien
agtttttatctggtttgttcatgga

SEQ ID NO: 292086 - DNA, 25 bp, Homo sapien
gttcatggatgtattctaagagctg

SEQ ID NO: 292087 - DNA, 25 bp, Homo sapien
ttctaagagctgagaacagggcctg

SEQ ID NO: 292088 - DNA, 25 bp, Homo sapien
cagggcctggacacaataagcattc

SEQ ID NO: 292089 - DNA, 25 bp, Homo sapien
tacatctgtctgaactggagctatt

SEQ ID NO: 292090 - DNA, 25 bp, Homo sapien
ggagctatttccagatgaaagggta

SEQ ID NO: 292091 - DNA, 25 bp, Homo sapien
tatcaaccacagttcctctgtttcc

SEQ ID NO: 292092 - DNA, 25 bp, Homo sapien
tcctctgtttcctgtcttcaagaaa

SEQ ID NO: 292093 - DNA, 25 bp, Homo sapien
gaacagaaagtacaccttagagaaa

SEQ ID NO: 292094 - DNA, 25 bp, Homo sapien
gtaatgagcatagcaaagtctttag

SEQ ID NO: 292095 - DNA, 25 bp, Homo sapien
aagtctttagagtatcttccagcct

SEQ ID NO: 292096 - DNA, 25 bp, Homo sapien
gtctttagagtatcttccagcctta

SEQ ID NO: 292097 - DNA, 25 bp, Homo sapien
agagtatcttccagccttactaaac

SEQ ID NO: 292098 - DNA, 25 bp, Homo sapien
gtatcttccagccttactaaacatc

SEQ ID NO: 292099 - DNA, 25 bp, Homo sapien
catcaagtaatccatactgtagaga

SEQ ID NO: 292100 - DNA, 25 bp, Homo sapien
aggcatttactatactccttcctaa

SEQ ID NO: 292101 - DNA, 25 bp, Homo sapien
tactccttcctaagagcaccagatg

SEQ ID NO: 292102 - DNA, 25 bp, Homo sapien
acatgttttctaaactagatctagg

SEQ ID NO: 292103 - DNA, 25 bp, Homo sapien
gaatgtggaatcaatccgtcctcct

SEQ ID NO: 292104 - DNA, 25 bp, Homo sapien
ttaagggctaaccactggttaatga

SEQ ID NO: 292105 - DNA, 25 bp, Homo sapien
aaacactaagatgtcccagattact

SEQ ID NO: 292106 - DNA, 25 bp, Homo sapien
aagatgtcccagattactctccaga

SEQ ID NO: 292107 - DNA, 25 bp, Homo sapien
ttactctccagagtggaaccaggga

SEQ ID NO: 292108 - DNA, 25 bp, Homo sapien
gcagcttcaacaattccaattagtc

SEQ ID NO: 292109 - DNA, 25 bp, Homo sapien
caattccaattagtctgttacagag

SEQ ID NO: 292110 - DNA, 25 bp, Homo sapien
gtctgttacagagtcatccacaagc

SEQ ID NO: 292111 - DNA, 25 bp, Homo sapien
ctgagaggacctgatcatgtaggga

SEQ ID NO: 292112 - DNA, 25 bp, Homo sapien
taaccaactatcatccccagcgatg

SEQ ID NO: 292113 - DNA, 25 bp, Homo sapien
atcatccccagcgatgttcaaacat

SEQ ID NO: 292114 - DNA, 25 bp, Homo sapien
acccatcccaaaacactgtggaaag

SEQ ID NO: 292115 - DNA, 25 bp, Homo sapien
acactgtggaaagaagggcctcttc

SEQ ID NO: 292116 - DNA, 25 bp, Homo sapien
ggaaagaagggcctcttctccgtgg

SEQ ID NO: 292117 - DNA, 25 bp, Homo sapien
atccccagcgatgttcaaacataaa

SEQ ID NO: 292118 - DNA, 25 bp, Homo sapien
taaaatcttatctatgtgcagcatg

SEQ ID NO: 292119 - DNA, 25 bp, Homo sapien
tctccaggtgacagaaagggctcta

SEQ ID NO: 292120 - DNA, 25 bp, Homo sapien
gacagaaagggctctagacagctga

SEQ ID NO: 292121 - DNA, 25 bp, Homo sapien
agggctctagacagctgagaggacc

SEQ ID NO: 292122 - DNA, 25 bp, Homo sapien
cggctgcaagacctggaaaggtcac

SEQ ID NO: 292123 - DNA, 25 bp, Homo sapien
acctggaaaggtcacatctcctggg

SEQ ID NO: 292124 - DNA, 25 bp, Homo sapien
gaagcccttacagaggccttggcca

SEQ ID NO: 292125 - DNA, 25 bp, Homo sapien
ttggccaccacttctgcaggtccgt

SEQ ID NO: 292126 - DNA, 25 bp, Homo sapien
tctgcaggtccgtctctccactgtg

SEQ ID NO: 292127 - DNA, 25 bp, Homo sapien
ggacgaacacacagcggtcagtcga

SEQ ID NO: 292128 - DNA, 25 bp, Homo sapien
aacacacagcggtcagtcgaggaga

SEQ ID NO: 292129 - DNA, 25 bp, Homo sapien
gtcagtcgaggagaggaagcaccca

SEQ ID NO: 292130 - DNA, 25 bp, Homo sapien
tccctactcatagctgcagacatcc

SEQ ID NO: 292131 - DNA, 25 bp, Homo sapien
cccagtggtgtatgcactcgttgta

SEQ ID NO: 292132 - DNA, 25 bp, Homo sapien
ggtgtatgcactcgttgtataaaat

SEQ ID NO: 292133 - DNA, 25 bp, Homo sapien
ttttttaagggagctcaaggtcaca

SEQ ID NO: 292134 - DNA, 25 bp, Homo sapien
agctcaaggtcacaagaagaaatga

SEQ ID NO: 292135 - DNA, 25 bp, Homo sapien
gaaaggaacaatcagcagccctgtt

SEQ ID NO: 292136 - DNA, 25 bp, Homo sapien
gaacaatcagcagccctgttcagaa

SEQ ID NO: 292137 - DNA, 25 bp, Homo sapien
agcagccctgttcagaaggtggttt

SEQ ID NO: 292138 - DNA, 25 bp, Homo sapien
ggtggtttgaagacttcattgctgt

SEQ ID NO: 292139 - DNA, 25 bp, Homo sapien
gaagacttcattgctgtagtttgga

SEQ ID NO: 292140 - DNA, 25 bp, Homo sapien
gctgtagtttggattaactcccctc

SEQ ID NO: 292141 - DNA, 25 bp, Homo sapien
ccccatcccaaactgcatttataat

SEQ ID NO: 292142 - DNA, 25 bp, Homo sapien
aactgcatttataattttgtgactg

SEQ ID NO: 292143 - DNA, 25 bp, Homo sapien
taattttgtgactgaggatcatttg

SEQ ID NO: 292144 - DNA, 25 bp, Homo sapien
ggatttcggctagacataaagaact

SEQ ID NO: 292145 - DNA, 25 bp, Homo sapien
ttaagcaggagggacaagttgccaa

SEQ ID NO: 292146 - DNA, 25 bp, Homo sapien
gcaggagggacaagttgccaagaaa

SEQ ID NO: 292147 - DNA, 25 bp, Homo sapien
gccaagaaagtttgtgaaatcctct

SEQ ID NO: 292148 - DNA, 25 bp, Homo sapien
gtgaaatcctcttctcaaaggactt

SEQ ID NO: 292149 - DNA, 25 bp, Homo sapien
aatcctcttctcaaaggacttgaaa

SEQ ID NO: 292150 - DNA, 25 bp, Homo sapien
gagaaaagttttcccagtggtctga

SEQ ID NO: 292151 - DNA, 25 bp, Homo sapien
ttttcccagtggtctgaggttttag

SEQ ID NO: 292152 - DNA, 25 bp, Homo sapien
cagtggtctgaggttttagatgcca

SEQ ID NO: 292153 - DNA, 25 bp, Homo sapien
ggtctgaggttttagatgccatgtt

SEQ ID NO: 292154 - DNA, 25 bp, Homo sapien
tcctctccaaaccaattaattcctg

SEQ ID NO: 292155 - DNA, 25 bp, Homo sapien
gcgtcttaacgtgggcctggacgcc

SEQ ID NO: 292156 - DNA, 25 bp, Homo sapien
ctctgaggtcccatcgtggcgggct

SEQ ID NO: 292157 - DNA, 25 bp, Homo sapien
gaggtcccatcgtggcgggctgtgg

SEQ ID NO: 292158 - DNA, 25 bp, Homo sapien
gggcgttggtcggataggcagggca

SEQ ID NO: 292159 - DNA, 25 bp, Homo sapien
gttggtcggataggcagggcaggca

SEQ ID NO: 292160 - DNA, 25 bp, Homo sapien
cttaacgtgggcctggacgcctgtc

SEQ ID NO: 292161 - DNA, 25 bp, Homo sapien
ttaacgtgggcctggacgcctgtct

SEQ ID NO: 292162 - DNA, 25 bp, Homo sapien
taacgtgggcctggacgcctgtctg

SEQ ID NO: 292163 - DNA, 25 bp, Homo sapien
gaacagaccaggtgtccgcctctgg

SEQ ID NO: 292164 - DNA, 25 bp, Homo sapien
acagaccaggtgtccgcctctggcc

SEQ ID NO: 292165 - DNA, 25 bp, Homo sapien
acgcctgtctgacgccctccagagg

SEQ ID NO: 292166 - DNA, 25 bp, Homo sapien
agctgcaaaccctcatctgaagagg

SEQ ID NO: 292167 - DNA, 25 bp, Homo sapien
gcaaaccctcatctgaagaggacga

SEQ ID NO: 292168 - DNA, 25 bp, Homo sapien
accctcatctgaagaggacgaatga

SEQ ID NO: 292169 - DNA, 25 bp, Homo sapien
aagaggacgaatgaggaggaccact

SEQ ID NO: 292170 - DNA, 25 bp, Homo sapien
gaatgaggaggaccactgtggtgca

SEQ ID NO: 292171 - DNA, 25 bp, Homo sapien
agatatgtccactgatccgcatctt

SEQ ID NO: 292172 - DNA, 25 bp, Homo sapien
tatgtccactgatccgcatcttcat

SEQ ID NO: 292173 - DNA, 25 bp, Homo sapien
ctaaccagggtgaaagcctgagtcc

SEQ ID NO: 292174 - DNA, 25 bp, Homo sapien
ataccccttttcctcacagtcagaa

SEQ ID NO: 292175 - DNA, 25 bp, Homo sapien
cccttttcctcacagtcagaacagc

SEQ ID NO: 292176 - DNA, 25 bp, Homo sapien
tcctcagcacaaaacccagctgcaa

SEQ ID NO: 292177 - DNA, 25 bp, Homo sapien
acgatgacattgactggctgggatg

SEQ ID NO: 292178 - DNA, 25 bp, Homo sapien
atgacattgactggctgggatgaag

SEQ ID NO: 292179 - DNA, 25 bp, Homo sapien
atgaagacccaggaaactggtgcaa

SEQ ID NO: 292180 - DNA, 25 bp, Homo sapien
agacccaggaaactggtgcaaaggt

SEQ ID NO: 292181 - DNA, 25 bp, Homo sapien
ggtgaagaggatcataaccctgtct

SEQ ID NO: 292182 - DNA, 25 bp, Homo sapien
aagaggatcataaccctgtcttcaa

SEQ ID NO: 292183 - DNA, 25 bp, Homo sapien
aggatcataaccctgtcttcaagaa

SEQ ID NO: 292184 - DNA, 25 bp, Homo sapien
gtcttcaagaacactgggatttcag

SEQ ID NO: 292185 - DNA, 25 bp, Homo sapien
ttcaagaacactgggatttcagcag

SEQ ID NO: 292186 - DNA, 25 bp, Homo sapien
ggatttcagcagcaagttggaagaa

SEQ ID NO: 292187 - DNA, 25 bp, Homo sapien
tcagcagcaagttggaagaaggact

SEQ ID NO: 292188 - DNA, 25 bp, Homo sapien
cttccgtttctatttgtgaagggag

SEQ ID NO: 292189 - DNA, 25 bp, Homo sapien
ttccgtttctatttgtgaagggagg

SEQ ID NO: 292190 - DNA, 25 bp, Homo sapien
ccgtttctatttgtgaagggaggag

SEQ ID NO: 292191 - DNA, 25 bp, Homo sapien
gaggcgggctggtgtctctggccgg

SEQ ID NO: 292192 - DNA, 25 bp, Homo sapien
ggccggggactggaatttcatctga

SEQ ID NO: 292193 - DNA, 25 bp, Homo sapien
atttcatctgaatgactgcccctgc

SEQ ID NO: 292194 - DNA, 25 bp, Homo sapien
tttcatctgaatgactgcccctgcg

SEQ ID NO: 292195 - DNA, 25 bp, Homo sapien
ttcatctgaatgactgcccctgcgc

SEQ ID NO: 292196 - DNA, 25 bp, Homo sapien
tcatctgaatgactgcccctgcgcg

SEQ ID NO: 292197 - DNA, 25 bp, Homo sapien
aatgactgcccctgcgcgcacgcag

SEQ ID NO: 292198 - DNA, 25 bp, Homo sapien
gggagcgcagaagtagccgcccggg

SEQ ID NO: 292199 - DNA, 25 bp, Homo sapien
ggtggtttgaagacttcattgctgt

SEQ ID NO: 292200 - DNA, 25 bp, Homo sapien
gtggtttgaagacttcattgctgta

SEQ ID NO: 292201 - DNA, 25 bp, Homo sapien
tggtttgaagacttcattgctgtag

SEQ ID NO: 292202 - DNA, 25 bp, Homo sapien
ggtttgaagacttcattgctgtagt

SEQ ID NO: 292203 - DNA, 25 bp, Homo sapien
gtttgaagacttcattgctgtagtt

SEQ ID NO: 292204 - DNA, 25 bp, Homo sapien
tttgaagacttcattgctgtagttt

SEQ ID NO: 292205 - DNA, 25 bp, Homo sapien
ttgaagacttcattgctgtagtttg

SEQ ID NO: 292206 - DNA, 25 bp, Homo sapien
tgaagacttcattgctgtagtttgg

SEQ ID NO: 292207 - DNA, 25 bp, Homo sapien
gaagacttcattgctgtagtttgga

SEQ ID NO: 292208 - DNA, 25 bp, Homo sapien
tgctgtagtttggattaactcccct

SEQ ID NO: 292209 - DNA, 25 bp, Homo sapien
gctgtagtttggattaactcccctc

SEQ ID NO: 292210 - DNA, 25 bp, Homo sapien
agttggactatttaagcttacacag

SEQ ID NO: 292211 - DNA, 25 bp, Homo sapien
gactatttaagcttacacagactct

SEQ ID NO: 292212 - DNA, 25 bp, Homo sapien
acacagactctattaatgctatatg

SEQ ID NO: 292213 - DNA, 25 bp, Homo sapien
atgctatatggttattctacccctg

SEQ ID NO: 292214 - DNA, 25 bp, Homo sapien
atatggttattctacccctgacttt

SEQ ID NO: 292215 - DNA, 25 bp, Homo sapien
gttattctacccctgactttggaag

SEQ ID NO: 292216 - DNA, 25 bp, Homo sapien
gagaaactggcatgggaatacactt

SEQ ID NO: 292217 - DNA, 25 bp, Homo sapien
ctggcatgggaatacacttttctaa

SEQ ID NO: 292218 - DNA, 25 bp, Homo sapien
tgcgatatataatggtctcaattta

SEQ ID NO: 292219 - DNA, 25 bp, Homo sapien
ctgtgctgtttttattttagctgtg

SEQ ID NO: 292220 - DNA, 25 bp, Homo sapien
ttagctgtgtaatttggaaacttca

SEQ ID NO: 292221 - DNA, 25 bp, Homo sapien
gtccatgtttacctaagcattgctg

SEQ ID NO: 292222 - DNA, 25 bp, Homo sapien
attgctgagtggaatggaacatcga

SEQ ID NO: 292223 - DNA, 25 bp, Homo sapien
tgctgcagagacctgacagtcaaag

SEQ ID NO: 292224 - DNA, 25 bp, Homo sapien
acctgacagtcaaagaatgccgagt

SEQ ID NO: 292225 - DNA, 25 bp, Homo sapien
gaatgccgagtctagtgtttgaaag

SEQ ID NO: 292226 - DNA, 25 bp, Homo sapien
gtgaatcctggttctacctctttct

SEQ ID NO: 292227 - DNA, 25 bp, Homo sapien
tctacctgtgtgaaccccgggtaag

SEQ ID NO: 292228 - DNA, 25 bp, Homo sapien
cccgggtaaggtggtgagctcaatt

SEQ ID NO: 292229 - DNA, 25 bp, Homo sapien
aaatgcaatacctgtgtcactcaag

SEQ ID NO: 292230 - DNA, 25 bp, Homo sapien
gtacatgctttattggactttttag

SEQ ID NO: 292231 - DNA, 25 bp, Homo sapien
ctttttagtgagtccatgtttacct

SEQ ID NO: 292232 - DNA, 25 bp, Homo sapien
aatgcgtcattaggtgataccatca

SEQ ID NO: 292233 - DNA, 25 bp, Homo sapien
cgtcattaggtgataccatcattgt

SEQ ID NO: 292234 - DNA, 25 bp, Homo sapien
gatagtgtagcctactaacatcgca

SEQ ID NO: 292235 - DNA, 25 bp, Homo sapien
agtgtagcctactaacatcgcagtt

SEQ ID NO: 292236 - DNA, 25 bp, Homo sapien
gtagcctactaacatcgcagttata

SEQ ID NO: 292237 - DNA, 25 bp, Homo sapien
gcctactaacatcgcagttatatag

SEQ ID NO: 292238 - DNA, 25 bp, Homo sapien
catcgcagttatatagtatagccta

SEQ ID NO: 292239 - DNA, 25 bp, Homo sapien
cagttatatagtatagcctattgct

SEQ ID NO: 292240 - DNA, 25 bp, Homo sapien
acagcatattgtgtactgaataatg

SEQ ID NO: 292241 - DNA, 25 bp, Homo sapien
aggcagttgtaatgtaacacctagt

SEQ ID NO: 292242 - DNA, 25 bp, Homo sapien
agttgtaatgtaacacctagtgttt

SEQ ID NO: 292243 - DNA, 25 bp, Homo sapien
ggattctttccagcatttcctactt

SEQ ID NO: 292244 - DNA, 25 bp, Homo sapien
agccaagagtggtgtctgacaactt

SEQ ID NO: 292245 - DNA, 25 bp, Homo sapien
gtctgacaacttctgtgtaactgga

SEQ ID NO: 292246 - DNA, 25 bp, Homo sapien
aaatatccagtgtagctccagggac

SEQ ID NO: 292247 - DNA, 25 bp, Homo sapien
agctccagggacatcacttttattc

SEQ ID NO: 292248 - DNA, 25 bp, Homo sapien
gggacatcacttttattcttctaca

SEQ ID NO: 292249 - DNA, 25 bp, Homo sapien
tttattcttctacactttccagcac

SEQ ID NO: 292250 - DNA, 25 bp, Homo sapien
caccagacaccatgcatagatttcc

SEQ ID NO: 292251 - DNA, 25 bp, Homo sapien
aaatctcatttttctaccttgccat

SEQ ID NO: 292252 - DNA, 25 bp, Homo sapien
gggctgatttgtatccaaaagtaat

SEQ ID NO: 292253 - DNA, 25 bp, Homo sapien
aagtaatgctgcgtgtctaggactg

SEQ ID NO: 292254 - DNA, 25 bp, Homo sapien
ggctaaacacagctggatgtcacct

SEQ ID NO: 292255 - DNA, 25 bp, Homo sapien
gctggatgtcacctgagttcattta

SEQ ID NO: 292256 - DNA, 25 bp, Homo sapien
gtcacctgagttcatttataggaag

SEQ ID NO: 292257 - DNA, 25 bp, Homo sapien
tgtcgaggtgaaacgtaaaagcatc

SEQ ID NO: 292258 - DNA, 25 bp, Homo sapien
gaaacgtaaaagcatctggcaggaa

SEQ ID NO: 292259 - DNA, 25 bp, Homo sapien
catctggcaggaaggtgagtctgaa

SEQ ID NO: 292260 - DNA, 25 bp, Homo sapien
gagtctgaagccctgcacccgcgtt

SEQ ID NO: 292261 - DNA, 25 bp, Homo sapien
tgcacccgcgttccgactatcagtg

SEQ ID NO: 292262 - DNA, 25 bp, Homo sapien
ggagctgttagcacgtaggattctt

SEQ ID NO: 292263 - DNA, 25 bp, Homo sapien
ctgttagcacgtaggattcttcaga

SEQ ID NO: 292264 - DNA, 25 bp, Homo sapien
gtgaagatctgggcagaccttgtgt

SEQ ID NO: 292265 - DNA, 25 bp, Homo sapien
tacccagtcttatagccctcggtta

SEQ ID NO: 292266 - DNA, 25 bp, Homo sapien
agtcttatagccctcggttatgcct

SEQ ID NO: 292267 - DNA, 25 bp, Homo sapien
tatagccctcggttatgcctttttt

SEQ ID NO: 292268 - DNA, 25 bp, Homo sapien
tttgctgtacaaaagtcttaagatt

SEQ ID NO: 292269 - DNA, 25 bp, Homo sapien
atgatggtggtatgttaatgttaca

SEQ ID NO: 292270 - DNA, 25 bp, Homo sapien
attctctcaggccttctctggtatt

SEQ ID NO: 292271 - DNA, 25 bp, Homo sapien
tctcaggccttctctggtatttata

SEQ ID NO: 292272 - DNA, 25 bp, Homo sapien
caggccttctctggtatttataata

SEQ ID NO: 292273 - DNA, 25 bp, Homo sapien
taatatatcacagaagtacccagtc

SEQ ID NO: 292274 - DNA, 25 bp, Homo sapien
atatcacagaagtacccagtcttat

SEQ ID NO: 292275 - DNA, 25 bp, Homo sapien
agaagtacccagtcttatagccctc

SEQ ID NO: 292276 - DNA, 25 bp, Homo sapien
caatgccacaaaaccacatcagaaa

SEQ ID NO: 292277 - DNA, 25 bp, Homo sapien
acatcagaaaccacaggcaggagtt

SEQ ID NO: 292278 - DNA, 25 bp, Homo sapien
actgtgcctggctacatttagatct

SEQ ID NO: 292279 - DNA, 25 bp, Homo sapien
gggttcatttttgcatatggtttaa

SEQ ID NO: 292280 - DNA, 25 bp, Homo sapien
gcaaaagtccactttatgtggctat

SEQ ID NO: 292281 - DNA, 25 bp, Homo sapien
gaaaagagcatctttcctctgttga

SEQ ID NO: 292282 - DNA, 25 bp, Homo sapien
gagcatctttcctctgttgagtagt

SEQ ID NO: 292283 - DNA, 25 bp, Homo sapien
ctttcctctgttgagtagtcttggc

SEQ ID NO: 292284 - DNA, 25 bp, Homo sapien
acttgtcaaaatcatttgtccatat

SEQ ID NO: 292285 - DNA, 25 bp, Homo sapien
atggtttatatgtggattctctatt

SEQ ID NO: 292286 - DNA, 25 bp, Homo sapien
gtggattctctattttattggtcat

SEQ ID NO: 292287 - DNA, 25 bp, Homo sapien
ggaagtgggcttatctagttggtaa

SEQ ID NO: 292288 - DNA, 25 bp, Homo sapien
tagtgatgggtaactgggtttgctc

SEQ ID NO: 292289 - DNA, 25 bp, Homo sapien
ctgggtttgctcagctgaactccct

SEQ ID NO: 292290 - DNA, 25 bp, Homo sapien
ttcattgtgggctgacctgcaagta

SEQ ID NO: 292291 - DNA, 25 bp, Homo sapien
taatttcttgtcacagatattgcct

SEQ ID NO: 292292 - DNA, 25 bp, Homo sapien
cagatattgcctgtgattggtaaat

SEQ ID NO: 292293 - DNA, 25 bp, Homo sapien
ggtaaattggtctaattctgtcatt

SEQ ID NO: 292294 - DNA, 25 bp, Homo sapien
tctgtcattcagctaattggcccat

SEQ ID NO: 292295 - DNA, 25 bp, Homo sapien
attggcccattagctgaatggtcac

SEQ ID NO: 292296 - DNA, 25 bp, Homo sapien
atggtcacactaagttgcatcctcc

SEQ ID NO: 292297 - DNA, 25 bp, Homo sapien
gcatcctccaactcaatttgatcag

SEQ ID NO: 292298 - DNA, 25 bp, Homo sapien
ttctctctgagccaattctttctga

SEQ ID NO: 292299 - DNA, 25 bp, Homo sapien
ttctgagctgacctggcctttttaa

SEQ ID NO: 292300 - DNA, 25 bp, Homo sapien
acctgttcgaggtttctgtttccag

SEQ ID NO: 292301 - DNA, 25 bp, Homo sapien
tctgtttccagatattcactagaat

SEQ ID NO: 292302 - DNA, 25 bp, Homo sapien
tagggcaaagacacctactttggaa

SEQ ID NO: 292303 - DNA, 25 bp, Homo sapien
gactgtcacaacattcccattagat

SEQ ID NO: 292304 - DNA, 25 bp, Homo sapien
attgctgaatgtagccttctctgtt

SEQ ID NO: 292305 - DNA, 25 bp, Homo sapien
gtagccttctctgttaaggtacaga

SEQ ID NO: 292306 - DNA, 25 bp, Homo sapien
gataattcctttcttaactctgtgc

SEQ ID NO: 292307 - DNA, 25 bp, Homo sapien
aactctgtgcaagatacgctggtga

SEQ ID NO: 292308 - DNA, 25 bp, Homo sapien
acgctggtgagcatggttatcattc

SEQ ID NO: 292309 - DNA, 25 bp, Homo sapien
ctttctggacccaagggtatttatg

SEQ ID NO: 292310 - DNA, 25 bp, Homo sapien
aattttatcccaacaaatgcatttt

SEQ ID NO: 292311 - DNA, 25 bp, Homo sapien
tttcccccctagaatgtgttcgctg

SEQ ID NO: 292312 - DNA, 25 bp, Homo sapien
gacccaagggtatttatggaaggca

SEQ ID NO: 292313 - DNA, 25 bp, Homo sapien
gagctatttatctctctgaaaacgt

SEQ ID NO: 292314 - DNA, 25 bp, Homo sapien
ttccaggaagagtgttgaggtttta

SEQ ID NO: 292315 - DNA, 25 bp, Homo sapien
gttgaggttttagctgtagaactgc

SEQ ID NO: 292316 - DNA, 25 bp, Homo sapien
gctgtagaactgctattgatttttt

SEQ ID NO: 292317 - DNA, 25 bp, Homo sapien
ttttttctggtgtgctttgttatag

SEQ ID NO: 292318 - DNA, 25 bp, Homo sapien
agaatgagcagtggccttttatata

SEQ ID NO: 292319 - DNA, 25 bp, Homo sapien
gagcagtggccttttatataattca

SEQ ID NO: 292320 - DNA, 25 bp, Homo sapien
gtcgttcagtcttctctgcagacac

SEQ ID NO: 292321 - DNA, 25 bp, Homo sapien
tcttctctgcagacacactaagtga

SEQ ID NO: 292322 - DNA, 25 bp, Homo sapien
ctaagtgatcataccaacgtgttat

SEQ ID NO: 292323 - DNA, 25 bp, Homo sapien
acgtgttatacactcaactagaaga

SEQ ID NO: 292324 - DNA, 25 bp, Homo sapien
gataataagctttaatctgagggca

SEQ ID NO: 292325 - DNA, 25 bp, Homo sapien
tctgagggcaagtacagtcctgaca

SEQ ID NO: 292326 - DNA, 25 bp, Homo sapien
agtacagtcctgacaaaagggcaag

SEQ ID NO: 292327 - DNA, 25 bp, Homo sapien
agtttgcataatagatcttcgatca

SEQ ID NO: 292328 - DNA, 25 bp, Homo sapien
gggcccgcaactaggctattattca

SEQ ID NO: 292329 - DNA, 25 bp, Homo sapien
tttactgttaaatcatgtgttgcta

SEQ ID NO: 292330 - DNA, 25 bp, Homo sapien
aacagtgtgttctaaatcagtcatt

SEQ ID NO: 292331 - DNA, 25 bp, Homo sapien
aaatataggatatagagtttgtacc

SEQ ID NO: 292332 - DNA, 25 bp, Homo sapien
gaatgaatattgttcaaagcaagga

SEQ ID NO: 292333 - DNA, 25 bp, Homo sapien
gaatattgttcaaagcaaggagtat

SEQ ID NO: 292334 - DNA, 25 bp, Homo sapien
tattgttcaaagcaaggagtatgtt

SEQ ID NO: 292335 - DNA, 25 bp, Homo sapien
ttgttcaaagcaaggagtatgttaa

SEQ ID NO: 292336 - DNA, 25 bp, Homo sapien
ctgtttgataaatagtttactgaac

SEQ ID NO: 292337 - DNA, 25 bp, Homo sapien
gataaatagtttactgaactagcag

SEQ ID NO: 292338 - DNA, 25 bp, Homo sapien
ctgaactagcagacgtgtggaaaaa

SEQ ID NO: 292339 - DNA, 25 bp, Homo sapien
tgaactagcagacgtgtggaaaaag

SEQ ID NO: 292340 - DNA, 25 bp, Homo sapien
gaactagcagacgtgtggaaaaaga

SEQ ID NO: 292341 - DNA, 25 bp, Homo sapien
actagcagacgtgtggaaaaagaat

SEQ ID NO: 292342 - DNA, 25 bp, Homo sapien
gattttttatgtgcctatagaacca

SEQ ID NO: 292343 - DNA, 25 bp, Homo sapien
gctgaaaagcacgatattccagata

SEQ ID NO: 292344 - DNA, 25 bp, Homo sapien
ttggcatagtgccttcctggaaatc

SEQ ID NO: 292345 - DNA, 25 bp, Homo sapien
gaaatcctggattgcatctaaaacc

SEQ ID NO: 292346 - DNA, 25 bp, Homo sapien
aggagttatgaaattgcccaaggtt

SEQ ID NO: 292347 - DNA, 25 bp, Homo sapien
aaaaccatgtggcagagggagaaac

SEQ ID NO: 292348 - DNA, 25 bp, Homo sapien
gagggagaaacaacagacaggacat

SEQ ID NO: 292349 - DNA, 25 bp, Homo sapien
gacaggacatcctgagaagactcag

SEQ ID NO: 292350 - DNA, 25 bp, Homo sapien
ttcacagctgaatgtataaggacct

SEQ ID NO: 292351 - DNA, 25 bp, Homo sapien
ataaggacctggacttgcaaatttg

SEQ ID NO: 292352 - DNA, 25 bp, Homo sapien
gcaaatttggcacaaagttcttcta

SEQ ID NO: 292353 - DNA, 25 bp, Homo sapien
acccatcctgttcgtgaataggtct

SEQ ID NO: 292354 - DNA, 25 bp, Homo sapien
catcctgttcgtgaataggtctcag

SEQ ID NO: 292355 - DNA, 25 bp, Homo sapien
ggagggactgccagatttggacact

SEQ ID NO: 292356 - DNA, 25 bp, Homo sapien
ggactgccagatttggacactatat

SEQ ID NO: 292357 - DNA, 25 bp, Homo sapien
gccagatttggacactatatttttt

SEQ ID NO: 292358 - DNA, 25 bp, Homo sapien
tgtgtatttcccctgaccttcaaaa

SEQ ID NO: 292359 - DNA, 25 bp, Homo sapien
aagcctcgtaaaggtcatcccacca

SEQ ID NO: 292360 - DNA, 25 bp, Homo sapien
caccatcaccaaagcctccgttttt

SEQ ID NO: 292361 - DNA, 25 bp, Homo sapien
atttagaggccaaatgtcattctgc

SEQ ID NO: 292362 - DNA, 25 bp, Homo sapien
atgtcattctgcaggtgccttcccg

SEQ ID NO: 292363 - DNA, 25 bp, Homo sapien
ctgcaggtgccttcccgatggatta

SEQ ID NO: 292364 - DNA, 25 bp, Homo sapien
aattgtcctacctcggtctctttat

SEQ ID NO: 292365 - DNA, 25 bp, Homo sapien
gtcctacctcggtctctttattagc

SEQ ID NO: 292366 - DNA, 25 bp, Homo sapien
ctctttattagccaggattacagat

SEQ ID NO: 292367 - DNA, 25 bp, Homo sapien
gcctggctattagaagatgcacttt

SEQ ID NO: 292368 - DNA, 25 bp, Homo sapien
cagagtggaatagtggtattgtgac

SEQ ID NO: 292369 - DNA, 25 bp, Homo sapien
tggaaaacttctaactcctcttcct

SEQ ID NO: 292370 - DNA, 25 bp, Homo sapien
ctcttcctaaatttacctcttacag

SEQ ID NO: 292371 - DNA, 25 bp, Homo sapien
atttacctcttacagagtgtcctgt

SEQ ID NO: 292372 - DNA, 25 bp, Homo sapien
gagtgtcctgtattaggtagcctca

SEQ ID NO: 292373 - DNA, 25 bp, Homo sapien
ctgtattaggtagcctcagtttcct

SEQ ID NO: 292374 - DNA, 25 bp, Homo sapien
cgaaatcctgagctcgagcaattgt

SEQ ID NO: 292375 - DNA, 25 bp, Homo sapien
gtatctaggtgcttggattgccgag

SEQ ID NO: 292376 - DNA, 25 bp, Homo sapien
ctaggtgcttggattgccgagttga

SEQ ID NO: 292377 - DNA, 25 bp, Homo sapien
tgccagtcggcttccgcgaaaacga

SEQ ID NO: 292378 - DNA, 25 bp, Homo sapien
gcgaaaacgactcttgctgtccaca

SEQ ID NO: 292379 - DNA, 25 bp, Homo sapien
tgtccacatagccagccgtgaagcc

SEQ ID NO: 292380 - DNA, 25 bp, Homo sapien
tcccctaaatgtcctcctaggaggc

SEQ ID NO: 292381 - DNA, 25 bp, Homo sapien
ggaagatgtgcctgttaccaagtgc

SEQ ID NO: 292382 - DNA, 25 bp, Homo sapien
atgtgcctgttaccaagtgcttcgt

SEQ ID NO: 292383 - DNA, 25 bp, Homo sapien
tgttaccaagtgcttcgtcccggcc

SEQ ID NO: 292384 - DNA, 25 bp, Homo sapien
ccccagcgcagacctatgaatgaag

SEQ ID NO: 292385 - DNA, 25 bp, Homo sapien
gctgatgtgaaaggcctgggtcccg

SEQ ID NO: 292386 - DNA, 25 bp, Homo sapien
taccgggacaaccaggatccagagc

SEQ ID NO: 292387 - DNA, 25 bp, Homo sapien
agagcagcgagggacccacagtgct

SEQ ID NO: 292388 - DNA, 25 bp, Homo sapien
attttctcccagtaatgagcagtcc

SEQ ID NO: 292389 - DNA, 25 bp, Homo sapien
ttctccatgctgctgtctccgggac

SEQ ID NO: 292390 - DNA, 25 bp, Homo sapien
tgtctccgggacatgagtcgcctgt

SEQ ID NO: 292391 - DNA, 25 bp, Homo sapien
ccgggacatgagtcgcctgtctgtc

SEQ ID NO: 292392 - DNA, 25 bp, Homo sapien
aatgagcagtcccactgtctttaac

SEQ ID NO: 292393 - DNA, 25 bp, Homo sapien
gcagtcccactgtctttaacggaca

SEQ ID NO: 292394 - DNA, 25 bp, Homo sapien
tttaacggacacctaaagagtgcag

SEQ ID NO: 292395 - DNA, 25 bp, Homo sapien
gagatggagcgctggacgccttcaa

SEQ ID NO: 292396 - DNA, 25 bp, Homo sapien
tggacgccttcaaataccgggacaa

SEQ ID NO: 292397 - DNA, 25 bp, Homo sapien
tattaaacgcctactgtgtaccgca

SEQ ID NO: 292398 - DNA, 25 bp, Homo sapien
tactgtgtaccgcataccctgcaaa

SEQ ID NO: 292399 - DNA, 25 bp, Homo sapien
gcataccctgcaaagcacttgacat

SEQ ID NO: 292400 - DNA, 25 bp, Homo sapien
gcacttgacatctttatgtcaccaa

SEQ ID NO: 292401 - DNA, 25 bp, Homo sapien
tgtcaccaaatccttacaacggcat

SEQ ID NO: 292402 - DNA, 25 bp, Homo sapien
aaatccttacaacggcattctgcgg

SEQ ID NO: 292403 - DNA, 25 bp, Homo sapien
cattctgcgggtaggtttcaccata

SEQ ID NO: 292404 - DNA, 25 bp, Homo sapien
aggtttcaccataccactgcacaga

SEQ ID NO: 292405 - DNA, 25 bp, Homo sapien
taaacggcccgaaattacacagcaa

SEQ ID NO: 292406 - DNA, 25 bp, Homo sapien
cctctagaggcggacactggtaatg

SEQ ID NO: 292407 - DNA, 25 bp, Homo sapien
cccagccagcatctcagtgatatta

SEQ ID NO: 292408 - DNA, 25 bp, Homo sapien
ttgtgcggtgaaactttgtgttgct

SEQ ID NO: 292409 - DNA, 25 bp, Homo sapien
ctttgtgttgctgttgctttggctg

SEQ ID NO: 292410 - DNA, 25 bp, Homo sapien
gctgtctgtgctgtagtggagtatt

SEQ ID NO: 292411 - DNA, 25 bp, Homo sapien
gatattgatgtatctgctactgctt

SEQ ID NO: 292412 - DNA, 25 bp, Homo sapien
atctgctactgctttatgagttcat

SEQ ID NO: 292413 - DNA, 25 bp, Homo sapien
gaataacatccatttaaacagttga

SEQ ID NO: 292414 - DNA, 25 bp, Homo sapien
cagttgacttacagtttgttaatgc

SEQ ID NO: 292415 - DNA, 25 bp, Homo sapien
tgctgagatgtaaagctgccacctt

SEQ ID NO: 292416 - DNA, 25 bp, Homo sapien
atgtaaagctgccacctttatattt

SEQ ID NO: 292417 - DNA, 25 bp, Homo sapien
ttcctgcttctgattttattgtgag

SEQ ID NO: 292418 - DNA, 25 bp, Homo sapien
atacaattgtggttaccttcaaatt

SEQ ID NO: 292419 - DNA, 25 bp, Homo sapien
aacaaacgaacactctcagacgcct

SEQ ID NO: 292420 - DNA, 25 bp, Homo sapien
aaacgaacactctcagacgcctcgg

SEQ ID NO: 292421 - DNA, 25 bp, Homo sapien
acgaacactctcagacgcctcggga

SEQ ID NO: 292422 - DNA, 25 bp, Homo sapien
gtggtgaccagaagatggaggactg

SEQ ID NO: 292423 - DNA, 25 bp, Homo sapien
tggagagccccatccttgccttgcc

SEQ ID NO: 292424 - DNA, 25 bp, Homo sapien
ttgccttgccgctctacaggagcac

SEQ ID NO: 292425 - DNA, 25 bp, Homo sapien
tctacaggagcacccgccgtctgag

SEQ ID NO: 292426 - DNA, 25 bp, Homo sapien
ggagcacccgccgtctgagtgaaga

SEQ ID NO: 292427 - DNA, 25 bp, Homo sapien
gagcacccgccgtctgagtgaagag

SEQ ID NO: 292428 - DNA, 25 bp, Homo sapien
gcacccgccgtctgagtgaagagga

SEQ ID NO: 292429 - DNA, 25 bp, Homo sapien
cccgccgtctgagtgaagaggagtt

SEQ ID NO: 292430 - DNA, 25 bp, Homo sapien
ggaaaaccttcatccaaattggaca

SEQ ID NO: 292431 - DNA, 25 bp, Homo sapien
aaattggacaccttaatcaacataa

SEQ ID NO: 292432 - DNA, 25 bp, Homo sapien
gaaaagcagaaaagtcttcaggcaa

SEQ ID NO: 292433 - DNA, 25 bp, Homo sapien
agtcttcaggcaaactgctcactta

SEQ ID NO: 292434 - DNA, 25 bp, Homo sapien
aggcaaactgctcacttagctcatc

SEQ ID NO: 292435 - DNA, 25 bp, Homo sapien
tgctcacttagctcatcatcagcga

SEQ ID NO: 292436 - DNA, 25 bp, Homo sapien
atactggagagtcgtcaacatgccc

SEQ ID NO: 292437 - DNA, 25 bp, Homo sapien
agagtcgtcaacatgcccctcttta

SEQ ID NO: 292438 - DNA, 25 bp, Homo sapien
tttaccttccacgtcaaatcctgtg

SEQ ID NO: 292439 - DNA, 25 bp, Homo sapien
aaatcctgtggatctgtttcccaaa

SEQ ID NO: 292440 - DNA, 25 bp, Homo sapien
tgtggatctgtttcccaaatttctc

SEQ ID NO: 292441 - DNA, 25 bp, Homo sapien
agtaaacatgcttcttgtcccaggt

SEQ ID NO: 292442 - DNA, 25 bp, Homo sapien
tgtcccaggttaacttgtgctgcct

SEQ ID NO: 292443 - DNA, 25 bp, Homo sapien
tgctgcctcagtcgctgtttaaaca

SEQ ID NO: 292444 - DNA, 25 bp, Homo sapien
tttatacgcactgttaacctgcctg

SEQ ID NO: 292445 - DNA, 25 bp, Homo sapien
tgcccattaccctattacttttaat

SEQ ID NO: 292446 - DNA, 25 bp, Homo sapien
taaactactgttccctgggcagttg

SEQ ID NO: 292447 - DNA, 25 bp, Homo sapien
tgggcagttgtctcttttaacgtcc

SEQ ID NO: 292448 - DNA, 25 bp, Homo sapien
taaacttgccaaccctcatatgaag

SEQ ID NO: 292449 - DNA, 25 bp, Homo sapien
aaccctcatatgaaggcctcaggct

SEQ ID NO: 292450 - DNA, 25 bp, Homo sapien
aaggcctcaggcttgttattggcaa

SEQ ID NO: 292451 - DNA, 25 bp, Homo sapien
gtcttaagctagtgaccttgcaggc

SEQ ID NO: 292452 - DNA, 25 bp, Homo sapien
gagtaactggaatggcttttcctga

SEQ ID NO: 292453 - DNA, 25 bp, Homo sapien
ggaatggcttttcctgatgacccag

SEQ ID NO: 292454 - DNA, 25 bp, Homo sapien
gacagcctgctcaagagcacactgt

SEQ ID NO: 292455 - DNA, 25 bp, Homo sapien
gctgccctccttggatggaactatg

SEQ ID NO: 292456 - DNA, 25 bp, Homo sapien
gaatgatttttattcttctacttcc

SEQ ID NO: 292457 - DNA, 25 bp, Homo sapien
atgggaaaccaaggacacagtcagc

SEQ ID NO: 292458 - DNA, 25 bp, Homo sapien
aaggacacagtcagcatttaacaaa

SEQ ID NO: 292459 - DNA, 25 bp, Homo sapien
ctgcatctcagtcagaactgtattg

SEQ ID NO: 292460 - DNA, 25 bp, Homo sapien
gtattgcatttgcttctctctggat

SEQ ID NO: 292461 - DNA, 25 bp, Homo sapien
gcttctctctggattaccttgaagt

SEQ ID NO: 292462 - DNA, 25 bp, Homo sapien
tggattaccttgaagttactcccct

SEQ ID NO: 292463 - DNA, 25 bp, Homo sapien
gccactgggttgaacgcagcccgct

SEQ ID NO: 292464 - DNA, 25 bp, Homo sapien
caggcttttcaatggactagagtgc

SEQ ID NO: 292465 - DNA, 25 bp, Homo sapien
tgggttgaacgcagcccgctgcagc

SEQ ID NO: 292466 - DNA, 25 bp, Homo sapien
ccctgtgaccttgattaaaagacta

SEQ ID NO: 292467 - DNA, 25 bp, Homo sapien
agagcagttttcattttaccgatac

SEQ ID NO: 292468 - DNA, 25 bp, Homo sapien
agttttcattttaccgatacatcga

SEQ ID NO: 292469 - DNA, 25 bp, Homo sapien
tcattttaccgatacatcgatcaga

SEQ ID NO: 292470 - DNA, 25 bp, Homo sapien
atcgatcagagagtacggagcttcc

SEQ ID NO: 292471 - DNA, 25 bp, Homo sapien
gagagtacggagcttcccacattgc

SEQ ID NO: 292472 - DNA, 25 bp, Homo sapien
tctgcctgtggcaagggttgtcctg

SEQ ID NO: 292473 - DNA, 25 bp, Homo sapien
caagggttgtcctgctgctgggcac

SEQ ID NO: 292474 - DNA, 25 bp, Homo sapien
gtgtctaaagtactttatgttacca

SEQ ID NO: 292475 - DNA, 25 bp, Homo sapien
tgttaccaaccaaatttggctgctg

SEQ ID NO: 292476 - DNA, 25 bp, Homo sapien
ttggctgctgcactcattaagaatg

SEQ ID NO: 292477 - DNA, 25 bp, Homo sapien
gctgcactcattaagaatgcaactt

SEQ ID NO: 292478 - DNA, 25 bp, Homo sapien
gttattttcatgcaattctgtaagt

SEQ ID NO: 292479 - DNA, 25 bp, Homo sapien
atttataataatctaccactgtcta

SEQ ID NO: 292480 - DNA, 25 bp, Homo sapien
taatctaccactgtctaaaagtgta

SEQ ID NO: 292481 - DNA, 25 bp, Homo sapien
gtgtaagaatcaaaacagccatcta

SEQ ID NO: 292482 - DNA, 25 bp, Homo sapien
aacagccatctaatttagtttcaga

SEQ ID NO: 292483 - DNA, 25 bp, Homo sapien
ttctgtaagtctaagatcatcatct

SEQ ID NO: 292484 - DNA, 25 bp, Homo sapien
gatcatcatctacagttctgctctt

SEQ ID NO: 292485 - DNA, 25 bp, Homo sapien
aagcccatgcggaaaccacgtcctt

SEQ ID NO: 292486 - DNA, 25 bp, Homo sapien
atgaagccctccctgatgtaccaac

SEQ ID NO: 292487 - DNA, 25 bp, Homo sapien
tgatgtaccaaccactgggatctct

SEQ ID NO: 292488 - DNA, 25 bp, Homo sapien
tttttcctggaaagggtgcctgcgt

SEQ ID NO: 292489 - DNA, 25 bp, Homo sapien
gaaccaccgtagcactttatttgta

SEQ ID NO: 292490 - DNA, 25 bp, Homo sapien
atttgtacctttctcatggcactta

SEQ ID NO: 292491 - DNA, 25 bp, Homo sapien
gcacttaccatattctgccttgtat

SEQ ID NO: 292492 - DNA, 25 bp, Homo sapien
gttatttgtgcacttgtcctttgac

SEQ ID NO: 292493 - DNA, 25 bp, Homo sapien
gcacttgtcctttgactgttcttag

SEQ ID NO: 292494 - DNA, 25 bp, Homo sapien
gtgcctgcgttttactgtctctgtg

SEQ ID NO: 292495 - DNA, 25 bp, Homo sapien
gtctctgtgcctttggtcttgctat

SEQ ID NO: 292496 - DNA, 25 bp, Homo sapien
atactaaaagcttaaatagggccag

SEQ ID NO: 292497 - DNA, 25 bp, Homo sapien
tactaaaagcttaaatagggccagg

SEQ ID NO: 292498 - DNA, 25 bp, Homo sapien
ctaaaagcttaaatagggccaggtg

SEQ ID NO: 292499 - DNA, 25 bp, Homo sapien
aaagcttaaatagggccaggtgcgg

SEQ ID NO: 292500 - DNA, 25 bp, Homo sapien
ttgaacctgcaagacggaggttatg

SEQ ID NO: 292501 - DNA, 25 bp, Homo sapien
tgaacctgcaagacggaggttatgt

SEQ ID NO: 292502 - DNA, 25 bp, Homo sapien
acctgcaagacggaggttatgtgag

SEQ ID NO: 292503 - DNA, 25 bp, Homo sapien
cctgcaagacggaggttatgtgagt

SEQ ID NO: 292504 - DNA, 25 bp, Homo sapien
gcaagacggaggttatgtgagtgga

SEQ ID NO: 292505 - DNA, 25 bp, Homo sapien
gttatgtgagtggagattgagccac

SEQ ID NO: 292506 - DNA, 25 bp, Homo sapien
ttatgtgagtggagattgagccact

SEQ ID NO: 292507 - DNA, 25 bp, Homo sapien
gaaatcttacagctaatcaacacct

SEQ ID NO: 292508 - DNA, 25 bp, Homo sapien
atcaacaccttgtagcttaacaccc

SEQ ID NO: 292509 - DNA, 25 bp, Homo sapien
gcagcaggaaacaggcttgcccaaa

SEQ ID NO: 292510 - DNA, 25 bp, Homo sapien
taccacccttagacctcgggatgag

SEQ ID NO: 292511 - DNA, 25 bp, Homo sapien
aaactccgcgagtaaggcagagccg

SEQ ID NO: 292512 - DNA, 25 bp, Homo sapien
agagccggatccatctaggcttctc

SEQ ID NO: 292513 - DNA, 25 bp, Homo sapien
gcttctctagttcctatgcattcat

SEQ ID NO: 292514 - DNA, 25 bp, Homo sapien
atacagagcaacacctctgtgccag

SEQ ID NO: 292515 - DNA, 25 bp, Homo sapien
tcgggatgagttcacacccattata

SEQ ID NO: 292516 - DNA, 25 bp, Homo sapien
gccggacgtcaagtggctggctcca

SEQ ID NO: 292517 - DNA, 25 bp, Homo sapien
gctccagcccgaagactacggagaa

SEQ ID NO: 292518 - DNA, 25 bp, Homo sapien
ggtcagtgtgttgataacagcccac

SEQ ID NO: 292519 - DNA, 25 bp, Homo sapien
agtgtgttgataacagcccacccac

SEQ ID NO: 292520 - DNA, 25 bp, Homo sapien
cacctgtggttccagggtgttctta

SEQ ID NO: 292521 - DNA, 25 bp, Homo sapien
tggttccagggtgttcttaagaagc

SEQ ID NO: 292522 - DNA, 25 bp, Homo sapien
aagaagccaaggttgtcttgggtgt

SEQ ID NO: 292523 - DNA, 25 bp, Homo sapien
gtgtggtagctctttgaaaggtaga

SEQ ID NO: 292524 - DNA, 25 bp, Homo sapien
tgaaaggtagaaagttccaccaaga

SEQ ID NO: 292525 - DNA, 25 bp, Homo sapien
ttttttcttgaatactgcttagctt

SEQ ID NO: 292526 - DNA, 25 bp, Homo sapien
aggctccaagatgcagattgcctgt

SEQ ID NO: 292527 - DNA, 25 bp, Homo sapien
ggctatctctctccacagataaacc

SEQ ID NO: 292528 - DNA, 25 bp, Homo sapien
tctccacagataaacctactcacat

SEQ ID NO: 292529 - DNA, 25 bp, Homo sapien
gcttttatattcatcatagtataca

SEQ ID NO: 292530 - DNA, 25 bp, Homo sapien
tatacattggcggtatctagccctt

SEQ ID NO: 292531 - DNA, 25 bp, Homo sapien
gtatctagccctttctctgtaaaat

SEQ ID NO: 292532 - DNA, 25 bp, Homo sapien
aaaatatccctatgtttaatctgta

SEQ ID NO: 292533 - DNA, 25 bp, Homo sapien
ctatgtttaatctgtatttcttgct

SEQ ID NO: 292534 - DNA, 25 bp, Homo sapien
atgtaaagttgagcttctttctaga

SEQ ID NO: 292535 - DNA, 25 bp, Homo sapien
ggataggtgttagtttgatctgttc

SEQ ID NO: 292536 - DNA, 25 bp, Homo sapien
tctttacctccgcttatttggttca

SEQ ID NO: 292537 - DNA, 25 bp, Homo sapien
tacctccgcttatttggttcagaga

SEQ ID NO: 292538 - DNA, 25 bp, Homo sapien
ggttcagagaaattagggcctacta

SEQ ID NO: 292539 - DNA, 25 bp, Homo sapien
tgaaaataaaggtcagtcccttctt

SEQ ID NO: 292540 - DNA, 25 bp, Homo sapien
gtgacggtaccaagtcaccggccac

SEQ ID NO: 292541 - DNA, 25 bp, Homo sapien
ggtcctcacagcagcgctgcatggt

SEQ ID NO: 292542 - DNA, 25 bp, Homo sapien
acagcagcgctgcatggtcggacct

SEQ ID NO: 292543 - DNA, 25 bp, Homo sapien
agcgctgcatggtcggacctcatca

SEQ ID NO: 292544 - DNA, 25 bp, Homo sapien
acccacattccaccaagaggaagct

SEQ ID NO: 292545 - DNA, 25 bp, Homo sapien
atcatccaggccttgggccttcgac

SEQ ID NO: 292546 - DNA, 25 bp, Homo sapien
ctccatgagccgtccagggcctgaa

SEQ ID NO: 292547 - DNA, 25 bp, Homo sapien
cagggcctgaagaggtatccaataa

SEQ ID NO: 292548 - DNA, 25 bp, Homo sapien
ggcctgaagaggtatccaataaaca

SEQ ID NO: 292549 - DNA, 25 bp, Homo sapien
aaagcagaacacaaagagctgtgat

SEQ ID NO: 292550 - DNA, 25 bp, Homo sapien
acaaagagctgtgatggagtggatc

SEQ ID NO: 292551 - DNA, 25 bp, Homo sapien
ggctaaacacagctggatgtcacct

SEQ ID NO: 292552 - DNA, 25 bp, Homo sapien
gctggatgtcacctgagttcattta

SEQ ID NO: 292553 - DNA, 25 bp, Homo sapien
gtcacctgagttcatttataggaag

SEQ ID NO: 292554 - DNA, 25 bp, Homo sapien
ggtgaaacgtaaaagcatctggcag

SEQ ID NO: 292555 - DNA, 25 bp, Homo sapien
catctggcaggaaggtgagtctgaa

SEQ ID NO: 292556 - DNA, 25 bp, Homo sapien
gagtctgaagccctgcacccgcgtt

SEQ ID NO: 292557 - DNA, 25 bp, Homo sapien
tgcacccgcgttccgactatcagtg

SEQ ID NO: 292558 - DNA, 25 bp, Homo sapien
ggagctgttagcacgtaggattctt

SEQ ID NO: 292559 - DNA, 25 bp, Homo sapien
attcttcagagcagctgggctggag

SEQ ID NO: 292560 - DNA, 25 bp, Homo sapien
gtcagtgaagatctgggcagacctt

SEQ ID NO: 292561 - DNA, 25 bp, Homo sapien
gtgacttcagggtctgaggtccaaa

SEQ ID NO: 292562 - DNA, 25 bp, Homo sapien
ggaggctcctgttgggtcccgaaca

SEQ ID NO: 292563 - DNA, 25 bp, Homo sapien
ttgggtcccgaacatttaagatggt

SEQ ID NO: 292564 - DNA, 25 bp, Homo sapien
ggtgaattttccactgaggatctca

SEQ ID NO: 292565 - DNA, 25 bp, Homo sapien
attcctctgagtttcaaagctatcc

SEQ ID NO: 292566 - DNA, 25 bp, Homo sapien
gaggttcctcatgaggtttcagctt

SEQ ID NO: 292567 - DNA, 25 bp, Homo sapien
gtttcagctttacaatgccttcctt

SEQ ID NO: 292568 - DNA, 25 bp, Homo sapien
ttccttcgagtttctctgtaggagt

SEQ ID NO: 292569 - DNA, 25 bp, Homo sapien
ggaacaattctatggcacggagcac

SEQ ID NO: 292570 - DNA, 25 bp, Homo sapien
gcacatcaaacttccttgccatgag

SEQ ID NO: 292571 - DNA, 25 bp, Homo sapien
aaagctatccacagctctgtctagc

SEQ ID NO: 292572 - DNA, 25 bp, Homo sapien
cagagcctgaagtaccacatgttgg

SEQ ID NO: 292573 - DNA, 25 bp, Homo sapien
ataggcttaaacgaactgtgcacca

SEQ ID NO: 292574 - DNA, 25 bp, Homo sapien
gaactgtgcaccaatgtttcatcta

SEQ ID NO: 292575 - DNA, 25 bp, Homo sapien
tgaccacacatttctttccatagtc

SEQ ID NO: 292576 - DNA, 25 bp, Homo sapien
gcacacattcaaaaagctgccccat

SEQ ID NO: 292577 - DNA, 25 bp, Homo sapien
ttctttccatagtcaagcaccgtca

SEQ ID NO: 292578 - DNA, 25 bp, Homo sapien
aagcaccgtcacctctggaagaagg

SEQ ID NO: 292579 - DNA, 25 bp, Homo sapien
tgccccatcctctggaggaactcgt

SEQ ID NO: 292580 - DNA, 25 bp, Homo sapien
tggaggaactcgtccacatgtggcc

SEQ ID NO: 292581 - DNA, 25 bp, Homo sapien
acatgtggccgcttcagcacataca

SEQ ID NO: 292582 - DNA, 25 bp, Homo sapien
gcacatacacctgatgtatagttcc

SEQ ID NO: 292583 - DNA, 25 bp, Homo sapien
gtatagttccatcgatttcaaccgg

SEQ ID NO: 292584 - DNA, 25 bp, Homo sapien
catcggtcaaactggttttagccca

SEQ ID NO: 292585 - DNA, 25 bp, Homo sapien
gattggttcttaagtcatcaaggat

SEQ ID NO: 292586 - DNA, 25 bp, Homo sapien
caaaggatagccttagggctctttc

SEQ ID NO: 292587 - DNA, 25 bp, Homo sapien
tctccggcgtcactctgtcctgtta

SEQ ID NO: 292588 - DNA, 25 bp, Homo sapien
tgtcctgttatccacagtcttcctc

SEQ ID NO: 292589 - DNA, 25 bp, Homo sapien
tcttcctcctgatgggtgaggcagg

SEQ ID NO: 292590 - DNA, 25 bp, Homo sapien
ttcagtcttttactgtcagctcatc

SEQ ID NO: 292591 - DNA, 25 bp, Homo sapien
tgtcagctcatctcactctatgaaa

SEQ ID NO: 292592 - DNA, 25 bp, Homo sapien
catctcactctatgaaacccagttc

SEQ ID NO: 292593 - DNA, 25 bp, Homo sapien
tgaaacccagttcttcaattgtaag

SEQ ID NO: 292594 - DNA, 25 bp, Homo sapien
gtaagcaacagaaacatcggtcaaa

SEQ ID NO: 292595 - DNA, 25 bp, Homo sapien
gtgaaattcgttattctacatggaa

SEQ ID NO: 292596 - DNA, 25 bp, Homo sapien
tcgttattctacatggaagaaagct

SEQ ID NO: 292597 - DNA, 25 bp, Homo sapien
ggttgggttacaactcaatctccag

SEQ ID NO: 292598 - DNA, 25 bp, Homo sapien
ttgggttacaactcaatctccagaa

SEQ ID NO: 292599 - DNA, 25 bp, Homo sapien
gttaatcggagcaaggtacatctca

SEQ ID NO: 292600 - DNA, 25 bp, Homo sapien
atcggagcaaggtacatctcaggta

SEQ ID NO: 292601 - DNA, 25 bp, Homo sapien
gcaaggtacatctcaggtattccat

SEQ ID NO: 292602 - DNA, 25 bp, Homo sapien
aaggtacatctcaggtattccataa

SEQ ID NO: 292603 - DNA, 25 bp, Homo sapien
ggtacatctcaggtattccataaaa

SEQ ID NO: 292604 - DNA, 25 bp, Homo sapien
tcaggtattccataaaacctaccaa

SEQ ID NO: 292605 - DNA, 25 bp, Homo sapien
atgacactattcatagactttgatt

SEQ ID NO: 292606 - DNA, 25 bp, Homo sapien
aagcaaagcagttcagcctgaaatt

SEQ ID NO: 292607 - DNA, 25 bp, Homo sapien
tgaaattgactacagagcttccctt

SEQ ID NO: 292608 - DNA, 25 bp, Homo sapien
agagcttccctttgcttcagcagag

SEQ ID NO: 292609 - DNA, 25 bp, Homo sapien
tgctaagcttgctgcaggccaggaa

SEQ ID NO: 292610 - DNA, 25 bp, Homo sapien
aagcttgctgcaggccaggaaacag

SEQ ID NO: 292611 - DNA, 25 bp, Homo sapien
aggaaacaggcctgggcttgcagct

SEQ ID NO: 292612 - DNA, 25 bp, Homo sapien
gggcctctttgcacagcttactggg

SEQ ID NO: 292613 - DNA, 25 bp, Homo sapien
gggataggccaagctctgggaactc

SEQ ID NO: 292614 - DNA, 25 bp, Homo sapien
gccaagctctgggaactcctttcaa

SEQ ID NO: 292615 - DNA, 25 bp, Homo sapien
tttgagcaataaggcaactgcggtg

SEQ ID NO: 292616 - DNA, 25 bp, Homo sapien
aggcaactgcggtgaggaaaaaata

SEQ ID NO: 292617 - DNA, 25 bp, Homo sapien
aggaagacagtgtcggccacagccg

SEQ ID NO: 292618 - DNA, 25 bp, Homo sapien
cagccgcagaataaacatgtggaga

SEQ ID NO: 292619 - DNA, 25 bp, Homo sapien
tgatcaccttgactgaagcactgca

SEQ ID NO: 292620 - DNA, 25 bp, Homo sapien
agacaagataaagacagcctgatgc

SEQ ID NO: 292621 - DNA, 25 bp, Homo sapien
gggcttcatccacagatggcatttt

SEQ ID NO: 292622 - DNA, 25 bp, Homo sapien
ggcattttccagacagggtggctct

SEQ ID NO: 292623 - DNA, 25 bp, Homo sapien
agacagggtggctctctctgttagc

SEQ ID NO: 292624 - DNA, 25 bp, Homo sapien
tggctctctctgttagcgggcagga

SEQ ID NO: 292625 - DNA, 25 bp, Homo sapien
tagcgggcaggaccttctgttactt

SEQ ID NO: 292626 - DNA, 25 bp, Homo sapien
ggaccttctgttacttggatcattc

SEQ ID NO: 292627 - DNA, 25 bp, Homo sapien
gttacttggatcattctataacaac

SEQ ID NO: 292628 - DNA, 25 bp, Homo sapien
aatgttaatcggagcaaggtacatc

SEQ ID NO: 292629 - DNA, 25 bp, Homo sapien
gttaatcggagcaaggtacatctca

SEQ ID NO: 292630 - DNA, 25 bp, Homo sapien
aatcggagcaaggtacatctcaggt

SEQ ID NO: 292631 - DNA, 25 bp, Homo sapien
atcggagcaaggtacatctcaggta

SEQ ID NO: 292632 - DNA, 25 bp, Homo sapien
tcggagcaaggtacatctcaggtat

SEQ ID NO: 292633 - DNA, 25 bp, Homo sapien
cggagcaaggtacatctcaggtatt

SEQ ID NO: 292634 - DNA, 25 bp, Homo sapien
ggagcaaggtacatctcaggtattc

SEQ ID NO: 292635 - DNA, 25 bp, Homo sapien
agcaaggtacatctcaggtattcca

SEQ ID NO: 292636 - DNA, 25 bp, Homo sapien
gcaaggtacatctcaggtattccat

SEQ ID NO: 292637 - DNA, 25 bp, Homo sapien
caaggtacatctcaggtattccata

SEQ ID NO: 292638 - DNA, 25 bp, Homo sapien
aaggtacatctcaggtattccataa

SEQ ID NO: 292639 - DNA, 25 bp, Homo sapien
tacagttcagaaacgtctacctcag

SEQ ID NO: 292640 - DNA, 25 bp, Homo sapien
gaaacgtctacctcagccaggagca

SEQ ID NO: 292641 - DNA, 25 bp, Homo sapien
aactcgttatttattatgccatggc

SEQ ID NO: 292642 - DNA, 25 bp, Homo sapien
ggcacataggcataaaccagccctt

SEQ ID NO: 292643 - DNA, 25 bp, Homo sapien
accagcccttctgtgaataagcaaa

SEQ ID NO: 292644 - DNA, 25 bp, Homo sapien
taagcaaacagaacctgcccaggtg

SEQ ID NO: 292645 - DNA, 25 bp, Homo sapien
gtggttttatgatactgagccgcct

SEQ ID NO: 292646 - DNA, 25 bp, Homo sapien
cctgcccaggtgcaagagaagcttg

SEQ ID NO: 292647 - DNA, 25 bp, Homo sapien
attggagaagagtttgtttcaagca

SEQ ID NO: 292648 - DNA, 25 bp, Homo sapien
atactgagccgccttgtttggtgac

SEQ ID NO: 292649 - DNA, 25 bp, Homo sapien
agccgccttgtttggtgaccagggt

SEQ ID NO: 292650 - DNA, 25 bp, Homo sapien
ttctgtggctcagatgggaccatct

SEQ ID NO: 292651 - DNA, 25 bp, Homo sapien
tgaggtccaggcctagctgatccac

SEQ ID NO: 292652 - DNA, 25 bp, Homo sapien
agtatactccatccatcctagacat

SEQ ID NO: 292653 - DNA, 25 bp, Homo sapien
tactccatccatcctagacattttt

SEQ ID NO: 292654 - DNA, 25 bp, Homo sapien
catccatcctagacatttttctctt

SEQ ID NO: 292655 - DNA, 25 bp, Homo sapien
gaaaggtactcaattttaaatctct

SEQ ID NO: 292656 - DNA, 25 bp, Homo sapien
tcaattttaaatctcttggcatggg

SEQ ID NO: 292657 - DNA, 25 bp, Homo sapien
gttttttcctgccaagcattcattc

SEQ ID NO: 292658 - DNA, 25 bp, Homo sapien
aaaaaacacctgtcccaatcatagt

SEQ ID NO: 292659 - DNA, 25 bp, Homo sapien
acctgtcccaatcatagtttctgtg

SEQ ID NO: 292660 - DNA, 25 bp, Homo sapien
gtcccaatcatagtttctgtggctc

SEQ ID NO: 292661 - DNA, 25 bp, Homo sapien
aggcacacgcctgagtaattttttt

SEQ ID NO: 292662 - DNA, 25 bp, Homo sapien
catgttacccaggttgggctcgaag

SEQ ID NO: 292663 - DNA, 25 bp, Homo sapien
atgttacccaggttgggctcgaagt

SEQ ID NO: 292664 - DNA, 25 bp, Homo sapien
tgttacccaggttgggctcgaagtc

SEQ ID NO: 292665 - DNA, 25 bp, Homo sapien
ttacccaggttgggctcgaagtcct

SEQ ID NO: 292666 - DNA, 25 bp, Homo sapien
tacccaggttgggctcgaagtcctg

SEQ ID NO: 292667 - DNA, 25 bp, Homo sapien
acccaggttgggctcgaagtcctgg

SEQ ID NO: 292668 - DNA, 25 bp, Homo sapien
cacccagcccagaatattttgcata

SEQ ID NO: 292669 - DNA, 25 bp, Homo sapien
acccagcccagaatattttgcatac

SEQ ID NO: 292670 - DNA, 25 bp, Homo sapien
cccagcccagaatattttgcataca

SEQ ID NO: 292671 - DNA, 25 bp, Homo sapien
ttttgcatacattttgcctgtcatt

SEQ ID NO: 292672 - DNA, 25 bp, Homo sapien
agggcccaggtcagcctcagtctgc

SEQ ID NO: 292673 - DNA, 25 bp, Homo sapien
gtctgctgtgcctccagactgcaga

SEQ ID NO: 292674 - DNA, 25 bp, Homo sapien
gcctccagactgcagagctctcaga

SEQ ID NO: 292675 - DNA, 25 bp, Homo sapien
gagacgaaaaggctacctctcctac

SEQ ID NO: 292676 - DNA, 25 bp, Homo sapien
ctctcctacccaagttaagtgttca

SEQ ID NO: 292677 - DNA, 25 bp, Homo sapien
gaggcagctgtgtaatcctatgtca

SEQ ID NO: 292678 - DNA, 25 bp, Homo sapien
atgtcagctctcttaggaagcccca

SEQ ID NO: 292679 - DNA, 25 bp, Homo sapien
taggaagccccagtacttatattgg

SEQ ID NO: 292680 - DNA, 25 bp, Homo sapien
atattgggcatgcacttgcccttaa

SEQ ID NO: 292681 - DNA, 25 bp, Homo sapien
aacaatgatttgtgagtccaggaac

SEQ ID NO: 292682 - DNA, 25 bp, Homo sapien
gtgagtccaggaacaatttactatt

SEQ ID NO: 292683 - DNA, 25 bp, Homo sapien
gtattttgtaggctctgtaagctcg

SEQ ID NO: 292684 - DNA, 25 bp, Homo sapien
aggctctgtaagctcgtgttttctt

SEQ ID NO: 292685 - DNA, 25 bp, Homo sapien
tgtaagctcgtgttttcttccctcc

SEQ ID NO: 292686 - DNA, 25 bp, Homo sapien
ttcttccctccttgtacagctgcaa

SEQ ID NO: 292687 - DNA, 25 bp, Homo sapien
gcataagctgcatactaagttttcc

SEQ ID NO: 292688 - DNA, 25 bp, Homo sapien
ctaagttttcccagagatgtaagac

SEQ ID NO: 292689 - DNA, 25 bp, Homo sapien
aatggactttgttcttgcttctgta

SEQ ID NO: 292690 - DNA, 25 bp, Homo sapien
tgcttcctgcttcacgtaattcctg

SEQ ID NO: 292691 - DNA, 25 bp, Homo sapien
agacattcgttttctttgatctatg

SEQ ID NO: 292692 - DNA, 25 bp, Homo sapien
ttcgttttctttgatctatgcttag

SEQ ID NO: 292693 - DNA, 25 bp, Homo sapien
ctatgcttagattttctggatgcaa

SEQ ID NO: 292694 - DNA, 25 bp, Homo sapien
actgaggcacacagcggttaaggga

SEQ ID NO: 292695 - DNA, 25 bp, Homo sapien
aggcacacagcggttaagggactta

SEQ ID NO: 292696 - DNA, 25 bp, Homo sapien
gcacacagcggttaagggacttacg

SEQ ID NO: 292697 - DNA, 25 bp, Homo sapien
cacacagcggttaagggacttacgc

SEQ ID NO: 292698 - DNA, 25 bp, Homo sapien
cgcgaggcatgttctcagtgtgtgt

SEQ ID NO: 292699 - DNA, 25 bp, Homo sapien
tcacacagcagtagagctgggctgg

SEQ ID NO: 292700 - DNA, 25 bp, Homo sapien
gaggcatgttctcagtgtgtgtctt

SEQ ID NO: 292701 - DNA, 25 bp, Homo sapien
gggctggcaagggagggactgcaaa

SEQ ID NO: 292702 - DNA, 25 bp, Homo sapien
agggactgcaaagggcctcacaggg

SEQ ID NO: 292703 - DNA, 25 bp, Homo sapien
aaagggcctcacaggggctagacga

SEQ ID NO: 292704 - DNA, 25 bp, Homo sapien
ggctagacgagggccctgggcacca

SEQ ID NO: 292705 - DNA, 25 bp, Homo sapien
gggctcccacagatgctgccaggtt

SEQ ID NO: 292706 - DNA, 25 bp, Homo sapien
ttttggctctcctgttgcctcttgg

SEQ ID NO: 292707 - DNA, 25 bp, Homo sapien
gatgctgccaggtttgttttgtaca

SEQ ID NO: 292708 - DNA, 25 bp, Homo sapien
aacttaattgtgagaacggagacct

SEQ ID NO: 292709 - DNA, 25 bp, Homo sapien
gagaacggagacctcatcactagct

SEQ ID NO: 292710 - DNA, 25 bp, Homo sapien
agacctcatcactagctgcatgttt

SEQ ID NO: 292711 - DNA, 25 bp, Homo sapien
cactagctgcatgttttggatttgg

SEQ ID NO: 292712 - DNA, 25 bp, Homo sapien
gtgttaattatgatttgtccaggta

SEQ ID NO: 292713 - DNA, 25 bp, Homo sapien
atttgtccaggtaagatgcagtagc

SEQ ID NO: 292714 - DNA, 25 bp, Homo sapien
agatgcagtagctgctccctgagca

SEQ ID NO: 292715 - DNA, 25 bp, Homo sapien
atttctgctaattattgcttttgtg

SEQ ID NO: 292716 - DNA, 25 bp, Homo sapien
gaggtccccttagggaagcatttct

SEQ ID NO: 292717 - DNA, 25 bp, Homo sapien
gtccccttagggaagcatttcttca

SEQ ID NO: 292718 - DNA, 25 bp, Homo sapien
ggtggcccagggacctccggcatca

SEQ ID NO: 292719 - DNA, 25 bp, Homo sapien
gacctccggcatcagggcctgcatg

SEQ ID NO: 292720 - DNA, 25 bp, Homo sapien
agccctgctaagtcccagccttggg

SEQ ID NO: 292721 - DNA, 25 bp, Homo sapien
agtcccagccttgggaacctgagga

SEQ ID NO: 292722 - DNA, 25 bp, Homo sapien
acctgaggagggtatctgcctattt

SEQ ID NO: 292723 - DNA, 25 bp, Homo sapien
aacatgtttcttaggttattcacta

SEQ ID NO: 292724 - DNA, 25 bp, Homo sapien
gaaccactgctttgtggctttgaaa

SEQ ID NO: 292725 - DNA, 25 bp, Homo sapien
gattactaagatttttgcccttaag

SEQ ID NO: 292726 - DNA, 25 bp, Homo sapien
ttgcccttaaggctctgtatataaa

SEQ ID NO: 292727 - DNA, 25 bp, Homo sapien
caggaatgggaaaggcgtgacccaa

SEQ ID NO: 292728 - DNA, 25 bp, Homo sapien
agcatctgtctcagagctccactca

SEQ ID NO: 292729 - DNA, 25 bp, Homo sapien
tctgtctcagagctccactcagggt

SEQ ID NO: 292730 - DNA, 25 bp, Homo sapien
gggtggcttcagacttccactgcac

SEQ ID NO: 292731 - DNA, 25 bp, Homo sapien
tggcttcagacttccactgcacgac

SEQ ID NO: 292732 - DNA, 25 bp, Homo sapien
tccactgcacgacctggagcaccaa

SEQ ID NO: 292733 - DNA, 25 bp, Homo sapien
agaccacacaccacaataccaaatt

SEQ ID NO: 292734 - DNA, 25 bp, Homo sapien
accacaataccaaattcacccaaga

SEQ ID NO: 292735 - DNA, 25 bp, Homo sapien
aataccaaattcacccaagaagagg

SEQ ID NO: 292736 - DNA, 25 bp, Homo sapien
attgtagtgttcaaggagatgatgg

SEQ ID NO: 292737 - DNA, 25 bp, Homo sapien
tggagttgcagagagacctggtgcc

SEQ ID NO: 292738 - DNA, 25 bp, Homo sapien
taagctggtctatgttatagctcta

SEQ ID NO: 292739 - DNA, 25 bp, Homo sapien
ggtctatgttatagctctagcagta

SEQ ID NO: 292740 - DNA, 25 bp, Homo sapien
atgttatagctctagcagtatggaa

SEQ ID NO: 292741 - DNA, 25 bp, Homo sapien
tgtgctttaaaatatgcttaccttt

SEQ ID NO: 292742 - DNA, 25 bp, Homo sapien
aaatatgcttaccttttgaatgatc

SEQ ID NO: 292743 - DNA, 25 bp, Homo sapien
ggctatatgttgttgagatatttga

SEQ ID NO: 292744 - DNA, 25 bp, Homo sapien
ccttgttttcacttgtgcactgtga

SEQ ID NO: 292745 - DNA, 25 bp, Homo sapien
cacttgtgcactgtgaatgaacttt

SEQ ID NO: 292746 - DNA, 25 bp, Homo sapien
gtgcactgtgaatgaactttgtatt

SEQ ID NO: 292747 - DNA, 25 bp, Homo sapien
taaaaccttcacattacgtgtagat

SEQ ID NO: 292748 - DNA, 25 bp, Homo sapien
cattacgtgtagatattattgcaac

SEQ ID NO: 292749 - DNA, 25 bp, Homo sapien
gcgtcttaacgtgggcctggacgcc

SEQ ID NO: 292750 - DNA, 25 bp, Homo sapien
ctctgaggtcccatcgtggcgggct

SEQ ID NO: 292751 - DNA, 25 bp, Homo sapien
gaggtcccatcgtggcgggctgtgg

SEQ ID NO: 292752 - DNA, 25 bp, Homo sapien
gggcgttggtcggataggcagggca

SEQ ID NO: 292753 - DNA, 25 bp, Homo sapien
gttggtcggataggcagggcaggca

SEQ ID NO: 292754 - DNA, 25 bp, Homo sapien
ttaacgtgggcctggacgcctgtct

SEQ ID NO: 292755 - DNA, 25 bp, Homo sapien
gaacagaccaggtgtccgcctctgg

SEQ ID NO: 292756 - DNA, 25 bp, Homo sapien
acgtgggcctggacgcctgtctgac

SEQ ID NO: 292757 - DNA, 25 bp, Homo sapien
tcctccttgcggcagtgtggcctgc

SEQ ID NO: 292758 - DNA, 25 bp, Homo sapien
gtctgacgccctccagaggctggaa

SEQ ID NO: 292759 - DNA, 25 bp, Homo sapien
agagcccaggactgtggccttgagc

SEQ ID NO: 292760 - DNA, 25 bp, Homo sapien
ctgcaccgtgcttggatgctgggat

SEQ ID NO: 292761 - DNA, 25 bp, Homo sapien
ggcacgaggagcatgtacaactgca

SEQ ID NO: 292762 - DNA, 25 bp, Homo sapien
atgctgggatcctctgtgtcttcca

SEQ ID NO: 292763 - DNA, 25 bp, Homo sapien
tgtgtcttccacagagccctagtgc

SEQ ID NO: 292764 - DNA, 25 bp, Homo sapien
cacagagccctagtgcctgttatta

SEQ ID NO: 292765 - DNA, 25 bp, Homo sapien
tgcctgttattatttgtagaattaa

SEQ ID NO: 292766 - DNA, 25 bp, Homo sapien
ggagcatgtacaactgcacaataaa

SEQ ID NO: 292767 - DNA, 25 bp, Homo sapien
gcacaataaattgcacgtagatgta

SEQ ID NO: 292768 - DNA, 25 bp, Homo sapien
aattgcacgtagatgtacagagaga

SEQ ID NO: 292769 - DNA, 25 bp, Homo sapien
aacggtgaacacaaaattctggaca

SEQ ID NO: 292770 - DNA, 25 bp, Homo sapien
acagtgatgacctctgagatgcgga

SEQ ID NO: 292771 - DNA, 25 bp, Homo sapien
gtttccaggagctgtcatctcactc

SEQ ID NO: 292772 - DNA, 25 bp, Homo sapien
tcatctcactcctttccagagtctg

SEQ ID NO: 292773 - DNA, 25 bp, Homo sapien
agagtctgccctgcggatggcctgt

SEQ ID NO: 292774 - DNA, 25 bp, Homo sapien
aatgtggcagaaaggcctgctcgat

SEQ ID NO: 292775 - DNA, 25 bp, Homo sapien
aaggcctgctcgattttgcctggag

SEQ ID NO: 292776 - DNA, 25 bp, Homo sapien
agcagctgcagcttcccacgcttgt

SEQ ID NO: 292777 - DNA, 25 bp, Homo sapien
tgccctcacgtcgtcttgttaaaag

SEQ ID NO: 292778 - DNA, 25 bp, Homo sapien
aagcggaatcaatacacaaacaagg

SEQ ID NO: 292779 - DNA, 25 bp, Homo sapien
acaaggttttctaatcttctaaatg

SEQ ID NO: 292780 - DNA, 25 bp, Homo sapien
aatcttctaaatgtttccacgtggg

SEQ ID NO: 292781 - DNA, 25 bp, Homo sapien
gcatcctatgcaatctttgcaatag

SEQ ID NO: 292782 - DNA, 25 bp, Homo sapien
gagtgagttacgtcttttctttaga

SEQ ID NO: 292783 - DNA, 25 bp, Homo sapien
gagttacgtcttttctttagaacag

SEQ ID NO: 292784 - DNA, 25 bp, Homo sapien
aatcactcgacctgaatgcatggca

SEQ ID NO: 292785 - DNA, 25 bp, Homo sapien
agaccaaagctatctcatagaacta

SEQ ID NO: 292786 - DNA, 25 bp, Homo sapien
gaactaaaacccctcaatgacaagt

SEQ ID NO: 292787 - DNA, 25 bp, Homo sapien
gtagatgtgagaggtcacgcgacct

SEQ ID NO: 292788 - DNA, 25 bp, Homo sapien
gagaggtcacgcgacctcctgaggt

SEQ ID NO: 292789 - DNA, 25 bp, Homo sapien
ccttcctaggcggtggagctgtaga

SEQ ID NO: 292790 - DNA, 25 bp, Homo sapien
gcatggcaaggcatttttgtcatca

SEQ ID NO: 292791 - DNA, 25 bp, Homo sapien
gatgaggtctgtggtggcttaaaat

SEQ ID NO: 292792 - DNA, 25 bp, Homo sapien
gtggtggcttaaaatgtagctgtta

SEQ ID NO: 292793 - DNA, 25 bp, Homo sapien
gcgcgttcgggtgggatgggtggcc

SEQ ID NO: 292794 - DNA, 25 bp, Homo sapien
tgggagccctagtggaagctccgct

SEQ ID NO: 292795 - DNA, 25 bp, Homo sapien
gagccctagtggaagctccgctccg

SEQ ID NO: 292796 - DNA, 25 bp, Homo sapien
ctcgcctgtaaaatggaaggactgg

SEQ ID NO: 292797 - DNA, 25 bp, Homo sapien
tggaaggactggactgaggaccatc

SEQ ID NO: 292798 - DNA, 25 bp, Homo sapien
gaagctcagcagcaacgcggtcagc

SEQ ID NO: 292799 - DNA, 25 bp, Homo sapien
gctcagcagcaacgcggtcagctag

SEQ ID NO: 292800 - DNA, 25 bp, Homo sapien
agcagcaacgcggtcagctagaggc

SEQ ID NO: 292801 - DNA, 25 bp, Homo sapien
agcaacgcggtcagctagaggccga

SEQ ID NO: 292802 - DNA, 25 bp, Homo sapien
cggtcagctagaggccgagagcttc

SEQ ID NO: 292803 - DNA, 25 bp, Homo sapien
cagctagaggccgagagcttcctgg

SEQ ID NO: 292804 - DNA, 25 bp, Homo sapien
ttgtgggtttactctgataagaata

SEQ ID NO: 292805 - DNA, 25 bp, Homo sapien
gaatattaatcagtgtgcatttgaa

SEQ ID NO: 292806 - DNA, 25 bp, Homo sapien
aggaatcttatttttggaattacat

SEQ ID NO: 292807 - DNA, 25 bp, Homo sapien
atagctctgtaaaccactgcccaga

SEQ ID NO: 292808 - DNA, 25 bp, Homo sapien
attacatgggagcaaatagttttca

SEQ ID NO: 292809 - DNA, 25 bp, Homo sapien
aatagttttcatattgtgcccacaa

SEQ ID NO: 292810 - DNA, 25 bp, Homo sapien
tgtgcccacaaacaattccttcttg

SEQ ID NO: 292811 - DNA, 25 bp, Homo sapien
tccttcttgctaatagaccttcttg

SEQ ID NO: 292812 - DNA, 25 bp, Homo sapien
ttgctaatagaccttcttgtagcat

SEQ ID NO: 292813 - DNA, 25 bp, Homo sapien
aaccactgcccagatcaagatctag

SEQ ID NO: 292814 - DNA, 25 bp, Homo sapien
gaacatttccagcatagtatgtctg

SEQ ID NO: 292815 - DNA, 25 bp, Homo sapien
tgtgttttaagggtgcaggccacta

SEQ ID NO: 292816 - DNA, 25 bp, Homo sapien
gggtgcaggccactagctaagcaat

SEQ ID NO: 292817 - DNA, 25 bp, Homo sapien
atgaacatgtccttatctcagcagc

SEQ ID NO: 292818 - DNA, 25 bp, Homo sapien
tacctcttcttttgtggtatgtccc

SEQ ID NO: 292819 - DNA, 25 bp, Homo sapien
tttgtggtatgtccccatgtcactc

SEQ ID NO: 292820 - DNA, 25 bp, Homo sapien
atgtcactcagccattaccagtctc

SEQ ID NO: 292821 - DNA, 25 bp, Homo sapien
gtctcagccacaggttcagaacaat

SEQ ID NO: 292822 - DNA, 25 bp, Homo sapien
aacaatttgtggaatcccctattag

SEQ ID NO: 292823 - DNA, 25 bp, Homo sapien
ggaatcccctattagcttctgaaat

SEQ ID NO: 292824 - DNA, 25 bp, Homo sapien
ctacaatgagtaggtgcccaaacta

SEQ ID NO: 292825 - DNA, 25 bp, Homo sapien
acccagcctgggacatgtgttttaa

SEQ ID NO: 292826 - DNA, 25 bp, Homo sapien
tgtcgatgccagatgggctggtcct

SEQ ID NO: 292827 - DNA, 25 bp, Homo sapien
gggctggtcctcttttgtattattc

SEQ ID NO: 292828 - DNA, 25 bp, Homo sapien
aattttcctggctctctttgcttat

SEQ ID NO: 292829 - DNA, 25 bp, Homo sapien
tagaatcgacttatccgtttaacct

SEQ ID NO: 292830 - DNA, 25 bp, Homo sapien
gtttttactggaactgcattcgctt

SEQ ID NO: 292831 - DNA, 25 bp, Homo sapien
gcattcgctttatagatatactcgg

SEQ ID NO: 292832 - DNA, 25 bp, Homo sapien
gttgaatcttctcatccaaaaacac

SEQ ID NO: 292833 - DNA, 25 bp, Homo sapien
agtctgtcccgttgatgtgtctgtt

SEQ ID NO: 292834 - DNA, 25 bp, Homo sapien
tgtctgttgttcacaggcgagggct

SEQ ID NO: 292835 - DNA, 25 bp, Homo sapien
ggcgagggctgtgctgcttaaatta

SEQ ID NO: 292836 - DNA, 25 bp, Homo sapien
gatttctttaagatgtcgatgccag

SEQ ID NO: 292837 - DNA, 25 bp, Homo sapien
ggaaaatccaacagacatgtagcag

SEQ ID NO: 292838 - DNA, 25 bp, Homo sapien
atccaacagacatgtagcagttaca

SEQ ID NO: 292839 - DNA, 25 bp, Homo sapien
acatagctctaggagtcacagtata

SEQ ID NO: 292840 - DNA, 25 bp, Homo sapien
ggagtcacagtatatttcttattaa

SEQ ID NO: 292841 - DNA, 25 bp, Homo sapien
acaagagaacacacaaacggaacaa

SEQ ID NO: 292842 - DNA, 25 bp, Homo sapien
gagtggaaaactttatctggttgat

SEQ ID NO: 292843 - DNA, 25 bp, Homo sapien
tctggttgatttagctggtagtgaa

SEQ ID NO: 292844 - DNA, 25 bp, Homo sapien
tcaaagaccaacctttcagttcatg

SEQ ID NO: 292845 - DNA, 25 bp, Homo sapien
ggtgcacagagcgttttgtatgtag

SEQ ID NO: 292846 - DNA, 25 bp, Homo sapien
gagcgttttgtatgtagtccagatg

SEQ ID NO: 292847 - DNA, 25 bp, Homo sapien
gtccagatgaagttatggataccat

SEQ ID NO: 292848 - DNA, 25 bp, Homo sapien
atatgactaagtcgtaggcggtgaa

SEQ ID NO: 292849 - DNA, 25 bp, Homo sapien
gcataggaatccaggcttgccccat

SEQ ID NO: 292850 - DNA, 25 bp, Homo sapien
ggcagagactgctaggtgtctacca

SEQ ID NO: 292851 - DNA, 25 bp, Homo sapien
aggcttgccccataaacatttcttg

SEQ ID NO: 292852 - DNA, 25 bp, Homo sapien
aacatttcttgcatgatcctccatt

SEQ ID NO: 292853 - DNA, 25 bp, Homo sapien
agctgctggttggacggtcgtatcc

SEQ ID NO: 292854 - DNA, 25 bp, Homo sapien
tggcaaagattgtcagtctggttct

SEQ ID NO: 292855 - DNA, 25 bp, Homo sapien
agtctggttctttgaatgaccgtga

SEQ ID NO: 292856 - DNA, 25 bp, Homo sapien
gtgtctaccaaagattcttgctctt

SEQ ID NO: 292857 - DNA, 25 bp, Homo sapien
tgtggcaatccagccagggacattt

SEQ ID NO: 292858 - DNA, 25 bp, Homo sapien
agggacatttccctactcccagcat

SEQ ID NO: 292859 - DNA, 25 bp, Homo sapien
tgaggtccccaggagccatgaagct

SEQ ID NO: 292860 - DNA, 25 bp, Homo sapien
cagggcaatgggactgcagtgtcct

SEQ ID NO: 292861 - DNA, 25 bp, Homo sapien
tcttgtctgtggagcctccttcaaa

SEQ ID NO: 292862 - DNA, 25 bp, Homo sapien
gtccttgttctttcttgttctatgc

SEQ ID NO: 292863 - DNA, 25 bp, Homo sapien
tctttcttgttctatgcatccatgc

SEQ ID NO: 292864 - DNA, 25 bp, Homo sapien
acatccctctagactggccttgtgg

SEQ ID NO: 292865 - DNA, 25 bp, Homo sapien
tagactggccttgtggtcagagcct

SEQ ID NO: 292866 - DNA, 25 bp, Homo sapien
cttgtggtcagagcctggagtgcat

SEQ ID NO: 292867 - DNA, 25 bp, Homo sapien
cctgtgggctgcactgggccagaac

SEQ ID NO: 292868 - DNA, 25 bp, Homo sapien
acgggttgtggttcttctaggatct

SEQ ID NO: 292869 - DNA, 25 bp, Homo sapien
ggatcttctatcaatgttctctgag

SEQ ID NO: 292870 - DNA, 25 bp, Homo sapien
tcaaaatggcagcatccttcggacc

SEQ ID NO: 292871 - DNA, 25 bp, Homo sapien
gcccgccgacagaaacatctgcaaa

SEQ ID NO: 292872 - DNA, 25 bp, Homo sapien
atctgcaaagatacagtctgactca

SEQ ID NO: 292873 - DNA, 25 bp, Homo sapien
tgactcagtgggttgacaggaacat

SEQ ID NO: 292874 - DNA, 25 bp, Homo sapien
ggaacatgcgaagccaccatcggtt

SEQ ID NO: 292875 - DNA, 25 bp, Homo sapien
tcccagacttctcgtacagttaatt

SEQ ID NO: 292876 - DNA, 25 bp, Homo sapien
gttaatttgtgtcatcccatcagca

SEQ ID NO: 292877 - DNA, 25 bp, Homo sapien
atcccatcagcaatgaaggtcccta

SEQ ID NO: 292878 - DNA, 25 bp, Homo sapien
agcaatgaaggtccctatccagggt

SEQ ID NO: 292879 - DNA, 25 bp, Homo sapien
ctgttttgtgctttgccgattttgg

SEQ ID NO: 292880 - DNA, 25 bp, Homo sapien
gtgctttgccgattttggattttat

SEQ ID NO: 292881 - DNA, 25 bp, Homo sapien
ggccctgttcctagaaatgtgcttt

SEQ ID NO: 292882 - DNA, 25 bp, Homo sapien
gtgctttatcagagagtgtgtgttt

SEQ ID NO: 292883 - DNA, 25 bp, Homo sapien
gtgtgtgttttcttaagggattctt

SEQ ID NO: 292884 - DNA, 25 bp, Homo sapien
tctttccatattctgatgtgagaca

SEQ ID NO: 292885 - DNA, 25 bp, Homo sapien
atgttcatttgctcatttgccttta

SEQ ID NO: 292886 - DNA, 25 bp, Homo sapien
atttgctcatttgcctttataatag

SEQ ID NO: 292887 - DNA, 25 bp, Homo sapien
ataacctctttctacttcacgagat

SEQ ID NO: 292888 - DNA, 25 bp, Homo sapien
tgccacatgtgcattggaacaagtt

SEQ ID NO: 292889 - DNA, 25 bp, Homo sapien
tggaagtgttaagattccctcccca

SEQ ID NO: 292890 - DNA, 25 bp, Homo sapien
ccttcaaccctgtaatctaagccaa

SEQ ID NO: 292891 - DNA, 25 bp, Homo sapien
cctgtaatctaagccaactgtttga

SEQ ID NO: 292892 - DNA, 25 bp, Homo sapien
gggagttcaggtatctgttgtgact

SEQ ID NO: 292893 - DNA, 25 bp, Homo sapien
tgttgtgactggtgaagccctgtac

SEQ ID NO: 292894 - DNA, 25 bp, Homo sapien
agccctgtacctcctgggtattgaa

SEQ ID NO: 292895 - DNA, 25 bp, Homo sapien
tacctcctgggtattgaagaacctg

SEQ ID NO: 292896 - DNA, 25 bp, Homo sapien
aggaggtatctgcaaggaatgtata

SEQ ID NO: 292897 - DNA, 25 bp, Homo sapien
gttccacatggaagctgggttgcct

SEQ ID NO: 292898 - DNA, 25 bp, Homo sapien
cacaagtccccagtagagtggatct

SEQ ID NO: 292899 - DNA, 25 bp, Homo sapien
agagtggatctgtagttacccgccc

SEQ ID NO: 292900 - DNA, 25 bp, Homo sapien
tccctttcagggtggtcatgaggtc

SEQ ID NO: 292901 - DNA, 25 bp, Homo sapien
gaggtcccagagagaccatgcatct

SEQ ID NO: 292902 - DNA, 25 bp, Homo sapien
gttgtcactgtggtaatttccttgc

SEQ ID NO: 292903 - DNA, 25 bp, Homo sapien
ggcctgttgataactccattaccca

SEQ ID NO: 292904 - DNA, 25 bp, Homo sapien
gttgataactccattacccacccat

SEQ ID NO: 292905 - DNA, 25 bp, Homo sapien
gggagctgccttcggtacataattt

SEQ ID NO: 292906 - DNA, 25 bp, Homo sapien
gctgccttcggtacataatttgaag

SEQ ID NO: 292907 - DNA, 25 bp, Homo sapien
gtacataatttgaaggggcactccc

SEQ ID NO: 292908 - DNA, 25 bp, Homo sapien
tcttgggcacatgccggccctgagt

SEQ ID NO: 292909 - DNA, 25 bp, Homo sapien
gccccataatgtcctcagtggaagg

SEQ ID NO: 292910 - DNA, 25 bp, Homo sapien
gggttggcatgactaaaaataccag

SEQ ID NO: 292911 - DNA, 25 bp, Homo sapien
ggcatgactaaaaataccagtatgt

SEQ ID NO: 292912 - DNA, 25 bp, Homo sapien
gtatgtgtattaagtattttgagaa

SEQ ID NO: 292913 - DNA, 25 bp, Homo sapien
gaatgaaatgccaaggagtgcctac

SEQ ID NO: 292914 - DNA, 25 bp, Homo sapien
ggaagagctgacatgtgtacgtata

SEQ ID NO: 292915 - DNA, 25 bp, Homo sapien
acgtatatgtatatgcaacacctgt

SEQ ID NO: 292916 - DNA, 25 bp, Homo sapien
tcaaggaaaaccattgcctgcaccc

SEQ ID NO: 292917 - DNA, 25 bp, Homo sapien
aagcacggtcctaaacttgtctgca

SEQ ID NO: 292918 - DNA, 25 bp, Homo sapien
cggtcctaaacttgtctgcacttta

SEQ ID NO: 292919 - DNA, 25 bp, Homo sapien
gtctgcactttagaaacacctggag

SEQ ID NO: 292920 - DNA, 25 bp, Homo sapien
gaaaactctgctgcctaaggtcagc

SEQ ID NO: 292921 - DNA, 25 bp, Homo sapien
gcctaaggtcagcatcaatcaaaac

SEQ ID NO: 292922 - DNA, 25 bp, Homo sapien
atgaaaccagagcttctaggtgtgt

SEQ ID NO: 292923 - DNA, 25 bp, Homo sapien
agcttctaggtgtgtggcctggata

SEQ ID NO: 292924 - DNA, 25 bp, Homo sapien
gtggcctggatagtggtagattcaa

SEQ ID NO: 292925 - DNA, 25 bp, Homo sapien
gggccttcggaggtcatgaacacat

SEQ ID NO: 292926 - DNA, 25 bp, Homo sapien
gtcatgaacacatgcagggcagtca

SEQ ID NO: 292927 - DNA, 25 bp, Homo sapien
aggaagggatgtttacccatcacaa

SEQ ID NO: 292928 - DNA, 25 bp, Homo sapien
catcacaaatgggtctttccaatgt

SEQ ID NO: 292929 - DNA, 25 bp, Homo sapien
tttccaatgtgggtatttgtggctg

SEQ ID NO: 292930 - DNA, 25 bp, Homo sapien
gctggtgcacagataaaagtagaca

SEQ ID NO: 292931 - DNA, 25 bp, Homo sapien
gtagacacaatactccttggtgggt

SEQ ID NO: 292932 - DNA, 25 bp, Homo sapien
tccttggtgggtgtgcctctagtaa

SEQ ID NO: 292933 - DNA, 25 bp, Homo sapien
cctctagtaatgtgtaagttctgac

SEQ ID NO: 292934 - DNA, 25 bp, Homo sapien
aaaatcctggccagtggaactaaga

SEQ ID NO: 292935 - DNA, 25 bp, Homo sapien
atattcttgtttgggcaagggaact

SEQ ID NO: 292936 - DNA, 25 bp, Homo sapien
ctcgtgggaactcactcattatcag

SEQ ID NO: 292937 - DNA, 25 bp, Homo sapien
gtgggaactcactcattatcaggag

SEQ ID NO: 292938 - DNA, 25 bp, Homo sapien
tcattatcaggagaacagcactggg

SEQ ID NO: 292939 - DNA, 25 bp, Homo sapien
gggactgcccccgtgatctgatcac

SEQ ID NO: 292940 - DNA, 25 bp, Homo sapien
aggttccaccccagcacctgggaat

SEQ ID NO: 292941 - DNA, 25 bp, Homo sapien
cctgggaatcacaacttggtttaca

SEQ ID NO: 292942 - DNA, 25 bp, Homo sapien
ctgggaatcacaacttggtttacaa

SEQ ID NO: 292943 - DNA, 25 bp, Homo sapien
tgggaatcacaacttggtttacaat

SEQ ID NO: 292944 - DNA, 25 bp, Homo sapien
gggaatcacaacttggtttacaatt

SEQ ID NO: 292945 - DNA, 25 bp, Homo sapien
ggaatcacaacttggtttacaattc

SEQ ID NO: 292946 - DNA, 25 bp, Homo sapien
gaatcacaacttggtttacaattca

SEQ ID NO: 292947 - DNA, 25 bp, Homo sapien
cagtgagtgtggcacgtccttccgt

SEQ ID NO: 292948 - DNA, 25 bp, Homo sapien
gagtgtggcacgtccttccgtcagg

SEQ ID NO: 292949 - DNA, 25 bp, Homo sapien
ttccgtcagggctcagctctgattg

SEQ ID NO: 292950 - DNA, 25 bp, Homo sapien
gtcagggctcagctctgattggaca

SEQ ID NO: 292951 - DNA, 25 bp, Homo sapien
cagggctcagctctgattggacata

SEQ ID NO: 292952 - DNA, 25 bp, Homo sapien
ggctcagctctgattggacataagc

SEQ ID NO: 292953 - DNA, 25 bp, Homo sapien
gctctgattggacataagcgagttc

SEQ ID NO: 292954 - DNA, 25 bp, Homo sapien
tttagagtgagctcaaatcttactg

SEQ ID NO: 292955 - DNA, 25 bp, Homo sapien
gagtgagctcaaatcttactggaca

SEQ ID NO: 292956 - DNA, 25 bp, Homo sapien
aaaacatcaagtatggagtacccat

SEQ ID NO: 292957 - DNA, 25 bp, Homo sapien
gtatggagtacccatgaacttgatg

SEQ ID NO: 292958 - DNA, 25 bp, Homo sapien
gcctccagactaagggcgctcagtg

SEQ ID NO: 292959 - DNA, 25 bp, Homo sapien
taagggcgctcagtgcggcgttctt

SEQ ID NO: 292960 - DNA, 25 bp, Homo sapien
gcggcgttcttgttgcagatgattc

SEQ ID NO: 292961 - DNA, 25 bp, Homo sapien
gtgtcgggcgacatttgaccttctt

SEQ ID NO: 292962 - DNA, 25 bp, Homo sapien
catttgaccttcttcaggtgcttag

SEQ ID NO: 292963 - DNA, 25 bp, Homo sapien
gtctggaaacatgatcctttcgcgt

SEQ ID NO: 292964 - DNA, 25 bp, Homo sapien
tcctttcgcgtaagtttctttctga

SEQ ID NO: 292965 - DNA, 25 bp, Homo sapien
ttctttctgaaagccaccaatcttg

SEQ ID NO: 292966 - DNA, 25 bp, Homo sapien
gccaccaatcttgactgtaagctgt

SEQ ID NO: 292967 - DNA, 25 bp, Homo sapien
gtatttgagagatcttttggctgag

SEQ ID NO: 292968 - DNA, 25 bp, Homo sapien
cgccagggtgtgacctcaacggaaa

SEQ ID NO: 292969 - DNA, 25 bp, Homo sapien
gaactttcaaaatatgtgtttacct

SEQ ID NO: 292970 - DNA, 25 bp, Homo sapien
gaaaagttaaatatcttgtgtaagt

SEQ ID NO: 292971 - DNA, 25 bp, Homo sapien
gtaaagatgctcttaatgggaaaat

SEQ ID NO: 292972 - DNA, 25 bp, Homo sapien
tcttcatcttctctgctaaaatcag

SEQ ID NO: 292973 - DNA, 25 bp, Homo sapien
atcagaatcttcaggctagcaatgg

SEQ ID NO: 292974 - DNA, 25 bp, Homo sapien
ggcacacaaggacaattaatcccac

SEQ ID NO: 292975 - DNA, 25 bp, Homo sapien
aattaatcccacgtaatcactgcac

SEQ ID NO: 292976 - DNA, 25 bp, Homo sapien
ttaatcccacgtaatcactgcacac

SEQ ID NO: 292977 - DNA, 25 bp, Homo sapien
cacgtaatcactgcacaccatgtaa

SEQ ID NO: 292978 - DNA, 25 bp, Homo sapien
gtaatcactgcacaccatgtaaata

SEQ ID NO: 292979 - DNA, 25 bp, Homo sapien
atcactgcacaccatgtaaataatc

SEQ ID NO: 292980 - DNA, 25 bp, Homo sapien
gcgggcccaggttccaccctggaga

SEQ ID NO: 292981 - DNA, 25 bp, Homo sapien
ggcccaggttccaccctggagagag

SEQ ID NO: 292982 - DNA, 25 bp, Homo sapien
aggttccaccctggagagagcgctt

SEQ ID NO: 292983 - DNA, 25 bp, Homo sapien
gttccaccctggagagagcgcttcc

SEQ ID NO: 292984 - DNA, 25 bp, Homo sapien
caccctggagagagcgcttccctaa

SEQ ID NO: 292985 - DNA, 25 bp, Homo sapien
ggagagagcgcttccctaacttcgt

SEQ ID NO: 292986 - DNA, 25 bp, Homo sapien
gagagagcgcttccctaacttcgtg

SEQ ID NO: 292987 - DNA, 25 bp, Homo sapien
agagcgcttccctaacttcgtggcg

SEQ ID NO: 292988 - DNA, 25 bp, Homo sapien
agcgcttccctaacttcgtggcggc

SEQ ID NO: 292989 - DNA, 25 bp, Homo sapien
gacgcccctccagtcctgggagcag

SEQ ID NO: 292990 - DNA, 25 bp, Homo sapien
cccctaccagcctgcgaggtcagca

SEQ ID NO: 292991 - DNA, 25 bp, Homo sapien
atagttctgtatccaatctgttcaa

SEQ ID NO: 292992 - DNA, 25 bp, Homo sapien
gtatccaatctgttcaaaactccta

SEQ ID NO: 292993 - DNA, 25 bp, Homo sapien
ctaaaccaactctcagtctgagatg

SEQ ID NO: 292994 - DNA, 25 bp, Homo sapien
tctcagtctgagatggtcctcgcgg

SEQ ID NO: 292995 - DNA, 25 bp, Homo sapien
aacacccacactcggtgatttcgaa

SEQ ID NO: 292996 - DNA, 25 bp, Homo sapien
aaaatacgtgcagtagcctcggcca

SEQ ID NO: 292997 - DNA, 25 bp, Homo sapien
gagctggatgaaacgccggcttaca

SEQ ID NO: 292998 - DNA, 25 bp, Homo sapien
tacccaagcccggaattctgttaga

SEQ ID NO: 292999 - DNA, 25 bp, Homo sapien
ctgttagatgacaaactggacccta

SEQ ID NO: 293000 - DNA, 25 bp, Homo sapien
aactggaccctagagttaacattct

SEQ ID NO: 293001 - DNA, 25 bp, Homo sapien
tagagttaacattctagtctttccc

SEQ ID NO: 293002 - DNA, 25 bp, Homo sapien
gtgccagggacgtggaatccagcct

SEQ ID NO: 293003 - DNA, 25 bp, Homo sapien
agcctctgtcacatcttggtcacgt

SEQ ID NO: 293004 - DNA, 25 bp, Homo sapien
atcttggtcacgtgagttcagaaca

SEQ ID NO: 293005 - DNA, 25 bp, Homo sapien
aacagtgtagcctgaatgacggcat

SEQ ID NO: 293006 - DNA, 25 bp, Homo sapien
gaatgacggcatggtctcatgggca

SEQ ID NO: 293007 - DNA, 25 bp, Homo sapien
ggtctcatgggcaccctgagtccat

SEQ ID NO: 293008 - DNA, 25 bp, Homo sapien
gctcccactggccatgtgaatttca

SEQ ID NO: 293009 - DNA, 25 bp, Homo sapien
atgtgaatttcatcgccctcagcct

SEQ ID NO: 293010 - DNA, 25 bp, Homo sapien
caaaagagagaacacccagctcaag

SEQ ID NO: 293011 - DNA, 25 bp, Homo sapien
acatacatagtgttgtcaaagctta

SEQ ID NO: 293012 - DNA, 25 bp, Homo sapien
atactttgttattgattgttgctat

SEQ ID NO: 293013 - DNA, 25 bp, Homo sapien
atgctttttcttgattctctgaatg

SEQ ID NO: 293014 - DNA, 25 bp, Homo sapien
gattctctgaatgtatagtagtgct

SEQ ID NO: 293015 - DNA, 25 bp, Homo sapien
taccatatgggattttaactgtttg

SEQ ID NO: 293016 - DNA, 25 bp, Homo sapien
catatgggattttaactgtttgtct

SEQ ID NO: 293017 - DNA, 25 bp, Homo sapien
ttttaactgtttgtcttccactaga

SEQ ID NO: 293018 - DNA, 25 bp, Homo sapien
ctagacaataagctccttgaagact

SEQ ID NO: 293019 - DNA, 25 bp, Homo sapien
gacaataagctccttgaagactgaa

SEQ ID NO: 293020 - DNA, 25 bp, Homo sapien
aataagctccttgaagactgaattt

SEQ ID NO: 293021 - DNA, 25 bp, Homo sapien
gaatgtatagtagtgcttctttagc

SEQ ID NO: 293022 - DNA, 25 bp, Homo sapien
gtatagtagtgcttctttagctaag

SEQ ID NO: 293023 - DNA, 25 bp, Homo sapien
atagtagtgcttctttagctaagaa

SEQ ID NO: 293024 - DNA, 25 bp, Homo sapien
ctatcagaggcactagggcagtttt

SEQ ID NO: 293025 - DNA, 25 bp, Homo sapien
ggcagttttggaacagagagcccat

SEQ ID NO: 293026 - DNA, 25 bp, Homo sapien
gagcccatagaaaggctactgctta

SEQ ID NO: 293027 - DNA, 25 bp, Homo sapien
tgcttagagatagccattttcttct

SEQ ID NO: 293028 - DNA, 25 bp, Homo sapien
agctggaccagtgaattagacgcat

SEQ ID NO: 293029 - DNA, 25 bp, Homo sapien
ggaggagagctggaaaatccctttt

SEQ ID NO: 293030 - DNA, 25 bp, Homo sapien
aatccctttttggaagagctacaca

SEQ ID NO: 293031 - DNA, 25 bp, Homo sapien
gggtattcctcttaaatggcttgac

SEQ ID NO: 293032 - DNA, 25 bp, Homo sapien
tggcttgacaataaccaccaaccag

SEQ ID NO: 293033 - DNA, 25 bp, Homo sapien
agcactgccatacatgtgtcctgta

SEQ ID NO: 293034 - DNA, 25 bp, Homo sapien
atgtgtcctgtacctatcagaggca

SEQ ID NO: 293035 - DNA, 25 bp, Homo sapien
atttgagcaggatgtgcacaaggca

SEQ ID NO: 293036 - DNA, 25 bp, Homo sapien
gaaatgcccataattagtttctcag

SEQ ID NO: 293037 - DNA, 25 bp, Homo sapien
gaaggaagctactaaaagatctaat

SEQ ID NO: 293038 - DNA, 25 bp, Homo sapien
attttccttttgtctgggcagtagt

SEQ ID NO: 293039 - DNA, 25 bp, Homo sapien
tttccttttgtctgggcagtagtga

SEQ ID NO: 293040 - DNA, 25 bp, Homo sapien
ttccttttgtctgggcagtagtgaa

SEQ ID NO: 293041 - DNA, 25 bp, Homo sapien
ttgtctgggcagtagtgaaaataac

SEQ ID NO: 293042 - DNA, 25 bp, Homo sapien
gaaaataactactcacaacattcac

SEQ ID NO: 293043 - DNA, 25 bp, Homo sapien
acaacattcactatgtttgcaagga

SEQ ID NO: 293044 - DNA, 25 bp, Homo sapien
acattcactatgtttgcaaggaatt

SEQ ID NO: 293045 - DNA, 25 bp, Homo sapien
cactatgtttgcaaggaattaacac

SEQ ID NO: 293046 - DNA, 25 bp, Homo sapien
gcaggcttgttgaagctgttcataa

SEQ ID NO: 293047 - DNA, 25 bp, Homo sapien
gaacaatatttagtgtcaagttagt

SEQ ID NO: 293048 - DNA, 25 bp, Homo sapien
gtggaacagggattactacaaggtg

SEQ ID NO: 293049 - DNA, 25 bp, Homo sapien
gggattactacaaggtgaacatgct

SEQ ID NO: 293050 - DNA, 25 bp, Homo sapien
ggtgaacatgcttctgtaatcgcca

SEQ ID NO: 293051 - DNA, 25 bp, Homo sapien
gaacatgcttctgtaatcgccacac

SEQ ID NO: 293052 - DNA, 25 bp, Homo sapien
atgcttctgtaatcgccacacaggt

SEQ ID NO: 293053 - DNA, 25 bp, Homo sapien
tgtaatcgccacacaggtcaggaaa

SEQ ID NO: 293054 - DNA, 25 bp, Homo sapien
aatcgccacacaggtcaggaaataa

SEQ ID NO: 293055 - DNA, 25 bp, Homo sapien
actggagtatggtggcatgattatg

SEQ ID NO: 293056 - DNA, 25 bp, Homo sapien
gcatgattatggttcactgaagcct

SEQ ID NO: 293057 - DNA, 25 bp, Homo sapien
ttctcctggagaatttgacctgata

SEQ ID NO: 293058 - DNA, 25 bp, Homo sapien
tgacctgatacttggtgctgatatc

SEQ ID NO: 293059 - DNA, 25 bp, Homo sapien
gaaacattcacagatcttcttcaaa

SEQ ID NO: 293060 - DNA, 25 bp, Homo sapien
catctctgtagcaatcactctgtga

SEQ ID NO: 293061 - DNA, 25 bp, Homo sapien
gattcttttagcatgccgaattcgc

SEQ ID NO: 293062 - DNA, 25 bp, Homo sapien
gccgaattcgctatgaacgggataa

SEQ ID NO: 293063 - DNA, 25 bp, Homo sapien
gctatgaacgggataacaacttctt

SEQ ID NO: 293064 - DNA, 25 bp, Homo sapien
tcttagcaatgctggagaggcaatt

SEQ ID NO: 293065 - DNA, 25 bp, Homo sapien
gagaaaggttcactacgatcctgaa

SEQ ID NO: 293066 - DNA, 25 bp, Homo sapien
gtacatatttacgaagcacagaaga

SEQ ID NO: 293067 - DNA, 25 bp, Homo sapien
gaaggaggacttataattggctata

SEQ ID NO: 293068 - DNA, 25 bp, Homo sapien
gggatccttgactaattggtgcttc

SEQ ID NO: 293069 - DNA, 25 bp, Homo sapien
taattggtgcttcatatgttctcat

SEQ ID NO: 293070 - DNA, 25 bp, Homo sapien
tatgttctcattacttgctttgggt

SEQ ID NO: 293071 - DNA, 25 bp, Homo sapien
ggtaagtcttgtacaggcaggagcc

SEQ ID NO: 293072 - DNA, 25 bp, Homo sapien
tagggtctgttaccatctcagtgac

SEQ ID NO: 293073 - DNA, 25 bp, Homo sapien
taaaacaacctacaaacttccagca

SEQ ID NO: 293074 - DNA, 25 bp, Homo sapien
agcaccatttcctagcatgctggct

SEQ ID NO: 293075 - DNA, 25 bp, Homo sapien
tagcatgctggctcagcagactgtt

SEQ ID NO: 293076 - DNA, 25 bp, Homo sapien
ctcagcagactgttactccgtgtaa

SEQ ID NO: 293077 - DNA, 25 bp, Homo sapien
accctagtcctgatcctgttgggaa

SEQ ID NO: 293078 - DNA, 25 bp, Homo sapien
cctgttgggaagtctggaaagtcaa

SEQ ID NO: 293079 - DNA, 25 bp, Homo sapien
catcgttttcaccattagttgaggg

SEQ ID NO: 293080 - DNA, 25 bp, Homo sapien
tgctgctgtaagatggtttctgtgc

SEQ ID NO: 293081 - DNA, 25 bp, Homo sapien
tgtaagatggtttctgtgcagggaa

SEQ ID NO: 293082 - DNA, 25 bp, Homo sapien
ttcaccattagttgagggaatcgat

SEQ ID NO: 293083 - DNA, 25 bp, Homo sapien
tcagtgcacctgacacgcatggagc

SEQ ID NO: 293084 - DNA, 25 bp, Homo sapien
tgacacgcatggagccggtcctttc

SEQ ID NO: 293085 - DNA, 25 bp, Homo sapien
agccagaccccaaacaaactggctt

SEQ ID NO: 293086 - DNA, 25 bp, Homo sapien
gagggaatcgatctgtgccttcatt

SEQ ID NO: 293087 - DNA, 25 bp, Homo sapien
atcgatctgtgccttcattctaaga

SEQ ID NO: 293088 - DNA, 25 bp, Homo sapien
tgtgccttcattctaagatgccacc

SEQ ID NO: 293089 - DNA, 25 bp, Homo sapien
attctaagatgccaccgcattcggg

SEQ ID NO: 293090 - DNA, 25 bp, Homo sapien
agtggagtcaccagagtgagacgaa

SEQ ID NO: 293091 - DNA, 25 bp, Homo sapien
gggacctcttgtatcttgaagaaat

SEQ ID NO: 293092 - DNA, 25 bp, Homo sapien
gaagaaatcctgtagaatagaacaa

SEQ ID NO: 293093 - DNA, 25 bp, Homo sapien
tcttaaatgtcttcttcaagcaaag

SEQ ID NO: 293094 - DNA, 25 bp, Homo sapien
aaagaagccagtcccagagcaataa

SEQ ID NO: 293095 - DNA, 25 bp, Homo sapien
gaagccagtcccagagcaataaata

SEQ ID NO: 293096 - DNA, 25 bp, Homo sapien
ctgctgagcgcaagggctctgaagt

SEQ ID NO: 293097 - DNA, 25 bp, Homo sapien
gcaagggctctgaagttccagctta

SEQ ID NO: 293098 - DNA, 25 bp, Homo sapien
ctctgaagttccagcttagccctga

SEQ ID NO: 293099 - DNA, 25 bp, Homo sapien
ttagccctgaggtttggtgatagca

SEQ ID NO: 293100 - DNA, 25 bp, Homo sapien
ccctgaggtttggtgatagcagcca

SEQ ID NO: 293101 - DNA, 25 bp, Homo sapien
tttctgcatctgctttgcgtagcta

SEQ ID NO: 293102 - DNA, 25 bp, Homo sapien
ctgctttgcgtagctattgtaaggc

SEQ ID NO: 293103 - DNA, 25 bp, Homo sapien
gtaaggctttgaactaatgtatgta

SEQ ID NO: 293104 - DNA, 25 bp, Homo sapien
gtatttattgcttgaacttctgtgc

SEQ ID NO: 293105 - DNA, 25 bp, Homo sapien
gcttgaacttctgtgcataccttat

SEQ ID NO: 293106 - DNA, 25 bp, Homo sapien
ataaatgaccagactttttctaaga

SEQ ID NO: 293107 - DNA, 25 bp, Homo sapien
atgtctgacaatttaaatggctcat

SEQ ID NO: 293108 - DNA, 25 bp, Homo sapien
ttaaatggctcatgtattcttgctt

SEQ ID NO: 293109 - DNA, 25 bp, Homo sapien
gggactatgatcttttgtatacagc

SEQ ID NO: 293110 - DNA, 25 bp, Homo sapien
gcaaattttaaactgtagcacaaac

SEQ ID NO: 293111 - DNA, 25 bp, Homo sapien
ttactcttatatcattgcttgctag

SEQ ID NO: 293112 - DNA, 25 bp, Homo sapien
gtgaagtctcccaaatgaacttttt

SEQ ID NO: 293113 - DNA, 25 bp, Homo sapien
gacactcctgaccaacagcggtaga

SEQ ID NO: 293114 - DNA, 25 bp, Homo sapien
gcggtagaccctccagtgtttgcta

SEQ ID NO: 293115 - DNA, 25 bp, Homo sapien
gtttgctaatatggcgctggatctt

SEQ ID NO: 293116 - DNA, 25 bp, Homo sapien
gatcttggctttgtcatgtctttcc

SEQ ID NO: 293117 - DNA, 25 bp, Homo sapien
tttcctctgaggctgatgcgtatac

SEQ ID NO: 293118 - DNA, 25 bp, Homo sapien
ccagccatcctatttgaggtcgttt

SEQ ID NO: 293119 - DNA, 25 bp, Homo sapien
aaatgtctctccattgtcgctagcg

SEQ ID NO: 293120 - DNA, 25 bp, Homo sapien
ttgtcgctagcgtgcaggcatgtga

SEQ ID NO: 293121 - DNA, 25 bp, Homo sapien
gtgggtaactgatgcctcacagaat

SEQ ID NO: 293122 - DNA, 25 bp, Homo sapien
acaaatccttccgaggttggcccat

SEQ ID NO: 293123 - DNA, 25 bp, Homo sapien
gtttacagatacatttgagctaaat

SEQ ID NO: 293124 - DNA, 25 bp, Homo sapien
aataatctgtagcagtatgttctga

SEQ ID NO: 293125 - DNA, 25 bp, Homo sapien
tgttctgatgaacataatctctaga

SEQ ID NO: 293126 - DNA, 25 bp, Homo sapien
gaatactacagatcttcaagcataa

SEQ ID NO: 293127 - DNA, 25 bp, Homo sapien
cttcaagcataagatagaactgtat

SEQ ID NO: 293128 - DNA, 25 bp, Homo sapien
agaactgtatgtattgacctggaaa

SEQ ID NO: 293129 - DNA, 25 bp, Homo sapien
gtatgtattgacctggaaagccatg

SEQ ID NO: 293130 - DNA, 25 bp, Homo sapien
gtattgacctggaaagccatgataa

SEQ ID NO: 293131 - DNA, 25 bp, Homo sapien
gacctggaaagccatgataaatatg

SEQ ID NO: 293132 - DNA, 25 bp, Homo sapien
aattccaaattgttagcagtgttta

SEQ ID NO: 293133 - DNA, 25 bp, Homo sapien
gaaaattgagtattgggtttacaga

SEQ ID NO: 293134 - DNA, 25 bp, Homo sapien
agcgcggagagcagccacttctttg

SEQ ID NO: 293135 - DNA, 25 bp, Homo sapien
agagcagccacttctttgcatatct

SEQ ID NO: 293136 - DNA, 25 bp, Homo sapien
cacttctttgcatatctggtgactg

SEQ ID NO: 293137 - DNA, 25 bp, Homo sapien
tctttgcatatctggtgactgcagc

SEQ ID NO: 293138 - DNA, 25 bp, Homo sapien
ttgtggctgtcctctatatcgctca

SEQ ID NO: 293139 - DNA, 25 bp, Homo sapien
cctctatatcgctcatcacaacaag

SEQ ID NO: 293140 - DNA, 25 bp, Homo sapien
tcacaacaagcggaagatcattgct

SEQ ID NO: 293141 - DNA, 25 bp, Homo sapien
gatcattgcttttgtcctggaagga

SEQ ID NO: 293142 - DNA, 25 bp, Homo sapien
gaaaaagatctaaagtcacccggcg

SEQ ID NO: 293143 - DNA, 25 bp, Homo sapien
caaaggccagtgactaccaacgttt

SEQ ID NO: 293144 - DNA, 25 bp, Homo sapien
gtgactaccaacgtttggaccagaa

SEQ ID NO: 293145 - DNA, 25 bp, Homo sapien
gggccgcgtcagattgaccatggaa

SEQ ID NO: 293146 - DNA, 25 bp, Homo sapien
ttgaccatggaattcccctcatcga

SEQ ID NO: 293147 - DNA, 25 bp, Homo sapien
ccagaacacaactggcgccctgaaa

SEQ ID NO: 293148 - DNA, 25 bp, Homo sapien
aaactgttggtcagcgcaataaatc

SEQ ID NO: 293149 - DNA, 25 bp, Homo sapien
taaatcaatgaatggcctgctacgg

SEQ ID NO: 293150 - DNA, 25 bp, Homo sapien
caatgaatggcctgctacgggcgtg

SEQ ID NO: 293151 - DNA, 25 bp, Homo sapien
gcgcccgcaaagaacgcgatgggtc

SEQ ID NO: 293152 - DNA, 25 bp, Homo sapien
aaagaacgcgatgggtcgcgctgaa

SEQ ID NO: 293153 - DNA, 25 bp, Homo sapien
cgcgagaggcgtccggcaaggaaat

SEQ ID NO: 293154 - DNA, 25 bp, Homo sapien
accacaaccaaagcgtgccgaggag

SEQ ID NO: 293155 - DNA, 25 bp, Homo sapien
atcagactagggacccgacaccggg

SEQ ID NO: 293156 - DNA, 25 bp, Homo sapien
ggaggaaggatgtccctgcactgat

SEQ ID NO: 293157 - DNA, 25 bp, Homo sapien
aaggatgtccctgcactgatacaga

SEQ ID NO: 293158 - DNA, 25 bp, Homo sapien
ggatgtccctgcactgatacagaag

SEQ ID NO: 293159 - DNA, 25 bp, Homo sapien
gtccctgcactgatacagaagctgt

SEQ ID NO: 293160 - DNA, 25 bp, Homo sapien
ctgcactgatacagaagctgtttct

SEQ ID NO: 293161 - DNA, 25 bp, Homo sapien
gccgtgtcttacatttgtctctcta

SEQ ID NO: 293162 - DNA, 25 bp, Homo sapien
atttgtctctctatccggattagat

SEQ ID NO: 293163 - DNA, 25 bp, Homo sapien
cagatggtgaagagcgctcgcccgg

SEQ ID NO: 293164 - DNA, 25 bp, Homo sapien
gcgctcgcccggtagcagaaccgaa

SEQ ID NO: 293165 - DNA, 25 bp, Homo sapien
gtagcagaaccgaacccgggcttct

SEQ ID NO: 293166 - DNA, 25 bp, Homo sapien
agcagaaccgaacccgggcttctgg

SEQ ID NO: 293167 - DNA, 25 bp, Homo sapien
aaaggccagaggaatccaggcctgt

SEQ ID NO: 293168 - DNA, 25 bp, Homo sapien
ccaggcctgtggtgacaacatttga

SEQ ID NO: 293169 - DNA, 25 bp, Homo sapien
gacaacatttgagctgctggatcaa

SEQ ID NO: 293170 - DNA, 25 bp, Homo sapien
ggatcaaacctcacctgaagtcctt

SEQ ID NO: 293171 - DNA, 25 bp, Homo sapien
ccttcctattcctactagatatttt

SEQ ID NO: 293172 - DNA, 25 bp, Homo sapien
ttttttccactgtgtgggccaatgc

SEQ ID NO: 293173 - DNA, 25 bp, Homo sapien
gtgggccaatgcattccctttatac

SEQ ID NO: 293174 - DNA, 25 bp, Homo sapien
aatgcattccctttatactgtgtaa

SEQ ID NO: 293175 - DNA, 25 bp, Homo sapien
ctttatactgtgtaagccaggcatg

SEQ ID NO: 293176 - DNA, 25 bp, Homo sapien
aggtcagcctggcagaagccatctt

SEQ ID NO: 293177 - DNA, 25 bp, Homo sapien
gaagccatcttgtggagcatgaaaa

SEQ ID NO: 293178 - DNA, 25 bp, Homo sapien
tttttctatagcaatagtgtctgat

SEQ ID NO: 293179 - DNA, 25 bp, Homo sapien
gtctgatagacatatgcaagtcaca

SEQ ID NO: 293180 - DNA, 25 bp, Homo sapien
gcaagtcacatgtaatttaagatct

SEQ ID NO: 293181 - DNA, 25 bp, Homo sapien
tttaagatctagtagccacgctaaa

SEQ ID NO: 293182 - DNA, 25 bp, Homo sapien
actaagtctgtctggtttgcatatc

SEQ ID NO: 293183 - DNA, 25 bp, Homo sapien
gtctgtctggtttgcatatctcagt

SEQ ID NO: 293184 - DNA, 25 bp, Homo sapien
ggtttgcatatctcagttgagacac

SEQ ID NO: 293185 - DNA, 25 bp, Homo sapien
gttgagacactaaagttttactgat

SEQ ID NO: 293186 - DNA, 25 bp, Homo sapien
ctgataatacttaatccatgtttag

SEQ ID NO: 293187 - DNA, 25 bp, Homo sapien
gtaaatttacatacccatgttggtc

SEQ ID NO: 293188 - DNA, 25 bp, Homo sapien
acccatgttggtctaaatgtgctta

SEQ ID NO: 293189 - DNA, 25 bp, Homo sapien
agagggtcatggtattggcgtccat

SEQ ID NO: 293190 - DNA, 25 bp, Homo sapien
tattggcgtccatatttctgtactg

SEQ ID NO: 293191 - DNA, 25 bp, Homo sapien
atatttctgtactggtgcttcatga

SEQ ID NO: 293192 - DNA, 25 bp, Homo sapien
gcttcatgaaagctggtggcatctc

SEQ ID NO: 293193 - DNA, 25 bp, Homo sapien
ttccctgacacctgatatcataacg

SEQ ID NO: 293194 - DNA, 25 bp, Homo sapien
atcataacgaattcaggactccagc

SEQ ID NO: 293195 - DNA, 25 bp, Homo sapien
ttcaggactccagctcagtgagaga

SEQ ID NO: 293196 - DNA, 25 bp, Homo sapien
gtgagagagtttctgctccttgcaa

SEQ ID NO: 293197 - DNA, 25 bp, Homo sapien
gcaaccaaaagcatcttcactggga

SEQ ID NO: 293198 - DNA, 25 bp, Homo sapien
ggacatgtaacacaggcactcaccg

SEQ ID NO: 293199 - DNA, 25 bp, Homo sapien
gcactcaccgctgggatgctgtgga

SEQ ID NO: 293200 - DNA, 25 bp, Homo sapien
gtatagtgtgtaggcctagccccat

SEQ ID NO: 293201 - DNA, 25 bp, Homo sapien
taggcctagccccatgtattacgaa

SEQ ID NO: 293202 - DNA, 25 bp, Homo sapien
catgtattacgaactcataaactca

SEQ ID NO: 293203 - DNA, 25 bp, Homo sapien
aaacattgtatgtctccttcattta

SEQ ID NO: 293204 - DNA, 25 bp, Homo sapien
atgtctccttcatttatgcaagtca

SEQ ID NO: 293205 - DNA, 25 bp, Homo sapien
atgcaagtcatgctttcattctaca

SEQ ID NO: 293206 - DNA, 25 bp, Homo sapien
atgctttcattctacatgtacgtaa

SEQ ID NO: 293207 - DNA, 25 bp, Homo sapien
aatttgattgtattacctatcacag

SEQ ID NO: 293208 - DNA, 25 bp, Homo sapien
cctatcacagaaccaataacccttt

SEQ ID NO: 293209 - DNA, 25 bp, Homo sapien
caataaccctttctttttctgcact

SEQ ID NO: 293210 - DNA, 25 bp, Homo sapien
catgaatattctttactgtgcaaat

SEQ ID NO: 293211 - DNA, 25 bp, Homo sapien
ggctgccttggcatttttagtgatg

SEQ ID NO: 293212 - DNA, 25 bp, Homo sapien
ttttagtgatgtgtggcctcaccac

SEQ ID NO: 293213 - DNA, 25 bp, Homo sapien
gcctcaccacttaaatccagtttat

SEQ ID NO: 293214 - DNA, 25 bp, Homo sapien
ggactacacaataaacaccctccaa

SEQ ID NO: 293215 - DNA, 25 bp, Homo sapien
tgctcgcagcctcgccagtgagaat

SEQ ID NO: 293216 - DNA, 25 bp, Homo sapien
ggaagctacaatttggaagaatcct

SEQ ID NO: 293217 - DNA, 25 bp, Homo sapien
gcctcgccagtgagaatctactgta

SEQ ID NO: 293218 - DNA, 25 bp, Homo sapien
aagtgtgaattgcttcgacgaagtc

SEQ ID NO: 293219 - DNA, 25 bp, Homo sapien
gacgaagtcacacacccacggaggg

SEQ ID NO: 293220 - DNA, 25 bp, Homo sapien
gtcacacacccacggagggaagtaa

SEQ ID NO: 293221 - DNA, 25 bp, Homo sapien
agggaagtaatctggaggctgcctt

SEQ ID NO: 293222 - DNA, 25 bp, Homo sapien
gcactgggggactgcccccgtgatc

SEQ ID NO: 293223 - DNA, 25 bp, Homo sapien
gggactgcccccgtgatctgatcac

SEQ ID NO: 293224 - DNA, 25 bp, Homo sapien
ggactgcccccgtgatctgatcacc

SEQ ID NO: 293225 - DNA, 25 bp, Homo sapien
cctgggaatcacaacttggtttaca

SEQ ID NO: 293226 - DNA, 25 bp, Homo sapien
ctgggaatcacaacttggtttacaa

SEQ ID NO: 293227 - DNA, 25 bp, Homo sapien
tgggaatcacaacttggtttacaat

SEQ ID NO: 293228 - DNA, 25 bp, Homo sapien
gggaatcacaacttggtttacaatt

SEQ ID NO: 293229 - DNA, 25 bp, Homo sapien
ggaatcacaacttggtttacaattc

SEQ ID NO: 293230 - DNA, 25 bp, Homo sapien
gaatcacaacttggtttacaattca

SEQ ID NO: 293231 - DNA, 25 bp, Homo sapien
tatcaaagttcaggaccagaagatg

SEQ ID NO: 293232 - DNA, 25 bp, Homo sapien
caaagttcaggaccagaagatgact

SEQ ID NO: 293233 - DNA, 25 bp, Homo sapien
ttataattcacaattttacctgaaa

SEQ ID NO: 293234 - DNA, 25 bp, Homo sapien
aaaatttaacgtaatctgtgttgat

SEQ ID NO: 293235 - DNA, 25 bp, Homo sapien
aacgtaatctgtgttgatttatgta

SEQ ID NO: 293236 - DNA, 25 bp, Homo sapien
gatttatgtaaatctaccttggtct

SEQ ID NO: 293237 - DNA, 25 bp, Homo sapien
tttatgtaaatctaccttggtcttt

SEQ ID NO: 293238 - DNA, 25 bp, Homo sapien
ccagaagatgacttcgaatcttgtt

SEQ ID NO: 293239 - DNA, 25 bp, Homo sapien
agatgacttcgaatcttgtttgaga

SEQ ID NO: 293240 - DNA, 25 bp, Homo sapien
gaagtcacagtatgaagtttttcga

SEQ ID NO: 293241 - DNA, 25 bp, Homo sapien
aagtcacagtatgaagtttttcgaa

SEQ ID NO: 293242 - DNA, 25 bp, Homo sapien
taggcaatggtgtcagataatcgtg

SEQ ID NO: 293243 - DNA, 25 bp, Homo sapien
taatcgtgaaattgagaagtcgccc

SEQ ID NO: 293244 - DNA, 25 bp, Homo sapien
agaagtcgcccatccatttgggtgg

SEQ ID NO: 293245 - DNA, 25 bp, Homo sapien
ggtgggaaaataaccaacatcctca

SEQ ID NO: 293246 - DNA, 25 bp, Homo sapien
aacatcctcagttgtaatcccacta

SEQ ID NO: 293247 - DNA, 25 bp, Homo sapien
ttgtaatcccactaagaaccgccag

SEQ ID NO: 293248 - DNA, 25 bp, Homo sapien
gggcgagacgaaagcgacatcgctt

SEQ ID NO: 293249 - DNA, 25 bp, Homo sapien
atcgcttccatctttacgtgagtct

SEQ ID NO: 293250 - DNA, 25 bp, Homo sapien
gagtcttggaaatggttcagcacca

SEQ ID NO: 293251 - DNA, 25 bp, Homo sapien
gacgtccgccgaagacgtaggtgta

SEQ ID NO: 293252 - DNA, 25 bp, Homo sapien
aagacccctcgtggaggtggcctgt

SEQ ID NO: 293253 - DNA, 25 bp, Homo sapien
caaatctcatttgatgcagacatct

SEQ ID NO: 293254 - DNA, 25 bp, Homo sapien
gatgcagacatctgaaaatactcag

SEQ ID NO: 293255 - DNA, 25 bp, Homo sapien
aattcataaaatacccaccaaagct

SEQ ID NO: 293256 - DNA, 25 bp, Homo sapien
tacccaccaaagctaatagaaaaca

SEQ ID NO: 293257 - DNA, 25 bp, Homo sapien
tggaaccttccaggacaagaagtaa

SEQ ID NO: 293258 - DNA, 25 bp, Homo sapien
aagaacaacccagaggagtaatcaa

SEQ ID NO: 293259 - DNA, 25 bp, Homo sapien
caacccagaggagtaatcaaagtga

SEQ ID NO: 293260 - DNA, 25 bp, Homo sapien
aaagtgagaagccagtgccgcctcc

SEQ ID NO: 293261 - DNA, 25 bp, Homo sapien
agtgccgcctccaggtactggatga

SEQ ID NO: 293262 - DNA, 25 bp, Homo sapien
gtactggatgatcacagggacctca

SEQ ID NO: 293263 - DNA, 25 bp, Homo sapien
atgcatggtgaatatttgatgtttt

SEQ ID NO: 293264 - DNA, 25 bp, Homo sapien
gacacttaggtcaataactgtgcct

SEQ ID NO: 293265 - DNA, 25 bp, Homo sapien
cacttaggtcaataactgtgcctat

SEQ ID NO: 293266 - DNA, 25 bp, Homo sapien
acttaggtcaataactgtgcctata

SEQ ID NO: 293267 - DNA, 25 bp, Homo sapien
aggtcaataactgtgcctataagaa

SEQ ID NO: 293268 - DNA, 25 bp, Homo sapien
ggtcaataactgtgcctataagaat

SEQ ID NO: 293269 - DNA, 25 bp, Homo sapien
gtcaataactgtgcctataagaatt

SEQ ID NO: 293270 - DNA, 25 bp, Homo sapien
aataactgtgcctataagaatttcc

SEQ ID NO: 293271 - DNA, 25 bp, Homo sapien
ataactgtgcctataagaatttcct

SEQ ID NO: 293272 - DNA, 25 bp, Homo sapien
ataagaatttcctttgggccaggca

SEQ ID NO: 293273 - DNA, 25 bp, Homo sapien
taagaatttcctttgggccaggcat

SEQ ID NO: 293274 - DNA, 25 bp, Homo sapien
atcatttgaacactggaggcagaag

SEQ ID NO: 293275 - DNA, 25 bp, Homo sapien
agaggctgagtcaaatcaatctcct

SEQ ID NO: 293276 - DNA, 25 bp, Homo sapien
tcaaatcaatctcctcacctgagga

SEQ ID NO: 293277 - DNA, 25 bp, Homo sapien
ttagaagtcttccagccaccttgta

SEQ ID NO: 293278 - DNA, 25 bp, Homo sapien
tgaggacttcctaagaccagcgcac

SEQ ID NO: 293279 - DNA, 25 bp, Homo sapien
agaccagcgcactgaaggaccagca

SEQ ID NO: 293280 - DNA, 25 bp, Homo sapien
ataatgctaatgctcccttatggac

SEQ ID NO: 293281 - DNA, 25 bp, Homo sapien
gctcccttatggacaagactgcaat

SEQ ID NO: 293282 - DNA, 25 bp, Homo sapien
agactgcaattctctgcctgctgaa

SEQ ID NO: 293283 - DNA, 25 bp, Homo sapien
tgaagctcagctatgaccacgtgac

SEQ ID NO: 293284 - DNA, 25 bp, Homo sapien
agctatgaccacgtgacttgccttg

SEQ ID NO: 293285 - DNA, 25 bp, Homo sapien
acttgccttggccaatgaaagagga

SEQ ID NO: 293286 - DNA, 25 bp, Homo sapien
gataatgggactgttcacactacat

SEQ ID NO: 293287 - DNA, 25 bp, Homo sapien
gggactgttcacactacataatcat

SEQ ID NO: 293288 - DNA, 25 bp, Homo sapien
atgcagactgttcaatgccatcctc

SEQ ID NO: 293289 - DNA, 25 bp, Homo sapien
atcctccagacctactgattcagaa

SEQ ID NO: 293290 - DNA, 25 bp, Homo sapien
agcattgttgaacaaatccttcaag

SEQ ID NO: 293291 - DNA, 25 bp, Homo sapien
gaacaaatccttcaagaactaaggt

SEQ ID NO: 293292 - DNA, 25 bp, Homo sapien
aaggttaaaccatgaccactcctcg

SEQ ID NO: 293293 - DNA, 25 bp, Homo sapien
ttaaaccatgaccactcctcgaggc

SEQ ID NO: 293294 - DNA, 25 bp, Homo sapien
ggagattcgggctcatagattcctt

SEQ ID NO: 293295 - DNA, 25 bp, Homo sapien
attcgggctcatagattccttcttt

SEQ ID NO: 293296 - DNA, 25 bp, Homo sapien
ggtctccagtttgcaaacagataat

SEQ ID NO: 293297 - DNA, 25 bp, Homo sapien
aatgactgcgataaggtccctgttc

SEQ ID NO: 293298 - DNA, 25 bp, Homo sapien
aaggtccctgttctccaggtgctta

SEQ ID NO: 293299 - DNA, 25 bp, Homo sapien
gtgcttacaggctggcagacttgga

SEQ ID NO: 293300 - DNA, 25 bp, Homo sapien
atgcaaactctacaacagacatccc

SEQ ID NO: 293301 - DNA, 25 bp, Homo sapien
gacatcccctgtgagaattttagag

SEQ ID NO: 293302 - DNA, 25 bp, Homo sapien
aaagccctgaagtacttaggcactg

SEQ ID NO: 293303 - DNA, 25 bp, Homo sapien
gtacttaggcactggatcaaataca

SEQ ID NO: 293304 - DNA, 25 bp, Homo sapien
aggaaccctgaatctgaggcttctg

SEQ ID NO: 293305 - DNA, 25 bp, Homo sapien
aggcttctgtcctgggaagcagact

SEQ ID NO: 293306 - DNA, 25 bp, Homo sapien
ggaagcagactcttgaaaggcagca

SEQ ID NO: 293307 - DNA, 25 bp, Homo sapien
agtgtgaggctctggtgagtcaaaa

SEQ ID NO: 293308 - DNA, 25 bp, Homo sapien
tcctagccaagccatcttgaacgtc

SEQ ID NO: 293309 - DNA, 25 bp, Homo sapien
catcttgaacgtccctcttgctttt

SEQ ID NO: 293310 - DNA, 25 bp, Homo sapien
tcttgcttttggtgccactcgcggc

SEQ ID NO: 293311 - DNA, 25 bp, Homo sapien
tttggtgccactcgcggctttgctg

SEQ ID NO: 293312 - DNA, 25 bp, Homo sapien
tggaaatcctggtcccgttacctct

SEQ ID NO: 293313 - DNA, 25 bp, Homo sapien
ggatccttccacagaatcaggactt

SEQ ID NO: 293314 - DNA, 25 bp, Homo sapien
ttcccatcctcctcgagacttttta

SEQ ID NO: 293315 - DNA, 25 bp, Homo sapien
tacctacttaaagccatacggttct

SEQ ID NO: 293316 - DNA, 25 bp, Homo sapien
aaagccatacggttctctcttttct

SEQ ID NO: 293317 - DNA, 25 bp, Homo sapien
ggttctctcttttctcgcttttatc

SEQ ID NO: 293318 - DNA, 25 bp, Homo sapien
agaatcaggacttcttcctctactt

SEQ ID NO: 293319 - DNA, 25 bp, Homo sapien
ttaagtaagtcagtcaatccatagt

SEQ ID NO: 293320 - DNA, 25 bp, Homo sapien
tagtgaaatggactcttcctaccgc

SEQ ID NO: 293321 - DNA, 25 bp, Homo sapien
taccgcctgtagcatttactgttga

SEQ ID NO: 293322 - DNA, 25 bp, Homo sapien
tccattttaatagttcccagccttt

SEQ ID NO: 293323 - DNA, 25 bp, Homo sapien
gttcccagcctttataacactaagt

SEQ ID NO: 293324 - DNA, 25 bp, Homo sapien
gattaggcatctgctaaggttacat

SEQ ID NO: 293325 - DNA, 25 bp, Homo sapien
ggttacatgctaagcagctacttat

SEQ ID NO: 293326 - DNA, 25 bp, Homo sapien
gatgttctattccagagtagtccaa

SEQ ID NO: 293327 - DNA, 25 bp, Homo sapien
aaatactatgctctgctgactcaag

SEQ ID NO: 293328 - DNA, 25 bp, Homo sapien
gactcaagtcatgtctcaaacctat

SEQ ID NO: 293329 - DNA, 25 bp, Homo sapien
tgtctcaaacctatttcctctatta

SEQ ID NO: 293330 - DNA, 25 bp, Homo sapien
agaacggacctcaaacgctgtccca

SEQ ID NO: 293331 - DNA, 25 bp, Homo sapien
ctctgccttgtggatgtgtaactgg

SEQ ID NO: 293332 - DNA, 25 bp, Homo sapien
ggcacgtgatgtaccagaaactcct

SEQ ID NO: 293333 - DNA, 25 bp, Homo sapien
aaactcctgtgtgtggttgtatccg

SEQ ID NO: 293334 - DNA, 25 bp, Homo sapien
gttgtatccggtgcgtgacacagta

SEQ ID NO: 293335 - DNA, 25 bp, Homo sapien
ccagctgctccttggatttgggaag

SEQ ID NO: 293336 - DNA, 25 bp, Homo sapien
agatttacgggccatggaggctcct

SEQ ID NO: 293337 - DNA, 25 bp, Homo sapien
aatcgtgcactcattcagcaaaggt

SEQ ID NO: 293338 - DNA, 25 bp, Homo sapien
cagcaaaggtttcagggcctgctgt

SEQ ID NO: 293339 - DNA, 25 bp, Homo sapien
ctgctgtgtggagacacggttccaa

SEQ ID NO: 293340 - DNA, 25 bp, Homo sapien
acggttccaagcactgctgcagtag

SEQ ID NO: 293341 - DNA, 25 bp, Homo sapien
gtcctaacagaatggtatattcctc

SEQ ID NO: 293342 - DNA, 25 bp, Homo sapien
gaatggtatattcctctggaaaaag

SEQ ID NO: 293343 - DNA, 25 bp, Homo sapien
aagatgaacgtcaccaatggattgt

SEQ ID NO: 293344 - DNA, 25 bp, Homo sapien
gtcaccaatggattgtgctgctctc

SEQ ID NO: 293345 - DNA, 25 bp, Homo sapien
accaatggattgtgctgctctcgtt

SEQ ID NO: 293346 - DNA, 25 bp, Homo sapien
aatggattgtgctgctctcgtttca

SEQ ID NO: 293347 - DNA, 25 bp, Homo sapien
gtgctgctctcgtttcagctttgat

SEQ ID NO: 293348 - DNA, 25 bp, Homo sapien
gctctcgtttcagctttgatttttt

SEQ ID NO: 293349 - DNA, 25 bp, Homo sapien
tttttgtccttgagaaccttgtcct

SEQ ID NO: 293350 - DNA, 25 bp, Homo sapien
ttgagaaccttgtcctccctgctga

SEQ ID NO: 293351 - DNA, 25 bp, Homo sapien
cttgtcctccctgctgatttgtttc

SEQ ID NO: 293352 - DNA, 25 bp, Homo sapien
gagaatgtgaaggtatgcaaaagcc

SEQ ID NO: 293353 - DNA, 25 bp, Homo sapien
agaatgtgaaggtatgcaaaagcct

SEQ ID NO: 293354 - DNA, 25 bp, Homo sapien
gaatgtgaaggtatgcaaaagccta

SEQ ID NO: 293355 - DNA, 25 bp, Homo sapien
aatgtgaaggtatgcaaaagcctac

SEQ ID NO: 293356 - DNA, 25 bp, Homo sapien
atgtgaaggtatgcaaaagcctact

SEQ ID NO: 293357 - DNA, 25 bp, Homo sapien
tgtgaaggtatgcaaaagcctactt

SEQ ID NO: 293358 - DNA, 25 bp, Homo sapien
gccgccacacccagctgatgtttgt

SEQ ID NO: 293359 - DNA, 25 bp, Homo sapien
gtgaaggtatgcaaaagcctacttt

SEQ ID NO: 293360 - DNA, 25 bp, Homo sapien
tgaaggtatgcaaaagcctactttt

SEQ ID NO: 293361 - DNA, 25 bp, Homo sapien
gaaggtatgcaaaagcctacttttt

SEQ ID NO: 293362 - DNA, 25 bp, Homo sapien
acccaccgcgccctcccagaatgct

SEQ ID NO: 293363 - DNA, 25 bp, Homo sapien
gaagggtcggagtctgtaaaaccag

SEQ ID NO: 293364 - DNA, 25 bp, Homo sapien
agggtcggagtctgtaaaaccagca

SEQ ID NO: 293365 - DNA, 25 bp, Homo sapien
gggtcggagtctgtaaaaccagcat

SEQ ID NO: 293366 - DNA, 25 bp, Homo sapien
ggtcggagtctgtaaaaccagcata

SEQ ID NO: 293367 - DNA, 25 bp, Homo sapien
gtcggagtctgtaaaaccagcatac

SEQ ID NO: 293368 - DNA, 25 bp, Homo sapien
tcggagtctgtaaaaccagcataca

SEQ ID NO: 293369 - DNA, 25 bp, Homo sapien
gagtctgtaaaaccagcatacagtt

SEQ ID NO: 293370 - DNA, 25 bp, Homo sapien
gtaaaaccagcatacagtttggctt

SEQ ID NO: 293371 - DNA, 25 bp, Homo sapien
aaaccagcatacagtttggcttttt

SEQ ID NO: 293372 - DNA, 25 bp, Homo sapien
accagcatacagtttggcttttttc

SEQ ID NO: 293373 - DNA, 25 bp, Homo sapien
gcatacagtttggcttttttcacat

SEQ ID NO: 293374 - DNA, 25 bp, Homo sapien
tgagggcctcctacttaaggttcta

SEQ ID NO: 293375 - DNA, 25 bp, Homo sapien
ggttctaaggttgaagcagttttat

SEQ ID NO: 293376 - DNA, 25 bp, Homo sapien
gcagttttataattctacaacccta

SEQ ID NO: 293377 - DNA, 25 bp, Homo sapien
gggcatataaaacaggtccctaaag

SEQ ID NO: 293378 - DNA, 25 bp, Homo sapien
ttacccgtgtccagttaccagtaag

SEQ ID NO: 293379 - DNA, 25 bp, Homo sapien
gtgtccagttaccagtaagtataca

SEQ ID NO: 293380 - DNA, 25 bp, Homo sapien
gggctccaactgaactgtatttaaa

SEQ ID NO: 293381 - DNA, 25 bp, Homo sapien
aacacacacattgactccctaagga

SEQ ID NO: 293382 - DNA, 25 bp, Homo sapien
tgactccctaaggactaacgtaagt

SEQ ID NO: 293383 - DNA, 25 bp, Homo sapien
taacgtaagtccatttgagggcctc

SEQ ID NO: 293384 - DNA, 25 bp, Homo sapien
gtaagtccatttgagggcctcctac

SEQ ID NO: 293385 - DNA, 25 bp, Homo sapien
tcacaggtatttccagtcctcacgg

SEQ ID NO: 293386 - DNA, 25 bp, Homo sapien
gtcctcacgggcaagtcagagagtc

SEQ ID NO: 293387 - DNA, 25 bp, Homo sapien
gagagtcccagaggcaattgaacaa

SEQ ID NO: 293388 - DNA, 25 bp, Homo sapien
aagccctcagagatcacgtagtccg

SEQ ID NO: 293389 - DNA, 25 bp, Homo sapien
gtagtccgttcattctccatgggaa

SEQ ID NO: 293390 - DNA, 25 bp, Homo sapien
acttccctagagacctgtagccaaa

SEQ ID NO: 293391 - DNA, 25 bp, Homo sapien
aaatcatttggagagcttctgaagc

SEQ ID NO: 293392 - DNA, 25 bp, Homo sapien
tgtctcaaagaatcccatgtgcctc

SEQ ID NO: 293393 - DNA, 25 bp, Homo sapien
aatcccatgtgcctctagttgagaa

SEQ ID NO: 293394 - DNA, 25 bp, Homo sapien
gaaacattcctctggagattctagg

SEQ ID NO: 293395 - DNA, 25 bp, Homo sapien
gaatgttacgatactcaggtgggct

SEQ ID NO: 293396 - DNA, 25 bp, Homo sapien
ggtgtcattcccatctgttgtgaaa

SEQ ID NO: 293397 - DNA, 25 bp, Homo sapien
ccttatttctccctgaagtgtcata

SEQ ID NO: 293398 - DNA, 25 bp, Homo sapien
aagtgtcatagggtgggtttctgct

SEQ ID NO: 293399 - DNA, 25 bp, Homo sapien
agtggctactgattgatggttctgc

SEQ ID NO: 293400 - DNA, 25 bp, Homo sapien
ctgattgatggttctgcgtgggcaa

SEQ ID NO: 293401 - DNA, 25 bp, Homo sapien
gttgtcattggaacacttgttttca

SEQ ID NO: 293402 - DNA, 25 bp, Homo sapien
aatgctcgttgttgttggaacagtc

SEQ ID NO: 293403 - DNA, 25 bp, Homo sapien
gaacagtctttgtcgttggaacagt

SEQ ID NO: 293404 - DNA, 25 bp, Homo sapien
gaacagttgttgtcgttggaacgct

SEQ ID NO: 293405 - DNA, 25 bp, Homo sapien
ttggaacgcttgttgtcattggaac

SEQ ID NO: 293406 - DNA, 25 bp, Homo sapien
tgtcattggaacagtgatgctcgtt

SEQ ID NO: 293407 - DNA, 25 bp, Homo sapien
atataatttctgacctacgtaatga

SEQ ID NO: 293408 - DNA, 25 bp, Homo sapien
gacctacgtaatgatgtatgcacaa

SEQ ID NO: 293409 - DNA, 25 bp, Homo sapien
gatgtatgcacaagaagcctctctt

SEQ ID NO: 293410 - DNA, 25 bp, Homo sapien
agcctctcttgaatgtattaattca

SEQ ID NO: 293411 - DNA, 25 bp, Homo sapien
gttatggagtccttacaatgtgcta

SEQ ID NO: 293412 - DNA, 25 bp, Homo sapien
ccttacaatgtgctagtgggacttt

SEQ ID NO: 293413 - DNA, 25 bp, Homo sapien
ccaaatttggatcctggcctggaaa

SEQ ID NO: 293414 - DNA, 25 bp, Homo sapien
ggatcctggcctggaaaggctcaaa

SEQ ID NO: 293415 - DNA, 25 bp, Homo sapien
gaaaggctcaaagcccaatatggga

SEQ ID NO: 293416 - DNA, 25 bp, Homo sapien
gcccaatatgggagcctggatacaa

SEQ ID NO: 293417 - DNA, 25 bp, Homo sapien
tgggagcctggatacaaatgtgaaa

SEQ ID NO: 293418 - DNA, 25 bp, Homo sapien
ggcctctctgtttctattggttcat

SEQ ID NO: 293419 - DNA, 25 bp, Homo sapien
gtttctattggttcattgccttttt

SEQ ID NO: 293420 - DNA, 25 bp, Homo sapien
tgacacttagcatctttcttggctg

SEQ ID NO: 293421 - DNA, 25 bp, Homo sapien
aatgcaagtaccacatacccattcc

SEQ ID NO: 293422 - DNA, 25 bp, Homo sapien
agcatctttcttggctgttaaaata

SEQ ID NO: 293423 - DNA, 25 bp, Homo sapien
tcatgccctcgccaaatggatctgg

SEQ ID NO: 293424 - DNA, 25 bp, Homo sapien
gctccatttccttcaaatagttaat

SEQ ID NO: 293425 - DNA, 25 bp, Homo sapien
ataaagcataacagggtggcaggag

SEQ ID NO: 293426 - DNA, 25 bp, Homo sapien
ggagaggatgatataccaccactaa

SEQ ID NO: 293427 - DNA, 25 bp, Homo sapien
gatataccaccactaaatacagttg

SEQ ID NO: 293428 - DNA, 25 bp, Homo sapien
aaatacagttggatcccaaaggtgt

SEQ ID NO: 293429 - DNA, 25 bp, Homo sapien
tgatgaccatcgaccccagcctgga

SEQ ID NO: 293430 - DNA, 25 bp, Homo sapien
ggacaagcagacagtgaacacctac

SEQ ID NO: 293431 - DNA, 25 bp, Homo sapien
gaagccgtggtggaaatcctccaga

SEQ ID NO: 293432 - DNA, 25 bp, Homo sapien
tggaaatcctccagactgccctgga

SEQ ID NO: 293433 - DNA, 25 bp, Homo sapien
gagcggcttcaggtgattgacatca

SEQ ID NO: 293434 - DNA, 25 bp, Homo sapien
ttcaggtgattgacatcaggcgtgt

SEQ ID NO: 293435 - DNA, 25 bp, Homo sapien
tgtgggacctcgagagccagagcct

SEQ ID NO: 293436 - DNA, 25 bp, Homo sapien
cagagcctgcaagctaggaacttgt

SEQ ID NO: 293437 - DNA, 25 bp, Homo sapien
caagctaggaacttgtgggcagcct

SEQ ID NO: 293438 - DNA, 25 bp, Homo sapien
agcctgcgtactccagtcctgctaa

SEQ ID NO: 293439 - DNA, 25 bp, Homo sapien
tcctgctaacccctagcttttaata

SEQ ID NO: 293440 - DNA, 25 bp, Homo sapien
gaattaattttctccttatcttctt

SEQ ID NO: 293441 - DNA, 25 bp, Homo sapien
aattttctccttatcttcttactct

SEQ ID NO: 293442 - DNA, 25 bp, Homo sapien
tttctccttatcttcttactctcgc

SEQ ID NO: 293443 - DNA, 25 bp, Homo sapien
tagttctttatcttgagacaaaggg

SEQ ID NO: 293444 - DNA, 25 bp, Homo sapien
ttccgttccaaagttatactacact

SEQ ID NO: 293445 - DNA, 25 bp, Homo sapien
gttatactacacttattcaggatag

SEQ ID NO: 293446 - DNA, 25 bp, Homo sapien
ttcaaagtgcctgttgtagtatata

SEQ ID NO: 293447 - DNA, 25 bp, Homo sapien
gtgcctgttgtagtatatatcttta

SEQ ID NO: 293448 - DNA, 25 bp, Homo sapien
ggaatctcctacaaacactgtcctc

SEQ ID NO: 293449 - DNA, 25 bp, Homo sapien
actgcccactgccagtatttacatg

SEQ ID NO: 293450 - DNA, 25 bp, Homo sapien
gcccactgccagtatttacatgaat

SEQ ID NO: 293451 - DNA, 25 bp, Homo sapien
cgggagaacaaccttatgtatgttc

SEQ ID NO: 293452 - DNA, 25 bp, Homo sapien
agaagtctcacctcccagggcattg

SEQ ID NO: 293453 - DNA, 25 bp, Homo sapien
agtctcacctcccagggcattggtg

SEQ ID NO: 293454 - DNA, 25 bp, Homo sapien
acctcccagggcattggtgaattca

SEQ ID NO: 293455 - DNA, 25 bp, Homo sapien
gagagaaacctgatcgatgtactgt

SEQ ID NO: 293456 - DNA, 25 bp, Homo sapien
gagaaacctgatcgatgtactgtat

SEQ ID NO: 293457 - DNA, 25 bp, Homo sapien
aacctgatcgatgtactgtatgtgg

SEQ ID NO: 293458 - DNA, 25 bp, Homo sapien
cagaagtcccaactcactgtacatc

SEQ ID NO: 293459 - DNA, 25 bp, Homo sapien
gagaattcatacactaatgaaatca

SEQ ID NO: 293460 - DNA, 25 bp, Homo sapien
gaaatcataagaatggtctgaacac

SEQ ID NO: 293461 - DNA, 25 bp, Homo sapien
gaatggtctgaacacagaaaagcct

SEQ ID NO: 293462 - DNA, 25 bp, Homo sapien
ttatgctttcattccaaatggatct

SEQ ID NO: 293463 - DNA, 25 bp, Homo sapien
caattccccttacttcattttggca

SEQ ID NO: 293464 - DNA, 25 bp, Homo sapien
tcattttggcaaacactaagtcaaa

SEQ ID NO: 293465 - DNA, 25 bp, Homo sapien
aagtcaaatagtgaaatgcctgtca

SEQ ID NO: 293466 - DNA, 25 bp, Homo sapien
aatgcctgtcactacatagaaccta

SEQ ID NO: 293467 - DNA, 25 bp, Homo sapien
cactacatagaacctattacctggg

SEQ ID NO: 293468 - DNA, 25 bp, Homo sapien
gaacagattgagtttccttcatctt

SEQ ID NO: 293469 - DNA, 25 bp, Homo sapien
gagtttccttcatcttgtgtaaata

SEQ ID NO: 293470 - DNA, 25 bp, Homo sapien
agagacctggtaacttggtgacact

SEQ ID NO: 293471 - DNA, 25 bp, Homo sapien
tggtgacactgttaaaccctttttg

SEQ ID NO: 293472 - DNA, 25 bp, Homo sapien
tgtggtgttgagacttttctgaatt

SEQ ID NO: 293473 - DNA, 25 bp, Homo sapien
tacctcctgcggacgctgctgtact

SEQ ID NO: 293474 - DNA, 25 bp, Homo sapien
ctgtactgggcgtgcgagcggctgc

SEQ ID NO: 293475 - DNA, 25 bp, Homo sapien
cggccagaaaatgcgggcgcctgct

SEQ ID NO: 293476 - DNA, 25 bp, Homo sapien
gctgcctcgggctgctagacgagct

SEQ ID NO: 293477 - DNA, 25 bp, Homo sapien
tgctagacgagctcggccgagtgct

SEQ ID NO: 293478 - DNA, 25 bp, Homo sapien
tcgaggccgggacgttgcctcacta

SEQ ID NO: 293479 - DNA, 25 bp, Homo sapien
ggacgttgcctcactattttctgaa

SEQ ID NO: 293480 - DNA, 25 bp, Homo sapien
gttgcctcactattttctgaacggc

SEQ ID NO: 293481 - DNA, 25 bp, Homo sapien
actattttctgaacggccgacagct

SEQ ID NO: 293482 - DNA, 25 bp, Homo sapien
tgaacggccgacagctccgtacggg

SEQ ID NO: 293483 - DNA, 25 bp, Homo sapien
ggacgactccgctgcgctgctcgga

SEQ ID NO: 293484 - DNA, 25 bp, Homo sapien
gcagaagaagggtgtggtccccttc

SEQ ID NO: 293485 - DNA, 25 bp, Homo sapien
attttctgactgagttacagaggct

SEQ ID NO: 293486 - DNA, 25 bp, Homo sapien
tacagaggctggattcggccatccc

SEQ ID NO: 293487 - DNA, 25 bp, Homo sapien
atcccggacgacctggatggcaaca

SEQ ID NO: 293488 - DNA, 25 bp, Homo sapien
gacctggatggcaacaccaacaaga

SEQ ID NO: 293489 - DNA, 25 bp, Homo sapien
aggaggtccgagttctgcaggaaat

SEQ ID NO: 293490 - DNA, 25 bp, Homo sapien
ggaaatgcagctgctccaagtggct

SEQ ID NO: 293491 - DNA, 25 bp, Homo sapien
gtggctgccatgaattacaggcttc

SEQ ID NO: 293492 - DNA, 25 bp, Homo sapien
caggcttcggcctcttgagaaattt

SEQ ID NO: 293493 - DNA, 25 bp, Homo sapien
tttcacaagaatggagcagctcagt

SEQ ID NO: 293494 - DNA, 25 bp, Homo sapien
gacaaagagagctacaagctgtcct

SEQ ID NO: 293495 - DNA, 25 bp, Homo sapien
gcaagagtaagttcctgggcacagt

SEQ ID NO: 293496 - DNA, 25 bp, Homo sapien
gagctgaggcatataatagaattct

SEQ ID NO: 293497 - DNA, 25 bp, Homo sapien
tggcctcctgcggactctagtttcg

SEQ ID NO: 293498 - DNA, 25 bp, Homo sapien
ggactctagtttcgcctccttgatg

SEQ ID NO: 293499 - DNA, 25 bp, Homo sapien
tctagtttcgcctccttgatgtggc

SEQ ID NO: 293500 - DNA, 25 bp, Homo sapien
gcctccttgatgtggcgcctgggat

SEQ ID NO: 293501 - DNA, 25 bp, Homo sapien
tgatgtggcgcctgggatttcttca

SEQ ID NO: 293502 - DNA, 25 bp, Homo sapien
tggcgcctgggatttcttcacttca

SEQ ID NO: 293503 - DNA, 25 bp, Homo sapien
tgggatttcttcacttcagagctgt

SEQ ID NO: 293504 - DNA, 25 bp, Homo sapien
gatttcttcacttcagagctgtatt

SEQ ID NO: 293505 - DNA, 25 bp, Homo sapien
ttcagagctgtatttttacaggcaa

SEQ ID NO: 293506 - DNA, 25 bp, Homo sapien
atgatgacagcaatgcattttctac

SEQ ID NO: 293507 - DNA, 25 bp, Homo sapien
gcattttctacattcatatcctcaa

SEQ ID NO: 293508 - DNA, 25 bp, Homo sapien
caagctctactctcagaagcaaaaa

SEQ ID NO: 293509 - DNA, 25 bp, Homo sapien
ttctacattcatatcctcaatcata

SEQ ID NO: 293510 - DNA, 25 bp, Homo sapien
atatgtttttgaatgcttactggaa

SEQ ID NO: 293511 - DNA, 25 bp, Homo sapien
tgaatgcttactggaaaaccggttt

SEQ ID NO: 293512 - DNA, 25 bp, Homo sapien
aggtgactagttattggtcttgctc

SEQ ID NO: 293513 - DNA, 25 bp, Homo sapien
tagttattggtcttgctctgacagc

SEQ ID NO: 293514 - DNA, 25 bp, Homo sapien
gctctgacagccgtggaaaccattt

SEQ ID NO: 293515 - DNA, 25 bp, Homo sapien
gccgtggaaaccatttgctgatgaa

SEQ ID NO: 293516 - DNA, 25 bp, Homo sapien
atatctaggagtcagagtatgaatc

SEQ ID NO: 293517 - DNA, 25 bp, Homo sapien
agtaaagcccagagcatttgctatt

SEQ ID NO: 293518 - DNA, 25 bp, Homo sapien
gcatttgctatttattgctcaaggg

SEQ ID NO: 293519 - DNA, 25 bp, Homo sapien
tggacttccaacaagggccgctgcg

SEQ ID NO: 293520 - DNA, 25 bp, Homo sapien
gggcacctttgtacagtctggccgt

SEQ ID NO: 293521 - DNA, 25 bp, Homo sapien
agtctggccgtttgcttggcatggc

SEQ ID NO: 293522 - DNA, 25 bp, Homo sapien
tggcatggcctcttagaactcctta

SEQ ID NO: 293523 - DNA, 25 bp, Homo sapien
gaataagaagttagtctttctctcc

SEQ ID NO: 293524 - DNA, 25 bp, Homo sapien
agtcactgcctcctggacgaatatt

SEQ ID NO: 293525 - DNA, 25 bp, Homo sapien
ggacgaatatttgccagcacggagg

SEQ ID NO: 293526 - DNA, 25 bp, Homo sapien
tgcgcaggcgctgcaatcactgcag

SEQ ID NO: 293527 - DNA, 25 bp, Homo sapien
aatcactgcaggcacttgtctgcat

SEQ ID NO: 293528 - DNA, 25 bp, Homo sapien
gggcgaagagcaagtgacatcctga

SEQ ID NO: 293529 - DNA, 25 bp, Homo sapien
aagagcaagtgacatcctgacccct

SEQ ID NO: 293530 - DNA, 25 bp, Homo sapien
tcgccactgtaagcactgtccttgg

SEQ ID NO: 293531 - DNA, 25 bp, Homo sapien
agcactgtccttgggcccacatgga

SEQ ID NO: 293532 - DNA, 25 bp, Homo sapien
atggagaagtatctctccttcccta

SEQ ID NO: 293533 - DNA, 25 bp, Homo sapien
aaaggtgttagccaaatgcctggat

SEQ ID NO: 293534 - DNA, 25 bp, Homo sapien
aaatgcctggataaccatcgacccc

SEQ ID NO: 293535 - DNA, 25 bp, Homo sapien
tacccaccaaatctagtcagtagag

SEQ ID NO: 293536 - DNA, 25 bp, Homo sapien
gaaaaggctggtaatactagcactt

SEQ ID NO: 293537 - DNA, 25 bp, Homo sapien
gtaatactagcacttggtatgccaa

SEQ ID NO: 293538 - DNA, 25 bp, Homo sapien
agcacttggtatgccaagacctgaa

SEQ ID NO: 293539 - DNA, 25 bp, Homo sapien
gtcctcacatgccttttgctaggaa

SEQ ID NO: 293540 - DNA, 25 bp, Homo sapien
catgccttttgctaggaagtggttt

SEQ ID NO: 293541 - DNA, 25 bp, Homo sapien
agtggttttggcctcttttggtgca

SEQ ID NO: 293542 - DNA, 25 bp, Homo sapien
gtgcattctttctcacatgtcaatt

SEQ ID NO: 293543 - DNA, 25 bp, Homo sapien
gcaaggtctggccttcaacagtgaa

SEQ ID NO: 293544 - DNA, 25 bp, Homo sapien
atgagactgcaggtccactgattgc

SEQ ID NO: 293545 - DNA, 25 bp, Homo sapien
actgattgcaccgttcagtgctttt

SEQ ID NO: 293546 - DNA, 25 bp, Homo sapien
gcttttgactctgaagattgtttta

SEQ ID NO: 293547 - DNA, 25 bp, Homo sapien
tggtggagtctccatcatcagcgat

SEQ ID NO: 293548 - DNA, 25 bp, Homo sapien
aagactgttaggtgtcagcacagaa

SEQ ID NO: 293549 - DNA, 25 bp, Homo sapien
cagaaatgagtcttctcacttgggc

SEQ ID NO: 293550 - DNA, 25 bp, Homo sapien
ttttgtgtttcttgatgacagacta

SEQ ID NO: 293551 - DNA, 25 bp, Homo sapien
tgacagactattaagtttgggactt

SEQ ID NO: 293552 - DNA, 25 bp, Homo sapien
aagatgataagtttcctgcttaagt

SEQ ID NO: 293553 - DNA, 25 bp, Homo sapien
ttcctgcttaagttgtgcctttcag

SEQ ID NO: 293554 - DNA, 25 bp, Homo sapien
agttgtgcctttcagcttcaatgag

SEQ ID NO: 293555 - DNA, 25 bp, Homo sapien
gcttcaatgagtttaaggagcacta

SEQ ID NO: 293556 - DNA, 25 bp, Homo sapien
acctgaatagctgtggtttctccag

SEQ ID NO: 293557 - DNA, 25 bp, Homo sapien
agctgtggtttctccagtaaatatt

SEQ ID NO: 293558 - DNA, 25 bp, Homo sapien
ttttcttctactgaacatggagcca

SEQ ID NO: 293559 - DNA, 25 bp, Homo sapien
catggagccattattaagagttgtg

SEQ ID NO: 293560 - DNA, 25 bp, Homo sapien
ttgcttgtttgatgttctatttttc

SEQ ID NO: 293561 - DNA, 25 bp, Homo sapien
gacgcagctctgttacactgcagca

SEQ ID NO: 293562 - DNA, 25 bp, Homo sapien
gaggtagggataatctggtgtcatt

SEQ ID NO: 293563 - DNA, 25 bp, Homo sapien
tggtgtcattaaacacacaggcctt

SEQ ID NO: 293564 - DNA, 25 bp, Homo sapien
attaaacacacaggcctttgtggag

SEQ ID NO: 293565 - DNA, 25 bp, Homo sapien
gtggaggttaccgtacaccaacagc

SEQ ID NO: 293566 - DNA, 25 bp, Homo sapien
ggttaccgtacaccaacagcaggaa

SEQ ID NO: 293567 - DNA, 25 bp, Homo sapien
caccaacagcaggaagctttttctt

SEQ ID NO: 293568 - DNA, 25 bp, Homo sapien
cttctgagagcatagggagcctatg

SEQ ID NO: 293569 - DNA, 25 bp, Homo sapien
ggatattaagctccctcaaacaggc

SEQ ID NO: 293570 - DNA, 25 bp, Homo sapien
caaacaggccctgtatatctaacag

SEQ ID NO: 293571 - DNA, 25 bp, Homo sapien
tgtatatctaacaggctctggcccc

SEQ ID NO: 293572 - DNA, 25 bp, Homo sapien
aggaggtccgagttctgcaggaaat

SEQ ID NO: 293573 - DNA, 25 bp, Homo sapien
aggtccgagttctgcaggaaatgca

SEQ ID NO: 293574 - DNA, 25 bp, Homo sapien
gttctgcaggaaatgcagctgctcc

SEQ ID NO: 293575 - DNA, 25 bp, Homo sapien
ggaaatgcagctgctccaagtggct

SEQ ID NO: 293576 - DNA, 25 bp, Homo sapien
agctgctccaagtggctgccatgaa

SEQ ID NO: 293577 - DNA, 25 bp, Homo sapien
tgctccaagtggctgccatgaatta

SEQ ID NO: 293578 - DNA, 25 bp, Homo sapien
aagtggctgccatgaattacaggct

SEQ ID NO: 293579 - DNA, 25 bp, Homo sapien
tggctgccatgaattacaggcttcg

SEQ ID NO: 293580 - DNA, 25 bp, Homo sapien
cctcttgagaaatttgtcacctatt

SEQ ID NO: 293581 - DNA, 25 bp, Homo sapien
tttcacaagaatggagcagctcagt

SEQ ID NO: 293582 - DNA, 25 bp, Homo sapien
atggagcagctcagtgacaaagaga

SEQ ID NO: 293583 - DNA, 25 bp, Homo sapien
gtttcgccaaagtctgcctgactat

SEQ ID NO: 293584 - DNA, 25 bp, Homo sapien
gcctgactatatggcctgggttata

SEQ ID NO: 293585 - DNA, 25 bp, Homo sapien
ggcctgggttatatcactagagtga

SEQ ID NO: 293586 - DNA, 25 bp, Homo sapien
ggaagaagacatcaggcccctgctg

SEQ ID NO: 293587 - DNA, 25 bp, Homo sapien
gaacggaacccgcagtcaagccaga

SEQ ID NO: 293588 - DNA, 25 bp, Homo sapien
gcagtcaagccagagatatcccata

SEQ ID NO: 293589 - DNA, 25 bp, Homo sapien
aaaagagcaacttacgacgtctgga

SEQ ID NO: 293590 - DNA, 25 bp, Homo sapien
acttacgacgtctggagtagcagcg

SEQ ID NO: 293591 - DNA, 25 bp, Homo sapien
accaaattacagcttccagctgcca

SEQ ID NO: 293592 - DNA, 25 bp, Homo sapien
cgagggtttcaggactggagacaat

SEQ ID NO: 293593 - DNA, 25 bp, Homo sapien
tcgctgacagtttcgccaaagtctg

SEQ ID NO: 293594 - DNA, 25 bp, Homo sapien
tgccttggcctctcagtaaattata

SEQ ID NO: 293595 - DNA, 25 bp, Homo sapien
ccattgaatttcagggatgctgaat

SEQ ID NO: 293596 - DNA, 25 bp, Homo sapien
tttcagggatgctgaatttcaggga

SEQ ID NO: 293597 - DNA, 25 bp, Homo sapien
atttcagggagctaaattgttgacc

SEQ ID NO: 293598 - DNA, 25 bp, Homo sapien
ggagctaaattgttgacccttgcct

SEQ ID NO: 293599 - DNA, 25 bp, Homo sapien
agctaaattgttgacccttgcctgt

SEQ ID NO: 293600 - DNA, 25 bp, Homo sapien
ctaaattgttgacccttgcctgtag

SEQ ID NO: 293601 - DNA, 25 bp, Homo sapien
aaattgttgacccttgcctgtagtt

SEQ ID NO: 293602 - DNA, 25 bp, Homo sapien
attgttgacccttgcctgtagttgt

SEQ ID NO: 293603 - DNA, 25 bp, Homo sapien
gttgacccttgcctgtagttgttat

SEQ ID NO: 293604 - DNA, 25 bp, Homo sapien
tgacccttgcctgtagttgttattg

SEQ ID NO: 293605 - DNA, 25 bp, Homo sapien
aacttcaccagtatcctagaaacaa

SEQ ID NO: 293606 - DNA, 25 bp, Homo sapien
ttaggcagggacaggaagtattcaa

SEQ ID NO: 293607 - DNA, 25 bp, Homo sapien
ggaagtattcaaaggacagacatat

SEQ ID NO: 293608 - DNA, 25 bp, Homo sapien
ggttgaagtctgtggtttcttgtgt

SEQ ID NO: 293609 - DNA, 25 bp, Homo sapien
agaagttggtggaccctgtcctcca

SEQ ID NO: 293610 - DNA, 25 bp, Homo sapien
ctccatccaagaagtgctgccaagg

SEQ ID NO: 293611 - DNA, 25 bp, Homo sapien
aaaatggccaaaggaattctgacat

SEQ ID NO: 293612 - DNA, 25 bp, Homo sapien
gaattctgacattccatacctgaat

SEQ ID NO: 293613 - DNA, 25 bp, Homo sapien
tccatacctgaatgaactgttttcg

SEQ ID NO: 293614 - DNA, 25 bp, Homo sapien
aactgttttcgtgagtgctttgatc

SEQ ID NO: 293615 - DNA, 25 bp, Homo sapien
tgagtgctttgatcaccctatcccc

SEQ ID NO: 293616 - DNA, 25 bp, Homo sapien
gattttcctgcccaagattgcaaca

SEQ ID NO: 293617 - DNA, 25 bp, Homo sapien
ttttcctgcccaagattgcaacaac

SEQ ID NO: 293618 - DNA, 25 bp, Homo sapien
ttcctgcccaagattgcaacaacaa

SEQ ID NO: 293619 - DNA, 25 bp, Homo sapien
cctgcccaagattgcaacaacaaat

SEQ ID NO: 293620 - DNA, 25 bp, Homo sapien
tatgtagaactacagactgtttaga

SEQ ID NO: 293621 - DNA, 25 bp, Homo sapien
gactgtttagaatgctgagactgtt

SEQ ID NO: 293622 - DNA, 25 bp, Homo sapien
tagaatgctgagactgttctaagaa

SEQ ID NO: 293623 - DNA, 25 bp, Homo sapien
caaaaacagtagcacttcaaggaat

SEQ ID NO: 293624 - DNA, 25 bp, Homo sapien
aacagtagcacttcaaggaatggtc

SEQ ID NO: 293625 - DNA, 25 bp, Homo sapien
gtagcacttcaaggaatggtcactt

SEQ ID NO: 293626 - DNA, 25 bp, Homo sapien
gcacttcaaggaatggtcactttct

SEQ ID NO: 293627 - DNA, 25 bp, Homo sapien
tccctgtattatccttatgccctta

SEQ ID NO: 293628 - DNA, 25 bp, Homo sapien
tattatccttatgcccttacttgaa

SEQ ID NO: 293629 - DNA, 25 bp, Homo sapien
atgcccttacttgaaagttgtttca

SEQ ID NO: 293630 - DNA, 25 bp, Homo sapien
tgaagggcctgagtatttttaaatc

SEQ ID NO: 293631 - DNA, 25 bp, Homo sapien
agtagtgtaccattattactttctt

SEQ ID NO: 293632 - DNA, 25 bp, Homo sapien
taaatcaactgcagtgactctcttt

SEQ ID NO: 293633 - DNA, 25 bp, Homo sapien
gactctcttttgtgtatttgtgtac

SEQ ID NO: 293634 - DNA, 25 bp, Homo sapien
ttctgcatcgaattttatctccttt

SEQ ID NO: 293635 - DNA, 25 bp, Homo sapien
ttttatctcctttccttgcagaaga

SEQ ID NO: 293636 - DNA, 25 bp, Homo sapien
agagaattagccctttacagagata

SEQ ID NO: 293637 - DNA, 25 bp, Homo sapien
ccatggttatgcaagatgctaacaa

SEQ ID NO: 293638 - DNA, 25 bp, Homo sapien
gaaatagtctgcactctgctagccg

SEQ ID NO: 293639 - DNA, 25 bp, Homo sapien
tctgctagccgaggagtcaagtgca

SEQ ID NO: 293640 - DNA, 25 bp, Homo sapien
agagggagtgcagcatagcccagta

SEQ ID NO: 293641 - DNA, 25 bp, Homo sapien
cccagtaagggcttgatctaccaga

SEQ ID NO: 293642 - DNA, 25 bp, Homo sapien
gggcttgatctaccagatgggtctt

SEQ ID NO: 293643 - DNA, 25 bp, Homo sapien
agatgggtctttgctttgagtcact

SEQ ID NO: 293644 - DNA, 25 bp, Homo sapien
ctttgctttgagtcactgccagcaa

SEQ ID NO: 293645 - DNA, 25 bp, Homo sapien
aacatcccaaggctgaagacggcct

SEQ ID NO: 293646 - DNA, 25 bp, Homo sapien
aagacggcctggaagaaaacctgat

SEQ ID NO: 293647 - DNA, 25 bp, Homo sapien
aaacctgatgttcctctactcatct

SEQ ID NO: 293648 - DNA, 25 bp, Homo sapien
tccagagtccctttttgggcagaag

SEQ ID NO: 293649 - DNA, 25 bp, Homo sapien
taatgggatttctacttgcaggcag

SEQ ID NO: 293650 - DNA, 25 bp, Homo sapien
tacttgcaggcagacagtgcttcca

SEQ ID NO: 293651 - DNA, 25 bp, Homo sapien
gaatgttctctgaggcaaggcaaca

SEQ ID NO: 293652 - DNA, 25 bp, Homo sapien
caaggcaacatggtcaactagggat

SEQ ID NO: 293653 - DNA, 25 bp, Homo sapien
ggcaatgcttttctcatctctgcaa

SEQ ID NO: 293654 - DNA, 25 bp, Homo sapien
tgagttatctgtgctctgagacttt

SEQ ID NO: 293655 - DNA, 25 bp, Homo sapien
ctaattcagcttcccaacagtgtta

SEQ ID NO: 293656 - DNA, 25 bp, Homo sapien
aacagtgttacctctggaatcccac

SEQ ID NO: 293657 - DNA, 25 bp, Homo sapien
ctctggaatcccacctcagggattt

SEQ ID NO: 293658 - DNA, 25 bp, Homo sapien
ggattttgtatcctctagatcttgg

SEQ ID NO: 293659 - DNA, 25 bp, Homo sapien
gtatcctctagatcttggcagtaaa

SEQ ID NO: 293660 - DNA, 25 bp, Homo sapien
ggactgcctcactgggacaacgcac

SEQ ID NO: 293661 - DNA, 25 bp, Homo sapien
gacaacgcactgcattaggatctat

SEQ ID NO: 293662 - DNA, 25 bp, Homo sapien
gtcattctctcaagtgtaactccca

SEQ ID NO: 293663 - DNA, 25 bp, Homo sapien
taggatctatcccttacgatggctc

SEQ ID NO: 293664 - DNA, 25 bp, Homo sapien
tacgatggctcagggttttccagtc

SEQ ID NO: 293665 - DNA, 25 bp, Homo sapien
ttttccagtctctaaggcaccttat

SEQ ID NO: 293666 - DNA, 25 bp, Homo sapien
ggcaccttatcattatcttacctaa

SEQ ID NO: 293667 - DNA, 25 bp, Homo sapien
ttacctaaacttcctaataatcctg

SEQ ID NO: 293668 - DNA, 25 bp, Homo sapien
ctcaagtgtaactcccagtgcaaag

SEQ ID NO: 293669 - DNA, 25 bp, Homo sapien
agggaggctggacatctgctttcat

SEQ ID NO: 293670 - DNA, 25 bp, Homo sapien
ccagtgcaaagcatcacatcaactt

SEQ ID NO: 293671 - DNA, 25 bp, Homo sapien
gtcacttccactaaacagtgccagt

SEQ ID NO: 293672 - DNA, 25 bp, Homo sapien
aaggttctgtcacactcagtaaccc

SEQ ID NO: 293673 - DNA, 25 bp, Homo sapien
atatggagccaacttgagttcggaa

SEQ ID NO: 293674 - DNA, 25 bp, Homo sapien
agtaacccacttctggttcctcatt

SEQ ID NO: 293675 - DNA, 25 bp, Homo sapien
ttcctcattccgtgtcagtgatcag

SEQ ID NO: 293676 - DNA, 25 bp, Homo sapien
atctaccttagatttgctccatact

SEQ ID NO: 293677 - DNA, 25 bp, Homo sapien
aggagctaagctgggatgccacata

SEQ ID NO: 293678 - DNA, 25 bp, Homo sapien
ttcggaagggctgtggccacctcgt

SEQ ID NO: 293679 - DNA, 25 bp, Homo sapien
tttcgcccatctacttttcaccttg

SEQ ID NO: 293680 - DNA, 25 bp, Homo sapien
tttcaccttgccgtatctgattctt

SEQ ID NO: 293681 - DNA, 25 bp, Homo sapien
tgattcttcaccaccgtattctcag

SEQ ID NO: 293682 - DNA, 25 bp, Homo sapien
ggctgcaaattaatcacctcatctg

SEQ ID NO: 293683 - DNA, 25 bp, Homo sapien
ttaatcacctcatctgcatcctggg

SEQ ID NO: 293684 - DNA, 25 bp, Homo sapien
gggcctcttttgaatgcacatgctg

SEQ ID NO: 293685 - DNA, 25 bp, Homo sapien
gcacatgctgttagagcgcttctca

SEQ ID NO: 293686 - DNA, 25 bp, Homo sapien
agagcgcttctcacattgtattaaa

SEQ ID NO: 293687 - DNA, 25 bp, Homo sapien
gtcatttatgattccatttttccca

SEQ ID NO: 293688 - DNA, 25 bp, Homo sapien
tttcccactgactgtaggttctcaa

SEQ ID NO: 293689 - DNA, 25 bp, Homo sapien
tagggtgtaccatatttcttttaca

SEQ ID NO: 293690 - DNA, 25 bp, Homo sapien
aaagcacctgctacttcgtcggtat

SEQ ID NO: 293691 - DNA, 25 bp, Homo sapien
tcgtcggtattcattgttccggcta

SEQ ID NO: 293692 - DNA, 25 bp, Homo sapien
gttccggctatgaaagcttagacta

SEQ ID NO: 293693 - DNA, 25 bp, Homo sapien
atggcctctagctctgttcaactgt

SEQ ID NO: 293694 - DNA, 25 bp, Homo sapien
ctgttcaactgtcaattctgctggg

SEQ ID NO: 293695 - DNA, 25 bp, Homo sapien
gataaatctgttaacctctctgccc

SEQ ID NO: 293696 - DNA, 25 bp, Homo sapien
tttccccatctttaactcgagagtg

SEQ ID NO: 293697 - DNA, 25 bp, Homo sapien
gagtactaagggactcttccagcca

SEQ ID NO: 293698 - DNA, 25 bp, Homo sapien
cttccagccactttttggcagggat

SEQ ID NO: 293699 - DNA, 25 bp, Homo sapien
ttttggcagggatcagacttcggag

SEQ ID NO: 293700 - DNA, 25 bp, Homo sapien
tcatttccaaaatcgtcagacaccg

SEQ ID NO: 293701 - DNA, 25 bp, Homo sapien
agacaccgatttctctgcgcttttc

SEQ ID NO: 293702 - DNA, 25 bp, Homo sapien
ttttcttgcctggtgtcaggacagg

SEQ ID NO: 293703 - DNA, 25 bp, Homo sapien
agctatgcaggagacatggcctcta

SEQ ID NO: 293704 - DNA, 25 bp, Homo sapien
atttaggatggttacagatactcac

SEQ ID NO: 293705 - DNA, 25 bp, Homo sapien
ggttacagatactcaccatcaacat

SEQ ID NO: 293706 - DNA, 25 bp, Homo sapien
tacagatactcaccatcaacataaa

SEQ ID NO: 293707 - DNA, 25 bp, Homo sapien
gatactcaccatcaacataaataaa

SEQ ID NO: 293708 - DNA, 25 bp, Homo sapien
aatggagttctaggataaattattt

SEQ ID NO: 293709 - DNA, 25 bp, Homo sapien
tttgtggaatactaatggtcaagtc

SEQ ID NO: 293710 - DNA, 25 bp, Homo sapien
ggaatactaatggtcaagtcacata

SEQ ID NO: 293711 - DNA, 25 bp, Homo sapien
atactaatggtcaagtcacataaga

SEQ ID NO: 293712 - DNA, 25 bp, Homo sapien
taaaatcttttggtgaggagacaca

SEQ ID NO: 293713 - DNA, 25 bp, Homo sapien
aggagacacatttgacaactgctaa

SEQ ID NO: 293714 - DNA, 25 bp, Homo sapien
gacacatttgacaactgctaaagaa

SEQ ID NO: 293715 - DNA, 25 bp, Homo sapien
gattctccttatcctgctgtgcttt

SEQ ID NO: 293716 - DNA, 25 bp, Homo sapien
tatcctgctgtgctttgagggcctg

SEQ ID NO: 293717 - DNA, 25 bp, Homo sapien
cttcctcattttcacatcagtgatg

SEQ ID NO: 293718 - DNA, 25 bp, Homo sapien
gtgatgtttgggacccaggtgcact

SEQ ID NO: 293719 - DNA, 25 bp, Homo sapien
tgtttgggacccaggtgcactccat

SEQ ID NO: 293720 - DNA, 25 bp, Homo sapien
aggtgcactccatctgcacagatga

SEQ ID NO: 293721 - DNA, 25 bp, Homo sapien
tgcacagatgagacgggaatagaac

SEQ ID NO: 293722 - DNA, 25 bp, Homo sapien
ggtgggattccacttcctgcattgc

SEQ ID NO: 293723 - DNA, 25 bp, Homo sapien
gattccacttcctgcattgctttga

SEQ ID NO: 293724 - DNA, 25 bp, Homo sapien
gaagattggacaacctatggactga

SEQ ID NO: 293725 - DNA, 25 bp, Homo sapien
tggacaacctatggactgaacaggg

SEQ ID NO: 293726 - DNA, 25 bp, Homo sapien
ttcaacttctatatgccaagcacac

SEQ ID NO: 293727 - DNA, 25 bp, Homo sapien
gccaagcacactgctaaaggcttat

SEQ ID NO: 293728 - DNA, 25 bp, Homo sapien
aggcttatcttctaagtatatgcag

SEQ ID NO: 293729 - DNA, 25 bp, Homo sapien
gtatatgcaggcataccctactcac

SEQ ID NO: 293730 - DNA, 25 bp, Homo sapien
aggcataccctactcacacaaatag

SEQ ID NO: 293731 - DNA, 25 bp, Homo sapien
caaatagcttattaccagagatagg

SEQ ID NO: 293732 - DNA, 25 bp, Homo sapien
aaaaacttctctatggcctcttgat

SEQ ID NO: 293733 - DNA, 25 bp, Homo sapien
ttctctatggcctcttgatttaaga

SEQ ID NO: 293734 - DNA, 25 bp, Homo sapien
agccctaaaccaggatttatctgag

SEQ ID NO: 293735 - DNA, 25 bp, Homo sapien
gatttatctgagaatgtcttcccaa

SEQ ID NO: 293736 - DNA, 25 bp, Homo sapien
tctgagaatgtcttcccaaaaggga

SEQ ID NO: 293737 - DNA, 25 bp, Homo sapien
gaaggctcagcttccgggtcgagaa

SEQ ID NO: 293738 - DNA, 25 bp, Homo sapien
tcagcttccgggtcgagaacctggg

SEQ ID NO: 293739 - DNA, 25 bp, Homo sapien
tgcggtggacctgatcctgaggtct

SEQ ID NO: 293740 - DNA, 25 bp, Homo sapien
gacctgatcctgaggtctcagcgta

SEQ ID NO: 293741 - DNA, 25 bp, Homo sapien
cctgaggtctcagcgtagagatgct

SEQ ID NO: 293742 - DNA, 25 bp, Homo sapien
cagcgtagagatgctgagtccagag

SEQ ID NO: 293743 - DNA, 25 bp, Homo sapien
gagtccagaggcctgttctagttca

SEQ ID NO: 293744 - DNA, 25 bp, Homo sapien
agaggcctgttctagttcaccagtg

SEQ ID NO: 293745 - DNA, 25 bp, Homo sapien
gttctagttcaccagtgcagtgagg

SEQ ID NO: 293746 - DNA, 25 bp, Homo sapien
agtatccgggcctcccgagaggtgg

SEQ ID NO: 293747 - DNA, 25 bp, Homo sapien
gaaacttggcaccaacgcgccggga

SEQ ID NO: 293748 - DNA, 25 bp, Homo sapien
atgagtctgtccagccttgtcacag

SEQ ID NO: 293749 - DNA, 25 bp, Homo sapien
ctgcggtcctgatttcagctcacct

SEQ ID NO: 293750 - DNA, 25 bp, Homo sapien
tcagctcacctcagagtaaatcaga

SEQ ID NO: 293751 - DNA, 25 bp, Homo sapien
tttgctctgtgcagaacccagcaca

SEQ ID NO: 293752 - DNA, 25 bp, Homo sapien
gcacccagactttcacgaatgcatg

SEQ ID NO: 293753 - DNA, 25 bp, Homo sapien
gaatgcatgttgacgctttcagttc

SEQ ID NO: 293754 - DNA, 25 bp, Homo sapien
ttcagttcacccctttctttgctaa

SEQ ID NO: 293755 - DNA, 25 bp, Homo sapien
ctttctttgctaactttcttcctat

SEQ ID NO: 293756 - DNA, 25 bp, Homo sapien
tcctattttcttctaatgcgagagc

SEQ ID NO: 293757 - DNA, 25 bp, Homo sapien
gaacccagcacacgtgattttgtgt

SEQ ID NO: 293758 - DNA, 25 bp, Homo sapien
attttgtgtgacatgccagcagcct

SEQ ID NO: 293759 - DNA, 25 bp, Homo sapien
gtcacggaagttgcaagaaaccata

SEQ ID NO: 293760 - DNA, 25 bp, Homo sapien
gaaaccatatttgcaaacgttttat

SEQ ID NO: 293761 - DNA, 25 bp, Homo sapien
ttacatctgggaaaacgcttctact

SEQ ID NO: 293762 - DNA, 25 bp, Homo sapien
atttcacatattagccacagatttc

SEQ ID NO: 293763 - DNA, 25 bp, Homo sapien
attagccacagatttctagaagtga

SEQ ID NO: 293764 - DNA, 25 bp, Homo sapien
tgggaaaacgcttctactcatcaag

SEQ ID NO: 293765 - DNA, 25 bp, Homo sapien
gagattgctccaagcatgttttcaa

SEQ ID NO: 293766 - DNA, 25 bp, Homo sapien
actcatcaagagtggaattcctttt

SEQ ID NO: 293767 - DNA, 25 bp, Homo sapien
ttattcctataattgactcacagct

SEQ ID NO: 293768 - DNA, 25 bp, Homo sapien
attgactcacagcttcaaaaatctg

SEQ ID NO: 293769 - DNA, 25 bp, Homo sapien
aagtcatactttggtcacggaagtt

SEQ ID NO: 293770 - DNA, 25 bp, Homo sapien
tagacagactcaactttcccagaat

SEQ ID NO: 293771 - DNA, 25 bp, Homo sapien
ggcttaaataactaatcatctagag

SEQ ID NO: 293772 - DNA, 25 bp, Homo sapien
aaacttgtagaatcctaaatggcct

SEQ ID NO: 293773 - DNA, 25 bp, Homo sapien
agaatcctaaatggcctataaacta

SEQ ID NO: 293774 - DNA, 25 bp, Homo sapien
tggcctataaactataatccaaatg

SEQ ID NO: 293775 - DNA, 25 bp, Homo sapien
ggcatattacaaatattgctagcta

SEQ ID NO: 293776 - DNA, 25 bp, Homo sapien
tagtggcagttattttgtgcttttt

SEQ ID NO: 293777 - DNA, 25 bp, Homo sapien
tctagagttccacagatgcctaaac

SEQ ID NO: 293778 - DNA, 25 bp, Homo sapien
tccacagatgcctaaactatgaagt

SEQ ID NO: 293779 - DNA, 25 bp, Homo sapien
aaactagagtttgactgaatcttca

SEQ ID NO: 293780 - DNA, 25 bp, Homo sapien
gactgaatcttcaactagacagact

SEQ ID NO: 293781 - DNA, 25 bp, Homo sapien
gacatgtgacaaagacgcccgtctc

SEQ ID NO: 293782 - DNA, 25 bp, Homo sapien
aagacgcccgtctccgggagatggt

SEQ ID NO: 293783 - DNA, 25 bp, Homo sapien
acagtgcgggtttgcgctcggccct

SEQ ID NO: 293784 - DNA, 25 bp, Homo sapien
gagcaggcgctttgtctggctgtct

SEQ ID NO: 293785 - DNA, 25 bp, Homo sapien
ggcgctttgtctggctgtctgcaga

SEQ ID NO: 293786 - DNA, 25 bp, Homo sapien
tgcagagtgaggttcgcgccgcggc

SEQ ID NO: 293787 - DNA, 25 bp, Homo sapien
gcgggcgcccgtgcggtgcaggatg

SEQ ID NO: 293788 - DNA, 25 bp, Homo sapien
ggcgcgcgcgcctgtgccagggtga

SEQ ID NO: 293789 - DNA, 25 bp, Homo sapien
gccagggtgagtgcgctgcggcagc

SEQ ID NO: 293790 - DNA, 25 bp, Homo sapien
agggtgcccagcgacatgtgacaaa

SEQ ID NO: 293791 - DNA, 25 bp, Homo sapien
gtgcccagcgacatgtgacaaagac

SEQ ID NO: 293792 - DNA, 25 bp, Homo sapien
aaggtgataggagagacctcagtgt

SEQ ID NO: 293793 - DNA, 25 bp, Homo sapien
aactgaatgagctgtgtgctgttct

SEQ ID NO: 293794 - DNA, 25 bp, Homo sapien
gagctgtgtgctgttcttagaggaa

SEQ ID NO: 293795 - DNA, 25 bp, Homo sapien
actattccagtacaattctgtttat

SEQ ID NO: 293796 - DNA, 25 bp, Homo sapien
attctgtttattcttttctgtgcaa

SEQ ID NO: 293797 - DNA, 25 bp, Homo sapien
ttattcttttctgtgcaaacccaaa

SEQ ID NO: 293798 - DNA, 25 bp, Homo sapien
tctgtgcaaacccaaatttagtgta

SEQ ID NO: 293799 - DNA, 25 bp, Homo sapien
ttgatgagcaccacttgctgcctgt

SEQ ID NO: 293800 - DNA, 25 bp, Homo sapien
ctgtcagtccaactgcggtggagat

SEQ ID NO: 293801 - DNA, 25 bp, Homo sapien
gggtcaaatccccattgtcaaggtg

SEQ ID NO: 293802 - DNA, 25 bp, Homo sapien
aaatccccattgtcaaggtgatagg

SEQ ID NO: 293803 - DNA, 25 bp, Homo sapien
tcacaagtcaattgcaaacaaactg

SEQ ID NO: 293804 - DNA, 25 bp, Homo sapien
ctgaatgtacaaatcttagtgctgg

SEQ ID NO: 293805 - DNA, 25 bp, Homo sapien
gtacaaatcttagtgctggtgctga

SEQ ID NO: 293806 - DNA, 25 bp, Homo sapien
tagtgctggtgctgaaatctcttca

SEQ ID NO: 293807 - DNA, 25 bp, Homo sapien
aatctcttcagaatagtcatcatga

SEQ ID NO: 293808 - DNA, 25 bp, Homo sapien
aatttgcaagcatcaagtgtcaatc

SEQ ID NO: 293809 - DNA, 25 bp, Homo sapien
gcatcaagtgtcaatcaaaactgaa

SEQ ID NO: 293810 - DNA, 25 bp, Homo sapien
gttgaattctcatgcttttaggtgt

SEQ ID NO: 293811 - DNA, 25 bp, Homo sapien
ttctcatgcttttaggtgtacttcc

SEQ ID NO: 293812 - DNA, 25 bp, Homo sapien
catgcttttaggtgtacttcctttt

SEQ ID NO: 293813 - DNA, 25 bp, Homo sapien
gctaacttcgtttgtgcgattgaaa

SEQ ID NO: 293814 - DNA, 25 bp, Homo sapien
atgtatttttgtgataccgtcatta

SEQ ID NO: 293815 - DNA, 25 bp, Homo sapien
gtgataccgtcattatgttctgcat

SEQ ID NO: 293816 - DNA, 25 bp, Homo sapien
gtcattatgttctgcatttgcctca

SEQ ID NO: 293817 - DNA, 25 bp, Homo sapien
atgttctgcatttgcctcattttgg

SEQ ID NO: 293818 - DNA, 25 bp, Homo sapien
tgcatttgcctcattttggcagatc

SEQ ID NO: 293819 - DNA, 25 bp, Homo sapien
gcagatctacagtatgccattaaag

SEQ ID NO: 293820 - DNA, 25 bp, Homo sapien
actgaatttataatctatttctctg

SEQ ID NO: 293821 - DNA, 25 bp, Homo sapien
aaaggaactatgttccctgctgctt

SEQ ID NO: 293822 - DNA, 25 bp, Homo sapien
agtgaatatgatcttttcatggtca

SEQ ID NO: 293823 - DNA, 25 bp, Homo sapien
catggtcattgcctagataaaagta

SEQ ID NO: 293824 - DNA, 25 bp, Homo sapien
aagtagagccttttcaatcttagat

SEQ ID NO: 293825 - DNA, 25 bp, Homo sapien
gcatcctaaaactttttgggcatct

SEQ ID NO: 293826 - DNA, 25 bp, Homo sapien
ggagcctttggaaggcctcttatgt

SEQ ID NO: 293827 - DNA, 25 bp, Homo sapien
attgtcaccatccttcaagctgaga

SEQ ID NO: 293828 - DNA, 25 bp, Homo sapien
agctgagactcctggtgagcctttg

SEQ ID NO: 293829 - DNA, 25 bp, Homo sapien
gccaccatgaaaaccacatagctga

SEQ ID NO: 293830 - DNA, 25 bp, Homo sapien
aaaccacatagctgaccagggctgt

SEQ ID NO: 293831 - DNA, 25 bp, Homo sapien
tgaccagggctgtgcttgaggtaca

SEQ ID NO: 293832 - DNA, 25 bp, Homo sapien
tgcttgaggtacagaggacacacat

SEQ ID NO: 293833 - DNA, 25 bp, Homo sapien
aggcctgtgtcatgtttccttacag

SEQ ID NO: 293834 - DNA, 25 bp, Homo sapien
ttccttacagtcgttttttacagag

SEQ ID NO: 293835 - DNA, 25 bp, Homo sapien
actgctttctcaacagttcctgtga

SEQ ID NO: 293836 - DNA, 25 bp, Homo sapien
gctggaatgcgccaagcataaaggt

SEQ ID NO: 293837 - DNA, 25 bp, Homo sapien
gggcatggcatcaaaaggtaggtca

SEQ ID NO: 293838 - DNA, 25 bp, Homo sapien
ggcatcaaaaggtaggtcaacatat

SEQ ID NO: 293839 - DNA, 25 bp, Homo sapien
atagagatagaaactggtctgccca

SEQ ID NO: 293840 - DNA, 25 bp, Homo sapien
agaaactggtctgcccaggactagg

SEQ ID NO: 293841 - DNA, 25 bp, Homo sapien
gttgtctaaggataaggagcttctt

SEQ ID NO: 293842 - DNA, 25 bp, Homo sapien
tcttttttggatggtgaaataacct

SEQ ID NO: 293843 - DNA, 25 bp, Homo sapien
aacctaaaatatattgtgccattgt

SEQ ID NO: 293844 - DNA, 25 bp, Homo sapien
gtgccattgtttgcacaactttgtg

SEQ ID NO: 293845 - DNA, 25 bp, Homo sapien
taaaaacctgttaattgtactcact

SEQ ID NO: 293846 - DNA, 25 bp, Homo sapien
attgtactcactaaatgtcctcctt

SEQ ID NO: 293847 - DNA, 25 bp, Homo sapien
tgctgatggcttcaacagggtctca

SEQ ID NO: 293848 - DNA, 25 bp, Homo sapien
ttcaacagggtctcacctcatcttt

SEQ ID NO: 293849 - DNA, 25 bp, Homo sapien
tgctctttggccctggatcgagaaa

SEQ ID NO: 293850 - DNA, 25 bp, Homo sapien
atcagtgccccattaatatgctgcc

SEQ ID NO: 293851 - DNA, 25 bp, Homo sapien
cccattaatatgctgccctgtggca

SEQ ID NO: 293852 - DNA, 25 bp, Homo sapien
tgccaggcgtgcacaggtgtgcatt

SEQ ID NO: 293853 - DNA, 25 bp, Homo sapien
gatgtgcaagactccacagcagcag

SEQ ID NO: 293854 - DNA, 25 bp, Homo sapien
aggtgtgcattggtgtaccctggca

SEQ ID NO: 293855 - DNA, 25 bp, Homo sapien
cacaggtgtgcactgatgtgccctg

SEQ ID NO: 293856 - DNA, 25 bp, Homo sapien
atgtgccctggcatccattggtgta

SEQ ID NO: 293857 - DNA, 25 bp, Homo sapien
gggctcgcctgctgatggcttcaac

SEQ ID NO: 293858 - DNA, 25 bp, Homo sapien
tctagacagggaacagcttcaggat

SEQ ID NO: 293859 - DNA, 25 bp, Homo sapien
agggaacagcttcaggatacttcca

SEQ ID NO: 293860 - DNA, 25 bp, Homo sapien
acaaatattcccatgcctggagcat

SEQ ID NO: 293861 - DNA, 25 bp, Homo sapien
catgcctggagcatggcatagagga

SEQ ID NO: 293862 - DNA, 25 bp, Homo sapien
gggtctgaggaagccatttgagtct

SEQ ID NO: 293863 - DNA, 25 bp, Homo sapien
gaagccatttgagtctggccactag

SEQ ID NO: 293864 - DNA, 25 bp, Homo sapien
agtctggccactagacatctcatca

SEQ ID NO: 293865 - DNA, 25 bp, Homo sapien
catctcatcagccacttgtgtgaag

SEQ ID NO: 293866 - DNA, 25 bp, Homo sapien
acttgtgtgaagagatgccccatga

SEQ ID NO: 293867 - DNA, 25 bp, Homo sapien
aagagatgccccatgaccccagatg

SEQ ID NO: 293868 - DNA, 25 bp, Homo sapien
agcttccctgccaaactcacaagga

SEQ ID NO: 293869 - DNA, 25 bp, Homo sapien
aatctgtggctaatatgtgaaatat

SEQ ID NO: 293870 - DNA, 25 bp, Homo sapien
aaacgtttgcaaatatggtttcttg

SEQ ID NO: 293871 - DNA, 25 bp, Homo sapien
atatggtttcttgcaacttccgtga

SEQ ID NO: 293872 - DNA, 25 bp, Homo sapien
tttcttgcaacttccgtgaccaaag

SEQ ID NO: 293873 - DNA, 25 bp, Homo sapien
cttccgtgaccaaagtatgacttca

SEQ ID NO: 293874 - DNA, 25 bp, Homo sapien
agatttttgaagctgtgagtcaatt

SEQ ID NO: 293875 - DNA, 25 bp, Homo sapien
aaggaattccactcttgatgagtag

SEQ ID NO: 293876 - DNA, 25 bp, Homo sapien
gagtagaagcgttttcccagatgta

SEQ ID NO: 293877 - DNA, 25 bp, Homo sapien
gcgttttcccagatgtaaattcttg

SEQ ID NO: 293878 - DNA, 25 bp, Homo sapien
aacatgcttggagcaatctcttttc

SEQ ID NO: 293879 - DNA, 25 bp, Homo sapien
aatctcttttcacttgctatcatca

SEQ ID NO: 293880 - DNA, 25 bp, Homo sapien
ttattagcgcagattcctgggccat

SEQ ID NO: 293881 - DNA, 25 bp, Homo sapien
gattcctgggccatgccgggtaccg

SEQ ID NO: 293882 - DNA, 25 bp, Homo sapien
ggagaagcttgagcctctctcttgg

SEQ ID NO: 293883 - DNA, 25 bp, Homo sapien
tgccgggtaccgtgaccttgtgtaa

SEQ ID NO: 293884 - DNA, 25 bp, Homo sapien
gtaccgtgaccttgtgtaaatttat

SEQ ID NO: 293885 - DNA, 25 bp, Homo sapien
atcccgaggcctctggaatgggact

SEQ ID NO: 293886 - DNA, 25 bp, Homo sapien
tgagcctctctcttggacaggacaa

SEQ ID NO: 293887 - DNA, 25 bp, Homo sapien
atcctaactcctacaggccagagaa

SEQ ID NO: 293888 - DNA, 25 bp, Homo sapien
gaatgacatctctaactggctcata

SEQ ID NO: 293889 - DNA, 25 bp, Homo sapien
ggacaagctgaactctgaaatggga

SEQ ID NO: 293890 - DNA, 25 bp, Homo sapien
cccacctttccgatagtctgttaga

SEQ ID NO: 293891 - DNA, 25 bp, Homo sapien
gaattcagtaggtatctcacaggac

SEQ ID NO: 293892 - DNA, 25 bp, Homo sapien
gtaggtatctcacaggacaaatgaa

SEQ ID NO: 293893 - DNA, 25 bp, Homo sapien
aaaaggtgttcaatgtccccagtca

SEQ ID NO: 293894 - DNA, 25 bp, Homo sapien
aatgtccccagtcatcaggacaaca

SEQ ID NO: 293895 - DNA, 25 bp, Homo sapien
agtcatcaggacaacacaaattaaa

SEQ ID NO: 293896 - DNA, 25 bp, Homo sapien
taagataacatttcacgtccactaa

SEQ ID NO: 293897 - DNA, 25 bp, Homo sapien
acatttcacgtccactaaaattgct

SEQ ID NO: 293898 - DNA, 25 bp, Homo sapien
attgctaaggtgaaatacgatgaac

SEQ ID NO: 293899 - DNA, 25 bp, Homo sapien
tacgatgaacattgacaagtgtgtg

SEQ ID NO: 293900 - DNA, 25 bp, Homo sapien
ggagacactggaactctttatcatt

SEQ ID NO: 293901 - DNA, 25 bp, Homo sapien
gaagatgtgtctagcagtttcttat

SEQ ID NO: 293902 - DNA, 25 bp, Homo sapien
cctgtgcgtgtgacaggacgtcaag

SEQ ID NO: 293903 - DNA, 25 bp, Homo sapien
gacaggacgtcaagaactacataca

SEQ ID NO: 293904 - DNA, 25 bp, Homo sapien
aactacatacaaagacacagctgcc

SEQ ID NO: 293905 - DNA, 25 bp, Homo sapien
ctgcacagcctggtgcaatgcagct

SEQ ID NO: 293906 - DNA, 25 bp, Homo sapien
agctgcagcctgtcatcgagtcaat

SEQ ID NO: 293907 - DNA, 25 bp, Homo sapien
agcctgtcatcgagtcaattgcatt

SEQ ID NO: 293908 - DNA, 25 bp, Homo sapien
gagtcaattgcattgtcgtccgccg

SEQ ID NO: 293909 - DNA, 25 bp, Homo sapien
gccgctctcctgatgtagttctgtg

SEQ ID NO: 293910 - DNA, 25 bp, Homo sapien
tctgtgtttgtccattttgcactgc

SEQ ID NO: 293911 - DNA, 25 bp, Homo sapien
tgtttgtccattttgcactgctata

SEQ ID NO: 293912 - DNA, 25 bp, Homo sapien
ctgggtaagttggtgagcgcctgta

SEQ ID NO: 293913 - DNA, 25 bp, Homo sapien
ggtcaattccaaagagtaccagatt

SEQ ID NO: 293914 - DNA, 25 bp, Homo sapien
aagtagttcatcttaaggaacagcc

SEQ ID NO: 293915 - DNA, 25 bp, Homo sapien
aaggaacagccaagcgctagccagt

SEQ ID NO: 293916 - DNA, 25 bp, Homo sapien
agccaagcgctagccagttaagtga

SEQ ID NO: 293917 - DNA, 25 bp, Homo sapien
aagcgctagccagttaagtgaggca

SEQ ID NO: 293918 - DNA, 25 bp, Homo sapien
aagtgaggcatctcaattgcaagat

SEQ ID NO: 293919 - DNA, 25 bp, Homo sapien
gcaagattttctctgcatcggtcag

SEQ ID NO: 293920 - DNA, 25 bp, Homo sapien
ttctctgcatcggtcaggttagtga

SEQ ID NO: 293921 - DNA, 25 bp, Homo sapien
ggagatcaaacgtaagtgcactttc

SEQ ID NO: 293922 - DNA, 25 bp, Homo sapien
gatcaaacgtaagtgcactttccta

SEQ ID NO: 293923 - DNA, 25 bp, Homo sapien
gagatattagctcaggtcaattcca

SEQ ID NO: 293924 - DNA, 25 bp, Homo sapien
aaagtgaccagtgtgtccaccctga

SEQ ID NO: 293925 - DNA, 25 bp, Homo sapien
ccagtgtgtccaccctgaagagtga

SEQ ID NO: 293926 - DNA, 25 bp, Homo sapien
gtccaccctgaagagtgaagacata

SEQ ID NO: 293927 - DNA, 25 bp, Homo sapien
gaagacataaagatccgccaggaca

SEQ ID NO: 293928 - DNA, 25 bp, Homo sapien
gccaggacagcgtcaccaagctgct

SEQ ID NO: 293929 - DNA, 25 bp, Homo sapien
tcaccaagctgctgacggacgtgca

SEQ ID NO: 293930 - DNA, 25 bp, Homo sapien
gagtgcatggactccaagctcctgg

SEQ ID NO: 293931 - DNA, 25 bp, Homo sapien
ggactccaagctcctggccatgaag

SEQ ID NO: 293932 - DNA, 25 bp, Homo sapien
aagctcctggccatgaagcatgaga

SEQ ID NO: 293933 - DNA, 25 bp, Homo sapien
aagcatgagaatgaggctctgtggc

SEQ ID NO: 293934 - DNA, 25 bp, Homo sapien
agccttcggcagaagcatgcccagc

SEQ ID NO: 293935 - DNA, 25 bp, Homo sapien
acgttggcattttatctctccagga

SEQ ID NO: 293936 - DNA, 25 bp, Homo sapien
ggagcactcagctaggcggttccgt

SEQ ID NO: 293937 - DNA, 25 bp, Homo sapien
ctaggcggttccgtccaggagcttg

SEQ ID NO: 293938 - DNA, 25 bp, Homo sapien
gagcttgaaagcatcccagcggtgc

SEQ ID NO: 293939 - DNA, 25 bp, Homo sapien
cagcggtgcacctgttcagtctgag

SEQ ID NO: 293940 - DNA, 25 bp, Homo sapien
aggacctcaagcttgggtcaggcca

SEQ ID NO: 293941 - DNA, 25 bp, Homo sapien
ggtcaggccagcatgttttaggtat

SEQ ID NO: 293942 - DNA, 25 bp, Homo sapien
tgattgtcttgatttcaccctgaaa

SEQ ID NO: 293943 - DNA, 25 bp, Homo sapien
tcaccctgaaagctttggcaaacca

SEQ ID NO: 293944 - DNA, 25 bp, Homo sapien
aaaatctgacactgctttactccat

SEQ ID NO: 293945 - DNA, 25 bp, Homo sapien
gacactgctttactccatatcaatt

SEQ ID NO: 293946 - DNA, 25 bp, Homo sapien
ggtcaattccaaagagtaccagatt

SEQ ID NO: 293947 - DNA, 25 bp, Homo sapien
gtcaattccaaagagtaccagattc

SEQ ID NO: 293948 - DNA, 25 bp, Homo sapien
caattccaaagagtaccagattctt

SEQ ID NO: 293949 - DNA, 25 bp, Homo sapien
attccaaagagtaccagattctttc

SEQ ID NO: 293950 - DNA, 25 bp, Homo sapien
tccaaagagtaccagattctttcaa

SEQ ID NO: 293951 - DNA, 25 bp, Homo sapien
caaagagtaccagattctttcaaaa

SEQ ID NO: 293952 - DNA, 25 bp, Homo sapien
tctttcaaaaagtcagatgagtaag

SEQ ID NO: 293953 - DNA, 25 bp, Homo sapien
agttaagtgaggcatctcaattgca

SEQ ID NO: 293954 - DNA, 25 bp, Homo sapien
ttaagtgaggcatctcaattgcaag

SEQ ID NO: 293955 - DNA, 25 bp, Homo sapien
aagtgaggcatctcaattgcaagat

SEQ ID NO: 293956 - DNA, 25 bp, Homo sapien
ttctctgcatcggtcaggttagtga

SEQ ID NO: 293957 - DNA, 25 bp, Homo sapien
gatgctacagttttgacaccaaata

SEQ ID NO: 293958 - DNA, 25 bp, Homo sapien
caaagttcaggaccagaagatgact

SEQ ID NO: 293959 - DNA, 25 bp, Homo sapien
ttataattcacaattttacctgaaa

SEQ ID NO: 293960 - DNA, 25 bp, Homo sapien
aaaatttaacgtaatctgtgttgat

SEQ ID NO: 293961 - DNA, 25 bp, Homo sapien
acgtaatctgtgttgatttatgtaa

SEQ ID NO: 293962 - DNA, 25 bp, Homo sapien
tttatgtaaatctaccttggtcttt

SEQ ID NO: 293963 - DNA, 25 bp, Homo sapien
ccagaagatgacttcgaatcttgtt

SEQ ID NO: 293964 - DNA, 25 bp, Homo sapien
agatgacttcgaatcttgtttgaga

SEQ ID NO: 293965 - DNA, 25 bp, Homo sapien
gaagtcacagtatgaagtttttcga

SEQ ID NO: 293966 - DNA, 25 bp, Homo sapien
tttcgaagtagtagactctcatcag

SEQ ID NO: 293967 - DNA, 25 bp, Homo sapien
gtagactctcatcagatgctacagt

SEQ ID NO: 293968 - DNA, 25 bp, Homo sapien
aaagatggtcacgatttttgcagac

SEQ ID NO: 293969 - DNA, 25 bp, Homo sapien
gcaaagtattataggcctttccatc

SEQ ID NO: 293970 - DNA, 25 bp, Homo sapien
aggcctttccatctatccggagtga

SEQ ID NO: 293971 - DNA, 25 bp, Homo sapien
atccggagtgacctaccagagacag

SEQ ID NO: 293972 - DNA, 25 bp, Homo sapien
agcaagcttctgatcactcttcaac

SEQ ID NO: 293973 - DNA, 25 bp, Homo sapien
atcactcttcaacacccagcaagaa

SEQ ID NO: 293974 - DNA, 25 bp, Homo sapien
gcaagaagtcttatcctccatgcag

SEQ ID NO: 293975 - DNA, 25 bp, Homo sapien
atgcagccttctaagacctctctaa

SEQ ID NO: 293976 - DNA, 25 bp, Homo sapien
agacctctctaagcacaggtatcag

SEQ ID NO: 293977 - DNA, 25 bp, Homo sapien
acaggtatcagatcctcctctggat

SEQ ID NO: 293978 - DNA, 25 bp, Homo sapien
atcagataccatcagcataatgtca

SEQ ID NO: 293979 - DNA, 25 bp, Homo sapien
ggaagattcaattaaaggtaggcat

SEQ ID NO: 293980 - DNA, 25 bp, Homo sapien
aaggtaggcatataagctcctgaca

SEQ ID NO: 293981 - DNA, 25 bp, Homo sapien
ggcatataagctcctgacagaaaaa

SEQ ID NO: 293982 - DNA, 25 bp, Homo sapien
tagaaatgatggtatctcttaagat

SEQ ID NO: 293983 - DNA, 25 bp, Homo sapien
ttaacaagactccaattagggtgcc

SEQ ID NO: 293984 - DNA, 25 bp, Homo sapien
aagactccaattagggtgccagaat

SEQ ID NO: 293985 - DNA, 25 bp, Homo sapien
gggtgccagaatattactttacata

SEQ ID NO: 293986 - DNA, 25 bp, Homo sapien
ctttacatatcctcacaaagtggtt

SEQ ID NO: 293987 - DNA, 25 bp, Homo sapien
cctcacaaagtggttctaaaatctg

SEQ ID NO: 293988 - DNA, 25 bp, Homo sapien
gaaattcaaactgaaggcttctgtc

SEQ ID NO: 293989 - DNA, 25 bp, Homo sapien
aaggcttctgtctcccagtcctttg

SEQ ID NO: 293990 - DNA, 25 bp, Homo sapien
ataactacttcctagtcaaagaacg

SEQ ID NO: 293991 - DNA, 25 bp, Homo sapien
aatgtttttccgctttgagggatgt

SEQ ID NO: 293992 - DNA, 25 bp, Homo sapien
tccgctttgagggatgtaaccacat

SEQ ID NO: 293993 - DNA, 25 bp, Homo sapien
gatgtaaccacatccactcagagga

SEQ ID NO: 293994 - DNA, 25 bp, Homo sapien
acatccactcagaggacactacttt

SEQ ID NO: 293995 - DNA, 25 bp, Homo sapien
gacactacttttctgaaagctctgg

SEQ ID NO: 293996 - DNA, 25 bp, Homo sapien
gggtgactaatgatgagttcctaat

SEQ ID NO: 293997 - DNA, 25 bp, Homo sapien
ttaattgcaagtgtggtgccttgga

SEQ ID NO: 293998 - DNA, 25 bp, Homo sapien
tctgtggcttatcaaggtgtagatg

SEQ ID NO: 293999 - DNA, 25 bp, Homo sapien
cagaaagcaaacctggatacagagt

SEQ ID NO: 294000 - DNA, 25 bp, Homo sapien
agagtttccaccctcagttcctgga

SEQ ID NO: 294001 - DNA, 25 bp, Homo sapien
gatagttgacaggactttctaactg

SEQ ID NO: 294002 - DNA, 25 bp, Homo sapien
ctagcaacttcccagttccatctgt

SEQ ID NO: 294003 - DNA, 25 bp, Homo sapien
ggactttctaactggatagcagatg

SEQ ID NO: 294004 - DNA, 25 bp, Homo sapien
tatggaatcctgttcagcgggtgtt

SEQ ID NO: 294005 - DNA, 25 bp, Homo sapien
tgttcagcgggtgtttgctgagccc

SEQ ID NO: 294006 - DNA, 25 bp, Homo sapien
tttgctgagcccttcttgtgcaaaa

SEQ ID NO: 294007 - DNA, 25 bp, Homo sapien
gagcccttcttgtgcaaaaggctga

SEQ ID NO: 294008 - DNA, 25 bp, Homo sapien
ttcttgtgcaaaaggctgaagcggg

SEQ ID NO: 294009 - DNA, 25 bp, Homo sapien
ggaagtgcaaaataggccccagctg

SEQ ID NO: 294010 - DNA, 25 bp, Homo sapien
tgttgcccagctggcttgtacttct

SEQ ID NO: 294011 - DNA, 25 bp, Homo sapien
agctggcttgtacttctgagctcaa

SEQ ID NO: 294012 - DNA, 25 bp, Homo sapien
atttcacacacactccttgtagatg

SEQ ID NO: 294013 - DNA, 25 bp, Homo sapien
actccttgtagatgggagccagagg

SEQ ID NO: 294014 - DNA, 25 bp, Homo sapien
tgggagccagaggaaacctgaacgt

SEQ ID NO: 294015 - DNA, 25 bp, Homo sapien
ctgaacgtgggtggagcgttccact

SEQ ID NO: 294016 - DNA, 25 bp, Homo sapien
ggagcgttccactgagtctacttca

SEQ ID NO: 294017 - DNA, 25 bp, Homo sapien
cactgagtctacttcaggagacaga

SEQ ID NO: 294018 - DNA, 25 bp, Homo sapien
caggagacagaaggcccatgctgat

SEQ ID NO: 294019 - DNA, 25 bp, Homo sapien
catttcttcctagtctggcctttga

SEQ ID NO: 294020 - DNA, 25 bp, Homo sapien
tcctagtctggcctttgacacaaat

SEQ ID NO: 294021 - DNA, 25 bp, Homo sapien
gtctggcctttgacacaaatctggt

SEQ ID NO: 294022 - DNA, 25 bp, Homo sapien
ggcctttgacacaaatctggtagaa

SEQ ID NO: 294023 - DNA, 25 bp, Homo sapien
gaaggagacccttacgcggagctgc

SEQ ID NO: 294024 - DNA, 25 bp, Homo sapien
acctctgacttctggaactatgtgc

SEQ ID NO: 294025 - DNA, 25 bp, Homo sapien
cttctggaactatgtgcagcacttc

SEQ ID NO: 294026 - DNA, 25 bp, Homo sapien
ggaactatgtgcagcacttccaggc

SEQ ID NO: 294027 - DNA, 25 bp, Homo sapien
tatgtgcagcacttccaggccctgg

SEQ ID NO: 294028 - DNA, 25 bp, Homo sapien
gggcctacccccagatcgaggacat

SEQ ID NO: 294029 - DNA, 25 bp, Homo sapien
ggcctgagtcgcagatcagaaagca

SEQ ID NO: 294030 - DNA, 25 bp, Homo sapien
aggacatggcccgaaccttctttgc

SEQ ID NO: 294031 - DNA, 25 bp, Homo sapien
gtcgcagatcagaaagcaccgggaa

SEQ ID NO: 294032 - DNA, 25 bp, Homo sapien
gaaagcaccgggaagatgcaggcct

SEQ ID NO: 294033 - DNA, 25 bp, Homo sapien
aagatgcaggcctgcatggtgccgg

SEQ ID NO: 294034 - DNA, 25 bp, Homo sapien
tccgttattttctacataggcaaag

SEQ ID NO: 294035 - DNA, 25 bp, Homo sapien
gaattcgagggatagacagtctcca

SEQ ID NO: 294036 - DNA, 25 bp, Homo sapien
gtggtgggagagaattgcttttttc

SEQ ID NO: 294037 - DNA, 25 bp, Homo sapien
ttctggctgagatttccgtgcaaga

SEQ ID NO: 294038 - DNA, 25 bp, Homo sapien
gatttccgtgcaagacagcacccaa

SEQ ID NO: 294039 - DNA, 25 bp, Homo sapien
agacagcacccaatagactatttag

SEQ ID NO: 294040 - DNA, 25 bp, Homo sapien
tgacattttaatgggcgccatggct

SEQ ID NO: 294041 - DNA, 25 bp, Homo sapien
agattgagaaggtgcgtctcccctg

SEQ ID NO: 294042 - DNA, 25 bp, Homo sapien
tgctccaagtctcatcatgacagcg

SEQ ID NO: 294043 - DNA, 25 bp, Homo sapien
agtctcatcatgacagcgtgctgac

SEQ ID NO: 294044 - DNA, 25 bp, Homo sapien
gccttcctcacgcagaggccttaaa

SEQ ID NO: 294045 - DNA, 25 bp, Homo sapien
taggctacgagaggccatgagctcc

SEQ ID NO: 294046 - DNA, 25 bp, Homo sapien
atgagctcctcatctcttctctgtt

SEQ ID NO: 294047 - DNA, 25 bp, Homo sapien
tgagctctctgatccactgcacttg

SEQ ID NO: 294048 - DNA, 25 bp, Homo sapien
gagtctactttctgcatcattggtt

SEQ ID NO: 294049 - DNA, 25 bp, Homo sapien
aatgtcctcctaggctgcattggaa

SEQ ID NO: 294050 - DNA, 25 bp, Homo sapien
ggaattgtgtgttgtctagacccat

SEQ ID NO: 294051 - DNA, 25 bp, Homo sapien
gtgttgtctagacccatggccaaga

SEQ ID NO: 294052 - DNA, 25 bp, Homo sapien
gagggagaccaagctcaccaccaag

SEQ ID NO: 294053 - DNA, 25 bp, Homo sapien
accaagggcttttgccagattgctt

SEQ ID NO: 294054 - DNA, 25 bp, Homo sapien
gctttcatttacagaatttgcccat

SEQ ID NO: 294055 - DNA, 25 bp, Homo sapien
atttgcccattcatgtgtctttgtg

SEQ ID NO: 294056 - DNA, 25 bp, Homo sapien
agatccgccggaaaagtaaactgtg

SEQ ID NO: 294057 - DNA, 25 bp, Homo sapien
gtaaactgtggctggagaggaatct

SEQ ID NO: 294058 - DNA, 25 bp, Homo sapien
gggagcacctcgtaactccgcaaga

SEQ ID NO: 294059 - DNA, 25 bp, Homo sapien
aaggatggatgtaatcagtgggcct

SEQ ID NO: 294060 - DNA, 25 bp, Homo sapien
atcagtgggcctgaacttcattcct

SEQ ID NO: 294061 - DNA, 25 bp, Homo sapien
agtgggcctgaacttcattcctgcc

SEQ ID NO: 294062 - DNA, 25 bp, Homo sapien
taactccgcaagaccacgggctaga

SEQ ID NO: 294063 - DNA, 25 bp, Homo sapien
gacagtggcagagcagacgtctcct

SEQ ID NO: 294064 - DNA, 25 bp, Homo sapien
gtggcagagcagacgtctcctgtac

SEQ ID NO: 294065 - DNA, 25 bp, Homo sapien
gagcagacgtctcctgtacgctctt

SEQ ID NO: 294066 - DNA, 25 bp, Homo sapien
cccacgcctctagagggagtttatt

SEQ ID NO: 294067 - DNA, 25 bp, Homo sapien
tttctgagtttttcacatgcattaa

SEQ ID NO: 294068 - DNA, 25 bp, Homo sapien
tttcacatgcattaacttgcggtat

SEQ ID NO: 294069 - DNA, 25 bp, Homo sapien
cattaacttgcggtatttttctgtt

SEQ ID NO: 294070 - DNA, 25 bp, Homo sapien
taccagttaccattccgggttcgag

SEQ ID NO: 294071 - DNA, 25 bp, Homo sapien
attccgggttcgagcatcacaagct

SEQ ID NO: 294072 - DNA, 25 bp, Homo sapien
gagcatcacaagcttttgagcgcat

SEQ ID NO: 294073 - DNA, 25 bp, Homo sapien
gcttttgagcgcatggaactccata

SEQ ID NO: 294074 - DNA, 25 bp, Homo sapien
atggaactccataaactaacaaatt

SEQ ID NO: 294075 - DNA, 25 bp, Homo sapien
atccttttctaaaaactgaacaatg

SEQ ID NO: 294076 - DNA, 25 bp, Homo sapien
gaacaatggcacaattgtttgctat

SEQ ID NO: 294077 - DNA, 25 bp, Homo sapien
aattgtttgctatgtgcacccgtcc

SEQ ID NO: 294078 - DNA, 25 bp, Homo sapien
agggccgcaggtagactagcacttg

SEQ ID NO: 294079 - DNA, 25 bp, Homo sapien
gcacttgatgtctgatcctaacatg

SEQ ID NO: 294080 - DNA, 25 bp, Homo sapien
cctaacatggaaaacctgctctgct

SEQ ID NO: 294081 - DNA, 25 bp, Homo sapien
tgctctgctgatgtcgaattccttg

SEQ ID NO: 294082 - DNA, 25 bp, Homo sapien
atgtcgaattccttgccttacctgg

SEQ ID NO: 294083 - DNA, 25 bp, Homo sapien
ttacctggccatgggtccagctgtt

SEQ ID NO: 294084 - DNA, 25 bp, Homo sapien
attctatcagccagtttctcttgtg

SEQ ID NO: 294085 - DNA, 25 bp, Homo sapien
tcttgtgattctttggctggtgtct

SEQ ID NO: 294086 - DNA, 25 bp, Homo sapien
aacacagacaacactcggtcccagt

SEQ ID NO: 294087 - DNA, 25 bp, Homo sapien
ggtcccagtcatcagtcgctcaggt

SEQ ID NO: 294088 - DNA, 25 bp, Homo sapien
agtcgctcaggttccaacgtcaaac

SEQ ID NO: 294089 - DNA, 25 bp, Homo sapien
ggtctcttaatcacattgattctat

SEQ ID NO: 294090 - DNA, 25 bp, Homo sapien
tgattctatttcgtggatacttcca

SEQ ID NO: 294091 - DNA, 25 bp, Homo sapien
tttcgtggatacttccaaggaggaa

SEQ ID NO: 294092 - DNA, 25 bp, Homo sapien
tatacccgactgctgaaaaacattc

SEQ ID NO: 294093 - DNA, 25 bp, Homo sapien
aaacatgtttgtggataggtaatct

SEQ ID NO: 294094 - DNA, 25 bp, Homo sapien
gtggataggtaatctttgttttcct

SEQ ID NO: 294095 - DNA, 25 bp, Homo sapien
gatttctacttaagtgttcttgaca

SEQ ID NO: 294096 - DNA, 25 bp, Homo sapien
tgttcttgacattttactgcaccct

SEQ ID NO: 294097 - DNA, 25 bp, Homo sapien
tgacattttactgcacccttttaaa

SEQ ID NO: 294098 - DNA, 25 bp, Homo sapien
tgagcatagagtttaggcaagagaa

SEQ ID NO: 294099 - DNA, 25 bp, Homo sapien
gactactatggtctcttaatcacat

SEQ ID NO: 294100 - DNA, 25 bp, Homo sapien
ttcttctttagcagtaccttagttt

SEQ ID NO: 294101 - DNA, 25 bp, Homo sapien
agtaccttagtttgatctgatagtg

SEQ ID NO: 294102 - DNA, 25 bp, Homo sapien
ttgatctgatagtggcaaggatccc

SEQ ID NO: 294103 - DNA, 25 bp, Homo sapien
tcaaagagattaggaccttacccca

SEQ ID NO: 294104 - DNA, 25 bp, Homo sapien
gattaggaccttaccccaactccag

SEQ ID NO: 294105 - DNA, 25 bp, Homo sapien
tgtatagtctgattagtacgaggca

SEQ ID NO: 294106 - DNA, 25 bp, Homo sapien
agtacgaggcagaactttttgcagt

SEQ ID NO: 294107 - DNA, 25 bp, Homo sapien
tttgcagtgaaggaaatcaaccatc

SEQ ID NO: 294108 - DNA, 25 bp, Homo sapien
ttctgtctctctattgtggtagcta

SEQ ID NO: 294109 - DNA, 25 bp, Homo sapien
gtagctactaaccatatgtgatatt

SEQ ID NO: 294110 - DNA, 25 bp, Homo sapien
tgagtacttgatatgtgactactgc

SEQ ID NO: 294111 - DNA, 25 bp, Homo sapien
tgtccatccactgtgccccttgggc

SEQ ID NO: 294112 - DNA, 25 bp, Homo sapien
gcgctcggtgccacgtgccgtgtgg

SEQ ID NO: 294113 - DNA, 25 bp, Homo sapien
tgccgtgtggtgtctgtgccgcaga

SEQ ID NO: 294114 - DNA, 25 bp, Homo sapien
tgtctgtgccgcagacgggccatct

SEQ ID NO: 294115 - DNA, 25 bp, Homo sapien
tctgtgccgcagacgggccatctgc

SEQ ID NO: 294116 - DNA, 25 bp, Homo sapien
atctgcccgctcacttgtggacttt

SEQ ID NO: 294117 - DNA, 25 bp, Homo sapien
tgcccgctcacttgtggactttgcg

SEQ ID NO: 294118 - DNA, 25 bp, Homo sapien
tcacttgtggactttgcgctcccgg

SEQ ID NO: 294119 - DNA, 25 bp, Homo sapien
acttgtggactttgcgctcccggtt

SEQ ID NO: 294120 - DNA, 25 bp, Homo sapien
cttgtggactttgcgctcccggttg

SEQ ID NO: 294121 - DNA, 25 bp, Homo sapien
tggactttgcgctcccggttgtcgc

SEQ ID NO: 294122 - DNA, 25 bp, Homo sapien
gattccaaatcaaggttaaacatat

SEQ ID NO: 294123 - DNA, 25 bp, Homo sapien
cattcatggtgaaattcctatggta

SEQ ID NO: 294124 - DNA, 25 bp, Homo sapien
gaagatgacttgctatttacaatta

SEQ ID NO: 294125 - DNA, 25 bp, Homo sapien
acaaaagtgcctaagacagtacctg

SEQ ID NO: 294126 - DNA, 25 bp, Homo sapien
gacagtacctggcttcagagtcact

SEQ ID NO: 294127 - DNA, 25 bp, Homo sapien
acctggcttcagagtcactaagaaa

SEQ ID NO: 294128 - DNA, 25 bp, Homo sapien
gaaattgctaaaagctctgcttcgc

SEQ ID NO: 294129 - DNA, 25 bp, Homo sapien
aaagctctgcttcgcatggtaaaaa

SEQ ID NO: 294130 - DNA, 25 bp, Homo sapien
tatttgcctccctgatgtgtctgag

SEQ ID NO: 294131 - DNA, 25 bp, Homo sapien
gcctccctgatgtgtctgaggaata

SEQ ID NO: 294132 - DNA, 25 bp, Homo sapien
gatgtcggaagtgcaaactcttaaa

SEQ ID NO: 294133 - DNA, 25 bp, Homo sapien
attgctggtcggagggacccctctc

SEQ ID NO: 294134 - DNA, 25 bp, Homo sapien
agccctgcttgtatctgcctgacta

SEQ ID NO: 294135 - DNA, 25 bp, Homo sapien
tctgcctgactacttgctctaacgt

SEQ ID NO: 294136 - DNA, 25 bp, Homo sapien
ggctgcccaggatgtcagacgttct

SEQ ID NO: 294137 - DNA, 25 bp, Homo sapien
ggagactgccttttcttggcaccag

SEQ ID NO: 294138 - DNA, 25 bp, Homo sapien
ggatgtcagacgttctggctctcca

SEQ ID NO: 294139 - DNA, 25 bp, Homo sapien
gggagcccaactcatgtttttgttt

SEQ ID NO: 294140 - DNA, 25 bp, Homo sapien
tgttttcttccatccgtgaagcaag

SEQ ID NO: 294141 - DNA, 25 bp, Homo sapien
agtttgacaagcactacagcccatc

SEQ ID NO: 294142 - DNA, 25 bp, Homo sapien
gacagtgtagcaactgcctgacaat

SEQ ID NO: 294143 - DNA, 25 bp, Homo sapien
gatggtcactggacattgctggtcg

SEQ ID NO: 294144 - DNA, 25 bp, Homo sapien
attcgaatgtcttgctggatgaaga

SEQ ID NO: 294145 - DNA, 25 bp, Homo sapien
tgaagaggccgctcagccggagcct

SEQ ID NO: 294146 - DNA, 25 bp, Homo sapien
tcagccggagcctcctgtttcatgc

SEQ ID NO: 294147 - DNA, 25 bp, Homo sapien
ggagcctcctgtttcatgcgcttct

SEQ ID NO: 294148 - DNA, 25 bp, Homo sapien
gtttcatgcgcttctcttctgaggg

SEQ ID NO: 294149 - DNA, 25 bp, Homo sapien
ggttcagcccgctccttggccaggg

SEQ ID NO: 294150 - DNA, 25 bp, Homo sapien
tgccttgagggacctggacccccag

SEQ ID NO: 294151 - DNA, 25 bp, Homo sapien
aggcagaccaaaaatgtctgctagc

SEQ ID NO: 294152 - DNA, 25 bp, Homo sapien
agctagttggtttctatacaaatac

SEQ ID NO: 294153 - DNA, 25 bp, Homo sapien
ggtttctatacaaatacatattcga

SEQ ID NO: 294154 - DNA, 25 bp, Homo sapien
tacatattcgaatgtcttgctggat

SEQ ID NO: 294155 - DNA, 25 bp, Homo sapien
ggatttttaagatgtgggatcagaa

SEQ ID NO: 294156 - DNA, 25 bp, Homo sapien
atgtgggatcagaatatatgttact

SEQ ID NO: 294157 - DNA, 25 bp, Homo sapien
gtatacattaaaagtcatgcctaaa

SEQ ID NO: 294158 - DNA, 25 bp, Homo sapien
aaaagtcatgcctaaatttccaaag

SEQ ID NO: 294159 - DNA, 25 bp, Homo sapien
gtcatgcctaaatttccaaagagta

SEQ ID NO: 294160 - DNA, 25 bp, Homo sapien
tgcctaaatttccaaagagtagttt

SEQ ID NO: 294161 - DNA, 25 bp, Homo sapien
aaatattattttccagagagtaact

SEQ ID NO: 294162 - DNA, 25 bp, Homo sapien
tccagagagtaacttttctaaaggt

SEQ ID NO: 294163 - DNA, 25 bp, Homo sapien
tctaaaggtcctaaattctgaaaag

SEQ ID NO: 294164 - DNA, 25 bp, Homo sapien
tttgtacatgtaaaccttgataaat

SEQ ID NO: 294165 - DNA, 25 bp, Homo sapien
tgataaataaacagcatctcaaccc

SEQ ID NO: 294166 - DNA, 25 bp, Homo sapien
gggaaacccttggaatcctggatca

SEQ ID NO: 294167 - DNA, 25 bp, Homo sapien
gaaacccttggaatcctggatcaac

SEQ ID NO: 294168 - DNA, 25 bp, Homo sapien
atcctggatcaacaagacacccaac

SEQ ID NO: 294169 - DNA, 25 bp, Homo sapien
aagacacccaacacagaacagcaga

SEQ ID NO: 294170 - DNA, 25 bp, Homo sapien
agaacagcagactcctcttttccag

SEQ ID NO: 294171 - DNA, 25 bp, Homo sapien
agcagactcctcttttccaggtcat

SEQ ID NO: 294172 - DNA, 25 bp, Homo sapien
gactcctcttttccaggtcatctca

SEQ ID NO: 294173 - DNA, 25 bp, Homo sapien
ttttccaggtcatctcacctcagcg

SEQ ID NO: 294174 - DNA, 25 bp, Homo sapien
tatgtcccccatggtgttcgcacaa

SEQ ID NO: 294175 - DNA, 25 bp, Homo sapien
aaagggagagcggcctcttgcctgt

SEQ ID NO: 294176 - DNA, 25 bp, Homo sapien
agagcggcctcttgcctgtgggagg

SEQ ID NO: 294177 - DNA, 25 bp, Homo sapien
tacaagaaccccctactcaaaatgg

SEQ ID NO: 294178 - DNA, 25 bp, Homo sapien
aaatggaggctcaggccggtgtaaa

SEQ ID NO: 294179 - DNA, 25 bp, Homo sapien
tcaggccggtgtaaagcgggcctcc

SEQ ID NO: 294180 - DNA, 25 bp, Homo sapien
taaagcgggcctccctctgacggca

SEQ ID NO: 294181 - DNA, 25 bp, Homo sapien
gcgcggaacagcaagggccgtgtct

SEQ ID NO: 294182 - DNA, 25 bp, Homo sapien
aagggccgtgtctgtgcgggtgagt

SEQ ID NO: 294183 - DNA, 25 bp, Homo sapien
gcaactgcaggctgacgtcaccgca

SEQ ID NO: 294184 - DNA, 25 bp, Homo sapien
tgcaggctgacgtcaccgcaggccg

SEQ ID NO: 294185 - DNA, 25 bp, Homo sapien
gtgtgaactcggagagctacctgat

SEQ ID NO: 294186 - DNA, 25 bp, Homo sapien
aactcggagagctacctgatgtcgc

SEQ ID NO: 294187 - DNA, 25 bp, Homo sapien
gagagctacctgatgtcgcgcccct

SEQ ID NO: 294188 - DNA, 25 bp, Homo sapien
cagcctgcaggtggtgtcgctgctg

SEQ ID NO: 294189 - DNA, 25 bp, Homo sapien
ccagctctagactgcccagcttggg

SEQ ID NO: 294190 - DNA, 25 bp, Homo sapien
ccagagggagcatggttgcaagacc

SEQ ID NO: 294191 - DNA, 25 bp, Homo sapien
gggagactcgcctgtcctcatcgct

SEQ ID NO: 294192 - DNA, 25 bp, Homo sapien
aaggagggcgactacattgtgtcag

SEQ ID NO: 294193 - DNA, 25 bp, Homo sapien
gggcgactacattgtgtcagtgaat

SEQ ID NO: 294194 - DNA, 25 bp, Homo sapien
attgtgtcagtgaatgggcagccat

SEQ ID NO: 294195 - DNA, 25 bp, Homo sapien
gtgtcagtgaatgggcagccatgca

SEQ ID NO: 294196 - DNA, 25 bp, Homo sapien
acgcggaggtggtgacggagctgaa

SEQ ID NO: 294197 - DNA, 25 bp, Homo sapien
aaggctgcgggagaggcgggcgcca

SEQ ID NO: 294198 - DNA, 25 bp, Homo sapien
agaggcgggcgccagcctgcaggtg

SEQ ID NO: 294199 - DNA, 25 bp, Homo sapien
ctgttcctggagctgctaagtaacc

SEQ ID NO: 294200 - DNA, 25 bp, Homo sapien
agctgctaagtaaccagagcgaggc

SEQ ID NO: 294201 - DNA, 25 bp, Homo sapien
aggagccacaggactgcgccgctgt

SEQ ID NO: 294202 - DNA, 25 bp, Homo sapien
gccagcgatgtggttctgcgggtgc

SEQ ID NO: 294203 - DNA, 25 bp, Homo sapien
tgcgccgctgtcttcgacaagttca

SEQ ID NO: 294204 - DNA, 25 bp, Homo sapien
gtcttcgacaagttcatcaggtacc

SEQ ID NO: 294205 - DNA, 25 bp, Homo sapien
tgaccgtgctgctgacccaggccat

SEQ ID NO: 294206 - DNA, 25 bp, Homo sapien
agactggccaccaagtacggcgtgt

SEQ ID NO: 294207 - DNA, 25 bp, Homo sapien
gcaccgatgaggtccgggtattcca

SEQ ID NO: 294208 - DNA, 25 bp, Homo sapien
atgaggtccgggtattccacgccca

SEQ ID NO: 294209 - DNA, 25 bp, Homo sapien
tgctgggactgcacagtgagctgtt

SEQ ID NO: 294210 - DNA, 25 bp, Homo sapien
accaacccctcatgtaggtattagg

SEQ ID NO: 294211 - DNA, 25 bp, Homo sapien
tattagggcaatacactttcaaggt

SEQ ID NO: 294212 - DNA, 25 bp, Homo sapien
gggcaatacactttcaaggtagaat

SEQ ID NO: 294213 - DNA, 25 bp, Homo sapien
aatgctaacacattctttcataagc

SEQ ID NO: 294214 - DNA, 25 bp, Homo sapien
ataagcattaccaaggctgacatct

SEQ ID NO: 294215 - DNA, 25 bp, Homo sapien
ggctgacatctaatgttagttctga

SEQ ID NO: 294216 - DNA, 25 bp, Homo sapien
taaaaatgttactccagtctgtcat

SEQ ID NO: 294217 - DNA, 25 bp, Homo sapien
cagtctgtcattgtatatcccacgg

SEQ ID NO: 294218 - DNA, 25 bp, Homo sapien
tatcccacggtgttactcatcaaat

SEQ ID NO: 294219 - DNA, 25 bp, Homo sapien
tactcatcaaattttcatagctgct

SEQ ID NO: 294220 - DNA, 25 bp, Homo sapien
tcatagctgctttaatgacaggaat

SEQ ID NO: 294221 - DNA, 25 bp, Homo sapien
gaatgtcactgaatctttaatgcca

SEQ ID NO: 294222 - DNA, 25 bp, Homo sapien
taatgccagttacacagagctcagt

SEQ ID NO: 294223 - DNA, 25 bp, Homo sapien
agtaggtgtccgcacagccctttag

SEQ ID NO: 294224 - DNA, 25 bp, Homo sapien
agccctttagatgcacgtagcctat

SEQ ID NO: 294225 - DNA, 25 bp, Homo sapien
gcacgtagcctatttgatcttcgta

SEQ ID NO: 294226 - DNA, 25 bp, Homo sapien
gatcttcgtatcagccctgtaaggt

SEQ ID NO: 294227 - DNA, 25 bp, Homo sapien
atgacccagcatggaagtactcttg

SEQ ID NO: 294228 - DNA, 25 bp, Homo sapien
gggaagcaacagtccttgtaagctg

SEQ ID NO: 294229 - DNA, 25 bp, Homo sapien
gctgtttgtcagtgggccttagcaa

SEQ ID NO: 294230 - DNA, 25 bp, Homo sapien
gcaaccaagccccaagtggacagaa

SEQ ID NO: 294231 - DNA, 25 bp, Homo sapien
ttgctattacttctgtcccaatttg

SEQ ID NO: 294232 - DNA, 25 bp, Homo sapien
gaattgaattccgtgaaggctccct

SEQ ID NO: 294233 - DNA, 25 bp, Homo sapien
ttccgtgaaggctccctagtaatca

SEQ ID NO: 294234 - DNA, 25 bp, Homo sapien
ggctccctagtaatcaatagcaaaa

SEQ ID NO: 294235 - DNA, 25 bp, Homo sapien
aaaggaatggttttcagcatcaatt

SEQ ID NO: 294236 - DNA, 25 bp, Homo sapien
agcatcaatttaggattctcagacc

SEQ ID NO: 294237 - DNA, 25 bp, Homo sapien
ggattctcagacctgactaacaagg

SEQ ID NO: 294238 - DNA, 25 bp, Homo sapien
gaagagaaaacctatgccctgttca

SEQ ID NO: 294239 - DNA, 25 bp, Homo sapien
atgccctgttcattggtgacacagt

SEQ ID NO: 294240 - DNA, 25 bp, Homo sapien
cattggtgacacagtgcttgtggat

SEQ ID NO: 294241 - DNA, 25 bp, Homo sapien
atgaggatggcccagctactgttct

SEQ ID NO: 294242 - DNA, 25 bp, Homo sapien
ggatggcccagctactgttctcact

SEQ ID NO: 294243 - DNA, 25 bp, Homo sapien
gacaatgttggatgcaaacggattt

SEQ ID NO: 294244 - DNA, 25 bp, Homo sapien
aacggatttgccagcaattgcatca

SEQ ID NO: 294245 - DNA, 25 bp, Homo sapien
actgtcaaaaccagctctgcccgtg

SEQ ID NO: 294246 - DNA, 25 bp, Homo sapien
gctctgcccgtgtcttccgaagata

SEQ ID NO: 294247 - DNA, 25 bp, Homo sapien
gtgtcttccgaagataccaagtgaa

SEQ ID NO: 294248 - DNA, 25 bp, Homo sapien
gggatttacatctgaaaaaccaagt

SEQ ID NO: 294249 - DNA, 25 bp, Homo sapien
gagtggtttacccagtttggcacaa

SEQ ID NO: 294250 - DNA, 25 bp, Homo sapien
gtttggcacaactgaccccaaccta

SEQ ID NO: 294251 - DNA, 25 bp, Homo sapien
aacctagccctccatgaggactgag

SEQ ID NO: 294252 - DNA, 25 bp, Homo sapien
gccctccatgaggactgagcgcatg

SEQ ID NO: 294253 - DNA, 25 bp, Homo sapien
gaggtgacccaaatttcaagacaat

SEQ ID NO: 294254 - DNA, 25 bp, Homo sapien
tgtccatccactgtgccccttgggc

SEQ ID NO: 294255 - DNA, 25 bp, Homo sapien
gcgctcggtgccacgtgccgtgtgg

SEQ ID NO: 294256 - DNA, 25 bp, Homo sapien
tgccgtgtggtgtctgtgccgcaga

SEQ ID NO: 294257 - DNA, 25 bp, Homo sapien
gtctgtgccgcagacgggccatctg

SEQ ID NO: 294258 - DNA, 25 bp, Homo sapien
atctgcccgctcacttgtggacttt

SEQ ID NO: 294259 - DNA, 25 bp, Homo sapien
tgcccgctcacttgtggactttgcg

SEQ ID NO: 294260 - DNA, 25 bp, Homo sapien
acttgtggactttgcgctcccggtt

SEQ ID NO: 294261 - DNA, 25 bp, Homo sapien
tggactttgcgctcccggttgtcgc

SEQ ID NO: 294262 - DNA, 25 bp, Homo sapien
tctgccccaggagcttgacagggtg

SEQ ID NO: 294263 - DNA, 25 bp, Homo sapien
agcttgacagggtgcagggcctctt

SEQ ID NO: 294264 - DNA, 25 bp, Homo sapien
gggtgcagggcctcttctggcctct

SEQ ID NO: 294265 - DNA, 25 bp, Homo sapien
agaccctgggtggacgccggaggca

SEQ ID NO: 294266 - DNA, 25 bp, Homo sapien
gctcggcttcggtggattctcccgg

SEQ ID NO: 294267 - DNA, 25 bp, Homo sapien
aagaagaggagacgccgaaccacgc

SEQ ID NO: 294268 - DNA, 25 bp, Homo sapien
aggagacgccgaaccacgccgcgga

SEQ ID NO: 294269 - DNA, 25 bp, Homo sapien
gcttcggtggattctcccgggtctg

SEQ ID NO: 294270 - DNA, 25 bp, Homo sapien
gcagcctcaggaaagctttaccaat

SEQ ID NO: 294271 - DNA, 25 bp, Homo sapien
aaagctttaccaattcaggcaccca

SEQ ID NO: 294272 - DNA, 25 bp, Homo sapien
aattcaggcacccagtcagactatt

SEQ ID NO: 294273 - DNA, 25 bp, Homo sapien
aggcacccagtcagactattttggc

SEQ ID NO: 294274 - DNA, 25 bp, Homo sapien
ccagtcagactattttggccaaaat

SEQ ID NO: 294275 - DNA, 25 bp, Homo sapien
gatacgcaggcttctggagaccctg

SEQ ID NO: 294276 - DNA, 25 bp, Homo sapien
aactaagcttttggctggtccagca

SEQ ID NO: 294277 - DNA, 25 bp, Homo sapien
ctggtccagcaagacagggcagtca

SEQ ID NO: 294278 - DNA, 25 bp, Homo sapien
agtcaggctgacaatggtgctcttg

SEQ ID NO: 294279 - DNA, 25 bp, Homo sapien
gaactttcagccagagtgcgattct

SEQ ID NO: 294280 - DNA, 25 bp, Homo sapien
gtgcgattctgaactcccgggtgaa

SEQ ID NO: 294281 - DNA, 25 bp, Homo sapien
aatcctgactgcaggctgggtcaac

SEQ ID NO: 294282 - DNA, 25 bp, Homo sapien
cgcccaatgccatcggacaaagaat

SEQ ID NO: 294283 - DNA, 25 bp, Homo sapien
tactaccagggttccaaatgtgagc

SEQ ID NO: 294284 - DNA, 25 bp, Homo sapien
aatgtgagccatctgactacgtctt

SEQ ID NO: 294285 - DNA, 25 bp, Homo sapien
tacgtcttgcacactgaaacctcag

SEQ ID NO: 294286 - DNA, 25 bp, Homo sapien
agactagccaattctgcactccaat

SEQ ID NO: 294287 - DNA, 25 bp, Homo sapien
attgagataagagaggaccatgtga

SEQ ID NO: 294288 - DNA, 25 bp, Homo sapien
ggaaaataacctgaactcttaactg

SEQ ID NO: 294289 - DNA, 25 bp, Homo sapien
acctgaactcttaactgctcttgaa

SEQ ID NO: 294290 - DNA, 25 bp, Homo sapien
ctgctcttgaaagttcactctgtct

SEQ ID NO: 294291 - DNA, 25 bp, Homo sapien
cttcactccagctctattgactgat

SEQ ID NO: 294292 - DNA, 25 bp, Homo sapien
ccagctctattgactgattacctgt

SEQ ID NO: 294293 - DNA, 25 bp, Homo sapien
actgattacctgtagcccacttgct

SEQ ID NO: 294294 - DNA, 25 bp, Homo sapien
accttttggacagattacaacaaag

SEQ ID NO: 294295 - DNA, 25 bp, Homo sapien
gaagaattctgatacctcttgtaga

SEQ ID NO: 294296 - DNA, 25 bp, Homo sapien
tcttgtagattcattttccacccca

SEQ ID NO: 294297 - DNA, 25 bp, Homo sapien
attcattttccaccccaaagattag

SEQ ID NO: 294298 - DNA, 25 bp, Homo sapien
ccacatagcctcttgattctcaatt

SEQ ID NO: 294299 - DNA, 25 bp, Homo sapien
gcctcttgattctcaattcttattg

SEQ ID NO: 294300 - DNA, 25 bp, Homo sapien
tcttattgtttactctgtcagaatg

SEQ ID NO: 294301 - DNA, 25 bp, Homo sapien
agtctttatttcacaatctattcac

SEQ ID NO: 294302 - DNA, 25 bp, Homo sapien
atctattcactgaaacttgtgggta

SEQ ID NO: 294303 - DNA, 25 bp, Homo sapien
cactgaaacttgtgggtatttgaat

SEQ ID NO: 294304 - DNA, 25 bp, Homo sapien
aatcaaggataagctgtttggagaa

SEQ ID NO: 294305 - DNA, 25 bp, Homo sapien
ggtattataaagtctgaacaaagca

SEQ ID NO: 294306 - DNA, 25 bp, Homo sapien
aaattcttagactgtacatgcttat

SEQ ID NO: 294307 - DNA, 25 bp, Homo sapien
acattggaagtttttgttacttatg

SEQ ID NO: 294308 - DNA, 25 bp, Homo sapien
ttacttatgctagtaacaatgtgtg

SEQ ID NO: 294309 - DNA, 25 bp, Homo sapien
tgtagctggcaccacgatctaattt

SEQ ID NO: 294310 - DNA, 25 bp, Homo sapien
tagaacattttcctgatcccaactt

SEQ ID NO: 294311 - DNA, 25 bp, Homo sapien
gatcccaacttctgtagctgtttaa

SEQ ID NO: 294312 - DNA, 25 bp, Homo sapien
gttgatgtgattctttggtctcctt

SEQ ID NO: 294313 - DNA, 25 bp, Homo sapien
gtgattctttggtctcctttaatct

SEQ ID NO: 294314 - DNA, 25 bp, Homo sapien
tcctttaatctggaactgttccctg

SEQ ID NO: 294315 - DNA, 25 bp, Homo sapien
atctggaactgttccctgccttttt

SEQ ID NO: 294316 - DNA, 25 bp, Homo sapien
ttttcttccttgcttgacatttgta

SEQ ID NO: 294317 - DNA, 25 bp, Homo sapien
ttttgaagcttctaggccagatatc

SEQ ID NO: 294318 - DNA, 25 bp, Homo sapien
agcttctaggccagatatcttttag

SEQ ID NO: 294319 - DNA, 25 bp, Homo sapien
taccaaattgtgtagctggcaccac

SEQ ID NO: 294320 - DNA, 25 bp, Homo sapien
atcatcaagcagcacaggagccacc

SEQ ID NO: 294321 - DNA, 25 bp, Homo sapien
ccaactattcctttccagccaatga

SEQ ID NO: 294322 - DNA, 25 bp, Homo sapien
aagacagcttaaatgggaatatcca

SEQ ID NO: 294323 - DNA, 25 bp, Homo sapien
caggccattcatgagcaaggtgagc

SEQ ID NO: 294324 - DNA, 25 bp, Homo sapien
aaggtgagcatcacagtccatctcg

SEQ ID NO: 294325 - DNA, 25 bp, Homo sapien
gcatcacagtccatctcgagagaaa

SEQ ID NO: 294326 - DNA, 25 bp, Homo sapien
agtggttgaaagctctgccagctac

SEQ ID NO: 294327 - DNA, 25 bp, Homo sapien
ggtccatctcctgaagtactacatt

SEQ ID NO: 294328 - DNA, 25 bp, Homo sapien
actacattccagcttatgtggcacc

SEQ ID NO: 294329 - DNA, 25 bp, Homo sapien
tatgtggcaccaacaagacctgatg

SEQ ID NO: 294330 - DNA, 25 bp, Homo sapien
aagacctgatgcagaatggcgtaat

SEQ ID NO: 294331 - DNA, 25 bp, Homo sapien
atgaagtcagttttattcatttaga

SEQ ID NO: 294332 - DNA, 25 bp, Homo sapien
gaattatatctattgtgtctgtgaa

SEQ ID NO: 294333 - DNA, 25 bp, Homo sapien
gtctgtgaaatgataaatcctaaat

SEQ ID NO: 294334 - DNA, 25 bp, Homo sapien
gaataattcagtttagtgagtgctt

SEQ ID NO: 294335 - DNA, 25 bp, Homo sapien
gagtgcttatgatatacttgtctgc

SEQ ID NO: 294336 - DNA, 25 bp, Homo sapien
gcttatgatatacttgtctgcagtg

SEQ ID NO: 294337 - DNA, 25 bp, Homo sapien
atacttgtctgcagtgatagagtca

SEQ ID NO: 294338 - DNA, 25 bp, Homo sapien
ttgtctgcagtgatagagtcactat

SEQ ID NO: 294339 - DNA, 25 bp, Homo sapien
gagtcactatagattatttggttat

SEQ ID NO: 294340 - DNA, 25 bp, Homo sapien
tttttgcatccctgggccatacttg

SEQ ID NO: 294341 - DNA, 25 bp, Homo sapien
atccctgggccatacttgaagaaga

SEQ ID NO: 294342 - DNA, 25 bp, Homo sapien
tgacaatattctagggtccttagat

SEQ ID NO: 294343 - DNA, 25 bp, Homo sapien
agggtccttagatgagcacacttcc

SEQ ID NO: 294344 - DNA, 25 bp, Homo sapien
gcacacttcctgtatctgcattatt

SEQ ID NO: 294345 - DNA, 25 bp, Homo sapien
ttaccaaataccatcccatcagact

SEQ ID NO: 294346 - DNA, 25 bp, Homo sapien
tgaagtcacatgctcaatttcttga

SEQ ID NO: 294347 - DNA, 25 bp, Homo sapien
ttcttgagttgattttccccgacct

SEQ ID NO: 294348 - DNA, 25 bp, Homo sapien
cgacctcatcctttgatgctaagca

SEQ ID NO: 294349 - DNA, 25 bp, Homo sapien
gaagggctctgaaattctcattcct

SEQ ID NO: 294350 - DNA, 25 bp, Homo sapien
ttctcattcctatttcttacatgaa

SEQ ID NO: 294351 - DNA, 25 bp, Homo sapien
atgctggttttggtgcagggcaaaa

SEQ ID NO: 294352 - DNA, 25 bp, Homo sapien
tggtgcagggcaaaattagtctttc

SEQ ID NO: 294353 - DNA, 25 bp, Homo sapien
acctctcctgtctttcaactaaggc

SEQ ID NO: 294354 - DNA, 25 bp, Homo sapien
acatgccagaccatcgttggtggac

SEQ ID NO: 294355 - DNA, 25 bp, Homo sapien
tggacctcgtcaccagcatgaagtg

SEQ ID NO: 294356 - DNA, 25 bp, Homo sapien
ggctcttggagttgtcgactgacta

SEQ ID NO: 294357 - DNA, 25 bp, Homo sapien
gtcgactgactagttcacaattagt

SEQ ID NO: 294358 - DNA, 25 bp, Homo sapien
gtgactcatagcatctcactcattt

SEQ ID NO: 294359 - DNA, 25 bp, Homo sapien
aattccctaatagacattctcctag

SEQ ID NO: 294360 - DNA, 25 bp, Homo sapien
agcagtctgcacttttgcatcacat

SEQ ID NO: 294361 - DNA, 25 bp, Homo sapien
gacattctcctagcgggatgagtcc

SEQ ID NO: 294362 - DNA, 25 bp, Homo sapien
cctttacagcactcgggaaatgcct

SEQ ID NO: 294363 - DNA, 25 bp, Homo sapien
gggaaatgcctgctcctctagctgt

SEQ ID NO: 294364 - DNA, 25 bp, Homo sapien
tgagcgactgtcctatcacatcaga

SEQ ID NO: 294365 - DNA, 25 bp, Homo sapien
atcacatcagacgtgccgtgagaga

SEQ ID NO: 294366 - DNA, 25 bp, Homo sapien
tacagaggctgcacatccctgagaa

SEQ ID NO: 294367 - DNA, 25 bp, Homo sapien
gcaagaagcccggatatcaggagat

SEQ ID NO: 294368 - DNA, 25 bp, Homo sapien
ggatgccgggtgttcacaccaatgg

SEQ ID NO: 294369 - DNA, 25 bp, Homo sapien
ggattctacaagacatctgagggta

SEQ ID NO: 294370 - DNA, 25 bp, Homo sapien
tgggatccatagagggttatctgcc

SEQ ID NO: 294371 - DNA, 25 bp, Homo sapien
ttatctgcctagaagagggtcagca

SEQ ID NO: 294372 - DNA, 25 bp, Homo sapien
gggtcagcagtccagactagatctt

SEQ ID NO: 294373 - DNA, 25 bp, Homo sapien
gactagatcttgagtgtctgacatc

SEQ ID NO: 294374 - DNA, 25 bp, Homo sapien
tgtctgacatcagcgtgagcgactg

SEQ ID NO: 294375 - DNA, 25 bp, Homo sapien
ggagcccagggcacatccacatcag

SEQ ID NO: 294376 - DNA, 25 bp, Homo sapien
tgaggacagggttccccccaacgct

SEQ ID NO: 294377 - DNA, 25 bp, Homo sapien
atctggcttccagtgtccagcaaca

SEQ ID NO: 294378 - DNA, 25 bp, Homo sapien
tggcttccagtgtccagcaacagac

SEQ ID NO: 294379 - DNA, 25 bp, Homo sapien
ttccagtgtccagcaacagacgttt

SEQ ID NO: 294380 - DNA, 25 bp, Homo sapien
agtgtccagcaacagacgtttccag

SEQ ID NO: 294381 - DNA, 25 bp, Homo sapien
tttccagccactttcctcgaatcat

SEQ ID NO: 294382 - DNA, 25 bp, Homo sapien
catctgttgtaccttcccatgtatg

SEQ ID NO: 294383 - DNA, 25 bp, Homo sapien
ttgtaccttcccatgtatgcagtta

SEQ ID NO: 294384 - DNA, 25 bp, Homo sapien
gtatgcagttacctgtgcctttttc

SEQ ID NO: 294385 - DNA, 25 bp, Homo sapien
tgcctttttctacaccttttgttgc

SEQ ID NO: 294386 - DNA, 25 bp, Homo sapien
gtactcttgagttatattatccatg

SEQ ID NO: 294387 - DNA, 25 bp, Homo sapien
ttatccatggtcttaatatcagaga

SEQ ID NO: 294388 - DNA, 25 bp, Homo sapien
atcagagaagtgcagttgagtcgct

SEQ ID NO: 294389 - DNA, 25 bp, Homo sapien
gaagtgcagttgagtcgctattaaa

SEQ ID NO: 294390 - DNA, 25 bp, Homo sapien
gcagttgagtcgctattaaagaata

SEQ ID NO: 294391 - DNA, 25 bp, Homo sapien
aaaaggatcaaagtagccatgctca

SEQ ID NO: 294392 - DNA, 25 bp, Homo sapien
aagtagccatgctcagtggaagggt

SEQ ID NO: 294393 - DNA, 25 bp, Homo sapien
tgctcagtggaagggtaaggaactc

SEQ ID NO: 294394 - DNA, 25 bp, Homo sapien
gagacatgtttttaaccacttggac

SEQ ID NO: 294395 - DNA, 25 bp, Homo sapien
gtttttaaccacttggacactgcca

SEQ ID NO: 294396 - DNA, 25 bp, Homo sapien
ggacactgccaaccatggaattgtt

SEQ ID NO: 294397 - DNA, 25 bp, Homo sapien
gctaaatatgttagccctccaggtt

SEQ ID NO: 294398 - DNA, 25 bp, Homo sapien
agctttaagatgttacccttccaga

SEQ ID NO: 294399 - DNA, 25 bp, Homo sapien
gatgttacccttccagaggtacaga

SEQ ID NO: 294400 - DNA, 25 bp, Homo sapien
cttccagaggtacagaagaaaccta

SEQ ID NO: 294401 - DNA, 25 bp, Homo sapien
aaggtcctttcagtggtagactcgg

SEQ ID NO: 294402 - DNA, 25 bp, Homo sapien
aacttggtggcccctttgagatgcc

SEQ ID NO: 294403 - DNA, 25 bp, Homo sapien
cctttgagatgccaggtttcttttt

SEQ ID NO: 294404 - DNA, 25 bp, Homo sapien
tcttttttatctagaaatggctgca

SEQ ID NO: 294405 - DNA, 25 bp, Homo sapien
aatggctgcaagtggaagcggataa

SEQ ID NO: 294406 - DNA, 25 bp, Homo sapien
gaagcggataatatgtaggcacttt

SEQ ID NO: 294407 - DNA, 25 bp, Homo sapien
gtaggcactttgtaaattcatattg

SEQ ID NO: 294408 - DNA, 25 bp, Homo sapien
agagctttacctgaattatctcatt

SEQ ID NO: 294409 - DNA, 25 bp, Homo sapien
accctcacaattctcaaatcgtttc

SEQ ID NO: 294410 - DNA, 25 bp, Homo sapien
attctcaaatcgtttcattatcata

SEQ ID NO: 294411 - DNA, 25 bp, Homo sapien
agataagaactgaagcgtggcaaga

SEQ ID NO: 294412 - DNA, 25 bp, Homo sapien
gaagcgtggcaagattaaggaagtt

SEQ ID NO: 294413 - DNA, 25 bp, Homo sapien
agttgctcaacttcacatagtcaga

SEQ ID NO: 294414 - DNA, 25 bp, Homo sapien
cagaacatgactctagggagtagag

SEQ ID NO: 294415 - DNA, 25 bp, Homo sapien
gggtgcaagaggtcatccaaatttc

SEQ ID NO: 294416 - DNA, 25 bp, Homo sapien
ggtcatccaaatttcttgaaatacc

SEQ ID NO: 294417 - DNA, 25 bp, Homo sapien
gagaatgaattctaacactcaagtt

SEQ ID NO: 294418 - DNA, 25 bp, Homo sapien
tgaattctaacactcaagttttggg

SEQ ID NO: 294419 - DNA, 25 bp, Homo sapien
atgcgcggcatgaaatgcatgtgac

SEQ ID NO: 294420 - DNA, 25 bp, Homo sapien
aaaccgagacattacttagatgata

SEQ ID NO: 294421 - DNA, 25 bp, Homo sapien
taaggcgcagcaactcggtgaatct

SEQ ID NO: 294422 - DNA, 25 bp, Homo sapien
agcaactcggtgaatctgtacaaac

SEQ ID NO: 294423 - DNA, 25 bp, Homo sapien
ggaacacattagtctatgggacctt

SEQ ID NO: 294424 - DNA, 25 bp, Homo sapien
tagtctatgggaccttccagttttc

SEQ ID NO: 294425 - DNA, 25 bp, Homo sapien
gttttctcatgctcctttccagcta

SEQ ID NO: 294426 - DNA, 25 bp, Homo sapien
cagctactaacctctcctaaaggga

SEQ ID NO: 294427 - DNA, 25 bp, Homo sapien
ggaacaaccactttttggatttgat

SEQ ID NO: 294428 - DNA, 25 bp, Homo sapien
tttggatttgattcccaggcctcgc

SEQ ID NO: 294429 - DNA, 25 bp, Homo sapien
caggcctcgctttcgccgggaaatt

SEQ ID NO: 294430 - DNA, 25 bp, Homo sapien
acaatgggcaatcgtgacctcctgg

SEQ ID NO: 294431 - DNA, 25 bp, Homo sapien
gggtagatactgaaactgtgacaag

SEQ ID NO: 294432 - DNA, 25 bp, Homo sapien
ggcagaaatcagttggacccaatat

SEQ ID NO: 294433 - DNA, 25 bp, Homo sapien
acccaatatggccaactggagtttc

SEQ ID NO: 294434 - DNA, 25 bp, Homo sapien
tggccaactggagtttctgcagaaa

SEQ ID NO: 294435 - DNA, 25 bp, Homo sapien
cctgaatttccacgcatgtttcgta

SEQ ID NO: 294436 - DNA, 25 bp, Homo sapien
tgtttcgtattaactgccccggaat

SEQ ID NO: 294437 - DNA, 25 bp, Homo sapien
gccccggaatttgatttgcacacag

SEQ ID NO: 294438 - DNA, 25 bp, Homo sapien
aaccagacaagctctgcttcagggt

SEQ ID NO: 294439 - DNA, 25 bp, Homo sapien
gcacacagcacccatgaggaagcat

SEQ ID NO: 294440 - DNA, 25 bp, Homo sapien
gtgggtgggaacctctcgcaacctc

SEQ ID NO: 294441 - DNA, 25 bp, Homo sapien
caagaaaaaatgacgctccttcccg

SEQ ID NO: 294442 - DNA, 25 bp, Homo sapien
cgttcacttttcacttgcactattt

SEQ ID NO: 294443 - DNA, 25 bp, Homo sapien
aacagcagctgcacacaacctcttg

SEQ ID NO: 294444 - DNA, 25 bp, Homo sapien
ctgcacacaacctcttgctgaaata

SEQ ID NO: 294445 - DNA, 25 bp, Homo sapien
aatagcccaggcaggtttgtgaatt

SEQ ID NO: 294446 - DNA, 25 bp, Homo sapien
gtttgtgaatttatgtccttttgca

SEQ ID NO: 294447 - DNA, 25 bp, Homo sapien
gtccttttgcataaatcagagagct

SEQ ID NO: 294448 - DNA, 25 bp, Homo sapien
gggccctgtcctgaattatattcaa

SEQ ID NO: 294449 - DNA, 25 bp, Homo sapien
gcatttcctttaaaatggagcgaat

SEQ ID NO: 294450 - DNA, 25 bp, Homo sapien
atggagcgaatgatcctggaaatca

SEQ ID NO: 294451 - DNA, 25 bp, Homo sapien
tattagactatctctgcatggatgt

SEQ ID NO: 294452 - DNA, 25 bp, Homo sapien
tgtggccgcttctgtgtcccaccag

SEQ ID NO: 294453 - DNA, 25 bp, Homo sapien
atgaaccccaactggactgtgaggt

SEQ ID NO: 294454 - DNA, 25 bp, Homo sapien
gactgtgaggtctgattccgaatta

SEQ ID NO: 294455 - DNA, 25 bp, Homo sapien
cgaattagagatcccggtgccctag

SEQ ID NO: 294456 - DNA, 25 bp, Homo sapien
tagagatcccggtgccctagctgtg

SEQ ID NO: 294457 - DNA, 25 bp, Homo sapien
cctagctgtgctgatttgtctggag

SEQ ID NO: 294458 - DNA, 25 bp, Homo sapien
gatttgtctggagcttctttggtaa

SEQ ID NO: 294459 - DNA, 25 bp, Homo sapien
ctggagcttctttggtaattctgga

SEQ ID NO: 294460 - DNA, 25 bp, Homo sapien
attctggaagcttttcctggcagtc

SEQ ID NO: 294461 - DNA, 25 bp, Homo sapien
gaagcttttcctggcagtcaagaga

SEQ ID NO: 294462 - DNA, 25 bp, Homo sapien
ctgccgctgaccagagcatgggaaa

SEQ ID NO: 294463 - DNA, 25 bp, Homo sapien
acgaaagagctgtgccaagggaagc

SEQ ID NO: 294464 - DNA, 25 bp, Homo sapien
ggcagtgggatgcaggtggcctcta

SEQ ID NO: 294465 - DNA, 25 bp, Homo sapien
aaggcaagtccatgggttctttcct

SEQ ID NO: 294466 - DNA, 25 bp, Homo sapien
aagtccatgggttctttcctggagc

SEQ ID NO: 294467 - DNA, 25 bp, Homo sapien
acggccttgctgacccatcttagaa

SEQ ID NO: 294468 - DNA, 25 bp, Homo sapien
tgacccatcttagaacggcaggata

SEQ ID NO: 294469 - DNA, 25 bp, Homo sapien
gaacggcaggataatcaatgtgtgt

SEQ ID NO: 294470 - DNA, 25 bp, Homo sapien
aatcaatgtgtgttgtttgaggcca

SEQ ID NO: 294471 - DNA, 25 bp, Homo sapien
tcggcagctgtgattaagaaccttg

SEQ ID NO: 294472 - DNA, 25 bp, Homo sapien
agggattcctggattacccaggtga

SEQ ID NO: 294473 - DNA, 25 bp, Homo sapien
tacccaggtgagtttaatgtaacca

SEQ ID NO: 294474 - DNA, 25 bp, Homo sapien
gttgcctctgcagactagaaaagta

SEQ ID NO: 294475 - DNA, 25 bp, Homo sapien
gaaaagtaccattctgtttcctgat

SEQ ID NO: 294476 - DNA, 25 bp, Homo sapien
ctgtttcctgatatcctgtcttaga

SEQ ID NO: 294477 - DNA, 25 bp, Homo sapien
gatatcctgtcttagagtcggtatg

SEQ ID NO: 294478 - DNA, 25 bp, Homo sapien
gagtcggtatgtggagagcaccatt

SEQ ID NO: 294479 - DNA, 25 bp, Homo sapien
ggagagcaccattaactatttgtat

SEQ ID NO: 294480 - DNA, 25 bp, Homo sapien
ttggtgctgtaatatcaagtgcttt

SEQ ID NO: 294481 - DNA, 25 bp, Homo sapien
gttctgatgtatctgcatttaccct

SEQ ID NO: 294482 - DNA, 25 bp, Homo sapien
gcatttacccttcagatgcaaataa

SEQ ID NO: 294483 - DNA, 25 bp, Homo sapien
gagaaaacccactaaaatccttcat

SEQ ID NO: 294484 - DNA, 25 bp, Homo sapien
catttaagttagttgcctctgcaga

SEQ ID NO: 294485 - DNA, 25 bp, Homo sapien
aaaacctcaagcctctggttcacat

SEQ ID NO: 294486 - DNA, 25 bp, Homo sapien
tcaagcctctggttcacatctgagt

SEQ ID NO: 294487 - DNA, 25 bp, Homo sapien
agcctctggttcacatctgagtgac

SEQ ID NO: 294488 - DNA, 25 bp, Homo sapien
tggttcacatctgagtgacctttcc

SEQ ID NO: 294489 - DNA, 25 bp, Homo sapien
gagtgacctttccaaagcaactgtt

SEQ ID NO: 294490 - DNA, 25 bp, Homo sapien
acctttccaaagcaactgttctcag

SEQ ID NO: 294491 - DNA, 25 bp, Homo sapien
ctttccaaagcaactgttctcaggg

SEQ ID NO: 294492 - DNA, 25 bp, Homo sapien
gccgggaggctgtgaccttaaccca

SEQ ID NO: 294493 - DNA, 25 bp, Homo sapien
gggaggctgtgaccttaacccactt

SEQ ID NO: 294494 - DNA, 25 bp, Homo sapien
tgaccttaacccacttctttggaca

SEQ ID NO: 294495 - DNA, 25 bp, Homo sapien
tttggacagtgccttcctggcactc

SEQ ID NO: 294496 - DNA, 25 bp, Homo sapien
gggagagcgctctgaaatccattct

SEQ ID NO: 294497 - DNA, 25 bp, Homo sapien
attcttcagccgcacgtggaaaatg

SEQ ID NO: 294498 - DNA, 25 bp, Homo sapien
gacagctgtgactcttaaagagaat

SEQ ID NO: 294499 - DNA, 25 bp, Homo sapien
aacaaagcatctcagcctgctctat

SEQ ID NO: 294500 - DNA, 25 bp, Homo sapien
gctctatgagctggatatttcgtag

SEQ ID NO: 294501 - DNA, 25 bp, Homo sapien
tttcgtaggaaagagccgatttggc

SEQ ID NO: 294502 - DNA, 25 bp, Homo sapien
aatggaattgtctcagtttgcgcct

SEQ ID NO: 294503 - DNA, 25 bp, Homo sapien
gtttgcgcctttgtttcgtttgaca

SEQ ID NO: 294504 - DNA, 25 bp, Homo sapien
ctttgtttcgtttgacagcccttca

SEQ ID NO: 294505 - DNA, 25 bp, Homo sapien
agcccttcagggagtcatcgtgatt

SEQ ID NO: 294506 - DNA, 25 bp, Homo sapien
tgattgctggagacggtgaactaac

SEQ ID NO: 294507 - DNA, 25 bp, Homo sapien
taaggactcaaccactttaattttg

SEQ ID NO: 294508 - DNA, 25 bp, Homo sapien
tagtaattatctgacaccacccact

SEQ ID NO: 294509 - DNA, 25 bp, Homo sapien
ctcaactctacccactagttattac

SEQ ID NO: 294510 - DNA, 25 bp, Homo sapien
agcgatggcaatgatcacagcgttt

SEQ ID NO: 294511 - DNA, 25 bp, Homo sapien
cacagcgtttacagaatccgggact

SEQ ID NO: 294512 - DNA, 25 bp, Homo sapien
gatagatatagcctcacacttcctt

SEQ ID NO: 294513 - DNA, 25 bp, Homo sapien
cttcctttttctatcagtgtggtac

SEQ ID NO: 294514 - DNA, 25 bp, Homo sapien
tgggctccctctatctcaagattag

SEQ ID NO: 294515 - DNA, 25 bp, Homo sapien
atctcaagattagggttcctcccag

SEQ ID NO: 294516 - DNA, 25 bp, Homo sapien
tggaggccagctttcattttcatct

SEQ ID NO: 294517 - DNA, 25 bp, Homo sapien
cattttcatcttgagcagccgtgga

SEQ ID NO: 294518 - DNA, 25 bp, Homo sapien
tactccaagtcagattcctaaaaat

SEQ ID NO: 294519 - DNA, 25 bp, Homo sapien
aaatagagctccaatgggcaattta

SEQ ID NO: 294520 - DNA, 25 bp, Homo sapien
aaagccttagaaacatggacacctg

SEQ ID NO: 294521 - DNA, 25 bp, Homo sapien
tggacacctgaaatgctggcctaca

SEQ ID NO: 294522 - DNA, 25 bp, Homo sapien
ctggcctacatgaagggtacgatga

SEQ ID NO: 294523 - DNA, 25 bp, Homo sapien
ttcccagtcctgttttagtattcat

SEQ ID NO: 294524 - DNA, 25 bp, Homo sapien
agaatagcctcttggaccctcgaag

SEQ ID NO: 294525 - DNA, 25 bp, Homo sapien
cctcgaagttctacacctttgggag

SEQ ID NO: 294526 - DNA, 25 bp, Homo sapien
taaagggattgcttctttgtgtaaa

SEQ ID NO: 294527 - DNA, 25 bp, Homo sapien
ttcattttctccatctggaagtgat

SEQ ID NO: 294528 - DNA, 25 bp, Homo sapien
gatttctgcctgcatgttggagcac

SEQ ID NO: 294529 - DNA, 25 bp, Homo sapien
tctcaagtgtgtcaatcaggtaaac

SEQ ID NO: 294530 - DNA, 25 bp, Homo sapien
caggtaaactgaggaatgcatggaa

SEQ ID NO: 294531 - DNA, 25 bp, Homo sapien
ggctccctgtcctgggtgtttgctc

SEQ ID NO: 294532 - DNA, 25 bp, Homo sapien
gtgtttgctctctgaagtggaggcc

SEQ ID NO: 294533 - DNA, 25 bp, Homo sapien
ttgctctctgaagtggaggcctgag

SEQ ID NO: 294534 - DNA, 25 bp, Homo sapien
gcctgaggaaggtagtacttccaca

SEQ ID NO: 294535 - DNA, 25 bp, Homo sapien
ttttctgggcttcttaaaatgtcca

SEQ ID NO: 294536 - DNA, 25 bp, Homo sapien
atatccctcttgagttttgcctgga

SEQ ID NO: 294537 - DNA, 25 bp, Homo sapien
ttgagttttgcctggactttccctc

SEQ ID NO: 294538 - DNA, 25 bp, Homo sapien
ggactttccctctcaagtgtgtcaa

SEQ ID NO: 294539 - DNA, 25 bp, Homo sapien
tttccctctcaagtgtgtcaatcag

SEQ ID NO: 294540 - DNA, 25 bp, Homo sapien
attcttgggcctatgttcatcagcc

SEQ ID NO: 294541 - DNA, 25 bp, Homo sapien
gcctatgttcatcagccaagtgtat

SEQ ID NO: 294542 - DNA, 25 bp, Homo sapien
atcagccaagtgtatgctcactggg

SEQ ID NO: 294543 - DNA, 25 bp, Homo sapien
gggaccacgatgggcattcagcctg

SEQ ID NO: 294544 - DNA, 25 bp, Homo sapien
gcattcagcctggtgtgtggaataa

SEQ ID NO: 294545 - DNA, 25 bp, Homo sapien
ggaataatagtgctcaccatcaccc

SEQ ID NO: 294546 - DNA, 25 bp, Homo sapien
gtggtttacaaaagactcattgctc

SEQ ID NO: 294547 - DNA, 25 bp, Homo sapien
aagactcattgctctttctgtaaga

SEQ ID NO: 294548 - DNA, 25 bp, Homo sapien
cattgctctttctgtaagatatggg

SEQ ID NO: 294549 - DNA, 25 bp, Homo sapien
aggattcaggaataaactagctaag

SEQ ID NO: 294550 - DNA, 25 bp, Homo sapien
ataaactagctaagactgtgatgga

SEQ ID NO: 294551 - DNA, 25 bp, Homo sapien
tacagacacagtctttttgaagtat

SEQ ID NO: 294552 - DNA, 25 bp, Homo sapien
atgaagggctgactatattctcaca

SEQ ID NO: 294553 - DNA, 25 bp, Homo sapien
gggctgactatattctcacagttat

SEQ ID NO: 294554 - DNA, 25 bp, Homo sapien
attttatgacaatcttttaccaaag

SEQ ID NO: 294555 - DNA, 25 bp, Homo sapien
accaaagggccaactgtattctcat

SEQ ID NO: 294556 - DNA, 25 bp, Homo sapien
aagggccaactgtattctcatgttt

SEQ ID NO: 294557 - DNA, 25 bp, Homo sapien
ggccaactgtattctcatgtttatt

SEQ ID NO: 294558 - DNA, 25 bp, Homo sapien
tgtatgacaatttcatatcagcccc

SEQ ID NO: 294559 - DNA, 25 bp, Homo sapien
ccccagagagttggcatttggattg

SEQ ID NO: 294560 - DNA, 25 bp, Homo sapien
ggattgaaatcatactgagtctcta

SEQ ID NO: 294561 - DNA, 25 bp, Homo sapien
ctgagtctctagattaatttaggga

SEQ ID NO: 294562 - DNA, 25 bp, Homo sapien
tccggagaggctgccgtcggatcct

SEQ ID NO: 294563 - DNA, 25 bp, Homo sapien
tcggatcctggctctttgcggtctg

SEQ ID NO: 294564 - DNA, 25 bp, Homo sapien
gctggtgcaggtttaagtccgtctc

SEQ ID NO: 294565 - DNA, 25 bp, Homo sapien
ggtttaagtccgtctcagacagtcc

SEQ ID NO: 294566 - DNA, 25 bp, Homo sapien
ttgggcctccgtgacacagaacttg

SEQ ID NO: 294567 - DNA, 25 bp, Homo sapien
gtgacacagaacttgcttccttttc

SEQ ID NO: 294568 - DNA, 25 bp, Homo sapien
gaacttgcttccttttcctaggtcg

SEQ ID NO: 294569 - DNA, 25 bp, Homo sapien
ccttcaggtgttgcttcttttgtga

SEQ ID NO: 294570 - DNA, 25 bp, Homo sapien
ggtgttgcttcttttgtgaaacctt

SEQ ID NO: 294571 - DNA, 25 bp, Homo sapien
tttagaaccgctctagtgaacctct

SEQ ID NO: 294572 - DNA, 25 bp, Homo sapien
cgctctagtgaacctctctttaact

SEQ ID NO: 294573 - DNA, 25 bp, Homo sapien
ggatatcagtaggtgctatactttc

SEQ ID NO: 294574 - DNA, 25 bp, Homo sapien
ggtgctatactttctgactatcagc

SEQ ID NO: 294575 - DNA, 25 bp, Homo sapien
gactatcagcgtattcgagtggaaa

SEQ ID NO: 294576 - DNA, 25 bp, Homo sapien
gtgtgtaaaaggcttaatctccagc

SEQ ID NO: 294577 - DNA, 25 bp, Homo sapien
gcttaatctccagcctttagcttat

SEQ ID NO: 294578 - DNA, 25 bp, Homo sapien
ccagcctttagcttatctttggcag

SEQ ID NO: 294579 - DNA, 25 bp, Homo sapien
gatgatatcatctaacattcaagca

SEQ ID NO: 294580 - DNA, 25 bp, Homo sapien
ttgggtttagatcctgataagcatc

SEQ ID NO: 294581 - DNA, 25 bp, Homo sapien
ttagatcctgataagcatcttggga

SEQ ID NO: 294582 - DNA, 25 bp, Homo sapien
ttgggaaaaccctggatcaaatgga

SEQ ID NO: 294583 - DNA, 25 bp, Homo sapien
cttatctcatagagctttctaagaa

SEQ ID NO: 294584 - DNA, 25 bp, Homo sapien
gccactctgcggatgaggaagctga

SEQ ID NO: 294585 - DNA, 25 bp, Homo sapien
tctgcggatgaggaagctgacgcct

SEQ ID NO: 294586 - DNA, 25 bp, Homo sapien
gaagctgacgcctgggtgcagaacc

SEQ ID NO: 294587 - DNA, 25 bp, Homo sapien
tgacgcctgggtgcagaaccccgga

SEQ ID NO: 294588 - DNA, 25 bp, Homo sapien
ggacccccggattcagagcccaggt

SEQ ID NO: 294589 - DNA, 25 bp, Homo sapien
gcttccgcacaaacttgcgctcgga

SEQ ID NO: 294590 - DNA, 25 bp, Homo sapien
acaaacttgcgctcggagcaagtcc

SEQ ID NO: 294591 - DNA, 25 bp, Homo sapien
tgagaccagaggtgtccccaccgtc

SEQ ID NO: 294592 - DNA, 25 bp, Homo sapien
cgtccccgctagcagcgctggttat

SEQ ID NO: 294593 - DNA, 25 bp, Homo sapien
cccgggatttagagcatcctcgcga

SEQ ID NO: 294594 - DNA, 25 bp, Homo sapien
ggatttagagcatcctcgcgaccac

SEQ ID NO: 294595 - DNA, 25 bp, Homo sapien
tggcagatgtcccatttcccagtta

SEQ ID NO: 294596 - DNA, 25 bp, Homo sapien
ttcccagttactttctgttgtccaa

SEQ ID NO: 294597 - DNA, 25 bp, Homo sapien
aaaagtttaactgtcctgccagcca

SEQ ID NO: 294598 - DNA, 25 bp, Homo sapien
agctgctgagcattactctgataga

SEQ ID NO: 294599 - DNA, 25 bp, Homo sapien
gatagaccatcagtccttggtaagt

SEQ ID NO: 294600 - DNA, 25 bp, Homo sapien
cttggtaagtgtcctgtgcatctgg

SEQ ID NO: 294601 - DNA, 25 bp, Homo sapien
gtgcatctgggataagcatccgttt

SEQ ID NO: 294602 - DNA, 25 bp, Homo sapien
aagcatccgtttgttttcagctgcg

SEQ ID NO: 294603 - DNA, 25 bp, Homo sapien
tcagctgcgctttctgtgacttgct

SEQ ID NO: 294604 - DNA, 25 bp, Homo sapien
gacttgctctgcgtgagtcctcggt

SEQ ID NO: 294605 - DNA, 25 bp, Homo sapien
agtcctcggtccacgtgggccgttg

SEQ ID NO: 294606 - DNA, 25 bp, Homo sapien
gagccaggagaatagaagcgtccaa

SEQ ID NO: 294607 - DNA, 25 bp, Homo sapien
atagaagcgtccaagtcagtgcctt

SEQ ID NO: 294608 - DNA, 25 bp, Homo sapien
aagcgtccaagtcagtgccttcaga

SEQ ID NO: 294609 - DNA, 25 bp, Homo sapien
caagtcagtgccttcagagatccag

SEQ ID NO: 294610 - DNA, 25 bp, Homo sapien
agagatccagctgacttcaagaggg

SEQ ID NO: 294611 - DNA, 25 bp, Homo sapien
tttgcagtgactccacccgctatgt

SEQ ID NO: 294612 - DNA, 25 bp, Homo sapien
tgactccacccgctatgtgctggga

SEQ ID NO: 294613 - DNA, 25 bp, Homo sapien
cacccgctatgtgctgggaggcatt

SEQ ID NO: 294614 - DNA, 25 bp, Homo sapien
tgactccaaagcacacagcaatttc

SEQ ID NO: 294615 - DNA, 25 bp, Homo sapien
agcacacagcaatttcggcttggcc

SEQ ID NO: 294616 - DNA, 25 bp, Homo sapien
acacagcaatttcggcttggcccac

SEQ ID NO: 294617 - DNA, 25 bp, Homo sapien
ggaacaacttgtcaggtcacacaca

SEQ ID NO: 294618 - DNA, 25 bp, Homo sapien
aacttgtcaggtcacacacacatgc

SEQ ID NO: 294619 - DNA, 25 bp, Homo sapien
acacatgcaagcacaagcggcacac

SEQ ID NO: 294620 - DNA, 25 bp, Homo sapien
tgcacacacgcagactcatacatat

SEQ ID NO: 294621 - DNA, 25 bp, Homo sapien
cacgcagactcatacatattgttga

SEQ ID NO: 294622 - DNA, 25 bp, Homo sapien
tctgccaagcaattgtctcttatat

SEQ ID NO: 294623 - DNA, 25 bp, Homo sapien
atagattaattggtgatttcgtaca

SEQ ID NO: 294624 - DNA, 25 bp, Homo sapien
tggtgatttcgtacaataatttggg

SEQ ID NO: 294625 - DNA, 25 bp, Homo sapien
tgggagaaattaacattgcattttt

SEQ ID NO: 294626 - DNA, 25 bp, Homo sapien
gctagtcttagccttaaaatctttc

SEQ ID NO: 294627 - DNA, 25 bp, Homo sapien
aatctttcatacaatcatttggaac

SEQ ID NO: 294628 - DNA, 25 bp, Homo sapien
gaatattagaaactgttacagcctg

SEQ ID NO: 294629 - DNA, 25 bp, Homo sapien
tgttacagcctgcagttaccataat

SEQ ID NO: 294630 - DNA, 25 bp, Homo sapien
tacagcctgcagttaccataatttt

SEQ ID NO: 294631 - DNA, 25 bp, Homo sapien
agcctgcagttaccataattttcca

SEQ ID NO: 294632 - DNA, 25 bp, Homo sapien
cataattttccatgtttgtggaatt

SEQ ID NO: 294633 - DNA, 25 bp, Homo sapien
attgatattgaaatagcagggctaa

SEQ ID NO: 294634 - DNA, 25 bp, Homo sapien
agggctaaggaattactggcaagtt

SEQ ID NO: 294635 - DNA, 25 bp, Homo sapien
attactggcaagttttagcctgtgg

SEQ ID NO: 294636 - DNA, 25 bp, Homo sapien
gcaagttttagcctgtgggtaatac

SEQ ID NO: 294637 - DNA, 25 bp, Homo sapien
tagcctgtgggtaataccttagggt

SEQ ID NO: 294638 - DNA, 25 bp, Homo sapien
acaaaattatcagggatggctcttt

SEQ ID NO: 294639 - DNA, 25 bp, Homo sapien
ttgctttttgaattgaccagatatt

SEQ ID NO: 294640 - DNA, 25 bp, Homo sapien
ttaactaaatgtactgggtttggca

SEQ ID NO: 294641 - DNA, 25 bp, Homo sapien
tgggtttggcattttagacacactg

SEQ ID NO: 294642 - DNA, 25 bp, Homo sapien
gacacactgccttagattcttgtag

SEQ ID NO: 294643 - DNA, 25 bp, Homo sapien
gattcttgtagtgcatgatgacttt

SEQ ID NO: 294644 - DNA, 25 bp, Homo sapien
gcagggtaacatttgatgcagccat

SEQ ID NO: 294645 - DNA, 25 bp, Homo sapien
tttgatgcagccatgataacaggaa

SEQ ID NO: 294646 - DNA, 25 bp, Homo sapien
atagaagtatttctggctaagagaa

SEQ ID NO: 294647 - DNA, 25 bp, Homo sapien
agagaatactcttgacttgtaggga

SEQ ID NO: 294648 - DNA, 25 bp, Homo sapien
actcttgacttgtagggaggctccc

SEQ ID NO: 294649 - DNA, 25 bp, Homo sapien
gggaggctccctcggaataaatgta

SEQ ID NO: 294650 - DNA, 25 bp, Homo sapien
gagggaatttgctgggctcttttcc

SEQ ID NO: 294651 - DNA, 25 bp, Homo sapien
caatgttgctgactgtatctgtgga

SEQ ID NO: 294652 - DNA, 25 bp, Homo sapien
gactgtatctgtggagcttgttgta

SEQ ID NO: 294653 - DNA, 25 bp, Homo sapien
tatctgtggagcttgttgtacaacc

SEQ ID NO: 294654 - DNA, 25 bp, Homo sapien
gtggagcttgttgtacaacctttac

SEQ ID NO: 294655 - DNA, 25 bp, Homo sapien
tacaacctttacataaccaggtttg

SEQ ID NO: 294656 - DNA, 25 bp, Homo sapien
cataaccaggtttgtaaaacagttg

SEQ ID NO: 294657 - DNA, 25 bp, Homo sapien
agtgaactgttctttgaaattttat

SEQ ID NO: 294658 - DNA, 25 bp, Homo sapien
ttccttgcaatttctaagccaagtg

SEQ ID NO: 294659 - DNA, 25 bp, Homo sapien
aatttctaagccaagtgtcttctgc

SEQ ID NO: 294660 - DNA, 25 bp, Homo sapien
agccaagtgtcttctgcttctgtaa

SEQ ID NO: 294661 - DNA, 25 bp, Homo sapien
atttgggagccattgccttgagcgt

SEQ ID NO: 294662 - DNA, 25 bp, Homo sapien
tgccttgagcgttatttcccagatg

SEQ ID NO: 294663 - DNA, 25 bp, Homo sapien
ttcccagatggttttctaatgtcac

SEQ ID NO: 294664 - DNA, 25 bp, Homo sapien
actgaagaaaagacccatgcacaca

SEQ ID NO: 294665 - DNA, 25 bp, Homo sapien
aaaacggactcagcgattctggcaa

SEQ ID NO: 294666 - DNA, 25 bp, Homo sapien
gcgattctggcaagcggtacttact

SEQ ID NO: 294667 - DNA, 25 bp, Homo sapien
ggtacttactctgagatcacccgtt

SEQ ID NO: 294668 - DNA, 25 bp, Homo sapien
gagatcacccgtttgctaaggaaaa

SEQ ID NO: 294669 - DNA, 25 bp, Homo sapien
gacttcctcggaataggctgtggct

SEQ ID NO: 294670 - DNA, 25 bp, Homo sapien
gtggctcttcacaaggtgtcttcta

SEQ ID NO: 294671 - DNA, 25 bp, Homo sapien
gtcttctatgctttatttgggagcc

SEQ ID NO: 294672 - DNA, 25 bp, Homo sapien
agcctcgagttccttagcagccaaa

SEQ ID NO: 294673 - DNA, 25 bp, Homo sapien
agttccttagcagccaaagcttcgc

SEQ ID NO: 294674 - DNA, 25 bp, Homo sapien
aggcggcggcctctttgctgcctca

SEQ ID NO: 294675 - DNA, 25 bp, Homo sapien
ttgctgcctcaggtgccatctctta

SEQ ID NO: 294676 - DNA, 25 bp, Homo sapien
aggtgccatctcttacgccgaggtc

SEQ ID NO: 294677 - DNA, 25 bp, Homo sapien
aatggcccagcctgcggattccgag

SEQ ID NO: 294678 - DNA, 25 bp, Homo sapien
ctcttacgccgaggtcctgaagcaa

SEQ ID NO: 294679 - DNA, 25 bp, Homo sapien
tcgccccttgggagaggtttctcga

SEQ ID NO: 294680 - DNA, 25 bp, Homo sapien
agacggcgaagggtgctctggtcct

SEQ ID NO: 294681 - DNA, 25 bp, Homo sapien
tgcggattccgagtccggtctgagc

SEQ ID NO: 294682 - DNA, 25 bp, Homo sapien
ccggtctgagcctgctgtgtaaaat

SEQ ID NO: 294683 - DNA, 25 bp, Homo sapien
attttccttttgtctgggcagtagt

SEQ ID NO: 294684 - DNA, 25 bp, Homo sapien
tttccttttgtctgggcagtagtga

SEQ ID NO: 294685 - DNA, 25 bp, Homo sapien
ttccttttgtctgggcagtagtgaa

SEQ ID NO: 294686 - DNA, 25 bp, Homo sapien
ttgtctgggcagtagtgaaaataac

SEQ ID NO: 294687 - DNA, 25 bp, Homo sapien
gtctgggcagtagtgaaaataacta

SEQ ID NO: 294688 - DNA, 25 bp, Homo sapien
gaaaataactactcacaacattcac

SEQ ID NO: 294689 - DNA, 25 bp, Homo sapien
cacaacattcactatgtttgcaagg

SEQ ID NO: 294690 - DNA, 25 bp, Homo sapien
caacattcactatgtttgcaaggaa

SEQ ID NO: 294691 - DNA, 25 bp, Homo sapien
acattcactatgtttgcaaggaatt

SEQ ID NO: 294692 - DNA, 25 bp, Homo sapien
ttcactatgtttgcaaggaattaac

SEQ ID NO: 294693 - DNA, 25 bp, Homo sapien
ctatgtttgcaaggaattaacacaa

SEQ ID NO: 294694 - DNA, 25 bp, Homo sapien
aagagtttgcctcctgcatgtgaat

SEQ ID NO: 294695 - DNA, 25 bp, Homo sapien
tttgcctcctgcatgtgaattgcta

SEQ ID NO: 294696 - DNA, 25 bp, Homo sapien
ctccgtggaggataactgacaatat

SEQ ID NO: 294697 - DNA, 25 bp, Homo sapien
attgcaaatgcgcattcctggtgcc

SEQ ID NO: 294698 - DNA, 25 bp, Homo sapien
gcaaatgcgcattcctggtgccctg

SEQ ID NO: 294699 - DNA, 25 bp, Homo sapien
tggtgccctgccaattccacattgt

SEQ ID NO: 294700 - DNA, 25 bp, Homo sapien
ccacattgtctgtaatggaaaagga

SEQ ID NO: 294701 - DNA, 25 bp, Homo sapien
ataacctaaatgtctgccaataggg

SEQ ID NO: 294702 - DNA, 25 bp, Homo sapien
tgtctgccaatagggaaccacttaa

SEQ ID NO: 294703 - DNA, 25 bp, Homo sapien
gtcaaaactcgttgagatatacatt

SEQ ID NO: 294704 - DNA, 25 bp, Homo sapien
attaaaatcaatgcatttttcccca

SEQ ID NO: 294705 - DNA, 25 bp, Homo sapien
attgcccctagacttctgggacagt

SEQ ID NO: 294706 - DNA, 25 bp, Homo sapien
ctagacttctgggacagtgagactg

SEQ ID NO: 294707 - DNA, 25 bp, Homo sapien
ctgtgaggaaagctgaaatgatact

SEQ ID NO: 294708 - DNA, 25 bp, Homo sapien
ggtacacataccttatggcaacatt

SEQ ID NO: 294709 - DNA, 25 bp, Homo sapien
atggcaacattcctagcactctaaa

SEQ ID NO: 294710 - DNA, 25 bp, Homo sapien
agcactctaaattctagatttgtat

SEQ ID NO: 294711 - DNA, 25 bp, Homo sapien
ggtgcttctcaaaggattgccgtag

SEQ ID NO: 294712 - DNA, 25 bp, Homo sapien
gtatagtttctgtcaatatcttttg

SEQ ID NO: 294713 - DNA, 25 bp, Homo sapien
gtaagcttaatcaatacagggcatg

SEQ ID NO: 294714 - DNA, 25 bp, Homo sapien
aggtgccaccacagcactagtgatg

SEQ ID NO: 294715 - DNA, 25 bp, Homo sapien
agtgatggagagtcattgcccctag

SEQ ID NO: 294716 - DNA, 25 bp, Homo sapien
gctgcagttcgcctcgcaggaggtg

SEQ ID NO: 294717 - DNA, 25 bp, Homo sapien
cgcaggaggtggtgccgtacgggca

SEQ ID NO: 294718 - DNA, 25 bp, Homo sapien
cgcctcgactacttctcagaagaga

SEQ ID NO: 294719 - DNA, 25 bp, Homo sapien
ctcagaagagaggagcgcccgggac

SEQ ID NO: 294720 - DNA, 25 bp, Homo sapien
cggtgctggacctcgtgcactcggc

SEQ ID NO: 294721 - DNA, 25 bp, Homo sapien
tggacctcgtgcactcggccgaacg

SEQ ID NO: 294722 - DNA, 25 bp, Homo sapien
caacgccgacgacatggtggagacc

SEQ ID NO: 294723 - DNA, 25 bp, Homo sapien
acgacatggtggagaccgtgctcat

SEQ ID NO: 294724 - DNA, 25 bp, Homo sapien
ggtggagaccgtgctcatgaacttc

SEQ ID NO: 294725 - DNA, 25 bp, Homo sapien
ggagaccgtgctcatgaacttcctg

SEQ ID NO: 294726 - DNA, 25 bp, Homo sapien
accgtgctcatgaacttcctgcggg

SEQ ID NO: 294727 - DNA, 25 bp, Homo sapien
gaaaaagcattgcaaaactttctgc

SEQ ID NO: 294728 - DNA, 25 bp, Homo sapien
ctttctgctctgttagctgatgcgt

SEQ ID NO: 294729 - DNA, 25 bp, Homo sapien
ctgctctgttagctgatgcgtgtag

SEQ ID NO: 294730 - DNA, 25 bp, Homo sapien
gctctgttagctgatgcgtgtagcc

SEQ ID NO: 294731 - DNA, 25 bp, Homo sapien
tcacgttccccgcttgcttgagata

SEQ ID NO: 294732 - DNA, 25 bp, Homo sapien
cacgttccccgcttgcttgagatat

SEQ ID NO: 294733 - DNA, 25 bp, Homo sapien
acgttccccgcttgcttgagatatc

SEQ ID NO: 294734 - DNA, 25 bp, Homo sapien
cgttccccgcttgcttgagatatca

SEQ ID NO: 294735 - DNA, 25 bp, Homo sapien
gttccccgcttgcttgagatatcat

SEQ ID NO: 294736 - DNA, 25 bp, Homo sapien
ttccccgcttgcttgagatatcatg

SEQ ID NO: 294737 - DNA, 25 bp, Homo sapien
tccccgcttgcttgagatatcatga

SEQ ID NO: 294738 - DNA, 25 bp, Homo sapien
taaattggctgtatttccttgccgg

SEQ ID NO: 294739 - DNA, 25 bp, Homo sapien
gctgtatttccttgccggttttaat

SEQ ID NO: 294740 - DNA, 25 bp, Homo sapien
tttcctctcaagtatgctagaaaat

SEQ ID NO: 294741 - DNA, 25 bp, Homo sapien
ctgcaataagaagtgggttagcatt

SEQ ID NO: 294742 - DNA, 25 bp, Homo sapien
gggttagcattcaagtaaggtcaat

SEQ ID NO: 294743 - DNA, 25 bp, Homo sapien
gtaaggtcaataccccaaatgagaa

SEQ ID NO: 294744 - DNA, 25 bp, Homo sapien
ataccccaaatgagaaactcttcag

SEQ ID NO: 294745 - DNA, 25 bp, Homo sapien
gaaactcttcagttagaacacatta

SEQ ID NO: 294746 - DNA, 25 bp, Homo sapien
gaacacattagtggttgtaacacag

SEQ ID NO: 294747 - DNA, 25 bp, Homo sapien
aatgtgagcatttctaaacttggta

SEQ ID NO: 294748 - DNA, 25 bp, Homo sapien
gagcatttctaaacttggtaccaaa

SEQ ID NO: 294749 - DNA, 25 bp, Homo sapien
gtttatgggtaggatagcccgataa

SEQ ID NO: 294750 - DNA, 25 bp, Homo sapien
ggatagcccgataaagatgtcactt

SEQ ID NO: 294751 - DNA, 25 bp, Homo sapien
tagcccgataaagatgtcacttttc

SEQ ID NO: 294752 - DNA, 25 bp, Homo sapien
atttgagaagcctataaagtttgtt

SEQ ID NO: 294753 - DNA, 25 bp, Homo sapien
ggtatgtaactataacaaggacagt

SEQ ID NO: 294754 - DNA, 25 bp, Homo sapien
aaaaacgagacttatcccaccagct

SEQ ID NO: 294755 - DNA, 25 bp, Homo sapien
aaacgagacttatcccaccagctat

SEQ ID NO: 294756 - DNA, 25 bp, Homo sapien
agacttatcccaccagctattaaaa

SEQ ID NO: 294757 - DNA, 25 bp, Homo sapien
actactatagttaaaattttgcaat

SEQ ID NO: 294758 - DNA, 25 bp, Homo sapien
attagagaacccagaaacaggctag

SEQ ID NO: 294759 - DNA, 25 bp, Homo sapien
aacccagaaacaggctaggtgtggt

SEQ ID NO: 294760 - DNA, 25 bp, Homo sapien
caaatctcatttgatgcagacatct

SEQ ID NO: 294761 - DNA, 25 bp, Homo sapien
atctcatttgatgcagacatctgaa

SEQ ID NO: 294762 - DNA, 25 bp, Homo sapien
gatgcagacatctgaaaatactcag

SEQ ID NO: 294763 - DNA, 25 bp, Homo sapien
tacccaccaaagctaatagaaaaca

SEQ ID NO: 294764 - DNA, 25 bp, Homo sapien
tggaaccttccaggacaagaagtaa

SEQ ID NO: 294765 - DNA, 25 bp, Homo sapien
aagaacaacccagaggagtaatcaa

SEQ ID NO: 294766 - DNA, 25 bp, Homo sapien
caacccagaggagtaatcaaagtga

SEQ ID NO: 294767 - DNA, 25 bp, Homo sapien
aaagtgagaagccagtgccgcctcc

SEQ ID NO: 294768 - DNA, 25 bp, Homo sapien
agtgccgcctccaggtactggatga

SEQ ID NO: 294769 - DNA, 25 bp, Homo sapien
gtgccgcctccaggtactggatgat

SEQ ID NO: 294770 - DNA, 25 bp, Homo sapien
atgcatggtgaatatttgatgtttt

SEQ ID NO: 294771 - DNA, 25 bp, Homo sapien
gagtttgaattgaagtggtcctgaa

SEQ ID NO: 294772 - DNA, 25 bp, Homo sapien
tggtcctgaatttgagtgctgcata

SEQ ID NO: 294773 - DNA, 25 bp, Homo sapien
gagtgctgcatatgctacttttgag

SEQ ID NO: 294774 - DNA, 25 bp, Homo sapien
tgctgcatatgctacttttgagata

SEQ ID NO: 294775 - DNA, 25 bp, Homo sapien
tatgctacttttgagatatgtgatc

SEQ ID NO: 294776 - DNA, 25 bp, Homo sapien
cttttgagatatgtgatcttgagca

SEQ ID NO: 294777 - DNA, 25 bp, Homo sapien
gagcaagttgcttaatcacattaag

SEQ ID NO: 294778 - DNA, 25 bp, Homo sapien
atcacattaagcctcaattctctca

SEQ ID NO: 294779 - DNA, 25 bp, Homo sapien
aatagctactttacagtgttgagaa

SEQ ID NO: 294780 - DNA, 25 bp, Homo sapien
gtctacataaattgtgcctattgtt

SEQ ID NO: 294781 - DNA, 25 bp, Homo sapien
ataaattgtgcctattgttattact

SEQ ID NO: 294782 - DNA, 25 bp, Homo sapien
cattccacttctttagaaggttcta

SEQ ID NO: 294783 - DNA, 25 bp, Homo sapien
ttgtgcctaaagaatatagtccctt

SEQ ID NO: 294784 - DNA, 25 bp, Homo sapien
gaattgttttgaaacctaccacagg

SEQ ID NO: 294785 - DNA, 25 bp, Homo sapien
tgaaacctaccacaggtatttctac

SEQ ID NO: 294786 - DNA, 25 bp, Homo sapien
acaggtatttctacacaggaagatt

SEQ ID NO: 294787 - DNA, 25 bp, Homo sapien
ttgtcttcttaactcttgagttttg

SEQ ID NO: 294788 - DNA, 25 bp, Homo sapien
ttcatgaacttcacatcagaagcca

SEQ ID NO: 294789 - DNA, 25 bp, Homo sapien
aagccaagcccagaaaatatgggtt

SEQ ID NO: 294790 - DNA, 25 bp, Homo sapien
atatgggtttaaggtttgcctatat

SEQ ID NO: 294791 - DNA, 25 bp, Homo sapien
aaggtttgcctatatgtccaataca

SEQ ID NO: 294792 - DNA, 25 bp, Homo sapien
ttgcctatatgtccaatacaagaga

SEQ ID NO: 294793 - DNA, 25 bp, Homo sapien
aaaaatccataaaattgcacagaag

SEQ ID NO: 294794 - DNA, 25 bp, Homo sapien
atacacaatatggacgatggagaaa

SEQ ID NO: 294795 - DNA, 25 bp, Homo sapien
gaaaaacagttacatttctttatgg

SEQ ID NO: 294796 - DNA, 25 bp, Homo sapien
ggatcaagaagtttgtgtacacata

SEQ ID NO: 294797 - DNA, 25 bp, Homo sapien
tgtgtacacataatctcattttgag

SEQ ID NO: 294798 - DNA, 25 bp, Homo sapien
ttgtctttcagaagtgaatcaaaat

SEQ ID NO: 294799 - DNA, 25 bp, Homo sapien
atatttcaaaatgctgtcttatgaa

SEQ ID NO: 294800 - DNA, 25 bp, Homo sapien
gaaactacaatattctcacagatta

SEQ ID NO: 294801 - DNA, 25 bp, Homo sapien
atattttaggttttgcagtgtcttt

SEQ ID NO: 294802 - DNA, 25 bp, Homo sapien
ggttttgcagtgtcttttgcaacta

SEQ ID NO: 294803 - DNA, 25 bp, Homo sapien
ttttgcagtgtcttttgcaactact

SEQ ID NO: 294804 - DNA, 25 bp, Homo sapien
tgcagacttccaaagggtcagctct

SEQ ID NO: 294805 - DNA, 25 bp, Homo sapien
aaagggtcagctctgagactgccct

SEQ ID NO: 294806 - DNA, 25 bp, Homo sapien
tgccctccaggtgggcagttgatta

SEQ ID NO: 294807 - DNA, 25 bp, Homo sapien
tatttccaccagtgttttccagagc

SEQ ID NO: 294808 - DNA, 25 bp, Homo sapien
caccagtgttttccagagccttaaa

SEQ ID NO: 294809 - DNA, 25 bp, Homo sapien
agtgttttccagagccttaaactgt

SEQ ID NO: 294810 - DNA, 25 bp, Homo sapien
gtgacaactacctcagttggcagga

SEQ ID NO: 294811 - DNA, 25 bp, Homo sapien
aaatgagcagtatttgggcagatgc

SEQ ID NO: 294812 - DNA, 25 bp, Homo sapien
ggcagatgctatgggttacagttga

SEQ ID NO: 294813 - DNA, 25 bp, Homo sapien
tatacccttgtgaattatgtacatg

SEQ ID NO: 294814 - DNA, 25 bp, Homo sapien
catggtaaaatgttctctctctaca

SEQ ID NO: 294815 - DNA, 25 bp, Homo sapien
ctcgcgtgaggcagcggctaatcga

SEQ ID NO: 294816 - DNA, 25 bp, Homo sapien
atcgtgcgcaacaaggttctcacct

SEQ ID NO: 294817 - DNA, 25 bp, Homo sapien
tgttgccgcgcgagaaacagctccg

SEQ ID NO: 294818 - DNA, 25 bp, Homo sapien
acagctccgggagcactgcaagcgg

SEQ ID NO: 294819 - DNA, 25 bp, Homo sapien
tgacgccctgcgtgccaccaagaag

SEQ ID NO: 294820 - DNA, 25 bp, Homo sapien
cctgcgtgccaccaagaagagccag

SEQ ID NO: 294821 - DNA, 25 bp, Homo sapien
gtgggtggcactagccaagcaccaa

SEQ ID NO: 294822 - DNA, 25 bp, Homo sapien
ggcattgaagtccattcattacctt

SEQ ID NO: 294823 - DNA, 25 bp, Homo sapien
gaagtccattcattaccttgaagac

SEQ ID NO: 294824 - DNA, 25 bp, Homo sapien
attaccttgaagacgccttctgcga

SEQ ID NO: 294825 - DNA, 25 bp, Homo sapien
cttgaagacgccttctgcgagatga

SEQ ID NO: 294826 - DNA, 25 bp, Homo sapien
ctgttccattccttaattgtctggg

SEQ ID NO: 294827 - DNA, 25 bp, Homo sapien
aaggagggtcatgtcatatgtctgg

SEQ ID NO: 294828 - DNA, 25 bp, Homo sapien
ggttcagcaaattgtacccacatac

SEQ ID NO: 294829 - DNA, 25 bp, Homo sapien
gcaaattgtacccacataccaggca

SEQ ID NO: 294830 - DNA, 25 bp, Homo sapien
tgtacccacataccaggcacagaaa

SEQ ID NO: 294831 - DNA, 25 bp, Homo sapien
aacatacaaggaaggcacccccgct

SEQ ID NO: 294832 - DNA, 25 bp, Homo sapien
acccccgctctgtgggcgagacaaa

SEQ ID NO: 294833 - DNA, 25 bp, Homo sapien
ggcgagacaaagcagcaatcctctt

SEQ ID NO: 294834 - DNA, 25 bp, Homo sapien
aaagcagcaatcctcttcccacatg

SEQ ID NO: 294835 - DNA, 25 bp, Homo sapien
cacatgccaacccatctttttcttt

SEQ ID NO: 294836 - DNA, 25 bp, Homo sapien
ttgcttgcttcctccaccagtctga

SEQ ID NO: 294837 - DNA, 25 bp, Homo sapien
ctggccgcctgcagagactggcttc

SEQ ID NO: 294838 - DNA, 25 bp, Homo sapien
agagactggcttctacatactgggt

SEQ ID NO: 294839 - DNA, 25 bp, Homo sapien
gagactggcttctacatactgggtc

SEQ ID NO: 294840 - DNA, 25 bp, Homo sapien
gactggcttctacatactgggtcag

SEQ ID NO: 294841 - DNA, 25 bp, Homo sapien
catactgggtcaggttgagggaact

SEQ ID NO: 294842 - DNA, 25 bp, Homo sapien
ggaactgggccgtagctgctggagt

SEQ ID NO: 294843 - DNA, 25 bp, Homo sapien
ggcgtcgggcagtctcttggatgga

SEQ ID NO: 294844 - DNA, 25 bp, Homo sapien
cgggcagtctcttggatggagcgtc

SEQ ID NO: 294845 - DNA, 25 bp, Homo sapien
ttggatggagcgtcgcaatgtccgg

SEQ ID NO: 294846 - DNA, 25 bp, Homo sapien
cacggctctaggctgggactgtccc

SEQ ID NO: 294847 - DNA, 25 bp, Homo sapien
tgaccgccccaaaatatccgacaca

SEQ ID NO: 294848 - DNA, 25 bp, Homo sapien
gaatacctacaaggcattcctagaa

SEQ ID NO: 294849 - DNA, 25 bp, Homo sapien
ggcattcctagaattctcaatgtaa

SEQ ID NO: 294850 - DNA, 25 bp, Homo sapien
atgtaagtcattttttgccagcaaa

SEQ ID NO: 294851 - DNA, 25 bp, Homo sapien
ggatggcatacgtagttcattccaa

SEQ ID NO: 294852 - DNA, 25 bp, Homo sapien
ttcattccaagacctcaactgtgtg

SEQ ID NO: 294853 - DNA, 25 bp, Homo sapien
gacctcaactgtgtgacagacgcaa

SEQ ID NO: 294854 - DNA, 25 bp, Homo sapien
tgacagacgcaagggcagtagagtt

SEQ ID NO: 294855 - DNA, 25 bp, Homo sapien
gtaggagcatacgtttttgtcttta

SEQ ID NO: 294856 - DNA, 25 bp, Homo sapien
gtctttaattccctgcagacccctt

SEQ ID NO: 294857 - DNA, 25 bp, Homo sapien
ccttccccaatgatcatcagcaata

SEQ ID NO: 294858 - DNA, 25 bp, Homo sapien
atcagcaatacatccacccataaat

SEQ ID NO: 294859 - DNA, 25 bp, Homo sapien
gattctctgaatgtatagtagtgct

SEQ ID NO: 294860 - DNA, 25 bp, Homo sapien
taccatatgggattttaactgtttg

SEQ ID NO: 294861 - DNA, 25 bp, Homo sapien
ccatatgggattttaactgtttgtc

SEQ ID NO: 294862 - DNA, 25 bp, Homo sapien
atatgggattttaactgtttgtctt

SEQ ID NO: 294863 - DNA, 25 bp, Homo sapien
ctagacaataagctccttgaagact

SEQ ID NO: 294864 - DNA, 25 bp, Homo sapien
gacaataagctccttgaagactgaa

SEQ ID NO: 294865 - DNA, 25 bp, Homo sapien
aataagctccttgaagactgaattt

SEQ ID NO: 294866 - DNA, 25 bp, Homo sapien
ctctgaatgtatagtagtgcttctt

SEQ ID NO: 294867 - DNA, 25 bp, Homo sapien
gaatgtatagtagtgcttctttagc

SEQ ID NO: 294868 - DNA, 25 bp, Homo sapien
gtatagtagtgcttctttagctaag

SEQ ID NO: 294869 - DNA, 25 bp, Homo sapien
atagtagtgcttctttagctaagaa

SEQ ID NO: 294870 - DNA, 25 bp, Homo sapien
caatggatgcgctttggcagctgag

SEQ ID NO: 294871 - DNA, 25 bp, Homo sapien
atgcgctttggcagctgagtagtcc

SEQ ID NO: 294872 - DNA, 25 bp, Homo sapien
gctttggcagctgagtagtccgaga

SEQ ID NO: 294873 - DNA, 25 bp, Homo sapien
gcagctgagtagtccgagagccaga

SEQ ID NO: 294874 - DNA, 25 bp, Homo sapien
taagaacgctgtagcaggcctaggt

SEQ ID NO: 294875 - DNA, 25 bp, Homo sapien
gtagcaggcctaggtgaggaaattt

SEQ ID NO: 294876 - DNA, 25 bp, Homo sapien
ggtcttggagagttggacagtgtca

SEQ ID NO: 294877 - DNA, 25 bp, Homo sapien
tgcgggtcaagacgtctgcgtttaa

SEQ ID NO: 294878 - DNA, 25 bp, Homo sapien
agacgtctgcgtttaattcgggact

SEQ ID NO: 294879 - DNA, 25 bp, Homo sapien
gtctgcgtttaattcgggactgaag

SEQ ID NO: 294880 - DNA, 25 bp, Homo sapien
tttaattcgggactgaaggttagca

SEQ ID NO: 294881 - DNA, 25 bp, Homo sapien
gttaccattaatagtgttccagtga

SEQ ID NO: 294882 - DNA, 25 bp, Homo sapien
agtgttccagtgactgcttggaaac

SEQ ID NO: 294883 - DNA, 25 bp, Homo sapien
tttgctaatattctttatggtggtt

SEQ ID NO: 294884 - DNA, 25 bp, Homo sapien
tatggtggtttttacagtgtcaatc

SEQ ID NO: 294885 - DNA, 25 bp, Homo sapien
gtgtcaatcacctagacaatctgga

SEQ ID NO: 294886 - DNA, 25 bp, Homo sapien
caatctggagacttgttttctttta

SEQ ID NO: 294887 - DNA, 25 bp, Homo sapien
tcagtgtatactacagtgcaacaaa

SEQ ID NO: 294888 - DNA, 25 bp, Homo sapien
attacaccaattccaatttatcttt

SEQ ID NO: 294889 - DNA, 25 bp, Homo sapien
tatctttgctttgtgattcagaagt

SEQ ID NO: 294890 - DNA, 25 bp, Homo sapien
gtgattcagaagtgcctcagggcat

SEQ ID NO: 294891 - DNA, 25 bp, Homo sapien
gtgcctcagggcattatattgactt

SEQ ID NO: 294892 - DNA, 25 bp, Homo sapien
ggctccgaggctaggcgggcgctcg

SEQ ID NO: 294893 - DNA, 25 bp, Homo sapien
ttggagccgagggtctgggcaaacc

SEQ ID NO: 294894 - DNA, 25 bp, Homo sapien
tgcgggagcggccagggtgggaaaa

SEQ ID NO: 294895 - DNA, 25 bp, Homo sapien
tgtctgggtccccaccttagtctac

SEQ ID NO: 294896 - DNA, 25 bp, Homo sapien
tgggtccccaccttagtctacggtg

SEQ ID NO: 294897 - DNA, 25 bp, Homo sapien
tagtctacggtgtcgccttttctaa

SEQ ID NO: 294898 - DNA, 25 bp, Homo sapien
tacggtgtcgccttttctaactgcg

SEQ ID NO: 294899 - DNA, 25 bp, Homo sapien
gtgtcgccttttctaactgcgagtg

SEQ ID NO: 294900 - DNA, 25 bp, Homo sapien
gccttttctaactgcgagtgctaag

SEQ ID NO: 294901 - DNA, 25 bp, Homo sapien
ttttctaactgcgagtgctaaggaa

SEQ ID NO: 294902 - DNA, 25 bp, Homo sapien
ctaactgcgagtgctaaggaagagg

SEQ ID NO: 294903 - DNA, 25 bp, Homo sapien
gatgaaatgttggtgcagccagtta

SEQ ID NO: 294904 - DNA, 25 bp, Homo sapien
tggtgcagccagttataagtaatat

SEQ ID NO: 294905 - DNA, 25 bp, Homo sapien
aagtgctgccaccttttatgatgat

SEQ ID NO: 294906 - DNA, 25 bp, Homo sapien
tgctgccaccttttatgatgatttt

SEQ ID NO: 294907 - DNA, 25 bp, Homo sapien
agaaacatttggctgcatccacata

SEQ ID NO: 294908 - DNA, 25 bp, Homo sapien
atttggctgcatccacatagacctt

SEQ ID NO: 294909 - DNA, 25 bp, Homo sapien
gcatccacatagacctttatgtttt

SEQ ID NO: 294910 - DNA, 25 bp, Homo sapien
gcctcctttggcaacattcgtaaat

SEQ ID NO: 294911 - DNA, 25 bp, Homo sapien
ggcaacattcgtaaatgaagcagaa

SEQ ID NO: 294912 - DNA, 25 bp, Homo sapien
atcatgggtattggtgctgtgtaat

SEQ ID NO: 294913 - DNA, 25 bp, Homo sapien
ggtgctgtgtaatgaacaacgaatt

SEQ ID NO: 294914 - DNA, 25 bp, Homo sapien
ctacatctcagagccttttctgaag

SEQ ID NO: 294915 - DNA, 25 bp, Homo sapien
tttctgaagattttggcatccccac

SEQ ID NO: 294916 - DNA, 25 bp, Homo sapien
accatgttcctgtgtctttccccat

SEQ ID NO: 294917 - DNA, 25 bp, Homo sapien
gtgtctttccccatgaaggtttcag

SEQ ID NO: 294918 - DNA, 25 bp, Homo sapien
gttttccagccttatttgaagggag

SEQ ID NO: 294919 - DNA, 25 bp, Homo sapien
gaggccaaatgtctgctgcagtccc

SEQ ID NO: 294920 - DNA, 25 bp, Homo sapien
aaatgtctgctgcagtccctctgtg

SEQ ID NO: 294921 - DNA, 25 bp, Homo sapien
agtccctctgtgtcctgatttacag

SEQ ID NO: 294922 - DNA, 25 bp, Homo sapien
tgtgtcctgatttacagcaccagcc

SEQ ID NO: 294923 - DNA, 25 bp, Homo sapien
gatttacagcaccagccttgatgga

SEQ ID NO: 294924 - DNA, 25 bp, Homo sapien
cagcaccagccttgatggaacatgg

SEQ ID NO: 294925 - DNA, 25 bp, Homo sapien
cagccttagggttgggccctgaggc

SEQ ID NO: 294926 - DNA, 25 bp, Homo sapien
agccttagggttgggccctgaggct

SEQ ID NO: 294927 - DNA, 25 bp, Homo sapien
gccttagggttgggccctgaggctt

SEQ ID NO: 294928 - DNA, 25 bp, Homo sapien
ccttagggttgggccctgaggcttg

SEQ ID NO: 294929 - DNA, 25 bp, Homo sapien
cttagggttgggccctgaggcttga

SEQ ID NO: 294930 - DNA, 25 bp, Homo sapien
ttagggttgggccctgaggcttgaa

SEQ ID NO: 294931 - DNA, 25 bp, Homo sapien
tagggttgggccctgaggcttgaag

SEQ ID NO: 294932 - DNA, 25 bp, Homo sapien
agggttgggccctgaggcttgaagc

SEQ ID NO: 294933 - DNA, 25 bp, Homo sapien
ggcaccgcggcctgagcctggcgaa

SEQ ID NO: 294934 - DNA, 25 bp, Homo sapien
gcaccaccccgaactttgtaacaat

SEQ ID NO: 294935 - DNA, 25 bp, Homo sapien
gtaacaatctagagcaccacagagt

SEQ ID NO: 294936 - DNA, 25 bp, Homo sapien
agcaccacagagtgtttccagagat

SEQ ID NO: 294937 - DNA, 25 bp, Homo sapien
catggtgccactttcccggtgatcc

SEQ ID NO: 294938 - DNA, 25 bp, Homo sapien
cagagtgtttccagagatgggtttc

SEQ ID NO: 294939 - DNA, 25 bp, Homo sapien
cagagatgggtttcagtagcccagg

SEQ ID NO: 294940 - DNA, 25 bp, Homo sapien
gttgccgcccggcagagattcagtc

SEQ ID NO: 294941 - DNA, 25 bp, Homo sapien
gcccggcagagattcagtcccgaat

SEQ ID NO: 294942 - DNA, 25 bp, Homo sapien
gtcccgaatcccgacagcgaagaga

SEQ ID NO: 294943 - DNA, 25 bp, Homo sapien
atcccgacagcgaagagacttgtat

SEQ ID NO: 294944 - DNA, 25 bp, Homo sapien
agcgaagagacttgtatgccacctg

SEQ ID NO: 294945 - DNA, 25 bp, Homo sapien
aaaaagccaaactgtatgctggttt

SEQ ID NO: 294946 - DNA, 25 bp, Homo sapien
aaagccaaactgtatgctggtttta

SEQ ID NO: 294947 - DNA, 25 bp, Homo sapien
agccaaactgtatgctggttttaca

SEQ ID NO: 294948 - DNA, 25 bp, Homo sapien
tgtatgctggttttacagactccga

SEQ ID NO: 294949 - DNA, 25 bp, Homo sapien
gtatgctggttttacagactccgac

SEQ ID NO: 294950 - DNA, 25 bp, Homo sapien
tatgctggttttacagactccgacc

SEQ ID NO: 294951 - DNA, 25 bp, Homo sapien
atgctggttttacagactccgaccc

SEQ ID NO: 294952 - DNA, 25 bp, Homo sapien
gctggttttacagactccgaccctt

SEQ ID NO: 294953 - DNA, 25 bp, Homo sapien
tggttttacagactccgacccttct

SEQ ID NO: 294954 - DNA, 25 bp, Homo sapien
gttttacagactccgacccttctgt

SEQ ID NO: 294955 - DNA, 25 bp, Homo sapien
ttacagactccgacccttctgtcgt

SEQ ID NO: 294956 - DNA, 25 bp, Homo sapien
gggcttcgctgctccgtgccttcca

SEQ ID NO: 294957 - DNA, 25 bp, Homo sapien
tggaaacacctttggaaacagccgc

SEQ ID NO: 294958 - DNA, 25 bp, Homo sapien
gaaacacctttggaaacagccgcct

SEQ ID NO: 294959 - DNA, 25 bp, Homo sapien
aaacacctttggaaacagccgcctg

SEQ ID NO: 294960 - DNA, 25 bp, Homo sapien
aacacctttggaaacagccgcctga

SEQ ID NO: 294961 - DNA, 25 bp, Homo sapien
acacctttggaaacagccgcctgag

SEQ ID NO: 294962 - DNA, 25 bp, Homo sapien
acctttggaaacagccgcctgaggc

SEQ ID NO: 294963 - DNA, 25 bp, Homo sapien
agcagccaagggagctggcctctcc

SEQ ID NO: 294964 - DNA, 25 bp, Homo sapien
tacatccctctgtgaaccgcccaca

SEQ ID NO: 294965 - DNA, 25 bp, Homo sapien
acaggtgttcctctgtgagctggtc

SEQ ID NO: 294966 - DNA, 25 bp, Homo sapien
caggtgttcctctgtgagctggtcg

SEQ ID NO: 294967 - DNA, 25 bp, Homo sapien
aaatgacatcctgattccttttaaa

SEQ ID NO: 294968 - DNA, 25 bp, Homo sapien
gtattgatcaaataagcctaaacca

SEQ ID NO: 294969 - DNA, 25 bp, Homo sapien
aagcctaaaccaaatatgtgcaata

SEQ ID NO: 294970 - DNA, 25 bp, Homo sapien
gagcctttagatagtatctagtgca

SEQ ID NO: 294971 - DNA, 25 bp, Homo sapien
agatagtatctagtgcattgttaaa

SEQ ID NO: 294972 - DNA, 25 bp, Homo sapien
gatgtttttgtttacgtagaaatca

SEQ ID NO: 294973 - DNA, 25 bp, Homo sapien
agctgtgaaatgtatcaaccctcat

SEQ ID NO: 294974 - DNA, 25 bp, Homo sapien
gtgaaatgtatcaaccctcatctaa

SEQ ID NO: 294975 - DNA, 25 bp, Homo sapien
gtatcaaccctcatctaatttttgt

SEQ ID NO: 294976 - DNA, 25 bp, Homo sapien
accctcatctaatttttgtagtaca

SEQ ID NO: 294977 - DNA, 25 bp, Homo sapien
ttgtagtacaaaatgacatcctgat

SEQ ID NO: 294978 - DNA, 25 bp, Homo sapien
ggcctgttgataactccattaccca

SEQ ID NO: 294979 - DNA, 25 bp, Homo sapien
gttgataactccattacccacccat

SEQ ID NO: 294980 - DNA, 25 bp, Homo sapien
gctgccttcggtacataatttgaag

SEQ ID NO: 294981 - DNA, 25 bp, Homo sapien
gtacataatttgaaggggcactccc

SEQ ID NO: 294982 - DNA, 25 bp, Homo sapien
ttgaaggggcactccctcttgggca

SEQ ID NO: 294983 - DNA, 25 bp, Homo sapien
tcttgggcacatgccggccctgagt

SEQ ID NO: 294984 - DNA, 25 bp, Homo sapien
gggttggcatgactaaaaataccag

SEQ ID NO: 294985 - DNA, 25 bp, Homo sapien
ggcatgactaaaaataccagtatgt

SEQ ID NO: 294986 - DNA, 25 bp, Homo sapien
gtatgtgtattaagtattttgagaa

SEQ ID NO: 294987 - DNA, 25 bp, Homo sapien
gaatgaaatgccaaggagtgcctac

SEQ ID NO: 294988 - DNA, 25 bp, Homo sapien
aatgaaatgccaaggagtgcctact

SEQ ID NO: 294989 - DNA, 25 bp, Homo sapien
tagcacgaggctacagaaggattta

SEQ ID NO: 294990 - DNA, 25 bp, Homo sapien
aacgaaggtcttgtatggatttcac

SEQ ID NO: 294991 - DNA, 25 bp, Homo sapien
gtatggatttcacttccacttcctt

SEQ ID NO: 294992 - DNA, 25 bp, Homo sapien
ggatttgaaagtatgtctcccataa

SEQ ID NO: 294993 - DNA, 25 bp, Homo sapien
taaaagaaactgtgtcctccagaca

SEQ ID NO: 294994 - DNA, 25 bp, Homo sapien
gtcctccagacaaaaaccgcagatg

SEQ ID NO: 294995 - DNA, 25 bp, Homo sapien
aaaaaccgcagatggcacctcccgt

SEQ ID NO: 294996 - DNA, 25 bp, Homo sapien
agaaaacagccagggccctgctgct

SEQ ID NO: 294997 - DNA, 25 bp, Homo sapien
gctggttcttccgatgaacctggta

SEQ ID NO: 294998 - DNA, 25 bp, Homo sapien
atgccattgagcaaacctttcagag

SEQ ID NO: 294999 - DNA, 25 bp, Homo sapien
agtgaaaccaaagtgcgacgtagca

SEQ ID NO: 295000 - DNA, 25 bp, Homo sapien
ttttggtgaacctgccagaaaagct

SEQ ID NO: 295001 - DNA, 25 bp, Homo sapien
gctgccaaaaagctgactcttcttg

SEQ ID NO: 295002 - DNA, 25 bp, Homo sapien
taaaatgacccaagtttgtattcct

SEQ ID NO: 295003 - DNA, 25 bp, Homo sapien
gtttgtattcctccccacaagagag

SEQ ID NO: 295004 - DNA, 25 bp, Homo sapien
aagagaggaggcctatcttacctgg

SEQ ID NO: 295005 - DNA, 25 bp, Homo sapien
gcctatcttacctgggccttagaaa

SEQ ID NO: 295006 - DNA, 25 bp, Homo sapien
acctgggccttagaaagagccctga

SEQ ID NO: 295007 - DNA, 25 bp, Homo sapien
gaattcagttcttggtggcttatca

SEQ ID NO: 295008 - DNA, 25 bp, Homo sapien
ttcagggactcagaactcacgtgag

SEQ ID NO: 295009 - DNA, 25 bp, Homo sapien
ggtggcttatcaaaagcacacaggg

SEQ ID NO: 295010 - DNA, 25 bp, Homo sapien
caaccaaagtcaggcatctggtgct

SEQ ID NO: 295011 - DNA, 25 bp, Homo sapien
cccaaggccaagaccaccactgcca

SEQ ID NO: 295012 - DNA, 25 bp, Homo sapien
cagccaccaggagccgcagctccgg

SEQ ID NO: 295013 - DNA, 25 bp, Homo sapien
tccccgcttggtccgggtgaggaag

SEQ ID NO: 295014 - DNA, 25 bp, Homo sapien
gagcagcaccagaacgcagtgccgg

SEQ ID NO: 295015 - DNA, 25 bp, Homo sapien
cttggtccgggtgaggaagcaggtg

SEQ ID NO: 295016 - DNA, 25 bp, Homo sapien
agcagcaccagaacgcagtgccgga

SEQ ID NO: 295017 - DNA, 25 bp, Homo sapien
agcaccagaacgcagtgccggagcc

SEQ ID NO: 295018 - DNA, 25 bp, Homo sapien
gcaccagaacgcagtgccggagccg

SEQ ID NO: 295019 - DNA, 25 bp, Homo sapien
agccgcagcgggtgcgcgagcgtca

SEQ ID NO: 295020 - DNA, 25 bp, Homo sapien
tgcgcgagcgtcagcagcagcccta

SEQ ID NO: 295021 - DNA, 25 bp, Homo sapien
agcagccctacgcagctcagcacca

SEQ ID NO: 295022 - DNA, 25 bp, Homo sapien
tggaccaccgtgactgtagaggcgc

SEQ ID NO: 295023 - DNA, 25 bp, Homo sapien
accaccgtgactgtagaggcgctac

SEQ ID NO: 295024 - DNA, 25 bp, Homo sapien
tgtagaggcgctacacggccccacg

SEQ ID NO: 295025 - DNA, 25 bp, Homo sapien
cagacgcagcgtcgcaacctcggca

SEQ ID NO: 295026 - DNA, 25 bp, Homo sapien
caaactccgcgaacagtgacgcaga

SEQ ID NO: 295027 - DNA, 25 bp, Homo sapien
cagccttgtgcgagcccgatctggg

SEQ ID NO: 295028 - DNA, 25 bp, Homo sapien
ttgtgcgagcccgatctgggccttc

SEQ ID NO: 295029 - DNA, 25 bp, Homo sapien
gaacagtgacgcagaccccacgctt

SEQ ID NO: 295030 - DNA, 25 bp, Homo sapien
gcgcggctaccgcaagagcttaacg

SEQ ID NO: 295031 - DNA, 25 bp, Homo sapien
accgcaagagcttaacggatcagct

SEQ ID NO: 295032 - DNA, 25 bp, Homo sapien
ttgcagaccacacgcttccgtacag

SEQ ID NO: 295033 - DNA, 25 bp, Homo sapien
gtcagtgaaaggatccccaaaatga

SEQ ID NO: 295034 - DNA, 25 bp, Homo sapien
ccttcatatgaacctttgggaaaat

SEQ ID NO: 295035 - DNA, 25 bp, Homo sapien
taaccatagcaggaggtaaccggga

SEQ ID NO: 295036 - DNA, 25 bp, Homo sapien
atagaaaccctccatttgctgttac

SEQ ID NO: 295037 - DNA, 25 bp, Homo sapien
ttgctgttacccaagaatacccagg

SEQ ID NO: 295038 - DNA, 25 bp, Homo sapien
atacccaggagtatggagtcttcca

SEQ ID NO: 295039 - DNA, 25 bp, Homo sapien
cagtgtatctgggaagcgagtttca

SEQ ID NO: 295040 - DNA, 25 bp, Homo sapien
gcgagtttcaatctaaaaggtccat

SEQ ID NO: 295041 - DNA, 25 bp, Homo sapien
aaaaggtccatccaggagactccca

SEQ ID NO: 295042 - DNA, 25 bp, Homo sapien
ggagactcccattaccatttgggtt

SEQ ID NO: 295043 - DNA, 25 bp, Homo sapien
gtcagcctctgaaaagactttcttg

SEQ ID NO: 295044 - DNA, 25 bp, Homo sapien
ggctttatggattggatcactgcac

SEQ ID NO: 295045 - DNA, 25 bp, Homo sapien
tggatcactgcacccaatgagacac

SEQ ID NO: 295046 - DNA, 25 bp, Homo sapien
ctagctcctccataattcctttttt

SEQ ID NO: 295047 - DNA, 25 bp, Homo sapien
ttttttcctgcacgtgattacagtg

SEQ ID NO: 295048 - DNA, 25 bp, Homo sapien
taatacagtgctgaagagccagctg

SEQ ID NO: 295049 - DNA, 25 bp, Homo sapien
gattacagtgagatgctagatccct

SEQ ID NO: 295050 - DNA, 25 bp, Homo sapien
gagatgctagatccctcattcagct

SEQ ID NO: 295051 - DNA, 25 bp, Homo sapien
gaactggctttgtagatcatcctca

SEQ ID NO: 295052 - DNA, 25 bp, Homo sapien
atcatcctcaggaaactgacggtca

SEQ ID NO: 295053 - DNA, 25 bp, Homo sapien
tgacggtcaggcctcctgtatgaca

SEQ ID NO: 295054 - DNA, 25 bp, Homo sapien
ctgtatgacaccagggagctgaggc

SEQ ID NO: 295055 - DNA, 25 bp, Homo sapien
gcttcattatgcattttaaacactg

SEQ ID NO: 295056 - DNA, 25 bp, Homo sapien
aacactgtgcttcgtgtggtcagat

SEQ ID NO: 295057 - DNA, 25 bp, Homo sapien
tgaaatgttattctgcttgcactgt

SEQ ID NO: 295058 - DNA, 25 bp, Homo sapien
tctgcttgcactgtggtatctttta

SEQ ID NO: 295059 - DNA, 25 bp, Homo sapien
gagcaaacatacctggcttactttc

SEQ ID NO: 295060 - DNA, 25 bp, Homo sapien
atttctgttgtgaccttttcttcaa

SEQ ID NO: 295061 - DNA, 25 bp, Homo sapien
ttctctgttcaggaaatcaatttgg

SEQ ID NO: 295062 - DNA, 25 bp, Homo sapien
gtgaccttttcttcaagttaactga

SEQ ID NO: 295063 - DNA, 25 bp, Homo sapien
atacacagtgagttgctttttctaa

SEQ ID NO: 295064 - DNA, 25 bp, Homo sapien
ttctaatacagaaacccgtggcatt

SEQ ID NO: 295065 - DNA, 25 bp, Homo sapien
aacccgtggcattctaggagcttat

SEQ ID NO: 295066 - DNA, 25 bp, Homo sapien
agggaacagaaatcctccaccattc

SEQ ID NO: 295067 - DNA, 25 bp, Homo sapien
ccattcttctcaattgtgtagccac

SEQ ID NO: 295068 - DNA, 25 bp, Homo sapien
tgtagccacgagagatgcgagacct

SEQ ID NO: 295069 - DNA, 25 bp, Homo sapien
gagagatgcgagacctgtagacaaa

SEQ ID NO: 295070 - DNA, 25 bp, Homo sapien
aaagggtatgttaagtagctctgac

SEQ ID NO: 295071 - DNA, 25 bp, Homo sapien
tagctctgacagtagctcaccacag

SEQ ID NO: 295072 - DNA, 25 bp, Homo sapien
ggatctccaggaatgacatcaaatc

SEQ ID NO: 295073 - DNA, 25 bp, Homo sapien
aaatcttgactcttgtagtttcatc

SEQ ID NO: 295074 - DNA, 25 bp, Homo sapien
gtttcttattcaaaactgcatcttt

SEQ ID NO: 295075 - DNA, 25 bp, Homo sapien
actgcatctttacagagcttgttac

SEQ ID NO: 295076 - DNA, 25 bp, Homo sapien
agagcttgttactgtagtcataata

SEQ ID NO: 295077 - DNA, 25 bp, Homo sapien
tgacctctgttctccagaagcatgc

SEQ ID NO: 295078 - DNA, 25 bp, Homo sapien
ggttcccagtcaacaaatatccatt

SEQ ID NO: 295079 - DNA, 25 bp, Homo sapien
taggcatcggcacagcaccaaagca

SEQ ID NO: 295080 - DNA, 25 bp, Homo sapien
atcggcacagcaccaaagcagagaa

SEQ ID NO: 295081 - DNA, 25 bp, Homo sapien
gcatgatgtgtaattaagcttccaa

SEQ ID NO: 295082 - DNA, 25 bp, Homo sapien
aattaagcttccaatgcatagtgtg

SEQ ID NO: 295083 - DNA, 25 bp, Homo sapien
acacatcttggagatcaggctcaga

SEQ ID NO: 295084 - DNA, 25 bp, Homo sapien
tcaggctcagagacactaagtgact

SEQ ID NO: 295085 - DNA, 25 bp, Homo sapien
ggcagtgttacatgactctgtgtga

SEQ ID NO: 295086 - DNA, 25 bp, Homo sapien
ctgtgtgaatactgacagcattcag

SEQ ID NO: 295087 - DNA, 25 bp, Homo sapien
gcattcagagagcaatctgacctct

SEQ ID NO: 295088 - DNA, 25 bp, Homo sapien
agctctaaaatctgcttgtattcca

SEQ ID NO: 295089 - DNA, 25 bp, Homo sapien
gatattgttatatacatactatgaa

SEQ ID NO: 295090 - DNA, 25 bp, Homo sapien
atatgtataactttaacttctgttt

SEQ ID NO: 295091 - DNA, 25 bp, Homo sapien
aacttctgttttaccagcataccca

SEQ ID NO: 295092 - DNA, 25 bp, Homo sapien
tgttttaccagcatacccacacaaa

SEQ ID NO: 295093 - DNA, 25 bp, Homo sapien
tttaccagcatacccacacaaataa

SEQ ID NO: 295094 - DNA, 25 bp, Homo sapien
cagcatacccacacaaataacaaga

SEQ ID NO: 295095 - DNA, 25 bp, Homo sapien
gaatactacttatgaaatgtgcact

SEQ ID NO: 295096 - DNA, 25 bp, Homo sapien
aatgtgcactttatcctcattccat

SEQ ID NO: 295097 - DNA, 25 bp, Homo sapien
tgtgcactttatcctcattccataa

SEQ ID NO: 295098 - DNA, 25 bp, Homo sapien
tgtttattgaattcatttcactgta

SEQ ID NO: 295099 - DNA, 25 bp, Homo sapien
acagtggtccacggtaggcaggctt

SEQ ID NO: 295100 - DNA, 25 bp, Homo sapien
tgctgcgtgcggcattagctcatgc

SEQ ID NO: 295101 - DNA, 25 bp, Homo sapien
gcattagctcatgcgcagagagccc

SEQ ID NO: 295102 - DNA, 25 bp, Homo sapien
tttgggcaagcgagaggcacatcct

SEQ ID NO: 295103 - DNA, 25 bp, Homo sapien
catcctggtgcctctcaaaagtgga

SEQ ID NO: 295104 - DNA, 25 bp, Homo sapien
aacaggctctgactttggattccgc

SEQ ID NO: 295105 - DNA, 25 bp, Homo sapien
tttggattccgcttccctggaaagg

SEQ ID NO: 295106 - DNA, 25 bp, Homo sapien
gcttccctggaaagggccgttgatt

SEQ ID NO: 295107 - DNA, 25 bp, Homo sapien
agggccgttgatttgttcagcgttc

SEQ ID NO: 295108 - DNA, 25 bp, Homo sapien
ttgatttgttcagcgttctgcacgg

SEQ ID NO: 295109 - DNA, 25 bp, Homo sapien
tcagcgttctgcacggttcaggtca

SEQ ID NO: 295110 - DNA, 25 bp, Homo sapien
gcataacatggtttttagtcttaac

SEQ ID NO: 295111 - DNA, 25 bp, Homo sapien
cataacatggtttttagtcttaaca

SEQ ID NO: 295112 - DNA, 25 bp, Homo sapien
taacatggtttttagtcttaacaag

SEQ ID NO: 295113 - DNA, 25 bp, Homo sapien
catggtttttagtcttaacaagcac

SEQ ID NO: 295114 - DNA, 25 bp, Homo sapien
actccctagcttactttctacataa

SEQ ID NO: 295115 - DNA, 25 bp, Homo sapien
ctccctagcttactttctacataat

SEQ ID NO: 295116 - DNA, 25 bp, Homo sapien
tccctagcttactttctacataatt

SEQ ID NO: 295117 - DNA, 25 bp, Homo sapien
ccctagcttactttctacataattt

SEQ ID NO: 295118 - DNA, 25 bp, Homo sapien
agcttactttctacataatttagtt

SEQ ID NO: 295119 - DNA, 25 bp, Homo sapien
gttttaagagcaggaaatgcataac

SEQ ID NO: 295120 - DNA, 25 bp, Homo sapien
agagcaggaaatgcataacatggtt

SEQ ID NO: 295121 - DNA, 25 bp, Homo sapien
tgattctccttctgtaatcgagagt

SEQ ID NO: 295122 - DNA, 25 bp, Homo sapien
aatcgagagtgggaagtcgcttccc

SEQ ID NO: 295123 - DNA, 25 bp, Homo sapien
tttttccaaatacagcagtagcttt

SEQ ID NO: 295124 - DNA, 25 bp, Homo sapien
aatacagcagtagctttgaaagcat

SEQ ID NO: 295125 - DNA, 25 bp, Homo sapien
aagcattctttgctcctctgttaac

SEQ ID NO: 295126 - DNA, 25 bp, Homo sapien
ttctttgctcctctgttaacagcag

SEQ ID NO: 295127 - DNA, 25 bp, Homo sapien
gctcctctgttaacagcagaatgta

SEQ ID NO: 295128 - DNA, 25 bp, Homo sapien
tgaccactgcactgatggtttctta

SEQ ID NO: 295129 - DNA, 25 bp, Homo sapien
actgcactgatggtttcttaatcat

SEQ ID NO: 295130 - DNA, 25 bp, Homo sapien
atcatgcagtatgaagatcagcttc

SEQ ID NO: 295131 - DNA, 25 bp, Homo sapien
aaagccagtgcagttagttcatcat

SEQ ID NO: 295132 - DNA, 25 bp, Homo sapien
aggtcttgggtctgccacgttctct

SEQ ID NO: 295133 - DNA, 25 bp, Homo sapien
tgggtctgccacgttctctagctct

SEQ ID NO: 295134 - DNA, 25 bp, Homo sapien
agtcacccactcatccagggtagga

SEQ ID NO: 295135 - DNA, 25 bp, Homo sapien
cacccactcatccagggtaggaggg

SEQ ID NO: 295136 - DNA, 25 bp, Homo sapien
ggactgcatccctcctgggcctgag

SEQ ID NO: 295137 - DNA, 25 bp, Homo sapien
tgagcctcgggactcagtggacacc

SEQ ID NO: 295138 - DNA, 25 bp, Homo sapien
gcctcgggactcagtggacaccaaa

SEQ ID NO: 295139 - DNA, 25 bp, Homo sapien
gggactcagtggacaccaaagtcaa

SEQ ID NO: 295140 - DNA, 25 bp, Homo sapien
gtggacaccaaagtcaagaccagca

SEQ ID NO: 295141 - DNA, 25 bp, Homo sapien
ggacaccaaagtcaagaccagcacc

SEQ ID NO: 295142 - DNA, 25 bp, Homo sapien
gcctgggtgaggatctggaagctgt

SEQ ID NO: 295143 - DNA, 25 bp, Homo sapien
atgttacatttataatcagtgagga

SEQ ID NO: 295144 - DNA, 25 bp, Homo sapien
ggagtttgaggttttagtgcactgt

SEQ ID NO: 295145 - DNA, 25 bp, Homo sapien
gaaagggtcattggccaattgtttg

SEQ ID NO: 295146 - DNA, 25 bp, Homo sapien
cattggccaattgtttggagggaaa

SEQ ID NO: 295147 - DNA, 25 bp, Homo sapien
gaaaaaatacaccatgttctaaaat

SEQ ID NO: 295148 - DNA, 25 bp, Homo sapien
gaggttttagtgcactgtgattgca

SEQ ID NO: 295149 - DNA, 25 bp, Homo sapien
tttctagtgatttattgtgactttc

SEQ ID NO: 295150 - DNA, 25 bp, Homo sapien
gtgatttattgtgactttcatgcat

SEQ ID NO: 295151 - DNA, 25 bp, Homo sapien
aaatgaaaccatagccttacgagaa

SEQ ID NO: 295152 - DNA, 25 bp, Homo sapien
gaaaccatagccttacgagaagaaa

SEQ ID NO: 295153 - DNA, 25 bp, Homo sapien
aaccatagccttacgagaagaaaat

SEQ ID NO: 295154 - DNA, 25 bp, Homo sapien
gaaaccacttttgactttgtgcatg

SEQ ID NO: 295155 - DNA, 25 bp, Homo sapien
gactttgtgcatgctatttagcagt

SEQ ID NO: 295156 - DNA, 25 bp, Homo sapien
ttagcagttctacatttcaagtgat

SEQ ID NO: 295157 - DNA, 25 bp, Homo sapien
gacattatgactcactccatcttaa

SEQ ID NO: 295158 - DNA, 25 bp, Homo sapien
gactcactccatcttaaataaccaa

SEQ ID NO: 295159 - DNA, 25 bp, Homo sapien
aacgttttattttatgcttgccatg

SEQ ID NO: 295160 - DNA, 25 bp, Homo sapien
ttatgcttgccatgtatgcaccagg

SEQ ID NO: 295161 - DNA, 25 bp, Homo sapien
tgccatgtatgcaccaggccctgtt

SEQ ID NO: 295162 - DNA, 25 bp, Homo sapien
aggccctgttctaggcatttgagat

SEQ ID NO: 295163 - DNA, 25 bp, Homo sapien
gagatacagatctgtctcctgctct

SEQ ID NO: 295164 - DNA, 25 bp, Homo sapien
tcctgctctcatgtactgtagtgga

SEQ ID NO: 295165 - DNA, 25 bp, Homo sapien
ccgatggtcccagtgccatattagt

SEQ ID NO: 295166 - DNA, 25 bp, Homo sapien
ggtcccagtgccatattagtgtcac

SEQ ID NO: 295167 - DNA, 25 bp, Homo sapien
cccagtgccatattagtgtcacatt

SEQ ID NO: 295168 - DNA, 25 bp, Homo sapien
agtcgggagagctcggtgatgtcac

SEQ ID NO: 295169 - DNA, 25 bp, Homo sapien
gcccctttattacttgaatctcttc

SEQ ID NO: 295170 - DNA, 25 bp, Homo sapien
ttacttgaatctcttcgttgtgccc

SEQ ID NO: 295171 - DNA, 25 bp, Homo sapien
ttgaatctcttcgttgtgccctgtc

SEQ ID NO: 295172 - DNA, 25 bp, Homo sapien
atctcttcgttgtgccctgtctagg

SEQ ID NO: 295173 - DNA, 25 bp, Homo sapien
ttgtgccctgtctaggcacggtcgt

SEQ ID NO: 295174 - DNA, 25 bp, Homo sapien
taggcacggtcgtccgacagcaggc

SEQ ID NO: 295175 - DNA, 25 bp, Homo sapien
aatggaggtacaatgggacttccgg

SEQ ID NO: 295176 - DNA, 25 bp, Homo sapien
cggagtagttgaaaagcaggaagtc

SEQ ID NO: 295177 - DNA, 25 bp, Homo sapien
gcaggaagtccatcttgtagaggtc

SEQ ID NO: 295178 - DNA, 25 bp, Homo sapien
ggaagtccatcttgtagaggtcgaa

SEQ ID NO: 295179 - DNA, 25 bp, Homo sapien
atgtcccggaagaggcgcgctgcca

SEQ ID NO: 295180 - DNA, 25 bp, Homo sapien
gcggcccagggaagctcaggtcgga

SEQ ID NO: 295181 - DNA, 25 bp, Homo sapien
agctcaggtcggatgcgcccgccag

SEQ ID NO: 295182 - DNA, 25 bp, Homo sapien
ggtcttgtcggaaaggcacttgccc

SEQ ID NO: 295183 - DNA, 25 bp, Homo sapien
tcggaaaggcacttgccccgcgtgg

SEQ ID NO: 295184 - DNA, 25 bp, Homo sapien
ccgcgtggccacaggacctccagga

SEQ ID NO: 295185 - DNA, 25 bp, Homo sapien
aggaccgctagagcagccgcaggta

SEQ ID NO: 295186 - DNA, 25 bp, Homo sapien
accgctagagcagccgcaggtagga

SEQ ID NO: 295187 - DNA, 25 bp, Homo sapien
ctgtgtccccgcgttctgagaagtc

SEQ ID NO: 295188 - DNA, 25 bp, Homo sapien
gtgtccccgcgttctgagaagtcct

SEQ ID NO: 295189 - DNA, 25 bp, Homo sapien
ccgcgttctgagaagtcctctgtct

SEQ ID NO: 295190 - DNA, 25 bp, Homo sapien
gaagtcctctgtcttcgtgtcacta

SEQ ID NO: 295191 - DNA, 25 bp, Homo sapien
agtcctctgtcttcgtgtcactagg

SEQ ID NO: 295192 - DNA, 25 bp, Homo sapien
tgtcttcgtgtcactaggtccagaa

SEQ ID NO: 295193 - DNA, 25 bp, Homo sapien
tcttcgtgtcactaggtccagaaag

SEQ ID NO: 295194 - DNA, 25 bp, Homo sapien
ttcgtgtcactaggtccagaaagtc

SEQ ID NO: 295195 - DNA, 25 bp, Homo sapien
gtcactaggtccagaaagtcgcgcc

SEQ ID NO: 295196 - DNA, 25 bp, Homo sapien
actaggtccagaaagtcgcgccggg

SEQ ID NO: 295197 - DNA, 25 bp, Homo sapien
taggtccagaaagtcgcgccgggca

SEQ ID NO: 295198 - DNA, 25 bp, Homo sapien
aaaggcgaagggtgccatctgcttc

SEQ ID NO: 295199 - DNA, 25 bp, Homo sapien
ctgcttccccactgattcagaagat

SEQ ID NO: 295200 - DNA, 25 bp, Homo sapien
ttttcaatagtgtccctaccctgaa

SEQ ID NO: 295201 - DNA, 25 bp, Homo sapien
atcatggagttagctaacagcccag

SEQ ID NO: 295202 - DNA, 25 bp, Homo sapien
taacagcccagggaactggtctctt

SEQ ID NO: 295203 - DNA, 25 bp, Homo sapien
cctggaactcacctggaaagggcaa

SEQ ID NO: 295204 - DNA, 25 bp, Homo sapien
ggaaagggcaatcagctggctctat

SEQ ID NO: 295205 - DNA, 25 bp, Homo sapien
atcagctggctctatatcagacgcc

SEQ ID NO: 295206 - DNA, 25 bp, Homo sapien
agacgccaccacctggtctttgaag

SEQ ID NO: 295207 - DNA, 25 bp, Homo sapien
tttgaagtttctgtcctaccagtgc

SEQ ID NO: 295208 - DNA, 25 bp, Homo sapien
agtttctgtcctaccagtgccacag

SEQ ID NO: 295209 - DNA, 25 bp, Homo sapien
aattctttatatagtgccatgtggc

SEQ ID NO: 295210 - DNA, 25 bp, Homo sapien
gtgccatgtggcatctaaaataact

SEQ ID NO: 295211 - DNA, 25 bp, Homo sapien
gtggcatctaaaataactttggcta

SEQ ID NO: 295212 - DNA, 25 bp, Homo sapien
aagtgattcagttcatgtcaaacaa

SEQ ID NO: 295213 - DNA, 25 bp, Homo sapien
agaatggatcaaagtggcccttcat

SEQ ID NO: 295214 - DNA, 25 bp, Homo sapien
atcaaagtggcccttcatttggctc

SEQ ID NO: 295215 - DNA, 25 bp, Homo sapien
atttggctccacgtcatctcacaat

SEQ ID NO: 295216 - DNA, 25 bp, Homo sapien
gctccacgtcatctcacaatagtga

SEQ ID NO: 295217 - DNA, 25 bp, Homo sapien
gcagaatgtcactaaactaccataa

SEQ ID NO: 295218 - DNA, 25 bp, Homo sapien
gtcaaacaacatttcacaggattct

SEQ ID NO: 295219 - DNA, 25 bp, Homo sapien
atttcacaggattcttacccccaag

SEQ ID NO: 295220 - DNA, 25 bp, Homo sapien
tgcagacacacaagactatgtttta

SEQ ID NO: 295221 - DNA, 25 bp, Homo sapien
gcagacacacaagactatgttttaa

SEQ ID NO: 295222 - DNA, 25 bp, Homo sapien
cagacacacaagactatgttttaag

SEQ ID NO: 295223 - DNA, 25 bp, Homo sapien
catttgtgaggaaaatctcacttag

SEQ ID NO: 295224 - DNA, 25 bp, Homo sapien
gacacacaagactatgttttaagat

SEQ ID NO: 295225 - DNA, 25 bp, Homo sapien
cacacaagactatgttttaagatca

SEQ ID NO: 295226 - DNA, 25 bp, Homo sapien
cacaagactatgttttaagatcaaa

SEQ ID NO: 295227 - DNA, 25 bp, Homo sapien
gactatgttttaagatcaaacttac

SEQ ID NO: 295228 - DNA, 25 bp, Homo sapien
gttttaagatcaaacttacattcta

SEQ ID NO: 295229 - DNA, 25 bp, Homo sapien
cattctagttagaggatttatttta

SEQ ID NO: 295230 - DNA, 25 bp, Homo sapien
ttgtcacaaaaatgaaaaggttggc

SEQ ID NO: 295231 - DNA, 25 bp, Homo sapien
atgtaaaggtctgtttccatggtta

SEQ ID NO: 295232 - DNA, 25 bp, Homo sapien
tggttacccaaattccaggcactgg

SEQ ID NO: 295233 - DNA, 25 bp, Homo sapien
tggcagaggaaaagcatttctcctt

SEQ ID NO: 295234 - DNA, 25 bp, Homo sapien
atttctccttgctgcggcaagtcag

SEQ ID NO: 295235 - DNA, 25 bp, Homo sapien
agtcagagccagaatctcgggttct

SEQ ID NO: 295236 - DNA, 25 bp, Homo sapien
aatctcgggttctcctgctccaaag

SEQ ID NO: 295237 - DNA, 25 bp, Homo sapien
accctcattcgcgtgtgattcatgc

SEQ ID NO: 295238 - DNA, 25 bp, Homo sapien
gattcatgcgtttaggtggttctgc

SEQ ID NO: 295239 - DNA, 25 bp, Homo sapien
atgtctcacatggatcttatgcaga

SEQ ID NO: 295240 - DNA, 25 bp, Homo sapien
agagaagcctgagcgacttgcactt

SEQ ID NO: 295241 - DNA, 25 bp, Homo sapien
gcgacttgcactttcaacaatggtt

SEQ ID NO: 295242 - DNA, 25 bp, Homo sapien
caagcctcagcaaacccaaagatgt

SEQ ID NO: 295243 - DNA, 25 bp, Homo sapien
gaagttgctgcagattcctttggcc

SEQ ID NO: 295244 - DNA, 25 bp, Homo sapien
attcctttggccactgtatttgtta

SEQ ID NO: 295245 - DNA, 25 bp, Homo sapien
ctttggccactgtatttgttaattt

SEQ ID NO: 295246 - DNA, 25 bp, Homo sapien
aatttcttgcaatttgaaggtacga

SEQ ID NO: 295247 - DNA, 25 bp, Homo sapien
tgcatttaagttgtaaacgtctttt

SEQ ID NO: 295248 - DNA, 25 bp, Homo sapien
cctttgaagtgcctctgattctatg

SEQ ID NO: 295249 - DNA, 25 bp, Homo sapien
gtgcctctgattctatgtaacttgt

SEQ ID NO: 295250 - DNA, 25 bp, Homo sapien
ttctatgtaacttgttgcagactgg

SEQ ID NO: 295251 - DNA, 25 bp, Homo sapien
agttggtattttataagcacagaca

SEQ ID NO: 295252 - DNA, 25 bp, Homo sapien
gcacagacaattctaatggtaactt

SEQ ID NO: 295253 - DNA, 25 bp, Homo sapien
atgagggtctcactgctttaggatt

SEQ ID NO: 295254 - DNA, 25 bp, Homo sapien
gggtctcactgctttaggattgaag

SEQ ID NO: 295255 - DNA, 25 bp, Homo sapien
gctttaggattgaagtggctggaaa

SEQ ID NO: 295256 - DNA, 25 bp, Homo sapien
atgagggtactgtggctggtacttt

SEQ ID NO: 295257 - DNA, 25 bp, Homo sapien
gggtactgtggctggtactttctgt

SEQ ID NO: 295258 - DNA, 25 bp, Homo sapien
ttttaaactgtgagccgtccaagtc

SEQ ID NO: 295259 - DNA, 25 bp, Homo sapien
aactgtgagccgtccaagtcagaag

SEQ ID NO: 295260 - DNA, 25 bp, Homo sapien
gagccgtccaagtcagaagaagaca

SEQ ID NO: 295261 - DNA, 25 bp, Homo sapien
aagcaacttttccaacatacaattt

SEQ ID NO: 295262 - DNA, 25 bp, Homo sapien
tttcattttgagaacattccctgga

SEQ ID NO: 295263 - DNA, 25 bp, Homo sapien
ctggaattgccacataattcattaa

SEQ ID NO: 295264 - DNA, 25 bp, Homo sapien
tgacatcaaccttccgcagtatttt

SEQ ID NO: 295265 - DNA, 25 bp, Homo sapien
accccttcagcgacaggttggatga

SEQ ID NO: 295266 - DNA, 25 bp, Homo sapien
ggttggatgatgtggaacagcccct

SEQ ID NO: 295267 - DNA, 25 bp, Homo sapien
accttccgcagtattttgccatcat

SEQ ID NO: 295268 - DNA, 25 bp, Homo sapien
atgatgtggaacagcccctggacca

SEQ ID NO: 295269 - DNA, 25 bp, Homo sapien
gaccacagcagccttcggcagctgg

SEQ ID NO: 295270 - DNA, 25 bp, Homo sapien
cggcagctggttctcgacaattata

SEQ ID NO: 295271 - DNA, 25 bp, Homo sapien
gctggttctcgacaattatatcctg

SEQ ID NO: 295272 - DNA, 25 bp, Homo sapien
gttctcgacaattatatcctgaagg

SEQ ID NO: 295273 - DNA, 25 bp, Homo sapien
gttggagacctacaggcgcatcctg

SEQ ID NO: 295274 - DNA, 25 bp, Homo sapien
ctacaggcgcatcctggaagtggaa

SEQ ID NO: 295275 - DNA, 25 bp, Homo sapien
catttttatagctgcctactcatgt

SEQ ID NO: 295276 - DNA, 25 bp, Homo sapien
gctgcctactcatgtatggacttca

SEQ ID NO: 295277 - DNA, 25 bp, Homo sapien
aaaaatgaagccatgctttcctgaa

SEQ ID NO: 295278 - DNA, 25 bp, Homo sapien
ggaagtttacaggaaccagaacaca

SEQ ID NO: 295279 - DNA, 25 bp, Homo sapien
acacatccagcttcctaagcacaga

SEQ ID NO: 295280 - DNA, 25 bp, Homo sapien
aagcatgctgcttccattatgaaac

SEQ ID NO: 295281 - DNA, 25 bp, Homo sapien
gcttccattatgaaaccactctgtt

SEQ ID NO: 295282 - DNA, 25 bp, Homo sapien
ccactctgttggtaatccgtactgt

SEQ ID NO: 295283 - DNA, 25 bp, Homo sapien
gtaatccgtactgttatttgatggt

SEQ ID NO: 295284 - DNA, 25 bp, Homo sapien
tgctttcctgaaagccctatgaact

SEQ ID NO: 295285 - DNA, 25 bp, Homo sapien
gaagctagaccacttaatctttaga

SEQ ID NO: 295286 - DNA, 25 bp, Homo sapien
tccttttgaaaaggccagtctcaaa

SEQ ID NO: 295287 - DNA, 25 bp, Homo sapien
ctcaaaaagtagttaacacagcaaa

SEQ ID NO: 295288 - DNA, 25 bp, Homo sapien
aacacagcaaataagtccgacttaa

SEQ ID NO: 295289 - DNA, 25 bp, Homo sapien
taagtccgacttaatgggctgcaat

SEQ ID NO: 295290 - DNA, 25 bp, Homo sapien
gtccgacttaatgggctgcaatttt

SEQ ID NO: 295291 - DNA, 25 bp, Homo sapien
gacttaatgggctgcaattttcatt

SEQ ID NO: 295292 - DNA, 25 bp, Homo sapien
atgggctgcaattttcatttgaaaa

SEQ ID NO: 295293 - DNA, 25 bp, Homo sapien
tcttaagttttcattgacagccttc

SEQ ID NO: 295294 - DNA, 25 bp, Homo sapien
agttttcattgacagccttctaaga

SEQ ID NO: 295295 - DNA, 25 bp, Homo sapien
ttgacagccttctaagaactgccat

SEQ ID NO: 295296 - DNA, 25 bp, Homo sapien
cagccttctaagaactgccatctga

SEQ ID NO: 295297 - DNA, 25 bp, Homo sapien
aggcagaactgtgtgatccctgaat

SEQ ID NO: 295298 - DNA, 25 bp, Homo sapien
gtgatccctgaatgtgaacctgaag

SEQ ID NO: 295299 - DNA, 25 bp, Homo sapien
gaacctgaagttcaaaggacttgga

SEQ ID NO: 295300 - DNA, 25 bp, Homo sapien
gggtctgagttagctcctggctcca

SEQ ID NO: 295301 - DNA, 25 bp, Homo sapien
tgagttagctcctggctccactgag

SEQ ID NO: 295302 - DNA, 25 bp, Homo sapien
gctccactgagcaggccgtcagctg

SEQ ID NO: 295303 - DNA, 25 bp, Homo sapien
gcctggaacagctgcttccgaagaa

SEQ ID NO: 295304 - DNA, 25 bp, Homo sapien
gctgccttcagggaaatgcgtgcac

SEQ ID NO: 295305 - DNA, 25 bp, Homo sapien
tcagggaaatgcgtgcaccgtgcag

SEQ ID NO: 295306 - DNA, 25 bp, Homo sapien
cccagggaggcctcttcagcgggat

SEQ ID NO: 295307 - DNA, 25 bp, Homo sapien
cctcttcagcgggattggcagttgc

SEQ ID NO: 295308 - DNA, 25 bp, Homo sapien
ttctgctggaaactgcgatacctac

SEQ ID NO: 295309 - DNA, 25 bp, Homo sapien
gcgatacctaccctcggtacatggg

SEQ ID NO: 295310 - DNA, 25 bp, Homo sapien
atagctcacgtaagtgacttggtca

SEQ ID NO: 295311 - DNA, 25 bp, Homo sapien
gacttggtcacttggcaagatttct

SEQ ID NO: 295312 - DNA, 25 bp, Homo sapien
gcaagatttcttcgcttctcggata

SEQ ID NO: 295313 - DNA, 25 bp, Homo sapien
tcgcttctcggatagctgcaggaat

SEQ ID NO: 295314 - DNA, 25 bp, Homo sapien
aaaatgataatgtcttgttccaatt

SEQ ID NO: 295315 - DNA, 25 bp, Homo sapien
gaatagtaaacaggtccaagtatag

SEQ ID NO: 295316 - DNA, 25 bp, Homo sapien
ctttaggtttggaccaagtgctgtc

SEQ ID NO: 295317 - DNA, 25 bp, Homo sapien
gaccaagtgctgtcaaagccagaga

SEQ ID NO: 295318 - DNA, 25 bp, Homo sapien
agatactgatcagccaggacagata

SEQ ID NO: 295319 - DNA, 25 bp, Homo sapien
gttcgtcctcagcacaacgagcggc

SEQ ID NO: 295320 - DNA, 25 bp, Homo sapien
tcagcacaacgagcggcagcgggca

SEQ ID NO: 295321 - DNA, 25 bp, Homo sapien
agcgggcaccgaattgttctgcaac

SEQ ID NO: 295322 - DNA, 25 bp, Homo sapien
gttctgcaactacttttcacatctg

SEQ ID NO: 295323 - DNA, 25 bp, Homo sapien
catctgccttttgtagttgctgaac

SEQ ID NO: 295324 - DNA, 25 bp, Homo sapien
gttgctgaacaaaattcgttcccat

SEQ ID NO: 295325 - DNA, 25 bp, Homo sapien
ttcccatttgtttccggttggcaag

SEQ ID NO: 295326 - DNA, 25 bp, Homo sapien
ttccggttggcaagttcgtaggctt

SEQ ID NO: 295327 - DNA, 25 bp, Homo sapien
gcttcggcggaagtgtaaagtcaag

SEQ ID NO: 295328 - DNA, 25 bp, Homo sapien
attaataactcctccaaaacctctg

SEQ ID NO: 295329 - DNA, 25 bp, Homo sapien
taactcctccaaaacctctgtgggt

SEQ ID NO: 295330 - DNA, 25 bp, Homo sapien
gccaaagtgaattaaaatccaccat

SEQ ID NO: 295331 - DNA, 25 bp, Homo sapien
ctctgccgtcctgaaggcagtgtgg

SEQ ID NO: 295332 - DNA, 25 bp, Homo sapien
tttgatagcaatacggacactctgg

SEQ ID NO: 295333 - DNA, 25 bp, Homo sapien
agcaatacggacactctgggagctg

SEQ ID NO: 295334 - DNA, 25 bp, Homo sapien
ggagctgtgctgaatgtttcatact

SEQ ID NO: 295335 - DNA, 25 bp, Homo sapien
tgtttcatactttccttaatgtaat

SEQ ID NO: 295336 - DNA, 25 bp, Homo sapien
atcattactgtctctgctgtacatg

SEQ ID NO: 295337 - DNA, 25 bp, Homo sapien
agtaaaacagaacaccaagtaggag

SEQ ID NO: 295338 - DNA, 25 bp, Homo sapien
aacaccaagtaggagaatatcaact

SEQ ID NO: 295339 - DNA, 25 bp, Homo sapien
gaatatcaactgtaagtatacgcca

SEQ ID NO: 295340 - DNA, 25 bp, Homo sapien
aactgtaagtatacgccaaagtgaa

SEQ ID NO: 295341 - DNA, 25 bp, Homo sapien
aacaggcagaactgtgtgatccctg

SEQ ID NO: 295342 - DNA, 25 bp, Homo sapien
aggcagaactgtgtgatccctgaat

SEQ ID NO: 295343 - DNA, 25 bp, Homo sapien
gcagaactgtgtgatccctgaatgt

SEQ ID NO: 295344 - DNA, 25 bp, Homo sapien
actgtgtgatccctgaatgtgaacc

SEQ ID NO: 295345 - DNA, 25 bp, Homo sapien
ctgtgtgatccctgaatgtgaacct

SEQ ID NO: 295346 - DNA, 25 bp, Homo sapien
gctgccttcagggaaatgcgtgcac

SEQ ID NO: 295347 - DNA, 25 bp, Homo sapien
gccttcagggaaatgcgtgcaccgt

SEQ ID NO: 295348 - DNA, 25 bp, Homo sapien
cttcagggaaatgcgtgcaccgtgc

SEQ ID NO: 295349 - DNA, 25 bp, Homo sapien
tcagggaaatgcgtgcaccgtgcag

SEQ ID NO: 295350 - DNA, 25 bp, Homo sapien
cccagggaggcctcttcagcgggat

SEQ ID NO: 295351 - DNA, 25 bp, Homo sapien
cctcttcagcgggattggcagttgc

SEQ ID NO: 295352 - DNA, 25 bp, Homo sapien
gagtagtggcaggaccttgtcacca

SEQ ID NO: 295353 - DNA, 25 bp, Homo sapien
aggaccttgtcaccaggctctgatg

SEQ ID NO: 295354 - DNA, 25 bp, Homo sapien
cttgtcaccaggctctgatgaaggc

SEQ ID NO: 295355 - DNA, 25 bp, Homo sapien
tcttttaatcccaaactcttgccct

SEQ ID NO: 295356 - DNA, 25 bp, Homo sapien
acggctactccaggtcctcttgaaa

SEQ ID NO: 295357 - DNA, 25 bp, Homo sapien
tactccaggtcctcttgaaatccgt

SEQ ID NO: 295358 - DNA, 25 bp, Homo sapien
tgaaatccgtcctctccatggactt

SEQ ID NO: 295359 - DNA, 25 bp, Homo sapien
ctctctgctctaggtttgattaaca

SEQ ID NO: 295360 - DNA, 25 bp, Homo sapien
atgaaaaccagcatctccctagggc

SEQ ID NO: 295361 - DNA, 25 bp, Homo sapien
gccatggtctactgacagatggcaa

SEQ ID NO: 295362 - DNA, 25 bp, Homo sapien
acagatggcaagttactttgtaacc

SEQ ID NO: 295363 - DNA, 25 bp, Homo sapien
agaattttctaaaatggagcccatt

SEQ ID NO: 295364 - DNA, 25 bp, Homo sapien
tgtcttttcagtcttgcaagtaaag

SEQ ID NO: 295365 - DNA, 25 bp, Homo sapien
tcagtcttgcaagtaaagtctttaa

SEQ ID NO: 295366 - DNA, 25 bp, Homo sapien
taagcctcccaatgatttaaccgta

SEQ ID NO: 295367 - DNA, 25 bp, Homo sapien
gcctcccaatgatttaaccgtattt

SEQ ID NO: 295368 - DNA, 25 bp, Homo sapien
cccaccctgaataatatttacaaag

SEQ ID NO: 295369 - DNA, 25 bp, Homo sapien
ccccgtccttcagttgttataaatg

SEQ ID NO: 295370 - DNA, 25 bp, Homo sapien
atgatagttcattcttggtaagtat

SEQ ID NO: 295371 - DNA, 25 bp, Homo sapien
attcttggtaagtatatctgtaaca

SEQ ID NO: 295372 - DNA, 25 bp, Homo sapien
ggacatgaggtatggtgaacactta

SEQ ID NO: 295373 - DNA, 25 bp, Homo sapien
ttaaaattctgccagccagcttaaa

SEQ ID NO: 295374 - DNA, 25 bp, Homo sapien
gtctttcatgttattgtagctggca

SEQ ID NO: 295375 - DNA, 25 bp, Homo sapien
tgtagctggcatgcttcaaaatttt

SEQ ID NO: 295376 - DNA, 25 bp, Homo sapien
aattttgagcttactgggactgaca

SEQ ID NO: 295377 - DNA, 25 bp, Homo sapien
ggactgacagcctctcacttcaatc

SEQ ID NO: 295378 - DNA, 25 bp, Homo sapien
ctcacttcaatctgagggattgaca

SEQ ID NO: 295379 - DNA, 25 bp, Homo sapien
gacagaatttaaacaggctcattga

SEQ ID NO: 295380 - DNA, 25 bp, Homo sapien
ggctcattgattctgtacactctac

SEQ ID NO: 295381 - DNA, 25 bp, Homo sapien
attgattctgtacactctacccttc

SEQ ID NO: 295382 - DNA, 25 bp, Homo sapien
ctacccttcctgtggcaagtgataa

SEQ ID NO: 295383 - DNA, 25 bp, Homo sapien
ctgtggcaagtgataatgggatttc

SEQ ID NO: 295384 - DNA, 25 bp, Homo sapien
tttacaaatgacatccactgtggca

SEQ ID NO: 295385 - DNA, 25 bp, Homo sapien
gaaccaacccatcatggctcaagaa

SEQ ID NO: 295386 - DNA, 25 bp, Homo sapien
atctctgcatttataactccctgct

SEQ ID NO: 295387 - DNA, 25 bp, Homo sapien
gttcaccctgaagcacactatgtag

SEQ ID NO: 295388 - DNA, 25 bp, Homo sapien
cactatgtagacttgccatgtgcaa

SEQ ID NO: 295389 - DNA, 25 bp, Homo sapien
ttgccatgtgcaaagcagcttctta

SEQ ID NO: 295390 - DNA, 25 bp, Homo sapien
gcttcttagccaatcaatatccaca

SEQ ID NO: 295391 - DNA, 25 bp, Homo sapien
ggaaggatacctgcttatctctttg

SEQ ID NO: 295392 - DNA, 25 bp, Homo sapien
gtgctactgccaatcaccagactaa

SEQ ID NO: 295393 - DNA, 25 bp, Homo sapien
acatcatttctattccatggcaacg

SEQ ID NO: 295394 - DNA, 25 bp, Homo sapien
ggcaacgttttaagtcagaccatct

SEQ ID NO: 295395 - DNA, 25 bp, Homo sapien
agtcagaccatctggaatgtctcca

SEQ ID NO: 295396 - DNA, 25 bp, Homo sapien
tgagaaacactcagacagtctgttt

SEQ ID NO: 295397 - DNA, 25 bp, Homo sapien
agaagtcctagcagctgtcattgct

SEQ ID NO: 295398 - DNA, 25 bp, Homo sapien
gctgtcattgctggtggagttattg

SEQ ID NO: 295399 - DNA, 25 bp, Homo sapien
ggagttattggctttctctttgcaa

SEQ ID NO: 295400 - DNA, 25 bp, Homo sapien
tggctttctctttgcaatttttctt

SEQ ID NO: 295401 - DNA, 25 bp, Homo sapien
tatcctgctgttggtgtatcgcatg

SEQ ID NO: 295402 - DNA, 25 bp, Homo sapien
gaagctatgaccttggagaacgcaa

SEQ ID NO: 295403 - DNA, 25 bp, Homo sapien
ggagaacgcaaaccatccagtgctg

SEQ ID NO: 295404 - DNA, 25 bp, Homo sapien
aaccatccagtgctgcttatcagaa

SEQ ID NO: 295405 - DNA, 25 bp, Homo sapien
gaaggcacctactaaggagttttat

SEQ ID NO: 295406 - DNA, 25 bp, Homo sapien
gtaaaactccaacttagtgtctcta

SEQ ID NO: 295407 - DNA, 25 bp, Homo sapien
gccacttgcccttgactttacactt

SEQ ID NO: 295408 - DNA, 25 bp, Homo sapien
gactttacacttccgccgaagccta

SEQ ID NO: 295409 - DNA, 25 bp, Homo sapien
gaagcctacgaacttgccaaccgga

SEQ ID NO: 295410 - DNA, 25 bp, Homo sapien
cgaacttgccaaccggaaacaaatg

SEQ ID NO: 295411 - DNA, 25 bp, Homo sapien
ggaacgaattttgttcagcaactac

SEQ ID NO: 295412 - DNA, 25 bp, Homo sapien
tcagcaactacaaaaggcagatgtg

SEQ ID NO: 295413 - DNA, 25 bp, Homo sapien
gttgcagaacaattcggtgcccgct

SEQ ID NO: 295414 - DNA, 25 bp, Homo sapien
agaacaattcggtgcccgctgccgc

SEQ ID NO: 295415 - DNA, 25 bp, Homo sapien
tgccgctcgttgtgctgaggacgaa

SEQ ID NO: 295416 - DNA, 25 bp, Homo sapien
ttgtgctgaggacgaacggcgctgc

SEQ ID NO: 295417 - DNA, 25 bp, Homo sapien
gaacccacagaggttttggaggagt

SEQ ID NO: 295418 - DNA, 25 bp, Homo sapien
aaatctggggtgtttctcactgagc

SEQ ID NO: 295419 - DNA, 25 bp, Homo sapien
agctcagccagtgctatgccaatga

SEQ ID NO: 295420 - DNA, 25 bp, Homo sapien
ctcagccagtgctatgccaatgaag

SEQ ID NO: 295421 - DNA, 25 bp, Homo sapien
gccaatgaagtgaactaaattctct

SEQ ID NO: 295422 - DNA, 25 bp, Homo sapien
ctaaattctctggttctttgtggaa

SEQ ID NO: 295423 - DNA, 25 bp, Homo sapien
accccactcgaacttctgtgcaaga

SEQ ID NO: 295424 - DNA, 25 bp, Homo sapien
gtgcaagagccagaggaccagtgat

SEQ ID NO: 295425 - DNA, 25 bp, Homo sapien
cagaggaccagtgattactcgtggg

SEQ ID NO: 295426 - DNA, 25 bp, Homo sapien
cattaaactcttgactgaaatggtt

SEQ ID NO: 295427 - DNA, 25 bp, Homo sapien
caatgttagaatgacatggtttcac

SEQ ID NO: 295428 - DNA, 25 bp, Homo sapien
gacatggtttcacatttaacagtta

SEQ ID NO: 295429 - DNA, 25 bp, Homo sapien
ttaactgggtggatgttggtttcat

SEQ ID NO: 295430 - DNA, 25 bp, Homo sapien
gtggatgttggtttcatttactaaa

SEQ ID NO: 295431 - DNA, 25 bp, Homo sapien
acaaactcaatgttagccagtctga

SEQ ID NO: 295432 - DNA, 25 bp, Homo sapien
tagccagtctgagtcacaggtatct

SEQ ID NO: 295433 - DNA, 25 bp, Homo sapien
aacaacagaccctgggccattttct

SEQ ID NO: 295434 - DNA, 25 bp, Homo sapien
cacaggtatctgtggaggaccttaa

SEQ ID NO: 295435 - DNA, 25 bp, Homo sapien
aaaagcaaatgtaacagcacagttt

SEQ ID NO: 295436 - DNA, 25 bp, Homo sapien
gggccattttcttgagagctatctg

SEQ ID NO: 295437 - DNA, 25 bp, Homo sapien
agctatctggatgtaaaatttgtgg

SEQ ID NO: 295438 - DNA, 25 bp, Homo sapien
aatttgtgggtactgcttaccaact

SEQ ID NO: 295439 - DNA, 25 bp, Homo sapien
ggtactgcttaccaactggataagg

SEQ ID NO: 295440 - DNA, 25 bp, Homo sapien
acatagtagaaagtgggccccaatt

SEQ ID NO: 295441 - DNA, 25 bp, Homo sapien
tattctctacaatacatgtcagcta

SEQ ID NO: 295442 - DNA, 25 bp, Homo sapien
atgtcagctaacaaatggaactttc

SEQ ID NO: 295443 - DNA, 25 bp, Homo sapien
ggtttggttaatttgtcctgcagca

SEQ ID NO: 295444 - DNA, 25 bp, Homo sapien
gaaattttcttcttgtcacttccaa

SEQ ID NO: 295445 - DNA, 25 bp, Homo sapien
cacttccaacactgaattgtgatat

SEQ ID NO: 295446 - DNA, 25 bp, Homo sapien
gcctttaacaggacattcttgatca

SEQ ID NO: 295447 - DNA, 25 bp, Homo sapien
gcatcgtccctgattaacatcgtga

SEQ ID NO: 295448 - DNA, 25 bp, Homo sapien
gatattaagccattcactgtgtcct

SEQ ID NO: 295449 - DNA, 25 bp, Homo sapien
cactgtgtcctgtaacagtctctaa

SEQ ID NO: 295450 - DNA, 25 bp, Homo sapien
gtaacagtctctaatcgttcataaa

SEQ ID NO: 295451 - DNA, 25 bp, Homo sapien
agccgaaggccgagcccgtgtccag

SEQ ID NO: 295452 - DNA, 25 bp, Homo sapien
gaggcctccagtctcggccagaaag

SEQ ID NO: 295453 - DNA, 25 bp, Homo sapien
ccagtctcggccagaaagacctgga

SEQ ID NO: 295454 - DNA, 25 bp, Homo sapien
ggagaagacaatgcggtctcctctc

SEQ ID NO: 295455 - DNA, 25 bp, Homo sapien
aagacaatgcggtctcctctccagg

SEQ ID NO: 295456 - DNA, 25 bp, Homo sapien
gcggactcgcgacaacttcaccaag

SEQ ID NO: 295457 - DNA, 25 bp, Homo sapien
accaaggcgccgtcgtgggaggcga

SEQ ID NO: 295458 - DNA, 25 bp, Homo sapien
gcggtctcctctccaggcagttaga

SEQ ID NO: 295459 - DNA, 25 bp, Homo sapien
ctctccaggcagttagaccgcaaag

SEQ ID NO: 295460 - DNA, 25 bp, Homo sapien
gttagaccgcaaagcctcggctcag

SEQ ID NO: 295461 - DNA, 25 bp, Homo sapien
gtgaaggccgcgtggagccgaaggc

SEQ ID NO: 295462 - DNA, 25 bp, Homo sapien
gtcctgggcgagtatgaccgatcat

SEQ ID NO: 295463 - DNA, 25 bp, Homo sapien
tgaccgatcatcaaacgcagagccc

SEQ ID NO: 295464 - DNA, 25 bp, Homo sapien
aaacgcagagcccttgcaggttctg

SEQ ID NO: 295465 - DNA, 25 bp, Homo sapien
ttgcaggttctgtccgtctctcggg

SEQ ID NO: 295466 - DNA, 25 bp, Homo sapien
attacacaccctagctggaactcta

SEQ ID NO: 295467 - DNA, 25 bp, Homo sapien
aacaatgacgtgacgctgctgaagc

SEQ ID NO: 295468 - DNA, 25 bp, Homo sapien
tacacaacacgcatctcgccagttt

SEQ ID NO: 295469 - DNA, 25 bp, Homo sapien
agtttgcctggcatcctcaaacgag

SEQ ID NO: 295470 - DNA, 25 bp, Homo sapien
cctcaaacgaggctctgactgaagg

SEQ ID NO: 295471 - DNA, 25 bp, Homo sapien
tgactgaaggcctcacgtgtgtcac

SEQ ID NO: 295472 - DNA, 25 bp, Homo sapien
cctcagtggcgtgggcaatgtgaca

SEQ ID NO: 295473 - DNA, 25 bp, Homo sapien
tggagtctaaacaagcagtcggtat

SEQ ID NO: 295474 - DNA, 25 bp, Homo sapien
aacaagcagtcggtattgaatacta

SEQ ID NO: 295475 - DNA, 25 bp, Homo sapien
tactaatatctgagaagacctaggt

SEQ ID NO: 295476 - DNA, 25 bp, Homo sapien
aagacctaggttttcatcaccctga

SEQ ID NO: 295477 - DNA, 25 bp, Homo sapien
caccctgaaaattttggatgatagc

SEQ ID NO: 295478 - DNA, 25 bp, Homo sapien
attatcagtttggtacactgttgaa

SEQ ID NO: 295479 - DNA, 25 bp, Homo sapien
agaattatccattctgaagtttaat

SEQ ID NO: 295480 - DNA, 25 bp, Homo sapien
agctctcttgttggcctcattgtat

SEQ ID NO: 295481 - DNA, 25 bp, Homo sapien
cttgttggcctcattgtattattaa

SEQ ID NO: 295482 - DNA, 25 bp, Homo sapien
tattaatgagccttgactttttcaa

SEQ ID NO: 295483 - DNA, 25 bp, Homo sapien
ttcaacaaatgttgtggagtctaaa

SEQ ID NO: 295484 - DNA, 25 bp, Homo sapien
gggaatattctacatactgcttact

SEQ ID NO: 295485 - DNA, 25 bp, Homo sapien
tattctacatactgcttactttctc

SEQ ID NO: 295486 - DNA, 25 bp, Homo sapien
gcttactttctctataaaactcatc

SEQ ID NO: 295487 - DNA, 25 bp, Homo sapien
gaaaggcactgagttttgtaaatca

SEQ ID NO: 295488 - DNA, 25 bp, Homo sapien
tgtaaatcaggaccctaaatgttta

SEQ ID NO: 295489 - DNA, 25 bp, Homo sapien
atcaggaccctaaatgtttaattgt

SEQ ID NO: 295490 - DNA, 25 bp, Homo sapien
aattattatagctttgcgttgaagt

SEQ ID NO: 295491 - DNA, 25 bp, Homo sapien
agctttgcgttgaagtttgttgttt

SEQ ID NO: 295492 - DNA, 25 bp, Homo sapien
ataactctgtattgtagattatgca

SEQ ID NO: 295493 - DNA, 25 bp, Homo sapien
gatctttacaggcataaatatttaa

SEQ ID NO: 295494 - DNA, 25 bp, Homo sapien
taaactgtaatatgctaacttgaag

SEQ ID NO: 295495 - DNA, 25 bp, Homo sapien
aagaggctactgtacttatttttat

SEQ ID NO: 295496 - DNA, 25 bp, Homo sapien
gactacattaggtctttttcacggg

SEQ ID NO: 295497 - DNA, 25 bp, Homo sapien
cattaggtctttttcacgggaagct

SEQ ID NO: 295498 - DNA, 25 bp, Homo sapien
taggtctttttcacgggaagctgtt

SEQ ID NO: 295499 - DNA, 25 bp, Homo sapien
tcacgggaagctgttgttttctttc

SEQ ID NO: 295500 - DNA, 25 bp, Homo sapien
aagctgttgttttctttccgtctca

SEQ ID NO: 295501 - DNA, 25 bp, Homo sapien
ttctttccgtctcattactgtataa

SEQ ID NO: 295502 - DNA, 25 bp, Homo sapien
tactgtataagagtttccttaccct

SEQ ID NO: 295503 - DNA, 25 bp, Homo sapien
tataagagtttccttaccctttatg

SEQ ID NO: 295504 - DNA, 25 bp, Homo sapien
gagtttccttaccctttatgtattg

SEQ ID NO: 295505 - DNA, 25 bp, Homo sapien
ggataattaagtttttgcagatctt

SEQ ID NO: 295506 - DNA, 25 bp, Homo sapien
aggaacctttcttcagcctacagct

SEQ ID NO: 295507 - DNA, 25 bp, Homo sapien
tacagctcactctccagcaggaaac

SEQ ID NO: 295508 - DNA, 25 bp, Homo sapien
agctcactctccagcaggaaaccag

SEQ ID NO: 295509 - DNA, 25 bp, Homo sapien
aaccaggtgcaagctgggaaacagt

SEQ ID NO: 295510 - DNA, 25 bp, Homo sapien
gtgcaagctgggaaacagtcccaca

SEQ ID NO: 295511 - DNA, 25 bp, Homo sapien
ctgggaaacagtcccacattcctta

SEQ ID NO: 295512 - DNA, 25 bp, Homo sapien
ttacagccagcaacggccctctgga

SEQ ID NO: 295513 - DNA, 25 bp, Homo sapien
ctctggaccagggccaatgaaccag

SEQ ID NO: 295514 - DNA, 25 bp, Homo sapien
aatgaaccagggacctcaacaatca

SEQ ID NO: 295515 - DNA, 25 bp, Homo sapien
atgaaccagggacctcaacaatcac

SEQ ID NO: 295516 - DNA, 25 bp, Homo sapien
ccagcaaccccttacatctttacca

SEQ ID NO: 295517 - DNA, 25 bp, Homo sapien
ggaagatttcacttataagagcaaa

SEQ ID NO: 295518 - DNA, 25 bp, Homo sapien
taagagcaaaactaacggatatatt

SEQ ID NO: 295519 - DNA, 25 bp, Homo sapien
atatattagaagttgtgcggacatg

SEQ ID NO: 295520 - DNA, 25 bp, Homo sapien
tgtgcggacatgtgacacagattcc

SEQ ID NO: 295521 - DNA, 25 bp, Homo sapien
tttttcccagaagatctacagaatt

SEQ ID NO: 295522 - DNA, 25 bp, Homo sapien
caaaaagagattatccctacacctt

SEQ ID NO: 295523 - DNA, 25 bp, Homo sapien
aagagattatccctacaccttccac

SEQ ID NO: 295524 - DNA, 25 bp, Homo sapien
ccccatgacccaagcaatgaaggat

SEQ ID NO: 295525 - DNA, 25 bp, Homo sapien
ggaaagtgggagtctgtttgcaaaa

SEQ ID NO: 295526 - DNA, 25 bp, Homo sapien
aacagcagagtgaatgatttgaaac

SEQ ID NO: 295527 - DNA, 25 bp, Homo sapien
gcttttccaataacccttgtggaag

SEQ ID NO: 295528 - DNA, 25 bp, Homo sapien
ggtcaacacttgagcgtacaatatc

SEQ ID NO: 295529 - DNA, 25 bp, Homo sapien
cacttgagcgtacaatatcttgaac

SEQ ID NO: 295530 - DNA, 25 bp, Homo sapien
ctttcgccactcacggaccttgagg

SEQ ID NO: 295531 - DNA, 25 bp, Homo sapien
actcacggaccttgaggccagttga

SEQ ID NO: 295532 - DNA, 25 bp, Homo sapien
cacggaccttgaggccagttgacgg

SEQ ID NO: 295533 - DNA, 25 bp, Homo sapien
ttgaggccagttgacggcccttctc

SEQ ID NO: 295534 - DNA, 25 bp, Homo sapien
ttggctcctgattccctctctggtc

SEQ ID NO: 295535 - DNA, 25 bp, Homo sapien
tctctggtccctgtattggtcaaca

SEQ ID NO: 295536 - DNA, 25 bp, Homo sapien
tggtccctgtattggtcaacacttg

SEQ ID NO: 295537 - DNA, 25 bp, Homo sapien
gtccctgtattggtcaacacttgag

SEQ ID NO: 295538 - DNA, 25 bp, Homo sapien
gtattggtcaacacttgagcgtaca

SEQ ID NO: 295539 - DNA, 25 bp, Homo sapien
ccttattaccataatctagcctgat

SEQ ID NO: 295540 - DNA, 25 bp, Homo sapien
ctagcctgattcctgtcagagagtg

SEQ ID NO: 295541 - DNA, 25 bp, Homo sapien
gagagtggaactcgagacctctgat

SEQ ID NO: 295542 - DNA, 25 bp, Homo sapien
gagacctctgataatccacatggcc

SEQ ID NO: 295543 - DNA, 25 bp, Homo sapien
ctctgataatccacatggccatgga

SEQ ID NO: 295544 - DNA, 25 bp, Homo sapien
gccatggagtagagctgtgcctgcc

SEQ ID NO: 295545 - DNA, 25 bp, Homo sapien
gctgtgcctgccaagaatgccaata

SEQ ID NO: 295546 - DNA, 25 bp, Homo sapien
ttcttctgtcaatccatattcttta

SEQ ID NO: 295547 - DNA, 25 bp, Homo sapien
aatttactagtttctcctgtgttct

SEQ ID NO: 295548 - DNA, 25 bp, Homo sapien
gctttgtgttttactggtcttgcct

SEQ ID NO: 295549 - DNA, 25 bp, Homo sapien
tttactggtcttgccttggataata

SEQ ID NO: 295550 - DNA, 25 bp, Homo sapien
tacgctatgtagacgctgatcccag

SEQ ID NO: 295551 - DNA, 25 bp, Homo sapien
ctgatcccagcgagggtcaccatgg

SEQ ID NO: 295552 - DNA, 25 bp, Homo sapien
cgagggtcaccatggctccaaagag

SEQ ID NO: 295553 - DNA, 25 bp, Homo sapien
agggaccagccgaagctgatgtcca

SEQ ID NO: 295554 - DNA, 25 bp, Homo sapien
aaccatcaggatcaggctgagcggc

SEQ ID NO: 295555 - DNA, 25 bp, Homo sapien
gctgagcggcagcagaatcacaaat

SEQ ID NO: 295556 - DNA, 25 bp, Homo sapien
gaatcacaaatgtcccatgcatggt

SEQ ID NO: 295557 - DNA, 25 bp, Homo sapien
aatgtcccatgcatggtgagaagtt

SEQ ID NO: 295558 - DNA, 25 bp, Homo sapien
agctgatgtccacctggtccaggag

SEQ ID NO: 295559 - DNA, 25 bp, Homo sapien
agacacagcgcctcccggaaggcgg

SEQ ID NO: 295560 - DNA, 25 bp, Homo sapien
aaggcggcggctgaatacgctatgt

SEQ ID NO: 295561 - DNA, 25 bp, Homo sapien
tcttcatcctcactaacaatttggt

SEQ ID NO: 295562 - DNA, 25 bp, Homo sapien
ttctctgcttatgggcggtattaga

SEQ ID NO: 295563 - DNA, 25 bp, Homo sapien
gggcggtattagattttcattgata

SEQ ID NO: 295564 - DNA, 25 bp, Homo sapien
tgtctcgtctccacagtaccctttt

SEQ ID NO: 295565 - DNA, 25 bp, Homo sapien
agtacccttttcactgtcacaagaa

SEQ ID NO: 295566 - DNA, 25 bp, Homo sapien
gtgccaccgaagaaaagtaatgact

SEQ ID NO: 295567 - DNA, 25 bp, Homo sapien
tgtacttattttgtcagtttgtaac

SEQ ID NO: 295568 - DNA, 25 bp, Homo sapien
gggagtctaagtcttcatagtctaa

SEQ ID NO: 295569 - DNA, 25 bp, Homo sapien
gtctaatgtccaagtgggttgcact

SEQ ID NO: 295570 - DNA, 25 bp, Homo sapien
gggttgcactagatgtagacacttg

SEQ ID NO: 295571 - DNA, 25 bp, Homo sapien
gacacttggaggcttacttttcatg

SEQ ID NO: 295572 - DNA, 25 bp, Homo sapien
tttgccctcacgtcagttgtacatg

SEQ ID NO: 295573 - DNA, 25 bp, Homo sapien
tcacgtcagttgtacatggcatgga

SEQ ID NO: 295574 - DNA, 25 bp, Homo sapien
tacatggcatggaactttaaaaatt

SEQ ID NO: 295575 - DNA, 25 bp, Homo sapien
taaactttcatccagttagcttcat

SEQ ID NO: 295576 - DNA, 25 bp, Homo sapien
agcttcataacttttacgttccaga

SEQ ID NO: 295577 - DNA, 25 bp, Homo sapien
ttattttcctgtcaatgaaagcaat

SEQ ID NO: 295578 - DNA, 25 bp, Homo sapien
taaagataccagtgggacaggtttg

SEQ ID NO: 295579 - DNA, 25 bp, Homo sapien
aaaaatctcatgtgttcaaattaac

SEQ ID NO: 295580 - DNA, 25 bp, Homo sapien
tttcagtgattttgtgagatcagct

SEQ ID NO: 295581 - DNA, 25 bp, Homo sapien
gtgagatcagctgaaccacttatga

SEQ ID NO: 295582 - DNA, 25 bp, Homo sapien
cagctgaaccacttatgataataat

SEQ ID NO: 295583 - DNA, 25 bp, Homo sapien
agggagatccctatggcgttagtct

SEQ ID NO: 295584 - DNA, 25 bp, Homo sapien
tggcgttagtcttcccaggccttaa

SEQ ID NO: 295585 - DNA, 25 bp, Homo sapien
ttaaagggcccttgtcttcactcac

SEQ ID NO: 295586 - DNA, 25 bp, Homo sapien
ttcactcacaaacctcttatctctt

SEQ ID NO: 295587 - DNA, 25 bp, Homo sapien
tcttctccttcctctacattttaaa

SEQ ID NO: 295588 - DNA, 25 bp, Homo sapien
agtgtgatccctggcacgcactgac

SEQ ID NO: 295589 - DNA, 25 bp, Homo sapien
aaccgggagacaaattgagccacat

SEQ ID NO: 295590 - DNA, 25 bp, Homo sapien
attttcagacacttgttaccatatt

SEQ ID NO: 295591 - DNA, 25 bp, Homo sapien
aggcacacggactggctatttatca

SEQ ID NO: 295592 - DNA, 25 bp, Homo sapien
ggctatttatcaccacttctttttc

SEQ ID NO: 295593 - DNA, 25 bp, Homo sapien
tttttccccactaagattcctgtgc

SEQ ID NO: 295594 - DNA, 25 bp, Homo sapien
aagcctgcattctgaacacttgttg

SEQ ID NO: 295595 - DNA, 25 bp, Homo sapien
atagtatttggtgcttctggtcgtc

SEQ ID NO: 295596 - DNA, 25 bp, Homo sapien
gtgcttctggtcgtcaccatgtcct

SEQ ID NO: 295597 - DNA, 25 bp, Homo sapien
acatcccctgcatagtgcaacataa

SEQ ID NO: 295598 - DNA, 25 bp, Homo sapien
gagaactagtatatggacccaacaa

SEQ ID NO: 295599 - DNA, 25 bp, Homo sapien
acaaagcttcaggaggaccttgtta

SEQ ID NO: 295600 - DNA, 25 bp, Homo sapien
caggaggaccttgttagacccaatt

SEQ ID NO: 295601 - DNA, 25 bp, Homo sapien
ttgttagacccaattaaagccatat

SEQ ID NO: 295602 - DNA, 25 bp, Homo sapien
gaaagcagcaccagtatccacagga

SEQ ID NO: 295603 - DNA, 25 bp, Homo sapien
atccatggagttctcaagggccact

SEQ ID NO: 295604 - DNA, 25 bp, Homo sapien
aagggccactcaaaaaagcctgcat

SEQ ID NO: 295605 - DNA, 25 bp, Homo sapien
tttgtgaaagtccttctctagcctt

SEQ ID NO: 295606 - DNA, 25 bp, Homo sapien
agccttgcgtgagcctttctaaaaa

SEQ ID NO: 295607 - DNA, 25 bp, Homo sapien
aaaaattttctttcaccagctcact

SEQ ID NO: 295608 - DNA, 25 bp, Homo sapien
tgtctcccattctcagctcaaggag

SEQ ID NO: 295609 - DNA, 25 bp, Homo sapien
gaaatgtttctctttgctcaaggcc

SEQ ID NO: 295610 - DNA, 25 bp, Homo sapien
gctcaaggccttgtttgcctgttaa

SEQ ID NO: 295611 - DNA, 25 bp, Homo sapien
ctgttaaccttcagaagccactctg

SEQ ID NO: 295612 - DNA, 25 bp, Homo sapien
tgctcccagaatccctttcttagaa

SEQ ID NO: 295613 - DNA, 25 bp, Homo sapien
tagaaaaagcccatccgttgctctg

SEQ ID NO: 295614 - DNA, 25 bp, Homo sapien
ccatccgttgctctgtaagactaac

SEQ ID NO: 295615 - DNA, 25 bp, Homo sapien
aagactaaccaagcgcgactttctc

SEQ ID NO: 295616 - DNA, 25 bp, Homo sapien
agaagccgtcagtggactcgggaaa

SEQ ID NO: 295617 - DNA, 25 bp, Homo sapien
agtggactcgggaaaaagtgtctct

SEQ ID NO: 295618 - DNA, 25 bp, Homo sapien
aaaagtgtctcttagacctggcgct

SEQ ID NO: 295619 - DNA, 25 bp, Homo sapien
gtctcttagacctggcgctcggcgg

SEQ ID NO: 295620 - DNA, 25 bp, Homo sapien
agggcgtgcacctctcttgcagttt

SEQ ID NO: 295621 - DNA, 25 bp, Homo sapien
gggcgttttcagtcgaataaacttg

SEQ ID NO: 295622 - DNA, 25 bp, Homo sapien
tcgaataaacttgcgaccgccacgt

SEQ ID NO: 295623 - DNA, 25 bp, Homo sapien
ataaacttgcgaccgccacgtgtgg

SEQ ID NO: 295624 - DNA, 25 bp, Homo sapien
gccacgtgtggcatctttccaaggg

SEQ ID NO: 295625 - DNA, 25 bp, Homo sapien
acgtgtggcatctttccaagggagc

SEQ ID NO: 295626 - DNA, 25 bp, Homo sapien
atctttccaagggagccggctcaga

SEQ ID NO: 295627 - DNA, 25 bp, Homo sapien
agctttccataattcactgcactta

SEQ ID NO: 295628 - DNA, 25 bp, Homo sapien
gttacaggttaggaagatggtcttt

SEQ ID NO: 295629 - DNA, 25 bp, Homo sapien
tatagtgtagacatacccttcatct

SEQ ID NO: 295630 - DNA, 25 bp, Homo sapien
atacccttcatctattatatcataa

SEQ ID NO: 295631 - DNA, 25 bp, Homo sapien
aaatgcctggttctgaagggtcacg

SEQ ID NO: 295632 - DNA, 25 bp, Homo sapien
acatgttacattggactgaattaga

SEQ ID NO: 295633 - DNA, 25 bp, Homo sapien
ttttcccatttctaatagttggcac

SEQ ID NO: 295634 - DNA, 25 bp, Homo sapien
aatagttggcaccattataagctat

SEQ ID NO: 295635 - DNA, 25 bp, Homo sapien
gggctgtcaacaggtgttccttact

SEQ ID NO: 295636 - DNA, 25 bp, Homo sapien
acaggtgttccttactcataattga

SEQ ID NO: 295637 - DNA, 25 bp, Homo sapien
tcaaacctttaagttagctttccat

SEQ ID NO: 295638 - DNA, 25 bp, Homo sapien
atgtatatttcactctaaaggaaga

SEQ ID NO: 295639 - DNA, 25 bp, Homo sapien
aatgtaatctcattgaagctgattt

SEQ ID NO: 295640 - DNA, 25 bp, Homo sapien
ttatatactatgcttgaatgtcaat

SEQ ID NO: 295641 - DNA, 25 bp, Homo sapien
ctttctacagaaaggctttgacctc

SEQ ID NO: 295642 - DNA, 25 bp, Homo sapien
gaaaggctttgacctcaacatgctt

SEQ ID NO: 295643 - DNA, 25 bp, Homo sapien
ggctttgacctcaacatgctttatt

SEQ ID NO: 295644 - DNA, 25 bp, Homo sapien
tgacctcaacatgctttatttaatg

SEQ ID NO: 295645 - DNA, 25 bp, Homo sapien
acatgcttctgtctgcataccatca

SEQ ID NO: 295646 - DNA, 25 bp, Homo sapien
ttctgtctgcataccatcactgttt

SEQ ID NO: 295647 - DNA, 25 bp, Homo sapien
gtctgcataccatcactgtttgttg

SEQ ID NO: 295648 - DNA, 25 bp, Homo sapien
gcataccatcactgtttgttgctaa

SEQ ID NO: 295649 - DNA, 25 bp, Homo sapien
tcaggaattagaccacgtaacaatt

SEQ ID NO: 295650 - DNA, 25 bp, Homo sapien
attgtcgaagactttgaaactgcat

SEQ ID NO: 295651 - DNA, 25 bp, Homo sapien
gaaactgcatagtagattgtgacat

SEQ ID NO: 295652 - DNA, 25 bp, Homo sapien
gattgtgacattggagctttttgtt

SEQ ID NO: 295653 - DNA, 25 bp, Homo sapien
agctttttgttgtgctcattagaaa

SEQ ID NO: 295654 - DNA, 25 bp, Homo sapien
gaaagcagggtctgaaactcagcct

SEQ ID NO: 295655 - DNA, 25 bp, Homo sapien
aactcagcctgtgtagcaagcacgg

SEQ ID NO: 295656 - DNA, 25 bp, Homo sapien
aagcacgggtggctcacaagcagaa

SEQ ID NO: 295657 - DNA, 25 bp, Homo sapien
atctccctctcaaggccttaaacag

SEQ ID NO: 295658 - DNA, 25 bp, Homo sapien
aacaggtatgagttgattatagcca

SEQ ID NO: 295659 - DNA, 25 bp, Homo sapien
tgattatagccaatgtttacttttc

SEQ ID NO: 295660 - DNA, 25 bp, Homo sapien
tgcgcaccaggaacgtgtctgggct

SEQ ID NO: 295661 - DNA, 25 bp, Homo sapien
aggaacgtgtctgggctactgcctt

SEQ ID NO: 295662 - DNA, 25 bp, Homo sapien
ctcacagagcagcattcatgttctt

SEQ ID NO: 295663 - DNA, 25 bp, Homo sapien
ctgcctaaagtaaactcgggattgt

SEQ ID NO: 295664 - DNA, 25 bp, Homo sapien
ttctgagactcagtcaggcagtgga

SEQ ID NO: 295665 - DNA, 25 bp, Homo sapien
gcagtggagtttctttaacaagata

SEQ ID NO: 295666 - DNA, 25 bp, Homo sapien
gaatggttgagtccactgctaccgt

SEQ ID NO: 295667 - DNA, 25 bp, Homo sapien
aaactcgggattgtgagcagtgcac

SEQ ID NO: 295668 - DNA, 25 bp, Homo sapien
tgagcagtgcacgtggttcattact

SEQ ID NO: 295669 - DNA, 25 bp, Homo sapien
gagcaatagcagttctactccaaat

SEQ ID NO: 295670 - DNA, 25 bp, Homo sapien
gttctactccaaatccatggctgcg

SEQ ID NO: 295671 - DNA, 25 bp, Homo sapien
tagaaatataattctttataggact

SEQ ID NO: 295672 - DNA, 25 bp, Homo sapien
agaaatataattctttataggactt

SEQ ID NO: 295673 - DNA, 25 bp, Homo sapien
gaaatataattctttataggacttc

SEQ ID NO: 295674 - DNA, 25 bp, Homo sapien
aatataattctttataggacttcct

SEQ ID NO: 295675 - DNA, 25 bp, Homo sapien
atataattctttataggacttcctg

SEQ ID NO: 295676 - DNA, 25 bp, Homo sapien
tataattctttataggacttcctgg

SEQ ID NO: 295677 - DNA, 25 bp, Homo sapien
ataattctttataggacttcctggt

SEQ ID NO: 295678 - DNA, 25 bp, Homo sapien
taattctttataggacttcctggtc

SEQ ID NO: 295679 - DNA, 25 bp, Homo sapien
aattctttataggacttcctggtca

SEQ ID NO: 295680 - DNA, 25 bp, Homo sapien
attctttataggacttcctggtcaa

SEQ ID NO: 295681 - DNA, 25 bp, Homo sapien
ttctttataggacttcctggtcaat

SEQ ID NO: 295682 - DNA, 25 bp, Homo sapien
tatatcccaatacccaatagcccag

SEQ ID NO: 295683 - DNA, 25 bp, Homo sapien
tacccaatagcccagtattcttaga

SEQ ID NO: 295684 - DNA, 25 bp, Homo sapien
agcccagtattcttagaatccagtt

SEQ ID NO: 295685 - DNA, 25 bp, Homo sapien
gaatccagttgtattcatactctcc

SEQ ID NO: 295686 - DNA, 25 bp, Homo sapien
gttgtattcatactctcctggatca

SEQ ID NO: 295687 - DNA, 25 bp, Homo sapien
ctcctggatcatttctgttcctttg

SEQ ID NO: 295688 - DNA, 25 bp, Homo sapien
ttgtaatatagtccctttcttccct

SEQ ID NO: 295689 - DNA, 25 bp, Homo sapien
cctttcttcccttataggctcatat

SEQ ID NO: 295690 - DNA, 25 bp, Homo sapien
ttcccttataggctcatatgacatt

SEQ ID NO: 295691 - DNA, 25 bp, Homo sapien
aaaaaattacctcatctaagtgcag

SEQ ID NO: 295692 - DNA, 25 bp, Homo sapien
actcttttatcccaatctatatccc

SEQ ID NO: 295693 - DNA, 25 bp, Homo sapien
ggcctctcaatcaaaatcccagtct

SEQ ID NO: 295694 - DNA, 25 bp, Homo sapien
tcaaaatcccagtctccagtcggtt

SEQ ID NO: 295695 - DNA, 25 bp, Homo sapien
ttcccctgccgcctgcttagaggag

SEQ ID NO: 295696 - DNA, 25 bp, Homo sapien
gaaacataaagcacaaggcttttct

SEQ ID NO: 295697 - DNA, 25 bp, Homo sapien
attatgaatcattccctgagggcag

SEQ ID NO: 295698 - DNA, 25 bp, Homo sapien
aatcattccctgagggcaggcccag

SEQ ID NO: 295699 - DNA, 25 bp, Homo sapien
ggcccagagtctgacctgtgaggta

SEQ ID NO: 295700 - DNA, 25 bp, Homo sapien
gacctgtgaggtagctagaaggctt

SEQ ID NO: 295701 - DNA, 25 bp, Homo sapien
aaggcttgagcctctcatcaaagtc

SEQ ID NO: 295702 - DNA, 25 bp, Homo sapien
tcaaagtcccccaggttgtttccag

SEQ ID NO: 295703 - DNA, 25 bp, Homo sapien
ggttgtttccagaaagaatcctgag

SEQ ID NO: 295704 - DNA, 25 bp, Homo sapien
gaagtaaccttataactgctctcta

SEQ ID NO: 295705 - DNA, 25 bp, Homo sapien
ataactgctctctagtctgccttat

SEQ ID NO: 295706 - DNA, 25 bp, Homo sapien
gtctgccttatttgtgtcatagagt

SEQ ID NO: 295707 - DNA, 25 bp, Homo sapien
gagtaagatattccttgaaagccca

SEQ ID NO: 295708 - DNA, 25 bp, Homo sapien
gcccattaagtggaatagactttct

SEQ ID NO: 295709 - DNA, 25 bp, Homo sapien
gaaaataagagttctttacctcagt

SEQ ID NO: 295710 - DNA, 25 bp, Homo sapien
ctcagtcctcctctaatttggttga

SEQ ID NO: 295711 - DNA, 25 bp, Homo sapien
aacactaatgctgttctgtctgctc

SEQ ID NO: 295712 - DNA, 25 bp, Homo sapien
gctgttctgtctgctcacaagagat

SEQ ID NO: 295713 - DNA, 25 bp, Homo sapien
gataccctctcatggaataaacacc

SEQ ID NO: 295714 - DNA, 25 bp, Homo sapien
taaacaccttgcttagaattcatat

SEQ ID NO: 295715 - DNA, 25 bp, Homo sapien
aacacttctgggtctttaatgtctt

SEQ ID NO: 295716 - DNA, 25 bp, Homo sapien
aatgtcttttctatggctatttgat

SEQ ID NO: 295717 - DNA, 25 bp, Homo sapien
agaattaatgcctgtattgttggac

SEQ ID NO: 295718 - DNA, 25 bp, Homo sapien
ttgtttccaagttttcaccattata

SEQ ID NO: 295719 - DNA, 25 bp, Homo sapien
tatattatattcttgccaggctgta

SEQ ID NO: 295720 - DNA, 25 bp, Homo sapien
ccaggctgtaagctttactagcaga

SEQ ID NO: 295721 - DNA, 25 bp, Homo sapien
aaaagaacgctgagctagatctagc

SEQ ID NO: 295722 - DNA, 25 bp, Homo sapien
gctagatctagcttctggctctgtg

SEQ ID NO: 295723 - DNA, 25 bp, Homo sapien
tggctctgtgtgtttattgaccagt

SEQ ID NO: 295724 - DNA, 25 bp, Homo sapien
tgtttattgaccagtggtgtgcctt

SEQ ID NO: 295725 - DNA, 25 bp, Homo sapien
ttcagttttgtctctgtgtaaatga

SEQ ID NO: 295726 - DNA, 25 bp, Homo sapien
aaaaaagtgcctcagagggcattaa

SEQ ID NO: 295727 - DNA, 25 bp, Homo sapien
gcctcagagggcattaaagatccac

SEQ ID NO: 295728 - DNA, 25 bp, Homo sapien
gcattaaagatccactctgccctgg

SEQ ID NO: 295729 - DNA, 25 bp, Homo sapien
tccccactcctgtgaccatttggga

SEQ ID NO: 295730 - DNA, 25 bp, Homo sapien
ccactcctgtgaccatttgggaggt

SEQ ID NO: 295731 - DNA, 25 bp, Homo sapien
tcctgtgaccatttgggaggtgcca

SEQ ID NO: 295732 - DNA, 25 bp, Homo sapien
ctgcagtgccgtgggtgcctgacca

SEQ ID NO: 295733 - DNA, 25 bp, Homo sapien
gggtacccaaccagggttgcagcca

SEQ ID NO: 295734 - DNA, 25 bp, Homo sapien
caaccagggttgcagccacaggaat

SEQ ID NO: 295735 - DNA, 25 bp, Homo sapien
aaccagggttgcagccacaggaatc

SEQ ID NO: 295736 - DNA, 25 bp, Homo sapien
tggtttccagggaacacaagggaat

SEQ ID NO: 295737 - DNA, 25 bp, Homo sapien
acagctgccttcagtgggtagaatg

SEQ ID NO: 295738 - DNA, 25 bp, Homo sapien
gggcccagctttggccttagcttga

SEQ ID NO: 295739 - DNA, 25 bp, Homo sapien
tttggccttagcttgacggcagggc

SEQ ID NO: 295740 - DNA, 25 bp, Homo sapien
gcccctgccattgcaggagggtttg

SEQ ID NO: 295741 - DNA, 25 bp, Homo sapien
aggagggtttggttcccactcagct

SEQ ID NO: 295742 - DNA, 25 bp, Homo sapien
tgggccaggcccttttcctgcatgt

SEQ ID NO: 295743 - DNA, 25 bp, Homo sapien
ttttcctgcatgtgccacctccagt

SEQ ID NO: 295744 - DNA, 25 bp, Homo sapien
aagagaccactctgtgccaagtcga

SEQ ID NO: 295745 - DNA, 25 bp, Homo sapien
tgtgccaagtcgactatgccttaga

SEQ ID NO: 295746 - DNA, 25 bp, Homo sapien
agtcgactatgccttagacacatcc

SEQ ID NO: 295747 - DNA, 25 bp, Homo sapien
actatgccttagacacatcctccta

SEQ ID NO: 295748 - DNA, 25 bp, Homo sapien
ctttggctccaaagggatactccta

SEQ ID NO: 295749 - DNA, 25 bp, Homo sapien
gatactcctatcacacacatcagtt

SEQ ID NO: 295750 - DNA, 25 bp, Homo sapien
cacacatcagttttcatcccaagag

SEQ ID NO: 295751 - DNA, 25 bp, Homo sapien
atcagttttcatcccaagagaccga

SEQ ID NO: 295752 - DNA, 25 bp, Homo sapien
aagagaccgatgcacatccttctcc

SEQ ID NO: 295753 - DNA, 25 bp, Homo sapien
atcattgacaagtcattgccccttc

SEQ ID NO: 295754 - DNA, 25 bp, Homo sapien
aagtcattgccccttccaaatgaca

SEQ ID NO: 295755 - DNA, 25 bp, Homo sapien
acaatccatttcctcccacgaatga

SEQ ID NO: 295756 - DNA, 25 bp, Homo sapien
ttccttgaactgtctaccctgttgc

SEQ ID NO: 295757 - DNA, 25 bp, Homo sapien
ctaccctgttgcttttcacaaatca

SEQ ID NO: 295758 - DNA, 25 bp, Homo sapien
gttgcttttcacaaatcatggtaat

SEQ ID NO: 295759 - DNA, 25 bp, Homo sapien
aagcagaacaacgtttcctcttcag

SEQ ID NO: 295760 - DNA, 25 bp, Homo sapien
agaacaacgtttcctcttcagcagt

SEQ ID NO: 295761 - DNA, 25 bp, Homo sapien
caacgtttcctcttcagcagtgatg

SEQ ID NO: 295762 - DNA, 25 bp, Homo sapien
cgtttcctcttcagcagtgatgcaa

SEQ ID NO: 295763 - DNA, 25 bp, Homo sapien
tgaattagtttcatatccgggtatt

SEQ ID NO: 295764 - DNA, 25 bp, Homo sapien
ttagtttcatatccgggtattttct

SEQ ID NO: 295765 - DNA, 25 bp, Homo sapien
aaacatcttgttttaggcagtcatt

SEQ ID NO: 295766 - DNA, 25 bp, Homo sapien
ggcagtcattttaaaactacactcc

SEQ ID NO: 295767 - DNA, 25 bp, Homo sapien
actacactccaaatatctgactaca

SEQ ID NO: 295768 - DNA, 25 bp, Homo sapien
caaatatctgactacaattcagcag

SEQ ID NO: 295769 - DNA, 25 bp, Homo sapien
caggccctaggtttctatactttga

SEQ ID NO: 295770 - DNA, 25 bp, Homo sapien
atagttgtttacttggattcataca

SEQ ID NO: 295771 - DNA, 25 bp, Homo sapien
gaacagggcagcaatcttggaaagc

SEQ ID NO: 295772 - DNA, 25 bp, Homo sapien
gcaatcttggaaagctttctgaagc

SEQ ID NO: 295773 - DNA, 25 bp, Homo sapien
tctgaagcttataagaacctgaagg

SEQ ID NO: 295774 - DNA, 25 bp, Homo sapien
gggaacagtaacaaaggctgccttt

SEQ ID NO: 295775 - DNA, 25 bp, Homo sapien
tgcctttatgtctttggtcacaaag

SEQ ID NO: 295776 - DNA, 25 bp, Homo sapien
gtgattgttataccagggcttcctg

SEQ ID NO: 295777 - DNA, 25 bp, Homo sapien
cagggcttcctgaccttcgggagag

SEQ ID NO: 295778 - DNA, 25 bp, Homo sapien
cctgaccttcgggagagactcaaaa

SEQ ID NO: 295779 - DNA, 25 bp, Homo sapien
gttaatttggttggcttgctttatc

SEQ ID NO: 295780 - DNA, 25 bp, Homo sapien
gaagagctgctttggtatagttgtt

SEQ ID NO: 295781 - DNA, 25 bp, Homo sapien
tgcccatgggctctttcaggactca

SEQ ID NO: 295782 - DNA, 25 bp, Homo sapien
ttcaggactcagctggcatggcatt

SEQ ID NO: 295783 - DNA, 25 bp, Homo sapien
agctggcatggcatttgtttgctga

SEQ ID NO: 295784 - DNA, 25 bp, Homo sapien
tgaaaggattcattcccggaccaaa

SEQ ID NO: 295785 - DNA, 25 bp, Homo sapien
ggaccaaactgcttccatagaacgt

SEQ ID NO: 295786 - DNA, 25 bp, Homo sapien
gcttccatagaacgtcacagtctca

SEQ ID NO: 295787 - DNA, 25 bp, Homo sapien
acagtctcagtcatttgcaccaagg

SEQ ID NO: 295788 - DNA, 25 bp, Homo sapien
gcaccaaggaggttgattccagaca

SEQ ID NO: 295789 - DNA, 25 bp, Homo sapien
gacaactcagtcacatcaattagca

SEQ ID NO: 295790 - DNA, 25 bp, Homo sapien
gggaagaatttacaagccaatcaaa

SEQ ID NO: 295791 - DNA, 25 bp, Homo sapien
agccaatcaaattatagtcctttat

SEQ ID NO: 295792 - DNA, 25 bp, Homo sapien
tgaatgcctacacaaactctccaat

SEQ ID NO: 295793 - DNA, 25 bp, Homo sapien
aaactctccaatttgttgcccatca

SEQ ID NO: 295794 - DNA, 25 bp, Homo sapien
gcccatcacgcgcagcaatgtggag

SEQ ID NO: 295795 - DNA, 25 bp, Homo sapien
agcaatgtggagtggcctcttcact

SEQ ID NO: 295796 - DNA, 25 bp, Homo sapien
ggcctcttcactcacttaacagaat

SEQ ID NO: 295797 - DNA, 25 bp, Homo sapien
aagggtctagatccaaattatacaa

SEQ ID NO: 295798 - DNA, 25 bp, Homo sapien
gagaggcatggctaccgaacacaga

SEQ ID NO: 295799 - DNA, 25 bp, Homo sapien
tggactatacttcaggacatcactc

SEQ ID NO: 295800 - DNA, 25 bp, Homo sapien
aagagatgttgctttcttactcaga

SEQ ID NO: 295801 - DNA, 25 bp, Homo sapien
tactcagacaagaaggcaggcccat

SEQ ID NO: 295802 - DNA, 25 bp, Homo sapien
ggcccatggttaatcttatccgtaa

SEQ ID NO: 295803 - DNA, 25 bp, Homo sapien
cttgcgattctgaatggcacctaca

SEQ ID NO: 295804 - DNA, 25 bp, Homo sapien
ttctgaatggcacctacagagatgc

SEQ ID NO: 295805 - DNA, 25 bp, Homo sapien
tccaaggatcattactgggcctgcg

SEQ ID NO: 295806 - DNA, 25 bp, Homo sapien
aaggatcattactgggcctgcgccg

SEQ ID NO: 295807 - DNA, 25 bp, Homo sapien
tcattactgggcctgcgccggttct

SEQ ID NO: 295808 - DNA, 25 bp, Homo sapien
agctggccctaccataatgcctttg

SEQ ID NO: 295809 - DNA, 25 bp, Homo sapien
taccataatgcctttgatcagacaa

SEQ ID NO: 295810 - DNA, 25 bp, Homo sapien
aaatacagaccgctgtcatgccaaa

SEQ ID NO: 295811 - DNA, 25 bp, Homo sapien
tgtcatgccaaacggaactcctcac

SEQ ID NO: 295812 - DNA, 25 bp, Homo sapien
tcctcacccaactgctgcaatagtt

SEQ ID NO: 295813 - DNA, 25 bp, Homo sapien
aactgctgcaatagttcctccaggg

SEQ ID NO: 295814 - DNA, 25 bp, Homo sapien
aatgtgtctcattcgctaggataat

SEQ ID NO: 295815 - DNA, 25 bp, Homo sapien
ggataattgtgccaactttcgttat

SEQ ID NO: 295816 - DNA, 25 bp, Homo sapien
gccaactttcgttataggaagccaa

SEQ ID NO: 295817 - DNA, 25 bp, Homo sapien
gaagccaaaagatcctatcagggta

SEQ ID NO: 295818 - DNA, 25 bp, Homo sapien
gatcctatcagggtagttatcagat

SEQ ID NO: 295819 - DNA, 25 bp, Homo sapien
ttttgtgtcacatacaacctgtatt

SEQ ID NO: 295820 - DNA, 25 bp, Homo sapien
tttaagaacttcctgtatcctcggc

SEQ ID NO: 295821 - DNA, 25 bp, Homo sapien
gtatcctcggcttcaaatatttcag

SEQ ID NO: 295822 - DNA, 25 bp, Homo sapien
tgtttcgacgggacaggaagtgtta

SEQ ID NO: 295823 - DNA, 25 bp, Homo sapien
ggaagtgttataggccaccatcttt

SEQ ID NO: 295824 - DNA, 25 bp, Homo sapien
gttataggccaccatctttaattag

SEQ ID NO: 295825 - DNA, 25 bp, Homo sapien
gtaacctcttgagatatcctgaaga

SEQ ID NO: 295826 - DNA, 25 bp, Homo sapien
gatatcctgaagaactatagagcta

SEQ ID NO: 295827 - DNA, 25 bp, Homo sapien
acagctagcatgcacttgtcgggct

SEQ ID NO: 295828 - DNA, 25 bp, Homo sapien
gagctatgttgtttctgaattcctg

SEQ ID NO: 295829 - DNA, 25 bp, Homo sapien
agcatgcacttgtcgggcttgtaag

SEQ ID NO: 295830 - DNA, 25 bp, Homo sapien
tgattcatacatcttgttagagttt

SEQ ID NO: 295831 - DNA, 25 bp, Homo sapien
gagtttgctcatgttatctgaggca

SEQ ID NO: 295832 - DNA, 25 bp, Homo sapien
tgtcgggcttgtaagccatttggaa

SEQ ID NO: 295833 - DNA, 25 bp, Homo sapien
ggtcccttcaccagtaacaattctg

SEQ ID NO: 295834 - DNA, 25 bp, Homo sapien
ttacagttctgctgacatctggact

SEQ ID NO: 295835 - DNA, 25 bp, Homo sapien
gacatctggactgtaacctcttgag

SEQ ID NO: 295836 - DNA, 25 bp, Homo sapien
aattattcattgtctcactgggtcc

SEQ ID NO: 295837 - DNA, 25 bp, Homo sapien
cactgggtcccagatgtaccaatgg

SEQ ID NO: 295838 - DNA, 25 bp, Homo sapien
ggtcccagatgtaccaatggaatgc

SEQ ID NO: 295839 - DNA, 25 bp, Homo sapien
ggtgaattcatattcttgagcctga

SEQ ID NO: 295840 - DNA, 25 bp, Homo sapien
tattcttgagcctgaagaggaggtt

SEQ ID NO: 295841 - DNA, 25 bp, Homo sapien
aattctcctttgcactttttccaag

SEQ ID NO: 295842 - DNA, 25 bp, Homo sapien
ctcctttgcactttttccaagagaa

SEQ ID NO: 295843 - DNA, 25 bp, Homo sapien
ttttcaatcaaggagcattacccgt

SEQ ID NO: 295844 - DNA, 25 bp, Homo sapien
atcaaggagcattacccgtgcatct

SEQ ID NO: 295845 - DNA, 25 bp, Homo sapien
attacccgtgcatctctatcaggta

SEQ ID NO: 295846 - DNA, 25 bp, Homo sapien
cgtgcatctctatcaggtaaacaag

SEQ ID NO: 295847 - DNA, 25 bp, Homo sapien
tgcctataccggacgccaggaatgt

SEQ ID NO: 295848 - DNA, 25 bp, Homo sapien
tataccggacgccaggaatgttctt

SEQ ID NO: 295849 - DNA, 25 bp, Homo sapien
caggaatgttcttctttgagtaaag

SEQ ID NO: 295850 - DNA, 25 bp, Homo sapien
ttctttgagtaaaggcagcctcacc

SEQ ID NO: 295851 - DNA, 25 bp, Homo sapien
cctggctctaggacctgaagaactc

SEQ ID NO: 295852 - DNA, 25 bp, Homo sapien
gctctaggacctgaagaactctcga

SEQ ID NO: 295853 - DNA, 25 bp, Homo sapien
tgaagaactctcgaaggacccagcc

SEQ ID NO: 295854 - DNA, 25 bp, Homo sapien
aagaactctcgaaggacccagccct

SEQ ID NO: 295855 - DNA, 25 bp, Homo sapien
tgagccaaggacaaccacacagaaa

SEQ ID NO: 295856 - DNA, 25 bp, Homo sapien
ggattgaagcggtgctcagccaggc

SEQ ID NO: 295857 - DNA, 25 bp, Homo sapien
aagcagggcctcttgggatttactc

SEQ ID NO: 295858 - DNA, 25 bp, Homo sapien
attttcacaaagctgatatttctgg

SEQ ID NO: 295859 - DNA, 25 bp, Homo sapien
tggcccttagaatatgatacctgtt

SEQ ID NO: 295860 - DNA, 25 bp, Homo sapien
ggacaaaattccttttcactgcagt

SEQ ID NO: 295861 - DNA, 25 bp, Homo sapien
aattccttttcactgcagtattggg

SEQ ID NO: 295862 - DNA, 25 bp, Homo sapien
gaaggagctgtcctgaggcttccat

SEQ ID NO: 295863 - DNA, 25 bp, Homo sapien
tactgggcttgaggcaagaacattg

SEQ ID NO: 295864 - DNA, 25 bp, Homo sapien
aagaacattgttagggacggcctgc

SEQ ID NO: 295865 - DNA, 25 bp, Homo sapien
aaaccatggaatctttggccatcta

SEQ ID NO: 295866 - DNA, 25 bp, Homo sapien
ggaatctttggccatctatgaaaca

SEQ ID NO: 295867 - DNA, 25 bp, Homo sapien
tttggccatctatgaaacaatttcc

SEQ ID NO: 295868 - DNA, 25 bp, Homo sapien
tggactgtattttcacaaagctgat

SEQ ID NO: 295869 - DNA, 25 bp, Homo sapien
atccccgataaaggaggaccagtct

SEQ ID NO: 295870 - DNA, 25 bp, Homo sapien
taaaggaggaccagtctcggtcaag

SEQ ID NO: 295871 - DNA, 25 bp, Homo sapien
ccagtctcggtcaagggtatatgag

SEQ ID NO: 295872 - DNA, 25 bp, Homo sapien
caagctttcaaataattggtgattc

SEQ ID NO: 295873 - DNA, 25 bp, Homo sapien
gattcttaagatacatggagctaac

SEQ ID NO: 295874 - DNA, 25 bp, Homo sapien
ggttagaatgatttcccaaacttct

SEQ ID NO: 295875 - DNA, 25 bp, Homo sapien
tttcccaaacttctcctagaaggag

SEQ ID NO: 295876 - DNA, 25 bp, Homo sapien
ggagactgtagtgccagaccatact

SEQ ID NO: 295877 - DNA, 25 bp, Homo sapien
agaccatactgtcaacttttagatg

SEQ ID NO: 295878 - DNA, 25 bp, Homo sapien
acttttagatgtgtggtgtgaccca

SEQ ID NO: 295879 - DNA, 25 bp, Homo sapien
gtgtgacccagagagacctgaattt

SEQ ID NO: 295880 - DNA, 25 bp, Homo sapien
gaagaataacctatcagtcacctaa

SEQ ID NO: 295881 - DNA, 25 bp, Homo sapien
taacctatcagtcacctaatgggca

SEQ ID NO: 295882 - DNA, 25 bp, Homo sapien
cagtcacctaatgggcaaagaacac

SEQ ID NO: 295883 - DNA, 25 bp, Homo sapien
gattaggaaatagctgtcacttata

SEQ ID NO: 295884 - DNA, 25 bp, Homo sapien
agctgtcacttatagttgaaagact

SEQ ID NO: 295885 - DNA, 25 bp, Homo sapien
aacaaatgtatgattctcttaggca

SEQ ID NO: 295886 - DNA, 25 bp, Homo sapien
aggcttgaaccattgactttaatag

SEQ ID NO: 295887 - DNA, 25 bp, Homo sapien
gattctcttaggcagctagaaaatt

SEQ ID NO: 295888 - DNA, 25 bp, Homo sapien
ggccattaaaatgtacatgctagtt

SEQ ID NO: 295889 - DNA, 25 bp, Homo sapien
tactgattactctgataattttggg

SEQ ID NO: 295890 - DNA, 25 bp, Homo sapien
atcaatacttggaacacagtctctt

SEQ ID NO: 295891 - DNA, 25 bp, Homo sapien
tttaccaaaagagtatcaaggccag

SEQ ID NO: 295892 - DNA, 25 bp, Homo sapien
taccaaaagagtatcaaggccagag

SEQ ID NO: 295893 - DNA, 25 bp, Homo sapien
cagagtggtgggtggcacatgctta

SEQ ID NO: 295894 - DNA, 25 bp, Homo sapien
ggcacatgcttataacagcactttg

SEQ ID NO: 295895 - DNA, 25 bp, Homo sapien
atgttgagaccctgtgtctagcaaa

SEQ ID NO: 295896 - DNA, 25 bp, Homo sapien
ctactcagtagtcttaggtgggaag

SEQ ID NO: 295897 - DNA, 25 bp, Homo sapien
ctcagtagtcttaggtgggaagatc

SEQ ID NO: 295898 - DNA, 25 bp, Homo sapien
aacctgggaggtccatgctgcaggg

SEQ ID NO: 295899 - DNA, 25 bp, Homo sapien
cagggagctgaattcgtgccagtgc

SEQ ID NO: 295900 - DNA, 25 bp, Homo sapien
agggagctgaattcgtgccagtgca

SEQ ID NO: 295901 - DNA, 25 bp, Homo sapien
ggagctgaattcgtgccagtgcatt

SEQ ID NO: 295902 - DNA, 25 bp, Homo sapien
ctgataatcactggcctgctgacac

SEQ ID NO: 295903 - DNA, 25 bp, Homo sapien
ataatcactggcctgctgacacttc

SEQ ID NO: 295904 - DNA, 25 bp, Homo sapien
ggtttctcctcctgggagtcaaagt

SEQ ID NO: 295905 - DNA, 25 bp, Homo sapien
gagtcaaagtccatagcctgagctc

SEQ ID NO: 295906 - DNA, 25 bp, Homo sapien
gggaccaacggaaagagttcacgat

SEQ ID NO: 295907 - DNA, 25 bp, Homo sapien
aaagtccatagcctgagctcggagg

SEQ ID NO: 295908 - DNA, 25 bp, Homo sapien
agtactctgcaccactgccatacga

SEQ ID NO: 295909 - DNA, 25 bp, Homo sapien
tttcacaccaatccgtacatgctgc

SEQ ID NO: 295910 - DNA, 25 bp, Homo sapien
aaagagttcacgatgggaggcctgg

SEQ ID NO: 295911 - DNA, 25 bp, Homo sapien
tgcccgctggacagcactatctcta

SEQ ID NO: 295912 - DNA, 25 bp, Homo sapien
agcactatctctaccagcggtggtt

SEQ ID NO: 295913 - DNA, 25 bp, Homo sapien
gctgcaagttccttactttagcaca

SEQ ID NO: 295914 - DNA, 25 bp, Homo sapien
gttccttactttagcacacattcta

SEQ ID NO: 295915 - DNA, 25 bp, Homo sapien
ttatttgtgatctggcctgcagtat

SEQ ID NO: 295916 - DNA, 25 bp, Homo sapien
tgatctggcctgcagtatgccagct

SEQ ID NO: 295917 - DNA, 25 bp, Homo sapien
agtatgccagcttctgctctgtttc

SEQ ID NO: 295918 - DNA, 25 bp, Homo sapien
ttctgctctgtttctcatgtccttc

SEQ ID NO: 295919 - DNA, 25 bp, Homo sapien
ccatttgtgccctagtcatactgaa

SEQ ID NO: 295920 - DNA, 25 bp, Homo sapien
tgccctagtcatactgaactgccta

SEQ ID NO: 295921 - DNA, 25 bp, Homo sapien
aactgcctaggatgtgttgtcccac

SEQ ID NO: 295922 - DNA, 25 bp, Homo sapien
tgttgtcccacatcatagccattag

SEQ ID NO: 295923 - DNA, 25 bp, Homo sapien
catcatagccattagtcacctaggg

SEQ ID NO: 295924 - DNA, 25 bp, Homo sapien
aaagacccatctttcaatactgcca

SEQ ID NO: 295925 - DNA, 25 bp, Homo sapien
tggagaggacaaacatcatcatagt

SEQ ID NO: 295926 - DNA, 25 bp, Homo sapien
caaacatcatcatagtgggagatct

SEQ ID NO: 295927 - DNA, 25 bp, Homo sapien
gtgggagatctaaatacacctttct

SEQ ID NO: 295928 - DNA, 25 bp, Homo sapien
atacacctttctaaggaactgatga

SEQ ID NO: 295929 - DNA, 25 bp, Homo sapien
tagaaaatttaccaacaagcttact

SEQ ID NO: 295930 - DNA, 25 bp, Homo sapien
acaagcttacttaatgaccatatat

SEQ ID NO: 295931 - DNA, 25 bp, Homo sapien
gattcttttcaactgcacacatgga

SEQ ID NO: 295932 - DNA, 25 bp, Homo sapien
tcaactgcacacatggaatatttat

SEQ ID NO: 295933 - DNA, 25 bp, Homo sapien
atgagagtcttaaagcaagccaaca

SEQ ID NO: 295934 - DNA, 25 bp, Homo sapien
aaagcaagccaacaaattttagatt

SEQ ID NO: 295935 - DNA, 25 bp, Homo sapien
tcgctggaaacttagtagccttctg

SEQ ID NO: 295936 - DNA, 25 bp, Homo sapien
tccaactttttccagcatacacttg

SEQ ID NO: 295937 - DNA, 25 bp, Homo sapien
agtagccttctgatattccttgcag

SEQ ID NO: 295938 - DNA, 25 bp, Homo sapien
gagacagacacttcaatttcagatt

SEQ ID NO: 295939 - DNA, 25 bp, Homo sapien
atatgggtgagaacctcttctttct

SEQ ID NO: 295940 - DNA, 25 bp, Homo sapien
gagaacctcttctttctgattcaaa

SEQ ID NO: 295941 - DNA, 25 bp, Homo sapien
attcaaatcctgctcggctccttac

SEQ ID NO: 295942 - DNA, 25 bp, Homo sapien
ttacacgtacatctcctagcatacg

SEQ ID NO: 295943 - DNA, 25 bp, Homo sapien
gcatacacttggcttgtccattata

SEQ ID NO: 295944 - DNA, 25 bp, Homo sapien
cgaatgtataatgcagtctgatcag

SEQ ID NO: 295945 - DNA, 25 bp, Homo sapien
gggaatttgaaaccgcagtaccacg

SEQ ID NO: 295946 - DNA, 25 bp, Homo sapien
gggcaaatacagaccacttctgcaa

SEQ ID NO: 295947 - DNA, 25 bp, Homo sapien
tacagaccacttctgcaaatgagaa

SEQ ID NO: 295948 - DNA, 25 bp, Homo sapien
tgagaatagcactgttttgccttca

SEQ ID NO: 295949 - DNA, 25 bp, Homo sapien
tccgatggcaacctgcgtccagaag

SEQ ID NO: 295950 - DNA, 25 bp, Homo sapien
ggcaacctgcgtccagaagccatca

SEQ ID NO: 295951 - DNA, 25 bp, Homo sapien
atcactgctatcatcgtggtcttct

SEQ ID NO: 295952 - DNA, 25 bp, Homo sapien
atcatcgtggtcttctccctcttgg

SEQ ID NO: 295953 - DNA, 25 bp, Homo sapien
ctggcactgttggtgcggaagcttc

SEQ ID NO: 295954 - DNA, 25 bp, Homo sapien
ctgttggtgcggaagcttcgggaga

SEQ ID NO: 295955 - DNA, 25 bp, Homo sapien
aagcggcagacggagggcacctacc

SEQ ID NO: 295956 - DNA, 25 bp, Homo sapien
tggcgctgggcctgccgttcctgct

SEQ ID NO: 295957 - DNA, 25 bp, Homo sapien
agcacttatatctggttttcacttg

SEQ ID NO: 295958 - DNA, 25 bp, Homo sapien
tggttttcacttgattttagccaaa

SEQ ID NO: 295959 - DNA, 25 bp, Homo sapien
cttggtgttatgcagcccgttttaa

SEQ ID NO: 295960 - DNA, 25 bp, Homo sapien
ggctgagaagtaattatgtctgctt

SEQ ID NO: 295961 - DNA, 25 bp, Homo sapien
aacttatgagtcaccaactctgaat

SEQ ID NO: 295962 - DNA, 25 bp, Homo sapien
aactctgaatactgactttgatttt

SEQ ID NO: 295963 - DNA, 25 bp, Homo sapien
tatgcagcccgttttaagtaattta

SEQ ID NO: 295964 - DNA, 25 bp, Homo sapien
ataatcagacttgttttactccatc

SEQ ID NO: 295965 - DNA, 25 bp, Homo sapien
gacttgttttactccatctcatgct

SEQ ID NO: 295966 - DNA, 25 bp, Homo sapien
tctctttttggaacactgcacattt

SEQ ID NO: 295967 - DNA, 25 bp, Homo sapien
gcacatttgaattcaagcacttata

SEQ ID NO: 295968 - DNA, 25 bp, Homo sapien
gcgagcggccacactggactaggaa

SEQ ID NO: 295969 - DNA, 25 bp, Homo sapien
acactggactaggaaacgaggcgcc

SEQ ID NO: 295970 - DNA, 25 bp, Homo sapien
actaggaaacgaggcgccgggctgt

SEQ ID NO: 295971 - DNA, 25 bp, Homo sapien
ggctgctgcacaaagaggtggtggt

SEQ ID NO: 295972 - DNA, 25 bp, Homo sapien
tgcctggcactgattcccgcatttt

SEQ ID NO: 295973 - DNA, 25 bp, Homo sapien
agagtcgggcgagcgccaagacggc

SEQ ID NO: 295974 - DNA, 25 bp, Homo sapien
tggtcgagggagacgccaaatcgtt

SEQ ID NO: 295975 - DNA, 25 bp, Homo sapien
ggagacgccaaatcgttaagacggg

SEQ ID NO: 295976 - DNA, 25 bp, Homo sapien
gcccgtttcgggtctgggacacaat

SEQ ID NO: 295977 - DNA, 25 bp, Homo sapien
gtctgggacacaataatccggccga

SEQ ID NO: 295978 - DNA, 25 bp, Homo sapien
ggacacaataatccggccgaaggcg

SEQ ID NO: 295979 - DNA, 25 bp, Homo sapien
ggatagccatttggagatataacct

SEQ ID NO: 295980 - DNA, 25 bp, Homo sapien
gagatataacctaatgttaagtgac

SEQ ID NO: 295981 - DNA, 25 bp, Homo sapien
agatataacctaatgttaagtgacg

SEQ ID NO: 295982 - DNA, 25 bp, Homo sapien
gatataacctaatgttaagtgacga

SEQ ID NO: 295983 - DNA, 25 bp, Homo sapien
atataacctaatgttaagtgacgag

SEQ ID NO: 295984 - DNA, 25 bp, Homo sapien
atgttaagtgacgagttactggatg

SEQ ID NO: 295985 - DNA, 25 bp, Homo sapien
tactggatgcagcacccgaacatgg

SEQ ID NO: 295986 - DNA, 25 bp, Homo sapien
catatgtagctaacccttcgttgtg

SEQ ID NO: 295987 - DNA, 25 bp, Homo sapien
tgtagctaacccttcgttgtgcaca

SEQ ID NO: 295988 - DNA, 25 bp, Homo sapien
gctaacccttcgttgtgcacatgta

SEQ ID NO: 295989 - DNA, 25 bp, Homo sapien
tggaacaacttctagtattggatct

SEQ ID NO: 295990 - DNA, 25 bp, Homo sapien
tgagtatctctaaaggcgaagctga

SEQ ID NO: 295991 - DNA, 25 bp, Homo sapien
aagctgagtcagaggttactagaac

SEQ ID NO: 295992 - DNA, 25 bp, Homo sapien
gacgagggcgatctctaagtgtact

SEQ ID NO: 295993 - DNA, 25 bp, Homo sapien
ctaagtgtacttggcccaggcctga

SEQ ID NO: 295994 - DNA, 25 bp, Homo sapien
taactgctgtccctgaaagaggctg

SEQ ID NO: 295995 - DNA, 25 bp, Homo sapien
aatgctgtgcctgaggctaactagt

SEQ ID NO: 295996 - DNA, 25 bp, Homo sapien
gaggctaactagtcattcaagtctg

SEQ ID NO: 295997 - DNA, 25 bp, Homo sapien
attcaagtctgtacataatctccaa

SEQ ID NO: 295998 - DNA, 25 bp, Homo sapien
ataatctccaatgtcaaaactcaac

SEQ ID NO: 295999 - DNA, 25 bp, Homo sapien
tgggtttgaaggacctctgttgcca

SEQ ID NO: 296000 - DNA, 25 bp, Homo sapien
gttgccagaaagcatgagtatctct

SEQ ID NO: 296001 - DNA, 25 bp, Homo sapien
tttcaaaaccattaccactttcaat

SEQ ID NO: 296002 - DNA, 25 bp, Homo sapien
tgtaattaacatcctcattcatcag

SEQ ID NO: 296003 - DNA, 25 bp, Homo sapien
aaagctggtaagtccacacagcatt

SEQ ID NO: 296004 - DNA, 25 bp, Homo sapien
gtaagtccacacagcatttgtgcag

SEQ ID NO: 296005 - DNA, 25 bp, Homo sapien
acagcatttgtgcagtatcccttct

SEQ ID NO: 296006 - DNA, 25 bp, Homo sapien
gtatcccttctgtgtaaaatgttaa

SEQ ID NO: 296007 - DNA, 25 bp, Homo sapien
gtaaaatgttaaggctttcagatga

SEQ ID NO: 296008 - DNA, 25 bp, Homo sapien
aaagaacttcctgcaaaagatcaaa

SEQ ID NO: 296009 - DNA, 25 bp, Homo sapien
gttgaactataggtttctttctgag

SEQ ID NO: 296010 - DNA, 25 bp, Homo sapien
aggtttctttctgagatgtattttt

SEQ ID NO: 296011 - DNA, 25 bp, Homo sapien
ttcttccaataatgctctctttttc

SEQ ID NO: 296012 - DNA, 25 bp, Homo sapien
gggcaattgcaaactgatcgtagaa

SEQ ID NO: 296013 - DNA, 25 bp, Homo sapien
tagaaggcggagttgtccacgccca

SEQ ID NO: 296014 - DNA, 25 bp, Homo sapien
aagtcgatgtcctggagctcttcac

SEQ ID NO: 296015 - DNA, 25 bp, Homo sapien
acggtgcccttctcggtgatggtgt

SEQ ID NO: 296016 - DNA, 25 bp, Homo sapien
tgatggtgtcgcaccacatggtgaa

SEQ ID NO: 296017 - DNA, 25 bp, Homo sapien
atggtgaagcccacgctcacgatgg

SEQ ID NO: 296018 - DNA, 25 bp, Homo sapien
acgctcacgatggtgctggcaatga

SEQ ID NO: 296019 - DNA, 25 bp, Homo sapien
gaagaccacgaaggcgctgaccagg

SEQ ID NO: 296020 - DNA, 25 bp, Homo sapien
acgaaggcgctgaccaggaggttca

SEQ ID NO: 296021 - DNA, 25 bp, Homo sapien
cacggccagcaagagccttcagagg

SEQ ID NO: 296022 - DNA, 25 bp, Homo sapien
gtccggaattggacctgggcaattg

SEQ ID NO: 296023 - DNA, 25 bp, Homo sapien
catagtacaggtgggcacctttcca

SEQ ID NO: 296024 - DNA, 25 bp, Homo sapien
gggcacctttccaaatgggctacag

SEQ ID NO: 296025 - DNA, 25 bp, Homo sapien
tgggctacagcccatcagccttcta

SEQ ID NO: 296026 - DNA, 25 bp, Homo sapien
atcagccttctacagtaacctttaa

SEQ ID NO: 296027 - DNA, 25 bp, Homo sapien
gaaatccctctagttcctatggcaa

SEQ ID NO: 296028 - DNA, 25 bp, Homo sapien
caagaccctcagttatcatttacat

SEQ ID NO: 296029 - DNA, 25 bp, Homo sapien
tcatttacatttcagactctctcag

SEQ ID NO: 296030 - DNA, 25 bp, Homo sapien
ttcagactctctcagttcaaatgtt

SEQ ID NO: 296031 - DNA, 25 bp, Homo sapien
gaagttattattcctaggtaattca

SEQ ID NO: 296032 - DNA, 25 bp, Homo sapien
aatgggcatataccagcaccaaggt

SEQ ID NO: 296033 - DNA, 25 bp, Homo sapien
gtatttttatctggtgcatagtaca

SEQ ID NO: 296034 - DNA, 25 bp, Homo sapien
acgccaaacattctttccatctgaa

SEQ ID NO: 296035 - DNA, 25 bp, Homo sapien
aactcaaacgggtcagtaggctgca

SEQ ID NO: 296036 - DNA, 25 bp, Homo sapien
acttctgactcctggctgaactaag

SEQ ID NO: 296037 - DNA, 25 bp, Homo sapien
gattcagccctgcagactaaagacc

SEQ ID NO: 296038 - DNA, 25 bp, Homo sapien
tgaagtcagggaacacccatccttt

SEQ ID NO: 296039 - DNA, 25 bp, Homo sapien
acccatcctttctagattctacaca

SEQ ID NO: 296040 - DNA, 25 bp, Homo sapien
agcataggcaggattcgtgtcccac

SEQ ID NO: 296041 - DNA, 25 bp, Homo sapien
attcgtgtcccaccacagggaaggt

SEQ ID NO: 296042 - DNA, 25 bp, Homo sapien
ggaaggtctggtcctcgagtttctt

SEQ ID NO: 296043 - DNA, 25 bp, Homo sapien
cgagtttcttctgtgaccgatctga

SEQ ID NO: 296044 - DNA, 25 bp, Homo sapien
tgtgaccgatctgacgccaaacatt

SEQ ID NO: 296045 - DNA, 25 bp, Homo sapien
tatccagaaatacaacattaccttt

SEQ ID NO: 296046 - DNA, 25 bp, Homo sapien
aaaattcctggagattgatcatatc

SEQ ID NO: 296047 - DNA, 25 bp, Homo sapien
gatcatatctctagtgtttgggtct

SEQ ID NO: 296048 - DNA, 25 bp, Homo sapien
gtttgggtctagaatgtattttttg

SEQ ID NO: 296049 - DNA, 25 bp, Homo sapien
gaaaacatggtactctaatctcaca

SEQ ID NO: 296050 - DNA, 25 bp, Homo sapien
ggtactctaatctcacaagtgaggc

SEQ ID NO: 296051 - DNA, 25 bp, Homo sapien
ctgaaatgaggcaaggactttggac

SEQ ID NO: 296052 - DNA, 25 bp, Homo sapien
gactttggacaagaacatgtttgga

SEQ ID NO: 296053 - DNA, 25 bp, Homo sapien
gaacatgtttggacttgagatggtt

SEQ ID NO: 296054 - DNA, 25 bp, Homo sapien
gatacacagagggtctccttaatct

SEQ ID NO: 296055 - DNA, 25 bp, Homo sapien
gagggtctccttaatctctggatat

SEQ ID NO: 296056 - DNA, 25 bp, Homo sapien
acttgtgtttggcaggtgatttcat

SEQ ID NO: 296057 - DNA, 25 bp, Homo sapien
tataaatctgctttctgctcgagga

SEQ ID NO: 296058 - DNA, 25 bp, Homo sapien
taaatgagtggctctgcacagactg

SEQ ID NO: 296059 - DNA, 25 bp, Homo sapien
tgcacagactgttgttttgacttgg

SEQ ID NO: 296060 - DNA, 25 bp, Homo sapien
ggagagaagtctgcccaggattcca

SEQ ID NO: 296061 - DNA, 25 bp, Homo sapien
ggattccatcttaatgcacgtgctg

SEQ ID NO: 296062 - DNA, 25 bp, Homo sapien
taatgcacgtgctgatcttctggca

SEQ ID NO: 296063 - DNA, 25 bp, Homo sapien
atcttctggcatgtcctgagcttta

SEQ ID NO: 296064 - DNA, 25 bp, Homo sapien
tcctgagctttagtccatctgttag

SEQ ID NO: 296065 - DNA, 25 bp, Homo sapien
cattgtgcccattgcagaggtagcc

SEQ ID NO: 296066 - DNA, 25 bp, Homo sapien
gaggtagcctgccaacaccaagcat

SEQ ID NO: 296067 - DNA, 25 bp, Homo sapien
ttttcattccagatgtctacaaaag

SEQ ID NO: 296068 - DNA, 25 bp, Homo sapien
attccagatgtctacaaaagagaac

SEQ ID NO: 296069 - DNA, 25 bp, Homo sapien
gtactgattacatctgaaggttttt

SEQ ID NO: 296070 - DNA, 25 bp, Homo sapien
aaggtttttgtttctctgataccag

SEQ ID NO: 296071 - DNA, 25 bp, Homo sapien
ttgtttctctgataccaggatttaa

SEQ ID NO: 296072 - DNA, 25 bp, Homo sapien
tacgaagttcgttacctatttcaag

SEQ ID NO: 296073 - DNA, 25 bp, Homo sapien
gttacctatttcaagttacctctga

SEQ ID NO: 296074 - DNA, 25 bp, Homo sapien
agttacctctgagattccttacgct

SEQ ID NO: 296075 - DNA, 25 bp, Homo sapien
acctctgagattccttacgctgaag

SEQ ID NO: 296076 - DNA, 25 bp, Homo sapien
ctgagattccttacgctgaagacaa

SEQ ID NO: 296077 - DNA, 25 bp, Homo sapien
gattccttacgctgaagacaaatat

SEQ ID NO: 296078 - DNA, 25 bp, Homo sapien
agcctgccacaggaggtgcaagaca

SEQ ID NO: 296079 - DNA, 25 bp, Homo sapien
gcaagacagagcaagctggacagat

SEQ ID NO: 296080 - DNA, 25 bp, Homo sapien
acagatggaggaagccaggctgcca

SEQ ID NO: 296081 - DNA, 25 bp, Homo sapien
tggaggaagccaggctgccagacaa

SEQ ID NO: 296082 - DNA, 25 bp, Homo sapien
tcatcccatgcctggcagtgtcatg

SEQ ID NO: 296083 - DNA, 25 bp, Homo sapien
ccacctggcacagaacaaggcgggt

SEQ ID NO: 296084 - DNA, 25 bp, Homo sapien
catgcctggcagtgtcatggtagga

SEQ ID NO: 296085 - DNA, 25 bp, Homo sapien
cagacacctgcatgcctgaccagga

SEQ ID NO: 296086 - DNA, 25 bp, Homo sapien
tgaccaggagcccagaggctcagaa

SEQ ID NO: 296087 - DNA, 25 bp, Homo sapien
ctggcagtgtcatggtaggagccta

SEQ ID NO: 296088 - DNA, 25 bp, Homo sapien
agcctagggcgatagggccctgtcc

SEQ ID NO: 296089 - DNA, 25 bp, Homo sapien
gaagaattgacatgtatcccaccat

SEQ ID NO: 296090 - DNA, 25 bp, Homo sapien
gacatgtatcccaccataaaatggt

SEQ ID NO: 296091 - DNA, 25 bp, Homo sapien
attttacaaccaaagctcccatttg

SEQ ID NO: 296092 - DNA, 25 bp, Homo sapien
aaagctcccatttgattgtaatctt

SEQ ID NO: 296093 - DNA, 25 bp, Homo sapien
cccatttgattgtaatcttgccaaa

SEQ ID NO: 296094 - DNA, 25 bp, Homo sapien
aagcaataatatccactagtgttgt

SEQ ID NO: 296095 - DNA, 25 bp, Homo sapien
atccactagtgttgttatcagctac

SEQ ID NO: 296096 - DNA, 25 bp, Homo sapien
ttatcagctactgtaaccaagtggc

SEQ ID NO: 296097 - DNA, 25 bp, Homo sapien
caagtggctggttcatttggttgat

SEQ ID NO: 296098 - DNA, 25 bp, Homo sapien
ggctggttcatttggttgatgctga

SEQ ID NO: 296099 - DNA, 25 bp, Homo sapien
ttgatgctgattatggcctttaacc

SEQ ID NO: 296100 - DNA, 25 bp, Homo sapien
attccagttgatggtggcctcgctc

SEQ ID NO: 296101 - DNA, 25 bp, Homo sapien
gctccacttggttctgattgccatc

SEQ ID NO: 296102 - DNA, 25 bp, Homo sapien
gattgccatctccactggtgaaaac

SEQ ID NO: 296103 - DNA, 25 bp, Homo sapien
ggtgaaaaccgtcgtcttggtccat

SEQ ID NO: 296104 - DNA, 25 bp, Homo sapien
gtcttggtccatgtttctcttcctg

SEQ ID NO: 296105 - DNA, 25 bp, Homo sapien
gttggtctctttcccagtgatggga

SEQ ID NO: 296106 - DNA, 25 bp, Homo sapien
acattaggcttttgcatcccagcag

SEQ ID NO: 296107 - DNA, 25 bp, Homo sapien
agaaggaatagccagcatttagacc

SEQ ID NO: 296108 - DNA, 25 bp, Homo sapien
tagacccaagcctatgaacaccatt

SEQ ID NO: 296109 - DNA, 25 bp, Homo sapien
agacttcattgcacaccctagtttc

SEQ ID NO: 296110 - DNA, 25 bp, Homo sapien
gaagggaacggtcccattccagttg

SEQ ID NO: 296111 - DNA, 25 bp, Homo sapien
agcgggccatgcaggacatgcagct

SEQ ID NO: 296112 - DNA, 25 bp, Homo sapien
tgctgtgggagaaggcagtccaaca

SEQ ID NO: 296113 - DNA, 25 bp, Homo sapien
tgggagaaggcagtccaacagcacc

SEQ ID NO: 296114 - DNA, 25 bp, Homo sapien
cggcgcatggagatggataagacca

SEQ ID NO: 296115 - DNA, 25 bp, Homo sapien
aatgggccgagcagctgacaaagat

SEQ ID NO: 296116 - DNA, 25 bp, Homo sapien
gccgagcagctgacaaagatgggcc

SEQ ID NO: 296117 - DNA, 25 bp, Homo sapien
gggcaagcacttcatcggagacttc

SEQ ID NO: 296118 - DNA, 25 bp, Homo sapien
caagcacttcatcggagacttcctg

SEQ ID NO: 296119 - DNA, 25 bp, Homo sapien
ttcatcggagacttcctgcctccag

SEQ ID NO: 296120 - DNA, 25 bp, Homo sapien
tcctgcctccagacgagctggaaaa

SEQ ID NO: 296121 - DNA, 25 bp, Homo sapien
cagacgagctggaaaagtttatgga

SEQ ID NO: 296122 - DNA, 25 bp, Homo sapien
gtgttctgtagaacttgctcccaca

SEQ ID NO: 296123 - DNA, 25 bp, Homo sapien
tgtagaacttgctcccacactttaa

SEQ ID NO: 296124 - DNA, 25 bp, Homo sapien
aacttgctcccacactttaacattt

SEQ ID NO: 296125 - DNA, 25 bp, Homo sapien
gctcccacactttaacattttgctt

SEQ ID NO: 296126 - DNA, 25 bp, Homo sapien
aaagatttgttcgtgtacttagatc

SEQ ID NO: 296127 - DNA, 25 bp, Homo sapien
gttcgtgtacttagatcattccttt

SEQ ID NO: 296128 - DNA, 25 bp, Homo sapien
acttagatcattccttttcactgct

SEQ ID NO: 296129 - DNA, 25 bp, Homo sapien
attccttttcactgctttatgagct

SEQ ID NO: 296130 - DNA, 25 bp, Homo sapien
ttcactgctttatgagctgaatcat

SEQ ID NO: 296131 - DNA, 25 bp, Homo sapien
agctgaatcatttctgctcttcttt

SEQ ID NO: 296132 - DNA, 25 bp, Homo sapien
gctgaatcatttctgctcttctttc

SEQ ID NO: 296133 - DNA, 25 bp, Homo sapien
agctccaagtgagctctcgcagctg

SEQ ID NO: 296134 - DNA, 25 bp, Homo sapien
tccaagtgagctctcgcagctgcca

SEQ ID NO: 296135 - DNA, 25 bp, Homo sapien
caagtgagctctcgcagctgccagc

SEQ ID NO: 296136 - DNA, 25 bp, Homo sapien
agtgagctctcgcagctgccagcaa

SEQ ID NO: 296137 - DNA, 25 bp, Homo sapien
gtgagctctcgcagctgccagcaat

SEQ ID NO: 296138 - DNA, 25 bp, Homo sapien
tctcgcagctgccagcaatccaaag

SEQ ID NO: 296139 - DNA, 25 bp, Homo sapien
cgcagctgccagcaatccaaaggct

SEQ ID NO: 296140 - DNA, 25 bp, Homo sapien
gcagctgccagcaatccaaaggctc

SEQ ID NO: 296141 - DNA, 25 bp, Homo sapien
agctgccagcaatccaaaggctctt

SEQ ID NO: 296142 - DNA, 25 bp, Homo sapien
gctgccagcaatccaaaggctcttt

SEQ ID NO: 296143 - DNA, 25 bp, Homo sapien
ctgccagcaatccaaaggctctttt

SEQ ID NO: 296144 - DNA, 25 bp, Homo sapien
ttgggtctgagtcccttgcttaagg

SEQ ID NO: 296145 - DNA, 25 bp, Homo sapien
gaagtcctagttttcagcttgcaga

SEQ ID NO: 296146 - DNA, 25 bp, Homo sapien
gagattatgtctgaaatgcctaatg

SEQ ID NO: 296147 - DNA, 25 bp, Homo sapien
atgcctaatgagtcgcagggatttg

SEQ ID NO: 296148 - DNA, 25 bp, Homo sapien
gcagggatttgttgagactccgtaa

SEQ ID NO: 296149 - DNA, 25 bp, Homo sapien
gactccgtaatctcaagttctcttt

SEQ ID NO: 296150 - DNA, 25 bp, Homo sapien
aagttctctttgtgagctatcagca

SEQ ID NO: 296151 - DNA, 25 bp, Homo sapien
gtgagctatcagcatctgccagtct

SEQ ID NO: 296152 - DNA, 25 bp, Homo sapien
ttgtcctccctgagtatctcacagt

SEQ ID NO: 296153 - DNA, 25 bp, Homo sapien
gtatctcacagtccatatcctgatg

SEQ ID NO: 296154 - DNA, 25 bp, Homo sapien
atcctgatgagggatcaggccccta

SEQ ID NO: 296155 - DNA, 25 bp, Homo sapien
aagcacacaccaggaaactgcaggg

SEQ ID NO: 296156 - DNA, 25 bp, Homo sapien
gggctcacggaggaagtgctgcctg

SEQ ID NO: 296157 - DNA, 25 bp, Homo sapien
agctttcctccgtagagaccatgtg

SEQ ID NO: 296158 - DNA, 25 bp, Homo sapien
tcctccgtagagaccatgtgcagaa

SEQ ID NO: 296159 - DNA, 25 bp, Homo sapien
ccgtagagaccatgtgcagaacact

SEQ ID NO: 296160 - DNA, 25 bp, Homo sapien
acatgagggagccagtgttttgtca

SEQ ID NO: 296161 - DNA, 25 bp, Homo sapien
ggagccagtgttttgtcagcaggaa

SEQ ID NO: 296162 - DNA, 25 bp, Homo sapien
gccagtgttttgtcagcaggaagaa

SEQ ID NO: 296163 - DNA, 25 bp, Homo sapien
cagcacaggcccagagtacctgctg

SEQ ID NO: 296164 - DNA, 25 bp, Homo sapien
gatgctgaggttgacgacaggttcc

SEQ ID NO: 296165 - DNA, 25 bp, Homo sapien
aggttgacgacaggttccaggtcct

SEQ ID NO: 296166 - DNA, 25 bp, Homo sapien
taaggaaggaacaactcaaggacat

SEQ ID NO: 296167 - DNA, 25 bp, Homo sapien
aaggaacaactcaaggacattggga

SEQ ID NO: 296168 - DNA, 25 bp, Homo sapien
ttgggaatgataacttttccacttg

SEQ ID NO: 296169 - DNA, 25 bp, Homo sapien
aatagtatttacaggtggcttcttt

SEQ ID NO: 296170 - DNA, 25 bp, Homo sapien
tagtatttacaggtggcttctttta

SEQ ID NO: 296171 - DNA, 25 bp, Homo sapien
gcaggaatgtatatgaaatgtcaga

SEQ ID NO: 296172 - DNA, 25 bp, Homo sapien
cagattttattgtatttgcagagta

SEQ ID NO: 296173 - DNA, 25 bp, Homo sapien
gtatttgcagagtattagctttgaa

SEQ ID NO: 296174 - DNA, 25 bp, Homo sapien
ttgcagagtattagctttgaaattg

SEQ ID NO: 296175 - DNA, 25 bp, Homo sapien
gttttaaaatgccttattggtatca

SEQ ID NO: 296176 - DNA, 25 bp, Homo sapien
aatgccttattggtatcaattagaa

SEQ ID NO: 296177 - DNA, 25 bp, Homo sapien
gaacagaaatgtttatcgatgccat

SEQ ID NO: 296178 - DNA, 25 bp, Homo sapien
atgtttatcgatgccataacgtgat

SEQ ID NO: 296179 - DNA, 25 bp, Homo sapien
aacgtgatacatttgctttccggtg

SEQ ID NO: 296180 - DNA, 25 bp, Homo sapien
gatacatttgctttccggtgttgtt

SEQ ID NO: 296181 - DNA, 25 bp, Homo sapien
tacatttgctttccggtgttgtttt

SEQ ID NO: 296182 - DNA, 25 bp, Homo sapien
gggaaattttaccttaccatcacag

SEQ ID NO: 296183 - DNA, 25 bp, Homo sapien
accttaccatcacagattttgttac

SEQ ID NO: 296184 - DNA, 25 bp, Homo sapien
gttagcttttacaaataagaggctt

SEQ ID NO: 296185 - DNA, 25 bp, Homo sapien
gaggcttataatgtggccagatatt

SEQ ID NO: 296186 - DNA, 25 bp, Homo sapien
atgtggccagatattcttagaattc

SEQ ID NO: 296187 - DNA, 25 bp, Homo sapien
tagaattcttttaggtctaagtgtt

SEQ ID NO: 296188 - DNA, 25 bp, Homo sapien
aagacttcctgccacaaggttttat

SEQ ID NO: 296189 - DNA, 25 bp, Homo sapien
acttcctgccacaaggttttatctt

SEQ ID NO: 296190 - DNA, 25 bp, Homo sapien
gccacaaggttttatctttgaacac

SEQ ID NO: 296191 - DNA, 25 bp, Homo sapien
gaacactttattggtttgcgttttg

SEQ ID NO: 296192 - DNA, 25 bp, Homo sapien
tattggtttgcgttttgattaattt

SEQ ID NO: 296193 - DNA, 25 bp, Homo sapien
tgcagacacacaagactatgtttta

SEQ ID NO: 296194 - DNA, 25 bp, Homo sapien
catttgtgaggaaaatctcacttag

SEQ ID NO: 296195 - DNA, 25 bp, Homo sapien
gacacacaagactatgttttaagat

SEQ ID NO: 296196 - DNA, 25 bp, Homo sapien
gttttaagatcaaacttacattcta

SEQ ID NO: 296197 - DNA, 25 bp, Homo sapien
cattctagttagaggatttatttta

SEQ ID NO: 296198 - DNA, 25 bp, Homo sapien
ttgtcacaaaaatgaaaaggttggc

SEQ ID NO: 296199 - DNA, 25 bp, Homo sapien
gatatagttcttagacatcttcaga

SEQ ID NO: 296200 - DNA, 25 bp, Homo sapien
gaatgactaatttctccgagtggtg

SEQ ID NO: 296201 - DNA, 25 bp, Homo sapien
tctccgagtggtgcataatcttatt

SEQ ID NO: 296202 - DNA, 25 bp, Homo sapien
ttaccatagtaaccttagaccttag

SEQ ID NO: 296203 - DNA, 25 bp, Homo sapien
ccttagagaggtagctttggagtga

SEQ ID NO: 296204 - DNA, 25 bp, Homo sapien
gctttggagtgaaactttggctgca

SEQ ID NO: 296205 - DNA, 25 bp, Homo sapien
actttggctgcaataggctactttg

SEQ ID NO: 296206 - DNA, 25 bp, Homo sapien
ataggctactttggcaagccctccg

SEQ ID NO: 296207 - DNA, 25 bp, Homo sapien
ttggcaagccctccgtaaaagtcag

SEQ ID NO: 296208 - DNA, 25 bp, Homo sapien
gtacagagctaagagtgacatcaaa

SEQ ID NO: 296209 - DNA, 25 bp, Homo sapien
ggacccagatttgaagacccaataa

SEQ ID NO: 296210 - DNA, 25 bp, Homo sapien
tatactttagatttgggaagaccat

SEQ ID NO: 296211 - DNA, 25 bp, Homo sapien
gatgaattacatatacttagccatg

SEQ ID NO: 296212 - DNA, 25 bp, Homo sapien
tatacttagccatgtatttcctcca

SEQ ID NO: 296213 - DNA, 25 bp, Homo sapien
gtatttcctccatttcttctgaata

SEQ ID NO: 296214 - DNA, 25 bp, Homo sapien
agaaaacctctgatttgtggaatat

SEQ ID NO: 296215 - DNA, 25 bp, Homo sapien
attctcttgaattgggaaggtttat

SEQ ID NO: 296216 - DNA, 25 bp, Homo sapien
ataacttattctgtgtctacctcgg

SEQ ID NO: 296217 - DNA, 25 bp, Homo sapien
ttattctgtgtctacctcggtgaaa

SEQ ID NO: 296218 - DNA, 25 bp, Homo sapien
gtctacctcggtgaaagtactggaa

SEQ ID NO: 296219 - DNA, 25 bp, Homo sapien
gtactggaattataggactactcac

SEQ ID NO: 296220 - DNA, 25 bp, Homo sapien
ggactactcacttttcatatacttt

SEQ ID NO: 296221 - DNA, 25 bp, Homo sapien
aaatgtttagttgccacagtgaacc

SEQ ID NO: 296222 - DNA, 25 bp, Homo sapien
gaaccaggagtcactgagccaatga

SEQ ID NO: 296223 - DNA, 25 bp, Homo sapien
ccaatgactttaccagctgctgact

SEQ ID NO: 296224 - DNA, 25 bp, Homo sapien
agctgctgactaatcttcatcacca

SEQ ID NO: 296225 - DNA, 25 bp, Homo sapien
ttcatcaccactgtagattttgctg

SEQ ID NO: 296226 - DNA, 25 bp, Homo sapien
gcatgtgcaggtcctctatttttaa

SEQ ID NO: 296227 - DNA, 25 bp, Homo sapien
gttttcgttgctgcagtactttaca

SEQ ID NO: 296228 - DNA, 25 bp, Homo sapien
caaacttctagttcgttgagactta

SEQ ID NO: 296229 - DNA, 25 bp, Homo sapien
ttgagacttagtgaccatttggcat

SEQ ID NO: 296230 - DNA, 25 bp, Homo sapien
taggaaacaccacttccacaagtct

SEQ ID NO: 296231 - DNA, 25 bp, Homo sapien
ccacaagtctcaagcctcagtgcta

SEQ ID NO: 296232 - DNA, 25 bp, Homo sapien
acaatatatatatcctgtccttata

SEQ ID NO: 296233 - DNA, 25 bp, Homo sapien
ctagagtacattttccatcatgttt

SEQ ID NO: 296234 - DNA, 25 bp, Homo sapien
catgtttaagtgtatttctgctatt

SEQ ID NO: 296235 - DNA, 25 bp, Homo sapien
ttctgctattatttcctctcctgca

SEQ ID NO: 296236 - DNA, 25 bp, Homo sapien
attatttcctctcctgcagaataca

SEQ ID NO: 296237 - DNA, 25 bp, Homo sapien
tctcctgcagaatacatacaagtgt

SEQ ID NO: 296238 - DNA, 25 bp, Homo sapien
tataaagtcatacatgtacaagcat

SEQ ID NO: 296239 - DNA, 25 bp, Homo sapien
gagattgaatcacatttccatactg

SEQ ID NO: 296240 - DNA, 25 bp, Homo sapien
catttccatactgtctgttatttta

SEQ ID NO: 296241 - DNA, 25 bp, Homo sapien
tattgggtttctttagtttatgttg

SEQ ID NO: 296242 - DNA, 25 bp, Homo sapien
gttgttttctcaaaagcagcatttt

SEQ ID NO: 296243 - DNA, 25 bp, Homo sapien
atatttatgattaaaggcttttcac

SEQ ID NO: 296244 - DNA, 25 bp, Homo sapien
aggaagtttaactgtggcacatgtt

SEQ ID NO: 296245 - DNA, 25 bp, Homo sapien
ttaactgtggcacatgttttgatca

SEQ ID NO: 296246 - DNA, 25 bp, Homo sapien
ggcacatgttttgatcagaaaggta

SEQ ID NO: 296247 - DNA, 25 bp, Homo sapien
gaaaggtagttctctttgctctggt

SEQ ID NO: 296248 - DNA, 25 bp, Homo sapien
ggtagttctctttgctctggtagtt

SEQ ID NO: 296249 - DNA, 25 bp, Homo sapien
agtttgtactagttctttatttctg

SEQ ID NO: 296250 - DNA, 25 bp, Homo sapien
tgtactagttctttatttctgttgt

SEQ ID NO: 296251 - DNA, 25 bp, Homo sapien
ttataaatcacgtctaatcatactg

SEQ ID NO: 296252 - DNA, 25 bp, Homo sapien
aatcacgtctaatcatactgaattg

SEQ ID NO: 296253 - DNA, 25 bp, Homo sapien
gaattgtatctttattttaagcata

SEQ ID NO: 296254 - DNA, 25 bp, Homo sapien
ttttggttagagcttatagacatta

SEQ ID NO: 296255 - DNA, 25 bp, Homo sapien
gagcttatagacattacttttatga

SEQ ID NO: 296256 - DNA, 25 bp, Homo sapien
tttatgattattttgcgtgctaaat

SEQ ID NO: 296257 - DNA, 25 bp, Homo sapien
aagggtatgttttgaactatagcac

SEQ ID NO: 296258 - DNA, 25 bp, Homo sapien
taatgtgtgtgatcctagtatgttg

SEQ ID NO: 296259 - DNA, 25 bp, Homo sapien
gtatgttgatagctttgattttgtg

SEQ ID NO: 296260 - DNA, 25 bp, Homo sapien
gatagctttgattttgtgagtggtt

SEQ ID NO: 296261 - DNA, 25 bp, Homo sapien
gtgagtggtttactagtcatttatt

SEQ ID NO: 296262 - DNA, 25 bp, Homo sapien
attatgattcccatgaactctgata

SEQ ID NO: 296263 - DNA, 25 bp, Homo sapien
tgattcccatgaactctgatatgat

SEQ ID NO: 296264 - DNA, 25 bp, Homo sapien
attgtggttttaactcaggttgaat

SEQ ID NO: 296265 - DNA, 25 bp, Homo sapien
ccaggatgatcaggagccttcatta

SEQ ID NO: 296266 - DNA, 25 bp, Homo sapien
gatcaggagccttcattaaaacaga

SEQ ID NO: 296267 - DNA, 25 bp, Homo sapien
aaaccttcgtaaagtgaattgcatt

SEQ ID NO: 296268 - DNA, 25 bp, Homo sapien
cgtaaagtgaattgcattaaacatc

SEQ ID NO: 296269 - DNA, 25 bp, Homo sapien
tggagataaaatattcacttagaac

SEQ ID NO: 296270 - DNA, 25 bp, Homo sapien
cacttagaactgatgtaccaagctt

SEQ ID NO: 296271 - DNA, 25 bp, Homo sapien
gaactgatgtaccaagcttctgttt

SEQ ID NO: 296272 - DNA, 25 bp, Homo sapien
actgatgtaccaagcttctgttttg

SEQ ID NO: 296273 - DNA, 25 bp, Homo sapien
gatgtaccaagcttctgttttgtaa

SEQ ID NO: 296274 - DNA, 25 bp, Homo sapien
atttacctatagaaaaactcactgt

SEQ ID NO: 296275 - DNA, 25 bp, Homo sapien
tatagaaaaactcactgtagaatgt

SEQ ID NO: 296276 - DNA, 25 bp, Homo sapien
agtcgctgcatttgtaccgctgcca

SEQ ID NO: 296277 - DNA, 25 bp, Homo sapien
gcaacatcttccgaggcctggtcag

SEQ ID NO: 296278 - DNA, 25 bp, Homo sapien
tcttccgaggcctggtcagcctgca

SEQ ID NO: 296279 - DNA, 25 bp, Homo sapien
tctacctccaggagaacagcctgct

SEQ ID NO: 296280 - DNA, 25 bp, Homo sapien
tgctccacctacaggatgacttgtt

SEQ ID NO: 296281 - DNA, 25 bp, Homo sapien
ctacaggatgacttgttcgcggacc

SEQ ID NO: 296282 - DNA, 25 bp, Homo sapien
aggatgacttgttcgcggacctggc

SEQ ID NO: 296283 - DNA, 25 bp, Homo sapien
acttgttcgcggacctggccaacct

SEQ ID NO: 296284 - DNA, 25 bp, Homo sapien
tgctcacagagcacgtgtttcgcgg

SEQ ID NO: 296285 - DNA, 25 bp, Homo sapien
tggacctcggtgacaaccggcacct

SEQ ID NO: 296286 - DNA, 25 bp, Homo sapien
tggagcggctgcagtcgctgcattt

SEQ ID NO: 296287 - DNA, 25 bp, Homo sapien
ggatacctatcggagcaaagcctac

SEQ ID NO: 296288 - DNA, 25 bp, Homo sapien
aagcctaccagtgtgcagctggcaa

SEQ ID NO: 296289 - DNA, 25 bp, Homo sapien
agctggcaaaggagtaaggcaaatt

SEQ ID NO: 296290 - DNA, 25 bp, Homo sapien
gtaaggcaaattcagtactcttctg

SEQ ID NO: 296291 - DNA, 25 bp, Homo sapien
agtactcttctgattcttaaatgct

SEQ ID NO: 296292 - DNA, 25 bp, Homo sapien
tcttaaatgctgatagttcttgatt

SEQ ID NO: 296293 - DNA, 25 bp, Homo sapien
tatatgttgctgtttgctggctgct

SEQ ID NO: 296294 - DNA, 25 bp, Homo sapien
gctggctgcttttcagttaaatagc

SEQ ID NO: 296295 - DNA, 25 bp, Homo sapien
tagcattatttataggcctgtaaat

SEQ ID NO: 296296 - DNA, 25 bp, Homo sapien
gattattatgtatgtcccatgagta

SEQ ID NO: 296297 - DNA, 25 bp, Homo sapien
gtatgtcccatgagtagatgtaata

SEQ ID NO: 296298 - DNA, 25 bp, Homo sapien
aaaattgatgctaccaaattgtgcc

SEQ ID NO: 296299 - DNA, 25 bp, Homo sapien
ataacatttttgagagcattttaac

SEQ ID NO: 296300 - DNA, 25 bp, Homo sapien
aacatttttgagagcattttaacag

SEQ ID NO: 296301 - DNA, 25 bp, Homo sapien
acatttttgagagcattttaacagc

SEQ ID NO: 296302 - DNA, 25 bp, Homo sapien
atttttgagagcattttaacagcag

SEQ ID NO: 296303 - DNA, 25 bp, Homo sapien
ttttgagagcattttaacagcagtt

SEQ ID NO: 296304 - DNA, 25 bp, Homo sapien
tttgagagcattttaacagcagttt

SEQ ID NO: 296305 - DNA, 25 bp, Homo sapien
ttgagagcattttaacagcagttta

SEQ ID NO: 296306 - DNA, 25 bp, Homo sapien
tgagagcattttaacagcagtttac

SEQ ID NO: 296307 - DNA, 25 bp, Homo sapien
ttttaacagcagtttacaaatatgt

SEQ ID NO: 296308 - DNA, 25 bp, Homo sapien
aagaaagatgttgatagaaccctta

SEQ ID NO: 296309 - DNA, 25 bp, Homo sapien
tgacttgatcccaagagtttctctt

SEQ ID NO: 296310 - DNA, 25 bp, Homo sapien
aattcatattccaactcattccagt

SEQ ID NO: 296311 - DNA, 25 bp, Homo sapien
actcattccagtagcactttaggaa

SEQ ID NO: 296312 - DNA, 25 bp, Homo sapien
gttttaaacgcagtaagacctagct

SEQ ID NO: 296313 - DNA, 25 bp, Homo sapien
gtaagacctagcttcagagcactct

SEQ ID NO: 296314 - DNA, 25 bp, Homo sapien
agcttcagagcactctagggctcta

SEQ ID NO: 296315 - DNA, 25 bp, Homo sapien
gcactctagggctctagctaatttg

SEQ ID NO: 296316 - DNA, 25 bp, Homo sapien
agagtttctctttttgactcctaga

SEQ ID NO: 296317 - DNA, 25 bp, Homo sapien
tttgtccctaggtgctagtcatcta

SEQ ID NO: 296318 - DNA, 25 bp, Homo sapien
tttgactcctagaaatagcctttct

SEQ ID NO: 296319 - DNA, 25 bp, Homo sapien
gaaatagcctttctcacctatcatc

SEQ ID NO: 296320 - DNA, 25 bp, Homo sapien
tggtgtacatatgtccgctgggtga

SEQ ID NO: 296321 - DNA, 25 bp, Homo sapien
atgtccgctgggtgagttgacctgt

SEQ ID NO: 296322 - DNA, 25 bp, Homo sapien
gtgagttgacctgtggcctcgcaca

SEQ ID NO: 296323 - DNA, 25 bp, Homo sapien
ctttatgcttgctgtctctcagaat

SEQ ID NO: 296324 - DNA, 25 bp, Homo sapien
gctgtctctcagaattgttttctta

SEQ ID NO: 296325 - DNA, 25 bp, Homo sapien
taatgacgagtgtgcttcagtttgt

SEQ ID NO: 296326 - DNA, 25 bp, Homo sapien
cagtttgtttagcaaaaccactctc

SEQ ID NO: 296327 - DNA, 25 bp, Homo sapien
actctcttgaatcacgttaactttt

SEQ ID NO: 296328 - DNA, 25 bp, Homo sapien
aacgccatagcacagctgtctttat

SEQ ID NO: 296329 - DNA, 25 bp, Homo sapien
aagagcacatctactccagcatgat

SEQ ID NO: 296330 - DNA, 25 bp, Homo sapien
atctactccagcatgatctgtcatc

SEQ ID NO: 296331 - DNA, 25 bp, Homo sapien
ggatacctatcggagcaaagcctac

SEQ ID NO: 296332 - DNA, 25 bp, Homo sapien
gatacctatcggagcaaagcctacc

SEQ ID NO: 296333 - DNA, 25 bp, Homo sapien
atacctatcggagcaaagcctacca

SEQ ID NO: 296334 - DNA, 25 bp, Homo sapien
agcaaagcctaccagtgtgcagctg

SEQ ID NO: 296335 - DNA, 25 bp, Homo sapien
gcaaagcctaccagtgtgcagctgg

SEQ ID NO: 296336 - DNA, 25 bp, Homo sapien
aaagcctaccagtgtgcagctggca

SEQ ID NO: 296337 - DNA, 25 bp, Homo sapien
aagcctaccagtgtgcagctggcaa

SEQ ID NO: 296338 - DNA, 25 bp, Homo sapien
agcctaccagtgtgcagctggcaaa

SEQ ID NO: 296339 - DNA, 25 bp, Homo sapien
gcctaccagtgtgcagctggcaaag

SEQ ID NO: 296340 - DNA, 25 bp, Homo sapien
ctaccagtgtgcagctggcaaagga

SEQ ID NO: 296341 - DNA, 25 bp, Homo sapien
taccagtgtgcagctggcaaaggag

SEQ ID NO: 296342 - DNA, 25 bp, Homo sapien
caagaagtcccccaggtaacagcag

SEQ ID NO: 296343 - DNA, 25 bp, Homo sapien
tccccgcttggtccgggtgaggaag

SEQ ID NO: 296344 - DNA, 25 bp, Homo sapien
gagcagcaccagaacgcagtgccgg

SEQ ID NO: 296345 - DNA, 25 bp, Homo sapien
cttggtccgggtgaggaagcaggtg

SEQ ID NO: 296346 - DNA, 25 bp, Homo sapien
agcagcaccagaacgcagtgccgga

SEQ ID NO: 296347 - DNA, 25 bp, Homo sapien
agcaccagaacgcagtgccggagcc

SEQ ID NO: 296348 - DNA, 25 bp, Homo sapien
accagaacgcagtgccggagccgca

SEQ ID NO: 296349 - DNA, 25 bp, Homo sapien
agccgcagcgggtgcgcgagcgtca

SEQ ID NO: 296350 - DNA, 25 bp, Homo sapien
tgcgcgagcgtcagcagcagcccta

SEQ ID NO: 296351 - DNA, 25 bp, Homo sapien
gagcgtcagcagcagccctacgcag

SEQ ID NO: 296352 - DNA, 25 bp, Homo sapien
gcagccctacgcagctcagcaccag

SEQ ID NO: 296353 - DNA, 25 bp, Homo sapien
aattgaaacaaaactgagacaggat

SEQ ID NO: 296354 - DNA, 25 bp, Homo sapien
gacaggattcagataattctgacaa

SEQ ID NO: 296355 - DNA, 25 bp, Homo sapien
gaaaaagcagccacaacactgaccc

SEQ ID NO: 296356 - DNA, 25 bp, Homo sapien
actgaccccccaacatgttcttaat

SEQ ID NO: 296357 - DNA, 25 bp, Homo sapien
gaaaaggcatatttcaccctgaatg

SEQ ID NO: 296358 - DNA, 25 bp, Homo sapien
tttcaccctgaatgctaaatttagt

SEQ ID NO: 296359 - DNA, 25 bp, Homo sapien
gctaaatttagttctctactctgtt

SEQ ID NO: 296360 - DNA, 25 bp, Homo sapien
ttagttctctactctgttagtttag

SEQ ID NO: 296361 - DNA, 25 bp, Homo sapien
ttttgtgtaggaatcaatgccacca

SEQ ID NO: 296362 - DNA, 25 bp, Homo sapien
atcaatgccaccaaaatgttagtga

SEQ ID NO: 296363 - DNA, 25 bp, Homo sapien
tagtgataaccgtacaaacaaattg

SEQ ID NO: 296364 - DNA, 25 bp, Homo sapien
agtccccaaagttggagaatcccat

SEQ ID NO: 296365 - DNA, 25 bp, Homo sapien
gaatcccatcaaggagagtagccct

SEQ ID NO: 296366 - DNA, 25 bp, Homo sapien
gagtagccctgtaaggaattcgaat

SEQ ID NO: 296367 - DNA, 25 bp, Homo sapien
aggaattcgaatttccagcattttt

SEQ ID NO: 296368 - DNA, 25 bp, Homo sapien
tttttcacctctgacagagcccaga

SEQ ID NO: 296369 - DNA, 25 bp, Homo sapien
gagcccagacaccatgaacgcaagt

SEQ ID NO: 296370 - DNA, 25 bp, Homo sapien
gaacgcaagtgaattccgaaggaga

SEQ ID NO: 296371 - DNA, 25 bp, Homo sapien
ggtggattacgtggccaactacatg

SEQ ID NO: 296372 - DNA, 25 bp, Homo sapien
aggcattgagggacgccaggtctac

SEQ ID NO: 296373 - DNA, 25 bp, Homo sapien
aagagtgactgtctcagtgccgagt

SEQ ID NO: 296374 - DNA, 25 bp, Homo sapien
agtgccgagtgcctcagcagcttct

SEQ ID NO: 296375 - DNA, 25 bp, Homo sapien
tgcctataccggacgccaggaatgt

SEQ ID NO: 296376 - DNA, 25 bp, Homo sapien
tataccggacgccaggaatgttctt

SEQ ID NO: 296377 - DNA, 25 bp, Homo sapien
caggaatgttcttctttgagtaaag

SEQ ID NO: 296378 - DNA, 25 bp, Homo sapien
gttcttctttgagtaaaggcagcct

SEQ ID NO: 296379 - DNA, 25 bp, Homo sapien
tctttgagtaaaggcagcctcacct

SEQ ID NO: 296380 - DNA, 25 bp, Homo sapien
cctggctctaggacctgaagaactc

SEQ ID NO: 296381 - DNA, 25 bp, Homo sapien
gctctaggacctgaagaactctcga

SEQ ID NO: 296382 - DNA, 25 bp, Homo sapien
tgaagaactctcgaaggacccagcc

SEQ ID NO: 296383 - DNA, 25 bp, Homo sapien
aagaactctcgaaggacccagccct

SEQ ID NO: 296384 - DNA, 25 bp, Homo sapien
tgagccaaggacaaccacacagaaa

SEQ ID NO: 296385 - DNA, 25 bp, Homo sapien
ggattgaagcggtgctcagccaggc

SEQ ID NO: 296386 - DNA, 25 bp, Homo sapien
gggcactactgtacttaggaataca

SEQ ID NO: 296387 - DNA, 25 bp, Homo sapien
aggaatacaactatatacatatgat

SEQ ID NO: 296388 - DNA, 25 bp, Homo sapien
gaccatattatatttgggtatctac

SEQ ID NO: 296389 - DNA, 25 bp, Homo sapien
ttgggtatctactaatattttgtat

SEQ ID NO: 296390 - DNA, 25 bp, Homo sapien
tgtataaagcaattttttgttccat

SEQ ID NO: 296391 - DNA, 25 bp, Homo sapien
ttttgttccattacgtgactttttg

SEQ ID NO: 296392 - DNA, 25 bp, Homo sapien
tccattacgtgactttttgttttat

SEQ ID NO: 296393 - DNA, 25 bp, Homo sapien
tgcttccccaaaccacacttttaat

SEQ ID NO: 296394 - DNA, 25 bp, Homo sapien
cacacttttaatcaaaacctagaat

SEQ ID NO: 296395 - DNA, 25 bp, Homo sapien
gaatcatctgcagtccttgttaaaa

SEQ ID NO: 296396 - DNA, 25 bp, Homo sapien
gcaggtttctagaaccctctgaagt

SEQ ID NO: 296397 - DNA, 25 bp, Homo sapien
tgagccaccagatgagaagccttga

SEQ ID NO: 296398 - DNA, 25 bp, Homo sapien
gagcaaggcgtcagaggctgctatt

SEQ ID NO: 296399 - DNA, 25 bp, Homo sapien
gaggctgctattgctttctgaggtt

SEQ ID NO: 296400 - DNA, 25 bp, Homo sapien
ctttctgaggtttaagtgtcccctg

SEQ ID NO: 296401 - DNA, 25 bp, Homo sapien
tcccaggctgttactagccacagat

SEQ ID NO: 296402 - DNA, 25 bp, Homo sapien
gttactagccacagatccacagcag

SEQ ID NO: 296403 - DNA, 25 bp, Homo sapien
gggaccatatgtcgaactgtttaca

SEQ ID NO: 296404 - DNA, 25 bp, Homo sapien
actgtttacatggatgttgctctaa

SEQ ID NO: 296405 - DNA, 25 bp, Homo sapien
ctaagtgaatgtttcgggatgccga

SEQ ID NO: 296406 - DNA, 25 bp, Homo sapien
gatgaaatcacagccatagcaggga

SEQ ID NO: 296407 - DNA, 25 bp, Homo sapien
agtctgagcctgattaaaacataca

SEQ ID NO: 296408 - DNA, 25 bp, Homo sapien
tttttcacctctgacagagcccaga

SEQ ID NO: 296409 - DNA, 25 bp, Homo sapien
tgacagagcccagacaccatgaacg

SEQ ID NO: 296410 - DNA, 25 bp, Homo sapien
gagcccagacaccatgaacgcaagt

SEQ ID NO: 296411 - DNA, 25 bp, Homo sapien
gcccagacaccatgaacgcaagtga

SEQ ID NO: 296412 - DNA, 25 bp, Homo sapien
caccatgaacgcaagtgaattccga

SEQ ID NO: 296413 - DNA, 25 bp, Homo sapien
gaacgcaagtgaattccgaaggaga

SEQ ID NO: 296414 - DNA, 25 bp, Homo sapien
gagatggtggattacgtggccaact

SEQ ID NO: 296415 - DNA, 25 bp, Homo sapien
tggtggattacgtggccaactacat

SEQ ID NO: 296416 - DNA, 25 bp, Homo sapien
ggattacgtggccaactacatggaa

SEQ ID NO: 296417 - DNA, 25 bp, Homo sapien
tacgtggccaactacatggaaggca

SEQ ID NO: 296418 - DNA, 25 bp, Homo sapien
aggcattgagggacgccaggtctac

SEQ ID NO: 296419 - DNA, 25 bp, Homo sapien
accaggattgcatttgaagttaagc

SEQ ID NO: 296420 - DNA, 25 bp, Homo sapien
gcaaaaaaccagtcgatcaacagat

SEQ ID NO: 296421 - DNA, 25 bp, Homo sapien
aaccagtcgatcaacagattttcga

SEQ ID NO: 296422 - DNA, 25 bp, Homo sapien
agattttcgagtcccacagtcaata

SEQ ID NO: 296423 - DNA, 25 bp, Homo sapien
tttcgagtcccacagtcaatatgca

SEQ ID NO: 296424 - DNA, 25 bp, Homo sapien
gagtcccacagtcaatatgcaccat

SEQ ID NO: 296425 - DNA, 25 bp, Homo sapien
gtcccacagtcaatatgcaccatgt

SEQ ID NO: 296426 - DNA, 25 bp, Homo sapien
gtcaatatgcaccatgtttaatgtt

SEQ ID NO: 296427 - DNA, 25 bp, Homo sapien
catgtttaatgttatggttgatgcc

SEQ ID NO: 296428 - DNA, 25 bp, Homo sapien
gttatggttgatgccaaagctcaat

SEQ ID NO: 296429 - DNA, 25 bp, Homo sapien
ttgatgccaaagctcaatcaacaaa

SEQ ID NO: 296430 - DNA, 25 bp, Homo sapien
tctcaatcaggaaagatacccaaat

SEQ ID NO: 296431 - DNA, 25 bp, Homo sapien
gggaaaaacctgacatccagctcca

SEQ ID NO: 296432 - DNA, 25 bp, Homo sapien
agcagaactcagtccctcaatggcc

SEQ ID NO: 296433 - DNA, 25 bp, Homo sapien
ggaaacatctctgtattcccttttt

SEQ ID NO: 296434 - DNA, 25 bp, Homo sapien
ttttgaagggactccgtggtctcca

SEQ ID NO: 296435 - DNA, 25 bp, Homo sapien
agggactccgtggtctccatcactt

SEQ ID NO: 296436 - DNA, 25 bp, Homo sapien
atcacttcctgccagttcagatcat

SEQ ID NO: 296437 - DNA, 25 bp, Homo sapien
gttcagatcattcaacaccagccag

SEQ ID NO: 296438 - DNA, 25 bp, Homo sapien
acacacaaccataattctgttccat

SEQ ID NO: 296439 - DNA, 25 bp, Homo sapien
aattctgttccattctccaattttg

SEQ ID NO: 296440 - DNA, 25 bp, Homo sapien
attctccaattttggacccattggg

SEQ ID NO: 296441 - DNA, 25 bp, Homo sapien
gagactagtacatcactgggaataa

SEQ ID NO: 296442 - DNA, 25 bp, Homo sapien
tggtagttttgagatcagacacatc

SEQ ID NO: 296443 - DNA, 25 bp, Homo sapien
agatcagacacatctctcatccaat

SEQ ID NO: 296444 - DNA, 25 bp, Homo sapien
cacatctctcatccaattttctttt

SEQ ID NO: 296445 - DNA, 25 bp, Homo sapien
gaggcaggtgagactctaaaatatt

SEQ ID NO: 296446 - DNA, 25 bp, Homo sapien
agtagtaaagtataatcacatccct

SEQ ID NO: 296447 - DNA, 25 bp, Homo sapien
atcacatccctgttataagtgagga

SEQ ID NO: 296448 - DNA, 25 bp, Homo sapien
ttattgagtttcatcttttattggg

SEQ ID NO: 296449 - DNA, 25 bp, Homo sapien
gaaacatactttgtcagcagctgtc

SEQ ID NO: 296450 - DNA, 25 bp, Homo sapien
catactttgtcagcagctgtctcag

SEQ ID NO: 296451 - DNA, 25 bp, Homo sapien
gctgtctcaggaagagactcttcaa

SEQ ID NO: 296452 - DNA, 25 bp, Homo sapien
aggactcccactattgcctctgtga

SEQ ID NO: 296453 - DNA, 25 bp, Homo sapien
actcccactattgcctctgtgattg

SEQ ID NO: 296454 - DNA, 25 bp, Homo sapien
gattggcccaggaggaaaacacgac

SEQ ID NO: 296455 - DNA, 25 bp, Homo sapien
gggaagcactgtcatcttccacgtc

SEQ ID NO: 296456 - DNA, 25 bp, Homo sapien
gaagcactgtcatcttccacgtcat

SEQ ID NO: 296457 - DNA, 25 bp, Homo sapien
actgtcatcttccacgtcatcttca

SEQ ID NO: 296458 - DNA, 25 bp, Homo sapien
gcccatcctgccctttagatctggg

SEQ ID NO: 296459 - DNA, 25 bp, Homo sapien
catcctgccctttagatctgggcac

SEQ ID NO: 296460 - DNA, 25 bp, Homo sapien
ctgccctttagatctgggcaccaat

SEQ ID NO: 296461 - DNA, 25 bp, Homo sapien
ccctttagatctgggcaccaataaa

SEQ ID NO: 296462 - DNA, 25 bp, Homo sapien
ttagatctgggcaccaataaaggcg

SEQ ID NO: 296463 - DNA, 25 bp, Homo sapien
gtacttgaatcttttttgcgctgag

SEQ ID NO: 296464 - DNA, 25 bp, Homo sapien
agaattcattctaacatcttgtttc

SEQ ID NO: 296465 - DNA, 25 bp, Homo sapien
atcttgtttcataagggccacatca

SEQ ID NO: 296466 - DNA, 25 bp, Homo sapien
gggccacatcattcgttggagcatg

SEQ ID NO: 296467 - DNA, 25 bp, Homo sapien
gtgtacaattgttacctctcagctg

SEQ ID NO: 296468 - DNA, 25 bp, Homo sapien
ctctcagctgctgaagttcacactt

SEQ ID NO: 296469 - DNA, 25 bp, Homo sapien
acacttcaaggatctaggagctctg

SEQ ID NO: 296470 - DNA, 25 bp, Homo sapien
gggtcgtccagcaagatgctgattt

SEQ ID NO: 296471 - DNA, 25 bp, Homo sapien
gatgctgatttgtctttcagttggt

SEQ ID NO: 296472 - DNA, 25 bp, Homo sapien
cagttggtatggtttctgtgatcgg

SEQ ID NO: 296473 - DNA, 25 bp, Homo sapien
agcagcccaactcatgctttggaat

SEQ ID NO: 296474 - DNA, 25 bp, Homo sapien
aaaaaagtgcctcagagggcattaa

SEQ ID NO: 296475 - DNA, 25 bp, Homo sapien
gcctcagagggcattaaagatccac

SEQ ID NO: 296476 - DNA, 25 bp, Homo sapien
gcattaaagatccactctgccctgg

SEQ ID NO: 296477 - DNA, 25 bp, Homo sapien
tttctttcctgctggttcagctctc

SEQ ID NO: 296478 - DNA, 25 bp, Homo sapien
tccccactcctgtgaccatttggga

SEQ ID NO: 296479 - DNA, 25 bp, Homo sapien
tcctgtgaccatttgggaggtgcca

SEQ ID NO: 296480 - DNA, 25 bp, Homo sapien
ctgcagtgccgtgggtgcctgacca

SEQ ID NO: 296481 - DNA, 25 bp, Homo sapien
gggtacccaaccagggttgcagcca

SEQ ID NO: 296482 - DNA, 25 bp, Homo sapien
aaccagggttgcagccacaggaatc

SEQ ID NO: 296483 - DNA, 25 bp, Homo sapien
gccacaggaatcctcatggtttcca

SEQ ID NO: 296484 - DNA, 25 bp, Homo sapien
tggtttccagggaacacaagggaat

SEQ ID NO: 296485 - DNA, 25 bp, Homo sapien
tccagaaggatcagccaggtcccgg

SEQ ID NO: 296486 - DNA, 25 bp, Homo sapien
gatcagccaggtcccggcagctcaa

SEQ ID NO: 296487 - DNA, 25 bp, Homo sapien
tcaaccgggccaaggtgccggagac

SEQ ID NO: 296488 - DNA, 25 bp, Homo sapien
aaggtgccggagaccctcggactct

SEQ ID NO: 296489 - DNA, 25 bp, Homo sapien
gagaccctcggactctgcagactgt

SEQ ID NO: 296490 - DNA, 25 bp, Homo sapien
cctcggactctgcagactgtccagt

SEQ ID NO: 296491 - DNA, 25 bp, Homo sapien
gccctgaagagactcaaggatccta

SEQ ID NO: 296492 - DNA, 25 bp, Homo sapien
agggtagcgcctccggccaacacaa

SEQ ID NO: 296493 - DNA, 25 bp, Homo sapien
gccaacacaataggattcacctggg

SEQ ID NO: 296494 - DNA, 25 bp, Homo sapien
gggccagctccggagatttctgaga

SEQ ID NO: 296495 - DNA, 25 bp, Homo sapien
ggagatttctgagaggctcctcctc

SEQ ID NO: 296496 - DNA, 25 bp, Homo sapien
agctgtgtagctttcctatgtgtgt

SEQ ID NO: 296497 - DNA, 25 bp, Homo sapien
ttcctatgtgtgtattcaggcaggg

SEQ ID NO: 296498 - DNA, 25 bp, Homo sapien
agggaagatattccctggcaagctc

SEQ ID NO: 296499 - DNA, 25 bp, Homo sapien
cctggcaagctctcaggcatctcag

SEQ ID NO: 296500 - DNA, 25 bp, Homo sapien
ggcacttctttgtatccatggcaat

SEQ ID NO: 296501 - DNA, 25 bp, Homo sapien
gtatccatggcaatttgctttcccc

SEQ ID NO: 296502 - DNA, 25 bp, Homo sapien
tgctttcccctcactgaactgagat

SEQ ID NO: 296503 - DNA, 25 bp, Homo sapien
gaatgttactctgttggtggctccc

SEQ ID NO: 296504 - DNA, 25 bp, Homo sapien
gggtgactcagtgacaatagtgcta

SEQ ID NO: 296505 - DNA, 25 bp, Homo sapien
caatagtgctagaagtatgagtcaa

SEQ ID NO: 296506 - DNA, 25 bp, Homo sapien
atgagtcaaaacactgtacaacttg

SEQ ID NO: 296507 - DNA, 25 bp, Homo sapien
gtacctggcacatatttcatgctta

SEQ ID NO: 296508 - DNA, 25 bp, Homo sapien
aggtgatagctcctaatgttcttag

SEQ ID NO: 296509 - DNA, 25 bp, Homo sapien
ttaggaaacaccaagtcatatcact

SEQ ID NO: 296510 - DNA, 25 bp, Homo sapien
caagtcatatcacttaactgtgcca

SEQ ID NO: 296511 - DNA, 25 bp, Homo sapien
gccaacagtgttgagacagggttat

SEQ ID NO: 296512 - DNA, 25 bp, Homo sapien
aaggttaagtcgcttgcccaactgg

SEQ ID NO: 296513 - DNA, 25 bp, Homo sapien
tggcagcagagccatgtgctgaccc

SEQ ID NO: 296514 - DNA, 25 bp, Homo sapien
cagtgtgcctgactcctacctaggc

SEQ ID NO: 296515 - DNA, 25 bp, Homo sapien
cctctgtagcatgttcccacatgaa

SEQ ID NO: 296516 - DNA, 25 bp, Homo sapien
aaggttggtgtgtcaagtgattaac

SEQ ID NO: 296517 - DNA, 25 bp, Homo sapien
gtgattaacagcagtacctggcaca

SEQ ID NO: 296518 - DNA, 25 bp, Homo sapien
tgagtattccatactgctgcccctg

SEQ ID NO: 296519 - DNA, 25 bp, Homo sapien
tttgtcatctattgtgagagtcgtg

SEQ ID NO: 296520 - DNA, 25 bp, Homo sapien
gagagtcgtgatatcaccttccaca

SEQ ID NO: 296521 - DNA, 25 bp, Homo sapien
caccttccacatcagtgatactgag

SEQ ID NO: 296522 - DNA, 25 bp, Homo sapien
aaatctgccaaagatgcttcacagt

SEQ ID NO: 296523 - DNA, 25 bp, Homo sapien
gcttcacagttagttgttacctttt

SEQ ID NO: 296524 - DNA, 25 bp, Homo sapien
gttacctttttaagaagactgtgct

SEQ ID NO: 296525 - DNA, 25 bp, Homo sapien
acagtttgctgggtgttgaccaaca

SEQ ID NO: 296526 - DNA, 25 bp, Homo sapien
gaccaacatcaaactgcttatccag

SEQ ID NO: 296527 - DNA, 25 bp, Homo sapien
gcttatccaggaaccactagaagtg

SEQ ID NO: 296528 - DNA, 25 bp, Homo sapien
gtgaatctcttcttgagtattccat

SEQ ID NO: 296529 - DNA, 25 bp, Homo sapien
tattttttaccaaaagagtatcaag

SEQ ID NO: 296530 - DNA, 25 bp, Homo sapien
ttttaccaaaagagtatcaaggcca

SEQ ID NO: 296531 - DNA, 25 bp, Homo sapien
tttaccaaaagagtatcaaggccag

SEQ ID NO: 296532 - DNA, 25 bp, Homo sapien
ttaccaaaagagtatcaaggccaga

SEQ ID NO: 296533 - DNA, 25 bp, Homo sapien
taccaaaagagtatcaaggccagag

SEQ ID NO: 296534 - DNA, 25 bp, Homo sapien
ccagagtggtgggtggcacatgctt

SEQ ID NO: 296535 - DNA, 25 bp, Homo sapien
cagagtggtgggtggcacatgctta

SEQ ID NO: 296536 - DNA, 25 bp, Homo sapien
ctactcagtagtcttaggtgggaag

SEQ ID NO: 296537 - DNA, 25 bp, Homo sapien
cagggagctgaattcgtgccagtgc

SEQ ID NO: 296538 - DNA, 25 bp, Homo sapien
agggagctgaattcgtgccagtgca

SEQ ID NO: 296539 - DNA, 25 bp, Homo sapien
aacagtaaccggacaagcccattct

SEQ ID NO: 296540 - DNA, 25 bp, Homo sapien
ttggttacctgtaacagggcctcaa

SEQ ID NO: 296541 - DNA, 25 bp, Homo sapien
agggtcatagacttgcccattgctt

SEQ ID NO: 296542 - DNA, 25 bp, Homo sapien
tgctgtggacattccaagagcccag

SEQ ID NO: 296543 - DNA, 25 bp, Homo sapien
ctcctgtgggactcgcaaacataaa

SEQ ID NO: 296544 - DNA, 25 bp, Homo sapien
cataaaatctcaggctctctcattc

SEQ ID NO: 296545 - DNA, 25 bp, Homo sapien
tctctcattctcacatctacattac

SEQ ID NO: 296546 - DNA, 25 bp, Homo sapien
agagcccagaggcaactcaggccaa

SEQ ID NO: 296547 - DNA, 25 bp, Homo sapien
aggccaaggcgagtctgtctgttct

SEQ ID NO: 296548 - DNA, 25 bp, Homo sapien
gtctgtctgttctgaatctcttagg

SEQ ID NO: 296549 - DNA, 25 bp, Homo sapien
gaatctcttaggtcagttctgaatc

SEQ ID NO: 296550 - DNA, 25 bp, Homo sapien
gattaggaacacagacttgccgaca

SEQ ID NO: 296551 - DNA, 25 bp, Homo sapien
agacttgccgacatgctgtaagaaa

SEQ ID NO: 296552 - DNA, 25 bp, Homo sapien
ggttccaatggaagtgcacattcta

SEQ ID NO: 296553 - DNA, 25 bp, Homo sapien
gcacattctaaagcagttggcctgc

SEQ ID NO: 296554 - DNA, 25 bp, Homo sapien
gatgctgtcactgtataatttgata

SEQ ID NO: 296555 - DNA, 25 bp, Homo sapien
gttatttaaaaactgctccctaatg

SEQ ID NO: 296556 - DNA, 25 bp, Homo sapien
gctccctaatggcatggtttggtga

SEQ ID NO: 296557 - DNA, 25 bp, Homo sapien
gtttcatgccataatgctgtaccac

SEQ ID NO: 296558 - DNA, 25 bp, Homo sapien
tgctgtaccacattctgagattaga

SEQ ID NO: 296559 - DNA, 25 bp, Homo sapien
gagattagaacagagtacccacctt

SEQ ID NO: 296560 - DNA, 25 bp, Homo sapien
gagtacccaccttcatgaaatttca

SEQ ID NO: 296561 - DNA, 25 bp, Homo sapien
acaagggtccttctgtacttttcat

SEQ ID NO: 296562 - DNA, 25 bp, Homo sapien
ggtccttctgtacttttcatttgaa

SEQ ID NO: 296563 - DNA, 25 bp, Homo sapien
gaatcatatcctctaactactctgt

SEQ ID NO: 296564 - DNA, 25 bp, Homo sapien
ctctaactactctgtaagaaacgtt

SEQ ID NO: 296565 - DNA, 25 bp, Homo sapien
gaaacgtttttacatcaatattttg

SEQ ID NO: 296566 - DNA, 25 bp, Homo sapien
ttgctataccaatacagtcattaat

SEQ ID NO: 296567 - DNA, 25 bp, Homo sapien
cagtcattaattttacttggtgttt

SEQ ID NO: 296568 - DNA, 25 bp, Homo sapien
gttttcttcaccatatgtctgtttg

SEQ ID NO: 296569 - DNA, 25 bp, Homo sapien
caccatatgtctgtttgatttaagt

SEQ ID NO: 296570 - DNA, 25 bp, Homo sapien
gaatttagatttgtacagttctgga

SEQ ID NO: 296571 - DNA, 25 bp, Homo sapien
tatagaggagatacattctgtttct

SEQ ID NO: 296572 - DNA, 25 bp, Homo sapien
aagggtgcccaggaaccggcatcca

SEQ ID NO: 296573 - DNA, 25 bp, Homo sapien
aaatcagccctggagtagacctgcc

SEQ ID NO: 296574 - DNA, 25 bp, Homo sapien
taccaagttagcctccctttcagtt

SEQ ID NO: 296575 - DNA, 25 bp, Homo sapien
agttccgtctgacccctgtgttggt

SEQ ID NO: 296576 - DNA, 25 bp, Homo sapien
cgtctcttctcgtggtagcgggtta

SEQ ID NO: 296577 - DNA, 25 bp, Homo sapien
gcgggttagtgtttcagtgttctta

SEQ ID NO: 296578 - DNA, 25 bp, Homo sapien
agtgttcttaactccaatctgcttg

SEQ ID NO: 296579 - DNA, 25 bp, Homo sapien
tccaatctgcttgttcattgtacaa

SEQ ID NO: 296580 - DNA, 25 bp, Homo sapien
caatgtgcttcttttaaggccccat

SEQ ID NO: 296581 - DNA, 25 bp, Homo sapien
aggccccatttttgtaacttgagtg

SEQ ID NO: 296582 - DNA, 25 bp, Homo sapien
acttgagtgtgtcattcatctgaac

SEQ ID NO: 296583 - DNA, 25 bp, Homo sapien
gagagaggcccagtctatagcccgc

SEQ ID NO: 296584 - DNA, 25 bp, Homo sapien
tatagcccgcattaggcttcagaca

SEQ ID NO: 296585 - DNA, 25 bp, Homo sapien
gcttcagacaggtgagtaaggccat

SEQ ID NO: 296586 - DNA, 25 bp, Homo sapien
agtaaggccatcatagaccctccaa

SEQ ID NO: 296587 - DNA, 25 bp, Homo sapien
agctgccagataactaacgtctcat

SEQ ID NO: 296588 - DNA, 25 bp, Homo sapien
acgtctcatgagaaagcccaggcga

SEQ ID NO: 296589 - DNA, 25 bp, Homo sapien
gaaagcccaggcgagaccagcagaa

SEQ ID NO: 296590 - DNA, 25 bp, Homo sapien
ggcataagttgctttgtagcttctc

SEQ ID NO: 296591 - DNA, 25 bp, Homo sapien
tgcccagctgagcttagcctgaatt

SEQ ID NO: 296592 - DNA, 25 bp, Homo sapien
ttagcctgaattgcagacacatgag

SEQ ID NO: 296593 - DNA, 25 bp, Homo sapien
atcctccaccaccatgtaaggaagc

SEQ ID NO: 296594 - DNA, 25 bp, Homo sapien
tttgactttgtacagctggaaacca

SEQ ID NO: 296595 - DNA, 25 bp, Homo sapien
gctggaaaccagcaatgctggaaat

SEQ ID NO: 296596 - DNA, 25 bp, Homo sapien
aaatgagcactgaaggcagtttaat

SEQ ID NO: 296597 - DNA, 25 bp, Homo sapien
gcagtttaatgggtttgtcacttgt

SEQ ID NO: 296598 - DNA, 25 bp, Homo sapien
acttgtaaccaagtgacccatggca

SEQ ID NO: 296599 - DNA, 25 bp, Homo sapien
aaccaagtgacccatggcaagctca

SEQ ID NO: 296600 - DNA, 25 bp, Homo sapien
gacccatggcaagctcacagatttg

SEQ ID NO: 296601 - DNA, 25 bp, Homo sapien
ccatggcaagctcacagatttgtat

SEQ ID NO: 296602 - DNA, 25 bp, Homo sapien
gagttgctggcaaccatctttgcaa

SEQ ID NO: 296603 - DNA, 25 bp, Homo sapien
gcaaccatctttgcaaccatgcagg

SEQ ID NO: 296604 - DNA, 25 bp, Homo sapien
caaccatgcagggagaactactttg

SEQ ID NO: 296605 - DNA, 25 bp, Homo sapien
aaagctcatatttgatccagctagg

SEQ ID NO: 296606 - DNA, 25 bp, Homo sapien
gatccagctaggattttaccctgta

SEQ ID NO: 296607 - DNA, 25 bp, Homo sapien
ggattttaccctgtacatttgtatt

SEQ ID NO: 296608 - DNA, 25 bp, Homo sapien
ttgtatttcttgtaggctggcgcac

SEQ ID NO: 296609 - DNA, 25 bp, Homo sapien
gtaggctggcgcacagatatcttaa

SEQ ID NO: 296610 - DNA, 25 bp, Homo sapien
aaatggctactaattgctgctgtgt

SEQ ID NO: 296611 - DNA, 25 bp, Homo sapien
aaatggctatcaaggccgggtgcag

SEQ ID NO: 296612 - DNA, 25 bp, Homo sapien
gtgcagtggcttacagatctggtct

SEQ ID NO: 296613 - DNA, 25 bp, Homo sapien
gaatctcaagtccagaccagtccag

SEQ ID NO: 296614 - DNA, 25 bp, Homo sapien
agtccagaccagtccagagttcaag

SEQ ID NO: 296615 - DNA, 25 bp, Homo sapien
acaggcataaaccacaactcaataa

SEQ ID NO: 296616 - DNA, 25 bp, Homo sapien
agtggaagtttcttcggatcttgtt

SEQ ID NO: 296617 - DNA, 25 bp, Homo sapien
gtggaagtttcttcggatcttgttt

SEQ ID NO: 296618 - DNA, 25 bp, Homo sapien
gaagtttcttcggatcttgtttaga

SEQ ID NO: 296619 - DNA, 25 bp, Homo sapien
gatgctaccaaattgtgccttccta

SEQ ID NO: 296620 - DNA, 25 bp, Homo sapien
gctaccaaattgtgccttcctaaat

SEQ ID NO: 296621 - DNA, 25 bp, Homo sapien
aaattgtgccttcctaaataacatt

SEQ ID NO: 296622 - DNA, 25 bp, Homo sapien
ttgagagcattttaacagcagttta

SEQ ID NO: 296623 - DNA, 25 bp, Homo sapien
tatgttttgggctgttttcaaagaa

SEQ ID NO: 296624 - DNA, 25 bp, Homo sapien
tgatagaacccttagagtgactgtg

SEQ ID NO: 296625 - DNA, 25 bp, Homo sapien
aacccttagagtgactgtgggagaa

SEQ ID NO: 296626 - DNA, 25 bp, Homo sapien
acaaagtgtcacatcaacaaagttt

SEQ ID NO: 296627 - DNA, 25 bp, Homo sapien
taaaaagaatactaactggccggat

SEQ ID NO: 296628 - DNA, 25 bp, Homo sapien
aaaaagaatactaactggccggatg

SEQ ID NO: 296629 - DNA, 25 bp, Homo sapien
aaaagaatactaactggccggatgt

SEQ ID NO: 296630 - DNA, 25 bp, Homo sapien
aaagaatactaactggccggatgtg

SEQ ID NO: 296631 - DNA, 25 bp, Homo sapien
aagaatactaactggccggatgtgg

SEQ ID NO: 296632 - DNA, 25 bp, Homo sapien
agaatactaactggccggatgtggt

SEQ ID NO: 296633 - DNA, 25 bp, Homo sapien
gaatactaactggccggatgtggtg

SEQ ID NO: 296634 - DNA, 25 bp, Homo sapien
aatactaactggccggatgtggtgg

SEQ ID NO: 296635 - DNA, 25 bp, Homo sapien
atactaactggccggatgtggtggc

SEQ ID NO: 296636 - DNA, 25 bp, Homo sapien
actaactggccggatgtggtggctc

SEQ ID NO: 296637 - DNA, 25 bp, Homo sapien
ctaactggccggatgtggtggctca

SEQ ID NO: 296638 - DNA, 25 bp, Homo sapien
tttttcctctgctcaactctatgtc

SEQ ID NO: 296639 - DNA, 25 bp, Homo sapien
gggatcatcctgtgttagcacatag

SEQ ID NO: 296640 - DNA, 25 bp, Homo sapien
gtgttagcacatagaggtttacctc

SEQ ID NO: 296641 - DNA, 25 bp, Homo sapien
tctattccccatctgtgcagttgcc

SEQ ID NO: 296642 - DNA, 25 bp, Homo sapien
tgcagttgccttccccagcgtcaat

SEQ ID NO: 296643 - DNA, 25 bp, Homo sapien
agcgtcaatcgctgtgactggtgtc

SEQ ID NO: 296644 - DNA, 25 bp, Homo sapien
tgtcttctgtaaacttccagagtta

SEQ ID NO: 296645 - DNA, 25 bp, Homo sapien
acttccagagttatcgagcatatat

SEQ ID NO: 296646 - DNA, 25 bp, Homo sapien
tactgtatgctagtgtatttcacac

SEQ ID NO: 296647 - DNA, 25 bp, Homo sapien
ccctacagttttcacttggatcata

SEQ ID NO: 296648 - DNA, 25 bp, Homo sapien
catatatcttagagcattttgtgtc

SEQ ID NO: 296649 - DNA, 25 bp, Homo sapien
ggtactacaagcacatgagttgttg

SEQ ID NO: 296650 - DNA, 25 bp, Homo sapien
gagttgttgttaacttttaactgct

SEQ ID NO: 296651 - DNA, 25 bp, Homo sapien
ttccatctttattgcaggtccccat

SEQ ID NO: 296652 - DNA, 25 bp, Homo sapien
cttttatggagaaattggtctgcga

SEQ ID NO: 296653 - DNA, 25 bp, Homo sapien
gcaatacttacatatggcaccaaag

SEQ ID NO: 296654 - DNA, 25 bp, Homo sapien
ggcaccaaagggagttaaccagcag

SEQ ID NO: 296655 - DNA, 25 bp, Homo sapien
taaccagcagagtagactttgttct

SEQ ID NO: 296656 - DNA, 25 bp, Homo sapien
ttgttctgctcaaagatgccggttt

SEQ ID NO: 296657 - DNA, 25 bp, Homo sapien
tcaaagatgccggttttaacttgga

SEQ ID NO: 296658 - DNA, 25 bp, Homo sapien
taacttggacttacagaccttggaa

SEQ ID NO: 296659 - DNA, 25 bp, Homo sapien
cattctgtcaaggtactacaagcac

SEQ ID NO: 296660 - DNA, 25 bp, Homo sapien
taaacttcaaacattccacttttgt

SEQ ID NO: 296661 - DNA, 25 bp, Homo sapien
caaacattccacttttgtaatttgt

SEQ ID NO: 296662 - DNA, 25 bp, Homo sapien
gtaagcacaactgtaatctagtttt

SEQ ID NO: 296663 - DNA, 25 bp, Homo sapien
tctagttttaagagaaaccggtgct

SEQ ID NO: 296664 - DNA, 25 bp, Homo sapien
gtttgttgcaacagccattttcttg

SEQ ID NO: 296665 - DNA, 25 bp, Homo sapien
gcaacagccattttcttgggagaaa

SEQ ID NO: 296666 - DNA, 25 bp, Homo sapien
aagcttgagtgtaaagccatttgta

SEQ ID NO: 296667 - DNA, 25 bp, Homo sapien
ttgtaaaaggctttgccatactcat

SEQ ID NO: 296668 - DNA, 25 bp, Homo sapien
gccatactcattttaatatgtgcct

SEQ ID NO: 296669 - DNA, 25 bp, Homo sapien
aatatgtgcctgttgctgttaactt

SEQ ID NO: 296670 - DNA, 25 bp, Homo sapien
ttgctgttaacttttgatgaataaa

SEQ ID NO: 296671 - DNA, 25 bp, Homo sapien
ttgtccaggctgacagaactgcatt

SEQ ID NO: 296672 - DNA, 25 bp, Homo sapien
gacagaactgcatttttaattctat

SEQ ID NO: 296673 - DNA, 25 bp, Homo sapien
gaactgcatttttaattctatagaa

SEQ ID NO: 296674 - DNA, 25 bp, Homo sapien
tataattctttataggacttcctgg

SEQ ID NO: 296675 - DNA, 25 bp, Homo sapien
ataattctttataggacttcctggt

SEQ ID NO: 296676 - DNA, 25 bp, Homo sapien
taattctttataggacttcctggtc

SEQ ID NO: 296677 - DNA, 25 bp, Homo sapien
aattctttataggacttcctggtca

SEQ ID NO: 296678 - DNA, 25 bp, Homo sapien
attctttataggacttcctggtcaa

SEQ ID NO: 296679 - DNA, 25 bp, Homo sapien
ttctttataggacttcctggtcaat

SEQ ID NO: 296680 - DNA, 25 bp, Homo sapien
ttaatttaagtggtctcactctgtt

SEQ ID NO: 296681 - DNA, 25 bp, Homo sapien
taatttaagtggtctcactctgtta

SEQ ID NO: 296682 - DNA, 25 bp, Homo sapien
tacaaccatgacatttcaacttttg

SEQ ID NO: 296683 - DNA, 25 bp, Homo sapien
tcaacttttgatatgggcaactaac

SEQ ID NO: 296684 - DNA, 25 bp, Homo sapien
ggcaactaacagtgacccatctgtc

SEQ ID NO: 296685 - DNA, 25 bp, Homo sapien
tgtcagtcagaagtcctcgtgggtc

SEQ ID NO: 296686 - DNA, 25 bp, Homo sapien
ctgtctgtctgctaaaagtcctcat

SEQ ID NO: 296687 - DNA, 25 bp, Homo sapien
taaaagtcctcatgggtccgtctgt

SEQ ID NO: 296688 - DNA, 25 bp, Homo sapien
tgggtccgtctgtctgtgttctaaa

SEQ ID NO: 296689 - DNA, 25 bp, Homo sapien
gaagtacttcttttctggcctactg

SEQ ID NO: 296690 - DNA, 25 bp, Homo sapien
gagattagatacatttgtcccctct

SEQ ID NO: 296691 - DNA, 25 bp, Homo sapien
tacatttgtcccctctagacagagg

SEQ ID NO: 296692 - DNA, 25 bp, Homo sapien
ggtaacacctgagtacagaccttaa

SEQ ID NO: 296693 - DNA, 25 bp, Homo sapien
gaggactcagcttcactagcttgga

SEQ ID NO: 296694 - DNA, 25 bp, Homo sapien
tcactagcttggaaattacatattt

SEQ ID NO: 296695 - DNA, 25 bp, Homo sapien
catatttggagggatgagagcccat

SEQ ID NO: 296696 - DNA, 25 bp, Homo sapien
atagggtaggctcagtgtcagtgtt

SEQ ID NO: 296697 - DNA, 25 bp, Homo sapien
ttttgtttcttccttgttccataca

SEQ ID NO: 296698 - DNA, 25 bp, Homo sapien
tcttccttgttccatacacttgagt

SEQ ID NO: 296699 - DNA, 25 bp, Homo sapien
atacacttgagtagggatacatggt

SEQ ID NO: 296700 - DNA, 25 bp, Homo sapien
gggatacatggtattaacctcttta

SEQ ID NO: 296701 - DNA, 25 bp, Homo sapien
taacctctttaaacaggtctctaat

SEQ ID NO: 296702 - DNA, 25 bp, Homo sapien
aaacaggtctctaatttcatctcat

SEQ ID NO: 296703 - DNA, 25 bp, Homo sapien
caggtctctaatttcatctcattaa

SEQ ID NO: 296704 - DNA, 25 bp, Homo sapien
agctggcaaaggagtaaggcaaatt

SEQ ID NO: 296705 - DNA, 25 bp, Homo sapien
gtaaggcaaattcagtactcttctg

SEQ ID NO: 296706 - DNA, 25 bp, Homo sapien
agtactcttctgattcttaaatgct

SEQ ID NO: 296707 - DNA, 25 bp, Homo sapien
tcttaaatgctgatagttcttgatt

SEQ ID NO: 296708 - DNA, 25 bp, Homo sapien
ctgatagttcttgatttatcattcc

SEQ ID NO: 296709 - DNA, 25 bp, Homo sapien
tacatgtatatgttgctgtttgctg

SEQ ID NO: 296710 - DNA, 25 bp, Homo sapien
tatatgttgctgtttgctggctgct

SEQ ID NO: 296711 - DNA, 25 bp, Homo sapien
gctggctgcttttcagttaaatagc

SEQ ID NO: 296712 - DNA, 25 bp, Homo sapien
tagcattatttataggcctgtaaat

SEQ ID NO: 296713 - DNA, 25 bp, Homo sapien
gattattatgtatgtcccatgagta

SEQ ID NO: 296714 - DNA, 25 bp, Homo sapien
gtatgtcccatgagtagatgtaata

SEQ ID NO: 296715 - DNA, 25 bp, Homo sapien
tgaccccggctctattatttcagtt

SEQ ID NO: 296716 - DNA, 25 bp, Homo sapien
cggctctattatttcagtttttcct

SEQ ID NO: 296717 - DNA, 25 bp, Homo sapien
atgctggctttgacacaccaactga

SEQ ID NO: 296718 - DNA, 25 bp, Homo sapien
tggctttgacacaccaactgacaaa

SEQ ID NO: 296719 - DNA, 25 bp, Homo sapien
gacacaccaactgacaaagtctttc

SEQ ID NO: 296720 - DNA, 25 bp, Homo sapien
gttggagctgctaggttgtgcccct

SEQ ID NO: 296721 - DNA, 25 bp, Homo sapien
ggagctgctaggttgtgcccctgcc

SEQ ID NO: 296722 - DNA, 25 bp, Homo sapien
ccctcctgaaaattagccacacgaa

SEQ ID NO: 296723 - DNA, 25 bp, Homo sapien
ttagccacacgaaaggaagggtctg

SEQ ID NO: 296724 - DNA, 25 bp, Homo sapien
gtgccctgctgatgttgacactgac

SEQ ID NO: 296725 - DNA, 25 bp, Homo sapien
tgctgatgttgacactgaccccggc

SEQ ID NO: 296726 - DNA, 25 bp, Homo sapien
tgggaggctgctgcacgcgcattct

SEQ ID NO: 296727 - DNA, 25 bp, Homo sapien
tgatgctcacgtcacttggtgtagg

SEQ ID NO: 296728 - DNA, 25 bp, Homo sapien
acttggtgtaggtttcaggatcgcc

SEQ ID NO: 296729 - DNA, 25 bp, Homo sapien
ggatcgcctctttgaggaaggactt

SEQ ID NO: 296730 - DNA, 25 bp, Homo sapien
agagtactcacagcttgtatctccc

SEQ ID NO: 296731 - DNA, 25 bp, Homo sapien
atcctagaaccccattgtcctttat

SEQ ID NO: 296732 - DNA, 25 bp, Homo sapien
attgtcctttattccaccaaaccag

SEQ ID NO: 296733 - DNA, 25 bp, Homo sapien
caaaccagctccaggtgaccagact

SEQ ID NO: 296734 - DNA, 25 bp, Homo sapien
gactctactcagaaagcaaattcgt

SEQ ID NO: 296735 - DNA, 25 bp, Homo sapien
agagactggccaccacaaggacatg

SEQ ID NO: 296736 - DNA, 25 bp, Homo sapien
acatgcaggagaactgtcgggacca

SEQ ID NO: 296737 - DNA, 25 bp, Homo sapien
tccttttgaaaaggccagtctcaaa

SEQ ID NO: 296738 - DNA, 25 bp, Homo sapien
agtctcaaaaagtagttaacacagc

SEQ ID NO: 296739 - DNA, 25 bp, Homo sapien
aacacagcaaataagtccgacttaa

SEQ ID NO: 296740 - DNA, 25 bp, Homo sapien
taagtccgacttaatgggctgcaat

SEQ ID NO: 296741 - DNA, 25 bp, Homo sapien
gtccgacttaatgggctgcaatttt

SEQ ID NO: 296742 - DNA, 25 bp, Homo sapien
atgggctgcaattttcatttgaaaa

SEQ ID NO: 296743 - DNA, 25 bp, Homo sapien
tcttaagttttcattgacagccttc

SEQ ID NO: 296744 - DNA, 25 bp, Homo sapien
agttttcattgacagccttctaaga

SEQ ID NO: 296745 - DNA, 25 bp, Homo sapien
cagccttctaagaactgccatctga

SEQ ID NO: 296746 - DNA, 25 bp, Homo sapien
gaagattcttcgttgtcaagccgcc

SEQ ID NO: 296747 - DNA, 25 bp, Homo sapien
ttgtcaagccgccaaagtggagagt

SEQ ID NO: 296748 - DNA, 25 bp, Homo sapien
ttaaaaatgcagttctgtcagcctg

SEQ ID NO: 296749 - DNA, 25 bp, Homo sapien
aaaatgcagttctgtcagcctggac

SEQ ID NO: 296750 - DNA, 25 bp, Homo sapien
aaatgcagttctgtcagcctggaca

SEQ ID NO: 296751 - DNA, 25 bp, Homo sapien
tgcagttctgtcagcctggacaaca

SEQ ID NO: 296752 - DNA, 25 bp, Homo sapien
tatggcgatgaagaatcaagagctc

SEQ ID NO: 296753 - DNA, 25 bp, Homo sapien
gaagaatcaagagctcaaacttaca

SEQ ID NO: 296754 - DNA, 25 bp, Homo sapien
aatcaagagctcaaacttacattac

SEQ ID NO: 296755 - DNA, 25 bp, Homo sapien
ttactgtattgaccaggaagtccta

SEQ ID NO: 296756 - DNA, 25 bp, Homo sapien
actgtattgaccaggaagtcctata

SEQ ID NO: 296757 - DNA, 25 bp, Homo sapien
gtattgaccaggaagtcctataaag

SEQ ID NO: 296758 - DNA, 25 bp, Homo sapien
ccaggaagtcctataaagaattata

SEQ ID NO: 296759 - DNA, 25 bp, Homo sapien
gaattgtaccaagcagtgtttccca

SEQ ID NO: 296760 - DNA, 25 bp, Homo sapien
ctctccgggcactgtgcgggagcca

SEQ ID NO: 296761 - DNA, 25 bp, Homo sapien
aagaatggttggttatgcctcgcgt

SEQ ID NO: 296762 - DNA, 25 bp, Homo sapien
ttggttatgcctcgcgtgagtgaca

SEQ ID NO: 296763 - DNA, 25 bp, Homo sapien
atgcctcgcgtgagtgacagagcca

SEQ ID NO: 296764 - DNA, 25 bp, Homo sapien
gtgacagagccagggttttgtcttc

SEQ ID NO: 296765 - DNA, 25 bp, Homo sapien
gagccagggttttgtcttctatctt

SEQ ID NO: 296766 - DNA, 25 bp, Homo sapien
ggttttgtcttctatcttcagggca

SEQ ID NO: 296767 - DNA, 25 bp, Homo sapien
gtcttctatcttcagggcagggtac

SEQ ID NO: 296768 - DNA, 25 bp, Homo sapien
tatcttcagggcagggtacagctgg

SEQ ID NO: 296769 - DNA, 25 bp, Homo sapien
cagggtacagctgggtattggaatt

SEQ ID NO: 296770 - DNA, 25 bp, Homo sapien
acgctttcttgcctccgtgtgtaag

SEQ ID NO: 296771 - DNA, 25 bp, Homo sapien
gtgtgtaagctccttgtacaaccca

SEQ ID NO: 296772 - DNA, 25 bp, Homo sapien
gtacaacccagacccatcttgtatt

SEQ ID NO: 296773 - DNA, 25 bp, Homo sapien
ttttgtggcccagaaaactgaacga

SEQ ID NO: 296774 - DNA, 25 bp, Homo sapien
gaacgattattttgttcctccgtag

SEQ ID NO: 296775 - DNA, 25 bp, Homo sapien
gttcctccgtagtccaaagggcaga

SEQ ID NO: 296776 - DNA, 25 bp, Homo sapien
gctgtaatacagtctgtgggctcct

SEQ ID NO: 296777 - DNA, 25 bp, Homo sapien
gtgggctccttaccctgcagaggct

SEQ ID NO: 296778 - DNA, 25 bp, Homo sapien
aggctgtttcagctcacacagagtc

SEQ ID NO: 296779 - DNA, 25 bp, Homo sapien
acggctcccagttgacagtcagtgg

SEQ ID NO: 296780 - DNA, 25 bp, Homo sapien
agtcagtggaatgctcgtctcctta

SEQ ID NO: 296781 - DNA, 25 bp, Homo sapien
gacagtgacacagtaattaacattt

SEQ ID NO: 296782 - DNA, 25 bp, Homo sapien
taacatttatgaagccaggtttttt

SEQ ID NO: 296783 - DNA, 25 bp, Homo sapien
gccaggttttttggcaagcctgtta

SEQ ID NO: 296784 - DNA, 25 bp, Homo sapien
caagcctgttatatatgttatctta

SEQ ID NO: 296785 - DNA, 25 bp, Homo sapien
atgttatcttattaggtcatcataa

SEQ ID NO: 296786 - DNA, 25 bp, Homo sapien
ggtcatcataataaatcacaagtag

SEQ ID NO: 296787 - DNA, 25 bp, Homo sapien
aagtagatacgattacctgttttgc

SEQ ID NO: 296788 - DNA, 25 bp, Homo sapien
ggagaacatttctgggatctagatt

SEQ ID NO: 296789 - DNA, 25 bp, Homo sapien
gggatctagatttcagtactgttac

SEQ ID NO: 296790 - DNA, 25 bp, Homo sapien
tacagtaatggttgatgacagattc

SEQ ID NO: 296791 - DNA, 25 bp, Homo sapien
gatgacagattccaaattatagata

SEQ ID NO: 296792 - DNA, 25 bp, Homo sapien
actcttgataatttgaatagggcca

SEQ ID NO: 296793 - DNA, 25 bp, Homo sapien
agttggtgacctaaaggcttgttag

SEQ ID NO: 296794 - DNA, 25 bp, Homo sapien
ggcttgttagtgatgtggagttcct

SEQ ID NO: 296795 - DNA, 25 bp, Homo sapien
tgtggagttcctacatgcagtgagt

SEQ ID NO: 296796 - DNA, 25 bp, Homo sapien
tttcatgttaattctgacagttcac

SEQ ID NO: 296797 - DNA, 25 bp, Homo sapien
acagttcaccaaatagctagtcatg

SEQ ID NO: 296798 - DNA, 25 bp, Homo sapien
gctagtcatggagaatgcaggcagt

SEQ ID NO: 296799 - DNA, 25 bp, Homo sapien
cagttaacttaatatccctccagga

SEQ ID NO: 296800 - DNA, 25 bp, Homo sapien
atatccctccaggaatggttcctac

SEQ ID NO: 296801 - DNA, 25 bp, Homo sapien
ggttcctacgttgtgtattatttgg

SEQ ID NO: 296802 - DNA, 25 bp, Homo sapien
gtttcttttacttacctgcttgaat

SEQ ID NO: 296803 - DNA, 25 bp, Homo sapien
tgctacaaacaagagctatttcttt

SEQ ID NO: 296804 - DNA, 25 bp, Homo sapien
ggagcatcagtgtacctgagtcact

SEQ ID NO: 296805 - DNA, 25 bp, Homo sapien
tgtacctgagtcactttgtctgcat

SEQ ID NO: 296806 - DNA, 25 bp, Homo sapien
agtcactttgtctgcatctcttcat

SEQ ID NO: 296807 - DNA, 25 bp, Homo sapien
atctcttcatcccacaaaacacgag

SEQ ID NO: 296808 - DNA, 25 bp, Homo sapien
aaacacgaggctgggtctcattcag

SEQ ID NO: 296809 - DNA, 25 bp, Homo sapien
tgggtctcattcagcggcctctcac

SEQ ID NO: 296810 - DNA, 25 bp, Homo sapien
tctcaccaaccttcaagatccagaa

SEQ ID NO: 296811 - DNA, 25 bp, Homo sapien
aaaacaggaacgttcagctctgccc

SEQ ID NO: 296812 - DNA, 25 bp, Homo sapien
agctctgccctgtgtcgtatctaat

SEQ ID NO: 296813 - DNA, 25 bp, Homo sapien
gtgtcgtatctaatcacatacatta

SEQ ID NO: 296814 - DNA, 25 bp, Homo sapien
gtaaagttagtaccgtttgctgaat

SEQ ID NO: 296815 - DNA, 25 bp, Homo sapien
accgtttgctgaattagggtagcca

SEQ ID NO: 296816 - DNA, 25 bp, Homo sapien
agcagaagcaggtttgtgagagaaa

SEQ ID NO: 296817 - DNA, 25 bp, Homo sapien
aaagagaaggtagggctgcattatt

SEQ ID NO: 296818 - DNA, 25 bp, Homo sapien
ctgcattattgccaagtagatatca

SEQ ID NO: 296819 - DNA, 25 bp, Homo sapien
caaagtggaggtgtccagttttaca

SEQ ID NO: 296820 - DNA, 25 bp, Homo sapien
tacaaaaacgtcctttgtagcttag

SEQ ID NO: 296821 - DNA, 25 bp, Homo sapien
agatcagggctgcagacgttaagat

SEQ ID NO: 296822 - DNA, 25 bp, Homo sapien
ggctgcagacgttaagatggttatc

SEQ ID NO: 296823 - DNA, 25 bp, Homo sapien
gccaggtagattcctgggtttctct

SEQ ID NO: 296824 - DNA, 25 bp, Homo sapien
gggtttctcttgaacaattaggcag

SEQ ID NO: 296825 - DNA, 25 bp, Homo sapien
atgggaaccagtcaataatgggtca

SEQ ID NO: 296826 - DNA, 25 bp, Homo sapien
gtcaataatgggtcaggcacctcag

SEQ ID NO: 296827 - DNA, 25 bp, Homo sapien
gggtcaggcacctcagaagatctgt

SEQ ID NO: 296828 - DNA, 25 bp, Homo sapien
gatctgttttggaaacttgacgccc

SEQ ID NO: 296829 - DNA, 25 bp, Homo sapien
tttggaaacttgacgcccttcagac

SEQ ID NO: 296830 - DNA, 25 bp, Homo sapien
ttcagaccttcattcgggacctgca

SEQ ID NO: 296831 - DNA, 25 bp, Homo sapien
gggacctgcactggcctgaagaaga

SEQ ID NO: 296832 - DNA, 25 bp, Homo sapien
aaagcacctggaacaacggctgaag

SEQ ID NO: 296833 - DNA, 25 bp, Homo sapien
acggctgaagttgatggcaagtgac

SEQ ID NO: 296834 - DNA, 25 bp, Homo sapien
aagtgacatgatcgaatcttgtgtc

SEQ ID NO: 296835 - DNA, 25 bp, Homo sapien
tcgaatcttgtgtcaaaagaaccag

SEQ ID NO: 296836 - DNA, 25 bp, Homo sapien
ggacacatctttcctagtcagttgc

SEQ ID NO: 296837 - DNA, 25 bp, Homo sapien
agttgcgctcgttcctatggcaaaa

SEQ ID NO: 296838 - DNA, 25 bp, Homo sapien
agagaacttcagcttcggttttcca

SEQ ID NO: 296839 - DNA, 25 bp, Homo sapien
gggcagccgcacactttcggagtgc

SEQ ID NO: 296840 - DNA, 25 bp, Homo sapien
ttaagtgacttcctgcaaacgctac

SEQ ID NO: 296841 - DNA, 25 bp, Homo sapien
gcaaccagccttccaatcaaaagta

SEQ ID NO: 296842 - DNA, 25 bp, Homo sapien
atgtcactggcattggctcggccaa

SEQ ID NO: 296843 - DNA, 25 bp, Homo sapien
aatcacaagggcgttccgaaagcaa

SEQ ID NO: 296844 - DNA, 25 bp, Homo sapien
gaaagcaagcgctcgacacttgtaa

SEQ ID NO: 296845 - DNA, 25 bp, Homo sapien
ctggctcacgttccagcttgcggag

SEQ ID NO: 296846 - DNA, 25 bp, Homo sapien
gcttgcggagctttgggacacatct

SEQ ID NO: 296847 - DNA, 25 bp, Homo sapien
aaagctctacactggcaagccaaac

SEQ ID NO: 296848 - DNA, 25 bp, Homo sapien
ttgtgaatggcctccaagctcggac

SEQ ID NO: 296849 - DNA, 25 bp, Homo sapien
aagctcggacctttgggatctggac

SEQ ID NO: 296850 - DNA, 25 bp, Homo sapien
tctggacgctgctctcatcagtgat

SEQ ID NO: 296851 - DNA, 25 bp, Homo sapien
tgcctctgtgccattgacattcaca

SEQ ID NO: 296852 - DNA, 25 bp, Homo sapien
tgacattcacaacaagacgctctat

SEQ ID NO: 296853 - DNA, 25 bp, Homo sapien
tctatcacatcacactctggacctt

SEQ ID NO: 296854 - DNA, 25 bp, Homo sapien
tttgtctatggaactgcagctccca

SEQ ID NO: 296855 - DNA, 25 bp, Homo sapien
tggcacccctgatggtggcaagttt

SEQ ID NO: 296856 - DNA, 25 bp, Homo sapien
catcctgggtatgctggtcgggctc

SEQ ID NO: 296857 - DNA, 25 bp, Homo sapien
gtcgggctccggtatctagaagtag

SEQ ID NO: 296858 - DNA, 25 bp, Homo sapien
aatacggttaaatcattgggaggct

SEQ ID NO: 296859 - DNA, 25 bp, Homo sapien
atcattgggaggcttaattgtttta

SEQ ID NO: 296860 - DNA, 25 bp, Homo sapien
taaagactttacttgcaagactgaa

SEQ ID NO: 296861 - DNA, 25 bp, Homo sapien
aatgggctccattttagaaaattct

SEQ ID NO: 296862 - DNA, 25 bp, Homo sapien
gattcacttgaatcaatttttgcta

SEQ ID NO: 296863 - DNA, 25 bp, Homo sapien
gaaacgggttcaaataagtcaaatg

SEQ ID NO: 296864 - DNA, 25 bp, Homo sapien
caaacgtggtgctttctgtggagac

SEQ ID NO: 296865 - DNA, 25 bp, Homo sapien
gctttctgtggagacagtggctctg

SEQ ID NO: 296866 - DNA, 25 bp, Homo sapien
agtggctctgacacaccactttatg

SEQ ID NO: 296867 - DNA, 25 bp, Homo sapien
ctgacacaccactttatgctagaaa

SEQ ID NO: 296868 - DNA, 25 bp, Homo sapien
tttatgctagaaaggcgcaagggcc

SEQ ID NO: 296869 - DNA, 25 bp, Homo sapien
agcctgtgatacacccttagagtca

SEQ ID NO: 296870 - DNA, 25 bp, Homo sapien
tgaagctcacttctgcaggacccac

SEQ ID NO: 296871 - DNA, 25 bp, Homo sapien
atatcaaattcagtgggccatgagt

SEQ ID NO: 296872 - DNA, 25 bp, Homo sapien
gccatgagtcttgcccaaaagtata

SEQ ID NO: 296873 - DNA, 25 bp, Homo sapien
tggactatttgggtctattttcaaa

SEQ ID NO: 296874 - DNA, 25 bp, Homo sapien
ctttttcttctctaaactatctcaa

SEQ ID NO: 296875 - DNA, 25 bp, Homo sapien
tctgcaggacccaccatgacaaagt

SEQ ID NO: 296876 - DNA, 25 bp, Homo sapien
atctcaattccacatttcactttgc

SEQ ID NO: 296877 - DNA, 25 bp, Homo sapien
actttgcaggtgtagacatgacttt

SEQ ID NO: 296878 - DNA, 25 bp, Homo sapien
tgggcggttaaccagtgaaccaatt

SEQ ID NO: 296879 - DNA, 25 bp, Homo sapien
aattgagtggctctgggctcctata

SEQ ID NO: 296880 - DNA, 25 bp, Homo sapien
atgtacacaattactgtaaggctaa

SEQ ID NO: 296881 - DNA, 25 bp, Homo sapien
tgtaaggctaattcacgtgccatac

SEQ ID NO: 296882 - DNA, 25 bp, Homo sapien
ccacctgaaagcctgagttatcttg

SEQ ID NO: 296883 - DNA, 25 bp, Homo sapien
gagttatcttgctataagcttttca

SEQ ID NO: 296884 - DNA, 25 bp, Homo sapien
aagcttttcatggagcacttccttt

SEQ ID NO: 296885 - DNA, 25 bp, Homo sapien
atggagcacttcctttccagaaact

SEQ ID NO: 296886 - DNA, 25 bp, Homo sapien
atttagagaatgtcctggcgtcggt

SEQ ID NO: 296887 - DNA, 25 bp, Homo sapien
aatgtcctggcgtcggtttttagca

SEQ ID NO: 296888 - DNA, 25 bp, Homo sapien
cgtcggtttttagcatatgtggtat

SEQ ID NO: 296889 - DNA, 25 bp, Homo sapien
gcatttctgggtttcttgtgtggat

SEQ ID NO: 296890 - DNA, 25 bp, Homo sapien
tctgggtttcttgtgtggattttaa

SEQ ID NO: 296891 - DNA, 25 bp, Homo sapien
gccagtcagggctgttttcaggtgt

SEQ ID NO: 296892 - DNA, 25 bp, Homo sapien
gtgtatgtgaattcatcccagcagt

SEQ ID NO: 296893 - DNA, 25 bp, Homo sapien
tgctgccttttcctagggaactgaa

SEQ ID NO: 296894 - DNA, 25 bp, Homo sapien
aatcacagacgcgatgtggcactga

SEQ ID NO: 296895 - DNA, 25 bp, Homo sapien
gtggcactgattattgttcctcaaa

SEQ ID NO: 296896 - DNA, 25 bp, Homo sapien
ggatgcatttacctggccttaagat

SEQ ID NO: 296897 - DNA, 25 bp, Homo sapien
aatgcgtgtctgaagatagcctctt

SEQ ID NO: 296898 - DNA, 25 bp, Homo sapien
atagcctcttacagattcctcacgg

SEQ ID NO: 296899 - DNA, 25 bp, Homo sapien
atttacctggccttaagatgctcct

SEQ ID NO: 296900 - DNA, 25 bp, Homo sapien
agatgctcctgctgcaatgggaagt

SEQ ID NO: 296901 - DNA, 25 bp, Homo sapien
cctcctgtgcaatactttcttgtca

SEQ ID NO: 296902 - DNA, 25 bp, Homo sapien
gatgcttcagcaaaagtcattctct

SEQ ID NO: 296903 - DNA, 25 bp, Homo sapien
cagcaaaagtcattctctctttaac

SEQ ID NO: 296904 - DNA, 25 bp, Homo sapien
aaactcctcttcacgattgatagca

SEQ ID NO: 296905 - DNA, 25 bp, Homo sapien
aaatcagaaacgttagggcaccagt

SEQ ID NO: 296906 - DNA, 25 bp, Homo sapien
aacgttagggcaccagtgagttgaa

SEQ ID NO: 296907 - DNA, 25 bp, Homo sapien
aataatattatcctatccatccata

SEQ ID NO: 296908 - DNA, 25 bp, Homo sapien
atcctatccatccatatctattgaa

SEQ ID NO: 296909 - DNA, 25 bp, Homo sapien
atctattgaaattgtacaggtccat

SEQ ID NO: 296910 - DNA, 25 bp, Homo sapien
gtacaggtccataatttcattttaa

SEQ ID NO: 296911 - DNA, 25 bp, Homo sapien
agataatacccatttgttctatcac

SEQ ID NO: 296912 - DNA, 25 bp, Homo sapien
cctctccctatcattaactatcaaa

SEQ ID NO: 296913 - DNA, 25 bp, Homo sapien
aggaccagagtccatgccaagacca

SEQ ID NO: 296914 - DNA, 25 bp, Homo sapien
gctgttcagctttgctagaacctcc

SEQ ID NO: 296915 - DNA, 25 bp, Homo sapien
aagaccacccttcagcttccaaggc

SEQ ID NO: 296916 - DNA, 25 bp, Homo sapien
agtcaccacggcctcagacagggct

SEQ ID NO: 296917 - DNA, 25 bp, Homo sapien
acggcctcagacagggcttgtgctc

SEQ ID NO: 296918 - DNA, 25 bp, Homo sapien
cagacagggcttgtgctcagctgac

SEQ ID NO: 296919 - DNA, 25 bp, Homo sapien
agctttgctagaacctcccagatga

SEQ ID NO: 296920 - DNA, 25 bp, Homo sapien
tgtgctcagctgacacctgtgacac

SEQ ID NO: 296921 - DNA, 25 bp, Homo sapien
agctgacacctgtgacacagctctt

SEQ ID NO: 296922 - DNA, 25 bp, Homo sapien
ttgctagaacctcccagatgacccg

SEQ ID NO: 296923 - DNA, 25 bp, Homo sapien
gagcctgcaccccaaggaccagagt

SEQ ID NO: 296924 - DNA, 25 bp, Homo sapien
aaaattgtttggttgccatccagag

SEQ ID NO: 296925 - DNA, 25 bp, Homo sapien
ttgtttggttgccatccagagggct

SEQ ID NO: 296926 - DNA, 25 bp, Homo sapien
catccagagggctcttttatgaaga

SEQ ID NO: 296927 - DNA, 25 bp, Homo sapien
tcttaggacctttttggtgaatttg

SEQ ID NO: 296928 - DNA, 25 bp, Homo sapien
gttttataaaggcatacctctgtta

SEQ ID NO: 296929 - DNA, 25 bp, Homo sapien
gcatacctctgttaagaaggctggt

SEQ ID NO: 296930 - DNA, 25 bp, Homo sapien
ctctgttaagaaggctggttttatg

SEQ ID NO: 296931 - DNA, 25 bp, Homo sapien
tactttgatcaccaccctagctgtt

SEQ ID NO: 296932 - DNA, 25 bp, Homo sapien
tgatcaccaccctagctgttccttt

SEQ ID NO: 296933 - DNA, 25 bp, Homo sapien
aatatattattttggtgggcttgat

SEQ ID NO: 296934 - DNA, 25 bp, Homo sapien
gtgggcttgattttatagtttctct

SEQ ID NO: 296935 - DNA, 25 bp, Homo sapien
tatgacttacgaaatatgttgtgac

SEQ ID NO: 296936 - DNA, 25 bp, Homo sapien
gacttacgaaatatgttgtgacaat

SEQ ID NO: 296937 - DNA, 25 bp, Homo sapien
gcatttttatattacttgcatattc

SEQ ID NO: 296938 - DNA, 25 bp, Homo sapien
tattacttgcatattctcacattga

SEQ ID NO: 296939 - DNA, 25 bp, Homo sapien
acttgcatattctcacattgatttg

SEQ ID NO: 296940 - DNA, 25 bp, Homo sapien
cacaagtatttgacagtatggtaga

SEQ ID NO: 296941 - DNA, 25 bp, Homo sapien
attctgaattgtgttaggttgaaaa

SEQ ID NO: 296942 - DNA, 25 bp, Homo sapien
gaaaaagatgattgtggtgactatt

SEQ ID NO: 296943 - DNA, 25 bp, Homo sapien
ggtgactattatttcttgtccacta

SEQ ID NO: 296944 - DNA, 25 bp, Homo sapien
actattatttcttgtccactatttg

SEQ ID NO: 296945 - DNA, 25 bp, Homo sapien
attatttcttgtccactatttgttt

SEQ ID NO: 296946 - DNA, 25 bp, Homo sapien
cagtcactttaattatgcaacgttt

SEQ ID NO: 296947 - DNA, 25 bp, Homo sapien
aattatgcaacgttttgttatgaaa

SEQ ID NO: 296948 - DNA, 25 bp, Homo sapien
tgttatgaaacacagttttcttttt

SEQ ID NO: 296949 - DNA, 25 bp, Homo sapien
tttatgaaatagtgcagccctttgg

SEQ ID NO: 296950 - DNA, 25 bp, Homo sapien
gaaaaattttacatggcacaccatt

SEQ ID NO: 296951 - DNA, 25 bp, Homo sapien
atggcacaccattgatctgcatgat

SEQ ID NO: 296952 - DNA, 25 bp, Homo sapien
ttgatctgcatgatgatagaaggat

SEQ ID NO: 296953 - DNA, 25 bp, Homo sapien
gtatcttaattatctggtagcagaa

SEQ ID NO: 296954 - DNA, 25 bp, Homo sapien
ggtagcagaaatatgagtctcctag

SEQ ID NO: 296955 - DNA, 25 bp, Homo sapien
agaaatatgagtctcctagtctcaa

SEQ ID NO: 296956 - DNA, 25 bp, Homo sapien
tttgtcattgttacagtcactttaa

SEQ ID NO: 296957 - DNA, 25 bp, Homo sapien
gaacagtcctcggtgaatctgagag

SEQ ID NO: 296958 - DNA, 25 bp, Homo sapien
gaagcaccagctgtactactagaag

SEQ ID NO: 296959 - DNA, 25 bp, Homo sapien
gagcttttggtggtagatcccctgg

SEQ ID NO: 296960 - DNA, 25 bp, Homo sapien
gtggtagatcccctggtgtctccaa

SEQ ID NO: 296961 - DNA, 25 bp, Homo sapien
ggtgtctccaacctgactaggtgga

SEQ ID NO: 296962 - DNA, 25 bp, Homo sapien
acctgactaggtggacagagctcaa

SEQ ID NO: 296963 - DNA, 25 bp, Homo sapien
tgataggacatctggcttgccacaa

SEQ ID NO: 296964 - DNA, 25 bp, Homo sapien
gattacaaacaactatggccggaac

SEQ ID NO: 296965 - DNA, 25 bp, Homo sapien
tgccacaaaggtctgttcgaccaga

SEQ ID NO: 296966 - DNA, 25 bp, Homo sapien
gagttccctaccctaagagaatgtt

SEQ ID NO: 296967 - DNA, 25 bp, Homo sapien
gaatgttaccacctgaacagtcctc

SEQ ID NO: 296968 - DNA, 25 bp, Homo sapien
tcctgatcatttgtttgtcagcttc

SEQ ID NO: 296969 - DNA, 25 bp, Homo sapien
gtcagcttcactaattaagcagtgt

SEQ ID NO: 296970 - DNA, 25 bp, Homo sapien
ggaaattcatccacctcatttcttc

SEQ ID NO: 296971 - DNA, 25 bp, Homo sapien
aaaatccatcactcctcggctgcgg

SEQ ID NO: 296972 - DNA, 25 bp, Homo sapien
tcggctgcgggctgcgtaaaattta

SEQ ID NO: 296973 - DNA, 25 bp, Homo sapien
aattatgttgtcaggtctctttgta

SEQ ID NO: 296974 - DNA, 25 bp, Homo sapien
gtccttaaaggccactgtgcttgct

SEQ ID NO: 296975 - DNA, 25 bp, Homo sapien
actgtgcttgctgggttgtaatgca

SEQ ID NO: 296976 - DNA, 25 bp, Homo sapien
agggcattcctgttgttagtttaat

SEQ ID NO: 296977 - DNA, 25 bp, Homo sapien
tactggttagttatttaggttctca

SEQ ID NO: 296978 - DNA, 25 bp, Homo sapien
ggttctcaaatgtttgcctcatttt

SEQ ID NO: 296979 - DNA, 25 bp, Homo sapien
acaataccagtatttgatccagttt

SEQ ID NO: 296980 - DNA, 25 bp, Homo sapien
cagtatttgatccagtttcatctca

SEQ ID NO: 296981 - DNA, 25 bp, Homo sapien
atctcaactatgttatacctggaca

SEQ ID NO: 296982 - DNA, 25 bp, Homo sapien
tacctggacattttagatgtttatc

SEQ ID NO: 296983 - DNA, 25 bp, Homo sapien
gatgtttatcaaaggtcttttatgg

SEQ ID NO: 296984 - DNA, 25 bp, Homo sapien
gacatttatagggaatgttggctct

SEQ ID NO: 296985 - DNA, 25 bp, Homo sapien
ggctctgaacaaacttttgaaaact

SEQ ID NO: 296986 - DNA, 25 bp, Homo sapien
gacaaaattttggatcaactgaaaa

SEQ ID NO: 296987 - DNA, 25 bp, Homo sapien
aaaagcatgacttttgaaatctctg

SEQ ID NO: 296988 - DNA, 25 bp, Homo sapien
ctctgaatgccttggttctcagtat

SEQ ID NO: 296989 - DNA, 25 bp, Homo sapien
tgccttggttctcagtattatcatt

SEQ ID NO: 296990 - DNA, 25 bp, Homo sapien
ggtgcaagacagagcaagctggaca

SEQ ID NO: 296991 - DNA, 25 bp, Homo sapien
aagacagagcaagctggacagatgg

SEQ ID NO: 296992 - DNA, 25 bp, Homo sapien
acagatggaggaagccaggctgcca

SEQ ID NO: 296993 - DNA, 25 bp, Homo sapien
tggaggaagccaggctgccagacaa

SEQ ID NO: 296994 - DNA, 25 bp, Homo sapien
tcatcccatgcctggcagtgtcatg

SEQ ID NO: 296995 - DNA, 25 bp, Homo sapien
accccacctggcacagaacaaggcg

SEQ ID NO: 296996 - DNA, 25 bp, Homo sapien
catgcctggcagtgtcatggtagga

SEQ ID NO: 296997 - DNA, 25 bp, Homo sapien
tgaccaggagcccagaggctcagaa

SEQ ID NO: 296998 - DNA, 25 bp, Homo sapien
ctggcagtgtcatggtaggagccta

SEQ ID NO: 296999 - DNA, 25 bp, Homo sapien
agcctagggcgatagggccctgtcc

SEQ ID NO: 297000 - DNA, 25 bp, Homo sapien
ggtggcccacagtccagagcctgcc

SEQ ID NO: 297001 - DNA, 25 bp, Homo sapien
gtttgcctgcaatggtactgtaatt

SEQ ID NO: 297002 - DNA, 25 bp, Homo sapien
ggtactgtaattgagcatccggaat

SEQ ID NO: 297003 - DNA, 25 bp, Homo sapien
aagtaattcagctacagggtgacca

SEQ ID NO: 297004 - DNA, 25 bp, Homo sapien
cagggtgaccaacgcaagaacatat

SEQ ID NO: 297005 - DNA, 25 bp, Homo sapien
acatatgccagttcctcgtagagat

SEQ ID NO: 297006 - DNA, 25 bp, Homo sapien
tcctcgtagagattggactggctaa

SEQ ID NO: 297007 - DNA, 25 bp, Homo sapien
gactggctaaggacgatcagctgaa

SEQ ID NO: 297008 - DNA, 25 bp, Homo sapien
aggttcatgggttttaagtgcttgt

SEQ ID NO: 297009 - DNA, 25 bp, Homo sapien
agtgcttgtggctcactgaagctta

SEQ ID NO: 297010 - DNA, 25 bp, Homo sapien
gtgaggatttccttgcaatgagtag

SEQ ID NO: 297011 - DNA, 25 bp, Homo sapien
caatgagtagaatttcccttctctc

SEQ ID NO: 297012 - DNA, 25 bp, Homo sapien
aatgtatttttctatcttgttttat

SEQ ID NO: 297013 - DNA, 25 bp, Homo sapien
aaaattgccaattgttttgcagtac

SEQ ID NO: 297014 - DNA, 25 bp, Homo sapien
gccaattgttttgcagtactttatt

SEQ ID NO: 297015 - DNA, 25 bp, Homo sapien
attatattgggtgtcttgtcttttt

SEQ ID NO: 297016 - DNA, 25 bp, Homo sapien
tttgggcttttagttagctaatgaa

SEQ ID NO: 297017 - DNA, 25 bp, Homo sapien
gaatacattagacacttttgggttt

SEQ ID NO: 297018 - DNA, 25 bp, Homo sapien
gttgggattttacatagcttgcatt

SEQ ID NO: 297019 - DNA, 25 bp, Homo sapien
gcttgcattttaattctttggttct

SEQ ID NO: 297020 - DNA, 25 bp, Homo sapien
tctttggttctttgctgtttctatt

SEQ ID NO: 297021 - DNA, 25 bp, Homo sapien
gttctttgctgtttctattaaccca

SEQ ID NO: 297022 - DNA, 25 bp, Homo sapien
tgtttctattaacccacagcattat

SEQ ID NO: 297023 - DNA, 25 bp, Homo sapien
ttcgcagccactccaggatggagga

SEQ ID NO: 297024 - DNA, 25 bp, Homo sapien
atgcactctgtaatgggctttgaga

SEQ ID NO: 297025 - DNA, 25 bp, Homo sapien
tctcctccgggctgtgggaaggact

SEQ ID NO: 297026 - DNA, 25 bp, Homo sapien
ggactcgacccagattcggtggtca

SEQ ID NO: 297027 - DNA, 25 bp, Homo sapien
ttcggtggtcacgtcgctgtcggat

SEQ ID NO: 297028 - DNA, 25 bp, Homo sapien
gatcccatatcctcatctggacttt

SEQ ID NO: 297029 - DNA, 25 bp, Homo sapien
tttccagactgtcgctgcacacgga

SEQ ID NO: 297030 - DNA, 25 bp, Homo sapien
atgggtcggtacttgttcaggtcca

SEQ ID NO: 297031 - DNA, 25 bp, Homo sapien
ggattttccatagactttcccacag

SEQ ID NO: 297032 - DNA, 25 bp, Homo sapien
agactttcccacagccactgtaggg

SEQ ID NO: 297033 - DNA, 25 bp, Homo sapien
ggcacttgtgcctcttttcggaggc

SEQ ID NO: 297034 - DNA, 25 bp, Homo sapien
gagagaggaaaagctagccccaaga

SEQ ID NO: 297035 - DNA, 25 bp, Homo sapien
ctagccccaagatcagagcctgagg

SEQ ID NO: 297036 - DNA, 25 bp, Homo sapien
tttaaccagcattcccttttgttca

SEQ ID NO: 297037 - DNA, 25 bp, Homo sapien
cattcccttttgttcacttctccaa

SEQ ID NO: 297038 - DNA, 25 bp, Homo sapien
cacttctccaaagtctcagaatggg

SEQ ID NO: 297039 - DNA, 25 bp, Homo sapien
gggcaaacttcacaacaaatgggca

SEQ ID NO: 297040 - DNA, 25 bp, Homo sapien
caaatgggcagcagtttttggatct

SEQ ID NO: 297041 - DNA, 25 bp, Homo sapien
gtttttggatctgctctccaaggca

SEQ ID NO: 297042 - DNA, 25 bp, Homo sapien
tggatctgctctccaaggcacaatt

SEQ ID NO: 297043 - DNA, 25 bp, Homo sapien
tatctaaactttaggtccctgcttt

SEQ ID NO: 297044 - DNA, 25 bp, Homo sapien
tttcctcaccaaccagagactttgg

SEQ ID NO: 297045 - DNA, 25 bp, Homo sapien
tcaggaccccatcacgagtgataag

SEQ ID NO: 297046 - DNA, 25 bp, Homo sapien
aagcacattagcagccttcatgtcc

SEQ ID NO: 297047 - DNA, 25 bp, Homo sapien
gtccctatgcaggatcttgtttctg

SEQ ID NO: 297048 - DNA, 25 bp, Homo sapien
tagaggccgttaagcagcatctgca

SEQ ID NO: 297049 - DNA, 25 bp, Homo sapien
atctcagacagcgtgaacttgacca

SEQ ID NO: 297050 - DNA, 25 bp, Homo sapien
accaaaacattgctcaacagcccag

SEQ ID NO: 297051 - DNA, 25 bp, Homo sapien
gcaaggtcatgctcgcagaagtcga

SEQ ID NO: 297052 - DNA, 25 bp, Homo sapien
gcagaagtcgaacaccaggtatata

SEQ ID NO: 297053 - DNA, 25 bp, Homo sapien
gtatatactacccttgcagcggtta

SEQ ID NO: 297054 - DNA, 25 bp, Homo sapien
ggaagctttggttcgacaaatctca

SEQ ID NO: 297055 - DNA, 25 bp, Homo sapien
agttgaccacattctcgtgttttag

SEQ ID NO: 297056 - DNA, 25 bp, Homo sapien
ttcttgaaaacatgaatcacactca

SEQ ID NO: 297057 - DNA, 25 bp, Homo sapien
gaatcacactcatgaattctaacta

SEQ ID NO: 297058 - DNA, 25 bp, Homo sapien
cacactcatgaattctaactacaat

SEQ ID NO: 297059 - DNA, 25 bp, Homo sapien
agcagacagccctacagatcgtaca

SEQ ID NO: 297060 - DNA, 25 bp, Homo sapien
agacagccctacagatcgtacacac

SEQ ID NO: 297061 - DNA, 25 bp, Homo sapien
agccctacagatcgtacacacgttt

SEQ ID NO: 297062 - DNA, 25 bp, Homo sapien
tacagatcgtacacacgttttccaa

SEQ ID NO: 297063 - DNA, 25 bp, Homo sapien
gatcgtacacacgttttccaaaact

SEQ ID NO: 297064 - DNA, 25 bp, Homo sapien
aaactaacaatggaacaggcggcaa

SEQ ID NO: 297065 - DNA, 25 bp, Homo sapien
ggaacaggcggcaaacctatgccaa

SEQ ID NO: 297066 - DNA, 25 bp, Homo sapien
ataagaggagttgttcatgaggaaa

SEQ ID NO: 297067 - DNA, 25 bp, Homo sapien
gcagaacttcttcagctaaggttaa

SEQ ID NO: 297068 - DNA, 25 bp, Homo sapien
gctaaggttaatttgacgctatgat

SEQ ID NO: 297069 - DNA, 25 bp, Homo sapien
gacgctatgataaaactgagagatg

SEQ ID NO: 297070 - DNA, 25 bp, Homo sapien
gagatgtcaaaaagcctcttagaaa

SEQ ID NO: 297071 - DNA, 25 bp, Homo sapien
aatcttgaaagacttttcagggtat

SEQ ID NO: 297072 - DNA, 25 bp, Homo sapien
ttcagggtatctcattttttaggtg

SEQ ID NO: 297073 - DNA, 25 bp, Homo sapien
atgaaaaaagtaggccttctgacat

SEQ ID NO: 297074 - DNA, 25 bp, Homo sapien
aggccttctgacattgtgtacttgg

SEQ ID NO: 297075 - DNA, 25 bp, Homo sapien
acattgtgtacttggtggttctgtc

SEQ ID NO: 297076 - DNA, 25 bp, Homo sapien
tccctctgcctgtaacaaatctcat

SEQ ID NO: 297077 - DNA, 25 bp, Homo sapien
agaagtaaatccaccccgattctgt

SEQ ID NO: 297078 - DNA, 25 bp, Homo sapien
tgaaacgccttttgcgtttcttgcc

SEQ ID NO: 297079 - DNA, 25 bp, Homo sapien
tttgcgtttcttgcctcggttggaa

SEQ ID NO: 297080 - DNA, 25 bp, Homo sapien
tcttgcctcggttggaagtcacaaa

SEQ ID NO: 297081 - DNA, 25 bp, Homo sapien
tcctgcttcggtgatggccgcaaaa

SEQ ID NO: 297082 - DNA, 25 bp, Homo sapien
tctttccccacgtatgttttagttg

SEQ ID NO: 297083 - DNA, 25 bp, Homo sapien
cccacgtatgttttagttgtctgaa

SEQ ID NO: 297084 - DNA, 25 bp, Homo sapien
tagttgtctgaaatccatctggctc

SEQ ID NO: 297085 - DNA, 25 bp, Homo sapien
tgtctgaaatccatctggctctgcc

SEQ ID NO: 297086 - DNA, 25 bp, Homo sapien
tttccatggaactaaacgtgacaag

SEQ ID NO: 297087 - DNA, 25 bp, Homo sapien
gacataatcttcctgctaatgttgg

SEQ ID NO: 297088 - DNA, 25 bp, Homo sapien
gttggatattgcattgaaacgcctt

SEQ ID NO: 297089 - DNA, 25 bp, Homo sapien
gtcctgttttactttggcccatctt

SEQ ID NO: 297090 - DNA, 25 bp, Homo sapien
caaccctgtgggaatagtcattcat

SEQ ID NO: 297091 - DNA, 25 bp, Homo sapien
gtcattcatatcctagctgcaagct

SEQ ID NO: 297092 - DNA, 25 bp, Homo sapien
gtggtttatcagagcccaacttcga

SEQ ID NO: 297093 - DNA, 25 bp, Homo sapien
aacttcgagggctctgggctttagc

SEQ ID NO: 297094 - DNA, 25 bp, Homo sapien
tgggctttagctactgtcaccccat

SEQ ID NO: 297095 - DNA, 25 bp, Homo sapien
tcaccccatcataactgagcttcat

SEQ ID NO: 297096 - DNA, 25 bp, Homo sapien
tttttgttctaccaggtgcctagga

SEQ ID NO: 297097 - DNA, 25 bp, Homo sapien
gaatgctaacagtctgggaccacat

SEQ ID NO: 297098 - DNA, 25 bp, Homo sapien
gggaccacatagaccaccaggtgat

SEQ ID NO: 297099 - DNA, 25 bp, Homo sapien
atgagacaatcctgggagtcctgtt

SEQ ID NO: 297100 - DNA, 25 bp, Homo sapien
gaagactatatttctcagctgcctt

SEQ ID NO: 297101 - DNA, 25 bp, Homo sapien
tatatttctcagctgcctttgcagg

SEQ ID NO: 297102 - DNA, 25 bp, Homo sapien
gtgggcagggtcatgtgactattat

SEQ ID NO: 297103 - DNA, 25 bp, Homo sapien
aagtgacgagtcacttgtgggctga

SEQ ID NO: 297104 - DNA, 25 bp, Homo sapien
gttgtttgtgattctcaaatctctc

SEQ ID NO: 297105 - DNA, 25 bp, Homo sapien
tgttctgccattgcaattgtggaag

SEQ ID NO: 297106 - DNA, 25 bp, Homo sapien
gaaggagctttatgttgaaacggaa

SEQ ID NO: 297107 - DNA, 25 bp, Homo sapien
gaagtagtctatgtctcagtcacca

SEQ ID NO: 297108 - DNA, 25 bp, Homo sapien
tagtctatgtctcagtcaccatatg

SEQ ID NO: 297109 - DNA, 25 bp, Homo sapien
agggcaaatgccctggagaaccacc

SEQ ID NO: 297110 - DNA, 25 bp, Homo sapien
cacccagacacacaacaagtttgta

SEQ ID NO: 297111 - DNA, 25 bp, Homo sapien
cgtcagcattttccaatttccaggt

SEQ ID NO: 297112 - DNA, 25 bp, Homo sapien
tttccaggttggatctagagctgct

SEQ ID NO: 297113 - DNA, 25 bp, Homo sapien
agagctgctgttgatcactcaggca

SEQ ID NO: 297114 - DNA, 25 bp, Homo sapien
gattcatttagatgggtccaagctg

SEQ ID NO: 297115 - DNA, 25 bp, Homo sapien
gtccaagctgcagtccatgagcaat

SEQ ID NO: 297116 - DNA, 25 bp, Homo sapien
tgagcaataacagactaccccagat

SEQ ID NO: 297117 - DNA, 25 bp, Homo sapien
actaccccagatactgcagtttacg

SEQ ID NO: 297118 - DNA, 25 bp, Homo sapien
aagttattagttacctgaggcttct

SEQ ID NO: 297119 - DNA, 25 bp, Homo sapien
gaaagtcttcttttttgaccagttg

SEQ ID NO: 297120 - DNA, 25 bp, Homo sapien
aaagagggagcatgtgacacagcca

SEQ ID NO: 297121 - DNA, 25 bp, Homo sapien
gacacagccagtatggtggagtgct

SEQ ID NO: 297122 - DNA, 25 bp, Homo sapien
acaaggtacatgcattatgtgtcac

SEQ ID NO: 297123 - DNA, 25 bp, Homo sapien
tatgtgtcacattactgggcaaact

SEQ ID NO: 297124 - DNA, 25 bp, Homo sapien
acattactgggcaaactgttcaagt

SEQ ID NO: 297125 - DNA, 25 bp, Homo sapien
agccatgcttgcctatttgctgtat

SEQ ID NO: 297126 - DNA, 25 bp, Homo sapien
catgcttgcctatttgctgtataca

SEQ ID NO: 297127 - DNA, 25 bp, Homo sapien
gcttgcctatttgctgtatacatgt

SEQ ID NO: 297128 - DNA, 25 bp, Homo sapien
gcctatttgctgtatacatgtaatg

SEQ ID NO: 297129 - DNA, 25 bp, Homo sapien
taaagtgtagtgcattgaaacaaat

SEQ ID NO: 297130 - DNA, 25 bp, Homo sapien
gatacttttactatacaagggtgct

SEQ ID NO: 297131 - DNA, 25 bp, Homo sapien
tatacaagggtgctggtgcagaaaa

SEQ ID NO: 297132 - DNA, 25 bp, Homo sapien
gaaatgtagcattttatactttcaa

SEQ ID NO: 297133 - DNA, 25 bp, Homo sapien
gcacttaccaaatgttagtctgttt

SEQ ID NO: 297134 - DNA, 25 bp, Homo sapien
cacattattcttcttggattaccag

SEQ ID NO: 297135 - DNA, 25 bp, Homo sapien
ttcttcttggattaccagaaattgg

SEQ ID NO: 297136 - DNA, 25 bp, Homo sapien
taccagaaattggtttgaccatgaa

SEQ ID NO: 297137 - DNA, 25 bp, Homo sapien
tttgaccatgaataaacaggagata

SEQ ID NO: 297138 - DNA, 25 bp, Homo sapien
acaggagataatttcttgggtaatc

SEQ ID NO: 297139 - DNA, 25 bp, Homo sapien
gtggaggtagggaaattcaaagcta

SEQ ID NO: 297140 - DNA, 25 bp, Homo sapien
agctgtgtgaccttgcctaaactac

SEQ ID NO: 297141 - DNA, 25 bp, Homo sapien
cctaaactacctccttggatttgca

SEQ ID NO: 297142 - DNA, 25 bp, Homo sapien
tacctccttggatttgcagtctgtt

SEQ ID NO: 297143 - DNA, 25 bp, Homo sapien
ctccttggatttgcagtctgtttat

SEQ ID NO: 297144 - DNA, 25 bp, Homo sapien
ttgtctatgcttaaggaaccacctc

SEQ ID NO: 297145 - DNA, 25 bp, Homo sapien
ggaaccacctctgcatgaaaaatgt

SEQ ID NO: 297146 - DNA, 25 bp, Homo sapien
gatgggaaaaccgagaccacttttg

SEQ ID NO: 297147 - DNA, 25 bp, Homo sapien
gaccacttttgaaatgtccatgcat

SEQ ID NO: 297148 - DNA, 25 bp, Homo sapien
tgaaatgtccatgcataacacaatg

SEQ ID NO: 297149 - DNA, 25 bp, Homo sapien
taactttacaacatttagtggcttt

SEQ ID NO: 297150 - DNA, 25 bp, Homo sapien
tttagtggctttttgggaagacatc

SEQ ID NO: 297151 - DNA, 25 bp, Homo sapien
aagacatctctttggctactatcaa

SEQ ID NO: 297152 - DNA, 25 bp, Homo sapien
ttggctactatcaaagctgcttccc

SEQ ID NO: 297153 - DNA, 25 bp, Homo sapien
atgatttttccaagtcctggttcct

SEQ ID NO: 297154 - DNA, 25 bp, Homo sapien
tttccaagtcctggttcctgtgcag

SEQ ID NO: 297155 - DNA, 25 bp, Homo sapien
ttgacatttagtggtttccaaaata

SEQ ID NO: 297156 - DNA, 25 bp, Homo sapien
gttgaacatacattatgccttagaa

SEQ ID NO: 297157 - DNA, 25 bp, Homo sapien
atgcacattctgtattttgtgggat

SEQ ID NO: 297158 - DNA, 25 bp, Homo sapien
ttgacagatctctattctataaatg

SEQ ID NO: 297159 - DNA, 25 bp, Homo sapien
gtgggatgataatctaattcagtat

SEQ ID NO: 297160 - DNA, 25 bp, Homo sapien
cagtatagaatatgctgtttggcaa

SEQ ID NO: 297161 - DNA, 25 bp, Homo sapien
ggcaatgagtttgtggccagatttc

SEQ ID NO: 297162 - DNA, 25 bp, Homo sapien
gtggccagatttcaaatagggagtt

SEQ ID NO: 297163 - DNA, 25 bp, Homo sapien
gagttaagtggtactttcacaatcc

SEQ ID NO: 297164 - DNA, 25 bp, Homo sapien
aacattaatgtgttaataccctgta

SEQ ID NO: 297165 - DNA, 25 bp, Homo sapien
ataccctgtatggataatgcttgac

SEQ ID NO: 297166 - DNA, 25 bp, Homo sapien
ggacatattagtccctctcagcccc

SEQ ID NO: 297167 - DNA, 25 bp, Homo sapien
gggacccaactatcgtcttcctctt

SEQ ID NO: 297168 - DNA, 25 bp, Homo sapien
tttcctctgctaagtctccatcggg

SEQ ID NO: 297169 - DNA, 25 bp, Homo sapien
tctgctaagtctccatcgggcatcg

SEQ ID NO: 297170 - DNA, 25 bp, Homo sapien
tgctaagtctccatcgggcatcgac

SEQ ID NO: 297171 - DNA, 25 bp, Homo sapien
gctaagtctccatcgggcatcgacc

SEQ ID NO: 297172 - DNA, 25 bp, Homo sapien
accggacaccgtagcagcagcccca

SEQ ID NO: 297173 - DNA, 25 bp, Homo sapien
caaaatgggagagtgaggctgtcct

SEQ ID NO: 297174 - DNA, 25 bp, Homo sapien
aggctgtcctgcgtggaccagctcg

SEQ ID NO: 297175 - DNA, 25 bp, Homo sapien
tgtcctgcgtggaccagctcgtggc

SEQ ID NO: 297176 - DNA, 25 bp, Homo sapien
ggaccagctcgtggccgagactgat

SEQ ID NO: 297177 - DNA, 25 bp, Homo sapien
ctgtttcacaccagtctagaccaaa

SEQ ID NO: 297178 - DNA, 25 bp, Homo sapien
gtttcacaccagtctagaccaaaaa

SEQ ID NO: 297179 - DNA, 25 bp, Homo sapien
gttcagagtcaaaaaggaacttctg

SEQ ID NO: 297180 - DNA, 25 bp, Homo sapien
gaagataaattaattcatccctaaa

SEQ ID NO: 297181 - DNA, 25 bp, Homo sapien
tattgtcaaaatcatttcatagttt

SEQ ID NO: 297182 - DNA, 25 bp, Homo sapien
ataagggtattagcagttttctaat

SEQ ID NO: 297183 - DNA, 25 bp, Homo sapien
gtcactaacagatggtgattcttct

SEQ ID NO: 297184 - DNA, 25 bp, Homo sapien
agcagttttctaattagtaacacaa

SEQ ID NO: 297185 - DNA, 25 bp, Homo sapien
gtaacacaaatctgtctaaacaaga

SEQ ID NO: 297186 - DNA, 25 bp, Homo sapien
aaacaagaggacatcctagtacaca

SEQ ID NO: 297187 - DNA, 25 bp, Homo sapien
gaggacatcctagtacacaaaataa

SEQ ID NO: 297188 - DNA, 25 bp, Homo sapien
ggacctttttatgacacataatcag

SEQ ID NO: 297189 - DNA, 25 bp, Homo sapien
agagaaatccccctggctttggttg

SEQ ID NO: 297190 - DNA, 25 bp, Homo sapien
tggttggtttcgtaaatttagctat

SEQ ID NO: 297191 - DNA, 25 bp, Homo sapien
gctatatgtagcttgcgtgctttct

SEQ ID NO: 297192 - DNA, 25 bp, Homo sapien
tatatgtagcttgcgtgctttctcc

SEQ ID NO: 297193 - DNA, 25 bp, Homo sapien
tgtagcttgcgtgctttctcctgtt

SEQ ID NO: 297194 - DNA, 25 bp, Homo sapien
gaaactgaagagttgcttttcttgt

SEQ ID NO: 297195 - DNA, 25 bp, Homo sapien
gtaatttgaccaagttataatgcat

SEQ ID NO: 297196 - DNA, 25 bp, Homo sapien
tcccctccttaaacggagctataag

SEQ ID NO: 297197 - DNA, 25 bp, Homo sapien
aacggagctataaggtggccaaatc

SEQ ID NO: 297198 - DNA, 25 bp, Homo sapien
taaggtggccaaatctgagaacaat

SEQ ID NO: 297199 - DNA, 25 bp, Homo sapien
ctccagaagacctaaggtacagtca

SEQ ID NO: 297200 - DNA, 25 bp, Homo sapien
gaagacctaaggtacagtcagagct

SEQ ID NO: 297201 - DNA, 25 bp, Homo sapien
gtacagtcagagctgagccacgcct

SEQ ID NO: 297202 - DNA, 25 bp, Homo sapien
acagtcagagctgagccacgccttt

SEQ ID NO: 297203 - DNA, 25 bp, Homo sapien
agtcagagctgagccacgcctttgt

SEQ ID NO: 297204 - DNA, 25 bp, Homo sapien
agagctgagccacgcctttgtccat

SEQ ID NO: 297205 - DNA, 25 bp, Homo sapien
gctgagccacgcctttgtccatgaa

SEQ ID NO: 297206 - DNA, 25 bp, Homo sapien
tgagccacgcctttgtccatgaaga

SEQ ID NO: 297207 - DNA, 25 bp, Homo sapien
gagccacgcctttgtccatgaagag

SEQ ID NO: 297208 - DNA, 25 bp, Homo sapien
agccacgcctttgtccatgaagaga

SEQ ID NO: 297209 - DNA, 25 bp, Homo sapien
gccacgcctttgtccatgaagagaa

SEQ ID NO: 297210 - DNA, 25 bp, Homo sapien
gaactgggattacaccccaagtttg

SEQ ID NO: 297211 - DNA, 25 bp, Homo sapien
attacaccccaagtttgatgccagg

SEQ ID NO: 297212 - DNA, 25 bp, Homo sapien
caagtttgatgccaggactatagcc

SEQ ID NO: 297213 - DNA, 25 bp, Homo sapien
cagagggcaaggagcaccaggccct

SEQ ID NO: 297214 - DNA, 25 bp, Homo sapien
aattcaaagggctcccggtccatgt

SEQ ID NO: 297215 - DNA, 25 bp, Homo sapien
tcccggtccatgtgggacccatgga

SEQ ID NO: 297216 - DNA, 25 bp, Homo sapien
gtgggacccatggaagaagcatata

SEQ ID NO: 297217 - DNA, 25 bp, Homo sapien
gaagaagcatatagtgctttgcgct

SEQ ID NO: 297218 - DNA, 25 bp, Homo sapien
ccctacaccacatactcttaatggt

SEQ ID NO: 297219 - DNA, 25 bp, Homo sapien
acatactcttaatggtgaaaaccac

SEQ ID NO: 297220 - DNA, 25 bp, Homo sapien
ttgcaccaacctgatattatgagga

SEQ ID NO: 297221 - DNA, 25 bp, Homo sapien
taaactgttctaagaagcaggcagt

SEQ ID NO: 297222 - DNA, 25 bp, Homo sapien
tatattttaagtcagctgtcaaggg

SEQ ID NO: 297223 - DNA, 25 bp, Homo sapien
gaccacagccttagtatgacatcct

SEQ ID NO: 297224 - DNA, 25 bp, Homo sapien
gtatgacatcctgcacaatttgtga

SEQ ID NO: 297225 - DNA, 25 bp, Homo sapien
agcatttattctactgaaggcacag

SEQ ID NO: 297226 - DNA, 25 bp, Homo sapien
gaaggcacagtcttgtttatacttt

SEQ ID NO: 297227 - DNA, 25 bp, Homo sapien
gtttatactttctgcacattcagtg

SEQ ID NO: 297228 - DNA, 25 bp, Homo sapien
gcacattcagtgtattggtaattta

SEQ ID NO: 297229 - DNA, 25 bp, Homo sapien
agagtctgtgagtctcattctttaa

SEQ ID NO: 297230 - DNA, 25 bp, Homo sapien
gtgagtctcattctttaagatacag

SEQ ID NO: 297231 - DNA, 25 bp, Homo sapien
gatacagatgtgtgaacttcaatat

SEQ ID NO: 297232 - DNA, 25 bp, Homo sapien
acccaaattggcgtttgtcatcaga

SEQ ID NO: 297233 - DNA, 25 bp, Homo sapien
cccaaattggcgtttgtcatcagaa

SEQ ID NO: 297234 - DNA, 25 bp, Homo sapien
aaattggcgtttgtcatcagaatca

SEQ ID NO: 297235 - DNA, 25 bp, Homo sapien
aattggcgtttgtcatcagaatcag

SEQ ID NO: 297236 - DNA, 25 bp, Homo sapien
ttggcgtttgtcatcagaatcagag

SEQ ID NO: 297237 - DNA, 25 bp, Homo sapien
ggcgtttgtcatcagaatcagaggt

SEQ ID NO: 297238 - DNA, 25 bp, Homo sapien
gtttgtcatcagaatcagaggtatc

SEQ ID NO: 297239 - DNA, 25 bp, Homo sapien
agtgagcccaaaggttcgaaaggtg

SEQ ID NO: 297240 - DNA, 25 bp, Homo sapien
aggtgttgcagcttcttcgccttcg

SEQ ID NO: 297241 - DNA, 25 bp, Homo sapien
ttcgccttcgtcaaatcttcaatgg

SEQ ID NO: 297242 - DNA, 25 bp, Homo sapien
ttcgtcaaatcttcaatggaacctt

SEQ ID NO: 297243 - DNA, 25 bp, Homo sapien
gtaagaggcctatgactgcttcctg

SEQ ID NO: 297244 - DNA, 25 bp, Homo sapien
tctactagattctcaaactctattg

SEQ ID NO: 297245 - DNA, 25 bp, Homo sapien
aactctattgttaagtgctcacctc

SEQ ID NO: 297246 - DNA, 25 bp, Homo sapien
tcacctcttgagcatgttctaaaat

SEQ ID NO: 297247 - DNA, 25 bp, Homo sapien
gttctaaaatacttggatcctccgc

SEQ ID NO: 297248 - DNA, 25 bp, Homo sapien
ttccttgcgaagcagtccgaagcac

SEQ ID NO: 297249 - DNA, 25 bp, Homo sapien
aagcagtccgaagcactgcgtccag

SEQ ID NO: 297250 - DNA, 25 bp, Homo sapien
agatctttttgtttttcggcaatgg

SEQ ID NO: 297251 - DNA, 25 bp, Homo sapien
gcaatggaatcataatgcctttctc

SEQ ID NO: 297252 - DNA, 25 bp, Homo sapien
aatgcctttctcttaggtcaacaat

SEQ ID NO: 297253 - DNA, 25 bp, Homo sapien
ggtcaacaatttcttcctcagtaag

SEQ ID NO: 297254 - DNA, 25 bp, Homo sapien
acttcctgattacttggggcacgct

SEQ ID NO: 297255 - DNA, 25 bp, Homo sapien
gggcacgctgtactcatcttgctcc

SEQ ID NO: 297256 - DNA, 25 bp, Homo sapien
gcactgcctttctctacttcattta

SEQ ID NO: 297257 - DNA, 25 bp, Homo sapien
tgctgtccttcagatctcggttgaa

SEQ ID NO: 297258 - DNA, 25 bp, Homo sapien
cagatctcggttgaagtgtcacttc

SEQ ID NO: 297259 - DNA, 25 bp, Homo sapien
tcggttgaagtgtcacttccttggg

SEQ ID NO: 297260 - DNA, 25 bp, Homo sapien
gggaagctggcttacactctcagga

SEQ ID NO: 297261 - DNA, 25 bp, Homo sapien
tacactctcaggactcggttaggtt

SEQ ID NO: 297262 - DNA, 25 bp, Homo sapien
agaccaaacatcttgctgtggccta

SEQ ID NO: 297263 - DNA, 25 bp, Homo sapien
aacatcttgctgtggcctacaggag

SEQ ID NO: 297264 - DNA, 25 bp, Homo sapien
ttgctgtggcctacaggagacagga

SEQ ID NO: 297265 - DNA, 25 bp, Homo sapien
taaaatgtgctatgctttaattaaa

SEQ ID NO: 297266 - DNA, 25 bp, Homo sapien
gtatttactctacaagcagggatgt

SEQ ID NO: 297267 - DNA, 25 bp, Homo sapien
actctacaagcagggatgttttacc

SEQ ID NO: 297268 - DNA, 25 bp, Homo sapien
tgaagcttatgtttatgtggcaaaa

SEQ ID NO: 297269 - DNA, 25 bp, Homo sapien
gcaaaagtaagcttcaggactgggc

SEQ ID NO: 297270 - DNA, 25 bp, Homo sapien
aggactgggctgtgtatttttattg

SEQ ID NO: 297271 - DNA, 25 bp, Homo sapien
ggctgtgtatttttattggcatgta

SEQ ID NO: 297272 - DNA, 25 bp, Homo sapien
aacagttaatatgagctctacaaga

SEQ ID NO: 297273 - DNA, 25 bp, Homo sapien
ggagctaaagctatcaacagctgca

SEQ ID NO: 297274 - DNA, 25 bp, Homo sapien
gctatcaacagctgcagatttaaaa

SEQ ID NO: 297275 - DNA, 25 bp, Homo sapien
taaaactgttaggttagctcagttg

SEQ ID NO: 297276 - DNA, 25 bp, Homo sapien
ggaaacagaaacttccccatagcct

SEQ ID NO: 297277 - DNA, 25 bp, Homo sapien
agcccagtgaagcctgtgttggacc

SEQ ID NO: 297278 - DNA, 25 bp, Homo sapien
gcctgtgttggacctctaatctgca

SEQ ID NO: 297279 - DNA, 25 bp, Homo sapien
gtgttggacctctaatctgcagaac

SEQ ID NO: 297280 - DNA, 25 bp, Homo sapien
taatagatttgtgtttaagccacta

SEQ ID NO: 297281 - DNA, 25 bp, Homo sapien
gaagaacggttagagagagatgcac

SEQ ID NO: 297282 - DNA, 25 bp, Homo sapien
taagtttgtggtaatgtgttgtagc

SEQ ID NO: 297283 - DNA, 25 bp, Homo sapien
acagaaaactagtattctcaggcta

SEQ ID NO: 297284 - DNA, 25 bp, Homo sapien
gagagatgcaccattgctggctttg

SEQ ID NO: 297285 - DNA, 25 bp, Homo sapien
taagccagggagttgcaggcagcct

SEQ ID NO: 297286 - DNA, 25 bp, Homo sapien
gcaggcagcctgtagaattgagact

SEQ ID NO: 297287 - DNA, 25 bp, Homo sapien
gactctgctgacaccaaagtatttt

SEQ ID NO: 297288 - DNA, 25 bp, Homo sapien
gatgtaactctcaaggctggttcat

SEQ ID NO: 297289 - DNA, 25 bp, Homo sapien
ctcaaggctggttcattgtttctca

SEQ ID NO: 297290 - DNA, 25 bp, Homo sapien
tatgagtacgtgtgaccttttccca

SEQ ID NO: 297291 - DNA, 25 bp, Homo sapien
aagccggttgcccaactgcattaat

SEQ ID NO: 297292 - DNA, 25 bp, Homo sapien
tctaattcgggagtctgttcccttt

SEQ ID NO: 297293 - DNA, 25 bp, Homo sapien
cccttttagtgccacgcgttgaata

SEQ ID NO: 297294 - DNA, 25 bp, Homo sapien
gaatagttccacatactttcagaag

SEQ ID NO: 297295 - DNA, 25 bp, Homo sapien
tactttcagaagagctcagcagggc

SEQ ID NO: 297296 - DNA, 25 bp, Homo sapien
tggtctcccgagcatcatgagtaac

SEQ ID NO: 297297 - DNA, 25 bp, Homo sapien
atgagtaacgtgtctgctcagactc

SEQ ID NO: 297298 - DNA, 25 bp, Homo sapien
gaaccagaaggattcatcaggattc

SEQ ID NO: 297299 - DNA, 25 bp, Homo sapien
tttgatttgcagtccaataccgtac

SEQ ID NO: 297300 - DNA, 25 bp, Homo sapien
tccaataccgtactggcccagggag

SEQ ID NO: 297301 - DNA, 25 bp, Homo sapien
ccagggaggagcttttgagaacatg

SEQ ID NO: 297302 - DNA, 25 bp, Homo sapien
aagagaagataaatgcggtacgtgc

SEQ ID NO: 297303 - DNA, 25 bp, Homo sapien
gcggtacgtgcaatagttcctaata

SEQ ID NO: 297304 - DNA, 25 bp, Homo sapien
gaaattatcctggttttgcagcact

SEQ ID NO: 297305 - DNA, 25 bp, Homo sapien
ggttttgcagcactttgataactgt

SEQ ID NO: 297306 - DNA, 25 bp, Homo sapien
gacaaaacagtacaagcattcatgg

SEQ ID NO: 297307 - DNA, 25 bp, Homo sapien
agcattcatggaaggtagtgccagt

SEQ ID NO: 297308 - DNA, 25 bp, Homo sapien
gtagtgccagtgaagtactcaaaga

SEQ ID NO: 297309 - DNA, 25 bp, Homo sapien
tttgtaaaatgatgcttcccccttc

SEQ ID NO: 297310 - DNA, 25 bp, Homo sapien
cttctccatggtctagtcaattttg

SEQ ID NO: 297311 - DNA, 25 bp, Homo sapien
gtacaattaggtatctgactttaca

SEQ ID NO: 297312 - DNA, 25 bp, Homo sapien
gatgaaatcgagctgtcttttaact

SEQ ID NO: 297313 - DNA, 25 bp, Homo sapien
atcgagctgtcttttaacttttgta

SEQ ID NO: 297314 - DNA, 25 bp, Homo sapien
cagaatttgctggactatgctggca

SEQ ID NO: 297315 - DNA, 25 bp, Homo sapien
gctggactatgctggcaaggacttt

SEQ ID NO: 297316 - DNA, 25 bp, Homo sapien
gcaaggactttgtttacgatcaaat

SEQ ID NO: 297317 - DNA, 25 bp, Homo sapien
aattgtactagtgtctgcagggttt

SEQ ID NO: 297318 - DNA, 25 bp, Homo sapien
tgcagggtttgtcagtactcgtcaa

SEQ ID NO: 297319 - DNA, 25 bp, Homo sapien
gtcagtactcgtcaaagccaagtcc

SEQ ID NO: 297320 - DNA, 25 bp, Homo sapien
gaaaactatgaacatgactgattat

SEQ ID NO: 297321 - DNA, 25 bp, Homo sapien
gactgattattaaatgtctcatgtt

SEQ ID NO: 297322 - DNA, 25 bp, Homo sapien
aaatgtctcatgttaaacaatgcaa

SEQ ID NO: 297323 - DNA, 25 bp, Homo sapien
aacaatgcaatgtttgacatcactt

SEQ ID NO: 297324 - DNA, 25 bp, Homo sapien
ttgacatcactttacaaacttggat

SEQ ID NO: 297325 - DNA, 25 bp, Homo sapien
catcactttacaaacttggatcata

SEQ ID NO: 297326 - DNA, 25 bp, Homo sapien
ctttacaaacttggatcataaactg

SEQ ID NO: 297327 - DNA, 25 bp, Homo sapien
attatgagtgaatttctctatattc

SEQ ID NO: 297328 - DNA, 25 bp, Homo sapien
atttctctatattctgagtgagaaa

SEQ ID NO: 297329 - DNA, 25 bp, Homo sapien
gagaaaaatgtttagctgtgatgaa

SEQ ID NO: 297330 - DNA, 25 bp, Homo sapien
actatagagaaagtgggctgaggct

SEQ ID NO: 297331 - DNA, 25 bp, Homo sapien
tcgtttgtcttcagtcaacagcggc

SEQ ID NO: 297332 - DNA, 25 bp, Homo sapien
agcggctgaaactgaccactgagaa

SEQ ID NO: 297333 - DNA, 25 bp, Homo sapien
atgggtgtgggcactgacagttctc

SEQ ID NO: 297334 - DNA, 25 bp, Homo sapien
tttggccaggaattgagcttggctt

SEQ ID NO: 297335 - DNA, 25 bp, Homo sapien
tgagcttggcttggcaaagttcctt

SEQ ID NO: 297336 - DNA, 25 bp, Homo sapien
gcaaagttccttttaccctgttctg

SEQ ID NO: 297337 - DNA, 25 bp, Homo sapien
taccctgttctgttcatctaaatgc

SEQ ID NO: 297338 - DNA, 25 bp, Homo sapien
atgacctcaagttgtattccctggc

SEQ ID NO: 297339 - DNA, 25 bp, Homo sapien
attccctggcaaaatggactttctc

SEQ ID NO: 297340 - DNA, 25 bp, Homo sapien
tttctcaaaataggactgcacgctt

SEQ ID NO: 297341 - DNA, 25 bp, Homo sapien
gcacgcttggtgtactttaaatgtt

SEQ ID NO: 297342 - DNA, 25 bp, Homo sapien
gataaaccccgatattgggacctca

SEQ ID NO: 297343 - DNA, 25 bp, Homo sapien
gggacctcacagtgggtgtctgaaa

SEQ ID NO: 297344 - DNA, 25 bp, Homo sapien
aaaggacagatcactccggagtatc

SEQ ID NO: 297345 - DNA, 25 bp, Homo sapien
atcactccggagtatcagggattgt

SEQ ID NO: 297346 - DNA, 25 bp, Homo sapien
gacaggagtgagacaaccccccagg

SEQ ID NO: 297347 - DNA, 25 bp, Homo sapien
caggtacagcactggcttttctttt

SEQ ID NO: 297348 - DNA, 25 bp, Homo sapien
tacagcactggcttttcttttcagc

SEQ ID NO: 297349 - DNA, 25 bp, Homo sapien
actcctctgcatgtcttggagagcg

SEQ ID NO: 297350 - DNA, 25 bp, Homo sapien
tcttggagagcgctagttacacatt

SEQ ID NO: 297351 - DNA, 25 bp, Homo sapien
gagagcgctagttacacattggctt

SEQ ID NO: 297352 - DNA, 25 bp, Homo sapien
ttacacattggcttgtcccctttac

SEQ ID NO: 297353 - DNA, 25 bp, Homo sapien
aaatgagaagcctgctatgctgtgg

SEQ ID NO: 297354 - DNA, 25 bp, Homo sapien
gctatgctgtggatttatggctcat

SEQ ID NO: 297355 - DNA, 25 bp, Homo sapien
gatttatggctcatggactctggat

SEQ ID NO: 297356 - DNA, 25 bp, Homo sapien
tcatggactctggatgagttctgca

SEQ ID NO: 297357 - DNA, 25 bp, Homo sapien
gagttctgcatttatcttcgtggag

SEQ ID NO: 297358 - DNA, 25 bp, Homo sapien
atcatggcatccagaatggaactgc

SEQ ID NO: 297359 - DNA, 25 bp, Homo sapien
ccttatcccagactttctatttcag

SEQ ID NO: 297360 - DNA, 25 bp, Homo sapien
atttcagtggtccatggaagagcct

SEQ ID NO: 297361 - DNA, 25 bp, Homo sapien
ggaagagcctgcaagcttggctttt

SEQ ID NO: 297362 - DNA, 25 bp, Homo sapien
ttccatctcaggacttagctgcagg

SEQ ID NO: 297363 - DNA, 25 bp, Homo sapien
caggacttagctgcagggtctcagg

SEQ ID NO: 297364 - DNA, 25 bp, Homo sapien
gccagtataggcaacgtcacatttg

SEQ ID NO: 297365 - DNA, 25 bp, Homo sapien
ttgtttactttgcatttaccgtgag

SEQ ID NO: 297366 - DNA, 25 bp, Homo sapien
tttaccgtgagcaaagatacttctt

SEQ ID NO: 297367 - DNA, 25 bp, Homo sapien
agatacttcttggaatggctgcagt

SEQ ID NO: 297368 - DNA, 25 bp, Homo sapien
aatggctgcagtgaggccgtgtcat

SEQ ID NO: 297369 - DNA, 25 bp, Homo sapien
aggccgtgtcattggctcacaaaag

SEQ ID NO: 297370 - DNA, 25 bp, Homo sapien
aatttctgtgtttgcattccactgc

SEQ ID NO: 297371 - DNA, 25 bp, Homo sapien
tgctccctaaggtccttgactttct

SEQ ID NO: 297372 - DNA, 25 bp, Homo sapien
gactttctccccaggaattcactta

SEQ ID NO: 297373 - DNA, 25 bp, Homo sapien
ggactgagcattgtgtcaacctgtt

SEQ ID NO: 297374 - DNA, 25 bp, Homo sapien
gtcaacctgttgcagtgtttttcat

SEQ ID NO: 297375 - DNA, 25 bp, Homo sapien
tccttgttgcgcctcaccgtgggga

SEQ ID NO: 297376 - DNA, 25 bp, Homo sapien
ccttgttgcgcctcaccgtggggac

SEQ ID NO: 297377 - DNA, 25 bp, Homo sapien
cttgttgcgcctcaccgtggggacc

SEQ ID NO: 297378 - DNA, 25 bp, Homo sapien
ttgttgcgcctcaccgtggggacca

SEQ ID NO: 297379 - DNA, 25 bp, Homo sapien
tgttgcgcctcaccgtggggaccag

SEQ ID NO: 297380 - DNA, 25 bp, Homo sapien
ttgcgcctcaccgtggggaccaggt

SEQ ID NO: 297381 - DNA, 25 bp, Homo sapien
tgcgcctcaccgtggggaccaggtg

SEQ ID NO: 297382 - DNA, 25 bp, Homo sapien
gcgcctcaccgtggggaccaggtga

SEQ ID NO: 297383 - DNA, 25 bp, Homo sapien
taagaaatcatgactcttctaggta

SEQ ID NO: 297384 - DNA, 25 bp, Homo sapien
gtgcctagaaccatgagcttcggaa

SEQ ID NO: 297385 - DNA, 25 bp, Homo sapien
gcaaggccatcattgcattattaat

SEQ ID NO: 297386 - DNA, 25 bp, Homo sapien
atggaggacactattcacactgcag

SEQ ID NO: 297387 - DNA, 25 bp, Homo sapien
gaaaatgacaccttctggaacacaa

SEQ ID NO: 297388 - DNA, 25 bp, Homo sapien
taagtgatggctcccgaagttgtgc

SEQ ID NO: 297389 - DNA, 25 bp, Homo sapien
tggctcccgaagttgtgcaccgcag

SEQ ID NO: 297390 - DNA, 25 bp, Homo sapien
cttcggaaaatctaagccatagctt

SEQ ID NO: 297391 - DNA, 25 bp, Homo sapien
tagcttaggagataacacgctttaa

SEQ ID NO: 297392 - DNA, 25 bp, Homo sapien
acacgctttaatcatcttctacctt

SEQ ID NO: 297393 - DNA, 25 bp, Homo sapien
ttctaccttcaccttaataatttag

SEQ ID NO: 297394 - DNA, 25 bp, Homo sapien
ttcttagccactattagctgagagc

SEQ ID NO: 297395 - DNA, 25 bp, Homo sapien
tacccaggctgtttgactcttgatc

SEQ ID NO: 297396 - DNA, 25 bp, Homo sapien
gtttgactcttgatctcgcctagta

SEQ ID NO: 297397 - DNA, 25 bp, Homo sapien
atctcgcctagtactttttctcaat

SEQ ID NO: 297398 - DNA, 25 bp, Homo sapien
cgcctagtactttttctcaatatct

SEQ ID NO: 297399 - DNA, 25 bp, Homo sapien
ctgcgattgagttgtcctgcttgga

SEQ ID NO: 297400 - DNA, 25 bp, Homo sapien
tgcttggacacagcccttgtgttcc

SEQ ID NO: 297401 - DNA, 25 bp, Homo sapien
tccacatgtgtggtctgatccagtg

SEQ ID NO: 297402 - DNA, 25 bp, Homo sapien
gtgtggtctgatccagtgacaaaga

SEQ ID NO: 297403 - DNA, 25 bp, Homo sapien
tgccatttaaacatctcatcttgaa

SEQ ID NO: 297404 - DNA, 25 bp, Homo sapien
ctcatcttgaagaaccattctgcct

SEQ ID NO: 297405 - DNA, 25 bp, Homo sapien
cttaggcctgttttataagccactt

SEQ ID NO: 297406 - DNA, 25 bp, Homo sapien
gggacacaaacattccttctatagc

SEQ ID NO: 297407 - DNA, 25 bp, Homo sapien
tatagcactcacacacctatcatga

SEQ ID NO: 297408 - DNA, 25 bp, Homo sapien
tgtggctcttgatgtccctcgggtg

SEQ ID NO: 297409 - DNA, 25 bp, Homo sapien
gaatagaaaggtgcctgtgcttcag

SEQ ID NO: 297410 - DNA, 25 bp, Homo sapien
tgtgcttcaggcctgagacttcttt

SEQ ID NO: 297411 - DNA, 25 bp, Homo sapien
agacttctttccgtgtgtaggctca

SEQ ID NO: 297412 - DNA, 25 bp, Homo sapien
gtaggctcacactgcctgagaaatt

SEQ ID NO: 297413 - DNA, 25 bp, Homo sapien
aagccacttattcatattcacgagg

SEQ ID NO: 297414 - DNA, 25 bp, Homo sapien
gagggatctgcccttatgacctaat

SEQ ID NO: 297415 - DNA, 25 bp, Homo sapien
ttatgacctaatcgtctcccaaagg

SEQ ID NO: 297416 - DNA, 25 bp, Homo sapien
gcccctgagggccaagcagactatg

SEQ ID NO: 297417 - DNA, 25 bp, Homo sapien
gccaagcagactatgatcccgtcac

SEQ ID NO: 297418 - DNA, 25 bp, Homo sapien
tatgatcccgtcactccatatgtca

SEQ ID NO: 297419 - DNA, 25 bp, Homo sapien
cgtcactccatatgtcacggaagtt

SEQ ID NO: 297420 - DNA, 25 bp, Homo sapien
tgtcacggaagttgagtctgtggtt

SEQ ID NO: 297421 - DNA, 25 bp, Homo sapien
tgtatgcacaagtgttcaacttaca

SEQ ID NO: 297422 - DNA, 25 bp, Homo sapien
gccaccaccacaacagaatgatctt

SEQ ID NO: 297423 - DNA, 25 bp, Homo sapien
aacagaatgatcttgagattcctga

SEQ ID NO: 297424 - DNA, 25 bp, Homo sapien
gagattcctgaaagtcctacctatg

SEQ ID NO: 297425 - DNA, 25 bp, Homo sapien
tcctgaaagtcctacctatgaaaat

SEQ ID NO: 297426 - DNA, 25 bp, Homo sapien
gtcctacctatgaaaatttcacctg

SEQ ID NO: 297427 - DNA, 25 bp, Homo sapien
gggtgaacaatgactcctggcaagc

SEQ ID NO: 297428 - DNA, 25 bp, Homo sapien
ttgctccattcaattgctctcctct

SEQ ID NO: 297429 - DNA, 25 bp, Homo sapien
agctcttatcgttcccctggaatat

SEQ ID NO: 297430 - DNA, 25 bp, Homo sapien
gttcccctggaatatggccttgaga

SEQ ID NO: 297431 - DNA, 25 bp, Homo sapien
acaatgactcctggcaagcatccaa

SEQ ID NO: 297432 - DNA, 25 bp, Homo sapien
atggccttgagacagctcatccgtg

SEQ ID NO: 297433 - DNA, 25 bp, Homo sapien
tcatccgtgtccttcactgtgttat

SEQ ID NO: 297434 - DNA, 25 bp, Homo sapien
tcagctttcatctgaagatagctaa

SEQ ID NO: 297435 - DNA, 25 bp, Homo sapien
ctggaacagattatatgcctcccct

SEQ ID NO: 297436 - DNA, 25 bp, Homo sapien
tgcttgcagacgctagcaggtctca

SEQ ID NO: 297437 - DNA, 25 bp, Homo sapien
cagacgctagcaggtctcatctaca

SEQ ID NO: 297438 - DNA, 25 bp, Homo sapien
aagcctgtggcctgttttgagggaa

SEQ ID NO: 297439 - DNA, 25 bp, Homo sapien
tgtggcctgttttgagggaaaagta

SEQ ID NO: 297440 - DNA, 25 bp, Homo sapien
aattatataatgtagtcaactgcaa

SEQ ID NO: 297441 - DNA, 25 bp, Homo sapien
aatgtagtcaactgcaatatggaag

SEQ ID NO: 297442 - DNA, 25 bp, Homo sapien
gtagtcaactgcaatatggaagttt

SEQ ID NO: 297443 - DNA, 25 bp, Homo sapien
ctgcaatatggaagtttgttcttgt

SEQ ID NO: 297444 - DNA, 25 bp, Homo sapien
gtttctttgtcaataaccttaccag

SEQ ID NO: 297445 - DNA, 25 bp, Homo sapien
tttctttgtcaataaccttaccagt

SEQ ID NO: 297446 - DNA, 25 bp, Homo sapien
tctttgtcaataaccttaccagttt

SEQ ID NO: 297447 - DNA, 25 bp, Homo sapien
aaccttaccagttttataatgcagt

SEQ ID NO: 297448 - DNA, 25 bp, Homo sapien
gcagtttttgatggaattaaacaca

SEQ ID NO: 297449 - DNA, 25 bp, Homo sapien
ggcggtaatcgtgtgttgcatcgat

SEQ ID NO: 297450 - DNA, 25 bp, Homo sapien
aatcgtgtgttgcatcgatgcgttt

SEQ ID NO: 297451 - DNA, 25 bp, Homo sapien
ttgcatcgatgcgtttgtggtcacc

SEQ ID NO: 297452 - DNA, 25 bp, Homo sapien
gcatcgatgcgtttgtggtcaccac

SEQ ID NO: 297453 - DNA, 25 bp, Homo sapien
atcgatgcgtttgtggtcaccacga

SEQ ID NO: 297454 - DNA, 25 bp, Homo sapien
cgatgcgtttgtggtcaccacgaag

SEQ ID NO: 297455 - DNA, 25 bp, Homo sapien
tcaccacgaagatgaggaccaactt

SEQ ID NO: 297456 - DNA, 25 bp, Homo sapien
accacgaagatgaggaccaacttga

SEQ ID NO: 297457 - DNA, 25 bp, Homo sapien
gaccaacttgaaaagattcctggga

SEQ ID NO: 297458 - DNA, 25 bp, Homo sapien
aacttgaaaagattcctgggagtcg

SEQ ID NO: 297459 - DNA, 25 bp, Homo sapien
agattcctgggagtcgaagttgaaa

SEQ ID NO: 297460 - DNA, 25 bp, Homo sapien
agcggacgagtcgtccccattctgg

SEQ ID NO: 297461 - DNA, 25 bp, Homo sapien
actggcctcggagtcatgacaaggc

SEQ ID NO: 297462 - DNA, 25 bp, Homo sapien
ctctcaggcagctagattctggaca

SEQ ID NO: 297463 - DNA, 25 bp, Homo sapien
gcagctagattctggacaggcctgg

SEQ ID NO: 297464 - DNA, 25 bp, Homo sapien
ctagattctggacaggcctgggtct

SEQ ID NO: 297465 - DNA, 25 bp, Homo sapien
agattctggacaggcctgggtctgc

SEQ ID NO: 297466 - DNA, 25 bp, Homo sapien
acaggcctgggtctgcaagggaggt

SEQ ID NO: 297467 - DNA, 25 bp, Homo sapien
cctcggagtcatgacaaggctgggc

SEQ ID NO: 297468 - DNA, 25 bp, Homo sapien
aacgctctcgattgccacctactgt

SEQ ID NO: 297469 - DNA, 25 bp, Homo sapien
catgacaaggctgggcgagcagctc

SEQ ID NO: 297470 - DNA, 25 bp, Homo sapien
gagcagctcggcctcgggcgtcggt

SEQ ID NO: 297471 - DNA, 25 bp, Homo sapien
gttttctttgaattgtgctcttttc

SEQ ID NO: 297472 - DNA, 25 bp, Homo sapien
gaattgtgctcttttcagattttga

SEQ ID NO: 297473 - DNA, 25 bp, Homo sapien
ttgtgctcttttcagattttgagat

SEQ ID NO: 297474 - DNA, 25 bp, Homo sapien
ttgtgtaacaactagtaagtagaga

SEQ ID NO: 297475 - DNA, 25 bp, Homo sapien
attttctatctcttttgtcatggtt

SEQ ID NO: 297476 - DNA, 25 bp, Homo sapien
ttctatctcttttgtcatggtttat

SEQ ID NO: 297477 - DNA, 25 bp, Homo sapien
atctcttttgtcatggtttatgtcg

SEQ ID NO: 297478 - DNA, 25 bp, Homo sapien
tttgtcatggtttatgtcgtagctt

SEQ ID NO: 297479 - DNA, 25 bp, Homo sapien
tcatggtttatgtcgtagcttattt

SEQ ID NO: 297480 - DNA, 25 bp, Homo sapien
atggtttatgtcgtagcttatttaa

SEQ ID NO: 297481 - DNA, 25 bp, Homo sapien
gtattattactgtgatttctaaaga

SEQ ID NO: 297482 - DNA, 25 bp, Homo sapien
gaaagtcacctttgggctgaacaga

SEQ ID NO: 297483 - DNA, 25 bp, Homo sapien
gctgaacagaaacatgactgccgaa

SEQ ID NO: 297484 - DNA, 25 bp, Homo sapien
acatgactgccgaattcaagaagac

SEQ ID NO: 297485 - DNA, 25 bp, Homo sapien
tatcttggtcagtcccacgggccct

SEQ ID NO: 297486 - DNA, 25 bp, Homo sapien
acgggcccttctcgagtggccttcg

SEQ ID NO: 297487 - DNA, 25 bp, Homo sapien
agtggccttcgaccctgaacagaag

SEQ ID NO: 297488 - DNA, 25 bp, Homo sapien
tgaccaccacaccaaggagaaggcc

SEQ ID NO: 297489 - DNA, 25 bp, Homo sapien
aaggcccagggctatggatttcttc

SEQ ID NO: 297490 - DNA, 25 bp, Homo sapien
gagcagcagagtcccttgtaaaaga

SEQ ID NO: 297491 - DNA, 25 bp, Homo sapien
gactgcttttgtacagaatgcgcta

SEQ ID NO: 297492 - DNA, 25 bp, Homo sapien
gaatgcgctataaattataccttta

SEQ ID NO: 297493 - DNA, 25 bp, Homo sapien
gccgacctggctgggactcgtgaat

SEQ ID NO: 297494 - DNA, 25 bp, Homo sapien
cctggctgggactcgtgaatctgga

SEQ ID NO: 297495 - DNA, 25 bp, Homo sapien
atggatagtattgtctgtatttgga

SEQ ID NO: 297496 - DNA, 25 bp, Homo sapien
gagactttaatttctgtgtgagacc

SEQ ID NO: 297497 - DNA, 25 bp, Homo sapien
atttctgtgtgagaccaaaggagga

SEQ ID NO: 297498 - DNA, 25 bp, Homo sapien
aaatttgttgtggtacactatctta

SEQ ID NO: 297499 - DNA, 25 bp, Homo sapien
cactatcttatgtaacctgtctggt

SEQ ID NO: 297500 - DNA, 25 bp, Homo sapien
acctgtctggtgagtttgtttggac

SEQ ID NO: 297501 - DNA, 25 bp, Homo sapien
ttgtttggacaacctaactcagctt

SEQ ID NO: 297502 - DNA, 25 bp, Homo sapien
ggacaacctaactcagctttatttg

SEQ ID NO: 297503 - DNA, 25 bp, Homo sapien
cagctttatttgacatggaacctaa

SEQ ID NO: 297504 - DNA, 25 bp, Homo sapien
agggccccagaaggcccagtaggat

SEQ ID NO: 297505 - DNA, 25 bp, Homo sapien
gaaggcccagtaggatttacctcat

SEQ ID NO: 297506 - DNA, 25 bp, Homo sapien
ggcccagtaggatttacctcatgtg

SEQ ID NO: 297507 - DNA, 25 bp, Homo sapien
acctcatgtggtaagtcactcttgc

SEQ ID NO: 297508 - DNA, 25 bp, Homo sapien
tgtggtaagtcactcttgcaaggca

SEQ ID NO: 297509 - DNA, 25 bp, Homo sapien
ggtaagtcactcttgcaaggcacac

SEQ ID NO: 297510 - DNA, 25 bp, Homo sapien
agtcactcttgcaaggcacacagca

SEQ ID NO: 297511 - DNA, 25 bp, Homo sapien
tcttgcaaggcacacagcacagcgc

SEQ ID NO: 297512 - DNA, 25 bp, Homo sapien
gggacttcgggcttccggaaggcag

SEQ ID NO: 297513 - DNA, 25 bp, Homo sapien
agtggcccaggaacctcctgactgt

SEQ ID NO: 297514 - DNA, 25 bp, Homo sapien
tgactgtcctctccctttggttacc

SEQ ID NO: 297515 - DNA, 25 bp, Homo sapien
gaaaaaactgcactgttcccaccca

SEQ ID NO: 297516 - DNA, 25 bp, Homo sapien
actgttcccacccacatagttacag

SEQ ID NO: 297517 - DNA, 25 bp, Homo sapien
tacagccactttatcaaacagaaga

SEQ ID NO: 297518 - DNA, 25 bp, Homo sapien
aacagaagagcagtctggagccatt

SEQ ID NO: 297519 - DNA, 25 bp, Homo sapien
gagcagtctggagccattgcaaaac

SEQ ID NO: 297520 - DNA, 25 bp, Homo sapien
gtctggagccattgcaaaacaaaat

SEQ ID NO: 297521 - DNA, 25 bp, Homo sapien
aaacaaaatacctgccacaactcct

SEQ ID NO: 297522 - DNA, 25 bp, Homo sapien
tcttctcatttcgactccagctttt

SEQ ID NO: 297523 - DNA, 25 bp, Homo sapien
tttcgactccagcttttcatcttag

SEQ ID NO: 297524 - DNA, 25 bp, Homo sapien
agactaacatcaaggtagttgcaga

SEQ ID NO: 297525 - DNA, 25 bp, Homo sapien
caaggtagttgcagaattcagattc

SEQ ID NO: 297526 - DNA, 25 bp, Homo sapien
cccctgcagcaactaagatggtggg

SEQ ID NO: 297527 - DNA, 25 bp, Homo sapien
gaatacagttttcaggacctcaagc

SEQ ID NO: 297528 - DNA, 25 bp, Homo sapien
ggacctcaagcagacttcctagaga

SEQ ID NO: 297529 - DNA, 25 bp, Homo sapien
cctagagacttgtttctgagacagt

SEQ ID NO: 297530 - DNA, 25 bp, Homo sapien
ctgagacagttctttgccttcactt

SEQ ID NO: 297531 - DNA, 25 bp, Homo sapien
ttcacttccctgctagctgggaaag

SEQ ID NO: 297532 - DNA, 25 bp, Homo sapien
tgcctggccactgagaacagccaaa

SEQ ID NO: 297533 - DNA, 25 bp, Homo sapien
ttttggattttctccggactcatca

SEQ ID NO: 297534 - DNA, 25 bp, Homo sapien
tttctccggactcatcagtaaacct

SEQ ID NO: 297535 - DNA, 25 bp, Homo sapien
aaacctgtagaagtgtcgctttcca

SEQ ID NO: 297536 - DNA, 25 bp, Homo sapien
tagaagtgtcgctttccagcctttt

SEQ ID NO: 297537 - DNA, 25 bp, Homo sapien
agcagtggactacagctcactacca

SEQ ID NO: 297538 - DNA, 25 bp, Homo sapien
tggcagtccttcctatagcagtgca

SEQ ID NO: 297539 - DNA, 25 bp, Homo sapien
ctatagcagtgcaccatgtacaggt

SEQ ID NO: 297540 - DNA, 25 bp, Homo sapien
ccatgtacaggtgttgtgtgcaaca

SEQ ID NO: 297541 - DNA, 25 bp, Homo sapien
tgtgtgcaacaacccagaaatcgtt

SEQ ID NO: 297542 - DNA, 25 bp, Homo sapien
ggatggtcgaataaatctcttcaga

SEQ ID NO: 297543 - DNA, 25 bp, Homo sapien
aatctcttcagagctgatcacaagg

SEQ ID NO: 297544 - DNA, 25 bp, Homo sapien
gacaatgcagatagtagtacactcc

SEQ ID NO: 297545 - DNA, 25 bp, Homo sapien
tagtacactccatgctgtaaccttt

SEQ ID NO: 297546 - DNA, 25 bp, Homo sapien
taacctttcttcgaactcctgagat

SEQ ID NO: 297547 - DNA, 25 bp, Homo sapien
aatgagccttctcagatattgtcac

SEQ ID NO: 297548 - DNA, 25 bp, Homo sapien
taaaaagaacatcagacatcaccat

SEQ ID NO: 297549 - DNA, 25 bp, Homo sapien
acatcaccatcacctcgcttagaat

SEQ ID NO: 297550 - DNA, 25 bp, Homo sapien
catcacctcgcttagaatccatggg

SEQ ID NO: 297551 - DNA, 25 bp, Homo sapien
ttctcctcaaattcaatcttcccag

SEQ ID NO: 297552 - DNA, 25 bp, Homo sapien
cctcaaattcaatcttcccaggcat

SEQ ID NO: 297553 - DNA, 25 bp, Homo sapien
tcccaggcatttcatgaacttgcgt

SEQ ID NO: 297554 - DNA, 25 bp, Homo sapien
ggcatttcatgaacttgcgtctagt

SEQ ID NO: 297555 - DNA, 25 bp, Homo sapien
gaacttgcgtctagtttctgttccc

SEQ ID NO: 297556 - DNA, 25 bp, Homo sapien
ctagtttctgttccctctcaaattg

SEQ ID NO: 297557 - DNA, 25 bp, Homo sapien
tgttccctctcaaattgcccaggct

SEQ ID NO: 297558 - DNA, 25 bp, Homo sapien
tgcccaggctgtcctgtgagtgaca

SEQ ID NO: 297559 - DNA, 25 bp, Homo sapien
aggcattaaacttaggtaccaatct

SEQ ID NO: 297560 - DNA, 25 bp, Homo sapien
gtaccaatctacacaaagtcctcga

SEQ ID NO: 297561 - DNA, 25 bp, Homo sapien
caatctacacaaagtcctcgaaggg

SEQ ID NO: 297562 - DNA, 25 bp, Homo sapien
ggcctggcttggaccgaacgcgctt

SEQ ID NO: 297563 - DNA, 25 bp, Homo sapien
gcttggaccgaacgcgcttttgtgc

SEQ ID NO: 297564 - DNA, 25 bp, Homo sapien
ggaccgaacgcgcttttgtgccgcc

SEQ ID NO: 297565 - DNA, 25 bp, Homo sapien
gcagcaccctgaaggccactgagct

SEQ ID NO: 297566 - DNA, 25 bp, Homo sapien
tgaaggccactgagcttagggcgct

SEQ ID NO: 297567 - DNA, 25 bp, Homo sapien
gtccctagaagcgacttgaaatgag

SEQ ID NO: 297568 - DNA, 25 bp, Homo sapien
cagaacttaaaacaatcgaacgaat

SEQ ID NO: 297569 - DNA, 25 bp, Homo sapien
tcgaacgaattcgtcctttgttctt

SEQ ID NO: 297570 - DNA, 25 bp, Homo sapien
taggccattctaaaggaaagatgtt

SEQ ID NO: 297571 - DNA, 25 bp, Homo sapien
gaaagatgttccatgtcatcagaga

SEQ ID NO: 297572 - DNA, 25 bp, Homo sapien
atgttccatgtcatcagagatggta

SEQ ID NO: 297573 - DNA, 25 bp, Homo sapien
tttggtaccaaagattacacttgtg

SEQ ID NO: 297574 - DNA, 25 bp, Homo sapien
gattacacttgtgtttctacacagc

SEQ ID NO: 297575 - DNA, 25 bp, Homo sapien
tctacacagcaaaccatttttcttt

SEQ ID NO: 297576 - DNA, 25 bp, Homo sapien
gctattaatgtgaaagttgtctcta

SEQ ID NO: 297577 - DNA, 25 bp, Homo sapien
atgtttttcacaccttttgcattac

SEQ ID NO: 297578 - DNA, 25 bp, Homo sapien
tttcacaccttttgcattacataat

SEQ ID NO: 297579 - DNA, 25 bp, Homo sapien
aattttgtggaagcattttgccctt

SEQ ID NO: 297580 - DNA, 25 bp, Homo sapien
gtggaagcattttgccctttagaat

SEQ ID NO: 297581 - DNA, 25 bp, Homo sapien
tctggtcacatgtggaccttgatac

SEQ ID NO: 297582 - DNA, 25 bp, Homo sapien
ggaccttgatacgactaagcggtta

SEQ ID NO: 297583 - DNA, 25 bp, Homo sapien
aagcggttacatatgtggttgtgca

SEQ ID NO: 297584 - DNA, 25 bp, Homo sapien
gtggttgtgcaaaagctttctgttt

SEQ ID NO: 297585 - DNA, 25 bp, Homo sapien
atagtgttaccgatttacatcttgg

SEQ ID NO: 297586 - DNA, 25 bp, Homo sapien
acatcttggttttcagtggcactat

SEQ ID NO: 297587 - DNA, 25 bp, Homo sapien
tggcactatgtctaggaggcaatat

SEQ ID NO: 297588 - DNA, 25 bp, Homo sapien
ggcaatatccttttaaacagtgctt

SEQ ID NO: 297589 - DNA, 25 bp, Homo sapien
cagtgctttggctaagatagatact

SEQ ID NO: 297590 - DNA, 25 bp, Homo sapien
tgaactaagtatatcccatttggaa

SEQ ID NO: 297591 - DNA, 25 bp, Homo sapien
ttaaagggccaacagaactcttggt

SEQ ID NO: 297592 - DNA, 25 bp, Homo sapien
aatgacatctttgagcgcatcgctg

SEQ ID NO: 297593 - DNA, 25 bp, Homo sapien
agctccaagtgagctctcgcagctg

SEQ ID NO: 297594 - DNA, 25 bp, Homo sapien
tccaagtgagctctcgcagctgcca

SEQ ID NO: 297595 - DNA, 25 bp, Homo sapien
agtgagctctcgcagctgccagcaa

SEQ ID NO: 297596 - DNA, 25 bp, Homo sapien
gtgagctctcgcagctgccagcaat

SEQ ID NO: 297597 - DNA, 25 bp, Homo sapien
tctcgcagctgccagcaatccaaag

SEQ ID NO: 297598 - DNA, 25 bp, Homo sapien
agctgccagcaatccaaaggctctt

SEQ ID NO: 297599 - DNA, 25 bp, Homo sapien
ctgccagcaatccaaaggctctttt

SEQ ID NO: 297600 - DNA, 25 bp, Homo sapien
gagccactcacgcttccagagaaag

SEQ ID NO: 297601 - DNA, 25 bp, Homo sapien
cagagaaagagcctgtgcattttgc

SEQ ID NO: 297602 - DNA, 25 bp, Homo sapien
gcttgtagtcttttgggtggactcc

SEQ ID NO: 297603 - DNA, 25 bp, Homo sapien
ggcaacattggacagaaaatgcaat

SEQ ID NO: 297604 - DNA, 25 bp, Homo sapien
gaaaatgcaatgacataaccaattt

SEQ ID NO: 297605 - DNA, 25 bp, Homo sapien
gcaatgacataaccaatttgtaatg

SEQ ID NO: 297606 - DNA, 25 bp, Homo sapien
atttgtaatgattttggaactgtgt

SEQ ID NO: 297607 - DNA, 25 bp, Homo sapien
tttcaaatggactgttacagactga

SEQ ID NO: 297608 - DNA, 25 bp, Homo sapien
tggactgttacagactgaaaggtgt

SEQ ID NO: 297609 - DNA, 25 bp, Homo sapien
ctgaaaggtgtgaacagctttgtat

SEQ ID NO: 297610 - DNA, 25 bp, Homo sapien
gaacagctttgtatgtttatgaagg

SEQ ID NO: 297611 - DNA, 25 bp, Homo sapien
cagctttgtatgtttatgaagggta

SEQ ID NO: 297612 - DNA, 25 bp, Homo sapien
gggaatttaatacttttccacagat

SEQ ID NO: 297613 - DNA, 25 bp, Homo sapien
gaatttaatacttttccacagattt

SEQ ID NO: 297614 - DNA, 25 bp, Homo sapien
tctgtggtgacaacggaggaaatat

SEQ ID NO: 297615 - DNA, 25 bp, Homo sapien
gacaacggaggaaatatccaacaga

SEQ ID NO: 297616 - DNA, 25 bp, Homo sapien
ctaacagggaaattgggatcatagt

SEQ ID NO: 297617 - DNA, 25 bp, Homo sapien
gggatcatagtttatatgcatctga

SEQ ID NO: 297618 - DNA, 25 bp, Homo sapien
tatgcatctgatttgaaaggagtat

SEQ ID NO: 297619 - DNA, 25 bp, Homo sapien
tgaggaaggttttcatatatgatct

SEQ ID NO: 297620 - DNA, 25 bp, Homo sapien
gaaatcaagccttctaacactagtt

SEQ ID NO: 297621 - DNA, 25 bp, Homo sapien
aacactagttataattgagaagcaa

SEQ ID NO: 297622 - DNA, 25 bp, Homo sapien
gaagcaacagtaactccgtggacag

SEQ ID NO: 297623 - DNA, 25 bp, Homo sapien
agtaactccgtggacagcaatcaag

SEQ ID NO: 297624 - DNA, 25 bp, Homo sapien
aaaaagggcagaattcagtagaata

SEQ ID NO: 297625 - DNA, 25 bp, Homo sapien
ataaacaaaccgttgccccaatctg

SEQ ID NO: 297626 - DNA, 25 bp, Homo sapien
taaacaaaccgttgccccaatctgt

SEQ ID NO: 297627 - DNA, 25 bp, Homo sapien
agagagagagatgggctctccctgt

SEQ ID NO: 297628 - DNA, 25 bp, Homo sapien
cacacctggccgaaataataatatt

SEQ ID NO: 297629 - DNA, 25 bp, Homo sapien
taagttttttaattgctcagacacc

SEQ ID NO: 297630 - DNA, 25 bp, Homo sapien
tttttaattgctcagacaccacaac

SEQ ID NO: 297631 - DNA, 25 bp, Homo sapien
tttaattgctcagacaccacaacat

SEQ ID NO: 297632 - DNA, 25 bp, Homo sapien
cagacaccacaacatcctagatgga

SEQ ID NO: 297633 - DNA, 25 bp, Homo sapien
gacaccacaacatcctagatggagg

SEQ ID NO: 297634 - DNA, 25 bp, Homo sapien
caccacaacatcctagatggaggaa

SEQ ID NO: 297635 - DNA, 25 bp, Homo sapien
aacatcctagatggaggaaaccatt

SEQ ID NO: 297636 - DNA, 25 bp, Homo sapien
ggctagtttaagatatacaccccaa

SEQ ID NO: 297637 - DNA, 25 bp, Homo sapien
cacttattaaccaatcccgatttag

SEQ ID NO: 297638 - DNA, 25 bp, Homo sapien
atttttcttgttaacttgtctgtga

SEQ ID NO: 297639 - DNA, 25 bp, Homo sapien
ttcttgttaacttgtctgtgatcag

SEQ ID NO: 297640 - DNA, 25 bp, Homo sapien
gttaacttgtctgtgatcagtttaa

SEQ ID NO: 297641 - DNA, 25 bp, Homo sapien
gatcagtttaatttgtagggtccca

SEQ ID NO: 297642 - DNA, 25 bp, Homo sapien
ttgtagggtcccagacactgaacct

SEQ ID NO: 297643 - DNA, 25 bp, Homo sapien
cagacactgaacctaggatggaaga

SEQ ID NO: 297644 - DNA, 25 bp, Homo sapien
atcccgatttagaatccatttcttc

SEQ ID NO: 297645 - DNA, 25 bp, Homo sapien
gctttcctatggcttaggcaaccat

SEQ ID NO: 297646 - DNA, 25 bp, Homo sapien
cgagcagccgtaaacttcttttctt

SEQ ID NO: 297647 - DNA, 25 bp, Homo sapien
agtttcctggcctatttaatgtctc

SEQ ID NO: 297648 - DNA, 25 bp, Homo sapien
tgacttggctggctccctgctttag

SEQ ID NO: 297649 - DNA, 25 bp, Homo sapien
cctagctgacccctgaaatatttgg

SEQ ID NO: 297650 - DNA, 25 bp, Homo sapien
taaatgccatcaactttatcccctg

SEQ ID NO: 297651 - DNA, 25 bp, Homo sapien
ttatcccctgtagaagtgatctgtt

SEQ ID NO: 297652 - DNA, 25 bp, Homo sapien
atctgtttttcaactcccatggctt

SEQ ID NO: 297653 - DNA, 25 bp, Homo sapien
actcccatggcttctgatttgtgta

SEQ ID NO: 297654 - DNA, 25 bp, Homo sapien
gatttgtgtaactctttgaacaccc

SEQ ID NO: 297655 - DNA, 25 bp, Homo sapien
ttgaacacccaatattgacttgtat

SEQ ID NO: 297656 - DNA, 25 bp, Homo sapien
tgctttagggtttttggctcacttg

SEQ ID NO: 297657 - DNA, 25 bp, Homo sapien
gtggctctgggttacataacttttc

SEQ ID NO: 297658 - DNA, 25 bp, Homo sapien
gatgtcaagtcttcgagtcagcgtg

SEQ ID NO: 297659 - DNA, 25 bp, Homo sapien
agtcagcgtgactcattcgttcttc

SEQ ID NO: 297660 - DNA, 25 bp, Homo sapien
actcattcgttcttccaacagtttg

SEQ ID NO: 297661 - DNA, 25 bp, Homo sapien
ccaacagtttggacaccacaaagca

SEQ ID NO: 297662 - DNA, 25 bp, Homo sapien
tttctacagctggaaagtgagtcct

SEQ ID NO: 297663 - DNA, 25 bp, Homo sapien
aagtgagtcctatcctttgaggaaa

SEQ ID NO: 297664 - DNA, 25 bp, Homo sapien
agacatggagtggtttgaaagctac

SEQ ID NO: 297665 - DNA, 25 bp, Homo sapien
actcttcatttaagactgctctccc

SEQ ID NO: 297666 - DNA, 25 bp, Homo sapien
cccaaccaagacacatttgcctgga

SEQ ID NO: 297667 - DNA, 25 bp, Homo sapien
atttgcctggaaattcagttcttag

SEQ ID NO: 297668 - DNA, 25 bp, Homo sapien
ggttttgagtgacaccacagctgtc

SEQ ID NO: 297669 - DNA, 25 bp, Homo sapien
aaatttcacctgaaaggaaaagcag

SEQ ID NO: 297670 - DNA, 25 bp, Homo sapien
ggttggaaagtcagctggacctcat

SEQ ID NO: 297671 - DNA, 25 bp, Homo sapien
gttggaaagtcagctggacctcatg

SEQ ID NO: 297672 - DNA, 25 bp, Homo sapien
ttggaaagtcagctggacctcatgg

SEQ ID NO: 297673 - DNA, 25 bp, Homo sapien
tggaaagtcagctggacctcatggg

SEQ ID NO: 297674 - DNA, 25 bp, Homo sapien
aagtcagctggacctcatggggcct

SEQ ID NO: 297675 - DNA, 25 bp, Homo sapien
gacagaagcacctcagaatttcctt

SEQ ID NO: 297676 - DNA, 25 bp, Homo sapien
cagaagcacctcagaatttccttca

SEQ ID NO: 297677 - DNA, 25 bp, Homo sapien
agaagcacctcagaatttccttcag

SEQ ID NO: 297678 - DNA, 25 bp, Homo sapien
gaagcacctcagaatttccttcagt

SEQ ID NO: 297679 - DNA, 25 bp, Homo sapien
aagcacctcagaatttccttcagtg

SEQ ID NO: 297680 - DNA, 25 bp, Homo sapien
gacactggcctgagactgtctgcag

SEQ ID NO: 297681 - DNA, 25 bp, Homo sapien
tgtctgcagttgcaccgcagatcct

SEQ ID NO: 297682 - DNA, 25 bp, Homo sapien
tggcccgacccaatatcagttcagt

SEQ ID NO: 297683 - DNA, 25 bp, Homo sapien
atatcagttcagtcatccgatcttc

SEQ ID NO: 297684 - DNA, 25 bp, Homo sapien
gttcagtcatccgatcttccttggg

SEQ ID NO: 297685 - DNA, 25 bp, Homo sapien
attaccgtcctgaacccttgtcatc

SEQ ID NO: 297686 - DNA, 25 bp, Homo sapien
cttgtcatccactacttggctataa

SEQ ID NO: 297687 - DNA, 25 bp, Homo sapien
cactacttggctataagctccagaa

SEQ ID NO: 297688 - DNA, 25 bp, Homo sapien
ataagctccagaagtgacaagacac

SEQ ID NO: 297689 - DNA, 25 bp, Homo sapien
gtgacaagacacttcacatcttaaa

SEQ ID NO: 297690 - DNA, 25 bp, Homo sapien
gtttcctagtttataattcatttgg

SEQ ID NO: 297691 - DNA, 25 bp, Homo sapien
ccgaccctgcatcactgggctgcgg

SEQ ID NO: 297692 - DNA, 25 bp, Homo sapien
ctgcggctgggaaaagtgagaccca

SEQ ID NO: 297693 - DNA, 25 bp, Homo sapien
gtgagacccagacgctccatctcag

SEQ ID NO: 297694 - DNA, 25 bp, Homo sapien
tctcagcttccccatgtggtgctgt

SEQ ID NO: 297695 - DNA, 25 bp, Homo sapien
ggtggccaagactgccatgttgcca

SEQ ID NO: 297696 - DNA, 25 bp, Homo sapien
ggccaagactgccatgttgccatgc

SEQ ID NO: 297697 - DNA, 25 bp, Homo sapien
gccatgttgccatgctgtgatgcag

SEQ ID NO: 297698 - DNA, 25 bp, Homo sapien
catgttgccatgctgtgatgcagca

SEQ ID NO: 297699 - DNA, 25 bp, Homo sapien
gccgtgatgagtgatgggagccttg

SEQ ID NO: 297700 - DNA, 25 bp, Homo sapien
gggatttcctctggcaaaaggaaga

SEQ ID NO: 297701 - DNA, 25 bp, Homo sapien
tttcctctggcaaaaggaagagtca

SEQ ID NO: 297702 - DNA, 25 bp, Homo sapien
tctagctgctcccttgagagtccag

SEQ ID NO: 297703 - DNA, 25 bp, Homo sapien
ttgagagtccagcttcccgctcatc

SEQ ID NO: 297704 - DNA, 25 bp, Homo sapien
ttatctgacagttcacgaaacactt

SEQ ID NO: 297705 - DNA, 25 bp, Homo sapien
gttcacgaaacactttcacatgtat

SEQ ID NO: 297706 - DNA, 25 bp, Homo sapien
acatgtattgtgtatctgagaaacc

SEQ ID NO: 297707 - DNA, 25 bp, Homo sapien
tgagaaacctcacagcagcctgcaa

SEQ ID NO: 297708 - DNA, 25 bp, Homo sapien
gggtggttattgtcatgttacacat

SEQ ID NO: 297709 - DNA, 25 bp, Homo sapien
tcatgttacacatcaggaaactgag

SEQ ID NO: 297710 - DNA, 25 bp, Homo sapien
ggctcagtgagaaagatttgtccac

SEQ ID NO: 297711 - DNA, 25 bp, Homo sapien
aaagatttgtccactgtcacacagt

SEQ ID NO: 297712 - DNA, 25 bp, Homo sapien
gttagcaagtggctgtctgcttttt

SEQ ID NO: 297713 - DNA, 25 bp, Homo sapien
acatctgcctcgtgggataccgaca

SEQ ID NO: 297714 - DNA, 25 bp, Homo sapien
tgggataccgacagcaccttgatgc

SEQ ID NO: 297715 - DNA, 25 bp, Homo sapien
ttgatgctggcctctaatgcctctt

SEQ ID NO: 297716 - DNA, 25 bp, Homo sapien
tttctccttcagcaggcttttatag

SEQ ID NO: 297717 - DNA, 25 bp, Homo sapien
gtatccaagctagtggcggtcccag

SEQ ID NO: 297718 - DNA, 25 bp, Homo sapien
tataggcacggaccacatccttgag

SEQ ID NO: 297719 - DNA, 25 bp, Homo sapien
atccttgagccgtgcctggtactgg

SEQ ID NO: 297720 - DNA, 25 bp, Homo sapien
aagctgcttcttctgggtctctata

SEQ ID NO: 297721 - DNA, 25 bp, Homo sapien
gggtctctatagtctccagcaagtc

SEQ ID NO: 297722 - DNA, 25 bp, Homo sapien
cagtgctatcctcgctgtgagtgga

SEQ ID NO: 297723 - DNA, 25 bp, Homo sapien
aggcctggaagctggacacctgcga

SEQ ID NO: 297724 - DNA, 25 bp, Homo sapien
tacaaagaagtacctctgagaacat

SEQ ID NO: 297725 - DNA, 25 bp, Homo sapien
gaagtacctctgagaacattgaaaa

SEQ ID NO: 297726 - DNA, 25 bp, Homo sapien
acttataagggcagctgtcttcctg

SEQ ID NO: 297727 - DNA, 25 bp, Homo sapien
agctgtcttcctgcaagagttctgt

SEQ ID NO: 297728 - DNA, 25 bp, Homo sapien
cttcctgcaagagttctgttgccaa

SEQ ID NO: 297729 - DNA, 25 bp, Homo sapien
gagttctgttgccaaggaatttctt

SEQ ID NO: 297730 - DNA, 25 bp, Homo sapien
ggaatttcttaatgtcgctcattct

SEQ ID NO: 297731 - DNA, 25 bp, Homo sapien
atttcttaatgtcgctcattctgtc

SEQ ID NO: 297732 - DNA, 25 bp, Homo sapien
gggcgattgggctttgaaaaaatat

SEQ ID NO: 297733 - DNA, 25 bp, Homo sapien
tattcttaaaagtttgtttagcaga

SEQ ID NO: 297734 - DNA, 25 bp, Homo sapien
atttaaatgagcactacatactgtc

SEQ ID NO: 297735 - DNA, 25 bp, Homo sapien
gttttctttgaattgtgctcttttc

SEQ ID NO: 297736 - DNA, 25 bp, Homo sapien
gaattgtgctcttttcagattttga

SEQ ID NO: 297737 - DNA, 25 bp, Homo sapien
ttgtgctcttttcagattttgagat

SEQ ID NO: 297738 - DNA, 25 bp, Homo sapien
gaagggcagctagtgatttccatag

SEQ ID NO: 297739 - DNA, 25 bp, Homo sapien
ggattaaattctaagcaccaggcaa

SEQ ID NO: 297740 - DNA, 25 bp, Homo sapien
gcaccaggcaaatgctcttcattgt

SEQ ID NO: 297741 - DNA, 25 bp, Homo sapien
attttctatctcttttgtcatggtt

SEQ ID NO: 297742 - DNA, 25 bp, Homo sapien
atctcttttgtcatggtttatgtcg

SEQ ID NO: 297743 - DNA, 25 bp, Homo sapien
tttgtcatggtttatgtcgtagctt

SEQ ID NO: 297744 - DNA, 25 bp, Homo sapien
catggtttatgtcgtagcttattta

SEQ ID NO: 297745 - DNA, 25 bp, Homo sapien
gtattattactgtgatttctaaaga

SEQ ID NO: 297746 - DNA, 25 bp, Homo sapien
atcaacaacccggtggacagagcag

SEQ ID NO: 297747 - DNA, 25 bp, Homo sapien
aacccggtggacagagcagccgaac

SEQ ID NO: 297748 - DNA, 25 bp, Homo sapien
agagcagccgaaccccattttggaa

SEQ ID NO: 297749 - DNA, 25 bp, Homo sapien
cctccccaaagcactgacaaagaag

SEQ ID NO: 297750 - DNA, 25 bp, Homo sapien
agcactgacaaagaaggagcaccct

SEQ ID NO: 297751 - DNA, 25 bp, Homo sapien
gaaggagcaccctccggccatgaat

SEQ ID NO: 297752 - DNA, 25 bp, Homo sapien
cggccatgaatcacctggactccag

SEQ ID NO: 297753 - DNA, 25 bp, Homo sapien
tgaatcacctggactccagcagcaa

SEQ ID NO: 297754 - DNA, 25 bp, Homo sapien
ggacagcaggttcaacttcccagct

SEQ ID NO: 297755 - DNA, 25 bp, Homo sapien
agctgcctacttcattcatcataga

SEQ ID NO: 297756 - DNA, 25 bp, Homo sapien
tcatagacagcagtttatctttcca

SEQ ID NO: 297757 - DNA, 25 bp, Homo sapien
ggggctaaagtctcttctgttggta

SEQ ID NO: 297758 - DNA, 25 bp, Homo sapien
aatttattagttactcttgaaacag

SEQ ID NO: 297759 - DNA, 25 bp, Homo sapien
cagtaaagaaagctgcatagttatt

SEQ ID NO: 297760 - DNA, 25 bp, Homo sapien
aatatataactactgctgcttgaga

SEQ ID NO: 297761 - DNA, 25 bp, Homo sapien
aaacatattccacccaacttgagag

SEQ ID NO: 297762 - DNA, 25 bp, Homo sapien
ttccacccaacttgagagttctttt

SEQ ID NO: 297763 - DNA, 25 bp, Homo sapien
atgattggccatatgaacatttgta

SEQ ID NO: 297764 - DNA, 25 bp, Homo sapien
gaacatttgtaatcttgccattagg

SEQ ID NO: 297765 - DNA, 25 bp, Homo sapien
taatcttgccattaggtttggacct

SEQ ID NO: 297766 - DNA, 25 bp, Homo sapien
ttgccattaggtttggacctgccat

SEQ ID NO: 297767 - DNA, 25 bp, Homo sapien
taggtttggacctgccatattttgt

SEQ ID NO: 297768 - DNA, 25 bp, Homo sapien
tagtcctgccccatgatttctccaa

SEQ ID NO: 297769 - DNA, 25 bp, Homo sapien
ccttatttccaagtgttccagcctg

SEQ ID NO: 297770 - DNA, 25 bp, Homo sapien
tatttccaagtgttccagcctggac

SEQ ID NO: 297771 - DNA, 25 bp, Homo sapien
tttccaagtgttccagcctggacgc

SEQ ID NO: 297772 - DNA, 25 bp, Homo sapien
aagtgttccagcctggacgcttccc

SEQ ID NO: 297773 - DNA, 25 bp, Homo sapien
gaagcagttggttagggctgaacaa

SEQ ID NO: 297774 - DNA, 25 bp, Homo sapien
agcagttggttagggctgaacaaga

SEQ ID NO: 297775 - DNA, 25 bp, Homo sapien
tgaacaagacagagacggtgacccc

SEQ ID NO: 297776 - DNA, 25 bp, Homo sapien
aacaagacagagacggtgaccccaa

SEQ ID NO: 297777 - DNA, 25 bp, Homo sapien
agacagagacggtgaccccaagtgg

SEQ ID NO: 297778 - DNA, 25 bp, Homo sapien
acatctgctaaagctgcaggagcct

SEQ ID NO: 297779 - DNA, 25 bp, Homo sapien
agagcttcttcgacatcctgaacga

SEQ ID NO: 297780 - DNA, 25 bp, Homo sapien
gcttcttcgacatcctgaacgagtt

SEQ ID NO: 297781 - DNA, 25 bp, Homo sapien
tcgacatcctgaacgagttccgcag

SEQ ID NO: 297782 - DNA, 25 bp, Homo sapien
cctgaacgagttccgcagcgagcag

SEQ ID NO: 297783 - DNA, 25 bp, Homo sapien
ccactgcagcccacgaaggagaagg

SEQ ID NO: 297784 - DNA, 25 bp, Homo sapien
tgcagcccacgaaggagaaggagaa

SEQ ID NO: 297785 - DNA, 25 bp, Homo sapien
tcttccgcgagtacgggagcacctc

SEQ ID NO: 297786 - DNA, 25 bp, Homo sapien
cgcgagtacgggagcacctcgtcca

SEQ ID NO: 297787 - DNA, 25 bp, Homo sapien
tcgtccatcgacgtgcagggcatgc

SEQ ID NO: 297788 - DNA, 25 bp, Homo sapien
catcgacgtgcagggcatgcccgag

SEQ ID NO: 297789 - DNA, 25 bp, Homo sapien
agggcatgcccgagcagagcttctt

SEQ ID NO: 297790 - DNA, 25 bp, Homo sapien
aggaaaccggcttataatactatat

SEQ ID NO: 297791 - DNA, 25 bp, Homo sapien
aatactatatatgactctgcctgca

SEQ ID NO: 297792 - DNA, 25 bp, Homo sapien
gactctgcctgcattttatagttaa

SEQ ID NO: 297793 - DNA, 25 bp, Homo sapien
gccagtgggctaacaaatatcagca

SEQ ID NO: 297794 - DNA, 25 bp, Homo sapien
atgtctgtttagtaacccatgtcca

SEQ ID NO: 297795 - DNA, 25 bp, Homo sapien
gtttagtaacccatgtccactgata

SEQ ID NO: 297796 - DNA, 25 bp, Homo sapien
gtaacccatgtccactgatacttta

SEQ ID NO: 297797 - DNA, 25 bp, Homo sapien
gatactttaaatatgctaattactg

SEQ ID NO: 297798 - DNA, 25 bp, Homo sapien
aataatccgtgctgtctagaaatgt

SEQ ID NO: 297799 - DNA, 25 bp, Homo sapien
ccgtgctgtctagaaatgtgagtta

SEQ ID NO: 297800 - DNA, 25 bp, Homo sapien
atgtgagttacttaccttattagga

SEQ ID NO: 297801 - DNA, 25 bp, Homo sapien
tggctgtgctatctggcccctgaga

SEQ ID NO: 297802 - DNA, 25 bp, Homo sapien
tggcccctgagattgtacgcgagat

SEQ ID NO: 297803 - DNA, 25 bp, Homo sapien
cctgagattgtacgcgagatgaccc

SEQ ID NO: 297804 - DNA, 25 bp, Homo sapien
gaaggacgaggatcagctgccattc

SEQ ID NO: 297805 - DNA, 25 bp, Homo sapien
tgccattctccaaagctgctgatgt

SEQ ID NO: 297806 - DNA, 25 bp, Homo sapien
tgctgatgtctatgcatttgggact

SEQ ID NO: 297807 - DNA, 25 bp, Homo sapien
ttgggactgtttggtatgagctgca

SEQ ID NO: 297808 - DNA, 25 bp, Homo sapien
tatgagctgcaagcaagagactggc

SEQ ID NO: 297809 - DNA, 25 bp, Homo sapien
tggcccttgaagaaccaggctgcag

SEQ ID NO: 297810 - DNA, 25 bp, Homo sapien
tgcagaggcatccatctggcagatt

SEQ ID NO: 297811 - DNA, 25 bp, Homo sapien
aaggaagtcagtgagatcctgtcgg

SEQ ID NO: 297812 - DNA, 25 bp, Homo sapien
ggtgaatgtattttaagctgcccca

SEQ ID NO: 297813 - DNA, 25 bp, Homo sapien
gaatgtattttaagctgccccataa

SEQ ID NO: 297814 - DNA, 25 bp, Homo sapien
gctgccccataaaacacatcaaatt

SEQ ID NO: 297815 - DNA, 25 bp, Homo sapien
acatcaaattggtgtataagcattg

SEQ ID NO: 297816 - DNA, 25 bp, Homo sapien
gaacgtaaagattcttacatattgt

SEQ ID NO: 297817 - DNA, 25 bp, Homo sapien
gtttacctaatcaagtactacacag

SEQ ID NO: 297818 - DNA, 25 bp, Homo sapien
atcaagtactacacagttacacaca

SEQ ID NO: 297819 - DNA, 25 bp, Homo sapien
tttaatatacttgcctgtatttctg

SEQ ID NO: 297820 - DNA, 25 bp, Homo sapien
ctgtatttctggtcattcatttgca

SEQ ID NO: 297821 - DNA, 25 bp, Homo sapien
tctggtcattcatttgcaaagcatt

SEQ ID NO: 297822 - DNA, 25 bp, Homo sapien
tttcatttatgagaacgtatcctaa

SEQ ID NO: 297823 - DNA, 25 bp, Homo sapien
agtgggtgaggtttacatccatgca

SEQ ID NO: 297824 - DNA, 25 bp, Homo sapien
ttacatccatgcaagagccctgtga

SEQ ID NO: 297825 - DNA, 25 bp, Homo sapien
tgcaagagccctgtgaacccagata

SEQ ID NO: 297826 - DNA, 25 bp, Homo sapien
gaacccagatactgaagtatgtcta

SEQ ID NO: 297827 - DNA, 25 bp, Homo sapien
acaggtgtttctgctcacagcaagc

SEQ ID NO: 297828 - DNA, 25 bp, Homo sapien
tactccaagagcagtacttaacttg

SEQ ID NO: 297829 - DNA, 25 bp, Homo sapien
acttaacttgggtgtcatgggctat

SEQ ID NO: 297830 - DNA, 25 bp, Homo sapien
gtcatgggctatgctctctatacag

SEQ ID NO: 297831 - DNA, 25 bp, Homo sapien
gattacattagagtcttgtcttaaa

SEQ ID NO: 297832 - DNA, 25 bp, Homo sapien
aagcacttggagtttttcagggagc

SEQ ID NO: 297833 - DNA, 25 bp, Homo sapien
gtttttcagggagcgatgacatttg

SEQ ID NO: 297834 - DNA, 25 bp, Homo sapien
tatgagactatgctataggcagtgc

SEQ ID NO: 297835 - DNA, 25 bp, Homo sapien
gactatgctataggcagtgcttgct

SEQ ID NO: 297836 - DNA, 25 bp, Homo sapien
atgctataggcagtgcttgcttgaa

SEQ ID NO: 297837 - DNA, 25 bp, Homo sapien
ggcagtgcttgcttgaaaagtctca

SEQ ID NO: 297838 - DNA, 25 bp, Homo sapien
gtgcttgcttgaaaagtctcatttt

SEQ ID NO: 297839 - DNA, 25 bp, Homo sapien
aagtctcatttttaaatctccctgg

SEQ ID NO: 297840 - DNA, 25 bp, Homo sapien
gtctcatttttaaatctccctggca

SEQ ID NO: 297841 - DNA, 25 bp, Homo sapien
atttttaaatctccctggcatgagg

SEQ ID NO: 297842 - DNA, 25 bp, Homo sapien
tggcatgaggtgcccacttcccctt

SEQ ID NO: 297843 - DNA, 25 bp, Homo sapien
cctttccaaagcaaccattaaacat

SEQ ID NO: 297844 - DNA, 25 bp, Homo sapien
aagcaaccattaaacatactttgtt

SEQ ID NO: 297845 - DNA, 25 bp, Homo sapien
tataagtcaggtaacattggtgtat

SEQ ID NO: 297846 - DNA, 25 bp, Homo sapien
tgagaatgcaattaaacctgatgag

SEQ ID NO: 297847 - DNA, 25 bp, Homo sapien
aaagtctttctctaaaggagatact

SEQ ID NO: 297848 - DNA, 25 bp, Homo sapien
ttctctaaaggagatactgactccc

SEQ ID NO: 297849 - DNA, 25 bp, Homo sapien
gcattaaaatttatgtttgaggtta

SEQ ID NO: 297850 - DNA, 25 bp, Homo sapien
gtatatttgagtaactgtcaggctt

SEQ ID NO: 297851 - DNA, 25 bp, Homo sapien
ttgagtaactgtcaggcttttattt

SEQ ID NO: 297852 - DNA, 25 bp, Homo sapien
aaaattgtttaacatgtaccatgta

SEQ ID NO: 297853 - DNA, 25 bp, Homo sapien
gtaccatgtacatgtcattactata

SEQ ID NO: 297854 - DNA, 25 bp, Homo sapien
catgtacatgtcattactatatttc

SEQ ID NO: 297855 - DNA, 25 bp, Homo sapien
tatttcaatgcatcatgcttgtaac

SEQ ID NO: 297856 - DNA, 25 bp, Homo sapien
catgagcattatcctattagcacaa

SEQ ID NO: 297857 - DNA, 25 bp, Homo sapien
gatgtttaccagttgaactatgcta

SEQ ID NO: 297858 - DNA, 25 bp, Homo sapien
gaactatgctacaaactcttgactt

SEQ ID NO: 297859 - DNA, 25 bp, Homo sapien
tcacttgaaaactcatctatggagg

SEQ ID NO: 297860 - DNA, 25 bp, Homo sapien
gaggagtatggctcagttgaacaaa

SEQ ID NO: 297861 - DNA, 25 bp, Homo sapien
aaaagtgacagaccttaatccttgt

SEQ ID NO: 297862 - DNA, 25 bp, Homo sapien
taatccttgtcaagtactatcccag

SEQ ID NO: 297863 - DNA, 25 bp, Homo sapien
ataaggagggcttgtcatggttgca

SEQ ID NO: 297864 - DNA, 25 bp, Homo sapien
tgcatgctgatgaaactagagtttg

SEQ ID NO: 297865 - DNA, 25 bp, Homo sapien
gagtttgttcttatttaggttgctg

SEQ ID NO: 297866 - DNA, 25 bp, Homo sapien
tttaggttgctgatctttgagaaaa

SEQ ID NO: 297867 - DNA, 25 bp, Homo sapien
gagacctcagtcaccattgacggga

SEQ ID NO: 297868 - DNA, 25 bp, Homo sapien
tgacgggatccgcttcgtagtagat

SEQ ID NO: 297869 - DNA, 25 bp, Homo sapien
ccgcttcgtagtagattccggaaag

SEQ ID NO: 297870 - DNA, 25 bp, Homo sapien
agatgagctacgatccgcaggccaa

SEQ ID NO: 297871 - DNA, 25 bp, Homo sapien
aggccaagctgcaacggctgcagga

SEQ ID NO: 297872 - DNA, 25 bp, Homo sapien
gcaacggctgcaggagttctggatt

SEQ ID NO: 297873 - DNA, 25 bp, Homo sapien
caggagttctggattagtcaggcca

SEQ ID NO: 297874 - DNA, 25 bp, Homo sapien
attagtcaggccagcgcagagcagc

SEQ ID NO: 297875 - DNA, 25 bp, Homo sapien
tgcttccgcctctatgccgaatcgg

SEQ ID NO: 297876 - DNA, 25 bp, Homo sapien
atgccgaatcggactatgatgcctt

SEQ ID NO: 297877 - DNA, 25 bp, Homo sapien
ctggactcgttggtgctgcagatga

SEQ ID NO: 297878 - DNA, 25 bp, Homo sapien
aacacatgaacaatctgctggggct

SEQ ID NO: 297879 - DNA, 25 bp, Homo sapien
tgccaggtacatcccagccaggaca

SEQ ID NO: 297880 - DNA, 25 bp, Homo sapien
tcttcatgggcagctagccaggtgt

SEQ ID NO: 297881 - DNA, 25 bp, Homo sapien
gggcagctagccaggtgtaaccatc

SEQ ID NO: 297882 - DNA, 25 bp, Homo sapien
gctagccaggtgtaaccatcacagt

SEQ ID NO: 297883 - DNA, 25 bp, Homo sapien
gccaggtgtaaccatcacagtaaaa

SEQ ID NO: 297884 - DNA, 25 bp, Homo sapien
gtaaccatcacagtaaaaacagcca

SEQ ID NO: 297885 - DNA, 25 bp, Homo sapien
tagaggaaatcataggtttgtcagt

SEQ ID NO: 297886 - DNA, 25 bp, Homo sapien
gtttctgctttgtgactactgtgag

SEQ ID NO: 297887 - DNA, 25 bp, Homo sapien
ttgtgactactgtgagaagctaaac

SEQ ID NO: 297888 - DNA, 25 bp, Homo sapien
gaagcattacttgtgatatttttag

SEQ ID NO: 297889 - DNA, 25 bp, Homo sapien
ttcactagttctgcgtaacacgaca

SEQ ID NO: 297890 - DNA, 25 bp, Homo sapien
ttctgcgtaacacgacaggttgcct

SEQ ID NO: 297891 - DNA, 25 bp, Homo sapien
gcgtaacacgacaggttgcctaagg

SEQ ID NO: 297892 - DNA, 25 bp, Homo sapien
gaagctcggaagcaaatgcggtcct

SEQ ID NO: 297893 - DNA, 25 bp, Homo sapien
tcggaagcaaatgcggtcctgcgag

SEQ ID NO: 297894 - DNA, 25 bp, Homo sapien
gggctggtagactcactgttgtatg

SEQ ID NO: 297895 - DNA, 25 bp, Homo sapien
gactcactgttgtatgtgatccaca

SEQ ID NO: 297896 - DNA, 25 bp, Homo sapien
tgtatgtgatccacacgtgtgtgaa

SEQ ID NO: 297897 - DNA, 25 bp, Homo sapien
gtgtgtgaacacatccgattacgac

SEQ ID NO: 297898 - DNA, 25 bp, Homo sapien
gaacacatccgattacgacagcaag

SEQ ID NO: 297899 - DNA, 25 bp, Homo sapien
tacgacagcaagacggtggagaact

SEQ ID NO: 297900 - DNA, 25 bp, Homo sapien
ggaatatcctgagccatagaatgca

SEQ ID NO: 297901 - DNA, 25 bp, Homo sapien
ttgtttaaccagcaaaagagcagtg

SEQ ID NO: 297902 - DNA, 25 bp, Homo sapien
gagcagtggtctccattcggttcat

SEQ ID NO: 297903 - DNA, 25 bp, Homo sapien
attcggttcatcagttctcccaacg

SEQ ID NO: 297904 - DNA, 25 bp, Homo sapien
tctcccaacggcttgttagtgtctg

SEQ ID NO: 297905 - DNA, 25 bp, Homo sapien
cagtgcggtgagacagaaagcccag

SEQ ID NO: 297906 - DNA, 25 bp, Homo sapien
gggtgtctggaatcagataggtcca

SEQ ID NO: 297907 - DNA, 25 bp, Homo sapien
ataggtccaggtttgaattctgctc

SEQ ID NO: 297908 - DNA, 25 bp, Homo sapien
gagtggcgacgctaatatttacatg

SEQ ID NO: 297909 - DNA, 25 bp, Homo sapien
gacgctaatatttacatgcctgcca

SEQ ID NO: 297910 - DNA, 25 bp, Homo sapien
atttacatgcctgccaagttggata

SEQ ID NO: 297911 - DNA, 25 bp, Homo sapien
ggttcgctagaattgagcttagatt

SEQ ID NO: 297912 - DNA, 25 bp, Homo sapien
actagaagaatgcttctcttcttga

SEQ ID NO: 297913 - DNA, 25 bp, Homo sapien
tctcttcttgaatgcagtatattgc

SEQ ID NO: 297914 - DNA, 25 bp, Homo sapien
tatattgctgtaggagtatcttcgt

SEQ ID NO: 297915 - DNA, 25 bp, Homo sapien
agtatcttcgttttggtgcctgtga

SEQ ID NO: 297916 - DNA, 25 bp, Homo sapien
tcgttttggtgcctgtgaaacagtt

SEQ ID NO: 297917 - DNA, 25 bp, Homo sapien
gaaaacgagaacaactaatgtctga

SEQ ID NO: 297918 - DNA, 25 bp, Homo sapien
gaaaagcatcatatgtgtgttttta

SEQ ID NO: 297919 - DNA, 25 bp, Homo sapien
gatggctagtatgcatttttggtca

SEQ ID NO: 297920 - DNA, 25 bp, Homo sapien
ttgttttccttaatacgggagagca

SEQ ID NO: 297921 - DNA, 25 bp, Homo sapien
ttttgacagaaaatggttcgctaga

SEQ ID NO: 297922 - DNA, 25 bp, Homo sapien
atctagcatacttagggttctcatt

SEQ ID NO: 297923 - DNA, 25 bp, Homo sapien
gtttcttccctctttgtgactattc

SEQ ID NO: 297924 - DNA, 25 bp, Homo sapien
gtgactattccttagccttatagat

SEQ ID NO: 297925 - DNA, 25 bp, Homo sapien
tatagatttctagtactgcccagga

SEQ ID NO: 297926 - DNA, 25 bp, Homo sapien
agtactgcccaggaaatctaatttc

SEQ ID NO: 297927 - DNA, 25 bp, Homo sapien
tcaatacatttatcctaggtttcat

SEQ ID NO: 297928 - DNA, 25 bp, Homo sapien
taacgtattatctttttcaaaccag

SEQ ID NO: 297929 - DNA, 25 bp, Homo sapien
tttttcaaaccagatttatgtgcaa

SEQ ID NO: 297930 - DNA, 25 bp, Homo sapien
catgtaactgttactaagcagtcta

SEQ ID NO: 297931 - DNA, 25 bp, Homo sapien
agcagtctataaagttgtcatttac

SEQ ID NO: 297932 - DNA, 25 bp, Homo sapien
tgtcatttacaattactgattcaat

SEQ ID NO: 297933 - DNA, 25 bp, Homo sapien
gaattcaacgaaggatcagtatcaa

SEQ ID NO: 297934 - DNA, 25 bp, Homo sapien
gaaagccctggatgccaaaattgca

SEQ ID NO: 297935 - DNA, 25 bp, Homo sapien
aagatacaaggctccatttcatcag

SEQ ID NO: 297936 - DNA, 25 bp, Homo sapien
tccatttcatcagttgcgcattcag

SEQ ID NO: 297937 - DNA, 25 bp, Homo sapien
ttgcgcattcagtatggaaccagca

SEQ ID NO: 297938 - DNA, 25 bp, Homo sapien
gattcttgatttgtatgttacacaa

SEQ ID NO: 297939 - DNA, 25 bp, Homo sapien
gacagtgtgtacgaaatgctcccca

SEQ ID NO: 297940 - DNA, 25 bp, Homo sapien
aatgctccccagtttagatttgact

SEQ ID NO: 297941 - DNA, 25 bp, Homo sapien
actggtttatcaagtctaggactgc

SEQ ID NO: 297942 - DNA, 25 bp, Homo sapien
gtctaggactgccatggaattccag

SEQ ID NO: 297943 - DNA, 25 bp, Homo sapien
gaattccagagacgctgtaacactc

SEQ ID NO: 297944 - DNA, 25 bp, Homo sapien
aaccagcaaaggaaagaactatact

SEQ ID NO: 297945 - DNA, 25 bp, Homo sapien
agcaaaggaaagaactatactgagg

SEQ ID NO: 297946 - DNA, 25 bp, Homo sapien
gattcttgatttgtatgttacacaa

SEQ ID NO: 297947 - DNA, 25 bp, Homo sapien
attcttgatttgtatgttacacaaa

SEQ ID NO: 297948 - DNA, 25 bp, Homo sapien
ttcttgatttgtatgttacacaaaa

SEQ ID NO: 297949 - DNA, 25 bp, Homo sapien
cttgatttgtatgttacacaaaatg

SEQ ID NO: 297950 - DNA, 25 bp, Homo sapien
aaatgctccccagtttagatttgac

SEQ ID NO: 297951 - DNA, 25 bp, Homo sapien
aatgctccccagtttagatttgact

SEQ ID NO: 297952 - DNA, 25 bp, Homo sapien
atgctccccagtttagatttgactg

SEQ ID NO: 297953 - DNA, 25 bp, Homo sapien
tgctccccagtttagatttgactgg

SEQ ID NO: 297954 - DNA, 25 bp, Homo sapien
gctccccagtttagatttgactggt

SEQ ID NO: 297955 - DNA, 25 bp, Homo sapien
tcaaagctgttgtgggctctgggtt

SEQ ID NO: 297956 - DNA, 25 bp, Homo sapien
ggacaagcttgagctaggagaaact

SEQ ID NO: 297957 - DNA, 25 bp, Homo sapien
ggagaaactatccaaagaattccta

SEQ ID NO: 297958 - DNA, 25 bp, Homo sapien
agaattcctaacctttatcctgtct

SEQ ID NO: 297959 - DNA, 25 bp, Homo sapien
ctttatcctgtctctagtagcttta

SEQ ID NO: 297960 - DNA, 25 bp, Homo sapien
gtagctttaactggtacagcttgtt

SEQ ID NO: 297961 - DNA, 25 bp, Homo sapien
ggtacagcttgttttctgaaagtct

SEQ ID NO: 297962 - DNA, 25 bp, Homo sapien
tttctgaaagtcttaattttctgct

SEQ ID NO: 297963 - DNA, 25 bp, Homo sapien
gcttttattcaagaaggttacttca

SEQ ID NO: 297964 - DNA, 25 bp, Homo sapien
gggtgacacaaaatacgctaaggat

SEQ ID NO: 297965 - DNA, 25 bp, Homo sapien
cgctaaggatagctgatgagctcaa

SEQ ID NO: 297966 - DNA, 25 bp, Homo sapien
aggctgctttccaccagcgatggag

SEQ ID NO: 297967 - DNA, 25 bp, Homo sapien
cggttactgtggtgcccatgaaaat

SEQ ID NO: 297968 - DNA, 25 bp, Homo sapien
gacagtactgctgcaagtggatcgt

SEQ ID NO: 297969 - DNA, 25 bp, Homo sapien
gctgcaagtggatcgtgggactcct

SEQ ID NO: 297970 - DNA, 25 bp, Homo sapien
atcgtgggactcctccagtaggtga

SEQ ID NO: 297971 - DNA, 25 bp, Homo sapien
cagtaggtgactgtggctcgagaac

SEQ ID NO: 297972 - DNA, 25 bp, Homo sapien
tggcctgggcaagcctttctcagaa

SEQ ID NO: 297973 - DNA, 25 bp, Homo sapien
cctttctcagaactgctctgaagtc

SEQ ID NO: 297974 - DNA, 25 bp, Homo sapien
ctgctctgaagtctgaggcccatcc

SEQ ID NO: 297975 - DNA, 25 bp, Homo sapien
agatgtcacacctgtactgtggtct

SEQ ID NO: 297976 - DNA, 25 bp, Homo sapien
agacctgctgcggagcggatttgac

SEQ ID NO: 297977 - DNA, 25 bp, Homo sapien
gaactataaaggaactgttttcagt

SEQ ID NO: 297978 - DNA, 25 bp, Homo sapien
tgttttcagtactacctttaaagct

SEQ ID NO: 297979 - DNA, 25 bp, Homo sapien
tttaaagctcttttgtacacatctg

SEQ ID NO: 297980 - DNA, 25 bp, Homo sapien
aagctcttttgtacacatctgctgc

SEQ ID NO: 297981 - DNA, 25 bp, Homo sapien
gctcttttgtacacatctgctgcac

SEQ ID NO: 297982 - DNA, 25 bp, Homo sapien
acatctgctgcacacagcagcacat

SEQ ID NO: 297983 - DNA, 25 bp, Homo sapien
cccaagagtttgagagttaagccac

SEQ ID NO: 297984 - DNA, 25 bp, Homo sapien
gagtttgagagttaagccacacagc

SEQ ID NO: 297985 - DNA, 25 bp, Homo sapien
tttgagagttaagccacacagcaag

SEQ ID NO: 297986 - DNA, 25 bp, Homo sapien
aagacaacccagtagaagaaatgca

SEQ ID NO: 297987 - DNA, 25 bp, Homo sapien
gaagaaatgcaaacgattaagggaa

SEQ ID NO: 297988 - DNA, 25 bp, Homo sapien
gaatgcatctgctatttatacatct

SEQ ID NO: 297989 - DNA, 25 bp, Homo sapien
gcatctgctatttatacatctgcaa

SEQ ID NO: 297990 - DNA, 25 bp, Homo sapien
gctatttatacatctgcaagtgggt

SEQ ID NO: 297991 - DNA, 25 bp, Homo sapien
atacatctgcaagtgggtatgtcat

SEQ ID NO: 297992 - DNA, 25 bp, Homo sapien
atctgcaagtgggtatgtcataagg

SEQ ID NO: 297993 - DNA, 25 bp, Homo sapien
caagtgggtatgtcataaggagtca

SEQ ID NO: 297994 - DNA, 25 bp, Homo sapien
ggagtcagattatctttaatttaaa

SEQ ID NO: 297995 - DNA, 25 bp, Homo sapien
atgttttcaagagttatagcaaatt

SEQ ID NO: 297996 - DNA, 25 bp, Homo sapien
acaactgatgtaaatggtagtttca

SEQ ID NO: 297997 - DNA, 25 bp, Homo sapien
aatggtagtttcagtttttgtgaga

SEQ ID NO: 297998 - DNA, 25 bp, Homo sapien
gtagtttcagtttttgtgagattta

SEQ ID NO: 297999 - DNA, 25 bp, Homo sapien
caagaagcttccttgcctgagatca

SEQ ID NO: 298000 - DNA, 25 bp, Homo sapien
agaaaggaaccctcagagccggcaa

SEQ ID NO: 298001 - DNA, 25 bp, Homo sapien
ggcaactgaatcttggtccctgtga

SEQ ID NO: 298002 - DNA, 25 bp, Homo sapien
ggtccctgtgatgtcaagcccattg

SEQ ID NO: 298003 - DNA, 25 bp, Homo sapien
cactgcagaacatggcctctagatt

SEQ ID NO: 298004 - DNA, 25 bp, Homo sapien
gcctctagattaatgccaccgattc

SEQ ID NO: 298005 - DNA, 25 bp, Homo sapien
taatgccaccgattcaggaacacct

SEQ ID NO: 298006 - DNA, 25 bp, Homo sapien
ggaacacctccgacagtcttgaaat

SEQ ID NO: 298007 - DNA, 25 bp, Homo sapien
tggcttcttctattacagtctcttc

SEQ ID NO: 298008 - DNA, 25 bp, Homo sapien
tacagtctcttcattggaagctctg

SEQ ID NO: 298009 - DNA, 25 bp, Homo sapien
ggaagctctgtaggccaaggccaga

SEQ ID NO: 298010 - DNA, 25 bp, Homo sapien
gaggagatcgaacaggcacccacat

SEQ ID NO: 298011 - DNA, 25 bp, Homo sapien
ggcacccacatgtctcgggcaaaaa

SEQ ID NO: 298012 - DNA, 25 bp, Homo sapien
gtctcgggcaaaaatcacatctgaa

SEQ ID NO: 298013 - DNA, 25 bp, Homo sapien
aatcacatctgaacttgctaaagtt

SEQ ID NO: 298014 - DNA, 25 bp, Homo sapien
tattatgaacaggatctatggatgg

SEQ ID NO: 298015 - DNA, 25 bp, Homo sapien
cataaaggtaattgtttctggccaa

SEQ ID NO: 298016 - DNA, 25 bp, Homo sapien
ggtaattgtttctggccaacatctt

SEQ ID NO: 298017 - DNA, 25 bp, Homo sapien
ggccaacatctttctactgatgctt

SEQ ID NO: 298018 - DNA, 25 bp, Homo sapien
acatctttctactgatgctttgttt

SEQ ID NO: 298019 - DNA, 25 bp, Homo sapien
gtatgttgctgtttatattttctca

SEQ ID NO: 298020 - DNA, 25 bp, Homo sapien
tattttctcaaacttgaggctctat

SEQ ID NO: 298021 - DNA, 25 bp, Homo sapien
gaaggacaattgaaaccacttacca

SEQ ID NO: 298022 - DNA, 25 bp, Homo sapien
ttctatcttccatttggcataagcg

SEQ ID NO: 298023 - DNA, 25 bp, Homo sapien
cttccatttggcataagcgtttcga

SEQ ID NO: 298024 - DNA, 25 bp, Homo sapien
catttggcataagcgtttcgatgtt

SEQ ID NO: 298025 - DNA, 25 bp, Homo sapien
gcataagcgtttcgatgtttgtttt

SEQ ID NO: 298026 - DNA, 25 bp, Homo sapien
gaaatatacaaatcacgcaagacag

SEQ ID NO: 298027 - DNA, 25 bp, Homo sapien
caaatcacgcaagacagaaatatgt

SEQ ID NO: 298028 - DNA, 25 bp, Homo sapien
cataatatctgaatgacatgtagaa

SEQ ID NO: 298029 - DNA, 25 bp, Homo sapien
gctaggattgttaaactcaactctc

SEQ ID NO: 298030 - DNA, 25 bp, Homo sapien
tgagtcactaaaaaggaacaatctg

SEQ ID NO: 298031 - DNA, 25 bp, Homo sapien
aaaggaacaatctgatttagcaaat

SEQ ID NO: 298032 - DNA, 25 bp, Homo sapien
ggggaggggagatctatccacatac

SEQ ID NO: 298033 - DNA, 25 bp, Homo sapien
tatccacatacctcaggtaacaggg

SEQ ID NO: 298034 - DNA, 25 bp, Homo sapien
ccacatacctcaggtaacagggagg

SEQ ID NO: 298035 - DNA, 25 bp, Homo sapien
tcaggtaacagggaggtgcgcgggt

SEQ ID NO: 298036 - DNA, 25 bp, Homo sapien
gagggctgggcggaccaaaggccgg

SEQ ID NO: 298037 - DNA, 25 bp, Homo sapien
gggctgggcggaccaaaggccggag

SEQ ID NO: 298038 - DNA, 25 bp, Homo sapien
gctgggcggaccaaaggccggaggg

SEQ ID NO: 298039 - DNA, 25 bp, Homo sapien
gggatagcgagaggcttgagaatgg

SEQ ID NO: 298040 - DNA, 25 bp, Homo sapien
cgggtctgtacaatacggtttgcta

SEQ ID NO: 298041 - DNA, 25 bp, Homo sapien
ggtctgtacaatacggtttgctata

SEQ ID NO: 298042 - DNA, 25 bp, Homo sapien
ctgtacaatacggtttgctataaaa

SEQ ID NO: 298043 - DNA, 25 bp, Homo sapien
tgtgaaaaaacatcgtggaggagat

SEQ ID NO: 298044 - DNA, 25 bp, Homo sapien
gaggagatcgaacaggcacccacat

SEQ ID NO: 298045 - DNA, 25 bp, Homo sapien
agatcgaacaggcacccacatgtct

SEQ ID NO: 298046 - DNA, 25 bp, Homo sapien
aggcacccacatgtctcgggcaaaa

SEQ ID NO: 298047 - DNA, 25 bp, Homo sapien
gcacccacatgtctcgggcaaaaat

SEQ ID NO: 298048 - DNA, 25 bp, Homo sapien
gtctcgggcaaaaatcacatctgaa

SEQ ID NO: 298049 - DNA, 25 bp, Homo sapien
cgggcaaaaatcacatctgaacttg

SEQ ID NO: 298050 - DNA, 25 bp, Homo sapien
aatcacatctgaacttgctaaagtt

SEQ ID NO: 298051 - DNA, 25 bp, Homo sapien
gaacttgctaaagttatcaatgatg

SEQ ID NO: 298052 - DNA, 25 bp, Homo sapien
aatgatggcttatattattatgaac

SEQ ID NO: 298053 - DNA, 25 bp, Homo sapien
tattatgaacaggatctatggatgg

SEQ ID NO: 298054 - DNA, 25 bp, Homo sapien
gcaggtgtgcaagattcactctgaa

SEQ ID NO: 298055 - DNA, 25 bp, Homo sapien
gtgtgcaagattcactctgaagtgg

SEQ ID NO: 298056 - DNA, 25 bp, Homo sapien
tcactctgaagtggtggaggacacc

SEQ ID NO: 298057 - DNA, 25 bp, Homo sapien
acaccgaggctgtgagcgctgtgca

SEQ ID NO: 298058 - DNA, 25 bp, Homo sapien
aggctgtgagcgctgtgcagcagct

SEQ ID NO: 298059 - DNA, 25 bp, Homo sapien
gagcgtatgctggtggagcctgcct

SEQ ID NO: 298060 - DNA, 25 bp, Homo sapien
gggcagccttagcagccatctactc

SEQ ID NO: 298061 - DNA, 25 bp, Homo sapien
agccttagcagccatctactcaggc

SEQ ID NO: 298062 - DNA, 25 bp, Homo sapien
atctactcaggcctcctgcggaggc

SEQ ID NO: 298063 - DNA, 25 bp, Homo sapien
caccaatgcttcaatgcggccatca

SEQ ID NO: 298064 - DNA, 25 bp, Homo sapien
caatgcttcaatgcggccatcacag

SEQ ID NO: 298065 - DNA, 25 bp, Homo sapien
gggtcctgctcaacagcagagaggc

SEQ ID NO: 298066 - DNA, 25 bp, Homo sapien
tcaacagcagagaggccgtggttcc

SEQ ID NO: 298067 - DNA, 25 bp, Homo sapien
agaggccgtggttcccgtggatctc

SEQ ID NO: 298068 - DNA, 25 bp, Homo sapien
agcctgattccaagcgtcgtcagac

SEQ ID NO: 298069 - DNA, 25 bp, Homo sapien
attccaagcgtcgtcagaccaacaa

SEQ ID NO: 298070 - DNA, 25 bp, Homo sapien
gtcgtcagaccaacaaccaacagaa

SEQ ID NO: 298071 - DNA, 25 bp, Homo sapien
tcagcagccgcttcagcaaggtggt

SEQ ID NO: 298072 - DNA, 25 bp, Homo sapien
gcagccgcttcagcaaggtggtgac

SEQ ID NO: 298073 - DNA, 25 bp, Homo sapien
gcaaggtggtgactattctggtaac

SEQ ID NO: 298074 - DNA, 25 bp, Homo sapien
gttacaataatgacaaccaggaatt

SEQ ID NO: 298075 - DNA, 25 bp, Homo sapien
atgacaaccaggaattttatcagga

SEQ ID NO: 298076 - DNA, 25 bp, Homo sapien
ggaaaggtgccctggttctgtttct

SEQ ID NO: 298077 - DNA, 25 bp, Homo sapien
ggctgtggtgccagactggaaacta

SEQ ID NO: 298078 - DNA, 25 bp, Homo sapien
actaccagtttcctgggcatgtgcc

SEQ ID NO: 298079 - DNA, 25 bp, Homo sapien
gggcatgtgccttggtgtcaccgaa

SEQ ID NO: 298080 - DNA, 25 bp, Homo sapien
ttggtgtcaccgaacagccagatga

SEQ ID NO: 298081 - DNA, 25 bp, Homo sapien
aacagccagatgagacttgtcacca

SEQ ID NO: 298082 - DNA, 25 bp, Homo sapien
atagggaaacaagccacatctctgc

SEQ ID NO: 298083 - DNA, 25 bp, Homo sapien
tgcttcctgatgatacctgcccatc

SEQ ID NO: 298084 - DNA, 25 bp, Homo sapien
atgatacctgcccatccctgttttt

SEQ ID NO: 298085 - DNA, 25 bp, Homo sapien
catccctgttttttctccataaact

SEQ ID NO: 298086 - DNA, 25 bp, Homo sapien
tttttctccataaacttgctgggaa

SEQ ID NO: 298087 - DNA, 25 bp, Homo sapien
atacaaatgccagtaccttgccgag

SEQ ID NO: 298088 - DNA, 25 bp, Homo sapien
accttgccgagacttgttcactgat

SEQ ID NO: 298089 - DNA, 25 bp, Homo sapien
aaccccaaggtaatggtcatctact

SEQ ID NO: 298090 - DNA, 25 bp, Homo sapien
ggtcatctactttgcaacctatgga

SEQ ID NO: 298091 - DNA, 25 bp, Homo sapien
gcaacctatggagatcctgatagct

SEQ ID NO: 298092 - DNA, 25 bp, Homo sapien
gatcctgatagctcccatacaaagt

SEQ ID NO: 298093 - DNA, 25 bp, Homo sapien
gaggtacactgttgccaatttggag

SEQ ID NO: 298094 - DNA, 25 bp, Homo sapien
ggcaggaagccatcaaactaaacgt

SEQ ID NO: 298095 - DNA, 25 bp, Homo sapien
ttcagatgaacacctatcgatattc

SEQ ID NO: 298096 - DNA, 25 bp, Homo sapien
taattccagggacattagaccttgg

SEQ ID NO: 298097 - DNA, 25 bp, Homo sapien
gacattagaccttggtgaaatgcca

SEQ ID NO: 298098 - DNA, 25 bp, Homo sapien
atgatatcctattcttctaccttgt

SEQ ID NO: 298099 - DNA, 25 bp, Homo sapien
atatcctattcttctaccttgttgc

SEQ ID NO: 298100 - DNA, 25 bp, Homo sapien
attcttctaccttgttgcctggtaa

SEQ ID NO: 298101 - DNA, 25 bp, Homo sapien
ttctaccttgttgcctggtaacttt

SEQ ID NO: 298102 - DNA, 25 bp, Homo sapien
gcctggtaactttttctgaggactg

SEQ ID NO: 298103 - DNA, 25 bp, Homo sapien
ggtaactttttctgaggactgagtt

SEQ ID NO: 298104 - DNA, 25 bp, Homo sapien
gactgagtttctgcagcgatgtggt

SEQ ID NO: 298105 - DNA, 25 bp, Homo sapien
agtttctgcagcgatgtggtgcact

SEQ ID NO: 298106 - DNA, 25 bp, Homo sapien
ttctgcagcgatgtggtgcactctt

SEQ ID NO: 298107 - DNA, 25 bp, Homo sapien
cagcgatgtggtgcactcttcctgt

SEQ ID NO: 298108 - DNA, 25 bp, Homo sapien
tgtgatgaggaaacatctgggcccc

SEQ ID NO: 298109 - DNA, 25 bp, Homo sapien
aagactcataatgtccgtaaatcaa

SEQ ID NO: 298110 - DNA, 25 bp, Homo sapien
accatttgataaggaggctcacagc

SEQ ID NO: 298111 - DNA, 25 bp, Homo sapien
tcacagctcctcacaatactgagac

SEQ ID NO: 298112 - DNA, 25 bp, Homo sapien
caatactgagactgactcctgagag

SEQ ID NO: 298113 - DNA, 25 bp, Homo sapien
gagaatatcctcaacgtcatcctca

SEQ ID NO: 298114 - DNA, 25 bp, Homo sapien
ctggttgaacaaaaccgatgcctga

SEQ ID NO: 298115 - DNA, 25 bp, Homo sapien
aaaaccgatgcctgattgaatgaaa

SEQ ID NO: 298116 - DNA, 25 bp, Homo sapien
gaaaacaattctatgaggcaccaag

SEQ ID NO: 298117 - DNA, 25 bp, Homo sapien
gaggcaccaagacaatatgattcaa

SEQ ID NO: 298118 - DNA, 25 bp, Homo sapien
tatgattcaagtatgcagctctatg

SEQ ID NO: 298119 - DNA, 25 bp, Homo sapien
tgcagctctatgatggtctatttct

SEQ ID NO: 298120 - DNA, 25 bp, Homo sapien
ttctttggtgattgcttttgataac

SEQ ID NO: 298121 - DNA, 25 bp, Homo sapien
gcttttgataacactgagtggctaa

SEQ ID NO: 298122 - DNA, 25 bp, Homo sapien
cactgagtggctaaaggtcttcttt

SEQ ID NO: 298123 - DNA, 25 bp, Homo sapien
tcctgaaggcaaggtctctggaatt

SEQ ID NO: 298124 - DNA, 25 bp, Homo sapien
aaatgaagagtctgcactgcttatc

SEQ ID NO: 298125 - DNA, 25 bp, Homo sapien
gagtctgcactgcttatcagttgac

SEQ ID NO: 298126 - DNA, 25 bp, Homo sapien
gcactgcttatcagttgacccaaca

SEQ ID NO: 298127 - DNA, 25 bp, Homo sapien
ttgacccaacactcagtccacattg

SEQ ID NO: 298128 - DNA, 25 bp, Homo sapien
tgtccagtaaagagaccgtacggta

SEQ ID NO: 298129 - DNA, 25 bp, Homo sapien
acgtcccaacacaatgccagatgca

SEQ ID NO: 298130 - DNA, 25 bp, Homo sapien
gccagatgcaaaaacttctttggtg

SEQ ID NO: 298131 - DNA, 25 bp, Homo sapien
tagtcctgccccatgatttctccaa

SEQ ID NO: 298132 - DNA, 25 bp, Homo sapien
ccttatttccaagtgttccagcctg

SEQ ID NO: 298133 - DNA, 25 bp, Homo sapien
tatttccaagtgttccagcctggac

SEQ ID NO: 298134 - DNA, 25 bp, Homo sapien
tttccaagtgttccagcctggacgc

SEQ ID NO: 298135 - DNA, 25 bp, Homo sapien
aagtgttccagcctggacgcttccc

SEQ ID NO: 298136 - DNA, 25 bp, Homo sapien
ggcccctaagcctggaagcagttgg

SEQ ID NO: 298137 - DNA, 25 bp, Homo sapien
gaagcagttggttagggctgaacaa

SEQ ID NO: 298138 - DNA, 25 bp, Homo sapien
aacaagacagagacggtgaccccaa

SEQ ID NO: 298139 - DNA, 25 bp, Homo sapien
agacagagacggtgaccccaagtgg

SEQ ID NO: 298140 - DNA, 25 bp, Homo sapien
acatctgctaaagctgcaggagcct

SEQ ID NO: 298141 - DNA, 25 bp, Homo sapien
gcaggaacagctgggccatgctgca

SEQ ID NO: 298142 - DNA, 25 bp, Homo sapien
aaagagactcgagcacaaggtgtgt

SEQ ID NO: 298143 - DNA, 25 bp, Homo sapien
actcgagcacaaggtgtgtcccttc

SEQ ID NO: 298144 - DNA, 25 bp, Homo sapien
tttcactgggaggaaataccatgca

SEQ ID NO: 298145 - DNA, 25 bp, Homo sapien
tttttaagtctgtttcacgctccca

SEQ ID NO: 298146 - DNA, 25 bp, Homo sapien
gggctaatcggttctttcaatccta

SEQ ID NO: 298147 - DNA, 25 bp, Homo sapien
ggttctttcaatcctaaagcaacag

SEQ ID NO: 298148 - DNA, 25 bp, Homo sapien
aaaagacttaagacttggcagcagg

SEQ ID NO: 298149 - DNA, 25 bp, Homo sapien
gacttggcagcaggtccgactgtgc

SEQ ID NO: 298150 - DNA, 25 bp, Homo sapien
ccgactgtgccctttcaggatagga

SEQ ID NO: 298151 - DNA, 25 bp, Homo sapien
gtgccctttcaggataggaactgct

SEQ ID NO: 298152 - DNA, 25 bp, Homo sapien
caggataggaactgctcaggtgtgt

SEQ ID NO: 298153 - DNA, 25 bp, Homo sapien
tacagtcatggtggacaaggtcctc

SEQ ID NO: 298154 - DNA, 25 bp, Homo sapien
aaggtcctccagaaggcatgaacca

SEQ ID NO: 298155 - DNA, 25 bp, Homo sapien
tgaaccagcaatattaccctgatgg

SEQ ID NO: 298156 - DNA, 25 bp, Homo sapien
ggaaattcacagtatggccaacagc

SEQ ID NO: 298157 - DNA, 25 bp, Homo sapien
cagtatggccaacagcaagatgcat

SEQ ID NO: 298158 - DNA, 25 bp, Homo sapien
acaacagggatatccaccccagcag

SEQ ID NO: 298159 - DNA, 25 bp, Homo sapien
cagcagtacccagggcagcaaggtt

SEQ ID NO: 298160 - DNA, 25 bp, Homo sapien
gcaaggttacccaggacagcagcag

SEQ ID NO: 298161 - DNA, 25 bp, Homo sapien
gcagcagggctacggtccttcacag

SEQ ID NO: 298162 - DNA, 25 bp, Homo sapien
tacggtccttcacagggtggtccag

SEQ ID NO: 298163 - DNA, 25 bp, Homo sapien
acccacagggacaaggtcagcagta

SEQ ID NO: 298164 - DNA, 25 bp, Homo sapien
ccagtggctcattaagacagtacaa

SEQ ID NO: 298165 - DNA, 25 bp, Homo sapien
gacagtacaagagacaaatgcgaca

SEQ ID NO: 298166 - DNA, 25 bp, Homo sapien
aaatgcgacaaaacgtcaactggtg

SEQ ID NO: 298167 - DNA, 25 bp, Homo sapien
aaaacgtcaactggtgaacattcac

SEQ ID NO: 298168 - DNA, 25 bp, Homo sapien
gaacattcacaggattactaaacac

SEQ ID NO: 298169 - DNA, 25 bp, Homo sapien
ctgcagaaattctctaacaggattt

SEQ ID NO: 298170 - DNA, 25 bp, Homo sapien
aataaaggtttaggctattcacaga

SEQ ID NO: 298171 - DNA, 25 bp, Homo sapien
tattcacagaaaagcccagtgttat

SEQ ID NO: 298172 - DNA, 25 bp, Homo sapien
agaaaagcccagtgttatgttactt

SEQ ID NO: 298173 - DNA, 25 bp, Homo sapien
gtgttatgttactttcattgcatag

SEQ ID NO: 298174 - DNA, 25 bp, Homo sapien
aggcatgactacttggacatgtcaa

SEQ ID NO: 298175 - DNA, 25 bp, Homo sapien
tattcatctggttccaggtatcaga

SEQ ID NO: 298176 - DNA, 25 bp, Homo sapien
gttccaggtatcagagtgctccatc

SEQ ID NO: 298177 - DNA, 25 bp, Homo sapien
gagtgctccatctcaggcaccagga

SEQ ID NO: 298178 - DNA, 25 bp, Homo sapien
gaaagaggccagactcactctgcag

SEQ ID NO: 298179 - DNA, 25 bp, Homo sapien
gactcactctgcagggaccaatgga

SEQ ID NO: 298180 - DNA, 25 bp, Homo sapien
ctcccacgccttcattcaaaaaggg

SEQ ID NO: 298181 - DNA, 25 bp, Homo sapien
aggacctctcagactgaagccgtga

SEQ ID NO: 298182 - DNA, 25 bp, Homo sapien
actgaagccgtgaactcttgagaga

SEQ ID NO: 298183 - DNA, 25 bp, Homo sapien
tcttgagagaaaatccagttggcct

SEQ ID NO: 298184 - DNA, 25 bp, Homo sapien
tcctctatccacacaattcaacttg

SEQ ID NO: 298185 - DNA, 25 bp, Homo sapien
attcaacttgataactggactttag

SEQ ID NO: 298186 - DNA, 25 bp, Homo sapien
tccctaccttggtgaactggaagta

SEQ ID NO: 298187 - DNA, 25 bp, Homo sapien
tgcttcccagccatctggaagagag

SEQ ID NO: 298188 - DNA, 25 bp, Homo sapien
agagcttcccctcagagagctggga

SEQ ID NO: 298189 - DNA, 25 bp, Homo sapien
gctgggatgttgtcagcaggcatca

SEQ ID NO: 298190 - DNA, 25 bp, Homo sapien
ttgtcagcaggcatcagacagagca

SEQ ID NO: 298191 - DNA, 25 bp, Homo sapien
gacagagcaaaaagccatttttctt

SEQ ID NO: 298192 - DNA, 25 bp, Homo sapien
ttttctttattctattcctgataca

SEQ ID NO: 298193 - DNA, 25 bp, Homo sapien
attcctgatacaaagcaactgagat

SEQ ID NO: 298194 - DNA, 25 bp, Homo sapien
gagatatgcgtttctctttggaatt

SEQ ID NO: 298195 - DNA, 25 bp, Homo sapien
aatggagcttttgcggtgatggaca

SEQ ID NO: 298196 - DNA, 25 bp, Homo sapien
atccatcttgacaggtgtagacaca

SEQ ID NO: 298197 - DNA, 25 bp, Homo sapien
acatccgaggtaccacaaccggtga

SEQ ID NO: 298198 - DNA, 25 bp, Homo sapien
acaaccggtgactgctgagctgaac

SEQ ID NO: 298199 - DNA, 25 bp, Homo sapien
gggaaatgtgcctcaaatacttatt

SEQ ID NO: 298200 - DNA, 25 bp, Homo sapien
attaacccctggtacaggaggcctg

SEQ ID NO: 298201 - DNA, 25 bp, Homo sapien
gattattcctagatcctctgtgact

SEQ ID NO: 298202 - DNA, 25 bp, Homo sapien
gtgacttctctgaccatgtcacaca

SEQ ID NO: 298203 - DNA, 25 bp, Homo sapien
tgtcacacactaaccttcccagtga

SEQ ID NO: 298204 - DNA, 25 bp, Homo sapien
ttcccagtgaaccttctgctctgag

SEQ ID NO: 298205 - DNA, 25 bp, Homo sapien
aaatgtctgcagaatgcccaccagg

SEQ ID NO: 298206 - DNA, 25 bp, Homo sapien
gcagaatgcccaccaggcatggtat

SEQ ID NO: 298207 - DNA, 25 bp, Homo sapien
gcatggtattacagcagagatcccc

SEQ ID NO: 298208 - DNA, 25 bp, Homo sapien
gcctggccttccatatatcaagcag

SEQ ID NO: 298209 - DNA, 25 bp, Homo sapien
cagagttttatcaccttatgcaggg

SEQ ID NO: 298210 - DNA, 25 bp, Homo sapien
tgccacctgccataaagttgatagg

SEQ ID NO: 298211 - DNA, 25 bp, Homo sapien
taatgacattttgtggatattgcca

SEQ ID NO: 298212 - DNA, 25 bp, Homo sapien
gatattgccatgtcacaagtccagg

SEQ ID NO: 298213 - DNA, 25 bp, Homo sapien
gccatgtcacaagtccaggacagca

SEQ ID NO: 298214 - DNA, 25 bp, Homo sapien
aggacagcatcaaaaatagccctga

SEQ ID NO: 298215 - DNA, 25 bp, Homo sapien
atagccctgatgtctaaaccacttc

SEQ ID NO: 298216 - DNA, 25 bp, Homo sapien
tgtctaaaccacttcagctatcttt

SEQ ID NO: 298217 - DNA, 25 bp, Homo sapien
aaccacttcagctatcttttttatt

SEQ ID NO: 298218 - DNA, 25 bp, Homo sapien
tttatttctccccatatttcactct

SEQ ID NO: 298219 - DNA, 25 bp, Homo sapien
cttggtggcagcagttggattcaga

SEQ ID NO: 298220 - DNA, 25 bp, Homo sapien
cagttggattcagagcttgggcatc

SEQ ID NO: 298221 - DNA, 25 bp, Homo sapien
agagcttgggcatcctgatcatcag

SEQ ID NO: 298222 - DNA, 25 bp, Homo sapien
gatcatcaggacagacatttacagg

SEQ ID NO: 298223 - DNA, 25 bp, Homo sapien
ggatatgtatagaattactgcccca

SEQ ID NO: 298224 - DNA, 25 bp, Homo sapien
gtatagaattactgccccaaataga

SEQ ID NO: 298225 - DNA, 25 bp, Homo sapien
atagagggcaaagcactagacagaa

SEQ ID NO: 298226 - DNA, 25 bp, Homo sapien
cactagacagaagggtgagatccaa

SEQ ID NO: 298227 - DNA, 25 bp, Homo sapien
gggaatttggaatctatatttcatc

SEQ ID NO: 298228 - DNA, 25 bp, Homo sapien
tatttcatcagaatgcactcaaagc

SEQ ID NO: 298229 - DNA, 25 bp, Homo sapien
aacagtaagtatgctccatataaag

SEQ ID NO: 298230 - DNA, 25 bp, Homo sapien
gtaattccacttaattggtatacag

SEQ ID NO: 298231 - DNA, 25 bp, Homo sapien
atggaaaactgagggcaatctaact

SEQ ID NO: 298232 - DNA, 25 bp, Homo sapien
aaactgagggcaatctaactataag

SEQ ID NO: 298233 - DNA, 25 bp, Homo sapien
gggcaatctaactataagtcaatac

SEQ ID NO: 298234 - DNA, 25 bp, Homo sapien
gtcaatacataatccatactctgaa

SEQ ID NO: 298235 - DNA, 25 bp, Homo sapien
tccatactctgaaatacaagtcatt

SEQ ID NO: 298236 - DNA, 25 bp, Homo sapien
ggtgttgtcatgtattagtggaaga

SEQ ID NO: 298237 - DNA, 25 bp, Homo sapien
gtggaagagcacactgttcaaattt

SEQ ID NO: 298238 - DNA, 25 bp, Homo sapien
gagcacactgttcaaattttggagc

SEQ ID NO: 298239 - DNA, 25 bp, Homo sapien
cactgttcaaattttggagcagcat

SEQ ID NO: 298240 - DNA, 25 bp, Homo sapien
aaattttggagcagcataaattggc

SEQ ID NO: 298241 - DNA, 25 bp, Homo sapien
ctttacgtccttgaatattctagat

SEQ ID NO: 298242 - DNA, 25 bp, Homo sapien
agatatttactccttcaagaagtca

SEQ ID NO: 298243 - DNA, 25 bp, Homo sapien
caggagtatatccaggcctacctat

SEQ ID NO: 298244 - DNA, 25 bp, Homo sapien
tccccattaaccctcatttttcagt

SEQ ID NO: 298245 - DNA, 25 bp, Homo sapien
cagtctatagtatctgttcactcat

SEQ ID NO: 298246 - DNA, 25 bp, Homo sapien
tcactcattgctctatcacatctga

SEQ ID NO: 298247 - DNA, 25 bp, Homo sapien
acatctgagtttctccgtctttctt

SEQ ID NO: 298248 - DNA, 25 bp, Homo sapien
ccgtctttctttccactagattgta

SEQ ID NO: 298249 - DNA, 25 bp, Homo sapien
ctccttaagggcaaggtcggcatat

SEQ ID NO: 298250 - DNA, 25 bp, Homo sapien
agcaaagttctgtaaacaccgtgaa

SEQ ID NO: 298251 - DNA, 25 bp, Homo sapien
caccgtgaaggtaccatgagttcta

SEQ ID NO: 298252 - DNA, 25 bp, Homo sapien
gcggcccgagcaagaaggacttgct

SEQ ID NO: 298253 - DNA, 25 bp, Homo sapien
aggacttgctggagactatagagac

SEQ ID NO: 298254 - DNA, 25 bp, Homo sapien
gagactatagagacccagaagaagc

SEQ ID NO: 298255 - DNA, 25 bp, Homo sapien
aagcagcttctccagtaccaggcac

SEQ ID NO: 298256 - DNA, 25 bp, Homo sapien
ccagtaccaggcacggctcaaggat

SEQ ID NO: 298257 - DNA, 25 bp, Homo sapien
ctataaaagcctgctgaaggagaaa

SEQ ID NO: 298258 - DNA, 25 bp, Homo sapien
aagaggcattagaggccagcatcaa

SEQ ID NO: 298259 - DNA, 25 bp, Homo sapien
gcatcaaggtgctgtcggtatccca

SEQ ID NO: 298260 - DNA, 25 bp, Homo sapien
tgtcggtatcccacgaggcagatgt

SEQ ID NO: 298261 - DNA, 25 bp, Homo sapien
cagatgtgggcctcgcaggtgtcca

SEQ ID NO: 298262 - DNA, 25 bp, Homo sapien
tgtgggcctcgcaggtgtccagctt

SEQ ID NO: 298263 - DNA, 25 bp, Homo sapien
tcaacacaccggactgcactgaaga

SEQ ID NO: 298264 - DNA, 25 bp, Homo sapien
acaccggactgcactgaagaagctg

SEQ ID NO: 298265 - DNA, 25 bp, Homo sapien
tactttggacaaagcagtagcaaat

SEQ ID NO: 298266 - DNA, 25 bp, Homo sapien
agtagcaaatgcttaacgtttaatt

SEQ ID NO: 298267 - DNA, 25 bp, Homo sapien
ggtgagccgctcatctctaaggcaa

SEQ ID NO: 298268 - DNA, 25 bp, Homo sapien
tctaaggcaacatccagctgaaatt

SEQ ID NO: 298269 - DNA, 25 bp, Homo sapien
gcaacatccagctgaaatttcgtga

SEQ ID NO: 298270 - DNA, 25 bp, Homo sapien
aatttcgtgactttaccattctgtg

SEQ ID NO: 298271 - DNA, 25 bp, Homo sapien
gactttaccattctgtgcctgaaga

SEQ ID NO: 298272 - DNA, 25 bp, Homo sapien
gagaagctccgtaaataattatggg

SEQ ID NO: 298273 - DNA, 25 bp, Homo sapien
tatgtacacgcgattcataagtctt

SEQ ID NO: 298274 - DNA, 25 bp, Homo sapien
agtcatactgctggttaagcctgca

SEQ ID NO: 298275 - DNA, 25 bp, Homo sapien
gctggttaagcctgcagaacggtgt

SEQ ID NO: 298276 - DNA, 25 bp, Homo sapien
aagcctgcagaacggtgtacttgtt

SEQ ID NO: 298277 - DNA, 25 bp, Homo sapien
cttgtttgaaatgtatctggcccaa

SEQ ID NO: 298278 - DNA, 25 bp, Homo sapien
tgaaatgtatctggcccaatcgctg

SEQ ID NO: 298279 - DNA, 25 bp, Homo sapien
tgtatctggcccaatcgctgagcgt

SEQ ID NO: 298280 - DNA, 25 bp, Homo sapien
aatcgctgagcgtccgcgctgcatt

SEQ ID NO: 298281 - DNA, 25 bp, Homo sapien
gtccgcgctgcatttctccaaactg

SEQ ID NO: 298282 - DNA, 25 bp, Homo sapien
ctggcgaaccaagggcgcggaatct

SEQ ID NO: 298283 - DNA, 25 bp, Homo sapien
ttcctgaggtctcccagtcatactg

SEQ ID NO: 298284 - DNA, 25 bp, Homo sapien
gtctcccagtcatactgctggttaa

SEQ ID NO: 298285 - DNA, 25 bp, Homo sapien
gcttgttttgcagtgttcaggaaac

SEQ ID NO: 298286 - DNA, 25 bp, Homo sapien
agtgttcaggaaacaccattttcct

SEQ ID NO: 298287 - DNA, 25 bp, Homo sapien
attttcctggctcttaacgcttttg

SEQ ID NO: 298288 - DNA, 25 bp, Homo sapien
tcctggctcttaacgcttttgtatt

SEQ ID NO: 298289 - DNA, 25 bp, Homo sapien
ggctcttaacgcttttgtattggta

SEQ ID NO: 298290 - DNA, 25 bp, Homo sapien
tcttaacgcttttgtattggtatgg

SEQ ID NO: 298291 - DNA, 25 bp, Homo sapien
ctggaatctcactgactcgtgtgtt

SEQ ID NO: 298292 - DNA, 25 bp, Homo sapien
tctcactgactcgtgtgttatcaaa

SEQ ID NO: 298293 - DNA, 25 bp, Homo sapien
gactcgtgtgttatcaaagctatat

SEQ ID NO: 298294 - DNA, 25 bp, Homo sapien
atcaaagctatatcaggcctgggtg

SEQ ID NO: 298295 - DNA, 25 bp, Homo sapien
aggcctgggtgactgaattcttgca

SEQ ID NO: 298296 - DNA, 25 bp, Homo sapien
agccttttgagaaagctgccttcca

SEQ ID NO: 298297 - DNA, 25 bp, Homo sapien
gccttccagaaacagaatgataccc

SEQ ID NO: 298298 - DNA, 25 bp, Homo sapien
gctgctatcttagatggttgaaaac

SEQ ID NO: 298299 - DNA, 25 bp, Homo sapien
aaaactagacgggtggctcactgcc

SEQ ID NO: 298300 - DNA, 25 bp, Homo sapien
gacgggtggctcactgccattgtca

SEQ ID NO: 298301 - DNA, 25 bp, Homo sapien
gccattgtcaccaggttggaactct

SEQ ID NO: 298302 - DNA, 25 bp, Homo sapien
caggttggaactcttgcctctgtga

SEQ ID NO: 298303 - DNA, 25 bp, Homo sapien
ggaactcttgcctctgtgaggatgc

SEQ ID NO: 298304 - DNA, 25 bp, Homo sapien
gtgaggatgccttctctactgtgca

SEQ ID NO: 298305 - DNA, 25 bp, Homo sapien
ttctctactgtgcatacccatgaaa

SEQ ID NO: 298306 - DNA, 25 bp, Homo sapien
gtgcatacccatgaaatttaataca

SEQ ID NO: 298307 - DNA, 25 bp, Homo sapien
gtattggagtccagatatgatacca

SEQ ID NO: 298308 - DNA, 25 bp, Homo sapien
ggaaagccttacaagttatggtctt

SEQ ID NO: 298309 - DNA, 25 bp, Homo sapien
gagtgttcaagtttccaagatgatt

SEQ ID NO: 298310 - DNA, 25 bp, Homo sapien
caagatgattgggaatgcagaaacc

SEQ ID NO: 298311 - DNA, 25 bp, Homo sapien
tgcagaaaccagtttgacagacaac

SEQ ID NO: 298312 - DNA, 25 bp, Homo sapien
atccagacagacatttccatcagat

SEQ ID NO: 298313 - DNA, 25 bp, Homo sapien
ttccatcagatgatcatcagacatg

SEQ ID NO: 298314 - DNA, 25 bp, Homo sapien
gaagaaatgcccacttttgaccagc

SEQ ID NO: 298315 - DNA, 25 bp, Homo sapien
atgcccacttttgaccagcatgcat

SEQ ID NO: 298316 - DNA, 25 bp, Homo sapien
agcatgcatcccttactttttatca

SEQ ID NO: 298317 - DNA, 25 bp, Homo sapien
tgcatcccttactttttatcagaaa

SEQ ID NO: 298318 - DNA, 25 bp, Homo sapien
ttaaataaatttgccgtctgtatct

SEQ ID NO: 298319 - DNA, 25 bp, Homo sapien
aataaatttgccgtctgtatctaaa

SEQ ID NO: 298320 - DNA, 25 bp, Homo sapien
ataaatttgccgtctgtatctaaat

SEQ ID NO: 298321 - DNA, 25 bp, Homo sapien
aaatttgccgtctgtatctaaatat

SEQ ID NO: 298322 - DNA, 25 bp, Homo sapien
tttgccgtctgtatctaaatatctg

SEQ ID NO: 298323 - DNA, 25 bp, Homo sapien
ttgccgtctgtatctaaatatctga

SEQ ID NO: 298324 - DNA, 25 bp, Homo sapien
gccgtctgtatctaaatatctgaag

SEQ ID NO: 298325 - DNA, 25 bp, Homo sapien
gtctgtatctaaatatctgaagtgg

SEQ ID NO: 298326 - DNA, 25 bp, Homo sapien
gtatctaaatatctgaagtggacca

SEQ ID NO: 298327 - DNA, 25 bp, Homo sapien
aaatatctgaagtggaccaggtgcg

SEQ ID NO: 298328 - DNA, 25 bp, Homo sapien
atatctgaagtggaccaggtgcggt

SEQ ID NO: 298329 - DNA, 25 bp, Homo sapien
ccggagacagcctccctggctggga

SEQ ID NO: 298330 - DNA, 25 bp, Homo sapien
ggaatgaacgcagggcagagctcgg

SEQ ID NO: 298331 - DNA, 25 bp, Homo sapien
ccagggactcacaggacgctgtgca

SEQ ID NO: 298332 - DNA, 25 bp, Homo sapien
aggcccggctttctgggactcacaa

SEQ ID NO: 298333 - DNA, 25 bp, Homo sapien
cggctttctgggactcacaagctat

SEQ ID NO: 298334 - DNA, 25 bp, Homo sapien
actcacaagctatggtcaggagcga

SEQ ID NO: 298335 - DNA, 25 bp, Homo sapien
tggtcaggagcgagacgccgaccat

SEQ ID NO: 298336 - DNA, 25 bp, Homo sapien
gagctttcccgagagggctccgaga

SEQ ID NO: 298337 - DNA, 25 bp, Homo sapien
agacggacggcagtcgatgctactt

SEQ ID NO: 298338 - DNA, 25 bp, Homo sapien
gacggcagtcgatgctacttagggt

SEQ ID NO: 298339 - DNA, 25 bp, Homo sapien
tcgatgctacttagggtggacggaa

SEQ ID NO: 298340 - DNA, 25 bp, Homo sapien
taatttgaaactcatgtgtcctcat

SEQ ID NO: 298341 - DNA, 25 bp, Homo sapien
atgtgtcctcatggatcgtggatgc

SEQ ID NO: 298342 - DNA, 25 bp, Homo sapien
tggatcgtggatgccttcatttctt

SEQ ID NO: 298343 - DNA, 25 bp, Homo sapien
atttcttgagctctcaatgcagaca

SEQ ID NO: 298344 - DNA, 25 bp, Homo sapien
agacatttaaatggctgcaatcagt

SEQ ID NO: 298345 - DNA, 25 bp, Homo sapien
gcaatcagtagagtgacccgcggat

SEQ ID NO: 298346 - DNA, 25 bp, Homo sapien
gtgacccgcggatggcataaatgca

SEQ ID NO: 298347 - DNA, 25 bp, Homo sapien
gcataaatgcacctccttttcttgg

SEQ ID NO: 298348 - DNA, 25 bp, Homo sapien
gccttggatctatgggtctgggatt

SEQ ID NO: 298349 - DNA, 25 bp, Homo sapien
gggattgtggtcatctcctcaatcc

SEQ ID NO: 298350 - DNA, 25 bp, Homo sapien
ggccgtgggtgggaacttacataca

SEQ ID NO: 298351 - DNA, 25 bp, Homo sapien
gcccgcgtgccggtccccgatgtca

SEQ ID NO: 298352 - DNA, 25 bp, Homo sapien
cgggagtgccgtccccgcgcagagc

SEQ ID NO: 298353 - DNA, 25 bp, Homo sapien
gcagagccgcccatgcgtggactgc

SEQ ID NO: 298354 - DNA, 25 bp, Homo sapien
tgcgtggactgccacgccttcgagt

SEQ ID NO: 298355 - DNA, 25 bp, Homo sapien
gcgtggactgccacgccttcgagtt

SEQ ID NO: 298356 - DNA, 25 bp, Homo sapien
acgccttcgagttcatgcagcgcgc

SEQ ID NO: 298357 - DNA, 25 bp, Homo sapien
ttcgagttcatgcagcgcgccctgc

SEQ ID NO: 298358 - DNA, 25 bp, Homo sapien
tcgagttcatgcagcgcgccctgca

SEQ ID NO: 298359 - DNA, 25 bp, Homo sapien
agttcatgcagcgcgccctgcagga

SEQ ID NO: 298360 - DNA, 25 bp, Homo sapien
cgcggaacgtctgccggtgtccccg

SEQ ID NO: 298361 - DNA, 25 bp, Homo sapien
aacgtctgccggtgtccccgcgctg

SEQ ID NO: 298362 - DNA, 25 bp, Homo sapien
aagatgggaagtccacccagatgac

SEQ ID NO: 298363 - DNA, 25 bp, Homo sapien
ggaagtccacccagatgacaccggg

SEQ ID NO: 298364 - DNA, 25 bp, Homo sapien
agagaataaggatcacatccctctg

SEQ ID NO: 298365 - DNA, 25 bp, Homo sapien
gtactgatgctgttgagagccatct

SEQ ID NO: 298366 - DNA, 25 bp, Homo sapien
gccatctggtcctcagacatgggaa

SEQ ID NO: 298367 - DNA, 25 bp, Homo sapien
ctggtcctcagacatgggaaggcaa

SEQ ID NO: 298368 - DNA, 25 bp, Homo sapien
gaaggcaagagccatctgttcgacc

SEQ ID NO: 298369 - DNA, 25 bp, Homo sapien
ggcaagatgaaagctaagtccagtg

SEQ ID NO: 298370 - DNA, 25 bp, Homo sapien
gctcgctgccaacacgtttctcaaa

SEQ ID NO: 298371 - DNA, 25 bp, Homo sapien
aagaagaaggtccaagtagtctgaa

SEQ ID NO: 298372 - DNA, 25 bp, Homo sapien
ccaagtagtctgaaggactcgggag

SEQ ID NO: 298373 - DNA, 25 bp, Homo sapien
gttggcatgcagagactttgtcagg

SEQ ID NO: 298374 - DNA, 25 bp, Homo sapien
ttctgatcactggtctgtgccctca

SEQ ID NO: 298375 - DNA, 25 bp, Homo sapien
cgcacatcgacacactgtacttatt

SEQ ID NO: 298376 - DNA, 25 bp, Homo sapien
actgtacttatttgtccctctctaa

SEQ ID NO: 298377 - DNA, 25 bp, Homo sapien
ttgtccctctctaacattttaacta

SEQ ID NO: 298378 - DNA, 25 bp, Homo sapien
aagctcctacagtttcttgctggac

SEQ ID NO: 298379 - DNA, 25 bp, Homo sapien
agtaaatcccacaaaggccttatgc

SEQ ID NO: 298380 - DNA, 25 bp, Homo sapien
tggtgcattttgatctgcttcatga

SEQ ID NO: 298381 - DNA, 25 bp, Homo sapien
tctgcttcatgaagacgtgtccctt

SEQ ID NO: 298382 - DNA, 25 bp, Homo sapien
agacgtgtcccttcagtatttcatc

SEQ ID NO: 298383 - DNA, 25 bp, Homo sapien
agcaccctgtcgctggagttggcat

SEQ ID NO: 298384 - DNA, 25 bp, Homo sapien
ggaagtctaggagtcctctgtagaa

SEQ ID NO: 298385 - DNA, 25 bp, Homo sapien
tcatctggaacttgatcattgcttc

SEQ ID NO: 298386 - DNA, 25 bp, Homo sapien
aacttgatcattgcttcctcgtgct

SEQ ID NO: 298387 - DNA, 25 bp, Homo sapien
tcgtgctccttccagcagtcataat

SEQ ID NO: 298388 - DNA, 25 bp, Homo sapien
agcagtcataatctgtcgccatggc

SEQ ID NO: 298389 - DNA, 25 bp, Homo sapien
gtcgccatggcgatacttgcgtaac

SEQ ID NO: 298390 - DNA, 25 bp, Homo sapien
ttgcgtaacaaattccagcctcctt

SEQ ID NO: 298391 - DNA, 25 bp, Homo sapien
aaattccagcctccttagcaagaac

SEQ ID NO: 298392 - DNA, 25 bp, Homo sapien
tccttagcaagaaccacctctggaa

SEQ ID NO: 298393 - DNA, 25 bp, Homo sapien
ccacctctggaactgtggtcatgtt

SEQ ID NO: 298394 - DNA, 25 bp, Homo sapien
tgcatgggttgttggaagcagtatc

SEQ ID NO: 298395 - DNA, 25 bp, Homo sapien
tgttccctgctccactctgagtgga

SEQ ID NO: 298396 - DNA, 25 bp, Homo sapien
actctgagtggaattgctctccctg

SEQ ID NO: 298397 - DNA, 25 bp, Homo sapien
tctgagtggaattgctctccctgcc

SEQ ID NO: 298398 - DNA, 25 bp, Homo sapien
tgccccattctggtgtctttccact

SEQ ID NO: 298399 - DNA, 25 bp, Homo sapien
tttggaatcctctccgcacactgtg

SEQ ID NO: 298400 - DNA, 25 bp, Homo sapien
agggcccacaagctgaactgtggca

SEQ ID NO: 298401 - DNA, 25 bp, Homo sapien
aagctgaactgtggcatagctctct

SEQ ID NO: 298402 - DNA, 25 bp, Homo sapien
gctgaactgtggcatagctctctct

SEQ ID NO: 298403 - DNA, 25 bp, Homo sapien
tgaactgtggcatagctctctcttc

SEQ ID NO: 298404 - DNA, 25 bp, Homo sapien
aactgtggcatagctctctcttctt

SEQ ID NO: 298405 - DNA, 25 bp, Homo sapien
ctgtggcatagctctctcttcttct

SEQ ID NO: 298406 - DNA, 25 bp, Homo sapien
tgttcaggaaacagaccaggtggca

SEQ ID NO: 298407 - DNA, 25 bp, Homo sapien
tggcaggagggagtcttgtcctcaa

SEQ ID NO: 298408 - DNA, 25 bp, Homo sapien
tgtcctcaaggaacctcataagtct

SEQ ID NO: 298409 - DNA, 25 bp, Homo sapien
aggaacctcataagtcttgctaggg

SEQ ID NO: 298410 - DNA, 25 bp, Homo sapien
cagccatagaatccgggccttgatg

SEQ ID NO: 298411 - DNA, 25 bp, Homo sapien
tgatgcccaggcctcgccatgcata

SEQ ID NO: 298412 - DNA, 25 bp, Homo sapien
tgagacccgtctggcacaggcaacg

SEQ ID NO: 298413 - DNA, 25 bp, Homo sapien
tctggcacaggcaacggcagggccc

SEQ ID NO: 298414 - DNA, 25 bp, Homo sapien
gagcagggtcatcgaagcaggtggc

SEQ ID NO: 298415 - DNA, 25 bp, Homo sapien
ggtggcgtgcagacagtggcttctc

SEQ ID NO: 298416 - DNA, 25 bp, Homo sapien
cgtgctagtgcagtgaatgttcagg

SEQ ID NO: 298417 - DNA, 25 bp, Homo sapien
gaacatattcagcttccctattctt

SEQ ID NO: 298418 - DNA, 25 bp, Homo sapien
atatgcatgcctgcattagtataaa

SEQ ID NO: 298419 - DNA, 25 bp, Homo sapien
taaagcggtacacttttgggacatt

SEQ ID NO: 298420 - DNA, 25 bp, Homo sapien
caccgccacatcgaatgatcagtta

SEQ ID NO: 298421 - DNA, 25 bp, Homo sapien
ttgggacattttggttgaagggata

SEQ ID NO: 298422 - DNA, 25 bp, Homo sapien
agatagtggccttcaggattttata

SEQ ID NO: 298423 - DNA, 25 bp, Homo sapien
atcagttactgctggatacgggact

SEQ ID NO: 298424 - DNA, 25 bp, Homo sapien
ggatacgggactgaaaatggctttt

SEQ ID NO: 298425 - DNA, 25 bp, Homo sapien
ggctttttcctgagtcttacataaa

SEQ ID NO: 298426 - DNA, 25 bp, Homo sapien
ctgagtcttacataaaccgtgttat

SEQ ID NO: 298427 - DNA, 25 bp, Homo sapien
aaaccgtgttatgagaaccatgaac

SEQ ID NO: 298428 - DNA, 25 bp, Homo sapien
gaaagctgaacttgatactacttac

SEQ ID NO: 298429 - DNA, 25 bp, Homo sapien
acttgatactacttacactttctta

SEQ ID NO: 298430 - DNA, 25 bp, Homo sapien
gatactacttacactttcttaaagg

SEQ ID NO: 298431 - DNA, 25 bp, Homo sapien
tttataaatactgtgccccatgctc

SEQ ID NO: 298432 - DNA, 25 bp, Homo sapien
aatactgtgccccatgctctgacat

SEQ ID NO: 298433 - DNA, 25 bp, Homo sapien
tgtgccccatgctctgacatcatct

SEQ ID NO: 298434 - DNA, 25 bp, Homo sapien
ccaacagaccaactcagattggatt

SEQ ID NO: 298435 - DNA, 25 bp, Homo sapien
actcagattggattatgacttcatg

SEQ ID NO: 298436 - DNA, 25 bp, Homo sapien
ggaggaagagttaacagtacaatta

SEQ ID NO: 298437 - DNA, 25 bp, Homo sapien
tcttcctgctgacacaactggtatt

SEQ ID NO: 298438 - DNA, 25 bp, Homo sapien
tcctgctgacacaactggtattggg

SEQ ID NO: 298439 - DNA, 25 bp, Homo sapien
ccgcccctccgcgcaggcctccggg

SEQ ID NO: 298440 - DNA, 25 bp, Homo sapien
cgcccctccgcgcaggcctccgggg

SEQ ID NO: 298441 - DNA, 25 bp, Homo sapien
gcccctccgcgcaggcctccggggg

SEQ ID NO: 298442 - DNA, 25 bp, Homo sapien
ctccgcgcaggcctccggggggccg

SEQ ID NO: 298443 - DNA, 25 bp, Homo sapien
tccgcgcaggcctccggggggccgg

SEQ ID NO: 298444 - DNA, 25 bp, Homo sapien
gagggctgggcggaccaaaggccgg

SEQ ID NO: 298445 - DNA, 25 bp, Homo sapien
gggctgggcggaccaaaggccggag

SEQ ID NO: 298446 - DNA, 25 bp, Homo sapien
ggctgggcggaccaaaggccggagg

SEQ ID NO: 298447 - DNA, 25 bp, Homo sapien
gctgggcggaccaaaggccggaggg

SEQ ID NO: 298448 - DNA, 25 bp, Homo sapien
gggatagcgagaggcttgagaatgg

SEQ ID NO: 298449 - DNA, 25 bp, Homo sapien
ggatagcgagaggcttgagaatggg

SEQ ID NO: 298450 - DNA, 25 bp, Homo sapien
ggactgaaaaacctcaaggccattg

SEQ ID NO: 298451 - DNA, 25 bp, Homo sapien
aaggccattgatgtaaagctactgc

SEQ ID NO: 298452 - DNA, 25 bp, Homo sapien
aagctactgcatgtgtcaggttcat

SEQ ID NO: 298453 - DNA, 25 bp, Homo sapien
aaagagggatgatctagggatgact

SEQ ID NO: 298454 - DNA, 25 bp, Homo sapien
gatgactggaagaaggtgtgtacaa

SEQ ID NO: 298455 - DNA, 25 bp, Homo sapien
gtacaaagactgcagggtttccatt

SEQ ID NO: 298456 - DNA, 25 bp, Homo sapien
aagactgcagggtttccattccagc

SEQ ID NO: 298457 - DNA, 25 bp, Homo sapien
agggtttccattccagctccagctt

SEQ ID NO: 298458 - DNA, 25 bp, Homo sapien
agcgtatttctggtgtgtttcataa

SEQ ID NO: 298459 - DNA, 25 bp, Homo sapien
accccagtgggtcatgtggttacca

SEQ ID NO: 298460 - DNA, 25 bp, Homo sapien
gtggttaccatttcagagtactcaa

SEQ ID NO: 298461 - DNA, 25 bp, Homo sapien
aatgaaccaattctgcaaacaccga

SEQ ID NO: 298462 - DNA, 25 bp, Homo sapien
gcaaacaccgaacaaacagcccagg

SEQ ID NO: 298463 - DNA, 25 bp, Homo sapien
ggagaagcaccctctgtggccagag

SEQ ID NO: 298464 - DNA, 25 bp, Homo sapien
ctctgtggccagagctatgcaatgt

SEQ ID NO: 298465 - DNA, 25 bp, Homo sapien
ggaacatcatatacttttagaggcc

SEQ ID NO: 298466 - DNA, 25 bp, Homo sapien
caagcctttgctagatgaaacagga

SEQ ID NO: 298467 - DNA, 25 bp, Homo sapien
atttctccctgttgtctgactagga

SEQ ID NO: 298468 - DNA, 25 bp, Homo sapien
ctttatgtggttcattttgtgtgct

SEQ ID NO: 298469 - DNA, 25 bp, Homo sapien
ttgaaatacttgagctgcatcatgc

SEQ ID NO: 298470 - DNA, 25 bp, Homo sapien
gctgcatcatgcaaggttgacaagc

SEQ ID NO: 298471 - DNA, 25 bp, Homo sapien
actggctgccttgctcataatgaac

SEQ ID NO: 298472 - DNA, 25 bp, Homo sapien
agcccctccggaagaagcctcgaat

SEQ ID NO: 298473 - DNA, 25 bp, Homo sapien
tcgaatgggcttctgaggacacaag

SEQ ID NO: 298474 - DNA, 25 bp, Homo sapien
gtgggctgccctcaagccccagaga

SEQ ID NO: 298475 - DNA, 25 bp, Homo sapien
tcatccttcctctgggaccagatgt

SEQ ID NO: 298476 - DNA, 25 bp, Homo sapien
ctctgggaccagatgtgccttccac

SEQ ID NO: 298477 - DNA, 25 bp, Homo sapien
gccttccacagttgaaacttgagaa

SEQ ID NO: 298478 - DNA, 25 bp, Homo sapien
ttgagaagcagagctcgccaccttc

SEQ ID NO: 298479 - DNA, 25 bp, Homo sapien
cactgtgatgatgagccaagcaatt

SEQ ID NO: 298480 - DNA, 25 bp, Homo sapien
gagccaagcaatttggagccaagtt

SEQ ID NO: 298481 - DNA, 25 bp, Homo sapien
atttggagccaagttgaagggacag

SEQ ID NO: 298482 - DNA, 25 bp, Homo sapien
aagggacagggcaacaaaatacagt

SEQ ID NO: 298483 - DNA, 25 bp, Homo sapien
tttttggttatggtgctattcctaa

SEQ ID NO: 298484 - DNA, 25 bp, Homo sapien
ggttatggtgctattcctaaggtta

SEQ ID NO: 298485 - DNA, 25 bp, Homo sapien
ggtgctattcctaaggttaactttg

SEQ ID NO: 298486 - DNA, 25 bp, Homo sapien
taactttgaatatgtgacacacaca

SEQ ID NO: 298487 - DNA, 25 bp, Homo sapien
cacacacactcctaagtacctttaa

SEQ ID NO: 298488 - DNA, 25 bp, Homo sapien
cacacactcctaagtacctttaagg

SEQ ID NO: 298489 - DNA, 25 bp, Homo sapien
atttggtttcatcagaagcagcaag

SEQ ID NO: 298490 - DNA, 25 bp, Homo sapien
gcagcaagaatggacctgatgtctt

SEQ ID NO: 298491 - DNA, 25 bp, Homo sapien
gtctttaaaagcatagccgacaatg

SEQ ID NO: 298492 - DNA, 25 bp, Homo sapien
gccgacaatggtagcttctcaagtt

SEQ ID NO: 298493 - DNA, 25 bp, Homo sapien
aatggtagcttctcaagttatgaaa

SEQ ID NO: 298494 - DNA, 25 bp, Homo sapien
agctggcacacacttgtatagtgaa

SEQ ID NO: 298495 - DNA, 25 bp, Homo sapien
gtttacatgtgggaaaactccgcct

SEQ ID NO: 298496 - DNA, 25 bp, Homo sapien
tgtgggaaaactccgccttagacaa

SEQ ID NO: 298497 - DNA, 25 bp, Homo sapien
aaagtacaatcgtgtctctctctag

SEQ ID NO: 298498 - DNA, 25 bp, Homo sapien
gtgtctctctctagccggaatgcta

SEQ ID NO: 298499 - DNA, 25 bp, Homo sapien
tgctacagagagaaatggaacctta

SEQ ID NO: 298500 - DNA, 25 bp, Homo sapien
ggaaccttagatttgcaacaaaagt

SEQ ID NO: 298501 - DNA, 25 bp, Homo sapien
gtctgtaaactggtctgtttgccaa

SEQ ID NO: 298502 - DNA, 25 bp, Homo sapien
ctgtggccaatcttctgtgaaatac

SEQ ID NO: 298503 - DNA, 25 bp, Homo sapien
aatacaatgtgctgttggtgcaaca

SEQ ID NO: 298504 - DNA, 25 bp, Homo sapien
gttggtgcaacagatgattcaataa

SEQ ID NO: 298505 - DNA, 25 bp, Homo sapien
gtgggtgactgagcccgggtcctgg

SEQ ID NO: 298506 - DNA, 25 bp, Homo sapien
gggtcaggaagcaactttcccagga

SEQ ID NO: 298507 - DNA, 25 bp, Homo sapien
agcgtctccacttctcagctgattc

SEQ ID NO: 298508 - DNA, 25 bp, Homo sapien
cagctgattcctagaagctgagtcc

SEQ ID NO: 298509 - DNA, 25 bp, Homo sapien
aggaagcaactttcccaggacaggg

SEQ ID NO: 298510 - DNA, 25 bp, Homo sapien
attcctagaagctgagtcccgtccc

SEQ ID NO: 298511 - DNA, 25 bp, Homo sapien
tagaagctgagtcccgtcccttctc

SEQ ID NO: 298512 - DNA, 25 bp, Homo sapien
gccttgcctgcgtcgcaagcagttg

SEQ ID NO: 298513 - DNA, 25 bp, Homo sapien
cgtcgcaagcagttgtgggagcaga

SEQ ID NO: 298514 - DNA, 25 bp, Homo sapien
atctgtgtctctgtgcaggtatttt

SEQ ID NO: 298515 - DNA, 25 bp, Homo sapien
ggctgggttcttgccatcctgggca

SEQ ID NO: 298516 - DNA, 25 bp, Homo sapien
atatgttgtgagcatataccttcac

SEQ ID NO: 298517 - DNA, 25 bp, Homo sapien
cagttcttaatacctgttttgtaat

SEQ ID NO: 298518 - DNA, 25 bp, Homo sapien
gtaatcatgatattcagtcaaggca

SEQ ID NO: 298519 - DNA, 25 bp, Homo sapien
gatattcagtcaaggcattatggtt

SEQ ID NO: 298520 - DNA, 25 bp, Homo sapien
ggcattatggtttttaatcttgaaa

SEQ ID NO: 298521 - DNA, 25 bp, Homo sapien
atcttgaaacttagagaaccctttg

SEQ ID NO: 298522 - DNA, 25 bp, Homo sapien
acttagagaaccctttgaatatttg

SEQ ID NO: 298523 - DNA, 25 bp, Homo sapien
gaatatttgcttttactggtgtaca

SEQ ID NO: 298524 - DNA, 25 bp, Homo sapien
actgtacacataattatcatgttga

SEQ ID NO: 298525 - DNA, 25 bp, Homo sapien
taatttcaactagatcaagacatgt

SEQ ID NO: 298526 - DNA, 25 bp, Homo sapien
gatcaagacatgttaaccttttata

SEQ ID NO: 298527 - DNA, 25 bp, Homo sapien
aaccaggccaggacgttgcccctgg

SEQ ID NO: 298528 - DNA, 25 bp, Homo sapien
tgtgaggtcaggtcccccagattga

SEQ ID NO: 298529 - DNA, 25 bp, Homo sapien
ctgagtgtgggcaagtgtgtcaaaa

SEQ ID NO: 298530 - DNA, 25 bp, Homo sapien
gaggccgaagaagtcaaggcccctc

SEQ ID NO: 298531 - DNA, 25 bp, Homo sapien
gtcaaggcccctcccgcaaatgtgt

SEQ ID NO: 298532 - DNA, 25 bp, Homo sapien
cggatgccggagtgggagagtctct

SEQ ID NO: 298533 - DNA, 25 bp, Homo sapien
gagagtctctgagctgtgagattga

SEQ ID NO: 298534 - DNA, 25 bp, Homo sapien
gtgagattgatcttgcccctaattg

SEQ ID NO: 298535 - DNA, 25 bp, Homo sapien
ttgatcttgcccctaattggagagg

SEQ ID NO: 298536 - DNA, 25 bp, Homo sapien
gatcttgcccctaattggagaggaa

SEQ ID NO: 298537 - DNA, 25 bp, Homo sapien
ttgcccctaattggagaggaagccg

SEQ ID NO: 298538 - DNA, 25 bp, Homo sapien
tatttcaatttctcccccttcagtt

SEQ ID NO: 298539 - DNA, 25 bp, Homo sapien
atttctcccccttcagtttaatgag

SEQ ID NO: 298540 - DNA, 25 bp, Homo sapien
tcccccttcagtttaatgagtggtg

SEQ ID NO: 298541 - DNA, 25 bp, Homo sapien
gggaggaggtaagcataaataacat

SEQ ID NO: 298542 - DNA, 25 bp, Homo sapien
ggtaagcataaataacatgactgtg

SEQ ID NO: 298543 - DNA, 25 bp, Homo sapien
acatgactgtgttcttttgctggca

SEQ ID NO: 298544 - DNA, 25 bp, Homo sapien
atgactgtgttcttttgctggcact

SEQ ID NO: 298545 - DNA, 25 bp, Homo sapien
tgactgtgttcttttgctggcactg

SEQ ID NO: 298546 - DNA, 25 bp, Homo sapien
tgttcttttgctggcactgacttaa

SEQ ID NO: 298547 - DNA, 25 bp, Homo sapien
cctccccagcactgaacaattgaaa

SEQ ID NO: 298548 - DNA, 25 bp, Homo sapien
tgtataatatccctacctttttttg

SEQ ID NO: 298549 - DNA, 25 bp, Homo sapien
gttaaatattttcacttatgccatg

SEQ ID NO: 298550 - DNA, 25 bp, Homo sapien
attttcacttatgccatgatatctt

SEQ ID NO: 298551 - DNA, 25 bp, Homo sapien
cacttatgccatgatatcttattta

SEQ ID NO: 298552 - DNA, 25 bp, Homo sapien
tgccatgatatcttatttaatcttt

SEQ ID NO: 298553 - DNA, 25 bp, Homo sapien
aatttgtctatgaaaatacctgctc

SEQ ID NO: 298554 - DNA, 25 bp, Homo sapien
tctatgaaaatacctgctctgctag

SEQ ID NO: 298555 - DNA, 25 bp, Homo sapien
tatgaaaatacctgctctgctaggg

SEQ ID NO: 298556 - DNA, 25 bp, Homo sapien
gggcttctagttgaaaactcattaa

SEQ ID NO: 298557 - DNA, 25 bp, Homo sapien
aattgtttcttgtagcttttgcttt

SEQ ID NO: 298558 - DNA, 25 bp, Homo sapien
gtttcttgtagcttttgctttgatt

SEQ ID NO: 298559 - DNA, 25 bp, Homo sapien
tcttgtagcttttgctttgattgga

SEQ ID NO: 298560 - DNA, 25 bp, Homo sapien
gaatgtcataatttcaatttaatgt

SEQ ID NO: 298561 - DNA, 25 bp, Homo sapien
aaaatctattctcttacactaaata

SEQ ID NO: 298562 - DNA, 25 bp, Homo sapien
atctattctcttacactaaataaag

SEQ ID NO: 298563 - DNA, 25 bp, Homo sapien
aataaagtgttctttcaagatgcat

SEQ ID NO: 298564 - DNA, 25 bp, Homo sapien
taaagtgttctttcaagatgcattt

SEQ ID NO: 298565 - DNA, 25 bp, Homo sapien
tggtgtagtctaattcaataaagtc

SEQ ID NO: 298566 - DNA, 25 bp, Homo sapien
gtgtagtctaattcaataaagtcat

SEQ ID NO: 298567 - DNA, 25 bp, Homo sapien
gtagtctaattcaataaagtcatca

SEQ ID NO: 298568 - DNA, 25 bp, Homo sapien
gtctaattcaataaagtcatcattt

SEQ ID NO: 298569 - DNA, 25 bp, Homo sapien
aaagtcatcatttctttgctatgac

SEQ ID NO: 298570 - DNA, 25 bp, Homo sapien
aagtcatcatttctttgctatgaca

SEQ ID NO: 298571 - DNA, 25 bp, Homo sapien
gtgcagagaagcttcccaggggatt

SEQ ID NO: 298572 - DNA, 25 bp, Homo sapien
tgggttcccccgaaagacaagcgag

SEQ ID NO: 298573 - DNA, 25 bp, Homo sapien
agacaagcgaggtcattgcagttca

SEQ ID NO: 298574 - DNA, 25 bp, Homo sapien
acaagcgaggtcattgcagttcacc

SEQ ID NO: 298575 - DNA, 25 bp, Homo sapien
aggctgtccttggtccgaggctgct

SEQ ID NO: 298576 - DNA, 25 bp, Homo sapien
ttggtccgaggctgctcgttgcagc

SEQ ID NO: 298577 - DNA, 25 bp, Homo sapien
cccctgctggcggttacgatgcgtg

SEQ ID NO: 298578 - DNA, 25 bp, Homo sapien
cctgtgcctgtgacgtccctgtgga

SEQ ID NO: 298579 - DNA, 25 bp, Homo sapien
tgcctgtgacgtccctgtggacctg

SEQ ID NO: 298580 - DNA, 25 bp, Homo sapien
gctctgaatactgcatgaagcatta

SEQ ID NO: 298581 - DNA, 25 bp, Homo sapien
gcatgaagcattaaacgtgcaatga

SEQ ID NO: 298582 - DNA, 25 bp, Homo sapien
gtcaaaatgtgggtacagctcctga

SEQ ID NO: 298583 - DNA, 25 bp, Homo sapien
gtacagctcctgattcccaggatag

SEQ ID NO: 298584 - DNA, 25 bp, Homo sapien
ttcaggaggaaacagttgcagagct

SEQ ID NO: 298585 - DNA, 25 bp, Homo sapien
gttgcagagctaagaactgttgaga

SEQ ID NO: 298586 - DNA, 25 bp, Homo sapien
gagagtgaagctgcatcttatctgg

SEQ ID NO: 298587 - DNA, 25 bp, Homo sapien
ctggaccagatttctagatattata

SEQ ID NO: 298588 - DNA, 25 bp, Homo sapien
gagccaaattggtttctaaaatagc

SEQ ID NO: 298589 - DNA, 25 bp, Homo sapien
taaaatagctaaatatccccatgtg

SEQ ID NO: 298590 - DNA, 25 bp, Homo sapien
tatccccatgtggaggactatcgcc

SEQ ID NO: 298591 - DNA, 25 bp, Homo sapien
atgtggaggactatcgccgcaccgt

SEQ ID NO: 298592 - DNA, 25 bp, Homo sapien
actatcgccgcaccgtgacagagat

SEQ ID NO: 298593 - DNA, 25 bp, Homo sapien
gactaacagcatacttacaatttta

SEQ ID NO: 298594 - DNA, 25 bp, Homo sapien
aagaagctgttgttcagttcatctt

SEQ ID NO: 298595 - DNA, 25 bp, Homo sapien
tgttgttcagttcatcttaccagat

SEQ ID NO: 298596 - DNA, 25 bp, Homo sapien
tcatcttaccagatgtgtctggcga

SEQ ID NO: 298597 - DNA, 25 bp, Homo sapien
gtgtctggcgaagtattcagggttt

SEQ ID NO: 298598 - DNA, 25 bp, Homo sapien
gtattcagggtttgatggactgctt

SEQ ID NO: 298599 - DNA, 25 bp, Homo sapien
atggactgctttactttcgtttgga

SEQ ID NO: 298600 - DNA, 25 bp, Homo sapien
actgctttactttcgtttggaagtg

SEQ ID NO: 298601 - DNA, 25 bp, Homo sapien
aactttgttcatttcactgaggacc

SEQ ID NO: 298602 - DNA, 25 bp, Homo sapien
actgaggaccttatcttccttatat

SEQ ID NO: 298603 - DNA, 25 bp, Homo sapien
gaacaaagaagcaacaagcgtgaat

SEQ ID NO: 298604 - DNA, 25 bp, Homo sapien
aaatgataaagttcctgccttagag

SEQ ID NO: 298605 - DNA, 25 bp, Homo sapien
gataaagttcctgccttagagacgt

SEQ ID NO: 298606 - DNA, 25 bp, Homo sapien
gttcctgccttagagacgtttattg

SEQ ID NO: 298607 - DNA, 25 bp, Homo sapien
agagacgtttattgtctactggaga

SEQ ID NO: 298608 - DNA, 25 bp, Homo sapien
gagaaggtgggcatataatttaccc

SEQ ID NO: 298609 - DNA, 25 bp, Homo sapien
ggcatataatttacccaggtgagta

SEQ ID NO: 298610 - DNA, 25 bp, Homo sapien
tacccaggtgagtaaataatttata

SEQ ID NO: 298611 - DNA, 25 bp, Homo sapien
gaagttgcctagtacttgtgtatct

SEQ ID NO: 298612 - DNA, 25 bp, Homo sapien
tgtatctactatctctgctaaaagg

SEQ ID NO: 298613 - DNA, 25 bp, Homo sapien
ctactatctctgctaaaaggattga

SEQ ID NO: 298614 - DNA, 25 bp, Homo sapien
aaggattgaggaaagctttactgag

SEQ ID NO: 298615 - DNA, 25 bp, Homo sapien
ccctgccttttgaatctgcccagag

SEQ ID NO: 298616 - DNA, 25 bp, Homo sapien
tgaactcacagtgacccacagactg

SEQ ID NO: 298617 - DNA, 25 bp, Homo sapien
cagactgctgctggatgaacactca

SEQ ID NO: 298618 - DNA, 25 bp, Homo sapien
tgaacactcaggctacctaggtctt

SEQ ID NO: 298619 - DNA, 25 bp, Homo sapien
gctacctaggtcttctcataatgga

SEQ ID NO: 298620 - DNA, 25 bp, Homo sapien
agtgcaggctgcttgttcagctaga

SEQ ID NO: 298621 - DNA, 25 bp, Homo sapien
aggatggttgtattctctgccacag

SEQ ID NO: 298622 - DNA, 25 bp, Homo sapien
gataagccaggccaacctcctgtga

SEQ ID NO: 298623 - DNA, 25 bp, Homo sapien
atctctcagtggtgccgcatctaaa

SEQ ID NO: 298624 - DNA, 25 bp, Homo sapien
gtgccgcatctaaaggacaggcttt

SEQ ID NO: 298625 - DNA, 25 bp, Homo sapien
gcttttgccatgtgggcattgccat

SEQ ID NO: 298626 - DNA, 25 bp, Homo sapien
ttcctccccagagctgtagtttgaa

SEQ ID NO: 298627 - DNA, 25 bp, Homo sapien
tccccagagctgtagtttgaatttg

SEQ ID NO: 298628 - DNA, 25 bp, Homo sapien
gtggccctgggcattctgactttca

SEQ ID NO: 298629 - DNA, 25 bp, Homo sapien
gcattctgactttcatctgggtgtt

SEQ ID NO: 298630 - DNA, 25 bp, Homo sapien
gttgatgtttctgtgcacagctgtt

SEQ ID NO: 298631 - DNA, 25 bp, Homo sapien
ttctgtgcacagctgtttatttcca

SEQ ID NO: 298632 - DNA, 25 bp, Homo sapien
acaacttgtcccagaaggtgtttgg

SEQ ID NO: 298633 - DNA, 25 bp, Homo sapien
cttgtcccagaaggtgtttggcacc

SEQ ID NO: 298634 - DNA, 25 bp, Homo sapien
tttggcaccttgtttggtttgctga

SEQ ID NO: 298635 - DNA, 25 bp, Homo sapien
caccttgtttggtttgctgagctgg

SEQ ID NO: 298636 - DNA, 25 bp, Homo sapien
gtttgctgagctggtacgggacata

SEQ ID NO: 298637 - DNA, 25 bp, Homo sapien
tgtggcctgttttgagggaaaagta

SEQ ID NO: 298638 - DNA, 25 bp, Homo sapien
aattatataatgtagtcaactgcaa

SEQ ID NO: 298639 - DNA, 25 bp, Homo sapien
aatgtagtcaactgcaatatggaag

SEQ ID NO: 298640 - DNA, 25 bp, Homo sapien
gtagtcaactgcaatatggaagttt

SEQ ID NO: 298641 - DNA, 25 bp, Homo sapien
gtcaactgcaatatggaagtttgtt

SEQ ID NO: 298642 - DNA, 25 bp, Homo sapien
actgcaatatggaagtttgttcttg

SEQ ID NO: 298643 - DNA, 25 bp, Homo sapien
ctgcaatatggaagtttgttcttgt

SEQ ID NO: 298644 - DNA, 25 bp, Homo sapien
gtttctttgtcaataaccttaccag

SEQ ID NO: 298645 - DNA, 25 bp, Homo sapien
tttctttgtcaataaccttaccagt

SEQ ID NO: 298646 - DNA, 25 bp, Homo sapien
ttctttgtcaataaccttaccagtt

SEQ ID NO: 298647 - DNA, 25 bp, Homo sapien
tctttgtcaataaccttaccagttt

SEQ ID NO: 298648 - DNA, 25 bp, Homo sapien
gagcgcatcgcccatgagaacacct

SEQ ID NO: 298649 - DNA, 25 bp, Homo sapien
gctgaggaagctgccctcgaaaccc

SEQ ID NO: 298650 - DNA, 25 bp, Homo sapien
ctcgaaaccctccagaagacatctg

SEQ ID NO: 298651 - DNA, 25 bp, Homo sapien
aaaccctccagaagacatctgtcct

SEQ ID NO: 298652 - DNA, 25 bp, Homo sapien
agacatctgtcctgcagaggcccta

SEQ ID NO: 298653 - DNA, 25 bp, Homo sapien
aggcctgcgggaaggacttcctctt

SEQ ID NO: 298654 - DNA, 25 bp, Homo sapien
acctacaactgcctcacgaatgaca

SEQ ID NO: 298655 - DNA, 25 bp, Homo sapien
tgcctcacgaatgacacagacctgt

SEQ ID NO: 298656 - DNA, 25 bp, Homo sapien
gacacagacctgtacagcgactgtc

SEQ ID NO: 298657 - DNA, 25 bp, Homo sapien
tgtacagcgactgtctccgaacctt

SEQ ID NO: 298658 - DNA, 25 bp, Homo sapien
gactgtctccgaaccttctggacct

SEQ ID NO: 298659 - DNA, 25 bp, Homo sapien
gcccgcgtgccggtccccgatgtca

SEQ ID NO: 298660 - DNA, 25 bp, Homo sapien
tgctgctgctgagtctggcgctgct

SEQ ID NO: 298661 - DNA, 25 bp, Homo sapien
gctgctgagtctggcgctgctgggc

SEQ ID NO: 298662 - DNA, 25 bp, Homo sapien
gcagagccgcccatgcgtggactgc

SEQ ID NO: 298663 - DNA, 25 bp, Homo sapien
tgcgtggactgccacgccttcgagt

SEQ ID NO: 298664 - DNA, 25 bp, Homo sapien
ggactgccacgccttcgagttcatg

SEQ ID NO: 298665 - DNA, 25 bp, Homo sapien
acgccttcgagttcatgcagcgcgc

SEQ ID NO: 298666 - DNA, 25 bp, Homo sapien
ttcgagttcatgcagcgcgccctgc

SEQ ID NO: 298667 - DNA, 25 bp, Homo sapien
tcgagttcatgcagcgcgccctgca

SEQ ID NO: 298668 - DNA, 25 bp, Homo sapien
agttcatgcagcgcgccctgcagga

SEQ ID NO: 298669 - DNA, 25 bp, Homo sapien
cgcggaacgtctgccggtgtccccg

SEQ ID NO: 298670 - DNA, 25 bp, Homo sapien
aatgccacattggttaagtgccatc

SEQ ID NO: 298671 - DNA, 25 bp, Homo sapien
aagtgccatcatttgtaatgcaatg

SEQ ID NO: 298672 - DNA, 25 bp, Homo sapien
gtaatgcaatgtgtcacttgaaaag

SEQ ID NO: 298673 - DNA, 25 bp, Homo sapien
aagcaaaccgcgacaccctttgtct

SEQ ID NO: 298674 - DNA, 25 bp, Homo sapien
tttgtctccaccacacatagtgtac

SEQ ID NO: 298675 - DNA, 25 bp, Homo sapien
agtgtactttggaagcacaacgtcc

SEQ ID NO: 298676 - DNA, 25 bp, Homo sapien
ggaagcacaacgtccaggctggtac

SEQ ID NO: 298677 - DNA, 25 bp, Homo sapien
tccaggctggtaccgcagcgccatg

SEQ ID NO: 298678 - DNA, 25 bp, Homo sapien
cattcctcgcctcgttcataggaca

SEQ ID NO: 298679 - DNA, 25 bp, Homo sapien
cgttcataggacacttcactgccat

SEQ ID NO: 298680 - DNA, 25 bp, Homo sapien
cactgccattttctattcacataaa

SEQ ID NO: 298681 - DNA, 25 bp, Homo sapien
ttaaaccaagtcataaggaacagtg

SEQ ID NO: 298682 - DNA, 25 bp, Homo sapien
ttgagacagtgtagttgcagaaacc

SEQ ID NO: 298683 - DNA, 25 bp, Homo sapien
tgtagttgcagaaaccacgggaaat

SEQ ID NO: 298684 - DNA, 25 bp, Homo sapien
cacgggaaatatggtggatttggtt

SEQ ID NO: 298685 - DNA, 25 bp, Homo sapien
tggatttggttagcatgggtcagta

SEQ ID NO: 298686 - DNA, 25 bp, Homo sapien
tttggttagcatgggtcagtagtgt

SEQ ID NO: 298687 - DNA, 25 bp, Homo sapien
catgggtcagtagtgtgatggaaaa

SEQ ID NO: 298688 - DNA, 25 bp, Homo sapien
gaattaggcaaatggtaagcttgag

SEQ ID NO: 298689 - DNA, 25 bp, Homo sapien
aatggtaagcttgaggaggacagct

SEQ ID NO: 298690 - DNA, 25 bp, Homo sapien
gcttaatttgaatgatggccttaaa

SEQ ID NO: 298691 - DNA, 25 bp, Homo sapien
aacaccaggttgatgaagtttagga

SEQ ID NO: 298692 - DNA, 25 bp, Homo sapien
ccacagctaggtgtagtgagccaga

SEQ ID NO: 298693 - DNA, 25 bp, Homo sapien
gtgagccagacgaggcagcttactg

SEQ ID NO: 298694 - DNA, 25 bp, Homo sapien
gacgaggcagcttactgaacctggg

SEQ ID NO: 298695 - DNA, 25 bp, Homo sapien
gggttctctccattgtcaccgcatt

SEQ ID NO: 298696 - DNA, 25 bp, Homo sapien
attctccttcaccaggtgtggctgt

SEQ ID NO: 298697 - DNA, 25 bp, Homo sapien
ggcctgctgcaatctccttgaggca

SEQ ID NO: 298698 - DNA, 25 bp, Homo sapien
gcaatctccttgaggcaggaaacgt

SEQ ID NO: 298699 - DNA, 25 bp, Homo sapien
aggaaacgtgggattcagccccagc

SEQ ID NO: 298700 - DNA, 25 bp, Homo sapien
agccccagcctcacttagtggaggt

SEQ ID NO: 298701 - DNA, 25 bp, Homo sapien
ggaggttcttttaccatggacccag

SEQ ID NO: 298702 - DNA, 25 bp, Homo sapien
gttcttttaccatggacccaggctg

SEQ ID NO: 298703 - DNA, 25 bp, Homo sapien
ggactaaccaaccatctgtactttg

SEQ ID NO: 298704 - DNA, 25 bp, Homo sapien
aaccatctgtactttgatcccagaa

SEQ ID NO: 298705 - DNA, 25 bp, Homo sapien
ctgtactttgatcccagaattcatt

SEQ ID NO: 298706 - DNA, 25 bp, Homo sapien
attcattttgattctgctgtttgtt

SEQ ID NO: 298707 - DNA, 25 bp, Homo sapien
agaactgaaagctttctagcttgtt

SEQ ID NO: 298708 - DNA, 25 bp, Homo sapien
ctagcttgtttggatgtggttgtga

SEQ ID NO: 298709 - DNA, 25 bp, Homo sapien
gcactgattttccatctgtttgcca

SEQ ID NO: 298710 - DNA, 25 bp, Homo sapien
atctgtttgccattggttgggactt

SEQ ID NO: 298711 - DNA, 25 bp, Homo sapien
ttgccattggttgggacttctccaa

SEQ ID NO: 298712 - DNA, 25 bp, Homo sapien
ggttgggacttctccaatgtgttag

SEQ ID NO: 298713 - DNA, 25 bp, Homo sapien
aatgtgttaggaaagctgctgtgct

SEQ ID NO: 298714 - DNA, 25 bp, Homo sapien
ttatcctctgccatacagcatccat

SEQ ID NO: 298715 - DNA, 25 bp, Homo sapien
atacagcatccatctggagccctgt

SEQ ID NO: 298716 - DNA, 25 bp, Homo sapien
tggagccctgtcttttaggatgagt

SEQ ID NO: 298717 - DNA, 25 bp, Homo sapien
gtcgggcattaaaccttaagcttca

SEQ ID NO: 298718 - DNA, 25 bp, Homo sapien
ttaagcttcagtcgccatctgtgat

SEQ ID NO: 298719 - DNA, 25 bp, Homo sapien
aaagagctctttctgggtcaaatag

SEQ ID NO: 298720 - DNA, 25 bp, Homo sapien
tgggcttttcttgcaattgattttg

SEQ ID NO: 298721 - DNA, 25 bp, Homo sapien
gagccagatgccacatatcttgaaa

SEQ ID NO: 298722 - DNA, 25 bp, Homo sapien
taggcgctggcgtcggtattcagcc

SEQ ID NO: 298723 - DNA, 25 bp, Homo sapien
gcacatctgaggcttggcagcttct

SEQ ID NO: 298724 - DNA, 25 bp, Homo sapien
ttggcagcttctcatagcgccttat

SEQ ID NO: 298725 - DNA, 25 bp, Homo sapien
gaaattgcaacatacacaccttttt

SEQ ID NO: 298726 - DNA, 25 bp, Homo sapien
gcaacatacacacctttttattttc

SEQ ID NO: 298727 - DNA, 25 bp, Homo sapien
attttctggtgttaagctagttgtc

SEQ ID NO: 298728 - DNA, 25 bp, Homo sapien
gttaagctagttgtctttcctacct

SEQ ID NO: 298729 - DNA, 25 bp, Homo sapien
gtctttcctaccttacaaatcatgt

SEQ ID NO: 298730 - DNA, 25 bp, Homo sapien
gttagttttatgatttgttccgcat

SEQ ID NO: 298731 - DNA, 25 bp, Homo sapien
gatttgttccgcatgttttatgttt

SEQ ID NO: 298732 - DNA, 25 bp, Homo sapien
ataacatacgctttccatatcaggg

SEQ ID NO: 298733 - DNA, 25 bp, Homo sapien
tcagggaaaatcatatctgtttaat

SEQ ID NO: 298734 - DNA, 25 bp, Homo sapien
aattggctataactttaatatctgt

SEQ ID NO: 298735 - DNA, 25 bp, Homo sapien
taatatctgtggacaacttgtaaaa

SEQ ID NO: 298736 - DNA, 25 bp, Homo sapien
gtggagaacctgtgcgtcaccgaca

SEQ ID NO: 298737 - DNA, 25 bp, Homo sapien
tgtgcgtcaccgacagcccgatatc

SEQ ID NO: 298738 - DNA, 25 bp, Homo sapien
gatatccctccgtaccatctgtggg

SEQ ID NO: 298739 - DNA, 25 bp, Homo sapien
gggatccatgcgagagatcaaacct

SEQ ID NO: 298740 - DNA, 25 bp, Homo sapien
gcgagagatcaaacctcatcgagga

SEQ ID NO: 298741 - DNA, 25 bp, Homo sapien
aacctcatcgaggagacgtcatcaa

SEQ ID NO: 298742 - DNA, 25 bp, Homo sapien
gagacgtcatcaatgcggttcccca

SEQ ID NO: 298743 - DNA, 25 bp, Homo sapien
aatgcggttccccagctgagactca

SEQ ID NO: 298744 - DNA, 25 bp, Homo sapien
agctgagactcatgggacttgctcc

SEQ ID NO: 298745 - DNA, 25 bp, Homo sapien
gactcatgggacttgctccgggtga

SEQ ID NO: 298746 - DNA, 25 bp, Homo sapien
gcttcagcttggtgtgccgtcgcag

SEQ ID NO: 298747 - DNA, 25 bp, Homo sapien
aaaaggaagagtcagcccggcatct

SEQ ID NO: 298748 - DNA, 25 bp, Homo sapien
gaccctgcatcactgggctgcggct

SEQ ID NO: 298749 - DNA, 25 bp, Homo sapien
ctgcggctgggaaaagtgagaccca

SEQ ID NO: 298750 - DNA, 25 bp, Homo sapien
gtgagacccagacgctccatctcag

SEQ ID NO: 298751 - DNA, 25 bp, Homo sapien
tctcagcttccccatgtggtgctgt

SEQ ID NO: 298752 - DNA, 25 bp, Homo sapien
tgctgtgctctgtggtggccaagac

SEQ ID NO: 298753 - DNA, 25 bp, Homo sapien
ggtggccaagactgccatgttgcca

SEQ ID NO: 298754 - DNA, 25 bp, Homo sapien
ggccaagactgccatgttgccatgc

SEQ ID NO: 298755 - DNA, 25 bp, Homo sapien
ccatgttgccatgctgtgatgcagc

SEQ ID NO: 298756 - DNA, 25 bp, Homo sapien
gccgtgatgagtgatgggagccttg

SEQ ID NO: 298757 - DNA, 25 bp, Homo sapien
gggatttcctctggcaaaaggaaga

SEQ ID NO: 298758 - DNA, 25 bp, Homo sapien
gaatcacttgaacttttcacgaagt

SEQ ID NO: 298759 - DNA, 25 bp, Homo sapien
gaacttttcacgaagttcttagagg

SEQ ID NO: 298760 - DNA, 25 bp, Homo sapien
ggcaagatgcgaaggaaggaaccaa

SEQ ID NO: 298761 - DNA, 25 bp, Homo sapien
gaaggaaccaaggagatgttttctc

SEQ ID NO: 298762 - DNA, 25 bp, Homo sapien
tgacagctccggctcgagctttggc

SEQ ID NO: 298763 - DNA, 25 bp, Homo sapien
ggcgtctggtagataaagccctaga

SEQ ID NO: 298764 - DNA, 25 bp, Homo sapien
agataaagccctagaccttgtccac

SEQ ID NO: 298765 - DNA, 25 bp, Homo sapien
ttggcggcgcccaggcaattcccaa

SEQ ID NO: 298766 - DNA, 25 bp, Homo sapien
aattcccaagacctggcggcggagt

SEQ ID NO: 298767 - DNA, 25 bp, Homo sapien
ccctgcggcagattctcggcagaat

SEQ ID NO: 298768 - DNA, 25 bp, Homo sapien
gcggcagattctcggcagaatcact

SEQ ID NO: 298769 - DNA, 25 bp, Homo sapien
acctttgccagatggcaggagactg

SEQ ID NO: 298770 - DNA, 25 bp, Homo sapien
tttctcccaggtttcctgcatgcag

SEQ ID NO: 298771 - DNA, 25 bp, Homo sapien
gagactgccatctcctatcatgtga

SEQ ID NO: 298772 - DNA, 25 bp, Homo sapien
catctcctatcatgtgacctactgg

SEQ ID NO: 298773 - DNA, 25 bp, Homo sapien
ctcccaggtttcctgcatgcaggga

SEQ ID NO: 298774 - DNA, 25 bp, Homo sapien
gtgacctactggacaaagtgcggat

SEQ ID NO: 298775 - DNA, 25 bp, Homo sapien
aaagtgcggataagttgaaccatat

SEQ ID NO: 298776 - DNA, 25 bp, Homo sapien
gggaaactccaggtcaatgtgtctc

SEQ ID NO: 298777 - DNA, 25 bp, Homo sapien
aggtcaatgtgtctcctttttctga

SEQ ID NO: 298778 - DNA, 25 bp, Homo sapien
caatgtgtctcctttttctgaaaaa

SEQ ID NO: 298779 - DNA, 25 bp, Homo sapien
gtggctgccactagccatctgtgcc

SEQ ID NO: 298780 - DNA, 25 bp, Homo sapien
atattctgtatacttaagatgccag

SEQ ID NO: 298781 - DNA, 25 bp, Homo sapien
cagaaatacttctatggaaagagtt

SEQ ID NO: 298782 - DNA, 25 bp, Homo sapien
ggaaagagttaaaatctcctatcta

SEQ ID NO: 298783 - DNA, 25 bp, Homo sapien
aaaatctcctatctaaactgttaat

SEQ ID NO: 298784 - DNA, 25 bp, Homo sapien
ggtgtttaaagaactcacatagtat

SEQ ID NO: 298785 - DNA, 25 bp, Homo sapien
cacatagtatgactagtttctctct

SEQ ID NO: 298786 - DNA, 25 bp, Homo sapien
taaggaatctgcactgagaaccatt

SEQ ID NO: 298787 - DNA, 25 bp, Homo sapien
ggaatctgcactgagaaccattgca

SEQ ID NO: 298788 - DNA, 25 bp, Homo sapien
gttttcagttcagataaggttgact

SEQ ID NO: 298789 - DNA, 25 bp, Homo sapien
aaggttgactgtgcagctcacatct

SEQ ID NO: 298790 - DNA, 25 bp, Homo sapien
gcatagtacggatattcataaggat

SEQ ID NO: 298791 - DNA, 25 bp, Homo sapien
tcctggctggactcctggtctggac

SEQ ID NO: 298792 - DNA, 25 bp, Homo sapien
tggactcctggtctggactcagcat

SEQ ID NO: 298793 - DNA, 25 bp, Homo sapien
cctggtctggactcagcatcaggga

SEQ ID NO: 298794 - DNA, 25 bp, Homo sapien
tgggcttcttcacatggtcatcaaa

SEQ ID NO: 298795 - DNA, 25 bp, Homo sapien
tcttcacatggtcatcaaagacttg

SEQ ID NO: 298796 - DNA, 25 bp, Homo sapien
caaagacttggccagttccgcctct

SEQ ID NO: 298797 - DNA, 25 bp, Homo sapien
agcatcacgacgcatcagttcacca

SEQ ID NO: 298798 - DNA, 25 bp, Homo sapien
gacgcatcagttcaccaacaaacac

SEQ ID NO: 298799 - DNA, 25 bp, Homo sapien
caacaaacacgattcagtgctgcta

SEQ ID NO: 298800 - DNA, 25 bp, Homo sapien
tgctagtgctgggtcctgttctggg

SEQ ID NO: 298801 - DNA, 25 bp, Homo sapien
gggcgacaagcctggaccagatgaa

SEQ ID NO: 298802 - DNA, 25 bp, Homo sapien
ggacgtcccaatttcatgttcagtg

SEQ ID NO: 298803 - DNA, 25 bp, Homo sapien
tggagatgttggagatttctgtgct

SEQ ID NO: 298804 - DNA, 25 bp, Homo sapien
gatttctgtgctgaaggctgaatga

SEQ ID NO: 298805 - DNA, 25 bp, Homo sapien
gcaaaaagttctgtctgcttcagta

SEQ ID NO: 298806 - DNA, 25 bp, Homo sapien
aattcaaatctctttgctcggtcgg

SEQ ID NO: 298807 - DNA, 25 bp, Homo sapien
tctttgctcggtcggctttcatttt

SEQ ID NO: 298808 - DNA, 25 bp, Homo sapien
ttcatattctgggtccatttccttt

SEQ ID NO: 298809 - DNA, 25 bp, Homo sapien
tttccttttcagatttaggcgcttt

SEQ ID NO: 298810 - DNA, 25 bp, Homo sapien
gatttaggcgctttagcagcaagtt

SEQ ID NO: 298811 - DNA, 25 bp, Homo sapien
ggcgctttagcagcaagtttgagtt

SEQ ID NO: 298812 - DNA, 25 bp, Homo sapien
tgaaatgaagaaacgtttttctcct

SEQ ID NO: 298813 - DNA, 25 bp, Homo sapien
taaaccagatagagcttttttgaga

SEQ ID NO: 298814 - DNA, 25 bp, Homo sapien
cagcatgaaggatcccatatagatg

SEQ ID NO: 298815 - DNA, 25 bp, Homo sapien
ttctatctgaggatggtggaatttc

SEQ ID NO: 298816 - DNA, 25 bp, Homo sapien
gtggaatttccggaatatcagaatc

SEQ ID NO: 298817 - DNA, 25 bp, Homo sapien
gaatctgttctggaatccaaatctc

SEQ ID NO: 298818 - DNA, 25 bp, Homo sapien
tccaaatctccatatctgtcatcaa

SEQ ID NO: 298819 - DNA, 25 bp, Homo sapien
atctgtcatcaatatctgtttcttt

SEQ ID NO: 298820 - DNA, 25 bp, Homo sapien
tctccctcgcggtgtggcggcgaca

SEQ ID NO: 298821 - DNA, 25 bp, Homo sapien
tatccaccagtttttccaccttgaa

SEQ ID NO: 298822 - DNA, 25 bp, Homo sapien
caccagtttttccaccttgaagata

SEQ ID NO: 298823 - DNA, 25 bp, Homo sapien
tttccaccttgaagataaaccagat

SEQ ID NO: 298824 - DNA, 25 bp, Homo sapien
gaaattgctgggtcccgatgttggt

SEQ ID NO: 298825 - DNA, 25 bp, Homo sapien
tggctgttggagttttggaccactc

SEQ ID NO: 298826 - DNA, 25 bp, Homo sapien
tggaccactcgctagcagtgatttg

SEQ ID NO: 298827 - DNA, 25 bp, Homo sapien
aaaaattgtatggtgcggaacatgc

SEQ ID NO: 298828 - DNA, 25 bp, Homo sapien
gcggaacatgcaccttgacaatggt

SEQ ID NO: 298829 - DNA, 25 bp, Homo sapien
gacaatggtactaacttgttattct

SEQ ID NO: 298830 - DNA, 25 bp, Homo sapien
agatctatttttgccagagcaccct

SEQ ID NO: 298831 - DNA, 25 bp, Homo sapien
tcagtcctccgattacatttcacta

SEQ ID NO: 298832 - DNA, 25 bp, Homo sapien
acatttcactagagttccttacgag

SEQ ID NO: 298833 - DNA, 25 bp, Homo sapien
agagttccttacgagattgctgtat

SEQ ID NO: 298834 - DNA, 25 bp, Homo sapien
gattgctgtatattcctgggacctt

SEQ ID NO: 298835 - DNA, 25 bp, Homo sapien
agatgaaaagtcacctcagtttaaa

SEQ ID NO: 298836 - DNA, 25 bp, Homo sapien
gaaaagtcacctcagtttaaaagca

SEQ ID NO: 298837 - DNA, 25 bp, Homo sapien
aatcattactcttttaagttccagt

SEQ ID NO: 298838 - DNA, 25 bp, Homo sapien
caatgttattatccagctaattttc

SEQ ID NO: 298839 - DNA, 25 bp, Homo sapien
gctaattttcagagctttaaaactg

SEQ ID NO: 298840 - DNA, 25 bp, Homo sapien
aactgtaagcatgttaagtgtatta

SEQ ID NO: 298841 - DNA, 25 bp, Homo sapien
accatgttttcttacctccttccag

SEQ ID NO: 298842 - DNA, 25 bp, Homo sapien
ctagttataaatagcgcttccaaac

SEQ ID NO: 298843 - DNA, 25 bp, Homo sapien
ttctgctccaacctgtttagttctg

SEQ ID NO: 298844 - DNA, 25 bp, Homo sapien
tgctccaacctgtttagttctgtac

SEQ ID NO: 298845 - DNA, 25 bp, Homo sapien
ttagttctgtaccagatctctctag

SEQ ID NO: 298846 - DNA, 25 bp, Homo sapien
gctgcaagagaatcgagcgccgcaa

SEQ ID NO: 298847 - DNA, 25 bp, Homo sapien
aatcgagcgccgcaaggcgagctta

SEQ ID NO: 298848 - DNA, 25 bp, Homo sapien
aaggcgagcttatcttccacacctg

SEQ ID NO: 298849 - DNA, 25 bp, Homo sapien
ttatcttccacacctggtacagtgc

SEQ ID NO: 298850 - DNA, 25 bp, Homo sapien
gagcgagaagggaaagtgcatctaa

SEQ ID NO: 298851 - DNA, 25 bp, Homo sapien
tgcatctaaaaagcacagggaacct

SEQ ID NO: 298852 - DNA, 25 bp, Homo sapien
gaaagggtttcatcagttcgggtga

SEQ ID NO: 298853 - DNA, 25 bp, Homo sapien
tcatcagttcgggtgaaatcttgaa

SEQ ID NO: 298854 - DNA, 25 bp, Homo sapien
ctggacaggcttgttggagtcgtat

SEQ ID NO: 298855 - DNA, 25 bp, Homo sapien
aggcttgttggagtcgtataatgca

SEQ ID NO: 298856 - DNA, 25 bp, Homo sapien
tgaataaaaacttacggctgcctta

SEQ ID NO: 298857 - DNA, 25 bp, Homo sapien
atcactgcacgtgaagttcctggtc

SEQ ID NO: 298858 - DNA, 25 bp, Homo sapien
gttcctggtcaatgtggactgtggt

SEQ ID NO: 298859 - DNA, 25 bp, Homo sapien
ggtgatgctactgtgtgcctctgac

SEQ ID NO: 298860 - DNA, 25 bp, Homo sapien
gaaataccatccatagttggctatt

SEQ ID NO: 298861 - DNA, 25 bp, Homo sapien
gaaggaaactgacctaggaccaagg

SEQ ID NO: 298862 - DNA, 25 bp, Homo sapien
ggaccaaggtaaacctgacactgtg

SEQ ID NO: 298863 - DNA, 25 bp, Homo sapien
tgacactgtgtctctctagtgcaga

SEQ ID NO: 298864 - DNA, 25 bp, Homo sapien
gtctctctagtgcagattcctaact

SEQ ID NO: 298865 - DNA, 25 bp, Homo sapien
ttcatccaggatttgtctctatgac

SEQ ID NO: 298866 - DNA, 25 bp, Homo sapien
tctctatgactgttctccattgcat

SEQ ID NO: 298867 - DNA, 25 bp, Homo sapien
aaggtagggaacaccctgtgctcat

SEQ ID NO: 298868 - DNA, 25 bp, Homo sapien
aggacagcgcttctccgtccaatgc

SEQ ID NO: 298869 - DNA, 25 bp, Homo sapien
gctgggaccgaagccgtaaccgaag

SEQ ID NO: 298870 - DNA, 25 bp, Homo sapien
ctactcactcggaagctccagctaa

SEQ ID NO: 298871 - DNA, 25 bp, Homo sapien
gaagctccagctaactgtaggatct

SEQ ID NO: 298872 - DNA, 25 bp, Homo sapien
tgtaggatcttccacaccctaaggc

SEQ ID NO: 298873 - DNA, 25 bp, Homo sapien
acaccctaaggcttcagcttgagaa

SEQ ID NO: 298874 - DNA, 25 bp, Homo sapien
gcacttcgaagccagagcagaacca

SEQ ID NO: 298875 - DNA, 25 bp, Homo sapien
gccagagcagaaccaaaactcactt

SEQ ID NO: 298876 - DNA, 25 bp, Homo sapien
cgctcaaggacgaccccgagggtga

SEQ ID NO: 298877 - DNA, 25 bp, Homo sapien
tgacagggacggctgcgtcatcaca

SEQ ID NO: 298878 - DNA, 25 bp, Homo sapien
tcatcacaaaggtcctcctgtaggg

SEQ ID NO: 298879 - DNA, 25 bp, Homo sapien
attctctttgtacaattcctttcaa

SEQ ID NO: 298880 - DNA, 25 bp, Homo sapien
ctttcaacaatattgcttggaatta

SEQ ID NO: 298881 - DNA, 25 bp, Homo sapien
ggtattgatttccccgtctcaaaat

SEQ ID NO: 298882 - DNA, 25 bp, Homo sapien
aattgcaggttatccttgctttcaa

SEQ ID NO: 298883 - DNA, 25 bp, Homo sapien
caggttatccttgctttcaaaaaga

SEQ ID NO: 298884 - DNA, 25 bp, Homo sapien
ttgtttctgaaatgtagcttgttaa

SEQ ID NO: 298885 - DNA, 25 bp, Homo sapien
caagaaagatgcctaacacacacac

SEQ ID NO: 298886 - DNA, 25 bp, Homo sapien
taaatatcttttcctgctccgatca

SEQ ID NO: 298887 - DNA, 25 bp, Homo sapien
tcctgctccgatcattctttccttt

SEQ ID NO: 298888 - DNA, 25 bp, Homo sapien
tacctggctggtgaatgtttatatt

SEQ ID NO: 298889 - DNA, 25 bp, Homo sapien
tgtttatattgaattctctttgtac

SEQ ID NO: 298890 - DNA, 25 bp, Homo sapien
catgtctttaactggtttgaatgga

SEQ ID NO: 298891 - DNA, 25 bp, Homo sapien
atggacattgttggtttgagggaaa

SEQ ID NO: 298892 - DNA, 25 bp, Homo sapien
ttaaacctcaagctaaaatcagatt

SEQ ID NO: 298893 - DNA, 25 bp, Homo sapien
aaatcagattgtactgctttgcatt

SEQ ID NO: 298894 - DNA, 25 bp, Homo sapien
gattgtactgctttgcattgtgccc

SEQ ID NO: 298895 - DNA, 25 bp, Homo sapien
gctttgcattgtgccctgacaaaaa

SEQ ID NO: 298896 - DNA, 25 bp, Homo sapien
ttcgttcgcctctctagctgtgctt

SEQ ID NO: 298897 - DNA, 25 bp, Homo sapien
ctctctagctgtgctttctattttt

SEQ ID NO: 298898 - DNA, 25 bp, Homo sapien
tctatttttatgtgaggattcaggg

SEQ ID NO: 298899 - DNA, 25 bp, Homo sapien
gggaaatccaaaaactatgctgcta

SEQ ID NO: 298900 - DNA, 25 bp, Homo sapien
aaaaactatgctgctaccagcacca

SEQ ID NO: 298901 - DNA, 25 bp, Homo sapien
tccccgggcctagagaatgttaatt

SEQ ID NO: 298902 - DNA, 25 bp, Homo sapien
gcctagagaatgttaattgtcccac

SEQ ID NO: 298903 - DNA, 25 bp, Homo sapien
gaatgttaattgtcccactttccta

SEQ ID NO: 298904 - DNA, 25 bp, Homo sapien
tgttaattgtcccactttcctattt

SEQ ID NO: 298905 - DNA, 25 bp, Homo sapien
taattgtcccactttcctatttggg

SEQ ID NO: 298906 - DNA, 25 bp, Homo sapien
tgtcccactttcctatttgggtgga

SEQ ID NO: 298907 - DNA, 25 bp, Homo sapien
cccactttcctatttgggtggagca

SEQ ID NO: 298908 - DNA, 25 bp, Homo sapien
tttctgtgaggccagtgttgtttta

SEQ ID NO: 298909 - DNA, 25 bp, Homo sapien
tgaggccagtgttgttttatgcccc

SEQ ID NO: 298910 - DNA, 25 bp, Homo sapien
ccagtgttgttttatgcccccattt

SEQ ID NO: 298911 - DNA, 25 bp, Homo sapien
gcccccatttgggtggctaatttca

SEQ ID NO: 298912 - DNA, 25 bp, Homo sapien
ttaactcttttgtcttacaacggat

SEQ ID NO: 298913 - DNA, 25 bp, Homo sapien
aacggatattggtttgaatccagca

SEQ ID NO: 298914 - DNA, 25 bp, Homo sapien
tggcccagaaacacccagggcagtt

SEQ ID NO: 298915 - DNA, 25 bp, Homo sapien
agggctaacctagaactgatctacg

SEQ ID NO: 298916 - DNA, 25 bp, Homo sapien
gatctacgggtttctaatccgccaa

SEQ ID NO: 298917 - DNA, 25 bp, Homo sapien
taatccgccaagcagtaatccgaaa

SEQ ID NO: 298918 - DNA, 25 bp, Homo sapien
aaaaagtacacgcttcccacgatga

SEQ ID NO: 298919 - DNA, 25 bp, Homo sapien
ggcagaaggttcagcagacgcgatt

SEQ ID NO: 298920 - DNA, 25 bp, Homo sapien
gttaacattccagatcattcccggt

SEQ ID NO: 298921 - DNA, 25 bp, Homo sapien
atcattcccggtaccttcattatta

SEQ ID NO: 298922 - DNA, 25 bp, Homo sapien
ggtaccttcattattagcctggata

SEQ ID NO: 298923 - DNA, 25 bp, Homo sapien
ccagcctgaccaatgccgcggtgga

SEQ ID NO: 298924 - DNA, 25 bp, Homo sapien
accaatgccgcggtggaaacgggct

SEQ ID NO: 298925 - DNA, 25 bp, Homo sapien
ccaatgccgcggtggaaacgggctt

SEQ ID NO: 298926 - DNA, 25 bp, Homo sapien
gaaacgggcttggagctggccccat

SEQ ID NO: 298927 - DNA, 25 bp, Homo sapien
aacgggcttggagctggccccataa

SEQ ID NO: 298928 - DNA, 25 bp, Homo sapien
cccacagcttctcgactgcagtggg

SEQ ID NO: 298929 - DNA, 25 bp, Homo sapien
caacacttggagatttttccggagg

SEQ ID NO: 298930 - DNA, 25 bp, Homo sapien
ttttctaagggcacagagaatccat

SEQ ID NO: 298931 - DNA, 25 bp, Homo sapien
tctaagggcacagagaatccatttt

SEQ ID NO: 298932 - DNA, 25 bp, Homo sapien
gggcacagagaatccattttctaca

SEQ ID NO: 298933 - DNA, 25 bp, Homo sapien
cacagagaatccattttctacacat

SEQ ID NO: 298934 - DNA, 25 bp, Homo sapien
ttcagcctcctctgtgggcaccgag

SEQ ID NO: 298935 - DNA, 25 bp, Homo sapien
gaggcccaggagcttcaaaagtcag

SEQ ID NO: 298936 - DNA, 25 bp, Homo sapien
aaaagtcagaccaagactgtccttg

SEQ ID NO: 298937 - DNA, 25 bp, Homo sapien
caagactgtccttggtcccacaggg

SEQ ID NO: 298938 - DNA, 25 bp, Homo sapien
agaggtgagatctgtgcgtgccccc

SEQ ID NO: 298939 - DNA, 25 bp, Homo sapien
gacagggcgtgagatctttgcgccc

SEQ ID NO: 298940 - DNA, 25 bp, Homo sapien
tgatctccctttccagattttcaaa

SEQ ID NO: 298941 - DNA, 25 bp, Homo sapien
agattttcaaaacgcccaagtgacg

SEQ ID NO: 298942 - DNA, 25 bp, Homo sapien
aaacgcccaagtgacgtgaaatggt

SEQ ID NO: 298943 - DNA, 25 bp, Homo sapien
gtgtgtatttatatccgacgtaaac

SEQ ID NO: 298944 - DNA, 25 bp, Homo sapien
tcacgagatgtcctcgtctggaatt

SEQ ID NO: 298945 - DNA, 25 bp, Homo sapien
agacaccgctccagttctaagacgc

SEQ ID NO: 298946 - DNA, 25 bp, Homo sapien
tctaagacgccagcagtgggatcca

SEQ ID NO: 298947 - DNA, 25 bp, Homo sapien
tcaggctgcagattcggacggtcat

SEQ ID NO: 298948 - DNA, 25 bp, Homo sapien
ccacaggctttgctgtacagttcta

SEQ ID NO: 298949 - DNA, 25 bp, Homo sapien
tgtacagttctaagaagccagcagt

SEQ ID NO: 298950 - DNA, 25 bp, Homo sapien
cagtgggatccacatttgttaaggt

SEQ ID NO: 298951 - DNA, 25 bp, Homo sapien
tttgctgtaaatgaccaggtccttt

SEQ ID NO: 298952 - DNA, 25 bp, Homo sapien
ggacggtcattctccaaggctggat

SEQ ID NO: 298953 - DNA, 25 bp, Homo sapien
aaggctggatttgcaggtcaccacc

SEQ ID NO: 298954 - DNA, 25 bp, Homo sapien
accaccccggtacctatagacagag

SEQ ID NO: 298955 - DNA, 25 bp, Homo sapien
agcaggctggttagcagacaccgct

SEQ ID NO: 298956 - DNA, 25 bp, Homo sapien
agctcgcagcagtgctcccgtagag

SEQ ID NO: 298957 - DNA, 25 bp, Homo sapien
tcccgtagagctgatggcattggca

SEQ ID NO: 298958 - DNA, 25 bp, Homo sapien
ttcagccattgacttctggacatgg

SEQ ID NO: 298959 - DNA, 25 bp, Homo sapien
ctcagcacagggaagttctccagtg

SEQ ID NO: 298960 - DNA, 25 bp, Homo sapien
aggcccaggcttgctctcggtttag

SEQ ID NO: 298961 - DNA, 25 bp, Homo sapien
ctcggtttaggtcccatggcacgtg

SEQ ID NO: 298962 - DNA, 25 bp, Homo sapien
gacagctcttccaaggttgagggtt

SEQ ID NO: 298963 - DNA, 25 bp, Homo sapien
gttgagggttggaactccacagcct

SEQ ID NO: 298964 - DNA, 25 bp, Homo sapien
ttttggcccctctcatatccgggaa

SEQ ID NO: 298965 - DNA, 25 bp, Homo sapien
tcatatccgggaagggctccgtgcc

SEQ ID NO: 298966 - DNA, 25 bp, Homo sapien
gctccgtgcccagtagaggtgcagt

SEQ ID NO: 298967 - DNA, 25 bp, Homo sapien
attttgagggaaccgaattctgcct

SEQ ID NO: 298968 - DNA, 25 bp, Homo sapien
gggaaccgaattctgcctccagggt

SEQ ID NO: 298969 - DNA, 25 bp, Homo sapien
gtgttcactaattcacttggtgttg

SEQ ID NO: 298970 - DNA, 25 bp, Homo sapien
ggatttcccttaggcggcagcagcg

SEQ ID NO: 298971 - DNA, 25 bp, Homo sapien
ggctgccgcttttccgcagggccag

SEQ ID NO: 298972 - DNA, 25 bp, Homo sapien
cttggtgttggccaattctccatat

SEQ ID NO: 298973 - DNA, 25 bp, Homo sapien
ggccaattctccatatcactgaaat

SEQ ID NO: 298974 - DNA, 25 bp, Homo sapien
tcactgaaatcactagccttgttgg

SEQ ID NO: 298975 - DNA, 25 bp, Homo sapien
aatcactagccttgttggatttctt

SEQ ID NO: 298976 - DNA, 25 bp, Homo sapien
gttggatttctttgtcttgagcttt

SEQ ID NO: 298977 - DNA, 25 bp, Homo sapien
atttctttgtcttgagctttcctgc

SEQ ID NO: 298978 - DNA, 25 bp, Homo sapien
ataaacaaaccgttgccccaatctg

SEQ ID NO: 298979 - DNA, 25 bp, Homo sapien
taaacaaaccgttgccccaatctgt

SEQ ID NO: 298980 - DNA, 25 bp, Homo sapien
cacacctggccgaaataataatatt

SEQ ID NO: 298981 - DNA, 25 bp, Homo sapien
acacctggccgaaataataatattc

SEQ ID NO: 298982 - DNA, 25 bp, Homo sapien
tttttaattgctcagacaccacaac

SEQ ID NO: 298983 - DNA, 25 bp, Homo sapien
tttaattgctcagacaccacaacat

SEQ ID NO: 298984 - DNA, 25 bp, Homo sapien
cagacaccacaacatcctagatgga

SEQ ID NO: 298985 - DNA, 25 bp, Homo sapien
gacaccacaacatcctagatggagg

SEQ ID NO: 298986 - DNA, 25 bp, Homo sapien
acaccacaacatcctagatggagga

SEQ ID NO: 298987 - DNA, 25 bp, Homo sapien
accacaacatcctagatggaggaaa

SEQ ID NO: 298988 - DNA, 25 bp, Homo sapien
aacatcctagatggaggaaaccatt

SEQ ID NO: 298989 - DNA, 25 bp, Homo sapien
gtgggacgcaacaggcggcctcctc

SEQ ID NO: 298990 - DNA, 25 bp, Homo sapien
agaacggaggtgttttgctctctgc

SEQ ID NO: 298991 - DNA, 25 bp, Homo sapien
ccaccgcagcgatggcggctatgaa

SEQ ID NO: 298992 - DNA, 25 bp, Homo sapien
tggcggctatgaaacctctgggtat

SEQ ID NO: 298993 - DNA, 25 bp, Homo sapien
aggcgcggcaggtattctcccaaaa

SEQ ID NO: 298994 - DNA, 25 bp, Homo sapien
gacccggcaggtaaggaactgtcca

SEQ ID NO: 298995 - DNA, 25 bp, Homo sapien
ctgtccatcggaaggcaacgggcgt

SEQ ID NO: 298996 - DNA, 25 bp, Homo sapien
tgctctctgcgcctagatcggtatt

SEQ ID NO: 298997 - DNA, 25 bp, Homo sapien
tagatcggtattttcccctaccact

SEQ ID NO: 298998 - DNA, 25 bp, Homo sapien
ttaagattacgcttcaggccagtgt

SEQ ID NO: 298999 - DNA, 25 bp, Homo sapien
gcttcaggccagtgttaggctttct

SEQ ID NO: 299000 - DNA, 25 bp, Homo sapien
cttccagctggtcaaagagattgcc

SEQ ID NO: 299001 - DNA, 25 bp, Homo sapien
agagattgccgatgaagaccccagc

SEQ ID NO: 299002 - DNA, 25 bp, Homo sapien
cccagccacgtgaacttggtcaatg

SEQ ID NO: 299003 - DNA, 25 bp, Homo sapien
gggcgacgccactgatgctagcagc

SEQ ID NO: 299004 - DNA, 25 bp, Homo sapien
agaggcacgcggatgttgaccaagc

SEQ ID NO: 299005 - DNA, 25 bp, Homo sapien
gttgaccaagcaggacagcgtgcat

SEQ ID NO: 299006 - DNA, 25 bp, Homo sapien
agcgtgcatggctggacggccctca

SEQ ID NO: 299007 - DNA, 25 bp, Homo sapien
atgcaggcaacctaccatgggtcag

SEQ ID NO: 299008 - DNA, 25 bp, Homo sapien
agcgacaaggccagacagatgctct

SEQ ID NO: 299009 - DNA, 25 bp, Homo sapien
ctctggcctgagatggaggttccca

SEQ ID NO: 299010 - DNA, 25 bp, Homo sapien
ccaatgggctcttctggtcctgaga

SEQ ID NO: 299011 - DNA, 25 bp, Homo sapien
ggacatctgtcttagagaaacaagt

SEQ ID NO: 299012 - DNA, 25 bp, Homo sapien
gagaaacaagtttccctagaaagag

SEQ ID NO: 299013 - DNA, 25 bp, Homo sapien
gagaacgacaacatgatcaaacaca

SEQ ID NO: 299014 - DNA, 25 bp, Homo sapien
aaacacatgttcagagccaacttga

SEQ ID NO: 299015 - DNA, 25 bp, Homo sapien
aaaaattggatcttcttgaacagga

SEQ ID NO: 299016 - DNA, 25 bp, Homo sapien
gaacaggagtataacaaacttacca

SEQ ID NO: 299017 - DNA, 25 bp, Homo sapien
aaacttaccacaatgcaggcccttg

SEQ ID NO: 299018 - DNA, 25 bp, Homo sapien
ttaccacaatgcaggcccttgcaga

SEQ ID NO: 299019 - DNA, 25 bp, Homo sapien
acaggaaaggaaacgcatgcaagct

SEQ ID NO: 299020 - DNA, 25 bp, Homo sapien
gcatgcaagctaaggcagctgagtt

SEQ ID NO: 299021 - DNA, 25 bp, Homo sapien
cagctgagttgcagactggtctaga

SEQ ID NO: 299022 - DNA, 25 bp, Homo sapien
tttcgaagtggccagctgcggccac

SEQ ID NO: 299023 - DNA, 25 bp, Homo sapien
ggccaccaggtctcagcacaagagc

SEQ ID NO: 299024 - DNA, 25 bp, Homo sapien
gcacaagagcgcttcctttgcacag

SEQ ID NO: 299025 - DNA, 25 bp, Homo sapien
agcttcgagctttgttcagactaaa

SEQ ID NO: 299026 - DNA, 25 bp, Homo sapien
gggcacgagttgattccaagcacat

SEQ ID NO: 299027 - DNA, 25 bp, Homo sapien
gagttgattccaagcacatgccttt

SEQ ID NO: 299028 - DNA, 25 bp, Homo sapien
caagcacatgcctttgctgagtgtg

SEQ ID NO: 299029 - DNA, 25 bp, Homo sapien
agtggatgtagagcgcggttttatt

SEQ ID NO: 299030 - DNA, 25 bp, Homo sapien
tgtagagcgcggttttatttttgta

SEQ ID NO: 299031 - DNA, 25 bp, Homo sapien
gtactgacattggtaagagactgta

SEQ ID NO: 299032 - DNA, 25 bp, Homo sapien
gagactgtatagcatctatttattt

SEQ ID NO: 299033 - DNA, 25 bp, Homo sapien
aaggcatagccatatttatgaaggt

SEQ ID NO: 299034 - DNA, 25 bp, Homo sapien
aagggcagttctttataatacatga

SEQ ID NO: 299035 - DNA, 25 bp, Homo sapien
gtaatactctactaatcaatactta

SEQ ID NO: 299036 - DNA, 25 bp, Homo sapien
gaagtttttgttatgactaatctga

SEQ ID NO: 299037 - DNA, 25 bp, Homo sapien
gttatgactaatctgaatgcttttt

SEQ ID NO: 299038 - DNA, 25 bp, Homo sapien
gtttttccttaatctagttatgttg

SEQ ID NO: 299039 - DNA, 25 bp, Homo sapien
ggtatttgagggtgttccatttcca

SEQ ID NO: 299040 - DNA, 25 bp, Homo sapien
agggtgttccatttccactgaatag

SEQ ID NO: 299041 - DNA, 25 bp, Homo sapien
gttccatttccactgaatagtaaga

SEQ ID NO: 299042 - DNA, 25 bp, Homo sapien
taatacatgaaaagcctagggttta

SEQ ID NO: 299043 - DNA, 25 bp, Homo sapien
gatgatgcttacttagatttccaca

SEQ ID NO: 299044 - DNA, 25 bp, Homo sapien
tattctcactttgttggtgaggaac

SEQ ID NO: 299045 - DNA, 25 bp, Homo sapien
gcccaaaatggtcagaaagttagca

SEQ ID NO: 299046 - DNA, 25 bp, Homo sapien
tcagaaagttagcagatggcagagc

SEQ ID NO: 299047 - DNA, 25 bp, Homo sapien
gtctattttttaatccctatcttgc

SEQ ID NO: 299048 - DNA, 25 bp, Homo sapien
ttttttaatccctatcttgcactcc

SEQ ID NO: 299049 - DNA, 25 bp, Homo sapien
tatcttgcactccttggtcacgtaa

SEQ ID NO: 299050 - DNA, 25 bp, Homo sapien
cactccttggtcacgtaaaccttgt

SEQ ID NO: 299051 - DNA, 25 bp, Homo sapien
cacgtaaaccttgtgtgaatatgtt

SEQ ID NO: 299052 - DNA, 25 bp, Homo sapien
aataccaggtttcttgggtgggatg

SEQ ID NO: 299053 - DNA, 25 bp, Homo sapien
gcggtaacaacctgctgggtagtat

SEQ ID NO: 299054 - DNA, 25 bp, Homo sapien
cctgctgggtagtatcattattctc

SEQ ID NO: 299055 - DNA, 25 bp, Homo sapien
agcacctgcgcaggttggtgactga

SEQ ID NO: 299056 - DNA, 25 bp, Homo sapien
cacctgcgcaggttggtgactgaga

SEQ ID NO: 299057 - DNA, 25 bp, Homo sapien
cctgcgcaggttggtgactgagagt

SEQ ID NO: 299058 - DNA, 25 bp, Homo sapien
tgcgcaggttggtgactgagagtct

SEQ ID NO: 299059 - DNA, 25 bp, Homo sapien
caggttggtgactgagagtctggca

SEQ ID NO: 299060 - DNA, 25 bp, Homo sapien
gtgactgagagtctggcagcgggta

SEQ ID NO: 299061 - DNA, 25 bp, Homo sapien
actgagagtctggcagcgggtatca

SEQ ID NO: 299062 - DNA, 25 bp, Homo sapien
tgagagtctggcagcgggtatcagg

SEQ ID NO: 299063 - DNA, 25 bp, Homo sapien
gtctggcagcgggtatcagggcagc

SEQ ID NO: 299064 - DNA, 25 bp, Homo sapien
tggcagcgggtatcagggcagcctg

SEQ ID NO: 299065 - DNA, 25 bp, Homo sapien
gcagcgggtatcagggcagcctgca

SEQ ID NO: 299066 - DNA, 25 bp, Homo sapien
gatactttcatgttaagtttaggac

SEQ ID NO: 299067 - DNA, 25 bp, Homo sapien
gtccttgacaatagtaaatagcacc

SEQ ID NO: 299068 - DNA, 25 bp, Homo sapien
ggactaatcttgtgtatgctcctta

SEQ ID NO: 299069 - DNA, 25 bp, Homo sapien
aatcttgtgtatgctccttaagtga

SEQ ID NO: 299070 - DNA, 25 bp, Homo sapien
gtatgctccttaagtgatttgaatc

SEQ ID NO: 299071 - DNA, 25 bp, Homo sapien
aaaaagcttatgattccaatttgaa

SEQ ID NO: 299072 - DNA, 25 bp, Homo sapien
tagtaaatagcacctctgttccctt

SEQ ID NO: 299073 - DNA, 25 bp, Homo sapien
agaatatttaacttagctcatgaaa

SEQ ID NO: 299074 - DNA, 25 bp, Homo sapien
tctgttcccttattgggtaaatgat

SEQ ID NO: 299075 - DNA, 25 bp, Homo sapien
gtaaatgattttccaactctgggaa

SEQ ID NO: 299076 - DNA, 25 bp, Homo sapien
tccaactctgggaatgtgtagaatt

SEQ ID NO: 299077 - DNA, 25 bp, Homo sapien
agaggcccgcctgaagccagcccgg

SEQ ID NO: 299078 - DNA, 25 bp, Homo sapien
ggcgccctagcagatgcacgtgtct

SEQ ID NO: 299079 - DNA, 25 bp, Homo sapien
tagcagatgcacgtgtctgtcgaat

SEQ ID NO: 299080 - DNA, 25 bp, Homo sapien
agatgcacgtgtctgtcgaatcgct

SEQ ID NO: 299081 - DNA, 25 bp, Homo sapien
atgcacgtgtctgtcgaatcgctgc

SEQ ID NO: 299082 - DNA, 25 bp, Homo sapien
tgtctgtcgaatcgctgcctccgag

SEQ ID NO: 299083 - DNA, 25 bp, Homo sapien
atgctgtcacccattccagcctaaa

SEQ ID NO: 299084 - DNA, 25 bp, Homo sapien
attccagcctaaatgtgaccataaa

SEQ ID NO: 299085 - DNA, 25 bp, Homo sapien
gaccataaaattagggctgctgctt

SEQ ID NO: 299086 - DNA, 25 bp, Homo sapien
aaattagggctgctgcttttatcga

SEQ ID NO: 299087 - DNA, 25 bp, Homo sapien
aattagggctgctgcttttatcgag

SEQ ID NO: 299088 - DNA, 25 bp, Homo sapien
aaactggcattaggttcttagtgga

SEQ ID NO: 299089 - DNA, 25 bp, Homo sapien
taggttcttagtggagtgtgtgttt

SEQ ID NO: 299090 - DNA, 25 bp, Homo sapien
gtgtgttttgtgtagaggtatgttt

SEQ ID NO: 299091 - DNA, 25 bp, Homo sapien
gatgaaaggttttgcactgttgcat

SEQ ID NO: 299092 - DNA, 25 bp, Homo sapien
gcactgttgcataaagaagtttgat

SEQ ID NO: 299093 - DNA, 25 bp, Homo sapien
gatattcatttggagactttttaag

SEQ ID NO: 299094 - DNA, 25 bp, Homo sapien
agatgtataatttccgtgtgtttaa

SEQ ID NO: 299095 - DNA, 25 bp, Homo sapien
atgaaatctgttgtcgatgtactaa

SEQ ID NO: 299096 - DNA, 25 bp, Homo sapien
gttgtcgatgtactaatcttggttt

SEQ ID NO: 299097 - DNA, 25 bp, Homo sapien
ctaatcttggtttacagcatcttga

SEQ ID NO: 299098 - DNA, 25 bp, Homo sapien
ggtttacagcatcttgaatacttga

SEQ ID NO: 299099 - DNA, 25 bp, Homo sapien
cgcgtgtgtgggtggatataaatat

SEQ ID NO: 299100 - DNA, 25 bp, Homo sapien
caaaaggaaccatgggtgaccctgc

SEQ ID NO: 299101 - DNA, 25 bp, Homo sapien
atgggtgaccctgcgatatccactg

SEQ ID NO: 299102 - DNA, 25 bp, Homo sapien
ctgcgatatccactgtcattttcca

SEQ ID NO: 299103 - DNA, 25 bp, Homo sapien
tccatagtggacattgttggcagca

SEQ ID NO: 299104 - DNA, 25 bp, Homo sapien
agtggacattgttggcagcataaag

SEQ ID NO: 299105 - DNA, 25 bp, Homo sapien
ggccttttttggctttagacactgg

SEQ ID NO: 299106 - DNA, 25 bp, Homo sapien
ggctttagacactggctgccagcta

SEQ ID NO: 299107 - DNA, 25 bp, Homo sapien
ggctgccagctatttttactagaac

SEQ ID NO: 299108 - DNA, 25 bp, Homo sapien
ttactagaacacagaaagcctatca

SEQ ID NO: 299109 - DNA, 25 bp, Homo sapien
aagcctatcaaagaccttgtgtgta

SEQ ID NO: 299110 - DNA, 25 bp, Homo sapien
aaatggatgtcttcagacctcgtga

SEQ ID NO: 299111 - DNA, 25 bp, Homo sapien
agacctcgtgaactgtgggcatatc

SEQ ID NO: 299112 - DNA, 25 bp, Homo sapien
gcatatcaaagattgccttggaaat

SEQ ID NO: 299113 - DNA, 25 bp, Homo sapien
gggatcaggaccagcctcgcaagca

SEQ ID NO: 299114 - DNA, 25 bp, Homo sapien
tatactgcttcattttactaacctg

SEQ ID NO: 299115 - DNA, 25 bp, Homo sapien
taacctgcatagatcactaaaacca

SEQ ID NO: 299116 - DNA, 25 bp, Homo sapien
agcttaaagcatagacacctcccaa

SEQ ID NO: 299117 - DNA, 25 bp, Homo sapien
gaccagcctcgcaagcattttaata

SEQ ID NO: 299118 - DNA, 25 bp, Homo sapien
aaaggtcttcccatcagtttgcaag

SEQ ID NO: 299119 - DNA, 25 bp, Homo sapien
gtgggaacaaccagaatcttacctg

SEQ ID NO: 299120 - DNA, 25 bp, Homo sapien
aggctgcttctttcacttgttttta

SEQ ID NO: 299121 - DNA, 25 bp, Homo sapien
gcttcggcattctccttaggactta

SEQ ID NO: 299122 - DNA, 25 bp, Homo sapien
ttcggcattctccttaggacttatc

SEQ ID NO: 299123 - DNA, 25 bp, Homo sapien
ggcattctccttaggacttatctgc

SEQ ID NO: 299124 - DNA, 25 bp, Homo sapien
ttctccttaggacttatctgcttgt

SEQ ID NO: 299125 - DNA, 25 bp, Homo sapien
tctccttaggacttatctgcttgta

SEQ ID NO: 299126 - DNA, 25 bp, Homo sapien
tccttaggacttatctgcttgtaga

SEQ ID NO: 299127 - DNA, 25 bp, Homo sapien
ggacttatctgcttgtagatttggc

SEQ ID NO: 299128 - DNA, 25 bp, Homo sapien
cttatctgcttgtagatttggctga

SEQ ID NO: 299129 - DNA, 25 bp, Homo sapien
ctgcttgtagatttggctgatccaa

SEQ ID NO: 299130 - DNA, 25 bp, Homo sapien
gcttgtagatttggctgatccaatt

SEQ ID NO: 299131 - DNA, 25 bp, Homo sapien
tctctgtaatttgtgctttaagcat

SEQ ID NO: 299132 - DNA, 25 bp, Homo sapien
ttacactttaatctgatgattggat

SEQ ID NO: 299133 - DNA, 25 bp, Homo sapien
gtgaaacatcatcttgttagctaac

SEQ ID NO: 299134 - DNA, 25 bp, Homo sapien
acatcatcttgttagctaactttaa

SEQ ID NO: 299135 - DNA, 25 bp, Homo sapien
ttaatgtatcagtttgaacctagaa

SEQ ID NO: 299136 - DNA, 25 bp, Homo sapien
gtttgaacctagaatattgaattaa

SEQ ID NO: 299137 - DNA, 25 bp, Homo sapien
gaattaaaatgctgtctcagtattt

SEQ ID NO: 299138 - DNA, 25 bp, Homo sapien
atggaggaaaattgcatcttagacc

SEQ ID NO: 299139 - DNA, 25 bp, Homo sapien
catcttagaccatttttatatgcag

SEQ ID NO: 299140 - DNA, 25 bp, Homo sapien
atatgcagtgtacaatttgctgggc

SEQ ID NO: 299141 - DNA, 25 bp, Homo sapien
agtgtacaatttgctgggctagaaa

SEQ ID NO: 299142 - DNA, 25 bp, Homo sapien
tttgctgggctagaaatgagataaa

SEQ ID NO: 299143 - DNA, 25 bp, Homo sapien
gtcaagcccaagaatacataagtgc

SEQ ID NO: 299144 - DNA, 25 bp, Homo sapien
gccaataattggtcttctgccatcc

SEQ ID NO: 299145 - DNA, 25 bp, Homo sapien
tcttctgccatccttgtcagataaa

SEQ ID NO: 299146 - DNA, 25 bp, Homo sapien
gccatccttgtcagataaattactt

SEQ ID NO: 299147 - DNA, 25 bp, Homo sapien
ccgcgtcgaccttgggaagagttga

SEQ ID NO: 299148 - DNA, 25 bp, Homo sapien
ttcctccaaccttcattcctttggg

SEQ ID NO: 299149 - DNA, 25 bp, Homo sapien
caatttacaatcataaggagtggga

SEQ ID NO: 299150 - DNA, 25 bp, Homo sapien
ttgacttggtagagtggacagagcc

SEQ ID NO: 299151 - DNA, 25 bp, Homo sapien
gacagagccatcagctggatagaag

SEQ ID NO: 299152 - DNA, 25 bp, Homo sapien
gatagaagattgcacctgacctcac

SEQ ID NO: 299153 - DNA, 25 bp, Homo sapien
ctcacccttgtcaagcccaagaata

SEQ ID NO: 299154 - DNA, 25 bp, Homo sapien
gaatataatatttccatttaggtaa

SEQ ID NO: 299155 - DNA, 25 bp, Homo sapien
gaatgtcataatttcaatttaatgt

SEQ ID NO: 299156 - DNA, 25 bp, Homo sapien
aaaatctattctcttacactaaata

SEQ ID NO: 299157 - DNA, 25 bp, Homo sapien
atctattctcttacactaaataaag

SEQ ID NO: 299158 - DNA, 25 bp, Homo sapien
aataaagtgttctttcaagatgcat

SEQ ID NO: 299159 - DNA, 25 bp, Homo sapien
taaagtgttctttcaagatgcattt

SEQ ID NO: 299160 - DNA, 25 bp, Homo sapien
tggtgtagtctaattcaataaagtc

SEQ ID NO: 299161 - DNA, 25 bp, Homo sapien
gtagtctaattcaataaagtcatca

SEQ ID NO: 299162 - DNA, 25 bp, Homo sapien
gtctaattcaataaagtcatcattt

SEQ ID NO: 299163 - DNA, 25 bp, Homo sapien
aaagtcatcatttctttgctatgac

SEQ ID NO: 299164 - DNA, 25 bp, Homo sapien
aagtcatcatttctttgctatgaca

SEQ ID NO: 299165 - DNA, 25 bp, Homo sapien
tttattctcctccttaccttgatga

SEQ ID NO: 299166 - DNA, 25 bp, Homo sapien
tcctccttaccttgatgactatggg

SEQ ID NO: 299167 - DNA, 25 bp, Homo sapien
gggagaccgaccagggactcagacg

SEQ ID NO: 299168 - DNA, 25 bp, Homo sapien
atgcaaagagcgattcaagaagatt

SEQ ID NO: 299169 - DNA, 25 bp, Homo sapien
gaagattcagaagctctggcaccaa

SEQ ID NO: 299170 - DNA, 25 bp, Homo sapien
aagctctggcaccaacacagtgtca

SEQ ID NO: 299171 - DNA, 25 bp, Homo sapien
tcacagaggaaattggacatgcaca

SEQ ID NO: 299172 - DNA, 25 bp, Homo sapien
aggaagccaatcagacactggttgg

SEQ ID NO: 299173 - DNA, 25 bp, Homo sapien
gacactggttggcattgactggcaa

SEQ ID NO: 299174 - DNA, 25 bp, Homo sapien
ggcattgactggcaacatttataat

SEQ ID NO: 299175 - DNA, 25 bp, Homo sapien
attattgcaccaccaaaaaacacaa

SEQ ID NO: 299176 - DNA, 25 bp, Homo sapien
ttatcatgatattcaggtagatcct

SEQ ID NO: 299177 - DNA, 25 bp, Homo sapien
tcaggtagatcctgggttctagaat

SEQ ID NO: 299178 - DNA, 25 bp, Homo sapien
gatcctgggttctagaatatttaaa

SEQ ID NO: 299179 - DNA, 25 bp, Homo sapien
gataaaccaaagagtcaacttgtta

SEQ ID NO: 299180 - DNA, 25 bp, Homo sapien
ggttttcactagtatgcccagtctg

SEQ ID NO: 299181 - DNA, 25 bp, Homo sapien
tttcactagtatgcccagtctggac

SEQ ID NO: 299182 - DNA, 25 bp, Homo sapien
tagtatgcccagtctggactccaag

SEQ ID NO: 299183 - DNA, 25 bp, Homo sapien
ccagtctggactccaagtcctgggc

SEQ ID NO: 299184 - DNA, 25 bp, Homo sapien
tcaggttcctgagtagctcaacatt

SEQ ID NO: 299185 - DNA, 25 bp, Homo sapien
cctgagtagctcaacattttatgta

SEQ ID NO: 299186 - DNA, 25 bp, Homo sapien
gaaatattcttccaaatgaactttt

SEQ ID NO: 299187 - DNA, 25 bp, Homo sapien
tggctgattaataccacggctcaca

SEQ ID NO: 299188 - DNA, 25 bp, Homo sapien
taataccacggctcacaacataaca

SEQ ID NO: 299189 - DNA, 25 bp, Homo sapien
tcacaacataacagagcggctcatt

SEQ ID NO: 299190 - DNA, 25 bp, Homo sapien
agagcggctcattccatgaacaacc

SEQ ID NO: 299191 - DNA, 25 bp, Homo sapien
tttcgaattctatcatctgggcaaa

SEQ ID NO: 299192 - DNA, 25 bp, Homo sapien
gagtgtaacttcctgttttctccaa

SEQ ID NO: 299193 - DNA, 25 bp, Homo sapien
ttctccaaactaaaacactacgcag

SEQ ID NO: 299194 - DNA, 25 bp, Homo sapien
aaacactacgcagattcctgtaccg

SEQ ID NO: 299195 - DNA, 25 bp, Homo sapien
tcctgtaccgctctgggacagaaat

SEQ ID NO: 299196 - DNA, 25 bp, Homo sapien
gagcagaggccgtccccagagtcca

SEQ ID NO: 299197 - DNA, 25 bp, Homo sapien
aaatactacccgctgctgtggtgac

SEQ ID NO: 299198 - DNA, 25 bp, Homo sapien
ttgtaagcctgaatcgcagcccaaa

SEQ ID NO: 299199 - DNA, 25 bp, Homo sapien
agggcagcaatgttgaagtgaccat

SEQ ID NO: 299200 - DNA, 25 bp, Homo sapien
taaagtggtcacttccaccgtgaag

SEQ ID NO: 299201 - DNA, 25 bp, Homo sapien
ttccaccgtgaagcgaaagagccag

SEQ ID NO: 299202 - DNA, 25 bp, Homo sapien
aagagccagtagtgaatcccctcat

SEQ ID NO: 299203 - DNA, 25 bp, Homo sapien
agtgaatcccctcattttgtgcatt

SEQ ID NO: 299204 - DNA, 25 bp, Homo sapien
actccctcttcatagtgttgtgttt

SEQ ID NO: 299205 - DNA, 25 bp, Homo sapien
agagagtagtccctcttgcattcaa

SEQ ID NO: 299206 - DNA, 25 bp, Homo sapien
tcttgcattcaaacctccttcaaaa

SEQ ID NO: 299207 - DNA, 25 bp, Homo sapien
gatgtttttcacttgcattgtcatt

SEQ ID NO: 299208 - DNA, 25 bp, Homo sapien
tgcattgtcattagatgtccagaaa

SEQ ID NO: 299209 - DNA, 25 bp, Homo sapien
ggctagtgtgcaggtgaccaccatt

SEQ ID NO: 299210 - DNA, 25 bp, Homo sapien
agcctccctagttctgaacacttgc

SEQ ID NO: 299211 - DNA, 25 bp, Homo sapien
gaacacttgcatcattcactaccgg

SEQ ID NO: 299212 - DNA, 25 bp, Homo sapien
ggcaccaggaattctctcactggct

SEQ ID NO: 299213 - DNA, 25 bp, Homo sapien
gctagcactggaaacccaagggtct

SEQ ID NO: 299214 - DNA, 25 bp, Homo sapien
agggtctagttcacctgttctaaag

SEQ ID NO: 299215 - DNA, 25 bp, Homo sapien
gcagttcctgtaccaccgtgatgag

SEQ ID NO: 299216 - DNA, 25 bp, Homo sapien
tgatgaggatcagctgccccttcga

SEQ ID NO: 299217 - DNA, 25 bp, Homo sapien
gatgagcactgaactgctgctggaa

SEQ ID NO: 299218 - DNA, 25 bp, Homo sapien
ggttgttgttgtcccagagtcgcca

SEQ ID NO: 299219 - DNA, 25 bp, Homo sapien
tcaactccctcaaggctagtgtgca

SEQ ID NO: 299220 - DNA, 25 bp, Homo sapien
gcttcagaattctttcatacaaggc

SEQ ID NO: 299221 - DNA, 25 bp, Homo sapien
ttcagaattctttcatacaaggcag

SEQ ID NO: 299222 - DNA, 25 bp, Homo sapien
gcttgaaagaccagagttgctacag

SEQ ID NO: 299223 - DNA, 25 bp, Homo sapien
gaaagaccagagttgctacagattg

SEQ ID NO: 299224 - DNA, 25 bp, Homo sapien
agaccagagttgctacagattgtta

SEQ ID NO: 299225 - DNA, 25 bp, Homo sapien
gctacagattgttattacatgttcc

SEQ ID NO: 299226 - DNA, 25 bp, Homo sapien
cagattgttattacatgttccataa

SEQ ID NO: 299227 - DNA, 25 bp, Homo sapien
tggtaaattacgcagcttggaaaaa

SEQ ID NO: 299228 - DNA, 25 bp, Homo sapien
attacgcagcttggaaaaagggata

SEQ ID NO: 299229 - DNA, 25 bp, Homo sapien
aaaagggatatttcttgcaaggcaa

SEQ ID NO: 299230 - DNA, 25 bp, Homo sapien
aagggatatttcttgcaaggcaata

SEQ ID NO: 299231 - DNA, 25 bp, Homo sapien
agaggtcactcacttgaactttgcc

SEQ ID NO: 299232 - DNA, 25 bp, Homo sapien
tcacttgaactttgccattccaggc

SEQ ID NO: 299233 - DNA, 25 bp, Homo sapien
attccaggcattctcagagtggcga

SEQ ID NO: 299234 - DNA, 25 bp, Homo sapien
gcacaacttggtgctcttactgtgt

SEQ ID NO: 299235 - DNA, 25 bp, Homo sapien
gtgctcttactgtgtccttcagaaa

SEQ ID NO: 299236 - DNA, 25 bp, Homo sapien
gtgtgctgaacaaagttttcaacaa

SEQ ID NO: 299237 - DNA, 25 bp, Homo sapien
ttcaacaattcctagttgtgccttt

SEQ ID NO: 299238 - DNA, 25 bp, Homo sapien
taaaccatgcaatattcaggatagt

SEQ ID NO: 299239 - DNA, 25 bp, Homo sapien
aagaagctgctatttgggtaactta

SEQ ID NO: 299240 - DNA, 25 bp, Homo sapien
atttgggtaacttatttctctgtgg

SEQ ID NO: 299241 - DNA, 25 bp, Homo sapien
gggcagggagagtcaccaaacaatc

SEQ ID NO: 299242 - DNA, 25 bp, Homo sapien
atcgccatggcgacagattatgact

SEQ ID NO: 299243 - DNA, 25 bp, Homo sapien
attatgactgctggaaggagcacga

SEQ ID NO: 299244 - DNA, 25 bp, Homo sapien
gagcacgaggaagcaatgatcaagt

SEQ ID NO: 299245 - DNA, 25 bp, Homo sapien
atgatcaagttccagatgatcctca

SEQ ID NO: 299246 - DNA, 25 bp, Homo sapien
ccttctacagaggactcctagactt

SEQ ID NO: 299247 - DNA, 25 bp, Homo sapien
aggactcctagacttcccatcagtg

SEQ ID NO: 299248 - DNA, 25 bp, Homo sapien
gttatcaacatgaccacagttccag

SEQ ID NO: 299249 - DNA, 25 bp, Homo sapien
acagttccagaggtggttcttgcta

SEQ ID NO: 299250 - DNA, 25 bp, Homo sapien
tggttcttgctaaggaggctggaat

SEQ ID NO: 299251 - DNA, 25 bp, Homo sapien
ggaggctggaatttgttacgcaagt

SEQ ID NO: 299252 - DNA, 25 bp, Homo sapien
atttgttacgcaagtatcgccatgg

SEQ ID NO: 299253 - DNA, 25 bp, Homo sapien
tttttggttatggtgctattcctaa

SEQ ID NO: 299254 - DNA, 25 bp, Homo sapien
ttggttatggtgctattcctaaggt

SEQ ID NO: 299255 - DNA, 25 bp, Homo sapien
ggttatggtgctattcctaaggtta

SEQ ID NO: 299256 - DNA, 25 bp, Homo sapien
ttatggtgctattcctaaggttaac

SEQ ID NO: 299257 - DNA, 25 bp, Homo sapien
atggtgctattcctaaggttaactt

SEQ ID NO: 299258 - DNA, 25 bp, Homo sapien
ggtgctattcctaaggttaactttg

SEQ ID NO: 299259 - DNA, 25 bp, Homo sapien
gctattcctaaggttaactttgaat

SEQ ID NO: 299260 - DNA, 25 bp, Homo sapien
taactttgaatatgtgacacacaca

SEQ ID NO: 299261 - DNA, 25 bp, Homo sapien
actttgaatatgtgacacacacact

SEQ ID NO: 299262 - DNA, 25 bp, Homo sapien
cacacacactcctaagtacctttaa

SEQ ID NO: 299263 - DNA, 25 bp, Homo sapien
cacacactcctaagtacctttaagg

SEQ ID NO: 299264 - DNA, 25 bp, Homo sapien
ggcgccggcgttggcattagtatca

SEQ ID NO: 299265 - DNA, 25 bp, Homo sapien
gccggcgttggcattagtatcattt

SEQ ID NO: 299266 - DNA, 25 bp, Homo sapien
cggcgttggcattagtatcatttga

SEQ ID NO: 299267 - DNA, 25 bp, Homo sapien
cgttggcattagtatcatttgaaga

SEQ ID NO: 299268 - DNA, 25 bp, Homo sapien
cattagtatcatttgaagacgtggt

SEQ ID NO: 299269 - DNA, 25 bp, Homo sapien
aagacgtggttgtgaccttcactgg

SEQ ID NO: 299270 - DNA, 25 bp, Homo sapien
agacgtggttgtgaccttcactgga

SEQ ID NO: 299271 - DNA, 25 bp, Homo sapien
acgtggttgtgaccttcactggaga

SEQ ID NO: 299272 - DNA, 25 bp, Homo sapien
tggttgtgaccttcactggagagga

SEQ ID NO: 299273 - DNA, 25 bp, Homo sapien
gttgtgaccttcactggagaggaat

SEQ ID NO: 299274 - DNA, 25 bp, Homo sapien
tgtgaccttcactggagaggaatgg

SEQ ID NO: 299275 - DNA, 25 bp, Homo sapien
aatgtgaaaagcctgcactcttcct

SEQ ID NO: 299276 - DNA, 25 bp, Homo sapien
atgtgaaaagcctgcactcttcctg

SEQ ID NO: 299277 - DNA, 25 bp, Homo sapien
ggtgccggggcgatgcttccaccct

SEQ ID NO: 299278 - DNA, 25 bp, Homo sapien
cttccaccctggactgagtgttcgg

SEQ ID NO: 299279 - DNA, 25 bp, Homo sapien
ttccaccctggactgagtgttcggg

SEQ ID NO: 299280 - DNA, 25 bp, Homo sapien
agcctgctcggctgtatgtttctcg

SEQ ID NO: 299281 - DNA, 25 bp, Homo sapien
cctgctcggctgtatgtttctcgca

SEQ ID NO: 299282 - DNA, 25 bp, Homo sapien
tgctcggctgtatgtttctcgcacg

SEQ ID NO: 299283 - DNA, 25 bp, Homo sapien
tcggctgtatgtttctcgcacgctc

SEQ ID NO: 299284 - DNA, 25 bp, Homo sapien
ggctgtatgtttctcgcacgctcac

SEQ ID NO: 299285 - DNA, 25 bp, Homo sapien
gctgtatgtttctcgcacgctcacc

SEQ ID NO: 299286 - DNA, 25 bp, Homo sapien
acagattatgactgctggaaggagc

SEQ ID NO: 299287 - DNA, 25 bp, Homo sapien
ttatgactgctggaaggagcacgag

SEQ ID NO: 299288 - DNA, 25 bp, Homo sapien
acctggggggcggatgttatcaaca

SEQ ID NO: 299289 - DNA, 25 bp, Homo sapien
gttatcaacatgaccacagttccag

SEQ ID NO: 299290 - DNA, 25 bp, Homo sapien
atcaacatgaccacagttccagagg

SEQ ID NO: 299291 - DNA, 25 bp, Homo sapien
atgaccacagttccagaggtggttc

SEQ ID NO: 299292 - DNA, 25 bp, Homo sapien
tccagaggtggttcttgctaaggag

SEQ ID NO: 299293 - DNA, 25 bp, Homo sapien
tggttcttgctaaggaggctggaat

SEQ ID NO: 299294 - DNA, 25 bp, Homo sapien
ggaggctggaatttgttacgcaagt

SEQ ID NO: 299295 - DNA, 25 bp, Homo sapien
gaatttgttacgcaagtatcgccat

SEQ ID NO: 299296 - DNA, 25 bp, Homo sapien
atttgttacgcaagtatcgccatgg

SEQ ID NO: 299297 - DNA, 25 bp, Homo sapien
caagcaaagccccttctctcattta

SEQ ID NO: 299298 - DNA, 25 bp, Homo sapien
tgaactccactgttacctctcagct

SEQ ID NO: 299299 - DNA, 25 bp, Homo sapien
ttctctcatttactctgcatccttt

SEQ ID NO: 299300 - DNA, 25 bp, Homo sapien
atttactctgcatccttttcagaag

SEQ ID NO: 299301 - DNA, 25 bp, Homo sapien
ctctgcatccttttcagaagaggta

SEQ ID NO: 299302 - DNA, 25 bp, Homo sapien
tgttacctctcagctacttcattta

SEQ ID NO: 299303 - DNA, 25 bp, Homo sapien
atggttggctaaggaggcagcatct

SEQ ID NO: 299304 - DNA, 25 bp, Homo sapien
tacctctcagctacttcatttattc

SEQ ID NO: 299305 - DNA, 25 bp, Homo sapien
gcagcatctctggtaaagtaacatt

SEQ ID NO: 299306 - DNA, 25 bp, Homo sapien
ttctttcaacaaatagctatccagc

SEQ ID NO: 299307 - DNA, 25 bp, Homo sapien
tcaacaaatagctatccagcctctc

SEQ ID NO: 299308 - DNA, 25 bp, Homo sapien
attttccacgtattcctgaggacgg

SEQ ID NO: 299309 - DNA, 25 bp, Homo sapien
gtattcctgaggacggactggaccg

SEQ ID NO: 299310 - DNA, 25 bp, Homo sapien
ggactggaccgtctatgttttttca

SEQ ID NO: 299311 - DNA, 25 bp, Homo sapien
gaccgtctatgttttttcagccctt

SEQ ID NO: 299312 - DNA, 25 bp, Homo sapien
tggacttttagagtagaagctgcac

SEQ ID NO: 299313 - DNA, 25 bp, Homo sapien
gtagaagctgcacttggcaataagc

SEQ ID NO: 299314 - DNA, 25 bp, Homo sapien
cttggcaataagctcgtgtcgtctg

SEQ ID NO: 299315 - DNA, 25 bp, Homo sapien
aataagctcgtgtcgtctgtcagag

SEQ ID NO: 299316 - DNA, 25 bp, Homo sapien
gtgtcgtctgtcagagcccctctct

SEQ ID NO: 299317 - DNA, 25 bp, Homo sapien
ctctctcaactctgtgacctgataa

SEQ ID NO: 299318 - DNA, 25 bp, Homo sapien
ctctgtgacctgataatgtttctaa

SEQ ID NO: 299319 - DNA, 25 bp, Homo sapien
cggttgtaagtagccagatccctct

SEQ ID NO: 299320 - DNA, 25 bp, Homo sapien
agatccctctccagtgacattggaa

SEQ ID NO: 299321 - DNA, 25 bp, Homo sapien
gacattggaacatgctactttttaa

SEQ ID NO: 299322 - DNA, 25 bp, Homo sapien
ttaattggccctgtacagtttgctt

SEQ ID NO: 299323 - DNA, 25 bp, Homo sapien
ggccctgtacagtttgcttatttat

SEQ ID NO: 299324 - DNA, 25 bp, Homo sapien
acactacaggtgttgaatggttaaa

SEQ ID NO: 299325 - DNA, 25 bp, Homo sapien
aatggttaaaatgtaggcctccagt

SEQ ID NO: 299326 - DNA, 25 bp, Homo sapien
tcagttattttctgagtgtgcagac

SEQ ID NO: 299327 - DNA, 25 bp, Homo sapien
gtgtgcagacagctatttcgcactg

SEQ ID NO: 299328 - DNA, 25 bp, Homo sapien
agacagctatttcgcactgtattaa

SEQ ID NO: 299329 - DNA, 25 bp, Homo sapien
cagtagacagatgttggtgcaatac

SEQ ID NO: 299330 - DNA, 25 bp, Homo sapien
attcctcatatgtcctcaatagtac

SEQ ID NO: 299331 - DNA, 25 bp, Homo sapien
atgtcctcaatagtacaattctaat

SEQ ID NO: 299332 - DNA, 25 bp, Homo sapien
ataaaatgggaagcaactgatttct

SEQ ID NO: 299333 - DNA, 25 bp, Homo sapien
ttctcagctaagaaaggctcattta

SEQ ID NO: 299334 - DNA, 25 bp, Homo sapien
caagctcagtatctttctgatttta

SEQ ID NO: 299335 - DNA, 25 bp, Homo sapien
aaaggctcatttatcacagaacaca

SEQ ID NO: 299336 - DNA, 25 bp, Homo sapien
cccactacgcttcccataattgaaa

SEQ ID NO: 299337 - DNA, 25 bp, Homo sapien
gattttatatcaaagtaccgcaaca

SEQ ID NO: 299338 - DNA, 25 bp, Homo sapien
aagtaccgcaacaatgcatcattgt

SEQ ID NO: 299339 - DNA, 25 bp, Homo sapien
caatgcatcattgtagttaatttat

SEQ ID NO: 299340 - DNA, 25 bp, Homo sapien
gaataaattcctcatatgtcctcaa

SEQ ID NO: 299341 - DNA, 25 bp, Homo sapien
ttttcattatacttggttcttcttt

SEQ ID NO: 299342 - DNA, 25 bp, Homo sapien
cttggctgttttatatctatgttgc

SEQ ID NO: 299343 - DNA, 25 bp, Homo sapien
atatctatgttgctgtcagcatggg

SEQ ID NO: 299344 - DNA, 25 bp, Homo sapien
ttgctgtcagcatgggaatctctat

SEQ ID NO: 299345 - DNA, 25 bp, Homo sapien
gtcagcatgggaatctctattatta

SEQ ID NO: 299346 - DNA, 25 bp, Homo sapien
gggaatctctattattagaaagcta

SEQ ID NO: 299347 - DNA, 25 bp, Homo sapien
acagttttagatggcctgtttgctc

SEQ ID NO: 299348 - DNA, 25 bp, Homo sapien
ttttagatggcctgtttgctctttc

SEQ ID NO: 299349 - DNA, 25 bp, Homo sapien
agatggcctgtttgctctttctaaa

SEQ ID NO: 299350 - DNA, 25 bp, Homo sapien
tggcctgtttgctctttctaaatat

SEQ ID NO: 299351 - DNA, 25 bp, Homo sapien
gcctgtttgctctttctaaatataa

SEQ ID NO: 299352 - DNA, 25 bp, Homo sapien
gcccaggtactcaaaccagcctggg

SEQ ID NO: 299353 - DNA, 25 bp, Homo sapien
ttcttcaaaatgtacttaggctctg

SEQ ID NO: 299354 - DNA, 25 bp, Homo sapien
gtacttaggctctggttactgggat

SEQ ID NO: 299355 - DNA, 25 bp, Homo sapien
taggctctggttactgggatggcca

SEQ ID NO: 299356 - DNA, 25 bp, Homo sapien
gatggccagtagatgtaatgcagat

SEQ ID NO: 299357 - DNA, 25 bp, Homo sapien
ttcagagggcccacgttcaagggat

SEQ ID NO: 299358 - DNA, 25 bp, Homo sapien
acctggagaccgactcttaaaagca

SEQ ID NO: 299359 - DNA, 25 bp, Homo sapien
ggagaccgactcttaaaagcacagt

SEQ ID NO: 299360 - DNA, 25 bp, Homo sapien
ttaaaagcacagtccgtggttgggt

SEQ ID NO: 299361 - DNA, 25 bp, Homo sapien
gcctgtaagtaagtctcagcccttt

SEQ ID NO: 299362 - DNA, 25 bp, Homo sapien
gtaagtaagtctcagccctttggag

SEQ ID NO: 299363 - DNA, 25 bp, Homo sapien
tctggcttataaaggtgcctggcct

SEQ ID NO: 299364 - DNA, 25 bp, Homo sapien
tggcttataaaggtgcctggcctgt

SEQ ID NO: 299365 - DNA, 25 bp, Homo sapien
ttataaaggtgcctggcctgtgcca

SEQ ID NO: 299366 - DNA, 25 bp, Homo sapien
agcatcttcagcacttaccgatcca

SEQ ID NO: 299367 - DNA, 25 bp, Homo sapien
catcttcagcacttaccgatccaga

SEQ ID NO: 299368 - DNA, 25 bp, Homo sapien
ggccttctccggtgtcctgtaccaa

SEQ ID NO: 299369 - DNA, 25 bp, Homo sapien
gtgtcctgtaccaactcttctattt

SEQ ID NO: 299370 - DNA, 25 bp, Homo sapien
taagagaacctcagatgatgtacct

SEQ ID NO: 299371 - DNA, 25 bp, Homo sapien
tcagatgatgtacctgagcctcagg

SEQ ID NO: 299372 - DNA, 25 bp, Homo sapien
agatgatgtacctgagcctcagggt

SEQ ID NO: 299373 - DNA, 25 bp, Homo sapien
tgtacctgagcctcagggttttgtt

SEQ ID NO: 299374 - DNA, 25 bp, Homo sapien
ttggtgcttctaaggactggtttgc

SEQ ID NO: 299375 - DNA, 25 bp, Homo sapien
gactggtttgcttgtacctgagaca

SEQ ID NO: 299376 - DNA, 25 bp, Homo sapien
tgtacctgagacacgttgcctacta

SEQ ID NO: 299377 - DNA, 25 bp, Homo sapien
agacacgttgcctactatcagtttg

SEQ ID NO: 299378 - DNA, 25 bp, Homo sapien
tactatcagtttggtcctgcctgca

SEQ ID NO: 299379 - DNA, 25 bp, Homo sapien
tgcactctggagaagccacaagaat

SEQ ID NO: 299380 - DNA, 25 bp, Homo sapien
tgacttttgctcatacacgacactg

SEQ ID NO: 299381 - DNA, 25 bp, Homo sapien
acacgacactgttgcaatgctgctc

SEQ ID NO: 299382 - DNA, 25 bp, Homo sapien
tgctgctcctctttggaagctcttt

SEQ ID NO: 299383 - DNA, 25 bp, Homo sapien
ttttttgcaactgccctgtatacaa

SEQ ID NO: 299384 - DNA, 25 bp, Homo sapien
aagtttactgattggtgcttctaag

SEQ ID NO: 299385 - DNA, 25 bp, Homo sapien
tttatcatctatctgtcagtcagtc

SEQ ID NO: 299386 - DNA, 25 bp, Homo sapien
cagtcagtcaggagcccctgggaag

SEQ ID NO: 299387 - DNA, 25 bp, Homo sapien
gtcaggagcccctgggaaggaacca

SEQ ID NO: 299388 - DNA, 25 bp, Homo sapien
gggaaggaaccagcatgtaacatgt

SEQ ID NO: 299389 - DNA, 25 bp, Homo sapien
atgctgggatgaggcagaacatcct

SEQ ID NO: 299390 - DNA, 25 bp, Homo sapien
gtgggccttaaatgtaatcacaggt

SEQ ID NO: 299391 - DNA, 25 bp, Homo sapien
atcacaggtagtatccttttaagag

SEQ ID NO: 299392 - DNA, 25 bp, Homo sapien
aaaagatttgactacaggagaaggc

SEQ ID NO: 299393 - DNA, 25 bp, Homo sapien
gaaactggagttatgtgctctgagg

SEQ ID NO: 299394 - DNA, 25 bp, Homo sapien
gaggaaggagccacgagccttccca

SEQ ID NO: 299395 - DNA, 25 bp, Homo sapien
gccttcccacacctagaagctgaaa

SEQ ID NO: 299396 - DNA, 25 bp, Homo sapien
attcactaataaggtactgaaggcc

SEQ ID NO: 299397 - DNA, 25 bp, Homo sapien
agctgagtgatttgtcacggccact

SEQ ID NO: 299398 - DNA, 25 bp, Homo sapien
gagtgatttgtcacggccactggta

SEQ ID NO: 299399 - DNA, 25 bp, Homo sapien
tttgtcacggccactggtagcaggg

SEQ ID NO: 299400 - DNA, 25 bp, Homo sapien
gtagcaggggtaccatacctcagga

SEQ ID NO: 299401 - DNA, 25 bp, Homo sapien
atacctcaggatcaccccaacgatg

SEQ ID NO: 299402 - DNA, 25 bp, Homo sapien
tcaccccaacgatgagcccatagat

SEQ ID NO: 299403 - DNA, 25 bp, Homo sapien
cgatgagcccatagatcatggccag

SEQ ID NO: 299404 - DNA, 25 bp, Homo sapien
acccggcggtgcttgaagagccaga

SEQ ID NO: 299405 - DNA, 25 bp, Homo sapien
ttctcagtagcgagctcctccatgg

SEQ ID NO: 299406 - DNA, 25 bp, Homo sapien
cagtagcgagctcctccatggcgct

SEQ ID NO: 299407 - DNA, 25 bp, Homo sapien
ggaaggatcccaggcacatggttca

SEQ ID NO: 299408 - DNA, 25 bp, Homo sapien
caggcacatggttcatcacgagcat

SEQ ID NO: 299409 - DNA, 25 bp, Homo sapien
catcacgagcatgagggaacagcaa

SEQ ID NO: 299410 - DNA, 25 bp, Homo sapien
acacagatggctggatccggtgcta

SEQ ID NO: 299411 - DNA, 25 bp, Homo sapien
ggatccggtgctacgggaaacattt

SEQ ID NO: 299412 - DNA, 25 bp, Homo sapien
aacattttcctaagatgcccatgag

SEQ ID NO: 299413 - DNA, 25 bp, Homo sapien
gatgcccatgagaacagaccaagat

SEQ ID NO: 299414 - DNA, 25 bp, Homo sapien
aacagaccaagatgtgtacagcact

SEQ ID NO: 299415 - DNA, 25 bp, Homo sapien
gatgtgtacagcactatgagcatta

SEQ ID NO: 299416 - DNA, 25 bp, Homo sapien
ttccagaatcaataatccgtggcaa

SEQ ID NO: 299417 - DNA, 25 bp, Homo sapien
aatccgtggcaacatatctctgtaa

SEQ ID NO: 299418 - DNA, 25 bp, Homo sapien
aggtattctttatagcagtacaaga

SEQ ID NO: 299419 - DNA, 25 bp, Homo sapien
gtacaagaactaatacagcacctaa

SEQ ID NO: 299420 - DNA, 25 bp, Homo sapien
gaactaatacagcacctaataggca

SEQ ID NO: 299421 - DNA, 25 bp, Homo sapien
gcacctaataggcattcaacaaata

SEQ ID NO: 299422 - DNA, 25 bp, Homo sapien
aacaaatagtaattccctgctcctt

SEQ ID NO: 299423 - DNA, 25 bp, Homo sapien
tgctccttctgcctaagcagacatg

SEQ ID NO: 299424 - DNA, 25 bp, Homo sapien
ctgcctaagcagacatgcatgggtt

SEQ ID NO: 299425 - DNA, 25 bp, Homo sapien
gcagacatgcatgggtttgtgtatc

SEQ ID NO: 299426 - DNA, 25 bp, Homo sapien
acatgcatgggtttgtgtatctaaa

SEQ ID NO: 299427 - DNA, 25 bp, Homo sapien
gtgtatctaaactgtaggactttac

SEQ ID NO: 299428 - DNA, 25 bp, Homo sapien
taaactgtaggactttacaaagact

SEQ ID NO: 299429 - DNA, 25 bp, Homo sapien
tgggtactctctaggtgcccgttca

SEQ ID NO: 299430 - DNA, 25 bp, Homo sapien
acatacagggccgtctgtcctttta

SEQ ID NO: 299431 - DNA, 25 bp, Homo sapien
tgtccttttacgtccaccagatcca

SEQ ID NO: 299432 - DNA, 25 bp, Homo sapien
tgaggaagtccacacagctcccatg

SEQ ID NO: 299433 - DNA, 25 bp, Homo sapien
tgcagtggccgcgattcgcaacggt

SEQ ID NO: 299434 - DNA, 25 bp, Homo sapien
agcaccagacagacttctcgttgat

SEQ ID NO: 299435 - DNA, 25 bp, Homo sapien
agacagacttctcgttgatgcggct

SEQ ID NO: 299436 - DNA, 25 bp, Homo sapien
acttctcgttgatgcggctccggta

SEQ ID NO: 299437 - DNA, 25 bp, Homo sapien
tgctgcgatggtgccggcttccgtt

SEQ ID NO: 299438 - DNA, 25 bp, Homo sapien
ccgcgccagcttcgagaaggatctg

SEQ ID NO: 299439 - DNA, 25 bp, Homo sapien
gcttcgagaaggatctgggtactct

SEQ ID NO: 299440 - DNA, 25 bp, Homo sapien
ggagaaagctccctccgttctgatg

SEQ ID NO: 299441 - DNA, 25 bp, Homo sapien
ccctccgttctgatgcttttgagct

SEQ ID NO: 299442 - DNA, 25 bp, Homo sapien
cttttgagcttatcagggacaccct

SEQ ID NO: 299443 - DNA, 25 bp, Homo sapien
cagcagaaattccagctgatccttc

SEQ ID NO: 299444 - DNA, 25 bp, Homo sapien
gatccttcagccttcagagttgatg

SEQ ID NO: 299445 - DNA, 25 bp, Homo sapien
gaatcgtgggtttcaagaactctgt

SEQ ID NO: 299446 - DNA, 25 bp, Homo sapien
gggtttcaagaactctgtggtctct

SEQ ID NO: 299447 - DNA, 25 bp, Homo sapien
ctctgtggtctcttaagcattggta

SEQ ID NO: 299448 - DNA, 25 bp, Homo sapien
gcattggtattccacagctacactt

SEQ ID NO: 299449 - DNA, 25 bp, Homo sapien
agctacacttccctgatactttgca

SEQ ID NO: 299450 - DNA, 25 bp, Homo sapien
gatactttgcactcagtaatgacaa

SEQ ID NO: 299451 - DNA, 25 bp, Homo sapien
atttccccagggtaagacggatgca

SEQ ID NO: 299452 - DNA, 25 bp, Homo sapien
ccccagggtaagacggatgcaggct

SEQ ID NO: 299453 - DNA, 25 bp, Homo sapien
taagacggatgcaggcttactgtct

SEQ ID NO: 299454 - DNA, 25 bp, Homo sapien
gacggatgcaggcttactgtctgat

SEQ ID NO: 299455 - DNA, 25 bp, Homo sapien
cggatgcaggcttactgtctgataa

SEQ ID NO: 299456 - DNA, 25 bp, Homo sapien
gatgcaggcttactgtctgataaga

SEQ ID NO: 299457 - DNA, 25 bp, Homo sapien
gcaggcttactgtctgataagatgg

SEQ ID NO: 299458 - DNA, 25 bp, Homo sapien
ggcttactgtctgataagatggttt

SEQ ID NO: 299459 - DNA, 25 bp, Homo sapien
gtctgataagatggttttgtctctc

SEQ ID NO: 299460 - DNA, 25 bp, Homo sapien
gataagatggttttgtctctctgtg

SEQ ID NO: 299461 - DNA, 25 bp, Homo sapien
aagatggttttgtctctctgtgtgt

SEQ ID NO: 299462 - DNA, 25 bp, Homo sapien
aatagacattgctatgtatagcggg

SEQ ID NO: 299463 - DNA, 25 bp, Homo sapien
agcaactcgggcatcagtgcaagca

SEQ ID NO: 299464 - DNA, 25 bp, Homo sapien
aactcgggcatcagtgcaagcacct

SEQ ID NO: 299465 - DNA, 25 bp, Homo sapien
gcacctgcagcagtaacgggaggat

SEQ ID NO: 299466 - DNA, 25 bp, Homo sapien
cacatacagcgaggtgatgggccac

SEQ ID NO: 299467 - DNA, 25 bp, Homo sapien
aggtgatgggccaccacccaggcgc

SEQ ID NO: 299468 - DNA, 25 bp, Homo sapien
gtttcagcagaacaatgcagagagc

SEQ ID NO: 299469 - DNA, 25 bp, Homo sapien
tgcagagagcacaatagtacccatc

SEQ ID NO: 299470 - DNA, 25 bp, Homo sapien
aatagtacccatcaaaggcaaagat

SEQ ID NO: 299471 - DNA, 25 bp, Homo sapien
ctggtctgattccttccaacgtgca

SEQ ID NO: 299472 - DNA, 25 bp, Homo sapien
tgattccttccaacgtgcacttcag

SEQ ID NO: 299473 - DNA, 25 bp, Homo sapien
aagtcaatgctgatacctgaagaaa

SEQ ID NO: 299474 - DNA, 25 bp, Homo sapien
tgctgatacctgaagaaagtcccat

SEQ ID NO: 299475 - DNA, 25 bp, Homo sapien
aagtcccatcagagatctgtgacct

SEQ ID NO: 299476 - DNA, 25 bp, Homo sapien
gagatctgtgacctgaatcttcata

SEQ ID NO: 299477 - DNA, 25 bp, Homo sapien
aatcttcataactttcacaggccct

SEQ ID NO: 299478 - DNA, 25 bp, Homo sapien
acaggccctttctaaatgccaagga

SEQ ID NO: 299479 - DNA, 25 bp, Homo sapien
tggagaagaatatgccacctatggc

SEQ ID NO: 299480 - DNA, 25 bp, Homo sapien
tatggcatcccaatatgcctgtgcc

SEQ ID NO: 299481 - DNA, 25 bp, Homo sapien
gggaatgaaacctgggtattctcat

SEQ ID NO: 299482 - DNA, 25 bp, Homo sapien
gcacttgtccacatattttattccg

SEQ ID NO: 299483 - DNA, 25 bp, Homo sapien
actgctgaaattggtcaggagctca

SEQ ID NO: 299484 - DNA, 25 bp, Homo sapien
tcgggcacagggtggccggccgtcg

SEQ ID NO: 299485 - DNA, 25 bp, Homo sapien
gggtggccggccgtcgcggccagga

SEQ ID NO: 299486 - DNA, 25 bp, Homo sapien
gggaggcggactccgccggtgcagc

SEQ ID NO: 299487 - DNA, 25 bp, Homo sapien
gacgcgggaggaccgggcctcatcg

SEQ ID NO: 299488 - DNA, 25 bp, Homo sapien
ggaggaccgggcctcatcgtcccgg

SEQ ID NO: 299489 - DNA, 25 bp, Homo sapien
ggaccgggcctcatcgtcccgggag

SEQ ID NO: 299490 - DNA, 25 bp, Homo sapien
tcatcgtcccgggagcgctccgcgt

SEQ ID NO: 299491 - DNA, 25 bp, Homo sapien
atcgtcccgggagcgctccgcgtcg

SEQ ID NO: 299492 - DNA, 25 bp, Homo sapien
gggagcgctccgcgtcgcgaggccg

SEQ ID NO: 299493 - DNA, 25 bp, Homo sapien
gcgcgctcctcatcccgggagagcg

SEQ ID NO: 299494 - DNA, 25 bp, Homo sapien
gctcctcatcccgggagagcggccg

SEQ ID NO: 299495 - DNA, 25 bp, Homo sapien
gacttggcctcctcccgggatgact

SEQ ID NO: 299496 - DNA, 25 bp, Homo sapien
ccgggatgacttcttccgcaccaag

SEQ ID NO: 299497 - DNA, 25 bp, Homo sapien
ggatgacttcttccgcaccaagccg

SEQ ID NO: 299498 - DNA, 25 bp, Homo sapien
ggccctctgacggtaacaaacgaga

SEQ ID NO: 299499 - DNA, 25 bp, Homo sapien
gccctctgacggtaacaaacgagac

SEQ ID NO: 299500 - DNA, 25 bp, Homo sapien
ggctcaagggcgctcgctcggccga

SEQ ID NO: 299501 - DNA, 25 bp, Homo sapien
gacggtaacaaacgagaccaggcca

SEQ ID NO: 299502 - DNA, 25 bp, Homo sapien
ggtaacaaacgagaccaggccacct

SEQ ID NO: 299503 - DNA, 25 bp, Homo sapien
acaaacgagaccaggccacctcgat

SEQ ID NO: 299504 - DNA, 25 bp, Homo sapien
agaccaggccacctcgatgtcccag

SEQ ID NO: 299505 - DNA, 25 bp, Homo sapien
gtcccagctccacctcatctgtggg

SEQ ID NO: 299506 - DNA, 25 bp, Homo sapien
ggatatatatttactctctgaacaa

SEQ ID NO: 299507 - DNA, 25 bp, Homo sapien
gtggacaagcactgtactcaaagga

SEQ ID NO: 299508 - DNA, 25 bp, Homo sapien
ctcaaaggatttcattgtttttctt

SEQ ID NO: 299509 - DNA, 25 bp, Homo sapien
gttaaaggccccaagtagttcaatg

SEQ ID NO: 299510 - DNA, 25 bp, Homo sapien
gccccaagtagttcaatggctagct

SEQ ID NO: 299511 - DNA, 25 bp, Homo sapien
atggctagcttttctcattatccca

SEQ ID NO: 299512 - DNA, 25 bp, Homo sapien
gctagcttttctcattatcccaatg

SEQ ID NO: 299513 - DNA, 25 bp, Homo sapien
tatcccaatgagatcaagtgctagg

SEQ ID NO: 299514 - DNA, 25 bp, Homo sapien
caagtgctaggactggattgaaatc

SEQ ID NO: 299515 - DNA, 25 bp, Homo sapien
aaaaaatccttccaggcattgagaa

SEQ ID NO: 299516 - DNA, 25 bp, Homo sapien
cttccaggcattgagaagtgcagcc

SEQ ID NO: 299517 - DNA, 25 bp, Homo sapien
gtaaatatcattttcaatggtgtat

SEQ ID NO: 299518 - DNA, 25 bp, Homo sapien
gtgtataatatttcatcataggatg

SEQ ID NO: 299519 - DNA, 25 bp, Homo sapien
aggatgacatcatggtttagttaac

SEQ ID NO: 299520 - DNA, 25 bp, Homo sapien
ggatatttgagggtctttccaaatt

SEQ ID NO: 299521 - DNA, 25 bp, Homo sapien
aaatttggccattgtaatttcacaa

SEQ ID NO: 299522 - DNA, 25 bp, Homo sapien
tgtaatttcacaatgtctttttcat

SEQ ID NO: 299523 - DNA, 25 bp, Homo sapien
aatgtctttttcattacctaactga

SEQ ID NO: 299524 - DNA, 25 bp, Homo sapien
gaagtccttttaatagctacatttc

SEQ ID NO: 299525 - DNA, 25 bp, Homo sapien
tagctacatttcattgactaagtgg

SEQ ID NO: 299526 - DNA, 25 bp, Homo sapien
atttcattgactaagtggaacttca

SEQ ID NO: 299527 - DNA, 25 bp, Homo sapien
agtggaacttcaagagacaggtaga

SEQ ID NO: 299528 - DNA, 25 bp, Homo sapien
cctttggtcttctgacacagcttgc

SEQ ID NO: 299529 - DNA, 25 bp, Homo sapien
ctttggtcttctgacacagcttgct

SEQ ID NO: 299530 - DNA, 25 bp, Homo sapien
tttggtcttctgacacagcttgctc

SEQ ID NO: 299531 - DNA, 25 bp, Homo sapien
acctacaactttctctgcatcaaaa

SEQ ID NO: 299532 - DNA, 25 bp, Homo sapien
cctacaactttctctgcatcaaaaa

SEQ ID NO: 299533 - DNA, 25 bp, Homo sapien
tacaactttctctgcatcaaaaact

SEQ ID NO: 299534 - DNA, 25 bp, Homo sapien
acaactttctctgcatcaaaaactt

SEQ ID NO: 299535 - DNA, 25 bp, Homo sapien
gtgggacagccttcagacatcagta

SEQ ID NO: 299536 - DNA, 25 bp, Homo sapien
tgggacagccttcagacatcagtag

SEQ ID NO: 299537 - DNA, 25 bp, Homo sapien
gggacagccttcagacatcagtagc

SEQ ID NO: 299538 - DNA, 25 bp, Homo sapien
ggacagccttcagacatcagtagca

SEQ ID NO: 299539 - DNA, 25 bp, Homo sapien
gttgagggcccaagtctagggtcta

SEQ ID NO: 299540 - DNA, 25 bp, Homo sapien
gtctagggtctaaacaaagccagga

SEQ ID NO: 299541 - DNA, 25 bp, Homo sapien
gccaggagtggtttggtatattact

SEQ ID NO: 299542 - DNA, 25 bp, Homo sapien
agtgcaatcattgcgtgccattcct

SEQ ID NO: 299543 - DNA, 25 bp, Homo sapien
tgccattcctgcactcaatgtattg

SEQ ID NO: 299544 - DNA, 25 bp, Homo sapien
tgggataaacccacagctggtccta

SEQ ID NO: 299545 - DNA, 25 bp, Homo sapien
ctggtcctacttggcctcttgaaaa

SEQ ID NO: 299546 - DNA, 25 bp, Homo sapien
gaaaaccattccatcattgtgccaa

SEQ ID NO: 299547 - DNA, 25 bp, Homo sapien
tcattgtgccaatctagcctgaaaa

SEQ ID NO: 299548 - DNA, 25 bp, Homo sapien
gaaaccattgattgtctcttgcctc

SEQ ID NO: 299549 - DNA, 25 bp, Homo sapien
tactccaggctttgcagtgatcata

SEQ ID NO: 299550 - DNA, 25 bp, Homo sapien
ggtattgttagcgttccatttgtga

SEQ ID NO: 299551 - DNA, 25 bp, Homo sapien
gttagcgttccatttgtgaacaaat

SEQ ID NO: 299552 - DNA, 25 bp, Homo sapien
ttgtgaacaaatgttcccttggctt

SEQ ID NO: 299553 - DNA, 25 bp, Homo sapien
aatgttcccttggctttagcagatg

SEQ ID NO: 299554 - DNA, 25 bp, Homo sapien
gtttcttttgtagaccgaacttctg

SEQ ID NO: 299555 - DNA, 25 bp, Homo sapien
ttgtagaccgaacttctgaagagta

SEQ ID NO: 299556 - DNA, 25 bp, Homo sapien
gaagagtaataccaaatgcctaaaa

SEQ ID NO: 299557 - DNA, 25 bp, Homo sapien
catttcatgaaatgatgtcagtttc

SEQ ID NO: 299558 - DNA, 25 bp, Homo sapien
gtggagaggacctaacatatgtctc

SEQ ID NO: 299559 - DNA, 25 bp, Homo sapien
ggacctaacatatgtctctacctag

SEQ ID NO: 299560 - DNA, 25 bp, Homo sapien
gtctctacctagaaaggatggtttc

SEQ ID NO: 299561 - DNA, 25 bp, Homo sapien
tgcccaggctgcaagcgatatgcct

SEQ ID NO: 299562 - DNA, 25 bp, Homo sapien
ggctgcaagcgatatgcctaggctc

SEQ ID NO: 299563 - DNA, 25 bp, Homo sapien
tgcaagcgatatgcctaggctcaag

SEQ ID NO: 299564 - DNA, 25 bp, Homo sapien
ccacctcaacttccggaagtgctga

SEQ ID NO: 299565 - DNA, 25 bp, Homo sapien
tcaacttccggaagtgctgagatta

SEQ ID NO: 299566 - DNA, 25 bp, Homo sapien
gagaggtatgattctttctagagat

SEQ ID NO: 299567 - DNA, 25 bp, Homo sapien
agattttttctcatggctactatta

SEQ ID NO: 299568 - DNA, 25 bp, Homo sapien
tcatggctactattagatcaggaat

SEQ ID NO: 299569 - DNA, 25 bp, Homo sapien
tcaggaatgggtgattggagattat

SEQ ID NO: 299570 - DNA, 25 bp, Homo sapien
gattctaggttaacttctaccactt

SEQ ID NO: 299571 - DNA, 25 bp, Homo sapien
ttctaccactttaccctaatacata

SEQ ID NO: 299572 - DNA, 25 bp, Homo sapien
gaaacgacatatccctaaatagtgc

SEQ ID NO: 299573 - DNA, 25 bp, Homo sapien
ttttgtgatcttgaggtcacttcgt

SEQ ID NO: 299574 - DNA, 25 bp, Homo sapien
gaggtcacttcgtttaggtcattat

SEQ ID NO: 299575 - DNA, 25 bp, Homo sapien
taggtcattatctcaacccaacctc

SEQ ID NO: 299576 - DNA, 25 bp, Homo sapien
ctccccaaactctggtttgagccaa

SEQ ID NO: 299577 - DNA, 25 bp, Homo sapien
ggtttgagccaatatgtgttctatt

SEQ ID NO: 299578 - DNA, 25 bp, Homo sapien
gtgttctattgttctcagagcacca

SEQ ID NO: 299579 - DNA, 25 bp, Homo sapien
gagcaccagccgactgtacaacaat

SEQ ID NO: 299580 - DNA, 25 bp, Homo sapien
ttaccaaaaccagtggacctcttat

SEQ ID NO: 299581 - DNA, 25 bp, Homo sapien
gtggacctcttatcaaatgctgctt

SEQ ID NO: 299582 - DNA, 25 bp, Homo sapien
atgctgcttggtaacaaaatctatc

SEQ ID NO: 299583 - DNA, 25 bp, Homo sapien
ggtccctggctaccttgttatgagg

SEQ ID NO: 299584 - DNA, 25 bp, Homo sapien
ctggctaccttgttatgaggttttg

SEQ ID NO: 299585 - DNA, 25 bp, Homo sapien
gaggttttgttatttctctgacaag

SEQ ID NO: 299586 - DNA, 25 bp, Homo sapien
tatttctctgacaagattgctttgg

SEQ ID NO: 299587 - DNA, 25 bp, Homo sapien
gattgctttggaaagagctgctttt

SEQ ID NO: 299588 - DNA, 25 bp, Homo sapien
aaagagctgcttttagggattattt

SEQ ID NO: 299589 - DNA, 25 bp, Homo sapien
gggagcagggttctcctcaaagcct

SEQ ID NO: 299590 - DNA, 25 bp, Homo sapien
agggttctcctcaaagcctcacaac

SEQ ID NO: 299591 - DNA, 25 bp, Homo sapien
aagcctcacaaccataggatcatag

SEQ ID NO: 299592 - DNA, 25 bp, Homo sapien
tgcttcccagctcagaacatatact

SEQ ID NO: 299593 - DNA, 25 bp, Homo sapien
gaaagtagccctcaaataaactgtt

SEQ ID NO: 299594 - DNA, 25 bp, Homo sapien
gagaggtatgattctttctagagat

SEQ ID NO: 299595 - DNA, 25 bp, Homo sapien
ggtatgattctttctagagattttt

SEQ ID NO: 299596 - DNA, 25 bp, Homo sapien
ctagagattttttctcatggctact

SEQ ID NO: 299597 - DNA, 25 bp, Homo sapien
agattttttctcatggctactatta

SEQ ID NO: 299598 - DNA, 25 bp, Homo sapien
gattttttctcatggctactattag

SEQ ID NO: 299599 - DNA, 25 bp, Homo sapien
tttctcatggctactattagatcag

SEQ ID NO: 299600 - DNA, 25 bp, Homo sapien
tcatggctactattagatcaggaat

SEQ ID NO: 299601 - DNA, 25 bp, Homo sapien
tcaggaatgggtgattggagattat

SEQ ID NO: 299602 - DNA, 25 bp, Homo sapien
gattggagattattagattctaggt

SEQ ID NO: 299603 - DNA, 25 bp, Homo sapien
gattctaggttaacttctaccactt

SEQ ID NO: 299604 - DNA, 25 bp, Homo sapien
ttctaccactttaccctaatacata

SEQ ID NO: 299605 - DNA, 25 bp, Homo sapien
caggattgacgaactgtatctggga

SEQ ID NO: 299606 - DNA, 25 bp, Homo sapien
gacgaactgtatctgggaaacccca

SEQ ID NO: 299607 - DNA, 25 bp, Homo sapien
ctcctgagcgtggaactgagcacct

SEQ ID NO: 299608 - DNA, 25 bp, Homo sapien
gagcgtggaactgagcacctcccgg

SEQ ID NO: 299609 - DNA, 25 bp, Homo sapien
gaaaaaaccaacctatgaccctgtg

SEQ ID NO: 299610 - DNA, 25 bp, Homo sapien
aacctatgaccctgtgagcgaggac

SEQ ID NO: 299611 - DNA, 25 bp, Homo sapien
gtgagcgaggaccaagaccccttgt

SEQ ID NO: 299612 - DNA, 25 bp, Homo sapien
aagaccccttgtccagcgacttcaa

SEQ ID NO: 299613 - DNA, 25 bp, Homo sapien
cttgtccagcgacttcaagaggctg

SEQ ID NO: 299614 - DNA, 25 bp, Homo sapien
gggctgaggtcacgctcatcgactt

SEQ ID NO: 299615 - DNA, 25 bp, Homo sapien
tcatcgacttcggtgaggagcccgt

SEQ ID NO: 299616 - DNA, 25 bp, Homo sapien
tcaccaaaaccagtacgggtttgtg

SEQ ID NO: 299617 - DNA, 25 bp, Homo sapien
agtacgggtttgtgattcctgtcat

SEQ ID NO: 299618 - DNA, 25 bp, Homo sapien
acgggtttgtgattcctgtcatgca

SEQ ID NO: 299619 - DNA, 25 bp, Homo sapien
gggtttgtgattcctgtcatgcatt

SEQ ID NO: 299620 - DNA, 25 bp, Homo sapien
tcctgtcatgcattgctcattcaga

SEQ ID NO: 299621 - DNA, 25 bp, Homo sapien
catgcattgctcattcagagatgct

SEQ ID NO: 299622 - DNA, 25 bp, Homo sapien
agagatgctcatctaacttgccctg

SEQ ID NO: 299623 - DNA, 25 bp, Homo sapien
gatgctcatctaacttgccctgaga

SEQ ID NO: 299624 - DNA, 25 bp, Homo sapien
atctaacttgccctgagactccaga

SEQ ID NO: 299625 - DNA, 25 bp, Homo sapien
gagactccagaactaaatccttatg

SEQ ID NO: 299626 - DNA, 25 bp, Homo sapien
aatccttatgtatgaaattacctac

SEQ ID NO: 299627 - DNA, 25 bp, Homo sapien
aaatctatgaaatcttacctgactg

SEQ ID NO: 299628 - DNA, 25 bp, Homo sapien
tctatgaaatcttacctgactgcag

SEQ ID NO: 299629 - DNA, 25 bp, Homo sapien
gaaatcttacctgactgcagattca

SEQ ID NO: 299630 - DNA, 25 bp, Homo sapien
atcttacctgactgcagattcatca

SEQ ID NO: 299631 - DNA, 25 bp, Homo sapien
tgactgcagattcatcaggaattcc

SEQ ID NO: 299632 - DNA, 25 bp, Homo sapien
agaatgcacagtgatgcatgcctct

SEQ ID NO: 299633 - DNA, 25 bp, Homo sapien
catgcctctaatccaaactacttga

SEQ ID NO: 299634 - DNA, 25 bp, Homo sapien
tgcctctaatccaaactacttgaga

SEQ ID NO: 299635 - DNA, 25 bp, Homo sapien
caacataataagactctaccttcat

SEQ ID NO: 299636 - DNA, 25 bp, Homo sapien
taataagactctaccttcataaaaa

SEQ ID NO: 299637 - DNA, 25 bp, Homo sapien
aaaaaattgtgcacacttgtgtgta

SEQ ID NO: 299638 - DNA, 25 bp, Homo sapien
atgatgacatcacccttacagttga

SEQ ID NO: 299639 - DNA, 25 bp, Homo sapien
ttacagttgaagcttcttgtcatga

SEQ ID NO: 299640 - DNA, 25 bp, Homo sapien
gaggcactcctcaatatggattccc

SEQ ID NO: 299641 - DNA, 25 bp, Homo sapien
tcaatatggattcccctggccctat

SEQ ID NO: 299642 - DNA, 25 bp, Homo sapien
cccctggccctatgctggatgaaaa

SEQ ID NO: 299643 - DNA, 25 bp, Homo sapien
ttagttcacctgaagatgacatggt

SEQ ID NO: 299644 - DNA, 25 bp, Homo sapien
agatgacatggttgttgccccagtc

SEQ ID NO: 299645 - DNA, 25 bp, Homo sapien
agtcacccatgtgtccgtcacatta

SEQ ID NO: 299646 - DNA, 25 bp, Homo sapien
ccgtcacattagatgggattcctga

SEQ ID NO: 299647 - DNA, 25 bp, Homo sapien
aaatatgcagactcaccgggagcct

SEQ ID NO: 299648 - DNA, 25 bp, Homo sapien
gagcctcatcaccagaacagcctaa

SEQ ID NO: 299649 - DNA, 25 bp, Homo sapien
cagttctgcaaaatgtttccaccac

SEQ ID NO: 299650 - DNA, 25 bp, Homo sapien
aaagctgacactagacactagctac

SEQ ID NO: 299651 - DNA, 25 bp, Homo sapien
agacactagctacacgtgggaatag

SEQ ID NO: 299652 - DNA, 25 bp, Homo sapien
gagccgccgcaaaggatgaagtcca

SEQ ID NO: 299653 - DNA, 25 bp, Homo sapien
gaagtccactcagatttgaggcaat

SEQ ID NO: 299654 - DNA, 25 bp, Homo sapien
aaagcaacttctctggtaatctcct

SEQ ID NO: 299655 - DNA, 25 bp, Homo sapien
tggtaatctcctcctcagccattct

SEQ ID NO: 299656 - DNA, 25 bp, Homo sapien
tacccaggatttcagaacacagaac

SEQ ID NO: 299657 - DNA, 25 bp, Homo sapien
aagccctgcaggatatatcacagct

SEQ ID NO: 299658 - DNA, 25 bp, Homo sapien
tgtcaagccaactataaggcagctt

SEQ ID NO: 299659 - DNA, 25 bp, Homo sapien
taaggcagctttctacaacagttct

SEQ ID NO: 299660 - DNA, 25 bp, Homo sapien
gggttgcatacaaagataacatata

SEQ ID NO: 299661 - DNA, 25 bp, Homo sapien
atgtcttctgcaaattttctagtat

SEQ ID NO: 299662 - DNA, 25 bp, Homo sapien
gtcttctgcaaattttctagtataa

SEQ ID NO: 299663 - DNA, 25 bp, Homo sapien
cttctgcaaattttctagtataaca

SEQ ID NO: 299664 - DNA, 25 bp, Homo sapien
aaatcattatgtttagaggtctaat

SEQ ID NO: 299665 - DNA, 25 bp, Homo sapien
tttagaggtctaatgctatgttttc

SEQ ID NO: 299666 - DNA, 25 bp, Homo sapien
tagaggtctaatgctatgttttcat

SEQ ID NO: 299667 - DNA, 25 bp, Homo sapien
gaggtctaatgctatgttttcatat

SEQ ID NO: 299668 - DNA, 25 bp, Homo sapien
aggtctaatgctatgttttcatatt

SEQ ID NO: 299669 - DNA, 25 bp, Homo sapien
tatgttttcatattacagagtgaat

SEQ ID NO: 299670 - DNA, 25 bp, Homo sapien
taaattttggaatcctctaaacatt

SEQ ID NO: 299671 - DNA, 25 bp, Homo sapien
gtcaagaatactgctatacctttat

SEQ ID NO: 299672 - DNA, 25 bp, Homo sapien
tacctttattattctcagcttcctc

SEQ ID NO: 299673 - DNA, 25 bp, Homo sapien
tttcctcacttgaaattgaaccttc

SEQ ID NO: 299674 - DNA, 25 bp, Homo sapien
aattgaaccttcattgtcagctaag

SEQ ID NO: 299675 - DNA, 25 bp, Homo sapien
gaaccttcattgtcagctaagtata

SEQ ID NO: 299676 - DNA, 25 bp, Homo sapien
ttttgtgttttcctggacagagtgc

SEQ ID NO: 299677 - DNA, 25 bp, Homo sapien
tttcctggacagagtgcaagtggct

SEQ ID NO: 299678 - DNA, 25 bp, Homo sapien
agtgcaagtggctcttatcagccaa

SEQ ID NO: 299679 - DNA, 25 bp, Homo sapien
gctcttatcagccaaggtggtgaag

SEQ ID NO: 299680 - DNA, 25 bp, Homo sapien
tctctgcacctgtgtgcgccatgac

SEQ ID NO: 299681 - DNA, 25 bp, Homo sapien
gtgtgcgccatgacacacccacatg

SEQ ID NO: 299682 - DNA, 25 bp, Homo sapien
ttctggagaaaaatgccggtccgga

SEQ ID NO: 299683 - DNA, 25 bp, Homo sapien
tgccggtccggaagcaagataccca

SEQ ID NO: 299684 - DNA, 25 bp, Homo sapien
aagatacccagagagcattgcacct

SEQ ID NO: 299685 - DNA, 25 bp, Homo sapien
gagcattgcaccttttggaggaata

SEQ ID NO: 299686 - DNA, 25 bp, Homo sapien
gacagacagctcagaagttccatag

SEQ ID NO: 299687 - DNA, 25 bp, Homo sapien
acgggttattaacatatttcagagc

SEQ ID NO: 299688 - DNA, 25 bp, Homo sapien
cagagcaacctctttcaggctttaa

SEQ ID NO: 299689 - DNA, 25 bp, Homo sapien
gaagtgaccttactggataatccaa

SEQ ID NO: 299690 - DNA, 25 bp, Homo sapien
gtatagatcgttcaaagccgtctga

SEQ ID NO: 299691 - DNA, 25 bp, Homo sapien
agccgtctgaaccaattcaacctgt

SEQ ID NO: 299692 - DNA, 25 bp, Homo sapien
tacttgggagatttccagccttcca

SEQ ID NO: 299693 - DNA, 25 bp, Homo sapien
aatgaacacttttgatatgatattg

SEQ ID NO: 299694 - DNA, 25 bp, Homo sapien
aaatgccttaattttgtggactgtt

SEQ ID NO: 299695 - DNA, 25 bp, Homo sapien
gccttaattttgtggactgtttatt

SEQ ID NO: 299696 - DNA, 25 bp, Homo sapien
ggactgtttatttcaacaggtggaa

SEQ ID NO: 299697 - DNA, 25 bp, Homo sapien
tggaagtgttggtcgtgcgaaatct

SEQ ID NO: 299698 - DNA, 25 bp, Homo sapien
ttggtcgtgcgaaatcttggtattc

SEQ ID NO: 299699 - DNA, 25 bp, Homo sapien
gcgaaatcttggtattcgcatttca

SEQ ID NO: 299700 - DNA, 25 bp, Homo sapien
attcgcatttcaagaagggagttct

SEQ ID NO: 299701 - DNA, 25 bp, Homo sapien
tcttctttctatggaacgtttcaag

SEQ ID NO: 299702 - DNA, 25 bp, Homo sapien
gaacgtttcaagtgattggatagaa

SEQ ID NO: 299703 - DNA, 25 bp, Homo sapien
tggatagaaagaagggctctgaagc

SEQ ID NO: 299704 - DNA, 25 bp, Homo sapien
cgtcagtgttccgtgagggaatgaa

SEQ ID NO: 299705 - DNA, 25 bp, Homo sapien
agcagaagtcaacatttttacagat

SEQ ID NO: 299706 - DNA, 25 bp, Homo sapien
cggaggcaagaggtctttctctgca

SEQ ID NO: 299707 - DNA, 25 bp, Homo sapien
gcagtttggtggatttccaacattt

SEQ ID NO: 299708 - DNA, 25 bp, Homo sapien
tgtttggaagaatttcctcagctgc

SEQ ID NO: 299709 - DNA, 25 bp, Homo sapien
atttcctcagctgcaccaatgaagt

SEQ ID NO: 299710 - DNA, 25 bp, Homo sapien
gcaccaatgaagtccttgatctata

SEQ ID NO: 299711 - DNA, 25 bp, Homo sapien
gatctatagaagtcggcagtcccta

SEQ ID NO: 299712 - DNA, 25 bp, Homo sapien
agtccctaaatctacgtctgcattt

SEQ ID NO: 299713 - DNA, 25 bp, Homo sapien
atctacgtctgcattttgttgcaaa

SEQ ID NO: 299714 - DNA, 25 bp, Homo sapien
gttgcaaatcctttataacattcca

SEQ ID NO: 299715 - DNA, 25 bp, Homo sapien
atgttccagccatcataaggtccaa

SEQ ID NO: 299716 - DNA, 25 bp, Homo sapien
ttttcctgttagtgacatgtagtcc

SEQ ID NO: 299717 - DNA, 25 bp, Homo sapien
agtgacatgtagtccctttgttcta

SEQ ID NO: 299718 - DNA, 25 bp, Homo sapien
tgtagtccctttgttctagtaggaa

SEQ ID NO: 299719 - DNA, 25 bp, Homo sapien
atattgttcctttagcctacttcct

SEQ ID NO: 299720 - DNA, 25 bp, Homo sapien
ttcctgcagcttccaatttatccaa

SEQ ID NO: 299721 - DNA, 25 bp, Homo sapien
gaaatgtctacaacaattttgttca

SEQ ID NO: 299722 - DNA, 25 bp, Homo sapien
aattttgttcaaaagtctgttctag

SEQ ID NO: 299723 - DNA, 25 bp, Homo sapien
acgtacttcagtgttcattattaaa

SEQ ID NO: 299724 - DNA, 25 bp, Homo sapien
aaaactacgccattactatatcata

SEQ ID NO: 299725 - DNA, 25 bp, Homo sapien
aatctgggatggatgttccagccat

SEQ ID NO: 299726 - DNA, 25 bp, Homo sapien
agacctttcctaccatgaagatgtt

SEQ ID NO: 299727 - DNA, 25 bp, Homo sapien
atgtcaggaatgaccgtgacggctg

SEQ ID NO: 299728 - DNA, 25 bp, Homo sapien
gacggctggaatccctctgtgtgca

SEQ ID NO: 299729 - DNA, 25 bp, Homo sapien
tgtgtgcatgaacttctgtgccgcc

SEQ ID NO: 299730 - DNA, 25 bp, Homo sapien
ttagctttgcccagagcacggttgt

SEQ ID NO: 299731 - DNA, 25 bp, Homo sapien
agcacggttgtccaggatgacccca

SEQ ID NO: 299732 - DNA, 25 bp, Homo sapien
ggctcgttcatctcttctcttggga

SEQ ID NO: 299733 - DNA, 25 bp, Homo sapien
agtcaccgtgtctgtacaccaagat

SEQ ID NO: 299734 - DNA, 25 bp, Homo sapien
tctgtacaccaagatgcaccttacg

SEQ ID NO: 299735 - DNA, 25 bp, Homo sapien
ccttcctgcccatatggtatgtgga

SEQ ID NO: 299736 - DNA, 25 bp, Homo sapien
ggaagctatgactcaggacctccca

SEQ ID NO: 299737 - DNA, 25 bp, Homo sapien
agaagacattgaccagctcatcacc

SEQ ID NO: 299738 - DNA, 25 bp, Homo sapien
agctcatcaccatcagcggcatggt

SEQ ID NO: 299739 - DNA, 25 bp, Homo sapien
agcggcatggtgatcaggacatccc

SEQ ID NO: 299740 - DNA, 25 bp, Homo sapien
tcccagctgattcccgagatgcagg

SEQ ID NO: 299741 - DNA, 25 bp, Homo sapien
cgagatgcaggaggccttcttccag

SEQ ID NO: 299742 - DNA, 25 bp, Homo sapien
aagtgtgtgcccacacgacccgggt

SEQ ID NO: 299743 - DNA, 25 bp, Homo sapien
tgtacagacaactcatctcttaccc

SEQ ID NO: 299744 - DNA, 25 bp, Homo sapien
gttattccaacttttgacatggctg

SEQ ID NO: 299745 - DNA, 25 bp, Homo sapien
tgaaatcttctttgaccgttaccct

SEQ ID NO: 299746 - DNA, 25 bp, Homo sapien
accgttaccctgactcaatcttaga

SEQ ID NO: 299747 - DNA, 25 bp, Homo sapien
gattcaagtaagaccattcaacgca

SEQ ID NO: 299748 - DNA, 25 bp, Homo sapien
gccaaagttgagagctagggaacag

SEQ ID NO: 299749 - DNA, 25 bp, Homo sapien
ggccaacaagttgcaagtaattcaa

SEQ ID NO: 299750 - DNA, 25 bp, Homo sapien
gcaagtaattcaaatctccattgga

SEQ ID NO: 299751 - DNA, 25 bp, Homo sapien
aaggggcttctcacagagcaaggcg

SEQ ID NO: 299752 - DNA, 25 bp, Homo sapien
agagcaaggcggcagctccagggct

SEQ ID NO: 299753 - DNA, 25 bp, Homo sapien
tctgccactgccatgcagatggcaa

SEQ ID NO: 299754 - DNA, 25 bp, Homo sapien
tggcaagatggccaaggcagcccct

SEQ ID NO: 299755 - DNA, 25 bp, Homo sapien
gtcaaatcagaatctgtgagggcat

SEQ ID NO: 299756 - DNA, 25 bp, Homo sapien
ctgtgagggcatagtcagggagcat

SEQ ID NO: 299757 - DNA, 25 bp, Homo sapien
cagggagcatgagtaggagattcca

SEQ ID NO: 299758 - DNA, 25 bp, Homo sapien
gagattccagtgtgcagccaaagtt

SEQ ID NO: 299759 - DNA, 25 bp, Homo sapien
cagctctaaaataccagcaactttt

SEQ ID NO: 299760 - DNA, 25 bp, Homo sapien
gggacaatctgacatagcaattact

SEQ ID NO: 299761 - DNA, 25 bp, Homo sapien
gatgatttcctgacagtgactggga

SEQ ID NO: 299762 - DNA, 25 bp, Homo sapien
actgggaagaccgtgcgcttgctct

SEQ ID NO: 299763 - DNA, 25 bp, Homo sapien
gaagaccgtgcgcttgctctgaagc

SEQ ID NO: 299764 - DNA, 25 bp, Homo sapien
gctctgaagccttgtgagcaaggaa

SEQ ID NO: 299765 - DNA, 25 bp, Homo sapien
tgcatgtcctgcttgctgcacgcca

SEQ ID NO: 299766 - DNA, 25 bp, Homo sapien
ttgctgcacgccacatgggtgtggt

SEQ ID NO: 299767 - DNA, 25 bp, Homo sapien
tctgcatctcagttggccgccatca

SEQ ID NO: 299768 - DNA, 25 bp, Homo sapien
gttggccgccatcagtgtaaataga

SEQ ID NO: 299769 - DNA, 25 bp, Homo sapien
gcttaaagtcatggtttggctgcat

SEQ ID NO: 299770 - DNA, 25 bp, Homo sapien
aggacttctttggacgtgtggtcgt

SEQ ID NO: 299771 - DNA, 25 bp, Homo sapien
gtggtcgtcaggagcacagcagtcc

SEQ ID NO: 299772 - DNA, 25 bp, Homo sapien
acacggccccggagcaggactcagt

SEQ ID NO: 299773 - DNA, 25 bp, Homo sapien
aggagcgaggtctggttccgcttca

SEQ ID NO: 299774 - DNA, 25 bp, Homo sapien
tggttccgcttcaacgagggtgtct

SEQ ID NO: 299775 - DNA, 25 bp, Homo sapien
aacgagggtgtctccaacgccgtgc

SEQ ID NO: 299776 - DNA, 25 bp, Homo sapien
tgcggcgcagcctgtacatcaggga

SEQ ID NO: 299777 - DNA, 25 bp, Homo sapien
acatcagggacttgctctagttctc

SEQ ID NO: 299778 - DNA, 25 bp, Homo sapien
tctagttctctgagccgcggacatg

SEQ ID NO: 299779 - DNA, 25 bp, Homo sapien
attgcttcccgcagagtgcagagac

SEQ ID NO: 299780 - DNA, 25 bp, Homo sapien
gatgtctttataaagtcacaccttt

SEQ ID NO: 299781 - DNA, 25 bp, Homo sapien
ttcaaaagtctcatttaagctcatt

SEQ ID NO: 299782 - DNA, 25 bp, Homo sapien
atttaagctcattcatgccctttct

SEQ ID NO: 299783 - DNA, 25 bp, Homo sapien
cctttctcttatgtagtcttcttcg

SEQ ID NO: 299784 - DNA, 25 bp, Homo sapien
tatgtagtcttcttcgatacgaaag

SEQ ID NO: 299785 - DNA, 25 bp, Homo sapien
ggaataaatatccattagagctttt

SEQ ID NO: 299786 - DNA, 25 bp, Homo sapien
ttcttttttcctggactgagtttgg

SEQ ID NO: 299787 - DNA, 25 bp, Homo sapien
ttggctgaccaacaaaatctctcaa

SEQ ID NO: 299788 - DNA, 25 bp, Homo sapien
gaccaacaaaatctctcaagccatt

SEQ ID NO: 299789 - DNA, 25 bp, Homo sapien
attttttctcctgatttaatggtca

SEQ ID NO: 299790 - DNA, 25 bp, Homo sapien
cacaattatatccaactgatccatg

SEQ ID NO: 299791 - DNA, 25 bp, Homo sapien
ctgatccatgttgtatatgccttat

SEQ ID NO: 299792 - DNA, 25 bp, Homo sapien
cagggatcttgatagatgttctaac

SEQ ID NO: 299793 - DNA, 25 bp, Homo sapien
gatagatgttctaaccaaggcattg

SEQ ID NO: 299794 - DNA, 25 bp, Homo sapien
tgttctaaccaaggcattgaggatt

SEQ ID NO: 299795 - DNA, 25 bp, Homo sapien
ctaccatttaagtttgcatctgaat

SEQ ID NO: 299796 - DNA, 25 bp, Homo sapien
ataacaactttgaatgaggtgtttc

SEQ ID NO: 299797 - DNA, 25 bp, Homo sapien
gcatctgaatgaaaggtgtgatcca

SEQ ID NO: 299798 - DNA, 25 bp, Homo sapien
aaaggtgtgatccagagagtataac

SEQ ID NO: 299799 - DNA, 25 bp, Homo sapien
gagagtataacatcactggttaagc

SEQ ID NO: 299800 - DNA, 25 bp, Homo sapien
acatcactggttaagcagcacatct

SEQ ID NO: 299801 - DNA, 25 bp, Homo sapien
cactggttaagcagcacatctctga

SEQ ID NO: 299802 - DNA, 25 bp, Homo sapien
cacatctctgatgccaaattgacag

SEQ ID NO: 299803 - DNA, 25 bp, Homo sapien
gacgccctcacccaactgggcaact

SEQ ID NO: 299804 - DNA, 25 bp, Homo sapien
aactgggcaactgcgcctggcgcgt

SEQ ID NO: 299805 - DNA, 25 bp, Homo sapien
ggcaactgcgcctggcgcgtcaacg

SEQ ID NO: 299806 - DNA, 25 bp, Homo sapien
gtcaacgggcgcgtgctggacctgg

SEQ ID NO: 299807 - DNA, 25 bp, Homo sapien
aacgggcgcgtgctggacctggtgc

SEQ ID NO: 299808 - DNA, 25 bp, Homo sapien
aagggctgcccccagctaggcgtgc

SEQ ID NO: 299809 - DNA, 25 bp, Homo sapien
gtgagctggcgcactgccagaaggt

SEQ ID NO: 299810 - DNA, 25 bp, Homo sapien
aaggtggcccgggagatgcacagcc

SEQ ID NO: 299811 - DNA, 25 bp, Homo sapien
ggcccgggagatgcacagcctgcgg

SEQ ID NO: 299812 - DNA, 25 bp, Homo sapien
tctcgctggcgcagcacctgcggga

SEQ ID NO: 299813 - DNA, 25 bp, Homo sapien
tggcgcagcacctgcgggaccgcgt

SEQ ID NO: 299814 - DNA, 25 bp, Homo sapien
aatgttctagtgtagagtctgagac

SEQ ID NO: 299815 - DNA, 25 bp, Homo sapien
tctgagacgggcaagtggttgctcc

SEQ ID NO: 299816 - DNA, 25 bp, Homo sapien
gcaagtggttgctccaggattactc

SEQ ID NO: 299817 - DNA, 25 bp, Homo sapien
aaggaatcaaatccacgagtggaaa

SEQ ID NO: 299818 - DNA, 25 bp, Homo sapien
ttaattgactaattgccctgctgtt

SEQ ID NO: 299819 - DNA, 25 bp, Homo sapien
gccctgctgttttactggtgtatag

SEQ ID NO: 299820 - DNA, 25 bp, Homo sapien
ggatacttgtacataggtaaccaat

SEQ ID NO: 299821 - DNA, 25 bp, Homo sapien
taaccaatgtacatgggaggccaca

SEQ ID NO: 299822 - DNA, 25 bp, Homo sapien
ggaggccacatattttgttcactgt

SEQ ID NO: 299823 - DNA, 25 bp, Homo sapien
gtatctatatttcacatgtggaaac

SEQ ID NO: 299824 - DNA, 25 bp, Homo sapien
acatgtggaaactttcagggtggtt

SEQ ID NO: 299825 - DNA, 25 bp, Homo sapien
gagcaacactatcgtgtcttacaaa

SEQ ID NO: 299826 - DNA, 25 bp, Homo sapien
ctatcgtgtcttacaaaagttgttc

SEQ ID NO: 299827 - DNA, 25 bp, Homo sapien
gtaaatgatcatcacatttcgtgaa

SEQ ID NO: 299828 - DNA, 25 bp, Homo sapien
catttcgtgaattgaggccatgttc

SEQ ID NO: 299829 - DNA, 25 bp, Homo sapien
tcaggtgctaaggaagttcgccttt

SEQ ID NO: 299830 - DNA, 25 bp, Homo sapien
gaagttcgccttttacacagaagat

SEQ ID NO: 299831 - DNA, 25 bp, Homo sapien
ataaatcagacgttacagtggtgac

SEQ ID NO: 299832 - DNA, 25 bp, Homo sapien
ggtgacgtagtaaccatcatggcaa

SEQ ID NO: 299833 - DNA, 25 bp, Homo sapien
gaaaggagtccaattcatagcctaa

SEQ ID NO: 299834 - DNA, 25 bp, Homo sapien
cttcaaatgtattcttaggagtcag

SEQ ID NO: 299835 - DNA, 25 bp, Homo sapien
attttacccacaatagctgcctatt

SEQ ID NO: 299836 - DNA, 25 bp, Homo sapien
agctcctgtctggttagaggctgaa

SEQ ID NO: 299837 - DNA, 25 bp, Homo sapien
gaaagaaggaccagggtcaatccgg

SEQ ID NO: 299838 - DNA, 25 bp, Homo sapien
ggtctgagcgacacctaccctaggg

SEQ ID NO: 299839 - DNA, 25 bp, Homo sapien
gggtcttggtgtcctctgacttctg

SEQ ID NO: 299840 - DNA, 25 bp, Homo sapien
tgtcctctgacttctgtcctcagaa

SEQ ID NO: 299841 - DNA, 25 bp, Homo sapien
gtcctcagaagggagctcagaatgc

SEQ ID NO: 299842 - DNA, 25 bp, Homo sapien
agaatgcagctgaggcttcccctgg

SEQ ID NO: 299843 - DNA, 25 bp, Homo sapien
gtgccccaggtggatcagcgaatgc

SEQ ID NO: 299844 - DNA, 25 bp, Homo sapien
ggtggatcagcgaatgcccctgaag

SEQ ID NO: 299845 - DNA, 25 bp, Homo sapien
gaatgcccctgaagccaggtgccag

SEQ ID NO: 299846 - DNA, 25 bp, Homo sapien
ctgaagccaggtgccagttgcatcc

SEQ ID NO: 299847 - DNA, 25 bp, Homo sapien
ccagctactgaggagacttgaggta

SEQ ID NO: 299848 - DNA, 25 bp, Homo sapien
gagcgaaactgggtctcaagttaaa

SEQ ID NO: 299849 - DNA, 25 bp, Homo sapien
aaaaacccacagcacacccttcgcg

SEQ ID NO: 299850 - DNA, 25 bp, Homo sapien
ttcgcggctgtcagcgctctcctga

SEQ ID NO: 299851 - DNA, 25 bp, Homo sapien
ggctgtcagcgctctcctgatgtca

SEQ ID NO: 299852 - DNA, 25 bp, Homo sapien
tgtcagcgctctcctgatgtcacag

SEQ ID NO: 299853 - DNA, 25 bp, Homo sapien
tcagcgctctcctgatgtcacagtg

SEQ ID NO: 299854 - DNA, 25 bp, Homo sapien
agcgctctcctgatgtcacagtggc

SEQ ID NO: 299855 - DNA, 25 bp, Homo sapien
gctctcctgatgtcacagtggctgc

SEQ ID NO: 299856 - DNA, 25 bp, Homo sapien
tctcctgatgtcacagtggctgcgt

SEQ ID NO: 299857 - DNA, 25 bp, Homo sapien
cctgatgtcacagtggctgcgtgtc

SEQ ID NO: 299858 - DNA, 25 bp, Homo sapien
gccttcgctcctcaccatgtgtaag

SEQ ID NO: 299859 - DNA, 25 bp, Homo sapien
gcctgaggtgccctaaacacactat

SEQ ID NO: 299860 - DNA, 25 bp, Homo sapien
cctgaggtgccctaaacacactatg

SEQ ID NO: 299861 - DNA, 25 bp, Homo sapien
tgaggtgccctaaacacactatgac

SEQ ID NO: 299862 - DNA, 25 bp, Homo sapien
aggtgccctaaacacactatgaccg

SEQ ID NO: 299863 - DNA, 25 bp, Homo sapien
gtgccctaaacacactatgaccgct

SEQ ID NO: 299864 - DNA, 25 bp, Homo sapien
aaacacactatgaccgctcccgaaa

SEQ ID NO: 299865 - DNA, 25 bp, Homo sapien
aacacactatgaccgctcccgaaaa

SEQ ID NO: 299866 - DNA, 25 bp, Homo sapien
tgaccgctcccgaaaagcccgtgaa

SEQ ID NO: 299867 - DNA, 25 bp, Homo sapien
gctcccgaaaagcccgtgaaacaag

SEQ ID NO: 299868 - DNA, 25 bp, Homo sapien
acaagaggaaatggctgccttggac

SEQ ID NO: 299869 - DNA, 25 bp, Homo sapien
ggactgattactcattagctgccat

SEQ ID NO: 299870 - DNA, 25 bp, Homo sapien
agctctgacttacaaacccaggctg

SEQ ID NO: 299871 - DNA, 25 bp, Homo sapien
tcgtaggtagtggtgtgctgccatc

SEQ ID NO: 299872 - DNA, 25 bp, Homo sapien
gtgctgccatctatagtgtaatcat

SEQ ID NO: 299873 - DNA, 25 bp, Homo sapien
tcattttccaagtcagctactgctt

SEQ ID NO: 299874 - DNA, 25 bp, Homo sapien
tgcctttgcccagaattcatgtcag

SEQ ID NO: 299875 - DNA, 25 bp, Homo sapien
ttcatgtcaggatttctttttccac

SEQ ID NO: 299876 - DNA, 25 bp, Homo sapien
gccatcagcaacgttcaacaaacat

SEQ ID NO: 299877 - DNA, 25 bp, Homo sapien
aaacatttttggagaccctactatg

SEQ ID NO: 299878 - DNA, 25 bp, Homo sapien
gaccctactatgttccagccattgt

SEQ ID NO: 299879 - DNA, 25 bp, Homo sapien
gccattgtcctgcttgagatgcagc

SEQ ID NO: 299880 - DNA, 25 bp, Homo sapien
tcagacagctttcatccactgctct

SEQ ID NO: 299881 - DNA, 25 bp, Homo sapien
atccactgctctgcactagaattgc

SEQ ID NO: 299882 - DNA, 25 bp, Homo sapien
tgctctgcactagaattgcacaaat

SEQ ID NO: 299883 - DNA, 25 bp, Homo sapien
gcacaaatcttcatggtgagcaatt

SEQ ID NO: 299884 - DNA, 25 bp, Homo sapien
ataatatttggcttcccattgctct

SEQ ID NO: 299885 - DNA, 25 bp, Homo sapien
tcccattgctctttggagttgttta

SEQ ID NO: 299886 - DNA, 25 bp, Homo sapien
ttgacaacctcctcattagtttctt

SEQ ID NO: 299887 - DNA, 25 bp, Homo sapien
caacctcctcattagtttcttaaat

SEQ ID NO: 299888 - DNA, 25 bp, Homo sapien
gtttcttaaatgagtactggtttgt

SEQ ID NO: 299889 - DNA, 25 bp, Homo sapien
attatcaacattatccattccattt

SEQ ID NO: 299890 - DNA, 25 bp, Homo sapien
aacattatccattccatttatgaag

SEQ ID NO: 299891 - DNA, 25 bp, Homo sapien
atcaggttgacagcaccacaaatgt

SEQ ID NO: 299892 - DNA, 25 bp, Homo sapien
accacaaatgtttactcagtctgag

SEQ ID NO: 299893 - DNA, 25 bp, Homo sapien
tactcagtctgagcaggtgtgtagt

SEQ ID NO: 299894 - DNA, 25 bp, Homo sapien
gcaggtgtgtagtatccaagaataa

SEQ ID NO: 299895 - DNA, 25 bp, Homo sapien
caaatacctatagcagactgagact

SEQ ID NO: 299896 - DNA, 25 bp, Homo sapien
gactgaatatcataagactgtgcaa

SEQ ID NO: 299897 - DNA, 25 bp, Homo sapien
gcaaacacattccaacactatttcc

SEQ ID NO: 299898 - DNA, 25 bp, Homo sapien
cactatttcccacccaacaatagaa

SEQ ID NO: 299899 - DNA, 25 bp, Homo sapien
acaatagaatctgcaggagtcctct

SEQ ID NO: 299900 - DNA, 25 bp, Homo sapien
tctgcaggagtcctctaggaggcct

SEQ ID NO: 299901 - DNA, 25 bp, Homo sapien
agtggcatatactattggagaaatc

SEQ ID NO: 299902 - DNA, 25 bp, Homo sapien
gaggtggagaagctcgccggccgcg

SEQ ID NO: 299903 - DNA, 25 bp, Homo sapien
tgctgcgaggaagacccggtcagct

SEQ ID NO: 299904 - DNA, 25 bp, Homo sapien
aggaagacccggtcagctgtccctt

SEQ ID NO: 299905 - DNA, 25 bp, Homo sapien
gagatgtgggcctcggagctgcgtg

SEQ ID NO: 299906 - DNA, 25 bp, Homo sapien
ggcccgggctgtgcggattccctaa

SEQ ID NO: 299907 - DNA, 25 bp, Homo sapien
ggattccctaaacgccgcacttgcg

SEQ ID NO: 299908 - DNA, 25 bp, Homo sapien
acagccccttacgtaaccgtcagtg

SEQ ID NO: 299909 - DNA, 25 bp, Homo sapien
aaggttgtggctaggaagttcctga

SEQ ID NO: 299910 - DNA, 25 bp, Homo sapien
gctaggaagttcctgacaacccagg

SEQ ID NO: 299911 - DNA, 25 bp, Homo sapien
acaacccagggccagtgagtgtctc

SEQ ID NO: 299912 - DNA, 25 bp, Homo sapien
ccagtgagtgtctcggaagcctgtg

SEQ ID NO: 299913 - DNA, 25 bp, Homo sapien
tcagagatgttcatgcaggctccct

SEQ ID NO: 299914 - DNA, 25 bp, Homo sapien
gatgttcatgcaggctccctagggc

SEQ ID NO: 299915 - DNA, 25 bp, Homo sapien
tttccatggagatagggcactgagg

SEQ ID NO: 299916 - DNA, 25 bp, Homo sapien
agatagggcactgaggctcccgtga

SEQ ID NO: 299917 - DNA, 25 bp, Homo sapien
aggctcccgtgaggttggaatcgac

SEQ ID NO: 299918 - DNA, 25 bp, Homo sapien
ctcccgtgaggttggaatcgacttc

SEQ ID NO: 299919 - DNA, 25 bp, Homo sapien
caggctggcagtagcactgctgaga

SEQ ID NO: 299920 - DNA, 25 bp, Homo sapien
actgctgagatgctgtatttccacc

SEQ ID NO: 299921 - DNA, 25 bp, Homo sapien
tgagatgctgtatttccacccaatt

SEQ ID NO: 299922 - DNA, 25 bp, Homo sapien
atttccacccaattctgggtatatc

SEQ ID NO: 299923 - DNA, 25 bp, Homo sapien
aattctgggtatatcagtgtgtctt

SEQ ID NO: 299924 - DNA, 25 bp, Homo sapien
tttctaacacacagacctaacatct

SEQ ID NO: 299925 - DNA, 25 bp, Homo sapien
gaaactttgccataattatctttgc

SEQ ID NO: 299926 - DNA, 25 bp, Homo sapien
gccataattatctttgcatttctta

SEQ ID NO: 299927 - DNA, 25 bp, Homo sapien
ctttgcatttcttatcctgacagct

SEQ ID NO: 299928 - DNA, 25 bp, Homo sapien
tgcatttcttatcctgacagctttc

SEQ ID NO: 299929 - DNA, 25 bp, Homo sapien
gacagctttctctaataaactctag

SEQ ID NO: 299930 - DNA, 25 bp, Homo sapien
ctaataaactctagtcctctggcta

SEQ ID NO: 299931 - DNA, 25 bp, Homo sapien
tagtcctctggctagagagccactt

SEQ ID NO: 299932 - DNA, 25 bp, Homo sapien
agagagccacttacaggtccctgaa

SEQ ID NO: 299933 - DNA, 25 bp, Homo sapien
aggtccctgaataagccagctctca

SEQ ID NO: 299934 - DNA, 25 bp, Homo sapien
gaataagccagctctcacatccctt

SEQ ID NO: 299935 - DNA, 25 bp, Homo sapien
gtttccacactactaccatttacag

SEQ ID NO: 299936 - DNA, 25 bp, Homo sapien
gcagaaactagctttgacttgtgta

SEQ ID NO: 299937 - DNA, 25 bp, Homo sapien
gacttgtgtaacgatgcactgtcaa

SEQ ID NO: 299938 - DNA, 25 bp, Homo sapien
gaattgaaattccacattcccagaa

SEQ ID NO: 299939 - DNA, 25 bp, Homo sapien
ccagaatttaacactcagctgctcc

SEQ ID NO: 299940 - DNA, 25 bp, Homo sapien
ctcagctgctcctctagtaataagt

SEQ ID NO: 299941 - DNA, 25 bp, Homo sapien
gctcctctagtaataagttcctggg

SEQ ID NO: 299942 - DNA, 25 bp, Homo sapien
ggataatacattaaccaacattggt

SEQ ID NO: 299943 - DNA, 25 bp, Homo sapien
ggttgaaacatacctgagtaatcat

SEQ ID NO: 299944 - DNA, 25 bp, Homo sapien
atcatatcaggatgcatgttaagct

SEQ ID NO: 299945 - DNA, 25 bp, Homo sapien
aataagatcccaaaatgcagtagct

SEQ ID NO: 299946 - DNA, 25 bp, Homo sapien
ccctgagcgatgtggtgggcgacca

SEQ ID NO: 299947 - DNA, 25 bp, Homo sapien
gaccacaatgtcgtgtgccccgtgg

SEQ ID NO: 299948 - DNA, 25 bp, Homo sapien
tgcccgggtctacgcctacgtcttt

SEQ ID NO: 299949 - DNA, 25 bp, Homo sapien
tacgtctttgaacaccgtgcttcca

SEQ ID NO: 299950 - DNA, 25 bp, Homo sapien
cacggctacgagatcgagttcatct

SEQ ID NO: 299951 - DNA, 25 bp, Homo sapien
gatcgagttcatctttgggatcccc

SEQ ID NO: 299952 - DNA, 25 bp, Homo sapien
ctctcgaaactacacggcagaggag

SEQ ID NO: 299953 - DNA, 25 bp, Homo sapien
gaaactacacggcagaggagaaaat

SEQ ID NO: 299954 - DNA, 25 bp, Homo sapien
agcgactgatgcgatactgggccaa

SEQ ID NO: 299955 - DNA, 25 bp, Homo sapien
actgatgcgatactgggccaacttt

SEQ ID NO: 299956 - DNA, 25 bp, Homo sapien
ctgggccaactttgcccgcacaggg

SEQ ID NO: 299957 - DNA, 25 bp, Homo sapien
caggatgatcttctggtccatcgcc

SEQ ID NO: 299958 - DNA, 25 bp, Homo sapien
tgatcttctggtccatcgcccgctg

SEQ ID NO: 299959 - DNA, 25 bp, Homo sapien
tcacggatccggtgttccacggcct

SEQ ID NO: 299960 - DNA, 25 bp, Homo sapien
atccggtgttccacggcctctagtt

SEQ ID NO: 299961 - DNA, 25 bp, Homo sapien
gcagctttcggatgagttccagcag

SEQ ID NO: 299962 - DNA, 25 bp, Homo sapien
acggcctctagttctcgctgctgag

SEQ ID NO: 299963 - DNA, 25 bp, Homo sapien
gctgctgagccgcctgaaccacagg

SEQ ID NO: 299964 - DNA, 25 bp, Homo sapien
ttcggatgagttccagcaggttcat

SEQ ID NO: 299965 - DNA, 25 bp, Homo sapien
gatgagttccagcaggttcatctgc

SEQ ID NO: 299966 - DNA, 25 bp, Homo sapien
gttggtggtcacgtagaagccagcc

SEQ ID NO: 299967 - DNA, 25 bp, Homo sapien
tggtggtcacgtagaagccagccac

SEQ ID NO: 299968 - DNA, 25 bp, Homo sapien
tttcccaacttgaggtcccggtgca

SEQ ID NO: 299969 - DNA, 25 bp, Homo sapien
ttgaggtcccggtgcaagatgccgc

SEQ ID NO: 299970 - DNA, 25 bp, Homo sapien
aagatgccgcgctggtgcaagtact

SEQ ID NO: 299971 - DNA, 25 bp, Homo sapien
gctggtgcaagtacttgaggccaga

SEQ ID NO: 299972 - DNA, 25 bp, Homo sapien
aggccagaaaggatctgccgcaggt

SEQ ID NO: 299973 - DNA, 25 bp, Homo sapien
tgccgcaggtagtagcgcacttctg

SEQ ID NO: 299974 - DNA, 25 bp, Homo sapien
gcacttctggctccaacagggtgtg

SEQ ID NO: 299975 - DNA, 25 bp, Homo sapien
aaatgtagatgttgtcagcgtcctc

SEQ ID NO: 299976 - DNA, 25 bp, Homo sapien
tagatgttgtcagcgtcctcaaagt

SEQ ID NO: 299977 - DNA, 25 bp, Homo sapien
accttcagttccatgttctcagtga

SEQ ID NO: 299978 - DNA, 25 bp, Homo sapien
cagttccatgttctcagtgatgaaa

SEQ ID NO: 299979 - DNA, 25 bp, Homo sapien
tgcgccagctgggaccctcccgccg

SEQ ID NO: 299980 - DNA, 25 bp, Homo sapien
gccccagcgcccgaggtctacgcgg

SEQ ID NO: 299981 - DNA, 25 bp, Homo sapien
tgctgccatcgctcggcggcccctt

SEQ ID NO: 299982 - DNA, 25 bp, Homo sapien
ccgtggctgcgctgaggctgtggcc

SEQ ID NO: 299983 - DNA, 25 bp, Homo sapien
gtggctgcgctgaggctgtggccct

SEQ ID NO: 299984 - DNA, 25 bp, Homo sapien
tggccctgagactgcatcggaggcg

SEQ ID NO: 299985 - DNA, 25 bp, Homo sapien
ggccctgagactgcatcggaggcgg

SEQ ID NO: 299986 - DNA, 25 bp, Homo sapien
gccctgagactgcatcggaggcggc

SEQ ID NO: 299987 - DNA, 25 bp, Homo sapien
ctgagactgcatcggaggcggcgcc

SEQ ID NO: 299988 - DNA, 25 bp, Homo sapien
agactgcatcggaggcggcgccccg

SEQ ID NO: 299989 - DNA, 25 bp, Homo sapien
gcggcgccccgttctagggccgtgg

SEQ ID NO: 299990 - DNA, 25 bp, Homo sapien
gtttacaagagccacagtctgtttc

SEQ ID NO: 299991 - DNA, 25 bp, Homo sapien
ttcagcatcttctcaggttcgacga

SEQ ID NO: 299992 - DNA, 25 bp, Homo sapien
ggttcgacgaggtgctttataaatc

SEQ ID NO: 299993 - DNA, 25 bp, Homo sapien
aaatcatctcaggactttcaaccca

SEQ ID NO: 299994 - DNA, 25 bp, Homo sapien
tttcaacccaggcatatcgtcagtt

SEQ ID NO: 299995 - DNA, 25 bp, Homo sapien
ggcatatcgtcagttaccttctaac

SEQ ID NO: 299996 - DNA, 25 bp, Homo sapien
aactttaagtcatcttgcagctgtg

SEQ ID NO: 299997 - DNA, 25 bp, Homo sapien
atcttgcagctgtggcacacaaaac

SEQ ID NO: 299998 - DNA, 25 bp, Homo sapien
gggccagacttcatcttttcaaagc

SEQ ID NO: 299999 - DNA, 25 bp, Homo sapien
atcttttcaaagctgtccgttctgt

SEQ ID NO: 300000 - DNA, 25 bp, Homo sapien
aaagctgtccgttctgtcctagcca

SEQ ID NO: 300001 - DNA, 25 bp, Homo sapien
tgtatacaaagacatggcagctact

SEQ ID NO: 300002 - DNA, 25 bp, Homo sapien
atacaaagacatggcagctactgca

SEQ ID NO: 300003 - DNA, 25 bp, Homo sapien
aaagacatggcagctactgcatctt

SEQ ID NO: 300004 - DNA, 25 bp, Homo sapien
agctactgcatcttcatgtgtcaca

SEQ ID NO: 300005 - DNA, 25 bp, Homo sapien
gctactgcatcttcatgtgtcacaa

SEQ ID NO: 300006 - DNA, 25 bp, Homo sapien
gtgtcacaaactctacatctgcttc

SEQ ID NO: 300007 - DNA, 25 bp, Homo sapien
tgtcacaaactctacatctgcttct

SEQ ID NO: 300008 - DNA, 25 bp, Homo sapien
tgcttctcctgtggctctgccatca

SEQ ID NO: 300009 - DNA, 25 bp, Homo sapien
tgccatcagctccaatatcaatatg

SEQ ID NO: 300010 - DNA, 25 bp, Homo sapien
gctccaatatcaatatgaactcgta

SEQ ID NO: 300011 - DNA, 25 bp, Homo sapien
gaactcgtattggatttagtggtga

SEQ ID NO: 300012 - DNA, 25 bp, Homo sapien
gtaaagaaccttaactaatgctaag

SEQ ID NO: 300013 - DNA, 25 bp, Homo sapien
gttaggtttctaagtttaggacatg

SEQ ID NO: 300014 - DNA, 25 bp, Homo sapien
ggagtttattttgattaacataggt

SEQ ID NO: 300015 - DNA, 25 bp, Homo sapien
acataggttattctgaccaccacct

SEQ ID NO: 300016 - DNA, 25 bp, Homo sapien
taggttattctgaccaccacctctt

SEQ ID NO: 300017 - DNA, 25 bp, Homo sapien
cttaatctccttagaatctgacagt

SEQ ID NO: 300018 - DNA, 25 bp, Homo sapien
atctccttagaatctgacagtctca

SEQ ID NO: 300019 - DNA, 25 bp, Homo sapien
gacagtctcaaagctgtcacacaaa

SEQ ID NO: 300020 - DNA, 25 bp, Homo sapien
gtctcaaagctgtcacacaaattag

SEQ ID NO: 300021 - DNA, 25 bp, Homo sapien
aattagactaattttgacactttga

SEQ ID NO: 300022 - DNA, 25 bp, Homo sapien
gactaattttgacactttgaaatga

SEQ ID NO: 300023 - DNA, 25 bp, Homo sapien
ataacaggcattataaccactggat

SEQ ID NO: 300024 - DNA, 25 bp, Homo sapien
tataaccactggatccaccatggtg

SEQ ID NO: 300025 - DNA, 25 bp, Homo sapien
tccaccatggtggagcacaattact

SEQ ID NO: 300026 - DNA, 25 bp, Homo sapien
atgtgtctgcctacagaatcctgta

SEQ ID NO: 300027 - DNA, 25 bp, Homo sapien
aatggactgtgtacagagagcctgg

SEQ ID NO: 300028 - DNA, 25 bp, Homo sapien
gattatcaccaggatgtgcgtaata

SEQ ID NO: 300029 - DNA, 25 bp, Homo sapien
tgcgtaataactttttgccaccaat

SEQ ID NO: 300030 - DNA, 25 bp, Homo sapien
tttgccaccaattattgcacgtttt

SEQ ID NO: 300031 - DNA, 25 bp, Homo sapien
agagtgaatcctacccaatggcagc

SEQ ID NO: 300032 - DNA, 25 bp, Homo sapien
gccatgaaaatggagctgctcggat

SEQ ID NO: 300033 - DNA, 25 bp, Homo sapien
gctgctcggatgtcagtttattcct

SEQ ID NO: 300034 - DNA, 25 bp, Homo sapien
attatgggagcgcatttccccaggg

SEQ ID NO: 300035 - DNA, 25 bp, Homo sapien
ctcttacagtcacgagctcttcctg

SEQ ID NO: 300036 - DNA, 25 bp, Homo sapien
cccctcatgagggtagtcccagaga

SEQ ID NO: 300037 - DNA, 25 bp, Homo sapien
gtcccagagaccaggcgatggcatc

SEQ ID NO: 300038 - DNA, 25 bp, Homo sapien
agaccaggcgatggcatctgcacta

SEQ ID NO: 300039 - DNA, 25 bp, Homo sapien
aggcgatggcatctgcactattcac

SEQ ID NO: 300040 - DNA, 25 bp, Homo sapien
gatggcatctgcactattcacagcg

SEQ ID NO: 300041 - DNA, 25 bp, Homo sapien
gcatctgcactattcacagcggatt

SEQ ID NO: 300042 - DNA, 25 bp, Homo sapien
tgcactattcacagcggattcccag

SEQ ID NO: 300043 - DNA, 25 bp, Homo sapien
attcacagcggattcccaggcaatg

SEQ ID NO: 300044 - DNA, 25 bp, Homo sapien
gacaacaggcaggagaattatggga

SEQ ID NO: 300045 - DNA, 25 bp, Homo sapien
agaatttttctttagctgctgaagt

SEQ ID NO: 300046 - DNA, 25 bp, Homo sapien
ttctattacaaaatgtggactcacc

SEQ ID NO: 300047 - DNA, 25 bp, Homo sapien
gtggactcaccaattgctttgtgtt

SEQ ID NO: 300048 - DNA, 25 bp, Homo sapien
ttccatgtgacctgttacttcaggc

SEQ ID NO: 300049 - DNA, 25 bp, Homo sapien
gacctgttacttcaggctacttggg

SEQ ID NO: 300050 - DNA, 25 bp, Homo sapien
gggaacatcttagtcctctgtagct

SEQ ID NO: 300051 - DNA, 25 bp, Homo sapien
atcttagtcctctgtagctcctgaa

SEQ ID NO: 300052 - DNA, 25 bp, Homo sapien
tgaacccagcactggtgcttcaaga

SEQ ID NO: 300053 - DNA, 25 bp, Homo sapien
aggtagcacgtctttgttcaaaaca

SEQ ID NO: 300054 - DNA, 25 bp, Homo sapien
acttctggaggccacatcctgaata

SEQ ID NO: 300055 - DNA, 25 bp, Homo sapien
gaggccacatcctgaatatgaatgt

SEQ ID NO: 300056 - DNA, 25 bp, Homo sapien
ccctcctgttgctgttctctctgag

SEQ ID NO: 300057 - DNA, 25 bp, Homo sapien
tctgagttatctgagagaggccaca

SEQ ID NO: 300058 - DNA, 25 bp, Homo sapien
caaacacagcccttccagttcttag

SEQ ID NO: 300059 - DNA, 25 bp, Homo sapien
ttccagttcttaggtgatctccagg

SEQ ID NO: 300060 - DNA, 25 bp, Homo sapien
ttaggtgatctccaggaccctcctt

SEQ ID NO: 300061 - DNA, 25 bp, Homo sapien
tcctttcattcccagcacatctttg

SEQ ID NO: 300062 - DNA, 25 bp, Homo sapien
tccctccctaggaaggtggccaggt

SEQ ID NO: 300063 - DNA, 25 bp, Homo sapien
aaggtggccaggtcctcactgagtc

SEQ ID NO: 300064 - DNA, 25 bp, Homo sapien
cctcactgagtctccttaaggacag

SEQ ID NO: 300065 - DNA, 25 bp, Homo sapien
gaggaaatgtctctccctttgtctg

SEQ ID NO: 300066 - DNA, 25 bp, Homo sapien
tgttcatggccctcctgttgctgtt

SEQ ID NO: 300067 - DNA, 25 bp, Homo sapien
gataaattcccagaactctcagttc

SEQ ID NO: 300068 - DNA, 25 bp, Homo sapien
aaagtgtcttgaatgctatagagct

SEQ ID NO: 300069 - DNA, 25 bp, Homo sapien
atgctatagagctaatgttcaaaaa

SEQ ID NO: 300070 - DNA, 25 bp, Homo sapien
ccacaaactttttgaagtctccttg

SEQ ID NO: 300071 - DNA, 25 bp, Homo sapien
gaagtctccttgaatatgtcccatt

SEQ ID NO: 300072 - DNA, 25 bp, Homo sapien
gtctccttgaatatgtcccatttat

SEQ ID NO: 300073 - DNA, 25 bp, Homo sapien
aattctgtgactactcatgttgact

SEQ ID NO: 300074 - DNA, 25 bp, Homo sapien
gtgactactcatgttgacttaatgc

SEQ ID NO: 300075 - DNA, 25 bp, Homo sapien
ctcatgttgacttaatgctgactta

SEQ ID NO: 300076 - DNA, 25 bp, Homo sapien
gacttaatgctgacttaattttctg

SEQ ID NO: 300077 - DNA, 25 bp, Homo sapien
taatgctgacttaattttctgtttt

SEQ ID NO: 300078 - DNA, 25 bp, Homo sapien
gccagtagtggcttagtccaagtgt

SEQ ID NO: 300079 - DNA, 25 bp, Homo sapien
tagtggcttagtccaagtgtgagtc

SEQ ID NO: 300080 - DNA, 25 bp, Homo sapien
gtgtgagtccattttgaaaggctta

SEQ ID NO: 300081 - DNA, 25 bp, Homo sapien
ggacaggcttcagtctgtggtcaaa

SEQ ID NO: 300082 - DNA, 25 bp, Homo sapien
tgagagccaccagcaagccactggt

SEQ ID NO: 300083 - DNA, 25 bp, Homo sapien
cagcaagccactggtgcaagttcca

SEQ ID NO: 300084 - DNA, 25 bp, Homo sapien
cactggtgcaagttccagagtccaa

SEQ ID NO: 300085 - DNA, 25 bp, Homo sapien
aaagaacctagtgttggatgtccaa

SEQ ID NO: 300086 - DNA, 25 bp, Homo sapien
acctagtgttggatgtccaagggca

SEQ ID NO: 300087 - DNA, 25 bp, Homo sapien
gagtgaaaggaatcatccagcacag

SEQ ID NO: 300088 - DNA, 25 bp, Homo sapien
aaggaatcatccagcacaggaaaaa

SEQ ID NO: 300089 - DNA, 25 bp, Homo sapien
agatatctgtgaggcggctgcccca

SEQ ID NO: 300090 - DNA, 25 bp, Homo sapien
agcagttgagcttgcgcacgctgtg

SEQ ID NO: 300091 - DNA, 25 bp, Homo sapien
gcagttgagcttgcgcacgctgtgc

SEQ ID NO: 300092 - DNA, 25 bp, Homo sapien
ttgagcttgcgcacgctgtgcagct

SEQ ID NO: 300093 - DNA, 25 bp, Homo sapien
tgagcttgcgcacgctgtgcagctc

SEQ ID NO: 300094 - DNA, 25 bp, Homo sapien
ttgcgcacgctgtgcagctccgagg

SEQ ID NO: 300095 - DNA, 25 bp, Homo sapien
acgctgtgcagctccgaggccttgg

SEQ ID NO: 300096 - DNA, 25 bp, Homo sapien
gggtcagaaccatcttccgcgtcag

SEQ ID NO: 300097 - DNA, 25 bp, Homo sapien
ggtcagaaccatcttccgcgtcagc

SEQ ID NO: 300098 - DNA, 25 bp, Homo sapien
tcagaaccatcttccgcgtcagctt

SEQ ID NO: 300099 - DNA, 25 bp, Homo sapien
catcttccgcgtcagcttcatggcg

SEQ ID NO: 300100 - DNA, 25 bp, Homo sapien
agaggagatgtcactttcctggaag

SEQ ID NO: 300101 - DNA, 25 bp, Homo sapien
ggatgctacagaacatggcttcaat

SEQ ID NO: 300102 - DNA, 25 bp, Homo sapien
agtcataacttacgtgccactttta

SEQ ID NO: 300103 - DNA, 25 bp, Homo sapien
tacgtgccacttttatgttattctg

SEQ ID NO: 300104 - DNA, 25 bp, Homo sapien
ttttatgttattctggactttgggc

SEQ ID NO: 300105 - DNA, 25 bp, Homo sapien
tgtccctccattgaagtgtcactaa

SEQ ID NO: 300106 - DNA, 25 bp, Homo sapien
gaagtgtcactaactttgtcaaaaa

SEQ ID NO: 300107 - DNA, 25 bp, Homo sapien
gtcaaaaataccttacactaattag

SEQ ID NO: 300108 - DNA, 25 bp, Homo sapien
attagaggtgccagaatttttatac

SEQ ID NO: 300109 - DNA, 25 bp, Homo sapien
agaaaggtgccagcacgtgcccttt

SEQ ID NO: 300110 - DNA, 25 bp, Homo sapien
agcacgtgccctttggagtagtaca

SEQ ID NO: 300111 - DNA, 25 bp, Homo sapien
gataaattcccagaactctcagttc

SEQ ID NO: 300112 - DNA, 25 bp, Homo sapien
ataaattcccagaactctcagttct

SEQ ID NO: 300113 - DNA, 25 bp, Homo sapien
caaaagtgtcttgaatgctatagag

SEQ ID NO: 300114 - DNA, 25 bp, Homo sapien
aaaagtgtcttgaatgctatagagc

SEQ ID NO: 300115 - DNA, 25 bp, Homo sapien
aaagtgtcttgaatgctatagagct

SEQ ID NO: 300116 - DNA, 25 bp, Homo sapien
aatgctatagagctaatgttcaaaa

SEQ ID NO: 300117 - DNA, 25 bp, Homo sapien
atgctatagagctaatgttcaaaaa

SEQ ID NO: 300118 - DNA, 25 bp, Homo sapien
tgctatagagctaatgttcaaaaat

SEQ ID NO: 300119 - DNA, 25 bp, Homo sapien
ctcatgttgacttaatgctgactta

SEQ ID NO: 300120 - DNA, 25 bp, Homo sapien
tcatgttgacttaatgctgacttaa

SEQ ID NO: 300121 - DNA, 25 bp, Homo sapien
acaagttgatacaaattttgtttat

SEQ ID NO: 300122 - DNA, 25 bp, Homo sapien
ggtatggtgtccacacgttgaggta

SEQ ID NO: 300123 - DNA, 25 bp, Homo sapien
gtgtccacacgttgaggtacaggca

SEQ ID NO: 300124 - DNA, 25 bp, Homo sapien
gggttccacatctcggtgccctcaa

SEQ ID NO: 300125 - DNA, 25 bp, Homo sapien
tcggtgccctcaaaacctgggtata

SEQ ID NO: 300126 - DNA, 25 bp, Homo sapien
tcaaaacctgggtatagggtgtcca

SEQ ID NO: 300127 - DNA, 25 bp, Homo sapien
tagggtgtccacatattggtagcag

SEQ ID NO: 300128 - DNA, 25 bp, Homo sapien
cacatattggtagcagacactctgg

SEQ ID NO: 300129 - DNA, 25 bp, Homo sapien
cactctggaaggttgtagcgtctac

SEQ ID NO: 300130 - DNA, 25 bp, Homo sapien
aaggttgtagcgtctaccacccctg

SEQ ID NO: 300131 - DNA, 25 bp, Homo sapien
ctgaccaaggctgcttgggctccgg

SEQ ID NO: 300132 - DNA, 25 bp, Homo sapien
gggtcccatgggtggctccgcaaag

SEQ ID NO: 300133 - DNA, 25 bp, Homo sapien
tacagggaatgaagactcgaagagg

SEQ ID NO: 300134 - DNA, 25 bp, Homo sapien
gactcgaagaggagatgtcactttc

SEQ ID NO: 300135 - DNA, 25 bp, Homo sapien
agaggagatgtcactttcctggaag

SEQ ID NO: 300136 - DNA, 25 bp, Homo sapien
gattcaattaaggatgctacagaac

SEQ ID NO: 300137 - DNA, 25 bp, Homo sapien
ggatgctacagaacatggcttcaat

SEQ ID NO: 300138 - DNA, 25 bp, Homo sapien
gctacagaacatggcttcaattaag

SEQ ID NO: 300139 - DNA, 25 bp, Homo sapien
agaaaggtgccagcacgtgcccttt

SEQ ID NO: 300140 - DNA, 25 bp, Homo sapien
aaggtgccagcacgtgccctttgga

SEQ ID NO: 300141 - DNA, 25 bp, Homo sapien
cagcacgtgccctttggagtagtac

SEQ ID NO: 300142 - DNA, 25 bp, Homo sapien
gcacgtgccctttggagtagtacag

SEQ ID NO: 300143 - DNA, 25 bp, Homo sapien
tgccctttggagtagtacagggaat

SEQ ID NO: 300144 - DNA, 25 bp, Homo sapien
ctgaggagctccaagataccccaac

SEQ ID NO: 300145 - DNA, 25 bp, Homo sapien
tgaggagctccaagataccccaacc

SEQ ID NO: 300146 - DNA, 25 bp, Homo sapien
tacctcagctgggagcactgtcttc

SEQ ID NO: 300147 - DNA, 25 bp, Homo sapien
tcagctgggagcactgtcttccatg

SEQ ID NO: 300148 - DNA, 25 bp, Homo sapien
agctgggagcactgtcttccatggg

SEQ ID NO: 300149 - DNA, 25 bp, Homo sapien
actgtcttccatggggcttccactt

SEQ ID NO: 300150 - DNA, 25 bp, Homo sapien
acttctctcctcaacctggggaaga

SEQ ID NO: 300151 - DNA, 25 bp, Homo sapien
tgccttccccaaaagctggcttctt

SEQ ID NO: 300152 - DNA, 25 bp, Homo sapien
ttccccaaaagctggcttcttgctc

SEQ ID NO: 300153 - DNA, 25 bp, Homo sapien
ctccaaggagagagcattgacccac

SEQ ID NO: 300154 - DNA, 25 bp, Homo sapien
ccaaggagagagcattgacccacct

SEQ ID NO: 300155 - DNA, 25 bp, Homo sapien
tggcttcaacagatatgtatggcat

SEQ ID NO: 300156 - DNA, 25 bp, Homo sapien
atatgtatggcatgctgggatgtgc

SEQ ID NO: 300157 - DNA, 25 bp, Homo sapien
tgcctgcgttgtgccagttgctgga

SEQ ID NO: 300158 - DNA, 25 bp, Homo sapien
gagcagctgaaatcttgccatcaag

SEQ ID NO: 300159 - DNA, 25 bp, Homo sapien
aagcaaccctcattctcatgcctgt

SEQ ID NO: 300160 - DNA, 25 bp, Homo sapien
atgcctgtaggtttccattgctctg

SEQ ID NO: 300161 - DNA, 25 bp, Homo sapien
taggtttccattgctctgtcccagg

SEQ ID NO: 300162 - DNA, 25 bp, Homo sapien
ttgcgtgccagagacgccacaactt

SEQ ID NO: 300163 - DNA, 25 bp, Homo sapien
aacttcatgtccctgtctcttgcaa

SEQ ID NO: 300164 - DNA, 25 bp, Homo sapien
atgccttggatgtggtcccaccagc

SEQ ID NO: 300165 - DNA, 25 bp, Homo sapien
tcagcttaggctctgcttcccagtg

SEQ ID NO: 300166 - DNA, 25 bp, Homo sapien
atcagtccttattagcaaaaatgaa

SEQ ID NO: 300167 - DNA, 25 bp, Homo sapien
aagtaggcatatttaccactcctaa

SEQ ID NO: 300168 - DNA, 25 bp, Homo sapien
ggcatatttaccactcctaattttg

SEQ ID NO: 300169 - DNA, 25 bp, Homo sapien
ccactcctaattttgatgaaacttc

SEQ ID NO: 300170 - DNA, 25 bp, Homo sapien
gatgaaacttccagtgctactacaa

SEQ ID NO: 300171 - DNA, 25 bp, Homo sapien
aaacttccagtgctactacaatcag

SEQ ID NO: 300172 - DNA, 25 bp, Homo sapien
tgctactacaatcagcacatctgag

SEQ ID NO: 300173 - DNA, 25 bp, Homo sapien
tacaatcagcacatctgaggatgga

SEQ ID NO: 300174 - DNA, 25 bp, Homo sapien
atctgaggatggaagttatggtact

SEQ ID NO: 300175 - DNA, 25 bp, Homo sapien
ggtactgatgtaaccaggtgcatat

SEQ ID NO: 300176 - DNA, 25 bp, Homo sapien
ccaggtgcatatgtggttttacaca

SEQ ID NO: 300177 - DNA, 25 bp, Homo sapien
tgtcgcggcccagagcagcataatg

SEQ ID NO: 300178 - DNA, 25 bp, Homo sapien
cgcggcccagagcagcataatgctg

SEQ ID NO: 300179 - DNA, 25 bp, Homo sapien
agcataatgctgcaggccgttgcaa

SEQ ID NO: 300180 - DNA, 25 bp, Homo sapien
cataatgctgcaggccgttgcaaga

SEQ ID NO: 300181 - DNA, 25 bp, Homo sapien
acataggcggcagggtcggaggcgc

SEQ ID NO: 300182 - DNA, 25 bp, Homo sapien
tcggaggcgcgcacagcgttcgcca

SEQ ID NO: 300183 - DNA, 25 bp, Homo sapien
gcgttcgccacctccatacagcagg

SEQ ID NO: 300184 - DNA, 25 bp, Homo sapien
atacagcaggccagcgtctgccagg

SEQ ID NO: 300185 - DNA, 25 bp, Homo sapien
caggccagcgtctgccagggttcct

SEQ ID NO: 300186 - DNA, 25 bp, Homo sapien
tcggcccgtcaagggttggtccgcg

SEQ ID NO: 300187 - DNA, 25 bp, Homo sapien
tccaggttgacggaggcggcgccca

SEQ ID NO: 300188 - DNA, 25 bp, Homo sapien
tcctttacttcccagagaacttcac

SEQ ID NO: 300189 - DNA, 25 bp, Homo sapien
agagaacttcacagagactctgtcc

SEQ ID NO: 300190 - DNA, 25 bp, Homo sapien
agagactctgtccttccatgcaaag

SEQ ID NO: 300191 - DNA, 25 bp, Homo sapien
gtccttccatgcaaaggcttcctga

SEQ ID NO: 300192 - DNA, 25 bp, Homo sapien
catgcaaaggcttcctgaaataggg

SEQ ID NO: 300193 - DNA, 25 bp, Homo sapien
gggagactgactgagtagctcattc

SEQ ID NO: 300194 - DNA, 25 bp, Homo sapien
ctcattcttgtgacttacagtgcca

SEQ ID NO: 300195 - DNA, 25 bp, Homo sapien
cttgtgacttacagtgccaacattt

SEQ ID NO: 300196 - DNA, 25 bp, Homo sapien
aagaatgctcatattaatgtactta

SEQ ID NO: 300197 - DNA, 25 bp, Homo sapien
acacatgtagagcatatctgttata

SEQ ID NO: 300198 - DNA, 25 bp, Homo sapien
aatggttatttgttactaaagctat

SEQ ID NO: 300199 - DNA, 25 bp, Homo sapien
cgtctcaggtcccaggcgctagatg

SEQ ID NO: 300200 - DNA, 25 bp, Homo sapien
aggtcccaggcgctagatgcacttg

SEQ ID NO: 300201 - DNA, 25 bp, Homo sapien
ctagatgcacttggagcgagtttct

SEQ ID NO: 300202 - DNA, 25 bp, Homo sapien
acttggagcgagtttctcctggacg

SEQ ID NO: 300203 - DNA, 25 bp, Homo sapien
agtttctcctggacgcgggtgtcaa

SEQ ID NO: 300204 - DNA, 25 bp, Homo sapien
tcctggacgcgggtgtcaacacatg

SEQ ID NO: 300205 - DNA, 25 bp, Homo sapien
gtcaacacatgagtggaagctgtaa

SEQ ID NO: 300206 - DNA, 25 bp, Homo sapien
ctgtaaaaatcccaaagagctgctg

SEQ ID NO: 300207 - DNA, 25 bp, Homo sapien
agagctgctgggaatccttaattaa

SEQ ID NO: 300208 - DNA, 25 bp, Homo sapien
aaaaatgcagtccaccgatgcagag

SEQ ID NO: 300209 - DNA, 25 bp, Homo sapien
agtccaccgatgcagaggtcgcagc

SEQ ID NO: 300210 - DNA, 25 bp, Homo sapien
tccttgtggtcggtggtgacgatgg

SEQ ID NO: 300211 - DNA, 25 bp, Homo sapien
gtgacgatggtgaagtacacgtact

SEQ ID NO: 300212 - DNA, 25 bp, Homo sapien
agtacacgtacttgcccgtgcgctc

SEQ ID NO: 300213 - DNA, 25 bp, Homo sapien
gatggagtggaagcgcagctccttg

SEQ ID NO: 300214 - DNA, 25 bp, Homo sapien
ggaacaggctcaggcggtcggaggt

SEQ ID NO: 300215 - DNA, 25 bp, Homo sapien
cgcgcttcttcttccatagctggaa

SEQ ID NO: 300216 - DNA, 25 bp, Homo sapien
tccatagctggaagaggctgtcgct

SEQ ID NO: 300217 - DNA, 25 bp, Homo sapien
tggaagaggctgtcgctgcgcttct

SEQ ID NO: 300218 - DNA, 25 bp, Homo sapien
agaggctgtcgctgcgcttctccaa

SEQ ID NO: 300219 - DNA, 25 bp, Homo sapien
atttcatgtcgtgccgagcgcggga

SEQ ID NO: 300220 - DNA, 25 bp, Homo sapien
gactgggagcggcaatgcgggcggt

SEQ ID NO: 300221 - DNA, 25 bp, Homo sapien
attatgacacaccaacaatatctag

SEQ ID NO: 300222 - DNA, 25 bp, Homo sapien
aagtaagaactggtgtagcaatgat

SEQ ID NO: 300223 - DNA, 25 bp, Homo sapien
gatgcttcatattctagctgtagcc

SEQ ID NO: 300224 - DNA, 25 bp, Homo sapien
ctgtagccacagagttgagggtagt

SEQ ID NO: 300225 - DNA, 25 bp, Homo sapien
aatctagagaagtgacagcctacat

SEQ ID NO: 300226 - DNA, 25 bp, Homo sapien
gacagcctacattacttcattatta

SEQ ID NO: 300227 - DNA, 25 bp, Homo sapien
ttactcttcttttagtctttagtct

SEQ ID NO: 300228 - DNA, 25 bp, Homo sapien
gtttactctataaatcagcattttg

SEQ ID NO: 300229 - DNA, 25 bp, Homo sapien
aatcagcattttgtaatcctttata

SEQ ID NO: 300230 - DNA, 25 bp, Homo sapien
gtaatcctttataaactcatccaga

SEQ ID NO: 300231 - DNA, 25 bp, Homo sapien
atccagatttaaatgctactttttc

SEQ ID NO: 300232 - DNA, 25 bp, Homo sapien
gattactacagcaagctgaaggctt

SEQ ID NO: 300233 - DNA, 25 bp, Homo sapien
acagcaagctgaaggcttatgagta

SEQ ID NO: 300234 - DNA, 25 bp, Homo sapien
atgagtataccaccatacgcaggga

SEQ ID NO: 300235 - DNA, 25 bp, Homo sapien
gtataccaccatacgcagggagagg

SEQ ID NO: 300236 - DNA, 25 bp, Homo sapien
gcttggaagcaacccacagctcacc

SEQ ID NO: 300237 - DNA, 25 bp, Homo sapien
ctcaccccaagacaagagaattagt

SEQ ID NO: 300238 - DNA, 25 bp, Homo sapien
gtgggatcattctcaacgggatgcc

SEQ ID NO: 300239 - DNA, 25 bp, Homo sapien
ggatcattctcaacgggatgcccat

SEQ ID NO: 300240 - DNA, 25 bp, Homo sapien
ttctcaacgggatgcccatttccat

SEQ ID NO: 300241 - DNA, 25 bp, Homo sapien
ccatttccatcctctacaacaagtt

SEQ ID NO: 300242 - DNA, 25 bp, Homo sapien
tacaacaagttttctgattactaca

SEQ ID NO: 300243 - DNA, 25 bp, Homo sapien
tccgtcacagcctggttgtccagct

SEQ ID NO: 300244 - DNA, 25 bp, Homo sapien
agggagctcagtgtgcagcatagct

SEQ ID NO: 300245 - DNA, 25 bp, Homo sapien
agcacgggttctcggccagccacag

SEQ ID NO: 300246 - DNA, 25 bp, Homo sapien
ggagctcagtgtgcagcatagcttg

SEQ ID NO: 300247 - DNA, 25 bp, Homo sapien
acgcggcagccccttcaggtagaag

SEQ ID NO: 300248 - DNA, 25 bp, Homo sapien
agctcagtgtgcagcatagcttggg

SEQ ID NO: 300249 - DNA, 25 bp, Homo sapien
gcggcagccccttcaggtagaagag

SEQ ID NO: 300250 - DNA, 25 bp, Homo sapien
ggcagccccttcaggtagaagagct

SEQ ID NO: 300251 - DNA, 25 bp, Homo sapien
agccccttcaggtagaagagctcag

SEQ ID NO: 300252 - DNA, 25 bp, Homo sapien
tcaggtagaagagctcagccaggct

SEQ ID NO: 300253 - DNA, 25 bp, Homo sapien
gggatgcggttcctccgcaggtaca

SEQ ID NO: 300254 - DNA, 25 bp, Homo sapien
acagcacacgtggtctgcagcatta

SEQ ID NO: 300255 - DNA, 25 bp, Homo sapien
gtctgcagcattacgggcgtgccat

SEQ ID NO: 300256 - DNA, 25 bp, Homo sapien
ttacgggcgtgccattcacctgcac

SEQ ID NO: 300257 - DNA, 25 bp, Homo sapien
tgcaccacagccgaaaggatgcctg

SEQ ID NO: 300258 - DNA, 25 bp, Homo sapien
ctgaggtcaccgagggcccgcaaga

SEQ ID NO: 300259 - DNA, 25 bp, Homo sapien
gactggccaaagacgccaaagccca

SEQ ID NO: 300260 - DNA, 25 bp, Homo sapien
tcatggaagtgctcagcgggcacag

SEQ ID NO: 300261 - DNA, 25 bp, Homo sapien
caccactgctatgtcatagggacat

SEQ ID NO: 300262 - DNA, 25 bp, Homo sapien
ggacatgtctcctgagtggcaaata

SEQ ID NO: 300263 - DNA, 25 bp, Homo sapien
tggcaaataccacacggccccagat

SEQ ID NO: 300264 - DNA, 25 bp, Homo sapien
gtccggctgaagctgcctagcgcca

SEQ ID NO: 300265 - DNA, 25 bp, Homo sapien
agcacctccgttttcagtcagtgtt

SEQ ID NO: 300266 - DNA, 25 bp, Homo sapien
gttttcagtcagtgttgtccagcaa

SEQ ID NO: 300267 - DNA, 25 bp, Homo sapien
tgttgtccagcaacggtaccgttta

SEQ ID NO: 300268 - DNA, 25 bp, Homo sapien
gtaccgtttacacagtcacctcaga

SEQ ID NO: 300269 - DNA, 25 bp, Homo sapien
cccttgccaagctgttagccttaga

SEQ ID NO: 300270 - DNA, 25 bp, Homo sapien
tagccttagagtgattgcagtgaac

SEQ ID NO: 300271 - DNA, 25 bp, Homo sapien
tgtttacacaccgtgaatccattcc

SEQ ID NO: 300272 - DNA, 25 bp, Homo sapien
attcccatcagtccattccagttgg

SEQ ID NO: 300273 - DNA, 25 bp, Homo sapien
tggcaccagcctgaaccatttggta

SEQ ID NO: 300274 - DNA, 25 bp, Homo sapien
gtacctggtgttaactggagtcctg

SEQ ID NO: 300275 - DNA, 25 bp, Homo sapien
cttgctgacttctcttcatttgagg

SEQ ID NO: 300276 - DNA, 25 bp, Homo sapien
ttccagtttctgtgtgatgcaatca

SEQ ID NO: 300277 - DNA, 25 bp, Homo sapien
gtgatgcaatcaaatgtcctattaa

SEQ ID NO: 300278 - DNA, 25 bp, Homo sapien
atttgtagctactgatacagcagaa

SEQ ID NO: 300279 - DNA, 25 bp, Homo sapien
gaagggaactgtaattacttgtatt

SEQ ID NO: 300280 - DNA, 25 bp, Homo sapien
gtaagccatacgttaaatgtttgtt

SEQ ID NO: 300281 - DNA, 25 bp, Homo sapien
ttctgcttctatttttatgccaatg

SEQ ID NO: 300282 - DNA, 25 bp, Homo sapien
gaaggcatttgtcttgttactaatt

SEQ ID NO: 300283 - DNA, 25 bp, Homo sapien
acatgatgtaactacttcttgatat

SEQ ID NO: 300284 - DNA, 25 bp, Homo sapien
ttccattgttacctcgatgcaaaag

SEQ ID NO: 300285 - DNA, 25 bp, Homo sapien
gtaggtacatctattgtagctgtga

SEQ ID NO: 300286 - DNA, 25 bp, Homo sapien
gtagctgtgattattccagtttctg

SEQ ID NO: 300287 - DNA, 25 bp, Homo sapien
atatacaaatgagatctcaagccaa

SEQ ID NO: 300288 - DNA, 25 bp, Homo sapien
ctctttcccatatctgttcatctat

SEQ ID NO: 300289 - DNA, 25 bp, Homo sapien
tcccatatctgttcatctatgatag

SEQ ID NO: 300290 - DNA, 25 bp, Homo sapien
gttcatctatgatagtcaactgaat

SEQ ID NO: 300291 - DNA, 25 bp, Homo sapien
cataaaaaagattcatgcttggttt

SEQ ID NO: 300292 - DNA, 25 bp, Homo sapien
tcatgcttggttttataagctattt

SEQ ID NO: 300293 - DNA, 25 bp, Homo sapien
agtatcattgctattctgagaaatc

SEQ ID NO: 300294 - DNA, 25 bp, Homo sapien
ttggtttccaagcaaaacacgttat

SEQ ID NO: 300295 - DNA, 25 bp, Homo sapien
aaacacgttatttggctgagaacct

SEQ ID NO: 300296 - DNA, 25 bp, Homo sapien
cacgttatttggctgagaaccttta

SEQ ID NO: 300297 - DNA, 25 bp, Homo sapien
ggctgagaacctttagtttgtaaat

SEQ ID NO: 300298 - DNA, 25 bp, Homo sapien
gcaggagtttgcatcaaatagcagt

SEQ ID NO: 300299 - DNA, 25 bp, Homo sapien
atagcagtgcatcgctgaagctttt

SEQ ID NO: 300300 - DNA, 25 bp, Homo sapien
agcttttggagacttttggatggaa

SEQ ID NO: 300301 - DNA, 25 bp, Homo sapien
gaagattaagttccagcatttctga

SEQ ID NO: 300302 - DNA, 25 bp, Homo sapien
aagttccagcatttctgacttgtta

SEQ ID NO: 300303 - DNA, 25 bp, Homo sapien
gttattttgagttactctgctactc

SEQ ID NO: 300304 - DNA, 25 bp, Homo sapien
actctgctactcttaggctgcatag

SEQ ID NO: 300305 - DNA, 25 bp, Homo sapien
gctactcttaggctgcatagtttat

SEQ ID NO: 300306 - DNA, 25 bp, Homo sapien
gaacacatgcatttatggatccagt

SEQ ID NO: 300307 - DNA, 25 bp, Homo sapien
gatccagtatcatgcagtgctgccc

SEQ ID NO: 300308 - DNA, 25 bp, Homo sapien
gtgcaatttcttcagtaatttagat

SEQ ID NO: 300309 - DNA, 25 bp, Homo sapien
ggctttccagacacatttaggggtt

SEQ ID NO: 300310 - DNA, 25 bp, Homo sapien
cagacacatttaggggttcgcgcga

SEQ ID NO: 300311 - DNA, 25 bp, Homo sapien
gctttgtgctcatggaccagccgca

SEQ ID NO: 300312 - DNA, 25 bp, Homo sapien
atggaccagccgcacaacttttgaa

SEQ ID NO: 300313 - DNA, 25 bp, Homo sapien
ggaccagccgcacaacttttgaagg

SEQ ID NO: 300314 - DNA, 25 bp, Homo sapien
gcacaacttttgaaggctcgccggc

SEQ ID NO: 300315 - DNA, 25 bp, Homo sapien
aacttttgaaggctcgccggcccat

SEQ ID NO: 300316 - DNA, 25 bp, Homo sapien
cttttgaaggctcgccggcccatgt

SEQ ID NO: 300317 - DNA, 25 bp, Homo sapien
ctggagttgttgagcagccccgccg

SEQ ID NO: 300318 - DNA, 25 bp, Homo sapien
gagttgttgagcagccccgccgctg

SEQ ID NO: 300319 - DNA, 25 bp, Homo sapien
cgctgtggtccatgtagccgctggc

SEQ ID NO: 300320 - DNA, 25 bp, Homo sapien
tcccggtcccgacggcggaaagcag

SEQ ID NO: 300321 - DNA, 25 bp, Homo sapien
gtcccgacggcggaaagcaggatgg

SEQ ID NO: 300322 - DNA, 25 bp, Homo sapien
gtgccccggccacggacaaggcgga

SEQ ID NO: 300323 - DNA, 25 bp, Homo sapien
caaggcggaggaggtggtctgtgct

SEQ ID NO: 300324 - DNA, 25 bp, Homo sapien
ggtggtctgtgctcccgaagacgtc

SEQ ID NO: 300325 - DNA, 25 bp, Homo sapien
gtctgtgctcccgaagacgtcgcga

SEQ ID NO: 300326 - DNA, 25 bp, Homo sapien
tctgtgctcccgaagacgtcgcgag

SEQ ID NO: 300327 - DNA, 25 bp, Homo sapien
tcccgaagacgtcgcgagcccgttt

SEQ ID NO: 300328 - DNA, 25 bp, Homo sapien
gaagacgtcgcgagcccgtttccca

SEQ ID NO: 300329 - DNA, 25 bp, Homo sapien
agaggcgccctctgctcgcgacggg

SEQ ID NO: 300330 - DNA, 25 bp, Homo sapien
cctctgctcgcgacgggccagaacg

SEQ ID NO: 300331 - DNA, 25 bp, Homo sapien
gcacttcagaaacgctgaaacgttt

SEQ ID NO: 300332 - DNA, 25 bp, Homo sapien
tgaaacgtttcatggcagagcagct

SEQ ID NO: 300333 - DNA, 25 bp, Homo sapien
gcagcagcagattcctggaaaacca

SEQ ID NO: 300334 - DNA, 25 bp, Homo sapien
aaaaccaggcactttcacttggcag

SEQ ID NO: 300335 - DNA, 25 bp, Homo sapien
agggcctgtcgactgcacatggtta

SEQ ID NO: 300336 - DNA, 25 bp, Homo sapien
ctgtcgactgcacatggttaaaata

SEQ ID NO: 300337 - DNA, 25 bp, Homo sapien
taaaataaacctgtactggacccag

SEQ ID NO: 300338 - DNA, 25 bp, Homo sapien
actggacccagtagtgccttttaag

SEQ ID NO: 300339 - DNA, 25 bp, Homo sapien
ggacccagtagtgccttttaaggtg

SEQ ID NO: 300340 - DNA, 25 bp, Homo sapien
aaatctgtacctttaatatgtccta

SEQ ID NO: 300341 - DNA, 25 bp, Homo sapien
tacctttaatatgtcctacttttgg

SEQ ID NO: 300342 - DNA, 25 bp, Homo sapien
ctctcatgacaattttgttggtgaa

SEQ ID NO: 300343 - DNA, 25 bp, Homo sapien
gcagaaactgcatgtaactctaagt

SEQ ID NO: 300344 - DNA, 25 bp, Homo sapien
taactctaagttttactcctaacat

SEQ ID NO: 300345 - DNA, 25 bp, Homo sapien
gttttactcctaacatacatatgtt

SEQ ID NO: 300346 - DNA, 25 bp, Homo sapien
ggaagtattctattctatacttgcc

SEQ ID NO: 300347 - DNA, 25 bp, Homo sapien
ttctattctatacttgccaatgtgg

SEQ ID NO: 300348 - DNA, 25 bp, Homo sapien
ctatacttgccaatgtggagaacaa

SEQ ID NO: 300349 - DNA, 25 bp, Homo sapien
gaagtatatatatccattctgtatt

SEQ ID NO: 300350 - DNA, 25 bp, Homo sapien
ccattctgtattttacgtgcagcag

SEQ ID NO: 300351 - DNA, 25 bp, Homo sapien
ttttacgtgcagcagaattatcttc

SEQ ID NO: 300352 - DNA, 25 bp, Homo sapien
gcagaattatcttccgtaggatttt

SEQ ID NO: 300353 - DNA, 25 bp, Homo sapien
tctaccctgttcaaaggttttggtg

SEQ ID NO: 300354 - DNA, 25 bp, Homo sapien
aaaggttttggtgacaggctcctga

SEQ ID NO: 300355 - DNA, 25 bp, Homo sapien
caggctcctgagtgaagtgaagaaa

SEQ ID NO: 300356 - DNA, 25 bp, Homo sapien
aagaaactagctccaaaagatgtga

SEQ ID NO: 300357 - DNA, 25 bp, Homo sapien
gatcaggatatctgcacctcaggag

SEQ ID NO: 300358 - DNA, 25 bp, Homo sapien
ctcaggagagactgtattccacgtg

SEQ ID NO: 300359 - DNA, 25 bp, Homo sapien
aatatgaggaagacggtgcccgatc

SEQ ID NO: 300360 - DNA, 25 bp, Homo sapien
ggtgcccgatccatccacagaaaaa

SEQ ID NO: 300361 - DNA, 25 bp, Homo sapien
taatgtcgggacatcatcttcacct

SEQ ID NO: 300362 - DNA, 25 bp, Homo sapien
acgcttttctctaacattgtcctct

SEQ ID NO: 300363 - DNA, 25 bp, Homo sapien
tctctaacattgtcctctcaggagg

SEQ ID NO: 300364 - DNA, 25 bp, Homo sapien
ccgtctgaaaataagtacacaaata

SEQ ID NO: 300365 - DNA, 25 bp, Homo sapien
ataaggctctgtgcatacgaatggg

SEQ ID NO: 300366 - DNA, 25 bp, Homo sapien
ctttgaaaggcgttgccgcggcttc

SEQ ID NO: 300367 - DNA, 25 bp, Homo sapien
tttgaaaggcgttgccgcggcttcc

SEQ ID NO: 300368 - DNA, 25 bp, Homo sapien
ttgaaaggcgttgccgcggcttcca

SEQ ID NO: 300369 - DNA, 25 bp, Homo sapien
gcgttgccgcggcttccaaagcgat

SEQ ID NO: 300370 - DNA, 25 bp, Homo sapien
gttgccgcggcttccaaagcgatgc

SEQ ID NO: 300371 - DNA, 25 bp, Homo sapien
ttgccgcggcttccaaagcgatgcg

SEQ ID NO: 300372 - DNA, 25 bp, Homo sapien
tgccgcggcttccaaagcgatgcgc

SEQ ID NO: 300373 - DNA, 25 bp, Homo sapien
cgcggcttccaaagcgatgcgctgt

SEQ ID NO: 300374 - DNA, 25 bp, Homo sapien
gcggcttccaaagcgatgcgctgtg

SEQ ID NO: 300375 - DNA, 25 bp, Homo sapien
ggaggtcacagctggatctgcttgt

SEQ ID NO: 300376 - DNA, 25 bp, Homo sapien
atctgcttgttgcatttccagctgt

SEQ ID NO: 300377 - DNA, 25 bp, Homo sapien
agctgtgcagcacgtctcagagatt

SEQ ID NO: 300378 - DNA, 25 bp, Homo sapien
gaatgaagacatttctgctctcagc

SEQ ID NO: 300379 - DNA, 25 bp, Homo sapien
aggtgcatgcatgccctctctgagt

SEQ ID NO: 300380 - DNA, 25 bp, Homo sapien
tctctgagtctggactttgcttccc

SEQ ID NO: 300381 - DNA, 25 bp, Homo sapien
gactggcctgggatatctttacaag

SEQ ID NO: 300382 - DNA, 25 bp, Homo sapien
ggatatctttacaagcaggcactgt

SEQ ID NO: 300383 - DNA, 25 bp, Homo sapien
ttttttattcgccatctgatcccca

SEQ ID NO: 300384 - DNA, 25 bp, Homo sapien
tgatccccatgcctagcagagtgct

SEQ ID NO: 300385 - DNA, 25 bp, Homo sapien
atgcctagcagagtgctggcactta

SEQ ID NO: 300386 - DNA, 25 bp, Homo sapien
gccaaagttgagagctagggaacag

SEQ ID NO: 300387 - DNA, 25 bp, Homo sapien
ggccaacaagttgcaagtaattcaa

SEQ ID NO: 300388 - DNA, 25 bp, Homo sapien
gcaagtaattcaaatctccattgga

SEQ ID NO: 300389 - DNA, 25 bp, Homo sapien
aaggggcttctcacagagcaaggcg

SEQ ID NO: 300390 - DNA, 25 bp, Homo sapien
aaggcggcagctccagggctctcta

SEQ ID NO: 300391 - DNA, 25 bp, Homo sapien
tctgccactgccatgcagatggcaa

SEQ ID NO: 300392 - DNA, 25 bp, Homo sapien
tggcaagatggccaaggcagcccct

SEQ ID NO: 300393 - DNA, 25 bp, Homo sapien
ttgcacccaggaccagtcaaatcag

SEQ ID NO: 300394 - DNA, 25 bp, Homo sapien
gtcaaatcagaatctgtgagggcat

SEQ ID NO: 300395 - DNA, 25 bp, Homo sapien
cagggagcatgagtaggagattcca

SEQ ID NO: 300396 - DNA, 25 bp, Homo sapien
gagattccagtgtgcagccaaagtt

SEQ ID NO: 300397 - DNA, 25 bp, Homo sapien
atgcttatgatctccagttgacctc

SEQ ID NO: 300398 - DNA, 25 bp, Homo sapien
ctccagttgacctccgctataaatt

SEQ ID NO: 300399 - DNA, 25 bp, Homo sapien
ggattgaggcaaatggtttctaaca

SEQ ID NO: 300400 - DNA, 25 bp, Homo sapien
ggtttctaacattcctttgggctct

SEQ ID NO: 300401 - DNA, 25 bp, Homo sapien
tgggctctaaagtttgtagttttca

SEQ ID NO: 300402 - DNA, 25 bp, Homo sapien
tgtagttttcaaatggagaaccaag

SEQ ID NO: 300403 - DNA, 25 bp, Homo sapien
aaccaaggtgtaactgccaaggagg

SEQ ID NO: 300404 - DNA, 25 bp, Homo sapien
agaccttccattctgaaatggacag

SEQ ID NO: 300405 - DNA, 25 bp, Homo sapien
gaaatggacagaagtccccacagat

SEQ ID NO: 300406 - DNA, 25 bp, Homo sapien
agaagtccccacagattctcactga

SEQ ID NO: 300407 - DNA, 25 bp, Homo sapien
tttcccctgccttacatgcttatga

SEQ ID NO: 300408 - DNA, 25 bp, Homo sapien
tttatctcttcccactttatgctgg

SEQ ID NO: 300409 - DNA, 25 bp, Homo sapien
ttatgctgggccttccctatcctgc

SEQ ID NO: 300410 - DNA, 25 bp, Homo sapien
agttagtcactaacttctccgctgg

SEQ ID NO: 300411 - DNA, 25 bp, Homo sapien
acccttatcacatctcagctacata

SEQ ID NO: 300412 - DNA, 25 bp, Homo sapien
tcacatctcagctacatatataaac

SEQ ID NO: 300413 - DNA, 25 bp, Homo sapien
ataaactctctgttatctaagtaat

SEQ ID NO: 300414 - DNA, 25 bp, Homo sapien
ttctattagccagaagcaattccag

SEQ ID NO: 300415 - DNA, 25 bp, Homo sapien
tactaggaaggtgtcatgtagcccc

SEQ ID NO: 300416 - DNA, 25 bp, Homo sapien
aaggtgtcatgtagcccctgtctaa

SEQ ID NO: 300417 - DNA, 25 bp, Homo sapien
gtagcccctgtctaacatttgaatt

SEQ ID NO: 300418 - DNA, 25 bp, Homo sapien
tatgctgataatggcaatccaactt

SEQ ID NO: 300419 - DNA, 25 bp, Homo sapien
gcacttcagaaacgctgaaacgttt

SEQ ID NO: 300420 - DNA, 25 bp, Homo sapien
aaacgctgaaacgtttcatggcaga

SEQ ID NO: 300421 - DNA, 25 bp, Homo sapien
aacgctgaaacgtttcatggcagag

SEQ ID NO: 300422 - DNA, 25 bp, Homo sapien
acgctgaaacgtttcatggcagagc

SEQ ID NO: 300423 - DNA, 25 bp, Homo sapien
cgctgaaacgtttcatggcagagca

SEQ ID NO: 300424 - DNA, 25 bp, Homo sapien
gctgaaacgtttcatggcagagcag

SEQ ID NO: 300425 - DNA, 25 bp, Homo sapien
tgaaacgtttcatggcagagcagct

SEQ ID NO: 300426 - DNA, 25 bp, Homo sapien
gaaacgtttcatggcagagcagctg

SEQ ID NO: 300427 - DNA, 25 bp, Homo sapien
gcagcagcagattcctggaaaacca

SEQ ID NO: 300428 - DNA, 25 bp, Homo sapien
cagcagcagattcctggaaaaccag

SEQ ID NO: 300429 - DNA, 25 bp, Homo sapien
agcagcagattcctggaaaaccagg

SEQ ID NO: 300430 - DNA, 25 bp, Homo sapien
cacagcgcatcgctttggaagccgc

SEQ ID NO: 300431 - DNA, 25 bp, Homo sapien
acagcgcatcgctttggaagccgcg

SEQ ID NO: 300432 - DNA, 25 bp, Homo sapien
cagcgcatcgctttggaagccgcgg

SEQ ID NO: 300433 - DNA, 25 bp, Homo sapien
agcgcatcgctttggaagccgcggc

SEQ ID NO: 300434 - DNA, 25 bp, Homo sapien
gcgcatcgctttggaagccgcggca

SEQ ID NO: 300435 - DNA, 25 bp, Homo sapien
cgcatcgctttggaagccgcggcaa

SEQ ID NO: 300436 - DNA, 25 bp, Homo sapien
gcatcgctttggaagccgcggcaac

SEQ ID NO: 300437 - DNA, 25 bp, Homo sapien
ttggaagccgcggcaacgcctttca

SEQ ID NO: 300438 - DNA, 25 bp, Homo sapien
tggaagccgcggcaacgcctttcaa

SEQ ID NO: 300439 - DNA, 25 bp, Homo sapien
ggaagccgcggcaacgcctttcaaa

SEQ ID NO: 300440 - DNA, 25 bp, Homo sapien
gaagccgcggcaacgcctttcaaag

SEQ ID NO: 300441 - DNA, 25 bp, Homo sapien
caagtacatactcctctaattttaa

SEQ ID NO: 300442 - DNA, 25 bp, Homo sapien
aatattccattcaagagtcgtaata

SEQ ID NO: 300443 - DNA, 25 bp, Homo sapien
tcaagagtcgtaatataagccaaat

SEQ ID NO: 300444 - DNA, 25 bp, Homo sapien
ataagccaaattcacagagtggaaa

SEQ ID NO: 300445 - DNA, 25 bp, Homo sapien
tggaaaaggccacactctataaagt

SEQ ID NO: 300446 - DNA, 25 bp, Homo sapien
ggccacactctataaagttgataca

SEQ ID NO: 300447 - DNA, 25 bp, Homo sapien
gatacaaacattccatgaaggtgct

SEQ ID NO: 300448 - DNA, 25 bp, Homo sapien
aaggtgctactgtgaacaagttttc

SEQ ID NO: 300449 - DNA, 25 bp, Homo sapien
ggatgaatacatgatttggagcaag

SEQ ID NO: 300450 - DNA, 25 bp, Homo sapien
gagatgacagggtttattaggttta

SEQ ID NO: 300451 - DNA, 25 bp, Homo sapien
gctgtttacaaaatgggttatatat

SEQ ID NO: 300452 - DNA, 25 bp, Homo sapien
atctgcttctagttagagcattgcc

SEQ ID NO: 300453 - DNA, 25 bp, Homo sapien
agttagagcattgccgattgccttc

SEQ ID NO: 300454 - DNA, 25 bp, Homo sapien
agcattgccgattgccttcataatt

SEQ ID NO: 300455 - DNA, 25 bp, Homo sapien
gccgattgccttcataattcataat

SEQ ID NO: 300456 - DNA, 25 bp, Homo sapien
aattcataatgtgctgtgctcctct

SEQ ID NO: 300457 - DNA, 25 bp, Homo sapien
gctcctctgagggtctatctgtatt

SEQ ID NO: 300458 - DNA, 25 bp, Homo sapien
ttttaaattcttgcagctgggtttt

SEQ ID NO: 300459 - DNA, 25 bp, Homo sapien
agctgggttttaagacacaataatg

SEQ ID NO: 300460 - DNA, 25 bp, Homo sapien
tgaggtcaggcaaaccttccagcaa

SEQ ID NO: 300461 - DNA, 25 bp, Homo sapien
ttctgcccagagaacatactgacga

SEQ ID NO: 300462 - DNA, 25 bp, Homo sapien
atactgacgacagagaacacactga

SEQ ID NO: 300463 - DNA, 25 bp, Homo sapien
gaaagtgcatatcattgttcctaac

SEQ ID NO: 300464 - DNA, 25 bp, Homo sapien
gtgcatatcattgttcctaacattt

SEQ ID NO: 300465 - DNA, 25 bp, Homo sapien
atgaacccccataaagatgttcctg

SEQ ID NO: 300466 - DNA, 25 bp, Homo sapien
gatgttcctgatctttaaaactcat

SEQ ID NO: 300467 - DNA, 25 bp, Homo sapien
gttcctgatctttaaaactcattaa

SEQ ID NO: 300468 - DNA, 25 bp, Homo sapien
aacagaattttccaaagcattagac

SEQ ID NO: 300469 - DNA, 25 bp, Homo sapien
ttttccaaagcattagacatcactt

SEQ ID NO: 300470 - DNA, 25 bp, Homo sapien
ctcagtttatctgaggtgacttcgt

SEQ ID NO: 300471 - DNA, 25 bp, Homo sapien
gactaactgagcctacatctagatt

SEQ ID NO: 300472 - DNA, 25 bp, Homo sapien
ctgagcctacatctagattttaaat

SEQ ID NO: 300473 - DNA, 25 bp, Homo sapien
ataccatcttgaatcctaataatta

SEQ ID NO: 300474 - DNA, 25 bp, Homo sapien
tacgttcaaggtagcatttgccaaa

SEQ ID NO: 300475 - DNA, 25 bp, Homo sapien
aatgatatatatttgggtgagcccg

SEQ ID NO: 300476 - DNA, 25 bp, Homo sapien
ggtgagcccgaaaagccggatctga

SEQ ID NO: 300477 - DNA, 25 bp, Homo sapien
aataacaccaggcagaacgaccgct

SEQ ID NO: 300478 - DNA, 25 bp, Homo sapien
taacgccgcaaatcatgtcattagg

SEQ ID NO: 300479 - DNA, 25 bp, Homo sapien
gaccgctcttccagttgatgggaca

SEQ ID NO: 300480 - DNA, 25 bp, Homo sapien
attcttagccaaatgctctcaccaa

SEQ ID NO: 300481 - DNA, 25 bp, Homo sapien
gcagaaagcggtggacgtgtcccca

SEQ ID NO: 300482 - DNA, 25 bp, Homo sapien
ggacgtgtccccaaagcagtttgag

SEQ ID NO: 300483 - DNA, 25 bp, Homo sapien
gcagtttgagcgcttaagatcccta

SEQ ID NO: 300484 - DNA, 25 bp, Homo sapien
gcttaagatccctactacgttcaag

SEQ ID NO: 300485 - DNA, 25 bp, Homo sapien
ggccagtctgcaggacttcaggtaa

SEQ ID NO: 300486 - DNA, 25 bp, Homo sapien
gtaaaattgtcccacccaaactgca

SEQ ID NO: 300487 - DNA, 25 bp, Homo sapien
cagaagcttgctcacttatctctac

SEQ ID NO: 300488 - DNA, 25 bp, Homo sapien
gattttctgaaatacggaccacggc

SEQ ID NO: 300489 - DNA, 25 bp, Homo sapien
ggaccacggctttcttgatctaagg

SEQ ID NO: 300490 - DNA, 25 bp, Homo sapien
tgatctaaggaagaacttgctgctg

SEQ ID NO: 300491 - DNA, 25 bp, Homo sapien
ttaccgttgcgggactagaatgggc

SEQ ID NO: 300492 - DNA, 25 bp, Homo sapien
actagaatgggcgactgcttggagc

SEQ ID NO: 300493 - DNA, 25 bp, Homo sapien
actgcttggagccagtgcttgtttt

SEQ ID NO: 300494 - DNA, 25 bp, Homo sapien
gcttgtttttatctaggacacttac

SEQ ID NO: 300495 - DNA, 25 bp, Homo sapien
gtagaatacatttatctgcatttag

SEQ ID NO: 300496 - DNA, 25 bp, Homo sapien
agggcctgtcgactgcacatggtta

SEQ ID NO: 300497 - DNA, 25 bp, Homo sapien
ggcctgtcgactgcacatggttaaa

SEQ ID NO: 300498 - DNA, 25 bp, Homo sapien
tgtcgactgcacatggttaaaataa

SEQ ID NO: 300499 - DNA, 25 bp, Homo sapien
taaaataaacctgtactggacccag

SEQ ID NO: 300500 - DNA, 25 bp, Homo sapien
actggacccagtagtgccttttaag

SEQ ID NO: 300501 - DNA, 25 bp, Homo sapien
ggacccagtagtgccttttaaggtg

SEQ ID NO: 300502 - DNA, 25 bp, Homo sapien
ccagtagtgccttttaaggtgaaag

SEQ ID NO: 300503 - DNA, 25 bp, Homo sapien
gaaaggaatggtaaatctgtacctt

SEQ ID NO: 300504 - DNA, 25 bp, Homo sapien
aaatctgtacctttaatatgtccta

SEQ ID NO: 300505 - DNA, 25 bp, Homo sapien
tacctttaatatgtcctacttttgg

SEQ ID NO: 300506 - DNA, 25 bp, Homo sapien
ttttttccatcatctgtatataaaa

SEQ ID NO: 300507 - DNA, 25 bp, Homo sapien
atctgaattagtattgttatcccat

SEQ ID NO: 300508 - DNA, 25 bp, Homo sapien
ttgttatcccattttccacatgagg

SEQ ID NO: 300509 - DNA, 25 bp, Homo sapien
gtatatcaagttaaccagtgacaag

SEQ ID NO: 300510 - DNA, 25 bp, Homo sapien
tctttcttaacaacatgagtctact

SEQ ID NO: 300511 - DNA, 25 bp, Homo sapien
gagtctactagtttttctgtcatat

SEQ ID NO: 300512 - DNA, 25 bp, Homo sapien
gattgtaagttaactctggttccaa

SEQ ID NO: 300513 - DNA, 25 bp, Homo sapien
acctgttgaatgaaatcagtgccat

SEQ ID NO: 300514 - DNA, 25 bp, Homo sapien
cagtgccatgggattgtttgaacga

SEQ ID NO: 300515 - DNA, 25 bp, Homo sapien
gtttgaacgagcttggaccttgatt

SEQ ID NO: 300516 - DNA, 25 bp, Homo sapien
tggaccttgatttccaggtctacct

SEQ ID NO: 300517 - DNA, 25 bp, Homo sapien
aggtctacctgaaatatagtcactc

SEQ ID NO: 300518 - DNA, 25 bp, Homo sapien
cttcacgtctttagtcccaaataca

SEQ ID NO: 300519 - DNA, 25 bp, Homo sapien
cacgtctttagtcccaaatacacaa

SEQ ID NO: 300520 - DNA, 25 bp, Homo sapien
cacaaaattacgtgactggcaccat

SEQ ID NO: 300521 - DNA, 25 bp, Homo sapien
aattacgtgactggcaccatgaagt

SEQ ID NO: 300522 - DNA, 25 bp, Homo sapien
accatgaagtttcagcacgtgctct

SEQ ID NO: 300523 - DNA, 25 bp, Homo sapien
gtttcagcacgtgctcttaacgtac

SEQ ID NO: 300524 - DNA, 25 bp, Homo sapien
gtgctcttaacgtacagtgatttat

SEQ ID NO: 300525 - DNA, 25 bp, Homo sapien
acgtacagtgatttatgagccttgc

SEQ ID NO: 300526 - DNA, 25 bp, Homo sapien
aagcagccagcacataccttttcat

SEQ ID NO: 300527 - DNA, 25 bp, Homo sapien
agccagcacataccttttcatttac

SEQ ID NO: 300528 - DNA, 25 bp, Homo sapien
caacttcatagcaaaatctgtatta

SEQ ID NO: 300529 - DNA, 25 bp, Homo sapien
tgctcacgggagaccttctatgctg

SEQ ID NO: 300530 - DNA, 25 bp, Homo sapien
ttctatgctgccgttagctgacata

SEQ ID NO: 300531 - DNA, 25 bp, Homo sapien
ttagctgacatagaccacttggaac

SEQ ID NO: 300532 - DNA, 25 bp, Homo sapien
ccaacctcactaaacttcgcaaaat

SEQ ID NO: 300533 - DNA, 25 bp, Homo sapien
aaacttcgcaaaatggcccaggcct

SEQ ID NO: 300534 - DNA, 25 bp, Homo sapien
actgactgtccagaaggtgttggca

SEQ ID NO: 300535 - DNA, 25 bp, Homo sapien
agaaggtgttggcatcccaagcctg

SEQ ID NO: 300536 - DNA, 25 bp, Homo sapien
gagcttacaggaaagttgccgcctt

SEQ ID NO: 300537 - DNA, 25 bp, Homo sapien
aaagttgccgccttattgaagctct

SEQ ID NO: 300538 - DNA, 25 bp, Homo sapien
gccttattgaagctctgtcctcatg

SEQ ID NO: 300539 - DNA, 25 bp, Homo sapien
gccattccagtgtgctcacgggaga

SEQ ID NO: 300540 - DNA, 25 bp, Homo sapien
gtaaaataattacatgcctaatgaa

SEQ ID NO: 300541 - DNA, 25 bp, Homo sapien
gaaaagaagatgtcatttcctaatt

SEQ ID NO: 300542 - DNA, 25 bp, Homo sapien
aattttgatatctcattttcggcat

SEQ ID NO: 300543 - DNA, 25 bp, Homo sapien
tgatatctcattttcggcatttttt

SEQ ID NO: 300544 - DNA, 25 bp, Homo sapien
ttgtgttcacacagattgctgaatt

SEQ ID NO: 300545 - DNA, 25 bp, Homo sapien
gctgaattgatttctccatatttgt

SEQ ID NO: 300546 - DNA, 25 bp, Homo sapien
gaattgatttctccatatttgttaa

SEQ ID NO: 300547 - DNA, 25 bp, Homo sapien
caaatgcttttatgactaatgtaaa

SEQ ID NO: 300548 - DNA, 25 bp, Homo sapien
gaaaagaggcttacattttaaatgt

SEQ ID NO: 300549 - DNA, 25 bp, Homo sapien
ttattgtaaaaagtccaagcagatc

SEQ ID NO: 300550 - DNA, 25 bp, Homo sapien
gtccaagcagatcaataaactatat

SEQ ID NO: 300551 - DNA, 25 bp, Homo sapien
tcaaaggttctatatgtcacacaat

SEQ ID NO: 300552 - DNA, 25 bp, Homo sapien
tatgtcacacaatcgtaattccaaa

SEQ ID NO: 300553 - DNA, 25 bp, Homo sapien
atcgtaattccaaaagccattatgg

SEQ ID NO: 300554 - DNA, 25 bp, Homo sapien
agggtgtaaagccttcagatatttc

SEQ ID NO: 300555 - DNA, 25 bp, Homo sapien
tatttccccagttagtagagtgtct

SEQ ID NO: 300556 - DNA, 25 bp, Homo sapien
agagtgtctgcggtttttgttctac

SEQ ID NO: 300557 - DNA, 25 bp, Homo sapien
gtctgcggtttttgttctactatat

SEQ ID NO: 300558 - DNA, 25 bp, Homo sapien
gttctactatatgcttgtccatttt

SEQ ID NO: 300559 - DNA, 25 bp, Homo sapien
gtatctcatggtttgcagactgttt

SEQ ID NO: 300560 - DNA, 25 bp, Homo sapien
ctgttaaaaaccagctcttcaagct

SEQ ID NO: 300561 - DNA, 25 bp, Homo sapien
agctcttcaagctgaaatgctaatt

SEQ ID NO: 300562 - DNA, 25 bp, Homo sapien
caccctcccagcaggagtctcactg

SEQ ID NO: 300563 - DNA, 25 bp, Homo sapien
cagatgacacgattcatttattcat

SEQ ID NO: 300564 - DNA, 25 bp, Homo sapien
atatgtgactacaaagaaccagcga

SEQ ID NO: 300565 - DNA, 25 bp, Homo sapien
gtgactacaaagaaccagcgaaata

SEQ ID NO: 300566 - DNA, 25 bp, Homo sapien
aagaaccagcgaaataaatacatag

SEQ ID NO: 300567 - DNA, 25 bp, Homo sapien
atacatagatattagatagtccaat

SEQ ID NO: 300568 - DNA, 25 bp, Homo sapien
agtccaataacttaaggcgcccgtg

SEQ ID NO: 300569 - DNA, 25 bp, Homo sapien
ccaataacttaaggcgcccgtgcaa

SEQ ID NO: 300570 - DNA, 25 bp, Homo sapien
taacttaaggcgcccgtgcaacgga

SEQ ID NO: 300571 - DNA, 25 bp, Homo sapien
actggatgagggtgtcctgcccgcc

SEQ ID NO: 300572 - DNA, 25 bp, Homo sapien
gatgagggtgtcctgcccgcccatt

SEQ ID NO: 300573 - DNA, 25 bp, Homo sapien
tggcctggctccgacttggtttcag

SEQ ID NO: 300574 - DNA, 25 bp, Homo sapien
ggctccgacttggtttcagggctct

SEQ ID NO: 300575 - DNA, 25 bp, Homo sapien
ggctcgtcaggtgctggagcctcct

SEQ ID NO: 300576 - DNA, 25 bp, Homo sapien
tgctggagcctcctctcgtagtcag

SEQ ID NO: 300577 - DNA, 25 bp, Homo sapien
tcgtagtcagccttgagctccagca

SEQ ID NO: 300578 - DNA, 25 bp, Homo sapien
cagcatttccctggagagcgtgagg

SEQ ID NO: 300579 - DNA, 25 bp, Homo sapien
tttccctggagagcgtgaggactcg

SEQ ID NO: 300580 - DNA, 25 bp, Homo sapien
gtgaggactcgctcggcgtgctctg

SEQ ID NO: 300581 - DNA, 25 bp, Homo sapien
tccagggcctggatgcgctgtagaa

SEQ ID NO: 300582 - DNA, 25 bp, Homo sapien
ggatgcgctgtagaagggcttcctc

SEQ ID NO: 300583 - DNA, 25 bp, Homo sapien
tgcgctgtagaagggcttcctcctc

SEQ ID NO: 300584 - DNA, 25 bp, Homo sapien
cattgggtattttgaatgtttttct

SEQ ID NO: 300585 - DNA, 25 bp, Homo sapien
ttcttttctcaccttatcctagaac

SEQ ID NO: 300586 - DNA, 25 bp, Homo sapien
tcttttctcaccttatcctagaact

SEQ ID NO: 300587 - DNA, 25 bp, Homo sapien
cttttctcaccttatcctagaactt

SEQ ID NO: 300588 - DNA, 25 bp, Homo sapien
ttctcaccttatcctagaacttgag

SEQ ID NO: 300589 - DNA, 25 bp, Homo sapien
tctcaccttatcctagaacttgagg

SEQ ID NO: 300590 - DNA, 25 bp, Homo sapien
tcaccttatcctagaacttgaggct

SEQ ID NO: 300591 - DNA, 25 bp, Homo sapien
caccttatcctagaacttgaggctg

SEQ ID NO: 300592 - DNA, 25 bp, Homo sapien
accttatcctagaacttgaggctgg

SEQ ID NO: 300593 - DNA, 25 bp, Homo sapien
cttatcctagaacttgaggctgggc

SEQ ID NO: 300594 - DNA, 25 bp, Homo sapien
ttatcctagaacttgaggctgggcg

SEQ ID NO: 300595 - DNA, 25 bp, Homo sapien
gccagatctcattctcccgggtgtc

SEQ ID NO: 300596 - DNA, 25 bp, Homo sapien
gggtgtcccgagtgttctggccatc

SEQ ID NO: 300597 - DNA, 25 bp, Homo sapien
agttcctccttcagtgaccggatga

SEQ ID NO: 300598 - DNA, 25 bp, Homo sapien
agtgaccggatgatgccctgcagaa

SEQ ID NO: 300599 - DNA, 25 bp, Homo sapien
ggatgatgccctgcagaaccacggg

SEQ ID NO: 300600 - DNA, 25 bp, Homo sapien
tagtgaatcctgtcaaactccacgg

SEQ ID NO: 300601 - DNA, 25 bp, Homo sapien
gaatcctgtcaaactccacggagta

SEQ ID NO: 300602 - DNA, 25 bp, Homo sapien
aactccacggagtagatgaggatca

SEQ ID NO: 300603 - DNA, 25 bp, Homo sapien
agtagatgaggatcaggtagcgctt

SEQ ID NO: 300604 - DNA, 25 bp, Homo sapien
atcaggtagcgcttggagttgagct

SEQ ID NO: 300605 - DNA, 25 bp, Homo sapien
ttgcggttccgcagggactccaggt

SEQ ID NO: 300606 - DNA, 25 bp, Homo sapien
ttatgcaaagctctagaagatgcaa

SEQ ID NO: 300607 - DNA, 25 bp, Homo sapien
gatgcaaattaacctacagtgactg

SEQ ID NO: 300608 - DNA, 25 bp, Homo sapien
taacctacagtgactgaaggcagaa

SEQ ID NO: 300609 - DNA, 25 bp, Homo sapien
gcagcccaaggcgaaaaagtcgatc

SEQ ID NO: 300610 - DNA, 25 bp, Homo sapien
gaaaaagtcgatcctgtgccctgag

SEQ ID NO: 300611 - DNA, 25 bp, Homo sapien
gtgccctgagcacaggcagtcctga

SEQ ID NO: 300612 - DNA, 25 bp, Homo sapien
cagtcctgaggtgcgagcggtttcc

SEQ ID NO: 300613 - DNA, 25 bp, Homo sapien
gctcttcttggcctttcgagaactt

SEQ ID NO: 300614 - DNA, 25 bp, Homo sapien
ttcttggcctttcgagaacttcagc

SEQ ID NO: 300615 - DNA, 25 bp, Homo sapien
tggcctttcgagaacttcagcccct

SEQ ID NO: 300616 - DNA, 25 bp, Homo sapien
tctctgctgtttcctgttgctggca

SEQ ID NO: 300617 - DNA, 25 bp, Homo sapien
ccaggcctggagacctttgttctct

SEQ ID NO: 300618 - DNA, 25 bp, Homo sapien
agaaaatgaagttcctctccatacc

SEQ ID NO: 300619 - DNA, 25 bp, Homo sapien
gctgtgaagctcgaagtggcagctt

SEQ ID NO: 300620 - DNA, 25 bp, Homo sapien
gctcgaagtggcagcttaaaaaact

SEQ ID NO: 300621 - DNA, 25 bp, Homo sapien
aaaaactgcccatctcaggaggtgt

SEQ ID NO: 300622 - DNA, 25 bp, Homo sapien
ctgcccatctcaggaggtgtcttaa

SEQ ID NO: 300623 - DNA, 25 bp, Homo sapien
tctggaaatattgctgtgtatctgc

SEQ ID NO: 300624 - DNA, 25 bp, Homo sapien
aaggaggacataccgctggctcctg

SEQ ID NO: 300625 - DNA, 25 bp, Homo sapien
gctggctcctgcctttctcacttag

SEQ ID NO: 300626 - DNA, 25 bp, Homo sapien
gcaaagcagcttgatatagtggaaa

SEQ ID NO: 300627 - DNA, 25 bp, Homo sapien
gatttggattctagccccttagctg

SEQ ID NO: 300628 - DNA, 25 bp, Homo sapien
gtgtttagcaagaagctactcctag

SEQ ID NO: 300629 - DNA, 25 bp, Homo sapien
agctactcctagcttttgctaaaat

SEQ ID NO: 300630 - DNA, 25 bp, Homo sapien
gctaaaatatggttggcactgcctc

SEQ ID NO: 300631 - DNA, 25 bp, Homo sapien
ttggcactgcctcttgtggcacagg

SEQ ID NO: 300632 - DNA, 25 bp, Homo sapien
gtggcacaggccataattgttccat

SEQ ID NO: 300633 - DNA, 25 bp, Homo sapien
ataattgttccatagacccctctct

SEQ ID NO: 300634 - DNA, 25 bp, Homo sapien
tttctttggccattgtttgtttata

SEQ ID NO: 300635 - DNA, 25 bp, Homo sapien
tatatttcacaaactccacctactg

SEQ ID NO: 300636 - DNA, 25 bp, Homo sapien
ttttttaagaatggcctgatcatgg

SEQ ID NO: 300637 - DNA, 25 bp, Homo sapien
tgatcatggctatctcagccacatt

SEQ ID NO: 300638 - DNA, 25 bp, Homo sapien
ctcagccacattgttggcaatttaa

SEQ ID NO: 300639 - DNA, 25 bp, Homo sapien
gcctcaggcaagaaataaccaagcc

SEQ ID NO: 300640 - DNA, 25 bp, Homo sapien
agaaataaccaagccgagttgcctc

SEQ ID NO: 300641 - DNA, 25 bp, Homo sapien
ataaccaagccgagttgcctctgca

SEQ ID NO: 300642 - DNA, 25 bp, Homo sapien
aagccgagttgcctctgcacagcag

SEQ ID NO: 300643 - DNA, 25 bp, Homo sapien
gagttgcctctgcacagcagtgagc

SEQ ID NO: 300644 - DNA, 25 bp, Homo sapien
agcagtgagctcctggtggccctgg

SEQ ID NO: 300645 - DNA, 25 bp, Homo sapien
caggccttcttgttccctttgtgtg

SEQ ID NO: 300646 - DNA, 25 bp, Homo sapien
ttcttgttccctttgtgtgctccag

SEQ ID NO: 300647 - DNA, 25 bp, Homo sapien
aagggggcagcaccagatccagatc

SEQ ID NO: 300648 - DNA, 25 bp, Homo sapien
gcttgctgacaccagcgtttggagc

SEQ ID NO: 300649 - DNA, 25 bp, Homo sapien
tgacaccagcgtttggagcctcctg

SEQ ID NO: 300650 - DNA, 25 bp, Homo sapien
ggtctctatataatgaacacttaag

SEQ ID NO: 300651 - DNA, 25 bp, Homo sapien
agataactgtatgggccttttcctt

SEQ ID NO: 300652 - DNA, 25 bp, Homo sapien
aaatccacatgtgataacctatgtt

SEQ ID NO: 300653 - DNA, 25 bp, Homo sapien
gggctggtcacatgattccttgtca

SEQ ID NO: 300654 - DNA, 25 bp, Homo sapien
gattccttgtcatgaaggctgctct

SEQ ID NO: 300655 - DNA, 25 bp, Homo sapien
tcatgaaggctgctcttcactcttt

SEQ ID NO: 300656 - DNA, 25 bp, Homo sapien
cactcttttgtacttgtgattaaaa

SEQ ID NO: 300657 - DNA, 25 bp, Homo sapien
ttatactgtcataccccaaacattg

SEQ ID NO: 300658 - DNA, 25 bp, Homo sapien
gtcataccccaaacattgtcacttt

SEQ ID NO: 300659 - DNA, 25 bp, Homo sapien
gtcactttttaatgtaccagtctgc

SEQ ID NO: 300660 - DNA, 25 bp, Homo sapien
gtaccagtctgctagaaatctacaa

SEQ ID NO: 300661 - DNA, 25 bp, Homo sapien
gttccatagccagagatacaggact

SEQ ID NO: 300662 - DNA, 25 bp, Homo sapien
agatggcttatgatgaaacctgctg

SEQ ID NO: 300663 - DNA, 25 bp, Homo sapien
atgaaacctgctgccttcttaaaat

SEQ ID NO: 300664 - DNA, 25 bp, Homo sapien
gaagggcaagtgttttactatacga

SEQ ID NO: 300665 - DNA, 25 bp, Homo sapien
agatgattcgcttagcctcagtgaa

SEQ ID NO: 300666 - DNA, 25 bp, Homo sapien
tagagagcctagcatcacagtccca

SEQ ID NO: 300667 - DNA, 25 bp, Homo sapien
tagcatcacagtcccaattcagcac

SEQ ID NO: 300668 - DNA, 25 bp, Homo sapien
tactatacgatcacatatgggtcat

SEQ ID NO: 300669 - DNA, 25 bp, Homo sapien
atatgggtcatacgccccttttact

SEQ ID NO: 300670 - DNA, 25 bp, Homo sapien
tttactacctatatgcccatcctgc

SEQ ID NO: 300671 - DNA, 25 bp, Homo sapien
aagacataaagttccatagccagag

SEQ ID NO: 300672 - DNA, 25 bp, Homo sapien
aatacgctcatatggttggagtgtt

SEQ ID NO: 300673 - DNA, 25 bp, Homo sapien
aagtgaacctctgattttgtcaggg

SEQ ID NO: 300674 - DNA, 25 bp, Homo sapien
gattttgtcagggtttttctacgtg

SEQ ID NO: 300675 - DNA, 25 bp, Homo sapien
tgtcagggtttttctacgtgtaggc

SEQ ID NO: 300676 - DNA, 25 bp, Homo sapien
ggtttttctacgtgtaggcgtgaat

SEQ ID NO: 300677 - DNA, 25 bp, Homo sapien
ggcaccccttcaaaactgtacaaag

SEQ ID NO: 300678 - DNA, 25 bp, Homo sapien
caaagaagacgactgttttccattt

SEQ ID NO: 300679 - DNA, 25 bp, Homo sapien
ggagtttgacgtataaattgtttat

SEQ ID NO: 300680 - DNA, 25 bp, Homo sapien
aattgtttatgcttttggtgtaatc

SEQ ID NO: 300681 - DNA, 25 bp, Homo sapien
tatgcttttggtgtaatctcttaat

SEQ ID NO: 300682 - DNA, 25 bp, Homo sapien
gtgtaatctcttaataaactggttc

SEQ ID NO: 300683 - DNA, 25 bp, Homo sapien
cttgttttgatgtctaatctgtatc

SEQ ID NO: 300684 - DNA, 25 bp, Homo sapien
aatctgtatctataatgtaccctag

SEQ ID NO: 300685 - DNA, 25 bp, Homo sapien
gtaccctagtagtcgaacatacttt

SEQ ID NO: 300686 - DNA, 25 bp, Homo sapien
caattgtacatttgtatacctgtaa

SEQ ID NO: 300687 - DNA, 25 bp, Homo sapien
gaatcaacataaacacgttttttgg

SEQ ID NO: 300688 - DNA, 25 bp, Homo sapien
aagagaattagccagccctgtgcat

SEQ ID NO: 300689 - DNA, 25 bp, Homo sapien
ccagccctgtgcattcagtgtatat

SEQ ID NO: 300690 - DNA, 25 bp, Homo sapien
cagtgtatattctcaccttttatgg

SEQ ID NO: 300691 - DNA, 25 bp, Homo sapien
tctcaccttttatggtcgtagcata

SEQ ID NO: 300692 - DNA, 25 bp, Homo sapien
gtaaattgtaatttcaaccagaagt

SEQ ID NO: 300693 - DNA, 25 bp, Homo sapien
tgttctttatacagcctagttaatg

SEQ ID NO: 300694 - DNA, 25 bp, Homo sapien
gagggtctggtgactactagaccaa

SEQ ID NO: 300695 - DNA, 25 bp, Homo sapien
gtctggtgactactagaccaagggc

SEQ ID NO: 300696 - DNA, 25 bp, Homo sapien
gtgactactagaccaagggcatggc

SEQ ID NO: 300697 - DNA, 25 bp, Homo sapien
actactagaccaagggcatggcagc

SEQ ID NO: 300698 - DNA, 25 bp, Homo sapien
gcagagggcagctgaaagacttcag

SEQ ID NO: 300699 - DNA, 25 bp, Homo sapien
gagggcagctgaaagacttcaggaa

SEQ ID NO: 300700 - DNA, 25 bp, Homo sapien
gaaaccggatgagaggaaagacctg

SEQ ID NO: 300701 - DNA, 25 bp, Homo sapien
aagacctggaagctattgtaaaatc

SEQ ID NO: 300702 - DNA, 25 bp, Homo sapien
ctggaagctattgtaaaatctatgc

SEQ ID NO: 300703 - DNA, 25 bp, Homo sapien
aatctatgctgagggtctggtgact

SEQ ID NO: 300704 - DNA, 25 bp, Homo sapien
tatgctgagggtctggtgactacta

SEQ ID NO: 300705 - DNA, 25 bp, Homo sapien
gttctggtttcaataacttgttcaa

SEQ ID NO: 300706 - DNA, 25 bp, Homo sapien
tggtttcaataacttgttcaaggtc

SEQ ID NO: 300707 - DNA, 25 bp, Homo sapien
ttcaaggtcacacagaaccctaaat

SEQ ID NO: 300708 - DNA, 25 bp, Homo sapien
gaaccctaaatagagccagaaacta

SEQ ID NO: 300709 - DNA, 25 bp, Homo sapien
atatattttcattggactcctgctg

SEQ ID NO: 300710 - DNA, 25 bp, Homo sapien
attttcattggactcctgctgtcca

SEQ ID NO: 300711 - DNA, 25 bp, Homo sapien
cctgctgtccatttactgacaatat

SEQ ID NO: 300712 - DNA, 25 bp, Homo sapien
attttttaccatattctatgacatg

SEQ ID NO: 300713 - DNA, 25 bp, Homo sapien
tgagctaacatccatagagtgctta

SEQ ID NO: 300714 - DNA, 25 bp, Homo sapien
aacagtatctggcacatggtaatta

SEQ ID NO: 300715 - DNA, 25 bp, Homo sapien
ctggcacatggtaattaggtgtaac

SEQ ID NO: 300716 - DNA, 25 bp, Homo sapien
ataatatgatttccagtgtttactg

SEQ ID NO: 300717 - DNA, 25 bp, Homo sapien
gtgtttactgtagtgtatcttgtac

SEQ ID NO: 300718 - DNA, 25 bp, Homo sapien
gtgtatcttgtacagataacatgta

SEQ ID NO: 300719 - DNA, 25 bp, Homo sapien
cggaattgaagctattttttcttgc

SEQ ID NO: 300720 - DNA, 25 bp, Homo sapien
ttcttgcatttctaattgacctgag

SEQ ID NO: 300721 - DNA, 25 bp, Homo sapien
ttgacctgagggacattccgtttga

SEQ ID NO: 300722 - DNA, 25 bp, Homo sapien
ggacattccgtttgaaatgtactga

SEQ ID NO: 300723 - DNA, 25 bp, Homo sapien
gtactgaagttacagtttctggttt

SEQ ID NO: 300724 - DNA, 25 bp, Homo sapien
ataatgcttgaaatgtctaactatt

SEQ ID NO: 300725 - DNA, 25 bp, Homo sapien
aagtgttctttttatttgactgaca

SEQ ID NO: 300726 - DNA, 25 bp, Homo sapien
tttgactgacaattcattttacact

SEQ ID NO: 300727 - DNA, 25 bp, Homo sapien
ccacatcttgagcttcatacacaaa

SEQ ID NO: 300728 - DNA, 25 bp, Homo sapien
ttgagcttcatacacaaatgcaaac

SEQ ID NO: 300729 - DNA, 25 bp, Homo sapien
aaatgcaaaccctccttcggccagg

SEQ ID NO: 300730 - DNA, 25 bp, Homo sapien
gtctgccccacgaagtcactctggt

SEQ ID NO: 300731 - DNA, 25 bp, Homo sapien
aagtcactctggtcgcggccggaag

SEQ ID NO: 300732 - DNA, 25 bp, Homo sapien
gaagcaccgcccagggagcctggac

SEQ ID NO: 300733 - DNA, 25 bp, Homo sapien
gcctggacccgccaagaagtcgagc

SEQ ID NO: 300734 - DNA, 25 bp, Homo sapien
gactgcagcagcgacatggcggtgg

SEQ ID NO: 300735 - DNA, 25 bp, Homo sapien
gcgacatggcggtggctgcgccgca

SEQ ID NO: 300736 - DNA, 25 bp, Homo sapien
cagccggagtggtcgggctcgggct

SEQ ID NO: 300737 - DNA, 25 bp, Homo sapien
tcgccgtccgggtcagctcagcaac

SEQ ID NO: 300738 - DNA, 25 bp, Homo sapien
caaaacgcggctgaggatggaactc

SEQ ID NO: 300739 - DNA, 25 bp, Homo sapien
aggatggaactcagaatgaaactgc

SEQ ID NO: 300740 - DNA, 25 bp, Homo sapien
agaatgaaactgcaacccacctgcc

SEQ ID NO: 300741 - DNA, 25 bp, Homo sapien
gggcgcccttccaaagcacatactc

SEQ ID NO: 300742 - DNA, 25 bp, Homo sapien
atactcaccgaatgtttacagactg

SEQ ID NO: 300743 - DNA, 25 bp, Homo sapien
atgtttacagactggctgtcctggc

SEQ ID NO: 300744 - DNA, 25 bp, Homo sapien
acagactggctgtcctggcagggct

SEQ ID NO: 300745 - DNA, 25 bp, Homo sapien
tggctgtcctggcagggctttcaac

SEQ ID NO: 300746 - DNA, 25 bp, Homo sapien
tggcagggctttcaactgcacatgt

SEQ ID NO: 300747 - DNA, 25 bp, Homo sapien
atgagttgcaaccaaaacgcggctg

SEQ ID NO: 300748 - DNA, 25 bp, Homo sapien
gttgcaaccaaaacgcggctgagga

SEQ ID NO: 300749 - DNA, 25 bp, Homo sapien
gaggcgaggcgaggcacagcgcatc

SEQ ID NO: 300750 - DNA, 25 bp, Homo sapien
acagcgcatcgctttggaagccgcg

SEQ ID NO: 300751 - DNA, 25 bp, Homo sapien
agcgcatcgctttggaagccgcggc

SEQ ID NO: 300752 - DNA, 25 bp, Homo sapien
cgcatcgctttggaagccgcggcaa

SEQ ID NO: 300753 - DNA, 25 bp, Homo sapien
gcatcgctttggaagccgcggcaac

SEQ ID NO: 300754 - DNA, 25 bp, Homo sapien
atcgctttggaagccgcggcaacgc

SEQ ID NO: 300755 - DNA, 25 bp, Homo sapien
tggaagccgcggcaacgcctttcaa

SEQ ID NO: 300756 - DNA, 25 bp, Homo sapien
gaagccgcggcaacgcctttcaaag

SEQ ID NO: 300757 - DNA, 25 bp, Homo sapien
ttcaaagccccattcgtatgcacag

SEQ ID NO: 300758 - DNA, 25 bp, Homo sapien
cgtatgcacagagccttattccctt

SEQ ID NO: 300759 - DNA, 25 bp, Homo sapien
tttgtgtacttattttcagacggag

SEQ ID NO: 300760 - DNA, 25 bp, Homo sapien
tgggctcgcttcctgcttcagtttc

SEQ ID NO: 300761 - DNA, 25 bp, Homo sapien
ttcagtttccccaagctcccgatga

SEQ ID NO: 300762 - DNA, 25 bp, Homo sapien
aagctcccgatgagactccgctact

SEQ ID NO: 300763 - DNA, 25 bp, Homo sapien
actaccaccacgtcgataacgcaaa

SEQ ID NO: 300764 - DNA, 25 bp, Homo sapien
acgtcgataacgcaaacctagaggg

SEQ ID NO: 300765 - DNA, 25 bp, Homo sapien
taacgcaaacctagagggactcagg

SEQ ID NO: 300766 - DNA, 25 bp, Homo sapien
acctagagggactcagggtaaactg

SEQ ID NO: 300767 - DNA, 25 bp, Homo sapien
aggcactcaaactgccgaggagctc

SEQ ID NO: 300768 - DNA, 25 bp, Homo sapien
ctccgcctcccgagagacatttaat

SEQ ID NO: 300769 - DNA, 25 bp, Homo sapien
gcctcccgagagacatttaatccgg

SEQ ID NO: 300770 - DNA, 25 bp, Homo sapien
tgctcgcaggaagggcctggctcca

SEQ ID NO: 300771 - DNA, 25 bp, Homo sapien
gaaggcacagtgtcaagagcgcccc

SEQ ID NO: 300772 - DNA, 25 bp, Homo sapien
acagtgtcaagagcgcccctgttgg

SEQ ID NO: 300773 - DNA, 25 bp, Homo sapien
ctgttggcatatgaagacccaggag

SEQ ID NO: 300774 - DNA, 25 bp, Homo sapien
catatgaagacccaggagtgctgac

SEQ ID NO: 300775 - DNA, 25 bp, Homo sapien
gcctggcacagcaggaggcactcct

SEQ ID NO: 300776 - DNA, 25 bp, Homo sapien
aggaggcactcctgtttctgtccct

SEQ ID NO: 300777 - DNA, 25 bp, Homo sapien
atagatcatgtttattcccaagccc

SEQ ID NO: 300778 - DNA, 25 bp, Homo sapien
gatcatgtttattcccaagccccaa

SEQ ID NO: 300779 - DNA, 25 bp, Homo sapien
tgtttattcccaagccccaaccaga

SEQ ID NO: 300780 - DNA, 25 bp, Homo sapien
aaccagacatgttctacccctcaag

SEQ ID NO: 300781 - DNA, 25 bp, Homo sapien
atgttctacccctcaagatccctga

SEQ ID NO: 300782 - DNA, 25 bp, Homo sapien
agaccccaaggatggacctcaggaa

SEQ ID NO: 300783 - DNA, 25 bp, Homo sapien
aggttttcagtcctagtccatcatg

SEQ ID NO: 300784 - DNA, 25 bp, Homo sapien
agtcctagtccatcatgaccacata

SEQ ID NO: 300785 - DNA, 25 bp, Homo sapien
ctagtccatcatgaccacatagctg

SEQ ID NO: 300786 - DNA, 25 bp, Homo sapien
gctggaatacacttatttcacttgt

SEQ ID NO: 300787 - DNA, 25 bp, Homo sapien
caagcaactgttagagttgcagaca

SEQ ID NO: 300788 - DNA, 25 bp, Homo sapien
gtaaatggctgttcaaatcttgcat

SEQ ID NO: 300789 - DNA, 25 bp, Homo sapien
aaatcttgcatcttacccgtgatcc

SEQ ID NO: 300790 - DNA, 25 bp, Homo sapien
atggagctaagatcccagcactgag

SEQ ID NO: 300791 - DNA, 25 bp, Homo sapien
taagatcccagcactgagaagatgg

SEQ ID NO: 300792 - DNA, 25 bp, Homo sapien
gagaagatgggcattcctagcaggg

SEQ ID NO: 300793 - DNA, 25 bp, Homo sapien
tcaccagcctgggtttgtaagtcag

SEQ ID NO: 300794 - DNA, 25 bp, Homo sapien
gtttgtaagtcagagctgttggtca

SEQ ID NO: 300795 - DNA, 25 bp, Homo sapien
ggcagctaatgagtaatcagtccaa

SEQ ID NO: 300796 - DNA, 25 bp, Homo sapien
taagtgaacaaaccagcttcctcca

SEQ ID NO: 300797 - DNA, 25 bp, Homo sapien
agcttcctccataaacaaggtcaga

SEQ ID NO: 300798 - DNA, 25 bp, Homo sapien
ataacccagtgtatttcataaaagc

SEQ ID NO: 300799 - DNA, 25 bp, Homo sapien
gcaaaaacgcatctccatttacata

SEQ ID NO: 300800 - DNA, 25 bp, Homo sapien
ataactttactatggagctcatgat

SEQ ID NO: 300801 - DNA, 25 bp, Homo sapien
aaatctcacttgtataccgtcttta

SEQ ID NO: 300802 - DNA, 25 bp, Homo sapien
gtctttaataaggacccatgccatt

SEQ ID NO: 300803 - DNA, 25 bp, Homo sapien
aataaggacccatgccattctgatg

SEQ ID NO: 300804 - DNA, 25 bp, Homo sapien
gccttcgctcctcaccatgtgtaag

SEQ ID NO: 300805 - DNA, 25 bp, Homo sapien
gcctgaggtgccctaaacacactat

SEQ ID NO: 300806 - DNA, 25 bp, Homo sapien
tgaggtgccctaaacacactatgac

SEQ ID NO: 300807 - DNA, 25 bp, Homo sapien
aggtgccctaaacacactatgaccg

SEQ ID NO: 300808 - DNA, 25 bp, Homo sapien
gtgccctaaacacactatgaccgct

SEQ ID NO: 300809 - DNA, 25 bp, Homo sapien
aaacacactatgaccgctcccgaaa

SEQ ID NO: 300810 - DNA, 25 bp, Homo sapien
tgaccgctcccgaaaagcccgtgaa

SEQ ID NO: 300811 - DNA, 25 bp, Homo sapien
gctcccgaaaagcccgtgaaacaag

SEQ ID NO: 300812 - DNA, 25 bp, Homo sapien
acaagaggaaatggctgccttggac

SEQ ID NO: 300813 - DNA, 25 bp, Homo sapien
aatggctgccttggacgtggatagc

SEQ ID NO: 300814 - DNA, 25 bp, Homo sapien
gccacggcgagtatctgcagcagca

SEQ ID NO: 300815 - DNA, 25 bp, Homo sapien
gaaaggcctttggtcttctgacaca

SEQ ID NO: 300816 - DNA, 25 bp, Homo sapien
tttggtcttctgacacagcttgctc

SEQ ID NO: 300817 - DNA, 25 bp, Homo sapien
tggtcttctgacacagcttgctcaa

SEQ ID NO: 300818 - DNA, 25 bp, Homo sapien
tctgacacagcttgctcaacatcag

SEQ ID NO: 300819 - DNA, 25 bp, Homo sapien
taatcgtggctcaaaccttgttcaa

SEQ ID NO: 300820 - DNA, 25 bp, Homo sapien
tagacttcacctacaactttctctg

SEQ ID NO: 300821 - DNA, 25 bp, Homo sapien
acctacaactttctctgcatcaaaa

SEQ ID NO: 300822 - DNA, 25 bp, Homo sapien
acaactttctctgcatcaaaaactt

SEQ ID NO: 300823 - DNA, 25 bp, Homo sapien
gtgggacagccttcagacatcagta

SEQ ID NO: 300824 - DNA, 25 bp, Homo sapien
ggacagccttcagacatcagtagca

SEQ ID NO: 300825 - DNA, 25 bp, Homo sapien
gccttcagacatcagtagcaactta

SEQ ID NO: 300826 - DNA, 25 bp, Homo sapien
gaacctgtcgtaccagcatcatgag

SEQ ID NO: 300827 - DNA, 25 bp, Homo sapien
accagcatcatgagctggatgcagg

SEQ ID NO: 300828 - DNA, 25 bp, Homo sapien
gttaaaacgcccagtggtcattaag

SEQ ID NO: 300829 - DNA, 25 bp, Homo sapien
aacgcccagtggtcattaagtgaaa

SEQ ID NO: 300830 - DNA, 25 bp, Homo sapien
gtgaaacatcttttatcaacctgca

SEQ ID NO: 300831 - DNA, 25 bp, Homo sapien
acctgcaaaagctgcagcgttctct

SEQ ID NO: 300832 - DNA, 25 bp, Homo sapien
agcgttctctgccaggtcaaatggg

SEQ ID NO: 300833 - DNA, 25 bp, Homo sapien
gccaggtcaaatgggcatgtttaga

SEQ ID NO: 300834 - DNA, 25 bp, Homo sapien
gaagatggctgagtatagctaatga

SEQ ID NO: 300835 - DNA, 25 bp, Homo sapien
gcagatacttttatgtggaacaaca

SEQ ID NO: 300836 - DNA, 25 bp, Homo sapien
gtaaaagaacctgtcgtaccagcat

SEQ ID NO: 300837 - DNA, 25 bp, Homo sapien
caagaagttgtttaagcctaggcct

SEQ ID NO: 300838 - DNA, 25 bp, Homo sapien
ttaagcctaggcctaggcagtccac

SEQ ID NO: 300839 - DNA, 25 bp, Homo sapien
gctccagggctggtgctctagcaga

SEQ ID NO: 300840 - DNA, 25 bp, Homo sapien
tggtgctctagcagatccgctcagg

SEQ ID NO: 300841 - DNA, 25 bp, Homo sapien
tagcagatccgctcaggcacggttg

SEQ ID NO: 300842 - DNA, 25 bp, Homo sapien
atccgctcaggcacggttgggtgac

SEQ ID NO: 300843 - DNA, 25 bp, Homo sapien
gtcaccgattgcgtagattatttct

SEQ ID NO: 300844 - DNA, 25 bp, Homo sapien
agattatttctagggcagtgctggg

SEQ ID NO: 300845 - DNA, 25 bp, Homo sapien
agtgctgggttagaaatgtctgtct

SEQ ID NO: 300846 - DNA, 25 bp, Homo sapien
aaacaggacacatcttgccaccaca

SEQ ID NO: 300847 - DNA, 25 bp, Homo sapien
gctctctgcagcgtggatttccttt

SEQ ID NO: 300848 - DNA, 25 bp, Homo sapien
tgacttcactggcaaatcctgcaac

SEQ ID NO: 300849 - DNA, 25 bp, Homo sapien
gcccttaccctcttgtccaagcagt

SEQ ID NO: 300850 - DNA, 25 bp, Homo sapien
cagagaagcaggcaagatgaccttg

SEQ ID NO: 300851 - DNA, 25 bp, Homo sapien
tctcccaggaattctcatgtgggat

SEQ ID NO: 300852 - DNA, 25 bp, Homo sapien
caggaattctcatgtgggattcccc

SEQ ID NO: 300853 - DNA, 25 bp, Homo sapien
tcctgacttcctcttagatcataga

SEQ ID NO: 300854 - DNA, 25 bp, Homo sapien
gacttcctcttagatcatagattgg

SEQ ID NO: 300855 - DNA, 25 bp, Homo sapien
tagatcatagattggacctggtttt

SEQ ID NO: 300856 - DNA, 25 bp, Homo sapien
ctgttgacttgttgccctgaagtac

SEQ ID NO: 300857 - DNA, 25 bp, Homo sapien
tgttgacttgttgccctgaagtaca

SEQ ID NO: 300858 - DNA, 25 bp, Homo sapien
tgttgccctgaagtacaataaaaaa

SEQ ID NO: 300859 - DNA, 25 bp, Homo sapien
gatagtggctaatgtggctccccag

SEQ ID NO: 300860 - DNA, 25 bp, Homo sapien
gctccccaggcctaatttgggaaca

SEQ ID NO: 300861 - DNA, 25 bp, Homo sapien
gaacagtttttcctgattgctttga

SEQ ID NO: 300862 - DNA, 25 bp, Homo sapien
tttcattctgcttgccattgctata

SEQ ID NO: 300863 - DNA, 25 bp, Homo sapien
cttgccattgctatattctcccttt

SEQ ID NO: 300864 - DNA, 25 bp, Homo sapien
attctccctttataggagccattgg

SEQ ID NO: 300865 - DNA, 25 bp, Homo sapien
tataggagccattggatttctttcc

SEQ ID NO: 300866 - DNA, 25 bp, Homo sapien
gggaaatgtcccattagcattttca

SEQ ID NO: 300867 - DNA, 25 bp, Homo sapien
gcattttcagatcttttgatgtgca

SEQ ID NO: 300868 - DNA, 25 bp, Homo sapien
ttgatgtgcactaatgccattattg

SEQ ID NO: 300869 - DNA, 25 bp, Homo sapien
attattggtaatgccgttattggtg

SEQ ID NO: 300870 - DNA, 25 bp, Homo sapien
ttccttgagcagattggtccagtcc

SEQ ID NO: 300871 - DNA, 25 bp, Homo sapien
tgagcagattggtccagtccctctg

SEQ ID NO: 300872 - DNA, 25 bp, Homo sapien
tggtccagtccctctgctttctgtt

SEQ ID NO: 300873 - DNA, 25 bp, Homo sapien
gtatctgcataatgtctgaagtcat

SEQ ID NO: 300874 - DNA, 25 bp, Homo sapien
aagtcattaatgcagtaacaggtca

SEQ ID NO: 300875 - DNA, 25 bp, Homo sapien
atgcagtaacaggtcaagctcttta

SEQ ID NO: 300876 - DNA, 25 bp, Homo sapien
ggtcaagctctttagcattctttga

SEQ ID NO: 300877 - DNA, 25 bp, Homo sapien
atatgacattctcctttatcttcct

SEQ ID NO: 300878 - DNA, 25 bp, Homo sapien
agggttaatgtttatgaacgattca

SEQ ID NO: 300879 - DNA, 25 bp, Homo sapien
gaacgattcaaattgtcttcagtga

SEQ ID NO: 300880 - DNA, 25 bp, Homo sapien
gaaacacattagtcacaagaatccc

SEQ ID NO: 300881 - DNA, 25 bp, Homo sapien
agaatcagaatcttcaatgtcaaag

SEQ ID NO: 300882 - DNA, 25 bp, Homo sapien
caaatttgatgcgaactctctctcc

SEQ ID NO: 300883 - DNA, 25 bp, Homo sapien
atttgatgcgaactctctctcccat

SEQ ID NO: 300884 - DNA, 25 bp, Homo sapien
tttacacggatctcccattcacaaa

SEQ ID NO: 300885 - DNA, 25 bp, Homo sapien
gatctcccattcacaaacagtgctg

SEQ ID NO: 300886 - DNA, 25 bp, Homo sapien
cattcacaaacagtgctgttgggat

SEQ ID NO: 300887 - DNA, 25 bp, Homo sapien
ataggtctgtgggtagtttatggat

SEQ ID NO: 300888 - DNA, 25 bp, Homo sapien
gatgtaagggttccactctcagggc

SEQ ID NO: 300889 - DNA, 25 bp, Homo sapien
gttccactctcagggcctagtacag

SEQ ID NO: 300890 - DNA, 25 bp, Homo sapien
agtgtgtccacatccatcaccttgc

SEQ ID NO: 300891 - DNA, 25 bp, Homo sapien
agcaggagcaggacaagtaagagca

SEQ ID NO: 300892 - DNA, 25 bp, Homo sapien
aaatggcccaggttagtctgtcctg

SEQ ID NO: 300893 - DNA, 25 bp, Homo sapien
aggttagtctgtcctgagagtccag

SEQ ID NO: 300894 - DNA, 25 bp, Homo sapien
tgagagtccagagccttggttcagg

SEQ ID NO: 300895 - DNA, 25 bp, Homo sapien
gggacagagcccttgatacttaagg

SEQ ID NO: 300896 - DNA, 25 bp, Homo sapien
ggaagtgctggatattgctaagaat

SEQ ID NO: 300897 - DNA, 25 bp, Homo sapien
gaattcaggtagtctcgggatctcc

SEQ ID NO: 300898 - DNA, 25 bp, Homo sapien
gtagtctcgggatctccagagtctc

SEQ ID NO: 300899 - DNA, 25 bp, Homo sapien
tccagagtctccatgctaggacagg

SEQ ID NO: 300900 - DNA, 25 bp, Homo sapien
ccatgctaggacaggagatcttcag

SEQ ID NO: 300901 - DNA, 25 bp, Homo sapien
atagtctagtcagcttatttgtcaa

SEQ ID NO: 300902 - DNA, 25 bp, Homo sapien
atgctttaaaagtccacaaaataca

SEQ ID NO: 300903 - DNA, 25 bp, Homo sapien
agcattcaacttttgagggctacca

SEQ ID NO: 300904 - DNA, 25 bp, Homo sapien
gggaaataatcactaggactgaagt

SEQ ID NO: 300905 - DNA, 25 bp, Homo sapien
ggactgaagtatctactctgggttt

SEQ ID NO: 300906 - DNA, 25 bp, Homo sapien
tctgggtttagaaataacaccaaat

SEQ ID NO: 300907 - DNA, 25 bp, Homo sapien
acaccaaattttgtaggatgctatt

SEQ ID NO: 300908 - DNA, 25 bp, Homo sapien
gtaggatgctattatctgggaaagg

SEQ ID NO: 300909 - DNA, 25 bp, Homo sapien
agggaaggcagcaagaaacctacaa

SEQ ID NO: 300910 - DNA, 25 bp, Homo sapien
aaacctacaaggcaccaggctagaa

SEQ ID NO: 300911 - DNA, 25 bp, Homo sapien
caccaggctagaattcagagggaaa

SEQ ID NO: 300912 - DNA, 25 bp, Homo sapien
aatacaagatagtagtctcaagact

SEQ ID NO: 300913 - DNA, 25 bp, Homo sapien
gactaggtagaattccaaactttga

SEQ ID NO: 300914 - DNA, 25 bp, Homo sapien
gaatgaaatctctttgcagtggcct

SEQ ID NO: 300915 - DNA, 25 bp, Homo sapien
atgaaatctctttgcagtggcctct

SEQ ID NO: 300916 - DNA, 25 bp, Homo sapien
aaatctctttgcagtggcctctctc

SEQ ID NO: 300917 - DNA, 25 bp, Homo sapien
tccaaatttccaaagatgactgcat

SEQ ID NO: 300918 - DNA, 25 bp, Homo sapien
gatgactgcatagggaccaacactg

SEQ ID NO: 300919 - DNA, 25 bp, Homo sapien
atagggaccaacactgcctgacttt

SEQ ID NO: 300920 - DNA, 25 bp, Homo sapien
gcctgactttgcagtatctgtgaga

SEQ ID NO: 300921 - DNA, 25 bp, Homo sapien
tttgcagtatctgtgagaaaaacct

SEQ ID NO: 300922 - DNA, 25 bp, Homo sapien
aatgtggagctctcggcctagtgta

SEQ ID NO: 300923 - DNA, 25 bp, Homo sapien
ttatgggatagatacatgacttaga

SEQ ID NO: 300924 - DNA, 25 bp, Homo sapien
aattgtccagaaacagtactgaatt

SEQ ID NO: 300925 - DNA, 25 bp, Homo sapien
ttatgtgtgcttggctcagttgcct

SEQ ID NO: 300926 - DNA, 25 bp, Homo sapien
tcagttgcctgttacacagcctctg

SEQ ID NO: 300927 - DNA, 25 bp, Homo sapien
tctgccttggttttgtgtattctaa

SEQ ID NO: 300928 - DNA, 25 bp, Homo sapien
gatatttacagtgaagttcttcctt

SEQ ID NO: 300929 - DNA, 25 bp, Homo sapien
cagtgaagttcttccttttgaaact

SEQ ID NO: 300930 - DNA, 25 bp, Homo sapien
ctctctctaaaaattggttggccat

SEQ ID NO: 300931 - DNA, 25 bp, Homo sapien
ggttggccatgctcactaatgattt

SEQ ID NO: 300932 - DNA, 25 bp, Homo sapien
taagcatttcttggtattggtagat

SEQ ID NO: 300933 - DNA, 25 bp, Homo sapien
attggtagatttggattgcatggta

SEQ ID NO: 300934 - DNA, 25 bp, Homo sapien
ggtaagatgactgcccattttcacc

SEQ ID NO: 300935 - DNA, 25 bp, Homo sapien
attttcaccatgtatacctttgtca

SEQ ID NO: 300936 - DNA, 25 bp, Homo sapien
agtactcagctcagtttgatctaga

SEQ ID NO: 300937 - DNA, 25 bp, Homo sapien
tcagctcagtttgatctagatattg

SEQ ID NO: 300938 - DNA, 25 bp, Homo sapien
gagatacctatcttgaattcaaaga

SEQ ID NO: 300939 - DNA, 25 bp, Homo sapien
aagactgataaaatgctctcttcta

SEQ ID NO: 300940 - DNA, 25 bp, Homo sapien
gctctcttctatgaattgtgttaga

SEQ ID NO: 300941 - DNA, 25 bp, Homo sapien
gttagagaattacctgctagaaaaa

SEQ ID NO: 300942 - DNA, 25 bp, Homo sapien
aattcaagtagtccataaatgcata

SEQ ID NO: 300943 - DNA, 25 bp, Homo sapien
gagaaagtcctgtgcagtcctgaga

SEQ ID NO: 300944 - DNA, 25 bp, Homo sapien
gtgcagtcctgagatgattactctt

SEQ ID NO: 300945 - DNA, 25 bp, Homo sapien
gatgattactcttatttggtgtgct

SEQ ID NO: 300946 - DNA, 25 bp, Homo sapien
tggtgtgctgaaaatttgagttgac

SEQ ID NO: 300947 - DNA, 25 bp, Homo sapien
ttttatacaccgaacccctcgtgct

SEQ ID NO: 300948 - DNA, 25 bp, Homo sapien
aataacattactactatgaaacgaa

SEQ ID NO: 300949 - DNA, 25 bp, Homo sapien
ttttttcaaaaccatgtcttgccat

SEQ ID NO: 300950 - DNA, 25 bp, Homo sapien
aaaccatgtcttgccattacagatg

SEQ ID NO: 300951 - DNA, 25 bp, Homo sapien
ccatgtcttgccattacagatgaga

SEQ ID NO: 300952 - DNA, 25 bp, Homo sapien
gtcttgccattacagatgagacaag

SEQ ID NO: 300953 - DNA, 25 bp, Homo sapien
taatacgctgttgatgtaaaaataa

SEQ ID NO: 300954 - DNA, 25 bp, Homo sapien
aaggaaatacaatgaactgttctct

SEQ ID NO: 300955 - DNA, 25 bp, Homo sapien
gaactgttctcttcgagatccagaa

SEQ ID NO: 300956 - DNA, 25 bp, Homo sapien
tgttctcttcgagatccagaataaa

SEQ ID NO: 300957 - DNA, 25 bp, Homo sapien
agaataaaagtctggcagctagaac

SEQ ID NO: 300958 - DNA, 25 bp, Homo sapien
aggagcgcggcctcgggcacagggt

SEQ ID NO: 300959 - DNA, 25 bp, Homo sapien
tcgggcacagggtggccggccgtcg

SEQ ID NO: 300960 - DNA, 25 bp, Homo sapien
aggactgccgccgtctggccaagga

SEQ ID NO: 300961 - DNA, 25 bp, Homo sapien
aaggagctcgaggaggcgaaggcat

SEQ ID NO: 300962 - DNA, 25 bp, Homo sapien
gcgaaggcatcggagcggagcctgc

SEQ ID NO: 300963 - DNA, 25 bp, Homo sapien
tgcgcgcccggctgaagacgctgac

SEQ ID NO: 300964 - DNA, 25 bp, Homo sapien
aagacgctgaccagcgagctggcat

SEQ ID NO: 300965 - DNA, 25 bp, Homo sapien
cagcgagctggcattgtacaagagg

SEQ ID NO: 300966 - DNA, 25 bp, Homo sapien
gacgcgggaggaccgggcctcatcg

SEQ ID NO: 300967 - DNA, 25 bp, Homo sapien
ggaccgggcctcatcgtcccgggag

SEQ ID NO: 300968 - DNA, 25 bp, Homo sapien
gcgcgctcctcatcccgggagagcg

SEQ ID NO: 300969 - DNA, 25 bp, Homo sapien
gagaaagtctctacagaccttggct

SEQ ID NO: 300970 - DNA, 25 bp, Homo sapien
agtctctacagaccttggctctgga

SEQ ID NO: 300971 - DNA, 25 bp, Homo sapien
acagaccttggctctggagacaaaa

SEQ ID NO: 300972 - DNA, 25 bp, Homo sapien
gagacaaaattcttgctctggcaag

SEQ ID NO: 300973 - DNA, 25 bp, Homo sapien
gctctggcaagttttgaggttgaaa

SEQ ID NO: 300974 - DNA, 25 bp, Homo sapien
aaaaatgacatggtgcagaagcttg

SEQ ID NO: 300975 - DNA, 25 bp, Homo sapien
gtgcagaagcttgtaacattgatca

SEQ ID NO: 300976 - DNA, 25 bp, Homo sapien
attcttaatgtaaatggtgtctttc

SEQ ID NO: 300977 - DNA, 25 bp, Homo sapien
gggttttcagttattgcaaagaaat

SEQ ID NO: 300978 - DNA, 25 bp, Homo sapien
gagattctggaaatgcatcaataac

SEQ ID NO: 300979 - DNA, 25 bp, Homo sapien
tggaaatgcatcaataacctaagaa

SEQ ID NO: 300980 - DNA, 25 bp, Homo sapien
aggagcgcggcctcgggcacagggt

SEQ ID NO: 300981 - DNA, 25 bp, Homo sapien
ggagctcgaggaggcgaaggcatcg

SEQ ID NO: 300982 - DNA, 25 bp, Homo sapien
gctcgaggaggcgaaggcatcggag

SEQ ID NO: 300983 - DNA, 25 bp, Homo sapien
ctcgaggaggcgaaggcatcggagc

SEQ ID NO: 300984 - DNA, 25 bp, Homo sapien
tcgaggaggcgaaggcatcggagcg

SEQ ID NO: 300985 - DNA, 25 bp, Homo sapien
ggaggcgaaggcatcggagcggagc

SEQ ID NO: 300986 - DNA, 25 bp, Homo sapien
aggcgaaggcatcggagcggagcct

SEQ ID NO: 300987 - DNA, 25 bp, Homo sapien
gcgaaggcatcggagcggagcctgc

SEQ ID NO: 300988 - DNA, 25 bp, Homo sapien
cgaaggcatcggagcggagcctgcg

SEQ ID NO: 300989 - DNA, 25 bp, Homo sapien
tgcgcgcccggctgaagacgctgac

SEQ ID NO: 300990 - DNA, 25 bp, Homo sapien
agcgagctggcattgtacaagaggg

SEQ ID NO: 300991 - DNA, 25 bp, Homo sapien
actgtcagctgttatctactcttca

SEQ ID NO: 300992 - DNA, 25 bp, Homo sapien
tctactcttcaggttttggagaaac

SEQ ID NO: 300993 - DNA, 25 bp, Homo sapien
gaaaagcaaatttctctcctgagta

SEQ ID NO: 300994 - DNA, 25 bp, Homo sapien
ttctctcctgagtatttacatgtct

SEQ ID NO: 300995 - DNA, 25 bp, Homo sapien
ttacatgtctctgtatgctcaaata

SEQ ID NO: 300996 - DNA, 25 bp, Homo sapien
gctcaaatatgcagatgtgtcccta

SEQ ID NO: 300997 - DNA, 25 bp, Homo sapien
gatgtgtccctatgcgtgtatatta

SEQ ID NO: 300998 - DNA, 25 bp, Homo sapien
tagcttattttttaggctctagcca

SEQ ID NO: 300999 - DNA, 25 bp, Homo sapien
taggctctagccattttatattctt

SEQ ID NO: 301000 - DNA, 25 bp, Homo sapien
atattctttcatgtgcttctcaata

SEQ ID NO: 301001 - DNA, 25 bp, Homo sapien
atgtgcttctcaatattctttttct

SEQ ID NO: 301002 - DNA, 25 bp, Homo sapien
tgctttgctgcccttttattgtacc

SEQ ID NO: 301003 - DNA, 25 bp, Homo sapien
ttattgtaccccaggcctcctagag

SEQ ID NO: 301004 - DNA, 25 bp, Homo sapien
gaggactcctgcagattctattgtt

SEQ ID NO: 301005 - DNA, 25 bp, Homo sapien
gtgtttgcacagtcttatgatattc

SEQ ID NO: 301006 - DNA, 25 bp, Homo sapien
tatgatattcagtctcagtctgcta

SEQ ID NO: 301007 - DNA, 25 bp, Homo sapien
gtctcagtctgctataggtatttgt

SEQ ID NO: 301008 - DNA, 25 bp, Homo sapien
gttattcttggatactacacacctg

SEQ ID NO: 301009 - DNA, 25 bp, Homo sapien
actacacacctgctcagactgagta

SEQ ID NO: 301010 - DNA, 25 bp, Homo sapien
aacatttgtggtgctgtcaacctga

SEQ ID NO: 301011 - DNA, 25 bp, Homo sapien
caacctgatttcttgactctcaaat

SEQ ID NO: 301012 - DNA, 25 bp, Homo sapien
gatttctccaatagtatatgccact

SEQ ID NO: 301013 - DNA, 25 bp, Homo sapien
agcagcaggccaaatgccggcaagt

SEQ ID NO: 301014 - DNA, 25 bp, Homo sapien
aaatgccggcaagtgctctgtagga

SEQ ID NO: 301015 - DNA, 25 bp, Homo sapien
taggaaagtaccagggctgccttgg

SEQ ID NO: 301016 - DNA, 25 bp, Homo sapien
ggagtggccaccagagggtatacaa

SEQ ID NO: 301017 - DNA, 25 bp, Homo sapien
gagggtatacaagtggttgcccttt

SEQ ID NO: 301018 - DNA, 25 bp, Homo sapien
gttgccctttaaaagaagaggctca

SEQ ID NO: 301019 - DNA, 25 bp, Homo sapien
gaggctcaggagcagacatgtcttt

SEQ ID NO: 301020 - DNA, 25 bp, Homo sapien
gcagacatgtctttatgctagcctg

SEQ ID NO: 301021 - DNA, 25 bp, Homo sapien
agaaaccaaagtatgtgtctgggat

SEQ ID NO: 301022 - DNA, 25 bp, Homo sapien
gtctgggatccctgcttgcagaaaa

SEQ ID NO: 301023 - DNA, 25 bp, Homo sapien
ggatccctgcttgcagaaaaacatt

SEQ ID NO: 301024 - DNA, 25 bp, Homo sapien
aggcatctggccgttcatctggttc

SEQ ID NO: 301025 - DNA, 25 bp, Homo sapien
catctggttctgcatgtgcggtgca

SEQ ID NO: 301026 - DNA, 25 bp, Homo sapien
acctaccattccatctgaaggcatg

SEQ ID NO: 301027 - DNA, 25 bp, Homo sapien
gggagggccgctctgattcatccct

SEQ ID NO: 301028 - DNA, 25 bp, Homo sapien
tgattcatccctccaggacccatag

SEQ ID NO: 301029 - DNA, 25 bp, Homo sapien
ggacccataggcatatcctgtgtgg

SEQ ID NO: 301030 - DNA, 25 bp, Homo sapien
gcaaggtataccaagtttgtgtgca

SEQ ID NO: 301031 - DNA, 25 bp, Homo sapien
gtttgtgtgcaacatctgctgatac

SEQ ID NO: 301032 - DNA, 25 bp, Homo sapien
gatactgagaacactctgaggtctt

SEQ ID NO: 301033 - DNA, 25 bp, Homo sapien
tctgaggtctttcctttattctgag

SEQ ID NO: 301034 - DNA, 25 bp, Homo sapien
tatggttaggcccaggcatctggcc

SEQ ID NO: 301035 - DNA, 25 bp, Homo sapien
taatgactcttacccttaggatagg

SEQ ID NO: 301036 - DNA, 25 bp, Homo sapien
tagggtctgaactccttagcaggct

SEQ ID NO: 301037 - DNA, 25 bp, Homo sapien
gaactccttagcaggcttcatgata

SEQ ID NO: 301038 - DNA, 25 bp, Homo sapien
atattaaccttgttgacctctttgg

SEQ ID NO: 301039 - DNA, 25 bp, Homo sapien
tttggtctctctcagtacttctcaa

SEQ ID NO: 301040 - DNA, 25 bp, Homo sapien
atactttgctcttcagccacagtaa

SEQ ID NO: 301041 - DNA, 25 bp, Homo sapien
gttagttttagttccctgagtatgt

SEQ ID NO: 301042 - DNA, 25 bp, Homo sapien
atgttatcagctctctggattctgg

SEQ ID NO: 301043 - DNA, 25 bp, Homo sapien
tggattctgggctttgctcatattt

SEQ ID NO: 301044 - DNA, 25 bp, Homo sapien
ttgctcatatttcctctattcaaaa

SEQ ID NO: 301045 - DNA, 25 bp, Homo sapien
ccctctaaacacatcacattggcta

SEQ ID NO: 301046 - DNA, 25 bp, Homo sapien
tgtcattattgactcttcaccactc

SEQ ID NO: 301047 - DNA, 25 bp, Homo sapien
ttgagactcacttatccctttgctc

SEQ ID NO: 301048 - DNA, 25 bp, Homo sapien
catttttcttctcttgctctgaatc

SEQ ID NO: 301049 - DNA, 25 bp, Homo sapien
tctcttgctctgaatcccttaaatg

SEQ ID NO: 301050 - DNA, 25 bp, Homo sapien
atcccttaaatgctgaggctgctca

SEQ ID NO: 301051 - DNA, 25 bp, Homo sapien
ggctgctcaagtttcatccctagtc

SEQ ID NO: 301052 - DNA, 25 bp, Homo sapien
tttcatccctagtcctattttctca

SEQ ID NO: 301053 - DNA, 25 bp, Homo sapien
tttctcattctatatgcacactcat

SEQ ID NO: 301054 - DNA, 25 bp, Homo sapien
tcatttaacagacttcactggcttc

SEQ ID NO: 301055 - DNA, 25 bp, Homo sapien
ggcttcaggcaccatttgttttatt

SEQ ID NO: 301056 - DNA, 25 bp, Homo sapien
tctctctagtgctgtagacctttat

SEQ ID NO: 301057 - DNA, 25 bp, Homo sapien
ctagacttcagttttgctcacgttc

SEQ ID NO: 301058 - DNA, 25 bp, Homo sapien
tttgctcacgttcttccaactttaa

SEQ ID NO: 301059 - DNA, 25 bp, Homo sapien
tgattgctgttcctagacgtaggtt

SEQ ID NO: 301060 - DNA, 25 bp, Homo sapien
gttcctagacgtaggtttcctgagc

SEQ ID NO: 301061 - DNA, 25 bp, Homo sapien
gacgtaggtttcctgagcagttctt

SEQ ID NO: 301062 - DNA, 25 bp, Homo sapien
aggtttcctgagcagttcttttgtt

SEQ ID NO: 301063 - DNA, 25 bp, Homo sapien
ttcaaacttcttttcagaacaggct

SEQ ID NO: 301064 - DNA, 25 bp, Homo sapien
ttcttttcagaacaggcttagtcat

SEQ ID NO: 301065 - DNA, 25 bp, Homo sapien
gaacaggcttagtcattgactggaa

SEQ ID NO: 301066 - DNA, 25 bp, Homo sapien
gttggtttatttatcttgactctaa

SEQ ID NO: 301067 - DNA, 25 bp, Homo sapien
actactttatgtcatgttctacatg

SEQ ID NO: 301068 - DNA, 25 bp, Homo sapien
agccatcactgaagccagggcagca

SEQ ID NO: 301069 - DNA, 25 bp, Homo sapien
atgaggaaggacaccacgatgctgg

SEQ ID NO: 301070 - DNA, 25 bp, Homo sapien
agccagtgatgaaggcccacagctc

SEQ ID NO: 301071 - DNA, 25 bp, Homo sapien
aagggtgcttccaacgcccagggca

SEQ ID NO: 301072 - DNA, 25 bp, Homo sapien
catggtggataagcagcggcataat

SEQ ID NO: 301073 - DNA, 25 bp, Homo sapien
cagcggcataatttggtgtcttcta

SEQ ID NO: 301074 - DNA, 25 bp, Homo sapien
gtgtcttctagactgtccagggtca

SEQ ID NO: 301075 - DNA, 25 bp, Homo sapien
tctagactgtccagggtcacgattt

SEQ ID NO: 301076 - DNA, 25 bp, Homo sapien
gctctccgacagtcacgtaggtgta

SEQ ID NO: 301077 - DNA, 25 bp, Homo sapien
caaatatgcagaccccgtcttggga

SEQ ID NO: 301078 - DNA, 25 bp, Homo sapien
cccaaattcggcatagcagaggcca

SEQ ID NO: 301079 - DNA, 25 bp, Homo sapien
gcagacacaggcctgaactgtccac

SEQ ID NO: 301080 - DNA, 25 bp, Homo sapien
tgtccaccctctatgtcccgagtgg

SEQ ID NO: 301081 - DNA, 25 bp, Homo sapien
tctatgtcccgagtggtgactccac

SEQ ID NO: 301082 - DNA, 25 bp, Homo sapien
atcacaccccttctggagagcttgc

SEQ ID NO: 301083 - DNA, 25 bp, Homo sapien
tcacaccccttctggagagcttgca

SEQ ID NO: 301084 - DNA, 25 bp, Homo sapien
ttctggagagcttgcatcccttctg

SEQ ID NO: 301085 - DNA, 25 bp, Homo sapien
tggagagcttgcatcccttctgtcg

SEQ ID NO: 301086 - DNA, 25 bp, Homo sapien
aacaaagcgctttactgagggcacc

SEQ ID NO: 301087 - DNA, 25 bp, Homo sapien
aaagcgctttactgagggcacccac

SEQ ID NO: 301088 - DNA, 25 bp, Homo sapien
ttactgagggcacccactccacagt

SEQ ID NO: 301089 - DNA, 25 bp, Homo sapien
cacagtcccaaggaggcagacacag

SEQ ID NO: 301090 - DNA, 25 bp, Homo sapien
aagagaatacttggacggtgcacag

SEQ ID NO: 301091 - DNA, 25 bp, Homo sapien
aatacttggacggtgcacaggtgtc

SEQ ID NO: 301092 - DNA, 25 bp, Homo sapien
cggtgcacaggtgtccaactctttg

SEQ ID NO: 301093 - DNA, 25 bp, Homo sapien
ggtggatatcacaaaaatcatgcat

SEQ ID NO: 301094 - DNA, 25 bp, Homo sapien
cacaaaaatcatgcatgggccgggc

SEQ ID NO: 301095 - DNA, 25 bp, Homo sapien
gggctactaaggtctacagatacat

SEQ ID NO: 301096 - DNA, 25 bp, Homo sapien
aaggtctacagatacatgagtaaat

SEQ ID NO: 301097 - DNA, 25 bp, Homo sapien
taagagttcaataagcagtaagagc

SEQ ID NO: 301098 - DNA, 25 bp, Homo sapien
agcagtaagagctacaataatgtta

SEQ ID NO: 301099 - DNA, 25 bp, Homo sapien
aataatgttaagcagcaagcactaa

SEQ ID NO: 301100 - DNA, 25 bp, Homo sapien
gttaagcagcaagcactaagagaat

SEQ ID NO: 301101 - DNA, 25 bp, Homo sapien
agacacaggcctgaactgtccaccc

SEQ ID NO: 301102 - DNA, 25 bp, Homo sapien
tgtccaccctctatgtcccgagtgg

SEQ ID NO: 301103 - DNA, 25 bp, Homo sapien
caccctctatgtcccgagtggtgac

SEQ ID NO: 301104 - DNA, 25 bp, Homo sapien
tctatgtcccgagtggtgactccac

SEQ ID NO: 301105 - DNA, 25 bp, Homo sapien
tatgtcccgagtggtgactccactc

SEQ ID NO: 301106 - DNA, 25 bp, Homo sapien
ccactgctcagagatcacacccctt

SEQ ID NO: 301107 - DNA, 25 bp, Homo sapien
aacaaagcgctttactgagggcacc

SEQ ID NO: 301108 - DNA, 25 bp, Homo sapien
caaagcgctttactgagggcaccca

SEQ ID NO: 301109 - DNA, 25 bp, Homo sapien
aaagcgctttactgagggcacccac

SEQ ID NO: 301110 - DNA, 25 bp, Homo sapien
aagcgctttactgagggcacccact

SEQ ID NO: 301111 - DNA, 25 bp, Homo sapien
ttactgagggcacccactccacagt

SEQ ID NO: 301112 - DNA, 25 bp, Homo sapien
aataatcaagatatgtgtcgagtca

SEQ ID NO: 301113 - DNA, 25 bp, Homo sapien
tatgtgtcgagtcatttttctttca

SEQ ID NO: 301114 - DNA, 25 bp, Homo sapien
tttctttcaactccctcatttttca

SEQ ID NO: 301115 - DNA, 25 bp, Homo sapien
tttcaactccctcatttttcattga

SEQ ID NO: 301116 - DNA, 25 bp, Homo sapien
tttttcattgaacaaatctctgctt

SEQ ID NO: 301117 - DNA, 25 bp, Homo sapien
tgaacaaatctctgcttttcaagag

SEQ ID NO: 301118 - DNA, 25 bp, Homo sapien
caatgagttttagggatgtttgtgc

SEQ ID NO: 301119 - DNA, 25 bp, Homo sapien
atgtttgtgcgggtagactccatca

SEQ ID NO: 301120 - DNA, 25 bp, Homo sapien
gggtagactccatcatccatatgta

SEQ ID NO: 301121 - DNA, 25 bp, Homo sapien
gactccatcatccatatgtaacttg

SEQ ID NO: 301122 - DNA, 25 bp, Homo sapien
aagtgtttccgttgtgtgtcttgat

SEQ ID NO: 301123 - DNA, 25 bp, Homo sapien
gagcaaacgtactgcagttttcaaa

SEQ ID NO: 301124 - DNA, 25 bp, Homo sapien
caaacaaatgttagtactctgtatt

SEQ ID NO: 301125 - DNA, 25 bp, Homo sapien
aacccattatttgaagaccctgaag

SEQ ID NO: 301126 - DNA, 25 bp, Homo sapien
gaccctgaagacagtaagttgtttc

SEQ ID NO: 301127 - DNA, 25 bp, Homo sapien
gacagtaagttgtttcaggactcaa

SEQ ID NO: 301128 - DNA, 25 bp, Homo sapien
gtttcaggactcaagttttatgctg

SEQ ID NO: 301129 - DNA, 25 bp, Homo sapien
tttatgttcattaaaccaggttgga

SEQ ID NO: 301130 - DNA, 25 bp, Homo sapien
accaggttggataggacctctgctt

SEQ ID NO: 301131 - DNA, 25 bp, Homo sapien
tggataggacctctgcttagcaact

SEQ ID NO: 301132 - DNA, 25 bp, Homo sapien
ggacctctgcttagcaactgttttt

SEQ ID NO: 301133 - DNA, 25 bp, Homo sapien
ctctgcttagcaactgtttttcagc

SEQ ID NO: 301134 - DNA, 25 bp, Homo sapien
ggcagctgccaatggttctgtggca

SEQ ID NO: 301135 - DNA, 25 bp, Homo sapien
atggttctgtggcacagactggctc

SEQ ID NO: 301136 - DNA, 25 bp, Homo sapien
acagactggctcctgagaacccaga

SEQ ID NO: 301137 - DNA, 25 bp, Homo sapien
tgagaacccagacgaccttgacctg

SEQ ID NO: 301138 - DNA, 25 bp, Homo sapien
agacgaccttgacctggcagcccgg

SEQ ID NO: 301139 - DNA, 25 bp, Homo sapien
tagtacctcgcctgattttccatcg

SEQ ID NO: 301140 - DNA, 25 bp, Homo sapien
gattttccatcgttgcggtatccag

SEQ ID NO: 301141 - DNA, 25 bp, Homo sapien
ggtatccagccgcttcagacgtccg

SEQ ID NO: 301142 - DNA, 25 bp, Homo sapien
acgtccgccgccttcagtggtggta

SEQ ID NO: 301143 - DNA, 25 bp, Homo sapien
caaaccacagcatcccttaggttaa

SEQ ID NO: 301144 - DNA, 25 bp, Homo sapien
gggcagctttgcctagagctcattg

SEQ ID NO: 301145 - DNA, 25 bp, Homo sapien
aaatcagtgcccagacatcaaagct

SEQ ID NO: 301146 - DNA, 25 bp, Homo sapien
aatcagtgcccagacatcaaagcta

SEQ ID NO: 301147 - DNA, 25 bp, Homo sapien
acaagttaagggaacaggcagctgt

SEQ ID NO: 301148 - DNA, 25 bp, Homo sapien
agttaagggaacaggcagctgtttg

SEQ ID NO: 301149 - DNA, 25 bp, Homo sapien
gctgtttgaatagatcaattggata

SEQ ID NO: 301150 - DNA, 25 bp, Homo sapien
tcaattggatagtctaaggcagctc

SEQ ID NO: 301151 - DNA, 25 bp, Homo sapien
agctctctggaccaagctgtaaagg

SEQ ID NO: 301152 - DNA, 25 bp, Homo sapien
ctctggaccaagctgtaaaggagat

SEQ ID NO: 301153 - DNA, 25 bp, Homo sapien
ctggaccaagctgtaaaggagatac

SEQ ID NO: 301154 - DNA, 25 bp, Homo sapien
gctgtaaaggagatacaatcgaaat

SEQ ID NO: 301155 - DNA, 25 bp, Homo sapien
caggagccttgcatgggcttctctt

SEQ ID NO: 301156 - DNA, 25 bp, Homo sapien
gactcatatcctgtaatttttctaa

SEQ ID NO: 301157 - DNA, 25 bp, Homo sapien
tctaaatggcgtctccatgtggtct

SEQ ID NO: 301158 - DNA, 25 bp, Homo sapien
atgtggtctttcatgaatgtttgtc

SEQ ID NO: 301159 - DNA, 25 bp, Homo sapien
atgtttgtctggattctctatcctt

SEQ ID NO: 301160 - DNA, 25 bp, Homo sapien
gattctctatccttttactttcaac

SEQ ID NO: 301161 - DNA, 25 bp, Homo sapien
atgtcttttgtaaacagcccatgat

SEQ ID NO: 301162 - DNA, 25 bp, Homo sapien
gcactatttgtcttgtaattggagt

SEQ ID NO: 301163 - DNA, 25 bp, Homo sapien
gagtgtctgagtccattatgtttaa

SEQ ID NO: 301164 - DNA, 25 bp, Homo sapien
gtaattattgacctcattgggttta

SEQ ID NO: 301165 - DNA, 25 bp, Homo sapien
aagaccttgtgagctgtctacgtgt

SEQ ID NO: 301166 - DNA, 25 bp, Homo sapien
gtctacgtgtactctatgtctcagg

SEQ ID NO: 301167 - DNA, 25 bp, Homo sapien
ctttgaaaggcgttgccgcggcttc

SEQ ID NO: 301168 - DNA, 25 bp, Homo sapien
tttgaaaggcgttgccgcggcttcc

SEQ ID NO: 301169 - DNA, 25 bp, Homo sapien
ttgaaaggcgttgccgcggcttcca

SEQ ID NO: 301170 - DNA, 25 bp, Homo sapien
gcgttgccgcggcttccaaagcgat

SEQ ID NO: 301171 - DNA, 25 bp, Homo sapien
cgttgccgcggcttccaaagcgatg

SEQ ID NO: 301172 - DNA, 25 bp, Homo sapien
gttgccgcggcttccaaagcgatgc

SEQ ID NO: 301173 - DNA, 25 bp, Homo sapien
ttgccgcggcttccaaagcgatgcg

SEQ ID NO: 301174 - DNA, 25 bp, Homo sapien
tgccgcggcttccaaagcgatgcgc

SEQ ID NO: 301175 - DNA, 25 bp, Homo sapien
gccgcggcttccaaagcgatgcgct

SEQ ID NO: 301176 - DNA, 25 bp, Homo sapien
cgcggcttccaaagcgatgcgctgt

SEQ ID NO: 301177 - DNA, 25 bp, Homo sapien
gcggcttccaaagcgatgcgctgtg

SEQ ID NO: 301178 - DNA, 25 bp, Homo sapien
gcttttccacctagctctgctgtat

SEQ ID NO: 301179 - DNA, 25 bp, Homo sapien
ttccacctagctctgctgtatcatt

SEQ ID NO: 301180 - DNA, 25 bp, Homo sapien
gaattataagccaaagtgcgtcttt

SEQ ID NO: 301181 - DNA, 25 bp, Homo sapien
aagccaaagtgcgtctttcttgttt

SEQ ID NO: 301182 - DNA, 25 bp, Homo sapien
gccaaagtgcgtctttcttgttttg

SEQ ID NO: 301183 - DNA, 25 bp, Homo sapien
caaagtgcgtctttcttgttttgtc

SEQ ID NO: 301184 - DNA, 25 bp, Homo sapien
ttcttgttttgtccatatacacaca

SEQ ID NO: 301185 - DNA, 25 bp, Homo sapien
tgttttgtccatatacacacattgc

SEQ ID NO: 301186 - DNA, 25 bp, Homo sapien
atacacacattgcaccatacataaa

SEQ ID NO: 301187 - DNA, 25 bp, Homo sapien
acacattgcaccatacataaataat

SEQ ID NO: 301188 - DNA, 25 bp, Homo sapien
aaatgactccataattacaagtata

SEQ ID NO: 301189 - DNA, 25 bp, Homo sapien
tgaggagctccaagataccccaacc

SEQ ID NO: 301190 - DNA, 25 bp, Homo sapien
tacctcagctgggagcactgtcttc

SEQ ID NO: 301191 - DNA, 25 bp, Homo sapien
tcagctgggagcactgtcttccatg

SEQ ID NO: 301192 - DNA, 25 bp, Homo sapien
agctgggagcactgtcttccatggg

SEQ ID NO: 301193 - DNA, 25 bp, Homo sapien
acttctctcctcaacctggggaaga

SEQ ID NO: 301194 - DNA, 25 bp, Homo sapien
agaccacagggcagtgcctgcctca

SEQ ID NO: 301195 - DNA, 25 bp, Homo sapien
tgccttccccaaaagctggcttctt

SEQ ID NO: 301196 - DNA, 25 bp, Homo sapien
ttccccaaaagctggcttcttgctc

SEQ ID NO: 301197 - DNA, 25 bp, Homo sapien
aaagctggcttcttgctccaaggag

SEQ ID NO: 301198 - DNA, 25 bp, Homo sapien
ctccaaggagagagcattgacccac

SEQ ID NO: 301199 - DNA, 25 bp, Homo sapien
ccaaggagagagcattgacccacct

SEQ ID NO: 301200 - DNA, 25 bp, Homo sapien
ctgttacaaactttcaggttgccat

SEQ ID NO: 301201 - DNA, 25 bp, Homo sapien
caggttgccatattctttcataaca

SEQ ID NO: 301202 - DNA, 25 bp, Homo sapien
gtttgtctaatttctgtatccatac

SEQ ID NO: 301203 - DNA, 25 bp, Homo sapien
gtatccatactacgtttaacctctg

SEQ ID NO: 301204 - DNA, 25 bp, Homo sapien
tactacgtttaacctctgtgaggac

SEQ ID NO: 301205 - DNA, 25 bp, Homo sapien
aagggagcatgtttcttgttcagaa

SEQ ID NO: 301206 - DNA, 25 bp, Homo sapien
attagtccagtcatagtccctggca

SEQ ID NO: 301207 - DNA, 25 bp, Homo sapien
gtgaatcgtgtgtatcttcataaac

SEQ ID NO: 301208 - DNA, 25 bp, Homo sapien
aacatactgtttgtcctggtagagc

SEQ ID NO: 301209 - DNA, 25 bp, Homo sapien
aaattgtcaacctgggattcatgga

SEQ ID NO: 301210 - DNA, 25 bp, Homo sapien
gattcatggacaaccaatgatgtga

SEQ ID NO: 301211 - DNA, 25 bp, Homo sapien
attccttgtagttctgctccatatt

SEQ ID NO: 301212 - DNA, 25 bp, Homo sapien
aaatactctttgtacttctaaatga

SEQ ID NO: 301213 - DNA, 25 bp, Homo sapien
gaattgtggacaacctctaaggtac

SEQ ID NO: 301214 - DNA, 25 bp, Homo sapien
tggacaacctctaaggtacaaaact

SEQ ID NO: 301215 - DNA, 25 bp, Homo sapien
gtagttctgctccatattcgattat

SEQ ID NO: 301216 - DNA, 25 bp, Homo sapien
ttcccccttaccagatcagaaatga

SEQ ID NO: 301217 - DNA, 25 bp, Homo sapien
gttctgctccatattcgattattaa

SEQ ID NO: 301218 - DNA, 25 bp, Homo sapien
gaaatgatccccactgaacatgtaa

SEQ ID NO: 301219 - DNA, 25 bp, Homo sapien
gatccccactgaacatgtaaacaca

SEQ ID NO: 301220 - DNA, 25 bp, Homo sapien
gctccatattcgattattaatttcc

SEQ ID NO: 301221 - DNA, 25 bp, Homo sapien
taatttcctggaacaagtttgtgtt

SEQ ID NO: 301222 - DNA, 25 bp, Homo sapien
gcacctgggctgaaaaaccacctgt

SEQ ID NO: 301223 - DNA, 25 bp, Homo sapien
ttgggtaccatgcttactgtttgag

SEQ ID NO: 301224 - DNA, 25 bp, Homo sapien
accatgcttactgtttgagtgatga

SEQ ID NO: 301225 - DNA, 25 bp, Homo sapien
agccttccaaaatctacccatgtaa

SEQ ID NO: 301226 - DNA, 25 bp, Homo sapien
aacctgtatgtgtaccctttaatct

SEQ ID NO: 301227 - DNA, 25 bp, Homo sapien
ataaaatgacatagagccctccaaa

SEQ ID NO: 301228 - DNA, 25 bp, Homo sapien
ccattggaaagtggcagctacacat

SEQ ID NO: 301229 - DNA, 25 bp, Homo sapien
aaagtggcagctacacattgaattc

SEQ ID NO: 301230 - DNA, 25 bp, Homo sapien
gaattcacatgaaccagaggcactg

SEQ ID NO: 301231 - DNA, 25 bp, Homo sapien
gcactggagatcactagacaggtga

SEQ ID NO: 301232 - DNA, 25 bp, Homo sapien
agatcactagacaggtgagacagga

SEQ ID NO: 301233 - DNA, 25 bp, Homo sapien
atttcagtgaatcatttacgttttc

SEQ ID NO: 301234 - DNA, 25 bp, Homo sapien
gaatcatttacgttttcattggaag

SEQ ID NO: 301235 - DNA, 25 bp, Homo sapien
gttttcattggaagacagtatctga

SEQ ID NO: 301236 - DNA, 25 bp, Homo sapien
agtatctgatttcaactggtgcgtt

SEQ ID NO: 301237 - DNA, 25 bp, Homo sapien
gatttcaactggtgcgttacgaagt

SEQ ID NO: 301238 - DNA, 25 bp, Homo sapien
gttacgaagtagagccattcccaca

SEQ ID NO: 301239 - DNA, 25 bp, Homo sapien
acaaagtaaatgtgcagtgcccatg

SEQ ID NO: 301240 - DNA, 25 bp, Homo sapien
taaatgtgcagtgcccatgtttctt

SEQ ID NO: 301241 - DNA, 25 bp, Homo sapien
agtgcccatgtttcttgtgtttaaa

SEQ ID NO: 301242 - DNA, 25 bp, Homo sapien
ttcaaattttaaaagctagtgctct

SEQ ID NO: 301243 - DNA, 25 bp, Homo sapien
ttctggaagcaggagtttagtataa

SEQ ID NO: 301244 - DNA, 25 bp, Homo sapien
catcagacatctttgttcctactaa

SEQ ID NO: 301245 - DNA, 25 bp, Homo sapien
atctttgttcctactaattattttg

SEQ ID NO: 301246 - DNA, 25 bp, Homo sapien
gagtaatgttcagtatcgggctaat

SEQ ID NO: 301247 - DNA, 25 bp, Homo sapien
tcgggctaatgatcgatggatatca

SEQ ID NO: 301248 - DNA, 25 bp, Homo sapien
gatggatatcactcatccaattatg

SEQ ID NO: 301249 - DNA, 25 bp, Homo sapien
gatgcatggattagaccacggcctt

SEQ ID NO: 301250 - DNA, 25 bp, Homo sapien
gaccacggccttaaactttgtacat

SEQ ID NO: 301251 - DNA, 25 bp, Homo sapien
cggccttaaactttgtacatagtgt

SEQ ID NO: 301252 - DNA, 25 bp, Homo sapien
ttggagtctcttcaaggctttctgt

SEQ ID NO: 301253 - DNA, 25 bp, Homo sapien
gagtctcttcaaggctttctgtttt

SEQ ID NO: 301254 - DNA, 25 bp, Homo sapien
aacttaaaaatctatagccatgtga

SEQ ID NO: 301255 - DNA, 25 bp, Homo sapien
gatagtgtctatgaaggctgcccaa

SEQ ID NO: 301256 - DNA, 25 bp, Homo sapien
gcccaagaacttgaccattagggaa

SEQ ID NO: 301257 - DNA, 25 bp, Homo sapien
gaccattagggaaacatggctgttt

SEQ ID NO: 301258 - DNA, 25 bp, Homo sapien
ttctgtggattaactagtcaagccc

SEQ ID NO: 301259 - DNA, 25 bp, Homo sapien
ctagtcaagcccatacaggaagagt

SEQ ID NO: 301260 - DNA, 25 bp, Homo sapien
acaggaagagtgaggtcagctccca

SEQ ID NO: 301261 - DNA, 25 bp, Homo sapien
atttgggaccacacacgaattgcta

SEQ ID NO: 301262 - DNA, 25 bp, Homo sapien
ggaccacacacgaattgctaccatg

SEQ ID NO: 301263 - DNA, 25 bp, Homo sapien
ttgctaccatggtgagccagtgaaa

SEQ ID NO: 301264 - DNA, 25 bp, Homo sapien
aggcaggactggattgtgattacaa

SEQ ID NO: 301265 - DNA, 25 bp, Homo sapien
agagaattggagtgtgggcaacata

SEQ ID NO: 301266 - DNA, 25 bp, Homo sapien
tcctcgtccttttcaagtggtcaca

SEQ ID NO: 301267 - DNA, 25 bp, Homo sapien
tttcaagtggtcacaccttccaaga

SEQ ID NO: 301268 - DNA, 25 bp, Homo sapien
ttccaagaaggtcgcctgagaccct

SEQ ID NO: 301269 - DNA, 25 bp, Homo sapien
gggcccacgtctaggtagggtctct

SEQ ID NO: 301270 - DNA, 25 bp, Homo sapien
gggtctcttgagtcaggaaagcata

SEQ ID NO: 301271 - DNA, 25 bp, Homo sapien
ggaaagcatagtttcacggtgttct

SEQ ID NO: 301272 - DNA, 25 bp, Homo sapien
atagtttcacggtgttctgggcctc

SEQ ID NO: 301273 - DNA, 25 bp, Homo sapien
tctgaaagaagaatgggctgccacc

SEQ ID NO: 301274 - DNA, 25 bp, Homo sapien
gaagaatgggctgccacccagaccg

SEQ ID NO: 301275 - DNA, 25 bp, Homo sapien
cacccagaccgctaattcatagatc

SEQ ID NO: 301276 - DNA, 25 bp, Homo sapien
ctaattcatagatctgctgctggga

SEQ ID NO: 301277 - DNA, 25 bp, Homo sapien
tttttcccagctgacatgatttcct

SEQ ID NO: 301278 - DNA, 25 bp, Homo sapien
agctgacatgatttcctcagtgtta

SEQ ID NO: 301279 - DNA, 25 bp, Homo sapien
ttcaatccatcttaccacacaatat

SEQ ID NO: 301280 - DNA, 25 bp, Homo sapien
aattcttcaaagtcttatacgcagg

SEQ ID NO: 301281 - DNA, 25 bp, Homo sapien
gtcttatacgcaggaatgtttattc

SEQ ID NO: 301282 - DNA, 25 bp, Homo sapien
atgtttattctgctgtatttctgtg

SEQ ID NO: 301283 - DNA, 25 bp, Homo sapien
gaagcttcaaagctcttggaggctt

SEQ ID NO: 301284 - DNA, 25 bp, Homo sapien
aaagttctttctgttgggtgtgcat

SEQ ID NO: 301285 - DNA, 25 bp, Homo sapien
tgccattttacagtgtacccaaatg

SEQ ID NO: 301286 - DNA, 25 bp, Homo sapien
tacagtgtacccaaatgagaatgag

SEQ ID NO: 301287 - DNA, 25 bp, Homo sapien
gtatgcagtaaggtactcagtaatt

SEQ ID NO: 301288 - DNA, 25 bp, Homo sapien
agacaatttctaggtattaactaat

SEQ ID NO: 301289 - DNA, 25 bp, Homo sapien
gagacatcagagaaatattttactt

SEQ ID NO: 301290 - DNA, 25 bp, Homo sapien
gacgtaaactactgtgcactgctgc

SEQ ID NO: 301291 - DNA, 25 bp, Homo sapien
aaactactgtgcactgctgctattc

SEQ ID NO: 301292 - DNA, 25 bp, Homo sapien
gtgcactgctgctattcctaggaag

SEQ ID NO: 301293 - DNA, 25 bp, Homo sapien
gctgctattcctaggaagctgtgtt

SEQ ID NO: 301294 - DNA, 25 bp, Homo sapien
aggaagctgtgttttgggcaataca

SEQ ID NO: 301295 - DNA, 25 bp, Homo sapien
ttgggcaatacatggaagctaaata

SEQ ID NO: 301296 - DNA, 25 bp, Homo sapien
aaatatatgaccagaaatgctttct

SEQ ID NO: 301297 - DNA, 25 bp, Homo sapien
gaaatgctttctgccttgtaatata

SEQ ID NO: 301298 - DNA, 25 bp, Homo sapien
gctttctgccttgtaatatagtgta

SEQ ID NO: 301299 - DNA, 25 bp, Homo sapien
acagtaagatgggtccctgtgccag

SEQ ID NO: 301300 - DNA, 25 bp, Homo sapien
tgtgccaggcctcaatactgccagg

SEQ ID NO: 301301 - DNA, 25 bp, Homo sapien
aggcctcaatactgccagggaataa

SEQ ID NO: 301302 - DNA, 25 bp, Homo sapien
ggagaggaccctcagtgtcatatca

SEQ ID NO: 301303 - DNA, 25 bp, Homo sapien
ggaccctcagtgtcatatcaggaag

SEQ ID NO: 301304 - DNA, 25 bp, Homo sapien
ccagaggacagacaggttcaaaact

SEQ ID NO: 301305 - DNA, 25 bp, Homo sapien
gttggtgctataggccaagggtcat

SEQ ID NO: 301306 - DNA, 25 bp, Homo sapien
caagggtcattttatacttgggtat

SEQ ID NO: 301307 - DNA, 25 bp, Homo sapien
gggtataaatcaatcccagtttggg

SEQ ID NO: 301308 - DNA, 25 bp, Homo sapien
aaggctgacatgtgccattatatgt

SEQ ID NO: 301309 - DNA, 25 bp, Homo sapien
atatgtaacatcttccaattctttt

SEQ ID NO: 301310 - DNA, 25 bp, Homo sapien
acaaattttggcgttaacacttcat

SEQ ID NO: 301311 - DNA, 25 bp, Homo sapien
aattttggcgttaacacttcatact

SEQ ID NO: 301312 - DNA, 25 bp, Homo sapien
ttttggcgttaacacttcatactgt

SEQ ID NO: 301313 - DNA, 25 bp, Homo sapien
tggcgttaacacttcatactgttct

SEQ ID NO: 301314 - DNA, 25 bp, Homo sapien
cttcatactgttctgccaggcacag

SEQ ID NO: 301315 - DNA, 25 bp, Homo sapien
tcatactgttctgccaggcacagca

SEQ ID NO: 301316 - DNA, 25 bp, Homo sapien
gtgagccaagttcgaactcctgcat

SEQ ID NO: 301317 - DNA, 25 bp, Homo sapien
tgagccaagttcgaactcctgcatt

SEQ ID NO: 301318 - DNA, 25 bp, Homo sapien
gagccaagttcgaactcctgcattc

SEQ ID NO: 301319 - DNA, 25 bp, Homo sapien
caagttcgaactcctgcattccaac

SEQ ID NO: 301320 - DNA, 25 bp, Homo sapien
agttcgaactcctgcattccaacca

SEQ ID NO: 301321 - DNA, 25 bp, Homo sapien
aagctgtccggaaaccagttctcaa

SEQ ID NO: 301322 - DNA, 25 bp, Homo sapien
accagttctcaatctttggctttaa

SEQ ID NO: 301323 - DNA, 25 bp, Homo sapien
gttattcttacagcctaatccctga

SEQ ID NO: 301324 - DNA, 25 bp, Homo sapien
aggaagccatggtgattgtagtctc

SEQ ID NO: 301325 - DNA, 25 bp, Homo sapien
tgattgtagtctcaagctgccctgt

SEQ ID NO: 301326 - DNA, 25 bp, Homo sapien
gctgccctgtgcaaaagaagaccca

SEQ ID NO: 301327 - DNA, 25 bp, Homo sapien
tgtgcaaaagaagacccagccccag

SEQ ID NO: 301328 - DNA, 25 bp, Homo sapien
gacccagccccagtcaaagaattaa

SEQ ID NO: 301329 - DNA, 25 bp, Homo sapien
taggaactttttcctacagattagt

SEQ ID NO: 301330 - DNA, 25 bp, Homo sapien
aaacttgccacctccaagtcctggt

SEQ ID NO: 301331 - DNA, 25 bp, Homo sapien
acctccaagtcctggtattgccttg

SEQ ID NO: 301332 - DNA, 25 bp, Homo sapien
ctaggctggagtggactacaaggac

SEQ ID NO: 301333 - DNA, 25 bp, Homo sapien
ctggagtggactacaaggacataaa

SEQ ID NO: 301334 - DNA, 25 bp, Homo sapien
gacataaaagcagcgtccttcctat

SEQ ID NO: 301335 - DNA, 25 bp, Homo sapien
ataaaagcagcgtccttcctatctt

SEQ ID NO: 301336 - DNA, 25 bp, Homo sapien
gtccttcctatcttctggcctcaga

SEQ ID NO: 301337 - DNA, 25 bp, Homo sapien
tggcctcagagccaagccatgctga

SEQ ID NO: 301338 - DNA, 25 bp, Homo sapien
gccatgctgactgaggccaagtggg

SEQ ID NO: 301339 - DNA, 25 bp, Homo sapien
gccaggctgatgtggtgaacagctc

SEQ ID NO: 301340 - DNA, 25 bp, Homo sapien
agctcacagaaggattactttgaga

SEQ ID NO: 301341 - DNA, 25 bp, Homo sapien
ctttgagaagatagttttgtggctt

SEQ ID NO: 301342 - DNA, 25 bp, Homo sapien
gtggcttttaaataaggcgcatgtt

SEQ ID NO: 301343 - DNA, 25 bp, Homo sapien
tgttgcttgaaatgcacagtgcagc

SEQ ID NO: 301344 - DNA, 25 bp, Homo sapien
agtgcagcaatcttcgagctcccac

SEQ ID NO: 301345 - DNA, 25 bp, Homo sapien
tgccacatcacacagtatcattcca

SEQ ID NO: 301346 - DNA, 25 bp, Homo sapien
gtatcattccaaattccaagatcat

SEQ ID NO: 301347 - DNA, 25 bp, Homo sapien
aagatgattcactctggctgcactt

SEQ ID NO: 301348 - DNA, 25 bp, Homo sapien
tggctgcacttctcaatgcctggaa

SEQ ID NO: 301349 - DNA, 25 bp, Homo sapien
ttttagatttcaatccagtcctagc

SEQ ID NO: 301350 - DNA, 25 bp, Homo sapien
agtcctagcacttgatctcattggg

SEQ ID NO: 301351 - DNA, 25 bp, Homo sapien
gaaaagctagccattgaactacttg

SEQ ID NO: 301352 - DNA, 25 bp, Homo sapien
gaaatcctttgagtacagtgcttgt

SEQ ID NO: 301353 - DNA, 25 bp, Homo sapien
ttgagtacagtgcttgtccacttgt

SEQ ID NO: 301354 - DNA, 25 bp, Homo sapien
gggtaagctcagtctattactgaga

SEQ ID NO: 301355 - DNA, 25 bp, Homo sapien
tactgagacaatagtgagatggctt

SEQ ID NO: 301356 - DNA, 25 bp, Homo sapien
gagatggcttatatgtttcccctgt

SEQ ID NO: 301357 - DNA, 25 bp, Homo sapien
atgtttcccctgttaatatctggtt

SEQ ID NO: 301358 - DNA, 25 bp, Homo sapien
atccatcaaatggtatgctcgcagc

SEQ ID NO: 301359 - DNA, 25 bp, Homo sapien
ggtatgctcgcagcattagcaaaat

SEQ ID NO: 301360 - DNA, 25 bp, Homo sapien
tagcaaaattaggagtttcatcttt

SEQ ID NO: 301361 - DNA, 25 bp, Homo sapien
attgaatcacaggtggagactccta

SEQ ID NO: 301362 - DNA, 25 bp, Homo sapien
gtggagactcctattttcctttctg

SEQ ID NO: 301363 - DNA, 25 bp, Homo sapien
ctttctgttttcaggcctttgagcc

SEQ ID NO: 301364 - DNA, 25 bp, Homo sapien
gggagcccaaataccactcaattat

SEQ ID NO: 301365 - DNA, 25 bp, Homo sapien
ttgggtaccatgcttactgtttgag

SEQ ID NO: 301366 - DNA, 25 bp, Homo sapien
ggtaccatgcttactgtttgagtga

SEQ ID NO: 301367 - DNA, 25 bp, Homo sapien
ccatgcttactgtttgagtgatgag

SEQ ID NO: 301368 - DNA, 25 bp, Homo sapien
agccttccaaaatctacccatgtaa

SEQ ID NO: 301369 - DNA, 25 bp, Homo sapien
ttccaaaatctacccatgtaacaaa

SEQ ID NO: 301370 - DNA, 25 bp, Homo sapien
ataaaatgacatagagccctccaaa

SEQ ID NO: 301371 - DNA, 25 bp, Homo sapien
ccattggaaagtggcagctacacat

SEQ ID NO: 301372 - DNA, 25 bp, Homo sapien
aaagtggcagctacacattgaattc

SEQ ID NO: 301373 - DNA, 25 bp, Homo sapien
gaattcacatgaaccagaggcactg

SEQ ID NO: 301374 - DNA, 25 bp, Homo sapien
gcactggagatcactagacaggtga

SEQ ID NO: 301375 - DNA, 25 bp, Homo sapien
agatcactagacaggtgagacagga

SEQ ID NO: 301376 - DNA, 25 bp, Homo sapien
ctccatataccttcaccctaaagtt

SEQ ID NO: 301377 - DNA, 25 bp, Homo sapien
taatataacttaactcccaccagtc

SEQ ID NO: 301378 - DNA, 25 bp, Homo sapien
acagggaatctattggaaggaaact

SEQ ID NO: 301379 - DNA, 25 bp, Homo sapien
tccaggtcagccagacttagtaagg

SEQ ID NO: 301380 - DNA, 25 bp, Homo sapien
gtcagccagacttagtaaggatcaa

SEQ ID NO: 301381 - DNA, 25 bp, Homo sapien
tttggagaccctcccctgggtatca

SEQ ID NO: 301382 - DNA, 25 bp, Homo sapien
ctcccctgggtatcatggaatcatt

SEQ ID NO: 301383 - DNA, 25 bp, Homo sapien
ggtatcatggaatcattctcagagc

SEQ ID NO: 301384 - DNA, 25 bp, Homo sapien
tcattctcagagcaaaagcaatttt

SEQ ID NO: 301385 - DNA, 25 bp, Homo sapien
tggaaacagccaagacaaagtcaaa

SEQ ID NO: 301386 - DNA, 25 bp, Homo sapien
aaagataactctgggacagtcagca

SEQ ID NO: 301387 - DNA, 25 bp, Homo sapien
gaaccagtgagtgaagggcattatc

SEQ ID NO: 301388 - DNA, 25 bp, Homo sapien
gaagggcattatcacaactccaaga

SEQ ID NO: 301389 - DNA, 25 bp, Homo sapien
tatcacaactccaagaaccaactag

SEQ ID NO: 301390 - DNA, 25 bp, Homo sapien
agaaccaactaggagtcacccatga

SEQ ID NO: 301391 - DNA, 25 bp, Homo sapien
taggagtcacccatgacatcatctc

SEQ ID NO: 301392 - DNA, 25 bp, Homo sapien
gacatcatctcctgaatttcatcac

SEQ ID NO: 301393 - DNA, 25 bp, Homo sapien
tcctgaatttcatcaccaagcccag

SEQ ID NO: 301394 - DNA, 25 bp, Homo sapien
gcccagctgatcctatttcctaaat

SEQ ID NO: 301395 - DNA, 25 bp, Homo sapien
gggtggttttggtccatttctccag

SEQ ID NO: 301396 - DNA, 25 bp, Homo sapien
gatcctatttcctaaatggttcctg

SEQ ID NO: 301397 - DNA, 25 bp, Homo sapien
tggtccatttctccagcgaagaagt

SEQ ID NO: 301398 - DNA, 25 bp, Homo sapien
taaacatctgctgggtcttcgaagt

SEQ ID NO: 301399 - DNA, 25 bp, Homo sapien
tctgctgttgctgcctaagacgggt

SEQ ID NO: 301400 - DNA, 25 bp, Homo sapien
gcatgagcagtcttgtttggatatc

SEQ ID NO: 301401 - DNA, 25 bp, Homo sapien
ggatatctgcacatgtttgctttct

SEQ ID NO: 301402 - DNA, 25 bp, Homo sapien
gtttgctttctattggttcagactc

SEQ ID NO: 301403 - DNA, 25 bp, Homo sapien
ttcagactcaccttggaacagagct

SEQ ID NO: 301404 - DNA, 25 bp, Homo sapien
agagctgggtctgttaagtctgaga

SEQ ID NO: 301405 - DNA, 25 bp, Homo sapien
aagtctgagaccttgcttctggtac

SEQ ID NO: 301406 - DNA, 25 bp, Homo sapien
ggaagtggcccaatgttttgctcat

SEQ ID NO: 301407 - DNA, 25 bp, Homo sapien
aatgttttgctcatcctaaagtcac

SEQ ID NO: 301408 - DNA, 25 bp, Homo sapien
gtcactcaatgacttgcagcagcct

SEQ ID NO: 301409 - DNA, 25 bp, Homo sapien
acttggttcaccgtgatgtttctgg

SEQ ID NO: 301410 - DNA, 25 bp, Homo sapien
tggagtgaccactgtttgatacctg

SEQ ID NO: 301411 - DNA, 25 bp, Homo sapien
tttgatacctggtttgacagatatc

SEQ ID NO: 301412 - DNA, 25 bp, Homo sapien
aagggtctagaattggcttgatctc

SEQ ID NO: 301413 - DNA, 25 bp, Homo sapien
gcttgatctccacagtatctcttag

SEQ ID NO: 301414 - DNA, 25 bp, Homo sapien
ggtatagggctttgagtatcagtgc

SEQ ID NO: 301415 - DNA, 25 bp, Homo sapien
gtgccatcaaatagtacttccaggg

SEQ ID NO: 301416 - DNA, 25 bp, Homo sapien
ccagacaagtctgggtcctaagtga

SEQ ID NO: 301417 - DNA, 25 bp, Homo sapien
gtctgcatggtgttgggcatacagt

SEQ ID NO: 301418 - DNA, 25 bp, Homo sapien
tgggcatacagttatcgatgattat

SEQ ID NO: 301419 - DNA, 25 bp, Homo sapien
gattatggataacttggttcaccgt

SEQ ID NO: 301420 - DNA, 25 bp, Homo sapien
tgtgcgcgcacaggacttggctctc

SEQ ID NO: 301421 - DNA, 25 bp, Homo sapien
acaggacttggctctcttaggagat

SEQ ID NO: 301422 - DNA, 25 bp, Homo sapien
gagggtgctctttaagcattgctaa

SEQ ID NO: 301423 - DNA, 25 bp, Homo sapien
tgctaactatgagtgggtccctctc

SEQ ID NO: 301424 - DNA, 25 bp, Homo sapien
aacttctgagaaaacgagctgtctt

SEQ ID NO: 301425 - DNA, 25 bp, Homo sapien
aaacgagctgtcttctcttaccaag

SEQ ID NO: 301426 - DNA, 25 bp, Homo sapien
ttaccaagcgcctgcagccgtcaaa

SEQ ID NO: 301427 - DNA, 25 bp, Homo sapien
gccgtcaaaatgctgtaggctttag

SEQ ID NO: 301428 - DNA, 25 bp, Homo sapien
tgtaggctttagtcgtctgccagtt

SEQ ID NO: 301429 - DNA, 25 bp, Homo sapien
agttcccaagctgagctgtctcctt

SEQ ID NO: 301430 - DNA, 25 bp, Homo sapien
gagctgtctccttcatggataggat

SEQ ID NO: 301431 - DNA, 25 bp, Homo sapien
aaatgcaaaccctccttcggccagg

SEQ ID NO: 301432 - DNA, 25 bp, Homo sapien
gtctgccccacgaagtcactctggt

SEQ ID NO: 301433 - DNA, 25 bp, Homo sapien
gaagtcactctggtcgcggccggaa

SEQ ID NO: 301434 - DNA, 25 bp, Homo sapien
aagtcactctggtcgcggccggaag

SEQ ID NO: 301435 - DNA, 25 bp, Homo sapien
gaagcaccgcccagggagcctggac

SEQ ID NO: 301436 - DNA, 25 bp, Homo sapien
agggagcctggacccgccaagaagt

SEQ ID NO: 301437 - DNA, 25 bp, Homo sapien
gactgcagcagcgacatggcggtgg

SEQ ID NO: 301438 - DNA, 25 bp, Homo sapien
gcgacatggcggtggctgcgccgca

SEQ ID NO: 301439 - DNA, 25 bp, Homo sapien
cagccggagtggtcgggctcgggct

SEQ ID NO: 301440 - DNA, 25 bp, Homo sapien
tcgccgtccgggtcagctcagcaac

SEQ ID NO: 301441 - DNA, 25 bp, Homo sapien
ggcccggaggtgcaccatcttccgc

SEQ ID NO: 301442 - DNA, 25 bp, Homo sapien
gaatttcccatagaagctggtgaca

SEQ ID NO: 301443 - DNA, 25 bp, Homo sapien
gaagctggtgacatgttcctggaag

SEQ ID NO: 301444 - DNA, 25 bp, Homo sapien
atgttcctggaagctctgggctaca

SEQ ID NO: 301445 - DNA, 25 bp, Homo sapien
tgggctacacctggcatgacacttg

SEQ ID NO: 301446 - DNA, 25 bp, Homo sapien
atgacacttgctttgtatgctcagt

SEQ ID NO: 301447 - DNA, 25 bp, Homo sapien
tgctttgtatgctcagtgtgttgtg

SEQ ID NO: 301448 - DNA, 25 bp, Homo sapien
gtgaaagtttggaaggtcagacctt

SEQ ID NO: 301449 - DNA, 25 bp, Homo sapien
tggaaggtcagacctttttctccaa

SEQ ID NO: 301450 - DNA, 25 bp, Homo sapien
ggacaagcccctgtgtaagaaacat

SEQ ID NO: 301451 - DNA, 25 bp, Homo sapien
gcccctgtgtaagaaacatgctcat

SEQ ID NO: 301452 - DNA, 25 bp, Homo sapien
agtggccctgaaggaataaattcca

SEQ ID NO: 301453 - DNA, 25 bp, Homo sapien
acatggccgaaatagacgcacgcct

SEQ ID NO: 301454 - DNA, 25 bp, Homo sapien
gaaatagacgcacgcctgaaggcct

SEQ ID NO: 301455 - DNA, 25 bp, Homo sapien
agacgcacgcctgaaggccttgcag

SEQ ID NO: 301456 - DNA, 25 bp, Homo sapien
acgcctgaaggccttgcaggagtac

SEQ ID NO: 301457 - DNA, 25 bp, Homo sapien
ggccttgcaggagtacatgaaccga

SEQ ID NO: 301458 - DNA, 25 bp, Homo sapien
aggagtacatgaaccgactggacat

SEQ ID NO: 301459 - DNA, 25 bp, Homo sapien
ccgactggacatgcggtcataacgt

SEQ ID NO: 301460 - DNA, 25 bp, Homo sapien
acatgcggtcataacgtggagaagg

SEQ ID NO: 301461 - DNA, 25 bp, Homo sapien
ccacccacttgctgggtatggtgtg

SEQ ID NO: 301462 - DNA, 25 bp, Homo sapien
tcaggtgtgtgaggccctgaccctg

SEQ ID NO: 301463 - DNA, 25 bp, Homo sapien
agggaggatgtgtgcattttgtaaa

SEQ ID NO: 301464 - DNA, 25 bp, Homo sapien
caaacttctcttcagccccatggat

SEQ ID NO: 301465 - DNA, 25 bp, Homo sapien
atggatccttaacctggcagcccgt

SEQ ID NO: 301466 - DNA, 25 bp, Homo sapien
gttctctgtcccctagcactagact

SEQ ID NO: 301467 - DNA, 25 bp, Homo sapien
gcactagactcagctgtattgtttt

SEQ ID NO: 301468 - DNA, 25 bp, Homo sapien
ccactccaactgcacagaagttctg

SEQ ID NO: 301469 - DNA, 25 bp, Homo sapien
cacagaagttctgggcctgacaggt

SEQ ID NO: 301470 - DNA, 25 bp, Homo sapien
gcctgacaggtagattccagctgga

SEQ ID NO: 301471 - DNA, 25 bp, Homo sapien
aaggcaggcccgtgcctggttttgc

SEQ ID NO: 301472 - DNA, 25 bp, Homo sapien
tggttttgcgtctgttcccctgagg

SEQ ID NO: 301473 - DNA, 25 bp, Homo sapien
tctgttcccctgagggccatcgtca

SEQ ID NO: 301474 - DNA, 25 bp, Homo sapien
catcgtcatcctggagcttcaatgg

SEQ ID NO: 301475 - DNA, 25 bp, Homo sapien
acactagggctaaggctgcttggca

SEQ ID NO: 301476 - DNA, 25 bp, Homo sapien
tgcttggcagtgtctctgaagtcac

SEQ ID NO: 301477 - DNA, 25 bp, Homo sapien
aggctggaaatctcccaagtattca

SEQ ID NO: 301478 - DNA, 25 bp, Homo sapien
caggttgaattggttcagacggctt

SEQ ID NO: 301479 - DNA, 25 bp, Homo sapien
caattctggacctatcacttcattt

SEQ ID NO: 301480 - DNA, 25 bp, Homo sapien
gacggctttgaacgatctatacatt

SEQ ID NO: 301481 - DNA, 25 bp, Homo sapien
ggattatccagtaaggtcacttcat

SEQ ID NO: 301482 - DNA, 25 bp, Homo sapien
aagcctgaaagaggttgctctgaaa

SEQ ID NO: 301483 - DNA, 25 bp, Homo sapien
gctcttgaggaggtgtatcttcatc

SEQ ID NO: 301484 - DNA, 25 bp, Homo sapien
atcttcatcctgatacctgtatttc

SEQ ID NO: 301485 - DNA, 25 bp, Homo sapien
atttctctacactagggctaaggct

SEQ ID NO: 301486 - DNA, 25 bp, Homo sapien
ggttgagactaaattactcatcgtc

SEQ ID NO: 301487 - DNA, 25 bp, Homo sapien
cattttcctaatgatttgcagagat

SEQ ID NO: 301488 - DNA, 25 bp, Homo sapien
tcctaatgatttgcagagataactg

SEQ ID NO: 301489 - DNA, 25 bp, Homo sapien
gagataactgcacaattttgcatat

SEQ ID NO: 301490 - DNA, 25 bp, Homo sapien
gcacaattttgcatatcaatgatac

SEQ ID NO: 301491 - DNA, 25 bp, Homo sapien
caatgatactggttcttactcccac

SEQ ID NO: 301492 - DNA, 25 bp, Homo sapien
tgatactggttcttactcccaccag

SEQ ID NO: 301493 - DNA, 25 bp, Homo sapien
tcttactcccaccagtgtttcataa

SEQ ID NO: 301494 - DNA, 25 bp, Homo sapien
tcccaccagtgtttcataatactaa

SEQ ID NO: 301495 - DNA, 25 bp, Homo sapien
aatactaacaagatggtctctccta

SEQ ID NO: 301496 - DNA, 25 bp, Homo sapien
taacaagatggtctctcctagcaag

SEQ ID NO: 301497 - DNA, 25 bp, Homo sapien
ttttatctatcaacttggctaggcg

SEQ ID NO: 301498 - DNA, 25 bp, Homo sapien
atcaacttggctaggcgatgctacc

SEQ ID NO: 301499 - DNA, 25 bp, Homo sapien
tggctaggcgatgctacccatgtta

SEQ ID NO: 301500 - DNA, 25 bp, Homo sapien
ggcgatgctacccatgttactcagt

SEQ ID NO: 301501 - DNA, 25 bp, Homo sapien
ggtggaatgtaagtccctaaggaca

SEQ ID NO: 301502 - DNA, 25 bp, Homo sapien
gtccctaaggacacaatcttactca

SEQ ID NO: 301503 - DNA, 25 bp, Homo sapien
atcttactcacaattgtatctccaa

SEQ ID NO: 301504 - DNA, 25 bp, Homo sapien
gtatctccaacatttggcataatgc

SEQ ID NO: 301505 - DNA, 25 bp, Homo sapien
ggcataatgcctaatacgtaagtat

SEQ ID NO: 301506 - DNA, 25 bp, Homo sapien
ttaaacgagaacacaagcctaaatt

SEQ ID NO: 301507 - DNA, 25 bp, Homo sapien
atggaacttagtgactttaatggtt

SEQ ID NO: 301508 - DNA, 25 bp, Homo sapien
gacaaagcagcaagacgcagtctca

SEQ ID NO: 301509 - DNA, 25 bp, Homo sapien
ggtacagacaatagctgcctggagt

SEQ ID NO: 301510 - DNA, 25 bp, Homo sapien
gctgcctggagttgtacagaaactt

SEQ ID NO: 301511 - DNA, 25 bp, Homo sapien
cagaaacttgattgggtaaccctgg

SEQ ID NO: 301512 - DNA, 25 bp, Homo sapien
aggctgtggccagcagttgaccctg

SEQ ID NO: 301513 - DNA, 25 bp, Homo sapien
tgaccttccctgttgcaaagcagtg

SEQ ID NO: 301514 - DNA, 25 bp, Homo sapien
aaagcagtggcctactacagggtct

SEQ ID NO: 301515 - DNA, 25 bp, Homo sapien
ctacagggtctctctggagggagca

SEQ ID NO: 301516 - DNA, 25 bp, Homo sapien
agcaaggaggctcagtggccccatt

SEQ ID NO: 301517 - DNA, 25 bp, Homo sapien
gtggccccattcagcaattcgaagt

SEQ ID NO: 301518 - DNA, 25 bp, Homo sapien
tcagcaattcgaagtccctttaatt

SEQ ID NO: 301519 - DNA, 25 bp, Homo sapien
tccaggtaggatggtcgctcgggca

SEQ ID NO: 301520 - DNA, 25 bp, Homo sapien
gtacttggggtctgaggcaaagctc

SEQ ID NO: 301521 - DNA, 25 bp, Homo sapien
aggcaaagctctgggtggtgggcat

SEQ ID NO: 301522 - DNA, 25 bp, Homo sapien
tgggcatggtcttcccaggtgagct

SEQ ID NO: 301523 - DNA, 25 bp, Homo sapien
gggctgggtgtcctcgagccttgag

SEQ ID NO: 301524 - DNA, 25 bp, Homo sapien
ggtcgctcgggcagcaagtaatagt

SEQ ID NO: 301525 - DNA, 25 bp, Homo sapien
gcaagtaatagtgggtgctgctgac

SEQ ID NO: 301526 - DNA, 25 bp, Homo sapien
tgaccttcttgccatcccggacgat

SEQ ID NO: 301527 - DNA, 25 bp, Homo sapien
ttgccatcccggacgatgggcagga

SEQ ID NO: 301528 - DNA, 25 bp, Homo sapien
catcccggacgatgggcaggatgca

SEQ ID NO: 301529 - DNA, 25 bp, Homo sapien
aggatgcagggaccagcccgcgggc

SEQ ID NO: 301530 - DNA, 25 bp, Homo sapien
ggaaagttaccgcagatgattatct

SEQ ID NO: 301531 - DNA, 25 bp, Homo sapien
atgcttttgaagtaaggcttatgtt

SEQ ID NO: 301532 - DNA, 25 bp, Homo sapien
ggatttaagtcattacttaccagca

SEQ ID NO: 301533 - DNA, 25 bp, Homo sapien
gtcattacttaccagcaaaacttta

SEQ ID NO: 301534 - DNA, 25 bp, Homo sapien
gcaaaactttatatgccaagtagct

SEQ ID NO: 301535 - DNA, 25 bp, Homo sapien
aactgactttgtggatatttcttag

SEQ ID NO: 301536 - DNA, 25 bp, Homo sapien
atttcttagaactatggtcctcaaa

SEQ ID NO: 301537 - DNA, 25 bp, Homo sapien
ggtcctcaaattgtgagttgctgta

SEQ ID NO: 301538 - DNA, 25 bp, Homo sapien
gttgctgtagaatggaacttttctg

SEQ ID NO: 301539 - DNA, 25 bp, Homo sapien
tattatctcccatccaaatgccatc

SEQ ID NO: 301540 - DNA, 25 bp, Homo sapien
aaatgccatcttttgcactatgaga

SEQ ID NO: 301541 - DNA, 25 bp, Homo sapien
tctttcctagagcttatggtcccta

SEQ ID NO: 301542 - DNA, 25 bp, Homo sapien
tttcctagagcttatggtccctact

SEQ ID NO: 301543 - DNA, 25 bp, Homo sapien
tcctagagcttatggtccctactga

SEQ ID NO: 301544 - DNA, 25 bp, Homo sapien
agagcttatggtccctactgacctt

SEQ ID NO: 301545 - DNA, 25 bp, Homo sapien
ttatggtccctactgaccttggact

SEQ ID NO: 301546 - DNA, 25 bp, Homo sapien
tggtccctactgaccttggacttct

SEQ ID NO: 301547 - DNA, 25 bp, Homo sapien
cccactcctcaaaaacaataaatca

SEQ ID NO: 301548 - DNA, 25 bp, Homo sapien
ataaatcaaggctttgactgacctg

SEQ ID NO: 301549 - DNA, 25 bp, Homo sapien
tggtgctgtgctgtaggaagagaca

SEQ ID NO: 301550 - DNA, 25 bp, Homo sapien
agaagggactaatacaccatgtgaa

SEQ ID NO: 301551 - DNA, 25 bp, Homo sapien
gggactaatacaccatgtgaagata

SEQ ID NO: 301552 - DNA, 25 bp, Homo sapien
gatactcagcttgaaagagaccagg

SEQ ID NO: 301553 - DNA, 25 bp, Homo sapien
cagcttgaaagagaccaggtgcttc

SEQ ID NO: 301554 - DNA, 25 bp, Homo sapien
caggtgcttcaaaacttaggctcgg

SEQ ID NO: 301555 - DNA, 25 bp, Homo sapien
gtgcttcaaaacttaggctcggtag

SEQ ID NO: 301556 - DNA, 25 bp, Homo sapien
acttaggctcggtagaatcttactc

SEQ ID NO: 301557 - DNA, 25 bp, Homo sapien
ggctcggtagaatcttactcagaag

SEQ ID NO: 301558 - DNA, 25 bp, Homo sapien
aagaaactccaagccatgaacaaag

SEQ ID NO: 301559 - DNA, 25 bp, Homo sapien
atgaacaaagaactgcagagacttc

SEQ ID NO: 301560 - DNA, 25 bp, Homo sapien
gctcaaaaagaacatgcaaggttgc

SEQ ID NO: 301561 - DNA, 25 bp, Homo sapien
gcaaggttgcttaaaaatcagtctc

SEQ ID NO: 301562 - DNA, 25 bp, Homo sapien
agaaattgcagcaggatgtgatgga

SEQ ID NO: 301563 - DNA, 25 bp, Homo sapien
tggaatgcatgggtggactaaagac

SEQ ID NO: 301564 - DNA, 25 bp, Homo sapien
tggactaaagacctatcacctcact

SEQ ID NO: 301565 - DNA, 25 bp, Homo sapien
agacctatcacctcactctagaatg

SEQ ID NO: 301566 - DNA, 25 bp, Homo sapien
tcactctagaatgcccagcatgttg

SEQ ID NO: 301567 - DNA, 25 bp, Homo sapien
atgcccagcatgttggagcatgtta

SEQ ID NO: 301568 - DNA, 25 bp, Homo sapien
ggagcatgttaagcactatatgagc

SEQ ID NO: 301569 - DNA, 25 bp, Homo sapien
gcactatatgagctgctgaggatac

SEQ ID NO: 301570 - DNA, 25 bp, Homo sapien
acaacaacacaggtgtgtcctctgc

SEQ ID NO: 301571 - DNA, 25 bp, Homo sapien
ggcataaatgagcttccaaatgaac

SEQ ID NO: 301572 - DNA, 25 bp, Homo sapien
aatgaacacaaacaaatctggaagg

SEQ ID NO: 301573 - DNA, 25 bp, Homo sapien
ggcttttgaggaagaaggaccatta

SEQ ID NO: 301574 - DNA, 25 bp, Homo sapien
ctaagccttcggaagcagcaacatc

SEQ ID NO: 301575 - DNA, 25 bp, Homo sapien
ccctctggcagaagcatcagacttc

SEQ ID NO: 301576 - DNA, 25 bp, Homo sapien
ggcagaagcatcagacttcgcagat

SEQ ID NO: 301577 - DNA, 25 bp, Homo sapien
gaagcatcagacttcgcagatcagt

SEQ ID NO: 301578 - DNA, 25 bp, Homo sapien
agcatcagacttcgcagatcagtca

SEQ ID NO: 301579 - DNA, 25 bp, Homo sapien
tcagacttcgcagatcagtcagata

SEQ ID NO: 301580 - DNA, 25 bp, Homo sapien
acttcgcagatcagtcagataagag

SEQ ID NO: 301581 - DNA, 25 bp, Homo sapien
gatcagtcagataagagggacacga

SEQ ID NO: 301582 - DNA, 25 bp, Homo sapien
aattcagctgagagctagttggagc

SEQ ID NO: 301583 - DNA, 25 bp, Homo sapien
tcagctgagagctagttggagctct

SEQ ID NO: 301584 - DNA, 25 bp, Homo sapien
gggtcccacgagctttaccgagctc

SEQ ID NO: 301585 - DNA, 25 bp, Homo sapien
gaagaaaacagatttggcataagtt

SEQ ID NO: 301586 - DNA, 25 bp, Homo sapien
ttcccgtggttaagctgaggttatg

SEQ ID NO: 301587 - DNA, 25 bp, Homo sapien
gcataagttatatgacagccacagt

SEQ ID NO: 301588 - DNA, 25 bp, Homo sapien
cagccacagtgaggctttcttatat

SEQ ID NO: 301589 - DNA, 25 bp, Homo sapien
cacagtgaggctttcttatatatga

SEQ ID NO: 301590 - DNA, 25 bp, Homo sapien
agacattgacaatcagtcccatggg

SEQ ID NO: 301591 - DNA, 25 bp, Homo sapien
taaaaatcatattacaggcagcagt

SEQ ID NO: 301592 - DNA, 25 bp, Homo sapien
atacagaggccatttacctttttat

SEQ ID NO: 301593 - DNA, 25 bp, Homo sapien
gttatgagtgctttagtgtggctcc

SEQ ID NO: 301594 - DNA, 25 bp, Homo sapien
gtgtggctccattgaccagcactaa

SEQ ID NO: 301595 - DNA, 25 bp, Homo sapien
tggctccattgaccagcactaactt

SEQ ID NO: 301596 - DNA, 25 bp, Homo sapien
gggctgtgatggcaccaaggcaggt

SEQ ID NO: 301597 - DNA, 25 bp, Homo sapien
ggcaggtggagcaccaggtaccaca

SEQ ID NO: 301598 - DNA, 25 bp, Homo sapien
tggagcaccaggtaccacacagctg

SEQ ID NO: 301599 - DNA, 25 bp, Homo sapien
accaggtaccacacagctgggcttc

SEQ ID NO: 301600 - DNA, 25 bp, Homo sapien
tagcccgtcactccatacagtatta

SEQ ID NO: 301601 - DNA, 25 bp, Homo sapien
cactccatacagtattaggtgagga

SEQ ID NO: 301602 - DNA, 25 bp, Homo sapien
tggatgcgggcgctgtccttgccgg

SEQ ID NO: 301603 - DNA, 25 bp, Homo sapien
ccttgccgggaagtcactgttgaag

SEQ ID NO: 301604 - DNA, 25 bp, Homo sapien
ccgggaagtcactgttgaagttgca

SEQ ID NO: 301605 - DNA, 25 bp, Homo sapien
tgaagttgcagtggcttgttcacac

SEQ ID NO: 301606 - DNA, 25 bp, Homo sapien
gagaagtgaagactttctccttgca

SEQ ID NO: 301607 - DNA, 25 bp, Homo sapien
ctcctcttttggctgtatcttgtag

SEQ ID NO: 301608 - DNA, 25 bp, Homo sapien
gtatcttgtagccacatctttcaaa

SEQ ID NO: 301609 - DNA, 25 bp, Homo sapien
ttcctcttcttttttggcgagctca

SEQ ID NO: 301610 - DNA, 25 bp, Homo sapien
ggcgagctcactacgcttgaaatat

SEQ ID NO: 301611 - DNA, 25 bp, Homo sapien
tttattttccaccagcaggttcctg

SEQ ID NO: 301612 - DNA, 25 bp, Homo sapien
gcttccgaaggatctctgatttcag

SEQ ID NO: 301613 - DNA, 25 bp, Homo sapien
tgatttcagaatgtccatctcgccg

SEQ ID NO: 301614 - DNA, 25 bp, Homo sapien
agaatgtccatctcgccgccagaat

SEQ ID NO: 301615 - DNA, 25 bp, Homo sapien
gccgccagaatttaagctccagttt

SEQ ID NO: 301616 - DNA, 25 bp, Homo sapien
ggcggccgcgaacccactgagtata

SEQ ID NO: 301617 - DNA, 25 bp, Homo sapien
aacccactgagtatacggaacaaca

SEQ ID NO: 301618 - DNA, 25 bp, Homo sapien
caccatgcaggctggtcagcgagca

SEQ ID NO: 301619 - DNA, 25 bp, Homo sapien
gagcatttaacaaagggcctgaccc

SEQ ID NO: 301620 - DNA, 25 bp, Homo sapien
gggcctgacccttgaaaggcttact

SEQ ID NO: 301621 - DNA, 25 bp, Homo sapien
aaaggcttactgctgcatggctgtc

SEQ ID NO: 301622 - DNA, 25 bp, Homo sapien
atggctgtctgcatgaaccacgcct

SEQ ID NO: 301623 - DNA, 25 bp, Homo sapien
aaccacgcctggtgaaggagcctgg

SEQ ID NO: 301624 - DNA, 25 bp, Homo sapien
gtgagaaacaccatccaaagctggg

SEQ ID NO: 301625 - DNA, 25 bp, Homo sapien
gatgattaccttcagcatgattaca

SEQ ID NO: 301626 - DNA, 25 bp, Homo sapien
gtattaccttcagtatgattacaga

SEQ ID NO: 301627 - DNA, 25 bp, Homo sapien
gtcctacttgacaatcacatataga

SEQ ID NO: 301628 - DNA, 25 bp, Homo sapien
aacggtgctattcagtaagttctct

SEQ ID NO: 301629 - DNA, 25 bp, Homo sapien
ggaattctcaaaataagccctactc

SEQ ID NO: 301630 - DNA, 25 bp, Homo sapien
taagccctactccttttcacttact

SEQ ID NO: 301631 - DNA, 25 bp, Homo sapien
gataatgtgtaacagccagccccat

SEQ ID NO: 301632 - DNA, 25 bp, Homo sapien
cagccagccccatttcaaaaagatt

SEQ ID NO: 301633 - DNA, 25 bp, Homo sapien
gccccatttcaaaaagattaccagg

SEQ ID NO: 301634 - DNA, 25 bp, Homo sapien
tgggtcaaaatcatcttccgaagaa

SEQ ID NO: 301635 - DNA, 25 bp, Homo sapien
cattgtaaatcaaagggcattgtcc

SEQ ID NO: 301636 - DNA, 25 bp, Homo sapien
tcaaagggcattgtcctgttttgga

SEQ ID NO: 301637 - DNA, 25 bp, Homo sapien
tcttgtttttatcagttgagtgcct

SEQ ID NO: 301638 - DNA, 25 bp, Homo sapien
ttatcagttgagtgcctatagatgc

SEQ ID NO: 301639 - DNA, 25 bp, Homo sapien
gttgagtgcctatagatgcacatac

SEQ ID NO: 301640 - DNA, 25 bp, Homo sapien
gggccggcgttgaccgggaagagcg

SEQ ID NO: 301641 - DNA, 25 bp, Homo sapien
ggccggcgttgaccgggaagagcgg

SEQ ID NO: 301642 - DNA, 25 bp, Homo sapien
ggaagagcgggcaccgcggcagtgg

SEQ ID NO: 301643 - DNA, 25 bp, Homo sapien
gaagagcgggcaccgcggcagtggc

SEQ ID NO: 301644 - DNA, 25 bp, Homo sapien
aagagcgggcaccgcggcagtggct

SEQ ID NO: 301645 - DNA, 25 bp, Homo sapien
cgggcaccgcggcagtggctccgag

SEQ ID NO: 301646 - DNA, 25 bp, Homo sapien
gggcaccgcggcagtggctccgagg

SEQ ID NO: 301647 - DNA, 25 bp, Homo sapien
ggcaccgcggcagtggctccgaggg

SEQ ID NO: 301648 - DNA, 25 bp, Homo sapien
gcagtggctccgaggggacccgcga

SEQ ID NO: 301649 - DNA, 25 bp, Homo sapien
cagtggctccgaggggacccgcgat

SEQ ID NO: 301650 - DNA, 25 bp, Homo sapien
ggctccgaggggacccgcgatggca

SEQ ID NO: 301651 - DNA, 25 bp, Homo sapien
cttcctgcccctaagaatgattttg

SEQ ID NO: 301652 - DNA, 25 bp, Homo sapien
gattttgaaattgttctaccagaaa

SEQ ID NO: 301653 - DNA, 25 bp, Homo sapien
tgttctaccagaaaatgccgagaag

SEQ ID NO: 301654 - DNA, 25 bp, Homo sapien
tgatacttacattgaagatgctgct

SEQ ID NO: 301655 - DNA, 25 bp, Homo sapien
gtggatgctcgaaagcaggccatac

SEQ ID NO: 301656 - DNA, 25 bp, Homo sapien
aggccatacgagatgcagagcgtgt

SEQ ID NO: 301657 - DNA, 25 bp, Homo sapien
gaaacgaatgcataaagctgtccag

SEQ ID NO: 301658 - DNA, 25 bp, Homo sapien
aaagctgtccagaaagatctgccaa

SEQ ID NO: 301659 - DNA, 25 bp, Homo sapien
agatctgccaagaccatcagaagta

SEQ ID NO: 301660 - DNA, 25 bp, Homo sapien
gaaactattctaagacccttaaatg

SEQ ID NO: 301661 - DNA, 25 bp, Homo sapien
gaaccgcctttaacagatttacaga

SEQ ID NO: 301662 - DNA, 25 bp, Homo sapien
acagtagactcaatgctgccctgaa

SEQ ID NO: 301663 - DNA, 25 bp, Homo sapien
gtagactcaatgctgccctgaagaa

SEQ ID NO: 301664 - DNA, 25 bp, Homo sapien
gctgccctgaagaaacagacgagaa

SEQ ID NO: 301665 - DNA, 25 bp, Homo sapien
gaaacagacgagaaacaggaggaag

SEQ ID NO: 301666 - DNA, 25 bp, Homo sapien
tcctccaacctgctgtgaaggtaaa

SEQ ID NO: 301667 - DNA, 25 bp, Homo sapien
tgctgtgaaggtaaacctctcaggg

SEQ ID NO: 301668 - DNA, 25 bp, Homo sapien
atactcatacctgccaacagctagt

SEQ ID NO: 301669 - DNA, 25 bp, Homo sapien
tcatacctgccaacagctagtgggc

SEQ ID NO: 301670 - DNA, 25 bp, Homo sapien
agctagtgggccctgtgctagaact

SEQ ID NO: 301671 - DNA, 25 bp, Homo sapien
tagtgggccctgtgctagaactgcc

SEQ ID NO: 301672 - DNA, 25 bp, Homo sapien
gggccctgtgctagaactgccctct

SEQ ID NO: 301673 - DNA, 25 bp, Homo sapien
ttttcgggcccatgggcgcagccac

SEQ ID NO: 301674 - DNA, 25 bp, Homo sapien
gccatcttggaaggccttttttgcc

SEQ ID NO: 301675 - DNA, 25 bp, Homo sapien
tttgccggttcttcccgctgaggaa

SEQ ID NO: 301676 - DNA, 25 bp, Homo sapien
ttcccgctgaggaagtgtcgctcaa

SEQ ID NO: 301677 - DNA, 25 bp, Homo sapien
aagtgtcgctcaagacgctggccta

SEQ ID NO: 301678 - DNA, 25 bp, Homo sapien
gacgctggcctatgagttgtgattt

SEQ ID NO: 301679 - DNA, 25 bp, Homo sapien
ctccttgggctaagccagaccagaa

SEQ ID NO: 301680 - DNA, 25 bp, Homo sapien
aagccagaccagaaagggccccgtg

SEQ ID NO: 301681 - DNA, 25 bp, Homo sapien
gtgcgcaacgtgcttcacaatctct

SEQ ID NO: 301682 - DNA, 25 bp, Homo sapien
cgtgcttcacaatctctcagggaaa

SEQ ID NO: 301683 - DNA, 25 bp, Homo sapien
atctctcagggaaagcggctaacgt

SEQ ID NO: 301684 - DNA, 25 bp, Homo sapien
gtgcgggccgcgttacctcagcaga

SEQ ID NO: 301685 - DNA, 25 bp, Homo sapien
gttacctcagcagacgctagagagt

SEQ ID NO: 301686 - DNA, 25 bp, Homo sapien
acgctagagagtgaatgagccgcgc

SEQ ID NO: 301687 - DNA, 25 bp, Homo sapien
ggcgcgctagccttttcaagtgata

SEQ ID NO: 301688 - DNA, 25 bp, Homo sapien
gcgctagccttttcaagtgatagta

SEQ ID NO: 301689 - DNA, 25 bp, Homo sapien
agtgatagtaatcggagacttttcc

SEQ ID NO: 301690 - DNA, 25 bp, Homo sapien
ttgtctgacttcttcccggtggctc

SEQ ID NO: 301691 - DNA, 25 bp, Homo sapien
agacttttccgttacatgaggctca

SEQ ID NO: 301692 - DNA, 25 bp, Homo sapien
tacatgaggctcaacaaaagattgt

SEQ ID NO: 301693 - DNA, 25 bp, Homo sapien
tctgtttgggaaggcactaccgcgg

SEQ ID NO: 301694 - DNA, 25 bp, Homo sapien
tgggaaggcactaccgcggcgagtc

SEQ ID NO: 301695 - DNA, 25 bp, Homo sapien
atcctcatcgccatcaaccgacatg

SEQ ID NO: 301696 - DNA, 25 bp, Homo sapien
accgacatggggttctgctcatcca

SEQ ID NO: 301697 - DNA, 25 bp, Homo sapien
agcggcagcacctacttccacatgg

SEQ ID NO: 301698 - DNA, 25 bp, Homo sapien
gcacctacttccacatggcgctggg

SEQ ID NO: 301699 - DNA, 25 bp, Homo sapien
tggcagccgcctgctgtgcgagacc

SEQ ID NO: 301700 - DNA, 25 bp, Homo sapien
acctccctgggctataagatggatg

SEQ ID NO: 301701 - DNA, 25 bp, Homo sapien
tgacctcatatgtgcagcagctcct

SEQ ID NO: 301702 - DNA, 25 bp, Homo sapien
agcagctcctgagtgccatgaacaa

SEQ ID NO: 301703 - DNA, 25 bp, Homo sapien
gctcctgagtgccatgaacaagcag

SEQ ID NO: 301704 - DNA, 25 bp, Homo sapien
ctgagtgccatgaacaagcagcggg

SEQ ID NO: 301705 - DNA, 25 bp, Homo sapien
tggccagcacctagcagcggatgct

SEQ ID NO: 301706 - DNA, 25 bp, Homo sapien
ttttttctgtgctacactacataca

SEQ ID NO: 301707 - DNA, 25 bp, Homo sapien
gctacactacatacaaatcaccaaa

SEQ ID NO: 301708 - DNA, 25 bp, Homo sapien
cccttttgtgatccttggtgtactg

SEQ ID NO: 301709 - DNA, 25 bp, Homo sapien
gtgatccttggtgtactgagcagtt

SEQ ID NO: 301710 - DNA, 25 bp, Homo sapien
gatccttggtgtactgagcagtttc

SEQ ID NO: 301711 - DNA, 25 bp, Homo sapien
ttggtgtactgagcagtttctttgg

SEQ ID NO: 301712 - DNA, 25 bp, Homo sapien
aggagcaaggtgtcatcctgctctt

SEQ ID NO: 301713 - DNA, 25 bp, Homo sapien
gagcaaggtgtcatcctgctcttca

SEQ ID NO: 301714 - DNA, 25 bp, Homo sapien
gtcatcctgctcttcatttgtattt

SEQ ID NO: 301715 - DNA, 25 bp, Homo sapien
gctcttcatttgtattttggtccca

SEQ ID NO: 301716 - DNA, 25 bp, Homo sapien
gtggtaactaccgagatgaatattt

SEQ ID NO: 301717 - DNA, 25 bp, Homo sapien
attagttctgttagcttatttaaat

SEQ ID NO: 301718 - DNA, 25 bp, Homo sapien
atttcattcctttcatctcactgaa

SEQ ID NO: 301719 - DNA, 25 bp, Homo sapien
tcactgaaaactgtctgcaggccct

SEQ ID NO: 301720 - DNA, 25 bp, Homo sapien
gcaggccctttgatttggattagat

SEQ ID NO: 301721 - DNA, 25 bp, Homo sapien
gtgtgaagtactgtcttttgccaaa

SEQ ID NO: 301722 - DNA, 25 bp, Homo sapien
ttacctgttcttttcaacgtagtgg

SEQ ID NO: 301723 - DNA, 25 bp, Homo sapien
caacgtagtgggtttgtgcttgttt

SEQ ID NO: 301724 - DNA, 25 bp, Homo sapien
gatcagttcaaaaactatctgtact

SEQ ID NO: 301725 - DNA, 25 bp, Homo sapien
atctgtactatctgtactgcctctg

SEQ ID NO: 301726 - DNA, 25 bp, Homo sapien
actatctgtactgcctctgatgtta

SEQ ID NO: 301727 - DNA, 25 bp, Homo sapien
gtatagcataaggaagctagctctg

SEQ ID NO: 301728 - DNA, 25 bp, Homo sapien
taagcagacccatacctttccaggg

SEQ ID NO: 301729 - DNA, 25 bp, Homo sapien
tacctttccagggtcaaagtacaga

SEQ ID NO: 301730 - DNA, 25 bp, Homo sapien
ccatttcttttactctgtgtaaaga

SEQ ID NO: 301731 - DNA, 25 bp, Homo sapien
gaagtctaattcacaggcaaaccaa

SEQ ID NO: 301732 - DNA, 25 bp, Homo sapien
ggcaaaccaatacagaattgactgc

SEQ ID NO: 301733 - DNA, 25 bp, Homo sapien
aattgactgcagttgaacagactag

SEQ ID NO: 301734 - DNA, 25 bp, Homo sapien
cagactagaagtatttgtgggagga

SEQ ID NO: 301735 - DNA, 25 bp, Homo sapien
acatgaagcatgagttatctgattt

SEQ ID NO: 301736 - DNA, 25 bp, Homo sapien
attttaagccttcatttgcaattca

SEQ ID NO: 301737 - DNA, 25 bp, Homo sapien
ttgcaattcatgtaacagttgtgtc

SEQ ID NO: 301738 - DNA, 25 bp, Homo sapien
gtaacagttgtgtcataaattacac

SEQ ID NO: 301739 - DNA, 25 bp, Homo sapien
tgatcttgaagattcccttggaatg

SEQ ID NO: 301740 - DNA, 25 bp, Homo sapien
ttgaagattcccttggaatgttgag

SEQ ID NO: 301741 - DNA, 25 bp, Homo sapien
ttaggcttatttgagcactacctgc

SEQ ID NO: 301742 - DNA, 25 bp, Homo sapien
tgcccaactgtcagtgccagtgcat

SEQ ID NO: 301743 - DNA, 25 bp, Homo sapien
aactgtcagtgccagtgcatagccc

SEQ ID NO: 301744 - DNA, 25 bp, Homo sapien
agtgccagtgcatagcccttctttt

SEQ ID NO: 301745 - DNA, 25 bp, Homo sapien
cagtgcatagcccttcttttgtctc

SEQ ID NO: 301746 - DNA, 25 bp, Homo sapien
ccttcttttgtctcccttatgaaga

SEQ ID NO: 301747 - DNA, 25 bp, Homo sapien
tttgtctcccttatgaagactgccc

SEQ ID NO: 301748 - DNA, 25 bp, Homo sapien
tcccttatgaagactgccctgcagg

SEQ ID NO: 301749 - DNA, 25 bp, Homo sapien
ccttatgaagactgccctgcagggc

SEQ ID NO: 301750 - DNA, 25 bp, Homo sapien
catgatctgagcagcagcatccagg

SEQ ID NO: 301751 - DNA, 25 bp, Homo sapien
agcagcatccaggctgacctcaagg

SEQ ID NO: 301752 - DNA, 25 bp, Homo sapien
gacctcaaggaagcatagccacaaa

SEQ ID NO: 301753 - DNA, 25 bp, Homo sapien
tagccacaaaacagaatagcacctg

SEQ ID NO: 301754 - DNA, 25 bp, Homo sapien
aaacagaatagcacctgtctgtaca

SEQ ID NO: 301755 - DNA, 25 bp, Homo sapien
aatggcttcactcttatatttgagg

SEQ ID NO: 301756 - DNA, 25 bp, Homo sapien
tcactcttatatttgaggaagcaac

SEQ ID NO: 301757 - DNA, 25 bp, Homo sapien
aggaagcaactgaacaggagtcaat

SEQ ID NO: 301758 - DNA, 25 bp, Homo sapien
gagtcaatgatttcatattactgca

SEQ ID NO: 301759 - DNA, 25 bp, Homo sapien
acaacaaggtgttccgtgtgtgtgt

SEQ ID NO: 301760 - DNA, 25 bp, Homo sapien
acatttatgaaatattgcctgacta

SEQ ID NO: 301761 - DNA, 25 bp, Homo sapien
ataatcaattcccacttagcaccta

SEQ ID NO: 301762 - DNA, 25 bp, Homo sapien
attcccacttagcacctactgtgtg

SEQ ID NO: 301763 - DNA, 25 bp, Homo sapien
gtgtatgtttgacaagtcctgcttg

SEQ ID NO: 301764 - DNA, 25 bp, Homo sapien
acaagtcctgcttggcctgatgggt

SEQ ID NO: 301765 - DNA, 25 bp, Homo sapien
gaaggaacctgagcctggctgagat

SEQ ID NO: 301766 - DNA, 25 bp, Homo sapien
gaacctgagcctggctgagatggct

SEQ ID NO: 301767 - DNA, 25 bp, Homo sapien
tgaagtccaagcagctgaactggct

SEQ ID NO: 301768 - DNA, 25 bp, Homo sapien
tgaactggctgggtgggtttctacc

SEQ ID NO: 301769 - DNA, 25 bp, Homo sapien
gggtttctacctttgaaactgcaag

SEQ ID NO: 301770 - DNA, 25 bp, Homo sapien
gcaagacttgtttggagctcttaat

SEQ ID NO: 301771 - DNA, 25 bp, Homo sapien
ggagctcttaattacaatatctgat

SEQ ID NO: 301772 - DNA, 25 bp, Homo sapien
actcccttcttccacccagatgggt

SEQ ID NO: 301773 - DNA, 25 bp, Homo sapien
gagaaagcttgtggctcctgtccga

SEQ ID NO: 301774 - DNA, 25 bp, Homo sapien
aaagcttgtggctcctgtccgaggg

SEQ ID NO: 301775 - DNA, 25 bp, Homo sapien
tcctccttggcttggctttgctgct

SEQ ID NO: 301776 - DNA, 25 bp, Homo sapien
ccttggcttggctttgctgctgctt

SEQ ID NO: 301777 - DNA, 25 bp, Homo sapien
agaagggacctcctgaaaactcgct

SEQ ID NO: 301778 - DNA, 25 bp, Homo sapien
agggacctcctgaaaactcgctctt

SEQ ID NO: 301779 - DNA, 25 bp, Homo sapien
cctcctgaaaactcgctctttataa

SEQ ID NO: 301780 - DNA, 25 bp, Homo sapien
cctgaaaactcgctctttataaacg

SEQ ID NO: 301781 - DNA, 25 bp, Homo sapien
aactcgctctttataaacgaggcaa

SEQ ID NO: 301782 - DNA, 25 bp, Homo sapien
tcgctctttataaacgaggcaaaag

SEQ ID NO: 301783 - DNA, 25 bp, Homo sapien
atcatgtcctccctgcacttacatt

SEQ ID NO: 301784 - DNA, 25 bp, Homo sapien
acttacattgccactgctctgattt

SEQ ID NO: 301785 - DNA, 25 bp, Homo sapien
attgccactgctctgatttgggctt

SEQ ID NO: 301786 - DNA, 25 bp, Homo sapien
ccactgctctgatttgggctttttt

SEQ ID NO: 301787 - DNA, 25 bp, Homo sapien
cactaccagagttctctagcaaatc

SEQ ID NO: 301788 - DNA, 25 bp, Homo sapien
gttctctagcaaatctgagcatctg

SEQ ID NO: 301789 - DNA, 25 bp, Homo sapien
aatctgagcatctgacagggtgaaa

SEQ ID NO: 301790 - DNA, 25 bp, Homo sapien
tcagtgcccttctggtatcatctgc

SEQ ID NO: 301791 - DNA, 25 bp, Homo sapien
gcccttctggtatcatctgccaaga

SEQ ID NO: 301792 - DNA, 25 bp, Homo sapien
gtatcatctgccaagaccagggcct

SEQ ID NO: 301793 - DNA, 25 bp, Homo sapien
catctgccaagaccagggcctgctt

SEQ ID NO: 301794 - DNA, 25 bp, Homo sapien
gacagacagcaagattgagacacgc

SEQ ID NO: 301795 - DNA, 25 bp, Homo sapien
agcaagattgagacacgcgggcccc

SEQ ID NO: 301796 - DNA, 25 bp, Homo sapien
ccccactggtctctgagtgggaaag

SEQ ID NO: 301797 - DNA, 25 bp, Homo sapien
aagtgcgagagataaaggcctccaa

SEQ ID NO: 301798 - DNA, 25 bp, Homo sapien
gagataaaggcctccaagagaaaaa

SEQ ID NO: 301799 - DNA, 25 bp, Homo sapien
agacaactccgctacctttttatat

SEQ ID NO: 301800 - DNA, 25 bp, Homo sapien
acaactccgctacctttttatatgt

SEQ ID NO: 301801 - DNA, 25 bp, Homo sapien
actccgctacctttttatatgttgg

SEQ ID NO: 301802 - DNA, 25 bp, Homo sapien
tccgctacctttttatatgttggaa

SEQ ID NO: 301803 - DNA, 25 bp, Homo sapien
atacacaaaaactccaagccgcaag

SEQ ID NO: 301804 - DNA, 25 bp, Homo sapien
aactccaagccgcaagtccttcatg

SEQ ID NO: 301805 - DNA, 25 bp, Homo sapien
agatgctagaagttgtttgacctgt

SEQ ID NO: 301806 - DNA, 25 bp, Homo sapien
tttgacctgtgattgttcttgcttc

SEQ ID NO: 301807 - DNA, 25 bp, Homo sapien
gtccttacgtacgagtacatagcat

SEQ ID NO: 301808 - DNA, 25 bp, Homo sapien
gtacatagcatgattgggccagaat

SEQ ID NO: 301809 - DNA, 25 bp, Homo sapien
attgggccagaatccgtcttttgag

SEQ ID NO: 301810 - DNA, 25 bp, Homo sapien
tccgtcttttgagctcttctagtaa

SEQ ID NO: 301811 - DNA, 25 bp, Homo sapien
gagataatacctaagaccacatgga

SEQ ID NO: 301812 - DNA, 25 bp, Homo sapien
gtgggagagcttaccagtgctacct

SEQ ID NO: 301813 - DNA, 25 bp, Homo sapien
agtgctacctatgtgtaggctgaca

SEQ ID NO: 301814 - DNA, 25 bp, Homo sapien
tgtaggctgacactctgaaacttca

SEQ ID NO: 301815 - DNA, 25 bp, Homo sapien
aggaatctccatatgttggcactat

SEQ ID NO: 301816 - DNA, 25 bp, Homo sapien
gcatcagggatattacagattcttt

SEQ ID NO: 301817 - DNA, 25 bp, Homo sapien
ttattgggtattatgaccttttcta

SEQ ID NO: 301818 - DNA, 25 bp, Homo sapien
gaggctctttgtagttaacttatat

SEQ ID NO: 301819 - DNA, 25 bp, Homo sapien
gggggttctcatttgtataatccta

SEQ ID NO: 301820 - DNA, 25 bp, Homo sapien
tcctagcctatgacttaatgttgat

SEQ ID NO: 301821 - DNA, 25 bp, Homo sapien
aatgttgatgttttgctttgtcttt

SEQ ID NO: 301822 - DNA, 25 bp, Homo sapien
ctttgtcttttggatggcctaacct

SEQ ID NO: 301823 - DNA, 25 bp, Homo sapien
ggcctaacctacattaacatgttgg

SEQ ID NO: 301824 - DNA, 25 bp, Homo sapien
taacatgttggcagaccattttaaa

SEQ ID NO: 301825 - DNA, 25 bp, Homo sapien
acatgttggcagaccattttaaaac

SEQ ID NO: 301826 - DNA, 25 bp, Homo sapien
tgttggcagaccattttaaaacttt

SEQ ID NO: 301827 - DNA, 25 bp, Homo sapien
ttgccaagtcctaagttgatagctt

SEQ ID NO: 301828 - DNA, 25 bp, Homo sapien
aattatagtttcattaggacttggt

SEQ ID NO: 301829 - DNA, 25 bp, Homo sapien
tccccaaagggatactgcagttata

SEQ ID NO: 301830 - DNA, 25 bp, Homo sapien
actgcagttatatcacatacccaat

SEQ ID NO: 301831 - DNA, 25 bp, Homo sapien
atatcacatacccaataggcaccac

SEQ ID NO: 301832 - DNA, 25 bp, Homo sapien
taggcaccacgatgaagatcagagc

SEQ ID NO: 301833 - DNA, 25 bp, Homo sapien
gaagatcagagcttatacttaatta

SEQ ID NO: 301834 - DNA, 25 bp, Homo sapien
ggttttatacacaccagttccccag

SEQ ID NO: 301835 - DNA, 25 bp, Homo sapien
acaccagttccccagtaaatgcaaa

SEQ ID NO: 301836 - DNA, 25 bp, Homo sapien
gtcatatgttcaaaatgctcatggc

SEQ ID NO: 301837 - DNA, 25 bp, Homo sapien
atgctcatggcaaacaatcattttg

SEQ ID NO: 301838 - DNA, 25 bp, Homo sapien
agacttctccctctttatatggtta

SEQ ID NO: 301839 - DNA, 25 bp, Homo sapien
gttatcttacgacttacctagtcct

SEQ ID NO: 301840 - DNA, 25 bp, Homo sapien
tacctagtccttgagtctggtcatt

SEQ ID NO: 301841 - DNA, 25 bp, Homo sapien
agtctggtcattaactccttggtga

SEQ ID NO: 301842 - DNA, 25 bp, Homo sapien
tccttggtgaggagagaacccataa

SEQ ID NO: 301843 - DNA, 25 bp, Homo sapien
taagcttaggaagtgctctgcgaga

SEQ ID NO: 301844 - DNA, 25 bp, Homo sapien
gtgctctgcgagaaagagactgcta

SEQ ID NO: 301845 - DNA, 25 bp, Homo sapien
ggccagtgctctagagttgggtaaa

SEQ ID NO: 301846 - DNA, 25 bp, Homo sapien
gaatgggaccattatttagcagcaa

SEQ ID NO: 301847 - DNA, 25 bp, Homo sapien
tccctcatttagaccccaatggata

SEQ ID NO: 301848 - DNA, 25 bp, Homo sapien
gaccccaatggataccattccagag

SEQ ID NO: 301849 - DNA, 25 bp, Homo sapien
gtatgaagtacttttaacgtatgta

SEQ ID NO: 301850 - DNA, 25 bp, Homo sapien
aacgtatgtatttcattgctgtgtc

SEQ ID NO: 301851 - DNA, 25 bp, Homo sapien
gtatttcattgctgtgtcacactct

SEQ ID NO: 301852 - DNA, 25 bp, Homo sapien
attgctgtgtcacactctgtgtttt

SEQ ID NO: 301853 - DNA, 25 bp, Homo sapien
gctgtgtcacactctgtgttttgtg

SEQ ID NO: 301854 - DNA, 25 bp, Homo sapien
acactctgtgttttgtgaggtgaat

SEQ ID NO: 301855 - DNA, 25 bp, Homo sapien
gtgaggtgaatgtcttccttttctt

SEQ ID NO: 301856 - DNA, 25 bp, Homo sapien
gaattgatttccaagaatcggcatg

SEQ ID NO: 301857 - DNA, 25 bp, Homo sapien
atttccaagaatcggcatgtatact

SEQ ID NO: 301858 - DNA, 25 bp, Homo sapien
gaatcggcatgtatacttaatactg

SEQ ID NO: 301859 - DNA, 25 bp, Homo sapien
taatactgaatttctttgatttaac

SEQ ID NO: 301860 - DNA, 25 bp, Homo sapien
ttagttttcttcttactgctcattt

SEQ ID NO: 301861 - DNA, 25 bp, Homo sapien
tttgcttatttattgaccgtctccc

SEQ ID NO: 301862 - DNA, 25 bp, Homo sapien
tatttattgaccgtctcccctgctt

SEQ ID NO: 301863 - DNA, 25 bp, Homo sapien
gtctcccctgcttagaatgtcagct

SEQ ID NO: 301864 - DNA, 25 bp, Homo sapien
cccctgcttagaatgtcagctccag

SEQ ID NO: 301865 - DNA, 25 bp, Homo sapien
tttttcagacgggatttcgctatgt

SEQ ID NO: 301866 - DNA, 25 bp, Homo sapien
gactcaagtagtccggcctgccttg

SEQ ID NO: 301867 - DNA, 25 bp, Homo sapien
tcccaaagtgctgtggttgtagata

SEQ ID NO: 301868 - DNA, 25 bp, Homo sapien
tggttgtagatatgagccactgcgc

SEQ ID NO: 301869 - DNA, 25 bp, Homo sapien
gctagaatagtacccggcacacagt

SEQ ID NO: 301870 - DNA, 25 bp, Homo sapien
aatagtacccggcacacagtagaag

SEQ ID NO: 301871 - DNA, 25 bp, Homo sapien
agggctcccatgttgggcactgcga

SEQ ID NO: 301872 - DNA, 25 bp, Homo sapien
ccatgttgggcactgcgagaaccca

SEQ ID NO: 301873 - DNA, 25 bp, Homo sapien
acctcgctttgtcttggccctagag

SEQ ID NO: 301874 - DNA, 25 bp, Homo sapien
gaggctgggcctgttaccccatttt

SEQ ID NO: 301875 - DNA, 25 bp, Homo sapien
ctgggcctgttaccccattttgcag

SEQ ID NO: 301876 - DNA, 25 bp, Homo sapien
ttttcttcggtgttccgtgcaggac

SEQ ID NO: 301877 - DNA, 25 bp, Homo sapien
ttttgcagattgagaaggcgctcag

SEQ ID NO: 301878 - DNA, 25 bp, Homo sapien
ggagctgggtgctttgcgcaaaacc

SEQ ID NO: 301879 - DNA, 25 bp, Homo sapien
gcaaaaccaggcagcgaggacagaa

SEQ ID NO: 301880 - DNA, 25 bp, Homo sapien
agcgaggacagaagtcccgccgtgt

SEQ ID NO: 301881 - DNA, 25 bp, Homo sapien
ttccgtgcaggactgccggctgctt

SEQ ID NO: 301882 - DNA, 25 bp, Homo sapien
aatacacctctgattggaattagca

SEQ ID NO: 301883 - DNA, 25 bp, Homo sapien
ggaattagcaattacctgtgttatt

SEQ ID NO: 301884 - DNA, 25 bp, Homo sapien
ccagtttcccatagttttagtggtg

SEQ ID NO: 301885 - DNA, 25 bp, Homo sapien
ttagtggtggtatgactggcaacat

SEQ ID NO: 301886 - DNA, 25 bp, Homo sapien
gactggcaacattgttaacaacaaa

SEQ ID NO: 301887 - DNA, 25 bp, Homo sapien
aacaaatagacccatgccagactga

SEQ ID NO: 301888 - DNA, 25 bp, Homo sapien
catgccagactgaaaataacttgaa

SEQ ID NO: 301889 - DNA, 25 bp, Homo sapien
tttctttttgcatactattcatgga

SEQ ID NO: 301890 - DNA, 25 bp, Homo sapien
gaaataatctactctgcacttccct

SEQ ID NO: 301891 - DNA, 25 bp, Homo sapien
gatcatgatgcaaggctgtccaaaa

SEQ ID NO: 301892 - DNA, 25 bp, Homo sapien
gaatcaagtctcaaggctgatagta

SEQ ID NO: 301893 - DNA, 25 bp, Homo sapien
ccacctcccatttctgttgctggag

SEQ ID NO: 301894 - DNA, 25 bp, Homo sapien
tcgccagcttggctcgatgtttgcc

SEQ ID NO: 301895 - DNA, 25 bp, Homo sapien
cagcttggctcgatgtttgccatga

SEQ ID NO: 301896 - DNA, 25 bp, Homo sapien
tttgccatgagtattagcttaccca

SEQ ID NO: 301897 - DNA, 25 bp, Homo sapien
gagtattagcttacccaatgggacc

SEQ ID NO: 301898 - DNA, 25 bp, Homo sapien
attagcttacccaatgggaccgtgc

SEQ ID NO: 301899 - DNA, 25 bp, Homo sapien
tagcttacccaatgggaccgtgccc

SEQ ID NO: 301900 - DNA, 25 bp, Homo sapien
tgaccccaggtcagccctgtgtctg

SEQ ID NO: 301901 - DNA, 25 bp, Homo sapien
aggtcagccctgtgtctgtcacagg

SEQ ID NO: 301902 - DNA, 25 bp, Homo sapien
gtctgtcacaggctgggtcaaaaga

SEQ ID NO: 301903 - DNA, 25 bp, Homo sapien
gctgggtcaaaagagccctggctct

SEQ ID NO: 301904 - DNA, 25 bp, Homo sapien
ccaggctcgccttgacaccgaatgg

SEQ ID NO: 301905 - DNA, 25 bp, Homo sapien
caggctcgccttgacaccgaatggt

SEQ ID NO: 301906 - DNA, 25 bp, Homo sapien
aggctcgccttgacaccgaatggtt

SEQ ID NO: 301907 - DNA, 25 bp, Homo sapien
ggctcgccttgacaccgaatggttg

SEQ ID NO: 301908 - DNA, 25 bp, Homo sapien
gctcgccttgacaccgaatggttga

SEQ ID NO: 301909 - DNA, 25 bp, Homo sapien
ctcgccttgacaccgaatggttgaa

SEQ ID NO: 301910 - DNA, 25 bp, Homo sapien
cgccttgacaccgaatggttgaaaa

SEQ ID NO: 301911 - DNA, 25 bp, Homo sapien
gccttgacaccgaatggttgaaaac

SEQ ID NO: 301912 - DNA, 25 bp, Homo sapien
gccctgcgcgtcaggtcccggcctg

SEQ ID NO: 301913 - DNA, 25 bp, Homo sapien
ggctgccagcgtcggaggaggcctg

SEQ ID NO: 301914 - DNA, 25 bp, Homo sapien
tgccagcgtcggaggaggcctgaga

SEQ ID NO: 301915 - DNA, 25 bp, Homo sapien
atttgtgtgtttttaaccctcagag

SEQ ID NO: 301916 - DNA, 25 bp, Homo sapien
tgtttttaaccctcagagaactctg

SEQ ID NO: 301917 - DNA, 25 bp, Homo sapien
gagaactctgcattttagggtactt

SEQ ID NO: 301918 - DNA, 25 bp, Homo sapien
gggtacttgaggctgacttaactaa

SEQ ID NO: 301919 - DNA, 25 bp, Homo sapien
atttctgtaaatactaccaattgga

SEQ ID NO: 301920 - DNA, 25 bp, Homo sapien
gtagagtacttttctgaatccaatc

SEQ ID NO: 301921 - DNA, 25 bp, Homo sapien
gtatttctcagctgtgatctttgga

SEQ ID NO: 301922 - DNA, 25 bp, Homo sapien
agctgtgatctttggagcaaaagcc

SEQ ID NO: 301923 - DNA, 25 bp, Homo sapien
tggagcaaaagccaacggcaggaaa

SEQ ID NO: 301924 - DNA, 25 bp, Homo sapien
aatagtttgtaccagtttcatgaag

SEQ ID NO: 301925 - DNA, 25 bp, Homo sapien
tcatgaagtatgtctttgggttttt

SEQ ID NO: 301926 - DNA, 25 bp, Homo sapien
aaaagtgctgtttgtacgcaacctt

SEQ ID NO: 301927 - DNA, 25 bp, Homo sapien
agtgctgtttgtacgcaaccttgcc

SEQ ID NO: 301928 - DNA, 25 bp, Homo sapien
ctgtttgtacgcaaccttgccaata

SEQ ID NO: 301929 - DNA, 25 bp, Homo sapien
ttgtacgcaaccttgccaatactgt

SEQ ID NO: 301930 - DNA, 25 bp, Homo sapien
gcaaccttgccaatactgtaacaga

SEQ ID NO: 301931 - DNA, 25 bp, Homo sapien
aaccttgccaatactgtaacagaag

SEQ ID NO: 301932 - DNA, 25 bp, Homo sapien
tttgggaaactggaacgagtgaaga

SEQ ID NO: 301933 - DNA, 25 bp, Homo sapien
aagattatgcgttcattcattttga

SEQ ID NO: 301934 - DNA, 25 bp, Homo sapien
gcgttcattcattttgatgagcgag

SEQ ID NO: 301935 - DNA, 25 bp, Homo sapien
ttcattttgatgagcgagatggtgc

SEQ ID NO: 301936 - DNA, 25 bp, Homo sapien
aatggcaaagacttggagggagaaa

SEQ ID NO: 301937 - DNA, 25 bp, Homo sapien
attagccatgggagcaataatgtca

SEQ ID NO: 301938 - DNA, 25 bp, Homo sapien
ttagccatgggagcaataatgtcac

SEQ ID NO: 301939 - DNA, 25 bp, Homo sapien
tagccatgggagcaataatgtcacc

SEQ ID NO: 301940 - DNA, 25 bp, Homo sapien
actctacagtatacttgtgagagaa

SEQ ID NO: 301941 - DNA, 25 bp, Homo sapien
tctacagtatacttgtgagagaatg

SEQ ID NO: 301942 - DNA, 25 bp, Homo sapien
cagtatacttgtgagagaatgagag

SEQ ID NO: 301943 - DNA, 25 bp, Homo sapien
gtgaaagggacaaataacatctgtg

SEQ ID NO: 301944 - DNA, 25 bp, Homo sapien
gaaagggacaaataacatctgtgta

SEQ ID NO: 301945 - DNA, 25 bp, Homo sapien
agggacaaataacatctgtgtagca

SEQ ID NO: 301946 - DNA, 25 bp, Homo sapien
ggacaaataacatctgtgtagcagt

SEQ ID NO: 301947 - DNA, 25 bp, Homo sapien
acaaataacatctgtgtagcagtat

SEQ ID NO: 301948 - DNA, 25 bp, Homo sapien
gaaggagtcagtgttcttaactaca

SEQ ID NO: 301949 - DNA, 25 bp, Homo sapien
cagtgttcttaactacagtggtagc

SEQ ID NO: 301950 - DNA, 25 bp, Homo sapien
gaagggtaagcagggttctagaaat

SEQ ID NO: 301951 - DNA, 25 bp, Homo sapien
gtgttatgttttctccccactgtat

SEQ ID NO: 301952 - DNA, 25 bp, Homo sapien
ttttctccccactgtatttatttct

SEQ ID NO: 301953 - DNA, 25 bp, Homo sapien
atttatttctttggttagtggtgca

SEQ ID NO: 301954 - DNA, 25 bp, Homo sapien
ggttagtggtgcaagaaattctgtt

SEQ ID NO: 301955 - DNA, 25 bp, Homo sapien
taaggaattacgacaacagcttgta

SEQ ID NO: 301956 - DNA, 25 bp, Homo sapien
aacagcttgtagatgccagacttca

SEQ ID NO: 301957 - DNA, 25 bp, Homo sapien
agacttcaacaaacagcacagctga

SEQ ID NO: 301958 - DNA, 25 bp, Homo sapien
gagagtttgtaagttctacttcttg

SEQ ID NO: 301959 - DNA, 25 bp, Homo sapien
aaaaaatctaagcaaactatctttg

SEQ ID NO: 301960 - DNA, 25 bp, Homo sapien
aaaaatctaagcaaactatctttga

SEQ ID NO: 301961 - DNA, 25 bp, Homo sapien
aaaatctaagcaaactatctttgag

SEQ ID NO: 301962 - DNA, 25 bp, Homo sapien
aaatctaagcaaactatctttgagt

SEQ ID NO: 301963 - DNA, 25 bp, Homo sapien
aatctaagcaaactatctttgagtc

SEQ ID NO: 301964 - DNA, 25 bp, Homo sapien
atctaagcaaactatctttgagtca

SEQ ID NO: 301965 - DNA, 25 bp, Homo sapien
tctaagcaaactatctttgagtcaa

SEQ ID NO: 301966 - DNA, 25 bp, Homo sapien
ctaagcaaactatctttgagtcaaa

SEQ ID NO: 301967 - DNA, 25 bp, Homo sapien
taagcaaactatctttgagtcaaaa

SEQ ID NO: 301968 - DNA, 25 bp, Homo sapien
aagcaaactatctttgagtcaaaaa

SEQ ID NO: 301969 - DNA, 25 bp, Homo sapien
aaaaaaagttggataactcatctat

SEQ ID NO: 301970 - DNA, 25 bp, Homo sapien
ggctgaatgggcaaatctgtccaaa

SEQ ID NO: 301971 - DNA, 25 bp, Homo sapien
gaatgggcaaatctgtccaaacagc

SEQ ID NO: 301972 - DNA, 25 bp, Homo sapien
gggcaaatctgtccaaacagctagt

SEQ ID NO: 301973 - DNA, 25 bp, Homo sapien
ctgtccaaacagctagtaaccggct

SEQ ID NO: 301974 - DNA, 25 bp, Homo sapien
aaacagctagtaaccggctgtgagg

SEQ ID NO: 301975 - DNA, 25 bp, Homo sapien
agggagagggtcagaagcacttagc

SEQ ID NO: 301976 - DNA, 25 bp, Homo sapien
aagcacttagcgttggcctctgatt

SEQ ID NO: 301977 - DNA, 25 bp, Homo sapien
gcacttagcgttggcctctgattgc

SEQ ID NO: 301978 - DNA, 25 bp, Homo sapien
ttagcgttggcctctgattgctgtc

SEQ ID NO: 301979 - DNA, 25 bp, Homo sapien
agcgttggcctctgattgctgtcct

SEQ ID NO: 301980 - DNA, 25 bp, Homo sapien
gttggcctctgattgctgtcctctc

SEQ ID NO: 301981 - DNA, 25 bp, Homo sapien
caagaattatttcctgagttgatca

SEQ ID NO: 301982 - DNA, 25 bp, Homo sapien
gaattatttcctgagttgatcaaaa

SEQ ID NO: 301983 - DNA, 25 bp, Homo sapien
ttatttcctgagttgatcaaaaaga

SEQ ID NO: 301984 - DNA, 25 bp, Homo sapien
aattatgtgttgagcatgtcttttt

SEQ ID NO: 301985 - DNA, 25 bp, Homo sapien
atgtgttgagcatgtctttttatta

SEQ ID NO: 301986 - DNA, 25 bp, Homo sapien
agaaggtactttccatatctcctga

SEQ ID NO: 301987 - DNA, 25 bp, Homo sapien
aaggtactttccatatctcctgagt

SEQ ID NO: 301988 - DNA, 25 bp, Homo sapien
aggtactttccatatctcctgagtt

SEQ ID NO: 301989 - DNA, 25 bp, Homo sapien
gtactttccatatctcctgagttgg

SEQ ID NO: 301990 - DNA, 25 bp, Homo sapien
actttccatatctcctgagttggag

SEQ ID NO: 301991 - DNA, 25 bp, Homo sapien
tcctgagttggagatacttctgaaa

SEQ ID NO: 301992 - DNA, 25 bp, Homo sapien
tttagggttagatggactgcttgcc

SEQ ID NO: 301993 - DNA, 25 bp, Homo sapien
actgcttgcctgagtctgtctgaaa

SEQ ID NO: 301994 - DNA, 25 bp, Homo sapien
gcctgagtctgtctgaaagtgtgtt

SEQ ID NO: 301995 - DNA, 25 bp, Homo sapien
aagtgtgttggtttgcatgtttgat

SEQ ID NO: 301996 - DNA, 25 bp, Homo sapien
agaacccattgtccctgccctttag

SEQ ID NO: 301997 - DNA, 25 bp, Homo sapien
catttcctgcacatggctgtagaac

SEQ ID NO: 301998 - DNA, 25 bp, Homo sapien
cctgcacatggctgtagaacatact

SEQ ID NO: 301999 - DNA, 25 bp, Homo sapien
gccttttctgtgtcctgcataatat

SEQ ID NO: 302000 - DNA, 25 bp, Homo sapien
aatgaagtgtgctttggctttttgt

SEQ ID NO: 302001 - DNA, 25 bp, Homo sapien
gagatgttagctttctaagccagtt

SEQ ID NO: 302002 - DNA, 25 bp, Homo sapien
aagccagttgttaaaattcacatca

SEQ ID NO: 302003 - DNA, 25 bp, Homo sapien
gggaccccgggatcggctgcggtgt

SEQ ID NO: 302004 - DNA, 25 bp, Homo sapien
tagcgcgaccggctgtaaggagatc

SEQ ID NO: 302005 - DNA, 25 bp, Homo sapien
gtagctgcggctccgccgtccgtag

SEQ ID NO: 302006 - DNA, 25 bp, Homo sapien
accggctgtaaggagatcggctgta

SEQ ID NO: 302007 - DNA, 25 bp, Homo sapien
atcggctgtagggagaccggctata

SEQ ID NO: 302008 - DNA, 25 bp, Homo sapien
gagaccggctatagcgagaacccct

SEQ ID NO: 302009 - DNA, 25 bp, Homo sapien
accggctatagcgagaacccctata

SEQ ID NO: 302010 - DNA, 25 bp, Homo sapien
tagcgagaacccctatagcgagatc

SEQ ID NO: 302011 - DNA, 25 bp, Homo sapien
gagaacccctatagcgagatcggct

SEQ ID NO: 302012 - DNA, 25 bp, Homo sapien
aacccctatagcgagatcggctgcg

SEQ ID NO: 302013 - DNA, 25 bp, Homo sapien
cccctatagcgagatcggctgcggg

SEQ ID NO: 302014 - DNA, 25 bp, Homo sapien
catggaaggtgcaaaactcagtatt

SEQ ID NO: 302015 - DNA, 25 bp, Homo sapien
aacattaggatgaatggctggctgc

SEQ ID NO: 302016 - DNA, 25 bp, Homo sapien
gaatggctggctgcttctaggaata

SEQ ID NO: 302017 - DNA, 25 bp, Homo sapien
atggctggctgcttctaggaatata

SEQ ID NO: 302018 - DNA, 25 bp, Homo sapien
gctggctgcttctaggaatataaga

SEQ ID NO: 302019 - DNA, 25 bp, Homo sapien
gcttctaggaatataagatgcctca

SEQ ID NO: 302020 - DNA, 25 bp, Homo sapien
atgatttgaatactgtagctatttt

SEQ ID NO: 302021 - DNA, 25 bp, Homo sapien
atgtatgatttgcatgtttcaatga

SEQ ID NO: 302022 - DNA, 25 bp, Homo sapien
gggataaaacagtatactgacaact

SEQ ID NO: 302023 - DNA, 25 bp, Homo sapien
actgacaactgtttacaagaaagtg

SEQ ID NO: 302024 - DNA, 25 bp, Homo sapien
gagctgcttgtaagtataacaatat

SEQ ID NO: 302025 - DNA, 25 bp, Homo sapien
aggagacagcaatgaggacagcagt

SEQ ID NO: 302026 - DNA, 25 bp, Homo sapien
tgaggactcctccagtgagcaggac

SEQ ID NO: 302027 - DNA, 25 bp, Homo sapien
ggactcctccagtgagcaggacagt

SEQ ID NO: 302028 - DNA, 25 bp, Homo sapien
ctcctccagtgagcaggacagtgag

SEQ ID NO: 302029 - DNA, 25 bp, Homo sapien
tggacgggagtcaggcctagaaaac

SEQ ID NO: 302030 - DNA, 25 bp, Homo sapien
gggagtcaggcctagaaaacaaaag

SEQ ID NO: 302031 - DNA, 25 bp, Homo sapien
aaagaacagccaagaggaactcaaa

SEQ ID NO: 302032 - DNA, 25 bp, Homo sapien
ttcttcaaatgacgaatctagttca

SEQ ID NO: 302033 - DNA, 25 bp, Homo sapien
gacgaatctagttcaatagaagaca

SEQ ID NO: 302034 - DNA, 25 bp, Homo sapien
gaagacagttcttccgattctgaat

SEQ ID NO: 302035 - DNA, 25 bp, Homo sapien
aagacagttcttccgattctgaatc

SEQ ID NO: 302036 - DNA, 25 bp, Homo sapien
atgggagttcccaattaacaatgaa

SEQ ID NO: 302037 - DNA, 25 bp, Homo sapien
aagcaggttttgatgatgatggttc

SEQ ID NO: 302038 - DNA, 25 bp, Homo sapien
gatggttcagaatttcatgaacata

SEQ ID NO: 302039 - DNA, 25 bp, Homo sapien
catgaacatatatttctggagaaac

SEQ ID NO: 302040 - DNA, 25 bp, Homo sapien
atatttttgacatgatggcagttac

SEQ ID NO: 302041 - DNA, 25 bp, Homo sapien
ttgacatgatggcagttactaaaga

SEQ ID NO: 302042 - DNA, 25 bp, Homo sapien
gaaacagacacatcaccttcacttt

SEQ ID NO: 302043 - DNA, 25 bp, Homo sapien
ggaatttgctaagcagttagccaca

SEQ ID NO: 302044 - DNA, 25 bp, Homo sapien
aagcagttagccacagtaaatgaac

SEQ ID NO: 302045 - DNA, 25 bp, Homo sapien
agccacagtaaatgaacaacccctt

SEQ ID NO: 302046 - DNA, 25 bp, Homo sapien
gaacaaccccttcagaatggatttg

SEQ ID NO: 302047 - DNA, 25 bp, Homo sapien
ggccttgctcttgtcggccagccca

SEQ ID NO: 302048 - DNA, 25 bp, Homo sapien
gccttgctcttgtcggccagcccac

SEQ ID NO: 302049 - DNA, 25 bp, Homo sapien
ccttgctcttgtcggccagcccact

SEQ ID NO: 302050 - DNA, 25 bp, Homo sapien
cttgctcttgtcggccagcccactc

SEQ ID NO: 302051 - DNA, 25 bp, Homo sapien
ttgctcttgtcggccagcccactcc

SEQ ID NO: 302052 - DNA, 25 bp, Homo sapien
tgctcttgtcggccagcccactccc

SEQ ID NO: 302053 - DNA, 25 bp, Homo sapien
gctcttgtcggccagcccactcccc

SEQ ID NO: 302054 - DNA, 25 bp, Homo sapien
ctcttgtcggccagcccactcccca

SEQ ID NO: 302055 - DNA, 25 bp, Homo sapien
gaactggacaggcttggacctcatg

SEQ ID NO: 302056 - DNA, 25 bp, Homo sapien
aggcttggacctcatgtttcatttc

SEQ ID NO: 302057 - DNA, 25 bp, Homo sapien
aatacttattagcaaattgggcaac

SEQ ID NO: 302058 - DNA, 25 bp, Homo sapien
attgggcaacaatgggcatcttcca

SEQ ID NO: 302059 - DNA, 25 bp, Homo sapien
acaatgggcatcttccatgccacca

SEQ ID NO: 302060 - DNA, 25 bp, Homo sapien
ccacccaggcataaccagttggttt

SEQ ID NO: 302061 - DNA, 25 bp, Homo sapien
aggtttcaaatgtgtctagtgttca

SEQ ID NO: 302062 - DNA, 25 bp, Homo sapien
gtctagtgttcagtattgaggacaa

SEQ ID NO: 302063 - DNA, 25 bp, Homo sapien
aaagaaatacaagtggcaggcccaa

SEQ ID NO: 302064 - DNA, 25 bp, Homo sapien
ggcaggcccaagtattttctgtgat

SEQ ID NO: 302065 - DNA, 25 bp, Homo sapien
gtattttctgtgatatcccaggtta

SEQ ID NO: 302066 - DNA, 25 bp, Homo sapien
taatttgggcttctcaggcccagct

SEQ ID NO: 302067 - DNA, 25 bp, Homo sapien
tttgggcttctcaggcccagctcct

SEQ ID NO: 302068 - DNA, 25 bp, Homo sapien
tacaggcctggcatcatcctttcaa

SEQ ID NO: 302069 - DNA, 25 bp, Homo sapien
caggcctggcatcatcctttcaaca

SEQ ID NO: 302070 - DNA, 25 bp, Homo sapien
tggcatcatcctttcaacagcctct

SEQ ID NO: 302071 - DNA, 25 bp, Homo sapien
atcatcctttcaacagcctctttag

SEQ ID NO: 302072 - DNA, 25 bp, Homo sapien
catcctttcaacagcctctttaggc

SEQ ID NO: 302073 - DNA, 25 bp, Homo sapien
tttcaacagcctctttaggcccggc

SEQ ID NO: 302074 - DNA, 25 bp, Homo sapien
tctccaggaccaaaacatccttaag

SEQ ID NO: 302075 - DNA, 25 bp, Homo sapien
ccaggaccaaaacatccttaagtca

SEQ ID NO: 302076 - DNA, 25 bp, Homo sapien
ttttgcctgccaatggcctctctag

SEQ ID NO: 302077 - DNA, 25 bp, Homo sapien
cacaagatccagtctccgcaagaga

SEQ ID NO: 302078 - DNA, 25 bp, Homo sapien
aggaagctctttatgccttaacggt

SEQ ID NO: 302079 - DNA, 25 bp, Homo sapien
tatgccttaacggtgctggagatgt

SEQ ID NO: 302080 - DNA, 25 bp, Homo sapien
agaagttccacagcgaggtggccaa

SEQ ID NO: 302081 - DNA, 25 bp, Homo sapien
gaggtggccaaatttcgtttcctga

SEQ ID NO: 302082 - DNA, 25 bp, Homo sapien
cgtttcctgaacgaactgatcaaag

SEQ ID NO: 302083 - DNA, 25 bp, Homo sapien
gaactgatcaaagtgttgtccccaa

SEQ ID NO: 302084 - DNA, 25 bp, Homo sapien
tcaaagtgttgtccccaaagtacct

SEQ ID NO: 302085 - DNA, 25 bp, Homo sapien
gaaatactcttcagttggacagtct

SEQ ID NO: 302086 - DNA, 25 bp, Homo sapien
agttggacagtctggtttccggaag

SEQ ID NO: 302087 - DNA, 25 bp, Homo sapien
tctggtttccggaagacatcaagat

SEQ ID NO: 302088 - DNA, 25 bp, Homo sapien
ggagaagcaccccactaaagtggaa

SEQ ID NO: 302089 - DNA, 25 bp, Homo sapien
agttgctaccttcccaggcttactg

SEQ ID NO: 302090 - DNA, 25 bp, Homo sapien
actgggcagctcttttttgagtcac

SEQ ID NO: 302091 - DNA, 25 bp, Homo sapien
gtcacgtggatacagggaccgtttt

SEQ ID NO: 302092 - DNA, 25 bp, Homo sapien
gaccgttttctgaaccccaaatcag

SEQ ID NO: 302093 - DNA, 25 bp, Homo sapien
ggcacagtgtctcacaaagacagtt

SEQ ID NO: 302094 - DNA, 25 bp, Homo sapien
aaagacagttgtaccatttccaaga

SEQ ID NO: 302095 - DNA, 25 bp, Homo sapien
tttccaagaactagacagtctggga

SEQ ID NO: 302096 - DNA, 25 bp, Homo sapien
ggaggcacagttggaatgcccagat

SEQ ID NO: 302097 - DNA, 25 bp, Homo sapien
gttggcatttccagaacatgttgat

SEQ ID NO: 302098 - DNA, 25 bp, Homo sapien
gaacatgttgatttctggacgagat

SEQ ID NO: 302099 - DNA, 25 bp, Homo sapien
gtgtgtgtcagtgctcagctaagaa

SEQ ID NO: 302100 - DNA, 25 bp, Homo sapien
gtgctcagctaagaactgtagggaa

SEQ ID NO: 302101 - DNA, 25 bp, Homo sapien
gatggatgaccttcacgcagaactc

SEQ ID NO: 302102 - DNA, 25 bp, Homo sapien
ctccttttgggatatacatgatgca

SEQ ID NO: 302103 - DNA, 25 bp, Homo sapien
acatgatgcagaaaggatcctacat

SEQ ID NO: 302104 - DNA, 25 bp, Homo sapien
gagagagacagaactctctcagctg

SEQ ID NO: 302105 - DNA, 25 bp, Homo sapien
ctctcagctgacactctcagagatt

SEQ ID NO: 302106 - DNA, 25 bp, Homo sapien
gacactctcagagattcctgatggg

SEQ ID NO: 302107 - DNA, 25 bp, Homo sapien
cttgaagtccaaaggcgtctgcatt

SEQ ID NO: 302108 - DNA, 25 bp, Homo sapien
aaaggcgtctgcattgtttcctttc

SEQ ID NO: 302109 - DNA, 25 bp, Homo sapien
cctttctttgcccatccatgaatgt

SEQ ID NO: 302110 - DNA, 25 bp, Homo sapien
gtacttgtgctgtaccaaaatggta

SEQ ID NO: 302111 - DNA, 25 bp, Homo sapien
gttacgtggatatatgggccagcct

SEQ ID NO: 302112 - DNA, 25 bp, Homo sapien
tgggccagcctggatatacaacaga

SEQ ID NO: 302113 - DNA, 25 bp, Homo sapien
gagtagtaacctgtgaaacaaacat

SEQ ID NO: 302114 - DNA, 25 bp, Homo sapien
gaatatcctcttagacattgttcct

SEQ ID NO: 302115 - DNA, 25 bp, Homo sapien
gacattgttcctcataatgcactga

SEQ ID NO: 302116 - DNA, 25 bp, Homo sapien
gttcctcataatgcactgacagaat

SEQ ID NO: 302117 - DNA, 25 bp, Homo sapien
gacagaattcacatagctcttaatg

SEQ ID NO: 302118 - DNA, 25 bp, Homo sapien
atgtacgtacgtttgacttggtctc

SEQ ID NO: 302119 - DNA, 25 bp, Homo sapien
ttgacttggtctcgctgtcggttaa

SEQ ID NO: 302120 - DNA, 25 bp, Homo sapien
gtctcgctgtcggttaactgtaaag

SEQ ID NO: 302121 - DNA, 25 bp, Homo sapien
gatgctctagaaagatcctagttgc

SEQ ID NO: 302122 - DNA, 25 bp, Homo sapien
gatcctagttgcctttgtgtatatt

SEQ ID NO: 302123 - DNA, 25 bp, Homo sapien
gtgtatatttactgcctgcttgagt

SEQ ID NO: 302124 - DNA, 25 bp, Homo sapien
tactgcctgcttgagtgtttctatg

SEQ ID NO: 302125 - DNA, 25 bp, Homo sapien
tgagtgtttctatgtgtgggttttc

SEQ ID NO: 302126 - DNA, 25 bp, Homo sapien
ttttccctgtatcttgtagaaatgt

SEQ ID NO: 302127 - DNA, 25 bp, Homo sapien
gtgttttcctctgccatatggctcg

SEQ ID NO: 302128 - DNA, 25 bp, Homo sapien
ggctcgtggcctgcgagccaactat

SEQ ID NO: 302129 - DNA, 25 bp, Homo sapien
gcgagccaactatttcagctgtatt

SEQ ID NO: 302130 - DNA, 25 bp, Homo sapien
atttcagctgtattttaccttcatt

SEQ ID NO: 302131 - DNA, 25 bp, Homo sapien
tgtagtgaattccacagtagttttc

SEQ ID NO: 302132 - DNA, 25 bp, Homo sapien
cctactggctatctaagaagaatgg

SEQ ID NO: 302133 - DNA, 25 bp, Homo sapien
tttgagctgtgatagattatagtct

SEQ ID NO: 302134 - DNA, 25 bp, Homo sapien
agtctagtttaagttgctcctaagt

SEQ ID NO: 302135 - DNA, 25 bp, Homo sapien
tagtttaagttgctcctaagtagac

SEQ ID NO: 302136 - DNA, 25 bp, Homo sapien
gtttaagttgctcctaagtagacag

SEQ ID NO: 302137 - DNA, 25 bp, Homo sapien
taagttgctcctaagtagacagatg

SEQ ID NO: 302138 - DNA, 25 bp, Homo sapien
gttgctcctaagtagacagatgaag

SEQ ID NO: 302139 - DNA, 25 bp, Homo sapien
gctcctaagtagacagatgaagaaa

SEQ ID NO: 302140 - DNA, 25 bp, Homo sapien
tttaaaataggagggccccagatct

SEQ ID NO: 302141 - DNA, 25 bp, Homo sapien
cagatcttactttcctgtccttgag

SEQ ID NO: 302142 - DNA, 25 bp, Homo sapien
agatcttactttcctgtccttgagg

SEQ ID NO: 302143 - DNA, 25 bp, Homo sapien
agaggccgcttcagacaaccacctg

SEQ ID NO: 302144 - DNA, 25 bp, Homo sapien
acaaaagcaagcaaggtctggacag

SEQ ID NO: 302145 - DNA, 25 bp, Homo sapien
ggtctggacagctttgacacaggaa

SEQ ID NO: 302146 - DNA, 25 bp, Homo sapien
aaggagcaggagacctgttgcccaa

SEQ ID NO: 302147 - DNA, 25 bp, Homo sapien
caggagacctgttgcccaaggtaaa

SEQ ID NO: 302148 - DNA, 25 bp, Homo sapien
tgggctccctccctaaagttgagga

SEQ ID NO: 302149 - DNA, 25 bp, Homo sapien
gaggatgaattcgagcagccaacca

SEQ ID NO: 302150 - DNA, 25 bp, Homo sapien
tgaattcgagcagccaaccatgtct

SEQ ID NO: 302151 - DNA, 25 bp, Homo sapien
gccaaccatgtcttttgaatcctac

SEQ ID NO: 302152 - DNA, 25 bp, Homo sapien
atgtcttttgaatcctacctcagct

SEQ ID NO: 302153 - DNA, 25 bp, Homo sapien
ttgaatcctacctcagctatgacca

SEQ ID NO: 302154 - DNA, 25 bp, Homo sapien
gaatgttggaactgttgaatgggct

SEQ ID NO: 302155 - DNA, 25 bp, Homo sapien
gttggaactgttgaatgggctgatc

SEQ ID NO: 302156 - DNA, 25 bp, Homo sapien
ttggaactgttgaatgggctgatcc

SEQ ID NO: 302157 - DNA, 25 bp, Homo sapien
gaagatcctgatcctgaggttatgg

SEQ ID NO: 302158 - DNA, 25 bp, Homo sapien
aagatcctgatcctgaggttatggc

SEQ ID NO: 302159 - DNA, 25 bp, Homo sapien
gatcctgatcctgaggttatggcaa

SEQ ID NO: 302160 - DNA, 25 bp, Homo sapien
atcctgatcctgaggttatggcaaa

SEQ ID NO: 302161 - DNA, 25 bp, Homo sapien
tcctgatcctgaggttatggcaaag

SEQ ID NO: 302162 - DNA, 25 bp, Homo sapien
ctgatcctgaggttatggcaaaggt

SEQ ID NO: 302163 - DNA, 25 bp, Homo sapien
gatcctgaggttatggcaaaggtaa

SEQ ID NO: 302164 - DNA, 25 bp, Homo sapien
gttatggcaaaggtaaaagtgctgt

SEQ ID NO: 302165 - DNA, 25 bp, Homo sapien
gatgatgctcattgattcctgacca

SEQ ID NO: 302166 - DNA, 25 bp, Homo sapien
ttgattcctgaccatagcagtgaga

SEQ ID NO: 302167 - DNA, 25 bp, Homo sapien
gagaggccattttttgtgcaggaaa

SEQ ID NO: 302168 - DNA, 25 bp, Homo sapien
gaaatgtgcttaggactcagtcttg

SEQ ID NO: 302169 - DNA, 25 bp, Homo sapien
cagtcttgttttcgattatccacca

SEQ ID NO: 302170 - DNA, 25 bp, Homo sapien
attatccaccacagaaaccctgaga

SEQ ID NO: 302171 - DNA, 25 bp, Homo sapien
ttagaagtctctacccaggcgtaaa

SEQ ID NO: 302172 - DNA, 25 bp, Homo sapien
aggcgtaaatagagctccctactcc

SEQ ID NO: 302173 - DNA, 25 bp, Homo sapien
gagaacacaagctccagctgggctg

SEQ ID NO: 302174 - DNA, 25 bp, Homo sapien
tgcagggtgactttggcgaagtttt

SEQ ID NO: 302175 - DNA, 25 bp, Homo sapien
ggcgaagttttgtcagatccataaa

SEQ ID NO: 302176 - DNA, 25 bp, Homo sapien
cacactgacttccattttaagcttt

SEQ ID NO: 302177 - DNA, 25 bp, Homo sapien
tccattttaagctttctaccttctt

SEQ ID NO: 302178 - DNA, 25 bp, Homo sapien
atccagtgagaagacctgctcctca

SEQ ID NO: 302179 - DNA, 25 bp, Homo sapien
cctgctcctcagtcttgtaaatgta

SEQ ID NO: 302180 - DNA, 25 bp, Homo sapien
ggtaggagcagagccactatctcca

SEQ ID NO: 302181 - DNA, 25 bp, Homo sapien
agagccactatctccattgaagctg

SEQ ID NO: 302182 - DNA, 25 bp, Homo sapien
attgaagctgaaatggtagacctgt

SEQ ID NO: 302183 - DNA, 25 bp, Homo sapien
gtagacctgtaattgtgggaaaact

SEQ ID NO: 302184 - DNA, 25 bp, Homo sapien
atatatataatactttgtccttcat

SEQ ID NO: 302185 - DNA, 25 bp, Homo sapien
catatgtgaaagatccagtgttgga

SEQ ID NO: 302186 - DNA, 25 bp, Homo sapien
cagtgttggaattctttggtgtaaa

SEQ ID NO: 302187 - DNA, 25 bp, Homo sapien
aaccaagtgggtttctactagatcg

SEQ ID NO: 302188 - DNA, 25 bp, Homo sapien
tagatcggtgttccttgacagccaa

SEQ ID NO: 302189 - DNA, 25 bp, Homo sapien
aagggagctgacactgccctcctaa

SEQ ID NO: 302190 - DNA, 25 bp, Homo sapien
tgccctcctaagttctgatcttgct

SEQ ID NO: 302191 - DNA, 25 bp, Homo sapien
tgatcttgctcctgttcaactggaa

SEQ ID NO: 302192 - DNA, 25 bp, Homo sapien
ttgatggatcccatgtggtttcccc

SEQ ID NO: 302193 - DNA, 25 bp, Homo sapien
atcctgacgctgtggctcagacact

SEQ ID NO: 302194 - DNA, 25 bp, Homo sapien
agacactctccctaagctggtcctt

SEQ ID NO: 302195 - DNA, 25 bp, Homo sapien
aatcctgccttaaacacactcagaa

SEQ ID NO: 302196 - DNA, 25 bp, Homo sapien
gccaacagttgtgttcttccaatca

SEQ ID NO: 302197 - DNA, 25 bp, Homo sapien
caatcacatgatcttaccttttcaa

SEQ ID NO: 302198 - DNA, 25 bp, Homo sapien
ggcgctacggcgacgttttccagat

SEQ ID NO: 302199 - DNA, 25 bp, Homo sapien
acgttttccagatccgcctgggcag

SEQ ID NO: 302200 - DNA, 25 bp, Homo sapien
gcagctgccccatagtggtgctgaa

SEQ ID NO: 302201 - DNA, 25 bp, Homo sapien
gccccatagtggtgctgaatggcga

SEQ ID NO: 302202 - DNA, 25 bp, Homo sapien
tgctgaatggcgagcgcgccatcca

SEQ ID NO: 302203 - DNA, 25 bp, Homo sapien
actcctgtcggtgctggccactgtg

SEQ ID NO: 302204 - DNA, 25 bp, Homo sapien
cctgtcggtgctggccactgtgcat

SEQ ID NO: 302205 - DNA, 25 bp, Homo sapien
ctgaggcaacggaggcggcagctcc

SEQ ID NO: 302206 - DNA, 25 bp, Homo sapien
gtttgcgtggccactgatcggaaac

SEQ ID NO: 302207 - DNA, 25 bp, Homo sapien
cgtggccactgatcggaaacgcggc

SEQ ID NO: 302208 - DNA, 25 bp, Homo sapien
tgggccaggcggctcacctctcgtt

SEQ ID NO: 302209 - DNA, 25 bp, Homo sapien
gattatgtttgcactggattgtgat

SEQ ID NO: 302210 - DNA, 25 bp, Homo sapien
gattgtgatttgaacaggacactta

SEQ ID NO: 302211 - DNA, 25 bp, Homo sapien
aatcaagacttcataccctatcctt

SEQ ID NO: 302212 - DNA, 25 bp, Homo sapien
ataccctatccttgtagctcggaaa

SEQ ID NO: 302213 - DNA, 25 bp, Homo sapien
gaaattgaggtgtagcttaggctga

SEQ ID NO: 302214 - DNA, 25 bp, Homo sapien
ctgatgcggagagctgcagacagct

SEQ ID NO: 302215 - DNA, 25 bp, Homo sapien
agctgcagacagctggacctcctta

SEQ ID NO: 302216 - DNA, 25 bp, Homo sapien
acccatcagaccttggaataaaccg

SEQ ID NO: 302217 - DNA, 25 bp, Homo sapien
tgcagaggactctgaggtgccaccc

SEQ ID NO: 302218 - DNA, 25 bp, Homo sapien
tgaggtgccacccaagagcctttta

SEQ ID NO: 302219 - DNA, 25 bp, Homo sapien
tgctacttaagagtcactgcagaag

SEQ ID NO: 302220 - DNA, 25 bp, Homo sapien
cttaccatactagaaattaaagcga

SEQ ID NO: 302221 - DNA, 25 bp, Homo sapien
ttaccatactagaaattaaagcgaa

SEQ ID NO: 302222 - DNA, 25 bp, Homo sapien
taccatactagaaattaaagcgaat

SEQ ID NO: 302223 - DNA, 25 bp, Homo sapien
ccatactagaaattaaagcgaatac

SEQ ID NO: 302224 - DNA, 25 bp, Homo sapien
tactagaaattaaagcgaatacatt

SEQ ID NO: 302225 - DNA, 25 bp, Homo sapien
tttttggtctcagaccccactctta

SEQ ID NO: 302226 - DNA, 25 bp, Homo sapien
ttttggtctcagaccccactcttag

SEQ ID NO: 302227 - DNA, 25 bp, Homo sapien
tttggtctcagaccccactcttaga

SEQ ID NO: 302228 - DNA, 25 bp, Homo sapien
ggtctcagaccccactcttagaaat

SEQ ID NO: 302229 - DNA, 25 bp, Homo sapien
gtctcagaccccactcttagaaatt

SEQ ID NO: 302230 - DNA, 25 bp, Homo sapien
tctcagaccccactcttagaaattg

SEQ ID NO: 302231 - DNA, 25 bp, Homo sapien
atggtcacagttggtcgctgggcaa

SEQ ID NO: 302232 - DNA, 25 bp, Homo sapien
aacagctagcactatcatgagttac

SEQ ID NO: 302233 - DNA, 25 bp, Homo sapien
gttactacctcattgttactttcta

SEQ ID NO: 302234 - DNA, 25 bp, Homo sapien
tgttactttctaaaccaggcccgct

SEQ ID NO: 302235 - DNA, 25 bp, Homo sapien
aggcccgcttcacgagttagagttg

SEQ ID NO: 302236 - DNA, 25 bp, Homo sapien
gagttagagttgagctcccctgtag

SEQ ID NO: 302237 - DNA, 25 bp, Homo sapien
ctgtagccaggactatgctgtagat

SEQ ID NO: 302238 - DNA, 25 bp, Homo sapien
atcagtatgatctgggtgtggccaa

SEQ ID NO: 302239 - DNA, 25 bp, Homo sapien
tgggtgtggccaaaaacaattttct

SEQ ID NO: 302240 - DNA, 25 bp, Homo sapien
aacaattttctttattctgtctatc

SEQ ID NO: 302241 - DNA, 25 bp, Homo sapien
aaatagtacttctaccactgtttgg

SEQ ID NO: 302242 - DNA, 25 bp, Homo sapien
actcctgaggagaagtctgccgtta

SEQ ID NO: 302243 - DNA, 25 bp, Homo sapien
ctcctgaggagaagtctgccgttac

SEQ ID NO: 302244 - DNA, 25 bp, Homo sapien
tcctgaggagaagtctgccgttact

SEQ ID NO: 302245 - DNA, 25 bp, Homo sapien
cctgaggagaagtctgccgttactg

SEQ ID NO: 302246 - DNA, 25 bp, Homo sapien
ctgaggagaagtctgccgttactgc

SEQ ID NO: 302247 - DNA, 25 bp, Homo sapien
tgaggagaagtctgccgttactgcc

SEQ ID NO: 302248 - DNA, 25 bp, Homo sapien
gaggagaagtctgccgttactgccc

SEQ ID NO: 302249 - DNA, 25 bp, Homo sapien
gagaagtctgccgttactgccctgt

SEQ ID NO: 302250 - DNA, 25 bp, Homo sapien
agaagtctgccgttactgccctgtg

SEQ ID NO: 302251 - DNA, 25 bp, Homo sapien
gaagtctgccgttactgccctgtgg

SEQ ID NO: 302252 - DNA, 25 bp, Homo sapien
aagtctgccgttactgccctgtggg

SEQ ID NO: 302253 - DNA, 25 bp, Homo sapien
aaattaatcattgcagggtgtgagc

SEQ ID NO: 302254 - DNA, 25 bp, Homo sapien
gccctgagcccaaatccagaaagca

SEQ ID NO: 302255 - DNA, 25 bp, Homo sapien
gcagggcacaaccaagagagctaaa

SEQ ID NO: 302256 - DNA, 25 bp, Homo sapien
caagagagctaaagacccctgggta

SEQ ID NO: 302257 - DNA, 25 bp, Homo sapien
caagtccttccctgacgcagacttg

SEQ ID NO: 302258 - DNA, 25 bp, Homo sapien
tgacgcagacttgctggacaaccag

SEQ ID NO: 302259 - DNA, 25 bp, Homo sapien
gctggacaaccaggtgcgtcaacat

SEQ ID NO: 302260 - DNA, 25 bp, Homo sapien
aggtgcgtcaacatgcaggtacagg

SEQ ID NO: 302261 - DNA, 25 bp, Homo sapien
gtttgaccaactatctgggtactaa

SEQ ID NO: 302262 - DNA, 25 bp, Homo sapien
ggtactaaagcccagccaagttggc

SEQ ID NO: 302263 - DNA, 25 bp, Homo sapien
agccaagttggcacatcaaattaat

SEQ ID NO: 302264 - DNA, 25 bp, Homo sapien
tgcatttctcctactgggccagcta

SEQ ID NO: 302265 - DNA, 25 bp, Homo sapien
gggccagctattccacttagcttgg

SEQ ID NO: 302266 - DNA, 25 bp, Homo sapien
ggtatccattttttgctacttctga

SEQ ID NO: 302267 - DNA, 25 bp, Homo sapien
cttccaggcctaccaatagcagaat

SEQ ID NO: 302268 - DNA, 25 bp, Homo sapien
atagcagaatcaatccatctgtccc

SEQ ID NO: 302269 - DNA, 25 bp, Homo sapien
atctgtccctgagatactcatgttg

SEQ ID NO: 302270 - DNA, 25 bp, Homo sapien
atgttgtttcaaatgcctcctccca

SEQ ID NO: 302271 - DNA, 25 bp, Homo sapien
ttctggcatagtctcattctctgta

SEQ ID NO: 302272 - DNA, 25 bp, Homo sapien
attctctgtatgttatgccctatcc

SEQ ID NO: 302273 - DNA, 25 bp, Homo sapien
tgttatgccctatccacatggaatc

SEQ ID NO: 302274 - DNA, 25 bp, Homo sapien
tatcgtcctctgtaataaactggcc

SEQ ID NO: 302275 - DNA, 25 bp, Homo sapien
tctcagctaagccagctgccgggaa

SEQ ID NO: 302276 - DNA, 25 bp, Homo sapien
agctaagccagctgccgggaaggcc

SEQ ID NO: 302277 - DNA, 25 bp, Homo sapien
ccgttcggcggcattttctcttcaa

SEQ ID NO: 302278 - DNA, 25 bp, Homo sapien
gcttttcccgtaggaagaaccgatg

SEQ ID NO: 302279 - DNA, 25 bp, Homo sapien
gaaccgatgatgagccctgatgaaa

SEQ ID NO: 302280 - DNA, 25 bp, Homo sapien
ccgctgtctgcgaaggcctaaaggt

SEQ ID NO: 302281 - DNA, 25 bp, Homo sapien
gcctaaaggttagaaatacagcaat

SEQ ID NO: 302282 - DNA, 25 bp, Homo sapien
aaacccgcccggtcggatgtggcat

SEQ ID NO: 302283 - DNA, 25 bp, Homo sapien
cccggtcggatgtggcatttgaaga

SEQ ID NO: 302284 - DNA, 25 bp, Homo sapien
aagaaggcgtgggtcaataatcaac

SEQ ID NO: 302285 - DNA, 25 bp, Homo sapien
ggtcaataatcaacccgcactttct

SEQ ID NO: 302286 - DNA, 25 bp, Homo sapien
atgacctacaccaggattccccagg

SEQ ID NO: 302287 - DNA, 25 bp, Homo sapien
acagtgggcctgtgctttaacggca

SEQ ID NO: 302288 - DNA, 25 bp, Homo sapien
taacggcagtgccttcgtcttgtac

SEQ ID NO: 302289 - DNA, 25 bp, Homo sapien
ttgtacctctctgccgctgttgtag

SEQ ID NO: 302290 - DNA, 25 bp, Homo sapien
tgttgtagatgcatcttccgtctcc

SEQ ID NO: 302291 - DNA, 25 bp, Homo sapien
agtcacaacttcaacagctgggcgg

SEQ ID NO: 302292 - DNA, 25 bp, Homo sapien
gggcggcctcatcgttctttgcctt

SEQ ID NO: 302293 - DNA, 25 bp, Homo sapien
gtcaccatctgctacgctggaaata

SEQ ID NO: 302294 - DNA, 25 bp, Homo sapien
ttcagttttatagcatggagatcca

SEQ ID NO: 302295 - DNA, 25 bp, Homo sapien
ggaccatacagtgatttaccatttt

SEQ ID NO: 302296 - DNA, 25 bp, Homo sapien
aggaagactctcactgtaaaaacag

SEQ ID NO: 302297 - DNA, 25 bp, Homo sapien
agcagacacagaggtgcaggcacca

SEQ ID NO: 302298 - DNA, 25 bp, Homo sapien
aggcaccaggattctccacttcttc

SEQ ID NO: 302299 - DNA, 25 bp, Homo sapien
cctgctgggccacagttctaactgc

SEQ ID NO: 302300 - DNA, 25 bp, Homo sapien
aggccctggttcttgctatttcctg

SEQ ID NO: 302301 - DNA, 25 bp, Homo sapien
ttgctatttcctggtccccaacgtt

SEQ ID NO: 302302 - DNA, 25 bp, Homo sapien
gtccccaacgtttatctagcttgtt

SEQ ID NO: 302303 - DNA, 25 bp, Homo sapien
gtttatctagcttgtttgccctttc

SEQ ID NO: 302304 - DNA, 25 bp, Homo sapien
cagttgcacctactaactgcagtcc

SEQ ID NO: 302305 - DNA, 25 bp, Homo sapien
catgcaggagatgccctggccagta

SEQ ID NO: 302306 - DNA, 25 bp, Homo sapien
tggccagtaggacctccaacaggtt

SEQ ID NO: 302307 - DNA, 25 bp, Homo sapien
gacctccaacaggttgtttcccagg

SEQ ID NO: 302308 - DNA, 25 bp, Homo sapien
acttcattttcttagcgtttctgga

SEQ ID NO: 302309 - DNA, 25 bp, Homo sapien
tagcgtttctggagattacaacatc

SEQ ID NO: 302310 - DNA, 25 bp, Homo sapien
attacaacatcctgcggttccgttt

SEQ ID NO: 302311 - DNA, 25 bp, Homo sapien
acatcctgcggttccgtttctggga

SEQ ID NO: 302312 - DNA, 25 bp, Homo sapien
tccgtttctgggaactttactgatt

SEQ ID NO: 302313 - DNA, 25 bp, Homo sapien
ataagcattgattcctgcatttctg

SEQ ID NO: 302314 - DNA, 25 bp, Homo sapien
gatctcaagatctggactactgttg

SEQ ID NO: 302315 - DNA, 25 bp, Homo sapien
cagtgaggctcacttatgtctgtaa

SEQ ID NO: 302316 - DNA, 25 bp, Homo sapien
gaacattgttctactaaaaggatta

SEQ ID NO: 302317 - DNA, 25 bp, Homo sapien
tcattttagaatggttaagtcctta

SEQ ID NO: 302318 - DNA, 25 bp, Homo sapien
ttttccttgttatctttgcagatac

SEQ ID NO: 302319 - DNA, 25 bp, Homo sapien
tggtgacaccaggtctgtccactag

SEQ ID NO: 302320 - DNA, 25 bp, Homo sapien
gtctgtccactagtctgggcgggac

SEQ ID NO: 302321 - DNA, 25 bp, Homo sapien
tgacgtgcatggagctgggtcccca

SEQ ID NO: 302322 - DNA, 25 bp, Homo sapien
cccacggcaacgagggcacacggag

SEQ ID NO: 302323 - DNA, 25 bp, Homo sapien
acggaggcctccacggagcacagag

SEQ ID NO: 302324 - DNA, 25 bp, Homo sapien
tccacggagcacagagagcaagcaa

SEQ ID NO: 302325 - DNA, 25 bp, Homo sapien
gagagcaagcaaagcgaccctgaat

SEQ ID NO: 302326 - DNA, 25 bp, Homo sapien
aaagcgaccctgaattcctttgtgt

SEQ ID NO: 302327 - DNA, 25 bp, Homo sapien
gaccctgaattcctttgtgtttgtt

SEQ ID NO: 302328 - DNA, 25 bp, Homo sapien
tgtgtttgttactggttttgttctt

SEQ ID NO: 302329 - DNA, 25 bp, Homo sapien
atgctgcaaggtttccgccaaaaaa

SEQ ID NO: 302330 - DNA, 25 bp, Homo sapien
cttcagtgttggaaatggttctgtc

SEQ ID NO: 302331 - DNA, 25 bp, Homo sapien
tggaaatggttctgtctgtgctgtc

SEQ ID NO: 302332 - DNA, 25 bp, Homo sapien
ggaaatggttctgtctgtgctgtcc

SEQ ID NO: 302333 - DNA, 25 bp, Homo sapien
tgtccagcatagcagccacaagcca

SEQ ID NO: 302334 - DNA, 25 bp, Homo sapien
ccacaagccacatgtaactgagtct

SEQ ID NO: 302335 - DNA, 25 bp, Homo sapien
aagccacatgtaactgagtctttga

SEQ ID NO: 302336 - DNA, 25 bp, Homo sapien
gccacatgtaactgagtctttgaaa

SEQ ID NO: 302337 - DNA, 25 bp, Homo sapien
aaatgtagctagtggactgaggaac

SEQ ID NO: 302338 - DNA, 25 bp, Homo sapien
gctagtggactgaggaacaacagtt

SEQ ID NO: 302339 - DNA, 25 bp, Homo sapien
aacctccgccttgctggttgagatg

SEQ ID NO: 302340 - DNA, 25 bp, Homo sapien
ttgctggttgagatggattctcgct

SEQ ID NO: 302341 - DNA, 25 bp, Homo sapien
gaaagcagtttaaccacaaacagtg

SEQ ID NO: 302342 - DNA, 25 bp, Homo sapien
aaacagagctggcagacgcctgaaa

SEQ ID NO: 302343 - DNA, 25 bp, Homo sapien
agacgcctgaaactccatggaacca

SEQ ID NO: 302344 - DNA, 25 bp, Homo sapien
atggaaccatgcagctgtaccctag

SEQ ID NO: 302345 - DNA, 25 bp, Homo sapien
catgcagctgtaccctagggctcct

SEQ ID NO: 302346 - DNA, 25 bp, Homo sapien
tagggctcctcccaggaaaagagag

SEQ ID NO: 302347 - DNA, 25 bp, Homo sapien
aaagagagatgtcaacgtggcccaa

SEQ ID NO: 302348 - DNA, 25 bp, Homo sapien
agatgtcaacgtggcccaaggtgtc

SEQ ID NO: 302349 - DNA, 25 bp, Homo sapien
caaggtgtcctgaagcactgggatt

SEQ ID NO: 302350 - DNA, 25 bp, Homo sapien
aagcactgggattggattaactcga

SEQ ID NO: 302351 - DNA, 25 bp, Homo sapien
attaactcgagcgatggccttccca

SEQ ID NO: 302352 - DNA, 25 bp, Homo sapien
gtacagtttatattctgtcacagga

SEQ ID NO: 302353 - DNA, 25 bp, Homo sapien
taattgccggttttcatactctaga

SEQ ID NO: 302354 - DNA, 25 bp, Homo sapien
cggttttcatactctagaaggctga

SEQ ID NO: 302355 - DNA, 25 bp, Homo sapien
cattgacaaatttacccaccatctg

SEQ ID NO: 302356 - DNA, 25 bp, Homo sapien
ttacccaccatctgtggtttttcag

SEQ ID NO: 302357 - DNA, 25 bp, Homo sapien
gatatcgatcttacacattctgtgt

SEQ ID NO: 302358 - DNA, 25 bp, Homo sapien
acacattctgtgtataaagacctta

SEQ ID NO: 302359 - DNA, 25 bp, Homo sapien
taaagaccttaactccacaggacgg

SEQ ID NO: 302360 - DNA, 25 bp, Homo sapien
ccacaggacggacattttagagttt

SEQ ID NO: 302361 - DNA, 25 bp, Homo sapien
attaaggctatcattcttttagtaa

SEQ ID NO: 302362 - DNA, 25 bp, Homo sapien
aaagcctaattttaaagtgctgcct

SEQ ID NO: 302363 - DNA, 25 bp, Homo sapien
tccaaactgctgacgcgactctcac

SEQ ID NO: 302364 - DNA, 25 bp, Homo sapien
tctcagctaagccagctgccgggaa

SEQ ID NO: 302365 - DNA, 25 bp, Homo sapien
agctaagccagctgccgggaaggcc

SEQ ID NO: 302366 - DNA, 25 bp, Homo sapien
ccgttcggcggcattttctcttcaa

SEQ ID NO: 302367 - DNA, 25 bp, Homo sapien
gcctaaaggttagaaatacagcaat

SEQ ID NO: 302368 - DNA, 25 bp, Homo sapien
aaacccgcccggtcggatgtggcat

SEQ ID NO: 302369 - DNA, 25 bp, Homo sapien
cgcccggtcggatgtggcatttgaa

SEQ ID NO: 302370 - DNA, 25 bp, Homo sapien
ccggtcggatgtggcatttgaagaa

SEQ ID NO: 302371 - DNA, 25 bp, Homo sapien
aagaaggcgtgggtcaataatcaac

SEQ ID NO: 302372 - DNA, 25 bp, Homo sapien
gtgggtcaataatcaacccgcactt

SEQ ID NO: 302373 - DNA, 25 bp, Homo sapien
gtcaataatcaacccgcactttctc

SEQ ID NO: 302374 - DNA, 25 bp, Homo sapien
gctccccaaagcctgctgaagcatg

SEQ ID NO: 302375 - DNA, 25 bp, Homo sapien
caaagcctgctgaagcatggagtgt

SEQ ID NO: 302376 - DNA, 25 bp, Homo sapien
catggagtgttgatgctttcgtctc

SEQ ID NO: 302377 - DNA, 25 bp, Homo sapien
agtgttgatgctttcgtctccagcc

SEQ ID NO: 302378 - DNA, 25 bp, Homo sapien
cttctcagaatctacccaaaggata

SEQ ID NO: 302379 - DNA, 25 bp, Homo sapien
gaatctacccaaaggatactgtaac

SEQ ID NO: 302380 - DNA, 25 bp, Homo sapien
acactttacaatgttcatcccatga

SEQ ID NO: 302381 - DNA, 25 bp, Homo sapien
tcatcccatgatgtagtgcctcttt

SEQ ID NO: 302382 - DNA, 25 bp, Homo sapien
atgatgtagtgcctctttcatccac

SEQ ID NO: 302383 - DNA, 25 bp, Homo sapien
tgcctctttcatccactagtgcaaa

SEQ ID NO: 302384 - DNA, 25 bp, Homo sapien
ctttcatccactagtgcaaatcata

SEQ ID NO: 302385 - DNA, 25 bp, Homo sapien
ttttttctgtgctacactacataca

SEQ ID NO: 302386 - DNA, 25 bp, Homo sapien
gctacactacatacaaatcaccaaa

SEQ ID NO: 302387 - DNA, 25 bp, Homo sapien
cccttttgtgatccttggtgtactg

SEQ ID NO: 302388 - DNA, 25 bp, Homo sapien
ttttgtgatccttggtgtactgagc

SEQ ID NO: 302389 - DNA, 25 bp, Homo sapien
gtgatccttggtgtactgagcagtt

SEQ ID NO: 302390 - DNA, 25 bp, Homo sapien
gatccttggtgtactgagcagtttc

SEQ ID NO: 302391 - DNA, 25 bp, Homo sapien
ttggtgtactgagcagtttctttgg

SEQ ID NO: 302392 - DNA, 25 bp, Homo sapien
aggagcaaggtgtcatcctgctctt

SEQ ID NO: 302393 - DNA, 25 bp, Homo sapien
gagcaaggtgtcatcctgctcttca

SEQ ID NO: 302394 - DNA, 25 bp, Homo sapien
gtggtaactaccgagatgaatattt

SEQ ID NO: 302395 - DNA, 25 bp, Homo sapien
aactaccgagatgaatattttaatt

SEQ ID NO: 302396 - DNA, 25 bp, Homo sapien
ggccgaaattactccattgtatgat

SEQ ID NO: 302397 - DNA, 25 bp, Homo sapien
tatgatatgccatgtttctttatcc

SEQ ID NO: 302398 - DNA, 25 bp, Homo sapien
atggacatctaggttctgttcattt

SEQ ID NO: 302399 - DNA, 25 bp, Homo sapien
catctaggttctgttcatttttgtc

SEQ ID NO: 302400 - DNA, 25 bp, Homo sapien
atgctaccatgatcatttgtgtaca

SEQ ID NO: 302401 - DNA, 25 bp, Homo sapien
gatgtttttgattctcttgggtgga

SEQ ID NO: 302402 - DNA, 25 bp, Homo sapien
gctggtcaaatggtaagtctatgtt

SEQ ID NO: 302403 - DNA, 25 bp, Homo sapien
gatggtgaacttttgtagaatgaga

SEQ ID NO: 302404 - DNA, 25 bp, Homo sapien
gaatgagatagtcgaagctaaaact

SEQ ID NO: 302405 - DNA, 25 bp, Homo sapien
gctaaaactggagtatggcatctga

SEQ ID NO: 302406 - DNA, 25 bp, Homo sapien
ggcatctgaaggtaaatggctcatc

SEQ ID NO: 302407 - DNA, 25 bp, Homo sapien
ttagccatgggagcaataatgtcac

SEQ ID NO: 302408 - DNA, 25 bp, Homo sapien
tagccatgggagcaataatgtcacc

SEQ ID NO: 302409 - DNA, 25 bp, Homo sapien
agcaataatgtcaccacacacactt

SEQ ID NO: 302410 - DNA, 25 bp, Homo sapien
cacacacacttcatgaagcctctgg

SEQ ID NO: 302411 - DNA, 25 bp, Homo sapien
acacacttcatgaagcctctggaaa

SEQ ID NO: 302412 - DNA, 25 bp, Homo sapien
actctacagtatacttgtgagagaa

SEQ ID NO: 302413 - DNA, 25 bp, Homo sapien
cagtatacttgtgagagaatgagag

SEQ ID NO: 302414 - DNA, 25 bp, Homo sapien
gaaagggacaaataacatctgtgta

SEQ ID NO: 302415 - DNA, 25 bp, Homo sapien
ggacaaataacatctgtgtagcagt

SEQ ID NO: 302416 - DNA, 25 bp, Homo sapien
acaaataacatctgtgtagcagtat

SEQ ID NO: 302417 - DNA, 25 bp, Homo sapien
tctcagaccccactcttagaaattg

SEQ ID NO: 302418 - DNA, 25 bp, Homo sapien
atacccctggccagccgagagacga

SEQ ID NO: 302419 - DNA, 25 bp, Homo sapien
agacgacccgccttgtctgctatga

SEQ ID NO: 302420 - DNA, 25 bp, Homo sapien
gccttgtctgctatgatctctttca

SEQ ID NO: 302421 - DNA, 25 bp, Homo sapien
tctgctatgatctctttcactgggc

SEQ ID NO: 302422 - DNA, 25 bp, Homo sapien
tatgatctctttcactgggcctgcc

SEQ ID NO: 302423 - DNA, 25 bp, Homo sapien
tgggcctgcctcaatgaacgtgctg

SEQ ID NO: 302424 - DNA, 25 bp, Homo sapien
tcaatgaacgtgctgcccagctacc

SEQ ID NO: 302425 - DNA, 25 bp, Homo sapien
aaacacggcacctgccggctatcag

SEQ ID NO: 302426 - DNA, 25 bp, Homo sapien
tatcagtgccccagctgcaatggcc

SEQ ID NO: 302427 - DNA, 25 bp, Homo sapien
gggcctccctctgatcgatgaggtg

SEQ ID NO: 302428 - DNA, 25 bp, Homo sapien
tctgatcgatgaggtggtgagccca

SEQ ID NO: 302429 - DNA, 25 bp, Homo sapien
tcaagacaaatgcttgacccacggg

SEQ ID NO: 302430 - DNA, 25 bp, Homo sapien
aatgcttgacccacggggactccag

SEQ ID NO: 302431 - DNA, 25 bp, Homo sapien
cctgcagccactctggtggacttgg

SEQ ID NO: 302432 - DNA, 25 bp, Homo sapien
ccactctggtggacttggctttggg

SEQ ID NO: 302433 - DNA, 25 bp, Homo sapien
tggtggacttggctttgggtctggg

SEQ ID NO: 302434 - DNA, 25 bp, Homo sapien
gtcttagtgtcttaggcttgaggga

SEQ ID NO: 302435 - DNA, 25 bp, Homo sapien
cttagtgtcttaggcttgagggaga

SEQ ID NO: 302436 - DNA, 25 bp, Homo sapien
tgttgtttatttccacctgccagct

SEQ ID NO: 302437 - DNA, 25 bp, Homo sapien
gtttatttccacctgccagctcctt

SEQ ID NO: 302438 - DNA, 25 bp, Homo sapien
gagacccgggaggaaagcaagtcaa

SEQ ID NO: 302439 - DNA, 25 bp, Homo sapien
ccgggaggaaagcaagtcaagacaa

SEQ ID NO: 302440 - DNA, 25 bp, Homo sapien
gattctctgtcatgtgagtgagcaa

SEQ ID NO: 302441 - DNA, 25 bp, Homo sapien
atgtgagtgagcaaccttgccgtca

SEQ ID NO: 302442 - DNA, 25 bp, Homo sapien
gtgagcaaccttgccgtcagctttg

SEQ ID NO: 302443 - DNA, 25 bp, Homo sapien
cgtgtgccgaggagcctgggttctc

SEQ ID NO: 302444 - DNA, 25 bp, Homo sapien
ctcggcggatcttcctctgcatgtt

SEQ ID NO: 302445 - DNA, 25 bp, Homo sapien
gatcttcctctgcatgttccgagga

SEQ ID NO: 302446 - DNA, 25 bp, Homo sapien
ttcctctgcatgttccgaggagcct

SEQ ID NO: 302447 - DNA, 25 bp, Homo sapien
cagactggttcaaggtaagtgacct

SEQ ID NO: 302448 - DNA, 25 bp, Homo sapien
aggtaagtgacctcccaatcggcta

SEQ ID NO: 302449 - DNA, 25 bp, Homo sapien
aatcggctacctaatacctgatctt

SEQ ID NO: 302450 - DNA, 25 bp, Homo sapien
tacctaatacctgatcttcccagaa

SEQ ID NO: 302451 - DNA, 25 bp, Homo sapien
agcctgttccactgacatttcttag

SEQ ID NO: 302452 - DNA, 25 bp, Homo sapien
gttccactgacatttcttagacatt

SEQ ID NO: 302453 - DNA, 25 bp, Homo sapien
tttcttagacattcagcaaaacccc

SEQ ID NO: 302454 - DNA, 25 bp, Homo sapien
ttttctttcttgagggttggtcctg

SEQ ID NO: 302455 - DNA, 25 bp, Homo sapien
ttgagggttggtcctgtccccacct

SEQ ID NO: 302456 - DNA, 25 bp, Homo sapien
ccgggcatcagtggctagtccaaat

SEQ ID NO: 302457 - DNA, 25 bp, Homo sapien
ggcatcagtggctagtccaaataaa

SEQ ID NO: 302458 - DNA, 25 bp, Homo sapien
gttcacagagtgtagttagatccca

SEQ ID NO: 302459 - DNA, 25 bp, Homo sapien
agtgtagttagatcccaactcccat

SEQ ID NO: 302460 - DNA, 25 bp, Homo sapien
gtagttagatcccaactcccatgac

SEQ ID NO: 302461 - DNA, 25 bp, Homo sapien
tcccatgacctctggcttcagtggt

SEQ ID NO: 302462 - DNA, 25 bp, Homo sapien
ggaatccttagcgatgagatctact

SEQ ID NO: 302463 - DNA, 25 bp, Homo sapien
tccttagcgatgagatctactgccc

SEQ ID NO: 302464 - DNA, 25 bp, Homo sapien
gggactacaacaaagaagtgcacaa

SEQ ID NO: 302465 - DNA, 25 bp, Homo sapien
gaagtgcacaagtctgggtacctca

SEQ ID NO: 302466 - DNA, 25 bp, Homo sapien
aagtctgggtacctcagctctgagc

SEQ ID NO: 302467 - DNA, 25 bp, Homo sapien
ggtacctcagctctgagcggctgat

SEQ ID NO: 302468 - DNA, 25 bp, Homo sapien
agcggctgatccctcaaagagtgat

SEQ ID NO: 302469 - DNA, 25 bp, Homo sapien
gagtgatggaccagcacaaacttac

SEQ ID NO: 302470 - DNA, 25 bp, Homo sapien
cagcacaaacttaccagggaccagt

SEQ ID NO: 302471 - DNA, 25 bp, Homo sapien
tgcggaacaccgtgggatgctcaaa

SEQ ID NO: 302472 - DNA, 25 bp, Homo sapien
ggatgctcaaagataatgctatgtt

SEQ ID NO: 302473 - DNA, 25 bp, Homo sapien
tgtgttatttaagtattcacgtctt

SEQ ID NO: 302474 - DNA, 25 bp, Homo sapien
aaagacacattttatcagtaacaat

SEQ ID NO: 302475 - DNA, 25 bp, Homo sapien
tttatttttcagactcttccctcta

SEQ ID NO: 302476 - DNA, 25 bp, Homo sapien
ttccctctactacttactctgtatt

SEQ ID NO: 302477 - DNA, 25 bp, Homo sapien
ctacttactctgtatttctgtctct

SEQ ID NO: 302478 - DNA, 25 bp, Homo sapien
atttctgtctcttctaatgactagg

SEQ ID NO: 302479 - DNA, 25 bp, Homo sapien
gtctcttctaatgactaggaaaggc

SEQ ID NO: 302480 - DNA, 25 bp, Homo sapien
gtgataatgtgggtagtgttcctac

SEQ ID NO: 302481 - DNA, 25 bp, Homo sapien
tagtgttcctaccttcctgctgtat

SEQ ID NO: 302482 - DNA, 25 bp, Homo sapien
ttcctgctgtatgtgttctactgaa

SEQ ID NO: 302483 - DNA, 25 bp, Homo sapien
aatgagatataatagccatctggct

SEQ ID NO: 302484 - DNA, 25 bp, Homo sapien
tgatgtctttgtctaagtcttagaa

SEQ ID NO: 302485 - DNA, 25 bp, Homo sapien
tggagccgtcggaggtgcccacacc

SEQ ID NO: 302486 - DNA, 25 bp, Homo sapien
tgcagtgctgactcaatggttttgt

SEQ ID NO: 302487 - DNA, 25 bp, Homo sapien
tgctgactcaatggttttgttcttt

SEQ ID NO: 302488 - DNA, 25 bp, Homo sapien
aaagtctctgagcatctaccaaatg

SEQ ID NO: 302489 - DNA, 25 bp, Homo sapien
aaagggtacaagcacacctgcggtt

SEQ ID NO: 302490 - DNA, 25 bp, Homo sapien
gtacaagcacacctgcggttcttct

SEQ ID NO: 302491 - DNA, 25 bp, Homo sapien
gttcttctctcaggtcttccggaga

SEQ ID NO: 302492 - DNA, 25 bp, Homo sapien
tcaggtcttccggagagattcagga

SEQ ID NO: 302493 - DNA, 25 bp, Homo sapien
tagaagctgtcttgcacctgtcatc

SEQ ID NO: 302494 - DNA, 25 bp, Homo sapien
acctgtcatctctgtttttgctgtg

SEQ ID NO: 302495 - DNA, 25 bp, Homo sapien
tcctttaacttttcctgtggcccag

SEQ ID NO: 302496 - DNA, 25 bp, Homo sapien
gggacaacactttgatcagttcgtt

SEQ ID NO: 302497 - DNA, 25 bp, Homo sapien
aattccttgtttcttcagcatctga

SEQ ID NO: 302498 - DNA, 25 bp, Homo sapien
ggaaacgaaatttggccacctcgct

SEQ ID NO: 302499 - DNA, 25 bp, Homo sapien
atttggccacctcgctgtggaactt

SEQ ID NO: 302500 - DNA, 25 bp, Homo sapien
acagtggttcatgcacatctccagc

SEQ ID NO: 302501 - DNA, 25 bp, Homo sapien
ataaagagcttccttctcttgcgga

SEQ ID NO: 302502 - DNA, 25 bp, Homo sapien
tctcttgcggagactggatcttgtg

SEQ ID NO: 302503 - DNA, 25 bp, Homo sapien
actggatcttgtgggccagtagcca

SEQ ID NO: 302504 - DNA, 25 bp, Homo sapien
tcagcatctgataagcgtctcgaat

SEQ ID NO: 302505 - DNA, 25 bp, Homo sapien
gtatttcaatgactcttcctttaac

SEQ ID NO: 302506 - DNA, 25 bp, Homo sapien
gggatagaaaactactcctttctca

SEQ ID NO: 302507 - DNA, 25 bp, Homo sapien
agagttcactttgtctacattttgt

SEQ ID NO: 302508 - DNA, 25 bp, Homo sapien
gataaccaggaatctatggctcctc

SEQ ID NO: 302509 - DNA, 25 bp, Homo sapien
ggaatctatggctcctcccaaaaat

SEQ ID NO: 302510 - DNA, 25 bp, Homo sapien
aatatagtgcccttccagatatggg

SEQ ID NO: 302511 - DNA, 25 bp, Homo sapien
ccttccagatatgggcaaaaattct

SEQ ID NO: 302512 - DNA, 25 bp, Homo sapien
taaatccgaagtaaatccaacaggg

SEQ ID NO: 302513 - DNA, 25 bp, Homo sapien
atccaacagggaatctgcttgcaat

SEQ ID NO: 302514 - DNA, 25 bp, Homo sapien
gacaacagtgccatagtgacatcct

SEQ ID NO: 302515 - DNA, 25 bp, Homo sapien
agtgccatagtgacatccttaaaat

SEQ ID NO: 302516 - DNA, 25 bp, Homo sapien
atgtctgattcaagtatactcttag

SEQ ID NO: 302517 - DNA, 25 bp, Homo sapien
tcctctaatatcaaaacgaaaattt

SEQ ID NO: 302518 - DNA, 25 bp, Homo sapien
gtatatttaacaacattttggtaat

SEQ ID NO: 302519 - DNA, 25 bp, Homo sapien
aatttgagagtgtgtggaagtcccc

SEQ ID NO: 302520 - DNA, 25 bp, Homo sapien
tttgagagtgtgtggaagtccccct

SEQ ID NO: 302521 - DNA, 25 bp, Homo sapien
atagaagccaactatctaatcaatg

SEQ ID NO: 302522 - DNA, 25 bp, Homo sapien
tagaagccaactatctaatcaatgc

SEQ ID NO: 302523 - DNA, 25 bp, Homo sapien
agaagccaactatctaatcaatgcc

SEQ ID NO: 302524 - DNA, 25 bp, Homo sapien
tctaatcaatgccaaaagtgtgaac

SEQ ID NO: 302525 - DNA, 25 bp, Homo sapien
taatcaatgccaaaagtgtgaacaa

SEQ ID NO: 302526 - DNA, 25 bp, Homo sapien
caatgccaaaagtgtgaacaaaata

SEQ ID NO: 302527 - DNA, 25 bp, Homo sapien
agcagtgaaaaagaatgcaactttt

SEQ ID NO: 302528 - DNA, 25 bp, Homo sapien
cctacctgaggtcggagcatggaag

SEQ ID NO: 302529 - DNA, 25 bp, Homo sapien
caacaaaccctggtgacatgcaatt

SEQ ID NO: 302530 - DNA, 25 bp, Homo sapien
acaaaccctggtgacatgcaattta

SEQ ID NO: 302531 - DNA, 25 bp, Homo sapien
atttacctatatagcaagcctacac

SEQ ID NO: 302532 - DNA, 25 bp, Homo sapien
tttacctatatagcaagcctacaca

SEQ ID NO: 302533 - DNA, 25 bp, Homo sapien
ggaagccattatcctaaatgaactc

SEQ ID NO: 302534 - DNA, 25 bp, Homo sapien
gaagccattatcctaaatgaactca

SEQ ID NO: 302535 - DNA, 25 bp, Homo sapien
gccattatcctaaatgaactcactc

SEQ ID NO: 302536 - DNA, 25 bp, Homo sapien
tatcctaaatgaactcactcagaaa

SEQ ID NO: 302537 - DNA, 25 bp, Homo sapien
ctaaatgaactcactcagaaacaga

SEQ ID NO: 302538 - DNA, 25 bp, Homo sapien
atgaactcactcagaaacagaaaac

SEQ ID NO: 302539 - DNA, 25 bp, Homo sapien
gggaaagcagctcccaggccttact

SEQ ID NO: 302540 - DNA, 25 bp, Homo sapien
aaagcagctcccaggccttactcag

SEQ ID NO: 302541 - DNA, 25 bp, Homo sapien
ttactcaggcctcaggtccatgggt

SEQ ID NO: 302542 - DNA, 25 bp, Homo sapien
actcaggcctcaggtccatgggttg

SEQ ID NO: 302543 - DNA, 25 bp, Homo sapien
cctcaggtccatgggttgggcagcc

SEQ ID NO: 302544 - DNA, 25 bp, Homo sapien
ttgggcagccagtctgggcccttct

SEQ ID NO: 302545 - DNA, 25 bp, Homo sapien
tccttcacagcatttacttggagct

SEQ ID NO: 302546 - DNA, 25 bp, Homo sapien
ttcacagcatttacttggagctctt

SEQ ID NO: 302547 - DNA, 25 bp, Homo sapien
gcatttacttggagctctttgtgac

SEQ ID NO: 302548 - DNA, 25 bp, Homo sapien
catttacttggagctctttgtgaca

SEQ ID NO: 302549 - DNA, 25 bp, Homo sapien
agctctttgtgacacaccatgtcag

SEQ ID NO: 302550 - DNA, 25 bp, Homo sapien
gggactccgggagggatctcagtga

SEQ ID NO: 302551 - DNA, 25 bp, Homo sapien
tcgggccccagctcatgctggtcat

SEQ ID NO: 302552 - DNA, 25 bp, Homo sapien
caagctgcagtagccgtcggtgcag

SEQ ID NO: 302553 - DNA, 25 bp, Homo sapien
gtcggtgcagcttcttggccacgaa

SEQ ID NO: 302554 - DNA, 25 bp, Homo sapien
ttggccacgaagttgaacttggcgt

SEQ ID NO: 302555 - DNA, 25 bp, Homo sapien
aacttggcgtatgaggagtccccga

SEQ ID NO: 302556 - DNA, 25 bp, Homo sapien
gcgtatgaggagtccccgaggccca

SEQ ID NO: 302557 - DNA, 25 bp, Homo sapien
gcccaggacggcaaagtccatctga

SEQ ID NO: 302558 - DNA, 25 bp, Homo sapien
aaagtccatctgacagagggcagtg

SEQ ID NO: 302559 - DNA, 25 bp, Homo sapien
tggagggcaggttcttccggaatat

SEQ ID NO: 302560 - DNA, 25 bp, Homo sapien
gttcttccggaatataaacctccag

SEQ ID NO: 302561 - DNA, 25 bp, Homo sapien
tagctcctgaataagacctgtcagc

SEQ ID NO: 302562 - DNA, 25 bp, Homo sapien
acctgtcagcatcctttagtctaag

SEQ ID NO: 302563 - DNA, 25 bp, Homo sapien
tccatgttaccgatatagaagccaa

SEQ ID NO: 302564 - DNA, 25 bp, Homo sapien
agaagccaaactctaagccaagatc

SEQ ID NO: 302565 - DNA, 25 bp, Homo sapien
gtacaacttctgataattcctcttt

SEQ ID NO: 302566 - DNA, 25 bp, Homo sapien
gacagcagagctcagggatcttctt

SEQ ID NO: 302567 - DNA, 25 bp, Homo sapien
cagggatcttcttgcatttctacag

SEQ ID NO: 302568 - DNA, 25 bp, Homo sapien
ctacagaagatgcactggctgccct

SEQ ID NO: 302569 - DNA, 25 bp, Homo sapien
tgccctgggtttgtatctttcacaa

SEQ ID NO: 302570 - DNA, 25 bp, Homo sapien
gagtcttttccaagcacagaccaga

SEQ ID NO: 302571 - DNA, 25 bp, Homo sapien
ggactgtcaatccagtttgcactga

SEQ ID NO: 302572 - DNA, 25 bp, Homo sapien
tcccagctcttactaggagagggag

SEQ ID NO: 302573 - DNA, 25 bp, Homo sapien
aagccccagaccatgggagctgtct

SEQ ID NO: 302574 - DNA, 25 bp, Homo sapien
ccagaccatgggagctgtctgggat

SEQ ID NO: 302575 - DNA, 25 bp, Homo sapien
ctgtctgggatgttgatccttgaga

SEQ ID NO: 302576 - DNA, 25 bp, Homo sapien
tgttgatccttgagaacttggccct

SEQ ID NO: 302577 - DNA, 25 bp, Homo sapien
tgctttagacccaaggacccgattc

SEQ ID NO: 302578 - DNA, 25 bp, Homo sapien
ttagacccaaggacccgattcctgg

SEQ ID NO: 302579 - DNA, 25 bp, Homo sapien
ggacccgattcctgggctaggaaag

SEQ ID NO: 302580 - DNA, 25 bp, Homo sapien
ggtggccaccaagttgtggaagcac

SEQ ID NO: 302581 - DNA, 25 bp, Homo sapien
ggccaccaagttgtggaagcacatt

SEQ ID NO: 302582 - DNA, 25 bp, Homo sapien
caagttgtggaagcacatttctaaa

SEQ ID NO: 302583 - DNA, 25 bp, Homo sapien
gggactgcagacactatgtcggcac

SEQ ID NO: 302584 - DNA, 25 bp, Homo sapien
tatgtcggcacaatgagattctctg

SEQ ID NO: 302585 - DNA, 25 bp, Homo sapien
tgtgtaccgtgagattggccgccaa

SEQ ID NO: 302586 - DNA, 25 bp, Homo sapien
ccaactcttcagcagtctgtggcag

SEQ ID NO: 302587 - DNA, 25 bp, Homo sapien
tggcagccgcagtccttgcttcagg

SEQ ID NO: 302588 - DNA, 25 bp, Homo sapien
gagtccacgtactgccagcgtttga

SEQ ID NO: 302589 - DNA, 25 bp, Homo sapien
ccagcgtttgaggtagcaggacact

SEQ ID NO: 302590 - DNA, 25 bp, Homo sapien
tagcaggacactgccatctggatct

SEQ ID NO: 302591 - DNA, 25 bp, Homo sapien
aggagaggcatcacttcgtggctat

SEQ ID NO: 302592 - DNA, 25 bp, Homo sapien
gagaaaattccgcagtcgtccaaac

SEQ ID NO: 302593 - DNA, 25 bp, Homo sapien
gtcgtccaaactgtacttcatattg

SEQ ID NO: 302594 - DNA, 25 bp, Homo sapien
agcattggcctctcgccactggcag

SEQ ID NO: 302595 - DNA, 25 bp, Homo sapien
tggcctctcgccactggcagggact

SEQ ID NO: 302596 - DNA, 25 bp, Homo sapien
acgctgccttcgaggatgcccaggg

SEQ ID NO: 302597 - DNA, 25 bp, Homo sapien
tagacaccaatgagattgcaccgct

SEQ ID NO: 302598 - DNA, 25 bp, Homo sapien
agacgccccgccagatgcctgtgag

SEQ ID NO: 302599 - DNA, 25 bp, Homo sapien
agatgcctgtgaggcctcctttgac

SEQ ID NO: 302600 - DNA, 25 bp, Homo sapien
tttgacgcggtctccaccatccgag

SEQ ID NO: 302601 - DNA, 25 bp, Homo sapien
accatccgaggcgagctctttttct

SEQ ID NO: 302602 - DNA, 25 bp, Homo sapien
gaggcgagctctttttcttcaaagc

SEQ ID NO: 302603 - DNA, 25 bp, Homo sapien
gagctctttttcttcaaagcgggct

SEQ ID NO: 302604 - DNA, 25 bp, Homo sapien
aaagcgggctttgtgtggcgcctcc

SEQ ID NO: 302605 - DNA, 25 bp, Homo sapien
cccttccctgtgtatctgtgtcctg

SEQ ID NO: 302606 - DNA, 25 bp, Homo sapien
tgtcctgctaacagccaagagatgt

SEQ ID NO: 302607 - DNA, 25 bp, Homo sapien
acagccaagagatgttgcaagggag

SEQ ID NO: 302608 - DNA, 25 bp, Homo sapien
gagaccttgaacctgtcaggtttat

SEQ ID NO: 302609 - DNA, 25 bp, Homo sapien
gcatgttgaagtttagttctttacc

SEQ ID NO: 302610 - DNA, 25 bp, Homo sapien
aatctttttttaatcagcctcaagg

SEQ ID NO: 302611 - DNA, 25 bp, Homo sapien
ttaatcagcctcaaggttaaaataa

SEQ ID NO: 302612 - DNA, 25 bp, Homo sapien
attaatggtgtgatgtgacctgcct

SEQ ID NO: 302613 - DNA, 25 bp, Homo sapien
aatggtgtgatgtgacctgcctgtt

SEQ ID NO: 302614 - DNA, 25 bp, Homo sapien
gttttcaaggtagtttcacatgtct

SEQ ID NO: 302615 - DNA, 25 bp, Homo sapien
aaggtagtttcacatgtcttgcacc

SEQ ID NO: 302616 - DNA, 25 bp, Homo sapien
gtgcaaaccagtccaatattagcgg

SEQ ID NO: 302617 - DNA, 25 bp, Homo sapien
aatattagcggcagagctcttccct

SEQ ID NO: 302618 - DNA, 25 bp, Homo sapien
ttagcggcagagctcttccctagac

SEQ ID NO: 302619 - DNA, 25 bp, Homo sapien
tccctagacccgtcttgaagctgct

SEQ ID NO: 302620 - DNA, 25 bp, Homo sapien
ccatcatttcctccaggtagctggt

SEQ ID NO: 302621 - DNA, 25 bp, Homo sapien
atttcctccaggtagctggtggata

SEQ ID NO: 302622 - DNA, 25 bp, Homo sapien
ccaggtagctggtggatactgttta

SEQ ID NO: 302623 - DNA, 25 bp, Homo sapien
ggtggatactgtttatctggtgctc

SEQ ID NO: 302624 - DNA, 25 bp, Homo sapien
tggtgctcactatgccctaggtaac

SEQ ID NO: 302625 - DNA, 25 bp, Homo sapien
ctcactatgccctaggtaacactgt

SEQ ID NO: 302626 - DNA, 25 bp, Homo sapien
tatgccctaggtaacactgtaagtg

SEQ ID NO: 302627 - DNA, 25 bp, Homo sapien
cagaaccttgaggatgcttgtctct

SEQ ID NO: 302628 - DNA, 25 bp, Homo sapien
aactcagagctgttcacccaagtca

SEQ ID NO: 302629 - DNA, 25 bp, Homo sapien
tcacccaagtcagcggaggaggcct

SEQ ID NO: 302630 - DNA, 25 bp, Homo sapien
gaggcctcctgggacttgagcctga

SEQ ID NO: 302631 - DNA, 25 bp, Homo sapien
accctaggcagagatcatcaacttg

SEQ ID NO: 302632 - DNA, 25 bp, Homo sapien
atcaacttggtaccgatgagtgacg

SEQ ID NO: 302633 - DNA, 25 bp, Homo sapien
atgagtgacgcggagcttgaacatt

SEQ ID NO: 302634 - DNA, 25 bp, Homo sapien
agcttgaacattccagcgacttgct

SEQ ID NO: 302635 - DNA, 25 bp, Homo sapien
tattatttccctttcgatggtcttt

SEQ ID NO: 302636 - DNA, 25 bp, Homo sapien
gtaaagatttcaacgccaggtccat

SEQ ID NO: 302637 - DNA, 25 bp, Homo sapien
cgccaggtccattttccaaattttg

SEQ ID NO: 302638 - DNA, 25 bp, Homo sapien
cagcgccaatatgatgtcagggatt

SEQ ID NO: 302639 - DNA, 25 bp, Homo sapien
gtcagggatttcttcagtgccaacc

SEQ ID NO: 302640 - DNA, 25 bp, Homo sapien
aggctcaccagtgattgctgctgcc

SEQ ID NO: 302641 - DNA, 25 bp, Homo sapien
tggcgctcagcagtaacggccctat

SEQ ID NO: 302642 - DNA, 25 bp, Homo sapien
agtaacggccctatctgtctcctga

SEQ ID NO: 302643 - DNA, 25 bp, Homo sapien
ctgtctcctgatgcctgagcagagg

SEQ ID NO: 302644 - DNA, 25 bp, Homo sapien
ggagtccaccctctccttgatgcag

SEQ ID NO: 302645 - DNA, 25 bp, Homo sapien
aacacttcagaagcaccgtgtctga

SEQ ID NO: 302646 - DNA, 25 bp, Homo sapien
agaagcaccgtgtctgaaccgttgc

SEQ ID NO: 302647 - DNA, 25 bp, Homo sapien
gtctgaaccgttgcttgtggattta

SEQ ID NO: 302648 - DNA, 25 bp, Homo sapien
gtggatttatagtagttcagtcata

SEQ ID NO: 302649 - DNA, 25 bp, Homo sapien
aacccttataattcatactatcatg

SEQ ID NO: 302650 - DNA, 25 bp, Homo sapien
gaatttgctttatccatctcatttg

SEQ ID NO: 302651 - DNA, 25 bp, Homo sapien
atctcatttgcataacagttcatct

SEQ ID NO: 302652 - DNA, 25 bp, Homo sapien
taacagttcatctgtctggtcccat

SEQ ID NO: 302653 - DNA, 25 bp, Homo sapien
agttcatctgtctggtcccattagg

SEQ ID NO: 302654 - DNA, 25 bp, Homo sapien
ggtcccattaggctctaccaaagaa

SEQ ID NO: 302655 - DNA, 25 bp, Homo sapien
ggctctaccaaagaaagactctgat

SEQ ID NO: 302656 - DNA, 25 bp, Homo sapien
tgagtggacattattactgtgactc

SEQ ID NO: 302657 - DNA, 25 bp, Homo sapien
actgtgactcttgtaagtagccata

SEQ ID NO: 302658 - DNA, 25 bp, Homo sapien
taggtatgaaattccacatgtgcaa

SEQ ID NO: 302659 - DNA, 25 bp, Homo sapien
tccacatgtgcaaagtactgttaag

SEQ ID NO: 302660 - DNA, 25 bp, Homo sapien
ctcacccctgaattgacagtaccaa

SEQ ID NO: 302661 - DNA, 25 bp, Homo sapien
cagtaccaatgtgatctgagatcca

SEQ ID NO: 302662 - DNA, 25 bp, Homo sapien
gagatccagtctcaagcctgtcttc

SEQ ID NO: 302663 - DNA, 25 bp, Homo sapien
ccttttggcctagacctgttatcaa

SEQ ID NO: 302664 - DNA, 25 bp, Homo sapien
agaagggatttccatcctttccttg

SEQ ID NO: 302665 - DNA, 25 bp, Homo sapien
tttccttgctttctatccctgcgta

SEQ ID NO: 302666 - DNA, 25 bp, Homo sapien
cttacctgatgtcctttgagggcat

SEQ ID NO: 302667 - DNA, 25 bp, Homo sapien
aaagtaatgaatgctctgtctccac

SEQ ID NO: 302668 - DNA, 25 bp, Homo sapien
gctggcagcatctgacagcaacgat

SEQ ID NO: 302669 - DNA, 25 bp, Homo sapien
agtgcgtgcaaggaggagcctcaca

SEQ ID NO: 302670 - DNA, 25 bp, Homo sapien
aggaggagcctcacatttctccttc

SEQ ID NO: 302671 - DNA, 25 bp, Homo sapien
ttgtaagtgccccaagagaaaggtg

SEQ ID NO: 302672 - DNA, 25 bp, Homo sapien
gaaaggtgaccaacctgttctgctt

SEQ ID NO: 302673 - DNA, 25 bp, Homo sapien
tgttctgcttcgaacatcgggtcaa

SEQ ID NO: 302674 - DNA, 25 bp, Homo sapien
aacatcgggtcaacgtctgcgagca

SEQ ID NO: 302675 - DNA, 25 bp, Homo sapien
caacgtctgcgagcactgcctggta

SEQ ID NO: 302676 - DNA, 25 bp, Homo sapien
ctgcctggtagccaatcacgccaag

SEQ ID NO: 302677 - DNA, 25 bp, Homo sapien
ggcggtattggcttcctccaaatcc

SEQ ID NO: 302678 - DNA, 25 bp, Homo sapien
ttggcttcctccaaatccatgaggg

SEQ ID NO: 302679 - DNA, 25 bp, Homo sapien
ccacaagggcaaggacttgatttat

SEQ ID NO: 302680 - DNA, 25 bp, Homo sapien
cccaagagagagtctggtgcacagt

SEQ ID NO: 302681 - DNA, 25 bp, Homo sapien
gagtctggtgcacagtatgtgctca

SEQ ID NO: 302682 - DNA, 25 bp, Homo sapien
ggtgcgttcccgcagaccaaagaga

SEQ ID NO: 302683 - DNA, 25 bp, Homo sapien
gtgcgttcccgcagaccaaagagag

SEQ ID NO: 302684 - DNA, 25 bp, Homo sapien
gcgttcccgcagaccaaagagagtg

SEQ ID NO: 302685 - DNA, 25 bp, Homo sapien
gttcccgcagaccaaagagagtgtg

SEQ ID NO: 302686 - DNA, 25 bp, Homo sapien
tcccgcagaccaaagagagtgtgac

SEQ ID NO: 302687 - DNA, 25 bp, Homo sapien
agaccaaagagagtgtgactccctt

SEQ ID NO: 302688 - DNA, 25 bp, Homo sapien
agagagtgtgactcccttgccagct

SEQ ID NO: 302689 - DNA, 25 bp, Homo sapien
agggcccagtgacaaaatcattggg

SEQ ID NO: 302690 - DNA, 25 bp, Homo sapien
tgtagtcccaacttgctgctgtcac

SEQ ID NO: 302691 - DNA, 25 bp, Homo sapien
cccagctgctgccttcatattgaag

SEQ ID NO: 302692 - DNA, 25 bp, Homo sapien
ccagctgctgccttcatattgaagg

SEQ ID NO: 302693 - DNA, 25 bp, Homo sapien
gccctccaagcgcagacatgagtga

SEQ ID NO: 302694 - DNA, 25 bp, Homo sapien
cagacatgagtgatggcgcccggcc

SEQ ID NO: 302695 - DNA, 25 bp, Homo sapien
agacatgagtgatggcgcccggccc

SEQ ID NO: 302696 - DNA, 25 bp, Homo sapien
ctgccatttgcacgcccggccggga

SEQ ID NO: 302697 - DNA, 25 bp, Homo sapien
gggaggggaagcctcaccatttctc

SEQ ID NO: 302698 - DNA, 25 bp, Homo sapien
caccatttctcaaggtccataaaga

SEQ ID NO: 302699 - DNA, 25 bp, Homo sapien
gtccataaagactgagcggatgttt

SEQ ID NO: 302700 - DNA, 25 bp, Homo sapien
cataaagactgagcggatgtttcct

SEQ ID NO: 302701 - DNA, 25 bp, Homo sapien
aagactgagcggatgtttcctcgcc

SEQ ID NO: 302702 - DNA, 25 bp, Homo sapien
gactgagcggatgtttcctcgcctc

SEQ ID NO: 302703 - DNA, 25 bp, Homo sapien
tgagcggatgtttcctcgcctctcg

SEQ ID NO: 302704 - DNA, 25 bp, Homo sapien
tactgaccctgcttgttggacttaa

SEQ ID NO: 302705 - DNA, 25 bp, Homo sapien
ggacttaaccctgaagtcacaggta

SEQ ID NO: 302706 - DNA, 25 bp, Homo sapien
tatctctgcaatacacatactcttt

SEQ ID NO: 302707 - DNA, 25 bp, Homo sapien
tactcttttgtacggtgtgggctgt

SEQ ID NO: 302708 - DNA, 25 bp, Homo sapien
tgggctgttggcttggcgtcctacc

SEQ ID NO: 302709 - DNA, 25 bp, Homo sapien
tacctcttgcatcgtacacaacaga

SEQ ID NO: 302710 - DNA, 25 bp, Homo sapien
gcatcgtacacaacagaacatctta

SEQ ID NO: 302711 - DNA, 25 bp, Homo sapien
agctgtctggtctggtgattattac

SEQ ID NO: 302712 - DNA, 25 bp, Homo sapien
ccttggtgcaggtaaatgacccaga

SEQ ID NO: 302713 - DNA, 25 bp, Homo sapien
ggtggtggtgtacacaatccctgca

SEQ ID NO: 302714 - DNA, 25 bp, Homo sapien
tgtacacaatccctgcagtactgac

SEQ ID NO: 302715 - DNA, 25 bp, Homo sapien
ttgtaagtgccccaagagaaaggtg

SEQ ID NO: 302716 - DNA, 25 bp, Homo sapien
ccaagagaaaggtgaccaacctgtt

SEQ ID NO: 302717 - DNA, 25 bp, Homo sapien
tgttctgcttcgaacatcgggtcaa

SEQ ID NO: 302718 - DNA, 25 bp, Homo sapien
tctgcttcgaacatcgggtcaacgt

SEQ ID NO: 302719 - DNA, 25 bp, Homo sapien
ttcgaacatcgggtcaacgtctgcg

SEQ ID NO: 302720 - DNA, 25 bp, Homo sapien
aacatcgggtcaacgtctgcgagca

SEQ ID NO: 302721 - DNA, 25 bp, Homo sapien
atcgggtcaacgtctgcgagcactg

SEQ ID NO: 302722 - DNA, 25 bp, Homo sapien
gggtcaacgtctgcgagcactgcct

SEQ ID NO: 302723 - DNA, 25 bp, Homo sapien
caacgtctgcgagcactgcctggta

SEQ ID NO: 302724 - DNA, 25 bp, Homo sapien
agcactgcctggtagccaatcacgc

SEQ ID NO: 302725 - DNA, 25 bp, Homo sapien
ctgcctggtagccaatcacgccaag

SEQ ID NO: 302726 - DNA, 25 bp, Homo sapien
ggaaatgccaagagatagttcaatc

SEQ ID NO: 302727 - DNA, 25 bp, Homo sapien
gagatagttcaatctgcctctctgg

SEQ ID NO: 302728 - DNA, 25 bp, Homo sapien
tctctggcaagccatggacaccagg

SEQ ID NO: 302729 - DNA, 25 bp, Homo sapien
tggacaccaggtctgacaaactctc

SEQ ID NO: 302730 - DNA, 25 bp, Homo sapien
accaggtctgacaaactctcttact

SEQ ID NO: 302731 - DNA, 25 bp, Homo sapien
gacaaactctcttactccttaagac

SEQ ID NO: 302732 - DNA, 25 bp, Homo sapien
actccttaagacaaatgctcacctg

SEQ ID NO: 302733 - DNA, 25 bp, Homo sapien
ggaaataagctgcatggtaccataa

SEQ ID NO: 302734 - DNA, 25 bp, Homo sapien
gcatggtaccataatttctattcta

SEQ ID NO: 302735 - DNA, 25 bp, Homo sapien
gtatctctttggtattgctttggaa

SEQ ID NO: 302736 - DNA, 25 bp, Homo sapien
acattctttataactatcttgctat

SEQ ID NO: 302737 - DNA, 25 bp, Homo sapien
accctcagtttgctgttttccaggc

SEQ ID NO: 302738 - DNA, 25 bp, Homo sapien
aggccctgaggaggtttctcctgac

SEQ ID NO: 302739 - DNA, 25 bp, Homo sapien
tttctcctgactgccaaggtgtgaa

SEQ ID NO: 302740 - DNA, 25 bp, Homo sapien
tgaacacaggcatggcggcagaagt

SEQ ID NO: 302741 - DNA, 25 bp, Homo sapien
gaagtgccaaaagtgagccctctcc

SEQ ID NO: 302742 - DNA, 25 bp, Homo sapien
aagtgagccctctccagcagagtta

SEQ ID NO: 302743 - DNA, 25 bp, Homo sapien
agagttactcctgcttgaacccgca

SEQ ID NO: 302744 - DNA, 25 bp, Homo sapien
atgatgcttctaaggctctgaccac

SEQ ID NO: 302745 - DNA, 25 bp, Homo sapien
tgaccacagtgcactgcccaaggta

SEQ ID NO: 302746 - DNA, 25 bp, Homo sapien
tgcactgcccaaggtaagcaccaga

SEQ ID NO: 302747 - DNA, 25 bp, Homo sapien
aggtaagcaccagagaagtcagctg

SEQ ID NO: 302748 - DNA, 25 bp, Homo sapien
aacatcatcattggtttatgctgac

SEQ ID NO: 302749 - DNA, 25 bp, Homo sapien
cattggtttatgctgacactctttt

SEQ ID NO: 302750 - DNA, 25 bp, Homo sapien
gtttatgctgacactcttttatttg

SEQ ID NO: 302751 - DNA, 25 bp, Homo sapien
gacactcttttatttgatttgatca

SEQ ID NO: 302752 - DNA, 25 bp, Homo sapien
atgagcaatcataaatccaatctgt

SEQ ID NO: 302753 - DNA, 25 bp, Homo sapien
aaatccaatctgttactccactaat

SEQ ID NO: 302754 - DNA, 25 bp, Homo sapien
gttactccactaatagaacactgac

SEQ ID NO: 302755 - DNA, 25 bp, Homo sapien
agaacactgacgtcatctttcatct

SEQ ID NO: 302756 - DNA, 25 bp, Homo sapien
cactgacgtcatctttcatctcttt

SEQ ID NO: 302757 - DNA, 25 bp, Homo sapien
tttgtgtgctccttggtcagagtaa

SEQ ID NO: 302758 - DNA, 25 bp, Homo sapien
gtcagagtaaatagcccagatttct

SEQ ID NO: 302759 - DNA, 25 bp, Homo sapien
tgttttttggttggcagtaaccgat

SEQ ID NO: 302760 - DNA, 25 bp, Homo sapien
gtaaccgattttaatgactagcttt

SEQ ID NO: 302761 - DNA, 25 bp, Homo sapien
ttgtaaatgtgattcagggccccca

SEQ ID NO: 302762 - DNA, 25 bp, Homo sapien
agcacccctgtgtctgcagagtgcc

SEQ ID NO: 302763 - DNA, 25 bp, Homo sapien
ttcaaaactcagctgttccagccgg

SEQ ID NO: 302764 - DNA, 25 bp, Homo sapien
gttccagccggtgccaacctgtgaa

SEQ ID NO: 302765 - DNA, 25 bp, Homo sapien
agccggtgccaacctgtgaacttcc

SEQ ID NO: 302766 - DNA, 25 bp, Homo sapien
ccaccatatcccagaatctgctatt

SEQ ID NO: 302767 - DNA, 25 bp, Homo sapien
tatcccagaatctgctattccccaa

SEQ ID NO: 302768 - DNA, 25 bp, Homo sapien
ccagtttcctttcagtaatctttct

SEQ ID NO: 302769 - DNA, 25 bp, Homo sapien
gagccaggacaatagggcctgttgt

SEQ ID NO: 302770 - DNA, 25 bp, Homo sapien
tttcttctgtcactcagtaaccatg

SEQ ID NO: 302771 - DNA, 25 bp, Homo sapien
gtaaccatgatccttcctcatttaa

SEQ ID NO: 302772 - DNA, 25 bp, Homo sapien
gtaattaaatgctggttacccactt

SEQ ID NO: 302773 - DNA, 25 bp, Homo sapien
atgctggttacccacttaatgtgcc

SEQ ID NO: 302774 - DNA, 25 bp, Homo sapien
ggttacccacttaatgtgccaggta

SEQ ID NO: 302775 - DNA, 25 bp, Homo sapien
tgtgccaggtagtatgatactttct

SEQ ID NO: 302776 - DNA, 25 bp, Homo sapien
aacaaaacagtctagatccctgccc

SEQ ID NO: 302777 - DNA, 25 bp, Homo sapien
cagtctagatccctgccctcagaag

SEQ ID NO: 302778 - DNA, 25 bp, Homo sapien
ccctcagaagggttacagtttatgt

SEQ ID NO: 302779 - DNA, 25 bp, Homo sapien
gtttatgtgattactattttcatga

SEQ ID NO: 302780 - DNA, 25 bp, Homo sapien
aagccatatggaaagatttttatct

SEQ ID NO: 302781 - DNA, 25 bp, Homo sapien
cttttttacatttgcatgccctcac

SEQ ID NO: 302782 - DNA, 25 bp, Homo sapien
acttctcaagactggtagcccatat

SEQ ID NO: 302783 - DNA, 25 bp, Homo sapien
agactggtagcccatattgtgcctt

SEQ ID NO: 302784 - DNA, 25 bp, Homo sapien
agcccatattgtgcctttgtggaaa

SEQ ID NO: 302785 - DNA, 25 bp, Homo sapien
tgaggctagattccagaccccactc

SEQ ID NO: 302786 - DNA, 25 bp, Homo sapien
ggccccattacctgggcaaactcat

SEQ ID NO: 302787 - DNA, 25 bp, Homo sapien
tcatcccttgactggcaccatactg

SEQ ID NO: 302788 - DNA, 25 bp, Homo sapien
gaccaacctgcatactatttcaaca

SEQ ID NO: 302789 - DNA, 25 bp, Homo sapien
atactatttcaacatagcctggagc

SEQ ID NO: 302790 - DNA, 25 bp, Homo sapien
agttctgaacttgtgcttctcaaga

SEQ ID NO: 302791 - DNA, 25 bp, Homo sapien
agaactagtagatcccagaacacac

SEQ ID NO: 302792 - DNA, 25 bp, Homo sapien
ccgggtatccaagaggaaatccaag

SEQ ID NO: 302793 - DNA, 25 bp, Homo sapien
gaggaaatccaagtcaaggtcgcga

SEQ ID NO: 302794 - DNA, 25 bp, Homo sapien
gaaatccaagtcaaggtcgcgatcc

SEQ ID NO: 302795 - DNA, 25 bp, Homo sapien
aatccaagtcaaggtcgcgatccaa

SEQ ID NO: 302796 - DNA, 25 bp, Homo sapien
tccaagtcaaggtcgcgatccaaga

SEQ ID NO: 302797 - DNA, 25 bp, Homo sapien
agtcaaggtcgcgatccaagaggcc

SEQ ID NO: 302798 - DNA, 25 bp, Homo sapien
tcaaggtcgcgatccaagaggcccc

SEQ ID NO: 302799 - DNA, 25 bp, Homo sapien
gcagtgcagagtgctgagctgcttc

SEQ ID NO: 302800 - DNA, 25 bp, Homo sapien
ttcttctgattgctcctggggaaaa

SEQ ID NO: 302801 - DNA, 25 bp, Homo sapien
gggaaaacacgccttgtcctgaaga

SEQ ID NO: 302802 - DNA, 25 bp, Homo sapien
ggaaaacacgccttgtcctgaagaa

SEQ ID NO: 302803 - DNA, 25 bp, Homo sapien
accatcccgcgatggcgtttctcgt

SEQ ID NO: 302804 - DNA, 25 bp, Homo sapien
cgcgatggcgtttctcgtgtttttc

SEQ ID NO: 302805 - DNA, 25 bp, Homo sapien
gatggcgtttctcgtgtttttcttt

SEQ ID NO: 302806 - DNA, 25 bp, Homo sapien
gcgtttctcgtgtttttcttttctg

SEQ ID NO: 302807 - DNA, 25 bp, Homo sapien
tataaatattgaccgcacactcctg

SEQ ID NO: 302808 - DNA, 25 bp, Homo sapien
aaatattgaccgcacactcctgctt

SEQ ID NO: 302809 - DNA, 25 bp, Homo sapien
tattgaccgcacactcctgcttgct

SEQ ID NO: 302810 - DNA, 25 bp, Homo sapien
ctgcttgctccgggttttctctggg

SEQ ID NO: 302811 - DNA, 25 bp, Homo sapien
gtcccaagagcgcagtggccttggg

SEQ ID NO: 302812 - DNA, 25 bp, Homo sapien
ggtgacccgagagcgcaaaggcggc

SEQ ID NO: 302813 - DNA, 25 bp, Homo sapien
gcttcccaagctttatttattgcca

SEQ ID NO: 302814 - DNA, 25 bp, Homo sapien
tcaggagtaaatttgacaagtacat

SEQ ID NO: 302815 - DNA, 25 bp, Homo sapien
gacaagtacatgtgaataacctcct

SEQ ID NO: 302816 - DNA, 25 bp, Homo sapien
atgtgaataacctcctgtaaatgaa

SEQ ID NO: 302817 - DNA, 25 bp, Homo sapien
gaataacctcctgtaaatgaatttt

SEQ ID NO: 302818 - DNA, 25 bp, Homo sapien
gttgtgcagattagcaattttttgc

SEQ ID NO: 302819 - DNA, 25 bp, Homo sapien
tagcaattttttgctatagctttga

SEQ ID NO: 302820 - DNA, 25 bp, Homo sapien
atagctttgacttttctatgctgtg

SEQ ID NO: 302821 - DNA, 25 bp, Homo sapien
gctttgacttttctatgctgtgaat

SEQ ID NO: 302822 - DNA, 25 bp, Homo sapien
ttgacttttctatgctgtgaattaa

SEQ ID NO: 302823 - DNA, 25 bp, Homo sapien
gtgaattaatagctgcgatttggca

SEQ ID NO: 302824 - DNA, 25 bp, Homo sapien
tagctgcgatttggcaaacagccct

SEQ ID NO: 302825 - DNA, 25 bp, Homo sapien
tctctctggcgcactttcctgaagc

SEQ ID NO: 302826 - DNA, 25 bp, Homo sapien
gaagcctcttattaactcccatctc

SEQ ID NO: 302827 - DNA, 25 bp, Homo sapien
ttattaactcccatctccagaagca

SEQ ID NO: 302828 - DNA, 25 bp, Homo sapien
atctccagaagcacctcaacaatgt

SEQ ID NO: 302829 - DNA, 25 bp, Homo sapien
gtcagtggctgaggctgcactcaga

SEQ ID NO: 302830 - DNA, 25 bp, Homo sapien
ccagtcttggccattcagttgagtg

SEQ ID NO: 302831 - DNA, 25 bp, Homo sapien
aaaagacaagacatccaggcagggc

SEQ ID NO: 302832 - DNA, 25 bp, Homo sapien
gacatccaggcagggcttctctttt

SEQ ID NO: 302833 - DNA, 25 bp, Homo sapien
tctcttttctttccacaagggacaa

SEQ ID NO: 302834 - DNA, 25 bp, Homo sapien
caagagcttggcttatttaggctac

SEQ ID NO: 302835 - DNA, 25 bp, Homo sapien
ttatttaggctacagccctgctgct

SEQ ID NO: 302836 - DNA, 25 bp, Homo sapien
cagagacacttgacgaacttgggaa

SEQ ID NO: 302837 - DNA, 25 bp, Homo sapien
gaataggaacaactgggcatggtca

SEQ ID NO: 302838 - DNA, 25 bp, Homo sapien
gaatttaatgtctccagttgggctg

SEQ ID NO: 302839 - DNA, 25 bp, Homo sapien
gcatggtcagtgataccctgagcaa

SEQ ID NO: 302840 - DNA, 25 bp, Homo sapien
gagcaatcacattacttcgctagat

SEQ ID NO: 302841 - DNA, 25 bp, Homo sapien
tacttcgctagatcctgcacttttt

SEQ ID NO: 302842 - DNA, 25 bp, Homo sapien
aagaattatttcctgagttgatcaa

SEQ ID NO: 302843 - DNA, 25 bp, Homo sapien
ccagttgggctgaatttaggtttag

SEQ ID NO: 302844 - DNA, 25 bp, Homo sapien
atgtgttgagcatgtctttttatta

SEQ ID NO: 302845 - DNA, 25 bp, Homo sapien
gggtaaatcttcagagacacttgac

SEQ ID NO: 302846 - DNA, 25 bp, Homo sapien
gagacacttgactgagtcctcagag

SEQ ID NO: 302847 - DNA, 25 bp, Homo sapien
atgtccttccttagagcctgagtgg

SEQ ID NO: 302848 - DNA, 25 bp, Homo sapien
cttccttagagcctgagtggtgtga

SEQ ID NO: 302849 - DNA, 25 bp, Homo sapien
gtgtgaggtgacaggtctctctctc

SEQ ID NO: 302850 - DNA, 25 bp, Homo sapien
aaggtagactcttccctaggactga

SEQ ID NO: 302851 - DNA, 25 bp, Homo sapien
taggactgacgagttacggctgcca

SEQ ID NO: 302852 - DNA, 25 bp, Homo sapien
ttacggctgccagatgcctgcatgg

SEQ ID NO: 302853 - DNA, 25 bp, Homo sapien
atctgcatcttccattggtggtcaa

SEQ ID NO: 302854 - DNA, 25 bp, Homo sapien
gcatcttccattggtggtcaaggat

SEQ ID NO: 302855 - DNA, 25 bp, Homo sapien
ggagaaccacacctagtgcaagcct

SEQ ID NO: 302856 - DNA, 25 bp, Homo sapien
agtgcaagcctggtactcagtaaat

SEQ ID NO: 302857 - DNA, 25 bp, Homo sapien
ataagagcattggtccccaagccag

SEQ ID NO: 302858 - DNA, 25 bp, Homo sapien
caagaattatttcctgagttgatca

SEQ ID NO: 302859 - DNA, 25 bp, Homo sapien
aagaattatttcctgagttgatcaa

SEQ ID NO: 302860 - DNA, 25 bp, Homo sapien
gaattatttcctgagttgatcaaaa

SEQ ID NO: 302861 - DNA, 25 bp, Homo sapien
ttatttcctgagttgatcaaaaaga

SEQ ID NO: 302862 - DNA, 25 bp, Homo sapien
ctccagttgggctgaatttaggttt

SEQ ID NO: 302863 - DNA, 25 bp, Homo sapien
ccagttgggctgaatttaggtttag

SEQ ID NO: 302864 - DNA, 25 bp, Homo sapien
aattatgtgttgagcatgtcttttt

SEQ ID NO: 302865 - DNA, 25 bp, Homo sapien
cagttgggctgaatttaggtttagg

SEQ ID NO: 302866 - DNA, 25 bp, Homo sapien
ttatgtgttgagcatgtctttttat

SEQ ID NO: 302867 - DNA, 25 bp, Homo sapien
atgtgttgagcatgtctttttatta

SEQ ID NO: 302868 - DNA, 25 bp, Homo sapien
taggtttaggtttggtagaataatg

SEQ ID NO: 302869 - DNA, 25 bp, Homo sapien
gaaggaacctgtgaaagcctttatc

SEQ ID NO: 302870 - DNA, 25 bp, Homo sapien
gtgaaagcctttatcagtcatttat

SEQ ID NO: 302871 - DNA, 25 bp, Homo sapien
atcagtcatttattggctgtgagaa

SEQ ID NO: 302872 - DNA, 25 bp, Homo sapien
tcatttattggctgtgagaagttct

SEQ ID NO: 302873 - DNA, 25 bp, Homo sapien
gttctctgggagtgtgggtacattt

SEQ ID NO: 302874 - DNA, 25 bp, Homo sapien
gggtacatttgaaggcaagtgactt

SEQ ID NO: 302875 - DNA, 25 bp, Homo sapien
tgaaggcaagtgacttcagttgagg

SEQ ID NO: 302876 - DNA, 25 bp, Homo sapien
aagggatctggcagggcaccacagc

SEQ ID NO: 302877 - DNA, 25 bp, Homo sapien
ccctactgaaccatcagcatgtcag

SEQ ID NO: 302878 - DNA, 25 bp, Homo sapien
ctgaaccatcagcatgtcagtggca

SEQ ID NO: 302879 - DNA, 25 bp, Homo sapien
tggaggggccactgagattgtctct

SEQ ID NO: 302880 - DNA, 25 bp, Homo sapien
ctgagagctaaaattggcacccatt

SEQ ID NO: 302881 - DNA, 25 bp, Homo sapien
agagctaaaattggcacccattgcc

SEQ ID NO: 302882 - DNA, 25 bp, Homo sapien
attgccccgtgccttcaggcagtct

SEQ ID NO: 302883 - DNA, 25 bp, Homo sapien
ggcagagtatgccaccatccgaata

SEQ ID NO: 302884 - DNA, 25 bp, Homo sapien
agtatgccaccatccgaatatcagg

SEQ ID NO: 302885 - DNA, 25 bp, Homo sapien
ccaccatccgaatatcaggcactga

SEQ ID NO: 302886 - DNA, 25 bp, Homo sapien
atccgaatatcaggcactgagtggg

SEQ ID NO: 302887 - DNA, 25 bp, Homo sapien
ggatgtgggtgatgctcacatgact

SEQ ID NO: 302888 - DNA, 25 bp, Homo sapien
tgggtgatgctcacatgactggcta

SEQ ID NO: 302889 - DNA, 25 bp, Homo sapien
gttaactactatttttttggccatg

SEQ ID NO: 302890 - DNA, 25 bp, Homo sapien
tttttggccatgatctctttcccct

SEQ ID NO: 302891 - DNA, 25 bp, Homo sapien
aagggctttgcattgagtccaacac

SEQ ID NO: 302892 - DNA, 25 bp, Homo sapien
gcattgagtccaacacataataatt

SEQ ID NO: 302893 - DNA, 25 bp, Homo sapien
aatgtcagagttgttttactaatct

SEQ ID NO: 302894 - DNA, 25 bp, Homo sapien
tactaatctgtcttccactttcctt

SEQ ID NO: 302895 - DNA, 25 bp, Homo sapien
ggactttgccttctctcttaatctg

SEQ ID NO: 302896 - DNA, 25 bp, Homo sapien
cttctctcttaatctgcacaggttg

SEQ ID NO: 302897 - DNA, 25 bp, Homo sapien
gcacaggttgccttttcctgccttt

SEQ ID NO: 302898 - DNA, 25 bp, Homo sapien
ctgccttttctatcaggtgacactc

SEQ ID NO: 302899 - DNA, 25 bp, Homo sapien
gtgacactccacttattcctcaaga

SEQ ID NO: 302900 - DNA, 25 bp, Homo sapien
gcttcagtctctgaacggagataat

SEQ ID NO: 302901 - DNA, 25 bp, Homo sapien
tccacatcagcggattgttttgagg

SEQ ID NO: 302902 - DNA, 25 bp, Homo sapien
acgccagtggcggtaatggtcttca

SEQ ID NO: 302903 - DNA, 25 bp, Homo sapien
taatggtcttcatcccgttggtggc

SEQ ID NO: 302904 - DNA, 25 bp, Homo sapien
gtggccacgcactggtagtagccag

SEQ ID NO: 302905 - DNA, 25 bp, Homo sapien
tagtagccagtgtctgtcgtgtcca

SEQ ID NO: 302906 - DNA, 25 bp, Homo sapien
aggtcctggattcgcagtcgtgaac

SEQ ID NO: 302907 - DNA, 25 bp, Homo sapien
agtcgtgaaccatattctgtcttcc

SEQ ID NO: 302908 - DNA, 25 bp, Homo sapien
atattctgtcttccggatgatgatc

SEQ ID NO: 302909 - DNA, 25 bp, Homo sapien
attctttagccaccgcacgttaggg

SEQ ID NO: 302910 - DNA, 25 bp, Homo sapien
gggtgggtttcctgccaccttgcag

SEQ ID NO: 302911 - DNA, 25 bp, Homo sapien
atgatttgggctgtgcgttggaccc

SEQ ID NO: 302912 - DNA, 25 bp, Homo sapien
agccgcacaaacaggacgccagtgg

SEQ ID NO: 302913 - DNA, 25 bp, Homo sapien
gcctctcgaaaaggaaaaccaccat

SEQ ID NO: 302914 - DNA, 25 bp, Homo sapien
ctctcgaaaaggaaaaccaccatct

SEQ ID NO: 302915 - DNA, 25 bp, Homo sapien
ccatctttcttttaaggctgttcct

SEQ ID NO: 302916 - DNA, 25 bp, Homo sapien
catctttcttttaaggctgttcctg

SEQ ID NO: 302917 - DNA, 25 bp, Homo sapien
atctttcttttaaggctgttcctgg

SEQ ID NO: 302918 - DNA, 25 bp, Homo sapien
tgagaggatggaattgtgtgcacaa

SEQ ID NO: 302919 - DNA, 25 bp, Homo sapien
agaggatggaattgtgtgcacaaga

SEQ ID NO: 302920 - DNA, 25 bp, Homo sapien
aggatggaattgtgtgcacaagaac

SEQ ID NO: 302921 - DNA, 25 bp, Homo sapien
ggatggaattgtgtgcacaagaact

SEQ ID NO: 302922 - DNA, 25 bp, Homo sapien
gatggaattgtgtgcacaagaactg

SEQ ID NO: 302923 - DNA, 25 bp, Homo sapien
atggaattgtgtgcacaagaactgt

SEQ ID NO: 302924 - DNA, 25 bp, Homo sapien
gtgtttgtttcatcagctgcataag

SEQ ID NO: 302925 - DNA, 25 bp, Homo sapien
aggaatccattccagtgcgcagtgt

SEQ ID NO: 302926 - DNA, 25 bp, Homo sapien
tgcgcagtgtgcaggctgtagctat

SEQ ID NO: 302927 - DNA, 25 bp, Homo sapien
cagaattagtgtgttggagctttaa

SEQ ID NO: 302928 - DNA, 25 bp, Homo sapien
aaatagttggcacatcgtctgccct

SEQ ID NO: 302929 - DNA, 25 bp, Homo sapien
atcgtctgccctttaaaagcacaag

SEQ ID NO: 302930 - DNA, 25 bp, Homo sapien
gagaccagttggttgtccttgtaat

SEQ ID NO: 302931 - DNA, 25 bp, Homo sapien
gtccttgtaatgttggccggatcca

SEQ ID NO: 302932 - DNA, 25 bp, Homo sapien
cagcccttgtcttttaacagctact

SEQ ID NO: 302933 - DNA, 25 bp, Homo sapien
ttaacagctactgctccgggctgtg

SEQ ID NO: 302934 - DNA, 25 bp, Homo sapien
gacttgactactctttggaggaagt

SEQ ID NO: 302935 - DNA, 25 bp, Homo sapien
tcgtggcgaacgggaccgtccttct

SEQ ID NO: 302936 - DNA, 25 bp, Homo sapien
cgcccgccggcggtgcgtgtgggaa

SEQ ID NO: 302937 - DNA, 25 bp, Homo sapien
ccggcggtgcgtgtgggaaggcgtg

SEQ ID NO: 302938 - DNA, 25 bp, Homo sapien
tcgctgtcgcctccagtggttgtcg

SEQ ID NO: 302939 - DNA, 25 bp, Homo sapien
gctgtcgcctccagtggttgtcgac

SEQ ID NO: 302940 - DNA, 25 bp, Homo sapien
tgtcgcctccagtggttgtcgactt

SEQ ID NO: 302941 - DNA, 25 bp, Homo sapien
tcgcctccagtggttgtcgacttgc

SEQ ID NO: 302942 - DNA, 25 bp, Homo sapien
gcctccagtggttgtcgacttgcgg

SEQ ID NO: 302943 - DNA, 25 bp, Homo sapien
ctccagtggttgtcgacttgcgggc

SEQ ID NO: 302944 - DNA, 25 bp, Homo sapien
agtggttgtcgacttgcgggcggcc

SEQ ID NO: 302945 - DNA, 25 bp, Homo sapien
tggttgtcgacttgcgggcggcccc

SEQ ID NO: 302946 - DNA, 25 bp, Homo sapien
atctaactgatgtgacaaagacctg

SEQ ID NO: 302947 - DNA, 25 bp, Homo sapien
gacaaagacctgatgtttaatctgt

SEQ ID NO: 302948 - DNA, 25 bp, Homo sapien
cctgatgtttaatctgtcagttcag

SEQ ID NO: 302949 - DNA, 25 bp, Homo sapien
gtcagttcagaaaatttggcacact

SEQ ID NO: 302950 - DNA, 25 bp, Homo sapien
atttcaatgttagctaagaccttaa

SEQ ID NO: 302951 - DNA, 25 bp, Homo sapien
agctaagaccttaacttactcgaat

SEQ ID NO: 302952 - DNA, 25 bp, Homo sapien
cttactcgaataaatatacctctag

SEQ ID NO: 302953 - DNA, 25 bp, Homo sapien
gaacagaatcttgctctagagaaaa

SEQ ID NO: 302954 - DNA, 25 bp, Homo sapien
gtgtttctgcaatattattcccaaa

SEQ ID NO: 302955 - DNA, 25 bp, Homo sapien
tttcttaatcatcatttaacctgac

SEQ ID NO: 302956 - DNA, 25 bp, Homo sapien
atttaacctgacatttctgctttat

SEQ ID NO: 302957 - DNA, 25 bp, Homo sapien
tagactctagtatttatgggtggat

SEQ ID NO: 302958 - DNA, 25 bp, Homo sapien
atgggtggatttatccttttgcctt

SEQ ID NO: 302959 - DNA, 25 bp, Homo sapien
atttatccttttgccttctggtata

SEQ ID NO: 302960 - DNA, 25 bp, Homo sapien
ttttgccttctggtatacttcctta

SEQ ID NO: 302961 - DNA, 25 bp, Homo sapien
tctggtatacttccttacttttaag

SEQ ID NO: 302962 - DNA, 25 bp, Homo sapien
aattgtaaaactccaaggtgatgtt

SEQ ID NO: 302963 - DNA, 25 bp, Homo sapien
aactccaaggtgatgttgtacctct

SEQ ID NO: 302964 - DNA, 25 bp, Homo sapien
gtgatgttgtacctcttttgcttgc

SEQ ID NO: 302965 - DNA, 25 bp, Homo sapien
tgttgtacctcttttgcttgccaaa

SEQ ID NO: 302966 - DNA, 25 bp, Homo sapien
acctcttttgcttgccaaagtacag

SEQ ID NO: 302967 - DNA, 25 bp, Homo sapien
ttgcttgccaaagtacagaatttga

SEQ ID NO: 302968 - DNA, 25 bp, Homo sapien
gaacttaaggcagctccaatcgaag

SEQ ID NO: 302969 - DNA, 25 bp, Homo sapien
agactgtcttggctgcttctggaaa

SEQ ID NO: 302970 - DNA, 25 bp, Homo sapien
aaactacagatcactactcccgaag

SEQ ID NO: 302971 - DNA, 25 bp, Homo sapien
accacggaacggatcagcgaggcca

SEQ ID NO: 302972 - DNA, 25 bp, Homo sapien
atcagcgaggccaagtacactacca

SEQ ID NO: 302973 - DNA, 25 bp, Homo sapien
acactaccaccatctggtcattggt

SEQ ID NO: 302974 - DNA, 25 bp, Homo sapien
catctggtcattggtcttcaggtaa

SEQ ID NO: 302975 - DNA, 25 bp, Homo sapien
taaaaggccttgacgaactcctgca

SEQ ID NO: 302976 - DNA, 25 bp, Homo sapien
ttgacgaactcctgcaggctgacat

SEQ ID NO: 302977 - DNA, 25 bp, Homo sapien
aggctgacatctggcagcaggttga

SEQ ID NO: 302978 - DNA, 25 bp, Homo sapien
tgaagacgtcctgcagctggtagat

SEQ ID NO: 302979 - DNA, 25 bp, Homo sapien
gccctgaacgcgaacgctcgaggtg

SEQ ID NO: 302980 - DNA, 25 bp, Homo sapien
gaacgctcgaggtggccgcgcgcag

SEQ ID NO: 302981 - DNA, 25 bp, Homo sapien
ggccgcgcgcaggtgtttcctcgta

SEQ ID NO: 302982 - DNA, 25 bp, Homo sapien
gcaggtgtttcctcgtaccgcaggg

SEQ ID NO: 302983 - DNA, 25 bp, Homo sapien
tgcgcgcgggccgtgtgagcgatcg

SEQ ID NO: 302984 - DNA, 25 bp, Homo sapien
tgagcgatcgcggtgggttcgggcc

SEQ ID NO: 302985 - DNA, 25 bp, Homo sapien
gttcgggccggtgtgacgcgtgcgc

SEQ ID NO: 302986 - DNA, 25 bp, Homo sapien
ttctgcctccgaccggtcgtgtgtg

SEQ ID NO: 302987 - DNA, 25 bp, Homo sapien
ggttgacttcggaggcgctctgcct

SEQ ID NO: 302988 - DNA, 25 bp, Homo sapien
acttcggaggcgctctgcctcggaa

SEQ ID NO: 302989 - DNA, 25 bp, Homo sapien
aggcgctctgcctcggaaggaagga

SEQ ID NO: 302990 - DNA, 25 bp, Homo sapien
tgcacctcgatggtgtcaggcttcc

SEQ ID NO: 302991 - DNA, 25 bp, Homo sapien
tgtcaggcttcctgcggcgcatata

SEQ ID NO: 302992 - DNA, 25 bp, Homo sapien
tgcggcgcatatacaactcatggtt

SEQ ID NO: 302993 - DNA, 25 bp, Homo sapien
atacaactcatggttgcccatgcag

SEQ ID NO: 302994 - DNA, 25 bp, Homo sapien
atggttgcccatgcagagctgcagg

SEQ ID NO: 302995 - DNA, 25 bp, Homo sapien
agagctgcaggatccgcttgttgat

SEQ ID NO: 302996 - DNA, 25 bp, Homo sapien
aggatccgcttgttgattctcagac

SEQ ID NO: 302997 - DNA, 25 bp, Homo sapien
ccgcttgttgattctcagacgtggg

SEQ ID NO: 302998 - DNA, 25 bp, Homo sapien
acaaagtcaggtgccttcttgtcga

SEQ ID NO: 302999 - DNA, 25 bp, Homo sapien
gtgccttcttgtcgatgggtttaat

SEQ ID NO: 303000 - DNA, 25 bp, Homo sapien
agatgttcctgatttcactccaagg

SEQ ID NO: 303001 - DNA, 25 bp, Homo sapien
gactgtatcctcaaacacgccgcag

SEQ ID NO: 303002 - DNA, 25 bp, Homo sapien
cacgccgcagcgacaatgaagtttc

SEQ ID NO: 303003 - DNA, 25 bp, Homo sapien
gccgcagcgacaatgaagtttctaa

SEQ ID NO: 303004 - DNA, 25 bp, Homo sapien
atgaagtttctaagctcaggtaaag

SEQ ID NO: 303005 - DNA, 25 bp, Homo sapien
aagccaaagcctaaagaaaagatga

SEQ ID NO: 303006 - DNA, 25 bp, Homo sapien
tgaagcactcgggaaggaagcagct

SEQ ID NO: 303007 - DNA, 25 bp, Homo sapien
aagcagcttgtgagagcagcacgcc

SEQ ID NO: 303008 - DNA, 25 bp, Homo sapien
cttgtgagagcagcacgccgtcgtg

SEQ ID NO: 303009 - DNA, 25 bp, Homo sapien
gccgtcgtgggcgagcgatcacaat

SEQ ID NO: 303010 - DNA, 25 bp, Homo sapien
tgggcgagcgatcacaattacaatg

SEQ ID NO: 303011 - DNA, 25 bp, Homo sapien
gcgagcgatcacaattacaatgcag

SEQ ID NO: 303012 - DNA, 25 bp, Homo sapien
tgggctctggccctgaatggagatg

SEQ ID NO: 303013 - DNA, 25 bp, Homo sapien
ctgcacgtggactatgtactccgta

SEQ ID NO: 303014 - DNA, 25 bp, Homo sapien
tggactatgtactccgtatcctcct

SEQ ID NO: 303015 - DNA, 25 bp, Homo sapien
gtggtgttcacctcctggatgaagc

SEQ ID NO: 303016 - DNA, 25 bp, Homo sapien
tggatgaagcgcagcatccgcacat

SEQ ID NO: 303017 - DNA, 25 bp, Homo sapien
catccttcttctgctgggagatggc

SEQ ID NO: 303018 - DNA, 25 bp, Homo sapien
gagatggcaaatccgatgacaacct

SEQ ID NO: 303019 - DNA, 25 bp, Homo sapien
gcaaatccgatgacaacctcatcct

SEQ ID NO: 303020 - DNA, 25 bp, Homo sapien
catctctttcatggttacctcatct

SEQ ID NO: 303021 - DNA, 25 bp, Homo sapien
tggttacctcatctttgttcttgga

SEQ ID NO: 303022 - DNA, 25 bp, Homo sapien
tcatctttgttcttggaggccatct

SEQ ID NO: 303023 - DNA, 25 bp, Homo sapien
gtggaccccgtggtctccttccctg

SEQ ID NO: 303024 - DNA, 25 bp, Homo sapien
ggaccccgtggtctccttccctgtg

SEQ ID NO: 303025 - DNA, 25 bp, Homo sapien
tggctctcagctgtcgctgtggacc

SEQ ID NO: 303026 - DNA, 25 bp, Homo sapien
ggctctcagctgtcgctgtggaccc

SEQ ID NO: 303027 - DNA, 25 bp, Homo sapien
gctctcagctgtcgctgtggaccct

SEQ ID NO: 303028 - DNA, 25 bp, Homo sapien
tcgctgtggaccctgccgccgcagc

SEQ ID NO: 303029 - DNA, 25 bp, Homo sapien
gctgtggaccctgccgccgcagcac

SEQ ID NO: 303030 - DNA, 25 bp, Homo sapien
tcttcctctaaagaccctccccgca

SEQ ID NO: 303031 - DNA, 25 bp, Homo sapien
tccatcccgactcctggagccctga

SEQ ID NO: 303032 - DNA, 25 bp, Homo sapien
atcccgactcctggagccctgacac

SEQ ID NO: 303033 - DNA, 25 bp, Homo sapien
actcctggagccctgacaccccgat

SEQ ID NO: 303034 - DNA, 25 bp, Homo sapien
aagcaggttttgatgatgatggttc

SEQ ID NO: 303035 - DNA, 25 bp, Homo sapien
gatggttcagaatttcatgaacata

SEQ ID NO: 303036 - DNA, 25 bp, Homo sapien
catgaacatatatttctggagaaac

SEQ ID NO: 303037 - DNA, 25 bp, Homo sapien
tatattcacagggaaaagacttaat

SEQ ID NO: 303038 - DNA, 25 bp, Homo sapien
atatttttgacatgatggcagttac

SEQ ID NO: 303039 - DNA, 25 bp, Homo sapien
ttgacatgatggcagttactaaaga

SEQ ID NO: 303040 - DNA, 25 bp, Homo sapien
ggaatttgctaagcagttagccaca

SEQ ID NO: 303041 - DNA, 25 bp, Homo sapien
aagcagttagccacagtaaatgaac

SEQ ID NO: 303042 - DNA, 25 bp, Homo sapien
agccacagtaaatgaacaacccctt

SEQ ID NO: 303043 - DNA, 25 bp, Homo sapien
gaacaaccccttcagaatggatttg

SEQ ID NO: 303044 - DNA, 25 bp, Homo sapien
acaaccccttcagaatggatttgaa

SEQ ID NO: 303045 - DNA, 25 bp, Homo sapien
tattccgggcgtcttggtagtttct

SEQ ID NO: 303046 - DNA, 25 bp, Homo sapien
tcttggtagtttctggtgggattca

SEQ ID NO: 303047 - DNA, 25 bp, Homo sapien
cagaacttgaagtttctcccactgc

SEQ ID NO: 303048 - DNA, 25 bp, Homo sapien
ctccagtggtctcccaggtgccaga

SEQ ID NO: 303049 - DNA, 25 bp, Homo sapien
ggtgccagacccaaaagcttttcct

SEQ ID NO: 303050 - DNA, 25 bp, Homo sapien
gacccaaaagcttttcctacagtga

SEQ ID NO: 303051 - DNA, 25 bp, Homo sapien
agcttttcctacagtgatacccttt

SEQ ID NO: 303052 - DNA, 25 bp, Homo sapien
tcctacagtgataccctttattttt

SEQ ID NO: 303053 - DNA, 25 bp, Homo sapien
ttatttttacttccccttgactcat

SEQ ID NO: 303054 - DNA, 25 bp, Homo sapien
acttccccttgactcatatgtttta

SEQ ID NO: 303055 - DNA, 25 bp, Homo sapien
ccccttgactcatatgttttaacat

SEQ ID NO: 303056 - DNA, 25 bp, Homo sapien
gttatcttaaaagatctgccttagc

SEQ ID NO: 303057 - DNA, 25 bp, Homo sapien
tgatctttaaattttcccacaccat

SEQ ID NO: 303058 - DNA, 25 bp, Homo sapien
taaattttcccacaccataagagag

SEQ ID NO: 303059 - DNA, 25 bp, Homo sapien
ttttcccacaccataagagaggagc

SEQ ID NO: 303060 - DNA, 25 bp, Homo sapien
attaccagtttagactaagttacag

SEQ ID NO: 303061 - DNA, 25 bp, Homo sapien
gactaagttacagtatgtgtttcat

SEQ ID NO: 303062 - DNA, 25 bp, Homo sapien
acagtatgtgtttcataagtgatta

SEQ ID NO: 303063 - DNA, 25 bp, Homo sapien
gattaaagctatatcattcccagtt

SEQ ID NO: 303064 - DNA, 25 bp, Homo sapien
aagctatatcattcccagttattag

SEQ ID NO: 303065 - DNA, 25 bp, Homo sapien
atcattcccagttattagttaacac

SEQ ID NO: 303066 - DNA, 25 bp, Homo sapien
gttaacacaaattcagccacattct

SEQ ID NO: 303067 - DNA, 25 bp, Homo sapien
tatttctttcccaggaaattagctt

SEQ ID NO: 303068 - DNA, 25 bp, Homo sapien
gaaattagctttccagcccctttat

SEQ ID NO: 303069 - DNA, 25 bp, Homo sapien
gctttccagcccctttatatattgg

SEQ ID NO: 303070 - DNA, 25 bp, Homo sapien
aagttgttttagcttctgcagaagt

SEQ ID NO: 303071 - DNA, 25 bp, Homo sapien
aaagctgaagcggttcattgctatt

SEQ ID NO: 303072 - DNA, 25 bp, Homo sapien
agcggttcattgctattattgcagt

SEQ ID NO: 303073 - DNA, 25 bp, Homo sapien
tattgcagtgtcatgttctgtaata

SEQ ID NO: 303074 - DNA, 25 bp, Homo sapien
actttgcaaaacacaccaagtttgg

SEQ ID NO: 303075 - DNA, 25 bp, Homo sapien
tgatcaacggacttatctcagctct

SEQ ID NO: 303076 - DNA, 25 bp, Homo sapien
tcagctctcctaggaactaaaatgc

SEQ ID NO: 303077 - DNA, 25 bp, Homo sapien
gaactaaaatgccagggccaggctg

SEQ ID NO: 303078 - DNA, 25 bp, Homo sapien
ctaggcttgctttatcatcacatcc

SEQ ID NO: 303079 - DNA, 25 bp, Homo sapien
tttatcatcacatcccaaggccaga

SEQ ID NO: 303080 - DNA, 25 bp, Homo sapien
atcatcacatcccaaggccagaggg

SEQ ID NO: 303081 - DNA, 25 bp, Homo sapien
tggcagttatgacaggaaggctctc

SEQ ID NO: 303082 - DNA, 25 bp, Homo sapien
aggaaggctctctatacctggctcc

SEQ ID NO: 303083 - DNA, 25 bp, Homo sapien
ctatacctggctccccagtgttctg

SEQ ID NO: 303084 - DNA, 25 bp, Homo sapien
gcccctggcactgagcatgaggagc

SEQ ID NO: 303085 - DNA, 25 bp, Homo sapien
aacctggtccattttccacaggtag

SEQ ID NO: 303086 - DNA, 25 bp, Homo sapien
cattttccacaggtagctttcttga

SEQ ID NO: 303087 - DNA, 25 bp, Homo sapien
tccacaggtagctttcttgaactca

SEQ ID NO: 303088 - DNA, 25 bp, Homo sapien
gtagctttcttgaactcaccttgac

SEQ ID NO: 303089 - DNA, 25 bp, Homo sapien
atttcctaactctatcagataaact

SEQ ID NO: 303090 - DNA, 25 bp, Homo sapien
ctaactctatcagataaactcatct

SEQ ID NO: 303091 - DNA, 25 bp, Homo sapien
gataaactcatctttagtataaata

SEQ ID NO: 303092 - DNA, 25 bp, Homo sapien
aaataagcattatttgcaggttgcc

SEQ ID NO: 303093 - DNA, 25 bp, Homo sapien
gtaagtaacctaacccatgtttcag

SEQ ID NO: 303094 - DNA, 25 bp, Homo sapien
taagtaacctaacccatgtttcagc

SEQ ID NO: 303095 - DNA, 25 bp, Homo sapien
agtaacctaacccatgtttcagctt

SEQ ID NO: 303096 - DNA, 25 bp, Homo sapien
tttaggtgattcttagtaactccag

SEQ ID NO: 303097 - DNA, 25 bp, Homo sapien
ttaggtgattcttagtaactccagt

SEQ ID NO: 303098 - DNA, 25 bp, Homo sapien
aggtgattcttagtaactccagtag

SEQ ID NO: 303099 - DNA, 25 bp, Homo sapien
ggtgattcttagtaactccagtagc

SEQ ID NO: 303100 - DNA, 25 bp, Homo sapien
tgtctgaacagaaccgctccgtgac

SEQ ID NO: 303101 - DNA, 25 bp, Homo sapien
ctccgtgactggtagctgggtctga

SEQ ID NO: 303102 - DNA, 25 bp, Homo sapien
ggattcaggattgtggcgttattca

SEQ ID NO: 303103 - DNA, 25 bp, Homo sapien
gactttgaaattccccgatggctgg

SEQ ID NO: 303104 - DNA, 25 bp, Homo sapien
aatgtggagcccaggtgcctctggt

SEQ ID NO: 303105 - DNA, 25 bp, Homo sapien
gcttttccagactgtggttgtgaac

SEQ ID NO: 303106 - DNA, 25 bp, Homo sapien
gtgaaccggctccttctccaagaaa

SEQ ID NO: 303107 - DNA, 25 bp, Homo sapien
gaacatccagaggtgagactcagac

SEQ ID NO: 303108 - DNA, 25 bp, Homo sapien
gtgactgcatttagggaggtttaac

SEQ ID NO: 303109 - DNA, 25 bp, Homo sapien
gagttcttactgatcattccacttg

SEQ ID NO: 303110 - DNA, 25 bp, Homo sapien
gatcattccacttgttactggttaa

SEQ ID NO: 303111 - DNA, 25 bp, Homo sapien
gcgcttacctacctttccgaaacat

SEQ ID NO: 303112 - DNA, 25 bp, Homo sapien
cctccagaagagaagacgagctgtc

SEQ ID NO: 303113 - DNA, 25 bp, Homo sapien
agaagagaagacgagctgtcggctc

SEQ ID NO: 303114 - DNA, 25 bp, Homo sapien
aagagaagacgagctgtcggctccg

SEQ ID NO: 303115 - DNA, 25 bp, Homo sapien
atttcaacccggatcctcttcgcac

SEQ ID NO: 303116 - DNA, 25 bp, Homo sapien
atcctcttcgcacactcagcgcctg

SEQ ID NO: 303117 - DNA, 25 bp, Homo sapien
gaacggagggatgttcagtctatcc

SEQ ID NO: 303118 - DNA, 25 bp, Homo sapien
acggagggatgttcagtctatccgg

SEQ ID NO: 303119 - DNA, 25 bp, Homo sapien
ggagggatgttcagtctatccggag

SEQ ID NO: 303120 - DNA, 25 bp, Homo sapien
tctccggctccggactgcgggaaag

SEQ ID NO: 303121 - DNA, 25 bp, Homo sapien
ctccggctccggactgcgggaaagc

SEQ ID NO: 303122 - DNA, 25 bp, Homo sapien
taatttgggcttctcaggcccagct

SEQ ID NO: 303123 - DNA, 25 bp, Homo sapien
tttgggcttctcaggcccagctcct

SEQ ID NO: 303124 - DNA, 25 bp, Homo sapien
tcctgccttctgttggcctctacag

SEQ ID NO: 303125 - DNA, 25 bp, Homo sapien
tacaggcctggcatcatcctttcaa

SEQ ID NO: 303126 - DNA, 25 bp, Homo sapien
atcatcctttcaacagcctctttag

SEQ ID NO: 303127 - DNA, 25 bp, Homo sapien
catcctttcaacagcctctttaggc

SEQ ID NO: 303128 - DNA, 25 bp, Homo sapien
tttcaacagcctctttaggcccggc

SEQ ID NO: 303129 - DNA, 25 bp, Homo sapien
tctccaggaccaaaacatccttaag

SEQ ID NO: 303130 - DNA, 25 bp, Homo sapien
caaaacatccttaagtcaacctcac

SEQ ID NO: 303131 - DNA, 25 bp, Homo sapien
agccccagcttttgcctgccaatgg

SEQ ID NO: 303132 - DNA, 25 bp, Homo sapien
ttttgcctgccaatggcctctctag

SEQ ID NO: 303133 - DNA, 25 bp, Homo sapien
ggtagggcatccgtgaagttcaatg

SEQ ID NO: 303134 - DNA, 25 bp, Homo sapien
gtagggcatccgtgaagttcaatgg

SEQ ID NO: 303135 - DNA, 25 bp, Homo sapien
tagggcatccgtgaagttcaatggg

SEQ ID NO: 303136 - DNA, 25 bp, Homo sapien
gtgaagttcaatggggcggcaccca

SEQ ID NO: 303137 - DNA, 25 bp, Homo sapien
ccatcatgactggcggcaaggatgt

SEQ ID NO: 303138 - DNA, 25 bp, Homo sapien
ctggcggcaaggatgtgggctggtc

SEQ ID NO: 303139 - DNA, 25 bp, Homo sapien
aaggatgtgggctggtccctcggtt

SEQ ID NO: 303140 - DNA, 25 bp, Homo sapien
tgggctggtccctcggttaaggacg

SEQ ID NO: 303141 - DNA, 25 bp, Homo sapien
tctcccttcccactttgggtggaag

SEQ ID NO: 303142 - DNA, 25 bp, Homo sapien
ttcccactttgggtggaagttgagg

SEQ ID NO: 303143 - DNA, 25 bp, Homo sapien
tcccactttgggtggaagttgaggc

SEQ ID NO: 303144 - DNA, 25 bp, Homo sapien
ttattgatctaacctttgaagcttt

SEQ ID NO: 303145 - DNA, 25 bp, Homo sapien
tgggaaactggcatactgtgtgtat

SEQ ID NO: 303146 - DNA, 25 bp, Homo sapien
tactgtgtgtatagcactgccgatt

SEQ ID NO: 303147 - DNA, 25 bp, Homo sapien
atagcactgccgattggctaggcca

SEQ ID NO: 303148 - DNA, 25 bp, Homo sapien
gccgattggctaggccactgtgtct

SEQ ID NO: 303149 - DNA, 25 bp, Homo sapien
gtgtctctgctacaaattaaagaaa

SEQ ID NO: 303150 - DNA, 25 bp, Homo sapien
gtatgtacagagtagaccatctcta

SEQ ID NO: 303151 - DNA, 25 bp, Homo sapien
agagtagaccatctctagccctgtg

SEQ ID NO: 303152 - DNA, 25 bp, Homo sapien
ccatctctagccctgtggtgaaaga

SEQ ID NO: 303153 - DNA, 25 bp, Homo sapien
agccctgtggtgaaagaggtacact

SEQ ID NO: 303154 - DNA, 25 bp, Homo sapien
gaggtacactcgaatgtttgcataa

SEQ ID NO: 303155 - DNA, 25 bp, Homo sapien
atacaaagaagggaaccgcagacac

SEQ ID NO: 303156 - DNA, 25 bp, Homo sapien
gcctacctgaggtcggagcatggaa

SEQ ID NO: 303157 - DNA, 25 bp, Homo sapien
acctatctggtactatgctttttat

SEQ ID NO: 303158 - DNA, 25 bp, Homo sapien
ctatgctttttatctggatgatgaa

SEQ ID NO: 303159 - DNA, 25 bp, Homo sapien
caacaaaccctggtgacatgcaatt

SEQ ID NO: 303160 - DNA, 25 bp, Homo sapien
acaaaccctggtgacatgcaattta

SEQ ID NO: 303161 - DNA, 25 bp, Homo sapien
atttacctatatagcaagcctacac

SEQ ID NO: 303162 - DNA, 25 bp, Homo sapien
ggaagccattatcctaaatgaactc

SEQ ID NO: 303163 - DNA, 25 bp, Homo sapien
gccattatcctaaatgaactcactc

SEQ ID NO: 303164 - DNA, 25 bp, Homo sapien
tatcctaaatgaactcactcagaaa

SEQ ID NO: 303165 - DNA, 25 bp, Homo sapien
atgaactcactcagaaacagaaaac

SEQ ID NO: 303166 - DNA, 25 bp, Homo sapien
aagaagtgggcttgccccctgagcc

SEQ ID NO: 303167 - DNA, 25 bp, Homo sapien
gcctgcccatacagaggcccatgca

SEQ ID NO: 303168 - DNA, 25 bp, Homo sapien
cttggcccctgaacagactcgaagg

SEQ ID NO: 303169 - DNA, 25 bp, Homo sapien
cctgaacagactcgaagggtcacga

SEQ ID NO: 303170 - DNA, 25 bp, Homo sapien
gaagggtcacgaggaacagcagcac

SEQ ID NO: 303171 - DNA, 25 bp, Homo sapien
ggtcacgaggaacagcagcacccag

SEQ ID NO: 303172 - DNA, 25 bp, Homo sapien
gttcagtgacaaagtgctctaccat

SEQ ID NO: 303173 - DNA, 25 bp, Homo sapien
gtgacaaagtgctctaccatgctct

SEQ ID NO: 303174 - DNA, 25 bp, Homo sapien
aagtgctctaccatgctctgtgctg

SEQ ID NO: 303175 - DNA, 25 bp, Homo sapien
tctaccatgctctgtgctgtgacga

SEQ ID NO: 303176 - DNA, 25 bp, Homo sapien
accatgctctgtgctgtgacgatga

SEQ ID NO: 303177 - DNA, 25 bp, Homo sapien
gggtccctggtgcactgacctatct

SEQ ID NO: 303178 - DNA, 25 bp, Homo sapien
tggtgcactgacctatctgggatag

SEQ ID NO: 303179 - DNA, 25 bp, Homo sapien
cctatctgggataggcagtaccctg

SEQ ID NO: 303180 - DNA, 25 bp, Homo sapien
accaaacatttcactgagaaagccc

SEQ ID NO: 303181 - DNA, 25 bp, Homo sapien
cagtgcgctctgaccttctcttcat

SEQ ID NO: 303182 - DNA, 25 bp, Homo sapien
tctcttcatgtgtgtaaatctgtaa

SEQ ID NO: 303183 - DNA, 25 bp, Homo sapien
aatctgtaatataccattctctgtg

SEQ ID NO: 303184 - DNA, 25 bp, Homo sapien
gtaatataccattctctgtggcctg

SEQ ID NO: 303185 - DNA, 25 bp, Homo sapien
aatataccattctctgtggcctgtt

SEQ ID NO: 303186 - DNA, 25 bp, Homo sapien
tataccattctctgtggcctgtttt

SEQ ID NO: 303187 - DNA, 25 bp, Homo sapien
ggcaggccatctttttttgtactta

SEQ ID NO: 303188 - DNA, 25 bp, Homo sapien
gcagataaataatggagcatgcagt

SEQ ID NO: 303189 - DNA, 25 bp, Homo sapien
cagataaataatggagcatgcagtg

SEQ ID NO: 303190 - DNA, 25 bp, Homo sapien
tagctgacgataatcacaccttttc

SEQ ID NO: 303191 - DNA, 25 bp, Homo sapien
agctgacgataatcacaccttttcc

SEQ ID NO: 303192 - DNA, 25 bp, Homo sapien
gctgacgataatcacaccttttccc

SEQ ID NO: 303193 - DNA, 25 bp, Homo sapien
ctgacgataatcacaccttttcccc

SEQ ID NO: 303194 - DNA, 25 bp, Homo sapien
tgacgataatcacaccttttccccc

SEQ ID NO: 303195 - DNA, 25 bp, Homo sapien
gacgataatcacaccttttcccccg

SEQ ID NO: 303196 - DNA, 25 bp, Homo sapien
gataatcacaccttttcccccgtct

SEQ ID NO: 303197 - DNA, 25 bp, Homo sapien
tctgaaaaattgtaaatctgatcat

SEQ ID NO: 303198 - DNA, 25 bp, Homo sapien
ttttttacgctaaccattgtttctg

SEQ ID NO: 303199 - DNA, 25 bp, Homo sapien
tcccgcgatggcgtttctcgtgttt

SEQ ID NO: 303200 - DNA, 25 bp, Homo sapien
gatggcgtttctcgtgtttttcttt

SEQ ID NO: 303201 - DNA, 25 bp, Homo sapien
gcgtttctcgtgtttttcttttctg

SEQ ID NO: 303202 - DNA, 25 bp, Homo sapien
gtttttcttttctggatgatataaa

SEQ ID NO: 303203 - DNA, 25 bp, Homo sapien
tataaatattgaccgcacactcctg

SEQ ID NO: 303204 - DNA, 25 bp, Homo sapien
aatattgaccgcacactcctgcttg

SEQ ID NO: 303205 - DNA, 25 bp, Homo sapien
ctgcttgctccgggttttctctggg

SEQ ID NO: 303206 - DNA, 25 bp, Homo sapien
gtcccaagagcgcagtggccttggg

SEQ ID NO: 303207 - DNA, 25 bp, Homo sapien
ggtgacccgagagcgcaaaggcggc

SEQ ID NO: 303208 - DNA, 25 bp, Homo sapien
gcttcccaagctttatttattgcca

SEQ ID NO: 303209 - DNA, 25 bp, Homo sapien
tattgccaaatttgggcggcctcgc

SEQ ID NO: 303210 - DNA, 25 bp, Homo sapien
caagttgtagcggtcgctcgcctgg

SEQ ID NO: 303211 - DNA, 25 bp, Homo sapien
gcccagcgcggcaaggagcgagtgt

SEQ ID NO: 303212 - DNA, 25 bp, Homo sapien
caaggagcgagtgtgtgcacgcaga

SEQ ID NO: 303213 - DNA, 25 bp, Homo sapien
cgagtgtgtgcacgcagagggccgg

SEQ ID NO: 303214 - DNA, 25 bp, Homo sapien
tgtaccaaccaccttctcaagttgt

SEQ ID NO: 303215 - DNA, 25 bp, Homo sapien
taccaaccaccttctcaagttgtag

SEQ ID NO: 303216 - DNA, 25 bp, Homo sapien
aaccaccttctcaagttgtagcggt

SEQ ID NO: 303217 - DNA, 25 bp, Homo sapien
accaccttctcaagttgtagcggtc

SEQ ID NO: 303218 - DNA, 25 bp, Homo sapien
accttctcaagttgtagcggtcgct

SEQ ID NO: 303219 - DNA, 25 bp, Homo sapien
cttctcaagttgtagcggtcgctcg

SEQ ID NO: 303220 - DNA, 25 bp, Homo sapien
ttctcaagttgtagcggtcgctcgc

SEQ ID NO: 303221 - DNA, 25 bp, Homo sapien
tgaaacctctaaatgtcaacaatga

SEQ ID NO: 303222 - DNA, 25 bp, Homo sapien
actggattttcttaagagccactct

SEQ ID NO: 303223 - DNA, 25 bp, Homo sapien
gagccactctcttcttttggtaaga

SEQ ID NO: 303224 - DNA, 25 bp, Homo sapien
atacatatacagcagggctcctcgt

SEQ ID NO: 303225 - DNA, 25 bp, Homo sapien
ggctcctcgtctccaagagagacat

SEQ ID NO: 303226 - DNA, 25 bp, Homo sapien
gagagacattccagtagctcatccc

SEQ ID NO: 303227 - DNA, 25 bp, Homo sapien
attccagtagctcatccccaagcaa

SEQ ID NO: 303228 - DNA, 25 bp, Homo sapien
caaattgcagtgttttggatgcata

SEQ ID NO: 303229 - DNA, 25 bp, Homo sapien
tcctttactaaaatttctggttctg

SEQ ID NO: 303230 - DNA, 25 bp, Homo sapien
aattcaactccagaccttttgatcc

SEQ ID NO: 303231 - DNA, 25 bp, Homo sapien
gaccttttgatccactactcttagt

SEQ ID NO: 303232 - DNA, 25 bp, Homo sapien
gtcatcaagggtacctcagaaaggt

SEQ ID NO: 303233 - DNA, 25 bp, Homo sapien
cctcagaaaggttaacaatgcattt

SEQ ID NO: 303234 - DNA, 25 bp, Homo sapien
taacaatgcatttggtggaagagca

SEQ ID NO: 303235 - DNA, 25 bp, Homo sapien
gagcattcagtagtagatccaacat

SEQ ID NO: 303236 - DNA, 25 bp, Homo sapien
gatccaacattcatagaagactttc

SEQ ID NO: 303237 - DNA, 25 bp, Homo sapien
gaagactttctgttgacctatagga

SEQ ID NO: 303238 - DNA, 25 bp, Homo sapien
tctgttgacctataggacttttctt

SEQ ID NO: 303239 - DNA, 25 bp, Homo sapien
ggacttttctttctagcccaatgga

SEQ ID NO: 303240 - DNA, 25 bp, Homo sapien
cttttctttctagcccaatggaagt

SEQ ID NO: 303241 - DNA, 25 bp, Homo sapien
gagtggtttaatgacccgagcctca

SEQ ID NO: 303242 - DNA, 25 bp, Homo sapien
tgacccgagcctcagggataaggtt

SEQ ID NO: 303243 - DNA, 25 bp, Homo sapien
gctctaactaacttcagggaaattg

SEQ ID NO: 303244 - DNA, 25 bp, Homo sapien
ctaacttcagggaaattggaacaat

SEQ ID NO: 303245 - DNA, 25 bp, Homo sapien
taagttatgttacatgcacactcaa

SEQ ID NO: 303246 - DNA, 25 bp, Homo sapien
tctctctctgtctgcatgcatatta

SEQ ID NO: 303247 - DNA, 25 bp, Homo sapien
gtctgcatgcatattaaagtggaaa

SEQ ID NO: 303248 - DNA, 25 bp, Homo sapien
atatcttagttattaccatagtacc

SEQ ID NO: 303249 - DNA, 25 bp, Homo sapien
accatagtacctatgaaccttatca

SEQ ID NO: 303250 - DNA, 25 bp, Homo sapien
ttgactggtgttacagctgctatta

SEQ ID NO: 303251 - DNA, 25 bp, Homo sapien
tacagctgctattaatctaagtcta

SEQ ID NO: 303252 - DNA, 25 bp, Homo sapien
gctgctattaatctaagtctattgt

SEQ ID NO: 303253 - DNA, 25 bp, Homo sapien
aatctaagtctattgtttttctatt

SEQ ID NO: 303254 - DNA, 25 bp, Homo sapien
tggccatcctccaggtcactgcggg

SEQ ID NO: 303255 - DNA, 25 bp, Homo sapien
agggagagctgatctcaggtaagct

SEQ ID NO: 303256 - DNA, 25 bp, Homo sapien
gctgatctcaggtaagcttagccct

SEQ ID NO: 303257 - DNA, 25 bp, Homo sapien
gatctcaggtaagcttagccctgac

SEQ ID NO: 303258 - DNA, 25 bp, Homo sapien
caggtaagcttagccctgacctctg

SEQ ID NO: 303259 - DNA, 25 bp, Homo sapien
tgacctctgactctgacattgttca

SEQ ID NO: 303260 - DNA, 25 bp, Homo sapien
acctctgactctgacattgttcatt

SEQ ID NO: 303261 - DNA, 25 bp, Homo sapien
gactctgacattgttcatttgactt

SEQ ID NO: 303262 - DNA, 25 bp, Homo sapien
gacattgttcatttgactttccaca

SEQ ID NO: 303263 - DNA, 25 bp, Homo sapien
attgttcatttgactttccacaggg

SEQ ID NO: 303264 - DNA, 25 bp, Homo sapien
atttgactttccacaggggcactgc

SEQ ID NO: 303265 - DNA, 25 bp, Homo sapien
ttattgggtattatgaccttttcta

SEQ ID NO: 303266 - DNA, 25 bp, Homo sapien
gtgggggttctcatttgtataatcc

SEQ ID NO: 303267 - DNA, 25 bp, Homo sapien
gggggttctcatttgtataatccta

SEQ ID NO: 303268 - DNA, 25 bp, Homo sapien
ggcctaacctacattaacatgttgg

SEQ ID NO: 303269 - DNA, 25 bp, Homo sapien
gcctaacctacattaacatgttggc

SEQ ID NO: 303270 - DNA, 25 bp, Homo sapien
taacatgttggcagaccattttaaa

SEQ ID NO: 303271 - DNA, 25 bp, Homo sapien
aacatgttggcagaccattttaaaa

SEQ ID NO: 303272 - DNA, 25 bp, Homo sapien
acatgttggcagaccattttaaaac

SEQ ID NO: 303273 - DNA, 25 bp, Homo sapien
catgttggcagaccattttaaaact

SEQ ID NO: 303274 - DNA, 25 bp, Homo sapien
atgttggcagaccattttaaaactt

SEQ ID NO: 303275 - DNA, 25 bp, Homo sapien
tgttggcagaccattttaaaacttt

SEQ ID NO: 303276 - DNA, 25 bp, Homo sapien
gtatacaatcattgtttctgtaatg

SEQ ID NO: 303277 - DNA, 25 bp, Homo sapien
attgtttctgtaatgatgatgggta

SEQ ID NO: 303278 - DNA, 25 bp, Homo sapien
aatgatgatgggtattctgcttctt

SEQ ID NO: 303279 - DNA, 25 bp, Homo sapien
gatgatgggtattctgcttcttgtt

SEQ ID NO: 303280 - DNA, 25 bp, Homo sapien
tgatgggtattctgcttcttgtttt

SEQ ID NO: 303281 - DNA, 25 bp, Homo sapien
tgcttcttgtttttcattgtaatta

SEQ ID NO: 303282 - DNA, 25 bp, Homo sapien
aaaatgtatattgccatgcttttgg

SEQ ID NO: 303283 - DNA, 25 bp, Homo sapien
gtgttgcctaagaataccctaaagc

SEQ ID NO: 303284 - DNA, 25 bp, Homo sapien
gttgcctaagaataccctaaagcta

SEQ ID NO: 303285 - DNA, 25 bp, Homo sapien
aagaataccctaaagctatggctgt

SEQ ID NO: 303286 - DNA, 25 bp, Homo sapien
ataccctaaagctatggctgttact

SEQ ID NO: 303287 - DNA, 25 bp, Homo sapien
tatataatttgccttggatttattg

SEQ ID NO: 303288 - DNA, 25 bp, Homo sapien
atataatttgccttggatttattgt

SEQ ID NO: 303289 - DNA, 25 bp, Homo sapien
tataatttgccttggatttattgtg

SEQ ID NO: 303290 - DNA, 25 bp, Homo sapien
ataatttgccttggatttattgtgc

SEQ ID NO: 303291 - DNA, 25 bp, Homo sapien
taatttgccttggatttattgtgca

SEQ ID NO: 303292 - DNA, 25 bp, Homo sapien
gcacagtttgttgagttgtatgttt

SEQ ID NO: 303293 - DNA, 25 bp, Homo sapien
cacagtttgttgagttgtatgtttt

SEQ ID NO: 303294 - DNA, 25 bp, Homo sapien
acagtttgttgagttgtatgttttt

SEQ ID NO: 303295 - DNA, 25 bp, Homo sapien
gttcgacccggaccgctgctggttt

SEQ ID NO: 303296 - DNA, 25 bp, Homo sapien
cggagttgaaccagccggcgcgcct

SEQ ID NO: 303297 - DNA, 25 bp, Homo sapien
cgcgcctcacactgggccgttggga

SEQ ID NO: 303298 - DNA, 25 bp, Homo sapien
gccgctagcctctcaaggctggaag

SEQ ID NO: 303299 - DNA, 25 bp, Homo sapien
ctcaaggctggaagagtcgacgcgc

SEQ ID NO: 303300 - DNA, 25 bp, Homo sapien
gtcgggaccacttctccatcgagcg

SEQ ID NO: 303301 - DNA, 25 bp, Homo sapien
aggcgccagcggtgcgaaagctctc

SEQ ID NO: 303302 - DNA, 25 bp, Homo sapien
agcggtgcgaaagctctcgtctaag

SEQ ID NO: 303303 - DNA, 25 bp, Homo sapien
gcgaaagctctcgtctaagggcagc

SEQ ID NO: 303304 - DNA, 25 bp, Homo sapien
gctctcgtctaagggcagctttgct

SEQ ID NO: 303305 - DNA, 25 bp, Homo sapien
tgctgcacgcactacaggaggctgc

SEQ ID NO: 303306 - DNA, 25 bp, Homo sapien
ggttctctttgaggcctctcctaaa

SEQ ID NO: 303307 - DNA, 25 bp, Homo sapien
gacggtgagctcaggttgctccagc

SEQ ID NO: 303308 - DNA, 25 bp, Homo sapien
ggtgagctcaggttgctccagcaga

SEQ ID NO: 303309 - DNA, 25 bp, Homo sapien
gcagagccaaggcttaaagccagaa

SEQ ID NO: 303310 - DNA, 25 bp, Homo sapien
ggcttaaagccagaaccactacaaa

SEQ ID NO: 303311 - DNA, 25 bp, Homo sapien
gccagaaccactacaaagtttagag

SEQ ID NO: 303312 - DNA, 25 bp, Homo sapien
ttgctggagcaaacctctttttccc

SEQ ID NO: 303313 - DNA, 25 bp, Homo sapien
agctgcaccattgagcccttaatgg

SEQ ID NO: 303314 - DNA, 25 bp, Homo sapien
atcctttgtcactggagtgaagcct

SEQ ID NO: 303315 - DNA, 25 bp, Homo sapien
gagtgaagccttatagcaagcagag

SEQ ID NO: 303316 - DNA, 25 bp, Homo sapien
cttatagcaagcagagagtgaggcc

SEQ ID NO: 303317 - DNA, 25 bp, Homo sapien
tgttggcccggacaaaaaataacat

SEQ ID NO: 303318 - DNA, 25 bp, Homo sapien
ttttggcactaacagtgtgatctgt

SEQ ID NO: 303319 - DNA, 25 bp, Homo sapien
ctaacagtgtgatctgtagcaagaa

SEQ ID NO: 303320 - DNA, 25 bp, Homo sapien
gaaagataagcagtctgttcgaact

SEQ ID NO: 303321 - DNA, 25 bp, Homo sapien
tctgttcgaactgaggagacttcca

SEQ ID NO: 303322 - DNA, 25 bp, Homo sapien
ctgaggagacttccaaggagacttc

SEQ ID NO: 303323 - DNA, 25 bp, Homo sapien
cttcagagagccaagacagtgaaaa

SEQ ID NO: 303324 - DNA, 25 bp, Homo sapien
agtttggaagctacacttggcaggc

SEQ ID NO: 303325 - DNA, 25 bp, Homo sapien
gctacacttggcaggcttcgaagag

SEQ ID NO: 303326 - DNA, 25 bp, Homo sapien
ggcaggcttcgaagagctacagaat

SEQ ID NO: 303327 - DNA, 25 bp, Homo sapien
gctacagaatatgctccaaagaaga

SEQ ID NO: 303328 - DNA, 25 bp, Homo sapien
cctgacccaaggcatattttaacat

SEQ ID NO: 303329 - DNA, 25 bp, Homo sapien
atattttaacataacctgggagaag

SEQ ID NO: 303330 - DNA, 25 bp, Homo sapien
gaaagcctggctggaattctgactg

SEQ ID NO: 303331 - DNA, 25 bp, Homo sapien
tggctggaattctgactgtcttaca

SEQ ID NO: 303332 - DNA, 25 bp, Homo sapien
tctgactgtcttacatacatatgtg

SEQ ID NO: 303333 - DNA, 25 bp, Homo sapien
atacatatgtgcaaggttagcctgc

SEQ ID NO: 303334 - DNA, 25 bp, Homo sapien
ggttagcctgcaagattctagtttt

SEQ ID NO: 303335 - DNA, 25 bp, Homo sapien
tttatttaccagtgtgccagaatct

SEQ ID NO: 303336 - DNA, 25 bp, Homo sapien
gaatctgaaacaagctactgggagg

SEQ ID NO: 303337 - DNA, 25 bp, Homo sapien
aaaattccctgtatttcagctgtaa

SEQ ID NO: 303338 - DNA, 25 bp, Homo sapien
tcagctgtaatcaaagttacctcaa

SEQ ID NO: 303339 - DNA, 25 bp, Homo sapien
aggcccaggcctaacctgctaaatg

SEQ ID NO: 303340 - DNA, 25 bp, Homo sapien
gcccaggcctaacctgctaaatgtc

SEQ ID NO: 303341 - DNA, 25 bp, Homo sapien
tgctaaatgtccccggacggttctg

SEQ ID NO: 303342 - DNA, 25 bp, Homo sapien
ggacggttctggtctcctcggccac

SEQ ID NO: 303343 - DNA, 25 bp, Homo sapien
ttctggtctcctcggccactttcag

SEQ ID NO: 303344 - DNA, 25 bp, Homo sapien
ctcggccactttcagtgcgtcggtt

SEQ ID NO: 303345 - DNA, 25 bp, Homo sapien
gccactttcagtgcgtcggttcgtt

SEQ ID NO: 303346 - DNA, 25 bp, Homo sapien
actttcagtgcgtcggttcgttttg

SEQ ID NO: 303347 - DNA, 25 bp, Homo sapien
tcagtgcgtcggttcgttttgattc

SEQ ID NO: 303348 - DNA, 25 bp, Homo sapien
agtgcgtcggttcgttttgattctt

SEQ ID NO: 303349 - DNA, 25 bp, Homo sapien
tgcgtcggttcgttttgattctttt

SEQ ID NO: 303350 - DNA, 25 bp, Homo sapien
agtgctccaagtctaggaactccct

SEQ ID NO: 303351 - DNA, 25 bp, Homo sapien
agcagttacccaacagaaacattct

SEQ ID NO: 303352 - DNA, 25 bp, Homo sapien
gttttccccagttgtaatagtgcca

SEQ ID NO: 303353 - DNA, 25 bp, Homo sapien
atagtgccaagcaggcctgattctc

SEQ ID NO: 303354 - DNA, 25 bp, Homo sapien
aggcctgattctcgcgattattctc

SEQ ID NO: 303355 - DNA, 25 bp, Homo sapien
attattctcgaatcacctcctgtgt

SEQ ID NO: 303356 - DNA, 25 bp, Homo sapien
aatcacctcctgtgttgtgctggga

SEQ ID NO: 303357 - DNA, 25 bp, Homo sapien
gagcaggactgattgaattacggaa

SEQ ID NO: 303358 - DNA, 25 bp, Homo sapien
gaaaatgcctgtaaagtctgagtaa

SEQ ID NO: 303359 - DNA, 25 bp, Homo sapien
gtaagaaacttcatgctggcctgtg

SEQ ID NO: 303360 - DNA, 25 bp, Homo sapien
cttcatgctggcctgtgtgatacaa

SEQ ID NO: 303361 - DNA, 25 bp, Homo sapien
ttgtgaggtagaatgtcaggacttc

SEQ ID NO: 303362 - DNA, 25 bp, Homo sapien
gaatgtcaggacttcaggtattgaa

SEQ ID NO: 303363 - DNA, 25 bp, Homo sapien
ggatgatcccaggtttttgacttca

SEQ ID NO: 303364 - DNA, 25 bp, Homo sapien
atcccaggtttttgacttcactgtg

SEQ ID NO: 303365 - DNA, 25 bp, Homo sapien
aggtttttgacttcactgtgtgcct

SEQ ID NO: 303366 - DNA, 25 bp, Homo sapien
ttgacttcactgtgtgcctgttagt

SEQ ID NO: 303367 - DNA, 25 bp, Homo sapien
actgtgtgcctgttagtgctacttt

SEQ ID NO: 303368 - DNA, 25 bp, Homo sapien
gatgtccaaaggagcaacaggcttt

SEQ ID NO: 303369 - DNA, 25 bp, Homo sapien
aacaggctttgtcagatgggagata

SEQ ID NO: 303370 - DNA, 25 bp, Homo sapien
gagttctaaagtaatgactgcagtc

SEQ ID NO: 303371 - DNA, 25 bp, Homo sapien
agtaatgactgcagtcaagtgcccc

SEQ ID NO: 303372 - DNA, 25 bp, Homo sapien
agccaaaagatactgcaacgttcac

SEQ ID NO: 303373 - DNA, 25 bp, Homo sapien
agatactgcaacgttcacaagccca

SEQ ID NO: 303374 - DNA, 25 bp, Homo sapien
agcaaccacagaaggaggctgccct

SEQ ID NO: 303375 - DNA, 25 bp, Homo sapien
tgtcatcctgagtccgtacacatgg

SEQ ID NO: 303376 - DNA, 25 bp, Homo sapien
atcctgagtccgtacacatggagga

SEQ ID NO: 303377 - DNA, 25 bp, Homo sapien
tcttccagcatccagccaaggaggc

SEQ ID NO: 303378 - DNA, 25 bp, Homo sapien
gggaagggatcctatatgtcctgtt

SEQ ID NO: 303379 - DNA, 25 bp, Homo sapien
atcctatatgtcctgttggctctta

SEQ ID NO: 303380 - DNA, 25 bp, Homo sapien
atatgtcctgttggctcttaacaaa

SEQ ID NO: 303381 - DNA, 25 bp, Homo sapien
tgttggctcttaacaaagggtcagc

SEQ ID NO: 303382 - DNA, 25 bp, Homo sapien
gcatttccaaatcttagacttgaac

SEQ ID NO: 303383 - DNA, 25 bp, Homo sapien
acgacatgctcttctttgtactata

SEQ ID NO: 303384 - DNA, 25 bp, Homo sapien
catgctcttctttgtactatacaga

SEQ ID NO: 303385 - DNA, 25 bp, Homo sapien
gacacaccacagatcctctttttaa

SEQ ID NO: 303386 - DNA, 25 bp, Homo sapien
acagatcctctttttaaagcaggta

SEQ ID NO: 303387 - DNA, 25 bp, Homo sapien
gaaacatcattgtaaaacagtgctt

SEQ ID NO: 303388 - DNA, 25 bp, Homo sapien
gtgctttttaaactatccatggtaa

SEQ ID NO: 303389 - DNA, 25 bp, Homo sapien
aattctaatcctttgcaggttggta

SEQ ID NO: 303390 - DNA, 25 bp, Homo sapien
tatagcaccaagattagattgttat

SEQ ID NO: 303391 - DNA, 25 bp, Homo sapien
taaacactttcagtttctgtactta

SEQ ID NO: 303392 - DNA, 25 bp, Homo sapien
tctgtacttaatcttgcagtgtggt

SEQ ID NO: 303393 - DNA, 25 bp, Homo sapien
gcagtgtggtaataaagacttctac

SEQ ID NO: 303394 - DNA, 25 bp, Homo sapien
gtggcgaacgggaccgtccttctcg

SEQ ID NO: 303395 - DNA, 25 bp, Homo sapien
cgcccgccggcggtgcgtgtgggaa

SEQ ID NO: 303396 - DNA, 25 bp, Homo sapien
ccggcggtgcgtgtgggaaggcgtg

SEQ ID NO: 303397 - DNA, 25 bp, Homo sapien
tcgctgtcgcctccagtggttgtcg

SEQ ID NO: 303398 - DNA, 25 bp, Homo sapien
gctgtcgcctccagtggttgtcgac

SEQ ID NO: 303399 - DNA, 25 bp, Homo sapien
tgtcgcctccagtggttgtcgactt

SEQ ID NO: 303400 - DNA, 25 bp, Homo sapien
tcgcctccagtggttgtcgacttgc

SEQ ID NO: 303401 - DNA, 25 bp, Homo sapien
gcctccagtggttgtcgacttgcgg

SEQ ID NO: 303402 - DNA, 25 bp, Homo sapien
ctccagtggttgtcgacttgcgggc

SEQ ID NO: 303403 - DNA, 25 bp, Homo sapien
agtggttgtcgacttgcgggcggcc

SEQ ID NO: 303404 - DNA, 25 bp, Homo sapien
tggttgtcgacttgcgggcggcccc

SEQ ID NO: 303405 - DNA, 25 bp, Homo sapien
aagacatgattcttactgaacagaa

SEQ ID NO: 303406 - DNA, 25 bp, Homo sapien
gaagtttttagtatctgtctgcatt

SEQ ID NO: 303407 - DNA, 25 bp, Homo sapien
ctgcattttgggtagattttcaaca

SEQ ID NO: 303408 - DNA, 25 bp, Homo sapien
gatgtaactaagacacacttccaca

SEQ ID NO: 303409 - DNA, 25 bp, Homo sapien
gacacacttccacaagagccactag

SEQ ID NO: 303410 - DNA, 25 bp, Homo sapien
aagagccactaggataaccccactg

SEQ ID NO: 303411 - DNA, 25 bp, Homo sapien
aaccccactgaagcgcttatggagt

SEQ ID NO: 303412 - DNA, 25 bp, Homo sapien
gtaaagtgatgtaagcgaccagcaa

SEQ ID NO: 303413 - DNA, 25 bp, Homo sapien
gtaagcgaccagcaagcagtccact

SEQ ID NO: 303414 - DNA, 25 bp, Homo sapien
gcagtccactgctcctatagattgg

SEQ ID NO: 303415 - DNA, 25 bp, Homo sapien
cactgctcctatagattgggtcctc

SEQ ID NO: 303416 - DNA, 25 bp, Homo sapien
aaagattggctttccttggagtgaa

SEQ ID NO: 303417 - DNA, 25 bp, Homo sapien
aagtttgtcattaaacccatcgaca

SEQ ID NO: 303418 - DNA, 25 bp, Homo sapien
aaacccatcgacaagaaggcacctg

SEQ ID NO: 303419 - DNA, 25 bp, Homo sapien
catcgacaagaaggcacctgacttt

SEQ ID NO: 303420 - DNA, 25 bp, Homo sapien
ttatgccccacgtctgagaatcaac

SEQ ID NO: 303421 - DNA, 25 bp, Homo sapien
gagaatcaacaagcggatcctgcag

SEQ ID NO: 303422 - DNA, 25 bp, Homo sapien
ggatcctgcagctctgcatgggcaa

SEQ ID NO: 303423 - DNA, 25 bp, Homo sapien
tctgcatgggcaaccatgagttgta

SEQ ID NO: 303424 - DNA, 25 bp, Homo sapien
aaccatgagttgtatatgcgccgca

SEQ ID NO: 303425 - DNA, 25 bp, Homo sapien
tatatgcgccgcaggaagcctgaca

SEQ ID NO: 303426 - DNA, 25 bp, Homo sapien
ggaagcctgacaccatcgaggtgca

SEQ ID NO: 303427 - DNA, 25 bp, Homo sapien
gatgtagtccaccagttccaggaag

SEQ ID NO: 303428 - DNA, 25 bp, Homo sapien
accagttccaggaagctttcatcca

SEQ ID NO: 303429 - DNA, 25 bp, Homo sapien
gtctgcctcatccaacaccaagaag

SEQ ID NO: 303430 - DNA, 25 bp, Homo sapien
gagagttgctccagactgatcagtc

SEQ ID NO: 303431 - DNA, 25 bp, Homo sapien
tgatcagtcgacttttcagggcctt

SEQ ID NO: 303432 - DNA, 25 bp, Homo sapien
tggagtggccacaagcacatctgct

SEQ ID NO: 303433 - DNA, 25 bp, Homo sapien
tcctaccagcactaactgagctttg

SEQ ID NO: 303434 - DNA, 25 bp, Homo sapien
acatctgctgaaggctgtctggaca

SEQ ID NO: 303435 - DNA, 25 bp, Homo sapien
gacagctgcagcctgatcctacgca

SEQ ID NO: 303436 - DNA, 25 bp, Homo sapien
agtcagctgggccttctgctatgtg

SEQ ID NO: 303437 - DNA, 25 bp, Homo sapien
ggctcttctctaagatgtagtccac

SEQ ID NO: 303438 - DNA, 25 bp, Homo sapien
agctggataccagacatcctgctaa

SEQ ID NO: 303439 - DNA, 25 bp, Homo sapien
gacatcctgctaagaagaaatgcct

SEQ ID NO: 303440 - DNA, 25 bp, Homo sapien
ctgggcccagcaaagtgtctaccgg

SEQ ID NO: 303441 - DNA, 25 bp, Homo sapien
tgtgaatagcttccttgacacccaa

SEQ ID NO: 303442 - DNA, 25 bp, Homo sapien
ggagtagttgacaagcccagttgga

SEQ ID NO: 303443 - DNA, 25 bp, Homo sapien
aagcccagttggagagagattctaa

SEQ ID NO: 303444 - DNA, 25 bp, Homo sapien
gcttccttgacacccaataaggtca

SEQ ID NO: 303445 - DNA, 25 bp, Homo sapien
aactggtcatcatttcaaaagcccc

SEQ ID NO: 303446 - DNA, 25 bp, Homo sapien
aaggtcaattagactgcggttgcat

SEQ ID NO: 303447 - DNA, 25 bp, Homo sapien
actgcggttgcatggatgccatctg

SEQ ID NO: 303448 - DNA, 25 bp, Homo sapien
gatgccatctggattttccagaagg

SEQ ID NO: 303449 - DNA, 25 bp, Homo sapien
cgccctgcaattaacgttggtctgt

SEQ ID NO: 303450 - DNA, 25 bp, Homo sapien
gtctgtctgtatctcgtgtcggatc

SEQ ID NO: 303451 - DNA, 25 bp, Homo sapien
gaagctggaattggctcagtatcgt

SEQ ID NO: 303452 - DNA, 25 bp, Homo sapien
agtatcgtgaggttgctgcttttgc

SEQ ID NO: 303453 - DNA, 25 bp, Homo sapien
agttcggttctgacctcgatgctgc

SEQ ID NO: 303454 - DNA, 25 bp, Homo sapien
gatgctgccactcaacaacttttga

SEQ ID NO: 303455 - DNA, 25 bp, Homo sapien
acaacttttgagtcgtggcgtgcgt

SEQ ID NO: 303456 - DNA, 25 bp, Homo sapien
tggcgtgcgtctaactgagttgctg

SEQ ID NO: 303457 - DNA, 25 bp, Homo sapien
cagtattctcccatggctattgaag

SEQ ID NO: 303458 - DNA, 25 bp, Homo sapien
gtggctgttatctatgcgggtgtaa

SEQ ID NO: 303459 - DNA, 25 bp, Homo sapien
atatcttgataaactggagcccagc

SEQ ID NO: 303460 - DNA, 25 bp, Homo sapien
cgccagaaagcacgaacctcttctg

SEQ ID NO: 303461 - DNA, 25 bp, Homo sapien
acgaacctcttctgtcggttgcggg

SEQ ID NO: 303462 - DNA, 25 bp, Homo sapien
gaacctcttctgtcggttgcgggca

SEQ ID NO: 303463 - DNA, 25 bp, Homo sapien
tcttctgtcggttgcgggcactcag

SEQ ID NO: 303464 - DNA, 25 bp, Homo sapien
gcactcagcccatcagatgggtcgg

SEQ ID NO: 303465 - DNA, 25 bp, Homo sapien
ccatcagatgggtcgggcacgccac

SEQ ID NO: 303466 - DNA, 25 bp, Homo sapien
gatgggtcgggcacgccacagcggg

SEQ ID NO: 303467 - DNA, 25 bp, Homo sapien
aggtgccgggctactgggcagggct

SEQ ID NO: 303468 - DNA, 25 bp, Homo sapien
gcagggctgcatgccagggctgtgg

SEQ ID NO: 303469 - DNA, 25 bp, Homo sapien
cctcctctcggcatggaggtggtgg

SEQ ID NO: 303470 - DNA, 25 bp, Homo sapien
gaggtggtggacgtccggcggcaga

SEQ ID NO: 303471 - DNA, 25 bp, Homo sapien
cagacatggcggaaacccaggccaa

SEQ ID NO: 303472 - DNA, 25 bp, Homo sapien
aacccaggccaacaagctgcgggca

SEQ ID NO: 303473 - DNA, 25 bp, Homo sapien
ctgggccccaagcacaaggagtgac

SEQ ID NO: 303474 - DNA, 25 bp, Homo sapien
agcacaaggagtgacggcctgaccc

SEQ ID NO: 303475 - DNA, 25 bp, Homo sapien
cccctgggctctaaagaggaatgtc

SEQ ID NO: 303476 - DNA, 25 bp, Homo sapien
gaggaatgtctgctgttgcacatct

SEQ ID NO: 303477 - DNA, 25 bp, Homo sapien
tgctgttgcacatctggctgaggcc

SEQ ID NO: 303478 - DNA, 25 bp, Homo sapien
ttcggccttccctgggccctgaata

SEQ ID NO: 303479 - DNA, 25 bp, Homo sapien
gaataaacaccacagccagtttcct

SEQ ID NO: 303480 - DNA, 25 bp, Homo sapien
cagtcctagggacaaaagccaggtc

SEQ ID NO: 303481 - DNA, 25 bp, Homo sapien
ggacaaaagccaggtccacagcagt

SEQ ID NO: 303482 - DNA, 25 bp, Homo sapien
cagtctcctgctcgtttagaagtaa

SEQ ID NO: 303483 - DNA, 25 bp, Homo sapien
gtatccatagctaaatgcccagtcg

SEQ ID NO: 303484 - DNA, 25 bp, Homo sapien
aatgcccagtcgttatattttctag

SEQ ID NO: 303485 - DNA, 25 bp, Homo sapien
caagatgcttgttgtgtacagtttc

SEQ ID NO: 303486 - DNA, 25 bp, Homo sapien
gtacagtttcacagagccttcggat

SEQ ID NO: 303487 - DNA, 25 bp, Homo sapien
tcacagagccttcggattttttctt

SEQ ID NO: 303488 - DNA, 25 bp, Homo sapien
gatgaagcatcttgttccagttcca

SEQ ID NO: 303489 - DNA, 25 bp, Homo sapien
gttccagttccaaaagtcgaatcat

SEQ ID NO: 303490 - DNA, 25 bp, Homo sapien
gaatcattagatccaagctagctct

SEQ ID NO: 303491 - DNA, 25 bp, Homo sapien
tccaagctagctctatcaagatcca

SEQ ID NO: 303492 - DNA, 25 bp, Homo sapien
tgttcaaacgatctctactcagtat

SEQ ID NO: 303493 - DNA, 25 bp, Homo sapien
agtgttaaactgctactgttggtta

SEQ ID NO: 303494 - DNA, 25 bp, Homo sapien
aactgctactgttggttatagatca

SEQ ID NO: 303495 - DNA, 25 bp, Homo sapien
gttggttatagatcatgagaactga

SEQ ID NO: 303496 - DNA, 25 bp, Homo sapien
aagtccagagacttctacctgataa

SEQ ID NO: 303497 - DNA, 25 bp, Homo sapien
cagagacttctacctgataagtggt

SEQ ID NO: 303498 - DNA, 25 bp, Homo sapien
gtggtagagccagtgattaaatata

SEQ ID NO: 303499 - DNA, 25 bp, Homo sapien
ggtgatctgaatctaagtcctactt

SEQ ID NO: 303500 - DNA, 25 bp, Homo sapien
ctgaatctaagtcctacttgctaat

SEQ ID NO: 303501 - DNA, 25 bp, Homo sapien
aagtcctacttgctaatttatctag

SEQ ID NO: 303502 - DNA, 25 bp, Homo sapien
aattattagccttctaaactttgat

SEQ ID NO: 303503 - DNA, 25 bp, Homo sapien
taaatgtggactggctgaatgcggt

SEQ ID NO: 303504 - DNA, 25 bp, Homo sapien
ggattctggagaacagatttccagg

SEQ ID NO: 303505 - DNA, 25 bp, Homo sapien
gacagatgcaggcacctaccaagac

SEQ ID NO: 303506 - DNA, 25 bp, Homo sapien
gatgcaggcacctaccaagacctga

SEQ ID NO: 303507 - DNA, 25 bp, Homo sapien
acctcaggaagtggccctgccctac

SEQ ID NO: 303508 - DNA, 25 bp, Homo sapien
gcccctggaaggaacctcacaacag

SEQ ID NO: 303509 - DNA, 25 bp, Homo sapien
ggaaggaacctcacaacagggatac

SEQ ID NO: 303510 - DNA, 25 bp, Homo sapien
gaacctcacaacagggatacagcaa

SEQ ID NO: 303511 - DNA, 25 bp, Homo sapien
gggatacagcaaggacactccagtt

SEQ ID NO: 303512 - DNA, 25 bp, Homo sapien
atacagcaaggacactccagttccc

SEQ ID NO: 303513 - DNA, 25 bp, Homo sapien
agtcctgccatggtgctaccctgag

SEQ ID NO: 303514 - DNA, 25 bp, Homo sapien
tgccatggtgctaccctgagggaca

SEQ ID NO: 303515 - DNA, 25 bp, Homo sapien
ccaaattctaccagaatcaccttaa

SEQ ID NO: 303516 - DNA, 25 bp, Homo sapien
atcaagcacagcaggttggaatatg

SEQ ID NO: 303517 - DNA, 25 bp, Homo sapien
gacagtatatttcttcaagtctgag

SEQ ID NO: 303518 - DNA, 25 bp, Homo sapien
aagtctgagtttactttcttcctga

SEQ ID NO: 303519 - DNA, 25 bp, Homo sapien
gagtttactttcttcctgatcatga

SEQ ID NO: 303520 - DNA, 25 bp, Homo sapien
catgaccatctgaccttgttatttc

SEQ ID NO: 303521 - DNA, 25 bp, Homo sapien
tgaccttgttatttctgggcttggc

SEQ ID NO: 303522 - DNA, 25 bp, Homo sapien
tatttctgggcttggctcaagacca

SEQ ID NO: 303523 - DNA, 25 bp, Homo sapien
ggatgttgatgaacattcctttaaa

SEQ ID NO: 303524 - DNA, 25 bp, Homo sapien
agtgcttaggttgtagttatggctt

SEQ ID NO: 303525 - DNA, 25 bp, Homo sapien
gttatggctttgtctagaatggtga

SEQ ID NO: 303526 - DNA, 25 bp, Homo sapien
ctatgttcttcagatgtgcagccca

SEQ ID NO: 303527 - DNA, 25 bp, Homo sapien
gttcttcagatgtgcagcccacaat

SEQ ID NO: 303528 - DNA, 25 bp, Homo sapien
tgcagcccacaattcctcgggaaag

SEQ ID NO: 303529 - DNA, 25 bp, Homo sapien
caattcctcgggaaaggtgaacctg

SEQ ID NO: 303530 - DNA, 25 bp, Homo sapien
aagtctctctctgcagagccctgtt

SEQ ID NO: 303531 - DNA, 25 bp, Homo sapien
tgcagagccctgtttctaattgtgg

SEQ ID NO: 303532 - DNA, 25 bp, Homo sapien
gagccctgtttctaattgtggtaga

SEQ ID NO: 303533 - DNA, 25 bp, Homo sapien
gacagagcatttgccatgggacatt

SEQ ID NO: 303534 - DNA, 25 bp, Homo sapien
atttgccatgggacatttacagcct

SEQ ID NO: 303535 - DNA, 25 bp, Homo sapien
gccatgggacatttacagcctttat

SEQ ID NO: 303536 - DNA, 25 bp, Homo sapien
tacaaatgtatttagttctcttttt

SEQ ID NO: 303537 - DNA, 25 bp, Homo sapien
ttttcaggcagaccacccacaaata

SEQ ID NO: 303538 - DNA, 25 bp, Homo sapien
aatactgttttgcatcctggtggtc

SEQ ID NO: 303539 - DNA, 25 bp, Homo sapien
cctggtggtccttctcgggttgcag

SEQ ID NO: 303540 - DNA, 25 bp, Homo sapien
gagcgtgcagcttttacagtgtatg

SEQ ID NO: 303541 - DNA, 25 bp, Homo sapien
gtatgatctcttttactactggcat

SEQ ID NO: 303542 - DNA, 25 bp, Homo sapien
tactactggcatatctggaggaatt

SEQ ID NO: 303543 - DNA, 25 bp, Homo sapien
ggaggtactattcccaaaccaggca

SEQ ID NO: 303544 - DNA, 25 bp, Homo sapien
attggtggaattccagtcatcattc

SEQ ID NO: 303545 - DNA, 25 bp, Homo sapien
gtcatcattccaagagcaggatcaa

SEQ ID NO: 303546 - DNA, 25 bp, Homo sapien
ttggttgtccggcaattcccagcgg

SEQ ID NO: 303547 - DNA, 25 bp, Homo sapien
cagcggtgccattccaagattattc

SEQ ID NO: 303548 - DNA, 25 bp, Homo sapien
tggcacttgccattccaaaatatta

SEQ ID NO: 303549 - DNA, 25 bp, Homo sapien
atattatgccccaccaaggctgaga

SEQ ID NO: 303550 - DNA, 25 bp, Homo sapien
gctgagacagtgaatttgggctgct

SEQ ID NO: 303551 - DNA, 25 bp, Homo sapien
tttgggctgctgtagcctatttttt

SEQ ID NO: 303552 - DNA, 25 bp, Homo sapien
gaaccaatctggatgcctcattatg

SEQ ID NO: 303553 - DNA, 25 bp, Homo sapien
gcctcattatgtcaaccaggtccag

SEQ ID NO: 303554 - DNA, 25 bp, Homo sapien
ggtccagatgtgctataatctgttt

SEQ ID NO: 303555 - DNA, 25 bp, Homo sapien
atctgtttttacgtatgtaggccca

SEQ ID NO: 303556 - DNA, 25 bp, Homo sapien
tatgtaggcccagtcgtcatcagat

SEQ ID NO: 303557 - DNA, 25 bp, Homo sapien
gtcgtcatcagatgcttgcggcaaa

SEQ ID NO: 303558 - DNA, 25 bp, Homo sapien
gtgcttggagtttacctggcttatt

SEQ ID NO: 303559 - DNA, 25 bp, Homo sapien
gataacaactgtgagtagcctatga

SEQ ID NO: 303560 - DNA, 25 bp, Homo sapien
gtgagtagcctatgaatgaaattct

SEQ ID NO: 303561 - DNA, 25 bp, Homo sapien
atagtggattaatgcattttgctgc

SEQ ID NO: 303562 - DNA, 25 bp, Homo sapien
ggattaatgcattttgctgccttta

SEQ ID NO: 303563 - DNA, 25 bp, Homo sapien
gcattttgctgcctttattagggta

SEQ ID NO: 303564 - DNA, 25 bp, Homo sapien
gctgcctttattagggtactttatt

SEQ ID NO: 303565 - DNA, 25 bp, Homo sapien
ttgcttttcagaagtcagcctacat

SEQ ID NO: 303566 - DNA, 25 bp, Homo sapien
cagaagtcagcctacataacacatt

SEQ ID NO: 303567 - DNA, 25 bp, Homo sapien
aaaaaacctagtgctgattcacagc

SEQ ID NO: 303568 - DNA, 25 bp, Homo sapien
gctgattcacagcttattatccaat

SEQ ID NO: 303569 - DNA, 25 bp, Homo sapien
tcacagcttattatccaattcaaaa

SEQ ID NO: 303570 - DNA, 25 bp, Homo sapien
aagaaagccctcagaatccattctg

SEQ ID NO: 303571 - DNA, 25 bp, Homo sapien
aagccctcagaatccattctgtgga

SEQ ID NO: 303572 - DNA, 25 bp, Homo sapien
aatccattctgtggaaggtgacctc

SEQ ID NO: 303573 - DNA, 25 bp, Homo sapien
aaggtgacctcaggagaaaatcagc

SEQ ID NO: 303574 - DNA, 25 bp, Homo sapien
acaggaggaatggagccccagtgct

SEQ ID NO: 303575 - DNA, 25 bp, Homo sapien
ggaatggagccccagtgctccctca

SEQ ID NO: 303576 - DNA, 25 bp, Homo sapien
cagagtcaagtgcagtaaacagtac

SEQ ID NO: 303577 - DNA, 25 bp, Homo sapien
gaggactgtgccgagctgcatgact

SEQ ID NO: 303578 - DNA, 25 bp, Homo sapien
tgccgagctgcatgactacttcaat

SEQ ID NO: 303579 - DNA, 25 bp, Homo sapien
gcatgactacttcaatgtcctgagt

SEQ ID NO: 303580 - DNA, 25 bp, Homo sapien
ctacttcaatgtcctgagttacaga

SEQ ID NO: 303581 - DNA, 25 bp, Homo sapien
atataagggctttcatggcaaattt

SEQ ID NO: 303582 - DNA, 25 bp, Homo sapien
tgtttctatggttgctggaaatgtt

SEQ ID NO: 303583 - DNA, 25 bp, Homo sapien
gctggaaatgttgggtttagtttct

SEQ ID NO: 303584 - DNA, 25 bp, Homo sapien
aaaccatgttttaagtagctacagg

SEQ ID NO: 303585 - DNA, 25 bp, Homo sapien
aatgttgcattagtcttttcagtta

SEQ ID NO: 303586 - DNA, 25 bp, Homo sapien
ttgcattagtcttttcagttatctt

SEQ ID NO: 303587 - DNA, 25 bp, Homo sapien
tatcttctacctcctgtattttcta

SEQ ID NO: 303588 - DNA, 25 bp, Homo sapien
tctacctcctgtattttctactgta

SEQ ID NO: 303589 - DNA, 25 bp, Homo sapien
acctcctgtattttctactgtaata

SEQ ID NO: 303590 - DNA, 25 bp, Homo sapien
taatgtaatttaaggccttccacaa

SEQ ID NO: 303591 - DNA, 25 bp, Homo sapien
gaacagttcactttattccctgggt

SEQ ID NO: 303592 - DNA, 25 bp, Homo sapien
gtgaggcgtgagtgccccgtcctct

SEQ ID NO: 303593 - DNA, 25 bp, Homo sapien
tgccccgtcctctcttaatgcatta

SEQ ID NO: 303594 - DNA, 25 bp, Homo sapien
acagccttttctggctgtcctggag

SEQ ID NO: 303595 - DNA, 25 bp, Homo sapien
aaagtgcccctcatcgctgagaaaa

SEQ ID NO: 303596 - DNA, 25 bp, Homo sapien
tgcccctcatcgctgagaaaagtca

SEQ ID NO: 303597 - DNA, 25 bp, Homo sapien
agaaaagtcacccatggccgtccca

SEQ ID NO: 303598 - DNA, 25 bp, Homo sapien
gcttgcccaaagcaaaacttttctt

SEQ ID NO: 303599 - DNA, 25 bp, Homo sapien
tccatgtggattttgcattccattg

SEQ ID NO: 303600 - DNA, 25 bp, Homo sapien
gcattccattgcatatttccaagtc

SEQ ID NO: 303601 - DNA, 25 bp, Homo sapien
gcatatttccaagtcggctttgcta

SEQ ID NO: 303602 - DNA, 25 bp, Homo sapien
caagtcggctttgctataaacacaa

SEQ ID NO: 303603 - DNA, 25 bp, Homo sapien
ggcaccccacactgtattggcatca

SEQ ID NO: 303604 - DNA, 25 bp, Homo sapien
ggcatcagtgttaacagtcccagtt

SEQ ID NO: 303605 - DNA, 25 bp, Homo sapien
aacagtcccagttcagatgtgcaat

SEQ ID NO: 303606 - DNA, 25 bp, Homo sapien
gttcagatgtgcaatacttcagatt

SEQ ID NO: 303607 - DNA, 25 bp, Homo sapien
acttcagattggatacactgtaaca

SEQ ID NO: 303608 - DNA, 25 bp, Homo sapien
tccaactttgcatagacatcctcag

SEQ ID NO: 303609 - DNA, 25 bp, Homo sapien
agacatcctcagaatcgcaatcagt

SEQ ID NO: 303610 - DNA, 25 bp, Homo sapien
ctggcagaaaaggaacccgatctta

SEQ ID NO: 303611 - DNA, 25 bp, Homo sapien
aacccgatcttaatttccagctact

SEQ ID NO: 303612 - DNA, 25 bp, Homo sapien
tgctccttcatatggttctcccgga

SEQ ID NO: 303613 - DNA, 25 bp, Homo sapien
ctcccggacttccttccatgtattt

SEQ ID NO: 303614 - DNA, 25 bp, Homo sapien
tgaagagtggtggttgtcacacttt

SEQ ID NO: 303615 - DNA, 25 bp, Homo sapien
gttgtcacactttatggtctctgga

SEQ ID NO: 303616 - DNA, 25 bp, Homo sapien
tttatggtctctggaccccttaatg

SEQ ID NO: 303617 - DNA, 25 bp, Homo sapien
ggaccccttaatgtctgattcatgt

SEQ ID NO: 303618 - DNA, 25 bp, Homo sapien
ctgattcatgtagcagaagccagct

SEQ ID NO: 303619 - DNA, 25 bp, Homo sapien
gaagccagctagattttcatctgtc

SEQ ID NO: 303620 - DNA, 25 bp, Homo sapien
tcatctgtctctattcattttgttg

SEQ ID NO: 303621 - DNA, 25 bp, Homo sapien
tcattttgttgtgatgtcatggatc

SEQ ID NO: 303622 - DNA, 25 bp, Homo sapien
gatgtcatggatcatgtggcctctg

SEQ ID NO: 303623 - DNA, 25 bp, Homo sapien
aaactctactgtatactcgagaatg

SEQ ID NO: 303624 - DNA, 25 bp, Homo sapien
gttttgacctcatgaaccccatgaa

SEQ ID NO: 303625 - DNA, 25 bp, Homo sapien
gaccccagagaaaacccggagcaag

SEQ ID NO: 303626 - DNA, 25 bp, Homo sapien
aaaacccggagcaagcaggagtgtg

SEQ ID NO: 303627 - DNA, 25 bp, Homo sapien
gcaagcaggagtgtgcggtcaatat

SEQ ID NO: 303628 - DNA, 25 bp, Homo sapien
gagtgtgcggtcaatatttatatca

SEQ ID NO: 303629 - DNA, 25 bp, Homo sapien
gcggtcaatatttatatcatccaga

SEQ ID NO: 303630 - DNA, 25 bp, Homo sapien
aaaacacgagaaacgccatcgcggg

SEQ ID NO: 303631 - DNA, 25 bp, Homo sapien
acgagaaacgccatcgcgggatggt

SEQ ID NO: 303632 - DNA, 25 bp, Homo sapien
gactcggagggtgccgtgcgggcga

SEQ ID NO: 303633 - DNA, 25 bp, Homo sapien
ggcgaggccgcccaaatttggcaat

SEQ ID NO: 303634 - DNA, 25 bp, Homo sapien
ggccgcccaaatttggcaataaata

SEQ ID NO: 303635 - DNA, 25 bp, Homo sapien
tgcgctcttgggaccccagagaaaa

SEQ ID NO: 303636 - DNA, 25 bp, Homo sapien
agtcaggttgaaagctcatcgtgta

SEQ ID NO: 303637 - DNA, 25 bp, Homo sapien
aagctcatcgtgtagggttctgtgc

SEQ ID NO: 303638 - DNA, 25 bp, Homo sapien
tacaggactggaccgcagccaagat

SEQ ID NO: 303639 - DNA, 25 bp, Homo sapien
aagatgcctgcctgttaaccatgcc

SEQ ID NO: 303640 - DNA, 25 bp, Homo sapien
gtcatttccgcgtgaagccgcaggc

SEQ ID NO: 303641 - DNA, 25 bp, Homo sapien
cggagccttggtctgaaatgcctgt

SEQ ID NO: 303642 - DNA, 25 bp, Homo sapien
aaatgcctgtggagtaacctcggtc

SEQ ID NO: 303643 - DNA, 25 bp, Homo sapien
gtaacctcggtccataaacatgggt

SEQ ID NO: 303644 - DNA, 25 bp, Homo sapien
aaacatgggtgcacagtctgttctc

SEQ ID NO: 303645 - DNA, 25 bp, Homo sapien
tgttctccccaagtacagggcagga

SEQ ID NO: 303646 - DNA, 25 bp, Homo sapien
gcaggaggaaacaccgccctctgta

SEQ ID NO: 303647 - DNA, 25 bp, Homo sapien
ggctgttaacaattccatgcagtat

SEQ ID NO: 303648 - DNA, 25 bp, Homo sapien
tttggcagagtttataccctcccct

SEQ ID NO: 303649 - DNA, 25 bp, Homo sapien
gttttcttgctttattctgggcaag

SEQ ID NO: 303650 - DNA, 25 bp, Homo sapien
ttgtgctgctgttagtgcaactgct

SEQ ID NO: 303651 - DNA, 25 bp, Homo sapien
gcaactgctgtgtatgttgagccac

SEQ ID NO: 303652 - DNA, 25 bp, Homo sapien
atgttgagccactgttgtcatgcca

SEQ ID NO: 303653 - DNA, 25 bp, Homo sapien
gccaggtgcaaaggcagcttagcta

SEQ ID NO: 303654 - DNA, 25 bp, Homo sapien
aaggcagcttagctactgaggtagc

SEQ ID NO: 303655 - DNA, 25 bp, Homo sapien
ctgaggtagcgaatgttctgaggac

SEQ ID NO: 303656 - DNA, 25 bp, Homo sapien
tgaggacattctagacaacagctta

SEQ ID NO: 303657 - DNA, 25 bp, Homo sapien
acagcttagttcctttttcaggctc

SEQ ID NO: 303658 - DNA, 25 bp, Homo sapien
tatttcacgcttaattttcttcttt

SEQ ID NO: 303659 - DNA, 25 bp, Homo sapien
ttatttgtgatgttgatggcttcaa

SEQ ID NO: 303660 - DNA, 25 bp, Homo sapien
atacttcactgtatttacctcggcc

SEQ ID NO: 303661 - DNA, 25 bp, Homo sapien
cactgtatttacctcggcctaattt

SEQ ID NO: 303662 - DNA, 25 bp, Homo sapien
ggcctaattttcgaaccagctggta

SEQ ID NO: 303663 - DNA, 25 bp, Homo sapien
cagctggtagtcatcttgatttccc

SEQ ID NO: 303664 - DNA, 25 bp, Homo sapien
cattccaccacatgtgactcgtaat

SEQ ID NO: 303665 - DNA, 25 bp, Homo sapien
tgtgactcgtaatcccagtattctc

SEQ ID NO: 303666 - DNA, 25 bp, Homo sapien
atcccagtattctcgaggtctgtgt

SEQ ID NO: 303667 - DNA, 25 bp, Homo sapien
aatgtctgccagtgtgatgatgttg

SEQ ID NO: 303668 - DNA, 25 bp, Homo sapien
tgtgatgatgttgggacctcctctc

SEQ ID NO: 303669 - DNA, 25 bp, Homo sapien
aggcaccctccgtgtgcttctgagc

SEQ ID NO: 303670 - DNA, 25 bp, Homo sapien
tgtgcttctgagctgaggttgcttc

SEQ ID NO: 303671 - DNA, 25 bp, Homo sapien
tgcttctgagctgaggttgcttcac

SEQ ID NO: 303672 - DNA, 25 bp, Homo sapien
ctgagctgaggttgcttcacgggac

SEQ ID NO: 303673 - DNA, 25 bp, Homo sapien
agctgaggttgcttcacgggaccgt

SEQ ID NO: 303674 - DNA, 25 bp, Homo sapien
ttcacgggaccgtggcttccttcct

SEQ ID NO: 303675 - DNA, 25 bp, Homo sapien
tcccccgtgctctcgggcgaagtgg

SEQ ID NO: 303676 - DNA, 25 bp, Homo sapien
ggcgaagtgggttcttgtgccttcc

SEQ ID NO: 303677 - DNA, 25 bp, Homo sapien
gaagtgggttcttgtgccttcccct

SEQ ID NO: 303678 - DNA, 25 bp, Homo sapien
aaccccgctcagcagtcacagaagc

SEQ ID NO: 303679 - DNA, 25 bp, Homo sapien
aaatacataagctagtttctgttct

SEQ ID NO: 303680 - DNA, 25 bp, Homo sapien
gataaacgcacgcagccgagctcag

SEQ ID NO: 303681 - DNA, 25 bp, Homo sapien
tctttttgttcagaggtccatcggt

SEQ ID NO: 303682 - DNA, 25 bp, Homo sapien
tcttccctgaccctgttacaaactg

SEQ ID NO: 303683 - DNA, 25 bp, Homo sapien
gaaagcacagctcatttgtcctaaa

SEQ ID NO: 303684 - DNA, 25 bp, Homo sapien
attacacaaatcacacccttcaagc

SEQ ID NO: 303685 - DNA, 25 bp, Homo sapien
aggtccatcggtcaaagcctgcatt

SEQ ID NO: 303686 - DNA, 25 bp, Homo sapien
gacgggacggttacgctgattcatc

SEQ ID NO: 303687 - DNA, 25 bp, Homo sapien
aaagcctgcattttagagatggcat

SEQ ID NO: 303688 - DNA, 25 bp, Homo sapien
gagatggcattactgaggtccaaaa

SEQ ID NO: 303689 - DNA, 25 bp, Homo sapien
ggtccaaaaactagagccactcgct

SEQ ID NO: 303690 - DNA, 25 bp, Homo sapien
tcgctctgggtcatacagccgataa

SEQ ID NO: 303691 - DNA, 25 bp, Homo sapien
acctaccgtgatgtgcgcttcgagt

SEQ ID NO: 303692 - DNA, 25 bp, Homo sapien
gtggaccccgtggtctccttccctg

SEQ ID NO: 303693 - DNA, 25 bp, Homo sapien
tggtctccttccctgtggctctcag

SEQ ID NO: 303694 - DNA, 25 bp, Homo sapien
tggctctcagctgtcgctgtggacc

SEQ ID NO: 303695 - DNA, 25 bp, Homo sapien
ggctctcagctgtcgctgtggaccc

SEQ ID NO: 303696 - DNA, 25 bp, Homo sapien
gctctcagctgtcgctgtggaccct

SEQ ID NO: 303697 - DNA, 25 bp, Homo sapien
tctcagctgtcgctgtggaccctgc

SEQ ID NO: 303698 - DNA, 25 bp, Homo sapien
gctgtggaccctgccgccgcagcac

SEQ ID NO: 303699 - DNA, 25 bp, Homo sapien
tcttcctctaaagaccctccccgca

SEQ ID NO: 303700 - DNA, 25 bp, Homo sapien
tccatcccgactcctggagccctga

SEQ ID NO: 303701 - DNA, 25 bp, Homo sapien
actcctggagccctgacaccccgat

SEQ ID NO: 303702 - DNA, 25 bp, Homo sapien
ttatcctgatatgaacgcttctccc

SEQ ID NO: 303703 - DNA, 25 bp, Homo sapien
tgatatgaacgcttctcccttggtc

SEQ ID NO: 303704 - DNA, 25 bp, Homo sapien
aacgcttctcccttggtccgatttg

SEQ ID NO: 303705 - DNA, 25 bp, Homo sapien
ccttggtccgatttgagcgctttga

SEQ ID NO: 303706 - DNA, 25 bp, Homo sapien
atttgagcgctttgaccgggaggat

SEQ ID NO: 303707 - DNA, 25 bp, Homo sapien
gctttgaccgggaggatgatctcat

SEQ ID NO: 303708 - DNA, 25 bp, Homo sapien
ggatgatctcatcattgagtttgac

SEQ ID NO: 303709 - DNA, 25 bp, Homo sapien
cattgagtttgacaacatgttctcc

SEQ ID NO: 303710 - DNA, 25 bp, Homo sapien
acaacatgttctccagtgctacaga

SEQ ID NO: 303711 - DNA, 25 bp, Homo sapien
atgttctccagtgctacagacatcc

SEQ ID NO: 303712 - DNA, 25 bp, Homo sapien
acccatccactgatggtgcgccatg

SEQ ID NO: 303713 - DNA, 25 bp, Homo sapien
cttcccagtcaaggtggtggcctgg

SEQ ID NO: 303714 - DNA, 25 bp, Homo sapien
acctcaccggtgcagtgacccagga

SEQ ID NO: 303715 - DNA, 25 bp, Homo sapien
cagtgacccaggacggcatcagcag

SEQ ID NO: 303716 - DNA, 25 bp, Homo sapien
agtgacccaggacggcatcagcagc

SEQ ID NO: 303717 - DNA, 25 bp, Homo sapien
gacggcatcagcagcccagtgagca

SEQ ID NO: 303718 - DNA, 25 bp, Homo sapien
gcatcagcagcccagtgagcaccag

SEQ ID NO: 303719 - DNA, 25 bp, Homo sapien
catcagcagcccagtgagcaccagg

SEQ ID NO: 303720 - DNA, 25 bp, Homo sapien
atagggcacccatgaggctgcgctg

SEQ ID NO: 303721 - DNA, 25 bp, Homo sapien
tagggcacccatgaggctgcgctgc

SEQ ID NO: 303722 - DNA, 25 bp, Homo sapien
gcccagcagcacattccagtcactg

SEQ ID NO: 303723 - DNA, 25 bp, Homo sapien
caggccagagcagcctcttcctctc

SEQ ID NO: 303724 - DNA, 25 bp, Homo sapien
aacaccaggccagaactatagtcat

SEQ ID NO: 303725 - DNA, 25 bp, Homo sapien
ctatagtcatactcacacaaaggga

SEQ ID NO: 303726 - DNA, 25 bp, Homo sapien
gaaaaacaatgcttccagtggccac

SEQ ID NO: 303727 - DNA, 25 bp, Homo sapien
tccagtggccacttcctaaggagga

SEQ ID NO: 303728 - DNA, 25 bp, Homo sapien
taaggaggaacaaccccgtctgatc

SEQ ID NO: 303729 - DNA, 25 bp, Homo sapien
tctgatctcagaattggcaccacgt

SEQ ID NO: 303730 - DNA, 25 bp, Homo sapien
ggcaccacgtgagcttgctaagtga

SEQ ID NO: 303731 - DNA, 25 bp, Homo sapien
gataatatctgtttctactacggat

SEQ ID NO: 303732 - DNA, 25 bp, Homo sapien
tacggatttaggcaacaggacctgt

SEQ ID NO: 303733 - DNA, 25 bp, Homo sapien
ggacctgtacattgtcacattgcat

SEQ ID NO: 303734 - DNA, 25 bp, Homo sapien
tgcattatttttcttcaagcgttaa

SEQ ID NO: 303735 - DNA, 25 bp, Homo sapien
gaaaaacttctctctagctctgtga

SEQ ID NO: 303736 - DNA, 25 bp, Homo sapien
tctagctctgtgacgggcagttcag

SEQ ID NO: 303737 - DNA, 25 bp, Homo sapien
gacgggcagttcagataataccttc

SEQ ID NO: 303738 - DNA, 25 bp, Homo sapien
agttcagataataccttcaccagat

SEQ ID NO: 303739 - DNA, 25 bp, Homo sapien
aataccttcaccagatttacctgtt

SEQ ID NO: 303740 - DNA, 25 bp, Homo sapien
gatttacctgttttcagctgaagaa

SEQ ID NO: 303741 - DNA, 25 bp, Homo sapien
gtgagatgaagccttgaaaccctaa

SEQ ID NO: 303742 - DNA, 25 bp, Homo sapien
gaagccttgaaaccctaaaagtgat

SEQ ID NO: 303743 - DNA, 25 bp, Homo sapien
atatggtaactagggcaggtctttc

SEQ ID NO: 303744 - DNA, 25 bp, Homo sapien
agtgaatttcatacaggtaaaccct

SEQ ID NO: 303745 - DNA, 25 bp, Homo sapien
caggtaaaccctattataccctcag

SEQ ID NO: 303746 - DNA, 25 bp, Homo sapien
ccaacatcatctactactctctgaa

SEQ ID NO: 303747 - DNA, 25 bp, Homo sapien
aaggagtccaccactagtgagcaga

SEQ ID NO: 303748 - DNA, 25 bp, Homo sapien
agcagagtgccaggatgacagccat

SEQ ID NO: 303749 - DNA, 25 bp, Homo sapien
gacagccatggacaatgccagcaag

SEQ ID NO: 303750 - DNA, 25 bp, Homo sapien
gaatgcttctgagatgattgacaaa

SEQ ID NO: 303751 - DNA, 25 bp, Homo sapien
tgacattgacattcaaccgtacccg

SEQ ID NO: 303752 - DNA, 25 bp, Homo sapien
tgaaattatctctggtgctgcagct

SEQ ID NO: 303753 - DNA, 25 bp, Homo sapien
tgacagcatgagtatctatgacgat

SEQ ID NO: 303754 - DNA, 25 bp, Homo sapien
acgatattgatgctgacgtgctgca

SEQ ID NO: 303755 - DNA, 25 bp, Homo sapien
tgctgacgtgctgcaaaattaccaa

SEQ ID NO: 303756 - DNA, 25 bp, Homo sapien
atacaatctggccaacatcatctac

SEQ ID NO: 303757 - DNA, 25 bp, Homo sapien
tatagattaattttcactgagtcaa

SEQ ID NO: 303758 - DNA, 25 bp, Homo sapien
gttaaccaatatgactgcctgctat

SEQ ID NO: 303759 - DNA, 25 bp, Homo sapien
gactgcctgctatatgccaaacagc

SEQ ID NO: 303760 - DNA, 25 bp, Homo sapien
atgccaaacagcatgctagtccctg

SEQ ID NO: 303761 - DNA, 25 bp, Homo sapien
gcatgctagtccctgtgtgcacaga

SEQ ID NO: 303762 - DNA, 25 bp, Homo sapien
gtgtgcacagagatgaacatggttt

SEQ ID NO: 303763 - DNA, 25 bp, Homo sapien
gaacatggtttcattctcattgaat

SEQ ID NO: 303764 - DNA, 25 bp, Homo sapien
aagagggaatgcgtctttcctccat

SEQ ID NO: 303765 - DNA, 25 bp, Homo sapien
aatgcgtctttcctccatgtgaagg

SEQ ID NO: 303766 - DNA, 25 bp, Homo sapien
gtctttcctccatgtgaaggaagct

SEQ ID NO: 303767 - DNA, 25 bp, Homo sapien
aaggaagctccagtagcataacact

SEQ ID NO: 303768 - DNA, 25 bp, Homo sapien
tgttagtataatccacatgcaagtg

SEQ ID NO: 303769 - DNA, 25 bp, Homo sapien
acatgcaagtgatgaagccttctct

SEQ ID NO: 303770 - DNA, 25 bp, Homo sapien
gaagccttctctttgatgtgctaaa

SEQ ID NO: 303771 - DNA, 25 bp, Homo sapien
gatgtgctaaattggagaaggacta

SEQ ID NO: 303772 - DNA, 25 bp, Homo sapien
gaaggactaatggagctatgaatat

SEQ ID NO: 303773 - DNA, 25 bp, Homo sapien
taagtagtagtcttgctttaggtaa

SEQ ID NO: 303774 - DNA, 25 bp, Homo sapien
tgctttaggtaaaacactttcttga

SEQ ID NO: 303775 - DNA, 25 bp, Homo sapien
cactttcttgaaaccagaggcattt

SEQ ID NO: 303776 - DNA, 25 bp, Homo sapien
gatgctctgtgtggatagaaagcta

SEQ ID NO: 303777 - DNA, 25 bp, Homo sapien
aggtttattctgatgtgagcagcga

SEQ ID NO: 303778 - DNA, 25 bp, Homo sapien
gcagcgattgtgtgcagttcctccc

SEQ ID NO: 303779 - DNA, 25 bp, Homo sapien
tcgagacattcatcactaaagcagt

SEQ ID NO: 303780 - DNA, 25 bp, Homo sapien
attcatcactaaagcagtgatcggg

SEQ ID NO: 303781 - DNA, 25 bp, Homo sapien
aaagcagtgatcgggaaggctctga

SEQ ID NO: 303782 - DNA, 25 bp, Homo sapien
ggaaggctctgagggctgttttttt

SEQ ID NO: 303783 - DNA, 25 bp, Homo sapien
tttgatgttaacagaaaccaatctt

SEQ ID NO: 303784 - DNA, 25 bp, Homo sapien
agaaaccaatcttagcaccttttca

SEQ ID NO: 303785 - DNA, 25 bp, Homo sapien
atagataaggaatttcctgtacacc

SEQ ID NO: 303786 - DNA, 25 bp, Homo sapien
tcctgtacaccagattggaaatgga

SEQ ID NO: 303787 - DNA, 25 bp, Homo sapien
aatggagtgaaacaagccctcccat

SEQ ID NO: 303788 - DNA, 25 bp, Homo sapien
tggagtgaaacaagccctcccatgc

SEQ ID NO: 303789 - DNA, 25 bp, Homo sapien
tcagtgggcactcccaacctcagca

SEQ ID NO: 303790 - DNA, 25 bp, Homo sapien
ggcccacgcgcttgtcagggaacag

SEQ ID NO: 303791 - DNA, 25 bp, Homo sapien
cttctgttctctctagaggaagatc

SEQ ID NO: 303792 - DNA, 25 bp, Homo sapien
ggaagatctgcgttttgtctgcact

SEQ ID NO: 303793 - DNA, 25 bp, Homo sapien
atctgcgttttgtctgcactgtggg

SEQ ID NO: 303794 - DNA, 25 bp, Homo sapien
cacgcgcttgtcagggaacagaaca

SEQ ID NO: 303795 - DNA, 25 bp, Homo sapien
gagcgtcagaccctctaaagtggct

SEQ ID NO: 303796 - DNA, 25 bp, Homo sapien
gtcagaccctctaaagtggctgcct

SEQ ID NO: 303797 - DNA, 25 bp, Homo sapien
gaccctctaaagtggctgcctctcg

SEQ ID NO: 303798 - DNA, 25 bp, Homo sapien
gggaaagcttccacacctgtcatca

SEQ ID NO: 303799 - DNA, 25 bp, Homo sapien
ctgtttgatgcaagaaacgggaagc

SEQ ID NO: 303800 - DNA, 25 bp, Homo sapien
agggaacagaacagctctcgcccga

SEQ ID NO: 303801 - DNA, 25 bp, Homo sapien
aatgatgttttcacattatgtcata

SEQ ID NO: 303802 - DNA, 25 bp, Homo sapien
tgattttcatactcactatttgtag

SEQ ID NO: 303803 - DNA, 25 bp, Homo sapien
atactcactatttgtagtcactaca

SEQ ID NO: 303804 - DNA, 25 bp, Homo sapien
gtagtcactacaaagtgttaggttg

SEQ ID NO: 303805 - DNA, 25 bp, Homo sapien
gagaagttttgctgttggagcctga

SEQ ID NO: 303806 - DNA, 25 bp, Homo sapien
ttttgctgttggagcctgagggtaa

SEQ ID NO: 303807 - DNA, 25 bp, Homo sapien
gttagtctcttcaaaatagaatcag

SEQ ID NO: 303808 - DNA, 25 bp, Homo sapien
atatatgtctgcgtatgtgtgtttt

SEQ ID NO: 303809 - DNA, 25 bp, Homo sapien
atgtgtgttttgtgtatccgtatac

SEQ ID NO: 303810 - DNA, 25 bp, Homo sapien
gtatccgtatacacacacctataca

SEQ ID NO: 303811 - DNA, 25 bp, Homo sapien
acacacacctatacaaatgatgttt

SEQ ID NO: 303812 - DNA, 25 bp, Homo sapien
gcacctctctggtcaggcctagtca

SEQ ID NO: 303813 - DNA, 25 bp, Homo sapien
cccagcatgtcaactttggcatgac

SEQ ID NO: 303814 - DNA, 25 bp, Homo sapien
agggccatggcgttgacatctctat

SEQ ID NO: 303815 - DNA, 25 bp, Homo sapien
atggcgttgacatctctatctgcac

SEQ ID NO: 303816 - DNA, 25 bp, Homo sapien
ccataggtgctcttgtctagcttaa

SEQ ID NO: 303817 - DNA, 25 bp, Homo sapien
agcttaatgactctaaaccccgtct

SEQ ID NO: 303818 - DNA, 25 bp, Homo sapien
tctgataatcctcaaatttctgtct

SEQ ID NO: 303819 - DNA, 25 bp, Homo sapien
atttctgtctgtaacctagacctgg

SEQ ID NO: 303820 - DNA, 25 bp, Homo sapien
tgtaacctagacctggccacgaaac

SEQ ID NO: 303821 - DNA, 25 bp, Homo sapien
tggccacgaaaccttgggctcctac

SEQ ID NO: 303822 - DNA, 25 bp, Homo sapien
aaaagacatctcaaattccataggt

SEQ ID NO: 303823 - DNA, 25 bp, Homo sapien
acggccgcgtgttcagcttcatggg

SEQ ID NO: 303824 - DNA, 25 bp, Homo sapien
atggcacggttgtacttgtcgcaga

SEQ ID NO: 303825 - DNA, 25 bp, Homo sapien
gcagagcctctgcatgctctcgaag

SEQ ID NO: 303826 - DNA, 25 bp, Homo sapien
tgctctcgaagcttttggtgtcata

SEQ ID NO: 303827 - DNA, 25 bp, Homo sapien
aaacgtaattctccatagcgagctt

SEQ ID NO: 303828 - DNA, 25 bp, Homo sapien
tagcgagcttgagatccgggatttc

SEQ ID NO: 303829 - DNA, 25 bp, Homo sapien
gagatccgggatttcttcacagacc

SEQ ID NO: 303830 - DNA, 25 bp, Homo sapien
atttcttcacagacccatcggatgg

SEQ ID NO: 303831 - DNA, 25 bp, Homo sapien
gatggtctcgatgatttcatgagca

SEQ ID NO: 303832 - DNA, 25 bp, Homo sapien
tttcatgagcagcatcgtgatgttt

SEQ ID NO: 303833 - DNA, 25 bp, Homo sapien
atgtttatcgtagaccggcagcggc

SEQ ID NO: 303834 - DNA, 25 bp, Homo sapien
gtggaaaagcattggcttcccctgc

SEQ ID NO: 303835 - DNA, 25 bp, Homo sapien
agggacatccacatttatttgagca

SEQ ID NO: 303836 - DNA, 25 bp, Homo sapien
atttgagcacctaccaggatacctg

SEQ ID NO: 303837 - DNA, 25 bp, Homo sapien
ggatacctgctttgggagccttctg

SEQ ID NO: 303838 - DNA, 25 bp, Homo sapien
tgcgtgagatccctggctaccctgg

SEQ ID NO: 303839 - DNA, 25 bp, Homo sapien
ggctaccctggagagacatcagaca

SEQ ID NO: 303840 - DNA, 25 bp, Homo sapien
aagtgagatgcccaagagccctagc

SEQ ID NO: 303841 - DNA, 25 bp, Homo sapien
caagagccctagctgtctttgtctt

SEQ ID NO: 303842 - DNA, 25 bp, Homo sapien
tctgaatgaagcatgccgggcctca

SEQ ID NO: 303843 - DNA, 25 bp, Homo sapien
tgcacactgcccctcattatgttca

SEQ ID NO: 303844 - DNA, 25 bp, Homo sapien
cattatgttcatgatcggcaggaaa

SEQ ID NO: 303845 - DNA, 25 bp, Homo sapien
gaataacaacatttgcaggctcatg

SEQ ID NO: 303846 - DNA, 25 bp, Homo sapien
ggctcatgagagctgcctgacaaaa

SEQ ID NO: 303847 - DNA, 25 bp, Homo sapien
gagctgcctgacaaaaagcgtgtaa

SEQ ID NO: 303848 - DNA, 25 bp, Homo sapien
agtgattgctcctgtggccctgtga

SEQ ID NO: 303849 - DNA, 25 bp, Homo sapien
ggccctgtgattcagcaggtttatg

SEQ ID NO: 303850 - DNA, 25 bp, Homo sapien
gaatcgcagatgtcaaatggccaac

SEQ ID NO: 303851 - DNA, 25 bp, Homo sapien
tggccaacacagaatctaacgacat

SEQ ID NO: 303852 - DNA, 25 bp, Homo sapien
aatgctgaattgcttcatttctgca

SEQ ID NO: 303853 - DNA, 25 bp, Homo sapien
atttctgcaatttctgctgcttctt

SEQ ID NO: 303854 - DNA, 25 bp, Homo sapien
tctgccttaaaatttgatacctggt

SEQ ID NO: 303855 - DNA, 25 bp, Homo sapien
atacctggtaacttctctctgtgag

SEQ ID NO: 303856 - DNA, 25 bp, Homo sapien
gcggatgctgcttgatatcatttac

SEQ ID NO: 303857 - DNA, 25 bp, Homo sapien
atatgcttacctgcactgatgcttc

SEQ ID NO: 303858 - DNA, 25 bp, Homo sapien
ggtcacagcacagatctccgaggaa

SEQ ID NO: 303859 - DNA, 25 bp, Homo sapien
tctccgaggaaaatagaggctctgc

SEQ ID NO: 303860 - DNA, 25 bp, Homo sapien
tctgcgctgtgtgggagacatactg

SEQ ID NO: 303861 - DNA, 25 bp, Homo sapien
tgtgggagacatactggcctcacca

SEQ ID NO: 303862 - DNA, 25 bp, Homo sapien
tcaccaccgagttgtactccagagg

SEQ ID NO: 303863 - DNA, 25 bp, Homo sapien
ctccagaggaaagcttagttgtatt

SEQ ID NO: 303864 - DNA, 25 bp, Homo sapien
ttctctccagatgctgcaaagccag

SEQ ID NO: 303865 - DNA, 25 bp, Homo sapien
gcaaagccagcacagatcatcttct

SEQ ID NO: 303866 - DNA, 25 bp, Homo sapien
atcttctctgtgatccctcctggat

SEQ ID NO: 303867 - DNA, 25 bp, Homo sapien
agattctggaccaaccttcaactat

SEQ ID NO: 303868 - DNA, 25 bp, Homo sapien
ttctggaccaaccttcaactatctt

SEQ ID NO: 303869 - DNA, 25 bp, Homo sapien
tggaccaaccttcaactatcttctt

SEQ ID NO: 303870 - DNA, 25 bp, Homo sapien
accaaccttcaactatcttcttgat

SEQ ID NO: 303871 - DNA, 25 bp, Homo sapien
agaaagatgaactctgcaggctaag

SEQ ID NO: 303872 - DNA, 25 bp, Homo sapien
agatgaactctgcaggctaagaaat

SEQ ID NO: 303873 - DNA, 25 bp, Homo sapien
gaactctgcaggctaagaaatgaaa

SEQ ID NO: 303874 - DNA, 25 bp, Homo sapien
gaaaaagaacaagagctggacacat

SEQ ID NO: 303875 - DNA, 25 bp, Homo sapien
agaacaagagctggacacattaaaa

SEQ ID NO: 303876 - DNA, 25 bp, Homo sapien
attaaaaagaaagagtccatcagat

SEQ ID NO: 303877 - DNA, 25 bp, Homo sapien
tgccttctccgcgtggtcaaagagt

SEQ ID NO: 303878 - DNA, 25 bp, Homo sapien
gactgtacagaaatcggcaccctat

SEQ ID NO: 303879 - DNA, 25 bp, Homo sapien
aaatcggcaccctattttcttgcag

SEQ ID NO: 303880 - DNA, 25 bp, Homo sapien
tcttgcagctcagattttgttaatc

SEQ ID NO: 303881 - DNA, 25 bp, Homo sapien
gacagacgtaaagtgttttagcaaa

SEQ ID NO: 303882 - DNA, 25 bp, Homo sapien
cagggccatggagggatgcttctca

SEQ ID NO: 303883 - DNA, 25 bp, Homo sapien
atgcttctcacgaggcgcttcagaa

SEQ ID NO: 303884 - DNA, 25 bp, Homo sapien
agggacagagaagccctgcgtccaa

SEQ ID NO: 303885 - DNA, 25 bp, Homo sapien
caagggccttttgtcctgttagcaa

SEQ ID NO: 303886 - DNA, 25 bp, Homo sapien
gtcctgttagcaattgaggtgtgca

SEQ ID NO: 303887 - DNA, 25 bp, Homo sapien
tgtgcagagcactgtacagacccca

SEQ ID NO: 303888 - DNA, 25 bp, Homo sapien
ccctgtacattcctccctggaggtg

SEQ ID NO: 303889 - DNA, 25 bp, Homo sapien
aacattctacagattttatgatatc

SEQ ID NO: 303890 - DNA, 25 bp, Homo sapien
tcattagcatttatctttatgcatg

SEQ ID NO: 303891 - DNA, 25 bp, Homo sapien
aatggattgatactccttaagtaga

SEQ ID NO: 303892 - DNA, 25 bp, Homo sapien
gatactccttaagtagagcattcac

SEQ ID NO: 303893 - DNA, 25 bp, Homo sapien
agtagagcattcacaaccttttagt

SEQ ID NO: 303894 - DNA, 25 bp, Homo sapien
gagcattcacaaccttttagtaata

SEQ ID NO: 303895 - DNA, 25 bp, Homo sapien
tcacaaccttttagtaatatttggg

SEQ ID NO: 303896 - DNA, 25 bp, Homo sapien
tcaaatgatgttcctgttgcagaag

SEQ ID NO: 303897 - DNA, 25 bp, Homo sapien
gatgttcctgttgcagaagtctgcg

SEQ ID NO: 303898 - DNA, 25 bp, Homo sapien
gaagtctgcgaaacaatatctaaac

SEQ ID NO: 303899 - DNA, 25 bp, Homo sapien
gttgagagctaaacagtgtattgaa

SEQ ID NO: 303900 - DNA, 25 bp, Homo sapien
ttttgagccagcagacggaggttat

SEQ ID NO: 303901 - DNA, 25 bp, Homo sapien
cagacggaggttattaaaggcccag

SEQ ID NO: 303902 - DNA, 25 bp, Homo sapien
ggcccagttagttccttctggaaag

SEQ ID NO: 303903 - DNA, 25 bp, Homo sapien
tagttccttctggaaagcctttcct

SEQ ID NO: 303904 - DNA, 25 bp, Homo sapien
tggaaagcctttcctgcagatgtcc

SEQ ID NO: 303905 - DNA, 25 bp, Homo sapien
gcttaccgcagccatggaagaagcc

SEQ ID NO: 303906 - DNA, 25 bp, Homo sapien
tagtgagagaagctacagagccctg

SEQ ID NO: 303907 - DNA, 25 bp, Homo sapien
actaagtgaatgactctgacatggt

SEQ ID NO: 303908 - DNA, 25 bp, Homo sapien
taaagcttgagcctaatgactgcaa

SEQ ID NO: 303909 - DNA, 25 bp, Homo sapien
gcctaatgactgcaagctaaggtta

SEQ ID NO: 303910 - DNA, 25 bp, Homo sapien
taaggttaattttgagccagcagac

SEQ ID NO: 303911 - DNA, 25 bp, Homo sapien
tatagccaaggagcggtgacaggcc

SEQ ID NO: 303912 - DNA, 25 bp, Homo sapien
ggccaagataatgaggcatcacctg

SEQ ID NO: 303913 - DNA, 25 bp, Homo sapien
gaagaacctgatcagatattgagga

SEQ ID NO: 303914 - DNA, 25 bp, Homo sapien
ttgaggatgatcagctatcaaggat

SEQ ID NO: 303915 - DNA, 25 bp, Homo sapien
taatctgacttagcaaagttctttg

SEQ ID NO: 303916 - DNA, 25 bp, Homo sapien
gaccactgactgcaatggagacttg

SEQ ID NO: 303917 - DNA, 25 bp, Homo sapien
gcaaagttctttgcttaaactggat

SEQ ID NO: 303918 - DNA, 25 bp, Homo sapien
aaagaaagtgtacagaagagcctag

SEQ ID NO: 303919 - DNA, 25 bp, Homo sapien
caatggagacttgcagtagggaaag

SEQ ID NO: 303920 - DNA, 25 bp, Homo sapien
gagatattgggctcaactcctcata

SEQ ID NO: 303921 - DNA, 25 bp, Homo sapien
tattgggctcaactcctcatacagc

SEQ ID NO: 303922 - DNA, 25 bp, Homo sapien
aaagcacatcaccacaaggtcagtt

SEQ ID NO: 303923 - DNA, 25 bp, Homo sapien
aaggtcagttgcaaaggcccggtat

SEQ ID NO: 303924 - DNA, 25 bp, Homo sapien
gcaaaggcccggtatcacaggctta

SEQ ID NO: 303925 - DNA, 25 bp, Homo sapien
cacaggcttaaatacagagggctag

SEQ ID NO: 303926 - DNA, 25 bp, Homo sapien
gagaggaaggtggagtactaacaaa

SEQ ID NO: 303927 - DNA, 25 bp, Homo sapien
gttgaattatcactgcccatcagga

SEQ ID NO: 303928 - DNA, 25 bp, Homo sapien
actgcccatcaggacacggttattt

SEQ ID NO: 303929 - DNA, 25 bp, Homo sapien
gacacggttatttccccttactctg

SEQ ID NO: 303930 - DNA, 25 bp, Homo sapien
cccttactctgggacaccaaagatt

SEQ ID NO: 303931 - DNA, 25 bp, Homo sapien
gaggccatctcgagaggctgactgc

SEQ ID NO: 303932 - DNA, 25 bp, Homo sapien
gagaggctgactgctcacacctggg

SEQ ID NO: 303933 - DNA, 25 bp, Homo sapien
gagaacacagtgtgattctgtctgg

SEQ ID NO: 303934 - DNA, 25 bp, Homo sapien
gattctgtctggtaaggaagctgta

SEQ ID NO: 303935 - DNA, 25 bp, Homo sapien
gaagctgtatgttgatgttcactga

SEQ ID NO: 303936 - DNA, 25 bp, Homo sapien
gtgaataggttcatacagtccctta

SEQ ID NO: 303937 - DNA, 25 bp, Homo sapien
ggttcatacagtcccttaggcattt

SEQ ID NO: 303938 - DNA, 25 bp, Homo sapien
ccttaggcatttggctggaggataa

SEQ ID NO: 303939 - DNA, 25 bp, Homo sapien
aaagaacagccattgaccagcagag

SEQ ID NO: 303940 - DNA, 25 bp, Homo sapien
ctggacattattaagtgggctggct

SEQ ID NO: 303941 - DNA, 25 bp, Homo sapien
gaagtttatgcaagacagcgtgcta

SEQ ID NO: 303942 - DNA, 25 bp, Homo sapien
catttactagtgctgtgtgcctcgt

SEQ ID NO: 303943 - DNA, 25 bp, Homo sapien
tgtgcctcgttgcttttctgggtag

SEQ ID NO: 303944 - DNA, 25 bp, Homo sapien
gtcccatagttcaagtaggctccag

SEQ ID NO: 303945 - DNA, 25 bp, Homo sapien
ttttcctgattatataacctgttct

SEQ ID NO: 303946 - DNA, 25 bp, Homo sapien
ataacctgttctttgcgatgctttt

SEQ ID NO: 303947 - DNA, 25 bp, Homo sapien
ttttgcctaaactctaggacctatg

SEQ ID NO: 303948 - DNA, 25 bp, Homo sapien
ggacctatgacaggtgacagacacc

SEQ ID NO: 303949 - DNA, 25 bp, Homo sapien
accctcctgccttcatagaatacag

SEQ ID NO: 303950 - DNA, 25 bp, Homo sapien
atagaatacagcttctcctgggcta

SEQ ID NO: 303951 - DNA, 25 bp, Homo sapien
acagcttctcctgggctagacaatg

SEQ ID NO: 303952 - DNA, 25 bp, Homo sapien
acatgagtggactatttttcttact

SEQ ID NO: 303953 - DNA, 25 bp, Homo sapien
agagaggttacttgaacagctcaaa

SEQ ID NO: 303954 - DNA, 25 bp, Homo sapien
acagctcaaagtcccatagttcaag

SEQ ID NO: 303955 - DNA, 25 bp, Homo sapien
tctggatctccagctcggcaatgcg

SEQ ID NO: 303956 - DNA, 25 bp, Homo sapien
tcggcaatgcgctgccgcatctcgg

SEQ ID NO: 303957 - DNA, 25 bp, Homo sapien
ttcagctcctcgatctggtccttga

SEQ ID NO: 303958 - DNA, 25 bp, Homo sapien
ggctttcgctgagctgcgtctgcag

SEQ ID NO: 303959 - DNA, 25 bp, Homo sapien
gtctgcagccccttgttctgtgcag

SEQ ID NO: 303960 - DNA, 25 bp, Homo sapien
ttctgtgcagccaggtactgcagct

SEQ ID NO: 303961 - DNA, 25 bp, Homo sapien
atctggtccttgagctcgcggatgt

SEQ ID NO: 303962 - DNA, 25 bp, Homo sapien
ttgagctcgcggatgtactgcgatg

SEQ ID NO: 303963 - DNA, 25 bp, Homo sapien
tactgcgatgagtccgagtggttca

SEQ ID NO: 303964 - DNA, 25 bp, Homo sapien
gagtccgagtggttcagctggccct

SEQ ID NO: 303965 - DNA, 25 bp, Homo sapien
agctggccctggatgcggccttcct

SEQ ID NO: 303966 - DNA, 25 bp, Homo sapien
gtatttgcgttgagcagcgcagact

SEQ ID NO: 303967 - DNA, 25 bp, Homo sapien
ttgagcagcgcagactgtagagcaa

SEQ ID NO: 303968 - DNA, 25 bp, Homo sapien
cagcgcagactgtagagcaaagagc

SEQ ID NO: 303969 - DNA, 25 bp, Homo sapien
ggtgattgcagctggaagtgcccat

SEQ ID NO: 303970 - DNA, 25 bp, Homo sapien
ctggaagtgcccatgaccgagctgg

SEQ ID NO: 303971 - DNA, 25 bp, Homo sapien
aagtgcccatgaccgagctggcgtc

SEQ ID NO: 303972 - DNA, 25 bp, Homo sapien
ataagagcaacgtcgcgggacgctt

SEQ ID NO: 303973 - DNA, 25 bp, Homo sapien
ggtcatccaccaccctgcagaggag

SEQ ID NO: 303974 - DNA, 25 bp, Homo sapien
cgcgggacgcttgccgtctttatgg

SEQ ID NO: 303975 - DNA, 25 bp, Homo sapien
tgtcgctgcgggagagttaccgtat

SEQ ID NO: 303976 - DNA, 25 bp, Homo sapien
gagttaccgtatttgcgttgagcag

SEQ ID NO: 303977 - DNA, 25 bp, Homo sapien
gcccaggaggtcaaaaccagctggg

SEQ ID NO: 303978 - DNA, 25 bp, Homo sapien
ctatttaatcattcagttatgacaa

SEQ ID NO: 303979 - DNA, 25 bp, Homo sapien
atttaatcattcagttatgacaaac

SEQ ID NO: 303980 - DNA, 25 bp, Homo sapien
ttaatcattcagttatgacaaacta

SEQ ID NO: 303981 - DNA, 25 bp, Homo sapien
aatcattcagttatgacaaactaat

SEQ ID NO: 303982 - DNA, 25 bp, Homo sapien
cattcagttatgacaaactaatttt

SEQ ID NO: 303983 - DNA, 25 bp, Homo sapien
taattttaatatctggggccgggcg

SEQ ID NO: 303984 - DNA, 25 bp, Homo sapien
attttaatatctggggccgggcgtg

SEQ ID NO: 303985 - DNA, 25 bp, Homo sapien
ctgtgattcctcacactttgggaga

SEQ ID NO: 303986 - DNA, 25 bp, Homo sapien
tgtgattcctcacactttgggagac

SEQ ID NO: 303987 - DNA, 25 bp, Homo sapien
gtgattcctcacactttgggagact

SEQ ID NO: 303988 - DNA, 25 bp, Homo sapien
tgtcctcaatgtctagtctcacttg

SEQ ID NO: 303989 - DNA, 25 bp, Homo sapien
atgtctagtctcacttgttttcctc

SEQ ID NO: 303990 - DNA, 25 bp, Homo sapien
tacagagttcatcgaaagacacata

SEQ ID NO: 303991 - DNA, 25 bp, Homo sapien
tctgaagctcatggccattggagat

SEQ ID NO: 303992 - DNA, 25 bp, Homo sapien
tggacagcttctcgaagcttctctc

SEQ ID NO: 303993 - DNA, 25 bp, Homo sapien
attctcattccctcaagattcccta

SEQ ID NO: 303994 - DNA, 25 bp, Homo sapien
aagattccctattttgacagctccc

SEQ ID NO: 303995 - DNA, 25 bp, Homo sapien
ctattttgacagctccctaaggaaa

SEQ ID NO: 303996 - DNA, 25 bp, Homo sapien
tcgaagcttctctctgttctcagtc

SEQ ID NO: 303997 - DNA, 25 bp, Homo sapien
tctcagtcttcctggaacctctctt

SEQ ID NO: 303998 - DNA, 25 bp, Homo sapien
tcttgcctcttgtgcctaactttcc

SEQ ID NO: 303999 - DNA, 25 bp, Homo sapien
caggagcagtgagttgtgagtggaa

SEQ ID NO: 304000 - DNA, 25 bp, Homo sapien
agctgccttagacagattccctggg

SEQ ID NO: 304001 - DNA, 25 bp, Homo sapien
tgccttagacagattccctgggcct

SEQ ID NO: 304002 - DNA, 25 bp, Homo sapien
caccttccttacacctggtgggagc

SEQ ID NO: 304003 - DNA, 25 bp, Homo sapien
cttccttacacctggtgggagcccg

SEQ ID NO: 304004 - DNA, 25 bp, Homo sapien
tcagatctgcccttgcttgcctcat

SEQ ID NO: 304005 - DNA, 25 bp, Homo sapien
ttgcttgcctcatacctctgtgctc

SEQ ID NO: 304006 - DNA, 25 bp, Homo sapien
agctgagtccctccatccgtggatg

SEQ ID NO: 304007 - DNA, 25 bp, Homo sapien
gagtccctccatccgtggatgcttt

SEQ ID NO: 304008 - DNA, 25 bp, Homo sapien
tccatccgtggatgctttcctgcag

SEQ ID NO: 304009 - DNA, 25 bp, Homo sapien
agctatgtggtatgggggtcattcc

SEQ ID NO: 304010 - DNA, 25 bp, Homo sapien
ttatactaaatacagggcagtcctc

SEQ ID NO: 304011 - DNA, 25 bp, Homo sapien
aaatacagggcagtcctcactttgc

SEQ ID NO: 304012 - DNA, 25 bp, Homo sapien
acagggcagtcctcactttgcatgg

SEQ ID NO: 304013 - DNA, 25 bp, Homo sapien
ctcactttgcatggtagtgcaagat

SEQ ID NO: 304014 - DNA, 25 bp, Homo sapien
ggaaagcaactctacatccaaaggg

SEQ ID NO: 304015 - DNA, 25 bp, Homo sapien
gggaatataatgactactctgtggt

SEQ ID NO: 304016 - DNA, 25 bp, Homo sapien
aatgactactctgtggtcctcataa

SEQ ID NO: 304017 - DNA, 25 bp, Homo sapien
gactactctgtggtcctcataattt

SEQ ID NO: 304018 - DNA, 25 bp, Homo sapien
tgtggtcctcataatttttgtcaaa

SEQ ID NO: 304019 - DNA, 25 bp, Homo sapien
attatcagttgcaaatgtggacaga

SEQ ID NO: 304020 - DNA, 25 bp, Homo sapien
acatagcaaggatagttggaacagt

SEQ ID NO: 304021 - DNA, 25 bp, Homo sapien
actcatctactcattcttcgagtct

SEQ ID NO: 304022 - DNA, 25 bp, Homo sapien
tcattcttcgagtctacacttattg

SEQ ID NO: 304023 - DNA, 25 bp, Homo sapien
agtctacacttattgaatgcctgca

SEQ ID NO: 304024 - DNA, 25 bp, Homo sapien
aatgcctgcaaaatctaagtatcac

SEQ ID NO: 304025 - DNA, 25 bp, Homo sapien
aattatcttcagtataatccatggt

SEQ ID NO: 304026 - DNA, 25 bp, Homo sapien
taatccatggtaatgtatgcagtaa

SEQ ID NO: 304027 - DNA, 25 bp, Homo sapien
gtaattcaaattgatctctctctca

SEQ ID NO: 304028 - DNA, 25 bp, Homo sapien
gatctctctctcaataggtttctta

SEQ ID NO: 304029 - DNA, 25 bp, Homo sapien
ctctcaataggtttcttaacaatct

SEQ ID NO: 304030 - DNA, 25 bp, Homo sapien
ggaactattgggatttgtgacgctt

SEQ ID NO: 304031 - DNA, 25 bp, Homo sapien
ttgtgacgcttgttgcagtttacca

SEQ ID NO: 304032 - DNA, 25 bp, Homo sapien
aagacagcgggaagttcaccgccca

SEQ ID NO: 304033 - DNA, 25 bp, Homo sapien
aagttcaccgcccatttccagaaga

SEQ ID NO: 304034 - DNA, 25 bp, Homo sapien
atgaatattcttcccctcgctgttc

SEQ ID NO: 304035 - DNA, 25 bp, Homo sapien
ttcagtacagaaaccctacatttag

SEQ ID NO: 304036 - DNA, 25 bp, Homo sapien
gcccgctcacctgttgagaagttga

SEQ ID NO: 304037 - DNA, 25 bp, Homo sapien
aagttgaactgtgggccaagctcct

SEQ ID NO: 304038 - DNA, 25 bp, Homo sapien
aagctcctgcttctcagtccgtggt

SEQ ID NO: 304039 - DNA, 25 bp, Homo sapien
taaagtcggcttcggtttcatgtat

SEQ ID NO: 304040 - DNA, 25 bp, Homo sapien
ggtttcatgtatcggcttcgtgaca

SEQ ID NO: 304041 - DNA, 25 bp, Homo sapien
atcggcttcgtgacaccaaacaggg

SEQ ID NO: 304042 - DNA, 25 bp, Homo sapien
agactggttagagccacgacaactg

SEQ ID NO: 304043 - DNA, 25 bp, Homo sapien
tctgttgtttatccatgaagcctat

SEQ ID NO: 304044 - DNA, 25 bp, Homo sapien
gcccagtgggtctcaaaacattctt

SEQ ID NO: 304045 - DNA, 25 bp, Homo sapien
gggtttgacacactgctattagtag

SEQ ID NO: 304046 - DNA, 25 bp, Homo sapien
attagtagtgactcataattccacg

SEQ ID NO: 304047 - DNA, 25 bp, Homo sapien
taattccacgattccctgggataca

SEQ ID NO: 304048 - DNA, 25 bp, Homo sapien
gattccctgggatacagagaaggca

SEQ ID NO: 304049 - DNA, 25 bp, Homo sapien
gaacaaaaatcttcccaagaccctg

SEQ ID NO: 304050 - DNA, 25 bp, Homo sapien
caagaccctggcaaagagatcttcc

SEQ ID NO: 304051 - DNA, 25 bp, Homo sapien
tcttccttaggaatcagtggcatat

SEQ ID NO: 304052 - DNA, 25 bp, Homo sapien
gtggcatatgcgtttatgttcttta

SEQ ID NO: 304053 - DNA, 25 bp, Homo sapien
aagtgagcgcacttttttgaagctc

SEQ ID NO: 304054 - DNA, 25 bp, Homo sapien
aaggatctgggcctgtgcgcgacgc

SEQ ID NO: 304055 - DNA, 25 bp, Homo sapien
tcatggagaagtttcgggcggtgct

SEQ ID NO: 304056 - DNA, 25 bp, Homo sapien
ggtgctggacctgcacgtcaagcac

SEQ ID NO: 304057 - DNA, 25 bp, Homo sapien
acgtcaagcaccacagcgccttggg

SEQ ID NO: 304058 - DNA, 25 bp, Homo sapien
agcgccttgggctacggcctggtga

SEQ ID NO: 304059 - DNA, 25 bp, Homo sapien
gagcgcatcttctccgccgtggcat

SEQ ID NO: 304060 - DNA, 25 bp, Homo sapien
gtggcattccagtgcccgtgcagcg

SEQ ID NO: 304061 - DNA, 25 bp, Homo sapien
aaaaggctgcttctcgcagagtgga

SEQ ID NO: 304062 - DNA, 25 bp, Homo sapien
ttctcgcagagtggaaagccccggt

SEQ ID NO: 304063 - DNA, 25 bp, Homo sapien
catcccaccaaaaccatttgacaag

SEQ ID NO: 304064 - DNA, 25 bp, Homo sapien
aaccatttgacaagcaggacaacga

SEQ ID NO: 304065 - DNA, 25 bp, Homo sapien
acctatcatgtatcttctgtaccct

SEQ ID NO: 304066 - DNA, 25 bp, Homo sapien
atgtatcttctgtacccttacctta

SEQ ID NO: 304067 - DNA, 25 bp, Homo sapien
tcttctgtacccttaccttattttg

SEQ ID NO: 304068 - DNA, 25 bp, Homo sapien
aatcctagacatcaaatcatttcac

SEQ ID NO: 304069 - DNA, 25 bp, Homo sapien
gtcatcatatataattaaacagctt

SEQ ID NO: 304070 - DNA, 25 bp, Homo sapien
atgtcttttaaagatggcctgtggt

SEQ ID NO: 304071 - DNA, 25 bp, Homo sapien
agatggcctgtggttatcttggaaa

SEQ ID NO: 304072 - DNA, 25 bp, Homo sapien
cctgtggttatcttggaaattggtg

SEQ ID NO: 304073 - DNA, 25 bp, Homo sapien
attggtgatttatgctagaaagctt

SEQ ID NO: 304074 - DNA, 25 bp, Homo sapien
gctagaaagcttttaatgttggttt

SEQ ID NO: 304075 - DNA, 25 bp, Homo sapien
ttggtttattgttgaattcctagaa

SEQ ID NO: 304076 - DNA, 25 bp, Homo sapien
taggcataagctactgcacccatct

SEQ ID NO: 304077 - DNA, 25 bp, Homo sapien
taagctactgcacccatctcagaat

SEQ ID NO: 304078 - DNA, 25 bp, Homo sapien
tactgcacccatctcagaatttgtc

SEQ ID NO: 304079 - DNA, 25 bp, Homo sapien
gcacccatctcagaatttgtctatg

SEQ ID NO: 304080 - DNA, 25 bp, Homo sapien
ctcagaatttgtctatgtttacaat

SEQ ID NO: 304081 - DNA, 25 bp, Homo sapien
caatattatcaatgggtagacagct

SEQ ID NO: 304082 - DNA, 25 bp, Homo sapien
atgggtagacagctaattgcacaga

SEQ ID NO: 304083 - DNA, 25 bp, Homo sapien
ggtagacagctaattgcacagaata

SEQ ID NO: 304084 - DNA, 25 bp, Homo sapien
cattttccttaattcctgatttact

SEQ ID NO: 304085 - DNA, 25 bp, Homo sapien
aattcctgatttactcaggcccagg

SEQ ID NO: 304086 - DNA, 25 bp, Homo sapien
tcctgatttactcaggcccaggctt

SEQ ID NO: 304087 - DNA, 25 bp, Homo sapien
tcctggaggccgtgctgaagctgct

SEQ ID NO: 304088 - DNA, 25 bp, Homo sapien
acacctatgtggagagtccggctgc

SEQ ID NO: 304089 - DNA, 25 bp, Homo sapien
ctatgtggagagtccggctgcagtc

SEQ ID NO: 304090 - DNA, 25 bp, Homo sapien
gacggagtacgagtccatcctacgc

SEQ ID NO: 304091 - DNA, 25 bp, Homo sapien
ccggctgtgtgagagccctggcaaa

SEQ ID NO: 304092 - DNA, 25 bp, Homo sapien
gtgtgagagccctggcaaagataga

SEQ ID NO: 304093 - DNA, 25 bp, Homo sapien
gaggtttgagttttatgaacgggct

SEQ ID NO: 304094 - DNA, 25 bp, Homo sapien
ttatgaacgggctaagaaggctttt

SEQ ID NO: 304095 - DNA, 25 bp, Homo sapien
cgagctgctctacgcgctggcgcgg

SEQ ID NO: 304096 - DNA, 25 bp, Homo sapien
gacgagatcggctgggcatcccgca

SEQ ID NO: 304097 - DNA, 25 bp, Homo sapien
tgggcatcccgcagctcctggaggc

SEQ ID NO: 304098 - DNA, 25 bp, Homo sapien
agaaacggttgaagaacaagcaagc

SEQ ID NO: 304099 - DNA, 25 bp, Homo sapien
tatttcaagacagacagtatcaaat

SEQ ID NO: 304100 - DNA, 25 bp, Homo sapien
gacagtatcaaattgatgctgcaat

SEQ ID NO: 304101 - DNA, 25 bp, Homo sapien
ccacaatctccttgtttcagaagtg

SEQ ID NO: 304102 - DNA, 25 bp, Homo sapien
acaatctccttgtttcagaagtgta

SEQ ID NO: 304103 - DNA, 25 bp, Homo sapien
aatctccttgtttcagaagtgtaca

SEQ ID NO: 304104 - DNA, 25 bp, Homo sapien
tctccttgtttcagaagtgtacaac

SEQ ID NO: 304105 - DNA, 25 bp, Homo sapien
ccttgtttcagaagtgtacaaccag

SEQ ID NO: 304106 - DNA, 25 bp, Homo sapien
tagaatctttaattgaccgggacta

SEQ ID NO: 304107 - DNA, 25 bp, Homo sapien
gaatctttaattgaccgggactaca

SEQ ID NO: 304108 - DNA, 25 bp, Homo sapien
aatctttaattgaccgggactacat

SEQ ID NO: 304109 - DNA, 25 bp, Homo sapien
ggaattattgtccagtgccaacccc

SEQ ID NO: 304110 - DNA, 25 bp, Homo sapien
tcaggtgagcagagcctctacttga

SEQ ID NO: 304111 - DNA, 25 bp, Homo sapien
ctctacttgagggactattgttact

SEQ ID NO: 304112 - DNA, 25 bp, Homo sapien
tataggaatccttacttccccagta

SEQ ID NO: 304113 - DNA, 25 bp, Homo sapien
ttacttccccagtattgaagctgaa

SEQ ID NO: 304114 - DNA, 25 bp, Homo sapien
aagctgaatcagtgagtgtgtacaa

SEQ ID NO: 304115 - DNA, 25 bp, Homo sapien
aataaatcctggaagtcttgggatc

SEQ ID NO: 304116 - DNA, 25 bp, Homo sapien
tagcattttcttctatcacaccaca

SEQ ID NO: 304117 - DNA, 25 bp, Homo sapien
cctgtgtatgggtcaatggctgcaa

SEQ ID NO: 304118 - DNA, 25 bp, Homo sapien
aatggctgcaagagactcccacggc

SEQ ID NO: 304119 - DNA, 25 bp, Homo sapien
cccacggcccattctcaaaggagga

SEQ ID NO: 304120 - DNA, 25 bp, Homo sapien
gtgggatggtagcattcgtttctaa

SEQ ID NO: 304121 - DNA, 25 bp, Homo sapien
aatatagtgatttcacttcttcccc

SEQ ID NO: 304122 - DNA, 25 bp, Homo sapien
acctgctcgaggaaatccaattgaa

SEQ ID NO: 304123 - DNA, 25 bp, Homo sapien
cacttcttcccccatatagatattg

SEQ ID NO: 304124 - DNA, 25 bp, Homo sapien
attatagccatccacattagttttg

SEQ ID NO: 304125 - DNA, 25 bp, Homo sapien
gccatccacattagttttgtcaaat

SEQ ID NO: 304126 - DNA, 25 bp, Homo sapien
gtcaaattttcagcaatttctttaa

SEQ ID NO: 304127 - DNA, 25 bp, Homo sapien
atgataactgctattaagggaattc

SEQ ID NO: 304128 - DNA, 25 bp, Homo sapien
agaaacagatgttccagctaccagg

SEQ ID NO: 304129 - DNA, 25 bp, Homo sapien
agctaccaggatgtgcacgcattta

SEQ ID NO: 304130 - DNA, 25 bp, Homo sapien
gtgcacgcatttaacctgaacatgt

SEQ ID NO: 304131 - DNA, 25 bp, Homo sapien
caggtgtctgtacagggttttgatt

SEQ ID NO: 304132 - DNA, 25 bp, Homo sapien
gtataactacacaacaatcctacag

SEQ ID NO: 304133 - DNA, 25 bp, Homo sapien
gacttgtgtgctataagctttcagc

SEQ ID NO: 304134 - DNA, 25 bp, Homo sapien
tataagctttcagcaggtcctctgt

SEQ ID NO: 304135 - DNA, 25 bp, Homo sapien
gcaggtcctctgtctctagaataag

SEQ ID NO: 304136 - DNA, 25 bp, Homo sapien
aagtgtgctgacaagctggacacaa

SEQ ID NO: 304137 - DNA, 25 bp, Homo sapien
gctggacacaatctgggtgtgccca

SEQ ID NO: 304138 - DNA, 25 bp, Homo sapien
atgtttaaattgaaggctgcagcca

SEQ ID NO: 304139 - DNA, 25 bp, Homo sapien
ggctgcagccaatggaatatgttca

SEQ ID NO: 304140 - DNA, 25 bp, Homo sapien
atatgttcagctggttttccttggc

SEQ ID NO: 304141 - DNA, 25 bp, Homo sapien
cagctggttttccttggcttcctag

SEQ ID NO: 304142 - DNA, 25 bp, Homo sapien
acaggatctcagtatgttgcgcagg

SEQ ID NO: 304143 - DNA, 25 bp, Homo sapien
caggatctcagtatgttgcgcaggc

SEQ ID NO: 304144 - DNA, 25 bp, Homo sapien
atgttgcgcaggctggtctttaatt

SEQ ID NO: 304145 - DNA, 25 bp, Homo sapien
tgttgcgcaggctggtctttaattc

SEQ ID NO: 304146 - DNA, 25 bp, Homo sapien
gttgcgcaggctggtctttaattcc

SEQ ID NO: 304147 - DNA, 25 bp, Homo sapien
ttgcgcaggctggtctttaattcct

SEQ ID NO: 304148 - DNA, 25 bp, Homo sapien
agtgatcctcccatagatttgtctg

SEQ ID NO: 304149 - DNA, 25 bp, Homo sapien
gtgatcctcccatagatttgtctgt

SEQ ID NO: 304150 - DNA, 25 bp, Homo sapien
tttcagaaatgaggtgttgccttct

SEQ ID NO: 304151 - DNA, 25 bp, Homo sapien
ttcagaaatgaggtgttgccttctt

SEQ ID NO: 304152 - DNA, 25 bp, Homo sapien
tcagaaatgaggtgttgccttcttg

SEQ ID NO: 304153 - DNA, 25 bp, Homo sapien
acagctcctaggatagtgtgtgaca

SEQ ID NO: 304154 - DNA, 25 bp, Homo sapien
agtgtgtgacatgtagtaggttctc

SEQ ID NO: 304155 - DNA, 25 bp, Homo sapien
gtaggttctcagtatacttctctgg

SEQ ID NO: 304156 - DNA, 25 bp, Homo sapien
gtatacttctctggtacttaaatta

SEQ ID NO: 304157 - DNA, 25 bp, Homo sapien
gtaaacatgcctctgggttcagaaa

SEQ ID NO: 304158 - DNA, 25 bp, Homo sapien
gtgttggttctcctgtaaagtaata

SEQ ID NO: 304159 - DNA, 25 bp, Homo sapien
ggccgagagcattaaatttgcctct

SEQ ID NO: 304160 - DNA, 25 bp, Homo sapien
aatttgcctctataatatcatatca

SEQ ID NO: 304161 - DNA, 25 bp, Homo sapien
acacattttaatctctcaaccaggg

SEQ ID NO: 304162 - DNA, 25 bp, Homo sapien
tatttttctgtctacagctcctagg

SEQ ID NO: 304163 - DNA, 25 bp, Homo sapien
ttctgtctacagctcctaggatagt

SEQ ID NO: 304164 - DNA, 25 bp, Homo sapien
tgctaccattttggctgtttggatc

SEQ ID NO: 304165 - DNA, 25 bp, Homo sapien
cattttggctgtttggatcctcctt

SEQ ID NO: 304166 - DNA, 25 bp, Homo sapien
ggctgtttggatcctcctttgaaaa

SEQ ID NO: 304167 - DNA, 25 bp, Homo sapien
tcctttgaaaaagtctcctaaacag

SEQ ID NO: 304168 - DNA, 25 bp, Homo sapien
taaacagacaggctacggatggata

SEQ ID NO: 304169 - DNA, 25 bp, Homo sapien
gacaggctacggatggatatgtcag

SEQ ID NO: 304170 - DNA, 25 bp, Homo sapien
tgtcaggaatgtgattcttcatctt

SEQ ID NO: 304171 - DNA, 25 bp, Homo sapien
agaaaaaatatatctcaggagctca

SEQ ID NO: 304172 - DNA, 25 bp, Homo sapien
ctcaggagctcaacatggaacagaa

SEQ ID NO: 304173 - DNA, 25 bp, Homo sapien
gaaaagtttgcagcttatgtaatag

SEQ ID NO: 304174 - DNA, 25 bp, Homo sapien
ttgcagcttatgtaatagcagataa

SEQ ID NO: 304175 - DNA, 25 bp, Homo sapien
ccggcaccgcgggaaaagcagcgca

SEQ ID NO: 304176 - DNA, 25 bp, Homo sapien
aaaagcagcgcagggcagatcaggc

SEQ ID NO: 304177 - DNA, 25 bp, Homo sapien
atcaggcagggagggcggccggagc

SEQ ID NO: 304178 - DNA, 25 bp, Homo sapien
tcccagtcagttcaagacccgacat

SEQ ID NO: 304179 - DNA, 25 bp, Homo sapien
agtcagttcaagacccgacatgagg

SEQ ID NO: 304180 - DNA, 25 bp, Homo sapien
gttcaagacccgacatgagggaaaa

SEQ ID NO: 304181 - DNA, 25 bp, Homo sapien
cggaggccgccaagacggtcttaga

SEQ ID NO: 304182 - DNA, 25 bp, Homo sapien
gccgccaagacggtcttagaaaaat

SEQ ID NO: 304183 - DNA, 25 bp, Homo sapien
gaaaaataccccaatacacccatga

SEQ ID NO: 304184 - DNA, 25 bp, Homo sapien
ccccaatacacccatgagtcataaa

SEQ ID NO: 304185 - DNA, 25 bp, Homo sapien
gaaattcttcaagttatccagagag

SEQ ID NO: 304186 - DNA, 25 bp, Homo sapien
acacctatgtggagagtccggctgc

SEQ ID NO: 304187 - DNA, 25 bp, Homo sapien
ctatgtggagagtccggctgcagtc

SEQ ID NO: 304188 - DNA, 25 bp, Homo sapien
ggacggagtacgagtccatcctacg

SEQ ID NO: 304189 - DNA, 25 bp, Homo sapien
acggagtacgagtccatcctacgca

SEQ ID NO: 304190 - DNA, 25 bp, Homo sapien
ccggctgtgtgagagccctggcaaa

SEQ ID NO: 304191 - DNA, 25 bp, Homo sapien
gtgtgagagccctggcaaagataga

SEQ ID NO: 304192 - DNA, 25 bp, Homo sapien
gaggtttgagttttatgaacgggct

SEQ ID NO: 304193 - DNA, 25 bp, Homo sapien
tgagttttatgaacgggctaagaag

SEQ ID NO: 304194 - DNA, 25 bp, Homo sapien
cgagctgctctacgcgctggcgcgg

SEQ ID NO: 304195 - DNA, 25 bp, Homo sapien
gacgagatcggctgggcatcccgca

SEQ ID NO: 304196 - DNA, 25 bp, Homo sapien
tgggcatcccgcagctcctggaggc

SEQ ID NO: 304197 - DNA, 25 bp, Homo sapien
atgaaattgtattggcctcaaaccc

SEQ ID NO: 304198 - DNA, 25 bp, Homo sapien
tattggcctcaaacccaaattttct

SEQ ID NO: 304199 - DNA, 25 bp, Homo sapien
ctaggatagatttttcatgaaagct

SEQ ID NO: 304200 - DNA, 25 bp, Homo sapien
gattgtttatttgttttacagctaa

SEQ ID NO: 304201 - DNA, 25 bp, Homo sapien
cattaagcatgattccaggttttta

SEQ ID NO: 304202 - DNA, 25 bp, Homo sapien
caggtttttaattatgttccagcaa

SEQ ID NO: 304203 - DNA, 25 bp, Homo sapien
ttccagcaacactagtgtttcttta

SEQ ID NO: 304204 - DNA, 25 bp, Homo sapien
attcttgaaagtaataccactgttg

SEQ ID NO: 304205 - DNA, 25 bp, Homo sapien
taataccactgttgttactctttct

SEQ ID NO: 304206 - DNA, 25 bp, Homo sapien
actctttctccttacaatttttatg

SEQ ID NO: 304207 - DNA, 25 bp, Homo sapien
gttgttgagatgtatcagttatgta

SEQ ID NO: 304208 - DNA, 25 bp, Homo sapien
ggaaccaaatccattaacattctaa

SEQ ID NO: 304209 - DNA, 25 bp, Homo sapien
ttctaactcagcatacttttaactt

SEQ ID NO: 304210 - DNA, 25 bp, Homo sapien
aagtagttcagcatctatcgccagc

SEQ ID NO: 304211 - DNA, 25 bp, Homo sapien
tatcgccagccaggttgtttctcag

SEQ ID NO: 304212 - DNA, 25 bp, Homo sapien
ggttgtttctcagccatcaaatgat

SEQ ID NO: 304213 - DNA, 25 bp, Homo sapien
atgactaaaatttctgaggcttcag

SEQ ID NO: 304214 - DNA, 25 bp, Homo sapien
tgaggcttcaggagtaacagagata

SEQ ID NO: 304215 - DNA, 25 bp, Homo sapien
gatacaacagtcttggaggtaactc

SEQ ID NO: 304216 - DNA, 25 bp, Homo sapien
gaggtaactccatttgctacaggac

SEQ ID NO: 304217 - DNA, 25 bp, Homo sapien
atttgctacaggacaggcccttgcc

SEQ ID NO: 304218 - DNA, 25 bp, Homo sapien
ggacaggcccttgcctaaaagagaa

SEQ ID NO: 304219 - DNA, 25 bp, Homo sapien
acgacggatctgtgtgttacagtag

SEQ ID NO: 304220 - DNA, 25 bp, Homo sapien
gttacagtagaggatcacgggcatt

SEQ ID NO: 304221 - DNA, 25 bp, Homo sapien
aggatcacgggcatttgaaatgaca

SEQ ID NO: 304222 - DNA, 25 bp, Homo sapien
gaaatgacacaactggaagctaaat

SEQ ID NO: 304223 - DNA, 25 bp, Homo sapien
aaggcgaggtatgacgctccacttg

SEQ ID NO: 304224 - DNA, 25 bp, Homo sapien
tatgacgctccacttggtctcactg

SEQ ID NO: 304225 - DNA, 25 bp, Homo sapien
atccaatctatcttccagtccagaa

SEQ ID NO: 304226 - DNA, 25 bp, Homo sapien
gttttgtgccaaaatgcattcaccc

SEQ ID NO: 304227 - DNA, 25 bp, Homo sapien
agtaaacccattcagcttcaggagg

SEQ ID NO: 304228 - DNA, 25 bp, Homo sapien
ggaggcttttcagcaaacaaagcat

SEQ ID NO: 304229 - DNA, 25 bp, Homo sapien
aagcataatttgtacgacggatctg

SEQ ID NO: 304230 - DNA, 25 bp, Homo sapien
gcaaaccatgagatgcactggccaa

SEQ ID NO: 304231 - DNA, 25 bp, Homo sapien
ccatgagatgcactggccaaatcca

SEQ ID NO: 304232 - DNA, 25 bp, Homo sapien
agcccaccggcttgttttcaaacag

SEQ ID NO: 304233 - DNA, 25 bp, Homo sapien
gagcaactactagagaatcccaaga

SEQ ID NO: 304234 - DNA, 25 bp, Homo sapien
agcttgcaagctagaaatggatttt

SEQ ID NO: 304235 - DNA, 25 bp, Homo sapien
tcacagaccatagataaagtttcat

SEQ ID NO: 304236 - DNA, 25 bp, Homo sapien
aagtttcattgtaacgcagccatgc

SEQ ID NO: 304237 - DNA, 25 bp, Homo sapien
ttgtaacgcagccatgctaattctt

SEQ ID NO: 304238 - DNA, 25 bp, Homo sapien
aatcccaagagattctttcaggaac

SEQ ID NO: 304239 - DNA, 25 bp, Homo sapien
caagagattctttcaggaactggaa

SEQ ID NO: 304240 - DNA, 25 bp, Homo sapien
gacattgtacagagtcagcaaacca

SEQ ID NO: 304241 - DNA, 25 bp, Homo sapien
taatgtagccattgattaccatgta

SEQ ID NO: 304242 - DNA, 25 bp, Homo sapien
gattaccatgtaactctgggtcact

SEQ ID NO: 304243 - DNA, 25 bp, Homo sapien
gtaactctgggtcactattcattag

SEQ ID NO: 304244 - DNA, 25 bp, Homo sapien
agtaaaacgagattgaggacttcaa

SEQ ID NO: 304245 - DNA, 25 bp, Homo sapien
ttaagaatagggttgtcttccctat

SEQ ID NO: 304246 - DNA, 25 bp, Homo sapien
gtcttccctattctactgtcgaaat

SEQ ID NO: 304247 - DNA, 25 bp, Homo sapien
tattctactgtcgaaatatgggcga

SEQ ID NO: 304248 - DNA, 25 bp, Homo sapien
ggcgaaatgggcgattatacacaaa

SEQ ID NO: 304249 - DNA, 25 bp, Homo sapien
gctggaacgctataatgtatcatca

SEQ ID NO: 304250 - DNA, 25 bp, Homo sapien
aacatggccgtgtttcataacatac

SEQ ID NO: 304251 - DNA, 25 bp, Homo sapien
ggccgtgtttcataacatactcaag

SEQ ID NO: 304252 - DNA, 25 bp, Homo sapien
tagtcagtatagttgggaggcacca

SEQ ID NO: 304253 - DNA, 25 bp, Homo sapien
ggcaccatggagcagggatcaccct

SEQ ID NO: 304254 - DNA, 25 bp, Homo sapien
cctccacctcacttgacaaggagat

SEQ ID NO: 304255 - DNA, 25 bp, Homo sapien
gttcatagacaccatctgataggga

SEQ ID NO: 304256 - DNA, 25 bp, Homo sapien
ggaactggctcagcataggccaact

SEQ ID NO: 304257 - DNA, 25 bp, Homo sapien
acccaggttgccatcttgaagactt

SEQ ID NO: 304258 - DNA, 25 bp, Homo sapien
gaagactttccatcacccaaatatc

SEQ ID NO: 304259 - DNA, 25 bp, Homo sapien
cccaaatatcattcagctcttccag

SEQ ID NO: 304260 - DNA, 25 bp, Homo sapien
agtggccttagcctagctagcacag

SEQ ID NO: 304261 - DNA, 25 bp, Homo sapien
ctgtgcatcacagcatagcttttag

SEQ ID NO: 304262 - DNA, 25 bp, Homo sapien
tagaggcaggatttgtagtcagtat

SEQ ID NO: 304263 - DNA, 25 bp, Homo sapien
taccagtccataccagctgcgattt

SEQ ID NO: 304264 - DNA, 25 bp, Homo sapien
gtccataccagctgcgatttgtgag

SEQ ID NO: 304265 - DNA, 25 bp, Homo sapien
agctgcgatttgtgagtggacctgt

SEQ ID NO: 304266 - DNA, 25 bp, Homo sapien
ggctctcagagataaggttttttac

SEQ ID NO: 304267 - DNA, 25 bp, Homo sapien
tttacatgtgtaacaatcccaagat

SEQ ID NO: 304268 - DNA, 25 bp, Homo sapien
gtaacaatcccaagatttcctagat

SEQ ID NO: 304269 - DNA, 25 bp, Homo sapien
gataacttcttcagatacatttgtg

SEQ ID NO: 304270 - DNA, 25 bp, Homo sapien
gtgtaactttacagaatgtcatcaa

SEQ ID NO: 304271 - DNA, 25 bp, Homo sapien
ttacagaatgtcatcaagctttggg

SEQ ID NO: 304272 - DNA, 25 bp, Homo sapien
gggcacatgatttatccataaagga

SEQ ID NO: 304273 - DNA, 25 bp, Homo sapien
gatgcagtatgcttacttaaattaa

SEQ ID NO: 304274 - DNA, 25 bp, Homo sapien
aatttctgggctggtgggacccttg

SEQ ID NO: 304275 - DNA, 25 bp, Homo sapien
gggacccttgtccacaattgtagtt

SEQ ID NO: 304276 - DNA, 25 bp, Homo sapien
atatgtgcatcctctgtgctatcct

SEQ ID NO: 304277 - DNA, 25 bp, Homo sapien
gtgctatccttcagatccaatcaag

SEQ ID NO: 304278 - DNA, 25 bp, Homo sapien
agttcagaggaaagccttccgcacc

SEQ ID NO: 304279 - DNA, 25 bp, Homo sapien
cacctctgtgtgattggactcgttt

SEQ ID NO: 304280 - DNA, 25 bp, Homo sapien
gattggactcgtttatggcacagcc

SEQ ID NO: 304281 - DNA, 25 bp, Homo sapien
tggcacagccattatcatgtatgtt

SEQ ID NO: 304282 - DNA, 25 bp, Homo sapien
gaaatatctcctgctgtttcacagc

SEQ ID NO: 304283 - DNA, 25 bp, Homo sapien
tgtttcacagcctctttaatcccat

SEQ ID NO: 304284 - DNA, 25 bp, Homo sapien
tcaatccccttatctgtagtcttag

SEQ ID NO: 304285 - DNA, 25 bp, Homo sapien
aagactttcaaaaggccgcaggata

SEQ ID NO: 304286 - DNA, 25 bp, Homo sapien
taaactgcctataggaacccagaaa

SEQ ID NO: 304287 - DNA, 25 bp, Homo sapien
aaggccgcaggataattccaatgga

SEQ ID NO: 304288 - DNA, 25 bp, Homo sapien
ttccaatggatctatttgttcagtc

SEQ ID NO: 304289 - DNA, 25 bp, Homo sapien
ttgttcagtcattcagaagctatat

SEQ ID NO: 304290 - DNA, 25 bp, Homo sapien
tcagaagctatatcgggaacccatc

SEQ ID NO: 304291 - DNA, 25 bp, Homo sapien
tatcgggaacccatcatggatgagc

SEQ ID NO: 304292 - DNA, 25 bp, Homo sapien
tggatgagctctgctctaggcatgg

SEQ ID NO: 304293 - DNA, 25 bp, Homo sapien
ggaagacaaatatggccctagttct

SEQ ID NO: 304294 - DNA, 25 bp, Homo sapien
atggccctagttcttgtggatctta

SEQ ID NO: 304295 - DNA, 25 bp, Homo sapien
ctagttcttgtggatcttatgttct

SEQ ID NO: 304296 - DNA, 25 bp, Homo sapien
gaagcagatcacagccactggtcca

SEQ ID NO: 304297 - DNA, 25 bp, Homo sapien
agccactggtccataacaattagga

SEQ ID NO: 304298 - DNA, 25 bp, Homo sapien
gcaagcatctttttatcacatacca

SEQ ID NO: 304299 - DNA, 25 bp, Homo sapien
ttgtcaggttcctccattggaggga

SEQ ID NO: 304300 - DNA, 25 bp, Homo sapien
gggaattgtgtttcatgattaggca

SEQ ID NO: 304301 - DNA, 25 bp, Homo sapien
atgattaggcactgtttctgctcct

SEQ ID NO: 304302 - DNA, 25 bp, Homo sapien
gcactgtttctgctccttaaaaatg

SEQ ID NO: 304303 - DNA, 25 bp, Homo sapien
aaatgactttccagtctatcctcca

SEQ ID NO: 304304 - DNA, 25 bp, Homo sapien
agtctatcctccacagctctttgtt

SEQ ID NO: 304305 - DNA, 25 bp, Homo sapien
agctctttgttctacactctaggga

SEQ ID NO: 304306 - DNA, 25 bp, Homo sapien
gttctacactctagggaatcattct

SEQ ID NO: 304307 - DNA, 25 bp, Homo sapien
tcctcaatccggagagtccgcgcgg

SEQ ID NO: 304308 - DNA, 25 bp, Homo sapien
gggcttttcctaataaatagccagg

SEQ ID NO: 304309 - DNA, 25 bp, Homo sapien
taataaatagccaggcacccgctgc

SEQ ID NO: 304310 - DNA, 25 bp, Homo sapien
cctcgcgctgcgtacgggagcacgt

SEQ ID NO: 304311 - DNA, 25 bp, Homo sapien
caggtgccccgggaacgagcctagg

SEQ ID NO: 304312 - DNA, 25 bp, Homo sapien
taggaaccgggtccgccgagtgcgg

SEQ ID NO: 304313 - DNA, 25 bp, Homo sapien
gggaccggcctctctccggagaaag

SEQ ID NO: 304314 - DNA, 25 bp, Homo sapien
ggcctctctccggagaaagtaagga

SEQ ID NO: 304315 - DNA, 25 bp, Homo sapien
gaaagtaaggaattctgctcctggg

SEQ ID NO: 304316 - DNA, 25 bp, Homo sapien
gctcctgggcaggtaataccggaaa

SEQ ID NO: 304317 - DNA, 25 bp, Homo sapien
aggctgcaatcgcaaattgtttaaa

SEQ ID NO: 304318 - DNA, 25 bp, Homo sapien
gcaacagatatgacacagctaggct

SEQ ID NO: 304319 - DNA, 25 bp, Homo sapien
gtattcacttactgtactactgaag

SEQ ID NO: 304320 - DNA, 25 bp, Homo sapien
gaagagtcaacatttcaaagctaat

SEQ ID NO: 304321 - DNA, 25 bp, Homo sapien
tctactaagtgtgtgactttttccc

SEQ ID NO: 304322 - DNA, 25 bp, Homo sapien
gactttttccccaagaatgatttca

SEQ ID NO: 304323 - DNA, 25 bp, Homo sapien
atttcatctgcttccaccaatttca

SEQ ID NO: 304324 - DNA, 25 bp, Homo sapien
gcttccaccaatttcagtattctag

SEQ ID NO: 304325 - DNA, 25 bp, Homo sapien
gtcaaaatcatagcatgcggaagca

SEQ ID NO: 304326 - DNA, 25 bp, Homo sapien
gcggaagcagcacaagatatcatgt

SEQ ID NO: 304327 - DNA, 25 bp, Homo sapien
caacatgtgttgtgccaagtcagta

SEQ ID NO: 304328 - DNA, 25 bp, Homo sapien
tgtgccaagtcagtaaacagccatc

SEQ ID NO: 304329 - DNA, 25 bp, Homo sapien
gtttaacctgcttaatggctacagt

SEQ ID NO: 304330 - DNA, 25 bp, Homo sapien
tgtgaaaactgtagccttggtctct

SEQ ID NO: 304331 - DNA, 25 bp, Homo sapien
gtagccttggtctcttaaccatgta

SEQ ID NO: 304332 - DNA, 25 bp, Homo sapien
aatttggactataatgtccttgctt

SEQ ID NO: 304333 - DNA, 25 bp, Homo sapien
atttgctgtgtttgcttttgtctcc

SEQ ID NO: 304334 - DNA, 25 bp, Homo sapien
tttgtctcctcgtggtgttattcat

SEQ ID NO: 304335 - DNA, 25 bp, Homo sapien
tctcctcgtggtgttattcatagac

SEQ ID NO: 304336 - DNA, 25 bp, Homo sapien
attcatagacctggaaatgcttctc

SEQ ID NO: 304337 - DNA, 25 bp, Homo sapien
aaatgcttctcagatcctgtgtggc

SEQ ID NO: 304338 - DNA, 25 bp, Homo sapien
cagatcctgtgtggccggtgtttgc

SEQ ID NO: 304339 - DNA, 25 bp, Homo sapien
ggtgtttgcatcttcagtggccaca

SEQ ID NO: 304340 - DNA, 25 bp, Homo sapien
gaggccgtgcctcagcattctgtta

SEQ ID NO: 304341 - DNA, 25 bp, Homo sapien
gtgcctcagcattctgttactcggc

SEQ ID NO: 304342 - DNA, 25 bp, Homo sapien
agcattctgttactcggcctgcagc

SEQ ID NO: 304343 - DNA, 25 bp, Homo sapien
ccgaggtggcgctgaggtggcttca

SEQ ID NO: 304344 - DNA, 25 bp, Homo sapien
tggctcctgctcacggatgctgttg

SEQ ID NO: 304345 - DNA, 25 bp, Homo sapien
tcacggatgctgttgcatttcctgc

SEQ ID NO: 304346 - DNA, 25 bp, Homo sapien
tgcctgccacctttttgccatgaca

SEQ ID NO: 304347 - DNA, 25 bp, Homo sapien
tttttgccatgacaccagactctct

SEQ ID NO: 304348 - DNA, 25 bp, Homo sapien
ccatgacaccagactctcttttaaa

SEQ ID NO: 304349 - DNA, 25 bp, Homo sapien
accagactctcttttaaattgtaat

SEQ ID NO: 304350 - DNA, 25 bp, Homo sapien
gaatctggaaacataaagtacccct

SEQ ID NO: 304351 - DNA, 25 bp, Homo sapien
aagttttcctatgctgacctttctt

SEQ ID NO: 304352 - DNA, 25 bp, Homo sapien
ctgacctttctttgtattctaggga

SEQ ID NO: 304353 - DNA, 25 bp, Homo sapien
gggataaatcctttttgaacacagt

SEQ ID NO: 304354 - DNA, 25 bp, Homo sapien
gaacacagtgcattattctttcaat

SEQ ID NO: 304355 - DNA, 25 bp, Homo sapien
tacactactgaatatgacttgctaa

SEQ ID NO: 304356 - DNA, 25 bp, Homo sapien
gagatttatgctttcagtgtattag

SEQ ID NO: 304357 - DNA, 25 bp, Homo sapien
gaataaccttaagctttctttctct

SEQ ID NO: 304358 - DNA, 25 bp, Homo sapien
ttgtattttccttgctcagttttag

SEQ ID NO: 304359 - DNA, 25 bp, Homo sapien
attatgctagcctcagatatttcct

SEQ ID NO: 304360 - DNA, 25 bp, Homo sapien
gcctcagatatttcctgagagcagt

SEQ ID NO: 304361 - DNA, 25 bp, Homo sapien
gcagtatgtctattttgccttctga

SEQ ID NO: 304362 - DNA, 25 bp, Homo sapien
aacccaggtaaactcacaaatagag

SEQ ID NO: 304363 - DNA, 25 bp, Homo sapien
atatgtaacaatttttgggccaaat

SEQ ID NO: 304364 - DNA, 25 bp, Homo sapien
gccaaatgcttaagaagtgagaatt

SEQ ID NO: 304365 - DNA, 25 bp, Homo sapien
ggaaacaaaagttggaatctgtctt

SEQ ID NO: 304366 - DNA, 25 bp, Homo sapien
aagttggaatctgtcttagaagtaa

SEQ ID NO: 304367 - DNA, 25 bp, Homo sapien
ttagaagtaatctactccacccctt

SEQ ID NO: 304368 - DNA, 25 bp, Homo sapien
gtttgagtgctctatttaaagctag

SEQ ID NO: 304369 - DNA, 25 bp, Homo sapien
caattaaatatgcatggctgtatct

SEQ ID NO: 304370 - DNA, 25 bp, Homo sapien
atatgcatggctgtatctaaagggc

SEQ ID NO: 304371 - DNA, 25 bp, Homo sapien
gcatggctgtatctaaagggcttga

SEQ ID NO: 304372 - DNA, 25 bp, Homo sapien
gctgtatctaaagggcttgaaaact

SEQ ID NO: 304373 - DNA, 25 bp, Homo sapien
gcatccaggagggtcatggactacc

SEQ ID NO: 304374 - DNA, 25 bp, Homo sapien
aacaggttctccatcccatagtgcc

SEQ ID NO: 304375 - DNA, 25 bp, Homo sapien
ggaaccgccctacctaagctattgc

SEQ ID NO: 304376 - DNA, 25 bp, Homo sapien
gctattgccagcaaggacaggcact

SEQ ID NO: 304377 - DNA, 25 bp, Homo sapien
gacaggcacttgagcaaaggcaaca

SEQ ID NO: 304378 - DNA, 25 bp, Homo sapien
atcccatagtgcctgtgacgggctc

SEQ ID NO: 304379 - DNA, 25 bp, Homo sapien
atctggcgaggcatagctaggtcct

SEQ ID NO: 304380 - DNA, 25 bp, Homo sapien
ggcatagctaggtcctcatgtccct

SEQ ID NO: 304381 - DNA, 25 bp, Homo sapien
gtaggttcccaagcttggagtcagt

SEQ ID NO: 304382 - DNA, 25 bp, Homo sapien
gtgacgggctcagataaaatcagca

SEQ ID NO: 304383 - DNA, 25 bp, Homo sapien
tggcctgttacagctggctcctgga

SEQ ID NO: 304384 - DNA, 25 bp, Homo sapien
gagagggggagctcacggcaaaggg

SEQ ID NO: 304385 - DNA, 25 bp, Homo sapien
tgggctcgggcctggcggtgtccga

SEQ ID NO: 304386 - DNA, 25 bp, Homo sapien
gggctcgggcctggcggtgtccgag

SEQ ID NO: 304387 - DNA, 25 bp, Homo sapien
gggggggcacggcccgcgcacctgg

SEQ ID NO: 304388 - DNA, 25 bp, Homo sapien
cgcgcgctcactcgcccgtgtgggt

SEQ ID NO: 304389 - DNA, 25 bp, Homo sapien
gtgggtccgcaggtggtacttgagc

SEQ ID NO: 304390 - DNA, 25 bp, Homo sapien
tgggtccgcaggtggtacttgagcg

SEQ ID NO: 304391 - DNA, 25 bp, Homo sapien
gggtccgcaggtggtacttgagcga

SEQ ID NO: 304392 - DNA, 25 bp, Homo sapien
gtccgcaggtggtacttgagcgact

SEQ ID NO: 304393 - DNA, 25 bp, Homo sapien
gcccccggggaaacgcggcagcaag

SEQ ID NO: 304394 - DNA, 25 bp, Homo sapien
gcagcaagggacctggtctcactgc

SEQ ID NO: 304395 - DNA, 25 bp, Homo sapien
tgatttctggtcacaaggcccttga

SEQ ID NO: 304396 - DNA, 25 bp, Homo sapien
cttgagcagctggaggacttaggca

SEQ ID NO: 304397 - DNA, 25 bp, Homo sapien
acatcttcatactcaggagtaggga

SEQ ID NO: 304398 - DNA, 25 bp, Homo sapien
gtgcggagagcagccattcacatga

SEQ ID NO: 304399 - DNA, 25 bp, Homo sapien
ttcacatgagaagactccaccctgg

SEQ ID NO: 304400 - DNA, 25 bp, Homo sapien
tgagaagactccaccctggaggcag

SEQ ID NO: 304401 - DNA, 25 bp, Homo sapien
atccttccttaactgggcctctggg

SEQ ID NO: 304402 - DNA, 25 bp, Homo sapien
gtggcctgtgaggtatacagccctt

SEQ ID NO: 304403 - DNA, 25 bp, Homo sapien
cagcacttagagaatgacgcctcaa

SEQ ID NO: 304404 - DNA, 25 bp, Homo sapien
ctgggatggagatgggctcactcct

SEQ ID NO: 304405 - DNA, 25 bp, Homo sapien
atgggctcactcctgggccagtcag

SEQ ID NO: 304406 - DNA, 25 bp, Homo sapien
gctgtgtaattcaagttggctgcac

SEQ ID NO: 304407 - DNA, 25 bp, Homo sapien
gtaattcaagttggctgcacagcaa

SEQ ID NO: 304408 - DNA, 25 bp, Homo sapien
agttggctgcacagcaatttaatga

SEQ ID NO: 304409 - DNA, 25 bp, Homo sapien
agattattgaaagtggctgatggcc

SEQ ID NO: 304410 - DNA, 25 bp, Homo sapien
ggctgatggccataatctagataat

SEQ ID NO: 304411 - DNA, 25 bp, Homo sapien
tctagataattcctactgtgtcccc

SEQ ID NO: 304412 - DNA, 25 bp, Homo sapien
tagataattcctactgtgtccccat

SEQ ID NO: 304413 - DNA, 25 bp, Homo sapien
taattcctactgtgtccccatccat

SEQ ID NO: 304414 - DNA, 25 bp, Homo sapien
tgcctaagaaatggtgctgtgtgga

SEQ ID NO: 304415 - DNA, 25 bp, Homo sapien
gctgtgtggaatttccttgtttaag

SEQ ID NO: 304416 - DNA, 25 bp, Homo sapien
cttgtttaagaagagatacgtgtta

SEQ ID NO: 304417 - DNA, 25 bp, Homo sapien
aatcttgcttttacctagcctagac

SEQ ID NO: 304418 - DNA, 25 bp, Homo sapien
tacctagcctagaccacatttcact

SEQ ID NO: 304419 - DNA, 25 bp, Homo sapien
aaagcccaggatgactcctctcaaa

SEQ ID NO: 304420 - DNA, 25 bp, Homo sapien
acatttcactctacacattacctga

SEQ ID NO: 304421 - DNA, 25 bp, Homo sapien
tacacattacctgataagggccaaa

SEQ ID NO: 304422 - DNA, 25 bp, Homo sapien
acacatcatccactgatcagaatac

SEQ ID NO: 304423 - DNA, 25 bp, Homo sapien
ggatgactcctctcaaacagtgaaa

SEQ ID NO: 304424 - DNA, 25 bp, Homo sapien
gactcctctcaaacagtgaaaccgg

SEQ ID NO: 304425 - DNA, 25 bp, Homo sapien
gtgaaaccgggatcaattttggcag

SEQ ID NO: 304426 - DNA, 25 bp, Homo sapien
acaccacccaaagaaacatggagag

SEQ ID NO: 304427 - DNA, 25 bp, Homo sapien
tggagaggaccaccattaagaaaca

SEQ ID NO: 304428 - DNA, 25 bp, Homo sapien
tgctcaggcgtgaggctggatcgta

SEQ ID NO: 304429 - DNA, 25 bp, Homo sapien
atcgtagggttcgaggctgcttgct

SEQ ID NO: 304430 - DNA, 25 bp, Homo sapien
cgaggctgcttgcttttgttgttgt

SEQ ID NO: 304431 - DNA, 25 bp, Homo sapien
taaactcagacccttgtaagcccct

SEQ ID NO: 304432 - DNA, 25 bp, Homo sapien
cttgcccaaagatcctttgctgagt

SEQ ID NO: 304433 - DNA, 25 bp, Homo sapien
tcctttgctgagtgttctgtttttg

SEQ ID NO: 304434 - DNA, 25 bp, Homo sapien
tcagccagatccttacacgtggagc

SEQ ID NO: 304435 - DNA, 25 bp, Homo sapien
aaagctggagcctgacgtcagagct

SEQ ID NO: 304436 - DNA, 25 bp, Homo sapien
gcctgacgtcagagcttttaactcg

SEQ ID NO: 304437 - DNA, 25 bp, Homo sapien
agagcttttaactcggacatcaccc

SEQ ID NO: 304438 - DNA, 25 bp, Homo sapien
tcatacgggcagactgctcaggcgt

SEQ ID NO: 304439 - DNA, 25 bp, Homo sapien
ttggcaatgttaatgcttttaagat

SEQ ID NO: 304440 - DNA, 25 bp, Homo sapien
gatttgaacttgtcctcaaaccaag

SEQ ID NO: 304441 - DNA, 25 bp, Homo sapien
gaacttgtcctcaaaccaaggagac

SEQ ID NO: 304442 - DNA, 25 bp, Homo sapien
accaaggagacaacaatagtgtaat

SEQ ID NO: 304443 - DNA, 25 bp, Homo sapien
tttcagacataggacttctgccttg

SEQ ID NO: 304444 - DNA, 25 bp, Homo sapien
gtggatagttttctgtttaaatgca

SEQ ID NO: 304445 - DNA, 25 bp, Homo sapien
agttttctgtttaaatgcattggtc

SEQ ID NO: 304446 - DNA, 25 bp, Homo sapien
tttggctgtttgtaattcacttcag

SEQ ID NO: 304447 - DNA, 25 bp, Homo sapien
tgtaattcacttcagcttatagaga

SEQ ID NO: 304448 - DNA, 25 bp, Homo sapien
gatgaccttggatcatgctgggtat

SEQ ID NO: 304449 - DNA, 25 bp, Homo sapien
catgctgggtatgattggtctttaa

SEQ ID NO: 304450 - DNA, 25 bp, Homo sapien
tctccttctgtcaaggccatttgtg

SEQ ID NO: 304451 - DNA, 25 bp, Homo sapien
caaggccatttgtgtgtgtactgcg

SEQ ID NO: 304452 - DNA, 25 bp, Homo sapien
catttgtgtgtgtactgcggcaggt

SEQ ID NO: 304453 - DNA, 25 bp, Homo sapien
tgttctcacaatgtcctcagttttt

SEQ ID NO: 304454 - DNA, 25 bp, Homo sapien
tgtcctcagtttttcaggttgtctg

SEQ ID NO: 304455 - DNA, 25 bp, Homo sapien
aggttgtctgacagctttatgtaca

SEQ ID NO: 304456 - DNA, 25 bp, Homo sapien
gacagctttatgtacagcgtatttt

SEQ ID NO: 304457 - DNA, 25 bp, Homo sapien
tatttagggttttattctgatgagc

SEQ ID NO: 304458 - DNA, 25 bp, Homo sapien
tgatgagcaagtttgtgtgtatatg

SEQ ID NO: 304459 - DNA, 25 bp, Homo sapien
atgtgtgtatgagcatttgtatgta

SEQ ID NO: 304460 - DNA, 25 bp, Homo sapien
tacagtttttgtactatcatttaaa

SEQ ID NO: 304461 - DNA, 25 bp, Homo sapien
tggctgacatctagcaccactctct

SEQ ID NO: 304462 - DNA, 25 bp, Homo sapien
cctggtggtcagatgggcttcttgt

SEQ ID NO: 304463 - DNA, 25 bp, Homo sapien
tgtgtaggaagaacctcctccgagt

SEQ ID NO: 304464 - DNA, 25 bp, Homo sapien
ctcctccgagtcttgctagggaagg

SEQ ID NO: 304465 - DNA, 25 bp, Homo sapien
aagggtgaaattggcccctctcagc

SEQ ID NO: 304466 - DNA, 25 bp, Homo sapien
cctcctcggaatcagctgctgggcg

SEQ ID NO: 304467 - DNA, 25 bp, Homo sapien
ctgctgggcggcgagaccaagccat

SEQ ID NO: 304468 - DNA, 25 bp, Homo sapien
aagccatgtgtgtttctctgctcat

SEQ ID NO: 304469 - DNA, 25 bp, Homo sapien
tgtttctctgctcatgcactgctat

SEQ ID NO: 304470 - DNA, 25 bp, Homo sapien
gcactgctatcttcagaggactcct

SEQ ID NO: 304471 - DNA, 25 bp, Homo sapien
ggttctttatgcctgagcctggaag

SEQ ID NO: 304472 - DNA, 25 bp, Homo sapien
gaattggaagcagcctcagttacgt

SEQ ID NO: 304473 - DNA, 25 bp, Homo sapien
gcagcctcagttacgtgaatactac

SEQ ID NO: 304474 - DNA, 25 bp, Homo sapien
gatgccaaccctgtggtaattgagc

SEQ ID NO: 304475 - DNA, 25 bp, Homo sapien
attttcagacaacatttctactgca

SEQ ID NO: 304476 - DNA, 25 bp, Homo sapien
gataatcagccattagtaactcaag

SEQ ID NO: 304477 - DNA, 25 bp, Homo sapien
gtaaaggctacatcattaacactag

SEQ ID NO: 304478 - DNA, 25 bp, Homo sapien
gacgattaaaacgaactccacagct

SEQ ID NO: 304479 - DNA, 25 bp, Homo sapien
gaactccacagctgattcatggaag

SEQ ID NO: 304480 - DNA, 25 bp, Homo sapien
gtaattgagccatcatctgttttga

SEQ ID NO: 304481 - DNA, 25 bp, Homo sapien
atactcatttggaactgcagcccat

SEQ ID NO: 304482 - DNA, 25 bp, Homo sapien
agcccatcctatggagcaggtcgaa

SEQ ID NO: 304483 - DNA, 25 bp, Homo sapien
agtttactgaatctctgcccacaac

SEQ ID NO: 304484 - DNA, 25 bp, Homo sapien
ctgcccacaacaactatcaacatat

SEQ ID NO: 304485 - DNA, 25 bp, Homo sapien
tatcaacatatatcgaccttctttc

SEQ ID NO: 304486 - DNA, 25 bp, Homo sapien
aacatatatcgaccttctttccctc

SEQ ID NO: 304487 - DNA, 25 bp, Homo sapien
ctcccaaagccccattaaaatgaca

SEQ ID NO: 304488 - DNA, 25 bp, Homo sapien
aagagaagtaaacttgatccctgcc

SEQ ID NO: 304489 - DNA, 25 bp, Homo sapien
tgatccctgcccaaattgacataaa

SEQ ID NO: 304490 - DNA, 25 bp, Homo sapien
acatattagaagtgagccagttcca

SEQ ID NO: 304491 - DNA, 25 bp, Homo sapien
tgagccagttccaggcacagtgaat

SEQ ID NO: 304492 - DNA, 25 bp, Homo sapien
ccagttccaggcacagtgaatgaaa

SEQ ID NO: 304493 - DNA, 25 bp, Homo sapien
aatagaccagcctacttctttgtac

SEQ ID NO: 304494 - DNA, 25 bp, Homo sapien
gaatgttgttgaactctttgcatgt

SEQ ID NO: 304495 - DNA, 25 bp, Homo sapien
gaactctttgcatgttatttagtat

SEQ ID NO: 304496 - DNA, 25 bp, Homo sapien
gcagaaaacacttaagaacgtacct

SEQ ID NO: 304497 - DNA, 25 bp, Homo sapien
gaacgtacctggtcttcatgaattc

SEQ ID NO: 304498 - DNA, 25 bp, Homo sapien
ctggtcttcatgaattcctctttgg

SEQ ID NO: 304499 - DNA, 25 bp, Homo sapien
ggaaagagatccctgtggctattaa

SEQ ID NO: 304500 - DNA, 25 bp, Homo sapien
agagatccctgtggctattaaaaag

SEQ ID NO: 304501 - DNA, 25 bp, Homo sapien
gggagggttcttacacaccattaat

SEQ ID NO: 304502 - DNA, 25 bp, Homo sapien
aaagatacttaaactgcatgcaaac

SEQ ID NO: 304503 - DNA, 25 bp, Homo sapien
tgcaaactttatttactgtacagag

SEQ ID NO: 304504 - DNA, 25 bp, Homo sapien
ttactgtacagagttctggatgtat

SEQ ID NO: 304505 - DNA, 25 bp, Homo sapien
tgctttctggcagttgtgtttattt

SEQ ID NO: 304506 - DNA, 25 bp, Homo sapien
tttctcaagggcacaggctgtacag

SEQ ID NO: 304507 - DNA, 25 bp, Homo sapien
agctgagcctaggatgaaccacagt

SEQ ID NO: 304508 - DNA, 25 bp, Homo sapien
gatgaaccacagttgctcttatgcc

SEQ ID NO: 304509 - DNA, 25 bp, Homo sapien
cacagttgctcttatgccagttaaa

SEQ ID NO: 304510 - DNA, 25 bp, Homo sapien
gcaccctttgatcctgtgagtggag

SEQ ID NO: 304511 - DNA, 25 bp, Homo sapien
gaactccaaatccttaatccatttt

SEQ ID NO: 304512 - DNA, 25 bp, Homo sapien
aatccattttgaaggccggctggca

SEQ ID NO: 304513 - DNA, 25 bp, Homo sapien
tttctgtgggcctggtaagcagccc

SEQ ID NO: 304514 - DNA, 25 bp, Homo sapien
ggtaagcagccctagttgaatcatt

SEQ ID NO: 304515 - DNA, 25 bp, Homo sapien
gcagccctagttgaatcattttaga

SEQ ID NO: 304516 - DNA, 25 bp, Homo sapien
gacctgcctgcatggttccatccat

SEQ ID NO: 304517 - DNA, 25 bp, Homo sapien
ggttccatccattactcatggcctc

SEQ ID NO: 304518 - DNA, 25 bp, Homo sapien
ttccatccattactcatggcctcag

SEQ ID NO: 304519 - DNA, 25 bp, Homo sapien
tccattactcatggcctcagcctca

SEQ ID NO: 304520 - DNA, 25 bp, Homo sapien
tgtcttgtgtgcttcctgagggagt

SEQ ID NO: 304521 - DNA, 25 bp, Homo sapien
gtcttgtgtgcttcctgagggagta

SEQ ID NO: 304522 - DNA, 25 bp, Homo sapien
tgtgtgcttcctgagggagtaggga

SEQ ID NO: 304523 - DNA, 25 bp, Homo sapien
gggcctccatctctaatttcataat

SEQ ID NO: 304524 - DNA, 25 bp, Homo sapien
ggcctccatctctaatttcataata

SEQ ID NO: 304525 - DNA, 25 bp, Homo sapien
gcctccatctctaatttcataataa

SEQ ID NO: 304526 - DNA, 25 bp, Homo sapien
ctccatctctaatttcataataaac

SEQ ID NO: 304527 - DNA, 25 bp, Homo sapien
gtgagggcatctgaccgctccctga

SEQ ID NO: 304528 - DNA, 25 bp, Homo sapien
tgcccccccagggaatggtgtaagt

SEQ ID NO: 304529 - DNA, 25 bp, Homo sapien
taagtccctgatgctgtctcgaacc

SEQ ID NO: 304530 - DNA, 25 bp, Homo sapien
ctgatgctgtctcgaacccacatct

SEQ ID NO: 304531 - DNA, 25 bp, Homo sapien
gatttctagaactcagaactgtgct

SEQ ID NO: 304532 - DNA, 25 bp, Homo sapien
gaactgtgcttagaggctggccagc

SEQ ID NO: 304533 - DNA, 25 bp, Homo sapien
tagaggctggccagcgaccccttgg

SEQ ID NO: 304534 - DNA, 25 bp, Homo sapien
gaccccttggtcagtgcctatcatg

SEQ ID NO: 304535 - DNA, 25 bp, Homo sapien
ttggtcagtgcctatcatgtgggcc

SEQ ID NO: 304536 - DNA, 25 bp, Homo sapien
agtgcctatcatgtgggccttccag

SEQ ID NO: 304537 - DNA, 25 bp, Homo sapien
tatcatgtgggccttccagtccggg

SEQ ID NO: 304538 - DNA, 25 bp, Homo sapien
gggaaagaagctttctagagcttat

SEQ ID NO: 304539 - DNA, 25 bp, Homo sapien
ctgcttccactacatcaggaggtga

SEQ ID NO: 304540 - DNA, 25 bp, Homo sapien
gccgagtcatgcacacttcatcata

SEQ ID NO: 304541 - DNA, 25 bp, Homo sapien
gcacacttcatcatactcaccaggg

SEQ ID NO: 304542 - DNA, 25 bp, Homo sapien
gacccagaccatcattcttctttgg

SEQ ID NO: 304543 - DNA, 25 bp, Homo sapien
atcattcttctttggtctgccacct

SEQ ID NO: 304544 - DNA, 25 bp, Homo sapien
cagtgaccatacaggtgcagagcat

SEQ ID NO: 304545 - DNA, 25 bp, Homo sapien
tgcagagcatgagcaggatgcacag

SEQ ID NO: 304546 - DNA, 25 bp, Homo sapien
gtttatgtggtcaggcctgcctgga

SEQ ID NO: 304547 - DNA, 25 bp, Homo sapien
gaaaaggttcctgtaacaaatgtgg

SEQ ID NO: 304548 - DNA, 25 bp, Homo sapien
acaaatgtggttatcaatgggaaag

SEQ ID NO: 304549 - DNA, 25 bp, Homo sapien
gcgacgtcgtaaaccaggacgacct

SEQ ID NO: 304550 - DNA, 25 bp, Homo sapien
aaccaggacgacctgtaccaggcct

SEQ ID NO: 304551 - DNA, 25 bp, Homo sapien
caggacgacctgtaccaggccttgg

SEQ ID NO: 304552 - DNA, 25 bp, Homo sapien
ctgctggactggatgtgacgagccc

SEQ ID NO: 304553 - DNA, 25 bp, Homo sapien
tgctggactggatgtgacgagccca

SEQ ID NO: 304554 - DNA, 25 bp, Homo sapien
tggactggatgtgacgagcccagaa

SEQ ID NO: 304555 - DNA, 25 bp, Homo sapien
tggatgtgacgagcccagaaccact

SEQ ID NO: 304556 - DNA, 25 bp, Homo sapien
atgtgacgagcccagaaccactgcc

SEQ ID NO: 304557 - DNA, 25 bp, Homo sapien
tgtgacgagcccagaaccactgcct

SEQ ID NO: 304558 - DNA, 25 bp, Homo sapien
gagcccagaaccactgcctacaaac

SEQ ID NO: 304559 - DNA, 25 bp, Homo sapien
attctgccccacattggcagtgcca

SEQ ID NO: 304560 - DNA, 25 bp, Homo sapien
gtttctgattgttgctaatatatgg

SEQ ID NO: 304561 - DNA, 25 bp, Homo sapien
gatatctgcaattgatctcatgtcc

SEQ ID NO: 304562 - DNA, 25 bp, Homo sapien
gatctcatgtcctgaaaacttgcta

SEQ ID NO: 304563 - DNA, 25 bp, Homo sapien
gaaaacttgctaaatctgcttaata

SEQ ID NO: 304564 - DNA, 25 bp, Homo sapien
gttctacaggtagtcgtattgtcta

SEQ ID NO: 304565 - DNA, 25 bp, Homo sapien
gtcgtattgtctatgttggaaggaa

SEQ ID NO: 304566 - DNA, 25 bp, Homo sapien
ggaaagcctttcctcattcaatgtc

SEQ ID NO: 304567 - DNA, 25 bp, Homo sapien
cattcaatgtcggtcctgtgtttga

SEQ ID NO: 304568 - DNA, 25 bp, Homo sapien
gtcctgtgtttgaagacctgcaaat

SEQ ID NO: 304569 - DNA, 25 bp, Homo sapien
gaagacctgcaaattaactgataac

SEQ ID NO: 304570 - DNA, 25 bp, Homo sapien
aagacaaggtttagagtaactcact

SEQ ID NO: 304571 - DNA, 25 bp, Homo sapien
aagtatttgataaaagccagtcctc

SEQ ID NO: 304572 - DNA, 25 bp, Homo sapien
ggactcatcgccaccttagaatgga

SEQ ID NO: 304573 - DNA, 25 bp, Homo sapien
tcgccaccttagaatggattgccct

SEQ ID NO: 304574 - DNA, 25 bp, Homo sapien
gaatggattgcccttaatgccataa

SEQ ID NO: 304575 - DNA, 25 bp, Homo sapien
atgccataaggttgtatctgatgac

SEQ ID NO: 304576 - DNA, 25 bp, Homo sapien
gtaggaaaatactagacacctttct

SEQ ID NO: 304577 - DNA, 25 bp, Homo sapien
gacacctttctattagactgaggaa

SEQ ID NO: 304578 - DNA, 25 bp, Homo sapien
ctgaggaacaagatgaagttgccta

SEQ ID NO: 304579 - DNA, 25 bp, Homo sapien
aaacaagcagttgcctaattgccag

SEQ ID NO: 304580 - DNA, 25 bp, Homo sapien
aattgccaggcaccattttaaggag

SEQ ID NO: 304581 - DNA, 25 bp, Homo sapien
gaaaaccatttgatctctatagatg

SEQ ID NO: 304582 - DNA, 25 bp, Homo sapien
agccctgtaagggacatattattgt

SEQ ID NO: 304583 - DNA, 25 bp, Homo sapien
attattgtcccctttgatgggagaa

SEQ ID NO: 304584 - DNA, 25 bp, Homo sapien
taaagttaatatgtgctggaagcct

SEQ ID NO: 304585 - DNA, 25 bp, Homo sapien
gctggaagcctaaaccatggctttc

SEQ ID NO: 304586 - DNA, 25 bp, Homo sapien
cttctgttggtagctgccttgataa

SEQ ID NO: 304587 - DNA, 25 bp, Homo sapien
ggatgctacagttgttctcctttat

SEQ ID NO: 304588 - DNA, 25 bp, Homo sapien
gttgttctcctttatgtacatctga

SEQ ID NO: 304589 - DNA, 25 bp, Homo sapien
gtacatctgagcttacattgaggat

SEQ ID NO: 304590 - DNA, 25 bp, Homo sapien
gggcataatcatagttcctgacaat

SEQ ID NO: 304591 - DNA, 25 bp, Homo sapien
gttcctgacaatgtaaatagtgcat

SEQ ID NO: 304592 - DNA, 25 bp, Homo sapien
gaaatgactgtgcagtagccctgta

SEQ ID NO: 304593 - DNA, 25 bp, Homo sapien
attgggagtgtcaagatctaggctt

SEQ ID NO: 304594 - DNA, 25 bp, Homo sapien
aggcttgagtgttatatctgctgct

SEQ ID NO: 304595 - DNA, 25 bp, Homo sapien
ttgagtgttatatctgctgcttatt

SEQ ID NO: 304596 - DNA, 25 bp, Homo sapien
ggctaaatgtgagctgatttcttac

SEQ ID NO: 304597 - DNA, 25 bp, Homo sapien
agtctttgattcttagtttacctga

SEQ ID NO: 304598 - DNA, 25 bp, Homo sapien
gattcttagtttacctgatctgtaa

SEQ ID NO: 304599 - DNA, 25 bp, Homo sapien
tttaccacaaataatacctcctgcc

SEQ ID NO: 304600 - DNA, 25 bp, Homo sapien
aaataatacctcctgcctggaagag

SEQ ID NO: 304601 - DNA, 25 bp, Homo sapien
gcctggaagagccttgttgacattg

SEQ ID NO: 304602 - DNA, 25 bp, Homo sapien
gatttcttactagattactcagtga

SEQ ID NO: 304603 - DNA, 25 bp, Homo sapien
aaatccatttgagcaataggaacat

SEQ ID NO: 304604 - DNA, 25 bp, Homo sapien
gccgctggaaggagtccccacggaa

SEQ ID NO: 304605 - DNA, 25 bp, Homo sapien
gaaggagtccccacggaagctggtc

SEQ ID NO: 304606 - DNA, 25 bp, Homo sapien
gaagctggtcgtgggcgagctgcag

SEQ ID NO: 304607 - DNA, 25 bp, Homo sapien
acgagctgatgagacgtgcgtctgc

SEQ ID NO: 304608 - DNA, 25 bp, Homo sapien
tgcggcagcgcgtggtggaacttga

SEQ ID NO: 304609 - DNA, 25 bp, Homo sapien
gaacttgagacgcaggaccacatcc

SEQ ID NO: 304610 - DNA, 25 bp, Homo sapien
ttgagacgcaggaccacatccaccg

SEQ ID NO: 304611 - DNA, 25 bp, Homo sapien
gcaaccttctgaaccgcgtggaggc

SEQ ID NO: 304612 - DNA, 25 bp, Homo sapien
gagaagctgcagtacctggctgcac

SEQ ID NO: 304613 - DNA, 25 bp, Homo sapien
ggctgcagacgcagctcagcgaaaa

SEQ ID NO: 304614 - DNA, 25 bp, Homo sapien
agctcagcgaaaagccgcgcaagca

SEQ ID NO: 304615 - DNA, 25 bp, Homo sapien
gcaggagctgcctgcgtcctcatgg

SEQ ID NO: 304616 - DNA, 25 bp, Homo sapien
tgccttgcgacagctaccgcgaggg

SEQ ID NO: 304617 - DNA, 25 bp, Homo sapien
cttgcgacagctaccgcgagggcta

SEQ ID NO: 304618 - DNA, 25 bp, Homo sapien
ttgcgacagctaccgcgagggctac

SEQ ID NO: 304619 - DNA, 25 bp, Homo sapien
gacagctaccgcgagggctacagcg

SEQ ID NO: 304620 - DNA, 25 bp, Homo sapien
taccgcgagggctacagcgcctgtg

SEQ ID NO: 304621 - DNA, 25 bp, Homo sapien
ctacagcgcctgtgtggcgcgcctg

SEQ ID NO: 304622 - DNA, 25 bp, Homo sapien
tgccgtgtcctggagcccgccgtga

SEQ ID NO: 304623 - DNA, 25 bp, Homo sapien
agcccgccgtgagcgcgcgcctgct

SEQ ID NO: 304624 - DNA, 25 bp, Homo sapien
tgctggagcacctgtggcggagagc

SEQ ID NO: 304625 - DNA, 25 bp, Homo sapien
tggagcacctgtggcggagagcggc

SEQ ID NO: 304626 - DNA, 25 bp, Homo sapien
tggctgcgcttctccaggtgtctcc

SEQ ID NO: 304627 - DNA, 25 bp, Homo sapien
gtgtctcctgcctgctgtgtggacg

SEQ ID NO: 304628 - DNA, 25 bp, Homo sapien
gcctgctgtgtggacggtcccgtca

SEQ ID NO: 304629 - DNA, 25 bp, Homo sapien
taaaaaccagtgaccacggaccacg

SEQ ID NO: 304630 - DNA, 25 bp, Homo sapien
ttgggttccccggagttgcaggaat

SEQ ID NO: 304631 - DNA, 25 bp, Homo sapien
gttgcaggaatcagggcatttgccc

SEQ ID NO: 304632 - DNA, 25 bp, Homo sapien
ctggatcccctggtcgggactgtgt

SEQ ID NO: 304633 - DNA, 25 bp, Homo sapien
tcgggactgtgtgcctgccacgtgt

SEQ ID NO: 304634 - DNA, 25 bp, Homo sapien
gggccactgtcacatctgagccagg

SEQ ID NO: 304635 - DNA, 25 bp, Homo sapien
tgtcacatctgagccaggttcactg

SEQ ID NO: 304636 - DNA, 25 bp, Homo sapien
tgccgactgactgcctgacagtggc

SEQ ID NO: 304637 - DNA, 25 bp, Homo sapien
aacgactcttgacgattccggcgag

SEQ ID NO: 304638 - DNA, 25 bp, Homo sapien
attccggcgagttcatcctggtgca

SEQ ID NO: 304639 - DNA, 25 bp, Homo sapien
gcctctctcttctggttggacaata

SEQ ID NO: 304640 - DNA, 25 bp, Homo sapien
gacaatagttacatccttacgaaaa

SEQ ID NO: 304641 - DNA, 25 bp, Homo sapien
ccttacgaaaaggaggcaagctgct

SEQ ID NO: 304642 - DNA, 25 bp, Homo sapien
gtttggctgagggaaactcagacca

SEQ ID NO: 304643 - DNA, 25 bp, Homo sapien
ggtggatccactcaaccttgttacc

SEQ ID NO: 304644 - DNA, 25 bp, Homo sapien
ggacatgccgccatgctatgtgaaa

SEQ ID NO: 304645 - DNA, 25 bp, Homo sapien
gcaagaaagcagttgggtccccaca

SEQ ID NO: 304646 - DNA, 25 bp, Homo sapien
acaaaacgcccgaagtcaaggtgag

SEQ ID NO: 304647 - DNA, 25 bp, Homo sapien
aggtgagggtcacacaacgactctt

SEQ ID NO: 304648 - DNA, 25 bp, Homo sapien
agaagtgcggccttctaggcaagga

SEQ ID NO: 304649 - DNA, 25 bp, Homo sapien
taggcaaggactcacttcttcggga

SEQ ID NO: 304650 - DNA, 25 bp, Homo sapien
ggactcacttcttcgggacttggaa

SEQ ID NO: 304651 - DNA, 25 bp, Homo sapien
tggacaagaccgaactgcttcaccg

SEQ ID NO: 304652 - DNA, 25 bp, Homo sapien
ttcaccggcgcctggaatccctgaa

SEQ ID NO: 304653 - DNA, 25 bp, Homo sapien
tagcctcactttgtcctgcagaggc

SEQ ID NO: 304654 - DNA, 25 bp, Homo sapien
tcccttcttgaccagatcgatgaga

SEQ ID NO: 304655 - DNA, 25 bp, Homo sapien
aagagtctgcaaaacacttcatcct

SEQ ID NO: 304656 - DNA, 25 bp, Homo sapien
aaaacacttcatcctcaggacgtgc

SEQ ID NO: 304657 - DNA, 25 bp, Homo sapien
tcaggacgtgctgtcctgctttatt

SEQ ID NO: 304658 - DNA, 25 bp, Homo sapien
ctgctttattttaccttcgttgcta

SEQ ID NO: 304659 - DNA, 25 bp, Homo sapien
gaagccatgaagtgcatcttttaaa

SEQ ID NO: 304660 - DNA, 25 bp, Homo sapien
caccaagacttgtaggacattcctt

SEQ ID NO: 304661 - DNA, 25 bp, Homo sapien
tgtaggacattccttcatcttctcc

SEQ ID NO: 304662 - DNA, 25 bp, Homo sapien
gggcaacccagccatggatatatgc

SEQ ID NO: 304663 - DNA, 25 bp, Homo sapien
ggatatatgcctccaatcagcataa

SEQ ID NO: 304664 - DNA, 25 bp, Homo sapien
aatgcccattgcttgataaagtcaa

SEQ ID NO: 304665 - DNA, 25 bp, Homo sapien
gcttgataaagtcaacacacgtgta

SEQ ID NO: 304666 - DNA, 25 bp, Homo sapien
aagcctacctattctcccagagggc

SEQ ID NO: 304667 - DNA, 25 bp, Homo sapien
ctcccagagggcatgcattctatgg

SEQ ID NO: 304668 - DNA, 25 bp, Homo sapien
agacagagctgaatgtgtgccatca

SEQ ID NO: 304669 - DNA, 25 bp, Homo sapien
ctgaatgtgtgccatcagaagacca

SEQ ID NO: 304670 - DNA, 25 bp, Homo sapien
agagctgtgtcaaggcctgccttta

SEQ ID NO: 304671 - DNA, 25 bp, Homo sapien
aaggcctgcctttaatgtggtgctc

SEQ ID NO: 304672 - DNA, 25 bp, Homo sapien
gtggtgctccccacatgggaccaag

SEQ ID NO: 304673 - DNA, 25 bp, Homo sapien
gcagtcctaagagggtgtgttttcc

SEQ ID NO: 304674 - DNA, 25 bp, Homo sapien
tgccctggaaacagcatgttggttt

SEQ ID NO: 304675 - DNA, 25 bp, Homo sapien
aacagcatgttggtttctcctgtgg

SEQ ID NO: 304676 - DNA, 25 bp, Homo sapien
acacagttctgagtatcaattggat

SEQ ID NO: 304677 - DNA, 25 bp, Homo sapien
ttccccgttgtacagtgaaggatgg

SEQ ID NO: 304678 - DNA, 25 bp, Homo sapien
gatggtgagccgatagcaggttcca

SEQ ID NO: 304679 - DNA, 25 bp, Homo sapien
aggttccagggtcgcacaattcaga

SEQ ID NO: 304680 - DNA, 25 bp, Homo sapien
aatggcagagctgtgtcaaggcctg

SEQ ID NO: 304681 - DNA, 25 bp, Homo sapien
ataacacaaggtttggacacacctg

SEQ ID NO: 304682 - DNA, 25 bp, Homo sapien
tttggacacacctggagagctcggg

SEQ ID NO: 304683 - DNA, 25 bp, Homo sapien
acacacctggagagctcgggccagg

SEQ ID NO: 304684 - DNA, 25 bp, Homo sapien
acacctgtgagcctgagctcatcca

SEQ ID NO: 304685 - DNA, 25 bp, Homo sapien
gtgagcctgagctcatccaacaccg

SEQ ID NO: 304686 - DNA, 25 bp, Homo sapien
tccaagcacccctcggatgaagttg

SEQ ID NO: 304687 - DNA, 25 bp, Homo sapien
aagcacccctcggatgaagttgcgc

SEQ ID NO: 304688 - DNA, 25 bp, Homo sapien
tcggatgaagttgcgccccacactg

SEQ ID NO: 304689 - DNA, 25 bp, Homo sapien
agaccgcacgggtgagccctggact

SEQ ID NO: 304690 - DNA, 25 bp, Homo sapien
acgggtgagccctggactgcaaggt

SEQ ID NO: 304691 - DNA, 25 bp, Homo sapien
ggactgcaaggtgcatataacacaa

SEQ ID NO: 304692 - DNA, 25 bp, Homo sapien
actttgaataatttgactgtcttga

SEQ ID NO: 304693 - DNA, 25 bp, Homo sapien
gtcttgataattggttcctcccaaa

SEQ ID NO: 304694 - DNA, 25 bp, Homo sapien
gataattggttcctcccaaagactc

SEQ ID NO: 304695 - DNA, 25 bp, Homo sapien
caaagactcttctgcaactcccatt

SEQ ID NO: 304696 - DNA, 25 bp, Homo sapien
tgcactattggagccctgggttttg

SEQ ID NO: 304697 - DNA, 25 bp, Homo sapien
tcagcaccgtgagtcttactgtttg

SEQ ID NO: 304698 - DNA, 25 bp, Homo sapien
gtgagtcttactgtttgatcggaca

SEQ ID NO: 304699 - DNA, 25 bp, Homo sapien
gacagttagcaagatcagatccttt

SEQ ID NO: 304700 - DNA, 25 bp, Homo sapien
gcaagatcagatcctttttgcttat

SEQ ID NO: 304701 - DNA, 25 bp, Homo sapien
gcttattttctatcactttggaggg

SEQ ID NO: 304702 - DNA, 25 bp, Homo sapien
gagggttttctgtagcaaaatcagt

SEQ ID NO: 304703 - DNA, 25 bp, Homo sapien
aaaccagttctggtggttctcttgt

SEQ ID NO: 304704 - DNA, 25 bp, Homo sapien
ggttctcttgttaccatggttacat

SEQ ID NO: 304705 - DNA, 25 bp, Homo sapien
gagacaaagagcagttactcatctt

SEQ ID NO: 304706 - DNA, 25 bp, Homo sapien
attagtcttttcctaggagtatgga

SEQ ID NO: 304707 - DNA, 25 bp, Homo sapien
agtgttattagcttgatcctctatt

SEQ ID NO: 304708 - DNA, 25 bp, Homo sapien
cttgatcctctattctgtttttggt

SEQ ID NO: 304709 - DNA, 25 bp, Homo sapien
gattatttcacagctaataccgtgt

SEQ ID NO: 304710 - DNA, 25 bp, Homo sapien
aataccgtgtggtccctattacatc

SEQ ID NO: 304711 - DNA, 25 bp, Homo sapien
attacatcaggaggcttacaatacc

SEQ ID NO: 304712 - DNA, 25 bp, Homo sapien
tactcatctttgcaggtgttcacca

SEQ ID NO: 304713 - DNA, 25 bp, Homo sapien
gtgttcaccaggcaagttgtcattg

SEQ ID NO: 304714 - DNA, 25 bp, Homo sapien
cagcgcaaatggagacgaagttagt

SEQ ID NO: 304715 - DNA, 25 bp, Homo sapien
acgaagttagtcatggtgtcaggga

SEQ ID NO: 304716 - DNA, 25 bp, Homo sapien
aagtgtttggaatagatgatctctg

SEQ ID NO: 304717 - DNA, 25 bp, Homo sapien
catggtgtcagggaaggctttgaat

SEQ ID NO: 304718 - DNA, 25 bp, Homo sapien
gctggatctgcatgtgtgaatcggc

SEQ ID NO: 304719 - DNA, 25 bp, Homo sapien
gtgaatcggcatgcacaaacaggca

SEQ ID NO: 304720 - DNA, 25 bp, Homo sapien
ggcatgcacaaacaggcacactata

SEQ ID NO: 304721 - DNA, 25 bp, Homo sapien
ggcacactataatagctgaatttct

SEQ ID NO: 304722 - DNA, 25 bp, Homo sapien
gatctctgaagttctgtcagattct

SEQ ID NO: 304723 - DNA, 25 bp, Homo sapien
gtcagattctgtggttctattatga

SEQ ID NO: 304724 - DNA, 25 bp, Homo sapien
ccctgccagtcactgagattaataa

SEQ ID NO: 304725 - DNA, 25 bp, Homo sapien
gaactcctgggctcgtggacggcct

SEQ ID NO: 304726 - DNA, 25 bp, Homo sapien
gggacgaaggtctttatttgcaaca

SEQ ID NO: 304727 - DNA, 25 bp, Homo sapien
gcgaggcaggtacggatcattccca

SEQ ID NO: 304728 - DNA, 25 bp, Homo sapien
atggtctactgggagtccagcgttc

SEQ ID NO: 304729 - DNA, 25 bp, Homo sapien
ggacagtgggactcaaacccgactc

SEQ ID NO: 304730 - DNA, 25 bp, Homo sapien
gtacggatcattcccattttgcagg

SEQ ID NO: 304731 - DNA, 25 bp, Homo sapien
gtaggtacatagttacaaccggtgt

SEQ ID NO: 304732 - DNA, 25 bp, Homo sapien
acaaccggtgtgataacgatgagac

SEQ ID NO: 304733 - DNA, 25 bp, Homo sapien
cgatgagacgactaggtgtttccaa

SEQ ID NO: 304734 - DNA, 25 bp, Homo sapien
cctggaaaaggttgctgtacatcat

SEQ ID NO: 304735 - DNA, 25 bp, Homo sapien
gtacatcattttgttggaactcctg

SEQ ID NO: 304736 - DNA, 25 bp, Homo sapien
aagctacatagttttaggaaagcga

SEQ ID NO: 304737 - DNA, 25 bp, Homo sapien
ggaaatcctgactcttggtttaact

SEQ ID NO: 304738 - DNA, 25 bp, Homo sapien
aactgattcattcactgcctcattt

SEQ ID NO: 304739 - DNA, 25 bp, Homo sapien
tcattcactgcctcatttgtttatc

SEQ ID NO: 304740 - DNA, 25 bp, Homo sapien
aaatacttacttaacagatactgtg

SEQ ID NO: 304741 - DNA, 25 bp, Homo sapien
ggctcaggccatcgagacacagcag

SEQ ID NO: 304742 - DNA, 25 bp, Homo sapien
atgtttatacttgaggttggctaac

SEQ ID NO: 304743 - DNA, 25 bp, Homo sapien
gaggttggctaactcattaggacaa

SEQ ID NO: 304744 - DNA, 25 bp, Homo sapien
agtgagatttataatgcgtgcctta

SEQ ID NO: 304745 - DNA, 25 bp, Homo sapien
taatgcgtgccttatttgtactttt

SEQ ID NO: 304746 - DNA, 25 bp, Homo sapien
aaagactggttatcaaatacacata

SEQ ID NO: 304747 - DNA, 25 bp, Homo sapien
aaggtgctgggcgagttgctttctc

SEQ ID NO: 304748 - DNA, 25 bp, Homo sapien
gcgagttgctttctccaatcagcag

SEQ ID NO: 304749 - DNA, 25 bp, Homo sapien
tatattgctgccattagtgctcggt

SEQ ID NO: 304750 - DNA, 25 bp, Homo sapien
attagtgctcggtttgttcagcttc

SEQ ID NO: 304751 - DNA, 25 bp, Homo sapien
gtttgttcagcttcagcatggtgat

SEQ ID NO: 304752 - DNA, 25 bp, Homo sapien
gctagatgaccagatgtgtgatgaa

SEQ ID NO: 304753 - DNA, 25 bp, Homo sapien
gtgccaatgtcacttgcctgcagta

SEQ ID NO: 304754 - DNA, 25 bp, Homo sapien
attactgtgagttttgttgggcaaa

SEQ ID NO: 304755 - DNA, 25 bp, Homo sapien
gttgggcaaatatccactctcgtgc

SEQ ID NO: 304756 - DNA, 25 bp, Homo sapien
tctcgtgctggacgtgagttccata

SEQ ID NO: 304757 - DNA, 25 bp, Homo sapien
acgtgagttccataagccattggta

SEQ ID NO: 304758 - DNA, 25 bp, Homo sapien
tatgcacaagtcatggaacagtgaa

SEQ ID NO: 304759 - DNA, 25 bp, Homo sapien
agacattggttatatcattggtaag

SEQ ID NO: 304760 - DNA, 25 bp, Homo sapien
gttcatattgaattgtgcagactat

SEQ ID NO: 304761 - DNA, 25 bp, Homo sapien
attgtgcagactatatgttaagagc

SEQ ID NO: 304762 - DNA, 25 bp, Homo sapien
gagcaaacgtctttctacttacaga

SEQ ID NO: 304763 - DNA, 25 bp, Homo sapien
tacttacagaagtacgctcttcagg

SEQ ID NO: 304764 - DNA, 25 bp, Homo sapien
aagtacgctcttcagggtcagaatt

SEQ ID NO: 304765 - DNA, 25 bp, Homo sapien
cgctcttcagggtcagaatttcaat

SEQ ID NO: 304766 - DNA, 25 bp, Homo sapien
gtcagaatttcaatcacgaggtcag

SEQ ID NO: 304767 - DNA, 25 bp, Homo sapien
tatcattggtaagatggagctgtac

SEQ ID NO: 304768 - DNA, 25 bp, Homo sapien
catattgttatgcacaagtcatgga

SEQ ID NO: 304769 - DNA, 25 bp, Homo sapien
cagtgggtggaagagtgcaaggtct

SEQ ID NO: 304770 - DNA, 25 bp, Homo sapien
gaagagtgcaaggtctgccaggtca

SEQ ID NO: 304771 - DNA, 25 bp, Homo sapien
gtctgccaggtcagatggagacgca

SEQ ID NO: 304772 - DNA, 25 bp, Homo sapien
agatggagacgcagaacctgctggt

SEQ ID NO: 304773 - DNA, 25 bp, Homo sapien
gctggtgcaagctgggcaggtcctg

SEQ ID NO: 304774 - DNA, 25 bp, Homo sapien
ctggtgcaagctgggcaggtcctga

SEQ ID NO: 304775 - DNA, 25 bp, Homo sapien
tggtgcaagctgggcaggtcctgac

SEQ ID NO: 304776 - DNA, 25 bp, Homo sapien
aagctgggcaggtcctgaccaacct

SEQ ID NO: 304777 - DNA, 25 bp, Homo sapien
agctgggcaggtcctgaccaacctg

SEQ ID NO: 304778 - DNA, 25 bp, Homo sapien
gctgggcaggtcctgaccaacctgc

SEQ ID NO: 304779 - DNA, 25 bp, Homo sapien
ctgggcaggtcctgaccaacctgca

SEQ ID NO: 304780 - DNA, 25 bp, Homo sapien
caagaggagggcacgcgcgctccct

SEQ ID NO: 304781 - DNA, 25 bp, Homo sapien
agccccttcgcaaggcggccaggaa

SEQ ID NO: 304782 - DNA, 25 bp, Homo sapien
agagaagtgtggagacggaacgcga

SEQ ID NO: 304783 - DNA, 25 bp, Homo sapien
aacgcgagggcgaaagccaaggcca

SEQ ID NO: 304784 - DNA, 25 bp, Homo sapien
aagccaaggccaatgccagggcgag

SEQ ID NO: 304785 - DNA, 25 bp, Homo sapien
aaggccgagagccaaggagccgccg

SEQ ID NO: 304786 - DNA, 25 bp, Homo sapien
aaggagccgccgtgtgccagagcca

SEQ ID NO: 304787 - DNA, 25 bp, Homo sapien
aggagccgccgtgtgccagagccaa

SEQ ID NO: 304788 - DNA, 25 bp, Homo sapien
aagcgggagcgacagcggcagacga

SEQ ID NO: 304789 - DNA, 25 bp, Homo sapien
ggacaggccgtgaaggaagacacca

SEQ ID NO: 304790 - DNA, 25 bp, Homo sapien
gaaggaagacaccacgccgaggtca

SEQ ID NO: 304791 - DNA, 25 bp, Homo sapien
tgaaggccccttgagaactaagagt

SEQ ID NO: 304792 - DNA, 25 bp, Homo sapien
gcacacaccttctattggaagtcct

SEQ ID NO: 304793 - DNA, 25 bp, Homo sapien
ggaagtcctctcagattattcaggt

SEQ ID NO: 304794 - DNA, 25 bp, Homo sapien
ggtcaaaaccaactctacatttatg

SEQ ID NO: 304795 - DNA, 25 bp, Homo sapien
tggtcctcttgtgttacctcagcag

SEQ ID NO: 304796 - DNA, 25 bp, Homo sapien
agcagcatgtgtgattttcctaaat

SEQ ID NO: 304797 - DNA, 25 bp, Homo sapien
gattttcctaaatccttgaggcact

SEQ ID NO: 304798 - DNA, 25 bp, Homo sapien
gaactaagagttttcccatcctgga

SEQ ID NO: 304799 - DNA, 25 bp, Homo sapien
agccatctggccttaggaaaccaca

SEQ ID NO: 304800 - DNA, 25 bp, Homo sapien
taggaaaccacagtctttcctgcct

SEQ ID NO: 304801 - DNA, 25 bp, Homo sapien
tggcttttgcaagctcttccatcac

SEQ ID NO: 304802 - DNA, 25 bp, Homo sapien
gcagagggctagagaattatttcat

SEQ ID NO: 304803 - DNA, 25 bp, Homo sapien
attatttcatacaggctttgaggcc

SEQ ID NO: 304804 - DNA, 25 bp, Homo sapien
atacaggctttgaggccacccatgt

SEQ ID NO: 304805 - DNA, 25 bp, Homo sapien
tttgaggccacccatgtcacttatc

SEQ ID NO: 304806 - DNA, 25 bp, Homo sapien
ccaagatgcaactgggcagctagtt

SEQ ID NO: 304807 - DNA, 25 bp, Homo sapien
tgggcagctagttggccccataatt

SEQ ID NO: 304808 - DNA, 25 bp, Homo sapien
agttggccccataattctgggcctt

SEQ ID NO: 304809 - DNA, 25 bp, Homo sapien
ccccataattctgggcctttgttgt

SEQ ID NO: 304810 - DNA, 25 bp, Homo sapien
ttgttttaattacttgggcatccca

SEQ ID NO: 304811 - DNA, 25 bp, Homo sapien
ttacttgggcatcccaggaagcttt

SEQ ID NO: 304812 - DNA, 25 bp, Homo sapien
aggaagctttccagtgatctcctac

SEQ ID NO: 304813 - DNA, 25 bp, Homo sapien
tgtagtagagattgctaaacattta

SEQ ID NO: 304814 - DNA, 25 bp, Homo sapien
agacttcaatgttaactgttagagc

SEQ ID NO: 304815 - DNA, 25 bp, Homo sapien
caatgttaactgttagagctaactt

SEQ ID NO: 304816 - DNA, 25 bp, Homo sapien
gctaacttattgacagactggattc

SEQ ID NO: 304817 - DNA, 25 bp, Homo sapien
ttgacagactggattctaccaagca

SEQ ID NO: 304818 - DNA, 25 bp, Homo sapien
gactggattctaccaagcaatgact

SEQ ID NO: 304819 - DNA, 25 bp, Homo sapien
ggattctaccaagcaatgactgtta

SEQ ID NO: 304820 - DNA, 25 bp, Homo sapien
gcaatgactgttatataaacttttc

SEQ ID NO: 304821 - DNA, 25 bp, Homo sapien
aaaagttaaatatatggcatggcta

SEQ ID NO: 304822 - DNA, 25 bp, Homo sapien
atatggcatggctaaaatctacaga

SEQ ID NO: 304823 - DNA, 25 bp, Homo sapien
ggcatggctaaaatctacagaattg

SEQ ID NO: 304824 - DNA, 25 bp, Homo sapien
gggagcataagcactgagacaggca

SEQ ID NO: 304825 - DNA, 25 bp, Homo sapien
agcactgagacaggcacacgtgcct

SEQ ID NO: 304826 - DNA, 25 bp, Homo sapien
tgcccggctatcgtagccaggctgg

SEQ ID NO: 304827 - DNA, 25 bp, Homo sapien
aggctggcagccttgcaactccctg

SEQ ID NO: 304828 - DNA, 25 bp, Homo sapien
aagaacaatctaggaacattctggg

SEQ ID NO: 304829 - DNA, 25 bp, Homo sapien
gcaggaagggagtgtcacatgcaaa

SEQ ID NO: 304830 - DNA, 25 bp, Homo sapien
gtcacatgcaaaaggcaggatcagc

SEQ ID NO: 304831 - DNA, 25 bp, Homo sapien
aaggcaggatcagccaaagcagagg

SEQ ID NO: 304832 - DNA, 25 bp, Homo sapien
ccccacctaatgtcagaagtaaaat

SEQ ID NO: 304833 - DNA, 25 bp, Homo sapien
tctagaatctcgtcggctgctggga

SEQ ID NO: 304834 - DNA, 25 bp, Homo sapien
gccagccatcgcagggagcataagc

SEQ ID NO: 304835 - DNA, 25 bp, Homo sapien
gaaatcaagatctgcgtgctgggta

SEQ ID NO: 304836 - DNA, 25 bp, Homo sapien
gtgctgggtatgttcattgctactg

SEQ ID NO: 304837 - DNA, 25 bp, Homo sapien
ttgcttctaggccttttcaactgac

SEQ ID NO: 304838 - DNA, 25 bp, Homo sapien
aggccttttcaactgacagggtcag

SEQ ID NO: 304839 - DNA, 25 bp, Homo sapien
aactcattgtaatcgtgtaacttat

SEQ ID NO: 304840 - DNA, 25 bp, Homo sapien
aattgaactttgctagtaccccaga

SEQ ID NO: 304841 - DNA, 25 bp, Homo sapien
ttttaacgcttaatcaccttcatcc

SEQ ID NO: 304842 - DNA, 25 bp, Homo sapien
caccttcatcctcagttttatggta

SEQ ID NO: 304843 - DNA, 25 bp, Homo sapien
ttatggtaatcacttgtctttgcag

SEQ ID NO: 304844 - DNA, 25 bp, Homo sapien
gtctttgcagttttagtctgtaacc

SEQ ID NO: 304845 - DNA, 25 bp, Homo sapien
gtctgtaaccatgcatccctaaata

SEQ ID NO: 304846 - DNA, 25 bp, Homo sapien
ttagcccaggagctttactctgtgc

SEQ ID NO: 304847 - DNA, 25 bp, Homo sapien
aggagctttactctgtgccctggcc

SEQ ID NO: 304848 - DNA, 25 bp, Homo sapien
tggcttgggacactcacctgtgaaa

SEQ ID NO: 304849 - DNA, 25 bp, Homo sapien
gggacactcacctgtgaaactatgc

SEQ ID NO: 304850 - DNA, 25 bp, Homo sapien
gaaactatgcagctgggagctctct

SEQ ID NO: 304851 - DNA, 25 bp, Homo sapien
agctgggagctctctgcctaagagt

SEQ ID NO: 304852 - DNA, 25 bp, Homo sapien
gagctctctgcctaagagtttgcac

SEQ ID NO: 304853 - DNA, 25 bp, Homo sapien
tctgcctaagagtttgcactattta

SEQ ID NO: 304854 - DNA, 25 bp, Homo sapien
gcactatttaaacctgcctgggagt

SEQ ID NO: 304855 - DNA, 25 bp, Homo sapien
aacctgcctgggagttaggacggat

SEQ ID NO: 304856 - DNA, 25 bp, Homo sapien
taggacggatggttttaggaatgac

SEQ ID NO: 304857 - DNA, 25 bp, Homo sapien
ggacattgtgtttcctgtcatgtaa

SEQ ID NO: 304858 - DNA, 25 bp, Homo sapien
aaaccagctattttagttactattg

SEQ ID NO: 304859 - DNA, 25 bp, Homo sapien
gatttatgttaaactcgtacttacg

SEQ ID NO: 304860 - DNA, 25 bp, Homo sapien
aggcatgaactcagctcctaatcgt

SEQ ID NO: 304861 - DNA, 25 bp, Homo sapien
cagctcctaatcgtcactgtatagt

SEQ ID NO: 304862 - DNA, 25 bp, Homo sapien
aatcgtcactgtatagtcctgaatt

SEQ ID NO: 304863 - DNA, 25 bp, Homo sapien
agtcctgaatttgtagaactagagt

SEQ ID NO: 304864 - DNA, 25 bp, Homo sapien
gaactagagttaattccctcttgga

SEQ ID NO: 304865 - DNA, 25 bp, Homo sapien
taattccctcttggaactttctttg

SEQ ID NO: 304866 - DNA, 25 bp, Homo sapien
tttctttgttcttcagtagttactt

SEQ ID NO: 304867 - DNA, 25 bp, Homo sapien
gggttgtctgtcaaacaattcttga

SEQ ID NO: 304868 - DNA, 25 bp, Homo sapien
caaatgttcatctgcaaccgctatg

SEQ ID NO: 304869 - DNA, 25 bp, Homo sapien
gcaaccgctatgcagtctggtgaga

SEQ ID NO: 304870 - DNA, 25 bp, Homo sapien
gagagggagacagccatcacataga

SEQ ID NO: 304871 - DNA, 25 bp, Homo sapien
cacatagaaagtgaccgtacgggtt

SEQ ID NO: 304872 - DNA, 25 bp, Homo sapien
tggctttgtcgacaaagtcccactt

SEQ ID NO: 304873 - DNA, 25 bp, Homo sapien
gacaaagtcccacttccccgagtat

SEQ ID NO: 304874 - DNA, 25 bp, Homo sapien
ttaagggcccttggtatcaagtgag

SEQ ID NO: 304875 - DNA, 25 bp, Homo sapien
taaattcacccatcacagggtctcg

SEQ ID NO: 304876 - DNA, 25 bp, Homo sapien
tcgccctaccatcctggaattattt

SEQ ID NO: 304877 - DNA, 25 bp, Homo sapien
ataaatgcactatttcactgttcgc

SEQ ID NO: 304878 - DNA, 25 bp, Homo sapien
tgttcgcctcccattctaaggaggt

SEQ ID NO: 304879 - DNA, 25 bp, Homo sapien
agccagagctgggacgattcctgcg

SEQ ID NO: 304880 - DNA, 25 bp, Homo sapien
agctgggacgattcctgcggctgac

SEQ ID NO: 304881 - DNA, 25 bp, Homo sapien
ggctgaccccttgctgggctcgttt

SEQ ID NO: 304882 - DNA, 25 bp, Homo sapien
ttgctgggctcgtttccttccgcct

SEQ ID NO: 304883 - DNA, 25 bp, Homo sapien
tgcccagccatctctggttttatct

SEQ ID NO: 304884 - DNA, 25 bp, Homo sapien
gtgtctgatgtcaaacgtcatgaat

SEQ ID NO: 304885 - DNA, 25 bp, Homo sapien
gtcaaacgtcatgaatatggaaagc

SEQ ID NO: 304886 - DNA, 25 bp, Homo sapien
agaagaccttgttctgggttgacaa

SEQ ID NO: 304887 - DNA, 25 bp, Homo sapien
ctgggttgacaaatgcttgcagtta

SEQ ID NO: 304888 - DNA, 25 bp, Homo sapien
aaggaccacagaagtcaagcaactt

SEQ ID NO: 304889 - DNA, 25 bp, Homo sapien
cagaagtcaagcaacttgccaaggt

SEQ ID NO: 304890 - DNA, 25 bp, Homo sapien
cctggctgtgttctggaagttcaag

SEQ ID NO: 304891 - DNA, 25 bp, Homo sapien
agttcaagacacttagtcctccaca

SEQ ID NO: 304892 - DNA, 25 bp, Homo sapien
cctccacagtgggtggaagagtgca

SEQ ID NO: 304893 - DNA, 25 bp, Homo sapien
gaagagtgcaaggtctgccaggtca

SEQ ID NO: 304894 - DNA, 25 bp, Homo sapien
gagtgcaaggtctgccaggtcagat

SEQ ID NO: 304895 - DNA, 25 bp, Homo sapien
gtctgccaggtcagatggagacgca

SEQ ID NO: 304896 - DNA, 25 bp, Homo sapien
agatggagacgcagaacctgctggt

SEQ ID NO: 304897 - DNA, 25 bp, Homo sapien
cagaacctgctggtgcaagctgggc

SEQ ID NO: 304898 - DNA, 25 bp, Homo sapien
aagctgggcaggtcctgaccaacct

SEQ ID NO: 304899 - DNA, 25 bp, Homo sapien
gagctccacaggtcttcatgggcag

SEQ ID NO: 304900 - DNA, 25 bp, Homo sapien
tgtagcaagctgtctgcccttgggt

SEQ ID NO: 304901 - DNA, 25 bp, Homo sapien
tgcctctaaaccaagcaggtgcctg

SEQ ID NO: 304902 - DNA, 25 bp, Homo sapien
tggcagtcaggacagaccatcagtg

SEQ ID NO: 304903 - DNA, 25 bp, Homo sapien
ataaactttacactctcaccttgct

SEQ ID NO: 304904 - DNA, 25 bp, Homo sapien
ctcaccttgctctggtaactgcaga

SEQ ID NO: 304905 - DNA, 25 bp, Homo sapien
gaaaaatcacattaacgggccaggt

SEQ ID NO: 304906 - DNA, 25 bp, Homo sapien
gtcactcactgaagcatcaaaacct

SEQ ID NO: 304907 - DNA, 25 bp, Homo sapien
gggccaggtacatcatagggtctca

SEQ ID NO: 304908 - DNA, 25 bp, Homo sapien
atcatagggtctcagtaagtgttac

SEQ ID NO: 304909 - DNA, 25 bp, Homo sapien
atcaaaaccttgctagtcccaggtg

SEQ ID NO: 304910 - DNA, 25 bp, Homo sapien
aaaccttgctagtcccaggtgactg

SEQ ID NO: 304911 - DNA, 25 bp, Homo sapien
aaccctgctgttgtctgcctctaaa

SEQ ID NO: 304912 - DNA, 25 bp, Homo sapien
gcagaggaccacatttaccagggtg

SEQ ID NO: 304913 - DNA, 25 bp, Homo sapien
gaccacatttaccagggtgcacttt

SEQ ID NO: 304914 - DNA, 25 bp, Homo sapien
acatttaccagggtgcactttggcc

SEQ ID NO: 304915 - DNA, 25 bp, Homo sapien
caggaggcccctgggttccagtcaa

SEQ ID NO: 304916 - DNA, 25 bp, Homo sapien
cctgggttccagtcaaggtcatggg

SEQ ID NO: 304917 - DNA, 25 bp, Homo sapien
cagtcaaggtcatgggagaggccca

SEQ ID NO: 304918 - DNA, 25 bp, Homo sapien
cagggtggaaattaagtgcccaggt

SEQ ID NO: 304919 - DNA, 25 bp, Homo sapien
aaattaagtgcccaggtatgttatg

SEQ ID NO: 304920 - DNA, 25 bp, Homo sapien
tatgttatggatagcctgcagccct

SEQ ID NO: 304921 - DNA, 25 bp, Homo sapien
cagaggagcaaatgcgggtcaagaa

SEQ ID NO: 304922 - DNA, 25 bp, Homo sapien
aatgcgggtcaagaattccgaacta

SEQ ID NO: 304923 - DNA, 25 bp, Homo sapien
agagcctgcaggacgcccttcggtt

SEQ ID NO: 304924 - DNA, 25 bp, Homo sapien
tgggaagccctgttccaaccacatg

SEQ ID NO: 304925 - DNA, 25 bp, Homo sapien
aaccacatgccacataggtcctgtt

SEQ ID NO: 304926 - DNA, 25 bp, Homo sapien
cataggtcctgttacgtgagttaga

SEQ ID NO: 304927 - DNA, 25 bp, Homo sapien
ggtgcgtgtgcttctcaagatgagc

SEQ ID NO: 304928 - DNA, 25 bp, Homo sapien
gtgcttctcaagatgagctttcatc

SEQ ID NO: 304929 - DNA, 25 bp, Homo sapien
ttcatcaagttcttcctccacgcga

SEQ ID NO: 304930 - DNA, 25 bp, Homo sapien
ctccacgcgacgttggtccaattgg

SEQ ID NO: 304931 - DNA, 25 bp, Homo sapien
ctgcgccagcattgtgtgtcaagtg

SEQ ID NO: 304932 - DNA, 25 bp, Homo sapien
caagtgtgtgtgtggctggcattcc

SEQ ID NO: 304933 - DNA, 25 bp, Homo sapien
gcattcctgtgtgccgcgtgcagag

SEQ ID NO: 304934 - DNA, 25 bp, Homo sapien
agagttagccgggactgaagccgtc

SEQ ID NO: 304935 - DNA, 25 bp, Homo sapien
gactgaagccgtcgtcttcttaaga

SEQ ID NO: 304936 - DNA, 25 bp, Homo sapien
gtcttcttaagacggagttccataa

SEQ ID NO: 304937 - DNA, 25 bp, Homo sapien
gagttccataatgggccgggagtac

SEQ ID NO: 304938 - DNA, 25 bp, Homo sapien
ccctggtacgtagcgaggtatctgc

SEQ ID NO: 304939 - DNA, 25 bp, Homo sapien
gcgtccaggcccgttttgttcgtga

SEQ ID NO: 304940 - DNA, 25 bp, Homo sapien
ttttgttcgtgaccgggcccatggc

SEQ ID NO: 304941 - DNA, 25 bp, Homo sapien
ggtagtgcatcacctgttcgtaggc

SEQ ID NO: 304942 - DNA, 25 bp, Homo sapien
gcatcacctgttcgtaggccttgag

SEQ ID NO: 304943 - DNA, 25 bp, Homo sapien
ctgttcgtaggccttgaggtccatt

SEQ ID NO: 304944 - DNA, 25 bp, Homo sapien
taggccttgaggtccattttgtggg

SEQ ID NO: 304945 - DNA, 25 bp, Homo sapien
gggcagctctacttccctactgtca

SEQ ID NO: 304946 - DNA, 25 bp, Homo sapien
actgtcactgcttgggaatgtgggc

SEQ ID NO: 304947 - DNA, 25 bp, Homo sapien
tgggctgagagctgctgccacgtct

SEQ ID NO: 304948 - DNA, 25 bp, Homo sapien
gccacgtcttccactttttaagaga

SEQ ID NO: 304949 - DNA, 25 bp, Homo sapien
ccatgcttttagtgtagtatctcaa

SEQ ID NO: 304950 - DNA, 25 bp, Homo sapien
gggaactaattcaattaaggcttga

SEQ ID NO: 304951 - DNA, 25 bp, Homo sapien
gggttgtaaattcagattcctcttg

SEQ ID NO: 304952 - DNA, 25 bp, Homo sapien
ggcttgaaatatacactcaacacca

SEQ ID NO: 304953 - DNA, 25 bp, Homo sapien
attcctcttggccatacgggaaatc

SEQ ID NO: 304954 - DNA, 25 bp, Homo sapien
ggccatacgggaaatcaacaggaat

SEQ ID NO: 304955 - DNA, 25 bp, Homo sapien
gtgttgccaagtggagagtcccatg

SEQ ID NO: 304956 - DNA, 25 bp, Homo sapien
atttaaggaggtactggctcccaag

SEQ ID NO: 304957 - DNA, 25 bp, Homo sapien
acaagtgttggatgggcaccgtcct

SEQ ID NO: 304958 - DNA, 25 bp, Homo sapien
atgggcaccgtcctggtagaattcc

SEQ ID NO: 304959 - DNA, 25 bp, Homo sapien
tggtagaattccctcctctttgggt

SEQ ID NO: 304960 - DNA, 25 bp, Homo sapien
tttgggttccttagcactgcccttt

SEQ ID NO: 304961 - DNA, 25 bp, Homo sapien
ccttttctggtctttcactgattga

SEQ ID NO: 304962 - DNA, 25 bp, Homo sapien
cactgattgactctaggtctggcta

SEQ ID NO: 304963 - DNA, 25 bp, Homo sapien
taggtctggctatgtgattttcacg

SEQ ID NO: 304964 - DNA, 25 bp, Homo sapien
atgtgattttcacggctttggccaa

SEQ ID NO: 304965 - DNA, 25 bp, Homo sapien
aggaaattgacctctgagttgccaa

SEQ ID NO: 304966 - DNA, 25 bp, Homo sapien
ctgagttgccaagtcctgaggattc

SEQ ID NO: 304967 - DNA, 25 bp, Homo sapien
tcccacctgagattgcaggaatctt

SEQ ID NO: 304968 - DNA, 25 bp, Homo sapien
ttacctggcagaggcctcaacacaa

SEQ ID NO: 304969 - DNA, 25 bp, Homo sapien
gatgcagcaggccctcagagagcca

SEQ ID NO: 304970 - DNA, 25 bp, Homo sapien
agagagccatcgcaaccatcacaac

SEQ ID NO: 304971 - DNA, 25 bp, Homo sapien
gagccccagggaacgtacatatctt

SEQ ID NO: 304972 - DNA, 25 bp, Homo sapien
agaggcctcaacacaaacatggaag

SEQ ID NO: 304973 - DNA, 25 bp, Homo sapien
aacgtacatatcttcattccaccta

SEQ ID NO: 304974 - DNA, 25 bp, Homo sapien
aacatggaagacagctaggtatact

SEQ ID NO: 304975 - DNA, 25 bp, Homo sapien
gacagctaggtatacttcaattcta

SEQ ID NO: 304976 - DNA, 25 bp, Homo sapien
taggtatacttcaattctacctcct

SEQ ID NO: 304977 - DNA, 25 bp, Homo sapien
gataaaacttatcccaggcgtccgg

SEQ ID NO: 304978 - DNA, 25 bp, Homo sapien
aaactgctttggcatgctaattaga

SEQ ID NO: 304979 - DNA, 25 bp, Homo sapien
taaaaacgatggactccgtggaagg

SEQ ID NO: 304980 - DNA, 25 bp, Homo sapien
gggatccagggcagatcttcaagga

SEQ ID NO: 304981 - DNA, 25 bp, Homo sapien
gaacttaaaggagctattttcagtg

SEQ ID NO: 304982 - DNA, 25 bp, Homo sapien
attttcagtgacttcccttatcaac

SEQ ID NO: 304983 - DNA, 25 bp, Homo sapien
gacttcccttatcaacaaattcatt

SEQ ID NO: 304984 - DNA, 25 bp, Homo sapien
acgtgggatgaagggtcatgttcaa

SEQ ID NO: 304985 - DNA, 25 bp, Homo sapien
taacaactgatatgtcgtgggcatc

SEQ ID NO: 304986 - DNA, 25 bp, Homo sapien
gtcgtgggcatcaacaagtcagaat

SEQ ID NO: 304987 - DNA, 25 bp, Homo sapien
tagaacggttgtacgtgagccctgc

SEQ ID NO: 304988 - DNA, 25 bp, Homo sapien
tacgtgagccctgcctgtgattaag

SEQ ID NO: 304989 - DNA, 25 bp, Homo sapien
actgcccccatgtccttgggaggag

SEQ ID NO: 304990 - DNA, 25 bp, Homo sapien
ccccatgtccttgggaggagggacg

SEQ ID NO: 304991 - DNA, 25 bp, Homo sapien
gagagggggagctcacggcaaaggg

SEQ ID NO: 304992 - DNA, 25 bp, Homo sapien
tgggctcgggcctggcggtgtccga

SEQ ID NO: 304993 - DNA, 25 bp, Homo sapien
gggctcgggcctggcggtgtccgag

SEQ ID NO: 304994 - DNA, 25 bp, Homo sapien
cgcgcgctcactcgcccgtgtgggt

SEQ ID NO: 304995 - DNA, 25 bp, Homo sapien
gtgggtccgcaggtggtacttgagc

SEQ ID NO: 304996 - DNA, 25 bp, Homo sapien
tgggtccgcaggtggtacttgagcg

SEQ ID NO: 304997 - DNA, 25 bp, Homo sapien
gtccgcaggtggtacttgagcgact

SEQ ID NO: 304998 - DNA, 25 bp, Homo sapien
gcagcaagggacctggtctcactgc

SEQ ID NO: 304999 - DNA, 25 bp, Homo sapien
cagcaagggacctggtctcactgcc

SEQ ID NO: 305000 - DNA, 25 bp, Homo sapien
tggagcaggacaaccgcgcgctccg

SEQ ID NO: 305001 - DNA, 25 bp, Homo sapien
agagcttgcagctgctcaaggctcg

SEQ ID NO: 305002 - DNA, 25 bp, Homo sapien
tcaaggctcgctgcgaggagctgca

SEQ ID NO: 305003 - DNA, 25 bp, Homo sapien
actgggccacgctgtcgctggagaa

SEQ ID NO: 305004 - DNA, 25 bp, Homo sapien
aggccctgaagagccagatctcgga

SEQ ID NO: 305005 - DNA, 25 bp, Homo sapien
ctgaagagccagatctcggagaagc

SEQ ID NO: 305006 - DNA, 25 bp, Homo sapien
ctggagctgcagatcagcattgtgg

SEQ ID NO: 305007 - DNA, 25 bp, Homo sapien
gctgcagatcagcattgtggagcta

SEQ ID NO: 305008 - DNA, 25 bp, Homo sapien
atcagcattgtggagctagagaaga

SEQ ID NO: 305009 - DNA, 25 bp, Homo sapien
agctcctgcagctcaagtcctgtgt

SEQ ID NO: 305010 - DNA, 25 bp, Homo sapien
gcagctcaagtcctgtgtgccgcct

SEQ ID NO: 305011 - DNA, 25 bp, Homo sapien
ggagaggaacctattctccatgcag

SEQ ID NO: 305012 - DNA, 25 bp, Homo sapien
cagatcttgggagctgcaacggtgc

SEQ ID NO: 305013 - DNA, 25 bp, Homo sapien
gcaacggtgcatctgtctcacaaaa

SEQ ID NO: 305014 - DNA, 25 bp, Homo sapien
ctgtctcacaaaaaggttccttgtc

SEQ ID NO: 305015 - DNA, 25 bp, Homo sapien
aaagttcgacttgtagagccccata

SEQ ID NO: 305016 - DNA, 25 bp, Homo sapien
gttcgacttgtagagccccatagcc

SEQ ID NO: 305017 - DNA, 25 bp, Homo sapien
ctccttcaagcaaattcagcacaaa

SEQ ID NO: 305018 - DNA, 25 bp, Homo sapien
ttcagcacaaaaggcctctgtaaga

SEQ ID NO: 305019 - DNA, 25 bp, Homo sapien
atgatggctctgatgatggaccctc

SEQ ID NO: 305020 - DNA, 25 bp, Homo sapien
gatggaccctcagtgatggatgaaa

SEQ ID NO: 305021 - DNA, 25 bp, Homo sapien
atgatgcctttgattctttagaaag

SEQ ID NO: 305022 - DNA, 25 bp, Homo sapien
ctgtttcccaagctaatatcctaca

SEQ ID NO: 305023 - DNA, 25 bp, Homo sapien
gtttcccaagctaatatcctacatt

SEQ ID NO: 305024 - DNA, 25 bp, Homo sapien
atcctacattatatgatacatgcag

SEQ ID NO: 305025 - DNA, 25 bp, Homo sapien
tagctactttttatcctttacccat

SEQ ID NO: 305026 - DNA, 25 bp, Homo sapien
ttttatcctttacccatacttggag

SEQ ID NO: 305027 - DNA, 25 bp, Homo sapien
tatcctttacccatacttggagtag

SEQ ID NO: 305028 - DNA, 25 bp, Homo sapien
tcctttacccatacttggagtagtt

SEQ ID NO: 305029 - DNA, 25 bp, Homo sapien
tacccatacttggagtagtttatat

SEQ ID NO: 305030 - DNA, 25 bp, Homo sapien
gaaataaggctctttattataagtg

SEQ ID NO: 305031 - DNA, 25 bp, Homo sapien
ccctcctttcctagagactcaatta

SEQ ID NO: 305032 - DNA, 25 bp, Homo sapien
gagactcaattaacattgtagactt

SEQ ID NO: 305033 - DNA, 25 bp, Homo sapien
agcaccctgacgctgagcaaagcag

SEQ ID NO: 305034 - DNA, 25 bp, Homo sapien
gcaccctgacgctgagcaaagcaga

SEQ ID NO: 305035 - DNA, 25 bp, Homo sapien
caccctgacgctgagcaaagcagac

SEQ ID NO: 305036 - DNA, 25 bp, Homo sapien
accctgacgctgagcaaagcagact

SEQ ID NO: 305037 - DNA, 25 bp, Homo sapien
ccctgacgctgagcaaagcagacta

SEQ ID NO: 305038 - DNA, 25 bp, Homo sapien
cctgacgctgagcaaagcagactac

SEQ ID NO: 305039 - DNA, 25 bp, Homo sapien
ctgacgctgagcaaagcagactacg

SEQ ID NO: 305040 - DNA, 25 bp, Homo sapien
tgacgctgagcaaagcagactacga

SEQ ID NO: 305041 - DNA, 25 bp, Homo sapien
gacgctgagcaaagcagactacgag

SEQ ID NO: 305042 - DNA, 25 bp, Homo sapien
acgctgagcaaagcagactacgaga

SEQ ID NO: 305043 - DNA, 25 bp, Homo sapien
tggctgcctctgagtctgaatctcc

SEQ ID NO: 305044 - DNA, 25 bp, Homo sapien
gaaaccaatttctaagaggactgga

SEQ ID NO: 305045 - DNA, 25 bp, Homo sapien
agaggactggattgcagaagactcg

SEQ ID NO: 305046 - DNA, 25 bp, Homo sapien
gggacaacatttgatccaagatctt

SEQ ID NO: 305047 - DNA, 25 bp, Homo sapien
atattgataaccatgctcagcaatg

SEQ ID NO: 305048 - DNA, 25 bp, Homo sapien
ctcagcaatgagctattagattcat

SEQ ID NO: 305049 - DNA, 25 bp, Homo sapien
attcattttgggaaatctccataat

SEQ ID NO: 305050 - DNA, 25 bp, Homo sapien
gggaaatctccataatttcaatttg

SEQ ID NO: 305051 - DNA, 25 bp, Homo sapien
taagacctgtctacattgttatatg

SEQ ID NO: 305052 - DNA, 25 bp, Homo sapien
gttatatgtgtgtgacttgagtaat

SEQ ID NO: 305053 - DNA, 25 bp, Homo sapien
gagtaatgttatcaacgtttttgta

SEQ ID NO: 305054 - DNA, 25 bp, Homo sapien
tagtgattcacatccacgggacaaa

SEQ ID NO: 305055 - DNA, 25 bp, Homo sapien
gaagaaataagagctgacgccacac

SEQ ID NO: 305056 - DNA, 25 bp, Homo sapien
agctgacgccacacaagtcttggct

SEQ ID NO: 305057 - DNA, 25 bp, Homo sapien
aagtcttggctgcttttgttactat

SEQ ID NO: 305058 - DNA, 25 bp, Homo sapien
tgttaatcacttgcacagttgagaa

SEQ ID NO: 305059 - DNA, 25 bp, Homo sapien
acttgcacagttgagaacatttcct

SEQ ID NO: 305060 - DNA, 25 bp, Homo sapien
gaacatttcctatacatcggctttt

SEQ ID NO: 305061 - DNA, 25 bp, Homo sapien
catcggcttttaattctagctctta

SEQ ID NO: 305062 - DNA, 25 bp, Homo sapien
taattctagctcttatttcattttg

SEQ ID NO: 305063 - DNA, 25 bp, Homo sapien
ctttcgtctgcatgttcacaatacc

SEQ ID NO: 305064 - DNA, 25 bp, Homo sapien
gcatgttcacaataccaagcattaa

SEQ ID NO: 305065 - DNA, 25 bp, Homo sapien
ctttagcctacaatctcttattaaa

SEQ ID NO: 305066 - DNA, 25 bp, Homo sapien
tagcctacaatctcttattaaaaat

SEQ ID NO: 305067 - DNA, 25 bp, Homo sapien
caaatgcatttcatcagaactcaaa

SEQ ID NO: 305068 - DNA, 25 bp, Homo sapien
gcatttcatcagaactcaaatttaa

SEQ ID NO: 305069 - DNA, 25 bp, Homo sapien
ataatgctgaagttattccatataa

SEQ ID NO: 305070 - DNA, 25 bp, Homo sapien
gctgaagttattccatataagtatc

SEQ ID NO: 305071 - DNA, 25 bp, Homo sapien
gttattccatataagtatcaagtta

SEQ ID NO: 305072 - DNA, 25 bp, Homo sapien
gtatcaagttaaacacaattcattt

SEQ ID NO: 305073 - DNA, 25 bp, Homo sapien
gttaaacacaattcattttgattat

SEQ ID NO: 305074 - DNA, 25 bp, Homo sapien
ttgattataaactatttgacttttt

SEQ ID NO: 305075 - DNA, 25 bp, Homo sapien
gatgtatcaaaatttattgcacact

SEQ ID NO: 305076 - DNA, 25 bp, Homo sapien
agtgtgcaccacaaggtggagagcc

SEQ ID NO: 305077 - DNA, 25 bp, Homo sapien
tggagagccgagaataagcgagtaa

SEQ ID NO: 305078 - DNA, 25 bp, Homo sapien
agcgagtaaacagctgtgtaaatac

SEQ ID NO: 305079 - DNA, 25 bp, Homo sapien
tgtgtaaatacaaatagccctgatg

SEQ ID NO: 305080 - DNA, 25 bp, Homo sapien
acaaatagccctgatgtgggcggaa

SEQ ID NO: 305081 - DNA, 25 bp, Homo sapien
cggaatggagattttcacggagcag

SEQ ID NO: 305082 - DNA, 25 bp, Homo sapien
agattttcacggagcagggagcagt

SEQ ID NO: 305083 - DNA, 25 bp, Homo sapien
ggaattctcataggttatttctttc

SEQ ID NO: 305084 - DNA, 25 bp, Homo sapien
aacaaatagttacagagccgttact

SEQ ID NO: 305085 - DNA, 25 bp, Homo sapien
tccgggcgtttgagaacagagcaca

SEQ ID NO: 305086 - DNA, 25 bp, Homo sapien
tttgagaacagagcacaagcttgac

SEQ ID NO: 305087 - DNA, 25 bp, Homo sapien
agccgctttccttctgagcattcta

SEQ ID NO: 305088 - DNA, 25 bp, Homo sapien
gagcattctatttcccatatggcag

SEQ ID NO: 305089 - DNA, 25 bp, Homo sapien
agggactggtatttcgtgctcgaga

SEQ ID NO: 305090 - DNA, 25 bp, Homo sapien
gtgctcgagaatctgatatttttca

SEQ ID NO: 305091 - DNA, 25 bp, Homo sapien
ttcatcaaacaccttcctcaaactt

SEQ ID NO: 305092 - DNA, 25 bp, Homo sapien
caaactttgagtcccactgagttcc

SEQ ID NO: 305093 - DNA, 25 bp, Homo sapien
gagttccgagagtccatatggcata

SEQ ID NO: 305094 - DNA, 25 bp, Homo sapien
gaccctggcccggagataggagcct

SEQ ID NO: 305095 - DNA, 25 bp, Homo sapien
ataggagcctgcctttagagtctag

SEQ ID NO: 305096 - DNA, 25 bp, Homo sapien
agtctaggccgggtgactgcagaca

SEQ ID NO: 305097 - DNA, 25 bp, Homo sapien
gggtgactgcagacaagccgctttc

SEQ ID NO: 305098 - DNA, 25 bp, Homo sapien
gacctgcctgcatggttccatccat

SEQ ID NO: 305099 - DNA, 25 bp, Homo sapien
ggttccatccattactcatggcctc

SEQ ID NO: 305100 - DNA, 25 bp, Homo sapien
ttccatccattactcatggcctcag

SEQ ID NO: 305101 - DNA, 25 bp, Homo sapien
gctgagagagggaaccagcctgcct

SEQ ID NO: 305102 - DNA, 25 bp, Homo sapien
ccagccctgggcattgtcttgtgtg

SEQ ID NO: 305103 - DNA, 25 bp, Homo sapien
tgtcttgtgtgcttcctgagggagt

SEQ ID NO: 305104 - DNA, 25 bp, Homo sapien
gtcttgtgtgcttcctgagggagta

SEQ ID NO: 305105 - DNA, 25 bp, Homo sapien
tgtgtgcttcctgagggagtaggga

SEQ ID NO: 305106 - DNA, 25 bp, Homo sapien
gggcctccatctctaatttcataat

SEQ ID NO: 305107 - DNA, 25 bp, Homo sapien
ggcctccatctctaatttcataata

SEQ ID NO: 305108 - DNA, 25 bp, Homo sapien
gcctccatctctaatttcataataa

SEQ ID NO: 305109 - DNA, 25 bp, Homo sapien
gaaagaatataagtcctgctagata

SEQ ID NO: 305110 - DNA, 25 bp, Homo sapien
gaatataagtcctgctagataaatc

SEQ ID NO: 305111 - DNA, 25 bp, Homo sapien
ataagtcctgctagataaatcatta

SEQ ID NO: 305112 - DNA, 25 bp, Homo sapien
gaatatatactggaataattttgag

SEQ ID NO: 305113 - DNA, 25 bp, Homo sapien
taaaaagaaaccaatggcctaactg

SEQ ID NO: 305114 - DNA, 25 bp, Homo sapien
ggaaagaaaatctaaacagactgat

SEQ ID NO: 305115 - DNA, 25 bp, Homo sapien
aatgaaattcagacacttacagagc

SEQ ID NO: 305116 - DNA, 25 bp, Homo sapien
gaaattcagacacttacagagcagc

SEQ ID NO: 305117 - DNA, 25 bp, Homo sapien
aattcagacacttacagagcagcca

SEQ ID NO: 305118 - DNA, 25 bp, Homo sapien
ttcagacacttacagagcagccagg

SEQ ID NO: 305119 - DNA, 25 bp, Homo sapien
tcagacacttacagagcagccaggc

SEQ ID NO: 305120 - DNA, 25 bp, Homo sapien
ccagtgctctccacggacagggtga

SEQ ID NO: 305121 - DNA, 25 bp, Homo sapien
gggtgaactccacaaactcgttatt

SEQ ID NO: 305122 - DNA, 25 bp, Homo sapien
accggcgctgattttgcttgttgta

SEQ ID NO: 305123 - DNA, 25 bp, Homo sapien
gttattaagcagttggatccgggca

SEQ ID NO: 305124 - DNA, 25 bp, Homo sapien
gatccgggcaaccaggcaactcttg

SEQ ID NO: 305125 - DNA, 25 bp, Homo sapien
gcaactcttgctggacaccgtgtag

SEQ ID NO: 305126 - DNA, 25 bp, Homo sapien
agcgccgggtgcgtttcagtttcaa

SEQ ID NO: 305127 - DNA, 25 bp, Homo sapien
aaatggcagtggcatcttcttcttt

SEQ ID NO: 305128 - DNA, 25 bp, Homo sapien
tctttcttcaagaatggaggagcaa

SEQ ID NO: 305129 - DNA, 25 bp, Homo sapien
tttgcttgttgtagtaccagaggct

SEQ ID NO: 305130 - DNA, 25 bp, Homo sapien
tcgaggctttcctggccagtgctct

SEQ ID NO: 305131 - DNA, 25 bp, Homo sapien
gaagtgaccccatgtcagtcacatg

SEQ ID NO: 305132 - DNA, 25 bp, Homo sapien
agtcacatggactggtctttagcaa

SEQ ID NO: 305133 - DNA, 25 bp, Homo sapien
ggtctttagcaaagtccaaggctgc

SEQ ID NO: 305134 - DNA, 25 bp, Homo sapien
gtggtctctgttctacactttaatg

SEQ ID NO: 305135 - DNA, 25 bp, Homo sapien
taatgtcaccctctacatcatctta

SEQ ID NO: 305136 - DNA, 25 bp, Homo sapien
gcccacccaaccttataaacatgat

SEQ ID NO: 305137 - DNA, 25 bp, Homo sapien
gttaggcaccacactggttggtcaa

SEQ ID NO: 305138 - DNA, 25 bp, Homo sapien
ctggttggtcaacttggatgttcat

SEQ ID NO: 305139 - DNA, 25 bp, Homo sapien
ttggatgttcatcgaggctcattct

SEQ ID NO: 305140 - DNA, 25 bp, Homo sapien
gaggctcattctggccttgctcaga

SEQ ID NO: 305141 - DNA, 25 bp, Homo sapien
ctaccatttgaagtgaccccatgtc

SEQ ID NO: 305142 - DNA, 25 bp, Homo sapien
cgtttctctgtaactcgcttggtca

SEQ ID NO: 305143 - DNA, 25 bp, Homo sapien
ctctgtaactcgcttggtcacaata

SEQ ID NO: 305144 - DNA, 25 bp, Homo sapien
ggtcacaatagaagctgctcctaaa

SEQ ID NO: 305145 - DNA, 25 bp, Homo sapien
gctcctaaaagcaatgtagaccctt

SEQ ID NO: 305146 - DNA, 25 bp, Homo sapien
gtagacccttacaaagagaccagcc

SEQ ID NO: 305147 - DNA, 25 bp, Homo sapien
tacaaagagaccagcccacctaaat

SEQ ID NO: 305148 - DNA, 25 bp, Homo sapien
gaactctaacagtcctaatatttta

SEQ ID NO: 305149 - DNA, 25 bp, Homo sapien
gaacaatacagttcattcctgtggc

SEQ ID NO: 305150 - DNA, 25 bp, Homo sapien
agttcattcctgtggcttagtctag

SEQ ID NO: 305151 - DNA, 25 bp, Homo sapien
ggtcactcgtgggatgcaaaaacca

SEQ ID NO: 305152 - DNA, 25 bp, Homo sapien
tttgggcgctagctgcctctcggtt

SEQ ID NO: 305153 - DNA, 25 bp, Homo sapien
catcaattttgtactgttatgcagt

SEQ ID NO: 305154 - DNA, 25 bp, Homo sapien
taactgtcacatctattgaaaatgg

SEQ ID NO: 305155 - DNA, 25 bp, Homo sapien
tgttatttaagtgtcattgatgtac

SEQ ID NO: 305156 - DNA, 25 bp, Homo sapien
cattgatgtactgtattgacttggg

SEQ ID NO: 305157 - DNA, 25 bp, Homo sapien
tttgttacttaacatgtgtacatgc

SEQ ID NO: 305158 - DNA, 25 bp, Homo sapien
acatgtgtacatgcatgaaagcatt

SEQ ID NO: 305159 - DNA, 25 bp, Homo sapien
aagcatttttcgttgttccctgata

SEQ ID NO: 305160 - DNA, 25 bp, Homo sapien
catttttcgttgttccctgatagtt

SEQ ID NO: 305161 - DNA, 25 bp, Homo sapien
gttgttccctgatagttacatttca

SEQ ID NO: 305162 - DNA, 25 bp, Homo sapien
ggatttttccaaattacttaagatg

SEQ ID NO: 305163 - DNA, 25 bp, Homo sapien
ttttgggaacatcaattttgtactg

SEQ ID NO: 305164 - DNA, 25 bp, Homo sapien
atctctcagtagatctgcttgccag

SEQ ID NO: 305165 - DNA, 25 bp, Homo sapien
tctgcttgccagataacagctgtat

SEQ ID NO: 305166 - DNA, 25 bp, Homo sapien
ccaattcataccagccgtgaactgt

SEQ ID NO: 305167 - DNA, 25 bp, Homo sapien
taccagccgtgaactgtgatgctcc

SEQ ID NO: 305168 - DNA, 25 bp, Homo sapien
gataatgagagttccttgccctcca

SEQ ID NO: 305169 - DNA, 25 bp, Homo sapien
ccagttctccaagccgtttcgaaga

SEQ ID NO: 305170 - DNA, 25 bp, Homo sapien
gccgtttcgaagaagacctgctaat

SEQ ID NO: 305171 - DNA, 25 bp, Homo sapien
gacctgctaattgaattcagttgtt

SEQ ID NO: 305172 - DNA, 25 bp, Homo sapien
ttcatgctttccacaaaacaagaat

SEQ ID NO: 305173 - DNA, 25 bp, Homo sapien
gggattgaaaacactagcagcctaa

SEQ ID NO: 305174 - DNA, 25 bp, Homo sapien
aacactagcagcctaatctctcagt

SEQ ID NO: 305175 - DNA, 25 bp, Homo sapien
tgtacaaacaatcaccataacctat

SEQ ID NO: 305176 - DNA, 25 bp, Homo sapien
aatcaccataacctattggattttt

SEQ ID NO: 305177 - DNA, 25 bp, Homo sapien
aaaaattagtattcacttctgtgtc

SEQ ID NO: 305178 - DNA, 25 bp, Homo sapien
acttctgtgtcttgagcccacagat

SEQ ID NO: 305179 - DNA, 25 bp, Homo sapien
actcagattatatagggaaaggtgt

SEQ ID NO: 305180 - DNA, 25 bp, Homo sapien
gaaaggtgtgctcctaaaaacgaca

SEQ ID NO: 305181 - DNA, 25 bp, Homo sapien
gggcttatggttaataggtattatt

SEQ ID NO: 305182 - DNA, 25 bp, Homo sapien
ttacctgactaaagacctatgtggc

SEQ ID NO: 305183 - DNA, 25 bp, Homo sapien
taaagacctatgtggcctcatgata

SEQ ID NO: 305184 - DNA, 25 bp, Homo sapien
ggcctcatgatacacaggagcctat

SEQ ID NO: 305185 - DNA, 25 bp, Homo sapien
cacaggagcctataagatatgttta

SEQ ID NO: 305186 - DNA, 25 bp, Homo sapien
aagaactagttcagaggccgagcct

SEQ ID NO: 305187 - DNA, 25 bp, Homo sapien
ggccgagcctcctgggagaatgtct

SEQ ID NO: 305188 - DNA, 25 bp, Homo sapien
gagccctacaacattagaatggttc

SEQ ID NO: 305189 - DNA, 25 bp, Homo sapien
gaatgtctcccagctcacaaaaatg

SEQ ID NO: 305190 - DNA, 25 bp, Homo sapien
aaatgactactcactggcaagtaac

SEQ ID NO: 305191 - DNA, 25 bp, Homo sapien
acagaaagaacgtcatcagttggtt

SEQ ID NO: 305192 - DNA, 25 bp, Homo sapien
atcagttggttggtgttcttgcttt

SEQ ID NO: 305193 - DNA, 25 bp, Homo sapien
cttgctttctctccgtgaacaatta

SEQ ID NO: 305194 - DNA, 25 bp, Homo sapien
gttccttttctcagggcctaatatg

SEQ ID NO: 305195 - DNA, 25 bp, Homo sapien
ggcactcagcaaggagggttttttc

SEQ ID NO: 305196 - DNA, 25 bp, Homo sapien
tttcagaggcccaggaagaactagt

SEQ ID NO: 305197 - DNA, 25 bp, Homo sapien
gttggtaggaaagctatgtaatcta

SEQ ID NO: 305198 - DNA, 25 bp, Homo sapien
gtactaaatccttatatgtttttgg

SEQ ID NO: 305199 - DNA, 25 bp, Homo sapien
gactttaatagctaatttggacttc

SEQ ID NO: 305200 - DNA, 25 bp, Homo sapien
gggttaatttcacgagtgcatatca

SEQ ID NO: 305201 - DNA, 25 bp, Homo sapien
gtgcatatcacttttgactatatta

SEQ ID NO: 305202 - DNA, 25 bp, Homo sapien
ttttttcttaagtgctctcttcctt

SEQ ID NO: 305203 - DNA, 25 bp, Homo sapien
tcttaagtgctctcttccttatttc

SEQ ID NO: 305204 - DNA, 25 bp, Homo sapien
cattactacattcacatttctgctg

SEQ ID NO: 305205 - DNA, 25 bp, Homo sapien
atttctgctgtcaataagccctaat

SEQ ID NO: 305206 - DNA, 25 bp, Homo sapien
aagccctaatggagtgataaacttt

SEQ ID NO: 305207 - DNA, 25 bp, Homo sapien
gctagtagatactgcaccatgtctt

SEQ ID NO: 305208 - DNA, 25 bp, Homo sapien
gaagggattcacagaaggccaagaa

SEQ ID NO: 305209 - DNA, 25 bp, Homo sapien
ggttgggctgcgacctgtgacctca

SEQ ID NO: 305210 - DNA, 25 bp, Homo sapien
tgtgacctcagaccttcgctggctt

SEQ ID NO: 305211 - DNA, 25 bp, Homo sapien
aatggaaccacagccaaagggtctc

SEQ ID NO: 305212 - DNA, 25 bp, Homo sapien
cagaccttcgctggcttcaggactg

SEQ ID NO: 305213 - DNA, 25 bp, Homo sapien
cagtctggtgctgcggcattggtct

SEQ ID NO: 305214 - DNA, 25 bp, Homo sapien
tgctgcggcattggtcttctctgtg

SEQ ID NO: 305215 - DNA, 25 bp, Homo sapien
ttctctgtggtgtggatcctctggt

SEQ ID NO: 305216 - DNA, 25 bp, Homo sapien
agcttttccccatcgtggatctgaa

SEQ ID NO: 305217 - DNA, 25 bp, Homo sapien
gtggatctgaagagcactcggaccc

SEQ ID NO: 305218 - DNA, 25 bp, Homo sapien
cactcggaccctttagctgtggaag

SEQ ID NO: 305219 - DNA, 25 bp, Homo sapien
ttctcagccagtatcgtactgaata

SEQ ID NO: 305220 - DNA, 25 bp, Homo sapien
aaaggctctattgagtcttgcaatg

SEQ ID NO: 305221 - DNA, 25 bp, Homo sapien
agctctggccagagcattcagccaa

SEQ ID NO: 305222 - DNA, 25 bp, Homo sapien
ggccagagcattcagccaatcttgg

SEQ ID NO: 305223 - DNA, 25 bp, Homo sapien
gagcattcagccaatcttggcagat

SEQ ID NO: 305224 - DNA, 25 bp, Homo sapien
atcttggcagattgaggtactgcaa

SEQ ID NO: 305225 - DNA, 25 bp, Homo sapien
tatgccattgaatgccattgagacg

SEQ ID NO: 305226 - DNA, 25 bp, Homo sapien
ttgcaatggtaaacaacagaccctg

SEQ ID NO: 305227 - DNA, 25 bp, Homo sapien
acagaccctggagtttgaggacaac

SEQ ID NO: 305228 - DNA, 25 bp, Homo sapien
gaggacaacaccaaggtactgccat

SEQ ID NO: 305229 - DNA, 25 bp, Homo sapien
gtactgccatacttgaggtggagat

SEQ ID NO: 305230 - DNA, 25 bp, Homo sapien
gtctgcagaacaagcattttggaat

SEQ ID NO: 305231 - DNA, 25 bp, Homo sapien
attttggaataaatagccccatttg

SEQ ID NO: 305232 - DNA, 25 bp, Homo sapien
agccccatttgaacaataggccaaa

SEQ ID NO: 305233 - DNA, 25 bp, Homo sapien
gttagtacaaactatagcgcctcat

SEQ ID NO: 305234 - DNA, 25 bp, Homo sapien
agcaaagccaactagtccataagag

SEQ ID NO: 305235 - DNA, 25 bp, Homo sapien
tattcagtgagggttcacatttgga

SEQ ID NO: 305236 - DNA, 25 bp, Homo sapien
aactatagcgcctcatgttcttaac

SEQ ID NO: 305237 - DNA, 25 bp, Homo sapien
tagcgcctcatgttcttaacagacc

SEQ ID NO: 305238 - DNA, 25 bp, Homo sapien
ttaacagaccccaccacttcggatg

SEQ ID NO: 305239 - DNA, 25 bp, Homo sapien
cttcggatgccagttacagtgtaat

SEQ ID NO: 305240 - DNA, 25 bp, Homo sapien
tgtaggctatgttcttcattaagaa

SEQ ID NO: 305241 - DNA, 25 bp, Homo sapien
gaggattacatctgggtgcttttta

SEQ ID NO: 305242 - DNA, 25 bp, Homo sapien
tattttccatttgctcatcggtttt

SEQ ID NO: 305243 - DNA, 25 bp, Homo sapien
ccatttgctcatcggttttctgaaa

SEQ ID NO: 305244 - DNA, 25 bp, Homo sapien
atcggttttctgaaatttccacagc

SEQ ID NO: 305245 - DNA, 25 bp, Homo sapien
gactgttaccttggtagtgagaaac

SEQ ID NO: 305246 - DNA, 25 bp, Homo sapien
tttcaaagagggtcatttatacctg

SEQ ID NO: 305247 - DNA, 25 bp, Homo sapien
tcttccgcctcccaagtgaaatggg

SEQ ID NO: 305248 - DNA, 25 bp, Homo sapien
gctgattcatttatgttctttcttg

SEQ ID NO: 305249 - DNA, 25 bp, Homo sapien
gtatattgctcaaaacagcccttgc

SEQ ID NO: 305250 - DNA, 25 bp, Homo sapien
aaaacagcccttgcgagctctagga

SEQ ID NO: 305251 - DNA, 25 bp, Homo sapien
ttgcgagctctaggagctcaggagc

SEQ ID NO: 305252 - DNA, 25 bp, Homo sapien
tctttggtgtagtggattacctacc

SEQ ID NO: 305253 - DNA, 25 bp, Homo sapien
attatatgtactttcccttttctgc

SEQ ID NO: 305254 - DNA, 25 bp, Homo sapien
ttctgcacaaattctgggaaaatgt

SEQ ID NO: 305255 - DNA, 25 bp, Homo sapien
tctgggaaaatgtaaaagccttcat

SEQ ID NO: 305256 - DNA, 25 bp, Homo sapien
tagggaacaactgtaagtccattca

SEQ ID NO: 305257 - DNA, 25 bp, Homo sapien
gtccattcagagcagtttaatttag

SEQ ID NO: 305258 - DNA, 25 bp, Homo sapien
ggattacctaccattactctgagat

SEQ ID NO: 305259 - DNA, 25 bp, Homo sapien
ttttaacactgcagaagacctaagg

SEQ ID NO: 305260 - DNA, 25 bp, Homo sapien
gacctaaggagtcataagattccat

SEQ ID NO: 305261 - DNA, 25 bp, Homo sapien
agattttatatctctaatccagtat

SEQ ID NO: 305262 - DNA, 25 bp, Homo sapien
gagatcctggttttgtgtgaatgca

SEQ ID NO: 305263 - DNA, 25 bp, Homo sapien
gatctgtgctgggtgcagccttaga

SEQ ID NO: 305264 - DNA, 25 bp, Homo sapien
gggtgcagccttagaatgtaaattc

SEQ ID NO: 305265 - DNA, 25 bp, Homo sapien
tgcaggattggcattctaaatattt

SEQ ID NO: 305266 - DNA, 25 bp, Homo sapien
aaacaaatgcttctttaggttacag

SEQ ID NO: 305267 - DNA, 25 bp, Homo sapien
tcacgattgttagatactgttgtca

SEQ ID NO: 305268 - DNA, 25 bp, Homo sapien
aggttttagatgaggctttctggaa

SEQ ID NO: 305269 - DNA, 25 bp, Homo sapien
gaatgatttagtttccctgtaaggg

SEQ ID NO: 305270 - DNA, 25 bp, Homo sapien
gtaagggagcctgtctattggaata

SEQ ID NO: 305271 - DNA, 25 bp, Homo sapien
ggaatagacaggttcacttctccca

SEQ ID NO: 305272 - DNA, 25 bp, Homo sapien
ttctcccagtctttcaagttgcatg

SEQ ID NO: 305273 - DNA, 25 bp, Homo sapien
caagttgcatgctttttatatctga

SEQ ID NO: 305274 - DNA, 25 bp, Homo sapien
atgctggcacctgagagagttctta

SEQ ID NO: 305275 - DNA, 25 bp, Homo sapien
ctgtgcggaactcctgctgagcaga

SEQ ID NO: 305276 - DNA, 25 bp, Homo sapien
gcagagtggctttgtattcttcctt

SEQ ID NO: 305277 - DNA, 25 bp, Homo sapien
aactcaggctgttggtgcactgcta

SEQ ID NO: 305278 - DNA, 25 bp, Homo sapien
gtgcactgctagagggctgctgtct

SEQ ID NO: 305279 - DNA, 25 bp, Homo sapien
gctgctgtctctgacactgcagtag

SEQ ID NO: 305280 - DNA, 25 bp, Homo sapien
actgcagtagccacagtcgagcttg

SEQ ID NO: 305281 - DNA, 25 bp, Homo sapien
agtcgagcttgagctggctggtcca

SEQ ID NO: 305282 - DNA, 25 bp, Homo sapien
gggctcagaccagagcaatgctgtg

SEQ ID NO: 305283 - DNA, 25 bp, Homo sapien
gcaatgctgtgagagtcctggtact

SEQ ID NO: 305284 - DNA, 25 bp, Homo sapien
cctggtactggccagtgcagagact

SEQ ID NO: 305285 - DNA, 25 bp, Homo sapien
tgatgtagacatgcatgcagggttt

SEQ ID NO: 305286 - DNA, 25 bp, Homo sapien
ttggatccagcctagataaagtact

SEQ ID NO: 305287 - DNA, 25 bp, Homo sapien
cagcctagataaagtactcagcttt

SEQ ID NO: 305288 - DNA, 25 bp, Homo sapien
gctttattgagctacagattcctct

SEQ ID NO: 305289 - DNA, 25 bp, Homo sapien
gagctacagattcctcttctgtaaa

SEQ ID NO: 305290 - DNA, 25 bp, Homo sapien
ttctgtaaaagaacgtccacctcat

SEQ ID NO: 305291 - DNA, 25 bp, Homo sapien
gaacgtccacctcataggtagctta

SEQ ID NO: 305292 - DNA, 25 bp, Homo sapien
cacctcataggtagcttaaaattaa

SEQ ID NO: 305293 - DNA, 25 bp, Homo sapien
ctctgcactgtgcttgatacgtttt

SEQ ID NO: 305294 - DNA, 25 bp, Homo sapien
tgcaagcagaggaggaatcgaagtc

SEQ ID NO: 305295 - DNA, 25 bp, Homo sapien
gaatcgaagtcaggagggctcacag

SEQ ID NO: 305296 - DNA, 25 bp, Homo sapien
tgacagattaccagttggtctcccc

SEQ ID NO: 305297 - DNA, 25 bp, Homo sapien
agttggtctcccctgccaagaatcc

SEQ ID NO: 305298 - DNA, 25 bp, Homo sapien
tccagtctcttctcaaaggaagcac

SEQ ID NO: 305299 - DNA, 25 bp, Homo sapien
ggaagcacccaagagaaaggcacaa

SEQ ID NO: 305300 - DNA, 25 bp, Homo sapien
gaaaggcacaagctgtttcagaaga

SEQ ID NO: 305301 - DNA, 25 bp, Homo sapien
gaggagggaaagtctagctcaccaa

SEQ ID NO: 305302 - DNA, 25 bp, Homo sapien
ggaaagtctagctcaccaaagaaaa

SEQ ID NO: 305303 - DNA, 25 bp, Homo sapien
ttgaagtgaaagatcctgagctgga

SEQ ID NO: 305304 - DNA, 25 bp, Homo sapien
cccagggagatgacatggtttgtga

SEQ ID NO: 305305 - DNA, 25 bp, Homo sapien
atgacatcagaaaacctggtccaaa

SEQ ID NO: 305306 - DNA, 25 bp, Homo sapien
tcagaaaacctggtccaaactgctc

SEQ ID NO: 305307 - DNA, 25 bp, Homo sapien
gcaactttccctccagaaggtgtgg

SEQ ID NO: 305308 - DNA, 25 bp, Homo sapien
gccttggtgagctggtacatgtgtc

SEQ ID NO: 305309 - DNA, 25 bp, Homo sapien
tggtgagctggtacatgtgtccaca

SEQ ID NO: 305310 - DNA, 25 bp, Homo sapien
aagagtgcgtgcagctctgcgtgca

SEQ ID NO: 305311 - DNA, 25 bp, Homo sapien
gctctgcgtgcatgtggctgaagat

SEQ ID NO: 305312 - DNA, 25 bp, Homo sapien
gctgaagatgatggccagcttggcc

SEQ ID NO: 305313 - DNA, 25 bp, Homo sapien
cagcttggccagctgtcgcctgagt

SEQ ID NO: 305314 - DNA, 25 bp, Homo sapien
agctgtcgcctgagtctggagcccg

SEQ ID NO: 305315 - DNA, 25 bp, Homo sapien
cccggaagagctcgtcgttggcact

SEQ ID NO: 305316 - DNA, 25 bp, Homo sapien
cttggcctccagattggccaggtag

SEQ ID NO: 305317 - DNA, 25 bp, Homo sapien
tccagattggccaggtagatgagta

SEQ ID NO: 305318 - DNA, 25 bp, Homo sapien
aaatattattgaaaccgcccacagt

SEQ ID NO: 305319 - DNA, 25 bp, Homo sapien
aaccgcccacagtttcaaatctggt

SEQ ID NO: 305320 - DNA, 25 bp, Homo sapien
cacagtttcaaatctggtgggtgaa

SEQ ID NO: 305321 - DNA, 25 bp, Homo sapien
ggtgggtgaagtgcatcataagtat

SEQ ID NO: 305322 - DNA, 25 bp, Homo sapien
taagtatgctgttcccacttggcag

SEQ ID NO: 305323 - DNA, 25 bp, Homo sapien
cacttggcagtgttgctatccctgg

SEQ ID NO: 305324 - DNA, 25 bp, Homo sapien
tggcagtgttgctatccctggtcca

SEQ ID NO: 305325 - DNA, 25 bp, Homo sapien
tgggaagcagaagggcctgaaccat

SEQ ID NO: 305326 - DNA, 25 bp, Homo sapien
gaagggcctgaaccatatgatgcaa

SEQ ID NO: 305327 - DNA, 25 bp, Homo sapien
gcagatgtgagatacttggatataa

SEQ ID NO: 305328 - DNA, 25 bp, Homo sapien
gatttaaaaatgatgtctctacttt

SEQ ID NO: 305329 - DNA, 25 bp, Homo sapien
cagactctgtctcttcatatttcaa

SEQ ID NO: 305330 - DNA, 25 bp, Homo sapien
gggacaaattgttgcagccaccttt

SEQ ID NO: 305331 - DNA, 25 bp, Homo sapien
agccacctttggaaacaatctactg

SEQ ID NO: 305332 - DNA, 25 bp, Homo sapien
tgcaatacactacagcagtggacat

SEQ ID NO: 305333 - DNA, 25 bp, Homo sapien
ttaccaggtgccagacgccgtacta

SEQ ID NO: 305334 - DNA, 25 bp, Homo sapien
cagacgccgtactaacagctttata

SEQ ID NO: 305335 - DNA, 25 bp, Homo sapien
aacagctttatacggatgaactcat

SEQ ID NO: 305336 - DNA, 25 bp, Homo sapien
atttaatcctcccaaactccatgag

SEQ ID NO: 305337 - DNA, 25 bp, Homo sapien
agaagtcccagaacgtcacttcttc

SEQ ID NO: 305338 - DNA, 25 bp, Homo sapien
gtcacttcttccacaagtcataggg

SEQ ID NO: 305339 - DNA, 25 bp, Homo sapien
agtcatagggccagccaagattcaa

SEQ ID NO: 305340 - DNA, 25 bp, Homo sapien
cttcttatccatctgagcgcaaaag

SEQ ID NO: 305341 - DNA, 25 bp, Homo sapien
aaacttcagactggcattgattgaa

SEQ ID NO: 305342 - DNA, 25 bp, Homo sapien
gggcagcaacatcttcgaggtcgtc

SEQ ID NO: 305343 - DNA, 25 bp, Homo sapien
gaggtcgtccttgctccgatgatgt

SEQ ID NO: 305344 - DNA, 25 bp, Homo sapien
gatgatgtcacacctcttcgtctgt

SEQ ID NO: 305345 - DNA, 25 bp, Homo sapien
acctcttcgtctgtctggaagacat

SEQ ID NO: 305346 - DNA, 25 bp, Homo sapien
aagagcataccagcaacgtccggga

SEQ ID NO: 305347 - DNA, 25 bp, Homo sapien
gcaacgtccgggaaacagaatccaa

SEQ ID NO: 305348 - DNA, 25 bp, Homo sapien
tttcaccatcttctacacattacag

SEQ ID NO: 305349 - DNA, 25 bp, Homo sapien
ctacacattacagtgctgaactcct

SEQ ID NO: 305350 - DNA, 25 bp, Homo sapien
tcctacatcctgttcaagaaggata

SEQ ID NO: 305351 - DNA, 25 bp, Homo sapien
taggcgctcagctcccttgagaatg

SEQ ID NO: 305352 - DNA, 25 bp, Homo sapien
gctcccttgagaatgtatagccaca

SEQ ID NO: 305353 - DNA, 25 bp, Homo sapien
tatagccacaggtttactccctcgg

SEQ ID NO: 305354 - DNA, 25 bp, Homo sapien
gagattgaaaattgcactccttgca

SEQ ID NO: 305355 - DNA, 25 bp, Homo sapien
ttgcactccttgcattgtccaagaa

SEQ ID NO: 305356 - DNA, 25 bp, Homo sapien
gctgggaccactgaagggctacatc

SEQ ID NO: 305357 - DNA, 25 bp, Homo sapien
agtgttcccaggtccgctctggagg

SEQ ID NO: 305358 - DNA, 25 bp, Homo sapien
gctctggagggacacagctgcaact

SEQ ID NO: 305359 - DNA, 25 bp, Homo sapien
ggagggacacagctgcaactcagac

SEQ ID NO: 305360 - DNA, 25 bp, Homo sapien
ctgaagggctacatcctcaatggat

SEQ ID NO: 305361 - DNA, 25 bp, Homo sapien
ataggatccccacttgagctcacca

SEQ ID NO: 305362 - DNA, 25 bp, Homo sapien
agagtgtatgactttttatcctttt

SEQ ID NO: 305363 - DNA, 25 bp, Homo sapien
tgaaaattatttctatcgcaagaat

SEQ ID NO: 305364 - DNA, 25 bp, Homo sapien
tttctatcgcaagaatattaagtgg

SEQ ID NO: 305365 - DNA, 25 bp, Homo sapien
ttcctttgtttgaataatatacaga

SEQ ID NO: 305366 - DNA, 25 bp, Homo sapien
gtgtactactaaaacagacaattgg

SEQ ID NO: 305367 - DNA, 25 bp, Homo sapien
taatagtcttgtgctttttggaaga

SEQ ID NO: 305368 - DNA, 25 bp, Homo sapien
tcttgtgctttttggaagacttatt

SEQ ID NO: 305369 - DNA, 25 bp, Homo sapien
gctttttggaagacttattggtgga

SEQ ID NO: 305370 - DNA, 25 bp, Homo sapien
gacttattggtggagaagtgacaat

SEQ ID NO: 305371 - DNA, 25 bp, Homo sapien
gtgatatttcacagttgttcttgag

SEQ ID NO: 305372 - DNA, 25 bp, Homo sapien
gttcttgagaaggatttttataaat

SEQ ID NO: 305373 - DNA, 25 bp, Homo sapien
tccatcttggtagctgtcacttcaa

SEQ ID NO: 305374 - DNA, 25 bp, Homo sapien
cagtttccctgagtaatcatcacct

SEQ ID NO: 305375 - DNA, 25 bp, Homo sapien
aatcatcacctacatggccattaga

SEQ ID NO: 305376 - DNA, 25 bp, Homo sapien
tggccattagagtatctatcggtga

SEQ ID NO: 305377 - DNA, 25 bp, Homo sapien
atcggtgataattccatgatacaga

SEQ ID NO: 305378 - DNA, 25 bp, Homo sapien
tataaattcagtatcccaggaccta

SEQ ID NO: 305379 - DNA, 25 bp, Homo sapien
atcccaggacctaaacctttatgct

SEQ ID NO: 305380 - DNA, 25 bp, Homo sapien
aacctttatgctacattttcgaaga

SEQ ID NO: 305381 - DNA, 25 bp, Homo sapien
tctaaacataggttctgcatatctg

SEQ ID NO: 305382 - DNA, 25 bp, Homo sapien
aatgactggtgttttgtcttcacat

SEQ ID NO: 305383 - DNA, 25 bp, Homo sapien
cttcacatttttgtctaagcaagga

SEQ ID NO: 305384 - DNA, 25 bp, Homo sapien
ctgctgggccgggaggatgcttctg

SEQ ID NO: 305385 - DNA, 25 bp, Homo sapien
tccatgctcagaactgcttcctact

SEQ ID NO: 305386 - DNA, 25 bp, Homo sapien
tcagaactgcttcctactctacatc

SEQ ID NO: 305387 - DNA, 25 bp, Homo sapien
agcagctccagggtaaatccatctc

SEQ ID NO: 305388 - DNA, 25 bp, Homo sapien
agggtaaatccatctccgcccagag

SEQ ID NO: 305389 - DNA, 25 bp, Homo sapien
gatctgccccagtgacaataacaag

SEQ ID NO: 305390 - DNA, 25 bp, Homo sapien
agataaatgccttccattctcttcg

SEQ ID NO: 305391 - DNA, 25 bp, Homo sapien
atgccttccattctcttcgtactta

SEQ ID NO: 305392 - DNA, 25 bp, Homo sapien
aatccacatatttacacagtgtttc

SEQ ID NO: 305393 - DNA, 25 bp, Homo sapien
tacacagtgtttcatttgcggtaat

SEQ ID NO: 305394 - DNA, 25 bp, Homo sapien
atttgcggtaatgtttgtatagttt

SEQ ID NO: 305395 - DNA, 25 bp, Homo sapien
tcttaactcctacattctgaattct

SEQ ID NO: 305396 - DNA, 25 bp, Homo sapien
acattctgaattctagcccctcctt

SEQ ID NO: 305397 - DNA, 25 bp, Homo sapien
gttcttatctccaaacctgcaaatg

SEQ ID NO: 305398 - DNA, 25 bp, Homo sapien
tgaaattctattggttttccttctt

SEQ ID NO: 305399 - DNA, 25 bp, Homo sapien
gttttcaaactctgtctatgtacct

SEQ ID NO: 305400 - DNA, 25 bp, Homo sapien
gtctatgtaccttttgccaacttta

SEQ ID NO: 305401 - DNA, 25 bp, Homo sapien
gtatgtcactcacattgtaacttga

SEQ ID NO: 305402 - DNA, 25 bp, Homo sapien
tattgtaacgatgcctcctagagag

SEQ ID NO: 305403 - DNA, 25 bp, Homo sapien
gagagacatgcaggccagaatcatc

SEQ ID NO: 305404 - DNA, 25 bp, Homo sapien
gaatctatacctatattttcactag

SEQ ID NO: 305405 - DNA, 25 bp, Homo sapien
tttcctgtattttcacttctccaat

SEQ ID NO: 305406 - DNA, 25 bp, Homo sapien
tactcagttaatactagttttcaga

SEQ ID NO: 305407 - DNA, 25 bp, Homo sapien
gttttcagaacattagtccaaggct

SEQ ID NO: 305408 - DNA, 25 bp, Homo sapien
gtccaaggctatttcaagttttcca

SEQ ID NO: 305409 - DNA, 25 bp, Homo sapien
gtattttgtcatatgccttagcaga

SEQ ID NO: 305410 - DNA, 25 bp, Homo sapien
gccttagcagagtaagtcatttttc

SEQ ID NO: 305411 - DNA, 25 bp, Homo sapien
taggaataagctttttcgaactgaa

SEQ ID NO: 305412 - DNA, 25 bp, Homo sapien
ttctatctaatgttaatccattgct

SEQ ID NO: 305413 - DNA, 25 bp, Homo sapien
gttaatccattgcttatttgtattc

SEQ ID NO: 305414 - DNA, 25 bp, Homo sapien
gcttatttgtattcaattccattgt

SEQ ID NO: 305415 - DNA, 25 bp, Homo sapien
aattccattgtctacagtttgctta

SEQ ID NO: 305416 - DNA, 25 bp, Homo sapien
ctacagtttgcttaaatgttgacta

SEQ ID NO: 305417 - DNA, 25 bp, Homo sapien
tattctgccaactacttattgttat

SEQ ID NO: 305418 - DNA, 25 bp, Homo sapien
cttattgttatcagagaccccatcc

SEQ ID NO: 305419 - DNA, 25 bp, Homo sapien
tatcagagaccccatcctttagtat

SEQ ID NO: 305420 - DNA, 25 bp, Homo sapien
aattctgagagtgttcgttttgtct

SEQ ID NO: 305421 - DNA, 25 bp, Homo sapien
agagtgttcgttttgtctgtgttct

SEQ ID NO: 305422 - DNA, 25 bp, Homo sapien
tctgtgttctgtagcacccatttgt

SEQ ID NO: 305423 - DNA, 25 bp, Homo sapien
tagcacccatttgttccctgtttta

SEQ ID NO: 305424 - DNA, 25 bp, Homo sapien
tattacactgctttgtaattacttg

SEQ ID NO: 305425 - DNA, 25 bp, Homo sapien
ggcatgaatgggttaagacactatt

SEQ ID NO: 305426 - DNA, 25 bp, Homo sapien
atcttttacttctctgccttattct

SEQ ID NO: 305427 - DNA, 25 bp, Homo sapien
ttacttctctgccttattctgccaa

SEQ ID NO: 305428 - DNA, 25 bp, Homo sapien
attactggatacatacagctatgaa

SEQ ID NO: 305429 - DNA, 25 bp, Homo sapien
atcaagattgtccatctctacctct

SEQ ID NO: 305430 - DNA, 25 bp, Homo sapien
tacctctgtgccaaactctagactt

SEQ ID NO: 305431 - DNA, 25 bp, Homo sapien
gtgccaaactctagactttcattaa

SEQ ID NO: 305432 - DNA, 25 bp, Homo sapien
gaatgtatcaatattatttcagtca

SEQ ID NO: 305433 - DNA, 25 bp, Homo sapien
atttcagtcattgtaacatttacca

SEQ ID NO: 305434 - DNA, 25 bp, Homo sapien
gtaacatttaccacactcatgtaag

SEQ ID NO: 305435 - DNA, 25 bp, Homo sapien
caacaagaaatgaagccagcatcta

SEQ ID NO: 305436 - DNA, 25 bp, Homo sapien
gaagccagcatctaatggagaagta

SEQ ID NO: 305437 - DNA, 25 bp, Homo sapien
ggagaagtaatgtcgcctacactaa

SEQ ID NO: 305438 - DNA, 25 bp, Homo sapien
tgataaaactgttgccctcctacca

SEQ ID NO: 305439 - DNA, 25 bp, Homo sapien
taatttgtgctacagtttttcctaa

SEQ ID NO: 305440 - DNA, 25 bp, Homo sapien
ttgaaattttacacactgaaagctc

SEQ ID NO: 305441 - DNA, 25 bp, Homo sapien
ttttgttgtctttatgatgcatgcg

SEQ ID NO: 305442 - DNA, 25 bp, Homo sapien
tgatgcatgcgaacataaatgtctg

SEQ ID NO: 305443 - DNA, 25 bp, Homo sapien
ttcattcttgttggcttttgttacc

SEQ ID NO: 305444 - DNA, 25 bp, Homo sapien
tgttggcttttgttacccacaatta

SEQ ID NO: 305445 - DNA, 25 bp, Homo sapien
gttacccacaattacatactattct

SEQ ID NO: 305446 - DNA, 25 bp, Homo sapien
tacatactattcttactaatctgag

SEQ ID NO: 305447 - DNA, 25 bp, Homo sapien
gttttcaatgtttcactactctcta

SEQ ID NO: 305448 - DNA, 25 bp, Homo sapien
tttcactactctctactctgttaat

SEQ ID NO: 305449 - DNA, 25 bp, Homo sapien
ctctctactctgttaatttgtgcta

SEQ ID NO: 305450 - DNA, 25 bp, Homo sapien
tttgagcaaggtccgcaagcagtat

SEQ ID NO: 305451 - DNA, 25 bp, Homo sapien
aaggtccgcaagcagtattcctgca

SEQ ID NO: 305452 - DNA, 25 bp, Homo sapien
gcaagcagtattcctgcacttctcc

SEQ ID NO: 305453 - DNA, 25 bp, Homo sapien
atgccccagcgccaggtcggaagct

SEQ ID NO: 305454 - DNA, 25 bp, Homo sapien
cgccaggtcggaagctgtccacatg

SEQ ID NO: 305455 - DNA, 25 bp, Homo sapien
cccacaaggacagggccctgaatat

SEQ ID NO: 305456 - DNA, 25 bp, Homo sapien
aaggacagggccctgaatatggact

SEQ ID NO: 305457 - DNA, 25 bp, Homo sapien
ttgggaaggcaactgcactcacccc

SEQ ID NO: 305458 - DNA, 25 bp, Homo sapien
tcctgtggtacctgcccttcacggt

SEQ ID NO: 305459 - DNA, 25 bp, Homo sapien
caatgtgaagtagtcctgggaagtt

SEQ ID NO: 305460 - DNA, 25 bp, Homo sapien
agttgtactttgagcaaggtccgca

SEQ ID NO: 305461 - DNA, 25 bp, Homo sapien
ggaactttgatgttaagatgcactg

SEQ ID NO: 305462 - DNA, 25 bp, Homo sapien
gatgcactgatacaaaacttaaatt

SEQ ID NO: 305463 - DNA, 25 bp, Homo sapien
ttttggtctcctacattaaaacaat

SEQ ID NO: 305464 - DNA, 25 bp, Homo sapien
ctgcaatgtttccttaacagccatt

SEQ ID NO: 305465 - DNA, 25 bp, Homo sapien
gtttccttaacagccattctgaatt

SEQ ID NO: 305466 - DNA, 25 bp, Homo sapien
ttacaaactaattcctatttctgcc

SEQ ID NO: 305467 - DNA, 25 bp, Homo sapien
atttctgccacattccttcctgaga

SEQ ID NO: 305468 - DNA, 25 bp, Homo sapien
attccttcctgagaactgtctagtc

SEQ ID NO: 305469 - DNA, 25 bp, Homo sapien
gaactgtctagtcctggtttgggat

SEQ ID NO: 305470 - DNA, 25 bp, Homo sapien
tagtcctggtttgggatttatctta

SEQ ID NO: 305471 - DNA, 25 bp, Homo sapien
tgggatttatcttaaaggtctagaa

SEQ ID NO: 305472 - DNA, 25 bp, Homo sapien
aaatacactctaacatttgtggatt

SEQ ID NO: 305473 - DNA, 25 bp, Homo sapien
aagccatggatgagtgttcagtatc

SEQ ID NO: 305474 - DNA, 25 bp, Homo sapien
gttcagtatctgtttgtcaagtaga

SEQ ID NO: 305475 - DNA, 25 bp, Homo sapien
agtagatttctaaggcatgtgctga

SEQ ID NO: 305476 - DNA, 25 bp, Homo sapien
gatgagaatgtcagtcacttggaag

SEQ ID NO: 305477 - DNA, 25 bp, Homo sapien
gggtggccatatagttctctaagct

SEQ ID NO: 305478 - DNA, 25 bp, Homo sapien
gaagtttgacgaccttatttattag

SEQ ID NO: 305479 - DNA, 25 bp, Homo sapien
tatttattaggctggtgtctcgaac

SEQ ID NO: 305480 - DNA, 25 bp, Homo sapien
tttccctcttcattgatcatgtaga

SEQ ID NO: 305481 - DNA, 25 bp, Homo sapien
acaaattccttccatctaccctagt

SEQ ID NO: 305482 - DNA, 25 bp, Homo sapien
atctaccctagtctgctagtttcag

SEQ ID NO: 305483 - DNA, 25 bp, Homo sapien
tacctaagacttactgctttaaaag

SEQ ID NO: 305484 - DNA, 25 bp, Homo sapien
ctgctttaaaagtcagtgccaagtg

SEQ ID NO: 305485 - DNA, 25 bp, Homo sapien
aagtcagtgccaagtgagtggaaaa

SEQ ID NO: 305486 - DNA, 25 bp, Homo sapien
aattcattctgtaggttgttctgcc

SEQ ID NO: 305487 - DNA, 25 bp, Homo sapien
attctgtaggttgttctgcctcaaa

SEQ ID NO: 305488 - DNA, 25 bp, Homo sapien
gttgttctgcctcaaaggtggcctg

SEQ ID NO: 305489 - DNA, 25 bp, Homo sapien
gggtacccatgtcaccactgtcatt

SEQ ID NO: 305490 - DNA, 25 bp, Homo sapien
gcgacgtcgtaaaccaggacgacct

SEQ ID NO: 305491 - DNA, 25 bp, Homo sapien
caggacgacctgtaccaggccttgg

SEQ ID NO: 305492 - DNA, 25 bp, Homo sapien
tggatgtgacgagcccagaaccact

SEQ ID NO: 305493 - DNA, 25 bp, Homo sapien
aagaactgtgtgattctgccccaca

SEQ ID NO: 305494 - DNA, 25 bp, Homo sapien
aaagctttcttctggtcatttggca

SEQ ID NO: 305495 - DNA, 25 bp, Homo sapien
gtcatttggcaactgaatcctaggc

SEQ ID NO: 305496 - DNA, 25 bp, Homo sapien
atcctaggccatgagtgtatgtcaa

SEQ ID NO: 305497 - DNA, 25 bp, Homo sapien
ggagcacagacccatcgtttcatat

SEQ ID NO: 305498 - DNA, 25 bp, Homo sapien
cgtttcatatgcctgctcaatgtga

SEQ ID NO: 305499 - DNA, 25 bp, Homo sapien
agttggagtcaataggagctttaga

SEQ ID NO: 305500 - DNA, 25 bp, Homo sapien
ggagctttagagacctgtgtcccag

SEQ ID NO: 305501 - DNA, 25 bp, Homo sapien
tagagacctgtgtcccagagaatca

SEQ ID NO: 305502 - DNA, 25 bp, Homo sapien
gagacacatgagacagttacccctg

SEQ ID NO: 305503 - DNA, 25 bp, Homo sapien
atgagacagttacccctgcacggat

SEQ ID NO: 305504 - DNA, 25 bp, Homo sapien
cccctgcacggatggttgtaaagaa

SEQ ID NO: 305505 - DNA, 25 bp, Homo sapien
gctcagattgcctaagtcttggaga

SEQ ID NO: 305506 - DNA, 25 bp, Homo sapien
gtcttggagagaccactggagaaaa

SEQ ID NO: 305507 - DNA, 25 bp, Homo sapien
atgcacatgcatcttataactgaca

SEQ ID NO: 305508 - DNA, 25 bp, Homo sapien
gacaacagagtacttcaactcccac

SEQ ID NO: 305509 - DNA, 25 bp, Homo sapien
ccaccatagcccagaatattgtttt

SEQ ID NO: 305510 - DNA, 25 bp, Homo sapien
aatattattttcttggtcgttgaag

SEQ ID NO: 305511 - DNA, 25 bp, Homo sapien
aagaggatgcagctacctttgcgtc

SEQ ID NO: 305512 - DNA, 25 bp, Homo sapien
gcagctacctttgcgtctcaacagt

SEQ ID NO: 305513 - DNA, 25 bp, Homo sapien
ttgaatggcacagatgaattctctt

SEQ ID NO: 305514 - DNA, 25 bp, Homo sapien
aattctcttcaattctctgacatta

SEQ ID NO: 305515 - DNA, 25 bp, Homo sapien
gaagactggagctcagattgcctaa

SEQ ID NO: 305516 - DNA, 25 bp, Homo sapien
tgcctgggcctgaggaatgctcctg

SEQ ID NO: 305517 - DNA, 25 bp, Homo sapien
aggaatgctcctgacttagcttggg

SEQ ID NO: 305518 - DNA, 25 bp, Homo sapien
aaatgggctgtagggtccatgcgcc

SEQ ID NO: 305519 - DNA, 25 bp, Homo sapien
caggaagtattcctgggacagcctg

SEQ ID NO: 305520 - DNA, 25 bp, Homo sapien
gaccagttagggtggatgcagacat

SEQ ID NO: 305521 - DNA, 25 bp, Homo sapien
atgattctgcccttgcaaggctgag

SEQ ID NO: 305522 - DNA, 25 bp, Homo sapien
ttctgcccttgcaaggctgagggag

SEQ ID NO: 305523 - DNA, 25 bp, Homo sapien
aggtagatactcattcaacaaacat

SEQ ID NO: 305524 - DNA, 25 bp, Homo sapien
ctgtttctagctccttgttctttaa

SEQ ID NO: 305525 - DNA, 25 bp, Homo sapien
tctagctccttgttctttaaaccaa

SEQ ID NO: 305526 - DNA, 25 bp, Homo sapien
gagaaacagctgttttgaaccaccc

SEQ ID NO: 305527 - DNA, 25 bp, Homo sapien
gtcctcatggcccacggcagcgccc

SEQ ID NO: 305528 - DNA, 25 bp, Homo sapien
ctgccttgcgacagctaccgcgagg

SEQ ID NO: 305529 - DNA, 25 bp, Homo sapien
tgccttgcgacagctaccgcgaggg

SEQ ID NO: 305530 - DNA, 25 bp, Homo sapien
cttgcgacagctaccgcgagggcta

SEQ ID NO: 305531 - DNA, 25 bp, Homo sapien
ctacagcgcctgtgtggcgcgcctg

SEQ ID NO: 305532 - DNA, 25 bp, Homo sapien
tgccgtgtcctggagcccgccgtga

SEQ ID NO: 305533 - DNA, 25 bp, Homo sapien
agcccgccgtgagcgcgcgcctgct

SEQ ID NO: 305534 - DNA, 25 bp, Homo sapien
tgctggagcacctgtggcggagagc

SEQ ID NO: 305535 - DNA, 25 bp, Homo sapien
tggagcacctgtggcggagagcggc

SEQ ID NO: 305536 - DNA, 25 bp, Homo sapien
agagcggccagcgccaccctggacg

SEQ ID NO: 305537 - DNA, 25 bp, Homo sapien
gctggggattccagtggcccgtctg

SEQ ID NO: 305538 - DNA, 25 bp, Homo sapien
ataactgatccgttgggtgtatacc

SEQ ID NO: 305539 - DNA, 25 bp, Homo sapien
atccgttgggtgtataccatgtgcc

SEQ ID NO: 305540 - DNA, 25 bp, Homo sapien
gttgggtgtataccatgtgccaagc

SEQ ID NO: 305541 - DNA, 25 bp, Homo sapien
gtgccaagcaattttcatatactca

SEQ ID NO: 305542 - DNA, 25 bp, Homo sapien
gcaattttcatatactcatttaaca

SEQ ID NO: 305543 - DNA, 25 bp, Homo sapien
ggcagatattattaacctcagtcta

SEQ ID NO: 305544 - DNA, 25 bp, Homo sapien
tattattaacctcagtctatagatg

SEQ ID NO: 305545 - DNA, 25 bp, Homo sapien
gactaaagctcagagggattgctaa

SEQ ID NO: 305546 - DNA, 25 bp, Homo sapien
gctcagagggattgctaaaaactag

SEQ ID NO: 305547 - DNA, 25 bp, Homo sapien
gtagactcaaactgcaaagctaatg

SEQ ID NO: 305548 - DNA, 25 bp, Homo sapien
aagctaatgatatgctatctgcaaa

SEQ ID NO: 305549 - DNA, 25 bp, Homo sapien
cacctgtgtgctccccgtaggtaag

SEQ ID NO: 305550 - DNA, 25 bp, Homo sapien
gtgtgctccccgtaggtaagggcca

SEQ ID NO: 305551 - DNA, 25 bp, Homo sapien
gtaggtaagggccacttctgactgt

SEQ ID NO: 305552 - DNA, 25 bp, Homo sapien
aagggccacttctgactgtgtgtcc

SEQ ID NO: 305553 - DNA, 25 bp, Homo sapien
gaggactttactgaaccgtactgtg

SEQ ID NO: 305554 - DNA, 25 bp, Homo sapien
gaaccgtactgtgaatatgtccaag

SEQ ID NO: 305555 - DNA, 25 bp, Homo sapien
gaatatgtccaagtcccaaagccag

SEQ ID NO: 305556 - DNA, 25 bp, Homo sapien
atgtccaagtcccaaagccaggtga

SEQ ID NO: 305557 - DNA, 25 bp, Homo sapien
aagtcccaaagccaggtgaggtcag

SEQ ID NO: 305558 - DNA, 25 bp, Homo sapien
aaagccaggtgaggtcagaccccac

SEQ ID NO: 305559 - DNA, 25 bp, Homo sapien
tcagaccccactgcctgaggaagag

SEQ ID NO: 305560 - DNA, 25 bp, Homo sapien
tatccctgtcctctacccagagagt

SEQ ID NO: 305561 - DNA, 25 bp, Homo sapien
tgtcctctacccagagagtgcttcc

SEQ ID NO: 305562 - DNA, 25 bp, Homo sapien
ctacccagagagtgcttcctgcctg

SEQ ID NO: 305563 - DNA, 25 bp, Homo sapien
tgcctgctcaggctcaggtaatttc

SEQ ID NO: 305564 - DNA, 25 bp, Homo sapien
ctgctcaggctcaggtaatttcccc

SEQ ID NO: 305565 - DNA, 25 bp, Homo sapien
taatttccccctctaggcatggcag

SEQ ID NO: 305566 - DNA, 25 bp, Homo sapien
tgccaggtggaattcctcaggggaa

SEQ ID NO: 305567 - DNA, 25 bp, Homo sapien
tagactgaatgttccaaatcaaggg

SEQ ID NO: 305568 - DNA, 25 bp, Homo sapien
ccaaatcaagggaatggtgggcttt

SEQ ID NO: 305569 - DNA, 25 bp, Homo sapien
acttggagctgtgggatgcccctgt

SEQ ID NO: 305570 - DNA, 25 bp, Homo sapien
tgccagtgtttcctttgaccatcag

SEQ ID NO: 305571 - DNA, 25 bp, Homo sapien
aaggattctggctttccctactgca

SEQ ID NO: 305572 - DNA, 25 bp, Homo sapien
tggctttccctactgcattcatcca

SEQ ID NO: 305573 - DNA, 25 bp, Homo sapien
actacccgctccaagagagctgagt

SEQ ID NO: 305574 - DNA, 25 bp, Homo sapien
gagagctgagtaattgtcaagccag

SEQ ID NO: 305575 - DNA, 25 bp, Homo sapien
agctgagtaattgtcaagccaggtt

SEQ ID NO: 305576 - DNA, 25 bp, Homo sapien
aaagacataacagggtgcagaggct

SEQ ID NO: 305577 - DNA, 25 bp, Homo sapien
gagagttctaagcaacatgtcacga

SEQ ID NO: 305578 - DNA, 25 bp, Homo sapien
aacatgtcacgagctatgtagcctc

SEQ ID NO: 305579 - DNA, 25 bp, Homo sapien
tcacgagctatgtagcctcttcaca

SEQ ID NO: 305580 - DNA, 25 bp, Homo sapien
agctatgtagcctcttcacactgct

SEQ ID NO: 305581 - DNA, 25 bp, Homo sapien
gcctcttcacactgcttctgaaata

SEQ ID NO: 305582 - DNA, 25 bp, Homo sapien
taaaatctgggcactctaaaaatga

SEQ ID NO: 305583 - DNA, 25 bp, Homo sapien
atctgggcactctaaaaatgaaaac

SEQ ID NO: 305584 - DNA, 25 bp, Homo sapien
tccttccagacatttctttagattg

SEQ ID NO: 305585 - DNA, 25 bp, Homo sapien
tttctatttgcaatgttcactttta

SEQ ID NO: 305586 - DNA, 25 bp, Homo sapien
aatggtgctacgaagaattcttttt

SEQ ID NO: 305587 - DNA, 25 bp, Homo sapien
ggtgctacgaagaattctttttaat

SEQ ID NO: 305588 - DNA, 25 bp, Homo sapien
caaagactgtttatatgtaaggata

SEQ ID NO: 305589 - DNA, 25 bp, Homo sapien
gtgtattttttctagatgtgaacta

SEQ ID NO: 305590 - DNA, 25 bp, Homo sapien
gatgtgaactatttataattactta

SEQ ID NO: 305591 - DNA, 25 bp, Homo sapien
ataattacttatgtacaggagcttg

SEQ ID NO: 305592 - DNA, 25 bp, Homo sapien
ttagattgtcttttacttagtgctt

SEQ ID NO: 305593 - DNA, 25 bp, Homo sapien
gactgtctctgctctctaagaatag

SEQ ID NO: 305594 - DNA, 25 bp, Homo sapien
gctctctaagaataggtttccctca

SEQ ID NO: 305595 - DNA, 25 bp, Homo sapien
taggtttccctcacagatggcatct

SEQ ID NO: 305596 - DNA, 25 bp, Homo sapien
catctctctggatgctgctagagca

SEQ ID NO: 305597 - DNA, 25 bp, Homo sapien
tgctagagcatctggtgcttccaac

SEQ ID NO: 305598 - DNA, 25 bp, Homo sapien
cacactccagggaggaaggcagtgt

SEQ ID NO: 305599 - DNA, 25 bp, Homo sapien
atctgagaggagtcccatttggctc

SEQ ID NO: 305600 - DNA, 25 bp, Homo sapien
aggagtcccatttggctccttccta

SEQ ID NO: 305601 - DNA, 25 bp, Homo sapien
ccctccattctctaagacctgtaaa

SEQ ID NO: 305602 - DNA, 25 bp, Homo sapien
tgaaggtgaaaccttggccgcctgc

SEQ ID NO: 305603 - DNA, 25 bp, Homo sapien
gggttggccaactccgctaccgact

SEQ ID NO: 305604 - DNA, 25 bp, Homo sapien
gaaccaagcccttttgtgaaaggag

SEQ ID NO: 305605 - DNA, 25 bp, Homo sapien
ggagaattgaagtacatctgatctt

SEQ ID NO: 305606 - DNA, 25 bp, Homo sapien
tgataaattttttctccctacgata

SEQ ID NO: 305607 - DNA, 25 bp, Homo sapien
ttttttctccctacgatattcctga

SEQ ID NO: 305608 - DNA, 25 bp, Homo sapien
tccctacgatattcctgagattgag

SEQ ID NO: 305609 - DNA, 25 bp, Homo sapien
tccagtaactggaagattccctggg

SEQ ID NO: 305610 - DNA, 25 bp, Homo sapien
gagattctgatgtttctattttaca

SEQ ID NO: 305611 - DNA, 25 bp, Homo sapien
aaaactctgcaaagacaatgtctag

SEQ ID NO: 305612 - DNA, 25 bp, Homo sapien
aatgtctagcacttatatctccagt

SEQ ID NO: 305613 - DNA, 25 bp, Homo sapien
atatctccagtaactcctgtcaagg

SEQ ID NO: 305614 - DNA, 25 bp, Homo sapien
ctcctgtcaaggtttattgttgctt

SEQ ID NO: 305615 - DNA, 25 bp, Homo sapien
gaaccaagcccttttgtgaaaggag

SEQ ID NO: 305616 - DNA, 25 bp, Homo sapien
agcccttttgtgaaaggagttggca

SEQ ID NO: 305617 - DNA, 25 bp, Homo sapien
ggagaattgaagtacatctgatctt

SEQ ID NO: 305618 - DNA, 25 bp, Homo sapien
aattgaagtacatctgatcttagtg

SEQ ID NO: 305619 - DNA, 25 bp, Homo sapien
tgataaattttttctccctacgata

SEQ ID NO: 305620 - DNA, 25 bp, Homo sapien
ttttttctccctacgatattcctga

SEQ ID NO: 305621 - DNA, 25 bp, Homo sapien
tccctacgatattcctgagattgag

SEQ ID NO: 305622 - DNA, 25 bp, Homo sapien
tacgatattcctgagattgagattc

SEQ ID NO: 305623 - DNA, 25 bp, Homo sapien
tccagtaactggaagattccctggg

SEQ ID NO: 305624 - DNA, 25 bp, Homo sapien
gagattctgatgtttctattttaca

SEQ ID NO: 305625 - DNA, 25 bp, Homo sapien
ctattttacagataaaactctgcaa

SEQ ID NO: 305626 - DNA, 25 bp, Homo sapien
aaaactctgcaaagacaatgtctag

SEQ ID NO: 305627 - DNA, 25 bp, Homo sapien
aatgtctagcacttatatctccagt

SEQ ID NO: 305628 - DNA, 25 bp, Homo sapien
gtctagcacttatatctccagtaac

SEQ ID NO: 305629 - DNA, 25 bp, Homo sapien
agcacttatatctccagtaactcct

SEQ ID NO: 305630 - DNA, 25 bp, Homo sapien
gcacttatatctccagtaactcctg

SEQ ID NO: 305631 - DNA, 25 bp, Homo sapien
cttatatctccagtaactcctgtca

SEQ ID NO: 305632 - DNA, 25 bp, Homo sapien
atatctccagtaactcctgtcaagg

SEQ ID NO: 305633 - DNA, 25 bp, Homo sapien
atctccagtaactcctgtcaaggtt

SEQ ID NO: 305634 - DNA, 25 bp, Homo sapien
tctccagtaactcctgtcaaggttt

SEQ ID NO: 305635 - DNA, 25 bp, Homo sapien
ccagtaactcctgtcaaggtttatt

SEQ ID NO: 305636 - DNA, 25 bp, Homo sapien
gtcaaggtttattgttgcttgttca

SEQ ID NO: 305637 - DNA, 25 bp, Homo sapien
ccctttacttactcttttgctgctg

SEQ ID NO: 305638 - DNA, 25 bp, Homo sapien
tttacttactcttttgctgctggtt

SEQ ID NO: 305639 - DNA, 25 bp, Homo sapien
ttacttactcttttgctgctggtta

SEQ ID NO: 305640 - DNA, 25 bp, Homo sapien
acttactcttttgctgctggttatg

SEQ ID NO: 305641 - DNA, 25 bp, Homo sapien
ttactcttttgctgctggttatgca

SEQ ID NO: 305642 - DNA, 25 bp, Homo sapien
actcttttgctgctggttatgcatc

SEQ ID NO: 305643 - DNA, 25 bp, Homo sapien
tcttttgctgctggttatgcatctc

SEQ ID NO: 305644 - DNA, 25 bp, Homo sapien
ttttgctgctggttatgcatctcaa

SEQ ID NO: 305645 - DNA, 25 bp, Homo sapien
ttgctgctggttatgcatctcaaat

SEQ ID NO: 305646 - DNA, 25 bp, Homo sapien
gctgctggttatgcatctcaaatct

SEQ ID NO: 305647 - DNA, 25 bp, Homo sapien
atctgacttccttagccttcacctc

SEQ ID NO: 305648 - DNA, 25 bp, Homo sapien
ccatgaggtagggtctgttagtaac

SEQ ID NO: 305649 - DNA, 25 bp, Homo sapien
tagggtctgttagtaaccccagtat

SEQ ID NO: 305650 - DNA, 25 bp, Homo sapien
ggtctgttagtaaccccagtatgca

SEQ ID NO: 305651 - DNA, 25 bp, Homo sapien
gtctgttagtaaccccagtatgcag

SEQ ID NO: 305652 - DNA, 25 bp, Homo sapien
tgttagtaaccccagtatgcagatg

SEQ ID NO: 305653 - DNA, 25 bp, Homo sapien
gttagtaaccccagtatgcagatga

SEQ ID NO: 305654 - DNA, 25 bp, Homo sapien
ttagtaaccccagtatgcagatgag

SEQ ID NO: 305655 - DNA, 25 bp, Homo sapien
agtaaccccagtatgcagatgaggc

SEQ ID NO: 305656 - DNA, 25 bp, Homo sapien
taaccccagtatgcagatgaggcaa

SEQ ID NO: 305657 - DNA, 25 bp, Homo sapien
accccagtatgcagatgaggcaaat

SEQ ID NO: 305658 - DNA, 25 bp, Homo sapien
cccagtatgcagatgaggcaaatga

SEQ ID NO: 305659 - DNA, 25 bp, Homo sapien
accccactccaatgtgagtgctcga

SEQ ID NO: 305660 - DNA, 25 bp, Homo sapien
aatgtgagtgctcgatacacaagca

SEQ ID NO: 305661 - DNA, 25 bp, Homo sapien
gatacacaagcactctagctagctg

SEQ ID NO: 305662 - DNA, 25 bp, Homo sapien
aagcactctagctagctgccacgta

SEQ ID NO: 305663 - DNA, 25 bp, Homo sapien
tagctagctgccacgtacccaaggc

SEQ ID NO: 305664 - DNA, 25 bp, Homo sapien
gggacagaaccaggtcttctggtct

SEQ ID NO: 305665 - DNA, 25 bp, Homo sapien
cagaaccaggtcttctggtctgctc

SEQ ID NO: 305666 - DNA, 25 bp, Homo sapien
tgccccattcccctaacagaaagtt

SEQ ID NO: 305667 - DNA, 25 bp, Homo sapien
cattcccctaacagaaagtttgctt

SEQ ID NO: 305668 - DNA, 25 bp, Homo sapien
gaaaagtctaagaaagcctcccaca

SEQ ID NO: 305669 - DNA, 25 bp, Homo sapien
gtctaagaaagcctcccacaatact

SEQ ID NO: 305670 - DNA, 25 bp, Homo sapien
ttacatatccatccatcactctatc

SEQ ID NO: 305671 - DNA, 25 bp, Homo sapien
tatccatccatcaattcgccttgtt

SEQ ID NO: 305672 - DNA, 25 bp, Homo sapien
tcaattcgccttgtttccaagtgaa

SEQ ID NO: 305673 - DNA, 25 bp, Homo sapien
aaaggccttctgcattcgcctggat

SEQ ID NO: 305674 - DNA, 25 bp, Homo sapien
cattcgcctggattaagttctggga

SEQ ID NO: 305675 - DNA, 25 bp, Homo sapien
gttctgggagtagaggtgctattct

SEQ ID NO: 305676 - DNA, 25 bp, Homo sapien
gtgctattctacctcggtgatgcga

SEQ ID NO: 305677 - DNA, 25 bp, Homo sapien
agaaaagccgcagcactgagcctga

SEQ ID NO: 305678 - DNA, 25 bp, Homo sapien
actgagcctgattgatgtgctttgc

SEQ ID NO: 305679 - DNA, 25 bp, Homo sapien
attctacagtaaactctcctacacc

SEQ ID NO: 305680 - DNA, 25 bp, Homo sapien
ggatcctgtcattgaactatattat

SEQ ID NO: 305681 - DNA, 25 bp, Homo sapien
caatgccgctcagggtgcagtgagc

SEQ ID NO: 305682 - DNA, 25 bp, Homo sapien
ggtgcagtgagctcccctgggaaaa

SEQ ID NO: 305683 - DNA, 25 bp, Homo sapien
gtgcagtgagctcccctgggaaaac

SEQ ID NO: 305684 - DNA, 25 bp, Homo sapien
gtgagctcccctgggaaaaccgaag

SEQ ID NO: 305685 - DNA, 25 bp, Homo sapien
gctcccctgggaaaaccgaagccag

SEQ ID NO: 305686 - DNA, 25 bp, Homo sapien
tgggaaaaccgaagccagcaagacc

SEQ ID NO: 305687 - DNA, 25 bp, Homo sapien
caggagagggccacctcactgggcc

SEQ ID NO: 305688 - DNA, 25 bp, Homo sapien
tgacctcagctcctagaccctggac

SEQ ID NO: 305689 - DNA, 25 bp, Homo sapien
tggacccttggctgggactcagcat

SEQ ID NO: 305690 - DNA, 25 bp, Homo sapien
ggacccttggctgggactcagcatt

SEQ ID NO: 305691 - DNA, 25 bp, Homo sapien
aggtgaagctgccaggtgtgcacag

SEQ ID NO: 305692 - DNA, 25 bp, Homo sapien
agagataacgataacaacttttgaa

SEQ ID NO: 305693 - DNA, 25 bp, Homo sapien
gatgggttcatgtggtctgttctac

SEQ ID NO: 305694 - DNA, 25 bp, Homo sapien
ggttcatgtggtctgttctactatt

SEQ ID NO: 305695 - DNA, 25 bp, Homo sapien
ggtctgttctactattgtatctata

SEQ ID NO: 305696 - DNA, 25 bp, Homo sapien
caaaaaactcccaatcttacaatat

SEQ ID NO: 305697 - DNA, 25 bp, Homo sapien
cttacaatatttatcagacctacag

SEQ ID NO: 305698 - DNA, 25 bp, Homo sapien
atcagacctacagtgtattattttc

SEQ ID NO: 305699 - DNA, 25 bp, Homo sapien
gtgtattattttctaagttgtttct

SEQ ID NO: 305700 - DNA, 25 bp, Homo sapien
ttgtttccatttctgatgacttaat

SEQ ID NO: 305701 - DNA, 25 bp, Homo sapien
tttctttcaaagtcatccagtggtg

SEQ ID NO: 305702 - DNA, 25 bp, Homo sapien
caaagtcatccagtggtggaggaaa

SEQ ID NO: 305703 - DNA, 25 bp, Homo sapien
ggctgtttgccttcagaagctggac

SEQ ID NO: 305704 - DNA, 25 bp, Homo sapien
ttgccttcagaagctggactggaaa

SEQ ID NO: 305705 - DNA, 25 bp, Homo sapien
tagagcctgggaatctgcgctttca

SEQ ID NO: 305706 - DNA, 25 bp, Homo sapien
tgggaatctgcgctttcaccagctt

SEQ ID NO: 305707 - DNA, 25 bp, Homo sapien
cttcccaggtgattcaaacgcagtg

SEQ ID NO: 305708 - DNA, 25 bp, Homo sapien
caggtgattcaaacgcagtggctca

SEQ ID NO: 305709 - DNA, 25 bp, Homo sapien
gattcaaacgcagtggctcacggac

SEQ ID NO: 305710 - DNA, 25 bp, Homo sapien
gtggctcacggaccccactttgaga

SEQ ID NO: 305711 - DNA, 25 bp, Homo sapien
ggaccccactttgagaaacgcagac

SEQ ID NO: 305712 - DNA, 25 bp, Homo sapien
cactttgagaaacgcagactgggct

SEQ ID NO: 305713 - DNA, 25 bp, Homo sapien
cagactgggctgtttgccttcagaa

SEQ ID NO: 305714 - DNA, 25 bp, Homo sapien
atgatcaagctatcctttactccag

SEQ ID NO: 305715 - DNA, 25 bp, Homo sapien
gctgaaaacttacttacctgatact

SEQ ID NO: 305716 - DNA, 25 bp, Homo sapien
tgatacttcatcaggtctgctcaca

SEQ ID NO: 305717 - DNA, 25 bp, Homo sapien
tcaggtctgctcacaggtgtatcaa

SEQ ID NO: 305718 - DNA, 25 bp, Homo sapien
gacggtacctttggtgaaaccattg

SEQ ID NO: 305719 - DNA, 25 bp, Homo sapien
gtttagctggttttcacttcatcca

SEQ ID NO: 305720 - DNA, 25 bp, Homo sapien
ttcatccagttaccagccaatcaaa

SEQ ID NO: 305721 - DNA, 25 bp, Homo sapien
gtttttccaccgatcatattttcat

SEQ ID NO: 305722 - DNA, 25 bp, Homo sapien
atcaacatctatggcttttccctaa

SEQ ID NO: 305723 - DNA, 25 bp, Homo sapien
taaaccctgatcttagggccatcca

SEQ ID NO: 305724 - DNA, 25 bp, Homo sapien
agggccatccatttgtattttgaaa

SEQ ID NO: 305725 - DNA, 25 bp, Homo sapien
tgatggccgacgtggcaaacacctg

SEQ ID NO: 305726 - DNA, 25 bp, Homo sapien
cgtggcaaacacctgccccttggag

SEQ ID NO: 305727 - DNA, 25 bp, Homo sapien
ttggagcccacgcagaggaccacca

SEQ ID NO: 305728 - DNA, 25 bp, Homo sapien
acgcagaggaccaccatggaggcca

SEQ ID NO: 305729 - DNA, 25 bp, Homo sapien
agaggaccaccatggaggccacgac

SEQ ID NO: 305730 - DNA, 25 bp, Homo sapien
atggaggccacgaccacgatgaggt

SEQ ID NO: 305731 - DNA, 25 bp, Homo sapien
atgggcttccgggcaaagcgcagcc

SEQ ID NO: 305732 - DNA, 25 bp, Homo sapien
agaggcccacgtacttgctgcggca

SEQ ID NO: 305733 - DNA, 25 bp, Homo sapien
aggcccacgtacttgctgcggcagc

SEQ ID NO: 305734 - DNA, 25 bp, Homo sapien
accagaggcggaccacgtactccgt

SEQ ID NO: 305735 - DNA, 25 bp, Homo sapien
gaagaacaccaccagcacgatctcc

SEQ ID NO: 305736 - DNA, 25 bp, Homo sapien
tgtgactgggaagcttgaccggcca

SEQ ID NO: 305737 - DNA, 25 bp, Homo sapien
gcttgaccggccagtccgcgttggc

SEQ ID NO: 305738 - DNA, 25 bp, Homo sapien
gtccgcgttggcctgatggttccaa

SEQ ID NO: 305739 - DNA, 25 bp, Homo sapien
gatggttccaactgcaggaggctgc

SEQ ID NO: 305740 - DNA, 25 bp, Homo sapien
actgctgagctaattccagaattta

SEQ ID NO: 305741 - DNA, 25 bp, Homo sapien
gagatggttactggaactcttcatt

SEQ ID NO: 305742 - DNA, 25 bp, Homo sapien
actcttcattcccttcattgggaga

SEQ ID NO: 305743 - DNA, 25 bp, Homo sapien
cccttcattgggagatgcctggatg

SEQ ID NO: 305744 - DNA, 25 bp, Homo sapien
ggagatgcctggatgaacacagaca

SEQ ID NO: 305745 - DNA, 25 bp, Homo sapien
aggatcctgtctccttgcacatcac

SEQ ID NO: 305746 - DNA, 25 bp, Homo sapien
cttgcacatcacgtgggttggtcag

SEQ ID NO: 305747 - DNA, 25 bp, Homo sapien
tatccctgtcctctacccagagagt

SEQ ID NO: 305748 - DNA, 25 bp, Homo sapien
ctacccagagagtgcttcctgcctg

SEQ ID NO: 305749 - DNA, 25 bp, Homo sapien
tgcctgctcaggctcaggtaatttc

SEQ ID NO: 305750 - DNA, 25 bp, Homo sapien
ctgctcaggctcaggtaatttcccc

SEQ ID NO: 305751 - DNA, 25 bp, Homo sapien
tcctgccaggtggaattcctcaggg

SEQ ID NO: 305752 - DNA, 25 bp, Homo sapien
taatttccccctctaggcatggcag

SEQ ID NO: 305753 - DNA, 25 bp, Homo sapien
tagactgaatgttccaaatcaaggg

SEQ ID NO: 305754 - DNA, 25 bp, Homo sapien
ccaaatcaagggaatggtgggcttt

SEQ ID NO: 305755 - DNA, 25 bp, Homo sapien
acttggagctgtgggatgcccctgt

SEQ ID NO: 305756 - DNA, 25 bp, Homo sapien
gtgggatgcccctgtgccagtgttt

SEQ ID NO: 305757 - DNA, 25 bp, Homo sapien
tgccagtgtttcctttgaccatcag

SEQ ID NO: 305758 - DNA, 25 bp, Homo sapien
ttttctgtcagaagggtgagttagc

SEQ ID NO: 305759 - DNA, 25 bp, Homo sapien
gggtgagttagcactgaaccatctc

SEQ ID NO: 305760 - DNA, 25 bp, Homo sapien
agcactgaaccatctcatgtgtctt

SEQ ID NO: 305761 - DNA, 25 bp, Homo sapien
tcatgtgtcttttcactgagtaaca

SEQ ID NO: 305762 - DNA, 25 bp, Homo sapien
tgagtaacagcccatatccattcca

SEQ ID NO: 305763 - DNA, 25 bp, Homo sapien
tatccattccatgaaatgagtgact

SEQ ID NO: 305764 - DNA, 25 bp, Homo sapien
aaatgagtgactgctttgttgaatc

SEQ ID NO: 305765 - DNA, 25 bp, Homo sapien
catttatttgtagtctggttgtgtc

SEQ ID NO: 305766 - DNA, 25 bp, Homo sapien
agtctggttgtgtcatatcatggtt

SEQ ID NO: 305767 - DNA, 25 bp, Homo sapien
gtcatatcatggttgaattgcaaac

SEQ ID NO: 305768 - DNA, 25 bp, Homo sapien
aacaggttggatagaagagtcagca

SEQ ID NO: 305769 - DNA, 25 bp, Homo sapien
gatccctgagtcactgcttggagga

SEQ ID NO: 305770 - DNA, 25 bp, Homo sapien
gagctgcctgagatggcttcctgat

SEQ ID NO: 305771 - DNA, 25 bp, Homo sapien
tggcttcctgatcatgaacatccac

SEQ ID NO: 305772 - DNA, 25 bp, Homo sapien
tccacgttggactttgcctgagcaa

SEQ ID NO: 305773 - DNA, 25 bp, Homo sapien
gaataaacatcctatcttaagacaa

SEQ ID NO: 305774 - DNA, 25 bp, Homo sapien
atccttatgatctctctatctctac

SEQ ID NO: 305775 - DNA, 25 bp, Homo sapien
gtttttggcatatgaccagcttcaa

SEQ ID NO: 305776 - DNA, 25 bp, Homo sapien
ccagcttcaattacgctgcataatt

SEQ ID NO: 305777 - DNA, 25 bp, Homo sapien
gcataatttacatgtcttttccctc

SEQ ID NO: 305778 - DNA, 25 bp, Homo sapien
tcctttccagtcatagtggtaggaa

SEQ ID NO: 305779 - DNA, 25 bp, Homo sapien
aagcccagatgatgacagagaccca

SEQ ID NO: 305780 - DNA, 25 bp, Homo sapien
aaatagcctcgagacattcatcact

SEQ ID NO: 305781 - DNA, 25 bp, Homo sapien
tcgagacattcatcactaaagcagt

SEQ ID NO: 305782 - DNA, 25 bp, Homo sapien
ctaaagcagtgatcgggaaggctct

SEQ ID NO: 305783 - DNA, 25 bp, Homo sapien
ggaaggctctgagggctgttttttt

SEQ ID NO: 305784 - DNA, 25 bp, Homo sapien
tttgatgttaacagaaaccaatctt

SEQ ID NO: 305785 - DNA, 25 bp, Homo sapien
agaaaccaatcttagcaccttttca

SEQ ID NO: 305786 - DNA, 25 bp, Homo sapien
atagataaggaatttcctgtacacc

SEQ ID NO: 305787 - DNA, 25 bp, Homo sapien
tcctgtacaccagattggaaatgga

SEQ ID NO: 305788 - DNA, 25 bp, Homo sapien
atggagtgaaacaagccctcccatg

SEQ ID NO: 305789 - DNA, 25 bp, Homo sapien
gtgggccacgccttatgtaagaata

SEQ ID NO: 305790 - DNA, 25 bp, Homo sapien
ctcagcacttgtccgtagggtcaca

SEQ ID NO: 305791 - DNA, 25 bp, Homo sapien
tcctggctccaccagccaaggaggt

SEQ ID NO: 305792 - DNA, 25 bp, Homo sapien
caatgccgctcagggtgcagtgagc

SEQ ID NO: 305793 - DNA, 25 bp, Homo sapien
ggtgcagtgagctcccctgggaaaa

SEQ ID NO: 305794 - DNA, 25 bp, Homo sapien
gtgagctcccctgggaaaaccgaag

SEQ ID NO: 305795 - DNA, 25 bp, Homo sapien
tgggaaaaccgaagccagcaagacc

SEQ ID NO: 305796 - DNA, 25 bp, Homo sapien
cctgctcccagaggctggatttgaa

SEQ ID NO: 305797 - DNA, 25 bp, Homo sapien
caggagagggccacctcactgggcc

SEQ ID NO: 305798 - DNA, 25 bp, Homo sapien
tgacctcagctcctagaccctggac

SEQ ID NO: 305799 - DNA, 25 bp, Homo sapien
tggacccttggctgggactcagcat

SEQ ID NO: 305800 - DNA, 25 bp, Homo sapien
ggacccttggctgggactcagcatt

SEQ ID NO: 305801 - DNA, 25 bp, Homo sapien
aggtgaagctgccaggtgtgcacag

SEQ ID NO: 305802 - DNA, 25 bp, Homo sapien
cagaaaccagaagccgataccacag

SEQ ID NO: 305803 - DNA, 25 bp, Homo sapien
agaagccgataccacagaaaccaga

SEQ ID NO: 305804 - DNA, 25 bp, Homo sapien
gctcttcccgctcggacgtttacag

SEQ ID NO: 305805 - DNA, 25 bp, Homo sapien
gaagcggcaggttgagccccgcacc

SEQ ID NO: 305806 - DNA, 25 bp, Homo sapien
ggttgagccccgcaccttgctgtgc

SEQ ID NO: 305807 - DNA, 25 bp, Homo sapien
tgctgtgccctctagagcgagcgga

SEQ ID NO: 305808 - DNA, 25 bp, Homo sapien
aaagctgctgcgagatgttgcggcc

SEQ ID NO: 305809 - DNA, 25 bp, Homo sapien
agatgttgcggccttgcagacgtct

SEQ ID NO: 305810 - DNA, 25 bp, Homo sapien
ttgcggccttgcagacgtctcagct

SEQ ID NO: 305811 - DNA, 25 bp, Homo sapien
ggccccgcgcggaaggaaacgtgca

SEQ ID NO: 305812 - DNA, 25 bp, Homo sapien
gaaacgtgcagcgcgatgcggctta

SEQ ID NO: 305813 - DNA, 25 bp, Homo sapien
ttacagcaccatttcagtttgtcat

SEQ ID NO: 305814 - DNA, 25 bp, Homo sapien
cagtttgtcatctgtttattcacat

SEQ ID NO: 305815 - DNA, 25 bp, Homo sapien
attcacattactttcctgacactgg

SEQ ID NO: 305816 - DNA, 25 bp, Homo sapien
ggaattccagaagtgaccacctgtc

SEQ ID NO: 305817 - DNA, 25 bp, Homo sapien
tgtcattcccgaagtgccataactg

SEQ ID NO: 305818 - DNA, 25 bp, Homo sapien
aaaaggaagatgttgctgggcaccc

SEQ ID NO: 305819 - DNA, 25 bp, Homo sapien
gttggtggcttgaaacttctagcta

SEQ ID NO: 305820 - DNA, 25 bp, Homo sapien
ttctagctagactgtcacttcttac

SEQ ID NO: 305821 - DNA, 25 bp, Homo sapien
agacttatggactgttaatggactt

SEQ ID NO: 305822 - DNA, 25 bp, Homo sapien
gaaaataactcttcagatcatctgc

SEQ ID NO: 305823 - DNA, 25 bp, Homo sapien
gatcatctgcctttattggcaaagt

SEQ ID NO: 305824 - DNA, 25 bp, Homo sapien
tggaatataatttggcagtttcttg

SEQ ID NO: 305825 - DNA, 25 bp, Homo sapien
agtttcttgtaaaaccacacatgta

SEQ ID NO: 305826 - DNA, 25 bp, Homo sapien
accacacatgtatatgtcatgcttc

SEQ ID NO: 305827 - DNA, 25 bp, Homo sapien
acatgtatatgtcatgcttcaggaa

SEQ ID NO: 305828 - DNA, 25 bp, Homo sapien
gcttcaggaattgcacttctgagca

SEQ ID NO: 305829 - DNA, 25 bp, Homo sapien
gctttatttgtaatggtcgaaacct

SEQ ID NO: 305830 - DNA, 25 bp, Homo sapien
ggtcgaaacctgtaggcaacccata

SEQ ID NO: 305831 - DNA, 25 bp, Homo sapien
gaaacctgtaggcaacccatatatc

SEQ ID NO: 305832 - DNA, 25 bp, Homo sapien
acctgtaggcaacccatatatcctt

SEQ ID NO: 305833 - DNA, 25 bp, Homo sapien
taggcaacccatatatccttcctta

SEQ ID NO: 305834 - DNA, 25 bp, Homo sapien
aacccatatatccttccttaggtgg

SEQ ID NO: 305835 - DNA, 25 bp, Homo sapien
atagcattgagtgggacctaatccg

SEQ ID NO: 305836 - DNA, 25 bp, Homo sapien
gaaggaagctgggaatgaaactcaa

SEQ ID NO: 305837 - DNA, 25 bp, Homo sapien
ctggaagcggcaaccctcagctctg

SEQ ID NO: 305838 - DNA, 25 bp, Homo sapien
tttggaatccaccaccggaacccat

SEQ ID NO: 305839 - DNA, 25 bp, Homo sapien
gccgagcctcagcaagagttcgttt

SEQ ID NO: 305840 - DNA, 25 bp, Homo sapien
agagttcgttttgtgcctgagttac

SEQ ID NO: 305841 - DNA, 25 bp, Homo sapien
gttttgtgcctgagttactactaca

SEQ ID NO: 305842 - DNA, 25 bp, Homo sapien
tacccgtgcctgtgcgctgggagaa

SEQ ID NO: 305843 - DNA, 25 bp, Homo sapien
ctgggagaacaaggtcagcgcccaa

SEQ ID NO: 305844 - DNA, 25 bp, Homo sapien
gaaagttggtgtactgctgggttct

SEQ ID NO: 305845 - DNA, 25 bp, Homo sapien
tgggttctgaccaacttcttttgga

SEQ ID NO: 305846 - DNA, 25 bp, Homo sapien
gaagccctcaggtggaggtcagcat

SEQ ID NO: 305847 - DNA, 25 bp, Homo sapien
agcattgcttccctcagatcatggg

SEQ ID NO: 305848 - DNA, 25 bp, Homo sapien
atcatgggtgaatttgaggaactca

SEQ ID NO: 305849 - DNA, 25 bp, Homo sapien
ggaactcagttaatatctttgtatg

SEQ ID NO: 305850 - DNA, 25 bp, Homo sapien
cctccctccataaggtgagaacaag

SEQ ID NO: 305851 - DNA, 25 bp, Homo sapien
aggtgagaacaagcacatgctctgc

SEQ ID NO: 305852 - DNA, 25 bp, Homo sapien
atgctctgcccatgtcagaaattgt

SEQ ID NO: 305853 - DNA, 25 bp, Homo sapien
ttgtctagactagtgtttttcaaag

SEQ ID NO: 305854 - DNA, 25 bp, Homo sapien
ctccacgtgcagagcaaggtttcag

SEQ ID NO: 305855 - DNA, 25 bp, Homo sapien
aagtgcaaaagcctcaacccattac

SEQ ID NO: 305856 - DNA, 25 bp, Homo sapien
aacccattactgagttgagaagcca

SEQ ID NO: 305857 - DNA, 25 bp, Homo sapien
aacatccctgaaaacctctgtgaaa

SEQ ID NO: 305858 - DNA, 25 bp, Homo sapien
aatatattgtgactttaggcccatt

SEQ ID NO: 305859 - DNA, 25 bp, Homo sapien
actttaggcccatttttcatgtgct

SEQ ID NO: 305860 - DNA, 25 bp, Homo sapien
catgtgcttcactttgatagagtta

SEQ ID NO: 305861 - DNA, 25 bp, Homo sapien
ttgctctttactttagcttatcaaa

SEQ ID NO: 305862 - DNA, 25 bp, Homo sapien
attattttgtggactggaggccaaa

SEQ ID NO: 305863 - DNA, 25 bp, Homo sapien
gtgagcttctcacaggtttttaaag

SEQ ID NO: 305864 - DNA, 25 bp, Homo sapien
tcacaggtttttaaagctccactaa

SEQ ID NO: 305865 - DNA, 25 bp, Homo sapien
attatccacttgtctttacttttgt

SEQ ID NO: 305866 - DNA, 25 bp, Homo sapien
gaatagttggtaactctgccagagc

SEQ ID NO: 305867 - DNA, 25 bp, Homo sapien
gcctgtacttacctgccaaaaacaa

SEQ ID NO: 305868 - DNA, 25 bp, Homo sapien
gcatgtgcgtttaagggcatccaat

SEQ ID NO: 305869 - DNA, 25 bp, Homo sapien
aggcctttcctctggagttcacgtg

SEQ ID NO: 305870 - DNA, 25 bp, Homo sapien
agttcacgtgtaggtcgtactgaca

SEQ ID NO: 305871 - DNA, 25 bp, Homo sapien
gtactgacacacaacatggcctaaa

SEQ ID NO: 305872 - DNA, 25 bp, Homo sapien
agggaccccaaatccaggccaaatg

SEQ ID NO: 305873 - DNA, 25 bp, Homo sapien
ccaaatgggagcagggttgtcctca

SEQ ID NO: 305874 - DNA, 25 bp, Homo sapien
aaagaaacgcgaacccagcagcact

SEQ ID NO: 305875 - DNA, 25 bp, Homo sapien
ggaggaccccagctagaagactttc

SEQ ID NO: 305876 - DNA, 25 bp, Homo sapien
gccagcggcaattctgagtgctcat

SEQ ID NO: 305877 - DNA, 25 bp, Homo sapien
tgagtgctcatttccactttgccaa

SEQ ID NO: 305878 - DNA, 25 bp, Homo sapien
ttccactttgccaagacattacatg

SEQ ID NO: 305879 - DNA, 25 bp, Homo sapien
ttgtggtgccgctccccgtaatgta

SEQ ID NO: 305880 - DNA, 25 bp, Homo sapien
gccgctccccgtaatgtacggagga

SEQ ID NO: 305881 - DNA, 25 bp, Homo sapien
ctcggcgtcatgtcttcggtgctgg

SEQ ID NO: 305882 - DNA, 25 bp, Homo sapien
tcatgtcttcggtgctggcggcttc

SEQ ID NO: 305883 - DNA, 25 bp, Homo sapien
gcggcttcccatccgctggttctat

SEQ ID NO: 305884 - DNA, 25 bp, Homo sapien
ctggttctatcctcaaacgccggga

SEQ ID NO: 305885 - DNA, 25 bp, Homo sapien
tcaaacgccgggacaccgggaatct

SEQ ID NO: 305886 - DNA, 25 bp, Homo sapien
acaccgggaatctcggagaaggaca

SEQ ID NO: 305887 - DNA, 25 bp, Homo sapien
tttgatttcaggtctgcggacgctg

SEQ ID NO: 305888 - DNA, 25 bp, Homo sapien
caggtctgcggacgctgtataccct

SEQ ID NO: 305889 - DNA, 25 bp, Homo sapien
gctgcagccaataaaggccgttcct

SEQ ID NO: 305890 - DNA, 25 bp, Homo sapien
ttggctctggcacacggcggctcct

SEQ ID NO: 305891 - DNA, 25 bp, Homo sapien
acacggcggctccttggctctcggc

SEQ ID NO: 305892 - DNA, 25 bp, Homo sapien
attggccttggctttcgccctcgcg

SEQ ID NO: 305893 - DNA, 25 bp, Homo sapien
tggccttggctttcgccctcgcgtt

SEQ ID NO: 305894 - DNA, 25 bp, Homo sapien
gcgttccgtctccacacttctctgg

SEQ ID NO: 305895 - DNA, 25 bp, Homo sapien
ttcctggccgccttgcgaaggggct

SEQ ID NO: 305896 - DNA, 25 bp, Homo sapien
gtcctccagggagcgcgcgtgccct

SEQ ID NO: 305897 - DNA, 25 bp, Homo sapien
ttctcctgggcttgggaaccttcca

SEQ ID NO: 305898 - DNA, 25 bp, Homo sapien
tcctgggcttgggaaccttccagac

SEQ ID NO: 305899 - DNA, 25 bp, Homo sapien
tgggcttgggaaccttccagaccct

SEQ ID NO: 305900 - DNA, 25 bp, Homo sapien
gcttgggaaccttccagaccctgaa

SEQ ID NO: 305901 - DNA, 25 bp, Homo sapien
aaagagggccttatggatcactgga

SEQ ID NO: 305902 - DNA, 25 bp, Homo sapien
aaaggcaaggacctgtgccagagca

SEQ ID NO: 305903 - DNA, 25 bp, Homo sapien
aggacctgtgccagagcagccacca

SEQ ID NO: 305904 - DNA, 25 bp, Homo sapien
ataaatgccgggtgatcctgggcca

SEQ ID NO: 305905 - DNA, 25 bp, Homo sapien
tgatcctgggccagtggcttggctt

SEQ ID NO: 305906 - DNA, 25 bp, Homo sapien
gtggcttggcttctctcatgatgtc

SEQ ID NO: 305907 - DNA, 25 bp, Homo sapien
tcatgatgtccccactatggctggg

SEQ ID NO: 305908 - DNA, 25 bp, Homo sapien
aagcatggaggtgatcaatctcccc

SEQ ID NO: 305909 - DNA, 25 bp, Homo sapien
ccaggatccatacccccaggagaag

SEQ ID NO: 305910 - DNA, 25 bp, Homo sapien
agagaaggcctgcaaaggagacaaa

SEQ ID NO: 305911 - DNA, 25 bp, Homo sapien
ggaggcagtgagcatcttgaaacat

SEQ ID NO: 305912 - DNA, 25 bp, Homo sapien
tgaggcagacatctgaccatttttt

SEQ ID NO: 305913 - DNA, 25 bp, Homo sapien
cagattttactggagatttgtggtt

SEQ ID NO: 305914 - DNA, 25 bp, Homo sapien
atttgtggttttgcagggaggatca

SEQ ID NO: 305915 - DNA, 25 bp, Homo sapien
ttgcagggaggatcacatggcacat

SEQ ID NO: 305916 - DNA, 25 bp, Homo sapien
catggcacatggcagatcacacagc

SEQ ID NO: 305917 - DNA, 25 bp, Homo sapien
gatcacacagccttcaactatattc

SEQ ID NO: 305918 - DNA, 25 bp, Homo sapien
cccacccgtatgtaccacattgaaa

SEQ ID NO: 305919 - DNA, 25 bp, Homo sapien
gggtcgtccctgttatacccagaga

SEQ ID NO: 305920 - DNA, 25 bp, Homo sapien
gttatacccagagacacccagaaga

SEQ ID NO: 305921 - DNA, 25 bp, Homo sapien
cagaagacaaaacttagccccttct

SEQ ID NO: 305922 - DNA, 25 bp, Homo sapien
taaatctacttgaggcagacatctg

SEQ ID NO: 305923 - DNA, 25 bp, Homo sapien
accacgatgaggtcgatgatggaaa

SEQ ID NO: 305924 - DNA, 25 bp, Homo sapien
acgatctccatccagaagagagtcc

SEQ ID NO: 305925 - DNA, 25 bp, Homo sapien
ccagggcggcatactgctcgatggt

SEQ ID NO: 305926 - DNA, 25 bp, Homo sapien
gcggcatactgctcgatggtggaca

SEQ ID NO: 305927 - DNA, 25 bp, Homo sapien
ggcatactgctcgatggtggacagc

SEQ ID NO: 305928 - DNA, 25 bp, Homo sapien
catactgctcgatggtggacagcac

SEQ ID NO: 305929 - DNA, 25 bp, Homo sapien
tactgctcgatggtggacagcacgc

SEQ ID NO: 305930 - DNA, 25 bp, Homo sapien
actgctcgatggtggacagcacgct

SEQ ID NO: 305931 - DNA, 25 bp, Homo sapien
gctcgatggtggacagcacgctgaa

SEQ ID NO: 305932 - DNA, 25 bp, Homo sapien
cgatggtggacagcacgctgaagat

SEQ ID NO: 305933 - DNA, 25 bp, Homo sapien
tggacagcacgctgaagatgaggca

SEQ ID NO: 305934 - DNA, 25 bp, Homo sapien
gttggataggactttctcagctgaa

SEQ ID NO: 305935 - DNA, 25 bp, Homo sapien
ttctcagctgaacactgtcatctgc

SEQ ID NO: 305936 - DNA, 25 bp, Homo sapien
tgtcatctgccagagcttcaggcaa

SEQ ID NO: 305937 - DNA, 25 bp, Homo sapien
gaacagatgaaaccccagacatgac

SEQ ID NO: 305938 - DNA, 25 bp, Homo sapien
tttaggacacttaggccatactgaa

SEQ ID NO: 305939 - DNA, 25 bp, Homo sapien
gatgagaacaagcagcgtacacgat

SEQ ID NO: 305940 - DNA, 25 bp, Homo sapien
agcgtacacgattctgttgccaaca

SEQ ID NO: 305941 - DNA, 25 bp, Homo sapien
ggccatactgaagcaaggtgacaaa

SEQ ID NO: 305942 - DNA, 25 bp, Homo sapien
tagctacaatgtctcgtgaatcttg

SEQ ID NO: 305943 - DNA, 25 bp, Homo sapien
gtctcgtgaatcttgggtttccatt

SEQ ID NO: 305944 - DNA, 25 bp, Homo sapien
ggtttccattcaccctggtattcaa

SEQ ID NO: 305945 - DNA, 25 bp, Homo sapien
acgaggctgatgactcatttaccat

SEQ ID NO: 305946 - DNA, 25 bp, Homo sapien
gtccaagagagagcccacacacgtg

SEQ ID NO: 305947 - DNA, 25 bp, Homo sapien
agattagtgctttcagacatgatga

SEQ ID NO: 305948 - DNA, 25 bp, Homo sapien
ggcatggtctcgaaaaggcaagctt

SEQ ID NO: 305949 - DNA, 25 bp, Homo sapien
gttttgcctgcatttgtggagccct

SEQ ID NO: 305950 - DNA, 25 bp, Homo sapien
gtggagccctaactcatagcaagct

SEQ ID NO: 305951 - DNA, 25 bp, Homo sapien
taactcatagcaagctttcctgtgg

SEQ ID NO: 305952 - DNA, 25 bp, Homo sapien
agagaccccatcgtttacccagttg

SEQ ID NO: 305953 - DNA, 25 bp, Homo sapien
catcgtttacccagttgagtgaaat

SEQ ID NO: 305954 - DNA, 25 bp, Homo sapien
acacacgtggttggatgcagctgga

SEQ ID NO: 305955 - DNA, 25 bp, Homo sapien
gttcaaggaaaaggcctgggcatgt

SEQ ID NO: 305956 - DNA, 25 bp, Homo sapien
gagattgctgaagtagaagtgcgaa

SEQ ID NO: 305957 - DNA, 25 bp, Homo sapien
gaagtgcgaatgatagattttgctc

SEQ ID NO: 305958 - DNA, 25 bp, Homo sapien
ttttgctcatgtgttccctagcaac

SEQ ID NO: 305959 - DNA, 25 bp, Homo sapien
gttccctagcaacacaatagatgag

SEQ ID NO: 305960 - DNA, 25 bp, Homo sapien
atgagggatatgtttatgggctaaa

SEQ ID NO: 305961 - DNA, 25 bp, Homo sapien
tatgggctaaagcatttaatttctg

SEQ ID NO: 305962 - DNA, 25 bp, Homo sapien
gcatttaatttctgtacttcgaagt

SEQ ID NO: 305963 - DNA, 25 bp, Homo sapien
tacttcgaagtattttagacaattg

SEQ ID NO: 305964 - DNA, 25 bp, Homo sapien
acaattgaatcctctgttgcagtct

SEQ ID NO: 305965 - DNA, 25 bp, Homo sapien
gtggaaaagcatgtcacaggaacat

SEQ ID NO: 305966 - DNA, 25 bp, Homo sapien
atggaaatgtactttcccaactgga

SEQ ID NO: 305967 - DNA, 25 bp, Homo sapien
tgcacaaaacctctcctgagcagag

SEQ ID NO: 305968 - DNA, 25 bp, Homo sapien
gagaagctgggtaaccagtcttcct

SEQ ID NO: 305969 - DNA, 25 bp, Homo sapien
aaccagtcttcctgacataaggagt

SEQ ID NO: 305970 - DNA, 25 bp, Homo sapien
aaggagtgtgtacttgccagtcatc

SEQ ID NO: 305971 - DNA, 25 bp, Homo sapien
tacttgccagtcatcccatgggcag

SEQ ID NO: 305972 - DNA, 25 bp, Homo sapien
aagcagatgccatccctagccttgg

SEQ ID NO: 305973 - DNA, 25 bp, Homo sapien
ggagacatgctctgagtcacacact

SEQ ID NO: 305974 - DNA, 25 bp, Homo sapien
catgctctgagtcacacactggaga

SEQ ID NO: 305975 - DNA, 25 bp, Homo sapien
agaacttaaaggtgcctggccactg

SEQ ID NO: 305976 - DNA, 25 bp, Homo sapien
aaatgtatccacacaatgccataaa

SEQ ID NO: 305977 - DNA, 25 bp, Homo sapien
atatcagatgatgctctccacagat

SEQ ID NO: 305978 - DNA, 25 bp, Homo sapien
acacagtctgaagagacaaatcaaa

SEQ ID NO: 305979 - DNA, 25 bp, Homo sapien
aatgcaatacgtccagcctccaaaa

SEQ ID NO: 305980 - DNA, 25 bp, Homo sapien
gaatcagattatgacacagattttg

SEQ ID NO: 305981 - DNA, 25 bp, Homo sapien
atgcaatacgtccagcctccaaaaa

SEQ ID NO: 305982 - DNA, 25 bp, Homo sapien
cagattatgacacagattttgatat

SEQ ID NO: 305983 - DNA, 25 bp, Homo sapien
atgacacagattttgatattatcaa

SEQ ID NO: 305984 - DNA, 25 bp, Homo sapien
tgcaatacgtccagcctccaaaaaa

SEQ ID NO: 305985 - DNA, 25 bp, Homo sapien
gcaatacgtccagcctccaaaaaaa

SEQ ID NO: 305986 - DNA, 25 bp, Homo sapien
gtaagaatcaagaacattgtaagag

SEQ ID NO: 305987 - DNA, 25 bp, Homo sapien
tataagcaaaacacagtctgaagag

SEQ ID NO: 305988 - DNA, 25 bp, Homo sapien
aagcaaaacacagtctgaagagaca

SEQ ID NO: 305989 - DNA, 25 bp, Homo sapien
tgcaaccccggtagcatctgccaga

SEQ ID NO: 305990 - DNA, 25 bp, Homo sapien
gcagtggcttcaatgttggtgacta

SEQ ID NO: 305991 - DNA, 25 bp, Homo sapien
aatgttggtgactatgggatacact

SEQ ID NO: 305992 - DNA, 25 bp, Homo sapien
actatgggatacactggagatggca

SEQ ID NO: 305993 - DNA, 25 bp, Homo sapien
ctgagctaccactggcattcaaata

SEQ ID NO: 305994 - DNA, 25 bp, Homo sapien
cattcaaataagcaccagggctcca

SEQ ID NO: 305995 - DNA, 25 bp, Homo sapien
cagccgcttctttggaaccaaagat

SEQ ID NO: 305996 - DNA, 25 bp, Homo sapien
tttggaaccaaagatgcccctgaaa

SEQ ID NO: 305997 - DNA, 25 bp, Homo sapien
ccaaagatgcccctgaaaatgcagg

SEQ ID NO: 305998 - DNA, 25 bp, Homo sapien
aaatgcagggattctttacatctct

SEQ ID NO: 305999 - DNA, 25 bp, Homo sapien
gcagggattctttacatctctgggc

SEQ ID NO: 306000 - DNA, 25 bp, Homo sapien
ggaggcattcccagactcagggtta

SEQ ID NO: 306001 - DNA, 25 bp, Homo sapien
attcccagactcagggttagtcagc

SEQ ID NO: 306002 - DNA, 25 bp, Homo sapien
ggttagtcagcagattagcatttaa

SEQ ID NO: 306003 - DNA, 25 bp, Homo sapien
ccctgcctcctgactgatttaatct

SEQ ID NO: 306004 - DNA, 25 bp, Homo sapien
gtgaggacctctgagataggcccca

SEQ ID NO: 306005 - DNA, 25 bp, Homo sapien
ggacctctgagataggccccaggag

SEQ ID NO: 306006 - DNA, 25 bp, Homo sapien
tgagataggccccaggagtctcacc

SEQ ID NO: 306007 - DNA, 25 bp, Homo sapien
gcaccacttatgtctcagggctaac

SEQ ID NO: 306008 - DNA, 25 bp, Homo sapien
cacttatgtctcagggctaaccaga

SEQ ID NO: 306009 - DNA, 25 bp, Homo sapien
agggctaaccagagactccctgaaa

SEQ ID NO: 306010 - DNA, 25 bp, Homo sapien
ctaaccagagactccctgaaacaga

SEQ ID NO: 306011 - DNA, 25 bp, Homo sapien
ccattctgggcctcatgagggccgt

SEQ ID NO: 306012 - DNA, 25 bp, Homo sapien
gttggacaaacttgttttaagtgca

SEQ ID NO: 306013 - DNA, 25 bp, Homo sapien
gacaaacttgttttaagtgcaaaga

SEQ ID NO: 306014 - DNA, 25 bp, Homo sapien
agaaggtatcttgtaatgtttttca

SEQ ID NO: 306015 - DNA, 25 bp, Homo sapien
ttttcaaaaatccagggtccttgca

SEQ ID NO: 306016 - DNA, 25 bp, Homo sapien
caaaaatccagggtccttgcatata

SEQ ID NO: 306017 - DNA, 25 bp, Homo sapien
atccagggtccttgcatatatttca

SEQ ID NO: 306018 - DNA, 25 bp, Homo sapien
ccagggtccttgcatatatttcaga

SEQ ID NO: 306019 - DNA, 25 bp, Homo sapien
gggtccttgcatatatttcagatat

SEQ ID NO: 306020 - DNA, 25 bp, Homo sapien
tcagatatgtgtcattttagaccaa

SEQ ID NO: 306021 - DNA, 25 bp, Homo sapien
gtgtcattttagaccaagaagggac

SEQ ID NO: 306022 - DNA, 25 bp, Homo sapien
tgctacttctttttaaatccacttt

SEQ ID NO: 306023 - DNA, 25 bp, Homo sapien
gtaagatgactcgacacaaggccat

SEQ ID NO: 306024 - DNA, 25 bp, Homo sapien
agagctttcctctgtttgtatggcc

SEQ ID NO: 306025 - DNA, 25 bp, Homo sapien
tttgtatggcccgttcatgtcccag

SEQ ID NO: 306026 - DNA, 25 bp, Homo sapien
catgtcccaggcattgcaacacaaa

SEQ ID NO: 306027 - DNA, 25 bp, Homo sapien
gatttcaccacaacatgacaagcat

SEQ ID NO: 306028 - DNA, 25 bp, Homo sapien
gcacaatttaactaataagcccctt

SEQ ID NO: 306029 - DNA, 25 bp, Homo sapien
ttcgctctctagttggccaggctta

SEQ ID NO: 306030 - DNA, 25 bp, Homo sapien
gttggccaggcttaacctaatacac

SEQ ID NO: 306031 - DNA, 25 bp, Homo sapien
tacacatctaacgtgtgtgccacac

SEQ ID NO: 306032 - DNA, 25 bp, Homo sapien
gtgccacacggccagtagaaagttt

SEQ ID NO: 306033 - DNA, 25 bp, Homo sapien
caggctcgtctggaactccggtgct

SEQ ID NO: 306034 - DNA, 25 bp, Homo sapien
aggctcgtctggaactccggtgctc

SEQ ID NO: 306035 - DNA, 25 bp, Homo sapien
ggctcgtctggaactccggtgctca

SEQ ID NO: 306036 - DNA, 25 bp, Homo sapien
tctggaactccggtgctcaagtggc

SEQ ID NO: 306037 - DNA, 25 bp, Homo sapien
ctggaactccggtgctcaagtggcg

SEQ ID NO: 306038 - DNA, 25 bp, Homo sapien
tggaactccggtgctcaagtggcgt

SEQ ID NO: 306039 - DNA, 25 bp, Homo sapien
gaactccggtgctcaagtggcgtgc

SEQ ID NO: 306040 - DNA, 25 bp, Homo sapien
aactccggtgctcaagtggcgtgcc

SEQ ID NO: 306041 - DNA, 25 bp, Homo sapien
actccggtgctcaagtggcgtgccc

SEQ ID NO: 306042 - DNA, 25 bp, Homo sapien
ctccggtgctcaagtggcgtgccca

SEQ ID NO: 306043 - DNA, 25 bp, Homo sapien
cggtgctcaagtggcgtgcccacct

SEQ ID NO: 306044 - DNA, 25 bp, Homo sapien
attgatcgatcacacaactgcttag

SEQ ID NO: 306045 - DNA, 25 bp, Homo sapien
gatcgatcacacaactgcttagaaa

SEQ ID NO: 306046 - DNA, 25 bp, Homo sapien
atggattgaaggaaagtagctgact

SEQ ID NO: 306047 - DNA, 25 bp, Homo sapien
aggaaagtagctgactattatttat

SEQ ID NO: 306048 - DNA, 25 bp, Homo sapien
ttcaagtgacattgtctggtggctc

SEQ ID NO: 306049 - DNA, 25 bp, Homo sapien
agtgacattgtctggtggctctaag

SEQ ID NO: 306050 - DNA, 25 bp, Homo sapien
acattgtctggtggctctaagggtt

SEQ ID NO: 306051 - DNA, 25 bp, Homo sapien
tgtctggtggctctaagggtttaac

SEQ ID NO: 306052 - DNA, 25 bp, Homo sapien
tttgttttacctaacctgatctttg

SEQ ID NO: 306053 - DNA, 25 bp, Homo sapien
tgttttacctaacctgatctttggg

SEQ ID NO: 306054 - DNA, 25 bp, Homo sapien
acggaaataaagacacttcttggat

SEQ ID NO: 306055 - DNA, 25 bp, Homo sapien
gggcctaaaagggacagagacagaa

SEQ ID NO: 306056 - DNA, 25 bp, Homo sapien
aagaagattgtgagactgccagaat

SEQ ID NO: 306057 - DNA, 25 bp, Homo sapien
gcaatggtatgaggaactgttccac

SEQ ID NO: 306058 - DNA, 25 bp, Homo sapien
gaagacataacaactcgatgcaatg

SEQ ID NO: 306059 - DNA, 25 bp, Homo sapien
taacaactcgatgcaatgtgtgatt

SEQ ID NO: 306060 - DNA, 25 bp, Homo sapien
ctggactggatcttgcattggagga

SEQ ID NO: 306061 - DNA, 25 bp, Homo sapien
atgctataaaaggtatcactgagac

SEQ ID NO: 306062 - DNA, 25 bp, Homo sapien
tcactgagacagttaacatcattgg

SEQ ID NO: 306063 - DNA, 25 bp, Homo sapien
ttaatgatacattttcctgaatttg

SEQ ID NO: 306064 - DNA, 25 bp, Homo sapien
ttttcctgaatttggtaactttgct

SEQ ID NO: 306065 - DNA, 25 bp, Homo sapien
aactttgctattgttacctacacga

SEQ ID NO: 306066 - DNA, 25 bp, Homo sapien
gagagtagtcgcaagtgattgttgt

SEQ ID NO: 306067 - DNA, 25 bp, Homo sapien
gattttgtctcagctttttgttttt

SEQ ID NO: 306068 - DNA, 25 bp, Homo sapien
tgtttttctttgtatcaaacctgtt

SEQ ID NO: 306069 - DNA, 25 bp, Homo sapien
gttttgagatcatacactgttacag

SEQ ID NO: 306070 - DNA, 25 bp, Homo sapien
gaggcatattataaacgtgtggact

SEQ ID NO: 306071 - DNA, 25 bp, Homo sapien
aaacgtgtggacttcagtgttattc

SEQ ID NO: 306072 - DNA, 25 bp, Homo sapien
tcagtgttattccttctcttcaaaa

SEQ ID NO: 306073 - DNA, 25 bp, Homo sapien
atgatgttccaggtgtctagagggt

SEQ ID NO: 306074 - DNA, 25 bp, Homo sapien
agagggtgaggtatgtcatttacat

SEQ ID NO: 306075 - DNA, 25 bp, Homo sapien
aaaacagaaagtgcctctatggtaa

SEQ ID NO: 306076 - DNA, 25 bp, Homo sapien
gccagcatatttgggaatacatcct

SEQ ID NO: 306077 - DNA, 25 bp, Homo sapien
atcacagatttccactgctgctcta

SEQ ID NO: 306078 - DNA, 25 bp, Homo sapien
tgctgctctaatttaacgggattca

SEQ ID NO: 306079 - DNA, 25 bp, Homo sapien
tttaacgggattcactctttttctg

SEQ ID NO: 306080 - DNA, 25 bp, Homo sapien
gaacatgtctcgatgaaagcaattc

SEQ ID NO: 306081 - DNA, 25 bp, Homo sapien
ccagagctaggcaccagggatgcag

SEQ ID NO: 306082 - DNA, 25 bp, Homo sapien
ctgtgaacagactttgtcctgtcct

SEQ ID NO: 306083 - DNA, 25 bp, Homo sapien
gacagacaagtcgatgggaaaccac

SEQ ID NO: 306084 - DNA, 25 bp, Homo sapien
aacatggtaaaaagtgcctgatagc

SEQ ID NO: 306085 - DNA, 25 bp, Homo sapien
aagaccctctgtttgatactttgag

SEQ ID NO: 306086 - DNA, 25 bp, Homo sapien
ggtcttctgtggcataatcttccca

SEQ ID NO: 306087 - DNA, 25 bp, Homo sapien
ctgtggcataatcttcccaggaaga

SEQ ID NO: 306088 - DNA, 25 bp, Homo sapien
caggtggtagtgacatgtaggatta

SEQ ID NO: 306089 - DNA, 25 bp, Homo sapien
catgtaggattagaggactggcaat

SEQ ID NO: 306090 - DNA, 25 bp, Homo sapien
tagaggactggcaatgagtcagtaa

SEQ ID NO: 306091 - DNA, 25 bp, Homo sapien
caatgagtcagtaatgtggtgcagt

SEQ ID NO: 306092 - DNA, 25 bp, Homo sapien
cagtaatgtggtgcagtggtccaga

SEQ ID NO: 306093 - DNA, 25 bp, Homo sapien
tgtggtgaggatctgaaccttagta

SEQ ID NO: 306094 - DNA, 25 bp, Homo sapien
ggatctgaaccttagtagcagcagc

SEQ ID NO: 306095 - DNA, 25 bp, Homo sapien
caggccctctgtttctaaataggaa

SEQ ID NO: 306096 - DNA, 25 bp, Homo sapien
aataccattgttcttttccagccaa

SEQ ID NO: 306097 - DNA, 25 bp, Homo sapien
taccattgttcttttccagccaaaa

SEQ ID NO: 306098 - DNA, 25 bp, Homo sapien
ctccctctaggagccattaaatatt

SEQ ID NO: 306099 - DNA, 25 bp, Homo sapien
tcaccacgcccgtgaacatgaacgt

SEQ ID NO: 306100 - DNA, 25 bp, Homo sapien
cagcaggtcatgatggcagggcaga

SEQ ID NO: 306101 - DNA, 25 bp, Homo sapien
tggcagggcagagcgaggacgagtc

SEQ ID NO: 306102 - DNA, 25 bp, Homo sapien
aggacgagtctgtggacagcacaga

SEQ ID NO: 306103 - DNA, 25 bp, Homo sapien
aggaggatgcgggtgccctggcccc

SEQ ID NO: 306104 - DNA, 25 bp, Homo sapien
ggctggtcttggagaacagtgactc

SEQ ID NO: 306105 - DNA, 25 bp, Homo sapien
tcttggagaacagtgactccctgca

SEQ ID NO: 306106 - DNA, 25 bp, Homo sapien
gggcaggagcagacgcacctgactt

SEQ ID NO: 306107 - DNA, 25 bp, Homo sapien
gagcagacgcacctgactttttgga

SEQ ID NO: 306108 - DNA, 25 bp, Homo sapien
cagacgcacctgactttttggagtt

SEQ ID NO: 306109 - DNA, 25 bp, Homo sapien
gcaaacattttacacagttttattt

SEQ ID NO: 306110 - DNA, 25 bp, Homo sapien
tactgcatgatgtgaaccttggttt

SEQ ID NO: 306111 - DNA, 25 bp, Homo sapien
ctgcatgatgtgaaccttggttttg

SEQ ID NO: 306112 - DNA, 25 bp, Homo sapien
gagaagcacagactccgccacggac

SEQ ID NO: 306113 - DNA, 25 bp, Homo sapien
agaagcacagactccgccacggact

SEQ ID NO: 306114 - DNA, 25 bp, Homo sapien
acagactccgccacggactcctttt

SEQ ID NO: 306115 - DNA, 25 bp, Homo sapien
gatgtgaaccttggttttgaactct

SEQ ID NO: 306116 - DNA, 25 bp, Homo sapien
gtgaaccttggttttgaactctgtt

SEQ ID NO: 306117 - DNA, 25 bp, Homo sapien
gggcgtggttgtttcttgtggttgt

SEQ ID NO: 306118 - DNA, 25 bp, Homo sapien
accttggttttgaactctgttcctg

SEQ ID NO: 306119 - DNA, 25 bp, Homo sapien
cttggttttgaactctgttcctgcc

SEQ ID NO: 306120 - DNA, 25 bp, Homo sapien
gttttgaactctgttcctgcccctc

SEQ ID NO: 306121 - DNA, 25 bp, Homo sapien
aagggaaacctagtaatgccatcac

SEQ ID NO: 306122 - DNA, 25 bp, Homo sapien
aaacctagtaatgccatcacatgga

SEQ ID NO: 306123 - DNA, 25 bp, Homo sapien
cagaagtgccacctcatcataattc

SEQ ID NO: 306124 - DNA, 25 bp, Homo sapien
agtgccacctcatcataattcaagt

SEQ ID NO: 306125 - DNA, 25 bp, Homo sapien
taattcaagtgttcttccacacagc

SEQ ID NO: 306126 - DNA, 25 bp, Homo sapien
cttttccagacgacttcttagaaga

SEQ ID NO: 306127 - DNA, 25 bp, Homo sapien
catttatttgtacatcttttgcact

SEQ ID NO: 306128 - DNA, 25 bp, Homo sapien
tgtacatcttttgcactttcctatt

SEQ ID NO: 306129 - DNA, 25 bp, Homo sapien
acatcttttgcactttcctattgaa

SEQ ID NO: 306130 - DNA, 25 bp, Homo sapien
tgcactttcctattgaagacttgaa

SEQ ID NO: 306131 - DNA, 25 bp, Homo sapien
gacttgaacacgtttgtcttgataa

SEQ ID NO: 306132 - DNA, 25 bp, Homo sapien
gatacttcactttaataactgttgc

SEQ ID NO: 306133 - DNA, 25 bp, Homo sapien
aactgttgcttagtaattggctttg

SEQ ID NO: 306134 - DNA, 25 bp, Homo sapien
tgcttagtaattggctttgtagaga

SEQ ID NO: 306135 - DNA, 25 bp, Homo sapien
ggttttgtcttcaactcctttgcat

SEQ ID NO: 306136 - DNA, 25 bp, Homo sapien
aactcctttgcatgccaggcggtga

SEQ ID NO: 306137 - DNA, 25 bp, Homo sapien
catgccaggcggtgatgtggatctc

SEQ ID NO: 306138 - DNA, 25 bp, Homo sapien
tgtggatctcggcttctgtgagcct

SEQ ID NO: 306139 - DNA, 25 bp, Homo sapien
atccttaaaaccagaccctcatggc

SEQ ID NO: 306140 - DNA, 25 bp, Homo sapien
agcacctgaaagcttcctcgacatc

SEQ ID NO: 306141 - DNA, 25 bp, Homo sapien
gaaagcttcctcgacatctgttaat

SEQ ID NO: 306142 - DNA, 25 bp, Homo sapien
agcttcctcgacatctgttaataaa

SEQ ID NO: 306143 - DNA, 25 bp, Homo sapien
acatatattatctgggtgctgacaa

SEQ ID NO: 306144 - DNA, 25 bp, Homo sapien
gtgctgacaatacctctttactcta

SEQ ID NO: 306145 - DNA, 25 bp, Homo sapien
caatacctctttactctacacatga

SEQ ID NO: 306146 - DNA, 25 bp, Homo sapien
taaactgaggattatagggcacaca

SEQ ID NO: 306147 - DNA, 25 bp, Homo sapien
agggcacacatgtcttgcctgagct

SEQ ID NO: 306148 - DNA, 25 bp, Homo sapien
gcctgagctcagatggttatgaaac

SEQ ID NO: 306149 - DNA, 25 bp, Homo sapien
aagctgggctgggattctccttctc

SEQ ID NO: 306150 - DNA, 25 bp, Homo sapien
ggattctccttctcgatgtttgaaa

SEQ ID NO: 306151 - DNA, 25 bp, Homo sapien
gtgtactctaagctacacacaatag

SEQ ID NO: 306152 - DNA, 25 bp, Homo sapien
tttactcctggaacccataaaagat

SEQ ID NO: 306153 - DNA, 25 bp, Homo sapien
gcacgtaacgtcattggatgtcaga

SEQ ID NO: 306154 - DNA, 25 bp, Homo sapien
gcatgtctatgagcagttcctgctg

SEQ ID NO: 306155 - DNA, 25 bp, Homo sapien
ctgcagcttcaggtagttgttctcc

SEQ ID NO: 306156 - DNA, 25 bp, Homo sapien
gcttcaggtagttgttctcctccag

SEQ ID NO: 306157 - DNA, 25 bp, Homo sapien
tcctccagcaacacttggcttttgg

SEQ ID NO: 306158 - DNA, 25 bp, Homo sapien
aacacttggcttttggaccgctgca

SEQ ID NO: 306159 - DNA, 25 bp, Homo sapien
tcgccagctggctctcagtggtcca

SEQ ID NO: 306160 - DNA, 25 bp, Homo sapien
cgcggaacacgaaggcctggttgct

SEQ ID NO: 306161 - DNA, 25 bp, Homo sapien
gggttgcgctgcttctccagcaagt

SEQ ID NO: 306162 - DNA, 25 bp, Homo sapien
tgcttctccagcaagtgcatgcgcg

SEQ ID NO: 306163 - DNA, 25 bp, Homo sapien
tgcatgcgcgccatggtctcagtca

SEQ ID NO: 306164 - DNA, 25 bp, Homo sapien
atggtctcagtcagcatgtctatga

SEQ ID NO: 306165 - DNA, 25 bp, Homo sapien
tgccttctatgtcttaccatatttt

SEQ ID NO: 306166 - DNA, 25 bp, Homo sapien
gaaatatactgcattattgtgttaa

SEQ ID NO: 306167 - DNA, 25 bp, Homo sapien
gatattatctcccagtgtatccaga

SEQ ID NO: 306168 - DNA, 25 bp, Homo sapien
ttatctcccagtgtatccagatcta

SEQ ID NO: 306169 - DNA, 25 bp, Homo sapien
ctcccagtgtatccagatctaagta

SEQ ID NO: 306170 - DNA, 25 bp, Homo sapien
gatctaagtaatctcagtgaactat

SEQ ID NO: 306171 - DNA, 25 bp, Homo sapien
ctcagtgaactatacattgcctaaa

SEQ ID NO: 306172 - DNA, 25 bp, Homo sapien
tacattgcctaaaaagtggttttgt

SEQ ID NO: 306173 - DNA, 25 bp, Homo sapien
gatttgtagtcacatttctattggg

SEQ ID NO: 306174 - DNA, 25 bp, Homo sapien
ttgtagtcacatttctattgggata

SEQ ID NO: 306175 - DNA, 25 bp, Homo sapien
gcaaaatgcttaaagttccttttat

SEQ ID NO: 306176 - DNA, 25 bp, Homo sapien
ataaatctgacatgggccctgggca

SEQ ID NO: 306177 - DNA, 25 bp, Homo sapien
ggtgcaatgcagttcacacatacct

SEQ ID NO: 306178 - DNA, 25 bp, Homo sapien
aggatgttcaattcaggctgatgcc

SEQ ID NO: 306179 - DNA, 25 bp, Homo sapien
tgatgccaccctcataagggatctc

SEQ ID NO: 306180 - DNA, 25 bp, Homo sapien
aagggatctccttcagagctgttat

SEQ ID NO: 306181 - DNA, 25 bp, Homo sapien
gagctgttatatcaactggacatcc

SEQ ID NO: 306182 - DNA, 25 bp, Homo sapien
tggacatccctacatatcaaaagtg

SEQ ID NO: 306183 - DNA, 25 bp, Homo sapien
aaaagtgtctttcccttgtgaactg

SEQ ID NO: 306184 - DNA, 25 bp, Homo sapien
tgagatatggccttcagctgaagct

SEQ ID NO: 306185 - DNA, 25 bp, Homo sapien
tgaagctttctgacattcactgtgt

SEQ ID NO: 306186 - DNA, 25 bp, Homo sapien
cactgtgtactcaaggactttctcc

SEQ ID NO: 306187 - DNA, 25 bp, Homo sapien
agggaattacggctcatctcttttt

SEQ ID NO: 306188 - DNA, 25 bp, Homo sapien
ctcatctctttttgcccaatgtgaa

SEQ ID NO: 306189 - DNA, 25 bp, Homo sapien
agataatgggtgtcagcaggtcctg

SEQ ID NO: 306190 - DNA, 25 bp, Homo sapien
gtcagcaggtcctgtggctctatgg

SEQ ID NO: 306191 - DNA, 25 bp, Homo sapien
cactgaagtgggaactatgaatctt

SEQ ID NO: 306192 - DNA, 25 bp, Homo sapien
tgaatctttttctttactggataaa

SEQ ID NO: 306193 - DNA, 25 bp, Homo sapien
aagaagaactggcaactcctccact

SEQ ID NO: 306194 - DNA, 25 bp, Homo sapien
aactcctccactagatggcatcatt

SEQ ID NO: 306195 - DNA, 25 bp, Homo sapien
ggcatcattcttccaggagtgacaa

SEQ ID NO: 306196 - DNA, 25 bp, Homo sapien
tgacaaggcggtgcattctggacct

SEQ ID NO: 306197 - DNA, 25 bp, Homo sapien
cattctggacctggcacatcagtgg

SEQ ID NO: 306198 - DNA, 25 bp, Homo sapien
ggctgactaggcacccggtcccaga

SEQ ID NO: 306199 - DNA, 25 bp, Homo sapien
cacctggaacgcgttgtaggcgacc

SEQ ID NO: 306200 - DNA, 25 bp, Homo sapien
gaacgcgttgtaggcgaccccctgg

SEQ ID NO: 306201 - DNA, 25 bp, Homo sapien
gagcgggtgctagggttcaactcca

SEQ ID NO: 306202 - DNA, 25 bp, Homo sapien
gggtgctagggttcaactccactac

SEQ ID NO: 306203 - DNA, 25 bp, Homo sapien
tagggttcaactccactacgcagac

SEQ ID NO: 306204 - DNA, 25 bp, Homo sapien
tcaactccactacgcagactgctag

SEQ ID NO: 306205 - DNA, 25 bp, Homo sapien
tacgcagactgctagtgggatttca

SEQ ID NO: 306206 - DNA, 25 bp, Homo sapien
cagactgctagtgggatttcatttc

SEQ ID NO: 306207 - DNA, 25 bp, Homo sapien
gactgctagtgggatttcatttcct

SEQ ID NO: 306208 - DNA, 25 bp, Homo sapien
aacagccgggcaggcatcgctgccg

SEQ ID NO: 306209 - DNA, 25 bp, Homo sapien
gagcgggtgcaagaactcccaggtc

SEQ ID NO: 306210 - DNA, 25 bp, Homo sapien
gaactcccaggtcactgctttattc

SEQ ID NO: 306211 - DNA, 25 bp, Homo sapien
caggtcactgctttattcagaggac

SEQ ID NO: 306212 - DNA, 25 bp, Homo sapien
aaagcttcaatccacaggtttctaa

SEQ ID NO: 306213 - DNA, 25 bp, Homo sapien
cacaggtttctaatagtactctcat

SEQ ID NO: 306214 - DNA, 25 bp, Homo sapien
ctctcattcattttgcttacaaaag

SEQ ID NO: 306215 - DNA, 25 bp, Homo sapien
ggtacagattatcactaatcctctt

SEQ ID NO: 306216 - DNA, 25 bp, Homo sapien
agcctcagacttctgactgcaaatc

SEQ ID NO: 306217 - DNA, 25 bp, Homo sapien
aaatccaacaggacaatacagagtt

SEQ ID NO: 306218 - DNA, 25 bp, Homo sapien
atacagagttggcaggacccttctc

SEQ ID NO: 306219 - DNA, 25 bp, Homo sapien
tggcaggacccttctcaggagtgag

SEQ ID NO: 306220 - DNA, 25 bp, Homo sapien
acgtgtgcctgaccacgctggtgat

SEQ ID NO: 306221 - DNA, 25 bp, Homo sapien
tgaccacgctggtgatcatgggcag

SEQ ID NO: 306222 - DNA, 25 bp, Homo sapien
ccacgctggtgatcatgggcagcat

SEQ ID NO: 306223 - DNA, 25 bp, Homo sapien
gcagcatggccgtcatggacgcgta

SEQ ID NO: 306224 - DNA, 25 bp, Homo sapien
atggccgtcatggacgcgtacctgg

SEQ ID NO: 306225 - DNA, 25 bp, Homo sapien
tcatggacgcgtacctggtggagca

SEQ ID NO: 306226 - DNA, 25 bp, Homo sapien
acgcgtacctggtggagcagaacca

SEQ ID NO: 306227 - DNA, 25 bp, Homo sapien
cagaaccagggcccgcgcaagatcg

SEQ ID NO: 306228 - DNA, 25 bp, Homo sapien
agatcggcgtgtgcatcatcgtgct

SEQ ID NO: 306229 - DNA, 25 bp, Homo sapien
tcggcgtgtgcatcatcgtgctggt

SEQ ID NO: 306230 - DNA, 25 bp, Homo sapien
gggtttcgagctcgccgggccgtgt

SEQ ID NO: 306231 - DNA, 25 bp, Homo sapien
ggctgactaggcacccggtcccaga

SEQ ID NO: 306232 - DNA, 25 bp, Homo sapien
cacctggaacgcgttgtaggcgacc

SEQ ID NO: 306233 - DNA, 25 bp, Homo sapien
gagcgggtgctagggttcaactcca

SEQ ID NO: 306234 - DNA, 25 bp, Homo sapien
gggtgctagggttcaactccactac

SEQ ID NO: 306235 - DNA, 25 bp, Homo sapien
tagggttcaactccactacgcagac

SEQ ID NO: 306236 - DNA, 25 bp, Homo sapien
tcaactccactacgcagactgctag

SEQ ID NO: 306237 - DNA, 25 bp, Homo sapien
tacgcagactgctagtgggatttca

SEQ ID NO: 306238 - DNA, 25 bp, Homo sapien
gactgctagtgggatttcatttcct

SEQ ID NO: 306239 - DNA, 25 bp, Homo sapien
catttcctgcccctcagatttgtaa

SEQ ID NO: 306240 - DNA, 25 bp, Homo sapien
aacagccgggcaggcatcgctgccg

SEQ ID NO: 306241 - DNA, 25 bp, Homo sapien
catcgctgccgccatcttggaagcg

SEQ ID NO: 306242 - DNA, 25 bp, Homo sapien
acgctggttctctgcacttgaagca

SEQ ID NO: 306243 - DNA, 25 bp, Homo sapien
cacacagccaggaagtgcagctggc

SEQ ID NO: 306244 - DNA, 25 bp, Homo sapien
agctggcagggttcacagccggtct

SEQ ID NO: 306245 - DNA, 25 bp, Homo sapien
gcagggttcacagccggtctgtcgc

SEQ ID NO: 306246 - DNA, 25 bp, Homo sapien
tctgtcgctcgccaaagccggtttg

SEQ ID NO: 306247 - DNA, 25 bp, Homo sapien
ggcagaactggccatgccgagttca

SEQ ID NO: 306248 - DNA, 25 bp, Homo sapien
aagcaggtgccaggagctagctctt

SEQ ID NO: 306249 - DNA, 25 bp, Homo sapien
gccaggagctagctctttcccaaaa

SEQ ID NO: 306250 - DNA, 25 bp, Homo sapien
tttcctgagcgtctaccaggtacta

SEQ ID NO: 306251 - DNA, 25 bp, Homo sapien
gtctaccaggtactaggagaactct

SEQ ID NO: 306252 - DNA, 25 bp, Homo sapien
ggtactaggagaactcttacaacag

SEQ ID NO: 306253 - DNA, 25 bp, Homo sapien
gtttgtagtcgatagactccttttt

SEQ ID NO: 306254 - DNA, 25 bp, Homo sapien
tagtcgatagactcctttttgaaga

SEQ ID NO: 306255 - DNA, 25 bp, Homo sapien
gatagactcctttttgaagaccaat

SEQ ID NO: 306256 - DNA, 25 bp, Homo sapien
tcttcaaatcccaaagtagtaatta

SEQ ID NO: 306257 - DNA, 25 bp, Homo sapien
gagaatatagtcatgaattaaaccc

SEQ ID NO: 306258 - DNA, 25 bp, Homo sapien
aacaatgtctttatacatgtgaagt

SEQ ID NO: 306259 - DNA, 25 bp, Homo sapien
gtgtttttcaatcctgatcttagca

SEQ ID NO: 306260 - DNA, 25 bp, Homo sapien
ttcaatcctgatcttagcatattat

SEQ ID NO: 306261 - DNA, 25 bp, Homo sapien
atcctgatcttagcatattattata

SEQ ID NO: 306262 - DNA, 25 bp, Homo sapien
aagatttgtcaataaatttagccag

SEQ ID NO: 306263 - DNA, 25 bp, Homo sapien
ttagccagttagtttgtagtcgata

SEQ ID NO: 306264 - DNA, 25 bp, Homo sapien
ttgtccaatgttttccataaggctt

SEQ ID NO: 306265 - DNA, 25 bp, Homo sapien
tagagtcccatccattgaattcaat

SEQ ID NO: 306266 - DNA, 25 bp, Homo sapien
attgaattcaatgcaaatcacccat

SEQ ID NO: 306267 - DNA, 25 bp, Homo sapien
ccaacaccattcttttttatggaag

SEQ ID NO: 306268 - DNA, 25 bp, Homo sapien
ttttttatggaagattatgctcccc

SEQ ID NO: 306269 - DNA, 25 bp, Homo sapien
ttatgctccccctaatcctgcatat

SEQ ID NO: 306270 - DNA, 25 bp, Homo sapien
atggggatgagtgatgccttcagcc

SEQ ID NO: 306271 - DNA, 25 bp, Homo sapien
agccaaagcaaagctgatttctcag

SEQ ID NO: 306272 - DNA, 25 bp, Homo sapien
gatttctcaggaatgtcttcagcaa

SEQ ID NO: 306273 - DNA, 25 bp, Homo sapien
tcaggaatgtcttcagcaagaaacc

SEQ ID NO: 306274 - DNA, 25 bp, Homo sapien
gcaagaaacctatttttgtccaatg

SEQ ID NO: 306275 - DNA, 25 bp, Homo sapien
ggacgattaagttccctcagagagg

SEQ ID NO: 306276 - DNA, 25 bp, Homo sapien
gattaagttccctcagagaggaagc

SEQ ID NO: 306277 - DNA, 25 bp, Homo sapien
ccgactggagtcgttttcgtgctct

SEQ ID NO: 306278 - DNA, 25 bp, Homo sapien
tggagtcgttttcgtgctctccgca

SEQ ID NO: 306279 - DNA, 25 bp, Homo sapien
cgccgcgggtagcatcttctcagcg

SEQ ID NO: 306280 - DNA, 25 bp, Homo sapien
gggtagcatcttctcagcgccccgg

SEQ ID NO: 306281 - DNA, 25 bp, Homo sapien
acgagggcgtcctgtaggaacgtca

SEQ ID NO: 306282 - DNA, 25 bp, Homo sapien
ggggacgcccgccttttgctattat

SEQ ID NO: 306283 - DNA, 25 bp, Homo sapien
gggcgtcctgtaggaacgtcacaga

SEQ ID NO: 306284 - DNA, 25 bp, Homo sapien
cagagagcgtcctgtaggaacgtca

SEQ ID NO: 306285 - DNA, 25 bp, Homo sapien
gagcgtcctgtaggaacgtcacaga

SEQ ID NO: 306286 - DNA, 25 bp, Homo sapien
tcgggattccgggtaccgagcgcca

SEQ ID NO: 306287 - DNA, 25 bp, Homo sapien
ggattccgggtaccgagcgccacct

SEQ ID NO: 306288 - DNA, 25 bp, Homo sapien
agccattcacgcccaggacaggcag

SEQ ID NO: 306289 - DNA, 25 bp, Homo sapien
tgctcgccgggaggtatgctgtcct

SEQ ID NO: 306290 - DNA, 25 bp, Homo sapien
gggaggtatgctgtcctcggccggg

SEQ ID NO: 306291 - DNA, 25 bp, Homo sapien
gagggcaaggacgacaagaaagaca

SEQ ID NO: 306292 - DNA, 25 bp, Homo sapien
gacaagaaagacaccgacgtgggcg

SEQ ID NO: 306293 - DNA, 25 bp, Homo sapien
acgtgggcggcggtggcaagggcac

SEQ ID NO: 306294 - DNA, 25 bp, Homo sapien
gcacacggccggattagctgcggcg

SEQ ID NO: 306295 - DNA, 25 bp, Homo sapien
ctgcggcggcgggattaatgtggat

SEQ ID NO: 306296 - DNA, 25 bp, Homo sapien
tgtggatgtgaaccagcatccggat

SEQ ID NO: 306297 - DNA, 25 bp, Homo sapien
ccactcccatctttatgacatttca

SEQ ID NO: 306298 - DNA, 25 bp, Homo sapien
tttggaaacaacagcctagatcact

SEQ ID NO: 306299 - DNA, 25 bp, Homo sapien
tcactgttgaaggtgttcatggcat

SEQ ID NO: 306300 - DNA, 25 bp, Homo sapien
catggcatagttggagtctctgact

SEQ ID NO: 306301 - DNA, 25 bp, Homo sapien
acagaacagtacttttcttttagtg

SEQ ID NO: 306302 - DNA, 25 bp, Homo sapien
tagtgtttcattaagcctatgatgt

SEQ ID NO: 306303 - DNA, 25 bp, Homo sapien
gaaatgcttctgagcagtcttgtaa

SEQ ID NO: 306304 - DNA, 25 bp, Homo sapien
gcagtcttgtaatattgttcattca

SEQ ID NO: 306305 - DNA, 25 bp, Homo sapien
gttcattcatattgacctgcatctc

SEQ ID NO: 306306 - DNA, 25 bp, Homo sapien
gacctgcatctcatcattgcatgtt

SEQ ID NO: 306307 - DNA, 25 bp, Homo sapien
aaacgagtgcctgaactgcatgatt

SEQ ID NO: 306308 - DNA, 25 bp, Homo sapien
gcatatccttcttggaccatcaggg

SEQ ID NO: 306309 - DNA, 25 bp, Homo sapien
tcttggaccatcagggttgaaccta

SEQ ID NO: 306310 - DNA, 25 bp, Homo sapien
tcagggttgaacctagttgactaaa

SEQ ID NO: 306311 - DNA, 25 bp, Homo sapien
gaagtccagcatgagcatgaatggt

SEQ ID NO: 306312 - DNA, 25 bp, Homo sapien
gaatggtttgctctatctttcttgg

SEQ ID NO: 306313 - DNA, 25 bp, Homo sapien
gtttgctctatctttcttggttaag

SEQ ID NO: 306314 - DNA, 25 bp, Homo sapien
taagagacctaaccactgaactgct

SEQ ID NO: 306315 - DNA, 25 bp, Homo sapien
cgacccactgtggtcaaggcagcgg

SEQ ID NO: 306316 - DNA, 25 bp, Homo sapien
tctgggctttcctatgcgtttgtca

SEQ ID NO: 306317 - DNA, 25 bp, Homo sapien
tatgcgtttgtcactcttgttctgt

SEQ ID NO: 306318 - DNA, 25 bp, Homo sapien
gggttcctagagaggttcttaggat

SEQ ID NO: 306319 - DNA, 25 bp, Homo sapien
ctaattaggctgaaaactttttatg

SEQ ID NO: 306320 - DNA, 25 bp, Homo sapien
aaaagtagatcagccctatgaccta

SEQ ID NO: 306321 - DNA, 25 bp, Homo sapien
gtagatcagccctatgacctatcag

SEQ ID NO: 306322 - DNA, 25 bp, Homo sapien
atcagccctatgacctatcagttgt

SEQ ID NO: 306323 - DNA, 25 bp, Homo sapien
gccctatgacctatcagttgtactc

SEQ ID NO: 306324 - DNA, 25 bp, Homo sapien
ctatcagttgtactcccagtaaaaa

SEQ ID NO: 306325 - DNA, 25 bp, Homo sapien
gttaatgttcatcttggaagtcggt

SEQ ID NO: 306326 - DNA, 25 bp, Homo sapien
aatactgataacacagcagcatgaa

SEQ ID NO: 306327 - DNA, 25 bp, Homo sapien
gataacacagcagcatgaatgaatc

SEQ ID NO: 306328 - DNA, 25 bp, Homo sapien
tcttggaagtcggtaaatgggtatt

SEQ ID NO: 306329 - DNA, 25 bp, Homo sapien
gaagtcggtaaatgggtattggtat

SEQ ID NO: 306330 - DNA, 25 bp, Homo sapien
ctgctggcgtccttcgtctgtagtt

SEQ ID NO: 306331 - DNA, 25 bp, Homo sapien
tggcgtccttcgtctgtagttcctg

SEQ ID NO: 306332 - DNA, 25 bp, Homo sapien
gtccttcgtctgtagttcctggctt

SEQ ID NO: 306333 - DNA, 25 bp, Homo sapien
ttcgtctgtagttcctggcttttcc

SEQ ID NO: 306334 - DNA, 25 bp, Homo sapien
caccgtcagccactcgttttaatta

SEQ ID NO: 306335 - DNA, 25 bp, Homo sapien
gtcagccactcgttttaattacgcg

SEQ ID NO: 306336 - DNA, 25 bp, Homo sapien
gccactcgttttaattacgcgaacg

SEQ ID NO: 306337 - DNA, 25 bp, Homo sapien
gggttccaactcatccagcctttaa

SEQ ID NO: 306338 - DNA, 25 bp, Homo sapien
aactcatccagcctttaagtttggg

SEQ ID NO: 306339 - DNA, 25 bp, Homo sapien
atccagcctttaagtttgggtggtg

SEQ ID NO: 306340 - DNA, 25 bp, Homo sapien
ggaaagagatgcaccaaaggaagta

SEQ ID NO: 306341 - DNA, 25 bp, Homo sapien
gatatgtaactgattttctgctaga

SEQ ID NO: 306342 - DNA, 25 bp, Homo sapien
tttctgctagaagtttgatatcctc

SEQ ID NO: 306343 - DNA, 25 bp, Homo sapien
tgatatcctctgaatttagctaaag

SEQ ID NO: 306344 - DNA, 25 bp, Homo sapien
taaaggatcaccagcattcacccgg

SEQ ID NO: 306345 - DNA, 25 bp, Homo sapien
gaagaggctgtcctgtagcaattac

SEQ ID NO: 306346 - DNA, 25 bp, Homo sapien
gcaattacagctcaggactgtggct

SEQ ID NO: 306347 - DNA, 25 bp, Homo sapien
gactgtggctaacatctgaggaata

SEQ ID NO: 306348 - DNA, 25 bp, Homo sapien
gatgctgttcagagtactgcctatt

SEQ ID NO: 306349 - DNA, 25 bp, Homo sapien
gtactgcctatttcataaccactgt

SEQ ID NO: 306350 - DNA, 25 bp, Homo sapien
tagttaccgtttccaaacctgtcag

SEQ ID NO: 306351 - DNA, 25 bp, Homo sapien
gaaaatcgctttgtaaccattctat

SEQ ID NO: 306352 - DNA, 25 bp, Homo sapien
gtggacagagtaatgctttttgttt

SEQ ID NO: 306353 - DNA, 25 bp, Homo sapien
tttgtttttgtctgtctggacagta

SEQ ID NO: 306354 - DNA, 25 bp, Homo sapien
gtctgtctggacagtagttggctgt

SEQ ID NO: 306355 - DNA, 25 bp, Homo sapien
agttggctgtaacaaagtttgtgtc

SEQ ID NO: 306356 - DNA, 25 bp, Homo sapien
gtgtctaactaaaaagtacctgttg

SEQ ID NO: 306357 - DNA, 25 bp, Homo sapien
gtacctgttgactcagatagccaca

SEQ ID NO: 306358 - DNA, 25 bp, Homo sapien
aagagactagaacgtgatggcataa

SEQ ID NO: 306359 - DNA, 25 bp, Homo sapien
gagttcaaatctacagtccaccact

SEQ ID NO: 306360 - DNA, 25 bp, Homo sapien
gctcaccacttattacctacactta

SEQ ID NO: 306361 - DNA, 25 bp, Homo sapien
tacctacacttaatttttgctacct

SEQ ID NO: 306362 - DNA, 25 bp, Homo sapien
aatttttgctacctaatctgtaaag

SEQ ID NO: 306363 - DNA, 25 bp, Homo sapien
agtcaatgttaccaaagccctgtgc

SEQ ID NO: 306364 - DNA, 25 bp, Homo sapien
gttaccaaagccctgtgcctccatg

SEQ ID NO: 306365 - DNA, 25 bp, Homo sapien
tccatggcagctcctacagcatgaa

SEQ ID NO: 306366 - DNA, 25 bp, Homo sapien
tggcagctcctacagcatgaacact

SEQ ID NO: 306367 - DNA, 25 bp, Homo sapien
cctacagcatgaacactctctatgg

SEQ ID NO: 306368 - DNA, 25 bp, Homo sapien
gcgcgattcggctcagatggcctac

SEQ ID NO: 306369 - DNA, 25 bp, Homo sapien
gattcggctcagatggcctacctca

SEQ ID NO: 306370 - DNA, 25 bp, Homo sapien
ctacctcacacacttcgaggaggat

SEQ ID NO: 306371 - DNA, 25 bp, Homo sapien
cacacttcgaggaggatgtagaatc

SEQ ID NO: 306372 - DNA, 25 bp, Homo sapien
caaaggagtaacagcccctgtggca

SEQ ID NO: 306373 - DNA, 25 bp, Homo sapien
taacagcccctgtggcaaaccagga

SEQ ID NO: 306374 - DNA, 25 bp, Homo sapien
ctccgtgggtttctcctaaatctga

SEQ ID NO: 306375 - DNA, 25 bp, Homo sapien
tctcctaaatctgaagaacgatggg

SEQ ID NO: 306376 - DNA, 25 bp, Homo sapien
agaacgatgggaaaatgcacgtgga

SEQ ID NO: 306377 - DNA, 25 bp, Homo sapien
atgcacgtggagatgaaaccagatt

SEQ ID NO: 306378 - DNA, 25 bp, Homo sapien
gggattgtttaatcacaacctcaag

SEQ ID NO: 306379 - DNA, 25 bp, Homo sapien
gtttaatcacaacctcaagtgttaa

SEQ ID NO: 306380 - DNA, 25 bp, Homo sapien
caaacacgtttgtaggttcttactg

SEQ ID NO: 306381 - DNA, 25 bp, Homo sapien
tgtaggttcttactggaccagagga

SEQ ID NO: 306382 - DNA, 25 bp, Homo sapien
gcgcaccgggactgacttcgaggca

SEQ ID NO: 306383 - DNA, 25 bp, Homo sapien
accgggactgacttcgaggcacgct

SEQ ID NO: 306384 - DNA, 25 bp, Homo sapien
ggcacgcttcccttcattagagacg

SEQ ID NO: 306385 - DNA, 25 bp, Homo sapien
gaatttaagagggtcgggtgcggtg

SEQ ID NO: 306386 - DNA, 25 bp, Homo sapien
tttaagagggtcgggtgcggtggct

SEQ ID NO: 306387 - DNA, 25 bp, Homo sapien
ttaagagggtcgggtgcggtggctc

SEQ ID NO: 306388 - DNA, 25 bp, Homo sapien
gagaggccaaggtgggctgatcaca

SEQ ID NO: 306389 - DNA, 25 bp, Homo sapien
acaaggtcaagagttcgtgaccagc

SEQ ID NO: 306390 - DNA, 25 bp, Homo sapien
caaggtcaagagttcgtgaccagcc

SEQ ID NO: 306391 - DNA, 25 bp, Homo sapien
atggtggcacacacttgtagtccga

SEQ ID NO: 306392 - DNA, 25 bp, Homo sapien
tggtggcacacacttgtagtccgag

SEQ ID NO: 306393 - DNA, 25 bp, Homo sapien
acacacttgtagtccgagctactcg

SEQ ID NO: 306394 - DNA, 25 bp, Homo sapien
cacacttgtagtccgagctactcgg

SEQ ID NO: 306395 - DNA, 25 bp, Homo sapien
acacttgtagtccgagctactcggg

SEQ ID NO: 306396 - DNA, 25 bp, Homo sapien
gaatctgccatggtgcaaaccttgc

SEQ ID NO: 306397 - DNA, 25 bp, Homo sapien
gatggtactttactacagcggatgt

SEQ ID NO: 306398 - DNA, 25 bp, Homo sapien
cccgcacctcactataaaagctgaa

SEQ ID NO: 306399 - DNA, 25 bp, Homo sapien
agatgatgctctgttccagggcact

SEQ ID NO: 306400 - DNA, 25 bp, Homo sapien
ggctagagcactgggcagtttagaa

SEQ ID NO: 306401 - DNA, 25 bp, Homo sapien
gaatggattctttcgttgcctgcag

SEQ ID NO: 306402 - DNA, 25 bp, Homo sapien
tttcgttgcctgcagtggtggctcc

SEQ ID NO: 306403 - DNA, 25 bp, Homo sapien
ggctcctaacctccagttgtaatga

SEQ ID NO: 306404 - DNA, 25 bp, Homo sapien
acaaggactttcatctcctttgctc

SEQ ID NO: 306405 - DNA, 25 bp, Homo sapien
agaggctgacgctctgctctgttcg

SEQ ID NO: 306406 - DNA, 25 bp, Homo sapien
tgctctgttcggagaatctgccatg

SEQ ID NO: 306407 - DNA, 25 bp, Homo sapien
caacttgaagctggttgctctcaag

SEQ ID NO: 306408 - DNA, 25 bp, Homo sapien
tgaagctggttgctctcaagttcca

SEQ ID NO: 306409 - DNA, 25 bp, Homo sapien
tggttgctctcaagttccagaggcc

SEQ ID NO: 306410 - DNA, 25 bp, Homo sapien
gaactgagctgtgagatctgatact

SEQ ID NO: 306411 - DNA, 25 bp, Homo sapien
atctgatactatctctgggtctata

SEQ ID NO: 306412 - DNA, 25 bp, Homo sapien
actatctctgggtctatagtgctgg

SEQ ID NO: 306413 - DNA, 25 bp, Homo sapien
gggtctatagtgctggcattgaatt

SEQ ID NO: 306414 - DNA, 25 bp, Homo sapien
tgctggcattgaattggagaacacc

SEQ ID NO: 306415 - DNA, 25 bp, Homo sapien
cattgaattggagaacacccagctg

SEQ ID NO: 306416 - DNA, 25 bp, Homo sapien
tcactgcttggtgtgtggcggaaaa

SEQ ID NO: 306417 - DNA, 25 bp, Homo sapien
gtggcggaaaaaccctcacacattt

SEQ ID NO: 306418 - DNA, 25 bp, Homo sapien
tgactgccgccttttctttctgcac

SEQ ID NO: 306419 - DNA, 25 bp, Homo sapien
gggactctgcgctggacccgggatc

SEQ ID NO: 306420 - DNA, 25 bp, Homo sapien
tggacccgggatcccacgagggcca

SEQ ID NO: 306421 - DNA, 25 bp, Homo sapien
taaaattcggctttgtaggagcggg

SEQ ID NO: 306422 - DNA, 25 bp, Homo sapien
ctggatagagactggacaaaggagt

SEQ ID NO: 306423 - DNA, 25 bp, Homo sapien
aaggagtgtggccacagtgagaagt

SEQ ID NO: 306424 - DNA, 25 bp, Homo sapien
gagaagtggatagcgccacagctgc

SEQ ID NO: 306425 - DNA, 25 bp, Homo sapien
tagcgccacagctgcggcgatggac

SEQ ID NO: 306426 - DNA, 25 bp, Homo sapien
acagctgcggcgatggactcgttca

SEQ ID NO: 306427 - DNA, 25 bp, Homo sapien
agctgcggcgatggactcgttcata

SEQ ID NO: 306428 - DNA, 25 bp, Homo sapien
gcggcgatggactcgttcataggaa

SEQ ID NO: 306429 - DNA, 25 bp, Homo sapien
tgagggccccaggaaacaaagattc

SEQ ID NO: 306430 - DNA, 25 bp, Homo sapien
atgactgttgttttagagaaccttg

SEQ ID NO: 306431 - DNA, 25 bp, Homo sapien
agagaaccttggtccaactctgttc

SEQ ID NO: 306432 - DNA, 25 bp, Homo sapien
ggtccaactctgttctgacaaggtt

SEQ ID NO: 306433 - DNA, 25 bp, Homo sapien
ctgacaaggttttaggaagatggca

SEQ ID NO: 306434 - DNA, 25 bp, Homo sapien
gtggcagcagtgtactttttggatc

SEQ ID NO: 306435 - DNA, 25 bp, Homo sapien
agcagtgtactttttggatctttct

SEQ ID NO: 306436 - DNA, 25 bp, Homo sapien
aatatccacatgcaacatccgcaac

SEQ ID NO: 306437 - DNA, 25 bp, Homo sapien
catccgcaacaaatctagtatgtca

SEQ ID NO: 306438 - DNA, 25 bp, Homo sapien
tcaaggtttgacatactcccatgga

SEQ ID NO: 306439 - DNA, 25 bp, Homo sapien
gacatactcccatggaccccaaagt

SEQ ID NO: 306440 - DNA, 25 bp, Homo sapien
cctgatcagtctcggcccagaggaa

SEQ ID NO: 306441 - DNA, 25 bp, Homo sapien
aatgaagggcttgagcttctgcttt

SEQ ID NO: 306442 - DNA, 25 bp, Homo sapien
gagcttctgcttttacaaatctgag

SEQ ID NO: 306443 - DNA, 25 bp, Homo sapien
aatgaaatcccactagcagtctgcg

SEQ ID NO: 306444 - DNA, 25 bp, Homo sapien
gcagtctgcgtagtggagttgaacc

SEQ ID NO: 306445 - DNA, 25 bp, Homo sapien
tagtggagttgaaccctagcacccg

SEQ ID NO: 306446 - DNA, 25 bp, Homo sapien
acaacgcgttccaggtgggcaggct

SEQ ID NO: 306447 - DNA, 25 bp, Homo sapien
cacactgggagagggctcagccaac

SEQ ID NO: 306448 - DNA, 25 bp, Homo sapien
gggctcagccaaccacaaggtgata

SEQ ID NO: 306449 - DNA, 25 bp, Homo sapien
gataacgaggtcagcggagcaccag

SEQ ID NO: 306450 - DNA, 25 bp, Homo sapien
ggagcaccagaaaccggctcactag

SEQ ID NO: 306451 - DNA, 25 bp, Homo sapien
ggagtgtgttcagtcctggagacat

SEQ ID NO: 306452 - DNA, 25 bp, Homo sapien
gttcagtcctggagacatgggagct

SEQ ID NO: 306453 - DNA, 25 bp, Homo sapien
taggatattttgaaccaggagggtt

SEQ ID NO: 306454 - DNA, 25 bp, Homo sapien
ccaggagggtttcagaattcctctt

SEQ ID NO: 306455 - DNA, 25 bp, Homo sapien
tcaaggccatctgggtacgtggact

SEQ ID NO: 306456 - DNA, 25 bp, Homo sapien
tacgtggactgcaaagcacctggca

SEQ ID NO: 306457 - DNA, 25 bp, Homo sapien
gagctgggaagaggctgatactctc

SEQ ID NO: 306458 - DNA, 25 bp, Homo sapien
tccctgtgcccacgaagttactgtg

SEQ ID NO: 306459 - DNA, 25 bp, Homo sapien
agttactgtgctccatgttgtgcat

SEQ ID NO: 306460 - DNA, 25 bp, Homo sapien
tgttgtgcatggctcttctcctcac

SEQ ID NO: 306461 - DNA, 25 bp, Homo sapien
tgatactctcagatgccgtggagtt

SEQ ID NO: 306462 - DNA, 25 bp, Homo sapien
gctcttcttgattttgctagctaag

SEQ ID NO: 306463 - DNA, 25 bp, Homo sapien
ttgctagctaagagtaaagtggtta

SEQ ID NO: 306464 - DNA, 25 bp, Homo sapien
gtccctccctggctatagggcagct

SEQ ID NO: 306465 - DNA, 25 bp, Homo sapien
tagggcagctaggtttcacttactc

SEQ ID NO: 306466 - DNA, 25 bp, Homo sapien
ttcacttactcctctctacaagaga

SEQ ID NO: 306467 - DNA, 25 bp, Homo sapien
tcatcttttcctcctagggttgaag

SEQ ID NO: 306468 - DNA, 25 bp, Homo sapien
tcctcctagggttgaagactgactg

SEQ ID NO: 306469 - DNA, 25 bp, Homo sapien
agactgactgagacaatgcccctgc

SEQ ID NO: 306470 - DNA, 25 bp, Homo sapien
gagacaatgcccctgcacagtgttc

SEQ ID NO: 306471 - DNA, 25 bp, Homo sapien
ccctgcacagtgttccattttatat

SEQ ID NO: 306472 - DNA, 25 bp, Homo sapien
tatttagtcatgaacaaacaacttc

SEQ ID NO: 306473 - DNA, 25 bp, Homo sapien
gcatattaagatgtctggctgggca

SEQ ID NO: 306474 - DNA, 25 bp, Homo sapien
tattaagatgtctggctgggcatgg

SEQ ID NO: 306475 - DNA, 25 bp, Homo sapien
gcctagaagttggagactaacctgg

SEQ ID NO: 306476 - DNA, 25 bp, Homo sapien
gaagttggagactaacctggcgaga

SEQ ID NO: 306477 - DNA, 25 bp, Homo sapien
agttggagactaacctggcgagacc

SEQ ID NO: 306478 - DNA, 25 bp, Homo sapien
ttggagactaacctggcgagaccct

SEQ ID NO: 306479 - DNA, 25 bp, Homo sapien
ggagactaacctggcgagaccctgt

SEQ ID NO: 306480 - DNA, 25 bp, Homo sapien
gagggaatcttctctacctctacaa

SEQ ID NO: 306481 - DNA, 25 bp, Homo sapien
ggaatcttctctacctctacaaaat

SEQ ID NO: 306482 - DNA, 25 bp, Homo sapien
aatcttctctacctctacaaaatca

SEQ ID NO: 306483 - DNA, 25 bp, Homo sapien
tctacaaaatcaacacttaacactt

SEQ ID NO: 306484 - DNA, 25 bp, Homo sapien
aaagtgaaggaaacgtctcaagtga

SEQ ID NO: 306485 - DNA, 25 bp, Homo sapien
tttggtccacactgagattctgaag

SEQ ID NO: 306486 - DNA, 25 bp, Homo sapien
gtccacactgagattctgaagcttt

SEQ ID NO: 306487 - DNA, 25 bp, Homo sapien
ggcaggaaaggtattcctctttgtt

SEQ ID NO: 306488 - DNA, 25 bp, Homo sapien
ttgttaacctataagctgcccgtgg

SEQ ID NO: 306489 - DNA, 25 bp, Homo sapien
ataagctgcccgtggcagacgttta

SEQ ID NO: 306490 - DNA, 25 bp, Homo sapien
tggcagacgtttaccctctatcaca

SEQ ID NO: 306491 - DNA, 25 bp, Homo sapien
cctctatcacagacctttcacaaat

SEQ ID NO: 306492 - DNA, 25 bp, Homo sapien
gtgaagcataactttaacctggaag

SEQ ID NO: 306493 - DNA, 25 bp, Homo sapien
aagaatacagcctttctcagtgcac

SEQ ID NO: 306494 - DNA, 25 bp, Homo sapien
gtgcacactggagaaggtattctta

SEQ ID NO: 306495 - DNA, 25 bp, Homo sapien
cggctcctgtacctaagaggtctaa

SEQ ID NO: 306496 - DNA, 25 bp, Homo sapien
aagggtccacaattgaaatcacaga

SEQ ID NO: 306497 - DNA, 25 bp, Homo sapien
aaatcgcaaggctcggaggtcttct

SEQ ID NO: 306498 - DNA, 25 bp, Homo sapien
gaggtcttctgcttcttcagaggtc

SEQ ID NO: 306499 - DNA, 25 bp, Homo sapien
tcagaggtcctgtttttctccttga

SEQ ID NO: 306500 - DNA, 25 bp, Homo sapien
tctccttgacatccttaaatgctcc

SEQ ID NO: 306501 - DNA, 25 bp, Homo sapien
aaaatgtgacatattcctcagctta

SEQ ID NO: 306502 - DNA, 25 bp, Homo sapien
tgctccatagtaagcgcgataaatt

SEQ ID NO: 306503 - DNA, 25 bp, Homo sapien
tattcctcagcttaccacagagtga

SEQ ID NO: 306504 - DNA, 25 bp, Homo sapien
aacactgtcacagactggattccat

SEQ ID NO: 306505 - DNA, 25 bp, Homo sapien
gttagtggaattgctgcaccggctc

SEQ ID NO: 306506 - DNA, 25 bp, Homo sapien
gcgagagctatgtaatgcaaggcat

SEQ ID NO: 306507 - DNA, 25 bp, Homo sapien
aaggcatatgcctgatgaagtatac

SEQ ID NO: 306508 - DNA, 25 bp, Homo sapien
agtatacaaatacacctgaccagaa

SEQ ID NO: 306509 - DNA, 25 bp, Homo sapien
ttgtctcccacataagtctcttcta

SEQ ID NO: 306510 - DNA, 25 bp, Homo sapien
ataagtctcttctaggcactgtcgg

SEQ ID NO: 306511 - DNA, 25 bp, Homo sapien
ctgtgcctcagaataaccattgtcc

SEQ ID NO: 306512 - DNA, 25 bp, Homo sapien
tgtcctggtgttcatatccttagag

SEQ ID NO: 306513 - DNA, 25 bp, Homo sapien
gttggatatccatttaataggttcc

SEQ ID NO: 306514 - DNA, 25 bp, Homo sapien
aataggttccaggttatcttagttg

SEQ ID NO: 306515 - DNA, 25 bp, Homo sapien
atgagctcttttggcaatccgtcat

SEQ ID NO: 306516 - DNA, 25 bp, Homo sapien
ggcaatccgtcatcagtatattctg

SEQ ID NO: 306517 - DNA, 25 bp, Homo sapien
aaagtattagtcattctgaggatta

SEQ ID NO: 306518 - DNA, 25 bp, Homo sapien
tgctttaagtattagctccctacta

SEQ ID NO: 306519 - DNA, 25 bp, Homo sapien
tattagctccctactacatccataa

SEQ ID NO: 306520 - DNA, 25 bp, Homo sapien
tacatccataacaccctacttacta

SEQ ID NO: 306521 - DNA, 25 bp, Homo sapien
tttaattacacacaacttttcaaga

SEQ ID NO: 306522 - DNA, 25 bp, Homo sapien
agggaggtacctgtctactttatct

SEQ ID NO: 306523 - DNA, 25 bp, Homo sapien
ggtacctgtctactttatctacaat

SEQ ID NO: 306524 - DNA, 25 bp, Homo sapien
ttggctttctctaatccatgcaaac

SEQ ID NO: 306525 - DNA, 25 bp, Homo sapien
actacaaattccatcgggagtccta

SEQ ID NO: 306526 - DNA, 25 bp, Homo sapien
gggagtcctacatcactaacagtgg

SEQ ID NO: 306527 - DNA, 25 bp, Homo sapien
gaaagtacttcctatccacatgtga

SEQ ID NO: 306528 - DNA, 25 bp, Homo sapien
ggagtactctgatagcattggtttc

SEQ ID NO: 306529 - DNA, 25 bp, Homo sapien
attggtttcatttctcatgtcgtcc

SEQ ID NO: 306530 - DNA, 25 bp, Homo sapien
atttctcatgtcgtcctggcaagca

SEQ ID NO: 306531 - DNA, 25 bp, Homo sapien
gtcctggcaagcataattttgtagt

SEQ ID NO: 306532 - DNA, 25 bp, Homo sapien
atctcagtttcaggtagaagctgca

SEQ ID NO: 306533 - DNA, 25 bp, Homo sapien
agagagcagcctacccacaaaaggg

SEQ ID NO: 306534 - DNA, 25 bp, Homo sapien
agtctatatgtttgctcatctctgc

SEQ ID NO: 306535 - DNA, 25 bp, Homo sapien
atatgtttgctcatctctgcactgt

SEQ ID NO: 306536 - DNA, 25 bp, Homo sapien
aaggagcgtgtagtccaagtggaaa

SEQ ID NO: 306537 - DNA, 25 bp, Homo sapien
aagtggaaagccaggatagacagct

SEQ ID NO: 306538 - DNA, 25 bp, Homo sapien
agacagctggtaaaactcgcccatc

SEQ ID NO: 306539 - DNA, 25 bp, Homo sapien
aactgcagtcctacagccacgggaa

SEQ ID NO: 306540 - DNA, 25 bp, Homo sapien
gccacgggaactgaattcagcccat

SEQ ID NO: 306541 - DNA, 25 bp, Homo sapien
gaattcagcccataagctcattcat

SEQ ID NO: 306542 - DNA, 25 bp, Homo sapien
agctcattcataggcttggaaaggc

SEQ ID NO: 306543 - DNA, 25 bp, Homo sapien
tggaaaggcattcatctccagtctc

SEQ ID NO: 306544 - DNA, 25 bp, Homo sapien
cattcatctccagtctccagataag

SEQ ID NO: 306545 - DNA, 25 bp, Homo sapien
agcctggccaacactttgaatccag

SEQ ID NO: 306546 - DNA, 25 bp, Homo sapien
actttgaatccagccttgtgagacc

SEQ ID NO: 306547 - DNA, 25 bp, Homo sapien
tgtgagaccctaagccgagaactca

SEQ ID NO: 306548 - DNA, 25 bp, Homo sapien
gagaactcacttaagcctgcttgga

SEQ ID NO: 306549 - DNA, 25 bp, Homo sapien
ttaagcctgcttggacttctgacct

SEQ ID NO: 306550 - DNA, 25 bp, Homo sapien
gctcattttgacaaacgcagagtca

SEQ ID NO: 306551 - DNA, 25 bp, Homo sapien
caaacgcagagtcatgtacccatca

SEQ ID NO: 306552 - DNA, 25 bp, Homo sapien
gcagagtcatgtacccatcactaca

SEQ ID NO: 306553 - DNA, 25 bp, Homo sapien
gtcatgtacccatcactacaatcaa

SEQ ID NO: 306554 - DNA, 25 bp, Homo sapien
gtacccatcactacaatcaagttac

SEQ ID NO: 306555 - DNA, 25 bp, Homo sapien
atcaagttacagaccatctccataa

SEQ ID NO: 306556 - DNA, 25 bp, Homo sapien
agaccatctccataactccaaagaa

SEQ ID NO: 306557 - DNA, 25 bp, Homo sapien
taactccaaagaattccacacactc

SEQ ID NO: 306558 - DNA, 25 bp, Homo sapien
agaattccacacactccattgtagc

SEQ ID NO: 306559 - DNA, 25 bp, Homo sapien
acactccattgtagcccacggacaa

SEQ ID NO: 306560 - DNA, 25 bp, Homo sapien
cattgtagcccacggacaacaccag

SEQ ID NO: 306561 - DNA, 25 bp, Homo sapien
tttgcccacgatttcagggaaccta

SEQ ID NO: 306562 - DNA, 25 bp, Homo sapien
tgttggctgtttttcgtcactgctt

SEQ ID NO: 306563 - DNA, 25 bp, Homo sapien
gtcactgctttttaagctgaatctt

SEQ ID NO: 306564 - DNA, 25 bp, Homo sapien
gctgaatcttagctggttttcttga

SEQ ID NO: 306565 - DNA, 25 bp, Homo sapien
aaattcaaccagacattctctcctt

SEQ ID NO: 306566 - DNA, 25 bp, Homo sapien
attctctccttactgtggtcagctg

SEQ ID NO: 306567 - DNA, 25 bp, Homo sapien
tggtcagctgacatcataaccacta

SEQ ID NO: 306568 - DNA, 25 bp, Homo sapien
gaacctaggaggcttcctggccttg

SEQ ID NO: 306569 - DNA, 25 bp, Homo sapien
gtgaccttttccttgaatctcttat

SEQ ID NO: 306570 - DNA, 25 bp, Homo sapien
ttctttctacctgtgttgcatggca

SEQ ID NO: 306571 - DNA, 25 bp, Homo sapien
gttgcatggcagattctcagattga

SEQ ID NO: 306572 - DNA, 25 bp, Homo sapien
agctgtgattacagggaacccgttg

SEQ ID NO: 306573 - DNA, 25 bp, Homo sapien
agggaacccgttgttgctcagacac

SEQ ID NO: 306574 - DNA, 25 bp, Homo sapien
tgttgctcagacacccgatgtggaa

SEQ ID NO: 306575 - DNA, 25 bp, Homo sapien
agacacccgatgtggaaatttttct

SEQ ID NO: 306576 - DNA, 25 bp, Homo sapien
ttcttctccctcagttcaaatgaga

SEQ ID NO: 306577 - DNA, 25 bp, Homo sapien
tcaaatgagataaagatcctcctct

SEQ ID NO: 306578 - DNA, 25 bp, Homo sapien
gtgaacatgaggtcacagtgtccat

SEQ ID NO: 306579 - DNA, 25 bp, Homo sapien
gaggtcacagtgtccatgtaactaa

SEQ ID NO: 306580 - DNA, 25 bp, Homo sapien
gtgtccatgtaactaactcctggtt

SEQ ID NO: 306581 - DNA, 25 bp, Homo sapien
aaggcacatgttcaacttctggctt

SEQ ID NO: 306582 - DNA, 25 bp, Homo sapien
ttcaacttctggcttctgtccttga

SEQ ID NO: 306583 - DNA, 25 bp, Homo sapien
aatgggaagattggactcatgctgt

SEQ ID NO: 306584 - DNA, 25 bp, Homo sapien
gaatatttatttcagcctaatgagg

SEQ ID NO: 306585 - DNA, 25 bp, Homo sapien
gcctaatgaggtgttttgtgtttat

SEQ ID NO: 306586 - DNA, 25 bp, Homo sapien
tttttaagctaaatctccactgaga

SEQ ID NO: 306587 - DNA, 25 bp, Homo sapien
tctccactgagagtatagatattga

SEQ ID NO: 306588 - DNA, 25 bp, Homo sapien
gatattgatgctagtggctgctggt

SEQ ID NO: 306589 - DNA, 25 bp, Homo sapien
ggctgctggttttagttccacttca

SEQ ID NO: 306590 - DNA, 25 bp, Homo sapien
tggttttagttccacttcaccttat

SEQ ID NO: 306591 - DNA, 25 bp, Homo sapien
gttccacttcaccttataatggctt

SEQ ID NO: 306592 - DNA, 25 bp, Homo sapien
gcttgtgttcgatttagggctatat

SEQ ID NO: 306593 - DNA, 25 bp, Homo sapien
gatttagggctatatggacagtgtt

SEQ ID NO: 306594 - DNA, 25 bp, Homo sapien
gctacagagtaaaaacaaccaaatg

SEQ ID NO: 306595 - DNA, 25 bp, Homo sapien
tgattcttacagtgttgagccaaag

SEQ ID NO: 306596 - DNA, 25 bp, Homo sapien
ttacagtgttgagccaaagaagtca

SEQ ID NO: 306597 - DNA, 25 bp, Homo sapien
gaatattgtgtaattgcattcatat

SEQ ID NO: 306598 - DNA, 25 bp, Homo sapien
gatggatgcttatgcagtaaaactt

SEQ ID NO: 306599 - DNA, 25 bp, Homo sapien
gaagtgttaccatatatggacggca

SEQ ID NO: 306600 - DNA, 25 bp, Homo sapien
tatggacggcagttacctttcttgg

SEQ ID NO: 306601 - DNA, 25 bp, Homo sapien
accaaatgtgcatcatagtaaaact

SEQ ID NO: 306602 - DNA, 25 bp, Homo sapien
taggcatctggaatatgatgcaatc

SEQ ID NO: 306603 - DNA, 25 bp, Homo sapien
tgatgcaatcatacggatgactgat

SEQ ID NO: 306604 - DNA, 25 bp, Homo sapien
cggatgactgatttatggctacaca

SEQ ID NO: 306605 - DNA, 25 bp, Homo sapien
catcctagcccagggtcagtgtcat

SEQ ID NO: 306606 - DNA, 25 bp, Homo sapien
gtcagtgtcattcccttcaccttag

SEQ ID NO: 306607 - DNA, 25 bp, Homo sapien
cttagcctctcactgcccaaagagg

SEQ ID NO: 306608 - DNA, 25 bp, Homo sapien
gcccaaagaggcttacttttcttct

SEQ ID NO: 306609 - DNA, 25 bp, Homo sapien
gaaacggaaagcaagggcacctgat

SEQ ID NO: 306610 - DNA, 25 bp, Homo sapien
gaaagcaagggcacctgatggttca

SEQ ID NO: 306611 - DNA, 25 bp, Homo sapien
tgatggttcagtgcagcttcaggtt

SEQ ID NO: 306612 - DNA, 25 bp, Homo sapien
ttcagtgcagcttcaggttagaggg

SEQ ID NO: 306613 - DNA, 25 bp, Homo sapien
gggtaagccatgtgccctggaagca

SEQ ID NO: 306614 - DNA, 25 bp, Homo sapien
tgccctggaagcactgcagggagcc

SEQ ID NO: 306615 - DNA, 25 bp, Homo sapien
tgcagggagcctcagatttgcaccc

SEQ ID NO: 306616 - DNA, 25 bp, Homo sapien
tgcccttggaagatctgacccgaat

SEQ ID NO: 306617 - DNA, 25 bp, Homo sapien
gatctgacccgaatcaatgaagaaa

SEQ ID NO: 306618 - DNA, 25 bp, Homo sapien
atcgagaagtttgacatcagtgaca

SEQ ID NO: 306619 - DNA, 25 bp, Homo sapien
gtgacaatgctgaccggctcgagga

SEQ ID NO: 306620 - DNA, 25 bp, Homo sapien
atgacatcagtgtgatctctgtagt

SEQ ID NO: 306621 - DNA, 25 bp, Homo sapien
gaaggaaattctggccgtggtcaga

SEQ ID NO: 306622 - DNA, 25 bp, Homo sapien
aactggcctgaaagtgtctttgcaa

SEQ ID NO: 306623 - DNA, 25 bp, Homo sapien
gggaatggactcctctcctcagggt

SEQ ID NO: 306624 - DNA, 25 bp, Homo sapien
tatgagtcatcagatctacccctca

SEQ ID NO: 306625 - DNA, 25 bp, Homo sapien
agatctacccctcatgaagttgcct

SEQ ID NO: 306626 - DNA, 25 bp, Homo sapien
cactacctctggtacctgtaaaggt

SEQ ID NO: 306627 - DNA, 25 bp, Homo sapien
gttaagattccattagatagtacat

SEQ ID NO: 306628 - DNA, 25 bp, Homo sapien
agatagtacatttctcaaagatttt

SEQ ID NO: 306629 - DNA, 25 bp, Homo sapien
tgaggttgtatttgctttaccaaaa

SEQ ID NO: 306630 - DNA, 25 bp, Homo sapien
gcatgttgcaaaataacttggtgtc

SEQ ID NO: 306631 - DNA, 25 bp, Homo sapien
acttggtgtctatgattcagtttat

SEQ ID NO: 306632 - DNA, 25 bp, Homo sapien
gatgtacatcaatttgctaacaatg

SEQ ID NO: 306633 - DNA, 25 bp, Homo sapien
taacaatggttatctctgacgtggt

SEQ ID NO: 306634 - DNA, 25 bp, Homo sapien
gttatctctgacgtggtgggatttg

SEQ ID NO: 306635 - DNA, 25 bp, Homo sapien
ggtgggatttgagatgtgtttttct

SEQ ID NO: 306636 - DNA, 25 bp, Homo sapien
gttgtatttttctctattgtttgac

SEQ ID NO: 306637 - DNA, 25 bp, Homo sapien
ttctctattgtttgacttaacacag

SEQ ID NO: 306638 - DNA, 25 bp, Homo sapien
ccggcacaggccgtgtcagtttcaa

SEQ ID NO: 306639 - DNA, 25 bp, Homo sapien
ggcacaggccgtgtcagtttcaact

SEQ ID NO: 306640 - DNA, 25 bp, Homo sapien
gcacaggccgtgtcagtttcaactt

SEQ ID NO: 306641 - DNA, 25 bp, Homo sapien
cacaggccgtgtcagtttcaacttg

SEQ ID NO: 306642 - DNA, 25 bp, Homo sapien
acaggccgtgtcagtttcaacttgg

SEQ ID NO: 306643 - DNA, 25 bp, Homo sapien
caggccgtgtcagtttcaacttggg

SEQ ID NO: 306644 - DNA, 25 bp, Homo sapien
gccgtgtcagtttcaacttggggat

SEQ ID NO: 306645 - DNA, 25 bp, Homo sapien
agggcgcgcaggacggccggtcccg

SEQ ID NO: 306646 - DNA, 25 bp, Homo sapien
gggactctctgtccagcacctcggg

SEQ ID NO: 306647 - DNA, 25 bp, Homo sapien
aagggctccagagagccgtgcacgc

SEQ ID NO: 306648 - DNA, 25 bp, Homo sapien
ccagagagccgtgcacgcgggaggg

SEQ ID NO: 306649 - DNA, 25 bp, Homo sapien
ttttaagaaaactactgctcagtaa

SEQ ID NO: 306650 - DNA, 25 bp, Homo sapien
gtttaaaccatttctggtagctaat

SEQ ID NO: 306651 - DNA, 25 bp, Homo sapien
aaccatttctggtagctaatgacaa

SEQ ID NO: 306652 - DNA, 25 bp, Homo sapien
gttgtttacagtacaaatacttgta

SEQ ID NO: 306653 - DNA, 25 bp, Homo sapien
cagtatttccaatgtcgcagtaatt

SEQ ID NO: 306654 - DNA, 25 bp, Homo sapien
ttccaatgtcgcagtaatttagtaa

SEQ ID NO: 306655 - DNA, 25 bp, Homo sapien
aatttagtaaaactctgtggctgcc

SEQ ID NO: 306656 - DNA, 25 bp, Homo sapien
tgtggctgccttgattttgacagat

SEQ ID NO: 306657 - DNA, 25 bp, Homo sapien
ggctgccttgattttgacagatttt

SEQ ID NO: 306658 - DNA, 25 bp, Homo sapien
aaaagagaaaacagtgcctcatgtt

SEQ ID NO: 306659 - DNA, 25 bp, Homo sapien
gaaaacagtgcctcatgttttaaga

SEQ ID NO: 306660 - DNA, 25 bp, Homo sapien
gggacggttgtatatcaaggtacta

SEQ ID NO: 306661 - DNA, 25 bp, Homo sapien
tcaaggtactactgcaaacatattg

SEQ ID NO: 306662 - DNA, 25 bp, Homo sapien
gctgatgttcctcttctatcaaatg

SEQ ID NO: 306663 - DNA, 25 bp, Homo sapien
tgagagatgccaacagcagatgcca

SEQ ID NO: 306664 - DNA, 25 bp, Homo sapien
atatgatatgtgcaggctatgaaga

SEQ ID NO: 306665 - DNA, 25 bp, Homo sapien
gattcaggaggaccattaatgtgcc

SEQ ID NO: 306666 - DNA, 25 bp, Homo sapien
acaacaggtggttccttgctggtgt

SEQ ID NO: 306667 - DNA, 25 bp, Homo sapien
gctggtgtgacctcatttggataca

SEQ ID NO: 306668 - DNA, 25 bp, Homo sapien
tttggatacaagtgtgccctgccta

SEQ ID NO: 306669 - DNA, 25 bp, Homo sapien
taatcgccccggagtgtatgccagg

SEQ ID NO: 306670 - DNA, 25 bp, Homo sapien
cccggagtgtatgccagggtctcaa

SEQ ID NO: 306671 - DNA, 25 bp, Homo sapien
caggagctttactgaaagacttggt

SEQ ID NO: 306672 - DNA, 25 bp, Homo sapien
agctttactgaaagacttggttatc

SEQ ID NO: 306673 - DNA, 25 bp, Homo sapien
agacttggttatcaagtcttttggg

SEQ ID NO: 306674 - DNA, 25 bp, Homo sapien
caacctccacctcttataaatttct

SEQ ID NO: 306675 - DNA, 25 bp, Homo sapien
cctccacctcttataaatttcttca

SEQ ID NO: 306676 - DNA, 25 bp, Homo sapien
tccacctcttataaatttcttcatt

SEQ ID NO: 306677 - DNA, 25 bp, Homo sapien
tttaatggtaaaatacacgtaacat

SEQ ID NO: 306678 - DNA, 25 bp, Homo sapien
aaccattttactaataagtgtacag

SEQ ID NO: 306679 - DNA, 25 bp, Homo sapien
attttactaataagtgtacagttca

SEQ ID NO: 306680 - DNA, 25 bp, Homo sapien
ttcagtgatattaagtacatttgca

SEQ ID NO: 306681 - DNA, 25 bp, Homo sapien
catcactaccaccaacctccagaac

SEQ ID NO: 306682 - DNA, 25 bp, Homo sapien
gagatcacaggcataacctgccgcg

SEQ ID NO: 306683 - DNA, 25 bp, Homo sapien
tccaggcttcctaagttcatttaaa

SEQ ID NO: 306684 - DNA, 25 bp, Homo sapien
caggcttcctaagttcatttaaagg

SEQ ID NO: 306685 - DNA, 25 bp, Homo sapien
aaaggcgaatttatctattagtaat

SEQ ID NO: 306686 - DNA, 25 bp, Homo sapien
atctattagtaatgacggctgacga

SEQ ID NO: 306687 - DNA, 25 bp, Homo sapien
taatgacggctgacgagtgatggca

SEQ ID NO: 306688 - DNA, 25 bp, Homo sapien
ttttgtagagtcgggctgttgcccg

SEQ ID NO: 306689 - DNA, 25 bp, Homo sapien
gatgaaaaatgaaccttcgcctgta

SEQ ID NO: 306690 - DNA, 25 bp, Homo sapien
gaaaaatgaaccttcgcctgtaatc

SEQ ID NO: 306691 - DNA, 25 bp, Homo sapien
ctcaaactcctctaactcaaactaa

SEQ ID NO: 306692 - DNA, 25 bp, Homo sapien
tcctctaactcaaactaaaaagcca

SEQ ID NO: 306693 - DNA, 25 bp, Homo sapien
gcgtacctggactggccgccgtaca

SEQ ID NO: 306694 - DNA, 25 bp, Homo sapien
gtacaggcggccctggaggacatgg

SEQ ID NO: 306695 - DNA, 25 bp, Homo sapien
cctggaggacatgggcgacaagccc

SEQ ID NO: 306696 - DNA, 25 bp, Homo sapien
gggctcccgggactggatcggctgc

SEQ ID NO: 306697 - DNA, 25 bp, Homo sapien
tcgctcacttcggagggccccagga

SEQ ID NO: 306698 - DNA, 25 bp, Homo sapien
agctggagaggctttactcgcacat

SEQ ID NO: 306699 - DNA, 25 bp, Homo sapien
tggagaggctttactcgcacattcg

SEQ ID NO: 306700 - DNA, 25 bp, Homo sapien
gagaggctttactcgcacattcgca

SEQ ID NO: 306701 - DNA, 25 bp, Homo sapien
ggctttactcgcacattcgcacggg

SEQ ID NO: 306702 - DNA, 25 bp, Homo sapien
atgccaggtccaaggccttgctggg

SEQ ID NO: 306703 - DNA, 25 bp, Homo sapien
tgccaggtccaaggccttgctggga

SEQ ID NO: 306704 - DNA, 25 bp, Homo sapien
aagatgctgaatatggcctggcaat

SEQ ID NO: 306705 - DNA, 25 bp, Homo sapien
ggcctggcaattaatgaattccttt

SEQ ID NO: 306706 - DNA, 25 bp, Homo sapien
tgaattcctttatcctaataacgaa

SEQ ID NO: 306707 - DNA, 25 bp, Homo sapien
aaacaaacgaatccctgcaactgct

SEQ ID NO: 306708 - DNA, 25 bp, Homo sapien
cctgcaactgctgtaactatagata

SEQ ID NO: 306709 - DNA, 25 bp, Homo sapien
gaaacattaaccaagttcacaaaag

SEQ ID NO: 306710 - DNA, 25 bp, Homo sapien
gtaatgcaagattaaccgagctcaa

SEQ ID NO: 306711 - DNA, 25 bp, Homo sapien
aagcactttattgtgttatctacaa

SEQ ID NO: 306712 - DNA, 25 bp, Homo sapien
ctacaagatcagtgtgaaactcatc

SEQ ID NO: 306713 - DNA, 25 bp, Homo sapien
gaaactcatcaatcaactactgcgt

SEQ ID NO: 306714 - DNA, 25 bp, Homo sapien
tcaatcaactactgcgttcaacaaa

SEQ ID NO: 306715 - DNA, 25 bp, Homo sapien
gcaggccgatccttacattcgaggc

SEQ ID NO: 306716 - DNA, 25 bp, Homo sapien
aggccgatccttacattcgaggccg

SEQ ID NO: 306717 - DNA, 25 bp, Homo sapien
gctctggcccgttgcggtctctgtg

SEQ ID NO: 306718 - DNA, 25 bp, Homo sapien
ttgcggtctctgtggcccgcgcgac

SEQ ID NO: 306719 - DNA, 25 bp, Homo sapien
gatccttacattcgaggccggccca

SEQ ID NO: 306720 - DNA, 25 bp, Homo sapien
ccagcgacgccgtgtggtccgtgct

SEQ ID NO: 306721 - DNA, 25 bp, Homo sapien
tgtggtccgtgctccgctctgtggc

SEQ ID NO: 306722 - DNA, 25 bp, Homo sapien
gagaaactgctgagagtccggcccg

SEQ ID NO: 306723 - DNA, 25 bp, Homo sapien
gaaactgctgagagtccggcccggc

SEQ ID NO: 306724 - DNA, 25 bp, Homo sapien
tcacccgcgcaggacctcggtggga

SEQ ID NO: 306725 - DNA, 25 bp, Homo sapien
ggacctcggtgggagcgcgcacgtg

SEQ ID NO: 306726 - DNA, 25 bp, Homo sapien
ttagctatttcacttggggcaacat

SEQ ID NO: 306727 - DNA, 25 bp, Homo sapien
gggcaacatttaatctccaagatta

SEQ ID NO: 306728 - DNA, 25 bp, Homo sapien
atctcatttttatgtatcatcttta

SEQ ID NO: 306729 - DNA, 25 bp, Homo sapien
atcatctttaagacaaattgttaag

SEQ ID NO: 306730 - DNA, 25 bp, Homo sapien
aagtgaagtgtttttgctttctgcc

SEQ ID NO: 306731 - DNA, 25 bp, Homo sapien
tttgctttctgccaagagtcattaa

SEQ ID NO: 306732 - DNA, 25 bp, Homo sapien
tttctgccaagagtcattaaatgat

SEQ ID NO: 306733 - DNA, 25 bp, Homo sapien
gatatagcaagtatttgggtctctc

SEQ ID NO: 306734 - DNA, 25 bp, Homo sapien
tatagcaagtatttgggtctctctt

SEQ ID NO: 306735 - DNA, 25 bp, Homo sapien
tttgggtctctcttggtgttatcag

SEQ ID NO: 306736 - DNA, 25 bp, Homo sapien
gtctctcttggtgttatcaggatta

SEQ ID NO: 306737 - DNA, 25 bp, Homo sapien
aaggccgtggactgcttcacagctg

SEQ ID NO: 306738 - DNA, 25 bp, Homo sapien
cagcgttcgtcccaatgactatttg

SEQ ID NO: 306739 - DNA, 25 bp, Homo sapien
cccaatgactatttgctgtggaata

SEQ ID NO: 306740 - DNA, 25 bp, Homo sapien
tggaataagctaggcgccaccctgg

SEQ ID NO: 306741 - DNA, 25 bp, Homo sapien
ctaggcgccaccctggccaatggaa

SEQ ID NO: 306742 - DNA, 25 bp, Homo sapien
aaaccagagtgaagaagcagtagct

SEQ ID NO: 306743 - DNA, 25 bp, Homo sapien
agaagcagtagctgcgtaccgccgg

SEQ ID NO: 306744 - DNA, 25 bp, Homo sapien
gagctccagcctggctatatccggt

SEQ ID NO: 306745 - DNA, 25 bp, Homo sapien
agcctggctatatccggtcccgcta

SEQ ID NO: 306746 - DNA, 25 bp, Homo sapien
ctggaggccctgaacatgcagagga

SEQ ID NO: 306747 - DNA, 25 bp, Homo sapien
ggaggtgccatgtcggagaacatct

SEQ ID NO: 306748 - DNA, 25 bp, Homo sapien
actgaaagacttggttatcaagtct

SEQ ID NO: 306749 - DNA, 25 bp, Homo sapien
ctgaaagacttggttatcaagtctt

SEQ ID NO: 306750 - DNA, 25 bp, Homo sapien
gaaagacttggttatcaagtctttt

SEQ ID NO: 306751 - DNA, 25 bp, Homo sapien
aagacttggttatcaagtcttttgg

SEQ ID NO: 306752 - DNA, 25 bp, Homo sapien
agacttggttatcaagtcttttggg

SEQ ID NO: 306753 - DNA, 25 bp, Homo sapien
cttggttatcaagtcttttggggag

SEQ ID NO: 306754 - DNA, 25 bp, Homo sapien
ttggttatcaagtcttttggggaga

SEQ ID NO: 306755 - DNA, 25 bp, Homo sapien
tggttatcaagtcttttggggagag

SEQ ID NO: 306756 - DNA, 25 bp, Homo sapien
tttttgtcttcccactgatagtctt

SEQ ID NO: 306757 - DNA, 25 bp, Homo sapien
gtcttcccactgatagtctttggca

SEQ ID NO: 306758 - DNA, 25 bp, Homo sapien
ttcccactgatagtctttggcagct

SEQ ID NO: 306759 - DNA, 25 bp, Homo sapien
actgatagtctttggcagctcttga

SEQ ID NO: 306760 - DNA, 25 bp, Homo sapien
tagtctttggcagctcttgaataaa

SEQ ID NO: 306761 - DNA, 25 bp, Homo sapien
ctttggcagctcttgaataaattct

SEQ ID NO: 306762 - DNA, 25 bp, Homo sapien
gaataaattctacctgttggcatca

SEQ ID NO: 306763 - DNA, 25 bp, Homo sapien
aaattctacctgttggcatcaaggg

SEQ ID NO: 306764 - DNA, 25 bp, Homo sapien
gaaagttgtcttgatattaagtatt

SEQ ID NO: 306765 - DNA, 25 bp, Homo sapien
tattaagtatttactgtgagtccag

SEQ ID NO: 306766 - DNA, 25 bp, Homo sapien
gtgagtccagtaagccaaaggacca

SEQ ID NO: 306767 - DNA, 25 bp, Homo sapien
gtatcatatagtcacttatggttgt

SEQ ID NO: 306768 - DNA, 25 bp, Homo sapien
gtcacttatggttgttgtgttccta

SEQ ID NO: 306769 - DNA, 25 bp, Homo sapien
atggttgttgtgttcctagtactta

SEQ ID NO: 306770 - DNA, 25 bp, Homo sapien
tgttgtgttcctagtacttagtaca

SEQ ID NO: 306771 - DNA, 25 bp, Homo sapien
gtacttagtacaaggtatcggaatt

SEQ ID NO: 306772 - DNA, 25 bp, Homo sapien
atcggaattgttctttagttaatct

SEQ ID NO: 306773 - DNA, 25 bp, Homo sapien
aaatcttggtgtaatcttatcctca

SEQ ID NO: 306774 - DNA, 25 bp, Homo sapien
tggtgtaatcttatcctcatgttca

SEQ ID NO: 306775 - DNA, 25 bp, Homo sapien
ccttgtacttctttgtgcatttgtt

SEQ ID NO: 306776 - DNA, 25 bp, Homo sapien
gtacttctttgtgcatttgtttttt

SEQ ID NO: 306777 - DNA, 25 bp, Homo sapien
aaagttattttgttattgagtgatg

SEQ ID NO: 306778 - DNA, 25 bp, Homo sapien
tacaagcttgagctaccgcgcccag

SEQ ID NO: 306779 - DNA, 25 bp, Homo sapien
ccagccaacacatcacttttatctt

SEQ ID NO: 306780 - DNA, 25 bp, Homo sapien
acacatcacttttatcttgcagctc

SEQ ID NO: 306781 - DNA, 25 bp, Homo sapien
cttgcagctcccgagattctctttt

SEQ ID NO: 306782 - DNA, 25 bp, Homo sapien
tgcagctcccgagattctcttttct

SEQ ID NO: 306783 - DNA, 25 bp, Homo sapien
ccgagattctcttttctgtgacttt

SEQ ID NO: 306784 - DNA, 25 bp, Homo sapien
ctgtgacttttaaaattgtgcttac

SEQ ID NO: 306785 - DNA, 25 bp, Homo sapien
aattgtgcttacatatgtgtttgat

SEQ ID NO: 306786 - DNA, 25 bp, Homo sapien
gtgcttacatatgtgtttgatataa

SEQ ID NO: 306787 - DNA, 25 bp, Homo sapien
atatctttgtattctagtttgtttg

SEQ ID NO: 306788 - DNA, 25 bp, Homo sapien
gtattctagtttgtttgttcagctt

SEQ ID NO: 306789 - DNA, 25 bp, Homo sapien
tgtcttgctaaatatcagccaatta

SEQ ID NO: 306790 - DNA, 25 bp, Homo sapien
tatcagccaattaaggaacctcatt

SEQ ID NO: 306791 - DNA, 25 bp, Homo sapien
ttaaggaacctcattccagagcctc

SEQ ID NO: 306792 - DNA, 25 bp, Homo sapien
tgccgtataggttttagtggcctaa

SEQ ID NO: 306793 - DNA, 25 bp, Homo sapien
ggcctaaattctcctgatttgcctg

SEQ ID NO: 306794 - DNA, 25 bp, Homo sapien
tcctgatttgcctgtaagagtttta

SEQ ID NO: 306795 - DNA, 25 bp, Homo sapien
gcctgtaagagttttagtgacctga

SEQ ID NO: 306796 - DNA, 25 bp, Homo sapien
gtaagagttttagtgacctgaattc

SEQ ID NO: 306797 - DNA, 25 bp, Homo sapien
acctgaattctcctgatttgcctat

SEQ ID NO: 306798 - DNA, 25 bp, Homo sapien
gatttgcctataagaaccgctaatt

SEQ ID NO: 306799 - DNA, 25 bp, Homo sapien
ctaattatcttttctctgttacagg

SEQ ID NO: 306800 - DNA, 25 bp, Homo sapien
acaggcatgagactgcaactggcca

SEQ ID NO: 306801 - DNA, 25 bp, Homo sapien
atgagactgcaactggccacgcctt

SEQ ID NO: 306802 - DNA, 25 bp, Homo sapien
gagactgcaactggccacgcctttt

SEQ ID NO: 306803 - DNA, 25 bp, Homo sapien
accaatgacaatgtaaaagtctgtg

SEQ ID NO: 306804 - DNA, 25 bp, Homo sapien
agaacgatgaaactctttgatgaat

SEQ ID NO: 306805 - DNA, 25 bp, Homo sapien
aagatggaagattagctgagctgaa

SEQ ID NO: 306806 - DNA, 25 bp, Homo sapien
agctgagctgaacttactattgata

SEQ ID NO: 306807 - DNA, 25 bp, Homo sapien
gctgaacttactattgatagcgtgt

SEQ ID NO: 306808 - DNA, 25 bp, Homo sapien
gatagcgtgtaaactggttgcatct

SEQ ID NO: 306809 - DNA, 25 bp, Homo sapien
gcgtgtaaactggttgcatctattt

SEQ ID NO: 306810 - DNA, 25 bp, Homo sapien
aactggttgcatctatttggagttc

SEQ ID NO: 306811 - DNA, 25 bp, Homo sapien
aaggcatctgttgctttgggtcctc

SEQ ID NO: 306812 - DNA, 25 bp, Homo sapien
tttgggtcctccacgactcttaggc

SEQ ID NO: 306813 - DNA, 25 bp, Homo sapien
taggtaggctcaaaggtagacccgt

SEQ ID NO: 306814 - DNA, 25 bp, Homo sapien
gcagcaggtgaacatgaccgtgttt

SEQ ID NO: 306815 - DNA, 25 bp, Homo sapien
gaccgtgttttcaactgtgtccaca

SEQ ID NO: 306816 - DNA, 25 bp, Homo sapien
tttccagattgcaacctggcctgca

SEQ ID NO: 306817 - DNA, 25 bp, Homo sapien
ttcctgctcgtgtcttaacctaagt

SEQ ID NO: 306818 - DNA, 25 bp, Homo sapien
ttgaaacgcctacaaacctccatgt

SEQ ID NO: 306819 - DNA, 25 bp, Homo sapien
tccatgtggtagctcctttggcaaa

SEQ ID NO: 306820 - DNA, 25 bp, Homo sapien
gcaaatgtcctgctgtggcgtttta

SEQ ID NO: 306821 - DNA, 25 bp, Homo sapien
ggcgttttatgtgttgcttggagtc

SEQ ID NO: 306822 - DNA, 25 bp, Homo sapien
ccggcacaggccgtgtcagtttcaa

SEQ ID NO: 306823 - DNA, 25 bp, Homo sapien
cggcacaggccgtgtcagtttcaac

SEQ ID NO: 306824 - DNA, 25 bp, Homo sapien
ggcacaggccgtgtcagtttcaact

SEQ ID NO: 306825 - DNA, 25 bp, Homo sapien
gcacaggccgtgtcagtttcaactt

SEQ ID NO: 306826 - DNA, 25 bp, Homo sapien
cacaggccgtgtcagtttcaacttg

SEQ ID NO: 306827 - DNA, 25 bp, Homo sapien
acaggccgtgtcagtttcaacttgg

SEQ ID NO: 306828 - DNA, 25 bp, Homo sapien
caggccgtgtcagtttcaacttggg

SEQ ID NO: 306829 - DNA, 25 bp, Homo sapien
gccgtgtcagtttcaacttggggat

SEQ ID NO: 306830 - DNA, 25 bp, Homo sapien
agggcgcgcaggacggccggtcccg

SEQ ID NO: 306831 - DNA, 25 bp, Homo sapien
ggacggccggtcccgggactctctg

SEQ ID NO: 306832 - DNA, 25 bp, Homo sapien
gggctccagagagccgtgcacgcgg

SEQ ID NO: 306833 - DNA, 25 bp, Homo sapien
gaattttataatatcaaggcactta

SEQ ID NO: 306834 - DNA, 25 bp, Homo sapien
atatcaaggcacttaatttttagtt

SEQ ID NO: 306835 - DNA, 25 bp, Homo sapien
tcaaggcacttaatttttagttagt

SEQ ID NO: 306836 - DNA, 25 bp, Homo sapien
ttttagttagtgatataccatccaa

SEQ ID NO: 306837 - DNA, 25 bp, Homo sapien
tagttagtgatataccatccaaaag

SEQ ID NO: 306838 - DNA, 25 bp, Homo sapien
gttagtgatataccatccaaaaggc

SEQ ID NO: 306839 - DNA, 25 bp, Homo sapien
gtgatataccatccaaaaggcatct

SEQ ID NO: 306840 - DNA, 25 bp, Homo sapien
tgatataccatccaaaaggcatctg

SEQ ID NO: 306841 - DNA, 25 bp, Homo sapien
ccaaaaggcatctgaggctgggcac

SEQ ID NO: 306842 - DNA, 25 bp, Homo sapien
cccaaagtgctgtatgattgtttta

SEQ ID NO: 306843 - DNA, 25 bp, Homo sapien
caaagtgctgtatgattgttttaaa

SEQ ID NO: 306844 - DNA, 25 bp, Homo sapien
agtgaacttagcacatactgttcca

SEQ ID NO: 306845 - DNA, 25 bp, Homo sapien
atactgttccaaggtccctggccat

SEQ ID NO: 306846 - DNA, 25 bp, Homo sapien
ttcagagtctcctgtgctcatttta

SEQ ID NO: 306847 - DNA, 25 bp, Homo sapien
gtctcctgtgctcattttatatgca

SEQ ID NO: 306848 - DNA, 25 bp, Homo sapien
tatgcaatgtccagggttttcattc

SEQ ID NO: 306849 - DNA, 25 bp, Homo sapien
gtccagggttttcattctacttagt

SEQ ID NO: 306850 - DNA, 25 bp, Homo sapien
ttcattctacttagttgggaagcat

SEQ ID NO: 306851 - DNA, 25 bp, Homo sapien
gggaagcattagaaaatctcctctg

SEQ ID NO: 306852 - DNA, 25 bp, Homo sapien
aatctcctctgaagatttaatctta

SEQ ID NO: 306853 - DNA, 25 bp, Homo sapien
gacatgtttatctatcttgcccatc

SEQ ID NO: 306854 - DNA, 25 bp, Homo sapien
gcatggtctagtgaacttccttctg

SEQ ID NO: 306855 - DNA, 25 bp, Homo sapien
caatattggcaagatacacaaattt

SEQ ID NO: 306856 - DNA, 25 bp, Homo sapien
cacaaattttattcgtgtcattaga

SEQ ID NO: 306857 - DNA, 25 bp, Homo sapien
tcgtgtcattagagtaattctgtaa

SEQ ID NO: 306858 - DNA, 25 bp, Homo sapien
gaagcaacatagtacaaattcataa

SEQ ID NO: 306859 - DNA, 25 bp, Homo sapien
aaattcataattttccatcacctga

SEQ ID NO: 306860 - DNA, 25 bp, Homo sapien
cataattttccatcacctgaaattg

SEQ ID NO: 306861 - DNA, 25 bp, Homo sapien
tcacctgaaattgcaagttaacttt

SEQ ID NO: 306862 - DNA, 25 bp, Homo sapien
tgcaagttaactttgtcttttttgc

SEQ ID NO: 306863 - DNA, 25 bp, Homo sapien
ttgtcttttttgctacaaatctaat

SEQ ID NO: 306864 - DNA, 25 bp, Homo sapien
gctacaaatctaatttttctgagag

SEQ ID NO: 306865 - DNA, 25 bp, Homo sapien
tcacactcaaaattcagtgaccatg

SEQ ID NO: 306866 - DNA, 25 bp, Homo sapien
ccttctgccatgatcatgagactat

SEQ ID NO: 306867 - DNA, 25 bp, Homo sapien
tgaaggtacagcatggcatccaccc

SEQ ID NO: 306868 - DNA, 25 bp, Homo sapien
atctgaccttattaccttattgctg

SEQ ID NO: 306869 - DNA, 25 bp, Homo sapien
ttaccttattgctgttcaaagtctc

SEQ ID NO: 306870 - DNA, 25 bp, Homo sapien
ctgttcaaagtctctatcccagact

SEQ ID NO: 306871 - DNA, 25 bp, Homo sapien
tatcccagactgaaatcccaagaca

SEQ ID NO: 306872 - DNA, 25 bp, Homo sapien
gatgatgtgaagcaccaactcctct

SEQ ID NO: 306873 - DNA, 25 bp, Homo sapien
tgtgaagcaccaactcctctgggaa

SEQ ID NO: 306874 - DNA, 25 bp, Homo sapien
actcctctgggaatcaaattcgagg

SEQ ID NO: 306875 - DNA, 25 bp, Homo sapien
ataggcccggtagagatgaatgata

SEQ ID NO: 306876 - DNA, 25 bp, Homo sapien
tgaatgatagtgtctctccttggat

SEQ ID NO: 306877 - DNA, 25 bp, Homo sapien
ggaagatttctctcacgaattggag

SEQ ID NO: 306878 - DNA, 25 bp, Homo sapien
gaattggagagcactcagtcccggc

SEQ ID NO: 306879 - DNA, 25 bp, Homo sapien
agagcactcagtcccggctggacaa

SEQ ID NO: 306880 - DNA, 25 bp, Homo sapien
ttgcaaaagtatctcatatgaccag

SEQ ID NO: 306881 - DNA, 25 bp, Homo sapien
atatgaccagtgatcggcgccaatg

SEQ ID NO: 306882 - DNA, 25 bp, Homo sapien
tgatcggcgccaatggtgtgccata

SEQ ID NO: 306883 - DNA, 25 bp, Homo sapien
ggcgccaatggtgtgccatagccat

SEQ ID NO: 306884 - DNA, 25 bp, Homo sapien
aatggtgtgccatagccatcctctt

SEQ ID NO: 306885 - DNA, 25 bp, Homo sapien
atagccatcctctttgcagtcctgt

SEQ ID NO: 306886 - DNA, 25 bp, Homo sapien
cagtcctgttggttgtgctcatcct

SEQ ID NO: 306887 - DNA, 25 bp, Homo sapien
cctgttggttgtgctcatcctcttc

SEQ ID NO: 306888 - DNA, 25 bp, Homo sapien
gagcagctcacccaggagctagaca

SEQ ID NO: 306889 - DNA, 25 bp, Homo sapien
aggagctagacaccctccgcaacct

SEQ ID NO: 306890 - DNA, 25 bp, Homo sapien
aacctcttccgccagattcctgagg

SEQ ID NO: 306891 - DNA, 25 bp, Homo sapien
gccagattcctgaggcggccaacct

SEQ ID NO: 306892 - DNA, 25 bp, Homo sapien
gcggccaacctcatcaagggcgtgg

SEQ ID NO: 306893 - DNA, 25 bp, Homo sapien
tggattgtgggcaccaggctccctg

SEQ ID NO: 306894 - DNA, 25 bp, Homo sapien
attgtgggcaccaggctccctggca

SEQ ID NO: 306895 - DNA, 25 bp, Homo sapien
agaccatggataaatggcaaccggg

SEQ ID NO: 306896 - DNA, 25 bp, Homo sapien
ggcaaagagggcaggacccagcata

SEQ ID NO: 306897 - DNA, 25 bp, Homo sapien
aaagagggcaggacccagcataatg

SEQ ID NO: 306898 - DNA, 25 bp, Homo sapien
tatatggctgaataaagttgcactg

SEQ ID NO: 306899 - DNA, 25 bp, Homo sapien
atgacctgctctgcctagttaagaa

SEQ ID NO: 306900 - DNA, 25 bp, Homo sapien
taatcagcagttacaaagcacatac

SEQ ID NO: 306901 - DNA, 25 bp, Homo sapien
acatactttgttacgtgctaggctt

SEQ ID NO: 306902 - DNA, 25 bp, Homo sapien
ttacgtgctaggctttgcctcctgg

SEQ ID NO: 306903 - DNA, 25 bp, Homo sapien
tgcctcctggcctctagataattaa

SEQ ID NO: 306904 - DNA, 25 bp, Homo sapien
tagataattaagacggcccagggaa

SEQ ID NO: 306905 - DNA, 25 bp, Homo sapien
taagacggcccagggaataccagca

SEQ ID NO: 306906 - DNA, 25 bp, Homo sapien
aaaagcagacctagacgagctgttc

SEQ ID NO: 306907 - DNA, 25 bp, Homo sapien
taactggtacctgttggtcagaaaa

SEQ ID NO: 306908 - DNA, 25 bp, Homo sapien
aaattacagtactcaacccttctag

SEQ ID NO: 306909 - DNA, 25 bp, Homo sapien
gtactcaacccttctagcaaagtat

SEQ ID NO: 306910 - DNA, 25 bp, Homo sapien
actcaaatccgggtggttactgcag

SEQ ID NO: 306911 - DNA, 25 bp, Homo sapien
actatttcgtgtaaggcaaagtcct

SEQ ID NO: 306912 - DNA, 25 bp, Homo sapien
gcaaagtcctttgaaagggctccta

SEQ ID NO: 306913 - DNA, 25 bp, Homo sapien
aagggctcctagagcgtcaaggcct

SEQ ID NO: 306914 - DNA, 25 bp, Homo sapien
aggcctccacctgatgaatgaatga

SEQ ID NO: 306915 - DNA, 25 bp, Homo sapien
aatgaatgagtcaggcaggcccagc

SEQ ID NO: 306916 - DNA, 25 bp, Homo sapien
aactgaggtacgaggcctcgctgaa

SEQ ID NO: 306917 - DNA, 25 bp, Homo sapien
tacgaggcctcgctgaaagatgcga

SEQ ID NO: 306918 - DNA, 25 bp, Homo sapien
agaagcaccacttctctcaggctga

SEQ ID NO: 306919 - DNA, 25 bp, Homo sapien
ggctgatgctctaatctcggctccc

SEQ ID NO: 306920 - DNA, 25 bp, Homo sapien
ctacaatggcgtagacggcctccgc

SEQ ID NO: 306921 - DNA, 25 bp, Homo sapien
gcaccttatagccttacatgttctt

SEQ ID NO: 306922 - DNA, 25 bp, Homo sapien
gtgaaacaaattgcggactggcctt

SEQ ID NO: 306923 - DNA, 25 bp, Homo sapien
agtgcttaacgcaggagctggcaga

SEQ ID NO: 306924 - DNA, 25 bp, Homo sapien
agctggcagagaaagtggatactca

SEQ ID NO: 306925 - DNA, 25 bp, Homo sapien
ggatactcagtaaataacagcaatt

SEQ ID NO: 306926 - DNA, 25 bp, Homo sapien
aaattgcggactggccttgtcctga

SEQ ID NO: 306927 - DNA, 25 bp, Homo sapien
aaagcatgccatttatctggtaaaa

SEQ ID NO: 306928 - DNA, 25 bp, Homo sapien
atctggtaaaatcccccattctaag

SEQ ID NO: 306929 - DNA, 25 bp, Homo sapien
gccttgtcctgagtggccttaggaa

SEQ ID NO: 306930 - DNA, 25 bp, Homo sapien
agtctcctggccagtctgtagaatt

SEQ ID NO: 306931 - DNA, 25 bp, Homo sapien
gaatttggcaaagatgaggcacctt

SEQ ID NO: 306932 - DNA, 25 bp, Homo sapien
aggcccttatattgcatacctaatt

SEQ ID NO: 306933 - DNA, 25 bp, Homo sapien
actttccccaaagttcaactgcatg

SEQ ID NO: 306934 - DNA, 25 bp, Homo sapien
accttaatgtattggagcacgtctt

SEQ ID NO: 306935 - DNA, 25 bp, Homo sapien
gagcacgtcttacaggtggacttaa

SEQ ID NO: 306936 - DNA, 25 bp, Homo sapien
ttcctgagtcgttgttattttccac

SEQ ID NO: 306937 - DNA, 25 bp, Homo sapien
tgaaggtctttccactgtacagcat

SEQ ID NO: 306938 - DNA, 25 bp, Homo sapien
tgtacagcatttcaggcatcatcac

SEQ ID NO: 306939 - DNA, 25 bp, Homo sapien
ggcatcatcactatgactctttttt

SEQ ID NO: 306940 - DNA, 25 bp, Homo sapien
tcttttccccaatggcgagctgggt

SEQ ID NO: 306941 - DNA, 25 bp, Homo sapien
gggctctcttataggaactcacagt

SEQ ID NO: 306942 - DNA, 25 bp, Homo sapien
cagtctagcctactgtattttgttt

SEQ ID NO: 306943 - DNA, 25 bp, Homo sapien
tgcttcaaaatcatgccaccttatt

SEQ ID NO: 306944 - DNA, 25 bp, Homo sapien
gttattttatgtccatcatcttgta

SEQ ID NO: 306945 - DNA, 25 bp, Homo sapien
tcatcttgtaaatcttcatcttcag

SEQ ID NO: 306946 - DNA, 25 bp, Homo sapien
tcatcttcagtgcatagacccaggt

SEQ ID NO: 306947 - DNA, 25 bp, Homo sapien
catagacccaggtttttagggctgt

SEQ ID NO: 306948 - DNA, 25 bp, Homo sapien
agtgagaagtattttctgctagaaa

SEQ ID NO: 306949 - DNA, 25 bp, Homo sapien
gtggaatgaccacaaactattacct

SEQ ID NO: 306950 - DNA, 25 bp, Homo sapien
caatttgtagaatgtactgaccttc

SEQ ID NO: 306951 - DNA, 25 bp, Homo sapien
gtactgaccttctttatactgcaca

SEQ ID NO: 306952 - DNA, 25 bp, Homo sapien
gaccttctttatactgcacaaatga

SEQ ID NO: 306953 - DNA, 25 bp, Homo sapien
cacaaatgatatggtgcctctgcct

SEQ ID NO: 306954 - DNA, 25 bp, Homo sapien
aaacagagcagccacgggctcgaac

SEQ ID NO: 306955 - DNA, 25 bp, Homo sapien
ttttctggcagagtctcgatcacca

SEQ ID NO: 306956 - DNA, 25 bp, Homo sapien
cccactaaggttcttgctcaatctc

SEQ ID NO: 306957 - DNA, 25 bp, Homo sapien
tgctcaatctccctagaaaacctga

SEQ ID NO: 306958 - DNA, 25 bp, Homo sapien
aatctccctagaaaacctgaattgt

SEQ ID NO: 306959 - DNA, 25 bp, Homo sapien
gaattgtttcatccctttcagtcag

SEQ ID NO: 306960 - DNA, 25 bp, Homo sapien
agtcagccccctacgtggtctgaaa

SEQ ID NO: 306961 - DNA, 25 bp, Homo sapien
gaaagcacaagccacggagtttaag

SEQ ID NO: 306962 - DNA, 25 bp, Homo sapien
cacggagtttaagaaggcagcctga

SEQ ID NO: 306963 - DNA, 25 bp, Homo sapien
ggcgctgcagagtcagccaagtagc

SEQ ID NO: 306964 - DNA, 25 bp, Homo sapien
agagtcagccaagtagccaaggaag

SEQ ID NO: 306965 - DNA, 25 bp, Homo sapien
tagaaaactctactgttttaagctt

SEQ ID NO: 306966 - DNA, 25 bp, Homo sapien
ctttagtttcctttatggaatgaag

SEQ ID NO: 306967 - DNA, 25 bp, Homo sapien
ggtagtttggagttttataatcagt

SEQ ID NO: 306968 - DNA, 25 bp, Homo sapien
tattttcttgaatgggtttactata

SEQ ID NO: 306969 - DNA, 25 bp, Homo sapien
gggtttactatacatcagcattttg

SEQ ID NO: 306970 - DNA, 25 bp, Homo sapien
tgtttatgcatgttttgccaataga

SEQ ID NO: 306971 - DNA, 25 bp, Homo sapien
ttgccaatagaatttgtgcttcagt

SEQ ID NO: 306972 - DNA, 25 bp, Homo sapien
gggatctagtatgctcctggtctaa

SEQ ID NO: 306973 - DNA, 25 bp, Homo sapien
agtatgctcctggtctaatgcattt

SEQ ID NO: 306974 - DNA, 25 bp, Homo sapien
gctcctggtctaatgcatttacatt

SEQ ID NO: 306975 - DNA, 25 bp, Homo sapien
tacattgtttaggtaactggttcct

SEQ ID NO: 306976 - DNA, 25 bp, Homo sapien
ttctgagttttagcacagcatccca

SEQ ID NO: 306977 - DNA, 25 bp, Homo sapien
ttcccgggaagctttattgccaagg

SEQ ID NO: 306978 - DNA, 25 bp, Homo sapien
cgggaagctttattgccaaggcaat

SEQ ID NO: 306979 - DNA, 25 bp, Homo sapien
gagaccatgtgagtaggagttaaat

SEQ ID NO: 306980 - DNA, 25 bp, Homo sapien
gagtaggagttaaatgcacagccat

SEQ ID NO: 306981 - DNA, 25 bp, Homo sapien
ttgtgaagtgagactgcttgggttc

SEQ ID NO: 306982 - DNA, 25 bp, Homo sapien
gactgcttgggttcagatcttgatt

SEQ ID NO: 306983 - DNA, 25 bp, Homo sapien
gatcttgattctgccctttattcta

SEQ ID NO: 306984 - DNA, 25 bp, Homo sapien
attctgccctttattctatgttgtg

SEQ ID NO: 306985 - DNA, 25 bp, Homo sapien
aagaaaccaactggcttcttcctgt

SEQ ID NO: 306986 - DNA, 25 bp, Homo sapien
tgtggaatatattacattgtgctgt

SEQ ID NO: 306987 - DNA, 25 bp, Homo sapien
ttctgactagaaaatgctgccaaag

SEQ ID NO: 306988 - DNA, 25 bp, Homo sapien
gaaaatgctgccaaagtcattaaat

SEQ ID NO: 306989 - DNA, 25 bp, Homo sapien
gatataagatgtaccagctacctga

SEQ ID NO: 306990 - DNA, 25 bp, Homo sapien
gtaccagctacctgaaacaacagat

SEQ ID NO: 306991 - DNA, 25 bp, Homo sapien
gagcaaaatgtggtctttggtggaa

SEQ ID NO: 306992 - DNA, 25 bp, Homo sapien
aatcaattttggatttgtgctatcc

SEQ ID NO: 306993 - DNA, 25 bp, Homo sapien
tccacaattctttgatatgaactat

SEQ ID NO: 306994 - DNA, 25 bp, Homo sapien
gtgctatatcttgaatttatccaca

SEQ ID NO: 306995 - DNA, 25 bp, Homo sapien
aaatttgatcttatagccacttgaa

SEQ ID NO: 306996 - DNA, 25 bp, Homo sapien
tatagccacttgaagacatatgatg

SEQ ID NO: 306997 - DNA, 25 bp, Homo sapien
gacatatgatggaaattctgactag

SEQ ID NO: 306998 - DNA, 25 bp, Homo sapien
ttctgcctttctacagtaaagagat

SEQ ID NO: 306999 - DNA, 25 bp, Homo sapien
gcctttctacagtaaagagatgctg

SEQ ID NO: 307000 - DNA, 25 bp, Homo sapien
aatggaatgagttagtcaggagcta

SEQ ID NO: 307001 - DNA, 25 bp, Homo sapien
caggagctaattaatgaccaaagat

SEQ ID NO: 307002 - DNA, 25 bp, Homo sapien
aaatgcagccaaggcagagcacatt

SEQ ID NO: 307003 - DNA, 25 bp, Homo sapien
ggcagagcacattggataggactat

SEQ ID NO: 307004 - DNA, 25 bp, Homo sapien
gagcacattggataggactatactt

SEQ ID NO: 307005 - DNA, 25 bp, Homo sapien
agagatgctgggatatgaaagagat

SEQ ID NO: 307006 - DNA, 25 bp, Homo sapien
gagatttgaaacaactaattcccca

SEQ ID NO: 307007 - DNA, 25 bp, Homo sapien
taattccccaacttagactagaatg

SEQ ID NO: 307008 - DNA, 25 bp, Homo sapien
caacttagactagaatgcactgaaa

SEQ ID NO: 307009 - DNA, 25 bp, Homo sapien
ggcgtcaagtcaggcaaaaaggatt

SEQ ID NO: 307010 - DNA, 25 bp, Homo sapien
aggattcaggaagcaaagggtacaa

SEQ ID NO: 307011 - DNA, 25 bp, Homo sapien
ggtacaatccaaccctggaagcagt

SEQ ID NO: 307012 - DNA, 25 bp, Homo sapien
atccaaccctggaagcagtcacagt

SEQ ID NO: 307013 - DNA, 25 bp, Homo sapien
actcacatgtaaacagtccattgta

SEQ ID NO: 307014 - DNA, 25 bp, Homo sapien
gggacacaggagagatcaactactt

SEQ ID NO: 307015 - DNA, 25 bp, Homo sapien
gatcaactactttgggcacacggga

SEQ ID NO: 307016 - DNA, 25 bp, Homo sapien
tggtgaaagacagacactagagctt

SEQ ID NO: 307017 - DNA, 25 bp, Homo sapien
actagagcttgtacgaggcatggaa

SEQ ID NO: 307018 - DNA, 25 bp, Homo sapien
gcatgaaaaagcacagcaggttcca

SEQ ID NO: 307019 - DNA, 25 bp, Homo sapien
caggttccagggtcagtgagtatgc

SEQ ID NO: 307020 - DNA, 25 bp, Homo sapien
agtgcctcagaatttttctgggccc

SEQ ID NO: 307021 - DNA, 25 bp, Homo sapien
gcctcagaatttttctgggccctga

SEQ ID NO: 307022 - DNA, 25 bp, Homo sapien
gggacctctcacatcacttaggagt

SEQ ID NO: 307023 - DNA, 25 bp, Homo sapien
gacctctcacatcacttaggagtgg

SEQ ID NO: 307024 - DNA, 25 bp, Homo sapien
ctctcacatcacttaggagtgggag

SEQ ID NO: 307025 - DNA, 25 bp, Homo sapien
aggagtgggagagcacttatctcga

SEQ ID NO: 307026 - DNA, 25 bp, Homo sapien
gtgggagagcacttatctcgaagtt

SEQ ID NO: 307027 - DNA, 25 bp, Homo sapien
gagagcacttatctcgaagttaagt

SEQ ID NO: 307028 - DNA, 25 bp, Homo sapien
tatctcgaagttaagtattctttac

SEQ ID NO: 307029 - DNA, 25 bp, Homo sapien
gtattctttaccttctgaatttcta

SEQ ID NO: 307030 - DNA, 25 bp, Homo sapien
ttaccttctgaatttctagtctgga

SEQ ID NO: 307031 - DNA, 25 bp, Homo sapien
aggcccctgtgcatatctagcactc

SEQ ID NO: 307032 - DNA, 25 bp, Homo sapien
catatctagcactcagggcctggga

SEQ ID NO: 307033 - DNA, 25 bp, Homo sapien
gcctgggaacgtgcattccggaagt

SEQ ID NO: 307034 - DNA, 25 bp, Homo sapien
gtgcattccggaagtgtccgtttct

SEQ ID NO: 307035 - DNA, 25 bp, Homo sapien
aaattccctcacaaggacacacgct

SEQ ID NO: 307036 - DNA, 25 bp, Homo sapien
attccctgtgagtgaccccaaacct

SEQ ID NO: 307037 - DNA, 25 bp, Homo sapien
catcctgaggcaggcatgggacaag

SEQ ID NO: 307038 - DNA, 25 bp, Homo sapien
accgctgccacacgcaggtttaaat

SEQ ID NO: 307039 - DNA, 25 bp, Homo sapien
aaatgatgagaaccgatcctgctcc

SEQ ID NO: 307040 - DNA, 25 bp, Homo sapien
cggacctgcagctcgtaacagctgg

SEQ ID NO: 307041 - DNA, 25 bp, Homo sapien
ctcgtaacagctgggctccgtggga

SEQ ID NO: 307042 - DNA, 25 bp, Homo sapien
gtcagatacaatggcatcaaaagct

SEQ ID NO: 307043 - DNA, 25 bp, Homo sapien
ggcatcaaaagctagaatgggcatt

SEQ ID NO: 307044 - DNA, 25 bp, Homo sapien
caaaagccactcttcacattgaata

SEQ ID NO: 307045 - DNA, 25 bp, Homo sapien
gataatttctgaccctagacttcgc

SEQ ID NO: 307046 - DNA, 25 bp, Homo sapien
tagacttcgcttcgagttagcactt

SEQ ID NO: 307047 - DNA, 25 bp, Homo sapien
tcgcttcgagttagcacttcgagaa

SEQ ID NO: 307048 - DNA, 25 bp, Homo sapien
aagacaaagagagagcacggcggct

SEQ ID NO: 307049 - DNA, 25 bp, Homo sapien
gcacggcggctagaagcccttagga

SEQ ID NO: 307050 - DNA, 25 bp, Homo sapien
gaagcccttaggaaacaggttgctg

SEQ ID NO: 307051 - DNA, 25 bp, Homo sapien
acaggttgctgttgttgctcaattt

SEQ ID NO: 307052 - DNA, 25 bp, Homo sapien
tgctcaatttgatcctgttagaatg

SEQ ID NO: 307053 - DNA, 25 bp, Homo sapien
ttaactctggatgcaaaggaatgat

SEQ ID NO: 307054 - DNA, 25 bp, Homo sapien
ataccccaaagctttcttatctgaa

SEQ ID NO: 307055 - DNA, 25 bp, Homo sapien
agctttcttatctgaacacatttag

SEQ ID NO: 307056 - DNA, 25 bp, Homo sapien
acacatttagtcagcatctctcctg

SEQ ID NO: 307057 - DNA, 25 bp, Homo sapien
tgtgtgcccaggaaccctattatct

SEQ ID NO: 307058 - DNA, 25 bp, Homo sapien
ggaaccctattatctggctattcag

SEQ ID NO: 307059 - DNA, 25 bp, Homo sapien
gaacaatgcttcatctgctatcctt

SEQ ID NO: 307060 - DNA, 25 bp, Homo sapien
tgtgcttacacgtccctttccaaca

SEQ ID NO: 307061 - DNA, 25 bp, Homo sapien
aaaggctggaggaagtaacttgaca

SEQ ID NO: 307062 - DNA, 25 bp, Homo sapien
tgacaagaagctgattatcccccca

SEQ ID NO: 307063 - DNA, 25 bp, Homo sapien
cacatgcatttatgtttgctgttta

SEQ ID NO: 307064 - DNA, 25 bp, Homo sapien
gttgcttggagtggaccgaggctct

SEQ ID NO: 307065 - DNA, 25 bp, Homo sapien
ttgcttggagtggaccgaggctctg

SEQ ID NO: 307066 - DNA, 25 bp, Homo sapien
tgcttggagtggaccgaggctctgc

SEQ ID NO: 307067 - DNA, 25 bp, Homo sapien
gcttggagtggaccgaggctctgca

SEQ ID NO: 307068 - DNA, 25 bp, Homo sapien
ggagtggaccgaggctctgcaggaa

SEQ ID NO: 307069 - DNA, 25 bp, Homo sapien
gagtggaccgaggctctgcaggaat

SEQ ID NO: 307070 - DNA, 25 bp, Homo sapien
agtggaccgaggctctgcaggaatg

SEQ ID NO: 307071 - DNA, 25 bp, Homo sapien
gtggaccgaggctctgcaggaatgc

SEQ ID NO: 307072 - DNA, 25 bp, Homo sapien
tggaccgaggctctgcaggaatgca

SEQ ID NO: 307073 - DNA, 25 bp, Homo sapien
acaggaaacattggcctgtggctgt

SEQ ID NO: 307074 - DNA, 25 bp, Homo sapien
tgtggctgtccctcaaatggcggca

SEQ ID NO: 307075 - DNA, 25 bp, Homo sapien
tgtccctcaaatggcggcagtctct

SEQ ID NO: 307076 - DNA, 25 bp, Homo sapien
cctgaggtcttttggcctagctctg

SEQ ID NO: 307077 - DNA, 25 bp, Homo sapien
ggtcttttggcctagctctgtacaa

SEQ ID NO: 307078 - DNA, 25 bp, Homo sapien
ttttggcctagctctgtacaaccag

SEQ ID NO: 307079 - DNA, 25 bp, Homo sapien
cctgctgggctagcctgaggcctag

SEQ ID NO: 307080 - DNA, 25 bp, Homo sapien
tgaggcctagtctctgcttggtccc

SEQ ID NO: 307081 - DNA, 25 bp, Homo sapien
tagtctctgcttggtccccgagatg

SEQ ID NO: 307082 - DNA, 25 bp, Homo sapien
ttctcccttgtggttttgtaaagtg

SEQ ID NO: 307083 - DNA, 25 bp, Homo sapien
tcccttgtggttttgtaaagtgcaa

SEQ ID NO: 307084 - DNA, 25 bp, Homo sapien
atagtagatagtgcatattaagatg

SEQ ID NO: 307085 - DNA, 25 bp, Homo sapien
aatttagctagcaggaattggacat

SEQ ID NO: 307086 - DNA, 25 bp, Homo sapien
ttagctagcaggaattggacattta

SEQ ID NO: 307087 - DNA, 25 bp, Homo sapien
agctagcaggaattggacatttaaa

SEQ ID NO: 307088 - DNA, 25 bp, Homo sapien
ctagcaggaattggacatttaaagg

SEQ ID NO: 307089 - DNA, 25 bp, Homo sapien
attggacatttaaaggagggaatct

SEQ ID NO: 307090 - DNA, 25 bp, Homo sapien
acacttttttcaccttcagaattat

SEQ ID NO: 307091 - DNA, 25 bp, Homo sapien
tttttcaccttcagaattatttaga

SEQ ID NO: 307092 - DNA, 25 bp, Homo sapien
ttcagaattatttagaaggtggatt

SEQ ID NO: 307093 - DNA, 25 bp, Homo sapien
agaaggtggatttacttggtctagt

SEQ ID NO: 307094 - DNA, 25 bp, Homo sapien
gaaggtggatttacttggtctagtt

SEQ ID NO: 307095 - DNA, 25 bp, Homo sapien
catgcaaaccagcaaacagagacaa

SEQ ID NO: 307096 - DNA, 25 bp, Homo sapien
gacaaaggcaaactgccgctgctgt

SEQ ID NO: 307097 - DNA, 25 bp, Homo sapien
gcaaactgccgctgctgtgcacctg

SEQ ID NO: 307098 - DNA, 25 bp, Homo sapien
gcacctgggctatggcttcgagaac

SEQ ID NO: 307099 - DNA, 25 bp, Homo sapien
cctgggctatggcttcgagaacaaa

SEQ ID NO: 307100 - DNA, 25 bp, Homo sapien
atggcttcgagaacaaacgactaag

SEQ ID NO: 307101 - DNA, 25 bp, Homo sapien
gaatgaagctgtgggcttgttgcat

SEQ ID NO: 307102 - DNA, 25 bp, Homo sapien
agccaaacccacttcatgggttctg

SEQ ID NO: 307103 - DNA, 25 bp, Homo sapien
gaacagggtctgtgtgatcttccta

SEQ ID NO: 307104 - DNA, 25 bp, Homo sapien
tgtgtgatcttcctaggttacccag

SEQ ID NO: 307105 - DNA, 25 bp, Homo sapien
atcgggctgagagttcagctgctgt

SEQ ID NO: 307106 - DNA, 25 bp, Homo sapien
tgcctctctcacaggagcctgcatg

SEQ ID NO: 307107 - DNA, 25 bp, Homo sapien
tctctcacaggagcctgcatgggaa

SEQ ID NO: 307108 - DNA, 25 bp, Homo sapien
ttgggaccgtgatctccaagtctgg

SEQ ID NO: 307109 - DNA, 25 bp, Homo sapien
ggaccgtgatctccaagtctggaat

SEQ ID NO: 307110 - DNA, 25 bp, Homo sapien
ccgtgatctccaagtctggaattgg

SEQ ID NO: 307111 - DNA, 25 bp, Homo sapien
tgtggctgtcactgagagactgaag

SEQ ID NO: 307112 - DNA, 25 bp, Homo sapien
ggctgtcactgagagactgaagaga

SEQ ID NO: 307113 - DNA, 25 bp, Homo sapien
agggacagagaagcgcttctgcatc

SEQ ID NO: 307114 - DNA, 25 bp, Homo sapien
cagagaagcgcttctgcatcaggga

SEQ ID NO: 307115 - DNA, 25 bp, Homo sapien
aaagagggataagctgtcaagatac

SEQ ID NO: 307116 - DNA, 25 bp, Homo sapien
gtcaagataccagactgtcacctgc

SEQ ID NO: 307117 - DNA, 25 bp, Homo sapien
tgttccattatgttgattgcttgta

SEQ ID NO: 307118 - DNA, 25 bp, Homo sapien
gggtgtcttcctgtgcaactgacac

SEQ ID NO: 307119 - DNA, 25 bp, Homo sapien
gtgcaactgacacagctaggctttg

SEQ ID NO: 307120 - DNA, 25 bp, Homo sapien
acacagctaggctttgacggcaggc

SEQ ID NO: 307121 - DNA, 25 bp, Homo sapien
tgacggcaggcctccacaaggtcta

SEQ ID NO: 307122 - DNA, 25 bp, Homo sapien
tccacaaggtctacccttttgattc

SEQ ID NO: 307123 - DNA, 25 bp, Homo sapien
gattccctttaactgaattctgttc

SEQ ID NO: 307124 - DNA, 25 bp, Homo sapien
actgaattctgttcatcaattgttt

SEQ ID NO: 307125 - DNA, 25 bp, Homo sapien
aataagtatttctaagggctcagta

SEQ ID NO: 307126 - DNA, 25 bp, Homo sapien
ctaccatagggatcatttcatgcat

SEQ ID NO: 307127 - DNA, 25 bp, Homo sapien
gatgttaacactacctgatattaat

SEQ ID NO: 307128 - DNA, 25 bp, Homo sapien
cccggaaagccgagccccaggagag

SEQ ID NO: 307129 - DNA, 25 bp, Homo sapien
cccaggagagcgaggagaccaagca

SEQ ID NO: 307130 - DNA, 25 bp, Homo sapien
ggacgtgaacgtgcagatcgatgac

SEQ ID NO: 307131 - DNA, 25 bp, Homo sapien
gaacgtgcagatcgatgacagctac

SEQ ID NO: 307132 - DNA, 25 bp, Homo sapien
cgtgcagatcgatgacagctactac

SEQ ID NO: 307133 - DNA, 25 bp, Homo sapien
gcagatcgatgacagctactacgtg

SEQ ID NO: 307134 - DNA, 25 bp, Homo sapien
atgacagctactacgtggacgtggg

SEQ ID NO: 307135 - DNA, 25 bp, Homo sapien
actacgtggacgtgggcggctcgca

SEQ ID NO: 307136 - DNA, 25 bp, Homo sapien
gggcggctcgcagaagcgctggcag

SEQ ID NO: 307137 - DNA, 25 bp, Homo sapien
tggcagtgccccacctgcgagaagt

SEQ ID NO: 307138 - DNA, 25 bp, Homo sapien
agaagtcctacacctccaagtacaa

SEQ ID NO: 307139 - DNA, 25 bp, Homo sapien
aagaggtttggtggtcaccctgcca

SEQ ID NO: 307140 - DNA, 25 bp, Homo sapien
ctcttgggactactgggatctactt

SEQ ID NO: 307141 - DNA, 25 bp, Homo sapien
gccatagctggtccctaaaccataa

SEQ ID NO: 307142 - DNA, 25 bp, Homo sapien
aatgatactcatcatctctctcatc

SEQ ID NO: 307143 - DNA, 25 bp, Homo sapien
catcaccctttctaaatttctgtct

SEQ ID NO: 307144 - DNA, 25 bp, Homo sapien
atttctgtcttccttggttaacact

SEQ ID NO: 307145 - DNA, 25 bp, Homo sapien
ggttaacacttctgcttgtcaagat

SEQ ID NO: 307146 - DNA, 25 bp, Homo sapien
tctgcttgtcaagatggcttgcctg

SEQ ID NO: 307147 - DNA, 25 bp, Homo sapien
ttgcctggtagaatggctcagaccc

SEQ ID NO: 307148 - DNA, 25 bp, Homo sapien
ctgttataaataggcccctggtcca

SEQ ID NO: 307149 - DNA, 25 bp, Homo sapien
gttatatatgatttctccaagattc

SEQ ID NO: 307150 - DNA, 25 bp, Homo sapien
tagttttcaaataacttatcttcca

SEQ ID NO: 307151 - DNA, 25 bp, Homo sapien
taacttatcttccaggaccctatta

SEQ ID NO: 307152 - DNA, 25 bp, Homo sapien
acttatcttccaggaccctattata

SEQ ID NO: 307153 - DNA, 25 bp, Homo sapien
tatcttccaggaccctattataaaa

SEQ ID NO: 307154 - DNA, 25 bp, Homo sapien
taaaaatagcttcagatgtgcaaat

SEQ ID NO: 307155 - DNA, 25 bp, Homo sapien
gatgtgcaaataagactgcatcttg

SEQ ID NO: 307156 - DNA, 25 bp, Homo sapien
agactgcatcttggtaagtttgttt

SEQ ID NO: 307157 - DNA, 25 bp, Homo sapien
tatgcttctgattatacagcaggca

SEQ ID NO: 307158 - DNA, 25 bp, Homo sapien
gcttctgattatacagcaggcatat

SEQ ID NO: 307159 - DNA, 25 bp, Homo sapien
ttgggtgttttactgaatactaaat

SEQ ID NO: 307160 - DNA, 25 bp, Homo sapien
aaacacatgcattatgtaataggta

SEQ ID NO: 307161 - DNA, 25 bp, Homo sapien
tctcccagcagatgggatatgagca

SEQ ID NO: 307162 - DNA, 25 bp, Homo sapien
gatatgagcattggcagtgccaggc

SEQ ID NO: 307163 - DNA, 25 bp, Homo sapien
aggctccccaccaaggcaggaacag

SEQ ID NO: 307164 - DNA, 25 bp, Homo sapien
agggtgagcgccaggccagggctgc

SEQ ID NO: 307165 - DNA, 25 bp, Homo sapien
tgtctcaggtccctttggcactgtc

SEQ ID NO: 307166 - DNA, 25 bp, Homo sapien
tttggcactgtctcacccaggacac

SEQ ID NO: 307167 - DNA, 25 bp, Homo sapien
cagccgccaagcagacagtctcgag

SEQ ID NO: 307168 - DNA, 25 bp, Homo sapien
aagcagacagtctcgagtggacctg

SEQ ID NO: 307169 - DNA, 25 bp, Homo sapien
agacagtctcgagtggacctgcatc

SEQ ID NO: 307170 - DNA, 25 bp, Homo sapien
acagtctcgagtggacctgcatctc

SEQ ID NO: 307171 - DNA, 25 bp, Homo sapien
tctcgagtggacctgcatctcccag

SEQ ID NO: 307172 - DNA, 25 bp, Homo sapien
gatctttttgtttctgcctagtctc

SEQ ID NO: 307173 - DNA, 25 bp, Homo sapien
tctgtgccctgtctttgtgtgtttc

SEQ ID NO: 307174 - DNA, 25 bp, Homo sapien
aagtttctctgacttggtttttctg

SEQ ID NO: 307175 - DNA, 25 bp, Homo sapien
tttcccttcaggcatatgtctctaa

SEQ ID NO: 307176 - DNA, 25 bp, Homo sapien
gcatatgtctctaaaccaatgttat

SEQ ID NO: 307177 - DNA, 25 bp, Homo sapien
agacagggctactctaggaatggat

SEQ ID NO: 307178 - DNA, 25 bp, Homo sapien
gatattttccccatggatcaagatc

SEQ ID NO: 307179 - DNA, 25 bp, Homo sapien
tggatcaagatccagtttagggttg

SEQ ID NO: 307180 - DNA, 25 bp, Homo sapien
gctctgcacctgtgtttcagttact

SEQ ID NO: 307181 - DNA, 25 bp, Homo sapien
ctgtgtttcagttactctctctctc

SEQ ID NO: 307182 - DNA, 25 bp, Homo sapien
tctctctgtcttagatctttttgtt

SEQ ID NO: 307183 - DNA, 25 bp, Homo sapien
tgggtcgtaacttccaagaaagact

SEQ ID NO: 307184 - DNA, 25 bp, Homo sapien
gaaagactgattcgctctttgccca

SEQ ID NO: 307185 - DNA, 25 bp, Homo sapien
cgctctttgcccactagtttggaga

SEQ ID NO: 307186 - DNA, 25 bp, Homo sapien
cccactagtttggagagggccctga

SEQ ID NO: 307187 - DNA, 25 bp, Homo sapien
gagggccctgactgaggtccctgac

SEQ ID NO: 307188 - DNA, 25 bp, Homo sapien
tgcttcacctcctgaggagacggag

SEQ ID NO: 307189 - DNA, 25 bp, Homo sapien
gaggagacggagttacaagcaatgt

SEQ ID NO: 307190 - DNA, 25 bp, Homo sapien
tcattcttgtcctgattaacccaac

SEQ ID NO: 307191 - DNA, 25 bp, Homo sapien
tgattaacccaacaagctccttggc

SEQ ID NO: 307192 - DNA, 25 bp, Homo sapien
tcaacccaattctctacgtctttat

SEQ ID NO: 307193 - DNA, 25 bp, Homo sapien
attctctacgtctttatgggtcgta

SEQ ID NO: 307194 - DNA, 25 bp, Homo sapien
ttagctatttcacttggggcaacat

SEQ ID NO: 307195 - DNA, 25 bp, Homo sapien
gggcaacatttaatctccaagatta

SEQ ID NO: 307196 - DNA, 25 bp, Homo sapien
atctcatttttatgtatcatcttta

SEQ ID NO: 307197 - DNA, 25 bp, Homo sapien
atcatctttaagacaaattgttaag

SEQ ID NO: 307198 - DNA, 25 bp, Homo sapien
tagttaaatttcctatgaaagttag

SEQ ID NO: 307199 - DNA, 25 bp, Homo sapien
tttgctttctgccaagagtcattaa

SEQ ID NO: 307200 - DNA, 25 bp, Homo sapien
tgctttctgccaagagtcattaaat

SEQ ID NO: 307201 - DNA, 25 bp, Homo sapien
tttctgccaagagtcattaaatgat

SEQ ID NO: 307202 - DNA, 25 bp, Homo sapien
gatatagcaagtatttgggtctctc

SEQ ID NO: 307203 - DNA, 25 bp, Homo sapien
tatagcaagtatttgggtctctctt

SEQ ID NO: 307204 - DNA, 25 bp, Homo sapien
tttgggtctctcttggtgttatcag

SEQ ID NO: 307205 - DNA, 25 bp, Homo sapien
tggccctggctgtaagtttcctcgg

SEQ ID NO: 307206 - DNA, 25 bp, Homo sapien
tgtaagtttcctcggctctgcaggg

SEQ ID NO: 307207 - DNA, 25 bp, Homo sapien
gcactcagggatggaggagaccaca

SEQ ID NO: 307208 - DNA, 25 bp, Homo sapien
atggaggagaccacaccgcgcggct

SEQ ID NO: 307209 - DNA, 25 bp, Homo sapien
tgtttaatgaagactgggaggcctg

SEQ ID NO: 307210 - DNA, 25 bp, Homo sapien
aatggcggtccctgcggcctccaaa

SEQ ID NO: 307211 - DNA, 25 bp, Homo sapien
tttcctgctcgacatctcaatccag

SEQ ID NO: 307212 - DNA, 25 bp, Homo sapien
gacatctcaatccagctcctaatat

SEQ ID NO: 307213 - DNA, 25 bp, Homo sapien
tcaatccagctcctaatatctcaat

SEQ ID NO: 307214 - DNA, 25 bp, Homo sapien
gctcctaatatctcaatagggtttt

SEQ ID NO: 307215 - DNA, 25 bp, Homo sapien
aaagggtcgtgcagctcggtggcct

SEQ ID NO: 307216 - DNA, 25 bp, Homo sapien
ttttctccagggtaacactttacat

SEQ ID NO: 307217 - DNA, 25 bp, Homo sapien
gtgtgccatcttcaagttcagcagc

SEQ ID NO: 307218 - DNA, 25 bp, Homo sapien
cattttggtggttgtcttgatggat

SEQ ID NO: 307219 - DNA, 25 bp, Homo sapien
tgtaacatctggtcatggtggtcat

SEQ ID NO: 307220 - DNA, 25 bp, Homo sapien
catggtggtcatgaattggcaatcc

SEQ ID NO: 307221 - DNA, 25 bp, Homo sapien
attggcaatccaaaccttgaggaaa

SEQ ID NO: 307222 - DNA, 25 bp, Homo sapien
tgtactgctaaaccaaaccgatcca

SEQ ID NO: 307223 - DNA, 25 bp, Homo sapien
gaatcatatgagtctgtttaactgt

SEQ ID NO: 307224 - DNA, 25 bp, Homo sapien
taaaccaaaccgatccagaggacaa

SEQ ID NO: 307225 - DNA, 25 bp, Homo sapien
ccagaggacaacaaaagcccatttt

SEQ ID NO: 307226 - DNA, 25 bp, Homo sapien
gcctttggagagtctggttagagat

SEQ ID NO: 307227 - DNA, 25 bp, Homo sapien
tgcctctgtttcatcactgtgtcag

SEQ ID NO: 307228 - DNA, 25 bp, Homo sapien
gtgtcagaggcccatgtgaaatctt

SEQ ID NO: 307229 - DNA, 25 bp, Homo sapien
ggcccatgtgaaatctttcattctg

SEQ ID NO: 307230 - DNA, 25 bp, Homo sapien
gatgtacactgtgcttaatccctgc

SEQ ID NO: 307231 - DNA, 25 bp, Homo sapien
ttaatccctgcccatccttggtagc

SEQ ID NO: 307232 - DNA, 25 bp, Homo sapien
ccttggtagcccctagtgcaataaa

SEQ ID NO: 307233 - DNA, 25 bp, Homo sapien
agtgcaataaagtctccctgagtgg

SEQ ID NO: 307234 - DNA, 25 bp, Homo sapien
aagtctccctgagtggtgagttctc

SEQ ID NO: 307235 - DNA, 25 bp, Homo sapien
ctgagtggtgagttctcccggcaag

SEQ ID NO: 307236 - DNA, 25 bp, Homo sapien
ggagtttcttctgcagaatccagcc

SEQ ID NO: 307237 - DNA, 25 bp, Homo sapien
tctgtatagattgcttctcgtccgc

SEQ ID NO: 307238 - DNA, 25 bp, Homo sapien
gctggcaaagggagggccctgggct

SEQ ID NO: 307239 - DNA, 25 bp, Homo sapien
ggtccagctttggaagccaggctcc

SEQ ID NO: 307240 - DNA, 25 bp, Homo sapien
ctttggaagccaggctcccctgtga

SEQ ID NO: 307241 - DNA, 25 bp, Homo sapien
gtggcttgtctggtcttcgcccacg

SEQ ID NO: 307242 - DNA, 25 bp, Homo sapien
cttcgcccacgggaggctggacaga

SEQ ID NO: 307243 - DNA, 25 bp, Homo sapien
ctggacagaggctgtagccaacaca

SEQ ID NO: 307244 - DNA, 25 bp, Homo sapien
agaggctgtagccaacacaatcacc

SEQ ID NO: 307245 - DNA, 25 bp, Homo sapien
gctgtagccaacacaatcaccttta

SEQ ID NO: 307246 - DNA, 25 bp, Homo sapien
tagccaacacaatcacctttacttt

SEQ ID NO: 307247 - DNA, 25 bp, Homo sapien
atcacctttactttgtactctgtgt

SEQ ID NO: 307248 - DNA, 25 bp, Homo sapien
ctgtgtgtatgttttggttttctgt

SEQ ID NO: 307249 - DNA, 25 bp, Homo sapien
catcagcctgaattgaacatcctat

SEQ ID NO: 307250 - DNA, 25 bp, Homo sapien
gaacatcctatatctgaacatctgc

SEQ ID NO: 307251 - DNA, 25 bp, Homo sapien
gtgtgaactgcattgcaccttttgc

SEQ ID NO: 307252 - DNA, 25 bp, Homo sapien
gggcccatgtcagatttatgtctct

SEQ ID NO: 307253 - DNA, 25 bp, Homo sapien
atgtctctgctgatactatagtgga

SEQ ID NO: 307254 - DNA, 25 bp, Homo sapien
agtggaagccattttacctctaccg

SEQ ID NO: 307255 - DNA, 25 bp, Homo sapien
ggcaggtgaccaccagtgtgcacca

SEQ ID NO: 307256 - DNA, 25 bp, Homo sapien
tcacccatcccagtgtattcaggta

SEQ ID NO: 307257 - DNA, 25 bp, Homo sapien
aagtgaaccttggtgttctgttcat

SEQ ID NO: 307258 - DNA, 25 bp, Homo sapien
tagcccaagcatttattccgttttt

SEQ ID NO: 307259 - DNA, 25 bp, Homo sapien
tttctgatgagttaggccatggacc

SEQ ID NO: 307260 - DNA, 25 bp, Homo sapien
ttaagctcatcctagcaagacctct

SEQ ID NO: 307261 - DNA, 25 bp, Homo sapien
tagcaagacctctagagaccctaga

SEQ ID NO: 307262 - DNA, 25 bp, Homo sapien
gagaccctagagactcgactttagt

SEQ ID NO: 307263 - DNA, 25 bp, Homo sapien
ctagagactcgactttagtccttcc

SEQ ID NO: 307264 - DNA, 25 bp, Homo sapien
gacaggaggtaggatcctgccgctc

SEQ ID NO: 307265 - DNA, 25 bp, Homo sapien
tgccgctcgcgtcttagtgtttctc

SEQ ID NO: 307266 - DNA, 25 bp, Homo sapien
tagtgtttctccctcaagactttcc

SEQ ID NO: 307267 - DNA, 25 bp, Homo sapien
gttttgttgtcttgtgcagtatttt

SEQ ID NO: 307268 - DNA, 25 bp, Homo sapien
tgtgcagtattttacagcccctctt

SEQ ID NO: 307269 - DNA, 25 bp, Homo sapien
ttttctttatttctcgtacacacac

SEQ ID NO: 307270 - DNA, 25 bp, Homo sapien
cgtacacacacgcagttttaagggt

SEQ ID NO: 307271 - DNA, 25 bp, Homo sapien
aaatatgaacattgggactcagaga

SEQ ID NO: 307272 - DNA, 25 bp, Homo sapien
atgaacattgggactcagagaaaat

SEQ ID NO: 307273 - DNA, 25 bp, Homo sapien
taaagtggattcaggttatcagtga

SEQ ID NO: 307274 - DNA, 25 bp, Homo sapien
gaaatgatggtatagattacagcaa

SEQ ID NO: 307275 - DNA, 25 bp, Homo sapien
atctggatatatattgatgttactg

SEQ ID NO: 307276 - DNA, 25 bp, Homo sapien
ttgcaaatgtcctcccattaaacag

SEQ ID NO: 307277 - DNA, 25 bp, Homo sapien
caaatgtcctcccattaaacagaaa

SEQ ID NO: 307278 - DNA, 25 bp, Homo sapien
gaaagtttaaagaatgccctcaatc

SEQ ID NO: 307279 - DNA, 25 bp, Homo sapien
gaatgccctcaatccatgaacgaga

SEQ ID NO: 307280 - DNA, 25 bp, Homo sapien
ctcaatccatgaacgagagggagga

SEQ ID NO: 307281 - DNA, 25 bp, Homo sapien
atgctgtctttaattatttagaagg

SEQ ID NO: 307282 - DNA, 25 bp, Homo sapien
tatagagagggccttctattcctct

SEQ ID NO: 307283 - DNA, 25 bp, Homo sapien
attcctctccacctaaacttatata

SEQ ID NO: 307284 - DNA, 25 bp, Homo sapien
cttatataagctactgttttcctca

SEQ ID NO: 307285 - DNA, 25 bp, Homo sapien
tctacaggatctccagtccattgaa

SEQ ID NO: 307286 - DNA, 25 bp, Homo sapien
gatctccagtccattgaaatacatt

SEQ ID NO: 307287 - DNA, 25 bp, Homo sapien
atacattaatttttgagtctcttca

SEQ ID NO: 307288 - DNA, 25 bp, Homo sapien
gagtctcttcacacatttttatttc

SEQ ID NO: 307289 - DNA, 25 bp, Homo sapien
tcctagatttaagtcttgattgcaa

SEQ ID NO: 307290 - DNA, 25 bp, Homo sapien
ttgattgcaatcacatacaactagt

SEQ ID NO: 307291 - DNA, 25 bp, Homo sapien
tatttgatgttgaggactccatcct

SEQ ID NO: 307292 - DNA, 25 bp, Homo sapien
atcaccaagtcctcctagctataga

SEQ ID NO: 307293 - DNA, 25 bp, Homo sapien
gtctttgaccttctgcttcatgaca

SEQ ID NO: 307294 - DNA, 25 bp, Homo sapien
tgaccttctgcttcatgacactgtg

SEQ ID NO: 307295 - DNA, 25 bp, Homo sapien
atgacactgtggcatcgctaatttt

SEQ ID NO: 307296 - DNA, 25 bp, Homo sapien
gtggcatcgctaattttactgatat

SEQ ID NO: 307297 - DNA, 25 bp, Homo sapien
gagattggagtgctcatggtcctaa

SEQ ID NO: 307298 - DNA, 25 bp, Homo sapien
aacacctgaattagggagtccatct

SEQ ID NO: 307299 - DNA, 25 bp, Homo sapien
ggagtccatctagtgatggtttcat

SEQ ID NO: 307300 - DNA, 25 bp, Homo sapien
gcagaaccggaactgccccagttaa

SEQ ID NO: 307301 - DNA, 25 bp, Homo sapien
agttaagtcccaccatggcgcccag

SEQ ID NO: 307302 - DNA, 25 bp, Homo sapien
ccatggcgcccagtaaagggtgtgt

SEQ ID NO: 307303 - DNA, 25 bp, Homo sapien
taaagggtgtgtgggtctttgacct

SEQ ID NO: 307304 - DNA, 25 bp, Homo sapien
tttcaacctgcctgtgtctttgaat

SEQ ID NO: 307305 - DNA, 25 bp, Homo sapien
aacctgcctgtgtctttgaatccat

SEQ ID NO: 307306 - DNA, 25 bp, Homo sapien
gaatccatgatgtgcctctgataga

SEQ ID NO: 307307 - DNA, 25 bp, Homo sapien
tccatgatgtgcctctgatagacaa

SEQ ID NO: 307308 - DNA, 25 bp, Homo sapien
gatgtgcctctgatagacaacatat

SEQ ID NO: 307309 - DNA, 25 bp, Homo sapien
gcctctgatagacaacatatggtta

SEQ ID NO: 307310 - DNA, 25 bp, Homo sapien
gacaacatatggttagatctttttt

SEQ ID NO: 307311 - DNA, 25 bp, Homo sapien
ctttctgatttgatagtccattgat

SEQ ID NO: 307312 - DNA, 25 bp, Homo sapien
gatagtccattgatattttatataa

SEQ ID NO: 307313 - DNA, 25 bp, Homo sapien
ttgcacccggccctaggtatttcat

SEQ ID NO: 307314 - DNA, 25 bp, Homo sapien
cacccggccctaggtatttcattat

SEQ ID NO: 307315 - DNA, 25 bp, Homo sapien
tactcctttgattctacatcctcct

SEQ ID NO: 307316 - DNA, 25 bp, Homo sapien
gattctacatcctcctcgaagtgtg

SEQ ID NO: 307317 - DNA, 25 bp, Homo sapien
tctacatcctcctcgaagtgtgtga

SEQ ID NO: 307318 - DNA, 25 bp, Homo sapien
catcctcctcgaagtgtgtgaggta

SEQ ID NO: 307319 - DNA, 25 bp, Homo sapien
gtgaggtaggccatctgagccgaat

SEQ ID NO: 307320 - DNA, 25 bp, Homo sapien
aggtaggccatctgagccgaatcgc

SEQ ID NO: 307321 - DNA, 25 bp, Homo sapien
taggccatctgagccgaatcgcgcg

SEQ ID NO: 307322 - DNA, 25 bp, Homo sapien
ccatagagagtgttcatgctgtagg

SEQ ID NO: 307323 - DNA, 25 bp, Homo sapien
gtgttcatgctgtaggagctgccat

SEQ ID NO: 307324 - DNA, 25 bp, Homo sapien
tcatgctgtaggagctgccatggag

SEQ ID NO: 307325 - DNA, 25 bp, Homo sapien
ccatggaggcacagggctttggtaa

SEQ ID NO: 307326 - DNA, 25 bp, Homo sapien
acttaatttctgttccatgttcaaa

SEQ ID NO: 307327 - DNA, 25 bp, Homo sapien
gttccatgttcaaatcatctcattt

SEQ ID NO: 307328 - DNA, 25 bp, Homo sapien
atctcatttgcctatgtgccctata

SEQ ID NO: 307329 - DNA, 25 bp, Homo sapien
tcatttgcctatgtgccctatattt

SEQ ID NO: 307330 - DNA, 25 bp, Homo sapien
atttcaatctgtcattaaccctcct

SEQ ID NO: 307331 - DNA, 25 bp, Homo sapien
cattaaccctcctaccttctaaatg

SEQ ID NO: 307332 - DNA, 25 bp, Homo sapien
aatggccaaggtaattatgtctaac

SEQ ID NO: 307333 - DNA, 25 bp, Homo sapien
taattatgtctaaccttgcccttct

SEQ ID NO: 307334 - DNA, 25 bp, Homo sapien
tatgtcgtaaaatttcccagaagga

SEQ ID NO: 307335 - DNA, 25 bp, Homo sapien
gaatgactgcagataaaaaccttta

SEQ ID NO: 307336 - DNA, 25 bp, Homo sapien
tattattttggtggtgtgagttatc

SEQ ID NO: 307337 - DNA, 25 bp, Homo sapien
ccatagagagtgttcatgctgtagg

SEQ ID NO: 307338 - DNA, 25 bp, Homo sapien
tagagagtgttcatgctgtaggagc

SEQ ID NO: 307339 - DNA, 25 bp, Homo sapien
gagtgttcatgctgtaggagctgcc

SEQ ID NO: 307340 - DNA, 25 bp, Homo sapien
agtgttcatgctgtaggagctgcca

SEQ ID NO: 307341 - DNA, 25 bp, Homo sapien
gtgttcatgctgtaggagctgccat

SEQ ID NO: 307342 - DNA, 25 bp, Homo sapien
tgttcatgctgtaggagctgccatg

SEQ ID NO: 307343 - DNA, 25 bp, Homo sapien
gttcatgctgtaggagctgccatgg

SEQ ID NO: 307344 - DNA, 25 bp, Homo sapien
ttcatgctgtaggagctgccatgga

SEQ ID NO: 307345 - DNA, 25 bp, Homo sapien
tcatgctgtaggagctgccatggag

SEQ ID NO: 307346 - DNA, 25 bp, Homo sapien
tgctgtaggagctgccatggaggca

SEQ ID NO: 307347 - DNA, 25 bp, Homo sapien
ccatggaggcacagggctttggtaa

SEQ ID NO: 307348 - DNA, 25 bp, Homo sapien
tctcccagcagatgggatatgagca

SEQ ID NO: 307349 - DNA, 25 bp, Homo sapien
gatatgagcattggcagtgccaggc

SEQ ID NO: 307350 - DNA, 25 bp, Homo sapien
aggctccccaccaaggcaggaacag

SEQ ID NO: 307351 - DNA, 25 bp, Homo sapien
ttggagctgggctttggcactgctt

SEQ ID NO: 307352 - DNA, 25 bp, Homo sapien
agggtgagcgccaggccagggctgc

SEQ ID NO: 307353 - DNA, 25 bp, Homo sapien
tgtctcaggtccctttggcactgtc

SEQ ID NO: 307354 - DNA, 25 bp, Homo sapien
tttggcactgtctcacccaggacac

SEQ ID NO: 307355 - DNA, 25 bp, Homo sapien
tggcaaccagccaggaactgtgtgg

SEQ ID NO: 307356 - DNA, 25 bp, Homo sapien
cagccgccaagcagacagtctcgag

SEQ ID NO: 307357 - DNA, 25 bp, Homo sapien
agacagtctcgagtggacctgcatc

SEQ ID NO: 307358 - DNA, 25 bp, Homo sapien
tctcgagtggacctgcatctcccag

SEQ ID NO: 307359 - DNA, 25 bp, Homo sapien
cggaacctctgctgccccggaaagc

SEQ ID NO: 307360 - DNA, 25 bp, Homo sapien
ggacgtgaacgtgcagatcgatgac

SEQ ID NO: 307361 - DNA, 25 bp, Homo sapien
gtgaacgtgcagatcgatgacagct

SEQ ID NO: 307362 - DNA, 25 bp, Homo sapien
gaacgtgcagatcgatgacagctac

SEQ ID NO: 307363 - DNA, 25 bp, Homo sapien
acgtgcagatcgatgacagctacta

SEQ ID NO: 307364 - DNA, 25 bp, Homo sapien
gtgcagatcgatgacagctactacg

SEQ ID NO: 307365 - DNA, 25 bp, Homo sapien
gcagatcgatgacagctactacgtg

SEQ ID NO: 307366 - DNA, 25 bp, Homo sapien
atgacagctactacgtggacgtggg

SEQ ID NO: 307367 - DNA, 25 bp, Homo sapien
actacgtggacgtgggcggctcgca

SEQ ID NO: 307368 - DNA, 25 bp, Homo sapien
gggcggctcgcagaagcgctggcag

SEQ ID NO: 307369 - DNA, 25 bp, Homo sapien
agtgccccacctgcgagaagtccta

SEQ ID NO: 307370 - DNA, 25 bp, Homo sapien
cgctgatgaccgtgctcttcactat

SEQ ID NO: 307371 - DNA, 25 bp, Homo sapien
ttcactatgtgttctctgcccgtaa

SEQ ID NO: 307372 - DNA, 25 bp, Homo sapien
gcccgtaatttatcgcgcttactat

SEQ ID NO: 307373 - DNA, 25 bp, Homo sapien
atcgcgcttactatggagcatttaa

SEQ ID NO: 307374 - DNA, 25 bp, Homo sapien
aagaagcagaagacctccgagcctt

SEQ ID NO: 307375 - DNA, 25 bp, Homo sapien
gagccttgcgatttctatctgtgat

SEQ ID NO: 307376 - DNA, 25 bp, Homo sapien
gatttcaattgtggacccttggatt

SEQ ID NO: 307377 - DNA, 25 bp, Homo sapien
tcattttcagatctccagtatttcg

SEQ ID NO: 307378 - DNA, 25 bp, Homo sapien
agacctcttaggtacaggagccggt

SEQ ID NO: 307379 - DNA, 25 bp, Homo sapien
aacatggaatccagtctgtgacagt

SEQ ID NO: 307380 - DNA, 25 bp, Homo sapien
ctgtgacagtgtttttcactctgtg

SEQ ID NO: 307381 - DNA, 25 bp, Homo sapien
aatacttccatctaatcaaccatcc

SEQ ID NO: 307382 - DNA, 25 bp, Homo sapien
taatcaaccatccatgttccaatga

SEQ ID NO: 307383 - DNA, 25 bp, Homo sapien
gttccaatgatgttaactgtctcag

SEQ ID NO: 307384 - DNA, 25 bp, Homo sapien
taactgtctcagtgataccttttat

SEQ ID NO: 307385 - DNA, 25 bp, Homo sapien
atagcattttctcctccaatgcaag

SEQ ID NO: 307386 - DNA, 25 bp, Homo sapien
tccaatgcaagatccagtccagaat

SEQ ID NO: 307387 - DNA, 25 bp, Homo sapien
gtccagaatcacacattgcatcgag

SEQ ID NO: 307388 - DNA, 25 bp, Homo sapien
gcatcgagttgttatgtcttcttag

SEQ ID NO: 307389 - DNA, 25 bp, Homo sapien
gtcttcttagtctcctttaatgtgg

SEQ ID NO: 307390 - DNA, 25 bp, Homo sapien
ggaacagttcctcataccattgcat

SEQ ID NO: 307391 - DNA, 25 bp, Homo sapien
ttcctcataccattgcatacactgt

SEQ ID NO: 307392 - DNA, 25 bp, Homo sapien
ggcccgcaacagtccaggcagacga

SEQ ID NO: 307393 - DNA, 25 bp, Homo sapien
aacagtccaggcagacgagcgcgcg

SEQ ID NO: 307394 - DNA, 25 bp, Homo sapien
agccctcgagaatgcctgcactgtg

SEQ ID NO: 307395 - DNA, 25 bp, Homo sapien
cgcgcggcagcggtagtggcaggtg

SEQ ID NO: 307396 - DNA, 25 bp, Homo sapien
gtggcaggtgaacttgcaatctgca

SEQ ID NO: 307397 - DNA, 25 bp, Homo sapien
gaacttgcaatctgcagagaggcct

SEQ ID NO: 307398 - DNA, 25 bp, Homo sapien
tcgagaatgcctgcactgtggcctg

SEQ ID NO: 307399 - DNA, 25 bp, Homo sapien
gcctggcggtgaggcggaggagctc

SEQ ID NO: 307400 - DNA, 25 bp, Homo sapien
gaaatgtcccggagattgaagggaa

SEQ ID NO: 307401 - DNA, 25 bp, Homo sapien
cccggagattgaagggaagccccag

SEQ ID NO: 307402 - DNA, 25 bp, Homo sapien
ggagagggccgctgctcgccaggct

SEQ ID NO: 307403 - DNA, 25 bp, Homo sapien
agtggaaagctggatctctgcctaa

SEQ ID NO: 307404 - DNA, 25 bp, Homo sapien
ggatctctgcctaaagtcacggtag

SEQ ID NO: 307405 - DNA, 25 bp, Homo sapien
agagtgcacatctatctgacctcat

SEQ ID NO: 307406 - DNA, 25 bp, Homo sapien
tgacctcatcccacactgacaggtg

SEQ ID NO: 307407 - DNA, 25 bp, Homo sapien
agagagttgcacacattcctggcct

SEQ ID NO: 307408 - DNA, 25 bp, Homo sapien
cacattcctggcctggaagttggaa

SEQ ID NO: 307409 - DNA, 25 bp, Homo sapien
aggagcgtgggctgctcactgtccc

SEQ ID NO: 307410 - DNA, 25 bp, Homo sapien
gtgggctgctcactgtcccacttaa

SEQ ID NO: 307411 - DNA, 25 bp, Homo sapien
aaggtagcaagttagaggtctgaga

SEQ ID NO: 307412 - DNA, 25 bp, Homo sapien
aaatctctaaccaggttccaccaag

SEQ ID NO: 307413 - DNA, 25 bp, Homo sapien
tctaaccaggttccaccaaggtggt

SEQ ID NO: 307414 - DNA, 25 bp, Homo sapien
aacatcaagggtacccaccagcagg

SEQ ID NO: 307415 - DNA, 25 bp, Homo sapien
cttcctccgctgcaggatgaagtat

SEQ ID NO: 307416 - DNA, 25 bp, Homo sapien
tgaagtatgggttggccctctcggt

SEQ ID NO: 307417 - DNA, 25 bp, Homo sapien
atgggttggccctctcggtgatcca

SEQ ID NO: 307418 - DNA, 25 bp, Homo sapien
tcggtgatccacagcgcgttggcca

SEQ ID NO: 307419 - DNA, 25 bp, Homo sapien
atccacagcgcgttggccagcaaca

SEQ ID NO: 307420 - DNA, 25 bp, Homo sapien
gggttcacccacatggtcctggctg

SEQ ID NO: 307421 - DNA, 25 bp, Homo sapien
acaatgggcccgtgggtccagtcct

SEQ ID NO: 307422 - DNA, 25 bp, Homo sapien
cgggcgctggagtccaacacaacat

SEQ ID NO: 307423 - DNA, 25 bp, Homo sapien
cgctggagtccaacacaacatcaag

SEQ ID NO: 307424 - DNA, 25 bp, Homo sapien
gagtccaacacaacatcaagggtac

SEQ ID NO: 307425 - DNA, 25 bp, Homo sapien
cagtttagtgtcatgaactattcac

SEQ ID NO: 307426 - DNA, 25 bp, Homo sapien
tgaactattcacttcatatttttct

SEQ ID NO: 307427 - DNA, 25 bp, Homo sapien
atcttgtagtaactctttaaaatgt

SEQ ID NO: 307428 - DNA, 25 bp, Homo sapien
atgtatgtaagtaaatggctgcaga

SEQ ID NO: 307429 - DNA, 25 bp, Homo sapien
agtaaatggctgcagaaagtttttt

SEQ ID NO: 307430 - DNA, 25 bp, Homo sapien
ttttttagagaatcctgcttccatc

SEQ ID NO: 307431 - DNA, 25 bp, Homo sapien
gagaatcctgcttccatcagtaata

SEQ ID NO: 307432 - DNA, 25 bp, Homo sapien
gctggcccagccgagatttgttttc

SEQ ID NO: 307433 - DNA, 25 bp, Homo sapien
cccagccgagatttgttttctaaga

SEQ ID NO: 307434 - DNA, 25 bp, Homo sapien
gttttctaagatactttgtgtcatg

SEQ ID NO: 307435 - DNA, 25 bp, Homo sapien
agatactttgtgtcatgaacagttc

SEQ ID NO: 307436 - DNA, 25 bp, Homo sapien
attaattctcccctaacatccagtt

SEQ ID NO: 307437 - DNA, 25 bp, Homo sapien
tctcccctaacatccagttctgtag

SEQ ID NO: 307438 - DNA, 25 bp, Homo sapien
cagttctgtagccactcactttcca

SEQ ID NO: 307439 - DNA, 25 bp, Homo sapien
tctgtagccactcactttccacaga

SEQ ID NO: 307440 - DNA, 25 bp, Homo sapien
gcaacaactgctatcagtttccttt

SEQ ID NO: 307441 - DNA, 25 bp, Homo sapien
atttcataaattctttggacaaaag

SEQ ID NO: 307442 - DNA, 25 bp, Homo sapien
ggacaaaagtaggttattcataata

SEQ ID NO: 307443 - DNA, 25 bp, Homo sapien
gtgatttattacacattctcattat

SEQ ID NO: 307444 - DNA, 25 bp, Homo sapien
acacattctcattattagtccacat

SEQ ID NO: 307445 - DNA, 25 bp, Homo sapien
attagtccacatttggcctacttca

SEQ ID NO: 307446 - DNA, 25 bp, Homo sapien
tagtccacatttggcctacttcatt

SEQ ID NO: 307447 - DNA, 25 bp, Homo sapien
taactattcagagcttcttcaatct

SEQ ID NO: 307448 - DNA, 25 bp, Homo sapien
cagagcttcttcaatctctagtaag

SEQ ID NO: 307449 - DNA, 25 bp, Homo sapien
ctctagtaagcttgaaggtggtgtc

SEQ ID NO: 307450 - DNA, 25 bp, Homo sapien
gggtgacatttagactctgttcatt

SEQ ID NO: 307451 - DNA, 25 bp, Homo sapien
atgatgtgacatctagtatgtggta

SEQ ID NO: 307452 - DNA, 25 bp, Homo sapien
attgcacagactttataatccatta

SEQ ID NO: 307453 - DNA, 25 bp, Homo sapien
taattccatactttttactgtggca

SEQ ID NO: 307454 - DNA, 25 bp, Homo sapien
ccatactttttactgtggcaagggt

SEQ ID NO: 307455 - DNA, 25 bp, Homo sapien
ttttactgtggcaagggtgtgatgt

SEQ ID NO: 307456 - DNA, 25 bp, Homo sapien
caagggtgtgatgtgattgttaatc

SEQ ID NO: 307457 - DNA, 25 bp, Homo sapien
gaatccaaactgaatttaaagtgtt

SEQ ID NO: 307458 - DNA, 25 bp, Homo sapien
gacttttatgtcacttggacaacaa

SEQ ID NO: 307459 - DNA, 25 bp, Homo sapien
acttggacaacaaaccagtgcttag

SEQ ID NO: 307460 - DNA, 25 bp, Homo sapien
caaaccagtgcttaggaacggttat

SEQ ID NO: 307461 - DNA, 25 bp, Homo sapien
gaacggttattttcctgtcgacatc

SEQ ID NO: 307462 - DNA, 25 bp, Homo sapien
ttattttcctgtcgacatcgctgca

SEQ ID NO: 307463 - DNA, 25 bp, Homo sapien
gacatcgctgcatggatacttctta

SEQ ID NO: 307464 - DNA, 25 bp, Homo sapien
cgctgcatggatacttcttagaaga

SEQ ID NO: 307465 - DNA, 25 bp, Homo sapien
gaacataacagcattagcactcagt

SEQ ID NO: 307466 - DNA, 25 bp, Homo sapien
taacagcattagcactcagtcccag

SEQ ID NO: 307467 - DNA, 25 bp, Homo sapien
ttagcactcagtcccaggttctgct

SEQ ID NO: 307468 - DNA, 25 bp, Homo sapien
aggctgggaaagtaacatgcactgt

SEQ ID NO: 307469 - DNA, 25 bp, Homo sapien
agttggagcgaggttggcagtagca

SEQ ID NO: 307470 - DNA, 25 bp, Homo sapien
gggtggacagccagccgaggaggtg

SEQ ID NO: 307471 - DNA, 25 bp, Homo sapien
gaggaggtgccacgtcccggagcgc

SEQ ID NO: 307472 - DNA, 25 bp, Homo sapien
atgcccgcatccagactgctgtgaa

SEQ ID NO: 307473 - DNA, 25 bp, Homo sapien
tccagactgctgtgaaggcggctgc

SEQ ID NO: 307474 - DNA, 25 bp, Homo sapien
gtgaaggcggctgcgctctctcagt

SEQ ID NO: 307475 - DNA, 25 bp, Homo sapien
tctctcagtgccgtctcgggagtgt

SEQ ID NO: 307476 - DNA, 25 bp, Homo sapien
tctcgggagtgtgctggtcctctgt

SEQ ID NO: 307477 - DNA, 25 bp, Homo sapien
gggagtgtgctggtcctctgtttcc

SEQ ID NO: 307478 - DNA, 25 bp, Homo sapien
tttacttcaatatcaggcgtctggg

SEQ ID NO: 307479 - DNA, 25 bp, Homo sapien
gagaaaacctccccgatattttcag

SEQ ID NO: 307480 - DNA, 25 bp, Homo sapien
tggtgggtaggcaggcatttcctca

SEQ ID NO: 307481 - DNA, 25 bp, Homo sapien
ttcctcaggcctctcagtagtaagt

SEQ ID NO: 307482 - DNA, 25 bp, Homo sapien
agtagtaagtgtgagcactagctct

SEQ ID NO: 307483 - DNA, 25 bp, Homo sapien
gtgagcactagctctggaggcagat

SEQ ID NO: 307484 - DNA, 25 bp, Homo sapien
gcactagctctggaggcagatgagt

SEQ ID NO: 307485 - DNA, 25 bp, Homo sapien
ggcagatgagtcaatctccaggccc

SEQ ID NO: 307486 - DNA, 25 bp, Homo sapien
ccccagatggtacattcaggcacca

SEQ ID NO: 307487 - DNA, 25 bp, Homo sapien
gatggtacattcaggcaccagcata

SEQ ID NO: 307488 - DNA, 25 bp, Homo sapien
ggtacattcaggcaccagcatattc

SEQ ID NO: 307489 - DNA, 25 bp, Homo sapien
ttcaggcaccagcatattcctatgc

SEQ ID NO: 307490 - DNA, 25 bp, Homo sapien
attcctatgcatttctagataaaag

SEQ ID NO: 307491 - DNA, 25 bp, Homo sapien
ccaccatgctgaagatggccatgaa

SEQ ID NO: 307492 - DNA, 25 bp, Homo sapien
gatggccatgaagctcaaagcccgg

SEQ ID NO: 307493 - DNA, 25 bp, Homo sapien
tggccatgaagctcaaagcccgggc

SEQ ID NO: 307494 - DNA, 25 bp, Homo sapien
ccatgaagctcaaagcccgggcggc

SEQ ID NO: 307495 - DNA, 25 bp, Homo sapien
gagagcgagaagaagacggccgcgg

SEQ ID NO: 307496 - DNA, 25 bp, Homo sapien
aggtggctgccgaagctgcggcggc

SEQ ID NO: 307497 - DNA, 25 bp, Homo sapien
ggctgcggcgttggccgagccgaga

SEQ ID NO: 307498 - DNA, 25 bp, Homo sapien
gttggccgagccgagagagccgctc

SEQ ID NO: 307499 - DNA, 25 bp, Homo sapien
gagagagccgctcgcgccgcggaag

SEQ ID NO: 307500 - DNA, 25 bp, Homo sapien
gaccccgagaagctcgcgaagaacc

SEQ ID NO: 307501 - DNA, 25 bp, Homo sapien
gagaagctcgcgaagaaccccaaga

SEQ ID NO: 307502 - DNA, 25 bp, Homo sapien
cacaggcgatggtccagtagaccca

SEQ ID NO: 307503 - DNA, 25 bp, Homo sapien
atggtccagtagacccagggagtct

SEQ ID NO: 307504 - DNA, 25 bp, Homo sapien
gtccagtagacccagggagtctcga

SEQ ID NO: 307505 - DNA, 25 bp, Homo sapien
agtagacccagggagtctcgagtct

SEQ ID NO: 307506 - DNA, 25 bp, Homo sapien
agacccagggagtctcgagtctggt

SEQ ID NO: 307507 - DNA, 25 bp, Homo sapien
acccagggagtctcgagtctggtac

SEQ ID NO: 307508 - DNA, 25 bp, Homo sapien
agggagtctcgagtctggtacaaga

SEQ ID NO: 307509 - DNA, 25 bp, Homo sapien
gagtctcgagtctggtacaagattc

SEQ ID NO: 307510 - DNA, 25 bp, Homo sapien
ctcgagtctggtacaagattcggta

SEQ ID NO: 307511 - DNA, 25 bp, Homo sapien
cgagtctggtacaagattcggtaag

SEQ ID NO: 307512 - DNA, 25 bp, Homo sapien
ctggtacaagattcggtaaggagcg

SEQ ID NO: 307513 - DNA, 25 bp, Homo sapien
tgaggaaacagccaaatcctgcaag

SEQ ID NO: 307514 - DNA, 25 bp, Homo sapien
acgaggcttagtgtttcctgactta

SEQ ID NO: 307515 - DNA, 25 bp, Homo sapien
tggcatctgtaaggtatccagatgt

SEQ ID NO: 307516 - DNA, 25 bp, Homo sapien
tcactgtcaccagttccgagagctt

SEQ ID NO: 307517 - DNA, 25 bp, Homo sapien
gtgtttcctgacttattacacatca

SEQ ID NO: 307518 - DNA, 25 bp, Homo sapien
gtcaccagttccgagagcttccatt

SEQ ID NO: 307519 - DNA, 25 bp, Homo sapien
agagcttccattccacggctagaat

SEQ ID NO: 307520 - DNA, 25 bp, Homo sapien
cattccacggctagaattgcatggc

SEQ ID NO: 307521 - DNA, 25 bp, Homo sapien
ggcttgagttggttgaaacagtaca

SEQ ID NO: 307522 - DNA, 25 bp, Homo sapien
aaacagtacacatacctgcaggcag

SEQ ID NO: 307523 - DNA, 25 bp, Homo sapien
tgggtgggtcttatctgaggatgtc

SEQ ID NO: 307524 - DNA, 25 bp, Homo sapien
ggccacccaaagtgcccatgtttca

SEQ ID NO: 307525 - DNA, 25 bp, Homo sapien
ggctgtgagagaagccctcagagaa

SEQ ID NO: 307526 - DNA, 25 bp, Homo sapien
gagaagccctcagagaagtgcccaa

SEQ ID NO: 307527 - DNA, 25 bp, Homo sapien
aagccctcagagaagtgcccaatgg

SEQ ID NO: 307528 - DNA, 25 bp, Homo sapien
gaaagccagcttgccgtgttcccgg

SEQ ID NO: 307529 - DNA, 25 bp, Homo sapien
agcttgccgtgttcccggtgcaggc

SEQ ID NO: 307530 - DNA, 25 bp, Homo sapien
cctcgcaggcggagcataggtcgta

SEQ ID NO: 307531 - DNA, 25 bp, Homo sapien
cataggtcgtagtcagggcagacgc

SEQ ID NO: 307532 - DNA, 25 bp, Homo sapien
acgggcccgttacagccgtcacaga

SEQ ID NO: 307533 - DNA, 25 bp, Homo sapien
gttacagccgtcacagatcacgttg

SEQ ID NO: 307534 - DNA, 25 bp, Homo sapien
tacagccgtcacagatcacgttggg

SEQ ID NO: 307535 - DNA, 25 bp, Homo sapien
gccttcctggtttgccacaggggct

SEQ ID NO: 307536 - DNA, 25 bp, Homo sapien
tactcctttgattctacatcctcct

SEQ ID NO: 307537 - DNA, 25 bp, Homo sapien
gattctacatcctcctcgaagtgtg

SEQ ID NO: 307538 - DNA, 25 bp, Homo sapien
attctacatcctcctcgaagtgtgt

SEQ ID NO: 307539 - DNA, 25 bp, Homo sapien
tctacatcctcctcgaagtgtgtga

SEQ ID NO: 307540 - DNA, 25 bp, Homo sapien
ctacatcctcctcgaagtgtgtgag

SEQ ID NO: 307541 - DNA, 25 bp, Homo sapien
acatcctcctcgaagtgtgtgaggt

SEQ ID NO: 307542 - DNA, 25 bp, Homo sapien
atcctcctcgaagtgtgtgaggtag

SEQ ID NO: 307543 - DNA, 25 bp, Homo sapien
gtgaggtaggccatctgagccgaat

SEQ ID NO: 307544 - DNA, 25 bp, Homo sapien
aggtaggccatctgagccgaatcgc

SEQ ID NO: 307545 - DNA, 25 bp, Homo sapien
taggccatctgagccgaatcgcgcg

SEQ ID NO: 307546 - DNA, 25 bp, Homo sapien
aggagtaaagtatcttgtctgaaat

SEQ ID NO: 307547 - DNA, 25 bp, Homo sapien
agagtttctatacagcatgcttatt

SEQ ID NO: 307548 - DNA, 25 bp, Homo sapien
atgcttatttggagtcatgcctaac

SEQ ID NO: 307549 - DNA, 25 bp, Homo sapien
tggagtcatgcctaacaagattact

SEQ ID NO: 307550 - DNA, 25 bp, Homo sapien
ctaacaagattactttgggtctaat

SEQ ID NO: 307551 - DNA, 25 bp, Homo sapien
ttcagactttgatttgggccttgga

SEQ ID NO: 307552 - DNA, 25 bp, Homo sapien
ggtctaattttggaagcttggtact

SEQ ID NO: 307553 - DNA, 25 bp, Homo sapien
tggaagcttggtactccagggagct

SEQ ID NO: 307554 - DNA, 25 bp, Homo sapien
gcttggtactccagggagcttggac

SEQ ID NO: 307555 - DNA, 25 bp, Homo sapien
atgggaactcacatttaagtttctg

SEQ ID NO: 307556 - DNA, 25 bp, Homo sapien
gtaaaaggaggcaaagagcgacctt

SEQ ID NO: 307557 - DNA, 25 bp, Homo sapien
ctacaatcattagcagttttaatac

SEQ ID NO: 307558 - DNA, 25 bp, Homo sapien
taatactgctgtgtcagttttgtaa

SEQ ID NO: 307559 - DNA, 25 bp, Homo sapien
aaatgtacattatgtcttttgacat

SEQ ID NO: 307560 - DNA, 25 bp, Homo sapien
gtcttttgacatgttgaattttaaa

SEQ ID NO: 307561 - DNA, 25 bp, Homo sapien
gacattgtaaatcatagtagcctct

SEQ ID NO: 307562 - DNA, 25 bp, Homo sapien
aatgccactatattgaaagtactta

SEQ ID NO: 307563 - DNA, 25 bp, Homo sapien
gtatatatttctctactttggttct

SEQ ID NO: 307564 - DNA, 25 bp, Homo sapien
ttctctactttggttctagctattt

SEQ ID NO: 307565 - DNA, 25 bp, Homo sapien
ctagctattttatatgattgacatg

SEQ ID NO: 307566 - DNA, 25 bp, Homo sapien
taactgccttgaacttttggagact

SEQ ID NO: 307567 - DNA, 25 bp, Homo sapien
gaacttttggagacttgtactgtaa

SEQ ID NO: 307568 - DNA, 25 bp, Homo sapien
atggatctgactaaagggatgttca

SEQ ID NO: 307569 - DNA, 25 bp, Homo sapien
gaaaggaaattccaagcacttgggt

SEQ ID NO: 307570 - DNA, 25 bp, Homo sapien
gcacttgggtaaaagcttcatagct

SEQ ID NO: 307571 - DNA, 25 bp, Homo sapien
gaatgaactcgtgagcaaagcaaac

SEQ ID NO: 307572 - DNA, 25 bp, Homo sapien
gcaaagcaaacagccaggtacattt

SEQ ID NO: 307573 - DNA, 25 bp, Homo sapien
acagccaggtacatttgggagatgc

SEQ ID NO: 307574 - DNA, 25 bp, Homo sapien
tgaggatggaattaacaggcacaga

SEQ ID NO: 307575 - DNA, 25 bp, Homo sapien
ggcacagagtggttggcagcccaac

SEQ ID NO: 307576 - DNA, 25 bp, Homo sapien
gcagcccaacgtttgtgcaagtctg

SEQ ID NO: 307577 - DNA, 25 bp, Homo sapien
gcaagtctggcacatgcacacatca

SEQ ID NO: 307578 - DNA, 25 bp, Homo sapien
tgcacacatcattagcaactatgct

SEQ ID NO: 307579 - DNA, 25 bp, Homo sapien
accatttctagagggcccagtaggt

SEQ ID NO: 307580 - DNA, 25 bp, Homo sapien
gtaggtacatgttcgatctccagtc

SEQ ID NO: 307581 - DNA, 25 bp, Homo sapien
gtaggagatatcattcccatattat

SEQ ID NO: 307582 - DNA, 25 bp, Homo sapien
acagaaggtcgagtgacatgcctga

SEQ ID NO: 307583 - DNA, 25 bp, Homo sapien
tatggctgtgatccagtgcctgatt

SEQ ID NO: 307584 - DNA, 25 bp, Homo sapien
gtgcctgattcctaagcagatgtct

SEQ ID NO: 307585 - DNA, 25 bp, Homo sapien
agatgtctgtaagtggcagcttaga

SEQ ID NO: 307586 - DNA, 25 bp, Homo sapien
gcagcttagacgaggtaatggccat

SEQ ID NO: 307587 - DNA, 25 bp, Homo sapien
taatggccattttacctctccgaat

SEQ ID NO: 307588 - DNA, 25 bp, Homo sapien
tccgaatccagctcaggtgaaccag

SEQ ID NO: 307589 - DNA, 25 bp, Homo sapien
aggaaggtgtgctccatgctctgaa

SEQ ID NO: 307590 - DNA, 25 bp, Homo sapien
actcctttgtccagtctctatccag

SEQ ID NO: 307591 - DNA, 25 bp, Homo sapien
tttgtccagtctctatccagacttc

SEQ ID NO: 307592 - DNA, 25 bp, Homo sapien
ccgctcctacaaagccgaattttag

SEQ ID NO: 307593 - DNA, 25 bp, Homo sapien
tggtggccctcgtgggatcccgggt

SEQ ID NO: 307594 - DNA, 25 bp, Homo sapien
acaggcctgggcgacggtcagaagc

SEQ ID NO: 307595 - DNA, 25 bp, Homo sapien
gattttattcctatgaacgagtcca

SEQ ID NO: 307596 - DNA, 25 bp, Homo sapien
attcctatgaacgagtccatcgccg

SEQ ID NO: 307597 - DNA, 25 bp, Homo sapien
tatgaacgagtccatcgccgcagct

SEQ ID NO: 307598 - DNA, 25 bp, Homo sapien
gaacgagtccatcgccgcagctgtg

SEQ ID NO: 307599 - DNA, 25 bp, Homo sapien
gtccatcgccgcagctgtggcgcta

SEQ ID NO: 307600 - DNA, 25 bp, Homo sapien
tgtggcgctatccacttctcactgt

SEQ ID NO: 307601 - DNA, 25 bp, Homo sapien
ggtttaatccagaaatacggcctca

SEQ ID NO: 307602 - DNA, 25 bp, Homo sapien
atacggcctcaatgtgtgccaccag

SEQ ID NO: 307603 - DNA, 25 bp, Homo sapien
ccaccagtgtttccatcagtatttg

SEQ ID NO: 307604 - DNA, 25 bp, Homo sapien
gttggactattcaaggaagatcatt

SEQ ID NO: 307605 - DNA, 25 bp, Homo sapien
gtgatcttctttgaatgaattatcc

SEQ ID NO: 307606 - DNA, 25 bp, Homo sapien
atgaattatccaaggtatataccca

SEQ ID NO: 307607 - DNA, 25 bp, Homo sapien
gatgagtcaccagaagtttacccac

SEQ ID NO: 307608 - DNA, 25 bp, Homo sapien
gtttacccacaataattcagtcagg

SEQ ID NO: 307609 - DNA, 25 bp, Homo sapien
acaataattcagtcagggttctcac

SEQ ID NO: 307610 - DNA, 25 bp, Homo sapien
agggttctcactcttgtcaagttta

SEQ ID NO: 307611 - DNA, 25 bp, Homo sapien
aagtttactcaaactggcatggttt

SEQ ID NO: 307612 - DNA, 25 bp, Homo sapien
cccagcgctgccatgtagagcagcg

SEQ ID NO: 307613 - DNA, 25 bp, Homo sapien
ccatgtagagcagcgcgggccggga

SEQ ID NO: 307614 - DNA, 25 bp, Homo sapien
cgggacggcgcttcttcgcagcgca

SEQ ID NO: 307615 - DNA, 25 bp, Homo sapien
ttcttcgcagcgcagcaggcgtccg

SEQ ID NO: 307616 - DNA, 25 bp, Homo sapien
agtgaccagagcagcgcgaacttgc

SEQ ID NO: 307617 - DNA, 25 bp, Homo sapien
agcagcgcgaacttgcgcgcgcgca

SEQ ID NO: 307618 - DNA, 25 bp, Homo sapien
cgcagcagcaacaccggtgcgtaga

SEQ ID NO: 307619 - DNA, 25 bp, Homo sapien
aacaccggtgcgtagagcgcggcta

SEQ ID NO: 307620 - DNA, 25 bp, Homo sapien
tagagcgcggctaggccgaaacaca

SEQ ID NO: 307621 - DNA, 25 bp, Homo sapien
agcaccgtgagcagcgtgctgcgaa

SEQ ID NO: 307622 - DNA, 25 bp, Homo sapien
ctgcgaaggcccagcgcggcgaaca

SEQ ID NO: 307623 - DNA, 25 bp, Homo sapien
agccctgggacgtgcttccggcgct

SEQ ID NO: 307624 - DNA, 25 bp, Homo sapien
ttccggcgctgctcgcaggactgcg

SEQ ID NO: 307625 - DNA, 25 bp, Homo sapien
acatcaacgagtgcgaggaggagag

SEQ ID NO: 307626 - DNA, 25 bp, Homo sapien
tctacgctgcagtaccggctgctgc

SEQ ID NO: 307627 - DNA, 25 bp, Homo sapien
tacgctgcagtaccggctgctgccg

SEQ ID NO: 307628 - DNA, 25 bp, Homo sapien
caaccgcaccgagctcagcatgctg

SEQ ID NO: 307629 - DNA, 25 bp, Homo sapien
agcatcgagtgtggacccggccaga

SEQ ID NO: 307630 - DNA, 25 bp, Homo sapien
catcgagtgtggacccggccagatg

SEQ ID NO: 307631 - DNA, 25 bp, Homo sapien
gtggacccggccagatgtgcttcaa

SEQ ID NO: 307632 - DNA, 25 bp, Homo sapien
gacccggccagatgtgcttcaacac

SEQ ID NO: 307633 - DNA, 25 bp, Homo sapien
agtgtgtggacacaccctgtcctgc

SEQ ID NO: 307634 - DNA, 25 bp, Homo sapien
cgcccagccaacacatcacttttat

SEQ ID NO: 307635 - DNA, 25 bp, Homo sapien
cttgcagctcccgagattctctttt

SEQ ID NO: 307636 - DNA, 25 bp, Homo sapien
ttgcagctcccgagattctcttttc

SEQ ID NO: 307637 - DNA, 25 bp, Homo sapien
tgcagctcccgagattctcttttct

SEQ ID NO: 307638 - DNA, 25 bp, Homo sapien
aattgtgcttacatatgtgtttgat

SEQ ID NO: 307639 - DNA, 25 bp, Homo sapien
attgtgcttacatatgtgtttgata

SEQ ID NO: 307640 - DNA, 25 bp, Homo sapien
ttgtgcttacatatgtgtttgatat

SEQ ID NO: 307641 - DNA, 25 bp, Homo sapien
gtgcttacatatgtgtttgatataa

SEQ ID NO: 307642 - DNA, 25 bp, Homo sapien
gatataaatatctttgtattctagt

SEQ ID NO: 307643 - DNA, 25 bp, Homo sapien
atatctttgtattctagtttgtttg

SEQ ID NO: 307644 - DNA, 25 bp, Homo sapien
tatctttgtattctagtttgtttgt

SEQ ID NO: 307645 - DNA, 25 bp, Homo sapien
acagggaattaccttttgtattgct

SEQ ID NO: 307646 - DNA, 25 bp, Homo sapien
gaattaccttttgtattgcttgaat

SEQ ID NO: 307647 - DNA, 25 bp, Homo sapien
actgctgtctgtatgaactcttttt

SEQ ID NO: 307648 - DNA, 25 bp, Homo sapien
gctgtctgtatgaactctttttcag

SEQ ID NO: 307649 - DNA, 25 bp, Homo sapien
gagatcaaagtgttgtggcagcaca

SEQ ID NO: 307650 - DNA, 25 bp, Homo sapien
ggcagcacaaaggagagactgacta

SEQ ID NO: 307651 - DNA, 25 bp, Homo sapien
ctttggtggaggtaacatgagatca

SEQ ID NO: 307652 - DNA, 25 bp, Homo sapien
aagggtgagtcaagtctgtcaagga

SEQ ID NO: 307653 - DNA, 25 bp, Homo sapien
gagtcaagtctgtcaaggagacaag

SEQ ID NO: 307654 - DNA, 25 bp, Homo sapien
agagaagagcttgccagaggcccag

SEQ ID NO: 307655 - DNA, 25 bp, Homo sapien
gagcttgccagaggcccagagacca

SEQ ID NO: 307656 - DNA, 25 bp, Homo sapien
ttcctagaccagcacaggctcgaga

SEQ ID NO: 307657 - DNA, 25 bp, Homo sapien
aggctcgagaaagacatcccctagg

SEQ ID NO: 307658 - DNA, 25 bp, Homo sapien
aaagacatcccctaggcctggactt

SEQ ID NO: 307659 - DNA, 25 bp, Homo sapien
gcagctttagccaggctccggacgg

SEQ ID NO: 307660 - DNA, 25 bp, Homo sapien
tttagccaggctccggacggcagcc

SEQ ID NO: 307661 - DNA, 25 bp, Homo sapien
gccagaggaggcctttccccattgc

SEQ ID NO: 307662 - DNA, 25 bp, Homo sapien
cccattgctcaatggattccatgtt

SEQ ID NO: 307663 - DNA, 25 bp, Homo sapien
aaaatggcagccacctttccaagaa

SEQ ID NO: 307664 - DNA, 25 bp, Homo sapien
atggcagccacctttccaagaaaaa

SEQ ID NO: 307665 - DNA, 25 bp, Homo sapien
aaaatataaagggtccaagctgtat

SEQ ID NO: 307666 - DNA, 25 bp, Homo sapien
gggtccaagctgtatagtatttgtc

SEQ ID NO: 307667 - DNA, 25 bp, Homo sapien
gaattttataatatcaaggcactta

SEQ ID NO: 307668 - DNA, 25 bp, Homo sapien
aatatcaaggcacttaatttttagt

SEQ ID NO: 307669 - DNA, 25 bp, Homo sapien
atatcaaggcacttaatttttagtt

SEQ ID NO: 307670 - DNA, 25 bp, Homo sapien
atcaaggcacttaatttttagttag

SEQ ID NO: 307671 - DNA, 25 bp, Homo sapien
tcaaggcacttaatttttagttagt

SEQ ID NO: 307672 - DNA, 25 bp, Homo sapien
ttttagttagtgatataccatccaa

SEQ ID NO: 307673 - DNA, 25 bp, Homo sapien
tttagttagtgatataccatccaaa

SEQ ID NO: 307674 - DNA, 25 bp, Homo sapien
ttagttagtgatataccatccaaaa

SEQ ID NO: 307675 - DNA, 25 bp, Homo sapien
tagttagtgatataccatccaaaag

SEQ ID NO: 307676 - DNA, 25 bp, Homo sapien
agttagtgatataccatccaaaagg

SEQ ID NO: 307677 - DNA, 25 bp, Homo sapien
gttagtgatataccatccaaaaggc

SEQ ID NO: 307678 - DNA, 25 bp, Homo sapien
agaaaacacacagactccaactgta

SEQ ID NO: 307679 - DNA, 25 bp, Homo sapien
gaaaacacacagactccaactgtac

SEQ ID NO: 307680 - DNA, 25 bp, Homo sapien
aaaacacacagactccaactgtaca

SEQ ID NO: 307681 - DNA, 25 bp, Homo sapien
aaacacacagactccaactgtacaa

SEQ ID NO: 307682 - DNA, 25 bp, Homo sapien
aacacacagactccaactgtacaag

SEQ ID NO: 307683 - DNA, 25 bp, Homo sapien
acacacagactccaactgtacaaga

SEQ ID NO: 307684 - DNA, 25 bp, Homo sapien
cacacagactccaactgtacaagag

SEQ ID NO: 307685 - DNA, 25 bp, Homo sapien
acacagactccaactgtacaagagg

SEQ ID NO: 307686 - DNA, 25 bp, Homo sapien
gaggacgcccctgcggaaggaaggc

SEQ ID NO: 307687 - DNA, 25 bp, Homo sapien
ggaaggaaggcggcgctcctgcggg

SEQ ID NO: 307688 - DNA, 25 bp, Homo sapien
gggctggagagacgcccgcgcggtc

SEQ ID NO: 307689 - DNA, 25 bp, Homo sapien
ggtctcccggctcagggaccgctgg

SEQ ID NO: 307690 - DNA, 25 bp, Homo sapien
gctcagggaccgctggctcgcgggt

SEQ ID NO: 307691 - DNA, 25 bp, Homo sapien
cggcgctatggaaaccgcactttct

SEQ ID NO: 307692 - DNA, 25 bp, Homo sapien
gcgctatggaaaccgcactttctcc

SEQ ID NO: 307693 - DNA, 25 bp, Homo sapien
atggaaaccgcactttctccgcctg

SEQ ID NO: 307694 - DNA, 25 bp, Homo sapien
aaaaggggcgctcctgctcgaaggg

SEQ ID NO: 307695 - DNA, 25 bp, Homo sapien
tcttgaagcggtgtggtgagaggac

SEQ ID NO: 307696 - DNA, 25 bp, Homo sapien
gtggtgagaggacgcttccgaggaa

SEQ ID NO: 307697 - DNA, 25 bp, Homo sapien
ctggttttctacctcggtgaaggat

SEQ ID NO: 307698 - DNA, 25 bp, Homo sapien
ggcgggctgtgcacagggctcccca

SEQ ID NO: 307699 - DNA, 25 bp, Homo sapien
tacctcggtgaaggatctttgacac

SEQ ID NO: 307700 - DNA, 25 bp, Homo sapien
cagccggcgggcctgtaaatgcctc

SEQ ID NO: 307701 - DNA, 25 bp, Homo sapien
cgggcctgtaaatgcctcccttggg

SEQ ID NO: 307702 - DNA, 25 bp, Homo sapien
gtgaaggatctttgacacaggcaac

SEQ ID NO: 307703 - DNA, 25 bp, Homo sapien
catccaggcacccagtggaaacgga

SEQ ID NO: 307704 - DNA, 25 bp, Homo sapien
gcacccagtggaaacggacagctga

SEQ ID NO: 307705 - DNA, 25 bp, Homo sapien
ggacagctgaccatatagcccagtg

SEQ ID NO: 307706 - DNA, 25 bp, Homo sapien
agctgaccatatagcccagtgcctt

SEQ ID NO: 307707 - DNA, 25 bp, Homo sapien
accatatagcccagtgccttttctg

SEQ ID NO: 307708 - DNA, 25 bp, Homo sapien
gaagctctaagacaaacagcttttt

SEQ ID NO: 307709 - DNA, 25 bp, Homo sapien
aataattccttgtatggcttatggt

SEQ ID NO: 307710 - DNA, 25 bp, Homo sapien
agagcactgctctttcaaatacagt

SEQ ID NO: 307711 - DNA, 25 bp, Homo sapien
aatcatctgatattgacgagtcttt

SEQ ID NO: 307712 - DNA, 25 bp, Homo sapien
gagtctttttcgatatctagttcca

SEQ ID NO: 307713 - DNA, 25 bp, Homo sapien
gatatctagttccactcacttctca

SEQ ID NO: 307714 - DNA, 25 bp, Homo sapien
tcacttctcaccgaagcagagttgg

SEQ ID NO: 307715 - DNA, 25 bp, Homo sapien
gcagcaaatttatgccgattgtatc

SEQ ID NO: 307716 - DNA, 25 bp, Homo sapien
atttatgccgattgtatcctttaat

SEQ ID NO: 307717 - DNA, 25 bp, Homo sapien
cagcctctctagtcttcaagtatgg

SEQ ID NO: 307718 - DNA, 25 bp, Homo sapien
tcaagtatggcccaagctcctaaga

SEQ ID NO: 307719 - DNA, 25 bp, Homo sapien
ttgtctgcctttctggaaccaaatc

SEQ ID NO: 307720 - DNA, 25 bp, Homo sapien
ccagcagggcacaggatgctaggat

SEQ ID NO: 307721 - DNA, 25 bp, Homo sapien
taggataaagctgtggcgccccaaa

SEQ ID NO: 307722 - DNA, 25 bp, Homo sapien
tgtggcgccccaaaagtggcctgct

SEQ ID NO: 307723 - DNA, 25 bp, Homo sapien
atacatacagtctgagcttgacact

SEQ ID NO: 307724 - DNA, 25 bp, Homo sapien
cactgtataatttggcccagaacaa

SEQ ID NO: 307725 - DNA, 25 bp, Homo sapien
atgtattttgagctcatttaggtga

SEQ ID NO: 307726 - DNA, 25 bp, Homo sapien
aatgactttggcattccatgtaccc

SEQ ID NO: 307727 - DNA, 25 bp, Homo sapien
ttggcattccatgtacccactaggg

SEQ ID NO: 307728 - DNA, 25 bp, Homo sapien
ggaagctttatcaggctgcatttgc

SEQ ID NO: 307729 - DNA, 25 bp, Homo sapien
tttgccttatgcagaagtatgcctt

SEQ ID NO: 307730 - DNA, 25 bp, Homo sapien
tgtacaagtcccttagcgttgctct

SEQ ID NO: 307731 - DNA, 25 bp, Homo sapien
tacaagtcccttagcgttgctctga

SEQ ID NO: 307732 - DNA, 25 bp, Homo sapien
acaagtcccttagcgttgctctgag

SEQ ID NO: 307733 - DNA, 25 bp, Homo sapien
aagtcccttagcgttgctctgagga

SEQ ID NO: 307734 - DNA, 25 bp, Homo sapien
tcccttagcgttgctctgaggacag

SEQ ID NO: 307735 - DNA, 25 bp, Homo sapien
ccttagcgttgctctgaggacagga

SEQ ID NO: 307736 - DNA, 25 bp, Homo sapien
agcgttgctctgaggacaggagcaa

SEQ ID NO: 307737 - DNA, 25 bp, Homo sapien
ggtgccagggcagtctggacttgga

SEQ ID NO: 307738 - DNA, 25 bp, Homo sapien
tggacttggagttgggcttggcaga

SEQ ID NO: 307739 - DNA, 25 bp, Homo sapien
gcttggcagagggatgttgcaggtg

SEQ ID NO: 307740 - DNA, 25 bp, Homo sapien
gctggtagagttcctcccccatgca

SEQ ID NO: 307741 - DNA, 25 bp, Homo sapien
ctgttggctttgtattctgggaatt

SEQ ID NO: 307742 - DNA, 25 bp, Homo sapien
gaattagcccaagactatgctgctc

SEQ ID NO: 307743 - DNA, 25 bp, Homo sapien
atgggtgcaaatatactctcaggtt

SEQ ID NO: 307744 - DNA, 25 bp, Homo sapien
tatactctcaggttgcaatagcatg

SEQ ID NO: 307745 - DNA, 25 bp, Homo sapien
gcatgacgagtggtatttgaagcaa

SEQ ID NO: 307746 - DNA, 25 bp, Homo sapien
gaagcaataattgttccatcttgga

SEQ ID NO: 307747 - DNA, 25 bp, Homo sapien
gttccatcttggattatcggttttg

SEQ ID NO: 307748 - DNA, 25 bp, Homo sapien
ggattatcggttttgctctttgatt

SEQ ID NO: 307749 - DNA, 25 bp, Homo sapien
tttttgtttttctactcgtgccagt

SEQ ID NO: 307750 - DNA, 25 bp, Homo sapien
ttctactcgtgccagttgtattaaa

SEQ ID NO: 307751 - DNA, 25 bp, Homo sapien
caacctagttgtcttctaataacct

SEQ ID NO: 307752 - DNA, 25 bp, Homo sapien
ttctggaggccggagttggaaatca

SEQ ID NO: 307753 - DNA, 25 bp, Homo sapien
ggaaatcagtttcactgggcacaca

SEQ ID NO: 307754 - DNA, 25 bp, Homo sapien
ttcactgggcacacatggaggtgtt

SEQ ID NO: 307755 - DNA, 25 bp, Homo sapien
aggacccttcagattatattacgaa

SEQ ID NO: 307756 - DNA, 25 bp, Homo sapien
tgtttgaagggctgcccgtgccaga

SEQ ID NO: 307757 - DNA, 25 bp, Homo sapien
cgtgccagaggctctcagggagaat

SEQ ID NO: 307758 - DNA, 25 bp, Homo sapien
ctctcagggagaatcccttccttgt

SEQ ID NO: 307759 - DNA, 25 bp, Homo sapien
gaaaaaaggatgtcttgtcctgtgt

SEQ ID NO: 307760 - DNA, 25 bp, Homo sapien
gtgtgaactggaacagcgcttagaa

SEQ ID NO: 307761 - DNA, 25 bp, Homo sapien
aaacctgggcaagactgcgaatgtg

SEQ ID NO: 307762 - DNA, 25 bp, Homo sapien
tgcgaatgtgtgctactatccatcc

SEQ ID NO: 307763 - DNA, 25 bp, Homo sapien
gtctgaaaagacaggccttatattt

SEQ ID NO: 307764 - DNA, 25 bp, Homo sapien
gatcctgacatttaatgagacacta

SEQ ID NO: 307765 - DNA, 25 bp, Homo sapien
tttttgcttacttattctgttctag

SEQ ID NO: 307766 - DNA, 25 bp, Homo sapien
ttctgttctagaatccaaactctac

SEQ ID NO: 307767 - DNA, 25 bp, Homo sapien
agaatccaaactctacatactgttt

SEQ ID NO: 307768 - DNA, 25 bp, Homo sapien
gcattattgatattagctgtattag

SEQ ID NO: 307769 - DNA, 25 bp, Homo sapien
tagctgtattagatgactgtatgaa

SEQ ID NO: 307770 - DNA, 25 bp, Homo sapien
actgtatgaagagtcctgtttgcta

SEQ ID NO: 307771 - DNA, 25 bp, Homo sapien
gaagagtcctgtttgctagaatcct

SEQ ID NO: 307772 - DNA, 25 bp, Homo sapien
gtcctgtttgctagaatcctacttt

SEQ ID NO: 307773 - DNA, 25 bp, Homo sapien
atgtgtccactgtttccttgtgcct

SEQ ID NO: 307774 - DNA, 25 bp, Homo sapien
acactgacgtcaggcccacgtgcat

SEQ ID NO: 307775 - DNA, 25 bp, Homo sapien
ttcctaatgggctcccatttttcag

SEQ ID NO: 307776 - DNA, 25 bp, Homo sapien
gctgggcaaaggtcccttgatcttg

SEQ ID NO: 307777 - DNA, 25 bp, Homo sapien
ttgatcttggagttgcagcctcttt

SEQ ID NO: 307778 - DNA, 25 bp, Homo sapien
ggagttgcagcctctttctctccaa

SEQ ID NO: 307779 - DNA, 25 bp, Homo sapien
tttctctccaaggagggcggtgacc

SEQ ID NO: 307780 - DNA, 25 bp, Homo sapien
aaggagggcggtgaccagcctgagc

SEQ ID NO: 307781 - DNA, 25 bp, Homo sapien
cagcctgagccagtcaatccagtga

SEQ ID NO: 307782 - DNA, 25 bp, Homo sapien
attggttcaggagtagcctgtgacc

SEQ ID NO: 307783 - DNA, 25 bp, Homo sapien
caggagtagcctgtgaccaggagtc

SEQ ID NO: 307784 - DNA, 25 bp, Homo sapien
ttggccaagtgagaggagcacacct

SEQ ID NO: 307785 - DNA, 25 bp, Homo sapien
gtcgtttcttcagatgctgaccagt

SEQ ID NO: 307786 - DNA, 25 bp, Homo sapien
gatgctgaccagtatctgaattcag

SEQ ID NO: 307787 - DNA, 25 bp, Homo sapien
aaatagatgaaatactgctgtcagt

SEQ ID NO: 307788 - DNA, 25 bp, Homo sapien
tgctgtcagtaccacggttgctggc

SEQ ID NO: 307789 - DNA, 25 bp, Homo sapien
accacggttgctggctcttgtttag

SEQ ID NO: 307790 - DNA, 25 bp, Homo sapien
ggctcttgtttagcttctgagtcag

SEQ ID NO: 307791 - DNA, 25 bp, Homo sapien
caagtgccactctgtttttggacaa

SEQ ID NO: 307792 - DNA, 25 bp, Homo sapien
cactctgtttttggacaacggtcaa

SEQ ID NO: 307793 - DNA, 25 bp, Homo sapien
ttggacaacggtcaacaagcttcac

SEQ ID NO: 307794 - DNA, 25 bp, Homo sapien
ggtcaacaagcttcaccgccaagtg

SEQ ID NO: 307795 - DNA, 25 bp, Homo sapien
atgagagctttgtcgtttcttcaga

SEQ ID NO: 307796 - DNA, 25 bp, Homo sapien
cacaaatgtccctagtacagtaata

SEQ ID NO: 307797 - DNA, 25 bp, Homo sapien
aatgtccctagtacagtaataagga

SEQ ID NO: 307798 - DNA, 25 bp, Homo sapien
cccaggactttcggaaggattgctt

SEQ ID NO: 307799 - DNA, 25 bp, Homo sapien
caggagttgcagatcggccaggaca

SEQ ID NO: 307800 - DNA, 25 bp, Homo sapien
aggagttgcagatcggccaggacaa

SEQ ID NO: 307801 - DNA, 25 bp, Homo sapien
ttgcagatcggccaggacaatgtaa

SEQ ID NO: 307802 - DNA, 25 bp, Homo sapien
agatcggccaggacaatgtaagaaa

SEQ ID NO: 307803 - DNA, 25 bp, Homo sapien
ggacaatgtaagaaaaccccatgta

SEQ ID NO: 307804 - DNA, 25 bp, Homo sapien
aatgtaagaaaaccccatgtattag

SEQ ID NO: 307805 - DNA, 25 bp, Homo sapien
aggtggcaggatcgcatatagccca

SEQ ID NO: 307806 - DNA, 25 bp, Homo sapien
gcaggatcgcatatagcccaggagt

SEQ ID NO: 307807 - DNA, 25 bp, Homo sapien
gaagagcagtcttcagagaccacct

SEQ ID NO: 307808 - DNA, 25 bp, Homo sapien
agtcttcagagaccacctcagtttg

SEQ ID NO: 307809 - DNA, 25 bp, Homo sapien
tccttcagtggttcccagccatgga

SEQ ID NO: 307810 - DNA, 25 bp, Homo sapien
gttcccagccatggagtcatcgtga

SEQ ID NO: 307811 - DNA, 25 bp, Homo sapien
ccagccatggagtcatcgtgaaggg

SEQ ID NO: 307812 - DNA, 25 bp, Homo sapien
gggctccatggtcaataattttacg

SEQ ID NO: 307813 - DNA, 25 bp, Homo sapien
taattttacggtactgcacttggtt

SEQ ID NO: 307814 - DNA, 25 bp, Homo sapien
tacggtactgcacttggttatcaca

SEQ ID NO: 307815 - DNA, 25 bp, Homo sapien
actgcacttggttatcacagacaga

SEQ ID NO: 307816 - DNA, 25 bp, Homo sapien
tcatgatagcatgccatctctgtct

SEQ ID NO: 307817 - DNA, 25 bp, Homo sapien
gatagcatgccatctctgtctatat

SEQ ID NO: 307818 - DNA, 25 bp, Homo sapien
aaaacccaacatatatgggctgtta

SEQ ID NO: 307819 - DNA, 25 bp, Homo sapien
aaacccaacatatatgggctgttag

SEQ ID NO: 307820 - DNA, 25 bp, Homo sapien
aacccaacatatatgggctgttaga

SEQ ID NO: 307821 - DNA, 25 bp, Homo sapien
acccaacatatatgggctgttagat

SEQ ID NO: 307822 - DNA, 25 bp, Homo sapien
cccaacatatatgggctgttagata

SEQ ID NO: 307823 - DNA, 25 bp, Homo sapien
acatatatgggctgttagatagtaa

SEQ ID NO: 307824 - DNA, 25 bp, Homo sapien
catatatgggctgttagatagtaat

SEQ ID NO: 307825 - DNA, 25 bp, Homo sapien
atatgggctgttagatagtaattgt

SEQ ID NO: 307826 - DNA, 25 bp, Homo sapien
atgggctgttagatagtaattgtaa

SEQ ID NO: 307827 - DNA, 25 bp, Homo sapien
gggctgttagatagtaattgtaatt

SEQ ID NO: 307828 - DNA, 25 bp, Homo sapien
gctgttagatagtaattgtaatttc

SEQ ID NO: 307829 - DNA, 25 bp, Homo sapien
acagttcagtaaggtgctgccgcat

SEQ ID NO: 307830 - DNA, 25 bp, Homo sapien
gctgccgcatgatagcaaagctcga

SEQ ID NO: 307831 - DNA, 25 bp, Homo sapien
aagctcgacgactttttgtaacaag

SEQ ID NO: 307832 - DNA, 25 bp, Homo sapien
aacctggttctctccttcaagaata

SEQ ID NO: 307833 - DNA, 25 bp, Homo sapien
cagtattaacagttgttaccccgag

SEQ ID NO: 307834 - DNA, 25 bp, Homo sapien
gttgttaccccgaggaaatagtgag

SEQ ID NO: 307835 - DNA, 25 bp, Homo sapien
aatagtgaggtattattcccctgga

SEQ ID NO: 307836 - DNA, 25 bp, Homo sapien
attcccctggatattcagatacact

SEQ ID NO: 307837 - DNA, 25 bp, Homo sapien
gatacacttctgcagagggtggaca

SEQ ID NO: 307838 - DNA, 25 bp, Homo sapien
gggtggacagctatcaaccacttaa

SEQ ID NO: 307839 - DNA, 25 bp, Homo sapien
ctcaaattcacagcagagtagtttt

SEQ ID NO: 307840 - DNA, 25 bp, Homo sapien
aagctggcgtctgccgtctgaggct

SEQ ID NO: 307841 - DNA, 25 bp, Homo sapien
agctggcgtctgccgtctgaggctg

SEQ ID NO: 307842 - DNA, 25 bp, Homo sapien
gctggcgtctgccgtctgaggctgg

SEQ ID NO: 307843 - DNA, 25 bp, Homo sapien
ctggcgtctgccgtctgaggctgga

SEQ ID NO: 307844 - DNA, 25 bp, Homo sapien
tggcgtctgccgtctgaggctggag

SEQ ID NO: 307845 - DNA, 25 bp, Homo sapien
ggcgtctgccgtctgaggctggagc

SEQ ID NO: 307846 - DNA, 25 bp, Homo sapien
gcgtctgccgtctgaggctggagcg

SEQ ID NO: 307847 - DNA, 25 bp, Homo sapien
cgtctgccgtctgaggctggagcgc

SEQ ID NO: 307848 - DNA, 25 bp, Homo sapien
gtctgccgtctgaggctggagcgca

SEQ ID NO: 307849 - DNA, 25 bp, Homo sapien
tctgccgtctgaggctggagcgcag

SEQ ID NO: 307850 - DNA, 25 bp, Homo sapien
ctgccgtctgaggctggagcgcagt

SEQ ID NO: 307851 - DNA, 25 bp, Homo sapien
atagcactgtggtgtggacttgaac

SEQ ID NO: 307852 - DNA, 25 bp, Homo sapien
gtggacttgaacttggattgacctt

SEQ ID NO: 307853 - DNA, 25 bp, Homo sapien
tgaacttggattgaccttaaatttt

SEQ ID NO: 307854 - DNA, 25 bp, Homo sapien
gagaggcagcgacaagatacctcat

SEQ ID NO: 307855 - DNA, 25 bp, Homo sapien
gatacctcattatcagatgcttggt

SEQ ID NO: 307856 - DNA, 25 bp, Homo sapien
cagatgcttggtttatacattttgg

SEQ ID NO: 307857 - DNA, 25 bp, Homo sapien
ggactaaaatacttggtgatgaaat

SEQ ID NO: 307858 - DNA, 25 bp, Homo sapien
atacacctttaaacttgttatggag

SEQ ID NO: 307859 - DNA, 25 bp, Homo sapien
aggatacagcttggaaattggaact

SEQ ID NO: 307860 - DNA, 25 bp, Homo sapien
gaaattggaactgcaattgcctttt

SEQ ID NO: 307861 - DNA, 25 bp, Homo sapien
tggaactgcaattgccttttattaa

SEQ ID NO: 307862 - DNA, 25 bp, Homo sapien
gaaaagtacgctcggccccaaactg

SEQ ID NO: 307863 - DNA, 25 bp, Homo sapien
acgctcggccccaaactggtatttg

SEQ ID NO: 307864 - DNA, 25 bp, Homo sapien
aactggtatttgtcagacgatacat

SEQ ID NO: 307865 - DNA, 25 bp, Homo sapien
gacgatacatgtaaaagtttgtcct

SEQ ID NO: 307866 - DNA, 25 bp, Homo sapien
agtttgtccttgaacgtggaacaag

SEQ ID NO: 307867 - DNA, 25 bp, Homo sapien
tctgagacgggaactagtgatcact

SEQ ID NO: 307868 - DNA, 25 bp, Homo sapien
gtgatcactagctcaagaactgcaa

SEQ ID NO: 307869 - DNA, 25 bp, Homo sapien
gacaggaagctgttcactgtgaaac

SEQ ID NO: 307870 - DNA, 25 bp, Homo sapien
tgtgaaacagtctcttgcttgtcgt

SEQ ID NO: 307871 - DNA, 25 bp, Homo sapien
agtctcttgcttgtcgtgtattttt

SEQ ID NO: 307872 - DNA, 25 bp, Homo sapien
cgtgtatttttcgagtacttctgaa

SEQ ID NO: 307873 - DNA, 25 bp, Homo sapien
caaaaggctgtgacttctgttagtg

SEQ ID NO: 307874 - DNA, 25 bp, Homo sapien
aaaggctgtgacttctgttagtggg

SEQ ID NO: 307875 - DNA, 25 bp, Homo sapien
cgagtgtatggagaacttcaaggcc

SEQ ID NO: 307876 - DNA, 25 bp, Homo sapien
agaacttcaaggcctcctcctggct

SEQ ID NO: 307877 - DNA, 25 bp, Homo sapien
tagagggcgccaaaggcgacgtgcc

SEQ ID NO: 307878 - DNA, 25 bp, Homo sapien
caaaggcgacgtgccggccgccagc

SEQ ID NO: 307879 - DNA, 25 bp, Homo sapien
cgagcgcctgcaggaacaggcccct

SEQ ID NO: 307880 - DNA, 25 bp, Homo sapien
catagtaggcgctcaggaaatgatt

SEQ ID NO: 307881 - DNA, 25 bp, Homo sapien
agtaggcgctcaggaaatgattgct

SEQ ID NO: 307882 - DNA, 25 bp, Homo sapien
gaatgtggaatgaaagtccccagca

SEQ ID NO: 307883 - DNA, 25 bp, Homo sapien
aatgtggaatgaaagtccccagcag

SEQ ID NO: 307884 - DNA, 25 bp, Homo sapien
ggtcgatgacttgtgcagggtcata

SEQ ID NO: 307885 - DNA, 25 bp, Homo sapien
acacaattgatgtctaacccctaga

SEQ ID NO: 307886 - DNA, 25 bp, Homo sapien
tagacagtctttttagtgccctctg

SEQ ID NO: 307887 - DNA, 25 bp, Homo sapien
tgctctcagtcttgttgccctagta

SEQ ID NO: 307888 - DNA, 25 bp, Homo sapien
tgccctagtatcaagcaatcttaga

SEQ ID NO: 307889 - DNA, 25 bp, Homo sapien
gacaaacatcctgaattcttacaaa

SEQ ID NO: 307890 - DNA, 25 bp, Homo sapien
ttacaaacttacctctaaactctga

SEQ ID NO: 307891 - DNA, 25 bp, Homo sapien
gaggataaagttgccagtcctttta

SEQ ID NO: 307892 - DNA, 25 bp, Homo sapien
cagtccttttaatggtcagcctaat

SEQ ID NO: 307893 - DNA, 25 bp, Homo sapien
tggtcagcctaatcattctgtcagc

SEQ ID NO: 307894 - DNA, 25 bp, Homo sapien
cattctgtcagcctaatcgggtaat

SEQ ID NO: 307895 - DNA, 25 bp, Homo sapien
acactcggtcaaggaggcatttcct

SEQ ID NO: 307896 - DNA, 25 bp, Homo sapien
gagctgtagcacttggttcgattcc

SEQ ID NO: 307897 - DNA, 25 bp, Homo sapien
ttccatcccacgttaattcttttag

SEQ ID NO: 307898 - DNA, 25 bp, Homo sapien
gcagactgaaattctgttgccctga

SEQ ID NO: 307899 - DNA, 25 bp, Homo sapien
gatcgcctctgccattggtttttat

SEQ ID NO: 307900 - DNA, 25 bp, Homo sapien
ttttatcaccttcatacagttccca

SEQ ID NO: 307901 - DNA, 25 bp, Homo sapien
aattcggatcttgccatttgcacag

SEQ ID NO: 307902 - DNA, 25 bp, Homo sapien
tttgcacaggcgctgatgatccgga

SEQ ID NO: 307903 - DNA, 25 bp, Homo sapien
agaagggacacgtcgagcacctctt

SEQ ID NO: 307904 - DNA, 25 bp, Homo sapien
cacctctttgggatgcttgaaggcc

SEQ ID NO: 307905 - DNA, 25 bp, Homo sapien
tgaaggccatcaggcagcgctcgta

SEQ ID NO: 307906 - DNA, 25 bp, Homo sapien
gaaaaatgccagtctctgccccttg

SEQ ID NO: 307907 - DNA, 25 bp, Homo sapien
ccttgttttagtactgatttttcag

SEQ ID NO: 307908 - DNA, 25 bp, Homo sapien
gatttttcagaaattgtcctgatac

SEQ ID NO: 307909 - DNA, 25 bp, Homo sapien
ttttttagagcttcattcactattt

SEQ ID NO: 307910 - DNA, 25 bp, Homo sapien
gagtttactgtacattagactttgt

SEQ ID NO: 307911 - DNA, 25 bp, Homo sapien
agactttgttcttgaatgggaggga

SEQ ID NO: 307912 - DNA, 25 bp, Homo sapien
gggatacagtgattaataagaccaa

SEQ ID NO: 307913 - DNA, 25 bp, Homo sapien
gaccaatttacccacatagagctta

SEQ ID NO: 307914 - DNA, 25 bp, Homo sapien
tttacccacatagagcttacattct

SEQ ID NO: 307915 - DNA, 25 bp, Homo sapien
gaaaatctcaattaggaacaaatcc

SEQ ID NO: 307916 - DNA, 25 bp, Homo sapien
ggaacaaatccattgcagaaatgta

SEQ ID NO: 307917 - DNA, 25 bp, Homo sapien
ggcggaccccgagagatgactgatt

SEQ ID NO: 307918 - DNA, 25 bp, Homo sapien
gaccccgagagatgactgattgtgg

SEQ ID NO: 307919 - DNA, 25 bp, Homo sapien
gggaccgtctgctcctcctaatggc

SEQ ID NO: 307920 - DNA, 25 bp, Homo sapien
ccgtctgctcctcctaatggctggg

SEQ ID NO: 307921 - DNA, 25 bp, Homo sapien
accgtgcacgtctgcgcgggccgga

SEQ ID NO: 307922 - DNA, 25 bp, Homo sapien
gctcttctcgggaacttgcgcggga

SEQ ID NO: 307923 - DNA, 25 bp, Homo sapien
gaggcccggagctgcgccgctttac

SEQ ID NO: 307924 - DNA, 25 bp, Homo sapien
cggtgcctaaaacgcacacgcatca

SEQ ID NO: 307925 - DNA, 25 bp, Homo sapien
aacgcacacgcatcaaagtcacagg

SEQ ID NO: 307926 - DNA, 25 bp, Homo sapien
cacgcatcaaagtcacaggacgagt

SEQ ID NO: 307927 - DNA, 25 bp, Homo sapien
aagtcacaggacgagttagaggaga

SEQ ID NO: 307928 - DNA, 25 bp, Homo sapien
gtaatcacctactagtctagttgct

SEQ ID NO: 307929 - DNA, 25 bp, Homo sapien
ctactagtctagttgctaagggtac

SEQ ID NO: 307930 - DNA, 25 bp, Homo sapien
gctaagggtacagtagtgaacaatc

SEQ ID NO: 307931 - DNA, 25 bp, Homo sapien
gtgaacaatctgtgccctcagaaca

SEQ ID NO: 307932 - DNA, 25 bp, Homo sapien
ctgtgccctcagaacattctagtaa

SEQ ID NO: 307933 - DNA, 25 bp, Homo sapien
gtccccaattaacaatggttcagct

SEQ ID NO: 307934 - DNA, 25 bp, Homo sapien
acaatggttcagcttgcaattttta

SEQ ID NO: 307935 - DNA, 25 bp, Homo sapien
gcttgcaatttttaacttcatgatg

SEQ ID NO: 307936 - DNA, 25 bp, Homo sapien
taacttcatgatgggtattacatgc

SEQ ID NO: 307937 - DNA, 25 bp, Homo sapien
attacatgcatttttcacttaacga

SEQ ID NO: 307938 - DNA, 25 bp, Homo sapien
gcatttttcacttaacgatattttc

SEQ ID NO: 307939 - DNA, 25 bp, Homo sapien
gatggtaatatgtcatttctataaa

SEQ ID NO: 307940 - DNA, 25 bp, Homo sapien
cacaaggactgtgaatattgggatt

SEQ ID NO: 307941 - DNA, 25 bp, Homo sapien
attgggatttatgtccttgccatta

SEQ ID NO: 307942 - DNA, 25 bp, Homo sapien
ttatgtccttgccattacctagtgg

SEQ ID NO: 307943 - DNA, 25 bp, Homo sapien
attacctagtggttacagccctatc

SEQ ID NO: 307944 - DNA, 25 bp, Homo sapien
acagccctatcactaaaatttacat

SEQ ID NO: 307945 - DNA, 25 bp, Homo sapien
tacatcgtttctcagttgggatttg

SEQ ID NO: 307946 - DNA, 25 bp, Homo sapien
ctcagttgggatttgggcattgcta

SEQ ID NO: 307947 - DNA, 25 bp, Homo sapien
ttgggcattgctaacttactgtata

SEQ ID NO: 307948 - DNA, 25 bp, Homo sapien
cctcacccctgtatagaaaatgcct

SEQ ID NO: 307949 - DNA, 25 bp, Homo sapien
agaaaatgccttgcctctcaagaga

SEQ ID NO: 307950 - DNA, 25 bp, Homo sapien
ctccggtttcccagacaaatccaga

SEQ ID NO: 307951 - DNA, 25 bp, Homo sapien
tttcccagacaaatccagacaccag

SEQ ID NO: 307952 - DNA, 25 bp, Homo sapien
aaatccagacaccagcctttagggt

SEQ ID NO: 307953 - DNA, 25 bp, Homo sapien
acaccagcctttagggtggccttgg

SEQ ID NO: 307954 - DNA, 25 bp, Homo sapien
gagaactagatagagcctcccaacc

SEQ ID NO: 307955 - DNA, 25 bp, Homo sapien
gcctcccaaccctgatttagaaatg

SEQ ID NO: 307956 - DNA, 25 bp, Homo sapien
agagaggtgaaaagcgtcccccact

SEQ ID NO: 307957 - DNA, 25 bp, Homo sapien
aaatgaactagcttgttttgacagg

SEQ ID NO: 307958 - DNA, 25 bp, Homo sapien
actagcttgttttgacaggtttatt

SEQ ID NO: 307959 - DNA, 25 bp, Homo sapien
gtgcatgtgcttgagttaaatgtgc

SEQ ID NO: 307960 - DNA, 25 bp, Homo sapien
cttgagttaaatgtgcagggcagac

SEQ ID NO: 307961 - DNA, 25 bp, Homo sapien
ttttttggggcgctgaccgctccaa

SEQ ID NO: 307962 - DNA, 25 bp, Homo sapien
aagcagcgcggcagctaaagccaat

SEQ ID NO: 307963 - DNA, 25 bp, Homo sapien
gcgcggcagctaaagccaatgttaa

SEQ ID NO: 307964 - DNA, 25 bp, Homo sapien
gccaatgttaatttatagccaggtg

SEQ ID NO: 307965 - DNA, 25 bp, Homo sapien
taatttatagccaggtgtgcgtgtg

SEQ ID NO: 307966 - DNA, 25 bp, Homo sapien
gacagcttctgtccaatcatgttga

SEQ ID NO: 307967 - DNA, 25 bp, Homo sapien
gcttctgtccaatcatgttgagttg

SEQ ID NO: 307968 - DNA, 25 bp, Homo sapien
gtccaatcatgttgagttggtgatt

SEQ ID NO: 307969 - DNA, 25 bp, Homo sapien
gtttgatatttcttcgcgctaatgt

SEQ ID NO: 307970 - DNA, 25 bp, Homo sapien
ttgatatttcttcgcgctaatgtgt

SEQ ID NO: 307971 - DNA, 25 bp, Homo sapien
tcagggttttcaagcttttactctt

SEQ ID NO: 307972 - DNA, 25 bp, Homo sapien
tggaaggtgggtgccagacacagca

SEQ ID NO: 307973 - DNA, 25 bp, Homo sapien
tgacacaccttcagggcagtagcac

SEQ ID NO: 307974 - DNA, 25 bp, Homo sapien
accttcagggcagtagcacaggaga

SEQ ID NO: 307975 - DNA, 25 bp, Homo sapien
gcagtagcacaggagagatgtctgt

SEQ ID NO: 307976 - DNA, 25 bp, Homo sapien
gctgatttttatgcaatcctttctg

SEQ ID NO: 307977 - DNA, 25 bp, Homo sapien
tatgcaatcctttctggaagtgatg

SEQ ID NO: 307978 - DNA, 25 bp, Homo sapien
atgccaccttagaagctgcaactta

SEQ ID NO: 307979 - DNA, 25 bp, Homo sapien
gccaccttagaagctgcaacttaga

SEQ ID NO: 307980 - DNA, 25 bp, Homo sapien
gaagctgcaacttagagagaagcaa

SEQ ID NO: 307981 - DNA, 25 bp, Homo sapien
agcaacaaacggagaagcaggcatt

SEQ ID NO: 307982 - DNA, 25 bp, Homo sapien
caaacggagaagcaggcattgtgtt

SEQ ID NO: 307983 - DNA, 25 bp, Homo sapien
agacgatgttccacaggagcccgtg

SEQ ID NO: 307984 - DNA, 25 bp, Homo sapien
acgatgttccacaggagcccgtgcc

SEQ ID NO: 307985 - DNA, 25 bp, Homo sapien
ccacgctgtggaacgagccggccga

SEQ ID NO: 307986 - DNA, 25 bp, Homo sapien
ctaccggcaacttgcttaacctaga

SEQ ID NO: 307987 - DNA, 25 bp, Homo sapien
gccggccgagctgccgtcgggagaa

SEQ ID NO: 307988 - DNA, 25 bp, Homo sapien
ggcaacttgcttaacctagaggtgg

SEQ ID NO: 307989 - DNA, 25 bp, Homo sapien
caggacccgaggacagcaccgcgca

SEQ ID NO: 307990 - DNA, 25 bp, Homo sapien
caggagcggctggaccagggcggcg

SEQ ID NO: 307991 - DNA, 25 bp, Homo sapien
ctctccttggctttgcagacgatgt

SEQ ID NO: 307992 - DNA, 25 bp, Homo sapien
ggctttgcagacgatgttccacagg

SEQ ID NO: 307993 - DNA, 25 bp, Homo sapien
ttgcagacgatgttccacaggagcc

SEQ ID NO: 307994 - DNA, 25 bp, Homo sapien
gtacattgctcatttatgtctttaa

SEQ ID NO: 307995 - DNA, 25 bp, Homo sapien
tacagtatggcattaggattctaac

SEQ ID NO: 307996 - DNA, 25 bp, Homo sapien
atggcattaggattctaacttttta

SEQ ID NO: 307997 - DNA, 25 bp, Homo sapien
agataattaaccagagcactatttc

SEQ ID NO: 307998 - DNA, 25 bp, Homo sapien
gagcactatttcttaatatgccatt

SEQ ID NO: 307999 - DNA, 25 bp, Homo sapien
ttttcttcttcatttgtagtgacaa

SEQ ID NO: 308000 - DNA, 25 bp, Homo sapien
aatgattattattgagagcttgcta

SEQ ID NO: 308001 - DNA, 25 bp, Homo sapien
attattgagagcttgctatgggcaa

SEQ ID NO: 308002 - DNA, 25 bp, Homo sapien
gagagcttgctatgggcaaagcagt

SEQ ID NO: 308003 - DNA, 25 bp, Homo sapien
catgtatctttcctaatcatgatat

SEQ ID NO: 308004 - DNA, 25 bp, Homo sapien
gtatctttcctaatcatgatattga

SEQ ID NO: 308005 - DNA, 25 bp, Homo sapien
ctggactctgaaggcgtgagtctgc

SEQ ID NO: 308006 - DNA, 25 bp, Homo sapien
cgtgagtctgcatcttagggcatcg

SEQ ID NO: 308007 - DNA, 25 bp, Homo sapien
accacgaatctgaacatgcctctct

SEQ ID NO: 308008 - DNA, 25 bp, Homo sapien
cacgaatctgaacatgcctctctct

SEQ ID NO: 308009 - DNA, 25 bp, Homo sapien
acgaatctgaacatgcctctctctt

SEQ ID NO: 308010 - DNA, 25 bp, Homo sapien
cgaatctgaacatgcctctctcttg

SEQ ID NO: 308011 - DNA, 25 bp, Homo sapien
gaatctgaacatgcctctctcttgc

SEQ ID NO: 308012 - DNA, 25 bp, Homo sapien
aatctgaacatgcctctctcttgct

SEQ ID NO: 308013 - DNA, 25 bp, Homo sapien
tgctggagagaaaacacacttgctt

SEQ ID NO: 308014 - DNA, 25 bp, Homo sapien
gctggagagaaaacacacttgctta

SEQ ID NO: 308015 - DNA, 25 bp, Homo sapien
acacacttgcttagcccacaattct

SEQ ID NO: 308016 - DNA, 25 bp, Homo sapien
accctgagtgttttaagacataatt

SEQ ID NO: 308017 - DNA, 25 bp, Homo sapien
gcaaataactcatgtaatgcgtata

SEQ ID NO: 308018 - DNA, 25 bp, Homo sapien
aagtttatacattcaggcttgtgca

SEQ ID NO: 308019 - DNA, 25 bp, Homo sapien
ggcttgtgcaaatgtgtttatatca

SEQ ID NO: 308020 - DNA, 25 bp, Homo sapien
gtttatatcatttgcctaagccctt

SEQ ID NO: 308021 - DNA, 25 bp, Homo sapien
gcctaagcccttgattatttacatg

SEQ ID NO: 308022 - DNA, 25 bp, Homo sapien
gattatttacatgttcctatgtggg

SEQ ID NO: 308023 - DNA, 25 bp, Homo sapien
gttcctatgtgggatcacagtcctt

SEQ ID NO: 308024 - DNA, 25 bp, Homo sapien
gggatcacagtccttcagatatgaa

SEQ ID NO: 308025 - DNA, 25 bp, Homo sapien
atcatagcacagtgatttctttaca

SEQ ID NO: 308026 - DNA, 25 bp, Homo sapien
taacttgaacactcagaaataccct

SEQ ID NO: 308027 - DNA, 25 bp, Homo sapien
atcctgaaccgctgcagcgagagca

SEQ ID NO: 308028 - DNA, 25 bp, Homo sapien
aagctggcgtctgccgtctgaggct

SEQ ID NO: 308029 - DNA, 25 bp, Homo sapien
gtctgaggctggagcgcagtcccca

SEQ ID NO: 308030 - DNA, 25 bp, Homo sapien
tctatagagcctggcgtctggacgc

SEQ ID NO: 308031 - DNA, 25 bp, Homo sapien
atagagcctggcgtctggacgccga

SEQ ID NO: 308032 - DNA, 25 bp, Homo sapien
gtctggacgccgagggcagccccga

SEQ ID NO: 308033 - DNA, 25 bp, Homo sapien
ttgcttggagtggaccgaggctctg

SEQ ID NO: 308034 - DNA, 25 bp, Homo sapien
gcttggagtggaccgaggctctgca

SEQ ID NO: 308035 - DNA, 25 bp, Homo sapien
ggagtggaccgaggctctgcaggaa

SEQ ID NO: 308036 - DNA, 25 bp, Homo sapien
tggaccgaggctctgcaggaatgca

SEQ ID NO: 308037 - DNA, 25 bp, Homo sapien
caggaatgcagggagggccgggctc

SEQ ID NO: 308038 - DNA, 25 bp, Homo sapien
ggaactatctttagtttagatggaa

SEQ ID NO: 308039 - DNA, 25 bp, Homo sapien
gtttttaattgttgccgtattcatc

SEQ ID NO: 308040 - DNA, 25 bp, Homo sapien
gttgccgtattcatctatatagcta

SEQ ID NO: 308041 - DNA, 25 bp, Homo sapien
taatgaacaaaacctgtctaaacct

SEQ ID NO: 308042 - DNA, 25 bp, Homo sapien
gtttccaatgaatgaaagtcatgca

SEQ ID NO: 308043 - DNA, 25 bp, Homo sapien
atgcactttatttataggctctatg

SEQ ID NO: 308044 - DNA, 25 bp, Homo sapien
ataggctctatgttttggcttctgc

SEQ ID NO: 308045 - DNA, 25 bp, Homo sapien
gctctatgttttggcttctgcagta

SEQ ID NO: 308046 - DNA, 25 bp, Homo sapien
gttttggcttctgcagtacttttat

SEQ ID NO: 308047 - DNA, 25 bp, Homo sapien
tggcttctgcagtacttttattatc

SEQ ID NO: 308048 - DNA, 25 bp, Homo sapien
tatctatacataatttggccaaaaa

SEQ ID NO: 308049 - DNA, 25 bp, Homo sapien
tttgataaagacacatattcctctg

SEQ ID NO: 308050 - DNA, 25 bp, Homo sapien
attcctctgagttgctttattcacc

SEQ ID NO: 308051 - DNA, 25 bp, Homo sapien
acttcctttatcttgattcctgtca

SEQ ID NO: 308052 - DNA, 25 bp, Homo sapien
ttgattcctgtcaattccccttcat

SEQ ID NO: 308053 - DNA, 25 bp, Homo sapien
ttctagctccagtactctgttggca

SEQ ID NO: 308054 - DNA, 25 bp, Homo sapien
tactctgttggcatcctgcctgact

SEQ ID NO: 308055 - DNA, 25 bp, Homo sapien
tgactcaggtaccagtccactttta

SEQ ID NO: 308056 - DNA, 25 bp, Homo sapien
caggtaccagtccacttttaaagct

SEQ ID NO: 308057 - DNA, 25 bp, Homo sapien
ccacttacgtctatagtgttctttt

SEQ ID NO: 308058 - DNA, 25 bp, Homo sapien
tatagtgttctttttactgaatccc

SEQ ID NO: 308059 - DNA, 25 bp, Homo sapien
gtatatgtatctttcctaccttagg

SEQ ID NO: 308060 - DNA, 25 bp, Homo sapien
agcttctacgacctgatggatggaa

SEQ ID NO: 308061 - DNA, 25 bp, Homo sapien
aaatcaaactctgtgactctatggt

SEQ ID NO: 308062 - DNA, 25 bp, Homo sapien
tgtgactctatggttgactgccacc

SEQ ID NO: 308063 - DNA, 25 bp, Homo sapien
ctatggttgactgccacctctgcaa

SEQ ID NO: 308064 - DNA, 25 bp, Homo sapien
tgcaaccttgactcatctgctgaaa

SEQ ID NO: 308065 - DNA, 25 bp, Homo sapien
tgactcatctgctgaaaaggcaaga

SEQ ID NO: 308066 - DNA, 25 bp, Homo sapien
cagcaagccctgttttagggactac

SEQ ID NO: 308067 - DNA, 25 bp, Homo sapien
ccctgttttagggactacataagat

SEQ ID NO: 308068 - DNA, 25 bp, Homo sapien
agatgagttctttaggattgcgtgt

SEQ ID NO: 308069 - DNA, 25 bp, Homo sapien
gattgcgtgtgttttgagtttttgt

SEQ ID NO: 308070 - DNA, 25 bp, Homo sapien
ggtttcttagaataactgttcaact

SEQ ID NO: 308071 - DNA, 25 bp, Homo sapien
caacctccacctcttataaatttct

SEQ ID NO: 308072 - DNA, 25 bp, Homo sapien
cctccacctcttataaatttcttca

SEQ ID NO: 308073 - DNA, 25 bp, Homo sapien
tttaatggtaaaatacacgtaacat

SEQ ID NO: 308074 - DNA, 25 bp, Homo sapien
ttaatggtaaaatacacgtaacata

SEQ ID NO: 308075 - DNA, 25 bp, Homo sapien
taaccattttactaataagtgtaca

SEQ ID NO: 308076 - DNA, 25 bp, Homo sapien
aaccattttactaataagtgtacag

SEQ ID NO: 308077 - DNA, 25 bp, Homo sapien
cattttactaataagtgtacagttc

SEQ ID NO: 308078 - DNA, 25 bp, Homo sapien
attttactaataagtgtacagttca

SEQ ID NO: 308079 - DNA, 25 bp, Homo sapien
accatcactaccaccaacctccaga

SEQ ID NO: 308080 - DNA, 25 bp, Homo sapien
ccatcactaccaccaacctccagaa

SEQ ID NO: 308081 - DNA, 25 bp, Homo sapien
catcactaccaccaacctccagaac

SEQ ID NO: 308082 - DNA, 25 bp, Homo sapien
caagaccacgcagagcttgcgaaaa

SEQ ID NO: 308083 - DNA, 25 bp, Homo sapien
tactgacgttgtaacctggagccgg

SEQ ID NO: 308084 - DNA, 25 bp, Homo sapien
acagggtcctgaacacccgcagttc

SEQ ID NO: 308085 - DNA, 25 bp, Homo sapien
ttgtaacctggagccggaggacacg

SEQ ID NO: 308086 - DNA, 25 bp, Homo sapien
aagtccgtggaacggatcttccgat

SEQ ID NO: 308087 - DNA, 25 bp, Homo sapien
aacggatcttccgatccttgttctt

SEQ ID NO: 308088 - DNA, 25 bp, Homo sapien
tgttctttgattcgttaccaacctt

SEQ ID NO: 308089 - DNA, 25 bp, Homo sapien
caaccttccacttccgtagacagtt

SEQ ID NO: 308090 - DNA, 25 bp, Homo sapien
gaggacgccagagccgaaaccggtt

SEQ ID NO: 308091 - DNA, 25 bp, Homo sapien
gagccgaaaccggttccagggcact

SEQ ID NO: 308092 - DNA, 25 bp, Homo sapien
taaggctcgaactcgccacccaaga

SEQ ID NO: 308093 - DNA, 25 bp, Homo sapien
gaatttccaggataatttcccggag

SEQ ID NO: 308094 - DNA, 25 bp, Homo sapien
aatttcccggagttggttgcatgca

SEQ ID NO: 308095 - DNA, 25 bp, Homo sapien
tcccggagttggttgcatgcattat

SEQ ID NO: 308096 - DNA, 25 bp, Homo sapien
ggttgcatgcattatctttcataat

SEQ ID NO: 308097 - DNA, 25 bp, Homo sapien
ttactttacatgctagtgtttcaag

SEQ ID NO: 308098 - DNA, 25 bp, Homo sapien
catgctagtgtttcaagtattgtat

SEQ ID NO: 308099 - DNA, 25 bp, Homo sapien
caagtattgtatgaggattttcaca

SEQ ID NO: 308100 - DNA, 25 bp, Homo sapien
gaggattttcacaatagtatcactg

SEQ ID NO: 308101 - DNA, 25 bp, Homo sapien
agtatcactgaatgatgtcaccaga

SEQ ID NO: 308102 - DNA, 25 bp, Homo sapien
gaatgatgtcaccagagctctgaga

SEQ ID NO: 308103 - DNA, 25 bp, Homo sapien
gatgtcaccagagctctgagaataa

SEQ ID NO: 308104 - DNA, 25 bp, Homo sapien
gcccatcccatcaggtcatgaggaa

SEQ ID NO: 308105 - DNA, 25 bp, Homo sapien
atcaggtcatgaggaagggttcttt

SEQ ID NO: 308106 - DNA, 25 bp, Homo sapien
acactcggcacttctgtgggagcta

SEQ ID NO: 308107 - DNA, 25 bp, Homo sapien
gcacttctgtgggagctattcatac

SEQ ID NO: 308108 - DNA, 25 bp, Homo sapien
ggagctattcatacacagtgacttg

SEQ ID NO: 308109 - DNA, 25 bp, Homo sapien
cagtgacttgatgttcttggaggat

SEQ ID NO: 308110 - DNA, 25 bp, Homo sapien
ggatcaacaaaactgccctgggaaa

SEQ ID NO: 308111 - DNA, 25 bp, Homo sapien
atccagtggatgaagaagtcacctt

SEQ ID NO: 308112 - DNA, 25 bp, Homo sapien
tggaagggaaggtctcctgccccta

SEQ ID NO: 308113 - DNA, 25 bp, Homo sapien
ttccccaagtataacgtcaggccca

SEQ ID NO: 308114 - DNA, 25 bp, Homo sapien
aacgtcaggcccaagtgtggacaca

SEQ ID NO: 308115 - DNA, 25 bp, Homo sapien
gcatttaatcagcacctgatgactt

SEQ ID NO: 308116 - DNA, 25 bp, Homo sapien
atcagcacctgatgacttggcagga

SEQ ID NO: 308117 - DNA, 25 bp, Homo sapien
tgatgacttggcaggacttgcccca

SEQ ID NO: 308118 - DNA, 25 bp, Homo sapien
acttggcaggacttgccccaccagg

SEQ ID NO: 308119 - DNA, 25 bp, Homo sapien
tgaagggtagtggacaccaggatcc

SEQ ID NO: 308120 - DNA, 25 bp, Homo sapien
accaggatcctttggattaatcctc

SEQ ID NO: 308121 - DNA, 25 bp, Homo sapien
ttggattaatcctctgccacctctc

SEQ ID NO: 308122 - DNA, 25 bp, Homo sapien
caaccgagagtgaatttatgtaatt

SEQ ID NO: 308123 - DNA, 25 bp, Homo sapien
gtaattgagtgaaagtctacgaatc

SEQ ID NO: 308124 - DNA, 25 bp, Homo sapien
gaaagtctacgaatcataattgtaa

SEQ ID NO: 308125 - DNA, 25 bp, Homo sapien
ttaaggctgggcatttgtttgaaat

SEQ ID NO: 308126 - DNA, 25 bp, Homo sapien
ctgttgcatttgaattgtgatagat

SEQ ID NO: 308127 - DNA, 25 bp, Homo sapien
gatagatttctttggctacctgtgc

SEQ ID NO: 308128 - DNA, 25 bp, Homo sapien
atttctttggctacctgtgcataat

SEQ ID NO: 308129 - DNA, 25 bp, Homo sapien
tggctacctgtgcataatgtagttt

SEQ ID NO: 308130 - DNA, 25 bp, Homo sapien
gtagtttgtagtatcaatgtgttac

SEQ ID NO: 308131 - DNA, 25 bp, Homo sapien
gttacaagagtgattgtttcttcat

SEQ ID NO: 308132 - DNA, 25 bp, Homo sapien
attgtttcttcatgccagagaaaat

SEQ ID NO: 308133 - DNA, 25 bp, Homo sapien
gaattgcaatcatcaaatggtgttt

SEQ ID NO: 308134 - DNA, 25 bp, Homo sapien
aatggtgtttcataacttggtagta

SEQ ID NO: 308135 - DNA, 25 bp, Homo sapien
gccatataacatgggattttcctca

SEQ ID NO: 308136 - DNA, 25 bp, Homo sapien
ccttttgtacttcactcagatacta

SEQ ID NO: 308137 - DNA, 25 bp, Homo sapien
cctattagccaatccgatctcagag

SEQ ID NO: 308138 - DNA, 25 bp, Homo sapien
gccaatccgatctcagagtctctga

SEQ ID NO: 308139 - DNA, 25 bp, Homo sapien
tcagagtctctgagtggcctccttg

SEQ ID NO: 308140 - DNA, 25 bp, Homo sapien
ccttctcttcagcacccagtaggtg

SEQ ID NO: 308141 - DNA, 25 bp, Homo sapien
gtttgctgcattgaattatctccct

SEQ ID NO: 308142 - DNA, 25 bp, Homo sapien
cattgaattatctccctattccttc

SEQ ID NO: 308143 - DNA, 25 bp, Homo sapien
ttatctccctattccttctcatttg

SEQ ID NO: 308144 - DNA, 25 bp, Homo sapien
tagcttcccataccttctccaagtg

SEQ ID NO: 308145 - DNA, 25 bp, Homo sapien
ttcccataccttctccaagtgtctt

SEQ ID NO: 308146 - DNA, 25 bp, Homo sapien
cctttctttgtctggctccctatga

SEQ ID NO: 308147 - DNA, 25 bp, Homo sapien
gtctggctccctatgactttctatt

SEQ ID NO: 308148 - DNA, 25 bp, Homo sapien
tagggtaggaccctcaccgctgcgt

SEQ ID NO: 308149 - DNA, 25 bp, Homo sapien
atgtatgccaatttggtgctttttg

SEQ ID NO: 308150 - DNA, 25 bp, Homo sapien
ggaacttttgtataataatgcctgg

SEQ ID NO: 308151 - DNA, 25 bp, Homo sapien
taataatgcctggtcattgggtgac

SEQ ID NO: 308152 - DNA, 25 bp, Homo sapien
gtcattgggtgacctgcgattgtca

SEQ ID NO: 308153 - DNA, 25 bp, Homo sapien
gggtgacctgcgattgtcagaaaga

SEQ ID NO: 308154 - DNA, 25 bp, Homo sapien
gaagccaggttgatacagctgccca

SEQ ID NO: 308155 - DNA, 25 bp, Homo sapien
gttgatacagctgcccacttccttt

SEQ ID NO: 308156 - DNA, 25 bp, Homo sapien
gctgcgtccagcaggacagtcgaac

SEQ ID NO: 308157 - DNA, 25 bp, Homo sapien
acgtgcttgaaacaatcacacagga

SEQ ID NO: 308158 - DNA, 25 bp, Homo sapien
atcacacaggacacttttctacatt

SEQ ID NO: 308159 - DNA, 25 bp, Homo sapien
tccaggaagaggaaccacagccctt

SEQ ID NO: 308160 - DNA, 25 bp, Homo sapien
agcccttccttcaatagcactatct

SEQ ID NO: 308161 - DNA, 25 bp, Homo sapien
gaaagagtcaacctaaagcccagaa

SEQ ID NO: 308162 - DNA, 25 bp, Homo sapien
taaagcccagaaccctgctcgattg

SEQ ID NO: 308163 - DNA, 25 bp, Homo sapien
gaaccctgctcgattgagccgcaaa

SEQ ID NO: 308164 - DNA, 25 bp, Homo sapien
gattgagccgcaaagagctggagaa

SEQ ID NO: 308165 - DNA, 25 bp, Homo sapien
ggagaactttgatgtttattcctag

SEQ ID NO: 308166 - DNA, 25 bp, Homo sapien
tgtttattcctagttgctgcagcaa

SEQ ID NO: 308167 - DNA, 25 bp, Homo sapien
agttgctgcagcaattctcaccttt

SEQ ID NO: 308168 - DNA, 25 bp, Homo sapien
aattctcacctttcttgcacatcag

SEQ ID NO: 308169 - DNA, 25 bp, Homo sapien
acctttcttgcacatcagcatctgc

SEQ ID NO: 308170 - DNA, 25 bp, Homo sapien
ctttgggcacaaagccaggctgcag

SEQ ID NO: 308171 - DNA, 25 bp, Homo sapien
ggcacaaagccaggctgcagctctg

SEQ ID NO: 308172 - DNA, 25 bp, Homo sapien
tctggccactgacttggaccaggga

SEQ ID NO: 308173 - DNA, 25 bp, Homo sapien
cactgacttggaccagggatgcccc

SEQ ID NO: 308174 - DNA, 25 bp, Homo sapien
tggctgctcttgacaccctctggct

SEQ ID NO: 308175 - DNA, 25 bp, Homo sapien
tcttcggctgcctgcgttaggaagg

SEQ ID NO: 308176 - DNA, 25 bp, Homo sapien
tgcctgcgttaggaagggagaacct

SEQ ID NO: 308177 - DNA, 25 bp, Homo sapien
gggagaacctgccagttttcagaag

SEQ ID NO: 308178 - DNA, 25 bp, Homo sapien
gaaatgtgagtgcatggccttcctg

SEQ ID NO: 308179 - DNA, 25 bp, Homo sapien
atgtgagtgcatggccttcctgaca

SEQ ID NO: 308180 - DNA, 25 bp, Homo sapien
cttcctgacacccagacaaaacttt

SEQ ID NO: 308181 - DNA, 25 bp, Homo sapien
agcatggggcatgctacttaatatc

SEQ ID NO: 308182 - DNA, 25 bp, Homo sapien
ccatcccataaaagagtagtgatag

SEQ ID NO: 308183 - DNA, 25 bp, Homo sapien
gtagtgatagtgacaacatcttagg

SEQ ID NO: 308184 - DNA, 25 bp, Homo sapien
acatcttaggattgctttgaggtct

SEQ ID NO: 308185 - DNA, 25 bp, Homo sapien
cttaggattgctttgaggtctaaat

SEQ ID NO: 308186 - DNA, 25 bp, Homo sapien
tgagttaacattttcaaagcactta

SEQ ID NO: 308187 - DNA, 25 bp, Homo sapien
gtctgagacacaagagctatatgtt

SEQ ID NO: 308188 - DNA, 25 bp, Homo sapien
gagctatatgttagaggttatcatc

SEQ ID NO: 308189 - DNA, 25 bp, Homo sapien
gttagaggttatcatcattatttgt

SEQ ID NO: 308190 - DNA, 25 bp, Homo sapien
tgttggctacccaacattcattccc

SEQ ID NO: 308191 - DNA, 25 bp, Homo sapien
caccttcttgctgccagtgccttga

SEQ ID NO: 308192 - DNA, 25 bp, Homo sapien
ggaggcctaagtacagccgtgtgta

SEQ ID NO: 308193 - DNA, 25 bp, Homo sapien
agtacagccgtgtgtacccagccgg

SEQ ID NO: 308194 - DNA, 25 bp, Homo sapien
agccgggcaccagagttaagacaac

SEQ ID NO: 308195 - DNA, 25 bp, Homo sapien
taagacaactggacttgtgctcaaa

SEQ ID NO: 308196 - DNA, 25 bp, Homo sapien
attaatcctcaaaagacgctttcaa

SEQ ID NO: 308197 - DNA, 25 bp, Homo sapien
tgtgctcaaaaacccttctttagta

SEQ ID NO: 308198 - DNA, 25 bp, Homo sapien
taaaacaacccgtaggagtctgtgg

SEQ ID NO: 308199 - DNA, 25 bp, Homo sapien
tgaagtctggatgcaatttgccaca

SEQ ID NO: 308200 - DNA, 25 bp, Homo sapien
tgcaatttgccacactgagtctgtt

SEQ ID NO: 308201 - DNA, 25 bp, Homo sapien
gaacattatcccttttggagacgca

SEQ ID NO: 308202 - DNA, 25 bp, Homo sapien
atcccttttggagacgcagaagcta

SEQ ID NO: 308203 - DNA, 25 bp, Homo sapien
aggagagtctagcttgccacacatg

SEQ ID NO: 308204 - DNA, 25 bp, Homo sapien
gccacacatgtgaaatcattcccag

SEQ ID NO: 308205 - DNA, 25 bp, Homo sapien
acttacatttcattgctgcatctgc

SEQ ID NO: 308206 - DNA, 25 bp, Homo sapien
gagagccaagagcaacttattccct

SEQ ID NO: 308207 - DNA, 25 bp, Homo sapien
gagcaacttattcccttgtgacatg

SEQ ID NO: 308208 - DNA, 25 bp, Homo sapien
tgacatgatgacacacctctggata

SEQ ID NO: 308209 - DNA, 25 bp, Homo sapien
gacacacctctggatagatgtatat

SEQ ID NO: 308210 - DNA, 25 bp, Homo sapien
atgttacaaacactttctcttccct

SEQ ID NO: 308211 - DNA, 25 bp, Homo sapien
tttctcttccctagtatcctattac

SEQ ID NO: 308212 - DNA, 25 bp, Homo sapien
gtatcctattacctgtctgaagaag

SEQ ID NO: 308213 - DNA, 25 bp, Homo sapien
gtacactgtgtaccttcgtatcact

SEQ ID NO: 308214 - DNA, 25 bp, Homo sapien
gtaacctactcttactccacaatgt

SEQ ID NO: 308215 - DNA, 25 bp, Homo sapien
tgtctatattcactgcagggctcta

SEQ ID NO: 308216 - DNA, 25 bp, Homo sapien
gcagggctctatgattagtccataa

SEQ ID NO: 308217 - DNA, 25 bp, Homo sapien
gcctggcccaagacgtatggcctga

SEQ ID NO: 308218 - DNA, 25 bp, Homo sapien
attaccaaacattcctcttagatag

SEQ ID NO: 308219 - DNA, 25 bp, Homo sapien
cttctactaagatatgttacaggat

SEQ ID NO: 308220 - DNA, 25 bp, Homo sapien
gttttacattctcttggtcttataa

SEQ ID NO: 308221 - DNA, 25 bp, Homo sapien
gtcttataataacaccacgcccaat

SEQ ID NO: 308222 - DNA, 25 bp, Homo sapien
accacgcccaatccagtatttgatg

SEQ ID NO: 308223 - DNA, 25 bp, Homo sapien
gtatttgatgcgtcggtggtcactc

SEQ ID NO: 308224 - DNA, 25 bp, Homo sapien
gtggtcactcggaaggttgttattt

SEQ ID NO: 308225 - DNA, 25 bp, Homo sapien
taaggtcttaatgcaatttgagaat

SEQ ID NO: 308226 - DNA, 25 bp, Homo sapien
gaatttaattttatctggagaggaa

SEQ ID NO: 308227 - DNA, 25 bp, Homo sapien
tgaaaatcaaatttcccaccaaaag

SEQ ID NO: 308228 - DNA, 25 bp, Homo sapien
gaactagtattcctttgagaagggc

SEQ ID NO: 308229 - DNA, 25 bp, Homo sapien
aagagatgcagttaacctagctgaa

SEQ ID NO: 308230 - DNA, 25 bp, Homo sapien
agttaacctagctgaatgtatggca

SEQ ID NO: 308231 - DNA, 25 bp, Homo sapien
gaatgtatggcagcctttctttatc

SEQ ID NO: 308232 - DNA, 25 bp, Homo sapien
tatcaaacctaacccataagcctgc

SEQ ID NO: 308233 - DNA, 25 bp, Homo sapien
aaacctaacccataagcctgctgca

SEQ ID NO: 308234 - DNA, 25 bp, Homo sapien
aacccataagcctgctgcatttaag

SEQ ID NO: 308235 - DNA, 25 bp, Homo sapien
taagcctgctgcatttaaggtctta

SEQ ID NO: 308236 - DNA, 25 bp, Homo sapien
tttatacatgtcatcaaagtctaca

SEQ ID NO: 308237 - DNA, 25 bp, Homo sapien
caaaatatttaccttctacgataca

SEQ ID NO: 308238 - DNA, 25 bp, Homo sapien
ttaccttctacgatacaactaatgt

SEQ ID NO: 308239 - DNA, 25 bp, Homo sapien
tacgatacaactaatgttaacgcat

SEQ ID NO: 308240 - DNA, 25 bp, Homo sapien
gttaacgcataaagtatcttactgg

SEQ ID NO: 308241 - DNA, 25 bp, Homo sapien
gcataaagtatcttactggtaacaa

SEQ ID NO: 308242 - DNA, 25 bp, Homo sapien
atgatctgaatttgagatgttgcaa

SEQ ID NO: 308243 - DNA, 25 bp, Homo sapien
ttgcaaatgaattgtggtgtccggt

SEQ ID NO: 308244 - DNA, 25 bp, Homo sapien
gaattgtggtgtccggtagtttctt

SEQ ID NO: 308245 - DNA, 25 bp, Homo sapien
gtgtccggtagtttcttcttacatt

SEQ ID NO: 308246 - DNA, 25 bp, Homo sapien
taggggtcttactccattaattcat

SEQ ID NO: 308247 - DNA, 25 bp, Homo sapien
agggcagatttcagagcgtctccgg

SEQ ID NO: 308248 - DNA, 25 bp, Homo sapien
gtcccagatcgaaaggtgacctgtg

SEQ ID NO: 308249 - DNA, 25 bp, Homo sapien
aaggtgacctgtgatcaagttcatc

SEQ ID NO: 308250 - DNA, 25 bp, Homo sapien
tcaagttcatcatgaggctctgact

SEQ ID NO: 308251 - DNA, 25 bp, Homo sapien
tcatcatgaggctctgactggcata

SEQ ID NO: 308252 - DNA, 25 bp, Homo sapien
ggctgcatagatgacatccggaccc

SEQ ID NO: 308253 - DNA, 25 bp, Homo sapien
tgaggctctgactggcatatgctgc

SEQ ID NO: 308254 - DNA, 25 bp, Homo sapien
ctgactggcatatgctgccaccacg

SEQ ID NO: 308255 - DNA, 25 bp, Homo sapien
catagatgacatccggacccgatac

SEQ ID NO: 308256 - DNA, 25 bp, Homo sapien
atgacatccggacccgatacgacac

SEQ ID NO: 308257 - DNA, 25 bp, Homo sapien
gggtccttgaatcctggcaagcaga

SEQ ID NO: 308258 - DNA, 25 bp, Homo sapien
gttgattcagcaattcccataggat

SEQ ID NO: 308259 - DNA, 25 bp, Homo sapien
aattcccataggatgtattacatgc

SEQ ID NO: 308260 - DNA, 25 bp, Homo sapien
ggatgtattacatgctctaatttat

SEQ ID NO: 308261 - DNA, 25 bp, Homo sapien
tttgcccattgtactcttaaaaaga

SEQ ID NO: 308262 - DNA, 25 bp, Homo sapien
aaagatgttgggatgttgattgcga

SEQ ID NO: 308263 - DNA, 25 bp, Homo sapien
gttgggatgttgattgcgattttta

SEQ ID NO: 308264 - DNA, 25 bp, Homo sapien
aatcagcagtggaaatcagttttaa

SEQ ID NO: 308265 - DNA, 25 bp, Homo sapien
gattattgttaaatgcctctttttt

SEQ ID NO: 308266 - DNA, 25 bp, Homo sapien
aatgtttcataaaccctggcactgg

SEQ ID NO: 308267 - DNA, 25 bp, Homo sapien
ataaaccctggcactggtcacaaag

SEQ ID NO: 308268 - DNA, 25 bp, Homo sapien
ggcactggtcacaaagctcagctgt

SEQ ID NO: 308269 - DNA, 25 bp, Homo sapien
gggcatgctacttaatatctctgtg

SEQ ID NO: 308270 - DNA, 25 bp, Homo sapien
ccatcccataaaagagtagtgatag

SEQ ID NO: 308271 - DNA, 25 bp, Homo sapien
gtagtgatagtgacaacatcttagg

SEQ ID NO: 308272 - DNA, 25 bp, Homo sapien
acatcttaggattgctttgaggtct

SEQ ID NO: 308273 - DNA, 25 bp, Homo sapien
cttaggattgctttgaggtctaaat

SEQ ID NO: 308274 - DNA, 25 bp, Homo sapien
tgagttaacattttcaaagcactta

SEQ ID NO: 308275 - DNA, 25 bp, Homo sapien
gtctgagacacaagagctatatgtt

SEQ ID NO: 308276 - DNA, 25 bp, Homo sapien
gagctatatgttagaggttatcatc

SEQ ID NO: 308277 - DNA, 25 bp, Homo sapien
gttagaggttatcatcattatttgt

SEQ ID NO: 308278 - DNA, 25 bp, Homo sapien
tgttggctacccaacattcattccc

SEQ ID NO: 308279 - DNA, 25 bp, Homo sapien
ccttgatttggttgtttgttgtttg

SEQ ID NO: 308280 - DNA, 25 bp, Homo sapien
gtcccagatcgaaaggtgacctgtg

SEQ ID NO: 308281 - DNA, 25 bp, Homo sapien
aaggtgacctgtgatcaagttcatc

SEQ ID NO: 308282 - DNA, 25 bp, Homo sapien
gtgacctgtgatcaagttcatcatg

SEQ ID NO: 308283 - DNA, 25 bp, Homo sapien
tcaagttcatcatgaggctctgact

SEQ ID NO: 308284 - DNA, 25 bp, Homo sapien
tcatcatgaggctctgactggcata

SEQ ID NO: 308285 - DNA, 25 bp, Homo sapien
catgaggctctgactggcatatgct

SEQ ID NO: 308286 - DNA, 25 bp, Homo sapien
ggctgcatagatgacatccggaccc

SEQ ID NO: 308287 - DNA, 25 bp, Homo sapien
tgaggctctgactggcatatgctgc

SEQ ID NO: 308288 - DNA, 25 bp, Homo sapien
ctgactggcatatgctgccaccacg

SEQ ID NO: 308289 - DNA, 25 bp, Homo sapien
catagatgacatccggacccgatac

SEQ ID NO: 308290 - DNA, 25 bp, Homo sapien
atgacatccggacccgatacgacac

SEQ ID NO: 308291 - DNA, 25 bp, Homo sapien
gttcattcttttcctccttgattaa

SEQ ID NO: 308292 - DNA, 25 bp, Homo sapien
attcttttcctccttgattaaagtg

SEQ ID NO: 308293 - DNA, 25 bp, Homo sapien
ttcctccttgattaaagtgaaacaa

SEQ ID NO: 308294 - DNA, 25 bp, Homo sapien
aatgtaggtcagtgtgttatgtaaa

SEQ ID NO: 308295 - DNA, 25 bp, Homo sapien
cagtgtgttatgtaaattgatgtcc

SEQ ID NO: 308296 - DNA, 25 bp, Homo sapien
ctacctgaacatgtgatgctttctc

SEQ ID NO: 308297 - DNA, 25 bp, Homo sapien
acatgtgatgctttctcttttattc

SEQ ID NO: 308298 - DNA, 25 bp, Homo sapien
catattctctgagggccttcagtca

SEQ ID NO: 308299 - DNA, 25 bp, Homo sapien
ttctctgagggccttcagtcaattt

SEQ ID NO: 308300 - DNA, 25 bp, Homo sapien
tctgagggccttcagtcaatttttt

SEQ ID NO: 308301 - DNA, 25 bp, Homo sapien
atatgtatctatgacttagggttac

SEQ ID NO: 308302 - DNA, 25 bp, Homo sapien
catgagcggagtcaccacctccttg

SEQ ID NO: 308303 - DNA, 25 bp, Homo sapien
atgagcggagtcaccacctccttgc

SEQ ID NO: 308304 - DNA, 25 bp, Homo sapien
tgagcggagtcaccacctccttgcg

SEQ ID NO: 308305 - DNA, 25 bp, Homo sapien
gagcggagtcaccacctccttgcgc

SEQ ID NO: 308306 - DNA, 25 bp, Homo sapien
agcggagtcaccacctccttgcgct

SEQ ID NO: 308307 - DNA, 25 bp, Homo sapien
gcggagtcaccacctccttgcgctt

SEQ ID NO: 308308 - DNA, 25 bp, Homo sapien
ccctcacagcccggggcagccagca

SEQ ID NO: 308309 - DNA, 25 bp, Homo sapien
gtaccgggccctgaccgtgcccgag

SEQ ID NO: 308310 - DNA, 25 bp, Homo sapien
ctgacggtggccaccgtgttccggg

SEQ ID NO: 308311 - DNA, 25 bp, Homo sapien
tggccaccgtgttccggggccgcat

SEQ ID NO: 308312 - DNA, 25 bp, Homo sapien
ggccaccgtgttccggggccgcatg

SEQ ID NO: 308313 - DNA, 25 bp, Homo sapien
acagcctagtgggatattttgcaag

SEQ ID NO: 308314 - DNA, 25 bp, Homo sapien
aagacagtaccccagctctgcagtg

SEQ ID NO: 308315 - DNA, 25 bp, Homo sapien
acagtagcagttggccccttaaaca

SEQ ID NO: 308316 - DNA, 25 bp, Homo sapien
ccttaaacatgggtccagagcagga

SEQ ID NO: 308317 - DNA, 25 bp, Homo sapien
gactggagctttgtgctcagcctga

SEQ ID NO: 308318 - DNA, 25 bp, Homo sapien
agcctgaggtcagatgtgcttcctg

SEQ ID NO: 308319 - DNA, 25 bp, Homo sapien
gatgtgcttcctgtctataaaggag

SEQ ID NO: 308320 - DNA, 25 bp, Homo sapien
cagggaggagctgtacaccgtcaga

SEQ ID NO: 308321 - DNA, 25 bp, Homo sapien
tacaccgtcagaggagatctaggga

SEQ ID NO: 308322 - DNA, 25 bp, Homo sapien
gatctagggacaagagcggctctgc

SEQ ID NO: 308323 - DNA, 25 bp, Homo sapien
ggattggtatatgtcacctcttccc

SEQ ID NO: 308324 - DNA, 25 bp, Homo sapien
atagggattgatgatgttcaacatt

SEQ ID NO: 308325 - DNA, 25 bp, Homo sapien
gatgttcaacattattctctttgaa

SEQ ID NO: 308326 - DNA, 25 bp, Homo sapien
acttggtttctcagtatttcaacaa

SEQ ID NO: 308327 - DNA, 25 bp, Homo sapien
ggtttctcagtatttcaacaataaa

SEQ ID NO: 308328 - DNA, 25 bp, Homo sapien
ataaagcatgttttaatgatttgtc

SEQ ID NO: 308329 - DNA, 25 bp, Homo sapien
tttgtctttagaggagtgagcactc

SEQ ID NO: 308330 - DNA, 25 bp, Homo sapien
gagcactcctctgggggtatattac

SEQ ID NO: 308331 - DNA, 25 bp, Homo sapien
gaaattaactctatggtgccttaag

SEQ ID NO: 308332 - DNA, 25 bp, Homo sapien
actctatggtgccttaaggttacat

SEQ ID NO: 308333 - DNA, 25 bp, Homo sapien
ggtgccttaaggttacatttgcaat

SEQ ID NO: 308334 - DNA, 25 bp, Homo sapien
gccttaaggttacatttgcaataaa

SEQ ID NO: 308335 - DNA, 25 bp, Homo sapien
agggatgcaattcaacacgtaatat

SEQ ID NO: 308336 - DNA, 25 bp, Homo sapien
gaaggtatccaaagggcaatgtaac

SEQ ID NO: 308337 - DNA, 25 bp, Homo sapien
gaacaactggtatatatggagcatc

SEQ ID NO: 308338 - DNA, 25 bp, Homo sapien
gtggagcttaataccaaggcgatgg

SEQ ID NO: 308339 - DNA, 25 bp, Homo sapien
ccaaggcgatgggttgatttgtgca

SEQ ID NO: 308340 - DNA, 25 bp, Homo sapien
caacacgtaatattccctaacacaa

SEQ ID NO: 308341 - DNA, 25 bp, Homo sapien
gtttacctgtgtagcatacctgtac

SEQ ID NO: 308342 - DNA, 25 bp, Homo sapien
aacacaatatttccataacagtctg

SEQ ID NO: 308343 - DNA, 25 bp, Homo sapien
ataacagtctgtagcgtcttcttca

SEQ ID NO: 308344 - DNA, 25 bp, Homo sapien
agcgtcttcttcaggctaagggatt

SEQ ID NO: 308345 - DNA, 25 bp, Homo sapien
gggcctcatctatcagagttgtaat

SEQ ID NO: 308346 - DNA, 25 bp, Homo sapien
gctcatctgttccaagcaggaggat

SEQ ID NO: 308347 - DNA, 25 bp, Homo sapien
ctgggagtgagtagctctgtgttta

SEQ ID NO: 308348 - DNA, 25 bp, Homo sapien
gacaaggatgacaccgaaggtccag

SEQ ID NO: 308349 - DNA, 25 bp, Homo sapien
atgacaccgaaggtccaggagtcca

SEQ ID NO: 308350 - DNA, 25 bp, Homo sapien
aaggtccaggagtccaggacagcag

SEQ ID NO: 308351 - DNA, 25 bp, Homo sapien
atgggcagggcctggacattccaca

SEQ ID NO: 308352 - DNA, 25 bp, Homo sapien
ggcctggacattccacaccctggtg

SEQ ID NO: 308353 - DNA, 25 bp, Homo sapien
tctggcagagcatccgacctcttgg

SEQ ID NO: 308354 - DNA, 25 bp, Homo sapien
agcatccgacctcttggagcaagtt

SEQ ID NO: 308355 - DNA, 25 bp, Homo sapien
tcttggagcaagtttctgcctctgg

SEQ ID NO: 308356 - DNA, 25 bp, Homo sapien
ggcgggcccttttcacaacaggctg

SEQ ID NO: 308357 - DNA, 25 bp, Homo sapien
aaaatgttttccatgagaaaccaag

SEQ ID NO: 308358 - DNA, 25 bp, Homo sapien
caagaaacttacactggtttgacag

SEQ ID NO: 308359 - DNA, 25 bp, Homo sapien
gacagtggtcagttacatgtcccca

SEQ ID NO: 308360 - DNA, 25 bp, Homo sapien
tggtcagttacatgtccccacagtt

SEQ ID NO: 308361 - DNA, 25 bp, Homo sapien
cacagttccaatgtgcctgttcact

SEQ ID NO: 308362 - DNA, 25 bp, Homo sapien
ttccaatgtgcctgttcactcacct

SEQ ID NO: 308363 - DNA, 25 bp, Homo sapien
ctacttggctgctgttttaaagttt

SEQ ID NO: 308364 - DNA, 25 bp, Homo sapien
ttggctgctgttttaaagtttgccc

SEQ ID NO: 308365 - DNA, 25 bp, Homo sapien
tattacagatctaaagctctttcga

SEQ ID NO: 308366 - DNA, 25 bp, Homo sapien
aaagctctttcgattttatactgat

SEQ ID NO: 308367 - DNA, 25 bp, Homo sapien
tgattaaatcagtactgcagtattt

SEQ ID NO: 308368 - DNA, 25 bp, Homo sapien
cacatgctgctaaatgcagatttaa

SEQ ID NO: 308369 - DNA, 25 bp, Homo sapien
ttacatctgaggatcatgacttttc

SEQ ID NO: 308370 - DNA, 25 bp, Homo sapien
tttcctcctttcttggagatcttgg

SEQ ID NO: 308371 - DNA, 25 bp, Homo sapien
tcctttcttggagatcttggtataa

SEQ ID NO: 308372 - DNA, 25 bp, Homo sapien
cttggtataaaattcatctgctgtt

SEQ ID NO: 308373 - DNA, 25 bp, Homo sapien
gctgttataaaatcaggtttctaca

SEQ ID NO: 308374 - DNA, 25 bp, Homo sapien
ggtttctacagagttcgtttcacac

SEQ ID NO: 308375 - DNA, 25 bp, Homo sapien
gagttcgtttcacactaaaggtagt

SEQ ID NO: 308376 - DNA, 25 bp, Homo sapien
agtttgttactgtttgcatgaggaa

SEQ ID NO: 308377 - DNA, 25 bp, Homo sapien
ttgcatgaggaaaccatgtatgtct

SEQ ID NO: 308378 - DNA, 25 bp, Homo sapien
gaaattcaagattccataatcgtaa

SEQ ID NO: 308379 - DNA, 25 bp, Homo sapien
aagatgcagaagacgggccaccaga

SEQ ID NO: 308380 - DNA, 25 bp, Homo sapien
agaagacgggccaccagagttgttg

SEQ ID NO: 308381 - DNA, 25 bp, Homo sapien
gtttattcatggtggtcatactgcc

SEQ ID NO: 308382 - DNA, 25 bp, Homo sapien
ggtggtcatactgccaagatatctg

SEQ ID NO: 308383 - DNA, 25 bp, Homo sapien
tctgatttctcctggaatcccaatg

SEQ ID NO: 308384 - DNA, 25 bp, Homo sapien
aagtgtggcaaatggagttagtcct

SEQ ID NO: 308385 - DNA, 25 bp, Homo sapien
tgtggcaaatggagttagtccttga

SEQ ID NO: 308386 - DNA, 25 bp, Homo sapien
gtccttgaccactagtttgatgcca

SEQ ID NO: 308387 - DNA, 25 bp, Homo sapien
tttgatgccatctccattttgggtg

SEQ ID NO: 308388 - DNA, 25 bp, Homo sapien
tgatgccatctccattttgggtgac

SEQ ID NO: 308389 - DNA, 25 bp, Homo sapien
tctccattttgggtgacctgtttca

SEQ ID NO: 308390 - DNA, 25 bp, Homo sapien
ttatcaactgctgccatttggaact

SEQ ID NO: 308391 - DNA, 25 bp, Homo sapien
ctgctgccatttggaacttcctata

SEQ ID NO: 308392 - DNA, 25 bp, Homo sapien
aaaatgatctatttcagtgttcctt

SEQ ID NO: 308393 - DNA, 25 bp, Homo sapien
ttcagtgttcctttcgcctttcctc

SEQ ID NO: 308394 - DNA, 25 bp, Homo sapien
tggtttcagtaacccatgctgttct

SEQ ID NO: 308395 - DNA, 25 bp, Homo sapien
tattctacgtctttctccctatgtt

SEQ ID NO: 308396 - DNA, 25 bp, Homo sapien
gtctttctccctatgttgaaaaaag

SEQ ID NO: 308397 - DNA, 25 bp, Homo sapien
tcccacagtttctgatgtgtgtgtt

SEQ ID NO: 308398 - DNA, 25 bp, Homo sapien
gatgtgtgtgtttatagtcttcaat

SEQ ID NO: 308399 - DNA, 25 bp, Homo sapien
acatgttaggaactgagtatcttaa

SEQ ID NO: 308400 - DNA, 25 bp, Homo sapien
agatgtcttagaatgctttagtttt

SEQ ID NO: 308401 - DNA, 25 bp, Homo sapien
gcccggaccagatacattccgtgta

SEQ ID NO: 308402 - DNA, 25 bp, Homo sapien
ggaccagatacattccgtgtacatc

SEQ ID NO: 308403 - DNA, 25 bp, Homo sapien
agatacattccgtgtacatcacgcc

SEQ ID NO: 308404 - DNA, 25 bp, Homo sapien
acattccgtgtacatcacgcccggg

SEQ ID NO: 308405 - DNA, 25 bp, Homo sapien
gacctgccagtgcagggcgccctgg

SEQ ID NO: 308406 - DNA, 25 bp, Homo sapien
agaccaatggctgagagccacagct

SEQ ID NO: 308407 - DNA, 25 bp, Homo sapien
atggctgagagccacagctgacaaa

SEQ ID NO: 308408 - DNA, 25 bp, Homo sapien
gagagccacagctgacaaagtctgc

SEQ ID NO: 308409 - DNA, 25 bp, Homo sapien
tgacaaagtctgcatgtccgaggac

SEQ ID NO: 308410 - DNA, 25 bp, Homo sapien
aaagtctgcatgtccgaggacggcc

SEQ ID NO: 308411 - DNA, 25 bp, Homo sapien
acctgcctcgctgggcaccgggtgc

SEQ ID NO: 308412 - DNA, 25 bp, Homo sapien
acaacgtgtttttaggcacatgaca

SEQ ID NO: 308413 - DNA, 25 bp, Homo sapien
aggcacatgacagccttcttgcaat

SEQ ID NO: 308414 - DNA, 25 bp, Homo sapien
gaaactacgtgtggccaggatctca

SEQ ID NO: 308415 - DNA, 25 bp, Homo sapien
aggatctcatccactatcacagttt

SEQ ID NO: 308416 - DNA, 25 bp, Homo sapien
tatcacagtttcagctttccccaaa

SEQ ID NO: 308417 - DNA, 25 bp, Homo sapien
tgcagacgcccatccttattaaagg

SEQ ID NO: 308418 - DNA, 25 bp, Homo sapien
gggcaaagacttctcatacacctag

SEQ ID NO: 308419 - DNA, 25 bp, Homo sapien
ctcatacacctaggatggatcttat

SEQ ID NO: 308420 - DNA, 25 bp, Homo sapien
tcttatattcttggcgggactgcag

SEQ ID NO: 308421 - DNA, 25 bp, Homo sapien
gactgcagagaaggtgccgtgtcct

SEQ ID NO: 308422 - DNA, 25 bp, Homo sapien
tgagtcctcatgtcagggcacaggc

SEQ ID NO: 308423 - DNA, 25 bp, Homo sapien
tatggcagcagaggcctttccctca

SEQ ID NO: 308424 - DNA, 25 bp, Homo sapien
tttccctcagacaagctacaaagtg

SEQ ID NO: 308425 - DNA, 25 bp, Homo sapien
agacaagctacaaagtgcccaggat

SEQ ID NO: 308426 - DNA, 25 bp, Homo sapien
tacaaagtgcccaggatgccatcca

SEQ ID NO: 308427 - DNA, 25 bp, Homo sapien
agcttctcctaggatcccagtggca

SEQ ID NO: 308428 - DNA, 25 bp, Homo sapien
taggatcccagtggcatttatcagt

SEQ ID NO: 308429 - DNA, 25 bp, Homo sapien
gcatttatcagtggccagctacctg

SEQ ID NO: 308430 - DNA, 25 bp, Homo sapien
cgtggcagcagcatacctctgcatt

SEQ ID NO: 308431 - DNA, 25 bp, Homo sapien
agcatacctctgcatttctggaatg

SEQ ID NO: 308432 - DNA, 25 bp, Homo sapien
gcatttctggaatgtgtgtgcatca

SEQ ID NO: 308433 - DNA, 25 bp, Homo sapien
ggaatgtgtgtgcatcaatgatgtt

SEQ ID NO: 308434 - DNA, 25 bp, Homo sapien
gaagctgtgggtcaacgcggaggga

SEQ ID NO: 308435 - DNA, 25 bp, Homo sapien
cgtgggaacccatcccggtgaagcg

SEQ ID NO: 308436 - DNA, 25 bp, Homo sapien
aacccatcccggtgaagcggcagcg

SEQ ID NO: 308437 - DNA, 25 bp, Homo sapien
ggtgaagcggcagcgtcacgtcctt

SEQ ID NO: 308438 - DNA, 25 bp, Homo sapien
gcgtcacgtcctttctcccagggat

SEQ ID NO: 308439 - DNA, 25 bp, Homo sapien
tcccagggatctgttggtcggagac

SEQ ID NO: 308440 - DNA, 25 bp, Homo sapien
ctgttggtcggagacatctggactt

SEQ ID NO: 308441 - DNA, 25 bp, Homo sapien
gtcggagacatctggactttcatgt

SEQ ID NO: 308442 - DNA, 25 bp, Homo sapien
gagacatctggactttcatgtggac

SEQ ID NO: 308443 - DNA, 25 bp, Homo sapien
atctggactttcatgtggacagcct

SEQ ID NO: 308444 - DNA, 25 bp, Homo sapien
caccgtggccggcccttaaaagcat

SEQ ID NO: 308445 - DNA, 25 bp, Homo sapien
tttacttaacttaccataaatgcag

SEQ ID NO: 308446 - DNA, 25 bp, Homo sapien
taccataaatgcagtgtgacttttc

SEQ ID NO: 308447 - DNA, 25 bp, Homo sapien
ccataaatgcagtgtgacttttccc

SEQ ID NO: 308448 - DNA, 25 bp, Homo sapien
tggattgtgaggctcttaacttctt

SEQ ID NO: 308449 - DNA, 25 bp, Homo sapien
ggattgtgaggctcttaacttctta

SEQ ID NO: 308450 - DNA, 25 bp, Homo sapien
gattgtgaggctcttaacttcttaa

SEQ ID NO: 308451 - DNA, 25 bp, Homo sapien
attgtgaggctcttaacttcttaaa

SEQ ID NO: 308452 - DNA, 25 bp, Homo sapien
tgtgaggctcttaacttcttaaaag

SEQ ID NO: 308453 - DNA, 25 bp, Homo sapien
gtgaggctcttaacttcttaaaagt

SEQ ID NO: 308454 - DNA, 25 bp, Homo sapien
gaggctcttaacttcttaaaagtat

SEQ ID NO: 308455 - DNA, 25 bp, Homo sapien
ggctcttaacttcttaaaagtatag

SEQ ID NO: 308456 - DNA, 25 bp, Homo sapien
catgccacctgccatggtgtgtatc

SEQ ID NO: 308457 - DNA, 25 bp, Homo sapien
acctgccatggtgtgtatcccggga

SEQ ID NO: 308458 - DNA, 25 bp, Homo sapien
gccatggtgtgtatcccgggagaat

SEQ ID NO: 308459 - DNA, 25 bp, Homo sapien
tgtatcccgggagaatcacgagcaa

SEQ ID NO: 308460 - DNA, 25 bp, Homo sapien
aatcacgagcaacatggtgtgtgca

SEQ ID NO: 308461 - DNA, 25 bp, Homo sapien
ggccctgtggacaagatggcatccc

SEQ ID NO: 308462 - DNA, 25 bp, Homo sapien
cctgtggacaagatggcatccctgg

SEQ ID NO: 308463 - DNA, 25 bp, Homo sapien
atccctggagtctacacctatattt

SEQ ID NO: 308464 - DNA, 25 bp, Homo sapien
ctggagtctacacctatatttgcaa

SEQ ID NO: 308465 - DNA, 25 bp, Homo sapien
gaacttcttggaactttaactcctg

SEQ ID NO: 308466 - DNA, 25 bp, Homo sapien
tcttggaactttaactcctgccagc

SEQ ID NO: 308467 - DNA, 25 bp, Homo sapien
caatactgggtgactgctggactaa

SEQ ID NO: 308468 - DNA, 25 bp, Homo sapien
ggtgacgagatcaagtatcccgcta

SEQ ID NO: 308469 - DNA, 25 bp, Homo sapien
aagtatcccgctagccacagactag

SEQ ID NO: 308470 - DNA, 25 bp, Homo sapien
cgctagccacagactagctctggga

SEQ ID NO: 308471 - DNA, 25 bp, Homo sapien
atggccagagagtgtgaccccagca

SEQ ID NO: 308472 - DNA, 25 bp, Homo sapien
gctctctgctttcaggtcctaaact

SEQ ID NO: 308473 - DNA, 25 bp, Homo sapien
aactgacaccagtaaaaggacgact

SEQ ID NO: 308474 - DNA, 25 bp, Homo sapien
ccaggcctcaaaaccaaagactcta

SEQ ID NO: 308475 - DNA, 25 bp, Homo sapien
gactctatcttactttgcctcaagt

SEQ ID NO: 308476 - DNA, 25 bp, Homo sapien
tgcctcaagtttgcaagttggtaaa

SEQ ID NO: 308477 - DNA, 25 bp, Homo sapien
aaaagctgccggtaggcactcaaaa

SEQ ID NO: 308478 - DNA, 25 bp, Homo sapien
ccttccttatattcatttggcagtg

SEQ ID NO: 308479 - DNA, 25 bp, Homo sapien
catttggcagtgtcgccgccttaaa

SEQ ID NO: 308480 - DNA, 25 bp, Homo sapien
gccgccttaaacagccatgatgcaa

SEQ ID NO: 308481 - DNA, 25 bp, Homo sapien
actggttatccaggcttattgctag

SEQ ID NO: 308482 - DNA, 25 bp, Homo sapien
caggcttattgctagattatcccgt

SEQ ID NO: 308483 - DNA, 25 bp, Homo sapien
gattatcccgtatctttgctagttt

SEQ ID NO: 308484 - DNA, 25 bp, Homo sapien
tctttgctagtttgtaccagagttc

SEQ ID NO: 308485 - DNA, 25 bp, Homo sapien
aactctggcatggatcttgggtgac

SEQ ID NO: 308486 - DNA, 25 bp, Homo sapien
atgttattcacatctccgaggatcc

SEQ ID NO: 308487 - DNA, 25 bp, Homo sapien
cttcgccataacacagcagcagagt

SEQ ID NO: 308488 - DNA, 25 bp, Homo sapien
gcagagtctgggtgccaaccagtga

SEQ ID NO: 308489 - DNA, 25 bp, Homo sapien
ttctcatgggtaaggaaactcggct

SEQ ID NO: 308490 - DNA, 25 bp, Homo sapien
tcctctcatctcttttcaactatct

SEQ ID NO: 308491 - DNA, 25 bp, Homo sapien
tcatctcttttcaactatcttccaa

SEQ ID NO: 308492 - DNA, 25 bp, Homo sapien
ttttcaactatcttccaaatactgt

SEQ ID NO: 308493 - DNA, 25 bp, Homo sapien
aatactgttgccacagctacatcat

SEQ ID NO: 308494 - DNA, 25 bp, Homo sapien
tgttgccacagctacatcataatgc

SEQ ID NO: 308495 - DNA, 25 bp, Homo sapien
agctacatcataatgccaccactgt

SEQ ID NO: 308496 - DNA, 25 bp, Homo sapien
taatgccaccactgtctgtttgaga

SEQ ID NO: 308497 - DNA, 25 bp, Homo sapien
accactgtctgtttgagactccttc

SEQ ID NO: 308498 - DNA, 25 bp, Homo sapien
gtctgtttgagactccttcatgagc

SEQ ID NO: 308499 - DNA, 25 bp, Homo sapien
gactccttcatgagcaaagattgat

SEQ ID NO: 308500 - DNA, 25 bp, Homo sapien
attttgaaagaggttccagctatca

SEQ ID NO: 308501 - DNA, 25 bp, Homo sapien
ttttgaaagaggttccagctatcac

SEQ ID NO: 308502 - DNA, 25 bp, Homo sapien
tttgaaagaggttccagctatcact

SEQ ID NO: 308503 - DNA, 25 bp, Homo sapien
ttccagctatcacttgtaaccatat

SEQ ID NO: 308504 - DNA, 25 bp, Homo sapien
tccagctatcacttgtaaccatata

SEQ ID NO: 308505 - DNA, 25 bp, Homo sapien
ccagctatcacttgtaaccatatat

SEQ ID NO: 308506 - DNA, 25 bp, Homo sapien
cagctatcacttgtaaccatatata

SEQ ID NO: 308507 - DNA, 25 bp, Homo sapien
agctatcacttgtaaccatatatat

SEQ ID NO: 308508 - DNA, 25 bp, Homo sapien
gctatcacttgtaaccatatatata

SEQ ID NO: 308509 - DNA, 25 bp, Homo sapien
ctatcacttgtaaccatatatatat

SEQ ID NO: 308510 - DNA, 25 bp, Homo sapien
tatcacttgtaaccatatatatata

SEQ ID NO: 308511 - DNA, 25 bp, Homo sapien
tccaattcccctgcaacaaagtttg

SEQ ID NO: 308512 - DNA, 25 bp, Homo sapien
caattcccctgcaacaaagtttgta

SEQ ID NO: 308513 - DNA, 25 bp, Homo sapien
ttcccctgcaacaaagtttgtacca

SEQ ID NO: 308514 - DNA, 25 bp, Homo sapien
aacaaagtttgtaccaggagcattt

SEQ ID NO: 308515 - DNA, 25 bp, Homo sapien
agtttgtaccaggagcatttggcga

SEQ ID NO: 308516 - DNA, 25 bp, Homo sapien
accaggagcatttggcgagtgtcca

SEQ ID NO: 308517 - DNA, 25 bp, Homo sapien
ggagcatttggcgagtgtccagcaa

SEQ ID NO: 308518 - DNA, 25 bp, Homo sapien
gcatttggcgagtgtccagcaagat

SEQ ID NO: 308519 - DNA, 25 bp, Homo sapien
gagtgtccagcaagatgtgcccgtg

SEQ ID NO: 308520 - DNA, 25 bp, Homo sapien
gtgtccagcaagatgtgcccgtgga

SEQ ID NO: 308521 - DNA, 25 bp, Homo sapien
gtccagcaagatgtgcccgtggatg

SEQ ID NO: 308522 - DNA, 25 bp, Homo sapien
aggaatgtacgagacatgccagcta

SEQ ID NO: 308523 - DNA, 25 bp, Homo sapien
gacatgccagctagaaatgccaaag

SEQ ID NO: 308524 - DNA, 25 bp, Homo sapien
tgccaaagagagctccaaagtgttt

SEQ ID NO: 308525 - DNA, 25 bp, Homo sapien
gtgttttgcactgatttaccaagtt

SEQ ID NO: 308526 - DNA, 25 bp, Homo sapien
ggtatcaatgttatctgaaacccat

SEQ ID NO: 308527 - DNA, 25 bp, Homo sapien
tgaaacccattaacacctttctctg

SEQ ID NO: 308528 - DNA, 25 bp, Homo sapien
aacacctttctctgtgaactgcaca

SEQ ID NO: 308529 - DNA, 25 bp, Homo sapien
gaactgcacatattaatctgtgact

SEQ ID NO: 308530 - DNA, 25 bp, Homo sapien
cagcagaatagaaccatcttactgg

SEQ ID NO: 308531 - DNA, 25 bp, Homo sapien
agatccaatgccattttacattagc

SEQ ID NO: 308532 - DNA, 25 bp, Homo sapien
tacattagcctactctgaaatcaag

SEQ ID NO: 308533 - DNA, 25 bp, Homo sapien
agtttgtcaccaccatcgcatacag

SEQ ID NO: 308534 - DNA, 25 bp, Homo sapien
gctggcatcagaagacctacgcctt

SEQ ID NO: 308535 - DNA, 25 bp, Homo sapien
gaagacctacgccttcagcgagaac

SEQ ID NO: 308536 - DNA, 25 bp, Homo sapien
gaaccctctgcccacagtggagatt

SEQ ID NO: 308537 - DNA, 25 bp, Homo sapien
tggagattgccatccggaacacggg

SEQ ID NO: 308538 - DNA, 25 bp, Homo sapien
gcgatgcggaccagtggtgcccact

SEQ ID NO: 308539 - DNA, 25 bp, Homo sapien
agtggtgcccactgctggagactct

SEQ ID NO: 308540 - DNA, 25 bp, Homo sapien
tggagactctgacagacgctgagat

SEQ ID NO: 308541 - DNA, 25 bp, Homo sapien
agaagatccgcgaccaggacaggaa

SEQ ID NO: 308542 - DNA, 25 bp, Homo sapien
accaggacaggaacacgaggcggat

SEQ ID NO: 308543 - DNA, 25 bp, Homo sapien
gctcccacggagcatctcagaagat

SEQ ID NO: 308544 - DNA, 25 bp, Homo sapien
gggaagaacgtgatccacccattcc

SEQ ID NO: 308545 - DNA, 25 bp, Homo sapien
tgatccacccattcctgtctcggag

SEQ ID NO: 308546 - DNA, 25 bp, Homo sapien
tgtctcggagccttcccattgtctt

SEQ ID NO: 308547 - DNA, 25 bp, Homo sapien
ttcccattgtcttcgatgaatttgt

SEQ ID NO: 308548 - DNA, 25 bp, Homo sapien
tcttcgatgaatttgtggacatgga

SEQ ID NO: 308549 - DNA, 25 bp, Homo sapien
ggacatggactttggcacaggtgct

SEQ ID NO: 308550 - DNA, 25 bp, Homo sapien
gcacaggtgctgtgaagatcacccc

SEQ ID NO: 308551 - DNA, 25 bp, Homo sapien
ccccgcacatgaccaaaatgactat

SEQ ID NO: 308552 - DNA, 25 bp, Homo sapien
tgactatgaagttgggcagcggcac

SEQ ID NO: 308553 - DNA, 25 bp, Homo sapien
agcggcacgggctggaggccatcag

SEQ ID NO: 308554 - DNA, 25 bp, Homo sapien
gcctgcccaggtttgaggccaggaa

SEQ ID NO: 308555 - DNA, 25 bp, Homo sapien
ccaaagtgactgttgatactggagt

SEQ ID NO: 308556 - DNA, 25 bp, Homo sapien
gttgatactggagtaattcctgcct

SEQ ID NO: 308557 - DNA, 25 bp, Homo sapien
aaaacaagccaggtcctaacataga

SEQ ID NO: 308558 - DNA, 25 bp, Homo sapien
aagccaggtcctaacatagaaagtg

SEQ ID NO: 308559 - DNA, 25 bp, Homo sapien
caggtcctaacatagaaagtgggaa

SEQ ID NO: 308560 - DNA, 25 bp, Homo sapien
gaatgaagatgatgacgcctccttc

SEQ ID NO: 308561 - DNA, 25 bp, Homo sapien
agatgatgacgcctccttcaaaatt

SEQ ID NO: 308562 - DNA, 25 bp, Homo sapien
gatgatgacgcctccttcaaaatta

SEQ ID NO: 308563 - DNA, 25 bp, Homo sapien
ttcaaaattaagacagtggcccaaa

SEQ ID NO: 308564 - DNA, 25 bp, Homo sapien
gacagtggcccaaaagaaggcagaa

SEQ ID NO: 308565 - DNA, 25 bp, Homo sapien
gaagaaaaagcgaaactgcggaagc

SEQ ID NO: 308566 - DNA, 25 bp, Homo sapien
taaattgcaacaaaatgatacccaa

SEQ ID NO: 308567 - DNA, 25 bp, Homo sapien
tatcctttttgtattgtgaaactgg

SEQ ID NO: 308568 - DNA, 25 bp, Homo sapien
gacattgtaaattatcagctggttt

SEQ ID NO: 308569 - DNA, 25 bp, Homo sapien
ttgtaaattatcagctggtttttct

SEQ ID NO: 308570 - DNA, 25 bp, Homo sapien
gtgtgaaaacacagaacagtatttt

SEQ ID NO: 308571 - DNA, 25 bp, Homo sapien
gaacagtattttgatctatttgata

SEQ ID NO: 308572 - DNA, 25 bp, Homo sapien
gagcatgtacatagaaatagtgact

SEQ ID NO: 308573 - DNA, 25 bp, Homo sapien
aatagtgactgcttgaatactgtat

SEQ ID NO: 308574 - DNA, 25 bp, Homo sapien
gaatactgtatttacttgcactctt

SEQ ID NO: 308575 - DNA, 25 bp, Homo sapien
tacttgcactctttcagtacatcaa

SEQ ID NO: 308576 - DNA, 25 bp, Homo sapien
tctttcagtacatcaagattcctgt

SEQ ID NO: 308577 - DNA, 25 bp, Homo sapien
gttgaagaaatgatgcctcatattc

SEQ ID NO: 308578 - DNA, 25 bp, Homo sapien
tgagcttgccaagcagttaggtgtt

SEQ ID NO: 308579 - DNA, 25 bp, Homo sapien
tgttgggagtggaaatctgcgattt

SEQ ID NO: 308580 - DNA, 25 bp, Homo sapien
gaaatctgcgatttgctgatgaaac

SEQ ID NO: 308581 - DNA, 25 bp, Homo sapien
tttgctgatgaaacagccatgctag

SEQ ID NO: 308582 - DNA, 25 bp, Homo sapien
aaaagttggtcaaggctgtgccaca

SEQ ID NO: 308583 - DNA, 25 bp, Homo sapien
acacccttggcacttttctgtgatg

SEQ ID NO: 308584 - DNA, 25 bp, Homo sapien
gtgaagtttgttctggattctgctt

SEQ ID NO: 308585 - DNA, 25 bp, Homo sapien
tggattctgcttttctcgaaggtgg

SEQ ID NO: 308586 - DNA, 25 bp, Homo sapien
tcaacatctgaaaggagcacatagt

SEQ ID NO: 308587 - DNA, 25 bp, Homo sapien
attattggctggtgacagttcttca

SEQ ID NO: 308588 - DNA, 25 bp, Homo sapien
ggctattccttcaccagttggaaga

SEQ ID NO: 308589 - DNA, 25 bp, Homo sapien
ttccttcaccagttggaagatgtat

SEQ ID NO: 308590 - DNA, 25 bp, Homo sapien
gtatatatgggtggttcctggtttg

SEQ ID NO: 308591 - DNA, 25 bp, Homo sapien
agtgtctcacacttgatagagctta

SEQ ID NO: 308592 - DNA, 25 bp, Homo sapien
cacttgatagagcttatgttcagta

SEQ ID NO: 308593 - DNA, 25 bp, Homo sapien
ttttgaagtccccttatattctgtg

SEQ ID NO: 308594 - DNA, 25 bp, Homo sapien
gaagtccccttatattctgtgtatc

SEQ ID NO: 308595 - DNA, 25 bp, Homo sapien
gtccccttatattctgtgtatcaat

SEQ ID NO: 308596 - DNA, 25 bp, Homo sapien
ttcattgtttgcatgaaccatgttt

SEQ ID NO: 308597 - DNA, 25 bp, Homo sapien
aaccatgtttggctattccttcacc

SEQ ID NO: 308598 - DNA, 25 bp, Homo sapien
atgtttggctattccttcaccagtt

SEQ ID NO: 308599 - DNA, 25 bp, Homo sapien
ggcagaatttttctatgaaaccacc

SEQ ID NO: 308600 - DNA, 25 bp, Homo sapien
ctgttgactatacacttagtattta

SEQ ID NO: 308601 - DNA, 25 bp, Homo sapien
gtacttttttgtggtgtagttcctg

SEQ ID NO: 308602 - DNA, 25 bp, Homo sapien
tttgtggtgtagttcctggataagt

SEQ ID NO: 308603 - DNA, 25 bp, Homo sapien
tgtagttcctggataagtttttctt

SEQ ID NO: 308604 - DNA, 25 bp, Homo sapien
ctaacttttcaatttatttgcacag

SEQ ID NO: 308605 - DNA, 25 bp, Homo sapien
aaaagtcaggaccagtttatagcat

SEQ ID NO: 308606 - DNA, 25 bp, Homo sapien
aggaccagtttatagcattgcagct

SEQ ID NO: 308607 - DNA, 25 bp, Homo sapien
agcattgcagctatctgttctttga

SEQ ID NO: 308608 - DNA, 25 bp, Homo sapien
tgcagctatctgttctttgaagatt

SEQ ID NO: 308609 - DNA, 25 bp, Homo sapien
ctatctgttctttgaagatttggca

SEQ ID NO: 308610 - DNA, 25 bp, Homo sapien
agcccctgcagagatccagacgctt

SEQ ID NO: 308611 - DNA, 25 bp, Homo sapien
gccgacccatccaggtggggaaact

SEQ ID NO: 308612 - DNA, 25 bp, Homo sapien
actgaggcacggagcagctgatgcc

SEQ ID NO: 308613 - DNA, 25 bp, Homo sapien
gcagctgatgcccaaggtccagcag

SEQ ID NO: 308614 - DNA, 25 bp, Homo sapien
cagctgatgcccaaggtccagcagc

SEQ ID NO: 308615 - DNA, 25 bp, Homo sapien
agctgatgcccaaggtccagcagcc

SEQ ID NO: 308616 - DNA, 25 bp, Homo sapien
tgatgcccaaggtccagcagccatg

SEQ ID NO: 308617 - DNA, 25 bp, Homo sapien
gatgcccaaggtccagcagccatgc

SEQ ID NO: 308618 - DNA, 25 bp, Homo sapien
tgcccaaggtccagcagccatgctg

SEQ ID NO: 308619 - DNA, 25 bp, Homo sapien
caaggtccagcagccatgctggtgg

SEQ ID NO: 308620 - DNA, 25 bp, Homo sapien
gtgggctggggaggcgctcagactc

SEQ ID NO: 308621 - DNA, 25 bp, Homo sapien
taaatgcagggagtaacaggattct

SEQ ID NO: 308622 - DNA, 25 bp, Homo sapien
aggattctgccctgagttgaaaatg

SEQ ID NO: 308623 - DNA, 25 bp, Homo sapien
aaggacgctgagacaaatgtggaga

SEQ ID NO: 308624 - DNA, 25 bp, Homo sapien
cagtggaatttctctaatgtgatca

SEQ ID NO: 308625 - DNA, 25 bp, Homo sapien
gtgatcactgtggttctataggcga

SEQ ID NO: 308626 - DNA, 25 bp, Homo sapien
ggttctataggcgaatatcccactt

SEQ ID NO: 308627 - DNA, 25 bp, Homo sapien
gaatatcccactttctttggcatgt

SEQ ID NO: 308628 - DNA, 25 bp, Homo sapien
actttctttggcatgtatctcctaa

SEQ ID NO: 308629 - DNA, 25 bp, Homo sapien
attctataaaacaactggccatgga

SEQ ID NO: 308630 - DNA, 25 bp, Homo sapien
gtatctcctaagtacttagcggtaa

SEQ ID NO: 308631 - DNA, 25 bp, Homo sapien
ggaacggttatagatcaaaggagac

SEQ ID NO: 308632 - DNA, 25 bp, Homo sapien
aatgggtggctctctggttgctgct

SEQ ID NO: 308633 - DNA, 25 bp, Homo sapien
ctgctgctgtcggtttcttttggag

SEQ ID NO: 308634 - DNA, 25 bp, Homo sapien
ggttcttttcaaatttcctctgcaa

SEQ ID NO: 308635 - DNA, 25 bp, Homo sapien
aaatttcctctgcaagtctctttcc

SEQ ID NO: 308636 - DNA, 25 bp, Homo sapien
ggagccactgcatggtgcctacgtc

SEQ ID NO: 308637 - DNA, 25 bp, Homo sapien
gtgcctacgtcctctctatttttct

SEQ ID NO: 308638 - DNA, 25 bp, Homo sapien
tctcctcctctgtgttcttgtttgc

SEQ ID NO: 308639 - DNA, 25 bp, Homo sapien
cttcctcagagtcgtcatcatcaga

SEQ ID NO: 308640 - DNA, 25 bp, Homo sapien
tcatcatcagagacgttgtaatagt

SEQ ID NO: 308641 - DNA, 25 bp, Homo sapien
atagtcaaaagaggcttcctggttc

SEQ ID NO: 308642 - DNA, 25 bp, Homo sapien
cctgctgacgctgggaagcaggcat

SEQ ID NO: 308643 - DNA, 25 bp, Homo sapien
cccttctctgaataacccattaatc

SEQ ID NO: 308644 - DNA, 25 bp, Homo sapien
aatggctcaagcacttcctaaaggt

SEQ ID NO: 308645 - DNA, 25 bp, Homo sapien
ttcctaaaggtctcgcctcttaaca

SEQ ID NO: 308646 - DNA, 25 bp, Homo sapien
ttaacacgcctgcattgggcaccaa

SEQ ID NO: 308647 - DNA, 25 bp, Homo sapien
gggcaccaagtatccaacagatgaa

SEQ ID NO: 308648 - DNA, 25 bp, Homo sapien
gatttgctgtcaagtagtttgcatt

SEQ ID NO: 308649 - DNA, 25 bp, Homo sapien
gggactaacgagagacagccacatt

SEQ ID NO: 308650 - DNA, 25 bp, Homo sapien
gccacattggcttttattacagacc

SEQ ID NO: 308651 - DNA, 25 bp, Homo sapien
ttattacagacccactcttgtgcta

SEQ ID NO: 308652 - DNA, 25 bp, Homo sapien
acagacccactcttgtgctaactag

SEQ ID NO: 308653 - DNA, 25 bp, Homo sapien
gctaactagccccttctctgaataa

SEQ ID NO: 308654 - DNA, 25 bp, Homo sapien
agatcgcgcccgagtactacgacca

SEQ ID NO: 308655 - DNA, 25 bp, Homo sapien
tgccgcagcaccactcctgggtgaa

SEQ ID NO: 308656 - DNA, 25 bp, Homo sapien
accactcctgggtgaaggtgctctg

SEQ ID NO: 308657 - DNA, 25 bp, Homo sapien
aggtgctctgggattttgtgtttga

SEQ ID NO: 308658 - DNA, 25 bp, Homo sapien
attttgtgtttgaggactccctggg

SEQ ID NO: 308659 - DNA, 25 bp, Homo sapien
accatgggcaacagcgcgcgcgcag

SEQ ID NO: 308660 - DNA, 25 bp, Homo sapien
tatgccagggtgaagcgggtgtaca

SEQ ID NO: 308661 - DNA, 25 bp, Homo sapien
tgtacaggctggcaaaagatggtct

SEQ ID NO: 308662 - DNA, 25 bp, Homo sapien
aaaagatggtctgtgagcccgggct

SEQ ID NO: 308663 - DNA, 25 bp, Homo sapien
gcgcagcgagcttcgagtgggtcta

SEQ ID NO: 308664 - DNA, 25 bp, Homo sapien
caaggagatactgggtgcggaagat

SEQ ID NO: 308665 - DNA, 25 bp, Homo sapien
ttcggttgcatttcatgaaaccagc

SEQ ID NO: 308666 - DNA, 25 bp, Homo sapien
aaaccagcattgttcgagcctgtga

SEQ ID NO: 308667 - DNA, 25 bp, Homo sapien
agcctgtgagaaccccgtcctgtgt

SEQ ID NO: 308668 - DNA, 25 bp, Homo sapien
cctgtgtcttcagctcgatagattt

SEQ ID NO: 308669 - DNA, 25 bp, Homo sapien
gggttcgtctgcagcccctctggtt

SEQ ID NO: 308670 - DNA, 25 bp, Homo sapien
atcagcaccgtgtggactccaaaac

SEQ ID NO: 308671 - DNA, 25 bp, Homo sapien
gtggactccaaaacgagttgccaat

SEQ ID NO: 308672 - DNA, 25 bp, Homo sapien
aacgagttgccaatccttcctttct

SEQ ID NO: 308673 - DNA, 25 bp, Homo sapien
tttccctcattaccctgtatttttg

SEQ ID NO: 308674 - DNA, 25 bp, Homo sapien
ccctgtatttttgtgcatactgaat

SEQ ID NO: 308675 - DNA, 25 bp, Homo sapien
atatcaccgggtaaaactgttcaga

SEQ ID NO: 308676 - DNA, 25 bp, Homo sapien
gatccgattgaaaacttaggcaccg

SEQ ID NO: 308677 - DNA, 25 bp, Homo sapien
gcaccggttaattcttcccggtgct

SEQ ID NO: 308678 - DNA, 25 bp, Homo sapien
aattcttcccggtgctccaaggcca

SEQ ID NO: 308679 - DNA, 25 bp, Homo sapien
gagagagcctcaattcttagcacac

SEQ ID NO: 308680 - DNA, 25 bp, Homo sapien
tcaattcttagcacacccaggcttg

SEQ ID NO: 308681 - DNA, 25 bp, Homo sapien
agcacacccaggcttgctgcgtcga

SEQ ID NO: 308682 - DNA, 25 bp, Homo sapien
tgctgcgtcgatcgccacaggtgaa

SEQ ID NO: 308683 - DNA, 25 bp, Homo sapien
gccacaggtgaagaggcctcgagac

SEQ ID NO: 308684 - DNA, 25 bp, Homo sapien
gcctcgagacatttagggcctctgt

SEQ ID NO: 308685 - DNA, 25 bp, Homo sapien
tcgagacatttagggcctctgtgtt

SEQ ID NO: 308686 - DNA, 25 bp, Homo sapien
gctctttaattttttggcttgcttg

SEQ ID NO: 308687 - DNA, 25 bp, Homo sapien
gaaggagtccttatcctgattccca

SEQ ID NO: 308688 - DNA, 25 bp, Homo sapien
ggcagtgctgaagccgagaccagac

SEQ ID NO: 308689 - DNA, 25 bp, Homo sapien
accagacaggatccctcgggtggaa

SEQ ID NO: 308690 - DNA, 25 bp, Homo sapien
gggctcctcctcagtgaatggatgg

SEQ ID NO: 308691 - DNA, 25 bp, Homo sapien
gatgggtggtaatctcctttcctac

SEQ ID NO: 308692 - DNA, 25 bp, Homo sapien
tgtcctagcggtagcctctgttcct

SEQ ID NO: 308693 - DNA, 25 bp, Homo sapien
ctctgttccttctcttgttttatct

SEQ ID NO: 308694 - DNA, 25 bp, Homo sapien
aaataccaaaaccattctctcacct

SEQ ID NO: 308695 - DNA, 25 bp, Homo sapien
attctctcacctgccagagaggagc

SEQ ID NO: 308696 - DNA, 25 bp, Homo sapien
agctcataggagttgggcttcctca

SEQ ID NO: 308697 - DNA, 25 bp, Homo sapien
gcttcctcagagagtgttcctccct

SEQ ID NO: 308698 - DNA, 25 bp, Homo sapien
taacatactcctatgggctcggcag

SEQ ID NO: 308699 - DNA, 25 bp, Homo sapien
tatgggctcggcagctgtgtcaaga

SEQ ID NO: 308700 - DNA, 25 bp, Homo sapien
agctgtgtcaagatcgagtctcctt

SEQ ID NO: 308701 - DNA, 25 bp, Homo sapien
aagatcgagtctccttgctaccctt

SEQ ID NO: 308702 - DNA, 25 bp, Homo sapien
tgcaacccgtgcagcccatatgatc

SEQ ID NO: 308703 - DNA, 25 bp, Homo sapien
atatgatccttgcaacccgtgttat

SEQ ID NO: 308704 - DNA, 25 bp, Homo sapien
tgcaacccgtgttatccctgtggaa

SEQ ID NO: 308705 - DNA, 25 bp, Homo sapien
gtggaagccgattttcctgtaggaa

SEQ ID NO: 308706 - DNA, 25 bp, Homo sapien
gtgcgcataggaacccattacttaa

SEQ ID NO: 308707 - DNA, 25 bp, Homo sapien
tagaagtcagttactccagccaggc

SEQ ID NO: 308708 - DNA, 25 bp, Homo sapien
tcccatggcccctgttgttgaagta

SEQ ID NO: 308709 - DNA, 25 bp, Homo sapien
gttttcagcagagctccttaaatat

SEQ ID NO: 308710 - DNA, 25 bp, Homo sapien
gggccattgggatctctggactctt

SEQ ID NO: 308711 - DNA, 25 bp, Homo sapien
gatctctggactctttggccatgaa

SEQ ID NO: 308712 - DNA, 25 bp, Homo sapien
ggactctttggccatgaaaaactcc

SEQ ID NO: 308713 - DNA, 25 bp, Homo sapien
aaaaactccagtccagagcctcagg

SEQ ID NO: 308714 - DNA, 25 bp, Homo sapien
tcaggctttgacacccagcagtaag

SEQ ID NO: 308715 - DNA, 25 bp, Homo sapien
cagcagtaagctaacagtggacaca

SEQ ID NO: 308716 - DNA, 25 bp, Homo sapien
ctccttcgagcaccctttgtgaaaa

SEQ ID NO: 308717 - DNA, 25 bp, Homo sapien
cagtgtctcagaactactgacacca

SEQ ID NO: 308718 - DNA, 25 bp, Homo sapien
gaaacccagtttggattccccaatg

SEQ ID NO: 308719 - DNA, 25 bp, Homo sapien
ttggattccccaatgcagcaggaaa

SEQ ID NO: 308720 - DNA, 25 bp, Homo sapien
atactgacttgtttgcattgggcat

SEQ ID NO: 308721 - DNA, 25 bp, Homo sapien
tgcattgggcatatatactactctt

SEQ ID NO: 308722 - DNA, 25 bp, Homo sapien
tactactcttgcgagcaggaggcct

SEQ ID NO: 308723 - DNA, 25 bp, Homo sapien
cgagcaggaggcctgaaatctccta

SEQ ID NO: 308724 - DNA, 25 bp, Homo sapien
caacccagggagactgttaggtcct

SEQ ID NO: 308725 - DNA, 25 bp, Homo sapien
agcctggcaacaagggaaatcccga

SEQ ID NO: 308726 - DNA, 25 bp, Homo sapien
aaatcccgagattgtaggcaagagg

SEQ ID NO: 308727 - DNA, 25 bp, Homo sapien
gatgctttcaaaaagcctggaggga

SEQ ID NO: 308728 - DNA, 25 bp, Homo sapien
tgtttaacgcattccttctttggtt

SEQ ID NO: 308729 - DNA, 25 bp, Homo sapien
tgttaggtcctttggtctagaaact

SEQ ID NO: 308730 - DNA, 25 bp, Homo sapien
aatagccagactatactgacttgtt

SEQ ID NO: 308731 - DNA, 25 bp, Homo sapien
gttagtttcttacatggttttccat

SEQ ID NO: 308732 - DNA, 25 bp, Homo sapien
ggttttccatagtcacatttgttaa

SEQ ID NO: 308733 - DNA, 25 bp, Homo sapien
gtcacatttgttaaagagtccagtt

SEQ ID NO: 308734 - DNA, 25 bp, Homo sapien
tgttaaagagtccagttgatgggca

SEQ ID NO: 308735 - DNA, 25 bp, Homo sapien
ctgggatgcatgaagactttccaag

SEQ ID NO: 308736 - DNA, 25 bp, Homo sapien
gatgcatgaagactttccaaggaaa

SEQ ID NO: 308737 - DNA, 25 bp, Homo sapien
ctttccaaggaaaacgcagacaagg

SEQ ID NO: 308738 - DNA, 25 bp, Homo sapien
gcagacaaggaacattctatccaca

SEQ ID NO: 308739 - DNA, 25 bp, Homo sapien
atacagtgttttcaaatgttcatgg

SEQ ID NO: 308740 - DNA, 25 bp, Homo sapien
atacaccaagacagaccatagtctg

SEQ ID NO: 308741 - DNA, 25 bp, Homo sapien
gtttatgatatgaataatctcccct

SEQ ID NO: 308742 - DNA, 25 bp, Homo sapien
gctaggcagggttggaaacatgcta

SEQ ID NO: 308743 - DNA, 25 bp, Homo sapien
tgaaatctttccttctcagtagagt

SEQ ID NO: 308744 - DNA, 25 bp, Homo sapien
ttctcagtagagttgcccttgcagc

SEQ ID NO: 308745 - DNA, 25 bp, Homo sapien
agtagagttgcccttgcagctgaaa

SEQ ID NO: 308746 - DNA, 25 bp, Homo sapien
aaaataagcagatcccacttgtctc

SEQ ID NO: 308747 - DNA, 25 bp, Homo sapien
tctgttctcctatgcatgccctgga

SEQ ID NO: 308748 - DNA, 25 bp, Homo sapien
atgcatgccctggaaagagaatgaa

SEQ ID NO: 308749 - DNA, 25 bp, Homo sapien
gagaatgaatgagccctttttaatt

SEQ ID NO: 308750 - DNA, 25 bp, Homo sapien
tttatcaactggttttcttccatct

SEQ ID NO: 308751 - DNA, 25 bp, Homo sapien
tcttccatctctttactagtgagcc

SEQ ID NO: 308752 - DNA, 25 bp, Homo sapien
catctctttactagtgagccatggg

SEQ ID NO: 308753 - DNA, 25 bp, Homo sapien
agtcagggaacagtagggctctttg

SEQ ID NO: 308754 - DNA, 25 bp, Homo sapien
agggctctttgaagaactacagatt

SEQ ID NO: 308755 - DNA, 25 bp, Homo sapien
aactacagattgtgttctaaatgaa

SEQ ID NO: 308756 - DNA, 25 bp, Homo sapien
gggcgagtgataaccactgatgaat

SEQ ID NO: 308757 - DNA, 25 bp, Homo sapien
atgaatggcagatggtgttgacaac

SEQ ID NO: 308758 - DNA, 25 bp, Homo sapien
aagcttagtagcttgagctggtcct

SEQ ID NO: 308759 - DNA, 25 bp, Homo sapien
gccagagtctgtaggatcttacatg

SEQ ID NO: 308760 - DNA, 25 bp, Homo sapien
gtaggatcttacatgtcttgcaatc

SEQ ID NO: 308761 - DNA, 25 bp, Homo sapien
cttacatgtcttgcaatcagttttg

SEQ ID NO: 308762 - DNA, 25 bp, Homo sapien
atcagttttgactttgaccttggaa

SEQ ID NO: 308763 - DNA, 25 bp, Homo sapien
agtaggagctctttagccagactaa

SEQ ID NO: 308764 - DNA, 25 bp, Homo sapien
gaatcgcgatattgcagcgcagagt

SEQ ID NO: 308765 - DNA, 25 bp, Homo sapien
gcaagcaagggtttcgaggacttca

SEQ ID NO: 308766 - DNA, 25 bp, Homo sapien
ttcgaggacttcaaagactcctagg

SEQ ID NO: 308767 - DNA, 25 bp, Homo sapien
cggcaaagcactggcagggctcgaa

SEQ ID NO: 308768 - DNA, 25 bp, Homo sapien
aaacttctactgcttcctactgaag

SEQ ID NO: 308769 - DNA, 25 bp, Homo sapien
cctactgaagagtggatgggccttc

SEQ ID NO: 308770 - DNA, 25 bp, Homo sapien
tgggccttcagggaagttcctggca

SEQ ID NO: 308771 - DNA, 25 bp, Homo sapien
tggcaggaacagtcctcccatttgt

SEQ ID NO: 308772 - DNA, 25 bp, Homo sapien
agtcctcccatttgtctgggcggat

SEQ ID NO: 308773 - DNA, 25 bp, Homo sapien
gcaactgtgattgaaggcggtcttt

SEQ ID NO: 308774 - DNA, 25 bp, Homo sapien
aggcggtctttcaaagcaggctctt

SEQ ID NO: 308775 - DNA, 25 bp, Homo sapien
actttgcaagcagagcgcgcgcgaa

SEQ ID NO: 308776 - DNA, 25 bp, Homo sapien
gagcgcgcgcgaaatcgtcggattt

SEQ ID NO: 308777 - DNA, 25 bp, Homo sapien
aaatcgtcggatttccagcgaggca

SEQ ID NO: 308778 - DNA, 25 bp, Homo sapien
gtcggatttccagcgaggcagcaaa

SEQ ID NO: 308779 - DNA, 25 bp, Homo sapien
tttccagcgaggcagcaaatatttg

SEQ ID NO: 308780 - DNA, 25 bp, Homo sapien
gaaagaagcggagccgagccgagcc

SEQ ID NO: 308781 - DNA, 25 bp, Homo sapien
tcccggccgcgcagacagaaaagaa

SEQ ID NO: 308782 - DNA, 25 bp, Homo sapien
tcctaaagttactaatcccgcggag

SEQ ID NO: 308783 - DNA, 25 bp, Homo sapien
gggagagagcgtgcctcgggccgcc

SEQ ID NO: 308784 - DNA, 25 bp, Homo sapien
gggcggtcatttgagcgtgtttact

SEQ ID NO: 308785 - DNA, 25 bp, Homo sapien
catttgagcgtgtttacttaaagac

SEQ ID NO: 308786 - DNA, 25 bp, Homo sapien
ggtgtagttacactgatgacttttc

SEQ ID NO: 308787 - DNA, 25 bp, Homo sapien
tttcaaggttcccagggcctgacca

SEQ ID NO: 308788 - DNA, 25 bp, Homo sapien
ccagggcctgaccaaaattttggct

SEQ ID NO: 308789 - DNA, 25 bp, Homo sapien
ggcttctcttaatacaaagtggcac

SEQ ID NO: 308790 - DNA, 25 bp, Homo sapien
ggcacctggaattttagctctgtgt

SEQ ID NO: 308791 - DNA, 25 bp, Homo sapien
tattgggccccaaatgggtttctgt

SEQ ID NO: 308792 - DNA, 25 bp, Homo sapien
atgggtttctgtgggatgcaacccc

SEQ ID NO: 308793 - DNA, 25 bp, Homo sapien
gcaaccccagaaagggtactctgat

SEQ ID NO: 308794 - DNA, 25 bp, Homo sapien
ggagaaggtttactgcttgtcctgt

SEQ ID NO: 308795 - DNA, 25 bp, Homo sapien
tgtcctgtcatcgtagttcatgttt

SEQ ID NO: 308796 - DNA, 25 bp, Homo sapien
ggagataaccaaagccaacagtctt

SEQ ID NO: 308797 - DNA, 25 bp, Homo sapien
tggacattgagacccaggctggcat

SEQ ID NO: 308798 - DNA, 25 bp, Homo sapien
aggctggcatcgtggcccatatcca

SEQ ID NO: 308799 - DNA, 25 bp, Homo sapien
atcgtggcccatatccaggaggtag

SEQ ID NO: 308800 - DNA, 25 bp, Homo sapien
gacctactaccaggaagttctccag

SEQ ID NO: 308801 - DNA, 25 bp, Homo sapien
gcccatatccaggaggtaggtgcgt

SEQ ID NO: 308802 - DNA, 25 bp, Homo sapien
ctactaccaggaagttctccagcag

SEQ ID NO: 308803 - DNA, 25 bp, Homo sapien
tcagctgtggactgctgctcctgtg

SEQ ID NO: 308804 - DNA, 25 bp, Homo sapien
ctccagcagctgattgtaatgaatt

SEQ ID NO: 308805 - DNA, 25 bp, Homo sapien
cagctgattgtaatgaatttgccca

SEQ ID NO: 308806 - DNA, 25 bp, Homo sapien
aatgaatttgcccaatgttttgatg

SEQ ID NO: 308807 - DNA, 25 bp, Homo sapien
tttgatgattggcagagacccactg

SEQ ID NO: 308808 - DNA, 25 bp, Homo sapien
ctctagttattgaggaaaactggac

SEQ ID NO: 308809 - DNA, 25 bp, Homo sapien
gatactttagtcttaaattgaggtt

SEQ ID NO: 308810 - DNA, 25 bp, Homo sapien
aaaacttgggctttctaatcagaat

SEQ ID NO: 308811 - DNA, 25 bp, Homo sapien
gggctttctaatcagaatttccagg

SEQ ID NO: 308812 - DNA, 25 bp, Homo sapien
tctaatcagaatttccaggaggagg

SEQ ID NO: 308813 - DNA, 25 bp, Homo sapien
ggaggaaagtgtgtgctgaatattt

SEQ ID NO: 308814 - DNA, 25 bp, Homo sapien
atattttaaacatttcccactgatc

SEQ ID NO: 308815 - DNA, 25 bp, Homo sapien
aacatttcccactgatcatacaaag

SEQ ID NO: 308816 - DNA, 25 bp, Homo sapien
ttcccactgatcatacaaagtctga

SEQ ID NO: 308817 - DNA, 25 bp, Homo sapien
ttaaatttacacttataatgccttt

SEQ ID NO: 308818 - DNA, 25 bp, Homo sapien
ttaacatgtgcttttccaaattaaa

SEQ ID NO: 308819 - DNA, 25 bp, Homo sapien
ttgatctccatctttggctccggct

SEQ ID NO: 308820 - DNA, 25 bp, Homo sapien
ccatctttggctccggcttctcggg

SEQ ID NO: 308821 - DNA, 25 bp, Homo sapien
gacagccggactcctcggagcagcc

SEQ ID NO: 308822 - DNA, 25 bp, Homo sapien
tcaacgggcagctgtgcgccaagca

SEQ ID NO: 308823 - DNA, 25 bp, Homo sapien
caacgggcagctgtgcgccaagcag

SEQ ID NO: 308824 - DNA, 25 bp, Homo sapien
tgtgcgccaagcaggcgctcgccag

SEQ ID NO: 308825 - DNA, 25 bp, Homo sapien
tcggcgcctggactcgagccattgt

SEQ ID NO: 308826 - DNA, 25 bp, Homo sapien
tggactcgagccattgtcgccttct

SEQ ID NO: 308827 - DNA, 25 bp, Homo sapien
gactcgagccattgtcgccttctag

SEQ ID NO: 308828 - DNA, 25 bp, Homo sapien
tcgagccattgtcgccttctaggga

SEQ ID NO: 308829 - DNA, 25 bp, Homo sapien
agaggagggaacgagcgggcgccgg

SEQ ID NO: 308830 - DNA, 25 bp, Homo sapien
taacatcatcattctttctgggctg

SEQ ID NO: 308831 - DNA, 25 bp, Homo sapien
attaccatttgctccgatgcctata

SEQ ID NO: 308832 - DNA, 25 bp, Homo sapien
gatgcctatgatttggtatttctcc

SEQ ID NO: 308833 - DNA, 25 bp, Homo sapien
atttctcctggccagagagtagcac

SEQ ID NO: 308834 - DNA, 25 bp, Homo sapien
gtattctaacccttattgctcaatg

SEQ ID NO: 308835 - DNA, 25 bp, Homo sapien
ttattgctcaatgtgtttttccaga

SEQ ID NO: 308836 - DNA, 25 bp, Homo sapien
gtgtttttccagagcagcccaaaag

SEQ ID NO: 308837 - DNA, 25 bp, Homo sapien
ctccgatgcctatagctcagtatta

SEQ ID NO: 308838 - DNA, 25 bp, Homo sapien
aaaggttatgctgggtttcatgagc

SEQ ID NO: 308839 - DNA, 25 bp, Homo sapien
gaggatgactgactggtgccaccta

SEQ ID NO: 308840 - DNA, 25 bp, Homo sapien
actggtgccacctagaaagacaaac

SEQ ID NO: 308841 - DNA, 25 bp, Homo sapien
tatagctatttattttcctggggta

SEQ ID NO: 308842 - DNA, 25 bp, Homo sapien
aattgtgacaagtatcctagaagaa

SEQ ID NO: 308843 - DNA, 25 bp, Homo sapien
tatcctctattcttagtttctgatg

SEQ ID NO: 308844 - DNA, 25 bp, Homo sapien
ctattcttagtttctgatgctttgt

SEQ ID NO: 308845 - DNA, 25 bp, Homo sapien
aactttgcctttaccacttatatgg

SEQ ID NO: 308846 - DNA, 25 bp, Homo sapien
gcctttaccacttatatggtattag

SEQ ID NO: 308847 - DNA, 25 bp, Homo sapien
aaacatggtactttgttctcctgct

SEQ ID NO: 308848 - DNA, 25 bp, Homo sapien
ttgttctcctgcttcctagacgaaa

SEQ ID NO: 308849 - DNA, 25 bp, Homo sapien
tctcctgcttcctagacgaaatcta

SEQ ID NO: 308850 - DNA, 25 bp, Homo sapien
gcttcctagacgaaatctaagcaat

SEQ ID NO: 308851 - DNA, 25 bp, Homo sapien
ctaagcaatattttatccacttctt

SEQ ID NO: 308852 - DNA, 25 bp, Homo sapien
cagctccggaactggcgccctttgg

SEQ ID NO: 308853 - DNA, 25 bp, Homo sapien
tcagctcccgcttctggtccctgta

SEQ ID NO: 308854 - DNA, 25 bp, Homo sapien
ctggtccctgtagcaaagctggaag

SEQ ID NO: 308855 - DNA, 25 bp, Homo sapien
ggtccctgtagcaaagctggaaggc

SEQ ID NO: 308856 - DNA, 25 bp, Homo sapien
gtccctgtagcaaagctggaaggca

SEQ ID NO: 308857 - DNA, 25 bp, Homo sapien
tccctgtagcaaagctggaaggcag

SEQ ID NO: 308858 - DNA, 25 bp, Homo sapien
gcaaggcagccccttgctccgtggt

SEQ ID NO: 308859 - DNA, 25 bp, Homo sapien
gtggtccctctcaccatcataatgt

SEQ ID NO: 308860 - DNA, 25 bp, Homo sapien
ggtccctctcaccatcataatgtta

SEQ ID NO: 308861 - DNA, 25 bp, Homo sapien
gtccctctcaccatcataatgttaa

SEQ ID NO: 308862 - DNA, 25 bp, Homo sapien
ccctctcaccatcataatgttaata

SEQ ID NO: 308863 - DNA, 25 bp, Homo sapien
tccttccccgtttttgtgcttctgg

SEQ ID NO: 308864 - DNA, 25 bp, Homo sapien
taattaatttaacaagtgctgcagt

SEQ ID NO: 308865 - DNA, 25 bp, Homo sapien
tttgcaatttcttccctgccctaca

SEQ ID NO: 308866 - DNA, 25 bp, Homo sapien
tgggttggactcagggtctcctcca

SEQ ID NO: 308867 - DNA, 25 bp, Homo sapien
gttggactcagggtctcctccagct

SEQ ID NO: 308868 - DNA, 25 bp, Homo sapien
gggctggaccgcagcacctatctga

SEQ ID NO: 308869 - DNA, 25 bp, Homo sapien
accgcagcacctatctgagcagtta

SEQ ID NO: 308870 - DNA, 25 bp, Homo sapien
atctgagcagttagagcgtctttct

SEQ ID NO: 308871 - DNA, 25 bp, Homo sapien
gcagttagagcgtctttcttttcag

SEQ ID NO: 308872 - DNA, 25 bp, Homo sapien
ttagagcgtctttcttttcagattg

SEQ ID NO: 308873 - DNA, 25 bp, Homo sapien
ttcagattgtgtacagtagattatt

SEQ ID NO: 308874 - DNA, 25 bp, Homo sapien
cccagctcaactcctaatgatatca

SEQ ID NO: 308875 - DNA, 25 bp, Homo sapien
aatgatatcacaggtcagctactca

SEQ ID NO: 308876 - DNA, 25 bp, Homo sapien
cgctacctagtagagaatacagtat

SEQ ID NO: 308877 - DNA, 25 bp, Homo sapien
gaatacagtatgttcatcctagtgt

SEQ ID NO: 308878 - DNA, 25 bp, Homo sapien
gttcatcctagtgtgaaattttcta

SEQ ID NO: 308879 - DNA, 25 bp, Homo sapien
tttctactttgatttccactgttct

SEQ ID NO: 308880 - DNA, 25 bp, Homo sapien
tgatttccactgttcttatacgcac

SEQ ID NO: 308881 - DNA, 25 bp, Homo sapien
ccactgttcttatacgcactatgtc

SEQ ID NO: 308882 - DNA, 25 bp, Homo sapien
tatacgcactatgtctaagaagcaa

SEQ ID NO: 308883 - DNA, 25 bp, Homo sapien
gaaaaagaccttatggatcacccaa

SEQ ID NO: 308884 - DNA, 25 bp, Homo sapien
ccttatggatcacccaagtgttgga

SEQ ID NO: 308885 - DNA, 25 bp, Homo sapien
cagtggctgcaaggtacatggtttc

SEQ ID NO: 308886 - DNA, 25 bp, Homo sapien
agtggctgcaaggtacatggtttca

SEQ ID NO: 308887 - DNA, 25 bp, Homo sapien
tggctgcaaggtacatggtttcact

SEQ ID NO: 308888 - DNA, 25 bp, Homo sapien
ggctgcaaggtacatggtttcactg

SEQ ID NO: 308889 - DNA, 25 bp, Homo sapien
gctgcaaggtacatggtttcactgt

SEQ ID NO: 308890 - DNA, 25 bp, Homo sapien
actgtgactggcctgtattttactt

SEQ ID NO: 308891 - DNA, 25 bp, Homo sapien
ctgtgactggcctgtattttacttt

SEQ ID NO: 308892 - DNA, 25 bp, Homo sapien
tgtgactggcctgtattttactttt

SEQ ID NO: 308893 - DNA, 25 bp, Homo sapien
gtgactggcctgtattttactttta

SEQ ID NO: 308894 - DNA, 25 bp, Homo sapien
tgactggcctgtattttacttttaa

SEQ ID NO: 308895 - DNA, 25 bp, Homo sapien
tggcctgtattttacttttaaattg

SEQ ID NO: 308896 - DNA, 25 bp, Homo sapien
cactgacccgggtaggactcctgga

SEQ ID NO: 308897 - DNA, 25 bp, Homo sapien
gtaggactcctggacagggtgactc

SEQ ID NO: 308898 - DNA, 25 bp, Homo sapien
acagggtgactccagatcagctgtt

SEQ ID NO: 308899 - DNA, 25 bp, Homo sapien
cagatcagctgtttgtgagtgtgca

SEQ ID NO: 308900 - DNA, 25 bp, Homo sapien
gagtgtgcaggatgcagctgcttat

SEQ ID NO: 308901 - DNA, 25 bp, Homo sapien
ggagctcactgacccaaagatttgc

SEQ ID NO: 308902 - DNA, 25 bp, Homo sapien
aagatttgcaccgtgtgggtctgac

SEQ ID NO: 308903 - DNA, 25 bp, Homo sapien
tgggtctgacctcatcatgtggagt

SEQ ID NO: 308904 - DNA, 25 bp, Homo sapien
catcatgtggagtgcagagggccct

SEQ ID NO: 308905 - DNA, 25 bp, Homo sapien
cagagggccctgatgacatgtgtgt

SEQ ID NO: 308906 - DNA, 25 bp, Homo sapien
tgatgaggaccatgacccttgaacc

SEQ ID NO: 308907 - DNA, 25 bp, Homo sapien
gaaatacagggtcctgtccttgcat

SEQ ID NO: 308908 - DNA, 25 bp, Homo sapien
tgtccttgcataagttcctgcagga

SEQ ID NO: 308909 - DNA, 25 bp, Homo sapien
gacaggaagtgtcccaaggctcaaa

SEQ ID NO: 308910 - DNA, 25 bp, Homo sapien
gtcccaaggctcaaaacaacacaga

SEQ ID NO: 308911 - DNA, 25 bp, Homo sapien
aaaagcctcacgctgcaactttgct

SEQ ID NO: 308912 - DNA, 25 bp, Homo sapien
tgttgcccagagaggcctcacacag

SEQ ID NO: 308913 - DNA, 25 bp, Homo sapien
cctcacacaggcctcagaaatgttt

SEQ ID NO: 308914 - DNA, 25 bp, Homo sapien
gaaatgtttcttgtcacacaaagct

SEQ ID NO: 308915 - DNA, 25 bp, Homo sapien
acaaagcttttggtagccgattcca

SEQ ID NO: 308916 - DNA, 25 bp, Homo sapien
gtagccgattccaagcgagggattt

SEQ ID NO: 308917 - DNA, 25 bp, Homo sapien
atttaatccttacatttttgcccat

SEQ ID NO: 308918 - DNA, 25 bp, Homo sapien
gtggagcccgcccacgaggagcaca

SEQ ID NO: 308919 - DNA, 25 bp, Homo sapien
gaagatcttcttgagttgcgcccgg

SEQ ID NO: 308920 - DNA, 25 bp, Homo sapien
atcttcttgagttgcgcccgggagc

SEQ ID NO: 308921 - DNA, 25 bp, Homo sapien
gttgcgcccgggagcacgtccagca

SEQ ID NO: 308922 - DNA, 25 bp, Homo sapien
gaataaaaagttccagttggtggca

SEQ ID NO: 308923 - DNA, 25 bp, Homo sapien
tccactttggtaagggtcaggaccg

SEQ ID NO: 308924 - DNA, 25 bp, Homo sapien
gtgaagggcgcgtcgaacttcctga

SEQ ID NO: 308925 - DNA, 25 bp, Homo sapien
agggcgcgtcgaacttcctgaaggt

SEQ ID NO: 308926 - DNA, 25 bp, Homo sapien
gtcgaacttcctgaaggtcagcttg

SEQ ID NO: 308927 - DNA, 25 bp, Homo sapien
ttcctgaaggtcagcttggcgagct

SEQ ID NO: 308928 - DNA, 25 bp, Homo sapien
agcttggcgagctgcgtggagcccg

SEQ ID NO: 308929 - DNA, 25 bp, Homo sapien
aagatggtctggttccctagtggag

SEQ ID NO: 308930 - DNA, 25 bp, Homo sapien
gatagcaaagacacggtcaccctct

SEQ ID NO: 308931 - DNA, 25 bp, Homo sapien
gacacggtcaccctctttggatttg

SEQ ID NO: 308932 - DNA, 25 bp, Homo sapien
gtgtttctatcactggaaggaggat

SEQ ID NO: 308933 - DNA, 25 bp, Homo sapien
tccaaggaaatactgcccacgtcta

SEQ ID NO: 308934 - DNA, 25 bp, Homo sapien
tgcccacgtctagtgcaggagcaga

SEQ ID NO: 308935 - DNA, 25 bp, Homo sapien
gagcagaaatcgaagtcatccatca

SEQ ID NO: 308936 - DNA, 25 bp, Homo sapien
gaagtcatccatcagctagcgtgtg

SEQ ID NO: 308937 - DNA, 25 bp, Homo sapien
gcgtgtggacaagctcactattcac

SEQ ID NO: 308938 - DNA, 25 bp, Homo sapien
tattcacacaagctcagcctagctg

SEQ ID NO: 308939 - DNA, 25 bp, Homo sapien
gcctagctgagtccatacaaatcct

SEQ ID NO: 308940 - DNA, 25 bp, Homo sapien
gctgaaagcagcgtaatccccttta

SEQ ID NO: 308941 - DNA, 25 bp, Homo sapien
gaaagcagcgtaatcccctttacct

SEQ ID NO: 308942 - DNA, 25 bp, Homo sapien
atgattgctctctactcggtggtcg

SEQ ID NO: 308943 - DNA, 25 bp, Homo sapien
gctctctactcggtggtcggcaaat

SEQ ID NO: 308944 - DNA, 25 bp, Homo sapien
ctactcggtggtcggcaaatttaat

SEQ ID NO: 308945 - DNA, 25 bp, Homo sapien
tatgctgaataaatgccgtcaggcc

SEQ ID NO: 308946 - DNA, 25 bp, Homo sapien
taaatgccgtcaggccagctagtca

SEQ ID NO: 308947 - DNA, 25 bp, Homo sapien
tgccgtcaggccagctagtcaaggt

SEQ ID NO: 308948 - DNA, 25 bp, Homo sapien
aggccagctagtcaaggtgcacaac

SEQ ID NO: 308949 - DNA, 25 bp, Homo sapien
gctagtcaaggtgcacaactctttt

SEQ ID NO: 308950 - DNA, 25 bp, Homo sapien
acaactctttttgtgcgtggtgtgg

SEQ ID NO: 308951 - DNA, 25 bp, Homo sapien
aatcgcctcgtcaacatgtttgctt

SEQ ID NO: 308952 - DNA, 25 bp, Homo sapien
caccacagctgggtagtaaggactg

SEQ ID NO: 308953 - DNA, 25 bp, Homo sapien
tcaacatgtttgcttcccttcctcg

SEQ ID NO: 308954 - DNA, 25 bp, Homo sapien
ggccctttcggctgaatcccaggaa

SEQ ID NO: 308955 - DNA, 25 bp, Homo sapien
aacccgggccgcgacaggaacatgt

SEQ ID NO: 308956 - DNA, 25 bp, Homo sapien
ggccgcgacaggaacatgtccagta

SEQ ID NO: 308957 - DNA, 25 bp, Homo sapien
atgtccagtatccatcccatgtcta

SEQ ID NO: 308958 - DNA, 25 bp, Homo sapien
gaccctgggtgtccgattttttcag

SEQ ID NO: 308959 - DNA, 25 bp, Homo sapien
ttcaggtcttttacaagggactaga

SEQ ID NO: 308960 - DNA, 25 bp, Homo sapien
aagggactagagagcggcccgaatt

SEQ ID NO: 308961 - DNA, 25 bp, Homo sapien
gagagcggcccgaattctgtcactg

SEQ ID NO: 308962 - DNA, 25 bp, Homo sapien
gtctgtttaggccaggccaacacaa

SEQ ID NO: 308963 - DNA, 25 bp, Homo sapien
ggccaggccaacacaagtgacctat

SEQ ID NO: 308964 - DNA, 25 bp, Homo sapien
agtgacctatgtggattttagcatc

SEQ ID NO: 308965 - DNA, 25 bp, Homo sapien
gagagaatcctgcatctaacaattt

SEQ ID NO: 308966 - DNA, 25 bp, Homo sapien
aatttgctggtgtgtacttagctca

SEQ ID NO: 308967 - DNA, 25 bp, Homo sapien
ttagctcagatacttgattgcaact

SEQ ID NO: 308968 - DNA, 25 bp, Homo sapien
gattgcaactgtgttgggtcaacta

SEQ ID NO: 308969 - DNA, 25 bp, Homo sapien
gttgggtcaactatttctaatggga

SEQ ID NO: 308970 - DNA, 25 bp, Homo sapien
gggacttttccatttgcatgtacag

SEQ ID NO: 308971 - DNA, 25 bp, Homo sapien
tatgctgttattccttacctagaga

SEQ ID NO: 308972 - DNA, 25 bp, Homo sapien
tagagaaacaatttccctccaaagt

SEQ ID NO: 308973 - DNA, 25 bp, Homo sapien
gtgggttgctgcagcccgtgtctca

SEQ ID NO: 308974 - DNA, 25 bp, Homo sapien
ggtcaggtcaagatgtccccagttt

SEQ ID NO: 308975 - DNA, 25 bp, Homo sapien
gatgtccccagtttcttgacttctg

SEQ ID NO: 308976 - DNA, 25 bp, Homo sapien
gacttctgacctcatatgttttccc

SEQ ID NO: 308977 - DNA, 25 bp, Homo sapien
aaagatttaggctgtggttcacggc

SEQ ID NO: 308978 - DNA, 25 bp, Homo sapien
gcagctctttgcaccaatgttggct

SEQ ID NO: 308979 - DNA, 25 bp, Homo sapien
aatgttggcttgtcattggtgcggc

SEQ ID NO: 308980 - DNA, 25 bp, Homo sapien
gggacggatagcaagagccaccatt

SEQ ID NO: 308981 - DNA, 25 bp, Homo sapien
caccattaatgagggcagggcgatc

SEQ ID NO: 308982 - DNA, 25 bp, Homo sapien
agggcgatccttgaagatcctggtt

SEQ ID NO: 308983 - DNA, 25 bp, Homo sapien
aagatcctggttcaggcctctgggc

SEQ ID NO: 308984 - DNA, 25 bp, Homo sapien
ctccacgaccaatctatttatcttc

SEQ ID NO: 308985 - DNA, 25 bp, Homo sapien
atttatcttctctggaacttcttgt

SEQ ID NO: 308986 - DNA, 25 bp, Homo sapien
gaacttcttgtaatgccgggagtgc

SEQ ID NO: 308987 - DNA, 25 bp, Homo sapien
gccgggagtgcagagcttacaagtt

SEQ ID NO: 308988 - DNA, 25 bp, Homo sapien
gaggctctttccttgtaagtgggtc

SEQ ID NO: 308989 - DNA, 25 bp, Homo sapien
tgtaagtgggtctctccccaggagc

SEQ ID NO: 308990 - DNA, 25 bp, Homo sapien
agcagggacttttacccatgctggg

SEQ ID NO: 308991 - DNA, 25 bp, Homo sapien
tgccctcctacttagactgggatct

SEQ ID NO: 308992 - DNA, 25 bp, Homo sapien
agactgggatctggtttccctcagc

SEQ ID NO: 308993 - DNA, 25 bp, Homo sapien
agctggttcccttgctagcgtgtga

SEQ ID NO: 308994 - DNA, 25 bp, Homo sapien
cttgctagcgtgtgactctgtgtgt

SEQ ID NO: 308995 - DNA, 25 bp, Homo sapien
ggaaccaaccagtggtgcctttgga

SEQ ID NO: 308996 - DNA, 25 bp, Homo sapien
gaaatcttggtttatgcttcctctc

SEQ ID NO: 308997 - DNA, 25 bp, Homo sapien
ttatgcttcctctctgacagtagga

SEQ ID NO: 308998 - DNA, 25 bp, Homo sapien
gctattgtgggagtttctcctgcca

SEQ ID NO: 308999 - DNA, 25 bp, Homo sapien
tgtgggagtttctcctgccatgtag

SEQ ID NO: 309000 - DNA, 25 bp, Homo sapien
tcctgccatgtagagtgatggaaga

SEQ ID NO: 309001 - DNA, 25 bp, Homo sapien
agctgtttaaggaaagaatctggtc

SEQ ID NO: 309002 - DNA, 25 bp, Homo sapien
gaatctggtcatatgacctcctttc

SEQ ID NO: 309003 - DNA, 25 bp, Homo sapien
tggtcatatgacctcctttctgcaa

SEQ ID NO: 309004 - DNA, 25 bp, Homo sapien
ttctgcaattggaaatgaacgccac

SEQ ID NO: 309005 - DNA, 25 bp, Homo sapien
ggaaatgaacgccacagggaaaaga

SEQ ID NO: 309006 - DNA, 25 bp, Homo sapien
gttgccctgtgctacggcacaacga

SEQ ID NO: 309007 - DNA, 25 bp, Homo sapien
tgctacggcacaacgattttcactt

SEQ ID NO: 309008 - DNA, 25 bp, Homo sapien
acggcacaacgattttcacttacat

SEQ ID NO: 309009 - DNA, 25 bp, Homo sapien
tggtccctcagtccttcaagagaag

SEQ ID NO: 309010 - DNA, 25 bp, Homo sapien
gtccttcaagagaagctgatctctg

SEQ ID NO: 309011 - DNA, 25 bp, Homo sapien
cttctatgccattgttatgcctctg

SEQ ID NO: 309012 - DNA, 25 bp, Homo sapien
atgccattgttatgcctctgctgaa

SEQ ID NO: 309013 - DNA, 25 bp, Homo sapien
ttatgcctctgctgaaccctgtgat

SEQ ID NO: 309014 - DNA, 25 bp, Homo sapien
ctctgctgaaccctgtgatttatag

SEQ ID NO: 309015 - DNA, 25 bp, Homo sapien
tgaaccctgtgatttatagtctaag

SEQ ID NO: 309016 - DNA, 25 bp, Homo sapien
gggcctggcataaactattagagaa

SEQ ID NO: 309017 - DNA, 25 bp, Homo sapien
tcagccattataattgattttcaaa

SEQ ID NO: 309018 - DNA, 25 bp, Homo sapien
aatttagtttcttaagcttcatgga

SEQ ID NO: 309019 - DNA, 25 bp, Homo sapien
gtttcttaagcttcatggattcaaa

SEQ ID NO: 309020 - DNA, 25 bp, Homo sapien
gcttcatggattcaaattgagtgcc

SEQ ID NO: 309021 - DNA, 25 bp, Homo sapien
ttgagtgccatttggattttgaggc

SEQ ID NO: 309022 - DNA, 25 bp, Homo sapien
ttgaggcccctcagtggaaataatt

SEQ ID NO: 309023 - DNA, 25 bp, Homo sapien
gtgcaaattcactgacctactttct

SEQ ID NO: 309024 - DNA, 25 bp, Homo sapien
actgacctactttctgtgcttctgg

SEQ ID NO: 309025 - DNA, 25 bp, Homo sapien
tctgtgcttctggaaatgctgaatc

SEQ ID NO: 309026 - DNA, 25 bp, Homo sapien
ggaaatgctgaatcgaataatcttt

SEQ ID NO: 309027 - DNA, 25 bp, Homo sapien
tttttcctcccaataatccctctga

SEQ ID NO: 309028 - DNA, 25 bp, Homo sapien
acctgaggcgaagctggctcttctt

SEQ ID NO: 309029 - DNA, 25 bp, Homo sapien
gcatgctccctttgtgcttccttta

SEQ ID NO: 309030 - DNA, 25 bp, Homo sapien
ttcctttagaccatagtgagcccct

SEQ ID NO: 309031 - DNA, 25 bp, Homo sapien
tagtgagcccctaaggttatttagt

SEQ ID NO: 309032 - DNA, 25 bp, Homo sapien
tttactttcctaagaggccagccca

SEQ ID NO: 309033 - DNA, 25 bp, Homo sapien
gaggccagcccaggatctggttaaa

SEQ ID NO: 309034 - DNA, 25 bp, Homo sapien
gatctggttaaagaaggtctcccta

SEQ ID NO: 309035 - DNA, 25 bp, Homo sapien
taaagaaggtctccctaaacatcgg

SEQ ID NO: 309036 - DNA, 25 bp, Homo sapien
tggttatcttggtgagcagtccctt

SEQ ID NO: 309037 - DNA, 25 bp, Homo sapien
aaatccagcttcagattgcaaacct

SEQ ID NO: 309038 - DNA, 25 bp, Homo sapien
agcttcagattgcaaaccttccctc

SEQ ID NO: 309039 - DNA, 25 bp, Homo sapien
ggacctagcaaagccactgttaaag

SEQ ID NO: 309040 - DNA, 25 bp, Homo sapien
gcaaagccactgttaaagctatgca

SEQ ID NO: 309041 - DNA, 25 bp, Homo sapien
gccactgttaaagctatgcaagaag

SEQ ID NO: 309042 - DNA, 25 bp, Homo sapien
gttaaagctatgcaagaagctctgg

SEQ ID NO: 309043 - DNA, 25 bp, Homo sapien
aagaagctctggctaagcttaaaga

SEQ ID NO: 309044 - DNA, 25 bp, Homo sapien
agctctggctaagcttaaagaggaa

SEQ ID NO: 309045 - DNA, 25 bp, Homo sapien
gaacgtataaaacggcttgaagaat

SEQ ID NO: 309046 - DNA, 25 bp, Homo sapien
gaagaattagaagccaagcgtaaag

SEQ ID NO: 309047 - DNA, 25 bp, Homo sapien
taaagaagaggaacgattggaacaa

SEQ ID NO: 309048 - DNA, 25 bp, Homo sapien
aaaaaggacctagcaaagccactgt

SEQ ID NO: 309049 - DNA, 25 bp, Homo sapien
aaggacctagcaaagccactgttaa

SEQ ID NO: 309050 - DNA, 25 bp, Homo sapien
ttctcttcacattttccctcagaga

SEQ ID NO: 309051 - DNA, 25 bp, Homo sapien
aaccacacgtggtagtcttgtttgc

SEQ ID NO: 309052 - DNA, 25 bp, Homo sapien
aaggtcatgtttgatctgtcccaga

SEQ ID NO: 309053 - DNA, 25 bp, Homo sapien
gatctgtcccagacgagtcgcatat

SEQ ID NO: 309054 - DNA, 25 bp, Homo sapien
cgagtcgcatatttcctgtagctgg

SEQ ID NO: 309055 - DNA, 25 bp, Homo sapien
gtagctggagtgttgctcaccataa

SEQ ID NO: 309056 - DNA, 25 bp, Homo sapien
tccagctgtacaactgaccagtgag

SEQ ID NO: 309057 - DNA, 25 bp, Homo sapien
gagttatctgtcatcactgttgccc

SEQ ID NO: 309058 - DNA, 25 bp, Homo sapien
gtccttccttgtgtagtttcatcat

SEQ ID NO: 309059 - DNA, 25 bp, Homo sapien
cttcccacatcttgcgcaaaatgat

SEQ ID NO: 309060 - DNA, 25 bp, Homo sapien
aatgattttctgtgctcattcggca

SEQ ID NO: 309061 - DNA, 25 bp, Homo sapien
tatgtgtatgagtgttgtatatgca

SEQ ID NO: 309062 - DNA, 25 bp, Homo sapien
gtctgtatgtgtgtacaactaaaga

SEQ ID NO: 309063 - DNA, 25 bp, Homo sapien
aaaggtttgtactgtctgagtgcac

SEQ ID NO: 309064 - DNA, 25 bp, Homo sapien
gtttgtactgtctgagtgcacagct

SEQ ID NO: 309065 - DNA, 25 bp, Homo sapien
gtactgtctgagtgcacagctactg

SEQ ID NO: 309066 - DNA, 25 bp, Homo sapien
gtctgagtgcacagctactggaata

SEQ ID NO: 309067 - DNA, 25 bp, Homo sapien
gcacagctactggaataaatttagg

SEQ ID NO: 309068 - DNA, 25 bp, Homo sapien
aatttagggaatctcaggaacaagc

SEQ ID NO: 309069 - DNA, 25 bp, Homo sapien
ttagggaatctcaggaacaagcata

SEQ ID NO: 309070 - DNA, 25 bp, Homo sapien
ttcttctcagaagtgtaagtgcagt

SEQ ID NO: 309071 - DNA, 25 bp, Homo sapien
gtaagtgcagtttttaattctgtat

SEQ ID NO: 309072 - DNA, 25 bp, Homo sapien
gttgagaatcttcgacggcaagcct

SEQ ID NO: 309073 - DNA, 25 bp, Homo sapien
aatcttcgacggcaagcctgtcttg

SEQ ID NO: 309074 - DNA, 25 bp, Homo sapien
caagcctgtcttgttgctgttgaga

SEQ ID NO: 309075 - DNA, 25 bp, Homo sapien
tgctgttgagaatgcgtggcgcaaa

SEQ ID NO: 309076 - DNA, 25 bp, Homo sapien
gtggcgcaaagctcaagaagtctgt

SEQ ID NO: 309077 - DNA, 25 bp, Homo sapien
gaagtctgtaaccttgttggccaaa

SEQ ID NO: 309078 - DNA, 25 bp, Homo sapien
tgtaaccttgttggccaaaccttag

SEQ ID NO: 309079 - DNA, 25 bp, Homo sapien
ggaaggccaaatagatgatcaccag

SEQ ID NO: 309080 - DNA, 25 bp, Homo sapien
aaatagatgatcaccagtcatccag

SEQ ID NO: 309081 - DNA, 25 bp, Homo sapien
agtcatccagactctcaagttcatt

SEQ ID NO: 309082 - DNA, 25 bp, Homo sapien
atccagactctcaagttcattaact

SEQ ID NO: 309083 - DNA, 25 bp, Homo sapien
tctctcctgtctattcatcagctag

SEQ ID NO: 309084 - DNA, 25 bp, Homo sapien
attcatcagctaggctgaagctcct

SEQ ID NO: 309085 - DNA, 25 bp, Homo sapien
ttgctgctccagaaaggtcgaagat

SEQ ID NO: 309086 - DNA, 25 bp, Homo sapien
ccagaaaggtcgaagatggcagttt

SEQ ID NO: 309087 - DNA, 25 bp, Homo sapien
tggcagttttcccaaactccggctt

SEQ ID NO: 309088 - DNA, 25 bp, Homo sapien
aaactccggcttgcccagatgtctg

SEQ ID NO: 309089 - DNA, 25 bp, Homo sapien
agctgcccaagctggtttcagatag

SEQ ID NO: 309090 - DNA, 25 bp, Homo sapien
gtttcagataggtctctctctctgg

SEQ ID NO: 309091 - DNA, 25 bp, Homo sapien
tggagcccaaccacttcggcacatg

SEQ ID NO: 309092 - DNA, 25 bp, Homo sapien
accacttcggcacatgttcacagga

SEQ ID NO: 309093 - DNA, 25 bp, Homo sapien
tgtgtcacaagccactgggcactca

SEQ ID NO: 309094 - DNA, 25 bp, Homo sapien
tgcgggacaacatcctgcccgagct

SEQ ID NO: 309095 - DNA, 25 bp, Homo sapien
ggacaacatcctgcccgagcttggg

SEQ ID NO: 309096 - DNA, 25 bp, Homo sapien
gtgcggtttgaagaccacgaaggac

SEQ ID NO: 309097 - DNA, 25 bp, Homo sapien
gtttgaagaccacgaaggactgccc

SEQ ID NO: 309098 - DNA, 25 bp, Homo sapien
ttgaagaccacgaaggactgcccac

SEQ ID NO: 309099 - DNA, 25 bp, Homo sapien
gaagaccacgaaggactgcccacag

SEQ ID NO: 309100 - DNA, 25 bp, Homo sapien
tggccaagatgaagattccccccag

SEQ ID NO: 309101 - DNA, 25 bp, Homo sapien
gattccccccagtgagatgttcttg

SEQ ID NO: 309102 - DNA, 25 bp, Homo sapien
gttcttgtcagaaaccgacaaatac

SEQ ID NO: 309103 - DNA, 25 bp, Homo sapien
tcagaaaccgacaaatactccaagt

SEQ ID NO: 309104 - DNA, 25 bp, Homo sapien
aaccgacaaatactccaagtttgat

SEQ ID NO: 309105 - DNA, 25 bp, Homo sapien
aagagctattaggtcccatctggtc

SEQ ID NO: 309106 - DNA, 25 bp, Homo sapien
attattcccttcagtgtactctctc

SEQ ID NO: 309107 - DNA, 25 bp, Homo sapien
tctcgtgctttgtccaggctggtgg

SEQ ID NO: 309108 - DNA, 25 bp, Homo sapien
ggagatggcattctttgcagtgatt

SEQ ID NO: 309109 - DNA, 25 bp, Homo sapien
gtgatttccacaacactgtagacgt

SEQ ID NO: 309110 - DNA, 25 bp, Homo sapien
acgtaatcttgtggctggtgtcaat

SEQ ID NO: 309111 - DNA, 25 bp, Homo sapien
tggtgtcaatttggccttcagcatg

SEQ ID NO: 309112 - DNA, 25 bp, Homo sapien
gcatggagtttttatttcacatact

SEQ ID NO: 309113 - DNA, 25 bp, Homo sapien
agagcctcttggcagaaatgagaaa

SEQ ID NO: 309114 - DNA, 25 bp, Homo sapien
gtttgtcagtttgcatgtcaactag

SEQ ID NO: 309115 - DNA, 25 bp, Homo sapien
atgtcaactaggacgagctgggcac

SEQ ID NO: 309116 - DNA, 25 bp, Homo sapien
aactttcaaaaagactctggatgat

SEQ ID NO: 309117 - DNA, 25 bp, Homo sapien
tcaaaaagactctggatgatggctt

SEQ ID NO: 309118 - DNA, 25 bp, Homo sapien
aaaaagactctggatgatggctttt

SEQ ID NO: 309119 - DNA, 25 bp, Homo sapien
tggcttttttcccttcatcatcctg

SEQ ID NO: 309120 - DNA, 25 bp, Homo sapien
ggcttttttcccttcatcatcctgg

SEQ ID NO: 309121 - DNA, 25 bp, Homo sapien
ggatgccatcaatgacagagttagg

SEQ ID NO: 309122 - DNA, 25 bp, Homo sapien
gccatcaatgacagagttaggcatt

SEQ ID NO: 309123 - DNA, 25 bp, Homo sapien
aatgacagagttaggcattttgacc

SEQ ID NO: 309124 - DNA, 25 bp, Homo sapien
ggagtgcagcaaaaaccaagggatt

SEQ ID NO: 309125 - DNA, 25 bp, Homo sapien
gtgcagcaaaaaccaagggatttga

SEQ ID NO: 309126 - DNA, 25 bp, Homo sapien
ggatttgaggtatatttggctgaaa

SEQ ID NO: 309127 - DNA, 25 bp, Homo sapien
gaatgtaagacccagaatttatccc

SEQ ID NO: 309128 - DNA, 25 bp, Homo sapien
atgtaagacccagaatttatccctt

SEQ ID NO: 309129 - DNA, 25 bp, Homo sapien
gtaagacccagaatttatccctttg

SEQ ID NO: 309130 - DNA, 25 bp, Homo sapien
tggcctttttaatagcaggatggaa

SEQ ID NO: 309131 - DNA, 25 bp, Homo sapien
tttaatagcaggatggaattgattc

SEQ ID NO: 309132 - DNA, 25 bp, Homo sapien
taaaggttgaggtgttgtttttgca

SEQ ID NO: 309133 - DNA, 25 bp, Homo sapien
gtttccaatgaaatttcattactct

SEQ ID NO: 309134 - DNA, 25 bp, Homo sapien
atttcattactctgacctcttctaa

SEQ ID NO: 309135 - DNA, 25 bp, Homo sapien
ttactctgacctcttctaatttttg

SEQ ID NO: 309136 - DNA, 25 bp, Homo sapien
tgacctcttctaatttttggtcttc

SEQ ID NO: 309137 - DNA, 25 bp, Homo sapien
tggtcttctttatatttacatgtct

SEQ ID NO: 309138 - DNA, 25 bp, Homo sapien
ctactagacttaaagaaattctggc

SEQ ID NO: 309139 - DNA, 25 bp, Homo sapien
tactagacttaaagaaattctggcc

SEQ ID NO: 309140 - DNA, 25 bp, Homo sapien
actagacttaaagaaattctggccg

SEQ ID NO: 309141 - DNA, 25 bp, Homo sapien
ctagacttaaagaaattctggccgg

SEQ ID NO: 309142 - DNA, 25 bp, Homo sapien
tagacttaaagaaattctggccggg

SEQ ID NO: 309143 - DNA, 25 bp, Homo sapien
gacttaaagaaattctggccgggtg

SEQ ID NO: 309144 - DNA, 25 bp, Homo sapien
cttaaagaaattctggccgggtgcg

SEQ ID NO: 309145 - DNA, 25 bp, Homo sapien
ttaaagaaattctggccgggtgcgg

SEQ ID NO: 309146 - DNA, 25 bp, Homo sapien
taaagaaattctggccgggtgcggt

SEQ ID NO: 309147 - DNA, 25 bp, Homo sapien
aaagaaattctggccgggtgcggtg

SEQ ID NO: 309148 - DNA, 25 bp, Homo sapien
aagaaattctggccgggtgcggtgg

SEQ ID NO: 309149 - DNA, 25 bp, Homo sapien
atatgctacagtttaaccgttctac

SEQ ID NO: 309150 - DNA, 25 bp, Homo sapien
gtttaaccgttctaccattgatggg

SEQ ID NO: 309151 - DNA, 25 bp, Homo sapien
cattgatgggcacttgggtcgtttc

SEQ ID NO: 309152 - DNA, 25 bp, Homo sapien
tgggtcgtttccaggttggaaccat

SEQ ID NO: 309153 - DNA, 25 bp, Homo sapien
tggcttctttcatgcaacataatat

SEQ ID NO: 309154 - DNA, 25 bp, Homo sapien
gcgcctgcccctttaaaaacagatt

SEQ ID NO: 309155 - DNA, 25 bp, Homo sapien
aaacagattatctcattctctcgct

SEQ ID NO: 309156 - DNA, 25 bp, Homo sapien
attggatggactcatccatgtcact

SEQ ID NO: 309157 - DNA, 25 bp, Homo sapien
atccatgtcactgtgtaccaatagt

SEQ ID NO: 309158 - DNA, 25 bp, Homo sapien
gtgtaccaatagtttcttttcttat

SEQ ID NO: 309159 - DNA, 25 bp, Homo sapien
cttttcttattgctgggtagattcc

SEQ ID NO: 309160 - DNA, 25 bp, Homo sapien
gaaaaagaatgtaagacccagaatt

SEQ ID NO: 309161 - DNA, 25 bp, Homo sapien
gaatgtaagacccagaatttatccc

SEQ ID NO: 309162 - DNA, 25 bp, Homo sapien
aatgtaagacccagaatttatccct

SEQ ID NO: 309163 - DNA, 25 bp, Homo sapien
tgtaagacccagaatttatcccttt

SEQ ID NO: 309164 - DNA, 25 bp, Homo sapien
gtaagacccagaatttatccctttg

SEQ ID NO: 309165 - DNA, 25 bp, Homo sapien
tggcctttttaatagcaggatggaa

SEQ ID NO: 309166 - DNA, 25 bp, Homo sapien
ggcctttttaatagcaggatggaat

SEQ ID NO: 309167 - DNA, 25 bp, Homo sapien
tttaatagcaggatggaattgattc

SEQ ID NO: 309168 - DNA, 25 bp, Homo sapien
taaaggttgaggtgttgtttttgca

SEQ ID NO: 309169 - DNA, 25 bp, Homo sapien
tgaggaaaggtttccaatgaaattt

SEQ ID NO: 309170 - DNA, 25 bp, Homo sapien
tttccaatgaaatttcattactctg

SEQ ID NO: 309171 - DNA, 25 bp, Homo sapien
aagtcggtcccatctggagccagga

SEQ ID NO: 309172 - DNA, 25 bp, Homo sapien
cataaatgggttttgcctgcgtcag

SEQ ID NO: 309173 - DNA, 25 bp, Homo sapien
gtcaggtcctcgtcgttgagcagat

SEQ ID NO: 309174 - DNA, 25 bp, Homo sapien
tcgtcgttgagcagatgcgactcgc

SEQ ID NO: 309175 - DNA, 25 bp, Homo sapien
gcagttctgacacttgctcttgttg

SEQ ID NO: 309176 - DNA, 25 bp, Homo sapien
tcttgttgaagatgttggcctggaa

SEQ ID NO: 309177 - DNA, 25 bp, Homo sapien
tggcctggaatttcctgcacgggtt

SEQ ID NO: 309178 - DNA, 25 bp, Homo sapien
aaaggatgaagaaccgtcgctgcca

SEQ ID NO: 309179 - DNA, 25 bp, Homo sapien
gtcgctgccatttccgagaccggtg

SEQ ID NO: 309180 - DNA, 25 bp, Homo sapien
agaccggtgcactgggttgtcaaag

SEQ ID NO: 309181 - DNA, 25 bp, Homo sapien
ggttgtcaaagtcggtcccatctgg

SEQ ID NO: 309182 - DNA, 25 bp, Homo sapien
tagttacatgaattaagggccagaa

SEQ ID NO: 309183 - DNA, 25 bp, Homo sapien
ttacccaaatactcaatttactaat

SEQ ID NO: 309184 - DNA, 25 bp, Homo sapien
actaatttattcttcactgaggatt

SEQ ID NO: 309185 - DNA, 25 bp, Homo sapien
tattcttcactgaggatttctgatc

SEQ ID NO: 309186 - DNA, 25 bp, Homo sapien
ttcactgaggatttctgatctgatt

SEQ ID NO: 309187 - DNA, 25 bp, Homo sapien
ggatttctgatctgattttttattc

SEQ ID NO: 309188 - DNA, 25 bp, Homo sapien
tattcaacaaaccttaaacacccag

SEQ ID NO: 309189 - DNA, 25 bp, Homo sapien
accttaaacacccagaagcagtaat

SEQ ID NO: 309190 - DNA, 25 bp, Homo sapien
gaagcagtaataatcatcgaggtat

SEQ ID NO: 309191 - DNA, 25 bp, Homo sapien
aatcatcgaggtatgtttatattta

SEQ ID NO: 309192 - DNA, 25 bp, Homo sapien
taagtcttggtaacaaataacctat

SEQ ID NO: 309193 - DNA, 25 bp, Homo sapien
taaatcctcacctgccctttgaaga

SEQ ID NO: 309194 - DNA, 25 bp, Homo sapien
ctcacctgccctttgaagagccaat

SEQ ID NO: 309195 - DNA, 25 bp, Homo sapien
gccaataagggcatctttgtcttta

SEQ ID NO: 309196 - DNA, 25 bp, Homo sapien
gcaaatgttattcagattttgtact

SEQ ID NO: 309197 - DNA, 25 bp, Homo sapien
tgtacttgtctatctgtttacctca

SEQ ID NO: 309198 - DNA, 25 bp, Homo sapien
tctgtttacctcagtgtagatgata

SEQ ID NO: 309199 - DNA, 25 bp, Homo sapien
gttgttattactagttcagtcccaa

SEQ ID NO: 309200 - DNA, 25 bp, Homo sapien
tattactagttcagtcccaaactta

SEQ ID NO: 309201 - DNA, 25 bp, Homo sapien
taccctttccttttcagagagctaa

SEQ ID NO: 309202 - DNA, 25 bp, Homo sapien
ttcagagagctaatggccatgcttt

SEQ ID NO: 309203 - DNA, 25 bp, Homo sapien
tttgaatgaagtgggatacttgcat

SEQ ID NO: 309204 - DNA, 25 bp, Homo sapien
tagctgtctttccaccatatgaggg

SEQ ID NO: 309205 - DNA, 25 bp, Homo sapien
gtctttccaccatatgagggtgcaa

SEQ ID NO: 309206 - DNA, 25 bp, Homo sapien
gcaatgggaagctggcagtctgcaa

SEQ ID NO: 309207 - DNA, 25 bp, Homo sapien
ggaagctggcagtctgcaaccagaa

SEQ ID NO: 309208 - DNA, 25 bp, Homo sapien
gtctgcaaccagaagaggaccctca

SEQ ID NO: 309209 - DNA, 25 bp, Homo sapien
accgttctagcaccgtgaactcaga

SEQ ID NO: 309210 - DNA, 25 bp, Homo sapien
gtgaactcagacttcagtctccaga

SEQ ID NO: 309211 - DNA, 25 bp, Homo sapien
atgtcacccagtttatagtactttg

SEQ ID NO: 309212 - DNA, 25 bp, Homo sapien
atagtactttgttatagaagctcaa

SEQ ID NO: 309213 - DNA, 25 bp, Homo sapien
aagaagagaccagagagctagctag

SEQ ID NO: 309214 - DNA, 25 bp, Homo sapien
gagagctagctagctgtctttccac

SEQ ID NO: 309215 - DNA, 25 bp, Homo sapien
atctttcaagggacctctccatgat

SEQ ID NO: 309216 - DNA, 25 bp, Homo sapien
ggcaggcatcgccattcttgctgaa

SEQ ID NO: 309217 - DNA, 25 bp, Homo sapien
gctgaaccgtttgtgattgccattt

SEQ ID NO: 309218 - DNA, 25 bp, Homo sapien
attgccatttgagctctggaagcct

SEQ ID NO: 309219 - DNA, 25 bp, Homo sapien
tctggaagcctctattgccatgaga

SEQ ID NO: 309220 - DNA, 25 bp, Homo sapien
gccatgagagttctgtcacggtcac

SEQ ID NO: 309221 - DNA, 25 bp, Homo sapien
gttctgtcacggtcactttactgtc

SEQ ID NO: 309222 - DNA, 25 bp, Homo sapien
tccaggttcctgagccctactgtgt

SEQ ID NO: 309223 - DNA, 25 bp, Homo sapien
tactgtgtctcaggtgtgccctgaa

SEQ ID NO: 309224 - DNA, 25 bp, Homo sapien
cagggcttgtgtgcacatatcctta

SEQ ID NO: 309225 - DNA, 25 bp, Homo sapien
atatccttagcccatctttcaaggg

SEQ ID NO: 309226 - DNA, 25 bp, Homo sapien
tattaacgctgcccgtctcccttat

SEQ ID NO: 309227 - DNA, 25 bp, Homo sapien
gtctcccttataacctggacgtgag

SEQ ID NO: 309228 - DNA, 25 bp, Homo sapien
cccttataacctggacgtgagctgt

SEQ ID NO: 309229 - DNA, 25 bp, Homo sapien
cttataacctggacgtgagctgtca

SEQ ID NO: 309230 - DNA, 25 bp, Homo sapien
tataacctggacgtgagctgtcaga

SEQ ID NO: 309231 - DNA, 25 bp, Homo sapien
taacctggacgtgagctgtcagagc

SEQ ID NO: 309232 - DNA, 25 bp, Homo sapien
aggctcagaccctgctgtggttggc

SEQ ID NO: 309233 - DNA, 25 bp, Homo sapien
tcagaccctgctgtggttggcttgg

SEQ ID NO: 309234 - DNA, 25 bp, Homo sapien
gccacctggccaatgtgcatttttg

SEQ ID NO: 309235 - DNA, 25 bp, Homo sapien
cacctggccaatgtgcatttttgca

SEQ ID NO: 309236 - DNA, 25 bp, Homo sapien
acctggccaatgtgcatttttgcac

SEQ ID NO: 309237 - DNA, 25 bp, Homo sapien
gacacagggcgggagggtgccgaga

SEQ ID NO: 309238 - DNA, 25 bp, Homo sapien
ccagcattgggctccagcagatgca

SEQ ID NO: 309239 - DNA, 25 bp, Homo sapien
attgggctccagcagatgcacgaca

SEQ ID NO: 309240 - DNA, 25 bp, Homo sapien
agcagatgcacgacaccaccatgat

SEQ ID NO: 309241 - DNA, 25 bp, Homo sapien
atgcacgacaccaccatgataccga

SEQ ID NO: 309242 - DNA, 25 bp, Homo sapien
acaccaccatgataccgacaagctg

SEQ ID NO: 309243 - DNA, 25 bp, Homo sapien
atgataccgacaagctggcccacca

SEQ ID NO: 309244 - DNA, 25 bp, Homo sapien
accatctccacgtcgtgggcgcgag

SEQ ID NO: 309245 - DNA, 25 bp, Homo sapien
gtgggcgcgagctctgcgtgccgag

SEQ ID NO: 309246 - DNA, 25 bp, Homo sapien
tgctccgagagccgccaaagaaggt

SEQ ID NO: 309247 - DNA, 25 bp, Homo sapien
aggtggaggccgaagcgatggacga

SEQ ID NO: 309248 - DNA, 25 bp, Homo sapien
ccctattttatttctggtgtgattt

SEQ ID NO: 309249 - DNA, 25 bp, Homo sapien
ttctggtgtgatttctctgtcttac

SEQ ID NO: 309250 - DNA, 25 bp, Homo sapien
tgatttctctgtcttaccttctaaa

SEQ ID NO: 309251 - DNA, 25 bp, Homo sapien
ctctgtcttaccttctaaatgagaa

SEQ ID NO: 309252 - DNA, 25 bp, Homo sapien
gtcagattctatagtttcctagata

SEQ ID NO: 309253 - DNA, 25 bp, Homo sapien
taaccaaattgctctatgtattatt

SEQ ID NO: 309254 - DNA, 25 bp, Homo sapien
aatacttcagaactggcttcttttc

SEQ ID NO: 309255 - DNA, 25 bp, Homo sapien
tcttttctcaaactcccactgtggg

SEQ ID NO: 309256 - DNA, 25 bp, Homo sapien
tgtagaatctctatgctcatgtact

SEQ ID NO: 309257 - DNA, 25 bp, Homo sapien
atgctcatgtactgtaaatagtgaa

SEQ ID NO: 309258 - DNA, 25 bp, Homo sapien
aatagtgaagtgatctgcttataaa

SEQ ID NO: 309259 - DNA, 25 bp, Homo sapien
agctccttctatttctgcagccaag

SEQ ID NO: 309260 - DNA, 25 bp, Homo sapien
gcagccaaggcatcaagatcaatgt

SEQ ID NO: 309261 - DNA, 25 bp, Homo sapien
gatcaatgtcatccttggtgctgtc

SEQ ID NO: 309262 - DNA, 25 bp, Homo sapien
gtgctgtcttcgctcttgtttttct

SEQ ID NO: 309263 - DNA, 25 bp, Homo sapien
tgtttcttccccattgcttgtcaat

SEQ ID NO: 309264 - DNA, 25 bp, Homo sapien
attgcttgtcaatggcgctcgtggc

SEQ ID NO: 309265 - DNA, 25 bp, Homo sapien
actgtctcccggctgactttggtct

SEQ ID NO: 309266 - DNA, 25 bp, Homo sapien
tgactttggtctccgctcagctctt

SEQ ID NO: 309267 - DNA, 25 bp, Homo sapien
agacccgcgcactggaacaggacac

SEQ ID NO: 309268 - DNA, 25 bp, Homo sapien
acatatggtgtcagttctcaggcgc

SEQ ID NO: 309269 - DNA, 25 bp, Homo sapien
tgtcagttctcaggcgcaagcgcat

SEQ ID NO: 309270 - DNA, 25 bp, Homo sapien
gaaaaagccctcaatcgaaccaaat

SEQ ID NO: 309271 - DNA, 25 bp, Homo sapien
gaacggagtcattattcctctaagg

SEQ ID NO: 309272 - DNA, 25 bp, Homo sapien
attcctctaaggtggttcgctttga

SEQ ID NO: 309273 - DNA, 25 bp, Homo sapien
ttcgctttgaggtggtctgaagcca

SEQ ID NO: 309274 - DNA, 25 bp, Homo sapien
tggtctgaagccaaggcctcgcgga

SEQ ID NO: 309275 - DNA, 25 bp, Homo sapien
ctcgcggagcttctttgtgtgtcac

SEQ ID NO: 309276 - DNA, 25 bp, Homo sapien
tgtgtgtcaccttgcttccacgttt

SEQ ID NO: 309277 - DNA, 25 bp, Homo sapien
ttccacgtttcagttcttgttttgt

SEQ ID NO: 309278 - DNA, 25 bp, Homo sapien
cttgttttgtttctactgctttagt

SEQ ID NO: 309279 - DNA, 25 bp, Homo sapien
cataggttttgtggtcggacagact

SEQ ID NO: 309280 - DNA, 25 bp, Homo sapien
tcggacagactgattgggagaagat

SEQ ID NO: 309281 - DNA, 25 bp, Homo sapien
gtaaatggttagtattcatacctct

SEQ ID NO: 309282 - DNA, 25 bp, Homo sapien
gtattcatacctcttaagcattttt

SEQ ID NO: 309283 - DNA, 25 bp, Homo sapien
tcttaagcatttttactgtaactct

SEQ ID NO: 309284 - DNA, 25 bp, Homo sapien
gtaactcttcatcagatctcaacta

SEQ ID NO: 309285 - DNA, 25 bp, Homo sapien
tcttcatcagatctcaactacaaag

SEQ ID NO: 309286 - DNA, 25 bp, Homo sapien
gggtagattcatcttcttccaaagt

SEQ ID NO: 309287 - DNA, 25 bp, Homo sapien
tttagagagagcctgccatgtgtca

SEQ ID NO: 309288 - DNA, 25 bp, Homo sapien
ccatgtgtcaggtactgttgaggat

SEQ ID NO: 309289 - DNA, 25 bp, Homo sapien
tcttcttccaaagtatatggactgt

SEQ ID NO: 309290 - DNA, 25 bp, Homo sapien
ggagggcaccagaacaaaaggctgc

SEQ ID NO: 309291 - DNA, 25 bp, Homo sapien
gccatcaggaaataggaggaggtaa

SEQ ID NO: 309292 - DNA, 25 bp, Homo sapien
ttaattcatgtttgtctcgccatgc

SEQ ID NO: 309293 - DNA, 25 bp, Homo sapien
gtctcgccatgcttctttactttaa

SEQ ID NO: 309294 - DNA, 25 bp, Homo sapien
gccatgcttctttactttaacatat

SEQ ID NO: 309295 - DNA, 25 bp, Homo sapien
aacatatttcttttgcagaatgtaa

SEQ ID NO: 309296 - DNA, 25 bp, Homo sapien
gtttatataagtgtactggctgtaa

SEQ ID NO: 309297 - DNA, 25 bp, Homo sapien
gtgtactggctgtaaatgatgctaa

SEQ ID NO: 309298 - DNA, 25 bp, Homo sapien
ctggctgtaaatgatgctaaatata

SEQ ID NO: 309299 - DNA, 25 bp, Homo sapien
aaggaatgtttgcacctccacattt

SEQ ID NO: 309300 - DNA, 25 bp, Homo sapien
ctccacattttattgcttctggatg

SEQ ID NO: 309301 - DNA, 25 bp, Homo sapien
aatcatgtaattatttctgctgtta

SEQ ID NO: 309302 - DNA, 25 bp, Homo sapien
tctgctgttatataaagtgccatac

SEQ ID NO: 309303 - DNA, 25 bp, Homo sapien
aatggtgactaatgttctggaactt

SEQ ID NO: 309304 - DNA, 25 bp, Homo sapien
ctggaactttcccattaaccttctg

SEQ ID NO: 309305 - DNA, 25 bp, Homo sapien
tttcccattaaccttctgcatttag

SEQ ID NO: 309306 - DNA, 25 bp, Homo sapien
gaattatagatgttgagtgctccag

SEQ ID NO: 309307 - DNA, 25 bp, Homo sapien
gagtgctccagtaaacagtgattct

SEQ ID NO: 309308 - DNA, 25 bp, Homo sapien
acagtgattctctttatatctgatt

SEQ ID NO: 309309 - DNA, 25 bp, Homo sapien
aatgtaagtatgtatctcagagtca

SEQ ID NO: 309310 - DNA, 25 bp, Homo sapien
tatgtatctcagagtcattttgacc

SEQ ID NO: 309311 - DNA, 25 bp, Homo sapien
gagtcattttgaccattatggaagt

SEQ ID NO: 309312 - DNA, 25 bp, Homo sapien
cattatggaagttgtatctctctgt

SEQ ID NO: 309313 - DNA, 25 bp, Homo sapien
actgtgtgtgtatgttaggtgctca

SEQ ID NO: 309314 - DNA, 25 bp, Homo sapien
ttctgccctctctctgaatgaagat

SEQ ID NO: 309315 - DNA, 25 bp, Homo sapien
gggcagaggcagtgactgtccactt

SEQ ID NO: 309316 - DNA, 25 bp, Homo sapien
gaatgaagatctaccaaaacagtat

SEQ ID NO: 309317 - DNA, 25 bp, Homo sapien
cagtataactgaccaaggtttcttt

SEQ ID NO: 309318 - DNA, 25 bp, Homo sapien
gactgtccacttggtgagcttgtac

SEQ ID NO: 309319 - DNA, 25 bp, Homo sapien
ggtgagcttgtacaagtccacccac

SEQ ID NO: 309320 - DNA, 25 bp, Homo sapien
agcttgtacaagtccacccacctgt

SEQ ID NO: 309321 - DNA, 25 bp, Homo sapien
cacccacctgttctaactcaagaag

SEQ ID NO: 309322 - DNA, 25 bp, Homo sapien
ttctaactcaagaagggaccactgg

SEQ ID NO: 309323 - DNA, 25 bp, Homo sapien
gaccactggttcgagagagtattga

SEQ ID NO: 309324 - DNA, 25 bp, Homo sapien
gttcgagagagtattgagccaggcc

SEQ ID NO: 309325 - DNA, 25 bp, Homo sapien
aattgagacccttaatgttgcttta

SEQ ID NO: 309326 - DNA, 25 bp, Homo sapien
gaatattttgtctgtgatatacttt

SEQ ID NO: 309327 - DNA, 25 bp, Homo sapien
atagttctaaagtcttcactgttgc

SEQ ID NO: 309328 - DNA, 25 bp, Homo sapien
aagtcttcactgttgctactaagag

SEQ ID NO: 309329 - DNA, 25 bp, Homo sapien
gatgctataatgtcagttcactcca

SEQ ID NO: 309330 - DNA, 25 bp, Homo sapien
ataatgtcagttcactccagtccaa

SEQ ID NO: 309331 - DNA, 25 bp, Homo sapien
gttcactccagtccaatcaaatgta

SEQ ID NO: 309332 - DNA, 25 bp, Homo sapien
aaagtccttgaatagttctctaggg

SEQ ID NO: 309333 - DNA, 25 bp, Homo sapien
gttctctagggacaatttctcactt

SEQ ID NO: 309334 - DNA, 25 bp, Homo sapien
aatttctcacttgccattgacatta

SEQ ID NO: 309335 - DNA, 25 bp, Homo sapien
gccattgacattaatctttggtgta

SEQ ID NO: 309336 - DNA, 25 bp, Homo sapien
tcgcgtaagcattgttgttctgttt

SEQ ID NO: 309337 - DNA, 25 bp, Homo sapien
tgttgttctgttttgagggttattg

SEQ ID NO: 309338 - DNA, 25 bp, Homo sapien
cacagaactttagagttgggaaagc

SEQ ID NO: 309339 - DNA, 25 bp, Homo sapien
ataatcctatattgagcttcagtgg

SEQ ID NO: 309340 - DNA, 25 bp, Homo sapien
gcttcagtggagaataaaccagctg

SEQ ID NO: 309341 - DNA, 25 bp, Homo sapien
gctgagaagaactcattgccttcat

SEQ ID NO: 309342 - DNA, 25 bp, Homo sapien
gaactcattgccttcatcaatgtgt

SEQ ID NO: 309343 - DNA, 25 bp, Homo sapien
gaaagcagttggactagaagtgtat

SEQ ID NO: 309344 - DNA, 25 bp, Homo sapien
tgaaatggtaaagcctgcaaagtat

SEQ ID NO: 309345 - DNA, 25 bp, Homo sapien
gttaaggcttgtgttatttcgcgta

SEQ ID NO: 309346 - DNA, 25 bp, Homo sapien
gttatttcgcgtaagcattgttgtt

SEQ ID NO: 309347 - DNA, 25 bp, Homo sapien
gccctcagggcttggatcattcagt

SEQ ID NO: 309348 - DNA, 25 bp, Homo sapien
ggcccagaagagaagaccatcatga

SEQ ID NO: 309349 - DNA, 25 bp, Homo sapien
gctgctggcaaagaggcggaggatg

SEQ ID NO: 309350 - DNA, 25 bp, Homo sapien
atggtgttggagttctatgtgcagc

SEQ ID NO: 309351 - DNA, 25 bp, Homo sapien
ctatgtgcagcaggaatgggcagca

SEQ ID NO: 309352 - DNA, 25 bp, Homo sapien
gcatgtggtgtgtccgccagcgtta

SEQ ID NO: 309353 - DNA, 25 bp, Homo sapien
tggtgtgtccgccagcgttactgtc

SEQ ID NO: 309354 - DNA, 25 bp, Homo sapien
cagcgttactgtcgtttgctcaacg

SEQ ID NO: 309355 - DNA, 25 bp, Homo sapien
tctgcagctgttttcatccaggcct

SEQ ID NO: 309356 - DNA, 25 bp, Homo sapien
gcatgctggtgcgacgcacactgct

SEQ ID NO: 309357 - DNA, 25 bp, Homo sapien
ggtgcgacgcacactgctgcatgca

SEQ ID NO: 309358 - DNA, 25 bp, Homo sapien
gtaaagtgtgttctgttcttatctt

SEQ ID NO: 309359 - DNA, 25 bp, Homo sapien
gtgttctgttcttatctttttaatg

SEQ ID NO: 309360 - DNA, 25 bp, Homo sapien
aatgactaagctttaaacagtttat

SEQ ID NO: 309361 - DNA, 25 bp, Homo sapien
agaaaatttgatcttacgcatgaat

SEQ ID NO: 309362 - DNA, 25 bp, Homo sapien
tttgatcttacgcatgaatccatgt

SEQ ID NO: 309363 - DNA, 25 bp, Homo sapien
gatcttacgcatgaatccatgtcat

SEQ ID NO: 309364 - DNA, 25 bp, Homo sapien
tacgcatgaatccatgtcatggcca

SEQ ID NO: 309365 - DNA, 25 bp, Homo sapien
atgtcatggccagccactgtcacat

SEQ ID NO: 309366 - DNA, 25 bp, Homo sapien
tcatggccagccactgtcacatagt

SEQ ID NO: 309367 - DNA, 25 bp, Homo sapien
tggccagccactgtcacatagtggg

SEQ ID NO: 309368 - DNA, 25 bp, Homo sapien
attagggattttagcacactaaaat

SEQ ID NO: 309369 - DNA, 25 bp, Homo sapien
gcaatatgacagaaaaaccgaagtt

SEQ ID NO: 309370 - DNA, 25 bp, Homo sapien
aaaaccgaagtttcatgtatatgat

SEQ ID NO: 309371 - DNA, 25 bp, Homo sapien
gaattggccctcatgttaaacctag

SEQ ID NO: 309372 - DNA, 25 bp, Homo sapien
ggacagaattagctgcttgtgtatt

SEQ ID NO: 309373 - DNA, 25 bp, Homo sapien
tgtgtatttattcttctcctgcaac

SEQ ID NO: 309374 - DNA, 25 bp, Homo sapien
tatttattcttctcctgcaactttg

SEQ ID NO: 309375 - DNA, 25 bp, Homo sapien
tgcaactttgccacgctattttgta

SEQ ID NO: 309376 - DNA, 25 bp, Homo sapien
actttgccacgctattttgtacctc

SEQ ID NO: 309377 - DNA, 25 bp, Homo sapien
ttgtacctcccttcctaattatgat

SEQ ID NO: 309378 - DNA, 25 bp, Homo sapien
aagctttcttagagagcagtcaggc

SEQ ID NO: 309379 - DNA, 25 bp, Homo sapien
agagagcagtcaggcaatgtgtatt

SEQ ID NO: 309380 - DNA, 25 bp, Homo sapien
attcggacggagagcgcgaggactc

SEQ ID NO: 309381 - DNA, 25 bp, Homo sapien
gagagcgcgaggactcggcggctga

SEQ ID NO: 309382 - DNA, 25 bp, Homo sapien
aaatggccggagctggaccgaccat

SEQ ID NO: 309383 - DNA, 25 bp, Homo sapien
aatggccggagctggaccgaccatg

SEQ ID NO: 309384 - DNA, 25 bp, Homo sapien
tggccggagctggaccgaccatgct

SEQ ID NO: 309385 - DNA, 25 bp, Homo sapien
ggagctggaccgaccatgctgctac

SEQ ID NO: 309386 - DNA, 25 bp, Homo sapien
agctggaccgaccatgctgctacga

SEQ ID NO: 309387 - DNA, 25 bp, Homo sapien
agaatggctgttgcagtcggcgtca

SEQ ID NO: 309388 - DNA, 25 bp, Homo sapien
aatggctgttgcagtcggcgtcaga

SEQ ID NO: 309389 - DNA, 25 bp, Homo sapien
gttgcagtcggcgtcagagcagctc

SEQ ID NO: 309390 - DNA, 25 bp, Homo sapien
gcagtcggcgtcagagcagctccag

SEQ ID NO: 309391 - DNA, 25 bp, Homo sapien
tgaaataatccccataaagcagtga

SEQ ID NO: 309392 - DNA, 25 bp, Homo sapien
ggacagcatatataacatctagaaa

SEQ ID NO: 309393 - DNA, 25 bp, Homo sapien
gtaataaactctgctttctattctg

SEQ ID NO: 309394 - DNA, 25 bp, Homo sapien
attctgttgcattttcataagcctc

SEQ ID NO: 309395 - DNA, 25 bp, Homo sapien
gcattttcataagcctctaggtcat

SEQ ID NO: 309396 - DNA, 25 bp, Homo sapien
ataagcctctaggtcatgactgttt

SEQ ID NO: 309397 - DNA, 25 bp, Homo sapien
gcctctaggtcatgactgtttgcga

SEQ ID NO: 309398 - DNA, 25 bp, Homo sapien
aggtcatgactgtttgcgacattga

SEQ ID NO: 309399 - DNA, 25 bp, Homo sapien
ctgtttgcgacattgagaatactaa

SEQ ID NO: 309400 - DNA, 25 bp, Homo sapien
gaaatttcgattctgttataatgga

SEQ ID NO: 309401 - DNA, 25 bp, Homo sapien
atggaattgtccgtagggttattgt

SEQ ID NO: 309402 - DNA, 25 bp, Homo sapien
ggaactaacacaggtatgtcgagat

SEQ ID NO: 309403 - DNA, 25 bp, Homo sapien
atgtcgagatccacagagctgcgtc

SEQ ID NO: 309404 - DNA, 25 bp, Homo sapien
cgcactcgcagtagtctaacttacg

SEQ ID NO: 309405 - DNA, 25 bp, Homo sapien
gcagtagtctaacttacgttttcca

SEQ ID NO: 309406 - DNA, 25 bp, Homo sapien
atatcttctccaagggccttcccaa

SEQ ID NO: 309407 - DNA, 25 bp, Homo sapien
ttcccaacaatcagtgtgaagatga

SEQ ID NO: 309408 - DNA, 25 bp, Homo sapien
aagatgatagccagagagttacaga

SEQ ID NO: 309409 - DNA, 25 bp, Homo sapien
agagagttacagatgggcacagcca

SEQ ID NO: 309410 - DNA, 25 bp, Homo sapien
tgcctgagatgcaacaaatgccttt

SEQ ID NO: 309411 - DNA, 25 bp, Homo sapien
gcctttctaggcacaaaacacttcc

SEQ ID NO: 309412 - DNA, 25 bp, Homo sapien
tccatcatcatcatttcataccttt

SEQ ID NO: 309413 - DNA, 25 bp, Homo sapien
ataaacaccaaacttatcaccctct

SEQ ID NO: 309414 - DNA, 25 bp, Homo sapien
tctcatccaaactgctcttctttga

SEQ ID NO: 309415 - DNA, 25 bp, Homo sapien
aaactgctcttctttgagagtttcc

SEQ ID NO: 309416 - DNA, 25 bp, Homo sapien
ctcccctaactcttcacatgtaaat

SEQ ID NO: 309417 - DNA, 25 bp, Homo sapien
catgtaaatacccagccaccaagtt

SEQ ID NO: 309418 - DNA, 25 bp, Homo sapien
gccaccaagttcagttgatatcccc

SEQ ID NO: 309419 - DNA, 25 bp, Homo sapien
gttgatatccccctgcaaaattgat

SEQ ID NO: 309420 - DNA, 25 bp, Homo sapien
aaattgatttatcttggcctgtctt

SEQ ID NO: 309421 - DNA, 25 bp, Homo sapien
tggcctgtctttgctattctcctaa

SEQ ID NO: 309422 - DNA, 25 bp, Homo sapien
gctattctcctaatcaaggcagttt

SEQ ID NO: 309423 - DNA, 25 bp, Homo sapien
gcagtttcttaattttccgtccttg

SEQ ID NO: 309424 - DNA, 25 bp, Homo sapien
gccaagtcgcgcagtagccagggct

SEQ ID NO: 309425 - DNA, 25 bp, Homo sapien
gtagccagggcttgcctgcagccca

SEQ ID NO: 309426 - DNA, 25 bp, Homo sapien
tgcagcccagaacactcagacaggg

SEQ ID NO: 309427 - DNA, 25 bp, Homo sapien
gaacactcagacagggtcaggcctt

SEQ ID NO: 309428 - DNA, 25 bp, Homo sapien
gtcaggccttccagggttcacagca

SEQ ID NO: 309429 - DNA, 25 bp, Homo sapien
tccagggttcacagcacgtcccatg

SEQ ID NO: 309430 - DNA, 25 bp, Homo sapien
catgcccctatgtcctggcatctgg

SEQ ID NO: 309431 - DNA, 25 bp, Homo sapien
gacgtggagtggcttcctgccctaa

SEQ ID NO: 309432 - DNA, 25 bp, Homo sapien
acatgccagagccaagaccggcaaa

SEQ ID NO: 309433 - DNA, 25 bp, Homo sapien
tgggctgttccaaagctggagtcct

SEQ ID NO: 309434 - DNA, 25 bp, Homo sapien
gtggcagctgctttgccaagtcgcg

SEQ ID NO: 309435 - DNA, 25 bp, Homo sapien
aggcccctctgagaaatcatgtggt

SEQ ID NO: 309436 - DNA, 25 bp, Homo sapien
tcatgtggtccctggtccactcacg

SEQ ID NO: 309437 - DNA, 25 bp, Homo sapien
gcctaggccaagcttgtggcctgat

SEQ ID NO: 309438 - DNA, 25 bp, Homo sapien
ggcatggccacttggtccaggcgta

SEQ ID NO: 309439 - DNA, 25 bp, Homo sapien
ggccacttggtccaggcgtaaaatt

SEQ ID NO: 309440 - DNA, 25 bp, Homo sapien
ttcccatccagtctttccagaagtg

SEQ ID NO: 309441 - DNA, 25 bp, Homo sapien
agtctttccagaagtgtggtccctc

SEQ ID NO: 309442 - DNA, 25 bp, Homo sapien
ttccagaagtgtggtccctcccatt

SEQ ID NO: 309443 - DNA, 25 bp, Homo sapien
ttccctagggtctgtgggatgctgc

SEQ ID NO: 309444 - DNA, 25 bp, Homo sapien
gtgactttattttctgagcaggccc

SEQ ID NO: 309445 - DNA, 25 bp, Homo sapien
ttattttctgagcaggcccctctga

SEQ ID NO: 309446 - DNA, 25 bp, Homo sapien
tgcttggcttcttgacctgcggaat

SEQ ID NO: 309447 - DNA, 25 bp, Homo sapien
tgcggaatccatgaccctgttacac

SEQ ID NO: 309448 - DNA, 25 bp, Homo sapien
ctgttacacccctaagttctgggat

SEQ ID NO: 309449 - DNA, 25 bp, Homo sapien
cctaagttctgggatggttcattat

SEQ ID NO: 309450 - DNA, 25 bp, Homo sapien
ataacaacagatcaccggaccacgg

SEQ ID NO: 309451 - DNA, 25 bp, Homo sapien
ggaccacggaaattacttctcctct

SEQ ID NO: 309452 - DNA, 25 bp, Homo sapien
aaattacttctcctcttctactctt

SEQ ID NO: 309453 - DNA, 25 bp, Homo sapien
aagcccgggcaccagacgtaagtga

SEQ ID NO: 309454 - DNA, 25 bp, Homo sapien
ctcttctactctttaggctaactcg

SEQ ID NO: 309455 - DNA, 25 bp, Homo sapien
tttatataaacaactcatccccacc

SEQ ID NO: 309456 - DNA, 25 bp, Homo sapien
gatgaggcttccagatgattcctgc

SEQ ID NO: 309457 - DNA, 25 bp, Homo sapien
ccatgaactctgtgccaacaccgtg

SEQ ID NO: 309458 - DNA, 25 bp, Homo sapien
agacagggcacagcaccgagctcag

SEQ ID NO: 309459 - DNA, 25 bp, Homo sapien
tcagcgccccgcaagcaagggtaag

SEQ ID NO: 309460 - DNA, 25 bp, Homo sapien
aagcaagggtaagccatggccctga

SEQ ID NO: 309461 - DNA, 25 bp, Homo sapien
catggccctgacctggagagtagac

SEQ ID NO: 309462 - DNA, 25 bp, Homo sapien
acctggagagtagacaacgtgcttc

SEQ ID NO: 309463 - DNA, 25 bp, Homo sapien
tgtcgttgccactgcacgagcatgt

SEQ ID NO: 309464 - DNA, 25 bp, Homo sapien
gcacgagcatgtgtgcacatacata

SEQ ID NO: 309465 - DNA, 25 bp, Homo sapien
gcacatacatacacacggccttcta

SEQ ID NO: 309466 - DNA, 25 bp, Homo sapien
acacggccttctaccgtagaatcaa

SEQ ID NO: 309467 - DNA, 25 bp, Homo sapien
gtagaatcaagttcacagagacaaa

SEQ ID NO: 309468 - DNA, 25 bp, Homo sapien
gggagggaggaagcggcttgccgga

SEQ ID NO: 309469 - DNA, 25 bp, Homo sapien
aggaagcggcttgccggagagccag

SEQ ID NO: 309470 - DNA, 25 bp, Homo sapien
agcggcttgccggagagccagggcg

SEQ ID NO: 309471 - DNA, 25 bp, Homo sapien
cggcttgccggagagccagggcgca

SEQ ID NO: 309472 - DNA, 25 bp, Homo sapien
gcttgccggagagccagggcgcagt

SEQ ID NO: 309473 - DNA, 25 bp, Homo sapien
ttgccggagagccagggcgcagtgg

SEQ ID NO: 309474 - DNA, 25 bp, Homo sapien
tgccggagagccagggcgcagtggg

SEQ ID NO: 309475 - DNA, 25 bp, Homo sapien
gccggagagccagggcgcagtgggc

SEQ ID NO: 309476 - DNA, 25 bp, Homo sapien
agagccagggcgcagtgggcggcag

SEQ ID NO: 309477 - DNA, 25 bp, Homo sapien
gagccagggcgcagtgggcggcagg

SEQ ID NO: 309478 - DNA, 25 bp, Homo sapien
agccagggcgcagtgggcggcaggg

SEQ ID NO: 309479 - DNA, 25 bp, Homo sapien
gaatttaagaagtgtcatcatggtt

SEQ ID NO: 309480 - DNA, 25 bp, Homo sapien
gaagtgtcatcatggttcaaaatat

SEQ ID NO: 309481 - DNA, 25 bp, Homo sapien
aaaatgctagctggcacaatatgct

SEQ ID NO: 309482 - DNA, 25 bp, Homo sapien
aacaccttaaaatatgtgactaatc

SEQ ID NO: 309483 - DNA, 25 bp, Homo sapien
atgctagctggcacaatatgctaaa

SEQ ID NO: 309484 - DNA, 25 bp, Homo sapien
aatggcgtaatttccaaataacagg

SEQ ID NO: 309485 - DNA, 25 bp, Homo sapien
agctggcacaatatgctaaaaacag

SEQ ID NO: 309486 - DNA, 25 bp, Homo sapien
tttagttttgaggtatttactgaat

SEQ ID NO: 309487 - DNA, 25 bp, Homo sapien
tttactgaatgaaaagctacaatgt

SEQ ID NO: 309488 - DNA, 25 bp, Homo sapien
tcttaaaaataacttgatgctctaa

SEQ ID NO: 309489 - DNA, 25 bp, Homo sapien
cttgatgctctaaaaatatgaattt

SEQ ID NO: 309490 - DNA, 25 bp, Homo sapien
tttacttaacttaccataaatgcag

SEQ ID NO: 309491 - DNA, 25 bp, Homo sapien
ccataaatgcagtgtgacttttccc

SEQ ID NO: 309492 - DNA, 25 bp, Homo sapien
atgcagtgtgacttttcccacacag

SEQ ID NO: 309493 - DNA, 25 bp, Homo sapien
tggattgtgaggctcttaacttctt

SEQ ID NO: 309494 - DNA, 25 bp, Homo sapien
ggattgtgaggctcttaacttctta

SEQ ID NO: 309495 - DNA, 25 bp, Homo sapien
attgtgaggctcttaacttcttaaa

SEQ ID NO: 309496 - DNA, 25 bp, Homo sapien
tgtgaggctcttaacttcttaaaag

SEQ ID NO: 309497 - DNA, 25 bp, Homo sapien
gtgaggctcttaacttcttaaaagt

SEQ ID NO: 309498 - DNA, 25 bp, Homo sapien
gaggctcttaacttcttaaaagtat

SEQ ID NO: 309499 - DNA, 25 bp, Homo sapien
ggctcttaacttcttaaaagtatag

SEQ ID NO: 309500 - DNA, 25 bp, Homo sapien
tcctataagcagtctttatgtctct

SEQ ID NO: 309501 - DNA, 25 bp, Homo sapien
gcttctaattcttcaagccgtttta

SEQ ID NO: 309502 - DNA, 25 bp, Homo sapien
tcaagccgttttatacgttcttcct

SEQ ID NO: 309503 - DNA, 25 bp, Homo sapien
ttcttcctctttaagcttagccaga

SEQ ID NO: 309504 - DNA, 25 bp, Homo sapien
gcttagccagagcttcttgcatagc

SEQ ID NO: 309505 - DNA, 25 bp, Homo sapien
gcttcttgcatagctttaacagtgg

SEQ ID NO: 309506 - DNA, 25 bp, Homo sapien
ttaacagtggctttgctaggtcctt

SEQ ID NO: 309507 - DNA, 25 bp, Homo sapien
gtggctttgctaggtccttttttct

SEQ ID NO: 309508 - DNA, 25 bp, Homo sapien
ttgttccaatcgttcctcttcttta

SEQ ID NO: 309509 - DNA, 25 bp, Homo sapien
aatcgttcctcttctttacgcttgg

SEQ ID NO: 309510 - DNA, 25 bp, Homo sapien
tcttctttacgcttggcttctaatt

SEQ ID NO: 309511 - DNA, 25 bp, Homo sapien
ctttacgcttggcttctaattcttc

SEQ ID NO: 309512 - DNA, 25 bp, Homo sapien
tggccactcgcaagaccttttatct

SEQ ID NO: 309513 - DNA, 25 bp, Homo sapien
actcgcaagaccttttatctgaaaa

SEQ ID NO: 309514 - DNA, 25 bp, Homo sapien
acttctgtggtcaactccctgcaga

SEQ ID NO: 309515 - DNA, 25 bp, Homo sapien
tgcagaactcccaaactgccgttct

SEQ ID NO: 309516 - DNA, 25 bp, Homo sapien
aaactgccgttcttttcgatagctc

SEQ ID NO: 309517 - DNA, 25 bp, Homo sapien
gccgttcttttcgatagctcacgat

SEQ ID NO: 309518 - DNA, 25 bp, Homo sapien
cttttcgatagctcacgatggtgta

SEQ ID NO: 309519 - DNA, 25 bp, Homo sapien
tcacgatggtgtatgagtgtcaatc

SEQ ID NO: 309520 - DNA, 25 bp, Homo sapien
gagtgtcaatcatctgacccttctt

SEQ ID NO: 309521 - DNA, 25 bp, Homo sapien
gacccttcttggagtctcatatttc

SEQ ID NO: 309522 - DNA, 25 bp, Homo sapien
cttggagtctcatatttcgtggaac

SEQ ID NO: 309523 - DNA, 25 bp, Homo sapien
tggctgggccagtcctgtcttcatt

SEQ ID NO: 309524 - DNA, 25 bp, Homo sapien
gagcccatgtcctattagggtatcg

SEQ ID NO: 309525 - DNA, 25 bp, Homo sapien
atacagccagcatcctcagtgagat

SEQ ID NO: 309526 - DNA, 25 bp, Homo sapien
gaaaatggcaattactcggcaggtc

SEQ ID NO: 309527 - DNA, 25 bp, Homo sapien
attactcggcaggtcagcagaaagc

SEQ ID NO: 309528 - DNA, 25 bp, Homo sapien
ctattagggtatcggctttgcctcc

SEQ ID NO: 309529 - DNA, 25 bp, Homo sapien
ggatacttctctccccgggattcag

SEQ ID NO: 309530 - DNA, 25 bp, Homo sapien
agctggaagaccgagccagtgccca

SEQ ID NO: 309531 - DNA, 25 bp, Homo sapien
ggctttgcctccgattatctggcaa

SEQ ID NO: 309532 - DNA, 25 bp, Homo sapien
gcctccgattatctggcaaataaac

SEQ ID NO: 309533 - DNA, 25 bp, Homo sapien
ttaggagtccgccagggtctttctg

SEQ ID NO: 309534 - DNA, 25 bp, Homo sapien
gtgcattcgaatcacatagcagtga

SEQ ID NO: 309535 - DNA, 25 bp, Homo sapien
atagcagtgactggagtcctgagct

SEQ ID NO: 309536 - DNA, 25 bp, Homo sapien
gtcctgagctgtgtctgaagactgt

SEQ ID NO: 309537 - DNA, 25 bp, Homo sapien
ctgtgagatcacgtttggagctgct

SEQ ID NO: 309538 - DNA, 25 bp, Homo sapien
ggagctgctgattggttttcagtga

SEQ ID NO: 309539 - DNA, 25 bp, Homo sapien
tcagtgatggccctgttgcacagtg

SEQ ID NO: 309540 - DNA, 25 bp, Homo sapien
tgcacagtgccgtgagacttagctc

SEQ ID NO: 309541 - DNA, 25 bp, Homo sapien
gacttagctccatggccaaagacga

SEQ ID NO: 309542 - DNA, 25 bp, Homo sapien
aaagacgatggtatcccctaggagc

SEQ ID NO: 309543 - DNA, 25 bp, Homo sapien
agagtcagctccacaaaaatcccga

SEQ ID NO: 309544 - DNA, 25 bp, Homo sapien
aatcccgattcctagcatgaaactg

SEQ ID NO: 309545 - DNA, 25 bp, Homo sapien
agcagcgcaccattcatcatttagg

SEQ ID NO: 309546 - DNA, 25 bp, Homo sapien
cattcatcatttaggcttgtggttt

SEQ ID NO: 309547 - DNA, 25 bp, Homo sapien
ggcttgtggtttgttgtttactcta

SEQ ID NO: 309548 - DNA, 25 bp, Homo sapien
gttgtttactctaccaatgttatgt

SEQ ID NO: 309549 - DNA, 25 bp, Homo sapien
aaatggcaggttttccaggtccacg

SEQ ID NO: 309550 - DNA, 25 bp, Homo sapien
tggcaggttttccaggtccacggaa

SEQ ID NO: 309551 - DNA, 25 bp, Homo sapien
ccacggaaaggtttggcctgacgct

SEQ ID NO: 309552 - DNA, 25 bp, Homo sapien
cgctggagtgcggtgatgaacttac

SEQ ID NO: 309553 - DNA, 25 bp, Homo sapien
tgcggtgatgaacttacgtgacaat

SEQ ID NO: 309554 - DNA, 25 bp, Homo sapien
gattgtattcctcagtagcacttta

SEQ ID NO: 309555 - DNA, 25 bp, Homo sapien
tcagtagcactttaaacgccgaaga

SEQ ID NO: 309556 - DNA, 25 bp, Homo sapien
gtacctttcctgagctattgcagca

SEQ ID NO: 309557 - DNA, 25 bp, Homo sapien
gagctattgcagcagattcctctct

SEQ ID NO: 309558 - DNA, 25 bp, Homo sapien
ctttctctcctacaggtgtccaaat

SEQ ID NO: 309559 - DNA, 25 bp, Homo sapien
gtgtccaaatcctaccctagagttt

SEQ ID NO: 309560 - DNA, 25 bp, Homo sapien
tcagttgactgcctcattgggtcag

SEQ ID NO: 309561 - DNA, 25 bp, Homo sapien
aaacacagctcaggtttctctcatc

SEQ ID NO: 309562 - DNA, 25 bp, Homo sapien
cacctttatttctgatgtgcccagt

SEQ ID NO: 309563 - DNA, 25 bp, Homo sapien
gtgcccagtctgaaacattctctgt

SEQ ID NO: 309564 - DNA, 25 bp, Homo sapien
atccttcccttggtttatagcccat

SEQ ID NO: 309565 - DNA, 25 bp, Homo sapien
attgggtcagtttaccttcacagga

SEQ ID NO: 309566 - DNA, 25 bp, Homo sapien
agtcaaccattcttcttgtaccttt

SEQ ID NO: 309567 - DNA, 25 bp, Homo sapien
ctttccacattattcctattagagg

SEQ ID NO: 309568 - DNA, 25 bp, Homo sapien
gaggagcaaatatcccatgccattc

SEQ ID NO: 309569 - DNA, 25 bp, Homo sapien
atcccatgccattcaagtatgtcaa

SEQ ID NO: 309570 - DNA, 25 bp, Homo sapien
aagtatgtcaaatgtgccctagcat

SEQ ID NO: 309571 - DNA, 25 bp, Homo sapien
gccctagcatttattggaccattag

SEQ ID NO: 309572 - DNA, 25 bp, Homo sapien
tggaccattaggtttttcttggtgt

SEQ ID NO: 309573 - DNA, 25 bp, Homo sapien
ctgtgatgtcttaaacccttttggt

SEQ ID NO: 309574 - DNA, 25 bp, Homo sapien
acatgtaactggtaggcgcactgcc

SEQ ID NO: 309575 - DNA, 25 bp, Homo sapien
cgcactgccaacacattactgaatt

SEQ ID NO: 309576 - DNA, 25 bp, Homo sapien
aggttaccataccaagtgtactatc

SEQ ID NO: 309577 - DNA, 25 bp, Homo sapien
tgtactatcctttagcaggccaaat

SEQ ID NO: 309578 - DNA, 25 bp, Homo sapien
attctgctgctgtagatatagtcta

SEQ ID NO: 309579 - DNA, 25 bp, Homo sapien
ctaaggtagttaaccatataagcct

SEQ ID NO: 309580 - DNA, 25 bp, Homo sapien
aagccttttcaactcttaatgccct

SEQ ID NO: 309581 - DNA, 25 bp, Homo sapien
taatgccctccacatgaatcagcag

SEQ ID NO: 309582 - DNA, 25 bp, Homo sapien
gaatcagcagttaagaaggttctag

SEQ ID NO: 309583 - DNA, 25 bp, Homo sapien
aaggttctagaacccatgaaagctt

SEQ ID NO: 309584 - DNA, 25 bp, Homo sapien
gaaagcttttgtatgtattactagg

SEQ ID NO: 309585 - DNA, 25 bp, Homo sapien
gtttgctgattttacagttctgact

SEQ ID NO: 309586 - DNA, 25 bp, Homo sapien
ctgactaaagctgacctaaatggat

SEQ ID NO: 309587 - DNA, 25 bp, Homo sapien
ttatgtgtaatattctagtgcttta

SEQ ID NO: 309588 - DNA, 25 bp, Homo sapien
tctagtgctttaatgactctttttt

SEQ ID NO: 309589 - DNA, 25 bp, Homo sapien
attcacaaatttattcagatagcca

SEQ ID NO: 309590 - DNA, 25 bp, Homo sapien
cagatagccaaattatcaaggaagt

SEQ ID NO: 309591 - DNA, 25 bp, Homo sapien
aacttccatttttaattaatgctgt

SEQ ID NO: 309592 - DNA, 25 bp, Homo sapien
taatgctgtgtaattcttttggtca

SEQ ID NO: 309593 - DNA, 25 bp, Homo sapien
gctgtgtaattcttttggtcatttc

SEQ ID NO: 309594 - DNA, 25 bp, Homo sapien
aattcttttggtcatttcattacat

SEQ ID NO: 309595 - DNA, 25 bp, Homo sapien
cttttggtcatttcattacattttt

SEQ ID NO: 309596 - DNA, 25 bp, Homo sapien
ggaggaaaggccatctccttatagt

SEQ ID NO: 309597 - DNA, 25 bp, Homo sapien
ggccatctccttatagttaaccttt

SEQ ID NO: 309598 - DNA, 25 bp, Homo sapien
aatcagaggaaaaatcgcaatcaaa

SEQ ID NO: 309599 - DNA, 25 bp, Homo sapien
aaatgtcacttgataaacaactaat

SEQ ID NO: 309600 - DNA, 25 bp, Homo sapien
acctcccaggactgatcagactctt

SEQ ID NO: 309601 - DNA, 25 bp, Homo sapien
acacggactggcgaccttcagggcg

SEQ ID NO: 309602 - DNA, 25 bp, Homo sapien
gactggcgaccttcagggcgcacgc

SEQ ID NO: 309603 - DNA, 25 bp, Homo sapien
acgcccgacaggctcaagactgaat

SEQ ID NO: 309604 - DNA, 25 bp, Homo sapien
gcccgacaggctcaagactgaatca

SEQ ID NO: 309605 - DNA, 25 bp, Homo sapien
acaggctcaagactgaatcactccc

SEQ ID NO: 309606 - DNA, 25 bp, Homo sapien
aggctcaagactgaatcactcccat

SEQ ID NO: 309607 - DNA, 25 bp, Homo sapien
aagactgaatcactcccatcctcga

SEQ ID NO: 309608 - DNA, 25 bp, Homo sapien
tcatcccatcagacactgaacccta

SEQ ID NO: 309609 - DNA, 25 bp, Homo sapien
tcagacactgaaccctatcctccgt

SEQ ID NO: 309610 - DNA, 25 bp, Homo sapien
ggatgcctgaccgaggggttcccat

SEQ ID NO: 309611 - DNA, 25 bp, Homo sapien
gacaaaaaacaggttgggcacaata

SEQ ID NO: 309612 - DNA, 25 bp, Homo sapien
acaaccaagtataaggagctcagaa

SEQ ID NO: 309613 - DNA, 25 bp, Homo sapien
ggagctcagaagatttccatctaaa

SEQ ID NO: 309614 - DNA, 25 bp, Homo sapien
aatagtttcaataatcctccaagac

SEQ ID NO: 309615 - DNA, 25 bp, Homo sapien
taaaagatatgtactgcaggcccag

SEQ ID NO: 309616 - DNA, 25 bp, Homo sapien
ctgcaggcccagatagataaggaga

SEQ ID NO: 309617 - DNA, 25 bp, Homo sapien
ggaaattaagcaggacatctcaagt

SEQ ID NO: 309618 - DNA, 25 bp, Homo sapien
ggacatctcaagtctccgctatgaa

SEQ ID NO: 309619 - DNA, 25 bp, Homo sapien
agtctccgctatgaactccttgaag

SEQ ID NO: 309620 - DNA, 25 bp, Homo sapien
ctcagaatacagaagacctagcaga

SEQ ID NO: 309621 - DNA, 25 bp, Homo sapien
gaagacctagcagaacttattagag

SEQ ID NO: 309622 - DNA, 25 bp, Homo sapien
caaataaatccctaagtttctgata

SEQ ID NO: 309623 - DNA, 25 bp, Homo sapien
tatgttgtaaagtatgctcccttgg

SEQ ID NO: 309624 - DNA, 25 bp, Homo sapien
gttgtaaagtatgctcccttggttt

SEQ ID NO: 309625 - DNA, 25 bp, Homo sapien
tgtaaagtatgctcccttggttttt

SEQ ID NO: 309626 - DNA, 25 bp, Homo sapien
gtatgctcccttggtttttcttaat

SEQ ID NO: 309627 - DNA, 25 bp, Homo sapien
tgctcccttggtttttcttaatctt

SEQ ID NO: 309628 - DNA, 25 bp, Homo sapien
aatgtttagacaaagctgatggcac

SEQ ID NO: 309629 - DNA, 25 bp, Homo sapien
gtttagacaaagctgatggcactat

SEQ ID NO: 309630 - DNA, 25 bp, Homo sapien
ttgtatcatgttccttgaaactgta

SEQ ID NO: 309631 - DNA, 25 bp, Homo sapien
atgttccttgaaactgtaaattcag

SEQ ID NO: 309632 - DNA, 25 bp, Homo sapien
cagtgaaaaatatctcttgcaataa

SEQ ID NO: 309633 - DNA, 25 bp, Homo sapien
ggatcacaactaattatcagaatct

SEQ ID NO: 309634 - DNA, 25 bp, Homo sapien
attatcagaatctgaccttatttcc

SEQ ID NO: 309635 - DNA, 25 bp, Homo sapien
cttatttccaagtcatagattccta

SEQ ID NO: 309636 - DNA, 25 bp, Homo sapien
gtcatagattcctataaactaggtt

SEQ ID NO: 309637 - DNA, 25 bp, Homo sapien
agatttaagcaggaactcaagaact

SEQ ID NO: 309638 - DNA, 25 bp, Homo sapien
aagaactgcagtaacccatggaaat

SEQ ID NO: 309639 - DNA, 25 bp, Homo sapien
ggctaaggcaagagatgattttctg

SEQ ID NO: 309640 - DNA, 25 bp, Homo sapien
attttctgaggcttatgtctggtga

SEQ ID NO: 309641 - DNA, 25 bp, Homo sapien
tggtgaaattttccagaagttcacg

SEQ ID NO: 309642 - DNA, 25 bp, Homo sapien
tagtaacctgaaaccttctatttgg

SEQ ID NO: 309643 - DNA, 25 bp, Homo sapien
cctgaaaccttctatttggagataa

SEQ ID NO: 309644 - DNA, 25 bp, Homo sapien
gaagtaggagaagctcgcgagatct

SEQ ID NO: 309645 - DNA, 25 bp, Homo sapien
aagtaggagaagctcgcgagatctg

SEQ ID NO: 309646 - DNA, 25 bp, Homo sapien
agtaggagaagctcgcgagatctgt

SEQ ID NO: 309647 - DNA, 25 bp, Homo sapien
gtaggagaagctcgcgagatctgtg

SEQ ID NO: 309648 - DNA, 25 bp, Homo sapien
taggagaagctcgcgagatctgtgc

SEQ ID NO: 309649 - DNA, 25 bp, Homo sapien
gagaagctcgcgagatctgtgccgt

SEQ ID NO: 309650 - DNA, 25 bp, Homo sapien
gagaggggatctcgcgaaaggaaag

SEQ ID NO: 309651 - DNA, 25 bp, Homo sapien
agaggggatctcgcgaaaggaaaga

SEQ ID NO: 309652 - DNA, 25 bp, Homo sapien
ttctgtctttgttattgcacaatga

SEQ ID NO: 309653 - DNA, 25 bp, Homo sapien
tctggcttggctaatggaaatcgac

SEQ ID NO: 309654 - DNA, 25 bp, Homo sapien
atggaaatcgacactagcgcttccc

SEQ ID NO: 309655 - DNA, 25 bp, Homo sapien
tagcgcttccccaatattagactta

SEQ ID NO: 309656 - DNA, 25 bp, Homo sapien
aacaggatcagtaagctcagactct

SEQ ID NO: 309657 - DNA, 25 bp, Homo sapien
cagactctccatctccattatttta

SEQ ID NO: 309658 - DNA, 25 bp, Homo sapien
tattttagccttgaccattcttctc

SEQ ID NO: 309659 - DNA, 25 bp, Homo sapien
ttcagtttccagttcaagttacatt

SEQ ID NO: 309660 - DNA, 25 bp, Homo sapien
gttacattgcttcagttacagtttg

SEQ ID NO: 309661 - DNA, 25 bp, Homo sapien
cttcagttacagtttgtttgaccct

SEQ ID NO: 309662 - DNA, 25 bp, Homo sapien
gtttgaccctgtattcagagctgca

SEQ ID NO: 309663 - DNA, 25 bp, Homo sapien
gtgagacaaaaccaatgtccacgcc

SEQ ID NO: 309664 - DNA, 25 bp, Homo sapien
gaaaaatcctgtaagtatgctgaac

SEQ ID NO: 309665 - DNA, 25 bp, Homo sapien
aatcctgtaagtatgctgaacatga

SEQ ID NO: 309666 - DNA, 25 bp, Homo sapien
atgctgaacatgaaaggacctggaa

SEQ ID NO: 309667 - DNA, 25 bp, Homo sapien
gcctttaccaaattatccctacttg

SEQ ID NO: 309668 - DNA, 25 bp, Homo sapien
accaaattatccctacttgagagaa

SEQ ID NO: 309669 - DNA, 25 bp, Homo sapien
atccctacttgagagaaaacttgga

SEQ ID NO: 309670 - DNA, 25 bp, Homo sapien
caatgtggcacaaatttcaaccagt

SEQ ID NO: 309671 - DNA, 25 bp, Homo sapien
tggcacaaatttcaaccagtttttt

SEQ ID NO: 309672 - DNA, 25 bp, Homo sapien
ttttaaacagactacacatctttga

SEQ ID NO: 309673 - DNA, 25 bp, Homo sapien
gactacacatctttgaaatcatact

SEQ ID NO: 309674 - DNA, 25 bp, Homo sapien
caaaagacaggtaggagcttgggaa

SEQ ID NO: 309675 - DNA, 25 bp, Homo sapien
taaggtcccgggatgctgcctccag

SEQ ID NO: 309676 - DNA, 25 bp, Homo sapien
cttttagccttttccaactctcagc

SEQ ID NO: 309677 - DNA, 25 bp, Homo sapien
aactggaaagccctcttcccagcag

SEQ ID NO: 309678 - DNA, 25 bp, Homo sapien
agccctcttcccagcagtgcagtgt

SEQ ID NO: 309679 - DNA, 25 bp, Homo sapien
aaggtgcccgtagaatgggtgttat

SEQ ID NO: 309680 - DNA, 25 bp, Homo sapien
ggtgttcagaacttaaggactttgc

SEQ ID NO: 309681 - DNA, 25 bp, Homo sapien
acttaaggactttgcaggtcttaca

SEQ ID NO: 309682 - DNA, 25 bp, Homo sapien
aggtcttacaaaggcctggcattct

SEQ ID NO: 309683 - DNA, 25 bp, Homo sapien
aaaggcctggcattctaccttcttt

SEQ ID NO: 309684 - DNA, 25 bp, Homo sapien
tggcattctaccttctttagttcag

SEQ ID NO: 309685 - DNA, 25 bp, Homo sapien
aaatcagctggactgattcctcctc

SEQ ID NO: 309686 - DNA, 25 bp, Homo sapien
cctctcactctattctttttcaaaa

SEQ ID NO: 309687 - DNA, 25 bp, Homo sapien
tgatgatctcggctctgtcgatctg

SEQ ID NO: 309688 - DNA, 25 bp, Homo sapien
agaataaccttgtctacatctacaa

SEQ ID NO: 309689 - DNA, 25 bp, Homo sapien
gtctacatctacaaaacatcttcta

SEQ ID NO: 309690 - DNA, 25 bp, Homo sapien
gattttgataggaactgcatttaac

SEQ ID NO: 309691 - DNA, 25 bp, Homo sapien
tttactgtattctgtctagcaatcc

SEQ ID NO: 309692 - DNA, 25 bp, Homo sapien
ttctgtctagcaatccatgaacatg

SEQ ID NO: 309693 - DNA, 25 bp, Homo sapien
tgtcgatctgtgtgtctgtgcctct

SEQ ID NO: 309694 - DNA, 25 bp, Homo sapien
ctctgccagcattgcactcttggtt

SEQ ID NO: 309695 - DNA, 25 bp, Homo sapien
gcactcttggttcacatagctatat

SEQ ID NO: 309696 - DNA, 25 bp, Homo sapien
agcttcaggctcagtagtcattcct

SEQ ID NO: 309697 - DNA, 25 bp, Homo sapien
agtagtcattcctttatgctgttgc

SEQ ID NO: 309698 - DNA, 25 bp, Homo sapien
tgtactgtgataactggtgcttgaa

SEQ ID NO: 309699 - DNA, 25 bp, Homo sapien
cttggcatgatttagggaccattgc

SEQ ID NO: 309700 - DNA, 25 bp, Homo sapien
ggaccattgccttttccatggtaga

SEQ ID NO: 309701 - DNA, 25 bp, Homo sapien
atgtgggactctctgtcatcttcac

SEQ ID NO: 309702 - DNA, 25 bp, Homo sapien
atcttcaccttgttgttccaagtgc

SEQ ID NO: 309703 - DNA, 25 bp, Homo sapien
ggtggagtcaggcaaaactctgcaa

SEQ ID NO: 309704 - DNA, 25 bp, Homo sapien
aactctgcaatgactcacaggtacc

SEQ ID NO: 309705 - DNA, 25 bp, Homo sapien
aagtctcaactcagagcatccatca

SEQ ID NO: 309706 - DNA, 25 bp, Homo sapien
agagcatccatcagagcttcaggct

SEQ ID NO: 309707 - DNA, 25 bp, Homo sapien
tctccataacatgcccaaggaggaa

SEQ ID NO: 309708 - DNA, 25 bp, Homo sapien
aaaaggaaggccgacaccttgatat

SEQ ID NO: 309709 - DNA, 25 bp, Homo sapien
aaaggaaggccgacaccttgatatg

SEQ ID NO: 309710 - DNA, 25 bp, Homo sapien
aggaaggccgacaccttgatatggt

SEQ ID NO: 309711 - DNA, 25 bp, Homo sapien
gaaggccgacaccttgatatggtgc

SEQ ID NO: 309712 - DNA, 25 bp, Homo sapien
aaggccgacaccttgatatggtgca

SEQ ID NO: 309713 - DNA, 25 bp, Homo sapien
ggccgacaccttgatatggtgcagt

SEQ ID NO: 309714 - DNA, 25 bp, Homo sapien
ccgacaccttgatatggtgcagtgt

SEQ ID NO: 309715 - DNA, 25 bp, Homo sapien
gacaccttgatatggtgcagtgtgt

SEQ ID NO: 309716 - DNA, 25 bp, Homo sapien
caccttgatatggtgcagtgtgtcc

SEQ ID NO: 309717 - DNA, 25 bp, Homo sapien
tctcatgctgcctgttctcatgggt

SEQ ID NO: 309718 - DNA, 25 bp, Homo sapien
ttgcgttcctgtggcgggcacctga

SEQ ID NO: 309719 - DNA, 25 bp, Homo sapien
atgcccgagtactgtcctcaggcgg

SEQ ID NO: 309720 - DNA, 25 bp, Homo sapien
tcctcaggcggaacggcgtctgcag

SEQ ID NO: 309721 - DNA, 25 bp, Homo sapien
agcaggctcggctgacgcggtccct

SEQ ID NO: 309722 - DNA, 25 bp, Homo sapien
ggtccctggcatttcccgtgctggc

SEQ ID NO: 309723 - DNA, 25 bp, Homo sapien
ctcgatgctgcttcccgctgggagc

SEQ ID NO: 309724 - DNA, 25 bp, Homo sapien
ggagcctccttctgacggcggaaag

SEQ ID NO: 309725 - DNA, 25 bp, Homo sapien
tgacggcggaaaggagcttcacctg

SEQ ID NO: 309726 - DNA, 25 bp, Homo sapien
agagcatggagctttttcgctggtc

SEQ ID NO: 309727 - DNA, 25 bp, Homo sapien
agctttttcgctggtccggcgcggt

SEQ ID NO: 309728 - DNA, 25 bp, Homo sapien
tggtccggcgcggtctcttgcgttc

SEQ ID NO: 309729 - DNA, 25 bp, Homo sapien
ttagagtaacttcctctctttattt

SEQ ID NO: 309730 - DNA, 25 bp, Homo sapien
tgactattggtttcctttgcggttt

SEQ ID NO: 309731 - DNA, 25 bp, Homo sapien
ttcagaatcatcttcgacggatagg

SEQ ID NO: 309732 - DNA, 25 bp, Homo sapien
aatagtgcaatcatatgtgtcagta

SEQ ID NO: 309733 - DNA, 25 bp, Homo sapien
atgtgtcagtattccggtattctag

SEQ ID NO: 309734 - DNA, 25 bp, Homo sapien
cagtattccggtattctaggaactt

SEQ ID NO: 309735 - DNA, 25 bp, Homo sapien
aaggttaatcaaggtcctcatggac

SEQ ID NO: 309736 - DNA, 25 bp, Homo sapien
tcatggactgaaccttgaggccctt

SEQ ID NO: 309737 - DNA, 25 bp, Homo sapien
actgaaccttgaggcccttctgctg

SEQ ID NO: 309738 - DNA, 25 bp, Homo sapien
tcacttttgccctatcagactttta

SEQ ID NO: 309739 - DNA, 25 bp, Homo sapien
tgccctatcagacttttagagtaac

SEQ ID NO: 309740 - DNA, 25 bp, Homo sapien
taacgggacatactccgcgcatgca

SEQ ID NO: 309741 - DNA, 25 bp, Homo sapien
gcgcatgcacatttaggatcaccgt

SEQ ID NO: 309742 - DNA, 25 bp, Homo sapien
aggatcaccgtgtcttctcgttgga

SEQ ID NO: 309743 - DNA, 25 bp, Homo sapien
ttctcgttggactgatctgtcgtta

SEQ ID NO: 309744 - DNA, 25 bp, Homo sapien
tgatctgtcgttaggaccctggacc

SEQ ID NO: 309745 - DNA, 25 bp, Homo sapien
gtaattgtctttgctctgaagtttt

SEQ ID NO: 309746 - DNA, 25 bp, Homo sapien
agtaacaaaggcattccagctcttt

SEQ ID NO: 309747 - DNA, 25 bp, Homo sapien
ttttcccagccgaagctcactgtgt

SEQ ID NO: 309748 - DNA, 25 bp, Homo sapien
ctcactgtgtttactacataggatg

SEQ ID NO: 309749 - DNA, 25 bp, Homo sapien
gaaagactctctctaacgttagcta

SEQ ID NO: 309750 - DNA, 25 bp, Homo sapien
taacgttagctacgcgtgcagaaat

SEQ ID NO: 309751 - DNA, 25 bp, Homo sapien
ggagtgcaggacttgcttctcccct

SEQ ID NO: 309752 - DNA, 25 bp, Homo sapien
ttgcttctcccctaacattttgttg

SEQ ID NO: 309753 - DNA, 25 bp, Homo sapien
cttctcccctaacattttgttgtga

SEQ ID NO: 309754 - DNA, 25 bp, Homo sapien
agtgaacacctttgtatctaccacc

SEQ ID NO: 309755 - DNA, 25 bp, Homo sapien
acacctttgtatctaccaccttgat

SEQ ID NO: 309756 - DNA, 25 bp, Homo sapien
gtatctaccaccttgattctctata

SEQ ID NO: 309757 - DNA, 25 bp, Homo sapien
gattctctataggtataggcactca

SEQ ID NO: 309758 - DNA, 25 bp, Homo sapien
ctctataggtataggcactcaattt

SEQ ID NO: 309759 - DNA, 25 bp, Homo sapien
tggaggtggagttctgaaacagcca

SEQ ID NO: 309760 - DNA, 25 bp, Homo sapien
gaaacagccactgtggtgaaggagt

SEQ ID NO: 309761 - DNA, 25 bp, Homo sapien
aaggagtgtgtgcagctgggactgt

SEQ ID NO: 309762 - DNA, 25 bp, Homo sapien
gccctcagggcttggatcattcagt

SEQ ID NO: 309763 - DNA, 25 bp, Homo sapien
gctgctggcaaagaggcggaggatg

SEQ ID NO: 309764 - DNA, 25 bp, Homo sapien
atggtgttggagttctatgtgcagc

SEQ ID NO: 309765 - DNA, 25 bp, Homo sapien
tccgcatgtggtgtgtccgccagcg

SEQ ID NO: 309766 - DNA, 25 bp, Homo sapien
gcatgtggtgtgtccgccagcgtta

SEQ ID NO: 309767 - DNA, 25 bp, Homo sapien
catgtggtgtgtccgccagcgttac

SEQ ID NO: 309768 - DNA, 25 bp, Homo sapien
tggtgtgtccgccagcgttactgtc

SEQ ID NO: 309769 - DNA, 25 bp, Homo sapien
tctgcagctgttttcatccaggcct

SEQ ID NO: 309770 - DNA, 25 bp, Homo sapien
gcatgctggtgcgacgcacactgct

SEQ ID NO: 309771 - DNA, 25 bp, Homo sapien
tggtgcgacgcacactgctgcatgc

SEQ ID NO: 309772 - DNA, 25 bp, Homo sapien
ggtgcgacgcacactgctgcatgca

SEQ ID NO: 309773 - DNA, 25 bp, Homo sapien
gattgaaagcttattccatagagaa

SEQ ID NO: 309774 - DNA, 25 bp, Homo sapien
ttccatagagaagacattgggttct

SEQ ID NO: 309775 - DNA, 25 bp, Homo sapien
aagacattgggttctagagacttac

SEQ ID NO: 309776 - DNA, 25 bp, Homo sapien
ggttctagagacttacaggctatgc

SEQ ID NO: 309777 - DNA, 25 bp, Homo sapien
acaggctatgcttgtagtttctcat

SEQ ID NO: 309778 - DNA, 25 bp, Homo sapien
gtttctcatatttaccttccttttg

SEQ ID NO: 309779 - DNA, 25 bp, Homo sapien
aaggtgaggttatttgtgtgaagaa

SEQ ID NO: 309780 - DNA, 25 bp, Homo sapien
gaatggttaggatcagtttgtttac

SEQ ID NO: 309781 - DNA, 25 bp, Homo sapien
catccgtaccactttttggaacagt

SEQ ID NO: 309782 - DNA, 25 bp, Homo sapien
tacagcaggcatggacaaaaacaga

SEQ ID NO: 309783 - DNA, 25 bp, Homo sapien
agtctaactgattgaaagcttattc

SEQ ID NO: 309784 - DNA, 25 bp, Homo sapien
acagcagcgctcaccaactgtgggc

SEQ ID NO: 309785 - DNA, 25 bp, Homo sapien
aactgtgggcctggctctgtcctaa

SEQ ID NO: 309786 - DNA, 25 bp, Homo sapien
tggctctgtcctaagaacgctgtgg

SEQ ID NO: 309787 - DNA, 25 bp, Homo sapien
gtcctaagaacgctgtgggtcactc

SEQ ID NO: 309788 - DNA, 25 bp, Homo sapien
acgctgtgggtcactcgggtgatac

SEQ ID NO: 309789 - DNA, 25 bp, Homo sapien
tcactcgggtgataccaagggcagt

SEQ ID NO: 309790 - DNA, 25 bp, Homo sapien
taccaagggcagtggttaagcccat

SEQ ID NO: 309791 - DNA, 25 bp, Homo sapien
agtggttaagcccatgctcactggg

SEQ ID NO: 309792 - DNA, 25 bp, Homo sapien
gccccaagccccaggtggctttggg

SEQ ID NO: 309793 - DNA, 25 bp, Homo sapien
gcagttgccagccttggcgactcac

SEQ ID NO: 309794 - DNA, 25 bp, Homo sapien
cagccttggcgactcacacaggcga

SEQ ID NO: 309795 - DNA, 25 bp, Homo sapien
aggcatagttcaatgtgaccctttg

SEQ ID NO: 309796 - DNA, 25 bp, Homo sapien
aatctatgattctttgcagtcttca

SEQ ID NO: 309797 - DNA, 25 bp, Homo sapien
agattttgcatctgctactccataa

SEQ ID NO: 309798 - DNA, 25 bp, Homo sapien
gcatctgctactccataatgtttat

SEQ ID NO: 309799 - DNA, 25 bp, Homo sapien
aaaattaacatcacttatccccact

SEQ ID NO: 309800 - DNA, 25 bp, Homo sapien
ttagttatcttctgcccataatgta

SEQ ID NO: 309801 - DNA, 25 bp, Homo sapien
tatccccactgctgtataccttgat

SEQ ID NO: 309802 - DNA, 25 bp, Homo sapien
actgctgtataccttgatttggaaa

SEQ ID NO: 309803 - DNA, 25 bp, Homo sapien
tcttctgcccataatgtacccataa

SEQ ID NO: 309804 - DNA, 25 bp, Homo sapien
taaagtgtacccataatgacagaac

SEQ ID NO: 309805 - DNA, 25 bp, Homo sapien
aaatgtgcttgtactccaggagtcc

SEQ ID NO: 309806 - DNA, 25 bp, Homo sapien
aaaggcactgacatttctagtttgc

SEQ ID NO: 309807 - DNA, 25 bp, Homo sapien
ggcactgacatttctagtttgcccc

SEQ ID NO: 309808 - DNA, 25 bp, Homo sapien
tcggcacttccccaggctcatttga

SEQ ID NO: 309809 - DNA, 25 bp, Homo sapien
ttccccaggctcatttgagcaggtg

SEQ ID NO: 309810 - DNA, 25 bp, Homo sapien
caggctcatttgagcaggtgtgcct

SEQ ID NO: 309811 - DNA, 25 bp, Homo sapien
ttcccaggtgcctcatccataatga

SEQ ID NO: 309812 - DNA, 25 bp, Homo sapien
ggtgcctcatccataatgagataat

SEQ ID NO: 309813 - DNA, 25 bp, Homo sapien
caagggtccttgcatccctagtctc

SEQ ID NO: 309814 - DNA, 25 bp, Homo sapien
aaactccagctctgattcgccatca

SEQ ID NO: 309815 - DNA, 25 bp, Homo sapien
tctgattcgccatcaacccatggag

SEQ ID NO: 309816 - DNA, 25 bp, Homo sapien
agccccaaaggcactgacatttcta

SEQ ID NO: 309817 - DNA, 25 bp, Homo sapien
tccacgtccacgtgtgacctgattc

SEQ ID NO: 309818 - DNA, 25 bp, Homo sapien
gtgtctaattgagctagttaccaca

SEQ ID NO: 309819 - DNA, 25 bp, Homo sapien
gagctagttaccacaagttgcctat

SEQ ID NO: 309820 - DNA, 25 bp, Homo sapien
gttaccacaagttgcctataaatgg

SEQ ID NO: 309821 - DNA, 25 bp, Homo sapien
actaaaagaccacacgaccactggg

SEQ ID NO: 309822 - DNA, 25 bp, Homo sapien
ggaactgtaaacatccacccctaca

SEQ ID NO: 309823 - DNA, 25 bp, Homo sapien
acccctacacactgccagtatgaga

SEQ ID NO: 309824 - DNA, 25 bp, Homo sapien
tgctgatatgttttctgctgacctg

SEQ ID NO: 309825 - DNA, 25 bp, Homo sapien
tgctgacctgatgacaatgttccta

SEQ ID NO: 309826 - DNA, 25 bp, Homo sapien
gacaatgttcctatggtcacactaa

SEQ ID NO: 309827 - DNA, 25 bp, Homo sapien
gtcacactaaccactgctgggtaat

SEQ ID NO: 309828 - DNA, 25 bp, Homo sapien
gagctttaccagttattttgtcagg

SEQ ID NO: 309829 - DNA, 25 bp, Homo sapien
cagttattttgtcaggtagcattcc

SEQ ID NO: 309830 - DNA, 25 bp, Homo sapien
gtcaggtagcattccattaaattag

SEQ ID NO: 309831 - DNA, 25 bp, Homo sapien
aggatgcatcatctttgagactgat

SEQ ID NO: 309832 - DNA, 25 bp, Homo sapien
tctttgagactgatggatttttgat

SEQ ID NO: 309833 - DNA, 25 bp, Homo sapien
tgattcatttttccgagttttattg

SEQ ID NO: 309834 - DNA, 25 bp, Homo sapien
ttgaatttggaatgacaccgagatc

SEQ ID NO: 309835 - DNA, 25 bp, Homo sapien
gaatgacaccgagatcccaatagcc

SEQ ID NO: 309836 - DNA, 25 bp, Homo sapien
gagatcccaatagcctgtacaaagt

SEQ ID NO: 309837 - DNA, 25 bp, Homo sapien
gtaggtcaacaacagagccattctt

SEQ ID NO: 309838 - DNA, 25 bp, Homo sapien
acagagccattcttgataatacaga

SEQ ID NO: 309839 - DNA, 25 bp, Homo sapien
gagaacagagtcaccctgaaatcca

SEQ ID NO: 309840 - DNA, 25 bp, Homo sapien
agaacagagtcaccctgaaatccag

SEQ ID NO: 309841 - DNA, 25 bp, Homo sapien
aacagagtcaccctgaaatccagca

SEQ ID NO: 309842 - DNA, 25 bp, Homo sapien
acagagtcaccctgaaatccagcag

SEQ ID NO: 309843 - DNA, 25 bp, Homo sapien
cagagtcaccctgaaatccagcagc

SEQ ID NO: 309844 - DNA, 25 bp, Homo sapien
gtcctccttgaagggctccaggctt

SEQ ID NO: 309845 - DNA, 25 bp, Homo sapien
tccttgaagggctccaggcttcacc

SEQ ID NO: 309846 - DNA, 25 bp, Homo sapien
ccttgaagggctccaggcttcaccc

SEQ ID NO: 309847 - DNA, 25 bp, Homo sapien
agctgaaacaagaggttggagaaca

SEQ ID NO: 309848 - DNA, 25 bp, Homo sapien
aaacaagaggttggagaacagagtc

SEQ ID NO: 309849 - DNA, 25 bp, Homo sapien
acaagaggttggagaacagagtcac

SEQ ID NO: 309850 - DNA, 25 bp, Homo sapien
ggactattaagccaaacaattccta

SEQ ID NO: 309851 - DNA, 25 bp, Homo sapien
ttcacaaaacgacagagggacagct

SEQ ID NO: 309852 - DNA, 25 bp, Homo sapien
actgcgtttcagtccttgacagaca

SEQ ID NO: 309853 - DNA, 25 bp, Homo sapien
gacagacataagtaagggatcaagt

SEQ ID NO: 309854 - DNA, 25 bp, Homo sapien
aaggaatcaacaatgctagcactga

SEQ ID NO: 309855 - DNA, 25 bp, Homo sapien
caggattacggaggagctgtgctct

SEQ ID NO: 309856 - DNA, 25 bp, Homo sapien
gctctgggagcatatatggtgatca

SEQ ID NO: 309857 - DNA, 25 bp, Homo sapien
tggtgatcaatcagatgcatgactt

SEQ ID NO: 309858 - DNA, 25 bp, Homo sapien
gggacagctgtttccatcaaacact

SEQ ID NO: 309859 - DNA, 25 bp, Homo sapien
cagcttcacctgagacgagggcatg

SEQ ID NO: 309860 - DNA, 25 bp, Homo sapien
cgagggcatgactctgggaacatca

SEQ ID NO: 309861 - DNA, 25 bp, Homo sapien
ggccctctgctaaagcccgggcacc

SEQ ID NO: 309862 - DNA, 25 bp, Homo sapien
ctggctctcagtggaggccagagat

SEQ ID NO: 309863 - DNA, 25 bp, Homo sapien
atgctggtggccaccgtgtcccttg

SEQ ID NO: 309864 - DNA, 25 bp, Homo sapien
gtggccaccgtgtcccttgctgcgg

SEQ ID NO: 309865 - DNA, 25 bp, Homo sapien
accgtgtcccttgctgcggctgcat

SEQ ID NO: 309866 - DNA, 25 bp, Homo sapien
gcggctgcatcttccagtctctcct

SEQ ID NO: 309867 - DNA, 25 bp, Homo sapien
gtggccgctctctttataagaaccc

SEQ ID NO: 309868 - DNA, 25 bp, Homo sapien
tggccgctctctttataagaaccct

SEQ ID NO: 309869 - DNA, 25 bp, Homo sapien
gccgctctctttataagaaccctgg

SEQ ID NO: 309870 - DNA, 25 bp, Homo sapien
gctctctttataagaaccctggtca

SEQ ID NO: 309871 - DNA, 25 bp, Homo sapien
ctctttataagaaccctggtcattg

SEQ ID NO: 309872 - DNA, 25 bp, Homo sapien
attgaaataatggtggaaaatgcct

SEQ ID NO: 309873 - DNA, 25 bp, Homo sapien
gaaaatgccttgtaaccgtgcttga

SEQ ID NO: 309874 - DNA, 25 bp, Homo sapien
aaatgccttgtaaccgtgcttgatg

SEQ ID NO: 309875 - DNA, 25 bp, Homo sapien
tgccttgtaaccgtgcttgatgtag

SEQ ID NO: 309876 - DNA, 25 bp, Homo sapien
ccttgtaaccgtgcttgatgtagag

SEQ ID NO: 309877 - DNA, 25 bp, Homo sapien
gtaaccgtgcttgatgtagagtagt

SEQ ID NO: 309878 - DNA, 25 bp, Homo sapien
ccgtgcttgatgtagagtagttact

SEQ ID NO: 309879 - DNA, 25 bp, Homo sapien
gagtagttacttagccagttatttc

SEQ ID NO: 309880 - DNA, 25 bp, Homo sapien
tagttacttagccagttatttcctc

SEQ ID NO: 309881 - DNA, 25 bp, Homo sapien
acgtttggttgctaggaaagagcct

SEQ ID NO: 309882 - DNA, 25 bp, Homo sapien
ttggttgctaggaaagagccttaag

SEQ ID NO: 309883 - DNA, 25 bp, Homo sapien
cattcagatgactccattgaaaaca

SEQ ID NO: 309884 - DNA, 25 bp, Homo sapien
aatgtcagcatggttcctgaaatcc

SEQ ID NO: 309885 - DNA, 25 bp, Homo sapien
aatattgtgtggtagagcaggtgta

SEQ ID NO: 309886 - DNA, 25 bp, Homo sapien
gctggttgtcagctgatagttttta

SEQ ID NO: 309887 - DNA, 25 bp, Homo sapien
gatgatcctcttcaaccctgaggtc

SEQ ID NO: 309888 - DNA, 25 bp, Homo sapien
caaccctgaggtcttaattgtgaga

SEQ ID NO: 309889 - DNA, 25 bp, Homo sapien
gtgagatggattcttgaacctcctt

SEQ ID NO: 309890 - DNA, 25 bp, Homo sapien
cttcctccaccaggatttgaagtaa

SEQ ID NO: 309891 - DNA, 25 bp, Homo sapien
gaaaaatgttttacggtggctgctt

SEQ ID NO: 309892 - DNA, 25 bp, Homo sapien
tacggtggctgcttgtactttatgt

SEQ ID NO: 309893 - DNA, 25 bp, Homo sapien
ggctgcttgtactttatgtgtgtat

SEQ ID NO: 309894 - DNA, 25 bp, Homo sapien
gtggacacacaaagctaatttgata

SEQ ID NO: 309895 - DNA, 25 bp, Homo sapien
gctaatttgatagctcacgccaaac

SEQ ID NO: 309896 - DNA, 25 bp, Homo sapien
tagctcacgccaaacaaagagacat

SEQ ID NO: 309897 - DNA, 25 bp, Homo sapien
ttatctaagaggcttcccacttctt

SEQ ID NO: 309898 - DNA, 25 bp, Homo sapien
gaaaaggctaagttcactgacttta

SEQ ID NO: 309899 - DNA, 25 bp, Homo sapien
gttcactgactttacagattcaatt

SEQ ID NO: 309900 - DNA, 25 bp, Homo sapien
attatggatggctggtttttatttc

SEQ ID NO: 309901 - DNA, 25 bp, Homo sapien
tttttatttctctacccattggcct

SEQ ID NO: 309902 - DNA, 25 bp, Homo sapien
tctctacccattggccttggtgaca

SEQ ID NO: 309903 - DNA, 25 bp, Homo sapien
ttggtgacatcatgacattcccctg

SEQ ID NO: 309904 - DNA, 25 bp, Homo sapien
tgacattcccctgagtttggttaat

SEQ ID NO: 309905 - DNA, 25 bp, Homo sapien
ggcccagaaccctgcagatgaagcc

SEQ ID NO: 309906 - DNA, 25 bp, Homo sapien
agaaccctgcagatgaagccacaga

SEQ ID NO: 309907 - DNA, 25 bp, Homo sapien
gaagccacagagcaggcgctcgacc

SEQ ID NO: 309908 - DNA, 25 bp, Homo sapien
agagcaggcgctcgaccagacccat

SEQ ID NO: 309909 - DNA, 25 bp, Homo sapien
gagggcacggaaacctgtgccgaga

SEQ ID NO: 309910 - DNA, 25 bp, Homo sapien
agaggagatccccagagtcagggag

SEQ ID NO: 309911 - DNA, 25 bp, Homo sapien
agggtggcagcgagggcagggcagc

SEQ ID NO: 309912 - DNA, 25 bp, Homo sapien
cctgtccttgggagagggcgtcacc

SEQ ID NO: 309913 - DNA, 25 bp, Homo sapien
gtcacccggtcagagactccaaata

SEQ ID NO: 309914 - DNA, 25 bp, Homo sapien
gtcagagactccaaataaaccggtt

SEQ ID NO: 309915 - DNA, 25 bp, Homo sapien
gagactccaaataaaccggttcttg

SEQ ID NO: 309916 - DNA, 25 bp, Homo sapien
gatgaatccataatgtctggaactt

SEQ ID NO: 309917 - DNA, 25 bp, Homo sapien
tctggaactttgctgagacatgagt

SEQ ID NO: 309918 - DNA, 25 bp, Homo sapien
atgagtgggcacagttttcattgta

SEQ ID NO: 309919 - DNA, 25 bp, Homo sapien
cagagtggatattcatgcgattatg

SEQ ID NO: 309920 - DNA, 25 bp, Homo sapien
catgcgattatgaagtgtttattag

SEQ ID NO: 309921 - DNA, 25 bp, Homo sapien
gtgtttattagttaccattggcgac

SEQ ID NO: 309922 - DNA, 25 bp, Homo sapien
ttaccattggcgacctagcatgctt

SEQ ID NO: 309923 - DNA, 25 bp, Homo sapien
gacctagcatgcttctcatttcaaa

SEQ ID NO: 309924 - DNA, 25 bp, Homo sapien
gcatgcttctcatttcaaaccttgg

SEQ ID NO: 309925 - DNA, 25 bp, Homo sapien
ttctcatttcaaaccttggaaggtg

SEQ ID NO: 309926 - DNA, 25 bp, Homo sapien
gaaaatgtacaaactctctaaataa

SEQ ID NO: 309927 - DNA, 25 bp, Homo sapien
gggacgtcctccagtatgttctgtt

SEQ ID NO: 309928 - DNA, 25 bp, Homo sapien
tatttttcactgttggttgcaatcc

SEQ ID NO: 309929 - DNA, 25 bp, Homo sapien
tgactttgggatccactcatgggtg

SEQ ID NO: 309930 - DNA, 25 bp, Homo sapien
cacctttctgttgtgccttgcattt

SEQ ID NO: 309931 - DNA, 25 bp, Homo sapien
gttgtgccttgcatttgtccacaca

SEQ ID NO: 309932 - DNA, 25 bp, Homo sapien
gcatttgtccacacacagggagtct

SEQ ID NO: 309933 - DNA, 25 bp, Homo sapien
acacacagggagtctggctgagctg

SEQ ID NO: 309934 - DNA, 25 bp, Homo sapien
aaaggccacggctgggtgtcattgc

SEQ ID NO: 309935 - DNA, 25 bp, Homo sapien
acggctgggtgtcattgccattttc

SEQ ID NO: 309936 - DNA, 25 bp, Homo sapien
gggtgtcattgccattttcccagct

SEQ ID NO: 309937 - DNA, 25 bp, Homo sapien
cagctcatctcaccgggaagaaaag

SEQ ID NO: 309938 - DNA, 25 bp, Homo sapien
gtgcattgaatgaacagcgggacat

SEQ ID NO: 309939 - DNA, 25 bp, Homo sapien
atgaacagcgggacattggacacct

SEQ ID NO: 309940 - DNA, 25 bp, Homo sapien
aacagcgggacattggacacctgct

SEQ ID NO: 309941 - DNA, 25 bp, Homo sapien
agcgggacattggacacctgctgat

SEQ ID NO: 309942 - DNA, 25 bp, Homo sapien
gggacattggacacctgctgatcca

SEQ ID NO: 309943 - DNA, 25 bp, Homo sapien
acattggacacctgctgatccatca

SEQ ID NO: 309944 - DNA, 25 bp, Homo sapien
attggacacctgctgatccatcacc

SEQ ID NO: 309945 - DNA, 25 bp, Homo sapien
cgggcaggcccgtggatgaagagag

SEQ ID NO: 309946 - DNA, 25 bp, Homo sapien
tggagaagaccaggcatgagactgt

SEQ ID NO: 309947 - DNA, 25 bp, Homo sapien
agaccaggcatgagactgtggagaa

SEQ ID NO: 309948 - DNA, 25 bp, Homo sapien
aggcatgagactgtggagaagccac

SEQ ID NO: 309949 - DNA, 25 bp, Homo sapien
atggttttccatagtcacatttgtt

SEQ ID NO: 309950 - DNA, 25 bp, Homo sapien
ggttttccatagtcacatttgttaa

SEQ ID NO: 309951 - DNA, 25 bp, Homo sapien
gtcacatttgttaaagagtccagtt

SEQ ID NO: 309952 - DNA, 25 bp, Homo sapien
tgttaaagagtccagttgatgggca

SEQ ID NO: 309953 - DNA, 25 bp, Homo sapien
ctgggatgcatgaagactttccaag

SEQ ID NO: 309954 - DNA, 25 bp, Homo sapien
gatgcatgaagactttccaaggaaa

SEQ ID NO: 309955 - DNA, 25 bp, Homo sapien
ctttccaaggaaaacgcagacaagg

SEQ ID NO: 309956 - DNA, 25 bp, Homo sapien
aaacgcagacaaggaacattctatc

SEQ ID NO: 309957 - DNA, 25 bp, Homo sapien
gcagacaaggaacattctatccaca

SEQ ID NO: 309958 - DNA, 25 bp, Homo sapien
atacaccaagacagaccatagtctg

SEQ ID NO: 309959 - DNA, 25 bp, Homo sapien
gtttatgatatgaataatctcccct

SEQ ID NO: 309960 - DNA, 25 bp, Homo sapien
aatagtgggtataagcatagctctg

SEQ ID NO: 309961 - DNA, 25 bp, Homo sapien
tataagcatagctctgttacatgga

SEQ ID NO: 309962 - DNA, 25 bp, Homo sapien
gctgagcttttagtgtgatcatcac

SEQ ID NO: 309963 - DNA, 25 bp, Homo sapien
aattaatttcttatcacctgaccct

SEQ ID NO: 309964 - DNA, 25 bp, Homo sapien
cttatcacctgaccctatttttgtt

SEQ ID NO: 309965 - DNA, 25 bp, Homo sapien
tctcataccaagaaacttcctaagt

SEQ ID NO: 309966 - DNA, 25 bp, Homo sapien
gttaaccatcaaaattagtccttct

SEQ ID NO: 309967 - DNA, 25 bp, Homo sapien
aaaattagtccttctgtcatctctc

SEQ ID NO: 309968 - DNA, 25 bp, Homo sapien
gtcatctctcttagcatacttattt

SEQ ID NO: 309969 - DNA, 25 bp, Homo sapien
atacttatttcccttatgtgatgcc

SEQ ID NO: 309970 - DNA, 25 bp, Homo sapien
atttcccttatgtgatgcctaataa

SEQ ID NO: 309971 - DNA, 25 bp, Homo sapien
gtatagtcacaatattgagcttgtt

SEQ ID NO: 309972 - DNA, 25 bp, Homo sapien
gagcttgttgattatctccttcaga

SEQ ID NO: 309973 - DNA, 25 bp, Homo sapien
gattatctccttcagatccctaata

SEQ ID NO: 309974 - DNA, 25 bp, Homo sapien
ttcagatccctaatatgtttccttt

SEQ ID NO: 309975 - DNA, 25 bp, Homo sapien
tgtttcctttagcttacttgacctg

SEQ ID NO: 309976 - DNA, 25 bp, Homo sapien
cctttagcttacttgacctgtcaga

SEQ ID NO: 309977 - DNA, 25 bp, Homo sapien
aattaaaattttccactgtgatcag

SEQ ID NO: 309978 - DNA, 25 bp, Homo sapien
cagattttatcatgttctctttgta

SEQ ID NO: 309979 - DNA, 25 bp, Homo sapien
aactcatctttcttgtgttttaggt

SEQ ID NO: 309980 - DNA, 25 bp, Homo sapien
gaggtgcctttgcaactagatgtcc

SEQ ID NO: 309981 - DNA, 25 bp, Homo sapien
aactagatgtcccagtgacataaga

SEQ ID NO: 309982 - DNA, 25 bp, Homo sapien
aagaccagctccaggcggacgacgt

SEQ ID NO: 309983 - DNA, 25 bp, Homo sapien
gggcaatgggaccacccgtcgcaac

SEQ ID NO: 309984 - DNA, 25 bp, Homo sapien
tgagggtgcagccaaaggctcctac

SEQ ID NO: 309985 - DNA, 25 bp, Homo sapien
aaggctcctactgaagtggcgcata

SEQ ID NO: 309986 - DNA, 25 bp, Homo sapien
gtggcgcataactgacgctgtgtgt

SEQ ID NO: 309987 - DNA, 25 bp, Homo sapien
actgacgctgtgtgtgtcaggacgc

SEQ ID NO: 309988 - DNA, 25 bp, Homo sapien
gtcaggacgcgaggaaaacgctgca

SEQ ID NO: 309989 - DNA, 25 bp, Homo sapien
aaacgctgcacttacagggagaggt

SEQ ID NO: 309990 - DNA, 25 bp, Homo sapien
agaggtggtcactttgtttacggag

SEQ ID NO: 309991 - DNA, 25 bp, Homo sapien
tcactttgtttacggagtttggaag

SEQ ID NO: 309992 - DNA, 25 bp, Homo sapien
agaggaagctcaacacagagacctt

SEQ ID NO: 309993 - DNA, 25 bp, Homo sapien
gacttttcctccaggtgggaagaga

SEQ ID NO: 309994 - DNA, 25 bp, Homo sapien
tagttgtttatcaagtgacatttag

SEQ ID NO: 309995 - DNA, 25 bp, Homo sapien
gtgacatttagttgtttggttttgg

SEQ ID NO: 309996 - DNA, 25 bp, Homo sapien
ttttttgattgcgatttttcctctg

SEQ ID NO: 309997 - DNA, 25 bp, Homo sapien
tttgattgcgatttttcctctgatt

SEQ ID NO: 309998 - DNA, 25 bp, Homo sapien
aactataaggagatggcctttcctc

SEQ ID NO: 309999 - DNA, 25 bp, Homo sapien
tgaccaaaagaattacacagcatta

SEQ ID NO: 310000 - DNA, 25 bp, Homo sapien
aatggaagttttccacttccttgat

SEQ ID NO: 310001 - DNA, 25 bp, Homo sapien
agttttccacttccttgataatttg

SEQ ID NO: 310002 - DNA, 25 bp, Homo sapien
tccacttccttgataatttggctat

SEQ ID NO: 310003 - DNA, 25 bp, Homo sapien
tccttgataatttggctatctgaat

SEQ ID NO: 310004 - DNA, 25 bp, Homo sapien
tattgcagatcgaagcaagcagttc

SEQ ID NO: 310005 - DNA, 25 bp, Homo sapien
aagcagttcagagtctatgaggcct

SEQ ID NO: 310006 - DNA, 25 bp, Homo sapien
agaagctccatctgaacagactcct

SEQ ID NO: 310007 - DNA, 25 bp, Homo sapien
aaccttcatgagacccacagtgtgt

SEQ ID NO: 310008 - DNA, 25 bp, Homo sapien
acagtgtgtgatgggccaccacagc

SEQ ID NO: 310009 - DNA, 25 bp, Homo sapien
acagcactggcttctagacttttac

SEQ ID NO: 310010 - DNA, 25 bp, Homo sapien
tagacttttacagggaagccagtga

SEQ ID NO: 310011 - DNA, 25 bp, Homo sapien
gaagccagtgaacaaattacctcgt

SEQ ID NO: 310012 - DNA, 25 bp, Homo sapien
gaacaaattacctcgtcacccagaa

SEQ ID NO: 310013 - DNA, 25 bp, Homo sapien
aagagctcaggaactattttggaag

SEQ ID NO: 310014 - DNA, 25 bp, Homo sapien
ggaagttccttccagtctaagacta

SEQ ID NO: 310015 - DNA, 25 bp, Homo sapien
taccactctaaagtcttttcttcag

SEQ ID NO: 310016 - DNA, 25 bp, Homo sapien
ttttcttcagatgcagtcatgttct

SEQ ID NO: 310017 - DNA, 25 bp, Homo sapien
gggcttcaacttacgaatttggtga

SEQ ID NO: 310018 - DNA, 25 bp, Homo sapien
ggtgagttcacagttcagcctgtaa

SEQ ID NO: 310019 - DNA, 25 bp, Homo sapien
gtaacacatttcttcaggatttcca

SEQ ID NO: 310020 - DNA, 25 bp, Homo sapien
aggatttccagagcgtgcacagttt

SEQ ID NO: 310021 - DNA, 25 bp, Homo sapien
agcgtgcacagttttgagcagaaaa

SEQ ID NO: 310022 - DNA, 25 bp, Homo sapien
ttccagcaagctgtcatagacttga

SEQ ID NO: 310023 - DNA, 25 bp, Homo sapien
gggccccactgagaaagatgacaag

SEQ ID NO: 310024 - DNA, 25 bp, Homo sapien
atcagcaagtgattcggtgcaccca

SEQ ID NO: 310025 - DNA, 25 bp, Homo sapien
tgattcggtgcacccagcaaactta

SEQ ID NO: 310026 - DNA, 25 bp, Homo sapien
aagctctcccctcagggaaactatg

SEQ ID NO: 310027 - DNA, 25 bp, Homo sapien
cagagacgctttgtgcagttcaatg

SEQ ID NO: 310028 - DNA, 25 bp, Homo sapien
gtctgatgtactttggcagtgacaa

SEQ ID NO: 310029 - DNA, 25 bp, Homo sapien
gtgtgatacctttgactgccattga

SEQ ID NO: 310030 - DNA, 25 bp, Homo sapien
gagatgacccgcagcagcaaggaca

SEQ ID NO: 310031 - DNA, 25 bp, Homo sapien
aggacaacaagttccaggtcatcac

SEQ ID NO: 310032 - DNA, 25 bp, Homo sapien
atcaccggccagagggtgttcgtgt

SEQ ID NO: 310033 - DNA, 25 bp, Homo sapien
agggtgttcgtgttccgcacagaga

SEQ ID NO: 310034 - DNA, 25 bp, Homo sapien
gttccgcacagagagcgaggctcag

SEQ ID NO: 310035 - DNA, 25 bp, Homo sapien
tcagcgggacatgtggtgctccacg

SEQ ID NO: 310036 - DNA, 25 bp, Homo sapien
tcagtggctggctagacaagctctc

SEQ ID NO: 310037 - DNA, 25 bp, Homo sapien
gtgtttacttaaactgtgctgctaa

SEQ ID NO: 310038 - DNA, 25 bp, Homo sapien
cattgttgaaagtaaccgtcgtcag

SEQ ID NO: 310039 - DNA, 25 bp, Homo sapien
accgtcgtcagaaccccgctttgag

SEQ ID NO: 310040 - DNA, 25 bp, Homo sapien
tggagctggtccagccttcaacttc

SEQ ID NO: 310041 - DNA, 25 bp, Homo sapien
ttcaacttccgagcgagcgcggagc

SEQ ID NO: 310042 - DNA, 25 bp, Homo sapien
aagctacagaaaccttccaactgct

SEQ ID NO: 310043 - DNA, 25 bp, Homo sapien
tgttactagcgtgtgattgtccttc

SEQ ID NO: 310044 - DNA, 25 bp, Homo sapien
tgattgtccttctgcctcagatctt

SEQ ID NO: 310045 - DNA, 25 bp, Homo sapien
cagatcttctgtctcattcgataca

SEQ ID NO: 310046 - DNA, 25 bp, Homo sapien
gggactgatgtttacatctttggaa

SEQ ID NO: 310047 - DNA, 25 bp, Homo sapien
gacaagcatctcaaccacagttttt

SEQ ID NO: 310048 - DNA, 25 bp, Homo sapien
gatgggtgcctactgtgatgcattt

SEQ ID NO: 310049 - DNA, 25 bp, Homo sapien
tgcattttaccaggcattttacctt

SEQ ID NO: 310050 - DNA, 25 bp, Homo sapien
ttaccttcattattactcatctcta

SEQ ID NO: 310051 - DNA, 25 bp, Homo sapien
tctctattgtgataaccaggctccc

SEQ ID NO: 310052 - DNA, 25 bp, Homo sapien
ttgtgataaccaggctcccatttaa

SEQ ID NO: 310053 - DNA, 25 bp, Homo sapien
caggctcccatttaactgagtataa

SEQ ID NO: 310054 - DNA, 25 bp, Homo sapien
gatttctctaaggtcatcaaactat

SEQ ID NO: 310055 - DNA, 25 bp, Homo sapien
agtttttccactttaccttcatgat

SEQ ID NO: 310056 - DNA, 25 bp, Homo sapien
catgtattagctgtgttttagtgag

SEQ ID NO: 310057 - DNA, 25 bp, Homo sapien
gaatgaattgctatccatcataatt

SEQ ID NO: 310058 - DNA, 25 bp, Homo sapien
gctatccatcataatttttgctgtt

SEQ ID NO: 310059 - DNA, 25 bp, Homo sapien
gtgccatcagctctttggagtgaac

SEQ ID NO: 310060 - DNA, 25 bp, Homo sapien
tttaggtggtctttccatcccttca

SEQ ID NO: 310061 - DNA, 25 bp, Homo sapien
gtctttccatcccttcagatttaag

SEQ ID NO: 310062 - DNA, 25 bp, Homo sapien
agagacagacctacattccaagggt

SEQ ID NO: 310063 - DNA, 25 bp, Homo sapien
ttccaagggtcttctgagtgcaagg

SEQ ID NO: 310064 - DNA, 25 bp, Homo sapien
gtcttctgagtgcaaggccttgtgt

SEQ ID NO: 310065 - DNA, 25 bp, Homo sapien
gggaagcctgaacacagtcctataa

SEQ ID NO: 310066 - DNA, 25 bp, Homo sapien
agtcctataaactaaaggccactgc

SEQ ID NO: 310067 - DNA, 25 bp, Homo sapien
aggccactgcagacttttagcacaa

SEQ ID NO: 310068 - DNA, 25 bp, Homo sapien
agacttttagcacaaggagatcctt

SEQ ID NO: 310069 - DNA, 25 bp, Homo sapien
atccttacagggaacatgtgccatc

SEQ ID NO: 310070 - DNA, 25 bp, Homo sapien
gccagcgtgacgacagcggctgctc

SEQ ID NO: 310071 - DNA, 25 bp, Homo sapien
caagcggccatcacggcaagggact

SEQ ID NO: 310072 - DNA, 25 bp, Homo sapien
gcaagggactaaccgtcgtgtaact

SEQ ID NO: 310073 - DNA, 25 bp, Homo sapien
taaccgtcgtgtaactactgtctgc

SEQ ID NO: 310074 - DNA, 25 bp, Homo sapien
gtcgtgtaactactgtctgccacaa

SEQ ID NO: 310075 - DNA, 25 bp, Homo sapien
gtgtaactactgtctgccacaaaaa

SEQ ID NO: 310076 - DNA, 25 bp, Homo sapien
tgtctgccacaaaaatctctattat

SEQ ID NO: 310077 - DNA, 25 bp, Homo sapien
aatgcttttgttcctaatatattgg

SEQ ID NO: 310078 - DNA, 25 bp, Homo sapien
atatattgggacatcgggacatttc

SEQ ID NO: 310079 - DNA, 25 bp, Homo sapien
tgggacatcgggacatttcctgggt

SEQ ID NO: 310080 - DNA, 25 bp, Homo sapien
acatcgggacatttcctgggtctgt

SEQ ID NO: 310081 - DNA, 25 bp, Homo sapien
tggtgatgccagtggaaccccaggg

SEQ ID NO: 310082 - DNA, 25 bp, Homo sapien
ggtgtttggcgttctgctctctggc

SEQ ID NO: 310083 - DNA, 25 bp, Homo sapien
tgtttggcgttctgctctctggctg

SEQ ID NO: 310084 - DNA, 25 bp, Homo sapien
tttggcgttctgctctctggctggc

SEQ ID NO: 310085 - DNA, 25 bp, Homo sapien
tggcgttctgctctctggctggcct

SEQ ID NO: 310086 - DNA, 25 bp, Homo sapien
cgttctgctctctggctggccttca

SEQ ID NO: 310087 - DNA, 25 bp, Homo sapien
tcctccacctgaaaattccacttag

SEQ ID NO: 310088 - DNA, 25 bp, Homo sapien
ctccacctgaaaattccacttagca

SEQ ID NO: 310089 - DNA, 25 bp, Homo sapien
cacctgaaaattccacttagcacgg

SEQ ID NO: 310090 - DNA, 25 bp, Homo sapien
acctgaaaattccacttagcacggc

SEQ ID NO: 310091 - DNA, 25 bp, Homo sapien
cctgaaaattccacttagcacggcg

SEQ ID NO: 310092 - DNA, 25 bp, Homo sapien
tttaccctggcttccatctacacta

SEQ ID NO: 310093 - DNA, 25 bp, Homo sapien
tggcttccatctacactactccgga

SEQ ID NO: 310094 - DNA, 25 bp, Homo sapien
acactactccggatgacagtaatga

SEQ ID NO: 310095 - DNA, 25 bp, Homo sapien
aagagcacagaattgaagctgttga

SEQ ID NO: 310096 - DNA, 25 bp, Homo sapien
gaagctgttgagctatgatctcata

SEQ ID NO: 310097 - DNA, 25 bp, Homo sapien
tatgatctcatagccaccgatattt

SEQ ID NO: 310098 - DNA, 25 bp, Homo sapien
agccaccgatatttctcgctaagaa

SEQ ID NO: 310099 - DNA, 25 bp, Homo sapien
gatatttctcgctaagaagacagag

SEQ ID NO: 310100 - DNA, 25 bp, Homo sapien
gaggaagcaatccatgggaactact

SEQ ID NO: 310101 - DNA, 25 bp, Homo sapien
catgggaactacttatccacagtta

SEQ ID NO: 310102 - DNA, 25 bp, Homo sapien
actacttatccacagttaaacaaga

SEQ ID NO: 310103 - DNA, 25 bp, Homo sapien
gactctgatcaagcatttctgggca

SEQ ID NO: 310104 - DNA, 25 bp, Homo sapien
tttctgggcattcttctgctaaaac

SEQ ID NO: 310105 - DNA, 25 bp, Homo sapien
gcattcttctgctaaaactttgggt

SEQ ID NO: 310106 - DNA, 25 bp, Homo sapien
taatacgcatctcataatacgcaga

SEQ ID NO: 310107 - DNA, 25 bp, Homo sapien
gttatggttcattggcactctagaa

SEQ ID NO: 310108 - DNA, 25 bp, Homo sapien
gtaaaatgtcttgcacatccccaaa

SEQ ID NO: 310109 - DNA, 25 bp, Homo sapien
ttgcacatccccaaatactgttgcc

SEQ ID NO: 310110 - DNA, 25 bp, Homo sapien
aaatactgttgccagtgacctttgc

SEQ ID NO: 310111 - DNA, 25 bp, Homo sapien
gtgacctttgctcttaaccgaccca

SEQ ID NO: 310112 - DNA, 25 bp, Homo sapien
acttctgctttgactgaccacttcc

SEQ ID NO: 310113 - DNA, 25 bp, Homo sapien
ttccacttctcagtagccattgctt

SEQ ID NO: 310114 - DNA, 25 bp, Homo sapien
acccctggcgcctgacatgagccct

SEQ ID NO: 310115 - DNA, 25 bp, Homo sapien
ctcaacctgagcctggcgggcgagg

SEQ ID NO: 310116 - DNA, 25 bp, Homo sapien
agcctggcgggcgaggcgaccacat

SEQ ID NO: 310117 - DNA, 25 bp, Homo sapien
gggcgaggcgaccacatgcgcggcg

SEQ ID NO: 310118 - DNA, 25 bp, Homo sapien
tgggtccccaacacgtcggccgtgc

SEQ ID NO: 310119 - DNA, 25 bp, Homo sapien
aacacgtcggccgtgccgccgtcgg

SEQ ID NO: 310120 - DNA, 25 bp, Homo sapien
tgcccatcttctccatgacgctggg

SEQ ID NO: 310121 - DNA, 25 bp, Homo sapien
atcttctccatgacgctgggcgccg

SEQ ID NO: 310122 - DNA, 25 bp, Homo sapien
ctgggcgccgtgtccaacctgctgg

SEQ ID NO: 310123 - DNA, 25 bp, Homo sapien
gccgtgtccaacctgctggcgctgg

SEQ ID NO: 310124 - DNA, 25 bp, Homo sapien
cggcagggctgagcggccggtgatg

SEQ ID NO: 310125 - DNA, 25 bp, Homo sapien
tgctgagaaagtccccaccaccaag

SEQ ID NO: 310126 - DNA, 25 bp, Homo sapien
accaagtccacactctggcaggaag

SEQ ID NO: 310127 - DNA, 25 bp, Homo sapien
agtccacactctggcaggaagaaat

SEQ ID NO: 310128 - DNA, 25 bp, Homo sapien
aatgaggaccaaggaccagccagat

SEQ ID NO: 310129 - DNA, 25 bp, Homo sapien
gaccaaggaccagccagatggcagc

SEQ ID NO: 310130 - DNA, 25 bp, Homo sapien
atggcagcagcctgagtccagctca

SEQ ID NO: 310131 - DNA, 25 bp, Homo sapien
ctgcgggaacctgggctagagagca

SEQ ID NO: 310132 - DNA, 25 bp, Homo sapien
agagcgccatgagtagcgaccgcat

SEQ ID NO: 310133 - DNA, 25 bp, Homo sapien
catgagtagcgaccgcatggactgt

SEQ ID NO: 310134 - DNA, 25 bp, Homo sapien
tggagagcggctacttctctctgga

SEQ ID NO: 310135 - DNA, 25 bp, Homo sapien
gaagaccaaacaggacttgaaggct

SEQ ID NO: 310136 - DNA, 25 bp, Homo sapien
gttcatattcttctgttcaacagac

SEQ ID NO: 310137 - DNA, 25 bp, Homo sapien
tttctcctctcccttgaataagaaa

SEQ ID NO: 310138 - DNA, 25 bp, Homo sapien
gttttccattcctatgaactgtcta

SEQ ID NO: 310139 - DNA, 25 bp, Homo sapien
attcctatgaactgtctaatatctt

SEQ ID NO: 310140 - DNA, 25 bp, Homo sapien
gaactgtctaatatctttctattac

SEQ ID NO: 310141 - DNA, 25 bp, Homo sapien
ggctgggaaaggctaaatgacttat

SEQ ID NO: 310142 - DNA, 25 bp, Homo sapien
aggctaaatgacttatcctccatca

SEQ ID NO: 310143 - DNA, 25 bp, Homo sapien
ttatcctccatcagttataacagcc

SEQ ID NO: 310144 - DNA, 25 bp, Homo sapien
atcagttataacagcccctggtctt

SEQ ID NO: 310145 - DNA, 25 bp, Homo sapien
ttataacagcccctggtcttcttaa

SEQ ID NO: 310146 - DNA, 25 bp, Homo sapien
gctttcttgttgcatatatgcacag

SEQ ID NO: 310147 - DNA, 25 bp, Homo sapien
tgttttctttcctcagaccgaaact

SEQ ID NO: 310148 - DNA, 25 bp, Homo sapien
ggaagatagagcatgccccgtacac

SEQ ID NO: 310149 - DNA, 25 bp, Homo sapien
tacactcctctctggttttcttcct

SEQ ID NO: 310150 - DNA, 25 bp, Homo sapien
agccgacagtctgccttgcagtgaa

SEQ ID NO: 310151 - DNA, 25 bp, Homo sapien
tgtaatccacaagccgaagaaccca

SEQ ID NO: 310152 - DNA, 25 bp, Homo sapien
gccgaagaacccatgtttttctttg

SEQ ID NO: 310153 - DNA, 25 bp, Homo sapien
tggaaaaggctacgccctttcaggg

SEQ ID NO: 310154 - DNA, 25 bp, Homo sapien
gggtttccttttctcggctgtgttg

SEQ ID NO: 310155 - DNA, 25 bp, Homo sapien
gaaggaggcatgtgatcaccatcaa

SEQ ID NO: 310156 - DNA, 25 bp, Homo sapien
agtcttctgctctgggaaggatcac

SEQ ID NO: 310157 - DNA, 25 bp, Homo sapien
aaggatcacacagtcgtccttcagc

SEQ ID NO: 310158 - DNA, 25 bp, Homo sapien
cagagggttgccactggctgctaga

SEQ ID NO: 310159 - DNA, 25 bp, Homo sapien
gctgctagatttgttcttctgcatt

SEQ ID NO: 310160 - DNA, 25 bp, Homo sapien
ttctgcattttatcctaagtgacgg

SEQ ID NO: 310161 - DNA, 25 bp, Homo sapien
gtaggcaatggattttgctcaggct

SEQ ID NO: 310162 - DNA, 25 bp, Homo sapien
gctcaggctgattagaggcttacat

SEQ ID NO: 310163 - DNA, 25 bp, Homo sapien
aaatgctttcgatcacacctctgta

SEQ ID NO: 310164 - DNA, 25 bp, Homo sapien
ctttcgatcacacctctgtagagat

SEQ ID NO: 310165 - DNA, 25 bp, Homo sapien
tctgtagagatgtttgcctttccct

SEQ ID NO: 310166 - DNA, 25 bp, Homo sapien
tgcctttccctgtcattcaagaata

SEQ ID NO: 310167 - DNA, 25 bp, Homo sapien
gaatatgcgacctatagagttacgt

SEQ ID NO: 310168 - DNA, 25 bp, Homo sapien
agagttacgttgacttttcagtgtt

SEQ ID NO: 310169 - DNA, 25 bp, Homo sapien
tttcttatccaattgcaggtttgtt

SEQ ID NO: 310170 - DNA, 25 bp, Homo sapien
aaagcatgctttttgttcaggaatt

SEQ ID NO: 310171 - DNA, 25 bp, Homo sapien
tttttgaggcacactttagcagaaa

SEQ ID NO: 310172 - DNA, 25 bp, Homo sapien
gaggcacactttagcagaaatgatt

SEQ ID NO: 310173 - DNA, 25 bp, Homo sapien
aaatgattgacctaggcctgttgca

SEQ ID NO: 310174 - DNA, 25 bp, Homo sapien
gaagactatctcctcactgaagacg

SEQ ID NO: 310175 - DNA, 25 bp, Homo sapien
attgacctaggcctgttgcattaaa

SEQ ID NO: 310176 - DNA, 25 bp, Homo sapien
acctaggcctgttgcattaaaagct

SEQ ID NO: 310177 - DNA, 25 bp, Homo sapien
gcattaaaagcttacttctatttct

SEQ ID NO: 310178 - DNA, 25 bp, Homo sapien
tctcctcactgaagacgattcccat

SEQ ID NO: 310179 - DNA, 25 bp, Homo sapien
gattgacggttatcttttgtatctt

SEQ ID NO: 310180 - DNA, 25 bp, Homo sapien
gatggccaataaaacttaaaggtgt

SEQ ID NO: 310181 - DNA, 25 bp, Homo sapien
aaaggtgtggttagatgttttctca

SEQ ID NO: 310182 - DNA, 25 bp, Homo sapien
atgttttctcacttttgtgacatta

SEQ ID NO: 310183 - DNA, 25 bp, Homo sapien
gacattaatttatcactgagtctca

SEQ ID NO: 310184 - DNA, 25 bp, Homo sapien
tcactgagtctcattcaaccaagta

SEQ ID NO: 310185 - DNA, 25 bp, Homo sapien
gcaaattctagcagtatgtcttcga

SEQ ID NO: 310186 - DNA, 25 bp, Homo sapien
gtatgtcttcgataacttggatgtt

SEQ ID NO: 310187 - DNA, 25 bp, Homo sapien
ggatgttaggatagccaatatgtac

SEQ ID NO: 310188 - DNA, 25 bp, Homo sapien
agtattttgtcctatgtataacaca

SEQ ID NO: 310189 - DNA, 25 bp, Homo sapien
taggcaagtgaaattctggtaattc

SEQ ID NO: 310190 - DNA, 25 bp, Homo sapien
ggtaattcatactatttctttgtat

SEQ ID NO: 310191 - DNA, 25 bp, Homo sapien
tcacctgtggcgatcgacgcagcaa

SEQ ID NO: 310192 - DNA, 25 bp, Homo sapien
atcgacgcagcaagcctgggtgtgc

SEQ ID NO: 310193 - DNA, 25 bp, Homo sapien
caagcctgggtgtgctaagaattga

SEQ ID NO: 310194 - DNA, 25 bp, Homo sapien
taagaattgaggctctctctccttc

SEQ ID NO: 310195 - DNA, 25 bp, Homo sapien
tggccttggagcaccgggaagaatt

SEQ ID NO: 310196 - DNA, 25 bp, Homo sapien
taaccggtgcctaagttttcaatcg

SEQ ID NO: 310197 - DNA, 25 bp, Homo sapien
agttttcaatcggatcattcttctc

SEQ ID NO: 310198 - DNA, 25 bp, Homo sapien
tcttctcaacttgggcggctctttc

SEQ ID NO: 310199 - DNA, 25 bp, Homo sapien
agagcaaacacagaggccctaaatg

SEQ ID NO: 310200 - DNA, 25 bp, Homo sapien
acagaggccctaaatgtctcgaggc

SEQ ID NO: 310201 - DNA, 25 bp, Homo sapien
tcgaggcctcttcacctgtggcgat

SEQ ID NO: 310202 - DNA, 25 bp, Homo sapien
gtgagacaaaaccaatgtccacgcc

SEQ ID NO: 310203 - DNA, 25 bp, Homo sapien
gaaaaatcctgtaagtatgctgaac

SEQ ID NO: 310204 - DNA, 25 bp, Homo sapien
tatgctgaacatgaaaggacctgga

SEQ ID NO: 310205 - DNA, 25 bp, Homo sapien
ggacctggaagcagtagtgtgtctt

SEQ ID NO: 310206 - DNA, 25 bp, Homo sapien
tagtgtgtcttcagcctttaccaaa

SEQ ID NO: 310207 - DNA, 25 bp, Homo sapien
gcctttaccaaattatccctacttg

SEQ ID NO: 310208 - DNA, 25 bp, Homo sapien
accaaattatccctacttgagagaa

SEQ ID NO: 310209 - DNA, 25 bp, Homo sapien
atccctacttgagagaaaacttgga

SEQ ID NO: 310210 - DNA, 25 bp, Homo sapien
tggcacaaatttcaaccagtttttt

SEQ ID NO: 310211 - DNA, 25 bp, Homo sapien
ttttaaacagactacacatctttga

SEQ ID NO: 310212 - DNA, 25 bp, Homo sapien
gactacacatctttgaaatcatact

SEQ ID NO: 310213 - DNA, 25 bp, Homo sapien
ttaattcatgtttgtctcgccatgc

SEQ ID NO: 310214 - DNA, 25 bp, Homo sapien
aattcatgtttgtctcgccatgctt

SEQ ID NO: 310215 - DNA, 25 bp, Homo sapien
gtctcgccatgcttctttactttaa

SEQ ID NO: 310216 - DNA, 25 bp, Homo sapien
gccatgcttctttactttaacatat

SEQ ID NO: 310217 - DNA, 25 bp, Homo sapien
aacatatttcttttgcagaatgtaa

SEQ ID NO: 310218 - DNA, 25 bp, Homo sapien
gtttatataagtgtactggctgtaa

SEQ ID NO: 310219 - DNA, 25 bp, Homo sapien
gtgtactggctgtaaatgatgctaa

SEQ ID NO: 310220 - DNA, 25 bp, Homo sapien
ctggctgtaaatgatgctaaatata

SEQ ID NO: 310221 - DNA, 25 bp, Homo sapien
ctccacattttattgcttctggatg

SEQ ID NO: 310222 - DNA, 25 bp, Homo sapien
atttctgctgttatataaagtgcca

SEQ ID NO: 310223 - DNA, 25 bp, Homo sapien
ctgctgttatataaagtgccatact

SEQ ID NO: 310224 - DNA, 25 bp, Homo sapien
ggtggattatgccaaaatttctaga

SEQ ID NO: 310225 - DNA, 25 bp, Homo sapien
gattgttgctatggaaaggagccaa

SEQ ID NO: 310226 - DNA, 25 bp, Homo sapien
aggagccaaaacttccagctgttgc

SEQ ID NO: 310227 - DNA, 25 bp, Homo sapien
aaaacttccagctgttgccttagca

SEQ ID NO: 310228 - DNA, 25 bp, Homo sapien
gttgccttagcaatggtaacctgac

SEQ ID NO: 310229 - DNA, 25 bp, Homo sapien
tggtaacctgacgtggcactggtga

SEQ ID NO: 310230 - DNA, 25 bp, Homo sapien
gtgtgttttatggagagactctttc

SEQ ID NO: 310231 - DNA, 25 bp, Homo sapien
gtcttcagtgtggtctggagcccaa

SEQ ID NO: 310232 - DNA, 25 bp, Homo sapien
gtagcagctcggaagcagtactgca

SEQ ID NO: 310233 - DNA, 25 bp, Homo sapien
actgcaatcacattaatacccactt

SEQ ID NO: 310234 - DNA, 25 bp, Homo sapien
taatacccactttaaactatatgca

SEQ ID NO: 310235 - DNA, 25 bp, Homo sapien
ttggaggagggacatcccgcttcct

SEQ ID NO: 310236 - DNA, 25 bp, Homo sapien
gaggagggacatcccgcttccttat

SEQ ID NO: 310237 - DNA, 25 bp, Homo sapien
atcccgcttccttatccttagcttt

SEQ ID NO: 310238 - DNA, 25 bp, Homo sapien
atccttagcttttttgttgctcctc

SEQ ID NO: 310239 - DNA, 25 bp, Homo sapien
ttagcttttttgttgctcctcccca

SEQ ID NO: 310240 - DNA, 25 bp, Homo sapien
tcccggtagggtaccagggactgag

SEQ ID NO: 310241 - DNA, 25 bp, Homo sapien
gtccaaggtgccaatgatgcgggcc

SEQ ID NO: 310242 - DNA, 25 bp, Homo sapien
aaggtgccaatgatgcgggccgaca

SEQ ID NO: 310243 - DNA, 25 bp, Homo sapien
atgatgcgggccgacagagcgggcc

SEQ ID NO: 310244 - DNA, 25 bp, Homo sapien
agagcgggccgcactgtctgtctgt

SEQ ID NO: 310245 - DNA, 25 bp, Homo sapien
tctgtccgtctgtcccggaaagaac

SEQ ID NO: 310246 - DNA, 25 bp, Homo sapien
agatgcaagtcaaacactggccctc

SEQ ID NO: 310247 - DNA, 25 bp, Homo sapien
gggcgcccgtgtggtggagcctccg

SEQ ID NO: 310248 - DNA, 25 bp, Homo sapien
gacatgaggaggctcctcctggtca

SEQ ID NO: 310249 - DNA, 25 bp, Homo sapien
gagcctccggagaaggacgaccagc

SEQ ID NO: 310250 - DNA, 25 bp, Homo sapien
tggtggtgctgttccctgtccagaa

SEQ ID NO: 310251 - DNA, 25 bp, Homo sapien
tgttccctgtccagaagccgaaact

SEQ ID NO: 310252 - DNA, 25 bp, Homo sapien
tgaggaggctcctcctggtcaccag

SEQ ID NO: 310253 - DNA, 25 bp, Homo sapien
gtccagaagccgaaactcttgacca

SEQ ID NO: 310254 - DNA, 25 bp, Homo sapien
accaaggcctggatggagaccgagg

SEQ ID NO: 310255 - DNA, 25 bp, Homo sapien
caaggtccctatcaagatgcaagtc

SEQ ID NO: 310256 - DNA, 25 bp, Homo sapien
ggtccctatcaagatgcaagtcaaa

SEQ ID NO: 310257 - DNA, 25 bp, Homo sapien
attgcaggtttgttttattatgcaa

SEQ ID NO: 310258 - DNA, 25 bp, Homo sapien
ggacataaaagcatgctttttgttc

SEQ ID NO: 310259 - DNA, 25 bp, Homo sapien
tttttgaggcacactttagcagaaa

SEQ ID NO: 310260 - DNA, 25 bp, Homo sapien
tgaggcacactttagcagaaatgat

SEQ ID NO: 310261 - DNA, 25 bp, Homo sapien
gcagaaatgattgacctaggcctgt

SEQ ID NO: 310262 - DNA, 25 bp, Homo sapien
atgattgacctaggcctgttgcatt

SEQ ID NO: 310263 - DNA, 25 bp, Homo sapien
attgacctaggcctgttgcattaaa

SEQ ID NO: 310264 - DNA, 25 bp, Homo sapien
acctaggcctgttgcattaaaagct

SEQ ID NO: 310265 - DNA, 25 bp, Homo sapien
gcattaaaagcttacttctatttct

SEQ ID NO: 310266 - DNA, 25 bp, Homo sapien
tatttctaacataagatacacagag

SEQ ID NO: 310267 - DNA, 25 bp, Homo sapien
gattgacggttatcttttgtatctt

SEQ ID NO: 310268 - DNA, 25 bp, Homo sapien
gtcacagtgcgccttttaggtggct

SEQ ID NO: 310269 - DNA, 25 bp, Homo sapien
ttttaggtggctctcccagcgtctt

SEQ ID NO: 310270 - DNA, 25 bp, Homo sapien
tttcgtgaaatagtgtcctgcgccc

SEQ ID NO: 310271 - DNA, 25 bp, Homo sapien
gtgtcctgcgccctagtgaaactac

SEQ ID NO: 310272 - DNA, 25 bp, Homo sapien
tgaaactaccctgccttcacttagg

SEQ ID NO: 310273 - DNA, 25 bp, Homo sapien
tcacttaggcccgttttcttgagga

SEQ ID NO: 310274 - DNA, 25 bp, Homo sapien
ttcttgaggagtgaagctgtcggcc

SEQ ID NO: 310275 - DNA, 25 bp, Homo sapien
tcctgtgccgcaggcgcatgcgaaa

SEQ ID NO: 310276 - DNA, 25 bp, Homo sapien
ggcgcatgcgaaacagggaccgaac

SEQ ID NO: 310277 - DNA, 25 bp, Homo sapien
gctcgtttggttccggcctcaggct

SEQ ID NO: 310278 - DNA, 25 bp, Homo sapien
gtgttcctagcacccgagcgggcct

SEQ ID NO: 310279 - DNA, 25 bp, Homo sapien
aaacagtactttagatttcagctag

SEQ ID NO: 310280 - DNA, 25 bp, Homo sapien
gatttcagctagtgaaacagccata

SEQ ID NO: 310281 - DNA, 25 bp, Homo sapien
agccatatatgatcttctaattcca

SEQ ID NO: 310282 - DNA, 25 bp, Homo sapien
attccatttttatgtctcaagaatg

SEQ ID NO: 310283 - DNA, 25 bp, Homo sapien
ttttcatcttgaaagagcttcacaa

SEQ ID NO: 310284 - DNA, 25 bp, Homo sapien
aagagcttcacaaaacttacatgag

SEQ ID NO: 310285 - DNA, 25 bp, Homo sapien
aacttacatgagaatctggattgtc

SEQ ID NO: 310286 - DNA, 25 bp, Homo sapien
gaatctggattgtcataagaggtct

SEQ ID NO: 310287 - DNA, 25 bp, Homo sapien
gaggtctgagtttttaatggtatgt

SEQ ID NO: 310288 - DNA, 25 bp, Homo sapien
atggtatgttcgtatttctgttatg

SEQ ID NO: 310289 - DNA, 25 bp, Homo sapien
ttatatggccgttaattgactaaaa

SEQ ID NO: 310290 - DNA, 25 bp, Homo sapien
ttccatgagccggaggccattgagc

SEQ ID NO: 310291 - DNA, 25 bp, Homo sapien
gccattgagctgtgcacgaccacac

SEQ ID NO: 310292 - DNA, 25 bp, Homo sapien
acgaccacaccgctgatgaagacaa

SEQ ID NO: 310293 - DNA, 25 bp, Homo sapien
acaccgctgatgaagacaaggactc

SEQ ID NO: 310294 - DNA, 25 bp, Homo sapien
gctgatgaagacaaggactcacagt

SEQ ID NO: 310295 - DNA, 25 bp, Homo sapien
aagcactttcagaccatgctgaagt

SEQ ID NO: 310296 - DNA, 25 bp, Homo sapien
gaccatgctgaagtctaaattgaat

SEQ ID NO: 310297 - DNA, 25 bp, Homo sapien
aaattgaatgtcttaacactgaaaa

SEQ ID NO: 310298 - DNA, 25 bp, Homo sapien
aggaacctctcccagcggtcatctt

SEQ ID NO: 310299 - DNA, 25 bp, Homo sapien
tctcccagcggtcatcttccatgag

SEQ ID NO: 310300 - DNA, 25 bp, Homo sapien
tcatcttccatgagccggaggccat

SEQ ID NO: 310301 - DNA, 25 bp, Homo sapien
tacatttccaagttcagttatcctg

SEQ ID NO: 310302 - DNA, 25 bp, Homo sapien
gttatcctgaactgcacttcttttg

SEQ ID NO: 310303 - DNA, 25 bp, Homo sapien
gaactgcacttcttttgcagctcag

SEQ ID NO: 310304 - DNA, 25 bp, Homo sapien
tgcagctcagggtacttgtgtctaa

SEQ ID NO: 310305 - DNA, 25 bp, Homo sapien
ctcaccaggtcccagtgcaactagt

SEQ ID NO: 310306 - DNA, 25 bp, Homo sapien
acttgtgtctaaattgtggctaatg

SEQ ID NO: 310307 - DNA, 25 bp, Homo sapien
ggaggtctcatatgacagcttccaa

SEQ ID NO: 310308 - DNA, 25 bp, Homo sapien
aagagtcttccttaagatactggac

SEQ ID NO: 310309 - DNA, 25 bp, Homo sapien
gatactggacataagcaccctctgc

SEQ ID NO: 310310 - DNA, 25 bp, Homo sapien
tagtccagttgcacacaatatccat

SEQ ID NO: 310311 - DNA, 25 bp, Homo sapien
acacaatatccatcctccatttctt

SEQ ID NO: 310312 - DNA, 25 bp, Homo sapien
agcttcaagaagcagtcgtttgtgc

SEQ ID NO: 310313 - DNA, 25 bp, Homo sapien
gtggagtaccggataaaaatctctt

SEQ ID NO: 310314 - DNA, 25 bp, Homo sapien
tctctttccgggttaaccgagagat

SEQ ID NO: 310315 - DNA, 25 bp, Homo sapien
cgagagatagtgtccggcatgaagt

SEQ ID NO: 310316 - DNA, 25 bp, Homo sapien
gaagtacatccagcatacgtacagg

SEQ ID NO: 310317 - DNA, 25 bp, Homo sapien
tacgtacaggaaaggcgtcaagatt

SEQ ID NO: 310318 - DNA, 25 bp, Homo sapien
gattgacaagactgactacatggta

SEQ ID NO: 310319 - DNA, 25 bp, Homo sapien
agactgactacatggtaggcagcta

SEQ ID NO: 310320 - DNA, 25 bp, Homo sapien
gcttcacagacgacgacaagaccga

SEQ ID NO: 310321 - DNA, 25 bp, Homo sapien
tcctgggagtggaatctcaccatca

SEQ ID NO: 310322 - DNA, 25 bp, Homo sapien
ggaatctcaccatcaagaaggactg

SEQ ID NO: 310323 - DNA, 25 bp, Homo sapien
gtttatgttttgctcattacaccga

SEQ ID NO: 310324 - DNA, 25 bp, Homo sapien
ttacaccgatgaggaacccgaggtt

SEQ ID NO: 310325 - DNA, 25 bp, Homo sapien
gaggaacccgaggttcagagaagtc

SEQ ID NO: 310326 - DNA, 25 bp, Homo sapien
gagaagtcaactaactaccccaagg

SEQ ID NO: 310327 - DNA, 25 bp, Homo sapien
aggtcacagagcaaggagccgagtt

SEQ ID NO: 310328 - DNA, 25 bp, Homo sapien
gttgggattccagccgaaatgggca

SEQ ID NO: 310329 - DNA, 25 bp, Homo sapien
attccagccgaaatgggcactccga

SEQ ID NO: 310330 - DNA, 25 bp, Homo sapien
tagagcggctctgatcggctgtcct

SEQ ID NO: 310331 - DNA, 25 bp, Homo sapien
tgtcctgccggactacagtaaggtg

SEQ ID NO: 310332 - DNA, 25 bp, Homo sapien
gactacagtaaggtgtccccagaag

SEQ ID NO: 310333 - DNA, 25 bp, Homo sapien
ggcaaggactgatccggaacgctac

SEQ ID NO: 310334 - DNA, 25 bp, Homo sapien
gttgggagcccttgttaaaaatgat

SEQ ID NO: 310335 - DNA, 25 bp, Homo sapien
aagcccttgccatataaaattcatg

SEQ ID NO: 310336 - DNA, 25 bp, Homo sapien
catgcagactaaacagtttccctga

SEQ ID NO: 310337 - DNA, 25 bp, Homo sapien
cagactaaacagtttccctgacaga

SEQ ID NO: 310338 - DNA, 25 bp, Homo sapien
ataaagtggatgctaccccactcca

SEQ ID NO: 310339 - DNA, 25 bp, Homo sapien
tgctaccccactccagaatcaaaag

SEQ ID NO: 310340 - DNA, 25 bp, Homo sapien
gcaatttaattaaagtctcttaagt

SEQ ID NO: 310341 - DNA, 25 bp, Homo sapien
agagttttaaatgatccgtgttgaa

SEQ ID NO: 310342 - DNA, 25 bp, Homo sapien
tgcagtgggtctgacgtcagctgcc

SEQ ID NO: 310343 - DNA, 25 bp, Homo sapien
tctgacgtcagctgccgggcctggg

SEQ ID NO: 310344 - DNA, 25 bp, Homo sapien
ggctgggaggccatttgctattctg

SEQ ID NO: 310345 - DNA, 25 bp, Homo sapien
tttcatctgagcttgtggggcccgg

SEQ ID NO: 310346 - DNA, 25 bp, Homo sapien
agctggctggcggtgaggcctcgag

SEQ ID NO: 310347 - DNA, 25 bp, Homo sapien
tcgaggctgcggtcgtgtccctgat

SEQ ID NO: 310348 - DNA, 25 bp, Homo sapien
agtggaaagtggaatctgtcgcttt

SEQ ID NO: 310349 - DNA, 25 bp, Homo sapien
aagtggaatctgtcgctttgagctt

SEQ ID NO: 310350 - DNA, 25 bp, Homo sapien
ggaatctgtcgctttgagcttgaca

SEQ ID NO: 310351 - DNA, 25 bp, Homo sapien
gtcgctttgagcttgacaggcaaac

SEQ ID NO: 310352 - DNA, 25 bp, Homo sapien
gacacaggtgcgctccctgatctga

SEQ ID NO: 310353 - DNA, 25 bp, Homo sapien
gctttgagaacatcgggccgtggtt

SEQ ID NO: 310354 - DNA, 25 bp, Homo sapien
attggtggctccgtggccaggtttc

SEQ ID NO: 310355 - DNA, 25 bp, Homo sapien
ggctccgtggccaggtttcatctga

SEQ ID NO: 310356 - DNA, 25 bp, Homo sapien
aaataaattggccatcacgtctccc

SEQ ID NO: 310357 - DNA, 25 bp, Homo sapien
tcacgtctcccgttagggtcttaat

SEQ ID NO: 310358 - DNA, 25 bp, Homo sapien
ccagaacccttcatgccaaagaaag

SEQ ID NO: 310359 - DNA, 25 bp, Homo sapien
gtcttaatgagaccccaagaggcgt

SEQ ID NO: 310360 - DNA, 25 bp, Homo sapien
accccaagaggcgtcatttgtataa

SEQ ID NO: 310361 - DNA, 25 bp, Homo sapien
gtgtgctcaaaacgctggtaacggt

SEQ ID NO: 310362 - DNA, 25 bp, Homo sapien
ggtaacggttacctccagagaagag

SEQ ID NO: 310363 - DNA, 25 bp, Homo sapien
gagaacgatcgggacgatggtcaaa

SEQ ID NO: 310364 - DNA, 25 bp, Homo sapien
gtcaaagcggaccttacttcgagtt

SEQ ID NO: 310365 - DNA, 25 bp, Homo sapien
gcggaccttacttcgagtttcttat

SEQ ID NO: 310366 - DNA, 25 bp, Homo sapien
acgattgtttagtctgctttcctta

SEQ ID NO: 310367 - DNA, 25 bp, Homo sapien
tgcacaccacccatacctgggtagt

SEQ ID NO: 310368 - DNA, 25 bp, Homo sapien
cacaccacccatacctgggtagttt

SEQ ID NO: 310369 - DNA, 25 bp, Homo sapien
acaggtgtctgagccactgtaatcc

SEQ ID NO: 310370 - DNA, 25 bp, Homo sapien
gtaatccaaaaactgcacctggcag

SEQ ID NO: 310371 - DNA, 25 bp, Homo sapien
gcacctggcaggttttgtttttgat

SEQ ID NO: 310372 - DNA, 25 bp, Homo sapien
acctggcaggttttgtttttgatgt

SEQ ID NO: 310373 - DNA, 25 bp, Homo sapien
tggcaggttttgtttttgatgttta

SEQ ID NO: 310374 - DNA, 25 bp, Homo sapien
ttttcttttaataggtgagtgtctc

SEQ ID NO: 310375 - DNA, 25 bp, Homo sapien
ggtgagtgtctcatttacattctaa

SEQ ID NO: 310376 - DNA, 25 bp, Homo sapien
gagtgtctcatttacattctaatag

SEQ ID NO: 310377 - DNA, 25 bp, Homo sapien
gtctcatttacattctaatagatat

SEQ ID NO: 310378 - DNA, 25 bp, Homo sapien
cagacctgggtaattcttctagttc

SEQ ID NO: 310379 - DNA, 25 bp, Homo sapien
aattgcactgggaaacttccccaat

SEQ ID NO: 310380 - DNA, 25 bp, Homo sapien
gagtcatggcctttcgcccgctagt

SEQ ID NO: 310381 - DNA, 25 bp, Homo sapien
tctctcctcttgtcagcttttactg

SEQ ID NO: 310382 - DNA, 25 bp, Homo sapien
ttgtcagcttttactgcctcctgag

SEQ ID NO: 310383 - DNA, 25 bp, Homo sapien
gtcagcttttactgcctcctgaggc

SEQ ID NO: 310384 - DNA, 25 bp, Homo sapien
tgagtgtccagtccctccaaatccg

SEQ ID NO: 310385 - DNA, 25 bp, Homo sapien
aaatccggctacactctactggcaa

SEQ ID NO: 310386 - DNA, 25 bp, Homo sapien
gctacactctactggcaaggagcac

SEQ ID NO: 310387 - DNA, 25 bp, Homo sapien
ggccatgttttagagatcatccgag

SEQ ID NO: 310388 - DNA, 25 bp, Homo sapien
atgttttagagatcatccgaggact

SEQ ID NO: 310389 - DNA, 25 bp, Homo sapien
gaacgctgccactcttcaaaggctt

SEQ ID NO: 310390 - DNA, 25 bp, Homo sapien
cttcaaaggcttctcaatttcaaat

SEQ ID NO: 310391 - DNA, 25 bp, Homo sapien
taattctctccctcttagtttcaaa

SEQ ID NO: 310392 - DNA, 25 bp, Homo sapien
aaagcactggctattaatccccctg

SEQ ID NO: 310393 - DNA, 25 bp, Homo sapien
tctccctcttagtttcaaagttgtt

SEQ ID NO: 310394 - DNA, 25 bp, Homo sapien
agttgttacagtgttatctatgtga

SEQ ID NO: 310395 - DNA, 25 bp, Homo sapien
cccctggagttcagatggtcagttg

SEQ ID NO: 310396 - DNA, 25 bp, Homo sapien
atggtcagttgagtctatccctagt

SEQ ID NO: 310397 - DNA, 25 bp, Homo sapien
gtctatccctagttttttgcttcac

SEQ ID NO: 310398 - DNA, 25 bp, Homo sapien
ctagttttttgcttcacttgttcaa

SEQ ID NO: 310399 - DNA, 25 bp, Homo sapien
tggaactttctagaacgctgccact

SEQ ID NO: 310400 - DNA, 25 bp, Homo sapien
ctttctctgagcatgggtgattgat

SEQ ID NO: 310401 - DNA, 25 bp, Homo sapien
attgataagggcctgacatgctcct

SEQ ID NO: 310402 - DNA, 25 bp, Homo sapien
ctgacatgctccttcatttggaaaa

SEQ ID NO: 310403 - DNA, 25 bp, Homo sapien
gtattaatagaattggtttcccagt

SEQ ID NO: 310404 - DNA, 25 bp, Homo sapien
ggtttcccagtgaatagtgcctttt

SEQ ID NO: 310405 - DNA, 25 bp, Homo sapien
tagtgccttttacccaagactcata

SEQ ID NO: 310406 - DNA, 25 bp, Homo sapien
aagatgttatatccccatgcatgag

SEQ ID NO: 310407 - DNA, 25 bp, Homo sapien
atccccatgcatgagcattcatttt

SEQ ID NO: 310408 - DNA, 25 bp, Homo sapien
tttccactctaaacactgtctcagg

SEQ ID NO: 310409 - DNA, 25 bp, Homo sapien
ggagggtgtgtttcattgtgacaac

SEQ ID NO: 310410 - DNA, 25 bp, Homo sapien
ttgtgacaacagcatctttggtggg

SEQ ID NO: 310411 - DNA, 25 bp, Homo sapien
ctcacagcccagtgctttctgttca

SEQ ID NO: 310412 - DNA, 25 bp, Homo sapien
aacagagcctagaaaatcactagca

SEQ ID NO: 310413 - DNA, 25 bp, Homo sapien
acagctgcgggcacagggagcaatc

SEQ ID NO: 310414 - DNA, 25 bp, Homo sapien
cacagggagcaatcgcctggagcca

SEQ ID NO: 310415 - DNA, 25 bp, Homo sapien
gggcaaatgggcaaccctgtgcaaa

SEQ ID NO: 310416 - DNA, 25 bp, Homo sapien
tgggcaaccctgtgcaaaaggctct

SEQ ID NO: 310417 - DNA, 25 bp, Homo sapien
aaccctgtgcaaaaggctctggcaa

SEQ ID NO: 310418 - DNA, 25 bp, Homo sapien
tctggcaaccagatcatctacttta

SEQ ID NO: 310419 - DNA, 25 bp, Homo sapien
aaatcactagcagggctgagctcgg

SEQ ID NO: 310420 - DNA, 25 bp, Homo sapien
gctgcagccttcctgttggacccag

SEQ ID NO: 310421 - DNA, 25 bp, Homo sapien
gttggacccagtctgctcaaggact

SEQ ID NO: 310422 - DNA, 25 bp, Homo sapien
gggctcgagaatatcactttgagaa

SEQ ID NO: 310423 - DNA, 25 bp, Homo sapien
ttgagaaacactcttcctaaaggat

SEQ ID NO: 310424 - DNA, 25 bp, Homo sapien
tcttcctaaaggatactgacagagg

SEQ ID NO: 310425 - DNA, 25 bp, Homo sapien
taactgagaaaaacacctccatttt

SEQ ID NO: 310426 - DNA, 25 bp, Homo sapien
cacctccattttagatttgtaacat

SEQ ID NO: 310427 - DNA, 25 bp, Homo sapien
ctgggagtaagctatctggttaaat

SEQ ID NO: 310428 - DNA, 25 bp, Homo sapien
ggttaaatagccatctctttattgt

SEQ ID NO: 310429 - DNA, 25 bp, Homo sapien
tccacttttaagaacgacaaatcca

SEQ ID NO: 310430 - DNA, 25 bp, Homo sapien
atgccaggcacaaaagtagcctaat

SEQ ID NO: 310431 - DNA, 25 bp, Homo sapien
gtagcctaatcatatacacattatt

SEQ ID NO: 310432 - DNA, 25 bp, Homo sapien
tttaactcacagaccatctgaaggg

SEQ ID NO: 310433 - DNA, 25 bp, Homo sapien
ccagggacagggagaccggtgcgat

SEQ ID NO: 310434 - DNA, 25 bp, Homo sapien
acagggagaccggtgcgatggcaga

SEQ ID NO: 310435 - DNA, 25 bp, Homo sapien
gaccggtgcgatggcagagcgcggc

SEQ ID NO: 310436 - DNA, 25 bp, Homo sapien
tgcctctgcgcgtccatggagcagc

SEQ ID NO: 310437 - DNA, 25 bp, Homo sapien
tgcgcgtccatggagcagcgggaag

SEQ ID NO: 310438 - DNA, 25 bp, Homo sapien
atggagcagcgggaagggcgaaact

SEQ ID NO: 310439 - DNA, 25 bp, Homo sapien
gaagggcgaaactccggagcgccgc

SEQ ID NO: 310440 - DNA, 25 bp, Homo sapien
gagcccgcgcggaccgccgaggaag

SEQ ID NO: 310441 - DNA, 25 bp, Homo sapien
gaccgccgaggaagagacccccgct

SEQ ID NO: 310442 - DNA, 25 bp, Homo sapien
acatcggagggcagcggagcgagca

SEQ ID NO: 310443 - DNA, 25 bp, Homo sapien
gagggcagcggagcgagcagcgccg

SEQ ID NO: 310444 - DNA, 25 bp, Homo sapien
tgcacaccacccatacctgggtagt

SEQ ID NO: 310445 - DNA, 25 bp, Homo sapien
aaatggtgttgtgccatgttgccca

SEQ ID NO: 310446 - DNA, 25 bp, Homo sapien
acaggtgtctgagccactgtaatcc

SEQ ID NO: 310447 - DNA, 25 bp, Homo sapien
ggtgtctgagccactgtaatccaaa

SEQ ID NO: 310448 - DNA, 25 bp, Homo sapien
gtaatccaaaaactgcacctggcag

SEQ ID NO: 310449 - DNA, 25 bp, Homo sapien
cacctggcaggttttgtttttgatg

SEQ ID NO: 310450 - DNA, 25 bp, Homo sapien
tggcaggttttgtttttgatgttta

SEQ ID NO: 310451 - DNA, 25 bp, Homo sapien
ttttcttttaataggtgagtgtctc

SEQ ID NO: 310452 - DNA, 25 bp, Homo sapien
ggtgagtgtctcatttacattctaa

SEQ ID NO: 310453 - DNA, 25 bp, Homo sapien
gagtgtctcatttacattctaatag

SEQ ID NO: 310454 - DNA, 25 bp, Homo sapien
gtctcatttacattctaatagatat

SEQ ID NO: 310455 - DNA, 25 bp, Homo sapien
actggaccttctcactcacagcact

SEQ ID NO: 310456 - DNA, 25 bp, Homo sapien
acagcactgctgccctctggacaag

SEQ ID NO: 310457 - DNA, 25 bp, Homo sapien
atagaagttttttcgctgcagggca

SEQ ID NO: 310458 - DNA, 25 bp, Homo sapien
gaagttttttcgctgcagggcaatt

SEQ ID NO: 310459 - DNA, 25 bp, Homo sapien
tttttcgctgcagggcaattctgta

SEQ ID NO: 310460 - DNA, 25 bp, Homo sapien
tcgctgcagggcaattctgtaaatg

SEQ ID NO: 310461 - DNA, 25 bp, Homo sapien
aattctgtaaatgtgcttcccagct

SEQ ID NO: 310462 - DNA, 25 bp, Homo sapien
ttcccagctttaggaggtctgaggc

SEQ ID NO: 310463 - DNA, 25 bp, Homo sapien
ttaggaggtctgaggctactcttct

SEQ ID NO: 310464 - DNA, 25 bp, Homo sapien
ggaggtctgaggctactcttctcca

SEQ ID NO: 310465 - DNA, 25 bp, Homo sapien
ctactcttctccaataaccttcctt

SEQ ID NO: 310466 - DNA, 25 bp, Homo sapien
tcccttcgcgggttggcttcgggag

SEQ ID NO: 310467 - DNA, 25 bp, Homo sapien
ttggcttcgggagcctcgcgtggcg

SEQ ID NO: 310468 - DNA, 25 bp, Homo sapien
gtggcgctcgcgtgtgaggctgccg

SEQ ID NO: 310469 - DNA, 25 bp, Homo sapien
gctggcgccttcttgtttctaagaa

SEQ ID NO: 310470 - DNA, 25 bp, Homo sapien
tggcgccttcttgtttctaagaaaa

SEQ ID NO: 310471 - DNA, 25 bp, Homo sapien
gcaaaagtcagtgctgaacgcgctc

SEQ ID NO: 310472 - DNA, 25 bp, Homo sapien
aaagtcagtgctgaacgcgctctgc

SEQ ID NO: 310473 - DNA, 25 bp, Homo sapien
agtcagtgctgaacgcgctctgccg

SEQ ID NO: 310474 - DNA, 25 bp, Homo sapien
gtgctgaacgcgctctgccgcgtct

SEQ ID NO: 310475 - DNA, 25 bp, Homo sapien
gtctcgcgttcctctcctactaagg

SEQ ID NO: 310476 - DNA, 25 bp, Homo sapien
gttcctctcctactaaggctgcgct

SEQ ID NO: 310477 - DNA, 25 bp, Homo sapien
ccagtagagtgtagccggatttgga

SEQ ID NO: 310478 - DNA, 25 bp, Homo sapien
gccggatttggagggactggacact

SEQ ID NO: 310479 - DNA, 25 bp, Homo sapien
gggactggacactcagtgtgaacaa

SEQ ID NO: 310480 - DNA, 25 bp, Homo sapien
tgtgaacaagacgaaggcctcagga

SEQ ID NO: 310481 - DNA, 25 bp, Homo sapien
gaacaagacgaaggcctcaggaggc

SEQ ID NO: 310482 - DNA, 25 bp, Homo sapien
gcctcaggaggcagtaaaagctgac

SEQ ID NO: 310483 - DNA, 25 bp, Homo sapien
gagagaaaatgaagcgcctacgggt

SEQ ID NO: 310484 - DNA, 25 bp, Homo sapien
gcctacgggtgcatactggactagc

SEQ ID NO: 310485 - DNA, 25 bp, Homo sapien
gactagcgggcgaaaggccatgact

SEQ ID NO: 310486 - DNA, 25 bp, Homo sapien
aggccatgactccttagtttggaga

SEQ ID NO: 310487 - DNA, 25 bp, Homo sapien
gccatgactccttagtttggagaaa

SEQ ID NO: 310488 - DNA, 25 bp, Homo sapien
gcagcccagtgtcagcatctgtatt

SEQ ID NO: 310489 - DNA, 25 bp, Homo sapien
ccagtgtcagcatctgtattggtta

SEQ ID NO: 310490 - DNA, 25 bp, Homo sapien
gtattggttagaagaccaccgctaa

SEQ ID NO: 310491 - DNA, 25 bp, Homo sapien
agaagaccaccgctaatgaggagga

SEQ ID NO: 310492 - DNA, 25 bp, Homo sapien
taatgaggaggagcgtctctaccct

SEQ ID NO: 310493 - DNA, 25 bp, Homo sapien
aggagcgtctctaccctgcagctgt

SEQ ID NO: 310494 - DNA, 25 bp, Homo sapien
tgcagctgtctgtactcctgtgtct

SEQ ID NO: 310495 - DNA, 25 bp, Homo sapien
gtactcctgtgtcttccgtaatgtg

SEQ ID NO: 310496 - DNA, 25 bp, Homo sapien
tccgtaatgtgccaagctctctgaa

SEQ ID NO: 310497 - DNA, 25 bp, Homo sapien
tagtctgcaaaaagccatatgtctc

SEQ ID NO: 310498 - DNA, 25 bp, Homo sapien
cagggagatgtgttagtgtagcact

SEQ ID NO: 310499 - DNA, 25 bp, Homo sapien
tcatttatgactctgaaacatcccc

SEQ ID NO: 310500 - DNA, 25 bp, Homo sapien
gaccaagggagccactctccagttc

SEQ ID NO: 310501 - DNA, 25 bp, Homo sapien
tccgtgagccaggaccgggtcacat

SEQ ID NO: 310502 - DNA, 25 bp, Homo sapien
aggaccgggtcacatctctcagcca

SEQ ID NO: 310503 - DNA, 25 bp, Homo sapien
tcacatctctcagccaagtctagaa

SEQ ID NO: 310504 - DNA, 25 bp, Homo sapien
tctcagccaagtctagaagctctgg

SEQ ID NO: 310505 - DNA, 25 bp, Homo sapien
aagtctagaagctctggctagagga

SEQ ID NO: 310506 - DNA, 25 bp, Homo sapien
gtgcagagggtcctctgccaaagct

SEQ ID NO: 310507 - DNA, 25 bp, Homo sapien
cgagcccgggcatgctgggattagt

SEQ ID NO: 310508 - DNA, 25 bp, Homo sapien
cttgcacctggacagcggcctggct

SEQ ID NO: 310509 - DNA, 25 bp, Homo sapien
cacctgccttcatttatgactctga

SEQ ID NO: 310510 - DNA, 25 bp, Homo sapien
agacccacagaatcaccacactgaa

SEQ ID NO: 310511 - DNA, 25 bp, Homo sapien
gacccacagaatcaccacactgaag

SEQ ID NO: 310512 - DNA, 25 bp, Homo sapien
cacagaatcaccacactgaagcctt

SEQ ID NO: 310513 - DNA, 25 bp, Homo sapien
acagaatcaccacactgaagccttc

SEQ ID NO: 310514 - DNA, 25 bp, Homo sapien
agaatcaccacactgaagccttctc

SEQ ID NO: 310515 - DNA, 25 bp, Homo sapien
gaatcaccacactgaagccttctca

SEQ ID NO: 310516 - DNA, 25 bp, Homo sapien
atcaccacactgaagccttctcagt

SEQ ID NO: 310517 - DNA, 25 bp, Homo sapien
ccacactgaagccttctcagtggaa

SEQ ID NO: 310518 - DNA, 25 bp, Homo sapien
cacactgaagccttctcagtggaaa

SEQ ID NO: 310519 - DNA, 25 bp, Homo sapien
gagctaagaagcacaggaaacacag

SEQ ID NO: 310520 - DNA, 25 bp, Homo sapien
cacaggaaacacagaggccgaggtg

SEQ ID NO: 310521 - DNA, 25 bp, Homo sapien
gaatcacagggaggtctacagggaa

SEQ ID NO: 310522 - DNA, 25 bp, Homo sapien
ggtctacagggaaggtgcacgcact

SEQ ID NO: 310523 - DNA, 25 bp, Homo sapien
aaggtgcacgcactgagcgcctaat

SEQ ID NO: 310524 - DNA, 25 bp, Homo sapien
gagcgcctaatgattggacgtacaa

SEQ ID NO: 310525 - DNA, 25 bp, Homo sapien
tggccaacgccaagacttatttgtt

SEQ ID NO: 310526 - DNA, 25 bp, Homo sapien
gcagagaggctgagctctgacaaag

SEQ ID NO: 310527 - DNA, 25 bp, Homo sapien
gatccacacgggagatcacgtcgga

SEQ ID NO: 310528 - DNA, 25 bp, Homo sapien
tctgacaaagctgtttaaggctccg

SEQ ID NO: 310529 - DNA, 25 bp, Homo sapien
agatcacgtcggatttggacccagg

SEQ ID NO: 310530 - DNA, 25 bp, Homo sapien
aaagatacaagagttggctgtgggt

SEQ ID NO: 310531 - DNA, 25 bp, Homo sapien
ttggctgtgggtgccagaatcacag

SEQ ID NO: 310532 - DNA, 25 bp, Homo sapien
gtcatgcactttgttaatattcttt

SEQ ID NO: 310533 - DNA, 25 bp, Homo sapien
ttttgtgtacatcagatacaacact

SEQ ID NO: 310534 - DNA, 25 bp, Homo sapien
tagaataggtactccctattcccca

SEQ ID NO: 310535 - DNA, 25 bp, Homo sapien
tattccccaaccctgggaacacaat

SEQ ID NO: 310536 - DNA, 25 bp, Homo sapien
agttcatttgtatttaagatctatc

SEQ ID NO: 310537 - DNA, 25 bp, Homo sapien
cctcagtttagttattgctcttacc

SEQ ID NO: 310538 - DNA, 25 bp, Homo sapien
gttattgctcttacctttcaaacag

SEQ ID NO: 310539 - DNA, 25 bp, Homo sapien
tgctcttacctttcaaacagttaat

SEQ ID NO: 310540 - DNA, 25 bp, Homo sapien
gatacaacactcttctcatcttttt

SEQ ID NO: 310541 - DNA, 25 bp, Homo sapien
tgttgttttaatctttccactgttg

SEQ ID NO: 310542 - DNA, 25 bp, Homo sapien
gtttcatgtcatgcactttgttaat

SEQ ID NO: 310543 - DNA, 25 bp, Homo sapien
gggtaagttagtttcactcactcga

SEQ ID NO: 310544 - DNA, 25 bp, Homo sapien
gtttcactcactcgacggaatgtat

SEQ ID NO: 310545 - DNA, 25 bp, Homo sapien
atgtatgcagccgttaatgtatttc

SEQ ID NO: 310546 - DNA, 25 bp, Homo sapien
gccgttaatgtatttctgcattttc

SEQ ID NO: 310547 - DNA, 25 bp, Homo sapien
tgcattttcccatatttccagtgaa

SEQ ID NO: 310548 - DNA, 25 bp, Homo sapien
acatacagtactttcgcaattcgga

SEQ ID NO: 310549 - DNA, 25 bp, Homo sapien
actttcgcaattcggagtacaaacg

SEQ ID NO: 310550 - DNA, 25 bp, Homo sapien
agagaaggtcgcattttgcctgccg

SEQ ID NO: 310551 - DNA, 25 bp, Homo sapien
cgcattttgcctgccggagctaggg

SEQ ID NO: 310552 - DNA, 25 bp, Homo sapien
gcttgccggttccaacgagttttcg

SEQ ID NO: 310553 - DNA, 25 bp, Homo sapien
gaaacagcttaacgtccagggtaag

SEQ ID NO: 310554 - DNA, 25 bp, Homo sapien
ggagttgttgcgaggaatccattag

SEQ ID NO: 310555 - DNA, 25 bp, Homo sapien
gaatccattagtacctctcctagtg

SEQ ID NO: 310556 - DNA, 25 bp, Homo sapien
ttagtacctctcctagtgcctgcag

SEQ ID NO: 310557 - DNA, 25 bp, Homo sapien
tgcctgcagccacgcaatacatatt

SEQ ID NO: 310558 - DNA, 25 bp, Homo sapien
gctactggccagctgtgtgatccaa

SEQ ID NO: 310559 - DNA, 25 bp, Homo sapien
gtaagtggaaatctgtcaagtgtaa

SEQ ID NO: 310560 - DNA, 25 bp, Homo sapien
actgtgtggatattggtgtgatgca

SEQ ID NO: 310561 - DNA, 25 bp, Homo sapien
aagaggaagcactggaagatgatca

SEQ ID NO: 310562 - DNA, 25 bp, Homo sapien
agcttgcaaaatcagcattggctat

SEQ ID NO: 310563 - DNA, 25 bp, Homo sapien
gtgatccaagaaaagctactcgact

SEQ ID NO: 310564 - DNA, 25 bp, Homo sapien
gagtagtcctacttcatggagttgt

SEQ ID NO: 310565 - DNA, 25 bp, Homo sapien
gtaaagctgtaattgtttgccttat

SEQ ID NO: 310566 - DNA, 25 bp, Homo sapien
gctgtaattgtttgccttatgggaa

SEQ ID NO: 310567 - DNA, 25 bp, Homo sapien
aatttatggtgtgtctactatgaac

SEQ ID NO: 310568 - DNA, 25 bp, Homo sapien
ggcatgatgctgagagtttaactgt

SEQ ID NO: 310569 - DNA, 25 bp, Homo sapien
ctaaatagccctgtgaagtagatat

SEQ ID NO: 310570 - DNA, 25 bp, Homo sapien
gatattattccaactttacaggtta

SEQ ID NO: 310571 - DNA, 25 bp, Homo sapien
acaggttagaaaatttgaggcacag

SEQ ID NO: 310572 - DNA, 25 bp, Homo sapien
agtgaaacggcaaatttggcaattt

SEQ ID NO: 310573 - DNA, 25 bp, Homo sapien
tttggcaatttggacttggattcaa

SEQ ID NO: 310574 - DNA, 25 bp, Homo sapien
agctccttgcatcataccctggtac

SEQ ID NO: 310575 - DNA, 25 bp, Homo sapien
tcataccctggtacctaaaagacat

SEQ ID NO: 310576 - DNA, 25 bp, Homo sapien
gggaaagccatgtcctatctcaggg

SEQ ID NO: 310577 - DNA, 25 bp, Homo sapien
gccatgtcctatctcagggacacag

SEQ ID NO: 310578 - DNA, 25 bp, Homo sapien
agggacacagggtcatctgggcctc

SEQ ID NO: 310579 - DNA, 25 bp, Homo sapien
gtcatctgggcctctggctaataga

SEQ ID NO: 310580 - DNA, 25 bp, Homo sapien
aaataatgggactattttccctgtg

SEQ ID NO: 310581 - DNA, 25 bp, Homo sapien
tccctgtgaaatcctgaaaaccaaa

SEQ ID NO: 310582 - DNA, 25 bp, Homo sapien
aaaatggtggcgtctttatctgcat

SEQ ID NO: 310583 - DNA, 25 bp, Homo sapien
gaggtaatttgctccttcttgaaat

SEQ ID NO: 310584 - DNA, 25 bp, Homo sapien
gaaatccaaggtcacgtctactgtc

SEQ ID NO: 310585 - DNA, 25 bp, Homo sapien
tccaaggtcacgtctactgtctggg

SEQ ID NO: 310586 - DNA, 25 bp, Homo sapien
tggtttctcctttacaggagagccg

SEQ ID NO: 310587 - DNA, 25 bp, Homo sapien
atattccgggcatcgggtgtcccca

SEQ ID NO: 310588 - DNA, 25 bp, Homo sapien
ctcacttcagtccacaggcagggtc

SEQ ID NO: 310589 - DNA, 25 bp, Homo sapien
aggcagggtcctcagtcttcagcgc

SEQ ID NO: 310590 - DNA, 25 bp, Homo sapien
tttgtcttgtgtctccttgggtctc

SEQ ID NO: 310591 - DNA, 25 bp, Homo sapien
ttttctccaagacctaaactccctg

SEQ ID NO: 310592 - DNA, 25 bp, Homo sapien
caagacctaaactccctgaggacag

SEQ ID NO: 310593 - DNA, 25 bp, Homo sapien
ggacaggactattttttacatcttg

SEQ ID NO: 310594 - DNA, 25 bp, Homo sapien
gagcacttgctttaatgtgttggac

SEQ ID NO: 310595 - DNA, 25 bp, Homo sapien
gacactgggtccattaaagattgta

SEQ ID NO: 310596 - DNA, 25 bp, Homo sapien
cacctttctgtggtacagctataat

SEQ ID NO: 310597 - DNA, 25 bp, Homo sapien
tctggtttcatttaccaactgggtg

SEQ ID NO: 310598 - DNA, 25 bp, Homo sapien
taaaagaacagaacggagtccagaa

SEQ ID NO: 310599 - DNA, 25 bp, Homo sapien
gagtccagaactagatccacgcaga

SEQ ID NO: 310600 - DNA, 25 bp, Homo sapien
tagatccacgcagatatggccaatt

SEQ ID NO: 310601 - DNA, 25 bp, Homo sapien
gatatggccaattgatcttccaaaa

SEQ ID NO: 310602 - DNA, 25 bp, Homo sapien
gatcttccaaaaaggcaccaaagtg

SEQ ID NO: 310603 - DNA, 25 bp, Homo sapien
ttaaccaccagacctagaaaacttg

SEQ ID NO: 310604 - DNA, 25 bp, Homo sapien
gaaaacttggtatccatataggaaa

SEQ ID NO: 310605 - DNA, 25 bp, Homo sapien
taaatcttgatacttcataccatac

SEQ ID NO: 310606 - DNA, 25 bp, Homo sapien
attatagatggcacatagacctaaa

SEQ ID NO: 310607 - DNA, 25 bp, Homo sapien
gaatatttcctggacctgagctagg

SEQ ID NO: 310608 - DNA, 25 bp, Homo sapien
ggacctgagctaggcaaagatttca

SEQ ID NO: 310609 - DNA, 25 bp, Homo sapien
gaaattaggtctgttattataaggt

SEQ ID NO: 310610 - DNA, 25 bp, Homo sapien
atgtcccttattgtaactccctgag

SEQ ID NO: 310611 - DNA, 25 bp, Homo sapien
tcccttattgtaactccctgagata

SEQ ID NO: 310612 - DNA, 25 bp, Homo sapien
gtaactccctgagatacatctactt

SEQ ID NO: 310613 - DNA, 25 bp, Homo sapien
ccctgagatacatctacttagttaa

SEQ ID NO: 310614 - DNA, 25 bp, Homo sapien
agccctgaaggtaaatgattcactc

SEQ ID NO: 310615 - DNA, 25 bp, Homo sapien
tgattcactccatgtatgcttacag

SEQ ID NO: 310616 - DNA, 25 bp, Homo sapien
gtatgcttacagagccttcaaataa

SEQ ID NO: 310617 - DNA, 25 bp, Homo sapien
atgcatgatgttatttctgttttaa

SEQ ID NO: 310618 - DNA, 25 bp, Homo sapien
attttcttaaagcttcctcacattg

SEQ ID NO: 310619 - DNA, 25 bp, Homo sapien
aaagcttcctcacattgataatctg

SEQ ID NO: 310620 - DNA, 25 bp, Homo sapien
tgggtccactgtgcttattgctgag

SEQ ID NO: 310621 - DNA, 25 bp, Homo sapien
ctgtgcttattgctgagctggctgt

SEQ ID NO: 310622 - DNA, 25 bp, Homo sapien
tggctgtcatgtccaggctgtcccc

SEQ ID NO: 310623 - DNA, 25 bp, Homo sapien
tgccccgagtcctgtgtatacatct

SEQ ID NO: 310624 - DNA, 25 bp, Homo sapien
gagtcctgtgtatacatctgtgggt

SEQ ID NO: 310625 - DNA, 25 bp, Homo sapien
ctgtgtatacatctgtgggtgtgca

SEQ ID NO: 310626 - DNA, 25 bp, Homo sapien
gtgggtgtgcacatgtttgcatgaa

SEQ ID NO: 310627 - DNA, 25 bp, Homo sapien
catcaatttatcatggaatcttggg

SEQ ID NO: 310628 - DNA, 25 bp, Homo sapien
ctggactctccaggcactgaaccat

SEQ ID NO: 310629 - DNA, 25 bp, Homo sapien
aagcacagcttcttctatcatctac

SEQ ID NO: 310630 - DNA, 25 bp, Homo sapien
tatcatctacttttaaacaggaatt

SEQ ID NO: 310631 - DNA, 25 bp, Homo sapien
ggaaatgatccagcacctcaaggct

SEQ ID NO: 310632 - DNA, 25 bp, Homo sapien
gatccagcacctcaaggcttgtgat

SEQ ID NO: 310633 - DNA, 25 bp, Homo sapien
acctcaaggcttgtgatgtccctat

SEQ ID NO: 310634 - DNA, 25 bp, Homo sapien
aggcttgtgatgtccctattgagga

SEQ ID NO: 310635 - DNA, 25 bp, Homo sapien
gcaaaagggcctatcatgtccatct

SEQ ID NO: 310636 - DNA, 25 bp, Homo sapien
aagggcctatcatgtccatctactt

SEQ ID NO: 310637 - DNA, 25 bp, Homo sapien
tccgagaccccgacagaaatctgat

SEQ ID NO: 310638 - DNA, 25 bp, Homo sapien
gaccagaaatttaacctccacgagg

SEQ ID NO: 310639 - DNA, 25 bp, Homo sapien
tccaactacatctcctcgtgatgga

SEQ ID NO: 310640 - DNA, 25 bp, Homo sapien
ggctccctggacatatgtctgatca

SEQ ID NO: 310641 - DNA, 25 bp, Homo sapien
tggacatatgtctgatcacagaggt

SEQ ID NO: 310642 - DNA, 25 bp, Homo sapien
ctgttgtcatcactgagtcagcact

SEQ ID NO: 310643 - DNA, 25 bp, Homo sapien
tgttgtcatcactgagtcagcactc

SEQ ID NO: 310644 - DNA, 25 bp, Homo sapien
gttgtcatcactgagtcagcactca

SEQ ID NO: 310645 - DNA, 25 bp, Homo sapien
ttgtcatcactgagtcagcactcac

SEQ ID NO: 310646 - DNA, 25 bp, Homo sapien
gtcatcactgagtcagcactcacct

SEQ ID NO: 310647 - DNA, 25 bp, Homo sapien
catcactgagtcagcactcacctgg

SEQ ID NO: 310648 - DNA, 25 bp, Homo sapien
actgagtcagcactcacctggcctg

SEQ ID NO: 310649 - DNA, 25 bp, Homo sapien
aatgtctgagctaccccaggtcctc

SEQ ID NO: 310650 - DNA, 25 bp, Homo sapien
tctgagctaccccaggtcctcatgt

SEQ ID NO: 310651 - DNA, 25 bp, Homo sapien
gagctaccccaggtcctcatgtcag

SEQ ID NO: 310652 - DNA, 25 bp, Homo sapien
atgtcagcagagtggcgcctgcctg

SEQ ID NO: 310653 - DNA, 25 bp, Homo sapien
acctccgtcaagctgttgtcatcca

SEQ ID NO: 310654 - DNA, 25 bp, Homo sapien
atccagccacagatgccgtaactga

SEQ ID NO: 310655 - DNA, 25 bp, Homo sapien
gatgccgtaactgaacaagtccttc

SEQ ID NO: 310656 - DNA, 25 bp, Homo sapien
atggttggcatctaaacgcaaagac

SEQ ID NO: 310657 - DNA, 25 bp, Homo sapien
tgcaaagcactcagccctcgaatgg

SEQ ID NO: 310658 - DNA, 25 bp, Homo sapien
gccctcgaatggcttcactgggtac

SEQ ID NO: 310659 - DNA, 25 bp, Homo sapien
ttttcaactgattattctggagcgt

SEQ ID NO: 310660 - DNA, 25 bp, Homo sapien
gaactttgagttctttcaacccaga

SEQ ID NO: 310661 - DNA, 25 bp, Homo sapien
ctttcaacccagacaaggcctttgg

SEQ ID NO: 310662 - DNA, 25 bp, Homo sapien
agtcagggatgcttgagatcttgtt

SEQ ID NO: 310663 - DNA, 25 bp, Homo sapien
ttgttgagagccagggtcagcgcct

SEQ ID NO: 310664 - DNA, 25 bp, Homo sapien
ttcaaatgttcttttggctttaaca

SEQ ID NO: 310665 - DNA, 25 bp, Homo sapien
tggctttaacattctattaattata

SEQ ID NO: 310666 - DNA, 25 bp, Homo sapien
ctagattgaatactgtgaatgctaa

SEQ ID NO: 310667 - DNA, 25 bp, Homo sapien
aatgctaagttttattaatctggtc

SEQ ID NO: 310668 - DNA, 25 bp, Homo sapien
attaatctggtcatcttattttgat

SEQ ID NO: 310669 - DNA, 25 bp, Homo sapien
acatgttcaaatattctcaatgcac

SEQ ID NO: 310670 - DNA, 25 bp, Homo sapien
aatattctcaatgcacagttgttaa

SEQ ID NO: 310671 - DNA, 25 bp, Homo sapien
caatgcacagttgttaatgagtaat

SEQ ID NO: 310672 - DNA, 25 bp, Homo sapien
taatgagtaattgccgttaaaatat

SEQ ID NO: 310673 - DNA, 25 bp, Homo sapien
agaagtctcaatctcaaactctcca

SEQ ID NO: 310674 - DNA, 25 bp, Homo sapien
agtctcaatctcaaactctccatct

SEQ ID NO: 310675 - DNA, 25 bp, Homo sapien
ttcacctgctcctatgtgggtacct

SEQ ID NO: 310676 - DNA, 25 bp, Homo sapien
gctcctatgtgggtacctgagtcaa

SEQ ID NO: 310677 - DNA, 25 bp, Homo sapien
gggtacctgagtcaaaattgtcatt

SEQ ID NO: 310678 - DNA, 25 bp, Homo sapien
aatttccttcttgtaccatttctgt

SEQ ID NO: 310679 - DNA, 25 bp, Homo sapien
cttcttgtaccatttctgtttagtt

SEQ ID NO: 310680 - DNA, 25 bp, Homo sapien
ctgtatttttctgtttattccaaat

SEQ ID NO: 310681 - DNA, 25 bp, Homo sapien
ttgatgaaactgacaatccaatttg

SEQ ID NO: 310682 - DNA, 25 bp, Homo sapien
gaaagtttgtgtcgacgtctgtcta

SEQ ID NO: 310683 - DNA, 25 bp, Homo sapien
ttgtgtcgacgtctgtctagcttaa

SEQ ID NO: 310684 - DNA, 25 bp, Homo sapien
tcgacgtctgtctagcttaaatgaa

SEQ ID NO: 310685 - DNA, 25 bp, Homo sapien
gtctgtctagcttaaatgaatgtgt

SEQ ID NO: 310686 - DNA, 25 bp, Homo sapien
actccatcatccgtcttttattttt

SEQ ID NO: 310687 - DNA, 25 bp, Homo sapien
ttatttttgtgagcccgtacaactg

SEQ ID NO: 310688 - DNA, 25 bp, Homo sapien
gcccgtacaactgctcttattacaa

SEQ ID NO: 310689 - DNA, 25 bp, Homo sapien
aactgctcttattacaaagtcatgt

SEQ ID NO: 310690 - DNA, 25 bp, Homo sapien
tgacttttgggcttatgtcctgaaa

SEQ ID NO: 310691 - DNA, 25 bp, Homo sapien
gggcttatgtcctgaaagagttaac

SEQ ID NO: 310692 - DNA, 25 bp, Homo sapien
taacatacattcttccatacataac

SEQ ID NO: 310693 - DNA, 25 bp, Homo sapien
tcttccatacataacttattcacgt

SEQ ID NO: 310694 - DNA, 25 bp, Homo sapien
ccaaaacttgtttccctaagctgat

SEQ ID NO: 310695 - DNA, 25 bp, Homo sapien
cctaagctgatattgaaacttccat

SEQ ID NO: 310696 - DNA, 25 bp, Homo sapien
attgaaacttccattattgaacagt

SEQ ID NO: 310697 - DNA, 25 bp, Homo sapien
gacaggtatctccatgtaaataaat

SEQ ID NO: 310698 - DNA, 25 bp, Homo sapien
ataaattgtctgcatacctctctag

SEQ ID NO: 310699 - DNA, 25 bp, Homo sapien
tgcatacctctctagaagtctcatc

SEQ ID NO: 310700 - DNA, 25 bp, Homo sapien
acctctctagaagtctcatctatct

SEQ ID NO: 310701 - DNA, 25 bp, Homo sapien
atctgcctgggcaagggagtatcta

SEQ ID NO: 310702 - DNA, 25 bp, Homo sapien
gggagtatctaatgacagaaccaag

SEQ ID NO: 310703 - DNA, 25 bp, Homo sapien
taattctctgatttgcctatgccta

SEQ ID NO: 310704 - DNA, 25 bp, Homo sapien
tttgcctatgcctaatgattacctg

SEQ ID NO: 310705 - DNA, 25 bp, Homo sapien
gcctaatgattacctgagttcgtga

SEQ ID NO: 310706 - DNA, 25 bp, Homo sapien
acctgagttcgtgaaattactagta

SEQ ID NO: 310707 - DNA, 25 bp, Homo sapien
ataccacatatgtaactatctgcat

SEQ ID NO: 310708 - DNA, 25 bp, Homo sapien
acagtactttcatgaccagtgatga

SEQ ID NO: 310709 - DNA, 25 bp, Homo sapien
aggccaatgaggtctgcatggccag

SEQ ID NO: 310710 - DNA, 25 bp, Homo sapien
gaccttcaaggtgcgtaaagtccct

SEQ ID NO: 310711 - DNA, 25 bp, Homo sapien
ggtagagacttatttgtttcctgat

SEQ ID NO: 310712 - DNA, 25 bp, Homo sapien
aattgtttgttaagcacagcctgtt

SEQ ID NO: 310713 - DNA, 25 bp, Homo sapien
agcacagcctgtttcttggaagtta

SEQ ID NO: 310714 - DNA, 25 bp, Homo sapien
agaggcagcctgtgatccgtagtat

SEQ ID NO: 310715 - DNA, 25 bp, Homo sapien
atccgtagtatgctagggtgtgaca

SEQ ID NO: 310716 - DNA, 25 bp, Homo sapien
atgctagggtgtgacagcagccagc

SEQ ID NO: 310717 - DNA, 25 bp, Homo sapien
cagccacagctggatctgatgtctt

SEQ ID NO: 310718 - DNA, 25 bp, Homo sapien
tggatctgatgtcttgtctgccccg

SEQ ID NO: 310719 - DNA, 25 bp, Homo sapien
gtagatgccctattcaccacaaaga

SEQ ID NO: 310720 - DNA, 25 bp, Homo sapien
aactggctgggctataccaagaaga

SEQ ID NO: 310721 - DNA, 25 bp, Homo sapien
gaagagagcacccattggcttccat

SEQ ID NO: 310722 - DNA, 25 bp, Homo sapien
ggcttccatcgggttgtcgaaattt

SEQ ID NO: 310723 - DNA, 25 bp, Homo sapien
ttttgcacaagaacaatgcccctgt

SEQ ID NO: 310724 - DNA, 25 bp, Homo sapien
gaacaatgcccctgtgcagatatta

SEQ ID NO: 310725 - DNA, 25 bp, Homo sapien
gacacgaagttgaacttagccacta

SEQ ID NO: 310726 - DNA, 25 bp, Homo sapien
agttcaagtgccatgatgtcgtcat

SEQ ID NO: 310727 - DNA, 25 bp, Homo sapien
atgtcgtcattgatacctaccggga

SEQ ID NO: 310728 - DNA, 25 bp, Homo sapien
taccgggacctgaaggatcgtcaac

SEQ ID NO: 310729 - DNA, 25 bp, Homo sapien
gatcgtcaacagttgctagcataca

SEQ ID NO: 310730 - DNA, 25 bp, Homo sapien
tcagaatccatatgactgctgtggg

SEQ ID NO: 310731 - DNA, 25 bp, Homo sapien
ccgactgggccatggtcacctgcaa

SEQ ID NO: 310732 - DNA, 25 bp, Homo sapien
tcctccaagatcatccgcgtgacgg

SEQ ID NO: 310733 - DNA, 25 bp, Homo sapien
aagatcatccgcgtgacggagctgc

SEQ ID NO: 310734 - DNA, 25 bp, Homo sapien
gtgtgcctcgggactgcaagtggga

SEQ ID NO: 310735 - DNA, 25 bp, Homo sapien
tgctggtggcctgcactgtcatcgt

SEQ ID NO: 310736 - DNA, 25 bp, Homo sapien
ctgtcatcgtcctcacttttaagaa

SEQ ID NO: 310737 - DNA, 25 bp, Homo sapien
gtcctcacttttaagaagcctctgc

SEQ ID NO: 310738 - DNA, 25 bp, Homo sapien
aagcctctgcttcaggtcatcaaga

SEQ ID NO: 310739 - DNA, 25 bp, Homo sapien
ttcaggtcatcaagagccgctgcca

SEQ ID NO: 310740 - DNA, 25 bp, Homo sapien
atcaagagccgctgccactggtcct

SEQ ID NO: 310741 - DNA, 25 bp, Homo sapien
ggaactataccttatgtctcatttg

SEQ ID NO: 310742 - DNA, 25 bp, Homo sapien
gtctgcaaatagcaacttggtagag

SEQ ID NO: 310743 - DNA, 25 bp, Homo sapien
atagcaacttggtagaggactggca

SEQ ID NO: 310744 - DNA, 25 bp, Homo sapien
gaggactggcaaactgcctttcatc

SEQ ID NO: 310745 - DNA, 25 bp, Homo sapien
gcaaactgcctttcatccataaatt

SEQ ID NO: 310746 - DNA, 25 bp, Homo sapien
ctgcctttcatccataaattcatcc

SEQ ID NO: 310747 - DNA, 25 bp, Homo sapien
cctcccagttaatcactattctgac

SEQ ID NO: 310748 - DNA, 25 bp, Homo sapien
agttaatcactattctgactacatt

SEQ ID NO: 310749 - DNA, 25 bp, Homo sapien
attcactgtgtctcacatttgccta

SEQ ID NO: 310750 - DNA, 25 bp, Homo sapien
gtgtctcacatttgcctattcttga

SEQ ID NO: 310751 - DNA, 25 bp, Homo sapien
ctcacatttgcctattcttgaactt

SEQ ID NO: 310752 - DNA, 25 bp, Homo sapien
tgggcagctcgtgaacccggtgtcc

SEQ ID NO: 310753 - DNA, 25 bp, Homo sapien
tcccctcctggagaggacgtgggca

SEQ ID NO: 310754 - DNA, 25 bp, Homo sapien
gacgtgggcagctcgtgaacccggg

SEQ ID NO: 310755 - DNA, 25 bp, Homo sapien
gagcgcgtgggcagttcgtgacccg

SEQ ID NO: 310756 - DNA, 25 bp, Homo sapien
gggcagctcgtgacccgggtccctt

SEQ ID NO: 310757 - DNA, 25 bp, Homo sapien
cgggtcccttcctggagacgacgtg

SEQ ID NO: 310758 - DNA, 25 bp, Homo sapien
ttcctggagacgacgtgggcagctc

SEQ ID NO: 310759 - DNA, 25 bp, Homo sapien
acgacgtgggcagctcgtgacccgg

SEQ ID NO: 310760 - DNA, 25 bp, Homo sapien
gagggcgtgggcagttcgtgacccg

SEQ ID NO: 310761 - DNA, 25 bp, Homo sapien
tcgtgacccgggtcccttcctggag

SEQ ID NO: 310762 - DNA, 25 bp, Homo sapien
aggacgtgggcagctcatgaacccg

SEQ ID NO: 310763 - DNA, 25 bp, Homo sapien
gcatttgcaggctgagtgactcact

SEQ ID NO: 310764 - DNA, 25 bp, Homo sapien
tgactcactgtctggctggctcgga

SEQ ID NO: 310765 - DNA, 25 bp, Homo sapien
ataggtggcacagacagtccctggc

SEQ ID NO: 310766 - DNA, 25 bp, Homo sapien
gtccctggcacaagaaggctgtcca

SEQ ID NO: 310767 - DNA, 25 bp, Homo sapien
ttcagatgaaatggcatgctggtgc

SEQ ID NO: 310768 - DNA, 25 bp, Homo sapien
agttttgtactcctaactccatctc

SEQ ID NO: 310769 - DNA, 25 bp, Homo sapien
tgggtgatttgggtgtctcaaatat

SEQ ID NO: 310770 - DNA, 25 bp, Homo sapien
taactccatctcagcctaaaattgg

SEQ ID NO: 310771 - DNA, 25 bp, Homo sapien
ggcacaattggtaccagtggcccac

SEQ ID NO: 310772 - DNA, 25 bp, Homo sapien
cagtggcccacgaacgtaggtggta

SEQ ID NO: 310773 - DNA, 25 bp, Homo sapien
gtaggtggtaagacagcatttgcag

SEQ ID NO: 310774 - DNA, 25 bp, Homo sapien
aattacggtatgcattatctggtga

SEQ ID NO: 310775 - DNA, 25 bp, Homo sapien
atctggtgactatttgtgcctgaaa

SEQ ID NO: 310776 - DNA, 25 bp, Homo sapien
gactatttgtgcctgaaaattcgtt

SEQ ID NO: 310777 - DNA, 25 bp, Homo sapien
gtgcctgaaaattcgttttgtatta

SEQ ID NO: 310778 - DNA, 25 bp, Homo sapien
ttttttatcatgacagttttagaat

SEQ ID NO: 310779 - DNA, 25 bp, Homo sapien
gagattaaatgttcaaggctccaat

SEQ ID NO: 310780 - DNA, 25 bp, Homo sapien
gttcaaggctccaatattattttta

SEQ ID NO: 310781 - DNA, 25 bp, Homo sapien
gaacttatttaaggagtgctacttt

SEQ ID NO: 310782 - DNA, 25 bp, Homo sapien
aggagtgctactttacagaaattac

SEQ ID NO: 310783 - DNA, 25 bp, Homo sapien
gaaattactaacacaccaaaacatt

SEQ ID NO: 310784 - DNA, 25 bp, Homo sapien
ggttaagtctgctaaattacggtat

SEQ ID NO: 310785 - DNA, 25 bp, Homo sapien
gccgccaccaccgaaggagccggaa

SEQ ID NO: 310786 - DNA, 25 bp, Homo sapien
aggacctgaggcttccctcgccggg

SEQ ID NO: 310787 - DNA, 25 bp, Homo sapien
tgcaacggtccctcaggctttagga

SEQ ID NO: 310788 - DNA, 25 bp, Homo sapien
aacggtccctcaggctttaggagag

SEQ ID NO: 310789 - DNA, 25 bp, Homo sapien
ttttcggtggtagttgttgtttcag

SEQ ID NO: 310790 - DNA, 25 bp, Homo sapien
tcggtggtagttgttgtttcaggaa

SEQ ID NO: 310791 - DNA, 25 bp, Homo sapien
tggtagttgttgtttcaggaaactt

SEQ ID NO: 310792 - DNA, 25 bp, Homo sapien
ggaaactttattaagtcagcctctc

SEQ ID NO: 310793 - DNA, 25 bp, Homo sapien
aactttattaagtcagcctctcttt

SEQ ID NO: 310794 - DNA, 25 bp, Homo sapien
tattaagtcagcctctctttttctc

SEQ ID NO: 310795 - DNA, 25 bp, Homo sapien
gctaccgccgcggagcgcgtaggaa

SEQ ID NO: 310796 - DNA, 25 bp, Homo sapien
ctggtgctcttgtcacaggtagaac

SEQ ID NO: 310797 - DNA, 25 bp, Homo sapien
ggtagaacagcttgtttcttttcca

SEQ ID NO: 310798 - DNA, 25 bp, Homo sapien
tttccatctattcaagtgtgtttct

SEQ ID NO: 310799 - DNA, 25 bp, Homo sapien
aaatgctgatcttctctggagtcta

SEQ ID NO: 310800 - DNA, 25 bp, Homo sapien
ggtaggcaattatggtcactggaat

SEQ ID NO: 310801 - DNA, 25 bp, Homo sapien
ggtgcatgtacaacagcatccaaca

SEQ ID NO: 310802 - DNA, 25 bp, Homo sapien
gcatccaacatatctgtcttgttcc

SEQ ID NO: 310803 - DNA, 25 bp, Homo sapien
agctctgattttaggccttttgtgc

SEQ ID NO: 310804 - DNA, 25 bp, Homo sapien
taggccttttgtgcataccattaca

SEQ ID NO: 310805 - DNA, 25 bp, Homo sapien
gacattctacagtagcctgtgctga

SEQ ID NO: 310806 - DNA, 25 bp, Homo sapien
gcctgtgctgaactgatctcttaaa

SEQ ID NO: 310807 - DNA, 25 bp, Homo sapien
cggagggtgcggtgactgagatcac

SEQ ID NO: 310808 - DNA, 25 bp, Homo sapien
ggagggtgcggtgactgagatcacg

SEQ ID NO: 310809 - DNA, 25 bp, Homo sapien
aagaccatttatggcctaaccttgg

SEQ ID NO: 310810 - DNA, 25 bp, Homo sapien
agaccatttatggcctaaccttggt

SEQ ID NO: 310811 - DNA, 25 bp, Homo sapien
gaccatttatggcctaaccttggtt

SEQ ID NO: 310812 - DNA, 25 bp, Homo sapien
cttggtttttctgtctgtctcaaca

SEQ ID NO: 310813 - DNA, 25 bp, Homo sapien
ttctgtctgtctcaacaagaagtca

SEQ ID NO: 310814 - DNA, 25 bp, Homo sapien
tctgtctgtctcaacaagaagtcat

SEQ ID NO: 310815 - DNA, 25 bp, Homo sapien
ctgtctgtctcaacaagaagtcata

SEQ ID NO: 310816 - DNA, 25 bp, Homo sapien
gtctgtctcaacaagaagtcatatg

SEQ ID NO: 310817 - DNA, 25 bp, Homo sapien
gtctcaacaagaagtcatatgactt

SEQ ID NO: 310818 - DNA, 25 bp, Homo sapien
cttggcccatcagatgtttgattgt

SEQ ID NO: 310819 - DNA, 25 bp, Homo sapien
agatgtttgattgttatcccctccc

SEQ ID NO: 310820 - DNA, 25 bp, Homo sapien
cttctaccctgtgtttgcctataaa

SEQ ID NO: 310821 - DNA, 25 bp, Homo sapien
gtttgcctataaaagacacagtcat

SEQ ID NO: 310822 - DNA, 25 bp, Homo sapien
gacacagtcatatgttcctgggccc

SEQ ID NO: 310823 - DNA, 25 bp, Homo sapien
agcacctaggtgttgtcttactgga

SEQ ID NO: 310824 - DNA, 25 bp, Homo sapien
gtcttactggaatgtgtccacatgg

SEQ ID NO: 310825 - DNA, 25 bp, Homo sapien
gtgatatgtcacgtggcccagtact

SEQ ID NO: 310826 - DNA, 25 bp, Homo sapien
ctctcatgcctaggccttgtagaga

SEQ ID NO: 310827 - DNA, 25 bp, Homo sapien
gcctaggccttgtagagaatcccct

SEQ ID NO: 310828 - DNA, 25 bp, Homo sapien
ttttttctttgcagatccaggagat

SEQ ID NO: 310829 - DNA, 25 bp, Homo sapien
gacaatcagaatgtgttcatttata

SEQ ID NO: 310830 - DNA, 25 bp, Homo sapien
ataaagtatcactggtttgtatatt

SEQ ID NO: 310831 - DNA, 25 bp, Homo sapien
gtatattttaatgctgacctttgcc

SEQ ID NO: 310832 - DNA, 25 bp, Homo sapien
gctgacctttgcctgtgaactagaa

SEQ ID NO: 310833 - DNA, 25 bp, Homo sapien
acctttgcctgtgaactagaaaatc

SEQ ID NO: 310834 - DNA, 25 bp, Homo sapien
gtagagtcaggttgatttgccttca

SEQ ID NO: 310835 - DNA, 25 bp, Homo sapien
ttgatttgccttcatttaattcctg

SEQ ID NO: 310836 - DNA, 25 bp, Homo sapien
taattcctgcaaatgcattggaagt

SEQ ID NO: 310837 - DNA, 25 bp, Homo sapien
agtggatggataacttggaactttt

SEQ ID NO: 310838 - DNA, 25 bp, Homo sapien
taacttggaactttttccatactgt

SEQ ID NO: 310839 - DNA, 25 bp, Homo sapien
cccctcaccaagcattaaatctaat

SEQ ID NO: 310840 - DNA, 25 bp, Homo sapien
ctcatttttctgtttaatctccaca

SEQ ID NO: 310841 - DNA, 25 bp, Homo sapien
gtttaatctccacaacagccctatg

SEQ ID NO: 310842 - DNA, 25 bp, Homo sapien
agccctatgagggtggctccctttg

SEQ ID NO: 310843 - DNA, 25 bp, Homo sapien
tccagcaatagggtgctcactgcct

SEQ ID NO: 310844 - DNA, 25 bp, Homo sapien
gctccctttgttgtttgcattttaa

SEQ ID NO: 310845 - DNA, 25 bp, Homo sapien
tcagagaagttgagggacctgtccc

SEQ ID NO: 310846 - DNA, 25 bp, Homo sapien
agggacctgtcccagcatcacatgg

SEQ ID NO: 310847 - DNA, 25 bp, Homo sapien
ggtgtttgagcacaggccattcaca

SEQ ID NO: 310848 - DNA, 25 bp, Homo sapien
aaagaacaaccaccaccaacatcgg

SEQ ID NO: 310849 - DNA, 25 bp, Homo sapien
accaacatcggtaactccctgtatt

SEQ ID NO: 310850 - DNA, 25 bp, Homo sapien
aactccctgtattctcatttttctg

SEQ ID NO: 310851 - DNA, 25 bp, Homo sapien
ggaagccctgctaccctggacctta

SEQ ID NO: 310852 - DNA, 25 bp, Homo sapien
taccctggaccttacaccgggtgtg

SEQ ID NO: 310853 - DNA, 25 bp, Homo sapien
ttacaccgggtgtgggaatcagcct

SEQ ID NO: 310854 - DNA, 25 bp, Homo sapien
accgggtgtgggaatcagcctctgc

SEQ ID NO: 310855 - DNA, 25 bp, Homo sapien
ggtgtgggaatcagcctctgccccg

SEQ ID NO: 310856 - DNA, 25 bp, Homo sapien
agccccatctctgtctcaaggagag

SEQ ID NO: 310857 - DNA, 25 bp, Homo sapien
cccatctctgtctcaaggagagcag

SEQ ID NO: 310858 - DNA, 25 bp, Homo sapien
tctctgtctcaaggagagcagggta

SEQ ID NO: 310859 - DNA, 25 bp, Homo sapien
cagggtaggtgaaagtctagagaaa

SEQ ID NO: 310860 - DNA, 25 bp, Homo sapien
caacatccgggctgatagggatcaa

SEQ ID NO: 310861 - DNA, 25 bp, Homo sapien
catccgggctgatagggatcaagga

SEQ ID NO: 310862 - DNA, 25 bp, Homo sapien
ggtaatacatactgacaacccattc

SEQ ID NO: 310863 - DNA, 25 bp, Homo sapien
tgacaacccattcagcccaatgtag

SEQ ID NO: 310864 - DNA, 25 bp, Homo sapien
cattcagcccaatgtagcaggcagt

SEQ ID NO: 310865 - DNA, 25 bp, Homo sapien
aatgtagcaggcagtctgctcccac

SEQ ID NO: 310866 - DNA, 25 bp, Homo sapien
tgaccctttccgtagtgacatctgg

SEQ ID NO: 310867 - DNA, 25 bp, Homo sapien
agtgacatctggctctcagcttatt

SEQ ID NO: 310868 - DNA, 25 bp, Homo sapien
cagcttattgccctttcatgtaatt

SEQ ID NO: 310869 - DNA, 25 bp, Homo sapien
tcataaatcctgatttagtttcctg

SEQ ID NO: 310870 - DNA, 25 bp, Homo sapien
ggcttaccaggctgggcgaatagct

SEQ ID NO: 310871 - DNA, 25 bp, Homo sapien
ggctgggcgaatagcttaagtacaa

SEQ ID NO: 310872 - DNA, 25 bp, Homo sapien
aagtcatggtgagtgttgagtcagt

SEQ ID NO: 310873 - DNA, 25 bp, Homo sapien
agaagcttcctagcttactctttct

SEQ ID NO: 310874 - DNA, 25 bp, Homo sapien
gcttcctagcttactctttctgtaa

SEQ ID NO: 310875 - DNA, 25 bp, Homo sapien
gcttactctttctgtaatcttcttt

SEQ ID NO: 310876 - DNA, 25 bp, Homo sapien
ttttcctaaatgtaagagagcctca

SEQ ID NO: 310877 - DNA, 25 bp, Homo sapien
attactagagtaaggctgtcaaagg

SEQ ID NO: 310878 - DNA, 25 bp, Homo sapien
acataaacttgacatgtatggtggg

SEQ ID NO: 310879 - DNA, 25 bp, Homo sapien
aagaatctgtgttgtcttaacaaat

SEQ ID NO: 310880 - DNA, 25 bp, Homo sapien
gtcttaacaaatagatgcttctcaa

SEQ ID NO: 310881 - DNA, 25 bp, Homo sapien
tgcttctcaaggagcttacgctagt

SEQ ID NO: 310882 - DNA, 25 bp, Homo sapien
agcttacgctagtggttactctgtc

SEQ ID NO: 310883 - DNA, 25 bp, Homo sapien
tagtggttactctgtccagtcaggg

SEQ ID NO: 310884 - DNA, 25 bp, Homo sapien
gagcagaggcttatggactagacca

SEQ ID NO: 310885 - DNA, 25 bp, Homo sapien
atggactagaccacttttttcaggg

SEQ ID NO: 310886 - DNA, 25 bp, Homo sapien
agggctttaccttatcagccatgac

SEQ ID NO: 310887 - DNA, 25 bp, Homo sapien
ggtctcaatgtaggtctctcactcc

SEQ ID NO: 310888 - DNA, 25 bp, Homo sapien
taggtctctcactccagcagttttg

SEQ ID NO: 310889 - DNA, 25 bp, Homo sapien
ttgcccacatttttcatggctgtta

SEQ ID NO: 310890 - DNA, 25 bp, Homo sapien
gaaggcaagccttgagtgccactta

SEQ ID NO: 310891 - DNA, 25 bp, Homo sapien
gccttgagtgccacttacttggtaa

SEQ ID NO: 310892 - DNA, 25 bp, Homo sapien
attgtgtcagattgctcactgtagc

SEQ ID NO: 310893 - DNA, 25 bp, Homo sapien
caagacagagttctttgtggcttct

SEQ ID NO: 310894 - DNA, 25 bp, Homo sapien
tggcttctgtaacttgccatccaag

SEQ ID NO: 310895 - DNA, 25 bp, Homo sapien
gagagtcaggaccttgtggcactct

SEQ ID NO: 310896 - DNA, 25 bp, Homo sapien
aggaccttgtggcactctttaacca

SEQ ID NO: 310897 - DNA, 25 bp, Homo sapien
gtggcactctttaaccagtgaatgc

SEQ ID NO: 310898 - DNA, 25 bp, Homo sapien
ggcttggtgcagtaaggatgaaaac

SEQ ID NO: 310899 - DNA, 25 bp, Homo sapien
accagtgaatgctagttgaaggcaa

SEQ ID NO: 310900 - DNA, 25 bp, Homo sapien
gaaggcaatacaaccctctaggagg

SEQ ID NO: 310901 - DNA, 25 bp, Homo sapien
tacaaccctctaggaggagtttgga

SEQ ID NO: 310902 - DNA, 25 bp, Homo sapien
ttcaattgtctggaggatgtggttc

SEQ ID NO: 310903 - DNA, 25 bp, Homo sapien
gatgtggttccgactggaactcttt

SEQ ID NO: 310904 - DNA, 25 bp, Homo sapien
tccgactggaactctttggaaaaca

SEQ ID NO: 310905 - DNA, 25 bp, Homo sapien
agctgctgacagctgtctgactggt

SEQ ID NO: 310906 - DNA, 25 bp, Homo sapien
aaatgcaaattagctggacaggggt

SEQ ID NO: 310907 - DNA, 25 bp, Homo sapien
aatgcaaattagctggacaggggtg

SEQ ID NO: 310908 - DNA, 25 bp, Homo sapien
tgcaaattagctggacaggggtggc

SEQ ID NO: 310909 - DNA, 25 bp, Homo sapien
gcaaattagctggacaggggtggcg

SEQ ID NO: 310910 - DNA, 25 bp, Homo sapien
cctgggcgacaagaaggcaagggag

SEQ ID NO: 310911 - DNA, 25 bp, Homo sapien
ctgggcgacaagaaggcaagggagg

SEQ ID NO: 310912 - DNA, 25 bp, Homo sapien
tgggcgacaagaaggcaagggagga

SEQ ID NO: 310913 - DNA, 25 bp, Homo sapien
gcgacaagaaggcaagggaggaaaa

SEQ ID NO: 310914 - DNA, 25 bp, Homo sapien
gggaggaaaaaagcagggaattcag

SEQ ID NO: 310915 - DNA, 25 bp, Homo sapien
aaagcagggaattcaggggcagcac

SEQ ID NO: 310916 - DNA, 25 bp, Homo sapien
agcagggaattcaggggcagcacct

SEQ ID NO: 310917 - DNA, 25 bp, Homo sapien
ttttctggagagacattttcccttc

SEQ ID NO: 310918 - DNA, 25 bp, Homo sapien
tctggagagacattttcccttcttt

SEQ ID NO: 310919 - DNA, 25 bp, Homo sapien
attttcccttcttttcactgtgtgt

SEQ ID NO: 310920 - DNA, 25 bp, Homo sapien
tcactgtgtgttttcaaattcaaaa

SEQ ID NO: 310921 - DNA, 25 bp, Homo sapien
tcaaaatatgtgttcctttggtcac

SEQ ID NO: 310922 - DNA, 25 bp, Homo sapien
atatgtgttcctttggtcacactat

SEQ ID NO: 310923 - DNA, 25 bp, Homo sapien
gttcctttggtcacactatacattt

SEQ ID NO: 310924 - DNA, 25 bp, Homo sapien
tcctttggtcacactatacattttt

SEQ ID NO: 310925 - DNA, 25 bp, Homo sapien
gaagtgtcacactgtactttttaca

SEQ ID NO: 310926 - DNA, 25 bp, Homo sapien
ttacattttacattgcagcgatctc

SEQ ID NO: 310927 - DNA, 25 bp, Homo sapien
acattttacattgcagcgatctcag

SEQ ID NO: 310928 - DNA, 25 bp, Homo sapien
agagatcttgaactggccaattacc

SEQ ID NO: 310929 - DNA, 25 bp, Homo sapien
ggccaattaccaggctaatggagaa

SEQ ID NO: 310930 - DNA, 25 bp, Homo sapien
gcagctgtggaaactggttagtaac

SEQ ID NO: 310931 - DNA, 25 bp, Homo sapien
gagtatgagtcttagtttattttta

SEQ ID NO: 310932 - DNA, 25 bp, Homo sapien
taattgtccaacaaattccaagttc

SEQ ID NO: 310933 - DNA, 25 bp, Homo sapien
tagtaactaattctttacccagatg

SEQ ID NO: 310934 - DNA, 25 bp, Homo sapien
tttacccagatgttccttcaagatt

SEQ ID NO: 310935 - DNA, 25 bp, Homo sapien
gatgttccttcaagatttcattaca

SEQ ID NO: 310936 - DNA, 25 bp, Homo sapien
gatttcattacatcttgcagtgatc

SEQ ID NO: 310937 - DNA, 25 bp, Homo sapien
tgcagtgatcattgacaccagttgt

SEQ ID NO: 310938 - DNA, 25 bp, Homo sapien
gacaccagttgtcactgtatggtta

SEQ ID NO: 310939 - DNA, 25 bp, Homo sapien
aattagcttccacttcctgaaggga

SEQ ID NO: 310940 - DNA, 25 bp, Homo sapien
gcttccacttcctgaagggaggact

SEQ ID NO: 310941 - DNA, 25 bp, Homo sapien
cctgaagggaggactgtgtaagaat

SEQ ID NO: 310942 - DNA, 25 bp, Homo sapien
aaactaccacatacctaatcacatt

SEQ ID NO: 310943 - DNA, 25 bp, Homo sapien
gagcacaaagaccaagaaaatacct

SEQ ID NO: 310944 - DNA, 25 bp, Homo sapien
aggacatactaccttttgaggagca

SEQ ID NO: 310945 - DNA, 25 bp, Homo sapien
actaccttttgaggagcaacatagc

SEQ ID NO: 310946 - DNA, 25 bp, Homo sapien
gcaacatagcagcagatatctcagc

SEQ ID NO: 310947 - DNA, 25 bp, Homo sapien
gatatctcagctataaccagtgtaa

SEQ ID NO: 310948 - DNA, 25 bp, Homo sapien
gaaagttgtcatcctagaattgcat

SEQ ID NO: 310949 - DNA, 25 bp, Homo sapien
ctagaattgcatactcagggaaaat

SEQ ID NO: 310950 - DNA, 25 bp, Homo sapien
gtctgtatgaaagcatgtggtcaat

SEQ ID NO: 310951 - DNA, 25 bp, Homo sapien
tctgtatgaaagcatgtggtcaatt

SEQ ID NO: 310952 - DNA, 25 bp, Homo sapien
aatttctgctgctcggggtttgaga

SEQ ID NO: 310953 - DNA, 25 bp, Homo sapien
gagaagttctatattaggatgtcat

SEQ ID NO: 310954 - DNA, 25 bp, Homo sapien
agaagttctatattaggatgtcatt

SEQ ID NO: 310955 - DNA, 25 bp, Homo sapien
tttcaacagaagattgaggacactg

SEQ ID NO: 310956 - DNA, 25 bp, Homo sapien
cagaagattgaggacactgaaatat

SEQ ID NO: 310957 - DNA, 25 bp, Homo sapien
aatatgaggtgtgtgaagaaagtac

SEQ ID NO: 310958 - DNA, 25 bp, Homo sapien
cagagaaacttttgtggttgactta

SEQ ID NO: 310959 - DNA, 25 bp, Homo sapien
gagaaacttttgtggttgacttata

SEQ ID NO: 310960 - DNA, 25 bp, Homo sapien
gttgacttataaaacttgtaagtgc

SEQ ID NO: 310961 - DNA, 25 bp, Homo sapien
gcacagcaggtggtggaagcctaat

SEQ ID NO: 310962 - DNA, 25 bp, Homo sapien
aagcctaatagttgtgcaggtgatt

SEQ ID NO: 310963 - DNA, 25 bp, Homo sapien
aaagcacggagtggccacagttgga

SEQ ID NO: 310964 - DNA, 25 bp, Homo sapien
cacagttggatctgaccgagggaac

SEQ ID NO: 310965 - DNA, 25 bp, Homo sapien
gagggaactgaatcttttcctccat

SEQ ID NO: 310966 - DNA, 25 bp, Homo sapien
gaatcttttcctccatgtgagagct

SEQ ID NO: 310967 - DNA, 25 bp, Homo sapien
tgtgagagctgttgtcagcccaaca

SEQ ID NO: 310968 - DNA, 25 bp, Homo sapien
gtatacatgtacctgggacagggca

SEQ ID NO: 310969 - DNA, 25 bp, Homo sapien
agcttcccattctgcaatagtggca

SEQ ID NO: 310970 - DNA, 25 bp, Homo sapien
atagtggcatgatacccttttcctg

SEQ ID NO: 310971 - DNA, 25 bp, Homo sapien
agctggacccgaaatctaccaacaa

SEQ ID NO: 310972 - DNA, 25 bp, Homo sapien
cacccttcaatgtctccttgtgact

SEQ ID NO: 310973 - DNA, 25 bp, Homo sapien
aatgtctccttgtgactccttctta

SEQ ID NO: 310974 - DNA, 25 bp, Homo sapien
ctccttgtgactccttcttatggga

SEQ ID NO: 310975 - DNA, 25 bp, Homo sapien
gactccttcttatgggaggtcgacc

SEQ ID NO: 310976 - DNA, 25 bp, Homo sapien
atgggaggtcgacccagactgccac

SEQ ID NO: 310977 - DNA, 25 bp, Homo sapien
gcaggttgtgacatggagcaaactt

SEQ ID NO: 310978 - DNA, 25 bp, Homo sapien
gacatggagcaaacttttggtagtt

SEQ ID NO: 310979 - DNA, 25 bp, Homo sapien
ttttggtagtttgggatcttctctc

SEQ ID NO: 310980 - DNA, 25 bp, Homo sapien
tggtagtttgggatcttctctccca

SEQ ID NO: 310981 - DNA, 25 bp, Homo sapien
gccactccaaagtctatacacaggg

SEQ ID NO: 310982 - DNA, 25 bp, Homo sapien
acacaggggtggtctcttcaataaa

SEQ ID NO: 310983 - DNA, 25 bp, Homo sapien
taatgggtttctttaaactctagag

SEQ ID NO: 310984 - DNA, 25 bp, Homo sapien
actctagagggaaggcaaaagctgc

SEQ ID NO: 310985 - DNA, 25 bp, Homo sapien
tgggtgagggcctccacaaggcctc

SEQ ID NO: 310986 - DNA, 25 bp, Homo sapien
gcagacgcgatgaggccgtgcccat

SEQ ID NO: 310987 - DNA, 25 bp, Homo sapien
tgcgctgggacagatcagcctggct

SEQ ID NO: 310988 - DNA, 25 bp, Homo sapien
agcctggctgcagtagggacagaca

SEQ ID NO: 310989 - DNA, 25 bp, Homo sapien
gtagggacagacacgccaaggcaag

SEQ ID NO: 310990 - DNA, 25 bp, Homo sapien
acgccaaggcaagacaggagcagca

SEQ ID NO: 310991 - DNA, 25 bp, Homo sapien
ctgagggcagcggaactaaggtcat

SEQ ID NO: 310992 - DNA, 25 bp, Homo sapien
ggcacaagggaacttgctgtacttt

SEQ ID NO: 310993 - DNA, 25 bp, Homo sapien
tctgctcaattttcctagaaaccta

SEQ ID NO: 310994 - DNA, 25 bp, Homo sapien
agacttatgggaatgctgggtagaa

SEQ ID NO: 310995 - DNA, 25 bp, Homo sapien
gaagctgttttaattcccctgttga

SEQ ID NO: 310996 - DNA, 25 bp, Homo sapien
ggtagtagtattcctgggtctttat

SEQ ID NO: 310997 - DNA, 25 bp, Homo sapien
tttatgatgaccaccttgggccttg

SEQ ID NO: 310998 - DNA, 25 bp, Homo sapien
ttgggccttgggatcatgaccagga

SEQ ID NO: 310999 - DNA, 25 bp, Homo sapien
gaatcacgtgaagctgacaccactg

SEQ ID NO: 311000 - DNA, 25 bp, Homo sapien
agctgacaccactgaagggagagtt

SEQ ID NO: 311001 - DNA, 25 bp, Homo sapien
ggcagaaagagatcaagtccttggt

SEQ ID NO: 311002 - DNA, 25 bp, Homo sapien
taagtacaggatcaagccttgcttg

SEQ ID NO: 311003 - DNA, 25 bp, Homo sapien
aagccttgcttgagattggccttac

SEQ ID NO: 311004 - DNA, 25 bp, Homo sapien
gattggccttacctctggacttttt

SEQ ID NO: 311005 - DNA, 25 bp, Homo sapien
ggtatctgaaagtggactttcacta

SEQ ID NO: 311006 - DNA, 25 bp, Homo sapien
atgctagaattattgattaccaaaa

SEQ ID NO: 311007 - DNA, 25 bp, Homo sapien
aatggcaatgactttgtacctggtt

SEQ ID NO: 311008 - DNA, 25 bp, Homo sapien
aatgactttgtacctggttgccaca

SEQ ID NO: 311009 - DNA, 25 bp, Homo sapien
gactttgtacctggttgccacagaa

SEQ ID NO: 311010 - DNA, 25 bp, Homo sapien
tttgtacctggttgccacagaagtt

SEQ ID NO: 311011 - DNA, 25 bp, Homo sapien
gtacctggttgccacagaagttaga

SEQ ID NO: 311012 - DNA, 25 bp, Homo sapien
acagaagttagaaaggcctcgagaa

SEQ ID NO: 311013 - DNA, 25 bp, Homo sapien
gaaaggcctcgagaaaaatgttagt

SEQ ID NO: 311014 - DNA, 25 bp, Homo sapien
ggcctcgagaaaaatgttagtgaat

SEQ ID NO: 311015 - DNA, 25 bp, Homo sapien
agataactggaactaaatttggtat

SEQ ID NO: 311016 - DNA, 25 bp, Homo sapien
gagccccgggctcgcaaccgttgtc

SEQ ID NO: 311017 - DNA, 25 bp, Homo sapien
gctccgactgcttgtaggcgatgcc

SEQ ID NO: 311018 - DNA, 25 bp, Homo sapien
tccgactgcttgtaggcgatgccca

SEQ ID NO: 311019 - DNA, 25 bp, Homo sapien
cgactgcttgtaggcgatgcccagg

SEQ ID NO: 311020 - DNA, 25 bp, Homo sapien
tgcttgtaggcgatgcccaggcaaa

SEQ ID NO: 311021 - DNA, 25 bp, Homo sapien
ggaggaggagcaaccggagccacca

SEQ ID NO: 311022 - DNA, 25 bp, Homo sapien
taggcgatgcccaggcaaagaccgt

SEQ ID NO: 311023 - DNA, 25 bp, Homo sapien
gatgcccaggcaaagaccgtgactg

SEQ ID NO: 311024 - DNA, 25 bp, Homo sapien
gcccaggcaaagaccgtgactgaca

SEQ ID NO: 311025 - DNA, 25 bp, Homo sapien
ggcaaagaccgtgactgacactctc

SEQ ID NO: 311026 - DNA, 25 bp, Homo sapien
aaagaccgtgactgacactctcgct

SEQ ID NO: 311027 - DNA, 25 bp, Homo sapien
aaatacagaacgtgaaacccgagct

SEQ ID NO: 311028 - DNA, 25 bp, Homo sapien
acagaacgtgaaacccgagctgaac

SEQ ID NO: 311029 - DNA, 25 bp, Homo sapien
aacgtgaaacccgagctgaacagcg

SEQ ID NO: 311030 - DNA, 25 bp, Homo sapien
aaacccgagctgaacagcgtgtgct

SEQ ID NO: 311031 - DNA, 25 bp, Homo sapien
agctgaacagcgtgtgctctgatta

SEQ ID NO: 311032 - DNA, 25 bp, Homo sapien
tgaacagcgtgtgctctgattactt

SEQ ID NO: 311033 - DNA, 25 bp, Homo sapien
aacagcgtgtgctctgattacttga

SEQ ID NO: 311034 - DNA, 25 bp, Homo sapien
agcgtgtgctctgattacttgaatc

SEQ ID NO: 311035 - DNA, 25 bp, Homo sapien
gtgtgctctgattacttgaatctgg

SEQ ID NO: 311036 - DNA, 25 bp, Homo sapien
tctgattacttgaatctggtctcct

SEQ ID NO: 311037 - DNA, 25 bp, Homo sapien
ttccacttgaatttagtgctattag

SEQ ID NO: 311038 - DNA, 25 bp, Homo sapien
tttcatcagccttccaaaggccagc

SEQ ID NO: 311039 - DNA, 25 bp, Homo sapien
aaaggccagcttttgcttcatgtct

SEQ ID NO: 311040 - DNA, 25 bp, Homo sapien
tttgcttcatgtctgccttccgagt

SEQ ID NO: 311041 - DNA, 25 bp, Homo sapien
gagtcccagctcctgttttatggca

SEQ ID NO: 311042 - DNA, 25 bp, Homo sapien
tgttttatggcagcctcctgaggcc

SEQ ID NO: 311043 - DNA, 25 bp, Homo sapien
ctcctagtggcctcttttggcccaa

SEQ ID NO: 311044 - DNA, 25 bp, Homo sapien
ttagcagccactacaggcccagctt

SEQ ID NO: 311045 - DNA, 25 bp, Homo sapien
aggcccagctttgcgtcctttcaag

SEQ ID NO: 311046 - DNA, 25 bp, Homo sapien
agctttgcgtcctttcaagagtcct

SEQ ID NO: 311047 - DNA, 25 bp, Homo sapien
ttgcgtcctttcaagagtcctgcct

SEQ ID NO: 311048 - DNA, 25 bp, Homo sapien
tttcaagagtcctgcctcacagtgg

SEQ ID NO: 311049 - DNA, 25 bp, Homo sapien
gggtcctctggcttccagttacgca

SEQ ID NO: 311050 - DNA, 25 bp, Homo sapien
ctgtgctctatgtccgcacaaggga

SEQ ID NO: 311051 - DNA, 25 bp, Homo sapien
ttccagttacgcatctgggcagtgt

SEQ ID NO: 311052 - DNA, 25 bp, Homo sapien
atctgggcagtgtcccaaggccggt

SEQ ID NO: 311053 - DNA, 25 bp, Homo sapien
tctatgtccgcacaagggacgcagg

SEQ ID NO: 311054 - DNA, 25 bp, Homo sapien
agttccctggagacctccagacctg

SEQ ID NO: 311055 - DNA, 25 bp, Homo sapien
tcctggcctctgtgcaatgctgaca

SEQ ID NO: 311056 - DNA, 25 bp, Homo sapien
tgacaataaacctgtctctgcgtcc

SEQ ID NO: 311057 - DNA, 25 bp, Homo sapien
ataaacctgtctctgcgtcccagaa

SEQ ID NO: 311058 - DNA, 25 bp, Homo sapien
aggaccctaggttccccaggatgct

SEQ ID NO: 311059 - DNA, 25 bp, Homo sapien
tccccaggatgctcctcctattggg

SEQ ID NO: 311060 - DNA, 25 bp, Homo sapien
aaatttgaacagactaccaagcata

SEQ ID NO: 311061 - DNA, 25 bp, Homo sapien
gaacagactaccaagcatatttgaa

SEQ ID NO: 311062 - DNA, 25 bp, Homo sapien
taggtaactcaatccagtgtggtgc

SEQ ID NO: 311063 - DNA, 25 bp, Homo sapien
cagagtgtaacattggtctttgtct

SEQ ID NO: 311064 - DNA, 25 bp, Homo sapien
atctattttccttcatagtaccttt

SEQ ID NO: 311065 - DNA, 25 bp, Homo sapien
ttccttcatagtacctttaaaatat

SEQ ID NO: 311066 - DNA, 25 bp, Homo sapien
atccagtgtggtgctacaccaatca

SEQ ID NO: 311067 - DNA, 25 bp, Homo sapien
acttaacagattttcttatgctgat

SEQ ID NO: 311068 - DNA, 25 bp, Homo sapien
ttatgctgatatgtagaagcctacc

SEQ ID NO: 311069 - DNA, 25 bp, Homo sapien
gtgtggtgctacaccaatcatattg

SEQ ID NO: 311070 - DNA, 25 bp, Homo sapien
aacacgcacaaagttggcttccttt

SEQ ID NO: 311071 - DNA, 25 bp, Homo sapien
gtctgtatgaaagcatgtggtcaat

SEQ ID NO: 311072 - DNA, 25 bp, Homo sapien
atgtggtcaatttctgctgctcggg

SEQ ID NO: 311073 - DNA, 25 bp, Homo sapien
aatttctgctgctcggggtttgaga

SEQ ID NO: 311074 - DNA, 25 bp, Homo sapien
gagaagttctatattaggatgtcat

SEQ ID NO: 311075 - DNA, 25 bp, Homo sapien
aggatgtcatttacatacttttcaa

SEQ ID NO: 311076 - DNA, 25 bp, Homo sapien
tttcaacagaagattgaggacactg

SEQ ID NO: 311077 - DNA, 25 bp, Homo sapien
cagaagattgaggacactgaaatat

SEQ ID NO: 311078 - DNA, 25 bp, Homo sapien
aatatgaggtgtgtgaagaaagtac

SEQ ID NO: 311079 - DNA, 25 bp, Homo sapien
cagagaaacttttgtggttgactta

SEQ ID NO: 311080 - DNA, 25 bp, Homo sapien
gagaaacttttgtggttgacttata

SEQ ID NO: 311081 - DNA, 25 bp, Homo sapien
gttgacttataaaacttgtaagtgc

SEQ ID NO: 311082 - DNA, 25 bp, Homo sapien
gaaggtacgtggattatctgatgct

SEQ ID NO: 311083 - DNA, 25 bp, Homo sapien
tacgtggattatctgatgctacatc

SEQ ID NO: 311084 - DNA, 25 bp, Homo sapien
gatgctacatcacactctgggagag

SEQ ID NO: 311085 - DNA, 25 bp, Homo sapien
gggagagacttcccttctttcagag

SEQ ID NO: 311086 - DNA, 25 bp, Homo sapien
ttctttcagagagcctctcatttct

SEQ ID NO: 311087 - DNA, 25 bp, Homo sapien
agagcctctcatttcttaatgtgga

SEQ ID NO: 311088 - DNA, 25 bp, Homo sapien
atgtggatcattttgctctttcccc

SEQ ID NO: 311089 - DNA, 25 bp, Homo sapien
tgataatgctcacttactctctttc

SEQ ID NO: 311090 - DNA, 25 bp, Homo sapien
acatttcttattatcatttattgca

SEQ ID NO: 311091 - DNA, 25 bp, Homo sapien
attgcacatagcatggattaatcaa

SEQ ID NO: 311092 - DNA, 25 bp, Homo sapien
aatagactagagaaaggtgctttat

SEQ ID NO: 311093 - DNA, 25 bp, Homo sapien
tttcatcagccttccaaaggccagc

SEQ ID NO: 311094 - DNA, 25 bp, Homo sapien
aaaggccagcttttgcttcatgtct

SEQ ID NO: 311095 - DNA, 25 bp, Homo sapien
aggccagcttttgcttcatgtctgc

SEQ ID NO: 311096 - DNA, 25 bp, Homo sapien
ttttgcttcatgtctgccttccgag

SEQ ID NO: 311097 - DNA, 25 bp, Homo sapien
ttgcttcatgtctgccttccgagtc

SEQ ID NO: 311098 - DNA, 25 bp, Homo sapien
ctcctagtggcctcttttggcccaa

SEQ ID NO: 311099 - DNA, 25 bp, Homo sapien
ttttggcccaactctttcctcacca

SEQ ID NO: 311100 - DNA, 25 bp, Homo sapien
ttagcagccactacaggcccagctt

SEQ ID NO: 311101 - DNA, 25 bp, Homo sapien
aggcccagctttgcgtcctttcaag

SEQ ID NO: 311102 - DNA, 25 bp, Homo sapien
agctttgcgtcctttcaagagtcct

SEQ ID NO: 311103 - DNA, 25 bp, Homo sapien
ttgcgtcctttcaagagtcctgcct

SEQ ID NO: 311104 - DNA, 25 bp, Homo sapien
tgtcagacacagtgccagctacttg

SEQ ID NO: 311105 - DNA, 25 bp, Homo sapien
tttactttatttcatgcgtttcttg

SEQ ID NO: 311106 - DNA, 25 bp, Homo sapien
tcatgcgtttcttgaacatagtaaa

SEQ ID NO: 311107 - DNA, 25 bp, Homo sapien
ttgtgtgtttttgtagggtctcgta

SEQ ID NO: 311108 - DNA, 25 bp, Homo sapien
ttgtagggtctcgtatagtgatata

SEQ ID NO: 311109 - DNA, 25 bp, Homo sapien
gtgatatactagatcttagcaaggt

SEQ ID NO: 311110 - DNA, 25 bp, Homo sapien
actagatcttagcaaggtaccaaaa

SEQ ID NO: 311111 - DNA, 25 bp, Homo sapien
ggtaccaaaaatagctgcctcctgc

SEQ ID NO: 311112 - DNA, 25 bp, Homo sapien
gctgcctcctgctgaaaagctttgt

SEQ ID NO: 311113 - DNA, 25 bp, Homo sapien
gctgaaaagctttgtgaccacaaac

SEQ ID NO: 311114 - DNA, 25 bp, Homo sapien
gtgaactttgtcagacacagtgcca

SEQ ID NO: 311115 - DNA, 25 bp, Homo sapien
gattgtgtggtcaaatattcaattt

SEQ ID NO: 311116 - DNA, 25 bp, Homo sapien
gaggcagaactcatgtaagaataaa

SEQ ID NO: 311117 - DNA, 25 bp, Homo sapien
tattaagttcttatgtatgtcaaaa

SEQ ID NO: 311118 - DNA, 25 bp, Homo sapien
gatatcattttgaaattcatccatc

SEQ ID NO: 311119 - DNA, 25 bp, Homo sapien
attcatccatcttattgggtattgc

SEQ ID NO: 311120 - DNA, 25 bp, Homo sapien
atcttattgggtattgcaggagttc

SEQ ID NO: 311121 - DNA, 25 bp, Homo sapien
gaaaagatgttaatgcccattccct

SEQ ID NO: 311122 - DNA, 25 bp, Homo sapien
gatgttaatgcccattccctaactt

SEQ ID NO: 311123 - DNA, 25 bp, Homo sapien
ttaatgcccattccctaacttatgt

SEQ ID NO: 311124 - DNA, 25 bp, Homo sapien
gcccattccctaacttatgtcttag

SEQ ID NO: 311125 - DNA, 25 bp, Homo sapien
tccctaacttatgtcttagaccaaa

SEQ ID NO: 311126 - DNA, 25 bp, Homo sapien
gaacagactaccaagcatatttgaa

SEQ ID NO: 311127 - DNA, 25 bp, Homo sapien
taggtaactcaatccagtgtggtgc

SEQ ID NO: 311128 - DNA, 25 bp, Homo sapien
gaaagcctctcttcatattatcaga

SEQ ID NO: 311129 - DNA, 25 bp, Homo sapien
cagagtgtaacattggtctttgtct

SEQ ID NO: 311130 - DNA, 25 bp, Homo sapien
atctattttccttcatagtaccttt

SEQ ID NO: 311131 - DNA, 25 bp, Homo sapien
atccagtgtggtgctacaccaatca

SEQ ID NO: 311132 - DNA, 25 bp, Homo sapien
acttaacagattttcttatgctgat

SEQ ID NO: 311133 - DNA, 25 bp, Homo sapien
ttatgctgatatgtagaagcctacc

SEQ ID NO: 311134 - DNA, 25 bp, Homo sapien
gtgtggtgctacaccaatcatattg

SEQ ID NO: 311135 - DNA, 25 bp, Homo sapien
aaacacgcacaaagttggcttcctt

SEQ ID NO: 311136 - DNA, 25 bp, Homo sapien
ttggcttcctttgtcttcttaaaat

SEQ ID NO: 311137 - DNA, 25 bp, Homo sapien
ttatttacagccacttcagacgaaa

SEQ ID NO: 311138 - DNA, 25 bp, Homo sapien
cacagtgggcatgcgcaacattaga

SEQ ID NO: 311139 - DNA, 25 bp, Homo sapien
aaaatgctcaggaggcgacaggact

SEQ ID NO: 311140 - DNA, 25 bp, Homo sapien
ggaggcgacaggactaaccactttt

SEQ ID NO: 311141 - DNA, 25 bp, Homo sapien
taaccacttttacactttgatcttt

SEQ ID NO: 311142 - DNA, 25 bp, Homo sapien
tttgatctttccttctaggctgtac

SEQ ID NO: 311143 - DNA, 25 bp, Homo sapien
ttccttctaggctgtacattatttt

SEQ ID NO: 311144 - DNA, 25 bp, Homo sapien
cagtgttagctggtgagtcaaattc

SEQ ID NO: 311145 - DNA, 25 bp, Homo sapien
taaaacccgggacacatgttccacg

SEQ ID NO: 311146 - DNA, 25 bp, Homo sapien
cacgtggcaaggcttccataaaaac

SEQ ID NO: 311147 - DNA, 25 bp, Homo sapien
gcaacattagaggaaggtgggcttt

SEQ ID NO: 311148 - DNA, 25 bp, Homo sapien
ctcaccctggtctaaggcactggag

SEQ ID NO: 311149 - DNA, 25 bp, Homo sapien
aaggcactggagaactcttgctccg

SEQ ID NO: 311150 - DNA, 25 bp, Homo sapien
ggagaactcttgctccgcagagctg

SEQ ID NO: 311151 - DNA, 25 bp, Homo sapien
agagctgcggactcttgcacgagag

SEQ ID NO: 311152 - DNA, 25 bp, Homo sapien
ttgcacgagagaacctgcgcccagc

SEQ ID NO: 311153 - DNA, 25 bp, Homo sapien
tgtggcacagtagggcccacaccgg

SEQ ID NO: 311154 - DNA, 25 bp, Homo sapien
gccatggactcctgtactggaggaa

SEQ ID NO: 311155 - DNA, 25 bp, Homo sapien
gtggtgataaatgtccaggtttaca

SEQ ID NO: 311156 - DNA, 25 bp, Homo sapien
gtcaatgtgctacaatggatggatt

SEQ ID NO: 311157 - DNA, 25 bp, Homo sapien
cattatgtgtaattgcctagccaga

SEQ ID NO: 311158 - DNA, 25 bp, Homo sapien
tgcctagccagatcaattacacaag

SEQ ID NO: 311159 - DNA, 25 bp, Homo sapien
caaagtagactttatgacccaaagg

SEQ ID NO: 311160 - DNA, 25 bp, Homo sapien
gactttatgacccaaaggttgaggt

SEQ ID NO: 311161 - DNA, 25 bp, Homo sapien
gaggtaaaagcactactagggacaa

SEQ ID NO: 311162 - DNA, 25 bp, Homo sapien
gaggcagcagattaataattggcat

SEQ ID NO: 311163 - DNA, 25 bp, Homo sapien
tactagggacaaagagtaatgcctc

SEQ ID NO: 311164 - DNA, 25 bp, Homo sapien
gagtaatgcctcttagtgatgaaag

SEQ ID NO: 311165 - DNA, 25 bp, Homo sapien
tttctaaatctgtatgcacttcatg

SEQ ID NO: 311166 - DNA, 25 bp, Homo sapien
gcacttcatgacataagctcacaat

SEQ ID NO: 311167 - DNA, 25 bp, Homo sapien
gagtgaaaactcattgacataaatt

SEQ ID NO: 311168 - DNA, 25 bp, Homo sapien
ccagtgtagctatattaatgccaga

SEQ ID NO: 311169 - DNA, 25 bp, Homo sapien
gtagctatattaatgccagacaaag

SEQ ID NO: 311170 - DNA, 25 bp, Homo sapien
gggcaccttttggaactggatccag

SEQ ID NO: 311171 - DNA, 25 bp, Homo sapien
ggaactggatccagcaacagacacc

SEQ ID NO: 311172 - DNA, 25 bp, Homo sapien
ccatccatcacataacagtggtctt

SEQ ID NO: 311173 - DNA, 25 bp, Homo sapien
ggagactctcggtcctttaaatgca

SEQ ID NO: 311174 - DNA, 25 bp, Homo sapien
gactctcggtcctttaaatgcaaag

SEQ ID NO: 311175 - DNA, 25 bp, Homo sapien
ctcggtcctttaaatgcaaagtagc

SEQ ID NO: 311176 - DNA, 25 bp, Homo sapien
gcaaagtagcaatggaggctcccaa

SEQ ID NO: 311177 - DNA, 25 bp, Homo sapien
agcaatggaggctcccaaccaagag

SEQ ID NO: 311178 - DNA, 25 bp, Homo sapien
tcccaaccaagaggtcccacctgaa

SEQ ID NO: 311179 - DNA, 25 bp, Homo sapien
ctccccatggactagcagtggtgtg

SEQ ID NO: 311180 - DNA, 25 bp, Homo sapien
ccccatggactagcagtggtgtggc

SEQ ID NO: 311181 - DNA, 25 bp, Homo sapien
attagttaggcttctgagcttgcaa

SEQ ID NO: 311182 - DNA, 25 bp, Homo sapien
ctgagcttgcaatcatattgaatgt

SEQ ID NO: 311183 - DNA, 25 bp, Homo sapien
ttatacttagaactgaccacctccc

SEQ ID NO: 311184 - DNA, 25 bp, Homo sapien
ccggccacgcggagagctgtacagt

SEQ ID NO: 311185 - DNA, 25 bp, Homo sapien
gctgtacagtgtgtaaatctgcctt

SEQ ID NO: 311186 - DNA, 25 bp, Homo sapien
gtgtaaatctgcctttatcttggat

SEQ ID NO: 311187 - DNA, 25 bp, Homo sapien
gcctttatcttggattgattggtac

SEQ ID NO: 311188 - DNA, 25 bp, Homo sapien
tgattggtacagtatttttgcatct

SEQ ID NO: 311189 - DNA, 25 bp, Homo sapien
atttttgcatctgtgggacctacct

SEQ ID NO: 311190 - DNA, 25 bp, Homo sapien
tgggacctaccttttcgttcagtag

SEQ ID NO: 311191 - DNA, 25 bp, Homo sapien
cttttcgttcagtagtttgaactat

SEQ ID NO: 311192 - DNA, 25 bp, Homo sapien
gaaatgcacgtttacagcaagaggt

SEQ ID NO: 311193 - DNA, 25 bp, Homo sapien
gagatcatgctccaggacatatttg

SEQ ID NO: 311194 - DNA, 25 bp, Homo sapien
gactctattcttagcgtcacagtgg

SEQ ID NO: 311195 - DNA, 25 bp, Homo sapien
cacagtggacgggaaaactgccaac

SEQ ID NO: 311196 - DNA, 25 bp, Homo sapien
aaccttaacttggagacacggactg

SEQ ID NO: 311197 - DNA, 25 bp, Homo sapien
gtgaagacgatgaatccctccgaga

SEQ ID NO: 311198 - DNA, 25 bp, Homo sapien
atgaatccctccgagaaatggtgga

SEQ ID NO: 311199 - DNA, 25 bp, Homo sapien
gcacagagactgtacgaggccctga

SEQ ID NO: 311200 - DNA, 25 bp, Homo sapien
aggccctgacgccagttcactgaga

SEQ ID NO: 311201 - DNA, 25 bp, Homo sapien
agttcactgagactgtgcctgtata

SEQ ID NO: 311202 - DNA, 25 bp, Homo sapien
gactgtgcctgtatatgaactttga

SEQ ID NO: 311203 - DNA, 25 bp, Homo sapien
ttttggttgtctgtggcaattcctc

SEQ ID NO: 311204 - DNA, 25 bp, Homo sapien
ttgtctgtggcaattcctctgtaca

SEQ ID NO: 311205 - DNA, 25 bp, Homo sapien
tcctctgtacagattgtaacttttt

SEQ ID NO: 311206 - DNA, 25 bp, Homo sapien
cttcaccccgtcacttgaatatatg

SEQ ID NO: 311207 - DNA, 25 bp, Homo sapien
tattttggttgcaagacccttccga

SEQ ID NO: 311208 - DNA, 25 bp, Homo sapien
acccttccgaacacattcctgtata

SEQ ID NO: 311209 - DNA, 25 bp, Homo sapien
cattcctgtataaagtattttgcac

SEQ ID NO: 311210 - DNA, 25 bp, Homo sapien
gcactatttaaagaaacccatatgg

SEQ ID NO: 311211 - DNA, 25 bp, Homo sapien
caggatgtgcaatatgatggcgtca

SEQ ID NO: 311212 - DNA, 25 bp, Homo sapien
tatgatggcgtcacagtgctcatcg

SEQ ID NO: 311213 - DNA, 25 bp, Homo sapien
gtgctcatcgttgtacctgtaatgt

SEQ ID NO: 311214 - DNA, 25 bp, Homo sapien
acccttccctcattgttcaggaaag

SEQ ID NO: 311215 - DNA, 25 bp, Homo sapien
gaaagcttaggccacgtgacagtga

SEQ ID NO: 311216 - DNA, 25 bp, Homo sapien
acaatgattatgtcagcagctgctt

SEQ ID NO: 311217 - DNA, 25 bp, Homo sapien
agcagctgcttggaggcctgttcat

SEQ ID NO: 311218 - DNA, 25 bp, Homo sapien
atctactacccacgtttccagggag

SEQ ID NO: 311219 - DNA, 25 bp, Homo sapien
agggagccctgcgaggaactactca

SEQ ID NO: 311220 - DNA, 25 bp, Homo sapien
gaactactcatcacggtcctggatg

SEQ ID NO: 311221 - DNA, 25 bp, Homo sapien
ctctcctgagcccagactaacattt

SEQ ID NO: 311222 - DNA, 25 bp, Homo sapien
tctctttctaggactactcatctct

SEQ ID NO: 311223 - DNA, 25 bp, Homo sapien
taggactactcatctcttttagaga

SEQ ID NO: 311224 - DNA, 25 bp, Homo sapien
cctttctcctgttgacactcttttc

SEQ ID NO: 311225 - DNA, 25 bp, Homo sapien
gcttgttacatttaaggaccctaat

SEQ ID NO: 311226 - DNA, 25 bp, Homo sapien
ggaccctaatcaatacacaggacta

SEQ ID NO: 311227 - DNA, 25 bp, Homo sapien
aagggtgaaattacatgttccatgg

SEQ ID NO: 311228 - DNA, 25 bp, Homo sapien
gaggaagactctgaaacacactaga

SEQ ID NO: 311229 - DNA, 25 bp, Homo sapien
acactagaaggacacacccagggat

SEQ ID NO: 311230 - DNA, 25 bp, Homo sapien
cacacccagggatatcaacttcact

SEQ ID NO: 311231 - DNA, 25 bp, Homo sapien
tttcaaccttgaaccttccgagcta

SEQ ID NO: 311232 - DNA, 25 bp, Homo sapien
aaccttccgagctacaagagtctgt

SEQ ID NO: 311233 - DNA, 25 bp, Homo sapien
aagagtctgttgagcccttagcttc

SEQ ID NO: 311234 - DNA, 25 bp, Homo sapien
gtatacttgagtccttgtacacagt

SEQ ID NO: 311235 - DNA, 25 bp, Homo sapien
tttgacacagtcttagcttgttaca

SEQ ID NO: 311236 - DNA, 25 bp, Homo sapien
ctggagggccagacttgaaatgaga

SEQ ID NO: 311237 - DNA, 25 bp, Homo sapien
agggccagacttgaaatgagaactc

SEQ ID NO: 311238 - DNA, 25 bp, Homo sapien
cctgcgaacagccacttctaagtat

SEQ ID NO: 311239 - DNA, 25 bp, Homo sapien
gcgaacagccacttctaagtatggg

SEQ ID NO: 311240 - DNA, 25 bp, Homo sapien
aatgttactaagacaacttggtggg

SEQ ID NO: 311241 - DNA, 25 bp, Homo sapien
gcctccccgaggcacatggctgagt

SEQ ID NO: 311242 - DNA, 25 bp, Homo sapien
cccgaggcacatggctgagtgctga

SEQ ID NO: 311243 - DNA, 25 bp, Homo sapien
agctgggaaggcaccatcgtaatgc

SEQ ID NO: 311244 - DNA, 25 bp, Homo sapien
gggaaggcaccatcgtaatgccctg

SEQ ID NO: 311245 - DNA, 25 bp, Homo sapien
aaggcaccatcgtaatgccctggag

SEQ ID NO: 311246 - DNA, 25 bp, Homo sapien
gcaccatcgtaatgccctggagggc

SEQ ID NO: 311247 - DNA, 25 bp, Homo sapien
atctttcgtctttattgtcttacgt

SEQ ID NO: 311248 - DNA, 25 bp, Homo sapien
ttgtcttacgtttctaattagttgg

SEQ ID NO: 311249 - DNA, 25 bp, Homo sapien
aaaataagggctcatgacaagtaca

SEQ ID NO: 311250 - DNA, 25 bp, Homo sapien
gtacattatttgattctacttagga

SEQ ID NO: 311251 - DNA, 25 bp, Homo sapien
gattctacttaggatagctttttag

SEQ ID NO: 311252 - DNA, 25 bp, Homo sapien
tagctttttagcaggatctccttca

SEQ ID NO: 311253 - DNA, 25 bp, Homo sapien
gcaggatctccttcagaatttttgt

SEQ ID NO: 311254 - DNA, 25 bp, Homo sapien
agaatttttgtcttgactttgaatc

SEQ ID NO: 311255 - DNA, 25 bp, Homo sapien
actttgaatctttgcctgtttgtct

SEQ ID NO: 311256 - DNA, 25 bp, Homo sapien
gaatctttgcctgtttgtctaaaca

SEQ ID NO: 311257 - DNA, 25 bp, Homo sapien
aacatttgactaacattctgtttga

SEQ ID NO: 311258 - DNA, 25 bp, Homo sapien
aaagctacattctgcattcatactg

SEQ ID NO: 311259 - DNA, 25 bp, Homo sapien
cattcatactgttccatgagccaca

SEQ ID NO: 311260 - DNA, 25 bp, Homo sapien
tactgttccatgagccacaaagttt

SEQ ID NO: 311261 - DNA, 25 bp, Homo sapien
gccacaaagtttagctatgccaaca

SEQ ID NO: 311262 - DNA, 25 bp, Homo sapien
ccccttcatagtaacaggacctact

SEQ ID NO: 311263 - DNA, 25 bp, Homo sapien
acaggacctacttatttctgaacca

SEQ ID NO: 311264 - DNA, 25 bp, Homo sapien
atttctgaaccacccatacagtgac

SEQ ID NO: 311265 - DNA, 25 bp, Homo sapien
gacaacaaccctcaagattgaagaa

SEQ ID NO: 311266 - DNA, 25 bp, Homo sapien
acaataaggccttcataatagcaca

SEQ ID NO: 311267 - DNA, 25 bp, Homo sapien
tcataatagcacaaaccggagaaat

SEQ ID NO: 311268 - DNA, 25 bp, Homo sapien
tgggaggcaagctgttcttaggatc

SEQ ID NO: 311269 - DNA, 25 bp, Homo sapien
aggaccaggtgagcctcttcagaat

SEQ ID NO: 311270 - DNA, 25 bp, Homo sapien
gtgagcctcttcagaatgcatcatt

SEQ ID NO: 311271 - DNA, 25 bp, Homo sapien
ggaagtgagactatttattgcatat

SEQ ID NO: 311272 - DNA, 25 bp, Homo sapien
tgcatcatttccacccatactaaat

SEQ ID NO: 311273 - DNA, 25 bp, Homo sapien
aaatgactacatcatctctttggac

SEQ ID NO: 311274 - DNA, 25 bp, Homo sapien
tcatctctttggacatcccaattca

SEQ ID NO: 311275 - DNA, 25 bp, Homo sapien
atcccaattcacaaaagtctgaagt

SEQ ID NO: 311276 - DNA, 25 bp, Homo sapien
gtctgaagtagttcccagtaactgc

SEQ ID NO: 311277 - DNA, 25 bp, Homo sapien
ccagtaactgcagggttcttgacca

SEQ ID NO: 311278 - DNA, 25 bp, Homo sapien
gttcttgaccatttcaatgtcctct

SEQ ID NO: 311279 - DNA, 25 bp, Homo sapien
atttttaatactttctcaattctga

SEQ ID NO: 311280 - DNA, 25 bp, Homo sapien
aaaatgtcaggatgctccagaccct

SEQ ID NO: 311281 - DNA, 25 bp, Homo sapien
gtcaggatgctccagaccctattaa

SEQ ID NO: 311282 - DNA, 25 bp, Homo sapien
tatatcaagttagttgcatgctctg

SEQ ID NO: 311283 - DNA, 25 bp, Homo sapien
gcagagagcatgttgtatcattgta

SEQ ID NO: 311284 - DNA, 25 bp, Homo sapien
gttgtatcattgtatgtcagactca

SEQ ID NO: 311285 - DNA, 25 bp, Homo sapien
gtcagactcagagggagatttttct

SEQ ID NO: 311286 - DNA, 25 bp, Homo sapien
agaggatggtgaacgttctcgctgc

SEQ ID NO: 311287 - DNA, 25 bp, Homo sapien
atggtgaacgttctcgctgcgtata

SEQ ID NO: 311288 - DNA, 25 bp, Homo sapien
tgaacgttctcgctgcgtatactgc

SEQ ID NO: 311289 - DNA, 25 bp, Homo sapien
tctcgctgcgtatactgccaggaaa

SEQ ID NO: 311290 - DNA, 25 bp, Homo sapien
tactgccaggaaaggtttaatcatg

SEQ ID NO: 311291 - DNA, 25 bp, Homo sapien
aaatatttggtcaatacaactctaa

SEQ ID NO: 311292 - DNA, 25 bp, Homo sapien
tctctatgaacactccctggtagta

SEQ ID NO: 311293 - DNA, 25 bp, Homo sapien
ggtcaatacaactctaaaatacata

SEQ ID NO: 311294 - DNA, 25 bp, Homo sapien
aaagaaattggatggcctagcatat

SEQ ID NO: 311295 - DNA, 25 bp, Homo sapien
ggatggcctagcatatgatctatat

SEQ ID NO: 311296 - DNA, 25 bp, Homo sapien
gaacactccctggtagtactagtaa

SEQ ID NO: 311297 - DNA, 25 bp, Homo sapien
tatgatctatatggagttaaggaac

SEQ ID NO: 311298 - DNA, 25 bp, Homo sapien
taaggaaccaaatgggtgattctaa

SEQ ID NO: 311299 - DNA, 25 bp, Homo sapien
atgtttttaatcttctatcagtgta

SEQ ID NO: 311300 - DNA, 25 bp, Homo sapien
ggtagtactagtaattctttctata

SEQ ID NO: 311301 - DNA, 25 bp, Homo sapien
tattcttgtatttgtgagtcattaa

SEQ ID NO: 311302 - DNA, 25 bp, Homo sapien
tgtacttgtcagaactagaggaaat

SEQ ID NO: 311303 - DNA, 25 bp, Homo sapien
ttgtcagaactagaggaaatagcca

SEQ ID NO: 311304 - DNA, 25 bp, Homo sapien
gaactagaggaaatagccaagacta

SEQ ID NO: 311305 - DNA, 25 bp, Homo sapien
gaggaaatagccaagactaatgaaa

SEQ ID NO: 311306 - DNA, 25 bp, Homo sapien
aagacttttaaattcactactagag

SEQ ID NO: 311307 - DNA, 25 bp, Homo sapien
aattcactactagagtggtcatttt

SEQ ID NO: 311308 - DNA, 25 bp, Homo sapien
tcactactagagtggtcattttaaa

SEQ ID NO: 311309 - DNA, 25 bp, Homo sapien
aaaatacatccatgttttaacttat

SEQ ID NO: 311310 - DNA, 25 bp, Homo sapien
ttcctccttgttctgtctttcaaac

SEQ ID NO: 311311 - DNA, 25 bp, Homo sapien
ttcaaaccagctaaatatttgtcac

SEQ ID NO: 311312 - DNA, 25 bp, Homo sapien
tttcatatatcaggttttaaatagt

SEQ ID NO: 311313 - DNA, 25 bp, Homo sapien
tgctgtttgttcacatcatgaggct

SEQ ID NO: 311314 - DNA, 25 bp, Homo sapien
tctcaccattgtgttagtttccaac

SEQ ID NO: 311315 - DNA, 25 bp, Homo sapien
agtttccaactgacacatggcctga

SEQ ID NO: 311316 - DNA, 25 bp, Homo sapien
acatggcctgagagattggagtatc

SEQ ID NO: 311317 - DNA, 25 bp, Homo sapien
gttttttgtgactatttcctgatgt

SEQ ID NO: 311318 - DNA, 25 bp, Homo sapien
ctgcaactcttttagtgctcaggat

SEQ ID NO: 311319 - DNA, 25 bp, Homo sapien
ttactttcaggactagttcagacat

SEQ ID NO: 311320 - DNA, 25 bp, Homo sapien
gtgacttcatgtaatccttattctg

SEQ ID NO: 311321 - DNA, 25 bp, Homo sapien
tcctgatgtttgacagactgttctt

SEQ ID NO: 311322 - DNA, 25 bp, Homo sapien
ctgttctttcaacttggtgtagagt

SEQ ID NO: 311323 - DNA, 25 bp, Homo sapien
gttacagtctactcttttagggaga

SEQ ID NO: 311324 - DNA, 25 bp, Homo sapien
ttcaatgtgcccatcttaggtggga

SEQ ID NO: 311325 - DNA, 25 bp, Homo sapien
gtgcccatcttaggtgggagaagct

SEQ ID NO: 311326 - DNA, 25 bp, Homo sapien
gggagaagctagatcctgtgcagca

SEQ ID NO: 311327 - DNA, 25 bp, Homo sapien
agctagatcctgtgcagcagcctgg

SEQ ID NO: 311328 - DNA, 25 bp, Homo sapien
ggctcgctctacagtctagagcaca

SEQ ID NO: 311329 - DNA, 25 bp, Homo sapien
tctagagcacatgcagctaacttgt

SEQ ID NO: 311330 - DNA, 25 bp, Homo sapien
gctaacttgtgcctctgcttatgca

SEQ ID NO: 311331 - DNA, 25 bp, Homo sapien
aacaaccataaccttcatttgaagt

SEQ ID NO: 311332 - DNA, 25 bp, Homo sapien
aaggtgtattcaggatcctcaaagc

SEQ ID NO: 311333 - DNA, 25 bp, Homo sapien
caaagcattttaaccttgccgctta

SEQ ID NO: 311334 - DNA, 25 bp, Homo sapien
aattttgctgcattgttaaactgta

SEQ ID NO: 311335 - DNA, 25 bp, Homo sapien
ataataaaaacagcctgagccacgg

SEQ ID NO: 311336 - DNA, 25 bp, Homo sapien
ctggagagaccgagacccggcgcaa

SEQ ID NO: 311337 - DNA, 25 bp, Homo sapien
agacccggcgcaagagagcgcagcc

SEQ ID NO: 311338 - DNA, 25 bp, Homo sapien
gcaagagagcgcagccttagtagga

SEQ ID NO: 311339 - DNA, 25 bp, Homo sapien
cagccttagtaggagaggaacgcga

SEQ ID NO: 311340 - DNA, 25 bp, Homo sapien
ggcagagcgcgttcagcactgactt

SEQ ID NO: 311341 - DNA, 25 bp, Homo sapien
agcgcgttcagcactgacttttgct

SEQ ID NO: 311342 - DNA, 25 bp, Homo sapien
cagcactgacttttgctgctgcttc

SEQ ID NO: 311343 - DNA, 25 bp, Homo sapien
tagaaacaagaaggcgccagcggca

SEQ ID NO: 311344 - DNA, 25 bp, Homo sapien
caagaaggcgccagcggcagcctca

SEQ ID NO: 311345 - DNA, 25 bp, Homo sapien
tcccgaagccaacccgcgaagggag

SEQ ID NO: 311346 - DNA, 25 bp, Homo sapien
gaaattaagattgttccttgacact

SEQ ID NO: 311347 - DNA, 25 bp, Homo sapien
aagattgttccttgacacttttatg

SEQ ID NO: 311348 - DNA, 25 bp, Homo sapien
cttttatggctgttgcgtaggcaga

SEQ ID NO: 311349 - DNA, 25 bp, Homo sapien
tttatggctgttgcgtaggcagagt

SEQ ID NO: 311350 - DNA, 25 bp, Homo sapien
agcctgaatcatttgcagggtcccc

SEQ ID NO: 311351 - DNA, 25 bp, Homo sapien
cctgagaagtgtgcggccctggcgt

SEQ ID NO: 311352 - DNA, 25 bp, Homo sapien
gtgcagtgcaagtgttttctgccct

SEQ ID NO: 311353 - DNA, 25 bp, Homo sapien
tgggcctggcttgtgaacctgtgat

SEQ ID NO: 311354 - DNA, 25 bp, Homo sapien
cagtgcaagtgttttctgccctggg

SEQ ID NO: 311355 - DNA, 25 bp, Homo sapien
ctcagtgcagctgggtcactttctt

SEQ ID NO: 311356 - DNA, 25 bp, Homo sapien
tgcagctgggtcactttcttctcag

SEQ ID NO: 311357 - DNA, 25 bp, Homo sapien
gtgttttccatttactagtgaaggc

SEQ ID NO: 311358 - DNA, 25 bp, Homo sapien
agtgaaggctgaacattcttttaaa

SEQ ID NO: 311359 - DNA, 25 bp, Homo sapien
aaagatgtctttgtccttgtacaat

SEQ ID NO: 311360 - DNA, 25 bp, Homo sapien
ggaaaacactttatagcccttatgg

SEQ ID NO: 311361 - DNA, 25 bp, Homo sapien
gcccttatggactaacttggtctgc

SEQ ID NO: 311362 - DNA, 25 bp, Homo sapien
ggtctgctttgaaatttggctcagg

SEQ ID NO: 311363 - DNA, 25 bp, Homo sapien
atttggctcaggtaggccttaccat

SEQ ID NO: 311364 - DNA, 25 bp, Homo sapien
gtaggccttaccatggagttacctg

SEQ ID NO: 311365 - DNA, 25 bp, Homo sapien
gagttacctggtagctattaaagaa

SEQ ID NO: 311366 - DNA, 25 bp, Homo sapien
taaagttggccttgtagtggtcaga

SEQ ID NO: 311367 - DNA, 25 bp, Homo sapien
cagaaagacccttaaaatctgcctt

SEQ ID NO: 311368 - DNA, 25 bp, Homo sapien
tagaagaaacattcctcctagcgcc

SEQ ID NO: 311369 - DNA, 25 bp, Homo sapien
gaaatcaagtccaagtatctcaagt

SEQ ID NO: 311370 - DNA, 25 bp, Homo sapien
accttgtctttaacattccgcagtg

SEQ ID NO: 311371 - DNA, 25 bp, Homo sapien
tggaagttcctcaaagctctccgtt

SEQ ID NO: 311372 - DNA, 25 bp, Homo sapien
aagctctccgttttgaaagcatcct

SEQ ID NO: 311373 - DNA, 25 bp, Homo sapien
ctctatgattaccagccactaaatt

SEQ ID NO: 311374 - DNA, 25 bp, Homo sapien
actaaattgcatctgccaccgaggg

SEQ ID NO: 311375 - DNA, 25 bp, Homo sapien
ggctttgaacctgttattcttggga

SEQ ID NO: 311376 - DNA, 25 bp, Homo sapien
gtaacagtacaacaatccatatcag

SEQ ID NO: 311377 - DNA, 25 bp, Homo sapien
acagcttagggcttgacttcattat

SEQ ID NO: 311378 - DNA, 25 bp, Homo sapien
ggctgccattttatgcattctgagt

SEQ ID NO: 311379 - DNA, 25 bp, Homo sapien
atttgttccttctggaattttagtg

SEQ ID NO: 311380 - DNA, 25 bp, Homo sapien
gacaaggttatgcttcagttgcctt

SEQ ID NO: 311381 - DNA, 25 bp, Homo sapien
cagttgccttaactagttgccttgg

SEQ ID NO: 311382 - DNA, 25 bp, Homo sapien
agttgccttggcatcattaataagt

SEQ ID NO: 311383 - DNA, 25 bp, Homo sapien
ttcctctactgatttgaaatgccat

SEQ ID NO: 311384 - DNA, 25 bp, Homo sapien
attccctaacatatttgggtctgtt

SEQ ID NO: 311385 - DNA, 25 bp, Homo sapien
gtttctggatcctctaacccactgt

SEQ ID NO: 311386 - DNA, 25 bp, Homo sapien
tctaacccactgttctagagagaaa

SEQ ID NO: 311387 - DNA, 25 bp, Homo sapien
gtgatcgttttagattatttgtctc

SEQ ID NO: 311388 - DNA, 25 bp, Homo sapien
tttgtctctctgtaatctaaaatcc

SEQ ID NO: 311389 - DNA, 25 bp, Homo sapien
aaatccaaggtacacgctgggcaca

SEQ ID NO: 311390 - DNA, 25 bp, Homo sapien
gaaggtacgtggattatctgatgct

SEQ ID NO: 311391 - DNA, 25 bp, Homo sapien
tacgtggattatctgatgctacatc

SEQ ID NO: 311392 - DNA, 25 bp, Homo sapien
gatgctacatcacactctgggagag

SEQ ID NO: 311393 - DNA, 25 bp, Homo sapien
gggagagacttcccttctttcagag

SEQ ID NO: 311394 - DNA, 25 bp, Homo sapien
ctttcagagagcctctcatttctta

SEQ ID NO: 311395 - DNA, 25 bp, Homo sapien
tgctctttccccctgataatgctca

SEQ ID NO: 311396 - DNA, 25 bp, Homo sapien
tgataatgctcacttactctctttc

SEQ ID NO: 311397 - DNA, 25 bp, Homo sapien
acttactctctttcataatctcccc

SEQ ID NO: 311398 - DNA, 25 bp, Homo sapien
acatttcttattatcatttattgca

SEQ ID NO: 311399 - DNA, 25 bp, Homo sapien
attgcacatagcatggattaatcaa

SEQ ID NO: 311400 - DNA, 25 bp, Homo sapien
aatagactagagaaaggtgctttat

SEQ ID NO: 311401 - DNA, 25 bp, Homo sapien
ctctgtgtagtccaggccacacatt

SEQ ID NO: 311402 - DNA, 25 bp, Homo sapien
tctgtgtagtccaggccacacattc

SEQ ID NO: 311403 - DNA, 25 bp, Homo sapien
ggtcccgacgcagggcctggccaca

SEQ ID NO: 311404 - DNA, 25 bp, Homo sapien
tgctgtcacacagagccttgagtag

SEQ ID NO: 311405 - DNA, 25 bp, Homo sapien
ctgtcacacagagccttgagtaggg

SEQ ID NO: 311406 - DNA, 25 bp, Homo sapien
acacagagccttgagtagggtgcag

SEQ ID NO: 311407 - DNA, 25 bp, Homo sapien
agggtgcaggccaccgtgaaactgt

SEQ ID NO: 311408 - DNA, 25 bp, Homo sapien
gtgcaggccaccgtgaaactgtcag

SEQ ID NO: 311409 - DNA, 25 bp, Homo sapien
gcaggccaccgtgaaactgtcaggg

SEQ ID NO: 311410 - DNA, 25 bp, Homo sapien
ggccaccgtgaaactgtcagggctg

SEQ ID NO: 311411 - DNA, 25 bp, Homo sapien
accgtgaaactgtcagggctgggaa

SEQ ID NO: 311412 - DNA, 25 bp, Homo sapien
tcattatgggaagctcattcagata

SEQ ID NO: 311413 - DNA, 25 bp, Homo sapien
cttgagcagggaactacatggttct

SEQ ID NO: 311414 - DNA, 25 bp, Homo sapien
gaactacatggttcttagtaacagc

SEQ ID NO: 311415 - DNA, 25 bp, Homo sapien
catgctgttacttaccacagtaact

SEQ ID NO: 311416 - DNA, 25 bp, Homo sapien
ccacagtaacttttctggttatatg

SEQ ID NO: 311417 - DNA, 25 bp, Homo sapien
ggaagctcattcagataacgtggaa

SEQ ID NO: 311418 - DNA, 25 bp, Homo sapien
gaaaaacgctgcttttctacgcctt

SEQ ID NO: 311419 - DNA, 25 bp, Homo sapien
aacgctgcttttctacgccttcaag

SEQ ID NO: 311420 - DNA, 25 bp, Homo sapien
taacgtggaagttgaacctgatgaa

SEQ ID NO: 311421 - DNA, 25 bp, Homo sapien
gggaacttgaatgtcatgaaacaca

SEQ ID NO: 311422 - DNA, 25 bp, Homo sapien
ggaagaatatgtccaaggttataag

SEQ ID NO: 311423 - DNA, 25 bp, Homo sapien
tagacaagggtgtcacactgtcata

SEQ ID NO: 311424 - DNA, 25 bp, Homo sapien
cacactgtcataagatgtatagtct

SEQ ID NO: 311425 - DNA, 25 bp, Homo sapien
gtatagtcttctagtacttgttctt

SEQ ID NO: 311426 - DNA, 25 bp, Homo sapien
acttgttctttttattcagtgtcag

SEQ ID NO: 311427 - DNA, 25 bp, Homo sapien
gtgtcagaactaagattcatctaca

SEQ ID NO: 311428 - DNA, 25 bp, Homo sapien
aagattcatctacattattgtgtgt

SEQ ID NO: 311429 - DNA, 25 bp, Homo sapien
gtgtacctatagtccattcattgtt

SEQ ID NO: 311430 - DNA, 25 bp, Homo sapien
tatagtccattcattgttgttgttg

SEQ ID NO: 311431 - DNA, 25 bp, Homo sapien
agtttcccgtctcctatgtgaacaa

SEQ ID NO: 311432 - DNA, 25 bp, Homo sapien
cccgtctcctatgtgaacaagtgat

SEQ ID NO: 311433 - DNA, 25 bp, Homo sapien
gcaaatgtgttgctttgagagatat

SEQ ID NO: 311434 - DNA, 25 bp, Homo sapien
ttgggatgagaaatgtcagtgtttt

SEQ ID NO: 311435 - DNA, 25 bp, Homo sapien
tttctaaatacttttctggtggttg

SEQ ID NO: 311436 - DNA, 25 bp, Homo sapien
atacttttctggtggttgattattc

SEQ ID NO: 311437 - DNA, 25 bp, Homo sapien
tctggtggttgattattcttttaaa

SEQ ID NO: 311438 - DNA, 25 bp, Homo sapien
ctgtggttagggaaacataagctat

SEQ ID NO: 311439 - DNA, 25 bp, Homo sapien
gagctattgtaactatgatctgaga

SEQ ID NO: 311440 - DNA, 25 bp, Homo sapien
gagattagaatttgactctccaaat

SEQ ID NO: 311441 - DNA, 25 bp, Homo sapien
gactctccaaatgacctattgtagg

SEQ ID NO: 311442 - DNA, 25 bp, Homo sapien
acctattgtaggtcagtgttgtata

SEQ ID NO: 311443 - DNA, 25 bp, Homo sapien
tgtgtgaccctagaatctgccctta

SEQ ID NO: 311444 - DNA, 25 bp, Homo sapien
gtgaccctagaatctgcccttaaaa

SEQ ID NO: 311445 - DNA, 25 bp, Homo sapien
gcagctttggccactggggatattg

SEQ ID NO: 311446 - DNA, 25 bp, Homo sapien
gccactggggatattgttgacctgg

SEQ ID NO: 311447 - DNA, 25 bp, Homo sapien
tctctttttacaaatcaaccaaata

SEQ ID NO: 311448 - DNA, 25 bp, Homo sapien
caaatcaaccaaatactttttaatg

SEQ ID NO: 311449 - DNA, 25 bp, Homo sapien
aaactttgtgttcaagtattctcat

SEQ ID NO: 311450 - DNA, 25 bp, Homo sapien
ttgtgttcaagtattctcattaaaa

SEQ ID NO: 311451 - DNA, 25 bp, Homo sapien
gaatcttgctggtgtttggaagtgt

SEQ ID NO: 311452 - DNA, 25 bp, Homo sapien
atcttgctggtgtttggaagtgtcc

SEQ ID NO: 311453 - DNA, 25 bp, Homo sapien
cttgctggtgtttggaagtgtccga

SEQ ID NO: 311454 - DNA, 25 bp, Homo sapien
tgctggtgtttggaagtgtccgatc

SEQ ID NO: 311455 - DNA, 25 bp, Homo sapien
ctggtgtttggaagtgtccgatcta

SEQ ID NO: 311456 - DNA, 25 bp, Homo sapien
aaagcatgcattgtttgactagcca

SEQ ID NO: 311457 - DNA, 25 bp, Homo sapien
gtttgactagccagctttctagaaa

SEQ ID NO: 311458 - DNA, 25 bp, Homo sapien
atccaacctattcatggtgtcctca

SEQ ID NO: 311459 - DNA, 25 bp, Homo sapien
ggtgtcctcacttattgtggtcaat

SEQ ID NO: 311460 - DNA, 25 bp, Homo sapien
gggatggataactttgaacactaaa

SEQ ID NO: 311461 - DNA, 25 bp, Homo sapien
ggctattagattgtcccaggccata

SEQ ID NO: 311462 - DNA, 25 bp, Homo sapien
ggagccaaaggcacgtcttcaccat

SEQ ID NO: 311463 - DNA, 25 bp, Homo sapien
ccaggccatatctattcccagttct

SEQ ID NO: 311464 - DNA, 25 bp, Homo sapien
ttcccagttctttgtgagtagtctt

SEQ ID NO: 311465 - DNA, 25 bp, Homo sapien
gtgagtagtcttcttactttttctg

SEQ ID NO: 311466 - DNA, 25 bp, Homo sapien
gtaagaagcatatttccaccaaaag

SEQ ID NO: 311467 - DNA, 25 bp, Homo sapien
ggtagttaaaccagagagcaatgac

SEQ ID NO: 311468 - DNA, 25 bp, Homo sapien
gaaacagaagctgcgtatgaatcag

SEQ ID NO: 311469 - DNA, 25 bp, Homo sapien
ctgcgtatgaatcagatatccccga

SEQ ID NO: 311470 - DNA, 25 bp, Homo sapien
aagctataatgacagtcctgatgtc

SEQ ID NO: 311471 - DNA, 25 bp, Homo sapien
tgatgtcattgtagaggctcagttt

SEQ ID NO: 311472 - DNA, 25 bp, Homo sapien
ggctcagtttgatggcagcgactca

SEQ ID NO: 311473 - DNA, 25 bp, Homo sapien
tcagtttgatggcagcgactcagaa

SEQ ID NO: 311474 - DNA, 25 bp, Homo sapien
tggcagcgactcagaagatggacat

SEQ ID NO: 311475 - DNA, 25 bp, Homo sapien
gaagatggacatggcatcacacaaa

SEQ ID NO: 311476 - DNA, 25 bp, Homo sapien
tggcatcacacaaaatgtgctggtt

SEQ ID NO: 311477 - DNA, 25 bp, Homo sapien
caaaatgtgctggttgatggtgtta

SEQ ID NO: 311478 - DNA, 25 bp, Homo sapien
gcatttggtttatgagtcgttttaa

SEQ ID NO: 311479 - DNA, 25 bp, Homo sapien
aaaaacgtgtacttttactgctgcg

SEQ ID NO: 311480 - DNA, 25 bp, Homo sapien
tttatttcaccgctataaccctgaa

SEQ ID NO: 311481 - DNA, 25 bp, Homo sapien
tataaccctgaatgtgtagctgtgt

SEQ ID NO: 311482 - DNA, 25 bp, Homo sapien
tgtaacatgcctccagaaacgtgcc

SEQ ID NO: 311483 - DNA, 25 bp, Homo sapien
tgcctccagaaacgtgccctaaaca

SEQ ID NO: 311484 - DNA, 25 bp, Homo sapien
gaaacgtgccctaaacacaaatata

SEQ ID NO: 311485 - DNA, 25 bp, Homo sapien
caggaagaaatacgaccaacctccg

SEQ ID NO: 311486 - DNA, 25 bp, Homo sapien
gaccaacctccgtaacaaatgagag

SEQ ID NO: 311487 - DNA, 25 bp, Homo sapien
gagaaacttcacctgactgtgtttt

SEQ ID NO: 311488 - DNA, 25 bp, Homo sapien
gactgtgttttgtgcatttggttta

SEQ ID NO: 311489 - DNA, 25 bp, Homo sapien
tctctcgccctttttcgtttgtact

SEQ ID NO: 311490 - DNA, 25 bp, Homo sapien
cgtttgtactccgaattgcgaaagt

SEQ ID NO: 311491 - DNA, 25 bp, Homo sapien
gaaagtactgtatgttcactggaaa

SEQ ID NO: 311492 - DNA, 25 bp, Homo sapien
cgcgggaatccgagaatgtgagcaa

SEQ ID NO: 311493 - DNA, 25 bp, Homo sapien
gaaatacattaacggctgcatacat

SEQ ID NO: 311494 - DNA, 25 bp, Homo sapien
ggctgcatacattccgtcgagtgag

SEQ ID NO: 311495 - DNA, 25 bp, Homo sapien
gagtgaaactaacttaccctggacg

SEQ ID NO: 311496 - DNA, 25 bp, Homo sapien
taccctggacgttaagctgtttcca

SEQ ID NO: 311497 - DNA, 25 bp, Homo sapien
ctgtttccagttctcactttactaa

SEQ ID NO: 311498 - DNA, 25 bp, Homo sapien
aaactcgttggaaccggcaagcgcg

SEQ ID NO: 311499 - DNA, 25 bp, Homo sapien
agctccggcaggcaaaatgcgacct

SEQ ID NO: 311500 - DNA, 25 bp, Homo sapien
tactggcagtttgcctgagggccca

SEQ ID NO: 311501 - DNA, 25 bp, Homo sapien
gggtagaatccttcacactgcatgt

SEQ ID NO: 311502 - DNA, 25 bp, Homo sapien
tcattttttaattacagccgtagac

SEQ ID NO: 311503 - DNA, 25 bp, Homo sapien
ttacagccgtagactcatatagact

SEQ ID NO: 311504 - DNA, 25 bp, Homo sapien
gactcatatagactctgactgccaa

SEQ ID NO: 311505 - DNA, 25 bp, Homo sapien
tgactgccaatctaaagcacctaga

SEQ ID NO: 311506 - DNA, 25 bp, Homo sapien
atctaaagcacctagagagtttttt

SEQ ID NO: 311507 - DNA, 25 bp, Homo sapien
tgagggcccagcatgcctaactctc

SEQ ID NO: 311508 - DNA, 25 bp, Homo sapien
tgcctaactctcaccagcgtggata

SEQ ID NO: 311509 - DNA, 25 bp, Homo sapien
tcaccagcgtggatatgaagcgagg

SEQ ID NO: 311510 - DNA, 25 bp, Homo sapien
gaagcgaggaaaacctgagctcaca

SEQ ID NO: 311511 - DNA, 25 bp, Homo sapien
ggtgcctgctttgcatgaaagagaa

SEQ ID NO: 311512 - DNA, 25 bp, Homo sapien
gtgtatgtgttagtgtgacaaccaa

SEQ ID NO: 311513 - DNA, 25 bp, Homo sapien
aaccaaagcaggtatttcgtacagt

SEQ ID NO: 311514 - DNA, 25 bp, Homo sapien
gtacagtaggagatttcaacaacgt

SEQ ID NO: 311515 - DNA, 25 bp, Homo sapien
aacaacgtgacaatattctctaggc

SEQ ID NO: 311516 - DNA, 25 bp, Homo sapien
aggcacttgggctcactgtctgtag

SEQ ID NO: 311517 - DNA, 25 bp, Homo sapien
atctgggaaggtaacagcgagccgt

SEQ ID NO: 311518 - DNA, 25 bp, Homo sapien
taacagcgagccgtaccatctgcag

SEQ ID NO: 311519 - DNA, 25 bp, Homo sapien
cagcagctcttggaggttactactg

SEQ ID NO: 311520 - DNA, 25 bp, Homo sapien
ttggaggttactactgacagttttc

SEQ ID NO: 311521 - DNA, 25 bp, Homo sapien
gacagttttcattacactggtttgt

SEQ ID NO: 311522 - DNA, 25 bp, Homo sapien
ataatcactgaagtccttggagaac

SEQ ID NO: 311523 - DNA, 25 bp, Homo sapien
ttgatgtgatcttcctggtcagcgc

SEQ ID NO: 311524 - DNA, 25 bp, Homo sapien
tggtcagcgctctctctagcatact

SEQ ID NO: 311525 - DNA, 25 bp, Homo sapien
tagcatactcttcctctatttggct

SEQ ID NO: 311526 - DNA, 25 bp, Homo sapien
tatttggctcacaaacaggcaccag

SEQ ID NO: 311527 - DNA, 25 bp, Homo sapien
aatggcaccttgaacttaagcctac

SEQ ID NO: 311528 - DNA, 25 bp, Homo sapien
aacttaagcctactacagactgtta

SEQ ID NO: 311529 - DNA, 25 bp, Homo sapien
gaggccagtggtttcaaaatttaga

SEQ ID NO: 311530 - DNA, 25 bp, Homo sapien
gaaccagggcctgacattttataaa

SEQ ID NO: 311531 - DNA, 25 bp, Homo sapien
gtagcatttttcaccttcatagcat

SEQ ID NO: 311532 - DNA, 25 bp, Homo sapien
ttttcaccttcatagcatactcctt

SEQ ID NO: 311533 - DNA, 25 bp, Homo sapien
agcatcactgcccttaaatgaggtc

SEQ ID NO: 311534 - DNA, 25 bp, Homo sapien
taaatgaggtcacactccatgcact

SEQ ID NO: 311535 - DNA, 25 bp, Homo sapien
ggtgattaatgcatgtgtccagaca

SEQ ID NO: 311536 - DNA, 25 bp, Homo sapien
cagacacctggtttcaacgaggcaa

SEQ ID NO: 311537 - DNA, 25 bp, Homo sapien
aacgaggcaaatccctggcatacaa

SEQ ID NO: 311538 - DNA, 25 bp, Homo sapien
ggcatacaatcccagcttgtctctt

SEQ ID NO: 311539 - DNA, 25 bp, Homo sapien
actgtgtgtatttctcgagctggcc

SEQ ID NO: 311540 - DNA, 25 bp, Homo sapien
ggcctgtcaccatgcaaagagtatt

SEQ ID NO: 311541 - DNA, 25 bp, Homo sapien
aaggatgttcagttccctaggcttt

SEQ ID NO: 311542 - DNA, 25 bp, Homo sapien
tccctaggcttttcatcatggtcaa

SEQ ID NO: 311543 - DNA, 25 bp, Homo sapien
gggaatcagcccaaaaggtcagcat

SEQ ID NO: 311544 - DNA, 25 bp, Homo sapien
acgccgggcctaccatgactatatt

SEQ ID NO: 311545 - DNA, 25 bp, Homo sapien
cgccgggcctaccatgactatattt

SEQ ID NO: 311546 - DNA, 25 bp, Homo sapien
gccgggcctaccatgactatattta

SEQ ID NO: 311547 - DNA, 25 bp, Homo sapien
ccgggcctaccatgactatatttaa

SEQ ID NO: 311548 - DNA, 25 bp, Homo sapien
cgggcctaccatgactatatttaag

SEQ ID NO: 311549 - DNA, 25 bp, Homo sapien
gggcctaccatgactatatttaaga

SEQ ID NO: 311550 - DNA, 25 bp, Homo sapien
ggcctaccatgactatatttaagag

SEQ ID NO: 311551 - DNA, 25 bp, Homo sapien
gcctaccatgactatatttaagaga

SEQ ID NO: 311552 - DNA, 25 bp, Homo sapien
actcattcctttattccttctcctt

SEQ ID NO: 311553 - DNA, 25 bp, Homo sapien
tcattcctttattccttctcctttc

SEQ ID NO: 311554 - DNA, 25 bp, Homo sapien
cattcctttattccttctcctttct

SEQ ID NO: 311555 - DNA, 25 bp, Homo sapien
ttcttctctcctcctaggaagttag

SEQ ID NO: 311556 - DNA, 25 bp, Homo sapien
cttctctcctcctaggaagttaggg

SEQ ID NO: 311557 - DNA, 25 bp, Homo sapien
aagggtcatgagcacaggagcctct

SEQ ID NO: 311558 - DNA, 25 bp, Homo sapien
ggtgggtttgaaatttccaatctct

SEQ ID NO: 311559 - DNA, 25 bp, Homo sapien
aatctctaatcacatgtttgggctt

SEQ ID NO: 311560 - DNA, 25 bp, Homo sapien
tctaatcacatgtttgggctttttg

SEQ ID NO: 311561 - DNA, 25 bp, Homo sapien
ggtcatgagcacaggagcctctgct

SEQ ID NO: 311562 - DNA, 25 bp, Homo sapien
catgtttgggctttttgatgtgaca

SEQ ID NO: 311563 - DNA, 25 bp, Homo sapien
gctttttgatgtgacagccccttcc

SEQ ID NO: 311564 - DNA, 25 bp, Homo sapien
agccccttccttggaactatgtaag

SEQ ID NO: 311565 - DNA, 25 bp, Homo sapien
ttggaactatgtaaggatcccttag

SEQ ID NO: 311566 - DNA, 25 bp, Homo sapien
ctgccatccctgaataaggcttcta

SEQ ID NO: 311567 - DNA, 25 bp, Homo sapien
gccatccctgaataaggcttctaat

SEQ ID NO: 311568 - DNA, 25 bp, Homo sapien
atccctgaataaggcttctaattta

SEQ ID NO: 311569 - DNA, 25 bp, Homo sapien
taaggcttctaatttattatgcttt

SEQ ID NO: 311570 - DNA, 25 bp, Homo sapien
cacgctggaatagtggagagagccc

SEQ ID NO: 311571 - DNA, 25 bp, Homo sapien
gctggaatagtggagagagccccaa

SEQ ID NO: 311572 - DNA, 25 bp, Homo sapien
aatagtggagagagccccaaaccag

SEQ ID NO: 311573 - DNA, 25 bp, Homo sapien
agtggagagagccccaaaccagctt

SEQ ID NO: 311574 - DNA, 25 bp, Homo sapien
gtgtttctgtcttcacatccatgac

SEQ ID NO: 311575 - DNA, 25 bp, Homo sapien
gtttctgtcttcacatccatgacat

SEQ ID NO: 311576 - DNA, 25 bp, Homo sapien
tttctgtcttcacatccatgacatg

SEQ ID NO: 311577 - DNA, 25 bp, Homo sapien
ttgacaccaacttcaaggcaccagt

SEQ ID NO: 311578 - DNA, 25 bp, Homo sapien
aaggcaccagtgtttagtgcaagca

SEQ ID NO: 311579 - DNA, 25 bp, Homo sapien
gtgcaagcaggtagagaggacctat

SEQ ID NO: 311580 - DNA, 25 bp, Homo sapien
gaggacctatgaactaggtttctaa

SEQ ID NO: 311581 - DNA, 25 bp, Homo sapien
taggtttctaattggcagtcagtgc

SEQ ID NO: 311582 - DNA, 25 bp, Homo sapien
gcagtcagtgctaattcagccatta

SEQ ID NO: 311583 - DNA, 25 bp, Homo sapien
tttccactaaaatagtgtcccgact

SEQ ID NO: 311584 - DNA, 25 bp, Homo sapien
cacacacatagaccatctcatctta

SEQ ID NO: 311585 - DNA, 25 bp, Homo sapien
gaccatctcatcttactttatttct

SEQ ID NO: 311586 - DNA, 25 bp, Homo sapien
gtaattgacaagactcaagcttttg

SEQ ID NO: 311587 - DNA, 25 bp, Homo sapien
aaatacttacgactgttctcttgat

SEQ ID NO: 311588 - DNA, 25 bp, Homo sapien
ccatctgtaccccactattaataag

SEQ ID NO: 311589 - DNA, 25 bp, Homo sapien
taaggcttaacgtcatagtactggt

SEQ ID NO: 311590 - DNA, 25 bp, Homo sapien
catagtactggttattcataggata

SEQ ID NO: 311591 - DNA, 25 bp, Homo sapien
gatgaacagttcatttgtgctcata

SEQ ID NO: 311592 - DNA, 25 bp, Homo sapien
tcatttgtgctcatagttaactacg

SEQ ID NO: 311593 - DNA, 25 bp, Homo sapien
gtgctcatagttaactacgtaaaca

SEQ ID NO: 311594 - DNA, 25 bp, Homo sapien
tacgtaaacatgatactgagtccag

SEQ ID NO: 311595 - DNA, 25 bp, Homo sapien
tactgagtccagttaaccaccaggc

SEQ ID NO: 311596 - DNA, 25 bp, Homo sapien
agtccagttaaccaccaggccagtg

SEQ ID NO: 311597 - DNA, 25 bp, Homo sapien
ggaaggtttatgacaggatttcaga

SEQ ID NO: 311598 - DNA, 25 bp, Homo sapien
gacaggatttcagagaccagagata

SEQ ID NO: 311599 - DNA, 25 bp, Homo sapien
gtttggctagtttgatgagtatgaa

SEQ ID NO: 311600 - DNA, 25 bp, Homo sapien
gaagcaggctgacattggcaattta

SEQ ID NO: 311601 - DNA, 25 bp, Homo sapien
tggcaatttagatgacttcgaagaa

SEQ ID NO: 311602 - DNA, 25 bp, Homo sapien
gagcttatcaacaaacttaactttt

SEQ ID NO: 311603 - DNA, 25 bp, Homo sapien
aaacttaactttttggatgaagcag

SEQ ID NO: 311604 - DNA, 25 bp, Homo sapien
aaaaagttgtatctgccgctcttca

SEQ ID NO: 311605 - DNA, 25 bp, Homo sapien
gcagaaaaggacttggccaccgtga

SEQ ID NO: 311606 - DNA, 25 bp, Homo sapien
ggccaccgtgaattcaaatccattt

SEQ ID NO: 311607 - DNA, 25 bp, Homo sapien
ccgctcttcagttttcattatcttg

SEQ ID NO: 311608 - DNA, 25 bp, Homo sapien
cattatcttgcatttttctgaggga

SEQ ID NO: 311609 - DNA, 25 bp, Homo sapien
gatgaagacatgcaaagtttggcta

SEQ ID NO: 311610 - DNA, 25 bp, Homo sapien
gcccagggttcagaccgtgactccg

SEQ ID NO: 311611 - DNA, 25 bp, Homo sapien
tgtgttctacaaccatgtagcaaag

SEQ ID NO: 311612 - DNA, 25 bp, Homo sapien
tacaaccatgtagcaaagggccagc

SEQ ID NO: 311613 - DNA, 25 bp, Homo sapien
ccatgtagcaaagggccagcgtctc

SEQ ID NO: 311614 - DNA, 25 bp, Homo sapien
tagcaaagggccagcgtctccacca

SEQ ID NO: 311615 - DNA, 25 bp, Homo sapien
tccaccaactcctgagaactcgttt

SEQ ID NO: 311616 - DNA, 25 bp, Homo sapien
accaactcctgagaactcgtttcaa

SEQ ID NO: 311617 - DNA, 25 bp, Homo sapien
gagaactcgtttcaaggaactcgat

SEQ ID NO: 311618 - DNA, 25 bp, Homo sapien
actcgtttcaaggaactcgatgttt

SEQ ID NO: 311619 - DNA, 25 bp, Homo sapien
tttcaaggaactcgatgtttccggg

SEQ ID NO: 311620 - DNA, 25 bp, Homo sapien
ggaccaagcccgcccagggttcaga

SEQ ID NO: 311621 - DNA, 25 bp, Homo sapien
tgtctctctcacacagatacacgtg

SEQ ID NO: 311622 - DNA, 25 bp, Homo sapien
acagatacacgtgcgctccctggga

SEQ ID NO: 311623 - DNA, 25 bp, Homo sapien
gcttcctgtgtgtagccctggcata

SEQ ID NO: 311624 - DNA, 25 bp, Homo sapien
gtagccctggcatagacttgctcgt

SEQ ID NO: 311625 - DNA, 25 bp, Homo sapien
gcatagacttgctcgtcagggtgtt

SEQ ID NO: 311626 - DNA, 25 bp, Homo sapien
ggccgggcagacatttatgctctga

SEQ ID NO: 311627 - DNA, 25 bp, Homo sapien
gctctgagcagcaaggaccattggg

SEQ ID NO: 311628 - DNA, 25 bp, Homo sapien
gaggtgggcacaaagactgctgctt

SEQ ID NO: 311629 - DNA, 25 bp, Homo sapien
gtgtgtctgacatcccataaatgtg

SEQ ID NO: 311630 - DNA, 25 bp, Homo sapien
gacatcccataaatgtgtgtgtggt

SEQ ID NO: 311631 - DNA, 25 bp, Homo sapien
gtgactacgggcaccacaaactccg

SEQ ID NO: 311632 - DNA, 25 bp, Homo sapien
aatgaaaacctctcattcaccttca

SEQ ID NO: 311633 - DNA, 25 bp, Homo sapien
gaaaacctctcattcaccttcattt

SEQ ID NO: 311634 - DNA, 25 bp, Homo sapien
ttcaccttcattttatacagcactt

SEQ ID NO: 311635 - DNA, 25 bp, Homo sapien
tacagcacttttaaccaaattactt

SEQ ID NO: 311636 - DNA, 25 bp, Homo sapien
ttctaatgttagctccagtactggc

SEQ ID NO: 311637 - DNA, 25 bp, Homo sapien
atgttagctccagtactggctggca

SEQ ID NO: 311638 - DNA, 25 bp, Homo sapien
agtactggctggcacttacattcac

SEQ ID NO: 311639 - DNA, 25 bp, Homo sapien
tggctggcacttacattcactacac

SEQ ID NO: 311640 - DNA, 25 bp, Homo sapien
tggcacttacattcactacactgta

SEQ ID NO: 311641 - DNA, 25 bp, Homo sapien
ttacattcactacactgtacctata

SEQ ID NO: 311642 - DNA, 25 bp, Homo sapien
tcaacagaaccaattactaacttta

SEQ ID NO: 311643 - DNA, 25 bp, Homo sapien
gggcagtgttttataacacattttc

SEQ ID NO: 311644 - DNA, 25 bp, Homo sapien
tttccccactgggtgattgaaggat

SEQ ID NO: 311645 - DNA, 25 bp, Homo sapien
aatttgacagctacatgaaacatga

SEQ ID NO: 311646 - DNA, 25 bp, Homo sapien
acattttcctcacttctgaagtcgg

SEQ ID NO: 311647 - DNA, 25 bp, Homo sapien
tgaagtcggtttgcagctggtaact

SEQ ID NO: 311648 - DNA, 25 bp, Homo sapien
gcagctggtaacttgttcatccaga

SEQ ID NO: 311649 - DNA, 25 bp, Homo sapien
atgagactttgtgagctgtgcttac

SEQ ID NO: 311650 - DNA, 25 bp, Homo sapien
ctttgtgagctgtgcttacagtttg

SEQ ID NO: 311651 - DNA, 25 bp, Homo sapien
tatattttgcatttacttcccagtg

SEQ ID NO: 311652 - DNA, 25 bp, Homo sapien
atttacttcccagtgcttcatagct

SEQ ID NO: 311653 - DNA, 25 bp, Homo sapien
ccagtgcttcatagctgcattttgt

SEQ ID NO: 311654 - DNA, 25 bp, Homo sapien
aacagctttggctcagcagacatgt

SEQ ID NO: 311655 - DNA, 25 bp, Homo sapien
caaagtagagcctacaaggtcaggg

SEQ ID NO: 311656 - DNA, 25 bp, Homo sapien
aggactaaagactgccctgcgggaa

SEQ ID NO: 311657 - DNA, 25 bp, Homo sapien
aaagactgccctgcgggaagatggc

SEQ ID NO: 311658 - DNA, 25 bp, Homo sapien
ttctgacctcagttgagtatctgtg

SEQ ID NO: 311659 - DNA, 25 bp, Homo sapien
agttgagtatctgtggccatgagca

SEQ ID NO: 311660 - DNA, 25 bp, Homo sapien
ctcctgaccaagcacatcttgaaca

SEQ ID NO: 311661 - DNA, 25 bp, Homo sapien
aagcacatcttgaacatcacctgag

SEQ ID NO: 311662 - DNA, 25 bp, Homo sapien
ggctgacagaccagggacaagtaga

SEQ ID NO: 311663 - DNA, 25 bp, Homo sapien
gactgggttcaaagtgacagacctt

SEQ ID NO: 311664 - DNA, 25 bp, Homo sapien
agacctttcactttcaacagctttg

SEQ ID NO: 311665 - DNA, 25 bp, Homo sapien
gcagctttgactttgcaataacgtg

SEQ ID NO: 311666 - DNA, 25 bp, Homo sapien
ataacgtggcaagtatctgatttct

SEQ ID NO: 311667 - DNA, 25 bp, Homo sapien
gtatctgatttctcctttgaggcag

SEQ ID NO: 311668 - DNA, 25 bp, Homo sapien
gaggtttaagtgtaggcctgttaca

SEQ ID NO: 311669 - DNA, 25 bp, Homo sapien
ggcctgttacacttgtttgatacct

SEQ ID NO: 311670 - DNA, 25 bp, Homo sapien
gatacctttttcatgacagtctcag

SEQ ID NO: 311671 - DNA, 25 bp, Homo sapien
gacagtctcagtatagatcagttgg

SEQ ID NO: 311672 - DNA, 25 bp, Homo sapien
aacacattttgatagggcttatttc

SEQ ID NO: 311673 - DNA, 25 bp, Homo sapien
gggcttatttcacacaaagaagttt

SEQ ID NO: 311674 - DNA, 25 bp, Homo sapien
aagctataagattcgctgacagcca

SEQ ID NO: 311675 - DNA, 25 bp, Homo sapien
ttcgctgacagccaaagtatcattt

SEQ ID NO: 311676 - DNA, 25 bp, Homo sapien
atggagcacattgtaactggctgac

SEQ ID NO: 311677 - DNA, 25 bp, Homo sapien
gtaactggctgacaacagtggccca

SEQ ID NO: 311678 - DNA, 25 bp, Homo sapien
ggctgacaacagtggcccaggaaaa

SEQ ID NO: 311679 - DNA, 25 bp, Homo sapien
tggcccaggaaaaccacagtaactt

SEQ ID NO: 311680 - DNA, 25 bp, Homo sapien
tgttttctaaacctctaatcctcaa

SEQ ID NO: 311681 - DNA, 25 bp, Homo sapien
tctaaacctctaatcctcaaaacaa

SEQ ID NO: 311682 - DNA, 25 bp, Homo sapien
ttggaagtaaactgattttcattca

SEQ ID NO: 311683 - DNA, 25 bp, Homo sapien
tttcattcagtgaactgccatttag

SEQ ID NO: 311684 - DNA, 25 bp, Homo sapien
atgagccgcggagcctggcctagaa

SEQ ID NO: 311685 - DNA, 25 bp, Homo sapien
ttaagtaagataccagcttcagaat

SEQ ID NO: 311686 - DNA, 25 bp, Homo sapien
gcttcagaataggagctagggtcta

SEQ ID NO: 311687 - DNA, 25 bp, Homo sapien
gactccaaggttaatgtcttaaaga

SEQ ID NO: 311688 - DNA, 25 bp, Homo sapien
gatactttcaggaaccatttctcta

SEQ ID NO: 311689 - DNA, 25 bp, Homo sapien
gaaccatttctctaggtgttaaaga

SEQ ID NO: 311690 - DNA, 25 bp, Homo sapien
agcagcaacaacctggtgtacttga

SEQ ID NO: 311691 - DNA, 25 bp, Homo sapien
ggtgtacttgaacgttcccagagga

SEQ ID NO: 311692 - DNA, 25 bp, Homo sapien
gttcccagaggagattttacagttc

SEQ ID NO: 311693 - DNA, 25 bp, Homo sapien
ggagattttacagttctgtcagagg

SEQ ID NO: 311694 - DNA, 25 bp, Homo sapien
ctgtcagaggatttagggtcccatt

SEQ ID NO: 311695 - DNA, 25 bp, Homo sapien
gagagaatctcagcctgacaggtta

SEQ ID NO: 311696 - DNA, 25 bp, Homo sapien
ttaacaggcctagggagcgaccagt

SEQ ID NO: 311697 - DNA, 25 bp, Homo sapien
gcctagggagcgaccagtccagatg

SEQ ID NO: 311698 - DNA, 25 bp, Homo sapien
actttgcctctctagaagcagcttc

SEQ ID NO: 311699 - DNA, 25 bp, Homo sapien
tctagaagcagcttctcgcctttcc

SEQ ID NO: 311700 - DNA, 25 bp, Homo sapien
ctcccgagggctggcaggagtcact

SEQ ID NO: 311701 - DNA, 25 bp, Homo sapien
aggagtcactgtcagtcacccttca

SEQ ID NO: 311702 - DNA, 25 bp, Homo sapien
ggtctgaaaggttgcatgggctcac

SEQ ID NO: 311703 - DNA, 25 bp, Homo sapien
atgggctcacctggtcttagacaag

SEQ ID NO: 311704 - DNA, 25 bp, Homo sapien
aggcagacctgcagtttgagtggct

SEQ ID NO: 311705 - DNA, 25 bp, Homo sapien
gcagcacatcacatcagttaacact

SEQ ID NO: 311706 - DNA, 25 bp, Homo sapien
tcacatcagttaacactgtttgcct

SEQ ID NO: 311707 - DNA, 25 bp, Homo sapien
ctgtttgccttccaactagttatta

SEQ ID NO: 311708 - DNA, 25 bp, Homo sapien
tagttattacggtgtcctgtgggac

SEQ ID NO: 311709 - DNA, 25 bp, Homo sapien
ctgttgtcatcactgagtcagcact

SEQ ID NO: 311710 - DNA, 25 bp, Homo sapien
gttgtcatcactgagtcagcactca

SEQ ID NO: 311711 - DNA, 25 bp, Homo sapien
gtcatcactgagtcagcactcacct

SEQ ID NO: 311712 - DNA, 25 bp, Homo sapien
catcactgagtcagcactcacctgg

SEQ ID NO: 311713 - DNA, 25 bp, Homo sapien
actgagtcagcactcacctggcctg

SEQ ID NO: 311714 - DNA, 25 bp, Homo sapien
tcctttctgggcttgggtagtcaaa

SEQ ID NO: 311715 - DNA, 25 bp, Homo sapien
aatgtctgagctaccccaggtcctc

SEQ ID NO: 311716 - DNA, 25 bp, Homo sapien
tctgagctaccccaggtcctcatgt

SEQ ID NO: 311717 - DNA, 25 bp, Homo sapien
atgtcagcagagtggcgcctgcctg

SEQ ID NO: 311718 - DNA, 25 bp, Homo sapien
ataaggctgatttggaccccaggct

SEQ ID NO: 311719 - DNA, 25 bp, Homo sapien
tgccctggacagcacttgtgtctgc

SEQ ID NO: 311720 - DNA, 25 bp, Homo sapien
gatattgcttccctttcatgtggga

SEQ ID NO: 311721 - DNA, 25 bp, Homo sapien
tcatgtgggagtttgctcacagccc

SEQ ID NO: 311722 - DNA, 25 bp, Homo sapien
gcccactgcatggtataatgaaatc

SEQ ID NO: 311723 - DNA, 25 bp, Homo sapien
gagtcagaagcttagagatgcactt

SEQ ID NO: 311724 - DNA, 25 bp, Homo sapien
gatgcactttatggtttttacaact

SEQ ID NO: 311725 - DNA, 25 bp, Homo sapien
caactgctgttacaatgttctaaac

SEQ ID NO: 311726 - DNA, 25 bp, Homo sapien
ctaaacactgtgatctttccaaatg

SEQ ID NO: 311727 - DNA, 25 bp, Homo sapien
tttctgtattcgttttgtactgtag

SEQ ID NO: 311728 - DNA, 25 bp, Homo sapien
aataattcgctataaactggacttt

SEQ ID NO: 311729 - DNA, 25 bp, Homo sapien
gttatttattggcttattgcccctc

SEQ ID NO: 311730 - DNA, 25 bp, Homo sapien
attgcccctccttataatacattta

SEQ ID NO: 311731 - DNA, 25 bp, Homo sapien
ctgggcgctaagattgttgtgaatc

SEQ ID NO: 311732 - DNA, 25 bp, Homo sapien
gattgttgtgaatcattaccctcag

SEQ ID NO: 311733 - DNA, 25 bp, Homo sapien
tgtgaatcattaccctcagaatttg

SEQ ID NO: 311734 - DNA, 25 bp, Homo sapien
ttctagatgcttcttaacccatgat

SEQ ID NO: 311735 - DNA, 25 bp, Homo sapien
gatgcttcttaacccatgatttagg

SEQ ID NO: 311736 - DNA, 25 bp, Homo sapien
taacccatgatttaggtgagtaaac

SEQ ID NO: 311737 - DNA, 25 bp, Homo sapien
gatgatcaagctgaacgtagaacga

SEQ ID NO: 311738 - DNA, 25 bp, Homo sapien
gaacgtagaacgatattcctaatgg

SEQ ID NO: 311739 - DNA, 25 bp, Homo sapien
ttcctaatgggtgtgtttgcctttt

SEQ ID NO: 311740 - DNA, 25 bp, Homo sapien
atgatcatgcctcgctgcgtacttg

SEQ ID NO: 311741 - DNA, 25 bp, Homo sapien
gcctcgctgcgtacttgagcccagg

SEQ ID NO: 311742 - DNA, 25 bp, Homo sapien
actgttctaaaagtacgaatgtcat

SEQ ID NO: 311743 - DNA, 25 bp, Homo sapien
gtacgaatgtcatctagctattaaa

SEQ ID NO: 311744 - DNA, 25 bp, Homo sapien
agatggagtgtgtgctttctgagcc

SEQ ID NO: 311745 - DNA, 25 bp, Homo sapien
gtgtgctttctgagccttatttaaa

SEQ ID NO: 311746 - DNA, 25 bp, Homo sapien
agaaagctttagcttccattagaat

SEQ ID NO: 311747 - DNA, 25 bp, Homo sapien
tctatgagagcagggcccctgcttg

SEQ ID NO: 311748 - DNA, 25 bp, Homo sapien
cccctgcttgtcttattcgttgtta

SEQ ID NO: 311749 - DNA, 25 bp, Homo sapien
tgcttgtcttattcgttgttacatt

SEQ ID NO: 311750 - DNA, 25 bp, Homo sapien
atcggataccactgggtaaggcttg

SEQ ID NO: 311751 - DNA, 25 bp, Homo sapien
taccactgggtaaggcttggagttt

SEQ ID NO: 311752 - DNA, 25 bp, Homo sapien
ggagtttcaggtcttccagatgact

SEQ ID NO: 311753 - DNA, 25 bp, Homo sapien
cccagctatgcagaactgtgcctga

SEQ ID NO: 311754 - DNA, 25 bp, Homo sapien
agaactgtgcctgaactctggcaat

SEQ ID NO: 311755 - DNA, 25 bp, Homo sapien
cctgaactctggcaatgacctgaag

SEQ ID NO: 311756 - DNA, 25 bp, Homo sapien
tggcaatgacctgaagggccctcac

SEQ ID NO: 311757 - DNA, 25 bp, Homo sapien
tgaagggccctcacacagattcttc

SEQ ID NO: 311758 - DNA, 25 bp, Homo sapien
gcctccagaaaacaacgcagctctg

SEQ ID NO: 311759 - DNA, 25 bp, Homo sapien
cctcatggaatactgggcagagaat

SEQ ID NO: 311760 - DNA, 25 bp, Homo sapien
gggcagagaatccagtcacagcttg

SEQ ID NO: 311761 - DNA, 25 bp, Homo sapien
agaatccagtcacagcttgcctaca

SEQ ID NO: 311762 - DNA, 25 bp, Homo sapien
tacacttctgccctacaaactggaa

SEQ ID NO: 311763 - DNA, 25 bp, Homo sapien
ctgccctacaaactggaagctgata

SEQ ID NO: 311764 - DNA, 25 bp, Homo sapien
agggccgaggtgttgcgccaggcta

SEQ ID NO: 311765 - DNA, 25 bp, Homo sapien
aggtgttgcgccaggctaaagccaa

SEQ ID NO: 311766 - DNA, 25 bp, Homo sapien
ggtgttgcgccaggctaaagccaat

SEQ ID NO: 311767 - DNA, 25 bp, Homo sapien
cagttctcacaggaacactctgtga

SEQ ID NO: 311768 - DNA, 25 bp, Homo sapien
agtcatctgatagctcatcaagctc

SEQ ID NO: 311769 - DNA, 25 bp, Homo sapien
gtcatctgatagctcatcaagctct

SEQ ID NO: 311770 - DNA, 25 bp, Homo sapien
catctgatagctcatcaagctctga

SEQ ID NO: 311771 - DNA, 25 bp, Homo sapien
atcgaagagcggaaagaacagaccc

SEQ ID NO: 311772 - DNA, 25 bp, Homo sapien
agaacagacccggaatgccagggcc

SEQ ID NO: 311773 - DNA, 25 bp, Homo sapien
aacagacccggaatgccagggccga

SEQ ID NO: 311774 - DNA, 25 bp, Homo sapien
acagacccggaatgccagggccgag

SEQ ID NO: 311775 - DNA, 25 bp, Homo sapien
gatgacaaagcttgatatttattgc

SEQ ID NO: 311776 - DNA, 25 bp, Homo sapien
tttgggttgctctgtgtcaagagag

SEQ ID NO: 311777 - DNA, 25 bp, Homo sapien
gtcaagagaggttacatggtgttaa

SEQ ID NO: 311778 - DNA, 25 bp, Homo sapien
atggtgttaaatcggtacctgataa

SEQ ID NO: 311779 - DNA, 25 bp, Homo sapien
atgtacccaaatactatggccagat

SEQ ID NO: 311780 - DNA, 25 bp, Homo sapien
ggatctgaggtgatatgttctgaat

SEQ ID NO: 311781 - DNA, 25 bp, Homo sapien
atgtaagcaccgtcaacatcagaca

SEQ ID NO: 311782 - DNA, 25 bp, Homo sapien
acatcagacacctactcatggacat

SEQ ID NO: 311783 - DNA, 25 bp, Homo sapien
actcatggacatgtggttgccggat

SEQ ID NO: 311784 - DNA, 25 bp, Homo sapien
atgtggttgccggattttcttaaga

SEQ ID NO: 311785 - DNA, 25 bp, Homo sapien
gccggattttcttaagatgtttcca

SEQ ID NO: 311786 - DNA, 25 bp, Homo sapien
ttctgatttttcacagggctgggaa

SEQ ID NO: 311787 - DNA, 25 bp, Homo sapien
aaagacattctctacttgtaccctc

SEQ ID NO: 311788 - DNA, 25 bp, Homo sapien
tacttgtaccctctgtggagttcag

SEQ ID NO: 311789 - DNA, 25 bp, Homo sapien
gtaccctctgtggagttcagacttt

SEQ ID NO: 311790 - DNA, 25 bp, Homo sapien
gttcagactttccataaatcaggca

SEQ ID NO: 311791 - DNA, 25 bp, Homo sapien
ggcactgtgtcaatgaggataccca

SEQ ID NO: 311792 - DNA, 25 bp, Homo sapien
aggatacccaggagatgaatggaat

SEQ ID NO: 311793 - DNA, 25 bp, Homo sapien
aatggaatctactgtctttcccacg

SEQ ID NO: 311794 - DNA, 25 bp, Homo sapien
gtctttcccacgcttgtcaaggcat

SEQ ID NO: 311795 - DNA, 25 bp, Homo sapien
gcttgtcaaggcatctcatctgagc

SEQ ID NO: 311796 - DNA, 25 bp, Homo sapien
tcaaggcatctcatctgagcagtta

SEQ ID NO: 311797 - DNA, 25 bp, Homo sapien
agacccacagaatcaccacactgaa

SEQ ID NO: 311798 - DNA, 25 bp, Homo sapien
gacccacagaatcaccacactgaag

SEQ ID NO: 311799 - DNA, 25 bp, Homo sapien
cacagaatcaccacactgaagcctt

SEQ ID NO: 311800 - DNA, 25 bp, Homo sapien
acagaatcaccacactgaagccttc

SEQ ID NO: 311801 - DNA, 25 bp, Homo sapien
agaatcaccacactgaagccttctc

SEQ ID NO: 311802 - DNA, 25 bp, Homo sapien
gaatcaccacactgaagccttctca

SEQ ID NO: 311803 - DNA, 25 bp, Homo sapien
atcaccacactgaagccttctcagt

SEQ ID NO: 311804 - DNA, 25 bp, Homo sapien
tcaccacactgaagccttctcagtg

SEQ ID NO: 311805 - DNA, 25 bp, Homo sapien
ccacactgaagccttctcagtggaa

SEQ ID NO: 311806 - DNA, 25 bp, Homo sapien
cacactgaagccttctcagtggaaa

SEQ ID NO: 311807 - DNA, 25 bp, Homo sapien
gagctaagaagcacaggaaacacag

SEQ ID NO: 311808 - DNA, 25 bp, Homo sapien
cgatactgtgtaaattctttctttc

SEQ ID NO: 311809 - DNA, 25 bp, Homo sapien
ttctttccctttgttacatgatttc

SEQ ID NO: 311810 - DNA, 25 bp, Homo sapien
taccctggtgcttacatcggtgaac

SEQ ID NO: 311811 - DNA, 25 bp, Homo sapien
gtcaagttgtctttattctatctaa

SEQ ID NO: 311812 - DNA, 25 bp, Homo sapien
gtgcttacatcggtgaacaattggg

SEQ ID NO: 311813 - DNA, 25 bp, Homo sapien
ttactccaaatttcagcactggttg

SEQ ID NO: 311814 - DNA, 25 bp, Homo sapien
ctggttggcacatagctagtacaca

SEQ ID NO: 311815 - DNA, 25 bp, Homo sapien
gtcttgaagagtgttcctcatgttt

SEQ ID NO: 311816 - DNA, 25 bp, Homo sapien
tcatgtttctgcgagttattcacct

SEQ ID NO: 311817 - DNA, 25 bp, Homo sapien
tgcgagttattcacctttccattcc

SEQ ID NO: 311818 - DNA, 25 bp, Homo sapien
cattcccacccgatactgtgtaaat

SEQ ID NO: 311819 - DNA, 25 bp, Homo sapien
tttacttctgtgtcctaagggtaat

SEQ ID NO: 311820 - DNA, 25 bp, Homo sapien
ctaagggtaatttctcaggattgtt

SEQ ID NO: 311821 - DNA, 25 bp, Homo sapien
ggaaataggtcatttgctatattac

SEQ ID NO: 311822 - DNA, 25 bp, Homo sapien
gctatattacaagcaatccccaaat

SEQ ID NO: 311823 - DNA, 25 bp, Homo sapien
agcaatccccaaattttatggtctt

SEQ ID NO: 311824 - DNA, 25 bp, Homo sapien
tttatggtcttccaggaaaagttat

SEQ ID NO: 311825 - DNA, 25 bp, Homo sapien
gttattaccgtttatgatactaaca

SEQ ID NO: 311826 - DNA, 25 bp, Homo sapien
cgtttatgatactaacagttcctga

SEQ ID NO: 311827 - DNA, 25 bp, Homo sapien
gctatgatcagtatgttcatgaggt

SEQ ID NO: 311828 - DNA, 25 bp, Homo sapien
agcagttcctgtgttgcagctttta

SEQ ID NO: 311829 - DNA, 25 bp, Homo sapien
gttcctgtgttgcagcttttaacaa

SEQ ID NO: 311830 - DNA, 25 bp, Homo sapien
agatttctgtgcaagacactcccct

SEQ ID NO: 311831 - DNA, 25 bp, Homo sapien
ctcccctaaaaaacaagtgactgat

SEQ ID NO: 311832 - DNA, 25 bp, Homo sapien
gtgactgatgagattttccaataca

SEQ ID NO: 311833 - DNA, 25 bp, Homo sapien
ttccaatacatgtaacaagggttta

SEQ ID NO: 311834 - DNA, 25 bp, Homo sapien
acttatttctaagctatggaagcat

SEQ ID NO: 311835 - DNA, 25 bp, Homo sapien
aaatgagtactgatgtcatgctgac

SEQ ID NO: 311836 - DNA, 25 bp, Homo sapien
tgtcatgctgacagaagtgcaaata

SEQ ID NO: 311837 - DNA, 25 bp, Homo sapien
acagaagtgcaaatatttatggcca

SEQ ID NO: 311838 - DNA, 25 bp, Homo sapien
agctgttgacaagatccactaaaat

SEQ ID NO: 311839 - DNA, 25 bp, Homo sapien
aaacgtgtttatcacctttggatag

SEQ ID NO: 311840 - DNA, 25 bp, Homo sapien
atcacctttggatagaattcttaag

SEQ ID NO: 311841 - DNA, 25 bp, Homo sapien
tccccgccctttcttagagtgcagt

SEQ ID NO: 311842 - DNA, 25 bp, Homo sapien
gccctttcttagagtgcagttctta

SEQ ID NO: 311843 - DNA, 25 bp, Homo sapien
ttagccctctagaaacgagttggtg

SEQ ID NO: 311844 - DNA, 25 bp, Homo sapien
tagaaacgagttggtgtctttcgtc

SEQ ID NO: 311845 - DNA, 25 bp, Homo sapien
tggtgtctttcgtctcagtagcccc

SEQ ID NO: 311846 - DNA, 25 bp, Homo sapien
cccaccccaataagctgtagacatt

SEQ ID NO: 311847 - DNA, 25 bp, Homo sapien
gtagacattggtttacagtgaaact

SEQ ID NO: 311848 - DNA, 25 bp, Homo sapien
ggtttacagtgaaactatgctattc

SEQ ID NO: 311849 - DNA, 25 bp, Homo sapien
actatgctattctcagccctttgaa

SEQ ID NO: 311850 - DNA, 25 bp, Homo sapien
atgctattctcagccctttgaaact

SEQ ID NO: 311851 - DNA, 25 bp, Homo sapien
ttctcagccctttgaaactctgctt

SEQ ID NO: 311852 - DNA, 25 bp, Homo sapien
ggtaatccattagagactacagcag

SEQ ID NO: 311853 - DNA, 25 bp, Homo sapien
gactacagcagtgttacctgtgcaa

SEQ ID NO: 311854 - DNA, 25 bp, Homo sapien
gttacctgtgcaaatacaacttact

SEQ ID NO: 311855 - DNA, 25 bp, Homo sapien
acaacttactacttctgttaccttg

SEQ ID NO: 311856 - DNA, 25 bp, Homo sapien
tacttctgttaccttgaacttggaa

SEQ ID NO: 311857 - DNA, 25 bp, Homo sapien
aaaaaacagtgctctaccgaatgat

SEQ ID NO: 311858 - DNA, 25 bp, Homo sapien
agtgctctaccgaatgatgctgctt

SEQ ID NO: 311859 - DNA, 25 bp, Homo sapien
taccgaatgatgctgcttcaatgtc

SEQ ID NO: 311860 - DNA, 25 bp, Homo sapien
gggaaaacatctctaatttgtacac

SEQ ID NO: 311861 - DNA, 25 bp, Homo sapien
gacattttgctagcttttttcatct

SEQ ID NO: 311862 - DNA, 25 bp, Homo sapien
tgctagcttttttcatcttagcttg

SEQ ID NO: 311863 - DNA, 25 bp, Homo sapien
agcctctctaggtctctgcacagtc

SEQ ID NO: 311864 - DNA, 25 bp, Homo sapien
tctctaggtctctgcacagtctcca

SEQ ID NO: 311865 - DNA, 25 bp, Homo sapien
tctccagtgtggaaagctgtgggaa

SEQ ID NO: 311866 - DNA, 25 bp, Homo sapien
aggagcaggttctaggtcttcagga

SEQ ID NO: 311867 - DNA, 25 bp, Homo sapien
cttcaggattttctgcatcttaaag

SEQ ID NO: 311868 - DNA, 25 bp, Homo sapien
tgcatcttaaagcagctcatctcct

SEQ ID NO: 311869 - DNA, 25 bp, Homo sapien
tcatctcctttgccctcctagggag

SEQ ID NO: 311870 - DNA, 25 bp, Homo sapien
aaataacatttctcacacaaaggat

SEQ ID NO: 311871 - DNA, 25 bp, Homo sapien
tgggctgtgcaggttctgagctttc

SEQ ID NO: 311872 - DNA, 25 bp, Homo sapien
tgtgcaggttctgagctttccccat

SEQ ID NO: 311873 - DNA, 25 bp, Homo sapien
gcaggttctgagctttccccatgtg

SEQ ID NO: 311874 - DNA, 25 bp, Homo sapien
acactgatcgatttgttcacgagaa

SEQ ID NO: 311875 - DNA, 25 bp, Homo sapien
gttcacgagaaaggacatttctaaa

SEQ ID NO: 311876 - DNA, 25 bp, Homo sapien
ttctaaaagagccaggagactgccc

SEQ ID NO: 311877 - DNA, 25 bp, Homo sapien
aacctttaaacagcagagcagtgaa

SEQ ID NO: 311878 - DNA, 25 bp, Homo sapien
agatgcaggctggagcgatccctca

SEQ ID NO: 311879 - DNA, 25 bp, Homo sapien
ggctggagcgatccctcataattta

SEQ ID NO: 311880 - DNA, 25 bp, Homo sapien
gggcagacctgcctgacttggatat

SEQ ID NO: 311881 - DNA, 25 bp, Homo sapien
gacttggatatcagcttctccatga

SEQ ID NO: 311882 - DNA, 25 bp, Homo sapien
ggatatcagcttctccatgaaaata

SEQ ID NO: 311883 - DNA, 25 bp, Homo sapien
gcttctccatgaaaatatgcagtgc

SEQ ID NO: 311884 - DNA, 25 bp, Homo sapien
gtgcctaaaatttacactgatcgat

SEQ ID NO: 311885 - DNA, 25 bp, Homo sapien
gaagaaagctaactcagtacactaa

SEQ ID NO: 311886 - DNA, 25 bp, Homo sapien
gctaactcagtacactaagagtgat

SEQ ID NO: 311887 - DNA, 25 bp, Homo sapien
gtacactaagagtgatttacatgcc

SEQ ID NO: 311888 - DNA, 25 bp, Homo sapien
ccctttgacctcctgaatcagaatc

SEQ ID NO: 311889 - DNA, 25 bp, Homo sapien
ctttgacctcctgaatcagaatctc

SEQ ID NO: 311890 - DNA, 25 bp, Homo sapien
ttgaccctccccaaatgccttgtta

SEQ ID NO: 311891 - DNA, 25 bp, Homo sapien
cctccccaaatgccttgttatttat

SEQ ID NO: 311892 - DNA, 25 bp, Homo sapien
tatatctctgcttttagataacaga

SEQ ID NO: 311893 - DNA, 25 bp, Homo sapien
atcagaatctctagggacacggcct

SEQ ID NO: 311894 - DNA, 25 bp, Homo sapien
gaatctctagggacacggcctggaa

SEQ ID NO: 311895 - DNA, 25 bp, Homo sapien
tctctagggacacggcctggaagtt

SEQ ID NO: 311896 - DNA, 25 bp, Homo sapien
tgtgtcactttctgcaagacaagga

SEQ ID NO: 311897 - DNA, 25 bp, Homo sapien
agacaaggaccagcctcaaagagga

SEQ ID NO: 311898 - DNA, 25 bp, Homo sapien
tgtcctgtggctttcctctgactgc

SEQ ID NO: 311899 - DNA, 25 bp, Homo sapien
gcctctcagtccagctttgagtgga

SEQ ID NO: 311900 - DNA, 25 bp, Homo sapien
gtccagctttgagtggagttacata

SEQ ID NO: 311901 - DNA, 25 bp, Homo sapien
gagttacataatttccaggcttccc

SEQ ID NO: 311902 - DNA, 25 bp, Homo sapien
cccatccctgaactgtttacacagt

SEQ ID NO: 311903 - DNA, 25 bp, Homo sapien
tgtttacacagtagctctcacccac

SEQ ID NO: 311904 - DNA, 25 bp, Homo sapien
tctcacccacaaagagtccgcatga

SEQ ID NO: 311905 - DNA, 25 bp, Homo sapien
caaagagtccgcatgatggcttttc

SEQ ID NO: 311906 - DNA, 25 bp, Homo sapien
catgatggcttttcctctgtttgga

SEQ ID NO: 311907 - DNA, 25 bp, Homo sapien
aatgtgggaagcaatagcctccagt

SEQ ID NO: 311908 - DNA, 25 bp, Homo sapien
gaagcaatagcctccagtaatgctg

SEQ ID NO: 311909 - DNA, 25 bp, Homo sapien
acaggatcttagaacagcgtttgca

SEQ ID NO: 311910 - DNA, 25 bp, Homo sapien
cagcgtttgcaaagtgtgctctaca

SEQ ID NO: 311911 - DNA, 25 bp, Homo sapien
gtgtgctctacagaaaactatgata

SEQ ID NO: 311912 - DNA, 25 bp, Homo sapien
aaagtgtccatagtccagtcacctt

SEQ ID NO: 311913 - DNA, 25 bp, Homo sapien
agtccagtcaccttgagaaactctg

SEQ ID NO: 311914 - DNA, 25 bp, Homo sapien
atgcaaatatcccagcgtagtaggc

SEQ ID NO: 311915 - DNA, 25 bp, Homo sapien
tatcccagcgtagtaggccgatcaa

SEQ ID NO: 311916 - DNA, 25 bp, Homo sapien
ggccgatcaacgtaacatagaacct

SEQ ID NO: 311917 - DNA, 25 bp, Homo sapien
aaataggtgcttttacatgtagaat

SEQ ID NO: 311918 - DNA, 25 bp, Homo sapien
gcaaacacacccattaggaatatcg

SEQ ID NO: 311919 - DNA, 25 bp, Homo sapien
ggaatatcgttctacgttcagcttg

SEQ ID NO: 311920 - DNA, 25 bp, Homo sapien
gttcagcttgatcatcaagttttgc

SEQ ID NO: 311921 - DNA, 25 bp, Homo sapien
agtttactcacctaaatcatgggtt

SEQ ID NO: 311922 - DNA, 25 bp, Homo sapien
aagaagcatctagaaagtccaaatt

SEQ ID NO: 311923 - DNA, 25 bp, Homo sapien
gtccaaattctgagggtaatgattc

SEQ ID NO: 311924 - DNA, 25 bp, Homo sapien
gattcacaacaatcttagcgcccag

SEQ ID NO: 311925 - DNA, 25 bp, Homo sapien
acaacaatcttagcgcccagtaggg

SEQ ID NO: 311926 - DNA, 25 bp, Homo sapien
ttagcgcccagtagggctatcggag

SEQ ID NO: 311927 - DNA, 25 bp, Homo sapien
gaatccagccctttgtggctgcaga

SEQ ID NO: 311928 - DNA, 25 bp, Homo sapien
gaagggaagcagtttcagcctcccc

SEQ ID NO: 311929 - DNA, 25 bp, Homo sapien
actgacttcccgttcttcagctgct

SEQ ID NO: 311930 - DNA, 25 bp, Homo sapien
ttcccgttcttcagctgctctaggc

SEQ ID NO: 311931 - DNA, 25 bp, Homo sapien
ttcttcagctgctctaggcttccct

SEQ ID NO: 311932 - DNA, 25 bp, Homo sapien
ttcagctgctctaggcttccctgtc

SEQ ID NO: 311933 - DNA, 25 bp, Homo sapien
aactgccatggacccctcttcagca

SEQ ID NO: 311934 - DNA, 25 bp, Homo sapien
agccagtacctggtttctgtctcag

SEQ ID NO: 311935 - DNA, 25 bp, Homo sapien
cagtacctggtttctgtctcagcgg

SEQ ID NO: 311936 - DNA, 25 bp, Homo sapien
ggaggactcagtagataggtattga

SEQ ID NO: 311937 - DNA, 25 bp, Homo sapien
tgagatgagggaatcggctttctgt

SEQ ID NO: 311938 - DNA, 25 bp, Homo sapien
atgagggaatcggctttctgtggcc

SEQ ID NO: 311939 - DNA, 25 bp, Homo sapien
tttctgtggccgggaacactcctgc

SEQ ID NO: 311940 - DNA, 25 bp, Homo sapien
agatgtaccgagtttgaaatcccag

SEQ ID NO: 311941 - DNA, 25 bp, Homo sapien
gaaatcccagaagcccaagaggaaa

SEQ ID NO: 311942 - DNA, 25 bp, Homo sapien
tctgttctctaaccttggaaggttt

SEQ ID NO: 311943 - DNA, 25 bp, Homo sapien
atttctcagaggatagcctttcact

SEQ ID NO: 311944 - DNA, 25 bp, Homo sapien
atagcctttcacttattcatctgtc

SEQ ID NO: 311945 - DNA, 25 bp, Homo sapien
tattcatctgtccagcatgactcat

SEQ ID NO: 311946 - DNA, 25 bp, Homo sapien
agcatgactcatccccgggagtgtt

SEQ ID NO: 311947 - DNA, 25 bp, Homo sapien
gtctttggccatcttctgctggagc

SEQ ID NO: 311948 - DNA, 25 bp, Homo sapien
atcttctgctggagcttccagggag

SEQ ID NO: 311949 - DNA, 25 bp, Homo sapien
agggaggatgtgtctccaagagacc

SEQ ID NO: 311950 - DNA, 25 bp, Homo sapien
gtctccaagagaccagatgtaccga

SEQ ID NO: 311951 - DNA, 25 bp, Homo sapien
aatcacgtctttgtatttgcagcta

SEQ ID NO: 311952 - DNA, 25 bp, Homo sapien
gtatttgcagctacagactgggtcc

SEQ ID NO: 311953 - DNA, 25 bp, Homo sapien
gcttgttgttggctgagatttaaaa

SEQ ID NO: 311954 - DNA, 25 bp, Homo sapien
gatagtttgaagatactcccctaaa

SEQ ID NO: 311955 - DNA, 25 bp, Homo sapien
gtaaagattcttccatactcggctc

SEQ ID NO: 311956 - DNA, 25 bp, Homo sapien
attcttccatactcggctcggatga

SEQ ID NO: 311957 - DNA, 25 bp, Homo sapien
tccatactcggctcggatgagttgt

SEQ ID NO: 311958 - DNA, 25 bp, Homo sapien
agtggctgttcacaattgattttag

SEQ ID NO: 311959 - DNA, 25 bp, Homo sapien
gattaatcacttgctcttgtgggca

SEQ ID NO: 311960 - DNA, 25 bp, Homo sapien
aatcacttgctcttgtgggcagctt

SEQ ID NO: 311961 - DNA, 25 bp, Homo sapien
gctcttgtgggcagcttttcaaaaa

SEQ ID NO: 311962 - DNA, 25 bp, Homo sapien
agcctagaggctcagatcagaatct

SEQ ID NO: 311963 - DNA, 25 bp, Homo sapien
agaatctggagctgcgggtcacgca

SEQ ID NO: 311964 - DNA, 25 bp, Homo sapien
acgcacggtgccagaggtttaggtt

SEQ ID NO: 311965 - DNA, 25 bp, Homo sapien
ttgacaacaatgatggaggctttcc

SEQ ID NO: 311966 - DNA, 25 bp, Homo sapien
ggaggctttcctgcgataaacggct

SEQ ID NO: 311967 - DNA, 25 bp, Homo sapien
ataaacggctcaatcttccctggaa

SEQ ID NO: 311968 - DNA, 25 bp, Homo sapien
gaatctgcactctctcagctttatg

SEQ ID NO: 311969 - DNA, 25 bp, Homo sapien
agctttatggctgcccatgctggag

SEQ ID NO: 311970 - DNA, 25 bp, Homo sapien
atgctggagctttgcagactgaacc

SEQ ID NO: 311971 - DNA, 25 bp, Homo sapien
gactgaaccatgtcagaggtcactc

SEQ ID NO: 311972 - DNA, 25 bp, Homo sapien
gtggcagagacaccaagtgctcacc

SEQ ID NO: 311973 - DNA, 25 bp, Homo sapien
cgtggccctgcagttagatgagctg

SEQ ID NO: 311974 - DNA, 25 bp, Homo sapien
gatgagctgagatcactatagtact

SEQ ID NO: 311975 - DNA, 25 bp, Homo sapien
tagtactatatagcgctctaaatcc

SEQ ID NO: 311976 - DNA, 25 bp, Homo sapien
agcgctctaaatcctaaatgctaga

SEQ ID NO: 311977 - DNA, 25 bp, Homo sapien
aaatgctagatcactgtaatactgt

SEQ ID NO: 311978 - DNA, 25 bp, Homo sapien
gtaatactgtacagatcagccactt

SEQ ID NO: 311979 - DNA, 25 bp, Homo sapien
atcagccacttgctggcttgtgact

SEQ ID NO: 311980 - DNA, 25 bp, Homo sapien
gcttgtgactctgggccatttactt

SEQ ID NO: 311981 - DNA, 25 bp, Homo sapien
ttgtttactgtaatttctagcatgt

SEQ ID NO: 311982 - DNA, 25 bp, Homo sapien
tctagcatgtagttcgtgctccatg

SEQ ID NO: 311983 - DNA, 25 bp, Homo sapien
gtgctccatgcatttaactgttatt

SEQ ID NO: 311984 - DNA, 25 bp, Homo sapien
aatttccatctctgacttgttggaa

SEQ ID NO: 311985 - DNA, 25 bp, Homo sapien
ggaaatttggtgaattatccactca

SEQ ID NO: 311986 - DNA, 25 bp, Homo sapien
gaattatccactcagattcccgagt

SEQ ID NO: 311987 - DNA, 25 bp, Homo sapien
agattcccgagttaggacctctact

SEQ ID NO: 311988 - DNA, 25 bp, Homo sapien
gacctctactccatccagtgcagga

SEQ ID NO: 311989 - DNA, 25 bp, Homo sapien
cctagactctacctaaacactgtca

SEQ ID NO: 311990 - DNA, 25 bp, Homo sapien
gctggtgcacatgcatcctttaggc

SEQ ID NO: 311991 - DNA, 25 bp, Homo sapien
gcacatgcatcctttaggcctattt

SEQ ID NO: 311992 - DNA, 25 bp, Homo sapien
atcctttaggcctatttattccaag

SEQ ID NO: 311993 - DNA, 25 bp, Homo sapien
atttattccaagtgagacagctctg

SEQ ID NO: 311994 - DNA, 25 bp, Homo sapien
tcatcctcatggctattccatctca

SEQ ID NO: 311995 - DNA, 25 bp, Homo sapien
tttgatgagagcaccagcctcaagc

SEQ ID NO: 311996 - DNA, 25 bp, Homo sapien
tcaagccttgttctgtgcccacaag

SEQ ID NO: 311997 - DNA, 25 bp, Homo sapien
atactgtgcaggcatcactccagaa

SEQ ID NO: 311998 - DNA, 25 bp, Homo sapien
taaaccatagtctttaaagcccaga

SEQ ID NO: 311999 - DNA, 25 bp, Homo sapien
agcccagaatcaggcttgtttcttg

SEQ ID NO: 312000 - DNA, 25 bp, Homo sapien
tgtttcttggttttggtagctgtaa

SEQ ID NO: 312001 - DNA, 25 bp, Homo sapien
gtcattcactggttcattcttttct

SEQ ID NO: 312002 - DNA, 25 bp, Homo sapien
ccagaatcactggacctgtacaaca

SEQ ID NO: 312003 - DNA, 25 bp, Homo sapien
ctgtacaacatgctgattccctgat

SEQ ID NO: 312004 - DNA, 25 bp, Homo sapien
tgatgcacaggcgatccaggcttca

SEQ ID NO: 312005 - DNA, 25 bp, Homo sapien
ggcttcattcccagctttgatgaga

SEQ ID NO: 312006 - DNA, 25 bp, Homo sapien
tgaacctgcatgtatattttctgac

SEQ ID NO: 312007 - DNA, 25 bp, Homo sapien
agagggctctggtgcattgtgtcac

SEQ ID NO: 312008 - DNA, 25 bp, Homo sapien
attgtgtcaccaacagatctcctag

SEQ ID NO: 312009 - DNA, 25 bp, Homo sapien
gatctcctagaccatggcttattac

SEQ ID NO: 312010 - DNA, 25 bp, Homo sapien
tattaccaagccctccacagtgcaa

SEQ ID NO: 312011 - DNA, 25 bp, Homo sapien
gaatgggtgggtttaaatcctgcct

SEQ ID NO: 312012 - DNA, 25 bp, Homo sapien
tgcctctgccattcactagatgtag

SEQ ID NO: 312013 - DNA, 25 bp, Homo sapien
agatgtagccttgagcatgttacca

SEQ ID NO: 312014 - DNA, 25 bp, Homo sapien
ccttgagcatgttaccattagccct

SEQ ID NO: 312015 - DNA, 25 bp, Homo sapien
gtgaaattcaactcacctgtgattt

SEQ ID NO: 312016 - DNA, 25 bp, Homo sapien
tggacttcatgagcctcaaggtttt

SEQ ID NO: 312017 - DNA, 25 bp, Homo sapien
tgccatccccagaaccggtgtgaca

SEQ ID NO: 312018 - DNA, 25 bp, Homo sapien
agaaccggtgtgacaggccccacaa

SEQ ID NO: 312019 - DNA, 25 bp, Homo sapien
aggccccacaagcacgcatgtgagt

SEQ ID NO: 312020 - DNA, 25 bp, Homo sapien
caagcacgcatgtgagtcagctcat

SEQ ID NO: 312021 - DNA, 25 bp, Homo sapien
gtgagtcagctcatgcacaggagag

SEQ ID NO: 312022 - DNA, 25 bp, Homo sapien
tgtgactgcacccaggcctgaacac

SEQ ID NO: 312023 - DNA, 25 bp, Homo sapien
gaacacacatgcatggcctgagatc

SEQ ID NO: 312024 - DNA, 25 bp, Homo sapien
actccaggcctgaagtatctgccac

SEQ ID NO: 312025 - DNA, 25 bp, Homo sapien
aggcctgaagtatctgccacctttg

SEQ ID NO: 312026 - DNA, 25 bp, Homo sapien
aagtatctgccacctttggcaggct

SEQ ID NO: 312027 - DNA, 25 bp, Homo sapien
tctgggccccatggaaaggctgagg

SEQ ID NO: 312028 - DNA, 25 bp, Homo sapien
agcaccagggcttggactggatctt

SEQ ID NO: 312029 - DNA, 25 bp, Homo sapien
actggatcttactcagtccatggtg

SEQ ID NO: 312030 - DNA, 25 bp, Homo sapien
atcttactcagtccatggtgcccag

SEQ ID NO: 312031 - DNA, 25 bp, Homo sapien
atgtgaccgtcatgccctggatgga

SEQ ID NO: 312032 - DNA, 25 bp, Homo sapien
gaccgtcatgccctggatggagcca

SEQ ID NO: 312033 - DNA, 25 bp, Homo sapien
gtagtggaccaatggcaaccctctg

SEQ ID NO: 312034 - DNA, 25 bp, Homo sapien
ctggatggagccactcctggctcac

SEQ ID NO: 312035 - DNA, 25 bp, Homo sapien
tggaccaatggcaaccctctgtggg

SEQ ID NO: 312036 - DNA, 25 bp, Homo sapien
ggccaggagaatgggattaccctat

SEQ ID NO: 312037 - DNA, 25 bp, Homo sapien
gagaatgggattaccctatgaccaa

SEQ ID NO: 312038 - DNA, 25 bp, Homo sapien
tgggattaccctatgaccaaggaga

SEQ ID NO: 312039 - DNA, 25 bp, Homo sapien
ctctccacgagagtcaacaggtgtc

SEQ ID NO: 312040 - DNA, 25 bp, Homo sapien
acgagagtcaacaggtgtcacacta

SEQ ID NO: 312041 - DNA, 25 bp, Homo sapien
gagtcaacaggtgtcacactaagga

SEQ ID NO: 312042 - DNA, 25 bp, Homo sapien
gtcacactaaggagactttgttcat

SEQ ID NO: 312043 - DNA, 25 bp, Homo sapien
taaggagactttgttcatggctggg

SEQ ID NO: 312044 - DNA, 25 bp, Homo sapien
tatggtttgggtatggtttgcttgc

SEQ ID NO: 312045 - DNA, 25 bp, Homo sapien
gtatggtttgcttgcccccaccaaa

SEQ ID NO: 312046 - DNA, 25 bp, Homo sapien
gaatagattaatgccttccagttga

SEQ ID NO: 312047 - DNA, 25 bp, Homo sapien
gattaatgccttccagttgaagtga

SEQ ID NO: 312048 - DNA, 25 bp, Homo sapien
atgccttccagttgaagtgaatcat

SEQ ID NO: 312049 - DNA, 25 bp, Homo sapien
gtgaatcatcactcttgtgggaatg

SEQ ID NO: 312050 - DNA, 25 bp, Homo sapien
atttacctggtgtttgagtttatgg

SEQ ID NO: 312051 - DNA, 25 bp, Homo sapien
ttatgggtgagtgaggccccggcca

SEQ ID NO: 312052 - DNA, 25 bp, Homo sapien
tgttctgtcctgacgccgtctgcgg

SEQ ID NO: 312053 - DNA, 25 bp, Homo sapien
tgcagctggcccacagtggcttgct

SEQ ID NO: 312054 - DNA, 25 bp, Homo sapien
tcaccatgtaccctggactcaggga

SEQ ID NO: 312055 - DNA, 25 bp, Homo sapien
ggactcagggacagacagctgacta

SEQ ID NO: 312056 - DNA, 25 bp, Homo sapien
gacagctgactagtgtcagcctcca

SEQ ID NO: 312057 - DNA, 25 bp, Homo sapien
tagtgtcagcctccagagccagcag

SEQ ID NO: 312058 - DNA, 25 bp, Homo sapien
tgctctgaccacagtttgcagttgc

SEQ ID NO: 312059 - DNA, 25 bp, Homo sapien
gaccacagtttgcagttgcgttctc

SEQ ID NO: 312060 - DNA, 25 bp, Homo sapien
tgcagttgcgttctcctttttcttc

SEQ ID NO: 312061 - DNA, 25 bp, Homo sapien
aattgtcagaacataggcttccctc

SEQ ID NO: 312062 - DNA, 25 bp, Homo sapien
ataggcttccctcaagaactcaaaa

SEQ ID NO: 312063 - DNA, 25 bp, Homo sapien
aagaactcaaaatcgcactctggga

SEQ ID NO: 312064 - DNA, 25 bp, Homo sapien
gcccaaggactgatgctcataatga

SEQ ID NO: 312065 - DNA, 25 bp, Homo sapien
aaatcgcactctgggagccatttta

SEQ ID NO: 312066 - DNA, 25 bp, Homo sapien
ctgggagccattttaagatctgaaa

SEQ ID NO: 312067 - DNA, 25 bp, Homo sapien
gagatacctaataagttgtgccaga

SEQ ID NO: 312068 - DNA, 25 bp, Homo sapien
ctgatgctcataatgatgttcgtga

SEQ ID NO: 312069 - DNA, 25 bp, Homo sapien
aaaccagcaggacttgattagataa

SEQ ID NO: 312070 - DNA, 25 bp, Homo sapien
gcgaatggaatgaactctgcctaat

SEQ ID NO: 312071 - DNA, 25 bp, Homo sapien
ggaatgaactctgcctaatgataat

SEQ ID NO: 312072 - DNA, 25 bp, Homo sapien
ttagcaagtctaaggtacaacaaga

SEQ ID NO: 312073 - DNA, 25 bp, Homo sapien
agctgagtagctgaatccgcttctc

SEQ ID NO: 312074 - DNA, 25 bp, Homo sapien
ctgaatccgcttctctttgagttaa

SEQ ID NO: 312075 - DNA, 25 bp, Homo sapien
gcttctctttgagttaatccatgaa

SEQ ID NO: 312076 - DNA, 25 bp, Homo sapien
aattgtttcttctagtctaattcta

SEQ ID NO: 312077 - DNA, 25 bp, Homo sapien
gttttcatgtatttagtccttccta

SEQ ID NO: 312078 - DNA, 25 bp, Homo sapien
agtccttcctattacattctacaaa

SEQ ID NO: 312079 - DNA, 25 bp, Homo sapien
ttctacaaattctactccatgtttt

SEQ ID NO: 312080 - DNA, 25 bp, Homo sapien
ctccatgttttaattctacaatcta

SEQ ID NO: 312081 - DNA, 25 bp, Homo sapien
gatactattcatggagccttattta

SEQ ID NO: 312082 - DNA, 25 bp, Homo sapien
gccttatttatctccttagttgctt

SEQ ID NO: 312083 - DNA, 25 bp, Homo sapien
gcccgtaggcaaggtgcacctgggt

SEQ ID NO: 312084 - DNA, 25 bp, Homo sapien
taggcaaggtgcacctgggtgcccg

SEQ ID NO: 312085 - DNA, 25 bp, Homo sapien
ccctgcagcactgggcagacatgct

SEQ ID NO: 312086 - DNA, 25 bp, Homo sapien
actgggcagacatgctggcccacgc

SEQ ID NO: 312087 - DNA, 25 bp, Homo sapien
ggccagccagggaggtggaccgcat

SEQ ID NO: 312088 - DNA, 25 bp, Homo sapien
aggtggaccgcatgctggccctgca

SEQ ID NO: 312089 - DNA, 25 bp, Homo sapien
tcctgaatgcaccacatgcctctgt

SEQ ID NO: 312090 - DNA, 25 bp, Homo sapien
tgaatgcaccacatgcctctgtctc

SEQ ID NO: 312091 - DNA, 25 bp, Homo sapien
cgccctgcaggaccactgcaataaa

SEQ ID NO: 312092 - DNA, 25 bp, Homo sapien
gccctgcaggaccactgcaataaac

SEQ ID NO: 312093 - DNA, 25 bp, Homo sapien
cctgcaggaccactgcaataaacgc

SEQ ID NO: 312094 - DNA, 25 bp, Homo sapien
ttttagtgactccttctgtttcttt

SEQ ID NO: 312095 - DNA, 25 bp, Homo sapien
gttttccgttttactgacatttgct

SEQ ID NO: 312096 - DNA, 25 bp, Homo sapien
actgacatttgctctcaactttcta

SEQ ID NO: 312097 - DNA, 25 bp, Homo sapien
tactttctctaacttcttaaattgg

SEQ ID NO: 312098 - DNA, 25 bp, Homo sapien
acatcaaccactttattacatccca

SEQ ID NO: 312099 - DNA, 25 bp, Homo sapien
tcccataaactttgataggtaggta

SEQ ID NO: 312100 - DNA, 25 bp, Homo sapien
ttgtcttttcatcaagcttgccagg

SEQ ID NO: 312101 - DNA, 25 bp, Homo sapien
ttcatcaagcttgccaggtttgcct

SEQ ID NO: 312102 - DNA, 25 bp, Homo sapien
ccaggtttgcctattttatttgact

SEQ ID NO: 312103 - DNA, 25 bp, Homo sapien
tatttgactttgtaacagccagcag

SEQ ID NO: 312104 - DNA, 25 bp, Homo sapien
acagccagcagtaggttttagtgac

SEQ ID NO: 312105 - DNA, 25 bp, Homo sapien
ggggtgatttttctactgtcagttt

SEQ ID NO: 312106 - DNA, 25 bp, Homo sapien
aaacttgtctatttgcatttgtgtg

SEQ ID NO: 312107 - DNA, 25 bp, Homo sapien
gcatttgtgtgttattacttctagt

SEQ ID NO: 312108 - DNA, 25 bp, Homo sapien
ttctagttaagagtatttccaagga

SEQ ID NO: 312109 - DNA, 25 bp, Homo sapien
ttccaaggaaagtttcatgttactt

SEQ ID NO: 312110 - DNA, 25 bp, Homo sapien
gaaagtttcatgttacttattttgt

SEQ ID NO: 312111 - DNA, 25 bp, Homo sapien
ttttaatactggtagcttcctcaag

SEQ ID NO: 312112 - DNA, 25 bp, Homo sapien
aatactggtagcttcctcaaggttg

SEQ ID NO: 312113 - DNA, 25 bp, Homo sapien
ctggtagcttcctcaaggttggaaa

SEQ ID NO: 312114 - DNA, 25 bp, Homo sapien
gttggaaaacaagatctgaatacta

SEQ ID NO: 312115 - DNA, 25 bp, Homo sapien
aactatttttctgtggtcatattaa

SEQ ID NO: 312116 - DNA, 25 bp, Homo sapien
ttttttccggtcctgccacatgtaa

SEQ ID NO: 312117 - DNA, 25 bp, Homo sapien
tgccacatgtaacacttactctgtt

SEQ ID NO: 312118 - DNA, 25 bp, Homo sapien
gatcatatccaatctacttattaaa

SEQ ID NO: 312119 - DNA, 25 bp, Homo sapien
ctgtgttctatttaccagtggagtt

SEQ ID NO: 312120 - DNA, 25 bp, Homo sapien
ttttctgcagtggttgcgtttcact

SEQ ID NO: 312121 - DNA, 25 bp, Homo sapien
ggttgcgtttcactgtaaggataat

SEQ ID NO: 312122 - DNA, 25 bp, Homo sapien
aggataatggagttcctctcctctg

SEQ ID NO: 312123 - DNA, 25 bp, Homo sapien
ctgctttcctcagaggatggtcctt

SEQ ID NO: 312124 - DNA, 25 bp, Homo sapien
ggatggtcctttaacatagccagaa

SEQ ID NO: 312125 - DNA, 25 bp, Homo sapien
gaaacaagccctgtggtttgaaggt

SEQ ID NO: 312126 - DNA, 25 bp, Homo sapien
ggactaattgatatgcaccagttta

SEQ ID NO: 312127 - DNA, 25 bp, Homo sapien
acgccgggcctaccatgactatatt

SEQ ID NO: 312128 - DNA, 25 bp, Homo sapien
gccgggcctaccatgactatattta

SEQ ID NO: 312129 - DNA, 25 bp, Homo sapien
ccgggcctaccatgactatatttaa

SEQ ID NO: 312130 - DNA, 25 bp, Homo sapien
cgggcctaccatgactatatttaag

SEQ ID NO: 312131 - DNA, 25 bp, Homo sapien
gggcctaccatgactatatttaaga

SEQ ID NO: 312132 - DNA, 25 bp, Homo sapien
gcctaccatgactatatttaagaga

SEQ ID NO: 312133 - DNA, 25 bp, Homo sapien
tatttttattagcacatttcactca

SEQ ID NO: 312134 - DNA, 25 bp, Homo sapien
tttcactcattcctttattccttct

SEQ ID NO: 312135 - DNA, 25 bp, Homo sapien
actcattcctttattccttctcctt

SEQ ID NO: 312136 - DNA, 25 bp, Homo sapien
cattcctttattccttctcctttct

SEQ ID NO: 312137 - DNA, 25 bp, Homo sapien
tcctttctcttccttggttttgatc

SEQ ID NO: 312138 - DNA, 25 bp, Homo sapien
aggctgtagtacaagcaagcagttt

SEQ ID NO: 312139 - DNA, 25 bp, Homo sapien
tcatgggaatattcagtcaaggagc

SEQ ID NO: 312140 - DNA, 25 bp, Homo sapien
tattcagtcaaggagcagactttgg

SEQ ID NO: 312141 - DNA, 25 bp, Homo sapien
gactttggtctgaactagccattga

SEQ ID NO: 312142 - DNA, 25 bp, Homo sapien
gaactagccattgatgattgttaag

SEQ ID NO: 312143 - DNA, 25 bp, Homo sapien
gattgttaagtttcccattcttaga

SEQ ID NO: 312144 - DNA, 25 bp, Homo sapien
gtttcccattcttagactgcatcaa

SEQ ID NO: 312145 - DNA, 25 bp, Homo sapien
gactgcatcaatccttgtgatcctt

SEQ ID NO: 312146 - DNA, 25 bp, Homo sapien
aatccttgtgatccttaacaggtta

SEQ ID NO: 312147 - DNA, 25 bp, Homo sapien
gaatatctgtcaattaagcatcatg

SEQ ID NO: 312148 - DNA, 25 bp, Homo sapien
gcatcatgactcagataatttttac

SEQ ID NO: 312149 - DNA, 25 bp, Homo sapien
gaatcgttgcagaacacaatcagtt

SEQ ID NO: 312150 - DNA, 25 bp, Homo sapien
aatcagttctctcttgggattaaag

SEQ ID NO: 312151 - DNA, 25 bp, Homo sapien
gcaagagctttaggcacagagtgtc

SEQ ID NO: 312152 - DNA, 25 bp, Homo sapien
acaagactggatgacggatgcgatt

SEQ ID NO: 312153 - DNA, 25 bp, Homo sapien
gacggatgcgattcacatgctggat

SEQ ID NO: 312154 - DNA, 25 bp, Homo sapien
atgctggattcatactgccacccga

SEQ ID NO: 312155 - DNA, 25 bp, Homo sapien
acccgacatccgacaaaagtgtgct

SEQ ID NO: 312156 - DNA, 25 bp, Homo sapien
tggacagcaggacgctcaagctcga

SEQ ID NO: 312157 - DNA, 25 bp, Homo sapien
caagctcgaggtgtgcatctttaca

SEQ ID NO: 312158 - DNA, 25 bp, Homo sapien
acagagtgtcgcagctgtcttctca

SEQ ID NO: 312159 - DNA, 25 bp, Homo sapien
ctgtcttctcagtatctagcgctaa

SEQ ID NO: 312160 - DNA, 25 bp, Homo sapien
gtatacagcttctgatacttctgaa

SEQ ID NO: 312161 - DNA, 25 bp, Homo sapien
ctgaaaacctcacacagccaaaggg

SEQ ID NO: 312162 - DNA, 25 bp, Homo sapien
cagccaaagggtacatccttggtat

SEQ ID NO: 312163 - DNA, 25 bp, Homo sapien
ttagtacttctggtccccagtaacg

SEQ ID NO: 312164 - DNA, 25 bp, Homo sapien
ggtatagaggctcactcttactcac

SEQ ID NO: 312165 - DNA, 25 bp, Homo sapien
tcttactcaccagccaggcaaggaa

SEQ ID NO: 312166 - DNA, 25 bp, Homo sapien
ggaaggctcaatcctttggtgttag

SEQ ID NO: 312167 - DNA, 25 bp, Homo sapien
ttctggtccccagtaacggagagag

SEQ ID NO: 312168 - DNA, 25 bp, Homo sapien
atcagtcatttgcaatgcttttgag

SEQ ID NO: 312169 - DNA, 25 bp, Homo sapien
tttgagaaagtactgtgtataccct

SEQ ID NO: 312170 - DNA, 25 bp, Homo sapien
tgttttaaggctccaacaaattggt

SEQ ID NO: 312171 - DNA, 25 bp, Homo sapien
ttaactgctgttttggtattccaca

SEQ ID NO: 312172 - DNA, 25 bp, Homo sapien
tgctgttttggtattccacacaggg

SEQ ID NO: 312173 - DNA, 25 bp, Homo sapien
gctgctgagggagatcactgcaagt

SEQ ID NO: 312174 - DNA, 25 bp, Homo sapien
ggagatcactgcaagtgaacggcaa

SEQ ID NO: 312175 - DNA, 25 bp, Homo sapien
agtgaacggcaaaatctagtctgat

SEQ ID NO: 312176 - DNA, 25 bp, Homo sapien
ggcaaaatctagtctgatggctcag

SEQ ID NO: 312177 - DNA, 25 bp, Homo sapien
gactaaaaaacttggcctgccaact

SEQ ID NO: 312178 - DNA, 25 bp, Homo sapien
gagggagcagtgcttccagtgaaaa

SEQ ID NO: 312179 - DNA, 25 bp, Homo sapien
ccctggactgcctgccaagaaagag

SEQ ID NO: 312180 - DNA, 25 bp, Homo sapien
gaatcactagcacttcacaagtgct

SEQ ID NO: 312181 - DNA, 25 bp, Homo sapien
agcacttcacaagtgctgctgcaga

SEQ ID NO: 312182 - DNA, 25 bp, Homo sapien
gctataaaacacgtgaccctaggga

SEQ ID NO: 312183 - DNA, 25 bp, Homo sapien
agcggtatagagagtaccaccacca

SEQ ID NO: 312184 - DNA, 25 bp, Homo sapien
agacgccaccatgcctgcggaagga

SEQ ID NO: 312185 - DNA, 25 bp, Homo sapien
aacggacatggaaaggattggcctc

SEQ ID NO: 312186 - DNA, 25 bp, Homo sapien
gattggcctctttagtgagatggaa

SEQ ID NO: 312187 - DNA, 25 bp, Homo sapien
ttactgtgggtgataaatatgtgtc

SEQ ID NO: 312188 - DNA, 25 bp, Homo sapien
acaatttaatcatgtggcttaggaa

SEQ ID NO: 312189 - DNA, 25 bp, Homo sapien
ggcttaggaagctactatggaacaa

SEQ ID NO: 312190 - DNA, 25 bp, Homo sapien
ggcaacctgatctcggctgtcggag

SEQ ID NO: 312191 - DNA, 25 bp, Homo sapien
ctgtcggagtgggtgtcctcaagaa

SEQ ID NO: 312192 - DNA, 25 bp, Homo sapien
gaaaggactttgctataaaacacgt

SEQ ID NO: 312193 - DNA, 25 bp, Homo sapien
ccagtagagtgtagccggatttgga

SEQ ID NO: 312194 - DNA, 25 bp, Homo sapien
gccggatttggagggactggacact

SEQ ID NO: 312195 - DNA, 25 bp, Homo sapien
tggagggactggacactcagtgtga

SEQ ID NO: 312196 - DNA, 25 bp, Homo sapien
tgtgaacaagacgaaggcctcagga

SEQ ID NO: 312197 - DNA, 25 bp, Homo sapien
gaacaagacgaaggcctcaggaggc

SEQ ID NO: 312198 - DNA, 25 bp, Homo sapien
gcctcaggaggcagtaaaagctgac

SEQ ID NO: 312199 - DNA, 25 bp, Homo sapien
gagagaaaatgaagcgcctacgggt

SEQ ID NO: 312200 - DNA, 25 bp, Homo sapien
gactagcgggcgaaaggccatgact

SEQ ID NO: 312201 - DNA, 25 bp, Homo sapien
aggccatgactccttagtttggaga

SEQ ID NO: 312202 - DNA, 25 bp, Homo sapien
gccatgactccttagtttggagaaa

SEQ ID NO: 312203 - DNA, 25 bp, Homo sapien
gactccttagtttggagaaagaact

SEQ ID NO: 312204 - DNA, 25 bp, Homo sapien
gggtgtcactgttttcatcccctcc

SEQ ID NO: 312205 - DNA, 25 bp, Homo sapien
gggtgcagcctctgaaagagactgt

SEQ ID NO: 312206 - DNA, 25 bp, Homo sapien
gagactgtgaatctatatataccat

SEQ ID NO: 312207 - DNA, 25 bp, Homo sapien
taccatttctgggacgaattcatct

SEQ ID NO: 312208 - DNA, 25 bp, Homo sapien
atttctgggacgaattcatcttctg

SEQ ID NO: 312209 - DNA, 25 bp, Homo sapien
tgggacgaattcatcttctgaggcc

SEQ ID NO: 312210 - DNA, 25 bp, Homo sapien
tcttccatctgaattgcctcctaga

SEQ ID NO: 312211 - DNA, 25 bp, Homo sapien
tccatctgaattgcctcctagatat

SEQ ID NO: 312212 - DNA, 25 bp, Homo sapien
agggagaaattactcctcagattct

SEQ ID NO: 312213 - DNA, 25 bp, Homo sapien
gagaaattactcctcagattcttgc

SEQ ID NO: 312214 - DNA, 25 bp, Homo sapien
tactcttaagtgcatgtaatcaaac

SEQ ID NO: 312215 - DNA, 25 bp, Homo sapien
gagaggctgacttaataaagtttcc

SEQ ID NO: 312216 - DNA, 25 bp, Homo sapien
ggctgacttaataaagtttcctgaa

SEQ ID NO: 312217 - DNA, 25 bp, Homo sapien
gtcgctgccggagagtctctgcttc

SEQ ID NO: 312218 - DNA, 25 bp, Homo sapien
tctcctaaagcctgagggaccgttg

SEQ ID NO: 312219 - DNA, 25 bp, Homo sapien
tcctaaagcctgagggaccgttgca

SEQ ID NO: 312220 - DNA, 25 bp, Homo sapien
taaagcctgagggaccgttgcaggt

SEQ ID NO: 312221 - DNA, 25 bp, Homo sapien
gaccgttgcaggtggagcggcgctg

SEQ ID NO: 312222 - DNA, 25 bp, Homo sapien
ggtgggacccgggttgcggcggcag

SEQ ID NO: 312223 - DNA, 25 bp, Homo sapien
ggcggcagccgttgccccggcgagg

SEQ ID NO: 312224 - DNA, 25 bp, Homo sapien
cccggcgagggaagcctcaggtcct

SEQ ID NO: 312225 - DNA, 25 bp, Homo sapien
gctccgcggcggtagctcgggctct

SEQ ID NO: 312226 - DNA, 25 bp, Homo sapien
gggagctgtttgtacaattttagtt

SEQ ID NO: 312227 - DNA, 25 bp, Homo sapien
gacttctttatatcacaaggccttt

SEQ ID NO: 312228 - DNA, 25 bp, Homo sapien
atcacaaggcctttgcaattttgtt

SEQ ID NO: 312229 - DNA, 25 bp, Homo sapien
gctatttaagctgactctgttacca

SEQ ID NO: 312230 - DNA, 25 bp, Homo sapien
tgttaccattcttgacaggctctga

SEQ ID NO: 312231 - DNA, 25 bp, Homo sapien
ttcttgacaggctctgaactctaat

SEQ ID NO: 312232 - DNA, 25 bp, Homo sapien
gaactctaataagcctctatagtgt

SEQ ID NO: 312233 - DNA, 25 bp, Homo sapien
tttacattcctatacatcctgcaaa

SEQ ID NO: 312234 - DNA, 25 bp, Homo sapien
agtttgtgtgttttctggcccaatc

SEQ ID NO: 312235 - DNA, 25 bp, Homo sapien
ttctggcccaatcaaccttgagtga

SEQ ID NO: 312236 - DNA, 25 bp, Homo sapien
caaccttgagtgagtggaattaact

SEQ ID NO: 312237 - DNA, 25 bp, Homo sapien
aattgcataattgttctgagggtta

SEQ ID NO: 312238 - DNA, 25 bp, Homo sapien
gaatatgtgtttgtacattcctgtt

SEQ ID NO: 312239 - DNA, 25 bp, Homo sapien
aaagggctcaggtttcacatggtcc

SEQ ID NO: 312240 - DNA, 25 bp, Homo sapien
agggctcaggtttcacatggtccag

SEQ ID NO: 312241 - DNA, 25 bp, Homo sapien
ttcacatggtccaggtgaggtaaaa

SEQ ID NO: 312242 - DNA, 25 bp, Homo sapien
aatggtctcaggtttaatttgtaat

SEQ ID NO: 312243 - DNA, 25 bp, Homo sapien
gtaatacgacaaacactggaagata

SEQ ID NO: 312244 - DNA, 25 bp, Homo sapien
gatataacccacaggaaattcttgg

SEQ ID NO: 312245 - DNA, 25 bp, Homo sapien
ggaaattcttggaaacatcaatact

SEQ ID NO: 312246 - DNA, 25 bp, Homo sapien
gatagtcactagagtaatgtattct

SEQ ID NO: 312247 - DNA, 25 bp, Homo sapien
gagtaatgtattcttaacctttgta

SEQ ID NO: 312248 - DNA, 25 bp, Homo sapien
gctgctcacacttcagtgatccctg

SEQ ID NO: 312249 - DNA, 25 bp, Homo sapien
agtgatccctgcagatgggaagtat

SEQ ID NO: 312250 - DNA, 25 bp, Homo sapien
gttattgtagaaacctccagaatct

SEQ ID NO: 312251 - DNA, 25 bp, Homo sapien
cagaatctttctttgttacagcttt

SEQ ID NO: 312252 - DNA, 25 bp, Homo sapien
gaattgttcctaagaggcgactcag

SEQ ID NO: 312253 - DNA, 25 bp, Homo sapien
tacagattgaatgccaagttgtgga

SEQ ID NO: 312254 - DNA, 25 bp, Homo sapien
gaagtcacttttcagcttgtgtcta

SEQ ID NO: 312255 - DNA, 25 bp, Homo sapien
agcttgtgtctaacaacccagcatt

SEQ ID NO: 312256 - DNA, 25 bp, Homo sapien
aacccagcattctcagcaaagcagt

SEQ ID NO: 312257 - DNA, 25 bp, Homo sapien
tttggtaatagtcccgggcaagcac

SEQ ID NO: 312258 - DNA, 25 bp, Homo sapien
gtattgctgtctataccaaggcaca

SEQ ID NO: 312259 - DNA, 25 bp, Homo sapien
tccattaagtaggagttgtccagta

SEQ ID NO: 312260 - DNA, 25 bp, Homo sapien
taggagttgtccagtatgttgtaaa

SEQ ID NO: 312261 - DNA, 25 bp, Homo sapien
gtaaatcatttgctacaaaagcgaa

SEQ ID NO: 312262 - DNA, 25 bp, Homo sapien
catagaggactaaggagggattcaa

SEQ ID NO: 312263 - DNA, 25 bp, Homo sapien
gagggattcaattactcctgatata

SEQ ID NO: 312264 - DNA, 25 bp, Homo sapien
tcctgatatagcaacaaagcctggg

SEQ ID NO: 312265 - DNA, 25 bp, Homo sapien
aaagcctgggcaacctttgttcctg

SEQ ID NO: 312266 - DNA, 25 bp, Homo sapien
gggcaacctttgttcctggattcta

SEQ ID NO: 312267 - DNA, 25 bp, Homo sapien
gttcctggattctatttctcctaaa

SEQ ID NO: 312268 - DNA, 25 bp, Homo sapien
aacaaaagtcttcttcaaaggctga

SEQ ID NO: 312269 - DNA, 25 bp, Homo sapien
aaagtcttcttcaaaggctgaatac

SEQ ID NO: 312270 - DNA, 25 bp, Homo sapien
tcttttgtgtcccaactatgttgct

SEQ ID NO: 312271 - DNA, 25 bp, Homo sapien
gtgagcctgaatgctgagatcctga

SEQ ID NO: 312272 - DNA, 25 bp, Homo sapien
tgagatcctgagaccgtgctgcggc

SEQ ID NO: 312273 - DNA, 25 bp, Homo sapien
gcggcgcctgggaattcatagagca

SEQ ID NO: 312274 - DNA, 25 bp, Homo sapien
ctcgcatcgtgtgccatgcaagtaa

SEQ ID NO: 312275 - DNA, 25 bp, Homo sapien
atgcaagtaaacctaccctatcctg

SEQ ID NO: 312276 - DNA, 25 bp, Homo sapien
aactatgttgctctgacggttccac

SEQ ID NO: 312277 - DNA, 25 bp, Homo sapien
gttccacttgcactactggttttta

SEQ ID NO: 312278 - DNA, 25 bp, Homo sapien
ttacttcatcgttaatctctgctct

SEQ ID NO: 312279 - DNA, 25 bp, Homo sapien
ttaatctctgctctggccgataaca

SEQ ID NO: 312280 - DNA, 25 bp, Homo sapien
tctggccgataacagcctgcatgaa

SEQ ID NO: 312281 - DNA, 25 bp, Homo sapien
gaggccattagcttgaggctgtctc

SEQ ID NO: 312282 - DNA, 25 bp, Homo sapien
aggctgtctctgtacgttgagttcc

SEQ ID NO: 312283 - DNA, 25 bp, Homo sapien
cgttgagttcccacctaacaatgga

SEQ ID NO: 312284 - DNA, 25 bp, Homo sapien
ggaaacctacattaggctgtaatga

SEQ ID NO: 312285 - DNA, 25 bp, Homo sapien
gggctactggccaatcatgggcaac

SEQ ID NO: 312286 - DNA, 25 bp, Homo sapien
gggcaaccaactcattataccaggc

SEQ ID NO: 312287 - DNA, 25 bp, Homo sapien
aactcattataccaggccccacaag

SEQ ID NO: 312288 - DNA, 25 bp, Homo sapien
aaggcagcctgcatagctatagcca

SEQ ID NO: 312289 - DNA, 25 bp, Homo sapien
agctatagccaatcagtttctccac

SEQ ID NO: 312290 - DNA, 25 bp, Homo sapien
aggtggcatacgcacagggcctaaa

SEQ ID NO: 312291 - DNA, 25 bp, Homo sapien
aaaagtttgcatactgctcttaaat

SEQ ID NO: 312292 - DNA, 25 bp, Homo sapien
aggcaggcccatttgtctgcttaga

SEQ ID NO: 312293 - DNA, 25 bp, Homo sapien
ttttaccatcttgggaacatattca

SEQ ID NO: 312294 - DNA, 25 bp, Homo sapien
acagaatgggtccaggaccatgtca

SEQ ID NO: 312295 - DNA, 25 bp, Homo sapien
gaccatgtcaagaccacctgctgat

SEQ ID NO: 312296 - DNA, 25 bp, Homo sapien
ccacctgctgatgctagtgttagat

SEQ ID NO: 312297 - DNA, 25 bp, Homo sapien
gctagtgttagatgactccaggaat

SEQ ID NO: 312298 - DNA, 25 bp, Homo sapien
ttagatgactccaggaatgtgaggt

SEQ ID NO: 312299 - DNA, 25 bp, Homo sapien
tggtttcagaatgtaatccgtgttg

SEQ ID NO: 312300 - DNA, 25 bp, Homo sapien
tccgtgttgacgtgtactgtttgca

SEQ ID NO: 312301 - DNA, 25 bp, Homo sapien
gacgtgtactgtttgcatactctca

SEQ ID NO: 312302 - DNA, 25 bp, Homo sapien
ctgtttgcatactctcagactgttt

SEQ ID NO: 312303 - DNA, 25 bp, Homo sapien
agggagccggctcagtctcttcttg

SEQ ID NO: 312304 - DNA, 25 bp, Homo sapien
attgctccccgcgcggcattggagg

SEQ ID NO: 312305 - DNA, 25 bp, Homo sapien
ggcattggaggtggccgccggagag

SEQ ID NO: 312306 - DNA, 25 bp, Homo sapien
gaaggccaacgcctgcgccaggctt

SEQ ID NO: 312307 - DNA, 25 bp, Homo sapien
tgcgccaggcttgtcaggcggaaac

SEQ ID NO: 312308 - DNA, 25 bp, Homo sapien
gcttgtcaggcggaaacggctaaca

SEQ ID NO: 312309 - DNA, 25 bp, Homo sapien
ggcggaaacggctaacaaggagatt

SEQ ID NO: 312310 - DNA, 25 bp, Homo sapien
gctaacaaggagatttggtcagcaa

SEQ ID NO: 312311 - DNA, 25 bp, Homo sapien
gccccaccgcggctaatgcaagagg

SEQ ID NO: 312312 - DNA, 25 bp, Homo sapien
accgcggctaatgcaagaggccaaa

SEQ ID NO: 312313 - DNA, 25 bp, Homo sapien
gtggcggcggcctgacggtgcgtgt

SEQ ID NO: 312314 - DNA, 25 bp, Homo sapien
agcaaggcatcgcttagaacgacat

SEQ ID NO: 312315 - DNA, 25 bp, Homo sapien
tagaacgacattccctccggaacat

SEQ ID NO: 312316 - DNA, 25 bp, Homo sapien
ggaacatcatacagccaccagagac

SEQ ID NO: 312317 - DNA, 25 bp, Homo sapien
caccagagacaacggcagacggcca

SEQ ID NO: 312318 - DNA, 25 bp, Homo sapien
acaggctgtgcatgtgttaacttgc

SEQ ID NO: 312319 - DNA, 25 bp, Homo sapien
gccggcgtcccactttacagacaag

SEQ ID NO: 312320 - DNA, 25 bp, Homo sapien
agacatcacttgtctgtcatgccct

SEQ ID NO: 312321 - DNA, 25 bp, Homo sapien
gtcatgccctgcttgtcaatggcaa

SEQ ID NO: 312322 - DNA, 25 bp, Homo sapien
gcaaggcagggactcaaacccggta

SEQ ID NO: 312323 - DNA, 25 bp, Homo sapien
aaacccggtacgctggctctgacat

SEQ ID NO: 312324 - DNA, 25 bp, Homo sapien
tgagtatcactcgacacctgcaagg

SEQ ID NO: 312325 - DNA, 25 bp, Homo sapien
ttttctggagagacattttcccttc

SEQ ID NO: 312326 - DNA, 25 bp, Homo sapien
tctggagagacattttcccttcttt

SEQ ID NO: 312327 - DNA, 25 bp, Homo sapien
attttcccttcttttcactgtgtgt

SEQ ID NO: 312328 - DNA, 25 bp, Homo sapien
ttttcccttcttttcactgtgtgtt

SEQ ID NO: 312329 - DNA, 25 bp, Homo sapien
tcaaaatatgtgttcctttggtcac

SEQ ID NO: 312330 - DNA, 25 bp, Homo sapien
aatatgtgttcctttggtcacacta

SEQ ID NO: 312331 - DNA, 25 bp, Homo sapien
atgtgttcctttggtcacactatac

SEQ ID NO: 312332 - DNA, 25 bp, Homo sapien
gttcctttggtcacactatacattt

SEQ ID NO: 312333 - DNA, 25 bp, Homo sapien
tcctttggtcacactatacattttt

SEQ ID NO: 312334 - DNA, 25 bp, Homo sapien
ttacattttacattgcagcgatctc

SEQ ID NO: 312335 - DNA, 25 bp, Homo sapien
acattttacattgcagcgatctcag

SEQ ID NO: 312336 - DNA, 25 bp, Homo sapien
gataacttttccctgctccctctct

SEQ ID NO: 312337 - DNA, 25 bp, Homo sapien
cacagtgcagcccattgcacacaaa

SEQ ID NO: 312338 - DNA, 25 bp, Homo sapien
acagtgcagcccattgcacacaaac

SEQ ID NO: 312339 - DNA, 25 bp, Homo sapien
cagtgcagcccattgcacacaaact

SEQ ID NO: 312340 - DNA, 25 bp, Homo sapien
agtgcagcccattgcacacaaacta

SEQ ID NO: 312341 - DNA, 25 bp, Homo sapien
tgcagcccattgcacacaaactaca

SEQ ID NO: 312342 - DNA, 25 bp, Homo sapien
gcagcccattgcacacaaactacaa

SEQ ID NO: 312343 - DNA, 25 bp, Homo sapien
cagcccattgcacacaaactacaaa

SEQ ID NO: 312344 - DNA, 25 bp, Homo sapien
agcccattgcacacaaactacaaac

SEQ ID NO: 312345 - DNA, 25 bp, Homo sapien
gcccattgcacacaaactacaaact

SEQ ID NO: 312346 - DNA, 25 bp, Homo sapien
tacccagggaagtgagaaataaaga

SEQ ID NO: 312347 - DNA, 25 bp, Homo sapien
gtgctagtttaacaggaaatctcca

SEQ ID NO: 312348 - DNA, 25 bp, Homo sapien
ggaaatctccaatgcattattatct

SEQ ID NO: 312349 - DNA, 25 bp, Homo sapien
tagactcatctcaaaggctcacttt

SEQ ID NO: 312350 - DNA, 25 bp, Homo sapien
aaggctcacttttcatttgcatggg

SEQ ID NO: 312351 - DNA, 25 bp, Homo sapien
tgcatgggcccttgctatttgtagg

SEQ ID NO: 312352 - DNA, 25 bp, Homo sapien
gaggagacactccttgttaacagga

SEQ ID NO: 312353 - DNA, 25 bp, Homo sapien
taacaggatggttagcccacggctc

SEQ ID NO: 312354 - DNA, 25 bp, Homo sapien
ttccacacccagtaaattgttttag

SEQ ID NO: 312355 - DNA, 25 bp, Homo sapien
attgttttagtttatggccctcagc

SEQ ID NO: 312356 - DNA, 25 bp, Homo sapien
tatggccctcagctgcagttgcaat

SEQ ID NO: 312357 - DNA, 25 bp, Homo sapien
gttgcaatcatcatcaaattccagt

SEQ ID NO: 312358 - DNA, 25 bp, Homo sapien
aatgggcgaaaccatcttgatccga

SEQ ID NO: 312359 - DNA, 25 bp, Homo sapien
gaaaccatcttgatccgatgcgaat

SEQ ID NO: 312360 - DNA, 25 bp, Homo sapien
cgatgcgaatgcagtaatgttctat

SEQ ID NO: 312361 - DNA, 25 bp, Homo sapien
tgttctatataccatttcatcagtt

SEQ ID NO: 312362 - DNA, 25 bp, Homo sapien
ttaaactcgtcacccacaacaaact

SEQ ID NO: 312363 - DNA, 25 bp, Homo sapien
actacagtgaaagcccttttcagtg

SEQ ID NO: 312364 - DNA, 25 bp, Homo sapien
cagtgaaagatgtcagaaacctcaa

SEQ ID NO: 312365 - DNA, 25 bp, Homo sapien
ctcaaaacctttggcctgactcaga

SEQ ID NO: 312366 - DNA, 25 bp, Homo sapien
ggcctgactcagaactaccatgtga

SEQ ID NO: 312367 - DNA, 25 bp, Homo sapien
taccatgtgaaaatcagtactctct

SEQ ID NO: 312368 - DNA, 25 bp, Homo sapien
atcagtactctcttaatgtttgaaa

SEQ ID NO: 312369 - DNA, 25 bp, Homo sapien
tatcttgcccagaaagtacacttgt

SEQ ID NO: 312370 - DNA, 25 bp, Homo sapien
gaatgattctgtgtcccattttaaa

SEQ ID NO: 312371 - DNA, 25 bp, Homo sapien
gtcccattttaaaggtccaggctat

SEQ ID NO: 312372 - DNA, 25 bp, Homo sapien
ccaggctatcccctagatttagatt

SEQ ID NO: 312373 - DNA, 25 bp, Homo sapien
agttcctaaaaaatcttccagtctg

SEQ ID NO: 312374 - DNA, 25 bp, Homo sapien
aatcttccagtctgaatcctgacaa

SEQ ID NO: 312375 - DNA, 25 bp, Homo sapien
gctaaattaatttccactcctcttc

SEQ ID NO: 312376 - DNA, 25 bp, Homo sapien
gcactgtttggtacattacagccac

SEQ ID NO: 312377 - DNA, 25 bp, Homo sapien
tacagccaccattagccttaaaagc

SEQ ID NO: 312378 - DNA, 25 bp, Homo sapien
agctgcagcagccaaattcggtgac

SEQ ID NO: 312379 - DNA, 25 bp, Homo sapien
gccaaattcggtgacagtaacataa

SEQ ID NO: 312380 - DNA, 25 bp, Homo sapien
taaagataacttttccctgctccct

SEQ ID NO: 312381 - DNA, 25 bp, Homo sapien
catcactgcctgcagggcatgcaca

SEQ ID NO: 312382 - DNA, 25 bp, Homo sapien
gacaacataaacaagacccagggac

SEQ ID NO: 312383 - DNA, 25 bp, Homo sapien
ggcatgcacagtgcagcccattgca

SEQ ID NO: 312384 - DNA, 25 bp, Homo sapien
cacagtgcagcccattgcacacaaa

SEQ ID NO: 312385 - DNA, 25 bp, Homo sapien
agtgcagcccattgcacacaaacta

SEQ ID NO: 312386 - DNA, 25 bp, Homo sapien
gcagcccattgcacacaaactacaa

SEQ ID NO: 312387 - DNA, 25 bp, Homo sapien
gcccattgcacacaaactacaaact

SEQ ID NO: 312388 - DNA, 25 bp, Homo sapien
acaatttgtgtttgggacgtctgat

SEQ ID NO: 312389 - DNA, 25 bp, Homo sapien
acagggtatggtgctgtgccccaga

SEQ ID NO: 312390 - DNA, 25 bp, Homo sapien
tacccagggaagtgagaaataaaga

SEQ ID NO: 312391 - DNA, 25 bp, Homo sapien
tcaatgggagcaatagcactaactt

SEQ ID NO: 312392 - DNA, 25 bp, Homo sapien
atagcactaacttaactcaggccaa

SEQ ID NO: 312393 - DNA, 25 bp, Homo sapien
cttaactcaggccaagacttgggct

SEQ ID NO: 312394 - DNA, 25 bp, Homo sapien
taccacacctttgcttgggagtgca

SEQ ID NO: 312395 - DNA, 25 bp, Homo sapien
tgggagtgcacttacacagctttct

SEQ ID NO: 312396 - DNA, 25 bp, Homo sapien
gtgcacttacacagctttctttgta

SEQ ID NO: 312397 - DNA, 25 bp, Homo sapien
gctgccttttggtagttaggctcca

SEQ ID NO: 312398 - DNA, 25 bp, Homo sapien
gcaactgactgcagggaggcacaga

SEQ ID NO: 312399 - DNA, 25 bp, Homo sapien
ttgcctgattagcatatggtactca

SEQ ID NO: 312400 - DNA, 25 bp, Homo sapien
gcatatggtactcagggcttaaaac

SEQ ID NO: 312401 - DNA, 25 bp, Homo sapien
aaccaagtatgcaaacctcacattt

SEQ ID NO: 312402 - DNA, 25 bp, Homo sapien
tatttctggcccttacacagtagta

SEQ ID NO: 312403 - DNA, 25 bp, Homo sapien
tggcccttacacagtagtatttctg

SEQ ID NO: 312404 - DNA, 25 bp, Homo sapien
aaggtctctgattcctgcttgctct

SEQ ID NO: 312405 - DNA, 25 bp, Homo sapien
tctgattcctgcttgctctagtaca

SEQ ID NO: 312406 - DNA, 25 bp, Homo sapien
gattcctgcttgctctagtacaggc

SEQ ID NO: 312407 - DNA, 25 bp, Homo sapien
tgcttgctctagtacaggcgtgctc

SEQ ID NO: 312408 - DNA, 25 bp, Homo sapien
ttgctctagtacaggcgtgctctca

SEQ ID NO: 312409 - DNA, 25 bp, Homo sapien
tagtacaggcgtgctctcactttaa

SEQ ID NO: 312410 - DNA, 25 bp, Homo sapien
acaggcgtgctctcactttaagaaa

SEQ ID NO: 312411 - DNA, 25 bp, Homo sapien
gcgtgctctcactttaagaaagcct

SEQ ID NO: 312412 - DNA, 25 bp, Homo sapien
aagaaagcctgatgccgctgggcga

SEQ ID NO: 312413 - DNA, 25 bp, Homo sapien
tacttaggcagaaggcgccaccagc

SEQ ID NO: 312414 - DNA, 25 bp, Homo sapien
gtgaagtgacacctcaaggatcctg

SEQ ID NO: 312415 - DNA, 25 bp, Homo sapien
acacctcaaggatcctgtgacacag

SEQ ID NO: 312416 - DNA, 25 bp, Homo sapien
gaaacagcagtcgaatctcactggg

SEQ ID NO: 312417 - DNA, 25 bp, Homo sapien
gtcgaatctcactgggaacataagg

SEQ ID NO: 312418 - DNA, 25 bp, Homo sapien
gaatgcttcagtgagtgactcctgc

SEQ ID NO: 312419 - DNA, 25 bp, Homo sapien
cagtgagtgactcctgccagagtta

SEQ ID NO: 312420 - DNA, 25 bp, Homo sapien
tcctgccagagttagatttcgagaa

SEQ ID NO: 312421 - DNA, 25 bp, Homo sapien
tgggatctgggctggtaacaagacc

SEQ ID NO: 312422 - DNA, 25 bp, Homo sapien
tggtaacaagacctgagcacagcct

SEQ ID NO: 312423 - DNA, 25 bp, Homo sapien
agcccagtgggcatgagcaatactt

SEQ ID NO: 312424 - DNA, 25 bp, Homo sapien
gaaaaattaactgtagcgcttcatt

SEQ ID NO: 312425 - DNA, 25 bp, Homo sapien
gtagcgcttcattatactattatat

SEQ ID NO: 312426 - DNA, 25 bp, Homo sapien
actgtgaagttttatctcttgcata

SEQ ID NO: 312427 - DNA, 25 bp, Homo sapien
atctcttgcatatactttatacgga

SEQ ID NO: 312428 - DNA, 25 bp, Homo sapien
tactttatacggaagtattacgcct

SEQ ID NO: 312429 - DNA, 25 bp, Homo sapien
tttacaaggtttctgttttgtgtgg

SEQ ID NO: 312430 - DNA, 25 bp, Homo sapien
gaagagtaattgatgttgctaagaa

SEQ ID NO: 312431 - DNA, 25 bp, Homo sapien
taaatgttaccagcactttttttgt

SEQ ID NO: 312432 - DNA, 25 bp, Homo sapien
gtaagtttcactttccgaggtattg

SEQ ID NO: 312433 - DNA, 25 bp, Homo sapien
gtttcactttccgaggtattgtaca

SEQ ID NO: 312434 - DNA, 25 bp, Homo sapien
ggtattgtacaagttcacactgttt

SEQ ID NO: 312435 - DNA, 25 bp, Homo sapien
atgaattgtccattgctgagtatga

SEQ ID NO: 312436 - DNA, 25 bp, Homo sapien
aagagatgtccagtccaggcaaagc

SEQ ID NO: 312437 - DNA, 25 bp, Homo sapien
caggcaaagccttcactgaagttcc

SEQ ID NO: 312438 - DNA, 25 bp, Homo sapien
tgaagttccatcatcgccacttctc

SEQ ID NO: 312439 - DNA, 25 bp, Homo sapien
tctccctttttagggtcattcaaag

SEQ ID NO: 312440 - DNA, 25 bp, Homo sapien
gcattttgcagatcagtgctactca

SEQ ID NO: 312441 - DNA, 25 bp, Homo sapien
agtgctactcattcaaagggctttg

SEQ ID NO: 312442 - DNA, 25 bp, Homo sapien
ggctttgcaactcaaacagattgtt

SEQ ID NO: 312443 - DNA, 25 bp, Homo sapien
acagattgttagtgtgctagtgata

SEQ ID NO: 312444 - DNA, 25 bp, Homo sapien
gaaatgggtatactacagctttaac

SEQ ID NO: 312445 - DNA, 25 bp, Homo sapien
acagctttaactagccttagtgaga

SEQ ID NO: 312446 - DNA, 25 bp, Homo sapien
atgcctgtaactgaatgtgctcaga

SEQ ID NO: 312447 - DNA, 25 bp, Homo sapien
ttgaaggtgtgggactgtcctggct

SEQ ID NO: 312448 - DNA, 25 bp, Homo sapien
tgtcctggctggagaccactgggtc

SEQ ID NO: 312449 - DNA, 25 bp, Homo sapien
agaccactgggtcaggagaactcca

SEQ ID NO: 312450 - DNA, 25 bp, Homo sapien
aactccagtagagggtttgggtgct

SEQ ID NO: 312451 - DNA, 25 bp, Homo sapien
ggttttcttaccttgactatgcaga

SEQ ID NO: 312452 - DNA, 25 bp, Homo sapien
ggcagagccaactccagaggcggat

SEQ ID NO: 312453 - DNA, 25 bp, Homo sapien
agccaactccagaggcggatctcct

SEQ ID NO: 312454 - DNA, 25 bp, Homo sapien
cttgactatgcagagggtggtccat

SEQ ID NO: 312455 - DNA, 25 bp, Homo sapien
ggcactgaagatggaaccccctctt

SEQ ID NO: 312456 - DNA, 25 bp, Homo sapien
tgaccccatgcctgtaactgaatgt

SEQ ID NO: 312457 - DNA, 25 bp, Homo sapien
gaactgtacttcttgttgaaaataa

SEQ ID NO: 312458 - DNA, 25 bp, Homo sapien
ttttttgcatcatctaatggacatg

SEQ ID NO: 312459 - DNA, 25 bp, Homo sapien
gaagtgtcgtggaccctattggaaa

SEQ ID NO: 312460 - DNA, 25 bp, Homo sapien
accctattggaaacagcatgattgg

SEQ ID NO: 312461 - DNA, 25 bp, Homo sapien
ggaatttgcataggatgagttcagt

SEQ ID NO: 312462 - DNA, 25 bp, Homo sapien
aattttggcattgtgagattttatt

SEQ ID NO: 312463 - DNA, 25 bp, Homo sapien
ttactgtgtgaacctaaagttactg

SEQ ID NO: 312464 - DNA, 25 bp, Homo sapien
gttactgtttaagtacatgccacgc

SEQ ID NO: 312465 - DNA, 25 bp, Homo sapien
taagtacatgccacgcaactctgtg

SEQ ID NO: 312466 - DNA, 25 bp, Homo sapien
tacatgccacgcaactctgtgttat

SEQ ID NO: 312467 - DNA, 25 bp, Homo sapien
gtgttattaagaagcactgtctcag

SEQ ID NO: 312468 - DNA, 25 bp, Homo sapien
atatatgctacacatctaagtgctt

SEQ ID NO: 312469 - DNA, 25 bp, Homo sapien
atgctacacatctaagtgctttgta

SEQ ID NO: 312470 - DNA, 25 bp, Homo sapien
gctacacatctaagtgctttgtaag

SEQ ID NO: 312471 - DNA, 25 bp, Homo sapien
acacatctaagtgctttgtaagact

SEQ ID NO: 312472 - DNA, 25 bp, Homo sapien
gtgctttgtaagactttatcaccag

SEQ ID NO: 312473 - DNA, 25 bp, Homo sapien
gctttgtaagactttatcaccaggc

SEQ ID NO: 312474 - DNA, 25 bp, Homo sapien
gtaagactttatcaccaggcgcggt

SEQ ID NO: 312475 - DNA, 25 bp, Homo sapien
aagactttatcaccaggcgcggtgg

SEQ ID NO: 312476 - DNA, 25 bp, Homo sapien
agactttatcaccaggcgcggtggc

SEQ ID NO: 312477 - DNA, 25 bp, Homo sapien
ccacggcaggtggattaccataggt

SEQ ID NO: 312478 - DNA, 25 bp, Homo sapien
acggcaggtggattaccataggtcg

SEQ ID NO: 312479 - DNA, 25 bp, Homo sapien
tacttccctgacatcccttaagact

SEQ ID NO: 312480 - DNA, 25 bp, Homo sapien
tgacatcccttaagactcaagtctt

SEQ ID NO: 312481 - DNA, 25 bp, Homo sapien
agtcttgatactttgtctgctctct

SEQ ID NO: 312482 - DNA, 25 bp, Homo sapien
ggctctttctttgtcattactatta

SEQ ID NO: 312483 - DNA, 25 bp, Homo sapien
cttgatgttgactcttgctaaaatt

SEQ ID NO: 312484 - DNA, 25 bp, Homo sapien
tcttccttattgttaatgcttatag

SEQ ID NO: 312485 - DNA, 25 bp, Homo sapien
tccttgttatcttttagcccatgtc

SEQ ID NO: 312486 - DNA, 25 bp, Homo sapien
tagcccatgtcatccgaatcatttg

SEQ ID NO: 312487 - DNA, 25 bp, Homo sapien
tcatttgctgtttctagcctaggtg

SEQ ID NO: 312488 - DNA, 25 bp, Homo sapien
agcctaggtgctttgactatgccag

SEQ ID NO: 312489 - DNA, 25 bp, Homo sapien
tatgccagcttgtatttcttcagaa

SEQ ID NO: 312490 - DNA, 25 bp, Homo sapien
attcctttttactgctgactaatag

SEQ ID NO: 312491 - DNA, 25 bp, Homo sapien
tttactgctgactaatagtctgctg

SEQ ID NO: 312492 - DNA, 25 bp, Homo sapien
atagtctgctgtgtgaatccaccgc

SEQ ID NO: 312493 - DNA, 25 bp, Homo sapien
tgtgtgaatccaccgctagaaaccc

SEQ ID NO: 312494 - DNA, 25 bp, Homo sapien
cgctagaaacccactcatcagttga

SEQ ID NO: 312495 - DNA, 25 bp, Homo sapien
ttgatggtcatgtgggttgcttctc

SEQ ID NO: 312496 - DNA, 25 bp, Homo sapien
gtcatgtgggttgcttctcgtattc

SEQ ID NO: 312497 - DNA, 25 bp, Homo sapien
gttgcttctcgtattcgcttattat

SEQ ID NO: 312498 - DNA, 25 bp, Homo sapien
ctcgtattcgcttattatgaacagt

SEQ ID NO: 312499 - DNA, 25 bp, Homo sapien
gaacagtgctggaataaacgttcct

SEQ ID NO: 312500 - DNA, 25 bp, Homo sapien
gaataaacgttcctgtgcactcttg

SEQ ID NO: 312501 - DNA, 25 bp, Homo sapien
cccatgccagagtgtagggcgtgtt

SEQ ID NO: 312502 - DNA, 25 bp, Homo sapien
tagggcgtgttcaggcgagggtctt

SEQ ID NO: 312503 - DNA, 25 bp, Homo sapien
caggcgagggtcttggcgtgcagta

SEQ ID NO: 312504 - DNA, 25 bp, Homo sapien
ggcgtgcagtagtccagggtgcggt

SEQ ID NO: 312505 - DNA, 25 bp, Homo sapien
gggtagtccagacctccatggcggg

SEQ ID NO: 312506 - DNA, 25 bp, Homo sapien
gggtccttccgtgctgtagtccggg

SEQ ID NO: 312507 - DNA, 25 bp, Homo sapien
ggcacggcaaggtgtgggtcctctg

SEQ ID NO: 312508 - DNA, 25 bp, Homo sapien
gggtcctctggtgccctaggtcggg

SEQ ID NO: 312509 - DNA, 25 bp, Homo sapien
gggcggcgagtcagaggttctcccg

SEQ ID NO: 312510 - DNA, 25 bp, Homo sapien
ttctcccgtgccttggtctagggcg

SEQ ID NO: 312511 - DNA, 25 bp, Homo sapien
cgtgccttggtctagggcgtggaag

SEQ ID NO: 312512 - DNA, 25 bp, Homo sapien
tctctttggttgaagtcagccacta

SEQ ID NO: 312513 - DNA, 25 bp, Homo sapien
gaagtcagccactaagttcatcttt

SEQ ID NO: 312514 - DNA, 25 bp, Homo sapien
gttcatctttaaacatgctatctca

SEQ ID NO: 312515 - DNA, 25 bp, Homo sapien
attccccgaagccacccaaaatgtg

SEQ ID NO: 312516 - DNA, 25 bp, Homo sapien
tttgccctctcagaacttctaggga

SEQ ID NO: 312517 - DNA, 25 bp, Homo sapien
ttggtgtttccttccctaacgagct

SEQ ID NO: 312518 - DNA, 25 bp, Homo sapien
aacgagctcagccacttgtaaccag

SEQ ID NO: 312519 - DNA, 25 bp, Homo sapien
agccacttgtaaccagcttattgaa

SEQ ID NO: 312520 - DNA, 25 bp, Homo sapien
gaaagactagttgcagttaccattc

SEQ ID NO: 312521 - DNA, 25 bp, Homo sapien
gttaccattctctggtgagctctga

SEQ ID NO: 312522 - DNA, 25 bp, Homo sapien
gtgagctctgactggctttttacaa

SEQ ID NO: 312523 - DNA, 25 bp, Homo sapien
tttattgagagcattttctttggag

SEQ ID NO: 312524 - DNA, 25 bp, Homo sapien
ttggaggattataccttgctcatct

SEQ ID NO: 312525 - DNA, 25 bp, Homo sapien
aggattataccttgctcatcttggc

SEQ ID NO: 312526 - DNA, 25 bp, Homo sapien
ttataccttgctcatcttggcacaa

SEQ ID NO: 312527 - DNA, 25 bp, Homo sapien
catcttggcacaaaagaaggcgaaa

SEQ ID NO: 312528 - DNA, 25 bp, Homo sapien
aggcgaaaggaagtaacatgggatt

SEQ ID NO: 312529 - DNA, 25 bp, Homo sapien
aaatcaccatgttgatgtcttcttg

SEQ ID NO: 312530 - DNA, 25 bp, Homo sapien
gttgatgtcttcttgagtaggccaa

SEQ ID NO: 312531 - DNA, 25 bp, Homo sapien
tcttcttgagtaggccaagttgcgt

SEQ ID NO: 312532 - DNA, 25 bp, Homo sapien
gtaggccaagttgcgtataaagaga

SEQ ID NO: 312533 - DNA, 25 bp, Homo sapien
gacaacaggagattttaaggtatga

SEQ ID NO: 312534 - DNA, 25 bp, Homo sapien
gtgattgtattatagtttctgaagc

SEQ ID NO: 312535 - DNA, 25 bp, Homo sapien
gtttctgaagcttatgactggctat

SEQ ID NO: 312536 - DNA, 25 bp, Homo sapien
gaagcttatgactggctataaatat

SEQ ID NO: 312537 - DNA, 25 bp, Homo sapien
acatacccatgagaaaccagaccaa

SEQ ID NO: 312538 - DNA, 25 bp, Homo sapien
gaatatatatcatcactgtgacctt

SEQ ID NO: 312539 - DNA, 25 bp, Homo sapien
actgtgaccttgaacttatagtcat

SEQ ID NO: 312540 - DNA, 25 bp, Homo sapien
gaccttgaacttatagtcatttggg

SEQ ID NO: 312541 - DNA, 25 bp, Homo sapien
gaacttatagtcatttgggataaaa

SEQ ID NO: 312542 - DNA, 25 bp, Homo sapien
ttttattatgggtggtcctctcaaa

SEQ ID NO: 312543 - DNA, 25 bp, Homo sapien
tatgggtggtcctctcaaattggcc

SEQ ID NO: 312544 - DNA, 25 bp, Homo sapien
gtggtcctctcaaattggccccaaa

SEQ ID NO: 312545 - DNA, 25 bp, Homo sapien
aaagacctggctttgcagtgaggca

SEQ ID NO: 312546 - DNA, 25 bp, Homo sapien
tggctttgcagtgaggcagtcccaa

SEQ ID NO: 312547 - DNA, 25 bp, Homo sapien
ggcagtcccaagttcaaatctgagc

SEQ ID NO: 312548 - DNA, 25 bp, Homo sapien
ttcaaatctgagctcaccactgacc

SEQ ID NO: 312549 - DNA, 25 bp, Homo sapien
accactgacccgtcgtgtgatgggc

SEQ ID NO: 312550 - DNA, 25 bp, Homo sapien
attcggccggccatagtagctgctc

SEQ ID NO: 312551 - DNA, 25 bp, Homo sapien
agaaactgtttctcatcctcatcct

SEQ ID NO: 312552 - DNA, 25 bp, Homo sapien
tcatcctcatgcctgcaaactgtaa

SEQ ID NO: 312553 - DNA, 25 bp, Homo sapien
atgcctgcaaactgtaaaccgtcct

SEQ ID NO: 312554 - DNA, 25 bp, Homo sapien
ctgtaaaccgtcctacttaacaatg

SEQ ID NO: 312555 - DNA, 25 bp, Homo sapien
gaaaagtgtttcaatgtgacaggaa

SEQ ID NO: 312556 - DNA, 25 bp, Homo sapien
gatttaccacccacaatagtactgt

SEQ ID NO: 312557 - DNA, 25 bp, Homo sapien
ctgtctggccagtatttatgcttgg

SEQ ID NO: 312558 - DNA, 25 bp, Homo sapien
tatgcttgggtacaacaatcctctt

SEQ ID NO: 312559 - DNA, 25 bp, Homo sapien
acaacaatcctcttccgtctaatga

SEQ ID NO: 312560 - DNA, 25 bp, Homo sapien
tcttccgtctaatgagcagtctcta

SEQ ID NO: 312561 - DNA, 25 bp, Homo sapien
gagcagtctctaactatacggcaca

SEQ ID NO: 312562 - DNA, 25 bp, Homo sapien
tacggcacatttgctgtcatctaag

SEQ ID NO: 312563 - DNA, 25 bp, Homo sapien
ataaccctgattactagaactgtat

SEQ ID NO: 312564 - DNA, 25 bp, Homo sapien
acatgagtacgtgtcttcgaaaata

SEQ ID NO: 312565 - DNA, 25 bp, Homo sapien
tccatgttccttaagtagactctat

SEQ ID NO: 312566 - DNA, 25 bp, Homo sapien
gatcctagcttaatgatttaccacc

SEQ ID NO: 312567 - DNA, 25 bp, Homo sapien
ccacctgatggcttacgtctgtata

SEQ ID NO: 312568 - DNA, 25 bp, Homo sapien
atgggcagaaatgtggcctcttcct

SEQ ID NO: 312569 - DNA, 25 bp, Homo sapien
aaatgtggcctcttcctgaacacag

SEQ ID NO: 312570 - DNA, 25 bp, Homo sapien
tgaacacagccttgcggctctctga

SEQ ID NO: 312571 - DNA, 25 bp, Homo sapien
ccttgcggctctctgaaacacaggg

SEQ ID NO: 312572 - DNA, 25 bp, Homo sapien
agaatcatggtactcaacctctgag

SEQ ID NO: 312573 - DNA, 25 bp, Homo sapien
gaccaatggcttcagacgatcttga

SEQ ID NO: 312574 - DNA, 25 bp, Homo sapien
gatcttgagtctcccatcatgggaa

SEQ ID NO: 312575 - DNA, 25 bp, Homo sapien
ggcagggtaaacattcaggatcttc

SEQ ID NO: 312576 - DNA, 25 bp, Homo sapien
attcctgatgagagctaataccgtg

SEQ ID NO: 312577 - DNA, 25 bp, Homo sapien
aataccgtggacaatcatttctaac

SEQ ID NO: 312578 - DNA, 25 bp, Homo sapien
tatcatgttgacatccctggtgcca

SEQ ID NO: 312579 - DNA, 25 bp, Homo sapien
gggagcccactgatgtcgctgtgac

SEQ ID NO: 312580 - DNA, 25 bp, Homo sapien
aagctgtcctgtcttatggctgtta

SEQ ID NO: 312581 - DNA, 25 bp, Homo sapien
gagtatttcacggatcggtcctaca

SEQ ID NO: 312582 - DNA, 25 bp, Homo sapien
acggatcggtcctacagtgacatgt

SEQ ID NO: 312583 - DNA, 25 bp, Homo sapien
acatgtgaacttgctgtcctcccag

SEQ ID NO: 312584 - DNA, 25 bp, Homo sapien
tcccagttgagtccattcattcact

SEQ ID NO: 312585 - DNA, 25 bp, Homo sapien
gggtgaatgcactctactcctggga

SEQ ID NO: 312586 - DNA, 25 bp, Homo sapien
atgcactctactcctgggatcagat

SEQ ID NO: 312587 - DNA, 25 bp, Homo sapien
aagcaggtggttgctggtagctttt

SEQ ID NO: 312588 - DNA, 25 bp, Homo sapien
ggtagcttttatttcgtccatcagc

SEQ ID NO: 312589 - DNA, 25 bp, Homo sapien
cttacacgtgagcctgcagcttcat

SEQ ID NO: 312590 - DNA, 25 bp, Homo sapien
agcttcattcacagcccctgtgtag

SEQ ID NO: 312591 - DNA, 25 bp, Homo sapien
acagcccctgtgtagaaagataggc

SEQ ID NO: 312592 - DNA, 25 bp, Homo sapien
gataggcacatcgataggtccctcc

SEQ ID NO: 312593 - DNA, 25 bp, Homo sapien
actgaggcaggcactaaaagcagct

SEQ ID NO: 312594 - DNA, 25 bp, Homo sapien
ctaaaagcagctgactggcagccct

SEQ ID NO: 312595 - DNA, 25 bp, Homo sapien
ggcagccctagaaacatgaagggtt

SEQ ID NO: 312596 - DNA, 25 bp, Homo sapien
gggtttcatttatagtttcagtcct

SEQ ID NO: 312597 - DNA, 25 bp, Homo sapien
catttatagtttcagtccttttcct

SEQ ID NO: 312598 - DNA, 25 bp, Homo sapien
aaaaagccttgaagtcctgcttctg

SEQ ID NO: 312599 - DNA, 25 bp, Homo sapien
cttctgagttttctaatttgtgcag

SEQ ID NO: 312600 - DNA, 25 bp, Homo sapien
ctggaggatctggaacgcgcggtgg

SEQ ID NO: 312601 - DNA, 25 bp, Homo sapien
aacgcgcggtggagctgagcggcgg

SEQ ID NO: 312602 - DNA, 25 bp, Homo sapien
agagctttgtgcagcgcggactcct

SEQ ID NO: 312603 - DNA, 25 bp, Homo sapien
gagctttgtgcagcgcggactcctg

SEQ ID NO: 312604 - DNA, 25 bp, Homo sapien
gcagcgcggactcctggcgcggctg

SEQ ID NO: 312605 - DNA, 25 bp, Homo sapien
gacgacgcccgcagggacttcgaga

SEQ ID NO: 312606 - DNA, 25 bp, Homo sapien
acgacgcccgcagggacttcgagag

SEQ ID NO: 312607 - DNA, 25 bp, Homo sapien
gggacttcgagagggcggcacggct

SEQ ID NO: 312608 - DNA, 25 bp, Homo sapien
cacagccctggagaggtttggccaa

SEQ ID NO: 312609 - DNA, 25 bp, Homo sapien
acagccctggagaggtttggccaag

SEQ ID NO: 312610 - DNA, 25 bp, Homo sapien
agccctggagaggtttggccaagcc

SEQ ID NO: 312611 - DNA, 25 bp, Homo sapien
gcatagaatggagactttggagttt

SEQ ID NO: 312612 - DNA, 25 bp, Homo sapien
gggtttggggacatcagcttctctc

SEQ ID NO: 312613 - DNA, 25 bp, Homo sapien
tctctcttccagttagtctgataag

SEQ ID NO: 312614 - DNA, 25 bp, Homo sapien
gtctgataagtcctttgttgcctgg

SEQ ID NO: 312615 - DNA, 25 bp, Homo sapien
aagtcctttgttgcctggccctgga

SEQ ID NO: 312616 - DNA, 25 bp, Homo sapien
gaaaccacttgtgctccgaaaatgc

SEQ ID NO: 312617 - DNA, 25 bp, Homo sapien
gtgctccgaaaatgccattctctgg

SEQ ID NO: 312618 - DNA, 25 bp, Homo sapien
cattctctggaatgtagctgtggag

SEQ ID NO: 312619 - DNA, 25 bp, Homo sapien
gagagttggcccctgtgttctgtaa

SEQ ID NO: 312620 - DNA, 25 bp, Homo sapien
ccctgtgttctgtaacccaagcaag

SEQ ID NO: 312621 - DNA, 25 bp, Homo sapien
gtaacccaagcaagtactgtctcac

SEQ ID NO: 312622 - DNA, 25 bp, Homo sapien
tctgacttcgtcaaacttacacaat

SEQ ID NO: 312623 - DNA, 25 bp, Homo sapien
gcgatagggactgtttggacctgac

SEQ ID NO: 312624 - DNA, 25 bp, Homo sapien
atagggactgtttggacctgactcc

SEQ ID NO: 312625 - DNA, 25 bp, Homo sapien
agggactgtttggacctgactccaa

SEQ ID NO: 312626 - DNA, 25 bp, Homo sapien
gggactgtttggacctgactccaac

SEQ ID NO: 312627 - DNA, 25 bp, Homo sapien
gactgtttggacctgactccaacct

SEQ ID NO: 312628 - DNA, 25 bp, Homo sapien
tgtttggacctgactccaacctgcg

SEQ ID NO: 312629 - DNA, 25 bp, Homo sapien
tcctgcgcttttcctggaacccaaa

SEQ ID NO: 312630 - DNA, 25 bp, Homo sapien
ccaaagctctgacttcgtcaaactt

SEQ ID NO: 312631 - DNA, 25 bp, Homo sapien
aaagctctgacttcgtcaaacttac

SEQ ID NO: 312632 - DNA, 25 bp, Homo sapien
agctctgacttcgtcaaacttacac

SEQ ID NO: 312633 - DNA, 25 bp, Homo sapien
tgaagaaatgtatctctccatgagc

SEQ ID NO: 312634 - DNA, 25 bp, Homo sapien
gaaatgtatctctccatgagcatta

SEQ ID NO: 312635 - DNA, 25 bp, Homo sapien
gtatctctccatgagcattaaattg

SEQ ID NO: 312636 - DNA, 25 bp, Homo sapien
catgagcattaaattgccatatcca

SEQ ID NO: 312637 - DNA, 25 bp, Homo sapien
aatttaacccagatctgtacagaat

SEQ ID NO: 312638 - DNA, 25 bp, Homo sapien
taatggttttcagctattggtagac

SEQ ID NO: 312639 - DNA, 25 bp, Homo sapien
agctattggtagactgacttattct

SEQ ID NO: 312640 - DNA, 25 bp, Homo sapien
tgctatatttagagtaacatacagg

SEQ ID NO: 312641 - DNA, 25 bp, Homo sapien
aattcttgattcatctttgattata

SEQ ID NO: 312642 - DNA, 25 bp, Homo sapien
gaggaaaaatcattatggtccattt

SEQ ID NO: 312643 - DNA, 25 bp, Homo sapien
attatggtccatttaaacttgaaga

SEQ ID NO: 312644 - DNA, 25 bp, Homo sapien
ggtatagataagaggagcaggcctt

SEQ ID NO: 312645 - DNA, 25 bp, Homo sapien
gtatagataagaggagcaggccttg

SEQ ID NO: 312646 - DNA, 25 bp, Homo sapien
tatagataagaggagcaggccttgg

SEQ ID NO: 312647 - DNA, 25 bp, Homo sapien
atagataagaggagcaggccttggc

SEQ ID NO: 312648 - DNA, 25 bp, Homo sapien
tagataagaggagcaggccttggcc

SEQ ID NO: 312649 - DNA, 25 bp, Homo sapien
agataagaggagcaggccttggcca

SEQ ID NO: 312650 - DNA, 25 bp, Homo sapien
ataagaggagcaggccttggccagg

SEQ ID NO: 312651 - DNA, 25 bp, Homo sapien
agaggagcaggccttggccaggcgt

SEQ ID NO: 312652 - DNA, 25 bp, Homo sapien
gaggagcaggccttggccaggcgtg

SEQ ID NO: 312653 - DNA, 25 bp, Homo sapien
cacgatgtcaggagatcgaaatcag

SEQ ID NO: 312654 - DNA, 25 bp, Homo sapien
acccggtgggaagagtttgcagtga

SEQ ID NO: 312655 - DNA, 25 bp, Homo sapien
ggtggagatttacttggttcataca

SEQ ID NO: 312656 - DNA, 25 bp, Homo sapien
ggttcatacaccttttgcctgaatt

SEQ ID NO: 312657 - DNA, 25 bp, Homo sapien
ggaggacttttatcctttttgatag

SEQ ID NO: 312658 - DNA, 25 bp, Homo sapien
gacagtttcatatatcttgaactca

SEQ ID NO: 312659 - DNA, 25 bp, Homo sapien
gaactcaatatctcagatctcttct

SEQ ID NO: 312660 - DNA, 25 bp, Homo sapien
agatctcttctactgtattactgaa

SEQ ID NO: 312661 - DNA, 25 bp, Homo sapien
gacaatgttcgccattcactagata

SEQ ID NO: 312662 - DNA, 25 bp, Homo sapien
ttacacttattcaagcttgtctgtg

SEQ ID NO: 312663 - DNA, 25 bp, Homo sapien
caagcttgtctgtgattaatggaat

SEQ ID NO: 312664 - DNA, 25 bp, Homo sapien
ggaattggtgtcagatgctggaatt

SEQ ID NO: 312665 - DNA, 25 bp, Homo sapien
ggaatttattctgaccaatgaacac

SEQ ID NO: 312666 - DNA, 25 bp, Homo sapien
gctctgcccactaatgtggcctgtg

SEQ ID NO: 312667 - DNA, 25 bp, Homo sapien
acactgcagctgagcagtccaggtt

SEQ ID NO: 312668 - DNA, 25 bp, Homo sapien
tgagacagcggatgtctcttctctc

SEQ ID NO: 312669 - DNA, 25 bp, Homo sapien
caccccactaaccttggagcaggaa

SEQ ID NO: 312670 - DNA, 25 bp, Homo sapien
ggagcaggaaacactcctgcagacc

SEQ ID NO: 312671 - DNA, 25 bp, Homo sapien
tgcagaccctgccttacagagaaga

SEQ ID NO: 312672 - DNA, 25 bp, Homo sapien
tcttctctcccttcttaatcagttt

SEQ ID NO: 312673 - DNA, 25 bp, Homo sapien
tctcccttcttaatcagttttctta

SEQ ID NO: 312674 - DNA, 25 bp, Homo sapien
gggcaagtataaccaccaatcctca

SEQ ID NO: 312675 - DNA, 25 bp, Homo sapien
gtataaccaccaatcctcaggtgaa

SEQ ID NO: 312676 - DNA, 25 bp, Homo sapien
aatcctcaggtgaagcctcttagtt

SEQ ID NO: 312677 - DNA, 25 bp, Homo sapien
gatttttcagtgtgacagtggctat

SEQ ID NO: 312678 - DNA, 25 bp, Homo sapien
gtggctatttacaagaatgccctag

SEQ ID NO: 312679 - DNA, 25 bp, Homo sapien
gaatgccctagttcttaggatgtta

SEQ ID NO: 312680 - DNA, 25 bp, Homo sapien
tcttaggatgttagtgctgaatcat

SEQ ID NO: 312681 - DNA, 25 bp, Homo sapien
gctgaatcattagacaagagacctg

SEQ ID NO: 312682 - DNA, 25 bp, Homo sapien
gagacctgatggctacaactgacat

SEQ ID NO: 312683 - DNA, 25 bp, Homo sapien
attggtccagacagataacacaact

SEQ ID NO: 312684 - DNA, 25 bp, Homo sapien
aacacaactgggttggtccattaag

SEQ ID NO: 312685 - DNA, 25 bp, Homo sapien
gtccattaagtgacccctgatgcag

SEQ ID NO: 312686 - DNA, 25 bp, Homo sapien
ttaagtgacccctgatgcagcactg

SEQ ID NO: 312687 - DNA, 25 bp, Homo sapien
tgcagcactgcattgaaggcaaaaa

SEQ ID NO: 312688 - DNA, 25 bp, Homo sapien
tgcatcagcttctctggcaagccat

SEQ ID NO: 312689 - DNA, 25 bp, Homo sapien
atcttcatcatcaaactgctccatg

SEQ ID NO: 312690 - DNA, 25 bp, Homo sapien
aaactgctccatgggttccacaatg

SEQ ID NO: 312691 - DNA, 25 bp, Homo sapien
gtcgttgttagcaagaatgccccat

SEQ ID NO: 312692 - DNA, 25 bp, Homo sapien
ccagagcctttcgtgcaggaggttt

SEQ ID NO: 312693 - DNA, 25 bp, Homo sapien
ggaggttttgctgcaaactctacaa

SEQ ID NO: 312694 - DNA, 25 bp, Homo sapien
tacaaaaccttttcctgtagctcta

SEQ ID NO: 312695 - DNA, 25 bp, Homo sapien
gatcatccacaaccacaacagcttt

SEQ ID NO: 312696 - DNA, 25 bp, Homo sapien
aacagctttctctactggaccaaac

SEQ ID NO: 312697 - DNA, 25 bp, Homo sapien
gaaaatgcttgctctagcagctcat

SEQ ID NO: 312698 - DNA, 25 bp, Homo sapien
tcaaggctgctccatgtgtagcgaa

SEQ ID NO: 312699 - DNA, 25 bp, Homo sapien
tgcagttaccacctggaatcttcag

SEQ ID NO: 312700 - DNA, 25 bp, Homo sapien
gaatcttcagccaggacttggaggc

SEQ ID NO: 312701 - DNA, 25 bp, Homo sapien
cccttctgtggcacttctgagatga

SEQ ID NO: 312702 - DNA, 25 bp, Homo sapien
gcacttctgagatgacaacttgttt

SEQ ID NO: 312703 - DNA, 25 bp, Homo sapien
gacaacttgtttcacagttggatgg

SEQ ID NO: 312704 - DNA, 25 bp, Homo sapien
aaagagcggccccattattccagaa

SEQ ID NO: 312705 - DNA, 25 bp, Homo sapien
cggccccattattccagaacatttt

SEQ ID NO: 312706 - DNA, 25 bp, Homo sapien
acattttatccacacaggctcagac

SEQ ID NO: 312707 - DNA, 25 bp, Homo sapien
tgccttttctgcatggccagggtcc

SEQ ID NO: 312708 - DNA, 25 bp, Homo sapien
atcgctcacagctgtcagtgtgcac

SEQ ID NO: 312709 - DNA, 25 bp, Homo sapien
cagctgtcagtgtgcacatgctcag

SEQ ID NO: 312710 - DNA, 25 bp, Homo sapien
ctgcccaacatggattttctcctgg

SEQ ID NO: 312711 - DNA, 25 bp, Homo sapien
caacatggattttctcctggcgctg

SEQ ID NO: 312712 - DNA, 25 bp, Homo sapien
ggtgctggtatcctcgctctacctg

SEQ ID NO: 312713 - DNA, 25 bp, Homo sapien
gtatcctcgctctacctgcaggcgg

SEQ ID NO: 312714 - DNA, 25 bp, Homo sapien
aggcggccgccgagttcgacgggag

SEQ ID NO: 312715 - DNA, 25 bp, Homo sapien
ggtggcccaggcaaatagtgtcatc

SEQ ID NO: 312716 - DNA, 25 bp, Homo sapien
gcccaggcaaatagtgtcatcgatt

SEQ ID NO: 312717 - DNA, 25 bp, Homo sapien
agtgtcatcgattggcctatgtcgt

SEQ ID NO: 312718 - DNA, 25 bp, Homo sapien
atcgattggcctatgtcgttatggt

SEQ ID NO: 312719 - DNA, 25 bp, Homo sapien
cctatgtcgttatggtgggaggatt

SEQ ID NO: 312720 - DNA, 25 bp, Homo sapien
ctgtcctccgggagcggcagcagta

SEQ ID NO: 312721 - DNA, 25 bp, Homo sapien
ccaggaagtgtgagctgttacagca

SEQ ID NO: 312722 - DNA, 25 bp, Homo sapien
gacaagcactattttctcttcctac

SEQ ID NO: 312723 - DNA, 25 bp, Homo sapien
atttctaatgcctactgccatcaag

SEQ ID NO: 312724 - DNA, 25 bp, Homo sapien
tactgccatcaaggccttgttttgc

SEQ ID NO: 312725 - DNA, 25 bp, Homo sapien
aatgtgtgtggcatgtgtaagaaaa

SEQ ID NO: 312726 - DNA, 25 bp, Homo sapien
atactatcttatactacctctccag

SEQ ID NO: 312727 - DNA, 25 bp, Homo sapien
tatcttatactacctctccaggttg

SEQ ID NO: 312728 - DNA, 25 bp, Homo sapien
tatactacctctccaggttgccaga

SEQ ID NO: 312729 - DNA, 25 bp, Homo sapien
tacctctccaggttgccagagagtt

SEQ ID NO: 312730 - DNA, 25 bp, Homo sapien
ggcacaaccgtctccctttatagtt

SEQ ID NO: 312731 - DNA, 25 bp, Homo sapien
tctccctttatagttctacttttct

SEQ ID NO: 312732 - DNA, 25 bp, Homo sapien
gataaactttgtcatgttctaccag

SEQ ID NO: 312733 - DNA, 25 bp, Homo sapien
taaactttgtcatgttctaccagtg

SEQ ID NO: 312734 - DNA, 25 bp, Homo sapien
aaactttgtcatgttctaccagtgt

SEQ ID NO: 312735 - DNA, 25 bp, Homo sapien
aactttgtcatgttctaccagtgtt

SEQ ID NO: 312736 - DNA, 25 bp, Homo sapien
actttgtcatgttctaccagtgttt

SEQ ID NO: 312737 - DNA, 25 bp, Homo sapien
aatgtatattcattgcaaggtacaa

SEQ ID NO: 312738 - DNA, 25 bp, Homo sapien
attgcaaggtacaatgtgaactgta

SEQ ID NO: 312739 - DNA, 25 bp, Homo sapien
gcaaggtacaatgtgaactgtaaat

SEQ ID NO: 312740 - DNA, 25 bp, Homo sapien
tcatgttctaccagtgttttattac

SEQ ID NO: 312741 - DNA, 25 bp, Homo sapien
atgttctaccagtgttttattacag

SEQ ID NO: 312742 - DNA, 25 bp, Homo sapien
tgttctaccagtgttttattacaga

SEQ ID NO: 312743 - DNA, 25 bp, Homo sapien
gagttgaggttgtctgccaacgcta

SEQ ID NO: 312744 - DNA, 25 bp, Homo sapien
gccaacgctaactggccagctctga

SEQ ID NO: 312745 - DNA, 25 bp, Homo sapien
caggaggagccatcaggccagttct

SEQ ID NO: 312746 - DNA, 25 bp, Homo sapien
gttctctgggatactgctgtgtctc

SEQ ID NO: 312747 - DNA, 25 bp, Homo sapien
tgcagtttgctctgcgtcactcagc

SEQ ID NO: 312748 - DNA, 25 bp, Homo sapien
tcactcagcggcagacggagaggca

SEQ ID NO: 312749 - DNA, 25 bp, Homo sapien
agaggcagacacgagccccttgtga

SEQ ID NO: 312750 - DNA, 25 bp, Homo sapien
gagctccagttgtgtcttgtaagaa

SEQ ID NO: 312751 - DNA, 25 bp, Homo sapien
ttaccgtcatctcacaatgctctga

SEQ ID NO: 312752 - DNA, 25 bp, Homo sapien
actggctcctttgggtgggatctga

SEQ ID NO: 312753 - DNA, 25 bp, Homo sapien
atctgatggcatctcatggagttga

SEQ ID NO: 312754 - DNA, 25 bp, Homo sapien
ttgtgggcacgataatagcaactga

SEQ ID NO: 312755 - DNA, 25 bp, Homo sapien
aatagcaactgagctgtcacagcct

SEQ ID NO: 312756 - DNA, 25 bp, Homo sapien
tgagctgtcacagcctaccagcagg

SEQ ID NO: 312757 - DNA, 25 bp, Homo sapien
aggctggtaacacctccagggtctc

SEQ ID NO: 312758 - DNA, 25 bp, Homo sapien
tccagggtctcttggctagagcaga

SEQ ID NO: 312759 - DNA, 25 bp, Homo sapien
gagcagatttcttagcagctgacta

SEQ ID NO: 312760 - DNA, 25 bp, Homo sapien
gcagctgactaggacttcagtcatt

SEQ ID NO: 312761 - DNA, 25 bp, Homo sapien
agtcattgggaagcctatgaggcct

SEQ ID NO: 312762 - DNA, 25 bp, Homo sapien
gaggcctttacatttttggtgtgag

SEQ ID NO: 312763 - DNA, 25 bp, Homo sapien
ctgtgtgaatttttagtcctatatt

SEQ ID NO: 312764 - DNA, 25 bp, Homo sapien
aattgatctcttattccaagaatcc

SEQ ID NO: 312765 - DNA, 25 bp, Homo sapien
ataaagagtacctacaaatcaataa

SEQ ID NO: 312766 - DNA, 25 bp, Homo sapien
gaaatggctcttaaatgaatgaaaa

SEQ ID NO: 312767 - DNA, 25 bp, Homo sapien
aatgaaaacatactctcactcagag

SEQ ID NO: 312768 - DNA, 25 bp, Homo sapien
tgaaaacatactctcactcagagaa

SEQ ID NO: 312769 - DNA, 25 bp, Homo sapien
gaaaatttaacccatgtcaagatac

SEQ ID NO: 312770 - DNA, 25 bp, Homo sapien
aatttaacccatgtcaagatacttg

SEQ ID NO: 312771 - DNA, 25 bp, Homo sapien
tttaacccatgtcaagatacttggg

SEQ ID NO: 312772 - DNA, 25 bp, Homo sapien
gtgttttaaaattcgattgtggtga

SEQ ID NO: 312773 - DNA, 25 bp, Homo sapien
ggtgatggttataaccctataaatt

SEQ ID NO: 312774 - DNA, 25 bp, Homo sapien
tactaaaacttattgaagtgtacct

SEQ ID NO: 312775 - DNA, 25 bp, Homo sapien
ttgaagtgtacctttaaaacaaatg

SEQ ID NO: 312776 - DNA, 25 bp, Homo sapien
ctgttcagatatggctattactttc

SEQ ID NO: 312777 - DNA, 25 bp, Homo sapien
atgatgtatggcctgtaccggctca

SEQ ID NO: 312778 - DNA, 25 bp, Homo sapien
cggctcagggcatttggacactatt

SEQ ID NO: 312779 - DNA, 25 bp, Homo sapien
ggacactatttcaatgacacactcg

SEQ ID NO: 312780 - DNA, 25 bp, Homo sapien
aatgacacactcgttttcttgcctc

SEQ ID NO: 312781 - DNA, 25 bp, Homo sapien
gttttcttgcctccagttggttcag

SEQ ID NO: 312782 - DNA, 25 bp, Homo sapien
gcctggagaataatagacctgtgct

SEQ ID NO: 312783 - DNA, 25 bp, Homo sapien
ctgtgctgtccaagagcacttgaaa

SEQ ID NO: 312784 - DNA, 25 bp, Homo sapien
aatcgcacagcttattgaagaggca

SEQ ID NO: 312785 - DNA, 25 bp, Homo sapien
ggcattgtctaataaccctcagcaa

SEQ ID NO: 312786 - DNA, 25 bp, Homo sapien
gcaagtagtagaaggctgctgttca

SEQ ID NO: 312787 - DNA, 25 bp, Homo sapien
ttatctaatgaagcccattcctttt

SEQ ID NO: 312788 - DNA, 25 bp, Homo sapien
tctaatgaagcccattcctttttgt

SEQ ID NO: 312789 - DNA, 25 bp, Homo sapien
tacatattgtatgcactgtgctgat

SEQ ID NO: 312790 - DNA, 25 bp, Homo sapien
attgtatgcactgtgctgatgcaag

SEQ ID NO: 312791 - DNA, 25 bp, Homo sapien
aattattctgcatctcatcacatca

SEQ ID NO: 312792 - DNA, 25 bp, Homo sapien
atcacatcacagtatttctgtacta

SEQ ID NO: 312793 - DNA, 25 bp, Homo sapien
gtatttctgtactatttattcatat

SEQ ID NO: 312794 - DNA, 25 bp, Homo sapien
agatgtcacttaaacttatgcttac

SEQ ID NO: 312795 - DNA, 25 bp, Homo sapien
gtcacttaaacttatgcttacaaac

SEQ ID NO: 312796 - DNA, 25 bp, Homo sapien
gcttacaaactaaagactaatcgct

SEQ ID NO: 312797 - DNA, 25 bp, Homo sapien
gactaatcgctcaatatgaaaacat

SEQ ID NO: 312798 - DNA, 25 bp, Homo sapien
ctgtggctttagtggctatcactga

SEQ ID NO: 312799 - DNA, 25 bp, Homo sapien
agtggctatcactgaaactctttcc

SEQ ID NO: 312800 - DNA, 25 bp, Homo sapien
ttttaggtttctgtactttctgtag

SEQ ID NO: 312801 - DNA, 25 bp, Homo sapien
atgtttacatggaaactacaggaaa

SEQ ID NO: 312802 - DNA, 25 bp, Homo sapien
aaattggctacatttctcacttctc

SEQ ID NO: 312803 - DNA, 25 bp, Homo sapien
ctcacttctcctatcatgtggtcaa

SEQ ID NO: 312804 - DNA, 25 bp, Homo sapien
ttctcctatcatgtggtcaaagtta

SEQ ID NO: 312805 - DNA, 25 bp, Homo sapien
gtggtcaaagttattgttgtatacc

SEQ ID NO: 312806 - DNA, 25 bp, Homo sapien
tgttgtataccagcgatgggatgta

SEQ ID NO: 312807 - DNA, 25 bp, Homo sapien
atttcagccttataattagcaaaaa

SEQ ID NO: 312808 - DNA, 25 bp, Homo sapien
agagaataaagtcttctgtggcttt

SEQ ID NO: 312809 - DNA, 25 bp, Homo sapien
ttttgaaaacgttctcacttctaga

SEQ ID NO: 312810 - DNA, 25 bp, Homo sapien
gaatttccacttaagcctttgttat

SEQ ID NO: 312811 - DNA, 25 bp, Homo sapien
agcctttgttattattgtagtttct

SEQ ID NO: 312812 - DNA, 25 bp, Homo sapien
aaatccacactaattccaacatctg

SEQ ID NO: 312813 - DNA, 25 bp, Homo sapien
caacatctgggtcatctcgaggtca

SEQ ID NO: 312814 - DNA, 25 bp, Homo sapien
gggtcatctcgaggtcagtctctat

SEQ ID NO: 312815 - DNA, 25 bp, Homo sapien
cgaggtcagtctctattgattgcct

SEQ ID NO: 312816 - DNA, 25 bp, Homo sapien
cagtctctattgattgcctttttct

SEQ ID NO: 312817 - DNA, 25 bp, Homo sapien
aggttcattgactctttaccacctc

SEQ ID NO: 312818 - DNA, 25 bp, Homo sapien
aagctgctcctgaacgcaactgatt

SEQ ID NO: 312819 - DNA, 25 bp, Homo sapien
gaacgcaactgattattatttttta

SEQ ID NO: 312820 - DNA, 25 bp, Homo sapien
ggtgggtcaacttatttcccactat

SEQ ID NO: 312821 - DNA, 25 bp, Homo sapien
caggcctgatgcaggtccatctaga

SEQ ID NO: 312822 - DNA, 25 bp, Homo sapien
gcaggtccatctagacagctcagat

SEQ ID NO: 312823 - DNA, 25 bp, Homo sapien
gacagctcagattagcctaggccat

SEQ ID NO: 312824 - DNA, 25 bp, Homo sapien
gggtcaacttatttcccactatgac

SEQ ID NO: 312825 - DNA, 25 bp, Homo sapien
tcagattagcctaggccatgcccta

SEQ ID NO: 312826 - DNA, 25 bp, Homo sapien
attagcctaggccatgccctaggga

SEQ ID NO: 312827 - DNA, 25 bp, Homo sapien
catgccctagggacacggcctaggg

SEQ ID NO: 312828 - DNA, 25 bp, Homo sapien
aacttatttcccactatgacattta

SEQ ID NO: 312829 - DNA, 25 bp, Homo sapien
ttggccctgagctgcttagggacag

SEQ ID NO: 312830 - DNA, 25 bp, Homo sapien
tttcccactatgacatttatatctt

SEQ ID NO: 312831 - DNA, 25 bp, Homo sapien
tacctgcctcaactttccatagtgt

SEQ ID NO: 312832 - DNA, 25 bp, Homo sapien
tggcccagccactcttattcttgta

SEQ ID NO: 312833 - DNA, 25 bp, Homo sapien
cactcttattcttgtaccacctctt

SEQ ID NO: 312834 - DNA, 25 bp, Homo sapien
taaagaatgtgtcatggctctcctt

SEQ ID NO: 312835 - DNA, 25 bp, Homo sapien
catggctctcctttctgctcttgat

SEQ ID NO: 312836 - DNA, 25 bp, Homo sapien
tttctgctcttgatcatgataacgt

SEQ ID NO: 312837 - DNA, 25 bp, Homo sapien
gctcttgatcatgataacgttctaa

SEQ ID NO: 312838 - DNA, 25 bp, Homo sapien
gataacgttctaaagggtgtggaat

SEQ ID NO: 312839 - DNA, 25 bp, Homo sapien
tacagtacagaactggtgtgtgcta

SEQ ID NO: 312840 - DNA, 25 bp, Homo sapien
aactggtgtgtgctatgtgacatga

SEQ ID NO: 312841 - DNA, 25 bp, Homo sapien
atgtgacatgagaggtactgagatt

SEQ ID NO: 312842 - DNA, 25 bp, Homo sapien
ctggaggatctggaacgcgcggtgg

SEQ ID NO: 312843 - DNA, 25 bp, Homo sapien
aacgcgcggtggagctgagcggcgg

SEQ ID NO: 312844 - DNA, 25 bp, Homo sapien
agagctttgtgcagcgcggactcct

SEQ ID NO: 312845 - DNA, 25 bp, Homo sapien
gagctttgtgcagcgcggactcctg

SEQ ID NO: 312846 - DNA, 25 bp, Homo sapien
ggctgcagggccgagacgacgacgc

SEQ ID NO: 312847 - DNA, 25 bp, Homo sapien
gacgacgcccgcagggacttcgaga

SEQ ID NO: 312848 - DNA, 25 bp, Homo sapien
gggacttcgagagggcggcacggct

SEQ ID NO: 312849 - DNA, 25 bp, Homo sapien
cacagccctggagaggtttggccaa

SEQ ID NO: 312850 - DNA, 25 bp, Homo sapien
agccctggagaggtttggccaagcc

SEQ ID NO: 312851 - DNA, 25 bp, Homo sapien
agaggtttggccaagccatctgcct

SEQ ID NO: 312852 - DNA, 25 bp, Homo sapien
gcctgctgcctgagagggcttcagc

SEQ ID NO: 312853 - DNA, 25 bp, Homo sapien
gtgccaccctaccagcacgaggaga

SEQ ID NO: 312854 - DNA, 25 bp, Homo sapien
cacgaggagatcatcggcaaggtct

SEQ ID NO: 312855 - DNA, 25 bp, Homo sapien
gatcatcggcaaggtctgtgagctc

SEQ ID NO: 312856 - DNA, 25 bp, Homo sapien
atcggcaaggtctgtgagctcatca

SEQ ID NO: 312857 - DNA, 25 bp, Homo sapien
cggcaaggtctgtgagctcatcaac

SEQ ID NO: 312858 - DNA, 25 bp, Homo sapien
caaggtctgtgagctcatcaacgag

SEQ ID NO: 312859 - DNA, 25 bp, Homo sapien
gtctgtgagctcatcaacgaggtga

SEQ ID NO: 312860 - DNA, 25 bp, Homo sapien
gtgagctcatcaacgaggtgaagga

SEQ ID NO: 312861 - DNA, 25 bp, Homo sapien
tcatcaacgaggtgaaggagtcctg

SEQ ID NO: 312862 - DNA, 25 bp, Homo sapien
aggtgaaggagtcctgggccgagga

SEQ ID NO: 312863 - DNA, 25 bp, Homo sapien
aggaggccgacttcgagcccgctgc

SEQ ID NO: 312864 - DNA, 25 bp, Homo sapien
gaaactgtcttgattgtacttgtaa

SEQ ID NO: 312865 - DNA, 25 bp, Homo sapien
aaaggcaatcagtccaggatacagg

SEQ ID NO: 312866 - DNA, 25 bp, Homo sapien
attttttgaaccctgacattcagag

SEQ ID NO: 312867 - DNA, 25 bp, Homo sapien
gagtcagtcacctggcacatagtgg

SEQ ID NO: 312868 - DNA, 25 bp, Homo sapien
gtggatgcttaataacaggtgtgga

SEQ ID NO: 312869 - DNA, 25 bp, Homo sapien
aaattggctgctacttgcccgggca

SEQ ID NO: 312870 - DNA, 25 bp, Homo sapien
ggcagtgggccagactcataaacat

SEQ ID NO: 312871 - DNA, 25 bp, Homo sapien
aacatagtggccattcagaatcctg

SEQ ID NO: 312872 - DNA, 25 bp, Homo sapien
tggccattcagaatcctgcaacgtt

SEQ ID NO: 312873 - DNA, 25 bp, Homo sapien
gaatcctgcaacgttcatgttttcg

SEQ ID NO: 312874 - DNA, 25 bp, Homo sapien
gcaacgttcatgttttcgtgtatta

SEQ ID NO: 312875 - DNA, 25 bp, Homo sapien
gtgcggagcggtgttggttcaggcg

SEQ ID NO: 312876 - DNA, 25 bp, Homo sapien
ggttcaggcgctggcgacagtgcta

SEQ ID NO: 312877 - DNA, 25 bp, Homo sapien
gcgacagtgctatggccacggcagg

SEQ ID NO: 312878 - DNA, 25 bp, Homo sapien
gggccgcgtgcgtctcagcggtggc

SEQ ID NO: 312879 - DNA, 25 bp, Homo sapien
agcggtggcgccttcggaccctatt

SEQ ID NO: 312880 - DNA, 25 bp, Homo sapien
gtggcgccttcggaccctattggcg

SEQ ID NO: 312881 - DNA, 25 bp, Homo sapien
ctattggcgcccgggacttaagcgg

SEQ ID NO: 312882 - DNA, 25 bp, Homo sapien
gccacggtgacctcgggcgtagggc

SEQ ID NO: 312883 - DNA, 25 bp, Homo sapien
cgggcacgctggtggaagcgcgggc

SEQ ID NO: 312884 - DNA, 25 bp, Homo sapien
acatcgggccgcagagaaagtgccg

SEQ ID NO: 312885 - DNA, 25 bp, Homo sapien
ccgcagagaaagtgccgatggcctg

SEQ ID NO: 312886 - DNA, 25 bp, Homo sapien
tggccagagccggattttgttgcac

SEQ ID NO: 312887 - DNA, 25 bp, Homo sapien
ttttgttgcactccgggcaggaaga

SEQ ID NO: 312888 - DNA, 25 bp, Homo sapien
gagcgcaactttcagcgtcttttct

SEQ ID NO: 312889 - DNA, 25 bp, Homo sapien
ctgacggagatagtagtgccttgct

SEQ ID NO: 312890 - DNA, 25 bp, Homo sapien
gatagtagtgccttgctgaagtcac

SEQ ID NO: 312891 - DNA, 25 bp, Homo sapien
agtgccttgctgaagtcacggcggc

SEQ ID NO: 312892 - DNA, 25 bp, Homo sapien
aactttcagcgtcttttctgcggct

SEQ ID NO: 312893 - DNA, 25 bp, Homo sapien
aggcagggaacttcccggtgagcca

SEQ ID NO: 312894 - DNA, 25 bp, Homo sapien
ttttctgcggcttccttctatcccg

SEQ ID NO: 312895 - DNA, 25 bp, Homo sapien
ttctatcccgctccgaggctgcagg

SEQ ID NO: 312896 - DNA, 25 bp, Homo sapien
gccctggcagagtggcgcactggaa

SEQ ID NO: 312897 - DNA, 25 bp, Homo sapien
ctgtcaccaacaatcgagtctccaa

SEQ ID NO: 312898 - DNA, 25 bp, Homo sapien
aatcgagtctccaacagcaacaccg

SEQ ID NO: 312899 - DNA, 25 bp, Homo sapien
acactgctttgcgttcgcagccttt

SEQ ID NO: 312900 - DNA, 25 bp, Homo sapien
gttcgcagcctttccgcttcctgtt

SEQ ID NO: 312901 - DNA, 25 bp, Homo sapien
caaccccgagcgcaaagaaattgac

SEQ ID NO: 312902 - DNA, 25 bp, Homo sapien
aagaaattgacctcgcagcggtcct

SEQ ID NO: 312903 - DNA, 25 bp, Homo sapien
attgacctcgcagcggtcctacaat

SEQ ID NO: 312904 - DNA, 25 bp, Homo sapien
ttttatatcattggccaagctttac

SEQ ID NO: 312905 - DNA, 25 bp, Homo sapien
ctgcctcatgcagcctatgggctag

SEQ ID NO: 312906 - DNA, 25 bp, Homo sapien
gcctatgggctaggctttagggtcc

SEQ ID NO: 312907 - DNA, 25 bp, Homo sapien
ttagggtccgcggttggtcagaccg

SEQ ID NO: 312908 - DNA, 25 bp, Homo sapien
gggagaaacacatttactccccaat

SEQ ID NO: 312909 - DNA, 25 bp, Homo sapien
ccccaataattgtacgggaggtgat

SEQ ID NO: 312910 - DNA, 25 bp, Homo sapien
tacatgaccatgcacccagtttggc

SEQ ID NO: 312911 - DNA, 25 bp, Homo sapien
cagtttggccttctctgaggtcaga

SEQ ID NO: 312912 - DNA, 25 bp, Homo sapien
tggccttctctgaggtcagatcgga

SEQ ID NO: 312913 - DNA, 25 bp, Homo sapien
aggtcagatcggaacaactcacttg

SEQ ID NO: 312914 - DNA, 25 bp, Homo sapien
gatcggaacaactcacttgaaaaaa

SEQ ID NO: 312915 - DNA, 25 bp, Homo sapien
agaatggagagtcccttcatctcag

SEQ ID NO: 312916 - DNA, 25 bp, Homo sapien
agtcccttcatctcagcagcggtgg

SEQ ID NO: 312917 - DNA, 25 bp, Homo sapien
atctcagcagcggtggagactctct

SEQ ID NO: 312918 - DNA, 25 bp, Homo sapien
cagcggtggagactctctcctgtgt

SEQ ID NO: 312919 - DNA, 25 bp, Homo sapien
cagtgaagaaactttagggaagcct

SEQ ID NO: 312920 - DNA, 25 bp, Homo sapien
tttagggaagcctgacaaccacacc

SEQ ID NO: 312921 - DNA, 25 bp, Homo sapien
tagggaagcctgacaaccacaccct

SEQ ID NO: 312922 - DNA, 25 bp, Homo sapien
ctctgctgatccctgtggaatttta

SEQ ID NO: 312923 - DNA, 25 bp, Homo sapien
cagttggccgctcctggattcctta

SEQ ID NO: 312924 - DNA, 25 bp, Homo sapien
tgatccctgtggaattttacatgga

SEQ ID NO: 312925 - DNA, 25 bp, Homo sapien
ataatgagtaaaagactgtcctgcc

SEQ ID NO: 312926 - DNA, 25 bp, Homo sapien
aagactgtcctgccaatagagaata

SEQ ID NO: 312927 - DNA, 25 bp, Homo sapien
tacagtgaaacggtatggaacatac

SEQ ID NO: 312928 - DNA, 25 bp, Homo sapien
ggtatggaacatacacagtggaaca

SEQ ID NO: 312929 - DNA, 25 bp, Homo sapien
gatggaacagtgtttataagcacaa

SEQ ID NO: 312930 - DNA, 25 bp, Homo sapien
atcaggctgccccaagtgagatgct

SEQ ID NO: 312931 - DNA, 25 bp, Homo sapien
aagtgagatgctggcaactcttggg

SEQ ID NO: 312932 - DNA, 25 bp, Homo sapien
caactcttgggcctttagatttcca

SEQ ID NO: 312933 - DNA, 25 bp, Homo sapien
ggcctttagatttccaaaacctcat

SEQ ID NO: 312934 - DNA, 25 bp, Homo sapien
tcattttgagcccttctgcagggta

SEQ ID NO: 312935 - DNA, 25 bp, Homo sapien
gtttttgagttttggcctcaggcgt

SEQ ID NO: 312936 - DNA, 25 bp, Homo sapien
gggccgcgatgacatcttccctgag

SEQ ID NO: 312937 - DNA, 25 bp, Homo sapien
tcttccctgaggatctgaggcaaat

SEQ ID NO: 312938 - DNA, 25 bp, Homo sapien
tggcctcaggcgtcagaatcttaga

SEQ ID NO: 312939 - DNA, 25 bp, Homo sapien
gaatcttagaacgtctcaggctttt

SEQ ID NO: 312940 - DNA, 25 bp, Homo sapien
tctgttctctggaggcttccctgac

SEQ ID NO: 312941 - DNA, 25 bp, Homo sapien
acaagctaaaccactcacaagcggg

SEQ ID NO: 312942 - DNA, 25 bp, Homo sapien
cacaagcgggcccagaggaagtaaa

SEQ ID NO: 312943 - DNA, 25 bp, Homo sapien
gaacactgtggttgaaccatccttg

SEQ ID NO: 312944 - DNA, 25 bp, Homo sapien
tggttgaaccatccttggccttctg

SEQ ID NO: 312945 - DNA, 25 bp, Homo sapien
ttggccttctgcagcaaggatctgc

SEQ ID NO: 312946 - DNA, 25 bp, Homo sapien
cagcaaggatctgcaacctggaagg

SEQ ID NO: 312947 - DNA, 25 bp, Homo sapien
atgaaggctctcagagctgaggaga

SEQ ID NO: 312948 - DNA, 25 bp, Homo sapien
tgaggagaggccaggtcagaatatc

SEQ ID NO: 312949 - DNA, 25 bp, Homo sapien
aaactgcagcacctctaacacaggg

SEQ ID NO: 312950 - DNA, 25 bp, Homo sapien
acttgggagcactttttgtgggtat

SEQ ID NO: 312951 - DNA, 25 bp, Homo sapien
ggagattccaccagcaacaagctaa

SEQ ID NO: 312952 - DNA, 25 bp, Homo sapien
cagcatttactttgtacccttataa

SEQ ID NO: 312953 - DNA, 25 bp, Homo sapien
gtacccttataacatttcactcttg

SEQ ID NO: 312954 - DNA, 25 bp, Homo sapien
aacatttcactcttgacttgatttg

SEQ ID NO: 312955 - DNA, 25 bp, Homo sapien
cactcttgacttgatttgagaaaca

SEQ ID NO: 312956 - DNA, 25 bp, Homo sapien
gaatgttcttgtgttcaactaattt

SEQ ID NO: 312957 - DNA, 25 bp, Homo sapien
gtgttcaactaattttctgctgtgg

SEQ ID NO: 312958 - DNA, 25 bp, Homo sapien
tgaattctaaaatatcctgatagct

SEQ ID NO: 312959 - DNA, 25 bp, Homo sapien
tcctgatagcttcatagataagtgc

SEQ ID NO: 312960 - DNA, 25 bp, Homo sapien
gcttcatagataagtgcttttcttt

SEQ ID NO: 312961 - DNA, 25 bp, Homo sapien
ttttcttttaacatgtacctctact

SEQ ID NO: 312962 - DNA, 25 bp, Homo sapien
gtacctctacttgaatgtaagtgct

SEQ ID NO: 312963 - DNA, 25 bp, Homo sapien
gagtcatgtagtgttggcttccacc

SEQ ID NO: 312964 - DNA, 25 bp, Homo sapien
tggcttccaccccaatatgagcagg

SEQ ID NO: 312965 - DNA, 25 bp, Homo sapien
gtggttcaaagcaagcactctagaa

SEQ ID NO: 312966 - DNA, 25 bp, Homo sapien
agcactctagaataaacacacatgg

SEQ ID NO: 312967 - DNA, 25 bp, Homo sapien
gggttcaagtccagctattacctta

SEQ ID NO: 312968 - DNA, 25 bp, Homo sapien
gtccagctattaccttacttggtgg

SEQ ID NO: 312969 - DNA, 25 bp, Homo sapien
accttacttggtgggtattcatggg

SEQ ID NO: 312970 - DNA, 25 bp, Homo sapien
gtgggtattcatgggtaagttaact

SEQ ID NO: 312971 - DNA, 25 bp, Homo sapien
aacttttccaagtctgattgtaaat

SEQ ID NO: 312972 - DNA, 25 bp, Homo sapien
aactctcagcatagtgcttaccaca

SEQ ID NO: 312973 - DNA, 25 bp, Homo sapien
gtatgcaactaattacctctgtaat

SEQ ID NO: 312974 - DNA, 25 bp, Homo sapien
tggctcttttcatttatatcttcaa

SEQ ID NO: 312975 - DNA, 25 bp, Homo sapien
ttatatcttcaaaatcccttatttt

SEQ ID NO: 312976 - DNA, 25 bp, Homo sapien
tcccttattttacatttggttgtat

SEQ ID NO: 312977 - DNA, 25 bp, Homo sapien
acatttggttgtatctcttcttcct

SEQ ID NO: 312978 - DNA, 25 bp, Homo sapien
catttggttgtatctcttcttcctt

SEQ ID NO: 312979 - DNA, 25 bp, Homo sapien
ttttttcctgattttagccagtcat

SEQ ID NO: 312980 - DNA, 25 bp, Homo sapien
ttcctgattttagccagtcattcac

SEQ ID NO: 312981 - DNA, 25 bp, Homo sapien
gattttagccagtcattcacatctg

SEQ ID NO: 312982 - DNA, 25 bp, Homo sapien
tttagccagtcattcacatctgcat

SEQ ID NO: 312983 - DNA, 25 bp, Homo sapien
gagtttttaagttgctatttcagat

SEQ ID NO: 312984 - DNA, 25 bp, Homo sapien
ttaagttgctatttcagatttttta

SEQ ID NO: 312985 - DNA, 25 bp, Homo sapien
ttttctagctgttcatcttttagct

SEQ ID NO: 312986 - DNA, 25 bp, Homo sapien
gctgttcatcttttagctaaatttg

SEQ ID NO: 312987 - DNA, 25 bp, Homo sapien
gtttggtttctactaagttctggat

SEQ ID NO: 312988 - DNA, 25 bp, Homo sapien
tctactaagttctggattctggatg

SEQ ID NO: 312989 - DNA, 25 bp, Homo sapien
ttctggatgggagattgcactgtgt

SEQ ID NO: 312990 - DNA, 25 bp, Homo sapien
actgtgtgtgacatgcaagtttcat

SEQ ID NO: 312991 - DNA, 25 bp, Homo sapien
catgcaagtttcatggtgtgggaga

SEQ ID NO: 312992 - DNA, 25 bp, Homo sapien
gagattgcagagcatttgggttact

SEQ ID NO: 312993 - DNA, 25 bp, Homo sapien
tgggttactgcttttactctttgga

SEQ ID NO: 312994 - DNA, 25 bp, Homo sapien
actctttggaagctgttatcatctg

SEQ ID NO: 312995 - DNA, 25 bp, Homo sapien
gctgttatcatctgtatctgcttta

SEQ ID NO: 312996 - DNA, 25 bp, Homo sapien
tgctctgggtcatcctctgctgggc

SEQ ID NO: 312997 - DNA, 25 bp, Homo sapien
tgccattctcgctctgccgacgttg

SEQ ID NO: 312998 - DNA, 25 bp, Homo sapien
tgccgacgttgactctctctctgaa

SEQ ID NO: 312999 - DNA, 25 bp, Homo sapien
gttgactctctctctgaatccagtc

SEQ ID NO: 313000 - DNA, 25 bp, Homo sapien
agaagcccagccatgaaggcagcta

SEQ ID NO: 313001 - DNA, 25 bp, Homo sapien
tggagcccaggacctaagtccacct

SEQ ID NO: 313002 - DNA, 25 bp, Homo sapien
ggacctaagtccacctcacctagag

SEQ ID NO: 313003 - DNA, 25 bp, Homo sapien
cacctcacctagagcctggaattag

SEQ ID NO: 313004 - DNA, 25 bp, Homo sapien
attaggatcccagagttcagccagc

SEQ ID NO: 313005 - DNA, 25 bp, Homo sapien
gggtccagaactcaagagtccgcct

SEQ ID NO: 313006 - DNA, 25 bp, Homo sapien
aagagtccgcctgcttggagctgga

SEQ ID NO: 313007 - DNA, 25 bp, Homo sapien
aatacccatagcctgtatcccggat

SEQ ID NO: 313008 - DNA, 25 bp, Homo sapien
gggcattttcagtgtcgcagggacc

SEQ ID NO: 313009 - DNA, 25 bp, Homo sapien
gacctgcccaggctttagggctgct

SEQ ID NO: 313010 - DNA, 25 bp, Homo sapien
ggagtctgactccagtgcctgtcct

SEQ ID NO: 313011 - DNA, 25 bp, Homo sapien
tgtcctcttagccacagtgtgtgct

SEQ ID NO: 313012 - DNA, 25 bp, Homo sapien
gtgtgctgccccactagggacagga

SEQ ID NO: 313013 - DNA, 25 bp, Homo sapien
gtatcccggatgtaggaacactgat

SEQ ID NO: 313014 - DNA, 25 bp, Homo sapien
gtaggaacactgatggaagctgacc

SEQ ID NO: 313015 - DNA, 25 bp, Homo sapien
gaagctgacccgagtgaagtgcacc

SEQ ID NO: 313016 - DNA, 25 bp, Homo sapien
gtgccgggtggtattctgattctta

SEQ ID NO: 313017 - DNA, 25 bp, Homo sapien
gtattctgattcttacgctgcgcgc

SEQ ID NO: 313018 - DNA, 25 bp, Homo sapien
atgtgtgtactgtatctgcctttcc

SEQ ID NO: 313019 - DNA, 25 bp, Homo sapien
tgcctttccaccacatttttatgac

SEQ ID NO: 313020 - DNA, 25 bp, Homo sapien
ttatgacactgtattccactgcctg

SEQ ID NO: 313021 - DNA, 25 bp, Homo sapien
ttctttccctaggatttgtcctaca

SEQ ID NO: 313022 - DNA, 25 bp, Homo sapien
ttgtcctacagcttagtattgtggt

SEQ ID NO: 313023 - DNA, 25 bp, Homo sapien
ttgtggttgacagcgatactagggc

SEQ ID NO: 313024 - DNA, 25 bp, Homo sapien
agggctgacagcacagaagtcacaa

SEQ ID NO: 313025 - DNA, 25 bp, Homo sapien
gttcatacaatgtggcaacctcttt

SEQ ID NO: 313026 - DNA, 25 bp, Homo sapien
tgtggcaacctcttttgcatagttg

SEQ ID NO: 313027 - DNA, 25 bp, Homo sapien
tgcatagttgcgtaggatcctgttt

SEQ ID NO: 313028 - DNA, 25 bp, Homo sapien
gcgtaggatcctgtttgtaatgcta

SEQ ID NO: 313029 - DNA, 25 bp, Homo sapien
gatctttgcctgacttcacatttaa

SEQ ID NO: 313030 - DNA, 25 bp, Homo sapien
gtttcattttcttggctcttttcat

SEQ ID NO: 313031 - DNA, 25 bp, Homo sapien
tggctcttttcatttatatcttcaa

SEQ ID NO: 313032 - DNA, 25 bp, Homo sapien
ttcaaaatcccttattttacatttg

SEQ ID NO: 313033 - DNA, 25 bp, Homo sapien
catttggttgtatctcttcttcctt

SEQ ID NO: 313034 - DNA, 25 bp, Homo sapien
ttttcctgattttagccagtcattc

SEQ ID NO: 313035 - DNA, 25 bp, Homo sapien
gattttagccagtcattcacatctg

SEQ ID NO: 313036 - DNA, 25 bp, Homo sapien
tttagccagtcattcacatctgcat

SEQ ID NO: 313037 - DNA, 25 bp, Homo sapien
cacatctgcattttgtttgtccagt

SEQ ID NO: 313038 - DNA, 25 bp, Homo sapien
gagtttttaagttgctatttcagat

SEQ ID NO: 313039 - DNA, 25 bp, Homo sapien
ttaagttgctatttcagatttttta

SEQ ID NO: 313040 - DNA, 25 bp, Homo sapien
aacgtacttgattggtttccctgag

SEQ ID NO: 313041 - DNA, 25 bp, Homo sapien
gattggtttccctgagttgtgtttt

SEQ ID NO: 313042 - DNA, 25 bp, Homo sapien
gtttccctgagttgtgtttttggca

SEQ ID NO: 313043 - DNA, 25 bp, Homo sapien
gttattcatgaggaagctagcataa

SEQ ID NO: 313044 - DNA, 25 bp, Homo sapien
aacttgataagttcttgcattgagt

SEQ ID NO: 313045 - DNA, 25 bp, Homo sapien
agttcttgcattgagtgactgctaa

SEQ ID NO: 313046 - DNA, 25 bp, Homo sapien
gagtgactgctaatttgaaagtaac

SEQ ID NO: 313047 - DNA, 25 bp, Homo sapien
atgagacagatttcctttctggaac

SEQ ID NO: 313048 - DNA, 25 bp, Homo sapien
gatttcctttctggaacacttgttg

SEQ ID NO: 313049 - DNA, 25 bp, Homo sapien
aacacttgttgtttcttagtattga

SEQ ID NO: 313050 - DNA, 25 bp, Homo sapien
ggattagcaatccttttaaaaagag

SEQ ID NO: 313051 - DNA, 25 bp, Homo sapien
gggaacatttggaatgatagccttt

SEQ ID NO: 313052 - DNA, 25 bp, Homo sapien
gatagccttttagttctgtagacac

SEQ ID NO: 313053 - DNA, 25 bp, Homo sapien
ctgtagacactaaagtactgactct

SEQ ID NO: 313054 - DNA, 25 bp, Homo sapien
gtactgactctaccaaatcaatgat

SEQ ID NO: 313055 - DNA, 25 bp, Homo sapien
agaacatctgaattccatcttggag

SEQ ID NO: 313056 - DNA, 25 bp, Homo sapien
acactgcgaagtacccatcactgat

SEQ ID NO: 313057 - DNA, 25 bp, Homo sapien
ttggtgagaccttgatattctgccg

SEQ ID NO: 313058 - DNA, 25 bp, Homo sapien
tgcccattccagacttacttttggt

SEQ ID NO: 313059 - DNA, 25 bp, Homo sapien
acttttggttacaatagtgactgca

SEQ ID NO: 313060 - DNA, 25 bp, Homo sapien
tagtgactgcagtgtatgctgagac

SEQ ID NO: 313061 - DNA, 25 bp, Homo sapien
gtatgctgagactgatcaatggaaa

SEQ ID NO: 313062 - DNA, 25 bp, Homo sapien
gggaaccaagagaaccacgtagaat

SEQ ID NO: 313063 - DNA, 25 bp, Homo sapien
aaccaagagaaccacgtagaatcct

SEQ ID NO: 313064 - DNA, 25 bp, Homo sapien
gagaaccacgtagaatcctcaaccg

SEQ ID NO: 313065 - DNA, 25 bp, Homo sapien
gaaccacgtagaatcctcaaccgtg

SEQ ID NO: 313066 - DNA, 25 bp, Homo sapien
cacgtagaatcctcaaccgtgcgga

SEQ ID NO: 313067 - DNA, 25 bp, Homo sapien
cgtggtccaacgtcctgcggggcat

SEQ ID NO: 313068 - DNA, 25 bp, Homo sapien
agttgtctttttcccagccgcatcc

SEQ ID NO: 313069 - DNA, 25 bp, Homo sapien
ttgtctttttcccagccgcatcctg

SEQ ID NO: 313070 - DNA, 25 bp, Homo sapien
ctggtcctgtacgacgagctcaaga

SEQ ID NO: 313071 - DNA, 25 bp, Homo sapien
ggtcctgtacgacgagctcaagaag

SEQ ID NO: 313072 - DNA, 25 bp, Homo sapien
tcctgtacgacgagctcaagaaggt

SEQ ID NO: 313073 - DNA, 25 bp, Homo sapien
acgttccagccgtctggactctttc

SEQ ID NO: 313074 - DNA, 25 bp, Homo sapien
ggactctttctctcctactgagacg

SEQ ID NO: 313075 - DNA, 25 bp, Homo sapien
tctcctactgagacgcagcctatag

SEQ ID NO: 313076 - DNA, 25 bp, Homo sapien
ctgagacgcagcctataggtccgca

SEQ ID NO: 313077 - DNA, 25 bp, Homo sapien
gccagtcctcccaggaactgaaata

SEQ ID NO: 313078 - DNA, 25 bp, Homo sapien
gccaagaagaagtttacagcctcct

SEQ ID NO: 313079 - DNA, 25 bp, Homo sapien
gaagaagtttacagcctcctgagct

SEQ ID NO: 313080 - DNA, 25 bp, Homo sapien
ggctatgcttgaacccactgatgaa

SEQ ID NO: 313081 - DNA, 25 bp, Homo sapien
tatgcttgaacccactgatgaagag

SEQ ID NO: 313082 - DNA, 25 bp, Homo sapien
gagcctaaagaagagaaaccaccca

SEQ ID NO: 313083 - DNA, 25 bp, Homo sapien
tgttcactgggcatcttcccttcga

SEQ ID NO: 313084 - DNA, 25 bp, Homo sapien
caaaaagccagttgctctggctgtg

SEQ ID NO: 313085 - DNA, 25 bp, Homo sapien
gtgtggcttcagaggcacatttcca

SEQ ID NO: 313086 - DNA, 25 bp, Homo sapien
gaggcacatttccagttaatcagta

SEQ ID NO: 313087 - DNA, 25 bp, Homo sapien
gtacaaccaaagtcaaccaaatagt

SEQ ID NO: 313088 - DNA, 25 bp, Homo sapien
ggtacacacgtaggtttgatagatg

SEQ ID NO: 313089 - DNA, 25 bp, Homo sapien
gtttaggcttctagtgaacccatca

SEQ ID NO: 313090 - DNA, 25 bp, Homo sapien
ccatcacccaaacagcaaacatagt

SEQ ID NO: 313091 - DNA, 25 bp, Homo sapien
agtacctagttcaaagactattatc

SEQ ID NO: 313092 - DNA, 25 bp, Homo sapien
gactattatcttacttaggtagacg

SEQ ID NO: 313093 - DNA, 25 bp, Homo sapien
cttacttaggtagacgacacacgtt

SEQ ID NO: 313094 - DNA, 25 bp, Homo sapien
gacgacacacgtttaaaatatatac

SEQ ID NO: 313095 - DNA, 25 bp, Homo sapien
gttttagccaactgaaatctcccgt

SEQ ID NO: 313096 - DNA, 25 bp, Homo sapien
gaaatctcccgtgcatttttctgac

SEQ ID NO: 313097 - DNA, 25 bp, Homo sapien
atttttctgacaagccagctaggcc

SEQ ID NO: 313098 - DNA, 25 bp, Homo sapien
tgctatgctgtccttgtgtctttca

SEQ ID NO: 313099 - DNA, 25 bp, Homo sapien
gtgtctttcatttgatgaccttaag

SEQ ID NO: 313100 - DNA, 25 bp, Homo sapien
actgtatctaccctttgacactgac

SEQ ID NO: 313101 - DNA, 25 bp, Homo sapien
gacactgaccagttggcacatggtg

SEQ ID NO: 313102 - DNA, 25 bp, Homo sapien
aaatgtgaacgtacagccagtgctg

SEQ ID NO: 313103 - DNA, 25 bp, Homo sapien
gctgtgtgcgggaggactctctcct

SEQ ID NO: 313104 - DNA, 25 bp, Homo sapien
accgtgcactattaatggagcccca

SEQ ID NO: 313105 - DNA, 25 bp, Homo sapien
ccatgcagtggctcatattgaggtt

SEQ ID NO: 313106 - DNA, 25 bp, Homo sapien
ttacagaattaaaccccttcattgt

SEQ ID NO: 313107 - DNA, 25 bp, Homo sapien
ttatctgttatctaggttgtccatt

SEQ ID NO: 313108 - DNA, 25 bp, Homo sapien
gttgtccatttaccggttggacact

SEQ ID NO: 313109 - DNA, 25 bp, Homo sapien
ttaccggttggacactgatactctg

SEQ ID NO: 313110 - DNA, 25 bp, Homo sapien
ggttggacactgatactctgtcaaa

SEQ ID NO: 313111 - DNA, 25 bp, Homo sapien
gacactgatactctgtcaaattcct

SEQ ID NO: 313112 - DNA, 25 bp, Homo sapien
aaaaatgactctttagtctgctgaa

SEQ ID NO: 313113 - DNA, 25 bp, Homo sapien
gactctttagtctgctgaaatttag

SEQ ID NO: 313114 - DNA, 25 bp, Homo sapien
gctgaaatttagcactagtacttta

SEQ ID NO: 313115 - DNA, 25 bp, Homo sapien
agtactttagtgttctgatcctgga

SEQ ID NO: 313116 - DNA, 25 bp, Homo sapien
gttctgatcctggaaaattcaaggt

SEQ ID NO: 313117 - DNA, 25 bp, Homo sapien
gtgctatgaactacctattattgtt

SEQ ID NO: 313118 - DNA, 25 bp, Homo sapien
gcagggttctcaacccactctctta

SEQ ID NO: 313119 - DNA, 25 bp, Homo sapien
atttttctaagcaatggtttcacaa

SEQ ID NO: 313120 - DNA, 25 bp, Homo sapien
aaaattgtgggtttggtgtgataat

SEQ ID NO: 313121 - DNA, 25 bp, Homo sapien
aagcttgatgtgtgtagtagtcccc

SEQ ID NO: 313122 - DNA, 25 bp, Homo sapien
ggatatgttccaagatgaccagtgg

SEQ ID NO: 313123 - DNA, 25 bp, Homo sapien
actctcttactccttcaaggacgtt

SEQ ID NO: 313124 - DNA, 25 bp, Homo sapien
ctccttcaaggacgtttctgtttgt

SEQ ID NO: 313125 - DNA, 25 bp, Homo sapien
atttttgcacatttgtgtgctgcca

SEQ ID NO: 313126 - DNA, 25 bp, Homo sapien
gtgtgctgccagtgctatgaactac

SEQ ID NO: 313127 - DNA, 25 bp, Homo sapien
gctgccagtgctatgaactacctat

SEQ ID NO: 313128 - DNA, 25 bp, Homo sapien
caagcacatacatctacacccattt

SEQ ID NO: 313129 - DNA, 25 bp, Homo sapien
catacatctacacccatttctactt

SEQ ID NO: 313130 - DNA, 25 bp, Homo sapien
tttccttgtaaacccttgtatatca

SEQ ID NO: 313131 - DNA, 25 bp, Homo sapien
ccttgtatatcacattctggctggg

SEQ ID NO: 313132 - DNA, 25 bp, Homo sapien
tctggctgggtgactataaaccata

SEQ ID NO: 313133 - DNA, 25 bp, Homo sapien
ggtgactataaaccatactcctaat

SEQ ID NO: 313134 - DNA, 25 bp, Homo sapien
aaagcaaatgcctctaagactccct

SEQ ID NO: 313135 - DNA, 25 bp, Homo sapien
taagactccctcagcattgggaagc

SEQ ID NO: 313136 - DNA, 25 bp, Homo sapien
gcattgggaagctgcaagaaataca

SEQ ID NO: 313137 - DNA, 25 bp, Homo sapien
tagaaattcatttaaggcaagtgca

SEQ ID NO: 313138 - DNA, 25 bp, Homo sapien
tgcagatttgctccccagtgaagaa

SEQ ID NO: 313139 - DNA, 25 bp, Homo sapien
ggagcaatcaaatcattctgggagc

SEQ ID NO: 313140 - DNA, 25 bp, Homo sapien
ctgggagcagctacaatgggatgat

SEQ ID NO: 313141 - DNA, 25 bp, Homo sapien
agggctgttcaaggacaggcacctc

SEQ ID NO: 313142 - DNA, 25 bp, Homo sapien
atgggcctcagctactcagtggaat

SEQ ID NO: 313143 - DNA, 25 bp, Homo sapien
ggcctcagctactcagtggaataat

SEQ ID NO: 313144 - DNA, 25 bp, Homo sapien
gcctggcatatactagacatccata

SEQ ID NO: 313145 - DNA, 25 bp, Homo sapien
gacatccataagtctttgctgcatt

SEQ ID NO: 313146 - DNA, 25 bp, Homo sapien
tctttgctgcattgtatcttcttca

SEQ ID NO: 313147 - DNA, 25 bp, Homo sapien
gatacttgcagagttaggtaccagc

SEQ ID NO: 313148 - DNA, 25 bp, Homo sapien
gcagagttaggtaccagcaggtgcc

SEQ ID NO: 313149 - DNA, 25 bp, Homo sapien
ggtgccggccacatctataagtgta

SEQ ID NO: 313150 - DNA, 25 bp, Homo sapien
agaaggcttcgacgacgtcatcatc

SEQ ID NO: 313151 - DNA, 25 bp, Homo sapien
gtggctacactaaaggcgacgaggt

SEQ ID NO: 313152 - DNA, 25 bp, Homo sapien
cgccgtggccagcatgaactacgat

SEQ ID NO: 313153 - DNA, 25 bp, Homo sapien
gaactacgatcccattgtgtccaag

SEQ ID NO: 313154 - DNA, 25 bp, Homo sapien
ttgtgtccaaggtcgctgaggtgct

SEQ ID NO: 313155 - DNA, 25 bp, Homo sapien
ggcctcaggccgtgccatccggaag

SEQ ID NO: 313156 - DNA, 25 bp, Homo sapien
gagactggcgacatgtcctggctta

SEQ ID NO: 313157 - DNA, 25 bp, Homo sapien
aaaggatcctgagctcacatgcagt

SEQ ID NO: 313158 - DNA, 25 bp, Homo sapien
tgagctcacatgcagtagacttggg

SEQ ID NO: 313159 - DNA, 25 bp, Homo sapien
gagcactgtgccctactctgggacc

SEQ ID NO: 313160 - DNA, 25 bp, Homo sapien
tctgggaccgccatgtttggcaaga

SEQ ID NO: 313161 - DNA, 25 bp, Homo sapien
cactgtacaaactgaggcatctgag

SEQ ID NO: 313162 - DNA, 25 bp, Homo sapien
agagtcagtactctgtcaacccaga

SEQ ID NO: 313163 - DNA, 25 bp, Homo sapien
agagctggccacgatgtcttacttt

SEQ ID NO: 313164 - DNA, 25 bp, Homo sapien
gtcttactttcatccatcagaaggt

SEQ ID NO: 313165 - DNA, 25 bp, Homo sapien
ttcagatacatccttttccaagagt

SEQ ID NO: 313166 - DNA, 25 bp, Homo sapien
atccttttccaagagtgcagagagc

SEQ ID NO: 313167 - DNA, 25 bp, Homo sapien
gcacatttttgggtaccacttcttc

SEQ ID NO: 313168 - DNA, 25 bp, Homo sapien
tttttgggtaccacttcttcagata

SEQ ID NO: 313169 - DNA, 25 bp, Homo sapien
gaagatcaggcacaagaacatcaga

SEQ ID NO: 313170 - DNA, 25 bp, Homo sapien
gacggatatcatttccataggctca

SEQ ID NO: 313171 - DNA, 25 bp, Homo sapien
acgatgagtcggttacccggtgaag

SEQ ID NO: 313172 - DNA, 25 bp, Homo sapien
agcacaagctttatgaggaatagga

SEQ ID NO: 313173 - DNA, 25 bp, Homo sapien
ggctgttgctcttaatcctcagtgg

SEQ ID NO: 313174 - DNA, 25 bp, Homo sapien
gttgctcttaatcctcagtggaggc

SEQ ID NO: 313175 - DNA, 25 bp, Homo sapien
aggcttcaggctttaccacttagaa

SEQ ID NO: 313176 - DNA, 25 bp, Homo sapien
acttagaacgttctccagggctctg

SEQ ID NO: 313177 - DNA, 25 bp, Homo sapien
agggctctggttacctgatcagcac

SEQ ID NO: 313178 - DNA, 25 bp, Homo sapien
ctggttacctgatcagcactgaagt

SEQ ID NO: 313179 - DNA, 25 bp, Homo sapien
gcactgaagttgttcaaagggacat

SEQ ID NO: 313180 - DNA, 25 bp, Homo sapien
tattaagctactttgcctcagtggt

SEQ ID NO: 313181 - DNA, 25 bp, Homo sapien
aagctactttgcctcagtggttgca

SEQ ID NO: 313182 - DNA, 25 bp, Homo sapien
agatgaggacaagaacaccctgaga

SEQ ID NO: 313183 - DNA, 25 bp, Homo sapien
agttatttccagcacggagcagctg

SEQ ID NO: 313184 - DNA, 25 bp, Homo sapien
tttccagcacggagcagctgcccaa

SEQ ID NO: 313185 - DNA, 25 bp, Homo sapien
agctgcccaagttacctgggagatg

SEQ ID NO: 313186 - DNA, 25 bp, Homo sapien
aatcgtgtgaaagctggttaaccct

SEQ ID NO: 313187 - DNA, 25 bp, Homo sapien
gaaagctggttaaccctttgaggat

SEQ ID NO: 313188 - DNA, 25 bp, Homo sapien
gctggttaaccctttgaggattaga

SEQ ID NO: 313189 - DNA, 25 bp, Homo sapien
aaccctttgaggattagagtaatgg

SEQ ID NO: 313190 - DNA, 25 bp, Homo sapien
ggagtttcactccaggatgtacgta

SEQ ID NO: 313191 - DNA, 25 bp, Homo sapien
ttcactccaggatgtacgtaggacc

SEQ ID NO: 313192 - DNA, 25 bp, Homo sapien
aggatgtacgtaggaccagccctcc

SEQ ID NO: 313193 - DNA, 25 bp, Homo sapien
tcccgcgggaactcagtttaataat

SEQ ID NO: 313194 - DNA, 25 bp, Homo sapien
ggaaaggcttttactcagagctcac

SEQ ID NO: 313195 - DNA, 25 bp, Homo sapien
tactcagagctcacagcttcgtcaa

SEQ ID NO: 313196 - DNA, 25 bp, Homo sapien
tcagagctcacagcttcgtcaacat

SEQ ID NO: 313197 - DNA, 25 bp, Homo sapien
agctcacagcttcgtcaacatcaga

SEQ ID NO: 313198 - DNA, 25 bp, Homo sapien
tttactcagaactcacaacttttcc

SEQ ID NO: 313199 - DNA, 25 bp, Homo sapien
actcagaactcacaacttttccagc

SEQ ID NO: 313200 - DNA, 25 bp, Homo sapien
agaactcacaacttttccagcatca

SEQ ID NO: 313201 - DNA, 25 bp, Homo sapien
aactcacaacttttccagcatcaga

SEQ ID NO: 313202 - DNA, 25 bp, Homo sapien
actcacaacttttccagcatcagag

SEQ ID NO: 313203 - DNA, 25 bp, Homo sapien
ggcctttaataaatgctcaaacctt

SEQ ID NO: 313204 - DNA, 25 bp, Homo sapien
ttaataaatgctcaaaccttactcg

SEQ ID NO: 313205 - DNA, 25 bp, Homo sapien
tctgacttcgtcaaacttacacaat

SEQ ID NO: 313206 - DNA, 25 bp, Homo sapien
ttacacaattaaaggcaggcggaag

SEQ ID NO: 313207 - DNA, 25 bp, Homo sapien
gaagcaagcgggaagattctagaat

SEQ ID NO: 313208 - DNA, 25 bp, Homo sapien
gcgatagggactgtttggacctgac

SEQ ID NO: 313209 - DNA, 25 bp, Homo sapien
tctagaatggaagggagcccgccga

SEQ ID NO: 313210 - DNA, 25 bp, Homo sapien
atagggactgtttggacctgactcc

SEQ ID NO: 313211 - DNA, 25 bp, Homo sapien
gggactgtttggacctgactccaac

SEQ ID NO: 313212 - DNA, 25 bp, Homo sapien
tgtttggacctgactccaacctgcg

SEQ ID NO: 313213 - DNA, 25 bp, Homo sapien
tcctgcgcttttcctggaacccaaa

SEQ ID NO: 313214 - DNA, 25 bp, Homo sapien
tggaacccaaagctctgacttcgtc

SEQ ID NO: 313215 - DNA, 25 bp, Homo sapien
aaagctctgacttcgtcaaacttac

SEQ ID NO: 313216 - DNA, 25 bp, Homo sapien
ctgctagaattggagtctggcctca

SEQ ID NO: 313217 - DNA, 25 bp, Homo sapien
ttggagtctggcctcagctggttcc

SEQ ID NO: 313218 - DNA, 25 bp, Homo sapien
ctggttcctaccagcagtactgcca

SEQ ID NO: 313219 - DNA, 25 bp, Homo sapien
gaaccacttgtgtcctctgaaatgc

SEQ ID NO: 313220 - DNA, 25 bp, Homo sapien
acttgtgtcctctgaaatgcatatg

SEQ ID NO: 313221 - DNA, 25 bp, Homo sapien
cctgtgcctcagaatgggactatgt

SEQ ID NO: 313222 - DNA, 25 bp, Homo sapien
gcctcagaatgggactatgtttgga

SEQ ID NO: 313223 - DNA, 25 bp, Homo sapien
actgtgaaccctgatccaaattgac

SEQ ID NO: 313224 - DNA, 25 bp, Homo sapien
gatccaaattgacttatgcccttat

SEQ ID NO: 313225 - DNA, 25 bp, Homo sapien
gaaatttggccacttacactcacag

SEQ ID NO: 313226 - DNA, 25 bp, Homo sapien
ttggccacttacactcacagaggaa

SEQ ID NO: 313227 - DNA, 25 bp, Homo sapien
agcccatcttacatcacagtgccat

SEQ ID NO: 313228 - DNA, 25 bp, Homo sapien
acagtgccatgcttgacttggtctc

SEQ ID NO: 313229 - DNA, 25 bp, Homo sapien
gacttggtctccaatacatcggcac

SEQ ID NO: 313230 - DNA, 25 bp, Homo sapien
atcggcacccattggcatttggaga

SEQ ID NO: 313231 - DNA, 25 bp, Homo sapien
gaacttgctccgtagttatttgaca

SEQ ID NO: 313232 - DNA, 25 bp, Homo sapien
gttgtctgtgataatgtattctcta

SEQ ID NO: 313233 - DNA, 25 bp, Homo sapien
gtattctctatgtttccaatcgtca

SEQ ID NO: 313234 - DNA, 25 bp, Homo sapien
caatcgtcagtatgggaatctctcc

SEQ ID NO: 313235 - DNA, 25 bp, Homo sapien
acgccatggctgtgagtgtctaaca

SEQ ID NO: 313236 - DNA, 25 bp, Homo sapien
gtgtctaacataagggacgctgttt

SEQ ID NO: 313237 - DNA, 25 bp, Homo sapien
gggacgctgtttttgcaggttttgt

SEQ ID NO: 313238 - DNA, 25 bp, Homo sapien
tgacgccgccagtcccgcggtgaga

SEQ ID NO: 313239 - DNA, 25 bp, Homo sapien
tcccgcggtgagacgtgagcgccat

SEQ ID NO: 313240 - DNA, 25 bp, Homo sapien
gcgagagaaaaccacgtgcaccaaa

SEQ ID NO: 313241 - DNA, 25 bp, Homo sapien
ccattggcgtccgtggcctctgttt

SEQ ID NO: 313242 - DNA, 25 bp, Homo sapien
tccgtggcctctgtttccgtggcaa

SEQ ID NO: 313243 - DNA, 25 bp, Homo sapien
gtttccgtggcaacctagtaaccat

SEQ ID NO: 313244 - DNA, 25 bp, Homo sapien
gcaacctagtaaccattaattttca

SEQ ID NO: 313245 - DNA, 25 bp, Homo sapien
gaaaaccacgtgcaccaaactttag

SEQ ID NO: 313246 - DNA, 25 bp, Homo sapien
aaaagctcgatgacagctccaggtc

SEQ ID NO: 313247 - DNA, 25 bp, Homo sapien
aagagagcataattgtgtgtccatc

SEQ ID NO: 313248 - DNA, 25 bp, Homo sapien
aaagatggtcattccggactcctga

SEQ ID NO: 313249 - DNA, 25 bp, Homo sapien
attcacttcaataccagagccacct

SEQ ID NO: 313250 - DNA, 25 bp, Homo sapien
tgaactcatctttcctagtgcttac

SEQ ID NO: 313251 - DNA, 25 bp, Homo sapien
gtttcctatttactaagaagccata

SEQ ID NO: 313252 - DNA, 25 bp, Homo sapien
agccataccagcatgagatctcctt

SEQ ID NO: 313253 - DNA, 25 bp, Homo sapien
gcatgagatctccttgatagtgtta

SEQ ID NO: 313254 - DNA, 25 bp, Homo sapien
gatagtgttaaatcccactgtggaa

SEQ ID NO: 313255 - DNA, 25 bp, Homo sapien
atctttcctagtgcttactctcagc

SEQ ID NO: 313256 - DNA, 25 bp, Homo sapien
tcccagccttaccagaggttacgat

SEQ ID NO: 313257 - DNA, 25 bp, Homo sapien
agaagaaaaaagcaggtgcctcctc

SEQ ID NO: 313258 - DNA, 25 bp, Homo sapien
tttttccagcaccactgtctgtgtg

SEQ ID NO: 313259 - DNA, 25 bp, Homo sapien
gtctgtgtgagtccattcacttcaa

SEQ ID NO: 313260 - DNA, 25 bp, Homo sapien
caggcggaagaacgcgggctgggaa

SEQ ID NO: 313261 - DNA, 25 bp, Homo sapien
cggaagaacgcgggctgggaagcaa

SEQ ID NO: 313262 - DNA, 25 bp, Homo sapien
ggaagcaagcgggaagattctagaa

SEQ ID NO: 313263 - DNA, 25 bp, Homo sapien
gaagcaagcgggaagattctagaat

SEQ ID NO: 313264 - DNA, 25 bp, Homo sapien
aagcaagcgggaagattctagaatg

SEQ ID NO: 313265 - DNA, 25 bp, Homo sapien
gcaagcgggaagattctagaatgga

SEQ ID NO: 313266 - DNA, 25 bp, Homo sapien
tctagaatggaagggagcccgccga

SEQ ID NO: 313267 - DNA, 25 bp, Homo sapien
gaatggaagggagcccgccgagcgc

SEQ ID NO: 313268 - DNA, 25 bp, Homo sapien
gcgccaggccgggtccgatggagca

SEQ ID NO: 313269 - DNA, 25 bp, Homo sapien
gccaggccgggtccgatggagcagg

SEQ ID NO: 313270 - DNA, 25 bp, Homo sapien
gagctcgcggcctgcggagcgcccg

SEQ ID NO: 313271 - DNA, 25 bp, Homo sapien
gtagatatgtacagcaaccgcactg

SEQ ID NO: 313272 - DNA, 25 bp, Homo sapien
agatatgtacagcaaccgcactggg

SEQ ID NO: 313273 - DNA, 25 bp, Homo sapien
atatgtacagcaaccgcactgggat

SEQ ID NO: 313274 - DNA, 25 bp, Homo sapien
tgtacagcaaccgcactgggatggg

SEQ ID NO: 313275 - DNA, 25 bp, Homo sapien
ggatggggtagttttgcctgtaatt

SEQ ID NO: 313276 - DNA, 25 bp, Homo sapien
ttaaactccagtttccacacttgca

SEQ ID NO: 313277 - DNA, 25 bp, Homo sapien
taaactccagtttccacacttgcat

SEQ ID NO: 313278 - DNA, 25 bp, Homo sapien
aactccagtttccacacttgcatct

SEQ ID NO: 313279 - DNA, 25 bp, Homo sapien
cagtttccacacttgcatcttgcaa

SEQ ID NO: 313280 - DNA, 25 bp, Homo sapien
gtttccacacttgcatcttgcaatg

SEQ ID NO: 313281 - DNA, 25 bp, Homo sapien
cacacttgcatcttgcaatgttggt

SEQ ID NO: 313282 - DNA, 25 bp, Homo sapien
aatgtccagcattgatgtattttct

SEQ ID NO: 313283 - DNA, 25 bp, Homo sapien
cagcattgatgtattttctttaaga

SEQ ID NO: 313284 - DNA, 25 bp, Homo sapien
tacagtatataagcattctttggga

SEQ ID NO: 313285 - DNA, 25 bp, Homo sapien
gcattctttgggaatacagtataaa

SEQ ID NO: 313286 - DNA, 25 bp, Homo sapien
ttttgttcaaggatgaatcttccct

SEQ ID NO: 313287 - DNA, 25 bp, Homo sapien
ttctcttaatttcgtgtttccttgc

SEQ ID NO: 313288 - DNA, 25 bp, Homo sapien
taatttcgtgtttccttgcacataa

SEQ ID NO: 313289 - DNA, 25 bp, Homo sapien
ttcgtgtttccttgcacataatagc

SEQ ID NO: 313290 - DNA, 25 bp, Homo sapien
ttgcacataatagcactgcccctaa

SEQ ID NO: 313291 - DNA, 25 bp, Homo sapien
acataatagcactgcccctaacttc

SEQ ID NO: 313292 - DNA, 25 bp, Homo sapien
tcagagatgctgattgcagttaaaa

SEQ ID NO: 313293 - DNA, 25 bp, Homo sapien
gacaactctgaatctttgaaagtat

SEQ ID NO: 313294 - DNA, 25 bp, Homo sapien
gaatgagcagctacaatctaaagaa

SEQ ID NO: 313295 - DNA, 25 bp, Homo sapien
tgaggacagaggtggaaactcagca

SEQ ID NO: 313296 - DNA, 25 bp, Homo sapien
gatgaggaatttaaatccaccttca

SEQ ID NO: 313297 - DNA, 25 bp, Homo sapien
aatccaccttcatcaaactgggagg

SEQ ID NO: 313298 - DNA, 25 bp, Homo sapien
ccttcatcaaactgggaggtggaaa

SEQ ID NO: 313299 - DNA, 25 bp, Homo sapien
gtggaaaagttgagctgtgacctga

SEQ ID NO: 313300 - DNA, 25 bp, Homo sapien
agttgagctgtgacctgaagatcca

SEQ ID NO: 313301 - DNA, 25 bp, Homo sapien
gatccatggtttggaacaagagctg

SEQ ID NO: 313302 - DNA, 25 bp, Homo sapien
gaaagccaaacaaacggatccatat

SEQ ID NO: 313303 - DNA, 25 bp, Homo sapien
ggatccatatcaggaagacaatctg

SEQ ID NO: 313304 - DNA, 25 bp, Homo sapien
ggcactaactttatcctgtcgtatg

SEQ ID NO: 313305 - DNA, 25 bp, Homo sapien
atcctgtcgtatgtcactgtggaaa

SEQ ID NO: 313306 - DNA, 25 bp, Homo sapien
actgtggaaagcactcttcagagcc

SEQ ID NO: 313307 - DNA, 25 bp, Homo sapien
acacttgttttctcactgtggagta

SEQ ID NO: 313308 - DNA, 25 bp, Homo sapien
gagtacatctgtgttggtgacttca

SEQ ID NO: 313309 - DNA, 25 bp, Homo sapien
ggtgacttcagctaaacctgttccc

SEQ ID NO: 313310 - DNA, 25 bp, Homo sapien
gttccccagggataaatgcaacagc

SEQ ID NO: 313311 - DNA, 25 bp, Homo sapien
atgcaacagcccatacaaaatcagg

SEQ ID NO: 313312 - DNA, 25 bp, Homo sapien
ggacacagtccaacaacttcgtgta

SEQ ID NO: 313313 - DNA, 25 bp, Homo sapien
agacagaggagcactacggccaagt

SEQ ID NO: 313314 - DNA, 25 bp, Homo sapien
tacggccaagtgtccttttatgata

SEQ ID NO: 313315 - DNA, 25 bp, Homo sapien
atacctgtcattgtacatatgtcca

SEQ ID NO: 313316 - DNA, 25 bp, Homo sapien
tgtcattgtacatatgtccaacccc

SEQ ID NO: 313317 - DNA, 25 bp, Homo sapien
tacatatgtccaaccccctaaaatg

SEQ ID NO: 313318 - DNA, 25 bp, Homo sapien
gtaggttcatcaattactgcaaatg

SEQ ID NO: 313319 - DNA, 25 bp, Homo sapien
attactgcaaatgtacctctttggt

SEQ ID NO: 313320 - DNA, 25 bp, Homo sapien
ctgcaaatgtacctctttggtggga

SEQ ID NO: 313321 - DNA, 25 bp, Homo sapien
caaatgtacctctttggtgggagat

SEQ ID NO: 313322 - DNA, 25 bp, Homo sapien
gtacctctttggtgggagatgttga

SEQ ID NO: 313323 - DNA, 25 bp, Homo sapien
cctctttggtgggagatgttgaaaa

SEQ ID NO: 313324 - DNA, 25 bp, Homo sapien
gagactatgcatgtgtggggacaac

SEQ ID NO: 313325 - DNA, 25 bp, Homo sapien
gggacaacaactatatgggaaatct

SEQ ID NO: 313326 - DNA, 25 bp, Homo sapien
atgcaacatgccctttcgacccacc

SEQ ID NO: 313327 - DNA, 25 bp, Homo sapien
tcaccaataaataatctgcacttcc

SEQ ID NO: 313328 - DNA, 25 bp, Homo sapien
accaataaataatctgcacttccag

SEQ ID NO: 313329 - DNA, 25 bp, Homo sapien
aataatctgcacttccagagctcgg

SEQ ID NO: 313330 - DNA, 25 bp, Homo sapien
ataatctgcacttccagagctcggg

SEQ ID NO: 313331 - DNA, 25 bp, Homo sapien
ccacaacctggtgttgggtccgata

SEQ ID NO: 313332 - DNA, 25 bp, Homo sapien
cacaacctggtgttgggtccgataa

SEQ ID NO: 313333 - DNA, 25 bp, Homo sapien
tgttgggtccgataaccccaacatc

SEQ ID NO: 313334 - DNA, 25 bp, Homo sapien
tgggtccgataaccccaacatccct

SEQ ID NO: 313335 - DNA, 25 bp, Homo sapien
gataaccccaacatccctgaatctc

SEQ ID NO: 313336 - DNA, 25 bp, Homo sapien
tccagactgtctgcccatacacctg

SEQ ID NO: 313337 - DNA, 25 bp, Homo sapien
ttctatgggaacatggcttgaagcc

SEQ ID NO: 313338 - DNA, 25 bp, Homo sapien
acatctgaacaccaacttagctacc

SEQ ID NO: 313339 - DNA, 25 bp, Homo sapien
agctaccaagtgaggtcaagtgcct

SEQ ID NO: 313340 - DNA, 25 bp, Homo sapien
gtcaagtgcctgaaaagtactgtat

SEQ ID NO: 313341 - DNA, 25 bp, Homo sapien
aagcatgttttccttatgtaaaaga

SEQ ID NO: 313342 - DNA, 25 bp, Homo sapien
ttatggcaatgcataccaggctttc

SEQ ID NO: 313343 - DNA, 25 bp, Homo sapien
ataccaggctttcacctgctagaaa

SEQ ID NO: 313344 - DNA, 25 bp, Homo sapien
tcacctgctagaaacatacttgttg

SEQ ID NO: 313345 - DNA, 25 bp, Homo sapien
atacttgttgccaactttgccatct

SEQ ID NO: 313346 - DNA, 25 bp, Homo sapien
aactttgccatctaccactattctc

SEQ ID NO: 313347 - DNA, 25 bp, Homo sapien
actattctcctccttagaacaggta

SEQ ID NO: 313348 - DNA, 25 bp, Homo sapien
actggaaggccgacgagctcagcat

SEQ ID NO: 313349 - DNA, 25 bp, Homo sapien
acgagctcagcatgcgactcggtga

SEQ ID NO: 313350 - DNA, 25 bp, Homo sapien
atgcgactcggtgacggaccaggct

SEQ ID NO: 313351 - DNA, 25 bp, Homo sapien
tcggcagggccggtgtactttttgt

SEQ ID NO: 313352 - DNA, 25 bp, Homo sapien
tggttgtcattggtgtgttgttgca

SEQ ID NO: 313353 - DNA, 25 bp, Homo sapien
tgttgttgcacattccaggacgtca

SEQ ID NO: 313354 - DNA, 25 bp, Homo sapien
ggacgtcagtattttaacaggttct

SEQ ID NO: 313355 - DNA, 25 bp, Homo sapien
ttctaagtgcctttctatcgtagct

SEQ ID NO: 313356 - DNA, 25 bp, Homo sapien
tctatcgtagcttatgttttcctcc

SEQ ID NO: 313357 - DNA, 25 bp, Homo sapien
tcttggctccattgctgttagcata

SEQ ID NO: 313358 - DNA, 25 bp, Homo sapien
tataacaatatattcctccatggga

SEQ ID NO: 313359 - DNA, 25 bp, Homo sapien
gaaccactcctggttcagagaggca

SEQ ID NO: 313360 - DNA, 25 bp, Homo sapien
ggttcagagaggcagctcccagaac

SEQ ID NO: 313361 - DNA, 25 bp, Homo sapien
ggcaagctgaaagaggaatgacttc

SEQ ID NO: 313362 - DNA, 25 bp, Homo sapien
gaaggagccagaaatctggaccagc

SEQ ID NO: 313363 - DNA, 25 bp, Homo sapien
aagcctctgggctggtagccacagt

SEQ ID NO: 313364 - DNA, 25 bp, Homo sapien
ctctgggctggtagccacagtgttt

SEQ ID NO: 313365 - DNA, 25 bp, Homo sapien
ctggtagccacagtgtttggaagca

SEQ ID NO: 313366 - DNA, 25 bp, Homo sapien
cacagtgtttggaagcaggcttcct

SEQ ID NO: 313367 - DNA, 25 bp, Homo sapien
tcctccggagtctccgcaggctgga

SEQ ID NO: 313368 - DNA, 25 bp, Homo sapien
aggagacgaacccaggagagtagct

SEQ ID NO: 313369 - DNA, 25 bp, Homo sapien
gggagccggaaccactcctggttca

SEQ ID NO: 313370 - DNA, 25 bp, Homo sapien
actacgtggccgtcaacaatcccaa

SEQ ID NO: 313371 - DNA, 25 bp, Homo sapien
tacgtggccgtcaacaatcccaaga

SEQ ID NO: 313372 - DNA, 25 bp, Homo sapien
aacaatcccaagaagcaggaatgaa

SEQ ID NO: 313373 - DNA, 25 bp, Homo sapien
gcaggaatgaaagtggcgctttctc

SEQ ID NO: 313374 - DNA, 25 bp, Homo sapien
aggaatgaaagtggcgctttctccg

SEQ ID NO: 313375 - DNA, 25 bp, Homo sapien
ggaatgaaagtggcgctttctccgc

SEQ ID NO: 313376 - DNA, 25 bp, Homo sapien
gttccaggacatagtctgaggcaag

SEQ ID NO: 313377 - DNA, 25 bp, Homo sapien
ttccaggacatagtctgaggcaaga

SEQ ID NO: 313378 - DNA, 25 bp, Homo sapien
tccaggacatagtctgaggcaagat

SEQ ID NO: 313379 - DNA, 25 bp, Homo sapien
ccaggacatagtctgaggcaagatg

SEQ ID NO: 313380 - DNA, 25 bp, Homo sapien
aggacatagtctgaggcaagatgga

SEQ ID NO: 313381 - DNA, 25 bp, Homo sapien
atgcaacatgccctttcgacccacc

SEQ ID NO: 313382 - DNA, 25 bp, Homo sapien
tgcaacatgccctttcgacccaccc

SEQ ID NO: 313383 - DNA, 25 bp, Homo sapien
tcaccaataaataatctgcacttcc

SEQ ID NO: 313384 - DNA, 25 bp, Homo sapien
caccaataaataatctgcacttcca

SEQ ID NO: 313385 - DNA, 25 bp, Homo sapien
accaataaataatctgcacttccag

SEQ ID NO: 313386 - DNA, 25 bp, Homo sapien
ccaataaataatctgcacttccaga

SEQ ID NO: 313387 - DNA, 25 bp, Homo sapien
caataaataatctgcacttccagag

SEQ ID NO: 313388 - DNA, 25 bp, Homo sapien
accccaacatccctgaatctccacc

SEQ ID NO: 313389 - DNA, 25 bp, Homo sapien
aacatccctgaatctccacccacct

SEQ ID NO: 313390 - DNA, 25 bp, Homo sapien
ctgccctccagactgtctgcccata

SEQ ID NO: 313391 - DNA, 25 bp, Homo sapien
gccctccagactgtctgcccataca

SEQ ID NO: 313392 - DNA, 25 bp, Homo sapien
gagaaagccttgaaagaagcataca

SEQ ID NO: 313393 - DNA, 25 bp, Homo sapien
aagccttgaaagaagcatacaatag

SEQ ID NO: 313394 - DNA, 25 bp, Homo sapien
atagaaagacagacaaatcagtgga

SEQ ID NO: 313395 - DNA, 25 bp, Homo sapien
gacaaatcagtggaggaattaaaac

SEQ ID NO: 313396 - DNA, 25 bp, Homo sapien
gtttataaaacagagcccaatcctt

SEQ ID NO: 313397 - DNA, 25 bp, Homo sapien
taaaacagagcccaatccttgcctt

SEQ ID NO: 313398 - DNA, 25 bp, Homo sapien
aaacagagcccaatccttgccttct

SEQ ID NO: 313399 - DNA, 25 bp, Homo sapien
ctctccctccactcaaatagaaaag

SEQ ID NO: 313400 - DNA, 25 bp, Homo sapien
gagaaagaaggtattaggctacagt

SEQ ID NO: 313401 - DNA, 25 bp, Homo sapien
ttaggctacagtttataagagagat

SEQ ID NO: 313402 - DNA, 25 bp, Homo sapien
gggtcacatttggagaaatatctga

SEQ ID NO: 313403 - DNA, 25 bp, Homo sapien
tacccagtcatcagtgggagtgaat

SEQ ID NO: 313404 - DNA, 25 bp, Homo sapien
acccagtcatcagtgggagtgaatc

SEQ ID NO: 313405 - DNA, 25 bp, Homo sapien
cccagtcatcagtgggagtgaatca

SEQ ID NO: 313406 - DNA, 25 bp, Homo sapien
ccagtcatcagtgggagtgaatcag

SEQ ID NO: 313407 - DNA, 25 bp, Homo sapien
agtcatcagtgggagtgaatcagta

SEQ ID NO: 313408 - DNA, 25 bp, Homo sapien
gtcatcagtgggagtgaatcagtag

SEQ ID NO: 313409 - DNA, 25 bp, Homo sapien
tcatcagtgggagtgaatcagtagg

SEQ ID NO: 313410 - DNA, 25 bp, Homo sapien
catcagtgggagtgaatcagtagga

SEQ ID NO: 313411 - DNA, 25 bp, Homo sapien
atcagtgggagtgaatcagtaggaa

SEQ ID NO: 313412 - DNA, 25 bp, Homo sapien
tcagtgggagtgaatcagtaggaat

SEQ ID NO: 313413 - DNA, 25 bp, Homo sapien
agtgggagtgaatcagtaggaatgt

SEQ ID NO: 313414 - DNA, 25 bp, Homo sapien
ttcgttcattcctggctatctagaa

SEQ ID NO: 313415 - DNA, 25 bp, Homo sapien
gttcattcctggctatctagaaaaa

SEQ ID NO: 313416 - DNA, 25 bp, Homo sapien
aaagtcagtggtatgcctttatact

SEQ ID NO: 313417 - DNA, 25 bp, Homo sapien
atgcctttatacttttacctgttat

SEQ ID NO: 313418 - DNA, 25 bp, Homo sapien
atacttttacctgttatctggaaga

SEQ ID NO: 313419 - DNA, 25 bp, Homo sapien
atttttctttattcatgagctttgt

SEQ ID NO: 313420 - DNA, 25 bp, Homo sapien
atgagctttgtagattagaatggta

SEQ ID NO: 313421 - DNA, 25 bp, Homo sapien
attagaatggtaatgatgctcatca

SEQ ID NO: 313422 - DNA, 25 bp, Homo sapien
gaaatgtgtttgtgactttagctaa

SEQ ID NO: 313423 - DNA, 25 bp, Homo sapien
gtattccatagtactgtgaaatcta

SEQ ID NO: 313424 - DNA, 25 bp, Homo sapien
gaaatctatgtagttaatctcaata

SEQ ID NO: 313425 - DNA, 25 bp, Homo sapien
tggcagtagcagtccctgcactagg

SEQ ID NO: 313426 - DNA, 25 bp, Homo sapien
gtagcagtccctgcactaggtcaga

SEQ ID NO: 313427 - DNA, 25 bp, Homo sapien
agtccctgcactaggtcagacaatc

SEQ ID NO: 313428 - DNA, 25 bp, Homo sapien
attcaggccagagttgtgggccgcc

SEQ ID NO: 313429 - DNA, 25 bp, Homo sapien
actaggtcagacaatcccctttggg

SEQ ID NO: 313430 - DNA, 25 bp, Homo sapien
agcaggaggagtttgaggtccctac

SEQ ID NO: 313431 - DNA, 25 bp, Homo sapien
gggcctgaattgaccataaaggatg

SEQ ID NO: 313432 - DNA, 25 bp, Homo sapien
gccgccgtcggcagcaagaacagag

SEQ ID NO: 313433 - DNA, 25 bp, Homo sapien
aacagagagagaggtggacagatct

SEQ ID NO: 313434 - DNA, 25 bp, Homo sapien
gacagatctgagagatactgagatt

SEQ ID NO: 313435 - DNA, 25 bp, Homo sapien
tgagattaaaaggagcccaagcccc

SEQ ID NO: 313436 - DNA, 25 bp, Homo sapien
ttaggccttgagatgtttgacacac

SEQ ID NO: 313437 - DNA, 25 bp, Homo sapien
gacacagacagacttaaactttttc

SEQ ID NO: 313438 - DNA, 25 bp, Homo sapien
tttttcttagacagtagccctcatc

SEQ ID NO: 313439 - DNA, 25 bp, Homo sapien
atctgcctctgggaagtattctgaa

SEQ ID NO: 313440 - DNA, 25 bp, Homo sapien
tgaaacactccagcttttccgtgag

SEQ ID NO: 313441 - DNA, 25 bp, Homo sapien
gcttttccgtgagtactgattcatc

SEQ ID NO: 313442 - DNA, 25 bp, Homo sapien
gacccaaactgaaggagtctccact

SEQ ID NO: 313443 - DNA, 25 bp, Homo sapien
gaaggagtctccactgctaaaaata

SEQ ID NO: 313444 - DNA, 25 bp, Homo sapien
aacacagaccatgagttctgggttt

SEQ ID NO: 313445 - DNA, 25 bp, Homo sapien
agcttgttcttcaccagcaacgaaa

SEQ ID NO: 313446 - DNA, 25 bp, Homo sapien
cagacagcaatggatgactttcttc

SEQ ID NO: 313447 - DNA, 25 bp, Homo sapien
agtcttggtcatctccgactggcgg

SEQ ID NO: 313448 - DNA, 25 bp, Homo sapien
cgactggcggcgctaggatttcccc

SEQ ID NO: 313449 - DNA, 25 bp, Homo sapien
ctgtgtcttgatgggttcctccaac

SEQ ID NO: 313450 - DNA, 25 bp, Homo sapien
aacactcactttgtatcgataaacg

SEQ ID NO: 313451 - DNA, 25 bp, Homo sapien
atcgataaacgaccctgcagttctt

SEQ ID NO: 313452 - DNA, 25 bp, Homo sapien
agttcttcacgacctgcattgcgct

SEQ ID NO: 313453 - DNA, 25 bp, Homo sapien
gctggcagtcctgagtgaagaactc

SEQ ID NO: 313454 - DNA, 25 bp, Homo sapien
tcctgagtgaagaactctcctctca

SEQ ID NO: 313455 - DNA, 25 bp, Homo sapien
cccagagatgggaaacctggatctg

SEQ ID NO: 313456 - DNA, 25 bp, Homo sapien
tggatctgagactgccagctagctg

SEQ ID NO: 313457 - DNA, 25 bp, Homo sapien
gcggcctcctagtctgtaaagcgaa

SEQ ID NO: 313458 - DNA, 25 bp, Homo sapien
aatgacatccaagtttaccagtaga

SEQ ID NO: 313459 - DNA, 25 bp, Homo sapien
gatgcacagaatgggcatgaccttc

SEQ ID NO: 313460 - DNA, 25 bp, Homo sapien
agctcacgagcacacctggagaaat

SEQ ID NO: 313461 - DNA, 25 bp, Homo sapien
aaccaggttctgaatcatcacgatt

SEQ ID NO: 313462 - DNA, 25 bp, Homo sapien
gaatcatcacgattgccttttgcat

SEQ ID NO: 313463 - DNA, 25 bp, Homo sapien
gccttttgcatgaaaacatcggctg

SEQ ID NO: 313464 - DNA, 25 bp, Homo sapien
catcggctggtgatgtgacttctct

SEQ ID NO: 313465 - DNA, 25 bp, Homo sapien
atgtgacttctcttcaggccatgag

SEQ ID NO: 313466 - DNA, 25 bp, Homo sapien
atgcccgctgcagtaatggacgttt

SEQ ID NO: 313467 - DNA, 25 bp, Homo sapien
gtacaaaatgctttgagtctttccg

SEQ ID NO: 313468 - DNA, 25 bp, Homo sapien
agtctttccgattgctcattaattc

SEQ ID NO: 313469 - DNA, 25 bp, Homo sapien
gatctgccacatgtctgagggttgc

SEQ ID NO: 313470 - DNA, 25 bp, Homo sapien
atgtctgagggttgcagagcccgct

SEQ ID NO: 313471 - DNA, 25 bp, Homo sapien
cagagcccgctgtggaggtaagatt

SEQ ID NO: 313472 - DNA, 25 bp, Homo sapien
aagattggaaacacatgaggcagag

SEQ ID NO: 313473 - DNA, 25 bp, Homo sapien
aaacatctctgctggaatatttgga

SEQ ID NO: 313474 - DNA, 25 bp, Homo sapien
agaacactcttctggacctggttga

SEQ ID NO: 313475 - DNA, 25 bp, Homo sapien
aacactcttctggacctggttgaag

SEQ ID NO: 313476 - DNA, 25 bp, Homo sapien
aatgcttttgaatgttcttagtgat

SEQ ID NO: 313477 - DNA, 25 bp, Homo sapien
gaaggagattgttgacccagtgacc

SEQ ID NO: 313478 - DNA, 25 bp, Homo sapien
cccagtgacctggagttgaggctca

SEQ ID NO: 313479 - DNA, 25 bp, Homo sapien
aggctcagggagagatctgccacat

SEQ ID NO: 313480 - DNA, 25 bp, Homo sapien
atggctaaaatgcaacaggtggaca

SEQ ID NO: 313481 - DNA, 25 bp, Homo sapien
atgcaacaggtggacaataccaatt

SEQ ID NO: 313482 - DNA, 25 bp, Homo sapien
caataccaattgtcggcaaggatgt

SEQ ID NO: 313483 - DNA, 25 bp, Homo sapien
ccaattgtcggcaaggatgtaaaaa

SEQ ID NO: 313484 - DNA, 25 bp, Homo sapien
aacagcacaatggttttagaaaact

SEQ ID NO: 313485 - DNA, 25 bp, Homo sapien
tagaaaactgttgggcagtttctta

SEQ ID NO: 313486 - DNA, 25 bp, Homo sapien
aatatacagctaccataaaacctag

SEQ ID NO: 313487 - DNA, 25 bp, Homo sapien
cataaaacctagcaattctactcct

SEQ ID NO: 313488 - DNA, 25 bp, Homo sapien
tgtccacaaaaatccctgtacaaga

SEQ ID NO: 313489 - DNA, 25 bp, Homo sapien
aatagccccacagaaacagctcagg

SEQ ID NO: 313490 - DNA, 25 bp, Homo sapien
gggtccatgaacagaaggatagcta

SEQ ID NO: 313491 - DNA, 25 bp, Homo sapien
gtaatcccaactagataggctttat

SEQ ID NO: 313492 - DNA, 25 bp, Homo sapien
taggctttatgctcacatcattgtc

SEQ ID NO: 313493 - DNA, 25 bp, Homo sapien
ttatgctcacatcattgtcccatac

SEQ ID NO: 313494 - DNA, 25 bp, Homo sapien
ggtctagatgagacttggaaggcaa

SEQ ID NO: 313495 - DNA, 25 bp, Homo sapien
gaaggcaaggagcatcgaaatttga

SEQ ID NO: 313496 - DNA, 25 bp, Homo sapien
gaaatttgagatacccaggaccctt

SEQ ID NO: 313497 - DNA, 25 bp, Homo sapien
cccaggaccctttcaagcaagaatg

SEQ ID NO: 313498 - DNA, 25 bp, Homo sapien
gaccctttcaagcaagaatggccaa

SEQ ID NO: 313499 - DNA, 25 bp, Homo sapien
aaattattttcagcctccttgtcat

SEQ ID NO: 313500 - DNA, 25 bp, Homo sapien
ttattttcagcctccttgtcatata

SEQ ID NO: 313501 - DNA, 25 bp, Homo sapien
tcagcctccttgtcatataatcatt

SEQ ID NO: 313502 - DNA, 25 bp, Homo sapien
agatctgacctctgccgcatagcag

SEQ ID NO: 313503 - DNA, 25 bp, Homo sapien
tgccgcatagcagccgtgtgacctt

SEQ ID NO: 313504 - DNA, 25 bp, Homo sapien
gatcctgatgcaggactcacaggcc

SEQ ID NO: 313505 - DNA, 25 bp, Homo sapien
caagtcacttgtcccctctgtggag

SEQ ID NO: 313506 - DNA, 25 bp, Homo sapien
gccaccccaagtcatgtattctgga

SEQ ID NO: 313507 - DNA, 25 bp, Homo sapien
tcatgtattctggagctgtggtgag

SEQ ID NO: 313508 - DNA, 25 bp, Homo sapien
ggtgagggttagatgtctcagaaaa

SEQ ID NO: 313509 - DNA, 25 bp, Homo sapien
gggcagctgccgttgggctaaaaat

SEQ ID NO: 313510 - DNA, 25 bp, Homo sapien
aaaatgcagagagccctgagttcag

SEQ ID NO: 313511 - DNA, 25 bp, Homo sapien
agagccctgagttcagatctgacct

SEQ ID NO: 313512 - DNA, 25 bp, Homo sapien
tgagttcagatctgacctctgccgc

SEQ ID NO: 313513 - DNA, 25 bp, Homo sapien
ggcaaaacctggacctccaattaag

SEQ ID NO: 313514 - DNA, 25 bp, Homo sapien
gcaaaacctggacctccaattaagt

SEQ ID NO: 313515 - DNA, 25 bp, Homo sapien
aacctggacctccaattaagtatag

SEQ ID NO: 313516 - DNA, 25 bp, Homo sapien
cctggacctccaattaagtatagta

SEQ ID NO: 313517 - DNA, 25 bp, Homo sapien
ggacctccaattaagtatagtattt

SEQ ID NO: 313518 - DNA, 25 bp, Homo sapien
gtatagtatttctctgaatcttagg

SEQ ID NO: 313519 - DNA, 25 bp, Homo sapien
tctgaatcttaggatctttaataaa

SEQ ID NO: 313520 - DNA, 25 bp, Homo sapien
gaatgcagtgcagtgacatgctcat

SEQ ID NO: 313521 - DNA, 25 bp, Homo sapien
atgcagtgcagtgacatgctcatgg

SEQ ID NO: 313522 - DNA, 25 bp, Homo sapien
gcagctttgaccttctgggttcaaa

SEQ ID NO: 313523 - DNA, 25 bp, Homo sapien
tgggttcaaacaatcctgacacctc

SEQ ID NO: 313524 - DNA, 25 bp, Homo sapien
gtgggaaatattccagttttaggct

SEQ ID NO: 313525 - DNA, 25 bp, Homo sapien
tccagttttaggctaccagctgttt

SEQ ID NO: 313526 - DNA, 25 bp, Homo sapien
ttaggctaccagctgtttaaacagt

SEQ ID NO: 313527 - DNA, 25 bp, Homo sapien
taaacagtttggttcaaatccttca

SEQ ID NO: 313528 - DNA, 25 bp, Homo sapien
aaatctcaaaacataactccacata

SEQ ID NO: 313529 - DNA, 25 bp, Homo sapien
taactccacatatgtatttactaca

SEQ ID NO: 313530 - DNA, 25 bp, Homo sapien
tgtatttactacatattgaagggtg

SEQ ID NO: 313531 - DNA, 25 bp, Homo sapien
atattgaagggtgtattcacttgga

SEQ ID NO: 313532 - DNA, 25 bp, Homo sapien
aaagcaaacagatgccaatggcctt

SEQ ID NO: 313533 - DNA, 25 bp, Homo sapien
gatgccaatggcctttttgaaaaca

SEQ ID NO: 313534 - DNA, 25 bp, Homo sapien
gaaaacatgtatctatcagcaataa

SEQ ID NO: 313535 - DNA, 25 bp, Homo sapien
cggtgtgtcctgcagacctgaagcc

SEQ ID NO: 313536 - DNA, 25 bp, Homo sapien
ggtgtgtcctgcagacctgaagcca

SEQ ID NO: 313537 - DNA, 25 bp, Homo sapien
gtgtgtcctgcagacctgaagccaa

SEQ ID NO: 313538 - DNA, 25 bp, Homo sapien
tgtgtcctgcagacctgaagccaag

SEQ ID NO: 313539 - DNA, 25 bp, Homo sapien
gtgtcctgcagacctgaagccaaga

SEQ ID NO: 313540 - DNA, 25 bp, Homo sapien
tgtcctgcagacctgaagccaagat

SEQ ID NO: 313541 - DNA, 25 bp, Homo sapien
gtcctgcagacctgaagccaagatc

SEQ ID NO: 313542 - DNA, 25 bp, Homo sapien
tcctgcagacctgaagccaagatca

SEQ ID NO: 313543 - DNA, 25 bp, Homo sapien
cctgcagacctgaagccaagatcaa

SEQ ID NO: 313544 - DNA, 25 bp, Homo sapien
tacatgctgatcgaggttgtgccat

SEQ ID NO: 313545 - DNA, 25 bp, Homo sapien
tgatcgaggttgtgccatttgggct

SEQ ID NO: 313546 - DNA, 25 bp, Homo sapien
gccatttgggctacctgtggagcaa

SEQ ID NO: 313547 - DNA, 25 bp, Homo sapien
gctacctgtggagcaaggtcgttgt

SEQ ID NO: 313548 - DNA, 25 bp, Homo sapien
agcaaggtcgttgtgtcagcgcgtt

SEQ ID NO: 313549 - DNA, 25 bp, Homo sapien
gtcagcgcgttgtttatggttactt

SEQ ID NO: 313550 - DNA, 25 bp, Homo sapien
ttatggttacttgtctctcagaaca

SEQ ID NO: 313551 - DNA, 25 bp, Homo sapien
agaacaattgttctctcctaccttg

SEQ ID NO: 313552 - DNA, 25 bp, Homo sapien
ctccctggtggttatcaagactcca

SEQ ID NO: 313553 - DNA, 25 bp, Homo sapien
agactccacaaatatccagtgcctc

SEQ ID NO: 313554 - DNA, 25 bp, Homo sapien
ccagtgcctcttgcgctttaggata

SEQ ID NO: 313555 - DNA, 25 bp, Homo sapien
agtttgaggccagctagagtgacat

SEQ ID NO: 313556 - DNA, 25 bp, Homo sapien
gtttgaggccagctagagtgacata

SEQ ID NO: 313557 - DNA, 25 bp, Homo sapien
tttgaggccagctagagtgacatag

SEQ ID NO: 313558 - DNA, 25 bp, Homo sapien
ttgaggccagctagagtgacatagc

SEQ ID NO: 313559 - DNA, 25 bp, Homo sapien
tgaggccagctagagtgacatagca

SEQ ID NO: 313560 - DNA, 25 bp, Homo sapien
gaggccagctagagtgacatagcaa

SEQ ID NO: 313561 - DNA, 25 bp, Homo sapien
aggccagctagagtgacatagcaag

SEQ ID NO: 313562 - DNA, 25 bp, Homo sapien
catagcaagactccgatgctacaaa

SEQ ID NO: 313563 - DNA, 25 bp, Homo sapien
gcaagactccgatgctacaaaaaag

SEQ ID NO: 313564 - DNA, 25 bp, Homo sapien
gagatcgccgccctgcgttccagtc

SEQ ID NO: 313565 - DNA, 25 bp, Homo sapien
ccgccctgcgttccagtctgggcaa

SEQ ID NO: 313566 - DNA, 25 bp, Homo sapien
cggtgtgtcctgcagacctgaagcc

SEQ ID NO: 313567 - DNA, 25 bp, Homo sapien
ggtgtgtcctgcagacctgaagcca

SEQ ID NO: 313568 - DNA, 25 bp, Homo sapien
gtgtgtcctgcagacctgaagccaa

SEQ ID NO: 313569 - DNA, 25 bp, Homo sapien
tgtgtcctgcagacctgaagccaag

SEQ ID NO: 313570 - DNA, 25 bp, Homo sapien
gtgtcctgcagacctgaagccaaga

SEQ ID NO: 313571 - DNA, 25 bp, Homo sapien
tgtcctgcagacctgaagccaagat

SEQ ID NO: 313572 - DNA, 25 bp, Homo sapien
gtcctgcagacctgaagccaagatc

SEQ ID NO: 313573 - DNA, 25 bp, Homo sapien
cctgcagacctgaagccaagatcaa

SEQ ID NO: 313574 - DNA, 25 bp, Homo sapien
tgcagacctgaagccaagatcaagg

SEQ ID NO: 313575 - DNA, 25 bp, Homo sapien
atcagtgttctgcaacttttctacc

SEQ ID NO: 313576 - DNA, 25 bp, Homo sapien
aacttttctacccagtcatcagtgg

SEQ ID NO: 313577 - DNA, 25 bp, Homo sapien
attttcctccacgtgaccaaatgag

SEQ ID NO: 313578 - DNA, 25 bp, Homo sapien
atttttcagactttttccacattag

SEQ ID NO: 313579 - DNA, 25 bp, Homo sapien
cacattagttgggaagcaaacccct

SEQ ID NO: 313580 - DNA, 25 bp, Homo sapien
ggcaatgtcagttattaagctttag

SEQ ID NO: 313581 - DNA, 25 bp, Homo sapien
ttagggaaccacatgccactttagg

SEQ ID NO: 313582 - DNA, 25 bp, Homo sapien
tgccactttaggtaacacatgattg

SEQ ID NO: 313583 - DNA, 25 bp, Homo sapien
gattgaagagtgaagtccctgcttt

SEQ ID NO: 313584 - DNA, 25 bp, Homo sapien
gtccctgctttaaagtgtactcctg

SEQ ID NO: 313585 - DNA, 25 bp, Homo sapien
aagtgtactcctgtggacacagtaa

SEQ ID NO: 313586 - DNA, 25 bp, Homo sapien
ggtatatttctatctaaatactctg

SEQ ID NO: 313587 - DNA, 25 bp, Homo sapien
aatactctgtagcttttgtgattca

SEQ ID NO: 313588 - DNA, 25 bp, Homo sapien
gtacttggatgccaaatacaccaaa

SEQ ID NO: 313589 - DNA, 25 bp, Homo sapien
atacaccaaaatgaacccagcactt

SEQ ID NO: 313590 - DNA, 25 bp, Homo sapien
aaatgaacccagcactttgatggca

SEQ ID NO: 313591 - DNA, 25 bp, Homo sapien
actagttattctttccagtaatagc

SEQ ID NO: 313592 - DNA, 25 bp, Homo sapien
cagtaatagcatctgggaactaaaa

SEQ ID NO: 313593 - DNA, 25 bp, Homo sapien
gctaatgagtaaactgaagcccaga

SEQ ID NO: 313594 - DNA, 25 bp, Homo sapien
aatgacttgcctaggttctcttagc

SEQ ID NO: 313595 - DNA, 25 bp, Homo sapien
taggttctcttagcagtcctgtgca

SEQ ID NO: 313596 - DNA, 25 bp, Homo sapien
cttagcagtcctgtgcagacacttt

SEQ ID NO: 313597 - DNA, 25 bp, Homo sapien
cttcctttccatcatcaagataaaa

SEQ ID NO: 313598 - DNA, 25 bp, Homo sapien
aactgttaatttgtacttggatgcc

SEQ ID NO: 313599 - DNA, 25 bp, Homo sapien
cagatagctaaattcttaatcctaa

SEQ ID NO: 313600 - DNA, 25 bp, Homo sapien
cccttaattctgtctgtagtgttat

SEQ ID NO: 313601 - DNA, 25 bp, Homo sapien
aattctgtctgtagtgttatatcaa

SEQ ID NO: 313602 - DNA, 25 bp, Homo sapien
ctgtagtgttatatcaagacttttt

SEQ ID NO: 313603 - DNA, 25 bp, Homo sapien
actttttgatagtcatgaaactgag

SEQ ID NO: 313604 - DNA, 25 bp, Homo sapien
ttcctgtggttaataacacctttat

SEQ ID NO: 313605 - DNA, 25 bp, Homo sapien
taataacacctttattttgaacaga

SEQ ID NO: 313606 - DNA, 25 bp, Homo sapien
attttgaacagagtactcttaagca

SEQ ID NO: 313607 - DNA, 25 bp, Homo sapien
gtactcttaagcaacttatattgtg

SEQ ID NO: 313608 - DNA, 25 bp, Homo sapien
ctgtgcatattttttaccctgttgt

SEQ ID NO: 313609 - DNA, 25 bp, Homo sapien
gcatattttttaccctgttgtttat

SEQ ID NO: 313610 - DNA, 25 bp, Homo sapien
taattaaagaattcggccaatctgg

SEQ ID NO: 313611 - DNA, 25 bp, Homo sapien
aagaattcggccaatctggattggt

SEQ ID NO: 313612 - DNA, 25 bp, Homo sapien
ttcccatcttccttattcccaaaat

SEQ ID NO: 313613 - DNA, 25 bp, Homo sapien
atctggattggtatgtttcttccca

SEQ ID NO: 313614 - DNA, 25 bp, Homo sapien
ggtatgtttcttcccagttatgtct

SEQ ID NO: 313615 - DNA, 25 bp, Homo sapien
atgtttcttcccagttatgtcttta

SEQ ID NO: 313616 - DNA, 25 bp, Homo sapien
gtttcttcccagttatgtctttaag

SEQ ID NO: 313617 - DNA, 25 bp, Homo sapien
ttcccagttatgtctttaaggccta

SEQ ID NO: 313618 - DNA, 25 bp, Homo sapien
ttatgtctttaaggcctaagaccag

SEQ ID NO: 313619 - DNA, 25 bp, Homo sapien
gaccagacactctactgccctgtgc

SEQ ID NO: 313620 - DNA, 25 bp, Homo sapien
tgtgcctgcctttggagcttgagcg

SEQ ID NO: 313621 - DNA, 25 bp, Homo sapien
atccaggctccgaaattttctcttg

SEQ ID NO: 313622 - DNA, 25 bp, Homo sapien
cctcagcctccatgaaacggagatt

SEQ ID NO: 313623 - DNA, 25 bp, Homo sapien
gaaacggagatttcgcttcctcccg

SEQ ID NO: 313624 - DNA, 25 bp, Homo sapien
agaaagacggctcccttattattcg

SEQ ID NO: 313625 - DNA, 25 bp, Homo sapien
ggctcccttattattcgttcggatt

SEQ ID NO: 313626 - DNA, 25 bp, Homo sapien
cgttcggattattattgtggatttg

SEQ ID NO: 313627 - DNA, 25 bp, Homo sapien
gtgggtttttcttccacaccagact

SEQ ID NO: 313628 - DNA, 25 bp, Homo sapien
cagactcctggaaaatccgatcgcc

SEQ ID NO: 313629 - DNA, 25 bp, Homo sapien
ctgattctcagacccagcctacgtt

SEQ ID NO: 313630 - DNA, 25 bp, Homo sapien
gttcggcctttttctgaaagacaat

SEQ ID NO: 313631 - DNA, 25 bp, Homo sapien
caatttcctgagttagttctgctgt

SEQ ID NO: 313632 - DNA, 25 bp, Homo sapien
ggcaaaacctggacctccaattaag

SEQ ID NO: 313633 - DNA, 25 bp, Homo sapien
gcaaaacctggacctccaattaagt

SEQ ID NO: 313634 - DNA, 25 bp, Homo sapien
aacctggacctccaattaagtatag

SEQ ID NO: 313635 - DNA, 25 bp, Homo sapien
cctggacctccaattaagtatagta

SEQ ID NO: 313636 - DNA, 25 bp, Homo sapien
ggacctccaattaagtatagtattt

SEQ ID NO: 313637 - DNA, 25 bp, Homo sapien
gtatagtatttctctgaatcttagg

SEQ ID NO: 313638 - DNA, 25 bp, Homo sapien
tatagtatttctctgaatcttagga

SEQ ID NO: 313639 - DNA, 25 bp, Homo sapien
tctgaatcttaggatctttaataaa

SEQ ID NO: 313640 - DNA, 25 bp, Homo sapien
gaatgcagtgcagtgacatgctcat

SEQ ID NO: 313641 - DNA, 25 bp, Homo sapien
atgcagtgcagtgacatgctcatgg

SEQ ID NO: 313642 - DNA, 25 bp, Homo sapien
caaacaatcctgacacctcagccac

SEQ ID NO: 313643 - DNA, 25 bp, Homo sapien
ggaaggaacttctcatctatttgga

SEQ ID NO: 313644 - DNA, 25 bp, Homo sapien
ggaacttctcatctatttggaaatg

SEQ ID NO: 313645 - DNA, 25 bp, Homo sapien
ggaaatgattctctgaggtcccgct

SEQ ID NO: 313646 - DNA, 25 bp, Homo sapien
gaaatgattctctgaggtcccgctg

SEQ ID NO: 313647 - DNA, 25 bp, Homo sapien
ctgaggtcccgctggaaagagtttt

SEQ ID NO: 313648 - DNA, 25 bp, Homo sapien
tgaggtcccgctggaaagagtttta

SEQ ID NO: 313649 - DNA, 25 bp, Homo sapien
aaaatttactctggccaaaatgcct

SEQ ID NO: 313650 - DNA, 25 bp, Homo sapien
atttactctggccaaaatgccttcc

SEQ ID NO: 313651 - DNA, 25 bp, Homo sapien
tttactctggccaaaatgccttcct

SEQ ID NO: 313652 - DNA, 25 bp, Homo sapien
gccttccttgttgtcaaatcagcac

SEQ ID NO: 313653 - DNA, 25 bp, Homo sapien
gtcaaatcagcacaaagttaaggtt

SEQ ID NO: 313654 - DNA, 25 bp, Homo sapien
tcctgggagcctcacggacgctgtc

SEQ ID NO: 313655 - DNA, 25 bp, Homo sapien
ggacgctgtctctggccctagacaa

SEQ ID NO: 313656 - DNA, 25 bp, Homo sapien
ggccctagacaaccctaacgaggag

SEQ ID NO: 313657 - DNA, 25 bp, Homo sapien
acaaccctaacgaggaggtggcaga

SEQ ID NO: 313658 - DNA, 25 bp, Homo sapien
agaagtgaagatctcccacttcccg

SEQ ID NO: 313659 - DNA, 25 bp, Homo sapien
ggcttcagtgtgtcgcagcgctgtt

SEQ ID NO: 313660 - DNA, 25 bp, Homo sapien
gtcgcagcgctgtttcgtgttgcag

SEQ ID NO: 313661 - DNA, 25 bp, Homo sapien
tgtttcgtgttgcagcctaaagaga

SEQ ID NO: 313662 - DNA, 25 bp, Homo sapien
gttatttctgttaactggacaccac

SEQ ID NO: 313663 - DNA, 25 bp, Homo sapien
aactggacaccactcaaagaaggcc

SEQ ID NO: 313664 - DNA, 25 bp, Homo sapien
caaagaaggccgagtaagagagatt

SEQ ID NO: 313665 - DNA, 25 bp, Homo sapien
gtataatcattcttagactgttgac

SEQ ID NO: 313666 - DNA, 25 bp, Homo sapien
tagactgttgacatggctgtggaaa

SEQ ID NO: 313667 - DNA, 25 bp, Homo sapien
gggaatgtactcatcccctcttctt

SEQ ID NO: 313668 - DNA, 25 bp, Homo sapien
ccaccaaagaggcttcttgttgcag

SEQ ID NO: 313669 - DNA, 25 bp, Homo sapien
aaagaggcttcttgttgcagccctc

SEQ ID NO: 313670 - DNA, 25 bp, Homo sapien
gttgcagccctcagtatctggatat

SEQ ID NO: 313671 - DNA, 25 bp, Homo sapien
gcagccctcagtatctggatatggg

SEQ ID NO: 313672 - DNA, 25 bp, Homo sapien
aaggaagggaaagagcaatgctgct

SEQ ID NO: 313673 - DNA, 25 bp, Homo sapien
caatgctgctgtgcttcaatcctgg

SEQ ID NO: 313674 - DNA, 25 bp, Homo sapien
gctgctgtgcttcaatcctggcctt

SEQ ID NO: 313675 - DNA, 25 bp, Homo sapien
aatcctttgaacttgtagaacatct

SEQ ID NO: 313676 - DNA, 25 bp, Homo sapien
gtgctacttagtgaatctcaccaga

SEQ ID NO: 313677 - DNA, 25 bp, Homo sapien
gaatagaatacatgacaagtccctt

SEQ ID NO: 313678 - DNA, 25 bp, Homo sapien
gacaagtcccttactaaaactggag

SEQ ID NO: 313679 - DNA, 25 bp, Homo sapien
agtatattaaagcttggcctgcata

SEQ ID NO: 313680 - DNA, 25 bp, Homo sapien
agcttggcctgcatatttataaaca

SEQ ID NO: 313681 - DNA, 25 bp, Homo sapien
agtattgctaagttgctcttattgt

SEQ ID NO: 313682 - DNA, 25 bp, Homo sapien
tgctcttattgtgtagaactttccc

SEQ ID NO: 313683 - DNA, 25 bp, Homo sapien
atctggtaccaaatgaatgcgtttt

SEQ ID NO: 313684 - DNA, 25 bp, Homo sapien
aatgaatgcgtttttccacatccac

SEQ ID NO: 313685 - DNA, 25 bp, Homo sapien
cacatccacctgtatgcttgtgagt

SEQ ID NO: 313686 - DNA, 25 bp, Homo sapien
atgcttgtgagttctagtgctactt

SEQ ID NO: 313687 - DNA, 25 bp, Homo sapien
atgtagttcggtggatcatccagca

SEQ ID NO: 313688 - DNA, 25 bp, Homo sapien
gcagtagagccagagccatagtaaa

SEQ ID NO: 313689 - DNA, 25 bp, Homo sapien
ttgctcttagcaacttgagtcttac

SEQ ID NO: 313690 - DNA, 25 bp, Homo sapien
gttcagtttagtagccattttcttt

SEQ ID NO: 313691 - DNA, 25 bp, Homo sapien
aggctgtagtggttccgaaatgaaa

SEQ ID NO: 313692 - DNA, 25 bp, Homo sapien
ttccgaaatgaaaattaggccctga

SEQ ID NO: 313693 - DNA, 25 bp, Homo sapien
ggccctgattttatgtaagatgatg

SEQ ID NO: 313694 - DNA, 25 bp, Homo sapien
agtgatttagacatcttacacagtt

SEQ ID NO: 313695 - DNA, 25 bp, Homo sapien
tacacagttactgagcacctggtac

SEQ ID NO: 313696 - DNA, 25 bp, Homo sapien
gagcacctggtacagtgaagatctc

SEQ ID NO: 313697 - DNA, 25 bp, Homo sapien
agatctctcaagaatgatttgtgtg

SEQ ID NO: 313698 - DNA, 25 bp, Homo sapien
tgtaccagggcttcagtgtctccgt

SEQ ID NO: 313699 - DNA, 25 bp, Homo sapien
tcagtgtctccgtgcagggcatcat

SEQ ID NO: 313700 - DNA, 25 bp, Homo sapien
agggcatcatcatctaccgggcggc

SEQ ID NO: 313701 - DNA, 25 bp, Homo sapien
taccgggcggcctacttcggcgtgt

SEQ ID NO: 313702 - DNA, 25 bp, Homo sapien
tacttcggcgtgtacgatacggcca

SEQ ID NO: 313703 - DNA, 25 bp, Homo sapien
tacgatacggccaagggcatgctcc

SEQ ID NO: 313704 - DNA, 25 bp, Homo sapien
aacacgcacatcgtggtgagctgga

SEQ ID NO: 313705 - DNA, 25 bp, Homo sapien
tgagctggatgatcgcgcagaccgt

SEQ ID NO: 313706 - DNA, 25 bp, Homo sapien
gatgatcgcgcagaccgtgacggcc

SEQ ID NO: 313707 - DNA, 25 bp, Homo sapien
tgacatcatgtacacgggcaccgtc

SEQ ID NO: 313708 - DNA, 25 bp, Homo sapien
gcaccgtcgactgttggaggaagat

SEQ ID NO: 313709 - DNA, 25 bp, Homo sapien
gaaaattttccttatggcatcagtc

SEQ ID NO: 313710 - DNA, 25 bp, Homo sapien
ttttccttatggcatcagtcttctc

SEQ ID NO: 313711 - DNA, 25 bp, Homo sapien
atggcatcagtcttctctgacagat

SEQ ID NO: 313712 - DNA, 25 bp, Homo sapien
gtcttctctgacagattgcagcttc

SEQ ID NO: 313713 - DNA, 25 bp, Homo sapien
cataagcccttaataaaatacccat

SEQ ID NO: 313714 - DNA, 25 bp, Homo sapien
aatacccattacatgtagttgaagt

SEQ ID NO: 313715 - DNA, 25 bp, Homo sapien
aaatccccagaaattcagaatacat

SEQ ID NO: 313716 - DNA, 25 bp, Homo sapien
gaatacatgaatataggctgacatt

SEQ ID NO: 313717 - DNA, 25 bp, Homo sapien
cattaaagcagatgtacgtctcgtg

SEQ ID NO: 313718 - DNA, 25 bp, Homo sapien
agcagatgtacgtctcgtgcagaac

SEQ ID NO: 313719 - DNA, 25 bp, Homo sapien
gtacgtctcgtgcagaacacacagt

SEQ ID NO: 313720 - DNA, 25 bp, Homo sapien
gccaagcggctacgttcttctcggc

SEQ ID NO: 313721 - DNA, 25 bp, Homo sapien
gcagaccagcatctcagacatgtcg

SEQ ID NO: 313722 - DNA, 25 bp, Homo sapien
gaccagcatctcagacatgtcgaaa

SEQ ID NO: 313723 - DNA, 25 bp, Homo sapien
gcatctcagacatgtcgaaaaagat

SEQ ID NO: 313724 - DNA, 25 bp, Homo sapien
tttgatccctaaaataatgagagaa

SEQ ID NO: 313725 - DNA, 25 bp, Homo sapien
aaggccaaagagaggtgttctgaac

SEQ ID NO: 313726 - DNA, 25 bp, Homo sapien
gagaggtgttctgaacaagttcaag

SEQ ID NO: 313727 - DNA, 25 bp, Homo sapien
aactctggagttcttatggtagtaa

SEQ ID NO: 313728 - DNA, 25 bp, Homo sapien
gttcttatggtagtaaaatgccgga

SEQ ID NO: 313729 - DNA, 25 bp, Homo sapien
taaaatgccggaaagaaaattctgc

SEQ ID NO: 313730 - DNA, 25 bp, Homo sapien
ggtcgcacgtgcgtccgagcccaag

SEQ ID NO: 313731 - DNA, 25 bp, Homo sapien
gggcatactaccagcagccaggaaa

SEQ ID NO: 313732 - DNA, 25 bp, Homo sapien
gatccgagctgcagggcacgagcct

SEQ ID NO: 313733 - DNA, 25 bp, Homo sapien
agcctcatctgcttgctcgacaggg

SEQ ID NO: 313734 - DNA, 25 bp, Homo sapien
gggatcctgctagatggtgataaag

SEQ ID NO: 313735 - DNA, 25 bp, Homo sapien
aggcaagtttctgcttcaggtcttc

SEQ ID NO: 313736 - DNA, 25 bp, Homo sapien
caagtccctttttactgaggacact

SEQ ID NO: 313737 - DNA, 25 bp, Homo sapien
ttactgaggacactttcttcctgga

SEQ ID NO: 313738 - DNA, 25 bp, Homo sapien
ggccactggctttggtcagggcaac

SEQ ID NO: 313739 - DNA, 25 bp, Homo sapien
ttggtcagggcaacatcagagctct

SEQ ID NO: 313740 - DNA, 25 bp, Homo sapien
tcagagctctgtggcagtccgtaca

SEQ ID NO: 313741 - DNA, 25 bp, Homo sapien
agtccgtacaggagcaatctgccag

SEQ ID NO: 313742 - DNA, 25 bp, Homo sapien
aattattgactgtgcaaactgtgac

SEQ ID NO: 313743 - DNA, 25 bp, Homo sapien
gtgcaaactgtgactcagtggatat

SEQ ID NO: 313744 - DNA, 25 bp, Homo sapien
gactcagtggatatttgtatgcccc

SEQ ID NO: 313745 - DNA, 25 bp, Homo sapien
attctcattgtagttaagttactgt

SEQ ID NO: 313746 - DNA, 25 bp, Homo sapien
agttactgttagtttggtgcaatac

SEQ ID NO: 313747 - DNA, 25 bp, Homo sapien
ttagtttggtgcaatacattctttc

SEQ ID NO: 313748 - DNA, 25 bp, Homo sapien
gtacttggaaattgtgctgctactt

SEQ ID NO: 313749 - DNA, 25 bp, Homo sapien
attgtgctgctacttaaatattgaa

SEQ ID NO: 313750 - DNA, 25 bp, Homo sapien
aaatgttccttctcacttattctac

SEQ ID NO: 313751 - DNA, 25 bp, Homo sapien
gttccttctcacttattctactgga

SEQ ID NO: 313752 - DNA, 25 bp, Homo sapien
attctactggaattgaccatgaaaa

SEQ ID NO: 313753 - DNA, 25 bp, Homo sapien
cgtaatattttgatggtaactgact

SEQ ID NO: 313754 - DNA, 25 bp, Homo sapien
gatggtaactgacttatttagattt

SEQ ID NO: 313755 - DNA, 25 bp, Homo sapien
gtattcacaagtttacctctgagtt

SEQ ID NO: 313756 - DNA, 25 bp, Homo sapien
tacctctgagtttatttgcatacca

SEQ ID NO: 313757 - DNA, 25 bp, Homo sapien
gagtttatttgcataccatagttta

SEQ ID NO: 313758 - DNA, 25 bp, Homo sapien
taccatagtttactgggtgttccta

SEQ ID NO: 313759 - DNA, 25 bp, Homo sapien
gggtgttcctatttaaatctatttg

SEQ ID NO: 313760 - DNA, 25 bp, Homo sapien
caaattgagtcatacttgctgatta

SEQ ID NO: 313761 - DNA, 25 bp, Homo sapien
ttaaattaccagaggagtgcttttt

SEQ ID NO: 313762 - DNA, 25 bp, Homo sapien
ccagaggagtgctttttaatatgcc

SEQ ID NO: 313763 - DNA, 25 bp, Homo sapien
atatgcctaggttttgtatgtttaa

SEQ ID NO: 313764 - DNA, 25 bp, Homo sapien
gtgcagccagtaggactttataagt

SEQ ID NO: 313765 - DNA, 25 bp, Homo sapien
gactttataagtcttagtgcctgac

SEQ ID NO: 313766 - DNA, 25 bp, Homo sapien
gtcttagtgcctgaccatttaaaaa

SEQ ID NO: 313767 - DNA, 25 bp, Homo sapien
aattgtgatgtttgtggcccttttt

SEQ ID NO: 313768 - DNA, 25 bp, Homo sapien
gacagtaggtcatcgtacttatcac

SEQ ID NO: 313769 - DNA, 25 bp, Homo sapien
gtacttatcacgtcttttccattct

SEQ ID NO: 313770 - DNA, 25 bp, Homo sapien
tttccattctcatgtttctgtacac

SEQ ID NO: 313771 - DNA, 25 bp, Homo sapien
tttctgtacacaaggagctggcatc

SEQ ID NO: 313772 - DNA, 25 bp, Homo sapien
ttttgaatgctacttttccttctct

SEQ ID NO: 313773 - DNA, 25 bp, Homo sapien
ttccttctctaaaaactgaccatga

SEQ ID NO: 313774 - DNA, 25 bp, Homo sapien
aaactgaccatgaattatattctca

SEQ ID NO: 313775 - DNA, 25 bp, Homo sapien
tctagataactcaccatttcatttc

SEQ ID NO: 313776 - DNA, 25 bp, Homo sapien
ctcaccatttcatttctgtatcaaa

SEQ ID NO: 313777 - DNA, 25 bp, Homo sapien
gtatcaaattaagtagccctgggtc

SEQ ID NO: 313778 - DNA, 25 bp, Homo sapien
tcaaattaagtagccctgggtcttt

SEQ ID NO: 313779 - DNA, 25 bp, Homo sapien
aagtagccctgggtcttttgctata

SEQ ID NO: 313780 - DNA, 25 bp, Homo sapien
agccctgggtcttttgctatatatt

SEQ ID NO: 313781 - DNA, 25 bp, Homo sapien
cctctctgcacattactgcaagatt

SEQ ID NO: 313782 - DNA, 25 bp, Homo sapien
tttccttaagggtctgttctccaga

SEQ ID NO: 313783 - DNA, 25 bp, Homo sapien
ttaagggtctgttctccagaaattc

SEQ ID NO: 313784 - DNA, 25 bp, Homo sapien
cagaaattcccttattcactgcctg

SEQ ID NO: 313785 - DNA, 25 bp, Homo sapien
agaaattcccttattcactgcctgc

SEQ ID NO: 313786 - DNA, 25 bp, Homo sapien
gattggttggattgcatatctctgt

SEQ ID NO: 313787 - DNA, 25 bp, Homo sapien
gcatatctctgtgaatgggactcaa

SEQ ID NO: 313788 - DNA, 25 bp, Homo sapien
aatgctggaccagatgacccttgca

SEQ ID NO: 313789 - DNA, 25 bp, Homo sapien
cagatgacccttgcaatcatggtgc

SEQ ID NO: 313790 - DNA, 25 bp, Homo sapien
tgcacagaattaaaaccgtcaagtt

SEQ ID NO: 313791 - DNA, 25 bp, Homo sapien
gttccccatccatctctgagatgga

SEQ ID NO: 313792 - DNA, 25 bp, Homo sapien
ggatgagaatctgagtcttccacaa

SEQ ID NO: 313793 - DNA, 25 bp, Homo sapien
tgagtcttccacaagatgcccaaga

SEQ ID NO: 313794 - DNA, 25 bp, Homo sapien
tgcccaagacttgttaaacccgtgg

SEQ ID NO: 313795 - DNA, 25 bp, Homo sapien
aaagcccttgttgcaggctatgctt

SEQ ID NO: 313796 - DNA, 25 bp, Homo sapien
ggaacccaggccaagacactaaaat

SEQ ID NO: 313797 - DNA, 25 bp, Homo sapien
atcctctgttagtcatccctagtgt

SEQ ID NO: 313798 - DNA, 25 bp, Homo sapien
ttagtcatccctagtgtgttagtgg

SEQ ID NO: 313799 - DNA, 25 bp, Homo sapien
atatactctggttgcttcatctaaa

SEQ ID NO: 313800 - DNA, 25 bp, Homo sapien
gcacttggacttacacactattgag

SEQ ID NO: 313801 - DNA, 25 bp, Homo sapien
gacttacacactattgaggttctgg

SEQ ID NO: 313802 - DNA, 25 bp, Homo sapien
gaggttctggattaattcaagcatt

SEQ ID NO: 313803 - DNA, 25 bp, Homo sapien
ctggattaattcaagcattcatgct

SEQ ID NO: 313804 - DNA, 25 bp, Homo sapien
ctctggttgcttcatctaaaaacat

SEQ ID NO: 313805 - DNA, 25 bp, Homo sapien
ggttgaaatcttttactttgagagt

SEQ ID NO: 313806 - DNA, 25 bp, Homo sapien
aacataaacccagcagttacaaagg

SEQ ID NO: 313807 - DNA, 25 bp, Homo sapien
aaaataatcgatcctctgttagtca

SEQ ID NO: 313808 - DNA, 25 bp, Homo sapien
cctccgaggaatgcagttgccagtg

SEQ ID NO: 313809 - DNA, 25 bp, Homo sapien
cagtgtgcaaaatgggcctggtggt

SEQ ID NO: 313810 - DNA, 25 bp, Homo sapien
aataggaagtgcatctaaatcggat

SEQ ID NO: 313811 - DNA, 25 bp, Homo sapien
ctaaatcggatgaaagcagtactga

SEQ ID NO: 313812 - DNA, 25 bp, Homo sapien
gcagtactgaggagactgataaatc

SEQ ID NO: 313813 - DNA, 25 bp, Homo sapien
gagatctcagtgtggtgtgaaagct

SEQ ID NO: 313814 - DNA, 25 bp, Homo sapien
taataaagcttctagtaccacacct

SEQ ID NO: 313815 - DNA, 25 bp, Homo sapien
gcttctagtaccacacctaaaggga

SEQ ID NO: 313816 - DNA, 25 bp, Homo sapien
gtaccacacctaaagggaattcaag

SEQ ID NO: 313817 - DNA, 25 bp, Homo sapien
caatggaaatagtggctctaacagc

SEQ ID NO: 313818 - DNA, 25 bp, Homo sapien
atagtggctctaacagcaacaaagc

SEQ ID NO: 313819 - DNA, 25 bp, Homo sapien
tggatatatcttttatacatcaaat

SEQ ID NO: 313820 - DNA, 25 bp, Homo sapien
tatacatcaaataggactgcttcca

SEQ ID NO: 313821 - DNA, 25 bp, Homo sapien
aaataggactgcttccaaactagaa

SEQ ID NO: 313822 - DNA, 25 bp, Homo sapien
ggactgcttccaaactagaaataat

SEQ ID NO: 313823 - DNA, 25 bp, Homo sapien
gaaaattctattaattgctttttag

SEQ ID NO: 313824 - DNA, 25 bp, Homo sapien
ttactgtgactttaggtaaaaactg

SEQ ID NO: 313825 - DNA, 25 bp, Homo sapien
ggtaaaaactgacaactttctacat

SEQ ID NO: 313826 - DNA, 25 bp, Homo sapien
aaaactgacaactttctacatacga

SEQ ID NO: 313827 - DNA, 25 bp, Homo sapien
gacaactttctacatacgaatttta

SEQ ID NO: 313828 - DNA, 25 bp, Homo sapien
taaatagtattcatctgtcattgct

SEQ ID NO: 313829 - DNA, 25 bp, Homo sapien
tacacagagctttaaaatacatgca

SEQ ID NO: 313830 - DNA, 25 bp, Homo sapien
ctttgtcaaagctattactccaggt

SEQ ID NO: 313831 - DNA, 25 bp, Homo sapien
ttactccaggttgtagtgctttttt

SEQ ID NO: 313832 - DNA, 25 bp, Homo sapien
tttttctactttactttgatctaag

SEQ ID NO: 313833 - DNA, 25 bp, Homo sapien
tgatctaagtcctgtctttccttca

SEQ ID NO: 313834 - DNA, 25 bp, Homo sapien
ccttcaaattttggctacttattgc

SEQ ID NO: 313835 - DNA, 25 bp, Homo sapien
ggctacttattgcatgaagcttttt

SEQ ID NO: 313836 - DNA, 25 bp, Homo sapien
ccattcttggtggtaattttagtct

SEQ ID NO: 313837 - DNA, 25 bp, Homo sapien
gaattcctgaagtactacctaattg

SEQ ID NO: 313838 - DNA, 25 bp, Homo sapien
acttggatcatgttatcttgtatta

SEQ ID NO: 313839 - DNA, 25 bp, Homo sapien
actccattaatatatcctcggccgg

SEQ ID NO: 313840 - DNA, 25 bp, Homo sapien
ttaatatatcctcggccgggtgcag

SEQ ID NO: 313841 - DNA, 25 bp, Homo sapien
aagtctgctcagttaggtcacatgc

SEQ ID NO: 313842 - DNA, 25 bp, Homo sapien
cagttaggtcacatgctccagaggc

SEQ ID NO: 313843 - DNA, 25 bp, Homo sapien
tgctccagaggcactcactgcaaaa

SEQ ID NO: 313844 - DNA, 25 bp, Homo sapien
ctcactgcaaaagagcctgaagatt

SEQ ID NO: 313845 - DNA, 25 bp, Homo sapien
ccatcggctttgctgagtatgaatg

SEQ ID NO: 313846 - DNA, 25 bp, Homo sapien
gagagaagtcaagccctctaggtga

SEQ ID NO: 313847 - DNA, 25 bp, Homo sapien
aagccctctaggtgataggcaggaa

SEQ ID NO: 313848 - DNA, 25 bp, Homo sapien
aaatcttggtttgctcagacgggcc

SEQ ID NO: 313849 - DNA, 25 bp, Homo sapien
gacgggcctggattatacttacgtt

SEQ ID NO: 313850 - DNA, 25 bp, Homo sapien
gaggagggctgcacagcacacagta

SEQ ID NO: 313851 - DNA, 25 bp, Homo sapien
agtaggcggcacaaaagtctgctca

SEQ ID NO: 313852 - DNA, 25 bp, Homo sapien
gagcctgaagtcagagacagctcag

SEQ ID NO: 313853 - DNA, 25 bp, Homo sapien
tggctcgggcccttccctggacttt

SEQ ID NO: 313854 - DNA, 25 bp, Homo sapien
cccggggtcaggtaagtagcctcag

SEQ ID NO: 313855 - DNA, 25 bp, Homo sapien
tcctccatttttgcttctctgggtc

SEQ ID NO: 313856 - DNA, 25 bp, Homo sapien
ttctctgggtctgtcttcgtccatg

SEQ ID NO: 313857 - DNA, 25 bp, Homo sapien
gggtctgtcttcgtccatgcctgct

SEQ ID NO: 313858 - DNA, 25 bp, Homo sapien
tgggaccaccgccctctggtgtttt

SEQ ID NO: 313859 - DNA, 25 bp, Homo sapien
ttggccagagcttctgttcaggcgc

SEQ ID NO: 313860 - DNA, 25 bp, Homo sapien
agagcttctgttcaggcgctctcca

SEQ ID NO: 313861 - DNA, 25 bp, Homo sapien
tgttcaggcgctctccatgaaagca

SEQ ID NO: 313862 - DNA, 25 bp, Homo sapien
ccctggaaaactgagcctgaagtca

SEQ ID NO: 313863 - DNA, 25 bp, Homo sapien
attataggtgttaccactgaccccg

SEQ ID NO: 313864 - DNA, 25 bp, Homo sapien
tgaccccgaaggtaagatttactgt

SEQ ID NO: 313865 - DNA, 25 bp, Homo sapien
ttttgttttagtctcaagggcaatt

SEQ ID NO: 313866 - DNA, 25 bp, Homo sapien
gaatgatcaagttggctgtcagaac

SEQ ID NO: 313867 - DNA, 25 bp, Homo sapien
tacaaaccaggatgtctaagagcag

SEQ ID NO: 313868 - DNA, 25 bp, Homo sapien
aagagcagaagtccgtggttgccac

SEQ ID NO: 313869 - DNA, 25 bp, Homo sapien
aagtccgtggttgccacctctcaag

SEQ ID NO: 313870 - DNA, 25 bp, Homo sapien
acctctcaagcctcttagcttaatc

SEQ ID NO: 313871 - DNA, 25 bp, Homo sapien
agcctcttagcttaatccaatctag

SEQ ID NO: 313872 - DNA, 25 bp, Homo sapien
caatctaggatgcatttccactctg

SEQ ID NO: 313873 - DNA, 25 bp, Homo sapien
atttccactctgcaacaaacagtat

SEQ ID NO: 313874 - DNA, 25 bp, Homo sapien
ccagctccttgtggaatggtctgtt

SEQ ID NO: 313875 - DNA, 25 bp, Homo sapien
aatggtctgttggagcggacctgac

SEQ ID NO: 313876 - DNA, 25 bp, Homo sapien
tctgttggagcggacctgacctgga

SEQ ID NO: 313877 - DNA, 25 bp, Homo sapien
gcggacctgacctggagaatccacg

SEQ ID NO: 313878 - DNA, 25 bp, Homo sapien
agaatccacgcctctcacacatgga

SEQ ID NO: 313879 - DNA, 25 bp, Homo sapien
tctcacacatggagctgggcaacag

SEQ ID NO: 313880 - DNA, 25 bp, Homo sapien
ccaggagcgcccacatcaggaggac

SEQ ID NO: 313881 - DNA, 25 bp, Homo sapien
gagtgagctagagagtcggatatta

SEQ ID NO: 313882 - DNA, 25 bp, Homo sapien
cacatcaggaggaccccaggaaggg

SEQ ID NO: 313883 - DNA, 25 bp, Homo sapien
tgccaggaccctgcttcggaggtca

SEQ ID NO: 313884 - DNA, 25 bp, Homo sapien
gaggtcacaccagctccttgtggaa

SEQ ID NO: 313885 - DNA, 25 bp, Homo sapien
cagcagaaatgcctgtacaaacatt

SEQ ID NO: 313886 - DNA, 25 bp, Homo sapien
atgcctgtacaaacattcaagttag

SEQ ID NO: 313887 - DNA, 25 bp, Homo sapien
cattcaagttagttggcagtctata

SEQ ID NO: 313888 - DNA, 25 bp, Homo sapien
gcagtctataaatgtgagttgggta

SEQ ID NO: 313889 - DNA, 25 bp, Homo sapien
atgtgagttgggtatattttacaac

SEQ ID NO: 313890 - DNA, 25 bp, Homo sapien
tttacaactaaatgatagggcttga

SEQ ID NO: 313891 - DNA, 25 bp, Homo sapien
tgatagggcttgaaaatacttttga

SEQ ID NO: 313892 - DNA, 25 bp, Homo sapien
aaccaacaagacaagcacaaacaat

SEQ ID NO: 313893 - DNA, 25 bp, Homo sapien
gacaagcacaaacaattcaagttaa

SEQ ID NO: 313894 - DNA, 25 bp, Homo sapien
cattaatataattttgaggccaggt

SEQ ID NO: 313895 - DNA, 25 bp, Homo sapien
gctgaggaggaaacatcacttgagg

SEQ ID NO: 313896 - DNA, 25 bp, Homo sapien
acgaggctgaccagaccatgggcag

SEQ ID NO: 313897 - DNA, 25 bp, Homo sapien
agccccagcaagtctgtccacagag

SEQ ID NO: 313898 - DNA, 25 bp, Homo sapien
agcaagtctgtccacagagcgtctt

SEQ ID NO: 313899 - DNA, 25 bp, Homo sapien
gcaagtctgtccacagagcgtcttc

SEQ ID NO: 313900 - DNA, 25 bp, Homo sapien
aagtctgtccacagagcgtcttctt

SEQ ID NO: 313901 - DNA, 25 bp, Homo sapien
agtctgtccacagagcgtcttcttc

SEQ ID NO: 313902 - DNA, 25 bp, Homo sapien
tgtccacagagcgtcttcttcatgg

SEQ ID NO: 313903 - DNA, 25 bp, Homo sapien
acagagcgtcttcttcatggcagca

SEQ ID NO: 313904 - DNA, 25 bp, Homo sapien
cttcatggcagcagctgccttcttt

SEQ ID NO: 313905 - DNA, 25 bp, Homo sapien
gcagctgccttctttcactgtctca

SEQ ID NO: 313906 - DNA, 25 bp, Homo sapien
agcctgtgggtcctggctttgtgct

SEQ ID NO: 313907 - DNA, 25 bp, Homo sapien
gatcgtaaaaatcagtgcatggcat

SEQ ID NO: 313908 - DNA, 25 bp, Homo sapien
gtgcatggcattagagtcttgtgat

SEQ ID NO: 313909 - DNA, 25 bp, Homo sapien
agtcttgtgatgttaaagggccttc

SEQ ID NO: 313910 - DNA, 25 bp, Homo sapien
cttgtgatgttaaagggccttctca

SEQ ID NO: 313911 - DNA, 25 bp, Homo sapien
atgttaaagggccttctcaataaat

SEQ ID NO: 313912 - DNA, 25 bp, Homo sapien
gcagggaatgatgaacttgagcagt

SEQ ID NO: 313913 - DNA, 25 bp, Homo sapien
tgatgaacttgagcagtaaaaactt

SEQ ID NO: 313914 - DNA, 25 bp, Homo sapien
tgagcagtaaaaacttaaccacaaa

SEQ ID NO: 313915 - DNA, 25 bp, Homo sapien
cacaaaaggttattggtggtggagt

SEQ ID NO: 313916 - DNA, 25 bp, Homo sapien
gtggtggagtagattatgttctttt

SEQ ID NO: 313917 - DNA, 25 bp, Homo sapien
gatatatgatatgcatgcagacagc

SEQ ID NO: 313918 - DNA, 25 bp, Homo sapien
ggaaagagcccaatgcccaccgcaa

SEQ ID NO: 313919 - DNA, 25 bp, Homo sapien
atggcacaaggctgggcctgggctc

SEQ ID NO: 313920 - DNA, 25 bp, Homo sapien
gtctccaaggaagatacgggcctgt

SEQ ID NO: 313921 - DNA, 25 bp, Homo sapien
ctccaaggaagatacgggcctgttc

SEQ ID NO: 313922 - DNA, 25 bp, Homo sapien
aagatacgggcctgttccggcgaag

SEQ ID NO: 313923 - DNA, 25 bp, Homo sapien
gatacgggcctgttccggcgaagct

SEQ ID NO: 313924 - DNA, 25 bp, Homo sapien
tacgggcctgttccggcgaagctcc

SEQ ID NO: 313925 - DNA, 25 bp, Homo sapien
ggtccttccggcaagccctgaatga

SEQ ID NO: 313926 - DNA, 25 bp, Homo sapien
ttccggcaagccctgaatgacggcc

SEQ ID NO: 313927 - DNA, 25 bp, Homo sapien
ggcaagccctgaatgacggcccagc

SEQ ID NO: 313928 - DNA, 25 bp, Homo sapien
aagccctgaatgacggcccagctac

SEQ ID NO: 313929 - DNA, 25 bp, Homo sapien
aactatcatggactctgtacaggat

SEQ ID NO: 313930 - DNA, 25 bp, Homo sapien
aatatgtactgcttctttctttgat

SEQ ID NO: 313931 - DNA, 25 bp, Homo sapien
tttgattgccactcaagatggaaac

SEQ ID NO: 313932 - DNA, 25 bp, Homo sapien
gatggaaacaccatgccaaggcatt

SEQ ID NO: 313933 - DNA, 25 bp, Homo sapien
ggcattttggttatacacagatcat

SEQ ID NO: 313934 - DNA, 25 bp, Homo sapien
gatgactagtcgaacttaatataca

SEQ ID NO: 313935 - DNA, 25 bp, Homo sapien
gttcttgcaaatactttacacttag

SEQ ID NO: 313936 - DNA, 25 bp, Homo sapien
atactttacacttagctgccattac

SEQ ID NO: 313937 - DNA, 25 bp, Homo sapien
ttagctgccattacacaacaaattg

SEQ ID NO: 313938 - DNA, 25 bp, Homo sapien
ggaattttccagctgttcaactatc

SEQ ID NO: 313939 - DNA, 25 bp, Homo sapien
gctgttcaactatcatggactctgt

SEQ ID NO: 313940 - DNA, 25 bp, Homo sapien
gagagtgggtcagaattgtaacatt

SEQ ID NO: 313941 - DNA, 25 bp, Homo sapien
attgtaacattgataggcattgcat

SEQ ID NO: 313942 - DNA, 25 bp, Homo sapien
gataggcattgcataaaccctgcag

SEQ ID NO: 313943 - DNA, 25 bp, Homo sapien
ggcattgcataaaccctgcagcatt

SEQ ID NO: 313944 - DNA, 25 bp, Homo sapien
ttgcataaaccctgcagcattttta

SEQ ID NO: 313945 - DNA, 25 bp, Homo sapien
ataaaccctgcagcatttttaagtt

SEQ ID NO: 313946 - DNA, 25 bp, Homo sapien
ttttaagttaaacttgctctcattt

SEQ ID NO: 313947 - DNA, 25 bp, Homo sapien
gcaggaaaacacaactagctctata

SEQ ID NO: 313948 - DNA, 25 bp, Homo sapien
ggaaaacacaactagctctataatg

SEQ ID NO: 313949 - DNA, 25 bp, Homo sapien
agctctataatgagtattgcatata

SEQ ID NO: 313950 - DNA, 25 bp, Homo sapien
gaaaaagagactggacatggtggct

SEQ ID NO: 313951 - DNA, 25 bp, Homo sapien
tttgtctttctttaacgcccaggct

SEQ ID NO: 313952 - DNA, 25 bp, Homo sapien
aggcttcgtcttatttctactgttt

SEQ ID NO: 313953 - DNA, 25 bp, Homo sapien
tctactgtttttgtcgcaacttcca

SEQ ID NO: 313954 - DNA, 25 bp, Homo sapien
gtttttgtcgcaacttccattgatt

SEQ ID NO: 313955 - DNA, 25 bp, Homo sapien
tccattgatttatgtcccttccctc

SEQ ID NO: 313956 - DNA, 25 bp, Homo sapien
agtacatcagggaacctttccacac

SEQ ID NO: 313957 - DNA, 25 bp, Homo sapien
cccatccgtgtacgtatgtggcatt

SEQ ID NO: 313958 - DNA, 25 bp, Homo sapien
gtggcatttccaggtatgactgagt

SEQ ID NO: 313959 - DNA, 25 bp, Homo sapien
gtcagaggctcttcagtgatttctt

SEQ ID NO: 313960 - DNA, 25 bp, Homo sapien
agtgatttcttgctattgaccgatg

SEQ ID NO: 313961 - DNA, 25 bp, Homo sapien
ttgaccgatgcttcactgtgccaaa

SEQ ID NO: 313962 - DNA, 25 bp, Homo sapien
tgaagtcatctattgagccaccatt

SEQ ID NO: 313963 - DNA, 25 bp, Homo sapien
gagccaccattcaattattcatcta

SEQ ID NO: 313964 - DNA, 25 bp, Homo sapien
tctattaattccttgatccttcatt

SEQ ID NO: 313965 - DNA, 25 bp, Homo sapien
atttatccattctgcaaacttttct

SEQ ID NO: 313966 - DNA, 25 bp, Homo sapien
aaacttttcttgagcaccagcacgg

SEQ ID NO: 313967 - DNA, 25 bp, Homo sapien
gcacgggtggccatttgtggacttc

SEQ ID NO: 313968 - DNA, 25 bp, Homo sapien
gacttctcttcattcctatgtgttt

SEQ ID NO: 313969 - DNA, 25 bp, Homo sapien
aaagtgatccactctcgaaaggctc

SEQ ID NO: 313970 - DNA, 25 bp, Homo sapien
aaaggctcctttccagtctgtggtt

SEQ ID NO: 313971 - DNA, 25 bp, Homo sapien
ttgggttcaagtcatgccagggcca

SEQ ID NO: 313972 - DNA, 25 bp, Homo sapien
attcagttttgcctcaagattggaa

SEQ ID NO: 313973 - DNA, 25 bp, Homo sapien
gatacaacgtgtttcctaaaagtag

SEQ ID NO: 313974 - DNA, 25 bp, Homo sapien
ggcttgcacgccgagtgcctgtgac

SEQ ID NO: 313975 - DNA, 25 bp, Homo sapien
gtgacgcgccggcttgacttaactg

SEQ ID NO: 313976 - DNA, 25 bp, Homo sapien
ttgacttaactgcttccctgaagta

SEQ ID NO: 313977 - DNA, 25 bp, Homo sapien
aactgcttccctgaagtaccgtgag

SEQ ID NO: 313978 - DNA, 25 bp, Homo sapien
ttccctgaagtaccgtgaggttcct

SEQ ID NO: 313979 - DNA, 25 bp, Homo sapien
agtaccgtgaggttcctgatgtgcg

SEQ ID NO: 313980 - DNA, 25 bp, Homo sapien
agacggtaggcttatgcggcacgct

SEQ ID NO: 313981 - DNA, 25 bp, Homo sapien
ttatgcggcacgctttcgtttccac

SEQ ID NO: 313982 - DNA, 25 bp, Homo sapien
gctttcgtttccaccgtggctactg

SEQ ID NO: 313983 - DNA, 25 bp, Homo sapien
accgtggctactgcgctttgggaag

SEQ ID NO: 313984 - DNA, 25 bp, Homo sapien
actagaagaatgaccaaccatcctg

SEQ ID NO: 313985 - DNA, 25 bp, Homo sapien
aaccatcctggttggcctgggactg

SEQ ID NO: 313986 - DNA, 25 bp, Homo sapien
gggactgtcctagttttagcattga

SEQ ID NO: 313987 - DNA, 25 bp, Homo sapien
cattgaaagtttcaggttccaggaa

SEQ ID NO: 313988 - DNA, 25 bp, Homo sapien
ctgctggtcaccctagcagctgagg

SEQ ID NO: 313989 - DNA, 25 bp, Homo sapien
gcagctgagggactcttcaatacag

SEQ ID NO: 313990 - DNA, 25 bp, Homo sapien
gagggactcttcaatacagaattag

SEQ ID NO: 313991 - DNA, 25 bp, Homo sapien
atctataaacatctactgaagcctg

SEQ ID NO: 313992 - DNA, 25 bp, Homo sapien
aaacatctactgaagcctgttctgt

SEQ ID NO: 313993 - DNA, 25 bp, Homo sapien
aagcctgttctgtctgcaccgacat

SEQ ID NO: 313994 - DNA, 25 bp, Homo sapien
gttctgtctgcaccgacattttcat

SEQ ID NO: 313995 - DNA, 25 bp, Homo sapien
agtttgaggccagctagagtgacat

SEQ ID NO: 313996 - DNA, 25 bp, Homo sapien
gtttgaggccagctagagtgacata

SEQ ID NO: 313997 - DNA, 25 bp, Homo sapien
tttgaggccagctagagtgacatag

SEQ ID NO: 313998 - DNA, 25 bp, Homo sapien
ttgaggccagctagagtgacatagc

SEQ ID NO: 313999 - DNA, 25 bp, Homo sapien
gaggccagctagagtgacatagcaa

SEQ ID NO: 314000 - DNA, 25 bp, Homo sapien
aggccagctagagtgacatagcaag

SEQ ID NO: 314001 - DNA, 25 bp, Homo sapien
catagcaagactccgatgctacaaa

SEQ ID NO: 314002 - DNA, 25 bp, Homo sapien
gcaagactccgatgctacaaaaaag

SEQ ID NO: 314003 - DNA, 25 bp, Homo sapien
ttgctctgttttgcctgctggagtg

SEQ ID NO: 314004 - DNA, 25 bp, Homo sapien
gagatcgccgccctgcgttccagtc

SEQ ID NO: 314005 - DNA, 25 bp, Homo sapien
ccgccctgcgttccagtctgggcaa

SEQ ID NO: 314006 - DNA, 25 bp, Homo sapien
aaggttggtgcaatcttcggctcta

SEQ ID NO: 314007 - DNA, 25 bp, Homo sapien
aatcttcggctctactcggctgttt

SEQ ID NO: 314008 - DNA, 25 bp, Homo sapien
actcggctgttttcgctgatgcggg

SEQ ID NO: 314009 - DNA, 25 bp, Homo sapien
ctcacgcacggctctagaaagacgg

SEQ ID NO: 314010 - DNA, 25 bp, Homo sapien
ttttttccatgtgttcacttccggg

SEQ ID NO: 314011 - DNA, 25 bp, Homo sapien
atgtgttcacttccgggtccggcgt

SEQ ID NO: 314012 - DNA, 25 bp, Homo sapien
gtcgatccggatgcccgaggcagaa

SEQ ID NO: 314013 - DNA, 25 bp, Homo sapien
tgcccgaggcagaaggatgtttgac

SEQ ID NO: 314014 - DNA, 25 bp, Homo sapien
gatgtttgacctccggataagcgag

SEQ ID NO: 314015 - DNA, 25 bp, Homo sapien
atagggcgcggcttaggctttatac

SEQ ID NO: 314016 - DNA, 25 bp, Homo sapien
tttatacaccttgccagccaatgac

SEQ ID NO: 314017 - DNA, 25 bp, Homo sapien
cacgaggctgaccagaccatgggca

SEQ ID NO: 314018 - DNA, 25 bp, Homo sapien
acgaggctgaccagaccatgggcag

SEQ ID NO: 314019 - DNA, 25 bp, Homo sapien
cgaggctgaccagaccatgggcagg

SEQ ID NO: 314020 - DNA, 25 bp, Homo sapien
agccccagcaagtctgtccacagag

SEQ ID NO: 314021 - DNA, 25 bp, Homo sapien
agcaagtctgtccacagagcgtctt

SEQ ID NO: 314022 - DNA, 25 bp, Homo sapien
gcaagtctgtccacagagcgtcttc

SEQ ID NO: 314023 - DNA, 25 bp, Homo sapien
aagtctgtccacagagcgtcttctt

SEQ ID NO: 314024 - DNA, 25 bp, Homo sapien
agtctgtccacagagcgtcttcttc

SEQ ID NO: 314025 - DNA, 25 bp, Homo sapien
tcttcatggcagcagctgccttctt

SEQ ID NO: 314026 - DNA, 25 bp, Homo sapien
cttcatggcagcagctgccttcttt

SEQ ID NO: 314027 - DNA, 25 bp, Homo sapien
agcctgtgggtcctggctttgtgct

SEQ ID NO: 314028 - DNA, 25 bp, Homo sapien
aagaattggaggtagagccagaact

SEQ ID NO: 314029 - DNA, 25 bp, Homo sapien
agccagaactggaacccatctttct

SEQ ID NO: 314030 - DNA, 25 bp, Homo sapien
ccagaactggaacccatctttcttt

SEQ ID NO: 314031 - DNA, 25 bp, Homo sapien
agttcatatccttctgcaaattcct

SEQ ID NO: 314032 - DNA, 25 bp, Homo sapien
gttcatatccttctgcaaattcctc

SEQ ID NO: 314033 - DNA, 25 bp, Homo sapien
tcatatccttctgcaaattcctcta

SEQ ID NO: 314034 - DNA, 25 bp, Homo sapien
atatccttctgcaaattcctctaga

SEQ ID NO: 314035 - DNA, 25 bp, Homo sapien
atccttctgcaaattcctctagagc

SEQ ID NO: 314036 - DNA, 25 bp, Homo sapien
tccttctgcaaattcctctagagca

SEQ ID NO: 314037 - DNA, 25 bp, Homo sapien
tgcaaattcctctagagcagagaat

SEQ ID NO: 314038 - DNA, 25 bp, Homo sapien
gaaattgagttctgtggagattaaa

SEQ ID NO: 314039 - DNA, 25 bp, Homo sapien
atttctccaggagaactccacactt

SEQ ID NO: 314040 - DNA, 25 bp, Homo sapien
gaactccacacttgcacaatatctt

SEQ ID NO: 314041 - DNA, 25 bp, Homo sapien
ccaaggacagaagagggacaatatt

SEQ ID NO: 314042 - DNA, 25 bp, Homo sapien
gacaatatttgtccttcctactgga

SEQ ID NO: 314043 - DNA, 25 bp, Homo sapien
tgtccttcctactggattttgaaac

SEQ ID NO: 314044 - DNA, 25 bp, Homo sapien
aaccctttgcactgagtgtagactg

SEQ ID NO: 314045 - DNA, 25 bp, Homo sapien
gtagactgtagttctgtgacatacc

SEQ ID NO: 314046 - DNA, 25 bp, Homo sapien
gttctgtgacataccatgaagagtg

SEQ ID NO: 314047 - DNA, 25 bp, Homo sapien
tgtgtgttttaagggagctactgtc

SEQ ID NO: 314048 - DNA, 25 bp, Homo sapien
ggagctactgtcttacccaaaacct

SEQ ID NO: 314049 - DNA, 25 bp, Homo sapien
tcatgaattgctcattattcagcca

SEQ ID NO: 314050 - DNA, 25 bp, Homo sapien
gcgactggccccacttaatgggttt

SEQ ID NO: 314051 - DNA, 25 bp, Homo sapien
gttttcagaggtgggagcaaagaat

SEQ ID NO: 314052 - DNA, 25 bp, Homo sapien
tttcagaggtgggagcaaagaatga

SEQ ID NO: 314053 - DNA, 25 bp, Homo sapien
ggaggaagagagctcccatcttttc

SEQ ID NO: 314054 - DNA, 25 bp, Homo sapien
gaggaagagagctcccatcttttcc

SEQ ID NO: 314055 - DNA, 25 bp, Homo sapien
aggaagagagctcccatcttttcca

SEQ ID NO: 314056 - DNA, 25 bp, Homo sapien
gaagagagctcccatcttttccatt

SEQ ID NO: 314057 - DNA, 25 bp, Homo sapien
aagagagctcccatcttttccatta

SEQ ID NO: 314058 - DNA, 25 bp, Homo sapien
agagagctcccatcttttccattac

SEQ ID NO: 314059 - DNA, 25 bp, Homo sapien
aatgattctctaaagactgtccttc

SEQ ID NO: 314060 - DNA, 25 bp, Homo sapien
atgattctctaaagactgtccttca

SEQ ID NO: 314061 - DNA, 25 bp, Homo sapien
gtggttaatcctaggtacctccctg

SEQ ID NO: 314062 - DNA, 25 bp, Homo sapien
ctaggtacctccctgcctacaaagg

SEQ ID NO: 314063 - DNA, 25 bp, Homo sapien
aaggagttcttattaatactgcagg

SEQ ID NO: 314064 - DNA, 25 bp, Homo sapien
aatactgcaggatcttttcttcatg

SEQ ID NO: 314065 - DNA, 25 bp, Homo sapien
actgcaggatcttttcttcatgaat

SEQ ID NO: 314066 - DNA, 25 bp, Homo sapien
tttcttcatgaatatatgcttccat

SEQ ID NO: 314067 - DNA, 25 bp, Homo sapien
cattaatttttaaccatgcacttta

SEQ ID NO: 314068 - DNA, 25 bp, Homo sapien
aatttttctgaatagcctaagtatg

SEQ ID NO: 314069 - DNA, 25 bp, Homo sapien
ccagtcagcttttgaggtgtcagat

SEQ ID NO: 314070 - DNA, 25 bp, Homo sapien
gcactttaagtttgtgagcctataa

SEQ ID NO: 314071 - DNA, 25 bp, Homo sapien
gagcattatatttagtggttaatcc

SEQ ID NO: 314072 - DNA, 25 bp, Homo sapien
gagttataatttaatgtccttccat

SEQ ID NO: 314073 - DNA, 25 bp, Homo sapien
tgtccttccattcaatcactgtatt

SEQ ID NO: 314074 - DNA, 25 bp, Homo sapien
ttccattcaatcactgtatttcaaa

SEQ ID NO: 314075 - DNA, 25 bp, Homo sapien
ggaaggtcatacttggtattttcct

SEQ ID NO: 314076 - DNA, 25 bp, Homo sapien
tgacctcagctggaatgccttcata

SEQ ID NO: 314077 - DNA, 25 bp, Homo sapien
ggaatgccttcatagtgttcacatg

SEQ ID NO: 314078 - DNA, 25 bp, Homo sapien
gtgttcacatgaacacatttggcct

SEQ ID NO: 314079 - DNA, 25 bp, Homo sapien
aaagattatttctctaacttactgg

SEQ ID NO: 314080 - DNA, 25 bp, Homo sapien
actggtttatcttttgtagcttatt

SEQ ID NO: 314081 - DNA, 25 bp, Homo sapien
atcttttgtagcttatttcaggtga

SEQ ID NO: 314082 - DNA, 25 bp, Homo sapien
gcttatttcaggtgatttgttgtgt

SEQ ID NO: 314083 - DNA, 25 bp, Homo sapien
gttcattgggtgtgcgaaacaccct

SEQ ID NO: 314084 - DNA, 25 bp, Homo sapien
ttcattgggtgtgcgaaacaccctt

SEQ ID NO: 314085 - DNA, 25 bp, Homo sapien
cattgggtgtgcgaaacaccctttt

SEQ ID NO: 314086 - DNA, 25 bp, Homo sapien
ttccaatttgcccttcagagaactt

SEQ ID NO: 314087 - DNA, 25 bp, Homo sapien
tccaatttgcccttcagagaactta

SEQ ID NO: 314088 - DNA, 25 bp, Homo sapien
tcagagaacttaagtcaaggagagt

SEQ ID NO: 314089 - DNA, 25 bp, Homo sapien
gagaacttaagtcaaggagagttga

SEQ ID NO: 314090 - DNA, 25 bp, Homo sapien
taagtcaaggagagttgaaattcac

SEQ ID NO: 314091 - DNA, 25 bp, Homo sapien
cattatgttggccaacagaacttga

SEQ ID NO: 314092 - DNA, 25 bp, Homo sapien
tatgttggccaacagaacttgattg

SEQ ID NO: 314093 - DNA, 25 bp, Homo sapien
atgttggccaacagaacttgattgt

SEQ ID NO: 314094 - DNA, 25 bp, Homo sapien
tggcagtagcagtccctgcactagg

SEQ ID NO: 314095 - DNA, 25 bp, Homo sapien
gtagcagtccctgcactaggtcaga

SEQ ID NO: 314096 - DNA, 25 bp, Homo sapien
agtccctgcactaggtcagacaatc

SEQ ID NO: 314097 - DNA, 25 bp, Homo sapien
attcaggccagagttgtgggccgcc

SEQ ID NO: 314098 - DNA, 25 bp, Homo sapien
tgcactaggtcagacaatccccttt

SEQ ID NO: 314099 - DNA, 25 bp, Homo sapien
actaggtcagacaatcccctttggg

SEQ ID NO: 314100 - DNA, 25 bp, Homo sapien
gggcctgaattgaccataaaggatg

SEQ ID NO: 314101 - DNA, 25 bp, Homo sapien
ttgtgggccgccgtcggcagcaaga

SEQ ID NO: 314102 - DNA, 25 bp, Homo sapien
aacagagagagaggtggacagatct

SEQ ID NO: 314103 - DNA, 25 bp, Homo sapien
gacagatctgagagatactgagatt

SEQ ID NO: 314104 - DNA, 25 bp, Homo sapien
tgagattaaaaggagcccaagcccc

SEQ ID NO: 314105 - DNA, 25 bp, Homo sapien
aagtacatgtctttgaatatcattc

SEQ ID NO: 314106 - DNA, 25 bp, Homo sapien
attcttttttctctgctgcctacca

SEQ ID NO: 314107 - DNA, 25 bp, Homo sapien
tgctgcctaccaacaagtccaaaat

SEQ ID NO: 314108 - DNA, 25 bp, Homo sapien
ggtatttagtactctctacacccta

SEQ ID NO: 314109 - DNA, 25 bp, Homo sapien
tttgtctctagctatgacctgtcac

SEQ ID NO: 314110 - DNA, 25 bp, Homo sapien
atgacctgtcacataacatgccctc

SEQ ID NO: 314111 - DNA, 25 bp, Homo sapien
ataacatgccctccaccaatgtggg

SEQ ID NO: 314112 - DNA, 25 bp, Homo sapien
ccaccaatgtgggtcacttcatttt

SEQ ID NO: 314113 - DNA, 25 bp, Homo sapien
gggtcacttcattttctacttgtac

SEQ ID NO: 314114 - DNA, 25 bp, Homo sapien
tacttgtacatctatgattcttctc

SEQ ID NO: 314115 - DNA, 25 bp, Homo sapien
ggcttttgttcaaagtccttttcat

SEQ ID NO: 314116 - DNA, 25 bp, Homo sapien
gctttcacagctctctttgaagcag

SEQ ID NO: 314117 - DNA, 25 bp, Homo sapien
gctctctttgaagcagatgtcttgg

SEQ ID NO: 314118 - DNA, 25 bp, Homo sapien
ttggtgaactcggtagactctttta

SEQ ID NO: 314119 - DNA, 25 bp, Homo sapien
gactcttttatacctgttgtcacaa

SEQ ID NO: 314120 - DNA, 25 bp, Homo sapien
acctgttgtcacaagaaagctttgt

SEQ ID NO: 314121 - DNA, 25 bp, Homo sapien
gtaaaaccagacagtgaagcaaaat

SEQ ID NO: 314122 - DNA, 25 bp, Homo sapien
aatgttgccaactgcttaacctagg

SEQ ID NO: 314123 - DNA, 25 bp, Homo sapien
aactgcttaacctaggctatgtgaa

SEQ ID NO: 314124 - DNA, 25 bp, Homo sapien
cctaggctatgtgaacccacagtaa

SEQ ID NO: 314125 - DNA, 25 bp, Homo sapien
gaacccacagtaaacctgaaggtgt

SEQ ID NO: 314126 - DNA, 25 bp, Homo sapien
tgaaacgtgacctcctattgatgta

SEQ ID NO: 314127 - DNA, 25 bp, Homo sapien
aggtgctcaagaacatgggctatgc

SEQ ID NO: 314128 - DNA, 25 bp, Homo sapien
ggctatgccgccaaggccatgaagg

SEQ ID NO: 314129 - DNA, 25 bp, Homo sapien
atgaaggcggcccatgacaacatgg

SEQ ID NO: 314130 - DNA, 25 bp, Homo sapien
attgctgaccagcaagaacttgcag

SEQ ID NO: 314131 - DNA, 25 bp, Homo sapien
gcagaggagatttcaacagcaattt

SEQ ID NO: 314132 - DNA, 25 bp, Homo sapien
cagcaatttcgaaacctgtagggtt

SEQ ID NO: 314133 - DNA, 25 bp, Homo sapien
ggatgagctcatggcggaattagaa

SEQ ID NO: 314134 - DNA, 25 bp, Homo sapien
aatttgctggaaatcagtggacccg

SEQ ID NO: 314135 - DNA, 25 bp, Homo sapien
ggaaatcagtggacccgaaacagtc

SEQ ID NO: 314136 - DNA, 25 bp, Homo sapien
gaaacagtccctctaccaaatgttc

SEQ ID NO: 314137 - DNA, 25 bp, Homo sapien
accaaatgttccctctatagcccta

SEQ ID NO: 314138 - DNA, 25 bp, Homo sapien
gaaattccccacacaggactgggtt

SEQ ID NO: 314139 - DNA, 25 bp, Homo sapien
cacaggactgggttaattctaaggt

SEQ ID NO: 314140 - DNA, 25 bp, Homo sapien
gactgggttaattctaaggtattgc

SEQ ID NO: 314141 - DNA, 25 bp, Homo sapien
ctaaggtattgctttagctctgtga

SEQ ID NO: 314142 - DNA, 25 bp, Homo sapien
gtattgctttagctctgtgaagaaa

SEQ ID NO: 314143 - DNA, 25 bp, Homo sapien
actgtttgtccttccctgatcagag

SEQ ID NO: 314144 - DNA, 25 bp, Homo sapien
gtccttccctgatcagagcagataa

SEQ ID NO: 314145 - DNA, 25 bp, Homo sapien
gagcagataaacatcaccgtaccat

SEQ ID NO: 314146 - DNA, 25 bp, Homo sapien
aaacatcaccgtaccatagatggga

SEQ ID NO: 314147 - DNA, 25 bp, Homo sapien
accgtaccatagatgggacttctag

SEQ ID NO: 314148 - DNA, 25 bp, Homo sapien
ggacttctagaaattccccacacag

SEQ ID NO: 314149 - DNA, 25 bp, Homo sapien
ctggccacagtttgtcaggttgttt

SEQ ID NO: 314150 - DNA, 25 bp, Homo sapien
aggttgtttagccagatgccccatt

SEQ ID NO: 314151 - DNA, 25 bp, Homo sapien
atgccccattggtaaggtagactga

SEQ ID NO: 314152 - DNA, 25 bp, Homo sapien
actgaaatctcggtttagggctgac

SEQ ID NO: 314153 - DNA, 25 bp, Homo sapien
tagggctgaccccaagaaacagtct

SEQ ID NO: 314154 - DNA, 25 bp, Homo sapien
aacagtctggttcgtgctttggtat

SEQ ID NO: 314155 - DNA, 25 bp, Homo sapien
gtggactccagtgtgcatagcagct

SEQ ID NO: 314156 - DNA, 25 bp, Homo sapien
gcagctgctgtcttgctacaagtta

SEQ ID NO: 314157 - DNA, 25 bp, Homo sapien
gattgtgattggtggctcatttcaa

SEQ ID NO: 314158 - DNA, 25 bp, Homo sapien
tgtactgattgatcttggcattttc

SEQ ID NO: 314159 - DNA, 25 bp, Homo sapien
ttggatttcatgtccagtggcttct

SEQ ID NO: 314160 - DNA, 25 bp, Homo sapien
aatccagggatttgggattctctgg

SEQ ID NO: 314161 - DNA, 25 bp, Homo sapien
attaaccgggactgggctagagcct

SEQ ID NO: 314162 - DNA, 25 bp, Homo sapien
gggcaagacacctaagaaatccaac

SEQ ID NO: 314163 - DNA, 25 bp, Homo sapien
caagtccagcctaagtatccaagtc

SEQ ID NO: 314164 - DNA, 25 bp, Homo sapien
taagtatccaagtccctgtcccagc

SEQ ID NO: 314165 - DNA, 25 bp, Homo sapien
ccacctggacaggaggtaggcctct

SEQ ID NO: 314166 - DNA, 25 bp, Homo sapien
aggaggtaggcctctccagaccaca

SEQ ID NO: 314167 - DNA, 25 bp, Homo sapien
tctccagaccacaccagagaggtgg

SEQ ID NO: 314168 - DNA, 25 bp, Homo sapien
cagagaggtggtcccactcctactt

SEQ ID NO: 314169 - DNA, 25 bp, Homo sapien
tcccaaatgaggaatccaaggccaa

SEQ ID NO: 314170 - DNA, 25 bp, Homo sapien
ggatttacccaagggcattcctcaa

SEQ ID NO: 314171 - DNA, 25 bp, Homo sapien
gagtactctgaatactccgagtatt

SEQ ID NO: 314172 - DNA, 25 bp, Homo sapien
tccgagtattctgtggaggagtacc

SEQ ID NO: 314173 - DNA, 25 bp, Homo sapien
agtaccaggaccctgaagctccttg

SEQ ID NO: 314174 - DNA, 25 bp, Homo sapien
gaagctccttgggatagtgatgacc

SEQ ID NO: 314175 - DNA, 25 bp, Homo sapien
ggatagtgatgacccctgttccctg

SEQ ID NO: 314176 - DNA, 25 bp, Homo sapien
tgttccctgccactggatgagggct

SEQ ID NO: 314177 - DNA, 25 bp, Homo sapien
tggatgagggctcctgcactgccta

SEQ ID NO: 314178 - DNA, 25 bp, Homo sapien
gcgctggtaccatcgggctgtgaca

SEQ ID NO: 314179 - DNA, 25 bp, Homo sapien
gctgtgacaggcagcacagaggcct

SEQ ID NO: 314180 - DNA, 25 bp, Homo sapien
agaggcctgtcacccttttgtctat

SEQ ID NO: 314181 - DNA, 25 bp, Homo sapien
gctgtggagggaatgccaaccgttt

SEQ ID NO: 314182 - DNA, 25 bp, Homo sapien
gcaaaacttcaaaacatggtaattt

SEQ ID NO: 314183 - DNA, 25 bp, Homo sapien
catggtaatttgaagcaggttggga

SEQ ID NO: 314184 - DNA, 25 bp, Homo sapien
gcaggttgggattaactctgggata

SEQ ID NO: 314185 - DNA, 25 bp, Homo sapien
aactctgggatattggaaagacttt

SEQ ID NO: 314186 - DNA, 25 bp, Homo sapien
tggaaagactttaaactccattagg

SEQ ID NO: 314187 - DNA, 25 bp, Homo sapien
actccattaggaaaattaacaagca

SEQ ID NO: 314188 - DNA, 25 bp, Homo sapien
ttaacaagcatgtagtctataaaag

SEQ ID NO: 314189 - DNA, 25 bp, Homo sapien
gaataatactttcttccaccttcag

SEQ ID NO: 314190 - DNA, 25 bp, Homo sapien
aataatactttcttccaccttcaga

SEQ ID NO: 314191 - DNA, 25 bp, Homo sapien
tttcttttgtatcactaaacatttc

SEQ ID NO: 314192 - DNA, 25 bp, Homo sapien
gtatcactaaacatttcaaatttgt

SEQ ID NO: 314193 - DNA, 25 bp, Homo sapien
cgcctccctatgtggtgctggactt

SEQ ID NO: 314194 - DNA, 25 bp, Homo sapien
tggtgctggacttgccgcaggagac

SEQ ID NO: 314195 - DNA, 25 bp, Homo sapien
tgctgagcctgttctatagcacagc

SEQ ID NO: 314196 - DNA, 25 bp, Homo sapien
gagcctgttctatagcacagcactg

SEQ ID NO: 314197 - DNA, 25 bp, Homo sapien
gttctatagcacagcactgaccgtg

SEQ ID NO: 314198 - DNA, 25 bp, Homo sapien
atagcacagcactgaccgtgaccag

SEQ ID NO: 314199 - DNA, 25 bp, Homo sapien
gcactgaccgtgaccagcgtccggg

SEQ ID NO: 314200 - DNA, 25 bp, Homo sapien
tactgagcgggagccggcaaggcac

SEQ ID NO: 314201 - DNA, 25 bp, Homo sapien
gaggaacctcttggagaagccagct

SEQ ID NO: 314202 - DNA, 25 bp, Homo sapien
gagaagccagctatgcttgccagaa

SEQ ID NO: 314203 - DNA, 25 bp, Homo sapien
agctatgcttgccagaactcagccc

SEQ ID NO: 314204 - DNA, 25 bp, Homo sapien
gtagcttttctatcagaattgcaga

SEQ ID NO: 314205 - DNA, 25 bp, Homo sapien
gaattgcagatagtcatgttgggct

SEQ ID NO: 314206 - DNA, 25 bp, Homo sapien
gttgggctaacagtcaattggatat

SEQ ID NO: 314207 - DNA, 25 bp, Homo sapien
gatatattcctttacctcacatgac

SEQ ID NO: 314208 - DNA, 25 bp, Homo sapien
aactgtggtggtatctagaggtgaa

SEQ ID NO: 314209 - DNA, 25 bp, Homo sapien
atgttgtaactgaaagcactgttga

SEQ ID NO: 314210 - DNA, 25 bp, Homo sapien
gcactgttgaatatgggtatcggct

SEQ ID NO: 314211 - DNA, 25 bp, Homo sapien
atgggtatcggctttctttttcact

SEQ ID NO: 314212 - DNA, 25 bp, Homo sapien
tcactttgactcttaacattatcag

SEQ ID NO: 314213 - DNA, 25 bp, Homo sapien
ttatcagtcaacttccacattaatg

SEQ ID NO: 314214 - DNA, 25 bp, Homo sapien
gaaagttgaccatagttatttccaa

SEQ ID NO: 314215 - DNA, 25 bp, Homo sapien
gatactggagatggctagttgctgt

SEQ ID NO: 314216 - DNA, 25 bp, Homo sapien
gctagttgctgtgttacgggtttga

SEQ ID NO: 314217 - DNA, 25 bp, Homo sapien
acgggtttgagttacatttggctat

SEQ ID NO: 314218 - DNA, 25 bp, Homo sapien
gacttcttcctacacgcgcattgag

SEQ ID NO: 314219 - DNA, 25 bp, Homo sapien
tcctacacgcgcattgagacagatt

SEQ ID NO: 314220 - DNA, 25 bp, Homo sapien
gagacagattccaactggttaatga

SEQ ID NO: 314221 - DNA, 25 bp, Homo sapien
gagattctgttggttgactgcctaa

SEQ ID NO: 314222 - DNA, 25 bp, Homo sapien
ctgttggttgactgcctaaagagaa

SEQ ID NO: 314223 - DNA, 25 bp, Homo sapien
ggatggccttcagattataccagct

SEQ ID NO: 314224 - DNA, 25 bp, Homo sapien
gattataccagcttagctagcatta

SEQ ID NO: 314225 - DNA, 25 bp, Homo sapien
gctagcattactaaccaactgttgg

SEQ ID NO: 314226 - DNA, 25 bp, Homo sapien
gcgactggccccacttaatgggttt

SEQ ID NO: 314227 - DNA, 25 bp, Homo sapien
tggccccacttaatgggttttcaga

SEQ ID NO: 314228 - DNA, 25 bp, Homo sapien
gttttcagaggtgggagcaaagaat

SEQ ID NO: 314229 - DNA, 25 bp, Homo sapien
ggaggaagagagctcccatcttttc

SEQ ID NO: 314230 - DNA, 25 bp, Homo sapien
aggaagagagctcccatcttttcca

SEQ ID NO: 314231 - DNA, 25 bp, Homo sapien
gaagagagctcccatcttttccatt

SEQ ID NO: 314232 - DNA, 25 bp, Homo sapien
aagagagctcccatcttttccatta

SEQ ID NO: 314233 - DNA, 25 bp, Homo sapien
agagagctcccatcttttccattac

SEQ ID NO: 314234 - DNA, 25 bp, Homo sapien
aatgattctctaaagactgtccttc

SEQ ID NO: 314235 - DNA, 25 bp, Homo sapien
atgattctctaaagactgtccttca

SEQ ID NO: 314236 - DNA, 25 bp, Homo sapien
agactgtccttcagcatccctaaag

SEQ ID NO: 314237 - DNA, 25 bp, Homo sapien
acctccagttgcctacaattccagt

SEQ ID NO: 314238 - DNA, 25 bp, Homo sapien
agttgcctacaattccagtcgctga

SEQ ID NO: 314239 - DNA, 25 bp, Homo sapien
ttgcctacaattccagtcgctgact

SEQ ID NO: 314240 - DNA, 25 bp, Homo sapien
ctacaattccagtcgctgacttggt

SEQ ID NO: 314241 - DNA, 25 bp, Homo sapien
aattccagtcgctgacttggtcctg

SEQ ID NO: 314242 - DNA, 25 bp, Homo sapien
gtcgctgacttggtcctgttttcta

SEQ ID NO: 314243 - DNA, 25 bp, Homo sapien
gggcctggaaacttcgttctgtaga

SEQ ID NO: 314244 - DNA, 25 bp, Homo sapien
gcctggaaacttcgttctgtagaga

SEQ ID NO: 314245 - DNA, 25 bp, Homo sapien
gaaacttcgttctgtagagaactat

SEQ ID NO: 314246 - DNA, 25 bp, Homo sapien
gggcgggagcactggtcaccgcggg

SEQ ID NO: 314247 - DNA, 25 bp, Homo sapien
gaatccgaggagtaaagagtttgct

SEQ ID NO: 314248 - DNA, 25 bp, Homo sapien
aattccctcgaaagagccaattgtt

SEQ ID NO: 314249 - DNA, 25 bp, Homo sapien
tcttacagatataaccgatgccaaa

SEQ ID NO: 314250 - DNA, 25 bp, Homo sapien
aggtttggtaatgcattggcccaga

SEQ ID NO: 314251 - DNA, 25 bp, Homo sapien
ggcccagagatttcagccatactgt

SEQ ID NO: 314252 - DNA, 25 bp, Homo sapien
gccatactgtgacagctggtctgat

SEQ ID NO: 314253 - DNA, 25 bp, Homo sapien
tccctgaaaagttctcgcttgtcac

SEQ ID NO: 314254 - DNA, 25 bp, Homo sapien
gcttgtcacaagaacacttagactt

SEQ ID NO: 314255 - DNA, 25 bp, Homo sapien
acttagacttgccttgtgccttaga

SEQ ID NO: 314256 - DNA, 25 bp, Homo sapien
gtgccttagagtcagagctcacaca

SEQ ID NO: 314257 - DNA, 25 bp, Homo sapien
actatcctagttgagtagcagcttc

SEQ ID NO: 314258 - DNA, 25 bp, Homo sapien
agtagcagcttctctttcagaattt

SEQ ID NO: 314259 - DNA, 25 bp, Homo sapien
taaaggaaagttgtcccaggattca

SEQ ID NO: 314260 - DNA, 25 bp, Homo sapien
gtcccaggattcatcctaaagaaag

SEQ ID NO: 314261 - DNA, 25 bp, Homo sapien
ttcttgagttttaccaccacttagt

SEQ ID NO: 314262 - DNA, 25 bp, Homo sapien
caccacttagttcccactgaatttt

SEQ ID NO: 314263 - DNA, 25 bp, Homo sapien
ttgtaacttcctgtgtttgcatcct

SEQ ID NO: 314264 - DNA, 25 bp, Homo sapien
gtttgcatcctctgttcctattctg

SEQ ID NO: 314265 - DNA, 25 bp, Homo sapien
cttgctctgtgtcatctcagtcatt

SEQ ID NO: 314266 - DNA, 25 bp, Homo sapien
gtgtcatctcagtcatttgacttag

SEQ ID NO: 314267 - DNA, 25 bp, Homo sapien
tgacttagaaagtgcccttcaaaag

SEQ ID NO: 314268 - DNA, 25 bp, Homo sapien
gtgcccttcaaaaggaccctgttca

SEQ ID NO: 314269 - DNA, 25 bp, Homo sapien
tgttcactgctgcacttttcaatga

SEQ ID NO: 314270 - DNA, 25 bp, Homo sapien
gagtttctctccaatttccaaaatg

SEQ ID NO: 314271 - DNA, 25 bp, Homo sapien
tttccaaccctccaaataaggctgt

SEQ ID NO: 314272 - DNA, 25 bp, Homo sapien
aggctgttacagcatcctcatttac

SEQ ID NO: 314273 - DNA, 25 bp, Homo sapien
ttacactttccaaacataacttatg

SEQ ID NO: 314274 - DNA, 25 bp, Homo sapien
acttatgacagtgatacgcctaccc

SEQ ID NO: 314275 - DNA, 25 bp, Homo sapien
atgacagtgatacgcctaccctgct

SEQ ID NO: 314276 - DNA, 25 bp, Homo sapien
aaccttaaatgcattacaccttaga

SEQ ID NO: 314277 - DNA, 25 bp, Homo sapien
gcattacaccttagaaatggtctag

SEQ ID NO: 314278 - DNA, 25 bp, Homo sapien
atggtctaggtaaatttccagtttg

SEQ ID NO: 314279 - DNA, 25 bp, Homo sapien
gcttgggctaagagaacatatggct

SEQ ID NO: 314280 - DNA, 25 bp, Homo sapien
aagagaacatatggctatcgtaggg

SEQ ID NO: 314281 - DNA, 25 bp, Homo sapien
gaaggtatgtcttcatactacagga

SEQ ID NO: 314282 - DNA, 25 bp, Homo sapien
gtatgtcttcatactacaggatttc

SEQ ID NO: 314283 - DNA, 25 bp, Homo sapien
tgtcttcatactacaggatttctga

SEQ ID NO: 314284 - DNA, 25 bp, Homo sapien
catactacaggatttctgacttgaa

SEQ ID NO: 314285 - DNA, 25 bp, Homo sapien
caggatttctgacttgaatatattc

SEQ ID NO: 314286 - DNA, 25 bp, Homo sapien
atgctttaattcattaccataacaa

SEQ ID NO: 314287 - DNA, 25 bp, Homo sapien
tgtactaagaattaatgttgcatct

SEQ ID NO: 314288 - DNA, 25 bp, Homo sapien
tgttgcatctttagtattccatttt

SEQ ID NO: 314289 - DNA, 25 bp, Homo sapien
gcatctttagtattccattttttgg

SEQ ID NO: 314290 - DNA, 25 bp, Homo sapien
tagtattccattttttggaactgtt

SEQ ID NO: 314291 - DNA, 25 bp, Homo sapien
gaaatatttttgtgttccatggtca

SEQ ID NO: 314292 - DNA, 25 bp, Homo sapien
ggtatctgtatattaacactgttat

SEQ ID NO: 314293 - DNA, 25 bp, Homo sapien
cagtgtgttcttattctgtccagaa

SEQ ID NO: 314294 - DNA, 25 bp, Homo sapien
gtccagaacagatccatattttcaa

SEQ ID NO: 314295 - DNA, 25 bp, Homo sapien
gctacttcagctgcaacctaatttc

SEQ ID NO: 314296 - DNA, 25 bp, Homo sapien
caacctaatttctgggtgagggaca

SEQ ID NO: 314297 - DNA, 25 bp, Homo sapien
gagggacagggttgcccctgaacac

SEQ ID NO: 314298 - DNA, 25 bp, Homo sapien
gggttgcccctgaacacagtataat

SEQ ID NO: 314299 - DNA, 25 bp, Homo sapien
gtaggaatcctcactgtagttctgt

SEQ ID NO: 314300 - DNA, 25 bp, Homo sapien
ctcactgtagttctgtagcattatt

SEQ ID NO: 314301 - DNA, 25 bp, Homo sapien
atgttgtccacttattttcggtctg

SEQ ID NO: 314302 - DNA, 25 bp, Homo sapien
tttcggtctggaacttagccaggat

SEQ ID NO: 314303 - DNA, 25 bp, Homo sapien
cttttcaataaacgccccacgctga

SEQ ID NO: 314304 - DNA, 25 bp, Homo sapien
gccccacgctgatagcacagaggag

SEQ ID NO: 314305 - DNA, 25 bp, Homo sapien
agcccggcatgcactgtatgggaaa

SEQ ID NO: 314306 - DNA, 25 bp, Homo sapien
tgggaaagcagtccaccttgttaca

SEQ ID NO: 314307 - DNA, 25 bp, Homo sapien
gcagtccaccttgttacagttttaa

SEQ ID NO: 314308 - DNA, 25 bp, Homo sapien
aatttcttgctatcttagcattcag

SEQ ID NO: 314309 - DNA, 25 bp, Homo sapien
tagcattcagataccaatggcttgc

SEQ ID NO: 314310 - DNA, 25 bp, Homo sapien
agataccaatggcttgctaaaagaa

SEQ ID NO: 314311 - DNA, 25 bp, Homo sapien
aatgtctttttattctcaggtcaat

SEQ ID NO: 314312 - DNA, 25 bp, Homo sapien
tttattctcaggtcaatcgctcaca

SEQ ID NO: 314313 - DNA, 25 bp, Homo sapien
aggtcaatcgctcacactttgtttt

SEQ ID NO: 314314 - DNA, 25 bp, Homo sapien
tttcacagacctcttgcacagtgta

SEQ ID NO: 314315 - DNA, 25 bp, Homo sapien
gcacagtgtagttgactttcccaga

SEQ ID NO: 314316 - DNA, 25 bp, Homo sapien
atgctgtctcaggaggaaaattgac

SEQ ID NO: 314317 - DNA, 25 bp, Homo sapien
gctcttcagattgttctatgctatg

SEQ ID NO: 314318 - DNA, 25 bp, Homo sapien
ttgttctatgctatgaccttttccc

SEQ ID NO: 314319 - DNA, 25 bp, Homo sapien
tatgctatgaccttttcccgtggcg

SEQ ID NO: 314320 - DNA, 25 bp, Homo sapien
ccgtggcgcacattttctccactgt

SEQ ID NO: 314321 - DNA, 25 bp, Homo sapien
tccctcctaagctctggtaatttaa

SEQ ID NO: 314322 - DNA, 25 bp, Homo sapien
atgacagtctgggagttactcactt

SEQ ID NO: 314323 - DNA, 25 bp, Homo sapien
ctgggagttactcacttttatggaa

SEQ ID NO: 314324 - DNA, 25 bp, Homo sapien
ggaagtgccgacacatttcacagac

SEQ ID NO: 314325 - DNA, 25 bp, Homo sapien
tgctcaccaggacgctatacatact

SEQ ID NO: 314326 - DNA, 25 bp, Homo sapien
ccaggacgctatacatacttgcaca

SEQ ID NO: 314327 - DNA, 25 bp, Homo sapien
tcagaagattcgtgggcccttcctt

SEQ ID NO: 314328 - DNA, 25 bp, Homo sapien
aaccatttcatgaacccatgagccc

SEQ ID NO: 314329 - DNA, 25 bp, Homo sapien
acccatgagccccagattaagaact

SEQ ID NO: 314330 - DNA, 25 bp, Homo sapien
taagaactctttctcttggttgttg

SEQ ID NO: 314331 - DNA, 25 bp, Homo sapien
actacgtagcaggaagaggaccatt

SEQ ID NO: 314332 - DNA, 25 bp, Homo sapien
gaggaccattgtgatccactaccaa

SEQ ID NO: 314333 - DNA, 25 bp, Homo sapien
gccttttcactgagggcctgtgcca

SEQ ID NO: 314334 - DNA, 25 bp, Homo sapien
gtgatccactaccaatagaacattt

SEQ ID NO: 314335 - DNA, 25 bp, Homo sapien
agggcctgtgccattctcgatgcaa

SEQ ID NO: 314336 - DNA, 25 bp, Homo sapien
gtgatcataccataaacacagatga

SEQ ID NO: 314337 - DNA, 25 bp, Homo sapien
cataaacacagatgagttgcacctt

SEQ ID NO: 314338 - DNA, 25 bp, Homo sapien
ttacttggtctctttggcatttttc

SEQ ID NO: 314339 - DNA, 25 bp, Homo sapien
cttggtctctttggcatttttccat

SEQ ID NO: 314340 - DNA, 25 bp, Homo sapien
gtatctagacaactacatttttaat

SEQ ID NO: 314341 - DNA, 25 bp, Homo sapien
tagtatatttccgttatattaagga

SEQ ID NO: 314342 - DNA, 25 bp, Homo sapien
ggctgtaagccagagtatatcaggt

SEQ ID NO: 314343 - DNA, 25 bp, Homo sapien
agccagagtatatcaggtactataa

SEQ ID NO: 314344 - DNA, 25 bp, Homo sapien
ggtactataaatacatcactaattt

SEQ ID NO: 314345 - DNA, 25 bp, Homo sapien
aacaaataatggctcaggcaatccc

SEQ ID NO: 314346 - DNA, 25 bp, Homo sapien
gtctggaatatttccagtggtggaa

SEQ ID NO: 314347 - DNA, 25 bp, Homo sapien
agattggtgataatccagcttggga

SEQ ID NO: 314348 - DNA, 25 bp, Homo sapien
ataatccagcttgggagaaaggacc

SEQ ID NO: 314349 - DNA, 25 bp, Homo sapien
agaaaggacccaagatctcgctgtc

SEQ ID NO: 314350 - DNA, 25 bp, Homo sapien
gtgaatccaggtttcataggctcat

SEQ ID NO: 314351 - DNA, 25 bp, Homo sapien
ggtttcataggctcatgtggaggat

SEQ ID NO: 314352 - DNA, 25 bp, Homo sapien
tggaggatgtatgttgtggatccat

SEQ ID NO: 314353 - DNA, 25 bp, Homo sapien
taagtcatccaatgtaccccaagtc

SEQ ID NO: 314354 - DNA, 25 bp, Homo sapien
tattattttcatttgttggcataac

SEQ ID NO: 314355 - DNA, 25 bp, Homo sapien
gttggcataacttagagctctgcaa

SEQ ID NO: 314356 - DNA, 25 bp, Homo sapien
gtaccccaagtctttgaagtcaaat

SEQ ID NO: 314357 - DNA, 25 bp, Homo sapien
atgggaacacacaaagacatagatt

SEQ ID NO: 314358 - DNA, 25 bp, Homo sapien
tagggttcaccatattctagtacaa

SEQ ID NO: 314359 - DNA, 25 bp, Homo sapien
attctagtacaacttcatcttattt

SEQ ID NO: 314360 - DNA, 25 bp, Homo sapien
ctcattcacaggtcccaggggttaa

SEQ ID NO: 314361 - DNA, 25 bp, Homo sapien
agacttgaacatatctttttggaaa

SEQ ID NO: 314362 - DNA, 25 bp, Homo sapien
ggaaagatacacttcaacccaaaag

SEQ ID NO: 314363 - DNA, 25 bp, Homo sapien
gatacacttcaacccaaaagaaaga

SEQ ID NO: 314364 - DNA, 25 bp, Homo sapien
ttttcccttttgtcatcctggttgt

SEQ ID NO: 314365 - DNA, 25 bp, Homo sapien
tctgtttttgtgagaggctatggag

SEQ ID NO: 314366 - DNA, 25 bp, Homo sapien
gagaggctatggaggaaattcaaaa

SEQ ID NO: 314367 - DNA, 25 bp, Homo sapien
tcttgctccaccgagaaccttgtgg

SEQ ID NO: 314368 - DNA, 25 bp, Homo sapien
caccgagaaccttgtggttgtgttc

SEQ ID NO: 314369 - DNA, 25 bp, Homo sapien
cagaatagccaagaaatccctcctt

SEQ ID NO: 314370 - DNA, 25 bp, Homo sapien
aaatccctccttttcaacgctctgt

SEQ ID NO: 314371 - DNA, 25 bp, Homo sapien
tttaaaaaccatccctcatagccca

SEQ ID NO: 314372 - DNA, 25 bp, Homo sapien
tcatagcccacaattttgggtcaac

SEQ ID NO: 314373 - DNA, 25 bp, Homo sapien
ttgggtcaactctcaaaattgggaa

SEQ ID NO: 314374 - DNA, 25 bp, Homo sapien
gaaaactggcactgttgggagaaaa

SEQ ID NO: 314375 - DNA, 25 bp, Homo sapien
aacatgaactggctcaggcaagcaa

SEQ ID NO: 314376 - DNA, 25 bp, Homo sapien
caaatagcgggagtcggcacaggaa

SEQ ID NO: 314377 - DNA, 25 bp, Homo sapien
atgcgtggtggcgtcaccttcaaaa

SEQ ID NO: 314378 - DNA, 25 bp, Homo sapien
aaactaaagtggtgccaggcggaca

SEQ ID NO: 314379 - DNA, 25 bp, Homo sapien
tgccaggcggacagatgagtccttg

SEQ ID NO: 314380 - DNA, 25 bp, Homo sapien
aatagttgacttgccaggtttaatt

SEQ ID NO: 314381 - DNA, 25 bp, Homo sapien
ttgccaggtttaattctttcattgc

SEQ ID NO: 314382 - DNA, 25 bp, Homo sapien
actgtgtgtagtaagctgacggtaa

SEQ ID NO: 314383 - DNA, 25 bp, Homo sapien
agaatacatatcactgccaggcctg

SEQ ID NO: 314384 - DNA, 25 bp, Homo sapien
aacagtgatgaattgtcaggacctt

SEQ ID NO: 314385 - DNA, 25 bp, Homo sapien
tcaggaccttatttaggaaaccctg

SEQ ID NO: 314386 - DNA, 25 bp, Homo sapien
ataactccctgctaggctaagtaga

SEQ ID NO: 314387 - DNA, 25 bp, Homo sapien
gaaaccaggttatttctccctgctt

SEQ ID NO: 314388 - DNA, 25 bp, Homo sapien
ggttatttctccctgcttatggctc

SEQ ID NO: 314389 - DNA, 25 bp, Homo sapien
tatggctccccgcaaagggacttgc

SEQ ID NO: 314390 - DNA, 25 bp, Homo sapien
aagggacttgcagcgtgtcctgcaa

SEQ ID NO: 314391 - DNA, 25 bp, Homo sapien
aagagagtgaactcctctcccagag

SEQ ID NO: 314392 - DNA, 25 bp, Homo sapien
ctcctctcccagaggtcatggagaa

SEQ ID NO: 314393 - DNA, 25 bp, Homo sapien
catccaggtacagaggtatctgcat

SEQ ID NO: 314394 - DNA, 25 bp, Homo sapien
ggtacagaggtatctgcatggtaaa

SEQ ID NO: 314395 - DNA, 25 bp, Homo sapien
actgcagcctcggaaagtttgtcta

SEQ ID NO: 314396 - DNA, 25 bp, Homo sapien
aaagtttgtctaggccaaggcgctc

SEQ ID NO: 314397 - DNA, 25 bp, Homo sapien
ttgtctaggccaaggcgctctcctt

SEQ ID NO: 314398 - DNA, 25 bp, Homo sapien
ttctgcctgcctcttagtgtgggac

SEQ ID NO: 314399 - DNA, 25 bp, Homo sapien
tcttagtgtgggacctcccagggag

SEQ ID NO: 314400 - DNA, 25 bp, Homo sapien
tgggacctcccagggagatgagaaa

SEQ ID NO: 314401 - DNA, 25 bp, Homo sapien
tgcatggtaaataccacctccgcac

SEQ ID NO: 314402 - DNA, 25 bp, Homo sapien
caccaaaatcccatcgcttgaaccc

SEQ ID NO: 314403 - DNA, 25 bp, Homo sapien
ttaaaaatagctcacaccaaaatcc

SEQ ID NO: 314404 - DNA, 25 bp, Homo sapien
taaaaatagctcacaccaaaatccc

SEQ ID NO: 314405 - DNA, 25 bp, Homo sapien
aaaaatagctcacaccaaaatccca

SEQ ID NO: 314406 - DNA, 25 bp, Homo sapien
aaaatagctcacaccaaaatcccat

SEQ ID NO: 314407 - DNA, 25 bp, Homo sapien
aaatagctcacaccaaaatcccatc

SEQ ID NO: 314408 - DNA, 25 bp, Homo sapien
aatagctcacaccaaaatcccatcg

SEQ ID NO: 314409 - DNA, 25 bp, Homo sapien
atagctcacaccaaaatcccatcgc

SEQ ID NO: 314410 - DNA, 25 bp, Homo sapien
tagctcacaccaaaatcccatcgct

SEQ ID NO: 314411 - DNA, 25 bp, Homo sapien
tcacaccaaaatcccatcgcttgaa

SEQ ID NO: 314412 - DNA, 25 bp, Homo sapien
acaccaaaatcccatcgcttgaacc

SEQ ID NO: 314413 - DNA, 25 bp, Homo sapien
gcagttgctggcgattctgagaaaa

SEQ ID NO: 314414 - DNA, 25 bp, Homo sapien
ttctgagaaaacttggccgcatcca

SEQ ID NO: 314415 - DNA, 25 bp, Homo sapien
gccgctgccgagtctctgcgttctg

SEQ ID NO: 314416 - DNA, 25 bp, Homo sapien
ttctggccgcttcccggcttaatga

SEQ ID NO: 314417 - DNA, 25 bp, Homo sapien
ggcttaatgaatgccagccatttaa

SEQ ID NO: 314418 - DNA, 25 bp, Homo sapien
agccatttaatcattgctcctgcca

SEQ ID NO: 314419 - DNA, 25 bp, Homo sapien
tttaatcattgctcctgccaccaca

SEQ ID NO: 314420 - DNA, 25 bp, Homo sapien
gccaccacaaatagatgagcagtta

SEQ ID NO: 314421 - DNA, 25 bp, Homo sapien
taaaactcaacttggcataattcaa

SEQ ID NO: 314422 - DNA, 25 bp, Homo sapien
ccttggtgttgacctttgacctggg

SEQ ID NO: 314423 - DNA, 25 bp, Homo sapien
tcgacccggagcagcctctcggaag

SEQ ID NO: 314424 - DNA, 25 bp, Homo sapien
tggtagacttccctgtagggtaatt

SEQ ID NO: 314425 - DNA, 25 bp, Homo sapien
ttccctgtagggtaattgttatcta

SEQ ID NO: 314426 - DNA, 25 bp, Homo sapien
gtaattgttatctacctggactttt

SEQ ID NO: 314427 - DNA, 25 bp, Homo sapien
gttatctacctggacttttgttggg

SEQ ID NO: 314428 - DNA, 25 bp, Homo sapien
gggtacctgaaatggcggtgttttg

SEQ ID NO: 314429 - DNA, 25 bp, Homo sapien
tgttttttcgagtcatttactttag

SEQ ID NO: 314430 - DNA, 25 bp, Homo sapien
ttcgagtcatttactttagagaaaa

SEQ ID NO: 314431 - DNA, 25 bp, Homo sapien
aaatcctccaagttccttcatggag

SEQ ID NO: 314432 - DNA, 25 bp, Homo sapien
tccaagttccttcatggaggatatg

SEQ ID NO: 314433 - DNA, 25 bp, Homo sapien
ggatatgagtctagtgccagtgtac

SEQ ID NO: 314434 - DNA, 25 bp, Homo sapien
gtctagtgccagtgtactgagaaca

SEQ ID NO: 314435 - DNA, 25 bp, Homo sapien
attcttggtaattgattgctatatg

SEQ ID NO: 314436 - DNA, 25 bp, Homo sapien
gattgctatatgtagaaccctaaat

SEQ ID NO: 314437 - DNA, 25 bp, Homo sapien
gtagaaccctaaattgtttcactga

SEQ ID NO: 314438 - DNA, 25 bp, Homo sapien
aaattgtttcactgaattacaccag

SEQ ID NO: 314439 - DNA, 25 bp, Homo sapien
gaattacaccagtgtgggttttata

SEQ ID NO: 314440 - DNA, 25 bp, Homo sapien
gttttgcttctgcttttgaattcta

SEQ ID NO: 314441 - DNA, 25 bp, Homo sapien
gcttctgcttttgaattctagtaaa

SEQ ID NO: 314442 - DNA, 25 bp, Homo sapien
tatgactaaagagtgacttgtcact

SEQ ID NO: 314443 - DNA, 25 bp, Homo sapien
gacttgtcactaaaattgtcaacat

SEQ ID NO: 314444 - DNA, 25 bp, Homo sapien
gtcactaaaattgtcaacatgcatt

SEQ ID NO: 314445 - DNA, 25 bp, Homo sapien
gaatgttgtgtgctgttcatatgga

SEQ ID NO: 314446 - DNA, 25 bp, Homo sapien
aagcaggtacttatcgaagtgcatc

SEQ ID NO: 314447 - DNA, 25 bp, Homo sapien
atcgaagtgcatcttttcagtctaa

SEQ ID NO: 314448 - DNA, 25 bp, Homo sapien
atcttttcagtctaaatgtttgtct

SEQ ID NO: 314449 - DNA, 25 bp, Homo sapien
gtctaggtgctggtgagtccacatg

SEQ ID NO: 314450 - DNA, 25 bp, Homo sapien
tgctggtgagtccacatggacacat

SEQ ID NO: 314451 - DNA, 25 bp, Homo sapien
ggcaggagtctgctataaagtcaga

SEQ ID NO: 314452 - DNA, 25 bp, Homo sapien
taaagtcagaaggtgagatcctaga

SEQ ID NO: 314453 - DNA, 25 bp, Homo sapien
agagctgaatattacttgattacaa

SEQ ID NO: 314454 - DNA, 25 bp, Homo sapien
aaatcagattgcttaagggtgtgga

SEQ ID NO: 314455 - DNA, 25 bp, Homo sapien
cttaagggtgtggaatagcaggcta

SEQ ID NO: 314456 - DNA, 25 bp, Homo sapien
gaatagcaggctagttttaatacca

SEQ ID NO: 314457 - DNA, 25 bp, Homo sapien
tataaggtacaggttttaatttctg

SEQ ID NO: 314458 - DNA, 25 bp, Homo sapien
aatttctgagtttcttcttttctat

SEQ ID NO: 314459 - DNA, 25 bp, Homo sapien
acaaaatgccgtggcagtatctaac

SEQ ID NO: 314460 - DNA, 25 bp, Homo sapien
aacaatacttcccaccagaattata

SEQ ID NO: 314461 - DNA, 25 bp, Homo sapien
acttcccaccagaattatatatcct

SEQ ID NO: 314462 - DNA, 25 bp, Homo sapien
agatcattatccttttctctaccta

SEQ ID NO: 314463 - DNA, 25 bp, Homo sapien
atcattatccttttctctacctaaa

SEQ ID NO: 314464 - DNA, 25 bp, Homo sapien
tatccttttctctacctaaatatga

SEQ ID NO: 314465 - DNA, 25 bp, Homo sapien
ttctctacctaaatatgaggagtct

SEQ ID NO: 314466 - DNA, 25 bp, Homo sapien
tgaggagtcttagcataatgacaaa

SEQ ID NO: 314467 - DNA, 25 bp, Homo sapien
gcttaataacagttttgaatgtgag

SEQ ID NO: 314468 - DNA, 25 bp, Homo sapien
tacctagcggtctcttgattgtcga

SEQ ID NO: 314469 - DNA, 25 bp, Homo sapien
agcggtctcttgattgtcgatattt

SEQ ID NO: 314470 - DNA, 25 bp, Homo sapien
gattgtcgatattttgttggcatag

SEQ ID NO: 314471 - DNA, 25 bp, Homo sapien
gcataggtttatgtagagacgtata

SEQ ID NO: 314472 - DNA, 25 bp, Homo sapien
gacacactgtctttaaatctaggcc

SEQ ID NO: 314473 - DNA, 25 bp, Homo sapien
taaatctaggcctgtatccggtgtc

SEQ ID NO: 314474 - DNA, 25 bp, Homo sapien
tgtatccggtgtccgaggcgaactc

SEQ ID NO: 314475 - DNA, 25 bp, Homo sapien
gtgtccgaggcgaactcagtaagat

SEQ ID NO: 314476 - DNA, 25 bp, Homo sapien
agaggaaacctgaagcaagtgcgca

SEQ ID NO: 314477 - DNA, 25 bp, Homo sapien
aaacctgaagcaagtgcgcattgag

SEQ ID NO: 314478 - DNA, 25 bp, Homo sapien
gacgggttgccgactcgcctaccta

SEQ ID NO: 314479 - DNA, 25 bp, Homo sapien
tcagctgtactgagccaggcaaagc

SEQ ID NO: 314480 - DNA, 25 bp, Homo sapien
aaagcatccgattaccccactgctg

SEQ ID NO: 314481 - DNA, 25 bp, Homo sapien
gaaatgcctacccagatatgttaag

SEQ ID NO: 314482 - DNA, 25 bp, Homo sapien
actgctgtacacatcatgacctggg

SEQ ID NO: 314483 - DNA, 25 bp, Homo sapien
gggccgttggcctaagaaatatgtt

SEQ ID NO: 314484 - DNA, 25 bp, Homo sapien
gttgcttttcatcctgtataactgc

SEQ ID NO: 314485 - DNA, 25 bp, Homo sapien
tataactgcaactttgtgccggctc

SEQ ID NO: 314486 - DNA, 25 bp, Homo sapien
gtgccggctcatattatgttctaga

SEQ ID NO: 314487 - DNA, 25 bp, Homo sapien
gagagctcatgtacaccatggtgac

SEQ ID NO: 314488 - DNA, 25 bp, Homo sapien
ggaaaactcatttgcaatgctgaga

SEQ ID NO: 314489 - DNA, 25 bp, Homo sapien
aataggagagcatacactgtgggaa

SEQ ID NO: 314490 - DNA, 25 bp, Homo sapien
aagttatatcagtgactcaggctta

SEQ ID NO: 314491 - DNA, 25 bp, Homo sapien
gtgactcaggcttattatctgtaaa

SEQ ID NO: 314492 - DNA, 25 bp, Homo sapien
gggattatagcattcctgcctcata

SEQ ID NO: 314493 - DNA, 25 bp, Homo sapien
gcattcctgcctcatagggatgtta

SEQ ID NO: 314494 - DNA, 25 bp, Homo sapien
aaccttatcagattggtgtggtgaa

SEQ ID NO: 314495 - DNA, 25 bp, Homo sapien
cagtaactgagcctcgtgagcatta

SEQ ID NO: 314496 - DNA, 25 bp, Homo sapien
aagttagcctgtatactgggcatac

SEQ ID NO: 314497 - DNA, 25 bp, Homo sapien
ctgggcatacacattcttctggatt

SEQ ID NO: 314498 - DNA, 25 bp, Homo sapien
gatttgctccttttgtgagcaatca

SEQ ID NO: 314499 - DNA, 25 bp, Homo sapien
gagctaaaggcatttgctaactagt

SEQ ID NO: 314500 - DNA, 25 bp, Homo sapien
gactgaatacctgtgaacaagttat

SEQ ID NO: 314501 - DNA, 25 bp, Homo sapien
gattctgaaaacaaagtgtgagcga

SEQ ID NO: 314502 - DNA, 25 bp, Homo sapien
aagtgtgagcgattgacctgagaat

SEQ ID NO: 314503 - DNA, 25 bp, Homo sapien
gtgagcgattgacctgagaataaaa

SEQ ID NO: 314504 - DNA, 25 bp, Homo sapien
gctaaagcagttcacattggttttc

SEQ ID NO: 314505 - DNA, 25 bp, Homo sapien
ttcttttagcaagccattggtatct

SEQ ID NO: 314506 - DNA, 25 bp, Homo sapien
attggtatctgaatgctaagatagc

SEQ ID NO: 314507 - DNA, 25 bp, Homo sapien
aactgtaacaaggtggactgctttc

SEQ ID NO: 314508 - DNA, 25 bp, Homo sapien
gtaacaaggtggactgctttcccat

SEQ ID NO: 314509 - DNA, 25 bp, Homo sapien
aaggtggactgctttcccatacagt

SEQ ID NO: 314510 - DNA, 25 bp, Homo sapien
ggactgctttcccatacagtgcatg

SEQ ID NO: 314511 - DNA, 25 bp, Homo sapien
tttcccatacagtgcatgccgggct

SEQ ID NO: 314512 - DNA, 25 bp, Homo sapien
tagggttcaccatattctagtacaa

SEQ ID NO: 314513 - DNA, 25 bp, Homo sapien
attctagtacaacttcatcttattt

SEQ ID NO: 314514 - DNA, 25 bp, Homo sapien
taaggtctcattcacaggtcccagg

SEQ ID NO: 314515 - DNA, 25 bp, Homo sapien
agacttgaacatatctttttggaaa

SEQ ID NO: 314516 - DNA, 25 bp, Homo sapien
ggaaagatacacttcaacccaaaag

SEQ ID NO: 314517 - DNA, 25 bp, Homo sapien
ttttcccttttgtcatcctggttgt

SEQ ID NO: 314518 - DNA, 25 bp, Homo sapien
tctgtttttgtgagaggctatggag

SEQ ID NO: 314519 - DNA, 25 bp, Homo sapien
gagaggctatggaggaaattcaaaa

SEQ ID NO: 314520 - DNA, 25 bp, Homo sapien
attcaaaatcaatgctgctgccacc

SEQ ID NO: 314521 - DNA, 25 bp, Homo sapien
tcttgctccaccgagaaccttgtgg

SEQ ID NO: 314522 - DNA, 25 bp, Homo sapien
caccgagaaccttgtggttgtgttc

SEQ ID NO: 314523 - DNA, 25 bp, Homo sapien
catcagcgggttgcccgccgctgac

SEQ ID NO: 314524 - DNA, 25 bp, Homo sapien
gccaggatgcacagaccgaccgaca

SEQ ID NO: 314525 - DNA, 25 bp, Homo sapien
caggatgcacagaccgaccgacaga

SEQ ID NO: 314526 - DNA, 25 bp, Homo sapien
aggatgcacagaccgaccgacagac

SEQ ID NO: 314527 - DNA, 25 bp, Homo sapien
acagaccgaccgacagacctcagtg

SEQ ID NO: 314528 - DNA, 25 bp, Homo sapien
agaccgaccgacagacctcagtgcc

SEQ ID NO: 314529 - DNA, 25 bp, Homo sapien
cccctgcgccctaatggtgctaacc

SEQ ID NO: 314530 - DNA, 25 bp, Homo sapien
taatggtgctaaccccctctcacta

SEQ ID NO: 314531 - DNA, 25 bp, Homo sapien
ttttattctaacagtttgtgtaaca

SEQ ID NO: 314532 - DNA, 25 bp, Homo sapien
attctaacagtttgtgtaacattta

SEQ ID NO: 314533 - DNA, 25 bp, Homo sapien
acagtttgtgtaacatttattatga

SEQ ID NO: 314534 - DNA, 25 bp, Homo sapien
ctcacacagcagtttgtaaccgcaa

SEQ ID NO: 314535 - DNA, 25 bp, Homo sapien
gtttgtaaccgcaagcattctcttt

SEQ ID NO: 314536 - DNA, 25 bp, Homo sapien
agcattctctttgaattctcacaga

SEQ ID NO: 314537 - DNA, 25 bp, Homo sapien
tctcacagaattcagcaagaagtag

SEQ ID NO: 314538 - DNA, 25 bp, Homo sapien
gtgaatttagtcacccttagccctt

SEQ ID NO: 314539 - DNA, 25 bp, Homo sapien
ttagcccttcagataagcctagcca

SEQ ID NO: 314540 - DNA, 25 bp, Homo sapien
taagcctagccagtacatatttcag

SEQ ID NO: 314541 - DNA, 25 bp, Homo sapien
gtacatatttcagcacaggcagttt

SEQ ID NO: 314542 - DNA, 25 bp, Homo sapien
attgaggtaactgagcacttgagaa

SEQ ID NO: 314543 - DNA, 25 bp, Homo sapien
agcacttgagaatattttagggtca

SEQ ID NO: 314544 - DNA, 25 bp, Homo sapien
gatattaaaaagacgttcagtccta

SEQ ID NO: 314545 - DNA, 25 bp, Homo sapien
gttactctataactctatgaccctg

SEQ ID NO: 314546 - DNA, 25 bp, Homo sapien
tactctataactctatgaccctgtg

SEQ ID NO: 314547 - DNA, 25 bp, Homo sapien
actctataactctatgaccctgtgt

SEQ ID NO: 314548 - DNA, 25 bp, Homo sapien
ctctataactctatgaccctgtgta

SEQ ID NO: 314549 - DNA, 25 bp, Homo sapien
ctataactctatgaccctgtgtagg

SEQ ID NO: 314550 - DNA, 25 bp, Homo sapien
tataactctatgaccctgtgtaggg

SEQ ID NO: 314551 - DNA, 25 bp, Homo sapien
ataactctatgaccctgtgtagggc

SEQ ID NO: 314552 - DNA, 25 bp, Homo sapien
aactctatgaccctgtgtagggcca

SEQ ID NO: 314553 - DNA, 25 bp, Homo sapien
actctatgaccctgtgtagggccag

SEQ ID NO: 314554 - DNA, 25 bp, Homo sapien
tctatgaccctgtgtagggccaggc

SEQ ID NO: 314555 - DNA, 25 bp, Homo sapien
ctatgaccctgtgtagggccaggca

SEQ ID NO: 314556 - DNA, 25 bp, Homo sapien
tatacttttggttattacgattaca

SEQ ID NO: 314557 - DNA, 25 bp, Homo sapien
cttttggttattacgattacacata

SEQ ID NO: 314558 - DNA, 25 bp, Homo sapien
ggttattacgattacacataatttt

SEQ ID NO: 314559 - DNA, 25 bp, Homo sapien
aatgggagcctctctgtaccccacc

SEQ ID NO: 314560 - DNA, 25 bp, Homo sapien
ttgggcattggctcattttcataaa

SEQ ID NO: 314561 - DNA, 25 bp, Homo sapien
attttcataaataacctcatcccag

SEQ ID NO: 314562 - DNA, 25 bp, Homo sapien
tttcataaataacctcatcccagac

SEQ ID NO: 314563 - DNA, 25 bp, Homo sapien
agggaaggtgttgtggctgttttgt

SEQ ID NO: 314564 - DNA, 25 bp, Homo sapien
ttggagctgtaagagggatcatgtc

SEQ ID NO: 314565 - DNA, 25 bp, Homo sapien
ggagctgtaagagggatcatgtcat

SEQ ID NO: 314566 - DNA, 25 bp, Homo sapien
agctgtaagagggatcatgtcatat

SEQ ID NO: 314567 - DNA, 25 bp, Homo sapien
gctgagatcactcctctgcttcagc

SEQ ID NO: 314568 - DNA, 25 bp, Homo sapien
agatcactcctctgcttcagcctgg

SEQ ID NO: 314569 - DNA, 25 bp, Homo sapien
gatcactcctctgcttcagcctggg

SEQ ID NO: 314570 - DNA, 25 bp, Homo sapien
atcactcctctgcttcagcctgggc

SEQ ID NO: 314571 - DNA, 25 bp, Homo sapien
tcactcctctgcttcagcctgggca

SEQ ID NO: 314572 - DNA, 25 bp, Homo sapien
cactcctctgcttcagcctgggcaa

SEQ ID NO: 314573 - DNA, 25 bp, Homo sapien
tcctctgcttcagcctgggcaattg

SEQ ID NO: 314574 - DNA, 25 bp, Homo sapien
ctctgcttcagcctgggcaattgag

SEQ ID NO: 314575 - DNA, 25 bp, Homo sapien
tctgcttcagcctgggcaattgagc

SEQ ID NO: 314576 - DNA, 25 bp, Homo sapien
ctgcttcagcctgggcaattgagcc

SEQ ID NO: 314577 - DNA, 25 bp, Homo sapien
gcttcagcctgggcaattgagccag

SEQ ID NO: 314578 - DNA, 25 bp, Homo sapien
gcctggaaacaaacagagccagcag

SEQ ID NO: 314579 - DNA, 25 bp, Homo sapien
gcagaacagaagctcaacagtgtgt

SEQ ID NO: 314580 - DNA, 25 bp, Homo sapien
gaacagaagctcaacagtgtgtgga

SEQ ID NO: 314581 - DNA, 25 bp, Homo sapien
ccccaaagagagtggcgttgcttac

SEQ ID NO: 314582 - DNA, 25 bp, Homo sapien
aagagagtggcgttgcttactatgt

SEQ ID NO: 314583 - DNA, 25 bp, Homo sapien
gcttactatgtggacctgcatggac

SEQ ID NO: 314584 - DNA, 25 bp, Homo sapien
ctatgtggacctgcatggacatgct

SEQ ID NO: 314585 - DNA, 25 bp, Homo sapien
ggacctgcatggacatgcttccaaa

SEQ ID NO: 314586 - DNA, 25 bp, Homo sapien
ctgcatggacatgcttccaaaaggg

SEQ ID NO: 314587 - DNA, 25 bp, Homo sapien
aaagctcatctccttgaattcagcc

SEQ ID NO: 314588 - DNA, 25 bp, Homo sapien
tctccttgaattcagcccacttcga

SEQ ID NO: 314589 - DNA, 25 bp, Homo sapien
attaaggaaggctttctatacatag

SEQ ID NO: 314590 - DNA, 25 bp, Homo sapien
taaggaaggctttctatacatagaa

SEQ ID NO: 314591 - DNA, 25 bp, Homo sapien
aaataaagatgcctaggccgggtgc

SEQ ID NO: 314592 - DNA, 25 bp, Homo sapien
ataaagatgcctaggccgggtgcag

SEQ ID NO: 314593 - DNA, 25 bp, Homo sapien
ttctttttaatctccatggaacaat

SEQ ID NO: 314594 - DNA, 25 bp, Homo sapien
aatctccatggaacaatttgtataa

SEQ ID NO: 314595 - DNA, 25 bp, Homo sapien
ggaacaatttgtataatttcttgat

SEQ ID NO: 314596 - DNA, 25 bp, Homo sapien
gatttaaattgctaaactgagctct

SEQ ID NO: 314597 - DNA, 25 bp, Homo sapien
tttaaattgctaaactgagctcttc

SEQ ID NO: 314598 - DNA, 25 bp, Homo sapien
aaattgctaaactgagctcttcatt

SEQ ID NO: 314599 - DNA, 25 bp, Homo sapien
gctcttcattcaaaatactaaacaa

SEQ ID NO: 314600 - DNA, 25 bp, Homo sapien
tcttctggaacttcaagcaaatgtg

SEQ ID NO: 314601 - DNA, 25 bp, Homo sapien
tctaagacagcaccactgccgcaag

SEQ ID NO: 314602 - DNA, 25 bp, Homo sapien
ccactgccgcaagtgtgggaaggcc

SEQ ID NO: 314603 - DNA, 25 bp, Homo sapien
cccctgatgggcttcgagtttgaag

SEQ ID NO: 314604 - DNA, 25 bp, Homo sapien
tgtgacagctgccacgaggccatca

SEQ ID NO: 314605 - DNA, 25 bp, Homo sapien
ctgccacgaggccatcacagatgaa

SEQ ID NO: 314606 - DNA, 25 bp, Homo sapien
acagatgaagaacgtgcacccacag

SEQ ID NO: 314607 - DNA, 25 bp, Homo sapien
acagccaccttccatgacagtaaac

SEQ ID NO: 314608 - DNA, 25 bp, Homo sapien
gacagtaaacataacattgtgcatg

SEQ ID NO: 314609 - DNA, 25 bp, Homo sapien
acattgtgcatgtgcatttcgatgc

SEQ ID NO: 314610 - DNA, 25 bp, Homo sapien
gcatttcgatgcaaccagaggatgg

SEQ ID NO: 314611 - DNA, 25 bp, Homo sapien
tgccacagttcttatactataatca

SEQ ID NO: 314612 - DNA, 25 bp, Homo sapien
tatagacatagatatataaccatat

SEQ ID NO: 314613 - DNA, 25 bp, Homo sapien
tataaccatatatcatacctggata

SEQ ID NO: 314614 - DNA, 25 bp, Homo sapien
atatcatacctggatatagacacac

SEQ ID NO: 314615 - DNA, 25 bp, Homo sapien
actataatcatatcgctttgtaata

SEQ ID NO: 314616 - DNA, 25 bp, Homo sapien
tgtaatataaatttctcccactttt

SEQ ID NO: 314617 - DNA, 25 bp, Homo sapien
ctcccactttttccattataagatt

SEQ ID NO: 314618 - DNA, 25 bp, Homo sapien
aaaatagctcacaccaaaatcccat

SEQ ID NO: 314619 - DNA, 25 bp, Homo sapien
aaatagctcacaccaaaatcccatc

SEQ ID NO: 314620 - DNA, 25 bp, Homo sapien
aatagctcacaccaaaatcccatcg

SEQ ID NO: 314621 - DNA, 25 bp, Homo sapien
tcacaccaaaatcccatcgcttgaa

SEQ ID NO: 314622 - DNA, 25 bp, Homo sapien
acaagcttgattcctgttctcgttt

SEQ ID NO: 314623 - DNA, 25 bp, Homo sapien
tgttctcgttttccccgaaggcagt

SEQ ID NO: 314624 - DNA, 25 bp, Homo sapien
gaaggcagttttcaccctctgcttt

SEQ ID NO: 314625 - DNA, 25 bp, Homo sapien
accctctgctttgagagcactttac

SEQ ID NO: 314626 - DNA, 25 bp, Homo sapien
gagcactttactgaacaagtacttg

SEQ ID NO: 314627 - DNA, 25 bp, Homo sapien
aagtacttgataccacgctcactat

SEQ ID NO: 314628 - DNA, 25 bp, Homo sapien
gataccacgctcactatgtgctaga

SEQ ID NO: 314629 - DNA, 25 bp, Homo sapien
atgtgctagacactgttctcggcac

SEQ ID NO: 314630 - DNA, 25 bp, Homo sapien
gacaccccagtgcagtgagtgcagt

SEQ ID NO: 314631 - DNA, 25 bp, Homo sapien
cagagagattctgagttccccactc

SEQ ID NO: 314632 - DNA, 25 bp, Homo sapien
ctccacatcggtcagttttatcttt

SEQ ID NO: 314633 - DNA, 25 bp, Homo sapien
tgtattaaactgaccgttctttgga

SEQ ID NO: 314634 - DNA, 25 bp, Homo sapien
gtaaataccaacctcgctacaacct

SEQ ID NO: 314635 - DNA, 25 bp, Homo sapien
tacagacgcatctgttctcgcctgg

SEQ ID NO: 314636 - DNA, 25 bp, Homo sapien
aaaatgccctccacggagacaaggc

SEQ ID NO: 314637 - DNA, 25 bp, Homo sapien
gacaaggcctgagaaccttcgggac

SEQ ID NO: 314638 - DNA, 25 bp, Homo sapien
ccgctgccgctcactgtgttgaaga

SEQ ID NO: 314639 - DNA, 25 bp, Homo sapien
ttttccaacgccctgagtaattcta

SEQ ID NO: 314640 - DNA, 25 bp, Homo sapien
acgccctgagtaattctagccaaaa

SEQ ID NO: 314641 - DNA, 25 bp, Homo sapien
tagccaaaatgcgtgactcgcctca

SEQ ID NO: 314642 - DNA, 25 bp, Homo sapien
gcctcacactagatgcttgctgtaa

SEQ ID NO: 314643 - DNA, 25 bp, Homo sapien
gcttgctgtaattgtgtctctgtat

SEQ ID NO: 314644 - DNA, 25 bp, Homo sapien
atatccttataatctaataatcttt

SEQ ID NO: 314645 - DNA, 25 bp, Homo sapien
taatctaataatctttatctgttct

SEQ ID NO: 314646 - DNA, 25 bp, Homo sapien
ttattttatgtatgttcttctaacc

SEQ ID NO: 314647 - DNA, 25 bp, Homo sapien
tattttatgtatgttcttctaacct

SEQ ID NO: 314648 - DNA, 25 bp, Homo sapien
atgtatgttcttctaaccttgcacc

SEQ ID NO: 314649 - DNA, 25 bp, Homo sapien
tgtatgttcttctaaccttgcaccc

SEQ ID NO: 314650 - DNA, 25 bp, Homo sapien
gtatgttcttctaaccttgcacccc

SEQ ID NO: 314651 - DNA, 25 bp, Homo sapien
caaggacatggactctattgacaca

SEQ ID NO: 314652 - DNA, 25 bp, Homo sapien
aaggacatggactctattgacacac

SEQ ID NO: 314653 - DNA, 25 bp, Homo sapien
aggacatggactctattgacacact

SEQ ID NO: 314654 - DNA, 25 bp, Homo sapien
ggacatggactctattgacacacta

SEQ ID NO: 314655 - DNA, 25 bp, Homo sapien
tgggtgtcatatgaagagaccttcc

SEQ ID NO: 314656 - DNA, 25 bp, Homo sapien
gagaccttcctggatgaattgcaga

SEQ ID NO: 314657 - DNA, 25 bp, Homo sapien
gtaaataagccacatttgcctacaa

SEQ ID NO: 314658 - DNA, 25 bp, Homo sapien
gcctacaaagcaagcttcaatccat

SEQ ID NO: 314659 - DNA, 25 bp, Homo sapien
gcttcaatccatatgcaatgtgcag

SEQ ID NO: 314660 - DNA, 25 bp, Homo sapien
ccaacaatcccattcactagaggta

SEQ ID NO: 314661 - DNA, 25 bp, Homo sapien
tcccattcactagaggtaactacta

SEQ ID NO: 314662 - DNA, 25 bp, Homo sapien
gtatcatactctgcatacagttctg

SEQ ID NO: 314663 - DNA, 25 bp, Homo sapien
catactctgcatacagttctgcatc

SEQ ID NO: 314664 - DNA, 25 bp, Homo sapien
ctgcatcttgattttagtcacttag

SEQ ID NO: 314665 - DNA, 25 bp, Homo sapien
agtcacttagcagttcagtgtttta

SEQ ID NO: 314666 - DNA, 25 bp, Homo sapien
aggctgccctgtttggaaggttcct

SEQ ID NO: 314667 - DNA, 25 bp, Homo sapien
ttggaaggttcctgtccttctgtct

SEQ ID NO: 314668 - DNA, 25 bp, Homo sapien
cctgtccttctgtcttggtagaaaa

SEQ ID NO: 314669 - DNA, 25 bp, Homo sapien
cttggtagaaaatggcagctagcct

SEQ ID NO: 314670 - DNA, 25 bp, Homo sapien
agctagccttgtaaagggcctcctt

SEQ ID NO: 314671 - DNA, 25 bp, Homo sapien
aaagggcctccttgtgtagcgagat

SEQ ID NO: 314672 - DNA, 25 bp, Homo sapien
cttgtgtagcgagatagaccatgta

SEQ ID NO: 314673 - DNA, 25 bp, Homo sapien
gggtctctcagtatatgtctagtgc

SEQ ID NO: 314674 - DNA, 25 bp, Homo sapien
ctcagtatatgtctagtgccaccac

SEQ ID NO: 314675 - DNA, 25 bp, Homo sapien
atgtctagtgccaccactattggtg

SEQ ID NO: 314676 - DNA, 25 bp, Homo sapien
accactattggtggagagtttcctt

SEQ ID NO: 314677 - DNA, 25 bp, Homo sapien
agatcttgatctaaggccctgggaa

SEQ ID NO: 314678 - DNA, 25 bp, Homo sapien
gccctgggaatgatactcctaccta

SEQ ID NO: 314679 - DNA, 25 bp, Homo sapien
agagtttcccaccaagactacctgt

SEQ ID NO: 314680 - DNA, 25 bp, Homo sapien
agactacctgtttatttccaatttg

SEQ ID NO: 314681 - DNA, 25 bp, Homo sapien
ttgtgctatcaaatgcaaggacatt

SEQ ID NO: 314682 - DNA, 25 bp, Homo sapien
aggacatttttctagatgcagatgt

SEQ ID NO: 314683 - DNA, 25 bp, Homo sapien
gagtgtgaagccttgtaagccacca

SEQ ID NO: 314684 - DNA, 25 bp, Homo sapien
gaagccttgtaagccaccagactga

SEQ ID NO: 314685 - DNA, 25 bp, Homo sapien
accagactgacagaaagccgtgggc

SEQ ID NO: 314686 - DNA, 25 bp, Homo sapien
aagccgtgggcaaccctaggagact

SEQ ID NO: 314687 - DNA, 25 bp, Homo sapien
gaaaaagaaacctcctgacaacaca

SEQ ID NO: 314688 - DNA, 25 bp, Homo sapien
gagaagaaaaacgtacttgattggt

SEQ ID NO: 314689 - DNA, 25 bp, Homo sapien
gttattcatgaggaagctagcataa

SEQ ID NO: 314690 - DNA, 25 bp, Homo sapien
aacttgataagttcttgcattgagt

SEQ ID NO: 314691 - DNA, 25 bp, Homo sapien
aagttcttgcattgagtgactgcta

SEQ ID NO: 314692 - DNA, 25 bp, Homo sapien
tcttgcattgagtgactgctaattt

SEQ ID NO: 314693 - DNA, 25 bp, Homo sapien
gagtgactgctaatttgaaagtaac

SEQ ID NO: 314694 - DNA, 25 bp, Homo sapien
atgagacagatttcctttctggaac

SEQ ID NO: 314695 - DNA, 25 bp, Homo sapien
gacagatttcctttctggaacactt

SEQ ID NO: 314696 - DNA, 25 bp, Homo sapien
gatttcctttctggaacacttgttg

SEQ ID NO: 314697 - DNA, 25 bp, Homo sapien
aacacttgttgtttcttagtattga

SEQ ID NO: 314698 - DNA, 25 bp, Homo sapien
ggattagcaatccttttaaaaagag

SEQ ID NO: 314699 - DNA, 25 bp, Homo sapien
agcagcgtccagttcgagatggttc

SEQ ID NO: 314700 - DNA, 25 bp, Homo sapien
tgacctggtttactcgtcacgaccc

SEQ ID NO: 314701 - DNA, 25 bp, Homo sapien
aaacacgtctaaaacccacagctgt

SEQ ID NO: 314702 - DNA, 25 bp, Homo sapien
gacatgaccccaaagcagtccaaag

SEQ ID NO: 314703 - DNA, 25 bp, Homo sapien
agtccaaagtggtgaaggccatcct

SEQ ID NO: 314704 - DNA, 25 bp, Homo sapien
tgaaggccatcctgtggctctgtgg

SEQ ID NO: 314705 - DNA, 25 bp, Homo sapien
aagggcaaggaagagctcccggcca

SEQ ID NO: 314706 - DNA, 25 bp, Homo sapien
gagcagaagccatcatagtttccct

SEQ ID NO: 314707 - DNA, 25 bp, Homo sapien
gtcacgaccccgtggtccagaagga

SEQ ID NO: 314708 - DNA, 25 bp, Homo sapien
ccagaaggaacaagcaccaccagca

SEQ ID NO: 314709 - DNA, 25 bp, Homo sapien
aacgggatgccagaggccagcagca

SEQ ID NO: 314710 - DNA, 25 bp, Homo sapien
gaagttcttttttgatgatggtgtt

SEQ ID NO: 314711 - DNA, 25 bp, Homo sapien
gatggtgtttgtgccttgatagaat

SEQ ID NO: 314712 - DNA, 25 bp, Homo sapien
agaatttttaggctgagagatcatg

SEQ ID NO: 314713 - DNA, 25 bp, Homo sapien
gagatcatggagtttatgccttcct

SEQ ID NO: 314714 - DNA, 25 bp, Homo sapien
agtttatgccttccttatcagtgag

SEQ ID NO: 314715 - DNA, 25 bp, Homo sapien
ccttccttatcagtgaggctgttta

SEQ ID NO: 314716 - DNA, 25 bp, Homo sapien
atcagtgaggctgtttagtggtgct

SEQ ID NO: 314717 - DNA, 25 bp, Homo sapien
tcaaactcccgagctcagcaattca

SEQ ID NO: 314718 - DNA, 25 bp, Homo sapien
acacagcaaatgagcaacaagtctt

SEQ ID NO: 314719 - DNA, 25 bp, Homo sapien
gttgggtggccttgcacctgcccct

SEQ ID NO: 314720 - DNA, 25 bp, Homo sapien
ccggccttgaagttcttttttgatg

SEQ ID NO: 314721 - DNA, 25 bp, Homo sapien
acggaggaacgcaggtctgctgcca

SEQ ID NO: 314722 - DNA, 25 bp, Homo sapien
acgcaggtctgctgccagggattga

SEQ ID NO: 314723 - DNA, 25 bp, Homo sapien
atgctgaagacaggctgatgggctc

SEQ ID NO: 314724 - DNA, 25 bp, Homo sapien
gatgggctcagctggtaggctccac

SEQ ID NO: 314725 - DNA, 25 bp, Homo sapien
tcagctggtaggctccactatctcg

SEQ ID NO: 314726 - DNA, 25 bp, Homo sapien
actatctcgccatgactgctgaaaa

SEQ ID NO: 314727 - DNA, 25 bp, Homo sapien
tcatcacttgcaaactctgcctgtg

SEQ ID NO: 314728 - DNA, 25 bp, Homo sapien
aaactctgcctgtgtgagcagtctc

SEQ ID NO: 314729 - DNA, 25 bp, Homo sapien
gcctgtgtgagcagtctctggacaa

SEQ ID NO: 314730 - DNA, 25 bp, Homo sapien
gtgagcagtctctggacaagatgac

SEQ ID NO: 314731 - DNA, 25 bp, Homo sapien
ggctactgagaagcccggcgacgga

SEQ ID NO: 314732 - DNA, 25 bp, Homo sapien
gaatcctttcctaagaatcgttgag

SEQ ID NO: 314733 - DNA, 25 bp, Homo sapien
aatcgttgaggaccaaagttgtctt

SEQ ID NO: 314734 - DNA, 25 bp, Homo sapien
caaagttgtctttgctgacacgtgt

SEQ ID NO: 314735 - DNA, 25 bp, Homo sapien
ttgtctttgctgacacgtgttgctt

SEQ ID NO: 314736 - DNA, 25 bp, Homo sapien
ctgacacgtgttgcttttctctttg

SEQ ID NO: 314737 - DNA, 25 bp, Homo sapien
gaaaaatcaagttgactgtgtcaag

SEQ ID NO: 314738 - DNA, 25 bp, Homo sapien
gttgactgtgtcaagtaacacccca

SEQ ID NO: 314739 - DNA, 25 bp, Homo sapien
agccatagtggctctctggagacac

SEQ ID NO: 314740 - DNA, 25 bp, Homo sapien
tctggagacacaggtcacaggcgga

SEQ ID NO: 314741 - DNA, 25 bp, Homo sapien
acacaggtcacaggcggagggtccc

SEQ ID NO: 314742 - DNA, 25 bp, Homo sapien
acaggcggagggtcccctgatcatc

SEQ ID NO: 314743 - DNA, 25 bp, Homo sapien
atatccttataatctaataatcttt

SEQ ID NO: 314744 - DNA, 25 bp, Homo sapien
tatccttataatctaataatcttta

SEQ ID NO: 314745 - DNA, 25 bp, Homo sapien
ataatctaataatctttatctgttc

SEQ ID NO: 314746 - DNA, 25 bp, Homo sapien
taatctaataatctttatctgttct

SEQ ID NO: 314747 - DNA, 25 bp, Homo sapien
caggtagaaaatataatggtgatga

SEQ ID NO: 314748 - DNA, 25 bp, Homo sapien
ttattttatgtatgttcttctaacc

SEQ ID NO: 314749 - DNA, 25 bp, Homo sapien
tattttatgtatgttcttctaacct

SEQ ID NO: 314750 - DNA, 25 bp, Homo sapien
caaggacatggactctattgacaca

SEQ ID NO: 314751 - DNA, 25 bp, Homo sapien
aaggacatggactctattgacacac

SEQ ID NO: 314752 - DNA, 25 bp, Homo sapien
aggacatggactctattgacacact

SEQ ID NO: 314753 - DNA, 25 bp, Homo sapien
ggacatggactctattgacacacta

SEQ ID NO: 314754 - DNA, 25 bp, Homo sapien
gaaagagcggaaaagggatcactca

SEQ ID NO: 314755 - DNA, 25 bp, Homo sapien
aagggatcactcaaacaacgaccgt

SEQ ID NO: 314756 - DNA, 25 bp, Homo sapien
acaacgaccgtgaagtgccaccgga

SEQ ID NO: 314757 - DNA, 25 bp, Homo sapien
agtgccaccggacttaaccaagaga

SEQ ID NO: 314758 - DNA, 25 bp, Homo sapien
ggacttaaccaagagacgtaaagag

SEQ ID NO: 314759 - DNA, 25 bp, Homo sapien
aaagtccttgtgaatctccttatcc

SEQ ID NO: 314760 - DNA, 25 bp, Homo sapien
gtccttgtgaatctccttatccaaa

SEQ ID NO: 314761 - DNA, 25 bp, Homo sapien
gtgaatctccttatccaaatgagaa

SEQ ID NO: 314762 - DNA, 25 bp, Homo sapien
ggcagtgattcatttaaatctgaga

SEQ ID NO: 314763 - DNA, 25 bp, Homo sapien
gaagatggataaaatctcctccggt

SEQ ID NO: 314764 - DNA, 25 bp, Homo sapien
gataaaatctcctccggtggcaaaa

SEQ ID NO: 314765 - DNA, 25 bp, Homo sapien
aatctgctcttttggaatcatcaca

SEQ ID NO: 314766 - DNA, 25 bp, Homo sapien
aatcatcacattccacttctaaaag

SEQ ID NO: 314767 - DNA, 25 bp, Homo sapien
ggagctttaaagatggcctggttga

SEQ ID NO: 314768 - DNA, 25 bp, Homo sapien
aagatggcctggttgaacgtccttc

SEQ ID NO: 314769 - DNA, 25 bp, Homo sapien
tgaacgtccttcctttgtgagtgag

SEQ ID NO: 314770 - DNA, 25 bp, Homo sapien
aaagatcagatagtccaatggtggc

SEQ ID NO: 314771 - DNA, 25 bp, Homo sapien
gatagtccaatggtggcagtgccag

SEQ ID NO: 314772 - DNA, 25 bp, Homo sapien
gcagtgccaggaacagaattcagct

SEQ ID NO: 314773 - DNA, 25 bp, Homo sapien
tttcttgcccctagacagtgtcttt

SEQ ID NO: 314774 - DNA, 25 bp, Homo sapien
gacagtgtctttcacttgaccctta

SEQ ID NO: 314775 - DNA, 25 bp, Homo sapien
cttactgagttttgaaccttagaat

SEQ ID NO: 314776 - DNA, 25 bp, Homo sapien
ttctttgatgagtctattccaacag

SEQ ID NO: 314777 - DNA, 25 bp, Homo sapien
ttccaacaggactaaattacagggt

SEQ ID NO: 314778 - DNA, 25 bp, Homo sapien
ttacagggtgatgatagactcctct

SEQ ID NO: 314779 - DNA, 25 bp, Homo sapien
atgatagactcctctgtgtcccgtt

SEQ ID NO: 314780 - DNA, 25 bp, Homo sapien
gtgtcccgttccattctaagaagca

SEQ ID NO: 314781 - DNA, 25 bp, Homo sapien
acttatattaggattttggcctctc

SEQ ID NO: 314782 - DNA, 25 bp, Homo sapien
gaagcattttagtgtttcaccgtgg

SEQ ID NO: 314783 - DNA, 25 bp, Homo sapien
ttcaccgtggacaatgctgacttct

SEQ ID NO: 314784 - DNA, 25 bp, Homo sapien
ttcctgctgacttttcgtagtgtta

SEQ ID NO: 314785 - DNA, 25 bp, Homo sapien
gattttcagctgacactcttgaata

SEQ ID NO: 314786 - DNA, 25 bp, Homo sapien
gacactcttgaatattccatgtatt

SEQ ID NO: 314787 - DNA, 25 bp, Homo sapien
ttcctatataccagcgtacacctct

SEQ ID NO: 314788 - DNA, 25 bp, Homo sapien
cagcgtacacctctatcaatacatt

SEQ ID NO: 314789 - DNA, 25 bp, Homo sapien
acactgcctcatgcacagatataga

SEQ ID NO: 314790 - DNA, 25 bp, Homo sapien
tgaagatactttctttcccctgcaa

SEQ ID NO: 314791 - DNA, 25 bp, Homo sapien
ctttctttcccctgcaatgcagaaa

SEQ ID NO: 314792 - DNA, 25 bp, Homo sapien
aattgcatgagcacacacaaccaca

SEQ ID NO: 314793 - DNA, 25 bp, Homo sapien
acaaccacactaaaccaaccagaat

SEQ ID NO: 314794 - DNA, 25 bp, Homo sapien
actagaggcagctgtatctgattga

SEQ ID NO: 314795 - DNA, 25 bp, Homo sapien
attgagattgacagagttacagggc

SEQ ID NO: 314796 - DNA, 25 bp, Homo sapien
ggttaatgagtccatactcctgcct

SEQ ID NO: 314797 - DNA, 25 bp, Homo sapien
tgcctccagtcagaactgtcctaag

SEQ ID NO: 314798 - DNA, 25 bp, Homo sapien
cagtccccgtgtttggatggcagga

SEQ ID NO: 314799 - DNA, 25 bp, Homo sapien
atcccagggcagtgagtttcagggc

SEQ ID NO: 314800 - DNA, 25 bp, Homo sapien
gagtttcagggcataagcagacgtt

SEQ ID NO: 314801 - DNA, 25 bp, Homo sapien
taagcagacgttgccacgttgcctt

SEQ ID NO: 314802 - DNA, 25 bp, Homo sapien
gttgccttcaatcctactggacaag

SEQ ID NO: 314803 - DNA, 25 bp, Homo sapien
actggacaagcatcggtgctggcct

SEQ ID NO: 314804 - DNA, 25 bp, Homo sapien
aattctgttccctcaggatgtgtgt

SEQ ID NO: 314805 - DNA, 25 bp, Homo sapien
gctacagccagtttaatctttgcca

SEQ ID NO: 314806 - DNA, 25 bp, Homo sapien
cagtttaatctttgccattctggca

SEQ ID NO: 314807 - DNA, 25 bp, Homo sapien
gatgtgtgtattgacaagctcagac

SEQ ID NO: 314808 - DNA, 25 bp, Homo sapien
gacaagctcagacaggtctcacacg

SEQ ID NO: 314809 - DNA, 25 bp, Homo sapien
gaggactctactcggcaaagccaga

SEQ ID NO: 314810 - DNA, 25 bp, Homo sapien
aatgacagtcagctacatgaccgat

SEQ ID NO: 314811 - DNA, 25 bp, Homo sapien
catgaccgatggactttctgaagct

SEQ ID NO: 314812 - DNA, 25 bp, Homo sapien
gaagctaaagaccacacctgaatca

SEQ ID NO: 314813 - DNA, 25 bp, Homo sapien
gaatcagggctgtggtaatcatctt

SEQ ID NO: 314814 - DNA, 25 bp, Homo sapien
gtaatcatcttaccatagctgtaaa

SEQ ID NO: 314815 - DNA, 25 bp, Homo sapien
ggcagttaccttgcaatcacttctt

SEQ ID NO: 314816 - DNA, 25 bp, Homo sapien
gcaatcacttctttcacagcagttg

SEQ ID NO: 314817 - DNA, 25 bp, Homo sapien
acagcagttgtattgtgccgtggct

SEQ ID NO: 314818 - DNA, 25 bp, Homo sapien
ttgtgccgtggctagaactgcatga

SEQ ID NO: 314819 - DNA, 25 bp, Homo sapien
gaactgcatgacacatgtcctgtat

SEQ ID NO: 314820 - DNA, 25 bp, Homo sapien
ggctttggccagtagctaaagtgca

SEQ ID NO: 314821 - DNA, 25 bp, Homo sapien
tggccagtagctaaagtgcaagact

SEQ ID NO: 314822 - DNA, 25 bp, Homo sapien
gtagctaaagtgcaagactgaatta

SEQ ID NO: 314823 - DNA, 25 bp, Homo sapien
caagggtggccttgaagaggccaaa

SEQ ID NO: 314824 - DNA, 25 bp, Homo sapien
gaggccaaaggaatgtccatttgct

SEQ ID NO: 314825 - DNA, 25 bp, Homo sapien
aaaggaatgtccatttgctgagttt

SEQ ID NO: 314826 - DNA, 25 bp, Homo sapien
ttccttatgtctccagtctggtgcc

SEQ ID NO: 314827 - DNA, 25 bp, Homo sapien
tctggtgccaggtagtggagtaaaa

SEQ ID NO: 314828 - DNA, 25 bp, Homo sapien
ttttttattctatgtgcacacttac

SEQ ID NO: 314829 - DNA, 25 bp, Homo sapien
tgtgcacacttacagtatacatata

SEQ ID NO: 314830 - DNA, 25 bp, Homo sapien
ttatatcacaatttacgaaaccaaa

SEQ ID NO: 314831 - DNA, 25 bp, Homo sapien
acctgcacaagcctggcggcagtca

SEQ ID NO: 314832 - DNA, 25 bp, Homo sapien
aagcctggcggcagtcagcagtgtc

SEQ ID NO: 314833 - DNA, 25 bp, Homo sapien
ctggcggcagtcagcagtgtcaccc

SEQ ID NO: 314834 - DNA, 25 bp, Homo sapien
cacacctgatactgggcctcagaat

SEQ ID NO: 314835 - DNA, 25 bp, Homo sapien
acacctgatactgggcctcagaatg

SEQ ID NO: 314836 - DNA, 25 bp, Homo sapien
tgggcctcagaatggacatcccgag

SEQ ID NO: 314837 - DNA, 25 bp, Homo sapien
agtgtgtccctgatgactggaaaga

SEQ ID NO: 314838 - DNA, 25 bp, Homo sapien
gaaaagtgtgcctgagacgcggtct

SEQ ID NO: 314839 - DNA, 25 bp, Homo sapien
aaaagtgtgcctgagacgcggtctg

SEQ ID NO: 314840 - DNA, 25 bp, Homo sapien
tgagacgcggtctggcccatcacca

SEQ ID NO: 314841 - DNA, 25 bp, Homo sapien
tcaccacatcagcaggctattgtca

SEQ ID NO: 314842 - DNA, 25 bp, Homo sapien
gttagcgagatcctgtgttgttttt

SEQ ID NO: 314843 - DNA, 25 bp, Homo sapien
ggacggtgccgtttcaaaatagagg

SEQ ID NO: 314844 - DNA, 25 bp, Homo sapien
atagaggcacagatgctccatgcac

SEQ ID NO: 314845 - DNA, 25 bp, Homo sapien
aggcacagatgctccatgcacgagg

SEQ ID NO: 314846 - DNA, 25 bp, Homo sapien
gggtccccgggcactggaacaagtg

SEQ ID NO: 314847 - DNA, 25 bp, Homo sapien
actggaacaagtgccaagttgaagg

SEQ ID NO: 314848 - DNA, 25 bp, Homo sapien
ctgggtgtgggtattcaggccctca

SEQ ID NO: 314849 - DNA, 25 bp, Homo sapien
gggtgtgggtattcaggccctcacc

SEQ ID NO: 314850 - DNA, 25 bp, Homo sapien
gaccctgaggaaagggcgccccctg

SEQ ID NO: 314851 - DNA, 25 bp, Homo sapien
tagtcctgcccgcaggttagcgaga

SEQ ID NO: 314852 - DNA, 25 bp, Homo sapien
tgcccgcaggttagcgagatcctgt

SEQ ID NO: 314853 - DNA, 25 bp, Homo sapien
ttttggagcccagaagtctgcaatc

SEQ ID NO: 314854 - DNA, 25 bp, Homo sapien
gagagagactgttctttgcctcttt

SEQ ID NO: 314855 - DNA, 25 bp, Homo sapien
agactgttctttgcctcttttagct

SEQ ID NO: 314856 - DNA, 25 bp, Homo sapien
ttttagcttctgattatggtcagca

SEQ ID NO: 314857 - DNA, 25 bp, Homo sapien
gattatggtcagcattccttggcat

SEQ ID NO: 314858 - DNA, 25 bp, Homo sapien
atggtcagcattccttggcatatct

SEQ ID NO: 314859 - DNA, 25 bp, Homo sapien
gcattccttggcatatctctctgtt

SEQ ID NO: 314860 - DNA, 25 bp, Homo sapien
gagtacttgcatcagaactctccct

SEQ ID NO: 314861 - DNA, 25 bp, Homo sapien
tacttgcatcagaactctccctcta

SEQ ID NO: 314862 - DNA, 25 bp, Homo sapien
tctccctctacctgtgtattataag

SEQ ID NO: 314863 - DNA, 25 bp, Homo sapien
acaagaggaatttattcttctcaaa

SEQ ID NO: 314864 - DNA, 25 bp, Homo sapien
gctttatgaacaaattctagctgaa

SEQ ID NO: 314865 - DNA, 25 bp, Homo sapien
cagctacatgatacaaatatggaac

SEQ ID NO: 314866 - DNA, 25 bp, Homo sapien
ggaactaacagatcttaaattacag

SEQ ID NO: 314867 - DNA, 25 bp, Homo sapien
acagatcttaaattacagttggaaa

SEQ ID NO: 314868 - DNA, 25 bp, Homo sapien
tggaaaaggccacccagagacaaga

SEQ ID NO: 314869 - DNA, 25 bp, Homo sapien
gatttgctgatagatcactgttgga

SEQ ID NO: 314870 - DNA, 25 bp, Homo sapien
gatagatcactgttggaaatggaaa

SEQ ID NO: 314871 - DNA, 25 bp, Homo sapien
gaaaaaagggaacgaagagctctag

SEQ ID NO: 314872 - DNA, 25 bp, Homo sapien
aaatgttaccagacctaaaagcaga

SEQ ID NO: 314873 - DNA, 25 bp, Homo sapien
cagacctaaaagcagacaaccagag

SEQ ID NO: 314874 - DNA, 25 bp, Homo sapien
gggccttgatcagagttataagcaa

SEQ ID NO: 314875 - DNA, 25 bp, Homo sapien
agttcagcctaaacctggagctggg

SEQ ID NO: 314876 - DNA, 25 bp, Homo sapien
gaagccttaaatcgttactcatctt

SEQ ID NO: 314877 - DNA, 25 bp, Homo sapien
ctttcacagtcttttataatcgtga

SEQ ID NO: 314878 - DNA, 25 bp, Homo sapien
tataatcgtgaatgagccctccgtt

SEQ ID NO: 314879 - DNA, 25 bp, Homo sapien
agccctccgttgtagactgttaatg

SEQ ID NO: 314880 - DNA, 25 bp, Homo sapien
tagactgttaatgcgtgtccaggat

SEQ ID NO: 314881 - DNA, 25 bp, Homo sapien
atgcgtgtccaggatgcccgagagt

SEQ ID NO: 314882 - DNA, 25 bp, Homo sapien
aaacaataaaagactcctcctgttg

SEQ ID NO: 314883 - DNA, 25 bp, Homo sapien
tatttgctttttgtatcctcctaag

SEQ ID NO: 314884 - DNA, 25 bp, Homo sapien
gcaagaaaatggtccccgtgggcag

SEQ ID NO: 314885 - DNA, 25 bp, Homo sapien
gtgggcagttcagcctaaacctgga

SEQ ID NO: 314886 - DNA, 25 bp, Homo sapien
ggacctaaggtagaaagctgcccat

SEQ ID NO: 314887 - DNA, 25 bp, Homo sapien
ctaaggtagaaagctgcccatcggg

SEQ ID NO: 314888 - DNA, 25 bp, Homo sapien
acagctctgtggctagaacactcca

SEQ ID NO: 314889 - DNA, 25 bp, Homo sapien
tagaacactccaaggcccttcggta

SEQ ID NO: 314890 - DNA, 25 bp, Homo sapien
aaggcccttcggtacccatcagagt

SEQ ID NO: 314891 - DNA, 25 bp, Homo sapien
ggtacccatcagagtgggccccttg

SEQ ID NO: 314892 - DNA, 25 bp, Homo sapien
tttcagttacagagtccagtggacc

SEQ ID NO: 314893 - DNA, 25 bp, Homo sapien
gagtccagtggaccattttgtagaa

SEQ ID NO: 314894 - DNA, 25 bp, Homo sapien
gtggaccattttgtagaaccatgca

SEQ ID NO: 314895 - DNA, 25 bp, Homo sapien
gaggtttgtggaacccagtcccctg

SEQ ID NO: 314896 - DNA, 25 bp, Homo sapien
ccagtcccctgcagaatctgtaaaa

SEQ ID NO: 314897 - DNA, 25 bp, Homo sapien
agttacctactattctgacatttta

SEQ ID NO: 314898 - DNA, 25 bp, Homo sapien
acttgtgctggtgttttggatctta

SEQ ID NO: 314899 - DNA, 25 bp, Homo sapien
gttttggatcttatgatgctgagca

SEQ ID NO: 314900 - DNA, 25 bp, Homo sapien
atgctgagcatgttctgcactggtg

SEQ ID NO: 314901 - DNA, 25 bp, Homo sapien
gcactggtgctaatgtctaatataa

SEQ ID NO: 314902 - DNA, 25 bp, Homo sapien
atttacacacatacgtgctacccag

SEQ ID NO: 314903 - DNA, 25 bp, Homo sapien
tacgtgctacccagagattaattta

SEQ ID NO: 314904 - DNA, 25 bp, Homo sapien
gtccatatgaactattgacccattg

SEQ ID NO: 314905 - DNA, 25 bp, Homo sapien
tgagacagcaacatacgcactccta

SEQ ID NO: 314906 - DNA, 25 bp, Homo sapien
tacgcactcctaaatcagtgtgttt

SEQ ID NO: 314907 - DNA, 25 bp, Homo sapien
aagtatctaactcatttccaaacat

SEQ ID NO: 314908 - DNA, 25 bp, Homo sapien
ttttgagattagaaaacacagccta

SEQ ID NO: 314909 - DNA, 25 bp, Homo sapien
tttcaaatccaaaacgcatgcactt

SEQ ID NO: 314910 - DNA, 25 bp, Homo sapien
caaaacgcatgcacttcaattgagt

SEQ ID NO: 314911 - DNA, 25 bp, Homo sapien
cacttcaattgagtgctacaagtat

SEQ ID NO: 314912 - DNA, 25 bp, Homo sapien
gagtttactaaaccttcacatggag

SEQ ID NO: 314913 - DNA, 25 bp, Homo sapien
ctaaaccttcacatggagtataaat

SEQ ID NO: 314914 - DNA, 25 bp, Homo sapien
gataaaattgtgagcttgagactag

SEQ ID NO: 314915 - DNA, 25 bp, Homo sapien
tgagactagctctgctgtgtgtaca

SEQ ID NO: 314916 - DNA, 25 bp, Homo sapien
ctagctctgctgtgtgtacagacac

SEQ ID NO: 314917 - DNA, 25 bp, Homo sapien
cacacacacgtctatttgtctatct

SEQ ID NO: 314918 - DNA, 25 bp, Homo sapien
cacacgtctatttgtctatctattt

SEQ ID NO: 314919 - DNA, 25 bp, Homo sapien
aggcacgggcagagcgggagcgggc

SEQ ID NO: 314920 - DNA, 25 bp, Homo sapien
ctggacgtcagcctgtttgagctga

SEQ ID NO: 314921 - DNA, 25 bp, Homo sapien
acgtcagcctgtttgagctgagtga

SEQ ID NO: 314922 - DNA, 25 bp, Homo sapien
cctgtttgagctgagtgagctgcgt

SEQ ID NO: 314923 - DNA, 25 bp, Homo sapien
agggccagtcgctggaacagctgga

SEQ ID NO: 314924 - DNA, 25 bp, Homo sapien
ggaagctctggtgcaaaccaaggac

SEQ ID NO: 314925 - DNA, 25 bp, Homo sapien
gtgcaaaccaaggaccaggagattc

SEQ ID NO: 314926 - DNA, 25 bp, Homo sapien
caaaccaaggaccaggagattcaga

SEQ ID NO: 314927 - DNA, 25 bp, Homo sapien
aggagattcagaccctgaagagtca

SEQ ID NO: 314928 - DNA, 25 bp, Homo sapien
ctgccgagcgtgaggagactcagca

SEQ ID NO: 314929 - DNA, 25 bp, Homo sapien
acccgcaatgcggagttggagcacc

SEQ ID NO: 314930 - DNA, 25 bp, Homo sapien
gatgataccaagagcagaggcaaca

SEQ ID NO: 314931 - DNA, 25 bp, Homo sapien
ctggcctccaggtgccggatccaga

SEQ ID NO: 314932 - DNA, 25 bp, Homo sapien
cggatccagacacctgacctagaat

SEQ ID NO: 314933 - DNA, 25 bp, Homo sapien
gatccagacacctgacctagaatgc

SEQ ID NO: 314934 - DNA, 25 bp, Homo sapien
cctgtggcaggaaatatcccctcat

SEQ ID NO: 314935 - DNA, 25 bp, Homo sapien
aggaaatatcccctcatgtcccagg

SEQ ID NO: 314936 - DNA, 25 bp, Homo sapien
gggaattgcagatgggtcttctata

SEQ ID NO: 314937 - DNA, 25 bp, Homo sapien
agatgggtcttctatacccttctac

SEQ ID NO: 314938 - DNA, 25 bp, Homo sapien
tgggtcttctatacccttctacctg

SEQ ID NO: 314939 - DNA, 25 bp, Homo sapien
ttctacctgcccttagatctccatt

SEQ ID NO: 314940 - DNA, 25 bp, Homo sapien
ttatcaaatagtacattgcattttg

SEQ ID NO: 314941 - DNA, 25 bp, Homo sapien
ggaattgtttgtatgaaaaccaatc

SEQ ID NO: 314942 - DNA, 25 bp, Homo sapien
tgtatgaaaaccaatcttcggcggg

SEQ ID NO: 314943 - DNA, 25 bp, Homo sapien
gtatgaaaaccaatcttcggcgggg

SEQ ID NO: 314944 - DNA, 25 bp, Homo sapien
tatgaaaaccaatcttcggcggggc

SEQ ID NO: 314945 - DNA, 25 bp, Homo sapien
atgaaaaccaatcttcggcggggcg

SEQ ID NO: 314946 - DNA, 25 bp, Homo sapien
tgaaaaccaatcttcggcggggcgt

SEQ ID NO: 314947 - DNA, 25 bp, Homo sapien
gaaaaccaatcttcggcggggcgtg

SEQ ID NO: 314948 - DNA, 25 bp, Homo sapien
aaccaatcttcggcggggcgtgatg

SEQ ID NO: 314949 - DNA, 25 bp, Homo sapien
ggtacccaaaatcccgactactcag

SEQ ID NO: 314950 - DNA, 25 bp, Homo sapien
caaaatcccgactactcaggagctg

SEQ ID NO: 314951 - DNA, 25 bp, Homo sapien
aaaatcccgactactcaggagctga

SEQ ID NO: 314952 - DNA, 25 bp, Homo sapien
tctgttcatttgttccttggacctt

SEQ ID NO: 314953 - DNA, 25 bp, Homo sapien
gttccttggaccttaatcatttgca

SEQ ID NO: 314954 - DNA, 25 bp, Homo sapien
gaccttaatcatttgcattttggag

SEQ ID NO: 314955 - DNA, 25 bp, Homo sapien
ctgctttaaaagtctgtaatttcag

SEQ ID NO: 314956 - DNA, 25 bp, Homo sapien
aaaaactatttgtctgtagttgctt

SEQ ID NO: 314957 - DNA, 25 bp, Homo sapien
gacaaagtgaatacccactgggcta

SEQ ID NO: 314958 - DNA, 25 bp, Homo sapien
tacccactgggctaagtttcatatc

SEQ ID NO: 314959 - DNA, 25 bp, Homo sapien
gtttcatatctaaagcttgtcacta

SEQ ID NO: 314960 - DNA, 25 bp, Homo sapien
aagcttgtcactaagaattttcatt

SEQ ID NO: 314961 - DNA, 25 bp, Homo sapien
aatagtgttgtgtgaatgctgtaag

SEQ ID NO: 314962 - DNA, 25 bp, Homo sapien
gtgttgtacatgtctctggtttcag

SEQ ID NO: 314963 - DNA, 25 bp, Homo sapien
aacagctcggatagaaagtgacttg

SEQ ID NO: 314964 - DNA, 25 bp, Homo sapien
agtgacttgacgctggagagtctaa

SEQ ID NO: 314965 - DNA, 25 bp, Homo sapien
gattcatccagggtgaagcccttct

SEQ ID NO: 314966 - DNA, 25 bp, Homo sapien
agcccttctgtggagctgaccaggg

SEQ ID NO: 314967 - DNA, 25 bp, Homo sapien
gcttgttctgaagatagcctgtttt

SEQ ID NO: 314968 - DNA, 25 bp, Homo sapien
gctgaccagggtgctgacccaaagg

SEQ ID NO: 314969 - DNA, 25 bp, Homo sapien
tggaggtctcaatcctctctacatt

SEQ ID NO: 314970 - DNA, 25 bp, Homo sapien
gaggaaaactcttggtcccagcaga

SEQ ID NO: 314971 - DNA, 25 bp, Homo sapien
aactcttggtcccagcagagagaaa

SEQ ID NO: 314972 - DNA, 25 bp, Homo sapien
gcctgtttttaagatgctcactgag

SEQ ID NO: 314973 - DNA, 25 bp, Homo sapien
tgatgacatccacataacagctcgg

SEQ ID NO: 314974 - DNA, 25 bp, Homo sapien
tggatgataattctgtcaagcacac

SEQ ID NO: 314975 - DNA, 25 bp, Homo sapien
caattatgtttggaattcagcatct

SEQ ID NO: 314976 - DNA, 25 bp, Homo sapien
aattatgtttggaattcagcatctt

SEQ ID NO: 314977 - DNA, 25 bp, Homo sapien
tatgtttggaattcagcatctttgg

SEQ ID NO: 314978 - DNA, 25 bp, Homo sapien
tgtttggaattcagcatctttggtt

SEQ ID NO: 314979 - DNA, 25 bp, Homo sapien
attcagcatctttggttggaacgca

SEQ ID NO: 314980 - DNA, 25 bp, Homo sapien
ttggttggaacgcattggctttttt

SEQ ID NO: 314981 - DNA, 25 bp, Homo sapien
actggcctggccttgaaagaacgga

SEQ ID NO: 314982 - DNA, 25 bp, Homo sapien
gaacggaagtctttcccattcactt

SEQ ID NO: 314983 - DNA, 25 bp, Homo sapien
tctttcccattcacttctctagaat

SEQ ID NO: 314984 - DNA, 25 bp, Homo sapien
acttctctagaatgctgccaagaca

SEQ ID NO: 314985 - DNA, 25 bp, Homo sapien
tcgtcctgcctttgaattccagagg

SEQ ID NO: 314986 - DNA, 25 bp, Homo sapien
attccagaggacatgtcctgtgcag

SEQ ID NO: 314987 - DNA, 25 bp, Homo sapien
tgtgcagagccaggttcttcccctg

SEQ ID NO: 314988 - DNA, 25 bp, Homo sapien
ggcagcagagcaatggccctggatt

SEQ ID NO: 314989 - DNA, 25 bp, Homo sapien
aatggccctggattggccggttcac

SEQ ID NO: 314990 - DNA, 25 bp, Homo sapien
attggccggttcacccattccgaat

SEQ ID NO: 314991 - DNA, 25 bp, Homo sapien
cccattccgaatggttacctgaatt

SEQ ID NO: 314992 - DNA, 25 bp, Homo sapien
gaatggttacctgaattgggtttgg

SEQ ID NO: 314993 - DNA, 25 bp, Homo sapien
gcatgtttacggtgcactcctgagt

SEQ ID NO: 314994 - DNA, 25 bp, Homo sapien
tacggtgcactcctgagtactgtgg

SEQ ID NO: 314995 - DNA, 25 bp, Homo sapien
gcactcctgagtactgtggccggtg

SEQ ID NO: 314996 - DNA, 25 bp, Homo sapien
ttatttgccttctactccccttaat

SEQ ID NO: 314997 - DNA, 25 bp, Homo sapien
ttctactccccttaatctaatctaa

SEQ ID NO: 314998 - DNA, 25 bp, Homo sapien
taaaagctctgttccatgcaactgg

SEQ ID NO: 314999 - DNA, 25 bp, Homo sapien
agctctgttccatgcaactggagtt

SEQ ID NO: 315000 - DNA, 25 bp, Homo sapien
atgcaactggagttccttatccctc

SEQ ID NO: 315001 - DNA, 25 bp, Homo sapien
aactggagttccttatccctctctt

SEQ ID NO: 315002 - DNA, 25 bp, Homo sapien
tcttccccttcccttatatattgag

SEQ ID NO: 315003 - DNA, 25 bp, Homo sapien
ccttcccttatatattgaggctatg

SEQ ID NO: 315004 - DNA, 25 bp, Homo sapien
atttcttcccactttcatctacctt

SEQ ID NO: 315005 - DNA, 25 bp, Homo sapien
ctttcatctaccttttctggcaaaa

SEQ ID NO: 315006 - DNA, 25 bp, Homo sapien
gtgaccctaagagcacactgcacag

SEQ ID NO: 315007 - DNA, 25 bp, Homo sapien
taatttcctcatatgtgaaacaagg

SEQ ID NO: 315008 - DNA, 25 bp, Homo sapien
ttatcaaatatggtgcttggaattg

SEQ ID NO: 315009 - DNA, 25 bp, Homo sapien
attaggagctctgttctcagactgc

SEQ ID NO: 315010 - DNA, 25 bp, Homo sapien
gcttggaattgggtagagacactca

SEQ ID NO: 315011 - DNA, 25 bp, Homo sapien
atggtagttggtagcattgtaggaa

SEQ ID NO: 315012 - DNA, 25 bp, Homo sapien
agtgaatagtaatagtcattttcca

SEQ ID NO: 315013 - DNA, 25 bp, Homo sapien
tacatgctttatcttgtgtaattgt

SEQ ID NO: 315014 - DNA, 25 bp, Homo sapien
ggtctgaatcctagatccaccagtg

SEQ ID NO: 315015 - DNA, 25 bp, Homo sapien
tgaatcctagatccaccagtggtct

SEQ ID NO: 315016 - DNA, 25 bp, Homo sapien
ccagtggtctggttaactcaaagaa

SEQ ID NO: 315017 - DNA, 25 bp, Homo sapien
aacctctctaagctataatttcctc

SEQ ID NO: 315018 - DNA, 25 bp, Homo sapien
ggtgaaatgagaagagccccgttct

SEQ ID NO: 315019 - DNA, 25 bp, Homo sapien
gtgaaatgagaagagccccgttctt

SEQ ID NO: 315020 - DNA, 25 bp, Homo sapien
tgaaatgagaagagccccgttcttc

SEQ ID NO: 315021 - DNA, 25 bp, Homo sapien
aaatgagaagagccccgttcttcct

SEQ ID NO: 315022 - DNA, 25 bp, Homo sapien
agagcagatgaaatctcaggcctgt

SEQ ID NO: 315023 - DNA, 25 bp, Homo sapien
gagcagatgaaatctcaggcctgtg

SEQ ID NO: 315024 - DNA, 25 bp, Homo sapien
gcagatgaaatctcaggcctgtggc

SEQ ID NO: 315025 - DNA, 25 bp, Homo sapien
cagatgaaatctcaggcctgtggct

SEQ ID NO: 315026 - DNA, 25 bp, Homo sapien
agatgaaatctcaggcctgtggctt

SEQ ID NO: 315027 - DNA, 25 bp, Homo sapien
gatgaaatctcaggcctgtggcttc

SEQ ID NO: 315028 - DNA, 25 bp, Homo sapien
gaaatctcaggcctgtggcttctcc

SEQ ID NO: 315029 - DNA, 25 bp, Homo sapien
atgctgactcctgcagaagcgtttc

SEQ ID NO: 315030 - DNA, 25 bp, Homo sapien
ttcagcaaccttccggtggatggag

SEQ ID NO: 315031 - DNA, 25 bp, Homo sapien
agaaggactgcccaaatgcctcttt

SEQ ID NO: 315032 - DNA, 25 bp, Homo sapien
tcctgtttgaggctgtcgtactcag

SEQ ID NO: 315033 - DNA, 25 bp, Homo sapien
actgctgtttgagggtcagcttctc

SEQ ID NO: 315034 - DNA, 25 bp, Homo sapien
tcggcagcctggatcttctcgtggg

SEQ ID NO: 315035 - DNA, 25 bp, Homo sapien
atcttctcgtgggtggtctccgtga

SEQ ID NO: 315036 - DNA, 25 bp, Homo sapien
tggtctccgtgagctccttggttag

SEQ ID NO: 315037 - DNA, 25 bp, Homo sapien
tagcctctctatctcagtcttataa

SEQ ID NO: 315038 - DNA, 25 bp, Homo sapien
ctcagtcttataatggtccaccgtc

SEQ ID NO: 315039 - DNA, 25 bp, Homo sapien
tataatggtccaccgtctgcaatac

SEQ ID NO: 315040 - DNA, 25 bp, Homo sapien
gcctgcagaagtatgctctgaggag

SEQ ID NO: 315041 - DNA, 25 bp, Homo sapien
tctgaggagataaacatgaccattt

SEQ ID NO: 315042 - DNA, 25 bp, Homo sapien
atagaggtcacaggctagcgagtcc

SEQ ID NO: 315043 - DNA, 25 bp, Homo sapien
gcgagtcctggatctactgattaat

SEQ ID NO: 315044 - DNA, 25 bp, Homo sapien
tactgattaatctcgctctgtcttt

SEQ ID NO: 315045 - DNA, 25 bp, Homo sapien
ctctgtctttgcagccctgagagga

SEQ ID NO: 315046 - DNA, 25 bp, Homo sapien
gccctgagaggataagtgctttcca

SEQ ID NO: 315047 - DNA, 25 bp, Homo sapien
gctttccaaagcagaggagcagtaa

SEQ ID NO: 315048 - DNA, 25 bp, Homo sapien
gaggcagaaacaacattggtccatg

SEQ ID NO: 315049 - DNA, 25 bp, Homo sapien
ggtccatgcaccataaaatgtaagc

SEQ ID NO: 315050 - DNA, 25 bp, Homo sapien
catttattgtgctaagggctttgta

SEQ ID NO: 315051 - DNA, 25 bp, Homo sapien
ctcttcaccctacaacatctatgtt

SEQ ID NO: 315052 - DNA, 25 bp, Homo sapien
aaaatgcctcccacaattgcagact

SEQ ID NO: 315053 - DNA, 25 bp, Homo sapien
ccacaattgcagactcactcatttt

SEQ ID NO: 315054 - DNA, 25 bp, Homo sapien
actcactcattttaccaaactatgg

SEQ ID NO: 315055 - DNA, 25 bp, Homo sapien
ggaatttgtcaacaccttttcttgg

SEQ ID NO: 315056 - DNA, 25 bp, Homo sapien
gtcaacaccttttcttgggaccaag

SEQ ID NO: 315057 - DNA, 25 bp, Homo sapien
ttgggaccaaggaagcaaagtcagt

SEQ ID NO: 315058 - DNA, 25 bp, Homo sapien
aagtcagtggataccgtgtcctgta

SEQ ID NO: 315059 - DNA, 25 bp, Homo sapien
gataccgtgtcctgtagacatgtca

SEQ ID NO: 315060 - DNA, 25 bp, Homo sapien
gtcctgtagacatgtcacttgtgat

SEQ ID NO: 315061 - DNA, 25 bp, Homo sapien
gtcacttgtgataaggcacggacaa

SEQ ID NO: 315062 - DNA, 25 bp, Homo sapien
actgatggttactgttgcgatctga

SEQ ID NO: 315063 - DNA, 25 bp, Homo sapien
ctgatggttactgttgcgatctgaa

SEQ ID NO: 315064 - DNA, 25 bp, Homo sapien
tgatggttactgttgcgatctgaag

SEQ ID NO: 315065 - DNA, 25 bp, Homo sapien
gatggttactgttgcgatctgaagt

SEQ ID NO: 315066 - DNA, 25 bp, Homo sapien
atggttactgttgcgatctgaagtt

SEQ ID NO: 315067 - DNA, 25 bp, Homo sapien
ggttactgttgcgatctgaagttca

SEQ ID NO: 315068 - DNA, 25 bp, Homo sapien
ttggttataaaaatgattgttggcc

SEQ ID NO: 315069 - DNA, 25 bp, Homo sapien
atatctaaattgaatctggaaccag

SEQ ID NO: 315070 - DNA, 25 bp, Homo sapien
atctaaattgaatctggaaccagat

SEQ ID NO: 315071 - DNA, 25 bp, Homo sapien
ggaaatgaagtttgtgtatcattca

SEQ ID NO: 315072 - DNA, 25 bp, Homo sapien
atgaagtttgtgtatcattcattat

SEQ ID NO: 315073 - DNA, 25 bp, Homo sapien
agatttgtctcacactctagtctgg

SEQ ID NO: 315074 - DNA, 25 bp, Homo sapien
actctagtctggtgatttccaggct

SEQ ID NO: 315075 - DNA, 25 bp, Homo sapien
atttccaggcttgtgcctgtcccag

SEQ ID NO: 315076 - DNA, 25 bp, Homo sapien
gggaaaatgtccatcaataagtaac

SEQ ID NO: 315077 - DNA, 25 bp, Homo sapien
ggttcgttaatgacctaagatgtaa

SEQ ID NO: 315078 - DNA, 25 bp, Homo sapien
aaataaaagccctccagtggttctg

SEQ ID NO: 315079 - DNA, 25 bp, Homo sapien
aaagccctccagtggttctgacaag

SEQ ID NO: 315080 - DNA, 25 bp, Homo sapien
agtggttctgacaagctgtagctag

SEQ ID NO: 315081 - DNA, 25 bp, Homo sapien
gttcaatttcatctaaaccttatgt

SEQ ID NO: 315082 - DNA, 25 bp, Homo sapien
catctaaaccttatgtgatttcagt

SEQ ID NO: 315083 - DNA, 25 bp, Homo sapien
cagtgttttcctcagatttgtctca

SEQ ID NO: 315084 - DNA, 25 bp, Homo sapien
gagtaattagctatagattccactg

SEQ ID NO: 315085 - DNA, 25 bp, Homo sapien
attagctatagattccactggcctt

SEQ ID NO: 315086 - DNA, 25 bp, Homo sapien
tatagattccactggccttaaacat

SEQ ID NO: 315087 - DNA, 25 bp, Homo sapien
gattccactggccttaaacatacaa

SEQ ID NO: 315088 - DNA, 25 bp, Homo sapien
tccactggccttaaacatacaatta

SEQ ID NO: 315089 - DNA, 25 bp, Homo sapien
gtatacatgatatagtgcacacaca

SEQ ID NO: 315090 - DNA, 25 bp, Homo sapien
gtgcacacacaaaagccacctttaa

SEQ ID NO: 315091 - DNA, 25 bp, Homo sapien
cacaaaagccacctttaattattga

SEQ ID NO: 315092 - DNA, 25 bp, Homo sapien
agtactatattttttgtgcatcaat

SEQ ID NO: 315093 - DNA, 25 bp, Homo sapien
tttttgtgcatcaatgtatttttct

SEQ ID NO: 315094 - DNA, 25 bp, Homo sapien
ttttctatttacaagcctatgtaaa

SEQ ID NO: 315095 - DNA, 25 bp, Homo sapien
tgctaagttcccctctgtacctaaa

SEQ ID NO: 315096 - DNA, 25 bp, Homo sapien
agggacccattagcagaggcagcgt

SEQ ID NO: 315097 - DNA, 25 bp, Homo sapien
agatttctcagccttggtgtgtgtt

SEQ ID NO: 315098 - DNA, 25 bp, Homo sapien
agccttggtgtgtgttgtccccagc

SEQ ID NO: 315099 - DNA, 25 bp, Homo sapien
agtaattgcctgtatacgtgggatt

SEQ ID NO: 315100 - DNA, 25 bp, Homo sapien
tacgtgggattagccagcttgctca

SEQ ID NO: 315101 - DNA, 25 bp, Homo sapien
agcttgctcaggaagtcagtgttgt

SEQ ID NO: 315102 - DNA, 25 bp, Homo sapien
aattcagaccggttgagtccaagga

SEQ ID NO: 315103 - DNA, 25 bp, Homo sapien
tcagacatccactcatcaggtccag

SEQ ID NO: 315104 - DNA, 25 bp, Homo sapien
atcaggtccagaccagaccgtgggc

SEQ ID NO: 315105 - DNA, 25 bp, Homo sapien
ttctgatccactccgttgctaagtt

SEQ ID NO: 315106 - DNA, 25 bp, Homo sapien
cataaatgtacagcttggtaaattt

SEQ ID NO: 315107 - DNA, 25 bp, Homo sapien
aatgtacagcttggtaaattttcaa

SEQ ID NO: 315108 - DNA, 25 bp, Homo sapien
ttttcaaaaagcaagcatatccagg

SEQ ID NO: 315109 - DNA, 25 bp, Homo sapien
ttcaaaaagcaagcatatccagggc

SEQ ID NO: 315110 - DNA, 25 bp, Homo sapien
tcaaaaagcaagcatatccagggct

SEQ ID NO: 315111 - DNA, 25 bp, Homo sapien
caaaaagcaagcatatccagggctg

SEQ ID NO: 315112 - DNA, 25 bp, Homo sapien
aaaaagcaagcatatccagggctgg

SEQ ID NO: 315113 - DNA, 25 bp, Homo sapien
aaaagcaagcatatccagggctggg

SEQ ID NO: 315114 - DNA, 25 bp, Homo sapien
aaagcaagcatatccagggctgggc

SEQ ID NO: 315115 - DNA, 25 bp, Homo sapien
aagcaagcatatccagggctgggcg

SEQ ID NO: 315116 - DNA, 25 bp, Homo sapien
caagcatatccagggctgggcgcgg

SEQ ID NO: 315117 - DNA, 25 bp, Homo sapien
gatgccttgagcttgagaggttgaa

SEQ ID NO: 315118 - DNA, 25 bp, Homo sapien
agcttggttcatggagaccctgttt

SEQ ID NO: 315119 - DNA, 25 bp, Homo sapien
ttggttcatggagaccctgtttttt

SEQ ID NO: 315120 - DNA, 25 bp, Homo sapien
aggtgtttacaccagcaaaatactc

SEQ ID NO: 315121 - DNA, 25 bp, Homo sapien
ggtgtttacaccagcaaaatactca

SEQ ID NO: 315122 - DNA, 25 bp, Homo sapien
gtgtttacaccagcaaaatactcat

SEQ ID NO: 315123 - DNA, 25 bp, Homo sapien
gtttacaccagcaaaatactcattt

SEQ ID NO: 315124 - DNA, 25 bp, Homo sapien
tcatacttagcaaatctaacacatg

SEQ ID NO: 315125 - DNA, 25 bp, Homo sapien
ttagcaaatctaacacatgaaatgt

SEQ ID NO: 315126 - DNA, 25 bp, Homo sapien
gcaaatctaacacatgaaatgtaac

SEQ ID NO: 315127 - DNA, 25 bp, Homo sapien
aaatgtaacatctgcatatggagaa

SEQ ID NO: 315128 - DNA, 25 bp, Homo sapien
atatttagggctgtagactactttc

SEQ ID NO: 315129 - DNA, 25 bp, Homo sapien
ctactttctaattgtttccatggct

SEQ ID NO: 315130 - DNA, 25 bp, Homo sapien
tgtttccatggcttattcttgagca

SEQ ID NO: 315131 - DNA, 25 bp, Homo sapien
gacttttctcgagcctttacagctc

SEQ ID NO: 315132 - DNA, 25 bp, Homo sapien
tgaggaactgggaccggcagcatta

SEQ ID NO: 315133 - DNA, 25 bp, Homo sapien
ggaccggcagcattatctttataca

SEQ ID NO: 315134 - DNA, 25 bp, Homo sapien
tatctttatacagagacctgaggca

SEQ ID NO: 315135 - DNA, 25 bp, Homo sapien
gaaattgattcccagctaggactag

SEQ ID NO: 315136 - DNA, 25 bp, Homo sapien
aaaaccttgggcctcggactgcgag

SEQ ID NO: 315137 - DNA, 25 bp, Homo sapien
gcagaagtttgcctgaatgcctgtc

SEQ ID NO: 315138 - DNA, 25 bp, Homo sapien
gcctgaatgcctgtcagttcacgga

SEQ ID NO: 315139 - DNA, 25 bp, Homo sapien
tagtttatcataaaggcatttcctt

SEQ ID NO: 315140 - DNA, 25 bp, Homo sapien
gaaaattagtggtaagatgtgacaa

SEQ ID NO: 315141 - DNA, 25 bp, Homo sapien
tgtgacaatacatcagctgcatcca

SEQ ID NO: 315142 - DNA, 25 bp, Homo sapien
aattagcagttctgattctgggtac

SEQ ID NO: 315143 - DNA, 25 bp, Homo sapien
agcagttctgattctgggtacactt

SEQ ID NO: 315144 - DNA, 25 bp, Homo sapien
ttctgattctgggtacacttgttat

SEQ ID NO: 315145 - DNA, 25 bp, Homo sapien
attctgggtacacttgttatgatca

SEQ ID NO: 315146 - DNA, 25 bp, Homo sapien
ccagtctggtctcctagcctcaagt

SEQ ID NO: 315147 - DNA, 25 bp, Homo sapien
cccatctcagccttcagttggagat

SEQ ID NO: 315148 - DNA, 25 bp, Homo sapien
ctcagccttcagttggagatttctg

SEQ ID NO: 315149 - DNA, 25 bp, Homo sapien
gccttcagttggagatttctgattt

SEQ ID NO: 315150 - DNA, 25 bp, Homo sapien
ctgacatggatgttcatgcaactta

SEQ ID NO: 315151 - DNA, 25 bp, Homo sapien
ggatgttcatgcaacttaagtgtgt

SEQ ID NO: 315152 - DNA, 25 bp, Homo sapien
aacttaagtgtgttgttcctgaact

SEQ ID NO: 315153 - DNA, 25 bp, Homo sapien
gttcctgaactttctgtaatgtttc

SEQ ID NO: 315154 - DNA, 25 bp, Homo sapien
taacgtcttctaaaagattgtcatc

SEQ ID NO: 315155 - DNA, 25 bp, Homo sapien
gattgtcatcaacaccataatatgt

SEQ ID NO: 315156 - DNA, 25 bp, Homo sapien
cataatatgtaatctccaggagcaa

SEQ ID NO: 315157 - DNA, 25 bp, Homo sapien
gtaatctccaggagcaactgcctgt

SEQ ID NO: 315158 - DNA, 25 bp, Homo sapien
ccaggagcaactgcctgtaattttt

SEQ ID NO: 315159 - DNA, 25 bp, Homo sapien
tttcctgggaagtcaaggttacatc

SEQ ID NO: 315160 - DNA, 25 bp, Homo sapien
ggttacatcttgcagaggttgtttt

SEQ ID NO: 315161 - DNA, 25 bp, Homo sapien
tgtccctgtgtctgctagcactaga

SEQ ID NO: 315162 - DNA, 25 bp, Homo sapien
gcactagactttgttgctgcagatt

SEQ ID NO: 315163 - DNA, 25 bp, Homo sapien
gttgctgcagattgatccagtgggt

SEQ ID NO: 315164 - DNA, 25 bp, Homo sapien
gatccagtgggtacataggctaatt

SEQ ID NO: 315165 - DNA, 25 bp, Homo sapien
gtttaaaggagtccctcttgctgaa

SEQ ID NO: 315166 - DNA, 25 bp, Homo sapien
ggagtccctcttgctgaaagtagat

SEQ ID NO: 315167 - DNA, 25 bp, Homo sapien
gatgattactattgctgtagtgtta

SEQ ID NO: 315168 - DNA, 25 bp, Homo sapien
tttgtgctgaaaatccattgccatt

SEQ ID NO: 315169 - DNA, 25 bp, Homo sapien
aaatccattgccatttggtacaaat

SEQ ID NO: 315170 - DNA, 25 bp, Homo sapien
gtttgtacacaaacccttaggatgg

SEQ ID NO: 315171 - DNA, 25 bp, Homo sapien
ggatggtgagttgaagcatcaccct

SEQ ID NO: 315172 - DNA, 25 bp, Homo sapien
ctgccggccacaagggagcagcgtc

SEQ ID NO: 315173 - DNA, 25 bp, Homo sapien
gaggcaggctccagaagcaccccga

SEQ ID NO: 315174 - DNA, 25 bp, Homo sapien
gggccttattaagtgcgagaagcct

SEQ ID NO: 315175 - DNA, 25 bp, Homo sapien
tattaagtgcgagaagcctctccag

SEQ ID NO: 315176 - DNA, 25 bp, Homo sapien
taagtgcgagaagcctctccagcga

SEQ ID NO: 315177 - DNA, 25 bp, Homo sapien
agtgcgagaagcctctccagcgagt

SEQ ID NO: 315178 - DNA, 25 bp, Homo sapien
gagaagcctctccagcgagtcttcc

SEQ ID NO: 315179 - DNA, 25 bp, Homo sapien
tctccagcgagtcttccccgtgtgt

SEQ ID NO: 315180 - DNA, 25 bp, Homo sapien
cgtgtgtcctcatctgcggcaggca

SEQ ID NO: 315181 - DNA, 25 bp, Homo sapien
gtgtcctcatctgcggcaggcagga

SEQ ID NO: 315182 - DNA, 25 bp, Homo sapien
agaaacattaaccacccctctctag

SEQ ID NO: 315183 - DNA, 25 bp, Homo sapien
ttgtcttccacttgctttggtagtt

SEQ ID NO: 315184 - DNA, 25 bp, Homo sapien
ttggtagttgtcttcatatctccct

SEQ ID NO: 315185 - DNA, 25 bp, Homo sapien
ttcatatctccctgtgcttattgcc

SEQ ID NO: 315186 - DNA, 25 bp, Homo sapien
gtgcttattgccctgtctgaatcag

SEQ ID NO: 315187 - DNA, 25 bp, Homo sapien
atctgtcactcacttagacctatcc

SEQ ID NO: 315188 - DNA, 25 bp, Homo sapien
cactttttctactttcactacactt

SEQ ID NO: 315189 - DNA, 25 bp, Homo sapien
ttcactacacttttgaccttagcta

SEQ ID NO: 315190 - DNA, 25 bp, Homo sapien
tgaccttagctattgtttgagtgtg

SEQ ID NO: 315191 - DNA, 25 bp, Homo sapien
tccctgttcaagttagcttgatggt

SEQ ID NO: 315192 - DNA, 25 bp, Homo sapien
ggagggtgcctaagacaatcatcag

SEQ ID NO: 315193 - DNA, 25 bp, Homo sapien
aatcttccaagagcagagggagttc

SEQ ID NO: 315194 - DNA, 25 bp, Homo sapien
tctcttctcttggttctttgaggca

SEQ ID NO: 315195 - DNA, 25 bp, Homo sapien
ttctcttggttctttgaggcatcag

SEQ ID NO: 315196 - DNA, 25 bp, Homo sapien
tgaggcatcaggtgtttgccaccac

SEQ ID NO: 315197 - DNA, 25 bp, Homo sapien
catcaggtgtttgccaccactggac

SEQ ID NO: 315198 - DNA, 25 bp, Homo sapien
aggccattccccaacctagaagctt

SEQ ID NO: 315199 - DNA, 25 bp, Homo sapien
accactggacttctgtcatcgctgc

SEQ ID NO: 315200 - DNA, 25 bp, Homo sapien
ggacttctgtcatcgctgcctccaa

SEQ ID NO: 315201 - DNA, 25 bp, Homo sapien
atccccttcgaatctcagcttggct

SEQ ID NO: 315202 - DNA, 25 bp, Homo sapien
gaatctcagcttggctgtttcctcc

SEQ ID NO: 315203 - DNA, 25 bp, Homo sapien
tccttggagagatcactcccaggac

SEQ ID NO: 315204 - DNA, 25 bp, Homo sapien
aacctagaagcttctttctcagcag

SEQ ID NO: 315205 - DNA, 25 bp, Homo sapien
cgggatgcgggcactgcggtagagc

SEQ ID NO: 315206 - DNA, 25 bp, Homo sapien
gggatgcgggcactgcggtagagcc

SEQ ID NO: 315207 - DNA, 25 bp, Homo sapien
ggatgcgggcactgcggtagagccg

SEQ ID NO: 315208 - DNA, 25 bp, Homo sapien
gatgcgggcactgcggtagagccgg

SEQ ID NO: 315209 - DNA, 25 bp, Homo sapien
gcactgcggtagagccggtcctgcc

SEQ ID NO: 315210 - DNA, 25 bp, Homo sapien
cactgcggtagagccggtcctgccc

SEQ ID NO: 315211 - DNA, 25 bp, Homo sapien
cctccgctgctaaacccgcggacaa

SEQ ID NO: 315212 - DNA, 25 bp, Homo sapien
gcccagggaagtgccagggatccct

SEQ ID NO: 315213 - DNA, 25 bp, Homo sapien
ggaagtgccagggatccctgggaag

SEQ ID NO: 315214 - DNA, 25 bp, Homo sapien
aagtgccagggatccctgggaaggc

SEQ ID NO: 315215 - DNA, 25 bp, Homo sapien
agtgccagggatccctgggaaggcg

SEQ ID NO: 315216 - DNA, 25 bp, Homo sapien
cgggtccaaaataaatgacttacat

SEQ ID NO: 315217 - DNA, 25 bp, Homo sapien
cagagctgagtcaaggattcatgtt

SEQ ID NO: 315218 - DNA, 25 bp, Homo sapien
ggattcatgtttcttgatgcctagt

SEQ ID NO: 315219 - DNA, 25 bp, Homo sapien
cttgatgcctagtttagtagtcttt

SEQ ID NO: 315220 - DNA, 25 bp, Homo sapien
gtttagtagtctttgatgcaacaga

SEQ ID NO: 315221 - DNA, 25 bp, Homo sapien
gcaacagacatcaagtacatattat

SEQ ID NO: 315222 - DNA, 25 bp, Homo sapien
aagataatcttttggcttaaatcat

SEQ ID NO: 315223 - DNA, 25 bp, Homo sapien
gaatgtgtaacatccttgtaataca

SEQ ID NO: 315224 - DNA, 25 bp, Homo sapien
aatacaagtcattacccatttcaac

SEQ ID NO: 315225 - DNA, 25 bp, Homo sapien
gtcattacccatttcaactagagaa

SEQ ID NO: 315226 - DNA, 25 bp, Homo sapien
ggtaataggccattgcttttgtgta

SEQ ID NO: 315227 - DNA, 25 bp, Homo sapien
gcaatgtgtggtgtggtagcatttt

SEQ ID NO: 315228 - DNA, 25 bp, Homo sapien
gtagcatttttctgggctgtagtcc

SEQ ID NO: 315229 - DNA, 25 bp, Homo sapien
atttttctgggctgtagtccctaga

SEQ ID NO: 315230 - DNA, 25 bp, Homo sapien
tctgggctgtagtccctagatgggt

SEQ ID NO: 315231 - DNA, 25 bp, Homo sapien
tagtccctagatgggtagagaagaa

SEQ ID NO: 315232 - DNA, 25 bp, Homo sapien
agcacagggcagagcgcagagaact

SEQ ID NO: 315233 - DNA, 25 bp, Homo sapien
gagcgcagagaactgcatccacagg

SEQ ID NO: 315234 - DNA, 25 bp, Homo sapien
agagaactgcatccacaggcctcgc

SEQ ID NO: 315235 - DNA, 25 bp, Homo sapien
atggctgcaccacaccagcagatgc

SEQ ID NO: 315236 - DNA, 25 bp, Homo sapien
gattgaggtgatgctctggaataat

SEQ ID NO: 315237 - DNA, 25 bp, Homo sapien
ggactagagagtcgtgacaactaaa

SEQ ID NO: 315238 - DNA, 25 bp, Homo sapien
taaagtgaaagagaccggaccagct

SEQ ID NO: 315239 - DNA, 25 bp, Homo sapien
agtgaaagagaccggaccagcttca

SEQ ID NO: 315240 - DNA, 25 bp, Homo sapien
accagcttcagctttcggactctgg

SEQ ID NO: 315241 - DNA, 25 bp, Homo sapien
ccagcttcagctttcggactctggt

SEQ ID NO: 315242 - DNA, 25 bp, Homo sapien
ctggttcttggatcgtgtcctctcc

SEQ ID NO: 315243 - DNA, 25 bp, Homo sapien
tggttcttggatcgtgtcctctccc

SEQ ID NO: 315244 - DNA, 25 bp, Homo sapien
gaaggttgtacagcccgaacccgtg

SEQ ID NO: 315245 - DNA, 25 bp, Homo sapien
gttgtacagcccgaacccgtggagc

SEQ ID NO: 315246 - DNA, 25 bp, Homo sapien
tgtacagcccgaacccgtggagcaa

SEQ ID NO: 315247 - DNA, 25 bp, Homo sapien
gtacagcccgaacccgtggagcaat

SEQ ID NO: 315248 - DNA, 25 bp, Homo sapien
ccgaacccgtggagcaatgccctgt

SEQ ID NO: 315249 - DNA, 25 bp, Homo sapien
acctgcacaagcctggcggcagtca

SEQ ID NO: 315250 - DNA, 25 bp, Homo sapien
aagcctggcggcagtcagcagtgtc

SEQ ID NO: 315251 - DNA, 25 bp, Homo sapien
gcctggcggcagtcagcagtgtcac

SEQ ID NO: 315252 - DNA, 25 bp, Homo sapien
ctggcggcagtcagcagtgtcaccc

SEQ ID NO: 315253 - DNA, 25 bp, Homo sapien
cacacctgatactgggcctcagaat

SEQ ID NO: 315254 - DNA, 25 bp, Homo sapien
acacctgatactgggcctcagaatg

SEQ ID NO: 315255 - DNA, 25 bp, Homo sapien
cagtgtgtccctgatgactggaaag

SEQ ID NO: 315256 - DNA, 25 bp, Homo sapien
agtgtgtccctgatgactggaaaga

SEQ ID NO: 315257 - DNA, 25 bp, Homo sapien
gaaaagtgtgcctgagacgcggtct

SEQ ID NO: 315258 - DNA, 25 bp, Homo sapien
aaaagtgtgcctgagacgcggtctg

SEQ ID NO: 315259 - DNA, 25 bp, Homo sapien
tgagacgcggtctggcccatcacca

SEQ ID NO: 315260 - DNA, 25 bp, Homo sapien
tagtgagtctcaggtttcccagaca

SEQ ID NO: 315261 - DNA, 25 bp, Homo sapien
gtccaggaagtctcccggtgacaaa

SEQ ID NO: 315262 - DNA, 25 bp, Homo sapien
aactgaagttctgactactagaatc

SEQ ID NO: 315263 - DNA, 25 bp, Homo sapien
gaaatccagaggaggtttccaacct

SEQ ID NO: 315264 - DNA, 25 bp, Homo sapien
gaccagtacctgagaggtggactct

SEQ ID NO: 315265 - DNA, 25 bp, Homo sapien
gtctcccggtgacaaaattctggtc

SEQ ID NO: 315266 - DNA, 25 bp, Homo sapien
gtgctggctatgtccgaagcagcca

SEQ ID NO: 315267 - DNA, 25 bp, Homo sapien
aatgatgtccttgcacgagccaagt

SEQ ID NO: 315268 - DNA, 25 bp, Homo sapien
tcaacatgggcgataggactagcat

SEQ ID NO: 315269 - DNA, 25 bp, Homo sapien
actagcatggtgcaggaccctggct

SEQ ID NO: 315270 - DNA, 25 bp, Homo sapien
aagctcccacatcctggattagtga

SEQ ID NO: 315271 - DNA, 25 bp, Homo sapien
tggttggaatatgtggctccttttc

SEQ ID NO: 315272 - DNA, 25 bp, Homo sapien
ttttccatcactacatcttttcttc

SEQ ID NO: 315273 - DNA, 25 bp, Homo sapien
cttttcttccggatcttcatcatgg

SEQ ID NO: 315274 - DNA, 25 bp, Homo sapien
gttgcggaatatggaagcacctccc

SEQ ID NO: 315275 - DNA, 25 bp, Homo sapien
ggaagcacctcccaatggtacggtg

SEQ ID NO: 315276 - DNA, 25 bp, Homo sapien
caatggtacggtgcaccctgtggtg

SEQ ID NO: 315277 - DNA, 25 bp, Homo sapien
caccctgtggtggtcttggacagta

SEQ ID NO: 315278 - DNA, 25 bp, Homo sapien
gctccatgacggtagaagacttctc

SEQ ID NO: 315279 - DNA, 25 bp, Homo sapien
ggagcaactttttgacgcacaactt

SEQ ID NO: 315280 - DNA, 25 bp, Homo sapien
cacaacttttggtgcgtttttctag

SEQ ID NO: 315281 - DNA, 25 bp, Homo sapien
aagctttttcaagacctaactgcag

SEQ ID NO: 315282 - DNA, 25 bp, Homo sapien
cagaaggtgaatggcggctgcgagg

SEQ ID NO: 315283 - DNA, 25 bp, Homo sapien
atggcggctgcgagggaagggagtt

SEQ ID NO: 315284 - DNA, 25 bp, Homo sapien
gttggaggccgggagtgggaagcga

SEQ ID NO: 315285 - DNA, 25 bp, Homo sapien
gccgggagtgggaagcgaggctcat

SEQ ID NO: 315286 - DNA, 25 bp, Homo sapien
agtgggaagcgaggctcatgcgggc

SEQ ID NO: 315287 - DNA, 25 bp, Homo sapien
tgggaagcgaggctcatgcgggcgc

SEQ ID NO: 315288 - DNA, 25 bp, Homo sapien
ggaagcgaggctcatgcgggcgcca

SEQ ID NO: 315289 - DNA, 25 bp, Homo sapien
gaagcgaggctcatgcgggcgccaa

SEQ ID NO: 315290 - DNA, 25 bp, Homo sapien
aagcgaggctcatgcgggcgccaag

SEQ ID NO: 315291 - DNA, 25 bp, Homo sapien
agcgaggctcatgcgggcgccaagg

SEQ ID NO: 315292 - DNA, 25 bp, Homo sapien
tcatgcgggcgccaaggtggccctg

SEQ ID NO: 315293 - DNA, 25 bp, Homo sapien
taatgtcctcattaatgcaagtaat

SEQ ID NO: 315294 - DNA, 25 bp, Homo sapien
gcaagtaattttagagcacagtgta

SEQ ID NO: 315295 - DNA, 25 bp, Homo sapien
tagagcacagtgtagccatgtacag

SEQ ID NO: 315296 - DNA, 25 bp, Homo sapien
gtagccatgtacagtttccattatt

SEQ ID NO: 315297 - DNA, 25 bp, Homo sapien
gggacatcatggtaactggaaatga

SEQ ID NO: 315298 - DNA, 25 bp, Homo sapien
aagtttaatctttcacaaatgtgct

SEQ ID NO: 315299 - DNA, 25 bp, Homo sapien
caaatgtgcttgataaagctgttaa

SEQ ID NO: 315300 - DNA, 25 bp, Homo sapien
aagctgttaagaattgtctttccta

SEQ ID NO: 315301 - DNA, 25 bp, Homo sapien
agaattgtctttcctaagtatgtta

SEQ ID NO: 315302 - DNA, 25 bp, Homo sapien
aactcaactgtgagctaagtttaaa

SEQ ID NO: 315303 - DNA, 25 bp, Homo sapien
aactgcaatcatgaatgtttgtgat

SEQ ID NO: 315304 - DNA, 25 bp, Homo sapien
atttgattctgcatatagggctaat

SEQ ID NO: 315305 - DNA, 25 bp, Homo sapien
ggaagcatttgtaagcaatcctgta

SEQ ID NO: 315306 - DNA, 25 bp, Homo sapien
caatagatctaatagcaggtatcca

SEQ ID NO: 315307 - DNA, 25 bp, Homo sapien
atagcaggtatccagaagttataaa

SEQ ID NO: 315308 - DNA, 25 bp, Homo sapien
cttgaatcctgttagttctgaacat

SEQ ID NO: 315309 - DNA, 25 bp, Homo sapien
gggagccctgacaagtctttctgta

SEQ ID NO: 315310 - DNA, 25 bp, Homo sapien
ctgacaagtctttctgtaccttctt

SEQ ID NO: 315311 - DNA, 25 bp, Homo sapien
tgtaccttcttcgtaagtctggcat

SEQ ID NO: 315312 - DNA, 25 bp, Homo sapien
cttcttcgtaagtctggcattacag

SEQ ID NO: 315313 - DNA, 25 bp, Homo sapien
taatggaacattttgctagagggaa

SEQ ID NO: 315314 - DNA, 25 bp, Homo sapien
cattttgctagagggaatttgattc

SEQ ID NO: 315315 - DNA, 25 bp, Homo sapien
gacaaggaaactggcagggaaacaa

SEQ ID NO: 315316 - DNA, 25 bp, Homo sapien
gaaactggcagggaaacaaagtatc

SEQ ID NO: 315317 - DNA, 25 bp, Homo sapien
caaagtatccctggaaggaatttct

SEQ ID NO: 315318 - DNA, 25 bp, Homo sapien
tccctggaaggaatttcttaaagag

SEQ ID NO: 315319 - DNA, 25 bp, Homo sapien
aggaagaggcagatccctacaagtt

SEQ ID NO: 315320 - DNA, 25 bp, Homo sapien
gaagaggcagatccctacaagttta

SEQ ID NO: 315321 - DNA, 25 bp, Homo sapien
aggcagatccctacaagtttaaaat

SEQ ID NO: 315322 - DNA, 25 bp, Homo sapien
gcagatccctacaagtttaaaatca

SEQ ID NO: 315323 - DNA, 25 bp, Homo sapien
tgaagatgttgatcccaaagtgaaa

SEQ ID NO: 315324 - DNA, 25 bp, Homo sapien
gatgttgatcccaaagtgaaattga

SEQ ID NO: 315325 - DNA, 25 bp, Homo sapien
aattgaaagatggacttgtgaggaa

SEQ ID NO: 315326 - DNA, 25 bp, Homo sapien
aggtcaggagaccagcccggcaaca

SEQ ID NO: 315327 - DNA, 25 bp, Homo sapien
caaaaattagctggaaatcgcttga

SEQ ID NO: 315328 - DNA, 25 bp, Homo sapien
aaaaattagctggaaatcgcttgaa

SEQ ID NO: 315329 - DNA, 25 bp, Homo sapien
aaaattagctggaaatcgcttgaac

SEQ ID NO: 315330 - DNA, 25 bp, Homo sapien
aaattagctggaaatcgcttgaacc

SEQ ID NO: 315331 - DNA, 25 bp, Homo sapien
aattagctggaaatcgcttgaacct

SEQ ID NO: 315332 - DNA, 25 bp, Homo sapien
attagctggaaatcgcttgaacctg

SEQ ID NO: 315333 - DNA, 25 bp, Homo sapien
ccgagatcgtggcactgcagctcca

SEQ ID NO: 315334 - DNA, 25 bp, Homo sapien
cgagatcgtggcactgcagctccaa

SEQ ID NO: 315335 - DNA, 25 bp, Homo sapien
gagatcgtggcactgcagctccaaa

SEQ ID NO: 315336 - DNA, 25 bp, Homo sapien
agatcgtggcactgcagctccaaac

SEQ ID NO: 315337 - DNA, 25 bp, Homo sapien
aggtcgtgatgtgcgtgctctgcct

SEQ ID NO: 315338 - DNA, 25 bp, Homo sapien
gcgtgctctgcctcagtaggtctga

SEQ ID NO: 315339 - DNA, 25 bp, Homo sapien
agtaggtctgaggtgcccactgttg

SEQ ID NO: 315340 - DNA, 25 bp, Homo sapien
aggtgcccactgttgttatgcttag

SEQ ID NO: 315341 - DNA, 25 bp, Homo sapien
gcttagttttattagattctctgta

SEQ ID NO: 315342 - DNA, 25 bp, Homo sapien
gtaacaacatgagcttaccaaccag

SEQ ID NO: 315343 - DNA, 25 bp, Homo sapien
attgaacagattaactgggcactga

SEQ ID NO: 315344 - DNA, 25 bp, Homo sapien
tgggcactgaagtaaaattctacct

SEQ ID NO: 315345 - DNA, 25 bp, Homo sapien
aattctacctactttattctcttag

SEQ ID NO: 315346 - DNA, 25 bp, Homo sapien
aactgtcaaggttgccatcatattt

SEQ ID NO: 315347 - DNA, 25 bp, Homo sapien
ttgagttttgtcacctaggaaaaca

SEQ ID NO: 315348 - DNA, 25 bp, Homo sapien
ttatagtcagccctcatccacggat

SEQ ID NO: 315349 - DNA, 25 bp, Homo sapien
tatagtcagccctcatccacggatt

SEQ ID NO: 315350 - DNA, 25 bp, Homo sapien
agtcagccctcatccacggattcaa

SEQ ID NO: 315351 - DNA, 25 bp, Homo sapien
gaaccccttagagagaggaagacaa

SEQ ID NO: 315352 - DNA, 25 bp, Homo sapien
gaggaagacaataattaacaatagc

SEQ ID NO: 315353 - DNA, 25 bp, Homo sapien
taacaatagctaacacttacagagg

SEQ ID NO: 315354 - DNA, 25 bp, Homo sapien
aatagctaacacttacagaggctta

SEQ ID NO: 315355 - DNA, 25 bp, Homo sapien
agctaacacttacagaggcttatag

SEQ ID NO: 315356 - DNA, 25 bp, Homo sapien
aacacttacagaggcttatagtcag

SEQ ID NO: 315357 - DNA, 25 bp, Homo sapien
acagaggcttatagtcagccctcat

SEQ ID NO: 315358 - DNA, 25 bp, Homo sapien
gaggcttatagtcagccctcatcca

SEQ ID NO: 315359 - DNA, 25 bp, Homo sapien
tgagccccacaaattacgcagctag

SEQ ID NO: 315360 - DNA, 25 bp, Homo sapien
ggagcatgagatccagcttcgttat

SEQ ID NO: 315361 - DNA, 25 bp, Homo sapien
cagcttcgttattctctacttgaga

SEQ ID NO: 315362 - DNA, 25 bp, Homo sapien
aacttgcccaaggatattgcttgtt

SEQ ID NO: 315363 - DNA, 25 bp, Homo sapien
aaattacgcagctagtcctgggctt

SEQ ID NO: 315364 - DNA, 25 bp, Homo sapien
attgcttgttagtgtcagaactgaa

SEQ ID NO: 315365 - DNA, 25 bp, Homo sapien
gaaaccaaatgatcatatccctaga

SEQ ID NO: 315366 - DNA, 25 bp, Homo sapien
gatcatatccctagacttttagtct

SEQ ID NO: 315367 - DNA, 25 bp, Homo sapien
tttagtctgctttctcttccataaa

SEQ ID NO: 315368 - DNA, 25 bp, Homo sapien
gaaattgggcaggatctctcttgat

SEQ ID NO: 315369 - DNA, 25 bp, Homo sapien
ggcaggatctctcttgatctagaat

SEQ ID NO: 315370 - DNA, 25 bp, Homo sapien
ggtgaaatgagaagagccccgttct

SEQ ID NO: 315371 - DNA, 25 bp, Homo sapien
tgaaatgagaagagccccgttcttc

SEQ ID NO: 315372 - DNA, 25 bp, Homo sapien
agaagagccccgttcttcctcagtg

SEQ ID NO: 315373 - DNA, 25 bp, Homo sapien
agccccgttcttcctcagtgctggg

SEQ ID NO: 315374 - DNA, 25 bp, Homo sapien
cctctgggctccaggaaggagagca

SEQ ID NO: 315375 - DNA, 25 bp, Homo sapien
agagcagatgaaatctcaggcctgt

SEQ ID NO: 315376 - DNA, 25 bp, Homo sapien
gcagatgaaatctcaggcctgtggc

SEQ ID NO: 315377 - DNA, 25 bp, Homo sapien
agatgaaatctcaggcctgtggctt

SEQ ID NO: 315378 - DNA, 25 bp, Homo sapien
gatgaaatctcaggcctgtggcttc

SEQ ID NO: 315379 - DNA, 25 bp, Homo sapien
gaaatctcaggcctgtggcttctcc

SEQ ID NO: 315380 - DNA, 25 bp, Homo sapien
atctcaggcctgtggcttctccaca

SEQ ID NO: 315381 - DNA, 25 bp, Homo sapien
tcacaattgcatgacttctctttgg

SEQ ID NO: 315382 - DNA, 25 bp, Homo sapien
ggctggtaggttgagtattgttctt

SEQ ID NO: 315383 - DNA, 25 bp, Homo sapien
gtattgttctttttatccatccttt

SEQ ID NO: 315384 - DNA, 25 bp, Homo sapien
gtctttctgcttttaggattatatt

SEQ ID NO: 315385 - DNA, 25 bp, Homo sapien
ttatacaccaccactggagagtaga

SEQ ID NO: 315386 - DNA, 25 bp, Homo sapien
gaaggccactaacttgcaggcagtt

SEQ ID NO: 315387 - DNA, 25 bp, Homo sapien
aggcagttaacttatatctttacaa

SEQ ID NO: 315388 - DNA, 25 bp, Homo sapien
atctttacaagctacattctatttt

SEQ ID NO: 315389 - DNA, 25 bp, Homo sapien
gatttgcttatcactgtattctcat

SEQ ID NO: 315390 - DNA, 25 bp, Homo sapien
gtattctcatccactgaaatcagtc

SEQ ID NO: 315391 - DNA, 25 bp, Homo sapien
gaaatcagtccagctttaccttgga

SEQ ID NO: 315392 - DNA, 25 bp, Homo sapien
gagattgatgtaagggcaactgtcc

SEQ ID NO: 315393 - DNA, 25 bp, Homo sapien
gggcaactgtcccttggtgaagata

SEQ ID NO: 315394 - DNA, 25 bp, Homo sapien
cttggtgacacaataatcttcactg

SEQ ID NO: 315395 - DNA, 25 bp, Homo sapien
aatcttcactgaatggatcaagggt

SEQ ID NO: 315396 - DNA, 25 bp, Homo sapien
gggtatgtcatttttcaggttcttg

SEQ ID NO: 315397 - DNA, 25 bp, Homo sapien
tcaggttcttgtttgttaccataat

SEQ ID NO: 315398 - DNA, 25 bp, Homo sapien
accataatgagaggccaggagaact

SEQ ID NO: 315399 - DNA, 25 bp, Homo sapien
gagaactgggttctagctttaccct

SEQ ID NO: 315400 - DNA, 25 bp, Homo sapien
cccttccgacggtaaatatctggag

SEQ ID NO: 315401 - DNA, 25 bp, Homo sapien
aacctacccctctgtcagtaaatat

SEQ ID NO: 315402 - DNA, 25 bp, Homo sapien
acccctctgtcagtaaatatctgga

SEQ ID NO: 315403 - DNA, 25 bp, Homo sapien
tggcccctctaccaatagggcagta

SEQ ID NO: 315404 - DNA, 25 bp, Homo sapien
ccctctaccaatagggcagtagcct

SEQ ID NO: 315405 - DNA, 25 bp, Homo sapien
tataaggtgggcttggtccaacagg

SEQ ID NO: 315406 - DNA, 25 bp, Homo sapien
cagagggtacatactcctttctggg

SEQ ID NO: 315407 - DNA, 25 bp, Homo sapien
ggagagaatgctccctaccatatag

SEQ ID NO: 315408 - DNA, 25 bp, Homo sapien
gagaatgctccctaccatatagttg

SEQ ID NO: 315409 - DNA, 25 bp, Homo sapien
gaatgctccctaccatatagttgac

SEQ ID NO: 315410 - DNA, 25 bp, Homo sapien
atgctccctaccatatagttgacag

SEQ ID NO: 315411 - DNA, 25 bp, Homo sapien
gctccctaccatatagttgacagtg

SEQ ID NO: 315412 - DNA, 25 bp, Homo sapien
ttgattatgtgtattgatcaccctg

SEQ ID NO: 315413 - DNA, 25 bp, Homo sapien
tattgatcaccctgcaatcctatta

SEQ ID NO: 315414 - DNA, 25 bp, Homo sapien
tggctgtgagagattctttcaagaa

SEQ ID NO: 315415 - DNA, 25 bp, Homo sapien
gagagattctttcaagaagaccaaa

SEQ ID NO: 315416 - DNA, 25 bp, Homo sapien
ccaaagcagaacatggaacttccct

SEQ ID NO: 315417 - DNA, 25 bp, Homo sapien
ataattagaaaatccatgggctttg

SEQ ID NO: 315418 - DNA, 25 bp, Homo sapien
tggatttaaattctggttttagagc

SEQ ID NO: 315419 - DNA, 25 bp, Homo sapien
tttagagcccactgtgtttaacctc

SEQ ID NO: 315420 - DNA, 25 bp, Homo sapien
acctctccatccattaaaagagatg

SEQ ID NO: 315421 - DNA, 25 bp, Homo sapien
aagagatgattgtacctatgagata

SEQ ID NO: 315422 - DNA, 25 bp, Homo sapien
ggtaaagtgtccagtggtttttcat

SEQ ID NO: 315423 - DNA, 25 bp, Homo sapien
aagtgtccagtggtttttcataatg

SEQ ID NO: 315424 - DNA, 25 bp, Homo sapien
ggtttttcataatggatgcataatg

SEQ ID NO: 315425 - DNA, 25 bp, Homo sapien
cccactgccatttacttgagcgtga

SEQ ID NO: 315426 - DNA, 25 bp, Homo sapien
atttacttgagcgtgaatgacacac

SEQ ID NO: 315427 - DNA, 25 bp, Homo sapien
atgacacacgagagattctttgcct

SEQ ID NO: 315428 - DNA, 25 bp, Homo sapien
acgagagattctttgccttccataa

SEQ ID NO: 315429 - DNA, 25 bp, Homo sapien
agaactcaaattcaccatgcatagg

SEQ ID NO: 315430 - DNA, 25 bp, Homo sapien
gacaatgtctgcaattaaacaccag

SEQ ID NO: 315431 - DNA, 25 bp, Homo sapien
accatgcataggagtgataacaaaa

SEQ ID NO: 315432 - DNA, 25 bp, Homo sapien
ttaaacaccagtaagcaaaattgat

SEQ ID NO: 315433 - DNA, 25 bp, Homo sapien
gaatgacttgcagggcttatcacgc

SEQ ID NO: 315434 - DNA, 25 bp, Homo sapien
gggcttatcacgcagtttcatttac

SEQ ID NO: 315435 - DNA, 25 bp, Homo sapien
tcacgcagtttcatttacatcccta

SEQ ID NO: 315436 - DNA, 25 bp, Homo sapien
ttctattctcgtttagttttcaaga

SEQ ID NO: 315437 - DNA, 25 bp, Homo sapien
gggaaattggaaatcattacattgt

SEQ ID NO: 315438 - DNA, 25 bp, Homo sapien
tctccacacgcacagtttgctgcaa

SEQ ID NO: 315439 - DNA, 25 bp, Homo sapien
gagaatttcagatctgggtttttga

SEQ ID NO: 315440 - DNA, 25 bp, Homo sapien
aacagaattgcgcattgaaaacgat

SEQ ID NO: 315441 - DNA, 25 bp, Homo sapien
gacaatggtctaatgtgcattcctc

SEQ ID NO: 315442 - DNA, 25 bp, Homo sapien
taatgtgcattcctcattacctctc

SEQ ID NO: 315443 - DNA, 25 bp, Homo sapien
gtgcattcctcattacctctcgtgg

SEQ ID NO: 315444 - DNA, 25 bp, Homo sapien
aagaaactggtgacttggtccatca

SEQ ID NO: 315445 - DNA, 25 bp, Homo sapien
tggtccatcagtcacgaagttcttt

SEQ ID NO: 315446 - DNA, 25 bp, Homo sapien
gaagttctttctattctcgtttagt

SEQ ID NO: 315447 - DNA, 25 bp, Homo sapien
tgctaaaggaacagtgtggtgcccc

SEQ ID NO: 315448 - DNA, 25 bp, Homo sapien
tcatcagagagctgtatccatgtct

SEQ ID NO: 315449 - DNA, 25 bp, Homo sapien
gagctgtatccatgtctactttttt

SEQ ID NO: 315450 - DNA, 25 bp, Homo sapien
acttcttggccacagcacatcacag

SEQ ID NO: 315451 - DNA, 25 bp, Homo sapien
agcacatcacagacacagtttctgg

SEQ ID NO: 315452 - DNA, 25 bp, Homo sapien
gtttgaggatacagtgttggcagct

SEQ ID NO: 315453 - DNA, 25 bp, Homo sapien
gagaagaccttcttgccaggacata

SEQ ID NO: 315454 - DNA, 25 bp, Homo sapien
aggacataaaatgataccctcctct

SEQ ID NO: 315455 - DNA, 25 bp, Homo sapien
agcctgcttcgaatagtgggactca

SEQ ID NO: 315456 - DNA, 25 bp, Homo sapien
ggactcagggagataagaccttctt

SEQ ID NO: 315457 - DNA, 25 bp, Homo sapien
agaccttcttgctggatttttatga

SEQ ID NO: 315458 - DNA, 25 bp, Homo sapien
tcatcctgtggctttggacgtacta

SEQ ID NO: 315459 - DNA, 25 bp, Homo sapien
ggacgtactatccaaagaggctgta

SEQ ID NO: 315460 - DNA, 25 bp, Homo sapien
tgtacatccagcaagtcactagtta

SEQ ID NO: 315461 - DNA, 25 bp, Homo sapien
aataggaattcttggcgtgtaatgc

SEQ ID NO: 315462 - DNA, 25 bp, Homo sapien
gcgtgtaatgccatttcttgtagct

SEQ ID NO: 315463 - DNA, 25 bp, Homo sapien
gtgataagtgattaacctgttctgt

SEQ ID NO: 315464 - DNA, 25 bp, Homo sapien
tgttctgtgcttcagttgactctta

SEQ ID NO: 315465 - DNA, 25 bp, Homo sapien
gcttcagttgactcttataaggaca

SEQ ID NO: 315466 - DNA, 25 bp, Homo sapien
gacagtcattccctttaagcatctt

SEQ ID NO: 315467 - DNA, 25 bp, Homo sapien
gggatattgtcatctttctaatagg

SEQ ID NO: 315468 - DNA, 25 bp, Homo sapien
gaaagtaatcaggaccttttcaaga

SEQ ID NO: 315469 - DNA, 25 bp, Homo sapien
tttacatttacccagacttcagtac

SEQ ID NO: 315470 - DNA, 25 bp, Homo sapien
tccaaagtccactgaccatcttgag

SEQ ID NO: 315471 - DNA, 25 bp, Homo sapien
gacttcagtacatggatcaagctaa

SEQ ID NO: 315472 - DNA, 25 bp, Homo sapien
gatcaagctaacttttgttcatgga

SEQ ID NO: 315473 - DNA, 25 bp, Homo sapien
tttttcctcagtgctaccaagttag

SEQ ID NO: 315474 - DNA, 25 bp, Homo sapien
gaagaattcatccagtggcttcttt

SEQ ID NO: 315475 - DNA, 25 bp, Homo sapien
gtggcttctttctaggccaaccatt

SEQ ID NO: 315476 - DNA, 25 bp, Homo sapien
taggccaaccattcttcctgaggaa

SEQ ID NO: 315477 - DNA, 25 bp, Homo sapien
gaaccccaggtcataacccagagat

SEQ ID NO: 315478 - DNA, 25 bp, Homo sapien
agagatactgtccattcactgggcc

SEQ ID NO: 315479 - DNA, 25 bp, Homo sapien
ccatcaaaatgcatcaaggagcttt

SEQ ID NO: 315480 - DNA, 25 bp, Homo sapien
gtggaaatagggattctgtgtcttt

SEQ ID NO: 315481 - DNA, 25 bp, Homo sapien
aaatagggattctgtgtctttgtgt

SEQ ID NO: 315482 - DNA, 25 bp, Homo sapien
gtgtctttgtgtcataactttgatg

SEQ ID NO: 315483 - DNA, 25 bp, Homo sapien
gtctttgtgtcataactttgatggg

SEQ ID NO: 315484 - DNA, 25 bp, Homo sapien
catccaagccattgtaagagttcca

SEQ ID NO: 315485 - DNA, 25 bp, Homo sapien
aagccattgtaagagttccacagag

SEQ ID NO: 315486 - DNA, 25 bp, Homo sapien
caacgtctgtcccatccatatttgt

SEQ ID NO: 315487 - DNA, 25 bp, Homo sapien
gtctgtcccatccatatttgtctct

SEQ ID NO: 315488 - DNA, 25 bp, Homo sapien
ttgtaagagttccacagagctctgg

SEQ ID NO: 315489 - DNA, 25 bp, Homo sapien
gtcccatccatatttgtctctctgt

SEQ ID NO: 315490 - DNA, 25 bp, Homo sapien
catccatatttgtctctctgtccac

SEQ ID NO: 315491 - DNA, 25 bp, Homo sapien
ccccaaagatgctcctgagtgcaag

SEQ ID NO: 315492 - DNA, 25 bp, Homo sapien
caaagatgctcctgagtgcaagagc

SEQ ID NO: 315493 - DNA, 25 bp, Homo sapien
gcaagagcaggcaaggcagagtcct

SEQ ID NO: 315494 - DNA, 25 bp, Homo sapien
acagccacgaggtgacctccctgtg

SEQ ID NO: 315495 - DNA, 25 bp, Homo sapien
acgaggtgacctccctgtgcagaga

SEQ ID NO: 315496 - DNA, 25 bp, Homo sapien
aggtgacctccctgtgcagagactc

SEQ ID NO: 315497 - DNA, 25 bp, Homo sapien
gggacaggacaccactgcctgctct

SEQ ID NO: 315498 - DNA, 25 bp, Homo sapien
gacctggagatccagaagtatggcc

SEQ ID NO: 315499 - DNA, 25 bp, Homo sapien
aagtatggcccagaagagcccttgc

SEQ ID NO: 315500 - DNA, 25 bp, Homo sapien
gtatggcccagaagagcccttgccc

SEQ ID NO: 315501 - DNA, 25 bp, Homo sapien
ttgcctcccactgaggagactttgg

SEQ ID NO: 315502 - DNA, 25 bp, Homo sapien
agctacatgcttctttcctatacta

SEQ ID NO: 315503 - DNA, 25 bp, Homo sapien
catgcttctttcctatactactgta

SEQ ID NO: 315504 - DNA, 25 bp, Homo sapien
gcttctttcctatactactgtagca

SEQ ID NO: 315505 - DNA, 25 bp, Homo sapien
actactgtagcaaaccaaggcattg

SEQ ID NO: 315506 - DNA, 25 bp, Homo sapien
aaccaaggcattgatgagagggcat

SEQ ID NO: 315507 - DNA, 25 bp, Homo sapien
agagggcatgcaaattgtgcttcac

SEQ ID NO: 315508 - DNA, 25 bp, Homo sapien
gggcatgcaaattgtgcttcacttt

SEQ ID NO: 315509 - DNA, 25 bp, Homo sapien
gtgcttcactttacagtgttttatc

SEQ ID NO: 315510 - DNA, 25 bp, Homo sapien
ctgttgagtatttaagaggctgtac

SEQ ID NO: 315511 - DNA, 25 bp, Homo sapien
taagaggctgtacatgttttctttt

SEQ ID NO: 315512 - DNA, 25 bp, Homo sapien
tactttttcatgttcagtacatcaa

SEQ ID NO: 315513 - DNA, 25 bp, Homo sapien
catatttgtacagtgatcggcttca

SEQ ID NO: 315514 - DNA, 25 bp, Homo sapien
ttgtacagtgatcggcttcagtgat

SEQ ID NO: 315515 - DNA, 25 bp, Homo sapien
catagttatactacagtcctttttt

SEQ ID NO: 315516 - DNA, 25 bp, Homo sapien
acagtccttttttaaatgtatcctg

SEQ ID NO: 315517 - DNA, 25 bp, Homo sapien
tgtatcctgatacattgtaaaatat

SEQ ID NO: 315518 - DNA, 25 bp, Homo sapien
aaggagatatttttcactgttaact

SEQ ID NO: 315519 - DNA, 25 bp, Homo sapien
ctgttaacttttagcccatgcattt

SEQ ID NO: 315520 - DNA, 25 bp, Homo sapien
acttttagcccatgcattttcataa

SEQ ID NO: 315521 - DNA, 25 bp, Homo sapien
gattatttaacacttgatgtgatct

SEQ ID NO: 315522 - DNA, 25 bp, Homo sapien
taaacccaagttgcacaaccctcct

SEQ ID NO: 315523 - DNA, 25 bp, Homo sapien
cacaaccctcctgctgaagataaaa

SEQ ID NO: 315524 - DNA, 25 bp, Homo sapien
atgaatgggactgtggtgagctact

SEQ ID NO: 315525 - DNA, 25 bp, Homo sapien
gactgtggtgagctacttgtttctg

SEQ ID NO: 315526 - DNA, 25 bp, Homo sapien
tgagctacttgtttctgccatctgt

SEQ ID NO: 315527 - DNA, 25 bp, Homo sapien
ttgtttctgccatctgttgtactct

SEQ ID NO: 315528 - DNA, 25 bp, Homo sapien
tgttgtactctctcatgcctgtcag

SEQ ID NO: 315529 - DNA, 25 bp, Homo sapien
gcctgtcagccactgaagctgaatg

SEQ ID NO: 315530 - DNA, 25 bp, Homo sapien
gccactgaagctgaatggatcctaa

SEQ ID NO: 315531 - DNA, 25 bp, Homo sapien
aatggatcctaaattacttcctgga

SEQ ID NO: 315532 - DNA, 25 bp, Homo sapien
ttactgaccaagttcatctattttg

SEQ ID NO: 315533 - DNA, 25 bp, Homo sapien
gaccaagttcatctattttgtttta

SEQ ID NO: 315534 - DNA, 25 bp, Homo sapien
ttataaaagctgatagtgctgatct

SEQ ID NO: 315535 - DNA, 25 bp, Homo sapien
agaagctggaaccatttctcccgca

SEQ ID NO: 315536 - DNA, 25 bp, Homo sapien
ggaaccatttctcccgcaggcctga

SEQ ID NO: 315537 - DNA, 25 bp, Homo sapien
ccgcaggcctgagttcctaaggaaa

SEQ ID NO: 315538 - DNA, 25 bp, Homo sapien
cccactcttgctctacgaggagcaa

SEQ ID NO: 315539 - DNA, 25 bp, Homo sapien
tctacgaggagcaagtgcctgcccc

SEQ ID NO: 315540 - DNA, 25 bp, Homo sapien
cagccctgccaaagttgcattatct

SEQ ID NO: 315541 - DNA, 25 bp, Homo sapien
tgcattatctttggccaaggctggg

SEQ ID NO: 315542 - DNA, 25 bp, Homo sapien
aagaatgcaaagaggccgcttccct

SEQ ID NO: 315543 - DNA, 25 bp, Homo sapien
aaagaggccgcttccctaagaggct

SEQ ID NO: 315544 - DNA, 25 bp, Homo sapien
ccgcttccctaagaggcttggagga

SEQ ID NO: 315545 - DNA, 25 bp, Homo sapien
cttggaggagctgggctctatccca

SEQ ID NO: 315546 - DNA, 25 bp, Homo sapien
accggcctgggcacctttgaagctg

SEQ ID NO: 315547 - DNA, 25 bp, Homo sapien
cggcctgggcacctttgaagctgct

SEQ ID NO: 315548 - DNA, 25 bp, Homo sapien
ggcctgggcacctttgaagctgctg

SEQ ID NO: 315549 - DNA, 25 bp, Homo sapien
gcctgggcacctttgaagctgctgg

SEQ ID NO: 315550 - DNA, 25 bp, Homo sapien
cctgggcacctttgaagctgctggc

SEQ ID NO: 315551 - DNA, 25 bp, Homo sapien
ctgggcacctttgaagctgctggca

SEQ ID NO: 315552 - DNA, 25 bp, Homo sapien
ggcccgaagtactgatcgtagcgta

SEQ ID NO: 315553 - DNA, 25 bp, Homo sapien
gcccgaagtactgatcgtagcgtac

SEQ ID NO: 315554 - DNA, 25 bp, Homo sapien
cccgaagtactgatcgtagcgtact

SEQ ID NO: 315555 - DNA, 25 bp, Homo sapien
gaagtactgatcgtagcgtactccc

SEQ ID NO: 315556 - DNA, 25 bp, Homo sapien
aagtactgatcgtagcgtactcccc

SEQ ID NO: 315557 - DNA, 25 bp, Homo sapien
tgcctacattgcctaccccaaattt

SEQ ID NO: 315558 - DNA, 25 bp, Homo sapien
ctacattgcctaccccaaattttgg

SEQ ID NO: 315559 - DNA, 25 bp, Homo sapien
cattgcctaccccaaattttggacg

SEQ ID NO: 315560 - DNA, 25 bp, Homo sapien
tgcctaccccaaattttggacgtgt

SEQ ID NO: 315561 - DNA, 25 bp, Homo sapien
ccccaaattttggacgtgtgcttgt

SEQ ID NO: 315562 - DNA, 25 bp, Homo sapien
caaattttggacgtgtgcttgtgcc

SEQ ID NO: 315563 - DNA, 25 bp, Homo sapien
aattttggacgtgtgcttgtgcctg

SEQ ID NO: 315564 - DNA, 25 bp, Homo sapien
attttggacgtgtgcttgtgcctgc

SEQ ID NO: 315565 - DNA, 25 bp, Homo sapien
tttggacgtgtgcttgtgcctgcat

SEQ ID NO: 315566 - DNA, 25 bp, Homo sapien
tggacgtgtgcttgtgcctgcattg

SEQ ID NO: 315567 - DNA, 25 bp, Homo sapien
caggtccaaatcaaggcccaggctg

SEQ ID NO: 315568 - DNA, 25 bp, Homo sapien
tctggcctattgtcattgttgtttc

SEQ ID NO: 315569 - DNA, 25 bp, Homo sapien
aatgagattcctacactttgcctaa

SEQ ID NO: 315570 - DNA, 25 bp, Homo sapien
gattcctacactttgcctaattgag

SEQ ID NO: 315571 - DNA, 25 bp, Homo sapien
actttgcctaattgagccactacca

SEQ ID NO: 315572 - DNA, 25 bp, Homo sapien
attgagccactaccaggttttctgg

SEQ ID NO: 315573 - DNA, 25 bp, Homo sapien
actaccaggttttctggcagctgtg

SEQ ID NO: 315574 - DNA, 25 bp, Homo sapien
gcagctgtggccacattatttgtga

SEQ ID NO: 315575 - DNA, 25 bp, Homo sapien
ttctttatgttcagagtgacttttg

SEQ ID NO: 315576 - DNA, 25 bp, Homo sapien
cagagtgacttttgattctgattct

SEQ ID NO: 315577 - DNA, 25 bp, Homo sapien
ctttatgttttgtatggagcggcac

SEQ ID NO: 315578 - DNA, 25 bp, Homo sapien
tggagcggcacttttatctgtgttt

SEQ ID NO: 315579 - DNA, 25 bp, Homo sapien
agacctactggaaatctgtatcgaa

SEQ ID NO: 315580 - DNA, 25 bp, Homo sapien
atctgtatcgaaacagctatgtgat

SEQ ID NO: 315581 - DNA, 25 bp, Homo sapien
aaaagcatcatacttctctagtttg

SEQ ID NO: 315582 - DNA, 25 bp, Homo sapien
atcatacttctctagtttgcctgca

SEQ ID NO: 315583 - DNA, 25 bp, Homo sapien
tacttctctagtttgcctgcattca

SEQ ID NO: 315584 - DNA, 25 bp, Homo sapien
tagtttgcctgcattcagtggctaa

SEQ ID NO: 315585 - DNA, 25 bp, Homo sapien
gcctgcattcagtggctaacattat

SEQ ID NO: 315586 - DNA, 25 bp, Homo sapien
gtggctaacattatgagcattgtgt

SEQ ID NO: 315587 - DNA, 25 bp, Homo sapien
tgtaagataaacacatggtcagtat

SEQ ID NO: 315588 - DNA, 25 bp, Homo sapien
aatgttagagccatgattaattcct

SEQ ID NO: 315589 - DNA, 25 bp, Homo sapien
gagccatgattaattcctatgaaaa

SEQ ID NO: 315590 - DNA, 25 bp, Homo sapien
acagaaggacttgggattccggagc

SEQ ID NO: 315591 - DNA, 25 bp, Homo sapien
gggattccggagcagtcgcccctat

SEQ ID NO: 315592 - DNA, 25 bp, Homo sapien
agccagacgtgttgctgccgtgagt

SEQ ID NO: 315593 - DNA, 25 bp, Homo sapien
agacgtgttgctgccgtgagtaaaa

SEQ ID NO: 315594 - DNA, 25 bp, Homo sapien
gtgagtaaaacgagcgccctctccg

SEQ ID NO: 315595 - DNA, 25 bp, Homo sapien
ctctccgcactcgtttacaaattaa

SEQ ID NO: 315596 - DNA, 25 bp, Homo sapien
ggaggaaatttcgttggccaacctg

SEQ ID NO: 315597 - DNA, 25 bp, Homo sapien
ggccaacctggatactaacaagcta

SEQ ID NO: 315598 - DNA, 25 bp, Homo sapien
taacaagctagaggccatcgctcag

SEQ ID NO: 315599 - DNA, 25 bp, Homo sapien
agaggccatcgctcaggagatttac

SEQ ID NO: 315600 - DNA, 25 bp, Homo sapien
atcgctcaggagatttacgtagacc

SEQ ID NO: 315601 - DNA, 25 bp, Homo sapien
agcctgaatagggaagaggacatca

SEQ ID NO: 315602 - DNA, 25 bp, Homo sapien
atcagagagggacaggagtcacacc

SEQ ID NO: 315603 - DNA, 25 bp, Homo sapien
ggacaggagtcacaccagaaaaatc

SEQ ID NO: 315604 - DNA, 25 bp, Homo sapien
aacctcaagagttctattttcctag

SEQ ID NO: 315605 - DNA, 25 bp, Homo sapien
tttcctagttaattgtcactggcca

SEQ ID NO: 315606 - DNA, 25 bp, Homo sapien
ttgtcactggccactacgtttttaa

SEQ ID NO: 315607 - DNA, 25 bp, Homo sapien
actgcatcagatgacactttaaata

SEQ ID NO: 315608 - DNA, 25 bp, Homo sapien
agggcatgaaacactgtcctcatcc

SEQ ID NO: 315609 - DNA, 25 bp, Homo sapien
cgcctaccgcggacattggaaaata

SEQ ID NO: 315610 - DNA, 25 bp, Homo sapien
cattggaaaataagccccaggctgt

SEQ ID NO: 315611 - DNA, 25 bp, Homo sapien
tgggaaccctcatgaactcatccac

SEQ ID NO: 315612 - DNA, 25 bp, Homo sapien
tgcagtccctagagctggtggtctt

SEQ ID NO: 315613 - DNA, 25 bp, Homo sapien
tagagctggtggtcttcctacagac

SEQ ID NO: 315614 - DNA, 25 bp, Homo sapien
gttccagcaggcaggctgagcactg

SEQ ID NO: 315615 - DNA, 25 bp, Homo sapien
gcaggttgcttgtctcctggaggga

SEQ ID NO: 315616 - DNA, 25 bp, Homo sapien
gccgttgaggagctgtcacttcgct

SEQ ID NO: 315617 - DNA, 25 bp, Homo sapien
aggagctgtcacttcgctggagcat

SEQ ID NO: 315618 - DNA, 25 bp, Homo sapien
ttcgctggagcatgtattggcctca

SEQ ID NO: 315619 - DNA, 25 bp, Homo sapien
cctagcgggctccatgcataatttt

SEQ ID NO: 315620 - DNA, 25 bp, Homo sapien
gcgggctccatgcataattttaaaa

SEQ ID NO: 315621 - DNA, 25 bp, Homo sapien
aaaagccaattgcaggagtaggaat

SEQ ID NO: 315622 - DNA, 25 bp, Homo sapien
tgcaggagtaggaattcagttcaat

SEQ ID NO: 315623 - DNA, 25 bp, Homo sapien
ccagttccagttccgaatcatcaga

SEQ ID NO: 315624 - DNA, 25 bp, Homo sapien
ggcttcttcctaggagagcgcatcc

SEQ ID NO: 315625 - DNA, 25 bp, Homo sapien
ccgcatttgtgcaggcccatgcctg

SEQ ID NO: 315626 - DNA, 25 bp, Homo sapien
gacactgcaatggagaccttcaact

SEQ ID NO: 315627 - DNA, 25 bp, Homo sapien
atctttatcgctccccagggactct

SEQ ID NO: 315628 - DNA, 25 bp, Homo sapien
ggactctcgcgcagggatgcctcgt

SEQ ID NO: 315629 - DNA, 25 bp, Homo sapien
ggatgcctcgtcaggcccgagacaa

SEQ ID NO: 315630 - DNA, 25 bp, Homo sapien
cgagacaagaactgcatcgtggctt

SEQ ID NO: 315631 - DNA, 25 bp, Homo sapien
catcgtggcttgaaggcaggccgtc

SEQ ID NO: 315632 - DNA, 25 bp, Homo sapien
ccattctccagtcagagtagatgat

SEQ ID NO: 315633 - DNA, 25 bp, Homo sapien
gagtagatgatgaggcccatgcccc

SEQ ID NO: 315634 - DNA, 25 bp, Homo sapien
gggacttctctaaagcattgccacc

SEQ ID NO: 315635 - DNA, 25 bp, Homo sapien
gggaggaagctacacagctcctcta

SEQ ID NO: 315636 - DNA, 25 bp, Homo sapien
acacagctcctctattcttgggttg

SEQ ID NO: 315637 - DNA, 25 bp, Homo sapien
tgggctccggtctgctatcatctat

SEQ ID NO: 315638 - DNA, 25 bp, Homo sapien
tatcatctatcccttccaggcttat

SEQ ID NO: 315639 - DNA, 25 bp, Homo sapien
aggcttattcccaggcaggcagaca

SEQ ID NO: 315640 - DNA, 25 bp, Homo sapien
tctgggtctgactggcagctaagct

SEQ ID NO: 315641 - DNA, 25 bp, Homo sapien
taagctcccttatccttctctgaag

SEQ ID NO: 315642 - DNA, 25 bp, Homo sapien
tagacctgccttattcccacttatg

SEQ ID NO: 315643 - DNA, 25 bp, Homo sapien
ttattcccacttatgctgtacagct

SEQ ID NO: 315644 - DNA, 25 bp, Homo sapien
tgtacagctactctccaaagcaggg

SEQ ID NO: 315645 - DNA, 25 bp, Homo sapien
aaggaattgtcagagcaaaggcttt

SEQ ID NO: 315646 - DNA, 25 bp, Homo sapien
gagcaaaggctttgagtcccagctt

SEQ ID NO: 315647 - DNA, 25 bp, Homo sapien
tttgagtcccagcttcccagtttgt

SEQ ID NO: 315648 - DNA, 25 bp, Homo sapien
tcccagcttcccagtttgtgacctt

SEQ ID NO: 315649 - DNA, 25 bp, Homo sapien
gagcaattgcttaacttttccaaag

SEQ ID NO: 315650 - DNA, 25 bp, Homo sapien
gcttaacttttccaaagcctccaat

SEQ ID NO: 315651 - DNA, 25 bp, Homo sapien
agcctccaatagtcttcactctaaa

SEQ ID NO: 315652 - DNA, 25 bp, Homo sapien
tatgcagggtatttacaaggagcct

SEQ ID NO: 315653 - DNA, 25 bp, Homo sapien
ggagcctggtacttggtgtacctaa

SEQ ID NO: 315654 - DNA, 25 bp, Homo sapien
acttggtgtacctaatgtatgttag

SEQ ID NO: 315655 - DNA, 25 bp, Homo sapien
gcaaaaatttctctagcattgactg

SEQ ID NO: 315656 - DNA, 25 bp, Homo sapien
accctttcccagtattcagagctgt

SEQ ID NO: 315657 - DNA, 25 bp, Homo sapien
tattcagagctgtgaacccctgtgg

SEQ ID NO: 315658 - DNA, 25 bp, Homo sapien
tgtgaacccctgtggcgcaggactg

SEQ ID NO: 315659 - DNA, 25 bp, Homo sapien
actggcctgtgtctgttattttggt

SEQ ID NO: 315660 - DNA, 25 bp, Homo sapien
ttggttgtaaatcattctcctgtgg

SEQ ID NO: 315661 - DNA, 25 bp, Homo sapien
taaatcattctcctgtggaattggc

SEQ ID NO: 315662 - DNA, 25 bp, Homo sapien
gtccttaccagcaacagtttgcgtc

SEQ ID NO: 315663 - DNA, 25 bp, Homo sapien
cagtttgcgtcgtcacatgctgtga

SEQ ID NO: 315664 - DNA, 25 bp, Homo sapien
tatgtatatatcacgcagcaggagt

SEQ ID NO: 315665 - DNA, 25 bp, Homo sapien
atcacgcagcaggagtgtcattcat

SEQ ID NO: 315666 - DNA, 25 bp, Homo sapien
tgctgtcccctggtgaagtgacaag

SEQ ID NO: 315667 - DNA, 25 bp, Homo sapien
atcagtcgatggtcagagccctttg

SEQ ID NO: 315668 - DNA, 25 bp, Homo sapien
gaccatttttaggtgagcttggctt

SEQ ID NO: 315669 - DNA, 25 bp, Homo sapien
agtgtgcagtgcattcttcctgaat

SEQ ID NO: 315670 - DNA, 25 bp, Homo sapien
aattttgcaattctggtatctgggt

SEQ ID NO: 315671 - DNA, 25 bp, Homo sapien
ctgggtgtattttctaggtgtgtca

SEQ ID NO: 315672 - DNA, 25 bp, Homo sapien
aagaggttcctatccagtcatgtta

SEQ ID NO: 315673 - DNA, 25 bp, Homo sapien
cagtcatgttaatgatcttccactt

SEQ ID NO: 315674 - DNA, 25 bp, Homo sapien
atgatcttccacttgtactatcctg

SEQ ID NO: 315675 - DNA, 25 bp, Homo sapien
tactatcctgtgcttcgttgttaac

SEQ ID NO: 315676 - DNA, 25 bp, Homo sapien
ctgtgcttcgttgttaacctcgaaa

SEQ ID NO: 315677 - DNA, 25 bp, Homo sapien
gaaaacatactttgttggctgcaaa

SEQ ID NO: 315678 - DNA, 25 bp, Homo sapien
gtttggtttcttgtctgtccacggg

SEQ ID NO: 315679 - DNA, 25 bp, Homo sapien
gagacgggcttcaacaatggttcct

SEQ ID NO: 315680 - DNA, 25 bp, Homo sapien
acgggcttcaacaatggttcctgct

SEQ ID NO: 315681 - DNA, 25 bp, Homo sapien
gcttcaacaatggttcctgcttggg

SEQ ID NO: 315682 - DNA, 25 bp, Homo sapien
ttcctgcttgggtgtcccagcgggc

SEQ ID NO: 315683 - DNA, 25 bp, Homo sapien
ccagcgggcgcctatggcaaaaaca

SEQ ID NO: 315684 - DNA, 25 bp, Homo sapien
gcctatggcaaaaacacagcggttg

SEQ ID NO: 315685 - DNA, 25 bp, Homo sapien
acagcggttgcaattgtgtggcagc

SEQ ID NO: 315686 - DNA, 25 bp, Homo sapien
aattgtgtggcagcttgctactaat

SEQ ID NO: 315687 - DNA, 25 bp, Homo sapien
ggcagcttgctactaatgataatga

SEQ ID NO: 315688 - DNA, 25 bp, Homo sapien
gatcaagttgtttgatgcaataaac

SEQ ID NO: 315689 - DNA, 25 bp, Homo sapien
tgaacacctactcatctttctggac

SEQ ID NO: 315690 - DNA, 25 bp, Homo sapien
tctggactgagctcagatgtcacct

SEQ ID NO: 315691 - DNA, 25 bp, Homo sapien
tgtcaccttctgaagagacccttcc

SEQ ID NO: 315692 - DNA, 25 bp, Homo sapien
ttaacagctgcacctagagtcctct

SEQ ID NO: 315693 - DNA, 25 bp, Homo sapien
tgaagagacccttcctaactactgc

SEQ ID NO: 315694 - DNA, 25 bp, Homo sapien
gagacccttcctaactactgctttt

SEQ ID NO: 315695 - DNA, 25 bp, Homo sapien
cagtccccattagaagttggcagcc

SEQ ID NO: 315696 - DNA, 25 bp, Homo sapien
tccagctgctctgtgcacactgtgg

SEQ ID NO: 315697 - DNA, 25 bp, Homo sapien
acactgtggcccaacacccatgagg

SEQ ID NO: 315698 - DNA, 25 bp, Homo sapien
ggagcagaagcaaactggaagcctc

SEQ ID NO: 315699 - DNA, 25 bp, Homo sapien
aaactggaagcctcttgcattttca

SEQ ID NO: 315700 - DNA, 25 bp, Homo sapien
tgataccttgatattatctgcattg

SEQ ID NO: 315701 - DNA, 25 bp, Homo sapien
tattatctgcattgtggctacatgt

SEQ ID NO: 315702 - DNA, 25 bp, Homo sapien
tatctgcattgtggctacatgttac

SEQ ID NO: 315703 - DNA, 25 bp, Homo sapien
ctgcattgtggctacatgttacttt

SEQ ID NO: 315704 - DNA, 25 bp, Homo sapien
catgttacttttcttcacaagagtg

SEQ ID NO: 315705 - DNA, 25 bp, Homo sapien
gttacttttcttcacaagagtgata

SEQ ID NO: 315706 - DNA, 25 bp, Homo sapien
aaataaagaatgattggactgggaa

SEQ ID NO: 315707 - DNA, 25 bp, Homo sapien
gaggagagcaagcagtttaatatat

SEQ ID NO: 315708 - DNA, 25 bp, Homo sapien
gagagcaagcagtttaatatataga

SEQ ID NO: 315709 - DNA, 25 bp, Homo sapien
gggaccttataaaacatgagcaatg

SEQ ID NO: 315710 - DNA, 25 bp, Homo sapien
gagcaatggaacacttttttccaaa

SEQ ID NO: 315711 - DNA, 25 bp, Homo sapien
tgaggaaacccaggcacttctgacg

SEQ ID NO: 315712 - DNA, 25 bp, Homo sapien
ccaggcacttctgacggctgaggaa

SEQ ID NO: 315713 - DNA, 25 bp, Homo sapien
agagaaatcctaacctgaccatcac

SEQ ID NO: 315714 - DNA, 25 bp, Homo sapien
atctgattgcgaggaacctgggctc

SEQ ID NO: 315715 - DNA, 25 bp, Homo sapien
ctctgactcgaacacctgcaaagga

SEQ ID NO: 315716 - DNA, 25 bp, Homo sapien
cagggactgggaccgttacttacat

SEQ ID NO: 315717 - DNA, 25 bp, Homo sapien
gaccgttacttacatgacactgcac

SEQ ID NO: 315718 - DNA, 25 bp, Homo sapien
gacactgcacccaggagatacaaat

SEQ ID NO: 315719 - DNA, 25 bp, Homo sapien
gatacaaatcattgacactctgagt

SEQ ID NO: 315720 - DNA, 25 bp, Homo sapien
gtggttgtactctgtgaggccctga

SEQ ID NO: 315721 - DNA, 25 bp, Homo sapien
ctgagacaccagaagtgtgccctgc

SEQ ID NO: 315722 - DNA, 25 bp, Homo sapien
gacttctgcggcctgaagatcgaac

SEQ ID NO: 315723 - DNA, 25 bp, Homo sapien
gatcgaacaaaagatgtcctgacca

SEQ ID NO: 315724 - DNA, 25 bp, Homo sapien
aaagatgtcctgaccaagccaagga

SEQ ID NO: 315725 - DNA, 25 bp, Homo sapien
agccaaggaccaaccgctttgtgaa

SEQ ID NO: 315726 - DNA, 25 bp, Homo sapien
caaccgctttgtgaaattggcagtg

SEQ ID NO: 315727 - DNA, 25 bp, Homo sapien
cactggctgtggtgaaaagtgccct

SEQ ID NO: 315728 - DNA, 25 bp, Homo sapien
ggaatgggcccctaagtttcagctg

SEQ ID NO: 315729 - DNA, 25 bp, Homo sapien
tgggcccctaagtttcagctgcagc

SEQ ID NO: 315730 - DNA, 25 bp, Homo sapien
gcagctgtttccctgaaagccagag

SEQ ID NO: 315731 - DNA, 25 bp, Homo sapien
agaccttcctcttacatcacattaa

SEQ ID NO: 315732 - DNA, 25 bp, Homo sapien
ctcacccttccatggaaggattggg

SEQ ID NO: 315733 - DNA, 25 bp, Homo sapien
cagggcatattctatatggtgtatt

SEQ ID NO: 315734 - DNA, 25 bp, Homo sapien
tattctatatggtgtatttgtgtta

SEQ ID NO: 315735 - DNA, 25 bp, Homo sapien
aaagagcagggtcataatcacacag

SEQ ID NO: 315736 - DNA, 25 bp, Homo sapien
agcagggtcataatcacacagcagt

SEQ ID NO: 315737 - DNA, 25 bp, Homo sapien
aatgtttgcatgtttcagttttcaa

SEQ ID NO: 315738 - DNA, 25 bp, Homo sapien
ttcagttttcaagaaccaaatgagt

SEQ ID NO: 315739 - DNA, 25 bp, Homo sapien
cagcagtgccttatatagttgccat

SEQ ID NO: 315740 - DNA, 25 bp, Homo sapien
gcagtgccttatatagttgccataa

SEQ ID NO: 315741 - DNA, 25 bp, Homo sapien
tatagttgccataagacttcagtgc

SEQ ID NO: 315742 - DNA, 25 bp, Homo sapien
ttgccataagacttcagtgcagtac

SEQ ID NO: 315743 - DNA, 25 bp, Homo sapien
acatatcagggcatattctatatgg

SEQ ID NO: 315744 - DNA, 25 bp, Homo sapien
taagcagagcccaccatgggtgaga

SEQ ID NO: 315745 - DNA, 25 bp, Homo sapien
agagcccaccatgggtgagaagaga

SEQ ID NO: 315746 - DNA, 25 bp, Homo sapien
agaggaaagccagggtctccaccac

SEQ ID NO: 315747 - DNA, 25 bp, Homo sapien
gaagggttggcagttttataagagc

SEQ ID NO: 315748 - DNA, 25 bp, Homo sapien
tttataagagctggacctcctccta

SEQ ID NO: 315749 - DNA, 25 bp, Homo sapien
agctggacctcctcctatgagtaga

SEQ ID NO: 315750 - DNA, 25 bp, Homo sapien
ggacctcctcctatgagtagatgaa

SEQ ID NO: 315751 - DNA, 25 bp, Homo sapien
gctcttggtcgctgtggtgaaagtt

SEQ ID NO: 315752 - DNA, 25 bp, Homo sapien
cttggtcgctgtggtgaaagttcgt

SEQ ID NO: 315753 - DNA, 25 bp, Homo sapien
gaaagttcgtgtgtattcatcccct

SEQ ID NO: 315754 - DNA, 25 bp, Homo sapien
ttcgtgtgtattcatcccctgagaa

SEQ ID NO: 315755 - DNA, 25 bp, Homo sapien
gataacaaatccctacctatagcca

SEQ ID NO: 315756 - DNA, 25 bp, Homo sapien
aaatccctacctatagccatgtgga

SEQ ID NO: 315757 - DNA, 25 bp, Homo sapien
atagccatgtggaagcagcttgtca

SEQ ID NO: 315758 - DNA, 25 bp, Homo sapien
ggaagcagcttgtcactgtatttta

SEQ ID NO: 315759 - DNA, 25 bp, Homo sapien
agttgggtcatctttgaacacctac

SEQ ID NO: 315760 - DNA, 25 bp, Homo sapien
gaacacctaccttttatcaatgaat

SEQ ID NO: 315761 - DNA, 25 bp, Homo sapien
gaatatttttagactgttcttcagt

SEQ ID NO: 315762 - DNA, 25 bp, Homo sapien
gactgttcttcagtatctgagtcag

SEQ ID NO: 315763 - DNA, 25 bp, Homo sapien
acaccaaggtggcatcttagtctac

SEQ ID NO: 315764 - DNA, 25 bp, Homo sapien
accttcagtgagacttgcgtttcag

SEQ ID NO: 315765 - DNA, 25 bp, Homo sapien
gttatgtaaacggtctgatctgtaa

SEQ ID NO: 315766 - DNA, 25 bp, Homo sapien
ctgccggccacaagggagcagcgtc

SEQ ID NO: 315767 - DNA, 25 bp, Homo sapien
gaggcaggctccagaagcaccccga

SEQ ID NO: 315768 - DNA, 25 bp, Homo sapien
gggccttattaagtgcgagaagcct

SEQ ID NO: 315769 - DNA, 25 bp, Homo sapien
taagtgcgagaagcctctccagcga

SEQ ID NO: 315770 - DNA, 25 bp, Homo sapien
gcgagaagcctctccagcgagtctt

SEQ ID NO: 315771 - DNA, 25 bp, Homo sapien
tctccagcgagtcttccccgtgtgt

SEQ ID NO: 315772 - DNA, 25 bp, Homo sapien
cgtgtgtcctcatctgcggcaggca

SEQ ID NO: 315773 - DNA, 25 bp, Homo sapien
gtgtcctcatctgcggcaggcagga

SEQ ID NO: 315774 - DNA, 25 bp, Homo sapien
aaacaggaaattccacagctgcctc

SEQ ID NO: 315775 - DNA, 25 bp, Homo sapien
agctgcctccagaaacattaaccac

SEQ ID NO: 315776 - DNA, 25 bp, Homo sapien
gaaacattaaccacccctctctagt

SEQ ID NO: 315777 - DNA, 25 bp, Homo sapien
ggtccagggagaattcaatcacact

SEQ ID NO: 315778 - DNA, 25 bp, Homo sapien
gagaattcaatcacactctcttcct

SEQ ID NO: 315779 - DNA, 25 bp, Homo sapien
ttcctcctccttatggcccaggtta

SEQ ID NO: 315780 - DNA, 25 bp, Homo sapien
ttatggcccaggttatccacagcca

SEQ ID NO: 315781 - DNA, 25 bp, Homo sapien
cctactcttgcaccctaaatacaga

SEQ ID NO: 315782 - DNA, 25 bp, Homo sapien
cttgcaccctaaatacagacaactg

SEQ ID NO: 315783 - DNA, 25 bp, Homo sapien
acagacaactgcaacaggtgccacc

SEQ ID NO: 315784 - DNA, 25 bp, Homo sapien
tactgcttctactacccaaaaataa

SEQ ID NO: 315785 - DNA, 25 bp, Homo sapien
ataagaatttcaacactacttccaa

SEQ ID NO: 315786 - DNA, 25 bp, Homo sapien
tttcaacactacttccaagagactt

SEQ ID NO: 315787 - DNA, 25 bp, Homo sapien
actacttccaagagacttttagata

SEQ ID NO: 315788 - DNA, 25 bp, Homo sapien
gaaccaggaattgtctccaactcca

SEQ ID NO: 315789 - DNA, 25 bp, Homo sapien
caggaattgtctccaactccaggcg

SEQ ID NO: 315790 - DNA, 25 bp, Homo sapien
ggaattgtctccaactccaggcgct

SEQ ID NO: 315791 - DNA, 25 bp, Homo sapien
gtctccaactccaggcgctcaggga

SEQ ID NO: 315792 - DNA, 25 bp, Homo sapien
aggcgctcagggaatcgccttttcc

SEQ ID NO: 315793 - DNA, 25 bp, Homo sapien
tcagggaatcgccttttccggtgtc

SEQ ID NO: 315794 - DNA, 25 bp, Homo sapien
ggaatcgccttttccggtgtccagg

SEQ ID NO: 315795 - DNA, 25 bp, Homo sapien
ggtgtccaggcgctctgcagacaaa

SEQ ID NO: 315796 - DNA, 25 bp, Homo sapien
gtccaggcgctctgcagacaaataa

SEQ ID NO: 315797 - DNA, 25 bp, Homo sapien
caggcgctctgcagacaaataaaca

SEQ ID NO: 315798 - DNA, 25 bp, Homo sapien
gcgctctgcagacaaataaacagca

SEQ ID NO: 315799 - DNA, 25 bp, Homo sapien
agtaattatctttggtatattctag

SEQ ID NO: 315800 - DNA, 25 bp, Homo sapien
gaatataccagaaacactttgacaa

SEQ ID NO: 315801 - DNA, 25 bp, Homo sapien
taccagaaacactttgacaaacaca

SEQ ID NO: 315802 - DNA, 25 bp, Homo sapien
gaaacaactgggtcgtgagcatttt

SEQ ID NO: 315803 - DNA, 25 bp, Homo sapien
aactgggtcgtgagcattttagtgg

SEQ ID NO: 315804 - DNA, 25 bp, Homo sapien
gcattactggtaaataacaccagct

SEQ ID NO: 315805 - DNA, 25 bp, Homo sapien
ggattagcagatgcacatttctcaa

SEQ ID NO: 315806 - DNA, 25 bp, Homo sapien
gcagatgcacatttctcaagagaag

SEQ ID NO: 315807 - DNA, 25 bp, Homo sapien
agagaagtgaagtcagtgttatgca

SEQ ID NO: 315808 - DNA, 25 bp, Homo sapien
tcagtgttatgcaggagacagtgat

SEQ ID NO: 315809 - DNA, 25 bp, Homo sapien
gacagtgattgtcaacttaatttta

SEQ ID NO: 315810 - DNA, 25 bp, Homo sapien
tgcctacattgcctaccccaaattt

SEQ ID NO: 315811 - DNA, 25 bp, Homo sapien
ctacattgcctaccccaaattttgg

SEQ ID NO: 315812 - DNA, 25 bp, Homo sapien
cattgcctaccccaaattttggacg

SEQ ID NO: 315813 - DNA, 25 bp, Homo sapien
tgcctaccccaaattttggacgtgt

SEQ ID NO: 315814 - DNA, 25 bp, Homo sapien
ccccaaattttggacgtgtgcttgt

SEQ ID NO: 315815 - DNA, 25 bp, Homo sapien
aattttggacgtgtgcttgtgcctg

SEQ ID NO: 315816 - DNA, 25 bp, Homo sapien
tttggacgtgtgcttgtgcctgcat

SEQ ID NO: 315817 - DNA, 25 bp, Homo sapien
tggacgtgtgcttgtgcctgcattg

SEQ ID NO: 315818 - DNA, 25 bp, Homo sapien
cttgtgcctgcattgccaaagggct

SEQ ID NO: 315819 - DNA, 25 bp, Homo sapien
caggtccaaatcaaggcccaggctg

SEQ ID NO: 315820 - DNA, 25 bp, Homo sapien
ggtagagatctctgtctgccaatat

SEQ ID NO: 315821 - DNA, 25 bp, Homo sapien
aaatgtgatgacctttagcatagaa

SEQ ID NO: 315822 - DNA, 25 bp, Homo sapien
catagaaatggcttaaccttctggg

SEQ ID NO: 315823 - DNA, 25 bp, Homo sapien
gctgagctacacaaggtgcctctgt

SEQ ID NO: 315824 - DNA, 25 bp, Homo sapien
aaggtgcctctgtcaaacagctctg

SEQ ID NO: 315825 - DNA, 25 bp, Homo sapien
aacagctctgtcgaataatgctttt

SEQ ID NO: 315826 - DNA, 25 bp, Homo sapien
taatgcttttaaatgcgaccaatag

SEQ ID NO: 315827 - DNA, 25 bp, Homo sapien
gcgaccaatagatatacatgagcca

SEQ ID NO: 315828 - DNA, 25 bp, Homo sapien
gaggcagctggtgctaatctgattc

SEQ ID NO: 315829 - DNA, 25 bp, Homo sapien
aatctgattcagtactttaataggg

SEQ ID NO: 315830 - DNA, 25 bp, Homo sapien
gtgattcaattccagatctctctta

SEQ ID NO: 315831 - DNA, 25 bp, Homo sapien
gatctctcttactccagagccagta

SEQ ID NO: 315832 - DNA, 25 bp, Homo sapien
gccagacacccgacaggtggtgcca

SEQ ID NO: 315833 - DNA, 25 bp, Homo sapien
ttggatgtagcctgtgagctggacc

SEQ ID NO: 315834 - DNA, 25 bp, Homo sapien
tggaccggggactgcagctccagaa

SEQ ID NO: 315835 - DNA, 25 bp, Homo sapien
tgcagctccagaagcatgatgtcat

SEQ ID NO: 315836 - DNA, 25 bp, Homo sapien
gcatgatgtcatggtcgtggttcag

SEQ ID NO: 315837 - DNA, 25 bp, Homo sapien
atgatgtcatggtcgtggttcaggt

SEQ ID NO: 315838 - DNA, 25 bp, Homo sapien
tcatggtcgtggttcaggtgggtgg

SEQ ID NO: 315839 - DNA, 25 bp, Homo sapien
ggatagagtggacaacttccctcac

SEQ ID NO: 315840 - DNA, 25 bp, Homo sapien
tagagtggacaacttccctcacctg

SEQ ID NO: 315841 - DNA, 25 bp, Homo sapien
gagtggacaacttccctcacctgct

SEQ ID NO: 315842 - DNA, 25 bp, Homo sapien
acgccctagggcgtgcttgcctagg

SEQ ID NO: 315843 - DNA, 25 bp, Homo sapien
tcacccctggttctcatctttcttg

SEQ ID NO: 315844 - DNA, 25 bp, Homo sapien
atctttcttgatcaacatcttttct

SEQ ID NO: 315845 - DNA, 25 bp, Homo sapien
tcttgatcaacatcttttcttgcct

SEQ ID NO: 315846 - DNA, 25 bp, Homo sapien
gatcaacatcttttcttgcctctgt

SEQ ID NO: 315847 - DNA, 25 bp, Homo sapien
aagccacaggcctgagatttcatct

SEQ ID NO: 315848 - DNA, 25 bp, Homo sapien
agccacaggcctgagatttcatctg

SEQ ID NO: 315849 - DNA, 25 bp, Homo sapien
gccacaggcctgagatttcatctgc

SEQ ID NO: 315850 - DNA, 25 bp, Homo sapien
acaggcctgagatttcatctgctct

SEQ ID NO: 315851 - DNA, 25 bp, Homo sapien
gcctgagatttcatctgctctcctt

SEQ ID NO: 315852 - DNA, 25 bp, Homo sapien
tgctctccttcctggagcccagagg

SEQ ID NO: 315853 - DNA, 25 bp, Homo sapien
attttatctttgattctccttcagc

SEQ ID NO: 315854 - DNA, 25 bp, Homo sapien
agcgatgaaggtgaacgcgctcccc

SEQ ID NO: 315855 - DNA, 25 bp, Homo sapien
gctgtcgctgggaagccccactctg

SEQ ID NO: 315856 - DNA, 25 bp, Homo sapien
aggtctggttcctggagcatcagcg

SEQ ID NO: 315857 - DNA, 25 bp, Homo sapien
tctggttcctggagcatcagcgccc

SEQ ID NO: 315858 - DNA, 25 bp, Homo sapien
ggcaggatcgtttcctcccgacact

SEQ ID NO: 315859 - DNA, 25 bp, Homo sapien
gcctctcgccttgggcgcagggttt

SEQ ID NO: 315860 - DNA, 25 bp, Homo sapien
gggctcagctgtcaattccaaggaa

SEQ ID NO: 315861 - DNA, 25 bp, Homo sapien
gctcagctgtcaattccaaggaatt

SEQ ID NO: 315862 - DNA, 25 bp, Homo sapien
gaattcgtagggttcgacccacgcg

SEQ ID NO: 315863 - DNA, 25 bp, Homo sapien
ttcgtagggttcgacccacgcggcg

SEQ ID NO: 315864 - DNA, 25 bp, Homo sapien
gaaggatgaaggatgacccccaacc

SEQ ID NO: 315865 - DNA, 25 bp, Homo sapien
aagcagtaaaataattgggtcaata

SEQ ID NO: 315866 - DNA, 25 bp, Homo sapien
atttctaatacggatcaaaggcacc

SEQ ID NO: 315867 - DNA, 25 bp, Homo sapien
atacggatcaaaggcaccaaaaagg

SEQ ID NO: 315868 - DNA, 25 bp, Homo sapien
accaaaaaggtgagctgtgagtaag

SEQ ID NO: 315869 - DNA, 25 bp, Homo sapien
tgagctgtgagtaagatattcagac

SEQ ID NO: 315870 - DNA, 25 bp, Homo sapien
gcaccgtcccaagcagtagccacag

SEQ ID NO: 315871 - DNA, 25 bp, Homo sapien
gcagctacggaatgatgccatcacc

SEQ ID NO: 315872 - DNA, 25 bp, Homo sapien
gctacggaatgatgccatcaccgga

SEQ ID NO: 315873 - DNA, 25 bp, Homo sapien
atgatgccatcaccggaaagttcca

SEQ ID NO: 315874 - DNA, 25 bp, Homo sapien
gccatcaccggaaagttccatcagc

SEQ ID NO: 315875 - DNA, 25 bp, Homo sapien
cacgctggacagcacctgtttgata

SEQ ID NO: 315876 - DNA, 25 bp, Homo sapien
gaatgtatcagctcaccactacaac

SEQ ID NO: 315877 - DNA, 25 bp, Homo sapien
atcagctcaccactacaacagatta

SEQ ID NO: 315878 - DNA, 25 bp, Homo sapien
ctacaacagattaagtcacagatga

SEQ ID NO: 315879 - DNA, 25 bp, Homo sapien
gggagccactgtcaagtcacagaac

SEQ ID NO: 315880 - DNA, 25 bp, Homo sapien
gtcaagtcacagaacagccgtccag

SEQ ID NO: 315881 - DNA, 25 bp, Homo sapien
aacagccgtccaggcaggcttggaa

SEQ ID NO: 315882 - DNA, 25 bp, Homo sapien
ctctcaggacgggatggacttgcct

SEQ ID NO: 315883 - DNA, 25 bp, Homo sapien
aggacgggatggacttgcctgaccc

SEQ ID NO: 315884 - DNA, 25 bp, Homo sapien
gatggacttgcctgacccgatcggc

SEQ ID NO: 315885 - DNA, 25 bp, Homo sapien
tgacccgatcggcatggctgacgct

SEQ ID NO: 315886 - DNA, 25 bp, Homo sapien
tcggcatggctgacgctcctcaggg

SEQ ID NO: 315887 - DNA, 25 bp, Homo sapien
tgaaccacgaccatgacatcatgct

SEQ ID NO: 315888 - DNA, 25 bp, Homo sapien
acgaccatgacatcatgcttctgga

SEQ ID NO: 315889 - DNA, 25 bp, Homo sapien
atgacatcatgcttctggagctgca

SEQ ID NO: 315890 - DNA, 25 bp, Homo sapien
gacatcatgcttctggagctgcagt

SEQ ID NO: 315891 - DNA, 25 bp, Homo sapien
tggagctgcagtccccggtccagct

SEQ ID NO: 315892 - DNA, 25 bp, Homo sapien
ggtccagctcacaggctacatccaa

SEQ ID NO: 315893 - DNA, 25 bp, Homo sapien
tggcaccacctgtcgggtgtctggc

SEQ ID NO: 315894 - DNA, 25 bp, Homo sapien
ccagggtatgcacccacacaggtgg

SEQ ID NO: 315895 - DNA, 25 bp, Homo sapien
acaggtggcctgaggccccatagga

SEQ ID NO: 315896 - DNA, 25 bp, Homo sapien
cctgaggccccataggagtggctgg

SEQ ID NO: 315897 - DNA, 25 bp, Homo sapien
gaaggtctgaggtaggttcctttat

SEQ ID NO: 315898 - DNA, 25 bp, Homo sapien
tgaaccacgaccatgacatcatgct

SEQ ID NO: 315899 - DNA, 25 bp, Homo sapien
accacgaccatgacatcatgcttct

SEQ ID NO: 315900 - DNA, 25 bp, Homo sapien
acgaccatgacatcatgcttctgga

SEQ ID NO: 315901 - DNA, 25 bp, Homo sapien
gaccatgacatcatgcttctggagc

SEQ ID NO: 315902 - DNA, 25 bp, Homo sapien
ccatgacatcatgcttctggagctg

SEQ ID NO: 315903 - DNA, 25 bp, Homo sapien
atgacatcatgcttctggagctgca

SEQ ID NO: 315904 - DNA, 25 bp, Homo sapien
gacatcatgcttctggagctgcagt

SEQ ID NO: 315905 - DNA, 25 bp, Homo sapien
ggtccagctcacaggctacatccaa

SEQ ID NO: 315906 - DNA, 25 bp, Homo sapien
agctcacaggctacatccaaaccct

SEQ ID NO: 315907 - DNA, 25 bp, Homo sapien
tggcaccacctgtcgggtgtctggc

SEQ ID NO: 315908 - DNA, 25 bp, Homo sapien
accacctgtcgggtgtctggctggg

SEQ ID NO: 315909 - DNA, 25 bp, Homo sapien
tagtctgtccaggagctctaccaac

SEQ ID NO: 315910 - DNA, 25 bp, Homo sapien
ggagctctaccaactagcatgtttg

SEQ ID NO: 315911 - DNA, 25 bp, Homo sapien
aaaacctacactgttcttgttagca

SEQ ID NO: 315912 - DNA, 25 bp, Homo sapien
agatctttctgagtttctcttctca

SEQ ID NO: 315913 - DNA, 25 bp, Homo sapien
aaattgtatcctgcagtagcctcaa

SEQ ID NO: 315914 - DNA, 25 bp, Homo sapien
gcagtagcctcaatttaccctttga

SEQ ID NO: 315915 - DNA, 25 bp, Homo sapien
atctgaaacacaattctccccggat

SEQ ID NO: 315916 - DNA, 25 bp, Homo sapien
tccccggatcagtaatgctccatat

SEQ ID NO: 315917 - DNA, 25 bp, Homo sapien
atgctccatatatgtccacttcatg

SEQ ID NO: 315918 - DNA, 25 bp, Homo sapien
atgtccacttcatgcatgtctacaa

SEQ ID NO: 315919 - DNA, 25 bp, Homo sapien
ttcatgcatgtctacaatcccattc

SEQ ID NO: 315920 - DNA, 25 bp, Homo sapien
ccaacctaagcttctgccaataagg

SEQ ID NO: 315921 - DNA, 25 bp, Homo sapien
aacctaagcttctgccaataaggat

SEQ ID NO: 315922 - DNA, 25 bp, Homo sapien
taagcttctgccaataaggatttca

SEQ ID NO: 315923 - DNA, 25 bp, Homo sapien
ataaggatttcagataagcttttaa

SEQ ID NO: 315924 - DNA, 25 bp, Homo sapien
ttttatagtctactttaaataacag

SEQ ID NO: 315925 - DNA, 25 bp, Homo sapien
caaaggctgtacaagatttagtgtc

SEQ ID NO: 315926 - DNA, 25 bp, Homo sapien
aggctgtacaagatttagtgtcatt

SEQ ID NO: 315927 - DNA, 25 bp, Homo sapien
tagtgtcattgggtctcatatttgt

SEQ ID NO: 315928 - DNA, 25 bp, Homo sapien
gtgtcattgggtctcatatttgtgt

SEQ ID NO: 315929 - DNA, 25 bp, Homo sapien
gtcattgggtctcatatttgtgtta

SEQ ID NO: 315930 - DNA, 25 bp, Homo sapien
tcattgggtctcatatttgtgttag

SEQ ID NO: 315931 - DNA, 25 bp, Homo sapien
catatttgtacagtgatcggcttca

SEQ ID NO: 315932 - DNA, 25 bp, Homo sapien
atttgtacagtgatcggcttcagtg

SEQ ID NO: 315933 - DNA, 25 bp, Homo sapien
ttgtacagtgatcggcttcagtgat

SEQ ID NO: 315934 - DNA, 25 bp, Homo sapien
catagttatactacagtcctttttt

SEQ ID NO: 315935 - DNA, 25 bp, Homo sapien
tgtatcctgatacattgtaaaatat

SEQ ID NO: 315936 - DNA, 25 bp, Homo sapien
atgttggataaggagatatttttca

SEQ ID NO: 315937 - DNA, 25 bp, Homo sapien
ctgttaacttttagcccatgcattt

SEQ ID NO: 315938 - DNA, 25 bp, Homo sapien
taacttttagcccatgcattttcat

SEQ ID NO: 315939 - DNA, 25 bp, Homo sapien
acttttagcccatgcattttcataa

SEQ ID NO: 315940 - DNA, 25 bp, Homo sapien
gattatttaacacttgatgtgatct

SEQ ID NO: 315941 - DNA, 25 bp, Homo sapien
aagttgcacaaccctcctgctgaag

SEQ ID NO: 315942 - DNA, 25 bp, Homo sapien
aaatgagttgcaatgctccagccta

SEQ ID NO: 315943 - DNA, 25 bp, Homo sapien
agttgcaatgctccagcctaaccaa

SEQ ID NO: 315944 - DNA, 25 bp, Homo sapien
ttttgttaatccaatcccagaaggt

SEQ ID NO: 315945 - DNA, 25 bp, Homo sapien
tactgggtagggtcagttaacagac

SEQ ID NO: 315946 - DNA, 25 bp, Homo sapien
gtcagttaacagacagctgcctgtc

SEQ ID NO: 315947 - DNA, 25 bp, Homo sapien
agagtctgaccaagccccagtgggc

SEQ ID NO: 315948 - DNA, 25 bp, Homo sapien
gggatggaccccactggagcttgtc

SEQ ID NO: 315949 - DNA, 25 bp, Homo sapien
agtgggcgcttctcttcctaagtcc

SEQ ID NO: 315950 - DNA, 25 bp, Homo sapien
ttctcttcctaagtcctctggtgta

SEQ ID NO: 315951 - DNA, 25 bp, Homo sapien
tggtgtaccccattcttcaagggaa

SEQ ID NO: 315952 - DNA, 25 bp, Homo sapien
ggagcttgtctcatgctggcagcaa

SEQ ID NO: 315953 - DNA, 25 bp, Homo sapien
aaggagcagcggacccagcagaata

SEQ ID NO: 315954 - DNA, 25 bp, Homo sapien
cggacccagcagaatatggcccaaa

SEQ ID NO: 315955 - DNA, 25 bp, Homo sapien
tggcccaaaaaggaggcaggtctcc

SEQ ID NO: 315956 - DNA, 25 bp, Homo sapien
aaaggaggcaggtctcctgttgcaa

SEQ ID NO: 315957 - DNA, 25 bp, Homo sapien
ggcaggtctcctgttgcaagagcct

SEQ ID NO: 315958 - DNA, 25 bp, Homo sapien
aggtctcctgttgcaagagcctctg

SEQ ID NO: 315959 - DNA, 25 bp, Homo sapien
tcctgttgcaagagcctctgttttt

SEQ ID NO: 315960 - DNA, 25 bp, Homo sapien
gtaatgtccaaaagtatctttccat

SEQ ID NO: 315961 - DNA, 25 bp, Homo sapien
gtgagtttttgttaagcttatagga

SEQ ID NO: 315962 - DNA, 25 bp, Homo sapien
aagcttataggaatgggccagttaa

SEQ ID NO: 315963 - DNA, 25 bp, Homo sapien
atgggccagttaactaaggtagaca

SEQ ID NO: 315964 - DNA, 25 bp, Homo sapien
tggcagcagagtttccatgggaaca

SEQ ID NO: 315965 - DNA, 25 bp, Homo sapien
atgggaacatgtgctggttctgcgc

SEQ ID NO: 315966 - DNA, 25 bp, Homo sapien
gttctgcgctgaacccggtgtggct

SEQ ID NO: 315967 - DNA, 25 bp, Homo sapien
tcccttcacagccaatattgcagga

SEQ ID NO: 315968 - DNA, 25 bp, Homo sapien
agccaatattgcaggaactgagcct

SEQ ID NO: 315969 - DNA, 25 bp, Homo sapien
tcggccagggtaggcagtgctcttt

SEQ ID NO: 315970 - DNA, 25 bp, Homo sapien
taggcagtgctctttggccacccag

SEQ ID NO: 315971 - DNA, 25 bp, Homo sapien
agtgtcacaaacctgaactcaagtt

SEQ ID NO: 315972 - DNA, 25 bp, Homo sapien
tgaactcaagttacaggcaaaacct

SEQ ID NO: 315973 - DNA, 25 bp, Homo sapien
ttctaatgtaaagtccatgctccat

SEQ ID NO: 315974 - DNA, 25 bp, Homo sapien
atgctccattctaaagatgcctctg

SEQ ID NO: 315975 - DNA, 25 bp, Homo sapien
gagcagggtcataatcacacagcag

SEQ ID NO: 315976 - DNA, 25 bp, Homo sapien
aatgtttgcatgtttcagttttcaa

SEQ ID NO: 315977 - DNA, 25 bp, Homo sapien
ttcagttttcaagaaccaaatgagt

SEQ ID NO: 315978 - DNA, 25 bp, Homo sapien
attagctatagattccactggcctt

SEQ ID NO: 315979 - DNA, 25 bp, Homo sapien
gattccactggccttaaacatacaa

SEQ ID NO: 315980 - DNA, 25 bp, Homo sapien
gtatacatgatatagtgcacacaca

SEQ ID NO: 315981 - DNA, 25 bp, Homo sapien
gtgcacacacaaaagccacctttaa

SEQ ID NO: 315982 - DNA, 25 bp, Homo sapien
gcagtgccttatatagttgccataa

SEQ ID NO: 315983 - DNA, 25 bp, Homo sapien
tatagttgccataagacttcagtgc

SEQ ID NO: 315984 - DNA, 25 bp, Homo sapien
ttgccataagacttcagtgcagtac

SEQ ID NO: 315985 - DNA, 25 bp, Homo sapien
atcagggcatattctatatggtgta

SEQ ID NO: 315986 - DNA, 25 bp, Homo sapien
aaaacactcacccatcaacgaatat

SEQ ID NO: 315987 - DNA, 25 bp, Homo sapien
acactcacccatcaacgaatataga

SEQ ID NO: 315988 - DNA, 25 bp, Homo sapien
caacgaatatagactcttctctcat

SEQ ID NO: 315989 - DNA, 25 bp, Homo sapien
agactcttctctcatttatcgatga

SEQ ID NO: 315990 - DNA, 25 bp, Homo sapien
ttctctcatttatcgatgatcctct

SEQ ID NO: 315991 - DNA, 25 bp, Homo sapien
atttatcgatgatcctctttttcca

SEQ ID NO: 315992 - DNA, 25 bp, Homo sapien
ttatcgatgatcctctttttccatt

SEQ ID NO: 315993 - DNA, 25 bp, Homo sapien
ttccattttttaagtacttatgtgg

SEQ ID NO: 315994 - DNA, 25 bp, Homo sapien
acttatgtggaagctagtctcccaa

SEQ ID NO: 315995 - DNA, 25 bp, Homo sapien
agctagtctcccaaaacacaatctt

SEQ ID NO: 315996 - DNA, 25 bp, Homo sapien
ctagtctcccaaaacacaatcttta

SEQ ID NO: 315997 - DNA, 25 bp, Homo sapien
actctgatgtccagaggccaacctt

SEQ ID NO: 315998 - DNA, 25 bp, Homo sapien
acttctgctactgggtgagccaagt

SEQ ID NO: 315999 - DNA, 25 bp, Homo sapien
aggtccattgatatgtggctttagc

SEQ ID NO: 316000 - DNA, 25 bp, Homo sapien
atgtggctttagctcattgaggtta

SEQ ID NO: 316001 - DNA, 25 bp, Homo sapien
ttcaatcacttggtcatactggcag

SEQ ID NO: 316002 - DNA, 25 bp, Homo sapien
tcacttggtcatactggcagccagg

SEQ ID NO: 316003 - DNA, 25 bp, Homo sapien
cagggtcaggcactaggtgatcctt

SEQ ID NO: 316004 - DNA, 25 bp, Homo sapien
ggtgatccttgaattcttcacgtag

SEQ ID NO: 316005 - DNA, 25 bp, Homo sapien
gaattcttcacgtagactggcaatg

SEQ ID NO: 316006 - DNA, 25 bp, Homo sapien
tagactggcaatgtctgctcggcca

SEQ ID NO: 316007 - DNA, 25 bp, Homo sapien
tgctcggccagtcttgctcaggtac

SEQ ID NO: 316008 - DNA, 25 bp, Homo sapien
ccaacctaagcttctgccaataagg

SEQ ID NO: 316009 - DNA, 25 bp, Homo sapien
aacctaagcttctgccaataaggat

SEQ ID NO: 316010 - DNA, 25 bp, Homo sapien
taagcttctgccaataaggatttca

SEQ ID NO: 316011 - DNA, 25 bp, Homo sapien
ataaggatttcagataagcttttaa

SEQ ID NO: 316012 - DNA, 25 bp, Homo sapien
tatggaggattttctttgtgtcttt

SEQ ID NO: 316013 - DNA, 25 bp, Homo sapien
ttgtgtctttggaagttcacttacc

SEQ ID NO: 316014 - DNA, 25 bp, Homo sapien
caaaggctgtacaagatttagtgtc

SEQ ID NO: 316015 - DNA, 25 bp, Homo sapien
aggctgtacaagatttagtgtcatt

SEQ ID NO: 316016 - DNA, 25 bp, Homo sapien
tagtgtcattgggtctcatatttgt

SEQ ID NO: 316017 - DNA, 25 bp, Homo sapien
gtgtcattgggtctcatatttgtgt

SEQ ID NO: 316018 - DNA, 25 bp, Homo sapien
tcattgggtctcatatttgtgttag

SEQ ID NO: 316019 - DNA, 25 bp, Homo sapien
atgttgctgaggattgcgaactccc

SEQ ID NO: 316020 - DNA, 25 bp, Homo sapien
tgaggattgcgaactcccgcagcat

SEQ ID NO: 316021 - DNA, 25 bp, Homo sapien
gaactcccgcagcatatttatactg

SEQ ID NO: 316022 - DNA, 25 bp, Homo sapien
atttatactgtggaacggtgcggac

SEQ ID NO: 316023 - DNA, 25 bp, Homo sapien
gccagcagataccagggtgataata

SEQ ID NO: 316024 - DNA, 25 bp, Homo sapien
accagggtgataatatttacgtgaa

SEQ ID NO: 316025 - DNA, 25 bp, Homo sapien
ccatttggtacaatctgaagtgcaa

SEQ ID NO: 316026 - DNA, 25 bp, Homo sapien
gtacaatctgaagtgcaaagggtat

SEQ ID NO: 316027 - DNA, 25 bp, Homo sapien
ccccgaagaagccagtaaagcaggt

SEQ ID NO: 316028 - DNA, 25 bp, Homo sapien
aagccagtaaagcaggtacagaatt

SEQ ID NO: 316029 - DNA, 25 bp, Homo sapien
aggtacagaattgaacggtagaact

SEQ ID NO: 316030 - DNA, 25 bp, Homo sapien
ggaattgtttgtatgaaaaccaatc

SEQ ID NO: 316031 - DNA, 25 bp, Homo sapien
gaattgtttgtatgaaaaccaatct

SEQ ID NO: 316032 - DNA, 25 bp, Homo sapien
tgtatgaaaaccaatcttcggcggg

SEQ ID NO: 316033 - DNA, 25 bp, Homo sapien
gtatgaaaaccaatcttcggcgggg

SEQ ID NO: 316034 - DNA, 25 bp, Homo sapien
tatgaaaaccaatcttcggcggggc

SEQ ID NO: 316035 - DNA, 25 bp, Homo sapien
atgaaaaccaatcttcggcggggcg

SEQ ID NO: 316036 - DNA, 25 bp, Homo sapien
tgaaaaccaatcttcggcggggcgt

SEQ ID NO: 316037 - DNA, 25 bp, Homo sapien
gaaaaccaatcttcggcggggcgtg

SEQ ID NO: 316038 - DNA, 25 bp, Homo sapien
aaaccaatcttcggcggggcgtgat

SEQ ID NO: 316039 - DNA, 25 bp, Homo sapien
aaccaatcttcggcggggcgtgatg

SEQ ID NO: 316040 - DNA, 25 bp, Homo sapien
aatcttcggcggggcgtgatggctc

SEQ ID NO: 316041 - DNA, 25 bp, Homo sapien
cccagctgcccttatagttaaggtc

SEQ ID NO: 316042 - DNA, 25 bp, Homo sapien
cttatagttaaggtctggccagtga

SEQ ID NO: 316043 - DNA, 25 bp, Homo sapien
aggtctggccagtgaaatgtatgtg

SEQ ID NO: 316044 - DNA, 25 bp, Homo sapien
ggaaatgttacatgacacttctaga

SEQ ID NO: 316045 - DNA, 25 bp, Homo sapien
ccccttcctatttcctggaatgtgg

SEQ ID NO: 316046 - DNA, 25 bp, Homo sapien
ctatttcctggaatgtgggtgtgat

SEQ ID NO: 316047 - DNA, 25 bp, Homo sapien
tggagccctggcagccatactgcca

SEQ ID NO: 316048 - DNA, 25 bp, Homo sapien
agccatactgccacgtgtacagacg

SEQ ID NO: 316049 - DNA, 25 bp, Homo sapien
tgccacgtgtacagacgagtgccgt

SEQ ID NO: 316050 - DNA, 25 bp, Homo sapien
agacgagtgccgtcctttagggatg

SEQ ID NO: 316051 - DNA, 25 bp, Homo sapien
ttaaaatacaacacttcccagctgc

SEQ ID NO: 316052 - DNA, 25 bp, Homo sapien
atttcacaatatttaccctgcgcca

SEQ ID NO: 316053 - DNA, 25 bp, Homo sapien
tcacaatatttaccctgcgccaggt

SEQ ID NO: 316054 - DNA, 25 bp, Homo sapien
aatatttaccctgcgccaggtactg

SEQ ID NO: 316055 - DNA, 25 bp, Homo sapien
tttaccctgcgccaggtactgttct

SEQ ID NO: 316056 - DNA, 25 bp, Homo sapien
aattagcagaattggtgttgggccc

SEQ ID NO: 316057 - DNA, 25 bp, Homo sapien
agcagaattggtgttgggccctgaa

SEQ ID NO: 316058 - DNA, 25 bp, Homo sapien
ttgggccctgaaaaattagtccgat

SEQ ID NO: 316059 - DNA, 25 bp, Homo sapien
gtgggagtacagagccaaaccagat

SEQ ID NO: 316060 - DNA, 25 bp, Homo sapien
agtacagagccaaaccagatcaccc

SEQ ID NO: 316061 - DNA, 25 bp, Homo sapien
tcctgcaccaggcatccttgaaagg

SEQ ID NO: 316062 - DNA, 25 bp, Homo sapien
cctgcaccaggcatccttgaaaggg

SEQ ID NO: 316063 - DNA, 25 bp, Homo sapien
atattactttataatagtcagctgg

SEQ ID NO: 316064 - DNA, 25 bp, Homo sapien
cttaaccttcaaaacaatgtcagtg

SEQ ID NO: 316065 - DNA, 25 bp, Homo sapien
atgtcagtgttgtcacctgtgcatt

SEQ ID NO: 316066 - DNA, 25 bp, Homo sapien
ttgtcacctgtgcatttgatagcca

SEQ ID NO: 316067 - DNA, 25 bp, Homo sapien
gcatttgatagccacagcacaagta

SEQ ID NO: 316068 - DNA, 25 bp, Homo sapien
gatagccacagcacaagtattcttc

SEQ ID NO: 316069 - DNA, 25 bp, Homo sapien
gcacaagtattcttcaggagcataa

SEQ ID NO: 316070 - DNA, 25 bp, Homo sapien
aggagcataaatcctccagccttga

SEQ ID NO: 316071 - DNA, 25 bp, Homo sapien
gcataaatcctccagccttgaatgg

SEQ ID NO: 316072 - DNA, 25 bp, Homo sapien
gccttgaatggaccattgtccagct

SEQ ID NO: 316073 - DNA, 25 bp, Homo sapien
gtccagctcctgtgaaaaacttaat

SEQ ID NO: 316074 - DNA, 25 bp, Homo sapien
gttcttaaagaaatgaatctaggcc

SEQ ID NO: 316075 - DNA, 25 bp, Homo sapien
ttcttaaagaaatgaatctaggccg

SEQ ID NO: 316076 - DNA, 25 bp, Homo sapien
tcttaaagaaatgaatctaggccgg

SEQ ID NO: 316077 - DNA, 25 bp, Homo sapien
cttaaagaaatgaatctaggccggg

SEQ ID NO: 316078 - DNA, 25 bp, Homo sapien
ttaaagaaatgaatctaggccgggc

SEQ ID NO: 316079 - DNA, 25 bp, Homo sapien
taaagaaatgaatctaggccgggca

SEQ ID NO: 316080 - DNA, 25 bp, Homo sapien
aagaaatgaatctaggccgggcacg

SEQ ID NO: 316081 - DNA, 25 bp, Homo sapien
agaaatgaatctaggccgggcacgg

SEQ ID NO: 316082 - DNA, 25 bp, Homo sapien
gaaatgaatctaggccgggcacggt

SEQ ID NO: 316083 - DNA, 25 bp, Homo sapien
aaatgaatctaggccgggcacggtg

SEQ ID NO: 316084 - DNA, 25 bp, Homo sapien
gaggtggtcggatcacgaggttagg

SEQ ID NO: 316085 - DNA, 25 bp, Homo sapien
atttcacaatatttaccctgcgcca

SEQ ID NO: 316086 - DNA, 25 bp, Homo sapien
ttcacaatatttaccctgcgccagg

SEQ ID NO: 316087 - DNA, 25 bp, Homo sapien
acaatatttaccctgcgccaggtac

SEQ ID NO: 316088 - DNA, 25 bp, Homo sapien
aatatttaccctgcgccaggtactg

SEQ ID NO: 316089 - DNA, 25 bp, Homo sapien
tttaccctgcgccaggtactgttct

SEQ ID NO: 316090 - DNA, 25 bp, Homo sapien
aattagcagaattggtgttgggccc

SEQ ID NO: 316091 - DNA, 25 bp, Homo sapien
agcagaattggtgttgggccctgaa

SEQ ID NO: 316092 - DNA, 25 bp, Homo sapien
gtgggagtacagagccaaaccagat

SEQ ID NO: 316093 - DNA, 25 bp, Homo sapien
agagccaaaccagatcacccctctt

SEQ ID NO: 316094 - DNA, 25 bp, Homo sapien
tcctgcaccaggcatccttgaaagg

SEQ ID NO: 316095 - DNA, 25 bp, Homo sapien
cctgcaccaggcatccttgaaaggg

SEQ ID NO: 316096 - DNA, 25 bp, Homo sapien
tctgggcctgaaaggctgcaccgcc

SEQ ID NO: 316097 - DNA, 25 bp, Homo sapien
ctgcgtgaggccaccggacaggact

SEQ ID NO: 316098 - DNA, 25 bp, Homo sapien
accggacaggactgtgaggatcaca

SEQ ID NO: 316099 - DNA, 25 bp, Homo sapien
tgtgaggatcacagtcggtgaagca

SEQ ID NO: 316100 - DNA, 25 bp, Homo sapien
tcacagtcggtgaagcagagtgctt

SEQ ID NO: 316101 - DNA, 25 bp, Homo sapien
aagcagagtgctttgtaaacctcag

SEQ ID NO: 316102 - DNA, 25 bp, Homo sapien
agtgctttgtaaacctcagagtgcg

SEQ ID NO: 316103 - DNA, 25 bp, Homo sapien
gtaaacctcagagtgcggtactcgt

SEQ ID NO: 316104 - DNA, 25 bp, Homo sapien
ctcagagtgcggtactcgtggtgct

SEQ ID NO: 316105 - DNA, 25 bp, Homo sapien
tcgtggtgctggagccgagaaacca

SEQ ID NO: 316106 - DNA, 25 bp, Homo sapien
gcagctgctgagagccgactgtgaa

SEQ ID NO: 316107 - DNA, 25 bp, Homo sapien
ctgggaatcagtcactgtgctatcc

SEQ ID NO: 316108 - DNA, 25 bp, Homo sapien
gtcttgtggcccaactaccagagaa

SEQ ID NO: 316109 - DNA, 25 bp, Homo sapien
tcttgtggcccaactaccagagaac

SEQ ID NO: 316110 - DNA, 25 bp, Homo sapien
cttgtggcccaactaccagagaacg

SEQ ID NO: 316111 - DNA, 25 bp, Homo sapien
ttgtggcccaactaccagagaacgc

SEQ ID NO: 316112 - DNA, 25 bp, Homo sapien
tgtggcccaactaccagagaacgct

SEQ ID NO: 316113 - DNA, 25 bp, Homo sapien
gtggcccaactaccagagaacgctg

SEQ ID NO: 316114 - DNA, 25 bp, Homo sapien
tggcccaactaccagagaacgctgt

SEQ ID NO: 316115 - DNA, 25 bp, Homo sapien
ggcccaactaccagagaacgctgtc

SEQ ID NO: 316116 - DNA, 25 bp, Homo sapien
ccaactaccagagaacgctgtcccc

SEQ ID NO: 316117 - DNA, 25 bp, Homo sapien
accagagaacgctgtcccccgacat

SEQ ID NO: 316118 - DNA, 25 bp, Homo sapien
ttcttccgggctccaaaactaacat

SEQ ID NO: 316119 - DNA, 25 bp, Homo sapien
tccgggctccaaaactaacatatga

SEQ ID NO: 316120 - DNA, 25 bp, Homo sapien
aacatatgagtagatttctccaggt

SEQ ID NO: 316121 - DNA, 25 bp, Homo sapien
gagtagatttctccaggtagacaag

SEQ ID NO: 316122 - DNA, 25 bp, Homo sapien
ccaggtagacaagagtgaggtaaac

SEQ ID NO: 316123 - DNA, 25 bp, Homo sapien
taaacccccaagaatcaggaactag

SEQ ID NO: 316124 - DNA, 25 bp, Homo sapien
aatcaggaactagagccaagtaaag

SEQ ID NO: 316125 - DNA, 25 bp, Homo sapien
gaataagccccgagaagctttgagt

SEQ ID NO: 316126 - DNA, 25 bp, Homo sapien
taagccccgagaagctttgagtaaa

SEQ ID NO: 316127 - DNA, 25 bp, Homo sapien
aaggatactgtttgcacattgcgta

SEQ ID NO: 316128 - DNA, 25 bp, Homo sapien
actgtttgcacattgcgtattggaa

SEQ ID NO: 316129 - DNA, 25 bp, Homo sapien
tcgtggcccaagaagtagccccgtg

SEQ ID NO: 316130 - DNA, 25 bp, Homo sapien
ctcacacccaggagcatttgatagc

SEQ ID NO: 316131 - DNA, 25 bp, Homo sapien
aggagcatttgatagcttgcccacc

SEQ ID NO: 316132 - DNA, 25 bp, Homo sapien
atttgatagcttgcccacccctgtt

SEQ ID NO: 316133 - DNA, 25 bp, Homo sapien
atgccagcggcacgtttcattatgg

SEQ ID NO: 316134 - DNA, 25 bp, Homo sapien
ggcacgtttcattatggtttcccac

SEQ ID NO: 316135 - DNA, 25 bp, Homo sapien
gtttcattatggtttcccacatcca

SEQ ID NO: 316136 - DNA, 25 bp, Homo sapien
attatggtttcccacatccaaacct

SEQ ID NO: 316137 - DNA, 25 bp, Homo sapien
atccaaacctcatagcaaatgtaat

SEQ ID NO: 316138 - DNA, 25 bp, Homo sapien
taataggtagtctagccagcaacac

SEQ ID NO: 316139 - DNA, 25 bp, Homo sapien
gtctagccagcaacactaagtatta

SEQ ID NO: 316140 - DNA, 25 bp, Homo sapien
aaagattacacagttcttctggact

SEQ ID NO: 316141 - DNA, 25 bp, Homo sapien
tcttctggactgttaaattgtgcat

SEQ ID NO: 316142 - DNA, 25 bp, Homo sapien
aattgtgcatggttttggacccctt

SEQ ID NO: 316143 - DNA, 25 bp, Homo sapien
tgcatggttttggaccccttctgct

SEQ ID NO: 316144 - DNA, 25 bp, Homo sapien
cccttctgctctactacagagagtg

SEQ ID NO: 316145 - DNA, 25 bp, Homo sapien
aaagctcactttaccattccatata

SEQ ID NO: 316146 - DNA, 25 bp, Homo sapien
actttaccattccatatacttacta

SEQ ID NO: 316147 - DNA, 25 bp, Homo sapien
gaaaaccttatgaggcatcactagc

SEQ ID NO: 316148 - DNA, 25 bp, Homo sapien
gcatcactagccactgttaatatct

SEQ ID NO: 316149 - DNA, 25 bp, Homo sapien
ttgtattcttataccttttcaatat

SEQ ID NO: 316150 - DNA, 25 bp, Homo sapien
gaacaaatatagtttctggcactat

SEQ ID NO: 316151 - DNA, 25 bp, Homo sapien
tgcagacccagataaaaccgttact

SEQ ID NO: 316152 - DNA, 25 bp, Homo sapien
aatggtttctttgtcctacggctcg

SEQ ID NO: 316153 - DNA, 25 bp, Homo sapien
gacgccctgggtggtgatatcttct

SEQ ID NO: 316154 - DNA, 25 bp, Homo sapien
gtgatatcttctctgaaaccgggcc

SEQ ID NO: 316155 - DNA, 25 bp, Homo sapien
gtgtggcttccgaacgcaatggcgc

SEQ ID NO: 316156 - DNA, 25 bp, Homo sapien
acgcaatggcgccatttcatcgagg

SEQ ID NO: 316157 - DNA, 25 bp, Homo sapien
aggctgagcgcctttaatgaggtgc

SEQ ID NO: 316158 - DNA, 25 bp, Homo sapien
ggtgcgcaggactctaaagatccaa

SEQ ID NO: 316159 - DNA, 25 bp, Homo sapien
tttatgtttattttgccgcggttca

SEQ ID NO: 316160 - DNA, 25 bp, Homo sapien
cgcggttcatctgtcgttttactga

SEQ ID NO: 316161 - DNA, 25 bp, Homo sapien
tgtcgttttactgactgcagaccca

SEQ ID NO: 316162 - DNA, 25 bp, Homo sapien
gggctactgaacaggtgagccacac

SEQ ID NO: 316163 - DNA, 25 bp, Homo sapien
tggttaacactccagctgtctgtgg

SEQ ID NO: 316164 - DNA, 25 bp, Homo sapien
tcagggaactcttccgtttcattgc

SEQ ID NO: 316165 - DNA, 25 bp, Homo sapien
taacactccagctgtctgtggtggc

SEQ ID NO: 316166 - DNA, 25 bp, Homo sapien
aactcttccgtttcattgctttgac

SEQ ID NO: 316167 - DNA, 25 bp, Homo sapien
ttccgtttcattgctttgaccacat

SEQ ID NO: 316168 - DNA, 25 bp, Homo sapien
gtttcattgctttgaccacatccta

SEQ ID NO: 316169 - DNA, 25 bp, Homo sapien
cattgctttgaccacatcctataaa

SEQ ID NO: 316170 - DNA, 25 bp, Homo sapien
acatcctataaatcttgttctcctt

SEQ ID NO: 316171 - DNA, 25 bp, Homo sapien
gggttgcaggcacccacctctagac

SEQ ID NO: 316172 - DNA, 25 bp, Homo sapien
tagacgctaccgcagagccagagcc

SEQ ID NO: 316173 - DNA, 25 bp, Homo sapien
tgattttgtgagtcctggctgttga

SEQ ID NO: 316174 - DNA, 25 bp, Homo sapien
tgtgagtcctggctgttgagttact

SEQ ID NO: 316175 - DNA, 25 bp, Homo sapien
gtcctggctgttgagttacttaccc

SEQ ID NO: 316176 - DNA, 25 bp, Homo sapien
ggctgttgagttacttaccctgtat

SEQ ID NO: 316177 - DNA, 25 bp, Homo sapien
ttgagttacttaccctgtattttcg

SEQ ID NO: 316178 - DNA, 25 bp, Homo sapien
ggagctttcattaaagactcaaata

SEQ ID NO: 316179 - DNA, 25 bp, Homo sapien
gcggttcaagctgactaactgtaat

SEQ ID NO: 316180 - DNA, 25 bp, Homo sapien
tcttttttccagtatccagaacagt

SEQ ID NO: 316181 - DNA, 25 bp, Homo sapien
ttttccagtatccagaacagtttcc

SEQ ID NO: 316182 - DNA, 25 bp, Homo sapien
gaacagtttccaaatagggttgtat

SEQ ID NO: 316183 - DNA, 25 bp, Homo sapien
gggttgtatcctgatgtggaaacta

SEQ ID NO: 316184 - DNA, 25 bp, Homo sapien
gaattctattgcattgaaaacccca

SEQ ID NO: 316185 - DNA, 25 bp, Homo sapien
aaatcttattaagccagcctccatc

SEQ ID NO: 316186 - DNA, 25 bp, Homo sapien
gccagcctccatcattagagcatgt

SEQ ID NO: 316187 - DNA, 25 bp, Homo sapien
gagcatgtttctcaaactcttggtg

SEQ ID NO: 316188 - DNA, 25 bp, Homo sapien
caaactcttggtgtgtgcaaatcat

SEQ ID NO: 316189 - DNA, 25 bp, Homo sapien
ttcatgctttttcagtttgcttcat

SEQ ID NO: 316190 - DNA, 25 bp, Homo sapien
agtttgcttcatttgccatatgata

SEQ ID NO: 316191 - DNA, 25 bp, Homo sapien
atgatagaggttttcttcagaccat

SEQ ID NO: 316192 - DNA, 25 bp, Homo sapien
ggttttcttcagaccatattttgga

SEQ ID NO: 316193 - DNA, 25 bp, Homo sapien
ggaaagtatgctcttagttttaaat

SEQ ID NO: 316194 - DNA, 25 bp, Homo sapien
ggttatttccaagacccatagtaga

SEQ ID NO: 316195 - DNA, 25 bp, Homo sapien
tgataccttgatattatctgcattg

SEQ ID NO: 316196 - DNA, 25 bp, Homo sapien
catgttacttttcttcacaagagtg

SEQ ID NO: 316197 - DNA, 25 bp, Homo sapien
atgttacttttcttcacaagagtga

SEQ ID NO: 316198 - DNA, 25 bp, Homo sapien
tgttacttttcttcacaagagtgat

SEQ ID NO: 316199 - DNA, 25 bp, Homo sapien
ttacttttcttcacaagagtgatat

SEQ ID NO: 316200 - DNA, 25 bp, Homo sapien
aaataaagaatgattggactgggaa

SEQ ID NO: 316201 - DNA, 25 bp, Homo sapien
gaggagagcaagcagtttaatatat

SEQ ID NO: 316202 - DNA, 25 bp, Homo sapien
gagagcaagcagtttaatatataga

SEQ ID NO: 316203 - DNA, 25 bp, Homo sapien
gggaccttataaaacatgagcaatg

SEQ ID NO: 316204 - DNA, 25 bp, Homo sapien
gaccttataaaacatgagcaatgga

SEQ ID NO: 316205 - DNA, 25 bp, Homo sapien
gagcaatggaacacttttttccaaa

SEQ ID NO: 316206 - DNA, 25 bp, Homo sapien
ggagaatcaaagataaaataccagt

SEQ ID NO: 316207 - DNA, 25 bp, Homo sapien
gagaatcaaagataaaataccagtt

SEQ ID NO: 316208 - DNA, 25 bp, Homo sapien
agaatcaaagataaaataccagttt

SEQ ID NO: 316209 - DNA, 25 bp, Homo sapien
cagaggcaagaaaagatgttgatca

SEQ ID NO: 316210 - DNA, 25 bp, Homo sapien
agaggcaagaaaagatgttgatcaa

SEQ ID NO: 316211 - DNA, 25 bp, Homo sapien
gaggcaagaaaagatgttgatcaag

SEQ ID NO: 316212 - DNA, 25 bp, Homo sapien
ggcaagaaaagatgttgatcaagaa

SEQ ID NO: 316213 - DNA, 25 bp, Homo sapien
ttgatcaagaaagatgagaaccagg

SEQ ID NO: 316214 - DNA, 25 bp, Homo sapien
agggctgaaggagaatcaaagataa

SEQ ID NO: 316215 - DNA, 25 bp, Homo sapien
gggctgaaggagaatcaaagataaa

SEQ ID NO: 316216 - DNA, 25 bp, Homo sapien
ggctgaaggagaatcaaagataaaa

SEQ ID NO: 316217 - DNA, 25 bp, Homo sapien
tgccctatgcattgtaggattaatg

SEQ ID NO: 316218 - DNA, 25 bp, Homo sapien
gcagggataaacctcctagggttga

SEQ ID NO: 316219 - DNA, 25 bp, Homo sapien
cctcctagggttgagaacctttatg

SEQ ID NO: 316220 - DNA, 25 bp, Homo sapien
gttgagaacctttatgtagtaaaat

SEQ ID NO: 316221 - DNA, 25 bp, Homo sapien
aatttcaccattcaaatgttccatg

SEQ ID NO: 316222 - DNA, 25 bp, Homo sapien
caccattcaaatgttccatgagaga

SEQ ID NO: 316223 - DNA, 25 bp, Homo sapien
caaatgttccatgagagaatctaaa

SEQ ID NO: 316224 - DNA, 25 bp, Homo sapien
agaaagtaagtaaccacttcatggg

SEQ ID NO: 316225 - DNA, 25 bp, Homo sapien
accttgtgcttttccctgtcagagc

SEQ ID NO: 316226 - DNA, 25 bp, Homo sapien
agttgtgacaataaacttgttgttc

SEQ ID NO: 316227 - DNA, 25 bp, Homo sapien
aacttgttgttcagacattgccaaa

SEQ ID NO: 316228 - DNA, 25 bp, Homo sapien
gttcttcgcttgtaattgaattcat

SEQ ID NO: 316229 - DNA, 25 bp, Homo sapien
gaattcattactaacctcatctcgt

SEQ ID NO: 316230 - DNA, 25 bp, Homo sapien
taacctcatctcgtttgtttttggg

SEQ ID NO: 316231 - DNA, 25 bp, Homo sapien
gtgatcaagaattactcatagattt

SEQ ID NO: 316232 - DNA, 25 bp, Homo sapien
aagctacttgtttctttgagttagg

SEQ ID NO: 316233 - DNA, 25 bp, Homo sapien
ttgagttaggcaccaaggcaaaatc

SEQ ID NO: 316234 - DNA, 25 bp, Homo sapien
tgctctagagcattcgtgttgtggt

SEQ ID NO: 316235 - DNA, 25 bp, Homo sapien
agagcattcgtgttgtggtttacaa

SEQ ID NO: 316236 - DNA, 25 bp, Homo sapien
gcataattaggtgcacagtgacatt

SEQ ID NO: 316237 - DNA, 25 bp, Homo sapien
gcacagtgacattgggaagaggttt

SEQ ID NO: 316238 - DNA, 25 bp, Homo sapien
aaaatcacagttcttcgcttgtaat

SEQ ID NO: 316239 - DNA, 25 bp, Homo sapien
ggaatctatagtttaagctccagac

SEQ ID NO: 316240 - DNA, 25 bp, Homo sapien
taagctccagacatacaaacataag

SEQ ID NO: 316241 - DNA, 25 bp, Homo sapien
aggcacattgtgtctttaatttcag

SEQ ID NO: 316242 - DNA, 25 bp, Homo sapien
gggttctgatcacattgcacgcctc

SEQ ID NO: 316243 - DNA, 25 bp, Homo sapien
ttgtcctcctgatcctgacacattc

SEQ ID NO: 316244 - DNA, 25 bp, Homo sapien
gatcctgacacattctgagtaacat

SEQ ID NO: 316245 - DNA, 25 bp, Homo sapien
acatcagcaggaatgctctgaccat

SEQ ID NO: 316246 - DNA, 25 bp, Homo sapien
caggaatgctctgaccatgaggtgg

SEQ ID NO: 316247 - DNA, 25 bp, Homo sapien
tcgggacttgaaaaccactagggca

SEQ ID NO: 316248 - DNA, 25 bp, Homo sapien
actagggcacatctggatgccttcc

SEQ ID NO: 316249 - DNA, 25 bp, Homo sapien
ccccagtatgtccttttctggatta

SEQ ID NO: 316250 - DNA, 25 bp, Homo sapien
ttatgcattggcctcgatttgccaa

SEQ ID NO: 316251 - DNA, 25 bp, Homo sapien
gcattggcctcgatttgccaatcat

SEQ ID NO: 316252 - DNA, 25 bp, Homo sapien
cctcgatttgccaatcattctctat

SEQ ID NO: 316253 - DNA, 25 bp, Homo sapien
caatcattctctattggttaaaatt

SEQ ID NO: 316254 - DNA, 25 bp, Homo sapien
aaattttgtatctaataatcagcat

SEQ ID NO: 316255 - DNA, 25 bp, Homo sapien
taatcagcatatattctaaaatcat

SEQ ID NO: 316256 - DNA, 25 bp, Homo sapien
ataacagtctaaatcctgggcacct

SEQ ID NO: 316257 - DNA, 25 bp, Homo sapien
acagtctaaatcctgggcaccttag

SEQ ID NO: 316258 - DNA, 25 bp, Homo sapien
taaatcctgggcaccttagaagaat

SEQ ID NO: 316259 - DNA, 25 bp, Homo sapien
tcctgggcaccttagaagaatgaca

SEQ ID NO: 316260 - DNA, 25 bp, Homo sapien
ttatatcacaatattctgttttccc

SEQ ID NO: 316261 - DNA, 25 bp, Homo sapien
tattacttagttttacgtcagctca

SEQ ID NO: 316262 - DNA, 25 bp, Homo sapien
acgtcagctcatttcatcatcattg

SEQ ID NO: 316263 - DNA, 25 bp, Homo sapien
gtgaaatacttatctccatcctatg

SEQ ID NO: 316264 - DNA, 25 bp, Homo sapien
gagacgggtttagacaggttcaatt

SEQ ID NO: 316265 - DNA, 25 bp, Homo sapien
gaaagtgggatctagatggtctgat

SEQ ID NO: 316266 - DNA, 25 bp, Homo sapien
gatggtctgatcctagtgatctacc

SEQ ID NO: 316267 - DNA, 25 bp, Homo sapien
agtgatctaccatatgaaggacata

SEQ ID NO: 316268 - DNA, 25 bp, Homo sapien
acatagtttgtgtcctggtccaagt

SEQ ID NO: 316269 - DNA, 25 bp, Homo sapien
gtcctggtccaagtcaaatattgac

SEQ ID NO: 316270 - DNA, 25 bp, Homo sapien
tattgactcctcacaaacagtaagt

SEQ ID NO: 316271 - DNA, 25 bp, Homo sapien
tgtgatgcctttgattccactttac

SEQ ID NO: 316272 - DNA, 25 bp, Homo sapien
gtgaagtgtctgcgctgcctgctct

SEQ ID NO: 316273 - DNA, 25 bp, Homo sapien
tgaagtgtctgcgctgcctgctcta

SEQ ID NO: 316274 - DNA, 25 bp, Homo sapien
gtctgcgctgcctgctctacgccct

SEQ ID NO: 316275 - DNA, 25 bp, Homo sapien
tctgcgctgcctgctctacgccctc

SEQ ID NO: 316276 - DNA, 25 bp, Homo sapien
tgcgctgcctgctctacgccctcaa

SEQ ID NO: 316277 - DNA, 25 bp, Homo sapien
gcgctgcctgctctacgccctcaat

SEQ ID NO: 316278 - DNA, 25 bp, Homo sapien
cgctgcctgctctacgccctcaatc

SEQ ID NO: 316279 - DNA, 25 bp, Homo sapien
gctgcctgctctacgccctcaatct

SEQ ID NO: 316280 - DNA, 25 bp, Homo sapien
ctgcctgctctacgccctcaatctg

SEQ ID NO: 316281 - DNA, 25 bp, Homo sapien
tctacgccctcaatctgctcttttg

SEQ ID NO: 316282 - DNA, 25 bp, Homo sapien
ctacgccctcaatctgctcttttgg

SEQ ID NO: 316283 - DNA, 25 bp, Homo sapien
ttgtcatttccagcttgccaaagta

SEQ ID NO: 316284 - DNA, 25 bp, Homo sapien
catttccagcttgccaaagtaaaca

SEQ ID NO: 316285 - DNA, 25 bp, Homo sapien
ggaatgctgattgtacattttcaaa

SEQ ID NO: 316286 - DNA, 25 bp, Homo sapien
ttgcctttccaattcaatacataaa

SEQ ID NO: 316287 - DNA, 25 bp, Homo sapien
aatacataaatgctcctgttaaaca

SEQ ID NO: 316288 - DNA, 25 bp, Homo sapien
aatgctcctgttaaacactggtgaa

SEQ ID NO: 316289 - DNA, 25 bp, Homo sapien
aacactggtgaagcatctgttttta

SEQ ID NO: 316290 - DNA, 25 bp, Homo sapien
atactttatagggagattagtggca

SEQ ID NO: 316291 - DNA, 25 bp, Homo sapien
aataagctagtttcgcaaactggga

SEQ ID NO: 316292 - DNA, 25 bp, Homo sapien
gtttcgcaaactgggaatactgttt

SEQ ID NO: 316293 - DNA, 25 bp, Homo sapien
attatgcagatgatttcttgtcatt

SEQ ID NO: 316294 - DNA, 25 bp, Homo sapien
gcatcatcagcatcggaggcgccaa

SEQ ID NO: 316295 - DNA, 25 bp, Homo sapien
tcatcagcatcggaggcgccaaggc

SEQ ID NO: 316296 - DNA, 25 bp, Homo sapien
atcggaggcgccaaggccatcatca

SEQ ID NO: 316297 - DNA, 25 bp, Homo sapien
aaggccatcatcaacagcactgtca

SEQ ID NO: 316298 - DNA, 25 bp, Homo sapien
aacagcactgtcactcccaacatga

SEQ ID NO: 316299 - DNA, 25 bp, Homo sapien
aacttcccagaagttcgggcagtgg

SEQ ID NO: 316300 - DNA, 25 bp, Homo sapien
cagtgggccgacagtcgcgccaaca

SEQ ID NO: 316301 - DNA, 25 bp, Homo sapien
tgggccgacagtcgcgccaacacag

SEQ ID NO: 316302 - DNA, 25 bp, Homo sapien
ctgggctttgcctctgaacagcatc

SEQ ID NO: 316303 - DNA, 25 bp, Homo sapien
acagtttgccgagaagttccaggaa

SEQ ID NO: 316304 - DNA, 25 bp, Homo sapien
tttgccgagaagttccaggaagtga

SEQ ID NO: 316305 - DNA, 25 bp, Homo sapien
ccccacgagggagaccacagagata

SEQ ID NO: 316306 - DNA, 25 bp, Homo sapien
cccacgagggagaccacagagataa

SEQ ID NO: 316307 - DNA, 25 bp, Homo sapien
cagagataaaggagctccaggtccc

SEQ ID NO: 316308 - DNA, 25 bp, Homo sapien
tgcccgcgccactgtcaaatctagg

SEQ ID NO: 316309 - DNA, 25 bp, Homo sapien
gcgccactgtcaaatctagggccag

SEQ ID NO: 316310 - DNA, 25 bp, Homo sapien
gccactgtcaaatctagggccagat

SEQ ID NO: 316311 - DNA, 25 bp, Homo sapien
ctgtcaaatctagggccagatccca

SEQ ID NO: 316312 - DNA, 25 bp, Homo sapien
gtcaaatctagggccagatcccagg

SEQ ID NO: 316313 - DNA, 25 bp, Homo sapien
gcagaggaggctgcaagcagaacct

SEQ ID NO: 316314 - DNA, 25 bp, Homo sapien
tgggcctccaggtcagactggagac

SEQ ID NO: 316315 - DNA, 25 bp, Homo sapien
caggtcagactggagaccctgctgc

SEQ ID NO: 316316 - DNA, 25 bp, Homo sapien
agttcaggctggatttccaaatgtc

SEQ ID NO: 316317 - DNA, 25 bp, Homo sapien
aaatgtccagacattcaagtcttag

SEQ ID NO: 316318 - DNA, 25 bp, Homo sapien
attcaagtcttagcagcacctcagc

SEQ ID NO: 316319 - DNA, 25 bp, Homo sapien
agctgcaccctattcttggacctga

SEQ ID NO: 316320 - DNA, 25 bp, Homo sapien
tattcttggacctgattcttgttca

SEQ ID NO: 316321 - DNA, 25 bp, Homo sapien
cttgttcagaagtcaaatgttgcct

SEQ ID NO: 316322 - DNA, 25 bp, Homo sapien
aatgttgccttccattttcagaaaa

SEQ ID NO: 316323 - DNA, 25 bp, Homo sapien
aaaaggcccaccttcagtgtgtgaa

SEQ ID NO: 316324 - DNA, 25 bp, Homo sapien
gtgtgaaactcgaagtgcttggtca

SEQ ID NO: 316325 - DNA, 25 bp, Homo sapien
tgcttggtcacctgaattgttttca

SEQ ID NO: 316326 - DNA, 25 bp, Homo sapien
aaaagtcacctgaacccaattcctg

SEQ ID NO: 316327 - DNA, 25 bp, Homo sapien
tgttttttacttgttgcaacctcaa

SEQ ID NO: 316328 - DNA, 25 bp, Homo sapien
tacttgttgcaacctcaaatgacca

SEQ ID NO: 316329 - DNA, 25 bp, Homo sapien
gttgcaacctcaaatgaccaaatgg

SEQ ID NO: 316330 - DNA, 25 bp, Homo sapien
gaccaaatggtatgatgcacactga

SEQ ID NO: 316331 - DNA, 25 bp, Homo sapien
aaatggtatgatgcacactgagata

SEQ ID NO: 316332 - DNA, 25 bp, Homo sapien
tatgatgcacactgagatactcaat

SEQ ID NO: 316333 - DNA, 25 bp, Homo sapien
aatatcatgcagttgatgacggtac

SEQ ID NO: 316334 - DNA, 25 bp, Homo sapien
catgcagttgatgacggtacattaa

SEQ ID NO: 316335 - DNA, 25 bp, Homo sapien
aaaggacattttgactagcattcag

SEQ ID NO: 316336 - DNA, 25 bp, Homo sapien
ggacattttgactagcattcagaaa

SEQ ID NO: 316337 - DNA, 25 bp, Homo sapien
gaaagagtccattgattataagatt

SEQ ID NO: 316338 - DNA, 25 bp, Homo sapien
cagagccccagtcccgtgagctgag

SEQ ID NO: 316339 - DNA, 25 bp, Homo sapien
gtcccgtgagctgagccaatgatgt

SEQ ID NO: 316340 - DNA, 25 bp, Homo sapien
aatgatgtggcctagcggaagctgc

SEQ ID NO: 316341 - DNA, 25 bp, Homo sapien
tggcctagcggaagctgcctcctca

SEQ ID NO: 316342 - DNA, 25 bp, Homo sapien
ctcaccctaggtgttgctggagaac

SEQ ID NO: 316343 - DNA, 25 bp, Homo sapien
ccctaggtgttgctggagaaccctg

SEQ ID NO: 316344 - DNA, 25 bp, Homo sapien
aaagcaacacctgtgcttgcagcca

SEQ ID NO: 316345 - DNA, 25 bp, Homo sapien
gtgcttgcagccaggtcaggcccag

SEQ ID NO: 316346 - DNA, 25 bp, Homo sapien
aggcaggagcagtcgcctttcccac

SEQ ID NO: 316347 - DNA, 25 bp, Homo sapien
tccctgcagggtcagggaccagacc

SEQ ID NO: 316348 - DNA, 25 bp, Homo sapien
cagggaccagaccacgcccagagga

SEQ ID NO: 316349 - DNA, 25 bp, Homo sapien
agataacctttctgttcttactaga

SEQ ID NO: 316350 - DNA, 25 bp, Homo sapien
aaattctttagttctgtcaaaccag

SEQ ID NO: 316351 - DNA, 25 bp, Homo sapien
aagcactttgaacaatgcctggaaa

SEQ ID NO: 316352 - DNA, 25 bp, Homo sapien
taacaggtactctgtaaatgtttac

SEQ ID NO: 316353 - DNA, 25 bp, Homo sapien
aaatgtttaccttctctgcaagtgc

SEQ ID NO: 316354 - DNA, 25 bp, Homo sapien
ttaccttctctgcaagtgcctgcca

SEQ ID NO: 316355 - DNA, 25 bp, Homo sapien
gtgcctgccacgtgcccgaagaaaa

SEQ ID NO: 316356 - DNA, 25 bp, Homo sapien
cacgtgcccgaagaaaagacacatt

SEQ ID NO: 316357 - DNA, 25 bp, Homo sapien
tctgcggaggaattgagtcatcttt

SEQ ID NO: 316358 - DNA, 25 bp, Homo sapien
ttgagtcatctttgatagccatgga

SEQ ID NO: 316359 - DNA, 25 bp, Homo sapien
gatagccatggaattaagcgatgtt

SEQ ID NO: 316360 - DNA, 25 bp, Homo sapien
ggtgaccaattggatcttggatctg

SEQ ID NO: 316361 - DNA, 25 bp, Homo sapien
ggatctgaggaaaaagctccagctt

SEQ ID NO: 316362 - DNA, 25 bp, Homo sapien
actctcgaagttttgcccagagcaa

SEQ ID NO: 316363 - DNA, 25 bp, Homo sapien
aagttttgcccagagcaaacggagg

SEQ ID NO: 316364 - DNA, 25 bp, Homo sapien
gggttgcgttgccatcgcctaaaat

SEQ ID NO: 316365 - DNA, 25 bp, Homo sapien
cgttgccatcgcctaaaatgggaaa

SEQ ID NO: 316366 - DNA, 25 bp, Homo sapien
aaatgggaaaatggcaggcgtcaca

SEQ ID NO: 316367 - DNA, 25 bp, Homo sapien
aaatggcaggcgtcacaggttgcag

SEQ ID NO: 316368 - DNA, 25 bp, Homo sapien
gagaccagttgagtgccccggagcc

SEQ ID NO: 316369 - DNA, 25 bp, Homo sapien
acgcacttggccgacggaaatcacg

SEQ ID NO: 316370 - DNA, 25 bp, Homo sapien
cttggccgacggaaatcacgaattg

SEQ ID NO: 316371 - DNA, 25 bp, Homo sapien
acaatgctgcattccaggtgtaatt

SEQ ID NO: 316372 - DNA, 25 bp, Homo sapien
attgcagaggtatttcgccctcaaa

SEQ ID NO: 316373 - DNA, 25 bp, Homo sapien
aagcagtggttaccgtttcatccct

SEQ ID NO: 316374 - DNA, 25 bp, Homo sapien
cgtttcatcccttcaattaacctga

SEQ ID NO: 316375 - DNA, 25 bp, Homo sapien
attaacctgaatggctcctgctaaa

SEQ ID NO: 316376 - DNA, 25 bp, Homo sapien
tgatgccctgcacaaacttagccaa

SEQ ID NO: 316377 - DNA, 25 bp, Homo sapien
aacttagccaagtcgtgtccccgat

SEQ ID NO: 316378 - DNA, 25 bp, Homo sapien
cagctgtgctaggtgtggtatcttt

SEQ ID NO: 316379 - DNA, 25 bp, Homo sapien
gtgtggtatctttactggaaccgat

SEQ ID NO: 316380 - DNA, 25 bp, Homo sapien
tggaaccgataaatgcacctctggc

SEQ ID NO: 316381 - DNA, 25 bp, Homo sapien
gcacctctggctcttgataatgcaa

SEQ ID NO: 316382 - DNA, 25 bp, Homo sapien
gtacgctacgatcagtacttcgggc

SEQ ID NO: 316383 - DNA, 25 bp, Homo sapien
tacgctacgatcagtacttcgggcc

SEQ ID NO: 316384 - DNA, 25 bp, Homo sapien
ccgtgccagcagcttcaaaggtgcc

SEQ ID NO: 316385 - DNA, 25 bp, Homo sapien
gtgccagcagcttcaaaggtgccca

SEQ ID NO: 316386 - DNA, 25 bp, Homo sapien
tgccagcagcttcaaaggtgcccag

SEQ ID NO: 316387 - DNA, 25 bp, Homo sapien
gccagcagcttcaaaggtgcccagg

SEQ ID NO: 316388 - DNA, 25 bp, Homo sapien
ccagcagcttcaaaggtgcccaggc

SEQ ID NO: 316389 - DNA, 25 bp, Homo sapien
gggagtacgctacgatcagtacttc

SEQ ID NO: 316390 - DNA, 25 bp, Homo sapien
ggagtacgctacgatcagtacttcg

SEQ ID NO: 316391 - DNA, 25 bp, Homo sapien
gagtacgctacgatcagtacttcgg

SEQ ID NO: 316392 - DNA, 25 bp, Homo sapien
agtacgctacgatcagtacttcggg

SEQ ID NO: 316393 - DNA, 25 bp, Homo sapien
atgtgtttagataccattgtgttac

SEQ ID NO: 316394 - DNA, 25 bp, Homo sapien
tgttacaatggcctgaagcattcag

SEQ ID NO: 316395 - DNA, 25 bp, Homo sapien
attcagtacagtcacatgcgagcag

SEQ ID NO: 316396 - DNA, 25 bp, Homo sapien
tcacatgcgagcaggtatgcagcct

SEQ ID NO: 316397 - DNA, 25 bp, Homo sapien
agcaggtatgcagcctaggagcaat

SEQ ID NO: 316398 - DNA, 25 bp, Homo sapien
ggagcaataggccacaccacacagc

SEQ ID NO: 316399 - DNA, 25 bp, Homo sapien
cacacagcctaggtgtgcggcaggt

SEQ ID NO: 316400 - DNA, 25 bp, Homo sapien
gcaggtgtagcgcactctgatgcct

SEQ ID NO: 316401 - DNA, 25 bp, Homo sapien
tctgatgcctgcacgacgacaaaat

SEQ ID NO: 316402 - DNA, 25 bp, Homo sapien
gtttcagtcaatgatgggccacatg

SEQ ID NO: 316403 - DNA, 25 bp, Homo sapien
gtagatggtggtcccgtaagattat

SEQ ID NO: 316404 - DNA, 25 bp, Homo sapien
gtctctctgggatcatttcttaagt

SEQ ID NO: 316405 - DNA, 25 bp, Homo sapien
ggatcatttcttaagtcaactaggt

SEQ ID NO: 316406 - DNA, 25 bp, Homo sapien
ttagggttaccttatgacaagtgta

SEQ ID NO: 316407 - DNA, 25 bp, Homo sapien
gtaacagtaactccaaccttagaga

SEQ ID NO: 316408 - DNA, 25 bp, Homo sapien
gaaagttatgaagctccagttatac

SEQ ID NO: 316409 - DNA, 25 bp, Homo sapien
atgaattatatacccagaatgcaat

SEQ ID NO: 316410 - DNA, 25 bp, Homo sapien
tgagttgtaggtgtcgaatctttgg

SEQ ID NO: 316411 - DNA, 25 bp, Homo sapien
gaatctttggaaaatgccctctagc

SEQ ID NO: 316412 - DNA, 25 bp, Homo sapien
aaatgccctctagcttctggaatga

SEQ ID NO: 316413 - DNA, 25 bp, Homo sapien
agcttctggaatgaccctgatggat

SEQ ID NO: 316414 - DNA, 25 bp, Homo sapien
gaccctgatggatgggtttaagttt

SEQ ID NO: 316415 - DNA, 25 bp, Homo sapien
caagggttccattggaaactcaact

SEQ ID NO: 316416 - DNA, 25 bp, Homo sapien
tatatgtatactgtaagtgtgcaca

SEQ ID NO: 316417 - DNA, 25 bp, Homo sapien
ttttttactccactacctggcacca

SEQ ID NO: 316418 - DNA, 25 bp, Homo sapien
acctggcaccagactggagacataa

SEQ ID NO: 316419 - DNA, 25 bp, Homo sapien
gcaaatggacattcctttggcctct

SEQ ID NO: 316420 - DNA, 25 bp, Homo sapien
ggacattcctttggcctcttcaagg

SEQ ID NO: 316421 - DNA, 25 bp, Homo sapien
ctcagtcccctatgactacatttaa

SEQ ID NO: 316422 - DNA, 25 bp, Homo sapien
gactacatttaatatatcttctcat

SEQ ID NO: 316423 - DNA, 25 bp, Homo sapien
aattcagtcttgcactttagctact

SEQ ID NO: 316424 - DNA, 25 bp, Homo sapien
tcttgcactttagctactggccaaa

SEQ ID NO: 316425 - DNA, 25 bp, Homo sapien
cactttagctactggccaaagccaa

SEQ ID NO: 316426 - DNA, 25 bp, Homo sapien
tttaaaaatcaaatgcacacgcatg

SEQ ID NO: 316427 - DNA, 25 bp, Homo sapien
aatgcacacgcatggaagctgcttg

SEQ ID NO: 316428 - DNA, 25 bp, Homo sapien
tgcacacgcatggaagctgcttgtc

SEQ ID NO: 316429 - DNA, 25 bp, Homo sapien
acacgcatggaagctgcttgtccat

SEQ ID NO: 316430 - DNA, 25 bp, Homo sapien
atggaagctgcttgtccatgcactg

SEQ ID NO: 316431 - DNA, 25 bp, Homo sapien
aagctgcttgtccatgcactggttt

SEQ ID NO: 316432 - DNA, 25 bp, Homo sapien
gcttgtccatgcactggttttgtca

SEQ ID NO: 316433 - DNA, 25 bp, Homo sapien
ttgtccatgcactggttttgtcact

SEQ ID NO: 316434 - DNA, 25 bp, Homo sapien
gtccatgcactggttttgtcactgg

SEQ ID NO: 316435 - DNA, 25 bp, Homo sapien
atgcactggttttgtcactggcgtc

SEQ ID NO: 316436 - DNA, 25 bp, Homo sapien
gcactggttttgtcactggcgtcct

SEQ ID NO: 316437 - DNA, 25 bp, Homo sapien
ttcccagcagagctaagagacttct

SEQ ID NO: 316438 - DNA, 25 bp, Homo sapien
gggaaggacaagatgggccaccaca

SEQ ID NO: 316439 - DNA, 25 bp, Homo sapien
aagatgggccaccacatgcctgtgt

SEQ ID NO: 316440 - DNA, 25 bp, Homo sapien
atgcctgtgtccactgctggccaca

SEQ ID NO: 316441 - DNA, 25 bp, Homo sapien
agagcagttctagggttcgtagtca

SEQ ID NO: 316442 - DNA, 25 bp, Homo sapien
tagggttcgtagtcattctctctga

SEQ ID NO: 316443 - DNA, 25 bp, Homo sapien
tctctctgagtcatggaaaactgcc

SEQ ID NO: 316444 - DNA, 25 bp, Homo sapien
agagacttctagagcctcttgtgga

SEQ ID NO: 316445 - DNA, 25 bp, Homo sapien
agagcctcttgtggatggtcagcga

SEQ ID NO: 316446 - DNA, 25 bp, Homo sapien
ggatggtcagcgatagccctggtat

SEQ ID NO: 316447 - DNA, 25 bp, Homo sapien
tcagcgatagccctggtatgaccag

SEQ ID NO: 316448 - DNA, 25 bp, Homo sapien
tggcccctctaccaatagggcagta

SEQ ID NO: 316449 - DNA, 25 bp, Homo sapien
taccaatagggcagtagcctcctgc

SEQ ID NO: 316450 - DNA, 25 bp, Homo sapien
tataaggtgggcttggtccaacagg

SEQ ID NO: 316451 - DNA, 25 bp, Homo sapien
cagagggtacatactcctttctggg

SEQ ID NO: 316452 - DNA, 25 bp, Homo sapien
agagaatgctccctaccatatagtt

SEQ ID NO: 316453 - DNA, 25 bp, Homo sapien
gaatgctccctaccatatagttgac

SEQ ID NO: 316454 - DNA, 25 bp, Homo sapien
gctccctaccatatagttgacagtg

SEQ ID NO: 316455 - DNA, 25 bp, Homo sapien
tacctaccttccttttaatagcaga

SEQ ID NO: 316456 - DNA, 25 bp, Homo sapien
ttgattatgtgtattgatcaccctg

SEQ ID NO: 316457 - DNA, 25 bp, Homo sapien
tattgatcaccctgcaatcctatta

SEQ ID NO: 316458 - DNA, 25 bp, Homo sapien
ctattatgtatctgagtgtgtgtgt

SEQ ID NO: 316459 - DNA, 25 bp, Homo sapien
caggtcctggaaacaaaccatttag

SEQ ID NO: 316460 - DNA, 25 bp, Homo sapien
aacaaaccatttagcatcaggtcag

SEQ ID NO: 316461 - DNA, 25 bp, Homo sapien
atcaggtcagaagctactccatgga

SEQ ID NO: 316462 - DNA, 25 bp, Homo sapien
gaagctactccatggaattctgaga

SEQ ID NO: 316463 - DNA, 25 bp, Homo sapien
atggaattctgagaccacgaaagcc

SEQ ID NO: 316464 - DNA, 25 bp, Homo sapien
cacgaaagccaggtcaggtctcaaa

SEQ ID NO: 316465 - DNA, 25 bp, Homo sapien
gtcaggtctcaaattcagtagccca

SEQ ID NO: 316466 - DNA, 25 bp, Homo sapien
cctcccacaggtctagattttcttg

SEQ ID NO: 316467 - DNA, 25 bp, Homo sapien
gaagtatgctaatctcttggtacat

SEQ ID NO: 316468 - DNA, 25 bp, Homo sapien
ctcttggtacattaagtggctatca

SEQ ID NO: 316469 - DNA, 25 bp, Homo sapien
atactggctattatacagggctcaa

SEQ ID NO: 316470 - DNA, 25 bp, Homo sapien
gaggtgaagccttagcaaaaatgcc

SEQ ID NO: 316471 - DNA, 25 bp, Homo sapien
agccttagcaaaaatgcctcctcac

SEQ ID NO: 316472 - DNA, 25 bp, Homo sapien
aatcactgattccttcactgacata

SEQ ID NO: 316473 - DNA, 25 bp, Homo sapien
ctgattccttcactgacataatgta

SEQ ID NO: 316474 - DNA, 25 bp, Homo sapien
acataatgtaggaagcctctgagga

SEQ ID NO: 316475 - DNA, 25 bp, Homo sapien
acatagagaacggttgctactggca

SEQ ID NO: 316476 - DNA, 25 bp, Homo sapien
gaacggttgctactggcagaagcat

SEQ ID NO: 316477 - DNA, 25 bp, Homo sapien
ctactggcagaagcataagatcttt

SEQ ID NO: 316478 - DNA, 25 bp, Homo sapien
ataagatctttgtacaatattgctg

SEQ ID NO: 316479 - DNA, 25 bp, Homo sapien
atattgctggccctggttcacctgt

SEQ ID NO: 316480 - DNA, 25 bp, Homo sapien
ggttcacctgtttactgttatcaca

SEQ ID NO: 316481 - DNA, 25 bp, Homo sapien
ttcgaaatgacaacgggccacacct

SEQ ID NO: 316482 - DNA, 25 bp, Homo sapien
tacaacgagccagacgactattcta

SEQ ID NO: 316483 - DNA, 25 bp, Homo sapien
acgcgatgtgtctccaaacgtcatc

SEQ ID NO: 316484 - DNA, 25 bp, Homo sapien
gagccagacgactattctacacagt

SEQ ID NO: 316485 - DNA, 25 bp, Homo sapien
tgtctccaaacgtcatccaccagaa

SEQ ID NO: 316486 - DNA, 25 bp, Homo sapien
tcatccaccagaagggctgtttcca

SEQ ID NO: 316487 - DNA, 25 bp, Homo sapien
gctgtttccataaactcctaaaaat

SEQ ID NO: 316488 - DNA, 25 bp, Homo sapien
cagagcttcaccctgagtgggagct

SEQ ID NO: 316489 - DNA, 25 bp, Homo sapien
caccctgagtgggagctctctggga

SEQ ID NO: 316490 - DNA, 25 bp, Homo sapien
gggtgaataactacacagatttttc

SEQ ID NO: 316491 - DNA, 25 bp, Homo sapien
ttctggctcttccttcgaaatgaca

SEQ ID NO: 316492 - DNA, 25 bp, Homo sapien
attccaaacagtaccagtgagagca

SEQ ID NO: 316493 - DNA, 25 bp, Homo sapien
taccagtgagagcagcacttccact

SEQ ID NO: 316494 - DNA, 25 bp, Homo sapien
ccttaactgccttactcagtgggta

SEQ ID NO: 316495 - DNA, 25 bp, Homo sapien
atgcatatgctacttcactccctct

SEQ ID NO: 316496 - DNA, 25 bp, Homo sapien
tctcccaacccttaataatgaggca

SEQ ID NO: 316497 - DNA, 25 bp, Homo sapien
aagcaagagcctagtgaaggccaat

SEQ ID NO: 316498 - DNA, 25 bp, Homo sapien
tgaaggccaatgctaggtttacaaa

SEQ ID NO: 316499 - DNA, 25 bp, Homo sapien
tacaaacttacccagaagcctctgc

SEQ ID NO: 316500 - DNA, 25 bp, Homo sapien
ttcacaggctcctcagatgaaaata

SEQ ID NO: 316501 - DNA, 25 bp, Homo sapien
tgaatggtccacaagactaccctct

SEQ ID NO: 316502 - DNA, 25 bp, Homo sapien
tcttaagaggtttcacaaattccaa

SEQ ID NO: 316503 - DNA, 25 bp, Homo sapien
aaacttctaagccaagcattctgtt

SEQ ID NO: 316504 - DNA, 25 bp, Homo sapien
aagccaagcattctgtttggtaaag

SEQ ID NO: 316505 - DNA, 25 bp, Homo sapien
aaagatttctcttaactgttagata

SEQ ID NO: 316506 - DNA, 25 bp, Homo sapien
gatatggcagagtgtgtaactaatt

SEQ ID NO: 316507 - DNA, 25 bp, Homo sapien
actaattttagtattgtctttgcag

SEQ ID NO: 316508 - DNA, 25 bp, Homo sapien
gtattgtctttgcagtgtatgctga

SEQ ID NO: 316509 - DNA, 25 bp, Homo sapien
acatcaattcaggtaagtgtgtgtt

SEQ ID NO: 316510 - DNA, 25 bp, Homo sapien
ataatttgtcagtattctgtaggat

SEQ ID NO: 316511 - DNA, 25 bp, Homo sapien
ggatatagtcagctccttagcacac

SEQ ID NO: 316512 - DNA, 25 bp, Homo sapien
tccttagcacacaggtaaccaatgg

SEQ ID NO: 316513 - DNA, 25 bp, Homo sapien
taaccaatggcagagcttggacaag

SEQ ID NO: 316514 - DNA, 25 bp, Homo sapien
gaatattaattccatatctggcaac

SEQ ID NO: 316515 - DNA, 25 bp, Homo sapien
ttccatatctggcaacaggtggact

SEQ ID NO: 316516 - DNA, 25 bp, Homo sapien
acaggtggactagatgtctggcgaa

SEQ ID NO: 316517 - DNA, 25 bp, Homo sapien
gatgtctggcgaataacacctaata

SEQ ID NO: 316518 - DNA, 25 bp, Homo sapien
cctaatataaaacacctgtcacggt

SEQ ID NO: 316519 - DNA, 25 bp, Homo sapien
aaaacacctgtcacggtgattgaaa

SEQ ID NO: 316520 - DNA, 25 bp, Homo sapien
gtaaaatatatcttctggggccaaa

SEQ ID NO: 316521 - DNA, 25 bp, Homo sapien
atagaccagaattatctgctacttg

SEQ ID NO: 316522 - DNA, 25 bp, Homo sapien
attatctgctacttgaatgtttggc

SEQ ID NO: 316523 - DNA, 25 bp, Homo sapien
ttggcaaaactctcctagaaaactg

SEQ ID NO: 316524 - DNA, 25 bp, Homo sapien
tctcctagaaaactgagtctgatgt

SEQ ID NO: 316525 - DNA, 25 bp, Homo sapien
actgatcagtttgagtgactgcaac

SEQ ID NO: 316526 - DNA, 25 bp, Homo sapien
caacatgttctggttgcacaacagt

SEQ ID NO: 316527 - DNA, 25 bp, Homo sapien
gttgcacaacagttaggcatgctat

SEQ ID NO: 316528 - DNA, 25 bp, Homo sapien
acagttaggcatgctatggtttata

SEQ ID NO: 316529 - DNA, 25 bp, Homo sapien
tgtgaagtttggatgcctgtgaaga

SEQ ID NO: 316530 - DNA, 25 bp, Homo sapien
aaaactgaacagctactgtgctata

SEQ ID NO: 316531 - DNA, 25 bp, Homo sapien
gctactgtgctatattgattttatt

SEQ ID NO: 316532 - DNA, 25 bp, Homo sapien
gtagtattgagcagaccttgtttct

SEQ ID NO: 316533 - DNA, 25 bp, Homo sapien
gagcagaccttgtttctgcatgaaa

SEQ ID NO: 316534 - DNA, 25 bp, Homo sapien
gaaactagttgcaaaacccactatt

SEQ ID NO: 316535 - DNA, 25 bp, Homo sapien
tgcaaaacccactattttggaaata

SEQ ID NO: 316536 - DNA, 25 bp, Homo sapien
ttttccatttttaggatgaagaata

SEQ ID NO: 316537 - DNA, 25 bp, Homo sapien
atgaatatagttctgttacgtaata

SEQ ID NO: 316538 - DNA, 25 bp, Homo sapien
gttctgttacgtaatatttgtgttt

SEQ ID NO: 316539 - DNA, 25 bp, Homo sapien
aactgccctttgattttggaatgta

SEQ ID NO: 316540 - DNA, 25 bp, Homo sapien
ctgccctttgattttggaatgtatg

SEQ ID NO: 316541 - DNA, 25 bp, Homo sapien
gccctttgattttggaatgtatgaa

SEQ ID NO: 316542 - DNA, 25 bp, Homo sapien
aatgtatgaagcaggcaaatgcccc

SEQ ID NO: 316543 - DNA, 25 bp, Homo sapien
tgaagcaggcaaatgcccctacctt

SEQ ID NO: 316544 - DNA, 25 bp, Homo sapien
aggcaaatgcccctaccttctattt

SEQ ID NO: 316545 - DNA, 25 bp, Homo sapien
gcaaatgcccctaccttctattttt

SEQ ID NO: 316546 - DNA, 25 bp, Homo sapien
aaagatagtttggaggagtagttag

SEQ ID NO: 316547 - DNA, 25 bp, Homo sapien
ggttaatcacgccagtatgcgatca

SEQ ID NO: 316548 - DNA, 25 bp, Homo sapien
gtatgcgatcaatatcctcatctcc

SEQ ID NO: 316549 - DNA, 25 bp, Homo sapien
atctgctttgtcagtggattctgag

SEQ ID NO: 316550 - DNA, 25 bp, Homo sapien
agtctaaagttctgtcctgtacctg

SEQ ID NO: 316551 - DNA, 25 bp, Homo sapien
taaagttctgtcctgtacctgcagc

SEQ ID NO: 316552 - DNA, 25 bp, Homo sapien
tctccttgtgagtgttcattgtgca

SEQ ID NO: 316553 - DNA, 25 bp, Homo sapien
aagctgaaaattgcaaaaccctgta

SEQ ID NO: 316554 - DNA, 25 bp, Homo sapien
gcaaaaccctgtaatcatgaaatga

SEQ ID NO: 316555 - DNA, 25 bp, Homo sapien
gcctcctttggcctagttattttgt

SEQ ID NO: 316556 - DNA, 25 bp, Homo sapien
gaaatctcatgcttcacagtcgaat

SEQ ID NO: 316557 - DNA, 25 bp, Homo sapien
tgtagaacctgggttaatcacgcca

SEQ ID NO: 316558 - DNA, 25 bp, Homo sapien
ttcagtctctataccccttccactt

SEQ ID NO: 316559 - DNA, 25 bp, Homo sapien
tcagtctctataccccttccacttg

SEQ ID NO: 316560 - DNA, 25 bp, Homo sapien
cagtctctataccccttccacttgc

SEQ ID NO: 316561 - DNA, 25 bp, Homo sapien
agtctctataccccttccacttgcc

SEQ ID NO: 316562 - DNA, 25 bp, Homo sapien
gtctctataccccttccacttgcct

SEQ ID NO: 316563 - DNA, 25 bp, Homo sapien
tctctataccccttccacttgcctg

SEQ ID NO: 316564 - DNA, 25 bp, Homo sapien
ctctataccccttccacttgcctga

SEQ ID NO: 316565 - DNA, 25 bp, Homo sapien
tctataccccttccacttgcctgag

SEQ ID NO: 316566 - DNA, 25 bp, Homo sapien
ctataccccttccacttgcctgagc

SEQ ID NO: 316567 - DNA, 25 bp, Homo sapien
tataccccttccacttgcctgagct

SEQ ID NO: 316568 - DNA, 25 bp, Homo sapien
caacatcataaggaatcagacggat

SEQ ID NO: 316569 - DNA, 25 bp, Homo sapien
taaggaatcagacggatgcggaaac

SEQ ID NO: 316570 - DNA, 25 bp, Homo sapien
aaggctccggggcactcaactggtc

SEQ ID NO: 316571 - DNA, 25 bp, Homo sapien
cctccgtttgctctgggcaaaactt

SEQ ID NO: 316572 - DNA, 25 bp, Homo sapien
ttgctctgggcaaaacttcgagagt

SEQ ID NO: 316573 - DNA, 25 bp, Homo sapien
gagagttccctctgaagctggagct

SEQ ID NO: 316574 - DNA, 25 bp, Homo sapien
gagttccctctgaagctggagcttt

SEQ ID NO: 316575 - DNA, 25 bp, Homo sapien
ctgaagctggagctttttcctcaga

SEQ ID NO: 316576 - DNA, 25 bp, Homo sapien
ggagctttttcctcagatccaagat

SEQ ID NO: 316577 - DNA, 25 bp, Homo sapien
gatccaagatccaattggtcaccaa

SEQ ID NO: 316578 - DNA, 25 bp, Homo sapien
caattggtcaccaattcgtgatttc

SEQ ID NO: 316579 - DNA, 25 bp, Homo sapien
gaagcggcctcatcaatgggcagat

SEQ ID NO: 316580 - DNA, 25 bp, Homo sapien
aatgggcagatagcaaaggaccttg

SEQ ID NO: 316581 - DNA, 25 bp, Homo sapien
atagcaaaggaccttgggactctgg

SEQ ID NO: 316582 - DNA, 25 bp, Homo sapien
tccaggttctcatcagcagcaacga

SEQ ID NO: 316583 - DNA, 25 bp, Homo sapien
tcatcagcagcaacgaggtcaagga

SEQ ID NO: 316584 - DNA, 25 bp, Homo sapien
ggtcaaggagatcaaaggctacaag

SEQ ID NO: 316585 - DNA, 25 bp, Homo sapien
aaggacatcttcgtcactgtggctg

SEQ ID NO: 316586 - DNA, 25 bp, Homo sapien
gcaaggcgctgagagtccatgtcac

SEQ ID NO: 316587 - DNA, 25 bp, Homo sapien
aacaccttaatggtggctctgagca

SEQ ID NO: 316588 - DNA, 25 bp, Homo sapien
gctctgagcagctgcacgatggtgc

SEQ ID NO: 316589 - DNA, 25 bp, Homo sapien
gtgctggaaggaagcggcctcatca

SEQ ID NO: 316590 - DNA, 25 bp, Homo sapien
aatgctttgctacataatgaggcca

SEQ ID NO: 316591 - DNA, 25 bp, Homo sapien
atgctttgctacataatgaggccag

SEQ ID NO: 316592 - DNA, 25 bp, Homo sapien
tgctttgctacataatgaggccagg

SEQ ID NO: 316593 - DNA, 25 bp, Homo sapien
gctttgctacataatgaggccaggc

SEQ ID NO: 316594 - DNA, 25 bp, Homo sapien
aaaaaagtcctgtggaaatcatata

SEQ ID NO: 316595 - DNA, 25 bp, Homo sapien
aagtcctgtggaaatcatatagaca

SEQ ID NO: 316596 - DNA, 25 bp, Homo sapien
gtcctgtggaaatcatatagacaaa

SEQ ID NO: 316597 - DNA, 25 bp, Homo sapien
tatagacaaacatttgcaaagctgc

SEQ ID NO: 316598 - DNA, 25 bp, Homo sapien
tgctactgccattgtaccagtgtta

SEQ ID NO: 316599 - DNA, 25 bp, Homo sapien
gctactgccattgtaccagtgttaa

SEQ ID NO: 316600 - DNA, 25 bp, Homo sapien
ctactgccattgtaccagtgttaaa

SEQ ID NO: 316601 - DNA, 25 bp, Homo sapien
gagcaccgtgctagaggaactgtaa

SEQ ID NO: 316602 - DNA, 25 bp, Homo sapien
aacaggtcctgctggcttaatttaa

SEQ ID NO: 316603 - DNA, 25 bp, Homo sapien
ttgcatgaagtagcgtggaggccct

SEQ ID NO: 316604 - DNA, 25 bp, Homo sapien
tggactgctgctcgttctttaggat

SEQ ID NO: 316605 - DNA, 25 bp, Homo sapien
gctcgttctttaggatggactgttc

SEQ ID NO: 316606 - DNA, 25 bp, Homo sapien
ggactgttctggtatctggtattgg

SEQ ID NO: 316607 - DNA, 25 bp, Homo sapien
gagactgttaataagggacatcaca

SEQ ID NO: 316608 - DNA, 25 bp, Homo sapien
gatgggattcatttgaagcactcta

SEQ ID NO: 316609 - DNA, 25 bp, Homo sapien
atttgaagcactctatttctgtttt

SEQ ID NO: 316610 - DNA, 25 bp, Homo sapien
ttttatccaattttgccttcccaag

SEQ ID NO: 316611 - DNA, 25 bp, Homo sapien
caattttgccttcccaagatttttg

SEQ ID NO: 316612 - DNA, 25 bp, Homo sapien
agcttggttcatggagaccctgttt

SEQ ID NO: 316613 - DNA, 25 bp, Homo sapien
aggtgtttacaccagcaaaatactc

SEQ ID NO: 316614 - DNA, 25 bp, Homo sapien
ggtgtttacaccagcaaaatactca

SEQ ID NO: 316615 - DNA, 25 bp, Homo sapien
gtgtttacaccagcaaaatactcat

SEQ ID NO: 316616 - DNA, 25 bp, Homo sapien
tcatacttagcaaatctaacacatg

SEQ ID NO: 316617 - DNA, 25 bp, Homo sapien
catacttagcaaatctaacacatga

SEQ ID NO: 316618 - DNA, 25 bp, Homo sapien
atacttagcaaatctaacacatgaa

SEQ ID NO: 316619 - DNA, 25 bp, Homo sapien
tacttagcaaatctaacacatgaaa

SEQ ID NO: 316620 - DNA, 25 bp, Homo sapien
ttagcaaatctaacacatgaaatgt

SEQ ID NO: 316621 - DNA, 25 bp, Homo sapien
tagcaaatctaacacatgaaatgta

SEQ ID NO: 316622 - DNA, 25 bp, Homo sapien
gcaaatctaacacatgaaatgtaac

SEQ ID NO: 316623 - DNA, 25 bp, Homo sapien
atcacatccaggtacaggagggcca

SEQ ID NO: 316624 - DNA, 25 bp, Homo sapien
gccagatcacacacatccagtatga

SEQ ID NO: 316625 - DNA, 25 bp, Homo sapien
gtatgaacaaggagccccgttcctt

SEQ ID NO: 316626 - DNA, 25 bp, Homo sapien
ttcaggagtcccagatccagtatgt

SEQ ID NO: 316627 - DNA, 25 bp, Homo sapien
agatccagtatgtgcctgtgtcccc

SEQ ID NO: 316628 - DNA, 25 bp, Homo sapien
agcttgtcacacaggctcaacttga

SEQ ID NO: 316629 - DNA, 25 bp, Homo sapien
tcaacttgaggctgcagcacactca

SEQ ID NO: 316630 - DNA, 25 bp, Homo sapien
gtttggtacagacgagacagtgccc

SEQ ID NO: 316631 - DNA, 25 bp, Homo sapien
gacagtgcccgaacacattcaacag

SEQ ID NO: 316632 - DNA, 25 bp, Homo sapien
agctgcagcaccagggcatcgagta

SEQ ID NO: 316633 - DNA, 25 bp, Homo sapien
atcgagtacgacgtcatcaccctgg

SEQ ID NO: 316634 - DNA, 25 bp, Homo sapien
cgggatgcgggcactgcggtagagc

SEQ ID NO: 316635 - DNA, 25 bp, Homo sapien
ggatgcgggcactgcggtagagccg

SEQ ID NO: 316636 - DNA, 25 bp, Homo sapien
gatgcgggcactgcggtagagccgg

SEQ ID NO: 316637 - DNA, 25 bp, Homo sapien
gcactgcggtagagccggtcctgcc

SEQ ID NO: 316638 - DNA, 25 bp, Homo sapien
cactgcggtagagccggtcctgccc

SEQ ID NO: 316639 - DNA, 25 bp, Homo sapien
cctccgctgctaaacccgcggacaa

SEQ ID NO: 316640 - DNA, 25 bp, Homo sapien
tccctgtggcccagggaagtgccag

SEQ ID NO: 316641 - DNA, 25 bp, Homo sapien
gcccagggaagtgccagggatccct

SEQ ID NO: 316642 - DNA, 25 bp, Homo sapien
ggaagtgccagggatccctgggaag

SEQ ID NO: 316643 - DNA, 25 bp, Homo sapien
aagtgccagggatccctgggaaggc

SEQ ID NO: 316644 - DNA, 25 bp, Homo sapien
agggatccctgggaaggcgggagat

SEQ ID NO: 316645 - DNA, 25 bp, Homo sapien
aatgtggccgtgcagcccagacgat

SEQ ID NO: 316646 - DNA, 25 bp, Homo sapien
gtgcagcccagacgatcagagagaa

SEQ ID NO: 316647 - DNA, 25 bp, Homo sapien
gagaagccaggcgttgaccaagccc

SEQ ID NO: 316648 - DNA, 25 bp, Homo sapien
aggcgttgaccaagccccaaggtgc

SEQ ID NO: 316649 - DNA, 25 bp, Homo sapien
tgaggccatggtgcaactctgctgg

SEQ ID NO: 316650 - DNA, 25 bp, Homo sapien
ttggagcagagcttcacccggatgg

SEQ ID NO: 316651 - DNA, 25 bp, Homo sapien
ggatgggaaatcctcactcctgggt

SEQ ID NO: 316652 - DNA, 25 bp, Homo sapien
cctcctggtccatcttcttaagatg

SEQ ID NO: 316653 - DNA, 25 bp, Homo sapien
aagcgaaccagaagcaccgggcaca

SEQ ID NO: 316654 - DNA, 25 bp, Homo sapien
gctcctctggctgtgtagacagacc

SEQ ID NO: 316655 - DNA, 25 bp, Homo sapien
tgtagacagacctggcaatgtggcc

SEQ ID NO: 316656 - DNA, 25 bp, Homo sapien
ttgccttcttcctcgaaaaccctgg

SEQ ID NO: 316657 - DNA, 25 bp, Homo sapien
gggacccttccagatgggactaact

SEQ ID NO: 316658 - DNA, 25 bp, Homo sapien
gaaagtcattggcactgatctctaa

SEQ ID NO: 316659 - DNA, 25 bp, Homo sapien
ggcactgatctctaagatgctatca

SEQ ID NO: 316660 - DNA, 25 bp, Homo sapien
ctatcacatgtgattggtggttgat

SEQ ID NO: 316661 - DNA, 25 bp, Homo sapien
gcaaagtactacaaaggtggcttta

SEQ ID NO: 316662 - DNA, 25 bp, Homo sapien
aagcaattcacagaaactacttttt

SEQ ID NO: 316663 - DNA, 25 bp, Homo sapien
aactactttttcatgtagcttgtat

SEQ ID NO: 316664 - DNA, 25 bp, Homo sapien
gtagcttgtatgtgtgctccatgta

SEQ ID NO: 316665 - DNA, 25 bp, Homo sapien
atgtgtgctccatgtatttcatcat

SEQ ID NO: 316666 - DNA, 25 bp, Homo sapien
catggaagattttagtgtgtgttta

SEQ ID NO: 316667 - DNA, 25 bp, Homo sapien
gagagtttccatataatgtgccata

SEQ ID NO: 316668 - DNA, 25 bp, Homo sapien
aactgcatagacagcacgtcttcag

SEQ ID NO: 316669 - DNA, 25 bp, Homo sapien
acgtcttcagggtgtggtttctaag

SEQ ID NO: 316670 - DNA, 25 bp, Homo sapien
taaaattgcatgttcctccacgcag

SEQ ID NO: 316671 - DNA, 25 bp, Homo sapien
catcctccacgttcactgttttgga

SEQ ID NO: 316672 - DNA, 25 bp, Homo sapien
tttggaactagttgttctcctctgc

SEQ ID NO: 316673 - DNA, 25 bp, Homo sapien
gttctcctctgcacaaagcgatttt

SEQ ID NO: 316674 - DNA, 25 bp, Homo sapien
aggctttccagagcagcttcgattc

SEQ ID NO: 316675 - DNA, 25 bp, Homo sapien
gcttcgattccaagcagtcctacca

SEQ ID NO: 316676 - DNA, 25 bp, Homo sapien
agtcctaccagggttcggaagctga

SEQ ID NO: 316677 - DNA, 25 bp, Homo sapien
agtttctatggctctgttcttgtcc

SEQ ID NO: 316678 - DNA, 25 bp, Homo sapien
aaaggtcaacgtgcactttctcctt

SEQ ID NO: 316679 - DNA, 25 bp, Homo sapien
gtcaacgtgcactttctccttgtcg

SEQ ID NO: 316680 - DNA, 25 bp, Homo sapien
tccttgtcgcctgacagacatttta

SEQ ID NO: 316681 - DNA, 25 bp, Homo sapien
gtcgcctgacagacattttatttta

SEQ ID NO: 316682 - DNA, 25 bp, Homo sapien
tattttactaagactgctgtaccga

SEQ ID NO: 316683 - DNA, 25 bp, Homo sapien
tactaagactgctgtaccgaacaag

SEQ ID NO: 316684 - DNA, 25 bp, Homo sapien
gtaccgaacaagcatatttatcatc

SEQ ID NO: 316685 - DNA, 25 bp, Homo sapien
gcatatttatcatcaggagacagga

SEQ ID NO: 316686 - DNA, 25 bp, Homo sapien
agacaggatgggtttaaagcaggat

SEQ ID NO: 316687 - DNA, 25 bp, Homo sapien
ggacctgatgccctcgggtgggagg

SEQ ID NO: 316688 - DNA, 25 bp, Homo sapien
caccctcgggtcaaaggtcaacgtg

SEQ ID NO: 316689 - DNA, 25 bp, Homo sapien
taaacatttgagcaccatgaaatca

SEQ ID NO: 316690 - DNA, 25 bp, Homo sapien
tcaaaataccctataactactttct

SEQ ID NO: 316691 - DNA, 25 bp, Homo sapien
aactactttctatagtcatatctaa

SEQ ID NO: 316692 - DNA, 25 bp, Homo sapien
ctgaaaagactttaccatagacaat

SEQ ID NO: 316693 - DNA, 25 bp, Homo sapien
gactttaccatagacaataacatgc

SEQ ID NO: 316694 - DNA, 25 bp, Homo sapien
ataacatgcagttttatcagcacca

SEQ ID NO: 316695 - DNA, 25 bp, Homo sapien
atgcagttttatcagcaccaaagaa

SEQ ID NO: 316696 - DNA, 25 bp, Homo sapien
tcagcaccaaagaatgttgtccaaa

SEQ ID NO: 316697 - DNA, 25 bp, Homo sapien
aatacctgtctttctatttataaca

SEQ ID NO: 316698 - DNA, 25 bp, Homo sapien
ctgtctttctatttataacatctga

SEQ ID NO: 316699 - DNA, 25 bp, Homo sapien
tgttcataaacatttgagcaccatg

SEQ ID NO: 316700 - DNA, 25 bp, Homo sapien
catctttcttgatcaacatcttttc

SEQ ID NO: 316701 - DNA, 25 bp, Homo sapien
atctttcttgatcaacatcttttct

SEQ ID NO: 316702 - DNA, 25 bp, Homo sapien
ctttcttgatcaacatcttttcttg

SEQ ID NO: 316703 - DNA, 25 bp, Homo sapien
ttcttgatcaacatcttttcttgcc

SEQ ID NO: 316704 - DNA, 25 bp, Homo sapien
tcttgatcaacatcttttcttgcct

SEQ ID NO: 316705 - DNA, 25 bp, Homo sapien
ttgatcaacatcttttcttgcctct

SEQ ID NO: 316706 - DNA, 25 bp, Homo sapien
gatcaacatcttttcttgcctctgt

SEQ ID NO: 316707 - DNA, 25 bp, Homo sapien
ttaaactggtattttatctttgatt

SEQ ID NO: 316708 - DNA, 25 bp, Homo sapien
attttatctttgattctccttcagc

SEQ ID NO: 316709 - DNA, 25 bp, Homo sapien
tcacccctggttctcatctttcttg

SEQ ID NO: 316710 - DNA, 25 bp, Homo sapien
ctggttctcatctttcttgatcaac

SEQ ID NO: 316711 - DNA, 25 bp, Homo sapien
caactccaagtccacagaatatttc

SEQ ID NO: 316712 - DNA, 25 bp, Homo sapien
aactccaagtccacagaatatttca

SEQ ID NO: 316713 - DNA, 25 bp, Homo sapien
aaactgcaggtatgcgcagacacca

SEQ ID NO: 316714 - DNA, 25 bp, Homo sapien
aactgcaggtatgcgcagacaccag

SEQ ID NO: 316715 - DNA, 25 bp, Homo sapien
tgcaggtatgcgcagacaccagcaa

SEQ ID NO: 316716 - DNA, 25 bp, Homo sapien
gcaggtatgcgcagacaccagcaaa

SEQ ID NO: 316717 - DNA, 25 bp, Homo sapien
caggtatgcgcagacaccagcaaac

SEQ ID NO: 316718 - DNA, 25 bp, Homo sapien
aaacatgttctatatagttgcatgt

SEQ ID NO: 316719 - DNA, 25 bp, Homo sapien
aacatgttctatatagttgcatgtg

SEQ ID NO: 316720 - DNA, 25 bp, Homo sapien
acatgttctatatagttgcatgtga

SEQ ID NO: 316721 - DNA, 25 bp, Homo sapien
catgttctatatagttgcatgtgac

SEQ ID NO: 316722 - DNA, 25 bp, Homo sapien
tgagttaaatcatagcaatcaaatg

SEQ ID NO: 316723 - DNA, 25 bp, Homo sapien
atcaaatgacttttgaaacgcattc

SEQ ID NO: 316724 - DNA, 25 bp, Homo sapien
gaaacgcattcatcacaagagacag

SEQ ID NO: 316725 - DNA, 25 bp, Homo sapien
gcattcatcacaagagacagcttag

SEQ ID NO: 316726 - DNA, 25 bp, Homo sapien
gaagaatgttctcttggggcttaaa

SEQ ID NO: 316727 - DNA, 25 bp, Homo sapien
gatgcaatatcgacttttatttggt

SEQ ID NO: 316728 - DNA, 25 bp, Homo sapien
tatcgacttttatttggtttctcaa

SEQ ID NO: 316729 - DNA, 25 bp, Homo sapien
gatacaaatatttactggtgaaagg

SEQ ID NO: 316730 - DNA, 25 bp, Homo sapien
ggtgaaaggtaccacaaaagtgctt

SEQ ID NO: 316731 - DNA, 25 bp, Homo sapien
aaaagtgctttatgcttcctatggg

SEQ ID NO: 316732 - DNA, 25 bp, Homo sapien
gggactctgtaacataaacttgagt

SEQ ID NO: 316733 - DNA, 25 bp, Homo sapien
tccagctgttatttgtcagaggaca

SEQ ID NO: 316734 - DNA, 25 bp, Homo sapien
ggacagctaggattggttcaccctt

SEQ ID NO: 316735 - DNA, 25 bp, Homo sapien
aggattggttcacccttgctctgag

SEQ ID NO: 316736 - DNA, 25 bp, Homo sapien
gagttggccccaaagcgagctatgc

SEQ ID NO: 316737 - DNA, 25 bp, Homo sapien
aagcgagctatgctgaactcttctc

SEQ ID NO: 316738 - DNA, 25 bp, Homo sapien
gtctttacatgcaagagggatccaa

SEQ ID NO: 316739 - DNA, 25 bp, Homo sapien
gatccaattatgacaggctgaccca

SEQ ID NO: 316740 - DNA, 25 bp, Homo sapien
ttatctactgagtaaggctgacctt

SEQ ID NO: 316741 - DNA, 25 bp, Homo sapien
ggctgaccttacctgagtttctgta

SEQ ID NO: 316742 - DNA, 25 bp, Homo sapien
gttaatactaatccatcatccctca

SEQ ID NO: 316743 - DNA, 25 bp, Homo sapien
atccatcatccctcacagagatgta

SEQ ID NO: 316744 - DNA, 25 bp, Homo sapien
tcccggcggcggtacgagagcccaa

SEQ ID NO: 316745 - DNA, 25 bp, Homo sapien
agagcccaacaggagaggattagct

SEQ ID NO: 316746 - DNA, 25 bp, Homo sapien
gagaggattagctgtgccaaggaac

SEQ ID NO: 316747 - DNA, 25 bp, Homo sapien
tagctgtgccaaggaacacgccact

SEQ ID NO: 316748 - DNA, 25 bp, Homo sapien
aaggaacacgccactgctgcctgtc

SEQ ID NO: 316749 - DNA, 25 bp, Homo sapien
ctccacttccatttttgcctttgtt

SEQ ID NO: 316750 - DNA, 25 bp, Homo sapien
tgtttttaacttgtgctcttgtgag

SEQ ID NO: 316751 - DNA, 25 bp, Homo sapien
tgctcttgtgagttcttggtgtgtt

SEQ ID NO: 316752 - DNA, 25 bp, Homo sapien
gagttcttggtgtgtttctttgtga

SEQ ID NO: 316753 - DNA, 25 bp, Homo sapien
cttggtgtgtttctttgtgagtttt

SEQ ID NO: 316754 - DNA, 25 bp, Homo sapien
ctgtgaaaccaagttgtcgtgcttt

SEQ ID NO: 316755 - DNA, 25 bp, Homo sapien
acctgcacgtgaacaagggttgaca

SEQ ID NO: 316756 - DNA, 25 bp, Homo sapien
ggttgacatgatacactatggcctt

SEQ ID NO: 316757 - DNA, 25 bp, Homo sapien
gggccaggtgaaaccccaagctaat

SEQ ID NO: 316758 - DNA, 25 bp, Homo sapien
aagctaatcactgcggtctttcaga

SEQ ID NO: 316759 - DNA, 25 bp, Homo sapien
tttcagagccggacagacaggtgcc

SEQ ID NO: 316760 - DNA, 25 bp, Homo sapien
aagggaagcccaaacactttgcacg

SEQ ID NO: 316761 - DNA, 25 bp, Homo sapien
actttgcacgctgtgctgcagacat

SEQ ID NO: 316762 - DNA, 25 bp, Homo sapien
acattctggcctggtgtgtctgaaa

SEQ ID NO: 316763 - DNA, 25 bp, Homo sapien
tgaaagttgcatcagtcctcacggt

SEQ ID NO: 316764 - DNA, 25 bp, Homo sapien
agtcctcacggtgcaaacacagttg

SEQ ID NO: 316765 - DNA, 25 bp, Homo sapien
atgacactgaaatcctacagaccaa

SEQ ID NO: 316766 - DNA, 25 bp, Homo sapien
gggtttatacgtgtatagccttcaa

SEQ ID NO: 316767 - DNA, 25 bp, Homo sapien
cgtgtatagccttcaaatgaagcgt

SEQ ID NO: 316768 - DNA, 25 bp, Homo sapien
aaatgaagcgtgtgattgcctgcca

SEQ ID NO: 316769 - DNA, 25 bp, Homo sapien
gaagcgtgtgattgcctgccagaaa

SEQ ID NO: 316770 - DNA, 25 bp, Homo sapien
gattgcctgccagaaaactgcacat

SEQ ID NO: 316771 - DNA, 25 bp, Homo sapien
gcctgccagaaaactgcacatgact

SEQ ID NO: 316772 - DNA, 25 bp, Homo sapien
gccagacttccaaacaggcagttaa

SEQ ID NO: 316773 - DNA, 25 bp, Homo sapien
ttccaaacaggcagttaatctcatg

SEQ ID NO: 316774 - DNA, 25 bp, Homo sapien
cagaagatggcagtgtacgcatttg

SEQ ID NO: 316775 - DNA, 25 bp, Homo sapien
ggcagtgtacgcatttgggagttaa

SEQ ID NO: 316776 - DNA, 25 bp, Homo sapien
aaaaacagcagcttgcagctgagcc

SEQ ID NO: 316777 - DNA, 25 bp, Homo sapien
gagccagagctggtctatccagcat

SEQ ID NO: 316778 - DNA, 25 bp, Homo sapien
cagcatggcctagctctgagatgac

SEQ ID NO: 316779 - DNA, 25 bp, Homo sapien
tgagatgacgaccagacctgcttcc

SEQ ID NO: 316780 - DNA, 25 bp, Homo sapien
agccactgagtgatccaccgtggag

SEQ ID NO: 316781 - DNA, 25 bp, Homo sapien
atccaccgtggagggcacttgagat

SEQ ID NO: 316782 - DNA, 25 bp, Homo sapien
acttgagattaagtcccagcccctg

SEQ ID NO: 316783 - DNA, 25 bp, Homo sapien
tttcagcttggttcttccttcaaaa

SEQ ID NO: 316784 - DNA, 25 bp, Homo sapien
aaatgccatgcaacctgtatttatt

SEQ ID NO: 316785 - DNA, 25 bp, Homo sapien
tttttaatgacagcactccctctaa

SEQ ID NO: 316786 - DNA, 25 bp, Homo sapien
aaaaagttttcatcctgcctgatca

SEQ ID NO: 316787 - DNA, 25 bp, Homo sapien
gcctgatcatttcactggtggctga

SEQ ID NO: 316788 - DNA, 25 bp, Homo sapien
cccgtcggagactcaatcttcgcat

SEQ ID NO: 316789 - DNA, 25 bp, Homo sapien
ccgtcggagactcaatcttcgcatc

SEQ ID NO: 316790 - DNA, 25 bp, Homo sapien
cgtcggagactcaatcttcgcatct

SEQ ID NO: 316791 - DNA, 25 bp, Homo sapien
gtcggagactcaatcttcgcatctg

SEQ ID NO: 316792 - DNA, 25 bp, Homo sapien
cgcaggggtgcaaatgggtggccgt

SEQ ID NO: 316793 - DNA, 25 bp, Homo sapien
gggccgaagggctgaaccactgggc

SEQ ID NO: 316794 - DNA, 25 bp, Homo sapien
gccgaagggctgaaccactgggccc

SEQ ID NO: 316795 - DNA, 25 bp, Homo sapien
ccgaagggctgaaccactgggcccg

SEQ ID NO: 316796 - DNA, 25 bp, Homo sapien
aagggctgaaccactgggcccggat

SEQ ID NO: 316797 - DNA, 25 bp, Homo sapien
agggctgaaccactgggcccggatg

SEQ ID NO: 316798 - DNA, 25 bp, Homo sapien
ggctgaaccactgggcccggatggg

SEQ ID NO: 316799 - DNA, 25 bp, Homo sapien
ggaagagggtcatttgcatgtgcta

SEQ ID NO: 316800 - DNA, 25 bp, Homo sapien
ttgcatgtgctaggagctgtcttcc

SEQ ID NO: 316801 - DNA, 25 bp, Homo sapien
atgtgctaggagctgtcttccctgt

SEQ ID NO: 316802 - DNA, 25 bp, Homo sapien
ctgtcttccctgttcagaatgaaat

SEQ ID NO: 316803 - DNA, 25 bp, Homo sapien
attggttaggacagagaaccgtgtc

SEQ ID NO: 316804 - DNA, 25 bp, Homo sapien
acagagaaccgtgtctgagctaacc

SEQ ID NO: 316805 - DNA, 25 bp, Homo sapien
aaccaagtggaacagaattccctat

SEQ ID NO: 316806 - DNA, 25 bp, Homo sapien
gaattccctatggtcaaattaagtg

SEQ ID NO: 316807 - DNA, 25 bp, Homo sapien
aagtgatctctttatttcgccatcc

SEQ ID NO: 316808 - DNA, 25 bp, Homo sapien
tctttatttcgccatcctgattgaa

SEQ ID NO: 316809 - DNA, 25 bp, Homo sapien
tttcgccatcctgattgaataatct

SEQ ID NO: 316810 - DNA, 25 bp, Homo sapien
aaatgttcatatgctcgagagtcca

SEQ ID NO: 316811 - DNA, 25 bp, Homo sapien
gctcgagagtccagagtcactctgt

SEQ ID NO: 316812 - DNA, 25 bp, Homo sapien
agagtcactctgttctacggttcat

SEQ ID NO: 316813 - DNA, 25 bp, Homo sapien
agtcactctgttctacggttcatgt

SEQ ID NO: 316814 - DNA, 25 bp, Homo sapien
gttctacggttcatgtagctagcta

SEQ ID NO: 316815 - DNA, 25 bp, Homo sapien
ctacggttcatgtagctagctatat

SEQ ID NO: 316816 - DNA, 25 bp, Homo sapien
ctagctatattacaagcccaccaag

SEQ ID NO: 316817 - DNA, 25 bp, Homo sapien
taacagtgccattggtgttccttct

SEQ ID NO: 316818 - DNA, 25 bp, Homo sapien
gccattggtgttccttctgtttata

SEQ ID NO: 316819 - DNA, 25 bp, Homo sapien
ttggtgttccttctgtttataattg

SEQ ID NO: 316820 - DNA, 25 bp, Homo sapien
gtgttccttctgtttataattgatc

SEQ ID NO: 316821 - DNA, 25 bp, Homo sapien
ctgttaccagaggtggttaccacag

SEQ ID NO: 316822 - DNA, 25 bp, Homo sapien
tacagttagctatggatcacattcc

SEQ ID NO: 316823 - DNA, 25 bp, Homo sapien
ggatcacattccattgcactctagc

SEQ ID NO: 316824 - DNA, 25 bp, Homo sapien
ggtggttaccacaggcgtatccatt

SEQ ID NO: 316825 - DNA, 25 bp, Homo sapien
agaccctgtctgtaattcgttctgt

SEQ ID NO: 316826 - DNA, 25 bp, Homo sapien
gtctgtaattcgttctgtgcatttt

SEQ ID NO: 316827 - DNA, 25 bp, Homo sapien
cacaggcgtatccatttacccaaat

SEQ ID NO: 316828 - DNA, 25 bp, Homo sapien
gcgtatccatttacccaaattccat

SEQ ID NO: 316829 - DNA, 25 bp, Homo sapien
catttacccaaattccatccggact

SEQ ID NO: 316830 - DNA, 25 bp, Homo sapien
ttccatccggacttacacttaaaat

SEQ ID NO: 316831 - DNA, 25 bp, Homo sapien
aaatcagtgcatttttcgtggggca

SEQ ID NO: 316832 - DNA, 25 bp, Homo sapien
gtagtctatgggaatctgtgtcctt

SEQ ID NO: 316833 - DNA, 25 bp, Homo sapien
aatctgtgtccttgcctccttaaaa

SEQ ID NO: 316834 - DNA, 25 bp, Homo sapien
aagagccaaagcaaacctgtcattt

SEQ ID NO: 316835 - DNA, 25 bp, Homo sapien
acctgtcatttttgatagcttctga

SEQ ID NO: 316836 - DNA, 25 bp, Homo sapien
tctgaaataataagcccctgtacct

SEQ ID NO: 316837 - DNA, 25 bp, Homo sapien
taagcccctgtacctgttatttttg

SEQ ID NO: 316838 - DNA, 25 bp, Homo sapien
gtacctgttatttttgggctctggg

SEQ ID NO: 316839 - DNA, 25 bp, Homo sapien
aaactgctctgggagtcagtccatt

SEQ ID NO: 316840 - DNA, 25 bp, Homo sapien
gggagtcagtccattaaatagtgct

SEQ ID NO: 316841 - DNA, 25 bp, Homo sapien
gctgactttagataactttctggac

SEQ ID NO: 316842 - DNA, 25 bp, Homo sapien
acagctattggtttaagattctttt

SEQ ID NO: 316843 - DNA, 25 bp, Homo sapien
gaaactctttgacctggcctcggta

SEQ ID NO: 316844 - DNA, 25 bp, Homo sapien
aactctttgacctggcctcggtatc

SEQ ID NO: 316845 - DNA, 25 bp, Homo sapien
ttgacctggcctcggtatcctcaca

SEQ ID NO: 316846 - DNA, 25 bp, Homo sapien
tggcctcggtatcctcacatttaaa

SEQ ID NO: 316847 - DNA, 25 bp, Homo sapien
agttggcttatatgattggctggca

SEQ ID NO: 316848 - DNA, 25 bp, Homo sapien
atgattggctggcatatttggctca

SEQ ID NO: 316849 - DNA, 25 bp, Homo sapien
gattggctggcatatttggctcatc

SEQ ID NO: 316850 - DNA, 25 bp, Homo sapien
ttggctggcatatttggctcatctc

SEQ ID NO: 316851 - DNA, 25 bp, Homo sapien
gctggcatatttggctcatctcgaa

SEQ ID NO: 316852 - DNA, 25 bp, Homo sapien
ttggctcatctcgaagactgtctat

SEQ ID NO: 316853 - DNA, 25 bp, Homo sapien
agggcaaatggtagtgcctcattgc

SEQ ID NO: 316854 - DNA, 25 bp, Homo sapien
agttgataggccactgagctatggg

SEQ ID NO: 316855 - DNA, 25 bp, Homo sapien
taggccactgagctatgggcagcca

SEQ ID NO: 316856 - DNA, 25 bp, Homo sapien
tatgggcagccacatgtgttcctga

SEQ ID NO: 316857 - DNA, 25 bp, Homo sapien
gggcagccacatgtgttcctgatgg

SEQ ID NO: 316858 - DNA, 25 bp, Homo sapien
ttcctgatggaagggactgagtatc

SEQ ID NO: 316859 - DNA, 25 bp, Homo sapien
gaagggactgagtatctcccagaga

SEQ ID NO: 316860 - DNA, 25 bp, Homo sapien
gagtatctcccagagatcctggaca

SEQ ID NO: 316861 - DNA, 25 bp, Homo sapien
gatcctggacacgaggagacatgct

SEQ ID NO: 316862 - DNA, 25 bp, Homo sapien
cagtcctgagagagaagactctaaa

SEQ ID NO: 316863 - DNA, 25 bp, Homo sapien
gactctaaatccagaatttcttcag

SEQ ID NO: 316864 - DNA, 25 bp, Homo sapien
ctaaatccagaatttcttcaggcat

SEQ ID NO: 316865 - DNA, 25 bp, Homo sapien
tgcctccgcatttagtcctgctctg

SEQ ID NO: 316866 - DNA, 25 bp, Homo sapien
gcctccgcatttagtcctgctctgg

SEQ ID NO: 316867 - DNA, 25 bp, Homo sapien
tagtcctgctctggcctagggcaca

SEQ ID NO: 316868 - DNA, 25 bp, Homo sapien
tcctgctctggcctagggcacaggc

SEQ ID NO: 316869 - DNA, 25 bp, Homo sapien
aagctccttaatggtagggctgagg

SEQ ID NO: 316870 - DNA, 25 bp, Homo sapien
acaggccatcctggggatacgggca

SEQ ID NO: 316871 - DNA, 25 bp, Homo sapien
gcacggggttagaaacgctcccaag

SEQ ID NO: 316872 - DNA, 25 bp, Homo sapien
gagccaaggccagaggagccgctgg

SEQ ID NO: 316873 - DNA, 25 bp, Homo sapien
gaggggctggcaccggcccaggagt

SEQ ID NO: 316874 - DNA, 25 bp, Homo sapien
gggctgccctttgccctagctgcag

SEQ ID NO: 316875 - DNA, 25 bp, Homo sapien
tgccctttgccctagctgcagtcac

SEQ ID NO: 316876 - DNA, 25 bp, Homo sapien
gtgtttaggctagaaatgcctccca

SEQ ID NO: 316877 - DNA, 25 bp, Homo sapien
gaaatgcctcccacattggtaataa

SEQ ID NO: 316878 - DNA, 25 bp, Homo sapien
aaaatgcattatgccatggttgctt

SEQ ID NO: 316879 - DNA, 25 bp, Homo sapien
gccatggttgcttttgagatagatt

SEQ ID NO: 316880 - DNA, 25 bp, Homo sapien
attgtagtctgggtagcatctttaa

SEQ ID NO: 316881 - DNA, 25 bp, Homo sapien
atgtatgtgggcttaactgttgttc

SEQ ID NO: 316882 - DNA, 25 bp, Homo sapien
gtgggcttaactgttgttcatatca

SEQ ID NO: 316883 - DNA, 25 bp, Homo sapien
ggagatgctctgattgtataggtga

SEQ ID NO: 316884 - DNA, 25 bp, Homo sapien
gattgtataggtgagactctgtttc

SEQ ID NO: 316885 - DNA, 25 bp, Homo sapien
gatcagattattttactaccaacag

SEQ ID NO: 316886 - DNA, 25 bp, Homo sapien
gtttgaaagtccaactgtattaatt

SEQ ID NO: 316887 - DNA, 25 bp, Homo sapien
cctgccttagctcccaagtagctgg

SEQ ID NO: 316888 - DNA, 25 bp, Homo sapien
ttttgtattttttgcagtgatggga

SEQ ID NO: 316889 - DNA, 25 bp, Homo sapien
tttgtattttttgcagtgatgggat

SEQ ID NO: 316890 - DNA, 25 bp, Homo sapien
ttgtattttttgcagtgatgggatt

SEQ ID NO: 316891 - DNA, 25 bp, Homo sapien
tgtattttttgcagtgatgggattt

SEQ ID NO: 316892 - DNA, 25 bp, Homo sapien
gtattttttgcagtgatgggatttt

SEQ ID NO: 316893 - DNA, 25 bp, Homo sapien
tattttttgcagtgatgggattttg

SEQ ID NO: 316894 - DNA, 25 bp, Homo sapien
attttttgcagtgatgggattttgc

SEQ ID NO: 316895 - DNA, 25 bp, Homo sapien
ttttttgcagtgatgggattttgcc

SEQ ID NO: 316896 - DNA, 25 bp, Homo sapien
tttttgcagtgatgggattttgcca

SEQ ID NO: 316897 - DNA, 25 bp, Homo sapien
acgtgcacactcgtacatacacacc

SEQ ID NO: 316898 - DNA, 25 bp, Homo sapien
atcctgctttaaacccatcctgtct

SEQ ID NO: 316899 - DNA, 25 bp, Homo sapien
taaacccatcctgtctcctgatgat

SEQ ID NO: 316900 - DNA, 25 bp, Homo sapien
tctcctgatgataaatatgcttgtt

SEQ ID NO: 316901 - DNA, 25 bp, Homo sapien
gatgataaatatgcttgttcggtac

SEQ ID NO: 316902 - DNA, 25 bp, Homo sapien
gcttgttcggtacagcagtcttagt

SEQ ID NO: 316903 - DNA, 25 bp, Homo sapien
gttcggtacagcagtcttagtaaaa

SEQ ID NO: 316904 - DNA, 25 bp, Homo sapien
taaaatgtctgtcaggcgacaagga

SEQ ID NO: 316905 - DNA, 25 bp, Homo sapien
gacaaggagaaagtgcacgttgacc

SEQ ID NO: 316906 - DNA, 25 bp, Homo sapien
gaaagtgcacgttgacctttgaccc

SEQ ID NO: 316907 - DNA, 25 bp, Homo sapien
aagtgcacgttgacctttgacccga

SEQ ID NO: 316908 - DNA, 25 bp, Homo sapien
gaaactctttgacctggcctcggta

SEQ ID NO: 316909 - DNA, 25 bp, Homo sapien
aactctttgacctggcctcggtatc

SEQ ID NO: 316910 - DNA, 25 bp, Homo sapien
ttgacctggcctcggtatcctcaca

SEQ ID NO: 316911 - DNA, 25 bp, Homo sapien
cctggcctcggtatcctcacattta

SEQ ID NO: 316912 - DNA, 25 bp, Homo sapien
gagttggcttatatgattggctggc

SEQ ID NO: 316913 - DNA, 25 bp, Homo sapien
gttggcttatatgattggctggcat

SEQ ID NO: 316914 - DNA, 25 bp, Homo sapien
atgattggctggcatatttggctca

SEQ ID NO: 316915 - DNA, 25 bp, Homo sapien
gattggctggcatatttggctcatc

SEQ ID NO: 316916 - DNA, 25 bp, Homo sapien
ttggctggcatatttggctcatctc

SEQ ID NO: 316917 - DNA, 25 bp, Homo sapien
ggctggcatatttggctcatctcga

SEQ ID NO: 316918 - DNA, 25 bp, Homo sapien
gctggcatatttggctcatctcgaa

SEQ ID NO: 316919 - DNA, 25 bp, Homo sapien
gcaggtatgcgcagacaccagcaaa

SEQ ID NO: 316920 - DNA, 25 bp, Homo sapien
gacaacagggatcaacgacgggacc

SEQ ID NO: 316921 - DNA, 25 bp, Homo sapien
ggaccctccacagtatccagtggtt

SEQ ID NO: 316922 - DNA, 25 bp, Homo sapien
gttccagttcacctgcataccatca

SEQ ID NO: 316923 - DNA, 25 bp, Homo sapien
tcacctgcataccatcatctaagct

SEQ ID NO: 316924 - DNA, 25 bp, Homo sapien
atccctccatgtactctgggtgtca

SEQ ID NO: 316925 - DNA, 25 bp, Homo sapien
tctgggtgtcagcatctgtcctctt

SEQ ID NO: 316926 - DNA, 25 bp, Homo sapien
agcatctgtcctcttcagtctctat

SEQ ID NO: 316927 - DNA, 25 bp, Homo sapien
ttcagtctctataccccttccactt

SEQ ID NO: 316928 - DNA, 25 bp, Homo sapien
tataccccttccacttgcctgagct

SEQ ID NO: 316929 - DNA, 25 bp, Homo sapien
cttgcctgagctgaagtgccttgtg

SEQ ID NO: 316930 - DNA, 25 bp, Homo sapien
caccatttgtgaacccatttttcat

SEQ ID NO: 316931 - DNA, 25 bp, Homo sapien
aaaattctggttgggattttgattg

SEQ ID NO: 316932 - DNA, 25 bp, Homo sapien
catttgaggaggatggatatcttta

SEQ ID NO: 316933 - DNA, 25 bp, Homo sapien
gttaagccatactatcaaagagcac

SEQ ID NO: 316934 - DNA, 25 bp, Homo sapien
atactatcaaagagcacggtttttt

SEQ ID NO: 316935 - DNA, 25 bp, Homo sapien
aatttccatggctttatagtgtaac

SEQ ID NO: 316936 - DNA, 25 bp, Homo sapien
tccatggctttatagtgtaacttaa

SEQ ID NO: 316937 - DNA, 25 bp, Homo sapien
aacttaatatttgatgggaccagtc

SEQ ID NO: 316938 - DNA, 25 bp, Homo sapien
atttgatgggaccagtctcacttct

SEQ ID NO: 316939 - DNA, 25 bp, Homo sapien
atgggaccagtctcacttctttgtc

SEQ ID NO: 316940 - DNA, 25 bp, Homo sapien
ggaccagtctcacttctttgtcctt

SEQ ID NO: 316941 - DNA, 25 bp, Homo sapien
actgtgaatagccattgtattgttt

SEQ ID NO: 316942 - DNA, 25 bp, Homo sapien
gataaatcagttgttttgggcccct

SEQ ID NO: 316943 - DNA, 25 bp, Homo sapien
taaatcagttgttttgggcccctat

SEQ ID NO: 316944 - DNA, 25 bp, Homo sapien
aaattttgatgcttttcgtggataa

SEQ ID NO: 316945 - DNA, 25 bp, Homo sapien
tcgtggataaaagtagtgcctctct

SEQ ID NO: 316946 - DNA, 25 bp, Homo sapien
ggataaaagtagtgcctctctttat

SEQ ID NO: 316947 - DNA, 25 bp, Homo sapien
aagtagtgcctctctttatacaact

SEQ ID NO: 316948 - DNA, 25 bp, Homo sapien
gtaacgcaaataactacttcctgat

SEQ ID NO: 316949 - DNA, 25 bp, Homo sapien
aactacttcctgatttacatctcaa

SEQ ID NO: 316950 - DNA, 25 bp, Homo sapien
tacttcctgatttacatctcaatat

SEQ ID NO: 316951 - DNA, 25 bp, Homo sapien
acatctcaatatattcttctttcat

SEQ ID NO: 316952 - DNA, 25 bp, Homo sapien
ggaaagggtcaagattaccagccat

SEQ ID NO: 316953 - DNA, 25 bp, Homo sapien
aagggtcaagattaccagccattga

SEQ ID NO: 316954 - DNA, 25 bp, Homo sapien
ggtcaagattaccagccattgacca

SEQ ID NO: 316955 - DNA, 25 bp, Homo sapien
agggccttagcctgggaagcacagc

SEQ ID NO: 316956 - DNA, 25 bp, Homo sapien
gccttagcctgggaagcacagcttc

SEQ ID NO: 316957 - DNA, 25 bp, Homo sapien
gaagcacagcttctccgtcaagttt

SEQ ID NO: 316958 - DNA, 25 bp, Homo sapien
agcacagcttctccgtcaagttttt

SEQ ID NO: 316959 - DNA, 25 bp, Homo sapien
ttctccgtcaagtttttcccgagct

SEQ ID NO: 316960 - DNA, 25 bp, Homo sapien
gctcccctcgcaatacaccaggaag

SEQ ID NO: 316961 - DNA, 25 bp, Homo sapien
tcacagagcggaacgctccacgaga

SEQ ID NO: 316962 - DNA, 25 bp, Homo sapien
agcggaacgctccacgagaatcgtg

SEQ ID NO: 316963 - DNA, 25 bp, Homo sapien
cactcgtcactcacgggctgttgct

SEQ ID NO: 316964 - DNA, 25 bp, Homo sapien
caggcctggtctcggcgactcctgg

SEQ ID NO: 316965 - DNA, 25 bp, Homo sapien
tgctgccaggatgccgaaggatacc

SEQ ID NO: 316966 - DNA, 25 bp, Homo sapien
gggccttccaccttaagggcacagg

SEQ ID NO: 316967 - DNA, 25 bp, Homo sapien
gccttccaccttaagggcacaggag

SEQ ID NO: 316968 - DNA, 25 bp, Homo sapien
cttccaccttaagggcacaggagag

SEQ ID NO: 316969 - DNA, 25 bp, Homo sapien
gcacaggagagctgacacgggcctt

SEQ ID NO: 316970 - DNA, 25 bp, Homo sapien
acaggagagctgacacgggccttgc

SEQ ID NO: 316971 - DNA, 25 bp, Homo sapien
gctgacacgggccttgctggttctc

SEQ ID NO: 316972 - DNA, 25 bp, Homo sapien
gacacgggccttgctggttctccgg

SEQ ID NO: 316973 - DNA, 25 bp, Homo sapien
ggccttgctggttctccggctgtgt

SEQ ID NO: 316974 - DNA, 25 bp, Homo sapien
attagctcggtaaaatatacccagg

SEQ ID NO: 316975 - DNA, 25 bp, Homo sapien
aaatatacccaggaccataaacaga

SEQ ID NO: 316976 - DNA, 25 bp, Homo sapien
tacccaggaccataaacagatgaaa

SEQ ID NO: 316977 - DNA, 25 bp, Homo sapien
aacagatgaaaggtagaccaagtct

SEQ ID NO: 316978 - DNA, 25 bp, Homo sapien
gtagaccaagtctgattttagatac

SEQ ID NO: 316979 - DNA, 25 bp, Homo sapien
gaccaagtctgattttagatacacc

SEQ ID NO: 316980 - DNA, 25 bp, Homo sapien
gtctgattttagatacacctgctat

SEQ ID NO: 316981 - DNA, 25 bp, Homo sapien
gattttagatacacctgctatgaga

SEQ ID NO: 316982 - DNA, 25 bp, Homo sapien
ttagatacacctgctatgagacatg

SEQ ID NO: 316983 - DNA, 25 bp, Homo sapien
gatacacctgctatgagacatgtta

SEQ ID NO: 316984 - DNA, 25 bp, Homo sapien
acacctgctatgagacatgttaaag

SEQ ID NO: 316985 - DNA, 25 bp, Homo sapien
gccagcattggtgtaatatttttca

SEQ ID NO: 316986 - DNA, 25 bp, Homo sapien
aatgtgataaacacctgacccctat

SEQ ID NO: 316987 - DNA, 25 bp, Homo sapien
ataaacacctgacccctattagcgg

SEQ ID NO: 316988 - DNA, 25 bp, Homo sapien
gggactctgaattaactggagcttt

SEQ ID NO: 316989 - DNA, 25 bp, Homo sapien
aactggagctttgatttcgaggtct

SEQ ID NO: 316990 - DNA, 25 bp, Homo sapien
ttgatttcgaggtctgctttcagca

SEQ ID NO: 316991 - DNA, 25 bp, Homo sapien
tcgaggtctgctttcagcagcaaga

SEQ ID NO: 316992 - DNA, 25 bp, Homo sapien
agcagcaagaggcaaattggctaga

SEQ ID NO: 316993 - DNA, 25 bp, Homo sapien
gcccctgagtctgtcatttgttgac

SEQ ID NO: 316994 - DNA, 25 bp, Homo sapien
atttgttgactgtttggaactagtg

SEQ ID NO: 316995 - DNA, 25 bp, Homo sapien
ggaactagtgaaagccagcattggt

SEQ ID NO: 316996 - DNA, 25 bp, Homo sapien
atctgcaggcttgctaagatctcct

SEQ ID NO: 316997 - DNA, 25 bp, Homo sapien
taagatctcctgacctaggcgctgt

SEQ ID NO: 316998 - DNA, 25 bp, Homo sapien
tgggctgcagagctggctcttccta

SEQ ID NO: 316999 - DNA, 25 bp, Homo sapien
tggctcttcctagctggctaactat

SEQ ID NO: 317000 - DNA, 25 bp, Homo sapien
gctggctaactatcctgaatcagta

SEQ ID NO: 317001 - DNA, 25 bp, Homo sapien
gggaaatcgaatccaaactggctta

SEQ ID NO: 317002 - DNA, 25 bp, Homo sapien
ttgattaacatgactcaggagacca

SEQ ID NO: 317003 - DNA, 25 bp, Homo sapien
caggagaccagaactctatagagaa

SEQ ID NO: 317004 - DNA, 25 bp, Homo sapien
tatagagaacatggcctgacagtgg

SEQ ID NO: 317005 - DNA, 25 bp, Homo sapien
tgcttgccttcctgatagtcttccc

SEQ ID NO: 317006 - DNA, 25 bp, Homo sapien
gatagtcttcccctttatgaatgaa

SEQ ID NO: 317007 - DNA, 25 bp, Homo sapien
tgtgttgcgcactttgaggtatttc

SEQ ID NO: 317008 - DNA, 25 bp, Homo sapien
gcgcactttgaggtatttccactac

SEQ ID NO: 317009 - DNA, 25 bp, Homo sapien
ctttgaggtatttccactacagttg

SEQ ID NO: 317010 - DNA, 25 bp, Homo sapien
attcagttgctgcttttcctgttta

SEQ ID NO: 317011 - DNA, 25 bp, Homo sapien
gcttttcctgtttattattactatc

SEQ ID NO: 317012 - DNA, 25 bp, Homo sapien
tactatcttttgtaatcggaggttt

SEQ ID NO: 317013 - DNA, 25 bp, Homo sapien
ttactaccgagatataactaaatgc

SEQ ID NO: 317014 - DNA, 25 bp, Homo sapien
actaaatgcagctctgttgggccca

SEQ ID NO: 317015 - DNA, 25 bp, Homo sapien
aaatgcagctctgttgggcccaggg

SEQ ID NO: 317016 - DNA, 25 bp, Homo sapien
tagggcagcctttttagagcccttc

SEQ ID NO: 317017 - DNA, 25 bp, Homo sapien
gcagcctttttagagcccttccttt

SEQ ID NO: 317018 - DNA, 25 bp, Homo sapien
ctcctgggaagtggcctgcaagcac

SEQ ID NO: 317019 - DNA, 25 bp, Homo sapien
gggaagtggcctgcaagcacctgct

SEQ ID NO: 317020 - DNA, 25 bp, Homo sapien
cctctggaggtcacagggtagctgc

SEQ ID NO: 317021 - DNA, 25 bp, Homo sapien
ctggaggtcacagggtagctgccct

SEQ ID NO: 317022 - DNA, 25 bp, Homo sapien
tggccgtccctctggtgcagatgtc

SEQ ID NO: 317023 - DNA, 25 bp, Homo sapien
ctggtgcagatgtcctcggtggccc

SEQ ID NO: 317024 - DNA, 25 bp, Homo sapien
agatgtcctcggtggccccggtccg

SEQ ID NO: 317025 - DNA, 25 bp, Homo sapien
tccggtcgtgtcacctggcccaggt

SEQ ID NO: 317026 - DNA, 25 bp, Homo sapien
gtacctggtgtcgtggggtcatctc

SEQ ID NO: 317027 - DNA, 25 bp, Homo sapien
catctcggggcagcatcctggtgct

SEQ ID NO: 317028 - DNA, 25 bp, Homo sapien
tggtgctgggcggtctcggctctga

SEQ ID NO: 317029 - DNA, 25 bp, Homo sapien
attcctcacactatatttacattaa

SEQ ID NO: 317030 - DNA, 25 bp, Homo sapien
agatgacctgaccaaaaactttaca

SEQ ID NO: 317031 - DNA, 25 bp, Homo sapien
aaaactttacaggattcataaatca

SEQ ID NO: 317032 - DNA, 25 bp, Homo sapien
ggattcataaatcagggatcatttt

SEQ ID NO: 317033 - DNA, 25 bp, Homo sapien
aatcagggatcattttgctattgac

SEQ ID NO: 317034 - DNA, 25 bp, Homo sapien
gggatcattttgctattgacttcac

SEQ ID NO: 317035 - DNA, 25 bp, Homo sapien
gatcattttgctattgacttcacag

SEQ ID NO: 317036 - DNA, 25 bp, Homo sapien
cattttgctattgacttcacagtaa

SEQ ID NO: 317037 - DNA, 25 bp, Homo sapien
gctattgacttcacagtaatcagta

SEQ ID NO: 317038 - DNA, 25 bp, Homo sapien
gacttcacagtaatcagtagtttta

SEQ ID NO: 317039 - DNA, 25 bp, Homo sapien
agttaatttgcagcattttagtact

SEQ ID NO: 317040 - DNA, 25 bp, Homo sapien
ttgctcctggtatttaacaactgtc

SEQ ID NO: 317041 - DNA, 25 bp, Homo sapien
aaatcttactactacagagtcactt

SEQ ID NO: 317042 - DNA, 25 bp, Homo sapien
agagtcacttttacaatgagacctg

SEQ ID NO: 317043 - DNA, 25 bp, Homo sapien
atgagacctgcactttatgccagca

SEQ ID NO: 317044 - DNA, 25 bp, Homo sapien
atgccagcactgtttgtgaggagca

SEQ ID NO: 317045 - DNA, 25 bp, Homo sapien
gagcagtactgccttaaattagttt

SEQ ID NO: 317046 - DNA, 25 bp, Homo sapien
gactgatgtcagtgtacgttacttc

SEQ ID NO: 317047 - DNA, 25 bp, Homo sapien
acgttacttcctttatgtgactgac

SEQ ID NO: 317048 - DNA, 25 bp, Homo sapien
gacagtcagctttccattgagatat

SEQ ID NO: 317049 - DNA, 25 bp, Homo sapien
gatgatccccaagtatccttgtcat

SEQ ID NO: 317050 - DNA, 25 bp, Homo sapien
gtcatcagaagctttggaccttttc

SEQ ID NO: 317051 - DNA, 25 bp, Homo sapien
tgggagaagccctggccggcatgga

SEQ ID NO: 317052 - DNA, 25 bp, Homo sapien
gttgacccaaagaaccttgacacca

SEQ ID NO: 317053 - DNA, 25 bp, Homo sapien
aaagaaccttgacaccactccagtt

SEQ ID NO: 317054 - DNA, 25 bp, Homo sapien
aaccttgacaccactccagttgtca

SEQ ID NO: 317055 - DNA, 25 bp, Homo sapien
ctgtctgaagaagagcagatggcct

SEQ ID NO: 317056 - DNA, 25 bp, Homo sapien
aagaagagcagatggcctggctgct

SEQ ID NO: 317057 - DNA, 25 bp, Homo sapien
gggcgattatccatctttgctacat

SEQ ID NO: 317058 - DNA, 25 bp, Homo sapien
ggcgattatccatctttgctacatt

SEQ ID NO: 317059 - DNA, 25 bp, Homo sapien
gcgattatccatctttgctacatta

SEQ ID NO: 317060 - DNA, 25 bp, Homo sapien
gattatccatctttgctacattaca

SEQ ID NO: 317061 - DNA, 25 bp, Homo sapien
tatccatctttgctacattacagaa

SEQ ID NO: 317062 - DNA, 25 bp, Homo sapien
ggaactctgagcagctaaactctga

SEQ ID NO: 317063 - DNA, 25 bp, Homo sapien
ggtatacctgcgttttctcttcacc

SEQ ID NO: 317064 - DNA, 25 bp, Homo sapien
tttctcttcaccagacaaactgcgg

SEQ ID NO: 317065 - DNA, 25 bp, Homo sapien
ggaccagctggtgaaacataattct

SEQ ID NO: 317066 - DNA, 25 bp, Homo sapien
acataattctgaatcctgcccacag

SEQ ID NO: 317067 - DNA, 25 bp, Homo sapien
acagccttcggtggttttggatgaa

SEQ ID NO: 317068 - DNA, 25 bp, Homo sapien
gttttggatgaaaggccagcgcctt

SEQ ID NO: 317069 - DNA, 25 bp, Homo sapien
tgggagccctgcgtttgatttcaag

SEQ ID NO: 317070 - DNA, 25 bp, Homo sapien
tgatttcaagttttaaggccggcac

SEQ ID NO: 317071 - DNA, 25 bp, Homo sapien
tttaaggccggcactggtggagcaa

SEQ ID NO: 317072 - DNA, 25 bp, Homo sapien
agcactgtgggctctcagtttattg

SEQ ID NO: 317073 - DNA, 25 bp, Homo sapien
gaatcccagctctggcccttatcaa

SEQ ID NO: 317074 - DNA, 25 bp, Homo sapien
ccagctctggcccttatcaattctg

SEQ ID NO: 317075 - DNA, 25 bp, Homo sapien
cagctctggcccttatcaattctgt

SEQ ID NO: 317076 - DNA, 25 bp, Homo sapien
agctctggcccttatcaattctgtg

SEQ ID NO: 317077 - DNA, 25 bp, Homo sapien
gctctggcccttatcaattctgtga

SEQ ID NO: 317078 - DNA, 25 bp, Homo sapien
aattctgtgatcttatagaaggccg

SEQ ID NO: 317079 - DNA, 25 bp, Homo sapien
attctgtgatcttatagaaggccgg

SEQ ID NO: 317080 - DNA, 25 bp, Homo sapien
ttctgtgatcttatagaaggccggg

SEQ ID NO: 317081 - DNA, 25 bp, Homo sapien
tctgtgatcttatagaaggccgggc

SEQ ID NO: 317082 - DNA, 25 bp, Homo sapien
ctgtgatcttatagaaggccgggca

SEQ ID NO: 317083 - DNA, 25 bp, Homo sapien
gtgatcttatagaaggccgggcacg

SEQ ID NO: 317084 - DNA, 25 bp, Homo sapien
aaaagaacgatcaaggtgccccact

SEQ ID NO: 317085 - DNA, 25 bp, Homo sapien
cactcagtggactgcttgcagggca

SEQ ID NO: 317086 - DNA, 25 bp, Homo sapien
ttgcagggcattctcagcgtgatcc

SEQ ID NO: 317087 - DNA, 25 bp, Homo sapien
tcagcgtgatccctttacagttgct

SEQ ID NO: 317088 - DNA, 25 bp, Homo sapien
tttacagttgctggctttccacctt

SEQ ID NO: 317089 - DNA, 25 bp, Homo sapien
tccaccttgctgtgctgagaggcta

SEQ ID NO: 317090 - DNA, 25 bp, Homo sapien
gaggctatgatgttgatttcccacg

SEQ ID NO: 317091 - DNA, 25 bp, Homo sapien
gttgatttcccacggaatcttgcca

SEQ ID NO: 317092 - DNA, 25 bp, Homo sapien
ggaatcttgccaaatctgtgactgt

SEQ ID NO: 317093 - DNA, 25 bp, Homo sapien
gtatgattaagcaacacaagacacc

SEQ ID NO: 317094 - DNA, 25 bp, Homo sapien
tttaaaatatcaccccttgaagcct

SEQ ID NO: 317095 - DNA, 25 bp, Homo sapien
aagatgcctctttattggtgctgga

SEQ ID NO: 317096 - DNA, 25 bp, Homo sapien
tacgtgcaggtagcgctcagtggcc

SEQ ID NO: 317097 - DNA, 25 bp, Homo sapien
tgcaggtagcgctcagtggccgtct

SEQ ID NO: 317098 - DNA, 25 bp, Homo sapien
ggtagcgctcagtggccgtctccag

SEQ ID NO: 317099 - DNA, 25 bp, Homo sapien
gcctctttattggtgctggagctgt

SEQ ID NO: 317100 - DNA, 25 bp, Homo sapien
agctcttccacctcatacaaggtgg

SEQ ID NO: 317101 - DNA, 25 bp, Homo sapien
acctcatacaaggtggctgggtcca

SEQ ID NO: 317102 - DNA, 25 bp, Homo sapien
gctgggtccagcgagtgggcattga

SEQ ID NO: 317103 - DNA, 25 bp, Homo sapien
agtgggcattgatgaggctcacaag

SEQ ID NO: 317104 - DNA, 25 bp, Homo sapien
cattgatgaggctcacaagatactc

SEQ ID NO: 317105 - DNA, 25 bp, Homo sapien
atgggaccctcatcgggacccttgc

SEQ ID NO: 317106 - DNA, 25 bp, Homo sapien
gttgacccaaagaaccttgacacca

SEQ ID NO: 317107 - DNA, 25 bp, Homo sapien
caaagaaccttgacaccactccagt

SEQ ID NO: 317108 - DNA, 25 bp, Homo sapien
aaagaaccttgacaccactccagtt

SEQ ID NO: 317109 - DNA, 25 bp, Homo sapien
aagaaccttgacaccactccagttg

SEQ ID NO: 317110 - DNA, 25 bp, Homo sapien
agaaccttgacaccactccagttgt

SEQ ID NO: 317111 - DNA, 25 bp, Homo sapien
gaaccttgacaccactccagttgtc

SEQ ID NO: 317112 - DNA, 25 bp, Homo sapien
aaccttgacaccactccagttgtca

SEQ ID NO: 317113 - DNA, 25 bp, Homo sapien
atttgcctctgtgccgcccttctac

SEQ ID NO: 317114 - DNA, 25 bp, Homo sapien
tcctgtctgaagaagagcagatggc

SEQ ID NO: 317115 - DNA, 25 bp, Homo sapien
ctgtctgaagaagagcagatggcct

SEQ ID NO: 317116 - DNA, 25 bp, Homo sapien
aagaagagcagatggcctggctgct

SEQ ID NO: 317117 - DNA, 25 bp, Homo sapien
cctgcgttgccctctgggtctgtga

SEQ ID NO: 317118 - DNA, 25 bp, Homo sapien
cagtcctgcttcctcattttataga

SEQ ID NO: 317119 - DNA, 25 bp, Homo sapien
aactgaggctttgggaggactcact

SEQ ID NO: 317120 - DNA, 25 bp, Homo sapien
gaggactcactgacatacctacctt

SEQ ID NO: 317121 - DNA, 25 bp, Homo sapien
gacatacctaccttcaagatgagtt

SEQ ID NO: 317122 - DNA, 25 bp, Homo sapien
atgagttcaggtgggctcagttctg

SEQ ID NO: 317123 - DNA, 25 bp, Homo sapien
ggccccagtggctttgggaagcacc

SEQ ID NO: 317124 - DNA, 25 bp, Homo sapien
agggtgaaacatgcttcttctcttc

SEQ ID NO: 317125 - DNA, 25 bp, Homo sapien
ttcctgtggttccatccgaaggatt

SEQ ID NO: 317126 - DNA, 25 bp, Homo sapien
tccgaaggattgtggtgagccccgt

SEQ ID NO: 317127 - DNA, 25 bp, Homo sapien
agccccgtgccttcagttaataaag

SEQ ID NO: 317128 - DNA, 25 bp, Homo sapien
cttcaaatggtactgggtttcctga

SEQ ID NO: 317129 - DNA, 25 bp, Homo sapien
ttgtgctgctgactgccaaccccat

SEQ ID NO: 317130 - DNA, 25 bp, Homo sapien
caaccccatcctagagagcactgag

SEQ ID NO: 317131 - DNA, 25 bp, Homo sapien
gagcactgagcgacagatactgtaa

SEQ ID NO: 317132 - DNA, 25 bp, Homo sapien
gatactgtaaacatcctacactctc

SEQ ID NO: 317133 - DNA, 25 bp, Homo sapien
tcctacactctcagctgtggaaagt

SEQ ID NO: 317134 - DNA, 25 bp, Homo sapien
gagaaggctgtttactctttctgcc

SEQ ID NO: 317135 - DNA, 25 bp, Homo sapien
tactctttctgccttggaagtcaac

SEQ ID NO: 317136 - DNA, 25 bp, Homo sapien
caaccctactcctaaaagagccata

SEQ ID NO: 317137 - DNA, 25 bp, Homo sapien
agagccataatttagtcccaagtat

SEQ ID NO: 317138 - DNA, 25 bp, Homo sapien
atacttttctgatcttttcctgtga

SEQ ID NO: 317139 - DNA, 25 bp, Homo sapien
ggtccctggaggcaagtagtgtggt

SEQ ID NO: 317140 - DNA, 25 bp, Homo sapien
caagtagtgtggtgccctgaggcct

SEQ ID NO: 317141 - DNA, 25 bp, Homo sapien
gcaggctccaggaccgctcaaggaa

SEQ ID NO: 317142 - DNA, 25 bp, Homo sapien
gctccaggaccgctcaaggaacagg

SEQ ID NO: 317143 - DNA, 25 bp, Homo sapien
ctccaggaccgctcaaggaacaggg

SEQ ID NO: 317144 - DNA, 25 bp, Homo sapien
gatttgaggcaactcagagaggaca

SEQ ID NO: 317145 - DNA, 25 bp, Homo sapien
caactcagagaggacaggcccagca

SEQ ID NO: 317146 - DNA, 25 bp, Homo sapien
actcagagaggacaggcccagcagc

SEQ ID NO: 317147 - DNA, 25 bp, Homo sapien
ctcagagaggacaggcccagcagcc

SEQ ID NO: 317148 - DNA, 25 bp, Homo sapien
gatgccccgggctcagttgacccat

SEQ ID NO: 317149 - DNA, 25 bp, Homo sapien
gctcagttgacccatctgtaagtgg

SEQ ID NO: 317150 - DNA, 25 bp, Homo sapien
tggttgtttgtaagccaatgacatc

SEQ ID NO: 317151 - DNA, 25 bp, Homo sapien
ggttgtttgtaagccaatgacatcc

SEQ ID NO: 317152 - DNA, 25 bp, Homo sapien
ttgtttgtaagccaatgacatcccc

SEQ ID NO: 317153 - DNA, 25 bp, Homo sapien
tgtttgtaagccaatgacatcccct

SEQ ID NO: 317154 - DNA, 25 bp, Homo sapien
ttaaaggaagagtttattgtttctg

SEQ ID NO: 317155 - DNA, 25 bp, Homo sapien
gaagagtttattgtttctgtgttaa

SEQ ID NO: 317156 - DNA, 25 bp, Homo sapien
gtttgtaagccaatgacatcccctc

SEQ ID NO: 317157 - DNA, 25 bp, Homo sapien
tttgtaagccaatgacatcccctcc

SEQ ID NO: 317158 - DNA, 25 bp, Homo sapien
tgtaagccaatgacatcccctccaa

SEQ ID NO: 317159 - DNA, 25 bp, Homo sapien
agccaatgacatcccctccaaatgt

SEQ ID NO: 317160 - DNA, 25 bp, Homo sapien
atattctcattttcagacaatataa

SEQ ID NO: 317161 - DNA, 25 bp, Homo sapien
gccatctccctaaagggcagagggt

SEQ ID NO: 317162 - DNA, 25 bp, Homo sapien
tgaggtgcggtgaatagccgtatcc

SEQ ID NO: 317163 - DNA, 25 bp, Homo sapien
tagccgtatccggaaaccgagcgtg

SEQ ID NO: 317164 - DNA, 25 bp, Homo sapien
aatgttgcctatatttcaccagccc

SEQ ID NO: 317165 - DNA, 25 bp, Homo sapien
tatatttcaccagccctgacatatt

SEQ ID NO: 317166 - DNA, 25 bp, Homo sapien
tcaccagccctgacatatttatgaa

SEQ ID NO: 317167 - DNA, 25 bp, Homo sapien
gacatatttatgaatcgctccctgc

SEQ ID NO: 317168 - DNA, 25 bp, Homo sapien
atatttatgaatcgctccctgcatg

SEQ ID NO: 317169 - DNA, 25 bp, Homo sapien
tgaatcgctccctgcatgcaaatat

SEQ ID NO: 317170 - DNA, 25 bp, Homo sapien
tcgctccctgcatgcaaatatcatt

SEQ ID NO: 317171 - DNA, 25 bp, Homo sapien
tatcattacttaaagcgccggggag

SEQ ID NO: 317172 - DNA, 25 bp, Homo sapien
tttctcttttaatcataatcatgct

SEQ ID NO: 317173 - DNA, 25 bp, Homo sapien
gctttaaaaaataccctcgagcata

SEQ ID NO: 317174 - DNA, 25 bp, Homo sapien
taaaaaataccctcgagcatatgga

SEQ ID NO: 317175 - DNA, 25 bp, Homo sapien
aaataccctcgagcatatggagcaa

SEQ ID NO: 317176 - DNA, 25 bp, Homo sapien
attcattattactgtcatatctagg

SEQ ID NO: 317177 - DNA, 25 bp, Homo sapien
ttattactgtcatatctaggtctgt

SEQ ID NO: 317178 - DNA, 25 bp, Homo sapien
ttactgtcatatctaggtctgtttc

SEQ ID NO: 317179 - DNA, 25 bp, Homo sapien
actgtcatatctaggtctgtttctg

SEQ ID NO: 317180 - DNA, 25 bp, Homo sapien
gtcatatctaggtctgtttctgtcg

SEQ ID NO: 317181 - DNA, 25 bp, Homo sapien
agcgggccgtgattgcgctactgca

SEQ ID NO: 317182 - DNA, 25 bp, Homo sapien
gcgggccgtgattgcgctactgcat

SEQ ID NO: 317183 - DNA, 25 bp, Homo sapien
caccaccaagtttctgatccttttt

SEQ ID NO: 317184 - DNA, 25 bp, Homo sapien
caccaagtttctgatcctttttctt

SEQ ID NO: 317185 - DNA, 25 bp, Homo sapien
ttcttttctctcagaatcatcggac

SEQ ID NO: 317186 - DNA, 25 bp, Homo sapien
ttttctctcagaatcatcggactca

SEQ ID NO: 317187 - DNA, 25 bp, Homo sapien
ggttaaattgcataagggtttgtgt

SEQ ID NO: 317188 - DNA, 25 bp, Homo sapien
gggtttgtgttagactgatagcata

SEQ ID NO: 317189 - DNA, 25 bp, Homo sapien
gtttgtgttagactgatagcatatc

SEQ ID NO: 317190 - DNA, 25 bp, Homo sapien
gttagactgatagcatatctactga

SEQ ID NO: 317191 - DNA, 25 bp, Homo sapien
ctgatagcatatctactgagtagcg

SEQ ID NO: 317192 - DNA, 25 bp, Homo sapien
agcatatctactgagtagcgccccg

SEQ ID NO: 317193 - DNA, 25 bp, Homo sapien
atatctactgagtagcgccccgccg

SEQ ID NO: 317194 - DNA, 25 bp, Homo sapien
tactcctacgcgcagctgatagttc

SEQ ID NO: 317195 - DNA, 25 bp, Homo sapien
tacgcgcagctgatagttcaggcga

SEQ ID NO: 317196 - DNA, 25 bp, Homo sapien
agttcaggcgattacgatggctccc

SEQ ID NO: 317197 - DNA, 25 bp, Homo sapien
aggcgattacgatggctcccgacaa

SEQ ID NO: 317198 - DNA, 25 bp, Homo sapien
gattacgatggctcccgacaaacag

SEQ ID NO: 317199 - DNA, 25 bp, Homo sapien
gacaaacagctcaccctgaacggga

SEQ ID NO: 317200 - DNA, 25 bp, Homo sapien
acagctcaccctgaacgggatttat

SEQ ID NO: 317201 - DNA, 25 bp, Homo sapien
accctgaacgggatttatacacaca

SEQ ID NO: 317202 - DNA, 25 bp, Homo sapien
cgggatttatacacacatcactaaa

SEQ ID NO: 317203 - DNA, 25 bp, Homo sapien
aattatccctactacaggactgcgg

SEQ ID NO: 317204 - DNA, 25 bp, Homo sapien
tactacaggactgcggacaagggct

SEQ ID NO: 317205 - DNA, 25 bp, Homo sapien
ggctgcccgggcgtctccttgagcc

SEQ ID NO: 317206 - DNA, 25 bp, Homo sapien
tccagaggactcacaacactccggg

SEQ ID NO: 317207 - DNA, 25 bp, Homo sapien
gactcacaacactccggggcatgtt

SEQ ID NO: 317208 - DNA, 25 bp, Homo sapien
gggcatgttgctctttcaaatacca

SEQ ID NO: 317209 - DNA, 25 bp, Homo sapien
ggcatgttgctctttcaaataccag

SEQ ID NO: 317210 - DNA, 25 bp, Homo sapien
gcatgttgctctttcaaataccagg

SEQ ID NO: 317211 - DNA, 25 bp, Homo sapien
catgttgctctttcaaataccagga

SEQ ID NO: 317212 - DNA, 25 bp, Homo sapien
atgttgctctttcaaataccaggaa

SEQ ID NO: 317213 - DNA, 25 bp, Homo sapien
tgttgctctttcaaataccaggaat

SEQ ID NO: 317214 - DNA, 25 bp, Homo sapien
aatggggcacccttgaagtctgatt

SEQ ID NO: 317215 - DNA, 25 bp, Homo sapien
ggggcacccttgaagtctgattatt

SEQ ID NO: 317216 - DNA, 25 bp, Homo sapien
gaacagccgagtaaggttttgattt

SEQ ID NO: 317217 - DNA, 25 bp, Homo sapien
ttttgatttacaggaacagctcagc

SEQ ID NO: 317218 - DNA, 25 bp, Homo sapien
gcaagggccttgtagagagcttcat

SEQ ID NO: 317219 - DNA, 25 bp, Homo sapien
agagagcttcatgcctgctataaaa

SEQ ID NO: 317220 - DNA, 25 bp, Homo sapien
taacaagagcatttaagcataggca

SEQ ID NO: 317221 - DNA, 25 bp, Homo sapien
gcataggcaacagacctgctcaaaa

SEQ ID NO: 317222 - DNA, 25 bp, Homo sapien
gatattgctgcctgagtgtctaacc

SEQ ID NO: 317223 - DNA, 25 bp, Homo sapien
gagtgtctaacccaacttcataaag

SEQ ID NO: 317224 - DNA, 25 bp, Homo sapien
ttctggatggactttgcaaccataa

SEQ ID NO: 317225 - DNA, 25 bp, Homo sapien
tggtaaaactaaccctgttccactg

SEQ ID NO: 317226 - DNA, 25 bp, Homo sapien
ctgttccactgccagctagaagaac

SEQ ID NO: 317227 - DNA, 25 bp, Homo sapien
atgggttcatgagcccatcatgcca

SEQ ID NO: 317228 - DNA, 25 bp, Homo sapien
catcatgccacttctttgttggatc

SEQ ID NO: 317229 - DNA, 25 bp, Homo sapien
ttgttggatcactttgggcacctca

SEQ ID NO: 317230 - DNA, 25 bp, Homo sapien
ttgggcacctcactaaatttttctg

SEQ ID NO: 317231 - DNA, 25 bp, Homo sapien
ctaaatttttctgagctaggtcctc

SEQ ID NO: 317232 - DNA, 25 bp, Homo sapien
tgcaccttgcttgtctatcatcaaa

SEQ ID NO: 317233 - DNA, 25 bp, Homo sapien
aattcagagtccttccatatcagat

SEQ ID NO: 317234 - DNA, 25 bp, Homo sapien
tgtctatcatcaaagggtcactgtg

SEQ ID NO: 317235 - DNA, 25 bp, Homo sapien
atatactgaaccacatacctccatt

SEQ ID NO: 317236 - DNA, 25 bp, Homo sapien
accacatacctccattggcaacatt

SEQ ID NO: 317237 - DNA, 25 bp, Homo sapien
cattggcaacattaaacttcactcc

SEQ ID NO: 317238 - DNA, 25 bp, Homo sapien
ttgctctggaatggaaattaggctt

SEQ ID NO: 317239 - DNA, 25 bp, Homo sapien
taggcttttttgaaggtgtgaccct

SEQ ID NO: 317240 - DNA, 25 bp, Homo sapien
ttgaaggtgtgaccctttttgttca

SEQ ID NO: 317241 - DNA, 25 bp, Homo sapien
tgtttgacacacagtctctgataaa

SEQ ID NO: 317242 - DNA, 25 bp, Homo sapien
actctccttgctctgttaagtgtga

SEQ ID NO: 317243 - DNA, 25 bp, Homo sapien
gtgtgacactgtccctttgagaatc

SEQ ID NO: 317244 - DNA, 25 bp, Homo sapien
gaatctggcgacagctatgtatccc

SEQ ID NO: 317245 - DNA, 25 bp, Homo sapien
gacagctatgtatcccatcaccaca

SEQ ID NO: 317246 - DNA, 25 bp, Homo sapien
aaaaatttatgtctggttccaggag

SEQ ID NO: 317247 - DNA, 25 bp, Homo sapien
tgtctggttccaggagttacctttt

SEQ ID NO: 317248 - DNA, 25 bp, Homo sapien
gagttaccttttatgagaagtccat

SEQ ID NO: 317249 - DNA, 25 bp, Homo sapien
aacaaagctgtcatcgggctcacag

SEQ ID NO: 317250 - DNA, 25 bp, Homo sapien
gagacatctgcatgtgatcatctgc

SEQ ID NO: 317251 - DNA, 25 bp, Homo sapien
atgtgatcatctgcatagtcctctc

SEQ ID NO: 317252 - DNA, 25 bp, Homo sapien
tagtcctctcctctaacgggaaaca

SEQ ID NO: 317253 - DNA, 25 bp, Homo sapien
gggaaacacctcagatttgcatata

SEQ ID NO: 317254 - DNA, 25 bp, Homo sapien
tggtgctgaaatgaacccctttctt

SEQ ID NO: 317255 - DNA, 25 bp, Homo sapien
ttgaacatcaaagctgtctcccaca

SEQ ID NO: 317256 - DNA, 25 bp, Homo sapien
cagcagggtgcctcttagtggatgt

SEQ ID NO: 317257 - DNA, 25 bp, Homo sapien
ttagtggatgtgctgggtccaccct

SEQ ID NO: 317258 - DNA, 25 bp, Homo sapien
agcattgccagttggtctgtgtgtc

SEQ ID NO: 317259 - DNA, 25 bp, Homo sapien
gggacgatttcccagaaagcaattt

SEQ ID NO: 317260 - DNA, 25 bp, Homo sapien
gaaatgaccaaccaggtaagacctg

SEQ ID NO: 317261 - DNA, 25 bp, Homo sapien
gaaaaacatcaattggtctctttgc

SEQ ID NO: 317262 - DNA, 25 bp, Homo sapien
tggtctctttgccaagttcaagtcc

SEQ ID NO: 317263 - DNA, 25 bp, Homo sapien
gtaggttttctggatgtgtagtcaa

SEQ ID NO: 317264 - DNA, 25 bp, Homo sapien
agaaactagcatctcattcttgccc

SEQ ID NO: 317265 - DNA, 25 bp, Homo sapien
attcttgcccggctcctaaagagct

SEQ ID NO: 317266 - DNA, 25 bp, Homo sapien
ggctcctaaagagctgggtgaccct

SEQ ID NO: 317267 - DNA, 25 bp, Homo sapien
ggtacctagtcaccacagtgttagg

SEQ ID NO: 317268 - DNA, 25 bp, Homo sapien
cacagtgttaggtgggactagtgaa

SEQ ID NO: 317269 - DNA, 25 bp, Homo sapien
ggaggattggttcatccaagtcttt

SEQ ID NO: 317270 - DNA, 25 bp, Homo sapien
tccaagtctttaccacaatttagtg

SEQ ID NO: 317271 - DNA, 25 bp, Homo sapien
aagttcattcttagggtccaagttg

SEQ ID NO: 317272 - DNA, 25 bp, Homo sapien
ggcagtggttcttttgtgaacacca

SEQ ID NO: 317273 - DNA, 25 bp, Homo sapien
gtgaacaccactaactacattcgaa

SEQ ID NO: 317274 - DNA, 25 bp, Homo sapien
actacattcgaaaagcctctccaat

SEQ ID NO: 317275 - DNA, 25 bp, Homo sapien
tccaattccacattccaagtctata

SEQ ID NO: 317276 - DNA, 25 bp, Homo sapien
gagtaacaatgacctctcatgtagt

SEQ ID NO: 317277 - DNA, 25 bp, Homo sapien
agtagattaaagcagaggcctttgc

SEQ ID NO: 317278 - DNA, 25 bp, Homo sapien
aggcctttgccatatgattgttttt

SEQ ID NO: 317279 - DNA, 25 bp, Homo sapien
gcttaaatgtttgcttgccctgtaa

SEQ ID NO: 317280 - DNA, 25 bp, Homo sapien
gcttgccctgtaactgtaatacttt

SEQ ID NO: 317281 - DNA, 25 bp, Homo sapien
atactttggttaccagaatcacttg

SEQ ID NO: 317282 - DNA, 25 bp, Homo sapien
tcatgttgccgcattttaagagcat

SEQ ID NO: 317283 - DNA, 25 bp, Homo sapien
gttgccgcattttaagagcataatg

SEQ ID NO: 317284 - DNA, 25 bp, Homo sapien
gtaagtggaaatgcttgtacctgaa

SEQ ID NO: 317285 - DNA, 25 bp, Homo sapien
gtggaaatgcttgtacctgaaatgt

SEQ ID NO: 317286 - DNA, 25 bp, Homo sapien
tgcttgtacctgaaatgtgtatttt

SEQ ID NO: 317287 - DNA, 25 bp, Homo sapien
cttcagtggctctctcttatatgta

SEQ ID NO: 317288 - DNA, 25 bp, Homo sapien
tcagtggctctctcttatatgtatt

SEQ ID NO: 317289 - DNA, 25 bp, Homo sapien
tatgtcacctatgaaatgttagtag

SEQ ID NO: 317290 - DNA, 25 bp, Homo sapien
gaaatgttagtagatgcagagcaat

SEQ ID NO: 317291 - DNA, 25 bp, Homo sapien
gcaatgctgataaggtgtgtagtct

SEQ ID NO: 317292 - DNA, 25 bp, Homo sapien
ctgataaggtgtgtagtcttagact

SEQ ID NO: 317293 - DNA, 25 bp, Homo sapien
acagtgaccagccaccaggtgtgcc

SEQ ID NO: 317294 - DNA, 25 bp, Homo sapien
agccaccaggtgtgccatcgtggag

SEQ ID NO: 317295 - DNA, 25 bp, Homo sapien
tgccatcgtggaggaagtccaggtt

SEQ ID NO: 317296 - DNA, 25 bp, Homo sapien
ttggagaggtggtcttctgtaagca

SEQ ID NO: 317297 - DNA, 25 bp, Homo sapien
ggtcttctgtaagcaggtccatctc

SEQ ID NO: 317298 - DNA, 25 bp, Homo sapien
tgaggcccctttctgcctgtgacag

SEQ ID NO: 317299 - DNA, 25 bp, Homo sapien
gagtgtccgtctgggcactggtcca

SEQ ID NO: 317300 - DNA, 25 bp, Homo sapien
ctggtccatgacctgttgtctttct

SEQ ID NO: 317301 - DNA, 25 bp, Homo sapien
ctgttgtctttctgtatctactttc

SEQ ID NO: 317302 - DNA, 25 bp, Homo sapien
tttctgtatctactttctgcagccc

SEQ ID NO: 317303 - DNA, 25 bp, Homo sapien
tttctgcagcccctcactgaggagg

SEQ ID NO: 317304 - DNA, 25 bp, Homo sapien
aagctcatcaaaaggtgaggatccc

SEQ ID NO: 317305 - DNA, 25 bp, Homo sapien
tcaaaaggtgaggatcccgaccact

SEQ ID NO: 317306 - DNA, 25 bp, Homo sapien
aaaaggtgaggatcccgaccactgg

SEQ ID NO: 317307 - DNA, 25 bp, Homo sapien
gtgaggatcccgaccactgggatgt

SEQ ID NO: 317308 - DNA, 25 bp, Homo sapien
aggatcccgaccactgggatgttgg

SEQ ID NO: 317309 - DNA, 25 bp, Homo sapien
gatcccgaccactgggatgttggga

SEQ ID NO: 317310 - DNA, 25 bp, Homo sapien
cccgaccactgggatgttgggagat

SEQ ID NO: 317311 - DNA, 25 bp, Homo sapien
atgttgggagatagcgcgtgctcac

SEQ ID NO: 317312 - DNA, 25 bp, Homo sapien
ggagatagcgcgtgctcacggctct

SEQ ID NO: 317313 - DNA, 25 bp, Homo sapien
agatagcgcgtgctcacggctcttt

SEQ ID NO: 317314 - DNA, 25 bp, Homo sapien
gcgtgctcacggctctttcctttct

SEQ ID NO: 317315 - DNA, 25 bp, Homo sapien
aaaagcaataaacctggcggctctg

SEQ ID NO: 317316 - DNA, 25 bp, Homo sapien
agcaataaacctggcggctctggac

SEQ ID NO: 317317 - DNA, 25 bp, Homo sapien
aaacctggcggctctggacgagtag

SEQ ID NO: 317318 - DNA, 25 bp, Homo sapien
aacacttgtgccattgatgactggt

SEQ ID NO: 317319 - DNA, 25 bp, Homo sapien
ggtcttcgaagagggcccacatgcg

SEQ ID NO: 317320 - DNA, 25 bp, Homo sapien
tccagcggccagatttgccgtcggg

SEQ ID NO: 317321 - DNA, 25 bp, Homo sapien
tgtgccattgatgactggttctgtc

SEQ ID NO: 317322 - DNA, 25 bp, Homo sapien
atattgaaagcttcatgtgtttcca

SEQ ID NO: 317323 - DNA, 25 bp, Homo sapien
ttcatgtgtttccaggcaaaaagtt

SEQ ID NO: 317324 - DNA, 25 bp, Homo sapien
gtttccaggcaaaaagttgtaattg

SEQ ID NO: 317325 - DNA, 25 bp, Homo sapien
aagttgtaattgaaaccaggatgaa

SEQ ID NO: 317326 - DNA, 25 bp, Homo sapien
gatggcagaatttagacttgacaga

SEQ ID NO: 317327 - DNA, 25 bp, Homo sapien
attaggtgtagtaatctgctgttta

SEQ ID NO: 317328 - DNA, 25 bp, Homo sapien
atctgctgtttacctccagttatat

SEQ ID NO: 317329 - DNA, 25 bp, Homo sapien
gtttacctccagttatatgtgcaaa

SEQ ID NO: 317330 - DNA, 25 bp, Homo sapien
tatgtgcaaactcccaagccactaa

SEQ ID NO: 317331 - DNA, 25 bp, Homo sapien
ataacttcagttatgcactctaaca

SEQ ID NO: 317332 - DNA, 25 bp, Homo sapien
tatgcactctaacacagacgaccac

SEQ ID NO: 317333 - DNA, 25 bp, Homo sapien
gacgaccacctgaaatgcactggta

SEQ ID NO: 317334 - DNA, 25 bp, Homo sapien
tgcactggtatttatttctgataat

SEQ ID NO: 317335 - DNA, 25 bp, Homo sapien
aactttagaccaaaggtgtctgaga

SEQ ID NO: 317336 - DNA, 25 bp, Homo sapien
aaagggagcttgttcttcccattgc

SEQ ID NO: 317337 - DNA, 25 bp, Homo sapien
ttctcatggaaatggattttgcctc

SEQ ID NO: 317338 - DNA, 25 bp, Homo sapien
gaaatggattttgcctctttgggaa

SEQ ID NO: 317339 - DNA, 25 bp, Homo sapien
atggattttgcctctttgggaatga

SEQ ID NO: 317340 - DNA, 25 bp, Homo sapien
aatgatatggcagtggtggttctat

SEQ ID NO: 317341 - DNA, 25 bp, Homo sapien
gattcatggaatctcatcagcctgt

SEQ ID NO: 317342 - DNA, 25 bp, Homo sapien
atctcagcaaaaaggtgaagctgtt

SEQ ID NO: 317343 - DNA, 25 bp, Homo sapien
ctgttgtctgggttgcacaattatc

SEQ ID NO: 317344 - DNA, 25 bp, Homo sapien
gtctgggttgcacaattatcagcct

SEQ ID NO: 317345 - DNA, 25 bp, Homo sapien
gggttgcacaattatcagccttggc

SEQ ID NO: 317346 - DNA, 25 bp, Homo sapien
gttgcacaattatcagccttggctg

SEQ ID NO: 317347 - DNA, 25 bp, Homo sapien
tgcacaattatcagccttggctgat

SEQ ID NO: 317348 - DNA, 25 bp, Homo sapien
catggttgcttttttatgttctcca

SEQ ID NO: 317349 - DNA, 25 bp, Homo sapien
tctccatatgtattttcaagctctc

SEQ ID NO: 317350 - DNA, 25 bp, Homo sapien
cagttgttcttacttctcagggtat

SEQ ID NO: 317351 - DNA, 25 bp, Homo sapien
gggtatgttgctgaacttccaggaa

SEQ ID NO: 317352 - DNA, 25 bp, Homo sapien
gaatcattcccgtctttagtccagt

SEQ ID NO: 317353 - DNA, 25 bp, Homo sapien
tctttagtccagtgttgctgctcta

SEQ ID NO: 317354 - DNA, 25 bp, Homo sapien
ttgctgctctagtctcattggaagt

SEQ ID NO: 317355 - DNA, 25 bp, Homo sapien
attggaagtgacctgtccactgact

SEQ ID NO: 317356 - DNA, 25 bp, Homo sapien
atccccaagttcctaatttgccagc

SEQ ID NO: 317357 - DNA, 25 bp, Homo sapien
ctgtgtctagtgatcccagggataa

SEQ ID NO: 317358 - DNA, 25 bp, Homo sapien
aatgctgttgtctagtatcattgac

SEQ ID NO: 317359 - DNA, 25 bp, Homo sapien
cactgaggcccctttctgcctgtga

SEQ ID NO: 317360 - DNA, 25 bp, Homo sapien
actgaggcccctttctgcctgtgac

SEQ ID NO: 317361 - DNA, 25 bp, Homo sapien
ctgttgtctttctgtatctactttc

SEQ ID NO: 317362 - DNA, 25 bp, Homo sapien
tgtctttctgtatctactttctgca

SEQ ID NO: 317363 - DNA, 25 bp, Homo sapien
gtctttctgtatctactttctgcag

SEQ ID NO: 317364 - DNA, 25 bp, Homo sapien
ctttctgtatctactttctgcagcc

SEQ ID NO: 317365 - DNA, 25 bp, Homo sapien
tttctgtatctactttctgcagccc

SEQ ID NO: 317366 - DNA, 25 bp, Homo sapien
tctgtatctactttctgcagcccct

SEQ ID NO: 317367 - DNA, 25 bp, Homo sapien
tgtatctactttctgcagcccctca

SEQ ID NO: 317368 - DNA, 25 bp, Homo sapien
tttctgcagcccctcactgaggagg

SEQ ID NO: 317369 - DNA, 25 bp, Homo sapien
ttctgcagcccctcactgaggaggc

SEQ ID NO: 317370 - DNA, 25 bp, Homo sapien
catccttgcctctatgcatgcattt

SEQ ID NO: 317371 - DNA, 25 bp, Homo sapien
tatgcatgcatttgtccgtccatcc

SEQ ID NO: 317372 - DNA, 25 bp, Homo sapien
tctgtgcatgcatccatacctgcct

SEQ ID NO: 317373 - DNA, 25 bp, Homo sapien
gtgcatgcatctgtcagtctatcaa

SEQ ID NO: 317374 - DNA, 25 bp, Homo sapien
atctgtcagtctatcaatccccgat

SEQ ID NO: 317375 - DNA, 25 bp, Homo sapien
cccgatcccttctttgtaatggtgt

SEQ ID NO: 317376 - DNA, 25 bp, Homo sapien
taatggtgttgagcgctcacaactc

SEQ ID NO: 317377 - DNA, 25 bp, Homo sapien
tccctcatcctaagacgctcgttgg

SEQ ID NO: 317378 - DNA, 25 bp, Homo sapien
taagacgctcgttggatccattccc

SEQ ID NO: 317379 - DNA, 25 bp, Homo sapien
aagttctccagccagtggtctcaac

SEQ ID NO: 317380 - DNA, 25 bp, Homo sapien
tggtctcaactcaatcttcacttcc

SEQ ID NO: 317381 - DNA, 25 bp, Homo sapien
tcatctgtcaaacacgtatttggac

SEQ ID NO: 317382 - DNA, 25 bp, Homo sapien
acacgtatttggacatcaaggttgc

SEQ ID NO: 317383 - DNA, 25 bp, Homo sapien
atgcatggatttcatctttgaggag

SEQ ID NO: 317384 - DNA, 25 bp, Homo sapien
ggagttcaaaacctagtggagagaa

SEQ ID NO: 317385 - DNA, 25 bp, Homo sapien
gagagaacacatggtacaatcgtaa

SEQ ID NO: 317386 - DNA, 25 bp, Homo sapien
ggtacaatcgtaacacatgaaggac

SEQ ID NO: 317387 - DNA, 25 bp, Homo sapien
gaaggacaagtaagtgctgcagtaa

SEQ ID NO: 317388 - DNA, 25 bp, Homo sapien
ggtactaataacatgttccttggaa

SEQ ID NO: 317389 - DNA, 25 bp, Homo sapien
gaaaccatggaaattagggaagcct

SEQ ID NO: 317390 - DNA, 25 bp, Homo sapien
aagcctttacagagggtgtgacaaa

SEQ ID NO: 317391 - DNA, 25 bp, Homo sapien
aagctatgtacaatgatgtgcacct

SEQ ID NO: 317392 - DNA, 25 bp, Homo sapien
ggaacaggctacttcagatcaggga

SEQ ID NO: 317393 - DNA, 25 bp, Homo sapien
gaacaggctacttcagatcagggaa

SEQ ID NO: 317394 - DNA, 25 bp, Homo sapien
acaggctacttcagatcagggaaga

SEQ ID NO: 317395 - DNA, 25 bp, Homo sapien
ggctacttcagatcagggaagatgt

SEQ ID NO: 317396 - DNA, 25 bp, Homo sapien
tatgaagagggatgtcagcaacact

SEQ ID NO: 317397 - DNA, 25 bp, Homo sapien
aagagggatgtcagcaacacttcat

SEQ ID NO: 317398 - DNA, 25 bp, Homo sapien
gcaacacttcatcctgggccagtaa

SEQ ID NO: 317399 - DNA, 25 bp, Homo sapien
caacacttcatcctgggccagtaat

SEQ ID NO: 317400 - DNA, 25 bp, Homo sapien
acacttcatcctgggccagtaatag

SEQ ID NO: 317401 - DNA, 25 bp, Homo sapien
catcctgggccagtaatagggagag

SEQ ID NO: 317402 - DNA, 25 bp, Homo sapien
gggccagtaatagggagagtttctt

SEQ ID NO: 317403 - DNA, 25 bp, Homo sapien
gaggagagtaatgcctatctcaatt

SEQ ID NO: 317404 - DNA, 25 bp, Homo sapien
aatgcctatctcaattacctcataa

SEQ ID NO: 317405 - DNA, 25 bp, Homo sapien
gcctatctcaattacctcataaaat

SEQ ID NO: 317406 - DNA, 25 bp, Homo sapien
attattgcaaagatcaagtgagttg

SEQ ID NO: 317407 - DNA, 25 bp, Homo sapien
tcaagtgagttgatatgttacaaat

SEQ ID NO: 317408 - DNA, 25 bp, Homo sapien
atcactcaggattctatatgactct

SEQ ID NO: 317409 - DNA, 25 bp, Homo sapien
ggattctatatgactctgagttctc

SEQ ID NO: 317410 - DNA, 25 bp, Homo sapien
actctgagttctcaatttctagaaa

SEQ ID NO: 317411 - DNA, 25 bp, Homo sapien
tactttgttccctacaattctacgg

SEQ ID NO: 317412 - DNA, 25 bp, Homo sapien
tgttccctacaattctacggagtct

SEQ ID NO: 317413 - DNA, 25 bp, Homo sapien
tccctacaattctacggagtctttt

SEQ ID NO: 317414 - DNA, 25 bp, Homo sapien
agggattctggacttgcgattctaa

SEQ ID NO: 317415 - DNA, 25 bp, Homo sapien
gcgattctaagtctttgttcgtttt

SEQ ID NO: 317416 - DNA, 25 bp, Homo sapien
tgcattttctgagccaacataacca

SEQ ID NO: 317417 - DNA, 25 bp, Homo sapien
atagtaactctacattacagacctc

SEQ ID NO: 317418 - DNA, 25 bp, Homo sapien
caaactcagcagttcagagcatgta

SEQ ID NO: 317419 - DNA, 25 bp, Homo sapien
agagcatgtattctcactcagggct

SEQ ID NO: 317420 - DNA, 25 bp, Homo sapien
gggctctgcttccttgtaggtagat

SEQ ID NO: 317421 - DNA, 25 bp, Homo sapien
atcggtgagggcagttcttatttgt

SEQ ID NO: 317422 - DNA, 25 bp, Homo sapien
cagttcttatttgtatgccttattc

SEQ ID NO: 317423 - DNA, 25 bp, Homo sapien
gggcagtggctatccatgataagct

SEQ ID NO: 317424 - DNA, 25 bp, Homo sapien
atccatgataagcttttctcaaggc

SEQ ID NO: 317425 - DNA, 25 bp, Homo sapien
acagttttgttagcatgactgaact

SEQ ID NO: 317426 - DNA, 25 bp, Homo sapien
tacattgttgagcaactcaccctca

SEQ ID NO: 317427 - DNA, 25 bp, Homo sapien
actcaccctcaacagtaacatttgc

SEQ ID NO: 317428 - DNA, 25 bp, Homo sapien
taacatttgccttggtcttgtctgt

SEQ ID NO: 317429 - DNA, 25 bp, Homo sapien
tggtcttgtctgtgccacagtcaca

SEQ ID NO: 317430 - DNA, 25 bp, Homo sapien
cagtcacacacatattcgcctttat

SEQ ID NO: 317431 - DNA, 25 bp, Homo sapien
tcgcctttatctttaaggtccgcct

SEQ ID NO: 317432 - DNA, 25 bp, Homo sapien
tatctttaaggtccgcctttttgat

SEQ ID NO: 317433 - DNA, 25 bp, Homo sapien
ccaacacttttattccgtacagagg

SEQ ID NO: 317434 - DNA, 25 bp, Homo sapien
attccgtacagaggcttttccactt

SEQ ID NO: 317435 - DNA, 25 bp, Homo sapien
tttccacttttattagtcgagctga

SEQ ID NO: 317436 - DNA, 25 bp, Homo sapien
gttctcacagtattctttccagttg

SEQ ID NO: 317437 - DNA, 25 bp, Homo sapien
ctttccagttgttgtaattcataaa

SEQ ID NO: 317438 - DNA, 25 bp, Homo sapien
aagattagtgggacactcaggcaaa

SEQ ID NO: 317439 - DNA, 25 bp, Homo sapien
gacactcaggcaaaaatgttggtct

SEQ ID NO: 317440 - DNA, 25 bp, Homo sapien
aaaatgttggtctttctttgacatg

SEQ ID NO: 317441 - DNA, 25 bp, Homo sapien
aaatgttatcaattttgtcatggat

SEQ ID NO: 317442 - DNA, 25 bp, Homo sapien
ggatataatttgcagcccatggata

SEQ ID NO: 317443 - DNA, 25 bp, Homo sapien
gcagcccatggatataactggttga

SEQ ID NO: 317444 - DNA, 25 bp, Homo sapien
attcatggcatgtgtggtttattaa

SEQ ID NO: 317445 - DNA, 25 bp, Homo sapien
taatgccatgtactttctcctttct

SEQ ID NO: 317446 - DNA, 25 bp, Homo sapien
tgtactttctcctttctggaataaa

SEQ ID NO: 317447 - DNA, 25 bp, Homo sapien
tattaaagccaaggtttattcccat

SEQ ID NO: 317448 - DNA, 25 bp, Homo sapien
ttattcccattaactaagccacctg

SEQ ID NO: 317449 - DNA, 25 bp, Homo sapien
tgctccggctgcgagagaagcttct

SEQ ID NO: 317450 - DNA, 25 bp, Homo sapien
tgcgagagaagcttctccttcttgg

SEQ ID NO: 317451 - DNA, 25 bp, Homo sapien
aggaaaattaggctcatcatcaatt

SEQ ID NO: 317452 - DNA, 25 bp, Homo sapien
taggctcatcatcaattagtattta

SEQ ID NO: 317453 - DNA, 25 bp, Homo sapien
tttatggcgtgaggcatttcccaac

SEQ ID NO: 317454 - DNA, 25 bp, Homo sapien
atttcccaacttttcaatctcactg

SEQ ID NO: 317455 - DNA, 25 bp, Homo sapien
tcaatctcactgttgggcccagtga

SEQ ID NO: 317456 - DNA, 25 bp, Homo sapien
ggcccagtgaatgtgccgaagaact

SEQ ID NO: 317457 - DNA, 25 bp, Homo sapien
gaagaactggcacccatcgtccaaa

SEQ ID NO: 317458 - DNA, 25 bp, Homo sapien
gagggcggcgatgagagcgaaagtt

SEQ ID NO: 317459 - DNA, 25 bp, Homo sapien
gcggcgatgagagcgaaagttgcgc

SEQ ID NO: 317460 - DNA, 25 bp, Homo sapien
caggagccgcgggtccccgccactt

SEQ ID NO: 317461 - DNA, 25 bp, Homo sapien
gcgggtccccgccactttcgcacgg

SEQ ID NO: 317462 - DNA, 25 bp, Homo sapien
accgatgccggccatggtggagaag

SEQ ID NO: 317463 - DNA, 25 bp, Homo sapien
ccatggtggagaagggccccgaggt

SEQ ID NO: 317464 - DNA, 25 bp, Homo sapien
gaagggccccgaggtctcagggaag

SEQ ID NO: 317465 - DNA, 25 bp, Homo sapien
aaagttgcgctcggctcgtcgctgg

SEQ ID NO: 317466 - DNA, 25 bp, Homo sapien
tcggctcgtcgctgggggcttgaag

SEQ ID NO: 317467 - DNA, 25 bp, Homo sapien
ggcttgaagcggctccgcgctctgc

SEQ ID NO: 317468 - DNA, 25 bp, Homo sapien
cccgactcggactcgcgcccgtggg

SEQ ID NO: 317469 - DNA, 25 bp, Homo sapien
agagaggatgaaatacttgctgtac

SEQ ID NO: 317470 - DNA, 25 bp, Homo sapien
gaaatacttgctgtacttcaaaaca

SEQ ID NO: 317471 - DNA, 25 bp, Homo sapien
gtacttcaaaacataaaaccgatct

SEQ ID NO: 317472 - DNA, 25 bp, Homo sapien
gggatttctgattcatttcttctgc

SEQ ID NO: 317473 - DNA, 25 bp, Homo sapien
atttctgattcatttcttctgccct

SEQ ID NO: 317474 - DNA, 25 bp, Homo sapien
tgattcatttcttctgccctgctcc

SEQ ID NO: 317475 - DNA, 25 bp, Homo sapien
ttttttagtcaaatactgtctggac

SEQ ID NO: 317476 - DNA, 25 bp, Homo sapien
tcaaatactgtctggacttttgtga

SEQ ID NO: 317477 - DNA, 25 bp, Homo sapien
tttgtgagccaataacctccctcct

SEQ ID NO: 317478 - DNA, 25 bp, Homo sapien
gagcagagagccctcaaaagcctgg

SEQ ID NO: 317479 - DNA, 25 bp, Homo sapien
agagccctcaaaagcctgggtttct

SEQ ID NO: 317480 - DNA, 25 bp, Homo sapien
cacagtggaatggagtacacggact

SEQ ID NO: 317481 - DNA, 25 bp, Homo sapien
tggaatggagtacacggactgaatc

SEQ ID NO: 317482 - DNA, 25 bp, Homo sapien
ggaatggagtacacggactgaatct

SEQ ID NO: 317483 - DNA, 25 bp, Homo sapien
gaatggagtacacggactgaatctg

SEQ ID NO: 317484 - DNA, 25 bp, Homo sapien
cagccaacaggactcctgcgctgga

SEQ ID NO: 317485 - DNA, 25 bp, Homo sapien
gccaacaggactcctgcgctggact

SEQ ID NO: 317486 - DNA, 25 bp, Homo sapien
aggactcctgcgctggactcctgag

SEQ ID NO: 317487 - DNA, 25 bp, Homo sapien
tcctgcgctggactcctgagctgaa

SEQ ID NO: 317488 - DNA, 25 bp, Homo sapien
cctgcgctggactcctgagctgaag

SEQ ID NO: 317489 - DNA, 25 bp, Homo sapien
ctgcgctggactcctgagctgaagt

SEQ ID NO: 317490 - DNA, 25 bp, Homo sapien
tgcgctggactcctgagctgaagtg

SEQ ID NO: 317491 - DNA, 25 bp, Homo sapien
gatcctctaggcttggaaccgggat

SEQ ID NO: 317492 - DNA, 25 bp, Homo sapien
ggcttctgcaacaatgggagtttca

SEQ ID NO: 317493 - DNA, 25 bp, Homo sapien
ctgtgtctgagcatcgtgtcaggtt

SEQ ID NO: 317494 - DNA, 25 bp, Homo sapien
atcgtgtcaggttgcagtactccca

SEQ ID NO: 317495 - DNA, 25 bp, Homo sapien
gcagtactcccatctgactttggga

SEQ ID NO: 317496 - DNA, 25 bp, Homo sapien
gactttgggatccatcgtgtaacac

SEQ ID NO: 317497 - DNA, 25 bp, Homo sapien
accaagggccttccacaggatctgg

SEQ ID NO: 317498 - DNA, 25 bp, Homo sapien
attcctgcagtagttcatgatcaag

SEQ ID NO: 317499 - DNA, 25 bp, Homo sapien
tttcaaaggcttttctacccagtgt

SEQ ID NO: 317500 - DNA, 25 bp, Homo sapien
tttctacccagtgtccaagtgtgga

SEQ ID NO: 317501 - DNA, 25 bp, Homo sapien
cacagacttcttacctggtttggaa

SEQ ID NO: 317502 - DNA, 25 bp, Homo sapien
aaaagacaaagccacactggtgtga

SEQ ID NO: 317503 - DNA, 25 bp, Homo sapien
actggtgtgagttttcatggtcccc

SEQ ID NO: 317504 - DNA, 25 bp, Homo sapien
tgtgagttttcatggtccccgggac

SEQ ID NO: 317505 - DNA, 25 bp, Homo sapien
agaaagactacattcctgccactaa

SEQ ID NO: 317506 - DNA, 25 bp, Homo sapien
tacattcctgccactaacagtcggt

SEQ ID NO: 317507 - DNA, 25 bp, Homo sapien
ctaacagtcggtggccactgggcaa

SEQ ID NO: 317508 - DNA, 25 bp, Homo sapien
tggccactgggcaaatcttaagtct

SEQ ID NO: 317509 - DNA, 25 bp, Homo sapien
caaatcttaagtctgtggtgcctca

SEQ ID NO: 317510 - DNA, 25 bp, Homo sapien
cttaagtctgtggtgcctcagtttc

SEQ ID NO: 317511 - DNA, 25 bp, Homo sapien
cagtttcctcatatgcaaagcgggt

SEQ ID NO: 317512 - DNA, 25 bp, Homo sapien
ttcctcatatgcaaagcgggtttgt

SEQ ID NO: 317513 - DNA, 25 bp, Homo sapien
taggactggatattaggtgtcatat

SEQ ID NO: 317514 - DNA, 25 bp, Homo sapien
aaaagttattgctgtttgctaaagc

SEQ ID NO: 317515 - DNA, 25 bp, Homo sapien
atatgcaaaactgttgaaggaccat

SEQ ID NO: 317516 - DNA, 25 bp, Homo sapien
gaaggaccatagagaaatgtgtact

SEQ ID NO: 317517 - DNA, 25 bp, Homo sapien
gggcttttactaggcttcctgcgtg

SEQ ID NO: 317518 - DNA, 25 bp, Homo sapien
ttactaggcttcctgcgtgtgtaaa

SEQ ID NO: 317519 - DNA, 25 bp, Homo sapien
ggcttcctgcgtgtgtaaaagtcga

SEQ ID NO: 317520 - DNA, 25 bp, Homo sapien
aaagtcgaggtattgctggcattca

SEQ ID NO: 317521 - DNA, 25 bp, Homo sapien
gtattgctggcattcagggtgacat

SEQ ID NO: 317522 - DNA, 25 bp, Homo sapien
cattcagggtgacatgatggtacta

SEQ ID NO: 317523 - DNA, 25 bp, Homo sapien
tggtactaaatgttttccattaaag

SEQ ID NO: 317524 - DNA, 25 bp, Homo sapien
atcagcagtggtggcttctacggag

SEQ ID NO: 317525 - DNA, 25 bp, Homo sapien
gcttctacggagtgagcagccagta

SEQ ID NO: 317526 - DNA, 25 bp, Homo sapien
tacggagtgagcagccagtatgaga

SEQ ID NO: 317527 - DNA, 25 bp, Homo sapien
tgagagcctggaacacatgaccctc

SEQ ID NO: 317528 - DNA, 25 bp, Homo sapien
agagcctggaacacatgaccctcac

SEQ ID NO: 317529 - DNA, 25 bp, Homo sapien
tgttcctccaaggtctgctcttttg

SEQ ID NO: 317530 - DNA, 25 bp, Homo sapien
tccaaggtctgctcttttggcaagc

SEQ ID NO: 317531 - DNA, 25 bp, Homo sapien
aggtggagacggaacgggcccagct

SEQ ID NO: 317532 - DNA, 25 bp, Homo sapien
ctggaggacggcagatttgtgtacc

SEQ ID NO: 317533 - DNA, 25 bp, Homo sapien
ggacggcagatttgtgtaccgcctg

SEQ ID NO: 317534 - DNA, 25 bp, Homo sapien
gcagatttgtgtaccgcctgctgcg

SEQ ID NO: 317535 - DNA, 25 bp, Homo sapien
ggaagagaaaatgcgctcgaccacc

SEQ ID NO: 317536 - DNA, 25 bp, Homo sapien
agaaaatgcgctcgaccacctaagg

SEQ ID NO: 317537 - DNA, 25 bp, Homo sapien
ttcccaatctgcagcaaggtgtcac

SEQ ID NO: 317538 - DNA, 25 bp, Homo sapien
gcaaggtgtcacaagggcttctccg

SEQ ID NO: 317539 - DNA, 25 bp, Homo sapien
agggcttctccgcagctatgatttc

SEQ ID NO: 317540 - DNA, 25 bp, Homo sapien
ttctccgcagctatgatttctaaca

SEQ ID NO: 317541 - DNA, 25 bp, Homo sapien
tatgatttctaacaccatgccccgg

SEQ ID NO: 317542 - DNA, 25 bp, Homo sapien
gccaggagcctcagggtgcccgttc

SEQ ID NO: 317543 - DNA, 25 bp, Homo sapien
ctcagggtgcccgttcgggaaaatg

SEQ ID NO: 317544 - DNA, 25 bp, Homo sapien
aaatgggagccgaatcaggatcacc

SEQ ID NO: 317545 - DNA, 25 bp, Homo sapien
gggagccgaatcaggatcaccccat

SEQ ID NO: 317546 - DNA, 25 bp, Homo sapien
gctcagaatccacaagtcacggtct

SEQ ID NO: 317547 - DNA, 25 bp, Homo sapien
gtcacggtctaaacacacttagaat

SEQ ID NO: 317548 - DNA, 25 bp, Homo sapien
gcataaatctgttagcattattgcc

SEQ ID NO: 317549 - DNA, 25 bp, Homo sapien
gttgggatccaaacccaagtcttga

SEQ ID NO: 317550 - DNA, 25 bp, Homo sapien
cccaagtcttgagcaatgtttttct

SEQ ID NO: 317551 - DNA, 25 bp, Homo sapien
aaagctgctatccaatgatatagga

SEQ ID NO: 317552 - DNA, 25 bp, Homo sapien
tcattgtttgatttggtcctgccta

SEQ ID NO: 317553 - DNA, 25 bp, Homo sapien
tgatttggtcctgcctaaatttcac

SEQ ID NO: 317554 - DNA, 25 bp, Homo sapien
ctaaatttcacaagctaggccaatg

SEQ ID NO: 317555 - DNA, 25 bp, Homo sapien
gctaggccaatgaaggctgaatcaa

SEQ ID NO: 317556 - DNA, 25 bp, Homo sapien
aagacatttcatccaccaatatcat

SEQ ID NO: 317557 - DNA, 25 bp, Homo sapien
accactggtgcaacttcctccttca

SEQ ID NO: 317558 - DNA, 25 bp, Homo sapien
tcagagtcagtttctgcagtcagga

SEQ ID NO: 317559 - DNA, 25 bp, Homo sapien
gtcaggagagatgagcagttcacca

SEQ ID NO: 317560 - DNA, 25 bp, Homo sapien
gagagatgagcagttcaccaggaat

SEQ ID NO: 317561 - DNA, 25 bp, Homo sapien
gatgagcagttcaccaggaattggg

SEQ ID NO: 317562 - DNA, 25 bp, Homo sapien
gtgatggtgttagagattgcagccc

SEQ ID NO: 317563 - DNA, 25 bp, Homo sapien
aaactgcagcaggttgtacaaaaca

SEQ ID NO: 317564 - DNA, 25 bp, Homo sapien
actgcagcaggttgtacaaaacatt

SEQ ID NO: 317565 - DNA, 25 bp, Homo sapien
agagagctcacttgacccaaccgag

SEQ ID NO: 317566 - DNA, 25 bp, Homo sapien
agagctcacttgacccaaccgaggg

SEQ ID NO: 317567 - DNA, 25 bp, Homo sapien
gctcacttgacccaaccgagggttt

SEQ ID NO: 317568 - DNA, 25 bp, Homo sapien
ggcccggcgcactgccgctcatgag

SEQ ID NO: 317569 - DNA, 25 bp, Homo sapien
gcgcactgccgctcatgagcgcctt

SEQ ID NO: 317570 - DNA, 25 bp, Homo sapien
gcactgccgctcatgagcgccttcg

SEQ ID NO: 317571 - DNA, 25 bp, Homo sapien
actgccgctcatgagcgccttcgcg

SEQ ID NO: 317572 - DNA, 25 bp, Homo sapien
tgccgctcatgagcgccttcgcgcg

SEQ ID NO: 317573 - DNA, 25 bp, Homo sapien
tcatgagcgccttcgcgcgctcgcg

SEQ ID NO: 317574 - DNA, 25 bp, Homo sapien
tgagcgccttcgcgcgctcgcggaa

SEQ ID NO: 317575 - DNA, 25 bp, Homo sapien
cgcgctcgcggaaccccgtggcttc

SEQ ID NO: 317576 - DNA, 25 bp, Homo sapien
gaaccccgtggcttccccgacgcag

SEQ ID NO: 317577 - DNA, 25 bp, Homo sapien
cgacgcagcccagcggcacggagaa

SEQ ID NO: 317578 - DNA, 25 bp, Homo sapien
acgcagcccagcggcacggagaaag

SEQ ID NO: 317579 - DNA, 25 bp, Homo sapien
aacttataaagccactttgttgcat

SEQ ID NO: 317580 - DNA, 25 bp, Homo sapien
gttgcattttgtgtttcagtgttac

SEQ ID NO: 317581 - DNA, 25 bp, Homo sapien
cacagctatgtgtttttcattgaaa

SEQ ID NO: 317582 - DNA, 25 bp, Homo sapien
actgatcttgatgctgtgtattttt

SEQ ID NO: 317583 - DNA, 25 bp, Homo sapien
tgagttgtcttaggcattcctgagc

SEQ ID NO: 317584 - DNA, 25 bp, Homo sapien
attcctgagctcagcttcagttgga

SEQ ID NO: 317585 - DNA, 25 bp, Homo sapien
cagttggatggtgggtcagcaccct

SEQ ID NO: 317586 - DNA, 25 bp, Homo sapien
gcaccctgcgtttctgaacatacta

SEQ ID NO: 317587 - DNA, 25 bp, Homo sapien
gaacatactagacttcagtttaaaa

SEQ ID NO: 317588 - DNA, 25 bp, Homo sapien
gaggctgtataatatgttgctgttt

SEQ ID NO: 317589 - DNA, 25 bp, Homo sapien
gttgctgtttttacagtgctaatgt

SEQ ID NO: 317590 - DNA, 25 bp, Homo sapien
aaatcctacttggaagacatagagt

SEQ ID NO: 317591 - DNA, 25 bp, Homo sapien
ttgtcctttcagtttcatccctcac

SEQ ID NO: 317592 - DNA, 25 bp, Homo sapien
agagggcaacactcctgcagtcaga

SEQ ID NO: 317593 - DNA, 25 bp, Homo sapien
tgcagtcagaggaaggttctcttct

SEQ ID NO: 317594 - DNA, 25 bp, Homo sapien
ctgttgcttggccacatggcagcat

SEQ ID NO: 317595 - DNA, 25 bp, Homo sapien
catggcagcatggagttacagcact

SEQ ID NO: 317596 - DNA, 25 bp, Homo sapien
tttcatccctcacaacagaagctag

SEQ ID NO: 317597 - DNA, 25 bp, Homo sapien
agcactggaagtggaatcccgaaaa

SEQ ID NO: 317598 - DNA, 25 bp, Homo sapien
aaaactaggaaagctccagtgggca

SEQ ID NO: 317599 - DNA, 25 bp, Homo sapien
gcttctcagtgtcctttgctataaa

SEQ ID NO: 317600 - DNA, 25 bp, Homo sapien
gtttgtgattactttcctctggaaa

SEQ ID NO: 317601 - DNA, 25 bp, Homo sapien
cattacggagagtttcctatgtttc

SEQ ID NO: 317602 - DNA, 25 bp, Homo sapien
attacggagagtttcctatgtttca

SEQ ID NO: 317603 - DNA, 25 bp, Homo sapien
cactatctgtaatgccttttctcac

SEQ ID NO: 317604 - DNA, 25 bp, Homo sapien
actatctgtaatgccttttctcacc

SEQ ID NO: 317605 - DNA, 25 bp, Homo sapien
ctatctgtaatgccttttctcacct

SEQ ID NO: 317606 - DNA, 25 bp, Homo sapien
tatctgtaatgccttttctcacctg

SEQ ID NO: 317607 - DNA, 25 bp, Homo sapien
atctgtaatgccttttctcacctgt

SEQ ID NO: 317608 - DNA, 25 bp, Homo sapien
tctgtaatgccttttctcacctgtc

SEQ ID NO: 317609 - DNA, 25 bp, Homo sapien
ctgtaatgccttttctcacctgtca

SEQ ID NO: 317610 - DNA, 25 bp, Homo sapien
taacttgtgtagaactattctttga

SEQ ID NO: 317611 - DNA, 25 bp, Homo sapien
gatatattgtcatgtttgttgtgaa

SEQ ID NO: 317612 - DNA, 25 bp, Homo sapien
agttgtaacacttggctagttttgt

SEQ ID NO: 317613 - DNA, 25 bp, Homo sapien
ttttcttactgcacagtagaaaaat

SEQ ID NO: 317614 - DNA, 25 bp, Homo sapien
aatgactgagggagcactctcccac

SEQ ID NO: 317615 - DNA, 25 bp, Homo sapien
tgagggagcactctcccacgtccag

SEQ ID NO: 317616 - DNA, 25 bp, Homo sapien
ccacgtccagtgcactgatcatttt

SEQ ID NO: 317617 - DNA, 25 bp, Homo sapien
gtccagtgcactgatcattttagta

SEQ ID NO: 317618 - DNA, 25 bp, Homo sapien
cagtgcactgatcattttagtatgt

SEQ ID NO: 317619 - DNA, 25 bp, Homo sapien
tttagtatgtttgtgctttgtacgg

SEQ ID NO: 317620 - DNA, 25 bp, Homo sapien
caaggtaacttgtgtagaactattc

SEQ ID NO: 317621 - DNA, 25 bp, Homo sapien
aataagtctcttagttgaattgatt

SEQ ID NO: 317622 - DNA, 25 bp, Homo sapien
ataagtctcttagttgaattgattc

SEQ ID NO: 317623 - DNA, 25 bp, Homo sapien
taagtctcttagttgaattgattca

SEQ ID NO: 317624 - DNA, 25 bp, Homo sapien
aagtctcttagttgaattgattcat

SEQ ID NO: 317625 - DNA, 25 bp, Homo sapien
agtctcttagttgaattgattcata

SEQ ID NO: 317626 - DNA, 25 bp, Homo sapien
gtctcttagttgaattgattcatag

SEQ ID NO: 317627 - DNA, 25 bp, Homo sapien
tctcttagttgaattgattcatagt

SEQ ID NO: 317628 - DNA, 25 bp, Homo sapien
ctcttagttgaattgattcatagta

SEQ ID NO: 317629 - DNA, 25 bp, Homo sapien
gttgaattgattcatagtattctat

SEQ ID NO: 317630 - DNA, 25 bp, Homo sapien
gaattgattcatagtattctatttt

SEQ ID NO: 317631 - DNA, 25 bp, Homo sapien
aattgattcatagtattctattttt

SEQ ID NO: 317632 - DNA, 25 bp, Homo sapien
agctggaagttgaggctttattgag

SEQ ID NO: 317633 - DNA, 25 bp, Homo sapien
gaagttgaggctttattgaggtgaa

SEQ ID NO: 317634 - DNA, 25 bp, Homo sapien
gttgaggctttattgaggtgaagtt

SEQ ID NO: 317635 - DNA, 25 bp, Homo sapien
ggctttattgaggtgaagttgaaac

SEQ ID NO: 317636 - DNA, 25 bp, Homo sapien
ctttattgaggtgaagttgaaacta

SEQ ID NO: 317637 - DNA, 25 bp, Homo sapien
tgaggtgaagttgaaactaatctgc

SEQ ID NO: 317638 - DNA, 25 bp, Homo sapien
aactaatctgcacacatgtaatatg

SEQ ID NO: 317639 - DNA, 25 bp, Homo sapien
actaatctgcacacatgtaatatgt

SEQ ID NO: 317640 - DNA, 25 bp, Homo sapien
taatctgcacacatgtaatatgtag

SEQ ID NO: 317641 - DNA, 25 bp, Homo sapien
aatctgcacacatgtaatatgtaga

SEQ ID NO: 317642 - DNA, 25 bp, Homo sapien
tctgcacacatgtaatatgtagaat

SEQ ID NO: 317643 - DNA, 25 bp, Homo sapien
aggtggctgacagggtgtcccttcc

SEQ ID NO: 317644 - DNA, 25 bp, Homo sapien
ggctgacagggtgtcccttcccaaa

SEQ ID NO: 317645 - DNA, 25 bp, Homo sapien
gacagggtgtcccttcccaaatcac

SEQ ID NO: 317646 - DNA, 25 bp, Homo sapien
tacagccccacttcaatggcgtttg

SEQ ID NO: 317647 - DNA, 25 bp, Homo sapien
agccccacttcaatggcgtttgtgt

SEQ ID NO: 317648 - DNA, 25 bp, Homo sapien
cttcaatggcgtttgtgtgtctgtg

SEQ ID NO: 317649 - DNA, 25 bp, Homo sapien
tgtgtctgtgtctgtacacgcctgt

SEQ ID NO: 317650 - DNA, 25 bp, Homo sapien
gtctgtacacgcctgtgctctggac

SEQ ID NO: 317651 - DNA, 25 bp, Homo sapien
tgtacacgcctgtgctctggactcg

SEQ ID NO: 317652 - DNA, 25 bp, Homo sapien
cctgtgctctggactcgctgtgcag

SEQ ID NO: 317653 - DNA, 25 bp, Homo sapien
gactcgctgtgcagggtccggctcc

SEQ ID NO: 317654 - DNA, 25 bp, Homo sapien
gaaggaattttaggcaattcatttc

SEQ ID NO: 317655 - DNA, 25 bp, Homo sapien
gcaattcatttcattcatgctgcaa

SEQ ID NO: 317656 - DNA, 25 bp, Homo sapien
ttcatttcattcatgctgcaaaaca

SEQ ID NO: 317657 - DNA, 25 bp, Homo sapien
aacttaatatattcagtacctggca

SEQ ID NO: 317658 - DNA, 25 bp, Homo sapien
gtacctggcaagtagttaatctaat

SEQ ID NO: 317659 - DNA, 25 bp, Homo sapien
acaggttctgaggtaattatcctaa

SEQ ID NO: 317660 - DNA, 25 bp, Homo sapien
attatcctaagaacagtatcagcat

SEQ ID NO: 317661 - DNA, 25 bp, Homo sapien
agaacagtatcagcatttaaacatt

SEQ ID NO: 317662 - DNA, 25 bp, Homo sapien
gcatttaaacatttcaacaaggcaa

SEQ ID NO: 317663 - DNA, 25 bp, Homo sapien
aatggagtggcgcaaacacgactca

SEQ ID NO: 317664 - DNA, 25 bp, Homo sapien
gagtggcgcaaacacgactcactgc

SEQ ID NO: 317665 - DNA, 25 bp, Homo sapien
ggaaaatctgttaatgcacatgcac

SEQ ID NO: 317666 - DNA, 25 bp, Homo sapien
gcacatgcacaataatttcctgaaa

SEQ ID NO: 317667 - DNA, 25 bp, Homo sapien
ctgaaagccataggacatgtctgta

SEQ ID NO: 317668 - DNA, 25 bp, Homo sapien
ggacatgtctgtagtcagcaccacg

SEQ ID NO: 317669 - DNA, 25 bp, Homo sapien
gtctgtagtcagcaccacgatagca

SEQ ID NO: 317670 - DNA, 25 bp, Homo sapien
caccacgatagcaccgtttcatgaa

SEQ ID NO: 317671 - DNA, 25 bp, Homo sapien
ccgtttcatgaaaggcatggcggct

SEQ ID NO: 317672 - DNA, 25 bp, Homo sapien
atggcggctgcatttcataccacat

SEQ ID NO: 317673 - DNA, 25 bp, Homo sapien
ggctgcatttcataccacatcaaaa

SEQ ID NO: 317674 - DNA, 25 bp, Homo sapien
cctcaaaactgctccggtagtagtt

SEQ ID NO: 317675 - DNA, 25 bp, Homo sapien
actgctccggtagtagtttttaatg

SEQ ID NO: 317676 - DNA, 25 bp, Homo sapien
acaactttgagagtagtcatttagc

SEQ ID NO: 317677 - DNA, 25 bp, Homo sapien
gtcatttagcagtagatgtgcatta

SEQ ID NO: 317678 - DNA, 25 bp, Homo sapien
gaaaacagttctataagtccagggt

SEQ ID NO: 317679 - DNA, 25 bp, Homo sapien
cagttctataagtccagggttaatt

SEQ ID NO: 317680 - DNA, 25 bp, Homo sapien
atgtcagtctttaatgtcgagctta

SEQ ID NO: 317681 - DNA, 25 bp, Homo sapien
aatgtcgagcttattgtagggtaga

SEQ ID NO: 317682 - DNA, 25 bp, Homo sapien
aagagctttctactcagctaacgat

SEQ ID NO: 317683 - DNA, 25 bp, Homo sapien
gctaacgattactcattgatccaaa

SEQ ID NO: 317684 - DNA, 25 bp, Homo sapien
gggctattgtgagtactgtgtatgt

SEQ ID NO: 317685 - DNA, 25 bp, Homo sapien
gagtactgtgtatgtatttagcaaa

SEQ ID NO: 317686 - DNA, 25 bp, Homo sapien
atttaagacctagtaagtgctcaat

SEQ ID NO: 317687 - DNA, 25 bp, Homo sapien
ggcgcgaatggatcctgagcctcga

SEQ ID NO: 317688 - DNA, 25 bp, Homo sapien
gcgaatggatcctgagcctcgataa

SEQ ID NO: 317689 - DNA, 25 bp, Homo sapien
gaatggatcctgagcctcgataaca

SEQ ID NO: 317690 - DNA, 25 bp, Homo sapien
aatggatcctgagcctcgataacag

SEQ ID NO: 317691 - DNA, 25 bp, Homo sapien
ggatcctgagcctcgataacagatt

SEQ ID NO: 317692 - DNA, 25 bp, Homo sapien
tcctgagcctcgataacagattcct

SEQ ID NO: 317693 - DNA, 25 bp, Homo sapien
agcctcgataacagattcctcaacc

SEQ ID NO: 317694 - DNA, 25 bp, Homo sapien
ctcgataacagattcctcaaccggc

SEQ ID NO: 317695 - DNA, 25 bp, Homo sapien
gataacagattcctcaaccggccca

SEQ ID NO: 317696 - DNA, 25 bp, Homo sapien
tcggaaattctttggagtaatacca

SEQ ID NO: 317697 - DNA, 25 bp, Homo sapien
attctttggagtaataccaagtgga

SEQ ID NO: 317698 - DNA, 25 bp, Homo sapien
gtggcactaaactccttttgattgg

SEQ ID NO: 317699 - DNA, 25 bp, Homo sapien
tctttccttcccagctagactaagc

SEQ ID NO: 317700 - DNA, 25 bp, Homo sapien
gactaagcccctcatgggcaggtaa

SEQ ID NO: 317701 - DNA, 25 bp, Homo sapien
cccctcatgggcaggtaatgaagat

SEQ ID NO: 317702 - DNA, 25 bp, Homo sapien
gcacattcctcctacatggtagatg

SEQ ID NO: 317703 - DNA, 25 bp, Homo sapien
atcaagttgtagcttggtatcatac

SEQ ID NO: 317704 - DNA, 25 bp, Homo sapien
tggtatcatacacaattgcattctg

SEQ ID NO: 317705 - DNA, 25 bp, Homo sapien
catacacaattgcattctgaggaat

SEQ ID NO: 317706 - DNA, 25 bp, Homo sapien
ctgaggaattaaggtggtacaactt

SEQ ID NO: 317707 - DNA, 25 bp, Homo sapien
cttagggagatttggtgtgtctgct

SEQ ID NO: 317708 - DNA, 25 bp, Homo sapien
tggtgtgtctgctgtgatagaaaag

SEQ ID NO: 317709 - DNA, 25 bp, Homo sapien
catgagtgggttcatgtctctctcc

SEQ ID NO: 317710 - DNA, 25 bp, Homo sapien
ggacaaaatccccacttctttgctg

SEQ ID NO: 317711 - DNA, 25 bp, Homo sapien
tgctgccgcgagtcaatttgtgatt

SEQ ID NO: 317712 - DNA, 25 bp, Homo sapien
ttttgtctgcacctgtttgatgcca

SEQ ID NO: 317713 - DNA, 25 bp, Homo sapien
tgatgccaggtcgacatttcctaag

SEQ ID NO: 317714 - DNA, 25 bp, Homo sapien
atttcctaaggcaagcccctgtatt

SEQ ID NO: 317715 - DNA, 25 bp, Homo sapien
gcccctgtatttgttgtggatttaa

SEQ ID NO: 317716 - DNA, 25 bp, Homo sapien
gatttaagtggaggcggccagcaca

SEQ ID NO: 317717 - DNA, 25 bp, Homo sapien
ggccagcacacaccttggatgtaat

SEQ ID NO: 317718 - DNA, 25 bp, Homo sapien
gatgcaatggtggtgtcctccagac

SEQ ID NO: 317719 - DNA, 25 bp, Homo sapien
aagccacaacccatcgcaagtcaag

SEQ ID NO: 317720 - DNA, 25 bp, Homo sapien
actacagttttcaaggtgcttttct

SEQ ID NO: 317721 - DNA, 25 bp, Homo sapien
tcaaggtgcttttctattctaggga

SEQ ID NO: 317722 - DNA, 25 bp, Homo sapien
ttctagggagatctgcagggcactt

SEQ ID NO: 317723 - DNA, 25 bp, Homo sapien
gggcacttaacctacattagaccta

SEQ ID NO: 317724 - DNA, 25 bp, Homo sapien
acctaagaggtctgagggttcttca

SEQ ID NO: 317725 - DNA, 25 bp, Homo sapien
atctgaagcttgtgccttttgctgc

SEQ ID NO: 317726 - DNA, 25 bp, Homo sapien
gactgatgtctcctttaacagcttg

SEQ ID NO: 317727 - DNA, 25 bp, Homo sapien
aacagcttgataagtatctcaggat

SEQ ID NO: 317728 - DNA, 25 bp, Homo sapien
atctcaggatattctgcaggaatca

SEQ ID NO: 317729 - DNA, 25 bp, Homo sapien
caggatcttatgaattagtgctttc

SEQ ID NO: 317730 - DNA, 25 bp, Homo sapien
agtgctttcattatatttgtgtcta

SEQ ID NO: 317731 - DNA, 25 bp, Homo sapien
gaaagacgcggctgaggcccggcga

SEQ ID NO: 317732 - DNA, 25 bp, Homo sapien
ctgaggcccggcgagaattccagcg

SEQ ID NO: 317733 - DNA, 25 bp, Homo sapien
tgaggcccggcgagaattccagcgc

SEQ ID NO: 317734 - DNA, 25 bp, Homo sapien
aggcccggcgagaattccagcgcga

SEQ ID NO: 317735 - DNA, 25 bp, Homo sapien
gcccggcgagaattccagcgcgacg

SEQ ID NO: 317736 - DNA, 25 bp, Homo sapien
gcgagaattccagcgcgacgcgggc

SEQ ID NO: 317737 - DNA, 25 bp, Homo sapien
attccagcgcgacgcgggcgggcca

SEQ ID NO: 317738 - DNA, 25 bp, Homo sapien
acgcgggcgggccagcagtgctcgg

SEQ ID NO: 317739 - DNA, 25 bp, Homo sapien
atcctccgcagctgctggcccgggt

SEQ ID NO: 317740 - DNA, 25 bp, Homo sapien
gcgccggcggcttagtcccgctgcc

SEQ ID NO: 317741 - DNA, 25 bp, Homo sapien
gcacggagaaagacgcggctgaggc

SEQ ID NO: 317742 - DNA, 25 bp, Homo sapien
catgtatgtactacattttttgcta

SEQ ID NO: 317743 - DNA, 25 bp, Homo sapien
ctgatatttctgtttagttgagcta

SEQ ID NO: 317744 - DNA, 25 bp, Homo sapien
gttgagctagaaatacttcttattt

SEQ ID NO: 317745 - DNA, 25 bp, Homo sapien
agcaaataatgcctactactccgac

SEQ ID NO: 317746 - DNA, 25 bp, Homo sapien
aaataatgcctactactccgacttt

SEQ ID NO: 317747 - DNA, 25 bp, Homo sapien
aatgcctactactccgacttttata

SEQ ID NO: 317748 - DNA, 25 bp, Homo sapien
gcctactactccgacttttatagaa

SEQ ID NO: 317749 - DNA, 25 bp, Homo sapien
actccgacttttatagaagctactt

SEQ ID NO: 317750 - DNA, 25 bp, Homo sapien
atggggcatagttccttatgtgttt

SEQ ID NO: 317751 - DNA, 25 bp, Homo sapien
tgtattttcatactacatactgaat

SEQ ID NO: 317752 - DNA, 25 bp, Homo sapien
aaattgttacatctagacaactgta

SEQ ID NO: 317753 - DNA, 25 bp, Homo sapien
cacagtggaatggagtacacggact

SEQ ID NO: 317754 - DNA, 25 bp, Homo sapien
ggaatggagtacacggactgaatct

SEQ ID NO: 317755 - DNA, 25 bp, Homo sapien
gaatggagtacacggactgaatctg

SEQ ID NO: 317756 - DNA, 25 bp, Homo sapien
agtacacggactgaatctgcacaga

SEQ ID NO: 317757 - DNA, 25 bp, Homo sapien
cagccaacaggactcctgcgctgga

SEQ ID NO: 317758 - DNA, 25 bp, Homo sapien
gccaacaggactcctgcgctggact

SEQ ID NO: 317759 - DNA, 25 bp, Homo sapien
aggactcctgcgctggactcctgag

SEQ ID NO: 317760 - DNA, 25 bp, Homo sapien
tcctgcgctggactcctgagctgaa

SEQ ID NO: 317761 - DNA, 25 bp, Homo sapien
ctgcgctggactcctgagctgaagt

SEQ ID NO: 317762 - DNA, 25 bp, Homo sapien
gagctgaagtgcacatgaccacatt

SEQ ID NO: 317763 - DNA, 25 bp, Homo sapien
aaggaagaaccttctgccacagctt

SEQ ID NO: 317764 - DNA, 25 bp, Homo sapien
aaaggtattttgatactagatatta

SEQ ID NO: 317765 - DNA, 25 bp, Homo sapien
ggtattttgatactagatattaaaa

SEQ ID NO: 317766 - DNA, 25 bp, Homo sapien
aaatgtgcttctgtaattgtgatat

SEQ ID NO: 317767 - DNA, 25 bp, Homo sapien
aatgtgcttctgtaattgtgatatt

SEQ ID NO: 317768 - DNA, 25 bp, Homo sapien
atgtgcttctgtaattgtgatattt

SEQ ID NO: 317769 - DNA, 25 bp, Homo sapien
ctatgttactaaagacttttaatgt

SEQ ID NO: 317770 - DNA, 25 bp, Homo sapien
tatgttactaaagacttttaatgtt

SEQ ID NO: 317771 - DNA, 25 bp, Homo sapien
tttaatgtttagaaagttacctcag

SEQ ID NO: 317772 - DNA, 25 bp, Homo sapien
ttaatgtttagaaagttacctcagt

SEQ ID NO: 317773 - DNA, 25 bp, Homo sapien
taatgtttagaaagttacctcagtt

SEQ ID NO: 317774 - DNA, 25 bp, Homo sapien
tggactacttacaaagctgttttcc

SEQ ID NO: 317775 - DNA, 25 bp, Homo sapien
tgttatcctttttctcgggagaaat

SEQ ID NO: 317776 - DNA, 25 bp, Homo sapien
ttctctgctaagtgaaatgcaactt

SEQ ID NO: 317777 - DNA, 25 bp, Homo sapien
gcttgacatttttacaatgtacata

SEQ ID NO: 317778 - DNA, 25 bp, Homo sapien
ggaacatgccgtatgaagagcctct

SEQ ID NO: 317779 - DNA, 25 bp, Homo sapien
aaacaacttacacactccattgctt

SEQ ID NO: 317780 - DNA, 25 bp, Homo sapien
acttacacactccattgcttataac

SEQ ID NO: 317781 - DNA, 25 bp, Homo sapien
acactccattgcttataacttttga

SEQ ID NO: 317782 - DNA, 25 bp, Homo sapien
ccattgcttataacttttgagagaa

SEQ ID NO: 317783 - DNA, 25 bp, Homo sapien
gaagagcctctccaataataaatgc

SEQ ID NO: 317784 - DNA, 25 bp, Homo sapien
tagagtcaagtgatactttcataaa

SEQ ID NO: 317785 - DNA, 25 bp, Homo sapien
gatactttcataaagtgtttgcaca

SEQ ID NO: 317786 - DNA, 25 bp, Homo sapien
tttcttattaaatgctgccccacac

SEQ ID NO: 317787 - DNA, 25 bp, Homo sapien
cccacacaccacagtcaagaggttg

SEQ ID NO: 317788 - DNA, 25 bp, Homo sapien
agtcaagaggttgcacatgtgttca

SEQ ID NO: 317789 - DNA, 25 bp, Homo sapien
tgtgttcaaacactctcttcttggt

SEQ ID NO: 317790 - DNA, 25 bp, Homo sapien
ctctcttcttggtagatagtcagac

SEQ ID NO: 317791 - DNA, 25 bp, Homo sapien
tagtcagactatttggtgttccttc

SEQ ID NO: 317792 - DNA, 25 bp, Homo sapien
tatttggtgttccttctgcgaaccg

SEQ ID NO: 317793 - DNA, 25 bp, Homo sapien
gaaccgccctactgtcatttaagta

SEQ ID NO: 317794 - DNA, 25 bp, Homo sapien
aactctgttgatacaggagtggcct

SEQ ID NO: 317795 - DNA, 25 bp, Homo sapien
aggagtggcctctaactcatttagt

SEQ ID NO: 317796 - DNA, 25 bp, Homo sapien
ctaactcatttagtctcctgtggat

SEQ ID NO: 317797 - DNA, 25 bp, Homo sapien
ttgggccccactggccggtgaaact

SEQ ID NO: 317798 - DNA, 25 bp, Homo sapien
gccccactggccggtgaaactgttt

SEQ ID NO: 317799 - DNA, 25 bp, Homo sapien
aactgttttttttcgattcatatca

SEQ ID NO: 317800 - DNA, 25 bp, Homo sapien
ttttcgattcatatcattgatcttg

SEQ ID NO: 317801 - DNA, 25 bp, Homo sapien
ttcgattcatatcattgatcttgac

SEQ ID NO: 317802 - DNA, 25 bp, Homo sapien
cgattcatatcattgatcttgactt

SEQ ID NO: 317803 - DNA, 25 bp, Homo sapien
gactttgtacaagtgacctattagt

SEQ ID NO: 317804 - DNA, 25 bp, Homo sapien
ctttgtacaagtgacctattagtat

SEQ ID NO: 317805 - DNA, 25 bp, Homo sapien
ttgtacaagtgacctattagtatgt

SEQ ID NO: 317806 - DNA, 25 bp, Homo sapien
gtacaagtgacctattagtatgttc

SEQ ID NO: 317807 - DNA, 25 bp, Homo sapien
acaagtgacctattagtatgttctc

SEQ ID NO: 317808 - DNA, 25 bp, Homo sapien
ggctctccgggcctcctgacaggaa

SEQ ID NO: 317809 - DNA, 25 bp, Homo sapien
gacgtagggcagttctgagcgcaac

SEQ ID NO: 317810 - DNA, 25 bp, Homo sapien
tagggcagttctgagcgcaaccact

SEQ ID NO: 317811 - DNA, 25 bp, Homo sapien
agttctgagcgcaaccactgcagag

SEQ ID NO: 317812 - DNA, 25 bp, Homo sapien
acctcagtgcccgagtactgcagag

SEQ ID NO: 317813 - DNA, 25 bp, Homo sapien
tgcccgagtactgcagagccgagaa

SEQ ID NO: 317814 - DNA, 25 bp, Homo sapien
gagccgagaagatctcctctggaca

SEQ ID NO: 317815 - DNA, 25 bp, Homo sapien
gagaagatctcctctggacaggcac

SEQ ID NO: 317816 - DNA, 25 bp, Homo sapien
aagatctcctctggacaggcacctg

SEQ ID NO: 317817 - DNA, 25 bp, Homo sapien
accctcagcctgaactaagatggtg

SEQ ID NO: 317818 - DNA, 25 bp, Homo sapien
tggtgacagtggctcagctcagaca

SEQ ID NO: 317819 - DNA, 25 bp, Homo sapien
acgaagccccgcagggagtggatac

SEQ ID NO: 317820 - DNA, 25 bp, Homo sapien
agccccgcagggagtggatactcga

SEQ ID NO: 317821 - DNA, 25 bp, Homo sapien
gagtggatactcgacagccttcggc

SEQ ID NO: 317822 - DNA, 25 bp, Homo sapien
tggatactcgacagccttcggcctc

SEQ ID NO: 317823 - DNA, 25 bp, Homo sapien
agctctggtcgaagcgcattccgcc

SEQ ID NO: 317824 - DNA, 25 bp, Homo sapien
ttggccctgcggcttcctttgcaac

SEQ ID NO: 317825 - DNA, 25 bp, Homo sapien
ttgctctccgtggtttacccctggg

SEQ ID NO: 317826 - DNA, 25 bp, Homo sapien
ttacccctgggctctgaggcctggt

SEQ ID NO: 317827 - DNA, 25 bp, Homo sapien
gccactgccgcggattggctgttgc

SEQ ID NO: 317828 - DNA, 25 bp, Homo sapien
gcggattggctgttgcggacccggg

SEQ ID NO: 317829 - DNA, 25 bp, Homo sapien
ggagaggctcgttctccgcgggttt

SEQ ID NO: 317830 - DNA, 25 bp, Homo sapien
ctttcgctatcgtgagtaaaagtat

SEQ ID NO: 317831 - DNA, 25 bp, Homo sapien
tttcgctatcgtgagtaaaagtata

SEQ ID NO: 317832 - DNA, 25 bp, Homo sapien
ttcgctatcgtgagtaaaagtatat

SEQ ID NO: 317833 - DNA, 25 bp, Homo sapien
cgctatcgtgagtaaaagtatataa

SEQ ID NO: 317834 - DNA, 25 bp, Homo sapien
aagtatataaagctgtttctaactg

SEQ ID NO: 317835 - DNA, 25 bp, Homo sapien
gtatataaagctgtttctaactgaa

SEQ ID NO: 317836 - DNA, 25 bp, Homo sapien
tataaagctgtttctaactgaaaat

SEQ ID NO: 317837 - DNA, 25 bp, Homo sapien
taaagctgtttctaactgaaaatgc

SEQ ID NO: 317838 - DNA, 25 bp, Homo sapien
aaagctgtttctaactgaaaatgct

SEQ ID NO: 317839 - DNA, 25 bp, Homo sapien
agctgtttctaactgaaaatgcttg

SEQ ID NO: 317840 - DNA, 25 bp, Homo sapien
gctgtttctaactgaaaatgcttga

SEQ ID NO: 317841 - DNA, 25 bp, Homo sapien
atcagaaatggcgtgacctgtgcag

SEQ ID NO: 317842 - DNA, 25 bp, Homo sapien
aatggcgtgacctgtgcagcctgtc

SEQ ID NO: 317843 - DNA, 25 bp, Homo sapien
agcctgtcctgggttctgtaagcca

SEQ ID NO: 317844 - DNA, 25 bp, Homo sapien
gtaagccagtgtaggtgctgtccct

SEQ ID NO: 317845 - DNA, 25 bp, Homo sapien
gccagtgtaggtgctgtccctgtga

SEQ ID NO: 317846 - DNA, 25 bp, Homo sapien
ctgctccgagctctctggctgagga

SEQ ID NO: 317847 - DNA, 25 bp, Homo sapien
gaggtggactctttgtagctggtac

SEQ ID NO: 317848 - DNA, 25 bp, Homo sapien
tagctggtactaggtttgctttaca

SEQ ID NO: 317849 - DNA, 25 bp, Homo sapien
gtactaggtttgctttacagatggg

SEQ ID NO: 317850 - DNA, 25 bp, Homo sapien
acagggctgttccatcttgcgggta

SEQ ID NO: 317851 - DNA, 25 bp, Homo sapien
gctgttccatcttgcgggtacctgc

SEQ ID NO: 317852 - DNA, 25 bp, Homo sapien
gtttatattgtagtttgtaactcac

SEQ ID NO: 317853 - DNA, 25 bp, Homo sapien
attactgtatcgttgtcgttatgta

SEQ ID NO: 317854 - DNA, 25 bp, Homo sapien
taatactcaggtttgaaggctttct

SEQ ID NO: 317855 - DNA, 25 bp, Homo sapien
aaatgttcagctgatgctccacgtg

SEQ ID NO: 317856 - DNA, 25 bp, Homo sapien
ttcagctgatgctccacgtggaatt

SEQ ID NO: 317857 - DNA, 25 bp, Homo sapien
gctccacgtggaatttctcttgcaa

SEQ ID NO: 317858 - DNA, 25 bp, Homo sapien
ggaatttctcttgcaaactgcataa

SEQ ID NO: 317859 - DNA, 25 bp, Homo sapien
aactgcataagagtactcccgagaa

SEQ ID NO: 317860 - DNA, 25 bp, Homo sapien
gtactcccgagaatgagttatgaca

SEQ ID NO: 317861 - DNA, 25 bp, Homo sapien
tgacattgtggatcagactgtacct

SEQ ID NO: 317862 - DNA, 25 bp, Homo sapien
agactgtacctgatgttcagatgtt

SEQ ID NO: 317863 - DNA, 25 bp, Homo sapien
atgccttcctgggtacatggagttc

SEQ ID NO: 317864 - DNA, 25 bp, Homo sapien
gggtacatggagttcccgcccacga

SEQ ID NO: 317865 - DNA, 25 bp, Homo sapien
tggcaatctgacaacaacctgactt

SEQ ID NO: 317866 - DNA, 25 bp, Homo sapien
gacaacaacctgacttaaaagccag

SEQ ID NO: 317867 - DNA, 25 bp, Homo sapien
tcagaaaagatgttggtgtgcagca

SEQ ID NO: 317868 - DNA, 25 bp, Homo sapien
gtgtgcagcaagaaacccttcgcag

SEQ ID NO: 317869 - DNA, 25 bp, Homo sapien
ttcgcagcacctcacatgggcaaaa

SEQ ID NO: 317870 - DNA, 25 bp, Homo sapien
tggccttgacaaccatcttgcttta

SEQ ID NO: 317871 - DNA, 25 bp, Homo sapien
gctttacaagtgaattccgccaggt

SEQ ID NO: 317872 - DNA, 25 bp, Homo sapien
tccgccaggtttctaaagatggtca

SEQ ID NO: 317873 - DNA, 25 bp, Homo sapien
gatggtcacaacacaggtgccagga

SEQ ID NO: 317874 - DNA, 25 bp, Homo sapien
gtattcagaacatgtttacgggctt

SEQ ID NO: 317875 - DNA, 25 bp, Homo sapien
atgtttacgggcttctgtattcgac

SEQ ID NO: 317876 - DNA, 25 bp, Homo sapien
cgggcttctgtattcgacagtttat

SEQ ID NO: 317877 - DNA, 25 bp, Homo sapien
gattgcaaaggtttgaatctcagaa

SEQ ID NO: 317878 - DNA, 25 bp, Homo sapien
gtttgaatctcagaaccttcttttc

SEQ ID NO: 317879 - DNA, 25 bp, Homo sapien
aaacatggctatgaatggttaaaat

SEQ ID NO: 317880 - DNA, 25 bp, Homo sapien
ggttaaaattcatcattttcaccat

SEQ ID NO: 317881 - DNA, 25 bp, Homo sapien
gtataattcagtgactttagtacat

SEQ ID NO: 317882 - DNA, 25 bp, Homo sapien
gttaataccagcttagacagtttat

SEQ ID NO: 317883 - DNA, 25 bp, Homo sapien
gacagtttattttggctcttatatt

SEQ ID NO: 317884 - DNA, 25 bp, Homo sapien
ttaggcttggtttcatgggcagaaa

SEQ ID NO: 317885 - DNA, 25 bp, Homo sapien
ttttctcatgctataaacacaaaga

SEQ ID NO: 317886 - DNA, 25 bp, Homo sapien
atgagcaatcatcaaaagtctagat

SEQ ID NO: 317887 - DNA, 25 bp, Homo sapien
tttatatctaactgtattccctgac

SEQ ID NO: 317888 - DNA, 25 bp, Homo sapien
aactgtattccctgacagctgggtt

SEQ ID NO: 317889 - DNA, 25 bp, Homo sapien
attccctgacagctgggttcatgga

SEQ ID NO: 317890 - DNA, 25 bp, Homo sapien
ctgacagctgggttcatggaaatgc

SEQ ID NO: 317891 - DNA, 25 bp, Homo sapien
gcttgttggcatcaacatttctctc

SEQ ID NO: 317892 - DNA, 25 bp, Homo sapien
acatttctctccctttcactaagga

SEQ ID NO: 317893 - DNA, 25 bp, Homo sapien
tggaacaagatctctgtaccttctt

SEQ ID NO: 317894 - DNA, 25 bp, Homo sapien
gtaccttcttgatatcgagagcctg

SEQ ID NO: 317895 - DNA, 25 bp, Homo sapien
cgagagcctgcaaaaactcaacact

SEQ ID NO: 317896 - DNA, 25 bp, Homo sapien
gaacggatacagtgcaagacctatg

SEQ ID NO: 317897 - DNA, 25 bp, Homo sapien
gtgcaagacctatgcatgtgtgcta

SEQ ID NO: 317898 - DNA, 25 bp, Homo sapien
gaaagtcatctaatgggactcacaa

SEQ ID NO: 317899 - DNA, 25 bp, Homo sapien
gggactcacaattgatttcagcaca

SEQ ID NO: 317900 - DNA, 25 bp, Homo sapien
tgatttcagcacaggatttatctgc

SEQ ID NO: 317901 - DNA, 25 bp, Homo sapien
gatttatctgctttgatgctgcaac

SEQ ID NO: 317902 - DNA, 25 bp, Homo sapien
cttctttgctgccaaggtagcttgt

SEQ ID NO: 317903 - DNA, 25 bp, Homo sapien
aaggtagcttgtttggaccctctat

SEQ ID NO: 317904 - DNA, 25 bp, Homo sapien
ggaccctctatttttaggcaatcaa

SEQ ID NO: 317905 - DNA, 25 bp, Homo sapien
tttttaggcaatcaagctactgctt

SEQ ID NO: 317906 - DNA, 25 bp, Homo sapien
agctctgctaccacgagcaaagcaa

SEQ ID NO: 317907 - DNA, 25 bp, Homo sapien
actttctcactcaattgcaacccaa

SEQ ID NO: 317908 - DNA, 25 bp, Homo sapien
tcactcaattgcaacccaactgggt

SEQ ID NO: 317909 - DNA, 25 bp, Homo sapien
tagcagtatttacagtgctgcactg

SEQ ID NO: 317910 - DNA, 25 bp, Homo sapien
gtgctgcactgccattgataccatt

SEQ ID NO: 317911 - DNA, 25 bp, Homo sapien
cattgataccattcgctgctgaaga

SEQ ID NO: 317912 - DNA, 25 bp, Homo sapien
aagctagtggcccagtgatagccca

SEQ ID NO: 317913 - DNA, 25 bp, Homo sapien
tgctgcctcaggtctttggaagaaa

SEQ ID NO: 317914 - DNA, 25 bp, Homo sapien
atcaacttatgtttaaagcagcagc

SEQ ID NO: 317915 - DNA, 25 bp, Homo sapien
aagcagcagctactgaactggaatt

SEQ ID NO: 317916 - DNA, 25 bp, Homo sapien
aatatacttgtgtgctaatgggaga

SEQ ID NO: 317917 - DNA, 25 bp, Homo sapien
atttaactagcccaaatagctcact

SEQ ID NO: 317918 - DNA, 25 bp, Homo sapien
gctcaatgtcgatcagcagaagaat

SEQ ID NO: 317919 - DNA, 25 bp, Homo sapien
gcagaagaatctggtccttcgttct

SEQ ID NO: 317920 - DNA, 25 bp, Homo sapien
gaagaatctggtccttcgttctccc

SEQ ID NO: 317921 - DNA, 25 bp, Homo sapien
gatgtaagtggtgacgattcgctct

SEQ ID NO: 317922 - DNA, 25 bp, Homo sapien
taagtggtgacgattcgctctgtct

SEQ ID NO: 317923 - DNA, 25 bp, Homo sapien
gtggtgacgattcgctctgtctcct

SEQ ID NO: 317924 - DNA, 25 bp, Homo sapien
gagttttacaatctgttttttcaca

SEQ ID NO: 317925 - DNA, 25 bp, Homo sapien
ctgttttttcacaatggcttcaaag

SEQ ID NO: 317926 - DNA, 25 bp, Homo sapien
caatggcttcaaaggccatgtcggg

SEQ ID NO: 317927 - DNA, 25 bp, Homo sapien
tgaagagccccgtcctgactccatg

SEQ ID NO: 317928 - DNA, 25 bp, Homo sapien
cccgtcctgactccatggatgttct

SEQ ID NO: 317929 - DNA, 25 bp, Homo sapien
tgagggcggcgatgagagcgaaagt

SEQ ID NO: 317930 - DNA, 25 bp, Homo sapien
gggcggcgatgagagcgaaagttgc

SEQ ID NO: 317931 - DNA, 25 bp, Homo sapien
gcggcgatgagagcgaaagttgcgc

SEQ ID NO: 317932 - DNA, 25 bp, Homo sapien
caggagccgcgggtccccgccactt

SEQ ID NO: 317933 - DNA, 25 bp, Homo sapien
gcgggtccccgccactttcgcacgg

SEQ ID NO: 317934 - DNA, 25 bp, Homo sapien
accgatgccggccatggtggagaag

SEQ ID NO: 317935 - DNA, 25 bp, Homo sapien
aaagttgcgctcggctcgtcgctgg

SEQ ID NO: 317936 - DNA, 25 bp, Homo sapien
tcggctcgtcgctgggggcttgaag

SEQ ID NO: 317937 - DNA, 25 bp, Homo sapien
ggcttgaagcggctccgcgctctgc

SEQ ID NO: 317938 - DNA, 25 bp, Homo sapien
cgcgctctgcccgtttgggcctccc

SEQ ID NO: 317939 - DNA, 25 bp, Homo sapien
cccgactcggactcgcgcccgtggg

SEQ ID NO: 317940 - DNA, 25 bp, Homo sapien
gcccgaggattctagagagagcaca

SEQ ID NO: 317941 - DNA, 25 bp, Homo sapien
gaaagcgcggtggtccggaaatttg

SEQ ID NO: 317942 - DNA, 25 bp, Homo sapien
atttgagcggctggggaaccacctt

SEQ ID NO: 317943 - DNA, 25 bp, Homo sapien
ggaaccaccttcgtgtctcctcaga

SEQ ID NO: 317944 - DNA, 25 bp, Homo sapien
gggcgggcgctgtcgcctaactggt

SEQ ID NO: 317945 - DNA, 25 bp, Homo sapien
taactggtccccaacggcgtcggag

SEQ ID NO: 317946 - DNA, 25 bp, Homo sapien
tccccaacggcgtcggagcagaggc

SEQ ID NO: 317947 - DNA, 25 bp, Homo sapien
tgcagaaaatgaacggaggagcagc

SEQ ID NO: 317948 - DNA, 25 bp, Homo sapien
tggcttgagggctgggaacactcgc

SEQ ID NO: 317949 - DNA, 25 bp, Homo sapien
ggaacactcgcgtgtgtgagagatt

SEQ ID NO: 317950 - DNA, 25 bp, Homo sapien
cactcgcgtgtgtgagagatttagg

SEQ ID NO: 317951 - DNA, 25 bp, Homo sapien
gtggttcttcaagtagatctaagtc

SEQ ID NO: 317952 - DNA, 25 bp, Homo sapien
agatctaagtctccagcatctgtgg

SEQ ID NO: 317953 - DNA, 25 bp, Homo sapien
agcatctgtggatcgccagaggtcc

SEQ ID NO: 317954 - DNA, 25 bp, Homo sapien
ggtcccgatcaaggtccagatcagt

SEQ ID NO: 317955 - DNA, 25 bp, Homo sapien
ggtccagatcagttgacagtggcaa

SEQ ID NO: 317956 - DNA, 25 bp, Homo sapien
gatcagttgacagtggcaattaaac

SEQ ID NO: 317957 - DNA, 25 bp, Homo sapien
ttcccaaaccatacttgctaaaaat

SEQ ID NO: 317958 - DNA, 25 bp, Homo sapien
ccatacttgctaaaaattctggtaa

SEQ ID NO: 317959 - DNA, 25 bp, Homo sapien
ctggtaagtatgtgcttttctgtgg

SEQ ID NO: 317960 - DNA, 25 bp, Homo sapien
ttgggttgggctggatatctttgta

SEQ ID NO: 317961 - DNA, 25 bp, Homo sapien
tatctttgtagatgtggaccaccaa

SEQ ID NO: 317962 - DNA, 25 bp, Homo sapien
gaaagacgcggctgaggcccggcga

SEQ ID NO: 317963 - DNA, 25 bp, Homo sapien
ctgaggcccggcgagaattccagcg

SEQ ID NO: 317964 - DNA, 25 bp, Homo sapien
tgaggcccggcgagaattccagcgc

SEQ ID NO: 317965 - DNA, 25 bp, Homo sapien
aggcccggcgagaattccagcgcga

SEQ ID NO: 317966 - DNA, 25 bp, Homo sapien
ggcccggcgagaattccagcgcgac

SEQ ID NO: 317967 - DNA, 25 bp, Homo sapien
gcccggcgagaattccagcgcgacg

SEQ ID NO: 317968 - DNA, 25 bp, Homo sapien
gcgagaattccagcgcgacgcgggc

SEQ ID NO: 317969 - DNA, 25 bp, Homo sapien
attccagcgcgacgcgggcgggcca

SEQ ID NO: 317970 - DNA, 25 bp, Homo sapien
gggacccggcgcatcctccgcagct

SEQ ID NO: 317971 - DNA, 25 bp, Homo sapien
gcgccggcggcttagtcccgctgcc

SEQ ID NO: 317972 - DNA, 25 bp, Homo sapien
gcacggagaaagacgcggctgaggc

SEQ ID NO: 317973 - DNA, 25 bp, Homo sapien
ccttattctgggtctgattattttt

SEQ ID NO: 317974 - DNA, 25 bp, Homo sapien
accctttccttacccatcatggaga

SEQ ID NO: 317975 - DNA, 25 bp, Homo sapien
catggagacactactaaccttgtat

SEQ ID NO: 317976 - DNA, 25 bp, Homo sapien
tttattagagtgctgataacaccat

SEQ ID NO: 317977 - DNA, 25 bp, Homo sapien
gataacaccatattacagtagcata

SEQ ID NO: 317978 - DNA, 25 bp, Homo sapien
gtagcatacttacatatctgttttc

SEQ ID NO: 317979 - DNA, 25 bp, Homo sapien
ttgcttttatttcaccagtactcag

SEQ ID NO: 317980 - DNA, 25 bp, Homo sapien
accagtactcagaactatccacagt

SEQ ID NO: 317981 - DNA, 25 bp, Homo sapien
tggaatgcccaagatctctactgca

SEQ ID NO: 317982 - DNA, 25 bp, Homo sapien
agatctctactgcatcctgtagaca

SEQ ID NO: 317983 - DNA, 25 bp, Homo sapien
tcctgtagacatggagggtttcccc

SEQ ID NO: 317984 - DNA, 25 bp, Homo sapien
gaagcttttccgaggtttgtagctc

SEQ ID NO: 317985 - DNA, 25 bp, Homo sapien
gcttttccgaggtttgtagctcagt

SEQ ID NO: 317986 - DNA, 25 bp, Homo sapien
ttccgaggtttgtagctcagtattc

SEQ ID NO: 317987 - DNA, 25 bp, Homo sapien
aggtttgtagctcagtattctttct

SEQ ID NO: 317988 - DNA, 25 bp, Homo sapien
tttgtagctcagtattctttctttg

SEQ ID NO: 317989 - DNA, 25 bp, Homo sapien
atgggcacacgttcactttatgtgg

SEQ ID NO: 317990 - DNA, 25 bp, Homo sapien
gcacacgttcactttatgtgggtat

SEQ ID NO: 317991 - DNA, 25 bp, Homo sapien
ttatgtgggtattcctttcttcctt

SEQ ID NO: 317992 - DNA, 25 bp, Homo sapien
tatgtgggtattcctttcttccttt

SEQ ID NO: 317993 - DNA, 25 bp, Homo sapien
atcttcatgtacagatactgaggca

SEQ ID NO: 317994 - DNA, 25 bp, Homo sapien
tgtacagatactgaggcagcaaaga

SEQ ID NO: 317995 - DNA, 25 bp, Homo sapien
cacagataggtagcctgagcttggg

SEQ ID NO: 317996 - DNA, 25 bp, Homo sapien
gggacacctcagtggccacagatgg

SEQ ID NO: 317997 - DNA, 25 bp, Homo sapien
cagtggccacagatgggtatcctgg

SEQ ID NO: 317998 - DNA, 25 bp, Homo sapien
gggacatctcaatggccatagatag

SEQ ID NO: 317999 - DNA, 25 bp, Homo sapien
atggccatagataggtagcctgggt

SEQ ID NO: 318000 - DNA, 25 bp, Homo sapien
gggacacctcagtgggctgatatga

SEQ ID NO: 318001 - DNA, 25 bp, Homo sapien
ggctgatatgaataggctgcacttg

SEQ ID NO: 318002 - DNA, 25 bp, Homo sapien
cttggagatacctcagtgggctgaa

SEQ ID NO: 318003 - DNA, 25 bp, Homo sapien
gccagggttgggtactccctaatgg

SEQ ID NO: 318004 - DNA, 25 bp, Homo sapien
tgggtactccctaatggcctgagat

SEQ ID NO: 318005 - DNA, 25 bp, Homo sapien
ctccctaatggcctgagatgggtag

SEQ ID NO: 318006 - DNA, 25 bp, Homo sapien
ttttctctgaaaagatccagtccta

SEQ ID NO: 318007 - DNA, 25 bp, Homo sapien
gatccagtcctagagcaggattctt

SEQ ID NO: 318008 - DNA, 25 bp, Homo sapien
aggattcttcgatcattcatggcag

SEQ ID NO: 318009 - DNA, 25 bp, Homo sapien
cttgtccaaataactcagttcttaa

SEQ ID NO: 318010 - DNA, 25 bp, Homo sapien
gatcgtaaaccattatcctttaaag

SEQ ID NO: 318011 - DNA, 25 bp, Homo sapien
tacaggtagatttttccgtccctca

SEQ ID NO: 318012 - DNA, 25 bp, Homo sapien
atttttccgtccctcattaatagtg

SEQ ID NO: 318013 - DNA, 25 bp, Homo sapien
gtccctcattaatagtgccttctta

SEQ ID NO: 318014 - DNA, 25 bp, Homo sapien
aatacagactggtgttagctataac

SEQ ID NO: 318015 - DNA, 25 bp, Homo sapien
taacaaaactccagtaaggccaaag

SEQ ID NO: 318016 - DNA, 25 bp, Homo sapien
taaggccaaagaatcccaagttctt

SEQ ID NO: 318017 - DNA, 25 bp, Homo sapien
agaatgtttgtatctacctgcccac

SEQ ID NO: 318018 - DNA, 25 bp, Homo sapien
tatctacctgcccacattttcttaa

SEQ ID NO: 318019 - DNA, 25 bp, Homo sapien
tgaagaccaagctagtggctgcact

SEQ ID NO: 318020 - DNA, 25 bp, Homo sapien
agaccaagctagtggctgcactgta

SEQ ID NO: 318021 - DNA, 25 bp, Homo sapien
agtggctgcactgtaggtctgctgc

SEQ ID NO: 318022 - DNA, 25 bp, Homo sapien
gcactgtaggtctgctgcttatttg

SEQ ID NO: 318023 - DNA, 25 bp, Homo sapien
ctgtttatgttgtagaagctgaaat

SEQ ID NO: 318024 - DNA, 25 bp, Homo sapien
agctgaaattctagcaacatgcttc

SEQ ID NO: 318025 - DNA, 25 bp, Homo sapien
acatgcttcaattctgttattttga

SEQ ID NO: 318026 - DNA, 25 bp, Homo sapien
gtgcttttgaaagccataactctta

SEQ ID NO: 318027 - DNA, 25 bp, Homo sapien
tattgtttgctaattctttacttta

SEQ ID NO: 318028 - DNA, 25 bp, Homo sapien
caaagatgaccgtggttaaggcagt

SEQ ID NO: 318029 - DNA, 25 bp, Homo sapien
taaggcagtagaaagcaggctcgac

SEQ ID NO: 318030 - DNA, 25 bp, Homo sapien
agcaggctcgacactgagacgcggt

SEQ ID NO: 318031 - DNA, 25 bp, Homo sapien
tgagacgcggttccagccctagaag

SEQ ID NO: 318032 - DNA, 25 bp, Homo sapien
ggttccagccctagaaggattgcat

SEQ ID NO: 318033 - DNA, 25 bp, Homo sapien
aggattgcattttacgattcaggca

SEQ ID NO: 318034 - DNA, 25 bp, Homo sapien
gattcaggcaaacttcgagtctcct

SEQ ID NO: 318035 - DNA, 25 bp, Homo sapien
aaacttcgagtctcctcatgtgaca

SEQ ID NO: 318036 - DNA, 25 bp, Homo sapien
tcctcatgtgacatgtgtgcactcc

SEQ ID NO: 318037 - DNA, 25 bp, Homo sapien
gaattcatcttgaccaagcctaagg

SEQ ID NO: 318038 - DNA, 25 bp, Homo sapien
aagcctaaggccgtggcatgcaagg

SEQ ID NO: 318039 - DNA, 25 bp, Homo sapien
ggaggatgtctcctctttgaacccc

SEQ ID NO: 318040 - DNA, 25 bp, Homo sapien
ctctctctcccttagagtttatgag

SEQ ID NO: 318041 - DNA, 25 bp, Homo sapien
gagttattcaaggaggagacttctt

SEQ ID NO: 318042 - DNA, 25 bp, Homo sapien
gaggagacttcttaaagacagcaac

SEQ ID NO: 318043 - DNA, 25 bp, Homo sapien
gacagcaacgcaattcttgtaactt

SEQ ID NO: 318044 - DNA, 25 bp, Homo sapien
cgcaattcttgtaacttgtgtaaat

SEQ ID NO: 318045 - DNA, 25 bp, Homo sapien
catctttcagagtgataccatttct

SEQ ID NO: 318046 - DNA, 25 bp, Homo sapien
gagtgataccatttctacatttgat

SEQ ID NO: 318047 - DNA, 25 bp, Homo sapien
tttgataatgcctgtattcctgtag

SEQ ID NO: 318048 - DNA, 25 bp, Homo sapien
attcctgtaggatgtatatagttta

SEQ ID NO: 318049 - DNA, 25 bp, Homo sapien
gaagtcaatatgtctggttttattt

SEQ ID NO: 318050 - DNA, 25 bp, Homo sapien
gtcagcgcttccctcagaaaatggg

SEQ ID NO: 318051 - DNA, 25 bp, Homo sapien
agcgcttccctcagaaaatggggtt

SEQ ID NO: 318052 - DNA, 25 bp, Homo sapien
gaaaatggggttttcattgctaacg

SEQ ID NO: 318053 - DNA, 25 bp, Homo sapien
agtttctctggctgcagtccgcacc

SEQ ID NO: 318054 - DNA, 25 bp, Homo sapien
ttctctggctgcagtccgcaccttt

SEQ ID NO: 318055 - DNA, 25 bp, Homo sapien
tgcagtccgcacctttccctacaga

SEQ ID NO: 318056 - DNA, 25 bp, Homo sapien
tgggcggccacagggacccggaaca

SEQ ID NO: 318057 - DNA, 25 bp, Homo sapien
acagggacccggaacagccagaagg

SEQ ID NO: 318058 - DNA, 25 bp, Homo sapien
gaacagccagaagggggaactcacc

SEQ ID NO: 318059 - DNA, 25 bp, Homo sapien
aactcacccagcacgaaggaaatgg

SEQ ID NO: 318060 - DNA, 25 bp, Homo sapien
actcacccagcacgaaggaaatggg

SEQ ID NO: 318061 - DNA, 25 bp, Homo sapien
aaataccgccatcgttaacatccat

SEQ ID NO: 318062 - DNA, 25 bp, Homo sapien
acatccatgcaggatcatgctcttc

SEQ ID NO: 318063 - DNA, 25 bp, Homo sapien
tcatgctcttctaccacaatttttg

SEQ ID NO: 318064 - DNA, 25 bp, Homo sapien
tggctacattgcatccagggtgctc

SEQ ID NO: 318065 - DNA, 25 bp, Homo sapien
gaagagcctgctttatcctgaagat

SEQ ID NO: 318066 - DNA, 25 bp, Homo sapien
gaagatggaccatcagaacatccct

SEQ ID NO: 318067 - DNA, 25 bp, Homo sapien
agaacatccctcctctgaacaatct

SEQ ID NO: 318068 - DNA, 25 bp, Homo sapien
gaacaatctccaatggtacatctat

SEQ ID NO: 318069 - DNA, 25 bp, Homo sapien
atgagaaacaggctctggacaacat

SEQ ID NO: 318070 - DNA, 25 bp, Homo sapien
aagtacaaccctctggagtctctga

SEQ ID NO: 318071 - DNA, 25 bp, Homo sapien
gagtctctgatcaaagacgtggatt

SEQ ID NO: 318072 - DNA, 25 bp, Homo sapien
aggtcgaatgttcactagatcttca

SEQ ID NO: 318073 - DNA, 25 bp, Homo sapien
gaatgttcactagatcttcagggaa

SEQ ID NO: 318074 - DNA, 25 bp, Homo sapien
tgttcactagatcttcagggaaggg

SEQ ID NO: 318075 - DNA, 25 bp, Homo sapien
aggccatctgctcttcttcagacag

SEQ ID NO: 318076 - DNA, 25 bp, Homo sapien
ccatctgctcttcttcagacaggaa

SEQ ID NO: 318077 - DNA, 25 bp, Homo sapien
cagacaggaatgaagcacagctggt

SEQ ID NO: 318078 - DNA, 25 bp, Homo sapien
agcacagctggtagaagggcggcac

SEQ ID NO: 318079 - DNA, 25 bp, Homo sapien
agggcggcacagaggcaaatccatt

SEQ ID NO: 318080 - DNA, 25 bp, Homo sapien
ggcacagaggcaaatccattgacaa

SEQ ID NO: 318081 - DNA, 25 bp, Homo sapien
gaggcaaatccattgacaactggag

SEQ ID NO: 318082 - DNA, 25 bp, Homo sapien
aaatccattgacaactggagtggtg

SEQ ID NO: 318083 - DNA, 25 bp, Homo sapien
attggttgtttgtaagccaatgaca

SEQ ID NO: 318084 - DNA, 25 bp, Homo sapien
ttggttgtttgtaagccaatgacat

SEQ ID NO: 318085 - DNA, 25 bp, Homo sapien
tggttgtttgtaagccaatgacatc

SEQ ID NO: 318086 - DNA, 25 bp, Homo sapien
ggttgtttgtaagccaatgacatcc

SEQ ID NO: 318087 - DNA, 25 bp, Homo sapien
ttgtttgtaagccaatgacatcccc

SEQ ID NO: 318088 - DNA, 25 bp, Homo sapien
tgtttgtaagccaatgacatcccct

SEQ ID NO: 318089 - DNA, 25 bp, Homo sapien
ttaaaggaagagtttattgtttctg

SEQ ID NO: 318090 - DNA, 25 bp, Homo sapien
gtttgtaagccaatgacatcccctc

SEQ ID NO: 318091 - DNA, 25 bp, Homo sapien
tttgtaagccaatgacatcccctcc

SEQ ID NO: 318092 - DNA, 25 bp, Homo sapien
tgtaagccaatgacatcccctccaa

SEQ ID NO: 318093 - DNA, 25 bp, Homo sapien
atattctcattttcagacaatataa

SEQ ID NO: 318094 - DNA, 25 bp, Homo sapien
cagcgcttccctcagaaaatggggt

SEQ ID NO: 318095 - DNA, 25 bp, Homo sapien
agcgcttccctcagaaaatggggtt

SEQ ID NO: 318096 - DNA, 25 bp, Homo sapien
gcgcttccctcagaaaatggggttt

SEQ ID NO: 318097 - DNA, 25 bp, Homo sapien
gaaaatggggttttcattgctaacg

SEQ ID NO: 318098 - DNA, 25 bp, Homo sapien
tctctggctgcagtccgcacctttc

SEQ ID NO: 318099 - DNA, 25 bp, Homo sapien
tgcagtccgcacctttccctacaga

SEQ ID NO: 318100 - DNA, 25 bp, Homo sapien
tgggcggccacagggacccggaaca

SEQ ID NO: 318101 - DNA, 25 bp, Homo sapien
acagggacccggaacagccagaagg

SEQ ID NO: 318102 - DNA, 25 bp, Homo sapien
gaacagccagaagggggaactcacc

SEQ ID NO: 318103 - DNA, 25 bp, Homo sapien
aactcacccagcacgaaggaaatgg

SEQ ID NO: 318104 - DNA, 25 bp, Homo sapien
actcacccagcacgaaggaaatggg

SEQ ID NO: 318105 - DNA, 25 bp, Homo sapien
gttgagtatacatctaccacacata

SEQ ID NO: 318106 - DNA, 25 bp, Homo sapien
taccacacatatttttcagcccaga

SEQ ID NO: 318107 - DNA, 25 bp, Homo sapien
acacatatttttcagcccagagaca

SEQ ID NO: 318108 - DNA, 25 bp, Homo sapien
tatttttcagcccagagacattttc

SEQ ID NO: 318109 - DNA, 25 bp, Homo sapien
gagacattttccttttgtcaaacac

SEQ ID NO: 318110 - DNA, 25 bp, Homo sapien
cattttccttttgtcaaacacgtga

SEQ ID NO: 318111 - DNA, 25 bp, Homo sapien
gagggttctaatttttataggctct

SEQ ID NO: 318112 - DNA, 25 bp, Homo sapien
ttttataggctcttgactccattcc

SEQ ID NO: 318113 - DNA, 25 bp, Homo sapien
tataggctcttgactccattcccac

SEQ ID NO: 318114 - DNA, 25 bp, Homo sapien
gtgtccccagatgcttgtggcaaat

SEQ ID NO: 318115 - DNA, 25 bp, Homo sapien
ccccagatgcttgtggcaaatgaaa

SEQ ID NO: 318116 - DNA, 25 bp, Homo sapien
cagtgtcttccatttctcttttaat

SEQ ID NO: 318117 - DNA, 25 bp, Homo sapien
tttctcttttaatcataatcatgct

SEQ ID NO: 318118 - DNA, 25 bp, Homo sapien
ttaaaaaataccctcgagcatatgg

SEQ ID NO: 318119 - DNA, 25 bp, Homo sapien
aaataccctcgagcatatggagcaa

SEQ ID NO: 318120 - DNA, 25 bp, Homo sapien
agataattgttccttttctgctaat

SEQ ID NO: 318121 - DNA, 25 bp, Homo sapien
attcattattactgtcatatctagg

SEQ ID NO: 318122 - DNA, 25 bp, Homo sapien
attactgtcatatctaggtctgttt

SEQ ID NO: 318123 - DNA, 25 bp, Homo sapien
gtcatatctaggtctgtttctgtcg

SEQ ID NO: 318124 - DNA, 25 bp, Homo sapien
aggtctgtttctgtcgactgtggac

SEQ ID NO: 318125 - DNA, 25 bp, Homo sapien
tgtggaccacttatgtgcgatccgt

SEQ ID NO: 318126 - DNA, 25 bp, Homo sapien
agcgggccgtgattgcgctactgca

SEQ ID NO: 318127 - DNA, 25 bp, Homo sapien
aaagtactacttactatattctgta

SEQ ID NO: 318128 - DNA, 25 bp, Homo sapien
tacttactatattctgtagagtgtg

SEQ ID NO: 318129 - DNA, 25 bp, Homo sapien
tttacctgtgtttgagcattatggt

SEQ ID NO: 318130 - DNA, 25 bp, Homo sapien
taaacatgcatgatctccagtactt

SEQ ID NO: 318131 - DNA, 25 bp, Homo sapien
tgagcattatggtgtaggtttaata

SEQ ID NO: 318132 - DNA, 25 bp, Homo sapien
cttcagtctctgctcaggtattaat

SEQ ID NO: 318133 - DNA, 25 bp, Homo sapien
agtctctgctcaggtattaatgtgt

SEQ ID NO: 318134 - DNA, 25 bp, Homo sapien
atgcatgatctccagtactttgtac

SEQ ID NO: 318135 - DNA, 25 bp, Homo sapien
ggtgctttctttttaatctgtgata

SEQ ID NO: 318136 - DNA, 25 bp, Homo sapien
ttttaatctgtgataatctggtgtt

SEQ ID NO: 318137 - DNA, 25 bp, Homo sapien
ccagtactttgtacaatgtatagta

SEQ ID NO: 318138 - DNA, 25 bp, Homo sapien
gaatacagttacttaatgaccatgt

SEQ ID NO: 318139 - DNA, 25 bp, Homo sapien
gaccatgttatattgcttcctgtgt

SEQ ID NO: 318140 - DNA, 25 bp, Homo sapien
atattgcttcctgtgtaacatctgc

SEQ ID NO: 318141 - DNA, 25 bp, Homo sapien
tgtgtaacatctgccatttatttcc

SEQ ID NO: 318142 - DNA, 25 bp, Homo sapien
ttcctcagctgtacaaatcctctgt

SEQ ID NO: 318143 - DNA, 25 bp, Homo sapien
ctgttttctctctgttacacactaa

SEQ ID NO: 318144 - DNA, 25 bp, Homo sapien
aacatcaatggctttgtacttgtga

SEQ ID NO: 318145 - DNA, 25 bp, Homo sapien
gtgatgagagataaccttgccctag

SEQ ID NO: 318146 - DNA, 25 bp, Homo sapien
aaccttgccctagttgtgggcaaca

SEQ ID NO: 318147 - DNA, 25 bp, Homo sapien
aaagtcacacggcttgtgggcactg

SEQ ID NO: 318148 - DNA, 25 bp, Homo sapien
gggcactgtgccaagatttaaaatt

SEQ ID NO: 318149 - DNA, 25 bp, Homo sapien
gccctctcagggaaaattcccgaat

SEQ ID NO: 318150 - DNA, 25 bp, Homo sapien
aaaattcccgaattgcagttcttga

SEQ ID NO: 318151 - DNA, 25 bp, Homo sapien
tcttgaatctgggagcttgaggatt

SEQ ID NO: 318152 - DNA, 25 bp, Homo sapien
tgaggattcataacgtacaaaagga

SEQ ID NO: 318153 - DNA, 25 bp, Homo sapien
caggacagtatcgatgtgtggcaaa

SEQ ID NO: 318154 - DNA, 25 bp, Homo sapien
gtgtggcaaaaaacagcctcgggac

SEQ ID NO: 318155 - DNA, 25 bp, Homo sapien
cagcctcgggacagcatattccaaa

SEQ ID NO: 318156 - DNA, 25 bp, Homo sapien
cagcatattccaaagtggtgaagct

SEQ ID NO: 318157 - DNA, 25 bp, Homo sapien
gattaaaagcagtcctaccatgtac

SEQ ID NO: 318158 - DNA, 25 bp, Homo sapien
agcagtcctaccatgtactacaatg

SEQ ID NO: 318159 - DNA, 25 bp, Homo sapien
catgtactacaatgggtaatcccaa

SEQ ID NO: 318160 - DNA, 25 bp, Homo sapien
cagtggccacagatgggtatcctgg

SEQ ID NO: 318161 - DNA, 25 bp, Homo sapien
atggccatagataggtagcctgggt

SEQ ID NO: 318162 - DNA, 25 bp, Homo sapien
tgggctgatatgaataggctgcact

SEQ ID NO: 318163 - DNA, 25 bp, Homo sapien
gctgatatgaataggctgcacttgg

SEQ ID NO: 318164 - DNA, 25 bp, Homo sapien
ctcagtgagctgatatgggtgggct

SEQ ID NO: 318165 - DNA, 25 bp, Homo sapien
gtgggctgggcttggagatacctca

SEQ ID NO: 318166 - DNA, 25 bp, Homo sapien
atacctcagtgggctgaaatggctg

SEQ ID NO: 318167 - DNA, 25 bp, Homo sapien
gccagggttgggtactccctaatgg

SEQ ID NO: 318168 - DNA, 25 bp, Homo sapien
ttgggtactccctaatggcctgaga

SEQ ID NO: 318169 - DNA, 25 bp, Homo sapien
ggtactccctaatggcctgagatgg

SEQ ID NO: 318170 - DNA, 25 bp, Homo sapien
ctccctaatggcctgagatgggtag

SEQ ID NO: 318171 - DNA, 25 bp, Homo sapien
tggtcccggcggagatccagtggga

SEQ ID NO: 318172 - DNA, 25 bp, Homo sapien
gccacctgttgatgcttttgacttt

SEQ ID NO: 318173 - DNA, 25 bp, Homo sapien
cacctgttgatgcttttgactttct

SEQ ID NO: 318174 - DNA, 25 bp, Homo sapien
tttctgtccttgttcctcgtcccat

SEQ ID NO: 318175 - DNA, 25 bp, Homo sapien
tgttcctcgtcccatctggagcatt

SEQ ID NO: 318176 - DNA, 25 bp, Homo sapien
gtcccatctggagcatttccaattc

SEQ ID NO: 318177 - DNA, 25 bp, Homo sapien
atttccaattctggttttgcggagc

SEQ ID NO: 318178 - DNA, 25 bp, Homo sapien
ccaattctggttttgcggagcagca

SEQ ID NO: 318179 - DNA, 25 bp, Homo sapien
tctggttttgcggagcagcaggtct

SEQ ID NO: 318180 - DNA, 25 bp, Homo sapien
ttttgcggagcagcaggtctgagct

SEQ ID NO: 318181 - DNA, 25 bp, Homo sapien
aggtctgagcttgtccggcgagggt

SEQ ID NO: 318182 - DNA, 25 bp, Homo sapien
ggaagaccatgtccgagccggcctc

SEQ ID NO: 318183 - DNA, 25 bp, Homo sapien
tactgagagcttgaagaccgccgcg

SEQ ID NO: 318184 - DNA, 25 bp, Homo sapien
gaggactctgcccttagcctgtcgc

SEQ ID NO: 318185 - DNA, 25 bp, Homo sapien
acacacctcccgtcgggctggagag

SEQ ID NO: 318186 - DNA, 25 bp, Homo sapien
tgcatgccatgggagccaagcccgg

SEQ ID NO: 318187 - DNA, 25 bp, Homo sapien
gaccgccgcgctctgataaatgaca

SEQ ID NO: 318188 - DNA, 25 bp, Homo sapien
gccgcgctctgataaatgacattga

SEQ ID NO: 318189 - DNA, 25 bp, Homo sapien
tgacattgaagaccacgttctggaa

SEQ ID NO: 318190 - DNA, 25 bp, Homo sapien
accacgttctggaaggtcagggact

SEQ ID NO: 318191 - DNA, 25 bp, Homo sapien
aaggtcagggactgcttgtcgttga

SEQ ID NO: 318192 - DNA, 25 bp, Homo sapien
ttgtcgttgatggtccaccggaaga

SEQ ID NO: 318193 - DNA, 25 bp, Homo sapien
ttttctcatgctataaacacaaaga

SEQ ID NO: 318194 - DNA, 25 bp, Homo sapien
atgagcaatcatcaaaagtctagat

SEQ ID NO: 318195 - DNA, 25 bp, Homo sapien
atttatatctaactgtattccctga

SEQ ID NO: 318196 - DNA, 25 bp, Homo sapien
atctaactgtattccctgacagctg

SEQ ID NO: 318197 - DNA, 25 bp, Homo sapien
aactgtattccctgacagctgggtt

SEQ ID NO: 318198 - DNA, 25 bp, Homo sapien
attccctgacagctgggttcatgga

SEQ ID NO: 318199 - DNA, 25 bp, Homo sapien
tccctgacagctgggttcatggaaa

SEQ ID NO: 318200 - DNA, 25 bp, Homo sapien
tgacagctgggttcatggaaatgct

SEQ ID NO: 318201 - DNA, 25 bp, Homo sapien
gcttgttggcatcaacatttctctc

SEQ ID NO: 318202 - DNA, 25 bp, Homo sapien
ttggcatcaacatttctctcccttt

SEQ ID NO: 318203 - DNA, 25 bp, Homo sapien
acatttctctccctttcactaagga

SEQ ID NO: 318204 - DNA, 25 bp, Homo sapien
caggaccacaaaacccacagaggtg

SEQ ID NO: 318205 - DNA, 25 bp, Homo sapien
gtggaggtccatggcgctctcgaca

SEQ ID NO: 318206 - DNA, 25 bp, Homo sapien
gctctcgacacggtgcgaaggcact

SEQ ID NO: 318207 - DNA, 25 bp, Homo sapien
aggcactcgggcctcagagtccaac

SEQ ID NO: 318208 - DNA, 25 bp, Homo sapien
agtccaacagctgaggtgatcgcct

SEQ ID NO: 318209 - DNA, 25 bp, Homo sapien
gtgatcgcctctgaagcacgggtag

SEQ ID NO: 318210 - DNA, 25 bp, Homo sapien
ccaaatgaaactttcgggcagctcc

SEQ ID NO: 318211 - DNA, 25 bp, Homo sapien
ttcctccagcttcttgttcttgtcc

SEQ ID NO: 318212 - DNA, 25 bp, Homo sapien
aggacttgagggacttctctactac

SEQ ID NO: 318213 - DNA, 25 bp, Homo sapien
ggacttctctactaccgagtcatca

SEQ ID NO: 318214 - DNA, 25 bp, Homo sapien
tcatcaccaacagggcgcgaagagt

SEQ ID NO: 318215 - DNA, 25 bp, Homo sapien
atgcagctaaacaactgtcctctcc

SEQ ID NO: 318216 - DNA, 25 bp, Homo sapien
gctggaggctacaggtttattctct

SEQ ID NO: 318217 - DNA, 25 bp, Homo sapien
aaaatagaggatctctgggctggta

SEQ ID NO: 318218 - DNA, 25 bp, Homo sapien
tctgggctggtagacagcaggcaca

SEQ ID NO: 318219 - DNA, 25 bp, Homo sapien
acagcaggcacagatcgaggtaagg

SEQ ID NO: 318220 - DNA, 25 bp, Homo sapien
atcgaggtaaggaatcacatcagtt

SEQ ID NO: 318221 - DNA, 25 bp, Homo sapien
ggaatcacatcagttcctgccactt

SEQ ID NO: 318222 - DNA, 25 bp, Homo sapien
ggcccagacagaatatcaagcggta

SEQ ID NO: 318223 - DNA, 25 bp, Homo sapien
gattggttgaaagtatcttcatgtt

SEQ ID NO: 318224 - DNA, 25 bp, Homo sapien
gtatcttcatgttatatgccaagtc

SEQ ID NO: 318225 - DNA, 25 bp, Homo sapien
atgccaagtccatgcagctaaacaa

SEQ ID NO: 318226 - DNA, 25 bp, Homo sapien
gaatcccagctctggcccttatcaa

SEQ ID NO: 318227 - DNA, 25 bp, Homo sapien
ccagctctggcccttatcaattctg

SEQ ID NO: 318228 - DNA, 25 bp, Homo sapien
cagctctggcccttatcaattctgt

SEQ ID NO: 318229 - DNA, 25 bp, Homo sapien
agctctggcccttatcaattctgtg

SEQ ID NO: 318230 - DNA, 25 bp, Homo sapien
gctctggcccttatcaattctgtga

SEQ ID NO: 318231 - DNA, 25 bp, Homo sapien
caattctgtgatcttatagaaggcc

SEQ ID NO: 318232 - DNA, 25 bp, Homo sapien
aattctgtgatcttatagaaggccg

SEQ ID NO: 318233 - DNA, 25 bp, Homo sapien
attctgtgatcttatagaaggccgg

SEQ ID NO: 318234 - DNA, 25 bp, Homo sapien
ttctgtgatcttatagaaggccggg

SEQ ID NO: 318235 - DNA, 25 bp, Homo sapien
tctgtgatcttatagaaggccgggc

SEQ ID NO: 318236 - DNA, 25 bp, Homo sapien
ctgtgatcttatagaaggccgggca

SEQ ID NO: 318237 - DNA, 25 bp, Homo sapien
aatggagcattagatccccagctag

SEQ ID NO: 318238 - DNA, 25 bp, Homo sapien
cattagatccccagctaggtgacct

SEQ ID NO: 318239 - DNA, 25 bp, Homo sapien
gtgacctgatgaacacctttgtaaa

SEQ ID NO: 318240 - DNA, 25 bp, Homo sapien
gtaaactctcatactgggaaatggc

SEQ ID NO: 318241 - DNA, 25 bp, Homo sapien
aagcacgaatgcattacctccatgg

SEQ ID NO: 318242 - DNA, 25 bp, Homo sapien
acctccatggttgtggttacaagca

SEQ ID NO: 318243 - DNA, 25 bp, Homo sapien
caagtcacatgctatctacagttca

SEQ ID NO: 318244 - DNA, 25 bp, Homo sapien
aacaagaccgtcaaccattgctggg

SEQ ID NO: 318245 - DNA, 25 bp, Homo sapien
aaccattgctgggagacagacacta

SEQ ID NO: 318246 - DNA, 25 bp, Homo sapien
gaaatttggccagcgggatgtttat

SEQ ID NO: 318247 - DNA, 25 bp, Homo sapien
ggatgtttatcccatcaggatgtaa

SEQ ID NO: 318248 - DNA, 25 bp, Homo sapien
aggtggctgacagggtgtcccttcc

SEQ ID NO: 318249 - DNA, 25 bp, Homo sapien
gacagggtgtcccttcccaaatcac

SEQ ID NO: 318250 - DNA, 25 bp, Homo sapien
acagccccacttcaatggcgtttgt

SEQ ID NO: 318251 - DNA, 25 bp, Homo sapien
cttcaatggcgtttgtgtgtctgtg

SEQ ID NO: 318252 - DNA, 25 bp, Homo sapien
tgtgtctgtgtctgtacacgcctgt

SEQ ID NO: 318253 - DNA, 25 bp, Homo sapien
gtctgtacacgcctgtgctctggac

SEQ ID NO: 318254 - DNA, 25 bp, Homo sapien
cctgtgctctggactcgctgtgcag

SEQ ID NO: 318255 - DNA, 25 bp, Homo sapien
gactcgctgtgcagggtccggctcc

SEQ ID NO: 318256 - DNA, 25 bp, Homo sapien
gcgtgcagcgccagtgaccagatgc

SEQ ID NO: 318257 - DNA, 25 bp, Homo sapien
gtgaccagatgcgtcgttaccgcac

SEQ ID NO: 318258 - DNA, 25 bp, Homo sapien
ttcacccgagagcagattgcgcggc

SEQ ID NO: 318259 - DNA, 25 bp, Homo sapien
tttccttttctataacactctgaat

SEQ ID NO: 318260 - DNA, 25 bp, Homo sapien
aacactctgaattgctaatcttact

SEQ ID NO: 318261 - DNA, 25 bp, Homo sapien
gctaatcttactaacacctatgatg

SEQ ID NO: 318262 - DNA, 25 bp, Homo sapien
aacacctatgatgttacctgaaatc

SEQ ID NO: 318263 - DNA, 25 bp, Homo sapien
gatgttacctgaaatcaatctccca

SEQ ID NO: 318264 - DNA, 25 bp, Homo sapien
aaatcaatctcccatatgtatgctg

SEQ ID NO: 318265 - DNA, 25 bp, Homo sapien
atatgtatgctgtatgctatgctaa

SEQ ID NO: 318266 - DNA, 25 bp, Homo sapien
gtatgctatgctaagactcctgaaa

SEQ ID NO: 318267 - DNA, 25 bp, Homo sapien
gactcctgaaatatacttactctgt

SEQ ID NO: 318268 - DNA, 25 bp, Homo sapien
atacttactctgtgcttgtgtatgt

SEQ ID NO: 318269 - DNA, 25 bp, Homo sapien
gttaatgcaactattacctagagtg

SEQ ID NO: 318270 - DNA, 25 bp, Homo sapien
ctggcaggtaaatgccttcagtttg

SEQ ID NO: 318271 - DNA, 25 bp, Homo sapien
tggcaggtaaatgccttcagtttgt

SEQ ID NO: 318272 - DNA, 25 bp, Homo sapien
ttcagtttgttgttaaatagaggct

SEQ ID NO: 318273 - DNA, 25 bp, Homo sapien
aaatagaggctgatggataccgaga

SEQ ID NO: 318274 - DNA, 25 bp, Homo sapien
aatagaggctgatggataccgagaa

SEQ ID NO: 318275 - DNA, 25 bp, Homo sapien
atagaggctgatggataccgagaag

SEQ ID NO: 318276 - DNA, 25 bp, Homo sapien
tagaggctgatggataccgagaaga

SEQ ID NO: 318277 - DNA, 25 bp, Homo sapien
gaggctgatggataccgagaagaaa

SEQ ID NO: 318278 - DNA, 25 bp, Homo sapien
aggctgatggataccgagaagaaag

SEQ ID NO: 318279 - DNA, 25 bp, Homo sapien
atggataccgagaagaaagtggagc

SEQ ID NO: 318280 - DNA, 25 bp, Homo sapien
agttgggggccggtgctgccatgct

SEQ ID NO: 318281 - DNA, 25 bp, Homo sapien
aacaacctgtgagagtacaccagtg

SEQ ID NO: 318282 - DNA, 25 bp, Homo sapien
ggaaattttgctaaatatgagtaca

SEQ ID NO: 318283 - DNA, 25 bp, Homo sapien
ctgtgagagtacaccagtgcccaga

SEQ ID NO: 318284 - DNA, 25 bp, Homo sapien
gagagtacaccagtgcccagaggca

SEQ ID NO: 318285 - DNA, 25 bp, Homo sapien
tgcccagaggcacatacacgaaaag

SEQ ID NO: 318286 - DNA, 25 bp, Homo sapien
ggcacatacacgaaaagaagggaga

SEQ ID NO: 318287 - DNA, 25 bp, Homo sapien
gggagaaatggcttacatctcttct

SEQ ID NO: 318288 - DNA, 25 bp, Homo sapien
gaaatggcttacatctcttctatgg

SEQ ID NO: 318289 - DNA, 25 bp, Homo sapien
aatggcttacatctcttctatggat

SEQ ID NO: 318290 - DNA, 25 bp, Homo sapien
ggcttacatctcttctatggataca

SEQ ID NO: 318291 - DNA, 25 bp, Homo sapien
ttacatctcttctatggatacaggg

SEQ ID NO: 318292 - DNA, 25 bp, Homo sapien
cgaggcgctggtcggcagtccgaac

SEQ ID NO: 318293 - DNA, 25 bp, Homo sapien
cagtccgaacggagggagcgagacc

SEQ ID NO: 318294 - DNA, 25 bp, Homo sapien
gagacccccaagagcaacggcggca

SEQ ID NO: 318295 - DNA, 25 bp, Homo sapien
ggctcgcaaggcaccctggcgtgca

SEQ ID NO: 318296 - DNA, 25 bp, Homo sapien
gcgtgcagcgccagtgaccagatgc

SEQ ID NO: 318297 - DNA, 25 bp, Homo sapien
agcgccagtgaccagatgcgtcgtt

SEQ ID NO: 318298 - DNA, 25 bp, Homo sapien
gccagtgaccagatgcgtcgttacc

SEQ ID NO: 318299 - DNA, 25 bp, Homo sapien
gtgaccagatgcgtcgttaccgcac

SEQ ID NO: 318300 - DNA, 25 bp, Homo sapien
agatgcgtcgttaccgcaccgcctt

SEQ ID NO: 318301 - DNA, 25 bp, Homo sapien
ccttcacccgagagcagattgcgcg

SEQ ID NO: 318302 - DNA, 25 bp, Homo sapien
cacccgagagcagattgcgcggctg

SEQ ID NO: 318303 - DNA, 25 bp, Homo sapien
gatgatcttcgtgaaatacttgaac

SEQ ID NO: 318304 - DNA, 25 bp, Homo sapien
tcttgcctgcaagtatctgctaagg

SEQ ID NO: 318305 - DNA, 25 bp, Homo sapien
gctacggttattaatgacgaacgct

SEQ ID NO: 318306 - DNA, 25 bp, Homo sapien
agatgccatttttgggctcatgaaa

SEQ ID NO: 318307 - DNA, 25 bp, Homo sapien
gaagatctaggatatgcaggtccat

SEQ ID NO: 318308 - DNA, 25 bp, Homo sapien
atatgcaggtccatgtttgttttgg

SEQ ID NO: 318309 - DNA, 25 bp, Homo sapien
tgaagaccgaagaagcagaccattt

SEQ ID NO: 318310 - DNA, 25 bp, Homo sapien
aaagccattttgtgtatctgcctcc

SEQ ID NO: 318311 - DNA, 25 bp, Homo sapien
cctccggtgtgctggaattacctgt

SEQ ID NO: 318312 - DNA, 25 bp, Homo sapien
gctggaattacctgtggaccgctta

SEQ ID NO: 318313 - DNA, 25 bp, Homo sapien
cctgtggaccgcttatggatgtcat

SEQ ID NO: 318314 - DNA, 25 bp, Homo sapien
gaaccctctatcagcctcaggaaaa

SEQ ID NO: 318315 - DNA, 25 bp, Homo sapien
gcctcaggaaaacaagacctctgtg

SEQ ID NO: 318316 - DNA, 25 bp, Homo sapien
acaggaccagctggaagcagaaaga

SEQ ID NO: 318317 - DNA, 25 bp, Homo sapien
gaaaggccaatttcacagggcacca

SEQ ID NO: 318318 - DNA, 25 bp, Homo sapien
aaggccaatttcacagggcaccaaa

SEQ ID NO: 318319 - DNA, 25 bp, Homo sapien
acagggcaccaaacaagtatgaaat

SEQ ID NO: 318320 - DNA, 25 bp, Homo sapien
taaatcagaaatgcagacaccccag

SEQ ID NO: 318321 - DNA, 25 bp, Homo sapien
gaaatgcagacaccccagacgagag

SEQ ID NO: 318322 - DNA, 25 bp, Homo sapien
atgcagacaccccagacgagagcct

SEQ ID NO: 318323 - DNA, 25 bp, Homo sapien
accccagacgagagcctcacaggag

SEQ ID NO: 318324 - DNA, 25 bp, Homo sapien
caggaggctcgtgtctttggcccag

SEQ ID NO: 318325 - DNA, 25 bp, Homo sapien
aagaagagcagatggcctggctgct

SEQ ID NO: 318326 - DNA, 25 bp, Homo sapien
tggctgctgctcagatccctgcagc

SEQ ID NO: 318327 - DNA, 25 bp, Homo sapien
gcattatccatctttcactatctgt

SEQ ID NO: 318328 - DNA, 25 bp, Homo sapien
cactatctgtaatgccttttctcac

SEQ ID NO: 318329 - DNA, 25 bp, Homo sapien
tatctgtaatgccttttctcacctg

SEQ ID NO: 318330 - DNA, 25 bp, Homo sapien
ctgtaatgccttttctcacctgtca

SEQ ID NO: 318331 - DNA, 25 bp, Homo sapien
tttctcacctgtcatctcacatttt

SEQ ID NO: 318332 - DNA, 25 bp, Homo sapien
gaacattcgaccttcattacggaga

SEQ ID NO: 318333 - DNA, 25 bp, Homo sapien
acggagagtttcctatgtttcactg

SEQ ID NO: 318334 - DNA, 25 bp, Homo sapien
gagagtttcctatgtttcactgtgc

SEQ ID NO: 318335 - DNA, 25 bp, Homo sapien
agtttcctatgtttcactgtgcaaa

SEQ ID NO: 318336 - DNA, 25 bp, Homo sapien
gccggagaatgctcccagaggccat

SEQ ID NO: 318337 - DNA, 25 bp, Homo sapien
tgggtgtctggccactccatgtgct

SEQ ID NO: 318338 - DNA, 25 bp, Homo sapien
tgctgcccgtgctgttggaccagga

SEQ ID NO: 318339 - DNA, 25 bp, Homo sapien
aggaggccttatgtctcccatcagg

SEQ ID NO: 318340 - DNA, 25 bp, Homo sapien
tatgtctcccatcaggtgtgacagc

SEQ ID NO: 318341 - DNA, 25 bp, Homo sapien
atcaggtgtgacagcccagggattt

SEQ ID NO: 318342 - DNA, 25 bp, Homo sapien
tttccaaggcttagggaggacagca

SEQ ID NO: 318343 - DNA, 25 bp, Homo sapien
gtccttgcaggttgtttcgtgggtc

SEQ ID NO: 318344 - DNA, 25 bp, Homo sapien
gcaggttgtttcgtgggtcccagca

SEQ ID NO: 318345 - DNA, 25 bp, Homo sapien
ttcgtgggtcccagcaggaacagga

SEQ ID NO: 318346 - DNA, 25 bp, Homo sapien
gcaggaacaggagcctcctgcttgg

SEQ ID NO: 318347 - DNA, 25 bp, Homo sapien
aaagtcaacaaaacagccagcgggc

SEQ ID NO: 318348 - DNA, 25 bp, Homo sapien
agtcaacaaaacagccagcgggcgg

SEQ ID NO: 318349 - DNA, 25 bp, Homo sapien
acaaaacagccagcgggcgggaact

SEQ ID NO: 318350 - DNA, 25 bp, Homo sapien
ccagcgggcgggaactgttatgatc

SEQ ID NO: 318351 - DNA, 25 bp, Homo sapien
cgggcgggaactgttatgatcacct

SEQ ID NO: 318352 - DNA, 25 bp, Homo sapien
tgttatgatcacctccacatctcag

SEQ ID NO: 318353 - DNA, 25 bp, Homo sapien
ttatgatcacctccacatctcagac

SEQ ID NO: 318354 - DNA, 25 bp, Homo sapien
atctcagaccaaagggtcgtcctcc

SEQ ID NO: 318355 - DNA, 25 bp, Homo sapien
tgcccttcttccacagcgtatgtgg

SEQ ID NO: 318356 - DNA, 25 bp, Homo sapien
gtccatgtggaccaggcgcccagct

SEQ ID NO: 318357 - DNA, 25 bp, Homo sapien
cccggacaagcccatttggaagaag

SEQ ID NO: 318358 - DNA, 25 bp, Homo sapien
gctcaatgtcgatcagcagaagaat

SEQ ID NO: 318359 - DNA, 25 bp, Homo sapien
gcagaagaatctggtccttcgttct

SEQ ID NO: 318360 - DNA, 25 bp, Homo sapien
agaagaatctggtccttcgttctcc

SEQ ID NO: 318361 - DNA, 25 bp, Homo sapien
agaatctggtccttcgttctcccct

SEQ ID NO: 318362 - DNA, 25 bp, Homo sapien
gatgtaagtggtgacgattcgctct

SEQ ID NO: 318363 - DNA, 25 bp, Homo sapien
taagtggtgacgattcgctctgtct

SEQ ID NO: 318364 - DNA, 25 bp, Homo sapien
gtggtgacgattcgctctgtctcct

SEQ ID NO: 318365 - DNA, 25 bp, Homo sapien
tgtctcctctcgcaaccgggggtag

SEQ ID NO: 318366 - DNA, 25 bp, Homo sapien
caatggcttcaaaggccatgtcggg

SEQ ID NO: 318367 - DNA, 25 bp, Homo sapien
tgaagagccccgtcctgactccatg

SEQ ID NO: 318368 - DNA, 25 bp, Homo sapien
cccgtcctgactccatggatgttct

SEQ ID NO: 318369 - DNA, 25 bp, Homo sapien
cactatctgtaatgccttttctcac

SEQ ID NO: 318370 - DNA, 25 bp, Homo sapien
actatctgtaatgccttttctcacc

SEQ ID NO: 318371 - DNA, 25 bp, Homo sapien
ctatctgtaatgccttttctcacct

SEQ ID NO: 318372 - DNA, 25 bp, Homo sapien
tatctgtaatgccttttctcacctg

SEQ ID NO: 318373 - DNA, 25 bp, Homo sapien
atctgtaatgccttttctcacctgt

SEQ ID NO: 318374 - DNA, 25 bp, Homo sapien
tctgtaatgccttttctcacctgtc

SEQ ID NO: 318375 - DNA, 25 bp, Homo sapien
ctgtaatgccttttctcacctgtca

SEQ ID NO: 318376 - DNA, 25 bp, Homo sapien
cattacggagagtttcctatgtttc

SEQ ID NO: 318377 - DNA, 25 bp, Homo sapien
attacggagagtttcctatgtttca

SEQ ID NO: 318378 - DNA, 25 bp, Homo sapien
tgaacaggctggtccctggaggcaa

SEQ ID NO: 318379 - DNA, 25 bp, Homo sapien
caagtagtgtggtgccctgaggcct

SEQ ID NO: 318380 - DNA, 25 bp, Homo sapien
gcaggctccaggaccgctcaaggaa

SEQ ID NO: 318381 - DNA, 25 bp, Homo sapien
ctccaggaccgctcaaggaacaggg

SEQ ID NO: 318382 - DNA, 25 bp, Homo sapien
gatttgaggcaactcagagaggaca

SEQ ID NO: 318383 - DNA, 25 bp, Homo sapien
actcagagaggacaggcccagcagc

SEQ ID NO: 318384 - DNA, 25 bp, Homo sapien
agctgcatcctggagtccttctgag

SEQ ID NO: 318385 - DNA, 25 bp, Homo sapien
gcatcctggagtccttctgagaaat

SEQ ID NO: 318386 - DNA, 25 bp, Homo sapien
tctgagaaatgtgggacctgcccca

SEQ ID NO: 318387 - DNA, 25 bp, Homo sapien
gatgccccgggctcagttgacccat

SEQ ID NO: 318388 - DNA, 25 bp, Homo sapien
gctcagttgacccatctgtaagtgg

SEQ ID NO: 318389 - DNA, 25 bp, Homo sapien
atttggtaatatttatgtttcctat

SEQ ID NO: 318390 - DNA, 25 bp, Homo sapien
atttatgtttcctatatttgtaatg

SEQ ID NO: 318391 - DNA, 25 bp, Homo sapien
gtaatgaacattcttcttccggtac

SEQ ID NO: 318392 - DNA, 25 bp, Homo sapien
gaacattcttcttccggtacatttt

SEQ ID NO: 318393 - DNA, 25 bp, Homo sapien
gactgagattaatttatacacattg

SEQ ID NO: 318394 - DNA, 25 bp, Homo sapien
taaatagcccctcaggaaaactaag

SEQ ID NO: 318395 - DNA, 25 bp, Homo sapien
gaaaactaagtttttctctgctgtt

SEQ ID NO: 318396 - DNA, 25 bp, Homo sapien
gctgtttttttgcttgagagagcta

SEQ ID NO: 318397 - DNA, 25 bp, Homo sapien
gcttgagagagctataactgtaata

SEQ ID NO: 318398 - DNA, 25 bp, Homo sapien
ctgtaatagacttatatttctgaac

SEQ ID NO: 318399 - DNA, 25 bp, Homo sapien
atttctgaacattttagtgcttgcc

SEQ ID NO: 318400 - DNA, 25 bp, Homo sapien
aaaggtattttgatactagatatta

SEQ ID NO: 318401 - DNA, 25 bp, Homo sapien
aaatgtgcttctgtaattgtgatat

SEQ ID NO: 318402 - DNA, 25 bp, Homo sapien
aatgtgcttctgtaattgtgatatt

SEQ ID NO: 318403 - DNA, 25 bp, Homo sapien
atgtgcttctgtaattgtgatattt

SEQ ID NO: 318404 - DNA, 25 bp, Homo sapien
gtgatattttgttttctaagtaatt

SEQ ID NO: 318405 - DNA, 25 bp, Homo sapien
ctatgttactaaagacttttaatgt

SEQ ID NO: 318406 - DNA, 25 bp, Homo sapien
tttaatgtttagaaagttacctcag

SEQ ID NO: 318407 - DNA, 25 bp, Homo sapien
taatgtttagaaagttacctcagtt

SEQ ID NO: 318408 - DNA, 25 bp, Homo sapien
gaaagatggactacttacaaagctg

SEQ ID NO: 318409 - DNA, 25 bp, Homo sapien
agatggactacttacaaagctgttt

SEQ ID NO: 318410 - DNA, 25 bp, Homo sapien
tggactacttacaaagctgttttcc

SEQ ID NO: 318411 - DNA, 25 bp, Homo sapien
caccaccaagtttctgatccttttt

SEQ ID NO: 318412 - DNA, 25 bp, Homo sapien
caccaagtttctgatcctttttctt

SEQ ID NO: 318413 - DNA, 25 bp, Homo sapien
ttcttttctctcagaatcatcggac

SEQ ID NO: 318414 - DNA, 25 bp, Homo sapien
ttttctctcagaatcatcggactca

SEQ ID NO: 318415 - DNA, 25 bp, Homo sapien
cttcatcttcacatttggtttctag

SEQ ID NO: 318416 - DNA, 25 bp, Homo sapien
ttggtttctagaccatctacctcat

SEQ ID NO: 318417 - DNA, 25 bp, Homo sapien
ggttaaattgcataagggtttgtgt

SEQ ID NO: 318418 - DNA, 25 bp, Homo sapien
gggtttgtgttagactgatagcata

SEQ ID NO: 318419 - DNA, 25 bp, Homo sapien
gttagactgatagcatatctactga

SEQ ID NO: 318420 - DNA, 25 bp, Homo sapien
agcatatctactgagtagcgccccg

SEQ ID NO: 318421 - DNA, 25 bp, Homo sapien
atatctactgagtagcgccccgccg

SEQ ID NO: 318422 - DNA, 25 bp, Homo sapien
ttatacacattgacaatgggtaaat

SEQ ID NO: 318423 - DNA, 25 bp, Homo sapien
gctgtttttttgcttgagagagcta

SEQ ID NO: 318424 - DNA, 25 bp, Homo sapien
ttttttgcttgagagagctataact

SEQ ID NO: 318425 - DNA, 25 bp, Homo sapien
ttttgcttgagagagctataactgt

SEQ ID NO: 318426 - DNA, 25 bp, Homo sapien
tttgcttgagagagctataactgta

SEQ ID NO: 318427 - DNA, 25 bp, Homo sapien
gcttgagagagctataactgtaata

SEQ ID NO: 318428 - DNA, 25 bp, Homo sapien
gagagagctataactgtaatagact

SEQ ID NO: 318429 - DNA, 25 bp, Homo sapien
gagagctataactgtaatagactta

SEQ ID NO: 318430 - DNA, 25 bp, Homo sapien
gagctataactgtaatagacttata

SEQ ID NO: 318431 - DNA, 25 bp, Homo sapien
aactgtaatagacttatatttctga

SEQ ID NO: 318432 - DNA, 25 bp, Homo sapien
tgtaatagacttatatttctgaaca

SEQ ID NO: 318433 - DNA, 25 bp, Homo sapien
aagccactgtcaccctggatttttt

SEQ ID NO: 318434 - DNA, 25 bp, Homo sapien
cctggattttttgcagcactggctg

SEQ ID NO: 318435 - DNA, 25 bp, Homo sapien
tttttgcagcactggctggaatcag

SEQ ID NO: 318436 - DNA, 25 bp, Homo sapien
ctggaatcagtggtggatactgccg

SEQ ID NO: 318437 - DNA, 25 bp, Homo sapien
gatactgccgttgaggaatttttga

SEQ ID NO: 318438 - DNA, 25 bp, Homo sapien
gtcaccaaagcattacaagatgcca

SEQ ID NO: 318439 - DNA, 25 bp, Homo sapien
gataatggtcaaaaacagcctaata

SEQ ID NO: 318440 - DNA, 25 bp, Homo sapien
aacagcctaataacacacagtgccc

SEQ ID NO: 318441 - DNA, 25 bp, Homo sapien
ataacacacagtgcccatgtgcatg

SEQ ID NO: 318442 - DNA, 25 bp, Homo sapien
agtgcccatgtgcatgctccactat

SEQ ID NO: 318443 - DNA, 25 bp, Homo sapien
atgtgcatgctccactatctcaagc

SEQ ID NO: 318444 - DNA, 25 bp, Homo sapien
ggaatgcagaccctccagatgtatc

SEQ ID NO: 318445 - DNA, 25 bp, Homo sapien
gaccctccagatgtatccttgggaa

SEQ ID NO: 318446 - DNA, 25 bp, Homo sapien
tattgaagacctactttgtcctcta

SEQ ID NO: 318447 - DNA, 25 bp, Homo sapien
tactttgtcctctacatagggtagc

SEQ ID NO: 318448 - DNA, 25 bp, Homo sapien
gtcctctacatagggtagcttctgt

SEQ ID NO: 318449 - DNA, 25 bp, Homo sapien
gtagcttctgtcagggaatcttggt

SEQ ID NO: 318450 - DNA, 25 bp, Homo sapien
gtcagggaatcttggttcttcccaa

SEQ ID NO: 318451 - DNA, 25 bp, Homo sapien
gttcttcccaagaaacactgatttt

SEQ ID NO: 318452 - DNA, 25 bp, Homo sapien
gtgttcatttatttccaccacagca

SEQ ID NO: 318453 - DNA, 25 bp, Homo sapien
atactaatgagtacctatgacccat

SEQ ID NO: 318454 - DNA, 25 bp, Homo sapien
gagtacctatgacccataacacata

SEQ ID NO: 318455 - DNA, 25 bp, Homo sapien
gaaactgattggaaactctttggga

SEQ ID NO: 318456 - DNA, 25 bp, Homo sapien
gaaagccactcgaaaaggtcagatc

SEQ ID NO: 318457 - DNA, 25 bp, Homo sapien
ggtcagatctatttgctggtgtctc

SEQ ID NO: 318458 - DNA, 25 bp, Homo sapien
gatctatttgctggtgtctctaaat

SEQ ID NO: 318459 - DNA, 25 bp, Homo sapien
gctggtgtctctaaatgactattta

SEQ ID NO: 318460 - DNA, 25 bp, Homo sapien
atgactatttactttgaaacctcta

SEQ ID NO: 318461 - DNA, 25 bp, Homo sapien
ttgaaacctctattttccagccctt

SEQ ID NO: 318462 - DNA, 25 bp, Homo sapien
attttccagccctttgctgcatttg

SEQ ID NO: 318463 - DNA, 25 bp, Homo sapien
gctgcatttggcacatttgaattaa

SEQ ID NO: 318464 - DNA, 25 bp, Homo sapien
tggatttaaatctgtggcaaatgat

SEQ ID NO: 318465 - DNA, 25 bp, Homo sapien
ttcaccactgcctcggaatgggaaa

SEQ ID NO: 318466 - DNA, 25 bp, Homo sapien
tggacgatggcagcggctggacggg

SEQ ID NO: 318467 - DNA, 25 bp, Homo sapien
ggacgggcagtgaggaaggcagtga

SEQ ID NO: 318468 - DNA, 25 bp, Homo sapien
cagtgaggagggtaccggcggcagt

SEQ ID NO: 318469 - DNA, 25 bp, Homo sapien
agggggtgtggagcccagacattga

SEQ ID NO: 318470 - DNA, 25 bp, Homo sapien
ctctgagcttttccagttttggtct

SEQ ID NO: 318471 - DNA, 25 bp, Homo sapien
cttttccagttttggtctggaggat

SEQ ID NO: 318472 - DNA, 25 bp, Homo sapien
ttttggtctggaggatctgggcccc

SEQ ID NO: 318473 - DNA, 25 bp, Homo sapien
atctgggcccccctggaatgttcca

SEQ ID NO: 318474 - DNA, 25 bp, Homo sapien
acagacaccgttcaccttgtcactg

SEQ ID NO: 318475 - DNA, 25 bp, Homo sapien
agacaccgttcaccttgtcactgac

SEQ ID NO: 318476 - DNA, 25 bp, Homo sapien
gacaccgttcaccttgtcactgact

SEQ ID NO: 318477 - DNA, 25 bp, Homo sapien
tgaagctctcaaaaaaccccgtaat

SEQ ID NO: 318478 - DNA, 25 bp, Homo sapien
ccccgtaattgtatctgcagtagtc

SEQ ID NO: 318479 - DNA, 25 bp, Homo sapien
attgtatctgcagtagtcgtccatc

SEQ ID NO: 318480 - DNA, 25 bp, Homo sapien
tatctgcagtagtcgtccatcttgt

SEQ ID NO: 318481 - DNA, 25 bp, Homo sapien
agtagtcgtccatcttgtcccgctt

SEQ ID NO: 318482 - DNA, 25 bp, Homo sapien
ctccgggatgcccttctggctgttc

SEQ ID NO: 318483 - DNA, 25 bp, Homo sapien
tgttccagttctctgcgacaggccg

SEQ ID NO: 318484 - DNA, 25 bp, Homo sapien
gccccagttccgtaactgcctggaa

SEQ ID NO: 318485 - DNA, 25 bp, Homo sapien
gtaactgcctggaactcctccacgt

SEQ ID NO: 318486 - DNA, 25 bp, Homo sapien
gaactcctccacgttgctgtcgaag

SEQ ID NO: 318487 - DNA, 25 bp, Homo sapien
tccacgttgctgtcgaagcgcaggt

SEQ ID NO: 318488 - DNA, 25 bp, Homo sapien
gcaaaagcaataaacctggcggctc

SEQ ID NO: 318489 - DNA, 25 bp, Homo sapien
aaagcaataaacctggcggctctgg

SEQ ID NO: 318490 - DNA, 25 bp, Homo sapien
agcaataaacctggcggctctggac

SEQ ID NO: 318491 - DNA, 25 bp, Homo sapien
taaacctggcggctctggacgagta

SEQ ID NO: 318492 - DNA, 25 bp, Homo sapien
aaacctggcggctctggacgagtag

SEQ ID NO: 318493 - DNA, 25 bp, Homo sapien
tccagcggccagatttgccgtcggg

SEQ ID NO: 318494 - DNA, 25 bp, Homo sapien
ttggccgccaggtcctcgtcgtcgc

SEQ ID NO: 318495 - DNA, 25 bp, Homo sapien
tcgtcgccggggtcgccgccaatga

SEQ ID NO: 318496 - DNA, 25 bp, Homo sapien
atattgaaagcttcatgtgtttcca

SEQ ID NO: 318497 - DNA, 25 bp, Homo sapien
gtttccaggcaaaaagttgtaattg

SEQ ID NO: 318498 - DNA, 25 bp, Homo sapien
aagttgtaattgaaaccaggatgaa

SEQ ID NO: 318499 - DNA, 25 bp, Homo sapien
gggccaagcagggttccagattctc

SEQ ID NO: 318500 - DNA, 25 bp, Homo sapien
aagcagggttccagattctccagcc

SEQ ID NO: 318501 - DNA, 25 bp, Homo sapien
ttctgccagctttaaaacccttcac

SEQ ID NO: 318502 - DNA, 25 bp, Homo sapien
aaaacccttcactcaagcagcatta

SEQ ID NO: 318503 - DNA, 25 bp, Homo sapien
tgacagtcaaaacctgtgtacatat

SEQ ID NO: 318504 - DNA, 25 bp, Homo sapien
aaacctgtgtacatatttccatgta

SEQ ID NO: 318505 - DNA, 25 bp, Homo sapien
atacatacacacaccttcctattat

SEQ ID NO: 318506 - DNA, 25 bp, Homo sapien
catacacacaccttcctattataaa

SEQ ID NO: 318507 - DNA, 25 bp, Homo sapien
aagcatgacatctctttggcattcc

SEQ ID NO: 318508 - DNA, 25 bp, Homo sapien
catgacatctctttggcattccaag

SEQ ID NO: 318509 - DNA, 25 bp, Homo sapien
ctttggcattccaagtttgtgtttt

SEQ ID NO: 318510 - DNA, 25 bp, Homo sapien
ttctcatggaaatggattttgcctc

SEQ ID NO: 318511 - DNA, 25 bp, Homo sapien
gaaatggattttgcctctttgggaa

SEQ ID NO: 318512 - DNA, 25 bp, Homo sapien
atggattttgcctctttgggaatga

SEQ ID NO: 318513 - DNA, 25 bp, Homo sapien
aatgatatggcagtggtggttctat

SEQ ID NO: 318514 - DNA, 25 bp, Homo sapien
gcagtggtggttctatgtataattc

SEQ ID NO: 318515 - DNA, 25 bp, Homo sapien
ccttcttcttctgggcaacagataa

SEQ ID NO: 318516 - DNA, 25 bp, Homo sapien
gattcatggaatctcatcagcctgt

SEQ ID NO: 318517 - DNA, 25 bp, Homo sapien
aatctcatcagcctgttgtctgggt

SEQ ID NO: 318518 - DNA, 25 bp, Homo sapien
ctgttgtctgggttgcacaattatc

SEQ ID NO: 318519 - DNA, 25 bp, Homo sapien
gttgcacaattatcagccttggctg

SEQ ID NO: 318520 - DNA, 25 bp, Homo sapien
aaatgaaatcagacattctcatgga

SEQ ID NO: 318521 - DNA, 25 bp, Homo sapien
tcctccttcagagtcagtttctgca

SEQ ID NO: 318522 - DNA, 25 bp, Homo sapien
tcagagtcagtttctgcagtcagga

SEQ ID NO: 318523 - DNA, 25 bp, Homo sapien
gtcagtttctgcagtcaggagagat

SEQ ID NO: 318524 - DNA, 25 bp, Homo sapien
gtcaggagagatgagcagttcacca

SEQ ID NO: 318525 - DNA, 25 bp, Homo sapien
gagagatgagcagttcaccaggaat

SEQ ID NO: 318526 - DNA, 25 bp, Homo sapien
gatgagcagttcaccaggaattggg

SEQ ID NO: 318527 - DNA, 25 bp, Homo sapien
gtgatggtgttagagattgcagccc

SEQ ID NO: 318528 - DNA, 25 bp, Homo sapien
attgcagcccaggacaaagcatcac

SEQ ID NO: 318529 - DNA, 25 bp, Homo sapien
aactgcagcaggttgtacaaaacat

SEQ ID NO: 318530 - DNA, 25 bp, Homo sapien
agagagctcacttgacccaaccgag

SEQ ID NO: 318531 - DNA, 25 bp, Homo sapien
gctcacttgacccaaccgagggttt

SEQ ID NO: 318532 - DNA, 25 bp, Homo sapien
aaataaaagtggttcaagctgggca

SEQ ID NO: 318533 - DNA, 25 bp, Homo sapien
aataaaagtggttcaagctgggcat

SEQ ID NO: 318534 - DNA, 25 bp, Homo sapien
taaaagtggttcaagctgggcatgg

SEQ ID NO: 318535 - DNA, 25 bp, Homo sapien
aaaagtggttcaagctgggcatggt

SEQ ID NO: 318536 - DNA, 25 bp, Homo sapien
aaagtggttcaagctgggcatggtg

SEQ ID NO: 318537 - DNA, 25 bp, Homo sapien
aagtggttcaagctgggcatggtgg

SEQ ID NO: 318538 - DNA, 25 bp, Homo sapien
ttacccaggcgtgatggtgggcgcc

SEQ ID NO: 318539 - DNA, 25 bp, Homo sapien
tacccaggcgtgatggtgggcgcct

SEQ ID NO: 318540 - DNA, 25 bp, Homo sapien
acccaggcgtgatggtgggcgcctg

SEQ ID NO: 318541 - DNA, 25 bp, Homo sapien
cccaggcgtgatggtgggcgcctgt

SEQ ID NO: 318542 - DNA, 25 bp, Homo sapien
ccaggcgtgatggtgggcgcctgta

SEQ ID NO: 318543 - DNA, 25 bp, Homo sapien
tttggcttaacttccagatgctcag

SEQ ID NO: 318544 - DNA, 25 bp, Homo sapien
cttaacttccagatgctcagtcggc

SEQ ID NO: 318545 - DNA, 25 bp, Homo sapien
ggactgaagggcagctgccaagacc

SEQ ID NO: 318546 - DNA, 25 bp, Homo sapien
tcagttacctcctgacctgagggtg

SEQ ID NO: 318547 - DNA, 25 bp, Homo sapien
agagtggcaggaagcaagcatgttt

SEQ ID NO: 318548 - DNA, 25 bp, Homo sapien
agcatgtttgctgtgcacttaggaa

SEQ ID NO: 318549 - DNA, 25 bp, Homo sapien
agagggactgatcaggccccattca

SEQ ID NO: 318550 - DNA, 25 bp, Homo sapien
ctttctgtcctcacagattctgttt

SEQ ID NO: 318551 - DNA, 25 bp, Homo sapien
gtcctcacagattctgtttgacaga

SEQ ID NO: 318552 - DNA, 25 bp, Homo sapien
gtttgacagaatctaagggccatca

SEQ ID NO: 318553 - DNA, 25 bp, Homo sapien
tctaagggccatcagggaactcttt

SEQ ID NO: 318554 - DNA, 25 bp, Homo sapien
agtaccaaaggtagtctagtctaga

SEQ ID NO: 318555 - DNA, 25 bp, Homo sapien
gtctagtctagaacgataagttaat

SEQ ID NO: 318556 - DNA, 25 bp, Homo sapien
taagttaatacgtgttggcttttct

SEQ ID NO: 318557 - DNA, 25 bp, Homo sapien
ttctaatttgtactgtaacatcctt

SEQ ID NO: 318558 - DNA, 25 bp, Homo sapien
gtactgtaacatccttatactttct

SEQ ID NO: 318559 - DNA, 25 bp, Homo sapien
gatgcagagttcaggttaatatttt

SEQ ID NO: 318560 - DNA, 25 bp, Homo sapien
ggttaatattttactgcatctgata

SEQ ID NO: 318561 - DNA, 25 bp, Homo sapien
aatgtattatacgtttgaagcctag

SEQ ID NO: 318562 - DNA, 25 bp, Homo sapien
tatacgtttgaagcctagtgacttt

SEQ ID NO: 318563 - DNA, 25 bp, Homo sapien
gacattcttgtgatttcatatgctg

SEQ ID NO: 318564 - DNA, 25 bp, Homo sapien
ttcatatgctgtattcttcaagcaa

SEQ ID NO: 318565 - DNA, 25 bp, Homo sapien
atgtagcgggcgatcagttcattcc

SEQ ID NO: 318566 - DNA, 25 bp, Homo sapien
agttcattccgaccatacatcttgc

SEQ ID NO: 318567 - DNA, 25 bp, Homo sapien
gaccatacatcttgccttcatcaga

SEQ ID NO: 318568 - DNA, 25 bp, Homo sapien
gggacccagtttggcctgcagagaa

SEQ ID NO: 318569 - DNA, 25 bp, Homo sapien
gcagaggacatggttgccattgtct

SEQ ID NO: 318570 - DNA, 25 bp, Homo sapien
gttgccattgtctggaaagccttgt

SEQ ID NO: 318571 - DNA, 25 bp, Homo sapien
gaaagccttgtccttggaaacctgg

SEQ ID NO: 318572 - DNA, 25 bp, Homo sapien
caacttggactggatttcccttgat

SEQ ID NO: 318573 - DNA, 25 bp, Homo sapien
tttccttcgggccaaaacctggatg

SEQ ID NO: 318574 - DNA, 25 bp, Homo sapien
cctggatgtgactagaaacctgttt

SEQ ID NO: 318575 - DNA, 25 bp, Homo sapien
ttccccgttctcagcttgatgtagc

SEQ ID NO: 318576 - DNA, 25 bp, Homo sapien
gaattaggactccttgtgtgtgtta

SEQ ID NO: 318577 - DNA, 25 bp, Homo sapien
ttgtgtgtgttacaccaccccatat

SEQ ID NO: 318578 - DNA, 25 bp, Homo sapien
tgtgttacaccaccccatatgctgg

SEQ ID NO: 318579 - DNA, 25 bp, Homo sapien
cccatatgctgggttcactggaaca

SEQ ID NO: 318580 - DNA, 25 bp, Homo sapien
atcccctacataacactaacacttg

SEQ ID NO: 318581 - DNA, 25 bp, Homo sapien
agactggagtcagtgtcacggccac

SEQ ID NO: 318582 - DNA, 25 bp, Homo sapien
ggagtcagtgtcacggccaccgtcg

SEQ ID NO: 318583 - DNA, 25 bp, Homo sapien
ataacactaacacttggccataccc

SEQ ID NO: 318584 - DNA, 25 bp, Homo sapien
taacacttggccatacccatcagtg

SEQ ID NO: 318585 - DNA, 25 bp, Homo sapien
agtgccacctccaagggacctaaag

SEQ ID NO: 318586 - DNA, 25 bp, Homo sapien
ctccaagggacctaaagatgcctgg

SEQ ID NO: 318587 - DNA, 25 bp, Homo sapien
caaacaccagttttctttacaggct

SEQ ID NO: 318588 - DNA, 25 bp, Homo sapien
acaccagttttctttacaggcttcg

SEQ ID NO: 318589 - DNA, 25 bp, Homo sapien
ccagttttctttacaggcttcgagc

SEQ ID NO: 318590 - DNA, 25 bp, Homo sapien
gttttctttacaggcttcgagcccg

SEQ ID NO: 318591 - DNA, 25 bp, Homo sapien
tttacaggcttcgagcccgtcgcgg

SEQ ID NO: 318592 - DNA, 25 bp, Homo sapien
gctgctttgctaatggcggcggctc

SEQ ID NO: 318593 - DNA, 25 bp, Homo sapien
tgctttgctaatggcggcggctctc

SEQ ID NO: 318594 - DNA, 25 bp, Homo sapien
aaaaggccggcgtccatgttggcac

SEQ ID NO: 318595 - DNA, 25 bp, Homo sapien
gccggcgtccatgttggcaccatga

SEQ ID NO: 318596 - DNA, 25 bp, Homo sapien
atgttggcaccatgacgcagcatct

SEQ ID NO: 318597 - DNA, 25 bp, Homo sapien
ttggcaccatgacgcagcatctccg

SEQ ID NO: 318598 - DNA, 25 bp, Homo sapien
tctgtgtagggcatgtggctcctgt

SEQ ID NO: 318599 - DNA, 25 bp, Homo sapien
tgtagggcatgtggctcctgtcttg

SEQ ID NO: 318600 - DNA, 25 bp, Homo sapien
agggcatgtggctcctgtcttgcat

SEQ ID NO: 318601 - DNA, 25 bp, Homo sapien
ggtttctgccaatcacacgttcaat

SEQ ID NO: 318602 - DNA, 25 bp, Homo sapien
tttctgccaatcacacgttcaatct

SEQ ID NO: 318603 - DNA, 25 bp, Homo sapien
ctgccaatcacacgttcaatctctt

SEQ ID NO: 318604 - DNA, 25 bp, Homo sapien
aatcacacgttcaatctcttcctgg

SEQ ID NO: 318605 - DNA, 25 bp, Homo sapien
gatggttggttgtgcttttccttct

SEQ ID NO: 318606 - DNA, 25 bp, Homo sapien
tgagggttgttcatgtccattgatt

SEQ ID NO: 318607 - DNA, 25 bp, Homo sapien
gggttgttcatgtccattgattctt

SEQ ID NO: 318608 - DNA, 25 bp, Homo sapien
ttgttcatgtccattgattcttggt

SEQ ID NO: 318609 - DNA, 25 bp, Homo sapien
gacctcagcgtcgaggtcaacatct

SEQ ID NO: 318610 - DNA, 25 bp, Homo sapien
ggtcaacatctcctctgagacagtg

SEQ ID NO: 318611 - DNA, 25 bp, Homo sapien
gacagtgccgcccaccatcagtgtg

SEQ ID NO: 318612 - DNA, 25 bp, Homo sapien
caccatcagtgtgcccaagggtagg

SEQ ID NO: 318613 - DNA, 25 bp, Homo sapien
gtagggccgtggtgaccgtgcgcga

SEQ ID NO: 318614 - DNA, 25 bp, Homo sapien
gagggatcgcctgccgagctgcaat

SEQ ID NO: 318615 - DNA, 25 bp, Homo sapien
cgcctgccgagctgcaatgcgaggt

SEQ ID NO: 318616 - DNA, 25 bp, Homo sapien
cagtgctctggtcccgcgtggacaa

SEQ ID NO: 318617 - DNA, 25 bp, Homo sapien
tcccgcgtggacaaggaggctgcac

SEQ ID NO: 318618 - DNA, 25 bp, Homo sapien
tgagccgagacatgagcgggaccta

SEQ ID NO: 318619 - DNA, 25 bp, Homo sapien
acatgagcgggacctaccgctgcca

SEQ ID NO: 318620 - DNA, 25 bp, Homo sapien
gcctggcagtctctgacagagcttg

SEQ ID NO: 318621 - DNA, 25 bp, Homo sapien
agagcttgctgtaatggcctaacgt

SEQ ID NO: 318622 - DNA, 25 bp, Homo sapien
ggcctaacgtgctttatttggtgat

SEQ ID NO: 318623 - DNA, 25 bp, Homo sapien
ttggtgatgccacccaaaagtggat

SEQ ID NO: 318624 - DNA, 25 bp, Homo sapien
gcagagctgatggtaggtagtcact

SEQ ID NO: 318625 - DNA, 25 bp, Homo sapien
cctgcagttgctcagtgttgggaac

SEQ ID NO: 318626 - DNA, 25 bp, Homo sapien
gtgttgggaacgagccccacagcga

SEQ ID NO: 318627 - DNA, 25 bp, Homo sapien
gaacttcagcgctccattctaggga

SEQ ID NO: 318628 - DNA, 25 bp, Homo sapien
gggagagtcatggaaacctgcctga

SEQ ID NO: 318629 - DNA, 25 bp, Homo sapien
aacctgcctgagaatatccatgcct

SEQ ID NO: 318630 - DNA, 25 bp, Homo sapien
gtttgagataacattcttgtcattt

SEQ ID NO: 318631 - DNA, 25 bp, Homo sapien
gcttttgctaatgtgcttggtgccc

SEQ ID NO: 318632 - DNA, 25 bp, Homo sapien
ccactgaggctgctgagcagtgctt

SEQ ID NO: 318633 - DNA, 25 bp, Homo sapien
tgagcagtgcttaccatgcgcccga

SEQ ID NO: 318634 - DNA, 25 bp, Homo sapien
atgcgcccgatgtctcttctgtgtg

SEQ ID NO: 318635 - DNA, 25 bp, Homo sapien
gcaaaagtggcctcagagtctgaag

SEQ ID NO: 318636 - DNA, 25 bp, Homo sapien
aaagtccagactagctcttgaccac

SEQ ID NO: 318637 - DNA, 25 bp, Homo sapien
agctcttgaccacatccaagtgcat

SEQ ID NO: 318638 - DNA, 25 bp, Homo sapien
aagtgcatcctgcattaagctcagg

SEQ ID NO: 318639 - DNA, 25 bp, Homo sapien
taagctcaggcacatcaaacctgcc

SEQ ID NO: 318640 - DNA, 25 bp, Homo sapien
ctgcccaatcaaggtctgccaaagg

SEQ ID NO: 318641 - DNA, 25 bp, Homo sapien
ggagtctgcaaatgacatttctcat

SEQ ID NO: 318642 - DNA, 25 bp, Homo sapien
tcctcggtacacagaccacgggaca

SEQ ID NO: 318643 - DNA, 25 bp, Homo sapien
cctggcatccatgggcaaaggagag

SEQ ID NO: 318644 - DNA, 25 bp, Homo sapien
aggagagactgagacacaccgatgt

SEQ ID NO: 318645 - DNA, 25 bp, Homo sapien
accgatgtgtcaccatggcccggtg

SEQ ID NO: 318646 - DNA, 25 bp, Homo sapien
ggttcctgctgggaagcaacctgga

SEQ ID NO: 318647 - DNA, 25 bp, Homo sapien
tgggaagcaacctggactccggcct

SEQ ID NO: 318648 - DNA, 25 bp, Homo sapien
tccctctgtgcatcagtttccacat

SEQ ID NO: 318649 - DNA, 25 bp, Homo sapien
gtttccacatctccagagtctaggg

SEQ ID NO: 318650 - DNA, 25 bp, Homo sapien
agtctagggccctcttcctgagtga

SEQ ID NO: 318651 - DNA, 25 bp, Homo sapien
tcttcctgagtgacttaatccctga

SEQ ID NO: 318652 - DNA, 25 bp, Homo sapien
gtgacttaatccctgaagagagtgt

SEQ ID NO: 318653 - DNA, 25 bp, Homo sapien
ggcgcagaggcagaacagaagtcaa

SEQ ID NO: 318654 - DNA, 25 bp, Homo sapien
tgggaggcgcctttagtgacctgaa

SEQ ID NO: 318655 - DNA, 25 bp, Homo sapien
tagtgacctgaagtagtgagtctag

SEQ ID NO: 318656 - DNA, 25 bp, Homo sapien
agggcaggaccaggctctcggcatc

SEQ ID NO: 318657 - DNA, 25 bp, Homo sapien
aagggtcgcacagaaggcgggcgcc

SEQ ID NO: 318658 - DNA, 25 bp, Homo sapien
tcggcatctccgaggcggcggactc

SEQ ID NO: 318659 - DNA, 25 bp, Homo sapien
cggcggactcggatggagcagtttc

SEQ ID NO: 318660 - DNA, 25 bp, Homo sapien
gagcagtttctgagtgacggcctcc

SEQ ID NO: 318661 - DNA, 25 bp, Homo sapien
cgggcctgggcgtcaagggcgaagg

SEQ ID NO: 318662 - DNA, 25 bp, Homo sapien
gcgaaggccgaaagccggcgttaga

SEQ ID NO: 318663 - DNA, 25 bp, Homo sapien
gaagcggcttaggagaggccagagc

SEQ ID NO: 318664 - DNA, 25 bp, Homo sapien
ctacaagcaattaggtgattcaaaa

SEQ ID NO: 318665 - DNA, 25 bp, Homo sapien
acaagcaattaggtgattcaaaaga

SEQ ID NO: 318666 - DNA, 25 bp, Homo sapien
aagcaattaggtgattcaaaagagc

SEQ ID NO: 318667 - DNA, 25 bp, Homo sapien
tgattcaaaagagcaacttaggctg

SEQ ID NO: 318668 - DNA, 25 bp, Homo sapien
gattcaaaagagcaacttaggctgg

SEQ ID NO: 318669 - DNA, 25 bp, Homo sapien
ttcaaaagagcaacttaggctgggt

SEQ ID NO: 318670 - DNA, 25 bp, Homo sapien
caaaagagcaacttaggctgggtgc

SEQ ID NO: 318671 - DNA, 25 bp, Homo sapien
aaaagagcaacttaggctgggtgca

SEQ ID NO: 318672 - DNA, 25 bp, Homo sapien
aaagagcaacttaggctgggtgcag

SEQ ID NO: 318673 - DNA, 25 bp, Homo sapien
aaattaaccagacattgtggcatgt

SEQ ID NO: 318674 - DNA, 25 bp, Homo sapien
attaaccagacattgtggcatgtgc

SEQ ID NO: 318675 - DNA, 25 bp, Homo sapien
gtacatatgaaagtgacctccaagg

SEQ ID NO: 318676 - DNA, 25 bp, Homo sapien
aatactcataaggatcttcaggctg

SEQ ID NO: 318677 - DNA, 25 bp, Homo sapien
cttcaggctgaacagactatgtctg

SEQ ID NO: 318678 - DNA, 25 bp, Homo sapien
gaaagaacggattatgccccattaa

SEQ ID NO: 318679 - DNA, 25 bp, Homo sapien
tgccccattaaataacaagttgtgt

SEQ ID NO: 318680 - DNA, 25 bp, Homo sapien
gttcaagagtcagagcagtgagctc

SEQ ID NO: 318681 - DNA, 25 bp, Homo sapien
ccttctcactgagacagcaacattt

SEQ ID NO: 318682 - DNA, 25 bp, Homo sapien
gtatttgtggaactcactgcctcag

SEQ ID NO: 318683 - DNA, 25 bp, Homo sapien
gaactcactgcctcagtttgggtaa

SEQ ID NO: 318684 - DNA, 25 bp, Homo sapien
aaggatgagcagacaagtcaactaa

SEQ ID NO: 318685 - DNA, 25 bp, Homo sapien
ggttgagcaatctagagcatggagt

SEQ ID NO: 318686 - DNA, 25 bp, Homo sapien
tgttaagcatggattttccccctaa

SEQ ID NO: 318687 - DNA, 25 bp, Homo sapien
aaattctactctaaagcttctataa

SEQ ID NO: 318688 - DNA, 25 bp, Homo sapien
gaatttcatgtgaatccctttagga

SEQ ID NO: 318689 - DNA, 25 bp, Homo sapien
aatttcatgtgaatccctttaggat

SEQ ID NO: 318690 - DNA, 25 bp, Homo sapien
tttcatgtgaatccctttaggatgt

SEQ ID NO: 318691 - DNA, 25 bp, Homo sapien
catgtgaatccctttaggatgtttt

SEQ ID NO: 318692 - DNA, 25 bp, Homo sapien
ttcctataccttactgacacattgc

SEQ ID NO: 318693 - DNA, 25 bp, Homo sapien
gataatttattatacaccttagtct

SEQ ID NO: 318694 - DNA, 25 bp, Homo sapien
taatttattatacaccttagtcttt

SEQ ID NO: 318695 - DNA, 25 bp, Homo sapien
gtaagaaataatgcctccaattttt

SEQ ID NO: 318696 - DNA, 25 bp, Homo sapien
gatatgttaagcatggattttcccc

SEQ ID NO: 318697 - DNA, 25 bp, Homo sapien
cccaggagtctaagttaaatctaat

SEQ ID NO: 318698 - DNA, 25 bp, Homo sapien
atactgaacttgcaggtccaggttg

SEQ ID NO: 318699 - DNA, 25 bp, Homo sapien
gtccaggttggtatacattccaccc

SEQ ID NO: 318700 - DNA, 25 bp, Homo sapien
gtatacattccaccctctagaagta

SEQ ID NO: 318701 - DNA, 25 bp, Homo sapien
attccaccctctagaagtattttct

SEQ ID NO: 318702 - DNA, 25 bp, Homo sapien
agataagctgctcacattttgtttt

SEQ ID NO: 318703 - DNA, 25 bp, Homo sapien
ttttgaatgggcatctcctgaggaa

SEQ ID NO: 318704 - DNA, 25 bp, Homo sapien
atctcctgaggaaatgtagcatgac

SEQ ID NO: 318705 - DNA, 25 bp, Homo sapien
agcatgacattggtactaactgcat

SEQ ID NO: 318706 - DNA, 25 bp, Homo sapien
taaatacatcatactggcaaaccgt

SEQ ID NO: 318707 - DNA, 25 bp, Homo sapien
gtatcatcattcatgtagtatctat

SEQ ID NO: 318708 - DNA, 25 bp, Homo sapien
gcacaaaatggtttgggacttccaa

SEQ ID NO: 318709 - DNA, 25 bp, Homo sapien
actgtctctcctgcttcaagatgtt

SEQ ID NO: 318710 - DNA, 25 bp, Homo sapien
aagactctcaggaaagcaggctaca

SEQ ID NO: 318711 - DNA, 25 bp, Homo sapien
agcaggctacagctctacctcaaaa

SEQ ID NO: 318712 - DNA, 25 bp, Homo sapien
gaaggactggttttccaatggccta

SEQ ID NO: 318713 - DNA, 25 bp, Homo sapien
tggcctatatacacattttgctgca

SEQ ID NO: 318714 - DNA, 25 bp, Homo sapien
ttttgctgcactctacaaacagaaa

SEQ ID NO: 318715 - DNA, 25 bp, Homo sapien
aagcaataggcttgaatttcaccat

SEQ ID NO: 318716 - DNA, 25 bp, Homo sapien
ttcaccatgatatgtggtacaccta

SEQ ID NO: 318717 - DNA, 25 bp, Homo sapien
ggtacacctaccttattattcactt

SEQ ID NO: 318718 - DNA, 25 bp, Homo sapien
caagatgtttcttccctgtggatga

SEQ ID NO: 318719 - DNA, 25 bp, Homo sapien
aaatgctacagctatacccagacct

SEQ ID NO: 318720 - DNA, 25 bp, Homo sapien
gctacagctatacccagacctttta

SEQ ID NO: 318721 - DNA, 25 bp, Homo sapien
agctatacccagaccttttataggt

SEQ ID NO: 318722 - DNA, 25 bp, Homo sapien
atacccagaccttttataggtaatg

SEQ ID NO: 318723 - DNA, 25 bp, Homo sapien
ccttttataggtaatgaagcagttc

SEQ ID NO: 318724 - DNA, 25 bp, Homo sapien
caaaacctgtcctcagaattctata

SEQ ID NO: 318725 - DNA, 25 bp, Homo sapien
ctgtcctcagaattctataaagtgt

SEQ ID NO: 318726 - DNA, 25 bp, Homo sapien
ataaagtgtattaagaatgttcctt

SEQ ID NO: 318727 - DNA, 25 bp, Homo sapien
gaagcagtaagcagcatctgaagcc

SEQ ID NO: 318728 - DNA, 25 bp, Homo sapien
gcagtaagcagcatctgaagccaca

SEQ ID NO: 318729 - DNA, 25 bp, Homo sapien
gtttaaaaagctacaatcacatcat

SEQ ID NO: 318730 - DNA, 25 bp, Homo sapien
cagctgccctcgtatgaagacaata

SEQ ID NO: 318731 - DNA, 25 bp, Homo sapien
gccctcgtatgaagacaatagctgt

SEQ ID NO: 318732 - DNA, 25 bp, Homo sapien
atagctgtaaggatgaaggcacaca

SEQ ID NO: 318733 - DNA, 25 bp, Homo sapien
gaaggcacacaaaatgccaagtgag

SEQ ID NO: 318734 - DNA, 25 bp, Homo sapien
aagtgagagctctggctacagtccc

SEQ ID NO: 318735 - DNA, 25 bp, Homo sapien
aaggcaaaccctgcggctgtggcct

SEQ ID NO: 318736 - DNA, 25 bp, Homo sapien
ggctgtggccttggctttgccagaa

SEQ ID NO: 318737 - DNA, 25 bp, Homo sapien
atgaggacacagaagccccatgagt

SEQ ID NO: 318738 - DNA, 25 bp, Homo sapien
aagggatttgcctcacgccacagtg

SEQ ID NO: 318739 - DNA, 25 bp, Homo sapien
ttgcctcacgccacagtgaacaagg

SEQ ID NO: 318740 - DNA, 25 bp, Homo sapien
aggcaggatcagaactcagggagcc

SEQ ID NO: 318741 - DNA, 25 bp, Homo sapien
gggatatccccgatggcaccgattg

SEQ ID NO: 318742 - DNA, 25 bp, Homo sapien
gatggcaccgattgccaccgcaaag

SEQ ID NO: 318743 - DNA, 25 bp, Homo sapien
gattgccaccgcaaagcctacagca

SEQ ID NO: 318744 - DNA, 25 bp, Homo sapien
aaagcctacagcaccaccagtattg

SEQ ID NO: 318745 - DNA, 25 bp, Homo sapien
agcaccaccagtattgccagcgtcg

SEQ ID NO: 318746 - DNA, 25 bp, Homo sapien
tacagagtcacactcaatcctccgg

SEQ ID NO: 318747 - DNA, 25 bp, Homo sapien
aatcctccgggcaccttccttgaag

SEQ ID NO: 318748 - DNA, 25 bp, Homo sapien
ggagtggctaaggttggacaataca

SEQ ID NO: 318749 - DNA, 25 bp, Homo sapien
ggacaatacacgttcactgcagctg

SEQ ID NO: 318750 - DNA, 25 bp, Homo sapien
gtgtttggcctcaccacctgcatca

SEQ ID NO: 318751 - DNA, 25 bp, Homo sapien
tttcgtcagtactgggatatccccg

SEQ ID NO: 318752 - DNA, 25 bp, Homo sapien
ttactttcatcccacacacgtttgc

SEQ ID NO: 318753 - DNA, 25 bp, Homo sapien
cacacgtttgcaccatttgaccaaa

SEQ ID NO: 318754 - DNA, 25 bp, Homo sapien
ccctcacattgtttgatatcagtgg

SEQ ID NO: 318755 - DNA, 25 bp, Homo sapien
gaaaagtgacttatggcagcctgtg

SEQ ID NO: 318756 - DNA, 25 bp, Homo sapien
gtgacttatggcagcctgtggacag

SEQ ID NO: 318757 - DNA, 25 bp, Homo sapien
agcctgtggacagtcaagggtaccg

SEQ ID NO: 318758 - DNA, 25 bp, Homo sapien
ggccagggcttataggacctgccat

SEQ ID NO: 318759 - DNA, 25 bp, Homo sapien
tgttcgtgactctgtgttgctggtg

SEQ ID NO: 318760 - DNA, 25 bp, Homo sapien
gtgactctgtgttgctggtgtcaac

SEQ ID NO: 318761 - DNA, 25 bp, Homo sapien
gctggtgtcaacattcagagccaat

SEQ ID NO: 318762 - DNA, 25 bp, Homo sapien
agtagtattaaagcaagcagcccca

SEQ ID NO: 318763 - DNA, 25 bp, Homo sapien
tggagagctccctgcacagaagcaa

SEQ ID NO: 318764 - DNA, 25 bp, Homo sapien
aagcaaggactcagggcattgcccc

SEQ ID NO: 318765 - DNA, 25 bp, Homo sapien
tgagaactagactcagcgcccagca

SEQ ID NO: 318766 - DNA, 25 bp, Homo sapien
gcccagcactggatttgataataca

SEQ ID NO: 318767 - DNA, 25 bp, Homo sapien
aatacatgtgctttcctcttaactc

SEQ ID NO: 318768 - DNA, 25 bp, Homo sapien
ttcctcttaactcagacacttctag

SEQ ID NO: 318769 - DNA, 25 bp, Homo sapien
cacttctagggctggcagggtcaga

SEQ ID NO: 318770 - DNA, 25 bp, Homo sapien
ggccctgtttttgctgaacagctca

SEQ ID NO: 318771 - DNA, 25 bp, Homo sapien
gcaactgccaatacttgttctgtgt

SEQ ID NO: 318772 - DNA, 25 bp, Homo sapien
tgttctgtgtgacccttgcagccat

SEQ ID NO: 318773 - DNA, 25 bp, Homo sapien
cttgcagccatcctatgcggtaggt

SEQ ID NO: 318774 - DNA, 25 bp, Homo sapien
ctacaagcaattaggtgattcaaaa

SEQ ID NO: 318775 - DNA, 25 bp, Homo sapien
acaagcaattaggtgattcaaaaga

SEQ ID NO: 318776 - DNA, 25 bp, Homo sapien
aagcaattaggtgattcaaaagagc

SEQ ID NO: 318777 - DNA, 25 bp, Homo sapien
tgattcaaaagagcaacttaggctg

SEQ ID NO: 318778 - DNA, 25 bp, Homo sapien
gattcaaaagagcaacttaggctgg

SEQ ID NO: 318779 - DNA, 25 bp, Homo sapien
ttcaaaagagcaacttaggctgggt

SEQ ID NO: 318780 - DNA, 25 bp, Homo sapien
tcaaaagagcaacttaggctgggtg

SEQ ID NO: 318781 - DNA, 25 bp, Homo sapien
caaaagagcaacttaggctgggtgc

SEQ ID NO: 318782 - DNA, 25 bp, Homo sapien
aaaagagcaacttaggctgggtgca

SEQ ID NO: 318783 - DNA, 25 bp, Homo sapien
aaagagcaacttaggctgggtgcag

SEQ ID NO: 318784 - DNA, 25 bp, Homo sapien
aaattaaccagacattgtggcatgt

SEQ ID NO: 318785 - DNA, 25 bp, Homo sapien
atttggcttgactaccctgtatatt

SEQ ID NO: 318786 - DNA, 25 bp, Homo sapien
gttcttatctgtacatttctggtcc

SEQ ID NO: 318787 - DNA, 25 bp, Homo sapien
tacatttctggtccaatacctgtct

SEQ ID NO: 318788 - DNA, 25 bp, Homo sapien
atacctgtcttattagttgtccttc

SEQ ID NO: 318789 - DNA, 25 bp, Homo sapien
tattagttgtccttccccactaaag

SEQ ID NO: 318790 - DNA, 25 bp, Homo sapien
gtcatatttcatagtgcagtagcga

SEQ ID NO: 318791 - DNA, 25 bp, Homo sapien
aggagggtgtctcaagtttgctttt

SEQ ID NO: 318792 - DNA, 25 bp, Homo sapien
gcttttgtgtttcttctaggctttg

SEQ ID NO: 318793 - DNA, 25 bp, Homo sapien
gtttcttctaggctttgttcttgat

SEQ ID NO: 318794 - DNA, 25 bp, Homo sapien
gattttagacagatgagccagtgtt

SEQ ID NO: 318795 - DNA, 25 bp, Homo sapien
gagccagtgttaaggtgctacttca

SEQ ID NO: 318796 - DNA, 25 bp, Homo sapien
agcacaaacataattctcccaaaat

SEQ ID NO: 318797 - DNA, 25 bp, Homo sapien
aaggtggtctatgggaaatcatttt

SEQ ID NO: 318798 - DNA, 25 bp, Homo sapien
aatcagtgctgctgaacactactat

SEQ ID NO: 318799 - DNA, 25 bp, Homo sapien
ctgaaattcaggaccgagtaagctt

SEQ ID NO: 318800 - DNA, 25 bp, Homo sapien
ttcaggaccgagtaagcttaaaaat

SEQ ID NO: 318801 - DNA, 25 bp, Homo sapien
gtgctgctgaacactactatccaga

SEQ ID NO: 318802 - DNA, 25 bp, Homo sapien
aaaaatggtatatggttgtgtgtgt

SEQ ID NO: 318803 - DNA, 25 bp, Homo sapien
tttatttgttaaaccctgtcatgtt

SEQ ID NO: 318804 - DNA, 25 bp, Homo sapien
aaaccctgtcatgttattggtaaat

SEQ ID NO: 318805 - DNA, 25 bp, Homo sapien
tgaacactactatccagatgcccag

SEQ ID NO: 318806 - DNA, 25 bp, Homo sapien
gtgtctaagagcacaaacataattc

SEQ ID NO: 318807 - DNA, 25 bp, Homo sapien
taaggtcataactgcatttatcatg

SEQ ID NO: 318808 - DNA, 25 bp, Homo sapien
gtgcattaaactgtaacaaggcttc

SEQ ID NO: 318809 - DNA, 25 bp, Homo sapien
caaggcttctggcaattgtagattt

SEQ ID NO: 318810 - DNA, 25 bp, Homo sapien
tgtagatttagtttgacgctcccca

SEQ ID NO: 318811 - DNA, 25 bp, Homo sapien
ttgacgctccccaaagtgcatgaga

SEQ ID NO: 318812 - DNA, 25 bp, Homo sapien
gactttgccataatgatagactcaa

SEQ ID NO: 318813 - DNA, 25 bp, Homo sapien
gactcaatttagctctctgaactag

SEQ ID NO: 318814 - DNA, 25 bp, Homo sapien
tttagctctctgaactagttggtaa

SEQ ID NO: 318815 - DNA, 25 bp, Homo sapien
tttaattcccactttggctgtgtac

SEQ ID NO: 318816 - DNA, 25 bp, Homo sapien
ttcccactttggctgtgtacatcaa

SEQ ID NO: 318817 - DNA, 25 bp, Homo sapien
agaagtgtgtatgctgaccaaacca

SEQ ID NO: 318818 - DNA, 25 bp, Homo sapien
acttagtgctttgagtttaaattct

SEQ ID NO: 318819 - DNA, 25 bp, Homo sapien
tagtgctttgagtttaaattctttt

SEQ ID NO: 318820 - DNA, 25 bp, Homo sapien
tcttttttcagccactgtggtatgt

SEQ ID NO: 318821 - DNA, 25 bp, Homo sapien
ttttcagccactgtggtatgttgat

SEQ ID NO: 318822 - DNA, 25 bp, Homo sapien
ttcagccactgtggtatgttgatta

SEQ ID NO: 318823 - DNA, 25 bp, Homo sapien
attaataatgtgtctcctttatgtg

SEQ ID NO: 318824 - DNA, 25 bp, Homo sapien
taataatgtgtctcctttatgtgtt

SEQ ID NO: 318825 - DNA, 25 bp, Homo sapien
gtttttaaatagttacttggtcatg

SEQ ID NO: 318826 - DNA, 25 bp, Homo sapien
agttacttggtcatgaactatttat

SEQ ID NO: 318827 - DNA, 25 bp, Homo sapien
gaactatttataagctttggaaaca

SEQ ID NO: 318828 - DNA, 25 bp, Homo sapien
ctatttataagctttggaaacatga

SEQ ID NO: 318829 - DNA, 25 bp, Homo sapien
gtctcttattcttaaagcatctttc

SEQ ID NO: 318830 - DNA, 25 bp, Homo sapien
aaatgcatcatattaaaggcacaag

SEQ ID NO: 318831 - DNA, 25 bp, Homo sapien
ggtggagttgcctacttcagtggcc

SEQ ID NO: 318832 - DNA, 25 bp, Homo sapien
tggagttgcctacttcagtggcctt

SEQ ID NO: 318833 - DNA, 25 bp, Homo sapien
ggcctttattcccactataccagtt

SEQ ID NO: 318834 - DNA, 25 bp, Homo sapien
tattcccactataccagttctcagt

SEQ ID NO: 318835 - DNA, 25 bp, Homo sapien
gattttgatactttctggcaactgt

SEQ ID NO: 318836 - DNA, 25 bp, Homo sapien
ttctggcaactgtatcatctcttca

SEQ ID NO: 318837 - DNA, 25 bp, Homo sapien
caactgtatcatctcttcactatca

SEQ ID NO: 318838 - DNA, 25 bp, Homo sapien
gctaaggtgatttctttacatttga

SEQ ID NO: 318839 - DNA, 25 bp, Homo sapien
gaacatgtgtagatcaatgagagaa

SEQ ID NO: 318840 - DNA, 25 bp, Homo sapien
acgagtcactgttaatagtctgaac

SEQ ID NO: 318841 - DNA, 25 bp, Homo sapien
taaatgcccttgtctgaacgttcac

SEQ ID NO: 318842 - DNA, 25 bp, Homo sapien
gtctgaacgttcacttggagaaatg

SEQ ID NO: 318843 - DNA, 25 bp, Homo sapien
tgacaagttcggcataggcagacaa

SEQ ID NO: 318844 - DNA, 25 bp, Homo sapien
aggcagacaaggtcttcattttcac

SEQ ID NO: 318845 - DNA, 25 bp, Homo sapien
ccctgtttctagtactttatctcca

SEQ ID NO: 318846 - DNA, 25 bp, Homo sapien
gtactttatctccaaaacaccaggt

SEQ ID NO: 318847 - DNA, 25 bp, Homo sapien
tctccaaaacaccaggttgcagttg

SEQ ID NO: 318848 - DNA, 25 bp, Homo sapien
ttgcagttggccttggatagcctgt

SEQ ID NO: 318849 - DNA, 25 bp, Homo sapien
ttggatagcctgtacttggaaccag

SEQ ID NO: 318850 - DNA, 25 bp, Homo sapien
gttaatactgccaaatcaccttaga

SEQ ID NO: 318851 - DNA, 25 bp, Homo sapien
ttccctactctatgctcttgtaaaa

SEQ ID NO: 318852 - DNA, 25 bp, Homo sapien
aacactatctacttcctttgtcata

SEQ ID NO: 318853 - DNA, 25 bp, Homo sapien
acttcctttgtcataaactcatcat

SEQ ID NO: 318854 - DNA, 25 bp, Homo sapien
attaatattgtcctcctgctagaat

SEQ ID NO: 318855 - DNA, 25 bp, Homo sapien
gctccgtgagagcaaggatcctcct

SEQ ID NO: 318856 - DNA, 25 bp, Homo sapien
caaggatcctcctgtttaccctgta

SEQ ID NO: 318857 - DNA, 25 bp, Homo sapien
tgtttaccctgtacctccaatgtct

SEQ ID NO: 318858 - DNA, 25 bp, Homo sapien
tacctccaatgtctggcacttgtag

SEQ ID NO: 318859 - DNA, 25 bp, Homo sapien
attgtaattgatgtcctctggccac

SEQ ID NO: 318860 - DNA, 25 bp, Homo sapien
gtcctctggccacatagttttaaaa

SEQ ID NO: 318861 - DNA, 25 bp, Homo sapien
taggtgattgattatatgaccgaat

SEQ ID NO: 318862 - DNA, 25 bp, Homo sapien
agagatttaatttgagcgctgtgtt

SEQ ID NO: 318863 - DNA, 25 bp, Homo sapien
agcgctgtgttgatttgtgcattcc

SEQ ID NO: 318864 - DNA, 25 bp, Homo sapien
gtgttgatttgtgcattccttgtaa

SEQ ID NO: 318865 - DNA, 25 bp, Homo sapien
taaattagcttcacatcccagccgt

SEQ ID NO: 318866 - DNA, 25 bp, Homo sapien
agcactcacttagccctgttcagtt

SEQ ID NO: 318867 - DNA, 25 bp, Homo sapien
tgttcagttcccctgtaggcacagg

SEQ ID NO: 318868 - DNA, 25 bp, Homo sapien
aggtacacatatatcagcctcttgt

SEQ ID NO: 318869 - DNA, 25 bp, Homo sapien
atatcagcctcttgtaatcatgaag

SEQ ID NO: 318870 - DNA, 25 bp, Homo sapien
cagcagctggctaaccgggaaggaa

SEQ ID NO: 318871 - DNA, 25 bp, Homo sapien
gacatgctttactcttcctgaagaa

SEQ ID NO: 318872 - DNA, 25 bp, Homo sapien
tgaagaagatacttaagcccctcaa

SEQ ID NO: 318873 - DNA, 25 bp, Homo sapien
gaggtgaaccatcttaattactagt

SEQ ID NO: 318874 - DNA, 25 bp, Homo sapien
gttctattacctaattcagcttcct

SEQ ID NO: 318875 - DNA, 25 bp, Homo sapien
aattcagcttccttgtttggtctgc

SEQ ID NO: 318876 - DNA, 25 bp, Homo sapien
ttggtctgctgtggatctgccttat

SEQ ID NO: 318877 - DNA, 25 bp, Homo sapien
tggatctgccttattgcatatgcca

SEQ ID NO: 318878 - DNA, 25 bp, Homo sapien
gacaaagcttcattgtgaacaacct

SEQ ID NO: 318879 - DNA, 25 bp, Homo sapien
gagaaacaatctcatcacatttttt

SEQ ID NO: 318880 - DNA, 25 bp, Homo sapien
atcacattttttctagcctttccta

SEQ ID NO: 318881 - DNA, 25 bp, Homo sapien
gcctttcctacatttaaacttgctg

SEQ ID NO: 318882 - DNA, 25 bp, Homo sapien
catttaaacttgctgttgcccaaat

SEQ ID NO: 318883 - DNA, 25 bp, Homo sapien
ttttaaatgtctttggtgggcttct

SEQ ID NO: 318884 - DNA, 25 bp, Homo sapien
ggagacatggacgaagccttcaaat

SEQ ID NO: 318885 - DNA, 25 bp, Homo sapien
ggacgaagccttcaaatccatcaag

SEQ ID NO: 318886 - DNA, 25 bp, Homo sapien
aatccatcaagctcatcaaaaggtg

SEQ ID NO: 318887 - DNA, 25 bp, Homo sapien
tcaaaaggtgaggatcccgaccact

SEQ ID NO: 318888 - DNA, 25 bp, Homo sapien
aaaaggtgaggatcccgaccactgg

SEQ ID NO: 318889 - DNA, 25 bp, Homo sapien
gtgaggatcccgaccactgggatgt

SEQ ID NO: 318890 - DNA, 25 bp, Homo sapien
aggatcccgaccactgggatgttgg

SEQ ID NO: 318891 - DNA, 25 bp, Homo sapien
cccgaccactgggatgttgggagat

SEQ ID NO: 318892 - DNA, 25 bp, Homo sapien
atgttgggagatagcgcgtgctcac

SEQ ID NO: 318893 - DNA, 25 bp, Homo sapien
agatagcgcgtgctcacggctcttt

SEQ ID NO: 318894 - DNA, 25 bp, Homo sapien
gcgtgctcacggctctttcctttct

SEQ ID NO: 318895 - DNA, 25 bp, Homo sapien
atattccaccataaaacagctgagt

SEQ ID NO: 318896 - DNA, 25 bp, Homo sapien
agaggctatagctcacattttcaat

SEQ ID NO: 318897 - DNA, 25 bp, Homo sapien
cattttcaatcctctatttcttttt

SEQ ID NO: 318898 - DNA, 25 bp, Homo sapien
ttaaatataactttctactctgatg

SEQ ID NO: 318899 - DNA, 25 bp, Homo sapien
ctctctcacattttgatgatttaga

SEQ ID NO: 318900 - DNA, 25 bp, Homo sapien
cattttgatgatttagacagactcc

SEQ ID NO: 318901 - DNA, 25 bp, Homo sapien
tcttcctcctagtcaataaacccat

SEQ ID NO: 318902 - DNA, 25 bp, Homo sapien
aacccattgatgatctatttcccag

SEQ ID NO: 318903 - DNA, 25 bp, Homo sapien
tgatgatctatttcccagcttatcc

SEQ ID NO: 318904 - DNA, 25 bp, Homo sapien
agagtagacccaaagatgttatttt

SEQ ID NO: 318905 - DNA, 25 bp, Homo sapien
tgctgtttgaattttgtctccccac

SEQ ID NO: 318906 - DNA, 25 bp, Homo sapien
agactagagaaaaactgccttattt

SEQ ID NO: 318907 - DNA, 25 bp, Homo sapien
gccttattttcagaagcatgtcttc

SEQ ID NO: 318908 - DNA, 25 bp, Homo sapien
cttcattcaaagcttaggcttcaat

SEQ ID NO: 318909 - DNA, 25 bp, Homo sapien
gcttaggcttcaatagaaattcaga

SEQ ID NO: 318910 - DNA, 25 bp, Homo sapien
cagactaatcactgaaatgactatt

SEQ ID NO: 318911 - DNA, 25 bp, Homo sapien
caaactagtgaaatatctgggaaat

SEQ ID NO: 318912 - DNA, 25 bp, Homo sapien
atctgggaaataaactgcttcaaaa

SEQ ID NO: 318913 - DNA, 25 bp, Homo sapien
attttactgacatgaattttgctag

SEQ ID NO: 318914 - DNA, 25 bp, Homo sapien
tagtgaatacaaatacactgcctca

SEQ ID NO: 318915 - DNA, 25 bp, Homo sapien
aggccatgtatgaatgaacttacaa

SEQ ID NO: 318916 - DNA, 25 bp, Homo sapien
gagttaatcagtgtttgcatataga

SEQ ID NO: 318917 - DNA, 25 bp, Homo sapien
gagttatgagcaatctcacatacag

SEQ ID NO: 318918 - DNA, 25 bp, Homo sapien
gcaatctcacatacagctaatacag

SEQ ID NO: 318919 - DNA, 25 bp, Homo sapien
atacagtgtaagttctagaggacaa

SEQ ID NO: 318920 - DNA, 25 bp, Homo sapien
gaggacaatttcacacaatgtattt

SEQ ID NO: 318921 - DNA, 25 bp, Homo sapien
acaatgtatttcttgaagcttccaa

SEQ ID NO: 318922 - DNA, 25 bp, Homo sapien
gaagcttccaaaatgttcacacact

SEQ ID NO: 318923 - DNA, 25 bp, Homo sapien
cacagatgctagcagtgtatactaa

SEQ ID NO: 318924 - DNA, 25 bp, Homo sapien
agcagtgtatactaaatgccagaca

SEQ ID NO: 318925 - DNA, 25 bp, Homo sapien
atgccagacaccaaactaggccctt

SEQ ID NO: 318926 - DNA, 25 bp, Homo sapien
taggcccttcaaccacaaagggttg

SEQ ID NO: 318927 - DNA, 25 bp, Homo sapien
gttgaatctcatgatattctgtatt

SEQ ID NO: 318928 - DNA, 25 bp, Homo sapien
attttctgagaaccaattttgcctt

SEQ ID NO: 318929 - DNA, 25 bp, Homo sapien
accaattttgccttgttgaaatgtt

SEQ ID NO: 318930 - DNA, 25 bp, Homo sapien
gtttaaatgctgatactgttcttag

SEQ ID NO: 318931 - DNA, 25 bp, Homo sapien
actgttcttaggataattacctcag

SEQ ID NO: 318932 - DNA, 25 bp, Homo sapien
attacctcagaacctgtatctttta

SEQ ID NO: 318933 - DNA, 25 bp, Homo sapien
gcccagaaaatttaactggagtctg

SEQ ID NO: 318934 - DNA, 25 bp, Homo sapien
attagattaactacttgccaggtac

SEQ ID NO: 318935 - DNA, 25 bp, Homo sapien
actacttgccaggtactgaatatat

SEQ ID NO: 318936 - DNA, 25 bp, Homo sapien
aagggcctagtttgttttgcagcat

SEQ ID NO: 318937 - DNA, 25 bp, Homo sapien
gcctagtttgttttgcagcatgaat

SEQ ID NO: 318938 - DNA, 25 bp, Homo sapien
gtgagtcgtgtttgcgccactccat

SEQ ID NO: 318939 - DNA, 25 bp, Homo sapien
gtataattaagtttcttcatcctca

SEQ ID NO: 318940 - DNA, 25 bp, Homo sapien
ttaagtttcttcatcctcaatgtca

SEQ ID NO: 318941 - DNA, 25 bp, Homo sapien
aagtttcttcatcctcaatgtcaac

SEQ ID NO: 318942 - DNA, 25 bp, Homo sapien
gtttcttcatcctcaatgtcaactt

SEQ ID NO: 318943 - DNA, 25 bp, Homo sapien
ttcttcatcctcaatgtcaacttta

SEQ ID NO: 318944 - DNA, 25 bp, Homo sapien
tcatcctcaatgtcaactttatatt

SEQ ID NO: 318945 - DNA, 25 bp, Homo sapien
gtaattaaatgtgtagcaaccaagc

SEQ ID NO: 318946 - DNA, 25 bp, Homo sapien
aaatgtgtagcaaccaagctgacaa

SEQ ID NO: 318947 - DNA, 25 bp, Homo sapien
gtgtagcaaccaagctgacaatagt

SEQ ID NO: 318948 - DNA, 25 bp, Homo sapien
gcaaccaagctgacaatagtgatta

SEQ ID NO: 318949 - DNA, 25 bp, Homo sapien
tgccctcccaccaccaataacttta

SEQ ID NO: 318950 - DNA, 25 bp, Homo sapien
gcattgtgattaacctttatattct

SEQ ID NO: 318951 - DNA, 25 bp, Homo sapien
ttcagaatgcagtcagaaagggcaa

SEQ ID NO: 318952 - DNA, 25 bp, Homo sapien
agatcgatgggaaagtcatgtgttt

SEQ ID NO: 318953 - DNA, 25 bp, Homo sapien
gtgtttgcatttgtcacagctgctg

SEQ ID NO: 318954 - DNA, 25 bp, Homo sapien
cacagctgctgataaactaagaaca

SEQ ID NO: 318955 - DNA, 25 bp, Homo sapien
caagggaggagccattttacatata

SEQ ID NO: 318956 - DNA, 25 bp, Homo sapien
gagccattttacatataattcctga

SEQ ID NO: 318957 - DNA, 25 bp, Homo sapien
aagattatctatttcagctccctct

SEQ ID NO: 318958 - DNA, 25 bp, Homo sapien
ctctcttcccttgctttatggaatt

SEQ ID NO: 318959 - DNA, 25 bp, Homo sapien
ttggcattcttcttagtgctttaat

SEQ ID NO: 318960 - DNA, 25 bp, Homo sapien
agtgctttaatgttacgtcctgtgc

SEQ ID NO: 318961 - DNA, 25 bp, Homo sapien
atataattcaatgcattcttgataa

SEQ ID NO: 318962 - DNA, 25 bp, Homo sapien
tataattcaatgcattcttgataac

SEQ ID NO: 318963 - DNA, 25 bp, Homo sapien
ataattcaatgcattcttgataact

SEQ ID NO: 318964 - DNA, 25 bp, Homo sapien
taattcaatgcattcttgataactc

SEQ ID NO: 318965 - DNA, 25 bp, Homo sapien
aattcaatgcattcttgataactca

SEQ ID NO: 318966 - DNA, 25 bp, Homo sapien
attcaatgcattcttgataactcag

SEQ ID NO: 318967 - DNA, 25 bp, Homo sapien
atgcattcttgataactcagagcca

SEQ ID NO: 318968 - DNA, 25 bp, Homo sapien
tgcattcttgataactcagagccac

SEQ ID NO: 318969 - DNA, 25 bp, Homo sapien
gcattcttgataactcagagccact

SEQ ID NO: 318970 - DNA, 25 bp, Homo sapien
cattcttgataactcagagccacta

SEQ ID NO: 318971 - DNA, 25 bp, Homo sapien
attcttgataactcagagccactac

SEQ ID NO: 318972 - DNA, 25 bp, Homo sapien
gaggtcaatatcttattactctcat

SEQ ID NO: 318973 - DNA, 25 bp, Homo sapien
attactctcattttgtaggtgtata

SEQ ID NO: 318974 - DNA, 25 bp, Homo sapien
taggtgtataaatgtgggccttcat

SEQ ID NO: 318975 - DNA, 25 bp, Homo sapien
gtactcagaatgttggaatgttcat

SEQ ID NO: 318976 - DNA, 25 bp, Homo sapien
tcattcatcatatgccataccttgt

SEQ ID NO: 318977 - DNA, 25 bp, Homo sapien
atgccataccttgtgataagtcctt

SEQ ID NO: 318978 - DNA, 25 bp, Homo sapien
tgtgataagtccttacagtgtgttc

SEQ ID NO: 318979 - DNA, 25 bp, Homo sapien
cagtgtgttctcatgcaattctcgt

SEQ ID NO: 318980 - DNA, 25 bp, Homo sapien
ctcatgcaattctcgtgatagtcct

SEQ ID NO: 318981 - DNA, 25 bp, Homo sapien
ctcgtgatagtcctgtgaggtcaat

SEQ ID NO: 318982 - DNA, 25 bp, Homo sapien
agtcctgtgaggtcaatatcttatt

SEQ ID NO: 318983 - DNA, 25 bp, Homo sapien
agttttgttcatgtgttcctggagg

SEQ ID NO: 318984 - DNA, 25 bp, Homo sapien
acagtgaccagccaccaggtgtgcc

SEQ ID NO: 318985 - DNA, 25 bp, Homo sapien
caccaggtgtgccatcacggaggaa

SEQ ID NO: 318986 - DNA, 25 bp, Homo sapien
tgccatcacggaggaagtccaggtt

SEQ ID NO: 318987 - DNA, 25 bp, Homo sapien
aggtggtctccttctgtgagcaggt

SEQ ID NO: 318988 - DNA, 25 bp, Homo sapien
tccttctgtgagcaggtccacctct

SEQ ID NO: 318989 - DNA, 25 bp, Homo sapien
tgaggcccctttctgcctgtgacag

SEQ ID NO: 318990 - DNA, 25 bp, Homo sapien
agctccagctgccagcatgctactg

SEQ ID NO: 318991 - DNA, 25 bp, Homo sapien
aggatttttcccgtggcaagcgctt

SEQ ID NO: 318992 - DNA, 25 bp, Homo sapien
gatttttcccgtggcaagcgcttct

SEQ ID NO: 318993 - DNA, 25 bp, Homo sapien
tggccactcagtattccttgtccct

SEQ ID NO: 318994 - DNA, 25 bp, Homo sapien
gggatatcggctatgtcgacaccac

SEQ ID NO: 318995 - DNA, 25 bp, Homo sapien
atgtcgacaccacccactggaaggt

SEQ ID NO: 318996 - DNA, 25 bp, Homo sapien
cacccactggaaggtctacgttata

SEQ ID NO: 318997 - DNA, 25 bp, Homo sapien
gaaggtctacgttatagccagaggg

SEQ ID NO: 318998 - DNA, 25 bp, Homo sapien
ttggtcatctgcgatggaaccgctt

SEQ ID NO: 318999 - DNA, 25 bp, Homo sapien
gatggaaccgctttctcagaactgt

SEQ ID NO: 319000 - DNA, 25 bp, Homo sapien
aaccgctttctcagaactgtaggaa

SEQ ID NO: 319001 - DNA, 25 bp, Homo sapien
tagaactgtgcacaggaacagcttc

SEQ ID NO: 319002 - DNA, 25 bp, Homo sapien
acaggaacagcttccagagccgaaa

SEQ ID NO: 319003 - DNA, 25 bp, Homo sapien
gcttccagagccgaaaaccaggttg

SEQ ID NO: 319004 - DNA, 25 bp, Homo sapien
tccagagccgaaaaccaggttgaaa

SEQ ID NO: 319005 - DNA, 25 bp, Homo sapien
caacctggcccacttgcagagtttc

SEQ ID NO: 319006 - DNA, 25 bp, Homo sapien
ttgcagagtttcctggcccatctga

SEQ ID NO: 319007 - DNA, 25 bp, Homo sapien
tggcccatctgaccctaactgaaac

SEQ ID NO: 319008 - DNA, 25 bp, Homo sapien
aactgaaacccagcctcctaagaag

SEQ ID NO: 319009 - DNA, 25 bp, Homo sapien
ccagcctcctaagaaggacctggtg

SEQ ID NO: 319010 - DNA, 25 bp, Homo sapien
ggacctggtgttggaacagatccca

SEQ ID NO: 319011 - DNA, 25 bp, Homo sapien
gtgttggaacagatcccagaaatct

SEQ ID NO: 319012 - DNA, 25 bp, Homo sapien
tcccagaaatctgggagcggctgga

SEQ ID NO: 319013 - DNA, 25 bp, Homo sapien
gtggcaggcaattgccaagcaccag

SEQ ID NO: 319014 - DNA, 25 bp, Homo sapien
gagtgccaagtcaagcactgggaaa

SEQ ID NO: 319015 - DNA, 25 bp, Homo sapien
gtcaagcactgggaaaagcatggaa

SEQ ID NO: 319016 - DNA, 25 bp, Homo sapien
cgtccattggttcttgcatgacaat

SEQ ID NO: 319017 - DNA, 25 bp, Homo sapien
atgacaatcagagggacacggatcc

SEQ ID NO: 319018 - DNA, 25 bp, Homo sapien
gagctgcgggtggaattctacactg

SEQ ID NO: 319019 - DNA, 25 bp, Homo sapien
gggtggaattctacactgggatgaa

SEQ ID NO: 319020 - DNA, 25 bp, Homo sapien
aatgagaactcagacatcgccttcc

SEQ ID NO: 319021 - DNA, 25 bp, Homo sapien
gagaactcagacatcgccttccatt

SEQ ID NO: 319022 - DNA, 25 bp, Homo sapien
ccattgtttggtcattgacagccat

SEQ ID NO: 319023 - DNA, 25 bp, Homo sapien
tggtcattgacagccatgtgtgtgg

SEQ ID NO: 319024 - DNA, 25 bp, Homo sapien
ttcaaggacggcaaacaatttgatc

SEQ ID NO: 319025 - DNA, 25 bp, Homo sapien
caatttgatctgagcatcttggtgc

SEQ ID NO: 319026 - DNA, 25 bp, Homo sapien
gcatcttggtgctagacaatgaata

SEQ ID NO: 319027 - DNA, 25 bp, Homo sapien
ctttatttcaactagaaggtacaat

SEQ ID NO: 319028 - DNA, 25 bp, Homo sapien
tatttcaactagaaggtacaatctc

SEQ ID NO: 319029 - DNA, 25 bp, Homo sapien
tttcaactagaaggtacaatctctc

SEQ ID NO: 319030 - DNA, 25 bp, Homo sapien
ttcaactagaaggtacaatctctca

SEQ ID NO: 319031 - DNA, 25 bp, Homo sapien
tcaactagaaggtacaatctctcag

SEQ ID NO: 319032 - DNA, 25 bp, Homo sapien
caactagaaggtacaatctctcagg

SEQ ID NO: 319033 - DNA, 25 bp, Homo sapien
aactagaaggtacaatctctcaggg

SEQ ID NO: 319034 - DNA, 25 bp, Homo sapien
aaggtacaatctctcaggggtttca

SEQ ID NO: 319035 - DNA, 25 bp, Homo sapien
ggtacaatctctcaggggtttcata

SEQ ID NO: 319036 - DNA, 25 bp, Homo sapien
gtaactacgtaaaaaacagagctgt

SEQ ID NO: 319037 - DNA, 25 bp, Homo sapien
taactacgtaaaaaacagagctgta

SEQ ID NO: 319038 - DNA, 25 bp, Homo sapien
gggccagagcccactactgctgagg

SEQ ID NO: 319039 - DNA, 25 bp, Homo sapien
agcactgctctcgtcagctgtgttg

SEQ ID NO: 319040 - DNA, 25 bp, Homo sapien
tcgtcagctgtgttgcctttaccaa

SEQ ID NO: 319041 - DNA, 25 bp, Homo sapien
ttgcctttaccaagtgtcttcagag

SEQ ID NO: 319042 - DNA, 25 bp, Homo sapien
ttatgagttagagtagctggcctgg

SEQ ID NO: 319043 - DNA, 25 bp, Homo sapien
tgcctccctgggtttgatctttagg

SEQ ID NO: 319044 - DNA, 25 bp, Homo sapien
gatctttagggtctgactttctgca

SEQ ID NO: 319045 - DNA, 25 bp, Homo sapien
ccaaagtgtttgtcagctgggtgta

SEQ ID NO: 319046 - DNA, 25 bp, Homo sapien
gtcagctgggtgtacaactgcctat

SEQ ID NO: 319047 - DNA, 25 bp, Homo sapien
tacaactgcctatgtgatcctctgt

SEQ ID NO: 319048 - DNA, 25 bp, Homo sapien
tctgtctgtgctgcgaaacaaagac

SEQ ID NO: 319049 - DNA, 25 bp, Homo sapien
taaatgccccgtgctaaaaacatgc

SEQ ID NO: 319050 - DNA, 25 bp, Homo sapien
gccccgtgctaaaaacatgcaaatg

SEQ ID NO: 319051 - DNA, 25 bp, Homo sapien
gacttgccttatagacagcattggg

SEQ ID NO: 319052 - DNA, 25 bp, Homo sapien
ggttgttcatggtaaaccagcccaa

SEQ ID NO: 319053 - DNA, 25 bp, Homo sapien
tcatggtaaaccagcccaactccag

SEQ ID NO: 319054 - DNA, 25 bp, Homo sapien
agcccaactccagaagatgttctgc

SEQ ID NO: 319055 - DNA, 25 bp, Homo sapien
gaagatgttctgctgtgtcatcaga

SEQ ID NO: 319056 - DNA, 25 bp, Homo sapien
gttctgctgtgtcatcagacttatt

SEQ ID NO: 319057 - DNA, 25 bp, Homo sapien
gtgtcatcagacttattcacctata

SEQ ID NO: 319058 - DNA, 25 bp, Homo sapien
cagacttattcacctataaagacag

SEQ ID NO: 319059 - DNA, 25 bp, Homo sapien
tctactataataaacctttctcaga

SEQ ID NO: 319060 - DNA, 25 bp, Homo sapien
gggcgcagaggcagaacagaagtca

SEQ ID NO: 319061 - DNA, 25 bp, Homo sapien
tgggaggcgcctttagtgacctgaa

SEQ ID NO: 319062 - DNA, 25 bp, Homo sapien
tagtgacctgaagtagtgagtctag

SEQ ID NO: 319063 - DNA, 25 bp, Homo sapien
agggcaggaccaggctctcggcatc

SEQ ID NO: 319064 - DNA, 25 bp, Homo sapien
aagggtcgcacagaaggcgggcgcc

SEQ ID NO: 319065 - DNA, 25 bp, Homo sapien
aggaccaggctctcggcatctccga

SEQ ID NO: 319066 - DNA, 25 bp, Homo sapien
tcggcatctccgaggcggcggactc

SEQ ID NO: 319067 - DNA, 25 bp, Homo sapien
cggcggactcggatggagcagtttc

SEQ ID NO: 319068 - DNA, 25 bp, Homo sapien
cgggcctgggcgtcaagggcgaagg

SEQ ID NO: 319069 - DNA, 25 bp, Homo sapien
gcgaaggccgaaagccggcgttaga

SEQ ID NO: 319070 - DNA, 25 bp, Homo sapien
gaagcggcttaggagaggccagagc

SEQ ID NO: 319071 - DNA, 25 bp, Homo sapien
cgcagactggttcatgtctcttggg

SEQ ID NO: 319072 - DNA, 25 bp, Homo sapien
tccctggaaaccgttggcatctact

SEQ ID NO: 319073 - DNA, 25 bp, Homo sapien
gttggcatctacttcggactagtgt

SEQ ID NO: 319074 - DNA, 25 bp, Homo sapien
gactagtgtaccgtatccacagcgt

SEQ ID NO: 319075 - DNA, 25 bp, Homo sapien
cctcttccagaagtttaggctgaca

SEQ ID NO: 319076 - DNA, 25 bp, Homo sapien
aagactgactgaggccacttccagg

SEQ ID NO: 319077 - DNA, 25 bp, Homo sapien
agaggcaggccccagtgtgaccacc

SEQ ID NO: 319078 - DNA, 25 bp, Homo sapien
gcccacaagggcagagcagcattct

SEQ ID NO: 319079 - DNA, 25 bp, Homo sapien
agagcagcattctgagagacgcaca

SEQ ID NO: 319080 - DNA, 25 bp, Homo sapien
agagacgcacaggagaccaagccag

SEQ ID NO: 319081 - DNA, 25 bp, Homo sapien
gaccaagccagaccaataaacagaa

SEQ ID NO: 319082 - DNA, 25 bp, Homo sapien
tgttaagcatggattttccccctaa

SEQ ID NO: 319083 - DNA, 25 bp, Homo sapien
gaatttcatgtgaatccctttagga

SEQ ID NO: 319084 - DNA, 25 bp, Homo sapien
aatttcatgtgaatccctttaggat

SEQ ID NO: 319085 - DNA, 25 bp, Homo sapien
tttcatgtgaatccctttaggatgt

SEQ ID NO: 319086 - DNA, 25 bp, Homo sapien
tcatgtgaatccctttaggatgttt

SEQ ID NO: 319087 - DNA, 25 bp, Homo sapien
catgtgaatccctttaggatgtttt

SEQ ID NO: 319088 - DNA, 25 bp, Homo sapien
gataatttattatacaccttagtct

SEQ ID NO: 319089 - DNA, 25 bp, Homo sapien
taatttattatacaccttagtcttt

SEQ ID NO: 319090 - DNA, 25 bp, Homo sapien
agtaagaaataatgcctccaatttt

SEQ ID NO: 319091 - DNA, 25 bp, Homo sapien
gtaagaaataatgcctccaattttt

SEQ ID NO: 319092 - DNA, 25 bp, Homo sapien
gatatgttaagcatggattttcccc

SEQ ID NO: 319093 - DNA, 25 bp, Homo sapien
ggtcagatctatttgctggtgtctc

SEQ ID NO: 319094 - DNA, 25 bp, Homo sapien
gatctatttgctggtgtctctaaat

SEQ ID NO: 319095 - DNA, 25 bp, Homo sapien
atttgctggtgtctctaaatgacta

SEQ ID NO: 319096 - DNA, 25 bp, Homo sapien
gctggtgtctctaaatgactattta

SEQ ID NO: 319097 - DNA, 25 bp, Homo sapien
atgactatttactttgaaacctcta

SEQ ID NO: 319098 - DNA, 25 bp, Homo sapien
ttgaaacctctattttccagccctt

SEQ ID NO: 319099 - DNA, 25 bp, Homo sapien
gaaacctctattttccagccctttg

SEQ ID NO: 319100 - DNA, 25 bp, Homo sapien
ctttgctgcatttggcacatttgaa

SEQ ID NO: 319101 - DNA, 25 bp, Homo sapien
gctgcatttggcacatttgaattaa

SEQ ID NO: 319102 - DNA, 25 bp, Homo sapien
gttacgtataatctataaacatcaa

SEQ ID NO: 319103 - DNA, 25 bp, Homo sapien
tggatttaaatctgtggcaaatgat

SEQ ID NO: 319104 - DNA, 25 bp, Homo sapien
ggtctttagcatctcaaattccaac

SEQ ID NO: 319105 - DNA, 25 bp, Homo sapien
gtattaactcttcttcccaaagcaa

SEQ ID NO: 319106 - DNA, 25 bp, Homo sapien
gcaggtgatgccatgttatatccaa

SEQ ID NO: 319107 - DNA, 25 bp, Homo sapien
aaatcactgtgctgaacttttatgt

SEQ ID NO: 319108 - DNA, 25 bp, Homo sapien
cttttatgtttagcttccaagtatt

SEQ ID NO: 319109 - DNA, 25 bp, Homo sapien
gttttgcatttcaagtggtatcact

SEQ ID NO: 319110 - DNA, 25 bp, Homo sapien
agtggtatcactgttaaatgccatt

SEQ ID NO: 319111 - DNA, 25 bp, Homo sapien
ttttcagattgtggccttttattat

SEQ ID NO: 319112 - DNA, 25 bp, Homo sapien
tgtggccttttattattggctgcta

SEQ ID NO: 319113 - DNA, 25 bp, Homo sapien
tattggctgctagatcctggtgttt

SEQ ID NO: 319114 - DNA, 25 bp, Homo sapien
ctgctagatcctggtgtttctatgt

SEQ ID NO: 319115 - DNA, 25 bp, Homo sapien
aaggcacagatcaccttagaggcca

SEQ ID NO: 319116 - DNA, 25 bp, Homo sapien
ttagaggccacgctcccaagattag

SEQ ID NO: 319117 - DNA, 25 bp, Homo sapien
gccacgctcccaagattagttatca

SEQ ID NO: 319118 - DNA, 25 bp, Homo sapien
tagttatcaccctggcagtatgaat

SEQ ID NO: 319119 - DNA, 25 bp, Homo sapien
atcaccctggcagtatgaatacttc

SEQ ID NO: 319120 - DNA, 25 bp, Homo sapien
gaagagtgggaaccagctgttacac

SEQ ID NO: 319121 - DNA, 25 bp, Homo sapien
gggaaccagctgttacactcagcat

SEQ ID NO: 319122 - DNA, 25 bp, Homo sapien
gggccaaatggacatcactccctaa

SEQ ID NO: 319123 - DNA, 25 bp, Homo sapien
cactccctaacttcttgaggtctgt

SEQ ID NO: 319124 - DNA, 25 bp, Homo sapien
taacttcttgaggtctgtctcctct

SEQ ID NO: 319125 - DNA, 25 bp, Homo sapien
gtctcctctgtggattcacgcatgt

SEQ ID NO: 319126 - DNA, 25 bp, Homo sapien
agatggcaattttaactgccctgct

SEQ ID NO: 319127 - DNA, 25 bp, Homo sapien
acaatcacatcagctgtttgcaatt

SEQ ID NO: 319128 - DNA, 25 bp, Homo sapien
ggaacaaacgtatctgctccagatc

SEQ ID NO: 319129 - DNA, 25 bp, Homo sapien
gaaccgcgtggacatagcacgaagc

SEQ ID NO: 319130 - DNA, 25 bp, Homo sapien
agcacgaagccagatctttgtcttt

SEQ ID NO: 319131 - DNA, 25 bp, Homo sapien
aagccagatctttgtctttgggccc

SEQ ID NO: 319132 - DNA, 25 bp, Homo sapien
agatctttgtctttgggccccactg

SEQ ID NO: 319133 - DNA, 25 bp, Homo sapien
gaaagaactcgtcactgtgttcaga

SEQ ID NO: 319134 - DNA, 25 bp, Homo sapien
ttcagaatgggttctgagggccagc

SEQ ID NO: 319135 - DNA, 25 bp, Homo sapien
gttctgagggccagcaggacatcga

SEQ ID NO: 319136 - DNA, 25 bp, Homo sapien
ccagcaggacatcgagatggcaatt

SEQ ID NO: 319137 - DNA, 25 bp, Homo sapien
tcggtttccggatacggctattcac

SEQ ID NO: 319138 - DNA, 25 bp, Homo sapien
ggatacggctattcaccgcacctca

SEQ ID NO: 319139 - DNA, 25 bp, Homo sapien
tgccctttagggagatggcccccct

SEQ ID NO: 319140 - DNA, 25 bp, Homo sapien
tctccccggcgctttaagtaatgat

SEQ ID NO: 319141 - DNA, 25 bp, Homo sapien
cggcgctttaagtaatgatatttgc

SEQ ID NO: 319142 - DNA, 25 bp, Homo sapien
tatttgcatgcagggagcgattcat

SEQ ID NO: 319143 - DNA, 25 bp, Homo sapien
gcagggagcgattcataaatatgtc

SEQ ID NO: 319144 - DNA, 25 bp, Homo sapien
ttcataaatatgtcagggctggtga

SEQ ID NO: 319145 - DNA, 25 bp, Homo sapien
ctcgaaaaacgtcccagggcggctg

SEQ ID NO: 319146 - DNA, 25 bp, Homo sapien
aaaaacgtcccagggcggctgtgcg

SEQ ID NO: 319147 - DNA, 25 bp, Homo sapien
ggcacgctcggtttccggatacggc

SEQ ID NO: 319148 - DNA, 25 bp, Homo sapien
taattttaagtattgccagagttta

SEQ ID NO: 319149 - DNA, 25 bp, Homo sapien
gccagagtttaatgtacttgtctag

SEQ ID NO: 319150 - DNA, 25 bp, Homo sapien
tatttagctttcctttattcaacca

SEQ ID NO: 319151 - DNA, 25 bp, Homo sapien
ttcctttattcaaccaaatttcaga

SEQ ID NO: 319152 - DNA, 25 bp, Homo sapien
ttcagatttgaaactagcctatagc

SEQ ID NO: 319153 - DNA, 25 bp, Homo sapien
tattcaagctgtcatagtctgcact

SEQ ID NO: 319154 - DNA, 25 bp, Homo sapien
actagcctatagcatattttcattt

SEQ ID NO: 319155 - DNA, 25 bp, Homo sapien
atttgtcatcattgacacttgatca

SEQ ID NO: 319156 - DNA, 25 bp, Homo sapien
acacttgatcaattaatagccttat

SEQ ID NO: 319157 - DNA, 25 bp, Homo sapien
gaaaactcctttgacattctggatc

SEQ ID NO: 319158 - DNA, 25 bp, Homo sapien
ctcctttgacattctggatcataga

SEQ ID NO: 319159 - DNA, 25 bp, Homo sapien
attcttctccattgctgagacgtca

SEQ ID NO: 319160 - DNA, 25 bp, Homo sapien
tccattgctgagacgtcaaatcgaa

SEQ ID NO: 319161 - DNA, 25 bp, Homo sapien
gagacgtcaaatcgaacaattctga

SEQ ID NO: 319162 - DNA, 25 bp, Homo sapien
acaattctgaagtagggtctgtaga

SEQ ID NO: 319163 - DNA, 25 bp, Homo sapien
tgggcgggatggcattttcggaggg

SEQ ID NO: 319164 - DNA, 25 bp, Homo sapien
ggcatgtctattttgtaaacctcct

SEQ ID NO: 319165 - DNA, 25 bp, Homo sapien
ctccttggcgtagtactcttcgtcg

SEQ ID NO: 319166 - DNA, 25 bp, Homo sapien
tggcgtagtactcttcgtcgctcct

SEQ ID NO: 319167 - DNA, 25 bp, Homo sapien
tagatggaaatcacctccgggggga

SEQ ID NO: 319168 - DNA, 25 bp, Homo sapien
acttcctcgggctcaggatagtctt

SEQ ID NO: 319169 - DNA, 25 bp, Homo sapien
ctcgggctcaggatagtcttctggg

SEQ ID NO: 319170 - DNA, 25 bp, Homo sapien
aagccacacatcctcttggatttga

SEQ ID NO: 319171 - DNA, 25 bp, Homo sapien
gccacacatcctcttggatttgatg

SEQ ID NO: 319172 - DNA, 25 bp, Homo sapien
ttggatttgatgatgttgtacgatt

SEQ ID NO: 319173 - DNA, 25 bp, Homo sapien
gatgatgttgtacgattagaaattg

SEQ ID NO: 319174 - DNA, 25 bp, Homo sapien
ttagaaattgaatccaatatctgca

SEQ ID NO: 319175 - DNA, 25 bp, Homo sapien
ccaactgtttcacaactccattacg

SEQ ID NO: 319176 - DNA, 25 bp, Homo sapien
actgtttcacaactccattacgtca

SEQ ID NO: 319177 - DNA, 25 bp, Homo sapien
actccattacgtcaggcctggacaa

SEQ ID NO: 319178 - DNA, 25 bp, Homo sapien
attacgtcaggcctggacaaccatg

SEQ ID NO: 319179 - DNA, 25 bp, Homo sapien
ttacgtcaggcctggacaaccatgg

SEQ ID NO: 319180 - DNA, 25 bp, Homo sapien
cagaatgatgccatgattttatatg

SEQ ID NO: 319181 - DNA, 25 bp, Homo sapien
taatggggaatctgtttcctacctg

SEQ ID NO: 319182 - DNA, 25 bp, Homo sapien
gttcagccatgttcctttataacag

SEQ ID NO: 319183 - DNA, 25 bp, Homo sapien
gaataacttctaggttatgctattt

SEQ ID NO: 319184 - DNA, 25 bp, Homo sapien
gctggagcaaccagagtttatgcta

SEQ ID NO: 319185 - DNA, 25 bp, Homo sapien
agcaaccagagtttatgctatcttg

SEQ ID NO: 319186 - DNA, 25 bp, Homo sapien
gactcatggaatcttttctggccca

SEQ ID NO: 319187 - DNA, 25 bp, Homo sapien
tcatggaatcttttctggcccagcc

SEQ ID NO: 319188 - DNA, 25 bp, Homo sapien
tcgcatcaacactgcatgctttgaa

SEQ ID NO: 319189 - DNA, 25 bp, Homo sapien
tgcatgctttgaagcagtggtagtc

SEQ ID NO: 319190 - DNA, 25 bp, Homo sapien
ttgctccaaaatacgagtaattgac

SEQ ID NO: 319191 - DNA, 25 bp, Homo sapien
gagtaattgacatctccatgatcct

SEQ ID NO: 319192 - DNA, 25 bp, Homo sapien
ctagcaggccacagggcgaaggaca

SEQ ID NO: 319193 - DNA, 25 bp, Homo sapien
tagcaggccacagggcgaaggacag

SEQ ID NO: 319194 - DNA, 25 bp, Homo sapien
catggtccacggatgcgcctcccga

SEQ ID NO: 319195 - DNA, 25 bp, Homo sapien
gcaggcgtgagctcctctgctccag

SEQ ID NO: 319196 - DNA, 25 bp, Homo sapien
ggagctgccgtccaaagggaattac

SEQ ID NO: 319197 - DNA, 25 bp, Homo sapien
gagctgccgtccaaagggaattaca

SEQ ID NO: 319198 - DNA, 25 bp, Homo sapien
aacaagctctgggtgtcaggaggaa

SEQ ID NO: 319199 - DNA, 25 bp, Homo sapien
acaagctctgggtgtcaggaggaaa

SEQ ID NO: 319200 - DNA, 25 bp, Homo sapien
caagctctgggtgtcaggaggaaac

SEQ ID NO: 319201 - DNA, 25 bp, Homo sapien
aagctctgggtgtcaggaggaaacc

SEQ ID NO: 319202 - DNA, 25 bp, Homo sapien
ccaggctagcaggccacagggcgaa

SEQ ID NO: 319203 - DNA, 25 bp, Homo sapien
ttaagtcctggaacccagagctgct

SEQ ID NO: 319204 - DNA, 25 bp, Homo sapien
aacccagagctgctgtgtatttcga

SEQ ID NO: 319205 - DNA, 25 bp, Homo sapien
tgtgtatttcgagcgggcagtttat

SEQ ID NO: 319206 - DNA, 25 bp, Homo sapien
gcagtttatcttttgctatacttat

SEQ ID NO: 319207 - DNA, 25 bp, Homo sapien
tttcaattcaattacaccacgattc

SEQ ID NO: 319208 - DNA, 25 bp, Homo sapien
gggaaacgtcaactccattgcaatt

SEQ ID NO: 319209 - DNA, 25 bp, Homo sapien
tgcaattacttatcttcctcttcta

SEQ ID NO: 319210 - DNA, 25 bp, Homo sapien
tcttctatctctgttatacgccggg

SEQ ID NO: 319211 - DNA, 25 bp, Homo sapien
gggcatagaatgctcgtatacatct

SEQ ID NO: 319212 - DNA, 25 bp, Homo sapien
gtatacatctctttaacaaccacaa

SEQ ID NO: 319213 - DNA, 25 bp, Homo sapien
aaccacaaaccttaagccatgtaga

SEQ ID NO: 319214 - DNA, 25 bp, Homo sapien
aaactcctcagccttcagactggtt

SEQ ID NO: 319215 - DNA, 25 bp, Homo sapien
attttcaggtaatagcatttcagct

SEQ ID NO: 319216 - DNA, 25 bp, Homo sapien
gtaatagcatttcagctttttcccc

SEQ ID NO: 319217 - DNA, 25 bp, Homo sapien
tttttgcttgggaggagacagatta

SEQ ID NO: 319218 - DNA, 25 bp, Homo sapien
agacagattagactggattcggagt

SEQ ID NO: 319219 - DNA, 25 bp, Homo sapien
ctggattcggagtcttgattttgca

SEQ ID NO: 319220 - DNA, 25 bp, Homo sapien
cggagtcttgattttgcaaaggtaa

SEQ ID NO: 319221 - DNA, 25 bp, Homo sapien
ttactgcccacttggcgccttgtga

SEQ ID NO: 319222 - DNA, 25 bp, Homo sapien
ttggcgccttgtgattaagcaacta

SEQ ID NO: 319223 - DNA, 25 bp, Homo sapien
aagcaactagatttggagccagtca

SEQ ID NO: 319224 - DNA, 25 bp, Homo sapien
agccagtcaggcttttgtttagaca

SEQ ID NO: 319225 - DNA, 25 bp, Homo sapien
taaaggtgtgatgatctgaagaatc

SEQ ID NO: 319226 - DNA, 25 bp, Homo sapien
aatcatgaaactctgcggggtttcc

SEQ ID NO: 319227 - DNA, 25 bp, Homo sapien
ggttttcagctcctcagtagtgaca

SEQ ID NO: 319228 - DNA, 25 bp, Homo sapien
agctcctcagtagtgacaaagccat

SEQ ID NO: 319229 - DNA, 25 bp, Homo sapien
cccatcattgtcgattcgatcaaca

SEQ ID NO: 319230 - DNA, 25 bp, Homo sapien
tgtcgattcgatcaacaatcttccc

SEQ ID NO: 319231 - DNA, 25 bp, Homo sapien
cccaggaaggcctcgtggtcgtact

SEQ ID NO: 319232 - DNA, 25 bp, Homo sapien
aaggcctcgtggtcgtactggaagc

SEQ ID NO: 319233 - DNA, 25 bp, Homo sapien
ggcctcgtggtcgtactggaagctc

SEQ ID NO: 319234 - DNA, 25 bp, Homo sapien
cctcgtggtcgtactggaagctctg

SEQ ID NO: 319235 - DNA, 25 bp, Homo sapien
cgtggtcgtactggaagctctggtt

SEQ ID NO: 319236 - DNA, 25 bp, Homo sapien
tcaccaggctgttcagtggactcag

SEQ ID NO: 319237 - DNA, 25 bp, Homo sapien
gtggactcagttcttcatcttgtaa

SEQ ID NO: 319238 - DNA, 25 bp, Homo sapien
cttgtaatgtcgatggctttgccac

SEQ ID NO: 319239 - DNA, 25 bp, Homo sapien
atggctttgccacaccaggccaagc

SEQ ID NO: 319240 - DNA, 25 bp, Homo sapien
aagcccatgccataccttgtcaaga

SEQ ID NO: 319241 - DNA, 25 bp, Homo sapien
caagactgtcaaagtggttgtggtt

SEQ ID NO: 319242 - DNA, 25 bp, Homo sapien
ggaagaaacaggtcagccctcagat

SEQ ID NO: 319243 - DNA, 25 bp, Homo sapien
gctctgccattagctaggacctaag

SEQ ID NO: 319244 - DNA, 25 bp, Homo sapien
taggacctaagactctgcccacatt

SEQ ID NO: 319245 - DNA, 25 bp, Homo sapien
tggtctgttctctcccattacacat

SEQ ID NO: 319246 - DNA, 25 bp, Homo sapien
gtctcagcatgcaagagtttttcct

SEQ ID NO: 319247 - DNA, 25 bp, Homo sapien
gccgacatcatcaggagagagagct

SEQ ID NO: 319248 - DNA, 25 bp, Homo sapien
gagagcttgtcaatgagccttggaa

SEQ ID NO: 319249 - DNA, 25 bp, Homo sapien
gcctgtcttaaattgagggcacaac

SEQ ID NO: 319250 - DNA, 25 bp, Homo sapien
aaattgagggcacaacaacccaggg

SEQ ID NO: 319251 - DNA, 25 bp, Homo sapien
aagtgcaggaatgtcatgtcctact

SEQ ID NO: 319252 - DNA, 25 bp, Homo sapien
atgtcctactggctcctagaatgga

SEQ ID NO: 319253 - DNA, 25 bp, Homo sapien
tactggctcctagaatggaacttga

SEQ ID NO: 319254 - DNA, 25 bp, Homo sapien
tggaacttgagtcattttgatttgg

SEQ ID NO: 319255 - DNA, 25 bp, Homo sapien
atcacatccttttgtaccggcattg

SEQ ID NO: 319256 - DNA, 25 bp, Homo sapien
accggcattgctgagagctgctggt

SEQ ID NO: 319257 - DNA, 25 bp, Homo sapien
atccctcaaagcagagtaaggccag

SEQ ID NO: 319258 - DNA, 25 bp, Homo sapien
gtgaaattttcaggtagtctgagta

SEQ ID NO: 319259 - DNA, 25 bp, Homo sapien
gagtaatagattgttttgccactta

SEQ ID NO: 319260 - DNA, 25 bp, Homo sapien
agattgttttgccacttagaatagc

SEQ ID NO: 319261 - DNA, 25 bp, Homo sapien
gccacttagaatagcatttgccact

SEQ ID NO: 319262 - DNA, 25 bp, Homo sapien
atagcatttgccacttagtatttta

SEQ ID NO: 319263 - DNA, 25 bp, Homo sapien
gttggagtatttattgtcagttttg

SEQ ID NO: 319264 - DNA, 25 bp, Homo sapien
gttttgttcacttgttatctaatac

SEQ ID NO: 319265 - DNA, 25 bp, Homo sapien
taaagccttcagagggtttggacca

SEQ ID NO: 319266 - DNA, 25 bp, Homo sapien
ggtttggaccacatctctttggaaa

SEQ ID NO: 319267 - DNA, 25 bp, Homo sapien
gtttgcaacatatttaagagatact

SEQ ID NO: 319268 - DNA, 25 bp, Homo sapien
gatgccaaaatgactttatacaacg

SEQ ID NO: 319269 - DNA, 25 bp, Homo sapien
tcggtctccgggaacacgtaggtgc

SEQ ID NO: 319270 - DNA, 25 bp, Homo sapien
aaggcagcttcaggatgtcgttggc

SEQ ID NO: 319271 - DNA, 25 bp, Homo sapien
cactatgtggaagcgcggctggtac

SEQ ID NO: 319272 - DNA, 25 bp, Homo sapien
tttaggatggtgaagccgtgcttgt

SEQ ID NO: 319273 - DNA, 25 bp, Homo sapien
aagccgtgcttgtcagagatgttgt

SEQ ID NO: 319274 - DNA, 25 bp, Homo sapien
gtcagcttcagcttgtggaaggcca

SEQ ID NO: 319275 - DNA, 25 bp, Homo sapien
gtggaaggccacaggcttagccatc

SEQ ID NO: 319276 - DNA, 25 bp, Homo sapien
gatgtacatgcgtttgggcatctca

SEQ ID NO: 319277 - DNA, 25 bp, Homo sapien
ttgggcatctcagggtcggccttgc

SEQ ID NO: 319278 - DNA, 25 bp, Homo sapien
accatccagcgcgagttgtggaact

SEQ ID NO: 319279 - DNA, 25 bp, Homo sapien
tgtggaacttatagcggcaatcgtc

SEQ ID NO: 319280 - DNA, 25 bp, Homo sapien
tgcttttgctgctgtctgaaacatt

SEQ ID NO: 319281 - DNA, 25 bp, Homo sapien
ttgctgctgtctgaaacattcaaaa

SEQ ID NO: 319282 - DNA, 25 bp, Homo sapien
ggaaaatacattgtttcacgaatca

SEQ ID NO: 319283 - DNA, 25 bp, Homo sapien
gtttcacgaatcaaagtagtcactg

SEQ ID NO: 319284 - DNA, 25 bp, Homo sapien
cacgaatcaaagtagtcactggtat

SEQ ID NO: 319285 - DNA, 25 bp, Homo sapien
gtcactggtattaaaagaatgcaac

SEQ ID NO: 319286 - DNA, 25 bp, Homo sapien
agaatgcaacagcagttagtctgat

SEQ ID NO: 319287 - DNA, 25 bp, Homo sapien
gcaacagcagttagtctgatacaga

SEQ ID NO: 319288 - DNA, 25 bp, Homo sapien
atgggagtgctgattataggaaatt

SEQ ID NO: 319289 - DNA, 25 bp, Homo sapien
tcacaaaataactatcatggccagg

SEQ ID NO: 319290 - DNA, 25 bp, Homo sapien
aataactatcatggccaggagtggt

SEQ ID NO: 319291 - DNA, 25 bp, Homo sapien
tattctcccaatgggcatggcgtgc

SEQ ID NO: 319292 - DNA, 25 bp, Homo sapien
aatgggcatggcgtgctcttcaggc

SEQ ID NO: 319293 - DNA, 25 bp, Homo sapien
agacagagaccatgatgtggttcat

SEQ ID NO: 319294 - DNA, 25 bp, Homo sapien
gtggttcatgtaagccaggtcttcc

SEQ ID NO: 319295 - DNA, 25 bp, Homo sapien
ccaggtcttcccgatgagagaggtt

SEQ ID NO: 319296 - DNA, 25 bp, Homo sapien
atgagagaggttgatgggcttccct

SEQ ID NO: 319297 - DNA, 25 bp, Homo sapien
cctcggagagcctggactgtttgaa

SEQ ID NO: 319298 - DNA, 25 bp, Homo sapien
actgtttgaaatccacggagtgccg

SEQ ID NO: 319299 - DNA, 25 bp, Homo sapien
tgggcatcagctggatcacgcgtgt

SEQ ID NO: 319300 - DNA, 25 bp, Homo sapien
gacgctgggcagtgattattctcca

SEQ ID NO: 319301 - DNA, 25 bp, Homo sapien
ggcagtgattattctccatgggaga

SEQ ID NO: 319302 - DNA, 25 bp, Homo sapien
tgagacagatatcccatgttctcac

SEQ ID NO: 319303 - DNA, 25 bp, Homo sapien
tcccatgttctcacaataactcttt

SEQ ID NO: 319304 - DNA, 25 bp, Homo sapien
taactctttattgtttagctagccc

SEQ ID NO: 319305 - DNA, 25 bp, Homo sapien
tattgtttagctagccccagtgaca

SEQ ID NO: 319306 - DNA, 25 bp, Homo sapien
tttagctagccccagtgacaagtct

SEQ ID NO: 319307 - DNA, 25 bp, Homo sapien
tagctagccccagtgacaagtctga

SEQ ID NO: 319308 - DNA, 25 bp, Homo sapien
tagccccagtgacaagtctgagcca

SEQ ID NO: 319309 - DNA, 25 bp, Homo sapien
gtgacaagtctgagccagctagccc

SEQ ID NO: 319310 - DNA, 25 bp, Homo sapien
caagtctgagccagctagccccagt

SEQ ID NO: 319311 - DNA, 25 bp, Homo sapien
agctagccccagtgactttatgcat

SEQ ID NO: 319312 - DNA, 25 bp, Homo sapien
gccccagtgactttatgcatcttat

SEQ ID NO: 319313 - DNA, 25 bp, Homo sapien
cctgtccccttaggatctttgtctt

SEQ ID NO: 319314 - DNA, 25 bp, Homo sapien
acacttttgggaggtgctgctttac

SEQ ID NO: 319315 - DNA, 25 bp, Homo sapien
gctgctttacttaagaacctccggg

SEQ ID NO: 319316 - DNA, 25 bp, Homo sapien
gggctgttctgtacctggactataa

SEQ ID NO: 319317 - DNA, 25 bp, Homo sapien
ggactataatgttcacattccctag

SEQ ID NO: 319318 - DNA, 25 bp, Homo sapien
acattccctagactgtcctgcagct

SEQ ID NO: 319319 - DNA, 25 bp, Homo sapien
tgccttgctctggataaattcactg

SEQ ID NO: 319320 - DNA, 25 bp, Homo sapien
ctggataaattcactgcttctcacc

SEQ ID NO: 319321 - DNA, 25 bp, Homo sapien
tgctccttcgcgcttcatgggagat

SEQ ID NO: 319322 - DNA, 25 bp, Homo sapien
aaaacctgcttacatgcacacacat

SEQ ID NO: 319323 - DNA, 25 bp, Homo sapien
ttcttccaacaccagccttgatggt

SEQ ID NO: 319324 - DNA, 25 bp, Homo sapien
attactggtattagtcttagcctaa

SEQ ID NO: 319325 - DNA, 25 bp, Homo sapien
agtcttagcctaatgaacctaatta

SEQ ID NO: 319326 - DNA, 25 bp, Homo sapien
ttgcttcctcaaatagcatctgcag

SEQ ID NO: 319327 - DNA, 25 bp, Homo sapien
gcatctgcagcaattggaatgagaa

SEQ ID NO: 319328 - DNA, 25 bp, Homo sapien
gtgtttcaagtagtacattgcctga

SEQ ID NO: 319329 - DNA, 25 bp, Homo sapien
attgcctgaatcacaaatcacttga

SEQ ID NO: 319330 - DNA, 25 bp, Homo sapien
agtattgtatataatccctgatcct

SEQ ID NO: 319331 - DNA, 25 bp, Homo sapien
gtatataatccctgatcctatttgt

SEQ ID NO: 319332 - DNA, 25 bp, Homo sapien
ttcccatttgcatcaaaacctaatg

SEQ ID NO: 319333 - DNA, 25 bp, Homo sapien
acaaatggtgtattgcttttcatac

SEQ ID NO: 319334 - DNA, 25 bp, Homo sapien
gttttcacaaaagccatttgcctag

SEQ ID NO: 319335 - DNA, 25 bp, Homo sapien
gagaagtcttgttcccacaacccca

SEQ ID NO: 319336 - DNA, 25 bp, Homo sapien
acgtgccaggtacacataaccattt

SEQ ID NO: 319337 - DNA, 25 bp, Homo sapien
aaccatttttattcacctctagctt

SEQ ID NO: 319338 - DNA, 25 bp, Homo sapien
tttattcacctctagcttgtgcttc

SEQ ID NO: 319339 - DNA, 25 bp, Homo sapien
tctagcttgtgcttccaatgtttgt

SEQ ID NO: 319340 - DNA, 25 bp, Homo sapien
ccaatgtttgttaggcatatgtaaa

SEQ ID NO: 319341 - DNA, 25 bp, Homo sapien
tgaatagataagcatttctccctcc

SEQ ID NO: 319342 - DNA, 25 bp, Homo sapien
ttctccctccttttgctgacatgag

SEQ ID NO: 319343 - DNA, 25 bp, Homo sapien
tccttttgctgacatgagtggtggc

SEQ ID NO: 319344 - DNA, 25 bp, Homo sapien
gacttacaagttatgtttaggtatt

SEQ ID NO: 319345 - DNA, 25 bp, Homo sapien
gtttaggtattttacatggttcaga

SEQ ID NO: 319346 - DNA, 25 bp, Homo sapien
gaaactgtggcgtgatggccgcggg

SEQ ID NO: 319347 - DNA, 25 bp, Homo sapien
cctgacctgccgtctagaaaaacct

SEQ ID NO: 319348 - DNA, 25 bp, Homo sapien
ctgacctgccgtctagaaaaacctg

SEQ ID NO: 319349 - DNA, 25 bp, Homo sapien
tgacctgccgtctagaaaaacctgc

SEQ ID NO: 319350 - DNA, 25 bp, Homo sapien
ggtgaagcaggcgtcggagggcccc

SEQ ID NO: 319351 - DNA, 25 bp, Homo sapien
agcaggcgtcggagggccccctcaa

SEQ ID NO: 319352 - DNA, 25 bp, Homo sapien
gagggccccctcaagggcatcctgg

SEQ ID NO: 319353 - DNA, 25 bp, Homo sapien
tgagcaccaggtggtctcctctgac

SEQ ID NO: 319354 - DNA, 25 bp, Homo sapien
cccctccgggaaactgtggcgtgat

SEQ ID NO: 319355 - DNA, 25 bp, Homo sapien
ccctccgggaaactgtggcgtgatg

SEQ ID NO: 319356 - DNA, 25 bp, Homo sapien
tccgggaaactgtggcgtgatggcc

SEQ ID NO: 319357 - DNA, 25 bp, Homo sapien
aatggcattgtgaaaagtttttagt

SEQ ID NO: 319358 - DNA, 25 bp, Homo sapien
ttgtgaaaagtttttagttgcgctt

SEQ ID NO: 319359 - DNA, 25 bp, Homo sapien
gaaaagtttttagttgcgctttatg

SEQ ID NO: 319360 - DNA, 25 bp, Homo sapien
tttttagttgcgctttatgggtgga

SEQ ID NO: 319361 - DNA, 25 bp, Homo sapien
tttagttgcgctttatgggtggatg

SEQ ID NO: 319362 - DNA, 25 bp, Homo sapien
tagttgcgctttatgggtggatgct

SEQ ID NO: 319363 - DNA, 25 bp, Homo sapien
tgcgctttatgggtggatgctgaat

SEQ ID NO: 319364 - DNA, 25 bp, Homo sapien
tgaattacattttgatttgatactt

SEQ ID NO: 319365 - DNA, 25 bp, Homo sapien
taaaagtttgtgatcatattgtcta

SEQ ID NO: 319366 - DNA, 25 bp, Homo sapien
gtgatcatattgtctaccatgtagc

SEQ ID NO: 319367 - DNA, 25 bp, Homo sapien
tgatcatattgtctaccatgtagcc

SEQ ID NO: 319368 - DNA, 25 bp, Homo sapien
atgcttcatgacctgtgttttgatc

SEQ ID NO: 319369 - DNA, 25 bp, Homo sapien
ttcatgacctgtgttttgatcctgg

SEQ ID NO: 319370 - DNA, 25 bp, Homo sapien
gacctgtgttttgatcctggttgga

SEQ ID NO: 319371 - DNA, 25 bp, Homo sapien
gatcctggttggagtaaaacattcc

SEQ ID NO: 319372 - DNA, 25 bp, Homo sapien
gctgtgagaaatgtcctaaccacct

SEQ ID NO: 319373 - DNA, 25 bp, Homo sapien
gagaaatgtcctaaccacctgactg

SEQ ID NO: 319374 - DNA, 25 bp, Homo sapien
aaatgtcctaaccacctgactgcag

SEQ ID NO: 319375 - DNA, 25 bp, Homo sapien
tatcatcttctactgagcagcaagc

SEQ ID NO: 319376 - DNA, 25 bp, Homo sapien
tgagcagcaagctatactgtccaga

SEQ ID NO: 319377 - DNA, 25 bp, Homo sapien
agcaagctatactgtccagagccct

SEQ ID NO: 319378 - DNA, 25 bp, Homo sapien
tgggcactgacactaagctggtttc

SEQ ID NO: 319379 - DNA, 25 bp, Homo sapien
agagcagctcagaagtcatcccagc

SEQ ID NO: 319380 - DNA, 25 bp, Homo sapien
ctctgaatctcctgtgctatgtttt

SEQ ID NO: 319381 - DNA, 25 bp, Homo sapien
atctcctgtgctatgttttatttct

SEQ ID NO: 319382 - DNA, 25 bp, Homo sapien
accatgggcattcaggctctccaca

SEQ ID NO: 319383 - DNA, 25 bp, Homo sapien
cacactcttcactattatctcttgg

SEQ ID NO: 319384 - DNA, 25 bp, Homo sapien
tatctcttggtcagaggactccaat

SEQ ID NO: 319385 - DNA, 25 bp, Homo sapien
ataacagccaggtttacatgaactg

SEQ ID NO: 319386 - DNA, 25 bp, Homo sapien
aactgtgtttgttcattctgaccta

SEQ ID NO: 319387 - DNA, 25 bp, Homo sapien
gtgtttgttcattctgacctaaggg

SEQ ID NO: 319388 - DNA, 25 bp, Homo sapien
cagtaaccataacccctgaagctgt

SEQ ID NO: 319389 - DNA, 25 bp, Homo sapien
gtgactgccaaacatctcaaatgaa

SEQ ID NO: 319390 - DNA, 25 bp, Homo sapien
ggaagctataagtgtggtggcacaa

SEQ ID NO: 319391 - DNA, 25 bp, Homo sapien
ctataagtgtggtggcacaaaggct

SEQ ID NO: 319392 - DNA, 25 bp, Homo sapien
tggcacaaaggctgaggaagctaga

SEQ ID NO: 319393 - DNA, 25 bp, Homo sapien
ggctgaggaagctagaatttcctgt

SEQ ID NO: 319394 - DNA, 25 bp, Homo sapien
aatttcctgtgaaggacagtggaga

SEQ ID NO: 319395 - DNA, 25 bp, Homo sapien
ggacagtggagaacccagtgtccct

SEQ ID NO: 319396 - DNA, 25 bp, Homo sapien
gagaacccagtgtccctcgggctga

SEQ ID NO: 319397 - DNA, 25 bp, Homo sapien
tccctcgggctgacaagaaccactt

SEQ ID NO: 319398 - DNA, 25 bp, Homo sapien
gggctgacaagaaccacttcccaag

SEQ ID NO: 319399 - DNA, 25 bp, Homo sapien
gctgacaagaaccacttcccaagac

SEQ ID NO: 319400 - DNA, 25 bp, Homo sapien
gacccacagtgcctggagaggacat

SEQ ID NO: 319401 - DNA, 25 bp, Homo sapien
tggccggcaccaatcttagtcaaga

SEQ ID NO: 319402 - DNA, 25 bp, Homo sapien
agtcaagagtggctgtgatcacatt

SEQ ID NO: 319403 - DNA, 25 bp, Homo sapien
ttgtcttcatttcaattaaggctga

SEQ ID NO: 319404 - DNA, 25 bp, Homo sapien
aaactctagaggtgactcagtcagg

SEQ ID NO: 319405 - DNA, 25 bp, Homo sapien
taattgccttcattttcaacccagg

SEQ ID NO: 319406 - DNA, 25 bp, Homo sapien
attttcaacccaggagtgcctctca

SEQ ID NO: 319407 - DNA, 25 bp, Homo sapien
gcctctcacagctatatgactacgg

SEQ ID NO: 319408 - DNA, 25 bp, Homo sapien
atgactacggatccattagtgagga

SEQ ID NO: 319409 - DNA, 25 bp, Homo sapien
gtgaggagcgacacacacacctgta

SEQ ID NO: 319410 - DNA, 25 bp, Homo sapien
acacctgtaggcatcctgtgcaaac

SEQ ID NO: 319411 - DNA, 25 bp, Homo sapien
ggcatcctgtgcaaacactttgtca

SEQ ID NO: 319412 - DNA, 25 bp, Homo sapien
tgagacagatatcccatgttctcac

SEQ ID NO: 319413 - DNA, 25 bp, Homo sapien
tcccatgttctcacaataactcttt

SEQ ID NO: 319414 - DNA, 25 bp, Homo sapien
catgttctcacaataactctttatt

SEQ ID NO: 319415 - DNA, 25 bp, Homo sapien
taactctttattgtttagctagccc

SEQ ID NO: 319416 - DNA, 25 bp, Homo sapien
tattgtttagctagccccagtgaca

SEQ ID NO: 319417 - DNA, 25 bp, Homo sapien
tttagctagccccagtgacaagtct

SEQ ID NO: 319418 - DNA, 25 bp, Homo sapien
tagctagccccagtgacaagtctga

SEQ ID NO: 319419 - DNA, 25 bp, Homo sapien
tagccccagtgacaagtctgagcca

SEQ ID NO: 319420 - DNA, 25 bp, Homo sapien
cccagtgacaagtctgagccagcta

SEQ ID NO: 319421 - DNA, 25 bp, Homo sapien
gtgacaagtctgagccagctagccc

SEQ ID NO: 319422 - DNA, 25 bp, Homo sapien
caagtctgagccagctagccccagt

SEQ ID NO: 319423 - DNA, 25 bp, Homo sapien
ctactgagcagcaagctatactgtc

SEQ ID NO: 319424 - DNA, 25 bp, Homo sapien
actgagcagcaagctatactgtcca

SEQ ID NO: 319425 - DNA, 25 bp, Homo sapien
tgagcagcaagctatactgtccaga

SEQ ID NO: 319426 - DNA, 25 bp, Homo sapien
gagcagcaagctatactgtccagag

SEQ ID NO: 319427 - DNA, 25 bp, Homo sapien
gcagcaagctatactgtccagagcc

SEQ ID NO: 319428 - DNA, 25 bp, Homo sapien
agcaagctatactgtccagagccct

SEQ ID NO: 319429 - DNA, 25 bp, Homo sapien
ctcccagcgctatgattaccccagc

SEQ ID NO: 319430 - DNA, 25 bp, Homo sapien
cctgtgagcggcagtgggcactgac

SEQ ID NO: 319431 - DNA, 25 bp, Homo sapien
ggcagtgggcactgacactaagctg

SEQ ID NO: 319432 - DNA, 25 bp, Homo sapien
gtgggcactgacactaagctggttt

SEQ ID NO: 319433 - DNA, 25 bp, Homo sapien
tgggcactgacactaagctggtttc

SEQ ID NO: 319434 - DNA, 25 bp, Homo sapien
gcaacagtatgtaaagggaccaaga

SEQ ID NO: 319435 - DNA, 25 bp, Homo sapien
agggaccaagagtggcagcctttag

SEQ ID NO: 319436 - DNA, 25 bp, Homo sapien
agagtggcagcctttagggaaaatg

SEQ ID NO: 319437 - DNA, 25 bp, Homo sapien
gaagagctgtgaacaaagctcattt

SEQ ID NO: 319438 - DNA, 25 bp, Homo sapien
ataagcgtgctttatttcacataga

SEQ ID NO: 319439 - DNA, 25 bp, Homo sapien
gggcatcagacgttacatttcattc

SEQ ID NO: 319440 - DNA, 25 bp, Homo sapien
agacgttacatttcattcggacaaa

SEQ ID NO: 319441 - DNA, 25 bp, Homo sapien
ggacaaattactgaacagccgaagt

SEQ ID NO: 319442 - DNA, 25 bp, Homo sapien
acagccgaagtgattgtttccaatg

SEQ ID NO: 319443 - DNA, 25 bp, Homo sapien
gattgtttccaatgtaggttattat

SEQ ID NO: 319444 - DNA, 25 bp, Homo sapien
gatacaaagatttaactagtgtttc

SEQ ID NO: 319445 - DNA, 25 bp, Homo sapien
aaatattaatcctgcatgctggaca

SEQ ID NO: 319446 - DNA, 25 bp, Homo sapien
ccattttcttgtttaactttagcat

SEQ ID NO: 319447 - DNA, 25 bp, Homo sapien
ttgatcatggatcatactccccttg

SEQ ID NO: 319448 - DNA, 25 bp, Homo sapien
gatcatactccccttgtttctttgg

SEQ ID NO: 319449 - DNA, 25 bp, Homo sapien
tccccttgtttctttgggtgagaag

SEQ ID NO: 319450 - DNA, 25 bp, Homo sapien
gaagggatcgcagtttggaaactcc

SEQ ID NO: 319451 - DNA, 25 bp, Homo sapien
cagtttggaaactccggcggctgcg

SEQ ID NO: 319452 - DNA, 25 bp, Homo sapien
agtcccagctgtaggcttgtaaata

SEQ ID NO: 319453 - DNA, 25 bp, Homo sapien
tgtaggcttgtaaatacccgccccg

SEQ ID NO: 319454 - DNA, 25 bp, Homo sapien
aaccgcatagagaacgtggcagcaa

SEQ ID NO: 319455 - DNA, 25 bp, Homo sapien
gctgagggtctttgtttgggtttat

SEQ ID NO: 319456 - DNA, 25 bp, Homo sapien
catttcaaatatgtgaagcagccaa

SEQ ID NO: 319457 - DNA, 25 bp, Homo sapien
ttcaaatatgtgaagcagccaagat

SEQ ID NO: 319458 - DNA, 25 bp, Homo sapien
tagaaaagatacagtgaaaaccact

SEQ ID NO: 319459 - DNA, 25 bp, Homo sapien
actgaaactgagttagatgaatttg

SEQ ID NO: 319460 - DNA, 25 bp, Homo sapien
gaatttgagatttgactttgtttgc

SEQ ID NO: 319461 - DNA, 25 bp, Homo sapien
ttgagatttgactttgtttgcttta

SEQ ID NO: 319462 - DNA, 25 bp, Homo sapien
gagatttgactttgtttgctttaat

SEQ ID NO: 319463 - DNA, 25 bp, Homo sapien
agatttgactttgtttgctttaata

SEQ ID NO: 319464 - DNA, 25 bp, Homo sapien
gacagatagatataaatctcagcac

SEQ ID NO: 319465 - DNA, 25 bp, Homo sapien
agatagatataaatctcagcacttt

SEQ ID NO: 319466 - DNA, 25 bp, Homo sapien
gagctgggaagatagcttaaagcca

SEQ ID NO: 319467 - DNA, 25 bp, Homo sapien
gtggacattcttcctgtatgaatat

SEQ ID NO: 319468 - DNA, 25 bp, Homo sapien
gaatatcatatggactctaccctat

SEQ ID NO: 319469 - DNA, 25 bp, Homo sapien
atggactctaccctatgcttgtttt

SEQ ID NO: 319470 - DNA, 25 bp, Homo sapien
cctatgcttgttttcacatcattga

SEQ ID NO: 319471 - DNA, 25 bp, Homo sapien
tgggaaaatctgactactcttgttt

SEQ ID NO: 319472 - DNA, 25 bp, Homo sapien
aatctgactactcttgtttctacaa

SEQ ID NO: 319473 - DNA, 25 bp, Homo sapien
gtaactccacagtttaacaagtctg

SEQ ID NO: 319474 - DNA, 25 bp, Homo sapien
ctgagccttgactatttgggtaaat

SEQ ID NO: 319475 - DNA, 25 bp, Homo sapien
ggtagtttaccttcatgagatttgc

SEQ ID NO: 319476 - DNA, 25 bp, Homo sapien
tgttatattatttgcctagatcctg

SEQ ID NO: 319477 - DNA, 25 bp, Homo sapien
agatcctgcaatcttgtactagcaa

SEQ ID NO: 319478 - DNA, 25 bp, Homo sapien
atggtgcactctgaggggcactgtc

SEQ ID NO: 319479 - DNA, 25 bp, Homo sapien
tgaggggcactgtcaactagagatt

SEQ ID NO: 319480 - DNA, 25 bp, Homo sapien
actagagattggccccatccaggtg

SEQ ID NO: 319481 - DNA, 25 bp, Homo sapien
catccaggtgggaggaacccctttg

SEQ ID NO: 319482 - DNA, 25 bp, Homo sapien
gtgcatttgacaggatctctgaatg

SEQ ID NO: 319483 - DNA, 25 bp, Homo sapien
gcatttgacaggatctctgaatggc

SEQ ID NO: 319484 - DNA, 25 bp, Homo sapien
atttgacaggatctctgaatggcta

SEQ ID NO: 319485 - DNA, 25 bp, Homo sapien
ttgacaggatctctgaatggctagg

SEQ ID NO: 319486 - DNA, 25 bp, Homo sapien
acaggatctctgaatggctaggtaa

SEQ ID NO: 319487 - DNA, 25 bp, Homo sapien
caggatctctgaatggctaggtaat

SEQ ID NO: 319488 - DNA, 25 bp, Homo sapien
ggatctctgaatggctaggtaatgg

SEQ ID NO: 319489 - DNA, 25 bp, Homo sapien
tatttgagagcgttcccttgaagcc

SEQ ID NO: 319490 - DNA, 25 bp, Homo sapien
tttgagagcgttcccttgaagcccc

SEQ ID NO: 319491 - DNA, 25 bp, Homo sapien
gcgttcccttgaagcccctcagaga

SEQ ID NO: 319492 - DNA, 25 bp, Homo sapien
ggcggcggacggcaagcggttcctg

SEQ ID NO: 319493 - DNA, 25 bp, Homo sapien
aagcggttcctgtctgcgcttgcgc

SEQ ID NO: 319494 - DNA, 25 bp, Homo sapien
tgcacgcacgcgcatgcccgtagcg

SEQ ID NO: 319495 - DNA, 25 bp, Homo sapien
gcggtggccggcagcactgcgcgtg

SEQ ID NO: 319496 - DNA, 25 bp, Homo sapien
gcgtgcgcggtgaggagcccgctaa

SEQ ID NO: 319497 - DNA, 25 bp, Homo sapien
aggagcccgctaaggagcggcgctg

SEQ ID NO: 319498 - DNA, 25 bp, Homo sapien
ggcgctggcggacgtcgggctggct

SEQ ID NO: 319499 - DNA, 25 bp, Homo sapien
ccgtgacgtcgtgcggagagcttta

SEQ ID NO: 319500 - DNA, 25 bp, Homo sapien
ggtgggtaccagagaatgctgcctt

SEQ ID NO: 319501 - DNA, 25 bp, Homo sapien
tgggtaccagagaatgctgccttcc

SEQ ID NO: 319502 - DNA, 25 bp, Homo sapien
ggtaccagagaatgctgccttcccc

SEQ ID NO: 319503 - DNA, 25 bp, Homo sapien
tgcctcattttcctgtagctcctct

SEQ ID NO: 319504 - DNA, 25 bp, Homo sapien
ctcattttcctgtagctcctctggt

SEQ ID NO: 319505 - DNA, 25 bp, Homo sapien
gctgtgttcatccaagggggttctc

SEQ ID NO: 319506 - DNA, 25 bp, Homo sapien
gttctcccagaagtgaggggccttt

SEQ ID NO: 319507 - DNA, 25 bp, Homo sapien
ggcccttccttgtgttgccaattta

SEQ ID NO: 319508 - DNA, 25 bp, Homo sapien
cccttccttgtgttgccaatttatt

SEQ ID NO: 319509 - DNA, 25 bp, Homo sapien
cttccttgtgttgccaatttattaa

SEQ ID NO: 319510 - DNA, 25 bp, Homo sapien
gtgttgccaatttattaacagcaaa

SEQ ID NO: 319511 - DNA, 25 bp, Homo sapien
aaatcagcagaggaccattgtatgt

SEQ ID NO: 319512 - DNA, 25 bp, Homo sapien
ccattgtatgtattgtcaggtcttt

SEQ ID NO: 319513 - DNA, 25 bp, Homo sapien
acctttatttatgcttcttgtgagt

SEQ ID NO: 319514 - DNA, 25 bp, Homo sapien
tatttatgcttcttgtgagtagaga

SEQ ID NO: 319515 - DNA, 25 bp, Homo sapien
ggaacatctctgtgttttccggaat

SEQ ID NO: 319516 - DNA, 25 bp, Homo sapien
ctgtgttttccggaatgtttactca

SEQ ID NO: 319517 - DNA, 25 bp, Homo sapien
aatgctgtgatgctgggaacttagg

SEQ ID NO: 319518 - DNA, 25 bp, Homo sapien
tgggaacttagggaagattcaccaa

SEQ ID NO: 319519 - DNA, 25 bp, Homo sapien
atgggaaatggtgagcactcttaat

SEQ ID NO: 319520 - DNA, 25 bp, Homo sapien
gtgagcactcttaatattagtgaga

SEQ ID NO: 319521 - DNA, 25 bp, Homo sapien
gtgagaatggcaaacagcccatttg

SEQ ID NO: 319522 - DNA, 25 bp, Homo sapien
tgtgggactaggtaacactttaaat

SEQ ID NO: 319523 - DNA, 25 bp, Homo sapien
tacttttttactcaaagatttgcca

SEQ ID NO: 319524 - DNA, 25 bp, Homo sapien
gccaagaacacagcttattagtgaa

SEQ ID NO: 319525 - DNA, 25 bp, Homo sapien
attagtgaaagagacctgtggattg

SEQ ID NO: 319526 - DNA, 25 bp, Homo sapien
agacctgtggattgaaatggctgca

SEQ ID NO: 319527 - DNA, 25 bp, Homo sapien
tgaaatggctgcagatagatcccgc

SEQ ID NO: 319528 - DNA, 25 bp, Homo sapien
atggctgcagatagatcccgcagtc

SEQ ID NO: 319529 - DNA, 25 bp, Homo sapien
agatagatcccgcagtcccttctga

SEQ ID NO: 319530 - DNA, 25 bp, Homo sapien
atcccgcagtcccttctgaaaggaa

SEQ ID NO: 319531 - DNA, 25 bp, Homo sapien
cgcagtcccttctgaaaggaactgt

SEQ ID NO: 319532 - DNA, 25 bp, Homo sapien
cctcagcccaagaataaaagagagt

SEQ ID NO: 319533 - DNA, 25 bp, Homo sapien
cttgctttttcttaattatgtacaa

SEQ ID NO: 319534 - DNA, 25 bp, Homo sapien
gtacaatttagatacacatccaaaa

SEQ ID NO: 319535 - DNA, 25 bp, Homo sapien
aacctattctagttttgctccaaga

SEQ ID NO: 319536 - DNA, 25 bp, Homo sapien
tgctccaagaatgactcagttccaa

SEQ ID NO: 319537 - DNA, 25 bp, Homo sapien
gaatgactcagttccaatgtaaaat

SEQ ID NO: 319538 - DNA, 25 bp, Homo sapien
gtaaaattagaggacttaacagcaa

SEQ ID NO: 319539 - DNA, 25 bp, Homo sapien
acagtataacctaccatactttttg

SEQ ID NO: 319540 - DNA, 25 bp, Homo sapien
tctaacatgtgttttgtgtcactgt

SEQ ID NO: 319541 - DNA, 25 bp, Homo sapien
gttttgtgtcactgttacttagaat

SEQ ID NO: 319542 - DNA, 25 bp, Homo sapien
tgtgtcactgttacttagaataggt

SEQ ID NO: 319543 - DNA, 25 bp, Homo sapien
ttagaataggtactcgagtgaacga

SEQ ID NO: 319544 - DNA, 25 bp, Homo sapien
actaccattttcatcgaggacacca

SEQ ID NO: 319545 - DNA, 25 bp, Homo sapien
tcgaggacaccatcacggactgtaa

SEQ ID NO: 319546 - DNA, 25 bp, Homo sapien
gacaccatcacggactgtaagcaga

SEQ ID NO: 319547 - DNA, 25 bp, Homo sapien
atcacggactgtaagcagagtgctt

SEQ ID NO: 319548 - DNA, 25 bp, Homo sapien
ctgtaagcagagtgcttgtagttcc

SEQ ID NO: 319549 - DNA, 25 bp, Homo sapien
tgcttgtagttcctttgattgaaag

SEQ ID NO: 319550 - DNA, 25 bp, Homo sapien
agcgtgcgcatgcagacattccaag

SEQ ID NO: 319551 - DNA, 25 bp, Homo sapien
aaacagccaagatatgtctcctaac

SEQ ID NO: 319552 - DNA, 25 bp, Homo sapien
gatatgtctcctaacaacagaatga

SEQ ID NO: 319553 - DNA, 25 bp, Homo sapien
gaaactctactgtttatagatctta

SEQ ID NO: 319554 - DNA, 25 bp, Homo sapien
cgcatgcagacattccaagtgacca

SEQ ID NO: 319555 - DNA, 25 bp, Homo sapien
tgagggagcaactgcagctgtcaga

SEQ ID NO: 319556 - DNA, 25 bp, Homo sapien
gtcagaggcgacaggaacgtgtcta

SEQ ID NO: 319557 - DNA, 25 bp, Homo sapien
ggaacgtgtctaggcgaacgactaa

SEQ ID NO: 319558 - DNA, 25 bp, Homo sapien
ggcgaacgactaaagcacctggaaa

SEQ ID NO: 319559 - DNA, 25 bp, Homo sapien
aagcacctggaaaggctgatccgga

SEQ ID NO: 319560 - DNA, 25 bp, Homo sapien
aaggctgatccggagttcaagggaa

SEQ ID NO: 319561 - DNA, 25 bp, Homo sapien
atctctctgcgctgctagacatggt

SEQ ID NO: 319562 - DNA, 25 bp, Homo sapien
tgcgctgctagacatggtggacatt

SEQ ID NO: 319563 - DNA, 25 bp, Homo sapien
gacatttgagcagcctgacctgtgg

SEQ ID NO: 319564 - DNA, 25 bp, Homo sapien
gggtctctcccgaagagtttctgtt

SEQ ID NO: 319565 - DNA, 25 bp, Homo sapien
aatgttattctcagatgcttgatgc

SEQ ID NO: 319566 - DNA, 25 bp, Homo sapien
ggccatgaaggccttagaagccatt

SEQ ID NO: 319567 - DNA, 25 bp, Homo sapien
ggccttagaagccatttctggtgtc

SEQ ID NO: 319568 - DNA, 25 bp, Homo sapien
agaagccatttctggtgtctggtgg

SEQ ID NO: 319569 - DNA, 25 bp, Homo sapien
atagagatgatgtgccgaggtccca

SEQ ID NO: 319570 - DNA, 25 bp, Homo sapien
gatgtgccgaggtcccagtgaacaa

SEQ ID NO: 319571 - DNA, 25 bp, Homo sapien
gtcccagtgaacaacagtagccaaa

SEQ ID NO: 319572 - DNA, 25 bp, Homo sapien
aaacaatgactttttgatggcaaaa

SEQ ID NO: 319573 - DNA, 25 bp, Homo sapien
aattccatttcatgacctagttgta

SEQ ID NO: 319574 - DNA, 25 bp, Homo sapien
gacctagttgtattagaaaaccttg

SEQ ID NO: 319575 - DNA, 25 bp, Homo sapien
gaaaaccttgatgaactatatgttc

SEQ ID NO: 319576 - DNA, 25 bp, Homo sapien
gaactatatgttcccgatttacaaa

SEQ ID NO: 319577 - DNA, 25 bp, Homo sapien
ctaaccaacttaccaagccatctaa

SEQ ID NO: 319578 - DNA, 25 bp, Homo sapien
gtgcttctgagacttttcagtttgc

SEQ ID NO: 319579 - DNA, 25 bp, Homo sapien
ttcagtttgcacaatttctttctcc

SEQ ID NO: 319580 - DNA, 25 bp, Homo sapien
cgcttctgccctactcttttgtaag

SEQ ID NO: 319581 - DNA, 25 bp, Homo sapien
aagctgacacagttgttgttggtac

SEQ ID NO: 319582 - DNA, 25 bp, Homo sapien
gtacaatcttgttctatcaccagca

SEQ ID NO: 319583 - DNA, 25 bp, Homo sapien
taatactgcttggtgacattccctc

SEQ ID NO: 319584 - DNA, 25 bp, Homo sapien
accaccctgtgccatgataacaatg

SEQ ID NO: 319585 - DNA, 25 bp, Homo sapien
atgtttattagctttggcccaccta

SEQ ID NO: 319586 - DNA, 25 bp, Homo sapien
tagctttggcccacctaattggaaa

SEQ ID NO: 319587 - DNA, 25 bp, Homo sapien
tgatttaaaacaccctacttctaag

SEQ ID NO: 319588 - DNA, 25 bp, Homo sapien
aaatgcctgaggtactaaagttatg

SEQ ID NO: 319589 - DNA, 25 bp, Homo sapien
atactattgttattgcagcagatgc

SEQ ID NO: 319590 - DNA, 25 bp, Homo sapien
gcagcagatgccttttgaatccatt

SEQ ID NO: 319591 - DNA, 25 bp, Homo sapien
agatgccttttgaatccattttcca

SEQ ID NO: 319592 - DNA, 25 bp, Homo sapien
cattttccataattgcggatagtca

SEQ ID NO: 319593 - DNA, 25 bp, Homo sapien
ggatagtcataaattgcttgctcaa

SEQ ID NO: 319594 - DNA, 25 bp, Homo sapien
aattattgctgttgacaccagcgtt

SEQ ID NO: 319595 - DNA, 25 bp, Homo sapien
gttgacaccagcgttgtagattttt

SEQ ID NO: 319596 - DNA, 25 bp, Homo sapien
agatttttggtgttgttgaatgcag

SEQ ID NO: 319597 - DNA, 25 bp, Homo sapien
gaatgcagtagagagaccaagacac

SEQ ID NO: 319598 - DNA, 25 bp, Homo sapien
gagaccaagacactattctgtaaga

SEQ ID NO: 319599 - DNA, 25 bp, Homo sapien
atttcaaatatgtgaagcagccaag

SEQ ID NO: 319600 - DNA, 25 bp, Homo sapien
aatatgtgaagcagccaagatccac

SEQ ID NO: 319601 - DNA, 25 bp, Homo sapien
agatccacaaaagtgtgtattttca

SEQ ID NO: 319602 - DNA, 25 bp, Homo sapien
tagaaaagatacagtgaaaaccact

SEQ ID NO: 319603 - DNA, 25 bp, Homo sapien
aaaccactgaaactgagttagatga

SEQ ID NO: 319604 - DNA, 25 bp, Homo sapien
gaatttgagatttgactttgtttgc

SEQ ID NO: 319605 - DNA, 25 bp, Homo sapien
tgagatttgactttgtttgctttaa

SEQ ID NO: 319606 - DNA, 25 bp, Homo sapien
agatttgactttgtttgctttaata

SEQ ID NO: 319607 - DNA, 25 bp, Homo sapien
gacagatagatataaatctcagcac

SEQ ID NO: 319608 - DNA, 25 bp, Homo sapien
agatagatataaatctcagcacttt

SEQ ID NO: 319609 - DNA, 25 bp, Homo sapien
gagctgggaagatagcttaaagcca

SEQ ID NO: 319610 - DNA, 25 bp, Homo sapien
gtgggtaaacacctacaacatcgtc

SEQ ID NO: 319611 - DNA, 25 bp, Homo sapien
taaacacctacaacatcgtcacctg

SEQ ID NO: 319612 - DNA, 25 bp, Homo sapien
ctgccacacgccatttggagggttt

SEQ ID NO: 319613 - DNA, 25 bp, Homo sapien
gtgaggatgggcttaaggcctacac

SEQ ID NO: 319614 - DNA, 25 bp, Homo sapien
gggcttaaggcctacacagaggtaa

SEQ ID NO: 319615 - DNA, 25 bp, Homo sapien
aggtaaagacggtcaccatcaaggt

SEQ ID NO: 319616 - DNA, 25 bp, Homo sapien
aagaactcgtaagagcagctgtcag

SEQ ID NO: 319617 - DNA, 25 bp, Homo sapien
agctgtcagggaggcccagtcacag

SEQ ID NO: 319618 - DNA, 25 bp, Homo sapien
cagtcacagtccagcaattccacaa

SEQ ID NO: 319619 - DNA, 25 bp, Homo sapien
aattccacaaccaccttgaccaatg

SEQ ID NO: 319620 - DNA, 25 bp, Homo sapien
taaagccaagaacaccctttctttg

SEQ ID NO: 319621 - DNA, 25 bp, Homo sapien
attcttctccattgctgagacgtca

SEQ ID NO: 319622 - DNA, 25 bp, Homo sapien
tccattgctgagacgtcaaatcgaa

SEQ ID NO: 319623 - DNA, 25 bp, Homo sapien
gagacgtcaaatcgaacaattctga

SEQ ID NO: 319624 - DNA, 25 bp, Homo sapien
acaattctgaagtagggtctgtaga

SEQ ID NO: 319625 - DNA, 25 bp, Homo sapien
ggcatgtctattttgtaaacctcct

SEQ ID NO: 319626 - DNA, 25 bp, Homo sapien
ctccttggcgtagtactcttcgtcg

SEQ ID NO: 319627 - DNA, 25 bp, Homo sapien
tggcgtagtactcttcgtcgctcct

SEQ ID NO: 319628 - DNA, 25 bp, Homo sapien
tctcctggagcaagtccctggtgct

SEQ ID NO: 319629 - DNA, 25 bp, Homo sapien
gtccctggtgctgttgtagatggaa

SEQ ID NO: 319630 - DNA, 25 bp, Homo sapien
acttcctcgggctcaggatagtctt

SEQ ID NO: 319631 - DNA, 25 bp, Homo sapien
ctcgggctcaggatagtcttctggg

SEQ ID NO: 319632 - DNA, 25 bp, Homo sapien
gctgtaggccccatgaactcaaatg

SEQ ID NO: 319633 - DNA, 25 bp, Homo sapien
tcaaatgtaaattcaggctggtcca

SEQ ID NO: 319634 - DNA, 25 bp, Homo sapien
attcaggctggtccaaatgtgggca

SEQ ID NO: 319635 - DNA, 25 bp, Homo sapien
tgtgggcagcatgataaaactgtaa

SEQ ID NO: 319636 - DNA, 25 bp, Homo sapien
gcagccatgtacagggtctggctca

SEQ ID NO: 319637 - DNA, 25 bp, Homo sapien
agggtctggctcagtgccaggatcc

SEQ ID NO: 319638 - DNA, 25 bp, Homo sapien
gccttttgggatgccagagctgttc

SEQ ID NO: 319639 - DNA, 25 bp, Homo sapien
ccagagctgttctgaaactgacaga

SEQ ID NO: 319640 - DNA, 25 bp, Homo sapien
agaatgctataaccacatccttgtg

SEQ ID NO: 319641 - DNA, 25 bp, Homo sapien
ccacatccttgtgcctgattcaaag

SEQ ID NO: 319642 - DNA, 25 bp, Homo sapien
tgtaaatttctgtcaaggccacttc

SEQ ID NO: 319643 - DNA, 25 bp, Homo sapien
agccctatccatactatagtttctc

SEQ ID NO: 319644 - DNA, 25 bp, Homo sapien
ctaaaactttatctgaaagagtcat

SEQ ID NO: 319645 - DNA, 25 bp, Homo sapien
tgctatcttaatgttctgaaataag

SEQ ID NO: 319646 - DNA, 25 bp, Homo sapien
tgaatactgtaaaggaaataaacgg

SEQ ID NO: 319647 - DNA, 25 bp, Homo sapien
tatgaattcttgtaagcggaatgta

SEQ ID NO: 319648 - DNA, 25 bp, Homo sapien
atgaattcttgtaagcggaatgtaa

SEQ ID NO: 319649 - DNA, 25 bp, Homo sapien
tgaattcttgtaagcggaatgtaaa

SEQ ID NO: 319650 - DNA, 25 bp, Homo sapien
gaattcttgtaagcggaatgtaaaa

SEQ ID NO: 319651 - DNA, 25 bp, Homo sapien
ttcttgtaagcggaatgtaaaacgg

SEQ ID NO: 319652 - DNA, 25 bp, Homo sapien
tcttgtaagcggaatgtaaaacgga

SEQ ID NO: 319653 - DNA, 25 bp, Homo sapien
tgtaagcggaatgtaaaacggaaat

SEQ ID NO: 319654 - DNA, 25 bp, Homo sapien
aaaacaagctgtggccctttccact

SEQ ID NO: 319655 - DNA, 25 bp, Homo sapien
tccattccatggcttgaaacctctg

SEQ ID NO: 319656 - DNA, 25 bp, Homo sapien
catggcttgaaacctctgcctgatg

SEQ ID NO: 319657 - DNA, 25 bp, Homo sapien
cctgatgtggctccttcctttttcc

SEQ ID NO: 319658 - DNA, 25 bp, Homo sapien
ttgtcaaaccctcttcaaaggagga

SEQ ID NO: 319659 - DNA, 25 bp, Homo sapien
gcctagtcatgcctcccaactgtgg

SEQ ID NO: 319660 - DNA, 25 bp, Homo sapien
atgcctcccaactgtggtggtatat

SEQ ID NO: 319661 - DNA, 25 bp, Homo sapien
ccaactgtggtggtatatgtgtaca

SEQ ID NO: 319662 - DNA, 25 bp, Homo sapien
tgtggtggtatatgtgtacacacat

SEQ ID NO: 319663 - DNA, 25 bp, Homo sapien
ggttgctgattaaaatacactcccc

SEQ ID NO: 319664 - DNA, 25 bp, Homo sapien
ggggagtgtgacactttctttccat

SEQ ID NO: 319665 - DNA, 25 bp, Homo sapien
tgaatactgtaaaggaaataaacgg

SEQ ID NO: 319666 - DNA, 25 bp, Homo sapien
tatgaattcttgtaagcggaatgta

SEQ ID NO: 319667 - DNA, 25 bp, Homo sapien
atgaattcttgtaagcggaatgtaa

SEQ ID NO: 319668 - DNA, 25 bp, Homo sapien
tgaattcttgtaagcggaatgtaaa

SEQ ID NO: 319669 - DNA, 25 bp, Homo sapien
gaattcttgtaagcggaatgtaaaa

SEQ ID NO: 319670 - DNA, 25 bp, Homo sapien
attcttgtaagcggaatgtaaaacg

SEQ ID NO: 319671 - DNA, 25 bp, Homo sapien
ttcttgtaagcggaatgtaaaacgg

SEQ ID NO: 319672 - DNA, 25 bp, Homo sapien
tcttgtaagcggaatgtaaaacgga

SEQ ID NO: 319673 - DNA, 25 bp, Homo sapien
tgtaagcggaatgtaaaacggaaat

SEQ ID NO: 319674 - DNA, 25 bp, Homo sapien
tagccaccgctctcgtttttctgta

SEQ ID NO: 319675 - DNA, 25 bp, Homo sapien
ctctcgtttttctgtatcgctttta

SEQ ID NO: 319676 - DNA, 25 bp, Homo sapien
ttctgtatcgcttttatctcctgaa

SEQ ID NO: 319677 - DNA, 25 bp, Homo sapien
agagatcatctatatcaggaattga

SEQ ID NO: 319678 - DNA, 25 bp, Homo sapien
tatcaggaattgaatgtctaactca

SEQ ID NO: 319679 - DNA, 25 bp, Homo sapien
tgtctaactcaaacctctcattttt

SEQ ID NO: 319680 - DNA, 25 bp, Homo sapien
catttttgtttaataggtagatctc

SEQ ID NO: 319681 - DNA, 25 bp, Homo sapien
ggtagatctcatttgaagtctccta

SEQ ID NO: 319682 - DNA, 25 bp, Homo sapien
tcatttgaagtctcctatctgaatc

SEQ ID NO: 319683 - DNA, 25 bp, Homo sapien
tcttttttgctgtagtcaagcatta

SEQ ID NO: 319684 - DNA, 25 bp, Homo sapien
ctaggaatggattttccacgatgtc

SEQ ID NO: 319685 - DNA, 25 bp, Homo sapien
atggctaggtaatggatcccaagca

SEQ ID NO: 319686 - DNA, 25 bp, Homo sapien
gtaatggatcccaagcaggctcaca

SEQ ID NO: 319687 - DNA, 25 bp, Homo sapien
ggatcccaagcaggctcacaaattt

SEQ ID NO: 319688 - DNA, 25 bp, Homo sapien
ccaagcaggctcacaaatttaaatg

SEQ ID NO: 319689 - DNA, 25 bp, Homo sapien
ggctcacaaatttaaatgagggctt

SEQ ID NO: 319690 - DNA, 25 bp, Homo sapien
ggctttgtgtgcagaaagaggaata

SEQ ID NO: 319691 - DNA, 25 bp, Homo sapien
gtacagattattttcctaccactag

SEQ ID NO: 319692 - DNA, 25 bp, Homo sapien
tattttcctaccactagatttttgg

SEQ ID NO: 319693 - DNA, 25 bp, Homo sapien
gggagagtcaccatggaatgttgac

SEQ ID NO: 319694 - DNA, 25 bp, Homo sapien
tcaccatggaatgttgacaattact

SEQ ID NO: 319695 - DNA, 25 bp, Homo sapien
aagctcccttgctgaattcctgtcc

SEQ ID NO: 319696 - DNA, 25 bp, Homo sapien
gaacacagttcaaacctagacataa

SEQ ID NO: 319697 - DNA, 25 bp, Homo sapien
ctagacataatgctaaggccgcaaa

SEQ ID NO: 319698 - DNA, 25 bp, Homo sapien
gctaaggccgcaaaagccgaaggaa

SEQ ID NO: 319699 - DNA, 25 bp, Homo sapien
accttgctgcatgcctctttgggac

SEQ ID NO: 319700 - DNA, 25 bp, Homo sapien
atgcctctttgggactccgtttctc

SEQ ID NO: 319701 - DNA, 25 bp, Homo sapien
gcgacggacggttgccctggaaatt

SEQ ID NO: 319702 - DNA, 25 bp, Homo sapien
attttggacattcccaaagcgccaa

SEQ ID NO: 319703 - DNA, 25 bp, Homo sapien
caaagcgccaattttcatggtggag

SEQ ID NO: 319704 - DNA, 25 bp, Homo sapien
gcttctccaaactctggttgctgga

SEQ ID NO: 319705 - DNA, 25 bp, Homo sapien
tggttgctggaaggtccgcccacta

SEQ ID NO: 319706 - DNA, 25 bp, Homo sapien
ctacggaacctgcatcctagagtta

SEQ ID NO: 319707 - DNA, 25 bp, Homo sapien
taagtgtacagttctttcgcattaa

SEQ ID NO: 319708 - DNA, 25 bp, Homo sapien
agtgtacagttctttcgcattaatg

SEQ ID NO: 319709 - DNA, 25 bp, Homo sapien
gtgtacagttctttcgcattaatgc

SEQ ID NO: 319710 - DNA, 25 bp, Homo sapien
tgtacagttctttcgcattaatgca

SEQ ID NO: 319711 - DNA, 25 bp, Homo sapien
gtacagttctttcgcattaatgcac

SEQ ID NO: 319712 - DNA, 25 bp, Homo sapien
acagttctttcgcattaatgcaccc

SEQ ID NO: 319713 - DNA, 25 bp, Homo sapien
agttctttcgcattaatgcacccat

SEQ ID NO: 319714 - DNA, 25 bp, Homo sapien
gttctttcgcattaatgcacccatg

SEQ ID NO: 319715 - DNA, 25 bp, Homo sapien
ttctttcgcattaatgcacccatga

SEQ ID NO: 319716 - DNA, 25 bp, Homo sapien
ctttcgcattaatgcacccatgacc

SEQ ID NO: 319717 - DNA, 25 bp, Homo sapien
aaatatggtttatttaggtaagcat

SEQ ID NO: 319718 - DNA, 25 bp, Homo sapien
agcaccctgcagagcacacaggtac

SEQ ID NO: 319719 - DNA, 25 bp, Homo sapien
acaggtacagcaacaggaatctcag

SEQ ID NO: 319720 - DNA, 25 bp, Homo sapien
gaatctcagagacaggtggcctagc

SEQ ID NO: 319721 - DNA, 25 bp, Homo sapien
tggcctagcaggcacaggacacctg

SEQ ID NO: 319722 - DNA, 25 bp, Homo sapien
gggtcctgttaacgtcatctcaggg

SEQ ID NO: 319723 - DNA, 25 bp, Homo sapien
gttaacgtcatctcagggtccagac

SEQ ID NO: 319724 - DNA, 25 bp, Homo sapien
gaccctgaagatttcagaggctgca

SEQ ID NO: 319725 - DNA, 25 bp, Homo sapien
agaggctgcagaacttctgcctgaa

SEQ ID NO: 319726 - DNA, 25 bp, Homo sapien
attcaaactgctccaagtggtggga

SEQ ID NO: 319727 - DNA, 25 bp, Homo sapien
tggtgggaatcagatctgtcttgat

SEQ ID NO: 319728 - DNA, 25 bp, Homo sapien
cagatctgtcttgatgtgtcatcta

SEQ ID NO: 319729 - DNA, 25 bp, Homo sapien
cccaggactgtcattttggcatctg

SEQ ID NO: 319730 - DNA, 25 bp, Homo sapien
agccagcacctggttgatgtgtatt

SEQ ID NO: 319731 - DNA, 25 bp, Homo sapien
gatgtgtattcatactgacattaga

SEQ ID NO: 319732 - DNA, 25 bp, Homo sapien
gacattagattgatgtgcactgcat

SEQ ID NO: 319733 - DNA, 25 bp, Homo sapien
agaaatgaggtagctgacacagaaa

SEQ ID NO: 319734 - DNA, 25 bp, Homo sapien
gtatgtcttgaaacatgttcatctg

SEQ ID NO: 319735 - DNA, 25 bp, Homo sapien
tgttcatctggaagtattttcctcc

SEQ ID NO: 319736 - DNA, 25 bp, Homo sapien
ttttcctccaaagtaatgtagcatg

SEQ ID NO: 319737 - DNA, 25 bp, Homo sapien
ggattgttaacatgcctgggattgg

SEQ ID NO: 319738 - DNA, 25 bp, Homo sapien
aacatgcctgggattgggaaagata

SEQ ID NO: 319739 - DNA, 25 bp, Homo sapien
agataggactaaagttgtgccaaac

SEQ ID NO: 319740 - DNA, 25 bp, Homo sapien
attctaccttactagtagagttcaa

SEQ ID NO: 319741 - DNA, 25 bp, Homo sapien
caagttttcactgagagccttttca

SEQ ID NO: 319742 - DNA, 25 bp, Homo sapien
gcatttgtcagttattctatttcag

SEQ ID NO: 319743 - DNA, 25 bp, Homo sapien
gagtcaaaattcaagcacgatacat

SEQ ID NO: 319744 - DNA, 25 bp, Homo sapien
cacgatacattttgaaggctttgca

SEQ ID NO: 319745 - DNA, 25 bp, Homo sapien
tttgcaaactcctaaacccctgatg

SEQ ID NO: 319746 - DNA, 25 bp, Homo sapien
taaacccctgatgagtcctctcatt

SEQ ID NO: 319747 - DNA, 25 bp, Homo sapien
gatgagtcctctcattctggaagtg

SEQ ID NO: 319748 - DNA, 25 bp, Homo sapien
gagtagatactgatttgtcccgtag

SEQ ID NO: 319749 - DNA, 25 bp, Homo sapien
tgatttgtcccgtagtatggcagat

SEQ ID NO: 319750 - DNA, 25 bp, Homo sapien
gtcccgtagtatggcagatgacagg

SEQ ID NO: 319751 - DNA, 25 bp, Homo sapien
gtgcccagcgacaatcactgaacgc

SEQ ID NO: 319752 - DNA, 25 bp, Homo sapien
gacaatcactgaacgccgaagcctg

SEQ ID NO: 319753 - DNA, 25 bp, Homo sapien
actgaacgccgaagcctgcagccat

SEQ ID NO: 319754 - DNA, 25 bp, Homo sapien
caagtttcacgcaaagctgaaatct

SEQ ID NO: 319755 - DNA, 25 bp, Homo sapien
gccaaattggccttatggtgagact

SEQ ID NO: 319756 - DNA, 25 bp, Homo sapien
aattggccttatggtgagacttatt

SEQ ID NO: 319757 - DNA, 25 bp, Homo sapien
ttggccttatggtgagacttattgc

SEQ ID NO: 319758 - DNA, 25 bp, Homo sapien
ggccttatggtgagacttattgcat

SEQ ID NO: 319759 - DNA, 25 bp, Homo sapien
ggtgagacttattgcattgcactgc

SEQ ID NO: 319760 - DNA, 25 bp, Homo sapien
tgagacttattgcattgcactgccc

SEQ ID NO: 319761 - DNA, 25 bp, Homo sapien
gacttattgcattgcactgcccgtt

SEQ ID NO: 319762 - DNA, 25 bp, Homo sapien
tcgatgtcctccagggtttccaaaa

SEQ ID NO: 319763 - DNA, 25 bp, Homo sapien
ccaaaaccacaatttccttcatatg

SEQ ID NO: 319764 - DNA, 25 bp, Homo sapien
aaactcttcaggatgcagaaaggca

SEQ ID NO: 319765 - DNA, 25 bp, Homo sapien
ctgaagaatcatgaaactctgcggg

SEQ ID NO: 319766 - DNA, 25 bp, Homo sapien
gtttcctaggtagtaaccataggtg

SEQ ID NO: 319767 - DNA, 25 bp, Homo sapien
gtaaccataggtggcttgtttgtat

SEQ ID NO: 319768 - DNA, 25 bp, Homo sapien
ggcttgtttgtattcttcccaggaa

SEQ ID NO: 319769 - DNA, 25 bp, Homo sapien
ttcttcccaggaaattttatcatcc

SEQ ID NO: 319770 - DNA, 25 bp, Homo sapien
aaattttatcatccttgtccctatc

SEQ ID NO: 319771 - DNA, 25 bp, Homo sapien
ttatcatccttgtccctatcataat

SEQ ID NO: 319772 - DNA, 25 bp, Homo sapien
ttgtccctatcataatccttccaga

SEQ ID NO: 319773 - DNA, 25 bp, Homo sapien
aaatgatgaccattgtattaaaatg

SEQ ID NO: 319774 - DNA, 25 bp, Homo sapien
aatggcatatggaaaagctttgtat

SEQ ID NO: 319775 - DNA, 25 bp, Homo sapien
tggcatatggaaaagctttgtattt

SEQ ID NO: 319776 - DNA, 25 bp, Homo sapien
gctttgtattttggttagctatgca

SEQ ID NO: 319777 - DNA, 25 bp, Homo sapien
gtattttggttagctatgcaaagtc

SEQ ID NO: 319778 - DNA, 25 bp, Homo sapien
ttggttagctatgcaaagtcatgag

SEQ ID NO: 319779 - DNA, 25 bp, Homo sapien
ggttagctatgcaaagtcatgagaa

SEQ ID NO: 319780 - DNA, 25 bp, Homo sapien
aagtcatgagaaagatgagattctt

SEQ ID NO: 319781 - DNA, 25 bp, Homo sapien
ttctatttcatattaattccaggtg

SEQ ID NO: 319782 - DNA, 25 bp, Homo sapien
actactttgaaattccttgatttgt

SEQ ID NO: 319783 - DNA, 25 bp, Homo sapien
ctactttgaaattccttgatttgta

SEQ ID NO: 319784 - DNA, 25 bp, Homo sapien
tgggacgacaaatgcaaaatgcctt

SEQ ID NO: 319785 - DNA, 25 bp, Homo sapien
aggcagttttgcatgaagttttaag

SEQ ID NO: 319786 - DNA, 25 bp, Homo sapien
gttccattagggattttccatgcaa

SEQ ID NO: 319787 - DNA, 25 bp, Homo sapien
gatgcagttgtacgtggttattcca

SEQ ID NO: 319788 - DNA, 25 bp, Homo sapien
gtggttattccattcctaaaggcac

SEQ ID NO: 319789 - DNA, 25 bp, Homo sapien
atctttattctgtacactttgatga

SEQ ID NO: 319790 - DNA, 25 bp, Homo sapien
gagagacccagaagtgttccatcct

SEQ ID NO: 319791 - DNA, 25 bp, Homo sapien
gaagtgttccatcctgagcgatttc

SEQ ID NO: 319792 - DNA, 25 bp, Homo sapien
tcctgagcgatttctggacagcagt

SEQ ID NO: 319793 - DNA, 25 bp, Homo sapien
gacagcagtggatattttgccaaga

SEQ ID NO: 319794 - DNA, 25 bp, Homo sapien
ttgccaagaaggaagctttggttcc

SEQ ID NO: 319795 - DNA, 25 bp, Homo sapien
taaaggtgtgatgatctgaagaatc

SEQ ID NO: 319796 - DNA, 25 bp, Homo sapien
aggtgtgatgatctgaagaatcatg

SEQ ID NO: 319797 - DNA, 25 bp, Homo sapien
ggtgtgatgatctgaagaatcatga

SEQ ID NO: 319798 - DNA, 25 bp, Homo sapien
gtgtgatgatctgaagaatcatgaa

SEQ ID NO: 319799 - DNA, 25 bp, Homo sapien
tgtgatgatctgaagaatcatgaaa

SEQ ID NO: 319800 - DNA, 25 bp, Homo sapien
gtgatgatctgaagaatcatgaaac

SEQ ID NO: 319801 - DNA, 25 bp, Homo sapien
aatcatgaaactctgcggggtttcc

SEQ ID NO: 319802 - DNA, 25 bp, Homo sapien
atcatgaaactctgcggggtttcct

SEQ ID NO: 319803 - DNA, 25 bp, Homo sapien
tcatgaaactctgcggggtttccta

SEQ ID NO: 319804 - DNA, 25 bp, Homo sapien
atgaaactctgcggggtttcctagg

SEQ ID NO: 319805 - DNA, 25 bp, Homo sapien
tgaaactctgcggggtttcctaggt

SEQ ID NO: 319806 - DNA, 25 bp, Homo sapien
ccagggccagaaagtcggtatcttg

SEQ ID NO: 319807 - DNA, 25 bp, Homo sapien
agtcggtatcttggttgtgctctgg

SEQ ID NO: 319808 - DNA, 25 bp, Homo sapien
ggtgtttctgatgttattccagcct

SEQ ID NO: 319809 - DNA, 25 bp, Homo sapien
gttattccagcctcctgctacatta

SEQ ID NO: 319810 - DNA, 25 bp, Homo sapien
tcctgctacattatatccagaagta

SEQ ID NO: 319811 - DNA, 25 bp, Homo sapien
ccagaagtaattgcggaggctcctt

SEQ ID NO: 319812 - DNA, 25 bp, Homo sapien
taattgcggaggctccttcagctgc

SEQ ID NO: 319813 - DNA, 25 bp, Homo sapien
actttgattttggacagggacaagg

SEQ ID NO: 319814 - DNA, 25 bp, Homo sapien
agagaagcttcccttaaccagaggg

SEQ ID NO: 319815 - DNA, 25 bp, Homo sapien
tttccttttggctttcgagggcctg

SEQ ID NO: 319816 - DNA, 25 bp, Homo sapien
ttcgagggcctgtaaatatctatat

SEQ ID NO: 319817 - DNA, 25 bp, Homo sapien
agagaaaggacattcagtgacatcc

SEQ ID NO: 319818 - DNA, 25 bp, Homo sapien
ttcagtgacatccacgtgcagtatg

SEQ ID NO: 319819 - DNA, 25 bp, Homo sapien
gtgacatccacgtgcagtatgaata

SEQ ID NO: 319820 - DNA, 25 bp, Homo sapien
cagtatgaatacgtagcacaggcta

SEQ ID NO: 319821 - DNA, 25 bp, Homo sapien
aggctaagcaagttacctgttgaag

SEQ ID NO: 319822 - DNA, 25 bp, Homo sapien
aattgcagcacggtgaaggcaggcc

SEQ ID NO: 319823 - DNA, 25 bp, Homo sapien
aaggcaggccatttgtgtcgtagtc

SEQ ID NO: 319824 - DNA, 25 bp, Homo sapien
aggccatttgtgtcgtagtcttccg

SEQ ID NO: 319825 - DNA, 25 bp, Homo sapien
tttgtgtcgtagtcttccgtttgaa

SEQ ID NO: 319826 - DNA, 25 bp, Homo sapien
gtagtcttccgtttgaagacctgga

SEQ ID NO: 319827 - DNA, 25 bp, Homo sapien
aagacctggagatgtcattgtgaga

SEQ ID NO: 319828 - DNA, 25 bp, Homo sapien
aaagcataatgctaatggaaaagaa

SEQ ID NO: 319829 - DNA, 25 bp, Homo sapien
gaaaatctgatgttctattataata

SEQ ID NO: 319830 - DNA, 25 bp, Homo sapien
taatatgctattgctgaatatgaat

SEQ ID NO: 319831 - DNA, 25 bp, Homo sapien
tgaatagaaatacagggcatcattt

SEQ ID NO: 319832 - DNA, 25 bp, Homo sapien
aatacagggcatcatttccttgtct

SEQ ID NO: 319833 - DNA, 25 bp, Homo sapien
atacagggcatcatttccttgtctc

SEQ ID NO: 319834 - DNA, 25 bp, Homo sapien
tacagggcatcatttccttgtctca

SEQ ID NO: 319835 - DNA, 25 bp, Homo sapien
cagggcatcatttccttgtctcatt

SEQ ID NO: 319836 - DNA, 25 bp, Homo sapien
gcatcatttccttgtctcattataa

SEQ ID NO: 319837 - DNA, 25 bp, Homo sapien
ttcggtcttccacagcagtattatt

SEQ ID NO: 319838 - DNA, 25 bp, Homo sapien
gcagtattattgtctttgtggagtt

SEQ ID NO: 319839 - DNA, 25 bp, Homo sapien
gagcttttccatttggtgctccaat

SEQ ID NO: 319840 - DNA, 25 bp, Homo sapien
tccatttggtgctccaatgtctcct

SEQ ID NO: 319841 - DNA, 25 bp, Homo sapien
ctgctggacccatctgcctagtgga

SEQ ID NO: 319842 - DNA, 25 bp, Homo sapien
cctagtggaaggcagcaaaatttca

SEQ ID NO: 319843 - DNA, 25 bp, Homo sapien
agaaacaggtgaggttgagcagctt

SEQ ID NO: 319844 - DNA, 25 bp, Homo sapien
ggcctggagttggagctcaacagca

SEQ ID NO: 319845 - DNA, 25 bp, Homo sapien
tcaacagcaatggatttcagagacc

SEQ ID NO: 319846 - DNA, 25 bp, Homo sapien
ggatttcagagaccaccctgaaact

SEQ ID NO: 319847 - DNA, 25 bp, Homo sapien
gagaccaccctgaaactcccagtaa

SEQ ID NO: 319848 - DNA, 25 bp, Homo sapien
aaagacttgggagacatgttaataa

SEQ ID NO: 319849 - DNA, 25 bp, Homo sapien
gttaataaactcaagcatttgatcg

SEQ ID NO: 319850 - DNA, 25 bp, Homo sapien
actgtggcagcatggcatgggtcaa

SEQ ID NO: 319851 - DNA, 25 bp, Homo sapien
caagaagtacttctccttcatcttc

SEQ ID NO: 319852 - DNA, 25 bp, Homo sapien
cttcatcttcctttgatgtcggtaa

SEQ ID NO: 319853 - DNA, 25 bp, Homo sapien
atgtcggtaactcatcctttctgca

SEQ ID NO: 319854 - DNA, 25 bp, Homo sapien
atcctttctgcactgcgggagttgt

SEQ ID NO: 319855 - DNA, 25 bp, Homo sapien
taatgcttttgtgtcctccagttca

SEQ ID NO: 319856 - DNA, 25 bp, Homo sapien
tccagttcacatgctgattgctaag

SEQ ID NO: 319857 - DNA, 25 bp, Homo sapien
atgagtgaacccaaagctgctgaaa

SEQ ID NO: 319858 - DNA, 25 bp, Homo sapien
agctgctgaaacattctgcgtttat

SEQ ID NO: 319859 - DNA, 25 bp, Homo sapien
ttctgcgtttatgcaacttccttgc

SEQ ID NO: 319860 - DNA, 25 bp, Homo sapien
gatggtttcattgtcttgtctagag

SEQ ID NO: 319861 - DNA, 25 bp, Homo sapien
gtctctttctcacactattgaacct

SEQ ID NO: 319862 - DNA, 25 bp, Homo sapien
ctctttctcacactattgaacctgt

SEQ ID NO: 319863 - DNA, 25 bp, Homo sapien
ttctcacactattgaacctgtgatg

SEQ ID NO: 319864 - DNA, 25 bp, Homo sapien
tattgaacctgtgatgaaaacatct

SEQ ID NO: 319865 - DNA, 25 bp, Homo sapien
gaaaacatctgtaactactagccca

SEQ ID NO: 319866 - DNA, 25 bp, Homo sapien
aaacatctgtaactactagcccaca

SEQ ID NO: 319867 - DNA, 25 bp, Homo sapien
atctgtaactactagcccacagagt

SEQ ID NO: 319868 - DNA, 25 bp, Homo sapien
ctgtaactactagcccacagagtga

SEQ ID NO: 319869 - DNA, 25 bp, Homo sapien
taactactagcccacagagtgacat

SEQ ID NO: 319870 - DNA, 25 bp, Homo sapien
ctactagcccacagagtgacatgat

SEQ ID NO: 319871 - DNA, 25 bp, Homo sapien
actagcccacagagtgacatgatga

SEQ ID NO: 319872 - DNA, 25 bp, Homo sapien
aaagcataatgctaatggaaaagaa

SEQ ID NO: 319873 - DNA, 25 bp, Homo sapien
aagcataatgctaatggaaaagaaa

SEQ ID NO: 319874 - DNA, 25 bp, Homo sapien
gaaaatctgatgttctattataata

SEQ ID NO: 319875 - DNA, 25 bp, Homo sapien
taatatgctattgctgaatatgaat

SEQ ID NO: 319876 - DNA, 25 bp, Homo sapien
aatatgctattgctgaatatgaata

SEQ ID NO: 319877 - DNA, 25 bp, Homo sapien
atatgctattgctgaatatgaatag

SEQ ID NO: 319878 - DNA, 25 bp, Homo sapien
atatgaatagaaatacagggcatca

SEQ ID NO: 319879 - DNA, 25 bp, Homo sapien
tatgaatagaaatacagggcatcat

SEQ ID NO: 319880 - DNA, 25 bp, Homo sapien
atgaatagaaatacagggcatcatt

SEQ ID NO: 319881 - DNA, 25 bp, Homo sapien
tgaatagaaatacagggcatcattt

SEQ ID NO: 319882 - DNA, 25 bp, Homo sapien
gaatagaaatacagggcatcatttc

SEQ ID NO: 319883 - DNA, 25 bp, Homo sapien
aaattgccagagtagtgggatttca

SEQ ID NO: 319884 - DNA, 25 bp, Homo sapien
gtgggatttcacattataacctaca

SEQ ID NO: 319885 - DNA, 25 bp, Homo sapien
ggatttcacattataacctacacag

SEQ ID NO: 319886 - DNA, 25 bp, Homo sapien
aacctacacagagtgaatcgtctca

SEQ ID NO: 319887 - DNA, 25 bp, Homo sapien
cagagtgaatcgtctcaagctaaaa

SEQ ID NO: 319888 - DNA, 25 bp, Homo sapien
gaatcgtctcaagctaaaaacacag

SEQ ID NO: 319889 - DNA, 25 bp, Homo sapien
tctatgctttctctttatacattac

SEQ ID NO: 319890 - DNA, 25 bp, Homo sapien
tatacattactcttgcctgtctttt

SEQ ID NO: 319891 - DNA, 25 bp, Homo sapien
gttacaacaattttatacagacttt

SEQ ID NO: 319892 - DNA, 25 bp, Homo sapien
atgcaatgtaagttaaagactctaa

SEQ ID NO: 319893 - DNA, 25 bp, Homo sapien
ggacaaagattttagcaatggcaat

SEQ ID NO: 319894 - DNA, 25 bp, Homo sapien
gtcatttgactattactagtctcat

SEQ ID NO: 319895 - DNA, 25 bp, Homo sapien
attactagtctcattatttgtcaaa

SEQ ID NO: 319896 - DNA, 25 bp, Homo sapien
atttgtcaaataatcatggcgagta

SEQ ID NO: 319897 - DNA, 25 bp, Homo sapien
ggcgagtaatcttataaatgtccag

SEQ ID NO: 319898 - DNA, 25 bp, Homo sapien
ggaaattcttcatatgttaatgttc

SEQ ID NO: 319899 - DNA, 25 bp, Homo sapien
ggcattatagccagaccttgtcaaa

SEQ ID NO: 319900 - DNA, 25 bp, Homo sapien
ttatagccagaccttgtcaaataaa

SEQ ID NO: 319901 - DNA, 25 bp, Homo sapien
gagaggaatcatgctctatattctt

SEQ ID NO: 319902 - DNA, 25 bp, Homo sapien
atcatgctctatattcttttattaa

SEQ ID NO: 319903 - DNA, 25 bp, Homo sapien
tggtcttgaactcgtagcgttaatt

SEQ ID NO: 319904 - DNA, 25 bp, Homo sapien
cttgaactcgtagcgttaattgatc

SEQ ID NO: 319905 - DNA, 25 bp, Homo sapien
tgaggggcactgtcaactagagatt

SEQ ID NO: 319906 - DNA, 25 bp, Homo sapien
actagagattggccccatccaggtg

SEQ ID NO: 319907 - DNA, 25 bp, Homo sapien
catccaggtgggaggaacccctttg

SEQ ID NO: 319908 - DNA, 25 bp, Homo sapien
ggtgagtatccaatctgctgtgcat

SEQ ID NO: 319909 - DNA, 25 bp, Homo sapien
gtatccaatctgctgtgcatttgac

SEQ ID NO: 319910 - DNA, 25 bp, Homo sapien
gtgcatttgacaggatctctgaatg

SEQ ID NO: 319911 - DNA, 25 bp, Homo sapien
atttgacaggatctctgaatggcta

SEQ ID NO: 319912 - DNA, 25 bp, Homo sapien
acaggatctctgaatggctaggtaa

SEQ ID NO: 319913 - DNA, 25 bp, Homo sapien
ggatctctgaatggctaggtaatgg

SEQ ID NO: 319914 - DNA, 25 bp, Homo sapien
gtaatggatcccaagcaggctcaca

SEQ ID NO: 319915 - DNA, 25 bp, Homo sapien
gtacagattattttcctaccactag

SEQ ID NO: 319916 - DNA, 25 bp, Homo sapien
gtctttcaagctggccttatgacag

SEQ ID NO: 319917 - DNA, 25 bp, Homo sapien
ctggccttatgacagcttttcttaa

SEQ ID NO: 319918 - DNA, 25 bp, Homo sapien
gcttttcttaacgtttctgcggaca

SEQ ID NO: 319919 - DNA, 25 bp, Homo sapien
gtttctgcggacattttggcggact

SEQ ID NO: 319920 - DNA, 25 bp, Homo sapien
acattttggcggacttgtgtcggcc

SEQ ID NO: 319921 - DNA, 25 bp, Homo sapien
acttgtgtcggcctagctcagtgat

SEQ ID NO: 319922 - DNA, 25 bp, Homo sapien
ggcctagctcagtgatcagtttcgt

SEQ ID NO: 319923 - DNA, 25 bp, Homo sapien
gaatttgagtatccgaacattaaag

SEQ ID NO: 319924 - DNA, 25 bp, Homo sapien
gcaggaggatttttagccacatcaa

SEQ ID NO: 319925 - DNA, 25 bp, Homo sapien
gccacatcaaataatttacgtctca

SEQ ID NO: 319926 - DNA, 25 bp, Homo sapien
taaaacctgaaggttccatcgcgcc

SEQ ID NO: 319927 - DNA, 25 bp, Homo sapien
aacttactgcgatttgttctcaaaa

SEQ ID NO: 319928 - DNA, 25 bp, Homo sapien
actgcgatttgttctcaaaacttaa

SEQ ID NO: 319929 - DNA, 25 bp, Homo sapien
gcaagcaaatggctgatactaccaa

SEQ ID NO: 319930 - DNA, 25 bp, Homo sapien
ggctgatactaccaagagaactgga

SEQ ID NO: 319931 - DNA, 25 bp, Homo sapien
tggaagatggataccacacaaactt

SEQ ID NO: 319932 - DNA, 25 bp, Homo sapien
taaacctgtaaccacatttaagtga

SEQ ID NO: 319933 - DNA, 25 bp, Homo sapien
tgatctaaaacccatagcattgtag

SEQ ID NO: 319934 - DNA, 25 bp, Homo sapien
agcattgtagtcatggcaacccgct

SEQ ID NO: 319935 - DNA, 25 bp, Homo sapien
tagtcatggcaacccgctaaacttt

SEQ ID NO: 319936 - DNA, 25 bp, Homo sapien
ccgctaaactttctcatgcaactaa

SEQ ID NO: 319937 - DNA, 25 bp, Homo sapien
gtgttttaaatgtcctgtactgcta

SEQ ID NO: 319938 - DNA, 25 bp, Homo sapien
cggtgagttttaaagtataagcatt

SEQ ID NO: 319939 - DNA, 25 bp, Homo sapien
gacagatgtgttttttattgctgca

SEQ ID NO: 319940 - DNA, 25 bp, Homo sapien
agatgtgttttttattgctgcaaaa

SEQ ID NO: 319941 - DNA, 25 bp, Homo sapien
aagcacttagaggagcaatgcctgg

SEQ ID NO: 319942 - DNA, 25 bp, Homo sapien
gcctggcacacagtgaatgttacat

SEQ ID NO: 319943 - DNA, 25 bp, Homo sapien
gaatgttacatattagctgagctgt

SEQ ID NO: 319944 - DNA, 25 bp, Homo sapien
ttagctgagctgttactgttattcc

SEQ ID NO: 319945 - DNA, 25 bp, Homo sapien
gctgagctgttactgttattcctta

SEQ ID NO: 319946 - DNA, 25 bp, Homo sapien
gagctgttactgttattccttaata

SEQ ID NO: 319947 - DNA, 25 bp, Homo sapien
gctgttactgttattccttaataat

SEQ ID NO: 319948 - DNA, 25 bp, Homo sapien
agttctgataattattcagcctgaa

SEQ ID NO: 319949 - DNA, 25 bp, Homo sapien
actgtagtttacaggtaggccttga

SEQ ID NO: 319950 - DNA, 25 bp, Homo sapien
caggtaggccttgaaatatcttttt

SEQ ID NO: 319951 - DNA, 25 bp, Homo sapien
atatcttttttaggatctgttagga

SEQ ID NO: 319952 - DNA, 25 bp, Homo sapien
gatattgtattgtgtgtaacctgca

SEQ ID NO: 319953 - DNA, 25 bp, Homo sapien
ggaaagctgatatacctgtgcaaaa

SEQ ID NO: 319954 - DNA, 25 bp, Homo sapien
tatacctgtgcaaaatctttgcctc

SEQ ID NO: 319955 - DNA, 25 bp, Homo sapien
ctttgcctctgtgctgtcagtgtga

SEQ ID NO: 319956 - DNA, 25 bp, Homo sapien
gtgctgtcagtgtgatgtgctttct

SEQ ID NO: 319957 - DNA, 25 bp, Homo sapien
gtgatgtgctttctgcatggttata

SEQ ID NO: 319958 - DNA, 25 bp, Homo sapien
gcatggttatatactactagtgatt

SEQ ID NO: 319959 - DNA, 25 bp, Homo sapien
gctgcataaatgttagttggcacat

SEQ ID NO: 319960 - DNA, 25 bp, Homo sapien
tctgcaggatgaattcctagaagta

SEQ ID NO: 319961 - DNA, 25 bp, Homo sapien
agtagaattgctctgtcaaagggtt

SEQ ID NO: 319962 - DNA, 25 bp, Homo sapien
gaattgctctgtcaaagggtttgtt

SEQ ID NO: 319963 - DNA, 25 bp, Homo sapien
tgctctgtcaaagggtttgttactc

SEQ ID NO: 319964 - DNA, 25 bp, Homo sapien
gtcaaagggtttgttactcatctga

SEQ ID NO: 319965 - DNA, 25 bp, Homo sapien
caaagggtttgttactcatctgaac

SEQ ID NO: 319966 - DNA, 25 bp, Homo sapien
catctgaaccttaaaaagactggtt

SEQ ID NO: 319967 - DNA, 25 bp, Homo sapien
aaactcagtctcttaaagcgaaaat

SEQ ID NO: 319968 - DNA, 25 bp, Homo sapien
aaaatgggattaggccaggaatggt

SEQ ID NO: 319969 - DNA, 25 bp, Homo sapien
caatgacactgggatgtttctgatc

SEQ ID NO: 319970 - DNA, 25 bp, Homo sapien
aatgacactgggatgtttctgatcc

SEQ ID NO: 319971 - DNA, 25 bp, Homo sapien
tctgtgctctgggatggataccgtc

SEQ ID NO: 319972 - DNA, 25 bp, Homo sapien
gataccgtctgatgtctgtttgtta

SEQ ID NO: 319973 - DNA, 25 bp, Homo sapien
gtttgttattgatggcgcagccact

SEQ ID NO: 319974 - DNA, 25 bp, Homo sapien
tgcaaaactagtcaactcccatcta

SEQ ID NO: 319975 - DNA, 25 bp, Homo sapien
agtcaactcccatctataactgtta

SEQ ID NO: 319976 - DNA, 25 bp, Homo sapien
actgttactttttctagtgctgctt

SEQ ID NO: 319977 - DNA, 25 bp, Homo sapien
tgctttgtgctgagagaacatttta

SEQ ID NO: 319978 - DNA, 25 bp, Homo sapien
tttagtttactgcacttgacctgta

SEQ ID NO: 319979 - DNA, 25 bp, Homo sapien
gcacttgacctgtaaaagactgatt

SEQ ID NO: 319980 - DNA, 25 bp, Homo sapien
gactgattctttgtaattttaggga

SEQ ID NO: 319981 - DNA, 25 bp, Homo sapien
aatttcaatgttgcctttacatcac

SEQ ID NO: 319982 - DNA, 25 bp, Homo sapien
gaggtgcatgtgaccagggtcccaa

SEQ ID NO: 319983 - DNA, 25 bp, Homo sapien
ggccacagcttttcagatcctagga

SEQ ID NO: 319984 - DNA, 25 bp, Homo sapien
cagatcctaggaagcaagtggcatt

SEQ ID NO: 319985 - DNA, 25 bp, Homo sapien
catttgcttgagttgtggcctcgga

SEQ ID NO: 319986 - DNA, 25 bp, Homo sapien
tggcctcggaaggagaatgtttatc

SEQ ID NO: 319987 - DNA, 25 bp, Homo sapien
ggagaatgtttatctgttttctaac

SEQ ID NO: 319988 - DNA, 25 bp, Homo sapien
gttttctaactttgctgacaccagg

SEQ ID NO: 319989 - DNA, 25 bp, Homo sapien
acaccaggattctccctgtcattga

SEQ ID NO: 319990 - DNA, 25 bp, Homo sapien
gcattatctaattaccttcaggtgg

SEQ ID NO: 319991 - DNA, 25 bp, Homo sapien
accttcaggtggtttacttattctg

SEQ ID NO: 319992 - DNA, 25 bp, Homo sapien
aatattttgtacagagccctgtatc

SEQ ID NO: 319993 - DNA, 25 bp, Homo sapien
gacagcacagttagccctggtggct

SEQ ID NO: 319994 - DNA, 25 bp, Homo sapien
ggctcgagcccataatgtaccagtg

SEQ ID NO: 319995 - DNA, 25 bp, Homo sapien
accagtgctggtttgctgtgaaaca

SEQ ID NO: 319996 - DNA, 25 bp, Homo sapien
catacaagttctgtgagcgtgtgca

SEQ ID NO: 319997 - DNA, 25 bp, Homo sapien
ctgatgcctttgtctctaatgagct

SEQ ID NO: 319998 - DNA, 25 bp, Homo sapien
gatgaccctgatgatctgcaatgta

SEQ ID NO: 319999 - DNA, 25 bp, Homo sapien
ggagaacatgttgcgctggctaact

SEQ ID NO: 320000 - DNA, 25 bp, Homo sapien
ttgcgctggctaactggcagaacca

SEQ ID NO: 320001 - DNA, 25 bp, Homo sapien
cctacggttgttgaatctagtctat

SEQ ID NO: 320002 - DNA, 25 bp, Homo sapien
cagagcttgtggatctggtgatcac

SEQ ID NO: 320003 - DNA, 25 bp, Homo sapien
gatcccttgcagttctgtacctgtt

SEQ ID NO: 320004 - DNA, 25 bp, Homo sapien
attgccctaggattgtttcttccat

SEQ ID NO: 320005 - DNA, 25 bp, Homo sapien
gatgaaggttattggctctgagtca

SEQ ID NO: 320006 - DNA, 25 bp, Homo sapien
ggctctgagtcatttttggcattat

SEQ ID NO: 320007 - DNA, 25 bp, Homo sapien
gtcatttttggcattatcgtcacag

SEQ ID NO: 320008 - DNA, 25 bp, Homo sapien
gaattattccagattgctgccgatt

SEQ ID NO: 320009 - DNA, 25 bp, Homo sapien
ttgctgccgatttttgcctaagaaa

SEQ ID NO: 320010 - DNA, 25 bp, Homo sapien
caaactttgtcaaccaattctattg

SEQ ID NO: 320011 - DNA, 25 bp, Homo sapien
aattctattgtacgtctacccacag

SEQ ID NO: 320012 - DNA, 25 bp, Homo sapien
acgtctacccacaggcaactttgaa

SEQ ID NO: 320013 - DNA, 25 bp, Homo sapien
aggcaactttgaatttacttctcta

SEQ ID NO: 320014 - DNA, 25 bp, Homo sapien
ataaacatttcagcgatttaatccc

SEQ ID NO: 320015 - DNA, 25 bp, Homo sapien
ctcccctgcgtcacactgtgtgagg

SEQ ID NO: 320016 - DNA, 25 bp, Homo sapien
cctgcgtcacactgtgtgaggctgt

SEQ ID NO: 320017 - DNA, 25 bp, Homo sapien
tcacactgtgtgaggctgtgtctct

SEQ ID NO: 320018 - DNA, 25 bp, Homo sapien
tgtgtctctgccatccaaaaggggg

SEQ ID NO: 320019 - DNA, 25 bp, Homo sapien
gggccccttgagaatggtgatccac

SEQ ID NO: 320020 - DNA, 25 bp, Homo sapien
tcggaagcccgggagcccagtatgg

SEQ ID NO: 320021 - DNA, 25 bp, Homo sapien
ggaagggtcttacctcagcagttac

SEQ ID NO: 320022 - DNA, 25 bp, Homo sapien
ccagcacaggcctggtgctcaagat

SEQ ID NO: 320023 - DNA, 25 bp, Homo sapien
tggtgctcaagatctgccctcaggg

SEQ ID NO: 320024 - DNA, 25 bp, Homo sapien
cttcctccagtcttggagcattttt

SEQ ID NO: 320025 - DNA, 25 bp, Homo sapien
ccagtcttggagcattttttgcagg

SEQ ID NO: 320026 - DNA, 25 bp, Homo sapien
ggcagcatgtcgcagatcagcacag

SEQ ID NO: 320027 - DNA, 25 bp, Homo sapien
gggccgtggttcagcagtgacccac

SEQ ID NO: 320028 - DNA, 25 bp, Homo sapien
agcagtgacccacagaatggctttg

SEQ ID NO: 320029 - DNA, 25 bp, Homo sapien
atggctttgagcatcagtctacagg

SEQ ID NO: 320030 - DNA, 25 bp, Homo sapien
agtctacaggacaggttggaagcat

SEQ ID NO: 320031 - DNA, 25 bp, Homo sapien
ttggaagcatccactgtgaaccagg

SEQ ID NO: 320032 - DNA, 25 bp, Homo sapien
tgtgaaccaggcattagtcccctac

SEQ ID NO: 320033 - DNA, 25 bp, Homo sapien
tagtcccctacctggcctgtgtgtg

SEQ ID NO: 320034 - DNA, 25 bp, Homo sapien
taaattgggccgagccaactgtcag

SEQ ID NO: 320035 - DNA, 25 bp, Homo sapien
gagccaactgtcagtgcttactgaa

SEQ ID NO: 320036 - DNA, 25 bp, Homo sapien
ccagctctgtaatgggcgtaggtca

SEQ ID NO: 320037 - DNA, 25 bp, Homo sapien
tcaagtcattctgaccactctacat

SEQ ID NO: 320038 - DNA, 25 bp, Homo sapien
actctacatcctgcttcaaagtgtt

SEQ ID NO: 320039 - DNA, 25 bp, Homo sapien
atcctgcttcaaagtgttctgacac

SEQ ID NO: 320040 - DNA, 25 bp, Homo sapien
gacacttagatttggaatggctcta

SEQ ID NO: 320041 - DNA, 25 bp, Homo sapien
aatggctctaatgattctttgtact

SEQ ID NO: 320042 - DNA, 25 bp, Homo sapien
tctttgtacttgaatgtggtctgtc

SEQ ID NO: 320043 - DNA, 25 bp, Homo sapien
atgtggtctgtcaggccatgggtga

SEQ ID NO: 320044 - DNA, 25 bp, Homo sapien
aggaattcccttatgctgttacttg

SEQ ID NO: 320045 - DNA, 25 bp, Homo sapien
attcccttatgctgttacttgaaac

SEQ ID NO: 320046 - DNA, 25 bp, Homo sapien
gctgttacttgaaaccaggatcaac

SEQ ID NO: 320047 - DNA, 25 bp, Homo sapien
caggatcaacatcttaagcaaatgt

SEQ ID NO: 320048 - DNA, 25 bp, Homo sapien
gtcgatgtcctccagggtttccaaa

SEQ ID NO: 320049 - DNA, 25 bp, Homo sapien
tcgatgtcctccagggtttccaaaa

SEQ ID NO: 320050 - DNA, 25 bp, Homo sapien
gtttcctaggtagtaaccataggtg

SEQ ID NO: 320051 - DNA, 25 bp, Homo sapien
gtaaccataggtggcttgtttgtat

SEQ ID NO: 320052 - DNA, 25 bp, Homo sapien
ttcttcccaggaaattttatcatcc

SEQ ID NO: 320053 - DNA, 25 bp, Homo sapien
aaattttatcatccttgtccctatc

SEQ ID NO: 320054 - DNA, 25 bp, Homo sapien
attttatcatccttgtccctatcat

SEQ ID NO: 320055 - DNA, 25 bp, Homo sapien
ttatcatccttgtccctatcataat

SEQ ID NO: 320056 - DNA, 25 bp, Homo sapien
tcatccttgtccctatcataatcct

SEQ ID NO: 320057 - DNA, 25 bp, Homo sapien
ttgtccctatcataatccttccaga

SEQ ID NO: 320058 - DNA, 25 bp, Homo sapien
gtccctatcataatccttccagact

SEQ ID NO: 320059 - DNA, 25 bp, Homo sapien
ggtgataacgtctcagagcatgcct

SEQ ID NO: 320060 - DNA, 25 bp, Homo sapien
gagcatgcctaaaagagcactgcaa

SEQ ID NO: 320061 - DNA, 25 bp, Homo sapien
aaaagagcactgcaagattattttt

SEQ ID NO: 320062 - DNA, 25 bp, Homo sapien
ttattagatctaactcttcatagta

SEQ ID NO: 320063 - DNA, 25 bp, Homo sapien
gttaacgttattggaatgctgctca

SEQ ID NO: 320064 - DNA, 25 bp, Homo sapien
gttattggaatgctgctcagttctc

SEQ ID NO: 320065 - DNA, 25 bp, Homo sapien
ttctctgatcagtgcttatgttatg

SEQ ID NO: 320066 - DNA, 25 bp, Homo sapien
cagtgcttatgttatgattgttgat

SEQ ID NO: 320067 - DNA, 25 bp, Homo sapien
taaccaaagtagatgcctgcagaga

SEQ ID NO: 320068 - DNA, 25 bp, Homo sapien
atgtatgctgcctgtcagctattct

SEQ ID NO: 320069 - DNA, 25 bp, Homo sapien
atgctgcctgtcagctattctcatt

SEQ ID NO: 320070 - DNA, 25 bp, Homo sapien
tccacacccgtgagaaatcctggag

SEQ ID NO: 320071 - DNA, 25 bp, Homo sapien
acacccgtgagaaatcctggagagg

SEQ ID NO: 320072 - DNA, 25 bp, Homo sapien
atcctggagagggtatttttgtaga

SEQ ID NO: 320073 - DNA, 25 bp, Homo sapien
gagggtatttttgtagagtgtagac

SEQ ID NO: 320074 - DNA, 25 bp, Homo sapien
gagtgtagactgtggctagtgacaa

SEQ ID NO: 320075 - DNA, 25 bp, Homo sapien
cacgaccatttgatagggaactggg

SEQ ID NO: 320076 - DNA, 25 bp, Homo sapien
cagcttgctttctacaccaagagtt

SEQ ID NO: 320077 - DNA, 25 bp, Homo sapien
gcttgctttctacaccaagagttta

SEQ ID NO: 320078 - DNA, 25 bp, Homo sapien
ttgctttctacaccaagagtttatg

SEQ ID NO: 320079 - DNA, 25 bp, Homo sapien
gctttctacaccaagagtttatgtt

SEQ ID NO: 320080 - DNA, 25 bp, Homo sapien
gtttaatggctggaaagagaatctt

SEQ ID NO: 320081 - DNA, 25 bp, Homo sapien
gcctgagggcagggctctacctccc

SEQ ID NO: 320082 - DNA, 25 bp, Homo sapien
ctcccctgcgtcacactgtgtgagg

SEQ ID NO: 320083 - DNA, 25 bp, Homo sapien
tcccctgcgtcacactgtgtgaggc

SEQ ID NO: 320084 - DNA, 25 bp, Homo sapien
cccctgcgtcacactgtgtgaggct

SEQ ID NO: 320085 - DNA, 25 bp, Homo sapien
cctgcgtcacactgtgtgaggctgt

SEQ ID NO: 320086 - DNA, 25 bp, Homo sapien
tgtgtctctgccatccaaaaggggg

SEQ ID NO: 320087 - DNA, 25 bp, Homo sapien
gtgtctctgccatccaaaagggggc

SEQ ID NO: 320088 - DNA, 25 bp, Homo sapien
gtctctgccatccaaaagggggccc

SEQ ID NO: 320089 - DNA, 25 bp, Homo sapien
ctgccatccaaaagggggccccttg

SEQ ID NO: 320090 - DNA, 25 bp, Homo sapien
gggccccttgagaatggtgatccac

SEQ ID NO: 320091 - DNA, 25 bp, Homo sapien
ttacaggggcatttagggagcagat

SEQ ID NO: 320092 - DNA, 25 bp, Homo sapien
acccagtccatatagtatgatccca

SEQ ID NO: 320093 - DNA, 25 bp, Homo sapien
catatagtatgatcccacttgtctc

SEQ ID NO: 320094 - DNA, 25 bp, Homo sapien
gaaagttaatttgttgtctctctca

SEQ ID NO: 320095 - DNA, 25 bp, Homo sapien
gttaatttgttgtctctctcaagtg

SEQ ID NO: 320096 - DNA, 25 bp, Homo sapien
gtctctctcaagtgtctaatctaga

SEQ ID NO: 320097 - DNA, 25 bp, Homo sapien
agtgtctaatctagagcagtctcct

SEQ ID NO: 320098 - DNA, 25 bp, Homo sapien
ccttttttatccttgcaattgaatt

SEQ ID NO: 320099 - DNA, 25 bp, Homo sapien
gaattgttggagtcaattgctctta

SEQ ID NO: 320100 - DNA, 25 bp, Homo sapien
gttggagtcaattgctcttaaaaga

SEQ ID NO: 320101 - DNA, 25 bp, Homo sapien
aatgtacagcatttcggagttgtct

SEQ ID NO: 320102 - DNA, 25 bp, Homo sapien
agcatttcggagttgtcttttgctt

SEQ ID NO: 320103 - DNA, 25 bp, Homo sapien
attctgacgaagccagaggtctcag

SEQ ID NO: 320104 - DNA, 25 bp, Homo sapien
gacagtgaagtgtgaggcccaccct

SEQ ID NO: 320105 - DNA, 25 bp, Homo sapien
agtgaagtgtgaggcccaccctaga

SEQ ID NO: 320106 - DNA, 25 bp, Homo sapien
accctagagccaaggtgacgctgaa

SEQ ID NO: 320107 - DNA, 25 bp, Homo sapien
ctagagccaaggtgacgctgaatgg

SEQ ID NO: 320108 - DNA, 25 bp, Homo sapien
ggacaacgggcgcagcttctcctgc

SEQ ID NO: 320109 - DNA, 25 bp, Homo sapien
ctcctgctctgcaaccctggaggtg

SEQ ID NO: 320110 - DNA, 25 bp, Homo sapien
cttatacacaagaaccagacccggg

SEQ ID NO: 320111 - DNA, 25 bp, Homo sapien
tatacacaagaaccagacccgggag

SEQ ID NO: 320112 - DNA, 25 bp, Homo sapien
ccccgactggacgagagggattgtc

SEQ ID NO: 320113 - DNA, 25 bp, Homo sapien
tccgggaaactggacgtggccagaa

SEQ ID NO: 320114 - DNA, 25 bp, Homo sapien
atcttcacctatggaaagcagccat

SEQ ID NO: 320115 - DNA, 25 bp, Homo sapien
ggaaagcagccatggttccaactct

SEQ ID NO: 320116 - DNA, 25 bp, Homo sapien
ggttccaactctcaaacacggaggt

SEQ ID NO: 320117 - DNA, 25 bp, Homo sapien
acacggaggtcattgagtgcattac

SEQ ID NO: 320118 - DNA, 25 bp, Homo sapien
agtgcattacccaaggtcgtgtttt

SEQ ID NO: 320119 - DNA, 25 bp, Homo sapien
tcgtgttttggagcggccccgagtc

SEQ ID NO: 320120 - DNA, 25 bp, Homo sapien
ctggttggagcgaatctgctagtga

SEQ ID NO: 320121 - DNA, 25 bp, Homo sapien
acttcggcatgtccagagatgtcta

SEQ ID NO: 320122 - DNA, 25 bp, Homo sapien
agatgtctacagcacggattattac

SEQ ID NO: 320123 - DNA, 25 bp, Homo sapien
aagcatcatgtaccggaagttcact

SEQ ID NO: 320124 - DNA, 25 bp, Homo sapien
gtaccggaagttcactacagagagt

SEQ ID NO: 320125 - DNA, 25 bp, Homo sapien
ccctggatagtccactgtgtgcaga

SEQ ID NO: 320126 - DNA, 25 bp, Homo sapien
atgggagttgtcatgttgggaacat

SEQ ID NO: 320127 - DNA, 25 bp, Homo sapien
tgttgggaacatgctagacctcagt

SEQ ID NO: 320128 - DNA, 25 bp, Homo sapien
acatgctagacctcagtatccttga

SEQ ID NO: 320129 - DNA, 25 bp, Homo sapien
gtatccttgagggatgctgccttgg

SEQ ID NO: 320130 - DNA, 25 bp, Homo sapien
ggaaaccccaagaggtgcaggcact

SEQ ID NO: 320131 - DNA, 25 bp, Homo sapien
aagaggtgcaggcactgagcctctc

SEQ ID NO: 320132 - DNA, 25 bp, Homo sapien
gggttgatcacagaccaagagtgac

SEQ ID NO: 320133 - DNA, 25 bp, Homo sapien
aagagtgacgagtgatgtcaccctg

SEQ ID NO: 320134 - DNA, 25 bp, Homo sapien
tgtcaccctgtgactcatggccgga

SEQ ID NO: 320135 - DNA, 25 bp, Homo sapien
ttgcccctattgtctcagcacaaca

SEQ ID NO: 320136 - DNA, 25 bp, Homo sapien
gagagtgcccttactgaactagaac

SEQ ID NO: 320137 - DNA, 25 bp, Homo sapien
agaacaactccgcaaatcacgacag

SEQ ID NO: 320138 - DNA, 25 bp, Homo sapien
aaatgcagcttgttgattccatagt

SEQ ID NO: 320139 - DNA, 25 bp, Homo sapien
gattccatagttcgtcagcgtgata

SEQ ID NO: 320140 - DNA, 25 bp, Homo sapien
gtcagcgtgatatgtaccgtatttt

SEQ ID NO: 320141 - DNA, 25 bp, Homo sapien
gttgccattccattacatgcttcaa

SEQ ID NO: 320142 - DNA, 25 bp, Homo sapien
gcttcaagcttagatgatgtttctc

SEQ ID NO: 320143 - DNA, 25 bp, Homo sapien
atgtttctcttgcatcaactccaaa

SEQ ID NO: 320144 - DNA, 25 bp, Homo sapien
gcatcaactccaaaacgtccaagta

SEQ ID NO: 320145 - DNA, 25 bp, Homo sapien
cgtccaagtacatcacagactgttt

SEQ ID NO: 320146 - DNA, 25 bp, Homo sapien
ctgctccagtacctgttattgaatc

SEQ ID NO: 320147 - DNA, 25 bp, Homo sapien
acagggactcaccaagctggacttt

SEQ ID NO: 320148 - DNA, 25 bp, Homo sapien
gggactcaccaagctggactttcat

SEQ ID NO: 320149 - DNA, 25 bp, Homo sapien
ctcaccaagctggactttcatctaa

SEQ ID NO: 320150 - DNA, 25 bp, Homo sapien
agctggactttcatctaaaactaga

SEQ ID NO: 320151 - DNA, 25 bp, Homo sapien
aaactagacacacgtgacgccagcg

SEQ ID NO: 320152 - DNA, 25 bp, Homo sapien
acacgtgacgccagcggaccacaga

SEQ ID NO: 320153 - DNA, 25 bp, Homo sapien
tgggatccagctccaaagccatgcc

SEQ ID NO: 320154 - DNA, 25 bp, Homo sapien
tgggttgtgctgaaggtatgttaaa

SEQ ID NO: 320155 - DNA, 25 bp, Homo sapien
gttaaaattcatacaggacacccaa

SEQ ID NO: 320156 - DNA, 25 bp, Homo sapien
ggacacccaaaacaatcaatcttat

SEQ ID NO: 320157 - DNA, 25 bp, Homo sapien
taaaaaagacttgtggcaagctgaa

SEQ ID NO: 320158 - DNA, 25 bp, Homo sapien
ataagcccaacttctgatgtgccag

SEQ ID NO: 320159 - DNA, 25 bp, Homo sapien
gatgtgccagaaaccgccctgagat

SEQ ID NO: 320160 - DNA, 25 bp, Homo sapien
gagatctgccggtcatctccatgga

SEQ ID NO: 320161 - DNA, 25 bp, Homo sapien
atggacttctgcaccccattccata

SEQ ID NO: 320162 - DNA, 25 bp, Homo sapien
aggcccttgacatggcttacctgcc

SEQ ID NO: 320163 - DNA, 25 bp, Homo sapien
agcaccttgcccaacaggataagct

SEQ ID NO: 320164 - DNA, 25 bp, Homo sapien
acaggataagctggatccccttggc

SEQ ID NO: 320165 - DNA, 25 bp, Homo sapien
ctggatccccttggccttctgaata

SEQ ID NO: 320166 - DNA, 25 bp, Homo sapien
aagaccacttccctgtgggcttcca

SEQ ID NO: 320167 - DNA, 25 bp, Homo sapien
ttccctgtgggcttccaaaatggcc

SEQ ID NO: 320168 - DNA, 25 bp, Homo sapien
tttatcatttctccagtctgtcacc

SEQ ID NO: 320169 - DNA, 25 bp, Homo sapien
gcattagtttggatgtaggcccttg

SEQ ID NO: 320170 - DNA, 25 bp, Homo sapien
tgtaggcccttgttcagtcattttc

SEQ ID NO: 320171 - DNA, 25 bp, Homo sapien
ggccttggaagcaaacatcttctgg

SEQ ID NO: 320172 - DNA, 25 bp, Homo sapien
acatcttctggcatatggcttgtta

SEQ ID NO: 320173 - DNA, 25 bp, Homo sapien
gttgtgtttacactaactgccaaaa

SEQ ID NO: 320174 - DNA, 25 bp, Homo sapien
acactaactgccaaaatgtgcctgt

SEQ ID NO: 320175 - DNA, 25 bp, Homo sapien
atgtgcctgttgtaagtttggttaa

SEQ ID NO: 320176 - DNA, 25 bp, Homo sapien
gtcattactgagttacttgttaccc

SEQ ID NO: 320177 - DNA, 25 bp, Homo sapien
gagttacttgttacccttacagaat

SEQ ID NO: 320178 - DNA, 25 bp, Homo sapien
tcatgtacaggtgcattctagttac

SEQ ID NO: 320179 - DNA, 25 bp, Homo sapien
ggtgcattctagttacatgaacatg

SEQ ID NO: 320180 - DNA, 25 bp, Homo sapien
gtaagctttacctagcacctgagca

SEQ ID NO: 320181 - DNA, 25 bp, Homo sapien
cctcacccttttctagatgtaagac

SEQ ID NO: 320182 - DNA, 25 bp, Homo sapien
gtgactgggacttaaccaaggtctt

SEQ ID NO: 320183 - DNA, 25 bp, Homo sapien
aggtcttggtaaagcctgcatggca

SEQ ID NO: 320184 - DNA, 25 bp, Homo sapien
gcctgcatggcaccgtaagaagctg

SEQ ID NO: 320185 - DNA, 25 bp, Homo sapien
atactgtttgttcccgcaatcactg

SEQ ID NO: 320186 - DNA, 25 bp, Homo sapien
tttgttcccgcaatcactgatttga

SEQ ID NO: 320187 - DNA, 25 bp, Homo sapien
gaaaagttcccaacacaggcagctg

SEQ ID NO: 320188 - DNA, 25 bp, Homo sapien
aggcagctgctgtgtatatgggatt

SEQ ID NO: 320189 - DNA, 25 bp, Homo sapien
gtatatgggattagagccactacat

SEQ ID NO: 320190 - DNA, 25 bp, Homo sapien
gagccactacatagaatagtctctt

SEQ ID NO: 320191 - DNA, 25 bp, Homo sapien
aaaagatctgtttggatttgggaca

SEQ ID NO: 320192 - DNA, 25 bp, Homo sapien
taatttatcacctaggtacttagta

SEQ ID NO: 320193 - DNA, 25 bp, Homo sapien
gtttttcttcaaagctttgttgaca

SEQ ID NO: 320194 - DNA, 25 bp, Homo sapien
gacaatgtaggatattgccaactaa

SEQ ID NO: 320195 - DNA, 25 bp, Homo sapien
gatattgccaactaatcctttgact

SEQ ID NO: 320196 - DNA, 25 bp, Homo sapien
aatcctttgacttgagtgcttagcc

SEQ ID NO: 320197 - DNA, 25 bp, Homo sapien
ttgacttgagtgcttagccatgccc

SEQ ID NO: 320198 - DNA, 25 bp, Homo sapien
cttgagtgcttagccatgccccaat

SEQ ID NO: 320199 - DNA, 25 bp, Homo sapien
atgccccaatccaggcagcatgaag

SEQ ID NO: 320200 - DNA, 25 bp, Homo sapien
gggacacctagtggcagttgacctt

SEQ ID NO: 320201 - DNA, 25 bp, Homo sapien
ggcagttgacctttgaggatctatc

SEQ ID NO: 320202 - DNA, 25 bp, Homo sapien
gaaaaagatcagtgccccctttgga

SEQ ID NO: 320203 - DNA, 25 bp, Homo sapien
agctgctgagcaaccattctgtgtg

SEQ ID NO: 320204 - DNA, 25 bp, Homo sapien
ttgtgattggaaaaagctttacctc

SEQ ID NO: 320205 - DNA, 25 bp, Homo sapien
aaaagctttacctccagacatgtca

SEQ ID NO: 320206 - DNA, 25 bp, Homo sapien
gacatgtcaccactcacagatactt

SEQ ID NO: 320207 - DNA, 25 bp, Homo sapien
acagatacttttgtgccacttcata

SEQ ID NO: 320208 - DNA, 25 bp, Homo sapien
gtgccacttcataaggagtttgccc

SEQ ID NO: 320209 - DNA, 25 bp, Homo sapien
aaaccatcatgctagatttacagag

SEQ ID NO: 320210 - DNA, 25 bp, Homo sapien
gagaagtttctgcatatctgctact

SEQ ID NO: 320211 - DNA, 25 bp, Homo sapien
gtttctgcatatctgctacttgttg

SEQ ID NO: 320212 - DNA, 25 bp, Homo sapien
gctacttgttgcattttgggttcaa

SEQ ID NO: 320213 - DNA, 25 bp, Homo sapien
tgaggataaaagtacgatagcgata

SEQ ID NO: 320214 - DNA, 25 bp, Homo sapien
gtacgatagcgatatctaccacgaa

SEQ ID NO: 320215 - DNA, 25 bp, Homo sapien
gatagcgatatctaccacgaagctg

SEQ ID NO: 320216 - DNA, 25 bp, Homo sapien
gcgatatctaccacgaagctgttgt

SEQ ID NO: 320217 - DNA, 25 bp, Homo sapien
gatatctaccacgaagctgttgttc

SEQ ID NO: 320218 - DNA, 25 bp, Homo sapien
tatctaccacgaagctgttgttccc

SEQ ID NO: 320219 - DNA, 25 bp, Homo sapien
tctaccacgaagctgttgttcccca

SEQ ID NO: 320220 - DNA, 25 bp, Homo sapien
atgggatgtggttattgctgtgttt

SEQ ID NO: 320221 - DNA, 25 bp, Homo sapien
tgggatgtggttattgctgtgtttt

SEQ ID NO: 320222 - DNA, 25 bp, Homo sapien
gaatcaacggtttctgggtctgaga

SEQ ID NO: 320223 - DNA, 25 bp, Homo sapien
tcaacggtttctgggtctgagatgt

SEQ ID NO: 320224 - DNA, 25 bp, Homo sapien
aatttctagcaggtccacctcaaag

SEQ ID NO: 320225 - DNA, 25 bp, Homo sapien
gcaggtccacctcaaagtccttggt

SEQ ID NO: 320226 - DNA, 25 bp, Homo sapien
aaagtccttggtgggcagacgcacg

SEQ ID NO: 320227 - DNA, 25 bp, Homo sapien
atgtggccttccagcggtggcttcc

SEQ ID NO: 320228 - DNA, 25 bp, Homo sapien
gacaacacgcgcaggaacgtgctct

SEQ ID NO: 320229 - DNA, 25 bp, Homo sapien
aggaacgtgctcttgcctgcgccat

SEQ ID NO: 320230 - DNA, 25 bp, Homo sapien
agccgcagtcggtcagccgagtcca

SEQ ID NO: 320231 - DNA, 25 bp, Homo sapien
gtcggtcagccgagtccaccacaaa

SEQ ID NO: 320232 - DNA, 25 bp, Homo sapien
gctcacaaactccttccagtagaag

SEQ ID NO: 320233 - DNA, 25 bp, Homo sapien
aactccttccagtagaagcgcaggt

SEQ ID NO: 320234 - DNA, 25 bp, Homo sapien
tccttccagtagaagcgcaggttct

SEQ ID NO: 320235 - DNA, 25 bp, Homo sapien
aatgcactactgtgtgctgagcgct

SEQ ID NO: 320236 - DNA, 25 bp, Homo sapien
tactgtgtgctgagcgcttttctga

SEQ ID NO: 320237 - DNA, 25 bp, Homo sapien
gcttttctgatcctgcatctggtca

SEQ ID NO: 320238 - DNA, 25 bp, Homo sapien
gatcctgcatctggtcacggtcgcg

SEQ ID NO: 320239 - DNA, 25 bp, Homo sapien
tgtctacctgcagcacactcgatat

SEQ ID NO: 320240 - DNA, 25 bp, Homo sapien
gcagcacactcgatatggaccagtt

SEQ ID NO: 320241 - DNA, 25 bp, Homo sapien
atatggaccagttcatgcgcaagag

SEQ ID NO: 320242 - DNA, 25 bp, Homo sapien
ggaccagttcatgcgcaagaggatc

SEQ ID NO: 320243 - DNA, 25 bp, Homo sapien
catgcgcaagaggatcgaggcgatc

SEQ ID NO: 320244 - DNA, 25 bp, Homo sapien
gatccgcgggcagatcctgagcaag

SEQ ID NO: 320245 - DNA, 25 bp, Homo sapien
agaagactatcctgagcccgaggaa

SEQ ID NO: 320246 - DNA, 25 bp, Homo sapien
ttcgtaggatgatgtgcagcctgtc

SEQ ID NO: 320247 - DNA, 25 bp, Homo sapien
caggcattcagtttgtgggcatttc

SEQ ID NO: 320248 - DNA, 25 bp, Homo sapien
gtgggcatttcctgtcatttcggat

SEQ ID NO: 320249 - DNA, 25 bp, Homo sapien
atttcctgtcatttcggatcctgct

SEQ ID NO: 320250 - DNA, 25 bp, Homo sapien
gggcatctactggagcacctcagaa

SEQ ID NO: 320251 - DNA, 25 bp, Homo sapien
aacactggctcatgttttctttcca

SEQ ID NO: 320252 - DNA, 25 bp, Homo sapien
atgttttctttccatgtgagggagg

SEQ ID NO: 320253 - DNA, 25 bp, Homo sapien
gatactaaaagcctgttgccactgt

SEQ ID NO: 320254 - DNA, 25 bp, Homo sapien
aagcctgttgccactgttgtgtcat

SEQ ID NO: 320255 - DNA, 25 bp, Homo sapien
gttgtgtcatgatttccattcttca

SEQ ID NO: 320256 - DNA, 25 bp, Homo sapien
atggaaagccacaagcctcagaagg

SEQ ID NO: 320257 - DNA, 25 bp, Homo sapien
tgatgacatccaaggtaggtttcca

SEQ ID NO: 320258 - DNA, 25 bp, Homo sapien
gatgacatccaaggtaggtttccac

SEQ ID NO: 320259 - DNA, 25 bp, Homo sapien
tgacatccaaggtaggtttccaccc

SEQ ID NO: 320260 - DNA, 25 bp, Homo sapien
caccccacctgatgaagctacaggg

SEQ ID NO: 320261 - DNA, 25 bp, Homo sapien
gggactaacttatattctcaacctc

SEQ ID NO: 320262 - DNA, 25 bp, Homo sapien
ggactaacttatattctcaacctca

SEQ ID NO: 320263 - DNA, 25 bp, Homo sapien
ctaacttatattctcaacctcactg

SEQ ID NO: 320264 - DNA, 25 bp, Homo sapien
aacttatattctcaacctcactggg

SEQ ID NO: 320265 - DNA, 25 bp, Homo sapien
acttatattctcaacctcactggga

SEQ ID NO: 320266 - DNA, 25 bp, Homo sapien
cttatattctcaacctcactgggat

SEQ ID NO: 320267 - DNA, 25 bp, Homo sapien
ttatattctcaacctcactgggatg

SEQ ID NO: 320268 - DNA, 25 bp, Homo sapien
gcgtgtatttttaggaatgcgctat

SEQ ID NO: 320269 - DNA, 25 bp, Homo sapien
gaatgcgctatttccagtaagggaa

SEQ ID NO: 320270 - DNA, 25 bp, Homo sapien
tccagtaagggaagtattgacattt

SEQ ID NO: 320271 - DNA, 25 bp, Homo sapien
ttttaaggaactgtgctgcattaaa

SEQ ID NO: 320272 - DNA, 25 bp, Homo sapien
gtgctgcattaaaatccacagttgc

SEQ ID NO: 320273 - DNA, 25 bp, Homo sapien
aaaatccacagttgcatgaaacttt

SEQ ID NO: 320274 - DNA, 25 bp, Homo sapien
aatttgtgaactactcagaggactc

SEQ ID NO: 320275 - DNA, 25 bp, Homo sapien
actactcagaggactcaatgcccta

SEQ ID NO: 320276 - DNA, 25 bp, Homo sapien
agaggactcaatgccctaacatgta

SEQ ID NO: 320277 - DNA, 25 bp, Homo sapien
ttgatcattgcgatgtttaggccag

SEQ ID NO: 320278 - DNA, 25 bp, Homo sapien
atttcctggtacttaaatattgtgt

SEQ ID NO: 320279 - DNA, 25 bp, Homo sapien
tcctggaagaagtccctgcctccag

SEQ ID NO: 320280 - DNA, 25 bp, Homo sapien
agccaccagacccttttggagaagg

SEQ ID NO: 320281 - DNA, 25 bp, Homo sapien
tagcctagtctgataacctaatgcc

SEQ ID NO: 320282 - DNA, 25 bp, Homo sapien
agtctgataacctaatgcccacttg

SEQ ID NO: 320283 - DNA, 25 bp, Homo sapien
tgataacctaatgcccacttgggag

SEQ ID NO: 320284 - DNA, 25 bp, Homo sapien
ctaatgcccacttgggagagggata

SEQ ID NO: 320285 - DNA, 25 bp, Homo sapien
gatagaatgacttgagggcagccag

SEQ ID NO: 320286 - DNA, 25 bp, Homo sapien
agggcagccagtgcttaagccttct

SEQ ID NO: 320287 - DNA, 25 bp, Homo sapien
taagccttctcccttatgcaaacag

SEQ ID NO: 320288 - DNA, 25 bp, Homo sapien
atgcaaacagccactttgtccatgg

SEQ ID NO: 320289 - DNA, 25 bp, Homo sapien
ttgtccatgggctgttagcctcaaa

SEQ ID NO: 320290 - DNA, 25 bp, Homo sapien
gtgcatattagcagatccatactgg

SEQ ID NO: 320291 - DNA, 25 bp, Homo sapien
ggaggtttcatatacaccacttaca

SEQ ID NO: 320292 - DNA, 25 bp, Homo sapien
ctgaaatattagacttgttctgaaa

SEQ ID NO: 320293 - DNA, 25 bp, Homo sapien
tctgaaataagcttacctaggatga

SEQ ID NO: 320294 - DNA, 25 bp, Homo sapien
agcttacctaggatgataccacttt

SEQ ID NO: 320295 - DNA, 25 bp, Homo sapien
cctaggatgataccactttcactta

SEQ ID NO: 320296 - DNA, 25 bp, Homo sapien
atttcccaactatttaacagtggca

SEQ ID NO: 320297 - DNA, 25 bp, Homo sapien
gttaaaatacacagcagtcacttca

SEQ ID NO: 320298 - DNA, 25 bp, Homo sapien
agtcacttcatattactgcctccct

SEQ ID NO: 320299 - DNA, 25 bp, Homo sapien
tcaacccactcaacttctgaagaac

SEQ ID NO: 320300 - DNA, 25 bp, Homo sapien
acttctgaagaacagggctttttca

SEQ ID NO: 320301 - DNA, 25 bp, Homo sapien
gtctcacccttaggaagcccaaatg

SEQ ID NO: 320302 - DNA, 25 bp, Homo sapien
gcccaaatgctcactccttgagttt

SEQ ID NO: 320303 - DNA, 25 bp, Homo sapien
ccaaatgctcactccttgagtttct

SEQ ID NO: 320304 - DNA, 25 bp, Homo sapien
gctcactccttgagtttctaatgca

SEQ ID NO: 320305 - DNA, 25 bp, Homo sapien
cactccttgagtttctaatgcattc

SEQ ID NO: 320306 - DNA, 25 bp, Homo sapien
ctccttgagtttctaatgcattctt

SEQ ID NO: 320307 - DNA, 25 bp, Homo sapien
ttgagtttctaatgcattctttctg

SEQ ID NO: 320308 - DNA, 25 bp, Homo sapien
gagtttctaatgcattctttctgat

SEQ ID NO: 320309 - DNA, 25 bp, Homo sapien
gtttctaatgcattctttctgatgt

SEQ ID NO: 320310 - DNA, 25 bp, Homo sapien
taatgcattctttctgatgtacagg

SEQ ID NO: 320311 - DNA, 25 bp, Homo sapien
gcattctttctgatgtacaggaaga

SEQ ID NO: 320312 - DNA, 25 bp, Homo sapien
gatataattattaacaccacttcag

SEQ ID NO: 320313 - DNA, 25 bp, Homo sapien
aattattaacaccacttcagtgtga

SEQ ID NO: 320314 - DNA, 25 bp, Homo sapien
tattaacaccacttcagtgtgatta

SEQ ID NO: 320315 - DNA, 25 bp, Homo sapien
aacaccacttcagtgtgattattat

SEQ ID NO: 320316 - DNA, 25 bp, Homo sapien
accacttcagtgtgattattatgat

SEQ ID NO: 320317 - DNA, 25 bp, Homo sapien
cacttcagtgtgattattatgatta

SEQ ID NO: 320318 - DNA, 25 bp, Homo sapien
tatttttataccaacacatcttcaa

SEQ ID NO: 320319 - DNA, 25 bp, Homo sapien
ttttataccaacacatcttcaatta

SEQ ID NO: 320320 - DNA, 25 bp, Homo sapien
taccaacacatcttcaattattaat

SEQ ID NO: 320321 - DNA, 25 bp, Homo sapien
tattaatattcccagttgctagaga

SEQ ID NO: 320322 - DNA, 25 bp, Homo sapien
taatattcccagttgctagagaaaa

SEQ ID NO: 320323 - DNA, 25 bp, Homo sapien
tgtgcatattagcagatccatactg

SEQ ID NO: 320324 - DNA, 25 bp, Homo sapien
gtgcatattagcagatccatactgg

SEQ ID NO: 320325 - DNA, 25 bp, Homo sapien
gcatattagcagatccatactggaa

SEQ ID NO: 320326 - DNA, 25 bp, Homo sapien
catactggaaaatgcatggaggttt

SEQ ID NO: 320327 - DNA, 25 bp, Homo sapien
tgcatggaggtttcatatacaccac

SEQ ID NO: 320328 - DNA, 25 bp, Homo sapien
gcatggaggtttcatatacaccact

SEQ ID NO: 320329 - DNA, 25 bp, Homo sapien
catggaggtttcatatacaccactt

SEQ ID NO: 320330 - DNA, 25 bp, Homo sapien
atggaggtttcatatacaccactta

SEQ ID NO: 320331 - DNA, 25 bp, Homo sapien
tggaggtttcatatacaccacttac

SEQ ID NO: 320332 - DNA, 25 bp, Homo sapien
ggaggtttcatatacaccacttaca

SEQ ID NO: 320333 - DNA, 25 bp, Homo sapien
gaggtttcatatacaccacttacag

SEQ ID NO: 320334 - DNA, 25 bp, Homo sapien
tgcccacccccgaagccgttcagat

SEQ ID NO: 320335 - DNA, 25 bp, Homo sapien
cgagggtccttgtacagaaatggag

SEQ ID NO: 320336 - DNA, 25 bp, Homo sapien
gagggtccttgtacagaaatggagg

SEQ ID NO: 320337 - DNA, 25 bp, Homo sapien
agggtccttgtacagaaatggaggg

SEQ ID NO: 320338 - DNA, 25 bp, Homo sapien
ggtccttgtacagaaatggagggca

SEQ ID NO: 320339 - DNA, 25 bp, Homo sapien
gtccttgtacagaaatggagggcaa

SEQ ID NO: 320340 - DNA, 25 bp, Homo sapien
tccttgtacagaaatggagggcaaa

SEQ ID NO: 320341 - DNA, 25 bp, Homo sapien
ccttgtacagaaatggagggcaaag

SEQ ID NO: 320342 - DNA, 25 bp, Homo sapien
cttgtacagaaatggagggcaaaga

SEQ ID NO: 320343 - DNA, 25 bp, Homo sapien
ttgtacagaaatggagggcaaagag

SEQ ID NO: 320344 - DNA, 25 bp, Homo sapien
tgtacagaaatggagggcaaagagg

SEQ ID NO: 320345 - DNA, 25 bp, Homo sapien
aattgattctttgaaccttgatgag

SEQ ID NO: 320346 - DNA, 25 bp, Homo sapien
aaccttgatgagttctgcaactgct

SEQ ID NO: 320347 - DNA, 25 bp, Homo sapien
gagttctgcaactgctcagagcaca

SEQ ID NO: 320348 - DNA, 25 bp, Homo sapien
attccctctacgattgctgtggtgg

SEQ ID NO: 320349 - DNA, 25 bp, Homo sapien
ccaacttgacgctgggatacaggat

SEQ ID NO: 320350 - DNA, 25 bp, Homo sapien
ggagcaactggctcaggcgtctcca

SEQ ID NO: 320351 - DNA, 25 bp, Homo sapien
gcgtctccacggcagtggcaaatct

SEQ ID NO: 320352 - DNA, 25 bp, Homo sapien
ggatacaggatatttgacacttgca

SEQ ID NO: 320353 - DNA, 25 bp, Homo sapien
atttgacacttgcaacaccgtttct

SEQ ID NO: 320354 - DNA, 25 bp, Homo sapien
gcaacaccgtttctaaggccttgga

SEQ ID NO: 320355 - DNA, 25 bp, Homo sapien
accctgagttttgttgctcaaaaca

SEQ ID NO: 320356 - DNA, 25 bp, Homo sapien
cagagagatcatcacggcacggttt

SEQ ID NO: 320357 - DNA, 25 bp, Homo sapien
gagagatcatcacggcacggtttcc

SEQ ID NO: 320358 - DNA, 25 bp, Homo sapien
agatcatcacggcacggtttccaga

SEQ ID NO: 320359 - DNA, 25 bp, Homo sapien
catcacggcacggtttccagatgta

SEQ ID NO: 320360 - DNA, 25 bp, Homo sapien
gatgtaatactgcaaggaaaaatga

SEQ ID NO: 320361 - DNA, 25 bp, Homo sapien
aaaatgatgacgtgtctcctcactc

SEQ ID NO: 320362 - DNA, 25 bp, Homo sapien
tgatgacgtgtctcctcactctaga

SEQ ID NO: 320363 - DNA, 25 bp, Homo sapien
tgacgtgtctcctcactctagaggg

SEQ ID NO: 320364 - DNA, 25 bp, Homo sapien
ggttggtcccatgggttaagagctc

SEQ ID NO: 320365 - DNA, 25 bp, Homo sapien
tggtcccatgggttaagagctcacc

SEQ ID NO: 320366 - DNA, 25 bp, Homo sapien
gtcccatgggttaagagctcacccc

SEQ ID NO: 320367 - DNA, 25 bp, Homo sapien
aactactagttttgaaagcctcact

SEQ ID NO: 320368 - DNA, 25 bp, Homo sapien
gaaagcctcacttctgccaatggaa

SEQ ID NO: 320369 - DNA, 25 bp, Homo sapien
agcctcacttctgccaatggaagca

SEQ ID NO: 320370 - DNA, 25 bp, Homo sapien
tcacttctgccaatggaagcacatt

SEQ ID NO: 320371 - DNA, 25 bp, Homo sapien
ggaagcacattccagcatgtcgcca

SEQ ID NO: 320372 - DNA, 25 bp, Homo sapien
attccagcatgtcgccaacgcaatc

SEQ ID NO: 320373 - DNA, 25 bp, Homo sapien
gcatgtcgccaacgcaatccacttt

SEQ ID NO: 320374 - DNA, 25 bp, Homo sapien
tccactttccaccactttcacaaaa

SEQ ID NO: 320375 - DNA, 25 bp, Homo sapien
ctttcacaaaaaacgttactgcaca

SEQ ID NO: 320376 - DNA, 25 bp, Homo sapien
gttactgcacaattatactatccta

SEQ ID NO: 320377 - DNA, 25 bp, Homo sapien
gcacaattatactatcctaccctta

SEQ ID NO: 320378 - DNA, 25 bp, Homo sapien
gagagcttccagaatcctcgcagac

SEQ ID NO: 320379 - DNA, 25 bp, Homo sapien
cagaatcctcgcagacagcccagag

SEQ ID NO: 320380 - DNA, 25 bp, Homo sapien
agatggggttctcatcagttcttcc

SEQ ID NO: 320381 - DNA, 25 bp, Homo sapien
agttcttcctcccacaatgtaggac

SEQ ID NO: 320382 - DNA, 25 bp, Homo sapien
tcccacaatgtaggacctttccttt

SEQ ID NO: 320383 - DNA, 25 bp, Homo sapien
tcctttaccttccaatggataaaat

SEQ ID NO: 320384 - DNA, 25 bp, Homo sapien
agttcagagttcatagtcatattca

SEQ ID NO: 320385 - DNA, 25 bp, Homo sapien
agtcatattcatagacacagaatca

SEQ ID NO: 320386 - DNA, 25 bp, Homo sapien
acacagaatcaagcttttaacatat

SEQ ID NO: 320387 - DNA, 25 bp, Homo sapien
ttttaacatatacatccacctctat

SEQ ID NO: 320388 - DNA, 25 bp, Homo sapien
atacatccacctctatatgttaaat

SEQ ID NO: 320389 - DNA, 25 bp, Homo sapien
aacagtttagagttcttatgggcat

SEQ ID NO: 320390 - DNA, 25 bp, Homo sapien
ttatgggcatgattgtcctgacgct

SEQ ID NO: 320391 - DNA, 25 bp, Homo sapien
atgattgtcctgacgcttcctgtta

SEQ ID NO: 320392 - DNA, 25 bp, Homo sapien
gcttcctgttatcctcatatcaaaa

SEQ ID NO: 320393 - DNA, 25 bp, Homo sapien
aaaaactgcatcacaaccgtctttg

SEQ ID NO: 320394 - DNA, 25 bp, Homo sapien
accgtctttgatttccaagatgcca

SEQ ID NO: 320395 - DNA, 25 bp, Homo sapien
aactctcctcacaggaactcatgca

SEQ ID NO: 320396 - DNA, 25 bp, Homo sapien
acaggaactcatgcacaacttctgg

SEQ ID NO: 320397 - DNA, 25 bp, Homo sapien
caacttctgggaatctagtggctgt

SEQ ID NO: 320398 - DNA, 25 bp, Homo sapien
gtctaggagaaattttgcccatcaa

SEQ ID NO: 320399 - DNA, 25 bp, Homo sapien
agttcaattgccagtttcactaaga

SEQ ID NO: 320400 - DNA, 25 bp, Homo sapien
atcatgctcgttttcattcttgcac

SEQ ID NO: 320401 - DNA, 25 bp, Homo sapien
gttttcattcttgcacaggctttag

SEQ ID NO: 320402 - DNA, 25 bp, Homo sapien
ggctttagatttacacatcgttgcg

SEQ ID NO: 320403 - DNA, 25 bp, Homo sapien
gaaaaggcaactttgctcttcaaac

SEQ ID NO: 320404 - DNA, 25 bp, Homo sapien
tgctcttcaaacttacccagggctt

SEQ ID NO: 320405 - DNA, 25 bp, Homo sapien
agggctttccgagacagttctgtga

SEQ ID NO: 320406 - DNA, 25 bp, Homo sapien
tgtgaatttcaagtccttccccatt

SEQ ID NO: 320407 - DNA, 25 bp, Homo sapien
gtccttccccattgacaacatgtta

SEQ ID NO: 320408 - DNA, 25 bp, Homo sapien
catgttactgtagactttcttgtta

SEQ ID NO: 320409 - DNA, 25 bp, Homo sapien
tgaacccaagatactgtcagcctaa

SEQ ID NO: 320410 - DNA, 25 bp, Homo sapien
aacttagccagcaaccttttgtact

SEQ ID NO: 320411 - DNA, 25 bp, Homo sapien
atgggcctgctgcttctctttaaac

SEQ ID NO: 320412 - DNA, 25 bp, Homo sapien
ctgctgcttctctttaaacacgtga

SEQ ID NO: 320413 - DNA, 25 bp, Homo sapien
taaacacgtgaaatacgttccttat

SEQ ID NO: 320414 - DNA, 25 bp, Homo sapien
agtaagactgtgttgccagcagcaa

SEQ ID NO: 320415 - DNA, 25 bp, Homo sapien
agcaacacccggacagcaagtggct

SEQ ID NO: 320416 - DNA, 25 bp, Homo sapien
cggacagcaagtggctcttcctgct

SEQ ID NO: 320417 - DNA, 25 bp, Homo sapien
gacccacacaggtgtccagggctca

SEQ ID NO: 320418 - DNA, 25 bp, Homo sapien
ggtgtccagggctcacgcagagttt

SEQ ID NO: 320419 - DNA, 25 bp, Homo sapien
gctcacgcagagtttgccactgtgt

SEQ ID NO: 320420 - DNA, 25 bp, Homo sapien
tttgccactgtgttttacacaatcg

SEQ ID NO: 320421 - DNA, 25 bp, Homo sapien
gtgttttacacaatcgatggaatat

SEQ ID NO: 320422 - DNA, 25 bp, Homo sapien
ttcaattatttgttagggctcttcc

SEQ ID NO: 320423 - DNA, 25 bp, Homo sapien
tttccaaatgtgctgaattgtctat

SEQ ID NO: 320424 - DNA, 25 bp, Homo sapien
gtctattgatgggattttcagatct

SEQ ID NO: 320425 - DNA, 25 bp, Homo sapien
ttcagatcttttcatgagaactgga

SEQ ID NO: 320426 - DNA, 25 bp, Homo sapien
aatgtagctgggtggcacctaccta

SEQ ID NO: 320427 - DNA, 25 bp, Homo sapien
gcacctacctaggttgctacgtagt

SEQ ID NO: 320428 - DNA, 25 bp, Homo sapien
gtgagtagactttctcttgggtata

SEQ ID NO: 320429 - DNA, 25 bp, Homo sapien
ttgggtatagtaagcctcagacagc

SEQ ID NO: 320430 - DNA, 25 bp, Homo sapien
ctttcacttttatctactttacttg

SEQ ID NO: 320431 - DNA, 25 bp, Homo sapien
aattcctacctctaaaagctgcctt

SEQ ID NO: 320432 - DNA, 25 bp, Homo sapien
ctaaaagctgccttgagaactcaga

SEQ ID NO: 320433 - DNA, 25 bp, Homo sapien
ccaattaagaatcactggtataagt

SEQ ID NO: 320434 - DNA, 25 bp, Homo sapien
gtataagtgtacctttgtgctctcc

SEQ ID NO: 320435 - DNA, 25 bp, Homo sapien
taagtgtacctttgtgctctccaaa

SEQ ID NO: 320436 - DNA, 25 bp, Homo sapien
aacctcaatcccctcaaattttgat

SEQ ID NO: 320437 - DNA, 25 bp, Homo sapien
gatggtcaacttatcaagaggtgat

SEQ ID NO: 320438 - DNA, 25 bp, Homo sapien
cttatcaagaggtgatcagagccaa

SEQ ID NO: 320439 - DNA, 25 bp, Homo sapien
ggaaatatctccaggcagtccatct

SEQ ID NO: 320440 - DNA, 25 bp, Homo sapien
ctccaggcagtccatctgcttcaga

SEQ ID NO: 320441 - DNA, 25 bp, Homo sapien
gttatgccgatcaaaattgtctcca

SEQ ID NO: 320442 - DNA, 25 bp, Homo sapien
aattgtctccagatactgtcagatg

SEQ ID NO: 320443 - DNA, 25 bp, Homo sapien
agatactgtcagatgtctgtgggag

SEQ ID NO: 320444 - DNA, 25 bp, Homo sapien
cccctccgggaaactgtggcgtgat

SEQ ID NO: 320445 - DNA, 25 bp, Homo sapien
ccctccgggaaactgtggcgtgatg

SEQ ID NO: 320446 - DNA, 25 bp, Homo sapien
cctccgggaaactgtggcgtgatgg

SEQ ID NO: 320447 - DNA, 25 bp, Homo sapien
tccgggaaactgtggcgtgatggcc

SEQ ID NO: 320448 - DNA, 25 bp, Homo sapien
ggaaactgtggcgtgatggccgcgg

SEQ ID NO: 320449 - DNA, 25 bp, Homo sapien
gaaactgtggcgtgatggccgcggg

SEQ ID NO: 320450 - DNA, 25 bp, Homo sapien
ggacctgacctgccgtctagaaaaa

SEQ ID NO: 320451 - DNA, 25 bp, Homo sapien
gacctgacctgccgtctagaaaaac

SEQ ID NO: 320452 - DNA, 25 bp, Homo sapien
cctgacctgccgtctagaaaaacct

SEQ ID NO: 320453 - DNA, 25 bp, Homo sapien
ctgacctgccgtctagaaaaacctg

SEQ ID NO: 320454 - DNA, 25 bp, Homo sapien
tgacctgccgtctagaaaaacctgc

SEQ ID NO: 320455 - DNA, 25 bp, Homo sapien
gaatgctctactacttcaagtcttt

SEQ ID NO: 320456 - DNA, 25 bp, Homo sapien
atgctctactacttcaagtctttaa

SEQ ID NO: 320457 - DNA, 25 bp, Homo sapien
aataatatgaccctttgtcttctaa

SEQ ID NO: 320458 - DNA, 25 bp, Homo sapien
ggtgaagaaatcttgtgggtattct

SEQ ID NO: 320459 - DNA, 25 bp, Homo sapien
gaaatcttgtgggtattctggaaat

SEQ ID NO: 320460 - DNA, 25 bp, Homo sapien
atcttgtgggtattctggaaatttg

SEQ ID NO: 320461 - DNA, 25 bp, Homo sapien
ctggaaatttgatacggagagaact

SEQ ID NO: 320462 - DNA, 25 bp, Homo sapien
tgatacggagagaacttggtgagct

SEQ ID NO: 320463 - DNA, 25 bp, Homo sapien
atccctcttttccagaaaattctgt

SEQ ID NO: 320464 - DNA, 25 bp, Homo sapien
gtttctgtaggactttgttctccac

SEQ ID NO: 320465 - DNA, 25 bp, Homo sapien
ttctgtaggactttgttctccacaa

SEQ ID NO: 320466 - DNA, 25 bp, Homo sapien
aactcctccggagtagctgtcaggt

SEQ ID NO: 320467 - DNA, 25 bp, Homo sapien
tcctccggagtagctgtcaggtcac

SEQ ID NO: 320468 - DNA, 25 bp, Homo sapien
gtagctgtcaggtcaccattgaggt

SEQ ID NO: 320469 - DNA, 25 bp, Homo sapien
gtcaggtcaccattgaggtctgcag

SEQ ID NO: 320470 - DNA, 25 bp, Homo sapien
aggtctgcagctttgaatcttctct

SEQ ID NO: 320471 - DNA, 25 bp, Homo sapien
tgcagctttgaatcttctctcatca

SEQ ID NO: 320472 - DNA, 25 bp, Homo sapien
agctttgaatcttctctcatcacgt

SEQ ID NO: 320473 - DNA, 25 bp, Homo sapien
ttgaatcttctctcatcacgtggca

SEQ ID NO: 320474 - DNA, 25 bp, Homo sapien
atcttctctcatcacgtggcagcat

SEQ ID NO: 320475 - DNA, 25 bp, Homo sapien
ctcatcacgtggcagcatcttttta

SEQ ID NO: 320476 - DNA, 25 bp, Homo sapien
catcacgtggcagcatctttttaaa

SEQ ID NO: 320477 - DNA, 25 bp, Homo sapien
gaaggcgtccagcgtctccagagcc

SEQ ID NO: 320478 - DNA, 25 bp, Homo sapien
agagcctctacaagtgcctccatca

SEQ ID NO: 320479 - DNA, 25 bp, Homo sapien
tgcctccatcaaaccagcttttggg

SEQ ID NO: 320480 - DNA, 25 bp, Homo sapien
agaatctgttaagcccattcagcta

SEQ ID NO: 320481 - DNA, 25 bp, Homo sapien
gttaagcccattcagctaagcggca

SEQ ID NO: 320482 - DNA, 25 bp, Homo sapien
agcccattcagctaagcggcacggg

SEQ ID NO: 320483 - DNA, 25 bp, Homo sapien
gggtcacagggctttgagtagcctt

SEQ ID NO: 320484 - DNA, 25 bp, Homo sapien
gctttgagtagccttcctcggtgac

SEQ ID NO: 320485 - DNA, 25 bp, Homo sapien
tagccttcctcggtgacgctgagta

SEQ ID NO: 320486 - DNA, 25 bp, Homo sapien
ctcggtgacgctgagtagggaactc

SEQ ID NO: 320487 - DNA, 25 bp, Homo sapien
gtaaagcctgcagtaatgtggcaca

SEQ ID NO: 320488 - DNA, 25 bp, Homo sapien
taggtctttgacaatcttggctccc

SEQ ID NO: 320489 - DNA, 25 bp, Homo sapien
gaagtgccaatctgctattatcatg

SEQ ID NO: 320490 - DNA, 25 bp, Homo sapien
ggccagtcttggcattctcatcaaa

SEQ ID NO: 320491 - DNA, 25 bp, Homo sapien
gagagctatttcacatccacttggc

SEQ ID NO: 320492 - DNA, 25 bp, Homo sapien
acatccacttggcatttgtttccta

SEQ ID NO: 320493 - DNA, 25 bp, Homo sapien
ttcctaccgccatgttgttgagcac

SEQ ID NO: 320494 - DNA, 25 bp, Homo sapien
gaaggtaaaagccattccaccacca

SEQ ID NO: 320495 - DNA, 25 bp, Homo sapien
ttccaccaccaataatcatctcatt

SEQ ID NO: 320496 - DNA, 25 bp, Homo sapien
ttattgatgagctggatcttgtctg

SEQ ID NO: 320497 - DNA, 25 bp, Homo sapien
caaggtaatcttcacaccattcttc

SEQ ID NO: 320498 - DNA, 25 bp, Homo sapien
attcttctcagctttggacattagg

SEQ ID NO: 320499 - DNA, 25 bp, Homo sapien
gtctgtaggcttatgatggtaacca

SEQ ID NO: 320500 - DNA, 25 bp, Homo sapien
aatggcattgtgaaaagtttttagt

SEQ ID NO: 320501 - DNA, 25 bp, Homo sapien
gaaaagtttttagttgcgctttatg

SEQ ID NO: 320502 - DNA, 25 bp, Homo sapien
ttttagttgcgctttatgggtggat

SEQ ID NO: 320503 - DNA, 25 bp, Homo sapien
tagttgcgctttatgggtggatgct

SEQ ID NO: 320504 - DNA, 25 bp, Homo sapien
tgcgctttatgggtggatgctgaat

SEQ ID NO: 320505 - DNA, 25 bp, Homo sapien
ggtggatgctgaattacattttgat

SEQ ID NO: 320506 - DNA, 25 bp, Homo sapien
tgaattacattttgatttgatactt

SEQ ID NO: 320507 - DNA, 25 bp, Homo sapien
aagtttgtgatcatattgtctacca

SEQ ID NO: 320508 - DNA, 25 bp, Homo sapien
gtgatcatattgtctaccatgtagc

SEQ ID NO: 320509 - DNA, 25 bp, Homo sapien
tgatcatattgtctaccatgtagcc

SEQ ID NO: 320510 - DNA, 25 bp, Homo sapien
ctgtggcggcgacggcaggccccga

SEQ ID NO: 320511 - DNA, 25 bp, Homo sapien
tggcggcgacggcaggccccgagga

SEQ ID NO: 320512 - DNA, 25 bp, Homo sapien
gcggcgacggcaggccccgaggagg

SEQ ID NO: 320513 - DNA, 25 bp, Homo sapien
aggccgcgctgccgccggagcagag

SEQ ID NO: 320514 - DNA, 25 bp, Homo sapien
tgccgccggagcagagccgggtcca

SEQ ID NO: 320515 - DNA, 25 bp, Homo sapien
cggagcagagccgggtccagcccat

SEQ ID NO: 320516 - DNA, 25 bp, Homo sapien
gcccatgaccgcctccaactggacg

SEQ ID NO: 320517 - DNA, 25 bp, Homo sapien
caactggacgctggtgatggagggc

SEQ ID NO: 320518 - DNA, 25 bp, Homo sapien
actggacgctggtgatggagggcga

SEQ ID NO: 320519 - DNA, 25 bp, Homo sapien
gatggagggcgagtggatgctgaaa

SEQ ID NO: 320520 - DNA, 25 bp, Homo sapien
tggagggcgagtggatgctgaaatt

SEQ ID NO: 320521 - DNA, 25 bp, Homo sapien
ggaactgaacactgctaatatgatg

SEQ ID NO: 320522 - DNA, 25 bp, Homo sapien
aatatgcctgactaaagccactaca

SEQ ID NO: 320523 - DNA, 25 bp, Homo sapien
gactaaagccactacagaaatccag

SEQ ID NO: 320524 - DNA, 25 bp, Homo sapien
agaaatccagagattggctgttaaa

SEQ ID NO: 320525 - DNA, 25 bp, Homo sapien
aattctctttgatactgcagaggca

SEQ ID NO: 320526 - DNA, 25 bp, Homo sapien
agtggccatggatctgttcctctgt

SEQ ID NO: 320527 - DNA, 25 bp, Homo sapien
gttcctctgtgctaaatgtcttgtg

SEQ ID NO: 320528 - DNA, 25 bp, Homo sapien
ctaaatgtcttgtggcagggtgtgt

SEQ ID NO: 320529 - DNA, 25 bp, Homo sapien
gttcactggtactcttgagtggcct

SEQ ID NO: 320530 - DNA, 25 bp, Homo sapien
gagtggcctgaagtgacccattcta

SEQ ID NO: 320531 - DNA, 25 bp, Homo sapien
gaagtgacccattctatgaattgtt

SEQ ID NO: 320532 - DNA, 25 bp, Homo sapien
gaggattttggcatgcgtggcctgt

SEQ ID NO: 320533 - DNA, 25 bp, Homo sapien
tggcctgtcgccacctggacagcgt

SEQ ID NO: 320534 - DNA, 25 bp, Homo sapien
ggttgtccactttacctttatggtg

SEQ ID NO: 320535 - DNA, 25 bp, Homo sapien
gtccactttacctttatggtgaggc

SEQ ID NO: 320536 - DNA, 25 bp, Homo sapien
acctttatggtgaggcctgtcggat

SEQ ID NO: 320537 - DNA, 25 bp, Homo sapien
gaggcctgtcggatggctaagtcct

SEQ ID NO: 320538 - DNA, 25 bp, Homo sapien
gatggctaagtccttgaaaccctag

SEQ ID NO: 320539 - DNA, 25 bp, Homo sapien
aagtccttgaaaccctagagctgtg

SEQ ID NO: 320540 - DNA, 25 bp, Homo sapien
cttgaaaccctagagctgtgacgta

SEQ ID NO: 320541 - DNA, 25 bp, Homo sapien
aaaccctagagctgtgacgtagaat

SEQ ID NO: 320542 - DNA, 25 bp, Homo sapien
gacgtagaatatgtgctgtctgtga

SEQ ID NO: 320543 - DNA, 25 bp, Homo sapien
gaagatcttattcaatctatgcata

SEQ ID NO: 320544 - DNA, 25 bp, Homo sapien
tattgatgctactttatatacggaa

SEQ ID NO: 320545 - DNA, 25 bp, Homo sapien
atacggaaagtgatgttcaccccag

SEQ ID NO: 320546 - DNA, 25 bp, Homo sapien
gatgttcaccccagttgcaaagtaa

SEQ ID NO: 320547 - DNA, 25 bp, Homo sapien
cagcaatgaagtgctttctcttgga

SEQ ID NO: 320548 - DNA, 25 bp, Homo sapien
gttatttcacttgagtccggagatg

SEQ ID NO: 320549 - DNA, 25 bp, Homo sapien
gtccggagatgcaagtattcatgat

SEQ ID NO: 320550 - DNA, 25 bp, Homo sapien
gtagaaaatctgatcatcctagcaa

SEQ ID NO: 320551 - DNA, 25 bp, Homo sapien
tgatcatcctagcaaacaacagttt

SEQ ID NO: 320552 - DNA, 25 bp, Homo sapien
acaacagtttgtcttctaatgggaa

SEQ ID NO: 320553 - DNA, 25 bp, Homo sapien
agaatttttgcagagttttgtacat

SEQ ID NO: 320554 - DNA, 25 bp, Homo sapien
agcggctccagagatactctctaag

SEQ ID NO: 320555 - DNA, 25 bp, Homo sapien
gatactctctaagtggtggaggaac

SEQ ID NO: 320556 - DNA, 25 bp, Homo sapien
ggtggaggaacttcatcccactgaa

SEQ ID NO: 320557 - DNA, 25 bp, Homo sapien
tcccactgaaattcctttggcattt

SEQ ID NO: 320558 - DNA, 25 bp, Homo sapien
aaaagtcaacgagagccttcgctga

SEQ ID NO: 320559 - DNA, 25 bp, Homo sapien
tcaacgagagccttcgctgactcca

SEQ ID NO: 320560 - DNA, 25 bp, Homo sapien
ttcgctgactccaccgaagaggtgc

SEQ ID NO: 320561 - DNA, 25 bp, Homo sapien
aagaggtgcgccactgggagccacc

SEQ ID NO: 320562 - DNA, 25 bp, Homo sapien
gggagggtcagctccttccagcgat

SEQ ID NO: 320563 - DNA, 25 bp, Homo sapien
gctccttccagcgatcattttattt

SEQ ID NO: 320564 - DNA, 25 bp, Homo sapien
ccttccagcgatcattttattttat

SEQ ID NO: 320565 - DNA, 25 bp, Homo sapien
actcccaacagaaatgtctttctgg

SEQ ID NO: 320566 - DNA, 25 bp, Homo sapien
gtctttctggaagaatgccttgcat

SEQ ID NO: 320567 - DNA, 25 bp, Homo sapien
gaagaatgccttgcatctagcacaa

SEQ ID NO: 320568 - DNA, 25 bp, Homo sapien
gccttgcatctagcacaaaactgat

SEQ ID NO: 320569 - DNA, 25 bp, Homo sapien
caaaactgattattgcccctctgtc

SEQ ID NO: 320570 - DNA, 25 bp, Homo sapien
aaagaccactcctaatcacctctgg

SEQ ID NO: 320571 - DNA, 25 bp, Homo sapien
taatcacctctggcctcaggcggga

SEQ ID NO: 320572 - DNA, 25 bp, Homo sapien
tgccctccctgcaaatgggaacatc

SEQ ID NO: 320573 - DNA, 25 bp, Homo sapien
aacatcaaggttcccagtgcttaac

SEQ ID NO: 320574 - DNA, 25 bp, Homo sapien
gttcccagtgcttaactgagggaca

SEQ ID NO: 320575 - DNA, 25 bp, Homo sapien
gagggacaagtgacaatttagcaga

SEQ ID NO: 320576 - DNA, 25 bp, Homo sapien
gttgcagacaagatccagctcatca

SEQ ID NO: 320577 - DNA, 25 bp, Homo sapien
agattggcacttctctgtttgatga

SEQ ID NO: 320578 - DNA, 25 bp, Homo sapien
ttggcacttctctgtttgatgaaga

SEQ ID NO: 320579 - DNA, 25 bp, Homo sapien
gggagccaagattgtcaaagaccta

SEQ ID NO: 320580 - DNA, 25 bp, Homo sapien
gacaagatccagctcatcaataata

SEQ ID NO: 320581 - DNA, 25 bp, Homo sapien
agacctaatgtccaaagctgagaag

SEQ ID NO: 320582 - DNA, 25 bp, Homo sapien
ggtgtgaagattaccttgcctgttg

SEQ ID NO: 320583 - DNA, 25 bp, Homo sapien
gaagattaccttgcctgttgacttt

SEQ ID NO: 320584 - DNA, 25 bp, Homo sapien
attaccttgcctgttgactttgtca

SEQ ID NO: 320585 - DNA, 25 bp, Homo sapien
accttgcctgttgactttgtcactg

SEQ ID NO: 320586 - DNA, 25 bp, Homo sapien
gctcatcaataatatgctggacaaa

SEQ ID NO: 320587 - DNA, 25 bp, Homo sapien
tctaaactgttttaggttatagtct

SEQ ID NO: 320588 - DNA, 25 bp, Homo sapien
taaggttaaaagcatgcacttccat

SEQ ID NO: 320589 - DNA, 25 bp, Homo sapien
gttaaaagcatgcacttccatgcat

SEQ ID NO: 320590 - DNA, 25 bp, Homo sapien
acttccatgcatacttgcttttggg

SEQ ID NO: 320591 - DNA, 25 bp, Homo sapien
gggagaagacattctaataatcagt

SEQ ID NO: 320592 - DNA, 25 bp, Homo sapien
agacattctaataatcagtttgtga

SEQ ID NO: 320593 - DNA, 25 bp, Homo sapien
agtttgtgaaatagcttctgttgga

SEQ ID NO: 320594 - DNA, 25 bp, Homo sapien
gcttctgttggaaaccttttgaggg

SEQ ID NO: 320595 - DNA, 25 bp, Homo sapien
gggaataaggaatggtcatctaaaa

SEQ ID NO: 320596 - DNA, 25 bp, Homo sapien
ccaagctgttgatatctttctaaac

SEQ ID NO: 320597 - DNA, 25 bp, Homo sapien
gctgttgatatctttctaaactgtt

SEQ ID NO: 320598 - DNA, 25 bp, Homo sapien
atgcttcatgacctgtgttttgatc

SEQ ID NO: 320599 - DNA, 25 bp, Homo sapien
gcttcatgacctgtgttttgatcct

SEQ ID NO: 320600 - DNA, 25 bp, Homo sapien
ttcatgacctgtgttttgatcctgg

SEQ ID NO: 320601 - DNA, 25 bp, Homo sapien
catgacctgtgttttgatcctggtt

SEQ ID NO: 320602 - DNA, 25 bp, Homo sapien
gacctgtgttttgatcctggttgga

SEQ ID NO: 320603 - DNA, 25 bp, Homo sapien
ctgtgttttgatcctggttggagta
